United States Patent 7,709,616 (MICRORNAS AND USES THEREOF) - sequence listing, part 8

SEQ ID NO: 204470 - RNA, 64 nt, hsa; identical to SEQ ID NO: 41810

SEQ ID NO: 204471 - RNA, 64 nt, hsa; identical to SEQ ID NO: 41811

SEQ ID NO: 204472 - RNA, 64 nt, hsa; identical to SEQ ID NO: 41812

SEQ ID NO: 204473 - RNA, 64 nt, hsa; identical to SEQ ID NO: 41813

SEQ ID NO: 204474 - RNA, 64 nt, hsa; identical to SEQ ID NO: 41814

SEQ ID NO: 204475 - RNA, 64 nt, hsa; identical to SEQ ID NO: 41815

SEQ ID NO: 204476 - RNA, 64 nt, hsa; identical to SEQ ID NO: 41816

SEQ ID NO: 204477 - RNA, 64 nt, hsa; identical to SEQ ID NO: 41817

SEQ ID NO: 204478 - RNA, 64 nt, hsa; identical to SEQ ID NO: 41818

SEQ ID NO: 204479 - RNA, 64 nt, hsa; identical to SEQ ID NO: 41819

SEQ ID NO: 204480 - RNA, 64 nt, hsa; identical to SEQ ID NO: 41820

SEQ ID NO: 204481 - RNA, 64 nt, hsa; identical to SEQ ID NO: 41821

SEQ ID NO: 204482 - RNA, 64 nt, hsa; identical to SEQ ID NO: 41822

SEQ ID NO: 204483 - RNA, 64 nt, hsa; identical to SEQ ID NO: 41823

SEQ ID NO: 204484 - RNA, 64 nt, hsa; identical to SEQ ID NO: 41824

SEQ ID NO: 204485 - RNA, 64 nt, hsa; identical to SEQ ID NO: 41825

SEQ ID NO: 204486 - RNA, 64 nt, hsa; identical to SEQ ID NO: 41826

SEQ ID NO: 204487 - RNA, 64 nt, hsa; identical to SEQ ID NO: 41827

SEQ ID NO: 204488 - RNA, 64 nt, hsa; identical to SEQ ID NO: 41828

SEQ ID NO: 204489 - RNA, 64 nt, hsa; identical to SEQ ID NO: 41829

SEQ ID NO: 204490 - RNA, 64 nt, hsa; identical to SEQ ID NO: 41830

SEQ ID NO: 204491 - RNA, 64 nt, hsa; identical to SEQ ID NO: 41831

SEQ ID NO: 204492 - RNA, 64 nt, hsa; identical to SEQ ID NO: 41832

SEQ ID NO: 204493 - RNA, 64 nt, hsa; identical to SEQ ID NO: 41833

SEQ ID NO: 204494 - RNA, 64 nt, hsa; identical to SEQ ID NO: 41834

SEQ ID NO: 204495 - RNA, 64 nt, hsa; identical to SEQ ID NO: 41835

SEQ ID NO: 204496 - RNA, 64 nt, hsa; identical to SEQ ID NO: 41836

SEQ ID NO: 204497 - RNA, 64 nt, hsa; identical to SEQ ID NO: 41837

SEQ ID NO: 204498 - RNA, 64 nt, hsa; identical to SEQ ID NO: 41838

SEQ ID NO: 204499 - RNA, 64 nt, hsa; identical to SEQ ID NO: 41839

SEQ ID NO: 204500 - RNA, 64 nt, hsa; identical to SEQ ID NO: 41840

SEQ ID NO: 204501 - RNA, 64 nt, hsa; identical to SEQ ID NO: 41841

SEQ ID NO: 204502 - RNA, 64 nt, hsa; identical to SEQ ID NO: 41842

SEQ ID NO: 204503 - RNA, 64 nt, hsa; identical to SEQ ID NO: 41843

SEQ ID NO: 204504 - RNA, 64 nt, hsa; identical to SEQ ID NO: 41844

SEQ ID NO: 204505 - RNA, 64 nt, hsa; identical to SEQ ID NO: 41845

SEQ ID NO: 204506 - RNA, 64 nt, hsa; identical to SEQ ID NO: 41846

SEQ ID NO: 204507 - RNA, 64 nt, hsa; identical to SEQ ID NO: 41847

SEQ ID NO: 204508 - RNA, 64 nt, hsa; identical to SEQ ID NO: 41848

SEQ ID NO: 204509 - RNA, 64 nt, hsa; identical to SEQ ID NO: 41849

SEQ ID NO: 204510 - RNA, 64 nt, hsa; identical to SEQ ID NO: 41850

SEQ ID NO: 204511 - RNA, 64 nt, hsa; identical to SEQ ID NO: 41851

SEQ ID NO: 204512 - RNA, 64 nt, hsa; identical to SEQ ID NO: 41852

SEQ ID NO: 204513 - RNA, 64 nt, hsa; identical to SEQ ID NO: 41853

SEQ ID NO: 204514 - RNA, 64 nt, hsa; identical to SEQ ID NO: 41854

SEQ ID NO: 204515 - RNA, 64 nt, hsa; identical to SEQ ID NO: 41855

SEQ ID NO: 204516 - RNA, 64 nt, hsa; identical to SEQ ID NO: 41856

SEQ ID NO: 204517 - RNA, 64 nt, hsa; identical to SEQ ID NO: 41857

SEQ ID NO: 204518 - RNA, 64 nt, hsa; identical to SEQ ID NO: 41858

SEQ ID NO: 204519 - RNA, 64 nt, hsa; identical to SEQ ID NO: 41859

SEQ ID NO: 204520 - RNA, 64 nt, hsa; identical to SEQ ID NO: 41860

SEQ ID NO: 204521 - RNA, 64 nt, hsa; identical to SEQ ID NO: 41861

SEQ ID NO: 204522 - RNA, 64 nt, hsa; identical to SEQ ID NO: 41862

SEQ ID NO: 204523 - RNA, 64 nt, hsa; identical to SEQ ID NO: 41863

SEQ ID NO: 204524 - RNA, 64 nt, hsa; identical to SEQ ID NO: 41864

SEQ ID NO: 204525 - RNA, 64 nt, hsa; identical to SEQ ID NO: 41865

SEQ ID NO: 204526 - RNA, 64 nt, hsa; identical to SEQ ID NO: 41866

SEQ ID NO: 204527 - RNA, 64 nt, hsa; identical to SEQ ID NO: 41867

SEQ ID NO: 204528 - RNA, 64 nt, hsa; identical to SEQ ID NO: 41868

SEQ ID NO: 204529 - RNA, 64 nt, hsa; identical to SEQ ID NO: 41869

SEQ ID NO: 204530 - RNA, 64 nt, hsa; identical to SEQ ID NO: 41870

SEQ ID NO: 204531 - RNA, 64 nt, hsa; identical to SEQ ID NO: 41871

SEQ ID NO: 204532 - RNA, 64 nt, hsa; identical to SEQ ID NO: 41872

SEQ ID NO: 204533 - RNA, 64 nt, hsa; identical to SEQ ID NO: 41873

SEQ ID NO: 204534 - RNA, 64 nt, hsa; identical to SEQ ID NO: 41874

SEQ ID NO: 204535 - RNA, 64 nt, hsa; identical to SEQ ID NO: 41875

SEQ ID NO: 204536 - RNA, 64 nt, hsa; identical to SEQ ID NO: 41876

SEQ ID NO: 204537 - RNA, 64 nt, hsa; identical to SEQ ID NO: 41877

SEQ ID NO: 204538 - RNA, 64 nt, hsa; identical to SEQ ID NO: 41878

SEQ ID NO: 204539 - RNA, 64 nt, hsa; identical to SEQ ID NO: 41879

SEQ ID NO: 204540 - RNA, 64 nt, hsa; identical to SEQ ID NO: 41880

SEQ ID NO: 204541 - RNA, 64 nt, hsa; identical to SEQ ID NO: 41881

SEQ ID NO: 204542 - RNA, 64 nt, hsa; identical to SEQ ID NO: 41882

SEQ ID NO: 204543 - RNA, 64 nt, hsa; identical to SEQ ID NO: 41883

SEQ ID NO: 204544 - RNA, 64 nt, hsa; identical to SEQ ID NO: 41884

SEQ ID NO: 204545 - RNA, 64 nt, hsa; identical to SEQ ID NO: 41885

SEQ ID NO: 204546 - RNA, 64 nt, hsa; identical to SEQ ID NO: 41886

SEQ ID NO: 204547 - RNA, 64 nt, hsa; identical to SEQ ID NO: 41887

SEQ ID NO: 204548 - RNA, 64 nt, hsa; identical to SEQ ID NO: 41888

SEQ ID NO: 204549 - RNA, 64 nt, hsa; identical to SEQ ID NO: 41889

SEQ ID NO: 204550 - RNA, 64 nt, hsa; identical to SEQ ID NO: 41890

SEQ ID NO: 204551 - RNA, 64 nt, hsa; identical to SEQ ID NO: 41891

SEQ ID NO: 204552 - RNA, 64 nt, hsa; identical to SEQ ID NO: 41892

SEQ ID NO: 204553 - RNA, 64 nt, hsa; identical to SEQ ID NO: 41893

SEQ ID NO: 204554 - RNA, 64 nt, hsa; identical to SEQ ID NO: 41894

SEQ ID NO: 204555 - RNA, 64 nt, hsa; identical to SEQ ID NO: 41895

SEQ ID NO: 204556 - RNA, 64 nt, hsa; identical to SEQ ID NO: 41896

SEQ ID NO: 204557 - RNA, 64 nt, hsa; identical to SEQ ID NO: 41897

SEQ ID NO: 204558 - RNA, 64 nt, hsa; identical to SEQ ID NO: 41898

SEQ ID NO: 204559 - RNA, 64 nt, hsa; identical to SEQ ID NO: 41899

SEQ ID NO: 204560 - RNA, 64 nt, hsa; identical to SEQ ID NO: 41900

SEQ ID NO: 204561 - RNA, 64 nt, hsa; identical to SEQ ID NO: 41901

SEQ ID NO: 204562 - RNA, 64 nt, hsa; identical to SEQ ID NO: 41902

SEQ ID NO: 204563 - RNA, 64 nt, hsa; identical to SEQ ID NO: 41903

SEQ ID NO: 204564 - RNA, 64 nt, hsa; identical to SEQ ID NO: 41904

SEQ ID NO: 204565 - RNA, 64 nt, hsa; identical to SEQ ID NO: 41905

SEQ ID NO: 204566 - RNA, 64 nt, hsa; identical to SEQ ID NO: 41906

SEQ ID NO: 204567 - RNA, 64 nt, hsa; identical to SEQ ID NO: 41907

SEQ ID NO: 204568 - RNA, 64 nt, hsa; identical to SEQ ID NO: 41908

SEQ ID NO: 204569 - RNA, 64 nt, hsa; identical to SEQ ID NO: 41909

SEQ ID NO: 204570 - RNA, 64 nt, hsa; identical to SEQ ID NO: 41910

SEQ ID NO: 204571 - RNA, 64 nt, hsa; identical to SEQ ID NO: 41911

SEQ ID NO: 204572 - RNA, 64 nt, hsa; identical to SEQ ID NO: 41912

SEQ ID NO: 204573 - RNA, 64 nt, hsa; identical to SEQ ID NO: 41913

SEQ ID NO: 204574 - RNA, 64 nt, hsa; identical to SEQ ID NO: 41914

SEQ ID NO: 204575 - RNA, 64 nt, hsa; identical to SEQ ID NO: 41915

SEQ ID NO: 204576 - RNA, 64 nt, hsa; identical to SEQ ID NO: 41916

SEQ ID NO: 204577 - RNA, 64 nt, hsa; identical to SEQ ID NO: 41917

SEQ ID NO: 204578 - RNA, 64 nt, hsa; identical to SEQ ID NO: 41918

SEQ ID NO: 204579 - RNA, 64 nt, hsa; identical to SEQ ID NO: 41919

SEQ ID NO: 204580 - RNA, 64 nt, hsa; identical to SEQ ID NO: 41920

SEQ ID NO: 204581 - RNA, 64 nt, hsa; identical to SEQ ID NO: 41921

SEQ ID NO: 204582 - RNA, 64 nt, hsa; identical to SEQ ID NO: 41922

SEQ ID NO: 204583 - RNA, 64 nt, hsa; identical to SEQ ID NO: 41923

SEQ ID NO: 204584 - RNA, 64 nt, hsa; identical to SEQ ID NO: 41924

SEQ ID NO: 204585 - RNA, 64 nt, hsa; identical to SEQ ID NO: 41925

SEQ ID NO: 204586 - RNA, 64 nt, hsa; identical to SEQ ID NO: 41926

SEQ ID NO: 204587 - RNA, 64 nt, hsa; identical to SEQ ID NO: 41927

SEQ ID NO: 204588 - RNA, 64 nt, hsa; identical to SEQ ID NO: 41928

SEQ ID NO: 204589 - RNA, 64 nt, hsa; identical to SEQ ID NO: 41929

SEQ ID NO: 204590 - RNA, 64 nt, hsa; identical to SEQ ID NO: 41930

SEQ ID NO: 204591 - RNA, 64 nt, hsa; identical to SEQ ID NO: 41931

SEQ ID NO: 204592 - RNA, 64 nt, hsa; identical to SEQ ID NO: 41932

SEQ ID NO: 204593 - RNA, 64 nt, hsa; identical to SEQ ID NO: 41933

SEQ ID NO: 204594 - RNA, 64 nt, hsa; identical to SEQ ID NO: 41934

SEQ ID NO: 204595 - RNA, 64 nt, hsa; identical to SEQ ID NO: 41935

SEQ ID NO: 204596 - RNA, 64 nt, hsa; identical to SEQ ID NO: 41936

SEQ ID NO: 204597 - RNA, 64 nt, hsa; identical to SEQ ID NO: 41937

SEQ ID NO: 204598 - RNA, 64 nt, hsa; identical to SEQ ID NO: 41938

SEQ ID NO: 204599 - RNA, 64 nt, hsa; identical to SEQ ID NO: 41939

SEQ ID NO: 204600 - RNA, 64 nt, hsa; identical to SEQ ID NO: 41940

SEQ ID NO: 204601 - RNA, 64 nt, hsa; identical to SEQ ID NO: 41941

SEQ ID NO: 204602 - RNA, 64 nt, hsa; identical to SEQ ID NO: 41942

SEQ ID NO: 204603 - RNA, 64 nt, hsa; identical to SEQ ID NO: 41943

SEQ ID NO: 204604 - RNA, 64 nt, hsa; identical to SEQ ID NO: 41944

SEQ ID NO: 204605 - RNA, 64 nt, hsa; identical to SEQ ID NO: 41945

SEQ ID NO: 204606 - RNA, 64 nt, hsa; identical to SEQ ID NO: 41946

SEQ ID NO: 204607 - RNA, 64 nt, hsa; identical to SEQ ID NO: 41947

SEQ ID NO: 204608 - RNA, 64 nt, hsa; identical to SEQ ID NO: 41948

SEQ ID NO: 204609 - RNA, 64 nt, hsa; identical to SEQ ID NO: 41949

SEQ ID NO: 204610 - RNA, 64 nt, hsa; identical to SEQ ID NO: 41950

SEQ ID NO: 204611 - RNA, 64 nt, hsa; identical to SEQ ID NO: 41951

SEQ ID NO: 204612 - RNA, 64 nt, hsa; identical to SEQ ID NO: 41952

SEQ ID NO: 204613 - RNA, 64 nt, hsa; identical to SEQ ID NO: 41953

SEQ ID NO: 204614 - RNA, 64 nt, hsa; identical to SEQ ID NO: 41954

SEQ ID NO: 204615 - RNA, 64 nt, hsa; identical to SEQ ID NO: 41955

SEQ ID NO: 204616 - RNA, 64 nt, hsa; identical to SEQ ID NO: 41956

SEQ ID NO: 204617 - RNA, 64 nt, hsa; identical to SEQ ID NO: 41957

SEQ ID NO: 204618 - RNA, 64 nt, hsa; identical to SEQ ID NO: 41958

SEQ ID NO: 204619 - RNA, 64 nt, hsa; identical to SEQ ID NO: 41959

SEQ ID NO: 204620 - RNA, 64 nt, hsa; identical to SEQ ID NO: 41960

SEQ ID NO: 204621 - RNA, 64 nt, hsa; identical to SEQ ID NO: 41961

SEQ ID NO: 204622 - RNA, 64 nt, hsa; identical to SEQ ID NO: 41962

SEQ ID NO: 204623 - RNA, 64 nt, hsa; identical to SEQ ID NO: 41963

SEQ ID NO: 204624 - RNA, 64 nt, hsa; identical to SEQ ID NO: 41964

SEQ ID NO: 204625 - RNA, 64 nt, hsa; identical to SEQ ID NO: 41965

SEQ ID NO: 204626 - RNA, 64 nt, hsa; identical to SEQ ID NO: 41966

SEQ ID NO: 204627 - RNA, 64 nt, hsa; identical to SEQ ID NO: 41967

SEQ ID NO: 204628 - RNA, 64 nt, hsa; identical to SEQ ID NO: 41968

SEQ ID NO: 204629 - RNA, 64 nt, hsa; identical to SEQ ID NO: 41969

SEQ ID NO: 204630 - RNA, 64 nt, hsa; identical to SEQ ID NO: 41970

SEQ ID NO: 204631 - RNA, 64 nt, hsa; identical to SEQ ID NO: 41971

SEQ ID NO: 204632 - RNA, 64 nt, hsa; identical to SEQ ID NO: 41972

SEQ ID NO: 204633 - RNA, 64 nt, hsa; identical to SEQ ID NO: 41973

SEQ ID NO: 204634 - RNA, 64 nt, hsa; identical to SEQ ID NO: 41974

SEQ ID NO: 204635 - RNA, 64 nt, hsa; identical to SEQ ID NO: 41975

SEQ ID NO: 204636 - RNA, 64 nt, hsa; identical to SEQ ID NO: 41976

SEQ ID NO: 204637 - RNA, 64 nt, hsa; identical to SEQ ID NO: 41977

SEQ ID NO: 204638 - RNA, 64 nt, hsa; identical to SEQ ID NO: 41978

SEQ ID NO: 204639 - RNA, 64 nt, hsa; identical to SEQ ID NO: 41979

SEQ ID NO: 204640 - RNA, 64 nt, hsa; identical to SEQ ID NO: 41980

SEQ ID NO: 204641 - RNA, 64 nt, hsa; identical to SEQ ID NO: 41981

SEQ ID NO: 204642 - RNA, 64 nt, hsa; identical to SEQ ID NO: 41982

SEQ ID NO: 204643 - RNA, 64 nt, hsa; identical to SEQ ID NO: 41983

SEQ ID NO: 204644 - RNA, 64 nt, hsa; identical to SEQ ID NO: 41984

SEQ ID NO: 204645 - RNA, 64 nt, hsa; identical to SEQ ID NO: 41985

SEQ ID NO: 204646 - RNA, 64 nt, hsa; identical to SEQ ID NO: 41986

SEQ ID NO: 204647 - RNA, 64 nt, hsa; identical to SEQ ID NO: 41987

SEQ ID NO: 204648 - RNA, 64 nt, hsa; identical to SEQ ID NO: 41988

SEQ ID NO: 204649 - RNA, 64 nt, hsa; identical to SEQ ID NO: 41989

SEQ ID NO: 204650 - RNA, 64 nt, hsa; identical to SEQ ID NO: 41990

SEQ ID NO: 204651 - RNA, 64 nt, hsa; identical to SEQ ID NO: 41991

SEQ ID NO: 204652 - RNA, 64 nt, hsa; identical to SEQ ID NO: 41992

SEQ ID NO: 204653 - RNA, 64 nt, hsa; identical to SEQ ID NO: 41993

SEQ ID NO: 204654 - RNA, 64 nt, hsa; identical to SEQ ID NO: 41994

SEQ ID NO: 204655 - RNA, 64 nt, hsa; identical to SEQ ID NO: 41995

SEQ ID NO: 204656 - RNA, 64 nt, hsa; identical to SEQ ID NO: 41996

SEQ ID NO: 204657 - RNA, 64 nt, hsa; identical to SEQ ID NO: 41997

SEQ ID NO: 204658 - RNA, 64 nt, hsa; identical to SEQ ID NO: 41998

SEQ ID NO: 204659 - RNA, 64 nt, hsa; identical to SEQ ID NO: 41999

SEQ ID NO: 204660 - RNA, 64 nt, hsa; identical to SEQ ID NO: 42000

SEQ ID NO: 204661 - RNA, 64 nt, hsa; identical to SEQ ID NO: 42001

SEQ ID NO: 204662 - RNA, 64 nt, hsa; identical to SEQ ID NO: 42002

SEQ ID NO: 204663 - RNA, 64 nt, hsa; identical to SEQ ID NO: 42003

SEQ ID NO: 204664 - RNA, 64 nt, hsa; identical to SEQ ID NO: 42004

SEQ ID NO: 204665 - RNA, 64 nt, hsa; identical to SEQ ID NO: 42005

SEQ ID NO: 204666 - RNA, 64 nt, hsa; identical to SEQ ID NO: 42006

SEQ ID NO: 204667 - RNA, 64 nt, hsa; identical to SEQ ID NO: 42007

SEQ ID NO: 204668 - RNA, 64 nt, hsa; identical to SEQ ID NO: 42008

SEQ ID NO: 204669 - RNA, 64 nt, hsa; identical to SEQ ID NO: 42009

SEQ ID NO: 204670 - RNA, 64 nt, hsa; identical to SEQ ID NO: 42010

SEQ ID NO: 204671 - RNA, 64 nt, hsa; identical to SEQ ID NO: 42011

SEQ ID NO: 204672 - RNA, 64 nt, hsa; identical to SEQ ID NO: 42012

SEQ ID NO: 204673 - RNA, 64 nt, hsa; identical to SEQ ID NO: 42013

SEQ ID NO: 204674 - RNA, 64 nt, hsa; identical to SEQ ID NO: 42014

SEQ ID NO: 204675 - RNA, 64 nt, hsa; identical to SEQ ID NO: 42015

SEQ ID NO: 204676 - RNA, 64 nt, hsa; identical to SEQ ID NO: 42016

SEQ ID NO: 204677 - RNA, 64 nt, hsa; identical to SEQ ID NO: 42017

SEQ ID NO: 204678 - RNA, 64 nt, hsa; identical to SEQ ID NO: 42018

SEQ ID NO: 204679 - RNA, 64 nt, hsa; identical to SEQ ID NO: 42019

SEQ ID NO: 204680 - RNA, 64 nt, hsa; identical to SEQ ID NO: 42020

SEQ ID NO: 204681 - RNA, 64 nt, hsa; identical to SEQ ID NO: 42021

SEQ ID NO: 204682 - RNA, 64 nt, hsa; identical to SEQ ID NO: 42022

SEQ ID NO: 204683 - RNA, 64 nt, hsa; identical to SEQ ID NO: 42023

SEQ ID NO: 204684 - RNA, 64 nt, hsa; identical to SEQ ID NO: 42024

SEQ ID NO: 204685 - RNA, 64 nt, hsa; identical to SEQ ID NO: 42025

SEQ ID NO: 204686 - RNA, 64 nt, hsa; identical to SEQ ID NO: 42026

SEQ ID NO: 204687 - RNA, 64 nt, hsa; identical to SEQ ID NO: 42027

SEQ ID NO: 204688 - RNA, 64 nt, hsa; identical to SEQ ID NO: 42028

SEQ ID NO: 204689 - RNA, 64 nt, hsa; identical to SEQ ID NO: 42029

SEQ ID NO: 204690 - RNA, 64 nt, hsa; identical to SEQ ID NO: 42030

SEQ ID NO: 204691 - RNA, 64 nt, hsa; identical to SEQ ID NO: 42031

SEQ ID NO: 204692 - RNA, 64 nt, hsa; identical to SEQ ID NO: 42032

SEQ ID NO: 204693 - RNA, 64 nt, hsa; identical to SEQ ID NO: 42033

SEQ ID NO: 204694 - RNA, 64 nt, hsa; identical to SEQ ID NO: 42034

SEQ ID NO: 204695 - RNA, 64 nt, hsa; identical to SEQ ID NO: 42035

SEQ ID NO: 204696 - RNA, 64 nt, hsa; identical to SEQ ID NO: 42036

SEQ ID NO: 204697 - RNA, 64 nt, hsa; identical to SEQ ID NO: 42037

SEQ ID NO: 204698 - RNA, 64 nt, hsa; identical to SEQ ID NO: 42038

SEQ ID NO: 204699 - RNA, 64 nt, hsa; identical to SEQ ID NO: 42039

SEQ ID NO: 204700 - RNA, 64 nt, hsa; identical to SEQ ID NO: 42040

SEQ ID NO: 204701 - RNA, 64 nt, hsa; identical to SEQ ID NO: 42041

SEQ ID NO: 204702 - RNA, 64 nt, hsa; identical to SEQ ID NO: 42042

SEQ ID NO: 204703 - RNA, 64 nt, hsa; identical to SEQ ID NO: 42043

SEQ ID NO: 204704 - RNA, 64 nt, hsa; identical to SEQ ID NO: 42044

SEQ ID NO: 204705 - RNA, 64 nt, hsa; identical to SEQ ID NO: 42045

SEQ ID NO: 204706 - RNA, 64 nt, hsa; identical to SEQ ID NO: 42046

SEQ ID NO: 204707 - RNA, 64 nt, hsa; identical to SEQ ID NO: 42047

SEQ ID NO: 204708 - RNA, 64 nt, hsa; identical to SEQ ID NO: 42048

SEQ ID NO: 204709 - RNA, 64 nt, hsa; identical to SEQ ID NO: 42049

SEQ ID NO: 204710 - RNA, 64 nt, hsa; identical to SEQ ID NO: 42050

SEQ ID NO: 204711 - RNA, 64 nt, hsa; identical to SEQ ID NO: 42051

SEQ ID NO: 204712 - RNA, 64 nt, hsa; identical to SEQ ID NO: 42052

SEQ ID NO: 204713 - RNA, 64 nt, hsa; identical to SEQ ID NO: 42053

SEQ ID NO: 204714 - RNA, 64 nt, hsa; identical to SEQ ID NO: 42054

SEQ ID NO: 204715 - RNA, 64 nt, hsa; identical to SEQ ID NO: 42055

SEQ ID NO: 204716 - RNA, 64 nt, hsa; identical to SEQ ID NO: 42056

SEQ ID NO: 204717 - RNA, 64 nt, hsa; identical to SEQ ID NO: 42057

SEQ ID NO: 204718 - RNA, 64 nt, hsa; identical to SEQ ID NO: 42058

SEQ ID NO: 204719 - RNA, 64 nt, hsa; identical to SEQ ID NO: 42059

SEQ ID NO: 204720 - RNA, 64 nt, hsa; identical to SEQ ID NO: 42060

SEQ ID NO: 204721 - RNA, 64 nt, hsa; identical to SEQ ID NO: 42061

SEQ ID NO: 204722 - RNA, 64 nt, hsa; identical to SEQ ID NO: 42062

SEQ ID NO: 204723 - RNA, 64 nt, hsa; identical to SEQ ID NO: 42063

SEQ ID NO: 204724 - RNA, 64 nt, hsa; identical to SEQ ID NO: 42064

SEQ ID NO: 204725 - RNA, 64 nt, hsa; identical to SEQ ID NO: 42065

SEQ ID NO: 204726 - RNA, 64 nt, hsa; identical to SEQ ID NO: 42066

SEQ ID NO: 204727 - RNA, 64 nt, hsa; identical to SEQ ID NO: 42067

SEQ ID NO: 204728 - RNA, 64 nt, hsa; identical to SEQ ID NO: 42068

SEQ ID NO: 204729 - RNA, 64 nt, hsa; identical to SEQ ID NO: 42069

SEQ ID NO: 204730 - RNA, 64 nt, hsa; identical to SEQ ID NO: 42070

SEQ ID NO: 204731 - RNA, 64 nt, hsa; identical to SEQ ID NO: 42071

SEQ ID NO: 204732 - RNA, 64 nt, hsa; identical to SEQ ID NO: 42072

SEQ ID NO: 204733 - RNA, 64 nt, hsa; identical to SEQ ID NO: 42073

SEQ ID NO: 204734 - RNA, 64 nt, hsa; identical to SEQ ID NO: 42074

SEQ ID NO: 204735 - RNA, 64 nt, hsa; identical to SEQ ID NO: 42075

SEQ ID NO: 204736 - RNA, 64 nt, hsa; identical to SEQ ID NO: 42076

SEQ ID NO: 204737 - RNA, 64 nt, hsa; identical to SEQ ID NO: 42077

SEQ ID NO: 204738 - RNA, 64 nt, hsa; identical to SEQ ID NO: 42078

SEQ ID NO: 204739 - RNA, 64 nt, hsa; identical to SEQ ID NO: 42079

SEQ ID NO: 204740 - RNA, 64 nt, hsa; identical to SEQ ID NO: 42080

SEQ ID NO: 204741 - RNA, 64 nt, hsa; identical to SEQ ID NO: 42081

SEQ ID NO: 204742 - RNA, 64 nt, hsa; identical to SEQ ID NO: 42082

SEQ ID NO: 204743 - RNA, 64 nt, hsa; identical to SEQ ID NO: 42083

SEQ ID NO: 204744 - RNA, 64 nt, hsa; identical to SEQ ID NO: 42084

SEQ ID NO: 204745 - RNA, 64 nt, hsa; identical to SEQ ID NO: 42085

SEQ ID NO: 204746 - RNA, 64 nt, hsa; identical to SEQ ID NO: 42086

SEQ ID NO: 204747 - RNA, 64 nt, hsa; identical to SEQ ID NO: 42087

SEQ ID NO: 204748 - RNA, 64 nt, hsa; identical to SEQ ID NO: 42088

SEQ ID NO: 204749 - RNA, 64 nt, hsa; identical to SEQ ID NO: 42089

SEQ ID NO: 204750 - RNA, 64 nt, hsa; identical to SEQ ID NO: 42090

SEQ ID NO: 204751 - RNA, 64 nt, hsa; identical to SEQ ID NO: 42091

SEQ ID NO: 204752 - RNA, 64 nt, hsa; identical to SEQ ID NO: 42092

SEQ ID NO: 204753 - RNA, 64 nt, hsa; identical to SEQ ID NO: 42093

SEQ ID NO: 204754 - RNA, 64 nt, hsa; identical to SEQ ID NO: 42094

SEQ ID NO: 204755 - RNA, 64 nt, hsa; identical to SEQ ID NO: 42095

SEQ ID NO: 204756 - RNA, 64 nt, hsa; identical to SEQ ID NO: 42096

SEQ ID NO: 204757 - RNA, 64 nt, hsa; identical to SEQ ID NO: 42097

SEQ ID NO: 204758 - RNA, 64 nt, hsa; identical to SEQ ID NO: 42098

SEQ ID NO: 204759 - RNA, 64 nt, hsa; identical to SEQ ID NO: 42099

SEQ ID NO: 204760 - RNA, 64 nt, hsa; identical to SEQ ID NO: 42100

SEQ ID NO: 204761 - RNA, 64 nt, hsa; identical to SEQ ID NO: 42101

SEQ ID NO: 204762 - RNA, 64 nt, hsa; identical to SEQ ID NO: 41907

SEQ ID NO: 204763 - RNA, 64 nt, hsa; identical to SEQ ID NO: 41906

SEQ ID NO: 204764 - RNA, 64 nt, hsa; identical to SEQ ID NO: 41905

SEQ ID NO: 204765 - RNA, 64 nt, hsa; identical to SEQ ID NO: 41904

SEQ ID NO: 204766 - RNA, 64 nt, hsa; identical to SEQ ID NO: 42106

SEQ ID NO: 204767 - RNA, 64 nt, hsa; identical to SEQ ID NO: 42107

SEQ ID NO: 204768 - RNA, 64 nt, hsa; identical to SEQ ID NO: 42108

SEQ ID NO: 204769 - RNA, 64 nt, hsa; identical to SEQ ID NO: 42109

SEQ ID NO: 204770 - RNA, 64 nt, hsa; identical to SEQ ID NO: 42110

SEQ ID NO: 204771 - RNA, 64 nt, hsa; identical to SEQ ID NO: 42111

SEQ ID NO: 204772 - RNA, 64 nt, hsa; identical to SEQ ID NO: 42112

SEQ ID NO: 204773 - RNA, 64 nt, hsa; identical to SEQ ID NO: 42113

SEQ ID NO: 204774 - RNA, 64 nt, hsa; identical to SEQ ID NO: 42114

SEQ ID NO: 204775 - RNA, 64 nt, hsa; identical to SEQ ID NO: 42115

SEQ ID NO: 204776 - RNA, 64 nt, hsa; identical to SEQ ID NO: 42116

SEQ ID NO: 204777 - RNA, 64 nt, hsa; identical to SEQ ID NO: 42117

SEQ ID NO: 204778 - RNA, 64 nt, hsa; identical to SEQ ID NO: 42118

SEQ ID NO: 204779 - RNA, 64 nt, hsa; identical to SEQ ID NO: 42119

SEQ ID NO: 204780 - RNA, 64 nt, hsa; identical to SEQ ID NO: 42120

SEQ ID NO: 204781 - RNA, 64 nt, hsa; identical to SEQ ID NO: 42121

SEQ ID NO: 204782 - RNA, 64 nt, hsa; identical to SEQ ID NO: 42122

SEQ ID NO: 204783 - RNA, 64 nt, hsa; identical to SEQ ID NO: 42123

SEQ ID NO: 204784 - RNA, 64 nt, hsa; identical to SEQ ID NO: 42124

SEQ ID NO: 204785 - RNA, 64 nt, hsa; identical to SEQ ID NO: 42125

SEQ ID NO: 204786 - RNA, 64 nt, hsa; identical to SEQ ID NO: 42126

SEQ ID NO: 204787 - RNA, 64 nt, hsa; identical to SEQ ID NO: 42127

SEQ ID NO: 204788 - RNA, 64 nt, hsa; identical to SEQ ID NO: 42128

SEQ ID NO: 204789 - RNA, 64 nt, hsa; identical to SEQ ID NO: 42129

SEQ ID NO: 204790 - RNA, 64 nt, hsa; identical to SEQ ID NO: 42130

SEQ ID NO: 204791 - RNA, 64 nt, hsa; identical to SEQ ID NO: 42131

SEQ ID NO: 204792 - RNA, 64 nt, hsa; identical to SEQ ID NO: 42132

SEQ ID NO: 204793 - RNA, 64 nt, hsa; identical to SEQ ID NO: 42133

SEQ ID NO: 204794 - RNA, 64 nt, hsa; identical to SEQ ID NO: 42134

SEQ ID NO: 204795 - RNA, 64 nt, hsa; identical to SEQ ID NO: 42135

SEQ ID NO: 204796 - RNA, 64 nt, hsa; identical to SEQ ID NO: 42136

SEQ ID NO: 204797 - RNA, 64 nt, hsa; identical to SEQ ID NO: 42137

SEQ ID NO: 204798 - RNA, 64 nt, hsa; identical to SEQ ID NO: 42138

SEQ ID NO: 204799 - RNA, 64 nt, hsa; identical to SEQ ID NO: 42139

SEQ ID NO: 204800 - RNA, 64 nt, hsa; identical to SEQ ID NO: 42140

SEQ ID NO: 204801 - RNA, 64 nt, hsa; identical to SEQ ID NO: 42141

SEQ ID NO: 204802 - RNA, 64 nt, hsa; identical to SEQ ID NO: 42142

SEQ ID NO: 204803 - RNA, 64 nt, hsa; identical to SEQ ID NO: 42143

SEQ ID NO: 204804 - RNA, 64 nt, hsa; identical to SEQ ID NO: 42144

SEQ ID NO: 204805 - RNA, 64 nt, hsa; identical to SEQ ID NO: 42145

SEQ ID NO: 204806 - RNA, 64 nt, hsa; identical to SEQ ID NO: 42146

SEQ ID NO: 204807 - RNA, 64 nt, hsa; identical to SEQ ID NO: 42147

SEQ ID NO: 204808 - RNA, 64 nt, hsa; identical to SEQ ID NO: 42148

SEQ ID NO: 204809 - RNA, 64 nt, hsa; identical to SEQ ID NO: 42149

SEQ ID NO: 204810 - RNA, 64 nt, hsa; identical to SEQ ID NO: 42150

SEQ ID NO: 204811 - RNA, 64 nt, hsa; identical to SEQ ID NO: 42151

SEQ ID NO: 204812 - RNA, 64 nt, hsa; identical to SEQ ID NO: 42152

SEQ ID NO: 204813 - RNA, 64 nt, hsa; identical to SEQ ID NO: 42153

SEQ ID NO: 204814 - RNA, 64 nt, hsa; identical to SEQ ID NO: 42154

SEQ ID NO: 204815 - RNA, 64 nt, hsa; identical to SEQ ID NO: 42155

SEQ ID NO: 204816 - RNA, 64 nt, hsa; identical to SEQ ID NO: 42156

SEQ ID NO: 204817 - RNA, 64 nt, hsa; identical to SEQ ID NO: 42157

SEQ ID NO: 204818 - RNA, 64 nt, hsa; identical to SEQ ID NO: 42158

SEQ ID NO: 204819 - RNA, 64 nt, hsa; identical to SEQ ID NO: 42159

SEQ ID NO: 204820 - RNA, 64 nt, hsa; identical to SEQ ID NO: 42160

SEQ ID NO: 204821 - RNA, 64 nt, hsa; identical to SEQ ID NO: 42161

SEQ ID NO: 204822 - RNA, 64 nt, hsa; identical to SEQ ID NO: 42162

SEQ ID NO: 204823 - RNA, 64 nt, hsa; identical to SEQ ID NO: 42163

SEQ ID NO: 204824 - RNA, 64 nt, hsa; identical to SEQ ID NO: 42164

SEQ ID NO: 204825 - RNA, 64 nt, hsa; identical to SEQ ID NO: 42165

SEQ ID NO: 204826 - RNA, 64 nt, hsa; identical to SEQ ID NO: 42166

SEQ ID NO: 204827 - RNA, 64 nt, hsa; identical to SEQ ID NO: 42167

SEQ ID NO: 204828 - RNA, 64 nt, hsa; identical to SEQ ID NO: 42168

SEQ ID NO: 204829 - RNA, 64 nt, hsa; identical to SEQ ID NO: 42169

SEQ ID NO: 204830 - RNA, 64 nt, hsa; identical to SEQ ID NO: 42170

SEQ ID NO: 204831 - RNA, 64 nt, hsa; identical to SEQ ID NO: 42171

SEQ ID NO: 204832 - RNA, 64 nt, hsa; identical to SEQ ID NO: 42172

SEQ ID NO: 204833 - RNA, 64 nt, hsa; identical to SEQ ID NO: 42173

SEQ ID NO: 204834 - RNA, 64 nt, hsa; identical to SEQ ID NO: 42174

SEQ ID NO: 204835 - RNA, 64 nt, hsa; identical to SEQ ID NO: 42175

SEQ ID NO: 204836 - RNA, 64 nt, hsa; identical to SEQ ID NO: 42176

SEQ ID NO: 204837 - RNA, 64 nt, hsa; identical to SEQ ID NO: 42177

SEQ ID NO: 204838 - RNA, 64 nt, hsa; identical to SEQ ID NO: 42178

SEQ ID NO: 204839 - RNA, 64 nt, hsa; identical to SEQ ID NO: 42179

SEQ ID NO: 204840 - RNA, 64 nt, hsa; identical to SEQ ID NO: 42180

SEQ ID NO: 204841 - RNA, 64 nt, hsa; identical to SEQ ID NO: 42181

SEQ ID NO: 204842 - RNA, 64 nt, hsa; identical to SEQ ID NO: 42182

SEQ ID NO: 204843 - RNA, 64 nt, hsa; identical to SEQ ID NO: 42183

SEQ ID NO: 204844 - RNA, 64 nt, hsa; identical to SEQ ID NO: 42184

SEQ ID NO: 204845 - RNA, 64 nt, hsa; identical to SEQ ID NO: 42185

SEQ ID NO: 204846 - RNA, 64 nt, hsa; identical to SEQ ID NO: 42186

SEQ ID NO: 204847 - RNA, 64 nt, hsa; identical to SEQ ID NO: 42187

SEQ ID NO: 204848 - RNA, 64 nt, hsa; identical to SEQ ID NO: 42188

SEQ ID NO: 204849 - RNA, 64 nt, hsa; identical to SEQ ID NO: 42189

SEQ ID NO: 204850 - RNA, 64 nt, hsa; identical to SEQ ID NO: 42190

SEQ ID NO: 204851 - RNA, 64 nt, hsa; identical to SEQ ID NO: 42191

SEQ ID NO: 204852 - RNA, 64 nt, hsa; identical to SEQ ID NO: 42192

SEQ ID NO: 204853 - RNA, 64 nt, hsa; identical to SEQ ID NO: 42193

SEQ ID NO: 204854 - RNA, 64 nt, hsa; identical to SEQ ID NO: 42194

SEQ ID NO: 204855 - RNA, 64 nt, hsa; identical to SEQ ID NO: 42195

SEQ ID NO: 204856 - RNA, 64 nt, hsa; identical to SEQ ID NO: 42196

SEQ ID NO: 204857 - RNA, 64 nt, hsa; identical to SEQ ID NO: 42197

SEQ ID NO: 204858 - RNA, 64 nt, hsa; identical to SEQ ID NO: 42198

SEQ ID NO: 204859 - RNA, 64 nt, hsa; identical to SEQ ID NO: 42199

SEQ ID NO: 204860 - RNA, 64 nt, hsa; identical to SEQ ID NO: 42200

SEQ ID NO: 204861 - RNA, 64 nt, hsa; identical to SEQ ID NO: 42201

SEQ ID NO: 204862 - RNA, 64 nt, hsa; identical to SEQ ID NO: 42202

SEQ ID NO: 204863 - RNA, 64 nt, hsa; identical to SEQ ID NO: 42203

SEQ ID NO: 204864 - RNA, 64 nt, hsa; identical to SEQ ID NO: 42204

SEQ ID NO: 204865 - RNA, 64 nt, hsa; identical to SEQ ID NO: 42205

SEQ ID NO: 204866 - RNA, 64 nt, hsa; identical to SEQ ID NO: 42206

SEQ ID NO: 204867 - RNA, 64 nt, hsa; identical to SEQ ID NO: 42207

SEQ ID NO: 204868 - RNA, 64 nt, hsa; identical to SEQ ID NO: 42208

SEQ ID NO: 204869 - RNA, 64 nt, hsa; identical to SEQ ID NO: 42209

SEQ ID NO: 204870 - RNA, 64 nt, hsa; identical to SEQ ID NO: 42210

SEQ ID NO: 204871 - RNA, 64 nt, hsa; identical to SEQ ID NO: 42211

SEQ ID NO: 204872 - RNA, 64 nt, hsa; identical to SEQ ID NO: 42212

SEQ ID NO: 204873 - RNA, 64 nt, hsa; identical to SEQ ID NO: 42213

SEQ ID NO: 204874 - RNA, 64 nt, hsa; identical to SEQ ID NO: 42214

SEQ ID NO: 204875 - RNA, 64 nt, hsa; identical to SEQ ID NO: 42215

SEQ ID NO: 204876 - RNA, 64 nt, hsa; identical to SEQ ID NO: 42216

SEQ ID NO: 204877 - RNA, 64 nt, hsa; identical to SEQ ID NO: 42217

SEQ ID NO: 204878 - RNA, 64 nt, hsa; identical to SEQ ID NO: 42218

SEQ ID NO: 204879 - RNA, 64 nt, hsa; identical to SEQ ID NO: 42219

SEQ ID NO: 204880 - RNA, 64 nt, hsa; identical to SEQ ID NO: 42220

SEQ ID NO: 204881 - RNA, 64 nt, hsa; identical to SEQ ID NO: 42221

SEQ ID NO: 204882 - RNA, 64 nt, hsa; identical to SEQ ID NO: 42222

SEQ ID NO: 204883 - RNA, 64 nt, hsa; identical to SEQ ID NO: 42223

SEQ ID NO: 204884 - RNA, 64 nt, hsa; identical to SEQ ID NO: 42224

SEQ ID NO: 204885 - RNA, 64 nt, hsa; identical to SEQ ID NO: 42225

SEQ ID NO: 204886 - RNA, 64 nt, hsa; identical to SEQ ID NO: 42226

SEQ ID NO: 204887 - RNA, 64 nt, hsa; identical to SEQ ID NO: 42227

SEQ ID NO: 204888 - RNA, 64 nt, hsa; identical to SEQ ID NO: 42228

SEQ ID NO: 204889 - RNA, 64 nt, hsa; identical to SEQ ID NO: 42229

SEQ ID NO: 204890 - RNA, 64 nt, hsa; identical to SEQ ID NO: 42230

SEQ ID NO: 204891 - RNA, 64 nt, hsa; identical to SEQ ID NO: 42231

SEQ ID NO: 204892 - RNA, 64 nt, hsa; identical to SEQ ID NO: 42232

SEQ ID NO: 204893 - RNA, 64 nt, hsa; identical to SEQ ID NO: 42233

SEQ ID NO: 204894 - RNA, 64 nt, hsa; identical to SEQ ID NO: 42234

SEQ ID NO: 204895 - RNA, 64 nt, hsa; identical to SEQ ID NO: 42235

SEQ ID NO: 204896 - RNA, 64 nt, hsa
ucugagggaauuuuauauuuucagaguuuaaaauuauugcuacucccaauuuagaaaaaugggg

SEQ ID NO: 204897 - RNA, 64 nt, hsa
agagcuugaguugucaaaauauauuuuaauuaucuauugcuaaaaacauaguaagaugcagaga

SEQ ID NO: 204898 - RNA, 64 nt, hsa
agcagugcuuucaugaaugccauccuacacauauuauugcuauuaccugaacaaaauagaauua

SEQ ID NO: 204899 - RNA, 64 nt, hsa
cccacuacuggguuuggauccacaguuugaaaaauauugcuacaagacacuuaaggagaccauc

SEQ ID NO: 204900 - RNA, 64 nt, hsa
aaaaggcauaaccaagcacucucuuaucuugccuuauugcuauacuauuuacaucccacugcag

SEQ ID NO: 204901 - RNA, 64 nt, hsa
guaacauauagucuacuauagcauaguaugcuacuauugcuacuucuggugugauuuguaaugu

SEQ ID NO: 204902 - RNA, 64 nt, hsa
aaaauaauaauaguacuauugcuaguacuaguacuauugcuauuacuaguacuauuacuaguac

SEQ ID NO: 204903 - RNA, 64 nt, hsa
aaaauaaaauuuaccuuuaaaauaauaauaguacuauugcuaguacuaguacuauugcuauuac

SEQ ID NO: 204904 - RNA, 64 nt, hsa
ugcaguccuauuuaucugcagucguauuaaguccuauugcuagaauagguuacuacaaaaaagg

SEQ ID NO: 204905 - RNA, 64 nt, hsa
cuucaggacagugcagcugcauuuaucagagcacuauugcuaaguuuucuuuucuggcuugugu

SEQ ID NO: 204906 - RNA, 64 nt, hsa
ggcaucagaagauuauugaagaagcaccugcuacuauugcuacuccagcaguauuugaacacau

SEQ ID NO: 204907 - RNA, 64 nt, hsa
acaacaacuaugcaaauguggaauuaauucuugauauugcuaaaaggaucccaguacaaguaag

SEQ ID NO: 204908 - RNA, 64 nt, hsa
gcuuugggggaaauaaagugauugagaagguucuuauugcuaacaauggcauugcagcagugaa

SEQ ID NO: 204909 - RNA, 64 nt, hsa
guaauucucuuucuccauaguauuuaagcagaaauauugcuaguuuaauauugugucaggucgu

SEQ ID NO: 204910 - RNA, 64 nt, hsa
auaauacuaaaaaugcuucaauaacuuaucuugguauugcuaauaaaaaaaaaaagcugugaaa

SEQ ID NO: 204911 - RNA, 64 nt, hsa
uuauuuuuuaaaaagaaauuauauaaaaauacuuuauugcuaaaaauacuaauaaugaucuuag

SEQ ID NO: 204912 - RNA, 64 nt, hsa
uggauuggguugcagcccaccacaauaaagcaaauauugcuauaaagugagucacaaaaauggu

SEQ ID NO: 204913 - RNA, 64 nt, hsa
ggaaggggcauaugucacuaauagaaugucuccaaagcuggauugauguggagaaaacaccuuu

SEQ ID NO: 204914 - RNA, 64 nt, hsa
auaccaugauuguuuauggaaaguaucuuuaauaaagcuggauacaguuuggcuuggaaugcug

SEQ ID NO: 204915 - RNA, 64 nt, hsa
ucagaaugagagaacauuaaacuaccagucugguaagcuggauuuuuuuccccauggcuuuacu

SEQ ID NO: 204916 - RNA, 64 nt, hsa
uuuugccauuuggccagagggaaucagagacuacaagcuggacagucacccaggcccaaccuuc

SEQ ID NO: 204917 - RNA, 64 nt, hsa
ggguggauuugugcagggugcagcucuggagaagaagcuggaucacucuuggucccauucccua

SEQ ID NO: 204918 - RNA, 64 nt, hsa
acccugcugcaggaccacgguggacccacgggagaagcuggaggugcuggagaggacauacggg

SEQ ID NO: 204919 - RNA, 64 nt, hsa
acgacuucaaagagaacuugagauucaaaagaaaaagcuggauaaauuaaaaucugagguuaau

SEQ ID NO: 204920 - RNA, 64 nt, hsa
aacaaggcuagccauauuuaggacaacugaagaaaagcuggaaaaaaaaacaagcaaacuugaa

SEQ ID NO: 204921 - RNA, 64 nt, hsa
uucauguauuaaaauaacacugagauuuuuuuaaaagcuggaagauuguacagcauaaagcuaa

SEQ ID NO: 204922 - RNA, 64 nt, hsa
uugcucucuauuuugacuuguaaggauaccucauaagcuggaucuuuuauuuuuccuucauguu

SEQ ID NO: 204923 - RNA, 64 nt, hsa
cccgccuagaacccagucuaaugagaacuccagaaagcuggagcagcccaccuagagcuggccg

SEQ ID NO: 204924 - RNA, 64 nt, hsa
ugggaggcccaaggagaagagccugguccuggugaagcuggaacccuggcugugccgagugcac

SEQ ID NO: 204925 - RNA, 64 nt, hsa
auaccaugauuguuuauggaaaguaucuuuaauaaagcuggauacaguuugaaagaaaaaaaaa

SEQ ID NO: 204926 - RNA, 64 nt, hsa
ggaagggguaugugucacuaauagaauaucucugaagcuggauugauacggggaaaacaucuuu

SEQ ID NO: 204927 - RNA, 64 nt, hsa
agaagggccauaugucacuaauagaaagccccugaagcuggacugauguggggaaaacaccuuu

SEQ ID NO: 204928 - RNA, 64 nt, hsa
auaccaugauucuuuauggaaauuaucuuuaauaaagcuggauacaguuuggcuugggaaaaaa

SEQ ID NO: 204929 - RNA, 64 nt, hsa
acugcuccucuccccuccccacaaaaggaaaaaaaagcuggauuugauuuuuuuuuucugguca

SEQ ID NO: 204930 - RNA, 64 nt, hsa
uaccuguuaggaacaugaauaccuuacaaagcugaagcuggaacuuuucccaaaggguuuuggg

SEQ ID NO: 204931 - RNA, 64 nt, hsa
caaaaccacagccaacaucauacugaaugagcaaaagcuggagcauuacucuugagaaguagaa

SEQ ID NO: 204932 - RNA, 64 nt, hsa
caaaaagccaaagcaauccuaagcaaaaagaacaaagcuggaggcaucgcauuacccaacuuca

SEQ ID NO: 204933 - RNA, 64 nt, hsa
uuccagcugaaaaacuagaccugugccauuggggaagcuggacaaagucuagggggcccgccug

SEQ ID NO: 204934 - RNA, 64 nt, hsa
agucuagggggcccgccugguagagggucccgggaagcuggaucugucagccucggcccugagg

SEQ ID NO: 204935 - RNA, 64 nt, hsa
caagacucugucucaaauaauaauaauaauaauaaagcuggagacuuggccacaccugggcuaa

SEQ ID NO: 204936 - RNA, 64 nt, hsa
ggaggggaggaagaaaguuguuuucagcauaguaaagcuggaaggccaggugcagugucucacc

SEQ ID NO: 204937 - RNA, 64 nt, hsa
gcccaauagccaaggguacaaguacuaccgacagaagcuggaggaguuccggaaagccaaggcc

SEQ ID NO: 204938 - RNA, 64 nt, hsa
gaaggcagccuuguacuucagugacuucuggaauaagcuggacgucggcgcaaucuugcucuuc

SEQ ID NO: 204939 - RNA, 64 nt, hsa
gacuccggccaagaggcacaagcagcucaagaacaagcuggagaagaacgaggaggcggcccug

SEQ ID NO: 204940 - RNA, 64 nt, hsa
ucaaaguauuuaaauuuccuagguuuucaugaaaaagcuggaaagcgaucagcaucaagggcuu

SEQ ID NO: 204941 - RNA, 64 nt, hsa
ccuggacugggcuaaauuuaguuuucccacuguuaagcuggaaugaggacugucccaacaacag

SEQ ID NO: 204942 - RNA, 64 nt, hsa; identical to SEQ ID NO: 194676

SEQ ID NO: 204943 - RNA, 64 nt, hsa; identical to SEQ ID NO: 194677

SEQ ID NO: 204944 - RNA, 64 nt, hsa; identical to SEQ ID NO: 194678

SEQ ID NO: 204945 - RNA, 64 nt, hsa; identical to SEQ ID NO: 194679

SEQ ID NO: 204946 - RNA, 64 nt, hsa; identical to SEQ ID NO: 194680

SEQ ID NO: 204947 - RNA, 64 nt, hsa; identical to SEQ ID NO: 194681

SEQ ID NO: 204948 - RNA, 64 nt, hsa; identical to SEQ ID NO: 194682

SEQ ID NO: 204949 - RNA, 64 nt, hsa; identical to SEQ ID NO: 194683

SEQ ID NO: 204950 - RNA, 64 nt, hsa; identical to SEQ ID NO: 194684

SEQ ID NO: 204951 - RNA, 64 nt, hsa; identical to SEQ ID NO: 194685

SEQ ID NO: 204952 - RNA, 64 nt, hsa; identical to SEQ ID NO: 194686

SEQ ID NO: 204953 - RNA, 64 nt, hsa; identical to SEQ ID NO: 194687

SEQ ID NO: 204954 - RNA, 64 nt, hsa; identical to SEQ ID NO: 194688

SEQ ID NO: 204955 - RNA, 64 nt, hsa; identical to SEQ ID NO: 194689

SEQ ID NO: 204956 - RNA, 64 nt, hsa; identical to SEQ ID NO: 194690

SEQ ID NO: 204957 - RNA, 64 nt, hsa; identical to SEQ ID NO: 194691

SEQ ID NO: 204958 - RNA, 64 nt, hsa; identical to SEQ ID NO: 194692

SEQ ID NO: 204959 - RNA, 64 nt, hsa; identical to SEQ ID NO: 194693

SEQ ID NO: 204960 - RNA, 64 nt, hsa; identical to SEQ ID NO: 194694

SEQ ID NO: 204961 - RNA, 64 nt, hsa; identical to SEQ ID NO: 194695

SEQ ID NO: 204962 - RNA, 64 nt, hsa; identical to SEQ ID NO: 194696

SEQ ID NO: 204963 - RNA, 64 nt, hsa; identical to SEQ ID NO: 194697

SEQ ID NO: 204964 - RNA, 64 nt, hsa; identical to SEQ ID NO: 194698

SEQ ID NO: 204965 - RNA, 64 nt, hsa; identical to SEQ ID NO: 194699

SEQ ID NO: 204966 - RNA, 64 nt, hsa; identical to SEQ ID NO: 194700

SEQ ID NO: 204967 - RNA, 64 nt, hsa; identical to SEQ ID NO: 194701

SEQ ID NO: 204968 - RNA, 64 nt, hsa; identical to SEQ ID NO: 194702

SEQ ID NO: 204969 - RNA, 64 nt, hsa; identical to SEQ ID NO: 194703

SEQ ID NO: 204970 - RNA, 64 nt, hsa; identical to SEQ ID NO: 194704

SEQ ID NO: 204971 - RNA, 64 nt, hsa; identical to SEQ ID NO: 194705

SEQ ID NO: 204972 - RNA, 60 nt, hsa; identical to SEQ ID NO: 194706

SEQ ID NO: 204973 - RNA, 64 nt, hsa; identical to SEQ ID NO: 194707

SEQ ID NO: 204974 - RNA, 64 nt, hsa; identical to SEQ ID NO: 194708

SEQ ID NO: 204975 - RNA, 64 nt, hsa; identical to SEQ ID NO: 194709

SEQ ID NO: 204976 - RNA, 64 nt, hsa; identical to SEQ ID NO: 194710

SEQ ID NO: 204977 - RNA, 64 nt, hsa; identical to SEQ ID NO: 194711

SEQ ID NO: 204978 - RNA, 64 nt, hsa; identical to SEQ ID NO: 194712

SEQ ID NO: 204979 - RNA, 64 nt, hsa; identical to SEQ ID NO: 194713

SEQ ID NO: 204980 - RNA, 64 nt, hsa; identical to SEQ ID NO: 194714

SEQ ID NO: 204981 - RNA, 64 nt, hsa; identical to SEQ ID NO: 204913

SEQ ID NO: 204982 - RNA, 64 nt, hsa; identical to SEQ ID NO: 204914

SEQ ID NO: 204983 - RNA, 64 nt, hsa; identical to SEQ ID NO: 204915

SEQ ID NO: 204984 - RNA, 64 nt, hsa; identical to SEQ ID NO: 204916

SEQ ID NO: 204985 - RNA, 64 nt, hsa; identical to SEQ ID NO: 204917

SEQ ID NO: 204986 - RNA, 64 nt, hsa; identical to SEQ ID NO: 204918

SEQ ID NO: 204987 - RNA, 64 nt, hsa; identical to SEQ ID NO: 204919

SEQ ID NO: 204988 - RNA, 64 nt, hsa; identical to SEQ ID NO: 204920

SEQ ID NO: 204989 - RNA, 64 nt, hsa; identical to SEQ ID NO: 204921

SEQ ID NO: 204990 - RNA, 64 nt, hsa; identical to SEQ ID NO: 204922

SEQ ID NO: 204991 - RNA, 64 nt, hsa; identical to SEQ ID NO: 204923

SEQ ID NO: 204992 - RNA, 64 nt, hsa; identical to SEQ ID NO: 204924

SEQ ID NO: 204993 - RNA, 64 nt, hsa; identical to SEQ ID NO: 204925

SEQ ID NO: 204994 - RNA, 64 nt, hsa; identical to SEQ ID NO: 204926

SEQ ID NO: 204995 - RNA, 64 nt, hsa; identical to SEQ ID NO: 204927

SEQ ID NO: 204996 - RNA, 64 nt, hsa; identical to SEQ ID NO: 204928

SEQ ID NO: 204997 - RNA, 64 nt, hsa; identical to SEQ ID NO: 204929

SEQ ID NO: 204998 - RNA, 64 nt, hsa; identical to SEQ ID NO: 204930

SEQ ID NO: 204999 - RNA, 64 nt, hsa; identical to SEQ ID NO: 204931

SEQ ID NO: 205000 - RNA, 64 nt, hsa; identical to SEQ ID NO: 204932

SEQ ID NO: 205001 - RNA, 64 nt, hsa; identical to SEQ ID NO: 204933

SEQ ID NO: 205002 - RNA, 64 nt, hsa; identical to SEQ ID NO: 204934

SEQ ID NO: 205003 - RNA, 64 nt, hsa; identical to SEQ ID NO: 204935

SEQ ID NO: 205004 - RNA, 64 nt, hsa; identical to SEQ ID NO: 204936

SEQ ID NO: 205005 - RNA, 64 nt, hsa; identical to SEQ ID NO: 204937

SEQ ID NO: 205006 - RNA, 64 nt, hsa; identical to SEQ ID NO: 204938

SEQ ID NO: 205007 - RNA, 64 nt, hsa; identical to SEQ ID NO: 204939

SEQ ID NO: 205008 - RNA, 64 nt, hsa; identical to SEQ ID NO: 204940

SEQ ID NO: 205009 - RNA, 64 nt, hsa; identical to SEQ ID NO: 204941

SEQ ID NO: 205010 - RNA, 64 nt, hsa; identical to SEQ ID NO: 194676

SEQ ID NO: 205011 - RNA, 64 nt, hsa; identical to SEQ ID NO: 194677

SEQ ID NO: 205012 - RNA, 64 nt, hsa; identical to SEQ ID NO: 194678

SEQ ID NO: 205013 - RNA, 64 nt, hsa; identical to SEQ ID NO: 194679

SEQ ID NO: 205014 - RNA, 64 nt, hsa; identical to SEQ ID NO: 194680

SEQ ID NO: 205015 - RNA, 64 nt, hsa; identical to SEQ ID NO: 194681

SEQ ID NO: 205016 - RNA, 64 nt, hsa; identical to SEQ ID NO: 194682

SEQ ID NO: 205017 - RNA, 64 nt, hsa; identical to SEQ ID NO: 194683

SEQ ID NO: 205018 - RNA, 64 nt, hsa; identical to SEQ ID NO: 194684

SEQ ID NO: 205019 - RNA, 64 nt, hsa; identical to SEQ ID NO: 194685

SEQ ID NO: 205020 - RNA, 64 nt, hsa; identical to SEQ ID NO: 194686

SEQ ID NO: 205021 - RNA, 64 nt, hsa; identical to SEQ ID NO: 194687

SEQ ID NO: 205022 - RNA, 64 nt, hsa; identical to SEQ ID NO: 194688

SEQ ID NO: 205023 - RNA, 64 nt, hsa; identical to SEQ ID NO: 194689

SEQ ID NO: 205024 - RNA, 64 nt, hsa; identical to SEQ ID NO: 194690

SEQ ID NO: 205025 - RNA, 64 nt, hsa; identical to SEQ ID NO: 194691

SEQ ID NO: 205026 - RNA, 64 nt, hsa; identical to SEQ ID NO: 194692

SEQ ID NO: 205027 - RNA, 64 nt, hsa; identical to SEQ ID NO: 194693

SEQ ID NO: 205028 - RNA, 64 nt, hsa; identical to SEQ ID NO: 194694

SEQ ID NO: 205029 - RNA, 64 nt, hsa; identical to SEQ ID NO: 194695

SEQ ID NO: 205030 - RNA, 64 nt, hsa; identical to SEQ ID NO: 194696

SEQ ID NO: 205031 - RNA, 64 nt, hsa; identical to SEQ ID NO: 194697

SEQ ID NO: 205032 - RNA, 64 nt, hsa; identical to SEQ ID NO: 194698

SEQ ID NO: 205033 - RNA, 64 nt, hsa; identical to SEQ ID NO: 194699

SEQ ID NO: 205034 - RNA, 64 nt, hsa; identical to SEQ ID NO: 194700

SEQ ID NO: 205035 - RNA, 64 nt, hsa; identical to SEQ ID NO: 194701

SEQ ID NO: 205036 - RNA, 64 nt, hsa; identical to SEQ ID NO: 194702

SEQ ID NO: 205037 - RNA, 64 nt, hsa; identical to SEQ ID NO: 194703

SEQ ID NO: 205038 - RNA, 64 nt, hsa; identical to SEQ ID NO: 194704

SEQ ID NO: 205039 - RNA, 64 nt, hsa; identical to SEQ ID NO: 194705

SEQ ID NO: 205040 - RNA, 60 nt, hsa; identical to SEQ ID NO: 194706

SEQ ID NO: 205041 - RNA, 64 nt, hsa; identical to SEQ ID NO: 194707

SEQ ID NO: 205042 - RNA, 64 nt, hsa; identical to SEQ ID NO: 194708

SEQ ID NO: 205043 - RNA, 64 nt, hsa; identical to SEQ ID NO: 194709

SEQ ID NO: 205044 - RNA, 64 nt, hsa; identical to SEQ ID NO: 194710

SEQ ID NO: 205045 - RNA, 64 nt, hsa; identical to SEQ ID NO: 194711

SEQ ID NO: 205046 - RNA, 64 nt, hsa; identical to SEQ ID NO: 194712

SEQ ID NO: 205047 - RNA, 64 nt, hsa; identical to SEQ ID NO: 194713

SEQ ID NO: 205048 - RNA, 64 nt, hsa; identical to SEQ ID NO: 194714

SEQ ID NO: 205049 - RNA, 64 nt, hsa; identical to SEQ ID NO: 199907

SEQ ID NO: 205050 - RNA, 64 nt, hsa; identical to SEQ ID NO: 199908

SEQ ID NO: 205051 - RNA, 64 nt, hsa; identical to SEQ ID NO: 199909

SEQ ID NO: 205052 - RNA, 64 nt, hsa; identical to SEQ ID NO: 199910

SEQ ID NO: 205053 - RNA, 64 nt, hsa; identical to SEQ ID NO: 199911

SEQ ID NO: 205054 - RNA, 64 nt, hsa; identical to SEQ ID NO: 199912

SEQ ID NO: 205055 - RNA, 64 nt, hsa; identical to SEQ ID NO: 199913

SEQ ID NO: 205056 - RNA, 64 nt, hsa; identical to SEQ ID NO: 199914

SEQ ID NO: 205057 - RNA, 64 nt, hsa; identical to SEQ ID NO: 199915

SEQ ID NO: 205058 - RNA, 64 nt, hsa; identical to SEQ ID NO: 199916

SEQ ID NO: 205059 - RNA, 64 nt, hsa; identical to SEQ ID NO: 199917

SEQ ID NO: 205060 - RNA, 64 nt, hsa; identical to SEQ ID NO: 199918

SEQ ID NO: 205061 - RNA, 64 nt, hsa; identical to SEQ ID NO: 199919

SEQ ID NO: 205062 - RNA, 64 nt, hsa; identical to SEQ ID NO: 199920

SEQ ID NO: 205063 - RNA, 64 nt, hsa; identical to SEQ ID NO: 199921

SEQ ID NO: 205064 - RNA, 64 nt, hsa; identical to SEQ ID NO: 199922

SEQ ID NO: 205065 - RNA, 64 nt, hsa; identical to SEQ ID NO: 199923

SEQ ID NO: 205066 - RNA, 64 nt, hsa; identical to SEQ ID NO: 199924

SEQ ID NO: 205067 - RNA, 64 nt, hsa; identical to SEQ ID NO: 199925

SEQ ID NO: 205068 - RNA, 64 nt, hsa; identical to SEQ ID NO: 199926

SEQ ID NO: 205069 - RNA, 64 nt, hsa; identical to SEQ ID NO: 199927

SEQ ID NO: 205070 - RNA, 64 nt, hsa; identical to SEQ ID NO: 199928

SEQ ID NO: 205071 - RNA, 64 nt, hsa; identical to SEQ ID NO: 199929

SEQ ID NO: 205072 - RNA, 64 nt, hsa; identical to SEQ ID NO: 199930

SEQ ID NO: 205073 - RNA, 64 nt, hsa; identical to SEQ ID NO: 199931

SEQ ID NO: 205074 - RNA, 64 nt, hsa; identical to SEQ ID NO: 199932

SEQ ID NO: 205075 - RNA, 64 nt, hsa; identical to SEQ ID NO: 199933

SEQ ID NO: 205076 - RNA, 64 nt, hsa; identical to SEQ ID NO: 199934

SEQ ID NO: 205077 - RNA, 64 nt, hsa; identical to SEQ ID NO: 199935

SEQ ID NO: 205078 - RNA, 64 nt, hsa; identical to SEQ ID NO: 199936

SEQ ID NO: 205079 - RNA, 64 nt, hsa; identical to SEQ ID NO: 199937

SEQ ID NO: 205080 - RNA, 64 nt, hsa; identical to SEQ ID NO: 199938

SEQ ID NO: 205081 - RNA, 64 nt, hsa; identical to SEQ ID NO: 199939

SEQ ID NO: 205082 - RNA, 64 nt, hsa; identical to SEQ ID NO: 199940

SEQ ID NO: 205083 - RNA, 64 nt, hsa; identical to SEQ ID NO: 199941

SEQ ID NO: 205084 - RNA, 64 nt, hsa; identical to SEQ ID NO: 199942

SEQ ID NO: 205085 - RNA, 64 nt, hsa; identical to SEQ ID NO: 53816

SEQ ID NO: 205086 - RNA, 64 nt, hsa; identical to SEQ ID NO: 53817

SEQ ID NO: 205087 - RNA, 64 nt, hsa; identical to SEQ ID NO: 53818

SEQ ID NO: 205088 - RNA, 64 nt, hsa; identical to SEQ ID NO: 53819

SEQ ID NO: 205089 - RNA, 64 nt, hsa; identical to SEQ ID NO: 53820

SEQ ID NO: 205090 - RNA, 64 nt, hsa; identical to SEQ ID NO: 53821

SEQ ID NO: 205091 - RNA, 64 nt, hsa; identical to SEQ ID NO: 53822

SEQ ID NO: 205092 - RNA, 64 nt, hsa; identical to SEQ ID NO: 53823

SEQ ID NO: 205093 - RNA, 64 nt, hsa; identical to SEQ ID NO: 53824

SEQ ID NO: 205094 - RNA, 64 nt, hsa; identical to SEQ ID NO: 53825

SEQ ID NO: 205095 - RNA, 64 nt, hsa; identical to SEQ ID NO: 53826

SEQ ID NO: 205096 - RNA, 64 nt, hsa; identical to SEQ ID NO: 53827

SEQ ID NO: 205097 - RNA, 64 nt, hsa; identical to SEQ ID NO: 53828

SEQ ID NO: 205098 - RNA, 64 nt, hsa; identical to SEQ ID NO: 53829

SEQ ID NO: 205099 - RNA, 64 nt, hsa; identical to SEQ ID NO: 53830

SEQ ID NO: 205100 - RNA, 64 nt, hsa; identical to SEQ ID NO: 53831

SEQ ID NO: 205101 - RNA, 64 nt, hsa; identical to SEQ ID NO: 53832

SEQ ID NO: 205102 - RNA, 64 nt, hsa; identical to SEQ ID NO: 53833

SEQ ID NO: 205103 - RNA, 64 nt, hsa; identical to SEQ ID NO: 53834

SEQ ID NO: 205104 - RNA, 64 nt, hsa; identical to SEQ ID NO: 53835

SEQ ID NO: 205105 - RNA, 64 nt, hsa; identical to SEQ ID NO: 87004

SEQ ID NO: 205106 - RNA, 64 nt, hsa; identical to SEQ ID NO: 87005

SEQ ID NO: 205107 - RNA, 64 nt, hsa; identical to SEQ ID NO: 87006

SEQ ID NO: 205108 - RNA, 64 nt, hsa; identical to SEQ ID NO: 87007

SEQ ID NO: 205109 - RNA, 64 nt, hsa; identical to SEQ ID NO: 87008

SEQ ID NO: 205110 - RNA, 64 nt, hsa; identical to SEQ ID NO: 87009

SEQ ID NO: 205111 - RNA, 64 nt, hsa; identical to SEQ ID NO: 87010

SEQ ID NO: 205112 - RNA, 64 nt, hsa; identical to SEQ ID NO: 87011

SEQ ID NO: 205113 - RNA, 64 nt, hsa; identical to SEQ ID NO: 87012

SEQ ID NO: 205114 - RNA, 64 nt, hsa; identical to SEQ ID NO: 87013

SEQ ID NO: 205115 - RNA, 64 nt, hsa; identical to SEQ ID NO: 87014

SEQ ID NO: 205116 - RNA, 64 nt, hsa; identical to SEQ ID NO: 87015

SEQ ID NO: 205117 - RNA, 64 nt, hsa; identical to SEQ ID NO: 87016

SEQ ID NO: 205118 - RNA, 64 nt, hsa; identical to SEQ ID NO: 87017

SEQ ID NO: 205119 - RNA, 64 nt, hsa; identical to SEQ ID NO: 87018

SEQ ID NO: 205120 - RNA, 64 nt, hsa; identical to SEQ ID NO: 87019

SEQ ID NO: 205121 - RNA, 64 nt, hsa; identical to SEQ ID NO: 87020

SEQ ID NO: 205122 - RNA, 64 nt, hsa; identical to SEQ ID NO: 87021

SEQ ID NO: 205123 - RNA, 64 nt, hsa; identical to SEQ ID NO: 87022

SEQ ID NO: 205124 - RNA, 64 nt, hsa; identical to SEQ ID NO: 87023

SEQ ID NO: 205125 - RNA, 64 nt, hsa; identical to SEQ ID NO: 87024

SEQ ID NO: 205126 - RNA, 64 nt, hsa; identical to SEQ ID NO: 87025

SEQ ID NO: 205127 - RNA, 64 nt, hsa; identical to SEQ ID NO: 87026

SEQ ID NO: 205128 - RNA, 64 nt, hsa; identical to SEQ ID NO: 87027

SEQ ID NO: 205129 - RNA, 64 nt, hsa; identical to SEQ ID NO: 87028

SEQ ID NO: 205130 - RNA, 64 nt, hsa; identical to SEQ ID NO: 87029

SEQ ID NO: 205131 - RNA, 64 nt, hsa; identical to SEQ ID NO: 87030

SEQ ID NO: 205132 - RNA, 64 nt, hsa; identical to SEQ ID NO: 87031

SEQ ID NO: 205133 - RNA, 64 nt, hsa; identical to SEQ ID NO: 87032

SEQ ID NO: 205134 - RNA, 64 nt, hsa; identical to SEQ ID NO: 87033

SEQ ID NO: 205135 - RNA, 64 nt, hsa; identical to SEQ ID NO: 87034

SEQ ID NO: 205136 - RNA, 64 nt, hsa; identical to SEQ ID NO: 87035

SEQ ID NO: 205137 - RNA, 64 nt, hsa; identical to SEQ ID NO: 87036

SEQ ID NO: 205138 - RNA, 64 nt, hsa; identical to SEQ ID NO: 87037

SEQ ID NO: 205139 - RNA, 64 nt, hsa; identical to SEQ ID NO: 87038

SEQ ID NO: 205140 - RNA, 51 nt, hsa; identical to SEQ ID NO: 87039

SEQ ID NO: 205141 - RNA, 64 nt, hsa; identical to SEQ ID NO: 87040

SEQ ID NO: 205142 - RNA, 64 nt, hsa; identical to SEQ ID NO: 87041

SEQ ID NO: 205143 - RNA, 64 nt, hsa; identical to SEQ ID NO: 87042

SEQ ID NO: 205144 - RNA, 64 nt, hsa; identical to SEQ ID NO: 87043

SEQ ID NO: 205145 - RNA, 64 nt, hsa; identical to SEQ ID NO: 193898

SEQ ID NO: 205146 - RNA, 64 nt, hsa; identical to SEQ ID NO: 193899

SEQ ID NO: 205147 - RNA, 64 nt, hsa; identical to SEQ ID NO: 193900

SEQ ID NO: 205148 - RNA, 64 nt, hsa; identical to SEQ ID NO: 193901

SEQ ID NO: 205149 - RNA, 64 nt, hsa; identical to SEQ ID NO: 193902

SEQ ID NO: 205150 - RNA, 64 nt, hsa; identical to SEQ ID NO: 193903

SEQ ID NO: 205151 - RNA, 64 nt, hsa; identical to SEQ ID NO: 193904

SEQ ID NO: 205152 - RNA, 64 nt, hsa; identical to SEQ ID NO: 193905

SEQ ID NO: 205153 - RNA, 64 nt, hsa; identical to SEQ ID NO: 193906

SEQ ID NO: 205154 - RNA, 64 nt, hsa; identical to SEQ ID NO: 193907

SEQ ID NO: 205155 - RNA, 64 nt, hsa; identical to SEQ ID NO: 193908

SEQ ID NO: 205156 - RNA, 64 nt, hsa; identical to SEQ ID NO: 193909

SEQ ID NO: 205157 - RNA, 64 nt, hsa; identical to SEQ ID NO: 193910

SEQ ID NO: 205158 - RNA, 64 nt, hsa; identical to SEQ ID NO: 193911

SEQ ID NO: 205159 - RNA, 64 nt, hsa; identical to SEQ ID NO: 193912

SEQ ID NO: 205160 - RNA, 64 nt, hsa; identical to SEQ ID NO: 193913

SEQ ID NO: 205161 - RNA, 64 nt, hsa; identical to SEQ ID NO: 193914

SEQ ID NO: 205162 - RNA, 64 nt, hsa; identical to SEQ ID NO: 193915

SEQ ID NO: 205163 - RNA, 64 nt, hsa; identical to SEQ ID NO: 193916

SEQ ID NO: 205164 - RNA, 64 nt, hsa; identical to SEQ ID NO: 193917

SEQ ID NO: 205165 - RNA, 64 nt, hsa; identical to SEQ ID NO: 193918

SEQ ID NO: 205166 - RNA, 64 nt, hsa; identical to SEQ ID NO: 193919

SEQ ID NO: 205167 - RNA, 64 nt, hsa; identical to SEQ ID NO: 87004

SEQ ID NO: 205168 - RNA, 64 nt, hsa; identical to SEQ ID NO: 87005

SEQ ID NO: 205169 - RNA, 64 nt, hsa; identical to SEQ ID NO: 87006

SEQ ID NO: 205170 - RNA, 64 nt, hsa; identical to SEQ ID NO: 87007

SEQ ID NO: 205171 - RNA, 64 nt, hsa; identical to SEQ ID NO: 87008

SEQ ID NO: 205172 - RNA, 64 nt, hsa; identical to SEQ ID NO: 87009

SEQ ID NO: 205173 - RNA, 64 nt, hsa; identical to SEQ ID NO: 87010

SEQ ID NO: 205174 - RNA, 64 nt, hsa; identical to SEQ ID NO: 87011

SEQ ID NO: 205175 - RNA, 64 nt, hsa; identical to SEQ ID NO: 87012

SEQ ID NO: 205176 - RNA, 64 nt, hsa; identical to SEQ ID NO: 87013

SEQ ID NO: 205177 - RNA, 64 nt, hsa; identical to SEQ ID NO: 87014

SEQ ID NO: 205178 - RNA, 64 nt, hsa; identical to SEQ ID NO: 87015

SEQ ID NO: 205179 - RNA, 64 nt, hsa; identical to SEQ ID NO: 87016

SEQ ID NO: 205180 - RNA, 64 nt, hsa; identical to SEQ ID NO: 87017

SEQ ID NO: 205181 - RNA, 64 nt, hsa; identical to SEQ ID NO: 87018

SEQ ID NO: 205182 - RNA, 64 nt, hsa; identical to SEQ ID NO: 87019

SEQ ID NO: 205183 - RNA, 64 nt, hsa; identical to SEQ ID NO: 87020

SEQ ID NO: 205184 - RNA, 64 nt, hsa; identical to SEQ ID NO: 87021

SEQ ID NO: 205185 - RNA, 64 nt, hsa; identical to SEQ ID NO: 87022

SEQ ID NO: 205186 - RNA, 64 nt, hsa; identical to SEQ ID NO: 87023

SEQ ID NO: 205187 - RNA, 64 nt, hsa; identical to SEQ ID NO: 87024

SEQ ID NO: 205188 - RNA, 64 nt, hsa; identical to SEQ ID NO: 87025

SEQ ID NO: 205189 - RNA, 64 nt, hsa; identical to SEQ ID NO: 87026

SEQ ID NO: 205190 - RNA, 64 nt, hsa; identical to SEQ ID NO: 87027

SEQ ID NO: 205191 - RNA, 64 nt, hsa; identical to SEQ ID NO: 87028

SEQ ID NO: 205192 - RNA, 64 nt, hsa; identical to SEQ ID NO: 87029

SEQ ID NO: 205193 - RNA, 64 nt, hsa; identical to SEQ ID NO: 87030

SEQ ID NO: 205194 - RNA, 64 nt, hsa; identical to SEQ ID NO: 87031

SEQ ID NO: 205195 - RNA, 64 nt, hsa; identical to SEQ ID NO: 87032

SEQ ID NO: 205196 - RNA, 64 nt, hsa; identical to SEQ ID NO: 87033

SEQ ID NO: 205197 - RNA, 64 nt, hsa; identical to SEQ ID NO: 87034

SEQ ID NO: 205198 - RNA, 64 nt, hsa; identical to SEQ ID NO: 87035

SEQ ID NO: 205199 - RNA, 64 nt, hsa; identical to SEQ ID NO: 87036

SEQ ID NO: 205200 - RNA, 64 nt, hsa; identical to SEQ ID NO: 87037

SEQ ID NO: 205201 - RNA, 64 nt, hsa; identical to SEQ ID NO: 87038

SEQ ID NO: 205202 - RNA, 51 nt, hsa; identical to SEQ ID NO: 87039

SEQ ID NO: 205203 - RNA, 64 nt, hsa; identical to SEQ ID NO: 87040

SEQ ID NO: 205204 - RNA, 64 nt, hsa; identical to SEQ ID NO: 87041

SEQ ID NO: 205205 - RNA, 64 nt, hsa; identical to SEQ ID NO: 87042

SEQ ID NO: 205206 - RNA, 64 nt, hsa; identical to SEQ ID NO: 87043

SEQ ID NO: 205207 - RNA, 64 nt, hsa; identical to SEQ ID NO: 193898

SEQ ID NO: 205208 - RNA, 64 nt, hsa; identical to SEQ ID NO: 193899

SEQ ID NO: 205209 - RNA, 64 nt, hsa; identical to SEQ ID NO: 193900

SEQ ID NO: 205210 - RNA, 64 nt, hsa; identical to SEQ ID NO: 193901

SEQ ID NO: 205211 - RNA, 64 nt, hsa; identical to SEQ ID NO: 193902

SEQ ID NO: 205212 - RNA, 64 nt, hsa; identical to SEQ ID NO: 193903

SEQ ID NO: 205213 - RNA, 64 nt, hsa; identical to SEQ ID NO: 193904

SEQ ID NO: 205214 - RNA, 64 nt, hsa; identical to SEQ ID NO: 193905

SEQ ID NO: 205215 - RNA, 64 nt, hsa; identical to SEQ ID NO: 193906

SEQ ID NO: 205216 - RNA, 64 nt, hsa; identical to SEQ ID NO: 193907

SEQ ID NO: 205217 - RNA, 64 nt, hsa; identical to SEQ ID NO: 193908

SEQ ID NO: 205218 - RNA, 64 nt, hsa; identical to SEQ ID NO: 193909

SEQ ID NO: 205219 - RNA, 64 nt, hsa; identical to SEQ ID NO: 193910

SEQ ID NO: 205220 - RNA, 64 nt, hsa; identical to SEQ ID NO: 193911

SEQ ID NO: 205221 - RNA, 64 nt, hsa; identical to SEQ ID NO: 193912

SEQ ID NO: 205222 - RNA, 64 nt, hsa; identical to SEQ ID NO: 193913

SEQ ID NO: 205223 - RNA, 64 nt, hsa; identical to SEQ ID NO: 193914

SEQ ID NO: 205224 - RNA, 64 nt, hsa; identical to SEQ ID NO: 193915

SEQ ID NO: 205225 - RNA, 64 nt, hsa; identical to SEQ ID NO: 193916

SEQ ID NO: 205226 - RNA, 64 nt, hsa; identical to SEQ ID NO: 193917

SEQ ID NO: 205227 - RNA, 64 nt, hsa; identical to SEQ ID NO: 193918

SEQ ID NO: 205228 - RNA, 64 nt, hsa; identical to SEQ ID NO: 193919

SEQ ID NO: 205229 - RNA, 64 nt, hsa
agagcgccagccucugcuuucaggaaagguuuauuguggugagugccuucuguacagucgacug

SEQ ID NO: 205230 - RNA, 64 nt, hsa
guucagcguggacugcagaaguggcucacgcuccuguggugagggcagggugcuccacagacac

SEQ ID NO: 205231 - RNA, 64 nt, hsa
cuuguguguguuuauagcuuuuguuucgcgggguuguggugaggaaggggugauggcaugcgga

SEQ ID NO: 205232 - RNA, 64 nt, hsa
agggauauaaauuuccaggaauguguauuuuuaauguggugagaugcacucuuuuguuguacca

SEQ ID NO: 205233 - RNA, 64 nt, hsa
uuagcccgggaggugguggcucccuccugcucucuguggugaaagccaagcacacuuuccuaaa

SEQ ID NO: 205234 - RNA, 64 nt, hsa
cuccaccaugaagauggguuaagagucucaagguuguggugacuguagauauaugagugugcau

SEQ ID NO: 205235 - RNA, 64 nt, hsa
guugccaccuguuggagccaagaauguauuaguuuguggugacacuggguuagcucagcaugga

SEQ ID NO: 205236 - RNA, 64 nt, hsa
cacgcaaggcagccuuucccuuuggcuagauaaauguggugaaauugccacuagaaagggccag

SEQ ID NO: 205237 - RNA, 64 nt, hsa
gcaccaacaaugucacaagcacugugcuaaacacuguggugaaguagaacaauugcuaaucauu

SEQ ID NO: 205238 - RNA, 64 nt, hsa
ugucucacuuuccagagguagcagucacuaauacuguggugagugauuuuacucaaaggaaauc

SEQ ID NO: 205239 - RNA, 64 nt, hsa
aacugcccuuccuucugaccccucauaagaggaguguggugagggaggggacuggguagggguc

SEQ ID NO: 205240 - RNA, 64 nt, hsa
gguagguauuuugucuuucaaacuacaaauggaauguggugacauaaacuagacauggggugcc

SEQ ID NO: 205241 - RNA, 64 nt, hsa
gguaccgaaguggcauccgaggccacaugaaggcuguggugauggaucugcuccggcaguaccu

SEQ ID NO: 205242 - RNA, 64 nt, hsa
cccuacaggugacucgacagucccccaacuccuauguggugaucaugaauggcucauguguaga

SEQ ID NO: 205243 - RNA, 64 nt, hsa
ggcaggagagugcuugaacccaggaggcggagguuguggugagccaagaucaugccacugcacu

SEQ ID NO: 205244 - RNA, 51 nt, hsa
gagagaaaccuuacaaaugaguguggugaggucauuagguacaauucacuc

SEQ ID NO: 205245 - RNA, 64 nt, hsa
uuuaccuguacuguauucuuggucaucucaaauggcgucuaaacccagcuacuuugcauuccag

SEQ ID NO: 205246 - RNA, 64 nt, hsa
cauacaauucuguguuccucaguaaaugagauuagcgucuaaugaguagcaccccuuuacuaac

SEQ ID NO: 205247 - RNA, 64 nt, hsa
guuaaauauaauuuccaaacuuuguggucaggcagcgucuaagguuacguuaccacagacugac

SEQ ID NO: 205248 - RNA, 64 nt, hsa
cuguucuagggaacggaaaagaguucauggccaagcgucuaaccuaaagucccaggauuggcuc

SEQ ID NO: 205249 - RNA, 64 nt, hsa
agcucuucucggacuccccugggccaaugauguugcgucuaauacccuuugucucuccucuaug

SEQ ID NO: 205250 - RNA, 64 nt, hsa
ccucgcagcugcugcccgggaaaagcuggcccaggcgucuaaggagucaaaagagaaacagcuu

SEQ ID NO: 205251 - RNA, 64 nt, hsa
acuucauguauucauuuauauuuuauauuauuuugcgucuaaugauuuuuuauuaacaugauuu

SEQ ID NO: 205252 - RNA, 64 nt, hsa
ugcagcuuguggcaguggaaauauggcugaaugagcgucuaaaucguugagaccagugcaacuu

SEQ ID NO: 205253 - RNA, 64 nt, hsa
gaugagaaggggcagggacugggggcucugcuuugcgucuaaccuuugugggggagggccagca

SEQ ID NO: 205254 - RNA, 64 nt, hsa
ccuaguccugucccuccggccccaguggagacaggcgucuaagaacccgugccgagaggguucc

SEQ ID NO: 205255 - RNA, 64 nt, hsa
cguguccccucccuuccucugcgccggacuuggugcgucuaagaugagggggccaggcgguggc

SEQ ID NO: 205256 - RNA, 64 nt, hsa; identical to SEQ ID NO: 162025

SEQ ID NO: 205257 - RNA, 64 nt, hsa; identical to SEQ ID NO: 162026

SEQ ID NO: 205258 - RNA, 64 nt, hsa; identical to SEQ ID NO: 162027

SEQ ID NO: 205259 - RNA, 64 nt, hsa; identical to SEQ ID NO: 162028

SEQ ID NO: 205260 - RNA, 64 nt, hsa; identical to SEQ ID NO: 162029

SEQ ID NO: 205261 - RNA, 64 nt, hsa; identical to SEQ ID NO: 162030

SEQ ID NO: 205262 - RNA, 64 nt, hsa; identical to SEQ ID NO: 162031

SEQ ID NO: 205263 - RNA, 64 nt, hsa; identical to SEQ ID NO: 162032

SEQ ID NO: 205264 - RNA, 64 nt, hsa; identical to SEQ ID NO: 162033

SEQ ID NO: 205265 - RNA, 64 nt, hsa; identical to SEQ ID NO: 162034

SEQ ID NO: 205266 - RNA, 64 nt, hsa; identical to SEQ ID NO: 162035

SEQ ID NO: 205267 - RNA, 64 nt, hsa; identical to SEQ ID NO: 162036

SEQ ID NO: 205268 - RNA, 64 nt, hsa; identical to SEQ ID NO: 162037

SEQ ID NO: 205269 - RNA, 64 nt, hsa; identical to SEQ ID NO: 162038

SEQ ID NO: 205270 - RNA, 64 nt, hsa; identical to SEQ ID NO: 162039

SEQ ID NO: 205271 - RNA, 64 nt, hsa; identical to SEQ ID NO: 162040

SEQ ID NO: 205272 - RNA, 64 nt, hsa; identical to SEQ ID NO: 162041

SEQ ID NO: 205273 - RNA, 64 nt, hsa; identical to SEQ ID NO: 162042

SEQ ID NO: 205274 - RNA, 64 nt, hsa; identical to SEQ ID NO: 162043

SEQ ID NO: 205275 - RNA, 64 nt, hsa; identical to SEQ ID NO: 162044

SEQ ID NO: 205276 - RNA, 64 nt, hsa; identical to SEQ ID NO: 162045

SEQ ID NO: 205277 - RNA, 64 nt, hsa; identical to SEQ ID NO: 162046

SEQ ID NO: 205278 - RNA, 64 nt, hsa; identical to SEQ ID NO: 162047

SEQ ID NO: 205279 - RNA, 64 nt, hsa; identical to SEQ ID NO: 162048

SEQ ID NO: 205280 - RNA, 64 nt, hsa; identical to SEQ ID NO: 162049

SEQ ID NO: 205281 - RNA, 64 nt, hsa; identical to SEQ ID NO: 162050

SEQ ID NO: 205282 - RNA, 64 nt, hsa; identical to SEQ ID NO: 162051

SEQ ID NO: 205283 - RNA, 64 nt, hsa; identical to SEQ ID NO: 162052

SEQ ID NO: 205284 - RNA, 64 nt, hsa; identical to SEQ ID NO: 162053

SEQ ID NO: 205285 - RNA, 64 nt, hsa; identical to SEQ ID NO: 162054

SEQ ID NO: 205286 - RNA, 64 nt, hsa; identical to SEQ ID NO: 162055

SEQ ID NO: 205287 - RNA, 64 nt, hsa; identical to SEQ ID NO: 162056

SEQ ID NO: 205288 - RNA, 64 nt, hsa; identical to SEQ ID NO: 162057

SEQ ID NO: 205289 - RNA, 64 nt, hsa
uuaaaauauuuaacaguucaaucucaauaagaccucgcauuauguaugaauguuauucacugac

SEQ ID NO: 205290 - RNA, 64 nt, hsa
ucgaaaugcugagcagcauggauucugcaucgguucgcauuaucaaacccuuuccugcgcccca

SEQ ID NO: 205291 - RNA, 64 nt, hsa
ccaaucagugucaucuccuggguaaauuuugaugucgcauuauaaagacaugcauaauugaugg

SEQ ID NO: 205292 - RNA, 64 nt, hsa
agagguagggaggggaguauggguucauuuggcuucgcauuaugcaaggugaaaccguuuguuu

SEQ ID NO: 205293 - RNA, 64 nt, hsa
aucuuguaacugaagacacaccauaucuaugauaucgcauuaguccauguggggaaaagaaaga

SEQ ID NO: 205294 - RNA, 64 nt, hsa
ugaaacauccuugugcacacccuugugccuuugcucgcauuaauccuuccaagagacuucccuc

SEQ ID NO: 205295 - RNA, 64 nt, hsa
ugaaggcuugcuuuucccucgccuuuccugaaggucgcauuagagcgagucacauggagcaucc

SEQ ID NO: 205296 - RNA, 64 nt, hsa
auuuguuuauccuuaagaauuccaucuauauaaaucgcauuaaugaaauaccaacuaugcguaa

SEQ ID NO: 205297 - RNA, 64 nt, hsa
uaccauuuuaaccauuuuuaaguguacaguucuuucgcauuaaugcacccaugaccaccauuca

SEQ ID NO: 205298 - RNA, 64 nt, hsa
uguguuuacuucuaagggaaauacuaacuuucuuucgcauuaguauuaauuuugaaguagcuac

SEQ ID NO: 205299 - RNA, 64 nt, hsa
ggauuuagcuaggcuacuagaaguuagacugcuuucgcauuaaacagcuaacuucauccacagc

SEQ ID NO: 205300 - RNA, 64 nt, hsa
uaccauuagaaaauacuauuugaaauggacauuaucgcauuaucuuggcauaauggccagaaaa

SEQ ID NO: 205301 - RNA, 64 nt, hsa
acugcgugcgggacaguuauguuuccuugccccgucgcauuaaugaggcccuuccacaucauuu

SEQ ID NO: 205302 - RNA, 64 nt, hsa
guaaguucuuuagcaguguucaaagucuacuagcucgcauuaguuucuguugcugccaacagau

SEQ ID NO: 205303 - RNA, 64 nt, hsa
uguuucacacuauaguuuguguaacaacacguguucgcauuaucuauguugcuguuacuuuugu

SEQ ID NO: 205304 - RNA, 64 nt, hsa
gaacccgggagguggagguugcagugagccgagaucgcauuacugcacuccagccuggguaaca

SEQ ID NO: 205305 - RNA, 64 nt, hsa
uguggggagcagcaugggcaaggaagacacagacucgcauuacccuuggucacugugauuucug

SEQ ID NO: 205306 - RNA, 64 nt, hsa
uuggaauggccagcuuaugaaggcaaauuuccacucgcauuauuuaaugauggaagauucuggg

SEQ ID NO: 205307 - RNA, 64 nt, hsa
aaaagcuaauaccagucacucgauaauaaaguauucgcauuauaguuuuuuuuaaacugucuuc

SEQ ID NO: 205308 - RNA, 64 nt, hsa
gcaauccuaagcaaaaagaacaaagcuggaggcaucgcauuacccaacuucaaacuauacuaca

SEQ ID NO: 205309 - RNA, 64 nt, hsa
ucuguuuccucccagaagcaucucccagcuaagcucgcauuauuuuucuccucuggcuguuugc

SEQ ID NO: 205310 - RNA, 64 nt, hsa
uucuuucuuucauagauauuuuugucuauuuggaucgcauuaauuguuuccaguaaaacucuuu

SEQ ID NO: 205311 - RNA, 64 nt, hsa
gugaaggacuuuauuccgacuaauacucuuuuugucgcauuauauacccaguaaaaaagaaaag

SEQ ID NO: 205312 - RNA, 64 nt, hsa
cagcucuggaugaaggcaaaaacuguacuguguuucgcauuaagcacacacaucuggcccugac

SEQ ID NO: 205313 - RNA, 64 nt, hsa
acacuguaacaacuuugagaccaccucugaaucgucgcauuauaacuguuguagaaucuuaaau

SEQ ID NO: 205314 - RNA, 64 nt, hsa
cggugugauucuacugugcucagccuagucaauuucgcauuaaacugauuaucagcugaguauc

SEQ ID NO: 205315 - RNA, 64 nt, hsa
uacauuagcgcauuucuuaaacuaaacaggaaagucgcauuauuuucccauucuacucuagaaa

SEQ ID NO: 205316 - RNA, 64 nt, hsa
cgaugcuguuagguugcgcaagcgauguuugcgcucgcauuacagggaccucaaccuaggugca

SEQ ID NO: 205317 - RNA, 64 nt, hsa
ccaaacucuucugcuugguuggaauuucauuguaucgcauuauccagguggcuaguggcauuug

SEQ ID NO: 205318 - RNA, 64 nt, hsa
uuuuucucacuguggugugauuggcuaaacaaucucgcauuaaaaauucaaauguaaauugaau

SEQ ID NO: 205319 - RNA, 64 nt, hsa
uguuccuacuucccuaggaagcccuggcuaccuuucgcauuaggaccagucuggguuuuaaggc

SEQ ID NO: 205320 - RNA, 64 nt, hsa
aaaugaauuaagcaaccuagaagauacagagcuaaugaauuaucaaaaugugauuaaucccagu

SEQ ID NO: 205321 - RNA, 64 nt, hsa
ccucgaggugguaccuaagcuguggauuugcuaaaugaauuaagcaaccuagaagauacagagc

SEQ ID NO: 205322 - RNA, 64 nt, hsa
agcugugucugcccaaugaauaauggaaaaugccaugaauuaccuggauguucuuuuuacgagg

SEQ ID NO: 205323 - RNA, 64 nt, hsa
gagauuuuuuugagucaaagacuuaaagggcccaaugaauuauuauauacauacugcaucuugg

SEQ ID NO: 205324 - RNA, 64 nt, hsa
uuuguucaugaauauauuaaucagcauuagagaaaugaauuauaacuagacaucugcuguuauc

SEQ ID NO: 205325 - RNA, 64 nt, hsa
accaggaaguguuuaugaggaaacaacacccaagaugaauuauuuuugagacugucaggaagua

SEQ ID NO: 205326 - RNA, 64 nt, hsa
gugagcacuggcuucuauauuuuauuucauauuuaugaauuauaaauaugaauuuaauuacuaa

SEQ ID NO: 205327 - RNA, 64 nt, hsa
uuguuguaaaacagauguuuguuucuaaaauauaaugaauuaaugauuaucaaaguacaggcau

SEQ ID NO: 205328 - RNA, 64 nt, hsa
uucuuaaugaaguaaacccaacaaaacuagagguaugaauuaaugcuacacauuuuaauacaca

SEQ ID NO: 205329 - RNA, 64 nt, hsa
cauaaucaucucuuggaagaaaaugcugagaucaaugaauuauucugugugccuauauugacgu

SEQ ID NO: 205330 - RNA, 64 nt, hsa
aaacgguagcaacaacccaaauguccauccacagaugaauuaagacaugaaguguguucugucc

SEQ ID NO: 205331 - RNA, 64 nt, hsa
ugguugcacaacuuugugaauauacuagaaaccaaugaauuaaaaacuuuggaagaugaauuuu

SEQ ID NO: 205332 - RNA, 64 nt, hsa
ugucuaaaaauauauuauacaaacuaaaauguagaugaauuaaccucucaaagcacagaaugug

SEQ ID NO: 205333 - RNA, 64 nt, hsa
auuuuuaaaaguuuuugaaagagauaagugcaucaugaauuacauguacaugagaggagauagu

SEQ ID NO: 205334 - RNA, 64 nt, hsa
auagguauucacuaguugaauaguuuaauuugaaaugaauuaauuuuaaaugggaguuguucaa

SEQ ID NO: 205335 - RNA, 64 nt, hsa
cuggggucuucuuaaccaguacauagaacucuuuaugaauuaacuuuagcuuauguuggaagua

SEQ ID NO: 205336 - RNA, 64 nt, hsa
gcuaauuugauacuauaauagaaugagacauaaaaugaauuaauggaaacauauccacacugua

SEQ ID NO: 205337 - RNA, 64 nt, hsa
aaucuauggauaaauggaaaccuaauuauuuguaaugaauuauuuagacaguucuaagcccugu

SEQ ID NO: 205338 - RNA, 64 nt, hsa
uugaacauauuuaaaauacauuuucacagaauggaugaauuaguuguuucuucagaguuacuua

SEQ ID NO: 205339 - RNA, 64 nt, hsa
cuguuaaauagaauagguuuaaaugacuagucaaaugaauuauuuucuucuuguuaaauaaauu

SEQ ID NO: 205340 - RNA, 64 nt, hsa
cguggaacaguuaccucugccucagaaaacaaggaugaauuaaguuuuuuuuuaaaaaagaaac

SEQ ID NO: 205341 - RNA, 64 nt, hsa
agagaaugagagacacacugaagaagcaccaaucaugaauuaguuuuauaugcuucuguuuuau

SEQ ID NO: 205342 - RNA, 64 nt, hsa
auauauaacaaugcuguauuuuaaaagaaugauuaugaauuacauuuguauaaaauaauuuuua

SEQ ID NO: 205343 - RNA, 64 nt, hsa
gguuuuaaaccuugugcucuacuccuuccuguuaaugaauuaagaacacauucuaacaaggguc

SEQ ID NO: 205344 - RNA, 64 nt, hsa; identical to SEQ ID NO: 205343

SEQ ID NO: 205345 - RNA, 64 nt, hsa
auucaguuuugcucuuauaaggacagcucaagccaugaauuagugagcauucugaccucauuuu

SEQ ID NO: 205346 - RNA, 64 nt, hsa
acuuaaaguacuguaauccacuaaagacgugccaaugaauuauuggaauaucacacuuuaaaaa

SEQ ID NO: 205347 - RNA, 64 nt, hsa
guucuuuaaaauauaucugaaaguaguagucagaaugaauuaugguuggaaaacugaggaaucu

SEQ ID NO: 205348 - RNA, 64 nt, hsa
uuuucugugaggaggaggggaucgugauuucagaaugaauuauguaucccuucucuuuugguuu

SEQ ID NO: 205349 - RNA, 64 nt, hsa
uacuaaaaacuauggaauuguuuaauuaugguauaugaauuaauuucuuucuuuuuuucuuuuu

SEQ ID NO: 205350 - RNA, 64 nt, hsa
cugggauuacaggugggagccacaacacccggccaugaauuaacuccguuaaaaaauaaacgua

SEQ ID NO: 205351 - RNA, 64 nt, hsa
aaaggacugguaaauacaagccuuggguuucagaaugaauuagaaacaaauaacucuuacuguc

SEQ ID NO: 205352 - RNA, 64 nt, hsa
cuggaaauuugauacggagagaacuuggugagcuaugaauuacucucagucuccuuuuuacagg

SEQ ID NO: 205353 - RNA, 64 nt, hsa
uccaaagaguauuuuuuaaaggaacaaaacgagcaugaauuaacucuucaauauaagcuaugaa

SEQ ID NO: 205354 - RNA, 64 nt, hsa
aaugaaauucuaccuagaaugcaaaauuggguauaugaauuacauagcauguuguugggauuuu

SEQ ID NO: 205355 - RNA, 64 nt, hsa
aacucauuauaccaauucacuauuuuauuuuuuaaugaauuaaaacuagaaaacaaauugaugc

SEQ ID NO: 205356 - RNA, 64 nt, hsa
ccuaucugcagaucaagauuuucucauuagaacaaugaauuauccagcauucagaucuuucuag

SEQ ID NO: 205357 - RNA, 64 nt, hsa
uuguccauacucuuccuaugaagagggaaugcguaugaauuaaggcuacuacugucacagaaga

SEQ ID NO: 205358 - RNA, 64 nt, hsa
cucacaacacaaacagguaguucguugggggcaaaugaauuagccaacuguuaacuggaagcuu

SEQ ID NO: 205359 - RNA, 64 nt, hsa
auauucauaaaugugacaaaugaacagcaggauuaugaauuaucaaaggaaaaaguauuugcug

SEQ ID NO: 205360 - RNA, 64 nt, hsa
auaggaagaaagaagacaaacuuugcaucucaguaugaauuauucaauuuauuugaaugauuuu

SEQ ID NO: 205361 - RNA, 64 nt, hsa
agcuagucuuuugcuuuugcccauuuugaaucacaugaauuauuacaguguuuauccuuucaua

SEQ ID NO: 205362 - RNA, 64 nt, hsa
acagucgugagccacuguaccccgccuaaaacugaugaauuauuucugaaauuuucuauuuaac

SEQ ID NO: 205363 - RNA, 64 nt, hsa
acauuacucagaacaggcauauaauugaaaacuuaugaauuauuuuuuuuuaauuauuugagau

SEQ ID NO: 205364 - RNA, 64 nt, hsa
uugcuggacuggauuucuucuggagggaagcaccaugaauuaaaggugccagagcuccaugcau

SEQ ID NO: 205365 - RNA, 64 nt, hsa
ucacaauguaacggaugaccauaugcacaauuccaugaauuaaaucuguuuccuguguuaguca

SEQ ID NO: 205366 - RNA, 64 nt, hsa
ugcuuucauucgugaagccgaaacguuuuuaaacaugaauuacauaugaauuauuaagcauaug

SEQ ID NO: 205367 - RNA, 64 nt, hsa
gugaagccgaaacguuuuuaaacaugaauuacauaugaauuauuaagcauaugugcuuucgcag

SEQ ID NO: 205368 - RNA, 64 nt, hsa
aauaucauuuuguaugccauaauauauaugauuuaugaauuauaguaauauuaauaaaaguguu

SEQ ID NO: 205369 - RNA, 64 nt, hsa
uagaaaucugccgauaaccuaaaauaauuuagaaaugaauuaaaaaugugaaaucggguuaaag

SEQ ID NO: 205370 - RNA, 64 nt, hsa
uuggaaauacugugugacugcuguguuuugcagcaugaauuauaguaaaauggucuucaauucu

SEQ ID NO: 205371 - RNA, 64 nt, hsa; identical to SEQ ID NO: 146107

SEQ ID NO: 205372 - RNA, 64 nt, hsa; identical to SEQ ID NO: 146108

SEQ ID NO: 205373 - RNA, 64 nt, hsa; identical to SEQ ID NO: 146109

SEQ ID NO: 205374 - RNA, 64 nt, hsa; identical to SEQ ID NO: 146110

SEQ ID NO: 205375 - RNA, 64 nt, hsa; identical to SEQ ID NO: 146111

SEQ ID NO: 205376 - RNA, 64 nt, hsa; identical to SEQ ID NO: 146112

SEQ ID NO: 205377 - RNA, 64 nt, hsa; identical to SEQ ID NO: 146113

SEQ ID NO: 205378 - RNA, 64 nt, hsa; identical to SEQ ID NO: 146114

SEQ ID NO: 205379 - RNA, 64 nt, hsa; identical to SEQ ID NO: 146115

SEQ ID NO: 205380 - RNA, 58 nt, hsa; identical to SEQ ID NO: 146116

SEQ ID NO: 205381 - RNA, 64 nt, hsa; identical to SEQ ID NO: 146117

SEQ ID NO: 205382 - RNA, 64 nt, hsa; identical to SEQ ID NO: 146118

SEQ ID NO: 205383 - RNA, 64 nt, hsa; identical to SEQ ID NO: 146119

SEQ ID NO: 205384 - RNA, 64 nt, hsa; identical to SEQ ID NO: 146120

SEQ ID NO: 205385 - RNA, 64 nt, hsa; identical to SEQ ID NO: 146121

SEQ ID NO: 205386 - RNA, 64 nt, hsa; identical to SEQ ID NO: 146122

SEQ ID NO: 205387 - RNA, 64 nt, hsa; identical to SEQ ID NO: 146123

SEQ ID NO: 205388 - RNA, 64 nt, hsa; identical to SEQ ID NO: 146124

SEQ ID NO: 205389 - RNA, 64 nt, hsa; identical to SEQ ID NO: 146125

SEQ ID NO: 205390 - RNA, 64 nt, hsa; identical to SEQ ID NO: 146126

SEQ ID NO: 205391 - RNA, 64 nt, hsa; identical to SEQ ID NO: 146127

SEQ ID NO: 205392 - RNA, 64 nt, hsa; identical to SEQ ID NO: 146128

SEQ ID NO: 205393 - RNA, 64 nt, hsa; identical to SEQ ID NO: 146129

SEQ ID NO: 205394 - RNA, 64 nt, hsa; identical to SEQ ID NO: 146130

SEQ ID NO: 205395 - RNA, 64 nt, hsa; identical to SEQ ID NO: 146131

SEQ ID NO: 205396 - RNA, 64 nt, hsa; identical to SEQ ID NO: 146132

SEQ ID NO: 205397 - RNA, 64 nt, hsa; identical to SEQ ID NO: 146133

SEQ ID NO: 205398 - RNA, 64 nt, hsa; identical to SEQ ID NO: 146134

SEQ ID NO: 205399 - RNA, 64 nt, hsa; identical to SEQ ID NO: 146135

SEQ ID NO: 205400 - RNA, 64 nt, hsa; identical to SEQ ID NO: 146136

SEQ ID NO: 205401 - RNA, 64 nt, hsa; identical to SEQ ID NO: 146137

SEQ ID NO: 205402 - RNA, 64 nt, hsa; identical to SEQ ID NO: 146138

SEQ ID NO: 205403 - RNA, 64 nt, hsa; identical to SEQ ID NO: 146139

SEQ ID NO: 205404 - RNA, 64 nt, hsa; identical to SEQ ID NO: 146140

SEQ ID NO: 205405 - RNA, 64 nt, hsa; identical to SEQ ID NO: 146141

SEQ ID NO: 205406 - RNA, 64 nt, hsa; identical to SEQ ID NO: 146142

SEQ ID NO: 205407 - RNA, 64 nt, hsa; identical to SEQ ID NO: 146143

SEQ ID NO: 205408 - RNA, 64 nt, hsa; identical to SEQ ID NO: 146144

SEQ ID NO: 205409 - RNA, 64 nt, hsa; identical to SEQ ID NO: 146145

SEQ ID NO: 205410 - RNA, 63 nt, hsa; identical to SEQ ID NO: 146146

SEQ ID NO: 205411 - RNA, 64 nt, hsa; identical to SEQ ID NO: 146147

SEQ ID NO: 205412 - RNA, 64 nt, hsa; identical to SEQ ID NO: 146148

SEQ ID NO: 205413 - RNA, 64 nt, hsa; identical to SEQ ID NO: 146149

SEQ ID NO: 205414 - RNA, 64 nt, hsa; identical to SEQ ID NO: 146150

SEQ ID NO: 205415 - RNA, 64 nt, hsa; identical to SEQ ID NO: 146151

SEQ ID NO: 205416 - RNA, 64 nt, hsa; identical to SEQ ID NO: 146152

SEQ ID NO: 205417 - RNA, 64 nt, hsa; identical to SEQ ID NO: 146153

SEQ ID NO: 205418 - RNA, 64 nt, hsa; identical to SEQ ID NO: 146154

SEQ ID NO: 205419 - RNA, 64 nt, hsa; identical to SEQ ID NO: 146155

SEQ ID NO: 205420 - RNA, 64 nt, hsa; identical to SEQ ID NO: 146156

SEQ ID NO: 205421 - RNA, 64 nt, hsa; identical to SEQ ID NO: 146157

SEQ ID NO: 205422 - RNA, 64 nt, hsa; identical to SEQ ID NO: 146158

SEQ ID NO: 205423 - RNA, 64 nt, hsa; identical to SEQ ID NO: 146159

SEQ ID NO: 205424 - RNA, 64 nt, hsa; identical to SEQ ID NO: 146160

SEQ ID NO: 205425 - RNA, 64 nt, hsa; identical to SEQ ID NO: 146161

SEQ ID NO: 205426 - RNA, 64 nt, hsa; identical to SEQ ID NO: 146162

SEQ ID NO: 205427 - RNA, 64 nt, hsa; identical to SEQ ID NO: 146163

SEQ ID NO: 205428 - RNA, 64 nt, hsa; identical to SEQ ID NO: 146164

SEQ ID NO: 205429 - RNA, 64 nt, hsa; identical to SEQ ID NO: 146165

SEQ ID NO: 205430 - RNA, 64 nt, hsa; identical to SEQ ID NO: 146166

SEQ ID NO: 205431 - RNA, 64 nt, hsa; identical to SEQ ID NO: 146167

SEQ ID NO: 205432 - RNA, 64 nt, hsa; identical to SEQ ID NO: 146168

SEQ ID NO: 205433 - RNA, 64 nt, hsa; identical to SEQ ID NO: 146169

SEQ ID NO: 205434 - RNA, 64 nt, hsa; identical to SEQ ID NO: 146170

SEQ ID NO: 205435 - RNA, 64 nt, hsa; identical to SEQ ID NO: 146171

SEQ ID NO: 205436 - RNA, 64 nt, hsa; identical to SEQ ID NO: 146172

SEQ ID NO: 205437 - RNA, 64 nt, hsa; identical to SEQ ID NO: 146173

SEQ ID NO: 205438 - RNA, 64 nt, hsa; identical to SEQ ID NO: 146174

SEQ ID NO: 205439 - RNA, 64 nt, hsa; identical to SEQ ID NO: 146175

SEQ ID NO: 205440 - RNA, 64 nt, hsa; identical to SEQ ID NO: 146176

SEQ ID NO: 205441 - RNA, 64 nt, hsa; identical to SEQ ID NO: 146177

SEQ ID NO: 205442 - RNA, 64 nt, hsa; identical to SEQ ID NO: 146178

SEQ ID NO: 205443 - RNA, 64 nt, hsa; identical to SEQ ID NO: 146179

SEQ ID NO: 205444 - RNA, 64 nt, hsa; identical to SEQ ID NO: 146180

SEQ ID NO: 205445 - RNA, 64 nt, hsa; identical to SEQ ID NO: 146181

SEQ ID NO: 205446 - RNA, 64 nt, hsa; identical to SEQ ID NO: 146182

SEQ ID NO: 205447 - RNA, 64 nt, hsa; identical to SEQ ID NO: 146183

SEQ ID NO: 205448 - RNA, 64 nt, hsa; identical to SEQ ID NO: 146184

SEQ ID NO: 205449 - RNA, 64 nt, hsa; identical to SEQ ID NO: 146185

SEQ ID NO: 205450 - RNA, 64 nt, hsa; identical to SEQ ID NO: 146186

SEQ ID NO: 205451 - RNA, 64 nt, hsa; identical to SEQ ID NO: 146187

SEQ ID NO: 205452 - RNA, 64 nt, hsa; identical to SEQ ID NO: 146188

SEQ ID NO: 205453 - RNA, 64 nt, hsa; identical to SEQ ID NO: 146189

SEQ ID NO: 205454 - RNA, 64 nt, hsa; identical to SEQ ID NO: 146190

SEQ ID NO: 205455 - RNA, 64 nt, hsa; identical to SEQ ID NO: 146191

SEQ ID NO: 205456 - RNA, 64 nt, hsa; identical to SEQ ID NO: 146192

SEQ ID NO: 205457 - RNA, 64 nt, hsa; identical to SEQ ID NO: 146193

SEQ ID NO: 205458 - RNA, 64 nt, hsa; identical to SEQ ID NO: 146194

SEQ ID NO: 205459 - RNA, 64 nt, hsa; identical to SEQ ID NO: 146195

SEQ ID NO: 205460 - RNA, 64 nt, hsa; identical to SEQ ID NO: 146196

SEQ ID NO: 205461 - RNA, 64 nt, hsa; identical to SEQ ID NO: 146197

SEQ ID NO: 205462 - RNA, 64 nt, hsa; identical to SEQ ID NO: 146198

SEQ ID NO: 205463 - RNA, 64 nt, hsa; identical to SEQ ID NO: 146199

SEQ ID NO: 205464 - RNA, 64 nt, hsa; identical to SEQ ID NO: 146200

SEQ ID NO: 205465 - RNA, 64 nt, hsa; identical to SEQ ID NO: 146201

SEQ ID NO: 205466 - RNA, 64 nt, hsa; identical to SEQ ID NO: 146202

SEQ ID NO: 205467 - RNA, 64 nt, hsa; identical to SEQ ID NO: 146203

SEQ ID NO: 205468 - RNA, 64 nt, hsa; identical to SEQ ID NO: 146204

SEQ ID NO: 205469 - RNA, 64 nt, hsa; identical to SEQ ID NO: 146205

SEQ ID NO: 205470 - RNA, 64 nt, hsa; identical to SEQ ID NO: 146206

SEQ ID NO: 205471 - RNA, 58 nt, hsa; identical to SEQ ID NO: 146207

SEQ ID NO: 205472 - RNA, 64 nt, hsa; identical to SEQ ID NO: 146208

SEQ ID NO: 205473 - RNA, 64 nt, hsa; identical to SEQ ID NO: 146209

SEQ ID NO: 205474 - RNA, 64 nt, hsa; identical to SEQ ID NO: 146210

SEQ ID NO: 205475 - RNA, 64 nt, hsa; identical to SEQ ID NO: 146211

SEQ ID NO: 205476 - RNA, 64 nt, hsa; identical to SEQ ID NO: 146212

SEQ ID NO: 205477 - RNA, 64 nt, hsa; identical to SEQ ID NO: 146213

SEQ ID NO: 205478 - RNA, 64 nt, hsa; identical to SEQ ID NO: 146214

SEQ ID NO: 205479 - RNA, 64 nt, hsa; identical to SEQ ID NO: 146215

SEQ ID NO: 205480 - RNA, 64 nt, hsa; identical to SEQ ID NO: 146216

SEQ ID NO: 205481 - RNA, 64 nt, hsa; identical to SEQ ID NO: 146217

SEQ ID NO: 205482 - RNA, 64 nt, hsa; identical to SEQ ID NO: 146218

SEQ ID NO: 205483 - RNA, 64 nt, hsa; identical to SEQ ID NO: 146219

SEQ ID NO: 205484 - RNA, 64 nt, hsa; identical to SEQ ID NO: 146220

SEQ ID NO: 205485 - RNA, 64 nt, hsa; identical to SEQ ID NO: 146221

SEQ ID NO: 205486 - RNA, 64 nt, hsa; identical to SEQ ID NO: 146222

SEQ ID NO: 205487 - RNA, 64 nt, hsa; identical to SEQ ID NO: 146223

SEQ ID NO: 205488 - RNA, 64 nt, hsa; identical to SEQ ID NO: 146224

SEQ ID NO: 205489 - RNA, 64 nt, hsa; identical to SEQ ID NO: 146225

SEQ ID NO: 205490 - RNA, 64 nt, hsa; identical to SEQ ID NO: 146226

SEQ ID NO: 205491 - RNA, 64 nt, hsa; identical to SEQ ID NO: 146227

SEQ ID NO: 205492 - RNA, 63 nt, hsa; identical to SEQ ID NO: 146228

SEQ ID NO: 205493 - RNA, 64 nt, hsa; identical to SEQ ID NO: 146229

SEQ ID NO: 205494 - RNA, 64 nt, hsa; identical to SEQ ID NO: 146230

SEQ ID NO: 205495 - RNA, 64 nt, hsa; identical to SEQ ID NO: 146231

SEQ ID NO: 205496 - RNA, 64 nt, hsa; identical to SEQ ID NO: 146232

SEQ ID NO: 205497 - RNA, 64 nt, hsa; identical to SEQ ID NO: 146233

SEQ ID NO: 205498 - RNA, 64 nt, hsa; identical to SEQ ID NO: 146234

SEQ ID NO: 205499 - RNA, 64 nt, hsa; identical to SEQ ID NO: 146235

SEQ ID NO: 205500 - RNA, 64 nt, hsa; identical to SEQ ID NO: 146236

SEQ ID NO: 205501 - RNA, 64 nt, hsa; identical to SEQ ID NO: 146237

SEQ ID NO: 205502 - RNA, 64 nt, hsa; identical to SEQ ID NO: 146238

SEQ ID NO: 205503 - RNA, 64 nt, hsa; identical to SEQ ID NO: 146239

SEQ ID NO: 205504 - RNA, 64 nt, hsa; identical to SEQ ID NO: 146240

SEQ ID NO: 205505 - RNA, 64 nt, hsa; identical to SEQ ID NO: 146241

SEQ ID NO: 205506 - RNA, 64 nt, hsa; identical to SEQ ID NO: 146242

SEQ ID NO: 205507 - RNA, 64 nt, hsa; identical to SEQ ID NO: 146243

SEQ ID NO: 205508 - RNA, 64 nt, hsa; identical to SEQ ID NO: 146244

SEQ ID NO: 205509 - RNA, 64 nt, hsa; identical to SEQ ID NO: 146245

SEQ ID NO: 205510 - RNA, 64 nt, hsa; identical to SEQ ID NO: 146246

SEQ ID NO: 205511 - RNA, 64 nt, hsa; identical to SEQ ID NO: 146247

SEQ ID NO: 205512 - RNA, 64 nt, hsa; identical to SEQ ID NO: 146248

SEQ ID NO: 205513 - RNA, 64 nt, hsa; identical to SEQ ID NO: 146249

SEQ ID NO: 205514 - RNA, 64 nt, hsa; identical to SEQ ID NO: 146250

SEQ ID NO: 205515 - RNA, 64 nt, hsa; identical to SEQ ID NO: 146251

SEQ ID NO: 205516 - RNA, 64 nt, hsa; identical to SEQ ID NO: 146252

SEQ ID NO: 205517 - RNA, 64 nt, hsa; identical to SEQ ID NO: 146253

SEQ ID NO: 205518 - RNA, 64 nt, hsa; identical to SEQ ID NO: 146254

SEQ ID NO: 205519 - RNA, 64 nt, hsa; identical to SEQ ID NO: 146255

SEQ ID NO: 205520 - RNA, 64 nt, hsa; identical to SEQ ID NO: 146256

SEQ ID NO: 205521 - RNA, 64 nt, hsa; identical to SEQ ID NO: 146257

SEQ ID NO: 205522 - RNA, 64 nt, hsa; identical to SEQ ID NO: 146258

SEQ ID NO: 205523 - RNA, 64 nt, hsa; identical to SEQ ID NO: 146259

SEQ ID NO: 205524 - RNA, 64 nt, hsa; identical to SEQ ID NO: 146260

SEQ ID NO: 205525 - RNA, 64 nt, hsa; identical to SEQ ID NO: 146261

SEQ ID NO: 205526 - RNA, 64 nt, hsa; identical to SEQ ID NO: 146262

SEQ ID NO: 205527 - RNA, 64 nt, hsa; identical to SEQ ID NO: 146263

SEQ ID NO: 205528 - RNA, 64 nt, hsa; identical to SEQ ID NO: 146264

SEQ ID NO: 205529 - RNA, 64 nt, hsa; identical to SEQ ID NO: 146265

SEQ ID NO: 205530 - RNA, 64 nt, hsa; identical to SEQ ID NO: 146266

SEQ ID NO: 205531 - RNA, 64 nt, hsa; identical to SEQ ID NO: 146267

SEQ ID NO: 205532 - RNA, 64 nt, hsa; identical to SEQ ID NO: 146268

SEQ ID NO: 205533 - RNA, 64 nt, hsa; identical to SEQ ID NO: 146269

SEQ ID NO: 205534 - RNA, 64 nt, hsa; identical to SEQ ID NO: 146270

SEQ ID NO: 205535 - RNA, 64 nt, hsa; identical to SEQ ID NO: 146271

SEQ ID NO: 205536 - RNA, 64 nt, hsa; identical to SEQ ID NO: 146272

SEQ ID NO: 205537 - RNA, 64 nt, hsa; identical to SEQ ID NO: 146273

SEQ ID NO: 205538 - RNA, 64 nt, hsa; identical to SEQ ID NO: 146274

SEQ ID NO: 205539 - RNA, 64 nt, hsa; identical to SEQ ID NO: 146275

SEQ ID NO: 205540 - RNA, 64 nt, hsa; identical to SEQ ID NO: 146276

SEQ ID NO: 205541 - RNA, 64 nt, hsa; identical to SEQ ID NO: 146277

SEQ ID NO: 205542 - RNA, 64 nt, hsa; identical to SEQ ID NO: 146278

SEQ ID NO: 205543 - RNA, 64 nt, hsa; identical to SEQ ID NO: 146279

SEQ ID NO: 205544 - RNA, 64 nt, hsa; identical to SEQ ID NO: 146280

SEQ ID NO: 205545 - RNA, 64 nt, hsa; identical to SEQ ID NO: 146281

SEQ ID NO: 205546 - RNA, 64 nt, hsa; identical to SEQ ID NO: 146282

SEQ ID NO: 205547 - RNA, 64 nt, hsa; identical to SEQ ID NO: 146283

SEQ ID NO: 205548 - RNA, 64 nt, hsa; identical to SEQ ID NO: 146284

SEQ ID NO: 205549 - RNA, 64 nt, hsa; identical to SEQ ID NO: 146285

SEQ ID NO: 205550 - RNA, 64 nt, hsa; identical to SEQ ID NO: 146286

SEQ ID NO: 205551 - RNA, 64 nt, hsa; identical to SEQ ID NO: 146287

SEQ ID NO: 205552 - RNA, 64 nt, hsa; identical to SEQ ID NO: 146288

SEQ ID NO: 205553 - RNA, 64 nt, hsa; identical to SEQ ID NO: 146289

SEQ ID NO: 205554 - RNA, 64 nt, hsa; identical to SEQ ID NO: 146290

SEQ ID NO: 205555 - RNA, 64 nt, hsa; identical to SEQ ID NO: 146291

SEQ ID NO: 205556 - RNA, 64 nt, hsa; identical to SEQ ID NO: 146292

SEQ ID NO: 205557 - RNA, 64 nt, hsa; identical to SEQ ID NO: 146293

SEQ ID NO: 205558 - RNA, 64 nt, hsa; identical to SEQ ID NO: 146294

SEQ ID NO: 205559 - RNA, 64 nt, hsa; identical to SEQ ID NO: 146295

SEQ ID NO: 205560 - RNA, 64 nt, hsa; identical to SEQ ID NO: 146296

SEQ ID NO: 205561 - RNA, 64 nt, hsa; identical to SEQ ID NO: 146297

SEQ ID NO: 205562 - RNA, 64 nt, hsa; identical to SEQ ID NO: 146298

SEQ ID NO: 205563 - RNA, 64 nt, hsa; identical to SEQ ID NO: 146299

SEQ ID NO: 205564 - RNA, 64 nt, hsa; identical to SEQ ID NO: 146300

SEQ ID NO: 205565 - RNA, 64 nt, hsa; identical to SEQ ID NO: 146301

SEQ ID NO: 205566 - RNA, 64 nt, hsa; identical to SEQ ID NO: 146302

SEQ ID NO: 205567 - RNA, 64 nt, hsa; identical to SEQ ID NO: 146303

SEQ ID NO: 205568 - RNA, 64 nt, hsa; identical to SEQ ID NO: 146304

SEQ ID NO: 205569 - RNA, 64 nt, hsa; identical to SEQ ID NO: 146305

SEQ ID NO: 205570 - RNA, 64 nt, hsa; identical to SEQ ID NO: 146306

SEQ ID NO: 205571 - RNA, 64 nt, hsa; identical to SEQ ID NO: 146307

SEQ ID NO: 205572 - RNA, 64 nt, hsa; identical to SEQ ID NO: 146308

SEQ ID NO: 205573 - RNA, 64 nt, hsa; identical to SEQ ID NO: 146309

SEQ ID NO: 205574 - RNA, 64 nt, hsa; identical to SEQ ID NO: 146310

SEQ ID NO: 205575 - RNA, 64 nt, hsa; identical to SEQ ID NO: 146311

SEQ ID NO: 205576 - RNA, 64 nt, hsa; identical to SEQ ID NO: 146312

SEQ ID NO: 205577 - RNA, 64 nt, hsa; identical to SEQ ID NO: 146313

SEQ ID NO: 205578 - RNA, 64 nt, hsa; identical to SEQ ID NO: 146314

SEQ ID NO: 205579 - RNA, 64 nt, hsa; identical to SEQ ID NO: 146315

SEQ ID NO: 205580 - RNA, 64 nt, hsa; identical to SEQ ID NO: 146316

SEQ ID NO: 205581 - RNA, 64 nt, hsa; identical to SEQ ID NO: 146317

SEQ ID NO: 205582 - RNA, 64 nt, hsa; identical to SEQ ID NO: 146318

SEQ ID NO: 205583 - RNA, 64 nt, hsa; identical to SEQ ID NO: 146319

SEQ ID NO: 205584 - RNA, 64 nt, hsa; identical to SEQ ID NO: 146320

SEQ ID NO: 205585 - RNA, 64 nt, hsa; identical to SEQ ID NO: 146321

SEQ ID NO: 205586 - RNA, 64 nt, hsa; identical to SEQ ID NO: 146322

SEQ ID NO: 205587 - RNA, 64 nt, hsa; identical to SEQ ID NO: 146323

SEQ ID NO: 205588 - RNA, 64 nt, hsa; identical to SEQ ID NO: 146324

SEQ ID NO: 205589 - RNA, 64 nt, hsa; identical to SEQ ID NO: 146325

SEQ ID NO: 205590 - RNA, 64 nt, hsa; identical to SEQ ID NO: 146326

SEQ ID NO: 205591 - RNA, 64 nt, hsa; identical to SEQ ID NO: 146327

SEQ ID NO: 205592 - RNA, 64 nt, hsa; identical to SEQ ID NO: 146328

SEQ ID NO: 205593 - RNA, 64 nt, hsa; identical to SEQ ID NO: 146329

SEQ ID NO: 205594 - RNA, 64 nt, hsa; identical to SEQ ID NO: 146330

SEQ ID NO: 205595 - RNA, 64 nt, hsa; identical to SEQ ID NO: 146331

SEQ ID NO: 205596 - RNA, 64 nt, hsa; identical to SEQ ID NO: 146332

SEQ ID NO: 205597 - RNA, 64 nt, hsa; identical to SEQ ID NO: 146333

SEQ ID NO: 205598 - RNA, 64 nt, hsa; identical to SEQ ID NO: 146334

SEQ ID NO: 205599 - RNA, 64 nt, hsa; identical to SEQ ID NO: 146335

SEQ ID NO: 205600 - RNA, 64 nt, hsa; identical to SEQ ID NO: 146336

SEQ ID NO: 205601 - RNA, 64 nt, hsa; identical to SEQ ID NO: 146337

SEQ ID NO: 205602 - RNA, 64 nt, hsa; identical to SEQ ID NO: 146338

SEQ ID NO: 205603 - RNA, 64 nt, hsa; identical to SEQ ID NO: 146339

SEQ ID NO: 205604 - RNA, 64 nt, hsa; identical to SEQ ID NO: 146340

SEQ ID NO: 205605 - RNA, 64 nt, hsa; identical to SEQ ID NO: 146341

SEQ ID NO: 205606 - RNA, 64 nt, hsa; identical to SEQ ID NO: 146342

SEQ ID NO: 205607 - RNA, 64 nt, hsa; identical to SEQ ID NO: 146343

SEQ ID NO: 205608 - RNA, 64 nt, hsa; identical to SEQ ID NO: 146344

SEQ ID NO: 205609 - RNA, 64 nt, hsa; identical to SEQ ID NO: 146345

SEQ ID NO: 205610 - RNA, 64 nt, hsa; identical to SEQ ID NO: 146346

SEQ ID NO: 205611 - RNA, 64 nt, hsa; identical to SEQ ID NO: 146347

SEQ ID NO: 205612 - RNA, 64 nt, hsa; identical to SEQ ID NO: 146348

SEQ ID NO: 205613 - RNA, 64 nt, hsa; identical to SEQ ID NO: 146349

SEQ ID NO: 205614 - RNA, 64 nt, hsa; identical to SEQ ID NO: 146350

SEQ ID NO: 205615 - RNA, 64 nt, hsa; identical to SEQ ID NO: 146351

SEQ ID NO: 205616 - RNA, 64 nt, hsa; identical to SEQ ID NO: 146352

SEQ ID NO: 205617 - RNA, 64 nt, hsa; identical to SEQ ID NO: 146353

SEQ ID NO: 205618 - RNA, 64 nt, hsa; identical to SEQ ID NO: 146354

SEQ ID NO: 205619 - RNA, 64 nt, hsa; identical to SEQ ID NO: 146355

SEQ ID NO: 205620 - RNA, 64 nt, hsa; identical to SEQ ID NO: 146356

SEQ ID NO: 205621 - RNA, 64 nt, hsa; identical to SEQ ID NO: 146357

SEQ ID NO: 205622 - RNA, 64 nt, hsa; identical to SEQ ID NO: 146358

SEQ ID NO: 205623 - RNA, 64 nt, hsa; identical to SEQ ID NO: 146359

SEQ ID NO: 205624 - RNA, 64 nt, hsa; identical to SEQ ID NO: 146360

SEQ ID NO: 205625 - RNA, 64 nt, hsa; identical to SEQ ID NO: 146361

SEQ ID NO: 205626 - RNA, 64 nt, hsa; identical to SEQ ID NO: 146362

SEQ ID NO: 205627 - RNA, 64 nt, hsa; identical to SEQ ID NO: 146363

SEQ ID NO: 205628 - RNA, 64 nt, hsa; identical to SEQ ID NO: 146364

SEQ ID NO: 205629 - RNA, 64 nt, hsa; identical to SEQ ID NO: 146365

SEQ ID NO: 205630 - RNA, 64 nt, hsa; identical to SEQ ID NO: 146366

SEQ ID NO: 205631 - RNA, 64 nt, hsa; identical to SEQ ID NO: 146367

SEQ ID NO: 205632 - RNA, 64 nt, hsa; identical to SEQ ID NO: 146368

SEQ ID NO: 205633 - RNA, 64 nt, hsa; identical to SEQ ID NO: 146369

SEQ ID NO: 205634 - RNA, 64 nt, hsa; identical to SEQ ID NO: 146370

SEQ ID NO: 205635 - RNA, 64 nt, hsa; identical to SEQ ID NO: 146371

SEQ ID NO: 205636 - RNA, 64 nt, hsa; identical to SEQ ID NO: 146372

SEQ ID NO: 205637 - RNA, 64 nt, hsa; identical to SEQ ID NO: 146373

SEQ ID NO: 205638 - RNA, 64 nt, hsa; identical to SEQ ID NO: 146374

SEQ ID NO: 205639 - RNA, 64 nt, hsa; identical to SEQ ID NO: 146375

SEQ ID NO: 205640 - RNA, 64 nt, hsa; identical to SEQ ID NO: 146376

SEQ ID NO: 205641 - RNA, 64 nt, hsa; identical to SEQ ID NO: 146377

SEQ ID NO: 205642 - RNA, 64 nt, hsa; identical to SEQ ID NO: 146378

SEQ ID NO: 205643 - RNA, 64 nt, hsa; identical to SEQ ID NO: 146379

SEQ ID NO: 205644 - RNA, 64 nt, hsa; identical to SEQ ID NO: 146380

SEQ ID NO: 205645 - RNA, 64 nt, hsa; identical to SEQ ID NO: 146381

SEQ ID NO: 205646 - RNA, 64 nt, hsa; identical to SEQ ID NO: 146382

SEQ ID NO: 205647 - RNA, 64 nt, hsa; identical to SEQ ID NO: 146383

SEQ ID NO: 205648 - RNA, 64 nt, hsa; identical to SEQ ID NO: 146384

SEQ ID NO: 205649 - RNA, 64 nt, hsa; identical to SEQ ID NO: 146385

SEQ ID NO: 205650 - RNA, 64 nt, hsa; identical to SEQ ID NO: 146386

SEQ ID NO: 205651 - RNA, 64 nt, hsa; identical to SEQ ID NO: 146387

SEQ ID NO: 205652 - RNA, 64 nt, hsa; identical to SEQ ID NO: 146388

SEQ ID NO: 205653 - RNA, 64 nt, hsa; identical to SEQ ID NO: 146389

SEQ ID NO: 205654 - RNA, 64 nt, hsa; identical to SEQ ID NO: 146390

SEQ ID NO: 205655 - RNA, 64 nt, hsa; identical to SEQ ID NO: 146391

SEQ ID NO: 205656 - RNA, 64 nt, hsa; identical to SEQ ID NO: 146392

SEQ ID NO: 205657 - RNA, 64 nt, hsa; identical to SEQ ID NO: 146393

SEQ ID NO: 205658 - RNA, 64 nt, hsa; identical to SEQ ID NO: 146394

SEQ ID NO: 205659 - RNA, 64 nt, hsa; identical to SEQ ID NO: 146395

SEQ ID NO: 205660 - RNA, 64 nt, hsa; identical to SEQ ID NO: 146396

SEQ ID NO: 205661 - RNA, 64 nt, hsa; identical to SEQ ID NO: 146397

SEQ ID NO: 205662 - RNA, 64 nt, hsa; identical to SEQ ID NO: 146398

SEQ ID NO: 205663 - RNA, 64 nt, hsa; identical to SEQ ID NO: 146399

SEQ ID NO: 205664 - RNA, 64 nt, hsa; identical to SEQ ID NO: 146400

SEQ ID NO: 205665 - RNA, 64 nt, hsa; identical to SEQ ID NO: 146401

SEQ ID NO: 205666 - RNA, 64 nt, hsa; identical to SEQ ID NO: 146402

SEQ ID NO: 205667 - RNA, 64 nt, hsa; identical to SEQ ID NO: 146403

SEQ ID NO: 205668 - RNA, 64 nt, hsa; identical to SEQ ID NO: 146404

SEQ ID NO: 205669 - RNA, 64 nt, hsa; identical to SEQ ID NO: 146405

SEQ ID NO: 205670 - RNA, 64 nt, hsa; identical to SEQ ID NO: 146406

SEQ ID NO: 205671 - RNA, 64 nt, hsa; identical to SEQ ID NO: 146407

SEQ ID NO: 205672 - RNA, 64 nt, hsa; identical to SEQ ID NO: 146408

SEQ ID NO: 205673 - RNA, 64 nt, hsa; identical to SEQ ID NO: 146409

SEQ ID NO: 205674 - RNA, 64 nt, hsa; identical to SEQ ID NO: 146410

SEQ ID NO: 205675 - RNA, 64 nt, hsa; identical to SEQ ID NO: 146411

SEQ ID NO: 205676 - RNA, 64 nt, hsa; identical to SEQ ID NO: 146412

SEQ ID NO: 205677 - RNA, 64 nt, hsa; identical to SEQ ID NO: 146413

SEQ ID NO: 205678 - RNA, 64 nt, hsa; identical to SEQ ID NO: 146414

SEQ ID NO: 205679 - RNA, 64 nt, hsa; identical to SEQ ID NO: 146415

SEQ ID NO: 205680 - RNA, 64 nt, hsa; identical to SEQ ID NO: 146416

SEQ ID NO: 205681 - RNA, 64 nt, hsa; identical to SEQ ID NO: 146417

SEQ ID NO: 205682 - RNA, 64 nt, hsa; identical to SEQ ID NO: 146418

SEQ ID NO: 205683 - RNA, 64 nt, hsa; identical to SEQ ID NO: 146419

SEQ ID NO: 205684 - RNA, 64 nt, hsa; identical to SEQ ID NO: 146420

SEQ ID NO: 205685 - RNA, 64 nt, hsa; identical to SEQ ID NO: 146421

SEQ ID NO: 205686 - RNA, 64 nt, hsa; identical to SEQ ID NO: 146422

SEQ ID NO: 205687 - RNA, 64 nt, hsa; identical to SEQ ID NO: 146423

SEQ ID NO: 205688 - RNA, 64 nt, hsa; identical to SEQ ID NO: 146424

SEQ ID NO: 205689 - RNA, 64 nt, hsa; identical to SEQ ID NO: 146425

SEQ ID NO: 205690 - RNA, 64 nt, hsa; identical to SEQ ID NO: 146426

SEQ ID NO: 205691 - RNA, 64 nt, hsa; identical to SEQ ID NO: 146427

SEQ ID NO: 205692 - RNA, 64 nt, hsa; identical to SEQ ID NO: 146428

SEQ ID NO: 205693 - RNA, 64 nt, hsa; identical to SEQ ID NO: 146429

SEQ ID NO: 205694 - RNA, 64 nt, hsa; identical to SEQ ID NO: 146430

SEQ ID NO: 205695 - RNA, 64 nt, hsa; identical to SEQ ID NO: 146431

SEQ ID NO: 205696 - RNA, 64 nt, hsa; identical to SEQ ID NO: 146432

SEQ ID NO: 205697 - RNA, 64 nt, hsa; identical to SEQ ID NO: 146433

SEQ ID NO: 205698 - RNA, 64 nt, hsa; identical to SEQ ID NO: 146434

SEQ ID NO: 205699 - RNA, 64 nt, hsa; identical to SEQ ID NO: 146435

SEQ ID NO: 205700 - RNA, 64 nt, hsa; identical to SEQ ID NO: 146436

SEQ ID NO: 205701 - RNA, 64 nt, hsa; identical to SEQ ID NO: 146437

SEQ ID NO: 205702 - RNA, 64 nt, hsa; identical to SEQ ID NO: 146438

SEQ ID NO: 205703 - RNA, 64 nt, hsa; identical to SEQ ID NO: 146439

SEQ ID NO: 205704 - RNA, 64 nt, hsa; identical to SEQ ID NO: 146440

SEQ ID NO: 205705 - RNA, 64 nt, hsa; identical to SEQ ID NO: 146441

SEQ ID NO: 205706 - RNA, 64 nt, hsa; identical to SEQ ID NO: 146442

SEQ ID NO: 205707 - RNA, 64 nt, hsa; identical to SEQ ID NO: 146443

SEQ ID NO: 205708 - RNA, 64 nt, hsa; identical to SEQ ID NO: 146444

SEQ ID NO: 205709 - RNA, 64 nt, hsa; identical to SEQ ID NO: 146445

SEQ ID NO: 205710 - RNA, 64 nt, hsa; identical to SEQ ID NO: 146446

SEQ ID NO: 205711 - RNA, 64 nt, hsa; identical to SEQ ID NO: 146447

SEQ ID NO: 205712 - RNA, 64 nt, hsa; identical to SEQ ID NO: 146448

SEQ ID NO: 205713 - RNA, 64 nt, hsa; identical to SEQ ID NO: 146449

SEQ ID NO: 205714 - RNA, 64 nt, hsa; identical to SEQ ID NO: 146450

SEQ ID NO: 205715 - RNA, 64 nt, hsa; identical to SEQ ID NO: 146451

SEQ ID NO: 205716 - RNA, 64 nt, hsa; identical to SEQ ID NO: 146452

SEQ ID NO: 205717 - RNA, 64 nt, hsa; identical to SEQ ID NO: 146453

SEQ ID NO: 205718 - RNA, 64 nt, hsa; identical to SEQ ID NO: 146454

SEQ ID NO: 205719 - RNA, 64 nt, hsa; identical to SEQ ID NO: 146455

SEQ ID NO: 205720 - RNA, 64 nt, hsa; identical to SEQ ID NO: 146456

SEQ ID NO: 205721 - RNA, 64 nt, hsa; identical to SEQ ID NO: 146457

SEQ ID NO: 205722 - RNA, 64 nt, hsa; identical to SEQ ID NO: 146458

SEQ ID NO: 205723 - RNA, 64 nt, hsa; identical to SEQ ID NO: 146459

SEQ ID NO: 205724 - RNA, 64 nt, hsa; identical to SEQ ID NO: 146460

SEQ ID NO: 205725 - RNA, 64 nt, hsa; identical to SEQ ID NO: 146461

SEQ ID NO: 205726 - RNA, 64 nt, hsa; identical to SEQ ID NO: 146462

SEQ ID NO: 205727 - RNA, 64 nt, hsa; identical to SEQ ID NO: 71859

SEQ ID NO: 205728 - RNA, 64 nt, hsa; identical to SEQ ID NO: 71860

SEQ ID NO: 205729 - RNA, 64 nt, hsa; identical to SEQ ID NO: 71861

SEQ ID NO: 205730 - RNA, 64 nt, hsa; identical to SEQ ID NO: 71862

SEQ ID NO: 205731 - RNA, 64 nt, hsa; identical to SEQ ID NO: 71863

SEQ ID NO: 205732 - RNA, 64 nt, hsa; identical to SEQ ID NO: 71864

SEQ ID NO: 205733 - RNA, 64 nt, hsa; identical to SEQ ID NO: 71865

SEQ ID NO: 205734 - RNA, 64 nt, hsa; identical to SEQ ID NO: 71866

SEQ ID NO: 205735 - RNA, 64 nt, hsa; identical to SEQ ID NO: 71867

SEQ ID NO: 205736 - RNA, 64 nt, hsa; identical to SEQ ID NO: 71868

SEQ ID NO: 205737 - RNA, 64 nt, hsa; identical to SEQ ID NO: 71869

SEQ ID NO: 205738 - RNA, 64 nt, hsa; identical to SEQ ID NO: 71870

SEQ ID NO: 205739 - RNA, 64 nt, hsa; identical to SEQ ID NO: 71871

SEQ ID NO: 205740 - RNA, 64 nt, hsa; identical to SEQ ID NO: 71872

SEQ ID NO: 205741 - RNA, 64 nt, hsa; identical to SEQ ID NO: 71873

SEQ ID NO: 205742 - RNA, 64 nt, hsa; identical to SEQ ID NO: 71874

SEQ ID NO: 205743 - RNA, 64 nt, hsa; identical to SEQ ID NO: 71875

SEQ ID NO: 205744 - RNA, 64 nt, hsa; identical to SEQ ID NO: 71876

SEQ ID NO: 205745 - RNA, 64 nt, hsa; identical to SEQ ID NO: 71877

SEQ ID NO: 205746 - RNA, 64 nt, hsa; identical to SEQ ID NO: 71878

SEQ ID NO: 205747 - RNA, 64 nt, hsa; identical to SEQ ID NO: 71879

SEQ ID NO: 205748 - RNA, 64 nt, hsa; identical to SEQ ID NO: 108766

SEQ ID NO: 205749 - RNA, 64 nt, hsa; identical to SEQ ID NO: 108767

SEQ ID NO: 205750 - RNA, 64 nt, hsa; identical to SEQ ID NO: 108768

SEQ ID NO: 205751 - RNA, 64 nt, hsa; identical to SEQ ID NO: 108769

SEQ ID NO: 205752 - RNA, 64 nt, hsa; identical to SEQ ID NO: 108770

SEQ ID NO: 205753 - RNA, 64 nt, hsa; identical to SEQ ID NO: 108771

SEQ ID NO: 205754 - RNA, 64 nt, hsa; identical to SEQ ID NO: 108772

SEQ ID NO: 205755 - RNA, 64 nt, hsa; identical to SEQ ID NO: 108773

SEQ ID NO: 205756 - RNA, 64 nt, hsa; identical to SEQ ID NO: 108774

SEQ ID NO: 205757 - RNA, 64 nt, hsa; identical to SEQ ID NO: 108775

SEQ ID NO: 205758 - RNA, 64 nt, hsa; identical to SEQ ID NO: 108776

SEQ ID NO: 205759 - RNA, 64 nt, hsa; identical to SEQ ID NO: 108777

SEQ ID NO: 205760 - RNA, 64 nt, hsa; identical to SEQ ID NO: 108778

SEQ ID NO: 205761 - RNA, 64 nt, hsa; identical to SEQ ID NO: 108779

SEQ ID NO: 205762 - RNA, 64 nt, hsa; identical to SEQ ID NO: 108780

SEQ ID NO: 205763 - RNA, 64 nt, hsa; identical to SEQ ID NO: 108781

SEQ ID NO: 205764 - RNA, 64 nt, hsa; identical to SEQ ID NO: 108782

SEQ ID NO: 205765 - RNA, 64 nt, hsa; identical to SEQ ID NO: 108783

SEQ ID NO: 205766 - RNA, 64 nt, hsa; identical to SEQ ID NO: 108784

SEQ ID NO: 205767 - RNA, 64 nt, hsa; identical to SEQ ID NO: 108785

SEQ ID NO: 205768 - RNA, 64 nt, hsa; identical to SEQ ID NO: 108786

SEQ ID NO: 205769 - RNA, 64 nt, hsa; identical to SEQ ID NO: 108787

SEQ ID NO: 205770 - RNA, 64 nt, hsa; identical to SEQ ID NO: 108788

SEQ ID NO: 205771 - RNA, 64 nt, hsa; identical to SEQ ID NO: 108789

SEQ ID NO: 205772 - RNA, 64 nt, hsa; identical to SEQ ID NO: 108790

SEQ ID NO: 205773 - RNA, 64 nt, hsa; identical to SEQ ID NO: 108791

SEQ ID NO: 205774 - RNA, 64 nt, hsa; identical to SEQ ID NO: 108792

SEQ ID NO: 205775 - RNA, 64 nt, hsa; identical to SEQ ID NO: 108793

SEQ ID NO: 205776 - RNA, 64 nt, hsa; identical to SEQ ID NO: 108794

SEQ ID NO: 205777 - RNA, 64 nt, hsa; identical to SEQ ID NO: 108795

SEQ ID NO: 205778 - RNA, 64 nt, hsa; identical to SEQ ID NO: 108796

SEQ ID NO: 205779 - RNA, 64 nt, hsa; identical to SEQ ID NO: 108797

SEQ ID NO: 205780 - RNA, 64 nt, hsa; identical to SEQ ID NO: 108798

SEQ ID NO: 205781 - RNA, 64 nt, hsa; identical to SEQ ID NO: 108799

SEQ ID NO: 205782 - RNA, 64 nt, hsa; identical to SEQ ID NO: 108800

SEQ ID NO: 205783 - RNA, 64 nt, hsa; identical to SEQ ID NO: 108801

SEQ ID NO: 205784 - RNA, 64 nt, hsa; identical to SEQ ID NO: 108802

SEQ ID NO: 205785 - RNA, 64 nt, hsa; identical to SEQ ID NO: 108803

SEQ ID NO: 205786 - RNA, 64 nt, hsa; identical to SEQ ID NO: 108804

SEQ ID NO: 205787 - RNA, 64 nt, hsa; identical to SEQ ID NO: 108805

SEQ ID NO: 205788 - RNA, 64 nt, hsa; identical to SEQ ID NO: 108806

SEQ ID NO: 205789 - RNA, 64 nt, hsa; identical to SEQ ID NO: 108807

SEQ ID NO: 205790 - RNA, 64 nt, hsa; identical to SEQ ID NO: 108808

SEQ ID NO: 205791 - RNA, 64 nt, hsa; identical to SEQ ID NO: 108809

SEQ ID NO: 205792 - RNA, 64 nt, hsa; identical to SEQ ID NO: 108810

SEQ ID NO: 205793 - RNA, 64 nt, hsa; identical to SEQ ID NO: 108811

SEQ ID NO: 205794 - RNA, 64 nt, hsa; identical to SEQ ID NO: 108812

SEQ ID NO: 205795 - RNA, 64 nt, hsa; identical to SEQ ID NO: 108813

SEQ ID NO: 205796 - RNA, 64 nt, hsa; identical to SEQ ID NO: 108814

SEQ ID NO: 205797 - RNA, 64 nt, hsa; identical to SEQ ID NO: 108815

SEQ ID NO: 205798 - RNA, 64 nt, hsa; identical to SEQ ID NO: 108816

SEQ ID NO: 205799 - RNA, 64 nt, hsa; identical to SEQ ID NO: 108817

SEQ ID NO: 205800 - RNA, 64 nt, hsa; identical to SEQ ID NO: 108818

SEQ ID NO: 205801 - RNA, 64 nt, hsa; identical to SEQ ID NO: 108819

SEQ ID NO: 205802 - RNA, 64 nt, hsa; identical to SEQ ID NO: 108820

SEQ ID NO: 205803 - RNA, 64 nt, hsa; identical to SEQ ID NO: 108821

SEQ ID NO: 205804 - RNA, 64 nt, hsa; identical to SEQ ID NO: 108822

SEQ ID NO: 205805 - RNA, 64 nt, hsa; identical to SEQ ID NO: 108823

SEQ ID NO: 205806 - RNA, 64 nt, hsa; identical to SEQ ID NO: 108824

SEQ ID NO: 205807 - RNA, 64 nt, hsa; identical to SEQ ID NO: 108825

SEQ ID NO: 205808 - RNA, 64 nt, hsa
accuuaaaaaguugauuuccuugaagcaguuugaaaauuugaauugagucuuaacuuuaggaaa

SEQ ID NO: 205809 - RNA, 64 nt, hsa
gucagacucuuuuaaggguauuuuaaaaauuaguaaauuugaaugaacuaaagauauaucucua

SEQ ID NO: 205810 - RNA, 64 nt, hsa
gaguauaaggugugacuauuggauucuugaacuaaaauuugacccugucuucaccuuuguucuc

SEQ ID NO: 205811 - RNA, 64 nt, hsa
uuagcugacuagggucagggaaacuuuucucuucaaauuugaaagcuguuucuguuuucauuuu

SEQ ID NO: 205812 - RNA, 64 nt, hsa
uuuagaauagacguucucauuuauauuaucuuccaaauuugaucaguuagcaaaacuuaauaca

SEQ ID NO: 205813 - RNA, 64 nt, hsa
uuaacagguuuguuucuuuuuaauguuuuaccuaaaauuugacaugcuuacaggacagguuugc

SEQ ID NO: 205814 - RNA, 64 nt, hsa
gaaaccuuuuaaauagccaguuugaauuggauguaaauuugaaauucuuuuuuuuuaagccaca

SEQ ID NO: 205815 - RNA, 64 nt, hsa
agaauugaaugaaaagucaggagaucagaauuuuaaauuugacuuagccacuaacuagccaugu

SEQ ID NO: 205816 - RNA, 64 nt, hsa
ucauugaaaacgguaccugacuaccauuugcuggaaauuugacauguguguggcauuaucaaaa

SEQ ID NO: 205817 - RNA, 64 nt, hsa
uuuuuguuuguugaaugacaaaggcaauaaaaauaaauuugacuuuagcuuuuuuucuauacuu

SEQ ID NO: 205818 - RNA, 64 nt, hsa
gaucuuugauaggucuuugguguugguuguaacaaaauuugauuugaacuaccuauaaaugaaa

SEQ ID NO: 205819 - RNA, 64 nt, hsa
aucuucuguugugugcuuuucaaacacuguaaauaaauuugaaauuugaauaacuuuccacagu

SEQ ID NO: 205820 - RNA, 63 nt, hsa
guugugugcuuuucaaacacuguaaauaaauuugaaauuugaauaacuuuccacaguauaacu

SEQ ID NO: 205821 - RNA, 64 nt, hsa
aaugagccacaaacaguaaagcccuaucaguauaaaauuugaaaaaaaaaaaaaagaugauugu

SEQ ID NO: 205822 - RNA, 64 nt, hsa
acuuucuguuuacuccuaacaaaauaaagcaagcaaauuugagucaaauauuggugcacuuuaa

SEQ ID NO: 205823 - RNA, 64 nt, hsa
ccuuagugcuucagacccagcaagaaauuauugaaaauuugaagccauuacuuccagcugguau

SEQ ID NO: 205824 - RNA, 64 nt, hsa
acaggauaaacuacauacacugaucccuugcaagaaauuugaucucaguuauaaucuaaauuac

SEQ ID NO: 205825 - RNA, 64 nt, hsa
gguuauauacaauuuaaauugggcuaaaaauuaaaaauuugaggauuuaacuugauauagcucu

SEQ ID NO: 205826 - RNA, 64 nt, hsa
ccuagaggagacuaauucucuuucuagcccauccaaauuugauaaauggaaccagagguuauau

SEQ ID NO: 205827 - RNA, 64 nt, hsa
guuguuuguguuuuuuaauguacaauguucugauaaauuugacuguuaaauugcuauagcuagc

SEQ ID NO: 205828 - RNA, 64 nt, hsa
gccuugcaaaaaacaccacaugaauaaagcaauaaaauuugauuguuaagauacaguaguggac

SEQ ID NO: 205829 - RNA, 64 nt, hsa
gcuuugcugaauucuaacauuaaaucacagcccaaaauuugauggacuaauuauuauuuuaaaa

SEQ ID NO: 205830 - RNA, 64 nt, hsa
aaaaagaguaauuucauuuaaauaucuguuauucaaauuugaugauguuaaauguaauauaaug

SEQ ID NO: 205831 - RNA, 64 nt, hsa
ugguaauaucacuaugcauuucuacacauuuuauaaauuugauuuaugcagauuuugauacacu

SEQ ID NO: 205832 - RNA, 64 nt, hsa
gaaauuguauaaauauucaaaauuuuauuaggauaaauuugagaaacuuacguauaucuuaauu

SEQ ID NO: 205833 - RNA, 64 nt, hsa
aauuuuauuuguuuuuguucuauguaaucaaauaaaauuugaguaacauguaaugguaaggauu

SEQ ID NO: 205834 - RNA, 64 nt, hsa
cuuugaauuagaauuuugcuguaauaaaguuucaaaauuugaauaaaauaauuaaauuuuuuga

SEQ ID NO: 205835 - RNA, 64 nt, hsa
gcaguggacauugggauuguugcuugaaaaauuaaaauuugaauauuuucucucucauuugcau

SEQ ID NO: 205836 - RNA, 64 nt, hsa
ccuuuuaaagaucaucucuucagagcugcaugguaaauuugaauuuccccauuguucucuagag

SEQ ID NO: 205837 - RNA, 64 nt, hsa
aucaaaacauguuuaggaaaauugguacugugauaaauuugaauccaaaauccuuuuaacuaug

SEQ ID NO: 205838 - RNA, 64 nt, hsa
ggucuagaugagacuuggaaggcaaggagcaucgaaauuugagauacccaggacccuuucaagc

SEQ ID NO: 205839 - RNA, 64 nt, hsa
ugaugaagagguuuuacuaucucucacugugggaaaauuugaugaaauauuugaacugucacau

SEQ ID NO: 205840 - RNA, 64 nt, hsa
uuuaaaagauauucuuacucauuugcuagguuguaaauuugauuucaccauuaagaaaagguaa

SEQ ID NO: 205841 - RNA, 64 nt, hsa
aauaaaugaacucaaucuaaauuaaaaaagaaagaaauuugaaaaaacuuucucuuugccauuu

SEQ ID NO: 205842 - RNA, 64 nt, hsa
acaguuucauuaacuccuucccccgcucccccaaaaauuugaauuuuuuuuucaacacucuuac

SEQ ID NO: 205843 - RNA, 64 nt, hsa
guauugaguuguaucgugugguguauuuuuuaaaaaauuugauuuagcauucauauuuuccauc

SEQ ID NO: 205844 - RNA, 64 nt, hsa
ucugccaguguuucuuugcuaagccuugcaugcaaaauuugaaauuuuaacauuggcacccaaa

SEQ ID NO: 205845 - RNA, 64 nt, hsa
aaugaguuugaaaagaaacaaugaaauguguuaaaaauuugaccauauuagauaaauuuucgug

SEQ ID NO: 205846 - RNA, 64 nt, hsa
ugaugacauccaauacagaguucugguaaagauaaaauuugauacagguuuggugucauuauaa

SEQ ID NO: 205847 - RNA, 64 nt, hsa
uucucauuuuucuaaaauacaauuuuguuucuccaaauuugacagcagaauaaaaacccuaccc

SEQ ID NO: 205848 - RNA, 64 nt, hsa
gugaaguaaaaccgauaccuguccugcaggucuaaaauuugaauggaaauucaagcacaaguac

SEQ ID NO: 205849 - RNA, 64 nt, hsa
uucuaauuuaaguaaguuugaguuuagucacugcaaauuugacugugacuuuaaucuaaauuac

SEQ ID NO: 205850 - RNA, 64 nt, hsa
uuauuuuaaauauuaacucuaaagcaggauuacuaaauuugauuaaucuggucaaugagaauca

SEQ ID NO: 205851 - RNA, 64 nt, hsa
uauauuaggaaacugcuucuaccuagauugaaagaaauuugacucauaaacuuccaaguuagaa

SEQ ID NO: 205852 - RNA, 64 nt, hsa
uucuuaauauguucaauguauggucauacuuuuuaaauuugauuuuuuaaauauuauaaguggu

SEQ ID NO: 205853 - RNA, 64 nt, hsa
ccauccugaauuuuauaaaugauuuuuuauuuaaaaauuugagauuuuuaaaauuuuucacagc

SEQ ID NO: 205854 - RNA, 64 nt, hsa
gaaacagaauucuaaaaugugaguucaauucaauaaauuugaauuucuguaggaagaaucaaau

SEQ ID NO: 205855 - RNA, 64 nt, hsa
aaaaucagcucuaaaaccaaagcugauuuuuagaaaauuugaaaauguaaaucagcccuaucca

SEQ ID NO: 205856 - RNA, 64 nt, hsa; identical to SEQ ID NO: 205855

SEQ ID NO: 205857 - RNA, 64 nt, hsa; identical to SEQ ID NO: 205854

SEQ ID NO: 205858 - RNA, 64 nt, hsa
uaacauauggucccaauuuauuaauacuucuguuaaauuugaugucaggucaacauuuuucaga

SEQ ID NO: 205859 - RNA, 64 nt, hsa
uguaaguuuuagauucuaagguucaagauuuuuaaaauuugauuuaaaugaagaaauggauuuu

SEQ ID NO: 205860 - RNA, 64 nt, hsa
uugccguguagaauuuuuuuuagauauccauuguaaauuugaaacaaagaccgaucuguguaaa

SEQ ID NO: 205861 - RNA, 64 nt, hsa
gcugcuagagugcagcauuugugacacguauuugaaauuugaaauuuccuucugcacuguauaa

SEQ ID NO: 205862 - RNA, 64 nt, hsa
aauuugaccucaauugacuacaaaauuuguaguuaaauuugacuacaauuggaaaugccaaaaa

SEQ ID NO: 205863 - RNA, 64 nt, hsa
uguguucaauguagacaaugcaaaauuuguaguuaaauuugaccucaauugacuacaaaauuug

SEQ ID NO: 205864 - RNA, 64 nt, hsa
aauuguaauguuuaucugcugcuuuuuuuaaauaaaauuugacugaaaauguuuaauuggcauu

SEQ ID NO: 205865 - RNA, 64 nt, hsa
cuauaguacaaaaugcauaaaccauguccccaggaaauuugaaaggaagcaggugcugaaugga

SEQ ID NO: 205866 - RNA, 64 nt, hsa
uuuaauguaaugagauaccuuuguucauuuuuuuaaauuugaaauauacuuuaccugauccacu

SEQ ID NO: 205867 - RNA, 64 nt, hsa
ccaucugauuggcugguaccgagagcuguggguaaaauuugaaaauuguauuuagaauaagaaa

SEQ ID NO: 205868 - RNA, 64 nt, hsa
gcaagaggaaucucuugaaaacaggggcacacagaaauuugauuuguggccaaauuggaugaaa

SEQ ID NO: 205869 - RNA, 64 nt, hsa
uuacgaguaaaguguaaugaguacuguggaaaccaaauuugaauacugcaaauuuguaggaguu

SEQ ID NO: 205870 - RNA, 64 nt, hsa
uaauccagaaauauaccuaauaagauugagugaaaaauuugagucaaauaucuagggcauucac

SEQ ID NO: 205871 - RNA, 64 nt, hsa
guaaaacaaaguaaaugaaauuuaaacaaaaaauaaauuugaucacaaaaugccacuugugugc

SEQ ID NO: 205872 - RNA, 64 nt, hsa
cuauuuauuucuggauggucauuaucuuguagccaaauuugacaauauaaaguaaggagcaaag

SEQ ID NO: 205873 - RNA, 64 nt, hsa
caaaaaaaaaaaggcccaagaagaagaaaaugaaaaauuugaagauuugagagcaugaagauau

SEQ ID NO: 205874 - RNA, 64 nt, hsa
uuuuccuaguuuaguaucaacauuuuagaaugucaaauuugaugccuugugaacaaguaauuuu

SEQ ID NO: 205875 - RNA, 64 nt, hsa
ggguaaguugaugccauuuauaaauguuuuauugaaauuugauauuuaaugagaagccgguuaa

SEQ ID NO: 205876 - RNA, 64 nt, hsa
cauaaauauguacuauuuuaauuaugucgaguguaaauuugacaucgcguugcauuuauuuuua

SEQ ID NO: 205877 - RNA, 64 nt, hsa
cacuggcacacacaaaaaaguaguuuuaagcuuguuugcacaguucuuuuuuuccauuggaaau

SEQ ID NO: 205878 - RNA, 64 nt, hsa
aagcagggagaauaaagauaauuguauuuuauguuuugcacacaaacgcagaauuuguauaacc

SEQ ID NO: 205879 - RNA, 64 nt, hsa
aaccuccaucuugaagcuucuaugguucauagucuuugcacaggaaccugugguuuuaacaaac

SEQ ID NO: 205880 - RNA, 64 nt, hsa
aaauguacugaaauaaucauuggaauauuugcauuuugcacaaugacugguaugauagcucuug

SEQ ID NO: 205881 - RNA, 64 nt, hsa
cagcuguugcauuucuugcuuauucuguuuuguuuuugcacaucauaauggauuuuucuuagug

SEQ ID NO: 205882 - RNA, 64 nt, hsa
aagguuuaugaauucaaguaauaauuagauuuuuuuugcacagacuuacuuaacuuccuuauug

SEQ ID NO: 205883 - RNA, 64 nt, hsa
cccaggcaaaccaguaguggagguuuuacauuuguuugcacaucucaguauauuucuguugagg

SEQ ID NO: 205884 - RNA, 64 nt, hsa
uugcacaucucaguauauuucuguugagguaaaguuugcacagucaucugacuucugaucaagc

SEQ ID NO: 205885 - RNA, 64 nt, hsa
aaggcagaaguuucaagauguguguuugucuguauuugcacauguguuuguguguguguguaug

SEQ ID NO: 205886 - RNA, 64 nt, hsa
gucggcgggaagcgugggagguguagcuccuacuuuugcacaggcaccagcuaccucagggaca

SEQ ID NO: 205887 - RNA, 64 nt, hsa
uuagauaaggacugagugcuuccguugcaggcaguuugcacaauaccuaauuaaccuuccuauu

SEQ ID NO: 205888 - RNA, 64 nt, hsa
uauuuuaaaauuauaaauagauaauauauuauuuuuugcacauugugaucaguuugcccagaau

SEQ ID NO: 205889 - RNA, 64 nt, hsa
cuagggcacuggacuuucuggcaugggggcuguguuugcacaaguuauuuucauguuaccugga

SEQ ID NO: 205890 - RNA, 64 nt, hsa
cuaaggagggucuggccagaggaacagaccagcuuuugcacaaugaagcgcaagggaacaagug

SEQ ID NO: 205891 - RNA, 64 nt, hsa
agccccagguugauucaaugccuugggaacuauuuuugcacauuggaagccucaaaaacagucc

SEQ ID NO: 205892 - RNA, 64 nt, hsa
agccaauucuuuuuuaucccuuuuagaaguagaauuugcacacuuacuacaauugaggaguguc

SEQ ID NO: 205893 - RNA, 64 nt, hsa
guaaagguauucguuaauccugugaaugguagcuuuugcacagaacuuccaaaagcaaaacaaa

SEQ ID NO: 205894 - RNA, 64 nt, hsa
guugaucuuaaaacuaguugauuuaaagaguuuuuuugcacaacauuucaauuauauuugugaa

SEQ ID NO: 205895 - RNA, 64 nt, hsa
aauauaaucuucccauguuauuuaacaaauuguuuuugcacauaucugauuauauugaaagcag

SEQ ID NO: 205896 - RNA, 64 nt, hsa
auucacacaaucguuuuucuaugugugagagggauuugcacacucuuauuuuucuguaaaauau

SEQ ID NO: 205897 - RNA, 64 nt, hsa
agaaaauuauuuuaaauuucuaaguuauaauaaauuugcacacagauaacaugcaugcuauuua

SEQ ID NO: 205898 - RNA, 64 nt, hsa
gcuuagccuagcagucagugacuuacuugcacuuuuugcacauagauauaaaguaaaauuaugu

SEQ ID NO: 205899 - RNA, 64 nt, hsa
aguaauacuuguauuuauuugaaacacugggcuguuugcacagcuccaacugugcaugcucaaa

SEQ ID NO: 205900 - RNA, 64 nt, hsa
aauauaagguacaugccuauacagaacuuaacauuuugcacagaauauaucaaauauauuuuga

SEQ ID NO: 205901 - RNA, 64 nt, hsa
cauauuauuguaauuuagguauguuuuguuuuguuuugcacaacuguaacccuguuguuacuuu

SEQ ID NO: 205902 - RNA, 64 nt, hsa
uauacuaguuccuacuuagaacaaaaguaucaaguuugcacacaaguaaucugccagcugaccu

SEQ ID NO: 205903 - RNA, 64 nt, hsa
auuugccucagauauaucuguccuaaugcuuauauuugcacaaguauguaaaauaucguguuga

SEQ ID NO: 205904 - RNA, 64 nt, hsa
ucuggcugcauugauggccagauugucugcugccuuugcacaucuagugcugguuucagaaauu

SEQ ID NO: 205905 - RNA, 64 nt, hsa
ugcaccagccuuuaaacacuuuucgugaagaaauuuugcacaguaguuuaaaucuuuuguuaau

SEQ ID NO: 205906 - RNA, 64 nt, hsa
gaucuuagagaaaaugaauauuuaaauuuuaaaguuugcacauuucaucuuuguccuaacauga

SEQ ID NO: 205907 - RNA, 64 nt, hsa
auuucuaaauuugauuauauucucugaugaucccuuugcacagaacuaugcuuaucucauguuu

SEQ ID NO: 205908 - RNA, 64 nt, hsa
agucuguacauauuuuuguaccuuuuauguaaauuuugcacagaaauuuuuggcauaaguuuau

SEQ ID NO: 205909 - RNA, 64 nt, hsa
uaguauguuuaggguucuguguucagauauuuuguuugcacacuacuuuuuaggaaacuuauaa

SEQ ID NO: 205910 - RNA, 64 nt, hsa
uacuuaaaauaagcguccaguuauaaaaagccuauuugcacaacuuuuugggaauacuucuauu

SEQ ID NO: 205911 - RNA, 64 nt, hsa
acacaauucagugguacuuggaauccuguuuuaauuugcacaaauuuaaauguagagagccccu

SEQ ID NO: 205912 - RNA, 64 nt, hsa
uuccagauuucacaccuacaauaauuccaaaagguuugcacauuagaguuuguaacaaaauauu

SEQ ID NO: 205913 - RNA, 64 nt, hsa
ugauuuaagucucacacacugugcuaauaaguccuuugcacauauuauuggauucuagagcaac

SEQ ID NO: 205914 - RNA, 64 nt, hsa
agaagagaugaucaauaacuaaaauguuuuucguuuugcacaugguaaaauuuuagguagagag

SEQ ID NO: 205915 - RNA, 64 nt, hsa
accuguugcagaagcgguuaucuuucuuuuuuacuuugcacaucaguguuagccuuucccuauu

SEQ ID NO: 205916 - RNA, 64 nt, hsa
ccuuucccuauuucagcacaaucuuagacucauauuugcacacuuuugugucgugaaguucuag

SEQ ID NO: 205917 - RNA, 64 nt, hsa
aggaugagggaacaggcaaggaacaaaggcaaccuuugcacacucaccugagcccuggggaccc

SEQ ID NO: 205918 - RNA, 64 nt, hsa
cccccugggaaugggggguacucacgcaccccgcuuugcacaccacagagugcccucacccacu

SEQ ID NO: 205919 - RNA, 64 nt, hsa
aaaaccuagcuggaauaauaaugccauauuguauuuugcacacugcuuuauuuucuagaggcuc

SEQ ID NO: 205920 - RNA, 64 nt, hsa
aaguucaguuauuagucugugaagugcuuuacuuuuugcacaauuuuaauagcuugcuauucag

SEQ ID NO: 205921 - RNA, 64 nt, hsa
cuaccuaaaauaaauaccaaagauaaugcauauuuuugcacaguggagcuuacacuuaaaagaa

SEQ ID NO: 205922 - RNA, 64 nt, hsa
gugauguacucuuauauuuuucugggcuuuuccuuuugcacauuccaaaauucauuucauaaga

SEQ ID NO: 205923 - RNA, 64 nt, hsa
uacacaauggcaguauuaacaagcauuuuaaaccuuugcacaugauauugaaccuguucaguuu

SEQ ID NO: 205924 - RNA, 64 nt, hsa
ccaaaguggcacaacugcacaguucucagauuucuuugcacagauugauuuuuauugcggguuu

SEQ ID NO: 205925 - RNA, 64 nt, hsa
cuuuccuaguuacucaaauugacuuucccccaccuuugcacaggugcuuucaauaguuuuaaaa

SEQ ID NO: 205926 - RNA, 64 nt, hsa
uacgaugcucuaaucauauugcauuuaauuuuauuuugcacagugaccuuguagccacaugaga

SEQ ID NO: 205927 - RNA, 64 nt, hsa
cuuccacccugacggccgcgccauggccaccaaguuugcacacuugaagcuguugcugcgacac

SEQ ID NO: 205928 - RNA, 64 nt, hsa
ucuguuucuguuguuuuguuuuuaacaacuauacuuugcacacaugaaggucacugugguuugu

SEQ ID NO: 205929 - RNA, 64 nt, hsa
ucacgaccugcaaggggccagcagggacguggccccacgccacacacaaccucuccacaugccu

SEQ ID NO: 205930 - RNA, 64 nt, hsa
aagaugguggcggcacacgcucccucccgcagcaccacgccagcuggugcggcccccacucucu

SEQ ID NO: 205931 - RNA, 64 nt, hsa
guaacagaccaggaggguggcggaggaacuccugccacgccacugugucaugaaggaaagugaa

SEQ ID NO: 205932 - RNA, 64 nt, hsa
acguggucuuggagcuucugacuaguucagacugccacgccaaccccagaaaauaccccacaug

SEQ ID NO: 205933 - RNA, 64 nt, hsa
aggcuggggccacacugcgggacagcagccccuccaccuggaccagggagggccuccaugugca

SEQ ID NO: 205934 - RNA, 64 nt, hsa
aggucgugagauagauguggaaugaccugagaggcaccuggagcccacuguuggccaccuugag

SEQ ID NO: 205935 - RNA, 64 nt, hsa
ggaguuuuucuuaaacuugucugauaauaagaaucaccuggaguuaggagguggugguugcagu

SEQ ID NO: 205936 - RNA, 64 nt, hsa
gcaaaacuccgucucaaaaguaaauaaaaauaaucaccuggaguuuguuaaaccauauggauuc

SEQ ID NO: 205937 - RNA, 64 nt, hsa
cucagggcauggucucaucuccgcaucaggaauucaccuggagguugaaaagagaaaagaaaaa

SEQ ID NO: 205938 - RNA, 64 nt, hsa
ccagaggcacauuccucuccaucuuuccaccgcacaccuggaccaggcuugcaggcugccagac

SEQ ID NO: 205939 - RNA, 64 nt, hsa
cuuaaaguggcuucaccuggaggggccagagggucaccuggagcuggggagacacaucugccuu

SEQ ID NO: 205940 - RNA, 64 nt, hsa
ccgauccauccugaguggagccuuaaaguggcuucaccuggaggggccagagggucaccuggag

SEQ ID NO: 205941 - RNA, 64 nt, hsa
ccccaugcucugcauuucuaggauauuucuaggacaccuggauuggcuccaucacaucagagug

SEQ ID NO: 205942 - RNA, 64 nt, hsa
augcaaaaaauacucuuuuuugcuccuuuacccccaccuggacccugggcuauuggcugcuccc

SEQ ID NO: 205943 - RNA, 64 nt, hsa
cccuucacacaccacagccaggaggggccuuucccaccuggagagaaacuuccagaccagcccc

SEQ ID NO: 205944 - RNA, 64 nt, hsa
agccccucauaccacagccaagaggggccuuucucaccuggagagaaauuuccagaccaucccc

SEQ ID NO: 205945 - RNA, 64 nt, hsa
ccucucacacaccacagccaggagaggccuuucccaccuggacagaaacuuccagaccagcccc

SEQ ID NO: 205946 - RNA, 64 nt, hsa
agccccucucaccacagccaggagaggccuuuaccaccuggagagaagcuuccagaccagcccc

SEQ ID NO: 205947 - RNA, 64 nt, hsa
agccccucacaccacagccaggagaggccuuucccaccuggagagaaacuuccagaccagcccc

SEQ ID NO: 205948 - RNA, 64 nt, hsa
agccccucauaccacagccaagaggggccuuucucaccuggagagaaacuuccagaccagcccc

SEQ ID NO: 205949 - RNA, 64 nt, hsa
agcccuucacaccacagccaggagaggccuuucccaccuggagagaaacuuccagaccagcccc

SEQ ID NO: 205950 - RNA, 64 nt, hsa
agccccucucaccacagccaggagaggccguucccaccuggagggaaaauugcuccuuugaugg

SEQ ID NO: 205951 - RNA, 64 nt, hsa
cuggugggauaugacuuagaaccagguggcuggucaccuggauguacagaagucuaacugguga

SEQ ID NO: 205952 - RNA, 64 nt, hsa
ucucucucuuuccaauuauuuaaccaguuacuuccaccuggacauacgauaggaaauucaaacu

SEQ ID NO: 205953 - RNA, 64 nt, hsa
uuuugugcuuuacaaaacugugaaggauuguggucaccuggaacaggucuccaaucuauguuag

SEQ ID NO: 205954 - RNA, 64 nt, hsa
agggaaaaacaauuuuauuaccugcuuaaugguccaccuggaacuaaaagggauacuauuuucu

SEQ ID NO: 205955 - RNA, 64 nt, hsa
cgggaggaguggcaucuggggcucuuggcccucccaccuggagccuguuacccguuagagagcu

SEQ ID NO: 205956 - RNA, 64 nt, hsa
ucucugucugauccuguccauucggaaccaggcccaccuggaaucccacaacaucagcucugug

SEQ ID NO: 205957 - RNA, 64 nt, hsa
gaaaacucuaaauauaacagacccuacagggggccaccuggaguuugucaccuauuuauucaca

SEQ ID NO: 205958 - RNA, 64 nt, hsa
gcuacugucacaucuugaucacagagcagaaaggcaccuggaaugcggcugcccaagcuugcag

SEQ ID NO: 205959 - RNA, 64 nt, hsa
ggggucggggggacuggggcaccagaccaggcaccaccuggacacuuucuuguugaauccuccc

SEQ ID NO: 205960 - RNA, 64 nt, hsa
caugaggaggccaacccuugccauugaccguggccaccuggacccaggccaggcccggcccggc

SEQ ID NO: 205961 - RNA, 64 nt, hsa
uuuuuaguacuugaugacucuaauuacaugaaugcaccuggaaugacauuuguaacagaagacg

SEQ ID NO: 205962 - RNA, 64 nt, hsa
gaaguacucaggauagugccuggcauguaggaagcaccuggaaaauauucgcugugauuaccau

SEQ ID NO: 205963 - RNA, 64 nt, hsa
ucagacucgcgucccacugcccacaggacacauccaccuggaugugacucacagguaccuccaa

SEQ ID NO: 205964 - RNA, 64 nt, hsa
ccucucucuccagagccguuucccuagcuuuuggcaccuggaugccacaguccuccauuaggcu

SEQ ID NO: 205965 - RNA, 64 nt, hsa
aauaaaguaaaaugugaaacucaacccacaucaccaccuggaaucagggauugcucacuccagg

SEQ ID NO: 205966 - RNA, 64 nt, hsa
ccuggacaggcaccuccaggcgccuacccuggagcaccuggagcuuaucccggagcaccugcac

SEQ ID NO: 205967 - RNA, 64 nt, hsa
ccuggagcaccuggagcuuaucccggagcaccugcaccuggagucuacccagggccacccagcg

SEQ ID NO: 205968 - RNA, 64 nt, hsa
gcacggcggccuaccuccacaccacaaccaccuucaccuggaugugcagccccuuccuggugag

SEQ ID NO: 205969 - RNA, 64 nt, hsa
ucucugcaacuaugcccccgaugaggaccaagggcaccuggaggacagcuggaccgguaucugc

SEQ ID NO: 205970 - RNA, 64 nt, hsa
uggaagugcaaccacccaaugucucuggaagugccaccuggaagugccaccuggaagugucucu

SEQ ID NO: 205971 - RNA, 64 nt, hsa
acccaaugucucuggaagugccaccuggaagugccaccuggaagugucucuggaagagcaccca

SEQ ID NO: 205972 - RNA, 64 nt, hsa
ccucugucggccuccucccgacuugacucaccgucaccuggaagcagggcaccagcugcugggg

SEQ ID NO: 205973 - RNA, 64 nt, hsa
agccagcaggguggaugcaaggggccucuacccacaccuggaccuccgugcccucaccccagcc

SEQ ID NO: 205974 - RNA, 64 nt, hsa
ugcuauuuccgaauaucugaauauugauuucuaacaccuggaugaggcugugaccgaucaacuu

SEQ ID NO: 205975 - RNA, 64 nt, hsa
uaaacuaauuccauugauuguuacuuaaauuuuccaccuggaaucauggauuuaaaauuucccc

SEQ ID NO: 205976 - RNA, 64 nt, hsa
gcuagcuguaggaguuuuuuugauagcccaguggcaccuggaaugccagugaaacagaaccgcu

SEQ ID NO: 205977 - RNA, 64 nt, hsa
ucuuuugguuccccaguccaaaacacagucauuucaccuggacuauuucaaucauuacacaggu

SEQ ID NO: 205978 - RNA, 64 nt, hsa
ucaccuuuauggaacugcugaucgaugcuggcuccaccuggaccagggauucauguggaguuuc

SEQ ID NO: 205979 - RNA, 64 nt, hsa
ccggugcuuugcacuaucucuaccuggccgccuucaccuggaugcugcuggagggugugcaccu

SEQ ID NO: 205980 - RNA, 64 nt, hsa
ccucacugagauccauguaaggggcuccucuucccaccuggaacuugugaguggggacccauga

SEQ ID NO: 205981 - RNA, 64 nt, hsa
aggcccaggaccauggcuggggaggauaugucagcaccuggaaguggagugcaggcugcagcgc

SEQ ID NO: 205982 - RNA, 64 nt, hsa
ggcugagacugggcugacaucuagaaucaccugccaccuggagccucaguaaaaugccuggggu

SEQ ID NO: 205983 - RNA, 64 nt, hsa
uugccugguguguguggcuccccucuucacugggcaccuggauccaggcccaccugugucccug

SEQ ID NO: 205984 - RNA, 54 nt, hsa
ugcgcaguggcaugaaguagacgccaccuggaugccccauccaccgcaugcggu

SEQ ID NO: 205985 - RNA, 64 nt, hsa
auccagcgagcccuccccacccacccacgguccucaccuggagcuguggccuggcuguggaggg

SEQ ID NO: 205986 - RNA, 64 nt, hsa
ggugaccaagcuggugaaccgcggcuaccagccccaccuggaggacuuucugcugcgcaucaac

SEQ ID NO: 205987 - RNA, 64 nt, hsa
caaggccgcugucgacuacuucuucguggagcugcaccuggaggcgcacuaugaggcacugcgg

SEQ ID NO: 205988 - RNA, 64 nt, hsa
gcagacuggagugaugcggccacaagcccagggacaccuggagcccccaggagcugggagaggc

SEQ ID NO: 205989 - RNA, 64 nt, hsa
uuuaguaaugaauuaucauucccaaacccguguccaccuggaacaucaggaugggaccauguuu

SEQ ID NO: 205990 - RNA, 64 nt, hsa; identical to SEQ ID NO: 199877

SEQ ID NO: 205991 - RNA, 64 nt, hsa; identical to SEQ ID NO: 199878

SEQ ID NO: 205992 - RNA, 64 nt, hsa; identical to SEQ ID NO: 199879

SEQ ID NO: 205993 - RNA, 64 nt, hsa; identical to SEQ ID NO: 199880

SEQ ID NO: 205994 - RNA, 64 nt, hsa; identical to SEQ ID NO: 199881

SEQ ID NO: 205995 - RNA, 64 nt, hsa; identical to SEQ ID NO: 199882

SEQ ID NO: 205996 - RNA, 64 nt, hsa; identical to SEQ ID NO: 199883

SEQ ID NO: 205997 - RNA, 64 nt, hsa; identical to SEQ ID NO: 199884

SEQ ID NO: 205998 - RNA, 64 nt, hsa; identical to SEQ ID NO: 199885

SEQ ID NO: 205999 - RNA, 64 nt, hsa; identical to SEQ ID NO: 199886

SEQ ID NO: 206000 - RNA, 64 nt, hsa; identical to SEQ ID NO: 199887

SEQ ID NO: 206001 - RNA, 64 nt, hsa; identical to SEQ ID NO: 199888

SEQ ID NO: 206002 - RNA, 64 nt, hsa; identical to SEQ ID NO: 199889

SEQ ID NO: 206003 - RNA, 64 nt, hsa; identical to SEQ ID NO: 199890

SEQ ID NO: 206004 - RNA, 64 nt, hsa; identical to SEQ ID NO: 199891

SEQ ID NO: 206005 - RNA, 64 nt, hsa; identical to SEQ ID NO: 199892

SEQ ID NO: 206006 - RNA, 64 nt, hsa; identical to SEQ ID NO: 199893

SEQ ID NO: 206007 - RNA, 64 nt, hsa; identical to SEQ ID NO: 199894

SEQ ID NO: 206008 - RNA, 64 nt, hsa; identical to SEQ ID NO: 199895

SEQ ID NO: 206009 - RNA, 64 nt, hsa; identical to SEQ ID NO: 199896

SEQ ID NO: 206010 - RNA, 64 nt, hsa; identical to SEQ ID NO: 199897

SEQ ID NO: 206011 - RNA, 64 nt, hsa
ggcaauaaauuuugguagacuaauacaguacagcuagacccagaaauuuggaaggcuguagauc

SEQ ID NO: 206012 - RNA, 64 nt, hsa
cguauaaaauauuuuaauuuucuuguauuucauuuagacccaagaacaugcugaccaauguguu

SEQ ID NO: 206013 - RNA, 64 nt, hsa
uuggcgugccacccccacaaccccugaggagguguagacccagucugagagccgcaagcacuga

SEQ ID NO: 206014 - RNA, 64 nt, hsa
cucgggggauuggggggacuggggaggcgcagccuagacccaauugcuugcccccaugaggcua

SEQ ID NO: 206015 - RNA, 64 nt, hsa
acucggggcaacacaguggaaaguggggaggccauagacccaaacaaguucuuugggccaggca

SEQ ID NO: 206016 - RNA, 64 nt, hsa
cacuguaaguaaacuuugguaacucuaauggggauagacccacuuaagauauuuaaaaagguau

SEQ ID NO: 206017 - RNA, 64 nt, hsa
acuagacuucccaaauaauuuuaauauauacuuuuagacccacagugaaaccacagaaggucau

SEQ ID NO: 206018 - RNA, 64 nt, hsa
cacccucagagauucugauuagguagaucuggaguagacccagaaauacacaguuuaaagaaaa

SEQ ID NO: 206019 - RNA, 64 nt, hsa
caguauauguuuuaaacuuugauguaaaccuuuuuagacccaaacuuguggaaguaucaugugu

SEQ ID NO: 206020 - RNA, 64 nt, hsa
ugcuuaauguaaauauaaacagucacaauuaguauagacccaucgauauauuuuugauaauuuu

SEQ ID NO: 206021 - RNA, 64 nt, hsa
uguugggacuggcucagagcccaugggggcuggaggggggcagcugggacucuggaaucuucuu

SEQ ID NO: 206022 - RNA, 64 nt, hsa
uucuccaggagcagggaggguggaggggagggauggggggcacaggagcugggagccccgucuc

SEQ ID NO: 206023 - RNA, 64 nt, hsa
ucugggcaucccgggugggggauuuuggggccguggggggcagucucugguaccugugugcguc

SEQ ID NO: 206024 - RNA, 64 nt, hsa
caaaaacgaccaccuccaggacucagugaucccuggggggcaggcucugccagcccucggccac

SEQ ID NO: 206025 - RNA, 64 nt, hsa
cuucucucagaaucagcgagcccagcuguaggguggggggcaggcucccccauggcaggguccu

SEQ ID NO: 206026 - RNA, 64 nt, hsa
cccaugccucagccucauacagaugugccaucauggggggcauggguggagcagaggggcuccc

SEQ ID NO: 206027 - RNA, 64 nt, hsa
acuuggggucuagaccaugguggugccagccuggggggggcaguggcccucagcucugcccgcu

SEQ ID NO: 206028 - RNA, 64 nt, hsa
gggacaugaggugagagguauccuggccgagggcggggggcagcggggggucucccuccggacc

SEQ ID NO: 206029 - RNA, 64 nt, hsa
aaggacuagauuuguuuaagaagaaaaaugaaaccagacccagaucaauauuuuaggauacuag

SEQ ID NO: 206030 - RNA, 64 nt, hsa
ggugggagaggagguagauggggaagaaauaccccagacccaacaaaccuccagccagaaagcc

SEQ ID NO: 206031 - RNA, 64 nt, hsa
cguccaggccgagcgcagacuguuuaggacucagcagacccagcaagaggcaucugcccuuucc

SEQ ID NO: 206032 - RNA, 64 nt, hsa
cagggcugggcugugcaccugccucccacugacccagacccacuuccuccagagaggccucucu

SEQ ID NO: 206033 - RNA, 64 nt, hsa
ugccugagggcaguacccuccauugggcacaguccagacccaagucaaagaugccccauuccuu

SEQ ID NO: 206034 - RNA, 64 nt, hsa
cagaccccuuugagagacgccacucccugggacacagacccaggacccccgaggggagggcagg

SEQ ID NO: 206035 - RNA, 64 nt, hsa
gggcucugcccuuagucaugacaucucgcugagccagacccacucuguuccuuggaaccuagag

SEQ ID NO: 206036 - RNA, 64 nt, hsa
gaaauuaaacacaaaugguaacauauuccaaaaccagacccaucuuguugccuauugugauaaa

SEQ ID NO: 206037 - RNA, 64 nt, hsa
aggaugacagacagggacgaagcagagaccucuacagacccaagucaccaaguggagccuuuuu

SEQ ID NO: 206038 - RNA, 64 nt, hsa
cuuucugacaaaggagccugcacauuugggugagcagacccaagcuguuuacagcucuuucuug

SEQ ID NO: 206039 - RNA, 64 nt, hsa
ggggccaaacgaggaaggacacagacccaaaagccagacccaggucccagcgcgcuucugggcu

SEQ ID NO: 206040 - RNA, 64 nt, hsa
aaugcggacaauuggggccaaacgaggaaggacacagacccaaaagccagacccaggucccagc

SEQ ID NO: 206041 - RNA, 64 nt, hsa
ucaggcccagccaaagcccccuccucagucuccacagacccacaugugagcagcccaggcccau

SEQ ID NO: 206042 - RNA, 64 nt, hsa
agagguaggugcucccucaggaucaggugcccugcagacccagagccaguuccuauccccuaac

SEQ ID NO: 206043 - RNA, 64 nt, hsa
gaguuguggugaggccaccaggcugaagucagcucagacccagaccucccugcuuaggccacuc

SEQ ID NO: 206044 - RNA, 64 nt, hsa
gccugugcuuguguuugcugcuaauguccagcuacagacccagaggauaagccacugggcacug

SEQ ID NO: 206045 - RNA, 64 nt, hsa
gcaggggaugguguggucaagcccucgucuagagcagacccagcccagaccucugacacauuag

SEQ ID NO: 206046 - RNA, 64 nt, hsa
gacacccacagcugcagcaggugaccuccccuuccagacccagccaugcugugauaccggcgga

SEQ ID NO: 206047 - RNA, 64 nt, hsa
ccccaaagacccuucaaccuccccagucccccaccagacccacccucucccugaaucuacccac

SEQ ID NO: 206048 - RNA, 64 nt, hsa
ucacuucucaggagcaggaacagccaggggaccucagacccaggguauuuucauaccagacuau

SEQ ID NO: 206049 - RNA, 64 nt, hsa
aggcggggaugcucccacgccacgugcacacacacagacccacauguggguggggggcacccuc

SEQ ID NO: 206050 - RNA, 64 nt, hsa
ggggagacaccccaccucccuccuccauggggcacagacccaacacaaggcggggaugcuccca

SEQ ID NO: 206051 - RNA, 64 nt, hsa
cuggaaguuucugccucacucagaaugggcaggacagacccacugacuggacuucagagucugg

SEQ ID NO: 206052 - RNA, 64 nt, hsa
cacagcccauggguggacucggcccccugggguucagacccagguccguucggccuagugauga

SEQ ID NO: 206053 - RNA, 64 nt, hsa
ggguuuuaggaggaaggcuuggcuccugucuucccagacccaccaugccuggagaggucaggau

SEQ ID NO: 206054 - RNA, 64 nt, hsa
cugggggcucccccauauucccaggcccagaagacagacccacagcccugcccuugucucugag

SEQ ID NO: 206055 - RNA, 64 nt, hsa
aaggcauauguauaaccaaacuccaagugauaaccagacccaucucuccuccaccuugacaaaa

SEQ ID NO: 206056 - RNA, 64 nt, hsa
gugauacccucaccuugggguaaugguccuaacccagacccagggucuggaagcuuaauguuga

SEQ ID NO: 206057 - RNA, 64 nt, hsa
gaaacagacccggacagacagacacagccugaaacagacccagacaaacagacagacagacaca

SEQ ID NO: 206058 - RNA, 64 nt, hsa
cccagacaaacagacagacagacacagccugaaacagacccagacagacagacagacagccuga

SEQ ID NO: 206059 - RNA, 64 nt, hsa
aacagacccagacagacagacagacagccugaaacagacccagacacagccugaaacagauccg

SEQ ID NO: 206060 - RNA, 64 nt, hsa
cagauccggacagacagacagaaacagccugaaacagacccagacagacagacagacacagccu

SEQ ID NO: 206061 - RNA, 64 nt, hsa
gaaacagaccuagacagacagacacagauugaaacagacccagacaaacagacagacacagccu

SEQ ID NO: 206062 - RNA, 64 nt, hsa
cagacccagacaaacagacagacacagccugaaacagacccagacacagccugaaacagacccg

SEQ ID NO: 206063 - RNA, 64 nt, hsa
cagacccggacagacagacagacacagccugaaacagacccagacagacagacagacacagccu

SEQ ID NO: 206064 - RNA, 64 nt, hsa
cagacccagacagacagacagacacagccugaaacagacccagacagacagaccgacgcagccu

SEQ ID NO: 206065 - RNA, 64 nt, hsa
gacccagagguccaggucccagccccuccucccucagacccagcgguccaaugccaccuagacu

SEQ ID NO: 206066 - RNA, 64 nt, hsa
acucagagguccaggcccccaaccccuccuuccccagacccagagguccaggucccagccccuc

SEQ ID NO: 206067 - RNA, 64 nt, hsa
cccaggaguccagaccccccagccccuccucccucagacccagggguccaggcccccaaccccu

SEQ ID NO: 206068 - RNA, 64 nt, hsa
ucccucagacccaggaguccagccccuccucccucagacccaggaguccagaccccccagcccc

SEQ ID NO: 206069 - RNA, 64 nt, hsa
cccaggaguccagaccccccagccccuccucccucagacccaggaguccagccccuccucccuc

SEQ ID NO: 206070 - RNA, 64 nt, hsa
aaccaaggguacagauccccagccccuccucccucagacccaggaguccagaccccccagcccc

SEQ ID NO: 206071 - RNA, 64 nt, hsa
acccgggaguccaggcccccagccccuccucccucagacccaggagccccaguccccagcaucc

SEQ ID NO: 206072 - RNA, 64 nt, hsa
gacccaggaguccaggccccagccccuccucccucagacccaggaguccaggcccccagccccu

SEQ ID NO: 206073 - RNA, 64 nt, hsa
acccaggauucccgggccccaguaccuccucccucagacccaggacuccaggcccccagccccu

SEQ ID NO: 206074 - RNA, 64 nt, hsa
auccaggagucuaguccuccagcuccuccucccucagacccaggauucccgggccccaguaccu

SEQ ID NO: 206075 - RNA, 64 nt, hsa
uuggaacugacagcugugugaggccugcacuucucagacccagacuuagaacaaaaggaggagu

SEQ ID NO: 206076 - RNA, 64 nt, hsa
ugcgggauucagcaccaggcucuucccaguaccccagacccacugugggucuucccgugggaug

SEQ ID NO: 206077 - RNA, 64 nt, hsa
uagaaacacacaggaacagagaaaugguugaugucagacccagacauagaauguuggagcaaaa

SEQ ID NO: 206078 - RNA, 64 nt, hsa
uggaaacccguagauacagagaaguggucgauuccagacccagacauagaauguuugaacaaag

SEQ ID NO: 206079 - RNA, 64 nt, hsa; identical to SEQ ID NO: 206021

SEQ ID NO: 206080 - RNA, 64 nt, hsa; identical to SEQ ID NO: 206022

SEQ ID NO: 206081 - RNA, 64 nt, hsa; identical to SEQ ID NO: 206023

SEQ ID NO: 206082 - RNA, 64 nt, hsa; identical to SEQ ID NO: 206024

SEQ ID NO: 206083 - RNA, 64 nt, hsa; identical to SEQ ID NO: 206025

SEQ ID NO: 206084 - RNA, 64 nt, hsa; identical to SEQ ID NO: 206026

SEQ ID NO: 206085 - RNA, 64 nt, hsa; identical to SEQ ID NO: 206027

SEQ ID NO: 206086 - RNA, 64 nt, hsa; identical to SEQ ID NO: 206028

SEQ ID NO: 206087 - RNA, 64 nt, hsa; identical to SEQ ID NO: 206029

SEQ ID NO: 206088 - RNA, 64 nt, hsa; identical to SEQ ID NO: 206030

SEQ ID NO: 206089 - RNA, 64 nt, hsa; identical to SEQ ID NO: 206031

SEQ ID NO: 206090 - RNA, 64 nt, hsa; identical to SEQ ID NO: 206032

SEQ ID NO: 206091 - RNA, 64 nt, hsa; identical to SEQ ID NO: 206033

SEQ ID NO: 206092 - RNA, 64 nt, hsa; identical to SEQ ID NO: 206034

SEQ ID NO: 206093 - RNA, 64 nt, hsa; identical to SEQ ID NO: 206035

SEQ ID NO: 206094 - RNA, 64 nt, hsa; identical to SEQ ID NO: 206036

SEQ ID NO: 206095 - RNA, 64 nt, hsa; identical to SEQ ID NO: 206037

SEQ ID NO: 206096 - RNA, 64 nt, hsa; identical to SEQ ID NO: 206038

SEQ ID NO: 206097 - RNA, 64 nt, hsa; identical to SEQ ID NO: 206039

SEQ ID NO: 206098 - RNA, 64 nt, hsa; identical to SEQ ID NO: 206040

SEQ ID NO: 206099 - RNA, 64 nt, hsa; identical to SEQ ID NO: 206041

SEQ ID NO: 206100 - RNA, 64 nt, hsa; identical to SEQ ID NO: 206042

SEQ ID NO: 206101 - RNA, 64 nt, hsa; identical to SEQ ID NO: 206043

SEQ ID NO: 206102 - RNA, 64 nt, hsa; identical to SEQ ID NO: 206044

SEQ ID NO: 206103 - RNA, 64 nt, hsa; identical to SEQ ID NO: 206045

SEQ ID NO: 206104 - RNA, 64 nt, hsa; identical to SEQ ID NO: 206046

SEQ ID NO: 206105 - RNA, 64 nt, hsa; identical to SEQ ID NO: 206047

SEQ ID NO: 206106 - RNA, 64 nt, hsa; identical to SEQ ID NO: 206048

SEQ ID NO: 206107 - RNA, 64 nt, hsa; identical to SEQ ID NO: 206049

SEQ ID NO: 206108 - RNA, 64 nt, hsa; identical to SEQ ID NO: 206050

SEQ ID NO: 206109 - RNA, 64 nt, hsa; identical to SEQ ID NO: 206051

SEQ ID NO: 206110 - RNA, 64 nt, hsa; identical to SEQ ID NO: 206052

SEQ ID NO: 206111 - RNA, 64 nt, hsa; identical to SEQ ID NO: 206053

SEQ ID NO: 206112 - RNA, 64 nt, hsa; identical to SEQ ID NO: 206054

SEQ ID NO: 206113 - RNA, 64 nt, hsa; identical to SEQ ID NO: 206055

SEQ ID NO: 206114 - RNA, 64 nt, hsa; identical to SEQ ID NO: 206056

SEQ ID NO: 206115 - RNA, 64 nt, hsa; identical to SEQ ID NO: 206057

SEQ ID NO: 206116 - RNA, 64 nt, hsa; identical to SEQ ID NO: 206058

SEQ ID NO: 206117 - RNA, 64 nt, hsa; identical to SEQ ID NO: 206059

SEQ ID NO: 206118 - RNA, 64 nt, hsa; identical to SEQ ID NO: 206060

SEQ ID NO: 206119 - RNA, 64 nt, hsa; identical to SEQ ID NO: 206061

SEQ ID NO: 206120 - RNA, 64 nt, hsa; identical to SEQ ID NO: 206062

SEQ ID NO: 206121 - RNA, 64 nt, hsa; identical to SEQ ID NO: 206063

SEQ ID NO: 206122 - RNA, 64 nt, hsa; identical to SEQ ID NO: 206064

SEQ ID NO: 206123 - RNA, 64 nt, hsa; identical to SEQ ID NO: 206065

SEQ ID NO: 206124 - RNA, 64 nt, hsa; identical to SEQ ID NO: 206066

SEQ ID NO: 206125 - RNA, 64 nt, hsa; identical to SEQ ID NO: 206067

SEQ ID NO: 206126 - RNA, 64 nt, hsa; identical to SEQ ID NO: 206068

SEQ ID NO: 206127 - RNA, 64 nt, hsa; identical to SEQ ID NO: 206069

SEQ ID NO: 206128 - RNA, 64 nt, hsa; identical to SEQ ID NO: 206070

SEQ ID NO: 206129 - RNA, 64 nt, hsa; identical to SEQ ID NO: 206071

SEQ ID NO: 206130 - RNA, 64 nt, hsa; identical to SEQ ID NO: 206072

SEQ ID NO: 206131 - RNA, 64 nt, hsa; identical to SEQ ID NO: 206073

SEQ ID NO: 206132 - RNA, 64 nt, hsa; identical to SEQ ID NO: 206074

SEQ ID NO: 206133 - RNA, 64 nt, hsa; identical to SEQ ID NO: 206075

SEQ ID NO: 206134 - RNA, 64 nt, hsa; identical to SEQ ID NO: 206076

SEQ ID NO: 206135 - RNA, 64 nt, hsa; identical to SEQ ID NO: 206077

SEQ ID NO: 206136 - RNA, 64 nt, hsa; identical to SEQ ID NO: 206078

SEQ ID NO: 206137 - RNA, 64 nt, hsa
acuaugcaggcaagacaccauaaaaguuuaauuccuuacagaagaaccaguggaagaauuuaaa

SEQ ID NO: 206138 - RNA, 64 nt, hsa
gagcacuuggauuauggaucugaauagagaaaugcuuacagauaaucauuagcccacauaccag

SEQ ID NO: 206139 - RNA, 64 nt, hsa
ugcucacagucucacaucugguuggggugggcuccuuacagaacacgcuuucacaguuacccua

SEQ ID NO: 206140 - RNA, 64 nt, hsa
aauauaucuauauuauuguauuuaaaauguguuucuuacagacugcauguaguuggguauaauu

SEQ ID NO: 206141 - RNA, 64 nt, hsa
uaauaaucauuauaugcagaccuuccucuuucaucuuacagaggcuuagugaggcucagaugag

SEQ ID NO: 206142 - RNA, 64 nt, hsa
cuuuuagaaagaaccaggagaacaaccaaagcagcuuacagacgccugaacggagaaugaagug

SEQ ID NO: 206143 - RNA, 64 nt, hsa
uuuuuagugcuaucaucauuccuaacaagacuaacuuacagaaaaauaauuauaucugacugau

SEQ ID NO: 206144 - RNA, 64 nt, hsa
gaaagaacaaccuuaaaacuuuuaacagauaaaacuuacagaaaccuaugauauagaauucaua

SEQ ID NO: 206145 - RNA, 64 nt, hsa
uaauuccuguuguauaugucuauucacauugggucuuacagaaccaucuggcuucauucuucuu

SEQ ID NO: 206146 - RNA, 64 nt, hsa
agauaugacauuuauucaaaguuaaaagcaaacacuuacagaauuaugaagagguaucuguuua

SEQ ID NO: 206147 - RNA, 64 nt, hsa
uuuuaaaauguuucugaaaagugaacagaguuaccuuacagaguuuuggaucuuuccagggaua

SEQ ID NO: 206148 - RNA, 64 nt, hsa
cuauuucagcagcaaaaacuuuuucaaggaaaaucuuacagaaccuuuaaacacgugugcauac

SEQ ID NO: 206149 - RNA, 64 nt, hsa
ccaagcaccccuuuuaucccauccccgagcaggccuuacagaccacacugcaggaagucaaaca

SEQ ID NO: 206150 - RNA, 64 nt, hsa
cugagaggaaccaacuccagguagagagccgcuccuuacagaauggagccuccaucaccggaac

SEQ ID NO: 206151 - RNA, 64 nt, hsa; identical to SEQ ID NO: 94836

SEQ ID NO: 206152 - RNA, 64 nt, hsa; identical to SEQ ID NO: 94837

SEQ ID NO: 206153 - RNA, 64 nt, hsa; identical to SEQ ID NO: 94838

SEQ ID NO: 206154 - RNA, 64 nt, hsa; identical to SEQ ID NO: 94839

SEQ ID NO: 206155 - RNA, 64 nt, hsa; identical to SEQ ID NO: 94840

SEQ ID NO: 206156 - RNA, 64 nt, hsa; identical to SEQ ID NO: 94841

SEQ ID NO: 206157 - RNA, 64 nt, hsa; identical to SEQ ID NO: 94842

SEQ ID NO: 206158 - RNA, 52 nt, hsa; identical to SEQ ID NO: 94843

SEQ ID NO: 206159 - RNA, 64 nt, hsa; identical to SEQ ID NO: 94844

SEQ ID NO: 206160 - RNA, 64 nt, hsa; identical to SEQ ID NO: 94845

SEQ ID NO: 206161 - RNA, 64 nt, hsa; identical to SEQ ID NO: 94846

SEQ ID NO: 206162 - RNA, 64 nt, hsa; identical to SEQ ID NO: 94847

SEQ ID NO: 206163 - RNA, 64 nt, hsa; identical to SEQ ID NO: 94848

SEQ ID NO: 206164 - RNA, 64 nt, hsa; identical to SEQ ID NO: 94849

SEQ ID NO: 206165 - RNA, 64 nt, hsa
cuuuccuuuguaagauuauuugaucagaauauuuuguaaugaaaggaucuagaaagcaacuugg

SEQ ID NO: 206166 - RNA, 64 nt, hsa
ugggaacuaacacgugccucguaaagguccccaauguaaugacugagcagaaaaucaaucacuu

SEQ ID NO: 206167 - RNA, 64 nt, hsa
cuggugagucaaauaggguguuuucuuuugaaacuguaaugaauauguuugccagucaaauggc

SEQ ID NO: 206168 - RNA, 64 nt, hsa
uguggcauguugguuuuuuaugugcuaaccuaacuguaaugaccuuuucuacaacauguuuuau

SEQ ID NO: 206169 - RNA, 64 nt, hsa
cccacggugcuuauuauuguuuaugagcuuccauuguaaugauuccuuuuuauuuguagcagca

SEQ ID NO: 206170 - RNA, 64 nt, hsa
gacuaccggguuuuuaaaaguagugucuggaguuuguaaugagcaccguggagacuauguauuu

SEQ ID NO: 206171 - RNA, 64 nt, hsa
ucuacugaucaaugccccugcagguugcauuuauuguaaugaaaaagaaagacugggauuaauc

SEQ ID NO: 206172 - RNA, 64 nt, hsa
ugcuccucaacuuaggcugugcgguuagccagccuguaaugagaggagagaggccugagucacc

SEQ ID NO: 206173 - RNA, 64 nt, hsa
ggucucuaaaaaagaaaaaaaaaaauaaaacugauguaaugaauauauaauuacaacaaaagag

SEQ ID NO: 206174 - RNA, 64 nt, hsa
auagaccaagguaaaaaucucaaagaaugagacuuguaaugagaaugccacaaacuugaauacc

SEQ ID NO: 206175 - RNA, 64 nt, hsa
aauuuuauuuuugacagacuggauggaaugaguguguaaugauugauaaagguuguaaauuuua

SEQ ID NO: 206176 - RNA, 64 nt, hsa
gagaguaaauggagggcauuauuaauaauuaucuuguaaugaacuuaaaucuggacuguuccag

SEQ ID NO: 206177 - RNA, 64 nt, hsa
ucacugauguuuguuccuguuaaauguauagcauuguaaugagagcccaucaaauccugagugu

SEQ ID NO: 206178 - RNA, 64 nt, hsa
aagaucuuuaauacuuuccaugaguacuaaagauuguaaugaguuaccuuauccuuagaaguag

SEQ ID NO: 206179 - RNA, 64 nt, hsa
uaaccaccacuguguaguugcagaaagcccuagauguaaugauaguguaaucauuuugaauugu

SEQ ID NO: 206180 - RNA, 64 nt, hsa
aggaaguuuucaaucagugugaucaguuugauucuguaaugagcacagcaccuaauauuuugag

SEQ ID NO: 206181 - RNA, 64 nt, hsa
ucaaagaauucacacaggagagaaagcacaugaauguaaugaauguggaaaagcuuucagucaa

SEQ ID NO: 206182 - RNA, 64 nt, hsa
ucacaaaaugcauaggaaagagaaaucguaugaauguaaugaguaugagggcaguuucagucau

SEQ ID NO: 206183 - RNA, 64 nt, hsa
caucagagcauucauaccaaagagaacucaugaauguaaugaagaugggaagauauuuaucaaa

SEQ ID NO: 206184 - RNA, 64 nt, hsa
accugagaagacacacuuggagaaaccuuuuggguguaaugaaugugggaaaaccuuucaucag

SEQ ID NO: 206185 - RNA, 64 nt, hsa
ccacagaacucauauaagacagaaacccuauggguguaaugaauguggaaaaucauucugugug

SEQ ID NO: 206186 - RNA, 64 nt, hsa
cugaaacugaacuugcucacaucaucugcuucccuguaaugaacuaugaggguucuuuauccua

SEQ ID NO: 206187 - RNA, 64 nt, hsa
cccuuuuuuuucauuuauacuuuuucauuuagauuguaaugauuaacagaaacagggguaccuu

SEQ ID NO: 206188 - RNA, 64 nt, hsa
auuuucaaaaugcaguaaucaaaaugugaucuaguguaaugaaauaaaaugugaucuaguguaa

SEQ ID NO: 206189 - RNA, 64 nt, hsa
cuuuuuuacccaaaauaauuuuuagagaaaaugauguaaugaaaaauuguaccaugaauuagga

SEQ ID NO: 206190 - RNA, 64 nt, hsa
uccccgccccaguggcugccucugucuugaccuguguaaugaauuagugugcugugucacugug

SEQ ID NO: 206191 - RNA, 64 nt, hsa
agugacuucuuacaacauccacauaagaauuuguuguaaugaguucauguccacccagauguug

SEQ ID NO: 206192 - RNA, 64 nt, hsa
gccaaaaacucacuaauaggggugagucuuuaauuguaaugacuuuguuuuauccacauuacau

SEQ ID NO: 206193 - RNA, 64 nt, hsa
gagaaaagaaagccuuuucaucuguaaugcagcuuguaaugaccagccugcagucaauucuuga

SEQ ID NO: 206194 - RNA, 64 nt, hsa
acaauuggaaaugccaaaaacucgagucuuuaauuguaaugacuuuguuuuauccacaguuaag

SEQ ID NO: 206195 - RNA, 64 nt, hsa; identical to SEQ ID NO: 206193

SEQ ID NO: 206196 - RNA, 64 nt, hsa
ugucaauauaaguuagaagcuuauucuugguuuguguaaugaauuuauguauuguagugaauac

SEQ ID NO: 206197 - RNA, 64 nt, hsa
guguguauuguauagcucuagcuguuugacuaucuguaaugaaaaugcugcacuucaacuggua

SEQ ID NO: 206198 - RNA, 64 nt, hsa
uaaggcuacaauucagaaucuucugaaccaucuauguaaugaauggggauuauacauuggaauu

SEQ ID NO: 206199 - RNA, 64 nt, hsa
ugaaucucagggauggcccacaacuggguccacauguaaugagcccuguuuaauaacgaagggg

SEQ ID NO: 206200 - RNA, 64 nt, hsa
uuugauuuguauucaaguacucuucaaguaucuuuguaaugaagguuuggcuacuuguauaggu

SEQ ID NO: 206201 - RNA, 64 nt, hsa
uugaaggcaaccagugcaaaggcuacuacacuuguguaaugauauuuagcagaugcauacagga

SEQ ID NO: 206202 - RNA, 64 nt, hsa
ugaaaaaauucauacuggagagaaaccauucaaauguaaugaaugugguaaagccuucucucga

SEQ ID NO: 206203 - RNA, 64 nt, hsa
uaugagaagucauacuggugagaaacccuuugaauguaaugaaugugggaaagcauucucucaa

SEQ ID NO: 206204 - RNA, 64 nt, hsa
uaggagaauucauacuggagagaaaccuuacaaguguaaugaguguggcaaagccuuuagugac

SEQ ID NO: 206205 - RNA, 64 nt, hsa
ucaggccauucaugguguagggaaacuugacuaauguaaugauugucacaaagucuucaguaac

SEQ ID NO: 206206 - RNA, 64 nt, hsa
ucaaagaauuccuacuggugagaaacccuaugaauguaaugaaugugagaaggccucuucuugu

SEQ ID NO: 206207 - RNA, 64 nt, hsa
ucagagaauucacaguggggagaaacccuaugaauguaaugaaugugggaaugccuucauuugu

SEQ ID NO: 206208 - RNA, 64 nt, hsa
ucaggcaauucaugguguagggaaacuugacuaauguaaugauugucacaaagucuucaguaau

SEQ ID NO: 206209 - RNA, 64 nt, hsa
uacuggacuucacacuggagagaaaccuuacaaguguaaugaguguggcaaagccuuuggcaag

SEQ ID NO: 206210 - RNA, 64 nt, hsa
aaaggcaauucguauuggagagaaacccuacaaguguaaugaauguggcauaguuuuuaaucaa

SEQ ID NO: 206211 - RNA, 64 nt, hsa
caaagccauucauacuggagagaaacuuuacaaguguaaugaauguggcaagguuuuuaaucaa

SEQ ID NO: 206212 - RNA, 64 nt, hsa
ucauagacuucauaguggagagaaaccuuaaaaguguaaugaguguggcaacaccuuccaucac

SEQ ID NO: 206213 - RNA, 53 nt, hsa
auaguggagagaaaccuugaaaguguaaugaguguggcaagaccuucagucag

SEQ ID NO: 206214 - RNA, 64 nt, hsa
ucaagcaauccaugguauagggaaacuugacuaauguaaugauugucacaaaguuuucaguaau

SEQ ID NO: 206215 - RNA, 64 nt, hsa
cuagaauucacacuggagagaaacucauuauaaguguaaugaguguggcaagaccguuggucaa

SEQ ID NO: 206216 - RNA, 53 nt, hsa
auaguggagagaagccuuaauaguguaaugaguguggcaagaccuuccaucac

SEQ ID NO: 206217 - RNA, 64 nt, hsa
cucaucugcaaauaugugaucagugccgguaauuuguaaugaaugaagcgguaggcagguucua

SEQ ID NO: 206218 - RNA, 64 nt, hsa
accucaguguacaauuuugaaagaaguuuugccuuguaaugaguaauaauuuagaaaguagaca

SEQ ID NO: 206219 - RNA, 64 nt, hsa
ggaguagcaacuaguuuuguagcacuacauuuaauguaaugagauaccuuuguucauuuuuuua

SEQ ID NO: 206220 - RNA, 64 nt, hsa
augccacagagcuauugauuaaucaguaaguaccuguaaugaguuuucagugaagcuuucucuc

SEQ ID NO: 206221 - RNA, 64 nt, hsa
acuugaauugugaggcaauaagauaccuucuauauguaaugaucacagaacuaacccuuauaau

SEQ ID NO: 206222 - RNA, 64 nt, hsa; identical to SEQ ID NO: 53591

SEQ ID NO: 206223 - RNA, 64 nt, hsa; identical to SEQ ID NO: 53592

SEQ ID NO: 206224 - RNA, 64 nt, hsa; identical to SEQ ID NO: 53593

SEQ ID NO: 206225 - RNA, 64 nt, hsa; identical to SEQ ID NO: 53594

SEQ ID NO: 206226 - RNA, 64 nt, hsa; identical to SEQ ID NO: 53595

SEQ ID NO: 206227 - RNA, 64 nt, hsa; identical to SEQ ID NO: 53596

SEQ ID NO: 206228 - RNA, 64 nt, hsa; identical to SEQ ID NO: 53597

SEQ ID NO: 206229 - RNA, 64 nt, hsa; identical to SEQ ID NO: 53598

SEQ ID NO: 206230 - RNA, 64 nt, hsa; identical to SEQ ID NO: 53599

SEQ ID NO: 206231 - RNA, 64 nt, hsa; identical to SEQ ID NO: 53600

SEQ ID NO: 206232 - RNA, 64 nt, hsa; identical to SEQ ID NO: 53601

SEQ ID NO: 206233 - RNA, 64 nt, hsa; identical to SEQ ID NO: 53602

SEQ ID NO: 206234 - RNA, 64 nt, hsa; identical to SEQ ID NO: 53603

SEQ ID NO: 206235 - RNA, 64 nt, hsa; identical to SEQ ID NO: 53604

SEQ ID NO: 206236 - RNA, 64 nt, hsa; identical to SEQ ID NO: 53605

SEQ ID NO: 206237 - RNA, 64 nt, hsa; identical to SEQ ID NO: 53606

SEQ ID NO: 206238 - RNA, 64 nt, hsa; identical to SEQ ID NO: 53607

SEQ ID NO: 206239 - RNA, 64 nt, hsa; identical to SEQ ID NO: 53608

SEQ ID NO: 206240 - RNA, 64 nt, hsa; identical to SEQ ID NO: 53609

SEQ ID NO: 206241 - RNA, 64 nt, hsa; identical to SEQ ID NO: 53610

SEQ ID NO: 206242 - RNA, 64 nt, hsa; identical to SEQ ID NO: 53611

SEQ ID NO: 206243 - RNA, 64 nt, hsa; identical to SEQ ID NO: 53612

SEQ ID NO: 206244 - RNA, 64 nt, hsa; identical to SEQ ID NO: 53613

SEQ ID NO: 206245 - RNA, 64 nt, hsa; identical to SEQ ID NO: 53614

SEQ ID NO: 206246 - RNA, 64 nt, hsa; identical to SEQ ID NO: 53615

SEQ ID NO: 206247 - RNA, 64 nt, hsa; identical to SEQ ID NO: 53616

SEQ ID NO: 206248 - RNA, 64 nt, hsa; identical to SEQ ID NO: 53617

SEQ ID NO: 206249 - RNA, 64 nt, hsa; identical to SEQ ID NO: 53618

SEQ ID NO: 206250 - RNA, 64 nt, hsa; identical to SEQ ID NO: 53619

SEQ ID NO: 206251 - RNA, 64 nt, hsa; identical to SEQ ID NO: 53620

SEQ ID NO: 206252 - RNA, 64 nt, hsa; identical to SEQ ID NO: 53621

SEQ ID NO: 206253 - RNA, 64 nt, hsa; identical to SEQ ID NO: 53622

SEQ ID NO: 206254 - RNA, 64 nt, hsa; identical to SEQ ID NO: 53623

SEQ ID NO: 206255 - RNA, 64 nt, hsa; identical to SEQ ID NO: 53624

SEQ ID NO: 206256 - RNA, 64 nt, hsa; identical to SEQ ID NO: 53625

SEQ ID NO: 206257 - RNA, 64 nt, hsa
uaggccucacucaacaaccaagcgccuggaggacgggacagauggacagacagccacccugaga

SEQ ID NO: 206258 - RNA, 64 nt, hsa
ggaggagcuucccacuccaggacuguugaugaaagggacagauugaggaggaagugggcucuga

SEQ ID NO: 206259 - RNA, 64 nt, hsa
agcggugugcggcggggggucugcacccgggugggggacagagggaccuuuaaagaaaacaaaa

SEQ ID NO: 206260 - RNA, 64 nt, hsa
gcacgccugggcguggcagccucacagggaacacgggacagacgccggcgacgcgcagacacac

SEQ ID NO: 206261 - RNA, 64 nt, hsa
cccaguucaagacuuagcuccuguugucaugacggggacagagugagggaaugguaguuaaggc

SEQ ID NO: 206262 - RNA, 64 nt, hsa
cugcccaugggaaguaaacugcagcaggccacuggggacagaagggcccauguacuuguuggga

SEQ ID NO: 206263 - RNA, 64 nt, hsa
auccuucucuuuccuggguugggaaggccaggcagggacagagcaaaugacacuucucuuccuc

SEQ ID NO: 206264 - RNA, 64 nt, hsa
ugagagcguguguagugcugcaucuuaugacaaggggacagacaagcugggacgucagggaaau

SEQ ID NO: 206265 - RNA, 64 nt, hsa
uguucaggacguccgggaggaagcaagcaugugggggacagaacaguaguccuggacucgaaag

SEQ ID NO: 206266 - RNA, 64 nt, hsa
cucgccucgaccccgcgccgggcaccuguggcuugggacagauagaagggaugguuggggauac

SEQ ID NO: 206267 - RNA, 64 nt, hsa
uggccgccucuccuugccaggccugccaacucaggggacagauggagcaggaguggagaaaggg

SEQ ID NO: 206268 - RNA, 64 nt, hsa
caacugucgcccccuucaggcuaagucucaggcagggacagacccagaaagaacacagucugcc

SEQ ID NO: 206269 - RNA, 64 nt, hsa
ccgcaccugcccucuggcaccagaugccagggaagggacagaggaaaacagccacaaacaagcc

SEQ ID NO: 206270 - RNA, 64 nt, hsa
uguacucguguuguguccauugugugugugcguggggacagaggccuggaaaugcggaggacua

SEQ ID NO: 206271 - RNA, 64 nt, hsa
ggccuccgcagcuggacagagagugggggagggagggacagacagaaggccaaggcccgaugug

SEQ ID NO: 206272 - RNA, 64 nt, hsa
uguggugugcagagguggggagguggcgaggauggggacagaaagcgcacagaaucuuggacca

SEQ ID NO: 206273 - RNA, 64 nt, hsa
cucuuaugugacaguaaaguuuuuuggggggguggggacagagaaguuaagagcuuucauccuu

SEQ ID NO: 206274 - RNA, 64 nt, hsa
uuggcugcauuuucuuaucugaucacaauggcaggggacagaaugugcauggaguggagcaugu

SEQ ID NO: 206275 - RNA, 64 nt, hsa
cuaggacccuuccuguggggggucuacagagucagggacagaagggaagggacccacaggaagu

SEQ ID NO: 206276 - RNA, 64 nt, hsa
guugggguugcugacaccccuugggugcagcuuugggacagaugaguggcucuguccugucacu

SEQ ID NO: 206277 - RNA, 64 nt, hsa
agggcaaggagaaggaaguacccuggggagggaagggacagaggaagcuauuccuggcuuuucc

SEQ ID NO: 206278 - RNA, 64 nt, hsa
gguggaggguccugggagauagucccagggguccgggacagaguggagucaagagcuggaaccu

SEQ ID NO: 206279 - RNA, 64 nt, hsa
ugaccugcgggcuugcuugcugacuccucucaaagggacagagcgccccugcuccagggaggag

SEQ ID NO: 206280 - RNA, 64 nt, hsa
uuggcacggucucugcuccccaccagggcagcacgggacagaaacgucacggaggaguagccuc

SEQ ID NO: 206281 - RNA, 64 nt, hsa
ccagcucugaaauggaguucucacaccguaucuagggacagaggcaucuggaugcaaacgcggg

SEQ ID NO: 206282 - RNA, 64 nt, hsa
agugccuucagggcuggccucggccucgagucucgggacagaggccgccaguggagaucauggc

SEQ ID NO: 206283 - RNA, 64 nt, hsa
caggggugauggagacuuuugauggcuuuuggcagggacagacuuggacacaaaaccgauccau

SEQ ID NO: 206284 - RNA, 64 nt, hsa
agaagggcccucccuccagccuaggucagagguggggacagagaacuccccuacagcccagaga

SEQ ID NO: 206285 - RNA, 64 nt, hsa
cuugccucugggcugggugagcuugaaguccucugggacagagaccugucuccacgccuccggg

SEQ ID NO: 206286 - RNA, 64 nt, hsa
aagaagguggggucgaggaguugccaauaaacuugggacagacuauugauggccaagcccaucu

SEQ ID NO: 206287 - RNA, 64 nt, hsa
aaauuaauuuccuuacaguuuuccuagcugaugagggacagaaccagaacuagagccugagccc

SEQ ID NO: 206288 - RNA, 64 nt, hsa
ucagagugaggcgggggccuuucggauaucacaugggacagaggaagagcccggcuggaaucug

SEQ ID NO: 206289 - RNA, 64 nt, hsa
aauucaagacagugacagcauuacgucaccccuggggacagaggucagccuaaggugacacacg

SEQ ID NO: 206290 - RNA, 64 nt, hsa
cucuccggacccccuucccccucaccuccaggcagggacagaauaaauguuuguauggauuuua

SEQ ID NO: 206291 - RNA, 64 nt, hsa
gggccugcugccuucccuccugcggggugggggugggacagaccccagugggggccagggccac

SEQ ID NO: 206292 - RNA, 64 nt, hsa
aacaaacaaacaaaaagagccagugggggagggagggacagagacccagagggcagcgucagac

SEQ ID NO: 206293 - RNA, 64 nt, hsa
gggagaaaacuguacucuguccagacaugauagagggacagagccaaaaggauagagaaagaga

SEQ ID NO: 206294 - RNA, 64 nt, hsa
agucaggcaucacuguuagucuuuugggacagaugggacagauguucacuuuaauguuuuacuu

SEQ ID NO: 206295 - RNA, 64 nt, hsa
uguccccaaagucaggcaucacuguuagucuuuugggacagaugggacagauguucacuuuaau

SEQ ID NO: 206296 - RNA, 64 nt, hsa
gaaggagauucuggcauguuggggugagggcagagggacagaugaggggaggagggugcuggcu

SEQ ID NO: 206297 - RNA, 64 nt, hsa
gaugauggaccccucagaggcaagacuaggaucagggacagaucuggaggcccaggacauggcu

SEQ ID NO: 206298 - RNA, 64 nt, hsa
agggugggagcaggggcuggcgugggaggucugggggacagacaaggaugauggaccccucaga

SEQ ID NO: 206299 - RNA, 64 nt, hsa
cuggaccccugagagcuucugaucccagcuauuagggacagaagaagccuccaaaucuggaagg

SEQ ID NO: 206300 - RNA, 64 nt, hsa
uuggucaggcacuaggaguggagcaugagcucuggggacagacaguuauggguucuggucccac

SEQ ID NO: 206301 - RNA, 64 nt, hsa; identical to SEQ ID NO: 51918

SEQ ID NO: 206302 - RNA, 64 nt, hsa; identical to SEQ ID NO: 51919

SEQ ID NO: 206303 - RNA, 64 nt, hsa; identical to SEQ ID NO: 51920

SEQ ID NO: 206304 - RNA, 64 nt, hsa; identical to SEQ ID NO: 51921

SEQ ID NO: 206305 - RNA, 64 nt, hsa; identical to SEQ ID NO: 51922

SEQ ID NO: 206306 - RNA, 64 nt, hsa; identical to SEQ ID NO: 51923

SEQ ID NO: 206307 - RNA, 64 nt, hsa; identical to SEQ ID NO: 51924

SEQ ID NO: 206308 - RNA, 64 nt, hsa; identical to SEQ ID NO: 51925

SEQ ID NO: 206309 - RNA, 64 nt, hsa; identical to SEQ ID NO: 51926

SEQ ID NO: 206310 - RNA, 64 nt, hsa; identical to SEQ ID NO: 51927

SEQ ID NO: 206311 - RNA, 64 nt, hsa; identical to SEQ ID NO: 51928

SEQ ID NO: 206312 - RNA, 64 nt, hsa; identical to SEQ ID NO: 51929

SEQ ID NO: 206313 - RNA, 64 nt, hsa; identical to SEQ ID NO: 51930

SEQ ID NO: 206314 - RNA, 64 nt, hsa; identical to SEQ ID NO: 51931

SEQ ID NO: 206315 - RNA, 64 nt, hsa; identical to SEQ ID NO: 51932

SEQ ID NO: 206316 - RNA, 64 nt, hsa; identical to SEQ ID NO: 51933

SEQ ID NO: 206317 - RNA, 64 nt, hsa; identical to SEQ ID NO: 51934

SEQ ID NO: 206318 - RNA, 64 nt, hsa; identical to SEQ ID NO: 51935

SEQ ID NO: 206319 - RNA, 64 nt, hsa; identical to SEQ ID NO: 51936

SEQ ID NO: 206320 - RNA, 64 nt, hsa; identical to SEQ ID NO: 51937

SEQ ID NO: 206321 - RNA, 64 nt, hsa; identical to SEQ ID NO: 51938

SEQ ID NO: 206322 - RNA, 64 nt, hsa; identical to SEQ ID NO: 51939

SEQ ID NO: 206323 - RNA, 64 nt, hsa; identical to SEQ ID NO: 51940

SEQ ID NO: 206324 - RNA, 64 nt, hsa; identical to SEQ ID NO: 51941

SEQ ID NO: 206325 - RNA, 64 nt, hsa; identical to SEQ ID NO: 51942

SEQ ID NO: 206326 - RNA, 64 nt, hsa; identical to SEQ ID NO: 51943

SEQ ID NO: 206327 - RNA, 64 nt, hsa; identical to SEQ ID NO: 51944

SEQ ID NO: 206328 - RNA, 64 nt, hsa
cagaccuggacagacagacacagccugaaacagacccggacagacagacacagccugaaacaga

SEQ ID NO: 206329 - RNA, 64 nt, hsa
cccagacagacagacagacacagccugaaacagacccggacagacagacagacacagccugaaa

SEQ ID NO: 206330 - RNA, 64 nt, hsa
cccggacagacagacagacacagccugaaacagacccggacagacagacagacacagccugaaa

SEQ ID NO: 206331 - RNA, 64 nt, hsa; identical to SEQ ID NO: 206330

SEQ ID NO: 206332 - RNA, 64 nt, hsa
gccugaaacagacccagacacagccugaaacagacccggacagacagacagacacagccugaaa

SEQ ID NO: 206333 - RNA, 64 nt, hsa
gaugggagccagcaccagcaggauccgagggcgccccggacagaggucugccccacccacuucc

SEQ ID NO: 206334 - RNA, 64 nt, hsa
ccgcuggagaggcaccaugggcguggaggggcuucccggacaccgcccacccgggacccgccuc

SEQ ID NO: 206335 - RNA, 64 nt, hsa
uagaguugaaaggauugacauuucucaguaacuacccggcaaaauauauauuuucauaauguug

SEQ ID NO: 206336 - RNA, 64 nt, hsa
uccaagaugggaaacaugucgugugucugcacgccccggcaaacugccgccacucguucugcug

SEQ ID NO: 206337 - RNA, 64 nt, hsa
gaagaggggacuucugcaacagauucuguuucuuuuucccgacucuuuuccuugcugccaggua

SEQ ID NO: 206338 - RNA, 64 nt, hsa
ggcuuugcuacugacauacucaggcacagagaaauuucccgagcucugugguaagugugguccc

SEQ ID NO: 206339 - RNA, 64 nt, hsa
ugagugggguauaugcauaagugggagagaaaaaccaaacaaucuacuucaguucaguguaacu

SEQ ID NO: 206340 - RNA, 64 nt, hsa
uuccacucacagggagaugggauuccuuucuuguccaaacaaagggaguugcucuaaagcgagc

SEQ ID NO: 206341 - RNA, 64 nt, hsa
guuccuggaucucccauauuugugaugagacuagccaaacaaucucgucaucuggaggugcaga

SEQ ID NO: 206342 - RNA, 64 nt, hsa
gauggcagaucacuaugugccagugccuggaggaccaaacaacaacaacuaugcaaauguggaa

SEQ ID NO: 206343 - RNA, 64 nt, hsa
uagaucugaaauucagaguguagcucugagacuugcuuccaaagucauuucccaccacaugcag

SEQ ID NO: 206344 - RNA, 64 nt, hsa
cccaaaggaguucuugaucuggacgauggauauugcuuccaaugaaagguuugcccccaaaacc

SEQ ID NO: 206345 - RNA, 64 nt, hsa
aagaccuguggcuacugguagagaauuggaauaagcuuccaacaauggacuguagagauuaaug

SEQ ID NO: 206346 - RNA, 64 nt, hsa
ugguguaaagccaacucgaggggaaucugaauaagcuuccaaaauuuuuuuuuuuaagaaauaa

SEQ ID NO: 206347 - RNA, 64 nt, hsa
ccugcucuaucuuggguuucuuaauugcuuccaagcuuccaaaggcucuuuucagagccacuua

SEQ ID NO: 206348 - RNA, 64 nt, hsa
cauaauccccugcucuaucuuggguuucuuaauugcuuccaagcuuccaaaggcucuuuucaga

SEQ ID NO: 206349 - RNA, 64 nt, hsa
cagccacuuguggaauucuuugaagagcucagaggcuuccaagugaucugcuccugaacaaguu

SEQ ID NO: 206350 - RNA, 64 nt, hsa
ccuagcagaccuggauuuuucuuccugaucugcugcuuccaaguugugugaccuuggcuaaguc

SEQ ID NO: 206351 - RNA, 64 nt, hsa
gagugucgguguguggcacagaaggcuccugcuugcuuccaaagugauggacaggaaggggcag

SEQ ID NO: 206352 - RNA, 64 nt, hsa
cccaaacccagcacuccagacucgagggaagccagcuuccaagaacuggaaugcguacgucuuu

SEQ ID NO: 206353 - RNA, 64 nt, hsa
cccgaggcgugcuuccuuccugauugucucuagagcuuccaaguccugggaaugugcggggcca

SEQ ID NO: 206354 - RNA, 64 nt, hsa
ucuggucaggaacccucagggacccaggaacucagcuuccaaacaucugcaccuugaccggacu

SEQ ID NO: 206355 - RNA, 64 nt, hsa
uggccgugcccgaugugcaccucccagaagugcagcuuccaaaagucccagagaugaagcuccc

SEQ ID NO: 206356 - RNA, 64 nt, hsa
cgaaagugccagagaugaaagucccugagaugaagcuuccaaaggugccugagaugaaacuucc

SEQ ID NO: 206357 - RNA, 64 nt, hsa
cugaagugaagcuccccaaggcuccugaggucaagcuuccaaaagugcccgaggcagcccuucc

SEQ ID NO: 206358 - RNA, 64 nt, hsa
auguuuaugauauggugucuuuuucuugaaacaagcuuccaagggcuagaaauaaaauagccaa

SEQ ID NO: 206359 - RNA, 64 nt, hsa
ugcuguuccaucccagcuugaauuggugccacaagcuuccaaguuggcauuuuuucuagaaccu

SEQ ID NO: 206360 - RNA, 64 nt, hsa
ccuuagcacccagcaugugaccccacuccugaucaggucccagcaucuucccuucuuguucugu

SEQ ID NO: 206361 - RNA, 64 nt, hsa
gucccagcaucuucccuucuuguucuguuccuuaaggucccagcaccuuaccccaggacuuggu

SEQ ID NO: 206362 - RNA, 64 nt, hsa
uucuuagaauaucuaagaaucuuuguuagauauuaggucccaucaauucuuagaauaucuaaac

SEQ ID NO: 206363 - RNA, 64 nt, hsa
auauucuuaaugacauuucacugaugcuucuaucaggucccaucaauucuuagaauaucuaaga

SEQ ID NO: 206364 - RNA, 64 nt, hsa
gcugcccagaggaccccacgccucucagaggcagaggucccaugacagccuuugacccacaacg

SEQ ID NO: 206365 - RNA, 64 nt, hsa
cgcugcuauggaggcugccuccuagucucccaccaggucccaggcuguggaaagccccagccca

SEQ ID NO: 206366 - RNA, 64 nt, hsa
uccgacauguacugcuaguaccuguaagcauuuuaggucccagaauggaaaaaaaaaucagcua

SEQ ID NO: 206367 - RNA, 64 nt, hsa
caggccacuccaaucacccuacaagaugccaaggaggucccaggaaguccagcuccuuaaacug

SEQ ID NO: 206368 - RNA, 64 nt, hsa
gagugaccacggccccaagcccagggcuggaggcaggucccaggacgcgccgcucccucaugcu

SEQ ID NO: 206369 - RNA, 64 nt, hsa
gagugaccgcggccccgagccuggggcuggacgcaggucccaggacgugcugcucccuugugug

SEQ ID NO: 206370 - RNA, 64 nt, hsa
gagugaccgcggccccgagccuggggcuggacgcaggucccaggacaugcugcucccuugugug

SEQ ID NO: 206371 - RNA, 64 nt, hsa
cuagaccugccaggagcacuuggccugcaggggcaggucccagccgcuaaaaugggcaagggag

SEQ ID NO: 206372 - RNA, 64 nt, hsa
agguagccaaggucagcccugaggccagggugaaaggucccagacuucgaaugcccaccuuugg

SEQ ID NO: 206373 - RNA, 64 nt, hsa
uuucaguuaugcucuuuuaguugcaaggaaucucaagugggacaaacauaaaaagacucaaaag

SEQ ID NO: 206374 - RNA, 64 nt, hsa
ggcaaccagagccucagcauccaaagauggacugaagugggauggcugacaggcacauaacuua

SEQ ID NO: 206375 - RNA, 64 nt, hsa
gaaacuuuggccacuuggcuguucauuuuauucuaagugggauagggacauaccuaccuggauu

SEQ ID NO: 206376 - RNA, 64 nt, hsa
accaggaggagcucuucguaguccagaaagguagaagugggaguuguuuacuuaauuuuacugu

SEQ ID NO: 206377 - RNA, 64 nt, hsa
gcacaguacugggaagugggagcacaguacugagaagugggagcacaguacugagaaaugggag

SEQ ID NO: 206378 - RNA, 64 nt, hsa
gcacaguauugggaaaugggagcacaguacugggaagugggagcacaguacugagaagugggag

SEQ ID NO: 206379 - RNA, 64 nt, hsa
cacuguggcuccucuguuuuacauacucauuaguaagugggagguccacuggggcaacagacac

SEQ ID NO: 206380 - RNA, 64 nt, hsa
ucaggaauuucucuccuuacacgcacugauuuucaagugggagggaauuaggggcuuauguaua

SEQ ID NO: 206381 - RNA, 64 nt, hsa
guuuuuauuguuagcuaauugcugugacugcaggaagugggaguguuucuguuguuggcuaauu

SEQ ID NO: 206382 - RNA, 64 nt, hsa
cugccuugaaaagucuuucagcugugacugcaggaagugggaguguuuuuauuguuagcuaauu

SEQ ID NO: 206383 - RNA, 64 nt, hsa
uucauacucacuaaaaaccccaugaaagccuugaaagugggaaagcuuucauuagaaauuugca

SEQ ID NO: 206384 - RNA, 64 nt, hsa
gauaauggugaaaguuuaggcacauuuucacuaaaagugggaacagaaaauggaggccuguuuu

SEQ ID NO: 206385 - RNA, 64 nt, hsa
ccccaaagcaauugcaacaaaaacaaaaauugacaagugggaccuaauuaaacuaaauaacuuc

SEQ ID NO: 206386 - RNA, 64 nt, hsa
aacagaaaaugaaauaucccauguucucacuuauaagugggagcuaaacauugauuacacaugg

SEQ ID NO: 206387 - RNA, 64 nt, hsa
ugggcccuccaccuguggcucacaucucgccagccccacagagcauccucaggccucuccaagg

SEQ ID NO: 206388 - RNA, 64 nt, hsa
cccucaaccuccggaguccaggagaacccguacccccacagagccuuaagcaacuacuucugug

SEQ ID NO: 206389 - RNA, 64 nt, hsa
ugcgucagcccgaguucugaauuaaaacaugccucccacagaaucuauuucugaugaauaugaa

SEQ ID NO: 206390 - RNA, 64 nt, hsa
ccugaggccuccccagaagcagaagcauguaaagcccacagaaccgugaguugauuaaaucucu

SEQ ID NO: 206391 - RNA, 64 nt, hsa
ccucucggaccucgcuguguuucacugccuccugcccacagacccaggccugccggcccggacc

SEQ ID NO: 206392 - RNA, 64 nt, hsa
cccaaguggacacauggcugugcaggccaggaggcccacagauggacugagugcugggaagggg

SEQ ID NO: 206393 - RNA, 64 nt, hsa
cacugccacauggagucuugccaugccugugugccccacagaccuaauauauguccggacagcu

SEQ ID NO: 206394 - RNA, 64 nt, hsa
ccacugucaugcaggucauaucagaucugagugccccacagagucacagugugucuggacagcc

SEQ ID NO: 206395 - RNA, 64 nt, hsa
gacaagaugguguucugcuaauguuaaaugucagcccacagagcuaauaauaccucaguauaau

SEQ ID NO: 206396 - RNA, 64 nt, hsa
agaacaacaagguuaagcuucaucugcuuggugucccacagaacuugcacaagcaguuguuauu

SEQ ID NO: 206397 - RNA, 64 nt, hsa
gcugagaccuuggcucuguauggaggcugcucaccccacagacacugguggggagaccauggcu

SEQ ID NO: 206398 - RNA, 64 nt, hsa
uggaggagaggaaacagugacuaaaagcuggggacccacagagggguuggcagcuucucuuguc

SEQ ID NO: 206399 - RNA, 64 nt, hsa
caggccccacagaccccacagaggaugaagccaccccacagaggaugcagcccccagcugcaug

SEQ ID NO: 206400 - RNA, 64 nt, hsa
ggaaugcugaugacuuggagcaggccccacagaccccacagaggaugaagccaccccacagagg

SEQ ID NO: 206401 - RNA, 64 nt, hsa
ggugggcauggaaugcugaugacuuggagcaggccccacagaccccacagaggaugaagccacc

SEQ ID NO: 206402 - RNA, 64 nt, hsa
cgacacugaaagcugaguccugccgucugucucacccacagaugucuguagucggucgguguga

SEQ ID NO: 206403 - RNA, 64 nt, hsa
ccccagauucucaagcagaugcccaagggagguccccacagagccagagugccugaggcuuccu

SEQ ID NO: 206404 - RNA, 64 nt, hsa
guaaaugauugauaauaggaaugaguuaccucuucccacagacauuuguuuuuaaguaugacag

SEQ ID NO: 206405 - RNA, 64 nt, hsa
aauauuuuccagagucucuaaacucucaucuucccccacagauacacauccaagcucacaaaua

SEQ ID NO: 206406 - RNA, 64 nt, hsa
aggacccccagagccaagguggcugggaucuggccccacagauggggaaagauggggaagggug

SEQ ID NO: 206407 - RNA, 64 nt, hsa
gacuccauaugcaaucaguagcgagcagccgggccccacagacccucaugcacucucuuacgug

SEQ ID NO: 206408 - RNA, 64 nt, hsa
ccgaauccugacugcaaggcccaccugccccucccccacagagccuccagagcuagcugaggcc

SEQ ID NO: 206409 - RNA, 64 nt, hsa
cggggcaacggcuccccauuuuucccgagccccgcccacagagcucuuagccaauccuaugcag

SEQ ID NO: 206410 - RNA, 64 nt, hsa
aacaaauuugcugggagagggaaagacauucagacccacagaaaggaggcagcacacagagaaa

SEQ ID NO: 206411 - RNA, 64 nt, hsa
uuggggagguuggucagggaagagagggguucuacccacagaucaacuguguaaucuuuuacua

SEQ ID NO: 206412 - RNA, 64 nt, hsa
uugcaggagcauagaauaguuuggguaccaggaacccacagaggcacacaugaaaagccaaauu

SEQ ID NO: 206413 - RNA, 64 nt, hsa
guuagucuccauuucauagaugaaaauagugaagcccacagaaaauaaguagcuccuccacagg

SEQ ID NO: 206414 - RNA, 64 nt, hsa
ucagggaccacccuccccacaguaugcacucagccccacagaacccaccagucuuucugggaac

SEQ ID NO: 206415 - RNA, 64 nt, hsa
cagaguccccagccucccucagguuacucugcaccccacagaugguuugauggcugugcuguau

SEQ ID NO: 206416 - RNA, 64 nt, hsa
gccugcuccccacacggacuccaggcgguccccacccacagaagcagaccuucagcucagguaa

SEQ ID NO: 206417 - RNA, 64 nt, hsa
cgggguggcccuggaggccccugaccccaccccacccacagagcacgagggccccgucagcuca

SEQ ID NO: 206418 - RNA, 64 nt, hsa
gaacgggaugcuuugaagauaccaugaaauaaaacccacagagguauuugauguauuuaauugu

SEQ ID NO: 206419 - RNA, 64 nt, hsa
gcagggacuugcaguggauucuuggucaggugugcccacagaugcggaggcgaggugagugauu

SEQ ID NO: 206420 - RNA, 64 nt, hsa
gaaagguggugagggcggaggggccgcuccaggccccacagagcaggagacccccagagaaagc

SEQ ID NO: 206421 - RNA, 64 nt, hsa
aggugaguuuggugcaugcaaaccugugugcucacccacagagcaugggguaaugguguguaga

SEQ ID NO: 206422 - RNA, 64 nt, hsa
ucucagcccaacugcaggugguaggauaggggugcccacagagggcaaagaaacugcccauggu

SEQ ID NO: 206423 - RNA, 64 nt, hsa
accugugcuggccugugcucaacacgggccccuccccacagaaagcugcuccuggaugccccug

SEQ ID NO: 206424 - RNA, 64 nt, hsa
uucuuccauucauaaggagacucaaugauuuuaauugaucuagacagaauuauuuaaguuuuau

SEQ ID NO: 206425 - RNA, 64 nt, hsa
uuuucucacugccaucacauacuaaccuuauacuuugaucuauucuuuuugguuaugagagaaa

SEQ ID NO: 206426 - RNA, 64 nt, hsa
uggagcucaguauucaggaagcuuaauacuguuuuugaucuacaagauccaaauaauuaucccu

SEQ ID NO: 206427 - RNA, 64 nt, hsa
aaaaaguacugccacauauguagccuugaaguaguugaucuaauaaaugagagcagggaggaga

SEQ ID NO: 206428 - RNA, 64 nt, hsa
acaagaaauuacaaaaauguuucuguuuugaaacuugaucuacaaucaguaaaaguuugauaau

SEQ ID NO: 206429 - RNA, 64 nt, hsa
ggcuguccuuuuccacugaagaaggaaagacguuuugaucuagaaauagcguugugauuuccuu

SEQ ID NO: 206430 - RNA, 64 nt, hsa
cuugaauacuuuuuucauaguuauuuguuuaaaaagauuuaaaaaucauugcacuuuggucaga

SEQ ID NO: 206431 - RNA, 64 nt, hsa
acaaugcuaagugguauccgagguucuuaauaugagauuuaaaaucuuaaaauguuucuuauuu

SEQ ID NO: 206432 - RNA, 64 nt, hsa
ucagcaauguugaucucauaaaaggaaaaacaaaagauuuaaguauucuauauaccaaguuuuu

SEQ ID NO: 206433 - RNA, 64 nt, hsa
cccuauuguuggcuccacagccuuaaagugcuauagauuuaaauucauugauuaguuuuaauuu

SEQ ID NO: 206434 - RNA, 64 nt, hsa
gagugauaugcuugcugcuuaaucaaaggauuaaagauuuaaagaugucuaugucuucuauuuu

SEQ ID NO: 206435 - RNA, 64 nt, hsa
ucagaagugagcuaccaaaacuuccacagaugugagauuuaacacuuaauugcagucacgugua

SEQ ID NO: 206436 - RNA, 64 nt, hsa
ggauggagacuaugaagggguuuguaguuguaagagauuuaauauucaaaacugaaauauucug

SEQ ID NO: 206437 - RNA, 64 nt, hsa
aguguuagaaguuugugauucuccaaauaugccuagauuuaaagcugauuuaauuuauggaaaa

SEQ ID NO: 206438 - RNA, 64 nt, hsa
uauaauauuguacauauggauuuuuuuauuguuuagauuuaaccagcuuuuaaaucucucuuuu

SEQ ID NO: 206439 - RNA, 64 nt, hsa
aacauuuaaaaauccuuuggguaauucgaauuacagauuuaaaagagcuuaagaucugguguuu

SEQ ID NO: 206440 - RNA, 64 nt, hsa
auuugacuguuuaaaauguuggccaaaaaaaucaagauuuaauuuuuuuauuuguacugaaaaa

SEQ ID NO: 206441 - RNA, 64 nt, hsa
acucuacuaauuuuuagauauucauuaauaggaaagauuuaauguuacagcaucuacucuuugg

SEQ ID NO: 206442 - RNA, 64 nt, hsa
aaaguuguaccuugacccuagaauuccuuuuauaagauuuaauuguaauugucucaaagcauca

SEQ ID NO: 206443 - RNA, 64 nt, hsa
uuauaauucauugugguaagaaugauugaaaugcagauuuaacaaucuuauaaucuauugaaug

SEQ ID NO: 206444 - RNA, 64 nt, hsa
uugugaagaaaguauuuaaauccaacuuuugaacagauuuaacaaacaugaggaacuuuuuuau

SEQ ID NO: 206445 - RNA, 64 nt, hsa
uggcaaccuuauucaauagguuuucccauauuucagauuuaauaacugaaggccagagagauua

SEQ ID NO: 206446 - RNA, 64 nt, hsa
uuuauaaagguuuccuugugccaaauaagugcaaagauuuaauuuacuauuaaaaaccauaagc

SEQ ID NO: 206447 - RNA, 64 nt, hsa
agccaucuggguucugaucugcuguaaaagaugaagauuuaagugaccuuaauuaaccuguccu

SEQ ID NO: 206448 - RNA, 64 nt, hsa
ggcauauuguacucgaaaucugaagaccugcagcagauuuaaauuacaacucuuguuauaacuu

SEQ ID NO: 206449 - RNA, 64 nt, hsa
ugccucaacccuuuugagguuuugauuuggaaauagauuuaaaagaaaacaggcuaagauaaua

SEQ ID NO: 206450 - RNA, 64 nt, hsa
auaaguuccugcauuauaaguauaaagggaaccgagauuuaauuuggagaucaucacuguuaaa

SEQ ID NO: 206451 - RNA, 64 nt, hsa
agcagauuuaagauauguaacaacaauuauuugaagauuuaauuacuucuuaguaugugcauuu

SEQ ID NO: 206452 - RNA, 64 nt, hsa
aauuauauauacuauauuuuucucaauguuuagcagauuuaagauauguaacaacaauuauuug

SEQ ID NO: 206453 - RNA, 64 nt, hsa
uucugcuaacauucagacaaguaacaggcaacaaagauuuaagaaaaauuuaugguggaaaacc

SEQ ID NO: 206454 - RNA, 64 nt, hsa
ccauauuuaaguugaacugcucugcauuaauuacagauuuaauauaaaaugaacugauuauaua

SEQ ID NO: 206455 - RNA, 64 nt, hsa
cuccuuuuucccuuaaacuucuuucugucaaauuagauuuaaugagagaguacuauuuuuaagg

SEQ ID NO: 206456 - RNA, 64 nt, hsa
ugguacuugugacuacguuuuuucaaauauagauagauuuaagcugcuaauuuuuuuuuuuuua

SEQ ID NO: 206457 - RNA, 64 nt, hsa
uauuuuccaucauuucaaaccacaaacaaaauuaagauuuaaacugugggauggguaagaaauc

SEQ ID NO: 206458 - RNA, 64 nt, hsa
cugaaaacauguuaaggcuauaguuuagccaguaagauuuaaucacaauuuuucuucuuuaaua

SEQ ID NO: 206459 - RNA, 64 nt, hsa
cguacggcagccacuacccacauguaacuuuuuaagauuuaaauuuaaauuaguuaacauucaa

SEQ ID NO: 206460 - RNA, 64 nt, hsa
uuuguuguucugccuggagacaaggugcuaacauagauuuaagugaauacauuaacggugcuaa

SEQ ID NO: 206461 - RNA, 64 nt, hsa
gauuugaaaaucuuuaaugaacuggagaacacuaagauuuaaacucgaaaauucguuguucaag

SEQ ID NO: 206462 - RNA, 64 nt, hsa
uuuuccuuuucuaaauuuguuugugaucauugacagauuuaaggguuggguuuuuuguuuuggu

SEQ ID NO: 206463 - RNA, 64 nt, hsa
uaaauugaaauguuuuaaagaaaaaaguauucacagauuuaauaccuauuaauaauauaagagc

SEQ ID NO: 206464 - RNA, 64 nt, hsa
uaauuuuuuuaaaggagaaaaauuuuuuggcuuuagauuuaaaguaaauugaaauguuuuaaag

SEQ ID NO: 206465 - RNA, 64 nt, hsa
uuaaacaguaacauccagagugacaaauugcaggagauuuaauguauaaaauuucuaggaauua

SEQ ID NO: 206466 - RNA, 64 nt, hsa
caaaccaaauacugugaacguaccagguguuuacagauuuaaaugcauguuaccauagaaacua

SEQ ID NO: 206467 - RNA, 64 nt, hsa
uuccaccuuauuuuuaccuuugaucuacccuugcagauuuaaccugucuucuucccucccauua

SEQ ID NO: 206468 - RNA, 64 nt, hsa
cuuuugccuccguccaaaagauuccuccaaaaaaagauuuaaaaaaagauuucggcaucgacac

SEQ ID NO: 206469 - RNA, 64 nt, hsa
uuuuaaaaaauaguaugaaugugaauacuagaaaagauuuaaaaaauaguaugagugugaguac

SEQ ID NO: 206470 - RNA, 64 nt, hsa
agaaaugcuguuacuuuuuauuuuuacacccaucagauuuaaggaaaagacuuuuuagccauua

SEQ ID NO: 206471 - RNA, 64 nt, hsa
gggauaugaaggauucaaugaaugaucucuagaaagauuuaaagaagaauauucagauaaggau

SEQ ID NO: 206472 - RNA, 64 nt, hsa
uuaaagaauccaaggagacagauguuguaucuauagauuuaaaauaaucucaagcugcauccac

SEQ ID NO: 206473 - RNA, 64 nt, hsa
acaaaacaacagacuucauccuuagguuuucucaagauuuaagugaacacauuuacacauauca

SEQ ID NO: 206474 - RNA, 64 nt, hsa
auaucauagcacuaaaaagauugaguuaaaaauaagauuuaaaaaauauauauugauuaaaaug

SEQ ID NO: 206475 - RNA, 64 nt, hsa
uguucaguuguuaguugggaaagauugaguuaucagauuuaauuugccgaugggagccuuuauc

SEQ ID NO: 206476 - RNA, 64 nt, hsa
aucuuucucauuuaagaacuuaugaauaugcugaagauuuaauuugugauaccuuuguauguau

SEQ ID NO: 206477 - RNA, 64 nt, hsa
ugacuacagaauaggugaggguuucuuaaaaaugagauuuaagggcugggcacgguggcucaug

SEQ ID NO: 206478 - RNA, 64 nt, hsa
acuuuaugcaagauuggaauguaucuucaaauucagauuuaauaaacauguaaagauccucugu

SEQ ID NO: 206479 - RNA, 64 nt, hsa
cacaaugcgcauguaguuaacaauuuugcacuguagauuuaacauuuuguuaagaggauagauu

SEQ ID NO: 206480 - RNA, 64 nt, hsa
caggugaggcaaagugcugggacuuuuugguaauagauuuaauuaugaaugauuaguaggaaag

SEQ ID NO: 206481 - RNA, 64 nt, hsa
auuuguguagaauaaugugggauaccugaauaauagauuuaaaaggaccaagugguaaaauugg

SEQ ID NO: 206482 - RNA, 64 nt, hsa
ucauuguguucagaacuuaauugggcuugaacugagauuuaaaucuaauaaacaaguuaauaaa

SEQ ID NO: 206483 - RNA, 64 nt, hsa
acuccaggauucaggaguuuuaauguuagaauuuagauuuaacagauagaguguggcuucauuu

SEQ ID NO: 206484 - RNA, 64 nt, hsa
uuugauuuuugaaguugggguaguaguuagaacuagauuuaacuagucuauaaugaacaugaag

SEQ ID NO: 206485 - RNA, 64 nt, hsa
uagaaggcuguguauaguccauuucccaggucugagauuuaaauauauuuguaauucuuguguc

SEQ ID NO: 206486 - RNA, 64 nt, hsa
ggugccucuguuggcaaugaucaggcagcccaaaagauuuaaaugaucuauaauaauuuccaag

SEQ ID NO: 206487 - RNA, 64 nt, hsa
auagauuccaaauaaagaaucuagaaauaggagaagauuuaauuaugaggccuugaacacggau

SEQ ID NO: 206488 - RNA, 64 nt, hsa
uuuauugaguauuguuugugcuaagcauuguguuagauuuaaaaaauuaguggauugacuccac

SEQ ID NO: 206489 - RNA, 55 nt, hsa
ugaggagcacauuuuguuaacauucagauuuaauuacuguaaguaaaauuuaaaa

SEQ ID NO: 206490 - RNA, 64 nt, hsa
auaaaauguaaauuaucugaaaggacagaauauaagauuuaaccauguuugacguauuuuaauu

SEQ ID NO: 206491 - RNA, 64 nt, hsa
aguuuccacggcgacacacagccucaguggugcaagauuuaaaauuaccuuccuuuuuggcugg

SEQ ID NO: 206492 - RNA, 64 nt, hsa
gacuuugaagugaacccuugcuauaauuuuuuagagauuuaaaauuuaugguagacauuuagga

SEQ ID NO: 206493 - RNA, 64 nt, hsa
aucuauagcagaguuucucuauuuuauauuucauagauuuaaaaaacccaaauaaagauggauu

SEQ ID NO: 206494 - RNA, 64 nt, hsa
cagugguggcacguagagaacuagaugguaauaaagauuuaaaacuaugaagaagguuacagug

SEQ ID NO: 206495 - RNA, 64 nt, hsa
ggaccuuuucuuuacccaaggauuuuuaaaacucagauuuaaaacaagggguuacuuuacaucc

SEQ ID NO: 206496 - RNA, 64 nt, hsa
auucagcuuccugcugcuagcaaugccacgauuuagauuuaaugaugcuucaguggaaaucaau

SEQ ID NO: 206497 - RNA, 64 nt, hsa
acaaaaaaagaaugcuguuccugcaccugccgguuauuuccaagaagcugaaucuuugggacug

SEQ ID NO: 206498 - RNA, 64 nt, hsa
agacuggucuuuuagagacggcaugguauauuacuauuuccacauaaugaggagccaaagaaau

SEQ ID NO: 206499 - RNA, 64 nt, hsa
aucauaaugcuuaaagccauauggaguuggaaauuauuuccaaagcauauuuauuccauuguuu

SEQ ID NO: 206500 - RNA, 64 nt, hsa
aauuuauuuuccuccauucauguacuuuuccuuauauuuccaaaacuguuacugagaauggguc

SEQ ID NO: 206501 - RNA, 64 nt, hsa
uuguaauagaucccauucauuguccccuuugggguauuuccaauacuugaauggcagauuggag

SEQ ID NO: 206502 - RNA, 64 nt, hsa
uguuguaguauacauuggagaaacuggcagguuuuauuuccauuauuuuauuuccacuauaucu

SEQ ID NO: 206503 - RNA, 64 nt, hsa
uuggagaaacuggcagguuuuauuuccauuauuuuauuuccacuauaucuaugauaagaugcaa

SEQ ID NO: 206504 - RNA, 64 nt, hsa
ugagaauaaucuuccuugaguuuauauaaacugcuauuuccauauguuuuaaguuauauuuugg

SEQ ID NO: 206505 - RNA, 64 nt, hsa
gacuggagaauugaaaaauugguuuguauauugauauuuccagguucauuugcauauacuuuuu

SEQ ID NO: 206506 - RNA, 64 nt, hsa
gcucuuaagcaguguaagagugaaaauauaagcauauuuccauuaacaguauauuguacugauc

SEQ ID NO: 206507 - RNA, 64 nt, hsa
cauuucuauuucaucuuuugagucauauguauauuauuuccagaauuuuagacauuauuacagg

SEQ ID NO: 206508 - RNA, 64 nt, hsa
cauguggcucagugccuuccucucucuaccagucuauuuccauucuuucagcugugucugacau

SEQ ID NO: 206509 - RNA, 64 nt, hsa
caugugguucagugccuuccucucucuaccagucuauuuccacugaacaaaaccuacgcacaua

SEQ ID NO: 206510 - RNA, 64 nt, hsa
caugugauucacugccuuccucucucuaccagucuauuuccacugaacaaaaccuacacacaua

SEQ ID NO: 206511 - RNA, 64 nt, hsa
aacuuagaaauaagaaacacaaauguaaaauaaguauuuccauaacucauaauccagagauaau

SEQ ID NO: 206512 - RNA, 64 nt, hsa
uacugauugauugguccuuuuauaaacauugguauauuuccauucaugccaaagcaaaagaagu

SEQ ID NO: 206513 - RNA, 64 nt, hsa
gauaucacauaguacauauauuauuuccuuaguuuauuuccaaacugguauuuuaaauagacac

SEQ ID NO: 206514 - RNA, 64 nt, hsa
acuuggaagggcaaaaaucauccccuauuuuacuuauuuccaagaaaugcauuuucuuagcauc

SEQ ID NO: 206515 - RNA, 64 nt, hsa
uuuguaucuaggaguccauuugaguucuuuccaauauuuccauaucguucauaaaugugucugg

SEQ ID NO: 206516 - RNA, 64 nt, hsa
ccagugacuagagagagguuucauucaugauguguauuuccaauuuggucuucaauucaagaga

SEQ ID NO: 206517 - RNA, 64 nt, hsa
aggauugcaugugaagucuuuucuacugaaucuauauuuccauuuguaagugauuuuaaguuaa

SEQ ID NO: 206518 - RNA, 64 nt, hsa
aauauguuauccccacuaauuaauuuucguauauuauuuccaauauuuggaaagcucuuuauag

SEQ ID NO: 206519 - RNA, 64 nt, hsa
ugaugagauuacuuaaugauuuccaauuaaguuguauuuccaaauaucaugauuuccauuuuaa

SEQ ID NO: 206520 - RNA, 64 nt, hsa
agaauauacauucuucucagcaccacaucacacuuauuuccacauugaccacauaguuggaagu

SEQ ID NO: 206521 - RNA, 64 nt, hsa
cccccaagcuauccuguuucagauaauaucaauuuauuuccaauccaucagacuaaaaucuaag

SEQ ID NO: 206522 - RNA, 64 nt, hsa
uuaguguauaacaucaaguucuguguaaugaggcuauuuccaagucuccaaagauggucacugu

SEQ ID NO: 206523 - RNA, 64 nt, hsa
uuucaaaauuguugcaucccccuuagaauguuucuauuuccauaaggauuuagguaugcuauua

SEQ ID NO: 206524 - RNA, 64 nt, hsa
ucaauauugauuuuaaauauaaguaaugaaggcauauuuccaauaacuagugauauggcaucgu

SEQ ID NO: 206525 - RNA, 64 nt, hsa
guugauaaaaaucuuaaccaucccuagaguuuuauauuuccaaaaauaugccaaaaggaaaacu

SEQ ID NO: 206526 - RNA, 64 nt, hsa
uuuuauacaggguuaauaauccuuaaaauacuuuuauuuccaugccuuauuaguauacauacuu

SEQ ID NO: 206527 - RNA, 64 nt, hsa
gacuaccaaagaaauacauaguaaaacaaccuuuuauuuccaaauuguuaaagagccagccauu

SEQ ID NO: 206528 - RNA, 64 nt, hsa
gugcaguguacaaagaaguauauucugaauacauuauuuccauucauuuagcacaaauaaauca

SEQ ID NO: 206529 - RNA, 64 nt, hsa
gcaauuuccuccugugacgguugcuguuaccugguauuuccacucucacaguagaauagaaaug

SEQ ID NO: 206530 - RNA, 64 nt, hsa
ccuuuguuguucuguuuccuauuuugccaggaaguauuuccauaguugcugagaaucaaagcac

SEQ ID NO: 206531 - RNA, 64 nt, hsa
auucugcuucuuacagaaguauuacugaagguauuauuuccaauauuauuugguuuauuaugcg

SEQ ID NO: 206532 - RNA, 64 nt, hsa
gcuccauuucucugccuucccauuggaaauaguuuauuuccacauucuccacugcgugugguca

SEQ ID NO: 206533 - RNA, 64 nt, hsa
auaauauacauugaguacuccaucucuccaaauguauuuccauaauguguugaaaacaugcuaa

SEQ ID NO: 206534 - RNA, 64 nt, hsa
guuuguaaaccaaaaaguaauaaaugaaucccuauauuuccauuauaguauuuauuguauuuuu

SEQ ID NO: 206535 - RNA, 64 nt, hsa
uugacaauaacaaaaaugguuuuggauuuuguuuuauuuccaaaaaauguauacaauaucagaa

SEQ ID NO: 206536 - RNA, 64 nt, hsa
gaacagaccuuuucuuuuuacuuuaaaauuccuguauuuccauuuuuaagaguaaauuuaaucu

SEQ ID NO: 206537 - RNA, 64 nt, hsa
gcacauaaguaaaggugcuuuuuaaugugcagucuauuuccagagcuuacuuaguugcugauuu

SEQ ID NO: 206538 - RNA, 64 nt, hsa
auuuuuuugcuuuucauuuucuaaaguuaguuauuauuuccauugaagcuuguuuucuuuuuuu

SEQ ID NO: 206539 - RNA, 64 nt, hsa
uuuccaaccacugauuacuuuucaggaauuuaauuauuuccagauaaauuucuuuauuuuauau

SEQ ID NO: 206540 - RNA, 64 nt, hsa
gauuuaggucauuaauuuagauaaacuagcucauuauuuccaucuuuggaaaaggaaaaaaaaa

SEQ ID NO: 206541 - RNA, 64 nt, hsa
aguuuauuuugugauuuuuuggaaucguacuuuauauuuccaaauuuaaauuuaaaugcaagau

SEQ ID NO: 206542 - RNA, 64 nt, hsa
cacuaguaccauugacucucguugaauaacuuuauauuuccauaauccugaauuguguagauag

SEQ ID NO: 206543 - RNA, 64 nt, hsa
caaacaaaauauuuucauauuuauuucuuagaacuauuuccaaaauauuuauauuucaguuuuu

SEQ ID NO: 206544 - RNA, 64 nt, hsa
uuuuuuuuaaauucacggugaacagcacuuuuauuauuuccaguucagaagagccaaaaaaaag

SEQ ID NO: 206545 - RNA, 64 nt, hsa
uguauucaauaguaaauagacaaauuuuauuuuuuauuuccacuugaagaguuacauuucguau

SEQ ID NO: 206546 - RNA, 64 nt, hsa
gacaaccuccaaucaguuuacuucauuucaaaacuauuuccaaucacaaggaaagauuuauuua

SEQ ID NO: 206547 - RNA, 64 nt, hsa
ucuuugauaugcuuacgaguaagugaauccugauuauuuccagacccaccaccagaguggaucu

SEQ ID NO: 206548 - RNA, 64 nt, hsa
guauaaucuuuucaucugcuuuuagaaugugggauauuuccaguaccuacuuuuuuuuuuuuuu

SEQ ID NO: 206549 - RNA, 64 nt, hsa
cugcugcuucucagggaauccgacaccagccaaccauuuuaagccucuaaaagaccucgggcaa

SEQ ID NO: 206550 - RNA, 64 nt, hsa
cgucaaaguuguaagugacuaaccaagauuauuucauuuuaaaaccauagaauaaaaaugacac

SEQ ID NO: 206551 - RNA, 64 nt, hsa
guuaauuugcuuuuuaaaacaaauuuaauuaucacauuuuaaauuacuuuguggacuguguuuu

SEQ ID NO: 206552 - RNA, 63 nt, hsa
uuaacuuuuuuacucuuauaaaaccaguuccugacauuuuaaaaaacaauaucuguaaaaugg

SEQ ID NO: 206553 - RNA, 64 nt, hsa
uauucuuuucaugguauuuucuuccauaauaucucauuuuaaaaagaaguucuuuaugaacuua

SEQ ID NO: 206554 - RNA, 64 nt, hsa
guaacauauacauagccacauuuacaguuuuaaccauuuuaaggcauguaauucagugggguua

SEQ ID NO: 206555 - RNA, 64 nt, hsa
auauuuagaauuuuuaaacauguacaaagggcuacauuuuaauuuuaaaauagcuucacauuau

SEQ ID NO: 206556 - RNA, 64 nt, hsa
cuucacauuauuuuacuuauauuggguuuuucuucauuuuaauccuuuucaaguggaauggcuu

SEQ ID NO: 206557 - RNA, 64 nt, hsa
uuugaaauagacugugaaguaagcuguaacuugucauuuuaauuuuguuuaacacgguuacuga

SEQ ID NO: 206558 - RNA, 64 nt, hsa
aguuucuuacaaauaaaguuuguaagaaaauguucauuuuaagugauagauaguggagaaaauu

SEQ ID NO: 206559 - RNA, 64 nt, hsa
auuuauauuaccauuuauagauucauuuuggaaccauuuuaaauguaguaaugcuuauuuuaaa

SEQ ID NO: 206560 - RNA, 64 nt, hsa
uaauguucugguaacaagcuguuaucuuuuaagacauuuuaaugacucaaagguacacuauaca

SEQ ID NO: 206561 - RNA, 64 nt, hsa
acauugucugcugcaauuuaaauaaaaauuacgacauuuuaagauauuucauagacaaaccaaa

SEQ ID NO: 206562 - RNA, 64 nt, hsa
agcuguguuuauuugugaaguuaaaaguaaauagcauuuuaagccauaaugucccaaaauagau

SEQ ID NO: 206563 - RNA, 64 nt, hsa
ggcagaugcaccaauacaugguaauccucuuacucauuuuaagacguaggaaacucaauauucu

SEQ ID NO: 206564 - RNA, 64 nt, hsa
acuuuuuuacaauuggcucugagaaaaagggagacauuuuaaauucuuuaacuucuuauuucuc

SEQ ID NO: 206565 - RNA, 64 nt, hsa
aggaaacuagagugcauuuaaaauacucugucuucauuuuaacauguugaauggaauaacugca

SEQ ID NO: 206566 - RNA, 64 nt, hsa
gaaaaacaacuuuguuccuuccuccuagaacuuacauuuuaauggaaauagacaaaacacaucu

SEQ ID NO: 206567 - RNA, 64 nt, hsa
aaugagucacggcacuaacucaugguucuauacucauuuuaagaaauuguaaagguugaggugu

SEQ ID NO: 206568 - RNA, 64 nt, hsa
uguacaguauaguaaaaauacccuuuacuucugacauuuuaaggucacguccuauaguuugggg

SEQ ID NO: 206569 - RNA, 64 nt, hsa
ccuuccaaauaaaaagcuaaauauuccuccuugucauuuuaaugucauuauugaaauacuuuua

SEQ ID NO: 206570 - RNA, 64 nt, hsa
auuaauaccaaauauuuuagccuuaaauuuuugucauuuuaaaaucugauuuaauguuuucugc

SEQ ID NO: 206571 - RNA, 64 nt, hsa
gaaacauuuucuuucuuuuucuggaaauuuuguccauuuuaaaaaccaaucauuuuaagaagac

SEQ ID NO: 206572 - RNA, 64 nt, hsa
uuuucuggaaauuuuguccauuuuaaaaaccaaucauuuuaagaagacaugacaaugcaaugaa

SEQ ID NO: 206573 - RNA, 64 nt, hsa
aggauguuauugacauuauacacugaagucuuaacauuuuaacauuuauagugcuuauuugcaa

SEQ ID NO: 206574 - RNA, 64 nt, hsa
uguuucauugccuugauguuugaguguaaucuagcauuuuaauacaguguuuauuuugcaugau

SEQ ID NO: 206575 - RNA, 64 nt, hsa
uaaaauguguuuaauuuuccuuucugaaaacucucauuuuaaaaacguucauuuaauuauguau

SEQ ID NO: 206576 - RNA, 64 nt, hsa
auuugcauucagugccuuacugguauucucagaacauuuuaaugauuucuaacauuucuuaaca

SEQ ID NO: 206577 - RNA, 64 nt, hsa
aacuuuaaaaaacuaugucuaauuuauauuaauacauuuuaaaaaggugcccgcacuaccauac

SEQ ID NO: 206578 - RNA, 60 nt, hsa
auauggaagauggcauguaauaaacuacugcauuuuaagcuuccuauuuuuuuuuccagu

SEQ ID NO: 206579 - RNA, 64 nt, hsa
aacaauauaauucuuuggcagauauucagaauaacauuuuaaacuacauuuucuuagaaaauug

SEQ ID NO: 206580 - RNA, 64 nt, hsa
gacagugaucaaaguuuucagugcauuuauuguacauuuuaagaaaaaggugaaaaucauuugg

SEQ ID NO: 206581 - RNA, 64 nt, hsa
auggcucuucuuucaacauagaauuggauugggccauuuuaauugacuccuauacaaggaauua

SEQ ID NO: 206582 - RNA, 64 nt, hsa
auucauaggcccgaaacaccuuaaagacuucugucauuuuaaacaugagagguaauuuuauuuu

SEQ ID NO: 206583 - RNA, 64 nt, hsa
agccugaagaaaauugccucagccuccacaguaccauuuuaaauucacauaaaaggugaaagcu

SEQ ID NO: 206584 - RNA, 64 nt, hsa
uucuucacaaaaaaagaaaagaucuuaagucauacauuuuaauuguguagagguuguucaacug

SEQ ID NO: 206585 - RNA, 64 nt, hsa
aauuuuaaaaacucuauccaaaacauuuuuggagcauuuuaaagccccauacacagaaguauac

SEQ ID NO: 206586 - RNA, 64 nt, hsa
uaucuauuuuuauaaccaccugugguccauuguucauuuuaauucacauuucuuaugaaguaug

SEQ ID NO: 206587 - RNA, 64 nt, hsa
guuucaacgcugaccuuuucuugcauuauuguuucauuuuaaugauaguguuacuugucccacu

SEQ ID NO: 206588 - RNA, 64 nt, hsa
uaauugcuagauuaaaaauagacuagaacagguucauuuuaagauuuacuuggaagagcaaaga

SEQ ID NO: 206589 - RNA, 64 nt, hsa
uagcucucucaaaaauuaauuuuuauuccuuaagcauuuuaaaaacauuuuaaaaaauguuuug

SEQ ID NO: 206590 - RNA, 64 nt, hsa
aaaauuaauuuuuauuccuuaagcauuuuaaaaacauuuuaaaaaauguuuuguaaauccaggu

SEQ ID NO: 206591 - RNA, 64 nt, hsa
auagccaacugcuaaugcaaauuaaaacauauuucauuuuaacaugauuucaaaaucaguuuuu

SEQ ID NO: 206592 - RNA, 64 nt, hsa
caaauugucguuuuuauuccucuuauugggauaucauuuuaaaaacuuuauuggguuuuuauug

SEQ ID NO: 206593 - RNA, 64 nt, hsa
cuuacuaugaauacuaauuucgaaccauagcuuucauuuuaagcaucaucuugaauuucuaaac

SEQ ID NO: 206594 - RNA, 64 nt, hsa
uaacuaucuuucaauuccauacuucccccgcccccauuuuaaaggcuuauuguuguauuuugua

SEQ ID NO: 206595 - RNA, 64 nt, hsa
ccauuaacaguauauuguacugaucagcagcucucauuuuaacaucaguuaggcauaauauuuc

SEQ ID NO: 206596 - RNA, 64 nt, hsa
ugaauggcaaacgcuauuuaugcauaaauauuuucauuuuaaguaauauaugaaguguaaauac

SEQ ID NO: 206597 - RNA, 64 nt, hsa
ucuagccauaccucagauaauauguuuaguuuuacauuuuaaaauguuuaaauucucuuucaca

SEQ ID NO: 206598 - RNA, 64 nt, hsa
uuaagaaaauuuacaaaauuuauucucagguaaucauuuuaauaaaguucugcaaaauacacgu

SEQ ID NO: 206599 - RNA, 64 nt, hsa
cuagguauaaacauauauuuacaugauuaauccacauuuuaaaaugacuugcacuugugcauau

SEQ ID NO: 206600 - RNA, 64 nt, hsa
uggcugucuuucuagguauuccauagaaucaacacauuuuaaggcugaaagauacugucgaaau

SEQ ID NO: 206601 - RNA, 64 nt, hsa
uauuuuuucauugauauuugaaaacagacuaugacauuuuaaaaaucugcccuaugaguaucaa

SEQ ID NO: 206602 - RNA, 64 nt, hsa
gugaacuauaaaagcuuuuugccuacagauuuuacauuuuaaaauuaucuauggcuguuuuaaa

SEQ ID NO: 206603 - RNA, 64 nt, hsa
uguggucaaauaauauagucauuagccaccuaaacauuuuaauuccagauauuauuuaauucca

SEQ ID NO: 206604 - RNA, 64 nt, hsa
gaguuacuauguauauuaugcuuagcuuuuaaggcauuuuaaauaaccaugaauguugauuuca

SEQ ID NO: 206605 - RNA, 64 nt, hsa
ugguagaucguguuuagaggcuuuguaugugugucauuuuaauaagcaagaagauauauuuaga

SEQ ID NO: 206606 - RNA, 64 nt, hsa
agagcuuauauucuaguggaggaaguuagacaagcauuuuaaguaauaaauguauagagagugu

SEQ ID NO: 206607 - RNA, 64 nt, hsa
aagugugagcuguguuaaaaggcauucuuagauucauuuuaaccacauuuuuaaaaacucacag

SEQ ID NO: 206608 - RNA, 64 nt, hsa
ugggaagauuuugaaaacaggacaaagaaaacaucauuuuaaaaugucuucagcuuuuuuugaa

SEQ ID NO: 206609 - RNA, 64 nt, hsa
guauucaaacauauucugaacauugauguuugaacauuuuaauuugugugaugauguagaaaau

SEQ ID NO: 206610 - RNA, 64 nt, hsa
aggauuuuuaaauucaaauaaggauggcagugcccauuuuaaggaggauuucagcuauaacuga

SEQ ID NO: 206611 - RNA, 64 nt, hsa
ugaauaugcaaucauuuacuucuacugagugcugcauuuuaagaugcuagaugagaagaguagu

SEQ ID NO: 206612 - RNA, 64 nt, hsa
augaccaaccagauuaaacucuacccacauccugcauuuuaaggucuaaguuuaacuggucaac

SEQ ID NO: 206613 - RNA, 64 nt, hsa
cucccacuucugaaauguucauuuauacugguugcauuuuaagaucaugaaacaauuccaguua

SEQ ID NO: 206614 - RNA, 64 nt, hsa
auguauuaauaaugccuuauauauuguuuguagucauuuuaaguagcaugagccaugucccugu

SEQ ID NO: 206615 - RNA, 64 nt, hsa
gaauuaaauauuguaagauauguauaaugcuggccauuuuaaagggguuuucucaaaaguuaaa

SEQ ID NO: 206616 - RNA, 64 nt, hsa
auucugcuuuuuauacauuucagugcucugcauacauuuuaaauuaugaaugucgugcacuggc

SEQ ID NO: 206617 - RNA, 64 nt, hsa
acuguguauggggagguuguaguauuuauuauagcauuuuaaauaaggguaauucauuuuuuau

SEQ ID NO: 206618 - RNA, 64 nt, hsa
ggcuagaaaccuaacugauucuucucaguuuucucauuuuaaaacagcccaguauuccuuugua

SEQ ID NO: 206619 - RNA, 64 nt, hsa
cagccauauaaacuguucucuaggcaugcugugacauuuuaauaaaaagcaaaaggagcauuua

SEQ ID NO: 206620 - RNA, 64 nt, hsa
aaauauggauauuuguaccaggcugcguguuuuucauuuuaaacacacaagauuuaauugaaag

SEQ ID NO: 206621 - RNA, 64 nt, hsa
accccauggaaacacuaguccugauaauaaacaucauuuuaaaagaucaaaacaaacaaacaaa

SEQ ID NO: 206622 - RNA, 64 nt, hsa
aaugaaauauucaaccccugcugugcaggggggucauuuuaauguaacaccacaccccauggaa

SEQ ID NO: 206623 - RNA, 64 nt, hsa
ugaacacuuuacaaagaacaugcccggguuuuuacauuuuaaaaguuauucuagacaaucacua

SEQ ID NO: 206624 - RNA, 64 nt, hsa
caggccucaccuagacauccagaaucaaaaucugcauuuuaacaagaugcccaggugaucugca

SEQ ID NO: 206625 - RNA, 64 nt, hsa
uauauauuauggucucaauguuuuucuuacgccucauuuuaauuuauaaugaagguaaaauuaa

SEQ ID NO: 206626 - RNA, 64 nt, hsa
cacaguguauucuauauugcaaugauuuuuuuagcauuuuaauauuuuaauauauauuguaaaa

SEQ ID NO: 206627 - RNA, 64 nt, hsa
uuguggagcaauagaguucuccauuuuacagaagcauuuuaaauguaguuugaauauuuuccac

SEQ ID NO: 206628 - RNA, 64 nt, hsa
guauuuuucguauucuggaagauguuuuaagaagcauuuuaaaugucaguuacaauaugagaaa

SEQ ID NO: 206629 - RNA, 64 nt, hsa
uguuugggaaacauuuuaauaacgaauuaauaaacauuuuaauaucaaaacuaaaguguuuuuc

SEQ ID NO: 206630 - RNA, 64 nt, hsa
auaaaauggagacggcuuucauauguuugggaaacauuuuaauaacgaauuaauaaacauuuua

SEQ ID NO: 206631 - RNA, 64 nt, hsa
cucugguguuuauuauaaagcuuaaauuuuauaucauuuuaaaaugucuuggucuucuacugcc

SEQ ID NO: 206632 - RNA, 64 nt, hsa
gagcucuuugaucgcuuuuaauaaacugcaaguucauuuuaaaugaagggccagcauauauacu

SEQ ID NO: 206633 - RNA, 64 nt, hsa
ugaaaaguaugagaucugguuccauccaguaagacauuuuaauagagaagaucaaaauguuacc

SEQ ID NO: 206634 - RNA, 64 nt, hsa
uuuuccuuuuucucagauguagcugagucuugaucauuuuaagacaacgauggguagaauuuug

SEQ ID NO: 206635 - RNA, 64 nt, hsa
uagagugggaauuuuuuccuaaucauguuuuuaacauuuuaaaauaaaauuuaauacuaagaaa

SEQ ID NO: 206636 - RNA, 64 nt, hsa
uguuuaauucacguuugggaauauugaaugaauccauuuuaacauaagcacuguggugccaucu

SEQ ID NO: 206637 - RNA, 64 nt, hsa
ggaauuucuugcuuauagaggcaaaccacaguaucauuuuaacucuagaauugggcuuguacag

SEQ ID NO: 206638 - RNA, 64 nt, hsa
cuucuauuauuuguuuaguauguuguaaguagaucauuuuaaaaaacugaaucuauauuauguu

SEQ ID NO: 206639 - RNA, 64 nt, hsa
auauaaauacauauuugccauuuuaaacauuuaccauuuuaaccauuuuuaaguguacaguucu

SEQ ID NO: 206640 - RNA, 64 nt, hsa
ucuauugugguaaaauauauaaauacauauuugccauuuuaaacauuuaccauuuuaaccauuu

SEQ ID NO: 206641 - RNA, 64 nt, hsa
uauuuucaaucacauacaaguacauagaauuucacauuuuaauuuagcaaauugauuuaccuag

SEQ ID NO: 206642 - RNA, 64 nt, hsa
cauagacacauaauuaugcuuaagcuuuuaacagcauuuuaaccgcucuaaaaauuaccagagu

SEQ ID NO: 206643 - RNA, 64 nt, hsa
aauuaaaugcccuuaaauuucaccauuugucuuucauuuuaaagguuauuugcucccgauuaua

SEQ ID NO: 206644 - RNA, 64 nt, hsa
acuagagauguuucaaauguagauuuuaccagaccauuuuaaucaacuuuauugagauucaauu

SEQ ID NO: 206645 - RNA, 64 nt, hsa
ucugggauuuauagaucaauuuagggagaaaugacauuuuaacaauucugaguuuuccaauugu

SEQ ID NO: 206646 - RNA, 64 nt, hsa
gggauugaguuaaaacuauuuuauuuuaaauauacauuuuaaagcaguucuuuuuuuuuguuaa

SEQ ID NO: 206647 - RNA, 64 nt, hsa
auccccuuccccacguuccagccccugcagcccacauuuuaaguauauuccuucaagugaguuu

SEQ ID NO: 206648 - RNA, 64 nt, hsa
ggacaugguguuuaaaauuuaaaucugauuaauccauuuuaacaaacaaugcaaacaucuucag

SEQ ID NO: 206649 - RNA, 64 nt, hsa
cuucaugcuuacuauuuuaugucuauauuuaaaucauuuuaacuucuauagguuuuuaaaugga

SEQ ID NO: 206650 - RNA, 64 nt, hsa
uaccuuuauaguuaucgaucacuguuaaaacuuucauuuuaaaauccuauuaccaaguucaguu

SEQ ID NO: 206651 - RNA, 64 nt, hsa
uggguauuuuguccugauucacugccaauugucacauuuuaagacuuuuuuuuuuccauauagg

SEQ ID NO: 206652 - RNA, 64 nt, hsa
aaguagguuguuuuccugaaccguaaacuuguaucauuuuaacuugcacaaaggaagucuguuc

SEQ ID NO: 206653 - RNA, 64 nt, hsa
aaaaaaaaugugaacuaacuuauuuaauuuauggcauuuuaaaaugacacuguuaacccaacgg

SEQ ID NO: 206654 - RNA, 64 nt, hsa
augcacucagcucaacugcuguguuuaaaauacacauuuuaaaucccucuuuacagacacuaac

SEQ ID NO: 206655 - RNA, 64 nt, hsa
uagaaaaagaaaaaaggcuggguuuacuauugcacauuuuaagcuuuuauaccuuuaucuucuu

SEQ ID NO: 206656 - RNA, 64 nt, hsa
cacccagcauaaugacuuugagguucauccaugucauuuuaaauuuugaauuggcaauauauau

SEQ ID NO: 206657 - RNA, 64 nt, hsa
ucuuggauuccaaacuaaacaccaagauacuuuucauuuuaaaauguauaaaguaacaauucag

SEQ ID NO: 206658 - RNA, 64 nt, hsa
uuucauuguaccaugaaaccauuugauuuuuacccauuuuaaauguguuucugaagcaagacaa

SEQ ID NO: 206659 - RNA, 64 nt, hsa
cccacccugauguaauugacauuacauuucuuaacauuuuaaaaucuagaauuucuaaaaugga

SEQ ID NO: 206660 - RNA, 64 nt, hsa
auaauggcuuauaaaugguguuuaaauaugcauucauuuuaaucuacugaacaaauauugggau

SEQ ID NO: 206661 - RNA, 64 nt, hsa
aaauauuuacaaucauauagaauauauagaguuacauuuuaauagcaacuguguacaugucacg

SEQ ID NO: 206662 - RNA, 64 nt, hsa
aucauaguuaacauaguaaguucagcacuugucucauuuuaauguaaagauuugcuuccauuuu

SEQ ID NO: 206663 - RNA, 64 nt, hsa
ggcuggaaagcauuuguuauaaaccuauagugcacauuuuaacugcccccuaaauuacccuucc

SEQ ID NO: 206664 - RNA, 64 nt, hsa
cacauaaauaugaaacauuuaucagaaauguugccauuuuaaugagaugauuuucuucaucuca

SEQ ID NO: 206665 - RNA, 64 nt, hsa
aggaauaucuguauguuggaugacuuuaaugcuacauuuuaaaaaaagaaaauaaaguaauaau

SEQ ID NO: 206666 - RNA, 64 nt, hsa
uuuaaugaguuaucacuuuuucagcugauauauucauuuuaauggcuuuuuugaaaguuccuuu

SEQ ID NO: 206667 - RNA, 64 nt, hsa
uucaugguggcaaaauauuagcucuguuuugggacauuuuaaaauagaacuauccuuguucgau

SEQ ID NO: 206668 - RNA, 64 nt, hsa
uucucuuccuggcaucauaaggaguugguguaaucauuuuaaauuccacugaaaauuuaacagu

SEQ ID NO: 206669 - RNA, 64 nt, hsa
uuuguauacagagaagaaaaccucaaguaauaggcauuuuaaguaaaagucuaccuguguuuuu

SEQ ID NO: 206670 - RNA, 64 nt, hsa
uacauuucagucuuuuucauuuucauggagguuucauuuuaauggagcaggagagaaaagagag

SEQ ID NO: 206671 - RNA, 64 nt, hsa
ugaaucagaaacuagguuggggcuuaggaacgugcauuuuaaacacuuuuccaaagugauucuu

SEQ ID NO: 206672 - RNA, 64 nt, hsa
gccauuccuuuugcccaguuaaauguucaccaaucauuuuaacuaaauacucagacuuagaagu

SEQ ID NO: 206673 - RNA, 64 nt, hsa
aauuguuuucuguaucuugaaaaaguauucuccacauuuuaaauguuuuauauuagagaauucu

SEQ ID NO: 206674 - RNA, 64 nt, hsa
uuuaggcaacggguaucauauccaugaaaaaugucauuuuaagacacuaauaucaacaguauau

SEQ ID NO: 206675 - RNA, 64 nt, hsa
aaaguaggaaguugagcacaaccuuguccacagccauuuuaaauauccacuuagcccuguguag

SEQ ID NO: 206676 - RNA, 64 nt, hsa
uuuaucuuccaaacccaaucuaguaggauguucucauuuuaaaaacgaggggaaaagaccagag

SEQ ID NO: 206677 - RNA, 64 nt, hsa
aauuguaaagauugacaauagacuuaagaaauaacauuuuaaaaucuauuuuauacuuaccauu

SEQ ID NO: 206678 - RNA, 64 nt, hsa
uacaggcgugagccaccgcgccuggccaaaacaacauuuuaaguagaagauccagguuuuagug

SEQ ID NO: 206679 - RNA, 64 nt, hsa
cuccaggagcaugagaauugauccccagaagaaccauuuuaacuccaucugauacuccauugcc

SEQ ID NO: 206680 - RNA, 64 nt, hsa
gcagggagaaauauuaacuuuuuuaacccuuuaccauuuuaaauacuaacugggucuuucagau

SEQ ID NO: 206681 - RNA, 64 nt, hsa
caguucuguguacauuuuaaaggauaauggugaacauuuuaauggguuucccuugcccuuucca

SEQ ID NO: 206682 - RNA, 64 nt, hsa
gacaaauguguaugugugguuucaguucuguguacauuuuaaaggauaauggugaacauuuuaa

SEQ ID NO: 206683 - RNA, 64 nt, hsa
cucauuuuaauaucuuaugcuauuauucuguaaacauuuuaauuuuaguuucaugagucuuuau

SEQ ID NO: 206684 - RNA, 64 nt, hsa
uauuuuccuaagcacaaaucuuuuucuauauucucauuuuaauaucuuaugcuauuauucugua

SEQ ID NO: 206685 - RNA, 64 nt, hsa
aaauagaaauuguaaaucagagguuaucugucugcauuuuaaacugccaaauuaccuuauagua

SEQ ID NO: 206686 - RNA, 64 nt, hsa
cuaacucauuuucuuugaguuaaagcuguguauacauuuuaaaaggcauauagauaguguaugc

SEQ ID NO: 206687 - RNA, 64 nt, hsa
uaacaguacgcacugaauagugaaaauaauuagacauuuuaagaaccagagccauagaauuauu

SEQ ID NO: 206688 - RNA, 64 nt, hsa
acacagcuuguuuuuuugcccaaggaugagucuacauuuuaagaacugcaaugguauaaaggaa

SEQ ID NO: 206689 - RNA, 64 nt, hsa
aguacaaaucuuaaauauuuuuaauaaauccuuucauuuuaaaaagagaauugccaauacagaa

SEQ ID NO: 206690 - RNA, 64 nt, hsa
cauaaguucauggaaugaaauggcuuucugccuccauuuuaaucaugcauaaaaugaauuagau

SEQ ID NO: 206691 - RNA, 64 nt, hsa
uucuuccaguauuuuuuaaaaaacuguccuaucucauuuuaaaagacuuucuuuugcuugaucc

SEQ ID NO: 206692 - RNA, 64 nt, hsa
uuaaacuggauggguuaauuuauauaaacauuuucauuuuaaguuggcauuucugccugguucc

SEQ ID NO: 206693 - RNA, 64 nt, hsa
uugcaaucacuauguucaaucuggauuugucuuucauuuuaacuuuuaauauaaaaagggguuu

SEQ ID NO: 206694 - RNA, 64 nt, hsa
aguuucuuuuuaaaaauuuuccaaaacuuuucuccauuuuaaaaagcccuguuauaaacguuga

SEQ ID NO: 206695 - RNA, 64 nt, hsa
gaauggauuuuuccauacucaucuacaauuccuccauuuuaaaugacuacuuuuauuuuuuaau

SEQ ID NO: 206696 - RNA, 64 nt, hsa
gcugaauugagaucaggguuucuuuuccagggugcauuuuaauauacguaugaaaugaaauauu

SEQ ID NO: 206697 - RNA, 64 nt, hsa
guuguuguuauagccaugcauugaccauuaaaugcauuuuaauaucucggcaaaaugagauuug

SEQ ID NO: 206698 - RNA, 64 nt, hsa
ccugcuaccuaguuuguuagugcauuugagcacacauuuuaauuuuccucuaauuaaaaugugc

SEQ ID NO: 206699 - RNA, 64 nt, hsa
aaaucacagauuuuuucuuuaaauaaaaauaagucauuuuaauaacuaaaccagauucuuugug

SEQ ID NO: 206700 - RNA, 64 nt, hsa
aaacuaugccacagucuggauguguuuacugaaacauuuuaauaaggaaguuuauuuuugauaa

SEQ ID NO: 206701 - RNA, 64 nt, hsa
uacuguguauuuuucacuuguuucuaagaucaaacauuuuaauaugugcauguuauauauaaau

SEQ ID NO: 206702 - RNA, 64 nt, hsa
uucauagacaugaaauaguugcucagagauuaugcauuuuaagacacucauaguauauauugcc

SEQ ID NO: 206703 - RNA, 64 nt, hsa
cgaucagauuuuuccagaauuccguaucagucaccauuuuaauauggggacaaugaagacaagc

SEQ ID NO: 206704 - RNA, 64 nt, hsa
cucuuaaagaaauuaugaaaaauguacaauuuaacauuuuaaauaaauagugacagaaguuguu

SEQ ID NO: 206705 - RNA, 64 nt, hsa
uuugagccuaggagaaaaugccacugugugcauccauuuuaaaggguucccucauaaaaaaaug

SEQ ID NO: 206706 - RNA, 64 nt, hsa
caggugugagccacugugccuagccuauaaugaucauuuuaauguuucccaugcacucauuuag

SEQ ID NO: 206707 - RNA, 64 nt, hsa
uuccagacauacuucucugcaacuuguugagcaacauuuuaagauguuggacuucugcaauaga

SEQ ID NO: 206708 - RNA, 64 nt, hsa
gugauuugugggagacuaguguauuuuaaauuagcauuuuaauccauucuugacauucaguuag

SEQ ID NO: 206709 - RNA, 64 nt, hsa
acuauaguuucucuaaaacuuuaucugaaagagucauuuuaaaauaacuauuaaacaauguaac

SEQ ID NO: 206710 - RNA, 64 nt, hsa
aacugcuaucuuaauguucugaaauaaguuaaaacauuuuaaaauaugaauacuguaaaggaaa

SEQ ID NO: 206711 - RNA, 64 nt, hsa
uaaucaagccacacuaacuauggaaaaugagcagcauuuuaaaugcuuucuagugaaaaauuau

SEQ ID NO: 206712 - RNA, 64 nt, hsa
uagacaaaagaaaauacacacuaaaacuaaucuucauuuuaaaaggguaaaacaugacuauaca

SEQ ID NO: 206713 - RNA, 64 nt, hsa
ccagacuuucuuuuucuacaugugagauaguuuucauuuuaacuggcaugucauuugcacacaa

SEQ ID NO: 206714 - RNA, 64 nt, hsa
aaggcuguccacguacuuaauuuacuuaaguguucauuuuaaguaacgugcucacuguguauag

SEQ ID NO: 206715 - RNA, 64 nt, hsa
aagcagagaccaucugugaccauagccuagcuagcauuuuaaaaggggaaauuuuguucucuag

SEQ ID NO: 206716 - RNA, 64 nt, hsa
uaaccuguucauuaauaucagaaauuuacaauagcauuuuaagaccauaguaggauucuagcau

SEQ ID NO: 206717 - RNA, 64 nt, hsa
aaguugacucuucgacccccacccccacccaagacauuuuaauaguaaauagagagagagagaa

SEQ ID NO: 206718 - RNA, 64 nt, hsa
uggaagcuuucaugaauauucucuucuuuuaaaacauuuuaacauuauuuaaacagaaaaagau

SEQ ID NO: 206719 - RNA, 64 nt, hsa; identical to SEQ ID NO: 206710

SEQ ID NO: 206720 - RNA, 64 nt, hsa; identical to SEQ ID NO: 206709

SEQ ID NO: 206721 - RNA, 64 nt, hsa
aauguaacugcuaucuuaauguucugaaauaaaacauuuuaaaauauaaauccuguaguuuaaa

SEQ ID NO: 206722 - RNA, 64 nt, hsa
uagcccauggguuuaaaacuguaucuuaaagagucauuuuaaaauaauauaaauauuaaaaaau

SEQ ID NO: 206723 - RNA, 64 nt, hsa
ccuuuccuagcuuagagcauuuguaucuacaauacauuuuaaagucagaguucguguucccugu

SEQ ID NO: 206724 - RNA, 64 nt, hsa
cugguauggucaagcuuguaaauaacuuuuuuuacauuuuaaucuuuuccauuaauuaagaggu

SEQ ID NO: 206725 - RNA, 64 nt, hsa
agguugaaaagaagugcaguguaagaaaacccagcauuuuaauuacuugcaaauuaaguuacca

SEQ ID NO: 206726 - RNA, 64 nt, hsa
cauuaacaugcugcaauucaggagcugguuagaacauuuuaaguggcagcauagaauuuuggaa

SEQ ID NO: 206727 - RNA, 64 nt, hsa
uuugauuguuauaacaucucagcaccguuauucccauuuuaaugaugaggaaacugagucauag

SEQ ID NO: 206728 - RNA, 64 nt, hsa
auaguagggauaaaacacuaacuuaauguguauucauuuuaaauuguucuguauuuuuaaauug

SEQ ID NO: 206729 - RNA, 64 nt, hsa
uugaucuuuagauagcaugcaaaguaagacccagcauuuuaaaagcccuuuuuaaaaacuagac

SEQ ID NO: 206730 - RNA, 64 nt, hsa
uuaaguugcuugcuuuugcuuuguccauuuucaucauuuuaaaaugggggauaauaacagaacu

SEQ ID NO: 206731 - RNA, 64 nt, hsa
ucaaugaauuuucuauuuauacuaaacauauggacauuuuaaauguguuucuaauauuuuugau

SEQ ID NO: 206732 - RNA, 64 nt, hsa
acuucuagguauuacagaaacagucuguaaaugacauuuuaagaugcaaauuuaauucuguuca

SEQ ID NO: 206733 - RNA, 64 nt, hsa
caguuaagaauaaaccuuaaagcaaagacaaccacauuuuaauuuguucacaguauguaaaucu

SEQ ID NO: 206734 - RNA, 64 nt, hsa
uuuuaaugggaggguaauaaagaugaaagaccaacauuuuaacugauggaucccuuaagcuaca

SEQ ID NO: 206735 - RNA, 64 nt, hsa
cuucuucgaaacugaagugagucccgguuuguuucauuuuaaugggaggguaauaaagaugaaa

SEQ ID NO: 206736 - RNA, 64 nt, hsa
gugccagcugugauauugugcauaccauauggaccauuuuaaagaaaauuuuaaaauuucaaau

SEQ ID NO: 206737 - RNA, 64 nt, hsa
caaauagauucaacaauuacauuacuugcuuucacauuuuaaaggcacuuuaaaaaaaucuacu

SEQ ID NO: 206738 - RNA, 64 nt, hsa
uuauauucauuuucuccuuuuuucggaauugaaacauuuuaauuucaaauucaaauagaacauu

SEQ ID NO: 206739 - RNA, 64 nt, hsa
aagauaaacugaauaagcauuuagcuuuuuaaaucauuuuaaaaauuaagucuaauuuugaagc

SEQ ID NO: 206740 - RNA, 64 nt, hsa
caaaaacugcucaaagccauuuaaauuauauccucauuuuaaaaguuacauuugcaaauauuuc

SEQ ID NO: 206741 - RNA, 64 nt, hsa
aacgggagaugaugcacuguguuuugaaaguugucauuuuaaagcauuuuagcacaguucauag

SEQ ID NO: 206742 - RNA, 64 nt, hsa
uggauagcucagagguauccucuuuuugcucccccauuuuaacuugccacaucccagucacagu

SEQ ID NO: 206743 - RNA, 64 nt, hsa
uaacacagucuggcaguugcuaaauuuguguucccauuuuaaauugaccaauuuugggguguga

SEQ ID NO: 206744 - RNA, 64 nt, hsa
caagaauuuugcugaaugaaacaaucaaacaaagcauuuuaagguguaaguuauaguaccugua

SEQ ID NO: 206745 - RNA, 64 nt, hsa
aucuggaguauuaauguuugguucuauggaaccacauuuuaagagaucugcugauccaccuaag

SEQ ID NO: 206746 - RNA, 64 nt, hsa
cucaaaguaagcaauggagguaacaaauauugugcauuuuaacaguaauauuugaagauuugua

SEQ ID NO: 206747 - RNA, 64 nt, hsa
ucuugccaucuuuguuuucuuaaagaaaucuaugcauuuuaaggauaaaacuaaagcauauggg

SEQ ID NO: 206748 - RNA, 64 nt, hsa
auuaccaugcuggaauaagaagaguugcauuucucauuuuaaugagcauauggaaagaugggaa

SEQ ID NO: 206749 - RNA, 64 nt, hsa
aggauuuugcuaagggggcaaaaagcccagauaccauuuuaacuggcccaguucauuuucuccu

SEQ ID NO: 206750 - RNA, 64 nt, hsa
uucuguuagugugauuucuugcaacuuuauuuuacauuuuaaacugcugauauuggauauaaug

SEQ ID NO: 206751 - RNA, 64 nt, hsa
guguaaauaguauguauuuuauuauaauauuucucauuuuaagaugcuugguuuacauuaaauu

SEQ ID NO: 206752 - RNA, 64 nt, hsa
uauuacaucauuuacuugagguucaaaaauaauucauuuuaaauuaaguaguuuuaaucagcuu

SEQ ID NO: 206753 - RNA, 64 nt, hsa
aaguaguuuuaaucagcuuaaaagcuauuuaacccauuuuaauaagcuugcaguuuuguuucuc

SEQ ID NO: 206754 - RNA, 64 nt, hsa
cacguugccuguuuucaguuaacacugguaaugccauuuuaauauauggcuuuuucaaaucagu

SEQ ID NO: 206755 - RNA, 64 nt, hsa
gaauugcauauagagauguucaguggucguuuuucauuuuaaguaauuuuuguuuuggcauuuu

SEQ ID NO: 206756 - RNA, 64 nt, hsa
acaagcuuuccagaagcaauuuuauaacagauuucauuuuaacaaaauacugauccaauuuuca

SEQ ID NO: 206757 - RNA, 64 nt, hsa
ucuuuagaacaaauauuggagguuucauguuagccauuuuaaaaggcaacacuuugacaaaaug

SEQ ID NO: 206758 - RNA, 64 nt, hsa
aauauuugaacaaaaauugagagcuuuauugcugcauuuuaagcauaauuaauuuggacauuau

SEQ ID NO: 206759 - RNA, 64 nt, hsa
cacuaaaacauugucuacagcuccagauguuucucauuuuaaacaacuuuccacugacaacgaa

SEQ ID NO: 206760 - RNA, 64 nt, hsa
cuaggucuucaguguuuuacauugaauauugguacauuuuaauuauuuuuucucauaaaugggu

SEQ ID NO: 206761 - RNA, 64 nt, hsa
gagguucagcaauuggagguggcaauuggcuuugcauuuuaaaguauuucggguaaaggugaag

SEQ ID NO: 206762 - RNA, 64 nt, hsa
uuguucauccuaacuuucugagauggcuuuucaacauuuuaaaaaaacuaguguggcuaccauu

SEQ ID NO: 206763 - RNA, 64 nt, hsa
auaguccaaaauuuaagucuccaauaauuaauugcauuuuaaauuggcccacuuucaaggcaau

SEQ ID NO: 206764 - RNA, 64 nt, hsa
ggggaaagugauuuuaaaggugguuucuccagcacauuuuaagaaaagggaccaaaaguuauuu

SEQ ID NO: 206765 - RNA, 64 nt, hsa
accuaaucagcauauuuuugucugaauacuugaacauuuuaacaguaacgcagguguagaauca

SEQ ID NO: 206766 - RNA, 64 nt, hsa
uggggagagaggaccuccucugacaaacuggucugguacccaccaugugccaggauccacccug

SEQ ID NO: 206767 - RNA, 64 nt, hsa
aucucaauucugacaguguggaaggaaaucuguagguacccagguccucagcuccagacugggu

SEQ ID NO: 206768 - RNA, 64 nt, hsa
cuuauuaauuaaucacauuugcaggaaauucagaugaggcaagaaaauuuuauuggccugggua

SEQ ID NO: 206769 - RNA, 64 nt, hsa
aaaccagaggaaaugcauacagggcaugagcaacugaggcaaaccuuuguggacaugaauuguu

SEQ ID NO: 206770 - RNA, 64 nt, hsa
uaugcuuucucaugacaguuucucaacaauccugugaggcaaauucgcauguacccucuguauu

SEQ ID NO: 206771 - RNA, 64 nt, hsa
aaguuuauaauacucacuugacccuuguaacugaugaggcaaugaugccaccacaguauucuaa

SEQ ID NO: 206772 - RNA, 64 nt, hsa
ggaaaauccagcacaccaagcaccagucuucuucugaggcaaaagaaaaguguugucauuuuca

SEQ ID NO: 206773 - RNA, 64 nt, hsa
guaagaaggaugcuggucagagcugcagaaaauaugaggcaauuaaaagucuuuagcuguuagc

SEQ ID NO: 206774 - RNA, 64 nt, hsa
agcaucuauuuauuuagaugauuuaucugguaaaugaggcaaaaaaauuauuaaaaauacauua

SEQ ID NO: 206775 - RNA, 64 nt, hsa
cugcucuguguccucaggaagucacagagucuacugaggcaaggagagggugauucuuucccca

SEQ ID NO: 206776 - RNA, 64 nt, hsa
augguccuuaaauuucuuuuuuuuaaauugccacugaggcaacccuaguucaagaacucauucu

SEQ ID NO: 206777 - RNA, 64 nt, hsa
uucugaguccauuaucuuucacauacaguuuucaugaggcaaguuuuacucugcaaugguccuu

SEQ ID NO: 206778 - RNA, 64 nt, hsa; identical to SEQ ID NO: 21195

SEQ ID NO: 206779 - RNA, 64 nt, hsa; identical to SEQ ID NO: 21196

SEQ ID NO: 206780 - RNA, 64 nt, hsa; identical to SEQ ID NO: 21197

SEQ ID NO: 206781 - RNA, 64 nt, hsa; identical to SEQ ID NO: 21198

SEQ ID NO: 206782 - RNA, 64 nt, hsa
ugagaugacauuauugucuccauaauugagugauagcuuuaaaaaaaagauuaguuuugcuuaa

SEQ ID NO: 206783 - RNA, 64 nt, hsa
ggaacauaaauaguuucuaccugcuuguuagagaagcuuuaauuugguucuaauaaauacagua

SEQ ID NO: 206784 - RNA, 64 nt, hsa
accucuugcacuguugucuuguuucacugaucuuagcuuuaaacacaagagaagucuuuaaaaa

SEQ ID NO: 206785 - RNA, 64 nt, hsa
cccaucucuaaaaaaugaaaaaaagaagagagguagcuuuaaagugguuuuucucaugauauuc

SEQ ID NO: 206786 - RNA, 64 nt, hsa
guaacaugggaagacgugaagaagaaauaaucugagcuuuaauuauuuauauuuggauauaagg

SEQ ID NO: 206787 - RNA, 64 nt, hsa
uuaguugauagagauucauuuagucaaagacaaaagcuuuaacugugagggcacagccuugaag

SEQ ID NO: 206788 - RNA, 64 nt, hsa
aauauacuuuuccucaaguaauauaccuguuugaagcuuuaagagagauguuuuugguaacuau

SEQ ID NO: 206789 - RNA, 64 nt, hsa
caauguguaaacaggaacaacuuuaugauuugaaagcuuuaaaggagauucuucucccaccccc

SEQ ID NO: 206790 - RNA, 64 nt, hsa
ggggauugcuuuuucacuuugugacacucuuuagagcuuuaaugcuucacaguauauggccugg

SEQ ID NO: 206791 - RNA, 64 nt, hsa
aagaacauuagauauuuuaguuuuccagaacaaaagcuuuaaacuucugcaguaaguugagaga

SEQ ID NO: 206792 - RNA, 64 nt, hsa
ggcauuccuuuguguacuugguuuuucaccacugagcuuuaaauaagaauggaaauacaaggga

SEQ ID NO: 206793 - RNA, 64 nt, hsa
auugauguucuugcuuuguguuguguucugguaaagcuuuaagugagugucuuaccccuuuccu

SEQ ID NO: 206794 - RNA, 64 nt, hsa
aagauugaauguucauguguggguuaaaaaaagaagcuuuaacacuaauuuuccaaagguuagg

SEQ ID NO: 206795 - RNA, 64 nt, hsa
ugauuaucucuugggauucuuggugguugggcccagcuuuaacuuaguuguguguguuuuaaau

SEQ ID NO: 206796 - RNA, 64 nt, hsa
ugacuuauuuuuaaaacuuuuuuaaaaaagauuuagcuuuaaaauaguuggaaagaaugaagua

SEQ ID NO: 206797 - RNA, 64 nt, hsa
auugguuuuaguaagaauuaaauacauuucauugagcuuuaaaguacuuuggagaaacuuuggg

SEQ ID NO: 206798 - RNA, 64 nt, hsa
ugguaacaguucauguuugcuucauaaaugaagcagcuuuaaacaaauucauauucugucugga

SEQ ID NO: 206799 - RNA, 64 nt, hsa
ucuuuccucucuugguguucuagguaagccaaugagcuuuaaucucuacuugcuauaaccgugu

SEQ ID NO: 206800 - RNA, 64 nt, hsa
aguggcgguuucuccucgcaucuuuuuuuuuuuaagcuuuaacuuagcaggggcauggacuuua

SEQ ID NO: 206801 - RNA, 64 nt, hsa
caccugcggaaggagcuggagaaucugacaggacagcuuuaagcccaugugcaagaaaaugagg

SEQ ID NO: 206802 - RNA, 64 nt, hsa
caccugcggaaggagcuggagaaucuggcaggacagcuuuaagcccaaguggaagaaaaugagg

SEQ ID NO: 206803 - RNA, 64 nt, hsa
ccauuuaugcaccccgcaaccugggaucucaaggagcuuuaaagucuuaaugggaacuuggcau

SEQ ID NO: 206804 - RNA, 64 nt, hsa
ccgcauaugugugugcgugcgugugugcgcacauagcuuuaaaagaagacauucaaaauuugau

SEQ ID NO: 206805 - RNA, 64 nt, hsa
aggggccuggcugaccccuccagcuucagccuccagcuuuaacuucugucugcuccuaaugggg

SEQ ID NO: 206806 - RNA, 64 nt, hsa
aaaucaggacacaacagagggcagaggccccauuagcuuuaaaauguagccccagguuggagcu

SEQ ID NO: 206807 - RNA, 64 nt, hsa
uagcagcugccaguuuggagcauugcccucuaagagcuuuaaaacuauuuuuuuacaugccuua

SEQ ID NO: 206808 - RNA, 64 nt, hsa
auacauuuagguaaugaaugguaguagaacuaauagcuuuaacaggagaauagggaaugagaaa

SEQ ID NO: 206809 - RNA, 64 nt, hsa
agaaauggccaauuuaacuuuacaguaacaauagacagcacaacacaaacucucucaauacaga

SEQ ID NO: 206810 - RNA, 64 nt, hsa
uucacaaaauuuaaaucauaaacaggcaaaccaaacagcacacuguagcuauaguuguuaugug

SEQ ID NO: 206811 - RNA, 64 nt, hsa
aagacugugucuugaaagaauuaucaaagcugauacagcacauauacagaauuagccaaauggu

SEQ ID NO: 206812 - RNA, 64 nt, hsa
uccgaucuugugagacuuauucacuaucacaagaacagcacaggaaaguucugcccccgugauu

SEQ ID NO: 206813 - RNA, 64 nt, hsa
agucuucgcaccucgcccccucacccccuaacucacagcacaaacccugcaaacccaaagagaa

SEQ ID NO: 206814 - RNA, 64 nt, hsa
uuaaagaugcaguauauacuuuucucauuuuuaaacagcacauauuuauuaagagaaaaaaagu

SEQ ID NO: 206815 - RNA, 64 nt, hsa
auaacugaagggccugcucuuuccauuguggaucacagcacacacauacauacacccuccaccu

SEQ ID NO: 206816 - RNA, 64 nt, hsa
acuuuagggccccuuagcagggugagcuguuaaaacagcacacaucucucauccccucuuccuu

SEQ ID NO: 206817 - RNA, 64 nt, hsa
caccucccaccaaccaaccacacccggugggggcacagcacagaccccagagccaggaaccucu

SEQ ID NO: 206818 - RNA, 64 nt, hsa
caccucccaccaaccagccacacccggugggggcacagcacagaccccagaggcaggaaccucu

SEQ ID NO: 206819 - RNA, 64 nt, hsa
caccucccaccaaccagccacacccagugggggcacagcacagaccccagagccaggaaccucu

SEQ ID NO: 206820 - RNA, 64 nt, hsa
caccucccaccaaccagccacucccgguggggacacagcacagaccccaaagccaggaaccucu

SEQ ID NO: 206821 - RNA, 64 nt, hsa
gcaccccacuggcugcagcuagcccaccauaggcacagcacaucccaccacucuccuuccaguc

SEQ ID NO: 206822 - RNA, 64 nt, hsa
gacacaucugacauccuguguuugguuagaauauacagcacauugugauaacauaaaguggauu

SEQ ID NO: 206823 - RNA, 64 nt, hsa
acaccacaacacacaacacaccucaccucacaccacagcacaccucaccacaccacaccgcacu

SEQ ID NO: 206824 - RNA, 64 nt, hsa
cacugcaccauaccucaccacaucucaccacaccacagcacaccucaccacacaacacaccaca

SEQ ID NO: 206825 - RNA, 64 nt, hsa
ucuguccucaagaacaaguccuaggucaagggaaacagcacagccuguuuauaauuaggaaaca

SEQ ID NO: 206826 - RNA, 64 nt, hsa
uuggaugauuugggcauuacgaucaccucuuaccacagcacagaacauacauucuucaacagca

SEQ ID NO: 206827 - RNA, 64 nt, hsa
auccagagcccuacacuccacgaccugggggcucacagcacagaaccuagaagcaccugcugac

SEQ ID NO: 206828 - RNA, 64 nt, hsa
ccacacagcacaugcacacaggugcacagaccacacagcacacacaagugcacagagcacacug

SEQ ID NO: 206829 - RNA, 64 nt, hsa
acuaacacaugcacacacaaagugcauaggccacacagcacaugcacacaggugcacagaccac

SEQ ID NO: 206830 - RNA, 56 nt, hsa
aaaggauuagcagugugugagaaagaacagcacagucuuuuccuacgguacaagcu

SEQ ID NO: 206831 - RNA, 64 nt, hsa
aaaguacuagcaauaaguugaaugauaauagcucacagcacauuuguuaaugauucuuguguca

SEQ ID NO: 206832 - RNA, 64 nt, hsa
aaaugaagagaaccuucuuuuucucuugacuuugacagcacaugcuaaaaaucucuuccaagaa

SEQ ID NO: 206833 - RNA, 64 nt, hsa
uaugagcuccagugcuuuugccaaaauucucuugacagcacaccuccucucuuuccauguuaua

SEQ ID NO: 206834 - RNA, 64 nt, hsa; identical to SEQ ID NO: 173489

SEQ ID NO: 206835 - RNA, 64 nt, hsa; identical to SEQ ID NO: 173490

SEQ ID NO: 206836 - RNA, 64 nt, hsa; identical to SEQ ID NO: 173491

SEQ ID NO: 206837 - RNA, 64 nt, hsa; identical to SEQ ID NO: 173492

SEQ ID NO: 206838 - RNA, 64 nt, hsa; identical to SEQ ID NO: 173493

SEQ ID NO: 206839 - RNA, 64 nt, hsa; identical to SEQ ID NO: 173494

SEQ ID NO: 206840 - RNA, 64 nt, hsa; identical to SEQ ID NO: 173495

SEQ ID NO: 206841 - RNA, 64 nt, hsa; identical to SEQ ID NO: 173496

SEQ ID NO: 206842 - RNA, 64 nt, hsa; identical to SEQ ID NO: 173497

SEQ ID NO: 206843 - RNA, 64 nt, hsa; identical to SEQ ID NO: 173498

SEQ ID NO: 206844 - RNA, 64 nt, hsa; identical to SEQ ID NO: 173499

SEQ ID NO: 206845 - RNA, 64 nt, hsa; identical to SEQ ID NO: 173500

SEQ ID NO: 206846 - RNA, 64 nt, hsa; identical to SEQ ID NO: 173501

SEQ ID NO: 206847 - RNA, 64 nt, hsa; identical to SEQ ID NO: 173502

SEQ ID NO: 206848 - RNA, 64 nt, hsa; identical to SEQ ID NO: 173503

SEQ ID NO: 206849 - RNA, 64 nt, hsa; identical to SEQ ID NO: 173504

SEQ ID NO: 206850 - RNA, 64 nt, hsa; identical to SEQ ID NO: 173505

SEQ ID NO: 206851 - RNA, 64 nt, hsa; identical to SEQ ID NO: 173506

SEQ ID NO: 206852 - RNA, 64 nt, hsa; identical to SEQ ID NO: 173507

SEQ ID NO: 206853 - RNA, 64 nt, hsa; identical to SEQ ID NO: 173508

SEQ ID NO: 206854 - RNA, 64 nt, hsa; identical to SEQ ID NO: 173509

SEQ ID NO: 206855 - RNA, 64 nt, hsa; identical to SEQ ID NO: 173510

SEQ ID NO: 206856 - RNA, 64 nt, hsa; identical to SEQ ID NO: 173511

SEQ ID NO: 206857 - RNA, 64 nt, hsa; identical to SEQ ID NO: 173512

SEQ ID NO: 206858 - RNA, 64 nt, hsa; identical to SEQ ID NO: 173513

SEQ ID NO: 206859 - RNA, 64 nt, hsa; identical to SEQ ID NO: 173514

SEQ ID NO: 206860 - RNA, 64 nt, hsa; identical to SEQ ID NO: 173515

SEQ ID NO: 206861 - RNA, 64 nt, hsa; identical to SEQ ID NO: 173516

SEQ ID NO: 206862 - RNA, 64 nt, hsa; identical to SEQ ID NO: 173517

SEQ ID NO: 206863 - RNA, 64 nt, hsa; identical to SEQ ID NO: 173518

SEQ ID NO: 206864 - RNA, 64 nt, hsa; identical to SEQ ID NO: 173519

SEQ ID NO: 206865 - RNA, 64 nt, hsa; identical to SEQ ID NO: 173520

SEQ ID NO: 206866 - RNA, 64 nt, hsa; identical to SEQ ID NO: 173521

SEQ ID NO: 206867 - RNA, 64 nt, hsa; identical to SEQ ID NO: 173522

SEQ ID NO: 206868 - RNA, 64 nt, hsa; identical to SEQ ID NO: 173523

SEQ ID NO: 206869 - RNA, 64 nt, hsa; identical to SEQ ID NO: 173524

SEQ ID NO: 206870 - RNA, 64 nt, hsa; identical to SEQ ID NO: 173525

SEQ ID NO: 206871 - RNA, 64 nt, hsa; identical to SEQ ID NO: 173526

SEQ ID NO: 206872 - RNA, 64 nt, hsa; identical to SEQ ID NO: 173527

SEQ ID NO: 206873 - RNA, 64 nt, hsa; identical to SEQ ID NO: 173528

SEQ ID NO: 206874 - RNA, 64 nt, hsa; identical to SEQ ID NO: 173529

SEQ ID NO: 206875 - RNA, 64 nt, hsa; identical to SEQ ID NO: 173530

SEQ ID NO: 206876 - RNA, 64 nt, hsa; identical to SEQ ID NO: 173531

SEQ ID NO: 206877 - RNA, 64 nt, hsa; identical to SEQ ID NO: 173532

SEQ ID NO: 206878 - RNA, 64 nt, hsa
aaggcacugcccaaaauuuccccuacccccaacuuuccccuacccccaacuuuccccaccagcu

SEQ ID NO: 206879 - RNA, 64 nt, hsa
cuaggacugggcugaugaaggcacugcccaaaauuuccccuacccccaacuuuccccuaccccc

SEQ ID NO: 206880 - RNA, 64 nt, hsa
guccagcaaugaaggcuggagaaugcagccuggauuccccuacacacacacacacacacacaca

SEQ ID NO: 206881 - RNA, 64 nt, hsa
cuguguccucugcuucccuccguucugcuucagcuuccccuaagguuagggaagaaagaaucgg

SEQ ID NO: 206882 - RNA, 64 nt, hsa
cauaauaaucucuucuauuuauagcuauugguaguuccccuaaauucugacgauagaaauuuuu

SEQ ID NO: 206883 - RNA, 64 nt, hsa
uaacauauauauuacauuuauagcuauguaguaguuccccuaaauucuuguaaaaauaaauuuu

SEQ ID NO: 206884 - RNA, 62 nt, hsa
uuaacuaauauauuauuucuuuaagguuacucacuuccccuaccccuccaaauaccuugcau

SEQ ID NO: 206885 - RNA, 64 nt, hsa
ccugagcagcaggugugccccaugcccuguggguuuccccuauguccaaugacuguagacgggc

SEQ ID NO: 206886 - RNA, 64 nt, hsa
auucuccccaggcacugugggacugagaguccuauuccccuaguaauaggucauauuccccuag

SEQ ID NO: 206887 - RNA, 64 nt, hsa
acugagaguccuauuccccuaguaauaggucauauuccccuaguaauaugaguucucaaagccu

SEQ ID NO: 206888 - RNA, 64 nt, hsa
cuuacucugguuacuacauuucuuccacuccccuuuccccuaccugccuuaaccaaggcucaua

SEQ ID NO: 206889 - RNA, 64 nt, hsa
aggugggaaacccagauuuccucccuuugccauauuccccuaaaaugucuauaaauuaucaguc

SEQ ID NO: 206890 - RNA, 64 nt, hsa
ucaagauauuuuucucugaagugauuucugcuuggcacgcuacccucaucaucuuacucaucuu

SEQ ID NO: 206891 - RNA, 64 nt, hsa
gucagaucugucugaggagccccagucaugcucagcacgcuacagauguguuguuugucacacu

SEQ ID NO: 206892 - RNA, 64 nt, hsa
ugaugugguguuugauucucagggaaaacuguuggcacgcuaccauaaggugagcaucacuugu

SEQ ID NO: 206893 - RNA, 64 nt, hsa
gguggagguuguagugagccaagauugcaccacggcacgcuagccugggugacacagcaagacu

SEQ ID NO: 206894 - RNA, 64 nt, hsa
agcuuacauccuagcuggggagcagaguuagggugcacgcuauggcgcacacacacagugcacg

SEQ ID NO: 206895 - RNA, 64 nt, hsa
cuuuucucacccugguaaguacaguauuucaagagcacgcuaagggugguuuucauuuuacagg

SEQ ID NO: 206896 - RNA, 64 nt, hsa
agcauuguggcugugaguggcaagcugacauucugcacgcuagcacuuuacaaaaauauugugc

SEQ ID NO: 206897 - RNA, 64 nt, hsa
agagugguuugugcucaggcuggggaacagagaggcacgcuaugcugccagaauucccaggagg

SEQ ID NO: 206898 - RNA, 64 nt, hsa
aguucaggaacccuucuccauacccacaaucugagcacgcuaccaaaucucaaaauauccuaag

SEQ ID NO: 206899 - RNA, 64 nt, hsa
ugagaaaauaaaagacugcacuuuggagaggcaagcacgcuauccggguuguuguuuuguuuua

SEQ ID NO: 206900 - RNA, 64 nt, hsa
aagcaccuuggccuccucucagcucgccgaggaggcacgcuagagccgccuucccggugggagc

SEQ ID NO: 206901 - RNA, 64 nt, hsa
ccagccugggcgacagagcgagagucugucucaaaagaaaaaaaaaagcaccgccuccaaaugc

SEQ ID NO: 206902 - RNA, 64 nt, hsa
cagccugagcaacagagugagacccugucucuuaaagaaaaaaaaagucagacugcugggacug

SEQ ID NO: 206903 - RNA, 64 nt, hsa
aagacauaggacuuaacuggaaaaugaaaaaaaaaagaaaaagaaaaaacuaaacaaaaaaucc

SEQ ID NO: 206904 - RNA, 64 nt, hsa
uaggacuuaacuggaaaaugaaaaaaaaaagaaaaagaaaaaacuaaacaaaaaaucccucuag

SEQ ID NO: 206905 - RNA, 64 nt, hsa
cacaaaaauaaaaaacaaaaaaaacaaaaaacccaagaaaaaaaaaaagagucagcccuuggcu

SEQ ID NO: 206906 - RNA, 64 nt, hsa
uucacuguuguacacagucuguuuucuauuuguuaagaaaaacuacagcaucauugcauaauuc

SEQ ID NO: 206907 - RNA, 64 nt, hsa
auuuaaagacaucuauuaucugcuuugugcuuaaaagaaaaauucaaccuuuuuuuuuuuuuuu

SEQ ID NO: 206908 - RNA, 64 nt, hsa
ucugugaaaucgucugauggucuguguggaagaaaagaaaaaucugucugccgccuauuuccca

SEQ ID NO: 206909 - RNA, 64 nt, hsa
auacaaaagccagcaauaauucuucaagauccaaaagaaaaaaauauacuaccucagauuuuca

SEQ ID NO: 206910 - RNA, 64 nt, hsa
augguagauacaguuuaaaagugcuuacccaggcaagaaaaaacacagcuaggcuaagucaaca

SEQ ID NO: 206911 - RNA, 64 nt, hsa
guguuuuuguccuaauguugcuacucccauggcaaagaaaaaaaaaagaaugaaaaaaagaaaa

SEQ ID NO: 206912 - RNA, 64 nt, hsa
cucccauggcaaagaaaaaaaaaagaaugaaaaaaagaaaaaaauuuggaaaaaaaaaucaggc

SEQ ID NO: 206913 - RNA, 64 nt, hsa
uagaaaauucccccuacuucuaauuugcugaaugaagaaaaaaaaaaaucuuuuauuugugaua

SEQ ID NO: 206914 - RNA, 64 nt, hsa
ucuaguaugguguauuuaaauaauaaaaacuuaaaagaaaaaauauuuaaugguguuuggguuu

SEQ ID NO: 206915 - RNA, 64 nt, hsa
auuauucaaaugccuagaaauccauaguuuggaaaagaaaaaucaugucaucuucuauuuguac

SEQ ID NO: 206916 - RNA, 64 nt, hsa
aauggaaauugucggucauauuucuagaacuuuaaagaaaaaagaauguuauauuaguuuucua

SEQ ID NO: 206917 - RNA, 64 nt, hsa
cuagggaagauaauauuaaggaagacaaugugaaaagaaaaaugagccuggcaagaauguguuu

SEQ ID NO: 206918 - RNA, 64 nt, hsa
gggugacagagcaagugagacccugucucaaaaaaagaaaaagaaaaagaaaaaauauuuuccc

SEQ ID NO: 206919 - RNA, 64 nt, hsa
cagagcaagugagacccugucucaaaaaaagaaaaagaaaaagaaaaaauauuuucccuauuag

SEQ ID NO: 206920 - RNA, 64 nt, hsa
aagugagacccugucucaaaaaaagaaaaagaaaaagaaaaaauauuuucccuauuagagaaga

SEQ ID NO: 206921 - RNA, 64 nt, hsa
ugggucaaaagaauuagauguacagugaagggaaaagaaaaaaaaugggcgaagagagggugga

SEQ ID NO: 206922 - RNA, 64 nt, hsa
aagguguagauauaaugagguagaaguagaaaggaagaaaaacucaaagaauucuuaaaaggau

SEQ ID NO: 206923 - RNA, 64 nt, hsa
agcaacaaaauauuuauucuacuguaaaugacaaaagaaaaagaaaaauugagccuugggacgu

SEQ ID NO: 206924 - RNA, 64 nt, hsa
aaaauauuuauucuacuguaaaugacaaaagaaaaagaaaaauugagccuugggacgugcccau

SEQ ID NO: 206925 - RNA, 64 nt, hsa
auuuaugcaguuguacaauuuuauuuuuuucugcaagaaaaaguguaauguaugaaauaaacca

SEQ ID NO: 206926 - RNA, 64 nt, hsa
cuuuuuacugaaaguaagugacuuaaaaggauggaagaaaaacuacaugguuggaguguuuuua

SEQ ID NO: 206927 - RNA, 64 nt, hsa
aauuacagugugaacaagagaaaaacaggaauagaagaaaaaaguugcagguugaauuaucuau

SEQ ID NO: 206928 - RNA, 64 nt, hsa
ugggcuuuauuaucuugucagucacuaccuccuaaagaaaaaaaaaaaggcuagaagaaaaaac

SEQ ID NO: 206929 - RNA, 64 nt, hsa
gucacuaccuccuaaagaaaaaaaaaaaggcuagaagaaaaaacauuacauucauguucuaauu

SEQ ID NO: 206930 - RNA, 64 nt, hsa
ugaacuuauccuuccucccacaaaaaaagaaaagaagaaaaaauuccaagcagcaaaacuuacu

SEQ ID NO: 206931 - RNA, 64 nt, hsa
uauucauagacaaauuuuuuucaauauauuuugcaagaaaaaucuuugaauaagacuaacugca

SEQ ID NO: 206932 - RNA, 64 nt, hsa
uuggaauguaugcuaauugaacaugcaauuggggaagaaaaaauguagaaugauuuuugcuauu

SEQ ID NO: 206933 - RNA, 64 nt, hsa
guaggaaggaaaaaauaagagauagcagaggaaaaagaaaaacauuuccucuuauaacuucuga

SEQ ID NO: 206934 - RNA, 62 nt, hsa
aaaggggcaucugcuuauaagaagugagagagaagaaaaaucaugucccaaguucugagaau

SEQ ID NO: 206935 - RNA, 64 nt, hsa
gauuuguuuuuuacaucuccuuuuuccuuccuugaagaaaaauucuuggcugucccaaggauuc

SEQ ID NO: 206936 - RNA, 64 nt, hsa
agaacaguuaaucccuaaggucuugacaaaacagaagaaaaacaagccuccucguccuagucuu

SEQ ID NO: 206937 - RNA, 64 nt, hsa
uaauaaaaugcaacacuuggcauuuuuauguuuuaagaaaaacaguauuuuauuuauaauaaaa

SEQ ID NO: 206938 - RNA, 64 nt, hsa
uuaaaauuguauguuacuuauuuccagaaucucgaagaaaaaagaaaaaagagugguauuauua

SEQ ID NO: 206939 - RNA, 64 nt, hsa
uguauguuacuuauuuccagaaucucgaagaaaaaagaaaaaagagugguauuauuaugggcaa

SEQ ID NO: 206940 - RNA, 64 nt, hsa
gauugggggaguggggagggggaagaagaacaggaagaaaaaaaguacucugaacugcuccaag

SEQ ID NO: 206941 - RNA, 64 nt, hsa
gauugaacucacagauggauaccaacacggucagaagaaaaacggacagaacgguucuuguaua

SEQ ID NO: 206942 - RNA, 64 nt, hsa
aauguucuuaggcaucaaaauccaagguagcuguaagaaaaauacuggagcuaacaaugaagaa

SEQ ID NO: 206943 - RNA, 64 nt, hsa
ugcagcagucagguacauaguuaggugaacccaaaagaaaaacucuugaaaacaagagauuucu

SEQ ID NO: 206944 - RNA, 64 nt, hsa
caccgcugccagcccagaguuacccucuaaagauaagaaaaaggcuauuaauaucauacuaagu

SEQ ID NO: 206945 - RNA, 64 nt, hsa
ugaguucuaauaauccauguucaguuuguagggaaagaaaaaauaauuuuuccuucuacccacu

SEQ ID NO: 206946 - RNA, 64 nt, hsa
aagaacaguaaauuuuuagagaaacaacaaaacaaagaaaaagagcuuugagucuguaggggca

SEQ ID NO: 206947 - RNA, 64 nt, hsa
cccuaaacuguuuaaauaaagagcucuauuuuuaaagaaaaaagguacaauugaauggaaaagc

SEQ ID NO: 206948 - RNA, 64 nt, hsa
cacgugagguuuuguuuagagggauccacuacucaagaaaaaguuagcaaaccacuccuuuugu

SEQ ID NO: 206949 - RNA, 64 nt, hsa
aaauguucuuuauacagccuaguuaauguuuaaaaagaaaaaaauagcuugguuuuauuuguca

SEQ ID NO: 206950 - RNA, 64 nt, hsa
uugguuuaacaaaaaaaaaaagcuuuaaaaaaaaaagaaaaaaaggaaaagguuuuuagcucau

SEQ ID NO: 206951 - RNA, 64 nt, hsa
caggauuauuuaacuuaccuguauaucaaaagugaagaaaaaguuaguucauaaguaaaggcac

SEQ ID NO: 206952 - RNA, 64 nt, hsa
uuggaaguuuaggagccacgugagugaaaguuuuaagaaaaaugaaauuuaugucauacuuauu

SEQ ID NO: 206953 - RNA, 64 nt, hsa
gugucauguuguaaacauuucuuucaauaaacuaaagaaaaauuauuaaaggaacacauaccuu

SEQ ID NO: 206954 - RNA, 64 nt, hsa
acacacuaaauagcaucuuugaauacaaagaaccaagaaaaaggaaugaagacucgcaauuuca

SEQ ID NO: 206955 - RNA, 64 nt, hsa
cuguguuugguauuuuucugacaaaauuaagaaaaagaaaaaaaauuauuugugggcaaauguu

SEQ ID NO: 206956 - RNA, 64 nt, hsa
aaaucacuguguuugguauuuuucugacaaaauuaagaaaaagaaaaaaaauuauuugugggca

SEQ ID NO: 206957 - RNA, 64 nt, hsa
ugaagugcucugauuucuaaauauugugaagguuaagaaaaacauaaauuuaggucuaugggcu

SEQ ID NO: 206958 - RNA, 64 nt, hsa
cagagagcaaaccaaucagucccucaggaaagggaagaaaaagaagagguggcaccaugaagag

SEQ ID NO: 206959 - RNA, 64 nt, hsa
ucaacugcagucagagagcaagccccccaaaaaaaagaaaaagaaaaggaggcagaaagaggag

SEQ ID NO: 206960 - RNA, 64 nt, hsa
aauuaagaaaaaauaaaacuaccuacgaaauacuaagaaaaauuuguauacuaauauuaagaaa

SEQ ID NO: 206961 - RNA, 64 nt, hsa
augugugggucuuguuuggauccugacucaaauuaagaaaaaauaaaacuaccuacgaaauacu

SEQ ID NO: 206962 - RNA, 64 nt, hsa
uuugucacauguaucacccccaaaaaaagagaaaaagaaaaauagaagacauauaaauuaaaug

SEQ ID NO: 206963 - RNA, 64 nt, hsa
agaagagagggaggaagaaagggagagagaagaaaagaaaaaugaagaaaaguaauuagaauau

SEQ ID NO: 206964 - RNA, 64 nt, hsa
aacugcaaaucagaaagaaugauuugcagaaagaaagaaaaacuaugguguaauuuaaacucug

SEQ ID NO: 206965 - RNA, 64 nt, hsa
cucagcuuugccuucuugcuuuuucauaucuguaaagaaaaaaauuacauaucaguuguccuuu

SEQ ID NO: 206966 - RNA, 64 nt, hsa
uauauuaauuucacauauaaagguagauuuuucaaagaaaaauuugguaggcgguaguuuagaa

SEQ ID NO: 206967 - RNA, 64 nt, hsa
auaauuauaacugaaagguuuaaauauacuaccuaagaaaaaaguacuucugugacauauacaa

SEQ ID NO: 206968 - RNA, 64 nt, hsa
uucccaaguggugaggugagauuguggcuggaggaagaaaaaggauggcaugaaagaaugaccc

SEQ ID NO: 206969 - RNA, 64 nt, hsa
guuccuucuuuuuaccuuuuuaaaaaucuguuagaagaaaaaaagcagcagacgaaagagaaaa

SEQ ID NO: 206970 - RNA, 64 nt, hsa
gccaacauacugaaaccccgucucuacuaaaaauaagaaaaauuagcugggcgugguggcgggc

SEQ ID NO: 206971 - RNA, 64 nt, hsa
ugggugacagagaaggacuccgucucaaaaaaaaaagaaaaaagaauagucauuuuuaaacuac

SEQ ID NO: 206972 - RNA, 64 nt, hsa
gggagaaagggaaaagucagggaaggggagaagaaagaaaaacacauuuggccuuaaaauagca

SEQ ID NO: 206973 - RNA, 64 nt, hsa
agaauggggauacccccaaaauaagauucuggugaagaaaaagucuuguacuaaguuccccuuu

SEQ ID NO: 206974 - RNA, 64 nt, hsa
aggacuguaaagauuuguugacagcaaaauguugaagaaaaaagcuuauagaauaaaagcuaua

SEQ ID NO: 206975 - RNA, 64 nt, hsa
aagcugacuuggcacuuaagugcacuuuuuuaugaagaaaaaguacaaugaacugcuuuuccuc

SEQ ID NO: 206976 - RNA, 64 nt, hsa
ccaaaggaacauuuuaacuguaaaggcuggagacaagaaaaaauaaguagaucguuuuaauaac

SEQ ID NO: 206977 - RNA, 64 nt, hsa
gaugccgaagaguugaugucaaucuuuuuuuccuaagaaaaaaaguccgcgaguauuaaauauu

SEQ ID NO: 206978 - RNA, 64 nt, hsa
uuccucaacuugacaagaaaagcuaauuuaagagaagaaaaacauaaagucauuauauuaauua

SEQ ID NO: 206979 - RNA, 64 nt, hsa
gagaagaaaaacauaaagucauuauauuaauuaaaagaaaaaacaccauuuaauauguucugaa

SEQ ID NO: 206980 - RNA, 64 nt, hsa
uggauggggaaaugggugggagggugguguugggaagaaaaauuggucagcuuggcucggggag

SEQ ID NO: 206981 - RNA, 64 nt, hsa
aagauuaaccauuuuuuugucuuagaauaucaaaaagaaaaagaaaaagguguucuagcuguuu

SEQ ID NO: 206982 - RNA, 64 nt, hsa
aaccauuuuuuugucuuagaauaucaaaaagaaaaagaaaaagguguucuagcuguuugcauca

SEQ ID NO: 206983 - RNA, 64 nt, hsa
cucuuuuacuuugguuccuguugugcucuuguaaaagaaaaauauaauuuccugaagaauaaaa

SEQ ID NO: 206984 - RNA, 64 nt, hsa
aguguugcuagagaaaauuagggaaaaggugaaaaagaaaaaaugguaguaauugagcagaaaa

SEQ ID NO: 206985 - RNA, 64 nt, hsa
auuuaucuaaguagaacugaauuggcuaggaaaaaagaaaaacugcauguuaaucauuuuccua

SEQ ID NO: 206986 - RNA, 64 nt, hsa
cugucacaugacucauugaguaguaaugauucagaagaaaaagaaaaaggagacuuuauugguc

SEQ ID NO: 206987 - RNA, 64 nt, hsa
caugacucauugaguaguaaugauucagaagaaaaagaaaaaggagacuuuauuggucaauauu

SEQ ID NO: 206988 - RNA, 64 nt, hsa
agcccaggcaacaagagugaaacccugucucaaaaagaaaaaaaaaguugaccuugagaauuua

SEQ ID NO: 206989 - RNA, 64 nt, hsa
agccugggcaacauggcuaaacucugucucuauuaagaaaaaaaauguuaacauuaugauuuaa

SEQ ID NO: 206990 - RNA, 64 nt, hsa
uccagaacugugaaaaauaaauuuguuauuuaaaaagaaaaaaaaaaaaacaaaaaccugaguu

SEQ ID NO: 206991 - RNA, 64 nt, hsa
aaaaaaaaaaaaaaaaaaaaaaaggaaaaaaaaaaagaaaaagaaaacgugugcauuuuguaua

SEQ ID NO: 206992 - RNA, 64 nt, hsa
caaaaguuuuaccacagucugcacuugcagaagaaagaaaaaaauucaaaccacauguuuauuu

SEQ ID NO: 206993 - RNA, 64 nt, hsa
guuaugauaaaaggaaguagaugugaaaaagccuaagaaaaaggaaauuggacaguuuugauac

SEQ ID NO: 206994 - RNA, 64 nt, hsa
auugaaaaaagagaaaggggcaagaaauucauuaaagaaaaaccacagauacugaaacauuuga

SEQ ID NO: 206995 - RNA, 64 nt, hsa
uaugaaugguuuuaugucauuuuuuuaauuaaaaaagaaaaauucauauaaucguguuuaaaac

SEQ ID NO: 206996 - RNA, 64 nt, hsa
aaaauuccaacugcuguuggggaaggacacagaaaagaaaaauaaccacccaagaaaaacaaaa

SEQ ID NO: 206997 - RNA, 64 nt, hsa
uucauacuuuuuauacuuugaggaaaaaaagucaaagaaaaauuguauuugagggaaaaaacca

SEQ ID NO: 206998 - RNA, 64 nt, hsa
aauuuucuuugcauuuuaaaauaucuggauuaugaagaaaaagugaugaaaauaaauuaaaacu

SEQ ID NO: 206999 - RNA, 64 nt, hsa
ugcagugcagagcacuuuaaugcaaccagcuuucaagaaaaagcccuaucuaguacuugauguu

SEQ ID NO: 207000 - RNA, 64 nt, hsa
aauaauagcccugagauguuucuaacauuuaaauaagaaaaaaaucaaaucgaagucagccugc

SEQ ID NO: 207001 - RNA, 64 nt, hsa
uuugugcuuuaggcaaacauuaaccagcucuaacaagaaaaaugucuagauuuacacauuguca

SEQ ID NO: 207002 - RNA, 64 nt, hsa
accaaguaagacucaaaauugcaaauauaaacaaaagaaaaauccaacugaaaauaacacuaag

SEQ ID NO: 207003 - RNA, 64 nt, hsa
auaacaaaguguuaguaaucauugcuuucuguagaagaaaaagguuuaaauuuaaaauguguau

SEQ ID NO: 207004 - RNA, 64 nt, hsa
gccuauuuuucuguuccagcaacuguuuuuaugaaagaaaaacuugaaaugcuacuuaacuuac

SEQ ID NO: 207005 - RNA, 64 nt, hsa
aguauuuuuauuaccaauaaauuuaaaauuuuuuaagaaaaauauuuuuauccuagggccaagu

SEQ ID NO: 207006 - RNA, 64 nt, hsa
agcuuguauauguaguaguuugaugaauaauuuaaagaaaaacaccuaaaauuugaaaaaugau

SEQ ID NO: 207007 - RNA, 64 nt, hsa
ugaagugaacuaugaaguaagcaacaaggaugacaagaaaaacauggggaaacagaugccucag

SEQ ID NO: 207008 - RNA, 64 nt, hsa
uggggaaacagaugccucagccuacuuucacacuaagaaaaaaacuugucuucccuucugauug

SEQ ID NO: 207009 - RNA, 64 nt, hsa
gugcccaacuuuucuaagugagcuuagcaaugagaagaaaaaaaaacaugaauucuuuuucugg

SEQ ID NO: 207010 - RNA, 64 nt, hsa
gucagaaguauuuuaaagggcuuaaugugccaaaaagaaaaaaagcuagagacccuuuuugcaa

SEQ ID NO: 207011 - RNA, 64 nt, hsa
gccacugcaagcucugaaucaguuuuuuaaaaaaaagaaaaaaaaaaaaaaggagcugugcccc

SEQ ID NO: 207012 - RNA, 64 nt, hsa
ccaccugggcaacauaguaagaucuugucucuuaaagaaaaaaaaaaaagguacuuagaggucg

SEQ ID NO: 207013 - RNA, 64 nt, hsa
ggugggaggcaaaagacacuucuuacauuguggcaagaaaaaaugaggaagaagcaaaagcaga

SEQ ID NO: 207014 - RNA, 64 nt, hsa
ucacgcugcugauaaagacauacccgagacugggaagaaaaagugguuuaauuggacuuaaagu

SEQ ID NO: 207015 - RNA, 64 nt, hsa
uaaugcugcugauaaagacguacccgagacugggaagaaaaagagguuuacuuggacuuacagu

SEQ ID NO: 207016 - RNA, 64 nt, hsa
cagcaucuuaccuucauaugcaguaaaagaaagaaagaaaaaaaaaggaaaaaaaaaaaaaaac

SEQ ID NO: 207017 - RNA, 64 nt, hsa
uuuuuuguacaaaacuuuuuuaaauauaaauguuaagaaaaauuuuuuuuaaaaaacacuucau

SEQ ID NO: 207018 - RNA, 64 nt, hsa
gucucuaaaggguuaaauguaucaauuggaaaggaagaaaaaaggccuugaauugacaaauuaa

SEQ ID NO: 207019 - RNA, 64 nt, hsa
gaucaaaguuuucagugcauuuauuguacauuuuaagaaaaaggugaaaaucauuuggggagua

SEQ ID NO: 207020 - RNA, 64 nt, hsa
uucaaugacaugaaaacugugcaagcaaaaaccgaagaaaaacacuuaaguacaacuguaguga

SEQ ID NO: 207021 - RNA, 64 nt, hsa
auuuuuaucaaauguuaugaugcaaaaaaagaaaaagaaaaaaaaaaagaaaagaaaacuucaa

SEQ ID NO: 207022 - RNA, 64 nt, hsa
caaaagauuuuuaucaaauguuaugaugcaaaaaaagaaaaagaaaaaaaaaaagaaaagaaaa

SEQ ID NO: 207023 - RNA, 64 nt, hsa
caauaaagaaaaaaaaauacaaaggaagaaaagaaagaaaaacaaguguucagggcauaacaac

SEQ ID NO: 207024 - RNA, 64 nt, hsa
ucagaaagcaguagugagagugagaguaacaauaaagaaaaaaaaauacaaaggaagaaaagaa

SEQ ID NO: 207025 - RNA, 64 nt, hsa
acuggagaagaaaaaaaagaaaaaagauagaaaaaagaaaaaguuucagaagagcagaaguaaa

SEQ ID NO: 207026 - RNA, 64 nt, hsa
uuacaggaaauuagaucgacuggagaagaaaaaaaagaaaaaagauagaaaaaagaaaaaguuu

SEQ ID NO: 207027 - RNA, 64 nt, hsa
auuucccaauuacaggaaauuagaucgacuggagaagaaaaaaaagaaaaaagauagaaaaaag

SEQ ID NO: 207028 - RNA, 64 nt, hsa
gucuguacuaaaaaaaaaaaaaaagaaaaagaaaaagaaaaaagaauacccaggugugguagug

SEQ ID NO: 207029 - RNA, 64 nt, hsa
aacccggucuguacuaaaaaaaaaaaaaaagaaaaagaaaaagaaaaaagaauacccaggugug

SEQ ID NO: 207030 - RNA, 64 nt, hsa
uggugaaacccggucuguacuaaaaaaaaaaaaaaagaaaaagaaaaagaaaaaagaauaccca

SEQ ID NO: 207031 - RNA, 64 nt, hsa
uguuguuauacuguauuguuuagggaauaacaauaagaaaaacagucuguacauguucacuaca

SEQ ID NO: 207032 - RNA, 64 nt, hsa
aaguaucccuuucaaaugccuuugagaagaauagaagaaaaaaaguuuguauauauuuuaaaaa

SEQ ID NO: 207033 - RNA, 64 nt, hsa
ucccuuauguugaggcauggaaaaaaaauuggaaaagaaaaacucaguuuaaauacggagacua

SEQ ID NO: 207034 - RNA, 64 nt, hsa
guggcaauuuauuuuaagaguauuuucugguaaaaagaaaaauguguauuuuaagaugaaauau

SEQ ID NO: 207035 - RNA, 64 nt, hsa
gugcuuuguuuccgugcacuuaaaaauaauugagaagaaaaacucaauuaaaauuuuguuuaua

SEQ ID NO: 207036 - RNA, 64 nt, hsa
aaaaauuuuuaggaaacucaccuuccucaucuaaaagaaaaaggcauuuuagagaaaacuaaag

SEQ ID NO: 207037 - RNA, 64 nt, hsa
aaaccaugacgcaaagagagauuuuuuuuuaaagaagaaaaaaaaaaauucacacugccagcgu

SEQ ID NO: 207038 - RNA, 64 nt, hsa
aaauaaaaaggacuacuuaaacauuugucauauuaagaaaaaaaguuuaucuagcacuugugac

SEQ ID NO: 207039 - RNA, 64 nt, hsa
gaacuuauucuuaagaaauuguacuuuuuauuguaagaaaaauaaaaaggacuacuuaaacauu

SEQ ID NO: 207040 - RNA, 64 nt, hsa
auuuugcacgccaaacucggcagcuuuggggaagaagaaaaaugccuuucuguuccccucucau

SEQ ID NO: 207041 - RNA, 64 nt, hsa
gcccggcggucccuguuuugcuuuauugcuguuuaagaaaaauggagguaguuccaaaaaagug

SEQ ID NO: 207042 - RNA, 64 nt, hsa
gcuggguuuucugaagucugaggaacaaugccuuaagaaaaaacaaacagcaggaaucgguggg

SEQ ID NO: 207043 - RNA, 64 nt, hsa
uauuguugaauguacaucuaccccagccccucaaaagaaaaacuguuuacauagaaauuccuac

SEQ ID NO: 207044 - RNA, 64 nt, hsa
accuuaucuuugucacaggguguucuuuuuuaugaagaaaaauuugaaaaugauaaaagcuaag

SEQ ID NO: 207045 - RNA, 64 nt, hsa
aaguguuuuccacuaauuuugcaugcguauuuauaagaaaaaugugaauuuggugguuuuauuc

SEQ ID NO: 207046 - RNA, 64 nt, hsa
ugacaauuuauuuuugccaucauuuuuuuaauuaaagaaaaaauuuccagaagaggaaaaaaaa

SEQ ID NO: 207047 - RNA, 64 nt, hsa
gcacagaaguuuaagacuaugaguuuuuagggugaagaaaaaacuguacaguuuaaaugaaaau

SEQ ID NO: 207048 - RNA, 64 nt, hsa
gcaagacacucuggccaccauaaaaaacgcagaaaagaaaaaaagguuaagcauaaaaagaaag

SEQ ID NO: 207049 - RNA, 64 nt, hsa
agucugggcaccgaaagagagcaucaaaaucaccaagaaaaacagcuucucaguuaagugaaaa

SEQ ID NO: 207050 - RNA, 64 nt, hsa
aagcagggccaaauggaaagaacacauaauaaacaagaaaaaaacagaggugaagaaaaaucca

SEQ ID NO: 207051 - RNA, 64 nt, hsa
agaacacauaauaaacaagaaaaaaacagaggugaagaaaaauccaagucugaacgggaaugcc

SEQ ID NO: 207052 - RNA, 64 nt, hsa
cagggcuggggccaagaggaaaaacagggaaaaaaagaaaaaaaaaagaaaaaggaaaaggaag

SEQ ID NO: 207053 - RNA, 64 nt, hsa
ccaagaggaaaaacagggaaaaaaagaaaaaaaaaagaaaaaggaaaaggaagcgguguguggc

SEQ ID NO: 207054 - RNA, 64 nt, hsa
aauuuaaacaaagaaacacuugaaagaaacuggaaagaaaaauaauuuuuuuaugugaacaaau

SEQ ID NO: 207055 - RNA, 64 nt, hsa
aaaauaauuuuuuuaugugaacaaauuuugcaagaagaaaaaagcauaaaagacacuaacggca

SEQ ID NO: 207056 - RNA, 64 nt, hsa
uaaaguuuaauugaaagaauguaaagcaaccaaaaagaaaaaaaaaaagaaagaaagaggaaaa

SEQ ID NO: 207057 - RNA, 64 nt, hsa
cugcaaacuauuuaaagaaauauguauucuguaaaagaaaaaaaaaaugcggccuuuucaugag

SEQ ID NO: 207058 - RNA, 64 nt, hsa
gugauaagcacaaaucucuacuccucaugacaugaagaaaaagacugaaugugaagggaguuuc

SEQ ID NO: 207059 - RNA, 64 nt, hsa
auacguuugacccauuuugaauaaggaaauugaaaagaaaaauuuaaaaggagaaaaaaaugca

SEQ ID NO: 207060 - RNA, 64 nt, hsa
cacuauuauauaguggguuauauuaaaagaaaagaagaaaaauaucuaauuucucuuggcagau

SEQ ID NO: 207061 - RNA, 64 nt, hsa
aguuucaaagcagguaaauuguaaauguuucuuuaagaaaaagcaugugaaaggaaaaagguaa

SEQ ID NO: 207062 - RNA, 64 nt, hsa
uuucuuuuguauuuuguuauaaucuuaagcaacaaagaaaaaacccuaauauuugaaucuauuu

SEQ ID NO: 207063 - RNA, 64 nt, hsa
cuucugagguacauuuugaaugacagcauauuguaagaaaaaaaaaggugaauaaaauuugaca

SEQ ID NO: 207064 - RNA, 64 nt, hsa
uuuauugcuguuuugucuuucuuuuuucuaaaaaaagaaaaaaaagaaaaaaaggaaaagaaga

SEQ ID NO: 207065 - RNA, 64 nt, hsa
guuuugucuuucuuuuuucuaaaaaaagaaaaaaaagaaaaaaaggaaaagaagaacaaagaaa

SEQ ID NO: 207066 - RNA, 64 nt, hsa
ccggacagcgaacuggaggggggagaaauuuucaaagaaaaacgagggaaaugggaggggugca

SEQ ID NO: 207067 - RNA, 64 nt, hsa
agaaacagcauggagaaaacccgguacgcucaaaaagaaaaaggaaaaaaaaaaaucccaucac

SEQ ID NO: 207068 - RNA, 64 nt, hsa
gaccaugauaauucaguuuauauucaccacaugaaagaaaaauggguaacagaagaacccuuaa

SEQ ID NO: 207069 - RNA, 64 nt, hsa
aaguaauguugaccaucccccucucagcugaauaaagaaaaauuuaguucaauuuauugcaauu

SEQ ID NO: 207070 - RNA, 64 nt, hsa
auuuauuaauuuuaaaacauucagaacuuguugaaagaaaaauuauaucugaaucaagauucau

SEQ ID NO: 207071 - RNA, 64 nt, hsa
ugguaaaaucaguuuuuugauaguguguguauauaagaaaaaauagauacacacauucuuuuuu

SEQ ID NO: 207072 - RNA, 64 nt, hsa
cauuguuugggggccaggcauuacuacuaucaugaagaaaaaugaagagcaggaugcauguuag

SEQ ID NO: 207073 - RNA, 64 nt, hsa
cacuccagccugggccacagagcaagacugucucaagaaaaaaaauuuuuuaaauaaguuuaau

SEQ ID NO: 207074 - RNA, 64 nt, hsa
cuuuauucaagauaccugaacuggggugcuuuuuaagaaaaauuugggaaauauauauguuucu

SEQ ID NO: 207075 - RNA, 64 nt, hsa
cugaugcacaguaaaauccgagaaacacugguuuaagaaaaaccuuguaaugaucgaauaccca

SEQ ID NO: 207076 - RNA, 64 nt, hsa
aggagaaaagaaagcacacugccuaaauguguaaaagaaaaaugcagagguuauuaaaauguaa

SEQ ID NO: 207077 - RNA, 64 nt, hsa
ugugguuacccauuuuuuagaaggagccguacagaagaaaaauuauucuacauuauguaggauu

SEQ ID NO: 207078 - RNA, 64 nt, hsa
gucuuguuuguaaaaaaaaaaaaaaaaaaagaaaaagaaaaaaguguauuuuacuguuuucugu

SEQ ID NO: 207079 - RNA, 64 nt, hsa
aagcuagucuuguuuguaaaaaaaaaaaaaaaaaaagaaaaagaaaaaaguguauuuuacuguu

SEQ ID NO: 207080 - RNA, 64 nt, hsa
uuaugaaugacuuucuacagaguuucuauuucuaaagaaaaaacaauuguucacaucccaucug

SEQ ID NO: 207081 - RNA, 64 nt, hsa
gagccuguugugggagguagggaggaaauauguaaagaaaaacaggaagauaccugcacuaauc

SEQ ID NO: 207082 - RNA, 64 nt, hsa
uccuggcuaucuuaaacaaguucauacauuugaaaagaaaaaaaaauguuguuuaaaaaauguu

SEQ ID NO: 207083 - RNA, 64 nt, hsa
cuuagucuaaagacuguagcaaaaaaaaaaaaaaaagaaaaauuagauuuuacauaucuuugca

SEQ ID NO: 207084 - RNA, 64 nt, hsa
ugaauaucauugauuuuauaauuggugcuauuugaagaaaaaaauguacauuuauucauagaua

SEQ ID NO: 207085 - RNA, 64 nt, hsa
augaaccaaaugguucuuacuuuuccuggacuuaaagaaaaaaagagguuuaaguuuguugugg

SEQ ID NO: 207086 - RNA, 64 nt, hsa
ccagaaguaacuuauuuuguacuaguguccgcauaagaaaaagaaucggcaguauuuucuguuu

SEQ ID NO: 207087 - RNA, 64 nt, hsa
cccuucaacccccucgccuccuacucugagacaaaagaaaaaauauuaaaaaaaugcauaggcu

SEQ ID NO: 207088 - RNA, 64 nt, hsa
aaaaaagaggaaaaaaaggcaaaaaauauugugaaagaaaaaaaacaacuuaauauauuuugga

SEQ ID NO: 207089 - RNA, 64 nt, hsa
acauuugguucaugugcauuguuuacaaagcaaaaagaaaaaagaggaaaaaaaggcaaaaaau

SEQ ID NO: 207090 - RNA, 64 nt, hsa
uuuugguggggugggggugggcuaaagccauaggaagaaaaaugugauguauguguccaguaug

SEQ ID NO: 207091 - RNA, 64 nt, hsa
aaagaagagcugcagcuuugacagugcuuauuuaaagaaaaauacugcuggaaaauuuccaauu

SEQ ID NO: 207092 - RNA, 64 nt, hsa
ugaugcaacugauuuauacaaaaugaacuuuggcaagaaaaauaacauuaaccucauuguuuau

SEQ ID NO: 207093 - RNA, 64 nt, hsa
aguuucacagacaucauagauccuuuucuuaaagaagaaaaacauguauaaaauaguuuuagua

SEQ ID NO: 207094 - RNA, 64 nt, hsa
ugagaggaggcagagagagggaggcagauggaagaagaaaaacaguuaaauaagacauacccag

SEQ ID NO: 207095 - RNA, 64 nt, hsa
ccuggagagcagagcaagacucugucucaaaaaaaagaaaaaaguuuuauuauccuuacuuuuu

SEQ ID NO: 207096 - RNA, 64 nt, hsa
gcuuuugugccccuuaaauguagauaugugcugaaagaaaaaaaaaacgcccaacucuugaagu

SEQ ID NO: 207097 - RNA, 64 nt, hsa
acuuccguagauaauguggaaaucaaauuuaaccaagaaaaaaagauuggaacaaaugcucucu

SEQ ID NO: 207098 - RNA, 64 nt, hsa
uaacauucagacaaguaacaggcaacaaagauuuaagaaaaauuuaugguggaaaaccuuaaaa

SEQ ID NO: 207099 - RNA, 64 nt, hsa
augucaacacacuuaaacuacaugcuaaauagucaagaaaaaaauggaaacaguagcauccaua

SEQ ID NO: 207100 - RNA, 64 nt, hsa
aauuucuauucaggcuacuggaauugguuauuaaaagaaaaaggaaaaagaagaaucuugcugc

SEQ ID NO: 207101 - RNA, 64 nt, hsa
ucauaacuuuaauucaagaaugcaguuuuaccaaaagaaaaauuugaaaauuucuauucaggcu

SEQ ID NO: 207102 - RNA, 64 nt, hsa
ugugacaaaaaaaaaaaaaaaaaaaagaaaaaaaaagaaaaaacagaaauauauccagcuaaca

SEQ ID NO: 207103 - RNA, 64 nt, hsa
aacaguguucugugacaaaaaaaaaaaaaaaaaaaagaaaaaaaaagaaaaaacagaaauauau

SEQ ID NO: 207104 - RNA, 64 nt, hsa
ugaaaauguuuauuuaaaaaaaaaaaagaugacaaagaaaaacagagagagagaauauuggaga

SEQ ID NO: 207105 - RNA, 64 nt, hsa
caggaacccaccaaaccaaccaaucaaccaaacaaagaaaaaauuccacaaugaaagaauguau

SEQ ID NO: 207106 - RNA, 64 nt, hsa
augaacuuugguucuucaugagugcauuuugaaaaagaaaaaaaguacacauucagaaucuggc

SEQ ID NO: 207107 - RNA, 64 nt, hsa
aagaagcucaaagaaaagaaguacguuaaagaaaaagaaaaaaccucacuuuuccuuuauagug

SEQ ID NO: 207108 - RNA, 64 nt, hsa
uugaccaagaagcucaaagaaaagaaguacguuaaagaaaaagaaaaaaccucacuuuuccuuu

SEQ ID NO: 207109 - RNA, 64 nt, hsa
cuuuuaaagauaguuuugcuguugcuccuagugaaagaaaaaucucuguacaaaggagaaaaag

SEQ ID NO: 207110 - RNA, 64 nt, hsa
uuuuuugccuuggugacuuuugaaaaaaaaagaaaagaaaaagcagcauccuuauauuucuuua

SEQ ID NO: 207111 - RNA, 64 nt, hsa
caugauuuaauauaugugguuugggggaaaggacaagaaaaaacuauaauuccacauauaagaa

SEQ ID NO: 207112 - RNA, 64 nt, hsa
gccagaacuuucuuucacgguuacuguuccugaaaagaaaaagccaccuagcccuaucaagcca

SEQ ID NO: 207113 - RNA, 64 nt, hsa
cucaggaguuucuauaggugucuucagaguucugaagaaaaauuacuggacacagcuucagcua

SEQ ID NO: 207114 - RNA, 64 nt, hsa
uccaguaguaaaauauguaaccauugucccaguaaagaaaaauaacaaaaguuguaaaauguau

SEQ ID NO: 207115 - RNA, 64 nt, hsa
gguuaaacaugguuagaaacaacugaaagcauaaaagaaaaaucuaggccgggugcaguggcuc

SEQ ID NO: 207116 - RNA, 64 nt, hsa
guugugacaaccacaagcacuuuuuuuuuuuuuaaagaaaaaaagguagugaauuuuuaaucau

SEQ ID NO: 207117 - RNA, 64 nt, hsa
gaagauuuuuguccaugcuugauuuuuuuuuuuaaagaaaaacuuucauggguuagcauuaccu

SEQ ID NO: 207118 - RNA, 64 nt, hsa
ugcaggaaaauaauauuuuuauguauaaaagaugaagaaaaaauuuugcaagucuuuaagcaca

SEQ ID NO: 207119 - RNA, 64 nt, hsa
cuugaucccacugaucuugacaucaagucuaacaaagaaaaaguuuugaguuuuguauuuucuu

SEQ ID NO: 207120 - RNA, 64 nt, hsa
ccacagugccuacaacccaggcccuaaguugaugaagaaaaagucaaggaaggaggugauacaa

SEQ ID NO: 207121 - RNA, 64 nt, hsa
ccauuaccuuuccucugccugaaagacgugucucaagaaaaauaaauucuauuuuagaugcagg

SEQ ID NO: 207122 - RNA, 64 nt, hsa
ucuuccuuuaaagcaagaaaucauguuauuuagaaagaaaaacuaaucuuaaacauacuauuuc

SEQ ID NO: 207123 - RNA, 64 nt, hsa
augaccagaacuugucaaugagaaaccacuuguuaagaaaaaguccaguguuuauuucucaaga

SEQ ID NO: 207124 - RNA, 64 nt, hsa
cugauucucauaguaaauacaagcauacucuuguaagaaaaacacugaauacuuugaaccacaa

SEQ ID NO: 207125 - RNA, 64 nt, hsa
uuuaaaauuaagagagcagcaaaugaaaggaguaaagaaaaaaauagcugucggguaggaugcc

SEQ ID NO: 207126 - RNA, 64 nt, hsa
caugacauuucgcagugcagagaaggcagaacccaagaaaaacgucaucuuugagacuuugcuu

SEQ ID NO: 207127 - RNA, 64 nt, hsa
aggggggcagagauggaugaagagaaagcccacgaagaaaaaagccugguuuuguuuuucccag

SEQ ID NO: 207128 - RNA, 64 nt, hsa
uuggcaaucaaagcaugcacuuguaacaaugaaaaagaaaaagcauuuuauauuacuacucaau

SEQ ID NO: 207129 - RNA, 64 nt, hsa
aaaaaaaaaaaaaaucugccuaugcauguuuuuuaagaaaaaaaaaauggcuguaucggccugu

SEQ ID NO: 207130 - RNA, 64 nt, hsa
auuaggcagucuuaaaaaaaaaaaaaaacagaaaaagaaaaaaaagaacguugcaaauuuguua

SEQ ID NO: 207131 - RNA, 64 nt, hsa
ugugaagcagcuauacguggcauacauguauuuaaagaaaaaaaaauagauguagaguguuuuu

SEQ ID NO: 207132 - RNA, 64 nt, hsa
uccucagaagccuauuuuuaaagcagaagcaaaaaagaaaaacaaaauaacaaaaacaacccuu

SEQ ID NO: 207133 - RNA, 64 nt, hsa
guauauacauaugacauauauauuaaaauguaggaagaaaaauguuugaguaccugaugaaaau

SEQ ID NO: 207134 - RNA, 64 nt, hsa
uccauguugcuuuauauguagccuugccuuuuaaaagaaaaaguaugugaauaugaauugacag

SEQ ID NO: 207135 - RNA, 64 nt, hsa
cuaauggcuuguuuguguaaagcuuuuuuauuaaaagaaaaauuuuaaaaaucuuguaccuagc

SEQ ID NO: 207136 - RNA, 64 nt, hsa
ccucuuacaguaggaaacaacugaacccaucaauaagaaaaaggaucgaaagggaccaagcagc

SEQ ID NO: 207137 - RNA, 64 nt, hsa
guggccaaacuuauuuaugcugcuaaaugaaagaaagaaaaaagcaaauuauuuuuuuuuauuu

SEQ ID NO: 207138 - RNA, 64 nt, hsa
ccuucccccugcaaaaagaaaaaaagaaaagaaaaagaaaaaaaucccuuguucucaguggugc

SEQ ID NO: 207139 - RNA, 64 nt, hsa
cccugcccuucccccugcaaaaagaaaaaaagaaaagaaaaagaaaaaaaucccuuguucucag

SEQ ID NO: 207140 - RNA, 64 nt, hsa
uagacgauauacucccugcccuucccccugcaaaaagaaaaaaagaaaagaaaaagaaaaaaau

SEQ ID NO: 207141 - RNA, 64 nt, hsa
gccuucuguuacaccucaaaauguguuacaugggaagaaaaagauuaagaaaaagcaagauaau

SEQ ID NO: 207142 - RNA, 64 nt, hsa
accucaaaauguguuacaugggaagaaaaagauuaagaaaaagcaagauaauuuugaagaagga

SEQ ID NO: 207143 - RNA, 64 nt, hsa
uaaagcugguuuaauguuuuggccaaugcaccuaaagaaaaacaaacucguuuuuuacaaagcc

SEQ ID NO: 207144 - RNA, 64 nt, hsa
cucugaguggacuggccucaaagcaagcauucagaagaaaaagaagcaaccucaguaauuuaga

SEQ ID NO: 207145 - RNA, 64 nt, hsa
aaacaugaaaugcuuccaagcaugacaacuuuuaaagaaaaauaugauacucucagauuuuaag

SEQ ID NO: 207146 - RNA, 64 nt, hsa
ucagggagcuauuuucauuuagugcuaaacaaguaagaaaaauaagcucgagugaauuucuaaa

SEQ ID NO: 207147 - RNA, 64 nt, hsa
accccgcaaacaagaauuaagaugaucccaauaaaagaaaaauugcucaggaaacugaaccuuu

SEQ ID NO: 207148 - RNA, 64 nt, hsa
acaguuggagccaaugccucauaguguaaacugaaagaaaaauaguugcuuuuuaaaaugucag

SEQ ID NO: 207149 - RNA, 64 nt, hsa
cccaaauuucauucuuagaaaguuauguuccaugaagaaaaauauauguucuuuugaauacuua

SEQ ID NO: 207150 - RNA, 64 nt, hsa
gauucauaaggagcuuaucugaacagauuuaucuaagaaaaaaaaaaaacgacauaaaauaagu

SEQ ID NO: 207151 - RNA, 64 nt, hsa
auauguuuuuguaucaaaaacacucauauauuucaagaaaaagaaauuauguuaaauagcccug

SEQ ID NO: 207152 - RNA, 64 nt, hsa
aagaaaaagaaauuauguuaaauagcccuguuuuaagaaaaauauuuaugaagcaucucaacuu

SEQ ID NO: 207153 - RNA, 64 nt, hsa
ggcaauguagugagacccugucucuaauuuaaaaaagaaaaagaaaaaaacauucccaguggca

SEQ ID NO: 207154 - RNA, 64 nt, hsa
guagugagacccugucucuaauuuaaaaaagaaaaagaaaaaaacauucccaguggcagccugc

SEQ ID NO: 207155 - RNA, 64 nt, hsa
uugaauuguucuuaaggcaucauaucuagaagcaaagaaaaaagaaaaauaacaauuuaaguug

SEQ ID NO: 207156 - RNA, 64 nt, hsa
guucuuaaggcaucauaucuagaagcaaagaaaaaagaaaaauaacaauuuaaguuguguaaau

SEQ ID NO: 207157 - RNA, 64 nt, hsa
cucugucucagaaaaaaaaaaaaagaaaaggaaaaagaaaaauauauauucuauauuuuuuuaa

SEQ ID NO: 207158 - RNA, 64 nt, hsa
ugucguuuuaacaucuccacgucccuagcauaaaaagaaaaagaaaaaaauuuaaacugcuuuu

SEQ ID NO: 207159 - RNA, 64 nt, hsa
uuuaacaucuccacgucccuagcauaaaaagaaaaagaaaaaaauuuaaacugcuuuuucggaa

SEQ ID NO: 207160 - RNA, 64 nt, hsa
gugauaugauaaauaaaccccuaauuagccuuagaagaaaaaccacugcaagauauuaagcgug

SEQ ID NO: 207161 - RNA, 64 nt, hsa
uauuuaacccuguaaguuacuuuaaagcuaauacaagaaaaacaaagacaagugaaaguaagga

SEQ ID NO: 207162 - RNA, 64 nt, hsa
aaguuuauaguuuuauauuuggaccuugaaagguaagaaaaaaccagguucuccaaaguuagga

SEQ ID NO: 207163 - RNA, 64 nt, hsa
acuagcagggaaguuuccuugagccuaaaauaaaaagaaaaaauuaaaaagaaucaguuuuuuu

SEQ ID NO: 207164 - RNA, 64 nt, hsa
gagagaaaagagggggaagaugguucaaagauacaagaaaaaguagaaaaaaaaauaacacuua

SEQ ID NO: 207165 - RNA, 64 nt, hsa
gguguuucaaaggguaaauuauaaauguuucaugaagaaaaaauuuuaaaaaucuacgucuuua

SEQ ID NO: 207166 - RNA, 64 nt, hsa
ggugggggcuuaggcauccauauuggauucagaaaagaaaaagaaugaugcuucuugcaacaaa

SEQ ID NO: 207167 - RNA, 64 nt, hsa
uaauauguaauauuagaacauauuacaaaguagcaagaaaaauacgacauugguguaaaaauaa

SEQ ID NO: 207168 - RNA, 64 nt, hsa
ucagauauuucaacucaucucaucaguuucuuguaagaaaaaaacauuuucacuuuguagcaca

SEQ ID NO: 207169 - RNA, 64 nt, hsa
uuuggauagacuccaugccuucucucucccugcaaagaaaaaucuugaacauuuaugaugucaa

SEQ ID NO: 207170 - RNA, 64 nt, hsa
agaagugcauagguccauaauauuucauaaaaugaagaaaaagaauguggccaaacaauuauuc

SEQ ID NO: 207171 - RNA, 64 nt, hsa
auauaagaaaggaaauuuaaaaacauuccacaagaagaaaaauuauuguuuauacuucuacuua

SEQ ID NO: 207172 - RNA, 64 nt, hsa
caguaaauaauccuccuucaaaaaauaaaaauaaaagaaaaaggaaaaucauucaggaagaaau

SEQ ID NO: 207173 - RNA, 64 nt, hsa
uucagcuuccuugauuuagaaauaugauauaauaaagaaaaacuccauuuaucaucuguuacaa

SEQ ID NO: 207174 - RNA, 64 nt, hsa
cucaagcacuucuagaaucaugcacugaauucaaaagaaaaaucuugcugcuuuuuguccaggg

SEQ ID NO: 207175 - RNA, 64 nt, hsa
cucuugaugaaagaaaaagacagaaggaaggaagaagaaaaagacugcaagcuuuccugccaau

SEQ ID NO: 207176 - RNA, 64 nt, hsa
cuuuaaaaagcccucuuaaugaugcucuugaugaaagaaaaagacagaaggaaggaaggaagga

SEQ ID NO: 207177 - RNA, 64 nt, hsa
caauaauguagauagaacaaauuacagacaaggaaagaaaaaacuugaaugaaauggauuuuac

SEQ ID NO: 207178 - RNA, 64 nt, hsa
uccucuguaaagaucagaugguaaucuuucaaauaagaaaaaaauaaagacguauguuugacca

SEQ ID NO: 207179 - RNA, 64 nt, hsa
gcucauuuuuauuguuuuuacagccaguuauaguaagaaaaagguuuuuccccuugugcugcuu

SEQ ID NO: 207180 - RNA, 64 nt, hsa
cuugugagaacuugaacuguuuacuaguuaauugaagaaaaaguguaacacuaaggugaacuug

SEQ ID NO: 207181 - RNA, 64 nt, hsa
gccuugaaaaguuacucuagaggaaaaaugucuaaagaaaaaaaaaauucaaaaaguuuacauu

SEQ ID NO: 207182 - RNA, 64 nt, hsa
augauaucuaaagaucuauuuugccuuaccagaaaagaaaaaaaaaacccuaaaaccaaaaacu

SEQ ID NO: 207183 - RNA, 64 nt, hsa
gauagaaguuaaauagaauuuuuauuucauucuuaagaaaaacucauguuuguaacaaaugaua

SEQ ID NO: 207184 - RNA, 64 nt, hsa
uuucuuuucaacaaaacugcuaaugucuauuaggaagaaaaauguguuuaaaguuuuacaggaa

SEQ ID NO: 207185 - RNA, 64 nt, hsa
aaauauauuagucuagggccacuuaauuuagaggaagaaaaaaaaucaacccauccauagaaau

SEQ ID NO: 207186 - RNA, 64 nt, hsa
uugcauauauuucagaggaaaguaccagucaguaaagaaaaaugccaacuaaacaugaaacuau

SEQ ID NO: 207187 - RNA, 64 nt, hsa
ccauugucuagguaugaaauccucaagcaauaacaagaaaaaaggcccacaauuagaaaaauuu

SEQ ID NO: 207188 - RNA, 64 nt, hsa
gacuuaauguauguuguaagaaaagaaaaaagaaaagaaaaaaagggaaaaaagaaaagcaagg

SEQ ID NO: 207189 - RNA, 64 nt, hsa
caucugauucacgacuuaauguauguuguaagaaaagaaaaaagaaaagaaaaaaagggaaaaa

SEQ ID NO: 207190 - RNA, 64 nt, hsa
agauugaccaaaccauccaaaugccaaaaagaaaaagaaaaaaaaaagccucucuguccuauga

SEQ ID NO: 207191 - RNA, 64 nt, hsa
aagagaagauugaccaaaccauccaaaugccaaaaagaaaaagaaaaaaaaaagccucucuguc

SEQ ID NO: 207192 - RNA, 64 nt, hsa
auuuuuuucaggacugcucuaugguuuccuuuaaaagaaaaaaacuucuguuuguuuuuagcag

SEQ ID NO: 207193 - RNA, 64 nt, hsa
gaucaguuuuuuauaaaaauauauauuuuuguccaagaaaaaaaaaagcauacauaugugauua

SEQ ID NO: 207194 - RNA, 64 nt, hsa
uugauuauacuugaaugccaaagaacuuguccagaagaaaaaccuguuaaauucaaguauuaaa

SEQ ID NO: 207195 - RNA, 64 nt, hsa
ggaagauuguguuacugcccuucacagugaaaaaaagaaaaaucuuucauuuuuaaaauuagga

SEQ ID NO: 207196 - RNA, 64 nt, hsa
agacgaagaguuuaaagagaaaagggaaaaaagaaagaaaaaguaagcagggcuggcuucgccc

SEQ ID NO: 207197 - RNA, 64 nt, hsa
gucaguggagggcgagugguuucggaaaaaaaaaaagaaaaaaagaaaaaaaaagaaaaaaaaa

SEQ ID NO: 207198 - RNA, 64 nt, hsa
agggcgagugguuucggaaaaaaaaaaagaaaaaaagaaaaaaaaagaaaaaaaaaagauuuuu

SEQ ID NO: 207199 - RNA, 64 nt, hsa
guuucggaaaaaaaaaaagaaaaaaagaaaaaaaaagaaaaaaaaaagauuuuuuucuucucuu

SEQ ID NO: 207200 - RNA, 64 nt, hsa
ggggaggagaauuagccaaacacuguaagcuuuuaagaaaaacaaaguuuuaaacgaaauacug

SEQ ID NO: 207201 - RNA, 64 nt, hsa
ucaaggccacaaaaacaauguuugggggaaaaaaaagaaaaaaucaugccagcuaaucauguca

SEQ ID NO: 207202 - RNA, 64 nt, hsa
gacuucaauucauauuuauggccuuuggaauccaaagaaaaacagaagaauaauucauggauuu

SEQ ID NO: 207203 - RNA, 64 nt, hsa
uacuuuuuagacaggacagauacucucaacagacaagaaaaaagauuuagcuuaucacaagaag

SEQ ID NO: 207204 - RNA, 64 nt, hsa
uuuaaauuuagauuauguauuccuuuugaaacauaagaaaaacauuuaaaccuaugcugaaaau

SEQ ID NO: 207205 - RNA, 64 nt, hsa
aaaaacauuuaaaccuaugcugaaaauacgauaaaagaaaaacaacuccaauaugcuaaaaguu

SEQ ID NO: 207206 - RNA, 64 nt, hsa
aauaggauuguguguauauuugggauaucuauugaagaaaaaaagaaaaccccuuaaagauaau

SEQ ID NO: 207207 - RNA, 64 nt, hsa
ugucuuuaaaucagauaccaaauauuuuuuaggaaagaaaaauguuauuacugucauuagguug

SEQ ID NO: 207208 - RNA, 64 nt, hsa
uucaggcaguguuucugggggagguuauggagggaagaaaaaagaaaaaucgauagugagugac

SEQ ID NO: 207209 - RNA, 64 nt, hsa
aguguuucugggggagguuauggagggaagaaaaaagaaaaaucgauagugagugacugauugc

SEQ ID NO: 207210 - RNA, 64 nt, hsa
aaauaccauuaaacugugaucaguuaaaauuuaaaagaaaaaucagcacaaaagggcgcuaaaa

SEQ ID NO: 207211 - RNA, 64 nt, hsa
uggaguaucccauucugaugaguacagaaaaaaaaagaaaaagaaaagaagagaaaaaauuaag

SEQ ID NO: 207212 - RNA, 64 nt, hsa
aaaaaaaaagaaaaagaaaagaagagaaaaaauuaagaaaaaaaucaaaaaaggaagaaaacua

SEQ ID NO: 207213 - RNA, 64 nt, hsa
ggugucagauucaucaaacaaaaaauaaaucucgaagaaaaaaaaugcacuuacaugugcuuau

SEQ ID NO: 207214 - RNA, 64 nt, hsa
ucugagaucccaauggugugagucugacuuuggaaagaaaaagggacuaaagagaaauguaaca

SEQ ID NO: 207215 - RNA, 64 nt, hsa
ucaggauguggagcuuccuauucugugaaaaaccaagaaaaagauaugguuguauacucaaauu

SEQ ID NO: 207216 - RNA, 52 nt, hsa
agcaacaacagcagaguugauuaagaaaaaugaagaaaaaacgcaaaaagag

SEQ ID NO: 207217 - RNA, 62 nt, hsa
agcaacaacagcagaguugauuaagaaaaaugaagaaaaaacgcaaaaagagaacacaugua

SEQ ID NO: 207218 - RNA, 64 nt, hsa
cuugaaagcaucaagauuccacucaauuguggagaagaaaaaaggugcuguagaaagugcacca

SEQ ID NO: 207219 - RNA, 64 nt, hsa
uaaauacuuccugaacaucuuaggucuuuucaacaagaaaaagacagaggauuguccuuaaguc

SEQ ID NO: 207220 - RNA, 64 nt, hsa
aauggaacgacuucaaagagaacuugagauucaaaagaaaaagcuggauaaauuaaaaucugag

SEQ ID NO: 207221 - RNA, 64 nt, hsa
auucagaugaucaggaauguauauaacugaaaucaagaaaaagaacaguaugcauuuaaaaaga

SEQ ID NO: 207222 - RNA, 64 nt, hsa
guauugcauuuuugggggaagcaaauugacuuuaaagaaaaaaguuguggcaaaagaugcuaag

SEQ ID NO: 207223 - RNA, 64 nt, hsa
auuuuuucauuagggccauaucuccaaaaaaagaaagaaaaaauacaaaaaacaaaaacaaaaa

SEQ ID NO: 207224 - RNA, 64 nt, hsa
guauuucaagauaauguaguuuaaaaaaaaaaaaaagaaaaaaacuugauguaaauuccuccuu

SEQ ID NO: 207225 - RNA, 64 nt, hsa
uuauggaaauguugucuuuuauacuuaguuauauaagaaaaaagggaguuaugcaauuaauauc

SEQ ID NO: 207226 - RNA, 64 nt, hsa
uuagcauugcaugugaauaagaaaauaauguuuaaagaaaaaaaaaaaaaagcaaaccuccaaa

SEQ ID NO: 207227 - RNA, 64 nt, hsa
caaaaaaaaaaagcaaaaaaagaaaagagaaaaaaagaaaaaaugcaaauggaauaauuuucua

SEQ ID NO: 207228 - RNA, 64 nt, hsa
aaugcugugacagcuuuuuggcugcuuuaaccauaagaaaaaugauugguggaugauuuuauua

SEQ ID NO: 207229 - RNA, 64 nt, hsa
ccagccugggugauagagcaagacugucucaaaaaagaaaaaaaagaaaaaauuuuaauuuaau

SEQ ID NO: 207230 - RNA, 64 nt, hsa
gugauagagcaagacugucucaaaaaagaaaaaaaagaaaaaauuuuaauuuaauccuucugua

SEQ ID NO: 207231 - RNA, 64 nt, hsa
gaaauuguaaaaccugucaaugauacagucccuaaagaaaaaaaaucauugcuuugaagcaguu

SEQ ID NO: 207232 - RNA, 64 nt, hsa
uaugauguguugugauagcuaacauuuuaaauaaaagaaaaaauaucuugaagauuuuugucac

SEQ ID NO: 207233 - RNA, 64 nt, hsa
gaaugucagaaaugacuuuaucaucgucaucuugaagaaaaauaugaacacugaugaaggucau

SEQ ID NO: 207234 - RNA, 64 nt, hsa
accagucacuaggauauuucuacccaugcaacggaagaaaaacccauuacuccagaagaguaua

SEQ ID NO: 207235 - RNA, 64 nt, hsa
uggcaacagagcaagagucugucucaaaaaaaaaaagaaaaaaagaaaaaaagaaaaaagaaaa

SEQ ID NO: 207236 - RNA, 64 nt, hsa
gagcaagagucugucucaaaaaaaaaaagaaaaaaagaaaaaaagaaaaaagaaaaaucucauu

SEQ ID NO: 207237 - RNA, 64 nt, hsa
gucugucucaaaaaaaaaaagaaaaaaagaaaaaaagaaaaaagaaaaaucucauuauuucaaa

SEQ ID NO: 207238 - RNA, 64 nt, hsa
ucaaaaaaaaaaagaaaaaaagaaaaaaagaaaaaagaaaaaucucauuauuucaaaaugauag

SEQ ID NO: 207239 - RNA, 64 nt, hsa
guacauuuuaaaugguaaauaaucuguuuaugugaagaaaaagaauuaagucuuucuuccaacu

SEQ ID NO: 207240 - RNA, 64 nt, hsa
uccuuuacuaacaagagcaggaauucagaggcacaagaaaaagcauuggcaugagccaaagagu

SEQ ID NO: 207241 - RNA, 64 nt, hsa
augcauaaaagggucaaaccuguagaugcagaaaaagaaaaaaacuauaaauacaaaucuguau

SEQ ID NO: 207242 - RNA, 64 nt, hsa
uuuuccuuccucuguaagauaucccagcuuuaaaaagaaaaaaaaagaauuaccaagagaaggg

SEQ ID NO: 207243 - RNA, 64 nt, hsa
uucauuguaaaaugaacaaauacauaaauauuuuaagaaaaauuuaaguuuauucagauaaguc

SEQ ID NO: 207244 - RNA, 64 nt, hsa
uuuacuuuuggaagacaagauuauuagaauauugaagaaaaauuggagacuuauaaucauggua

SEQ ID NO: 207245 - RNA, 64 nt, hsa
ucugcuuuugacucauuucuaggcagugcuuaugaagaaaaauuaaagcacaaacauucuggca

SEQ ID NO: 207246 - RNA, 64 nt, hsa
uugcuguuguaaaaguguuuucauaaguucacucaagaaaaaugcagcuguucugaacuggaau

SEQ ID NO: 207247 - RNA, 64 nt, hsa
gcggcuuucuaauagagagauuaguaaauaugugaagaaaaagaccugcauuuggcaggaagau

SEQ ID NO: 207248 - RNA, 64 nt, hsa
augcaaaugucacaguaaugcaagcaaaguaucaaagaaaaacaaugaaauugaccuaguucag

SEQ ID NO: 207249 - RNA, 64 nt, hsa
accucccgucucucucggaaaaaaaaaaagaaaaaagaaaaagccgggugaggugguguguacc

SEQ ID NO: 207250 - RNA, 64 nt, hsa
cauggugaccucccgucucucucggaaaaaaaaaaagaaaaaagaaaaagccgggugagguggu

SEQ ID NO: 207251 - RNA, 64 nt, hsa
uauuaaugggccaaugcaaaaaaucauuuuuucaaagaaaaauuuguccauguaaagcuuaaau

SEQ ID NO: 207252 - RNA, 64 nt, hsa
aacagaaaaauaaaugauuuaaaaucaaaucaaaaagaaaaaacuaaacauuuaaacaaaaaug

SEQ ID NO: 207253 - RNA, 64 nt, hsa
gaugcggguguaagcccugauuuuuuuuucucccaagaaaaaucuuaaaggaccacuuuagaua

SEQ ID NO: 207254 - RNA, 64 nt, hsa
acuaaacaucuucaaaugguacuaugaggaaaaaaagaaaaacauuuuucuaaauauucaacua

SEQ ID NO: 207255 - RNA, 64 nt, hsa
uucuaaaaggaaaaauaauuuuaaguaaagaaaaaagaaaaaaaaggaagacuaaacagaaacc

SEQ ID NO: 207256 - RNA, 64 nt, hsa
gugaacuuucuaaaaggaaaaauaauuuuaaguaaagaaaaaagaaaaaaaaggaagacuaaac

SEQ ID NO: 207257 - RNA, 64 nt, hsa
agaagauaagccauguuucuguauuguacauguaaagaaaaauaaaacuguuuaugauacuugu

SEQ ID NO: 207258 - RNA, 64 nt, hsa
aaauauaauuaccuguaagguuaucugguuuuaaaagaaaaaaaaaaagccuacaaacucagug

SEQ ID NO: 207259 - RNA, 64 nt, hsa
aaaacuaugaaaaaauguauuuucuucuaugugcaagaaaaauagggcauuucaaagagcuguu

SEQ ID NO: 207260 - RNA, 64 nt, hsa
gcaacaagagugaaacuccaucuccaaaaaaaaaaagaaaaaguaacaaaaggaaauuauuugu

SEQ ID NO: 207261 - RNA, 64 nt, hsa
caugacauacuuuugcuuucaguaguuucauguaaagaaaaaaacuugaaaauaguaauaccug

SEQ ID NO: 207262 - RNA, 64 nt, hsa
aucuaaaauaaaaaucgaaauaauuuuuuuaaaaaagaaaaagacaauaguauuacccauggga

SEQ ID NO: 207263 - RNA, 64 nt, hsa
augaucaaggaaagcaagagagcagauaauacaaaagaaaaagaagaagguucacauaaauagc

SEQ ID NO: 207264 - RNA, 64 nt, hsa
uugaaauuaacucuuccaugaguuuucauugcugaagaaaaaccaaacauucuuguaaaaacau

SEQ ID NO: 207265 - RNA, 64 nt, hsa
uagguauaaaaccuacugcaacuuagaaaaaggaaagaaaaaagaaaacuuuuccaacugcugc

SEQ ID NO: 207266 - RNA, 64 nt, hsa
cauuuaagugcuguuuguucuuaaaaugcauuuaaagaaaaauuacccauauugacuuucacac

SEQ ID NO: 207267 - RNA, 64 nt, hsa
ggaauaauauugugaaaaugaaucuguuaugauaaagaaaaaauaaaguggaaacuuuuagagu

SEQ ID NO: 207268 - RNA, 64 nt, hsa
aguagaaaaggaaacuaguagggccaaaaaaaaaaagaaaaagaaaaagaaaaaagaaaaaaaa

SEQ ID NO: 207269 - RNA, 64 nt, hsa
aaaggaaacuaguagggccaaaaaaaaaaagaaaaagaaaaagaaaaaagaaaaaaaaagaaaa

SEQ ID NO: 207270 - RNA, 64 nt, hsa
aacuaguagggccaaaaaaaaaaagaaaaagaaaaagaaaaaagaaaaaaaaagaaaaaacugg

SEQ ID NO: 207271 - RNA, 64 nt, hsa
agggccaaaaaaaaaaagaaaaagaaaaagaaaaaagaaaaaaaaagaaaaaacugggaccuaa

SEQ ID NO: 207272 - RNA, 64 nt, hsa
aaaaaaagaaaaagaaaaagaaaaaagaaaaaaaaagaaaaaacugggaccuaaguauaaauau

SEQ ID NO: 207273 - RNA, 64 nt, hsa
uacuuaaaacuuugguuguuuuccuguaauauaaaagaaaaaguuaauuuaucaauugauugaa

SEQ ID NO: 207274 - RNA, 64 nt, hsa
uuucuugcaauuugaagguacgaguagagguuuaaagaaaaaucaguuuuuguucuuaaaaaug

SEQ ID NO: 207275 - RNA, 64 nt, hsa
gaauaacaacugcugggaauauccgugccaggaaaagaaaaauuucuggcaaauauuuugucac

SEQ ID NO: 207276 - RNA, 64 nt, hsa
aauugaacccauccacucugggcagguaagagaaaagaaaaagauaaggaaagaagagagaaga

SEQ ID NO: 207277 - RNA, 64 nt, hsa
agacaaagaucacuacagaccaaaacagaagaagaagaaaaaaaagaaaaagaaaucuaagcaa

SEQ ID NO: 207278 - RNA, 64 nt, hsa
ucacuacagaccaaaacagaagaagaagaaaaaaaagaaaaagaaaucuaagcaacaugguaag

SEQ ID NO: 207279 - RNA, 64 nt, hsa
cugauuugugaugucaauaggauggcaccuuggaaagaaaaaugaagaacaacuuuaucaagga

SEQ ID NO: 207280 - RNA, 64 nt, hsa
aaaaaaacaaacuaacuaacuaacuguguaaagaaagaaaaagggaaguaccaauggguuuuuc

SEQ ID NO: 207281 - RNA, 64 nt, hsa
ucaaucagcauauacauuucagccaaagccauagaagaaaaagcaauaguugcuugaauuauga

SEQ ID NO: 207282 - RNA, 64 nt, hsa
cugauauuauuucuauuuaauacucuuuucucucaagaaaaaaaaaaaaguuuguuuuuucuuu

SEQ ID NO: 207283 - RNA, 64 nt, hsa
auuccuaauaauagggauaaugcuguuuauugucaagaaaaaguaaaaucguucucuucaauua

SEQ ID NO: 207284 - RNA, 64 nt, hsa
uguguaaucuuuuaaaaauauuaucuugcagauaaagaaaaaaauuaagaguguguuuacaacu

SEQ ID NO: 207285 - RNA, 64 nt, hsa
aaaacugauaauaucuguaaugacaucagaaugaaagaaaaaaaauuguacaguguauauuccu

SEQ ID NO: 207286 - RNA, 64 nt, hsa
gaaaccaggagguuaucaugguaguugaccuuauaagaaaaaugauucuucuucagaaauuaaa

SEQ ID NO: 207287 - RNA, 64 nt, hsa
gaaauccuauauccaguuuccuguaauuuaauugaagaaaaauacauccaaauaaagacuuuau

SEQ ID NO: 207288 - RNA, 64 nt, hsa
aguuuaauuuaaaacuaugguguaagucuuugacaagaaaaaaaaacaaacaaacacuucuuuc

SEQ ID NO: 207289 - RNA, 64 nt, hsa
aacauugucaguuaacaucacucuugucuggcaaaagaaaaaaaauagacuuuuucaacucagc

SEQ ID NO: 207290 - RNA, 64 nt, hsa
gaaugccaguagaaaauucauaacguguaucuuuaagaaaaaugagcauacaucuuaaaucuuu

SEQ ID NO: 207291 - RNA, 64 nt, hsa
aaauuaaauccuugcaggaagagaaauuaacacuaagaaaaagucaucaauauuuuucaacuuu

SEQ ID NO: 207292 - RNA, 64 nt, hsa
aucuuuuguacuucucauaaccuaaugucagacuaagaaaaauaaaauaucugagaguaaauac

SEQ ID NO: 207293 - RNA, 64 nt, hsa
gcagagauuuauaaaaauauauaagaaagauguuaagaaaaauuaaggggggauccauugaaag

SEQ ID NO: 207294 - RNA, 64 nt, hsa
uacuuucaaguaaauauagcauuccuuuggcaaaaagaaaaaaaaaguaaaagaaaagaaaaaa

SEQ ID NO: 207295 - RNA, 64 nt, hsa
uuccuuuggcaaaaagaaaaaaaaaguaaaagaaaagaaaaaaaauguauuaccacccgaugag

SEQ ID NO: 207296 - RNA, 64 nt, hsa
uacaugucuauuugucaaacauaagugggaaccaaagaaaaaaugugacaaguuugaagacaca

SEQ ID NO: 207297 - RNA, 64 nt, hsa
aacuucaguuacugaccagucaagagaauuucucaagaaaaaucccagcaacguucccucuuuc

SEQ ID NO: 207298 - RNA, 64 nt, hsa
uugcugagcaaccaguguguuucaggaugauacaaagaaaaauauagaauagaaauaagugcag

SEQ ID NO: 207299 - RNA, 64 nt, hsa
cuggaugagaaaauuuucaauucuggccaugagaaagaaaaaaaaauaaacagccuucuuuuuu

SEQ ID NO: 207300 - RNA, 64 nt, hsa
uauggaaucaacaccaccgagcucugugggaaaaaagaaaaaccugcucccuucgcucugcugg

SEQ ID NO: 207301 - RNA, 64 nt, hsa
aacauguaucugucuacuuucucuuguuuaaaaaaagaaaaaaaaacuuaaaaaaaugggguua

SEQ ID NO: 207302 - RNA, 64 nt, hsa
uccagccugggugacagagcgagacuguguuucaaagaaaaaaaaaaacaagcagccuuuugcu

SEQ ID NO: 207303 - RNA, 64 nt, hsa
ccauguacucagauaaacaugaagaaaauaagcaaagaaaaauggagacugggaaagcaaagcu

SEQ ID NO: 207304 - RNA, 64 nt, hsa
uuaaaaaaagaaaaaaugaaaaaaaaaggaaaaaaagaaaaaaggaaaaaaacaguuugaacac

SEQ ID NO: 207305 - RNA, 64 nt, hsa
uuccaguguguaacccaguuugaaaucuuaaaaaaagaaaaaaugaaaaaaaaaggaaaaaaag

SEQ ID NO: 207306 - RNA, 64 nt, hsa
cauuuauguuagcauuaaugcacauuuuuaaaaaaagaaaaaaacauggucuuguuuuuacuac

SEQ ID NO: 207307 - RNA, 64 nt, hsa
augacuguugccugcaaaaauaaaagggaaaaaaaagaaaaaagaaacaaaaaggaacuucuua

SEQ ID NO: 207308 - RNA, 64 nt, hsa
gaagagguacuuuccuggaauaauugucuaccugaagaaaaaaaauuuauauauacauugugug

SEQ ID NO: 207309 - RNA, 64 nt, hsa
ccuuuuuggucaguaaaacuuaaugaaaaaagcaaagaaaaaaauauucugaacaaagcuauag

SEQ ID NO: 207310 - RNA, 64 nt, hsa
uggacugccaguaaaacaaauguguauucaacaaaagaaaaaaaauaaaacaguaacacuuuaa

SEQ ID NO: 207311 - RNA, 64 nt, hsa
gcagcuuauuuaaaacuugggguccuuuuuaaauaagaaaaauuauauaaauuuuagaaguuau

SEQ ID NO: 207312 - RNA, 64 nt, hsa
uuucuaaguuaaaucauuuucauuaaaaggaaaaaagaaaaaaaauuuuguaugucaauaacuu

SEQ ID NO: 207313 - RNA, 64 nt, hsa
aauuuacagaauauuauauaacccacugcugaaaaagaaaaaaaugauuguuuuagaaguuaaa

SEQ ID NO: 207314 - RNA, 64 nt, hsa
ucacuaauacuuacuguuaacugucuugagagaaaagaaaaauaugagagaacuauuguuuggg

SEQ ID NO: 207315 - RNA, 64 nt, hsa
agucucaaauuuuucaucucuucaaucacuagucaagaaaaauauaaaaacaacaaauacuucc

SEQ ID NO: 207316 - RNA, 64 nt, hsa
uuacaggcugcauucuugccuuacuguauagaaaaagaaaaaaggcuggguuuacuauugcaca

SEQ ID NO: 207317 - RNA, 64 nt, hsa
cuucuguacaucuuacuggguuuaauuaaaaaaaaagaaaaaacucuguuguaaaaacaguuua

SEQ ID NO: 207318 - RNA, 64 nt, hsa
acaguuguuugaugcauuaaaagaaaauaaaaaaaagaaaaaagagaaaagaaaaaaaaagaaa

SEQ ID NO: 207319 - RNA, 64 nt, hsa
cauuaaaagaaaauaaaaaaaagaaaaaagagaaaagaaaaaaaaagaaaaaaguuguaggcga

SEQ ID NO: 207320 - RNA, 64 nt, hsa
aaauaaaaaaaagaaaaaagagaaaagaaaaaaaaagaaaaaaguuguaggcgaaucauuuguu

SEQ ID NO: 207321 - RNA, 64 nt, hsa
uauauauauagaaccacuuuuuguagauuaguauaagaaaaauauuuacccuguuuuggggcaa

SEQ ID NO: 207322 - RNA, 64 nt, hsa
uguguucagcaaaaugugauguuuuuuucuuuuaaagaaaaaaagugaaaauauauagugccaa

SEQ ID NO: 207323 - RNA, 64 nt, hsa
ugaaggugugaugguagaaauaggaaaacaacaaaagaaaaacaauaacaaaaaaagaaagugu

SEQ ID NO: 207324 - RNA, 64 nt, hsa
ugaaaacgauuuaccaauguuguuuuuuuuuaacaagaaaaaaaauaaaagcacauugucauuu

SEQ ID NO: 207325 - RNA, 64 nt, hsa
uaccugaucaggaucugggagaauuugaaaaaaaaagaaaaacuagaaaaauaaacaaaauuaa

SEQ ID NO: 207326 - RNA, 64 nt, hsa
aaaaagaaaaacuagaaaaauaaacaaaauuaaaaagaaaaaaaaauaccugagacugaguaac

SEQ ID NO: 207327 - RNA, 64 nt, hsa
agaaauaauaccaggcuuuuauaaacuuuucuagaagaaaaaagauggaacuuuuccaauucag

SEQ ID NO: 207328 - RNA, 64 nt, hsa
cuggaagacagagugagaccccaucucaggaaaaaagaaaaaaaaaaagaugucauucagcagg

SEQ ID NO: 207329 - RNA, 64 nt, hsa
cugacauuacuuuagcaauucaacuugaugugagaagaaaaaacaaauguuucaacacaaaauc

SEQ ID NO: 207330 - RNA, 64 nt, hsa
gagaccuauguugaaaaccccugaaaauucacugaagaaaaaucauuacucuuuuucucaguaa

SEQ ID NO: 207331 - RNA, 64 nt, hsa
uauagggcuuuuugacagcuuuuugagaccucuuaagaaaaaauaaaaaguaaaaaaugaaagg

SEQ ID NO: 207332 - RNA, 64 nt, hsa
gccaaugacuacucaguuuuaggacuuucuguggaagaaaaaagggagaagaaaucaauuccac

SEQ ID NO: 207333 - RNA, 64 nt, hsa
uuuagaucuacaugaauaaacaaacuauuuuaccaagaaaaaucucagcuugcuuacugcuuaa

SEQ ID NO: 207334 - RNA, 64 nt, hsa
uuuugacuuuacaaaguauagauguuggaacauuaagaaaaauguauauucccaaugaaaaaau

SEQ ID NO: 207335 - RNA, 64 nt, hsa
uaacggauaaaauaauguguuauuuuuauagagaaagaaaaaaauagcaacacaaucuaguuua

SEQ ID NO: 207336 - RNA, 64 nt, hsa
gauuuauagcauugacuuuuacacacauucacacaagaaaaaaauccuuucaaaauucuuaaau

SEQ ID NO: 207337 - RNA, 64 nt, hsa
uucaggcuuuuuuuugguuucauuuuguuuuuuuaagaaaaagaaaaugaaaggaaaaaaauaa

SEQ ID NO: 207338 - RNA, 64 nt, hsa
gaaagcuucagaccgcuaguaaggcucaaagaagaagaaaaacaccaaaaccacaagggaaaag

SEQ ID NO: 207339 - RNA, 64 nt, hsa
aaagaagaagaaaaacaccaaaaccacaagggaaaagaaaaacccaguuucuuaggaaacgcaa

SEQ ID NO: 207340 - RNA, 64 nt, hsa
uuuauuauccagauuauuuggauaaguccuuuuuaagaaaaaaaaagaaaaugaaaaacaacac

SEQ ID NO: 207341 - RNA, 64 nt, hsa
caucuacgauucaacuaaucgaaggauuaaacuaaagaaaaaacuaagaagaacaaugaaccuu

SEQ ID NO: 207342 - RNA, 64 nt, hsa
guggucccuuuugaauuucaugagccucucaaaaaagaaaaacuuaaaaaaaaaaaaaaaaaaa

SEQ ID NO: 207343 - RNA, 64 nt, hsa
uccccuuccauucccaacucucucucucuuuuuaaagaaaaaugcuaagggcagcccugccugc

SEQ ID NO: 207344 - RNA, 64 nt, hsa
gagacaauuuaaggccugcacucuuauuucacuaaagaaaaacuaaugucagcacauguugcua

SEQ ID NO: 207345 - RNA, 64 nt, hsa
aagacaaacaauaugucuuuuuuuuuuuugcaugaagaaaaaugucuaucauuuacaguuucaa

SEQ ID NO: 207346 - RNA, 64 nt, hsa
gucuugugaaaaaguugaacaaauuuccuaaucaaagaaaaaaguaugagcuccauguuucuuu

SEQ ID NO: 207347 - RNA, 64 nt, hsa
aauucagaaauuggguuuugguucagugauucucaagaaaaagaucucuugcccauuaagaagu

SEQ ID NO: 207348 - RNA, 64 nt, hsa
ucacgcugcugauaaagacauaccugagaccaggaagaaaaagagguuuaauuggacuuacagu

SEQ ID NO: 207349 - RNA, 64 nt, hsa
cacacugcugauaaagacauuccucaagauugugaagaaaaagagguuuaauuggacuuacagu

SEQ ID NO: 207350 - RNA, 64 nt, hsa
aagcagaacugaaguuagcuuaagcauaaaaacaaagaaaaaucuucgcuuuucauguaugugg

SEQ ID NO: 207351 - RNA, 64 nt, hsa
acauuugugugcagauaccaaaagaggaggaaagaagaaaaaaauuaaugugugggagcugcac

SEQ ID NO: 207352 - RNA, 64 nt, hsa
gaagaccaaagaccucaaacacugguccuguucaaagaaaaagaaagaacaugaggguuaaaaa

SEQ ID NO: 207353 - RNA, 51 nt, hsa
acaagaccccugaggcaugacaagaaaaaaaaagaagaccaaagaccucaa

SEQ ID NO: 207354 - RNA, 64 nt, hsa
uccagccugggcgacagagcaagauuccguucccaagaaaaaaaaauuguucaacaauaagggc

SEQ ID NO: 207355 - RNA, 64 nt, hsa
uguuuaggaauuguccuuauagcauugcauacacaagaaaaacagagaaaagccugaucccugu

SEQ ID NO: 207356 - RNA, 64 nt, hsa
uuuauguuaguagagcuguuuucaacccaaaaauaagaaaaaauagcucuaaauaucuaaaagg

SEQ ID NO: 207357 - RNA, 64 nt, hsa
acacuguauaugaugaaaggcuucuauuuggaggaagaaaaauuaagaagacaacuuacaaaau

SEQ ID NO: 207358 - RNA, 64 nt, hsa
caaagccuugcuuuuagagaaugcccaauaaggcaagaaaaagcauaguaacuugugcuuugag

SEQ ID NO: 207359 - RNA, 64 nt, hsa
cagagcuucauucuccuggcuuuuagguuuguaaaagaaaaagggauaucuuuuuuauauuuuu

SEQ ID NO: 207360 - RNA, 64 nt, hsa
uacugcauugcaccaugagcaagaacugcucugcaagaaaaauaucugucccuguggucugaau

SEQ ID NO: 207361 - RNA, 64 nt, hsa
augcagauaacagcaggaaggacuuaagguguauaagaaaaagaaaguauucauacagaaauua

SEQ ID NO: 207362 - RNA, 64 nt, hsa
accgagguguuuuuuacauuuaagaaaaaaaaaaaagaaaaaaagauuguuuaaaaaaaaaagg

SEQ ID NO: 207363 - RNA, 64 nt, hsa
cugucucugcuguaccgagguguuuuuuacauuuaagaaaaaaaaaaaagaaaaaaagauuguu

SEQ ID NO: 207364 - RNA, 64 nt, hsa
auuuucauuguuauuuuuagaaagauuuuuugcuaagaaaaaaauuaaacauauuuacauauuu

SEQ ID NO: 207365 - RNA, 64 nt, hsa
uacuguuuguauaaaaaauagaaaaaaaaaagaaaagaaaaaaggcauaaaucuuuauugcaga

SEQ ID NO: 207366 - RNA, 64 nt, hsa
agaauagguuacuacaaaaaagguuauauucugaaagaaaaauaacugacauuauauauaacca

SEQ ID NO: 207367 - RNA, 64 nt, hsa
uccuuaucuuuugcagucucucugggaucaguaaaagaaaaaaaaaauaaugugcuuaagaagu

SEQ ID NO: 207368 - RNA, 64 nt, hsa
caagacccugucucuaaagaaaaaaaaaaaguaaaagaaaaauaaagcacgucuuggcucagcu

SEQ ID NO: 207369 - RNA, 64 nt, hsa
ccagccugggcaacauagcaagacccugucucuaaagaaaaaaaaaaaguaaaagaaaaauaaa

SEQ ID NO: 207370 - RNA, 64 nt, hsa
ggcuuuuuuuuccucucaaaaaaaaaaaaagaaaaagaaaaagaggaagaagcagcuuugcuga

SEQ ID NO: 207371 - RNA, 64 nt, hsa
ccagugggcuuuuuuuuccucucaaaaaaaaaaaaagaaaaagaaaaagaggaagaagcagcuu

SEQ ID NO: 207372 - RNA, 64 nt, hsa
cuggaggaaaaccagaucggacuaaaaaaggaaaaagaaaaacaaaaucuccgcaguguccaaa

SEQ ID NO: 207373 - RNA, 64 nt, hsa
ugcuucugggccaggccauugucacuguuaguugaagaaaaagcaguucccaggugccagcaaa

SEQ ID NO: 207374 - RNA, 64 nt, hsa
uaucuuuuaaacucaguucugcauccaacuugagaagaaaaaaagcuucuuuccauaucaagua

SEQ ID NO: 207375 - RNA, 64 nt, hsa
aucacccagacaugugcagaugaaaugucaauauaagaaaaaucaagguauuugggaaacaugg

SEQ ID NO: 207376 - RNA, 64 nt, hsa
auacuaauuuugaccuugaaagaugaauuccuucaagaaaaauaaaauaaugcuuaagauaaug

SEQ ID NO: 207377 - RNA, 64 nt, hsa
ugcgcaaaaauuguuaaauccuuugucuuuauuaaagaaaaauuugaguaacauuaaguuugau

SEQ ID NO: 207378 - RNA, 64 nt, hsa
ugcaugaauauaaaucuauauuauuugcuaaaaaaagaaaaaacauuuguguuuuaguuucuuu

SEQ ID NO: 207379 - RNA, 64 nt, hsa
ccguuaggguuuaaaaccauauugaucaacuagaaagaaaaauaugaaaagagaaaaauauuuu

SEQ ID NO: 207380 - RNA, 64 nt, hsa
cugauacuuuugaaacagaugugaaaaacagaaaaagaaaaaauugucugaaauguuuauuuug

SEQ ID NO: 207381 - RNA, 64 nt, hsa
caggauuuguagccuugugcuucuugcuaagagaaagaaaaacaaaaucagagggcauuaaaug

SEQ ID NO: 207382 - RNA, 64 nt, hsa
gcuagucaauaugaggauggugguuuauucucagaagaaaaagauauguaaggucuuuuagcuc

SEQ ID NO: 207383 - RNA, 64 nt, hsa
cuucaccuucaauaugagaauucagcgaacuugaaagaaaaaucaucugugaguuccuucaggu

SEQ ID NO: 207384 - RNA, 64 nt, hsa
aucuuugugccacacaggauuuuuuuuuuuuuuuaagaaaaaccuauagaugaaaaauuacuaa

SEQ ID NO: 207385 - RNA, 64 nt, hsa
ugcucuuucccccuuccaucucugacuuaagcaaaagaaaaagauuacccaaaaacugucuuua

SEQ ID NO: 207386 - RNA, 64 nt, hsa
ggugggguguuugggaggcugcgugccagucaagaagaaaaagguuugcauucucacauugcca

SEQ ID NO: 207387 - RNA, 64 nt, hsa
agauccuuuuauaggugagaaaaaaacaaucuggaagaaaaaaaccacacaaagacauugauuc

SEQ ID NO: 207388 - RNA, 64 nt, hsa
cuauagaaaauauuugagaauuucuuauacuaucaagaaaaaauucugugaauuaagauguaau

SEQ ID NO: 207389 - RNA, 64 nt, hsa
cuuuuuaaaaaguaacuuuuuuaauaauauaagaaagaaaaaugcccuuucacacugaaucuuc

SEQ ID NO: 207390 - RNA, 64 nt, hsa
ccaaccugagugacagagcaacacucugucuuaaaagaaaaaaaaaaaagagagagauaguaau

SEQ ID NO: 207391 - RNA, 64 nt, hsa
acauuauaaaagagcacuucuguggcucauuuaaaagaaaaaaaagguuaagucuuuuaaauuu

SEQ ID NO: 207392 - RNA, 64 nt, hsa
ugauuuuuaucuaaaaaaauucauuuuuauaucgaagaaaaaauauuuuauucaaacauuagau

SEQ ID NO: 207393 - RNA, 64 nt, hsa
uuucuguuacaacuuacaggaacauuuguacuuuaagaaaaauuuaagugacaaauguuagaag

SEQ ID NO: 207394 - RNA, 64 nt, hsa
uaugguuccagagaugcauacacuuuuuucugacaagaaaaaguaaaaggugaugagggcaauu

SEQ ID NO: 207395 - RNA, 64 nt, hsa
cccccucuggucuccucuuuguuuuguuuuaaggaagaaaaaucaguugcgcguucugaaauau

SEQ ID NO: 207396 - RNA, 64 nt, hsa
uguauauauacauaacaggguaaauuauucaguuaagaaaaaaauaauuuuaugaacugcaugu

SEQ ID NO: 207397 - RNA, 64 nt, hsa
aaaaaauaaauaagauaaagggucagcaacaacaaagaaaaagacaauuacagaaaauaagcaa

SEQ ID NO: 207398 - RNA, 64 nt, hsa
auuuaaggcuuuguaaaaugaagaguagaauuccaagaaaaaugagaaauaauuuuguaaaacu

SEQ ID NO: 207399 - RNA, 64 nt, hsa
ggauccugaacggaaaaggaagaagaaagagaagaagaaaaagaagguagaguagaggccuauu

SEQ ID NO: 207400 - RNA, 64 nt, hsa
aacaccaucugauucagaucacaagaagaagaaaaagaaaaaagaagaggauccugaacggaaa

SEQ ID NO: 207401 - RNA, 64 nt, hsa
uacagaaacaccaucugauucagaucacaagaagaagaaaaagaaaaaagaagaggauccugaa

SEQ ID NO: 207402 - RNA, 64 nt, hsa
aaauuuugcagcgaagagaaaugaagaaaaacugaagaaaaaaaaaaaacaggaaaaaaagaac

SEQ ID NO: 207403 - RNA, 64 nt, hsa
cacaaaaaaaaaaauuuugcagcgaagagaaaugaagaaaaacugaagaaaaaaaaaaaacagg

SEQ ID NO: 207404 - RNA, 64 nt, hsa
ugggugacagagcaagacucccucucaaaagaaaaagaaaaaagauguaaaaaccauucuuagu

SEQ ID NO: 207405 - RNA, 64 nt, hsa
ccagccugggugacagagcaagacucccucucaaaagaaaaagaaaaaagauguaaaaaccauu

SEQ ID NO: 207406 - RNA, 64 nt, hsa
gcagccuuugugccacuucagugcuagaaaguuaaagaaaaaaaaacuuuugugauuuaauaau

SEQ ID NO: 207407 - RNA, 64 nt, hsa
uaguuguacagauaguuuauaagcacaauauuuuaagaaaaaaaaguggcuggucuacuaggca

SEQ ID NO: 207408 - RNA, 64 nt, hsa
aaauuuuuaauugaguguaaacacaccuaacuuuaagaaaaagaaccgcuuguaugauuuucaa

SEQ ID NO: 207409 - RNA, 64 nt, hsa
aacuguaguaguuggucuagaaacaaaauacuccaagaaaaagaaaauuuucaaauaaaaccca

SEQ ID NO: 207410 - RNA, 64 nt, hsa
auuauacaaucaaacuagaucugaagcauaauuuaagaaaaacaucaacauuuuuugugcuuua

SEQ ID NO: 207411 - RNA, 64 nt, hsa
cuauuuguuaaaauauuugccuuuuuaaguaaaaaagaaaaaucagaacagggcuauuugaaga

SEQ ID NO: 207412 - RNA, 64 nt, hsa
ggucggguuuucaaucacacugaauuggcaggauaagaaaaauaggucagauaaguaugggaug

SEQ ID NO: 207413 - RNA, 64 nt, hsa
cuucccuuuagugauuucaguaguuuauauuggaaagaaaaacaauuacaacaugugcccuuac

SEQ ID NO: 207414 - RNA, 64 nt, hsa
aucauuugguuuuugaguuguuuuuucuuaauguaagaaaaauuguauuuuuuuuacaaguauc

SEQ ID NO: 207415 - RNA, 64 nt, hsa
uaaauuuaaaugggaagggaagaaaacaccaaauaagaaaaaaauuugccuuuaagaguuacuu

SEQ ID NO: 207416 - RNA, 64 nt, hsa
cgacagugcaagacucugucuccaaaaaaaaaaaaagaaaaaagaaaaucccccuucauccccc

SEQ ID NO: 207417 - RNA, 64 nt, hsa
gaaucccuuuguucucuguuuaaaaaaaucuaaaaagaaaaaggaaaaaaaaaaaagaacugcu

SEQ ID NO: 207418 - RNA, 64 nt, hsa
aguauggaauaauauaucucaugucauuuuuuagaagaaaaacuauuugaagguauuuuuuggu

SEQ ID NO: 207419 - RNA, 64 nt, hsa
uacuaccuaaagggaaccugcaauaaucuugaaaaagaaaaagagaaaaauuuuaaaauccugc

SEQ ID NO: 207420 - RNA, 64 nt, hsa
ugucuugaauucucuguuuaugcaaugugcucgaaagaaaaaaauguuaaaaauauaucuauaa

SEQ ID NO: 207421 - RNA, 64 nt, hsa
caaagauuauauaugacaaucaguauugcaaugaaagaaaaacuaaaaacagaaaugauauucu

SEQ ID NO: 207422 - RNA, 64 nt, hsa
uguggucuaucaccacugaauucauguaauagauaagaaaaaaauuagagguggaugucuuguu

SEQ ID NO: 207423 - RNA, 64 nt, hsa
ucaacauuuaugaaauauugccugacuauuuaaaaagaaaaaaguagcucuccauuaucaccuu

SEQ ID NO: 207424 - RNA, 64 nt, hsa
aaacagacaguauuguaaucccaucaaaagaugaaagaaaaacaaaaacaaaaaccaacaacaa

SEQ ID NO: 207425 - RNA, 64 nt, hsa
aaagagcuaaacuuauucagaaaggaaugacuagaagaaaaaggagacaauaccauguuguuca

SEQ ID NO: 207426 - RNA, 64 nt, hsa
ucauugauuuuaaacauuuuauuccuacuuucagaagaaaaauauaauacggaaaaaauuauag

SEQ ID NO: 207427 - RNA, 64 nt, hsa
cuugucaguggcguugggagggggagaaaaggaaaagaaaaaaaaaagaagaagaagaagaaaa

SEQ ID NO: 207428 - RNA, 64 nt, hsa
gaaaaaaaaaagaagaagaagaagaaaagagaagaagaaaaaaacgaaaacagucaaccaaccc

SEQ ID NO: 207429 - RNA, 64 nt, hsa
ugauggaaaguucagcaagaucagcaacaaaaccaagaaaaaugauccuugcgugcugaauauc

SEQ ID NO: 207430 - RNA, 64 nt, hsa
cugaaacgcuuccuauaacucgaguuuauaggggaagaaaaagcuauuguuuacaauuauauca

SEQ ID NO: 207431 - RNA, 64 nt, hsa
aagcaaagauccaccgagagaagaagagaaagaaaagaaaaagaaaaagcacaaaaaaagaucu

SEQ ID NO: 207432 - RNA, 64 nt, hsa
agauccaccgagagaagaagagaaagaaaagaaaaagaaaaagcacaaaaaaagaucucgaaca

SEQ ID NO: 207433 - RNA, 64 nt, hsa
uuuuuuuucuuuguaaugcaccugacagaaaaaaaagaaaaaugaauuucucuuuacuucucuc

SEQ ID NO: 207434 - RNA, 64 nt, hsa
auguguuuuguuguuuugugcuacaauuuuuaaaaagaaaaaaguuuuguuuuguuuuuugggg

SEQ ID NO: 207435 - RNA, 64 nt, hsa
cugacuaauagaccucagccucaaaaggcuuggaaagaaaaaacaaauacaacaagcaaacaac

SEQ ID NO: 207436 - RNA, 64 nt, hsa
cacucuccccaaaauauuauauuuuuucuauaaaaagaaaaaaauggaaaaaaauuacaaggca

SEQ ID NO: 207437 - RNA, 64 nt, hsa
acauaaagaaaagaugagcaaagaugguaaaaagaagaaaaagaagucaaagacaaagugugua

SEQ ID NO: 207438 - RNA, 64 nt, hsa
caaaauaucacauaagacaucaugauaacauuugaagaaaaaauaaaacuguagacccuaacag

SEQ ID NO: 207439 - RNA, 64 nt, hsa
cagucaaagaaagagaaaaaagauaaaguagaaaaagaaaaaagugaaaaggaaacaacuagca

SEQ ID NO: 207440 - RNA, 64 nt, hsa
aauacuaucauaguaauauuauuauugucaucccaagaaaaaauauauuaaaaagauauuugaa

SEQ ID NO: 207441 - RNA, 64 nt, hsa
aauacuaucauguuaauacuauuauugucaucccaagaaaaaagauauuuuaaaaauuuauuug

SEQ ID NO: 207442 - RNA, 64 nt, hsa
guaacaaucuugaagagcuaauuuuaauaaaaauaagaaaaauuaauacuaucauguuaauacu

SEQ ID NO: 207443 - RNA, 64 nt, hsa
acuuugcuaacuuacuaguaccagaguuauuuuaaagaaaaacacuaguguccaauuucauuuu

SEQ ID NO: 207444 - RNA, 64 nt, hsa
augacucccauugucccuuuauuuaggauauugaaagaaaaaauaaacuuuauguauuaguguc

SEQ ID NO: 207445 - RNA, 64 nt, hsa
uuuuaggaccaaucucauuuuuaauaagguuaaaaagaaaaaaaaagucuagcgaaaaaacucc

SEQ ID NO: 207446 - RNA, 64 nt, hsa
augagguccuucuggacuaaaagccaaaaaaagaaagaaaaaaauaauuuuucuuuucuguuuu

SEQ ID NO: 207447 - RNA, 64 nt, hsa
ucugucucaaaaaaaaaaaaagaaaaaagaaagaaagaaaaaaggcagaagcccuggauucaaa

SEQ ID NO: 207448 - RNA, 64 nt, hsa
gugacagagcgaaccucugucucaaaaaaaaaaaaagaaaaaagaaagaaagaaaaaaggcaga

SEQ ID NO: 207449 - RNA, 64 nt, hsa
cuauaagaauuaagggguaaagcacuaaacagaaaagaaaaaaaaaauagcaacucuggugagc

SEQ ID NO: 207450 - RNA, 64 nt, hsa
aaaacuguuuuacaguaucaaaauuuuucacuuaaagaaaaaaaaugccaugaaacauuugaac

SEQ ID NO: 207451 - RNA, 64 nt, hsa
caaagcacucagcucaauuaucuucuuagaaagaaagaaaaaguaugaauggucaaaaugaaua

SEQ ID NO: 207452 - RNA, 64 nt, hsa
uuaagaaaguacuugacuaaaaaaaaaagaaaaaaagaaaaaaaagaaagcauagacauauuuu

SEQ ID NO: 207453 - RNA, 64 nt, hsa
uuguuucuuuaagaaaguacuugacuaaaaaaaaaagaaaaaaagaaaaaaaagaaagcauaga

SEQ ID NO: 207454 - RNA, 64 nt, hsa
ugaauacaaagauaagugaaaagagagaaaggaaaagaaaaaggagaaaaacaaagagauuucu

SEQ ID NO: 207455 - RNA, 64 nt, hsa
gcuguugaucuuuuaucaauaauguucuauagaaaagaaaaaaaaaauauauauauauauauau

SEQ ID NO: 207456 - RNA, 64 nt, hsa
aaagcaaccccaaaagaguugauguguguuuuaaaagaaaaaacccaaugaggaacaauuggag

SEQ ID NO: 207457 - RNA, 64 nt, hsa
acaaaagcgaaacucugucucaaaaaagaaaaaaaagaaaaaaaagcacgugaccuuaugaggc

SEQ ID NO: 207458 - RNA, 64 nt, hsa
gccugggcaacaaaagcgaaacucugucucaaaaaagaaaaaaaagaaaaaaaagcacgugacc

SEQ ID NO: 207459 - RNA, 64 nt, hsa
aagcuuuuggcucucuguuucauuuuuuuccauuaagaaaaaaaaaaguccccuuuuaaaacaa

SEQ ID NO: 207460 - RNA, 64 nt, hsa
ugucuuuucaaaaugagaggcuuucauugaagaaaagaaaaaaacaacaguuaaaagcuuuugg

SEQ ID NO: 207461 - RNA, 64 nt, hsa
guugaggaauuuccucuaccaccuuuguugcuugaagaaaaacaugucuuuucaaaaugagagg

SEQ ID NO: 207462 - RNA, 64 nt, hsa
uaucuuaaaacuaaauguaauuuauuaacuaaucaagaaaaacaucuuuggcugagcucggugg

SEQ ID NO: 207463 - RNA, 64 nt, hsa
gccugggcaacauagggagacccccaucuuuacaaagaaaaaaaaaaggggaaaagaaaaucuu

SEQ ID NO: 207464 - RNA, 64 nt, hsa
ucaauaauaauaauaauaauaaugaugauacucuaagaaaaaaaucucaacauacuucauuuaa

SEQ ID NO: 207465 - RNA, 64 nt, hsa
agccugggugaaaaagacaggcugugucuccaaaaagaaaaaaaaaagucaaauucaaauauca

SEQ ID NO: 207466 - RNA, 64 nt, hsa
uuugaauuucaauaaucagggguuugggucaaggaagaaaaaucaugggacuugccauuuagga

SEQ ID NO: 207467 - RNA, 64 nt, hsa
uggaagagagaugagaaaauugagagcuauuauuaagaaaaacaguugagagaggaagaauuug

SEQ ID NO: 207468 - RNA, 64 nt, hsa
gggaaacgacccuguggcugugagaaagugaaaaaagaaaaaaaaaaaggcauuggcauuuucu

SEQ ID NO: 207469 - RNA, 64 nt, hsa
guauuaggacagaauuaaugaugcuuaaagagaaaagaaaaaaagagagaagaaaaaggagaga

SEQ ID NO: 207470 - RNA, 64 nt, hsa
uaaugaugcuuaaagagaaaagaaaaaaagagagaagaaaaaggagagaugaaaaaggaggaug

SEQ ID NO: 207471 - RNA, 64 nt, hsa
aaaaaaaaaaaaaaaaaaaaaaggaaaaaaaaaaaagaaaaaaaaccauauguguauuagggug

SEQ ID NO: 207472 - RNA, 64 nt, hsa
aauuugggaaguuuuacuuuuguuuucuucuaugaagaaaaaaaugcaggcugggcgcgguggc

SEQ ID NO: 207473 - RNA, 64 nt, hsa
uucauuacaggaaauguaacuagauauugugcccaagaaaaacagccagaagcaaagaaaugcu

SEQ ID NO: 207474 - RNA, 64 nt, hsa
caagcagaugauugauaaaaccugggaguaagguaagaaaaauggaacaaauuuuuaucuaaaa

SEQ ID NO: 207475 - RNA, 64 nt, hsa
uguaaaacuaauguaucaaaauuagcauauauggaagaaaaaucacuauucaaaaauaguuuca

SEQ ID NO: 207476 - RNA, 64 nt, hsa
uaugaugccggaauucuguaaacaauaaagaugaaagaaaaaaugaaaacuuuauacaaaaaag

SEQ ID NO: 207477 - RNA, 64 nt, hsa
gauuugaaauaaaaggaaauuuuagcaaggauuaaagaaaaaagcuaucagcuguauguuaaga

SEQ ID NO: 207478 - RNA, 64 nt, hsa
aauauaguucugauuggguauuaauuacuugauuaagaaaaaauuaacauuauagauacucugg

SEQ ID NO: 207479 - RNA, 64 nt, hsa
acagaacaagacugucucaaaaaaaaaaaaagagaagaaaaacugccuacaggccauaguuaac

SEQ ID NO: 207480 - RNA, 64 nt, hsa
uuuugcguaaguacuuugauuauuuaauauuuguaagaaaaaacuuucauuuuccuacagagga

SEQ ID NO: 207481 - RNA, 64 nt, hsa
aacaaaaaucuucaaagacugguuucuuuuuuaaaagaaaaaacuugaaagaacacuucuaagc

SEQ ID NO: 207482 - RNA, 64 nt, hsa
agugaugauaugcucuccuacagcaacauaugagaagaaaaaaggcuuaucuagauucgaaaau

SEQ ID NO: 207483 - RNA, 64 nt, hsa
ggaugaauguucucaaauguuacaaagcuguuuaaagaaaaagguauauauaaguaaucagaac

SEQ ID NO: 207484 - RNA, 64 nt, hsa
cacugaaaacauuuuugucauauucuuguauucaaagaaaaaggaaaaaagauuauuguaaaua

SEQ ID NO: 207485 - RNA, 64 nt, hsa
auaacuaaaacauugaaaacagaacaaaugagaaaagaaaaaaaaccugccgauuaacaagacu

SEQ ID NO: 207486 - RNA, 64 nt, hsa
aacuggaacuugacaauuauaaauaguaauagugaagaaaaaauagaaagguugcaauuauaua

SEQ ID NO: 207487 - RNA, 64 nt, hsa
gcacagcaguaaacuauggggaaaaaaaaagaagaagaaaaagaaacucagggaucacugggag

SEQ ID NO: 207488 - RNA, 64 nt, hsa
agaggcauuccagccccuauguuauugauggaaaaagaaaaagaagaaaagcaaucucgcagua

SEQ ID NO: 207489 - RNA, 64 nt, hsa
aaccagugaggcugcccugaacaaaaaaaacaaaaagaaaaaaaaaaaaggaaagaaagaaacu

SEQ ID NO: 207490 - RNA, 64 nt, hsa
cgcaaugagagaagcagcaguggguacaaggaggaagaaaaagggcuugcagagaguggaaagu

SEQ ID NO: 207491 - RNA, 64 nt, hsa
gaauauucaugaaacuucauugcagggguaauagaagaaaaaguaaauugggaggacuuaaugg

SEQ ID NO: 207492 - RNA, 64 nt, hsa
agguuuguugaacaaugccuuuucagguuggaagaagaaaaauagccucaaucucccaccccau

SEQ ID NO: 207493 - RNA, 64 nt, hsa
uuugcaacagaauuuuguagccuuaagggguaggaagaaaaaccugacugcaaaucaugucagu

SEQ ID NO: 207494 - RNA, 64 nt, hsa
ugguuauuuaccuccuuuuuuuuuuuuuuuuuuaaagaaaaaaggacuuuuaaccuuugcugac

SEQ ID NO: 207495 - RNA, 64 nt, hsa
gcuuacaaauauucuguuaagggguaguuuuauaaagaaaaaugauauauaguuauguugucuu

SEQ ID NO: 207496 - RNA, 64 nt, hsa
cuccuaucgguauacaaauuccauuucuuuuuauaagaaaaacacauaaaccauuaucauuuau

SEQ ID NO: 207497 - RNA, 64 nt, hsa
uguauagcuuacucuaccugcagacagaaaaugaaagaaaaaaauggacuugccuagaauaaua

SEQ ID NO: 207498 - RNA, 64 nt, hsa
gucuugcauccagaaaggccagauuuuaccuaccaagaaaaaaagauauuuuuccagagaguua

SEQ ID NO: 207499 - RNA, 62 nt, hsa
gaucauuuaacaaaaaauaaguagcuuuauuaaagaaaaaucuucaacacaaucaaacuuua

SEQ ID NO: 207500 - RNA, 64 nt, hsa
ugaaaaugcuggugagcugagguagaaaaaaaacaagaaaaaaauuuuaaaaauagcguuaaaa

SEQ ID NO: 207501 - RNA, 64 nt, hsa
gaacuauauuucaaaugaauuuaaauaucuuuuaaagaaaaaaacaccuaaaaauaaaucuuaa

SEQ ID NO: 207502 - RNA, 64 nt, hsa
uaacuggacaccuuuuauuugaagaaacaaacugaagaaaaaaugcuuccuuaagugcugacag

SEQ ID NO: 207503 - RNA, 64 nt, hsa
aauuauguaaaaaacaaaacuacaacaacaaaaaaagaaaaaaguuaaaaaagaaaaaaacacc

SEQ ID NO: 207504 - RNA, 64 nt, hsa
aaacuacaacaacaaaaaaagaaaaaaguuaaaaaagaaaaaaacaccaaaaaacaaaaacaaa

SEQ ID NO: 207505 - RNA, 64 nt, hsa
ccuuuguuuacuuagcuuucucuuaguuauaagaaagaaaaagaccucuugcaugaaaauagua

SEQ ID NO: 207506 - RNA, 64 nt, hsa
auacauagaauuugccaguuacuuucugacuacaaagaaaaacagauacuaaaagucucuucug

SEQ ID NO: 207507 - RNA, 64 nt, hsa
ugagcaaaaacagcaaguggugaaauucuuaaucaagaaaaaagcaaauuuaaaugcacuggau

SEQ ID NO: 207508 - RNA, 64 nt, hsa
aacagugggguuuaguacuccaaaugaacucuuaaagaaaaaaacuaaucuuggcauccuauca

SEQ ID NO: 207509 - RNA, 64 nt, hsa
cuuuuaaacuuauuuugcuuuaaaaaaaaaaaaaaagaaaaagaaaauuuaacuuaaaauauuu

SEQ ID NO: 207510 - RNA, 64 nt, hsa
uaaguuaacuguaauuacuguauuuugugggacaaagaaaaaaggacuccaguauuuguggccu

SEQ ID NO: 207511 - RNA, 64 nt, hsa
aaaaaaguuuuauuuuucuaaaaaaagaaaaaagaagaaaaaauuuaaaggguguacuuauauc

SEQ ID NO: 207512 - RNA, 64 nt, hsa
uuuguacaaaaaaaaaguuuuauuuuucuaaaaaaagaaaaaagaagaaaaaauuuaaagggug

SEQ ID NO: 207513 - RNA, 64 nt, hsa
uuaaauuauuccauaaauaauauuuaaagagcacaagaaaaauuuuuuaaagugcacuaaaaug

SEQ ID NO: 207514 - RNA, 64 nt, hsa
auuauaguuuuggcuguauaaauaaaacugugagaagaaaaaaauaauaugaaacaaugaggua

SEQ ID NO: 207515 - RNA, 64 nt, hsa
uuuauaucaaaggugcaucgugaccaaauuguuuaagaaaaaaaaacaaaaaaaacaaaaucua

SEQ ID NO: 207516 - RNA, 64 nt, hsa
ucugcuaagcuguuaaauguauuuauaguaaaggaagaaaaaaagacugucauuuccuuauaag

SEQ ID NO: 207517 - RNA, 64 nt, hsa
gauccacaaugcauggauuccuuugaagaaaaaaaagaaaaagagaaaaaaaucacaaaaacaa

SEQ ID NO: 207518 - RNA, 64 nt, hsa
gaaauuucugauccacaaugcauggauuccuuugaagaaaaaaaagaaaaagagaaaaaaauca

SEQ ID NO: 207519 - RNA, 64 nt, hsa
aauguaccuuuuuguuagugaauuuggaaauaaaaagaaaaaaaaaacaaaaacaaacaggcug

SEQ ID NO: 207520 - RNA, 64 nt, hsa
uaauaaucgagaaugccugggcauuuuacaaaacaagaaaaaaaauacccuuuucuuuuccuug

SEQ ID NO: 207521 - RNA, 64 nt, hsa
caauguauuagauaaacccaguuucagaaugauaaagaaaaaauguuagaccaaauaaugcggc

SEQ ID NO: 207522 - RNA, 64 nt, hsa
uaccacucuuuguguagauauuugucauauauuuaagaaaaagcuaaaaagaauggaaaucgca

SEQ ID NO: 207523 - RNA, 64 nt, hsa
acugcacaguugugaaaaaggaagagaaucauuaaagaaaaagaaaaaagauuuuaagaccguu

SEQ ID NO: 207524 - RNA, 64 nt, hsa
caguugugaaaaaggaagagaaucauuaaagaaaaagaaaaaagauuuuaagaccguugaaauc

SEQ ID NO: 207525 - RNA, 64 nt, hsa
aauuuguauuuuggaggugcuugaucuaucuacaaagaaaaauuaauuaggaauuacuuuauua

SEQ ID NO: 207526 - RNA, 64 nt, hsa
ugaauacugucuguaucuuugguuauccuguuugaagaaaaaggacaaauaaaacauggccagc

SEQ ID NO: 207527 - RNA, 64 nt, hsa
gauuaucugaagacacaaaccugacaggagggagaagaaaaaacaaaacacuugaaccaagaaa

SEQ ID NO: 207528 - RNA, 64 nt, hsa
caguaugcccagaagcuuuccuucauaaaauagaaagaaaaaaacauuuggcuuauuuuucacu

SEQ ID NO: 207529 - RNA, 64 nt, hsa
gauuaauaauccaacuuuaauaguauacauuuaaaagaaaaaaaacaaaagcccuggaaguuga

SEQ ID NO: 207530 - RNA, 64 nt, hsa
ccagggcuugucuggaucagcaccaacgauuuuaaagaaaaaaggaagaguuucuuagaugagu

SEQ ID NO: 207531 - RNA, 64 nt, hsa
uccacuucauccagaugaaggaaaggaagaccucaagaaaaauucacaguugagugcaucccag

SEQ ID NO: 207532 - RNA, 64 nt, hsa
uuauuuuuuaaaauucuaaguagaguauauugaaaagaaaaagaagagccuuaacauauauaaa

SEQ ID NO: 207533 - RNA, 64 nt, hsa
uaccacucuuuguguagauauuugucguauauugaagaaaaagcuaaaaagaauggaaaucgca

SEQ ID NO: 207534 - RNA, 64 nt, hsa; identical to SEQ ID NO: 207521

SEQ ID NO: 207535 - RNA, 64 nt, hsa
ccaggaacuacaagaugccaucugccguuugcaaaagaaaaaucuuuucccauauaauccaacu

SEQ ID NO: 207536 - RNA, 64 nt, hsa
agagagagagagagaggagaagacagagagauuaaagaaaaauauguucacucccacuuaugug

SEQ ID NO: 207537 - RNA, 64 nt, hsa
ggggcuuaggggauuggaacugggguuuggcugaaagaaaaaaaaaaaaauguaacugaugaau

SEQ ID NO: 207538 - RNA, 64 nt, hsa
aaggcccaggacacuugucagaaggaugcaaaaaaagaaaaaaguacauccacccucuuaaucc

SEQ ID NO: 207539 - RNA, 64 nt, hsa
gguuuuguuucuguuguuguucaaaugcaaaaaaaagaaaaaaaaagaaaaaaaaaggugacuc

SEQ ID NO: 207540 - RNA, 64 nt, hsa
cuguuguuguucaaaugcaaaaaaaagaaaaaaaaagaaaaaaaaaggugacucacauuguuac

SEQ ID NO: 207541 - RNA, 64 nt, hsa
gcuggaucugaguuuugucacucuaaaauuaaacaagaaaaaaagugggaaaagggcauccccc

SEQ ID NO: 207542 - RNA, 64 nt, hsa
cuuccauucaccauucuuuaucuuuucuuugaauaagaaaaaguaucuagcaaggauauuacuu

SEQ ID NO: 207543 - RNA, 64 nt, hsa
uguuuguaaaucuagccaauagagucauuuacagaagaaaaaugagcauguaauaauacaagaa

SEQ ID NO: 207544 - RNA, 64 nt, hsa
caaaaaaaaaaaaaaaaaaaaaaaaaaaagaaaaaagaaaaaaaaaauccaaaagagagaagag

SEQ ID NO: 207545 - RNA, 64 nt, hsa
uaaaagccaaaaaaaaaaaaaaaaaaaaaaaaaaaagaaaaaagaaaaaaaaaauccaaaagag

SEQ ID NO: 207546 - RNA, 64 nt, hsa
uuaucaaauauauauccagacgguucuucccuagaagaaaaacaagucuuuacaccugauaaaa

SEQ ID NO: 207547 - RNA, 64 nt, hsa
agggucucgcauucaagggcaauuacauuuuaaaaagaaaaacagaaaaagguuaaucacaaaa

SEQ ID NO: 207548 - RNA, 64 nt, hsa
gguauauuuauguaagaaaaugacuguaaaucucaagaaaaaucucagcagcuaauagcaacuc

SEQ ID NO: 207549 - RNA, 64 nt, hsa
cacucguuaaauagguuuucuuuaaacuuaauuaaagaaaaacuauuuaaagguaaaggauauu

SEQ ID NO: 207550 - RNA, 64 nt, hsa
cuucuguccuguucacagguucuccuucuucaucaagaaaaaguggaaccagcugucccuccag

SEQ ID NO: 207551 - RNA, 64 nt, hsa
uaugugccuuccaaccagagggagacccaguagaaagaaaaacauccugggaaauccagcuacc

SEQ ID NO: 207552 - RNA, 64 nt, hsa
uuuucuuacgaauauaccaacauccugaaaguuaaagaaaaaaaucuaauguaugaaugugacu

SEQ ID NO: 207553 - RNA, 64 nt, hsa
gaccuaaaaauaauucucuuguauuuuggagaugaagaaaaaagucauucaccugggagggauu

SEQ ID NO: 207554 - RNA, 64 nt, hsa
cagccugggugacagagcgagacuccguaucagaaagaaaaagaggaacugaaugaaaucucag

SEQ ID NO: 207555 - RNA, 64 nt, hsa
agccugggcaacauagugagaccccaucucuacaaagaaaaaaaaauuagcuggacaugguaau

SEQ ID NO: 207556 - RNA, 64 nt, hsa
cccaacuugggaguggggaaauugcuuaaaaaaaaagaaaaagaaaaaaaaaaagauuauucua

SEQ ID NO: 207557 - RNA, 64 nt, hsa
uugggaguggggaaauugcuuaaaaaaaaagaaaaagaaaaaaaaaaagauuauucuaaauaaa

SEQ ID NO: 207558 - RNA, 64 nt, hsa
gccccaccaagaggguggaucacaccucagugggaagaaaaauaaaauuuccuucagguuuuaa

SEQ ID NO: 207559 - RNA, 64 nt, hsa
cugauagucuugaauauuuuauuuuuuuaaugaaaagaaaaaacaagaaaguuauguuucauaa

SEQ ID NO: 207560 - RNA, 64 nt, hsa
caugcuuugauaucugguucagacuaucaucaggaagaaaaaaaaaucccacaguaccugaaau

SEQ ID NO: 207561 - RNA, 64 nt, hsa
uccagcugggagacacagcaagacuccgucucaaaagaaaaaaaaaaaaaagaacaacugccaa

SEQ ID NO: 207562 - RNA, 64 nt, hsa
aucuuaggcuggccagacuucagcuguuccuuugaagaaaaagacacagacaaagugacauucc

SEQ ID NO: 207563 - RNA, 64 nt, hsa
caauuauauucuuggccaauuuuguccaacggacaagaaaaaagcaaagucaacgacaccauua

SEQ ID NO: 207564 - RNA, 64 nt, hsa
gcagaagcgagaaaacuuuguuuauugaaaaaaaaagaaaaagaaagcaagaaaaaaagauacu

SEQ ID NO: 207565 - RNA, 64 nt, hsa
acuuuguuuauugaaaaaaaaagaaaaagaaagcaagaaaaaaagauacuauggggucaagugu

SEQ ID NO: 207566 - RNA, 64 nt, hsa
uuggacuuuguaauuauuuuuuuagcaguaauuaaagaaaaaaguccucugugaggaauauucu

SEQ ID NO: 207567 - RNA, 64 nt, hsa
aguauuuuuguacagauuugcuuucucuuacaaaaagaaaaaaaaaauccuguuguauuaacau

SEQ ID NO: 207568 - RNA, 64 nt, hsa
ucuaaggcucgccgugagccaggucuaaaguuugaagaaaaagaaaaaucuuaaaaaaaaaaaa

SEQ ID NO: 207569 - RNA, 64 nt, hsa
gcucgccgugagccaggucuaaaguuugaagaaaaagaaaaaucuuaaaaaaaaaaaaaaaaaa

SEQ ID NO: 207570 - RNA, 64 nt, hsa
aaagaaaaaucuuaaaaaaaaaaaaaaaaaaaaaaagaaaaaaagaaaaacaggaaaaaggacu

SEQ ID NO: 207571 - RNA, 64 nt, hsa
aucuuaaaaaaaaaaaaaaaaaaaaaaagaaaaaaagaaaaacaggaaaaaggacuuuuuuuuu

SEQ ID NO: 207572 - RNA, 64 nt, hsa
ccccagucugacauauuucauacagaauguuuaaaagaaaaacucugcuagucuuggcaaacau

SEQ ID NO: 207573 - RNA, 64 nt, hsa
ucuaugugaauauaagcuugugcacaauguuuaaaagaaaaacaaugaauuagaagagaucccc

SEQ ID NO: 207574 - RNA, 64 nt, hsa
uuuucccuugaggaaacaacagcuuuaaaagaaaaagaaaaaaaaagucuuugguaaauggcaa

SEQ ID NO: 207575 - RNA, 64 nt, hsa
auaaaguuuucccuugaggaaacaacagcuuuaaaagaaaaagaaaaaaaaagucuuugguaaa

SEQ ID NO: 207576 - RNA, 64 nt, hsa
uuuucccaucaagucauuuguuaaaacuaaauguaagaaaaaucugcuagaggaaaacuuugag

SEQ ID NO: 207577 - RNA, 64 nt, hsa
cuuaaagaauuugucaauccuagccuuccaagagaagaaaaagaagagaaacuagaaacaguua

SEQ ID NO: 207578 - RNA, 64 nt, hsa
gcaaauugauaguuguucuagcagugaagagauaaagaaaaaaaaguacaaccaaaugccaguc

SEQ ID NO: 207579 - RNA, 64 nt, hsa
aaaaaagaaaaagaaaaagcaagaagaaggaagaaagaaaaagacagaaagagaaauaggagga

SEQ ID NO: 207580 - RNA, 64 nt, hsa
caaaucucuugcuuucuuucuuaaaaaaaagaaaaagaaaaagcaagaagaaggaagaaagaaa

SEQ ID NO: 207581 - RNA, 64 nt, hsa
aagauucaaaucucuugcuuucuuucuuaaaaaaaagaaaaagaaaaagcaagaagaaggaaga

SEQ ID NO: 207582 - RNA, 64 nt, hsa
ccuagagcucuaauuguuuguuuuggaagaaaaaaagaaaaagaacaaaaaauauauaucacuc

SEQ ID NO: 207583 - RNA, 64 nt, hsa
gcgaggggccuagagcucuaauuguuuguuuuggaagaaaaaaagaaaaagaacaaaaaauaua

SEQ ID NO: 207584 - RNA, 64 nt, hsa
ugaaaguuaauccuuuuuaaaaacuuuauuuaaaaagaaaaauuagcagccaggugcaguggcu

SEQ ID NO: 207585 - RNA, 64 nt, hsa
aucaagagaaaaccaaucagcuucaucaaaacagaagaaaaaggcuaagucccagcaauacaaa

SEQ ID NO: 207586 - RNA, 64 nt, hsa
ucuccaccaagcauuugguuuauuuagaaaaaggaagaaaaacaaaaaacaaaaaacuaaaggg

SEQ ID NO: 207587 - RNA, 64 nt, hsa
ggacuggaggccgccaggcaggcguggccgagggaagaaaaagcuucuggauguccagccagcu

SEQ ID NO: 207588 - RNA, 64 nt, hsa
auguuucuuuauugcauaacuggcguguagcacaaagaaaaagccccuucuccaccagauauuu

SEQ ID NO: 207589 - RNA, 64 nt, hsa
cauuugcauacaccugggccaucuugguuuuugcaagaaaaaagcgaggaaaucagagaaacuc

SEQ ID NO: 207590 - RNA, 64 nt, hsa
agaaacuuugcuaguuaaaaaaaaaagaaaaaaaaagaaaaaaaaucccuuucuuguaaacuua

SEQ ID NO: 207591 - RNA, 64 nt, hsa
aaaguauaauagaaacuuugcuaguuaaaaaaaaaagaaaaaaaaagaaaaaaaaucccuuucu

SEQ ID NO: 207592 - RNA, 64 nt, hsa
aaaguuauuaaauuaauuauauguuuaaaaguuaaagaaaaaagagcugcagaguauuuauaaa

SEQ ID NO: 207593 - RNA, 64 nt, hsa
gugguauguucccuuaaaaaaaaaugacacuuggaagaaaaauguaugaaauucagaaauuccg

SEQ ID NO: 207594 - RNA, 64 nt, hsa
cugggauuacaggugugagcugccgcacccagccaagaaaaauaauacucuuaaauacuuagau

SEQ ID NO: 207595 - RNA, 64 nt, hsa
acauuuuaacuuaaugguacuuaaaauaauuuaaaagaaaaauguuaacuuagacauucuuaug

SEQ ID NO: 207596 - RNA, 64 nt, hsa
acaacuacaucccauuuuauauuuccaauuguuaaagaaaaauauuucaagaacaaaucuucuc

SEQ ID NO: 207597 - RNA, 64 nt, hsa
aacugaaauagaaaaggaaaaggaagaagcagagaagaaaaaaucaaagaaaucugucuaauuc

SEQ ID NO: 207598 - RNA, 64 nt, hsa
augauugguauuauggaaggcuuauugggggaacaagaaaaauauaaaaagugaucucugccca

SEQ ID NO: 207599 - RNA, 64 nt, hsa
auuucuguggauggcagccggagcauguuagcuuaagaaaaauguuguguguggugcucuaguc

SEQ ID NO: 207600 - RNA, 64 nt, hsa
uuaugagagaaaaggaaaaaggaaucaaagguggaagaaaaaaaaagccaaauucuguuuacgg

SEQ ID NO: 207601 - RNA, 64 nt, hsa
acgccuaaugaacaagcacaguuuuucaauggugaagaaaaaagcaccagacuuuuuuucuuuu

SEQ ID NO: 207602 - RNA, 64 nt, hsa
uuuccaaacugcuuuguguauuguauauuuuuuuaagaaaaagaaaagccuuauuugacuuaug

SEQ ID NO: 207603 - RNA, 64 nt, hsa
caggugaaucuagagccuacuuuuauuuugguuaaagaaaaagaaaauaucaauaauucaauuu

SEQ ID NO: 207604 - RNA, 64 nt, hsa
gucuaaaaacaucugcauaguuuucaacuggaaaaagaaaaaacuuaaaaaugggauguccuaa

SEQ ID NO: 207605 - RNA, 64 nt, hsa
gcuggggccuccuuccauugcaucauuuuaaaggaagaaaaaagcagcuaaaaaagaguggacc

SEQ ID NO: 207606 - RNA, 64 nt, hsa
aucauuauuuauguauugugcaauguguauaaacaagaaaaauaaagaaaagaugcacuuugcu

SEQ ID NO: 207607 - RNA, 64 nt, hsa
aaaggacuccugaaaaaaaaccugagauuuauuaaagaaaaaaauguauuuuauguuauauaua

SEQ ID NO: 207608 - RNA, 64 nt, hsa
agaaggugagauaagcccugagucucagcuaccuaagaaaaaccuggaugucacuggccacuga

SEQ ID NO: 207609 - RNA, 64 nt, hsa
ccaaagggaaauaucauuuauuuuuuacauuauuaagaaaaaaagauuuauuuauuuaagacag

SEQ ID NO: 207610 - RNA, 64 nt, hsa
gugauguaccaugaaacaaagcugcaggcuguuuaagaaaaaauaacacacauauaaacaucac

SEQ ID NO: 207611 - RNA, 64 nt, hsa
acagagcgagacuccgccucaaaaaaaaaaaaaaaagaaaaaaagaaauguaccuguuggcagg

SEQ ID NO: 207612 - RNA, 64 nt, hsa
uugaaaaggucuucugacacacuuaucuugcacaaagaaaaagaaaauuucuuuuacuguguuu

SEQ ID NO: 207613 - RNA, 64 nt, hsa
uccagaaaggagccacagcugacgccaaaaagaaaagaaaaaagauauauauauauauauauau

SEQ ID NO: 207614 - RNA, 64 nt, hsa
uguguuccuucagggaaacuggucuugaaaaagcaagaaaaaaaagcaaaaaaaaaaaaaaaaa

SEQ ID NO: 207615 - RNA, 64 nt, hsa
guugguuccauuuucuuuuuuucuuuuuuuuuuuaagaaaaaauaaaagguggauuugagcugu

SEQ ID NO: 207616 - RNA, 64 nt, hsa
aggagugugcggucaauauuuauaucauccagaaaagaaaaacacgagaaacgccaucgcggga

SEQ ID NO: 207617 - RNA, 64 nt, hsa
ucuuucuauaaauacauauuguuuaaaaaaaagcaagaaaaaaaggaaaacaaaggaaaauauc

SEQ ID NO: 207618 - RNA, 64 nt, hsa
uauccccaaaguuguuuucuagauuuguggcuuuaagaaaaacaaaacaaaacaaacacauugu

SEQ ID NO: 207619 - RNA, 64 nt, hsa
cuuuuuguggguguugcaugcaaaucaaguggacaagaaaaaauaacaaaacaaaaaacaagaa

SEQ ID NO: 207620 - RNA, 64 nt, hsa
caaguggacaagaaaaaauaacaaaacaaaaaacaagaaaaaaaaaacacaaaaccccguaaaa

SEQ ID NO: 207621 - RNA, 64 nt, hsa
gaagggaccuugcagggaccucucccuccaaaaaaagaaaaaaagaaaaagaaagaaaaaauaa

SEQ ID NO: 207622 - RNA, 64 nt, hsa
cuugcagggaccucucccuccaaaaaaagaaaaaaagaaaaagaaagaaaaaauaaaugaggaa

SEQ ID NO: 207623 - RNA, 64 nt, hsa
ccucucccuccaaaaaaagaaaaaaagaaaaagaaagaaaaaauaaaugaggaaacguguugca

SEQ ID NO: 207624 - RNA, 64 nt, hsa
aaacuaauaaaaagcaaaaaaaaaaaaaaaagaaaagaaaaaacacugcauuugggcaccaucu

SEQ ID NO: 207625 - RNA, 64 nt, hsa
ugaaucccugaaugacugcauggauagaaccacuaagaaaaauaaacuuuuauauuuuuauagc

SEQ ID NO: 207626 - RNA, 64 nt, hsa
guuugguucuaugugguuggucuguuucccggacaagaaaaauugcaaucaaaugucagcagcu

SEQ ID NO: 207627 - RNA, 64 nt, hsa
uuuaagaagcuuuuaaaagguaauaauacucugaaagaaaaaugacguaaccacagcguguacu

SEQ ID NO: 207628 - RNA, 64 nt, hsa
gaaggaaaaagaaagagaaagagagagagagagaaagaaaaagaaagaaaaguaagaaagaaaa

SEQ ID NO: 207629 - RNA, 64 nt, hsa
agagagagagaaagaaaaagaaagaaaaguaagaaagaaaaaagaaaaagaaagaaaaguaaga

SEQ ID NO: 207630 - RNA, 64 nt, hsa
gagaaagaaaaagaaagaaaaguaagaaagaaaaaagaaaaagaaagaaaaguaagaaagaaaa

SEQ ID NO: 207631 - RNA, 64 nt, hsa
aaaacacagcaugagaacuucgugaagcauacagaagaaaaaccuucagccagauugaaugcuu

SEQ ID NO: 207632 - RNA, 64 nt, hsa
ccaaccuuuugucuucccugggccacauuggaagaagaaaaauugucuugugccacacauacaa

SEQ ID NO: 207633 - RNA, 64 nt, hsa
acaauacacuaacauuaacaauagcugaugagcuaagaaaaaaaaaaagucugugcauaguuuu

SEQ ID NO: 207634 - RNA, 64 nt, hsa
aacgucuguggagcuucugcugcaaggaacaaaaaagaaaaaaaucaaaaaagcgacaaaaaaa

SEQ ID NO: 207635 - RNA, 64 nt, hsa
aaacaaaaugaaaaaaaaaggggggugggaggggaagaaaaacucuauuuuuguaaaaagggaa

SEQ ID NO: 207636 - RNA, 64 nt, hsa
aagaaaaaaaaaagacaaaaaaaaaaaaaaagaaaagaaaaaaaaucucaucacuugaagccac

SEQ ID NO: 207637 - RNA, 64 nt, hsa
uccccauugcuguaaauauuucaacgaaauggaaaagaaaaaaaaaagacaaaaaaaaaaaaaa

SEQ ID NO: 207638 - RNA, 64 nt, hsa
ccagccugggcaacaagagcaaaacucuaucucaaagaaaaaaagaaaauuucuacauauuaaa

SEQ ID NO: 207639 - RNA, 64 nt, hsa
augauauaucuggaauguccuuuuguucauacaaaagaaaaaugaggaugaauaacaaguuugg

SEQ ID NO: 207640 - RNA, 64 nt, hsa
ggcaacaagaacaaaacuccaucuaaagaagaaaaagaaaaacugaagagagaguaguugucag

SEQ ID NO: 207641 - RNA, 64 nt, hsa
agccugggcaacaagaacaaaacuccaucuaaagaagaaaaagaaaaacugaagagagaguagu

SEQ ID NO: 207642 - RNA, 64 nt, hsa
ugcuguucccaucccugaaacauugcauguauuuaagaaaaacaaaauguuaguggcauauuug

SEQ ID NO: 207643 - RNA, 64 nt, hsa
cuuccacgguccuguuaauucuagaucagagagcaagaaaaaaguacagaacauauccucuacg

SEQ ID NO: 207644 - RNA, 64 nt, hsa
aacugaucaaaagcauaauugaaaguucugaaaaaagaaaaauaauaauauguagaaaaaugua

SEQ ID NO: 207645 - RNA, 64 nt, hsa
gauggauuggacguugugacucuugccuuuuaagaagaaaaaaaagauaggacaaaguauuuga

SEQ ID NO: 207646 - RNA, 64 nt, hsa
aagaaaaggagucaagaacaauucacaguaugagaagaaaaauggaaaaaaaaaacuuuauuua

SEQ ID NO: 207647 - RNA, 64 nt, hsa
gaagaaaaauggaaaaaaaaaacuuuauuuaaaaaagaaaaaaguccagauuguaguuauacuu

SEQ ID NO: 207648 - RNA, 64 nt, hsa
aguggaaucuacuuucauuguuaacacugagcuaaagaaaaaaagccguguguuuuaugaauga

SEQ ID NO: 207649 - RNA, 64 nt, hsa
aguccaucuguuuguccaucugcugaaaugagaaaagaaaaauuuaugcacugauuuaaaacaa

SEQ ID NO: 207650 - RNA, 64 nt, hsa
aauuuaugcacugauuuaaaacaaaccaaaaaaaaagaaaaaaacaaaaaaaaaaaucccuccu

SEQ ID NO: 207651 - RNA, 64 nt, hsa
gcacacccgugguugugaaaauaguauagcaaaaaagaaaaauccccgguuauugauguacuag

SEQ ID NO: 207652 - RNA, 64 nt, hsa
auuuuuccccuuugcucuucuuuucccuccuuaaaagaaaaauuaccuucuaguccuaggauga

SEQ ID NO: 207653 - RNA, 64 nt, hsa
uuacccagccacuugggaacagcagguaauacugaagaaaaauaaaaauagauuuugaaaacgu

SEQ ID NO: 207654 - RNA, 64 nt, hsa
caagaggauuucuggauauuagucacccaucugcaagaaaaaugcugaggccucgggucaagau

SEQ ID NO: 207655 - RNA, 64 nt, hsa
aacagccacauaaccuugcggcaagucugauggaaagaaaaagauaaaccauccgugggguaga

SEQ ID NO: 207656 - RNA, 64 nt, hsa
auaauguaagggucuguuguaaaugaccaagaaaaagaaaaaaaaagcauucccaaucuugaca

SEQ ID NO: 207657 - RNA, 64 nt, hsa
aaaaaaauaauguaagggucuguuguaaaugaccaagaaaaagaaaaaaaaagcauucccaauc

SEQ ID NO: 207658 - RNA, 64 nt, hsa
guauuuuuguuuguaaguuaaaaagaaaaaaaaaaagaaaaaguuccgggcauuuugcaucaga

SEQ ID NO: 207659 - RNA, 64 nt, hsa
uuuauuauuacgguauuuuuguuuguaaguuaaaaagaaaaaaaaaaagaaaaaguuccgggca

SEQ ID NO: 207660 - RNA, 64 nt, hsa
ucacauccauucucaagguaguuauaugcuggagaagaaaaauccucuagacacaugaaggccc

SEQ ID NO: 207661 - RNA, 64 nt, hsa
agaguugagaguugggugagguuagucucuccugaagaaaaagccuauaaaaaguggcuaaucu

SEQ ID NO: 207662 - RNA, 64 nt, hsa
auuaacuuuaacuuauuaaaaaaaaaaaaagaaaaagaaaaacgauuuaaaaaaaaaaaaaaaa

SEQ ID NO: 207663 - RNA, 64 nt, hsa
auuuguauuaacuuuaacuuauuaaaaaaaaaaaaagaaaaagaaaaacgauuuaaaaaaaaaa

SEQ ID NO: 207664 - RNA, 64 nt, hsa
gagugccaagucagaaaguguguauuaccuuguaaagaaaaaaauuacaaagcagggguuuaga

SEQ ID NO: 207665 - RNA, 64 nt, hsa
cacguuucuuuguugagcugugucuugaaggcaaaagaaaaaaaauuucuacaguagucuuucu

SEQ ID NO: 207666 - RNA, 64 nt, hsa
caagcuaagagagcuugcaaaaaaaaaaagaaaaaagaaaaaaaaaaaccacguuucuuuguug

SEQ ID NO: 207667 - RNA, 64 nt, hsa
gaaugcacaagcuaagagagcuugcaaaaaaaaaaagaaaaaagaaaaaaaaaaaccacguuuc

SEQ ID NO: 207668 - RNA, 64 nt, hsa
aagcauccuuguacuuauaaucccaaugacuaugaagaaaaauaauuuagccaaauaguuccua

SEQ ID NO: 207669 - RNA, 64 nt, hsa
aaguuaagcucuaguauaacaaugauaugggucaaagaaaaaugaaaacaaauuuuaaaaacgu

SEQ ID NO: 207670 - RNA, 64 nt, hsa
guaacuacagagaggacguuucccuguuuagggaaagaaaaaacaucuucagaucauagguccu

SEQ ID NO: 207671 - RNA, 64 nt, hsa
aaucauugaacugagggggaaaaauguaacuaggaagaaaaacccaauuuaagaaauuacauaa

SEQ ID NO: 207672 - RNA, 64 nt, hsa
uuuaacacuugggacaacauuuauuauaaaugauaagaaaaaucuuagagguuugucuacccac

SEQ ID NO: 207673 - RNA, 64 nt, hsa
caacauagugagacgucgucucuacaaaaaaaaaaagaaaaaaaaaauuagccaggcaugcgaa

SEQ ID NO: 207674 - RNA, 64 nt, hsa
uuuuuuuguucuaggggaaaugaaugugcaaaaaaagaaaaagaacuguugguuauuuguguua

SEQ ID NO: 207675 - RNA, 64 nt, hsa
gauaauuuuuuaauuauuuaaauguacuuauauuaagaaaaauaucaaguacuacauuuucuuu

SEQ ID NO: 207676 - RNA, 64 nt, hsa
uagcagauaucauguaggaaagagaggauaaacaaagaaaaaagaaaaaaaaauaagcucauac

SEQ ID NO: 207677 - RNA, 64 nt, hsa
uaucauguaggaaagagaggauaaacaaagaaaaaagaaaaaaaaauaagcucauacccaaauu

SEQ ID NO: 207678 - RNA, 64 nt, hsa
uuucucuuuccagcugcuguuuuguaaaaagaaaaagaaaaaagaagcccaaacuagugagagu

SEQ ID NO: 207679 - RNA, 64 nt, hsa
ccuacauuucucuuuccagcugcuguuuuguaaaaagaaaaagaaaaaagaagcccaaacuagu

SEQ ID NO: 207680 - RNA, 64 nt, hsa
gggagaccaaccccuuugugucuuuugaaauacgaagaaaaauguguguucaggagcaugacuc

SEQ ID NO: 207681 - RNA, 64 nt, hsa
gaaaagagaaaggaaaggccaaaaaaaagaggaaaagaaaaauguacaaaaagauuuucgaucu

SEQ ID NO: 207682 - RNA, 64 nt, hsa
cuguuuuuuaaccuuuuguuccgccauuuaaaaaaagaaaaaaaaaaagcuuauguuucuuguc

SEQ ID NO: 207683 - RNA, 64 nt, hsa
cccccgccaccuguacucacccucacgcucuuugaagaaaaaaaaaaaaaucaccuuguguguu

SEQ ID NO: 207684 - RNA, 64 nt, hsa
gauaaucugauugcuguuguuuuguuuguuuggaaagaaaaaaaaugucuggcuucuucuacua

SEQ ID NO: 207685 - RNA, 64 nt, hsa
uugaacauuuacaaaaugucacacuuuuucuuaaaagaaaaauauuuugggguuugaauaaaau

SEQ ID NO: 207686 - RNA, 64 nt, hsa
cacuguggaaaagaguauugaguuacaaacugagaagaaaaagcaggaaguucccuaauaaucu

SEQ ID NO: 207687 - RNA, 64 nt, hsa
uacuagcaagcuaauggaaacaugauuuucggggaagaaaaacuacagaaaauguagaaauuua

SEQ ID NO: 207688 - RNA, 64 nt, hsa
uauuauuuaauuguguuggagcuucuuuuuccaaaagaaaaacuaguugcagucagggagccag

SEQ ID NO: 207689 - RNA, 64 nt, hsa
aauguguaagucacccccaccaaaaacaaaagagaagaaaaagaauagaaagaauuauccagug

SEQ ID NO: 207690 - RNA, 64 nt, hsa
ccaaucccuaguacauauauaauagaaaagggccaagaaaaauaugcaucuugauuuggagaga

SEQ ID NO: 207691 - RNA, 64 nt, hsa
acucucuuuccaauuucacuuugguggucugaagaagaaaaagaaauuuuauguauguaugugu

SEQ ID NO: 207692 - RNA, 64 nt, hsa
agcuuaucaugagagcccucaggggaaaggguuuaagaaaaacaacuccucuuucccauaguca

SEQ ID NO: 207693 - RNA, 64 nt, hsa
gucuucaaguaaguaaaacauacaucguagcuagaagaaaaauguaccuuaaauuugcaucuuc

SEQ ID NO: 207694 - RNA, 64 nt, hsa
uuuugauguugauuuugaccuguucaugauucagaagaaaaacaaacuuuuuuggauuuuuuuu

SEQ ID NO: 207695 - RNA, 64 nt, hsa
cuccucuaaucuguguacacaucuccaagcaaggaagaaaaaacaaacucugcucagacgccua

SEQ ID NO: 207696 - RNA, 64 nt, hsa
guguaaaguuacuuaagcuaaaucaauuucaaagaagaaaaacuuggaggacucauuuuaccug

SEQ ID NO: 207697 - RNA, 64 nt, hsa
cagcgaggcuaugacuuacuuaucucaauggcuaaagaaaaaauagugaaaauaccaaauacug

SEQ ID NO: 207698 - RNA, 64 nt, hsa
aaaagagaaaaaagaaaaaaaaugagaaaaaaguaagaaaaaaaaaaauccuguccuaggcuuu

SEQ ID NO: 207699 - RNA, 64 nt, hsa
aaaaauauacuugcuaucuauaaaaaagagaaaaaagaaaaaaaaugagaaaaaaguaagaaaa

SEQ ID NO: 207700 - RNA, 64 nt, hsa
ugugaguuuaaacaaaaaccacaaacagacaaacaagaaaaaaagcuuuuauugguguuuucac

SEQ ID NO: 207701 - RNA, 64 nt, hsa
ccagccugaacuauauuuaagagacuuuguaaaaaagaaaaauguauauagcugugaguuuaaa

SEQ ID NO: 207702 - RNA, 64 nt, hsa
agaacuuguuuagaaaggauucaguuaaccaaacaagaaaaaggcagugccucacaaagaaauu

SEQ ID NO: 207703 - RNA, 64 nt, hsa
gaagccauauuuuuacauaggagucagauacaaaaagaaaaaucacugaaugcuuuuagauauu

SEQ ID NO: 207704 - RNA, 64 nt, hsa
uuuccucaaguuacuuuccuucauuuucuuaaaaaagaaaaaaaauuauuaaauguuucucaca

SEQ ID NO: 207705 - RNA, 64 nt, hsa
caaggucaguucaggaaagcuuaagcaucgaaaaaagaaaaaaagccaugauguacccuccgag

SEQ ID NO: 207706 - RNA, 64 nt, hsa
aauauuuuuuuccuaaaggaauaaagggugaggaaagaaaaauauuaaaaaagcuaauauuuga

SEQ ID NO: 207707 - RNA, 64 nt, hsa
cuaauugccaguuccaguguauucaugguacucuaagaaaaaucucuuugguuuugauuucuug

SEQ ID NO: 207708 - RNA, 64 nt, hsa
aggaaccauaguugacaguuccaaucaguagcuuaagaaaaaaccguguuugucucuucuggaa

SEQ ID NO: 207709 - RNA, 64 nt, hsa
ucuugcucuccuagguagcccccucuucccugguaagaaaaagcaaaaggcauuucccacccug

SEQ ID NO: 207710 - RNA, 64 nt, hsa
aggggguggggagguaaauuccucugacuugccaaagaaaaagaagggaaccacaguggauaug

SEQ ID NO: 207711 - RNA, 64 nt, hsa
cauuccugaauaauuuccaaauguuuuuaauccaaagaaaaagguuuaaagcuuauuucccuuu

SEQ ID NO: 207712 - RNA, 64 nt, hsa
cacuugcucuccgugggaccgggugaagcacagaccuugccaagcuucagguucaccucgaaau

SEQ ID NO: 207713 - RNA, 64 nt, hsa
ggcaaaaggugcuuugaccucaucccccuguuacccuugccaaagccccugcagaauuaccuac

SEQ ID NO: 207714 - RNA, 64 nt, hsa
caugagaaagucccuuucugaggcccacugucuaccuugccagauccucagugcguaucgccaa

SEQ ID NO: 207715 - RNA, 64 nt, hsa
uuucaagagggaaaguggucuguacugcuuucauccuugccacugucuugcuuuuauuuuuuac

SEQ ID NO: 207716 - RNA, 64 nt, hsa
ccuccuggacgcaaauuaaaggccgagaaagaggccuugccaucaauggaauacugccauuuau

SEQ ID NO: 207717 - RNA, 64 nt, hsa
guguccgaagauaagcuccaggucuuaucguaucccuugccaucugaacuuguuugcacugcuu

SEQ ID NO: 207718 - RNA, 64 nt, hsa
auaguuugugccuugucuugaaggggguugcuccccuugccaaccucacacugcuaugauugcc

SEQ ID NO: 207719 - RNA, 64 nt, hsa
guccauugacagugaggucccaccccucaucucuccuugccaaauaguuugugccuugucuuga

SEQ ID NO: 207720 - RNA, 64 nt, hsa
acaacauuuuuuaaaucgugauuucggccuauuuccuugccaggccuguuuccccaccaggaaa

SEQ ID NO: 207721 - RNA, 64 nt, hsa
cccacacugcuugggcacuauugcgccccugccuccuugccaggcucuuccuccuguccugccu

SEQ ID NO: 207722 - RNA, 64 nt, hsa
uugacguggagggugggcaccagauggggaccagccuugccaacugcugcuguggccuccagcu

SEQ ID NO: 207723 - RNA, 64 nt, hsa
gagccugcaucauuugguucccucaaagggaagcccuugccaguggggguuugaaagagaauuu

SEQ ID NO: 207724 - RNA, 64 nt, hsa
caugagaccugguaacagugucucccucccagcuccuugccaaagccucuguugagaccugggc

SEQ ID NO: 207725 - RNA, 64 nt, hsa
gcucccaagacuucccugacucccccacuccccuccuugccaggggcacacccggaccccacac

SEQ ID NO: 207726 - RNA, 64 nt, hsa
cacccucuggccccacacuggcaaugaugccacaccuugccauguccacgcuguuggucaaacc

SEQ ID NO: 207727 - RNA, 64 nt, hsa
guccacccguggggcccaggggcuggggccacagccuugccauuuucguugccauacccucuug

SEQ ID NO: 207728 - RNA, 64 nt, hsa
ugugagccacugagaagagagacgccaacugcacccuugccacuuccaaagcaauagaggcaga

SEQ ID NO: 207729 - RNA, 64 nt, hsa
caucgcauguccuacaaucugcucuuagacacggccuugccaggagagccugcccucagacugc

SEQ ID NO: 207730 - RNA, 64 nt, hsa
ggggacuuuaccugcugggaccugcucccagagaccuugccacacugaaugucaccugcuagga

SEQ ID NO: 207731 - RNA, 64 nt, hsa
gggcuucacugccaggagccuccccugcuggggaccuugccagcuggggcuggggauggugccu

SEQ ID NO: 207732 - RNA, 64 nt, hsa
accggaccucuccuuucgcccccacacccccuccccuugccagcugugcccaccuuuguauuua

SEQ ID NO: 207733 - RNA, 64 nt, hsa
agacaguccccuggcccugccccucccucgccccccuugccaccuucccaggacugcuuguccg

SEQ ID NO: 207734 - RNA, 64 nt, hsa
cugggccagcccgcugugcacuuugaccccaguuccuugccagcacggcugcuaacagacugcc

SEQ ID NO: 207735 - RNA, 64 nt, hsa; identical to SEQ ID NO: 206901

SEQ ID NO: 207736 - RNA, 64 nt, hsa; identical to SEQ ID NO: 206902

SEQ ID NO: 207737 - RNA, 64 nt, hsa; identical to SEQ ID NO: 206903

SEQ ID NO: 207738 - RNA, 64 nt, hsa; identical to SEQ ID NO: 206904

SEQ ID NO: 207739 - RNA, 64 nt, hsa; identical to SEQ ID NO: 206905

SEQ ID NO: 207740 - RNA, 64 nt, hsa; identical to SEQ ID NO: 206906

SEQ ID NO: 207741 - RNA, 64 nt, hsa; identical to SEQ ID NO: 206907

SEQ ID NO: 207742 - RNA, 64 nt, hsa; identical to SEQ ID NO: 206908

SEQ ID NO: 207743 - RNA, 64 nt, hsa; identical to SEQ ID NO: 206909

SEQ ID NO: 207744 - RNA, 64 nt, hsa; identical to SEQ ID NO: 206910

SEQ ID NO: 207745 - RNA, 64 nt, hsa; identical to SEQ ID NO: 206911

SEQ ID NO: 207746 - RNA, 64 nt, hsa; identical to SEQ ID NO: 206912

SEQ ID NO: 207747 - RNA, 64 nt, hsa; identical to SEQ ID NO: 206913

SEQ ID NO: 207748 - RNA, 64 nt, hsa; identical to SEQ ID NO: 206914

SEQ ID NO: 207749 - RNA, 64 nt, hsa; identical to SEQ ID NO: 206915

SEQ ID NO: 207750 - RNA, 64 nt, hsa; identical to SEQ ID NO: 206916

SEQ ID NO: 207751 - RNA, 64 nt, hsa; identical to SEQ ID NO: 206917

SEQ ID NO: 207752 - RNA, 64 nt, hsa; identical to SEQ ID NO: 206918

SEQ ID NO: 207753 - RNA, 64 nt, hsa; identical to SEQ ID NO: 206919

SEQ ID NO: 207754 - RNA, 64 nt, hsa; identical to SEQ ID NO: 206920

SEQ ID NO: 207755 - RNA, 64 nt, hsa; identical to SEQ ID NO: 206921

SEQ ID NO: 207756 - RNA, 64 nt, hsa; identical to SEQ ID NO: 206922

SEQ ID NO: 207757 - RNA, 64 nt, hsa; identical to SEQ ID NO: 206923

SEQ ID NO: 207758 - RNA, 64 nt, hsa; identical to SEQ ID NO: 206924

SEQ ID NO: 207759 - RNA, 64 nt, hsa; identical to SEQ ID NO: 206925

SEQ ID NO: 207760 - RNA, 64 nt, hsa; identical to SEQ ID NO: 206926

SEQ ID NO: 207761 - RNA, 64 nt, hsa; identical to SEQ ID NO: 206927

SEQ ID NO: 207762 - RNA, 64 nt, hsa; identical to SEQ ID NO: 206928

SEQ ID NO: 207763 - RNA, 64 nt, hsa; identical to SEQ ID NO: 206929

SEQ ID NO: 207764 - RNA, 64 nt, hsa; identical to SEQ ID NO: 206930

SEQ ID NO: 207765 - RNA, 64 nt, hsa; identical to SEQ ID NO: 206931

SEQ ID NO: 207766 - RNA, 64 nt, hsa; identical to SEQ ID NO: 206932

SEQ ID NO: 207767 - RNA, 64 nt, hsa; identical to SEQ ID NO: 206933

SEQ ID NO: 207768 - RNA, 62 nt, hsa; identical to SEQ ID NO: 206934

SEQ ID NO: 207769 - RNA, 64 nt, hsa; identical to SEQ ID NO: 206935

SEQ ID NO: 207770 - RNA, 64 nt, hsa; identical to SEQ ID NO: 206936

SEQ ID NO: 207771 - RNA, 64 nt, hsa; identical to SEQ ID NO: 206937

SEQ ID NO: 207772 - RNA, 64 nt, hsa; identical to SEQ ID NO: 206938

SEQ ID NO: 207773 - RNA, 64 nt, hsa; identical to SEQ ID NO: 206939

SEQ ID NO: 207774 - RNA, 64 nt, hsa; identical to SEQ ID NO: 206940

SEQ ID NO: 207775 - RNA, 64 nt, hsa; identical to SEQ ID NO: 206941

SEQ ID NO: 207776 - RNA, 64 nt, hsa; identical to SEQ ID NO: 206942

SEQ ID NO: 207777 - RNA, 64 nt, hsa; identical to SEQ ID NO: 206943

SEQ ID NO: 207778 - RNA, 64 nt, hsa; identical to SEQ ID NO: 206944

SEQ ID NO: 207779 - RNA, 64 nt, hsa; identical to SEQ ID NO: 206945

SEQ ID NO: 207780 - RNA, 64 nt, hsa; identical to SEQ ID NO: 206946

SEQ ID NO: 207781 - RNA, 64 nt, hsa; identical to SEQ ID NO: 206947

SEQ ID NO: 207782 - RNA, 64 nt, hsa; identical to SEQ ID NO: 206948

SEQ ID NO: 207783 - RNA, 64 nt, hsa; identical to SEQ ID NO: 206949

SEQ ID NO: 207784 - RNA, 64 nt, hsa; identical to SEQ ID NO: 206950

SEQ ID NO: 207785 - RNA, 64 nt, hsa; identical to SEQ ID NO: 206951

SEQ ID NO: 207786 - RNA, 64 nt, hsa; identical to SEQ ID NO: 206952

SEQ ID NO: 207787 - RNA, 64 nt, hsa; identical to SEQ ID NO: 206953

SEQ ID NO: 207788 - RNA, 64 nt, hsa; identical to SEQ ID NO: 206954

SEQ ID NO: 207789 - RNA, 64 nt, hsa; identical to SEQ ID NO: 206955

SEQ ID NO: 207790 - RNA, 64 nt, hsa; identical to SEQ ID NO: 206956

SEQ ID NO: 207791 - RNA, 64 nt, hsa; identical to SEQ ID NO: 206957

SEQ ID NO: 207792 - RNA, 64 nt, hsa; identical to SEQ ID NO: 206958

SEQ ID NO: 207793 - RNA, 64 nt, hsa; identical to SEQ ID NO: 206959

SEQ ID NO: 207794 - RNA, 64 nt, hsa; identical to SEQ ID NO: 206960

SEQ ID NO: 207795 - RNA, 64 nt, hsa; identical to SEQ ID NO: 206961

SEQ ID NO: 207796 - RNA, 64 nt, hsa; identical to SEQ ID NO: 206962

SEQ ID NO: 207797 - RNA, 64 nt, hsa; identical to SEQ ID NO: 206963

SEQ ID NO: 207798 - RNA, 64 nt, hsa; identical to SEQ ID NO: 206964

SEQ ID NO: 207799 - RNA, 64 nt, hsa; identical to SEQ ID NO: 206965

SEQ ID NO: 207800 - RNA, 64 nt, hsa; identical to SEQ ID NO: 206966

SEQ ID NO: 207801 - RNA, 64 nt, hsa; identical to SEQ ID NO: 206967

SEQ ID NO: 207802 - RNA, 64 nt, hsa; identical to SEQ ID NO: 206968

SEQ ID NO: 207803 - RNA, 64 nt, hsa; identical to SEQ ID NO: 206969

SEQ ID NO: 207804 - RNA, 64 nt, hsa; identical to SEQ ID NO: 206970

SEQ ID NO: 207805 - RNA, 64 nt, hsa; identical to SEQ ID NO: 206971

SEQ ID NO: 207806 - RNA, 64 nt, hsa; identical to SEQ ID NO: 206972

SEQ ID NO: 207807 - RNA, 64 nt, hsa; identical to SEQ ID NO: 206973

SEQ ID NO: 207808 - RNA, 64 nt, hsa; identical to SEQ ID NO: 206974

SEQ ID NO: 207809 - RNA, 64 nt, hsa; identical to SEQ ID NO: 206975

SEQ ID NO: 207810 - RNA, 64 nt, hsa; identical to SEQ ID NO: 206976

SEQ ID NO: 207811 - RNA, 64 nt, hsa; identical to SEQ ID NO: 206977

SEQ ID NO: 207812 - RNA, 64 nt, hsa; identical to SEQ ID NO: 206978

SEQ ID NO: 207813 - RNA, 64 nt, hsa; identical to SEQ ID NO: 206979

SEQ ID NO: 207814 - RNA, 64 nt, hsa; identical to SEQ ID NO: 206980

SEQ ID NO: 207815 - RNA, 64 nt, hsa; identical to SEQ ID NO: 206981

SEQ ID NO: 207816 - RNA, 64 nt, hsa; identical to SEQ ID NO: 206982

SEQ ID NO: 207817 - RNA, 64 nt, hsa; identical to SEQ ID NO: 206983

SEQ ID NO: 207818 - RNA, 64 nt, hsa; identical to SEQ ID NO: 206984

SEQ ID NO: 207819 - RNA, 64 nt, hsa; identical to SEQ ID NO: 206985

SEQ ID NO: 207820 - RNA, 64 nt, hsa; identical to SEQ ID NO: 206986

SEQ ID NO: 207821 - RNA, 64 nt, hsa; identical to SEQ ID NO: 206987

SEQ ID NO: 207822 - RNA, 64 nt, hsa; identical to SEQ ID NO: 206988

SEQ ID NO: 207823 - RNA, 64 nt, hsa; identical to SEQ ID NO: 206989

SEQ ID NO: 207824 - RNA, 64 nt, hsa; identical to SEQ ID NO: 206990

SEQ ID NO: 207825 - RNA, 64 nt, hsa; identical to SEQ ID NO: 206991

SEQ ID NO: 207826 - RNA, 64 nt, hsa; identical to SEQ ID NO: 206992

SEQ ID NO: 207827 - RNA, 64 nt, hsa; identical to SEQ ID NO: 206993

SEQ ID NO: 207828 - RNA, 64 nt, hsa; identical to SEQ ID NO: 206994

SEQ ID NO: 207829 - RNA, 64 nt, hsa; identical to SEQ ID NO: 206995

SEQ ID NO: 207830 - RNA, 64 nt, hsa; identical to SEQ ID NO: 206996

SEQ ID NO: 207831 - RNA, 64 nt, hsa; identical to SEQ ID NO: 206997

SEQ ID NO: 207832 - RNA, 64 nt, hsa; identical to SEQ ID NO: 206998

SEQ ID NO: 207833 - RNA, 64 nt, hsa; identical to SEQ ID NO: 206999

SEQ ID NO: 207834 - RNA, 64 nt, hsa; identical to SEQ ID NO: 207000

SEQ ID NO: 207835 - RNA, 64 nt, hsa; identical to SEQ ID NO: 207001

SEQ ID NO: 207836 - RNA, 64 nt, hsa; identical to SEQ ID NO: 207002

SEQ ID NO: 207837 - RNA, 64 nt, hsa; identical to SEQ ID NO: 207003

SEQ ID NO: 207838 - RNA, 64 nt, hsa; identical to SEQ ID NO: 207004

SEQ ID NO: 207839 - RNA, 64 nt, hsa; identical to SEQ ID NO: 207005

SEQ ID NO: 207840 - RNA, 64 nt, hsa; identical to SEQ ID NO: 207006

SEQ ID NO: 207841 - RNA, 64 nt, hsa; identical to SEQ ID NO: 207007

SEQ ID NO: 207842 - RNA, 64 nt, hsa; identical to SEQ ID NO: 207008

SEQ ID NO: 207843 - RNA, 64 nt, hsa; identical to SEQ ID NO: 207009

SEQ ID NO: 207844 - RNA, 64 nt, hsa; identical to SEQ ID NO: 207010

SEQ ID NO: 207845 - RNA, 64 nt, hsa; identical to SEQ ID NO: 207011

SEQ ID NO: 207846 - RNA, 64 nt, hsa; identical to SEQ ID NO: 207012

SEQ ID NO: 207847 - RNA, 64 nt, hsa; identical to SEQ ID NO: 207013

SEQ ID NO: 207848 - RNA, 64 nt, hsa; identical to SEQ ID NO: 207014

SEQ ID NO: 207849 - RNA, 64 nt, hsa; identical to SEQ ID NO: 207015

SEQ ID NO: 207850 - RNA, 64 nt, hsa; identical to SEQ ID NO: 207016

SEQ ID NO: 207851 - RNA, 64 nt, hsa; identical to SEQ ID NO: 207017

SEQ ID NO: 207852 - RNA, 64 nt, hsa; identical to SEQ ID NO: 207018

SEQ ID NO: 207853 - RNA, 64 nt, hsa; identical to SEQ ID NO: 207019

SEQ ID NO: 207854 - RNA, 64 nt, hsa; identical to SEQ ID NO: 207020

SEQ ID NO: 207855 - RNA, 64 nt, hsa; identical to SEQ ID NO: 207021

SEQ ID NO: 207856 - RNA, 64 nt, hsa; identical to SEQ ID NO: 207022

SEQ ID NO: 207857 - RNA, 64 nt, hsa; identical to SEQ ID NO: 207023

SEQ ID NO: 207858 - RNA, 64 nt, hsa; identical to SEQ ID NO: 207024

SEQ ID NO: 207859 - RNA, 64 nt, hsa; identical to SEQ ID NO: 207025

SEQ ID NO: 207860 - RNA, 64 nt, hsa; identical to SEQ ID NO: 207026

SEQ ID NO: 207861 - RNA, 64 nt, hsa; identical to SEQ ID NO: 207027

SEQ ID NO: 207862 - RNA, 64 nt, hsa; identical to SEQ ID NO: 207028

SEQ ID NO: 207863 - RNA, 64 nt, hsa; identical to SEQ ID NO: 207029

SEQ ID NO: 207864 - RNA, 64 nt, hsa; identical to SEQ ID NO: 207030

SEQ ID NO: 207865 - RNA, 64 nt, hsa; identical to SEQ ID NO: 207031

SEQ ID NO: 207866 - RNA, 64 nt, hsa; identical to SEQ ID NO: 207032

SEQ ID NO: 207867 - RNA, 64 nt, hsa; identical to SEQ ID NO: 207033

SEQ ID NO: 207868 - RNA, 64 nt, hsa; identical to SEQ ID NO: 207034

SEQ ID NO: 207869 - RNA, 64 nt, hsa; identical to SEQ ID NO: 207035

SEQ ID NO: 207870 - RNA, 64 nt, hsa; identical to SEQ ID NO: 207036

SEQ ID NO: 207871 - RNA, 64 nt, hsa; identical to SEQ ID NO: 207037

SEQ ID NO: 207872 - RNA, 64 nt, hsa; identical to SEQ ID NO: 207038

SEQ ID NO: 207873 - RNA, 64 nt, hsa; identical to SEQ ID NO: 207039

SEQ ID NO: 207874 - RNA, 64 nt, hsa; identical to SEQ ID NO: 207040

SEQ ID NO: 207875 - RNA, 64 nt, hsa; identical to SEQ ID NO: 207041

SEQ ID NO: 207876 - RNA, 64 nt, hsa; identical to SEQ ID NO: 207042

SEQ ID NO: 207877 - RNA, 64 nt, hsa; identical to SEQ ID NO: 207043

SEQ ID NO: 207878 - RNA, 64 nt, hsa; identical to SEQ ID NO: 207044

SEQ ID NO: 207879 - RNA, 64 nt, hsa; identical to SEQ ID NO: 207045

SEQ ID NO: 207880 - RNA, 64 nt, hsa; identical to SEQ ID NO: 207046

SEQ ID NO: 207881 - RNA, 64 nt, hsa; identical to SEQ ID NO: 207047

SEQ ID NO: 207882 - RNA, 64 nt, hsa; identical to SEQ ID NO: 207048

SEQ ID NO: 207883 - RNA, 64 nt, hsa; identical to SEQ ID NO: 207049

SEQ ID NO: 207884 - RNA, 64 nt, hsa; identical to SEQ ID NO: 207050

SEQ ID NO: 207885 - RNA, 64 nt, hsa; identical to SEQ ID NO: 207051

SEQ ID NO: 207886 - RNA, 64 nt, hsa; identical to SEQ ID NO: 207052

SEQ ID NO: 207887 - RNA, 64 nt, hsa; identical to SEQ ID NO: 207053

SEQ ID NO: 207888 - RNA, 64 nt, hsa; identical to SEQ ID NO: 207054

SEQ ID NO: 207889 - RNA, 64 nt, hsa; identical to SEQ ID NO: 207055

SEQ ID NO: 207890 - RNA, 64 nt, hsa; identical to SEQ ID NO: 207056

SEQ ID NO: 207891 - RNA, 64 nt, hsa; identical to SEQ ID NO: 207057

SEQ ID NO: 207892 - RNA, 64 nt, hsa; identical to SEQ ID NO: 207058

SEQ ID NO: 207893 - RNA, 64 nt, hsa; identical to SEQ ID NO: 207059

SEQ ID NO: 207894 - RNA, 64 nt, hsa; identical to SEQ ID NO: 207060

SEQ ID NO: 207895 - RNA, 64 nt, hsa; identical to SEQ ID NO: 207061

SEQ ID NO: 207896 - RNA, 64 nt, hsa; identical to SEQ ID NO: 207062

SEQ ID NO: 207897 - RNA, 64 nt, hsa; identical to SEQ ID NO: 207063

SEQ ID NO: 207898 - RNA, 64 nt, hsa; identical to SEQ ID NO: 207064

SEQ ID NO: 207899 - RNA, 64 nt, hsa; identical to SEQ ID NO: 207065

SEQ ID NO: 207900 - RNA, 64 nt, hsa; identical to SEQ ID NO: 207066

SEQ ID NO: 207901 - RNA, 64 nt, hsa; identical to SEQ ID NO: 207067

SEQ ID NO: 207902 - RNA, 64 nt, hsa; identical to SEQ ID NO: 207068

SEQ ID NO: 207903 - RNA, 64 nt, hsa; identical to SEQ ID NO: 207069

SEQ ID NO: 207904 - RNA, 64 nt, hsa; identical to SEQ ID NO: 207070

SEQ ID NO: 207905 - RNA, 64 nt, hsa; identical to SEQ ID NO: 207071

SEQ ID NO: 207906 - RNA, 64 nt, hsa; identical to SEQ ID NO: 207072

SEQ ID NO: 207907 - RNA, 64 nt, hsa; identical to SEQ ID NO: 207073

SEQ ID NO: 207908 - RNA, 64 nt, hsa; identical to SEQ ID NO: 207074

SEQ ID NO: 207909 - RNA, 64 nt, hsa; identical to SEQ ID NO: 207075

SEQ ID NO: 207910 - RNA, 64 nt, hsa; identical to SEQ ID NO: 207076

SEQ ID NO: 207911 - RNA, 64 nt, hsa; identical to SEQ ID NO: 207077

SEQ ID NO: 207912 - RNA, 64 nt, hsa; identical to SEQ ID NO: 207078

SEQ ID NO: 207913 - RNA, 64 nt, hsa; identical to SEQ ID NO: 207079

SEQ ID NO: 207914 - RNA, 64 nt, hsa; identical to SEQ ID NO: 207080

SEQ ID NO: 207915 - RNA, 64 nt, hsa; identical to SEQ ID NO: 207081

SEQ ID NO: 207916 - RNA, 64 nt, hsa; identical to SEQ ID NO: 207082

SEQ ID NO: 207917 - RNA, 64 nt, hsa; identical to SEQ ID NO: 207083

SEQ ID NO: 207918 - RNA, 64 nt, hsa; identical to SEQ ID NO: 207084

SEQ ID NO: 207919 - RNA, 64 nt, hsa; identical to SEQ ID NO: 207085

SEQ ID NO: 207920 - RNA, 64 nt, hsa; identical to SEQ ID NO: 207086

SEQ ID NO: 207921 - RNA, 64 nt, hsa; identical to SEQ ID NO: 207087

SEQ ID NO: 207922 - RNA, 64 nt, hsa; identical to SEQ ID NO: 207088

SEQ ID NO: 207923 - RNA, 64 nt, hsa; identical to SEQ ID NO: 207089

SEQ ID NO: 207924 - RNA, 64 nt, hsa; identical to SEQ ID NO: 207090

SEQ ID NO: 207925 - RNA, 64 nt, hsa; identical to SEQ ID NO: 207091

SEQ ID NO: 207926 - RNA, 64 nt, hsa; identical to SEQ ID NO: 207092

SEQ ID NO: 207927 - RNA, 64 nt, hsa; identical to SEQ ID NO: 207093

SEQ ID NO: 207928 - RNA, 64 nt, hsa; identical to SEQ ID NO: 207094

SEQ ID NO: 207929 - RNA, 64 nt, hsa; identical to SEQ ID NO: 207095

SEQ ID NO: 207930 - RNA, 64 nt, hsa; identical to SEQ ID NO: 207096

SEQ ID NO: 207931 - RNA, 64 nt, hsa; identical to SEQ ID NO: 207097

SEQ ID NO: 207932 - RNA, 64 nt, hsa; identical to SEQ ID NO: 207098

SEQ ID NO: 207933 - RNA, 64 nt, hsa; identical to SEQ ID NO: 207099

SEQ ID NO: 207934 - RNA, 64 nt, hsa; identical to SEQ ID NO: 207100

SEQ ID NO: 207935 - RNA, 64 nt, hsa; identical to SEQ ID NO: 207101

SEQ ID NO: 207936 - RNA, 64 nt, hsa; identical to SEQ ID NO: 207102

SEQ ID NO: 207937 - RNA, 64 nt, hsa; identical to SEQ ID NO: 207103

SEQ ID NO: 207938 - RNA, 64 nt, hsa; identical to SEQ ID NO: 207104

SEQ ID NO: 207939 - RNA, 64 nt, hsa; identical to SEQ ID NO: 207105

SEQ ID NO: 207940 - RNA, 64 nt, hsa; identical to SEQ ID NO: 207106

SEQ ID NO: 207941 - RNA, 64 nt, hsa; identical to SEQ ID NO: 207107

SEQ ID NO: 207942 - RNA, 64 nt, hsa; identical to SEQ ID NO: 207108

SEQ ID NO: 207943 - RNA, 64 nt, hsa; identical to SEQ ID NO: 207109

SEQ ID NO: 207944 - RNA, 64 nt, hsa; identical to SEQ ID NO: 207110

SEQ ID NO: 207945 - RNA, 64 nt, hsa; identical to SEQ ID NO: 207111

SEQ ID NO: 207946 - RNA, 64 nt, hsa; identical to SEQ ID NO: 207112

SEQ ID NO: 207947 - RNA, 64 nt, hsa; identical to SEQ ID NO: 207113

SEQ ID NO: 207948 - RNA, 64 nt, hsa; identical to SEQ ID NO: 207114

SEQ ID NO: 207949 - RNA, 64 nt, hsa; identical to SEQ ID NO: 207115

SEQ ID NO: 207950 - RNA, 64 nt, hsa; identical to SEQ ID NO: 207116

SEQ ID NO: 207951 - RNA, 64 nt, hsa; identical to SEQ ID NO: 207117

SEQ ID NO: 207952 - RNA, 64 nt, hsa; identical to SEQ ID NO: 207118

SEQ ID NO: 207953 - RNA, 64 nt, hsa; identical to SEQ ID NO: 207119

SEQ ID NO: 207954 - RNA, 64 nt, hsa; identical to SEQ ID NO: 207120

SEQ ID NO: 207955 - RNA, 64 nt, hsa; identical to SEQ ID NO: 207121

SEQ ID NO: 207956 - RNA, 64 nt, hsa; identical to SEQ ID NO: 207122

SEQ ID NO: 207957 - RNA, 64 nt, hsa; identical to SEQ ID NO: 207123

SEQ ID NO: 207958 - RNA, 64 nt, hsa; identical to SEQ ID NO: 207124

SEQ ID NO: 207959 - RNA, 64 nt, hsa; identical to SEQ ID NO: 207125

SEQ ID NO: 207960 - RNA, 64 nt, hsa; identical to SEQ ID NO: 207126

SEQ ID NO: 207961 - RNA, 64 nt, hsa; identical to SEQ ID NO: 207127

SEQ ID NO: 207962 - RNA, 64 nt, hsa; identical to SEQ ID NO: 207128

SEQ ID NO: 207963 - RNA, 64 nt, hsa; identical to SEQ ID NO: 207129

SEQ ID NO: 207964 - RNA, 64 nt, hsa; identical to SEQ ID NO: 207130

SEQ ID NO: 207965 - RNA, 64 nt, hsa; identical to SEQ ID NO: 207131

SEQ ID NO: 207966 - RNA, 64 nt, hsa; identical to SEQ ID NO: 207132

SEQ ID NO: 207967 - RNA, 64 nt, hsa; identical to SEQ ID NO: 207133

SEQ ID NO: 207968 - RNA, 64 nt, hsa; identical to SEQ ID NO: 207134

SEQ ID NO: 207969 - RNA, 64 nt, hsa; identical to SEQ ID NO: 207135

SEQ ID NO: 207970 - RNA, 64 nt, hsa; identical to SEQ ID NO: 207136

SEQ ID NO: 207971 - RNA, 64 nt, hsa; identical to SEQ ID NO: 207137

SEQ ID NO: 207972 - RNA, 64 nt, hsa; identical to SEQ ID NO: 207138

SEQ ID NO: 207973 - RNA, 64 nt, hsa; identical to SEQ ID NO: 207139

SEQ ID NO: 207974 - RNA, 64 nt, hsa; identical to SEQ ID NO: 207140

SEQ ID NO: 207975 - RNA, 64 nt, hsa; identical to SEQ ID NO: 207141

SEQ ID NO: 207976 - RNA, 64 nt, hsa; identical to SEQ ID NO: 207142

SEQ ID NO: 207977 - RNA, 64 nt, hsa; identical to SEQ ID NO: 207143

SEQ ID NO: 207978 - RNA, 64 nt, hsa; identical to SEQ ID NO: 207144

SEQ ID NO: 207979 - RNA, 64 nt, hsa; identical to SEQ ID NO: 207145

SEQ ID NO: 207980 - RNA, 64 nt, hsa; identical to SEQ ID NO: 207146

SEQ ID NO: 207981 - RNA, 64 nt, hsa; identical to SEQ ID NO: 207147

SEQ ID NO: 207982 - RNA, 64 nt, hsa; identical to SEQ ID NO: 207148

SEQ ID NO: 207983 - RNA, 64 nt, hsa; identical to SEQ ID NO: 207149

SEQ ID NO: 207984 - RNA, 64 nt, hsa; identical to SEQ ID NO: 207150

SEQ ID NO: 207985 - RNA, 64 nt, hsa; identical to SEQ ID NO: 207151

SEQ ID NO: 207986 - RNA, 64 nt, hsa; identical to SEQ ID NO: 207152

SEQ ID NO: 207987 - RNA, 64 nt, hsa; identical to SEQ ID NO: 207153

SEQ ID NO: 207988 - RNA, 64 nt, hsa; identical to SEQ ID NO: 207154

SEQ ID NO: 207989 - RNA, 64 nt, hsa; identical to SEQ ID NO: 207155

SEQ ID NO: 207990 - RNA, 64 nt, hsa; identical to SEQ ID NO: 207156

SEQ ID NO: 207991 - RNA, 64 nt, hsa; identical to SEQ ID NO: 207157

SEQ ID NO: 207992 - RNA, 64 nt, hsa; identical to SEQ ID NO: 207158

SEQ ID NO: 207993 - RNA, 64 nt, hsa; identical to SEQ ID NO: 207159

SEQ ID NO: 207994 - RNA, 64 nt, hsa; identical to SEQ ID NO: 207160

SEQ ID NO: 207995 - RNA, 64 nt, hsa; identical to SEQ ID NO: 207161

SEQ ID NO: 207996 - RNA, 64 nt, hsa; identical to SEQ ID NO: 207162

SEQ ID NO: 207997 - RNA, 64 nt, hsa; identical to SEQ ID NO: 207163

SEQ ID NO: 207998 - RNA, 64 nt, hsa; identical to SEQ ID NO: 207164

SEQ ID NO: 207999 - RNA, 64 nt, hsa; identical to SEQ ID NO: 207165

SEQ ID NO: 208000 - RNA, 64 nt, hsa; identical to SEQ ID NO: 207166

SEQ ID NO: 208001 - RNA, 64 nt, hsa; identical to SEQ ID NO: 207167

SEQ ID NO: 208002 - RNA, 64 nt, hsa; identical to SEQ ID NO: 207168

SEQ ID NO: 208003 - RNA, 64 nt, hsa; identical to SEQ ID NO: 207169

SEQ ID NO: 208004 - RNA, 64 nt, hsa; identical to SEQ ID NO: 207170

SEQ ID NO: 208005 - RNA, 64 nt, hsa; identical to SEQ ID NO: 207171

SEQ ID NO: 208006 - RNA, 64 nt, hsa; identical to SEQ ID NO: 207172

SEQ ID NO: 208007 - RNA, 64 nt, hsa; identical to SEQ ID NO: 207173

SEQ ID NO: 208008 - RNA, 64 nt, hsa; identical to SEQ ID NO: 207174

SEQ ID NO: 208009 - RNA, 64 nt, hsa; identical to SEQ ID NO: 207175

SEQ ID NO: 208010 - RNA, 64 nt, hsa; identical to SEQ ID NO: 207176

SEQ ID NO: 208011 - RNA, 64 nt, hsa; identical to SEQ ID NO: 207177

SEQ ID NO: 208012 - RNA, 64 nt, hsa; identical to SEQ ID NO: 207178

SEQ ID NO: 208013 - RNA, 64 nt, hsa; identical to SEQ ID NO: 207179

SEQ ID NO: 208014 - RNA, 64 nt, hsa; identical to SEQ ID NO: 207180

SEQ ID NO: 208015 - RNA, 64 nt, hsa; identical to SEQ ID NO: 207181

SEQ ID NO: 208016 - RNA, 64 nt, hsa; identical to SEQ ID NO: 207182

SEQ ID NO: 208017 - RNA, 64 nt, hsa; identical to SEQ ID NO: 207183

SEQ ID NO: 208018 - RNA, 64 nt, hsa; identical to SEQ ID NO: 207184

SEQ ID NO: 208019 - RNA, 64 nt, hsa; identical to SEQ ID NO: 207185

SEQ ID NO: 208020 - RNA, 64 nt, hsa; identical to SEQ ID NO: 207186

SEQ ID NO: 208021 - RNA, 64 nt, hsa; identical to SEQ ID NO: 207187

SEQ ID NO: 208022 - RNA, 64 nt, hsa; identical to SEQ ID NO: 207188

SEQ ID NO: 208023 - RNA, 64 nt, hsa; identical to SEQ ID NO: 207189

SEQ ID NO: 208024 - RNA, 64 nt, hsa; identical to SEQ ID NO: 207190

SEQ ID NO: 208025 - RNA, 64 nt, hsa; identical to SEQ ID NO: 207191

SEQ ID NO: 208026 - RNA, 64 nt, hsa; identical to SEQ ID NO: 207192

SEQ ID NO: 208027 - RNA, 64 nt, hsa; identical to SEQ ID NO: 207193

SEQ ID NO: 208028 - RNA, 64 nt, hsa; identical to SEQ ID NO: 207194

SEQ ID NO: 208029 - RNA, 64 nt, hsa; identical to SEQ ID NO: 207195

SEQ ID NO: 208030 - RNA, 64 nt, hsa; identical to SEQ ID NO: 207196

SEQ ID NO: 208031 - RNA, 64 nt, hsa; identical to SEQ ID NO: 207197

SEQ ID NO: 208032 - RNA, 64 nt, hsa; identical to SEQ ID NO: 207198

SEQ ID NO: 208033 - RNA, 64 nt, hsa; identical to SEQ ID NO: 207199

SEQ ID NO: 208034 - RNA, 64 nt, hsa; identical to SEQ ID NO: 207200

SEQ ID NO: 208035 - RNA, 64 nt, hsa; identical to SEQ ID NO: 207201

SEQ ID NO: 208036 - RNA, 64 nt, hsa; identical to SEQ ID NO: 207202

SEQ ID NO: 208037 - RNA, 64 nt, hsa; identical to SEQ ID NO: 207203

SEQ ID NO: 208038 - RNA, 64 nt, hsa; identical to SEQ ID NO: 207204

SEQ ID NO: 208039 - RNA, 64 nt, hsa; identical to SEQ ID NO: 207205

SEQ ID NO: 208040 - RNA, 64 nt, hsa; identical to SEQ ID NO: 207206

SEQ ID NO: 208041 - RNA, 64 nt, hsa; identical to SEQ ID NO: 207207

SEQ ID NO: 208042 - RNA, 64 nt, hsa; identical to SEQ ID NO: 207208

SEQ ID NO: 208043 - RNA, 64 nt, hsa; identical to SEQ ID NO: 207209

SEQ ID NO: 208044 - RNA, 64 nt, hsa; identical to SEQ ID NO: 207210

SEQ ID NO: 208045 - RNA, 64 nt, hsa; identical to SEQ ID NO: 207211

SEQ ID NO: 208046 - RNA, 64 nt, hsa; identical to SEQ ID NO: 207212

SEQ ID NO: 208047 - RNA, 64 nt, hsa; identical to SEQ ID NO: 207213

SEQ ID NO: 208048 - RNA, 64 nt, hsa; identical to SEQ ID NO: 207214

SEQ ID NO: 208049 - RNA, 64 nt, hsa; identical to SEQ ID NO: 207215

SEQ ID NO: 208050 - RNA, 52 nt, hsa; identical to SEQ ID NO: 207216

SEQ ID NO: 208051 - RNA, 62 nt, hsa; identical to SEQ ID NO: 207217

SEQ ID NO: 208052 - RNA, 64 nt, hsa; identical to SEQ ID NO: 207218

SEQ ID NO: 208053 - RNA, 64 nt, hsa; identical to SEQ ID NO: 207219

SEQ ID NO: 208054 - RNA, 64 nt, hsa; identical to SEQ ID NO: 207220

SEQ ID NO: 208055 - RNA, 64 nt, hsa; identical to SEQ ID NO: 207221

SEQ ID NO: 208056 - RNA, 64 nt, hsa; identical to SEQ ID NO: 207222

SEQ ID NO: 208057 - RNA, 64 nt, hsa; identical to SEQ ID NO: 207223

SEQ ID NO: 208058 - RNA, 64 nt, hsa; identical to SEQ ID NO: 207224

SEQ ID NO: 208059 - RNA, 64 nt, hsa; identical to SEQ ID NO: 207225

SEQ ID NO: 208060 - RNA, 64 nt, hsa; identical to SEQ ID NO: 207226

SEQ ID NO: 208061 - RNA, 64 nt, hsa; identical to SEQ ID NO: 207227

SEQ ID NO: 208062 - RNA, 64 nt, hsa; identical to SEQ ID NO: 207228

SEQ ID NO: 208063 - RNA, 64 nt, hsa; identical to SEQ ID NO: 207229

SEQ ID NO: 208064 - RNA, 64 nt, hsa; identical to SEQ ID NO: 207230

SEQ ID NO: 208065 - RNA, 64 nt, hsa; identical to SEQ ID NO: 207231

SEQ ID NO: 208066 - RNA, 64 nt, hsa; identical to SEQ ID NO: 207232

SEQ ID NO: 208067 - RNA, 64 nt, hsa; identical to SEQ ID NO: 207233

SEQ ID NO: 208068 - RNA, 64 nt, hsa; identical to SEQ ID NO: 207234

SEQ ID NO: 208069 - RNA, 64 nt, hsa; identical to SEQ ID NO: 207235

SEQ ID NO: 208070 - RNA, 64 nt, hsa; identical to SEQ ID NO: 207236

SEQ ID NO: 208071 - RNA, 64 nt, hsa; identical to SEQ ID NO: 207237

SEQ ID NO: 208072 - RNA, 64 nt, hsa; identical to SEQ ID NO: 207238

SEQ ID NO: 208073 - RNA, 64 nt, hsa; identical to SEQ ID NO: 207239

SEQ ID NO: 208074 - RNA, 64 nt, hsa; identical to SEQ ID NO: 207240

SEQ ID NO: 208075 - RNA, 64 nt, hsa; identical to SEQ ID NO: 207241

SEQ ID NO: 208076 - RNA, 64 nt, hsa; identical to SEQ ID NO: 207242

SEQ ID NO: 208077 - RNA, 64 nt, hsa; identical to SEQ ID NO: 207243

SEQ ID NO: 208078 - RNA, 64 nt, hsa; identical to SEQ ID NO: 207244

SEQ ID NO: 208079 - RNA, 64 nt, hsa; identical to SEQ ID NO: 207245

SEQ ID NO: 208080 - RNA, 64 nt, hsa; identical to SEQ ID NO: 207246

SEQ ID NO: 208081 - RNA, 64 nt, hsa; identical to SEQ ID NO: 207247

SEQ ID NO: 208082 - RNA, 64 nt, hsa; identical to SEQ ID NO: 207248

SEQ ID NO: 208083 - RNA, 64 nt, hsa; identical to SEQ ID NO: 207249

SEQ ID NO: 208084 - RNA, 64 nt, hsa; identical to SEQ ID NO: 207250

SEQ ID NO: 208085 - RNA, 64 nt, hsa; identical to SEQ ID NO: 207251

SEQ ID NO: 208086 - RNA, 64 nt, hsa; identical to SEQ ID NO: 207252

SEQ ID NO: 208087 - RNA, 64 nt, hsa; identical to SEQ ID NO: 207253

SEQ ID NO: 208088 - RNA, 64 nt, hsa; identical to SEQ ID NO: 207254

SEQ ID NO: 208089 - RNA, 64 nt, hsa; identical to SEQ ID NO: 207255

SEQ ID NO: 208090 - RNA, 64 nt, hsa; identical to SEQ ID NO: 207256

SEQ ID NO: 208091 - RNA, 64 nt, hsa; identical to SEQ ID NO: 207257

SEQ ID NO: 208092 - RNA, 64 nt, hsa; identical to SEQ ID NO: 207258

SEQ ID NO: 208093 - RNA, 64 nt, hsa; identical to SEQ ID NO: 207259

SEQ ID NO: 208094 - RNA, 64 nt, hsa; identical to SEQ ID NO: 207260

SEQ ID NO: 208095 - RNA, 64 nt, hsa; identical to SEQ ID NO: 207261

SEQ ID NO: 208096 - RNA, 64 nt, hsa; identical to SEQ ID NO: 207262

SEQ ID NO: 208097 - RNA, 64 nt, hsa; identical to SEQ ID NO: 207263

SEQ ID NO: 208098 - RNA, 64 nt, hsa; identical to SEQ ID NO: 207264

SEQ ID NO: 208099 - RNA, 64 nt, hsa; identical to SEQ ID NO: 207265

SEQ ID NO: 208100 - RNA, 64 nt, hsa; identical to SEQ ID NO: 207266

SEQ ID NO: 208101 - RNA, 64 nt, hsa; identical to SEQ ID NO: 207267

SEQ ID NO: 208102 - RNA, 64 nt, hsa; identical to SEQ ID NO: 207268

SEQ ID NO: 208103 - RNA, 64 nt, hsa; identical to SEQ ID NO: 207269

SEQ ID NO: 208104 - RNA, 64 nt, hsa; identical to SEQ ID NO: 207270

SEQ ID NO: 208105 - RNA, 64 nt, hsa; identical to SEQ ID NO: 207271

SEQ ID NO: 208106 - RNA, 64 nt, hsa; identical to SEQ ID NO: 207272

SEQ ID NO: 208107 - RNA, 64 nt, hsa; identical to SEQ ID NO: 207273

SEQ ID NO: 208108 - RNA, 64 nt, hsa; identical to SEQ ID NO: 207274

SEQ ID NO: 208109 - RNA, 64 nt, hsa; identical to SEQ ID NO: 207275

SEQ ID NO: 208110 - RNA, 64 nt, hsa; identical to SEQ ID NO: 207276

SEQ ID NO: 208111 - RNA, 64 nt, hsa; identical to SEQ ID NO: 207277

SEQ ID NO: 208112 - RNA, 64 nt, hsa; identical to SEQ ID NO: 207278

SEQ ID NO: 208113 - RNA, 64 nt, hsa; identical to SEQ ID NO: 207279

SEQ ID NO: 208114 - RNA, 64 nt, hsa; identical to SEQ ID NO: 207280

SEQ ID NO: 208115 - RNA, 64 nt, hsa; identical to SEQ ID NO: 207281

SEQ ID NO: 208116 - RNA, 64 nt, hsa; identical to SEQ ID NO: 207282

SEQ ID NO: 208117 - RNA, 64 nt, hsa; identical to SEQ ID NO: 207283

SEQ ID NO: 208118 - RNA, 64 nt, hsa; identical to SEQ ID NO: 207284

SEQ ID NO: 208119 - RNA, 64 nt, hsa; identical to SEQ ID NO: 207285

SEQ ID NO: 208120 - RNA, 64 nt, hsa; identical to SEQ ID NO: 207286

SEQ ID NO: 208121 - RNA, 64 nt, hsa; identical to SEQ ID NO: 207287

SEQ ID NO: 208122 - RNA, 64 nt, hsa; identical to SEQ ID NO: 207288

SEQ ID NO: 208123 - RNA, 64 nt, hsa; identical to SEQ ID NO: 207289

SEQ ID NO: 208124 - RNA, 64 nt, hsa; identical to SEQ ID NO: 207290

SEQ ID NO: 208125 - RNA, 64 nt, hsa; identical to SEQ ID NO: 207291

SEQ ID NO: 208126 - RNA, 64 nt, hsa; identical to SEQ ID NO: 207292

SEQ ID NO: 208127 - RNA, 64 nt, hsa; identical to SEQ ID NO: 207293

SEQ ID NO: 208128 - RNA, 64 nt, hsa; identical to SEQ ID NO: 207294

SEQ ID NO: 208129 - RNA, 64 nt, hsa; identical to SEQ ID NO: 207295

SEQ ID NO: 208130 - RNA, 64 nt, hsa; identical to SEQ ID NO: 207296

SEQ ID NO: 208131 - RNA, 64 nt, hsa; identical to SEQ ID NO: 207297

SEQ ID NO: 208132 - RNA, 64 nt, hsa; identical to SEQ ID NO: 207298

SEQ ID NO: 208133 - RNA, 64 nt, hsa; identical to SEQ ID NO: 207299

SEQ ID NO: 208134 - RNA, 64 nt, hsa; identical to SEQ ID NO: 207300

SEQ ID NO: 208135 - RNA, 64 nt, hsa; identical to SEQ ID NO: 207301

SEQ ID NO: 208136 - RNA, 64 nt, hsa; identical to SEQ ID NO: 207302

SEQ ID NO: 208137 - RNA, 64 nt, hsa; identical to SEQ ID NO: 207303

SEQ ID NO: 208138 - RNA, 64 nt, hsa; identical to SEQ ID NO: 207304

SEQ ID NO: 208139 - RNA, 64 nt, hsa; identical to SEQ ID NO: 207305

SEQ ID NO: 208140 - RNA, 64 nt, hsa; identical to SEQ ID NO: 207306

SEQ ID NO: 208141 - RNA, 64 nt, hsa; identical to SEQ ID NO: 207307

SEQ ID NO: 208142 - RNA, 64 nt, hsa; identical to SEQ ID NO: 207308

SEQ ID NO: 208143 - RNA, 64 nt, hsa; identical to SEQ ID NO: 207309

SEQ ID NO: 208144 - RNA, 64 nt, hsa; identical to SEQ ID NO: 207310

SEQ ID NO: 208145 - RNA, 64 nt, hsa; identical to SEQ ID NO: 207311

SEQ ID NO: 208146 - RNA, 64 nt, hsa; identical to SEQ ID NO: 207312

SEQ ID NO: 208147 - RNA, 64 nt, hsa; identical to SEQ ID NO: 207313

SEQ ID NO: 208148 - RNA, 64 nt, hsa; identical to SEQ ID NO: 207314

SEQ ID NO: 208149 - RNA, 64 nt, hsa; identical to SEQ ID NO: 207315

SEQ ID NO: 208150 - RNA, 64 nt, hsa; identical to SEQ ID NO: 207316

SEQ ID NO: 208151 - RNA, 64 nt, hsa; identical to SEQ ID NO: 207317

SEQ ID NO: 208152 - RNA, 64 nt, hsa; identical to SEQ ID NO: 207318

SEQ ID NO: 208153 - RNA, 64 nt, hsa; identical to SEQ ID NO: 207319

SEQ ID NO: 208154 - RNA, 64 nt, hsa; identical to SEQ ID NO: 207320

SEQ ID NO: 208155 - RNA, 64 nt, hsa; identical to SEQ ID NO: 207321

SEQ ID NO: 208156 - RNA, 64 nt, hsa; identical to SEQ ID NO: 207322

SEQ ID NO: 208157 - RNA, 64 nt, hsa; identical to SEQ ID NO: 207323

SEQ ID NO: 208158 - RNA, 64 nt, hsa; identical to SEQ ID NO: 207324

SEQ ID NO: 208159 - RNA, 64 nt, hsa; identical to SEQ ID NO: 207325

SEQ ID NO: 208160 - RNA, 64 nt, hsa; identical to SEQ ID NO: 207326

SEQ ID NO: 208161 - RNA, 64 nt, hsa; identical to SEQ ID NO: 207327

SEQ ID NO: 208162 - RNA, 64 nt, hsa; identical to SEQ ID NO: 207328

SEQ ID NO: 208163 - RNA, 64 nt, hsa; identical to SEQ ID NO: 207329

SEQ ID NO: 208164 - RNA, 64 nt, hsa; identical to SEQ ID NO: 207330

SEQ ID NO: 208165 - RNA, 64 nt, hsa; identical to SEQ ID NO: 207331

SEQ ID NO: 208166 - RNA, 64 nt, hsa; identical to SEQ ID NO: 207332

SEQ ID NO: 208167 - RNA, 64 nt, hsa; identical to SEQ ID NO: 207333

SEQ ID NO: 208168 - RNA, 64 nt, hsa; identical to SEQ ID NO: 207334

SEQ ID NO: 208169 - RNA, 64 nt, hsa; identical to SEQ ID NO: 207335

SEQ ID NO: 208170 - RNA, 64 nt, hsa; identical to SEQ ID NO: 207336

SEQ ID NO: 208171 - RNA, 64 nt, hsa; identical to SEQ ID NO: 207337

SEQ ID NO: 208172 - RNA, 64 nt, hsa; identical to SEQ ID NO: 207338

SEQ ID NO: 208173 - RNA, 64 nt, hsa; identical to SEQ ID NO: 207339

SEQ ID NO: 208174 - RNA, 64 nt, hsa; identical to SEQ ID NO: 207340

SEQ ID NO: 208175 - RNA, 64 nt, hsa; identical to SEQ ID NO: 207341

SEQ ID NO: 208176 - RNA, 64 nt, hsa; identical to SEQ ID NO: 207342

SEQ ID NO: 208177 - RNA, 64 nt, hsa; identical to SEQ ID NO: 207343

SEQ ID NO: 208178 - RNA, 64 nt, hsa; identical to SEQ ID NO: 207344

SEQ ID NO: 208179 - RNA, 64 nt, hsa; identical to SEQ ID NO: 207345

SEQ ID NO: 208180 - RNA, 64 nt, hsa; identical to SEQ ID NO: 207346

SEQ ID NO: 208181 - RNA, 64 nt, hsa; identical to SEQ ID NO: 207347

SEQ ID NO: 208182 - RNA, 64 nt, hsa; identical to SEQ ID NO: 207348

SEQ ID NO: 208183 - RNA, 64 nt, hsa; identical to SEQ ID NO: 207349

SEQ ID NO: 208184 - RNA, 64 nt, hsa; identical to SEQ ID NO: 207350

SEQ ID NO: 208185 - RNA, 64 nt, hsa; identical to SEQ ID NO: 207351

SEQ ID NO: 208186 - RNA, 64 nt, hsa; identical to SEQ ID NO: 207352

SEQ ID NO: 208187 - RNA, 51 nt, hsa; identical to SEQ ID NO: 207353

SEQ ID NO: 208188 - RNA, 64 nt, hsa; identical to SEQ ID NO: 207354

SEQ ID NO: 208189 - RNA, 64 nt, hsa; identical to SEQ ID NO: 207355

SEQ ID NO: 208190 - RNA, 64 nt, hsa; identical to SEQ ID NO: 207356

SEQ ID NO: 208191 - RNA, 64 nt, hsa; identical to SEQ ID NO: 207357

SEQ ID NO: 208192 - RNA, 64 nt, hsa; identical to SEQ ID NO: 207358

SEQ ID NO: 208193 - RNA, 64 nt, hsa; identical to SEQ ID NO: 207359

SEQ ID NO: 208194 - RNA, 64 nt, hsa; identical to SEQ ID NO: 207360

SEQ ID NO: 208195 - RNA, 64 nt, hsa; identical to SEQ ID NO: 207361

SEQ ID NO: 208196 - RNA, 64 nt, hsa; identical to SEQ ID NO: 207362

SEQ ID NO: 208197 - RNA, 64 nt, hsa; identical to SEQ ID NO: 207363

SEQ ID NO: 208198 - RNA, 64 nt, hsa; identical to SEQ ID NO: 207364

SEQ ID NO: 208199 - RNA, 64 nt, hsa; identical to SEQ ID NO: 207365

SEQ ID NO: 208200 - RNA, 64 nt, hsa; identical to SEQ ID NO: 207366

SEQ ID NO: 208201 - RNA, 64 nt, hsa; identical to SEQ ID NO: 207367

SEQ ID NO: 208202 - RNA, 64 nt, hsa; identical to SEQ ID NO: 207368

SEQ ID NO: 208203 - RNA, 64 nt, hsa; identical to SEQ ID NO: 207369

SEQ ID NO: 208204 - RNA, 64 nt, hsa; identical to SEQ ID NO: 207370

SEQ ID NO: 208205 - RNA, 64 nt, hsa; identical to SEQ ID NO: 207371

SEQ ID NO: 208206 - RNA, 64 nt, hsa; identical to SEQ ID NO: 207372

SEQ ID NO: 208207 - RNA, 64 nt, hsa; identical to SEQ ID NO: 207373

SEQ ID NO: 208208 - RNA, 64 nt, hsa; identical to SEQ ID NO: 207374

SEQ ID NO: 208209 - RNA, 64 nt, hsa; identical to SEQ ID NO: 207375

SEQ ID NO: 208210 - RNA, 64 nt, hsa; identical to SEQ ID NO: 207376

SEQ ID NO: 208211 - RNA, 64 nt, hsa; identical to SEQ ID NO: 207377

SEQ ID NO: 208212 - RNA, 64 nt, hsa; identical to SEQ ID NO: 207378

SEQ ID NO: 208213 - RNA, 64 nt, hsa; identical to SEQ ID NO: 207379

SEQ ID NO: 208214 - RNA, 64 nt, hsa; identical to SEQ ID NO: 207380

SEQ ID NO: 208215 - RNA, 64 nt, hsa; identical to SEQ ID NO: 207381

SEQ ID NO: 208216 - RNA, 64 nt, hsa; identical to SEQ ID NO: 207382

SEQ ID NO: 208217 - RNA, 64 nt, hsa; identical to SEQ ID NO: 207383

SEQ ID NO: 208218 - RNA, 64 nt, hsa; identical to SEQ ID NO: 207384

SEQ ID NO: 208219 - RNA, 64 nt, hsa; identical to SEQ ID NO: 207385

SEQ ID NO: 208220 - RNA, 64 nt, hsa; identical to SEQ ID NO: 207386

SEQ ID NO: 208221 - RNA, 64 nt, hsa; identical to SEQ ID NO: 207387

SEQ ID NO: 208222 - RNA, 64 nt, hsa; identical to SEQ ID NO: 207388

SEQ ID NO: 208223 - RNA, 64 nt, hsa; identical to SEQ ID NO: 207389

SEQ ID NO: 208224 - RNA, 64 nt, hsa; identical to SEQ ID NO: 207390

SEQ ID NO: 208225 - RNA, 64 nt, hsa; identical to SEQ ID NO: 207391

SEQ ID NO: 208226 - RNA, 64 nt, hsa; identical to SEQ ID NO: 207392

SEQ ID NO: 208227 - RNA, 64 nt, hsa; identical to SEQ ID NO: 207393

SEQ ID NO: 208228 - RNA, 64 nt, hsa; identical to SEQ ID NO: 207394

SEQ ID NO: 208229 - RNA, 64 nt, hsa; identical to SEQ ID NO: 207395

SEQ ID NO: 208230 - RNA, 64 nt, hsa; identical to SEQ ID NO: 207396

SEQ ID NO: 208231 - RNA, 64 nt, hsa; identical to SEQ ID NO: 207397

SEQ ID NO: 208232 - RNA, 64 nt, hsa; identical to SEQ ID NO: 207398

SEQ ID NO: 208233 - RNA, 64 nt, hsa; identical to SEQ ID NO: 207399

SEQ ID NO: 208234 - RNA, 64 nt, hsa; identical to SEQ ID NO: 207400

SEQ ID NO: 208235 - RNA, 64 nt, hsa; identical to SEQ ID NO: 207401

SEQ ID NO: 208236 - RNA, 64 nt, hsa; identical to SEQ ID NO: 207402

SEQ ID NO: 208237 - RNA, 64 nt, hsa; identical to SEQ ID NO: 207403

SEQ ID NO: 208238 - RNA, 64 nt, hsa; identical to SEQ ID NO: 207404

SEQ ID NO: 208239 - RNA, 64 nt, hsa; identical to SEQ ID NO: 207405

SEQ ID NO: 208240 - RNA, 64 nt, hsa; identical to SEQ ID NO: 207406

SEQ ID NO: 208241 - RNA, 64 nt, hsa; identical to SEQ ID NO: 207407

SEQ ID NO: 208242 - RNA, 64 nt, hsa; identical to SEQ ID NO: 207408

SEQ ID NO: 208243 - RNA, 64 nt, hsa; identical to SEQ ID NO: 207409

SEQ ID NO: 208244 - RNA, 64 nt, hsa; identical to SEQ ID NO: 207410

SEQ ID NO: 208245 - RNA, 64 nt, hsa; identical to SEQ ID NO: 207411

SEQ ID NO: 208246 - RNA, 64 nt, hsa; identical to SEQ ID NO: 207412

SEQ ID NO: 208247 - RNA, 64 nt, hsa; identical to SEQ ID NO: 207413

SEQ ID NO: 208248 - RNA, 64 nt, hsa; identical to SEQ ID NO: 207414

SEQ ID NO: 208249 - RNA, 64 nt, hsa; identical to SEQ ID NO: 207415

SEQ ID NO: 208250 - RNA, 64 nt, hsa; identical to SEQ ID NO: 207416

SEQ ID NO: 208251 - RNA, 64 nt, hsa; identical to SEQ ID NO: 207417

SEQ ID NO: 208252 - RNA, 64 nt, hsa; identical to SEQ ID NO: 207418

SEQ ID NO: 208253 - RNA, 64 nt, hsa; identical to SEQ ID NO: 207419

SEQ ID NO: 208254 - RNA, 64 nt, hsa; identical to SEQ ID NO: 207420

SEQ ID NO: 208255 - RNA, 64 nt, hsa; identical to SEQ ID NO: 207421

SEQ ID NO: 208256 - RNA, 64 nt, hsa; identical to SEQ ID NO: 207422

SEQ ID NO: 208257 - RNA, 64 nt, hsa; identical to SEQ ID NO: 207423

SEQ ID NO: 208258 - RNA, 64 nt, hsa; identical to SEQ ID NO: 207424

SEQ ID NO: 208259 - RNA, 64 nt, hsa; identical to SEQ ID NO: 207425

SEQ ID NO: 208260 - RNA, 64 nt, hsa; identical to SEQ ID NO: 207426

SEQ ID NO: 208261 - RNA, 64 nt, hsa; identical to SEQ ID NO: 207427

SEQ ID NO: 208262 - RNA, 64 nt, hsa; identical to SEQ ID NO: 207428

SEQ ID NO: 208263 - RNA, 64 nt, hsa; identical to SEQ ID NO: 207429

SEQ ID NO: 208264 - RNA, 64 nt, hsa; identical to SEQ ID NO: 207430

SEQ ID NO: 208265 - RNA, 64 nt, hsa; identical to SEQ ID NO: 207431

SEQ ID NO: 208266 - RNA, 64 nt, hsa; identical to SEQ ID NO: 207432

SEQ ID NO: 208267 - RNA, 64 nt, hsa; identical to SEQ ID NO: 207433

SEQ ID NO: 208268 - RNA, 64 nt, hsa; identical to SEQ ID NO: 207434

SEQ ID NO: 208269 - RNA, 64 nt, hsa; identical to SEQ ID NO: 207435

SEQ ID NO: 208270 - RNA, 64 nt, hsa; identical to SEQ ID NO: 207436

SEQ ID NO: 208271 - RNA, 64 nt, hsa; identical to SEQ ID NO: 207437

SEQ ID NO: 208272 - RNA, 64 nt, hsa; identical to SEQ ID NO: 207438

SEQ ID NO: 208273 - RNA, 64 nt, hsa; identical to SEQ ID NO: 207439

SEQ ID NO: 208274 - RNA, 64 nt, hsa; identical to SEQ ID NO: 207440

SEQ ID NO: 208275 - RNA, 64 nt, hsa; identical to SEQ ID NO: 207441

SEQ ID NO: 208276 - RNA, 64 nt, hsa; identical to SEQ ID NO: 207442

SEQ ID NO: 208277 - RNA, 64 nt, hsa; identical to SEQ ID NO: 207443

SEQ ID NO: 208278 - RNA, 64 nt, hsa; identical to SEQ ID NO: 207444

SEQ ID NO: 208279 - RNA, 64 nt, hsa; identical to SEQ ID NO: 207445

SEQ ID NO: 208280 - RNA, 64 nt, hsa; identical to SEQ ID NO: 207446

SEQ ID NO: 208281 - RNA, 64 nt, hsa; identical to SEQ ID NO: 207447

SEQ ID NO: 208282 - RNA, 64 nt, hsa; identical to SEQ ID NO: 207448

SEQ ID NO: 208283 - RNA, 64 nt, hsa; identical to SEQ ID NO: 207449

SEQ ID NO: 208284 - RNA, 64 nt, hsa; identical to SEQ ID NO: 207450

SEQ ID NO: 208285 - RNA, 64 nt, hsa; identical to SEQ ID NO: 207451

SEQ ID NO: 208286 - RNA, 64 nt, hsa; identical to SEQ ID NO: 207452

SEQ ID NO: 208287 - RNA, 64 nt, hsa; identical to SEQ ID NO: 207453

SEQ ID NO: 208288 - RNA, 64 nt, hsa; identical to SEQ ID NO: 207454

SEQ ID NO: 208289 - RNA, 64 nt, hsa; identical to SEQ ID NO: 207455

SEQ ID NO: 208290 - RNA, 64 nt, hsa; identical to SEQ ID NO: 207456

SEQ ID NO: 208291 - RNA, 64 nt, hsa; identical to SEQ ID NO: 207457

SEQ ID NO: 208292 - RNA, 64 nt, hsa; identical to SEQ ID NO: 207458

SEQ ID NO: 208293 - RNA, 64 nt, hsa; identical to SEQ ID NO: 207459

SEQ ID NO: 208294 - RNA, 64 nt, hsa; identical to SEQ ID NO: 207460

SEQ ID NO: 208295 - RNA, 64 nt, hsa; identical to SEQ ID NO: 207461

SEQ ID NO: 208296 - RNA, 64 nt, hsa; identical to SEQ ID NO: 207462

SEQ ID NO: 208297 - RNA, 64 nt, hsa; identical to SEQ ID NO: 207463

SEQ ID NO: 208298 - RNA, 64 nt, hsa; identical to SEQ ID NO: 207464

SEQ ID NO: 208299 - RNA, 64 nt, hsa; identical to SEQ ID NO: 207465

SEQ ID NO: 208300 - RNA, 64 nt, hsa; identical to SEQ ID NO: 207466

SEQ ID NO: 208301 - RNA, 64 nt, hsa; identical to SEQ ID NO: 207467

SEQ ID NO: 208302 - RNA, 64 nt, hsa; identical to SEQ ID NO: 207468

SEQ ID NO: 208303 - RNA, 64 nt, hsa; identical to SEQ ID NO: 207469

SEQ ID NO: 208304 - RNA, 64 nt, hsa; identical to SEQ ID NO: 207470

SEQ ID NO: 208305 - RNA, 64 nt, hsa; identical to SEQ ID NO: 207471

SEQ ID NO: 208306 - RNA, 64 nt, hsa; identical to SEQ ID NO: 207472

SEQ ID NO: 208307 - RNA, 64 nt, hsa; identical to SEQ ID NO: 207473

SEQ ID NO: 208308 - RNA, 64 nt, hsa; identical to SEQ ID NO: 207474

SEQ ID NO: 208309 - RNA, 64 nt, hsa; identical to SEQ ID NO: 207475

SEQ ID NO: 208310 - RNA, 64 nt, hsa; identical to SEQ ID NO: 207476

SEQ ID NO: 208311 - RNA, 64 nt, hsa; identical to SEQ ID NO: 207477

SEQ ID NO: 208312 - RNA, 64 nt, hsa; identical to SEQ ID NO: 207478

SEQ ID NO: 208313 - RNA, 64 nt, hsa; identical to SEQ ID NO: 207479

SEQ ID NO: 208314 - RNA, 64 nt, hsa; identical to SEQ ID NO: 207480

SEQ ID NO: 208315 - RNA, 64 nt, hsa; identical to SEQ ID NO: 207481

SEQ ID NO: 208316 - RNA, 64 nt, hsa; identical to SEQ ID NO: 207482

SEQ ID NO: 208317 - RNA, 64 nt, hsa; identical to SEQ ID NO: 207483

SEQ ID NO: 208318 - RNA, 64 nt, hsa; identical to SEQ ID NO: 207484

SEQ ID NO: 208319 - RNA, 64 nt, hsa; identical to SEQ ID NO: 207485

SEQ ID NO: 208320 - RNA, 64 nt, hsa; identical to SEQ ID NO: 207486

SEQ ID NO: 208321 - RNA, 64 nt, hsa; identical to SEQ ID NO: 207487

SEQ ID NO: 208322 - RNA, 64 nt, hsa; identical to SEQ ID NO: 207488

SEQ ID NO: 208323 - RNA, 64 nt, hsa; identical to SEQ ID NO: 207489

SEQ ID NO: 208324 - RNA, 64 nt, hsa; identical to SEQ ID NO: 207490

SEQ ID NO: 208325 - RNA, 64 nt, hsa; identical to SEQ ID NO: 207491

SEQ ID NO: 208326 - RNA, 64 nt, hsa; identical to SEQ ID NO: 207492

SEQ ID NO: 208327 - RNA, 64 nt, hsa; identical to SEQ ID NO: 207493

SEQ ID NO: 208328 - RNA, 64 nt, hsa; identical to SEQ ID NO: 207494

SEQ ID NO: 208329 - RNA, 64 nt, hsa; identical to SEQ ID NO: 207495

SEQ ID NO: 208330 - RNA, 64 nt, hsa; identical to SEQ ID NO: 207496

SEQ ID NO: 208331 - RNA, 64 nt, hsa; identical to SEQ ID NO: 207497

SEQ ID NO: 208332 - RNA, 64 nt, hsa; identical to SEQ ID NO: 207498

SEQ ID NO: 208333 - RNA, 62 nt, hsa; identical to SEQ ID NO: 207499

SEQ ID NO: 208334 - RNA, 64 nt, hsa; identical to SEQ ID NO: 207500

SEQ ID NO: 208335 - RNA, 64 nt, hsa; identical to SEQ ID NO: 207501

SEQ ID NO: 208336 - RNA, 64 nt, hsa; identical to SEQ ID NO: 207502

SEQ ID NO: 208337 - RNA, 64 nt, hsa; identical to SEQ ID NO: 207503

SEQ ID NO: 208338 - RNA, 64 nt, hsa; identical to SEQ ID NO: 207504

SEQ ID NO: 208339 - RNA, 64 nt, hsa; identical to SEQ ID NO: 207505

SEQ ID NO: 208340 - RNA, 64 nt, hsa; identical to SEQ ID NO: 207506

SEQ ID NO: 208341 - RNA, 64 nt, hsa; identical to SEQ ID NO: 207507

SEQ ID NO: 208342 - RNA, 64 nt, hsa; identical to SEQ ID NO: 207508

SEQ ID NO: 208343 - RNA, 64 nt, hsa; identical to SEQ ID NO: 207509

SEQ ID NO: 208344 - RNA, 64 nt, hsa; identical to SEQ ID NO: 207510

SEQ ID NO: 208345 - RNA, 64 nt, hsa; identical to SEQ ID NO: 207511

SEQ ID NO: 208346 - RNA, 64 nt, hsa; identical to SEQ ID NO: 207512

SEQ ID NO: 208347 - RNA, 64 nt, hsa; identical to SEQ ID NO: 207513

SEQ ID NO: 208348 - RNA, 64 nt, hsa; identical to SEQ ID NO: 207514

SEQ ID NO: 208349 - RNA, 64 nt, hsa; identical to SEQ ID NO: 207515

SEQ ID NO: 208350 - RNA, 64 nt, hsa; identical to SEQ ID NO: 207516

SEQ ID NO: 208351 - RNA, 64 nt, hsa; identical to SEQ ID NO: 207517

SEQ ID NO: 208352 - RNA, 64 nt, hsa; identical to SEQ ID NO: 207518

SEQ ID NO: 208353 - RNA, 64 nt, hsa; identical to SEQ ID NO: 207519

SEQ ID NO: 208354 - RNA, 64 nt, hsa; identical to SEQ ID NO: 207520

SEQ ID NO: 208355 - RNA, 64 nt, hsa; identical to SEQ ID NO: 207521

SEQ ID NO: 208356 - RNA, 64 nt, hsa; identical to SEQ ID NO: 207522

SEQ ID NO: 208357 - RNA, 64 nt, hsa; identical to SEQ ID NO: 207523

SEQ ID NO: 208358 - RNA, 64 nt, hsa; identical to SEQ ID NO: 207524

SEQ ID NO: 208359 - RNA, 64 nt, hsa; identical to SEQ ID NO: 207525

SEQ ID NO: 208360 - RNA, 64 nt, hsa; identical to SEQ ID NO: 207526

SEQ ID NO: 208361 - RNA, 64 nt, hsa; identical to SEQ ID NO: 207527

SEQ ID NO: 208362 - RNA, 64 nt, hsa; identical to SEQ ID NO: 207528

SEQ ID NO: 208363 - RNA, 64 nt, hsa; identical to SEQ ID NO: 207529

SEQ ID NO: 208364 - RNA, 64 nt, hsa; identical to SEQ ID NO: 207530

SEQ ID NO: 208365 - RNA, 64 nt, hsa; identical to SEQ ID NO: 207531

SEQ ID NO: 208366 - RNA, 64 nt, hsa; identical to SEQ ID NO: 207532

SEQ ID NO: 208367 - RNA, 64 nt, hsa; identical to SEQ ID NO: 207533

SEQ ID NO: 208368 - RNA, 64 nt, hsa; identical to SEQ ID NO: 207521

SEQ ID NO: 208369 - RNA, 64 nt, hsa; identical to SEQ ID NO: 207535

SEQ ID NO: 208370 - RNA, 64 nt, hsa; identical to SEQ ID NO: 207536

SEQ ID NO: 208371 - RNA, 64 nt, hsa; identical to SEQ ID NO: 207537

SEQ ID NO: 208372 - RNA, 64 nt, hsa; identical to SEQ ID NO: 207538

SEQ ID NO: 208373 - RNA, 64 nt, hsa; identical to SEQ ID NO: 207539

SEQ ID NO: 208374 - RNA, 64 nt, hsa; identical to SEQ ID NO: 207540

SEQ ID NO: 208375 - RNA, 64 nt, hsa; identical to SEQ ID NO: 207541

SEQ ID NO: 208376 - RNA, 64 nt, hsa; identical to SEQ ID NO: 207542

SEQ ID NO: 208377 - RNA, 64 nt, hsa; identical to SEQ ID NO: 207543

SEQ ID NO: 208378 - RNA, 64 nt, hsa; identical to SEQ ID NO: 207544

SEQ ID NO: 208379 - RNA, 64 nt, hsa; identical to SEQ ID NO: 207545

SEQ ID NO: 208380 - RNA, 64 nt, hsa; identical to SEQ ID NO: 207546

SEQ ID NO: 208381 - RNA, 64 nt, hsa; identical to SEQ ID NO: 207547

SEQ ID NO: 208382 - RNA, 64 nt, hsa; identical to SEQ ID NO: 207548

SEQ ID NO: 208383 - RNA, 64 nt, hsa; identical to SEQ ID NO: 207549

SEQ ID NO: 208384 - RNA, 64 nt, hsa; identical to SEQ ID NO: 207550

SEQ ID NO: 208385 - RNA, 64 nt, hsa; identical to SEQ ID NO: 207551

SEQ ID NO: 208386 - RNA, 64 nt, hsa; identical to SEQ ID NO: 207552

SEQ ID NO: 208387 - RNA, 64 nt, hsa; identical to SEQ ID NO: 207553

SEQ ID NO: 208388 - RNA, 64 nt, hsa; identical to SEQ ID NO: 207554

SEQ ID NO: 208389 - RNA, 64 nt, hsa; identical to SEQ ID NO: 207555

SEQ ID NO: 208390 - RNA, 64 nt, hsa; identical to SEQ ID NO: 207556

SEQ ID NO: 208391 - RNA, 64 nt, hsa; identical to SEQ ID NO: 207557

SEQ ID NO: 208392 - RNA, 64 nt, hsa; identical to SEQ ID NO: 207558

SEQ ID NO: 208393 - RNA, 64 nt, hsa; identical to SEQ ID NO: 207559

SEQ ID NO: 208394 - RNA, 64 nt, hsa; identical to SEQ ID NO: 207560

SEQ ID NO: 208395 - RNA, 64 nt, hsa; identical to SEQ ID NO: 207561

SEQ ID NO: 208396 - RNA, 64 nt, hsa; identical to SEQ ID NO: 207562

SEQ ID NO: 208397 - RNA, 64 nt, hsa; identical to SEQ ID NO: 207563

SEQ ID NO: 208398 - RNA, 64 nt, hsa; identical to SEQ ID NO: 207564

SEQ ID NO: 208399 - RNA, 64 nt, hsa; identical to SEQ ID NO: 207565

SEQ ID NO: 208400 - RNA, 64 nt, hsa; identical to SEQ ID NO: 207566

SEQ ID NO: 208401 - RNA, 64 nt, hsa; identical to SEQ ID NO: 207567

SEQ ID NO: 208402 - RNA, 64 nt, hsa; identical to SEQ ID NO: 207568

SEQ ID NO: 208403 - RNA, 64 nt, hsa; identical to SEQ ID NO: 207569

SEQ ID NO: 208404 - RNA, 64 nt, hsa; identical to SEQ ID NO: 207570

SEQ ID NO: 208405 - RNA, 64 nt, hsa; identical to SEQ ID NO: 207571

SEQ ID NO: 208406 - RNA, 64 nt, hsa; identical to SEQ ID NO: 207572

SEQ ID NO: 208407 - RNA, 64 nt, hsa; identical to SEQ ID NO: 207573

SEQ ID NO: 208408 - RNA, 64 nt, hsa; identical to SEQ ID NO: 207574

SEQ ID NO: 208409 - RNA, 64 nt, hsa; identical to SEQ ID NO: 207575

SEQ ID NO: 208410 - RNA, 64 nt, hsa; identical to SEQ ID NO: 207576

SEQ ID NO: 208411 - RNA, 64 nt, hsa; identical to SEQ ID NO: 207577

SEQ ID NO: 208412 - RNA, 64 nt, hsa; identical to SEQ ID NO: 207578

SEQ ID NO: 208413 - RNA, 64 nt, hsa; identical to SEQ ID NO: 207579

SEQ ID NO: 208414 - RNA, 64 nt, hsa; identical to SEQ ID NO: 207580

SEQ ID NO: 208415 - RNA, 64 nt, hsa; identical to SEQ ID NO: 207581

SEQ ID NO: 208416 - RNA, 64 nt, hsa; identical to SEQ ID NO: 207582

SEQ ID NO: 208417 - RNA, 64 nt, hsa; identical to SEQ ID NO: 207583

SEQ ID NO: 208418 - RNA, 64 nt, hsa; identical to SEQ ID NO: 207584

SEQ ID NO: 208419 - RNA, 64 nt, hsa; identical to SEQ ID NO: 207585

SEQ ID NO: 208420 - RNA, 64 nt, hsa; identical to SEQ ID NO: 207586

SEQ ID NO: 208421 - RNA, 64 nt, hsa; identical to SEQ ID NO: 207587

SEQ ID NO: 208422 - RNA, 64 nt, hsa; identical to SEQ ID NO: 207588

SEQ ID NO: 208423 - RNA, 64 nt, hsa; identical to SEQ ID NO: 207589

SEQ ID NO: 208424 - RNA, 64 nt, hsa; identical to SEQ ID NO: 207590

SEQ ID NO: 208425 - RNA, 64 nt, hsa; identical to SEQ ID NO: 207591

SEQ ID NO: 208426 - RNA, 64 nt, hsa; identical to SEQ ID NO: 207592

SEQ ID NO: 208427 - RNA, 64 nt, hsa; identical to SEQ ID NO: 207593

SEQ ID NO: 208428 - RNA, 64 nt, hsa; identical to SEQ ID NO: 207594

SEQ ID NO: 208429 - RNA, 64 nt, hsa; identical to SEQ ID NO: 207595

SEQ ID NO: 208430 - RNA, 64 nt, hsa; identical to SEQ ID NO: 207596

SEQ ID NO: 208431 - RNA, 64 nt, hsa; identical to SEQ ID NO: 207597

SEQ ID NO: 208432 - RNA, 64 nt, hsa; identical to SEQ ID NO: 207598

SEQ ID NO: 208433 - RNA, 64 nt, hsa; identical to SEQ ID NO: 207599

SEQ ID NO: 208434 - RNA, 64 nt, hsa; identical to SEQ ID NO: 207600

SEQ ID NO: 208435 - RNA, 64 nt, hsa; identical to SEQ ID NO: 207601

SEQ ID NO: 208436 - RNA, 64 nt, hsa; identical to SEQ ID NO: 207602

SEQ ID NO: 208437 - RNA, 64 nt, hsa; identical to SEQ ID NO: 207603

SEQ ID NO: 208438 - RNA, 64 nt, hsa; identical to SEQ ID NO: 207604

SEQ ID NO: 208439 - RNA, 64 nt, hsa; identical to SEQ ID NO: 207605

SEQ ID NO: 208440 - RNA, 64 nt, hsa; identical to SEQ ID NO: 207606

SEQ ID NO: 208441 - RNA, 64 nt, hsa; identical to SEQ ID NO: 207607

SEQ ID NO: 208442 - RNA, 64 nt, hsa; identical to SEQ ID NO: 207608

SEQ ID NO: 208443 - RNA, 64 nt, hsa; identical to SEQ ID NO: 207609

SEQ ID NO: 208444 - RNA, 64 nt, hsa; identical to SEQ ID NO: 207610

SEQ ID NO: 208445 - RNA, 64 nt, hsa; identical to SEQ ID NO: 207611

SEQ ID NO: 208446 - RNA, 64 nt, hsa; identical to SEQ ID NO: 207612

SEQ ID NO: 208447 - RNA, 64 nt, hsa; identical to SEQ ID NO: 207613

SEQ ID NO: 208448 - RNA, 64 nt, hsa; identical to SEQ ID NO: 207614

SEQ ID NO: 208449 - RNA, 64 nt, hsa; identical to SEQ ID NO: 207615

SEQ ID NO: 208450 - RNA, 64 nt, hsa; identical to SEQ ID NO: 207616

SEQ ID NO: 208451 - RNA, 64 nt, hsa; identical to SEQ ID NO: 207617

SEQ ID NO: 208452 - RNA, 64 nt, hsa; identical to SEQ ID NO: 207618

SEQ ID NO: 208453 - RNA, 64 nt, hsa; identical to SEQ ID NO: 207619

SEQ ID NO: 208454 - RNA, 64 nt, hsa; identical to SEQ ID NO: 207620

SEQ ID NO: 208455 - RNA, 64 nt, hsa; identical to SEQ ID NO: 207621

SEQ ID NO: 208456 - RNA, 64 nt, hsa; identical to SEQ ID NO: 207622

SEQ ID NO: 208457 - RNA, 64 nt, hsa; identical to SEQ ID NO: 207623

SEQ ID NO: 208458 - RNA, 64 nt, hsa; identical to SEQ ID NO: 207624

SEQ ID NO: 208459 - RNA, 64 nt, hsa; identical to SEQ ID NO: 207625

SEQ ID NO: 208460 - RNA, 64 nt, hsa; identical to SEQ ID NO: 207626

SEQ ID NO: 208461 - RNA, 64 nt, hsa; identical to SEQ ID NO: 207627

SEQ ID NO: 208462 - RNA, 64 nt, hsa; identical to SEQ ID NO: 207628

SEQ ID NO: 208463 - RNA, 64 nt, hsa; identical to SEQ ID NO: 207629

SEQ ID NO: 208464 - RNA, 64 nt, hsa; identical to SEQ ID NO: 207630

SEQ ID NO: 208465 - RNA, 64 nt, hsa; identical to SEQ ID NO: 207631

SEQ ID NO: 208466 - RNA, 64 nt, hsa; identical to SEQ ID NO: 207632

SEQ ID NO: 208467 - RNA, 64 nt, hsa; identical to SEQ ID NO: 207633

SEQ ID NO: 208468 - RNA, 64 nt, hsa; identical to SEQ ID NO: 207634

SEQ ID NO: 208469 - RNA, 64 nt, hsa; identical to SEQ ID NO: 207635

SEQ ID NO: 208470 - RNA, 64 nt, hsa; identical to SEQ ID NO: 207636

SEQ ID NO: 208471 - RNA, 64 nt, hsa; identical to SEQ ID NO: 207637

SEQ ID NO: 208472 - RNA, 64 nt, hsa; identical to SEQ ID NO: 207638

SEQ ID NO: 208473 - RNA, 64 nt, hsa; identical to SEQ ID NO: 207639

SEQ ID NO: 208474 - RNA, 64 nt, hsa; identical to SEQ ID NO: 207640

SEQ ID NO: 208475 - RNA, 64 nt, hsa; identical to SEQ ID NO: 207641

SEQ ID NO: 208476 - RNA, 64 nt, hsa; identical to SEQ ID NO: 207642

SEQ ID NO: 208477 - RNA, 64 nt, hsa; identical to SEQ ID NO: 207643

SEQ ID NO: 208478 - RNA, 64 nt, hsa; identical to SEQ ID NO: 207644

SEQ ID NO: 208479 - RNA, 64 nt, hsa; identical to SEQ ID NO: 207645

SEQ ID NO: 208480 - RNA, 64 nt, hsa; identical to SEQ ID NO: 207646

SEQ ID NO: 208481 - RNA, 64 nt, hsa; identical to SEQ ID NO: 207647

SEQ ID NO: 208482 - RNA, 64 nt, hsa; identical to SEQ ID NO: 207648

SEQ ID NO: 208483 - RNA, 64 nt, hsa; identical to SEQ ID NO: 207649

SEQ ID NO: 208484 - RNA, 64 nt, hsa; identical to SEQ ID NO: 207650

SEQ ID NO: 208485 - RNA, 64 nt, hsa; identical to SEQ ID NO: 207651

SEQ ID NO: 208486 - RNA, 64 nt, hsa; identical to SEQ ID NO: 207652

SEQ ID NO: 208487 - RNA, 64 nt, hsa; identical to SEQ ID NO: 207653

SEQ ID NO: 208488 - RNA, 64 nt, hsa; identical to SEQ ID NO: 207654

SEQ ID NO: 208489 - RNA, 64 nt, hsa; identical to SEQ ID NO: 207655

SEQ ID NO: 208490 - RNA, 64 nt, hsa; identical to SEQ ID NO: 207656

SEQ ID NO: 208491 - RNA, 64 nt, hsa; identical to SEQ ID NO: 207657

SEQ ID NO: 208492 - RNA, 64 nt, hsa; identical to SEQ ID NO: 207658

SEQ ID NO: 208493 - RNA, 64 nt, hsa; identical to SEQ ID NO: 207659

SEQ ID NO: 208494 - RNA, 64 nt, hsa; identical to SEQ ID NO: 207660

SEQ ID NO: 208495 - RNA, 64 nt, hsa; identical to SEQ ID NO: 207661

SEQ ID NO: 208496 - RNA, 64 nt, hsa; identical to SEQ ID NO: 207662

SEQ ID NO: 208497 - RNA, 64 nt, hsa; identical to SEQ ID NO: 207663

SEQ ID NO: 208498 - RNA, 64 nt, hsa; identical to SEQ ID NO: 207664

SEQ ID NO: 208499 - RNA, 64 nt, hsa; identical to SEQ ID NO: 207665

SEQ ID NO: 208500 - RNA, 64 nt, hsa; identical to SEQ ID NO: 207666

SEQ ID NO: 208501 - RNA, 64 nt, hsa; identical to SEQ ID NO: 207667

SEQ ID NO: 208502 - RNA, 64 nt, hsa; identical to SEQ ID NO: 207668

SEQ ID NO: 208503 - RNA, 64 nt, hsa; identical to SEQ ID NO: 207669

SEQ ID NO: 208504 - RNA, 64 nt, hsa; identical to SEQ ID NO: 207670

SEQ ID NO: 208505 - RNA, 64 nt, hsa; identical to SEQ ID NO: 207671

SEQ ID NO: 208506 - RNA, 64 nt, hsa; identical to SEQ ID NO: 207672

SEQ ID NO: 208507 - RNA, 64 nt, hsa; identical to SEQ ID NO: 207673

SEQ ID NO: 208508 - RNA, 64 nt, hsa; identical to SEQ ID NO: 207674

SEQ ID NO: 208509 - RNA, 64 nt, hsa; identical to SEQ ID NO: 207675

SEQ ID NO: 208510 - RNA, 64 nt, hsa; identical to SEQ ID NO: 207676

SEQ ID NO: 208511 - RNA, 64 nt, hsa; identical to SEQ ID NO: 207677

SEQ ID NO: 208512 - RNA, 64 nt, hsa; identical to SEQ ID NO: 207678

SEQ ID NO: 208513 - RNA, 64 nt, hsa; identical to SEQ ID NO: 207679

SEQ ID NO: 208514 - RNA, 64 nt, hsa; identical to SEQ ID NO: 207680

SEQ ID NO: 208515 - RNA, 64 nt, hsa; identical to SEQ ID NO: 207681

SEQ ID NO: 208516 - RNA, 64 nt, hsa; identical to SEQ ID NO: 207682

SEQ ID NO: 208517 - RNA, 64 nt, hsa; identical to SEQ ID NO: 207683

SEQ ID NO: 208518 - RNA, 64 nt, hsa; identical to SEQ ID NO: 207684

SEQ ID NO: 208519 - RNA, 64 nt, hsa; identical to SEQ ID NO: 207685

SEQ ID NO: 208520 - RNA, 64 nt, hsa; identical to SEQ ID NO: 207686

SEQ ID NO: 208521 - RNA, 64 nt, hsa; identical to SEQ ID NO: 207687

SEQ ID NO: 208522 - RNA, 64 nt, hsa; identical to SEQ ID NO: 207688

SEQ ID NO: 208523 - RNA, 64 nt, hsa; identical to SEQ ID NO: 207689

SEQ ID NO: 208524 - RNA, 64 nt, hsa; identical to SEQ ID NO: 207690

SEQ ID NO: 208525 - RNA, 64 nt, hsa; identical to SEQ ID NO: 207691

SEQ ID NO: 208526 - RNA, 64 nt, hsa; identical to SEQ ID NO: 207692

SEQ ID NO: 208527 - RNA, 64 nt, hsa; identical to SEQ ID NO: 207693

SEQ ID NO: 208528 - RNA, 64 nt, hsa; identical to SEQ ID NO: 207694

SEQ ID NO: 208529 - RNA, 64 nt, hsa; identical to SEQ ID NO: 207695

SEQ ID NO: 208530 - RNA, 64 nt, hsa; identical to SEQ ID NO: 207696

SEQ ID NO: 208531 - RNA, 64 nt, hsa; identical to SEQ ID NO: 207697

SEQ ID NO: 208532 - RNA, 64 nt, hsa; identical to SEQ ID NO: 207698

SEQ ID NO: 208533 - RNA, 64 nt, hsa; identical to SEQ ID NO: 207699

SEQ ID NO: 208534 - RNA, 64 nt, hsa; identical to SEQ ID NO: 207700

SEQ ID NO: 208535 - RNA, 64 nt, hsa; identical to SEQ ID NO: 207701

SEQ ID NO: 208536 - RNA, 64 nt, hsa; identical to SEQ ID NO: 207702

SEQ ID NO: 208537 - RNA, 64 nt, hsa; identical to SEQ ID NO: 207703

SEQ ID NO: 208538 - RNA, 64 nt, hsa; identical to SEQ ID NO: 207704

SEQ ID NO: 208539 - RNA, 64 nt, hsa; identical to SEQ ID NO: 207705

SEQ ID NO: 208540 - RNA, 64 nt, hsa; identical to SEQ ID NO: 207706

SEQ ID NO: 208541 - RNA, 64 nt, hsa; identical to SEQ ID NO: 207707

SEQ ID NO: 208542 - RNA, 64 nt, hsa; identical to SEQ ID NO: 207708

SEQ ID NO: 208543 - RNA, 64 nt, hsa; identical to SEQ ID NO: 207709

SEQ ID NO: 208544 - RNA, 64 nt, hsa; identical to SEQ ID NO: 207710

SEQ ID NO: 208545 - RNA, 64 nt, hsa; identical to SEQ ID NO: 207711

SEQ ID NO: 208546 - RNA, 64 nt, hsa; identical to SEQ ID NO: 207712

SEQ ID NO: 208547 - RNA, 64 nt, hsa; identical to SEQ ID NO: 207713

SEQ ID NO: 208548 - RNA, 64 nt, hsa; identical to SEQ ID NO: 207714

SEQ ID NO: 208549 - RNA, 64 nt, hsa; identical to SEQ ID NO: 207715

SEQ ID NO: 208550 - RNA, 64 nt, hsa; identical to SEQ ID NO: 207716

SEQ ID NO: 208551 - RNA, 64 nt, hsa; identical to SEQ ID NO: 207717

SEQ ID NO: 208552 - RNA, 64 nt, hsa; identical to SEQ ID NO: 207718

SEQ ID NO: 208553 - RNA, 64 nt, hsa; identical to SEQ ID NO: 207719

SEQ ID NO: 208554 - RNA, 64 nt, hsa; identical to SEQ ID NO: 207720

SEQ ID NO: 208555 - RNA, 64 nt, hsa; identical to SEQ ID NO: 207721

SEQ ID NO: 208556 - RNA, 64 nt, hsa; identical to SEQ ID NO: 207722

SEQ ID NO: 208557 - RNA, 64 nt, hsa; identical to SEQ ID NO: 207723

SEQ ID NO: 208558 - RNA, 64 nt, hsa; identical to SEQ ID NO: 207724

SEQ ID NO: 208559 - RNA, 64 nt, hsa; identical to SEQ ID NO: 207725

SEQ ID NO: 208560 - RNA, 64 nt, hsa; identical to SEQ ID NO: 207726

SEQ ID NO: 208561 - RNA, 64 nt, hsa; identical to SEQ ID NO: 207727

SEQ ID NO: 208562 - RNA, 64 nt, hsa; identical to SEQ ID NO: 207728

SEQ ID NO: 208563 - RNA, 64 nt, hsa; identical to SEQ ID NO: 207729

SEQ ID NO: 208564 - RNA, 64 nt, hsa; identical to SEQ ID NO: 207730

SEQ ID NO: 208565 - RNA, 64 nt, hsa; identical to SEQ ID NO: 207731

SEQ ID NO: 208566 - RNA, 64 nt, hsa; identical to SEQ ID NO: 207732

SEQ ID NO: 208567 - RNA, 64 nt, hsa; identical to SEQ ID NO: 207733

SEQ ID NO: 208568 - RNA, 64 nt, hsa; identical to SEQ ID NO: 207734

SEQ ID NO: 208569 - RNA, 64 nt, hsa; identical to SEQ ID NO: 133159

SEQ ID NO: 208570 - RNA, 64 nt, hsa; identical to SEQ ID NO: 133160

SEQ ID NO: 208571 - RNA, 64 nt, hsa; identical to SEQ ID NO: 133161

SEQ ID NO: 208572 - RNA, 64 nt, hsa; identical to SEQ ID NO: 133162

SEQ ID NO: 208573 - RNA, 64 nt, hsa; identical to SEQ ID NO: 133163

SEQ ID NO: 208574 - RNA, 64 nt, hsa; identical to SEQ ID NO: 133164

SEQ ID NO: 208575 - RNA, 64 nt, hsa; identical to SEQ ID NO: 133165

SEQ ID NO: 208576 - RNA, 64 nt, hsa; identical to SEQ ID NO: 133166

SEQ ID NO: 208577 - RNA, 64 nt, hsa; identical to SEQ ID NO: 133167

SEQ ID NO: 208578 - RNA, 64 nt, hsa; identical to SEQ ID NO: 133168

SEQ ID NO: 208579 - RNA, 64 nt, hsa; identical to SEQ ID NO: 133169

SEQ ID NO: 208580 - RNA, 64 nt, hsa; identical to SEQ ID NO: 133170

SEQ ID NO: 208581 - RNA, 64 nt, hsa; identical to SEQ ID NO: 133171

SEQ ID NO: 208582 - RNA, 64 nt, hsa; identical to SEQ ID NO: 133172

SEQ ID NO: 208583 - RNA, 64 nt, hsa; identical to SEQ ID NO: 133173

SEQ ID NO: 208584 - RNA, 64 nt, hsa; identical to SEQ ID NO: 133174

SEQ ID NO: 208585 - RNA, 64 nt, hsa; identical to SEQ ID NO: 133175

SEQ ID NO: 208586 - RNA, 64 nt, hsa; identical to SEQ ID NO: 133176

SEQ ID NO: 208587 - RNA, 64 nt, hsa; identical to SEQ ID NO: 133177

SEQ ID NO: 208588 - RNA, 64 nt, hsa; identical to SEQ ID NO: 133178

SEQ ID NO: 208589 - RNA, 64 nt, hsa; identical to SEQ ID NO: 133179

SEQ ID NO: 208590 - RNA, 64 nt, hsa; identical to SEQ ID NO: 133180

SEQ ID NO: 208591 - RNA, 64 nt, hsa; identical to SEQ ID NO: 133181

SEQ ID NO: 208592 - RNA, 64 nt, hsa; identical to SEQ ID NO: 133182

SEQ ID NO: 208593 - RNA, 64 nt, hsa; identical to SEQ ID NO: 133183

SEQ ID NO: 208594 - RNA, 64 nt, hsa; identical to SEQ ID NO: 133184

SEQ ID NO: 208595 - RNA, 64 nt, hsa; identical to SEQ ID NO: 133185

SEQ ID NO: 208596 - RNA, 64 nt, hsa; identical to SEQ ID NO: 133186

SEQ ID NO: 208597 - RNA, 64 nt, hsa; identical to SEQ ID NO: 133187

SEQ ID NO: 208598 - RNA, 64 nt, hsa; identical to SEQ ID NO: 133188

SEQ ID NO: 208599 - RNA, 64 nt, hsa; identical to SEQ ID NO: 133189

SEQ ID NO: 208600 - RNA, 64 nt, hsa; identical to SEQ ID NO: 133190

SEQ ID NO: 208601 - RNA, 64 nt, hsa; identical to SEQ ID NO: 133191

SEQ ID NO: 208602 - RNA, 64 nt, hsa; identical to SEQ ID NO: 133192

SEQ ID NO: 208603 - RNA, 64 nt, hsa; identical to SEQ ID NO: 133193

SEQ ID NO: 208604 - RNA, 64 nt, hsa; identical to SEQ ID NO: 133194

SEQ ID NO: 208605 - RNA, 64 nt, hsa; identical to SEQ ID NO: 133195

SEQ ID NO: 208606 - RNA, 64 nt, hsa; identical to SEQ ID NO: 133196

SEQ ID NO: 208607 - RNA, 64 nt, hsa; identical to SEQ ID NO: 133197

SEQ ID NO: 208608 - RNA, 64 nt, hsa; identical to SEQ ID NO: 133198

SEQ ID NO: 208609 - RNA, 64 nt, hsa; identical to SEQ ID NO: 133199

SEQ ID NO: 208610 - RNA, 64 nt, hsa; identical to SEQ ID NO: 133200

SEQ ID NO: 208611 - RNA, 64 nt, hsa; identical to SEQ ID NO: 133201

SEQ ID NO: 208612 - RNA, 64 nt, hsa; identical to SEQ ID NO: 133202

SEQ ID NO: 208613 - RNA, 64 nt, hsa; identical to SEQ ID NO: 133203

SEQ ID NO: 208614 - RNA, 64 nt, hsa
cccggcgccugccggcgggcuccgcucuugggacaccggagaaccuaucaugucagccagcggg

SEQ ID NO: 208615 - RNA, 64 nt, hsa
ggugguauggggguuagcacuggcucucguucucaccggagaaggaaguguucuagugugguuu

SEQ ID NO: 208616 - RNA, 64 nt, hsa
ccaagcacagccuuauuucugccggggccuccccaccggagagcccagggggccggccggguuc

SEQ ID NO: 208617 - RNA, 64 nt, hsa
gcccucacuauugaugcauuuuuaauaagcaaucaccggagacuugguacccaguaagugguua

SEQ ID NO: 208618 - RNA, 64 nt, hsa
uacugcuuuaaucagaaacccucauuguguuucuaccggagagagaauguauuugcugacaacc

SEQ ID NO: 208619 - RNA, 64 nt, hsa
uggccuuccuucccgccagagggcuugugaacagaccggagaggacaguggauuguuuauacuc

SEQ ID NO: 208620 - RNA, 64 nt, hsa
ugugacaaggcuacgcugacaaucaguuaaacacaccggagaagaaccauuuacaugcaccuua

SEQ ID NO: 208621 - RNA, 64 nt, hsa
uaguuucuuuugcacaugcuacauugugcuuuagaccggagauaauacagugacuuuaccucac

SEQ ID NO: 208622 - RNA, 64 nt, hsa
auucucaaaccuugauaaacauaagagaauucauaccggagagaaacuguacaaaugugaagaa

SEQ ID NO: 208623 - RNA, 64 nt, hsa
agagcggugccggcagcaagcaggccuccuggugaccggagagaaagaggagcccucccgcuca

SEQ ID NO: 208624 - RNA, 64 nt, hsa
uacgaccacuggaagccagcacccaaggaagaugaccggagaacaucugccaucaaggcccuua

SEQ ID NO: 208625 - RNA, 64 nt, hsa
gaauaaauagaaccuguugugcaaccacgguuuaaccggagauuuugaggcuaggguguguuuc

SEQ ID NO: 208626 - RNA, 64 nt, hsa
aagacuagcgcggccaccgcgaagccgccaacccaccggagagggggcuucugaacuuggacuc

SEQ ID NO: 208627 - RNA, 64 nt, hsa
gacaccgcucaucccgaucucuuccugucagaggaccggagaagugugagaaggugccccuuca

SEQ ID NO: 208628 - RNA, 64 nt, hsa
aaugcucagcccuucucguuguaagagaauucacaccggagaacaacuuuuuaaaugccuucag

SEQ ID NO: 208629 - RNA, 64 nt, hsa
gaaauccuuuaguuauaacucagccuuuaggaacaccggagaacccacaauaauagaaaucuuu

SEQ ID NO: 208630 - RNA, 64 nt, hsa
guguguggaaagcgcugugggggaagagccggucaccggagagugagcaggcggagacuccaag

SEQ ID NO: 208631 - RNA, 64 nt, hsa
gcuucuguggcucuucacagaccucacggaugugaccggagaugagugccgaugaccacguuuu

SEQ ID NO: 208632 - RNA, 64 nt, hsa
ugaucaucuuggcuugggccgcuuaggaacaagaaccggagagaagugauuggaaaugaacucu

SEQ ID NO: 208633 - RNA, 64 nt, hsa
gggcccagaagcuuuagagguaugaggcugcagaaccggagagauuuuccucugugcagugcuc

SEQ ID NO: 208634 - RNA, 64 nt, hsa
caguaugaaaaucagcaugcccgccuaguuaccuaccggagaguuauccugauaaauuaaccuc

SEQ ID NO: 208635 - RNA, 64 nt, hsa
gcccaguggcucuuaaacaguuuagcaacuaauaaccggagaacuaacauguaguauuugugcu

SEQ ID NO: 208636 - RNA, 64 nt, hsa; identical to SEQ ID NO: 208628

SEQ ID NO: 208637 - RNA, 64 nt, hsa
agaaugcucgaggggcgcagagggcagcucccagaccggagaggaccuuggaccuguuaggcgc

SEQ ID NO: 208638 - RNA, 64 nt, hsa
acuccguggauagagaggcacacugucagaggugaccggagaacugaguugcaaaauauauuaa

SEQ ID NO: 208639 - RNA, 64 nt, hsa
uuuaaugucaagauguguuuucccacauaaauucaccggagacauccgggccccgcuucgaugu

SEQ ID NO: 208640 - RNA, 64 nt, hsa
cugagccuuucccucuaggcccugagguacaggaaccggagaaacguccccucaccccaucccu

SEQ ID NO: 208641 - RNA, 64 nt, hsa
uuaccugguaccuaaagguuucauuugggaucagaccggagacccuuggguucucccgucucac

SEQ ID NO: 208642 - RNA, 64 nt, hsa
guuaaaaaucuauacuggacaguuacaagaaauuaccggagaaaagcuugugagcucaccaaac

SEQ ID NO: 208643 - RNA, 64 nt, hsa
cuuggcaagaccgaggucgauuugucccagccuuaccggagaaaagagcuaugguuaguuacac

SEQ ID NO: 208644 - RNA, 64 nt, hsa
accuugggaaaugaguugaugucuccgguaaaacaccggagacuaauuccugcccugcccaauu

SEQ ID NO: 208645 - RNA, 64 nt, hsa
aagugcggguccggcagcuucugcccccugcagaaccggagagccagcuaagggguggggcugc

SEQ ID NO: 208646 - RNA, 64 nt, hsa
uacuacugauggccuuucgggggucccugccccaaccggagaggccggugcacagggccccgcc

SEQ ID NO: 208647 - RNA, 64 nt, hsa
uaguauuagccaccccccuccaucuguucccagcaccggagaagggggugcucagguggaggug

SEQ ID NO: 208648 - RNA, 64 nt, hsa
aacaggcaugggaaaauggaaggguugaggauggaccggagaauuggaacuucagaauagguca

SEQ ID NO: 208649 - RNA, 64 nt, hsa
acuucugcacuugcgguuccggcauggacaauggaccggagaguggggguggggggucccaaag

SEQ ID NO: 208650 - RNA, 64 nt, hsa
cccagccaguccuggugacuggccucugccuuccaccggagagacuacugaccuucucaccucc

SEQ ID NO: 208651 - RNA, 64 nt, hsa
guggacuagacggcguggcccaaggguggugagaaccggagaaccccaggacgcccucacugca

SEQ ID NO: 208652 - RNA, 64 nt, hsa
ucuucccccaggcccuccccagccgacgacagccaccggagaggagaucggaacacgauugucu

SEQ ID NO: 208653 - RNA, 64 nt, hsa
ucuccccgccgcccccaacaggcugucaaacaaaaccggagagggggugggggagccagccucc

SEQ ID NO: 208654 - RNA, 64 nt, hsa
gguuaugaagaugguugaacaccccacacauagcaccggagauaugagaucaacaguuucuuag

SEQ ID NO: 208655 - RNA, 64 nt, hsa
ucaacgacaguauugaguggucagguuacaauaaaccggagagaaaagguccgcuugcacuuuu

SEQ ID NO: 208656 - RNA, 64 nt, hsa
uccucuaaccgguaccucugaauggggcuggauaaccggagaccccaugggaggucccugaaga

SEQ ID NO: 208657 - RNA, 64 nt, hsa
aauuaauggcuacauagcaaggcaucgucuuggaaccggagaauuuucucuagacuauuaggcu

SEQ ID NO: 208658 - RNA, 64 nt, hsa
acguggugugagagggacggcucacagggcuuggaccggagagagauggcucaugaggcuugga

SEQ ID NO: 208659 - RNA, 64 nt, hsa
gccggccccucaccuaacagcugguuccuaccagaccggagaggggagaagucauguugccccu

SEQ ID NO: 208660 - RNA, 64 nt, hsa
cauguuggauuccguccccaccacacuuccagagaccggagaacugugcagggccuaaggccgu

SEQ ID NO: 208661 - RNA, 64 nt, hsa
uggcaugacgagcuggagcagaucgugcugcacaaccggagaagacagaauuaccucugcucuu

SEQ ID NO: 208662 - RNA, 64 nt, hsa
gagggcgacacagacacgggaccgaggggcggacaccggagagacacgggaaaggggucgggac

SEQ ID NO: 208663 - RNA, 64 nt, hsa
ucccugguaucuauaaacccuuuucaggggagagaccggagaccccaucuuagauacugucaac

SEQ ID NO: 208664 - RNA, 64 nt, hsa
ugacaugagaaaggucuuuagcaaucauuucugcaccggagaugaguuuuauccuguguugggg

SEQ ID NO: 208665 - RNA, 64 nt, hsa; identical to SEQ ID NO: 201634

SEQ ID NO: 208666 - RNA, 64 nt, hsa; identical to SEQ ID NO: 201635

SEQ ID NO: 208667 - RNA, 64 nt, hsa; identical to SEQ ID NO: 201636

SEQ ID NO: 208668 - RNA, 64 nt, hsa; identical to SEQ ID NO: 201637

SEQ ID NO: 208669 - RNA, 64 nt, hsa; identical to SEQ ID NO: 201638

SEQ ID NO: 208670 - RNA, 64 nt, hsa; identical to SEQ ID NO: 201639

SEQ ID NO: 208671 - RNA, 64 nt, hsa; identical to SEQ ID NO: 201640

SEQ ID NO: 208672 - RNA, 64 nt, hsa; identical to SEQ ID NO: 201641

SEQ ID NO: 208673 - RNA, 64 nt, hsa; identical to SEQ ID NO: 201642

SEQ ID NO: 208674 - RNA, 64 nt, hsa; identical to SEQ ID NO: 201643

SEQ ID NO: 208675 - RNA, 64 nt, hsa; identical to SEQ ID NO: 201644

SEQ ID NO: 208676 - RNA, 64 nt, hsa; identical to SEQ ID NO: 201645

SEQ ID NO: 208677 - RNA, 64 nt, hsa; identical to SEQ ID NO: 201646

SEQ ID NO: 208678 - RNA, 64 nt, hsa; identical to SEQ ID NO: 201647

SEQ ID NO: 208679 - RNA, 64 nt, hsa; identical to SEQ ID NO: 201648

SEQ ID NO: 208680 - RNA, 64 nt, hsa; identical to SEQ ID NO: 201649

SEQ ID NO: 208681 - RNA, 64 nt, hsa; identical to SEQ ID NO: 201650

SEQ ID NO: 208682 - RNA, 64 nt, hsa; identical to SEQ ID NO: 201651

SEQ ID NO: 208683 - RNA, 64 nt, hsa; identical to SEQ ID NO: 201652

SEQ ID NO: 208684 - RNA, 64 nt, hsa; identical to SEQ ID NO: 201653

SEQ ID NO: 208685 - RNA, 64 nt, hsa; identical to SEQ ID NO: 201654

SEQ ID NO: 208686 - RNA, 64 nt, hsa; identical to SEQ ID NO: 201655

SEQ ID NO: 208687 - RNA, 64 nt, hsa; identical to SEQ ID NO: 201656

SEQ ID NO: 208688 - RNA, 64 nt, hsa; identical to SEQ ID NO: 201657

SEQ ID NO: 208689 - RNA, 64 nt, hsa; identical to SEQ ID NO: 201658

SEQ ID NO: 208690 - RNA, 64 nt, hsa; identical to SEQ ID NO: 201659

SEQ ID NO: 208691 - RNA, 64 nt, hsa; identical to SEQ ID NO: 201660

SEQ ID NO: 208692 - RNA, 64 nt, hsa; identical to SEQ ID NO: 201661

SEQ ID NO: 208693 - RNA, 64 nt, hsa; identical to SEQ ID NO: 201662

SEQ ID NO: 208694 - RNA, 64 nt, hsa; identical to SEQ ID NO: 201663

SEQ ID NO: 208695 - RNA, 64 nt, hsa; identical to SEQ ID NO: 201664

SEQ ID NO: 208696 - RNA, 64 nt, hsa; identical to SEQ ID NO: 201665

SEQ ID NO: 208697 - RNA, 64 nt, hsa; identical to SEQ ID NO: 201666

SEQ ID NO: 208698 - RNA, 64 nt, hsa; identical to SEQ ID NO: 201667

SEQ ID NO: 208699 - RNA, 64 nt, hsa; identical to SEQ ID NO: 201668

SEQ ID NO: 208700 - RNA, 64 nt, hsa; identical to SEQ ID NO: 201669

SEQ ID NO: 208701 - RNA, 64 nt, hsa; identical to SEQ ID NO: 201670

SEQ ID NO: 208702 - RNA, 64 nt, hsa; identical to SEQ ID NO: 201671

SEQ ID NO: 208703 - RNA, 64 nt, hsa; identical to SEQ ID NO: 201672

SEQ ID NO: 208704 - RNA, 64 nt, hsa; identical to SEQ ID NO: 201673

SEQ ID NO: 208705 - RNA, 64 nt, hsa; identical to SEQ ID NO: 201674

SEQ ID NO: 208706 - RNA, 64 nt, hsa; identical to SEQ ID NO: 201675

SEQ ID NO: 208707 - RNA, 64 nt, hsa; identical to SEQ ID NO: 201676

SEQ ID NO: 208708 - RNA, 64 nt, hsa; identical to SEQ ID NO: 201677

SEQ ID NO: 208709 - RNA, 64 nt, hsa; identical to SEQ ID NO: 201678

SEQ ID NO: 208710 - RNA, 64 nt, hsa; identical to SEQ ID NO: 201679

SEQ ID NO: 208711 - RNA, 64 nt, hsa; identical to SEQ ID NO: 201680

SEQ ID NO: 208712 - RNA, 64 nt, hsa; identical to SEQ ID NO: 201681

SEQ ID NO: 208713 - RNA, 64 nt, hsa; identical to SEQ ID NO: 201682

SEQ ID NO: 208714 - RNA, 64 nt, hsa; identical to SEQ ID NO: 201683

SEQ ID NO: 208715 - RNA, 64 nt, hsa; identical to SEQ ID NO: 201684

SEQ ID NO: 208716 - RNA, 64 nt, hsa; identical to SEQ ID NO: 201685

SEQ ID NO: 208717 - RNA, 64 nt, hsa; identical to SEQ ID NO: 201686

SEQ ID NO: 208718 - RNA, 64 nt, hsa; identical to SEQ ID NO: 201687

SEQ ID NO: 208719 - RNA, 64 nt, hsa; identical to SEQ ID NO: 201688

SEQ ID NO: 208720 - RNA, 64 nt, hsa; identical to SEQ ID NO: 201689

SEQ ID NO: 208721 - RNA, 64 nt, hsa; identical to SEQ ID NO: 201690

SEQ ID NO: 208722 - RNA, 64 nt, hsa; identical to SEQ ID NO: 201691

SEQ ID NO: 208723 - RNA, 64 nt, hsa; identical to SEQ ID NO: 201692

SEQ ID NO: 208724 - RNA, 64 nt, hsa; identical to SEQ ID NO: 201693

SEQ ID NO: 208725 - RNA, 64 nt, hsa; identical to SEQ ID NO: 201694

SEQ ID NO: 208726 - RNA, 64 nt, hsa; identical to SEQ ID NO: 201695

SEQ ID NO: 208727 - RNA, 64 nt, hsa; identical to SEQ ID NO: 201696

SEQ ID NO: 208728 - RNA, 64 nt, hsa; identical to SEQ ID NO: 201697

SEQ ID NO: 208729 - RNA, 64 nt, hsa; identical to SEQ ID NO: 201698

SEQ ID NO: 208730 - RNA, 64 nt, hsa; identical to SEQ ID NO: 201699

SEQ ID NO: 208731 - RNA, 64 nt, hsa; identical to SEQ ID NO: 201700

SEQ ID NO: 208732 - RNA, 64 nt, hsa; identical to SEQ ID NO: 201701

SEQ ID NO: 208733 - RNA, 64 nt, hsa; identical to SEQ ID NO: 201702

SEQ ID NO: 208734 - RNA, 64 nt, hsa; identical to SEQ ID NO: 201703

SEQ ID NO: 208735 - RNA, 64 nt, hsa; identical to SEQ ID NO: 201704

SEQ ID NO: 208736 - RNA, 64 nt, hsa; identical to SEQ ID NO: 201705

SEQ ID NO: 208737 - RNA, 64 nt, hsa; identical to SEQ ID NO: 201706

SEQ ID NO: 208738 - RNA, 64 nt, hsa; identical to SEQ ID NO: 201707

SEQ ID NO: 208739 - RNA, 64 nt, hsa; identical to SEQ ID NO: 201708

SEQ ID NO: 208740 - RNA, 64 nt, hsa; identical to SEQ ID NO: 201709

SEQ ID NO: 208741 - RNA, 64 nt, hsa; identical to SEQ ID NO: 201710

SEQ ID NO: 208742 - RNA, 64 nt, hsa; identical to SEQ ID NO: 201711

SEQ ID NO: 208743 - RNA, 64 nt, hsa; identical to SEQ ID NO: 201712

SEQ ID NO: 208744 - RNA, 64 nt, hsa; identical to SEQ ID NO: 201713

SEQ ID NO: 208745 - RNA, 64 nt, hsa; identical to SEQ ID NO: 201714

SEQ ID NO: 208746 - RNA, 64 nt, hsa; identical to SEQ ID NO: 159255

SEQ ID NO: 208747 - RNA, 64 nt, hsa; identical to SEQ ID NO: 159256

SEQ ID NO: 208748 - RNA, 64 nt, hsa; identical to SEQ ID NO: 159257

SEQ ID NO: 208749 - RNA, 64 nt, hsa; identical to SEQ ID NO: 159258

SEQ ID NO: 208750 - RNA, 64 nt, hsa; identical to SEQ ID NO: 159259

SEQ ID NO: 208751 - RNA, 64 nt, hsa; identical to SEQ ID NO: 159260

SEQ ID NO: 208752 - RNA, 59 nt, hsa
ggaagcuguuccuggacugacugcuggcuggcgaggaggcugcgagcguggaaucggaa

SEQ ID NO: 208753 - RNA, 64 nt, hsa
uguauuuuuaguagagaugggguuucaccguaucggcgaggaugaucucuaucucuugaccucg

SEQ ID NO: 208754 - RNA, 64 nt, hsa
aaggagcagaggggugcggguaaacgaggaguggggcgaggaaagcgggaugggaacaaguggc

SEQ ID NO: 208755 - RNA, 64 nt, hsa
ugcacacucagggccagacccaccauccuggacuggcgaggaagaucagugccuccugcucugc

SEQ ID NO: 208756 - RNA, 59 nt, hsa
ccucccuguccaagaagugacuguugagaggcgaggagguagugggugaggcuaccuga

SEQ ID NO: 208757 - RNA, 64 nt, hsa
ucaaggagaguugagauacagugaaaugagccagggcgaggagggagggugaaggaacggaggg

SEQ ID NO: 208758 - RNA, 58 nt, hsa
augaugagaucgccguguaggugccgagggcgaggagauggaggcggcggcguggcug

SEQ ID NO: 208759 - RNA, 64 nt, hsa
ggaggaagaggaggaggaggaggaggaggaggaaggcgaggacaguggcacuucagcugccagc

SEQ ID NO: 208760 - RNA, 64 nt, hsa
gcagaggaccacaguggguggcaccuccugagaaggcgaggagagugguuguugccaacuaagc

SEQ ID NO: 208761 - RNA, 64 nt, hsa
ccccacgaaggccagaaagggggaaagggaccugggcgaggagaggauuuguggugcuuggaag

SEQ ID NO: 208762 - RNA, 64 nt, hsa
accuggacuuuaauugcacccaugaauguggcuaggcgaggagcuggaguggcuguucuuaaug

SEQ ID NO: 208763 - RNA, 64 nt, hsa
cccaaaugcgcccggaggccguuaggcuguggagggcgaggaaggcgguccagaggcggccggc

SEQ ID NO: 208764 - RNA, 64 nt, hsa
auucuucaucauucaaguucuaccuggacacaaaggcgaggacccugggguuccaacaaagcuc

SEQ ID NO: 208765 - RNA, 64 nt, hsa
cuucuuccuuccuuccccgagaaggccucaauguggcgaggaagaugcuggggccgguagggcu

SEQ ID NO: 208766 - RNA, 64 nt, hsa
uggcacaagggauggggacgcgagggggaggggaggcgaggaacaaggagaaggggcaacuuuc

SEQ ID NO: 208767 - RNA, 64 nt, hsa
accguuccaacagcauucacugccaguucuaauaggcgaggaaaaugcccgaggcgcugucuuc

SEQ ID NO: 208768 - RNA, 64 nt, hsa
aaauuacauuuauguuccuauauauuacaacaucggcgaggaaaugaaagcgauucuccuugag

SEQ ID NO: 208769 - RNA, 64 nt, hsa
aagugccguaagaaaaagaaacuauuugcuccuuggcgaggacuccaagaacucacugaugcac

SEQ ID NO: 208770 - RNA, 64 nt, hsa
agggcgcguuuggguuugauggcgaguuucuaaaggcgaggaaaugguuuguaagaggggaaag

SEQ ID NO: 208771 - RNA, 64 nt, hsa
caggaauguuugcaugaccuaccucaggaggggaggcgaggaagaguaauauuuagcauucagg

SEQ ID NO: 208772 - RNA, 64 nt, hsa
cucggcaguaggcagcugugcagcuucaccucuuggcgaggaggcgugugcugcagcuacgggc

SEQ ID NO: 208773 - RNA, 64 nt, hsa
aggacggagcugcagacgaaggcaggggacccauggcgaggaggaauggccagcaccccaggca

SEQ ID NO: 208774 - RNA, 64 nt, hsa
ugauaguauaaaaaaugguuaaugacaauucagaggcgaggagauucuguaaacuuaaaauuac

SEQ ID NO: 208775 - RNA, 64 nt, hsa
gagacucuuuuaggaucagaucugugagcacguuggcgaggaaaaacaaaacaaacaaaaaaaa

SEQ ID NO: 208776 - RNA, 64 nt, hsa
ccaaucauccaccagucagacugaauguguagcuggcgaggaauuacuuccacuucuggcccag

SEQ ID NO: 208777 - RNA, 64 nt, hsa
aauuuggagugaccaaaggugugcccuguacacaggcgaggacccugcaccuggaugggggucc

SEQ ID NO: 208778 - RNA, 64 nt, hsa
ccaccuggacggggaggcggccaaaaagcugaugggcgaggaggcccuggcggggggcgacaag

SEQ ID NO: 208779 - RNA, 64 nt, hsa
aacaugaaaaaugaugggcuccuccuaauaggaaggcgaggagaggagaaggccaggggaauga

SEQ ID NO: 208780 - RNA, 64 nt, hsa
gucugucuccaggcuggggagagaagggugaccaggcgaggagggagccgagacgucaacugug

SEQ ID NO: 208781 - RNA, 64 nt, hsa
cucuacucccuuaacaguguugaauucaacugaaggcgaggaauguuggugaugaagcugaguu

SEQ ID NO: 208782 - RNA, 64 nt, hsa
acuguggccgaccgcagcugugccguggcacgauggcgaggaagccagccccaaggaaacacug

SEQ ID NO: 208783 - RNA, 64 nt, hsa
uucuucaggccuugaaucaaaagccacuuuguuaggcgaggauuucccagaccacucaucacau

SEQ ID NO: 208784 - RNA, 64 nt, hsa
gcagagcggggagcugcagcacagcaacagugauggcgaggacuuccccguggcgcuguuuggg

SEQ ID NO: 208785 - RNA, 64 nt, hsa
aggaugggguugggggcuaaauuaauuggaguggggcgaggagagagccagaaaacauagaucc

SEQ ID NO: 208786 - RNA, 64 nt, hsa
ucgacuccugcggugcggggcuggcugucuggcuggcgaggagcugcugcgcuuccuucacaug

SEQ ID NO: 208787 - RNA, 64 nt, hsa
cgcggccggcggccucagaguccacggagcucgcggcgaggacgacuucugcuuuuguuguugu

SEQ ID NO: 208788 - RNA, 64 nt, hsa
acuccuaaaccaaaagugcuuuaaaaaccagccuggcgaggacagcccuggacccacuccacug

SEQ ID NO: 208789 - RNA, 64 nt, hsa
cgggguuccuuguguuagggacuuaagaaucugaggcgaggacccccaggcuuaccuguaggac

SEQ ID NO: 208790 - RNA, 64 nt, hsa
gggcugcggggucaggggcuccagcauccgagcuggcgaggaaacaguacagggucugaguucu

SEQ ID NO: 208791 - RNA, 64 nt, hsa
auuuuacaaaaauuauaaaaaaugaauuaguacuggcgaggacuaaaugaaacaauaauuuuuc

SEQ ID NO: 208792 - RNA, 64 nt, hsa
ggacgggugguccggagggaggcuggagcggggaggcgaggagggggcugugaguccucagagg

SEQ ID NO: 208793 - RNA, 64 nt, hsa
cccccuggugccugcaggccacccagggaccacgggcgaggacgugaagccucccgaacacgca

SEQ ID NO: 208794 - RNA, 64 nt, hsa
uccccuccacuuggcugcaagucgccugccauggggcgaggaggccugcaccccaguauaaggg

SEQ ID NO: 208795 - RNA, 64 nt, hsa
cagcucacucgaggccuggggaaggggacucaggggcgaggaggaugacuggguccggucgcca

SEQ ID NO: 208796 - RNA, 64 nt, hsa
cuggaaagcaggagggaacaaaggugaacaugaaggcgaggaugcuggggcccugcagugcgcu

SEQ ID NO: 208797 - RNA, 64 nt, hsa
agagccugaaaaacugccccaaugccacgguaaaggcgaggaagucuuggcuggcguugcugac

SEQ ID NO: 208798 - RNA, 64 nt, hsa
aggggagggggcgcccaggagggguggggaggggggcgaggagagccaagugcagcgaagggac

SEQ ID NO: 208799 - RNA, 64 nt, hsa
cuaggauugaaaggugcauuuuccccauaaaaaaggcgaggaaaacccauggcugcuuuguguc

SEQ ID NO: 208800 - RNA, 64 nt, hsa
cauccaggcugucaacaccagccccgagcggggaggcgaggaggcccugcaugccuuccugcuc

SEQ ID NO: 208801 - RNA, 64 nt, hsa
ggccucuacugcccuggcugcagucagugcccagggcgaggaauguggccaggggauccaggac

SEQ ID NO: 208802 - RNA, 64 nt, hsa
gcggccggagggcggguacaaggcugucugguuuggcgaggacaucgggacggaggcagacgug

SEQ ID NO: 208803 - RNA, 64 nt, hsa
ggagcugcugugcccaggacguggguucagcgugggcgaggaaagccuggcgagcguggcccug

SEQ ID NO: 208804 - RNA, 64 nt, hsa
uuaaccugcagaaacaguacuuagguaauuguagggcgaggauuauaaaugaaauuugcaaaau

SEQ ID NO: 208805 - RNA, 64 nt, hsa
ggugggugggagacagggcuuuuucucucccucuggcgaggacucucaggauguagggacuugg

SEQ ID NO: 208806 - RNA, 64 nt, hsa
caaggcccgauguggugugcagagguggggagguggcgaggauggggacagaaagcgcacagaa

SEQ ID NO: 208807 - RNA, 64 nt, hsa
aaacuuguagguguuuaagaauugguuuugggagggcgaggacugggccagguuagaggcagau

SEQ ID NO: 208808 - RNA, 64 nt, hsa
gccacggugagggcuuggaaggagacaggaauggggcgaggaaggagccaggcccggcaugagg

SEQ ID NO: 208809 - RNA, 64 nt, hsa
ugcccccuccuccccggccaaggcgccuggaccuggcgaggacgcugcccgccgagcggacuga

SEQ ID NO: 208810 - RNA, 64 nt, hsa
gaaugaccaacucuuaaaagccugauaggcucucggcgaggagcuuugaacgugucugaagggu

SEQ ID NO: 208811 - RNA, 64 nt, hsa
uucucuggagcuuugggccucagggcgccuagaaggcgaggacgcagaccugaaggcggccggu

SEQ ID NO: 208812 - RNA, 64 nt, hsa
uuaauauuaccaacuacauuggaagccugagcagggcgaggaccaauaauuuuaauuauuuaua

SEQ ID NO: 208813 - RNA, 64 nt, hsa
ccagcugcagccuaggcaggggaugcacagcccaggcgaggaagccuggcuucucugugagcac

SEQ ID NO: 208814 - RNA, 64 nt, hsa
acugauuauagagaaggcuacuaagugacucaugggcgaggagcauagacaguguggagacauu

SEQ ID NO: 208815 - RNA, 64 nt, hsa
auagaaugaaugaccccaaaauaggguuuucuugggcgaggaugugcuggauuaggaaagguga

SEQ ID NO: 208816 - RNA, 64 nt, hsa
cuauguacagaacuuuaaacaauauaguauuuauggcgaggacagcuguagucuguugugauau

SEQ ID NO: 208817 - RNA, 64 nt, hsa
aaucggggugguggcaauggucguggaggccgagggcgaggaggacccaugggccguggaggcu

SEQ ID NO: 208818 - RNA, 64 nt, hsa
agaaucacugaggcaccaauggcugagcaggaagggcgaggagacaccuugaucagcgucccag

SEQ ID NO: 208819 - RNA, 64 nt, hsa
ugccgcagaggccggagaccuccuggacuaguucggcgaggagacuggccacuggggguggcug

SEQ ID NO: 208820 - RNA, 64 nt, hsa
ugaagcuggacaagagccucaauaaggacacccuggcgaggaagcuggcagugcucaccccagg

SEQ ID NO: 208821 - RNA, 64 nt, hsa
aauccauaacugauuuccaagcugguguguucaaggcgaggacgguguguggguggccccuuaa

SEQ ID NO: 208822 - RNA, 57 nt, hsa
cacaggaaacuucgcagugaugcaccaggcgaggaaacgagaccucuuucguuccuu

SEQ ID NO: 208823 - RNA, 64 nt, hsa
gauccgggaauaaagaauguccgccucuccauggggcgaggacuucgcguuucaggggagggcc

SEQ ID NO: 208824 - RNA, 64 nt, hsa
uugcagagcuggccagcccccuccuuagggggugggcgaggagccucugggcagacccaagaac

SEQ ID NO: 208825 - RNA, 64 nt, hsa
ugggcacagcacagccagggcgcucuuccaggcaggcgaggauaacuugagaguuuccuagggc

SEQ ID NO: 208826 - RNA, 64 nt, hsa
uuaggacuugaagagggaagguauuuaauaacugggcgaggaugggugugguggcucacaccug

SEQ ID NO: 208827 - RNA, 59 nt, hsa
accccuacgugugggacugagucagcgguggcgaggagaggcgggcggauuuggggagg

SEQ ID NO: 208828 - RNA, 64 nt, hsa
cccgccauuacuuucuuuucuggagugccaugcuggcgaggauccggaugcggcagcacccucu

SEQ ID NO: 208829 - RNA, 64 nt, hsa
aucaugaaggugugcaaaugauucuuacggcaugggcgaggauuuuucaauuuauuuuuuaaag

SEQ ID NO: 208830 - RNA, 64 nt, hsa
uagccaggaaaggggugagagugauuguguugugggcgaggaggcguuuccacccccuggugcc

SEQ ID NO: 208831 - RNA, 64 nt, hsa
gcgaaggaaauggucacaccccccgcccaccccaggcgaggauccuggugacaugcuccucucc

SEQ ID NO: 208832 - RNA, 64 nt, hsa
uucuuucugugaggagauugaguacucugcagcuggcgaggaguugguugaggcacuucuucaa

SEQ ID NO: 208833 - RNA, 64 nt, hsa
gccuccugacaccagcagaggaauuuuguacccaggcgaggacuucuugaacuucugcguaucu

SEQ ID NO: 208834 - RNA, 64 nt, hsa
agccgaggccgagcgcccccugcuggcccgcggcggcgaggagcagagggagcggaggaggggc

SEQ ID NO: 208835 - RNA, 64 nt, hsa
uccccagcucugucccuguagucaccugccggugggcgaggauccucucccugggauaagcacu

SEQ ID NO: 208836 - RNA, 64 nt, hsa
cuacgacgaggccgauggcccgggcagcgggggcggcgaggaggccauggccggggccuacgac

SEQ ID NO: 208837 - RNA, 64 nt, hsa
gaggucugugaagagcgggcaggaggcaugagcaggcgaggagcuggccugucccgggaagcag

SEQ ID NO: 208838 - RNA, 64 nt, hsa
cccacccugaagguuguggguuuacuggaacgagggcgaggaacaccuggcccacccagggcgg

SEQ ID NO: 208839 - RNA, 64 nt, hsa
cuggucccugccuuggucccuugccugggaagagggcgaggaggccagugguggggacgcagag

SEQ ID NO: 208840 - RNA, 64 nt, hsa
acugcauccagccuggggcugaggcugaggcacuggcgaggagagggcgcuccucucugcacac

SEQ ID NO: 208841 - RNA, 64 nt, hsa
gguccagugaggggugacugcagccggucaggugggcgaggagaaggggggcugccccuuuccu

SEQ ID NO: 208842 - RNA, 64 nt, hsa
ccacuaccuccuccgcugcgcuuuugcaugcccgggcgaggaccgaagcacacaccuccacgcg

SEQ ID NO: 208843 - RNA, 64 nt, hsa
ccccaggcccaggccccaccccggcggcgguggcggcgaggaggccucgguccuuauggugguu

SEQ ID NO: 208844 - RNA, 64 nt, hsa
cuggcaggaacugggguggcuaucaauauuggauggcgaggacagcguggcacuggcugcgagu

SEQ ID NO: 208845 - RNA, 64 nt, hsa
gacagguggucggcgucggggugcgguggguaggggcgaggacaacgcagggugcgcuggguug

SEQ ID NO: 208846 - RNA, 64 nt, hsa
cuggggagacgaggguaugaguggaaagaggaugggcgaggaggccgggcuuaccuggacacua

SEQ ID NO: 208847 - RNA, 64 nt, hsa
ccgcugcucgcucccggaccaccugcccagcguuggcgaggagccccgggaggugcuucugcgg

SEQ ID NO: 208848 - RNA, 64 nt, hsa
cugacaaauuaugcuagagcaauuagacacccauggcgaggagaaaaaagaaccucuacuuaaa

SEQ ID NO: 208849 - RNA, 64 nt, hsa
agucaugcaggaugggaucuguggucaaaggacaggcgaggagcugugggcgcagggccugccg

SEQ ID NO: 208850 - RNA, 64 nt, hsa; identical to SEQ ID NO: 153164

SEQ ID NO: 208851 - RNA, 64 nt, hsa; identical to SEQ ID NO: 153165

SEQ ID NO: 208852 - RNA, 64 nt, hsa; identical to SEQ ID NO: 153166

SEQ ID NO: 208853 - RNA, 64 nt, hsa; identical to SEQ ID NO: 153167

SEQ ID NO: 208854 - RNA, 63 nt, hsa; identical to SEQ ID NO: 153168

SEQ ID NO: 208855 - RNA, 64 nt, hsa; identical to SEQ ID NO: 153169

SEQ ID NO: 208856 - RNA, 64 nt, hsa; identical to SEQ ID NO: 153170

SEQ ID NO: 208857 - RNA, 64 nt, hsa; identical to SEQ ID NO: 153171

SEQ ID NO: 208858 - RNA, 64 nt, hsa; identical to SEQ ID NO: 153172

SEQ ID NO: 208859 - RNA, 64 nt, hsa; identical to SEQ ID NO: 153173

SEQ ID NO: 208860 - RNA, 64 nt, hsa; identical to SEQ ID NO: 153174

SEQ ID NO: 208861 - RNA, 64 nt, hsa; identical to SEQ ID NO: 153175

SEQ ID NO: 208862 - RNA, 64 nt, hsa; identical to SEQ ID NO: 153176

SEQ ID NO: 208863 - RNA, 64 nt, hsa; identical to SEQ ID NO: 153177

SEQ ID NO: 208864 - RNA, 64 nt, hsa; identical to SEQ ID NO: 153178

SEQ ID NO: 208865 - RNA, 64 nt, hsa; identical to SEQ ID NO: 153179

SEQ ID NO: 208866 - RNA, 64 nt, hsa; identical to SEQ ID NO: 153180

SEQ ID NO: 208867 - RNA, 64 nt, hsa; identical to SEQ ID NO: 153181

SEQ ID NO: 208868 - RNA, 64 nt, hsa; identical to SEQ ID NO: 153182

SEQ ID NO: 208869 - RNA, 64 nt, hsa; identical to SEQ ID NO: 153183

SEQ ID NO: 208870 - RNA, 64 nt, hsa; identical to SEQ ID NO: 153184

SEQ ID NO: 208871 - RNA, 64 nt, hsa; identical to SEQ ID NO: 153185

SEQ ID NO: 208872 - RNA, 64 nt, hsa; identical to SEQ ID NO: 153186

SEQ ID NO: 208873 - RNA, 64 nt, hsa; identical to SEQ ID NO: 153187

SEQ ID NO: 208874 - RNA, 64 nt, hsa; identical to SEQ ID NO: 153188

SEQ ID NO: 208875 - RNA, 64 nt, hsa; identical to SEQ ID NO: 153189

SEQ ID NO: 208876 - RNA, 64 nt, hsa; identical to SEQ ID NO: 153190

SEQ ID NO: 208877 - RNA, 64 nt, hsa; identical to SEQ ID NO: 153191

SEQ ID NO: 208878 - RNA, 64 nt, hsa
gggggagccuggagccccugugugggagggcgaggcgggggagccuggagccccugugugggag

SEQ ID NO: 208879 - RNA, 64 nt, hsa
gggggagccuggagccccugugugggagggcgaggcgggggauccuggagccccugugucgggg

SEQ ID NO: 208880 - RNA, 64 nt, hsa
gacugcaaggcugucuccuuaaggcacugagugggcgggggaggcugggagccggcggcaggau

SEQ ID NO: 208881 - RNA, 64 nt, hsa
cagaaucuaagaccuuucagcuucgagccagggggcgggggaucccgagcaaaagccuuccgug

SEQ ID NO: 208882 - RNA, 64 nt, hsa; identical to SEQ ID NO: 72205

SEQ ID NO: 208883 - RNA, 64 nt, hsa; identical to SEQ ID NO: 72206

SEQ ID NO: 208884 - RNA, 64 nt, hsa; identical to SEQ ID NO: 72207

SEQ ID NO: 208885 - RNA, 64 nt, hsa; identical to SEQ ID NO: 72208

SEQ ID NO: 208886 - RNA, 64 nt, hsa; identical to SEQ ID NO: 72209

SEQ ID NO: 208887 - RNA, 64 nt, hsa; identical to SEQ ID NO: 72210

SEQ ID NO: 208888 - RNA, 64 nt, hsa; identical to SEQ ID NO: 72211

SEQ ID NO: 208889 - RNA, 64 nt, hsa; identical to SEQ ID NO: 72212

SEQ ID NO: 208890 - RNA, 64 nt, hsa; identical to SEQ ID NO: 72213

SEQ ID NO: 208891 - RNA, 64 nt, hsa; identical to SEQ ID NO: 72214

SEQ ID NO: 208892 - RNA, 64 nt, hsa; identical to SEQ ID NO: 72215

SEQ ID NO: 208893 - RNA, 64 nt, hsa; identical to SEQ ID NO: 72216

SEQ ID NO: 208894 - RNA, 64 nt, hsa; identical to SEQ ID NO: 72217

SEQ ID NO: 208895 - RNA, 64 nt, hsa; identical to SEQ ID NO: 72218

SEQ ID NO: 208896 - RNA, 64 nt, hsa; identical to SEQ ID NO: 72219

SEQ ID NO: 208897 - RNA, 64 nt, hsa; identical to SEQ ID NO: 72220

SEQ ID NO: 208898 - RNA, 64 nt, hsa; identical to SEQ ID NO: 72221

SEQ ID NO: 208899 - RNA, 64 nt, hsa; identical to SEQ ID NO: 72222

SEQ ID NO: 208900 - RNA, 64 nt, hsa; identical to SEQ ID NO: 72223

SEQ ID NO: 208901 - RNA, 64 nt, hsa; identical to SEQ ID NO: 72224

SEQ ID NO: 208902 - RNA, 64 nt, hsa; identical to SEQ ID NO: 72225

SEQ ID NO: 208903 - RNA, 64 nt, hsa; identical to SEQ ID NO: 72226

SEQ ID NO: 208904 - RNA, 64 nt, hsa; identical to SEQ ID NO: 72227

SEQ ID NO: 208905 - RNA, 64 nt, hsa; identical to SEQ ID NO: 72228

SEQ ID NO: 208906 - RNA, 64 nt, hsa; identical to SEQ ID NO: 72229

SEQ ID NO: 208907 - RNA, 64 nt, hsa; identical to SEQ ID NO: 72230

SEQ ID NO: 208908 - RNA, 64 nt, hsa; identical to SEQ ID NO: 72231

SEQ ID NO: 208909 - RNA, 64 nt, hsa; identical to SEQ ID NO: 72232

SEQ ID NO: 208910 - RNA, 64 nt, hsa; identical to SEQ ID NO: 72233

SEQ ID NO: 208911 - RNA, 64 nt, hsa; identical to SEQ ID NO: 72234

SEQ ID NO: 208912 - RNA, 64 nt, hsa; identical to SEQ ID NO: 72235

SEQ ID NO: 208913 - RNA, 64 nt, hsa; identical to SEQ ID NO: 72236

SEQ ID NO: 208914 - RNA, 64 nt, hsa; identical to SEQ ID NO: 72237

SEQ ID NO: 208915 - RNA, 64 nt, hsa; identical to SEQ ID NO: 72238

SEQ ID NO: 208916 - RNA, 64 nt, hsa; identical to SEQ ID NO: 72239

SEQ ID NO: 208917 - RNA, 64 nt, hsa; identical to SEQ ID NO: 72240

SEQ ID NO: 208918 - RNA, 64 nt, hsa; identical to SEQ ID NO: 72241

SEQ ID NO: 208919 - RNA, 64 nt, hsa; identical to SEQ ID NO: 72242

SEQ ID NO: 208920 - RNA, 64 nt, hsa; identical to SEQ ID NO: 72243

SEQ ID NO: 208921 - RNA, 64 nt, hsa; identical to SEQ ID NO: 72244

SEQ ID NO: 208922 - RNA, 64 nt, hsa; identical to SEQ ID NO: 72245

SEQ ID NO: 208923 - RNA, 64 nt, hsa; identical to SEQ ID NO: 72246

SEQ ID NO: 208924 - RNA, 64 nt, hsa; identical to SEQ ID NO: 72247

SEQ ID NO: 208925 - RNA, 64 nt, hsa; identical to SEQ ID NO: 72248

SEQ ID NO: 208926 - RNA, 64 nt, hsa; identical to SEQ ID NO: 72249

SEQ ID NO: 208927 - RNA, 64 nt, hsa; identical to SEQ ID NO: 72250

SEQ ID NO: 208928 - RNA, 64 nt, hsa; identical to SEQ ID NO: 72251

SEQ ID NO: 208929 - RNA, 64 nt, hsa; identical to SEQ ID NO: 72252

SEQ ID NO: 208930 - RNA, 64 nt, hsa; identical to SEQ ID NO: 72253

SEQ ID NO: 208931 - RNA, 64 nt, hsa; identical to SEQ ID NO: 72254

SEQ ID NO: 208932 - RNA, 64 nt, hsa; identical to SEQ ID NO: 72255

SEQ ID NO: 208933 - RNA, 64 nt, hsa; identical to SEQ ID NO: 72256

SEQ ID NO: 208934 - RNA, 64 nt, hsa; identical to SEQ ID NO: 72257

SEQ ID NO: 208935 - RNA, 64 nt, hsa; identical to SEQ ID NO: 72258

SEQ ID NO: 208936 - RNA, 64 nt, hsa; identical to SEQ ID NO: 72259

SEQ ID NO: 208937 - RNA, 64 nt, hsa; identical to SEQ ID NO: 72260

SEQ ID NO: 208938 - RNA, 64 nt, hsa; identical to SEQ ID NO: 72261

SEQ ID NO: 208939 - RNA, 64 nt, hsa; identical to SEQ ID NO: 72262

SEQ ID NO: 208940 - RNA, 64 nt, hsa; identical to SEQ ID NO: 72263

SEQ ID NO: 208941 - RNA, 64 nt, hsa; identical to SEQ ID NO: 72264

SEQ ID NO: 208942 - RNA, 64 nt, hsa; identical to SEQ ID NO: 72265

SEQ ID NO: 208943 - RNA, 64 nt, hsa; identical to SEQ ID NO: 72266

SEQ ID NO: 208944 - RNA, 64 nt, hsa; identical to SEQ ID NO: 72267

SEQ ID NO: 208945 - RNA, 64 nt, hsa; identical to SEQ ID NO: 72268

SEQ ID NO: 208946 - RNA, 64 nt, hsa; identical to SEQ ID NO: 72269

SEQ ID NO: 208947 - RNA, 64 nt, hsa; identical to SEQ ID NO: 72270

SEQ ID NO: 208948 - RNA, 64 nt, hsa; identical to SEQ ID NO: 72271

SEQ ID NO: 208949 - RNA, 64 nt, hsa; identical to SEQ ID NO: 72272

SEQ ID NO: 208950 - RNA, 64 nt, hsa; identical to SEQ ID NO: 72273

SEQ ID NO: 208951 - RNA, 64 nt, hsa
aaaacaucaaaacacugcagcaguuccuaaaugauucucacaagcaacccugagagagacaguc

SEQ ID NO: 208952 - RNA, 64 nt, hsa
ggagaucugggggaggcaggaagcuccucagauuuucucacagacccuucccaauuccaucacc

SEQ ID NO: 208953 - RNA, 64 nt, hsa
aaagaguaggaagagagaaaugguagccugcugcuucucacagacaccucacauccucacuugg

SEQ ID NO: 208954 - RNA, 64 nt, hsa
cuccuccuaaaggcaugcagcuugcagccccucuuucucacacgugugauccuagcgugagagg

SEQ ID NO: 208955 - RNA, 64 nt, hsa
cccuccuccucuucccuggcccauugaucaucccuucucacagagggucaucauuauuuccaaa

SEQ ID NO: 208956 - RNA, 64 nt, hsa
agaaugagugucaccaguggguaauugaaucaacuucucacacauacugaaggcuuuauauguc

SEQ ID NO: 208957 - RNA, 64 nt, hsa
caugauaccauggaaauauuccaaauaaauuuuuuucucacagugucaagguaacugaauucau

SEQ ID NO: 208958 - RNA, 64 nt, hsa
ugacuuuggaguuauucaguuaaugacccuuuaauucucacaaccaaccagucauguugcuuga

SEQ ID NO: 208959 - RNA, 64 nt, hsa
ucccgcaaaaugggcuuccugccugguuuuucucuucucacauuuuuuaaaugguccccugugu

SEQ ID NO: 208960 - RNA, 64 nt, hsa
ugaagggaguaugucuuaaauguaaaguuucugguucucacacuguacucugagguccaaauac

SEQ ID NO: 208961 - RNA, 64 nt, hsa
gagcaucuguuucaaaugugggacuuacaagcacuucucacaugagaaauuaggggcggguggg

SEQ ID NO: 208962 - RNA, 64 nt, hsa
ucuauuuuuauaacuggagugugaguucuguaucuucucacauucuguauacuguauccauuuu

SEQ ID NO: 208963 - RNA, 64 nt, hsa
ugcauuucgaaagcaaacagaagaaaaaaguauauucucacaguuuuuccccaggaagucugga

SEQ ID NO: 208964 - RNA, 64 nt, hsa
cucuaaaaguaaacuacuguuaggaacagcaguguucucacaguguggggcagccguccuucua

SEQ ID NO: 208965 - RNA, 64 nt, hsa
gaggcaugcacaucuggaauuaaggucaaacuaauucucacaucccucuaaaaguaaacuacug

SEQ ID NO: 208966 - RNA, 64 nt, hsa
gaguggugccugaaaauugugucuguccgugucuuucucacacucgaauccacauccuuugaac

SEQ ID NO: 208967 - RNA, 64 nt, hsa
ggaaauucacaacauacucaacuuuuggguuuuguucucacaguauuuuucacaaaaaaagggu

SEQ ID NO: 208968 - RNA, 64 nt, hsa
auaugcuucccgcauuguccuagucccaguuguauucucacagguguuaugugcaggacacaau

SEQ ID NO: 208969 - RNA, 64 nt, hsa
gggauuccuauugacacugcucgggugcacccaguucucacaugugcagucaugccguucucug

SEQ ID NO: 208970 - RNA, 64 nt, hsa
ucccaucgcacgugcuuucugcucuucugggaauuucucacacuggcaaagcaguccagccucc

SEQ ID NO: 208971 - RNA, 64 nt, hsa
gcacauaccaucaagccacacuaucaugguauuguucucacagucuuuuggugguugauggcca

SEQ ID NO: 208972 - RNA, 64 nt, hsa
acuacaauauuuaacuaaggcccaaccgauuuccauaauguagcaguuaccguguucaccucac

SEQ ID NO: 208973 - RNA, 64 nt, hsa
ccaacuuuucucuauuuacauaugcaucucuccuauaauguaaauagaauaauagcuuugaaau

SEQ ID NO: 208974 - RNA, 64 nt, hsa
aauauuuugacauaauguauuaacauuuuaauauauaauguacaauuuaagaauuggugcuuua

SEQ ID NO: 208975 - RNA, 64 nt, hsa
cuguuauuaaaacaauguucuucaauauuuugacauaauguauuaacauuuuaauauauaaugu

SEQ ID NO: 208976 - RNA, 64 nt, hsa
ggggccaacuccaauauaggguggguaaggccuuauaauguaaagagcauauaauguaaagggc

SEQ ID NO: 208977 - RNA, 64 nt, hsa
uaggguggguaaggccuuauaauguaaagagcauauaauguaaagggcuuuagagugagacaga

SEQ ID NO: 208978 - RNA, 64 nt, hsa
ucugagugacacuuuucacccuuguacagccaaaauaauguauauauggaaagugacagacaaa

SEQ ID NO: 208979 - RNA, 64 nt, hsa
uuucagccaucaaaaauaaggauuaauuuagaagauaauguacaauauguguccaugagaagua

SEQ ID NO: 208980 - RNA, 64 nt, hsa
uacuguaccaaaucuggaauuacaauggggaguaauaauguauacuaaaugacuuuuguauuuu

SEQ ID NO: 208981 - RNA, 64 nt, hsa
ugacuguugcuuaagaaguuuucuuauggcaaaaauaauguaaauaaguuacuaugaucugcau

SEQ ID NO: 208982 - RNA, 64 nt, hsa
augaugcuacauaauuuuguggcucccuaaugcaauaauguacagaagauaaaaaaauuuauaa

SEQ ID NO: 208983 - RNA, 64 nt, hsa
uuugaauuuucucuguaagagaauaaaagauaaaauaauguauuuucuuuauuucacauuuuau

SEQ ID NO: 208984 - RNA, 64 nt, hsa
uucuaugcaugcauuugaaagcuguuuuuaccugauaauguaguaauaaguuguauucauaaaa

SEQ ID NO: 208985 - RNA, 64 nt, hsa
uuuuugcaugacuuuucucucauuuuauucuuccauaauguauuucuacuauaaaauagaauca

SEQ ID NO: 208986 - RNA, 64 nt, hsa
ggcaaauuuauguagcuauguggaaugauaugucauaauguaaaauuagauaaauucuuuuuuc

SEQ ID NO: 208987 - RNA, 64 nt, hsa
uuucaguacaugaacuauagaaaaaaaucuauauauaauguacauaaauguuacauuuguaaag

SEQ ID NO: 208988 - RNA, 64 nt, hsa
aaaagggaauauaaagaugacuuucaaggaacauauaauguagucagaaagaugagaggauuag

SEQ ID NO: 208989 - RNA, 64 nt, hsa
aucuaaccauuuuauucucugcuucauagcauuuauaauguaugaugagguuaacacugaaaua

SEQ ID NO: 208990 - RNA, 64 nt, hsa
ugguucauaaauuauaauguauaaucuauacauuauaauguaauauauaaacuaaaauuuaugg

SEQ ID NO: 208991 - RNA, 64 nt, hsa
aauuauucuauaugaauauuaugguucauaaauuauaauguauaaucuauacauuauaauguaa

SEQ ID NO: 208992 - RNA, 64 nt, hsa
uuauguagguuucuuaucacuuucucuuugcauaauaauguacuaauauuuaaaauaccuucag

SEQ ID NO: 208993 - RNA, 64 nt, hsa
uagagauaauguaaacugaaaaaaaaucugcaagauaauguaacugaauguuuuaaaaacagaa

SEQ ID NO: 208994 - RNA, 64 nt, hsa
cauaugaccaucuuuccaucaaaucaauguagagauaauguaaacugaaaaaaaaucugcaaga

SEQ ID NO: 208995 - RNA, 64 nt, hsa
uuuauuaguaccuggcuugaagccuaguguuuucauaauguaauucaaugaaaacuguuggaga

SEQ ID NO: 208996 - RNA, 64 nt, hsa
gcugucaccuuaaauaagacauuuuaauuuuguuauaauguacaauuuagaaguuugauuaauu

SEQ ID NO: 208997 - RNA, 64 nt, hsa
ggagaaucgggcuaauuuauuaaugaugauaauuauaauguaucuguacagcacuuuuuacauu

SEQ ID NO: 208998 - RNA, 64 nt, hsa
ggcuagauuguuguguguuuuguugaauuuuuucauaauguaaugccguauuuauuguuuuuaa

SEQ ID NO: 208999 - RNA, 64 nt, hsa
guuguaugcuaguuuaaaaaagaaaauauguaauauaauguaaaaaaaaacaaaaaaaagcuuu

SEQ ID NO: 209000 - RNA, 64 nt, hsa
uguuuuuuccauauauauauaccuaugauaaaguauaauguauaaauuaagcauagcaagagau

SEQ ID NO: 209001 - RNA, 64 nt, hsa
uaauguauaaauuaagcauagcaagagauuaauaauaauguaauagaacaaugauaacauacua

SEQ ID NO: 209002 - RNA, 64 nt, hsa
aaauacacaauaaaguauuuugagguaaagggccauaauguaugcaaucuacucucaaaaaauu

SEQ ID NO: 209003 - RNA, 64 nt, hsa
ucagaaaugaggcaagcuaggagaaugggcuauuauaauguaaagaauuguagucucaguuaaa

SEQ ID NO: 209004 - RNA, 64 nt, hsa
gagaguucaccucuacucugcccuccucauagucauaauguagcaaguaaagaaugagaaugga

SEQ ID NO: 209005 - RNA, 64 nt, hsa
agaauggauucuguacaauacacuagaaaccaacauaauguauuucuuuaaaaccugugugaaa

SEQ ID NO: 209006 - RNA, 64 nt, hsa
uguuaaaucuuaaauaugcuuuuuaaaaauuggaauaauguauuaaggucaaauaauaucccau

SEQ ID NO: 209007 - RNA, 64 nt, hsa
uaacuaaguuguguuuaacuuaugugcagucuuuauaauguauguauguuauuacaguuucaac

SEQ ID NO: 209008 - RNA, 64 nt, hsa
auauaaccaaaugugguguuuuagugacuuuuugauaauguacaguuuuuugugaauuuaaauu

SEQ ID NO: 209009 - RNA, 64 nt, hsa
cccaccccccaguuuucagauuuucucucauccaauaauguaaaacuaucguguacggguuccu

SEQ ID NO: 209010 - RNA, 64 nt, hsa
gugaauucugguuuguuuguaaaacagcauuauuauaauguagguauggucaaugagcaguggu

SEQ ID NO: 209011 - RNA, 64 nt, hsa
gugcauauuuuuuaacaaugcccaaucuguaugaauaauguaaacuucgauuuuuuuuuaaaaa

SEQ ID NO: 209012 - RNA, 64 nt, hsa
auaguuaugcauuuauauucucaaaaaugaaaucauaauguacauugcuuuguagucugcucua

SEQ ID NO: 209013 - RNA, 64 nt, hsa
auuuauuuccuauucagcaauuugauuauguauuauaauguaaucuguaaauagugauaugauu

SEQ ID NO: 209014 - RNA, 64 nt, hsa
agcccauucaugguaagucuuaagcuuguuggaaauaauguacccauguagacuagcaaaauag

SEQ ID NO: 209015 - RNA, 64 nt, hsa
gguuuuuaaucaaaguuggcuuuauaggaggaguauaauguaugcacuacuguuuuaaaagaau

SEQ ID NO: 209016 - RNA, 64 nt, hsa
gcuaauuuuuguauuuuaguagagacaggguuucauaauguaagucaagcuggucucgaacucc

SEQ ID NO: 209017 - RNA, 64 nt, hsa
uuuugaaaaaauuagauuuuuugaaaagugaguaauaauguaauucaacucuuaaauuauuucc

SEQ ID NO: 209018 - RNA, 64 nt, hsa
caguaucacaucuagcucccuuacuuguccacagauaauguaaacaaaggagggaaaaacuuau

SEQ ID NO: 209019 - RNA, 64 nt, hsa
aaagucgugugaaauccuguacacuguguauagaauaauguaauuuuauguuaauuguuauuac

SEQ ID NO: 209020 - RNA, 64 nt, hsa
aagccacauuaaggagugagucuucuuuuuuacaauaauguaaaaauuaaacuguuuacauuuu

SEQ ID NO: 209021 - RNA, 64 nt, hsa
guuguugaauuugaaagccuuuguaaauaucaauauaauguaccaaugaaauaacaucuggggc

SEQ ID NO: 209022 - RNA, 64 nt, hsa
ccuucccccauaaguuggaggauaaaauggguaucaaugcuaauauuuccagggagaacaugaa

SEQ ID NO: 209023 - RNA, 64 nt, hsa
gaguccucugucauguguccuugucccuaggcuacaaugcuacacuuggcucaggcugaucacc

SEQ ID NO: 209024 - RNA, 64 nt, hsa; identical to SEQ ID NO: 45780

SEQ ID NO: 209025 - RNA, 64 nt, hsa; identical to SEQ ID NO: 45781

SEQ ID NO: 209026 - RNA, 64 nt, hsa; identical to SEQ ID NO: 45782

SEQ ID NO: 209027 - RNA, 64 nt, hsa; identical to SEQ ID NO: 45783

SEQ ID NO: 209028 - RNA, 64 nt, hsa; identical to SEQ ID NO: 45784

SEQ ID NO: 209029 - RNA, 64 nt, hsa; identical to SEQ ID NO: 45785

SEQ ID NO: 209030 - RNA, 64 nt, hsa; identical to SEQ ID NO: 45786

SEQ ID NO: 209031 - RNA, 64 nt, hsa; identical to SEQ ID NO: 45787

SEQ ID NO: 209032 - RNA, 64 nt, hsa; identical to SEQ ID NO: 45788

SEQ ID NO: 209033 - RNA, 64 nt, hsa; identical to SEQ ID NO: 45789

SEQ ID NO: 209034 - RNA, 64 nt, hsa; identical to SEQ ID NO: 45790

SEQ ID NO: 209035 - RNA, 64 nt, hsa; identical to SEQ ID NO: 45791

SEQ ID NO: 209036 - RNA, 64 nt, hsa; identical to SEQ ID NO: 45792

SEQ ID NO: 209037 - RNA, 64 nt, hsa; identical to SEQ ID NO: 45793

SEQ ID NO: 209038 - RNA, 64 nt, hsa; identical to SEQ ID NO: 45794

SEQ ID NO: 209039 - RNA, 64 nt, hsa; identical to SEQ ID NO: 45795

SEQ ID NO: 209040 - RNA, 64 nt, hsa; identical to SEQ ID NO: 45796

SEQ ID NO: 209041 - RNA, 64 nt, hsa; identical to SEQ ID NO: 45797

SEQ ID NO: 209042 - RNA, 64 nt, hsa; identical to SEQ ID NO: 45798

SEQ ID NO: 209043 - RNA, 64 nt, hsa; identical to SEQ ID NO: 45799

SEQ ID NO: 209044 - RNA, 64 nt, hsa; identical to SEQ ID NO: 45800

SEQ ID NO: 209045 - RNA, 64 nt, hsa; identical to SEQ ID NO: 45801

SEQ ID NO: 209046 - RNA, 64 nt, hsa; identical to SEQ ID NO: 45802

SEQ ID NO: 209047 - RNA, 64 nt, hsa; identical to SEQ ID NO: 45803

SEQ ID NO: 209048 - RNA, 64 nt, hsa; identical to SEQ ID NO: 45804

SEQ ID NO: 209049 - RNA, 64 nt, hsa; identical to SEQ ID NO: 45805

SEQ ID NO: 209050 - RNA, 64 nt, hsa; identical to SEQ ID NO: 45806

SEQ ID NO: 209051 - RNA, 64 nt, hsa
cugguucccucacagguuucuccagaaaguacucccucaguaaagcauuugcacaagaauccuu

SEQ ID NO: 209052 - RNA, 64 nt, hsa
cccuguuccucagcauggagcucuggcauccccaccucaguaucuaaccugaaccagccuggcu

SEQ ID NO: 209053 - RNA, 64 nt, hsa
cccucuccaugcuccccgccccaacccacucuggccucaguagauuuuuuuuucaguugugguu

SEQ ID NO: 209054 - RNA, 64 nt, hsa
cugagauuacaggugugagccaccgugcccagccccucaguagguuuuaaggagcccccagccc

SEQ ID NO: 209055 - RNA, 64 nt, hsa; identical to SEQ ID NO: 167990

SEQ ID NO: 209056 - RNA, 64 nt, hsa; identical to SEQ ID NO: 167991

SEQ ID NO: 209057 - RNA, 64 nt, hsa; identical to SEQ ID NO: 167992

SEQ ID NO: 209058 - RNA, 64 nt, hsa; identical to SEQ ID NO: 167993

SEQ ID NO: 209059 - RNA, 64 nt, hsa; identical to SEQ ID NO: 167994

SEQ ID NO: 209060 - RNA, 64 nt, hsa; identical to SEQ ID NO: 167995

SEQ ID NO: 209061 - RNA, 64 nt, hsa; identical to SEQ ID NO: 167996

SEQ ID NO: 209062 - RNA, 64 nt, hsa; identical to SEQ ID NO: 167997

SEQ ID NO: 209063 - RNA, 64 nt, hsa; identical to SEQ ID NO: 167998

SEQ ID NO: 209064 - RNA, 64 nt, hsa; identical to SEQ ID NO: 167999

SEQ ID NO: 209065 - RNA, 64 nt, hsa; identical to SEQ ID NO: 168000

SEQ ID NO: 209066 - RNA, 64 nt, hsa; identical to SEQ ID NO: 168001

SEQ ID NO: 209067 - RNA, 64 nt, hsa; identical to SEQ ID NO: 168002

SEQ ID NO: 209068 - RNA, 64 nt, hsa; identical to SEQ ID NO: 168003

SEQ ID NO: 209069 - RNA, 64 nt, hsa; identical to SEQ ID NO: 168004

SEQ ID NO: 209070 - RNA, 64 nt, hsa; identical to SEQ ID NO: 168005

SEQ ID NO: 209071 - RNA, 64 nt, hsa; identical to SEQ ID NO: 168006

SEQ ID NO: 209072 - RNA, 64 nt, hsa; identical to SEQ ID NO: 168007

SEQ ID NO: 209073 - RNA, 64 nt, hsa; identical to SEQ ID NO: 168008

SEQ ID NO: 209074 - RNA, 64 nt, hsa; identical to SEQ ID NO: 168009

SEQ ID NO: 209075 - RNA, 64 nt, hsa; identical to SEQ ID NO: 168010

SEQ ID NO: 209076 - RNA, 64 nt, hsa; identical to SEQ ID NO: 168011

SEQ ID NO: 209077 - RNA, 64 nt, hsa; identical to SEQ ID NO: 168012

SEQ ID NO: 209078 - RNA, 64 nt, hsa; identical to SEQ ID NO: 168013

SEQ ID NO: 209079 - RNA, 64 nt, hsa; identical to SEQ ID NO: 168014

SEQ ID NO: 209080 - RNA, 64 nt, hsa; identical to SEQ ID NO: 168015

SEQ ID NO: 209081 - RNA, 64 nt, hsa; identical to SEQ ID NO: 168016

SEQ ID NO: 209082 - RNA, 64 nt, hsa; identical to SEQ ID NO: 168017

SEQ ID NO: 209083 - RNA, 64 nt, hsa; identical to SEQ ID NO: 168018

SEQ ID NO: 209084 - RNA, 64 nt, hsa; identical to SEQ ID NO: 168018

SEQ ID NO: 209085 - RNA, 64 nt, hsa; identical to SEQ ID NO: 168020

SEQ ID NO: 209086 - RNA, 64 nt, hsa; identical to SEQ ID NO: 168021

SEQ ID NO: 209087 - RNA, 64 nt, hsa; identical to SEQ ID NO: 168022

SEQ ID NO: 209088 - RNA, 64 nt, hsa; identical to SEQ ID NO: 168023

SEQ ID NO: 209089 - RNA, 64 nt, hsa; identical to SEQ ID NO: 168024

SEQ ID NO: 209090 - RNA, 64 nt, hsa; identical to SEQ ID NO: 168025

SEQ ID NO: 209091 - RNA, 64 nt, hsa; identical to SEQ ID NO: 168026

SEQ ID NO: 209092 - RNA, 64 nt, hsa
cuuuccuugggccauaccuucccugcagaucuccagcccagaaccaucuuccccuguuguccuc

SEQ ID NO: 209093 - RNA, 64 nt, hsa
agaggagaggggaccagaccaucuccgcaaccacagcccagagcuccagucaccagauagaaaa

SEQ ID NO: 209094 - RNA, 64 nt, hsa
ggaguaaccgcuccagguaccuugaccuuuguacagcccagaggccaacacuguggguguguga

SEQ ID NO: 209095 - RNA, 64 nt, hsa
agcacugggaucacaggugucagccauugcacccagcccagauugucuuaauuucuaucuuguu

SEQ ID NO: 209096 - RNA, 64 nt, hsa
cgccuccccaagucagcaguccuagccccaaaccagcccagagcagggucucucuaaaggggac

SEQ ID NO: 209097 - RNA, 64 nt, hsa
cuccccuacaccaacaaagaggaauggcugcaagagcccagaucacccauuccggguucacucc

SEQ ID NO: 209098 - RNA, 64 nt, hsa
cgccagccuagaacauccugcucugaaugaacagagcccagauggggguccagagcuaagugac

SEQ ID NO: 209099 - RNA, 64 nt, hsa
agcacuaaggaugucaguguacgagacggugcgaagcccagaggaggcggcuugggauccucug

SEQ ID NO: 209100 - RNA, 64 nt, hsa
ugcagccacuggcuugauugggcccuggacguugagcccagauguuggagccacaccagccugg

SEQ ID NO: 209101 - RNA, 64 nt, hsa
ugugcccacugcccgugcagccuccuucagccagagcccagagcauagacaggaguguaggagu

SEQ ID NO: 209102 - RNA, 64 nt, hsa
ugggaacucaggaaaagcaggaacccuuuccaaaagcccagagaugcccugggcucagaucugu

SEQ ID NO: 209103 - RNA, 64 nt, hsa
accaggcuuugcagaggggcggggggugaggcuuagcccagaaggagaacugagcaggaaacca

SEQ ID NO: 209104 - RNA, 64 nt, hsa
gccuuucuggaaagcaggaguucaagccuuagcaagcccagaggcccccagcagacgaugagga

SEQ ID NO: 209105 - RNA, 64 nt, hsa
augauuauuuuauuuaguaaauaaaauaauagagagcccagaaaucaaccugcacaccuaccgc

SEQ ID NO: 209106 - RNA, 64 nt, hsa
ggggagacaggagccuagcggagcccagccugggagcccagaggguggcaagaacagugggcgu

SEQ ID NO: 209107 - RNA, 64 nt, hsa
acagcaccuccccgcugggaagagaagagggcccagcccagagccaccuggaucuaucccugcg

SEQ ID NO: 209108 - RNA, 64 nt, hsa
gcccgacggcagcgccgccgccgcccagaaucccagcccagaaucccgaccgccgcgccggacg

SEQ ID NO: 209109 - RNA, 64 nt, hsa
ccagccccuuccuuuccaaaccaugcaauggaagagcccagaugggugaagauugauuuugccu

SEQ ID NO: 209110 - RNA, 64 nt, hsa
acaagguccaacccugcaaugaagcagccacuucagcccagagagauuauaagaacugaugugg

SEQ ID NO: 209111 - RNA, 64 nt, hsa
ucccagcguuugccagagguggccacuucagccaagcccagagaagugugggcagaagcaguga

SEQ ID NO: 209112 - RNA, 64 nt, hsa
ccugaaugccuucugggguauuuccauaugcaacagcccagagucauagccuugggcaaccaca

SEQ ID NO: 209113 - RNA, 64 nt, hsa
uagcagaaauauugucuguaaagcuaggcagaugagcccagaagaauggucccagagaaagcag

SEQ ID NO: 209114 - RNA, 59 nt, hsa
ugauacagaagaucagcuaagacacacccagcccagauucaacaggaaaccgaucuucc

SEQ ID NO: 209115 - RNA, 64 nt, hsa
uuaccgugcacguaaauuggucagcagaaaagggagcccagaaaaggcagcagauggaccaugc

SEQ ID NO: 209116 - RNA, 64 nt, hsa
gcaaagggccucaauuccuauaagagacccucgcagcccagaggcgcccagaggaagucagcag

SEQ ID NO: 209117 - RNA, 64 nt, hsa
cacacuacugaauggaagcaggcugucuuguaaaagcccagaucacugugggcuggagaggaga

SEQ ID NO: 209118 - RNA, 64 nt, hsa
ccuaccccacggaggaugagaagaggcagaucgcagcccagaccaaccucacccuccugcaagu

SEQ ID NO: 209119 - RNA, 64 nt, hsa
cuuggaacacagugacucccuggaguagucgggcagcccagauggcacugaucacugagcagga

SEQ ID NO: 209120 - RNA, 64 nt, hsa
uccuuuaccccuguucugcuuaacagaacugccaagcccagaaguaccuuugcacuccugguuu

SEQ ID NO: 209121 - RNA, 64 nt, hsa
cagaguagggaagacucccacugaucugagaaugagcccagaggcuuguuuggggacuguuuua

SEQ ID NO: 209122 - RNA, 64 nt, hsa
acagugccagaauuaagugagucaagccaaguaaagcccagagaagauucucaucagcacuuuu

SEQ ID NO: 209123 - RNA, 64 nt, hsa
agccucccagcggcucaugaagcaucgagcuccaagcccagaugccaagcucccuggcugagcu

SEQ ID NO: 209124 - RNA, 64 nt, hsa
ucuuccgggcccugcugucaggcagcuuugcagaagcccagauggaccuggugccccugcgagg

SEQ ID NO: 209125 - RNA, 64 nt, hsa
cagguucuggguguagggcccagagaagcagaacagcccagagccccaggugccuggccuggcc

SEQ ID NO: 209126 - RNA, 64 nt, hsa
gcaccccgacguagcugccccccuggggggccacagcccagagaaccagccuaggaacacucgg

SEQ ID NO: 209127 - RNA, 64 nt, hsa
cuaucuggccccaacacaccugagagaauucagcagcccagacugagggucugggaugggguga

SEQ ID NO: 209128 - RNA, 64 nt, hsa
gcuagugcuaagagggaaggcccagguuugagagagcccagaggggcagagcccagagccuugu

SEQ ID NO: 209129 - RNA, 64 nt, hsa
gaaggcccagguuugagagagcccagaggggcagagcccagagccuuguuuggcccugaucucu

SEQ ID NO: 209130 - RNA, 64 nt, hsa
cccaggcccacugaagcauguuccauuucuaaaaagcccagaguucagugugucccaaggaaaa

SEQ ID NO: 209131 - RNA, 64 nt, hsa
uguucugagagcagcgugggcagcaaggcagggcagcccagagguggcagcggcaggcaaucug

SEQ ID NO: 209132 - RNA, 64 nt, hsa
cccagcccccugccccggcccugcuccagaacccagcccagaucggaggacaaguuccucucua

SEQ ID NO: 209133 - RNA, 64 nt, hsa
cccaacuccagaacccaacccuucucuagaauccagcccagaucugaggccaagcuaugugcua

SEQ ID NO: 209134 - RNA, 64 nt, hsa
agggaagggacuucauuuccaggggccacagccaagcccagagucccccagcggcucgcauguc

SEQ ID NO: 209135 - RNA, 64 nt, hsa
gccaagcccagagucccccagcggcucgcaugucagcccagaccccaggguccuuggccuagga

SEQ ID NO: 209136 - RNA, 64 nt, hsa
ugacacagacaccggacaaaccauugucuuggggagcccagaagagaaagugggcagggugggg

SEQ ID NO: 209137 - RNA, 64 nt, hsa
gaguuaguuaggcauugaguuugcccugggcaaaagcccagaagugggaguaugugguauaucu

SEQ ID NO: 209138 - RNA, 64 nt, hsa
aauguuuaugcagucaaggccaaagccugcccugagcccagacacaccuggguccccauucugg

SEQ ID NO: 209139 - RNA, 64 nt, hsa
cagaaggcuucccuggugcucucaguccaggcaaagcccagagcaucugagcacgucucugacu

SEQ ID NO: 209140 - RNA, 64 nt, hsa
aguccgcguguugcuggagggacacguguauuggagcccagaagaggggcuguguggccuggga

SEQ ID NO: 209141 - RNA, 64 nt, hsa
guguaagggcuuggggucuuagaagcugcucuuuagcccagauacacauacucuuuuuugucuu

SEQ ID NO: 209142 - RNA, 64 nt, hsa
agcggcagccaccaccaguguuguuuugaauaaaagcccagaagccuauuuaagaauuucuccg

SEQ ID NO: 209143 - RNA, 64 nt, hsa
aagggaccucuguggcuccagcugccaacccuggagcccagaccgagguggccauggagacucc

SEQ ID NO: 209144 - RNA, 64 nt, hsa
aaucgucuaagcccgggagguggagguugcagugagcccagauggcgcugcugcacucaagcuu

SEQ ID NO: 209145 - RNA, 64 nt, hsa
ucagcugcccacagcccucuugccugaccccugaagcccagaacucugaucuucacagcccuag

SEQ ID NO: 209146 - RNA, 64 nt, hsa
caugaugucccaugagggagacgguggggaggcuucccaugauuuggaggauagcaacaucagu

SEQ ID NO: 209147 - RNA, 63 nt, hsa
aggaugggcacggaaaaugaagaaagcaugaugucccaugagggagacgguggggaggcuucc

SEQ ID NO: 209148 - RNA, 64 nt, hsa
gccucauggagcuguuguauagaucccagauccaucccaugauuuguuccugucugaggcauag

SEQ ID NO: 209149 - RNA, 64 nt, hsa
uaaaaagcagaggcccagucaaaugagcauugcaucccaugagggaagcacgacagggcugaug

SEQ ID NO: 209150 - RNA, 64 nt, hsa
aagaaucccucuguucacuguggugggaaagaucacacuacaugccuguugauuggcucaguca

SEQ ID NO: 209151 - RNA, 64 nt, hsa
ugcugaccagcagugaaggcugcacuaguuuucuacacuacaggaauuacuguugaugauuuuu

SEQ ID NO: 209152 - RNA, 64 nt, hsa
uaguacauaaaucccgucaugcacuuuuuuucauacacuacaaggggauguguaauaaccaugc

SEQ ID NO: 209153 - RNA, 61 nt, hsa; identical to SEQ ID NO: 179696

SEQ ID NO: 209154 - RNA, 50 nt, hsa; identical to SEQ ID NO: 179697

SEQ ID NO: 209155 - RNA, 64 nt, hsa
augcaaauggucauuucagauguaugguguuuuuacacuacaaagaagucccccauguggauau

SEQ ID NO: 209156 - RNA, 64 nt, hsa
acucccucucaaaaaaaaaaguuacauuuacacuacacuacacuguagucuaauaaaguguaaa

SEQ ID NO: 209157 - RNA, 64 nt, hsa
gcgagacucccucucaaaaaaaaaaguuacauuuacacuacacuacacuguagucuaauaaagu

SEQ ID NO: 209158 - RNA, 64 nt, hsa
aaauuuaacuccauauguguuccucuuguucuaaucuugucaaccagugcaagugaccgacaaa

SEQ ID NO: 209159 - RNA, 64 nt, hsa
gauaucaacugcuuguaaaggugcuccucuuuuuucuugucauugcuggucaagauuacuaaua

SEQ ID NO: 209160 - RNA, 64 nt, hsa
auuuaggacaacaauuaacaaugcaguggcccauucuugucacucuacacauaugacuauacgg

SEQ ID NO: 209161 - RNA, 64 nt, hsa
ucauucaucacuuggacacaucgccuuugcauugucuugucacaccucccucacagucuuauag

SEQ ID NO: 209162 - RNA, 64 nt, hsa
ggcaucucugcagcucaaagauguggguucuuuuucuugucauuaacacauuguuauuucugua

SEQ ID NO: 209163 - RNA, 64 nt, hsa
caguguuauuucuauuggauaugguuugggcuucucuugucaaaucugugucggcugcccccug

SEQ ID NO: 209164 - RNA, 64 nt, hsa
gauacucaagcagguuucuugcuucuggcuuuguucuugucaucaguaaguauaacaaacuaug

SEQ ID NO: 209165 - RNA, 64 nt, hsa
ggcaaacaugugcaacucuuguauugcuccauuuucuugucaauggaagaaacccuuccacgug

SEQ ID NO: 209166 - RNA, 64 nt, hsa
acucuguacauuuuucuuuucuccuguaauauagucuugucaccuuagagcuuguuuauggaag

SEQ ID NO: 209167 - RNA, 64 nt, hsa
gugucugaaccuuauccauguuugcuagaugaggucuugucaaauauaucacuaccauugucac

SEQ ID NO: 209168 - RNA, 64 nt, hsa
uucuuuuuuucuuuuuuuugagauggagucucacucuugucacccaggcuggagugcaguagug

SEQ ID NO: 209169 - RNA, 64 nt, hsa
gaugggcuccauuaaaaccagcucaaaaauaaauucuugucaguaaagauuucuugucaagaug

SEQ ID NO: 209170 - RNA, 64 nt, hsa
ccagcucaaaaauaaauucuugucaguaaagauuucuugucaagaugucuuggauugcacuuuu

SEQ ID NO: 209171 - RNA, 64 nt, hsa
ucccggguacacuagauggcuccaucccaaggcaucuugucauaaaacagcuuucccccacccc

SEQ ID NO: 209172 - RNA, 64 nt, hsa
gaaaauaaaguugaguuggcuguguuuucucugcucuugucagaacauugggacaauuggucgu

SEQ ID NO: 209173 - RNA, 64 nt, hsa
uguccccaucccuccccugucucuuugagcuggcucuugucacuuaggucucaucucaguggcc

SEQ ID NO: 209174 - RNA, 64 nt, hsa
ccaaagacaaaauugggagaacaaaagaaaagcgucuugucacauacagaaggucccugauaaa

SEQ ID NO: 209175 - RNA, 64 nt, hsa
auggggcuggcagcaccgagagccuggggggccccccggagacggagcuuccugagggcaggga

SEQ ID NO: 209176 - RNA, 64 nt, hsa
ugggcccugagauccuccacggucagcgccggggcccggagauggagcugggacgagugugugg

SEQ ID NO: 209177 - RNA, 64 nt, hsa
aaccugcuguuggcccgggagagccccagaggcucccggagacugcagccuccugugguugggc

SEQ ID NO: 209178 - RNA, 64 nt, hsa
ugacucugaaggacucugggaggugagacguugucccggagaucaaaacguccgcucaaaacgu

SEQ ID NO: 209179 - RNA, 64 nt, hsa
caucuuuuuauggguggagcagagagucaaucccugcagccacccugcagccagccaucucugc

SEQ ID NO: 209180 - RNA, 64 nt, hsa
ggguggagcagagagucaaucccugcagccacccugcagccagccaucucugcaguucucucag

SEQ ID NO: 209181 - RNA, 64 nt, hsa
ccugccucaucccaaagaucagguaugggcugaaugcagccaucugagcaagggcugagggaag

SEQ ID NO: 209182 - RNA, 64 nt, hsa
ccuugcauggaugcaguugugacucuggggacaaugcagccagaagcugagggaccagcacuug

SEQ ID NO: 209183 - RNA, 64 nt, hsa
cugcuuuauugccaaagggcuaguuucgguuuucugcagccauugcgguuaaaaaauauaagua

SEQ ID NO: 209184 - RNA, 64 nt, hsa
gaacugaauagauuagaaugggugacaaaugcagugcagccaguguuuccauuaugcaacuugu

SEQ ID NO: 209185 - RNA, 64 nt, hsa
cagccagacaccuuguacugggcacgcgucagacugcagccaguccguuuccuuucuuuagcca

SEQ ID NO: 209186 - RNA, 64 nt, hsa
cacagcgcgguggcugggucugcacacuggccucugcagccagauuucuauauugggaguuuuu

SEQ ID NO: 209187 - RNA, 64 nt, hsa
cuggcggaucuagugaccagauauauagaaggacugcagccacugauucucucuuguccuucac

SEQ ID NO: 209188 - RNA, 64 nt, hsa
ggcaaagccagaaaaagaucuuucauuuugcaccugcagccaagcaaaugccugccaaauuuua

SEQ ID NO: 209189 - RNA, 64 nt, hsa
cuucugcagagaaaauguccccccacccgccaucugcagccaggugugugccacacggcagccu

SEQ ID NO: 209190 - RNA, 64 nt, hsa
acucccacccacuuccaucacccauccaauaaaaugcagccagguuuagccuuuggcuuugguc

SEQ ID NO: 209191 - RNA, 64 nt, hsa
acgguuaguccauaaucuagagccauuguggaacugcagccaugagguguguuuaucccacagu

SEQ ID NO: 209192 - RNA, 64 nt, hsa
uuuuccaccuuucacauccaaggggugggucaagugcagccagcaauuuauuuucauuguuggc

SEQ ID NO: 209193 - RNA, 64 nt, hsa
uggacucgcugauccugggccgcagccuggggugugcagccaucucauucugugaaugugccaa

SEQ ID NO: 209194 - RNA, 64 nt, hsa
ccuggaggccggcuuaguucuuccauuucacccuugcagccagcuguuggccacggccccugcc

SEQ ID NO: 209195 - RNA, 64 nt, hsa
cuggccuugcuggaggcacagggcucugcggaccugcagccaucugugaggcccgcggggaugg

SEQ ID NO: 209196 - RNA, 64 nt, hsa
ugcaaaagacccaacgccaacaccuggugccuucugcagccagcgcccacccauccgugcccgg

SEQ ID NO: 209197 - RNA, 64 nt, hsa
caagagauacauacucucuucaaagagcaugagaugcagccauucuuucagcaaagcuucauug

SEQ ID NO: 209198 - RNA, 64 nt, hsa
ugcaggugaaacccagucacugugagcucccaggugcagccagaggcaccucaagaagaagagg

SEQ ID NO: 209199 - RNA, 64 nt, hsa
agucucuuauuuaucugcagaaggaacuuuggggugcagccaggacccgguaggccugagccuc

SEQ ID NO: 209200 - RNA, 64 nt, hsa
cuccuggagugaguuuccauuuccagcuggaaucugcagccacccccauuuccuguuuuccauu

SEQ ID NO: 209201 - RNA, 64 nt, hsa
cccagcucuaugucugugucugaauuguggaucgugcagccaugguuauuguggaacuguggaa

SEQ ID NO: 209202 - RNA, 64 nt, hsa
cgugcagccaugguuauuguggaacuguggaaccugcagccauaguuauuugacuauaucuuga

SEQ ID NO: 209203 - RNA, 64 nt, hsa
cccugcacauuccagaagcccucaugggaagggaugcagccaggcagacuccugccagaugggg

SEQ ID NO: 209204 - RNA, 64 nt, hsa
gccaagaacuuaccuucagaacauacucuaauaaugcagccaggagccgucagccagaucccaa

SEQ ID NO: 209205 - RNA, 64 nt, hsa
aguuccugggaaagggguauguuuucucuccaggugcagccagaucucacaaaguacaaaacga

SEQ ID NO: 209206 - RNA, 64 nt, hsa
ucacuuguuccuucaucuacauguuuuguucauuugcagccaguuuuuacugaguuuguggcaa

SEQ ID NO: 209207 - RNA, 64 nt, hsa
agccacaugccuagacuuauauacuaguuaguggugcagccagggagaggacucagauuuccug

SEQ ID NO: 209208 - RNA, 64 nt, hsa
gcaaagucuaucucugaaacuccaugaagacuuuugcagccaguucccaccaauaugccccaga

SEQ ID NO: 209209 - RNA, 64 nt, hsa
acuacuagaugugaacuugaagaagguugucagcugcagccacuuucugccagcaucugcagcc

SEQ ID NO: 209210 - RNA, 64 nt, hsa
agguugucagcugcagccacuuucugccagcaucugcagccacuuucugccagcaucugcagcc

SEQ ID NO: 209211 - RNA, 64 nt, hsa
cugccagcaucugcagccacuuucugccagcaucugcagccagcaagcugggacuggcaggaaa

SEQ ID NO: 209212 - RNA, 64 nt, hsa
ggcagugugccgggccuccguugcaccucugaccugcagccacgucaucguugcgcagccccug

SEQ ID NO: 209213 - RNA, 64 nt, hsa
ggcccuuugugcagugaacagcccuggcugggggugcagccagucguguccgaacucuccaaug

SEQ ID NO: 209214 - RNA, 64 nt, hsa
uaucaaugaaaaaaaaaaaaaaaaagaccagcuuugcagccagaagccagaggauacccaggga

SEQ ID NO: 209215 - RNA, 64 nt, hsa
acuacugccugacguugucagucaagaccagccuugcagccaggugcaguggcucacaccugug

SEQ ID NO: 209216 - RNA, 64 nt, hsa
ccuuacacugggcacauggaggagacguccacccugcagccaggacugggguucacgucacugc

SEQ ID NO: 209217 - RNA, 64 nt, hsa
uccucgcucuccuaaguuuaauuacaacagcacgugcagccacgucagccaaaugacuucauuu

SEQ ID NO: 209218 - RNA, 64 nt, hsa
aacaagcccugggauuggacaaaagggcccaugcugcagccacugacugggggcagagcucugg

SEQ ID NO: 209219 - RNA, 64 nt, hsa
cuauucaggugccauguggccuucacugcagcccugcagccacccacgcaccaucugugggucu

SEQ ID NO: 209220 - RNA, 64 nt, hsa
aaucuuuaagaauccgccagcacuugguagcgucugcagccacccagguagcauacgcucuuug

SEQ ID NO: 209221 - RNA, 64 nt, hsa; identical to SEQ ID NO: 126039

SEQ ID NO: 209222 - RNA, 64 nt, hsa; identical to SEQ ID NO: 126040

SEQ ID NO: 209223 - RNA, 64 nt, hsa; identical to SEQ ID NO: 126041

SEQ ID NO: 209224 - RNA, 64 nt, hsa; identical to SEQ ID NO: 126042

SEQ ID NO: 209225 - RNA, 64 nt, hsa
aaaguaacuuuggcaguaauugacugaaaugaaucuuucuaaacuuuacaguacuaaagaaagc

SEQ ID NO: 209226 - RNA, 64 nt, hsa
uaaauucaaguuuucuggcccugaacucauauuccuuucuaauauagcacagcugucaucucau

SEQ ID NO: 209227 - RNA, 64 nt, hsa
augccccaaguguuaaaacugaauccauucaagucuuucuaacugaauacuuguuuuauagaaa

SEQ ID NO: 209228 - RNA, 64 nt, hsa
ccuugcggccccuggaaugaucaacucauuccagcuuucuaauucuucucaugcauaugcauuc

SEQ ID NO: 209229 - RNA, 64 nt, hsa
uuucuaguugcuuccucauuccuuuacccccaaacuuucuaagggcuccccgacugcagugcaa

SEQ ID NO: 209230 - RNA, 64 nt, hsa
guauggcuacccuugugaucuacaguaauuuauucuuucuaaagguaaagcauuuucaaaacuc

SEQ ID NO: 209231 - RNA, 64 nt, hsa
caugcacuaguguuuggaggguguugugguuugucuuucuaauuagguguauagccuauucacu

SEQ ID NO: 209232 - RNA, 64 nt, hsa
agaaaggauauggcuaccuuuuguuaaaucugcacuuucuaaauaucaaaaaagggaaaugaag

SEQ ID NO: 209233 - RNA, 64 nt, hsa
uguagcaucaagaugcccaacagaggaacucuuucuuucuaaccuuguucagauugaggugaaa

SEQ ID NO: 209234 - RNA, 64 nt, hsa
uuaucagggaagugaggaaauguuugggagaggacuuucuaagcucuauuuagguguuagaucu

SEQ ID NO: 209235 - RNA, 64 nt, hsa
acguacuuaaauuuucuguguggguauaauauagcuuucuaauuuuuuucuuucacaaaggcag

SEQ ID NO: 209236 - RNA, 64 nt, hsa
augauauuaaauaugccgaagccaagcacacagucuuucuaaaguguguguauguuugugugaa

SEQ ID NO: 209237 - RNA, 64 nt, hsa
gaacugcaauaauaucaaaacaaguacugguugacuuucuaauuagagagcaucugcaacaaaa

SEQ ID NO: 209238 - RNA, 64 nt, hsa
cacuuuugacugagggcagcuuugcaaaaugagacuuucuaaaucaaaccaggugcaauuauuu

SEQ ID NO: 209239 - RNA, 64 nt, hsa
caaaccuguaacuuguauccugacuuaucucuugcuuucuaaaccuuguuucuaacugucuauc

SEQ ID NO: 209240 - RNA, 64 nt, hsa
uuuuagcaaguuuucuuaugaaaauaccuuugugcuuucuaaguauaaagauuuaaauuauuuu

SEQ ID NO: 209241 - RNA, 64 nt, hsa
uacaaugagcugaauuagauggccuuaugaaacucuuucuaaccucuuacccaaccuguuucuc

SEQ ID NO: 209242 - RNA, 64 nt, hsa
auaguauaugccauaguuuagaaagaauauuaaccuuucuaaacuaaauuuagguuugcagaaa

SEQ ID NO: 209243 - RNA, 64 nt, hsa
cuuuuauagggaaacauucugugacauuaauuuccuuucuaauuuaaaggagaguuacuuuguu

SEQ ID NO: 209244 - RNA, 64 nt, hsa
aggaguuggaaggaaacucuuacuaaaauguuaacuuucuaaaaaccuucuuuuagaucuuccu

SEQ ID NO: 209245 - RNA, 64 nt, hsa
uauuucagguauaggaauuauaaaauaauugguucuuucuaaacacuugucccauuucauucuc

SEQ ID NO: 209246 - RNA, 64 nt, hsa
gacugaacgagcauaaauaaauguagcaaaauuucuuucuaaccugccuaaacucuaggccauu

SEQ ID NO: 209247 - RNA, 64 nt, hsa
guuuugcgcauugucaugggauucuuaagugaaccuuucuaaauguggucuuguucacaugcuc

SEQ ID NO: 209248 - RNA, 64 nt, hsa
augaguucauacuuucuacguggcauuuuucucccuuucuaaaaugaaagcugaugaaucuuaa

SEQ ID NO: 209249 - RNA, 64 nt, hsa
aaaccuguggcaaaaugaacgcuuauuuuacagacuuucuaauuugaccagauuucuuaaugaa

SEQ ID NO: 209250 - RNA, 64 nt, hsa
gccuuuuuauauucugaaauuauaacaaaagauacuuucuaacaguaguauuuuuagaauggca

SEQ ID NO: 209251 - RNA, 64 nt, hsa
ugauucuauuuuguaaauggagaaacaaucauaucuuucuaagcgguaauggaggaagacuagu

SEQ ID NO: 209252 - RNA, 64 nt, hsa
aauaucccaaguaguucuucuacgcauagcucaccuuucuaaacccaguuaagcauggaagaga

SEQ ID NO: 209253 - RNA, 64 nt, hsa
uuuacugggauuccugaucaaguaagccucuucccuuucuaauaaaauauacaccuuauaccca

SEQ ID NO: 209254 - RNA, 64 nt, hsa
auugguuaacagagcucuguugucugguuuuagucuuucuaaaggauauuuuaacuaaaacuau

SEQ ID NO: 209255 - RNA, 64 nt, hsa
uuuaacuaaaacuauggagaugcuaagagagugacuuucuaaauaugaaacagauaauuuacgg

SEQ ID NO: 209256 - RNA, 64 nt, hsa
ccaaaggaugacuguaggccgugugcuggccuuucuuucuaagaagcugcuuugagcuccugga

SEQ ID NO: 209257 - RNA, 64 nt, hsa
cugugaaauucguuuucuuuuucauggugccuuucuuucuaagaaaagauagaaagaauggggc

SEQ ID NO: 209258 - RNA, 64 nt, hsa
cauuaauuugucaaguuuuuuuuuucuuugaagacuuucuaaauuaggaagcagaaaaacaaau

SEQ ID NO: 209259 - RNA, 64 nt, hsa
cgugugaggccuuuuuuauuuuucuuuucacucucuuucuaaugcuucccaccuuaccuuuuag

SEQ ID NO: 209260 - RNA, 64 nt, hsa
gacauuccccuauggauuaucuuuauaucacugucuuucuaagcccagagaugucauaagugac

SEQ ID NO: 209261 - RNA, 64 nt, hsa
aacuuagaagcagcucuaaaucuaguagagcagacuuucuaacauaccuaguuuuguguauugg

SEQ ID NO: 209262 - RNA, 64 nt, hsa
auugauagaacguuucuuugugucgugaugaaaacuuucuaaauuucaguaguggugaugguug

SEQ ID NO: 209263 - RNA, 64 nt, hsa
cauuuugcucaacaugguauuugugguuuucagccuuucuaaaaguugcauguuaugugaguca

SEQ ID NO: 209264 - RNA, 64 nt, hsa
acugauagaacguuacuuugugucgugaugaaaacuuucuaaauuucaguaguggugaugguug

SEQ ID NO: 209265 - RNA, 64 nt, hsa; identical to SEQ ID NO: 209263

SEQ ID NO: 209266 - RNA, 64 nt, hsa
aagauccccuccuuccuaacguuuuuguuugaggcuuucuaaccaucucauuccuacuuuuaua

SEQ ID NO: 209267 - RNA, 64 nt, hsa
auauauucaacugugaagaagacccuggugauaccuuucuaaaaagguggagucuuccgggauu

SEQ ID NO: 209268 - RNA, 64 nt, hsa
cucuuuuuuuaacaaaugccuucuuauagaaaaacuuucuaagaggcaacaauuuagaauggau

SEQ ID NO: 209269 - RNA, 64 nt, hsa
acccuuguucaaaaaagaaauggauaaacuuggccuuucuaagugguaagaaugaccugucacu

SEQ ID NO: 209270 - RNA, 64 nt, hsa
ugguguauccagauugcuuugcuuuuagccagugcuuucuaauuuuuuucucgacauucuuggg

SEQ ID NO: 209271 - RNA, 64 nt, hsa
aguagaaaucuugaguaaucagauggaaugcaaucuuucuaacauuaagcuaccaagauccuga

SEQ ID NO: 209272 - RNA, 64 nt, hsa
ugauauaggaaugaaccaauacgcuuuuauuacccuuucuaacucugauuuuauaaucagacuu

SEQ ID NO: 209273 - RNA, 64 nt, hsa
uuagcccaguuauucuccccuaugccuuccuucucuuucuaagcguccacuaggucuggccuug

SEQ ID NO: 209274 - RNA, 64 nt, hsa
agucucugggcuauuuuuuauuuuugcaaaugugcuuucuaauagccauugccuuccauguugu

SEQ ID NO: 209275 - RNA, 64 nt, hsa
aaaauccauucuuuaucaaucaguccuuuuauagcuuucuaaguucuuauugauggcuaauaua

SEQ ID NO: 209276 - RNA, 64 nt, hsa
agaauuacacacuaggaaauagaacauaaccaauacuuucgaguccucccugugucccgcugug

SEQ ID NO: 209277 - RNA, 64 nt, hsa
gugccuuugcucagaggcgcuucacuuucuccacacuuucgaauuccuaaagacauguggagga

SEQ ID NO: 209278 - RNA, 64 nt, hsa
uuuggauuuuacaaaaaaaaaaaaaagcccagaaacuuucgaacaaaaccaaacacccggacga

SEQ ID NO: 209279 - RNA, 64 nt, hsa
ggaacccuugcuagcaggcauucuuauaaaagaaacuuucgagccuccuuauauugcuggaaac

SEQ ID NO: 209280 - RNA, 64 nt, hsa
cuaacaaaagguacuaggauuagcugcaaucucuacuuucgaugaggaaaucccaguaagcuuu

SEQ ID NO: 209281 - RNA, 64 nt, hsa
ugucaugagacuucaguguuaauguucacaauauacuuucgaaagaauaaaauaguucuccuac

SEQ ID NO: 209282 - RNA, 64 nt, hsa
acagccauuccguacaugugugaaguccugcauaacuuucgaacuuuguuaaauguuggcacua

SEQ ID NO: 209283 - RNA, 64 nt, hsa
aaacucuuccugccacgggcuugcagauugaagcacuuucgauguugggcgcuggcguuugugu

SEQ ID NO: 209284 - RNA, 64 nt, hsa
ugcuucuaucuagcauguuaaacaaagauaauauacuuucgaugaaaguaaauuauaggaaaaa

SEQ ID NO: 209285 - RNA, 64 nt, hsa
ggaggucuuugccaccaaugggagaugagcccaaacuuucgaucuaggugggugauguguagca

SEQ ID NO: 209286 - RNA, 64 nt, hsa
cucagccuucagcuuccuaaauucugugucugugacuuucgaaguuuuuuaaaccucugaauuu

SEQ ID NO: 209287 - RNA, 64 nt, hsa
agcagcugaagaaaaaagcucaaaugaucuagucacuuucgauacuguacuucagaugcgaaau

SEQ ID NO: 209288 - RNA, 64 nt, hsa
acaagaagaauaugaggugguuccuaggagcaacacuuucgaccuccaguucucccugaugaca

SEQ ID NO: 209289 - RNA, 64 nt, hsa
guaagacacuuaaaguaaguuugugaauuugucaacuuucgagcaucaaacaaauauuuuacuu

SEQ ID NO: 209290 - RNA, 64 nt, hsa
uuuaaauuaaaucaaugaucuucaaguauuugccacuuucgaguacagcuaauuggauaaucuc

SEQ ID NO: 209291 - RNA, 53 nt, hsa
aaagcuggagagcugcuuaauauacuuucgaaaguaagaagaguuucuucaag

SEQ ID NO: 209292 - RNA, 64 nt, hsa
aagaucuuaaguguauugcucuuucaucuuaaacacuuucgaggauuugcagugcgucuagcac

SEQ ID NO: 209293 - RNA, 64 nt, hsa
accucccccaagccaaccacuuucaccugggaugacuuucgauuaugcuuuguuuuggggcugu

SEQ ID NO: 209294 - RNA, 64 nt, hsa
aacaaacaaacaaacaaaaaaguaaaaaaagauuacuuucgagagagaaguuuaagcuucacca

SEQ ID NO: 209295 - RNA, 64 nt, hsa
caccaagaucuaaguuacuuguugaaagaaaguuacuuucgacaagaucuaauaugaaagcaua

SEQ ID NO: 209296 - RNA, 64 nt, hsa
agcauuaucuucaucaugggaaaacacuuauuuuacuuucgauuuuuuuuuuccauaaaggaaa

SEQ ID NO: 209297 - RNA, 64 nt, hsa
uccacuuguuaguuuaucuuggcacugaagaggcacuuucgaguaucuaacuuuugccauuggg

SEQ ID NO: 209298 - RNA, 64 nt, hsa
uaauucauaaccauagccucgaucaucaagaaauacuuucgaaauuucauuuuccuucagaaua

SEQ ID NO: 209299 - RNA, 64 nt, hsa
agguugucaacagguacuauuugucacauaacuaacuuucgaggcacuggaacauaccugaacu

SEQ ID NO: 209300 - RNA, 64 nt, hsa
uuccagcaaaacacagugcaauguucucagagugacuuucgaaauaaauugggcccaagagcuu

SEQ ID NO: 209301 - RNA, 64 nt, hsa
uccaggcagccaugggaggcggccucccuguuccacuuucgagguucguuugauuccuggcuga

SEQ ID NO: 209302 - RNA, 64 nt, hsa
ccaacuaacucacagaaaaacuguuuacuucuucacuuucgaaguauuuggcuuuuguuaauau

SEQ ID NO: 209303 - RNA, 64 nt, hsa
guugugcgugugcgcgcacacguguguaaaaagcacuuucgauugugccuccuguuuucucgag

SEQ ID NO: 209304 - RNA, 64 nt, hsa
cggacgcagccguucugugcccauucuucaggcaacuuucgauuccuuacuguagcuaauucua

SEQ ID NO: 209305 - RNA, 64 nt, hsa
gugguggcuuugaaggagcugucuauucggggugacuuucgaacuacaguugaauaccugauca

SEQ ID NO: 209306 - RNA, 64 nt, hsa
caguggagaugaagccuaagaauaugaucagguaacuuucgaccgacuuuccccaagagaaaau

SEQ ID NO: 209307 - RNA, 64 nt, hsa
aaaacucuucucucgggacaaacaaauauucgggacuuucgaagcccugaacuugagacaccaa

SEQ ID NO: 209308 - RNA, 64 nt, hsa
aguuacaggcaaagugaggagggagcugggggacacuuucgagcucccagcuccagcuucgucu

SEQ ID NO: 209309 - RNA, 64 nt, hsa
ucuucaccaggaguaaauuccaccucaugaaaccacuuucgaggcuccuucuggacuguggcgu

SEQ ID NO: 209310 - RNA, 64 nt, hsa
ugccccugaaccuaugacauacccaagucccaauacuuucgagccaucugccacugccuuuuga

SEQ ID NO: 209311 - RNA, 64 nt, hsa
aaaaaaaaaaaaaaaaaaagagaaucguacgucgacuuucgauuuuucacagccucagccuagg

SEQ ID NO: 209312 - RNA, 64 nt, hsa
ccaugggcacagcuaacauuaucccccagugauuacuuucgauuacacugaagagaccaccuug

SEQ ID NO: 209313 - RNA, 64 nt, hsa
auacgaaaggaaaaagggcaggggguucccccaaacuuucgaaguaggcccuggcaggcagcug

SEQ ID NO: 209314 - RNA, 64 nt, hsa
auguaauuucugauaaaaguaagagaaaugaggaacuuucgaacugcaaauaugccuccaaacu

SEQ ID NO: 209315 - RNA, 64 nt, hsa
gacagcuggucugcauugcugguacugguugcaucauccucauccucagagcuggcuucacagg

SEQ ID NO: 209316 - RNA, 64 nt, hsa
uggucugcauugcugguacugguugcaucauccucauccucagagcuggcuucacaggcagugu

SEQ ID NO: 209317 - RNA, 64 nt, hsa
uucccuuguuuuuuaaagauaccgugcuucuccacauccucauccuucaaggagcauauuuugc

SEQ ID NO: 209318 - RNA, 64 nt, hsa
acaaagucacagacauccugcaccugccacuaggcauccucauccuacugacaugcccauuucu

SEQ ID NO: 209319 - RNA, 64 nt, hsa
aucagaaguuuauaaaaauaaaucugacuauaugcauccucauuuauucccuuuagaaccuagg

SEQ ID NO: 209320 - RNA, 64 nt, hsa
gccagggccucaagcucaagauacuuauugaaaacauccucaauugcaauaaaaacauuauaac

SEQ ID NO: 209321 - RNA, 64 nt, hsa
acacaggaaccuaggggaggaggggagcgcugggcauccucaggcuggcggccaaggccugccc

SEQ ID NO: 209322 - RNA, 64 nt, hsa
ggacaagcaaaaggcugcaaacaacccagaagcccauccucagaagacuggagaaaugauugag

SEQ ID NO: 209323 - RNA, 64 nt, hsa
guacgcugcacaacuggaaguucuggguguucagcauccucauccggccucuguuugaguccuu

SEQ ID NO: 209324 - RNA, 64 nt, hsa
ggacucugagcguccgugucucucccccgcaacccauccucagccggggccguccagacagcaa

SEQ ID NO: 209325 - RNA, 64 nt, hsa
uggagugagagccaaagaaacaaagauccacacacauccucaccccacagaaacugcuggacac

SEQ ID NO: 209326 - RNA, 64 nt, hsa
aacuaaagcagcaaaugcaggaaggcugucucgccauccucaagacucagcagcucucauucuc

SEQ ID NO: 209327 - RNA, 64 nt, hsa
uaauuuuagcacacaucugcugacucuccuucaacauccucacccccaccccugggcaccauuu

SEQ ID NO: 209328 - RNA, 64 nt, hsa
uugcauaucuguauagaaaaucaagucaaucccccauccucacacccacucaucucugaggagc

SEQ ID NO: 209329 - RNA, 64 nt, hsa
caggcccagccuggccccaaauguucuuuccuuucauccucagcaagugcugagucugugaaua

SEQ ID NO: 209330 - RNA, 64 nt, hsa
ccgggaaaggccggugggaagagggcaggggcugcauccucagccccagggcccugcucaggcc

SEQ ID NO: 209331 - RNA, 64 nt, hsa
gacaccagugaugaaauggaccccuccacacaggcauccucagggcacagggcccugggggcac

SEQ ID NO: 209332 - RNA, 64 nt, hsa
uccuaggcugccugagauuucugugugcugaucgcauccucaguuucuuguccaccgcuucacu

SEQ ID NO: 209333 - RNA, 64 nt, hsa
ugggaguguggacuuaggaaaacaauauaaaggacauccucaucaucacggggugaaggucaga

SEQ ID NO: 209334 - RNA, 64 nt, hsa
uaauucuccauaaaaugggcuuuccucugucugccauccucagagucuggggugggagugugga

SEQ ID NO: 209335 - RNA, 64 nt, hsa
cuucuugcugcugaucacguuccaagagaaccaccauccucacacaacaaauuucugcucaacu

SEQ ID NO: 209336 - RNA, 64 nt, hsa
uccuuaccuauauguuucugaauaaauucugaaccauccucaucucauauaguguuuuguuuua

SEQ ID NO: 209337 - RNA, 64 nt, hsa
cuucuugcugcuaaucaacucccaagagaacuaccauccucacacaacaaccuucagcucaacu

SEQ ID NO: 209338 - RNA, 64 nt, hsa
cuugggaaucugcuugagggagggcagaauacuucauccucauucccucuuuccuuacaccuug

SEQ ID NO: 209339 - RNA, 64 nt, hsa
acugggugaggaguggucguauauuaccauaauucauccucacucaauugggagguggcauucu

SEQ ID NO: 209340 - RNA, 64 nt, hsa
uccauccauccucacucagcugcugccuacugggcauccucagcaagaugcuggagacuuuuua

SEQ ID NO: 209341 - RNA, 64 nt, hsa
gcacuugggcuccccuccugcccugcauuccauccauccucacucagcugcugccuacugggca

SEQ ID NO: 209342 - RNA, 64 nt, hsa
ccuccuggcccauccucauccucaucuucauccucauccucaucugugcaaccgcccguccucc

SEQ ID NO: 209343 - RNA, 64 nt, hsa
guguccccuccuggcccauccucauccucaucuucauccucauccucaucugugcaaccgcccg

SEQ ID NO: 209344 - RNA, 64 nt, hsa
guggcuccugcuguguccccuccuggcccauccucauccucaucuucauccucauccucaucug

SEQ ID NO: 209345 - RNA, 64 nt, hsa
gcugcuguggcuccugcuguguccccuccuggcccauccucauccucaucuucauccucauccu

SEQ ID NO: 209346 - RNA, 64 nt, hsa
gguccuccgggggaggaggguguagcuggcaugucauccucagggcgcuuccucgcucacgcca

SEQ ID NO: 209347 - RNA, 64 nt, hsa
cagugaguggcaggggcaggagaggggagaaccccauccucagagcugcucccagccagcgagu

SEQ ID NO: 209348 - RNA, 64 nt, hsa
ccacaucccaccacauccaccuccauccccaacccauccucauccccaacuacagccccaaacc

SEQ ID NO: 209349 - RNA, 64 nt, hsa
ccagccccagacuaauccacagccauccccaacucauccucauccccaacugcagccccaaacc

SEQ ID NO: 209350 - RNA, 64 nt, hsa
uccccucaacuccaauccauaacccccuucaaaccauccucaacuaagcuccucuccagcccug

SEQ ID NO: 209351 - RNA, 64 nt, hsa
auuuuuuuuucucuucaaguugcuuugucuuuuccauccucaucacaagcccuuguuugagugu

SEQ ID NO: 209352 - RNA, 64 nt, hsa
agguggcccuagagacacuagagucaccagccaccauccucagagcuuugaacuccccauucca

SEQ ID NO: 209353 - RNA, 64 nt, hsa
gaaacuauggcuuuaaacuacccuccagagugugcagacugaugggacaucaaauuugccacca

SEQ ID NO: 209354 - RNA, 64 nt, hsa
agaaugucaccaguccugcccaaugccuugacaacagacugaauuuuaaauguucacaacauaa

SEQ ID NO: 209355 - RNA, 64 nt, hsa
agaacagauuacuuaaagcuauuucauuucaaagcagacugaaugugacuucaucuaaaggcag

SEQ ID NO: 209356 - RNA, 64 nt, hsa
cacggcuuaaccccagucuugaugguauauugaacagacugaauauauuuuaccauuacagggc

SEQ ID NO: 209357 - RNA, 64 nt, hsa
ucuggguccuugcagcugugaugguuucagagcucagacugaucaggcaucaagcuacccucaa

SEQ ID NO: 209358 - RNA, 64 nt, hsa
auagauuccucuagaaaggcaucaaaaggcucaacagacugaauggccucuuggucugcgaaaa

SEQ ID NO: 209359 - RNA, 64 nt, hsa
aggaggccugacugguucauuacccuccccuacucagacugagcagcagucccagauaaccaag

SEQ ID NO: 209360 - RNA, 64 nt, hsa
cuaagaacacagcuggcuggaagaagacagggaccagacugaacugccacccucugcuaguccu

SEQ ID NO: 209361 - RNA, 64 nt, hsa
uuaggauaaaccuccaagcucacauuuaauauaacagacugaaguaaacauuagaauccuguuu

SEQ ID NO: 209362 - RNA, 64 nt, hsa
cauacgaaauguauuugguuuuguuggagagugucagacugaucuggaagugaaacacaguuua

SEQ ID NO: 209363 - RNA, 64 nt, hsa
ugucccuaugucuuggccacuccuagagcgugugcagacugaugauuuuauauguaaaucaaga

SEQ ID NO: 209364 - RNA, 64 nt, hsa
gcugggaacagaguggagucuccgguguguaccucagacugauggugcccauguguucgccucc

SEQ ID NO: 209365 - RNA, 64 nt, hsa
agaacuuauugggcaugugguauacugaagcaauacccguuagacaaggauauuuuacuucuuc

SEQ ID NO: 209366 - RNA, 64 nt, hsa
guccuucgauaauaugaaacauuaauuuacaaggacccguuagggcuucaaugaugcugagucu

SEQ ID NO: 209367 - RNA, 64 nt, hsa
cacguaacguagcauaugauguauaauagaguauacccguuacuuaaaaagaagucugaaaugu

SEQ ID NO: 209368 - RNA, 64 nt, hsa
cuggggcucuuggcccucccaccuggagccuguuacccguuagagagcugagacccuuauuuaa

SEQ ID NO: 209369 - RNA, 64 nt, hsa
gcacacuaccaguguugugggcacauuuaguuccacccguuagacccuugaugcuauucacaug

SEQ ID NO: 209370 - RNA, 64 nt, hsa
gcagaacugcgcacgcucccuuucugaaagaaacacccguuaccggguccagacugaauguggg

SEQ ID NO: 209371 - RNA, 64 nt, hsa
auaagaggagccgucuggugugucagggucacgaacccguuacauuucaggacgauccuuuuuc

SEQ ID NO: 209372 - RNA, 64 nt, hsa
cuugggcccaaugaauuaggggugaggccccagaacccguuaucuaugaguuguaugggggagc

SEQ ID NO: 209373 - RNA, 64 nt, hsa
caaucuuggagaggugcaaaaagcacugggggcuacccguuagcugcaucugcccuggcuguuu

SEQ ID NO: 209374 - RNA, 64 nt, hsa
ucuuccagcugugggaccgcugucccuuauuucaacccguuagcaacaauggauagagaacaca

SEQ ID NO: 209375 - RNA, 64 nt, hsa
cuuuuuccguaauaacacccuuccuucuguaaauacccguuaccauauuuauccauuuguaauu

SEQ ID NO: 209376 - RNA, 64 nt, hsa
gucacuagaccucagcuagccugacaccgcaauaacccguuaggcuuugaggcuuuucagugaa

SEQ ID NO: 209377 - RNA, 64 nt, hsa
aaauguuccauacugacaugccggaggcagccugacccguuauuuggaaagaauuugugaauua

SEQ ID NO: 209378 - RNA, 64 nt, hsa
gcuggggggaaggcgauguggugaccccacccccacccguuaauuuaaagcuguuucuaaacag

SEQ ID NO: 209379 - RNA, 64 nt, hsa
ucccuggauauggauuucaguuaaguauuuuguaacccguuacacuguguguccuuguguaaau

SEQ ID NO: 209380 - RNA, 64 nt, hsa
uaucguccuguugugcucagccccaacaucccagacccguuacccacuacccuucucuccccca

SEQ ID NO: 209381 - RNA, 64 nt, hsa
ggugggggcugccuguaaaugacacugugaauaaacccguuaccuuaccuggccuuccaugugg

SEQ ID NO: 209382 - RNA, 64 nt, hsa
uuaucuguucuguucaaaacuauuuguucaaagaacccguuaguguuguuuacaggguuacagu

SEQ ID NO: 209383 - RNA, 64 nt, hsa
acuucagguaagugaggugaaaugguagccagugacccguuaggagcucucaccguacauacuc

SEQ ID NO: 209384 - RNA, 64 nt, hsa
cccgagguggcuccugcuuaccuuaucaucccagggcucugauuagccaggccuggucaggguc

SEQ ID NO: 209385 - RNA, 64 nt, hsa
accaucugagggagaggaacguggaacaggagcaggcucugaugcugagaggcuugccuccggg

SEQ ID NO: 209386 - RNA, 64 nt, hsa
uccuguccugaccuucugugauguggaaacccuaggcucugagacacacucucuggugucugag

SEQ ID NO: 209387 - RNA, 64 nt, hsa
uuugucuuaagcuauaguguaaaaacaaaguuugggcucugaaaauuuaacugaaaaagauuuc

SEQ ID NO: 209388 - RNA, 64 nt, hsa
ggagaacaugugauggugugugaauaucccugcuggcucugaugcugguggguacgaaaggugu

SEQ ID NO: 209389 - RNA, 64 nt, hsa
aggcccauucccagcuccuugucuggggagccuuggcucugagccucuagcaugguucaguccu

SEQ ID NO: 209390 - RNA, 64 nt, hsa
gcagaagaaaugccuccccaggucugucucuggaggcucugagggagaugggcuugggggcugu

SEQ ID NO: 209391 - RNA, 64 nt, hsa
uggccugcaccucaccaagccuagccacucucgcggcucugaguggcucacaggcuugugaggg

SEQ ID NO: 209392 - RNA, 64 nt, hsa
gguaccucacacucggagcucgccugcccugcuuggcucugaggaccugcccagcgcucaaagg

SEQ ID NO: 209393 - RNA, 64 nt, hsa
ugccuuugcccucggccuacuugcccuagcaugaggcucugagagccaccugcccaccaaucug

SEQ ID NO: 209394 - RNA, 64 nt, hsa
agcagcccuuggugcaaagccagagacugauccuggcucugacggcugaagagggaagacccaa

SEQ ID NO: 209395 - RNA, 64 nt, hsa
ggaagcugcggcagggagcgggcgccggcuucguggcucugagguguaacgggggugggcuccc

SEQ ID NO: 209396 - RNA, 61 nt, hsa
uccgcaccaucagcgucugaggcgucccacuggcucugaucuugcuuccugcuuggaaacu

SEQ ID NO: 209397 - RNA, 64 nt, hsa
gauucuguuugacguauuguucucuagaaggccuggcucugauccagugaccccucucaccaaa

SEQ ID NO: 209398 - RNA, 64 nt, hsa
ugccggaggagaccccacuaacccagccugccugggcucugaccacuaacacucuuggccaugg

SEQ ID NO: 209399 - RNA, 64 nt, hsa
ugagucccccugcugccccugccacaucccagugggcucugacccccugaucucaacucguggc

SEQ ID NO: 209400 - RNA, 64 nt, hsa
ugcccuaccugccuguucuccagauggagaaacaggcucugagauuucacaggucuugcccaaa

SEQ ID NO: 209401 - RNA, 64 nt, hsa
cccggugcagaacaggggcacccuccaaacacugggcucugaggaguggaguucucuguucuag

SEQ ID NO: 209402 - RNA, 64 nt, hsa
gaagcugucugggcagcugcucgagggaggcccuggcucugaucccaggcuggauggaguggcu

SEQ ID NO: 209403 - RNA, 64 nt, hsa
ucucaaucuccagagccauguccauggggaggugggcucugaagggcgaaggugggagagcagg

SEQ ID NO: 209404 - RNA, 64 nt, hsa
ggagcuguggccuggcuguggagggccgggugguggcucugaggaugguccccagccccacccu

SEQ ID NO: 209405 - RNA, 64 nt, hsa
ccagcugaggaaggaggcagagcuggggccugaaggcucugagcagccuccagccagggggcuc

SEQ ID NO: 209406 - RNA, 64 nt, hsa
aaagaaagacaagugacaggggcaauggaucucaggcucugagauaaguauaucagaugacacu

SEQ ID NO: 209407 - RNA, 64 nt, hsa
gaagaaaagaaggaagcaguugccuuccggagggggcucugagagaaucuagccuccccucugu

SEQ ID NO: 209408 - RNA, 64 nt, hsa; identical to SEQ ID NO: 74140

SEQ ID NO: 209409 - RNA, 64 nt, hsa; identical to SEQ ID NO: 74141

SEQ ID NO: 209410 - RNA, 64 nt, hsa; identical to SEQ ID NO: 74142

SEQ ID NO: 209411 - RNA, 64 nt, hsa; identical to SEQ ID NO: 74143

SEQ ID NO: 209412 - RNA, 64 nt, hsa; identical to SEQ ID NO: 74144

SEQ ID NO: 209413 - RNA, 64 nt, hsa; identical to SEQ ID NO: 74145

SEQ ID NO: 209414 - RNA, 64 nt, hsa; identical to SEQ ID NO: 74146

SEQ ID NO: 209415 - RNA, 64 nt, hsa; identical to SEQ ID NO: 74147

SEQ ID NO: 209416 - RNA, 64 nt, hsa; identical to SEQ ID NO: 74148

SEQ ID NO: 209417 - RNA, 64 nt, hsa; identical to SEQ ID NO: 74149

SEQ ID NO: 209418 - RNA, 64 nt, hsa; identical to SEQ ID NO: 74150

SEQ ID NO: 209419 - RNA, 64 nt, hsa; identical to SEQ ID NO: 74151

SEQ ID NO: 209420 - RNA, 64 nt, hsa; identical to SEQ ID NO: 74152

SEQ ID NO: 209421 - RNA, 64 nt, hsa; identical to SEQ ID NO: 74153

SEQ ID NO: 209422 - RNA, 64 nt, hsa; identical to SEQ ID NO: 74154

SEQ ID NO: 209423 - RNA, 64 nt, hsa; identical to SEQ ID NO: 74155

SEQ ID NO: 209424 - RNA, 64 nt, hsa; identical to SEQ ID NO: 74156

SEQ ID NO: 209425 - RNA, 64 nt, hsa; identical to SEQ ID NO: 74157

SEQ ID NO: 209426 - RNA, 64 nt, hsa; identical to SEQ ID NO: 74158

SEQ ID NO: 209427 - RNA, 64 nt, hsa; identical to SEQ ID NO: 74159

SEQ ID NO: 209428 - RNA, 64 nt, hsa; identical to SEQ ID NO: 74160

SEQ ID NO: 209429 - RNA, 64 nt, hsa; identical to SEQ ID NO: 74161

SEQ ID NO: 209430 - RNA, 64 nt, hsa; identical to SEQ ID NO: 74162

SEQ ID NO: 209431 - RNA, 64 nt, hsa; identical to SEQ ID NO: 74163

SEQ ID NO: 209432 - RNA, 64 nt, hsa; identical to SEQ ID NO: 74164

SEQ ID NO: 209433 - RNA, 64 nt, hsa; identical to SEQ ID NO: 74165

SEQ ID NO: 209434 - RNA, 64 nt, hsa; identical to SEQ ID NO: 74166

SEQ ID NO: 209435 - RNA, 64 nt, hsa; identical to SEQ ID NO: 74167

SEQ ID NO: 209436 - RNA, 64 nt, hsa; identical to SEQ ID NO: 74168

SEQ ID NO: 209437 - RNA, 64 nt, hsa; identical to SEQ ID NO: 74169

SEQ ID NO: 209438 - RNA, 64 nt, hsa; identical to SEQ ID NO: 74170

SEQ ID NO: 209439 - RNA, 64 nt, hsa; identical to SEQ ID NO: 74171

SEQ ID NO: 209440 - RNA, 64 nt, hsa; identical to SEQ ID NO: 74172

SEQ ID NO: 209441 - RNA, 64 nt, hsa; identical to SEQ ID NO: 74173

SEQ ID NO: 209442 - RNA, 64 nt, hsa; identical to SEQ ID NO: 74174

SEQ ID NO: 209443 - RNA, 64 nt, hsa; identical to SEQ ID NO: 74175

SEQ ID NO: 209444 - RNA, 64 nt, hsa; identical to SEQ ID NO: 74176

SEQ ID NO: 209445 - RNA, 64 nt, hsa; identical to SEQ ID NO: 74177

SEQ ID NO: 209446 - RNA, 64 nt, hsa; identical to SEQ ID NO: 74178

SEQ ID NO: 209447 - RNA, 64 nt, hsa; identical to SEQ ID NO: 74179

SEQ ID NO: 209448 - RNA, 64 nt, hsa; identical to SEQ ID NO: 74180

SEQ ID NO: 209449 - RNA, 64 nt, hsa; identical to SEQ ID NO: 74181

SEQ ID NO: 209450 - RNA, 64 nt, hsa; identical to SEQ ID NO: 74182

SEQ ID NO: 209451 - RNA, 64 nt, hsa; identical to SEQ ID NO: 74183

SEQ ID NO: 209452 - RNA, 64 nt, hsa; identical to SEQ ID NO: 74184

SEQ ID NO: 209453 - RNA, 64 nt, hsa; identical to SEQ ID NO: 74185

SEQ ID NO: 209454 - RNA, 64 nt, hsa; identical to SEQ ID NO: 74186

SEQ ID NO: 209455 - RNA, 64 nt, hsa; identical to SEQ ID NO: 74187

SEQ ID NO: 209456 - RNA, 64 nt, hsa; identical to SEQ ID NO: 74188

SEQ ID NO: 209457 - RNA, 64 nt, hsa; identical to SEQ ID NO: 74189

SEQ ID NO: 209458 - RNA, 64 nt, hsa; identical to SEQ ID NO: 74190

SEQ ID NO: 209459 - RNA, 64 nt, hsa; identical to SEQ ID NO: 74191

SEQ ID NO: 209460 - RNA, 64 nt, hsa; identical to SEQ ID NO: 74192

SEQ ID NO: 209461 - RNA, 64 nt, hsa; identical to SEQ ID NO: 74193

SEQ ID NO: 209462 - RNA, 64 nt, hsa; identical to SEQ ID NO: 74194

SEQ ID NO: 209463 - RNA, 64 nt, hsa; identical to SEQ ID NO: 74195

SEQ ID NO: 209464 - RNA, 64 nt, hsa; identical to SEQ ID NO: 74196

SEQ ID NO: 209465 - RNA, 64 nt, hsa; identical to SEQ ID NO: 74197

SEQ ID NO: 209466 - RNA, 64 nt, hsa; identical to SEQ ID NO: 74198

SEQ ID NO: 209467 - RNA, 64 nt, hsa; identical to SEQ ID NO: 74199

SEQ ID NO: 209468 - RNA, 64 nt, hsa; identical to SEQ ID NO: 74200

SEQ ID NO: 209469 - RNA, 64 nt, hsa; identical to SEQ ID NO: 74201

SEQ ID NO: 209470 - RNA, 64 nt, hsa; identical to SEQ ID NO: 74202

SEQ ID NO: 209471 - RNA, 64 nt, hsa; identical to SEQ ID NO: 74203

SEQ ID NO: 209472 - RNA, 64 nt, hsa; identical to SEQ ID NO: 74204

SEQ ID NO: 209473 - RNA, 64 nt, hsa; identical to SEQ ID NO: 74205

SEQ ID NO: 209474 - RNA, 64 nt, hsa; identical to SEQ ID NO: 74206

SEQ ID NO: 209475 - RNA, 64 nt, hsa; identical to SEQ ID NO: 74207

SEQ ID NO: 209476 - RNA, 64 nt, hsa; identical to SEQ ID NO: 74208

SEQ ID NO: 209477 - RNA, 64 nt, hsa; identical to SEQ ID NO: 74209

SEQ ID NO: 209478 - RNA, 64 nt, hsa; identical to SEQ ID NO: 74210

SEQ ID NO: 209479 - RNA, 64 nt, hsa; identical to SEQ ID NO: 74211

SEQ ID NO: 209480 - RNA, 64 nt, hsa; identical to SEQ ID NO: 74212

SEQ ID NO: 209481 - RNA, 64 nt, hsa; identical to SEQ ID NO: 74213

SEQ ID NO: 209482 - RNA, 64 nt, hsa; identical to SEQ ID NO: 74214

SEQ ID NO: 209483 - RNA, 64 nt, hsa; identical to SEQ ID NO: 74215

SEQ ID NO: 209484 - RNA, 64 nt, hsa; identical to SEQ ID NO: 74216

SEQ ID NO: 209485 - RNA, 58 nt, hsa; identical to SEQ ID NO: 74217

SEQ ID NO: 209486 - RNA, 64 nt, hsa; identical to SEQ ID NO: 74218

SEQ ID NO: 209487 - RNA, 64 nt, hsa; identical to SEQ ID NO: 74219

SEQ ID NO: 209488 - RNA, 64 nt, hsa; identical to SEQ ID NO: 74220

SEQ ID NO: 209489 - RNA, 64 nt, hsa; identical to SEQ ID NO: 74221

SEQ ID NO: 209490 - RNA, 56 nt, hsa; identical to SEQ ID NO: 74222

SEQ ID NO: 209491 - RNA, 64 nt, hsa; identical to SEQ ID NO: 74223

SEQ ID NO: 209492 - RNA, 64 nt, hsa; identical to SEQ ID NO: 74224

SEQ ID NO: 209493 - RNA, 64 nt, hsa; identical to SEQ ID NO: 74225

SEQ ID NO: 209494 - RNA, 64 nt, hsa; identical to SEQ ID NO: 74226

SEQ ID NO: 209495 - RNA, 64 nt, hsa; identical to SEQ ID NO: 74227

SEQ ID NO: 209496 - RNA, 64 nt, hsa; identical to SEQ ID NO: 74228

SEQ ID NO: 209497 - RNA, 53 nt, hsa; identical to SEQ ID NO: 74229

SEQ ID NO: 209498 - RNA, 64 nt, hsa; identical to SEQ ID NO: 74230

SEQ ID NO: 209499 - RNA, 64 nt, hsa; identical to SEQ ID NO: 74231

SEQ ID NO: 209500 - RNA, 64 nt, hsa; identical to SEQ ID NO: 74232

SEQ ID NO: 209501 - RNA, 64 nt, hsa; identical to SEQ ID NO: 74233

SEQ ID NO: 209502 - RNA, 64 nt, hsa; identical to SEQ ID NO: 74234

SEQ ID NO: 209503 - RNA, 64 nt, hsa; identical to SEQ ID NO: 74235

SEQ ID NO: 209504 - RNA, 64 nt, hsa; identical to SEQ ID NO: 74236

SEQ ID NO: 209505 - RNA, 64 nt, hsa; identical to SEQ ID NO: 74237

SEQ ID NO: 209506 - RNA, 64 nt, hsa; identical to SEQ ID NO: 74238

SEQ ID NO: 209507 - RNA, 64 nt, hsa; identical to SEQ ID NO: 74239

SEQ ID NO: 209508 - RNA, 64 nt, hsa; identical to SEQ ID NO: 74240

SEQ ID NO: 209509 - RNA, 64 nt, hsa; identical to SEQ ID NO: 74241

SEQ ID NO: 209510 - RNA, 64 nt, hsa; identical to SEQ ID NO: 74242

SEQ ID NO: 209511 - RNA, 64 nt, hsa; identical to SEQ ID NO: 74243

SEQ ID NO: 209512 - RNA, 64 nt, hsa; identical to SEQ ID NO: 74244

SEQ ID NO: 209513 - RNA, 64 nt, hsa; identical to SEQ ID NO: 74245

SEQ ID NO: 209514 - RNA, 64 nt, hsa; identical to SEQ ID NO: 74246

SEQ ID NO: 209515 - RNA, 64 nt, hsa; identical to SEQ ID NO: 74247

SEQ ID NO: 209516 - RNA, 64 nt, hsa; identical to SEQ ID NO: 74248

SEQ ID NO: 209517 - RNA, 64 nt, hsa; identical to SEQ ID NO: 74249

SEQ ID NO: 209518 - RNA, 64 nt, hsa; identical to SEQ ID NO: 74250

SEQ ID NO: 209519 - RNA, 64 nt, hsa; identical to SEQ ID NO: 74251

SEQ ID NO: 209520 - RNA, 64 nt, hsa; identical to SEQ ID NO: 74252

SEQ ID NO: 209521 - RNA, 64 nt, hsa; identical to SEQ ID NO: 74253

SEQ ID NO: 209522 - RNA, 64 nt, hsa; identical to SEQ ID NO: 74254

SEQ ID NO: 209523 - RNA, 64 nt, hsa; identical to SEQ ID NO: 74255

SEQ ID NO: 209524 - RNA, 64 nt, hsa; identical to SEQ ID NO: 74256

SEQ ID NO: 209525 - RNA, 64 nt, hsa; identical to SEQ ID NO: 74257

SEQ ID NO: 209526 - RNA, 64 nt, hsa; identical to SEQ ID NO: 74258

SEQ ID NO: 209527 - RNA, 64 nt, hsa; identical to SEQ ID NO: 74259

SEQ ID NO: 209528 - RNA, 64 nt, hsa; identical to SEQ ID NO: 74260

SEQ ID NO: 209529 - RNA, 64 nt, hsa; identical to SEQ ID NO: 74261

SEQ ID NO: 209530 - RNA, 64 nt, hsa; identical to SEQ ID NO: 74262

SEQ ID NO: 209531 - RNA, 64 nt, hsa; identical to SEQ ID NO: 74263

SEQ ID NO: 209532 - RNA, 64 nt, hsa; identical to SEQ ID NO: 74264

SEQ ID NO: 209533 - RNA, 64 nt, hsa; identical to SEQ ID NO: 209384

SEQ ID NO: 209534 - RNA, 64 nt, hsa; identical to SEQ ID NO: 209385

SEQ ID NO: 209535 - RNA, 64 nt, hsa; identical to SEQ ID NO: 209386

SEQ ID NO: 209536 - RNA, 64 nt, hsa; identical to SEQ ID NO: 209387

SEQ ID NO: 209537 - RNA, 64 nt, hsa; identical to SEQ ID NO: 209388

SEQ ID NO: 209538 - RNA, 64 nt, hsa; identical to SEQ ID NO: 209389

SEQ ID NO: 209539 - RNA, 64 nt, hsa; identical to SEQ ID NO: 209390

SEQ ID NO: 209540 - RNA, 64 nt, hsa; identical to SEQ ID NO: 209391

SEQ ID NO: 209541 - RNA, 64 nt, hsa; identical to SEQ ID NO: 209392

SEQ ID NO: 209542 - RNA, 64 nt, hsa; identical to SEQ ID NO: 209393

SEQ ID NO: 209543 - RNA, 64 nt, hsa; identical to SEQ ID NO: 209394

SEQ ID NO: 209544 - RNA, 64 nt, hsa; identical to SEQ ID NO: 209395

SEQ ID NO: 209545 - RNA, 61 nt, hsa; identical to SEQ ID NO: 209396

SEQ ID NO: 209546 - RNA, 64 nt, hsa; identical to SEQ ID NO: 209397

SEQ ID NO: 209547 - RNA, 64 nt, hsa; identical to SEQ ID NO: 209398

SEQ ID NO: 209548 - RNA, 64 nt, hsa; identical to SEQ ID NO: 209399

SEQ ID NO: 209549 - RNA, 64 nt, hsa; identical to SEQ ID NO: 209400

SEQ ID NO: 209550 - RNA, 64 nt, hsa; identical to SEQ ID NO: 209401

SEQ ID NO: 209551 - RNA, 64 nt, hsa; identical to SEQ ID NO: 209402

SEQ ID NO: 209552 - RNA, 64 nt, hsa; identical to SEQ ID NO: 209403

SEQ ID NO: 209553 - RNA, 64 nt, hsa; identical to SEQ ID NO: 209404

SEQ ID NO: 209554 - RNA, 64 nt, hsa; identical to SEQ ID NO: 209405

SEQ ID NO: 209555 - RNA, 64 nt, hsa; identical to SEQ ID NO: 209406

SEQ ID NO: 209556 - RNA, 64 nt, hsa; identical to SEQ ID NO: 209407

SEQ ID NO: 209557 - RNA, 64 nt, hsa; identical to SEQ ID NO: 74140

SEQ ID NO: 209558 - RNA, 64 nt, hsa; identical to SEQ ID NO: 74141

SEQ ID NO: 209559 - RNA, 64 nt, hsa; identical to SEQ ID NO: 74142

SEQ ID NO: 209560 - RNA, 64 nt, hsa; identical to SEQ ID NO: 74143

SEQ ID NO: 209561 - RNA, 64 nt, hsa; identical to SEQ ID NO: 74144

SEQ ID NO: 209562 - RNA, 64 nt, hsa; identical to SEQ ID NO: 74145

SEQ ID NO: 209563 - RNA, 64 nt, hsa; identical to SEQ ID NO: 74146

SEQ ID NO: 209564 - RNA, 64 nt, hsa; identical to SEQ ID NO: 74147

SEQ ID NO: 209565 - RNA, 64 nt, hsa; identical to SEQ ID NO: 74148

SEQ ID NO: 209566 - RNA, 64 nt, hsa; identical to SEQ ID NO: 74149

SEQ ID NO: 209567 - RNA, 64 nt, hsa; identical to SEQ ID NO: 74150

SEQ ID NO: 209568 - RNA, 64 nt, hsa; identical to SEQ ID NO: 74151

SEQ ID NO: 209569 - RNA, 64 nt, hsa; identical to SEQ ID NO: 74152

SEQ ID NO: 209570 - RNA, 64 nt, hsa; identical to SEQ ID NO: 74153

SEQ ID NO: 209571 - RNA, 64 nt, hsa; identical to SEQ ID NO: 74154

SEQ ID NO: 209572 - RNA, 64 nt, hsa; identical to SEQ ID NO: 74155

SEQ ID NO: 209573 - RNA, 64 nt, hsa; identical to SEQ ID NO: 74156

SEQ ID NO: 209574 - RNA, 64 nt, hsa; identical to SEQ ID NO: 74157

SEQ ID NO: 209575 - RNA, 64 nt, hsa; identical to SEQ ID NO: 74158

SEQ ID NO: 209576 - RNA, 64 nt, hsa; identical to SEQ ID NO: 74159

SEQ ID NO: 209577 - RNA, 64 nt, hsa; identical to SEQ ID NO: 74160

SEQ ID NO: 209578 - RNA, 64 nt, hsa; identical to SEQ ID NO: 74161

SEQ ID NO: 209579 - RNA, 64 nt, hsa; identical to SEQ ID NO: 74162

SEQ ID NO: 209580 - RNA, 64 nt, hsa; identical to SEQ ID NO: 74163

SEQ ID NO: 209581 - RNA, 64 nt, hsa; identical to SEQ ID NO: 74164

SEQ ID NO: 209582 - RNA, 64 nt, hsa; identical to SEQ ID NO: 74165

SEQ ID NO: 209583 - RNA, 64 nt, hsa; identical to SEQ ID NO: 74166

SEQ ID NO: 209584 - RNA, 64 nt, hsa; identical to SEQ ID NO: 74167

SEQ ID NO: 209585 - RNA, 64 nt, hsa; identical to SEQ ID NO: 74168

SEQ ID NO: 209586 - RNA, 64 nt, hsa; identical to SEQ ID NO: 74169

SEQ ID NO: 209587 - RNA, 64 nt, hsa; identical to SEQ ID NO: 74170

SEQ ID NO: 209588 - RNA, 64 nt, hsa; identical to SEQ ID NO: 74171

SEQ ID NO: 209589 - RNA, 64 nt, hsa; identical to SEQ ID NO: 74172

SEQ ID NO: 209590 - RNA, 64 nt, hsa; identical to SEQ ID NO: 74173

SEQ ID NO: 209591 - RNA, 64 nt, hsa; identical to SEQ ID NO: 74174

SEQ ID NO: 209592 - RNA, 64 nt, hsa; identical to SEQ ID NO: 74175

SEQ ID NO: 209593 - RNA, 64 nt, hsa; identical to SEQ ID NO: 74176

SEQ ID NO: 209594 - RNA, 64 nt, hsa; identical to SEQ ID NO: 74177

SEQ ID NO: 209595 - RNA, 64 nt, hsa; identical to SEQ ID NO: 74178

SEQ ID NO: 209596 - RNA, 64 nt, hsa; identical to SEQ ID NO: 74179

SEQ ID NO: 209597 - RNA, 64 nt, hsa; identical to SEQ ID NO: 74180

SEQ ID NO: 209598 - RNA, 64 nt, hsa; identical to SEQ ID NO: 74181

SEQ ID NO: 209599 - RNA, 64 nt, hsa; identical to SEQ ID NO: 74182

SEQ ID NO: 209600 - RNA, 64 nt, hsa; identical to SEQ ID NO: 74183

SEQ ID NO: 209601 - RNA, 64 nt, hsa; identical to SEQ ID NO: 74184

SEQ ID NO: 209602 - RNA, 64 nt, hsa; identical to SEQ ID NO: 74185

SEQ ID NO: 209603 - RNA, 64 nt, hsa; identical to SEQ ID NO: 74186

SEQ ID NO: 209604 - RNA, 64 nt, hsa; identical to SEQ ID NO: 74187

SEQ ID NO: 209605 - RNA, 64 nt, hsa; identical to SEQ ID NO: 74188

SEQ ID NO: 209606 - RNA, 64 nt, hsa; identical to SEQ ID NO: 74189

SEQ ID NO: 209607 - RNA, 64 nt, hsa; identical to SEQ ID NO: 74190

SEQ ID NO: 209608 - RNA, 64 nt, hsa; identical to SEQ ID NO: 74191

SEQ ID NO: 209609 - RNA, 64 nt, hsa; identical to SEQ ID NO: 74192

SEQ ID NO: 209610 - RNA, 64 nt, hsa; identical to SEQ ID NO: 74193

SEQ ID NO: 209611 - RNA, 64 nt, hsa; identical to SEQ ID NO: 74194

SEQ ID NO: 209612 - RNA, 64 nt, hsa; identical to SEQ ID NO: 74195

SEQ ID NO: 209613 - RNA, 64 nt, hsa; identical to SEQ ID NO: 74196

SEQ ID NO: 209614 - RNA, 64 nt, hsa; identical to SEQ ID NO: 74197

SEQ ID NO: 209615 - RNA, 64 nt, hsa; identical to SEQ ID NO: 74198

SEQ ID NO: 209616 - RNA, 64 nt, hsa; identical to SEQ ID NO: 74199

SEQ ID NO: 209617 - RNA, 64 nt, hsa; identical to SEQ ID NO: 74200

SEQ ID NO: 209618 - RNA, 64 nt, hsa; identical to SEQ ID NO: 74201

SEQ ID NO: 209619 - RNA, 64 nt, hsa; identical to SEQ ID NO: 74202

SEQ ID NO: 209620 - RNA, 64 nt, hsa; identical to SEQ ID NO: 74203

SEQ ID NO: 209621 - RNA, 64 nt, hsa; identical to SEQ ID NO: 74204

SEQ ID NO: 209622 - RNA, 64 nt, hsa; identical to SEQ ID NO: 74205

SEQ ID NO: 209623 - RNA, 64 nt, hsa; identical to SEQ ID NO: 74206

SEQ ID NO: 209624 - RNA, 64 nt, hsa; identical to SEQ ID NO: 74207

SEQ ID NO: 209625 - RNA, 64 nt, hsa; identical to SEQ ID NO: 74208

SEQ ID NO: 209626 - RNA, 64 nt, hsa; identical to SEQ ID NO: 74209

SEQ ID NO: 209627 - RNA, 64 nt, hsa; identical to SEQ ID NO: 74210

SEQ ID NO: 209628 - RNA, 64 nt, hsa; identical to SEQ ID NO: 74211

SEQ ID NO: 209629 - RNA, 64 nt, hsa; identical to SEQ ID NO: 74212

SEQ ID NO: 209630 - RNA, 64 nt, hsa; identical to SEQ ID NO: 74213

SEQ ID NO: 209631 - RNA, 64 nt, hsa; identical to SEQ ID NO: 74214

SEQ ID NO: 209632 - RNA, 64 nt, hsa; identical to SEQ ID NO: 74215

SEQ ID NO: 209633 - RNA, 64 nt, hsa; identical to SEQ ID NO: 74216

SEQ ID NO: 209634 - RNA, 58 nt, hsa; identical to SEQ ID NO: 74217

SEQ ID NO: 209635 - RNA, 64 nt, hsa; identical to SEQ ID NO: 74218

SEQ ID NO: 209636 - RNA, 64 nt, hsa; identical to SEQ ID NO: 74219

SEQ ID NO: 209637 - RNA, 64 nt, hsa; identical to SEQ ID NO: 74220

SEQ ID NO: 209638 - RNA, 64 nt, hsa; identical to SEQ ID NO: 74221

SEQ ID NO: 209639 - RNA, 56 nt, hsa; identical to SEQ ID NO: 74222

SEQ ID NO: 209640 - RNA, 64 nt, hsa; identical to SEQ ID NO: 74223

SEQ ID NO: 209641 - RNA, 64 nt, hsa; identical to SEQ ID NO: 74224

SEQ ID NO: 209642 - RNA, 64 nt, hsa; identical to SEQ ID NO: 74225

SEQ ID NO: 209643 - RNA, 64 nt, hsa; identical to SEQ ID NO: 74226

SEQ ID NO: 209644 - RNA, 64 nt, hsa; identical to SEQ ID NO: 74227

SEQ ID NO: 209645 - RNA, 64 nt, hsa; identical to SEQ ID NO: 74228

SEQ ID NO: 209646 - RNA, 53 nt, hsa; identical to SEQ ID NO: 74229

SEQ ID NO: 209647 - RNA, 64 nt, hsa; identical to SEQ ID NO: 74230

SEQ ID NO: 209648 - RNA, 64 nt, hsa; identical to SEQ ID NO: 74231

SEQ ID NO: 209649 - RNA, 64 nt, hsa; identical to SEQ ID NO: 74232

SEQ ID NO: 209650 - RNA, 64 nt, hsa; identical to SEQ ID NO: 74233

SEQ ID NO: 209651 - RNA, 64 nt, hsa; identical to SEQ ID NO: 74234

SEQ ID NO: 209652 - RNA, 64 nt, hsa; identical to SEQ ID NO: 74235

SEQ ID NO: 209653 - RNA, 64 nt, hsa; identical to SEQ ID NO: 74236

SEQ ID NO: 209654 - RNA, 64 nt, hsa; identical to SEQ ID NO: 74237

SEQ ID NO: 209655 - RNA, 64 nt, hsa; identical to SEQ ID NO: 74238

SEQ ID NO: 209656 - RNA, 64 nt, hsa; identical to SEQ ID NO: 74239

SEQ ID NO: 209657 - RNA, 64 nt, hsa; identical to SEQ ID NO: 74240

SEQ ID NO: 209658 - RNA, 64 nt, hsa; identical to SEQ ID NO: 74241

SEQ ID NO: 209659 - RNA, 64 nt, hsa; identical to SEQ ID NO: 74242

SEQ ID NO: 209660 - RNA, 64 nt, hsa; identical to SEQ ID NO: 74243

SEQ ID NO: 209661 - RNA, 64 nt, hsa; identical to SEQ ID NO: 74244

SEQ ID NO: 209662 - RNA, 64 nt, hsa; identical to SEQ ID NO: 74245

SEQ ID NO: 209663 - RNA, 64 nt, hsa; identical to SEQ ID NO: 74246

SEQ ID NO: 209664 - RNA, 64 nt, hsa; identical to SEQ ID NO: 74247

SEQ ID NO: 209665 - RNA, 64 nt, hsa; identical to SEQ ID NO: 74248

SEQ ID NO: 209666 - RNA, 64 nt, hsa; identical to SEQ ID NO: 74249

SEQ ID NO: 209667 - RNA, 64 nt, hsa; identical to SEQ ID NO: 74250

SEQ ID NO: 209668 - RNA, 64 nt, hsa; identical to SEQ ID NO: 74251

SEQ ID NO: 209669 - RNA, 64 nt, hsa; identical to SEQ ID NO: 74252

SEQ ID NO: 209670 - RNA, 64 nt, hsa; identical to SEQ ID NO: 74253

SEQ ID NO: 209671 - RNA, 64 nt, hsa; identical to SEQ ID NO: 74254

SEQ ID NO: 209672 - RNA, 64 nt, hsa; identical to SEQ ID NO: 74255

SEQ ID NO: 209673 - RNA, 64 nt, hsa; identical to SEQ ID NO: 74256

SEQ ID NO: 209674 - RNA, 64 nt, hsa; identical to SEQ ID NO: 74257

SEQ ID NO: 209675 - RNA, 64 nt, hsa; identical to SEQ ID NO: 74258

SEQ ID NO: 209676 - RNA, 64 nt, hsa; identical to SEQ ID NO: 74259

SEQ ID NO: 209677 - RNA, 64 nt, hsa; identical to SEQ ID NO: 74260

SEQ ID NO: 209678 - RNA, 64 nt, hsa; identical to SEQ ID NO: 74261

SEQ ID NO: 209679 - RNA, 64 nt, hsa; identical to SEQ ID NO: 74262

SEQ ID NO: 209680 - RNA, 64 nt, hsa; identical to SEQ ID NO: 74263

SEQ ID NO: 209681 - RNA, 64 nt, hsa; identical to SEQ ID NO: 74264

SEQ ID NO: 209682 - RNA, 64 nt, hsa
cggcauaacuuuuuagaaaacagaaaugcccuugaugguggaaaaaagaaaacaaccacccccc

SEQ ID NO: 209683 - RNA, 64 nt, hsa
cuaaaacucacccaacagaucuuuccagagguccaugguggaagacgauaacccugugaaauac

SEQ ID NO: 209684 - RNA, 64 nt, hsa
ggcauacuaaaaaauguugagugguuaucuuuguaugguggaacaaagucacuguaauuuucau

SEQ ID NO: 209685 - RNA, 64 nt, hsa
gauugcuuaaguaaauuauuguaucuccauccagaugguggaguaccgcgcagacauuaaaagu

SEQ ID NO: 209686 - RNA, 64 nt, hsa
ugcugaaauaaaaagugagcaaguaauagauuuucuuggcaaaucuaaugauucagcccacagg

SEQ ID NO: 209687 - RNA, 64 nt, hsa
uauuuuaauuuauuuuuuacuauuuaacccuguacuuggcaaugcucaggcagcugauugugaa

SEQ ID NO: 209688 - RNA, 64 nt, hsa
uguuuauagucacaaccucuccucagcccuaacccuuggcaaucagaaaucuuuucaucuuuag

SEQ ID NO: 209689 - RNA, 64 nt, hsa
gaaaauaucagagaauuuaaugaaggaaagaagccuuggcaaaaugauggaugagagcuuucug

SEQ ID NO: 209690 - RNA, 64 nt, hsa
gccagucccauaaugaaaugcuguauugccauaguggucacacccaagugguccaguaucucaa

SEQ ID NO: 209691 - RNA, 64 nt, hsa
gaauuuaggaagcauucccucuucuacaggggucuggucacaagggcuggauucucugacaaaa

SEQ ID NO: 209692 - RNA, 64 nt, hsa
gugcauacaucucauccacaggggaagauaaagauggucacacaaacaguuuccauaaagaugu

SEQ ID NO: 209693 - RNA, 64 nt, hsa
uauaauuuaaaggauuggugucuuaguacacuuguggucacagggaucaacgaauaguaaauaa

SEQ ID NO: 209694 - RNA, 64 nt, hsa
gaugacaaccagcccagccaggccugacucaucauggucacauccagcccccacccccggccaa

SEQ ID NO: 209695 - RNA, 64 nt, hsa
ccaccacgccuggccaguuucuucauuuuacauauggucacauuggcgccuagaacaguuaggu

SEQ ID NO: 209696 - RNA, 64 nt, hsa
ggggagcaugccuucccccacccuggcuugcucuuggucacagggcgguucugggcacuugaac

SEQ ID NO: 209697 - RNA, 64 nt, hsa
cucuccccucucccauuuucucucuugggagcaauggucacagucccugguaccugaaaaggua

SEQ ID NO: 209698 - RNA, 64 nt, hsa
gagguugugggccuucucaaaccgccggccacacuggucacaggcaaaguccagcucagucuca

SEQ ID NO: 209699 - RNA, 64 nt, hsa
cagguggguucgggcuucaccgccuggcccucuguggucacagaggggcucgguggcccaggug

SEQ ID NO: 209700 - RNA, 64 nt, hsa
uucucucacgcucaagucaccaagaagaaucuucuggucacaaugcuuauugugaguaccauuu

SEQ ID NO: 209701 - RNA, 64 nt, hsa
uuucgaaaugaacgugcaauuagauucguugucauggucacaccugaagaccuuaaagccaaug

SEQ ID NO: 209702 - RNA, 64 nt, hsa
gaagggccuuuauuuucaggcauagacuccucuguggucacagcuggagcacagagagggaccc

SEQ ID NO: 209703 - RNA, 64 nt, hsa
uacaccagagcucuguggaccaaggggucauuccuggucacacacuccaucagcaaaauguauu

SEQ ID NO: 209704 - RNA, 64 nt, hsa; identical to SEQ ID NO: 51559

SEQ ID NO: 209705 - RNA, 64 nt, hsa; identical to SEQ ID NO: 51560

SEQ ID NO: 209706 - RNA, 64 nt, hsa; identical to SEQ ID NO: 51561

SEQ ID NO: 209707 - RNA, 64 nt, hsa; identical to SEQ ID NO: 51562

SEQ ID NO: 209708 - RNA, 64 nt, hsa; identical to SEQ ID NO: 51563

SEQ ID NO: 209709 - RNA, 64 nt, hsa; identical to SEQ ID NO: 51564

SEQ ID NO: 209710 - RNA, 64 nt, hsa; identical to SEQ ID NO: 51565

SEQ ID NO: 209711 - RNA, 64 nt, hsa; identical to SEQ ID NO: 51566

SEQ ID NO: 209712 - RNA, 64 nt, hsa; identical to SEQ ID NO: 51567

SEQ ID NO: 209713 - RNA, 64 nt, hsa; identical to SEQ ID NO: 51568

SEQ ID NO: 209714 - RNA, 64 nt, hsa; identical to SEQ ID NO: 51569

SEQ ID NO: 209715 - RNA, 64 nt, hsa; identical to SEQ ID NO: 51570

SEQ ID NO: 209716 - RNA, 64 nt, hsa; identical to SEQ ID NO: 51571

SEQ ID NO: 209717 - RNA, 64 nt, hsa; identical to SEQ ID NO: 51572

SEQ ID NO: 209718 - RNA, 64 nt, hsa; identical to SEQ ID NO: 51573

SEQ ID NO: 209719 - RNA, 64 nt, hsa; identical to SEQ ID NO: 51574

SEQ ID NO: 209720 - RNA, 64 nt, hsa; identical to SEQ ID NO: 51575

SEQ ID NO: 209721 - RNA, 64 nt, hsa; identical to SEQ ID NO: 51576

SEQ ID NO: 209722 - RNA, 64 nt, hsa; identical to SEQ ID NO: 51577

SEQ ID NO: 209723 - RNA, 64 nt, hsa; identical to SEQ ID NO: 51578

SEQ ID NO: 209724 - RNA, 64 nt, hsa
ugcauucagaggucuuguaaucuacuuguugcaggagaaagaagguaaaaaaugauuuuuuuaa

SEQ ID NO: 209725 - RNA, 64 nt, hsa
uugagaggggcaaaacugagaggggcuuuuccuagagaaagagaacaaggagcuugccaggcuu

SEQ ID NO: 209726 - RNA, 64 nt, hsa
uggcuccauauuucaacuaaaaauauaucuguuggagaaagaaauuaacaauaaagaauuuuca

SEQ ID NO: 209727 - RNA, 64 nt, hsa
cacuggcaggugugggaucuggggagagcggcuggagaaagaugcaguccucaggaagggggcc

SEQ ID NO: 209728 - RNA, 64 nt, hsa
cccguggaaagagggagaaagagaagcugaacaggagaaagacaaacagaaagaauagagaaca

SEQ ID NO: 209729 - RNA, 64 nt, hsa
cauugauauucccaguggugcccguggaaagagggagaaagagaagcugaacaggagaaagaca

SEQ ID NO: 209730 - RNA, 64 nt, hsa
ucagaaacaaccagcugagaaggcuacaagugacgagaaagauucuguuucaaauauagccaca

SEQ ID NO: 209731 - RNA, 64 nt, hsa
ucagaaacaaccagccuugaaggcuacaacugaugagaaagauucuguuucgaacauagccaca

SEQ ID NO: 209732 - RNA, 64 nt, hsa
ugagaaaccaccaggcuugaaggcuacaagugaugagaaagauucuguuuugaauauagccaga

SEQ ID NO: 209733 - RNA, 64 nt, hsa
agucacuuauuaacuuuucaguuugguuugcaaugagaaagaguggaaauuuguauuuuguuuu

SEQ ID NO: 209734 - RNA, 63 nt, hsa
caccaaauggaaugcuguaaauuacaggagcaagagaaagaagauaauuuaaccaugugaaaa

SEQ ID NO: 209735 - RNA, 64 nt, hsa
caaagaggaggaccccugaaggagcagaguccaugagaaagaaggagggaugggaccuuuguag

SEQ ID NO: 209736 - RNA, 64 nt, hsa
guugggguuuugccagggaaguaaaaggaguugagagaaagaugggucaguucagaagacauac

SEQ ID NO: 209737 - RNA, 64 nt, hsa
agugagagcacaaagauaacgcaggagagagagagagaaagaaugagaaagaaaaggaaugcaa

SEQ ID NO: 209738 - RNA, 64 nt, hsa
caaagauaacgcaggagagagagagagaaagaaugagaaagaaaaggaaugcaagagaaggaga

SEQ ID NO: 209739 - RNA, 64 nt, hsa
cuuuuaguaucgaugccacucaucugcagcagaagagaaagaaguccucuuggggcuuuuuagu

SEQ ID NO: 209740 - RNA, 64 nt, hsa
aaucggacgagaggaugugacauucgguccaggagagaaagagcaguuucuguuaaagauguaa

SEQ ID NO: 209741 - RNA, 64 nt, hsa
uaaaaugcaauaaggaaucaauucuuuucugccugagaaagagaaccagacgcaggaagaugaa

SEQ ID NO: 209742 - RNA, 64 nt, hsa
gugcaauguccuuugauuuuuuuuaauacauuaagagaaagagaaauauauauauauccacccc

SEQ ID NO: 209743 - RNA, 64 nt, hsa
ggugaaaauagacuaacuacuggagaaacaaagagagaaagaaaacccaguguuuccauagggg

SEQ ID NO: 209744 - RNA, 64 nt, hsa
ccaucuaugugucuccccuccccuccacaaaaaggagaaagagugcauuaaaauguuuaguugg

SEQ ID NO: 209745 - RNA, 64 nt, hsa
gagucacaaugaucaucuuacccaugugguuuuugagaaagaaagaucaauucuuuguuugcag

SEQ ID NO: 209746 - RNA, 64 nt, hsa
caauuugaugaauacccaguucucuucuuuucuagagaaagauaguugcaaccucaccucccuc

SEQ ID NO: 209747 - RNA, 64 nt, hsa
agacuccaucucaaaaaaaaaaaagagagagagagagaaagaaauagaagagaagagccaucuu

SEQ ID NO: 209748 - RNA, 64 nt, hsa
gagaccucuagagaaaagauguuuguuuacauaagagaaagaggccagacauggugucucacac

SEQ ID NO: 209749 - RNA, 64 nt, hsa
caacaaauauuaaauggcuucuucuuaaagcccagagaaagagguuuuuuaaaagacugucgcc

SEQ ID NO: 209750 - RNA, 64 nt, hsa
ccagugugucaccagcccucagcagaaaccgaaagagaaagaacggaaacacggaguuugggcu

SEQ ID NO: 209751 - RNA, 64 nt, hsa
augcuggaaggguaaggauuuaggaauaucuggagagaaagagagccugcaguuauguacauuu

SEQ ID NO: 209752 - RNA, 64 nt, hsa
aguuguagucaaaaugcuacaauaaaacaaaaaagagaaagaaaaugaagagcauuugacuccc

SEQ ID NO: 209753 - RNA, 64 nt, hsa
gucaggaagguagagagagaaaaagggagggaaggagaaagaaugggaauaaaauaaggaggua

SEQ ID NO: 209754 - RNA, 64 nt, hsa
auuucuggaugagaaaauuuucaauucuggccaugagaaagaaaaaaaaauaaacagccuucuu

SEQ ID NO: 209755 - RNA, 64 nt, hsa
ccuggaggaaagucauuccugccuaauccaucgagagaaagaggcuuacgaaaaacuuugccuc

SEQ ID NO: 209756 - RNA, 64 nt, hsa
ucuuucccaagcuccuagccaacacuauccuugggagaaagaaauuugcagaaacugcuaagac

SEQ ID NO: 209757 - RNA, 64 nt, hsa
accuugcuguugcucugaggagauauaauucugggagaaagaaucuuuuauaagaacaguacag

SEQ ID NO: 209758 - RNA, 64 nt, hsa
gugaguugggucaagugcauuggaccuagggaaagagaaagaaagaauaaaagcuggagagaga

SEQ ID NO: 209759 - RNA, 64 nt, hsa
ugaguugugagggcccagaucacagaucccaugugagaaagagagaguuucagcgucauccuug

SEQ ID NO: 209760 - RNA, 64 nt, hsa
cugccagcuuaaugaauuuagauguacuuuaagagagaaagacugguuauuucuccuuugugua

SEQ ID NO: 209761 - RNA, 64 nt, hsa
gagguauaacugaauaagaaauuuuuuuaagcaagagaaagacaacuguucugcggguuggaga

SEQ ID NO: 209762 - RNA, 64 nt, hsa
aaagaggcagcugagugagagacacagagagaaggagaaagagggagggagagagagaaagaga

SEQ ID NO: 209763 - RNA, 64 nt, hsa
gacacagagagaaggagaaagagggagggagagagagaaagagagagaaagagagagagagaga

SEQ ID NO: 209764 - RNA, 64 nt, hsa
gaaggagaaagagggagggagagagagaaagagagagaaagagagagagagagagagagagaga

SEQ ID NO: 209765 - RNA, 64 nt, hsa
uuauggacugggcaaagcccacuauaaacuauaggagaaagaaguucugauaaaccucuuagua

SEQ ID NO: 209766 - RNA, 64 nt, hsa
cauuuuucccaggguaaucaugaaagaaggcucagagaaagagggaaacaaaagccuguucagc

SEQ ID NO: 209767 - RNA, 64 nt, hsa
accccucugucaugccucuuuaaagagaaaagaagagaaagauuuuuuuuuuuuuuaauggcag

SEQ ID NO: 209768 - RNA, 64 nt, hsa
caggggagaaaaugguggcuaucccuucugcuuagagaaagaaauggccuuuagcugguuucau

SEQ ID NO: 209769 - RNA, 64 nt, hsa
uugugaaacuguagagagcagguagcccaaaauagagaaagauuagauaaagagaaaauaagua

SEQ ID NO: 209770 - RNA, 64 nt, hsa
gaguaaaugaauaaaacauuugcaaagaccuuuagagaaagagaaugggagcauaugugagaaa

SEQ ID NO: 209771 - RNA, 64 nt, hsa
acuuaaaguucuuaagaugagacuguguaaaugagagaaagacuugauucagaggaaaaaaaug

SEQ ID NO: 209772 - RNA, 64 nt, hsa
uauuugcauuuaaauugcaauccagcacacgugugagaaagaagaggcacuagucuaaaaggcu

SEQ ID NO: 209773 - RNA, 64 nt, hsa
acgccccuuaaaauaaguaaauaaauaaccuugagagaaagaacaagaucaauauauccugcag

SEQ ID NO: 209774 - RNA, 64 nt, hsa
acauagaaaggaaacugcaucagaaacaugaacagagaaagauugucugccuucuagaaucaga

SEQ ID NO: 209775 - RNA, 64 nt, hsa
gccugagcuaugccuguugaggcaucuggagacugagaaagaaucaaaggcagagaagaccagc

SEQ ID NO: 209776 - RNA, 64 nt, hsa
gauggccaggggagggggucuguggaagauucaggagaaagaaaggagaggcuaggguggugug

SEQ ID NO: 209777 - RNA, 64 nt, hsa
cccuuugcuguagcuacacuucagauuaaaguaggagaaagaaugugcugaguguuuuccuccc

SEQ ID NO: 209778 - RNA, 64 nt, hsa
cuggcccucaucccaacagcccagcaaggggagagagaaagagaauucuuuucuauagaacgag

SEQ ID NO: 209779 - RNA, 64 nt, hsa
aacagacauuuccuagagaaagagagagagagaggagaaagagagagaaggagagagacaguag

SEQ ID NO: 209780 - RNA, 64 nt, hsa
aaagugaggccugcuucacaacagacauuuccuagagaaagagagagagagaggagaaagagag

SEQ ID NO: 209781 - RNA, 64 nt, hsa
aaugugcuuuuuauuguaauucaacagcuauagagagaaagauaacuuauuguguguuugauuu

SEQ ID NO: 209782 - RNA, 64 nt, hsa
gaguguggcagagagugugcaugugagaaagcgagagaaagaggaacugaaggacgcgguuaau

SEQ ID NO: 209783 - RNA, 64 nt, hsa
cacaucccgccgccgccgccgccgccaugcccaagagaaagacugaaggggaugcuaaaggaga

SEQ ID NO: 209784 - RNA, 64 nt, hsa
gacaauauccuuacacauuugucauacuaucaaagagaaagaaacaagauuuccauucccacaa

SEQ ID NO: 209785 - RNA, 64 nt, hsa
ccuaagagacacauacagagugggccccgggcuggagaaagagcugccuggaugagaaacagcu

SEQ ID NO: 209786 - RNA, 64 nt, hsa
gacccucaggaauucagugccuucaacaacgugagagaaagagagaagccagccacagaccccu

SEQ ID NO: 209787 - RNA, 64 nt, hsa
aauagaaucagauuaucucuuuuuuucuaaaggagagaaagacuuagaacauacacagauccua

SEQ ID NO: 209788 - RNA, 64 nt, hsa
uucuauagacuugagaauguuuuucucuaaaugagagaaagacuuagaauguacacagauccaa

SEQ ID NO: 209789 - RNA, 64 nt, hsa
gagagugagagagagaaagagagugagagagagagagaaagagagagagagaugcuguugaauc

SEQ ID NO: 209790 - RNA, 64 nt, hsa
guaaccaguuuccagagagccagagagugagagagagaaagagagugagagagagagagaaaga

SEQ ID NO: 209791 - RNA, 64 nt, hsa
ggccgggcuguagaucagguuugcccacuugauugagaaagauguuccagugaggaacccugau

SEQ ID NO: 209792 - RNA, 64 nt, hsa
guacaauacggaaugaagaagaggggaaaauggggagaaagaugguuaaaauacauaauaaucc

SEQ ID NO: 209793 - RNA, 64 nt, hsa
guggguuccaaauuacucauagaggagaaaaccagagaaagaugaagaggaggaguuaggucua

SEQ ID NO: 209794 - RNA, 64 nt, hsa
ucaggguaggugggcacaggcuuggacuagagaggagaaagauugguguaaucugcuuuccugu

SEQ ID NO: 209795 - RNA, 64 nt, hsa
aauuguugaguuuauuuuuacacaguaaagaguggagaaagacuguggucuccucaggaugucu

SEQ ID NO: 209796 - RNA, 64 nt, hsa
guguguguguguugugugugugugugcgcuaagugagaaagagagcaggcucgggaggcccugc

SEQ ID NO: 209797 - RNA, 64 nt, hsa
uucugcccuuacagcaccucaugggaucagaaaagagaaagauguuggcucuuguaauaaaugc

SEQ ID NO: 209798 - RNA, 64 nt, hsa
aaaaacucuucaugugaaucuuaacuugcaaaaggagaaagauaaaauacagaagacuggcccc

SEQ ID NO: 209799 - RNA, 64 nt, hsa
aaggcccucagaagcagauuauuccuguuuuacagagaaagauacugagagugguugaguaauu

SEQ ID NO: 209800 - RNA, 64 nt, hsa
gugggagaauuauacuugacugaauuaugggcaggagaaagagcagauuccuuuuagcuaauuc

SEQ ID NO: 209801 - RNA, 64 nt, hsa
gcgggacagagugagacccugucugaaagaaagagagaaagaaagaaagaaagagagagaaaga

SEQ ID NO: 209802 - RNA, 64 nt, hsa
cugaaagaaagagagaaagaaagaaagaaagagagagaaagaaagaaagaaagaaagggaaaga

SEQ ID NO: 209803 - RNA, 64 nt, hsa
aagggaaagauggaaggaaggaaggaaaaagaaagagaaagagagagagagagaaagaaaaaga

SEQ ID NO: 209804 - RNA, 64 nt, hsa
gaaggaaggaaaaagaaagagaaagagagagagagagaaagaaaaagaaagaaaaguaagaaag

SEQ ID NO: 209805 - RNA, 64 nt, hsa
gacauucaaacaaaggaggaggagucauagggaagagaaagaaauggaagcacagcuucuuuca

SEQ ID NO: 209806 - RNA, 64 nt, hsa
uccacucuugaggagcagaagcauauaucuuuaugagaaagauggaggcuugaguuaugaaaua

SEQ ID NO: 209807 - RNA, 64 nt, hsa
gcagacucugacucaacuuucuaggcaccuagcagagaaagauaagaucaaaagguguuugguu

SEQ ID NO: 209808 - RNA, 64 nt, hsa
auacugacuaacuuggguggguggaucuagccaggagaaagacaguaacauguguucuguacuu

SEQ ID NO: 209809 - RNA, 64 nt, hsa
uaaucuuccgaccuuccucccagggcugaugugagagaaagaaaaucugaagggccccuggccu

SEQ ID NO: 209810 - RNA, 64 nt, hsa
guacaugaaccaggucauguuuggccuuguguuggagaaagagaauuauccccacuucacagau

SEQ ID NO: 209811 - RNA, 64 nt, hsa
ggcuuuuuacaggagaaaaaaaaaugacuuauaagagaaagagccuggaguauuuuuggaaaaa

SEQ ID NO: 209812 - RNA, 64 nt, hsa
aucuuuauaauuucuuugucucacagaagacuaggagaaagaucuuuuuuaaauaaucuuuuug

SEQ ID NO: 209813 - RNA, 64 nt, hsa
ucgaaaaaagaaaaaaagccaugauguacccuccgagaaagaagaacguaagcacaggaaagag

SEQ ID NO: 209814 - RNA, 64 nt, hsa
aaaacgacaccuagaagaaggcaaagaaaggccagagaaagagcaguccaagcauaaaaggaaa

SEQ ID NO: 209815 - RNA, 62 nt, hsa
augcugugccaucaugugaugcagccugccagaggcccaaugcuggaauggcaccaucauuc

SEQ ID NO: 209816 - RNA, 62 nt, hsa
caccacagaggccacaggcaggcccccacuucaggcccaaggccuggggcggggggaacagu

SEQ ID NO: 209817 - RNA, 62 nt, hsa
cucgugguuauuagcaaggcuggguaaugugaaggcccaagagcagagucugggccucugac

SEQ ID NO: 209818 - RNA, 62 nt, hsa
ugggacagccagagcuggguggggacagugauaggcccaagguccccuccacaucccagcag

SEQ ID NO: 209819 - RNA, 62 nt, hsa
cucuggggaggcccaagcagcuuguuuugcaaaggcccaaguccuccugcuaggaaaagcuu

SEQ ID NO: 209820 - RNA, 62 nt, hsa
gguaggugcaugggagggugggcccucuggggaggcccaagcagcuuguuuugcaaaggccc

SEQ ID NO: 209821 - RNA, 62 nt, hsa
ggcuguaggggagaguguggcaggugacccaaaggcccaaagagggccguggggccugagga

SEQ ID NO: 209822 - RNA, 62 nt, hsa
cuguuggcagaggacagccccuggggaaccccaggcccaacucuguccgguaucccuuuucc

SEQ ID NO: 209823 - RNA, 62 nt, hsa
ucaaucuaguccuagaguugugucccucugaaaggcccaaugccauguaacuaacuuuaaac

SEQ ID NO: 209824 - RNA, 62 nt, hsa
cccaaaaguccaaaaauguaauaauuuugacaaggcccaaaguugagaugcuaugaagcuug

SEQ ID NO: 209825 - RNA, 64 nt, hsa; identical to SEQ ID NO: 87137

SEQ ID NO: 209826 - RNA, 64 nt, hsa; identical to SEQ ID NO: 87138

SEQ ID NO: 209827 - RNA, 64 nt, hsa; identical to SEQ ID NO: 87139

SEQ ID NO: 209828 - RNA, 64 nt, hsa; identical to SEQ ID NO: 87140

SEQ ID NO: 209829 - RNA, 64 nt, hsa; identical to SEQ ID NO: 87141

SEQ ID NO: 209830 - RNA, 64 nt, hsa; identical to SEQ ID NO: 87142

SEQ ID NO: 209831 - RNA, 64 nt, hsa; identical to SEQ ID NO: 87143

SEQ ID NO: 209832 - RNA, 64 nt, hsa; identical to SEQ ID NO: 87144

SEQ ID NO: 209833 - RNA, 64 nt, hsa; identical to SEQ ID NO: 87145

SEQ ID NO: 209834 - RNA, 64 nt, hsa; identical to SEQ ID NO: 87146

SEQ ID NO: 209835 - RNA, 64 nt, hsa; identical to SEQ ID NO: 87147

SEQ ID NO: 209836 - RNA, 64 nt, hsa; identical to SEQ ID NO: 87148

SEQ ID NO: 209837 - RNA, 64 nt, hsa; identical to SEQ ID NO: 87149

SEQ ID NO: 209838 - RNA, 64 nt, hsa; identical to SEQ ID NO: 87150

SEQ ID NO: 209839 - RNA, 64 nt, hsa; identical to SEQ ID NO: 87151

SEQ ID NO: 209840 - RNA, 64 nt, hsa; identical to SEQ ID NO: 87152

SEQ ID NO: 209841 - RNA, 64 nt, hsa; identical to SEQ ID NO: 87153

SEQ ID NO: 209842 - RNA, 64 nt, hsa; identical to SEQ ID NO: 87154

SEQ ID NO: 209843 - RNA, 64 nt, hsa; identical to SEQ ID NO: 87155

SEQ ID NO: 209844 - RNA, 64 nt, hsa; identical to SEQ ID NO: 87156

SEQ ID NO: 209845 - RNA, 64 nt, hsa; identical to SEQ ID NO: 87157

SEQ ID NO: 209846 - RNA, 64 nt, hsa; identical to SEQ ID NO: 87158

SEQ ID NO: 209847 - RNA, 64 nt, hsa; identical to SEQ ID NO: 87159

SEQ ID NO: 209848 - RNA, 64 nt, hsa; identical to SEQ ID NO: 87160

SEQ ID NO: 209849 - RNA, 64 nt, hsa; identical to SEQ ID NO: 87161

SEQ ID NO: 209850 - RNA, 64 nt, hsa; identical to SEQ ID NO: 87162

SEQ ID NO: 209851 - RNA, 64 nt, hsa; identical to SEQ ID NO: 87163

SEQ ID NO: 209852 - RNA, 64 nt, hsa; identical to SEQ ID NO: 87164

SEQ ID NO: 209853 - RNA, 64 nt, hsa; identical to SEQ ID NO: 87165

SEQ ID NO: 209854 - RNA, 64 nt, hsa; identical to SEQ ID NO: 87166

SEQ ID NO: 209855 - RNA, 64 nt, hsa; identical to SEQ ID NO: 87167

SEQ ID NO: 209856 - RNA, 64 nt, hsa; identical to SEQ ID NO: 87168

SEQ ID NO: 209857 - RNA, 64 nt, hsa; identical to SEQ ID NO: 87169

SEQ ID NO: 209858 - RNA, 64 nt, hsa; identical to SEQ ID NO: 87170

SEQ ID NO: 209859 - RNA, 64 nt, hsa; identical to SEQ ID NO: 87171

SEQ ID NO: 209860 - RNA, 64 nt, hsa; identical to SEQ ID NO: 87172

SEQ ID NO: 209861 - RNA, 64 nt, hsa; identical to SEQ ID NO: 87173

SEQ ID NO: 209862 - RNA, 64 nt, hsa; identical to SEQ ID NO: 87174

SEQ ID NO: 209863 - RNA, 64 nt, hsa; identical to SEQ ID NO: 87175

SEQ ID NO: 209864 - RNA, 64 nt, hsa; identical to SEQ ID NO: 87176

SEQ ID NO: 209865 - RNA, 63 nt, hsa
gaaguuauuuuuaaaaagguacucugcauguucccgcaguaauguucugcacaacaguauugu

SEQ ID NO: 209866 - RNA, 63 nt, hsa
guuacugucgggcaguaacugccgcuugccuugccgcaguaggagggaaaucucaccuuccuu

SEQ ID NO: 209867 - RNA, 52 nt, hsa
ucagauggaagucuucauaaagccgcaguagaacuugagcugaaaacccaga

SEQ ID NO: 209868 - RNA, 63 nt, hsa
ucccaguguugccuuaacagggugucugucgugccgcaguagagcacugcugcuuccuccaac

SEQ ID NO: 209869 - RNA, 63 nt, hsa
aagucacuguguauguuuguuuggucaauguuuccgcaguauuuauuaaaacauacuuuuuuu

SEQ ID NO: 209870 - RNA, 63 nt, hsa
ggggccuucuucugacagagaauucuuugagguccgcaguagugcuuuugucagcacagacug

SEQ ID NO: 209871 - RNA, 61 nt, hsa
guuuuccagaugggaauuaaugugguggacuccgcaguauccggauuagguggcugcccuu

SEQ ID NO: 209872 - RNA, 63 nt, hsa
aucucaucccauucccauguaaauuaccacagaccgcaguaccggggcuggagcggagugaag

SEQ ID NO: 209873 - RNA, 63 nt, hsa
cuaagcugaguuaggugucuguccuuuaugaucccgcaguauuccaugaauacguauauucuc

SEQ ID NO: 209874 - RNA, 63 nt, hsa
guaacugcacuaaagggacguagugugaacaucccgcaguauaggcuuaagucacuuuuguga

SEQ ID NO: 209875 - RNA, 63 nt, hsa
uguucauaacacuuugcuccauaacccugauguccgcaguaucuaaguaucucagccuucauc

SEQ ID NO: 209876 - RNA, 63 nt, hsa
cugccaaaccccagggccuggccccgcccagucccgcaguacauccccuguccccuccccaac

SEQ ID NO: 209877 - RNA, 63 nt, hsa
agagggcaaaaggaugguuuugcaucuuccucaccgcaguaaaccaaugagguauuagacauu

SEQ ID NO: 209878 - RNA, 63 nt, hsa
gaacacuuguauauuguuuguuugagguucgugccgcaguaacagacacaguauuuaauugca

SEQ ID NO: 209879 - RNA, 63 nt, hsa
aguaagagacuccagcauggccuucuguuugccccgcaguaaaguaacuuccauauaaaaugg

SEQ ID NO: 209880 - RNA, 63 nt, hsa
gagcgagcguucugggcuggucgaagccugaagccgcaguauguccuugaguggguccccccc

SEQ ID NO: 209881 - RNA, 63 nt, hsa
gcacaggacccugcccucguguucccucccagcccgcaguauuucagggacaggcucuucccc

SEQ ID NO: 209882 - RNA, 63 nt, hsa
cucgguuucccgcggacuuggcugcugcucccaccgcaguaccgccuccuggaacggaagcau

SEQ ID NO: 209883 - RNA, 63 nt, hsa
agccgggagacccaggacuggcggccgccaugcccgcaguagguucuagggggcggugcuggc

SEQ ID NO: 209884 - RNA, 63 nt, hsa
ggaguguagauaaggcuucagccaugagucaccccgcaguaagccccagaguauauugaauag

SEQ ID NO: 209885 - RNA, 63 nt, hsa
uccgccgucucagcauccaggugacgugcugucccgcaguagcugcucgccacacaggcuguu

SEQ ID NO: 209886 - RNA, 63 nt, hsa
ucauacugugguucuucgagagaagcugcccauccgcaguaauaucuucccucugaugcugga

SEQ ID NO: 209887 - RNA, 64 nt, hsa
uggucacccuggggguccugggacacaccucaguaaagagcaaaggcaacgcccucaggguccc

SEQ ID NO: 209888 - RNA, 64 nt, hsa
aaaaaaagaaaagaaaaagauaaagggauugugaaaagagcauuuauauuggacuaaucagaug

SEQ ID NO: 209889 - RNA, 64 nt, hsa
gacaguuugaggagucgaauugagauucaucaucaaagagcaaugcagcgucguuaaaauaaaa

SEQ ID NO: 209890 - RNA, 64 nt, hsa
cggacgagaggaugugacauucgguccaggagagaaagagcaguuucuguuaaagauguaacaa

SEQ ID NO: 209891 - RNA, 64 nt, hsa
ucuaaaggucaguuuugggccaguucuugcaacuaaagagcagagaucucucugggcccuagac

SEQ ID NO: 209892 - RNA, 64 nt, hsa
uccaugggacuuaucauaggccuggugauucuugaaagagcauuuuucaugacucaaaaaugag

SEQ ID NO: 209893 - RNA, 64 nt, hsa
ucuguucccuaccuuuuuucacuuuuccuccuccaaagagcaaaaugaaaauuuugccuuagcu

SEQ ID NO: 209894 - RNA, 64 nt, hsa
caaaaugaaaauuuugccuuagcuacugcaguggaaagagcacugaacuaggaguuggaagaca

SEQ ID NO: 209895 - RNA, 64 nt, hsa
aacgaaauaucaaagucauuaaagacaggagacaaaagagcagugguaagaauaguagaugugg

SEQ ID NO: 209896 - RNA, 64 nt, hsa
gaagaauguuagaguaaugaaauggaggaucucuaaagagcaucugauucuuguugcuguacaa

SEQ ID NO: 209897 - RNA, 64 nt, hsa
guggccuccccuuccccucccugccccaggacuuaaagagcaauaguuugccccuuuuggaaug

SEQ ID NO: 209898 - RNA, 64 nt, hsa
uggaaugaucucugaauauauaaaacacacacacaaagagcaauaguuugccccuuuuggaacg

SEQ ID NO: 209899 - RNA, 64 nt, hsa
gcccagggccgcguggugaaaucuggcaguggggaaagagcaaccccagcccgucccuuccccc

SEQ ID NO: 209900 - RNA, 64 nt, hsa
gcugaaguaaaggggcaagauagggcaguuaacuaaagagcacuuuauuucuuugaagccuuuc

SEQ ID NO: 209901 - RNA, 64 nt, hsa
uucuaauugaauauuuuuauauuuuuaugaaacaaaagagcauuucuucagguuucuauuguau

SEQ ID NO: 209902 - RNA, 64 nt, hsa
cugguagagacaucuucaaggcaugaaauagcuuaaagagcagaguagaaacggaagaggcuuu

SEQ ID NO: 209903 - RNA, 64 nt, hsa
uuucacuaaagcauguuuauuccccuaauccauuaaagagcaugaaaaaaagaauaaauguauu

SEQ ID NO: 209904 - RNA, 64 nt, hsa
agaugaguuaggaauaaaccuauaacauuuacaaaaagagcaaaacuaagugauagaaaauauu

SEQ ID NO: 209905 - RNA, 64 nt, hsa
caguaaaccaaaacccaacaauguggccagaaagaaagagcaauaauaauuaauucacacacca

SEQ ID NO: 209906 - RNA, 64 nt, hsa
uggaaacauuuaaaugaucaggagggaguaacagaaagagcaaggcuguuuuugaaaaucauua

SEQ ID NO: 209907 - RNA, 64 nt, hsa
caacauaguaugugugcagauggacgauggauuuaaagagcauaccuuaugauuaaaccgaggu

SEQ ID NO: 209908 - RNA, 64 nt, hsa
agucagugaccuaugucugccaucuuacuggggaaaagagcaaguagccugucuuccuuuaagu

SEQ ID NO: 209909 - RNA, 64 nt, hsa
uuugaguaaacugauagauuuuacucugacugcaaaagagcacaccuaugcugcuuguugcagu

SEQ ID NO: 209910 - RNA, 64 nt, hsa
cuuaaaaugaagaauuaacuuguguuacaucuauaaagagcaaaauaacacacuccagaacuug

SEQ ID NO: 209911 - RNA, 64 nt, hsa
auugagcuauaugauuuaucagagaucugauuccaaagagcacagaauacuguucucagaccau

SEQ ID NO: 209912 - RNA, 64 nt, hsa
augagcaaucccuuaugcauagacuaccuuggcaaaagagcauuagcaagugucacugcucauc

SEQ ID NO: 209913 - RNA, 64 nt, hsa
aaggacucauucaugucacgcuuccuugagcagaaaagagcacugagagcacuugggaccccug

SEQ ID NO: 209914 - RNA, 64 nt, hsa
cugccauucaagacuggagacaccugggaaauaaaaagagcagggcacugcuggugggaagagg

SEQ ID NO: 209915 - RNA, 64 nt, hsa
cuauccauaaaaugaagguagccaggccugccucaaagagcauucaggaggcucugagaggaca

SEQ ID NO: 209916 - RNA, 64 nt, hsa
uggaugaaaggagaaggcuagaggcugagggaggaaagagcaguuaacaaacaaaggcaguagc

SEQ ID NO: 209917 - RNA, 64 nt, hsa
gggacaggcacagcagaggugagagugggaggagggcacguaccgggugccagcccuggagccc

SEQ ID NO: 209918 - RNA, 64 nt, hsa
aacaaacaaacaaacaccugugcuaggucagucuggcacguaagaugaacaucccuaccaauac

SEQ ID NO: 209919 - RNA, 64 nt, hsa
aagauucuacaugucuagaaucaaacucaaaucuggcacguaggugcuucuuaguaaaugcuua

SEQ ID NO: 209920 - RNA, 64 nt, hsa
uuuauucagccccuuaaucuauuuucagucuucuggcacguaauuuuuuucacaguuauuauuc

SEQ ID NO: 209921 - RNA, 64 nt, hsa
uuaauucagguguugaaggagcuuagguuuuagaggcacguagacuugguucaagucucguuag

SEQ ID NO: 209922 - RNA, 64 nt, hsa
aggaauaccacuuauguuacacuccugcacuaaaggcacguacugcagugugaagaaauguucu

SEQ ID NO: 209923 - RNA, 64 nt, hsa
cugcgcauuccagcuacgcuaagcgcccugcccaggcacguaacaaaacauagaccuguuuuga

SEQ ID NO: 209924 - RNA, 64 nt, hsa
ugaacgcacaacaugcacauucauccucacauguggcacguaaggucucauuugauauugugua

SEQ ID NO: 209925 - RNA, 64 nt, hsa
uuaaugaaaauagauauggucacaaguacauuaaggcacguagaagguaggaguaagaaaagcu

SEQ ID NO: 209926 - RNA, 64 nt, hsa
gacgugcuuauuuucacucagcaguguuaugaaaggcacguaguauauagagcccaaagcccug

SEQ ID NO: 209927 - RNA, 64 nt, hsa
auuacaggaaagcaccuguccuggcucuguaccuggcacguaguaggugcucaguucaugcugg

SEQ ID NO: 209928 - RNA, 64 nt, hsa
ggagccccaguggcugacaggccagccucacucaggcacguaccugcugaccagucagccacug

SEQ ID NO: 209929 - RNA, 64 nt, hsa
agcacugaaaaauuacucauucaaauuuccccugggcacguaaggcaaaauauugccgguuggg

SEQ ID NO: 209930 - RNA, 64 nt, hsa
uuauauuuauauauaaauauaaaaauuuguuaaaggcacguauaguuaagagaguuuuauuuua

SEQ ID NO: 209931 - RNA, 64 nt, hsa
aguuggaauauccaguuauuucaugucacacaucggcacguaugauggugguuuggucagaugg

SEQ ID NO: 209932 - RNA, 64 nt, hsa
uuuguuaauucuaguuucauuuaauaaccuguaaggcacguaaguuuaagcuuuuuuuuuuuuu

SEQ ID NO: 209933 - RNA, 64 nt, hsa
ggagggaagaacaggcccuggggugcagaggcccggcacguagagaacccagauagacgccggu

SEQ ID NO: 209934 - RNA, 64 nt, hsa
ccaggcauuuugucuccagggcucccgcuggacaggcacguacugcccuggggaguaaaugcgg

SEQ ID NO: 209935 - RNA, 64 nt, hsa
uaaaggguuaauuuauuguucagccuuaucccuuggcacguaaacagacuacuagacuuauugu

SEQ ID NO: 209936 - RNA, 64 nt, hsa
uggguaggaugcaucugauccagaguuagggagaggcacguacaggccaggccuagaaaugaug

SEQ ID NO: 209937 - RNA, 64 nt, hsa
acuaaucaucagaaaaucuguggccauuagggcuggcacguaaaaauccaaaaucacucagagg

SEQ ID NO: 209938 - RNA, 64 nt, hsa
guguaaaauagaauuaauguaucuugcuaguaagggcacguagagcauuuagaguugucuuuca

SEQ ID NO: 209939 - RNA, 64 nt, hsa
uggggcuccuccuucugucuuaagagaaagccaaggcacguagaguagggagaagaagggcacc

SEQ ID NO: 209940 - RNA, 64 nt, hsa
ccuagauagaacucggcccgucaguucugagugaggcacguaccacuugggcuugggauguccu

SEQ ID NO: 209941 - RNA, 64 nt, hsa
ggguaccaagcagcugcacagucggugccugggaggcacguagaggcccagagagucccugggg

SEQ ID NO: 209942 - RNA, 64 nt, hsa
agaugcaggugaugccauuacagaaccaaaucguggcacguauugcugugucuccucucagagu

SEQ ID NO: 209943 - RNA, 64 nt, hsa
auguaaauagaaagugcguacaguuagaacguccggcacguaacugaucggagcauucugggaa

SEQ ID NO: 209944 - RNA, 64 nt, hsa
cuuucuggccaaggugggcgguguuagauugugaggcacguacauggggccugccggaaugacu

SEQ ID NO: 209945 - RNA, 64 nt, hsa
guuggggagauaaaggaacauugguugcuuugguggcacguaagcuccuugucugucuccagca

SEQ ID NO: 209946 - RNA, 64 nt, hsa
uuccgaucuuuuugcucaggggccaaacacugaaggcacguacugcccaacccacugagcgccu

SEQ ID NO: 209947 - RNA, 64 nt, hsa
gacuaaagaguauauugggggaggaagagagggaggcacguaggaacaagcaaugagaagacca

SEQ ID NO: 209948 - RNA, 64 nt, hsa
aaggucagugagugagugcauuugcugcagugguggcacguagagaacuagaugguaauaaaga

SEQ ID NO: 209949 - RNA, 64 nt, hsa
cucccacuuccggccuagucugccagcuuuugcuggcacguaggcuaccacucuccgggcaccg

SEQ ID NO: 209950 - RNA, 64 nt, hsa
cuuguuucuuacaagcaaaccagggucccuucuuggcacguaacauguacguauuucugaaaua

SEQ ID NO: 209951 - RNA, 64 nt, hsa
augugaagaaggucguugcuuccccuucaccuuccaccaccaugauuguaaguuccuuuuuucu

SEQ ID NO: 209952 - RNA, 64 nt, hsa
cucagccucuggaguagcugagacuacaggcgcccaccaccaugcccggcuaauuuuguuugua

SEQ ID NO: 209953 - RNA, 64 nt, hsa
uuuucuguuuguuuguuuucauguugaaugcccacaccaccauccucucaucccagccaguaag

SEQ ID NO: 209954 - RNA, 64 nt, hsa
cuacaaauauaaguagucauuagaaguuugcaaccaccaccaagucugagagaacucugggaua

SEQ ID NO: 209955 - RNA, 64 nt, hsa
cucacccuccugaguagcugggacuacaggugugcaccaccacaccuggcuaauucuucuuaaa

SEQ ID NO: 209956 - RNA, 64 nt, hsa
cucagccucccaaguagcugggauuacaggcauacaccaccacgccccacuaauuuuuuguauu

SEQ ID NO: 209957 - RNA, 64 nt, hsa
ugugcugguaacugcuuugcuucuugaguagagccaccaccaccauagcccagccagaugagug

SEQ ID NO: 209958 - RNA, 64 nt, hsa
gcugguaacugcuuugcuucuugaguagagccaccaccaccauagcccagccagaugagugcuc

SEQ ID NO: 209959 - RNA, 64 nt, hsa
uaguuaacaaauguuccuccucccucugggauaccaccaccacuuguuucuguguguguuuauu

SEQ ID NO: 209960 - RNA, 64 nt, hsa
gauuuaagcuugaagcuacagauuauaucacuaucaccaccaccccucacccuaugcaaucaau

SEQ ID NO: 209961 - RNA, 64 nt, hsa
gaucccuuuggugaguaugguguucaggaugcaccaccaccaccucuagauaccuucaggcaac

SEQ ID NO: 209962 - RNA, 64 nt, hsa
caggaucccuuuggugaguaugguguucaggaugcaccaccaccaccucuagauaccuucaggc

SEQ ID NO: 209963 - RNA, 64 nt, hsa
uaagugcaauaguugacuuuuaaccaaccaccaccaccaccaaaaccaguuuaugcaguuggac

SEQ ID NO: 209964 - RNA, 64 nt, hsa
cuguaagugcaauaguugacuuuuaaccaaccaccaccaccaccaaaaccaguuuaugcaguug

SEQ ID NO: 209965 - RNA, 64 nt, hsa
uuacuguaagugcaauaguugacuuuuaaccaaccaccaccaccaccaaaaccaguuuaugcag

SEQ ID NO: 209966 - RNA, 64 nt, hsa
gagaaacacaaaauuuugaggcuagacccaugaucaccaccaacuauaauugcacaaggucuug

SEQ ID NO: 209967 - RNA, 64 nt, hsa
ugguuggaaggauagacugcccccuaccucccaccaccaccaugaaguuuggugacuugaggcu

SEQ ID NO: 209968 - RNA, 64 nt, hsa
augugguuggaaggauagacugcccccuaccucccaccaccaccaugaaguuuggugacuugag

SEQ ID NO: 209969 - RNA, 64 nt, hsa
cucagccucccgaguagcugggacuacaggcgcccaccaccacgcccggcuaauuuuuuguauu

SEQ ID NO: 209970 - RNA, 64 nt, hsa
cucagccucccgaguagcugggauuaugggcgcccaccaccaugcccagcuaauuuuuguauuu

SEQ ID NO: 209971 - RNA, 64 nt, hsa
ccagcccagcccacuccccgcauggggaggccgccaccaccaacaccucaucauccuucucauc

SEQ ID NO: 209972 - RNA, 64 nt, hsa
accaccaacaccucaucauccuucucaucgcuaacaccaccaccuccaucggcacccaagcggg

SEQ ID NO: 209973 - RNA, 64 nt, hsa
agaccuguuccucuuccaaaagaccucucuuuaccaccaccacccucaucacucagaaacccua

SEQ ID NO: 209974 - RNA, 64 nt, hsa
gccuuuggaauuacuccugcagaagguugccugccaccaccagcuggaccugagcuugggcaac

SEQ ID NO: 209975 - RNA, 64 nt, hsa
cucagccucccaaguagcugggacuaugggugcacaccaccacgccuggcuaauuuuuguauuu

SEQ ID NO: 209976 - RNA, 64 nt, hsa
ccaguggccugggagaggcagugagccuucucuccaccaccauagacagguguuaaugcaucua

SEQ ID NO: 209977 - RNA, 64 nt, hsa
cuucucaucacugcacacaagugccaugcuuugccaccaccaccaagcacaucugugauccuga

SEQ ID NO: 209978 - RNA, 64 nt, hsa
cucaucacugcacacaagugccaugcuuugccaccaccaccaagcacaucugugauccugaagg

SEQ ID NO: 209979 - RNA, 64 nt, hsa
ugggaagcuauccuuucucagcuaugugguuuggcaccaccaccaucuucaugaguggacccug

SEQ ID NO: 209980 - RNA, 64 nt, hsa
gaagcuauccuuucucagcuaugugguuuggcaccaccaccaucuucaugaguggacccuguuu

SEQ ID NO: 209981 - RNA, 64 nt, hsa
cugaggccaaagccagagacucgaacagccuccccaccaccaccagcauaugucaaggagcacu

SEQ ID NO: 209982 - RNA, 64 nt, hsa
aggccaaagccagagacucgaacagccuccccaccaccaccagcauaugucaaggagcacuugc

SEQ ID NO: 209983 - RNA, 64 nt, hsa
cucagccucccgaguagcugggacuacaggcgcccaccaccaugcccggcuaauuuuuguuuuu

SEQ ID NO: 209984 - RNA, 64 nt, hsa
cucagccucucaaguggcugggaccacagaagugcaccaccaugccuggcuuuuuuuuuuuuuu

SEQ ID NO: 209985 - RNA, 64 nt, hsa
cuuagccucccaaguagcugggauuacaggcgugcaccaccacgcccaguugauuuuuguauuu

SEQ ID NO: 209986 - RNA, 64 nt, hsa
ccucagccaccugacuagcugggauugcagccugcaccaccacaccuggcuaaauuuuuguugu

SEQ ID NO: 209987 - RNA, 64 nt, hsa
aguaggcgcuggccacccggcccugccuucccaccaccaccaccgugcauggggcagcaaacac

SEQ ID NO: 209988 - RNA, 64 nt, hsa
gcaaguaggcgcuggccacccggcccugccuucccaccaccaccaccgugcauggggcagcaaa

SEQ ID NO: 209989 - RNA, 64 nt, hsa
aagacuauccuuaccuuuuaguuucagcaguccucaccaccaccauauccccagugcugggaug

SEQ ID NO: 209990 - RNA, 64 nt, hsa
acuauccuuaccuuuuaguuucagcaguccucaccaccaccauauccccagugcugggauggca

SEQ ID NO: 209991 - RNA, 64 nt, hsa
cugcaccccaaauaugaacaacugcagcaggugccaccaccaccacaaaagacaccacuacccu

SEQ ID NO: 209992 - RNA, 64 nt, hsa
caccccaaauaugaacaacugcagcaggugccaccaccaccacaaaagacaccacuacccuugu

SEQ ID NO: 209993 - RNA, 64 nt, hsa
uuaugauugucuuguugauuaaauuguucaugcucaccaccaccaauaagguauuuuucucuga

SEQ ID NO: 209994 - RNA, 64 nt, hsa
ugauugucuuguugauuaaauuguucaugcucaccaccaccaauaagguauuuuucucugauug

SEQ ID NO: 209995 - RNA, 64 nt, hsa
cucagccucccaaguaacuaagacuacaggcaugcaccaccauacccaacuaauuuuauuuuuu

SEQ ID NO: 209996 - RNA, 64 nt, hsa
ccucccaggucagccucccaaguagcugggauuacaccaccaugcccagcuacuaaaaauacuu

SEQ ID NO: 209997 - RNA, 64 nt, hsa
uucagacaucugcaugagugacaaacuuucugaacaccaccaccaccaauaauacuuaucagca

SEQ ID NO: 209998 - RNA, 64 nt, hsa
agacaucugcaugagugacaaacuuucugaacaccaccaccaccaauaauacuuaucagcauca

SEQ ID NO: 209999 - RNA, 64 nt, hsa
caucugcaugagugacaaacuuucugaacaccaccaccaccaauaauacuuaucagcaucauaa

SEQ ID NO: 210000 - RNA, 64 nt, hsa
aaaaaaauaauaauaauaaaaugaaagaaacaaucaccaccaccauuauuaaacuguaacuugu

SEQ ID NO: 210001 - RNA, 64 nt, hsa
aaaauaauaauaauaaaaugaaagaaacaaucaccaccaccauuauuaaacuguaacuugucua

SEQ ID NO: 210002 - RNA, 64 nt, hsa
gagaccccaccaccaccaccaccaccaacaccaccaccaccaccgcgagcuggagcgcgcacca

SEQ ID NO: 210003 - RNA, 64 nt, hsa
agggagaccccaccaccaccaccaccaccaacaccaccaccaccaccgcgagcuggagcgcgca

SEQ ID NO: 210004 - RNA, 64 nt, hsa
cgcagggagaccccaccaccaccaccaccaccaacaccaccaccaccaccgcgagcuggagcgc

SEQ ID NO: 210005 - RNA, 64 nt, hsa
agggacagacgcagggagaccccaccaccaccaccaccaccaacaccaccaccaccaccgcgag

SEQ ID NO: 210006 - RNA, 64 nt, hsa
cuaagggacagacgcagggagaccccaccaccaccaccaccaccaacaccaccaccaccaccgc

SEQ ID NO: 210007 - RNA, 64 nt, hsa
cgucuaagggacagacgcagggagaccccaccaccaccaccaccaccaacaccaccaccaccac

SEQ ID NO: 210008 - RNA, 64 nt, hsa
cuacgucuaagggacagacgcagggagaccccaccaccaccaccaccaccaacaccaccaccac

SEQ ID NO: 210009 - RNA, 64 nt, hsa
ggacuacgucuaagggacagacgcagggagaccccaccaccaccaccaccaccaacaccaccac

SEQ ID NO: 210010 - RNA, 64 nt, hsa
gaucuuacuccagccucccaagcagcugggacuacaccaccacagguaugcaccaccauaccug

SEQ ID NO: 210011 - RNA, 64 nt, hsa
cccaagcagcugggacuacaccaccacagguaugcaccaccauaccuggcugauuuuuaaaauu

SEQ ID NO: 210012 - RNA, 64 nt, hsa
accaccgccaccaccaccaacaccgccacaccaacaccaccacuacaaaaaaaaaagaauuaau

SEQ ID NO: 210013 - RNA, 64 nt, hsa
ccucccuucccccaauacacagaaccaccgccaccaccaccaacaccgccacaccaacaccacc

SEQ ID NO: 210014 - RNA, 64 nt, hsa
aacccucccuucccccaauacacagaaccaccgccaccaccaccaacaccgccacaccaacacc

SEQ ID NO: 210015 - RNA, 64 nt, hsa
ugggcugauaaccaaauuuuaacacaucagcauucaccaccagguuuacuuuuauuuucagauu

SEQ ID NO: 210016 - RNA, 64 nt, hsa
cucagccucccgaguagcugggauuacaggcacccaccaccacgcccagcuaauuuuuguauuu

SEQ ID NO: 210017 - RNA, 64 nt, hsa
cuuagccucccaaguaccugggacuacaggcacgcaccaccaugccuagcuauucuuuuguauu

SEQ ID NO: 210018 - RNA, 64 nt, hsa
gucugggccaggcagaggugcuccucauccaugacaccaccagucugaaugguccugggggcug

SEQ ID NO: 210019 - RNA, 64 nt, hsa
augguccugggggcuggggcuggagaggccgcugcaccaccacccgagccugggagccagcguc

SEQ ID NO: 210020 - RNA, 64 nt, hsa
gccagcccaccagcagccccacucacagcugcugcaccaccaccuuccgcaggaugcacaggug

SEQ ID NO: 210021 - RNA, 64 nt, hsa
ucauccguccuuggcucaggauuuggagagcuugcaccaccaaaaauggcaaacaucaccagcu

SEQ ID NO: 210022 - RNA, 64 nt, hsa
aucuggaccccagagccagcccucccacuaccaccaccaccaccccggggcuccuuggcucacc

SEQ ID NO: 210023 - RNA, 64 nt, hsa
aucaucuggaccccagagccagcccucccacuaccaccaccaccaccccggggcuccuuggcuc

SEQ ID NO: 210024 - RNA, 64 nt, hsa
aguagucccaggaguagcugggacuacaggugcccaccaccacacccagcuaauuuuuuuguau

SEQ ID NO: 210025 - RNA, 64 nt, hsa
cagccuccugaguagccggggagcuacaagcaugcaccaccacacccagcuaauuuuuuuuuuu

SEQ ID NO: 210026 - RNA, 64 nt, hsa
gagugccacuuccccacccgggaaaggcugccgccaccaccaccaccaacacaacagcaauggc

SEQ ID NO: 210027 - RNA, 64 nt, hsa
ugccacuuccccacccgggaaaggcugccgccaccaccaccaccaacacaacagcaauggcaac

SEQ ID NO: 210028 - RNA, 64 nt, hsa
cacuuccccacccgggaaaggcugccgccaccaccaccaccaacacaacagcaauggcaacacc

SEQ ID NO: 210029 - RNA, 64 nt, hsa
uagcgaccaggcuugggcuuccccagcgccccaccaccaccacgugcagguggagcucugggau

SEQ ID NO: 210030 - RNA, 64 nt, hsa
cauuagcgaccaggcuugggcuuccccagcgccccaccaccaccacgugcagguggagcucugg

SEQ ID NO: 210031 - RNA, 64 nt, hsa
ccuucugagagcuuggugaaggugucuccaucaccaccaccagagccuccugcccagcccuggc

SEQ ID NO: 210032 - RNA, 64 nt, hsa
aagccuucugagagcuuggugaaggugucuccaucaccaccaccagagccuccugcccagcccu

SEQ ID NO: 210033 - RNA, 64 nt, hsa
ccucagcccccagguaacugggacuacaggcaugcaccaccaugccuggcuaauuuuuguauuu

SEQ ID NO: 210034 - RNA, 64 nt, hsa
cucggccucuccaguagcugggauuacaggugugcaccaccacgccuggcuaaauuuuguauuu

SEQ ID NO: 210035 - RNA, 64 nt, hsa
ccucacagccaugcccagaagccucacaccucgucaccaccaccaccccccaccccauccugag

SEQ ID NO: 210036 - RNA, 64 nt, hsa
cacagccaugcccagaagccucacaccucgucaccaccaccaccccccaccccauccugaggca

SEQ ID NO: 210037 - RNA, 64 nt, hsa
uuuuuuaaagaaacuggggaaggauuuaugaauacaccaccaccagaguggauaaugcuuagaa

SEQ ID NO: 210038 - RNA, 64 nt, hsa
uuuaaagaaacuggggaaggauuuaugaauacaccaccaccagaguggauaaugcuuagaauuc

SEQ ID NO: 210039 - RNA, 64 nt, hsa
auuugcauccuucuuccugagccaacugcuugggcaccaccacagcgucuucuauagcucggug

SEQ ID NO: 210040 - RNA, 64 nt, hsa
acccacccucucccaccucaugcuccugcaccugcaccaccaagguugaugccggauucgaagc

SEQ ID NO: 210041 - RNA, 64 nt, hsa
uuggaauuuucuggcacuuccucucuauugcccccaccaccaccacccccaucacugcuuucuc

SEQ ID NO: 210042 - RNA, 64 nt, hsa
gaauuuucuggcacuuccucucuauugcccccaccaccaccacccccaucacugcuuucuccca

SEQ ID NO: 210043 - RNA, 64 nt, hsa
ucuucagcacauugacccauagcacacacauacacaccaccaccaacaacgcuugugaauguau

SEQ ID NO: 210044 - RNA, 64 nt, hsa
ucagcacauugacccauagcacacacauacacaccaccaccaacaacgcuugugaauguauuuu

SEQ ID NO: 210045 - RNA, 64 nt, hsa
uguacguggccauggccagacaccccagucccuucaccaccaccugcuccccacgccaccacca

SEQ ID NO: 210046 - RNA, 64 nt, hsa
ccccagucccuucaccaccaccugcuccccacgccaccaccauuuggguggcuguuuuuaaaaa

SEQ ID NO: 210047 - RNA, 64 nt, hsa
cucaaagacucaagugggaacgacugggcacugccaccaccagaaagcuguucgacgagacggu

SEQ ID NO: 210048 - RNA, 64 nt, hsa
gucuugcccagaggaucacagugcugagaccccccaccaccagccgguaccugggaagggggag

SEQ ID NO: 210049 - RNA, 64 nt, hsa
gggacugacuccagagcccccuccuaagaaccaucaccaccacucagccaaucuguucugggcc

SEQ ID NO: 210050 - RNA, 64 nt, hsa
cggucauugccuccaugcccuugcuuggcucaagcaccaccaaucgcuuuaaugcuucagccac

SEQ ID NO: 210051 - RNA, 64 nt, hsa
cuuccuucucuaccaucacuccuguggcggucaccaccaccaccucucccgcccuuaccagcag

SEQ ID NO: 210052 - RNA, 64 nt, hsa
caucuuccuucucuaccaucacuccuguggcggucaccaccaccaccucucccgcccuuaccag

SEQ ID NO: 210053 - RNA, 56 nt, hsa
ugcgcuucuccaucaacugaagaagacaccaccauucugaggccagggagcgagug

SEQ ID NO: 210054 - RNA, 64 nt, hsa
cucagccucccaaguagcugagacuacaggcacacaccaccacgccuggcuaauuuuuguauuu

SEQ ID NO: 210055 - RNA, 64 nt, hsa
cugcccgcguuucagggccucgguccauagagaacaccaccaccauggccagguggaaggguuu

SEQ ID NO: 210056 - RNA, 64 nt, hsa
cccgcguuucagggccucgguccauagagaacaccaccaccauggccagguggaaggguuuauu

SEQ ID NO: 210057 - RNA, 64 nt, hsa
ugggcaacagagacccugucucaaccaccaccaccaccaccaccccuacuaccccuguauucaa

SEQ ID NO: 210058 - RNA, 64 nt, hsa
gccugggcaacagagacccugucucaaccaccaccaccaccaccaccccuacuaccccuguauu

SEQ ID NO: 210059 - RNA, 64 nt, hsa
ccagccugggcaacagagacccugucucaaccaccaccaccaccaccaccccuacuaccccugu

SEQ ID NO: 210060 - RNA, 64 nt, hsa
acuccagccugggcaacagagacccugucucaaccaccaccaccaccaccaccccuacuacccc

SEQ ID NO: 210061 - RNA, 64 nt, hsa
cauaggcuggcacucucaauccuacaucaggugccaccaccaccagacucaggcccugguguaa

SEQ ID NO: 210062 - RNA, 64 nt, hsa
aggcuggcacucucaauccuacaucaggugccaccaccaccagacucaggcccugguguaagaa

SEQ ID NO: 210063 - RNA, 64 nt, hsa
gccuccugaagccucugggaacuccuccuguggccaccaccaaaggaugaggaaucugaguugc

SEQ ID NO: 210064 - RNA, 64 nt, hsa
guucacaccccaaaaugacccaacgauguccacacaccaccaaaacccagccaaugggccaccu

SEQ ID NO: 210065 - RNA, 64 nt, hsa
cgguggggagggucguccgguaucccccagugcccaccaccaccaaccagaaucacuucucaga

SEQ ID NO: 210066 - RNA, 64 nt, hsa
uggggagggucguccgguaucccccagugcccaccaccaccaaccagaaucacuucucagacug

SEQ ID NO: 210067 - RNA, 64 nt, hsa
caggacuucccuuaacaguuuccggaucagugaccaccaccacguucagguuucugaaugcaga

SEQ ID NO: 210068 - RNA, 64 nt, hsa
ucuguccuggcagggaaacauacaccccuugucucaccaccaaccuugcuuguguagucagcag

SEQ ID NO: 210069 - RNA, 64 nt, hsa
aaauucugacaguguuuuucuuccucuuucauaccaccaccaccacaaucaucaacauaaagga

SEQ ID NO: 210070 - RNA, 64 nt, hsa
uucugacaguguuuuucuuccucuuucauaccaccaccaccacaaucaucaacauaaaggaagu

SEQ ID NO: 210071 - RNA, 55 nt, hsa
cugaguagcugggauuaugaguacacaccaccacgcccagcuaauuuuuguguuu

SEQ ID NO: 210072 - RNA, 64 nt, hsa
cucagccucccgaguagcagggauuaccggugugcaccaccaugccuggauaacuuuuuuuuuu

SEQ ID NO: 210073 - RNA, 64 nt, hsa
uguauuuccuccauuuuccugcuaugaaauauaucaccaccagcuugauucaaccuuaaaaaua

SEQ ID NO: 210074 - RNA, 64 nt, hsa
cucagccucccgaguagcugggauuacaggcgcccaccaccaugcccggcuaguuuuuuuguau

SEQ ID NO: 210075 - RNA, 64 nt, hsa
agaaaaucccaccuccccugaccuccaccaccuccaccaccaccaccaccaccaccaccaccac

SEQ ID NO: 210076 - RNA, 64 nt, hsa
aaaucccaccuccccugaccuccaccaccuccaccaccaccaccaccaccaccaccaccacuac

SEQ ID NO: 210077 - RNA, 64 nt, hsa
ucccaccuccccugaccuccaccaccuccaccaccaccaccaccaccaccaccaccacuaccac

SEQ ID NO: 210078 - RNA, 64 nt, hsa
caccuccccugaccuccaccaccuccaccaccaccaccaccaccaccaccaccacuaccaccac

SEQ ID NO: 210079 - RNA, 64 nt, hsa
cuccccugaccuccaccaccuccaccaccaccaccaccaccaccaccaccacuaccaccaccac

SEQ ID NO: 210080 - RNA, 64 nt, hsa
cccugaccuccaccaccuccaccaccaccaccaccaccaccaccaccacuaccaccaccaccca

SEQ ID NO: 210081 - RNA, 64 nt, hsa
ugaccuccaccaccuccaccaccaccaccaccaccaccaccaccacuaccaccaccacccaacu

SEQ ID NO: 210082 - RNA, 64 nt, hsa
ccuccaccaccuccaccaccaccaccaccaccaccaccaccacuaccaccaccacccaacuggg

SEQ ID NO: 210083 - RNA, 64 nt, hsa
ccaccaccaccaccaccaccaccaccaccacuaccaccaccacccaacuggggcuagagugggg

SEQ ID NO: 210084 - RNA, 64 nt, hsa
aggcugccagcagcucucuggugcaucgucucaacaccaccaaguuuguaggaccugcccaagu

SEQ ID NO: 210085 - RNA, 64 nt, hsa
cuuccugagggcuguagccagguccgcaucuccccaccaccaccagggcacucacucgcagcua

SEQ ID NO: 210086 - RNA, 64 nt, hsa
ccugagggcuguagccagguccgcaucuccccaccaccaccagggcacucacucgcagcuauag

SEQ ID NO: 210087 - RNA, 64 nt, hsa
ccuuaauggcugcuugcugccauaugugacaaaucaccaccaccaguguuaagugcuucuggau

SEQ ID NO: 210088 - RNA, 64 nt, hsa
uaauggcugcuugcugccauaugugacaaaucaccaccaccaguguuaagugcuucuggauuca

SEQ ID NO: 210089 - RNA, 64 nt, hsa
cucagccuccagaauagcugggauuacaggcguacaccaccaugccuggcuaauuuuuuuguau

SEQ ID NO: 210090 - RNA, 64 nt, hsa
ucauuuucagaaaaucuacaagucucguugagaccaccaccauaccucagaagguaggacugug

SEQ ID NO: 210091 - RNA, 64 nt, hsa
gcccccugcggcggaggccaacgcagggcaccaccaccaccaacuugaauuccgucaucaaugc

SEQ ID NO: 210092 - RNA, 64 nt, hsa
cuggcccccugcggcggaggccaacgcagggcaccaccaccaccaacuugaauuccgucaucaa

SEQ ID NO: 210093 - RNA, 64 nt, hsa
acacuggcccccugcggcggaggccaacgcagggcaccaccaccaccaacuugaauuccgucau

SEQ ID NO: 210094 - RNA, 64 nt, hsa
gcaucaucaccaugguaacaguucccaucaccaucaccaccaccaccaccaucaccaccaccau

SEQ ID NO: 210095 - RNA, 64 nt, hsa
ucaucaccaugguaacaguucccaucaccaucaccaccaccaccaccaucaccaccaccaugga

SEQ ID NO: 210096 - RNA, 64 nt, hsa
ucaccaugguaacaguucccaucaccaucaccaccaccaccaccaucaccaccaccauggacaa

SEQ ID NO: 210097 - RNA, 64 nt, hsa
ccaugguaacaguucccaucaccaucaccaccaccaccaccaucaccaccaccauggacaacaa

SEQ ID NO: 210098 - RNA, 64 nt, hsa
caguucccaucaccaucaccaccaccaccaccaucaccaccaccauggacaacaagccuugggu

SEQ ID NO: 210099 - RNA, 64 nt, hsa
uucccaucaccaucaccaccaccaccaccaucaccaccaccauggacaacaagccuuggguaac

SEQ ID NO: 210100 - RNA, 64 nt, hsa
gccaaggcugccugccgugcaccaccaccaccaccaccaccaugcuguguggccaccuggggcu

SEQ ID NO: 210101 - RNA, 64 nt, hsa
caggccaaggcugccugccgugcaccaccaccaccaccaccaccaugcuguguggccaccuggg

SEQ ID NO: 210102 - RNA, 64 nt, hsa
ugccaggccaaggcugccugccgugcaccaccaccaccaccaccaccaugcuguguggccaccu

SEQ ID NO: 210103 - RNA, 64 nt, hsa
agcugccaggccaaggcugccugccgugcaccaccaccaccaccaccaccaugcuguguggcca

SEQ ID NO: 210104 - RNA, 64 nt, hsa
acgagcugccaggccaaggcugccugccgugcaccaccaccaccaccaccaccaugcugugugg

SEQ ID NO: 210105 - RNA, 64 nt, hsa
cccacgagcugccaggccaaggcugccugccgugcaccaccaccaccaccaccaccaugcugug

SEQ ID NO: 210106 - RNA, 64 nt, hsa
cuucuagcuggaagccagcccagcguuucucuaccaccaccaccaugccuccaccugacuuugg

SEQ ID NO: 210107 - RNA, 64 nt, hsa
cuagcuggaagccagcccagcguuucucuaccaccaccaccaugccuccaccugacuuuggcuu

SEQ ID NO: 210108 - RNA, 64 nt, hsa
acauacccacuucacacacacacaucccaaauaccaccaccaaccaccuucuuccucucaacuc

SEQ ID NO: 210109 - RNA, 64 nt, hsa
gccaagcccuuuuuagugcugugcucguccagcucaccaccacagccccucucagcccucagua

SEQ ID NO: 210110 - RNA, 64 nt, hsa
gcgaacguggggugauucacagcacaaaagaccucaccaccacaccugcacucaccccaccuug

SEQ ID NO: 210111 - RNA, 64 nt, hsa
agggcaggauggggacaggaucaccugcccgggacaccaccauuaucauucuccucuagugacg

SEQ ID NO: 210112 - RNA, 64 nt, hsa
uucagccucccgaguagcugggauuacaggcaugcaccaccacaccuggcuaauuuuuguguuu

SEQ ID NO: 210113 - RNA, 64 nt, hsa
uucagccucccgaguagcugagauuauaggcgugcaccaccacaccuggcuaauuuuuguauuu

SEQ ID NO: 210114 - RNA, 63 nt, hsa
cagggccccagaagccaugacuacuaccaccaccaccaccaccccuucuggggucacuccauc

SEQ ID NO: 210115 - RNA, 60 nt, hsa
cagggccccagaagccaugacuacuaccaccaccaccaccaccccuucuggggucacucc

SEQ ID NO: 210116 - RNA, 57 nt, hsa
cagggccccagaagccaugacuacuaccaccaccaccaccaccccuucuggggucac

SEQ ID NO: 210117 - RNA, 64 nt, hsa
uucaucugcuucuuccacgcaccaccaccaccaccaccaccaucauggccauagccacgguggc

SEQ ID NO: 210118 - RNA, 64 nt, hsa
cucuucaucugcuucuuccacgcaccaccaccaccaccaccaccaucauggccauagccacggu

SEQ ID NO: 210119 - RNA, 64 nt, hsa
cuccucuucaucugcuucuuccacgcaccaccaccaccaccaccaccaucauggccauagccac

SEQ ID NO: 210120 - RNA, 64 nt, hsa
ugccuccucuucaucugcuucuuccacgcaccaccaccaccaccaccaccaucauggccauagc

SEQ ID NO: 210121 - RNA, 64 nt, hsa
cucugccuccucuucaucugcuucuuccacgcaccaccaccaccaccaccaccaucauggccau

SEQ ID NO: 210122 - RNA, 64 nt, hsa
ggccucugccuccucuucaucugcuucuuccacgcaccaccaccaccaccaccaccaucauggc

SEQ ID NO: 210123 - RNA, 64 nt, hsa
accaccaaccacgaccaccaccaccaccaccacucaccaccaucaucaccuccggaaaguguag

SEQ ID NO: 210124 - RNA, 64 nt, hsa
cacugccaccaccaccaaccacgaccaccaccaccaccaccacucaccaccaucaucaccuccg

SEQ ID NO: 210125 - RNA, 64 nt, hsa
caccacugccaccaccaccaaccacgaccaccaccaccaccaccacucaccaccaucaucaccu

SEQ ID NO: 210126 - RNA, 64 nt, hsa
agacaccacugccaccaccaccaaccacgaccaccaccaccaccaccacucaccaccaucauca

SEQ ID NO: 210127 - RNA, 64 nt, hsa
uacagacaccacugccaccaccaccaaccacgaccaccaccaccaccaccacucaccaccauca

SEQ ID NO: 210128 - RNA, 64 nt, hsa
uuaaguccccaacccuuacagacaccacugccaccaccaccaaccacgaccaccaccaccacca

SEQ ID NO: 210129 - RNA, 64 nt, hsa
gcuuuaaguccccaacccuuacagacaccacugccaccaccaccaaccacgaccaccaccacca

SEQ ID NO: 210130 - RNA, 64 nt, hsa
uucacuuaaaaauuaaaaacaucaguacuaccaccaccaccaacaacaucaacacagaucuuca

SEQ ID NO: 210131 - RNA, 64 nt, hsa
uccuucacuuaaaaauuaaaaacaucaguacuaccaccaccaccaacaacaucaacacagaucu

SEQ ID NO: 210132 - RNA, 64 nt, hsa
uuuaaauuucuacuuaagggcaaguaauuugagaauucugaaauuaagcaugaugcuuagauug

SEQ ID NO: 210133 - RNA, 64 nt, hsa
uaaaauaauucccuucucccauuccuugucugccauucugaauaugcuuauuaaaauauuuuuu

SEQ ID NO: 210134 - RNA, 64 nt, hsa
ccccccacccaccgcaagcuuugagugggacaccauucugaauuuuuuuucugaauuuuuuuuu

SEQ ID NO: 210135 - RNA, 64 nt, hsa
uccuucuuccccaauaugccugcgccaucuucacauucugaaguugaaacccaugaucaccccu

SEQ ID NO: 210136 - RNA, 64 nt, hsa
ccagggauccuccuccuuucucuuuuacuucugaauucugaaauucaguuaguuacuuuugccu

SEQ ID NO: 210137 - RNA, 64 nt, hsa
auuuuuggugugaaaauuauuuaguugccaguauauucugaagaaugucuucuugaucagucag

SEQ ID NO: 210138 - RNA, 64 nt, hsa
aauaauaugcccugcugaauacaugccauuucacauucugaaacuggguagagugguugggugu

SEQ ID NO: 210139 - RNA, 64 nt, hsa
aaagaaauagggugauuuuuaaaggauuaauaaaauucugaaauguuaaguagaagauuacauu

SEQ ID NO: 210140 - RNA, 64 nt, hsa
gauaaauucagaaaugcucuaagcuaccaaaguuauucugaaaguaugggaacugcuacaacua

SEQ ID NO: 210141 - RNA, 64 nt, hsa
agugaaucuaaucuuaaaacuacaaguuguaaguauucugaaauugggaaacauuuauuuuaaa

SEQ ID NO: 210142 - RNA, 64 nt, hsa
gguaacuuuguggcaaaaauuuucaauauaauacauucugaaacaauaguugcugccuugcaaa

SEQ ID NO: 210143 - RNA, 64 nt, hsa
ugacuguuucccuuuccuucaaggccuagaguauauucugaaaauuuaggaaugaggaagaaau

SEQ ID NO: 210144 - RNA, 64 nt, hsa
uagcuugagccugaaaugcaaaacccauggaggaauucugaagccauugucuccuugaguacca

SEQ ID NO: 210145 - RNA, 64 nt, hsa
auuuaaaaaacuaucuuuuugcuuacaguuuuaaauucugaacaauucucucuuauauguguau

SEQ ID NO: 210146 - RNA, 64 nt, hsa
ugcccccuagggucuauaauuccuuaaaauuuucauucugaaucugaaggagagagucuuuuaa

SEQ ID NO: 210147 - RNA, 64 nt, hsa
aauauuaagcuaaaagguuuccacuauuauagaaauucugaauuuugguaaaucacacucaaac

SEQ ID NO: 210148 - RNA, 64 nt, hsa
auaucuguaaucauaucuacaugcaauguuaguaauucugaaguuuuuuaaauuuauggcuauu

SEQ ID NO: 210149 - RNA, 64 nt, hsa
acuauagaugucuauacugugaaaaguguuuucaauucugaaaaaaagcauacaucaugauuau

SEQ ID NO: 210150 - RNA, 64 nt, hsa
acaggcuaaaauuaguuuuaaaauacuauauuaaauucugaaugcaauuuuuuuuuguucccuu

SEQ ID NO: 210151 - RNA, 64 nt, hsa
ugguucuacuuccuguaauguacaauuuuauauaauucugaaauguuuuuaauguauuugugca

SEQ ID NO: 210152 - RNA, 64 nt, hsa
uagaugaaauagugauguagcaaaaaccuaguaaauucugaaugcuuuuccacguagacuuauc

SEQ ID NO: 210153 - RNA, 64 nt, hsa
uaccaugguguuccuuaaaagaagaaaauuucuaauucugaacucaauguuuugcuuuuacucc

SEQ ID NO: 210154 - RNA, 64 nt, hsa
aaaauacaaaauuggaucaagacauucacccuaaauucugaauuuuugucagaaaagagauuug

SEQ ID NO: 210155 - RNA, 64 nt, hsa
uaacaagauagccaaaagcauaggauuucuuaaaauucugaauucgucuuuucugagaaacaua

SEQ ID NO: 210156 - RNA, 64 nt, hsa
uagugucuuugcguuaaaaaaucauugcaaaaguauucugaacugucaagcugcccagucagau

SEQ ID NO: 210157 - RNA, 64 nt, hsa
uuuuaaacaaggcaaggucuaaugcuguuuugagauucugaaauuaaugaaaauacuuauuuca

SEQ ID NO: 210158 - RNA, 64 nt, hsa
ucugcagauuccaaacuggaauaagcucuaucauauucugaaacaagaauuagaaugacuugag

SEQ ID NO: 210159 - RNA, 64 nt, hsa
cugccuccuguuuauugagaacuaugcauugaacauucugaaucauucuaagccucuggagaga

SEQ ID NO: 210160 - RNA, 64 nt, hsa
cucuggcagcauaauuuugugguuaagagaaugaauucugaauguacacuuucugucucaaacc

SEQ ID NO: 210161 - RNA, 64 nt, hsa
gcaaaugaaagcauaagcuuaagcauuuuuucauauucugaagucucaccacacauaauaacca

SEQ ID NO: 210162 - RNA, 64 nt, hsa
aaaugaauucaaccucagcccugaaaauaacagaauucugaaguuuccuaugacuaauucacaa

SEQ ID NO: 210163 - RNA, 64 nt, hsa
caccagguuaaaauuuuaauuucuacaaaauaacauucugaaucaagcacacuguauguucagu

SEQ ID NO: 210164 - RNA, 64 nt, hsa
uauuugauucuuaacuaaaauuguucucuuaaauauucugaauccugguaauuaaaaguuuggg

SEQ ID NO: 210165 - RNA, 64 nt, hsa
aaauuuuauaacaguuucagugaauagagaaaaaauucugaacugaucauaaugaguuaaaagu

SEQ ID NO: 210166 - RNA, 64 nt, hsa
gcugauuugcuuuuuauuaaacugcaggaaauuaauucugaagaaggaaaagaaacugacaugg

SEQ ID NO: 210167 - RNA, 64 nt, hsa
auacaguacauuuuucuucuaauaugauggagacauucugaaucuuagacuuucugaggggguu

SEQ ID NO: 210168 - RNA, 64 nt, hsa
caaauggaguuacaggaauucucuguaaugagugauucugaagagguacuuuccuggaauaauu

SEQ ID NO: 210169 - RNA, 64 nt, hsa
aguaaaacuuaaugaaaaaagcaaagaaaaaaauauucugaacaaagcuauaggguuuuaaguu

SEQ ID NO: 210170 - RNA, 64 nt, hsa
cuuuuaguauguuuaucaaguggcuaacaaaugcauucugaaaauguauuuaacauagcuguuu

SEQ ID NO: 210171 - RNA, 64 nt, hsa
uuucuguucauauuaauucacuugccagacuccaauucugaaaguugucuaguucuuccuucau

SEQ ID NO: 210172 - RNA, 64 nt, hsa
auuuuuuuuaauguuuagauuuguagucuagucuauucugaagauauuugauuaauauauuucu

SEQ ID NO: 210173 - RNA, 64 nt, hsa
cucuaaguuuugaugugugggcuucugaguuuauauucugaaaggaaauacacuucuuuugaac

SEQ ID NO: 210174 - RNA, 64 nt, hsa
cuaacagaaauuaauuuaacugacaugcauauugauucugaaauuuuuuuccuaaguuuuuuuc

SEQ ID NO: 210175 - RNA, 64 nt, hsa
acuguguaugcuuuugaauuuuauuuuuaggaaaauucugaagccagcuaucacagguuuguua

SEQ ID NO: 210176 - RNA, 64 nt, hsa
aaaauuuguggugcuccuguaacaguaagaacuaauucugaaauaaaagacaucuccuaaugcu

SEQ ID NO: 210177 - RNA, 64 nt, hsa
augguuuuaagcugaacuugaaggacugguuccuauucugaaacaguaaaacuauguauaauag

SEQ ID NO: 210178 - RNA, 64 nt, hsa
auuaaggcucuacuuccagguugaguaggaauccauucugaacaaacuacaaaaaugugacugg

SEQ ID NO: 210179 - RNA, 64 nt, hsa
cagcugaauaaaugugucuaaaacagacucuuguauucugaaaguacagucuacaacugauaaa

SEQ ID NO: 210180 - RNA, 64 nt, hsa
acucuaauggcauuugaacauguaaucaccagagauucugaaaugacugguuuauguuaagcua

SEQ ID NO: 210181 - RNA, 64 nt, hsa
gauuacaaguuugagucuccuaguauucaacaucauucugaacccugaaauaauauuuuucucu

SEQ ID NO: 210182 - RNA, 64 nt, hsa
guuagccacaaucugucauauauaugucuuuuagauucugaauggugauuuaaaauuuucaaaa

SEQ ID NO: 210183 - RNA, 64 nt, hsa
uugaaaaucaacccaauaauucuguauuaacugaauucugaacuuuucaggagguacugugagg

SEQ ID NO: 210184 - RNA, 64 nt, hsa
aucauguugaagucaaauuuggauuuuccaccaaauucugaauuuguagacauacuuguacgcu

SEQ ID NO: 210185 - RNA, 64 nt, hsa
aaaucuagaaacaugaaauuaguauuccaaagagauucugaaauuucuuuucuuggggaaauga

SEQ ID NO: 210186 - RNA, 64 nt, hsa
cuuuguauaaagagaccugccuuuaaaaucauacauucugaacauuuuagucaagcuacaacag

SEQ ID NO: 210187 - RNA, 64 nt, hsa
uccccaggaaaaaaauaaaugccuuugaaugaaaauucugaaauuguaaaugucuauuuuaaua

SEQ ID NO: 210188 - RNA, 64 nt, hsa
aaauaaguaguuaagggcuuuugguauuaaagauauucugaagcucugaaaugcuagaaaaaaa

SEQ ID NO: 210189 - RNA, 64 nt, hsa
uucauauucucauucguuuuuuaaaaacugauauauucugaauuuauucuuccauugagaaaaa

SEQ ID NO: 210190 - RNA, 64 nt, hsa
auacauuaaaugguugauuuggggaggaaaacuuauucugaauauuaacgguggugaaaagggg

SEQ ID NO: 210191 - RNA, 64 nt, hsa
caaauucaaaugguguuuuuuuguaaaacacaagauucugaagacuuaguuauuuuaaaaaagu

SEQ ID NO: 210192 - RNA, 64 nt, hsa
uauauacacacgaagguugcuagggaaccacuucauucugaaaauguguaaaugaaaggaaagu

SEQ ID NO: 210193 - RNA, 64 nt, hsa
guucugagcagaagaggggcaugagcugauucacauucugaaggaccucucuagcuggccagug

SEQ ID NO: 210194 - RNA, 64 nt, hsa
ggccauugcauugaaggaggugggaaaugauuagauucugaacauauguaauuauuuuucaguc

SEQ ID NO: 210195 - RNA, 64 nt, hsa
uucuguguugacccuuuguccaguggaauuggugauucugaauuguccuuuacuaaugguguug

SEQ ID NO: 210196 - RNA, 64 nt, hsa
aauaaacuucugaaaacccaaggccagguacugcauucugaaucagaaucucgcaguguuucug

SEQ ID NO: 210197 - RNA, 64 nt, hsa
aaccaggaacuaauucuauaauggaaaacuauccauucugaauaauagguauguaauuauuugc

SEQ ID NO: 210198 - RNA, 64 nt, hsa
uguaauuauuugcugcugcugcugugcucuguaaauucugaauaugacauuuaaacucugugcc

SEQ ID NO: 210199 - RNA, 64 nt, hsa
ugccaaggcugaaucccugggcccagucagcccugcugcacauggcacaggcauugcacacggu

SEQ ID NO: 210200 - RNA, 64 nt, hsa
ugcaagggcugaguucccaggcccugccagcccugcugcacagggugcaggcauugcacacggu

SEQ ID NO: 210201 - RNA, 64 nt, hsa
uuggcugcaugaguugggcuuccccuuacccagggcugcacagccaggugugagggucaccggc

SEQ ID NO: 210202 - RNA, 64 nt, hsa
gucccaugcgugagugugguggugugaccuucaggcugcacagaggcaaggacccagauguggc

SEQ ID NO: 210203 - RNA, 64 nt, hsa
cacauucaggagccugacuuggaucagacuuggggcugcacaguggagcagguggguucccgug

SEQ ID NO: 210204 - RNA, 64 nt, hsa
uccucuaccugccacaccucagaggguuccuacagcugcacacaagcaguugagaguugaugac

SEQ ID NO: 210205 - RNA, 64 nt, hsa
augcauacaaaggacacacagggauuuugaaaaugcugcacaucccuuaauagucaucuacaua

SEQ ID NO: 210206 - RNA, 64 nt, hsa
aaaaguugauuuacuuuuuauuaaguucuccagagcugcacaacuaguuauguuuugauuuguu

SEQ ID NO: 210207 - RNA, 64 nt, hsa
uaauaaugcccucauauugaguggucuguaaacggcugcacacuucaggcacuguaguugcuga

SEQ ID NO: 210208 - RNA, 64 nt, hsa
caaguggaacagcagcaaguuuuucagugcauaugcugcacaagaacaaaauauaaaucuguau

SEQ ID NO: 210209 - RNA, 64 nt, hsa
guucgccugccagcccagagcccuggaggagccggcugcacagagaggcuuuucuucccagcug

SEQ ID NO: 210210 - RNA, 64 nt, hsa
aaugcagggcuccucauugcucccaucugccucugcugcacacacaggcaccagcagggaugcc

SEQ ID NO: 210211 - RNA, 64 nt, hsa
ggcuggaaagcagagccuccugggaacacaucuggcugcacaggcugaaauauccacccagcag

SEQ ID NO: 210212 - RNA, 60 nt, hsa; identical to SEQ ID NO: 44968

SEQ ID NO: 210213 - RNA, 64 nt, hsa
cgcagguuccugucccuccgggagaccuagagaagcugcacacccaggagcuuuccaugacccg

SEQ ID NO: 210214 - RNA, 64 nt, hsa
agaggcuggggcauuggcaagaucacagguugaugcugcacagccccauugacacaaacccuca

SEQ ID NO: 210215 - RNA, 64 nt, hsa
ccaagcuguaucuucgccauugcaucuacucuuugcugcacacacugugcuugcuccuggcuuu

SEQ ID NO: 210216 - RNA, 64 nt, hsa
guucugaaucuuccugaaguguacugacauuugggcugcacagagccccacaccuucacuuaca

SEQ ID NO: 210217 - RNA, 64 nt, hsa
cugggcauaggcuuccugauuccaagccuuuucugggagcaaagccagggccuggugccugauu

SEQ ID NO: 210218 - RNA, 64 nt, hsa
auuaagaaaccuacauggguggcauggggcucuggggagcaagcccuuacuugcucagcacugg

SEQ ID NO: 210219 - RNA, 64 nt, hsa
ccuuuucucucguggaagauaaaaccuggacucagggagcaaccacaggcucuccacuuugaaa

SEQ ID NO: 210220 - RNA, 64 nt, hsa
ccucugcucccccaaagcuguuucugauccugcugggagcaacuaacuaguuauuaugcacauc

SEQ ID NO: 210221 - RNA, 64 nt, hsa
uucuccguugcaaagaauguuuccuaaauuguaugggagcaauaguauuuuugauguuuuaaug

SEQ ID NO: 210222 - RNA, 64 nt, hsa
ccuuuccugcucauccccagugagcuaguggagagggagcaagggaggccgcagagggaaaaaa

SEQ ID NO: 210223 - RNA, 64 nt, hsa
ccuguacugcccugccaucucaggccaaagggaggggagcaaguggggaccuggccauggcccc

SEQ ID NO: 210224 - RNA, 64 nt, hsa
uggggcaagcggggaaguugggaugagugcgugugggagcaaagaguuaaaaaucacuaugcua

SEQ ID NO: 210225 - RNA, 64 nt, hsa
cucauagagcugccucccccaggauggugaaguugggagcaaaauggggcuucuguaaguagag

SEQ ID NO: 210226 - RNA, 64 nt, hsa
ggacugaggaggaguggagggaagcagggagggagggagcaagugugaagggcacagcugcugg

SEQ ID NO: 210227 - RNA, 64 nt, hsa
guaaccaauccugccagaccuguuuggggcaguggggagcaaaccuagauaaggaccuguuugg

SEQ ID NO: 210228 - RNA, 64 nt, hsa
agcaaaccuagauaaggaccuguuuggggcagcagggagcaaaaucuccuuuaacaaccaagca

SEQ ID NO: 210229 - RNA, 64 nt, hsa
aggaagccuggagccaagaaccuucuggcucugagggagcaagagcuggcaggcggcagggcug

SEQ ID NO: 210230 - RNA, 64 nt, hsa
ggcugcaaugucucuaccacaucccagcaccagggggagcaaacccugccccugcccgccucuc

SEQ ID NO: 210231 - RNA, 64 nt, hsa
aaacacgacauauuuaaagaagguucuuucaccugggagcaaaugaacaauagcuaagugucuu

SEQ ID NO: 210232 - RNA, 64 nt, hsa
guaaauuauuuguggcuuugcugagugaaggaaggggagcaagggguggugccccuggucccag

SEQ ID NO: 210233 - RNA, 64 nt, hsa
uauuuuaaugguguuacagcauuugcaaaaauuauucugcuaaguauuuacaacucuauuuauu

SEQ ID NO: 210234 - RNA, 64 nt, hsa
acauuugucgugguuaccagugcagccugucaaauucugcuauuugacacagcuuuggaaagau

SEQ ID NO: 210235 - RNA, 64 nt, hsa
ucugcuaacuccugcacagccccguccucuuccuuucugcuagccuggcuaaaucugcucauua

SEQ ID NO: 210236 - RNA, 64 nt, hsa
ugugcaaguaccgaccauagagcaagaaucaagauucugcuaacuccugcacagccccguccuc

SEQ ID NO: 210237 - RNA, 64 nt, hsa
uggucucacagcuuaauauuugguaaugaauaaauucugcuagugguauauguugaucugaacu

SEQ ID NO: 210238 - RNA, 64 nt, hsa
uccacacacuugaccaucuacuuuguauaacacauucugcuaaggcccagggauacaauggcaa

SEQ ID NO: 210239 - RNA, 64 nt, hsa
uugcugucauccccacuuuagucacgagaucuuuuucugcuaacuguucauagucuguguagug

SEQ ID NO: 210240 - RNA, 64 nt, hsa
cccugcugguucuaauauuaacagaacugcagucuucugcuagccaauagcauuuaccugaugg

SEQ ID NO: 210241 - RNA, 64 nt, hsa
uguuagugaugcacauguguaacagcccccucuaaaagcgcaagccagucauaccccuguauau

SEQ ID NO: 210242 - RNA, 64 nt, hsa
auaaccauguucuuugguaaugaagccagaaaagaaagcgcaaaagaauggugacucauuugga

SEQ ID NO: 210243 - RNA, 64 nt, hsa
ucuccagugucacuguucuguuuccacgggauggaaagcgcaugggccuguguccauuguagau

SEQ ID NO: 210244 - RNA, 64 nt, hsa
agaagaaagaaccaaccacaagcacacaggaaggaaagcgcaggaggugaaaaugcuuucuugg

SEQ ID NO: 210245 - RNA, 64 nt, hsa
gaguuguugagucuguuuuguaaaguccccagagaaagcgcagaugcuagcacaugcccuaaug

SEQ ID NO: 210246 - RNA, 64 nt, hsa
caaaagacaccagccacucagaguucuauacuguaaagcgcagauaacauuuguguguuauacc

SEQ ID NO: 210247 - RNA, 64 nt, hsa
aaaaggaaaagggcaaauugaaagucaaggagaaaaagcgcaaagaggagaaugaagauccaga

SEQ ID NO: 210248 - RNA, 64 nt, hsa
gaggcauugaaggguuuuucuuagaugccuagaaaaagcgcacugggcuguuuuaccuuucuuu

SEQ ID NO: 210249 - RNA, 64 nt, hsa
gcauagcuuuucccuguccugacaccaggcaagaaaagcgcagagaaaucggugucugacgauu

SEQ ID NO: 210250 - RNA, 64 nt, hsa
gaugggugacacuuggaguggcacaaguugggggaaagcgcacuugagacagagguaaugaugg

SEQ ID NO: 210251 - RNA, 64 nt, hsa
uuggucauugccuugccaaacaggagcuccagcaaaagcgcaggaagagagacuggccuccuug

SEQ ID NO: 210252 - RNA, 64 nt, hsa
uauauacaugagcuaacuuuuuuaaauugucacaaaagcgcaucuccagauuccagacccugcc

SEQ ID NO: 210253 - RNA, 64 nt, hsa
gucuucccaggccagagaaaguggaagagaccacaaagcgcaggcaauuggcaggcaguggggg

SEQ ID NO: 210254 - RNA, 62 nt, hsa
gccaccacaagacuaaguaaagaccgaguugaaaagcgcauaaaaacaaaggcucuuuucag

SEQ ID NO: 210255 - RNA, 64 nt, hsa
uucuguuuuccguguucguaacagaagggaggggaaagcgcagcuacugacaaguagaacacug

SEQ ID NO: 210256 - RNA, 64 nt, hsa
aaggagauauugugggguccguuuaacucgauagaaagcgcagggggauggcccccggcgcggg

SEQ ID NO: 210257 - RNA, 64 nt, hsa
agcaagacuaauggaaauguggagagaauugaagaaagcgcacuuucacucuuaaugggagagc

SEQ ID NO: 210258 - RNA, 64 nt, hsa
ugauucuccugugccacaggaaaagagggccuggaaagcgcagugcaugcugggugcaugaagg

SEQ ID NO: 210259 - RNA, 64 nt, hsa
gugacugccugcagaaagaccagcaguugauauuaaagcgcaaaugaauucaaccucagcccug

SEQ ID NO: 210260 - RNA, 64 nt, hsa
agacucgagagggggaggggguaaggagcgcaccaaagcgcagagcuugcugcccgccgcacgc

SEQ ID NO: 210261 - RNA, 64 nt, hsa
accucacauggggccuuuucugagcaaggucucgaaagcgcaggccgcccuggcugagcagcac

SEQ ID NO: 210262 - RNA, 64 nt, hsa
gcaucuucuucccuccuucuacuguacuggauuuaaagcgcaccuuauagagacaucauauacu

SEQ ID NO: 210263 - RNA, 64 nt, hsa
uuaaugcuuaauacauacauggugcaaaauuuaaaaagcgcaaauagguaucuaguggaaaacc

SEQ ID NO: 210264 - RNA, 64 nt, hsa
guguauacaaagaaggcaaauucuuuaaucaaauaaagcgcauuauaaaaugagauguuuauug

SEQ ID NO: 210265 - RNA, 64 nt, hsa
agcauguugcuuuuguuuuuuuaaaaagcaaguaaaagcgcauuccuaaacagaguccgggggg

SEQ ID NO: 210266 - RNA, 64 nt, hsa
ugcagagguggggagguggcgaggauggggacagaaagcgcacagaaucuuggaccaggucucu

SEQ ID NO: 210267 - RNA, 64 nt, hsa
ucucuuaauguuguguaauugauuagguaacuaaaaagcgcaaauuguuggcagguuuugcugc

SEQ ID NO: 210268 - RNA, 64 nt, hsa
gcccaugucauuuaauugucaguuucuuugacauaaagcgcaucuucuccacaugggcuucacg

SEQ ID NO: 210269 - RNA, 64 nt, hsa
caaaagcauuauuacugauacuugcacacagucaaaagcgcagacuggauggauggucuuuuau

SEQ ID NO: 210270 - RNA, 64 nt, hsa
auuucaguggccuuuuuuuuuuuuuaaggaaaaaaaagcgcaaaaccaaguacauagugacgau

SEQ ID NO: 210271 - RNA, 64 nt, hsa
gcucuucaggagacugagacagagaagacaagugaaagcgcagccuguacaugacucucugugg

SEQ ID NO: 210272 - RNA, 64 nt, hsa
guucuccaccccucccccauacaaaauccacaacaaagcgcaguggucucuugugaaugacuga

SEQ ID NO: 210273 - RNA, 64 nt, hsa
gggauaacucagaggaacagacacucaaacucccaaagcgcaugauugcugggaaacaguagaa

SEQ ID NO: 210274 - RNA, 64 nt, hsa
uacuccuaaacuagcuauccaaaccuuacuauuaaaagcgcaggcagauuuaauuugcuaaaua

SEQ ID NO: 210275 - RNA, 64 nt, hsa
gacauccacuugcaaaauguuuggauguaauguuaaagcgcaaugugcaaaauuuaaaauaaag

SEQ ID NO: 210276 - RNA, 64 nt, hsa
uuccaggugcugcgcuuggcagaggggucucgccaaagcgcaugugugugcaugugugaacgug

SEQ ID NO: 210277 - RNA, 64 nt, hsa
ccccacucccaaugagcagcccaggccugggcaaaaagcgcaaaguguccuugcuuuucgacca

SEQ ID NO: 210278 - RNA, 64 nt, hsa
auauguaugugugcauaugucuguagcuguauauaaagcgcauguagagcuacagauccagaua

SEQ ID NO: 210279 - RNA, 64 nt, hsa
caguaugguacuuggacagcaggaaugauacauauaaucugaacuugggaaauuuuggaccuac

SEQ ID NO: 210280 - RNA, 64 nt, hsa
acuuugacucuaugaccuaugaagaauaaaaagauaaucugaagguguuugagucagaggcuac

SEQ ID NO: 210281 - RNA, 64 nt, hsa
uauacacuguaagcuuuguucugggaguugcuguuaaucugauguauaauguaauguuuuuauu

SEQ ID NO: 210282 - RNA, 64 nt, hsa
aauguaauguuuuuauuucaauuguuuauauggauaaucugagcagguacauuucugauucuga

SEQ ID NO: 210283 - RNA, 64 nt, hsa
agccaagccaagaggaugguuucaauaaaccuaauaaucugaaguucaguaucauuuugauuga

SEQ ID NO: 210284 - RNA, 64 nt, hsa
uucuucuacugcccugagccugaacgcuucugcuuaaucugagaaucacauuugguuuguugag

SEQ ID NO: 210285 - RNA, 64 nt, hsa
cacagucauauucacaaaccaauacugucauugcuaaucugaacuauuauuuuuauacuauaua

SEQ ID NO: 210286 - RNA, 64 nt, hsa
ugaguaaaauggucuuugauuaauaaacuuaguuuaaucugaauauguaaaugaauacauuuua

SEQ ID NO: 210287 - RNA, 64 nt, hsa
caauugauaaaguaaaugagguaaaauuuaacaauaaucugagcaaaagguauauguguuuucu

SEQ ID NO: 210288 - RNA, 64 nt, hsa
caauugauaaggcaaauaagguaacauuuaacaauaaucugauacacauaaauagagaaagagc

SEQ ID NO: 210289 - RNA, 64 nt, hsa
agcuaaugagguucuauuauaaagguucuacuuuuaaucugagggaaaacauguucagggcuuc

SEQ ID NO: 210290 - RNA, 64 nt, hsa
uggugccaaacuucgaauggaauacaaauucacauaaucugaacuuuguucacagguuauccua

SEQ ID NO: 210291 - RNA, 64 nt, hsa; identical to SEQ ID NO: 84425

SEQ ID NO: 210292 - RNA, 64 nt, hsa; identical to SEQ ID NO: 84426

SEQ ID NO: 210293 - RNA, 64 nt, hsa; identical to SEQ ID NO: 84427

SEQ ID NO: 210294 - RNA, 64 nt, hsa; identical to SEQ ID NO: 84428

SEQ ID NO: 210295 - RNA, 64 nt, hsa; identical to SEQ ID NO: 84429

SEQ ID NO: 210296 - RNA, 64 nt, hsa; identical to SEQ ID NO: 84430

SEQ ID NO: 210297 - RNA, 64 nt, hsa; identical to SEQ ID NO: 84431

SEQ ID NO: 210298 - RNA, 64 nt, hsa; identical to SEQ ID NO: 84432

SEQ ID NO: 210299 - RNA, 64 nt, hsa; identical to SEQ ID NO: 84433

SEQ ID NO: 210300 - RNA, 64 nt, hsa; identical to SEQ ID NO: 84434

SEQ ID NO: 210301 - RNA, 64 nt, hsa; identical to SEQ ID NO: 84435

SEQ ID NO: 210302 - RNA, 64 nt, hsa; identical to SEQ ID NO: 84436

SEQ ID NO: 210303 - RNA, 64 nt, hsa
ucucuguguuuuaugaagagaaaaugaucugauuuucccuuauacuucauuuuacaauacauau

SEQ ID NO: 210304 - RNA, 64 nt, hsa
uuuaucuguaggucaguguuccuugugcugucauuucccuuauaucuggaauuugucagcauuc

SEQ ID NO: 210305 - RNA, 64 nt, hsa
uucaaacagauuuguggcuguucuuuucugaaauuucccuuauucagguuucugugggaaaaau

SEQ ID NO: 210306 - RNA, 64 nt, hsa
uguuuuuuauuuuaucuaugcuaaaaugagcccuuucccuuauguccaguuuaagaugaucauu

SEQ ID NO: 210307 - RNA, 64 nt, hsa
aauuuacuuguuuuggauggcuugucuauacuccuucccuuaagggguaucauguauggugaua

SEQ ID NO: 210308 - RNA, 64 nt, hsa
gcuguuccuugguccuaguaagaagacaaacugcuucccuuacuuugcugaggguuugaauaaa

SEQ ID NO: 210309 - RNA, 64 nt, hsa
aaacauuuguucaaguucuaauaaaauuaauguuuucccuuaacauggcucaauaacuuaaaaa

SEQ ID NO: 210310 - RNA, 64 nt, hsa
cccugagaguacuccacgauuacuagguucuugauucccuuauauggcaaucaggcagaggcgu

SEQ ID NO: 210311 - RNA, 64 nt, hsa
gugaauaguggacaacugcccaugagcauuugacuucccuuacucuuugaugaucguagagaaa

SEQ ID NO: 210312 - RNA, 64 nt, hsa
ugcaauuaaaaauccuuauuucuuguucuagggcuucccuuaguuaaugguuauuauaaaccua

SEQ ID NO: 210313 - RNA, 64 nt, hsa
uuauuuucuuuuagagaggggaaagugugagcucuucccuuauuccuaauggcuauuuuugaag

SEQ ID NO: 210314 - RNA, 64 nt, hsa
cuaaaggacuugauguacauaacuccugucccuuuucccuuacaagguggggauugccccuggc

SEQ ID NO: 210315 - RNA, 64 nt, hsa
caugcaacuggaguuccuuaucccucucuuccccuucccuuauauauugaggcuaugggguagg

SEQ ID NO: 210316 - RNA, 64 nt, hsa
ugagguuuuuuaauaaccauuccuacuaucuguguucccuuagauacuccuguaauucuuaaug

SEQ ID NO: 210317 - RNA, 64 nt, hsa
ugguauaauauauaaagucagcagggacuccccuuucccuuagggcauacuacugucagucaga

SEQ ID NO: 210318 - RNA, 64 nt, hsa
ccagacaguugaugucuagauaggaccucaaugauucccuuagaaucuuagauaccaggauauu

SEQ ID NO: 210319 - RNA, 64 nt, hsa
gggagaacaaaauuguccaaaccaugcuguuuuuuucccuuaaauaaaucuuguauucuucagu

SEQ ID NO: 210320 - RNA, 64 nt, hsa
aaaaaaugccaugugauuguaauuauccuggauucagaauaauacugugauggggagccagauc

SEQ ID NO: 210321 - RNA, 64 nt, hsa
uucucucacaggcuugggaaauccuguuagcaugcagaauaaugugguaacuuugucaauuucc

SEQ ID NO: 210322 - RNA, 64 nt, hsa
ggaagaauaagagugcaccagaauaagagcgcaccagaauaagagcgcaccagcuaacaaugug

SEQ ID NO: 210323 - RNA, 64 nt, hsa
aaaucuucucuugaaaggaagaauaagagugcaccagaauaagagcgcaccagaauaagagcgc

SEQ ID NO: 210324 - RNA, 64 nt, hsa
uucuugccaguuaaaauuauaacuugcaaaugagcagaauaaaugagguuuuuuucaauuaaaa

SEQ ID NO: 210325 - RNA, 64 nt, hsa
gucuaaaugacuaaacuucaaaguaagauuuugucagaauaaauugagaccauuaaucuaauau

SEQ ID NO: 210326 - RNA, 64 nt, hsa
ccgaauuucaucauuuaucuaaagagaaaauaugcagaauaacuggucuuguuaagagugcaau

SEQ ID NO: 210327 - RNA, 64 nt, hsa
aacagaauuauaaaagcuuacuuuaaacaggaggcagaauaauucuuuuaggaaaccauuucau

SEQ ID NO: 210328 - RNA, 64 nt, hsa
accuauggauuucauguguuacaauaucaguuuccagaauaaagugagggaaaucaggucuuua

SEQ ID NO: 210329 - RNA, 64 nt, hsa
ucuauuaccacauuuucucuuauuaacaguaucucagaauaauuuucuuuccuuagaaaccuga

SEQ ID NO: 210330 - RNA, 64 nt, hsa
uuucaaaacaauuugcauuuagaguguuucgcaucagaauaacaugaguaagaugaacuggaac

SEQ ID NO: 210331 - RNA, 64 nt, hsa
uuuaaacaacuaaugcucuuugaagaaucauaaucagaauaaagauaaauucuugaucagcuau

SEQ ID NO: 210332 - RNA, 64 nt, hsa
aaaagcaauguaaaucagaauaaauauguuagaccagaauaaaauuaauuauauucuggucuuc

SEQ ID NO: 210333 - RNA, 64 nt, hsa
uucuguaauuauguuacauaaaagcaauguaaaucagaauaaauauguuagaccagaauaaaau

SEQ ID NO: 210334 - RNA, 64 nt, hsa
ccauagguucaacuacugcugaaagucuggauuucagaauaaagcagaauguaaguuucaguug

SEQ ID NO: 210335 - RNA, 64 nt, hsa
cuuaauuuuggcaaccacuagcaaaaaaacuugucagaauaauuuaaccaagccccucuccacu

SEQ ID NO: 210336 - RNA, 64 nt, hsa
aacaauuauccuaaagguuaauaguugaucgaaacagaauaauagaaaaauucuacuuuaauuu

SEQ ID NO: 210337 - RNA, 64 nt, hsa
uugaguuaaguguuuuuaauucagucagugaauucagaauaaguacauucauguauaacauagg

SEQ ID NO: 210338 - RNA, 64 nt, hsa
gcauuaaucagggcauaacuaauauucuccuguucagaauaauacuuauuuacgugugaaagca

SEQ ID NO: 210339 - RNA, 64 nt, hsa
aauccugggguugguauguaggaggucuauccugcagaauaaguugauacauuaguaccugauu

SEQ ID NO: 210340 - RNA, 64 nt, hsa
ccaaaugcagcuucauuuuccagauaccuugacgcagaauaaauuuuuucaucauuuaggugca

SEQ ID NO: 210341 - RNA, 64 nt, hsa
agauugcuccuaaauccaauuguuaaaauuggaucagaauaauuaucacaggaacuuaaauguu

SEQ ID NO: 210342 - RNA, 64 nt, hsa
caugucugugcugucuaguuuguguucaaaaugucagaauaaacacagaauaaauguucccacg

SEQ ID NO: 210343 - RNA, 64 nt, hsa
ugucuaguuuguguucaaaaugucagaauaaacacagaauaaauguucccacggccacacaguc

SEQ ID NO: 210344 - RNA, 64 nt, hsa
uaaaguaguguaauggauugacaaucaggaagaacagaauaacucaguuuuuuuucuccuacaa

SEQ ID NO: 210345 - RNA, 64 nt, hsa
uagagucuuguuauaguuguauaaaucaaaaacacagaauaaggaacauauuuaacuuuuuuuc

SEQ ID NO: 210346 - RNA, 64 nt, hsa
gggaaaauccacaccacacucuaaguggacagcucagaauaauuuagcauauuuccuuucacac

SEQ ID NO: 210347 - RNA, 64 nt, hsa
gauucaccacaaauuuucaugggcguugagugcucagaauaaugcuugaacaccucaccuugaa

SEQ ID NO: 210348 - RNA, 64 nt, hsa
guuacugucauucccauuccuuuucguuuagaaucagaauaaaguuguauuucaaauaucuaag

SEQ ID NO: 210349 - RNA, 64 nt, hsa
cuagggaagcacuugcucaaaaucugugaccugucagaauaaaaaugugguuuguacauaucaa

SEQ ID NO: 210350 - RNA, 64 nt, hsa
ugaucauuguugaacuucagcuccagugucucuccagaauaagacauuggcauucaaaugucua

SEQ ID NO: 210351 - RNA, 64 nt, hsa
uacuauacuucuggguugaacagaauuauuuaugcagaauaauucaauugaauauccaucacuu

SEQ ID NO: 210352 - RNA, 64 nt, hsa
ggauacacaucaaccacuuugcuguugaagcugucagaauaaauuccugguggucagaugaaag

SEQ ID NO: 210353 - RNA, 64 nt, hsa
gcccaacuuauauguuuuaaucucccuugucccucagaauaagcagaaaauauaacugcagcug

SEQ ID NO: 210354 - RNA, 64 nt, hsa
aaauucuuuuugauuauuuuuuguuuucauuuaccagaauaaaaacuaagaauuaaaaguuuga

SEQ ID NO: 210355 - RNA, 64 nt, hsa
uuacggaaaaauuagaaaaauucugauaauagugcagaauaaaugaauuaauguuuuacuuaau

SEQ ID NO: 210356 - RNA, 64 nt, hsa
uuaucugcagaacaucgauauguauaucauucuacagaauaauccaguauugcugauuuuaaag

SEQ ID NO: 210357 - RNA, 64 nt, hsa
uuggaaacugcuaaauucuauguuaaauacugugcagaauaauggaaacauuacaguucauaau

SEQ ID NO: 210358 - RNA, 64 nt, hsa
acauuguaaaacgugacaguaagacugauucuagcagaauaaaacauguacuacauuugcuaau

SEQ ID NO: 210359 - RNA, 64 nt, hsa
gacuucacacuguggacagcuuuucccaagaugucagaauaagacuccccaucaugaugaggcu

SEQ ID NO: 210360 - RNA, 64 nt, hsa
gucucuaaggaaggcagagaccuggguugagcagcagaauaaaagaucuucuuccaagaaaugc

SEQ ID NO: 210361 - RNA, 64 nt, hsa
aaguacacaauaguaagauuaugcucaauauucucagaauaauuuucaauguauuaaugaaaug

SEQ ID NO: 210362 - RNA, 64 nt, hsa
gucaaggguccacagggugccagccucucacccucagaauaaagacaucagccauucccuucug

SEQ ID NO: 210363 - RNA, 64 nt, hsa
agggccuuuguggacuagccaaggcugugagggccagaauaaacaacugcucaacaaagggugu

SEQ ID NO: 210364 - RNA, 64 nt, hsa
auuuguaaauaacuauguaaauagaaacagauaccagaauaaaucuacagcuagacccuuaguc

SEQ ID NO: 210365 - RNA, 64 nt, hsa
guaaaguuccuuaagucauauuugacugggcgugcagaauaacuucuuaacuuuuaacuaucag

SEQ ID NO: 210366 - RNA, 64 nt, hsa
aggcuuguuuaaugcaguaccauuggagaguuaacagaauaaucuaguagaaaaauaacugguu

SEQ ID NO: 210367 - RNA, 64 nt, hsa
uuuuucccaaguacauaaggaauacuugaaaauacagaauaacuaaauaguaucaaugcaucag

SEQ ID NO: 210368 - RNA, 64 nt, hsa
acaacugcauguuggauuagauugucucauauuucagaauaaaauguacuguauacuuuuccuc

SEQ ID NO: 210369 - RNA, 64 nt, hsa
gaccgaaucugaaacuuugggaauuugcuuuagccagaauaaagaaaccaaaucaugaaaauua

SEQ ID NO: 210370 - RNA, 64 nt, hsa; identical to SEQ ID NO: 210364

SEQ ID NO: 210371 - RNA, 64 nt, hsa
guaaaguuccuuaagucauauuugacugggcgugcagaauaacuucuuaacuauuaacuaucag

SEQ ID NO: 210372 - RNA, 64 nt, hsa
uaauacucuccucgacaagucaugcuguuuuaugcagaauaauccaggcgugagaguguucucu

SEQ ID NO: 210373 - RNA, 64 nt, hsa
caacucaguaggugagaauaauuaguagguucagcagaauaaacucuuuacaauuaauaacuca

SEQ ID NO: 210374 - RNA, 64 nt, hsa; identical to SEQ ID NO: 155946

SEQ ID NO: 210375 - RNA, 64 nt, hsa; identical to SEQ ID NO: 155947

SEQ ID NO: 210376 - RNA, 64 nt, hsa; identical to SEQ ID NO: 155948

SEQ ID NO: 210377 - RNA, 64 nt, hsa; identical to SEQ ID NO: 155949

SEQ ID NO: 210378 - RNA, 64 nt, hsa; identical to SEQ ID NO: 155950

SEQ ID NO: 210379 - RNA, 64 nt, hsa; identical to SEQ ID NO: 155951

SEQ ID NO: 210380 - RNA, 64 nt, hsa; identical to SEQ ID NO: 155952

SEQ ID NO: 210381 - RNA, 64 nt, hsa; identical to SEQ ID NO: 155953

SEQ ID NO: 210382 - RNA, 64 nt, hsa; identical to SEQ ID NO: 155954

SEQ ID NO: 210383 - RNA, 64 nt, hsa; identical to SEQ ID NO: 155955

SEQ ID NO: 210384 - RNA, 64 nt, hsa; identical to SEQ ID NO: 155956

SEQ ID NO: 210385 - RNA, 64 nt, hsa; identical to SEQ ID NO: 155957

SEQ ID NO: 210386 - RNA, 64 nt, hsa; identical to SEQ ID NO: 155958

SEQ ID NO: 210387 - RNA, 64 nt, hsa; identical to SEQ ID NO: 155959

SEQ ID NO: 210388 - RNA, 64 nt, hsa; identical to SEQ ID NO: 155960

SEQ ID NO: 210389 - RNA, 64 nt, hsa; identical to SEQ ID NO: 155961

SEQ ID NO: 210390 - RNA, 64 nt, hsa; identical to SEQ ID NO: 155962

SEQ ID NO: 210391 - RNA, 64 nt, hsa; identical to SEQ ID NO: 155963

SEQ ID NO: 210392 - RNA, 64 nt, hsa; identical to SEQ ID NO: 155964

SEQ ID NO: 210393 - RNA, 64 nt, hsa; identical to SEQ ID NO: 155965

SEQ ID NO: 210394 - RNA, 64 nt, hsa; identical to SEQ ID NO: 155966

SEQ ID NO: 210395 - RNA, 64 nt, hsa; identical to SEQ ID NO: 155967

SEQ ID NO: 210396 - RNA, 64 nt, hsa; identical to SEQ ID NO: 155968

SEQ ID NO: 210397 - RNA, 64 nt, hsa; identical to SEQ ID NO: 155969

SEQ ID NO: 210398 - RNA, 64 nt, hsa; identical to SEQ ID NO: 155970

SEQ ID NO: 210399 - RNA, 64 nt, hsa; identical to SEQ ID NO: 155971

SEQ ID NO: 210400 - RNA, 64 nt, hsa; identical to SEQ ID NO: 155972

SEQ ID NO: 210401 - RNA, 64 nt, hsa; identical to SEQ ID NO: 155973

SEQ ID NO: 210402 - RNA, 64 nt, hsa; identical to SEQ ID NO: 155974

SEQ ID NO: 210403 - RNA, 64 nt, hsa; identical to SEQ ID NO: 155975

SEQ ID NO: 210404 - RNA, 64 nt, hsa; identical to SEQ ID NO: 155976

SEQ ID NO: 210405 - RNA, 64 nt, hsa; identical to SEQ ID NO: 155977

SEQ ID NO: 210406 - RNA, 64 nt, hsa; identical to SEQ ID NO: 155978

SEQ ID NO: 210407 - RNA, 64 nt, hsa; identical to SEQ ID NO: 155979

SEQ ID NO: 210408 - RNA, 64 nt, hsa; identical to SEQ ID NO: 155980

SEQ ID NO: 210409 - RNA, 64 nt, hsa; identical to SEQ ID NO: 155981

SEQ ID NO: 210410 - RNA, 64 nt, hsa; identical to SEQ ID NO: 155982

SEQ ID NO: 210411 - RNA, 64 nt, hsa; identical to SEQ ID NO: 155983

SEQ ID NO: 210412 - RNA, 64 nt, hsa; identical to SEQ ID NO: 155984

SEQ ID NO: 210413 - RNA, 64 nt, hsa; identical to SEQ ID NO: 155985

SEQ ID NO: 210414 - RNA, 64 nt, hsa; identical to SEQ ID NO: 155986

SEQ ID NO: 210415 - RNA, 64 nt, hsa; identical to SEQ ID NO: 155987

SEQ ID NO: 210416 - RNA, 64 nt, hsa; identical to SEQ ID NO: 155988

SEQ ID NO: 210417 - RNA, 64 nt, hsa
ugggcagaauggcccuagaguucuuuucccugagaaaggagaaaaagaugggauugccacucac

SEQ ID NO: 210418 - RNA, 64 nt, hsa
uuuguugcuugguugguuuguugcuuuauuuuuaaaaggagaaguuuaacuuugcuauuuauuu

SEQ ID NO: 210419 - RNA, 64 nt, hsa
aaaagcaauugcuccaccuuacaaauuuggauagaaaggagauguaguuuauuucauaugggca

SEQ ID NO: 210420 - RNA, 64 nt, hsa
uggagggcaggcacgaagaacagugagauugucaaaaggagacaaccacagauccuacaggacu

SEQ ID NO: 210421 - RNA, 64 nt, hsa
uagauguguauguguagugcgauuuucuucaaggaaaggagacaaguccaaagcucguuugugg

SEQ ID NO: 210422 - RNA, 64 nt, hsa
augaguucaugcugauacucaaauuucuuuuuaaaaaggagaaacaggaagguuucuuuuggag

SEQ ID NO: 210423 - RNA, 64 nt, hsa
uuggugacuccaacuauggauagcuuauuuugaaaaaggagaauugcaaauuuuaccaaaagau

SEQ ID NO: 210424 - RNA, 64 nt, hsa
gguaguaaauuauagaauguauaagaaaaaauauaaaggagaaaaucaauuaucaggaaagcua

SEQ ID NO: 210425 - RNA, 64 nt, hsa
ucuccaucuagcaaaugaggcacuguucucaaccaaaggagauggggaucugguuuagggcaau

SEQ ID NO: 210426 - RNA, 64 nt, hsa
ggaacaggaacauuguuuucuagagcaagauaauaaaggagaugggccauacaaauguuuucua

SEQ ID NO: 210427 - RNA, 64 nt, hsa
agcaguaaaagaugaaguuuuauacacacagcaaaaaggagaaaaaauucuaguauauuuuaag

SEQ ID NO: 210428 - RNA, 64 nt, hsa
agaaggaaagagggcacccuuuucaguugggaagaaaggagagggguggcgccauggacguggc

SEQ ID NO: 210429 - RNA, 64 nt, hsa
guaaagccauuggaugaggaggggacugccauggaaaggagaguuuguuacuuacgguucugag

SEQ ID NO: 210430 - RNA, 64 nt, hsa
gcaagcagcaaccucugcagggcugacaggauuuaaaggagagaauguucuuauuuggaagcag

SEQ ID NO: 210431 - RNA, 64 nt, hsa
ugugacaucagaguauuugaccugcaguauugaaaaaggagaauucagaaugauacaguauuuu

SEQ ID NO: 210432 - RNA, 64 nt, hsa
gggugaggggagauuugcaccuagacacuucuugaaaggagacacucaguuucacaagugagcc

SEQ ID NO: 210433 - RNA, 64 nt, hsa
acaucccuuaccuccuuucguugauggccaaagcaaaggagaguccugggagcccacaagaucc

SEQ ID NO: 210434 - RNA, 64 nt, hsa
cagugcaucuuuuuaaaacaaggaaaagggaaaaaaaggagaaaaaacgaugcaucaagcuugu

SEQ ID NO: 210435 - RNA, 64 nt, hsa
accaaagaugaguuaaccaaaggaaaauaacauuaaaggagacuuauguguuaacgcuuuguuu

SEQ ID NO: 210436 - RNA, 64 nt, hsa
agagcaggaaguuguaaaucacuggcuaaugagaaaaggagacagcuaacucuaggaugaagcu

SEQ ID NO: 210437 - RNA, 64 nt, hsa
uuagggacaggguauagcuuagaugguggaaagcaaaggagagcaggaaguuguaaaucacugg

SEQ ID NO: 210438 - RNA, 64 nt, hsa
uacuggaguuugagaggagggaggugcuggggccaaaggagacacuagaaaagugguagauggg

SEQ ID NO: 210439 - RNA, 64 nt, hsa
uagaauguaaaagggcaguaauuaggggugagggaaaggagauaggggacccuaggagguagag

SEQ ID NO: 210440 - RNA, 64 nt, hsa
ucagacaggcgagaaguacgaggggagcgagacgaaaggagaacggugauuauucaugacaggc

SEQ ID NO: 210441 - RNA, 64 nt, hsa
auuuuuuucuacagauucauggaagaaguaaggaaaaggagagagcuagucuagauaaaaaaag

SEQ ID NO: 210442 - RNA, 64 nt, hsa
gaguccaggacauaugguaauacuagaccaaacuaaaggagaucauuguagaccaucaagaaga

SEQ ID NO: 210443 - RNA, 64 nt, hsa
cuguguuccaguuugauauggguuagguuaaggaaaaggagauggucucgaugucauggauuua

SEQ ID NO: 210444 - RNA, 64 nt, hsa
aagccugucccgcuagccuguguguucacacaccaaaggagaaggguaggcgagggguucggag

SEQ ID NO: 210445 - RNA, 64 nt, hsa
ggaaaguucugcuguuuuuagcaaaagcguccagaaaggagagcuuagcaggaguccuagcccu

SEQ ID NO: 210446 - RNA, 64 nt, hsa
caagagcguccccucacaaauaaauuaaagcguaaaaggagaccuacaucaggccuucauccug

SEQ ID NO: 210447 - RNA, 64 nt, hsa
aaacccacagagguauuugauguauuuaauugugaaaggagacuuugcagauaaaugaggccag

SEQ ID NO: 210448 - RNA, 64 nt, hsa
cacaguaacauccacagaacuaguccaacucuuaaaaggagagaggaaaaacacaggcaccagu

SEQ ID NO: 210449 - RNA, 64 nt, hsa
ugguguucugcauguagccuucuguggucaugugaaaggagacaggcucuucuaaguugaguug

SEQ ID NO: 210450 - RNA, 64 nt, hsa
aguuucucuggaauuccugucucuccuuuaaaagaaaggagagaacauuuuagaacaauaguuc

SEQ ID NO: 210451 - RNA, 64 nt, hsa
cccuguucucggugcugggaguacagcagugagcaaaggagacaauauucccugcucacagaga

SEQ ID NO: 210452 - RNA, 64 nt, hsa
auaccaugaguauguauguuuaccugugccuaauaaaggagaauuaugaaauaauuuuauuuuu

SEQ ID NO: 210453 - RNA, 64 nt, hsa
gagacgcugcaauaaagguugggagaaggcgcggaaaggagaggagcuggggccuuggggaccc

SEQ ID NO: 210454 - RNA, 64 nt, hsa
caguauugaucuuguguucuuugugccaauaugaaaaggagaggguugguucuuuccuuuauug

SEQ ID NO: 210455 - RNA, 64 nt, hsa
cauucaaagcuuuagaugugucccauguggcaagaaaggagacagugaauuuugucaaacaaua

SEQ ID NO: 210456 - RNA, 64 nt, hsa
aucagcauaugagaaucucugagagguccucuagaaaggagagaaaaagcaccucuuuuggcuc

SEQ ID NO: 210457 - RNA, 64 nt, hsa
gacuuuagacaaaagcaagaggaucagaugaagaaaaggagagguagauacagucagugucacu

SEQ ID NO: 210458 - RNA, 64 nt, hsa
auauggauuuagaaaaaggaacaccugaugaagaaaaggagagguagauacagucagugucacu

SEQ ID NO: 210459 - RNA, 64 nt, hsa
uuuuccuuucaacuuaguugacauacgugccuuaaaaaggaaaacuaguguugcuauugugcau

SEQ ID NO: 210460 - RNA, 64 nt, hsa
gaaaacuaguguugcuauugugcauuuacuagaaaaaaggaauugguuguuuagggcacacugu

SEQ ID NO: 210461 - RNA, 64 nt, hsa
uuauuuuaagaugccuuaaaaaucuuaaagucacaaaaggaaaaagguuuuuaacauuuacaug

SEQ ID NO: 210462 - RNA, 64 nt, hsa
guucaauauauacccuucucuaaacugugcggguaaaaggaaugacuguccuugagagaaccau

SEQ ID NO: 210463 - RNA, 64 nt, hsa
aauuugcacuguguucauauuaauccucuuuuaaaaaaggaaauauacagaagacaaacauugu

SEQ ID NO: 210464 - RNA, 64 nt, hsa
uuggaagggaaguuagacaagcuuuggggaagagaaaaggaauauaguccauuuccaaaggagc

SEQ ID NO: 210465 - RNA, 64 nt, hsa
cuugagugacagagcaagacuguaucucaaaggaaaaaggaaacuaggccaggcgugguggcuc

SEQ ID NO: 210466 - RNA, 64 nt, hsa
uaacaaaaaaaaaaagcuuuaaaaaaaaaagaaaaaaaggaaaagguuuuuagcucauuugccu

SEQ ID NO: 210467 - RNA, 64 nt, hsa
caagugguugcuccaggauuacucccuccuccaaaaaaggaaucaaauccacgaguggaaaagc

SEQ ID NO: 210468 - RNA, 64 nt, hsa
aaaaggaaacuucaaacaauauagaauuaaauguaaaaggaagcacuccuguguacagaugcga

SEQ ID NO: 210469 - RNA, 64 nt, hsa
ggcagagggaaagggguacacugagggagaaaggaaaaggaaacuucaaacaauauagaauuaa

SEQ ID NO: 210470 - RNA, 64 nt, hsa
uuaaaaaaaaaaaaaaaggaaaaaggaaaaaaaaaaaaggaaaaccagaagcccugcugucugu

SEQ ID NO: 210471 - RNA, 64 nt, hsa
ucuaugcuuucuucuuaaaaaaaaaaaaaaaggaaaaaggaaaaaaaaaaaaggaaaaccagaa

SEQ ID NO: 210472 - RNA, 64 nt, hsa
aucaaccucuaugcuuucuucuuaaaaaaaaaaaaaaaggaaaaaggaaaaaaaaaaaaggaaa

SEQ ID NO: 210473 - RNA, 64 nt, hsa
uuuaguucaggaaguuuuguuuuguguuuuaaauaaaaggaaagagcaaguuugcucagucaag

SEQ ID NO: 210474 - RNA, 64 nt, hsa
auguagggaaaaacuuuugcccgacugauuuuuaaaaaggaaaaaaaaaauguuuuacuaugug

SEQ ID NO: 210475 - RNA, 64 nt, hsa
cguucauguauauaagcuauuucuugauccauuuaaaaggaauuguacauuguguagaaaaaaa

SEQ ID NO: 210476 - RNA, 64 nt, hsa
uuuuccugcuuugguuaccuuuccuuuccccuuuaaaaggaauuagcuauagaacugcuuugua

SEQ ID NO: 210477 - RNA, 64 nt, hsa
acauauaaauuaaaugagacgagacaugucgaccaaaaggaaugugugggucuuguuuggaucc

SEQ ID NO: 210478 - RNA, 64 nt, hsa
aacugaauacuuguuuuauagaaaaugcauggagaaaaggaauuuguuuaaauaacauuauggg

SEQ ID NO: 210479 - RNA, 64 nt, hsa
uuucaguaucacagauuauucauaagaaauugagaaaaggaacaaucagaaguugcaaaagaug

SEQ ID NO: 210480 - RNA, 64 nt, hsa
cacuuaaaauagcuuccaauaaguaacuuagaccaaaaggaaaaaugaagugccccaggagaag

SEQ ID NO: 210481 - RNA, 64 nt, hsa
aagggccaaauagaguuuuuauauuuguuaugauaaaaggaaguagaugugaaaaagccuaaga

SEQ ID NO: 210482 - RNA, 64 nt, hsa
ugauaaaaggaaguagaugugaaaaagccuaagaaaaaggaaauuggacaguuuugauacaaac

SEQ ID NO: 210483 - RNA, 64 nt, hsa
uagguuuuaaacgacuuuuguuugcggggcuuuuaaaaggaaaaccgaauuagguccacuucaa

SEQ ID NO: 210484 - RNA, 64 nt, hsa
uucuguuuguguuauuucagaugauucaaauaucaaaaggaagauucuuccauuaaauugccuu

SEQ ID NO: 210485 - RNA, 64 nt, hsa
uggucauagcucauuacucuaccaccaagaaccuaaaaggaauuagaauacagcagaauuggcc

SEQ ID NO: 210486 - RNA, 64 nt, hsa
gaucauuuggaagacuuuagacucuauuaauuuuaaaaggaauauuuauuagccauaugcagaa

SEQ ID NO: 210487 - RNA, 64 nt, hsa
gcuugauggugauuguauuguauuccuuuaaucaaaaaggaaacacaauauucuaaguaucuuu

SEQ ID NO: 210488 - RNA, 64 nt, hsa
ucuagagacauuuuuauuuaugaauauuuauacaaaaaggaauucugucaagaugacugcucua

SEQ ID NO: 210489 - RNA, 57 nt, hsa
agaccgacgaggaugacuagacagcaaaaaaggaaaaguuaaacuaaaaaaaaaaag

SEQ ID NO: 210490 - RNA, 64 nt, hsa
ccaaggcccugcuuuuuuucuuaaaaguacuuuaaaaaggaaauuuguuuguauuuuuuauuua

SEQ ID NO: 210491 - RNA, 64 nt, hsa
gggccucugcucuccugggagacaaagcaauaauaaaaggaaguguuuguaaucccagcacuuu

SEQ ID NO: 210492 - RNA, 64 nt, hsa
auaaacaaauaaauuuuaaaaauaaauaaauaauaaaaggaaguguuagacaauguaaugccag

SEQ ID NO: 210493 - RNA, 64 nt, hsa
caauaccuugcagaggaaaggugggagagaggaaaaaaggaaauucuauagaaaucuauauauu

SEQ ID NO: 210494 - RNA, 64 nt, hsa
gaggauggagagaaguaucagcacccagaagagaaaaaggaauuuaaaacaaaaaccacagagg

SEQ ID NO: 210495 - RNA, 64 nt, hsa
cugucucccuucugacauuuccuaggaagcuaggaaaaggaaagugaaggaauggucuaaagaa

SEQ ID NO: 210496 - RNA, 64 nt, hsa
cuugugacugagaaaaguuuaaugccggcaugguaaaaggaagcugucucccuucugacauuuc

SEQ ID NO: 210497 - RNA, 64 nt, hsa
ugauuugggucugccauugacagaaugucaaauaaaaaggaauuagcuagaauaugaccauuaa

SEQ ID NO: 210498 - RNA, 64 nt, hsa
aaaguuaccaucgcaaaggaaagguuauuccaguaaaaggaaauaguuuucucaaccauuuaaa

SEQ ID NO: 210499 - RNA, 64 nt, hsa
ucgcugagcugcuuguuuaaaaaaaaaaaaaaggaaaaggaaaaagcaugacauuguguaucga

SEQ ID NO: 210500 - RNA, 64 nt, hsa
cccaaaucgcugagcugcuuguuuaaaaaaaaaaaaaaggaaaaggaaaaagcaugacauugug

SEQ ID NO: 210501 - RNA, 64 nt, hsa
uacacaacgauuacucgaagaugacugcaaagguaaaaggaaaauaaaaguguauugcacaaug

SEQ ID NO: 210502 - RNA, 64 nt, hsa
gaaauacacucagguggucuuauuuauuggcaacaaaaggaauuuucuauccagaagccuauuu

SEQ ID NO: 210503 - RNA, 64 nt, hsa
gggaaaguuugucaucauuugaaaaaggaaauauaaaaggaacaaccauauagccaaccugugg

SEQ ID NO: 210504 - RNA, 64 nt, hsa
aacaauuuaauugggaaaguuugucaucauuugaaaaaggaaauauaaaaggaacaaccauaua

SEQ ID NO: 210505 - RNA, 64 nt, hsa
cagaauaaggaucacugagaauuuaaaaaaauaaaaaaggaaguaaaaauuuuacaauuaggag

SEQ ID NO: 210506 - RNA, 64 nt, hsa
caaccagcuuucauaauuuuuaauugucaaaaccaaaaggaaucagaauaaggaucacugagaa

SEQ ID NO: 210507 - RNA, 64 nt, hsa
aaagaccauaagcaaacugguuauuuaaaauguaaaaaggaauaugaaagucuuauuaaaacac

SEQ ID NO: 210508 - RNA, 64 nt, hsa
auacuauuuggcaacuacugggacucuucagcacaaaaggaauagaucuaugauugacccugau

SEQ ID NO: 210509 - RNA, 64 nt, hsa
caggaccauacagugauuuaccauuuugauaauuaaaaggaaaaaaaaaggaagacucucacug

SEQ ID NO: 210510 - RNA, 64 nt, hsa
agugauuuaccauuuugauaauuaaaaggaaaaaaaaaggaagacucucacuguaaaaacagcu

SEQ ID NO: 210511 - RNA, 64 nt, hsa
ugccacaaaaucaauaaaagauguuuuugagaaaaaaaggaagaaaccaacucauucagaaggc

SEQ ID NO: 210512 - RNA, 64 nt, hsa
ucuuucugaucaccuuagaaauggcaguaagcccaaaaggaagaauuaugcugguaguaaaugg

SEQ ID NO: 210513 - RNA, 64 nt, hsa
gaaauagauguguguuuaauggaauugaagucugaaaaggaaguaguuauuuuagcagaaaauu

SEQ ID NO: 210514 - RNA, 64 nt, hsa
auugaauuauuuuucuccaaauugagacucucagaaaaggaagauugaauuagcguguuuuuug

SEQ ID NO: 210515 - RNA, 64 nt, hsa
aacuaugaggaugugcugguuuguugaaucaaacaaaaggaaauguuguggaauauuuuuccaa

SEQ ID NO: 210516 - RNA, 64 nt, hsa
agacaaggucaaaaaauagaugcaggcugaaaagaaaaggaagugggcuaagaugggaaaaaua

SEQ ID NO: 210517 - RNA, 64 nt, hsa
cuggucaacauagugagacacugucucuaccaaaaaaaggaaggaagggacacauaucaaacug

SEQ ID NO: 210518 - RNA, 64 nt, hsa
uugagagugugguuacgaaauacguuaggaggacaaaaggaauguguaagucuuuaaugccgau

SEQ ID NO: 210519 - RNA, 64 nt, hsa
acagcauggagaaaacccgguacgcucaaaaagaaaaaggaaaaaaaaaaaucccaucacccac

SEQ ID NO: 210520 - RNA, 64 nt, hsa
aaauuuggacauuuuaauuguuuaaaaauuguacaaaaggaaaaaauuagaauaaguacuggcg

SEQ ID NO: 210521 - RNA, 64 nt, hsa
cagagggcgguucuuuuuuuagauauuguuccuaaaaaggaauaaaugcauacaccuguuuguc

SEQ ID NO: 210522 - RNA, 64 nt, hsa
gggaguauuuuugauuuuucuacuuuuuguugaaaaaaggaauuuguacucugugcauuggaug

SEQ ID NO: 210523 - RNA, 64 nt, hsa
ucggggcgggccaaccccgagaaugaagauuggaaaaaggaaaaaaaaaaaaacacgucaaaag

SEQ ID NO: 210524 - RNA, 64 nt, hsa
uaagccgaugggggcaguggcguuaagugguggaaaaaggaaaguauauauguuagaguuuuga

SEQ ID NO: 210525 - RNA, 64 nt, hsa
cuccagcuugggcaacagagcaagauccugucucaaaaggaaaaagaaaacaggaccuaggugu

SEQ ID NO: 210526 - RNA, 64 nt, hsa
cagaucauucaguuggauuuucccaaugaagaggaaaaggaaaguaguuauuccuagcuccauu

SEQ ID NO: 210527 - RNA, 64 nt, hsa
ugcacagggcuugagcuuucugucauuugacuuuaaaaggaaguuucauucauauuuauccucu

SEQ ID NO: 210528 - RNA, 64 nt, hsa
agguguuuucucuuggacauacuaaaaaauaccuaaaaggaagcuuagaugggcugugacacaa

SEQ ID NO: 210529 - RNA, 64 nt, hsa
cucaugacaguugcccuuucaaagcaggaggaagaaaaggaagaaagaaaaacuguuucaucau

SEQ ID NO: 210530 - RNA, 64 nt, hsa
uagauucagcuuguaauaaucuuugagccacaccaaaaggaaugccaagggcucucuaaauuua

SEQ ID NO: 210531 - RNA, 64 nt, hsa
auuagcaagcaugaauuuuucacccaagagugaaaaaaggaaaaucuaccauggcuugaaguua

SEQ ID NO: 210532 - RNA, 64 nt, hsa
ugguggcagguacuaugaauguaauucauaauuuaaaaggaaaacuaaaaacuauuuugauuug

SEQ ID NO: 210533 - RNA, 64 nt, hsa
ucuuaucacacugauguguucaacuguuuaugggaaaaggaaacuaggaugguuuuauuuguga

SEQ ID NO: 210534 - RNA, 64 nt, hsa
cagcgcagagcagagugcugaguaaagaugucagaaaaggaaagcaauggucugguacaagucu

SEQ ID NO: 210535 - RNA, 64 nt, hsa
gcacuauugggguaugauguuugggucaguugauaaaaggaaaccuuuucaugccuuuagaugu

SEQ ID NO: 210536 - RNA, 64 nt, hsa
auauauauauauauauauauauauauauaaauuaaaaaggaaagaaaacuaacaaccaaccaac

SEQ ID NO: 210537 - RNA, 64 nt, hsa
aaaccuagaacuucaaaauguucguauucuauucaaaaggaaauauauauauauauauauauau

SEQ ID NO: 210538 - RNA, 64 nt, hsa
gaaaaggaauuuuccuguuaaauuaaacauuggcaaaaggaaauggaauaguauaaacacugau

SEQ ID NO: 210539 - RNA, 64 nt, hsa
agugaccuuuggugaucuucuuaggaacuucaagaaaaggaauuuuccuguuaaauuaaacauu

SEQ ID NO: 210540 - RNA, 64 nt, hsa
guuucguaaaacuugcgugucuuuuaaaaauaauaaaaggaagaugaguauuuaugaagaauau

SEQ ID NO: 210541 - RNA, 64 nt, hsa
aagguaaaacuuagauguccuuguaaaagaauaaaaaaggaauugcagugcaacaaaguacgug

SEQ ID NO: 210542 - RNA, 64 nt, hsa
uccuauuauaauaaaaggugaggacuccuuguaaaaaaggaaauguuccacagagucaaucuaa

SEQ ID NO: 210543 - RNA, 64 nt, hsa
agcaaaugcacaagcaaaaagaugcuugauacacaaaaggaacucuggagagaaaacuacagcu

SEQ ID NO: 210544 - RNA, 64 nt, hsa
gcuauuacauaagaaacaauggacccaagagaagaaaaggaagaaagaaagguuuuuugguuuu

SEQ ID NO: 210545 - RNA, 64 nt, hsa
caauuuuaggcucaaaaauuaaagcuaacacaggaaaaggaacuguacuggcuauuacauaaga

SEQ ID NO: 210546 - RNA, 64 nt, hsa
guuaaaaugacuguuuucucucucuauggaaauaaaaaggaaaaaaaaaaaggaaacuuuuuuu

SEQ ID NO: 210547 - RNA, 64 nt, hsa
uuuucucucucuauggaaauaaaaaggaaaaaaaaaaaggaaacuuuuuuuguuugcucuugca

SEQ ID NO: 210548 - RNA, 64 nt, hsa
gugauuggcaagacauguauuuaaacaauaaacuaaaaggaaauaaucuccacguacuaccauc

SEQ ID NO: 210549 - RNA, 64 nt, hsa
uuuuucuucaaaggcuuguuaaaccaaucauguuaaaaggaaauucuugguuuugguuuguugu

SEQ ID NO: 210550 - RNA, 64 nt, hsa
auuuuuguuuggccuugcauugccuugguaaaguaaaaggaaacaguacacuuggagcuaggaa

SEQ ID NO: 210551 - RNA, 64 nt, hsa
uaccuugaaccacauauaccaauuauaauuuuggaaaaggaauuaagccucacggaacaaugga

SEQ ID NO: 210552 - RNA, 64 nt, hsa
aaaaaacugacaaugcaugcuacuguucucuuucaaaaggaagagcaaccguguugaauacuaa

SEQ ID NO: 210553 - RNA, 64 nt, hsa
uugucagcuguagguggcaaaggugcccuuauaaaaaaggaaacuggcuuuucaaaaugggcua

SEQ ID NO: 210554 - RNA, 64 nt, hsa
uccaaaagugcagcaggagaacucuuuucccugaaaaaggaaaaauauugaacucaaugauagc

SEQ ID NO: 210555 - RNA, 64 nt, hsa
uacggucaguuaugucaauguuucauggucaauaaaaaggaaguugcaaauugugauuuaagca

SEQ ID NO: 210556 - RNA, 64 nt, hsa
uauauauccucuguauaaaaugagguuucaguacaaaaggaaccaugggugacccugcgauauc

SEQ ID NO: 210557 - RNA, 64 nt, hsa
cccgugauugguugguuuguagcacuaaggucuaaaaaggaaaaccauaaaagacaucagauua

SEQ ID NO: 210558 - RNA, 64 nt, hsa
aacagggaggaugggauuaguggaagcuuaauggaaaaggaaaguuaugauccuccaagacccu

SEQ ID NO: 210559 - RNA, 64 nt, hsa
cacaaucucuuauacuagugggacaaaagggagaaaaaggaagcaagauaaauggguauguagg

SEQ ID NO: 210560 - RNA, 64 nt, hsa
auugauacuuuaaaagccaaggugcccauauggaaaaaggaaauauacgaagagucaucaacuu

SEQ ID NO: 210561 - RNA, 64 nt, hsa
agcaguaucugccacugggauaaaguccuacuaaaaaaggaacgguaaauguacccuaaugauu

SEQ ID NO: 210562 - RNA, 64 nt, hsa
aucaugaucuaaugcagaugacuaggcuuuuuccaaaaggaagacagacccucagacaccaaaa

SEQ ID NO: 210563 - RNA, 64 nt, hsa
cacaggcaauauuccagcuauggagcuagcuuuaaaaaggaacaguaaaaauauuaaucgguua

SEQ ID NO: 210564 - RNA, 64 nt, hsa
cuccagccggggugacagaagagaccuugucucgaaaaggaaucugaaaacaauggaaccaugc

SEQ ID NO: 210565 - RNA, 64 nt, hsa
aaaugcugcuuccuauuggagcccagaaaaaaggaaaaggaaaguuuaggcuuucuuuguccuu

SEQ ID NO: 210566 - RNA, 64 nt, hsa
cguuguaaaugcugcuuccuauuggagcccagaaaaaaggaaaaggaaaguuuaggcuuucuuu

SEQ ID NO: 210567 - RNA, 64 nt, hsa
auuaagaaccagaaaaauaauuaaucucucuggaaaaaggaaagcuaaagaagacuaugauacc

SEQ ID NO: 210568 - RNA, 64 nt, hsa
ugguaacuugaaggcagcacagaggugagggauuaaaaggaaaggcagauuuugaaaucugacu

SEQ ID NO: 210569 - RNA, 64 nt, hsa
ucagugacaucugauuggcagaugagcuuauuucaaaaggaaggguggcuuugcauuucuugug

SEQ ID NO: 210570 - RNA, 64 nt, hsa
gguuaggaauccuagcacuugucucaggacucugaaaaggaacggcuuccucauuccuugucuu

SEQ ID NO: 210571 - RNA, 64 nt, hsa
auagcauccuuaagauuuaaaaaaaaaaaaaaaaaaaaggaaaaaaaagugauggaagccguaa

SEQ ID NO: 210572 - RNA, 64 nt, hsa
caucuugucuauuuuuucucuucauguuguaacaaaaaggaaaaaagaaaaaaaaaucccaucc

SEQ ID NO: 210573 - RNA, 61 nt, hsa
gacaccaagggcucuuaugaaucccauccugaaaaggaaggugcaucaccaucuacaggag

SEQ ID NO: 210574 - RNA, 64 nt, hsa
aaaaaaagucuguacuaauuucaauauggcucuuaaaaggaaugacagagaaauaggauacaag

SEQ ID NO: 210575 - RNA, 64 nt, hsa
agccaaaggauuuaagaguuuuguuguuguuaauaaaaggaauacuccuuuuccuuuuggauca

SEQ ID NO: 210576 - RNA, 64 nt, hsa
aaguuaguguaucaguaagaaacagaccuaguuuaaaaggaauaaucaacaauuuuauaaagga

SEQ ID NO: 210577 - RNA, 64 nt, hsa
uccccgucccuuaaaaagacaaaaaaaauaaggcaaaaggaaagcaacuaagacacuggacuau

SEQ ID NO: 210578 - RNA, 64 nt, hsa
agauaaauaccuggcaaaacuaaauaaauuaccaaaaaggaaaaaaaauccaccaaaccaugau

SEQ ID NO: 210579 - RNA, 64 nt, hsa
aggaggugccuccgaauuagaaaucagaauaaguaaaaggaacguucacucacaggguacgcuc

SEQ ID NO: 210580 - RNA, 64 nt, hsa
agaaaagaagagaaaaaauuaagaaaaaaaucaaaaaaggaagaaaacuaaaaaaaaaaaaaau

SEQ ID NO: 210581 - RNA, 64 nt, hsa
ugagcaccuuuuaaaccugcugcacauuggacucaaaaggaaaacuggaccaacaauaauugag

SEQ ID NO: 210582 - RNA, 64 nt, hsa
ccuuuggauuuuauuccaaaccuugcuguaauauaaaaggaaguuuacaagacaugauauugcu

SEQ ID NO: 210583 - RNA, 64 nt, hsa
ccucaccuguguggcccagauggcuccaacaagcaaaaggaaggaugcagugacucuugcugcc

SEQ ID NO: 210584 - RNA, 64 nt, hsa
aaaguauguuauugaaaguuucuauuugguugauaaaaggaacaauuuuuucccacuuuugaug

SEQ ID NO: 210585 - RNA, 64 nt, hsa
uaaugucauugguauaugguggcuguuuaccaauaaaaggaaaaaauucauuaaccgguugcuu

SEQ ID NO: 210586 - RNA, 64 nt, hsa
aucuuccuugucucaugaaaaccuaaauauaaaaaaaaggaaaauacuggaguuuuuauuucuc

SEQ ID NO: 210587 - RNA, 64 nt, hsa
ccagacaguuauuccauaaagcauuuguauaauuaaaaggaaaacagaaaaaggaaaaguaggc

SEQ ID NO: 210588 - RNA, 64 nt, hsa
cauaaagcauuuguauaauuaaaaggaaaacagaaaaaggaaaaguaggcaaaugugaaaauag

SEQ ID NO: 210589 - RNA, 64 nt, hsa
auuuuuaaaaaucuaccuguuccugacuuaaaacaaaaggaaagaaacuaccuuuuuauaaugc

SEQ ID NO: 210590 - RNA, 64 nt, hsa
aggagguauuguaagcuuuccauuuucuauaagaaaaaggaaaaguugaggggggggcauuagu

SEQ ID NO: 210591 - RNA, 64 nt, hsa
aggaaaaauaauuuuaaguaaagaaaaaagaaaaaaaaggaagacuaaacagaaaccagaacug

SEQ ID NO: 210592 - RNA, 64 nt, hsa
gugggaggggagcugguuuccuggugaacuuucuaaaaggaaaaauaauuuuaaguaaagaaaa

SEQ ID NO: 210593 - RNA, 64 nt, hsa
cagagaggagagucuuacggagggcugggagcuuaaaaggaaaacaauguccuuacuuguaaac

SEQ ID NO: 210594 - RNA, 64 nt, hsa
uguuuaugauaccaaaaaaauuacaguuuuguuuaaaaggaaauguugauguuuucaacuccaa

SEQ ID NO: 210595 - RNA, 55 nt, hsa
ccacuguugaguuuuccugacuuggaaaaggaaauguaaugaacuuauggaaagc

SEQ ID NO: 210596 - RNA, 64 nt, hsa
agcgucucgugaguccgacccagacauccaaacuaaaaggaagucauccagucuauucacagaa

SEQ ID NO: 210597 - RNA, 64 nt, hsa
auacauggcauuuucuagcuguguccuuauacauaaaaggaaaaagguagcucucucgagucuc

SEQ ID NO: 210598 - RNA, 64 nt, hsa
auuuuuauauacugaacugccauagaugcuggaaaaaaggaacugauguuuucagcauauuuuc

SEQ ID NO: 210599 - RNA, 64 nt, hsa
uuuccuguuuuucccccuuugaaaaacucaggaaaaaaggaagauugaacuaauaaaauuuuau

SEQ ID NO: 210600 - RNA, 64 nt, hsa
uucacauacacauauauacuggaaccuauaguagaaaaggaaacuaguagggccaaaaaaaaaa

SEQ ID NO: 210601 - RNA, 64 nt, hsa
cacuuuuggauuaggguacaauauuagagcucuaaaaaggaauaguagaauaacuuagcucagc

SEQ ID NO: 210602 - RNA, 64 nt, hsa
aucuuuugguuaggggacaauauuagagcuuuuaaaaaggaaggguagacucacuuagcucagc

SEQ ID NO: 210603 - RNA, 64 nt, hsa
aagaugaagauuauaacuguuuauuuaccuaauuaaaaggaaaggcagugccaaauaugagagg

SEQ ID NO: 210604 - RNA, 64 nt, hsa
gcuuuuaauuagucaaacuaaauuaaggcucauuaaaaggaaaggaacuacugggaaauuaugc

SEQ ID NO: 210605 - RNA, 64 nt, hsa
aaucaccccugccuuuuguucaacucuauaaaggaaaaggaauguagcucaacuugugauaaaa

SEQ ID NO: 210606 - RNA, 64 nt, hsa
auaaaaagugggaaggugaugcuguucuuauuguaaaaggaaagucauuuauauuaaagaauuu

SEQ ID NO: 210607 - RNA, 64 nt, hsa
aauaaugcuccucuuucaggguaauaaaguggggaaaaggaacgucuucucaaugcaagaacau

SEQ ID NO: 210608 - RNA, 64 nt, hsa
agcaugagcuuguucagagugaggggcauagugaaaaaggaacagccaugccucaaaaucaaau

SEQ ID NO: 210609 - RNA, 64 nt, hsa
uucaaggacuguuucagugugagucagaaugugaaaaaggaauaaaaaauacuguugggcucaa

SEQ ID NO: 210610 - RNA, 64 nt, hsa
gcacauguauugacaacaguuuuauaauuuaauaaaaaggaauacauugcaauccguaauuuuc

SEQ ID NO: 210611 - RNA, 64 nt, hsa
cagguuugaggggcuggggagugggaggggggagaaaaggaauguauuuaaacaauuuccgaug

SEQ ID NO: 210612 - RNA, 64 nt, hsa
gacaagaaauuuaaagaaucaaaacgaugguuugaaaaggaaaccuaugauacaugcaggagaa

SEQ ID NO: 210613 - RNA, 64 nt, hsa
uguuuaagaacuauuuuaaaguguuccagacccaaaaaggaaaaauaaaaaaaaaggaauauuu

SEQ ID NO: 210614 - RNA, 64 nt, hsa
aaaguguuccagacccaaaaaggaaaaauaaaaaaaaaggaauauuuguacccaacagcuagaa

SEQ ID NO: 210615 - RNA, 64 nt, hsa
aaaagaaaaaaugaaaaaaaaaggaaaaaaagaaaaaaggaaaaaaacaguuugaacacaaagg

SEQ ID NO: 210616 - RNA, 64 nt, hsa
aguuugaaaucuuaaaaaaagaaaaaaugaaaaaaaaaggaaaaaaagaaaaaaggaaaaaaac

SEQ ID NO: 210617 - RNA, 64 nt, hsa
caauaguuuaagaaauuuuuuuuuuaaauaaaaaaaaaggaaaagaggaagacuggacaaaaca

SEQ ID NO: 210618 - RNA, 64 nt, hsa
auugcauccuucuugcuuauacguuaaguuacauaaaaggaaaacaaaauuauguggugugaaa

SEQ ID NO: 210619 - RNA, 64 nt, hsa
aaaaauaaaagggaaaaaaaagaaaaaagaaacaaaaaggaacuucuuauaguugucuuuugug

SEQ ID NO: 210620 - RNA, 64 nt, hsa
cauuucauugagaauuaugauguuauaaaaaggaaaaaggaagaaugucgucuacugcagucua

SEQ ID NO: 210621 - RNA, 64 nt, hsa
gccaaagcauuucauugagaauuaugauguuauaaaaaggaaaaaggaagaaugucgucuacug

SEQ ID NO: 210622 - RNA, 64 nt, hsa
ccuucaauuucugagaaaaugaggcagagcauggaaaaggaauaggaaggagaaauuaauugag

SEQ ID NO: 210623 - RNA, 64 nt, hsa
cuuggaggaagaaaaacuguccuuccuucuccaaaaaaggaaaaauuauaauaauauaaaugac

SEQ ID NO: 210624 - RNA, 64 nt, hsa
acccaaaacauauauacagauuguuggcauuugcaaaaggaagcaucaauaguggacccagagg

SEQ ID NO: 210625 - RNA, 64 nt, hsa
agugcaugcacuaauaaaacugguuguuuaauuuaaaaggaauauauaagacuuuacccauguu

SEQ ID NO: 210626 - RNA, 64 nt, hsa
augcuaauguguuguaaacaagauucuaaauuuaaaaaggaaaacaaaacaaacuuguucuuug

SEQ ID NO: 210627 - RNA, 64 nt, hsa
gaauccugaggcugaugaauugugaaaauuccucaaaaggaaauuaugcuggucaucacaggaa

SEQ ID NO: 210628 - RNA, 64 nt, hsa
aaaucaccuacuuucaugcagguguauaaucuugaaaaggaaaaaugcuuccauguugaagcca

SEQ ID NO: 210629 - RNA, 64 nt, hsa
aaaaacuuuccaaacuuuugcaugagaaacuagaaaaaggaauguaugccacguaacuggauua

SEQ ID NO: 210630 - RNA, 64 nt, hsa
ccugugagguuuauacuauuucugguuuuuaaccaaaaggaaaucaucuggaagcaggaggcaa

SEQ ID NO: 210631 - RNA, 64 nt, hsa
guaaagguugacauauuccaaaacccuucuuuuuaaaaggaaaaaggauggagagaaggaugga

SEQ ID NO: 210632 - RNA, 64 nt, hsa
ucugaauaagaugauagacgagaauuuuuuuuaaaaaaggaauuuaaaggaaucuugugcaacu

SEQ ID NO: 210633 - RNA, 64 nt, hsa
auagguguugccuauugcugugcuuauaaaaugaaaaaggaaauugaggacacuuuugcaaaug

SEQ ID NO: 210634 - RNA, 63 nt, hsa
cauuuuucacuuugcucucaauuaaagucuauucaaaaggaaaguggcaagauuccaucagcu

SEQ ID NO: 210635 - RNA, 64 nt, hsa
gcuuucaagucugacucuccacuccuccucacuaaaaaggaaacuucaguugaucuucuucauc

SEQ ID NO: 210636 - RNA, 64 nt, hsa
uguaucuggggaaaaaaaacuuuuuuuuaaauuaaaaaggaaaauaaaagauauugaggucuuc

SEQ ID NO: 210637 - RNA, 64 nt, hsa
ccuguuucuaaacuuucgcuacuauaaaaccaaaaaaaggaauugagauuucaccaaccccagu

SEQ ID NO: 210638 - RNA, 64 nt, hsa
agccacagcagaagagccauucaucucauaaacaaaaaggaagaggaaagaaugaggaaggacc

SEQ ID NO: 210639 - RNA, 64 nt, hsa
guggcugaccagcuggcccaggauuucacagucgaaaaggaagccaccacugaugccucccacu

SEQ ID NO: 210640 - RNA, 64 nt, hsa
agcuugauaaauuugccuauaaaguuuuauaaagaaaaggaauauuuuguuuucauaaagagga

SEQ ID NO: 210641 - RNA, 64 nt, hsa
uggucacuaaaguauccugacaaguuccuaggaaaaaaggaauaaaguuuuuuuccuuaaaaaa

SEQ ID NO: 210642 - RNA, 64 nt, hsa
agagaacuacauuuuucuuauugccuugaaaguuaaaaggaaagcagauuucuucagugacuuu

SEQ ID NO: 210643 - RNA, 64 nt, hsa
gcuuucuuacauauacaucuuaguugauuauuaaaaaaggaaaaauaugguuuccagagaaaag

SEQ ID NO: 210644 - RNA, 64 nt, hsa
aauaucuagggucuguaaccguuuugguuugagaaaaaggaaaggccccuugucacauccucua

SEQ ID NO: 210645 - RNA, 64 nt, hsa
gacauauuuuagugggagccagacuauaaggaauaaaaggaaaaacuuucuuccucucucucca

SEQ ID NO: 210646 - RNA, 64 nt, hsa
uauacuauauacagccaguaaauacaugcuuaacaaaaggaaugagccugaaguucauaaagaa

SEQ ID NO: 210647 - RNA, 64 nt, hsa
gaaguucauaaagaauacauaucaauauucuuauaaaaggaauauaugaagauggcuuugauac

SEQ ID NO: 210648 - RNA, 64 nt, hsa
ugauaguggauaauagacaaagugaaaacauuuaaaaaggaagagaaacuucagccuuucuaag

SEQ ID NO: 210649 - RNA, 64 nt, hsa
gagaaaaaagauaaaguagaaaaagaaaaaagugaaaaggaaacaacuagcaaaaagaauagcc

SEQ ID NO: 210650 - RNA, 64 nt, hsa
uaauuaugaaaaucuaacacucaagauaguuucuaaaaggaaaucaguaguuaaggauaccuga

SEQ ID NO: 210651 - RNA, 64 nt, hsa
uucuaagacauuucugaauguagaccauuuuccaaaaaggaaacuuuauuuucaaaaaccuaau

SEQ ID NO: 210652 - RNA, 64 nt, hsa
gauuaauauuuguucaaguagagaaugaagauaaaaaaggaauuugaggccagguauggggugu

SEQ ID NO: 210653 - RNA, 64 nt, hsa
uuaauaucaaaaauugcuauuguauaguuugccuaaaaggaaguuggagugaauaucaucuuug

SEQ ID NO: 210654 - RNA, 64 nt, hsa
uuuguuuguuuuugugugguaaacugauauuuaaaaaaggaaaggagaaaaaucacgacuacug

SEQ ID NO: 210655 - RNA, 64 nt, hsa
augaguagcaacagcuggucauauacccuaucccaaaaggaagaacugucuugaacaagaugaa

SEQ ID NO: 210656 - RNA, 64 nt, hsa
gucauuggaauuuauauuaaaagacaaguuauuaaaaaggaaagguucuauucauaaucagggu

SEQ ID NO: 210657 - RNA, 64 nt, hsa
aacuuucauaaauuuuauggcaugucuucuauuuaaaaggaaaagaauaaguauucuugcaucu

SEQ ID NO: 210658 - RNA, 64 nt, hsa
agcacuuuucauucacuugaaagcuuaagugggaaaaaggaagaugauugucaggggaaaaacu

SEQ ID NO: 210659 - RNA, 64 nt, hsa
uugaaacaaggacaauuuguguuggaugguauucaaaaggaauuuuuuaaaacauuaagcaaca

SEQ ID NO: 210660 - RNA, 64 nt, hsa
ucauuugcaaauugcaauaaaacacauuuuagaaaaaaggaaccuucaauuauuagcuuuguuu

SEQ ID NO: 210661 - RNA, 64 nt, hsa
guccacucgcuuggauuucugacacaguuuacaaaaaaggaaaaaggcacugcuccuauuuucc

SEQ ID NO: 210662 - RNA, 64 nt, hsa
cccaauuggcagccucucacuacucuuucuggcuaaaaggaaucuaaucuuguugaggguagag

SEQ ID NO: 210663 - RNA, 64 nt, hsa
aggcagaacagccagagggggcaggaggggaccaaaaaggaaaaugaggacgugcagcagcauu

SEQ ID NO: 210664 - RNA, 64 nt, hsa
ggaaacuaauuuagucaucagagauacuuuccuaaaaaggaaaaauaaaaaacaaaauggugcc

SEQ ID NO: 210665 - RNA, 64 nt, hsa
cuugggaaauauuaugacaguugacuuuaagaucaaaaggaagggaagaccugaaagucauuug

SEQ ID NO: 210666 - RNA, 64 nt, hsa
gaaagaccagauccuuagagaaguuugugguauaaaaaggaaguggggacagauucgcagcaca

SEQ ID NO: 210667 - RNA, 64 nt, hsa
ucacuucucuuccucccucauggaagaugcaaguaaaaggaaaugcaaguaaccaccuggguua

SEQ ID NO: 210668 - RNA, 64 nt, hsa
aguauuuucuuauuucacuuuuacaccuaucuuuaaaaggaauuuaaauuuuguuuauauacau

SEQ ID NO: 210669 - RNA, 64 nt, hsa
uauacauuaacuaaaucaguacaaguuuggggugaaaaggaaauuuuuaauccaucucaaaugu

SEQ ID NO: 210670 - RNA, 62 nt, hsa
gagaacagguccugaugugaacaaccuaugggaaaaggaaaggucgagagaaucuuguccag

SEQ ID NO: 210671 - RNA, 64 nt, hsa
ucuaagucaagugcaaggacuuaacuugcguuugaaaaggaauuagagggucagaaacacccag

SEQ ID NO: 210672 - RNA, 64 nt, hsa
cacccgcuuagccuuuacauuccucuccaccgacaaaaggaaggggaaacucaaucagcaggac

SEQ ID NO: 210673 - RNA, 64 nt, hsa
aaacauucacugcacacguguacagcggaguacgaaaaggaacguuguccacaggggauuuaug

SEQ ID NO: 210674 - RNA, 64 nt, hsa
aauaaaacauuuuaaaauauaaauccuguaguuuaaaaggaagaaauggugggaaggaaaagua

SEQ ID NO: 210675 - RNA, 64 nt, hsa
aaacuaauauaugugagaguacuuaguugaaacaaaaaggaauuuuaguagacaguauuauauu

SEQ ID NO: 210676 - RNA, 64 nt, hsa
uaccacagacacaguuaaagcaaaaggaaacaauaaaaggaaugucugcaugcuauuuuaaucu

SEQ ID NO: 210677 - RNA, 64 nt, hsa
cagcacuuaaaaauaccacagacacaguuaaagcaaaaggaaacaauaaaaggaaugucugcau

SEQ ID NO: 210678 - RNA, 64 nt, hsa
gugguaccuugaaaauccaaaagccaucucaaguaaaaggaauaaaugugucaugcuuuuuaaa

SEQ ID NO: 210679 - RNA, 64 nt, hsa
auuugcuaugcagacagggaagggaauuucacuuaaaaggaaggucauuuggagaugugaagau

SEQ ID NO: 210680 - RNA, 64 nt, hsa
uuauuacccccccacuaugcccucauuuuuuuaaaaaaggaaaaaaaaaagaaacuggguucca

SEQ ID NO: 210681 - RNA, 64 nt, hsa
aaaauaaaaaaauaaauaaaaauaaaaaaaauaaaaaaggaaaaaaaaaaaagaagaaacaaga

SEQ ID NO: 210682 - RNA, 64 nt, hsa
uuccugcucacacuccagaauuaaauucuauugaaaaaggaaaaucagcaauucagcaaaaaau

SEQ ID NO: 210683 - RNA, 64 nt, hsa
guuaaugacagauguucuguuuuuauaaccuaccaaaaggaaacuagaggcuucuuggugaaga

SEQ ID NO: 210684 - RNA, 64 nt, hsa
cuccauccuaggcaacagagugauacgcuguuuaaaaaggaaaaaauccuucccuagagcuagu

SEQ ID NO: 210685 - RNA, 64 nt, hsa
gacagagugagacuccaucucaacagaaggaaaaaaaaggaaaauaggagaagguggaaauggg

SEQ ID NO: 210686 - RNA, 64 nt, hsa
aaacaaaguccaaaagucacuuuugaaugugaacaaaaggaagaaaaucaaggaaagaaugagu

SEQ ID NO: 210687 - RNA, 64 nt, hsa
uauuuuacagaugcaaacagcuauaauuuugcaaaaaaggaaaauaacucuccugaacaucuaa

SEQ ID NO: 210688 - RNA, 64 nt, hsa
aaagggagagcuaccaaauuguuuuuuucuuuuuaaaaggaaguuuaauguccguuguaucaca

SEQ ID NO: 210689 - RNA, 64 nt, hsa
agagcuuguucuuguauugugaccuuuuuuaaaaaaaaggaacugagguucagaaugauuaagg

SEQ ID NO: 210690 - RNA, 64 nt, hsa
aaaaaagaaaggacauugaguuuuaacagaagggaaaaggaaagaagaaaagauuuuugcagaa

SEQ ID NO: 210691 - RNA, 64 nt, hsa
acugagcagaacaaaucgucaggugccuggagcaaaaaggaaaaaaaaaaaagaaaggacauug

SEQ ID NO: 210692 - RNA, 64 nt, hsa
guuggcucuuuuuuuaaaagaugcgcucuaccugaaaaggaaauuggauuuuagaacuggaugu

SEQ ID NO: 210693 - RNA, 64 nt, hsa
uuauaaaaccucuugcuugugugcaaaaguuccuaaaaggaaacacaaguaaugccuauccauu

SEQ ID NO: 210694 - RNA, 64 nt, hsa
aacgacagccccaaucuucccgucuuuaugagagaaaaggaaaaaggaaucaaagguggaagaa

SEQ ID NO: 210695 - RNA, 64 nt, hsa
gccccaaucuucccgucuuuaugagagaaaaggaaaaaggaaucaaagguggaagaaaaaaaaa

SEQ ID NO: 210696 - RNA, 64 nt, hsa
ucagugucuuaauguggaaguuaacccuuaccaaaaaaggaaguuggcaaaaacagccuucuag

SEQ ID NO: 210697 - RNA, 64 nt, hsa
gcuuucuuuugcauggacaugggccagguuuuucaaaaggaauauaaacaggaucucaaacuug

SEQ ID NO: 210698 - RNA, 64 nt, hsa
aacaugguaagccuuagcagcaaacauucuuccuaaaaggaagacuucauuuucucaagaaaug

SEQ ID NO: 210699 - RNA, 64 nt, hsa
uauuuuuguauauuguugagaaagaaacacuaacaaaaggaacaacgaguaauuuauaaaauug

SEQ ID NO: 210700 - RNA, 64 nt, hsa
ucuguucauacagugaauaaagaucuaucaaaggaaaaggaaacugagaccgaaaacuuagggu

SEQ ID NO: 210701 - RNA, 64 nt, hsa
acugauuuuuccccccuaauaucugcucucuuucaaaaggaauaauucaaaagacuuaggacaa

SEQ ID NO: 210702 - RNA, 64 nt, hsa
guccauccauacaauggaguauuacacagccauaaaaaggaaugaagcagugauccccacuaca

SEQ ID NO: 210703 - RNA, 64 nt, hsa
agcuagauucucucucucaaaaaaaaaaaaaaaaaaaaggaaagaaagaaagaaaagaaaagaa

SEQ ID NO: 210704 - RNA, 64 nt, hsa
gaucagacuaggaacaaguugauaccaaaaccugaaaaggaaacuacagaaugggaaagucaua

SEQ ID NO: 210705 - RNA, 64 nt, hsa
caaaaacucaaucaauguaauucaguauuuuaacaaaaggaaugaaaaauuaucaucucaauag

SEQ ID NO: 210706 - RNA, 64 nt, hsa
guguugagggaaugaauaaguauuuccgucaagaaaaaggaaacaacaaaauaaaaccaaccca

SEQ ID NO: 210707 - RNA, 64 nt, hsa
guuauuauugucauuaguauuagugaauucacguaaaaggaagaucuguagacauaauaaaugu

SEQ ID NO: 210708 - RNA, 64 nt, hsa
aaagggacuacaucguuggcuuuugaccuugcugaaaaggaacauauaauuguauggaugguag

SEQ ID NO: 210709 - RNA, 64 nt, hsa
uuucauauguucuaaaaugacuagcaaugguuuaaaaaggaagaagaguggaagugaagaaggu

SEQ ID NO: 210710 - RNA, 64 nt, hsa
uaauuaauagguugcuaauuauuuaucacugcuaaaaaggaaaaaaggcauaaaaugaccuucu

SEQ ID NO: 210711 - RNA, 64 nt, hsa
gcuagaugaggacaugagaauaauucaggagaacaaaaggaaacacagaacaugcaaaaggccu

SEQ ID NO: 210712 - RNA, 64 nt, hsa
cuugaucaaggaagggcugucacuuuagagguucaaaaggaagugccucaaagcaaaggcaagc

SEQ ID NO: 210713 - RNA, 64 nt, hsa
uuccugcugggucuuaacaagcauaaaaaggaaaaaaaggaaacucaggcaaagggauccauau

SEQ ID NO: 210714 - RNA, 64 nt, hsa
ggacguccauuccugcugggucuuaacaagcauaaaaaggaaaaaaaggaaacucaggcaaagg

SEQ ID NO: 210715 - RNA, 64 nt, hsa
uauaauuggagauccugaacaccaaaguaagccuaaaaggaaucuuugaggaaaaaagccuucu

SEQ ID NO: 210716 - RNA, 64 nt, hsa
aaauggaucacagaccugaaucuguuguguugguaaaaggaaucaacaccuuuacauugcucaa

SEQ ID NO: 210717 - RNA, 64 nt, hsa
uaauuaaaaacccaaagaaccagcucauguuuggaaaaggaaucuuccacugaaacauuuggau

SEQ ID NO: 210718 - RNA, 64 nt, hsa
ugcuuuuccucaggaaauucggcaagacuuggagaaaaggaaagcuccaucaaagaggaccccc

SEQ ID NO: 210719 - RNA, 64 nt, hsa
uauuaagcauaugugcuuucgcagcugauaauauaaaaggaaaucccacagucuagauauagcc

SEQ ID NO: 210720 - RNA, 64 nt, hsa
auuauuaugagugggggacuggugacuuuauaugaaaaggaaggaagagugaccuaagcuagca

SEQ ID NO: 210721 - RNA, 64 nt, hsa
aaaagaacauaagaacucaaggagaacauaagagaaaaggaaaccuguuacagaaaagacaaga

SEQ ID NO: 210722 - RNA, 64 nt, hsa
auugaaaaaaaaaaacagucaauauggauuuagaaaaaggaacaccugaugaagaaaaggagag

SEQ ID NO: 210723 - RNA, 64 nt, hsa
caaagaaaggccagagaaagagcaguccaagcauaaaaggaaaaagaguuaugaagauacagau

SEQ ID NO: 210724 - RNA, 64 nt, hsa
acaaagucaacugaaucuuuuauucauagaaaugaaaaggaaaauaaaaacuguggcugaccaa

SEQ ID NO: 210725 - RNA, 64 nt, hsa
aaaaauacuguuucuucuauccaacucucuuaugaaaaggaacucuguauuuucuauuagccau

SEQ ID NO: 210726 - RNA, 64 nt, hsa
uauccuuacguccugagccgguuuaagucuguggaaaaggaagcacgggagaaauccacguaac

SEQ ID NO: 210727 - RNA, 64 nt, hsa
gaccauccacugucuuugacaccuagaagguggaaaaaggaaagagauuugagaagugagagag

SEQ ID NO: 210728 - RNA, 64 nt, hsa
agguacuguagcuuuuagggaaaaaaaaauguuaacacaucacaggucaaguugaagucauucu

SEQ ID NO: 210729 - RNA, 64 nt, hsa
aggcaaggagcuucugaagaaacugccucugcacacacaucacuggcugugaccccucaggcua

SEQ ID NO: 210730 - RNA, 64 nt, hsa
aaggcaaaaagaacgagugauuuuuccuuaggauacacaucaaccacuuugcuguugaagcugu

SEQ ID NO: 210731 - RNA, 64 nt, hsa
aguacuaauuuucacugcuaauaauucuguaaggacacaucaaagcuggccaaaauaaugaauu

SEQ ID NO: 210732 - RNA, 64 nt, hsa
ugggugagcuacucugguugguaauacucugugcacacaucauuguagccacacaucauugcug

SEQ ID NO: 210733 - RNA, 64 nt, hsa
guugguaauacucugugcacacaucauuguagccacacaucauugcugggagaauuaagcauua

SEQ ID NO: 210734 - RNA, 64 nt, hsa
gaacucaccacuuacccgggauaguaaacaugauacacaucaauaaaggcagacuuuauuguga

SEQ ID NO: 210735 - RNA, 64 nt, hsa
cagaguauguggauacccggaaacacacacacacacacaucaucauuaucaucaucaucauugu

SEQ ID NO: 210736 - RNA, 64 nt, hsa
gugacgccguggagcaggaucuucauucaucucaccagagcaacagcccaguccugaggauggg

SEQ ID NO: 210737 - RNA, 64 nt, hsa
aagaagugagaauuuccgaaaaagaucugccggcccagagcacucccucuugcccuaauccugg

SEQ ID NO: 210738 - RNA, 64 nt, hsa
gcccagcuccauacucuguccccccagcuaauacccagagcacccagaucagacucuccuucag

SEQ ID NO: 210739 - RNA, 64 nt, hsa
acaagugaucgccacccccccaccccaggcccugccagagcagggggaccuaggcuccucuuac

SEQ ID NO: 210740 - RNA, 64 nt, hsa
cuucauuuaaccaagcuauucaaguauuccuaugccagagcagugccaacucuuggagguccca

SEQ ID NO: 210741 - RNA, 64 nt, hsa
augaugucacacaaaauuaucaugacaaauauuaccagagcaaaguguaacggccaacacuuug

SEQ ID NO: 210742 - RNA, 64 nt, hsa
uccuguuugcagacguuggcgggccccgaggcucccagagcagccucugucaccgcuucugugu

SEQ ID NO: 210743 - RNA, 64 nt, hsa
uuuuuccuuguuugguugaucuuccccauucuggccagagcagggcuggagggaaggagccagg

SEQ ID NO: 210744 - RNA, 64 nt, hsa
cacugacucagggcucagacucagccucuauuguccagagcacuggcuuggcguccagcaauga

SEQ ID NO: 210745 - RNA, 64 nt, hsa
uguucuccuugggggcaggaaccuggggaggggcccagagcaaagggcaucagggagaaagucc

SEQ ID NO: 210746 - RNA, 64 nt, hsa
caguauuuaauguauuuauucuuguauguuuuuuccagagcauuaaagcuuucauaagguucuc

SEQ ID NO: 210747 - RNA, 64 nt, hsa
ccccacauaacuuuguccccucuuccccaacaacccagagcagguguugcagacaggagggcca

SEQ ID NO: 210748 - RNA, 64 nt, hsa
gccaccugagaagauggaaaggaaggagcugcccccagagcaucaguccuugaagagcagcuuu

SEQ ID NO: 210749 - RNA, 64 nt, hsa
cagcaaaggccagccucucccaccacugcaggugccagagcaaguggcacaagcaccacugaua

SEQ ID NO: 210750 - RNA, 64 nt, hsa
gccaggagagauucaacuuuccaaucuaaguauuccagagcauugcccaggcagaguugguuug

SEQ ID NO: 210751 - RNA, 64 nt, hsa
uagaagagauggggagauucaggaucccccugugccagagcacagccucaccggaugcugcuuc

SEQ ID NO: 210752 - RNA, 64 nt, hsa
gucucuccaucuguuugguggggguagagcugauccagagcacagaucuguuucgugcauugga

SEQ ID NO: 210753 - RNA, 64 nt, hsa
cguccgcgcgccagcacagaaacagaggagagucccagagcaggaggccccuggcccagcggcc

SEQ ID NO: 210754 - RNA, 64 nt, hsa
agcuagguggacugccccuaggacuucuguuucaccagagcaggaaucaaguggugaggcacug

SEQ ID NO: 210755 - RNA, 64 nt, hsa
uggauuuaacauagguucacagaaaguuuccuaaccagagcaucuuuuugaccacucagcaaaa

SEQ ID NO: 210756 - RNA, 64 nt, hsa
gaaacacgugccuacgcuguaaagaaauccuguuccagagcauaccuguuguacaaacagacac

SEQ ID NO: 210757 - RNA, 64 nt, hsa
caggaagaucagcuguaaauaaacgcugggcuccccagagcaccuguccgcccacugcccuugc

SEQ ID NO: 210758 - RNA, 64 nt, hsa
aaccauuuccccuuccaguagcuugguguccaucccagagcauucaugaagucuucccgccugg

SEQ ID NO: 210759 - RNA, 64 nt, hsa
ccagcagcugcucugcucaccagccugaccccacccagagcaggagcuggcgggugucuuccug

SEQ ID NO: 210760 - RNA, 64 nt, hsa
cagccccacuaucaguguccagcgugcugguuccccagagcacagcucagcaucacacugacac

SEQ ID NO: 210761 - RNA, 64 nt, hsa
caugugccccuuugcugcuggcuaccacucuuccccagagcagcaggccccgagccccuucagg

SEQ ID NO: 210762 - RNA, 64 nt, hsa
uugccauugccuggagggggaccagagcaugugaccagagcaugugcccagccccuccaccacc

SEQ ID NO: 210763 - RNA, 64 nt, hsa
uguggggucacucuugccauugccuggagggggaccagagcaugugaccagagcaugugcccag

SEQ ID NO: 210764 - RNA, 64 nt, hsa
ugugaaauugagcaauaggcaggcaccaccguccccagagcaggucagcgucucgagaggcccc

SEQ ID NO: 210765 - RNA, 64 nt, hsa
ggauacuguuguucacgauaauuucucccguuuuccagagcauuuaacauagcuuggaggcgua

SEQ ID NO: 210766 - RNA, 64 nt, hsa
ugggggcagggguuaguucuucaggucggcagacccagagcacuugauaaagaacuguauuuaa

SEQ ID NO: 210767 - RNA, 64 nt, hsa
gaccauccuggccauagcagccaagcccccauucccagagcagacccucuccccagaaggaccc

SEQ ID NO: 210768 - RNA, 64 nt, hsa
uugugacuagagggugguggagguaaggccuuccagagcccauggcuucaggagagggucucuc

SEQ ID NO: 210769 - RNA, 64 nt, hsa
uugaagcuuuaacaugguucaggcccuuggugugagagcccagggggaggacagcuugucugcu

SEQ ID NO: 210770 - RNA, 64 nt, hsa
accacaucaguguuuccgucugcucaccugccacagagcccacacccaugcccaccaguguugg

SEQ ID NO: 210771 - RNA, 64 nt, hsa
ccugggaagacacauucccuucccuguuccccagagagcccaccuccgcccugggcaggagccc

SEQ ID NO: 210772 - RNA, 64 nt, hsa
gacgucugugcugccugguuugcauccggcucacagagcccagacugcuggaacagccaaggac

SEQ ID NO: 210773 - RNA, 64 nt, hsa
gcucucccagacaggagccaggguugagcaauggagagcccagcccccacgucuuacagucgcc

SEQ ID NO: 210774 - RNA, 64 nt, hsa
cuuuguuuugaacuuccuuucccacuugguagaaagagcccagaagcagcccuggcccuguaag

SEQ ID NO: 210775 - RNA, 64 nt, hsa
cacagccuuauuucugccggggccuccccaccggagagcccagggggccggccggguuccuggu

SEQ ID NO: 210776 - RNA, 64 nt, hsa
uuauuuuauauaaaaaguguuucugugauucuucagagcccaggagucagugcuggugguugga

SEQ ID NO: 210777 - RNA, 64 nt, hsa
uugcucccaggcccagcaccgagcagaacagaccagagcccaccacaccacaaagagcagcacc

SEQ ID NO: 210778 - RNA, 64 nt, hsa
acaucauugaaguggagcccggcacaggggucauagagcccagugaggucggggauuuugaguu

SEQ ID NO: 210779 - RNA, 64 nt, hsa
gucagccagcucccagccacauggcgcaugaaggagagcccagucucccuccaggaaaggccug

SEQ ID NO: 210780 - RNA, 64 nt, hsa
agccugaccagaggggagguggauggcacuuuccagagcccagguucuuauggcauuucccagg

SEQ ID NO: 210781 - RNA, 64 nt, hsa
gaugugcccacugcccgugcagccuccuucagccagagcccagagcauagacaggaguguagga

SEQ ID NO: 210782 - RNA, 64 nt, hsa
agaaguguuccguacccacugcugaugguuucccagagcccacacugaguugaagaaccuauug

SEQ ID NO: 210783 - RNA, 64 nt, hsa
cuugacucccauuugcucucagugaccccagggcagagcccagagaaguguuccguacccacug

SEQ ID NO: 210784 - RNA, 64 nt, hsa
aacagauagcaaaugugucugguuagaucucagcagagcccauucugcaagaccuggcugagcc

SEQ ID NO: 210785 - RNA, 64 nt, hsa
ugauuaacaccuucuggagccagcucaucagcucagagcccagggucaggaguucguucaguaa

SEQ ID NO: 210786 - RNA, 64 nt, hsa
ccccuggauguccuucgaaggaaccaggacccucagagcccagcauccaucucugucaucaucu

SEQ ID NO: 210787 - RNA, 64 nt, hsa
cuccugcuccuacccaugcuacaggccaggaaccagagcccaucaucucagaggccccuggaug

SEQ ID NO: 210788 - RNA, 64 nt, hsa
uguuuguuccuguuaaauguauagcauuguaaugagagcccaucaaauccugagugucaguuug

SEQ ID NO: 210789 - RNA, 64 nt, hsa
uuguuaccuugaccacgcuguacaguaacauccaagagcccauucuacagugggugguuuuggu

SEQ ID NO: 210790 - RNA, 64 nt, hsa
ucuugcugcggcugcaauggaggcaaggggcugcagagcccaggugcacugugugaugauggga

SEQ ID NO: 210791 - RNA, 64 nt, hsa
guccuaucagugccccccagaguagagagcaauaagagcccagcccagugcagucccggcugug

SEQ ID NO: 210792 - RNA, 64 nt, hsa
ccuuguauauacccugcaccagcagugaccgggcagagcccaacccccuccacgggggucccag

SEQ ID NO: 210793 - RNA, 64 nt, hsa
ccaccucccugcacauggcacuacccagacugccagagcccaggcuggccucaucugcaccaug

SEQ ID NO: 210794 - RNA, 64 nt, hsa
cucuuuggagaaaccaaccagauacaucugcuggagagcccaggugggcacagagaagggugga

SEQ ID NO: 210795 - RNA, 64 nt, hsa
agccuugaagggcaaggagggaaacaguguuaccagagcccaguaagaacugcugucaugaagg

SEQ ID NO: 210796 - RNA, 64 nt, hsa
aaaucaaaauguuaacacaaagcuaagauucaucagagcccacccuauucuaaggaaccacaau

SEQ ID NO: 210797 - RNA, 64 nt, hsa
guaacucugguaaagcauccuguggagggagaggagagcccagucauuugcuuagaugguguuu

SEQ ID NO: 210798 - RNA, 64 nt, hsa
cugucucacucucaggacuauucuguaagaguccagagcccaccuccucaguuccuguggauag

SEQ ID NO: 210799 - RNA, 64 nt, hsa
uuagccuaaacagggcacauagaucucucccacuagagcccagagggaugagaggagagagcaa

SEQ ID NO: 210800 - RNA, 64 nt, hsa
gaguugaggcccuaacaaauuucaggcccagccaagagcccaugaauggaggcugcaggaggcu

SEQ ID NO: 210801 - RNA, 64 nt, hsa
agggccuugaaguagcagccuuggcugacuuuccagagcccagucccaagccuggcaccaagcc

SEQ ID NO: 210802 - RNA, 64 nt, hsa
aggcuagugcuaagagggaaggcccagguuugagagagcccagaggggcagagcccagagccuu

SEQ ID NO: 210803 - RNA, 64 nt, hsa
gggaaggcccagguuugagagagcccagaggggcagagcccagagccuuguuuggcccugaucu

SEQ ID NO: 210804 - RNA, 64 nt, hsa
ccauccccaucggcccuguccccuggagugugucagagcccaggggagaaugcagcccaccagg

SEQ ID NO: 210805 - RNA, 64 nt, hsa
cuguugaucuacccgugccugggccccuccccucagagcccaugguaacgaaccccuagaaagg

SEQ ID NO: 210806 - RNA, 64 nt, hsa
aagucccagaagcagucccugacccccagcuuucagagcccagccaccagcuuggggcuggaug

SEQ ID NO: 210807 - RNA, 64 nt, hsa
uauacacagaagugauaaaggaauccaaaguugaagagcccaggaaacgggaaacuguauccau

SEQ ID NO: 210808 - RNA, 64 nt, hsa
gcugcaaccagucuggggccauucagccagggacagagcccacagagcccauacaccugucucc

SEQ ID NO: 210809 - RNA, 64 nt, hsa
agucuggggccauucagccagggacagagcccacagagcccauacaccugucucccaccagcgg

SEQ ID NO: 210810 - RNA, 64 nt, hsa; identical to SEQ ID NO: 88792

SEQ ID NO: 210811 - RNA, 64 nt, hsa; identical to SEQ ID NO: 88793

SEQ ID NO: 210812 - RNA, 64 nt, hsa; identical to SEQ ID NO: 88794

SEQ ID NO: 210813 - RNA, 64 nt, hsa; identical to SEQ ID NO: 88795

SEQ ID NO: 210814 - RNA, 64 nt, hsa; identical to SEQ ID NO: 88796

SEQ ID NO: 210815 - RNA, 64 nt, hsa; identical to SEQ ID NO: 88797

SEQ ID NO: 210816 - RNA, 64 nt, hsa; identical to SEQ ID NO: 88798

SEQ ID NO: 210817 - RNA, 64 nt, hsa; identical to SEQ ID NO: 88799

SEQ ID NO: 210818 - RNA, 64 nt, hsa; identical to SEQ ID NO: 88800

SEQ ID NO: 210819 - RNA, 64 nt, hsa; identical to SEQ ID NO: 88801

SEQ ID NO: 210820 - RNA, 64 nt, hsa; identical to SEQ ID NO: 88802

SEQ ID NO: 210821 - RNA, 64 nt, hsa
agcggaucgcuccgggccaccaagccgcaccugugccugagacuccggauggacgacacagucg

SEQ ID NO: 210822 - RNA, 64 nt, hsa
gguguggagcaguggcuggggugggcgugguguggccugagagacugcccagcuggagaggccu

SEQ ID NO: 210823 - RNA, 64 nt, hsa
cagugauguagucuugcaguuuggcaacuuccuagccugagaaucccuaguggggcugugggaa

SEQ ID NO: 210824 - RNA, 64 nt, hsa
ccuuggcccuucaaggucaugcagugggucgagcgccugagauccuguucaccaggacuccaca

SEQ ID NO: 210825 - RNA, 64 nt, hsa
uccugccaggaaguguuuauuugccucuaauugggccugagagaccauagggagguuggggcuc

SEQ ID NO: 210826 - RNA, 64 nt, hsa
ggcuaguuaccacuaggcuaccaggucucuaggggccugagagaggcccucuagagaauccagg

SEQ ID NO: 210827 - RNA, 64 nt, hsa
gcggucccgcccugcccuaggcuuuaccuuggaagccugagaggcgccggcucucuugcuccuc

SEQ ID NO: 210828 - RNA, 64 nt, hsa
gacagcguaucgagcauccugacccacugccccugccugagaacgccaucucggcucccgggca

SEQ ID NO: 210829 - RNA, 64 nt, hsa
ucgcggugaccccucucucugguucccagcaccugccugagaccugccccaggcacccauaacc

SEQ ID NO: 210830 - RNA, 64 nt, hsa
ucccaggggugagaggccucauguauccuaggcugccugagauuucugugugcugaucgcaucc

SEQ ID NO: 210831 - RNA, 64 nt, hsa
cauggcguccugcccuugcuccagccugacaacagccugagaaauccccccguaacuuauuauc

SEQ ID NO: 210832 - RNA, 64 nt, hsa
ugugucccccgaacgcucugcaccuucugacgcagccugagaaugaccugcccuggccccagcc

SEQ ID NO: 210833 - RNA, 64 nt, hsa
acagaccaccagacgccagggcugauuggugggggccugagaccccgguugcccauucauggcu

SEQ ID NO: 210834 - RNA, 64 nt, hsa
ccccaggugguuuugaggcucgcucuugcgcggugccugagaagagggugaaggagcuggggca

SEQ ID NO: 210835 - RNA, 64 nt, hsa
ccucaccagugcugaugaugccgucaugcugcuggccugagacaguaucccagcuacaacagga

SEQ ID NO: 210836 - RNA, 64 nt, hsa
ccugugagccccaugcuggcugugcacugcgcgggccugagacugcuggauacaauguugggca

SEQ ID NO: 210837 - RNA, 64 nt, hsa
acaugaagcucccagagauaaaacuccccaaggugccugagauggcugugcccgaugugcaccu

SEQ ID NO: 210838 - RNA, 64 nt, hsa
ucccgaaagucccagagaugaaacucccuaaaaugccugagauggcugugccagagguucgacu

SEQ ID NO: 210839 - RNA, 64 nt, hsa
agaugaaagucccugagaugaagcuuccaaaggugccugagaugaaacuuccugagaugaaacu

SEQ ID NO: 210840 - RNA, 64 nt, hsa
aucauugaucuguuugaggaagugucugaccugggccugagagcuggagaaggugcagauucaa

SEQ ID NO: 210841 - RNA, 64 nt, hsa
aauguccuauaaaugcaccuccugucaaaaccaugccugagaggucccggcugggagugacagg

SEQ ID NO: 210842 - RNA, 64 nt, hsa; identical to SEQ ID NO: 125569

SEQ ID NO: 210843 - RNA, 64 nt, hsa; identical to SEQ ID NO: 125570

SEQ ID NO: 210844 - RNA, 64 nt, hsa; identical to SEQ ID NO: 125571

SEQ ID NO: 210845 - RNA, 64 nt, hsa; identical to SEQ ID NO: 125572

SEQ ID NO: 210846 - RNA, 64 nt, hsa; identical to SEQ ID NO: 125573

SEQ ID NO: 210847 - RNA, 64 nt, hsa; identical to SEQ ID NO: 125574

SEQ ID NO: 210848 - RNA, 64 nt, hsa; identical to SEQ ID NO: 125575

SEQ ID NO: 210849 - RNA, 64 nt, hsa; identical to SEQ ID NO: 125576

SEQ ID NO: 210850 - RNA, 64 nt, hsa; identical to SEQ ID NO: 125577

SEQ ID NO: 210851 - RNA, 64 nt, hsa; identical to SEQ ID NO: 125578

SEQ ID NO: 210852 - RNA, 64 nt, hsa; identical to SEQ ID NO: 125579

SEQ ID NO: 210853 - RNA, 64 nt, hsa; identical to SEQ ID NO: 125580

SEQ ID NO: 210854 - RNA, 64 nt, hsa; identical to SEQ ID NO: 125581

SEQ ID NO: 210855 - RNA, 64 nt, hsa; identical to SEQ ID NO: 125582

SEQ ID NO: 210856 - RNA, 64 nt, hsa; identical to SEQ ID NO: 125583

SEQ ID NO: 210857 - RNA, 64 nt, hsa; identical to SEQ ID NO: 125584

SEQ ID NO: 210858 - RNA, 64 nt, hsa; identical to SEQ ID NO: 125585

SEQ ID NO: 210859 - RNA, 64 nt, hsa; identical to SEQ ID NO: 125586

SEQ ID NO: 210860 - RNA, 64 nt, hsa; identical to SEQ ID NO: 125587

SEQ ID NO: 210861 - RNA, 64 nt, hsa; identical to SEQ ID NO: 125588

SEQ ID NO: 210862 - RNA, 64 nt, hsa; identical to SEQ ID NO: 125589

SEQ ID NO: 210863 - RNA, 64 nt, hsa; identical to SEQ ID NO: 125590

SEQ ID NO: 210864 - RNA, 64 nt, hsa; identical to SEQ ID NO: 125591

SEQ ID NO: 210865 - RNA, 64 nt, hsa; identical to SEQ ID NO: 125592

SEQ ID NO: 210866 - RNA, 64 nt, hsa; identical to SEQ ID NO: 125593

SEQ ID NO: 210867 - RNA, 64 nt, hsa; identical to SEQ ID NO: 125594

SEQ ID NO: 210868 - RNA, 64 nt, hsa; identical to SEQ ID NO: 125595

SEQ ID NO: 210869 - RNA, 64 nt, hsa; identical to SEQ ID NO: 125596

SEQ ID NO: 210870 - RNA, 64 nt, hsa; identical to SEQ ID NO: 125597

SEQ ID NO: 210871 - RNA, 64 nt, hsa; identical to SEQ ID NO: 125598

SEQ ID NO: 210872 - RNA, 64 nt, hsa; identical to SEQ ID NO: 125599

SEQ ID NO: 210873 - RNA, 64 nt, hsa; identical to SEQ ID NO: 125600

SEQ ID NO: 210874 - RNA, 64 nt, hsa; identical to SEQ ID NO: 125601

SEQ ID NO: 210875 - RNA, 64 nt, hsa; identical to SEQ ID NO: 125602

SEQ ID NO: 210876 - RNA, 64 nt, hsa; identical to SEQ ID NO: 125603

SEQ ID NO: 210877 - RNA, 64 nt, hsa; identical to SEQ ID NO: 125604

SEQ ID NO: 210878 - RNA, 64 nt, hsa; identical to SEQ ID NO: 125605

SEQ ID NO: 210879 - RNA, 64 nt, hsa; identical to SEQ ID NO: 125606

SEQ ID NO: 210880 - RNA, 64 nt, hsa; identical to SEQ ID NO: 125607

SEQ ID NO: 210881 - RNA, 64 nt, hsa; identical to SEQ ID NO: 125608

SEQ ID NO: 210882 - RNA, 64 nt, hsa; identical to SEQ ID NO: 125609

SEQ ID NO: 210883 - RNA, 64 nt, hsa; identical to SEQ ID NO: 125610

SEQ ID NO: 210884 - RNA, 64 nt, hsa; identical to SEQ ID NO: 125611

SEQ ID NO: 210885 - RNA, 64 nt, hsa; identical to SEQ ID NO: 125612

SEQ ID NO: 210886 - RNA, 64 nt, hsa; identical to SEQ ID NO: 125613

SEQ ID NO: 210887 - RNA, 64 nt, hsa; identical to SEQ ID NO: 125614

SEQ ID NO: 210888 - RNA, 64 nt, hsa; identical to SEQ ID NO: 125615

SEQ ID NO: 210889 - RNA, 64 nt, hsa; identical to SEQ ID NO: 125616

SEQ ID NO: 210890 - RNA, 64 nt, hsa; identical to SEQ ID NO: 125617

SEQ ID NO: 210891 - RNA, 64 nt, hsa; identical to SEQ ID NO: 125618

SEQ ID NO: 210892 - RNA, 64 nt, hsa; identical to SEQ ID NO: 125619

SEQ ID NO: 210893 - RNA, 64 nt, hsa; identical to SEQ ID NO: 125620

SEQ ID NO: 210894 - RNA, 64 nt, hsa; identical to SEQ ID NO: 125621

SEQ ID NO: 210895 - RNA, 64 nt, hsa; identical to SEQ ID NO: 125622

SEQ ID NO: 210896 - RNA, 64 nt, hsa; identical to SEQ ID NO: 125623

SEQ ID NO: 210897 - RNA, 64 nt, hsa; identical to SEQ ID NO: 125624

SEQ ID NO: 210898 - RNA, 64 nt, hsa; identical to SEQ ID NO: 125625

SEQ ID NO: 210899 - RNA, 64 nt, hsa; identical to SEQ ID NO: 125626

SEQ ID NO: 210900 - RNA, 64 nt, hsa; identical to SEQ ID NO: 125627

SEQ ID NO: 210901 - RNA, 64 nt, hsa; identical to SEQ ID NO: 125628

SEQ ID NO: 210902 - RNA, 64 nt, hsa; identical to SEQ ID NO: 125629

SEQ ID NO: 210903 - RNA, 64 nt, hsa; identical to SEQ ID NO: 125630

SEQ ID NO: 210904 - RNA, 64 nt, hsa; identical to SEQ ID NO: 125631

SEQ ID NO: 210905 - RNA, 64 nt, hsa; identical to SEQ ID NO: 125632

SEQ ID NO: 210906 - RNA, 64 nt, hsa; identical to SEQ ID NO: 125633

SEQ ID NO: 210907 - RNA, 64 nt, hsa; identical to SEQ ID NO: 125634

SEQ ID NO: 210908 - RNA, 64 nt, hsa; identical to SEQ ID NO: 125635

SEQ ID NO: 210909 - RNA, 64 nt, hsa; identical to SEQ ID NO: 125636

SEQ ID NO: 210910 - RNA, 64 nt, hsa; identical to SEQ ID NO: 125637

SEQ ID NO: 210911 - RNA, 64 nt, hsa; identical to SEQ ID NO: 125638

SEQ ID NO: 210912 - RNA, 64 nt, hsa; identical to SEQ ID NO: 125639

SEQ ID NO: 210913 - RNA, 64 nt, hsa; identical to SEQ ID NO: 125640

SEQ ID NO: 210914 - RNA, 64 nt, hsa; identical to SEQ ID NO: 125641

SEQ ID NO: 210915 - RNA, 64 nt, hsa; identical to SEQ ID NO: 125642

SEQ ID NO: 210916 - RNA, 64 nt, hsa; identical to SEQ ID NO: 163185

SEQ ID NO: 210917 - RNA, 64 nt, hsa; identical to SEQ ID NO: 163186

SEQ ID NO: 210918 - RNA, 64 nt, hsa; identical to SEQ ID NO: 163187

SEQ ID NO: 210919 - RNA, 64 nt, hsa; identical to SEQ ID NO: 163188

SEQ ID NO: 210920 - RNA, 64 nt, hsa; identical to SEQ ID NO: 99150

SEQ ID NO: 210921 - RNA, 64 nt, hsa; identical to SEQ ID NO: 99151

SEQ ID NO: 210922 - RNA, 64 nt, hsa; identical to SEQ ID NO: 99152

SEQ ID NO: 210923 - RNA, 64 nt, hsa; identical to SEQ ID NO: 99153

SEQ ID NO: 210924 - RNA, 64 nt, hsa; identical to SEQ ID NO: 146929

SEQ ID NO: 210925 - RNA, 64 nt, hsa; identical to SEQ ID NO: 146930

SEQ ID NO: 210926 - RNA, 64 nt, hsa; identical to SEQ ID NO: 146931

SEQ ID NO: 210927 - RNA, 64 nt, hsa; identical to SEQ ID NO: 146932

SEQ ID NO: 210928 - RNA, 64 nt, hsa; identical to SEQ ID NO: 146933

SEQ ID NO: 210929 - RNA, 64 nt, hsa; identical to SEQ ID NO: 146934

SEQ ID NO: 210930 - RNA, 64 nt, hsa
gcagaacaagaggcgcggggccacacccgugaaccaugcagacggccgaagaagucuuaggcag

SEQ ID NO: 210931 - RNA, 64 nt, hsa
auggggaagucgagggccuguggcuuggauccgccaugcagagauguggccgggcacccaucuu

SEQ ID NO: 210932 - RNA, 64 nt, hsa
uauauguugucaugcaggguuugggccaagaaagcaugcagaaaaaaaugccaugugauuguaa

SEQ ID NO: 210933 - RNA, 64 nt, hsa
augauucucucacaggcuugggaaauccuguuagcaugcagaauaaugugguaacuuugucaau

SEQ ID NO: 210934 - RNA, 64 nt, hsa
caagagaccccaaauagccugcucaguagagggucaugcagacaaggaagaaaacuuaggggcu

SEQ ID NO: 210935 - RNA, 64 nt, hsa
ggccugccuagggacacuguccagccuccaggcccaugcagaaagaguucagugcuacucugcg

SEQ ID NO: 210936 - RNA, 64 nt, hsa
gugugcacagauaugcugucuggacacgcacacacaugcagauaugcugccuggacacacacuu

SEQ ID NO: 210937 - RNA, 64 nt, hsa
gcagauaugcuguccggauacacacgcacgcacacaugcagauaugcugccugggcacacacuu

SEQ ID NO: 210938 - RNA, 64 nt, hsa
guaguaguagcugccaccacaucucuaggguagccaugcagaggagggcuucauauucccaaua

SEQ ID NO: 210939 - RNA, 64 nt, hsa
ugaauccaugcaagccccauaaaacaguuccuagcaugcagaaaaugcccacguaaauagcugu

SEQ ID NO: 210940 - RNA, 64 nt, hsa
gagggacauucugcuggcccacccugcgcgcugucaugcagaggccauucccccaggccugugu

SEQ ID NO: 210941 - RNA, 64 nt, hsa
guguacaugcaccaaagcaugugugaccuacagacaugcagaacaugcacguguacacauacca

SEQ ID NO: 210942 - RNA, 64 nt, hsa
cacucuugcucacaaugggcauggaucagaagaccaugcagaaguuacuguaucucuugugacc

SEQ ID NO: 210943 - RNA, 64 nt, hsa
caccccuggagggguggaguuucuaccccugacucaugcagacaucuauuacauggaggcagua

SEQ ID NO: 210944 - RNA, 64 nt, hsa
gagaagacucuccgccccacgccaaucccaaaggcaugcagauggcugugcauguuggcuucuu

SEQ ID NO: 210945 - RNA, 64 nt, hsa
cuucaaaacuagaaggaucuacuccgcaugggugcaugcagaggcuccuggaucugggaagccc

SEQ ID NO: 210946 - RNA, 64 nt, hsa
guggccacauuuggaggaaguucacauuuccuggcaugcagacccaaaacuggguucuggcucu

SEQ ID NO: 210947 - RNA, 64 nt, hsa
aaccacuaacuagguaguguaugccccuucagaacaugcagaguguaucuuuuuuuaaauuucu

SEQ ID NO: 210948 - RNA, 64 nt, hsa
cgcuggugcugggucucugguuugcugcagagccguaggacacuccuggcuccucaguaggaca

SEQ ID NO: 210949 - RNA, 64 nt, hsa
ugcugcagagccguaggacacuccuggcuccucaguaggacagacagacgcaggcggguuuauu

SEQ ID NO: 210950 - RNA, 64 nt, hsa
cagagaacagaaggccgaauccaaguuucaugugguaggacagagaacggcaaucuacaaaacu

SEQ ID NO: 210951 - RNA, 64 nt, hsa
agcuuuagugaaggcugaauccaaguuucauguaguaggacagagaacagaaggccgaauccaa

SEQ ID NO: 210952 - RNA, 64 nt, hsa
cuuagcuuuuuugacaaacucuuuucuccagguaguaggacaaugaaaauuguucuaagcaaag

SEQ ID NO: 210953 - RNA, 64 nt, hsa
guuccuucuucccucccuccugugaaguuacacuguaggacacaagcugugagcaaucugcagu

SEQ ID NO: 210954 - RNA, 64 nt, hsa
aggacuccgucccuguccccgacugugccacgugguaggacacauaggacacaggaauuccugg

SEQ ID NO: 210955 - RNA, 64 nt, hsa
auuccuggguccuugcccaugacugugccaugugguaggacacaggacacaggaauuccuggaa

SEQ ID NO: 210956 - RNA, 64 nt, hsa
ugggacauaagccuuugccccacaagcuguggagagggccaaaaccaagcugcuugagcccacu

SEQ ID NO: 210957 - RNA, 64 nt, hsa
aggccccugagagcuggacagagcagagaacuacagggccaaggguccagagaagugauaacuu

SEQ ID NO: 210958 - RNA, 64 nt, hsa
gcacaccucacacgggaccacagccgcgcugccgagggccaagcacaaagguuccagugagcgc

SEQ ID NO: 210959 - RNA, 64 nt, hsa
gccuggugcuggugaugggcccuggcccuacuccagggccaaugcacccccgccucacacacgc

SEQ ID NO: 210960 - RNA, 64 nt, hsa
cagauugguaaugccagaaaaaauuuuaagaggacucaccaaaaguacuagaucuauguaaguu

SEQ ID NO: 210961 - RNA, 64 nt, hsa
aaauaagagaugccagaacuacuuccauaacuaacucaccaaaucaaaucaucaguccucauau

SEQ ID NO: 210962 - RNA, 64 nt, hsa
gaaucaaguaugucccugaguagcaagauuaggccucaccaaagaagaaauuaaccugcacuuu

SEQ ID NO: 210963 - RNA, 64 nt, hsa
aucucaucccuuuguagaaauucuugccugaauucucaccaaguuuugaauuccuaagguagcc

SEQ ID NO: 210964 - RNA, 64 nt, hsa
ugagaagaagcagauccccuguguggucuccaugcucaccaaggaacucuacuucagucaauag

SEQ ID NO: 210965 - RNA, 64 nt, hsa
agcaccuuacugcccaggccuaucuggaagccaccucaccaaggaccuuggaagagcaagggac

SEQ ID NO: 210966 - RNA, 64 nt, hsa
ccucaaaugggcauagcccuauguacuaaauacauagcccuauguaccaaaaaguaaggcuuag

SEQ ID NO: 210967 - RNA, 64 nt, hsa
uauacagcuucauucuguugcccucaaaugggcauagcccuauguacuaaauacauagcccuau

SEQ ID NO: 210968 - RNA, 64 nt, hsa
uggguugaauacacuuuuaacagcccuagaucgauagcccuagcccuagauagauagcccuagc

SEQ ID NO: 210969 - RNA, 64 nt, hsa
gaauacacuuuuaacagcccuagaucgauagcccuagcccuagauagauagcccuagcccuaga

SEQ ID NO: 210970 - RNA, 64 nt, hsa
cagcccuagaucgauagcccuagcccuagauagauagcccuagcccuagauagauagcuauuag

SEQ ID NO: 210971 - RNA, 64 nt, hsa
uagaucgauagcccuagcccuagauagauagcccuagcccuagauagauagcuauuagguuggu

SEQ ID NO: 210972 - RNA, 64 nt, hsa
cagacugguaucaauauuagacaauguuauuuauuagcccuaauuguguuugguuucagacaaa

SEQ ID NO: 210973 - RNA, 64 nt, hsa
auauguuacaguaccccaccuguaaguuauuuauuagcccuaauuguguuugauuucagacaaa

SEQ ID NO: 210974 - RNA, 64 nt, hsa; identical to SEQ ID NO: 80686

SEQ ID NO: 210975 - RNA, 64 nt, hsa; identical to SEQ ID NO: 80687

SEQ ID NO: 210976 - RNA, 64 nt, hsa; identical to SEQ ID NO: 80688

SEQ ID NO: 210977 - RNA, 64 nt, hsa; identical to SEQ ID NO: 80689

SEQ ID NO: 210978 - RNA, 64 nt, hsa; identical to SEQ ID NO: 80690

SEQ ID NO: 210979 - RNA, 64 nt, hsa; identical to SEQ ID NO: 80691

SEQ ID NO: 210980 - RNA, 64 nt, hsa; identical to SEQ ID NO: 80692

SEQ ID NO: 210981 - RNA, 64 nt, hsa; identical to SEQ ID NO: 80693

SEQ ID NO: 210982 - RNA, 64 nt, hsa; identical to SEQ ID NO: 80694

SEQ ID NO: 210983 - RNA, 50 nt, hsa; identical to SEQ ID NO: 80695

SEQ ID NO: 210984 - RNA, 64 nt, hsa; identical to SEQ ID NO: 80696

SEQ ID NO: 210985 - RNA, 64 nt, hsa; identical to SEQ ID NO: 80697

SEQ ID NO: 210986 - RNA, 64 nt, hsa; identical to SEQ ID NO: 80698

SEQ ID NO: 210987 - RNA, 64 nt, hsa; identical to SEQ ID NO: 80699

SEQ ID NO: 210988 - RNA, 64 nt, hsa; identical to SEQ ID NO: 80700

SEQ ID NO: 210989 - RNA, 64 nt, hsa; identical to SEQ ID NO: 80701

SEQ ID NO: 210990 - RNA, 64 nt, hsa; identical to SEQ ID NO: 80702

SEQ ID NO: 210991 - RNA, 64 nt, hsa; identical to SEQ ID NO: 80703

SEQ ID NO: 210992 - RNA, 64 nt, hsa; identical to SEQ ID NO: 80704

SEQ ID NO: 210993 - RNA, 64 nt, hsa; identical to SEQ ID NO: 80705

SEQ ID NO: 210994 - RNA, 64 nt, hsa; identical to SEQ ID NO: 80706

SEQ ID NO: 210995 - RNA, 64 nt, hsa; identical to SEQ ID NO: 80707

SEQ ID NO: 210996 - RNA, 64 nt, hsa; identical to SEQ ID NO: 80708

SEQ ID NO: 210997 - RNA, 64 nt, hsa; identical to SEQ ID NO: 80709

SEQ ID NO: 210998 - RNA, 64 nt, hsa; identical to SEQ ID NO: 80710

SEQ ID NO: 210999 - RNA, 64 nt, hsa; identical to SEQ ID NO: 80711

SEQ ID NO: 211000 - RNA, 64 nt, hsa; identical to SEQ ID NO: 80712

SEQ ID NO: 211001 - RNA, 64 nt, hsa; identical to SEQ ID NO: 80713

SEQ ID NO: 211002 - RNA, 64 nt, hsa; identical to SEQ ID NO: 80714

SEQ ID NO: 211003 - RNA, 64 nt, hsa; identical to SEQ ID NO: 80715

SEQ ID NO: 211004 - RNA, 53 nt, hsa; identical to SEQ ID NO: 80716

SEQ ID NO: 211005 - RNA, 64 nt, hsa; identical to SEQ ID NO: 80717

SEQ ID NO: 211006 - RNA, 64 nt, hsa; identical to SEQ ID NO: 80718

SEQ ID NO: 211007 - RNA, 64 nt, hsa; identical to SEQ ID NO: 80719

SEQ ID NO: 211008 - RNA, 64 nt, hsa; identical to SEQ ID NO: 80720

SEQ ID NO: 211009 - RNA, 64 nt, hsa; identical to SEQ ID NO: 80721

SEQ ID NO: 211010 - RNA, 64 nt, hsa; identical to SEQ ID NO: 80722

SEQ ID NO: 211011 - RNA, 64 nt, hsa; identical to SEQ ID NO: 80723

SEQ ID NO: 211012 - RNA, 64 nt, hsa; identical to SEQ ID NO: 80724

SEQ ID NO: 211013 - RNA, 64 nt, hsa; identical to SEQ ID NO: 80725

SEQ ID NO: 211014 - RNA, 64 nt, hsa; identical to SEQ ID NO: 80726

SEQ ID NO: 211015 - RNA, 52 nt, hsa; identical to SEQ ID NO: 80727

SEQ ID NO: 211016 - RNA, 64 nt, hsa; identical to SEQ ID NO: 80728

SEQ ID NO: 211017 - RNA, 64 nt, hsa; identical to SEQ ID NO: 80729

SEQ ID NO: 211018 - RNA, 64 nt, hsa; identical to SEQ ID NO: 80730

SEQ ID NO: 211019 - RNA, 64 nt, hsa; identical to SEQ ID NO: 80731

SEQ ID NO: 211020 - RNA, 64 nt, hsa; identical to SEQ ID NO: 80732

SEQ ID NO: 211021 - RNA, 64 nt, hsa; identical to SEQ ID NO: 80733

SEQ ID NO: 211022 - RNA, 64 nt, hsa; identical to SEQ ID NO: 80734

SEQ ID NO: 211023 - RNA, 64 nt, hsa; identical to SEQ ID NO: 80735

SEQ ID NO: 211024 - RNA, 64 nt, hsa; identical to SEQ ID NO: 80736

SEQ ID NO: 211025 - RNA, 64 nt, hsa; identical to SEQ ID NO: 80737

SEQ ID NO: 211026 - RNA, 64 nt, hsa; identical to SEQ ID NO: 80738

SEQ ID NO: 211027 - RNA, 64 nt, hsa; identical to SEQ ID NO: 80739

SEQ ID NO: 211028 - RNA, 64 nt, hsa; identical to SEQ ID NO: 80740

SEQ ID NO: 211029 - RNA, 64 nt, hsa; identical to SEQ ID NO: 80741

SEQ ID NO: 211030 - RNA, 64 nt, hsa; identical to SEQ ID NO: 80742

SEQ ID NO: 211031 - RNA, 64 nt, hsa; identical to SEQ ID NO: 80743

SEQ ID NO: 211032 - RNA, 64 nt, hsa; identical to SEQ ID NO: 80744

SEQ ID NO: 211033 - RNA, 64 nt, hsa; identical to SEQ ID NO: 80745

SEQ ID NO: 211034 - RNA, 64 nt, hsa; identical to SEQ ID NO: 80746

SEQ ID NO: 211035 - RNA, 64 nt, hsa; identical to SEQ ID NO: 80747

SEQ ID NO: 211036 - RNA, 64 nt, hsa; identical to SEQ ID NO: 80748

SEQ ID NO: 211037 - RNA, 64 nt, hsa; identical to SEQ ID NO: 80749

SEQ ID NO: 211038 - RNA, 64 nt, hsa; identical to SEQ ID NO: 80750

SEQ ID NO: 211039 - RNA, 64 nt, hsa; identical to SEQ ID NO: 80751

SEQ ID NO: 211040 - RNA, 64 nt, hsa; identical to SEQ ID NO: 80752

SEQ ID NO: 211041 - RNA, 64 nt, hsa; identical to SEQ ID NO: 80753

SEQ ID NO: 211042 - RNA, 64 nt, hsa; identical to SEQ ID NO: 80754

SEQ ID NO: 211043 - RNA, 64 nt, hsa; identical to SEQ ID NO: 80755

SEQ ID NO: 211044 - RNA, 64 nt, hsa; identical to SEQ ID NO: 80756

SEQ ID NO: 211045 - RNA, 64 nt, hsa; identical to SEQ ID NO: 80757

SEQ ID NO: 211046 - RNA, 64 nt, hsa; identical to SEQ ID NO: 80758

SEQ ID NO: 211047 - RNA, 64 nt, hsa; identical to SEQ ID NO: 80759

SEQ ID NO: 211048 - RNA, 64 nt, hsa; identical to SEQ ID NO: 80760

SEQ ID NO: 211049 - RNA, 64 nt, hsa; identical to SEQ ID NO: 80761

SEQ ID NO: 211050 - RNA, 64 nt, hsa; identical to SEQ ID NO: 80762

SEQ ID NO: 211051 - RNA, 64 nt, hsa; identical to SEQ ID NO: 80763

SEQ ID NO: 211052 - RNA, 64 nt, hsa; identical to SEQ ID NO: 80764

SEQ ID NO: 211053 - RNA, 64 nt, hsa; identical to SEQ ID NO: 80765

SEQ ID NO: 211054 - RNA, 64 nt, hsa; identical to SEQ ID NO: 80766

SEQ ID NO: 211055 - RNA, 64 nt, hsa; identical to SEQ ID NO: 80767

SEQ ID NO: 211056 - RNA, 64 nt, hsa; identical to SEQ ID NO: 80768

SEQ ID NO: 211057 - RNA, 64 nt, hsa; identical to SEQ ID NO: 80769

SEQ ID NO: 211058 - RNA, 64 nt, hsa; identical to SEQ ID NO: 80770

SEQ ID NO: 211059 - RNA, 64 nt, hsa; identical to SEQ ID NO: 80771

SEQ ID NO: 211060 - RNA, 64 nt, hsa; identical to SEQ ID NO: 80772

SEQ ID NO: 211061 - RNA, 64 nt, hsa; identical to SEQ ID NO: 80773

SEQ ID NO: 211062 - RNA, 64 nt, hsa; identical to SEQ ID NO: 80774

SEQ ID NO: 211063 - RNA, 59 nt, hsa; identical to SEQ ID NO: 80775

SEQ ID NO: 211064 - RNA, 64 nt, hsa; identical to SEQ ID NO: 80776

SEQ ID NO: 211065 - RNA, 64 nt, hsa; identical to SEQ ID NO: 80777

SEQ ID NO: 211066 - RNA, 64 nt, hsa; identical to SEQ ID NO: 80778

SEQ ID NO: 211067 - RNA, 64 nt, hsa; identical to SEQ ID NO: 80779

SEQ ID NO: 211068 - RNA, 64 nt, hsa; identical to SEQ ID NO: 80780

SEQ ID NO: 211069 - RNA, 64 nt, hsa; identical to SEQ ID NO: 80781

SEQ ID NO: 211070 - RNA, 64 nt, hsa; identical to SEQ ID NO: 80782

SEQ ID NO: 211071 - RNA, 64 nt, hsa; identical to SEQ ID NO: 80783

SEQ ID NO: 211072 - RNA, 64 nt, hsa; identical to SEQ ID NO: 80784

SEQ ID NO: 211073 - RNA, 64 nt, hsa; identical to SEQ ID NO: 80785

SEQ ID NO: 211074 - RNA, 64 nt, hsa; identical to SEQ ID NO: 80786

SEQ ID NO: 211075 - RNA, 64 nt, hsa; identical to SEQ ID NO: 80787

SEQ ID NO: 211076 - RNA, 64 nt, hsa; identical to SEQ ID NO: 80788

SEQ ID NO: 211077 - RNA, 64 nt, hsa; identical to SEQ ID NO: 80789

SEQ ID NO: 211078 - RNA, 64 nt, hsa; identical to SEQ ID NO: 80790

SEQ ID NO: 211079 - RNA, 64 nt, hsa; identical to SEQ ID NO: 80791

SEQ ID NO: 211080 - RNA, 64 nt, hsa; identical to SEQ ID NO: 80792

SEQ ID NO: 211081 - RNA, 64 nt, hsa; identical to SEQ ID NO: 80793

SEQ ID NO: 211082 - RNA, 64 nt, hsa; identical to SEQ ID NO: 80794

SEQ ID NO: 211083 - RNA, 64 nt, hsa; identical to SEQ ID NO: 80795

SEQ ID NO: 211084 - RNA, 64 nt, hsa; identical to SEQ ID NO: 80796

SEQ ID NO: 211085 - RNA, 64 nt, hsa; identical to SEQ ID NO: 80797

SEQ ID NO: 211086 - RNA, 64 nt, hsa; identical to SEQ ID NO: 80798

SEQ ID NO: 211087 - RNA, 64 nt, hsa; identical to SEQ ID NO: 80799

SEQ ID NO: 211088 - RNA, 64 nt, hsa; identical to SEQ ID NO: 80800

SEQ ID NO: 211089 - RNA, 64 nt, hsa; identical to SEQ ID NO: 80801

SEQ ID NO: 211090 - RNA, 64 nt, hsa; identical to SEQ ID NO: 80802

SEQ ID NO: 211091 - RNA, 64 nt, hsa; identical to SEQ ID NO: 80803

SEQ ID NO: 211092 - RNA, 64 nt, hsa; identical to SEQ ID NO: 80804

SEQ ID NO: 211093 - RNA, 64 nt, hsa; identical to SEQ ID NO: 80805

SEQ ID NO: 211094 - RNA, 64 nt, hsa; identical to SEQ ID NO: 80806

SEQ ID NO: 211095 - RNA, 64 nt, hsa; identical to SEQ ID NO: 80807

SEQ ID NO: 211096 - RNA, 64 nt, hsa; identical to SEQ ID NO: 80808

SEQ ID NO: 211097 - RNA, 64 nt, hsa; identical to SEQ ID NO: 80809

SEQ ID NO: 211098 - RNA, 64 nt, hsa; identical to SEQ ID NO: 80810

SEQ ID NO: 211099 - RNA, 64 nt, hsa; identical to SEQ ID NO: 80811

SEQ ID NO: 211100 - RNA, 64 nt, hsa; identical to SEQ ID NO: 80812

SEQ ID NO: 211101 - RNA, 64 nt, hsa; identical to SEQ ID NO: 80813

SEQ ID NO: 211102 - RNA, 64 nt, hsa; identical to SEQ ID NO: 80814

SEQ ID NO: 211103 - RNA, 64 nt, hsa; identical to SEQ ID NO: 80815

SEQ ID NO: 211104 - RNA, 64 nt, hsa; identical to SEQ ID NO: 80816

SEQ ID NO: 211105 - RNA, 64 nt, hsa; identical to SEQ ID NO: 80817

SEQ ID NO: 211106 - RNA, 64 nt, hsa; identical to SEQ ID NO: 80818

SEQ ID NO: 211107 - RNA, 64 nt, hsa; identical to SEQ ID NO: 80819

SEQ ID NO: 211108 - RNA, 64 nt, hsa; identical to SEQ ID NO: 80820

SEQ ID NO: 211109 - RNA, 64 nt, hsa; identical to SEQ ID NO: 80821

SEQ ID NO: 211110 - RNA, 64 nt, hsa; identical to SEQ ID NO: 80822

SEQ ID NO: 211111 - RNA, 64 nt, hsa; identical to SEQ ID NO: 80823

SEQ ID NO: 211112 - RNA, 64 nt, hsa; identical to SEQ ID NO: 80824

SEQ ID NO: 211113 - RNA, 64 nt, hsa; identical to SEQ ID NO: 80825

SEQ ID NO: 211114 - RNA, 64 nt, hsa; identical to SEQ ID NO: 80826

SEQ ID NO: 211115 - RNA, 64 nt, hsa; identical to SEQ ID NO: 80827

SEQ ID NO: 211116 - RNA, 64 nt, hsa; identical to SEQ ID NO: 80828

SEQ ID NO: 211117 - RNA, 64 nt, hsa; identical to SEQ ID NO: 80829

SEQ ID NO: 211118 - RNA, 64 nt, hsa; identical to SEQ ID NO: 80830

SEQ ID NO: 211119 - RNA, 64 nt, hsa; identical to SEQ ID NO: 80831

SEQ ID NO: 211120 - RNA, 64 nt, hsa; identical to SEQ ID NO: 80832

SEQ ID NO: 211121 - RNA, 64 nt, hsa; identical to SEQ ID NO: 80833

SEQ ID NO: 211122 - RNA, 64 nt, hsa; identical to SEQ ID NO: 80834

SEQ ID NO: 211123 - RNA, 64 nt, hsa; identical to SEQ ID NO: 80835

SEQ ID NO: 211124 - RNA, 64 nt, hsa; identical to SEQ ID NO: 80836

SEQ ID NO: 211125 - RNA, 64 nt, hsa; identical to SEQ ID NO: 80837

SEQ ID NO: 211126 - RNA, 64 nt, hsa; identical to SEQ ID NO: 80838

SEQ ID NO: 211127 - RNA, 64 nt, hsa; identical to SEQ ID NO: 80839

SEQ ID NO: 211128 - RNA, 64 nt, hsa; identical to SEQ ID NO: 80839

SEQ ID NO: 211129 - RNA, 64 nt, hsa; identical to SEQ ID NO: 80841

SEQ ID NO: 211130 - RNA, 64 nt, hsa; identical to SEQ ID NO: 80842

SEQ ID NO: 211131 - RNA, 64 nt, hsa; identical to SEQ ID NO: 80843

SEQ ID NO: 211132 - RNA, 64 nt, hsa; identical to SEQ ID NO: 80844

SEQ ID NO: 211133 - RNA, 64 nt, hsa; identical to SEQ ID NO: 80845

SEQ ID NO: 211134 - RNA, 64 nt, hsa; identical to SEQ ID NO: 80846

SEQ ID NO: 211135 - RNA, 64 nt, hsa; identical to SEQ ID NO: 80847

SEQ ID NO: 211136 - RNA, 64 nt, hsa; identical to SEQ ID NO: 80848

SEQ ID NO: 211137 - RNA, 64 nt, hsa; identical to SEQ ID NO: 80849

SEQ ID NO: 211138 - RNA, 64 nt, hsa; identical to SEQ ID NO: 80850

SEQ ID NO: 211139 - RNA, 64 nt, hsa; identical to SEQ ID NO: 80851

SEQ ID NO: 211140 - RNA, 64 nt, hsa; identical to SEQ ID NO: 80852

SEQ ID NO: 211141 - RNA, 64 nt, hsa; identical to SEQ ID NO: 80853

SEQ ID NO: 211142 - RNA, 64 nt, hsa; identical to SEQ ID NO: 80854

SEQ ID NO: 211143 - RNA, 64 nt, hsa; identical to SEQ ID NO: 80855

SEQ ID NO: 211144 - RNA, 64 nt, hsa; identical to SEQ ID NO: 80856

SEQ ID NO: 211145 - RNA, 64 nt, hsa
caccagcccgcugagugugcacgaaauguucgcagugcaacaaaaagaaaaauccaucaggaac

SEQ ID NO: 211146 - RNA, 64 nt, hsa
gcuguaugcuaguaauuguuuuuauuccuaaugugugcaacaucacaucuccccaagaagcaac

SEQ ID NO: 211147 - RNA, 64 nt, hsa
ggaucacuugagcacaggaguuugagaccagccugugcaacaucaugaaacaucaucucuacau

SEQ ID NO: 211148 - RNA, 64 nt, hsa
uuugucuagcuucuaaugugguaaauugcacauugugcaacagaaccauuaauaaaagaaagga

SEQ ID NO: 211149 - RNA, 64 nt, hsa
uuuuuaaaagagauguagcagaauaauucuuccagugcaacaaaaucaauuuuuugcuaaacga

SEQ ID NO: 211150 - RNA, 64 nt, hsa
guaaaaacaaaaagacagugugugugucuguugagugcaacaagagcaaaaugaugcuuuccgc

SEQ ID NO: 211151 - RNA, 64 nt, hsa
ccugcggaggagguguggucaccaggaggcggcagugcaacaaccccagguaccgcagggaggg

SEQ ID NO: 211152 - RNA, 64 nt, hsa
gugcauguguuggugcugaccuccaggccgagaugugcaacacucagguaggccugcuuccugg

SEQ ID NO: 211153 - RNA, 64 nt, hsa; identical to SEQ ID NO: 128948

SEQ ID NO: 211154 - RNA, 64 nt, hsa; identical to SEQ ID NO: 128949

SEQ ID NO: 211155 - RNA, 64 nt, hsa; identical to SEQ ID NO: 128950

SEQ ID NO: 211156 - RNA, 64 nt, hsa; identical to SEQ ID NO: 128951

SEQ ID NO: 211157 - RNA, 64 nt, hsa; identical to SEQ ID NO: 128952

SEQ ID NO: 211158 - RNA, 64 nt, hsa; identical to SEQ ID NO: 128953

SEQ ID NO: 211159 - RNA, 64 nt, hsa; identical to SEQ ID NO: 128954

SEQ ID NO: 211160 - RNA, 64 nt, hsa; identical to SEQ ID NO: 128955

SEQ ID NO: 211161 - RNA, 64 nt, hsa; identical to SEQ ID NO: 128956

SEQ ID NO: 211162 - RNA, 64 nt, hsa; identical to SEQ ID NO: 128957

SEQ ID NO: 211163 - RNA, 64 nt, hsa; identical to SEQ ID NO: 128958

SEQ ID NO: 211164 - RNA, 64 nt, hsa; identical to SEQ ID NO: 128959

SEQ ID NO: 211165 - RNA, 64 nt, hsa; identical to SEQ ID NO: 128960

SEQ ID NO: 211166 - RNA, 64 nt, hsa; identical to SEQ ID NO: 128961

SEQ ID NO: 211167 - RNA, 64 nt, hsa; identical to SEQ ID NO: 128962

SEQ ID NO: 211168 - RNA, 64 nt, hsa; identical to SEQ ID NO: 128963

SEQ ID NO: 211169 - RNA, 64 nt, hsa; identical to SEQ ID NO: 128964

SEQ ID NO: 211170 - RNA, 64 nt, hsa; identical to SEQ ID NO: 128965

SEQ ID NO: 211171 - RNA, 64 nt, hsa; identical to SEQ ID NO: 128966

SEQ ID NO: 211172 - RNA, 64 nt, hsa; identical to SEQ ID NO: 128967

SEQ ID NO: 211173 - RNA, 64 nt, hsa; identical to SEQ ID NO: 128968

SEQ ID NO: 211174 - RNA, 64 nt, hsa; identical to SEQ ID NO: 128969

SEQ ID NO: 211175 - RNA, 64 nt, hsa; identical to SEQ ID NO: 128970

SEQ ID NO: 211176 - RNA, 64 nt, hsa; identical to SEQ ID NO: 128971

SEQ ID NO: 211177 - RNA, 64 nt, hsa; identical to SEQ ID NO: 128972

SEQ ID NO: 211178 - RNA, 64 nt, hsa; identical to SEQ ID NO: 128973

SEQ ID NO: 211179 - RNA, 64 nt, hsa; identical to SEQ ID NO: 128974

SEQ ID NO: 211180 - RNA, 64 nt, hsa; identical to SEQ ID NO: 128975

SEQ ID NO: 211181 - RNA, 64 nt, hsa; identical to SEQ ID NO: 128976

SEQ ID NO: 211182 - RNA, 64 nt, hsa; identical to SEQ ID NO: 128977

SEQ ID NO: 211183 - RNA, 64 nt, hsa; identical to SEQ ID NO: 128978

SEQ ID NO: 211184 - RNA, 64 nt, hsa; identical to SEQ ID NO: 128979

SEQ ID NO: 211185 - RNA, 64 nt, hsa; identical to SEQ ID NO: 128980

SEQ ID NO: 211186 - RNA, 64 nt, hsa; identical to SEQ ID NO: 128981

SEQ ID NO: 211187 - RNA, 64 nt, hsa; identical to SEQ ID NO: 128982

SEQ ID NO: 211188 - RNA, 64 nt, hsa; identical to SEQ ID NO: 128983

SEQ ID NO: 211189 - RNA, 64 nt, hsa; identical to SEQ ID NO: 128984

SEQ ID NO: 211190 - RNA, 64 nt, hsa; identical to SEQ ID NO: 128985

SEQ ID NO: 211191 - RNA, 64 nt, hsa; identical to SEQ ID NO: 128986

SEQ ID NO: 211192 - RNA, 64 nt, hsa; identical to SEQ ID NO: 128987

SEQ ID NO: 211193 - RNA, 64 nt, hsa; identical to SEQ ID NO: 128988

SEQ ID NO: 211194 - RNA, 64 nt, hsa; identical to SEQ ID NO: 128989

SEQ ID NO: 211195 - RNA, 64 nt, hsa; identical to SEQ ID NO: 128990

SEQ ID NO: 211196 - RNA, 64 nt, hsa; identical to SEQ ID NO: 128991

SEQ ID NO: 211197 - RNA, 64 nt, hsa; identical to SEQ ID NO: 128992

SEQ ID NO: 211198 - RNA, 64 nt, hsa; identical to SEQ ID NO: 128993

SEQ ID NO: 211199 - RNA, 64 nt, hsa; identical to SEQ ID NO: 128994

SEQ ID NO: 211200 - RNA, 56 nt, hsa; identical to SEQ ID NO: 128995

SEQ ID NO: 211201 - RNA, 64 nt, hsa
caauacaauuaaggaaugggcuuugcuaacccuucugagguaacuagacugcagcuaaccacca

SEQ ID NO: 211202 - RNA, 64 nt, hsa
agggcugugauuuguaauuuaaacuaauuguauucugagguaaccacaaaauaaauucaaccaa

SEQ ID NO: 211203 - RNA, 64 nt, hsa
gcagacaggucauguacuaauccuaguccuuuuccugagguagauuuuaaacaguauuuuuaaa

SEQ ID NO: 211204 - RNA, 64 nt, hsa
guaugcuacaguuuuucacauggaauuccguuuucugagguacagcacauuuuagguaacagua

SEQ ID NO: 211205 - RNA, 64 nt, hsa
uuucccuuuuuugccccauaagggcuagcauaagcugagguagaacuuaucuuuaagcugcagc

SEQ ID NO: 211206 - RNA, 64 nt, hsa
gcucacacaugcuggcugaagcguaagcagacaacugagguacucuuuugaaggaugaaggugg

SEQ ID NO: 211207 - RNA, 64 nt, hsa
gagcagagcaugcagugauggaagaagcaggaaaagcaagaagaaaagacagcagcaucaagag

SEQ ID NO: 211208 - RNA, 64 nt, hsa
gcacccagaacaugcugagcagaacaucagaaaaagcaagaagaagaaaaggcgacaucaagaa

SEQ ID NO: 211209 - RNA, 64 nt, hsa
auucucuaauuccaauaugucuuuugcuuccagaagcaagaaaaguuucuucucuccccuccuu

SEQ ID NO: 211210 - RNA, 64 nt, hsa
aaaaaaaucauugccauaagaaaaaguauaaauuagcaagaaaggagagugacuugauuugcuu

SEQ ID NO: 211211 - RNA, 64 nt, hsa
uucaccuuacucuguauuuauauuacccauaacuagcaagaaguucuuguucuagauuuuuugu

SEQ ID NO: 211212 - RNA, 64 nt, hsa
uguuuagaggcuuuguaugugugucauuuuaauaagcaagaagauauauuuagauuagaaaugg

SEQ ID NO: 211213 - RNA, 64 nt, hsa
agcaucgaaauuugagauacccaggacccuuucaagcaagaauggccaaaaagccuugugcugu

SEQ ID NO: 211214 - RNA, 64 nt, hsa
acaccacaggaaacccacauuuuuagauggaaagagcaagaaaauugugucagugcucuuaguu

SEQ ID NO: 211215 - RNA, 64 nt, hsa
uaaacauaagccagaaauuaaaaugacuauagacagcaagaauugagcuaauaauauguuuuaa

SEQ ID NO: 211216 - RNA, 64 nt, hsa
auugagcuaauaauauguuuuaacucuuaacaccagcaagaagucagucauuuauugaaguuuu

SEQ ID NO: 211217 - RNA, 64 nt, hsa
cuccuaaaauucuagccauuugucacacaaccacagcaagaaacguguucuauaucuagagugu

SEQ ID NO: 211218 - RNA, 64 nt, hsa
cauuacuucacuauaauuacaaggacaaauuauuagcaagaaauaagaauaguauuagaagaau

SEQ ID NO: 211219 - RNA, 64 nt, hsa
auacuacauggacagaguacugcauugcaccaugagcaagaacugcucugcaagaaaaauaucu

SEQ ID NO: 211220 - RNA, 64 nt, hsa
ccuguguauaaucucuugagaucuuuuuaaagcuagcaagaacucuauuuggaucagaacuaca

SEQ ID NO: 211221 - RNA, 64 nt, hsa
agaccucccccucacuuacauaaagcucccuugaagcaagaaagagggucccagggcugcaaaa

SEQ ID NO: 211222 - RNA, 64 nt, hsa
gaguuugggagaguggugaguggaagggaggagcagcaagaagcagccuguuuucacucagcuu

SEQ ID NO: 211223 - RNA, 64 nt, hsa
uuaaaguucagcguguuaaccuaacauaaaacacagcaagaaucugguugucugaacuauuuua

SEQ ID NO: 211224 - RNA, 64 nt, hsa
aaaacuuuguuuauugaaaaaaaaagaaaaagaaagcaagaaaaaaagauacuauggggucaag

SEQ ID NO: 211225 - RNA, 64 nt, hsa
auauauaugggcuuaaucauuuaaaauuuguugcagcaagaacuuuccuaccuguaggcaauag

SEQ ID NO: 211226 - RNA, 64 nt, hsa
ccucuugaugucucucagcugcagguggagcuggagcaagaauaccaagacaaauucaaaagac

SEQ ID NO: 211227 - RNA, 64 nt, hsa
uugcacuuugaaagaaaggcguuaaucauaaagaagcaagaauggucaaaaucgaaugcugcau

SEQ ID NO: 211228 - RNA, 64 nt, hsa
aagagccagggagggcagcccaggcccaagugacagcaagaacaagaaccacugccggcgugca

SEQ ID NO: 211229 - RNA, 64 nt, hsa
ccccauccucgcugggcccgccgaccccgguguuagcaagaauccucuaaaucaguuuauggag

SEQ ID NO: 211230 - RNA, 64 nt, hsa; identical to SEQ ID NO: 156330

SEQ ID NO: 211231 - RNA, 64 nt, hsa; identical to SEQ ID NO: 156331

SEQ ID NO: 211232 - RNA, 64 nt, hsa; identical to SEQ ID NO: 156332

SEQ ID NO: 211233 - RNA, 64 nt, hsa; identical to SEQ ID NO: 156333

SEQ ID NO: 211234 - RNA, 64 nt, hsa; identical to SEQ ID NO: 156334

SEQ ID NO: 211235 - RNA, 64 nt, hsa; identical to SEQ ID NO: 156335

SEQ ID NO: 211236 - RNA, 64 nt, hsa; identical to SEQ ID NO: 156336

SEQ ID NO: 211237 - RNA, 64 nt, hsa; identical to SEQ ID NO: 156337

SEQ ID NO: 211238 - RNA, 64 nt, hsa; identical to SEQ ID NO: 156338

SEQ ID NO: 211239 - RNA, 64 nt, hsa; identical to SEQ ID NO: 156339

SEQ ID NO: 211240 - RNA, 64 nt, hsa; identical to SEQ ID NO: 156340

SEQ ID NO: 211241 - RNA, 64 nt, hsa; identical to SEQ ID NO: 156341

SEQ ID NO: 211242 - RNA, 63 nt, hsa
uguuaggcucuccagggcuucuuuccaaacccccagcuccacaccccccagacccagcugguu

SEQ ID NO: 211243 - RNA, 63 nt, hsa
cccggccaggcagcugggaccagaaugcaaccccagcuccacuccagccuggcguccagggcc

SEQ ID NO: 211244 - RNA, 63 nt, hsa
uuccuguguuaguuugcuuaugauaauggcuuccagcuccauccauauugcuacagaggacau

SEQ ID NO: 211245 - RNA, 63 nt, hsa
augacuagcucuugccgauuaaugagaagagagcagcuccacaauuuuuaauuuuuuuaacuu

SEQ ID NO: 211246 - RNA, 63 nt, hsa
ggucgugguggagaaucugagggcacucucugccagcuccacagggugggaugagccucuccu

SEQ ID NO: 211247 - RNA, 63 nt, hsa
auucccacauaauacauuccaucacagccagcccagcuccacucagggcuggcccggggaguc

SEQ ID NO: 211248 - RNA, 63 nt, hsa
gagcaucauacuggaaagcaaacaccuuuccuccagcuccagaauuccuugucucugaaugac

SEQ ID NO: 211249 - RNA, 63 nt, hsa
agcucacaccgaguugugcuuggcuugcuugugcagcuccaggcacccggugggcacucuggu

SEQ ID NO: 211250 - RNA, 63 nt, hsa
gacuuggccuaggguugucugagccggagccggcagcuccacuggagagcagugcaggcagag

SEQ ID NO: 211251 - RNA, 63 nt, hsa
ggcgugugugugguggggcuuggcaugugauggcagcuccaggcaugccgcugcuuguauggc

SEQ ID NO: 211252 - RNA, 63 nt, hsa
uugucccuuuugaucauuauuaacucaggguuucagcuccaaccucgcugaguuggugcagcu

SEQ ID NO: 211253 - RNA, 63 nt, hsa
caggguuucagcuccaaccucgcugaguuggugcagcuccaggucauuccuggggugggaauc

SEQ ID NO: 211254 - RNA, 63 nt, hsa
acagcagcuccaccaaaugaagucccucucacgcagcuccacagcgcugucucgugaauggac

SEQ ID NO: 211255 - RNA, 63 nt, hsa
ugagagcugggcggcguccacaccuaagaacagcagcuccaccaaaugaagucccucucacgc

SEQ ID NO: 211256 - RNA, 63 nt, hsa
ggccugggcccucaggauguuucaaaggcuccacagcuccaccgcuccaccuggcuucacucc

SEQ ID NO: 211257 - RNA, 63 nt, hsa
agccaugagacccacagacuuggugccugagcgcagcuccagggaagccccagccccuuccag

SEQ ID NO: 211258 - RNA, 63 nt, hsa
guuauauacagauggcagcuuggaucucagguacagcuccaggggcaggcagugcccagcugg

SEQ ID NO: 211259 - RNA, 63 nt, hsa
ucccgccagccuuguuuucagguggucuggaggcagcuccacguccacacaguggccggcccu

SEQ ID NO: 211260 - RNA, 63 nt, hsa
gcuuuuccaccuccagcaaguguucccagcaaccagcuccauccuggcugcuugccuuccauu

SEQ ID NO: 211261 - RNA, 63 nt, hsa
uggcugagcucugugaucgcugugauguggacccagcuccagggagcagagugucgaggaugg

SEQ ID NO: 211262 - RNA, 63 nt, hsa
agccaccuuugcgugucaccuucacgggacuuccagcuccagcuaccuuugugugucaccuca

SEQ ID NO: 211263 - RNA, 63 nt, hsa
ccaaggugccugugcucccagcagguccaagugcagcuccagccaccuuugcgugucaccuuc

SEQ ID NO: 211264 - RNA, 63 nt, hsa
uuuuguauaaauaaaagaaaaugggacgugucccagcuccaggggugaugggggugauggacu

SEQ ID NO: 211265 - RNA, 63 nt, hsa
ucccgcagaccaaagagagugugacucccuugccagcuccagagugggggggcugucccaggg

SEQ ID NO: 211266 - RNA, 63 nt, hsa
aaagaacuuuccaggucagccggacagcuccagcagcuccacguuccaggcagccucgcccgc

SEQ ID NO: 211267 - RNA, 63 nt, hsa
cuagaggccaaagaacuuuccaggucagccggacagcuccagcagcuccacguuccaggcagc

SEQ ID NO: 211268 - RNA, 63 nt, hsa
ucccauaccaaagcccugugaguucaucagagucagcuccaggaaccaucaugguaaguggua

SEQ ID NO: 211269 - RNA, 63 nt, hsa
uugggucagaaccuucucucucugaauuuggaucagcuccaagcagugaaaauaguaaucaga

SEQ ID NO: 211270 - RNA, 63 nt, hsa
gcaacacaacaaucagauggcaccagggacuggcagcuccacugccgucaacuccuguucucc

SEQ ID NO: 211271 - RNA, 63 nt, hsa
aaaggcccugcuuccuggaaaggacacucagagcagcuccaagacagaggcucuguggcgggg

SEQ ID NO: 211272 - RNA, 63 nt, hsa
cccuuggccagggccaugggagucccgcgcagucagcuccacauuggccucugcagcugggug

SEQ ID NO: 211273 - RNA, 63 nt, hsa
uuauugugcucagugaacauccagugcugggugcagcuccaucacccucuuguguguuuacau

SEQ ID NO: 211274 - RNA, 63 nt, hsa
aagugauagucuauaggaguguuuaauuucuugcagcuccaucugguugcugcauuugaagca

SEQ ID NO: 211275 - RNA, 63 nt, hsa
acaaggauagaugcuggcccagggcccagagcccagcuccaaggggaaucagaacucaaaugg

SEQ ID NO: 211276 - RNA, 63 nt, hsa
uuugggccagacaugccacaaggacuuccuguccagcuccaaccugcaaagaucuguccucag

SEQ ID NO: 211277 - RNA, 63 nt, hsa
ccauggcuguguccccaggcaauaggaauuuuucagcuccauuguaaucuuacgggaucauca

SEQ ID NO: 211278 - RNA, 63 nt, hsa
ugccagguaauaagugugaucauuguugaacuucagcuccagugucucuccagaauaagacau

SEQ ID NO: 211279 - RNA, 63 nt, hsa
gugucuuugucauugucugguucuuaagagucccagcuccagguggcguccucccugccucuc

SEQ ID NO: 211280 - RNA, 63 nt, hsa
gucaaauggccugcccaugaagcccuggaauuccagcuccaccuccacuaccacuccaagccu

SEQ ID NO: 211281 - RNA, 63 nt, hsa
ggcacuaccacccugcuccaucaucacuacguccagcuccaacggcacuggugccccauucca

SEQ ID NO: 211282 - RNA, 63 nt, hsa
gcaccagugccucgcuccauuggcaccaacgcccagcuccaccgguacuggcucccugcucca

SEQ ID NO: 211283 - RNA, 63 nt, hsa
gacuagcacucagagggacuuaugauaaagguucagcuccagggguaguaccugagugugugc

SEQ ID NO: 211284 - RNA, 63 nt, hsa
uuuugcaagacaguggucaacaggaagacccagcagcuccacccucccaagugacaggccauu

SEQ ID NO: 211285 - RNA, 63 nt, hsa
cugauggaaugugccaccuguccggcccagugccagcuccagugccgcuccugcuuccccucc

SEQ ID NO: 211286 - RNA, 63 nt, hsa
ggagggggaccugucccccacucucucacccaccagcuccacacauuccagccaggcccaggc

SEQ ID NO: 211287 - RNA, 63 nt, hsa
gcacuccgucugaugggaggagucgugggagcccagcuccaggcccugguaccccucuucaug

SEQ ID NO: 211288 - RNA, 63 nt, hsa
aggcaggcucucagauguagguggcaaguggcacagcuccauguccggaggcccagcacuccg

SEQ ID NO: 211289 - RNA, 63 nt, hsa
gacccccggccugcagaacaucuguccccaagccagcuccacugcccaggcccccaagagggc

SEQ ID NO: 211290 - RNA, 63 nt, hsa
aagccagcuccacugcccaggcccccaagagggcagcuccagaagcugcccagggcuccggga

SEQ ID NO: 211291 - RNA, 63 nt, hsa
aaacgccaccuuacacucugcaggcugcagcggcagcuccagauggccuccugagcuggacga

SEQ ID NO: 211292 - RNA, 63 nt, hsa
cuagggcuccagaggggugaaugggccuuugcucagcuccaggcccagcgggaagggaggcug

SEQ ID NO: 211293 - RNA, 63 nt, hsa
guccauggggaucucaucacccacucccagccccagcuccagcugcccucaccucucuagcag

SEQ ID NO: 211294 - RNA, 63 nt, hsa
gccccaccuuuguccccuagcaaauucaggguacagcuccaccuagaaccaggcugcccucua

SEQ ID NO: 211295 - RNA, 63 nt, hsa
cuuggccccugccugcgucugugcucaaagcagcagcuccaacccugccucuguccccuuccc

SEQ ID NO: 211296 - RNA, 63 nt, hsa
agugccuccccgccccgccgcuggcgucaaguucagcuccacgugugccaucaguggauccga

SEQ ID NO: 211297 - RNA, 63 nt, hsa
ucuuccuauuuugaguuugguucagaucuuaagcagcuccaugcaacuguauuuauuuuugau

SEQ ID NO: 211298 - RNA, 63 nt, hsa
aaauugauuacaaguucucugcugugguugcugcagcuccaggaaguccccgcaaugucucac

SEQ ID NO: 211299 - RNA, 63 nt, hsa
cugucagggugcuggccccucugcagauggaaucagcuccaggcugacaccagcagaguccug

SEQ ID NO: 211300 - RNA, 63 nt, hsa
gggagggaggacagaccuccaccacacugacaucagcuccagcucccccagguugggggggag

SEQ ID NO: 211301 - RNA, 63 nt, hsa
cacaucccccccaaccuacccccaccccaaaagcagcuccaacagaauggccagagggccuca

SEQ ID NO: 211302 - RNA, 64 nt, hsa
gaagacuucaagccuuaaaaggaggcugccguggagcacggauacagaaacugagacacgugga

SEQ ID NO: 211303 - RNA, 64 nt, hsa
cugucugccucagaacauagccgugaucaagaugagcacggaggcucgugucccagcaccuggc

SEQ ID NO: 211304 - RNA, 64 nt, hsa
guuucuucucaaaauggauuucauauaauuucggagcacggaagcacacacaagcucuuuauga

SEQ ID NO: 211305 - RNA, 64 nt, hsa
ggguagcugagucugcuuaggggacugcaugggaagcacggaauauaggguuagauguguguua

SEQ ID NO: 211306 - RNA, 64 nt, hsa
gcucuggaggcugcugcugaccugggccaugaggagcacggaggagaaggacuggcagauccca

SEQ ID NO: 211307 - RNA, 64 nt, hsa
ucccagccuccacuuucagagugaaauucaaggcagcacggacaugugcccaucaggcacagaa

SEQ ID NO: 211308 - RNA, 64 nt, hsa
ugggauuaccgaagaguccccuuccuugcgugucagcacggaugcugugacugccaccugcguc

SEQ ID NO: 211309 - RNA, 64 nt, hsa
guggugaggguucuaggggaucucagauguguguagcacggagccugcuguguccugggugcuc

SEQ ID NO: 211310 - RNA, 64 nt, hsa
ucauucaggaaaucaaaucagucuuccggucugcagcacggaaaagcacauaaucuuucuuugc

SEQ ID NO: 211311 - RNA, 64 nt, hsa
cuagaaaauuuuauggcuaucgaagaaaugaagaagcacggaaguacucaugucggauucccag

SEQ ID NO: 211312 - RNA, 64 nt, hsa
aacaaaucccauauguugggcaacaguucaaauaagcacggagaaguguugcccaaacuugguu

SEQ ID NO: 211313 - RNA, 64 nt, hsa
ucguuucuuuuucaucucccccccacccacaaagagcacggagccagccuuccacuuuucccag

SEQ ID NO: 211314 - RNA, 64 nt, hsa
auuugaacucagaucugucugauaggaaugugaaagcacggacucuuacugcuaacuuuugugu

SEQ ID NO: 211315 - RNA, 64 nt, hsa
caguuggaugaauagagaagggaaaaguugcuggagcacggagugaagaugggaggagcuguua

SEQ ID NO: 211316 - RNA, 64 nt, hsa
aucuugugaaccccuaaauccgcucccuccuaacagcacggauucucuuggggcucuucuucag

SEQ ID NO: 211317 - RNA, 64 nt, hsa
uuuucacauuaggcuguugguucaaacuuuugggagcacggacugucaguucucugggaagugg

SEQ ID NO: 211318 - RNA, 64 nt, hsa
ucuuacacaucugacuccgcagugccugcaggggagcacggagccgcgggacagccaagcaccu

SEQ ID NO: 211319 - RNA, 64 nt, hsa
gauuauggucuuuagauuaauacugauuauauagagcacggaaagauaaagaauugaacauuuu

SEQ ID NO: 211320 - RNA, 64 nt, hsa
ugauguauugcuucuucacguuuuguuuuuauugagcacggaguagaauuccagggcugccuug

SEQ ID NO: 211321 - RNA, 64 nt, hsa
ccuuggggagggcuccuagugcugagcuuggagcagcacggacagcagcauuguuuaugggaau

SEQ ID NO: 211322 - RNA, 64 nt, hsa
cuccccacggugcgugcccuggugcugcgggugcagcacggaaaccccggcuucuacuguacag

SEQ ID NO: 211323 - RNA, 64 nt, hsa
cucccaaacaggaaacccuggugaagguucaggaagcacggagauucucuccaacaaaggucca

SEQ ID NO: 211324 - RNA, 64 nt, hsa
gggguucgcaccgugcugggcucccccugacuguagcacggaguguuggggcugggggccagcu

SEQ ID NO: 211325 - RNA, 64 nt, hsa
uuaugcagaaaaaaauugaacaaaacaggguaccagcacggaagacuuucuuaaaacgcaaccu

SEQ ID NO: 211326 - RNA, 57 nt, hsa
accgggacacagaauuauagaugucugagcacggacucucccaggccugccugcaug

SEQ ID NO: 211327 - RNA, 64 nt, hsa
gaaagggcaccccagcgggggcauguguggaggcagcacggaacauguagguuauagaucguca

SEQ ID NO: 211328 - RNA, 64 nt, hsa
ugguuauuauuuauauuauuuauuccuguucaguagcacggaaugaucuccaaacauuccuagg

SEQ ID NO: 211329 - RNA, 64 nt, hsa
ucauguggaaagaggagcugggaccgcggcgagcagcacggagcggaagggagagcaggggaga

SEQ ID NO: 211330 - RNA, 64 nt, hsa
uuggaugaggagugguugggcugugccugggccuagcacggacauggucuguccugacagcacu

SEQ ID NO: 211331 - RNA, 64 nt, hsa
cauugaacuugucuauggcaaugcuucuuucacaagcacggacugggcugaggucaacucugau

SEQ ID NO: 211332 - RNA, 64 nt, hsa
acauagcaagcugaacuguccuaaggcaggggcgagcacggaacaauggggccuucagcuggag

SEQ ID NO: 211333 - RNA, 64 nt, hsa
ucagggacaagaccagucccccagcgugguggucagcacggaagcuccaccuucuggguggagg

SEQ ID NO: 211334 - RNA, 64 nt, hsa
gggccugaggaggggucucuccaggcauuguuccagcacggaggugaugugucacgggcccuga

SEQ ID NO: 211335 - RNA, 64 nt, hsa
aaacuuucauucaagguugaagaagaaaugaagaagcacggaaguacucauaugggauucccag

SEQ ID NO: 211336 - RNA, 64 nt, hsa
accugccuuggcaagccuauuuuagugauauggcagcacggauauaacacuaugcauuaaaagc

SEQ ID NO: 211337 - RNA, 64 nt, hsa
ucgaguucuuggggcgcagagaacuuaggagagaagcacggaggagcccccggcagagcacccg

SEQ ID NO: 211338 - RNA, 64 nt, hsa
ucuagacaccaagggggaguaagcugagcugucuagcacggauuggagacucccucucccuggu

SEQ ID NO: 211339 - RNA, 64 nt, hsa
ccggggcccacuccgauccgccugggcucagcuaagcacggaagccaagggggcugugccgugg

SEQ ID NO: 211340 - RNA, 64 nt, hsa
aaacagaugcuccuguuugcugggggagggugugagcacggaguauuucugucccucgugaagu

SEQ ID NO: 211341 - RNA, 64 nt, hsa
uagcccugaguccuaggaggagcaccucugcaccagcacggaccucucgcuccacccagcucug

SEQ ID NO: 211342 - RNA, 64 nt, hsa
aaccguuccugaaaggccaccaggcgcccaguguagcacggaagaugcccacgugccugagcca

SEQ ID NO: 211343 - RNA, 64 nt, hsa
gcguaccucccucaccgucuggggcucuucugggagcacggagcauccccuguuccuguuucac

SEQ ID NO: 211344 - RNA, 64 nt, hsa
aaggccuucccccaccacugggcagaggcuggacagcacggacuucuagagagagccgcguugc

SEQ ID NO: 211345 - RNA, 64 nt, hsa
agcccuauuuucacuccuuccaguggucgacaugagcacggacuccuaaaccuuuuccacgcca

SEQ ID NO: 211346 - RNA, 64 nt, hsa
gcgccgacguccugcccaccacgcacucccggagagcacggaaccgcacgcacgucaggcaccg

SEQ ID NO: 211347 - RNA, 64 nt, hsa
cccaugucccagccacuucugggucccagccagcagcacggauguuacuguccugcuccuuccc

SEQ ID NO: 211348 - RNA, 64 nt, hsa
gcccugugguccugucccagugcagagggccuggagcacggauugugaauaaagccgcacaugc

SEQ ID NO: 211349 - RNA, 64 nt, hsa
uccggaguaccggcgggaggagguguacauccgcagcacggacuuugaccgcacgcuggagagu

SEQ ID NO: 211350 - RNA, 64 nt, hsa
aucagugaauggaucccaacaccccaaccacaggagcacggauucccuguaccucaacacccag

SEQ ID NO: 211351 - RNA, 64 nt, hsa
ggugucacaugcccacagcagccucggugacgagagcacggagcccaagagguggggugucgug

SEQ ID NO: 211352 - RNA, 64 nt, hsa
gccccaccggcgcgcucuucgcgcccgccccugcagcacggacaauaaaccuccgccaaugcac

SEQ ID NO: 211353 - RNA, 64 nt, hsa
ucaacucaaggguggucagcucaaugcuacacagagcacggacuuuuggauucuuugcaguacu

SEQ ID NO: 211354 - RNA, 64 nt, hsa
caucaucaccgacauguccuucuuaucuggaaagagcacggaaaugcagcggccuccuugaaga

SEQ ID NO: 211355 - RNA, 64 nt, hsa
agugcuggagagggugggcugagggacuggggccagcacggaccacccaaggccucugcuuccc

SEQ ID NO: 211356 - RNA, 64 nt, hsa
uccaggagacauauuuccagcagcuggcaccugcagcacggagcuccggcuucccaaacccuca

SEQ ID NO: 211357 - RNA, 64 nt, hsa
cggcugggagcaugaccuuggcgucuguucugggagcacggaugauaagcucuggaagcuggca

SEQ ID NO: 211358 - RNA, 64 nt, hsa
gcucccggccgggcgcgguggcucacgccuguaaucccagcacuuugggaggccgaggcgggca

SEQ ID NO: 211359 - RNA, 64 nt, hsa
cuugccagccaggcgugguggaucacgccuguaaucccagcacucugggaggccaaagcgggca

SEQ ID NO: 211360 - RNA, 64 nt, hsa
uaggcaggccaggugcaguggcucaugccuguaaucccagcauuuugguaggccgaggagggca

SEQ ID NO: 211361 - RNA, 64 nt, hsa
acacauggccaggcgcgguggcucacacccguaaucccagcacuuugcggggccgaggcagggg

SEQ ID NO: 211362 - RNA, 64 nt, hsa
aagccaggccgagcguguuggcucacgcuuguaaucccagcacuuugggaggccgaggcgggug

SEQ ID NO: 211363 - RNA, 64 nt, hsa
gugauuggccaggcgcaguggcucacgccuguaaucccagcacugggaggccgaggggggcgga

SEQ ID NO: 211364 - RNA, 64 nt, hsa
auggcaggcugggcgcgguggcucacgccuguaaucccagcacuuugggaggccaaggugggcg

SEQ ID NO: 211365 - RNA, 64 nt, hsa
uucuaacagaggaaacaaaugguccagcagucguucccagcagaacagcggagccuggacugac

SEQ ID NO: 211366 - RNA, 64 nt, hsa
acugggggcccagcagagccugcucccacccuccucccagcagcagacacccacccucucacug

SEQ ID NO: 211367 - RNA, 64 nt, hsa
uuuuuaggcugggcaugguggcucacaccuguaaucccagcacuuugagaggccgaggugagac

SEQ ID NO: 211368 - RNA, 64 nt, hsa
aacgaggcugggcgcaguggccucaugccuauaaucccagcacuuuggaaggcugaggcagaag

SEQ ID NO: 211369 - RNA, 64 nt, hsa
acccaguaguuaaaaaucaacucauugccuguaaucccagcacuuugggaggccgagacgggug

SEQ ID NO: 211370 - RNA, 64 nt, hsa
caguuucaaucuucugcauauggcuagccaguaaucccagcaccauuuauuaaauggggacuuc

SEQ ID NO: 211371 - RNA, 64 nt, hsa
gugaaaucugcccgggcacaccucaugccuguaaucccagcacucugggaggccaaggcagaug

SEQ ID NO: 211372 - RNA, 64 nt, hsa
uauuucauccgggcgcaguggcucacaccuguaaucccagcacuuugggaggccgaggugggca

SEQ ID NO: 211373 - RNA, 64 nt, hsa
uuuuuaaaauuagccugguggcucacgccuguaaucccagcacuuugggaggccgagguggcca

SEQ ID NO: 211374 - RNA, 64 nt, hsa
aaauuaggccgggcaugguggcucacgccuguaaucccagcacuuugggaggcccaggugggcg

SEQ ID NO: 211375 - RNA, 64 nt, hsa
cucucgggccaggcgcuguggcucacaccuauaaucccagcacuuuaggaggccgaggcaggcg

SEQ ID NO: 211376 - RNA, 50 nt, hsa; identical to SEQ ID NO: 178066

SEQ ID NO: 211377 - RNA, 64 nt, hsa
gcaugcucuggggaggcggcucuggcucuugccuucccagcaugcccuuuacuacaaagggcua

SEQ ID NO: 211378 - RNA, 64 nt, hsa
gcaugcucuagagaggcggcucuggugccccuccucccagcaugcucuggggaggcggcucugg

SEQ ID NO: 211379 - RNA, 64 nt, hsa
gcacgcucuggggaggcggcucuggugcccauccucccagcaugcucuagagaggcggcucugg

SEQ ID NO: 211380 - RNA, 64 nt, hsa
gcaugcucuagagaggcggcucuggugcccauccucccagcacgcucuggggaggcggcucugg

SEQ ID NO: 211381 - RNA, 64 nt, hsa
aagugcaguccuuggagauguacugguguccgucucccagcaugcucuagagaggcggcucugg

SEQ ID NO: 211382 - RNA, 64 nt, hsa
gugggaggaaggggaaagggcugggccucaccgcucccagcaacugaaaggacaacacuaucug

SEQ ID NO: 211383 - RNA, 64 nt, hsa
cugcccacuccugcgcuuuucaucgccauuccauucccagcagcuuuggagaccuccaggauua

SEQ ID NO: 211384 - RNA, 64 nt, hsa
guccugagccagccgugguggcucacaccuguaaucccagcacuuugggaggcugaggcaggug

SEQ ID NO: 211385 - RNA, 64 nt, hsa
uuuuuuggccgggcaugguggcucaugccuguaaucccagcacuuggggaggccaaggcaggcg

SEQ ID NO: 211386 - RNA, 64 nt, hsa
ucacacacuugucugugcuaugauguaugcaggaucccagcauugauacccaaugacaaacuau

SEQ ID NO: 211387 - RNA, 64 nt, hsa
agcaaaccgugccuucuggcucugcgccccauauucccagcaucauagacauccaacagcacca

SEQ ID NO: 211388 - RNA, 64 nt, hsa
uugaccuagccagcgcaguggcucaugccuguaaucccagcacuuugggaggcugaggcgggcg

SEQ ID NO: 211389 - RNA, 64 nt, hsa
aacgugggcugggcaugguggcucaugccuguaaucccagcacucugggaggcugaggugggcg

SEQ ID NO: 211390 - RNA, 64 nt, hsa
agucagcaggaggcugccggaacaacagcggcuuucccagcaaccccaaauucuggcugcgggu

SEQ ID NO: 211391 - RNA, 64 nt, hsa
gcucaggugacuggagcccgagggccugacagguucccagcagcugggccggccagccuugcac

SEQ ID NO: 211392 - RNA, 64 nt, hsa
aacuuuggcugggcaugguggcucacgccuguaaucccagcacuuugggaggccauggcgggug

SEQ ID NO: 211393 - RNA, 64 nt, hsa
uugacuggcugggugcgguggcucacgcuuguaaucccagcacuuugggaggcugaggcaggcg

SEQ ID NO: 211394 - RNA, 64 nt, hsa
gcugaaauggaagucagaagugagugaccuguuuucccagcaacucacccucuuccaucuccaa

SEQ ID NO: 211395 - RNA, 64 nt, hsa
ugucguggccgggcgcaguggcucacgccuguaaucccagcacuuugggaggccgaggugggug

SEQ ID NO: 211396 - RNA, 64 nt, hsa
cauaagggcugggggugguggcucaugccuguaaucccagcacuuugggaggccgaggcgggcg

SEQ ID NO: 211397 - RNA, 64 nt, hsa
ugaauaggccaggcgcaguggcucacaccuguaaucccagcacguugggaggccaaggcgggca

SEQ ID NO: 211398 - RNA, 64 nt, hsa
aaauaaggccagguguggugacucacacuuguaaucccagcaauuugggaggcugagacaggag

SEQ ID NO: 211399 - RNA, 64 nt, hsa
uaaauaaauaaucgacucaaaaauaagucaugugucccagcauaaggcaucagguuguuagaug

SEQ ID NO: 211400 - RNA, 64 nt, hsa
caagagggccgggcgcggugacucacgccuauaaucccagcacuuugggaggccgagaugggug

SEQ ID NO: 211401 - RNA, 64 nt, hsa
aacuuuggccgggcacgguggcucacaccuauaaucccagcacuaugggaggcugaggcaagca

SEQ ID NO: 211402 - RNA, 64 nt, hsa
uaaaggggccgggugugguggcucacaccuguaaucccagcacuuugggaggccgaagugggug

SEQ ID NO: 211403 - RNA, 64 nt, hsa
aauucuaggccggugcgguggcucaugccuguaaucccagcacuguaggcggccgaggugggug

SEQ ID NO: 211404 - RNA, 64 nt, hsa
gcuuugggccaggugcgguggcucaugccuguaaucccagcacuaugggaggccagggagggag

SEQ ID NO: 211405 - RNA, 64 nt, hsa
uauugauuggauugacuuuuuugcauuaaauuuuucccagcaaaauaaaucauauggcgaguca

SEQ ID NO: 211406 - RNA, 64 nt, hsa
aauccaggccaggugugguggcucaugccuguaaucccagcacuuugagaggccgaggugggca

SEQ ID NO: 211407 - RNA, 64 nt, hsa
cuuguaggcugagcgcgguggcucacgccuguaaucccagcacuuugggaggccaaggugggug

SEQ ID NO: 211408 - RNA, 64 nt, hsa
auagagggccaggugugguggcucacgccugugaucccagcacuuugggaggccaagacgggcg

SEQ ID NO: 211409 - RNA, 64 nt, hsa
uuacauaugccggcgcaguggcucauguguguaaucccagcacucugggaggcugagacaggua

SEQ ID NO: 211410 - RNA, 64 nt, hsa
aaaauuagccgggcgcgguggcucacaccuguaaucccagcacuuugggagguggaggcgggug

SEQ ID NO: 211411 - RNA, 64 nt, hsa
agugcuucugggcccagcuaaggaagccaucuguucccagcagaggagagcugcugcgcugacc

SEQ ID NO: 211412 - RNA, 64 nt, hsa
gagagcugcugcgcugaccugcagagguugguggucccagcacagagcugugcccaugggcuug

SEQ ID NO: 211413 - RNA, 64 nt, hsa
ucugguggccgggcgcgguggcucaaaccuguaaucccagcacuuugggaggccgaggugggug

SEQ ID NO: 211414 - RNA, 64 nt, hsa
gugauuggccaggugcaguggcucacaccuguaaucccagcacuuugggaggccaaagugggug

SEQ ID NO: 211415 - RNA, 64 nt, hsa
aaaauuagcuuggcgugguggugggcgccuguagucccagcagcuugggaggcugaggcuggag

SEQ ID NO: 211416 - RNA, 64 nt, hsa
guuuuaguccaggcacaguggcucacgccuguaaucccagcacuuugggaggccgaggugggug

SEQ ID NO: 211417 - RNA, 64 nt, hsa
aacaucucaggccacucauuaccuucgcucaugaucccagcagccauuuuucuuaacaccuucu

SEQ ID NO: 211418 - RNA, 64 nt, hsa
ggaacuccugcacaaguuuuaacugaacaagaaaucccagcaaaaggcauuuuuuuuucuacuu

SEQ ID NO: 211419 - RNA, 64 nt, hsa
cgaagcggccgggcacgguggcucaugccuguaaucccagcacuuuggggggcugaggugggcg

SEQ ID NO: 211420 - RNA, 64 nt, hsa
ugcuauggucuugauacauccucaaacuuucccuucccagcacagaggaauauuggcuggcaug

SEQ ID NO: 211421 - RNA, 64 nt, hsa
uaauuuuuauagaaucauucauauggaacugaguucccagcaucaucuuauucugaauagcauu

SEQ ID NO: 211422 - RNA, 64 nt, hsa
cauugugacuucucugauaaagcgucugaucuaaucccagcacuucuguaaccuucagcauuuc

SEQ ID NO: 211423 - RNA, 64 nt, hsa
ggagagucaaagggcuugcuugccccagcagaguucccagcagacagccauggcucuucccagc

SEQ ID NO: 211424 - RNA, 64 nt, hsa
cccagcagaguucccagcagacagccauggcucuucccagcagccugugcaaauucugaugaug

SEQ ID NO: 211425 - RNA, 64 nt, hsa
guuccaugaagaccacauccacacacgcaggaacucccagcaacacaagcuggaagcacauguu

SEQ ID NO: 211426 - RNA, 64 nt, hsa
aaguuuggccgggugcgguggcucacgccuguaaucccagcacuuugggaggccaagguggggg

SEQ ID NO: 211427 - RNA, 64 nt, hsa
agauauggccgagcgugauggcucaccccuguaaucccagcacuuugugaggccaaggugggcg

SEQ ID NO: 211428 - RNA, 64 nt, hsa
auacagggcugggcacgguggcucacgccuguaaucccagcacuuugggagguugcggguggau

SEQ ID NO: 211429 - RNA, 64 nt, hsa
gaaguuagcugggugugguggcucaugccuguaaucccagcacuuugggggccaaggagggugg

SEQ ID NO: 211430 - RNA, 64 nt, hsa
guuaauagccaggcaugguggcucaugccuguaaucccagcacuuugggaggcugaggcgggcg

SEQ ID NO: 211431 - RNA, 64 nt, hsa; identical to SEQ ID NO: 211424

SEQ ID NO: 211432 - RNA, 64 nt, hsa; identical to SEQ ID NO: 211423

SEQ ID NO: 211433 - RNA, 64 nt, hsa
gaaagaggccagacauggugucucacacguuuaaucccagcacuuugggaggcaggggcgggug

SEQ ID NO: 211434 - RNA, 64 nt, hsa
agggguggccgggcacaguggcucacgccuguaaucccagcacuuugagaggcugaggugguag

SEQ ID NO: 211435 - RNA, 64 nt, hsa
gugccuggcugggcgugguggcucacgccuguaaucccagcacuuugggaggccgaggcaggcg

SEQ ID NO: 211436 - RNA, 64 nt, hsa
guucuagcccaggagcgguggcucacacuuguaaucccagcacuuugggaugcuaaggcaggcg

SEQ ID NO: 211437 - RNA, 64 nt, hsa
guucuaggcggggcgugguggcucacacuuguaaucccagcacuuugggaggccaaggugggcg

SEQ ID NO: 211438 - RNA, 64 nt, hsa
cuaagcugggugggguggcucacacccgacguaaucccagcacguugggaggccgaggcaggug

SEQ ID NO: 211439 - RNA, 64 nt, hsa
cauucaggccaggcacggugacucacgccuguaaucccagcacuuugggaggccgaggcgggug

SEQ ID NO: 211440 - RNA, 64 nt, hsa
ccccgcccacauccuccuuccccaggaccugagcucccagcaucugcagacgacccccgcagcc

SEQ ID NO: 211441 - RNA, 64 nt, hsa
gagaccaaaggccgcccccgccugcugggguuccucccagcaccccagcuugcuggcugcccuc

SEQ ID NO: 211442 - RNA, 64 nt, hsa
uugguugcugcucuggccagggaggcagccccacucccagcaagcagaagugauccucgagggu

SEQ ID NO: 211443 - RNA, 64 nt, hsa
gccugaaaacagaggggagggaggaaggaaggagucccagcaggagcacagcccugguuuccug

SEQ ID NO: 211444 - RNA, 64 nt, hsa
cgagaccuucagcaguugaggcuggggcuaguggucccagcagcccagcccccacccuccuggc

SEQ ID NO: 211445 - RNA, 64 nt, hsa
ugcuaccucccagggcaugcagucuggaagggggucccagcaguggagugccgggacccucaga

SEQ ID NO: 211446 - RNA, 64 nt, hsa
aacaaaaucauucauaguuccauucacugugcuaucccagcaucucaguccuuccuccaugcag

SEQ ID NO: 211447 - RNA, 64 nt, hsa
acuuugggucggaugcaggggcucacaccgguaaucccagcacuuugagaggcugaggcgggaa

SEQ ID NO: 211448 - RNA, 64 nt, hsa
auguauggcuggacgcgguggcucacgccuguaaucccagcacuuugggaggcugaggcgggug

SEQ ID NO: 211449 - RNA, 64 nt, hsa
ccuucaggccagucgugguggcucaugccuguaaucccagcacuuugcaaggccgaggagggug

SEQ ID NO: 211450 - RNA, 64 nt, hsa
uuucacucuucaaacucccaaacacaugacuucuucccagcagcccuucccggccucuaaaguu

SEQ ID NO: 211451 - RNA, 64 nt, hsa
uucccagcagcccuucccggccucuaaaguuuggucccagcagcccuucccagccucuaaaguu

SEQ ID NO: 211452 - RNA, 64 nt, hsa
uagcacccagcaugugaccccacuccugaucaggucccagcaucuucccuucuuguucuguucc

SEQ ID NO: 211453 - RNA, 64 nt, hsa
ccagcaucuucccuucuuguucuguuccuuaaggucccagcaccuuaccccaggacuuggucuu

SEQ ID NO: 211454 - RNA, 64 nt, hsa
caucuguuaaaugagagaauagaguaugguugauucccagcauucagugguccugucaagcaac

SEQ ID NO: 211455 - RNA, 64 nt, hsa
auccuuggccuggcgcgguggcucacaccuguaaucccagcacuuuuggaggccaaggugggug

SEQ ID NO: 211456 - RNA, 64 nt, hsa
guccagggccggacacaguggcccaugccuguaaucccagcacuuuggggggccaaggcaggcu

SEQ ID NO: 211457 - RNA, 64 nt, hsa
uagaaaucucagcaugagcugcuauagaauacccucccagcaacaaaaccuaaucaguaaggcc

SEQ ID NO: 211458 - RNA, 64 nt, hsa
cuuaggugccgucucuagucugugagggaggaacucccagcauccccauugcccacaaauggaa

SEQ ID NO: 211459 - RNA, 64 nt, hsa
cugugguggcauuggccgagggucuucgggugcuucccagcacaagcugcccuugcuguccugu

SEQ ID NO: 211460 - RNA, 64 nt, hsa
gcccugggugggggacacucagagugggagcacaucccagcagugcccauguagcaggagcaca

SEQ ID NO: 211461 - RNA, 64 nt, hsa
caccaccuccugcacugcacuucugccguccacaucccagcacacuggcgaccugacuagcagc

SEQ ID NO: 211462 - RNA, 64 nt, hsa
acagucccuccacugugaacaagcuuuugcagcuucccagcacgaccauugaaaauaucucugu

SEQ ID NO: 211463 - RNA, 64 nt, hsa
uugccaguagugccuucaucaguuaagggaggugucccagcacagaucauucucaaaagcgagc

SEQ ID NO: 211464 - RNA, 64 nt, hsa
gucuucucuucugccaacuaacgugcucgcgcccucccagcacguggagagcuucaauugucag

SEQ ID NO: 211465 - RNA, 64 nt, hsa
cccugagcucuccugcaggguggagggcauuguuucccagcacccaggcagugucuugcuggug

SEQ ID NO: 211466 - RNA, 64 nt, hsa
ggaggccaggaugugcagucuccacauaguggcuucccagcaacaacuuuugacuuagaugggg

SEQ ID NO: 211467 - RNA, 64 nt, hsa
cauuaaggccgggugggguggcacaugccuguaaucccagcacuuugggaggccaaggcuggug

SEQ ID NO: 211468 - RNA, 64 nt, hsa
ugugauggcugggugcaguggcucacgccuguaaucccagcacuuugggaggcuuaggcggcug

SEQ ID NO: 211469 - RNA, 64 nt, hsa
agggcagaguagccaggguguggcccugccaucuucccagcagggccacucccggcacuccaug

SEQ ID NO: 211470 - RNA, 64 nt, hsa
guuuccuuuuugguacuuauuacugcuaaguauuucccagcacaugaaaccuuauuuuuuccca

SEQ ID NO: 211471 - RNA, 64 nt, hsa
aaauagggcugggcgcgguugcucacgccuguaaucccagcacuuuucagaggccaaggcgggc

SEQ ID NO: 211472 - RNA, 64 nt, hsa
ccuuuuggcauggugccauggcucacaucuguaaucccagcacuuuuggaggcugaggcgggug

SEQ ID NO: 211473 - RNA, 64 nt, hsa
accacagaaggagacccagacaucccgaggaaguucccagcagagcaaacugcuuuccagccug

SEQ ID NO: 211474 - RNA, 64 nt, hsa
cugggugaggcucccaaccuggcaguccccagccucccagcaucugugagcgucuguuggacuu

SEQ ID NO: 211475 - RNA, 64 nt, hsa
aaaccauaaugcagagugggcccccuacuccauuucccagcaaaaggcuccagcuggagggaug

SEQ ID NO: 211476 - RNA, 64 nt, hsa
ccuuaccugucaauaacaaugguggccaccugggucccagcacuuggcugguggagagauuuuu

SEQ ID NO: 211477 - RNA, 64 nt, hsa
uugauaggccgggcaugguggcucaugccuguaaucccagcacuuugggaggccaggaguucga

SEQ ID NO: 211478 - RNA, 64 nt, hsa
aagucaggcugggcgcaguggcucacgccuguaaucccagcacuuugggagggauaggugggcg

SEQ ID NO: 211479 - RNA, 64 nt, hsa
uguggggaggaaccauaaacccagcccucacagcucccagcacagggccucccugagccagugg

SEQ ID NO: 211480 - RNA, 64 nt, hsa
caucugggccaggcaagauggcucacgccugugaucccagcauuuugggaggccgaggcgggug

SEQ ID NO: 211481 - RNA, 64 nt, hsa
uuuugcuuauguuuuuccuuuuuaucuucucucaucccagcauacugaguuauuuauuaauuag

SEQ ID NO: 211482 - RNA, 64 nt, hsa
cagccccucagucaugcugccuucugcugcucccucccagcaggauucacccucucauucccgg

SEQ ID NO: 211483 - RNA, 64 nt, hsa
ucucucuucuaauuuucaguauaaccaaaaauuaucccagcaugagcacgggcacgugcccuuc

SEQ ID NO: 211484 - RNA, 64 nt, hsa
aaauugggccaggcacgguggcucacgccuguaaucccagcacuuugggaggccaaggccagcg

SEQ ID NO: 211485 - RNA, 64 nt, hsa
ggauaugguuauauauaugggaugguuugguuggucccagcaaaguauaugaaaauuaaaguuc

SEQ ID NO: 211486 - RNA, 64 nt, hsa
agcagcagucaggcacgguggcucaugccuguaaucccagcacuuugggaggcugaggcaggcg

SEQ ID NO: 211487 - RNA, 64 nt, hsa
gguguuggccaggcaugguggcucaugccuguaaucccagcauuuugggaggccaaggcgggcg

SEQ ID NO: 211488 - RNA, 64 nt, hsa
cauaaggccaggagcaguggcucacaccuuguaaucccagcacuuugggaggccaaggugggcg

SEQ ID NO: 211489 - RNA, 64 nt, hsa
auauauggccaggcgggauggcucacgccuguaaucccagcacuuugggaggcugaggcgggca

SEQ ID NO: 211490 - RNA, 64 nt, hsa
aaaauuagccgggcgugguggcuuacgccuguaaucccagcacuuugggaggccaaggugggcg

SEQ ID NO: 211491 - RNA, 64 nt, hsa
auaacuugccgggugcgguggcucaccccuguaaucccagcacuuugggaggccaaagcaggcg

SEQ ID NO: 211492 - RNA, 64 nt, hsa
aaaauuagccagggguggugguaugcaccugcagucccagcaacaugggaggcugaacaggaga

SEQ ID NO: 211493 - RNA, 64 nt, hsa
cuugagaacuuggcucagggcuccugaggaccuuucccagcauuaccuucccuucccuugaaag

SEQ ID NO: 211494 - RNA, 64 nt, hsa
acuaaaggccaggugcaguggcccaugccuguaaucccagcacuuugggaggugggacaauugc

SEQ ID NO: 211495 - RNA, 64 nt, hsa
aacacaggccgggucugguggcucaugccuguaaucccagcacuuugagaggccugaggucggc

SEQ ID NO: 211496 - RNA, 64 nt, hsa
gcuugucaacacagaauucaagccucauuugcuaucccagcaucucuuaaaacuuuguagucuu

SEQ ID NO: 211497 - RNA, 64 nt, hsa
agggggggccaggugcaguggcucacgccuguaaucccagcaguuugggaggccaaggcaagug

SEQ ID NO: 211498 - RNA, 64 nt, hsa
ugccuuaucagaaaccaagcuuaugaagaucuucucccagcagguccauagcaguaggcuuagg

SEQ ID NO: 211499 - RNA, 64 nt, hsa
cauauuugggcuggguauggagguucacugguaaucccagcacuuugggaggcccaggcagaag

SEQ ID NO: 211500 - RNA, 64 nt, hsa
aauuuuggcuaggcgugauggcucaggucuguaaucccagcacuuucgguggccggggugggug

SEQ ID NO: 211501 - RNA, 64 nt, hsa
ucucugucgcccaggcuggggugcaguggcgcgaucccagcacugcagccucaaccuccugggc

SEQ ID NO: 211502 - RNA, 64 nt, hsa
ccccucugcccugucccugcacaccuccacugccucccagcagaucuguggagacaaaacaagc

SEQ ID NO: 211503 - RNA, 64 nt, hsa
aaaucccagcaccccagccacaggcuguggcugcucccagcagaggcggggccggcagagaagg

SEQ ID NO: 211504 - RNA, 64 nt, hsa
guuuguacguuucucuuugaugaccaggaagaaaucccagcaccccagccacaggcuguggcug

SEQ ID NO: 211505 - RNA, 64 nt, hsa
acucuaggcugggugugguggcucacgccuauaaucccagcacuuugggaggcugaggugggug

SEQ ID NO: 211506 - RNA, 64 nt, hsa
accacuggccaggcgagguggcucacaccuguaaucccagcacuuugggaggccaaggcgggug

SEQ ID NO: 211507 - RNA, 64 nt, hsa
gggaaauagcaguucagagagaggaagcucucugucccagcaccgagacucacuccuaagucuu

SEQ ID NO: 211508 - RNA, 64 nt, hsa
acaagauggaagccuaaagcccaagucgagcagcucccagcacugcugugcagaccuagagguc

SEQ ID NO: 211509 - RNA, 64 nt, hsa
gaaaagaauuccccaggagaaaauggaaacacuaucccagcaaucugaauuccuuacuugggga

SEQ ID NO: 211510 - RNA, 64 nt, hsa
gcauugggcugagugugguggcucaugccuguaaucccagcacuuugggaggcugagacaggcg

SEQ ID NO: 211511 - RNA, 64 nt, hsa
aaaauuaaccaugcguggugguacacgucugucaucccagcagcucuuaaggcugaggcacaag

SEQ ID NO: 211512 - RNA, 64 nt, hsa
auaagaggccgggugcgguggcucaagccuguaaucccagcacuuugggaggccgaggcaggca

SEQ ID NO: 211513 - RNA, 64 nt, hsa
uuugcuggccagguaugguggcucacgccuguaaucccagcacuuugggaggcuaaggugggcg

SEQ ID NO: 211514 - RNA, 64 nt, hsa
uuauuuggccaagccugauggcucgugccuguacucccagcacuuugggaggcugaggugggag

SEQ ID NO: 211515 - RNA, 64 nt, hsa
guccuuggccaggugcaguggcucacgccuguaaucccagcacuuugggaggcugaggcaggcg

SEQ ID NO: 211516 - RNA, 64 nt, hsa
aaagcaaagaagagaagugacuuuuccuggccucucccagcaugcccugggcugagaugagaug

SEQ ID NO: 211517 - RNA, 64 nt, hsa
caagacgggccggcacgguggcucacgccuguaaucccagcacugagaggccgaucacuugagg

SEQ ID NO: 211518 - RNA, 64 nt, hsa
aagaugggccaggugcgguggcucacaccuguaaucccagcauuuugggaggccaaggugggug

SEQ ID NO: 211519 - RNA, 64 nt, hsa
auuagcagccaggugcaguggcucacgccuguaaucccagcacuuuaggaggccgaggcuggca

SEQ ID NO: 211520 - RNA, 64 nt, hsa
aucagcuucaucaaaacagaagaaaaaggcuaagucccagcaauacaaaggacauaagaaaagu

SEQ ID NO: 211521 - RNA, 64 nt, hsa
gggcuuucuggcugcucuucauugaccuguguguucccagcacacgaacagugccccuaacgga

SEQ ID NO: 211522 - RNA, 64 nt, hsa
gugggagagaaucaagcuccuguggccaccugugucccagcagcagugaguggagcugcucagg

SEQ ID NO: 211523 - RNA, 64 nt, hsa
gccuuagaaacagaauuccuaaggggauugacucucccagcauguucccagguccugcacccuu

SEQ ID NO: 211524 - RNA, 64 nt, hsa
guuggcggccgggugcaguggcucacgccuguaaucccagcacuucgggaggccgaggcgggug

SEQ ID NO: 211525 - RNA, 64 nt, hsa
cggugaggccgggcgcaguggcucacgccuguaaucccagcacuuugggaggccgaggcgggug

SEQ ID NO: 211526 - RNA, 64 nt, hsa
aauuuggccagacacaggugccucacgccuguaaucccagcacuuugggaggcugagcuggauc

SEQ ID NO: 211527 - RNA, 64 nt, hsa
ggccuuggcugggcaugguggcucacgccuguaaucccagcacuuugggaggccgaggucagga

SEQ ID NO: 211528 - RNA, 64 nt, hsa
ccuuagggccgagugcgguggcucacgccuauaaucccagcacuuugggaggccgaggcgggcg

SEQ ID NO: 211529 - RNA, 64 nt, hsa
acuugucuggcaaacaggagaugcuggauuucaaucccagcagggccucacuaguugagguauu

SEQ ID NO: 211530 - RNA, 64 nt, hsa
ggcucuggcugggugugguggcucacaccuguaaucccagcacuuugggaggcugaggcaggag

SEQ ID NO: 211531 - RNA, 64 nt, hsa
aggagaggccaggccugguggcucacgccuguaaucccagcacuuuaagaggccaaggcggaug

SEQ ID NO: 211532 - RNA, 64 nt, hsa
gagagauagugggugugguggcucacaccugcaaucccagcacuuuggaaggccgaggugggca

SEQ ID NO: 211533 - RNA, 64 nt, hsa
auaaugggccaggugaaguggcucacaccuguaaucccagcacuguggaaagacaggaguucga

SEQ ID NO: 211534 - RNA, 64 nt, hsa
aaugcgggccaggcacaguggcucacaccuguaaucccagcacuaugggaggcccaggugagca

SEQ ID NO: 211535 - RNA, 64 nt, hsa
caugaauuguuuauuugcagugaugcuucauauuucccagcacuguucaugguaucuuauuucc

SEQ ID NO: 211536 - RNA, 64 nt, hsa
uguauaggcugggugcgguggcucaugccuguaaucccagcacuuugggaggccaaggcaggug

SEQ ID NO: 211537 - RNA, 64 nt, hsa
agauggagccgggugcaguugccaacacuuguaaucccagcaguuugcgaggccgaggcaggug

SEQ ID NO: 211538 - RNA, 64 nt, hsa
acaggugagugggcaugguggcucaugccuguaaucccagcacuuuggaaggcugaggugggug

SEQ ID NO: 211539 - RNA, 64 nt, hsa
gccaggggccgggcacggugccucacaccuguaaucccagcacuuagguaggccaaggugggug

SEQ ID NO: 211540 - RNA, 64 nt, hsa
aaaauuagccaggcgugguggugggcaccuguagucccagcaacucgggaggcugaggcaggag

SEQ ID NO: 211541 - RNA, 64 nt, hsa
gccuuuggccgggugcgggggcucacgccuguaaucccagcacuuugggaggcccaggugggcg

SEQ ID NO: 211542 - RNA, 64 nt, hsa
ccaaguggccaggugcgguggcucaugccuguaaucccagcacuuugggaggccauggcaggug

SEQ ID NO: 211543 - RNA, 64 nt, hsa
ugaauuuggccuggcacaggggucacaccuguaaucccagcacuuugggaggacaaggugggug

SEQ ID NO: 211544 - RNA, 64 nt, hsa
aaaauuagccaggcgcauuggcucaugucuguaaucccagcacuuugggaggucgggggggugg

SEQ ID NO: 211545 - RNA, 64 nt, hsa
aggguuggccaggcacggugguucaugccuguaaucccagcacuaugggaggccgagacgggcg

SEQ ID NO: 211546 - RNA, 64 nt, hsa
aaaauagaccaggugcucuggcucaugccuguaaucccagcacuuugggaggccaaggugggca

SEQ ID NO: 211547 - RNA, 64 nt, hsa
ugcacaggacaggugugguggcucacaccuguaaucccagcacuuugggaggccgaggcaagag

SEQ ID NO: 211548 - RNA, 64 nt, hsa
ggauugggccaggcguggugucucacaccuguaaucccagcacuuugagaggccaagacaggua

SEQ ID NO: 211549 - RNA, 64 nt, hsa
cuucuuugcugggcauggugacucacgccuguaaucccagcacuuuggaagggugaggugggug

SEQ ID NO: 211550 - RNA, 64 nt, hsa
auucucggcugggcgcgguggcgcaugccuguaaucccagcacuuugggaggccaaggugggug

SEQ ID NO: 211551 - RNA, 64 nt, hsa
acaucagggcugggcacagcgguuccgccuguaaucccagcacuuugggagguccaggcaggug

SEQ ID NO: 211552 - RNA, 64 nt, hsa
auuucuggccgggcgugguggcucaagccuguaaucccagcacuuugggaggccgaggugggcg

SEQ ID NO: 211553 - RNA, 64 nt, hsa
uguuugggccaggcacagucgcucauacuuguaaucccagcacuuugggaggccgaggcgggug

SEQ ID NO: 211554 - RNA, 64 nt, hsa
uaaucaggcuaggcacaguggcucacacauggaaucccagcacuuugggaggccgaggugggag

SEQ ID NO: 211555 - RNA, 64 nt, hsa
ucuccccagcacugaguccccccuccuuugugugucccagcacccuuggccugaguaaacuugg

SEQ ID NO: 211556 - RNA, 64 nt, hsa
cugagaggccgggcacgguggcucacgccuguaaucccagcacuuugggaggcugagacaggca

SEQ ID NO: 211557 - RNA, 64 nt, hsa
uuaccuggccaggcaugguggcucacgccuguaaucccagcacuuugggaggccgaggcaggug

SEQ ID NO: 211558 - RNA, 64 nt, hsa
caucugagcuggaugcaguggcuuguuccuauagucccagcacuuugggaggcugaggugggug

SEQ ID NO: 211559 - RNA, 64 nt, hsa
caucuaggcuaggugcaguggcuuguuccuguagucccagcacucugggaaccuggguugggag

SEQ ID NO: 211560 - RNA, 64 nt, hsa
agaguuuaccuggcagagugugucaugccugcaaucccagcacuuugggaggccaaggcaggca

SEQ ID NO: 211561 - RNA, 64 nt, hsa
guccgacgccgcuuacucagagcccuggccucccucccccuaccucacacgcugcucaugaaag

SEQ ID NO: 211562 - RNA, 64 nt, hsa
ggaaaugaaaugaaaucaaauuuaucaguuuuuuucccccuaauuacccaaaagaucuuuugca

SEQ ID NO: 211563 - RNA, 64 nt, hsa
cccaccccuucccacggcgugucccacggccagacacaugcacacacaucacacccucaaacac

SEQ ID NO: 211564 - RNA, 64 nt, hsa
auguguaugcguaugcauacacaccacacacacacacaugcacaagucaugugcgaacagcccu

SEQ ID NO: 211565 - RNA, 64 nt, hsa
ucuacacguccacaccacucaccacacauacauacacaugcacacacacacacaugcaauucua

SEQ ID NO: 211566 - RNA, 64 nt, hsa
acucaccacacauacauacacaugcacacacacacacaugcaauucuaccuuuuucuaacacca

SEQ ID NO: 211567 - RNA, 64 nt, hsa
ccuagguucuuacacauaugcacacacgcauacacacaugcacgcacacacacauacacacaug

SEQ ID NO: 211568 - RNA, 64 nt, hsa
cacgcauacacacaugcacgcacacacacauacacacaugcacgcacgcacgcaugcacaccaa

SEQ ID NO: 211569 - RNA, 64 nt, hsa
acaccucucuacugagugcuccagagucuuagcucacaugcacugagaauucuuuacagcaaag

SEQ ID NO: 211570 - RNA, 64 nt, hsa
aagauuaaaacugaagauuuccucuggaagcuaccacaugcaaacauacaagcagucucaccuc

SEQ ID NO: 211571 - RNA, 64 nt, hsa
acgugcucccugaaggcacacguacgcacacacgcacaugcacagauaugccgccugggcacac

SEQ ID NO: 211572 - RNA, 64 nt, hsa
ugccuggacacacagauaaugcugccuugacacacacaugcacggauauugccuggacacacac

SEQ ID NO: 211573 - RNA, 64 nt, hsa
acgugugcacagauaugcugucuggacacgcacacacaugcagauaugcugccuggacacacac

SEQ ID NO: 211574 - RNA, 64 nt, hsa
gugcagauaugcuguccggauacacacgcacgcacacaugcagauaugcugccugggcacacac

SEQ ID NO: 211575 - RNA, 64 nt, hsa
gcagauaugcugccugggcacacacuuccggacacacaugcacacacaggugcagauaugcugc

SEQ ID NO: 211576 - RNA, 64 nt, hsa
cacacaugcagacauguacacacgugcacguacacacaugcaugcucgcuaagcggaaggaagu

SEQ ID NO: 211577 - RNA, 64 nt, hsa
cgugaugcuccaccugccagcccccggauucccacacaugcagacauguacacacgugcacgua

SEQ ID NO: 211578 - RNA, 64 nt, hsa
auaggaaagcagccccuccucacacauacaugugcacaugcacacacaugcaugcacacacaug

SEQ ID NO: 211579 - RNA, 64 nt, hsa
agccccuccucacacauacaugugcacaugcacacacaugcaugcacacacaugcacacauaca

SEQ ID NO: 211580 - RNA, 64 nt, hsa
cauacaugugcacaugcacacacaugcaugcacacacaugcacacauacacgcacaugcacaca

SEQ ID NO: 211581 - RNA, 64 nt, hsa
cacacaugcaugcacacacaugcacacauacacgcacaugcacacauacacaugcaugcacaca

SEQ ID NO: 211582 - RNA, 64 nt, hsa
cacacaugcacacauacacgcacaugcacacauacacaugcaugcacacauacacaggcauaca

SEQ ID NO: 211583 - RNA, 64 nt, hsa
ugcacacauacacaggcauacaugcaugcacacacacaugcacgcacacacacaugcacacaua

SEQ ID NO: 211584 - RNA, 64 nt, hsa
cauacaugcaugcacacacacaugcacgcacacacacaugcacacauacacgugcacacauaca

SEQ ID NO: 211585 - RNA, 64 nt, hsa
caugcacacauacacgugcacacauacacaggcacacaugcaugcacacauacacaugcacaca

SEQ ID NO: 211586 - RNA, 64 nt, hsa
cacacauacacaggcacacaugcaugcacacauacacaugcacacacacaugcacacauauaug

SEQ ID NO: 211587 - RNA, 64 nt, hsa
ggcacacaugcaugcacacauacacaugcacacacacaugcacacauauaugcacaggcacaca

SEQ ID NO: 211588 - RNA, 64 nt, hsa
cauauaugcacaggcacacacauguacgcacacacacaugcacugcacacauauccaugcacac

SEQ ID NO: 211589 - RNA, 64 nt, hsa
ugcacacauauccaugcacacaaacacauauauacacaugcacauacacagauuuuucugcugg

SEQ ID NO: 211590 - RNA, 64 nt, hsa
auaauacacaugcauuuaugugcguguguguauacacaugcauauauuuacuaauccuaucugc

SEQ ID NO: 211591 - RNA, 64 nt, hsa
cacaugccuccaugcauauaugugugugauaauacacaugcauuuaugugcguguguguauaca

SEQ ID NO: 211592 - RNA, 64 nt, hsa
gaccucugccagccaccuaagcccugcguacauucacaugcacacauggaagaauguuuaucgg

SEQ ID NO: 211593 - RNA, 64 nt, hsa
acaccuguaucacacaugugcuuacauuuccacucacaugcaccucugagccucccuugcuguc

SEQ ID NO: 211594 - RNA, 64 nt, hsa
acauguacccaccacaaacgugcaagcuccugcacacaugcaugcacacaaacguguacacaag

SEQ ID NO: 211595 - RNA, 64 nt, hsa
cagcguaaguuccuacacacggacgugugauacacacaugcauguacagguaagcacacaugua

SEQ ID NO: 211596 - RNA, 64 nt, hsa
ugcacagcagagagacguaugagcuucuacugcacacaugcacacacacacgcacacguacauu

SEQ ID NO: 211597 - RNA, 64 nt, hsa
auggacacaccccaaacacgcacaggcuccuacacacaugcacacacguguacaccacaaacga

SEQ ID NO: 211598 - RNA, 64 nt, hsa
acacacgucucccacacgugagcucccacacguacacaugcacauguacgcaccacaaacacau

SEQ ID NO: 211599 - RNA, 64 nt, hsa
aacacaugcgcaggcuccugcaggcgugaauacacacaugcacacacauauacacacaugugcc

SEQ ID NO: 211600 - RNA, 64 nt, hsa
aaaacuuccuuuacagagguucggacuaacauuucacaugcacauuucaaaacaagauguguca

SEQ ID NO: 211601 - RNA, 64 nt, hsa
uggaacugcgauaacugagaaacucuuaccaguccacaugcaauuagacauauucagcauauuu

SEQ ID NO: 211602 - RNA, 64 nt, hsa
uauggauacaacagcaaacauuuuauaaacuaugcacaugcauuacacacaugcacacacauau

SEQ ID NO: 211603 - RNA, 64 nt, hsa
gcaaacauuuuauaaacuaugcacaugcauuacacacaugcacacacauaugcacacacaugug

SEQ ID NO: 211604 - RNA, 64 nt, hsa
gaaggggagcaguugccaauauuugcaccaucuucacaugcacauguugcaacaagagcuucug

SEQ ID NO: 211605 - RNA, 64 nt, hsa
ucuguguuuguuuugcacuuuaaaaaagagagaacacaugcaaaugaacuugcuuguguguauu

SEQ ID NO: 211606 - RNA, 64 nt, hsa
uccauguuuguuuugcacuuuaaaaaagagagaacacaugcaaaugaacuugcuuguguguauu

SEQ ID NO: 211607 - RNA, 64 nt, hsa; identical to SEQ ID NO: 211604

SEQ ID NO: 211608 - RNA, 64 nt, hsa
ucuguguuugucuugcacuuuaaaaaagagagaacacaugcaaaugaacuugcuuguguguauu

SEQ ID NO: 211609 - RNA, 64 nt, hsa
gaaggggagcaguugccaauauuugcaccaucuucacaugcaccuguugcaacaagagcuucug

SEQ ID NO: 211610 - RNA, 64 nt, hsa
ggacuuagguucuggugaagggagacaaucagugcacaugcacacaccccacacgcauacacac

SEQ ID NO: 211611 - RNA, 64 nt, hsa
acaugcacacaccccacacgcauacacacaugaacacaugcacaugugcacacacaaguaagau

SEQ ID NO: 211612 - RNA, 64 nt, hsa
ccccaacccccacacccaugcagaacucccaggucacaugcacguauguccagggcaugggggu

SEQ ID NO: 211613 - RNA, 64 nt, hsa
acacagcacacacaagugcacagagcacacugcacacaugcacacacacacgcgugcaugcaca

SEQ ID NO: 211614 - RNA, 64 nt, hsa
acacaugcacacacaaagugcauaggccacacagcacaugcacacaggugcacagaccacacag

SEQ ID NO: 211615 - RNA, 64 nt, hsa
cauacacaagugcacagaccacacacagcacuaacacaugcacacacaaagugcauaggccaca

SEQ ID NO: 211616 - RNA, 64 nt, hsa
augcacgcuuacauguacacgugcacagaucacacacaugcacacacguguagcucacacacag

SEQ ID NO: 211617 - RNA, 64 nt, hsa
cauacgugcauacacaugccugcauacaggcauacacaugcacgcuuacauguacacgugcaca

SEQ ID NO: 211618 - RNA, 64 nt, hsa
uguccgcauacaggcguacacaugcacgcuugcacacaugcacacagaccacauagcacacaug

SEQ ID NO: 211619 - RNA, 64 nt, hsa
cacgugcucacauacauguccgcauacaggcguacacaugcacgcuugcacacaugcacacaga

SEQ ID NO: 211620 - RNA, 64 nt, hsa
ugcccacagaugccaccaaaaccugcuaucucuucaucaccagguacgauucucuuuccacagu

SEQ ID NO: 211621 - RNA, 64 nt, hsa
auccuuuuucacggggaccagaacacugguacgucaucaccaaagccaaucugcucuagcugcc

SEQ ID NO: 211622 - RNA, 64 nt, hsa
uucuuaaguucggauccaaguuugucuucuuauccaucaccaugcucccugaaagccuuuuuga

SEQ ID NO: 211623 - RNA, 64 nt, hsa
ccccuggccguccugucaucccugugugcugcagcaucaccacggccuacuucccaauauccac

SEQ ID NO: 211624 - RNA, 64 nt, hsa
ucauuuggcagccccuguuuucugcuguuuacaacaucaccagugccacgucaugagcgucaaa

SEQ ID NO: 211625 - RNA, 64 nt, hsa
gcucuccuccagcguggugugagaagaucauugccaucaccauuugguguguuccugugggaaa

SEQ ID NO: 211626 - RNA, 64 nt, hsa
uauggcaguguaucuauguaauuaucaauuuaaucaucaccaccgguguuuccauauuuuuucc

SEQ ID NO: 211627 - RNA, 64 nt, hsa
auuuuuaaaucacaugucauuacuuuugcaacaccaucaccaaaauuuuuugcucuuuuacauu

SEQ ID NO: 211628 - RNA, 64 nt, hsa
uuccauuuuagaauggggauucacagguucugugcaucaccacagugcucagagaggauucucc

SEQ ID NO: 211629 - RNA, 64 nt, hsa
ugcaacuaggaacauauacaguaaacaagcaauacaucaccaacgagcauucuuucagaaaaau

SEQ ID NO: 211630 - RNA, 64 nt, hsa
gcugaauccccuucacaguguuaacacaaaagggcaucaccaucccacgaugucugaaaccaga

SEQ ID NO: 211631 - RNA, 64 nt, hsa
cccuccaucugcccugggguggaggcaccaucaccaucaccaggcaugucugcagagccuggac

SEQ ID NO: 211632 - RNA, 64 nt, hsa
agaagccccuccaucugcccugggguggaggcaccaucaccaucaccaggcaugucugcagagc

SEQ ID NO: 211633 - RNA, 64 nt, hsa
ccaacagccagugcuccaagcccggaauugucuucaucaccaaaaggggccauuccgucuguac

SEQ ID NO: 211634 - RNA, 64 nt, hsa
agaucuccguggcugccauucccuucuuccuccucaucaccaucgcccuagggaccaagacuga

SEQ ID NO: 211635 - RNA, 64 nt, hsa
cuuucauguagccccucaacagaaugcauugcaucaucaccaugguaacaguucccaucaccau

SEQ ID NO: 211636 - RNA, 64 nt, hsa
gaaugcauugcaucaucaccaugguaacaguucccaucaccaucaccaccaccaccaccaucac

SEQ ID NO: 211637 - RNA, 64 nt, hsa
auugcaucaucaccaugguaacaguucccaucaccaucaccaccaccaccaccaucaccaccac

SEQ ID NO: 211638 - RNA, 64 nt, hsa
uaacaguucccaucaccaucaccaccaccaccaccaucaccaccaccauggacaacaagccuug

SEQ ID NO: 211639 - RNA, 64 nt, hsa; identical to SEQ ID NO: 80540

SEQ ID NO: 211640 - RNA, 64 nt, hsa; identical to SEQ ID NO: 80541

SEQ ID NO: 211641 - RNA, 64 nt, hsa; identical to SEQ ID NO: 80542

SEQ ID NO: 211642 - RNA, 64 nt, hsa; identical to SEQ ID NO: 80543

SEQ ID NO: 211643 - RNA, 64 nt, hsa; identical to SEQ ID NO: 80544

SEQ ID NO: 211644 - RNA, 64 nt, hsa; identical to SEQ ID NO: 80545

SEQ ID NO: 211645 - RNA, 64 nt, hsa; identical to SEQ ID NO: 80546

SEQ ID NO: 211646 - RNA, 64 nt, hsa; identical to SEQ ID NO: 80547

SEQ ID NO: 211647 - RNA, 64 nt, hsa; identical to SEQ ID NO: 80548

SEQ ID NO: 211648 - RNA, 64 nt, hsa; identical to SEQ ID NO: 80549

SEQ ID NO: 211649 - RNA, 64 nt, hsa; identical to SEQ ID NO: 80550

SEQ ID NO: 211650 - RNA, 64 nt, hsa; identical to SEQ ID NO: 80551

SEQ ID NO: 211651 - RNA, 64 nt, hsa; identical to SEQ ID NO: 80552

SEQ ID NO: 211652 - RNA, 64 nt, hsa; identical to SEQ ID NO: 80553

SEQ ID NO: 211653 - RNA, 64 nt, hsa; identical to SEQ ID NO: 80554

SEQ ID NO: 211654 - RNA, 64 nt, hsa; identical to SEQ ID NO: 80555

SEQ ID NO: 211655 - RNA, 64 nt, hsa; identical to SEQ ID NO: 80556

SEQ ID NO: 211656 - RNA, 64 nt, hsa; identical to SEQ ID NO: 80557

SEQ ID NO: 211657 - RNA, 64 nt, hsa; identical to SEQ ID NO: 80558

SEQ ID NO: 211658 - RNA, 64 nt, hsa; identical to SEQ ID NO: 80559

SEQ ID NO: 211659 - RNA, 64 nt, hsa; identical to SEQ ID NO: 80560

SEQ ID NO: 211660 - RNA, 64 nt, hsa; identical to SEQ ID NO: 80561

SEQ ID NO: 211661 - RNA, 64 nt, hsa; identical to SEQ ID NO: 80562

SEQ ID NO: 211662 - RNA, 64 nt, hsa; identical to SEQ ID NO: 80563

SEQ ID NO: 211663 - RNA, 64 nt, hsa; identical to SEQ ID NO: 80564

SEQ ID NO: 211664 - RNA, 64 nt, hsa; identical to SEQ ID NO: 80565

SEQ ID NO: 211665 - RNA, 64 nt, hsa; identical to SEQ ID NO: 80566

SEQ ID NO: 211666 - RNA, 64 nt, hsa; identical to SEQ ID NO: 80567

SEQ ID NO: 211667 - RNA, 64 nt, hsa; identical to SEQ ID NO: 80568

SEQ ID NO: 211668 - RNA, 64 nt, hsa; identical to SEQ ID NO: 80569

SEQ ID NO: 211669 - RNA, 64 nt, hsa; identical to SEQ ID NO: 80570

SEQ ID NO: 211670 - RNA, 64 nt, hsa; identical to SEQ ID NO: 80571

SEQ ID NO: 211671 - RNA, 64 nt, hsa; identical to SEQ ID NO: 80572

SEQ ID NO: 211672 - RNA, 64 nt, hsa; identical to SEQ ID NO: 80573

SEQ ID NO: 211673 - RNA, 64 nt, hsa; identical to SEQ ID NO: 80574

SEQ ID NO: 211674 - RNA, 64 nt, hsa; identical to SEQ ID NO: 80575

SEQ ID NO: 211675 - RNA, 64 nt, hsa; identical to SEQ ID NO: 80576

SEQ ID NO: 211676 - RNA, 64 nt, hsa; identical to SEQ ID NO: 80577

SEQ ID NO: 211677 - RNA, 64 nt, hsa; identical to SEQ ID NO: 80578

SEQ ID NO: 211678 - RNA, 64 nt, hsa; identical to SEQ ID NO: 80579

SEQ ID NO: 211679 - RNA, 64 nt, hsa; identical to SEQ ID NO: 80580

SEQ ID NO: 211680 - RNA, 64 nt, hsa; identical to SEQ ID NO: 80581

SEQ ID NO: 211681 - RNA, 64 nt, hsa; identical to SEQ ID NO: 80582

SEQ ID NO: 211682 - RNA, 64 nt, hsa; identical to SEQ ID NO: 80583

SEQ ID NO: 211683 - RNA, 64 nt, hsa; identical to SEQ ID NO: 80584

SEQ ID NO: 211684 - RNA, 64 nt, hsa; identical to SEQ ID NO: 80585

SEQ ID NO: 211685 - RNA, 64 nt, hsa; identical to SEQ ID NO: 80586

SEQ ID NO: 211686 - RNA, 64 nt, hsa; identical to SEQ ID NO: 80587

SEQ ID NO: 211687 - RNA, 64 nt, hsa; identical to SEQ ID NO: 80588

SEQ ID NO: 211688 - RNA, 64 nt, hsa; identical to SEQ ID NO: 80589

SEQ ID NO: 211689 - RNA, 64 nt, hsa; identical to SEQ ID NO: 80590

SEQ ID NO: 211690 - RNA, 64 nt, hsa; identical to SEQ ID NO: 80591

SEQ ID NO: 211691 - RNA, 64 nt, hsa; identical to SEQ ID NO: 80592

SEQ ID NO: 211692 - RNA, 64 nt, hsa; identical to SEQ ID NO: 80593

SEQ ID NO: 211693 - RNA, 64 nt, hsa; identical to SEQ ID NO: 80594

SEQ ID NO: 211694 - RNA, 64 nt, hsa; identical to SEQ ID NO: 80595

SEQ ID NO: 211695 - RNA, 64 nt, hsa; identical to SEQ ID NO: 80596

SEQ ID NO: 211696 - RNA, 64 nt, hsa; identical to SEQ ID NO: 80597

SEQ ID NO: 211697 - RNA, 64 nt, hsa
uucaucuccagcuugguguuccauggccccuaggcgaggugaucagggaguggggccaaugggc

SEQ ID NO: 211698 - RNA, 64 nt, hsa
ccuguucccugcuccgcuuccccauaccccagcccgaggugaagcccacaccuacacacccucu

SEQ ID NO: 211699 - RNA, 64 nt, hsa
cuucuacagaauuuucgucuuuaccuaugugaagcgaggugacgugauacgucacuggcgccgu

SEQ ID NO: 211700 - RNA, 64 nt, hsa
ggcucuccagccgcagcucagcugcacugcguuccgaggugaagucuugccccugaauuuugca

SEQ ID NO: 211701 - RNA, 64 nt, hsa
ggcucacaccuguaaucccagcacuuugagaggccgaggugagacgggaagauggcuugaacuc

SEQ ID NO: 211702 - RNA, 64 nt, hsa
guucccaagccuauuggaggaauguggguguggccgaggugauggcaagaaaggugcaagaaag

SEQ ID NO: 211703 - RNA, 64 nt, hsa
gguuuccuaaaggagacgagcgaauuaacggugucgaggugagccagggccagggggaccccgg

SEQ ID NO: 211704 - RNA, 64 nt, hsa
acucugcaaaaugggggugucccccgauccuggccgaggugaggaacagacagggggggucuag

SEQ ID NO: 211705 - RNA, 64 nt, hsa
caccaccgccacccagcagucagagaggaccuuucgaggugaugcacuguaaauccggcauuga

SEQ ID NO: 211706 - RNA, 64 nt, hsa
uuacacuaaguaaguggagggaaugaaaguguuucgaggugaauguggauauaauuucccucuu

SEQ ID NO: 211707 - RNA, 64 nt, hsa
ccacccuuugggcucagaggaggguggcuuuuuucgaggugagccauguuguagacacaugaua

SEQ ID NO: 211708 - RNA, 64 nt, hsa
ucauuggcgcauuaccccauaaaacuuuuugagacgaggugagaucugaguauaaagauagguc

SEQ ID NO: 211709 - RNA, 64 nt, hsa
gaaaaugccaugaauuaccuggauguucuuuuuacgaggugacaagaguuggggacagaacucc

SEQ ID NO: 211710 - RNA, 64 nt, hsa
uguccgucagugccagugccugugccagagguggcgaggugaguccuccagagcuuccuggccg

SEQ ID NO: 211711 - RNA, 64 nt, hsa
ccuacucuguggaugaugugauuguccuggaaaucgaggugaaaggcucaguagaaccuuucca

SEQ ID NO: 211712 - RNA, 64 nt, hsa
gguucgagcccaacuucaugcucuucgagaagugcgaggugaacggugcgggggcgcacccucu

SEQ ID NO: 211713 - RNA, 64 nt, hsa
uacaccauaugcaugcacuagaauuauuaacuaacgaggugagguauugcaaauguucaaaaaa

SEQ ID NO: 211714 - RNA, 64 nt, hsa
ugauuuagaaaagggacagaucagccccugaagacgaggugaaaagucaauuuuacaauuugua

SEQ ID NO: 211715 - RNA, 64 nt, hsa
gagacgcagucaggcgcacgcccgcaagaggcggcgaggugacaaguuuggagugcgcccccuu

SEQ ID NO: 211716 - RNA, 64 nt, hsa
cccugaaggggcugcugacugccccagaaucugccgaggugagaacagcauccugaggcacagc

SEQ ID NO: 211717 - RNA, 64 nt, hsa
ggcucacgccuguaaucccagcacuuugggaggccgaggugagcggaucaccugaggucaggag

SEQ ID NO: 211718 - RNA, 64 nt, hsa
acauccucuauugagaguuacagcaaguguuaaacgaggugaguucacauaacaggaauucugg

SEQ ID NO: 211719 - RNA, 64 nt, hsa
gggaaauuuuuaaaaaacuauucucaauuauauacgaggugaugggacuucuuaacacacauuu

SEQ ID NO: 211720 - RNA, 64 nt, hsa
aguuuaagaaguauucuaaacuguucuagaugaccgaggugaugaguucacauacacuggaagc

SEQ ID NO: 211721 - RNA, 64 nt, hsa
gcugcuggagcccagucaccccgggaccgugggccgaggugacugcagacccucccagggaggc

SEQ ID NO: 211722 - RNA, 64 nt, hsa
aucaggcagagaggcugggaugauggagaaagcucgaggugaaguuuuaaaaaaaaaguugugg

SEQ ID NO: 211723 - RNA, 64 nt, hsa
ccaacucaggcacaugcuuagcuguaaagggaagcgaggugaagucguccugcagcguauuaga

SEQ ID NO: 211724 - RNA, 52 nt, hsa
cugcuggaguuaaggaguagcucgaggugaagcuggaugggggauccagugg

SEQ ID NO: 211725 - RNA, 64 nt, hsa
ccugugguggagcauacacaggguacucuggggucgaggugagaggugaugugguauucagugc

SEQ ID NO: 211726 - RNA, 64 nt, hsa
uggaccugcuuacagagcaagccacgccucuuuccgaggugaaggugggaccauuccuugggaa

SEQ ID NO: 211727 - RNA, 64 nt, hsa
uccuuaugguaaauguaaacauguagacugcauucgaggugaccuaaaguagagaggucaugaa

SEQ ID NO: 211728 - RNA, 64 nt, hsa
ugccaaagugucccuugggucacacagcuaaagccgaggugaccaguuguaccccgagugccag

SEQ ID NO: 211729 - RNA, 64 nt, hsa
gcagaucaggggcucuggggaaacugcuggaacucgaggugaggaucagccuuuuccagcaucc

SEQ ID NO: 211730 - RNA, 64 nt, hsa
uggacagagcucaaagaggcccucuuaccgcuagcgaggugauaggacaucuggcuugccacaa

SEQ ID NO: 211731 - RNA, 64 nt, hsa
caagggcucugcuggucuuucugagucacagcugcgaggugaugggggcuggggccccaggcgu

SEQ ID NO: 211732 - RNA, 64 nt, hsa
gggaauugcacucuuggaagaucccgcauggguucgaggugaggccgcuucagaaccucaaaug

SEQ ID NO: 211733 - RNA, 64 nt, hsa
gauucuuggucaggugugcccacagaugcggaggcgaggugagugauuccaucauuucaguucu

SEQ ID NO: 211734 - RNA, 64 nt, hsa
gccuggcugcaggccugacuacugcccacaccaacgaggugaucuagcagauacauggcaacgu

SEQ ID NO: 211735 - RNA, 64 nt, hsa
accgguggcuucucgcugcgcagccuccagggcccgaggugaucccgguggugggauccacgcu

SEQ ID NO: 211736 - RNA, 64 nt, hsa
ugcucauuuucuggucugaccggcggaacccccacgaggugaagccagccuaugccaccaggua

SEQ ID NO: 211737 - RNA, 64 nt, hsa
agaugucucaccacaaagaaggaggauaagggagcgaggugauggauauguuaauuagcuugau

SEQ ID NO: 211738 - RNA, 64 nt, hsa
caggcacgccuguaaucccagcacuuugggaggccgaggugaaaggaucacuugagcccaggaa

SEQ ID NO: 211739 - RNA, 64 nt, hsa
cugcagauaacccuauacauuaauacugguaucucgaggugacucuucugaccaagggugguua

SEQ ID NO: 211740 - RNA, 64 nt, hsa
gguguguauauauaaaagguuguguacaacuccacgaggugaaaaauauucaguaacuuguuua

SEQ ID NO: 211741 - RNA, 64 nt, hsa
cucccaguauggccccaccugcucuuuccucccccgaggugaggccccgccugcucuuuccucc

SEQ ID NO: 211742 - RNA, 64 nt, hsa
caccuugcuccccgggaacccauggaaggagaagcgaggugaugcagcagcaggggcaagaccc

SEQ ID NO: 211743 - RNA, 64 nt, hsa; identical to SEQ ID NO: 108616

SEQ ID NO: 211744 - RNA, 64 nt, hsa; identical to SEQ ID NO: 108617

SEQ ID NO: 211745 - RNA, 64 nt, hsa; identical to SEQ ID NO: 108618

SEQ ID NO: 211746 - RNA, 64 nt, hsa; identical to SEQ ID NO: 108619

SEQ ID NO: 211747 - RNA, 64 nt, hsa; identical to SEQ ID NO: 108620

SEQ ID NO: 211748 - RNA, 64 nt, hsa; identical to SEQ ID NO: 108621

SEQ ID NO: 211749 - RNA, 64 nt, hsa; identical to SEQ ID NO: 108622

SEQ ID NO: 211750 - RNA, 64 nt, hsa; identical to SEQ ID NO: 108623

SEQ ID NO: 211751 - RNA, 61 nt, hsa; identical to SEQ ID NO: 108624

SEQ ID NO: 211752 - RNA, 64 nt, hsa; identical to SEQ ID NO: 108625

SEQ ID NO: 211753 - RNA, 64 nt, hsa; identical to SEQ ID NO: 108626

SEQ ID NO: 211754 - RNA, 64 nt, hsa; identical to SEQ ID NO: 108627

SEQ ID NO: 211755 - RNA, 64 nt, hsa; identical to SEQ ID NO: 108628

SEQ ID NO: 211756 - RNA, 64 nt, hsa; identical to SEQ ID NO: 108629

SEQ ID NO: 211757 - RNA, 64 nt, hsa; identical to SEQ ID NO: 108630

SEQ ID NO: 211758 - RNA, 64 nt, hsa; identical to SEQ ID NO: 108631

SEQ ID NO: 211759 - RNA, 64 nt, hsa; identical to SEQ ID NO: 108632

SEQ ID NO: 211760 - RNA, 64 nt, hsa; identical to SEQ ID NO: 108633

SEQ ID NO: 211761 - RNA, 64 nt, hsa; identical to SEQ ID NO: 108634

SEQ ID NO: 211762 - RNA, 64 nt, hsa; identical to SEQ ID NO: 108635

SEQ ID NO: 211763 - RNA, 64 nt, hsa; identical to SEQ ID NO: 108636

SEQ ID NO: 211764 - RNA, 64 nt, hsa; identical to SEQ ID NO: 108637

SEQ ID NO: 211765 - RNA, 64 nt, hsa; identical to SEQ ID NO: 108638

SEQ ID NO: 211766 - RNA, 64 nt, hsa; identical to SEQ ID NO: 108639

SEQ ID NO: 211767 - RNA, 64 nt, hsa; identical to SEQ ID NO: 108640

SEQ ID NO: 211768 - RNA, 64 nt, hsa; identical to SEQ ID NO: 108641

SEQ ID NO: 211769 - RNA, 64 nt, hsa; identical to SEQ ID NO: 108642

SEQ ID NO: 211770 - RNA, 64 nt, hsa; identical to SEQ ID NO: 108643

SEQ ID NO: 211771 - RNA, 64 nt, hsa; identical to SEQ ID NO: 108644

SEQ ID NO: 211772 - RNA, 64 nt, hsa; identical to SEQ ID NO: 108645

SEQ ID NO: 211773 - RNA, 64 nt, hsa; identical to SEQ ID NO: 108646

SEQ ID NO: 211774 - RNA, 64 nt, hsa; identical to SEQ ID NO: 108647

SEQ ID NO: 211775 - RNA, 64 nt, hsa; identical to SEQ ID NO: 108648

SEQ ID NO: 211776 - RNA, 64 nt, hsa; identical to SEQ ID NO: 108649

SEQ ID NO: 211777 - RNA, 64 nt, hsa; identical to SEQ ID NO: 108650

SEQ ID NO: 211778 - RNA, 64 nt, hsa; identical to SEQ ID NO: 108651

SEQ ID NO: 211779 - RNA, 64 nt, hsa; identical to SEQ ID NO: 108652

SEQ ID NO: 211780 - RNA, 64 nt, hsa; identical to SEQ ID NO: 108653

SEQ ID NO: 211781 - RNA, 64 nt, hsa; identical to SEQ ID NO: 108654

SEQ ID NO: 211782 - RNA, 64 nt, hsa; identical to SEQ ID NO: 108655

SEQ ID NO: 211783 - RNA, 64 nt, hsa; identical to SEQ ID NO: 108656

SEQ ID NO: 211784 - RNA, 64 nt, hsa; identical to SEQ ID NO: 108657

SEQ ID NO: 211785 - RNA, 64 nt, hsa; identical to SEQ ID NO: 108658

SEQ ID NO: 211786 - RNA, 64 nt, hsa; identical to SEQ ID NO: 108659

SEQ ID NO: 211787 - RNA, 64 nt, hsa; identical to SEQ ID NO: 108660

SEQ ID NO: 211788 - RNA, 64 nt, hsa; identical to SEQ ID NO: 108661

SEQ ID NO: 211789 - RNA, 64 nt, hsa; identical to SEQ ID NO: 108662

SEQ ID NO: 211790 - RNA, 64 nt, hsa; identical to SEQ ID NO: 108663

SEQ ID NO: 211791 - RNA, 64 nt, hsa; identical to SEQ ID NO: 108664

SEQ ID NO: 211792 - RNA, 64 nt, hsa; identical to SEQ ID NO: 108665

SEQ ID NO: 211793 - RNA, 64 nt, hsa; identical to SEQ ID NO: 108666

SEQ ID NO: 211794 - RNA, 64 nt, hsa; identical to SEQ ID NO: 108667

SEQ ID NO: 211795 - RNA, 64 nt, hsa; identical to SEQ ID NO: 108668

SEQ ID NO: 211796 - RNA, 64 nt, hsa; identical to SEQ ID NO: 108669

SEQ ID NO: 211797 - RNA, 64 nt, hsa; identical to SEQ ID NO: 108670

SEQ ID NO: 211798 - RNA, 64 nt, hsa; identical to SEQ ID NO: 108671

SEQ ID NO: 211799 - RNA, 64 nt, hsa; identical to SEQ ID NO: 108672

SEQ ID NO: 211800 - RNA, 64 nt, hsa; identical to SEQ ID NO: 108673

SEQ ID NO: 211801 - RNA, 64 nt, hsa; identical to SEQ ID NO: 108674

SEQ ID NO: 211802 - RNA, 64 nt, hsa; identical to SEQ ID NO: 108675

SEQ ID NO: 211803 - RNA, 64 nt, hsa; identical to SEQ ID NO: 108676

SEQ ID NO: 211804 - RNA, 64 nt, hsa; identical to SEQ ID NO: 108677

SEQ ID NO: 211805 - RNA, 64 nt, hsa; identical to SEQ ID NO: 108678

SEQ ID NO: 211806 - RNA, 64 nt, hsa; identical to SEQ ID NO: 108679

SEQ ID NO: 211807 - RNA, 64 nt, hsa; identical to SEQ ID NO: 108680

SEQ ID NO: 211808 - RNA, 64 nt, hsa; identical to SEQ ID NO: 108681

SEQ ID NO: 211809 - RNA, 64 nt, hsa; identical to SEQ ID NO: 108682

SEQ ID NO: 211810 - RNA, 64 nt, hsa; identical to SEQ ID NO: 108683

SEQ ID NO: 211811 - RNA, 64 nt, hsa; identical to SEQ ID NO: 108684

SEQ ID NO: 211812 - RNA, 64 nt, hsa; identical to SEQ ID NO: 108685

SEQ ID NO: 211813 - RNA, 64 nt, hsa; identical to SEQ ID NO: 108686

SEQ ID NO: 211814 - RNA, 64 nt, hsa; identical to SEQ ID NO: 108687

SEQ ID NO: 211815 - RNA, 64 nt, hsa; identical to SEQ ID NO: 108688

SEQ ID NO: 211816 - RNA, 64 nt, hsa; identical to SEQ ID NO: 108689

SEQ ID NO: 211817 - RNA, 64 nt, hsa; identical to SEQ ID NO: 108690

SEQ ID NO: 211818 - RNA, 64 nt, hsa; identical to SEQ ID NO: 108691

SEQ ID NO: 211819 - RNA, 64 nt, hsa; identical to SEQ ID NO: 108692

SEQ ID NO: 211820 - RNA, 64 nt, hsa; identical to SEQ ID NO: 108693

SEQ ID NO: 211821 - RNA, 64 nt, hsa; identical to SEQ ID NO: 108694

SEQ ID NO: 211822 - RNA, 64 nt, hsa; identical to SEQ ID NO: 108695

SEQ ID NO: 211823 - RNA, 64 nt, hsa; identical to SEQ ID NO: 108696

SEQ ID NO: 211824 - RNA, 64 nt, hsa; identical to SEQ ID NO: 108697

SEQ ID NO: 211825 - RNA, 64 nt, hsa; identical to SEQ ID NO: 108698

SEQ ID NO: 211826 - RNA, 64 nt, hsa; identical to SEQ ID NO: 108699

SEQ ID NO: 211827 - RNA, 64 nt, hsa; identical to SEQ ID NO: 108700

SEQ ID NO: 211828 - RNA, 64 nt, hsa; identical to SEQ ID NO: 108701

SEQ ID NO: 211829 - RNA, 64 nt, hsa; identical to SEQ ID NO: 108702

SEQ ID NO: 211830 - RNA, 64 nt, hsa; identical to SEQ ID NO: 108703

SEQ ID NO: 211831 - RNA, 64 nt, hsa; identical to SEQ ID NO: 108704

SEQ ID NO: 211832 - RNA, 64 nt, hsa; identical to SEQ ID NO: 108705

SEQ ID NO: 211833 - RNA, 64 nt, hsa; identical to SEQ ID NO: 108706

SEQ ID NO: 211834 - RNA, 64 nt, hsa; identical to SEQ ID NO: 108707

SEQ ID NO: 211835 - RNA, 64 nt, hsa; identical to SEQ ID NO: 108708

SEQ ID NO: 211836 - RNA, 64 nt, hsa; identical to SEQ ID NO: 108709

SEQ ID NO: 211837 - RNA, 64 nt, hsa; identical to SEQ ID NO: 108710

SEQ ID NO: 211838 - RNA, 64 nt, hsa; identical to SEQ ID NO: 108711

SEQ ID NO: 211839 - RNA, 64 nt, hsa; identical to SEQ ID NO: 108712

SEQ ID NO: 211840 - RNA, 64 nt, hsa; identical to SEQ ID NO: 108713

SEQ ID NO: 211841 - RNA, 64 nt, hsa; identical to SEQ ID NO: 108714

SEQ ID NO: 211842 - RNA, 64 nt, hsa; identical to SEQ ID NO: 108715

SEQ ID NO: 211843 - RNA, 64 nt, hsa; identical to SEQ ID NO: 108716

SEQ ID NO: 211844 - RNA, 64 nt, hsa; identical to SEQ ID NO: 108717

SEQ ID NO: 211845 - RNA, 64 nt, hsa; identical to SEQ ID NO: 108718

SEQ ID NO: 211846 - RNA, 64 nt, hsa; identical to SEQ ID NO: 108719

SEQ ID NO: 211847 - RNA, 64 nt, hsa; identical to SEQ ID NO: 108720

SEQ ID NO: 211848 - RNA, 64 nt, hsa; identical to SEQ ID NO: 108721

SEQ ID NO: 211849 - RNA, 64 nt, hsa; identical to SEQ ID NO: 108722

SEQ ID NO: 211850 - RNA, 64 nt, hsa; identical to SEQ ID NO: 108723

SEQ ID NO: 211851 - RNA, 64 nt, hsa; identical to SEQ ID NO: 108724

SEQ ID NO: 211852 - RNA, 64 nt, hsa; identical to SEQ ID NO: 108725

SEQ ID NO: 211853 - RNA, 64 nt, hsa; identical to SEQ ID NO: 108726

SEQ ID NO: 211854 - RNA, 64 nt, hsa; identical to SEQ ID NO: 108727

SEQ ID NO: 211855 - RNA, 64 nt, hsa; identical to SEQ ID NO: 108728

SEQ ID NO: 211856 - RNA, 64 nt, hsa; identical to SEQ ID NO: 108729

SEQ ID NO: 211857 - RNA, 64 nt, hsa; identical to SEQ ID NO: 108730

SEQ ID NO: 211858 - RNA, 64 nt, hsa; identical to SEQ ID NO: 108731

SEQ ID NO: 211859 - RNA, 64 nt, hsa; identical to SEQ ID NO: 108732

SEQ ID NO: 211860 - RNA, 64 nt, hsa; identical to SEQ ID NO: 108733

SEQ ID NO: 211861 - RNA, 64 nt, hsa; identical to SEQ ID NO: 108734

SEQ ID NO: 211862 - RNA, 64 nt, hsa; identical to SEQ ID NO: 108735

SEQ ID NO: 211863 - RNA, 64 nt, hsa; identical to SEQ ID NO: 108736

SEQ ID NO: 211864 - RNA, 64 nt, hsa; identical to SEQ ID NO: 108737

SEQ ID NO: 211865 - RNA, 64 nt, hsa; identical to SEQ ID NO: 108738

SEQ ID NO: 211866 - RNA, 64 nt, hsa; identical to SEQ ID NO: 108739

SEQ ID NO: 211867 - RNA, 64 nt, hsa; identical to SEQ ID NO: 108740

SEQ ID NO: 211868 - RNA, 64 nt, hsa; identical to SEQ ID NO: 108741

SEQ ID NO: 211869 - RNA, 64 nt, hsa; identical to SEQ ID NO: 108742

SEQ ID NO: 211870 - RNA, 64 nt, hsa; identical to SEQ ID NO: 108743

SEQ ID NO: 211871 - RNA, 64 nt, hsa; identical to SEQ ID NO: 108744

SEQ ID NO: 211872 - RNA, 64 nt, hsa; identical to SEQ ID NO: 108745

SEQ ID NO: 211873 - RNA, 64 nt, hsa; identical to SEQ ID NO: 108746

SEQ ID NO: 211874 - RNA, 64 nt, hsa; identical to SEQ ID NO: 108747

SEQ ID NO: 211875 - RNA, 64 nt, hsa; identical to SEQ ID NO: 108748

SEQ ID NO: 211876 - RNA, 64 nt, hsa; identical to SEQ ID NO: 108749

SEQ ID NO: 211877 - RNA, 64 nt, hsa; identical to SEQ ID NO: 108750

SEQ ID NO: 211878 - RNA, 64 nt, hsa; identical to SEQ ID NO: 108751

SEQ ID NO: 211879 - RNA, 64 nt, hsa; identical to SEQ ID NO: 108752

SEQ ID NO: 211880 - RNA, 64 nt, hsa; identical to SEQ ID NO: 108753

SEQ ID NO: 211881 - RNA, 64 nt, hsa; identical to SEQ ID NO: 108754

SEQ ID NO: 211882 - RNA, 64 nt, hsa; identical to SEQ ID NO: 108755

SEQ ID NO: 211883 - RNA, 64 nt, hsa; identical to SEQ ID NO: 108756

SEQ ID NO: 211884 - RNA, 64 nt, hsa; identical to SEQ ID NO: 108757

SEQ ID NO: 211885 - RNA, 64 nt, hsa; identical to SEQ ID NO: 108758

SEQ ID NO: 211886 - RNA, 64 nt, hsa; identical to SEQ ID NO: 108759

SEQ ID NO: 211887 - RNA, 64 nt, hsa; identical to SEQ ID NO: 108760

SEQ ID NO: 211888 - RNA, 64 nt, hsa; identical to SEQ ID NO: 108761

SEQ ID NO: 211889 - RNA, 64 nt, hsa; identical to SEQ ID NO: 108762

SEQ ID NO: 211890 - RNA, 64 nt, hsa; identical to SEQ ID NO: 108763

SEQ ID NO: 211891 - RNA, 64 nt, hsa; identical to SEQ ID NO: 108764

SEQ ID NO: 211892 - RNA, 64 nt, hsa; identical to SEQ ID NO: 108765

SEQ ID NO: 211893 - RNA, 64 nt, hsa; identical to SEQ ID NO: 80433

SEQ ID NO: 211894 - RNA, 64 nt, hsa; identical to SEQ ID NO: 80434

SEQ ID NO: 211895 - RNA, 64 nt, hsa; identical to SEQ ID NO: 80435

SEQ ID NO: 211896 - RNA, 64 nt, hsa; identical to SEQ ID NO: 80436

SEQ ID NO: 211897 - RNA, 64 nt, hsa; identical to SEQ ID NO: 80437

SEQ ID NO: 211898 - RNA, 64 nt, hsa; identical to SEQ ID NO: 80438

SEQ ID NO: 211899 - RNA, 64 nt, hsa; identical to SEQ ID NO: 80439

SEQ ID NO: 211900 - RNA, 64 nt, hsa; identical to SEQ ID NO: 80440

SEQ ID NO: 211901 - RNA, 64 nt, hsa; identical to SEQ ID NO: 80441

SEQ ID NO: 211902 - RNA, 64 nt, hsa; identical to SEQ ID NO: 80442

SEQ ID NO: 211903 - RNA, 64 nt, hsa
ucgguaaggaaaugucaaaucugguuuuuaaacaagguccaacccugcaaugaagcagccacuu

SEQ ID NO: 211904 - RNA, 64 nt, hsa
cugcauggauaguccugggccagccacaccaccgagguccaaguaugagccagggcugccucca

SEQ ID NO: 211905 - RNA, 64 nt, hsa; identical to SEQ ID NO: 51723

SEQ ID NO: 211906 - RNA, 64 nt, hsa; identical to SEQ ID NO: 51724

SEQ ID NO: 211907 - RNA, 64 nt, hsa; identical to SEQ ID NO: 51725

SEQ ID NO: 211908 - RNA, 64 nt, hsa; identical to SEQ ID NO: 51726

SEQ ID NO: 211909 - RNA, 64 nt, hsa; identical to SEQ ID NO: 51727

SEQ ID NO: 211910 - RNA, 64 nt, hsa; identical to SEQ ID NO: 51728

SEQ ID NO: 211911 - RNA, 64 nt, hsa; identical to SEQ ID NO: 51729

SEQ ID NO: 211912 - RNA, 64 nt, hsa; identical to SEQ ID NO: 51730

SEQ ID NO: 211913 - RNA, 64 nt, hsa; identical to SEQ ID NO: 51731

SEQ ID NO: 211914 - RNA, 64 nt, hsa; identical to SEQ ID NO: 51732

SEQ ID NO: 211915 - RNA, 64 nt, hsa; identical to SEQ ID NO: 51733

SEQ ID NO: 211916 - RNA, 64 nt, hsa; identical to SEQ ID NO: 51734

SEQ ID NO: 211917 - RNA, 64 nt, hsa; identical to SEQ ID NO: 51735

SEQ ID NO: 211918 - RNA, 64 nt, hsa; identical to SEQ ID NO: 51736

SEQ ID NO: 211919 - RNA, 64 nt, hsa; identical to SEQ ID NO: 51737

SEQ ID NO: 211920 - RNA, 64 nt, hsa; identical to SEQ ID NO: 51738

SEQ ID NO: 211921 - RNA, 64 nt, hsa; identical to SEQ ID NO: 51739

SEQ ID NO: 211922 - RNA, 64 nt, hsa; identical to SEQ ID NO: 51740

SEQ ID NO: 211923 - RNA, 64 nt, hsa; identical to SEQ ID NO: 51741

SEQ ID NO: 211924 - RNA, 64 nt, hsa; identical to SEQ ID NO: 51742

SEQ ID NO: 211925 - RNA, 64 nt, hsa; identical to SEQ ID NO: 51743

SEQ ID NO: 211926 - RNA, 64 nt, hsa; identical to SEQ ID NO: 51744

SEQ ID NO: 211927 - RNA, 64 nt, hsa; identical to SEQ ID NO: 51745

SEQ ID NO: 211928 - RNA, 64 nt, hsa; identical to SEQ ID NO: 51746

SEQ ID NO: 211929 - RNA, 64 nt, hsa; identical to SEQ ID NO: 51747

SEQ ID NO: 211930 - RNA, 64 nt, hsa; identical to SEQ ID NO: 51748

SEQ ID NO: 211931 - RNA, 64 nt, hsa; identical to SEQ ID NO: 182949

SEQ ID NO: 211932 - RNA, 64 nt, hsa; identical to SEQ ID NO: 182950

SEQ ID NO: 211933 - RNA, 64 nt, hsa; identical to SEQ ID NO: 182951

SEQ ID NO: 211934 - RNA, 64 nt, hsa; identical to SEQ ID NO: 182952

SEQ ID NO: 211935 - RNA, 64 nt, hsa; identical to SEQ ID NO: 182953

SEQ ID NO: 211936 - RNA, 64 nt, hsa; identical to SEQ ID NO: 182954

SEQ ID NO: 211937 - RNA, 64 nt, hsa; identical to SEQ ID NO: 51723

SEQ ID NO: 211938 - RNA, 64 nt, hsa; identical to SEQ ID NO: 51724

SEQ ID NO: 211939 - RNA, 64 nt, hsa; identical to SEQ ID NO: 51725

SEQ ID NO: 211940 - RNA, 64 nt, hsa; identical to SEQ ID NO: 51726

SEQ ID NO: 211941 - RNA, 64 nt, hsa; identical to SEQ ID NO: 51727

SEQ ID NO: 211942 - RNA, 64 nt, hsa; identical to SEQ ID NO: 51728

SEQ ID NO: 211943 - RNA, 64 nt, hsa; identical to SEQ ID NO: 51729

SEQ ID NO: 211944 - RNA, 64 nt, hsa; identical to SEQ ID NO: 51730

SEQ ID NO: 211945 - RNA, 64 nt, hsa; identical to SEQ ID NO: 51731

SEQ ID NO: 211946 - RNA, 64 nt, hsa; identical to SEQ ID NO: 51732

SEQ ID NO: 211947 - RNA, 64 nt, hsa; identical to SEQ ID NO: 51733

SEQ ID NO: 211948 - RNA, 64 nt, hsa; identical to SEQ ID NO: 51734

SEQ ID NO: 211949 - RNA, 64 nt, hsa; identical to SEQ ID NO: 51735

SEQ ID NO: 211950 - RNA, 64 nt, hsa; identical to SEQ ID NO: 51736

SEQ ID NO: 211951 - RNA, 64 nt, hsa; identical to SEQ ID NO: 51737

SEQ ID NO: 211952 - RNA, 64 nt, hsa; identical to SEQ ID NO: 51738

SEQ ID NO: 211953 - RNA, 64 nt, hsa; identical to SEQ ID NO: 51739

SEQ ID NO: 211954 - RNA, 64 nt, hsa; identical to SEQ ID NO: 51740

SEQ ID NO: 211955 - RNA, 64 nt, hsa; identical to SEQ ID NO: 51741

SEQ ID NO: 211956 - RNA, 64 nt, hsa; identical to SEQ ID NO: 51742

SEQ ID NO: 211957 - RNA, 64 nt, hsa; identical to SEQ ID NO: 51743

SEQ ID NO: 211958 - RNA, 64 nt, hsa; identical to SEQ ID NO: 51744

SEQ ID NO: 211959 - RNA, 64 nt, hsa; identical to SEQ ID NO: 51745

SEQ ID NO: 211960 - RNA, 64 nt, hsa; identical to SEQ ID NO: 51746

SEQ ID NO: 211961 - RNA, 64 nt, hsa; identical to SEQ ID NO: 51747

SEQ ID NO: 211962 - RNA, 64 nt, hsa; identical to SEQ ID NO: 51748

SEQ ID NO: 211963 - RNA, 64 nt, hsa; identical to SEQ ID NO: 182949

SEQ ID NO: 211964 - RNA, 64 nt, hsa; identical to SEQ ID NO: 182950

SEQ ID NO: 211965 - RNA, 64 nt, hsa; identical to SEQ ID NO: 182951

SEQ ID NO: 211966 - RNA, 64 nt, hsa; identical to SEQ ID NO: 182952

SEQ ID NO: 211967 - RNA, 64 nt, hsa; identical to SEQ ID NO: 182953

SEQ ID NO: 211968 - RNA, 64 nt, hsa; identical to SEQ ID NO: 182954

SEQ ID NO: 211969 - RNA, 64 nt, hsa
uagcacaugccagagguucacaucuguuuuguuuuucaaacaggucguagcuguauuuauuggc

SEQ ID NO: 211970 - RNA, 64 nt, hsa
cuaaugcuuagugccugaguauuuaaauuuucuuuucaaacaggcacaguucacauugcuagua

SEQ ID NO: 211971 - RNA, 60 nt, hsa
auucaaccacuucugugugauauguacauauucaaacacauuuuuuaacuuuuuuaaauu

SEQ ID NO: 211972 - RNA, 64 nt, hsa
cacuaaucagcuccuggauuuuuuuuuuuuuuuuuucaaacaaugguuugaaacaacuacugga

SEQ ID NO: 211973 - RNA, 64 nt, hsa
aaauauaacugacuguauacuauagugguaacuuuucaaacagcccuuagcacuuuuauacuaa

SEQ ID NO: 211974 - RNA, 64 nt, hsa
guugcauuaauuguauaaggguuuuuguauaguuuucaaacaucugugguguaaugaucuuugu

SEQ ID NO: 211975 - RNA, 64 nt, hsa
auucuguggauucuuuaaaccugugugcuaauaauucaaacaauguugcauuaauuguauaagg

SEQ ID NO: 211976 - RNA, 64 nt, hsa
ucaacuuggaaaugacacagacccacagaagguguucaaacacaaccuacucugcaaaccuugg

SEQ ID NO: 211977 - RNA, 64 nt, hsa
cuucauccuugacuccuuugguauuucacugaauuucaaacauuugucagagaagaaaaacgug

SEQ ID NO: 211978 - RNA, 64 nt, hsa
aaccugucugaugguggcaucuuccugcagacauuucaaacauguaacuuuuauaugaaaaaaa

SEQ ID NO: 211979 - RNA, 64 nt, hsa
aacagcagggucuaacugugcuuacuuagcccaguucaaacagaacaaaggaaaaauauagaaa

SEQ ID NO: 211980 - RNA, 64 nt, hsa
ucuaaccuuugaaaauauuauaacuggauauuucuucaaacagauguccuggaugaugguccau

SEQ ID NO: 211981 - RNA, 64 nt, hsa
cugcagauguuuuuucuuuuaacaaacuggaauuuucaaacagauuaucuguauuuaaauguau

SEQ ID NO: 211982 - RNA, 64 nt, hsa
uacauucuucuugcuguuguuuaguuuguuuuuuuucaaacaacccucuaaaaauguaaaaacc

SEQ ID NO: 211983 - RNA, 64 nt, hsa
uaccagauguaauuauguuuuggaaauguacauauucaaacagaagugccucauuuuagaaaug

SEQ ID NO: 211984 - RNA, 64 nt, hsa
aaccacuaagggcucuauguuugugucaugccucuucaaacaccaaggaguugaacaugcuucc

SEQ ID NO: 211985 - RNA, 64 nt, hsa
guuuaacacggccugauucaagacucugauaggauucaaacagauaccgguuaaccaugacuac

SEQ ID NO: 211986 - RNA, 64 nt, hsa
uuguucuuugaaaguagacguuucagucauucuuuucaaacaaguguuuguguaccuuuugcca

SEQ ID NO: 211987 - RNA, 64 nt, hsa
gaaaggggaaauuuuugguuaaauaagaguaagguucaaacacaagcaguacauguucuguuuc

SEQ ID NO: 211988 - RNA, 64 nt, hsa
aagcaguuugguggccuuuucacauucuccaauguucaaacauauuuuccacuuuccauuuucu

SEQ ID NO: 211989 - RNA, 64 nt, hsa
uuuaagaccacaaguuagaagaaaggucacauauuucaaacacaacuagauggggcucugaaag

SEQ ID NO: 211990 - RNA, 64 nt, hsa
cgcgagccaccgcgcccggccccuaaguuaauauuucaaacaaucgaagguaaaacaacauauu

SEQ ID NO: 211991 - RNA, 64 nt, hsa
aacaguaccuuuaucucaguaggaaauuaaauaauucaaacaucaaauaacuucaauuuaaggc

SEQ ID NO: 211992 - RNA, 64 nt, hsa
uuugcacaaacuuuguaacuuuuguuacugugaauucaaacauuacucuuuggacaguuuggac

SEQ ID NO: 211993 - RNA, 64 nt, hsa
aauuacuaacugcccucucccaagauucauuuaguucaaacaguauccguaaacuaggaauaau

SEQ ID NO: 211994 - RNA, 64 nt, hsa
ucuccacucaccgcagcguacuuggcacuucaguuucaaacacguaguccuuuaaaacuugauc

SEQ ID NO: 211995 - RNA, 64 nt, hsa
agcuguuuugcuaaauuauuuuuacuuggaauguuucaaacagauuucaggcugcaaacuuguu

SEQ ID NO: 211996 - RNA, 64 nt, hsa
ucauccaguuuucucuccaucucuuuucuuuguacaaucccauuuccuauuaccauucucugca

SEQ ID NO: 211997 - RNA, 64 nt, hsa
cacaugucugcaagaaggccuccaaauauagaaacaaucccauuagucagcaguggacccuguc

SEQ ID NO: 211998 - RNA, 64 nt, hsa
aaaacaauccagaaauugaucgguuuuuuuaggccaaucccaucccuucuggauaaccagaugu

SEQ ID NO: 211999 - RNA, 64 nt, hsa
aucacuccaagaaaagagauccacauaccauucucaaucccacugaaauugcuggcauucucaa

SEQ ID NO: 212000 - RNA, 64 nt, hsa
gguagucucuucacagggaagcaugugacacccacaaucccaccuagcccaggagagagcuacg

SEQ ID NO: 212001 - RNA, 64 nt, hsa
cugcaguauggccagacgugguggcucacaccugcaaucccagcaccuuaggaggccgaggcag

SEQ ID NO: 212002 - RNA, 64 nt, hsa
gcucugccauuccacugcuccuccauccacucgccaaucccaagagucuggccucccuccagcc

SEQ ID NO: 212003 - RNA, 64 nt, hsa
uggccugcugcucuuguaguggacuuccugaguccaaucccaccuccugguguagaauuuacac

SEQ ID NO: 212004 - RNA, 64 nt, hsa
cuuuuuuuaaugauuuauacaaugacuccaaaggcaaucccaaagaaaagauguaaagaauguu

SEQ ID NO: 212005 - RNA, 64 nt, hsa
auuaggucuggccaggcgaagugacucacaccugcaaucccagcacuuugggaggccgaggcgg

SEQ ID NO: 212006 - RNA, 64 nt, hsa
ggccgcccaguuugagaauugguguaagacaucacaaucccauuauucagagcgcguauggagu

SEQ ID NO: 212007 - RNA, 64 nt, hsa; identical to SEQ ID NO: 212006

SEQ ID NO: 212008 - RNA, 64 nt, hsa
gauuggaccagacccugaauucuucuagcuccuccaaucccauuuuaucccauggaaccacuaa

SEQ ID NO: 212009 - RNA, 64 nt, hsa
aggguaacuuaacagaguaucagaucuaucuugucaaucccaacguuuuacauaaaauaagaga

SEQ ID NO: 212010 - RNA, 64 nt, hsa
auuuuuauucauuuguauuuauuaaaugaaaaaacaaucccauggugucccuguuguguggugg

SEQ ID NO: 212011 - RNA, 64 nt, hsa
aaauuuggaggcugggugcuguggcucacgccugcaaucccagcacuuugggagacugaggcgg

SEQ ID NO: 212012 - RNA, 64 nt, hsa; identical to SEQ ID NO: 144448

SEQ ID NO: 212013 - RNA, 64 nt, hsa; identical to SEQ ID NO: 144449

SEQ ID NO: 212014 - RNA, 64 nt, hsa; identical to SEQ ID NO: 144450

SEQ ID NO: 212015 - RNA, 64 nt, hsa; identical to SEQ ID NO: 144451

SEQ ID NO: 212016 - RNA, 64 nt, hsa; identical to SEQ ID NO: 144452

SEQ ID NO: 212017 - RNA, 64 nt, hsa; identical to SEQ ID NO: 144453

SEQ ID NO: 212018 - RNA, 64 nt, hsa; identical to SEQ ID NO: 144454

SEQ ID NO: 212019 - RNA, 64 nt, hsa; identical to SEQ ID NO: 144455

SEQ ID NO: 212020 - RNA, 64 nt, hsa; identical to SEQ ID NO: 144456

SEQ ID NO: 212021 - RNA, 64 nt, hsa; identical to SEQ ID NO: 144457

SEQ ID NO: 212022 - RNA, 64 nt, hsa; identical to SEQ ID NO: 144458

SEQ ID NO: 212023 - RNA, 64 nt, hsa; identical to SEQ ID NO: 144459

SEQ ID NO: 212024 - RNA, 64 nt, hsa; identical to SEQ ID NO: 144460

SEQ ID NO: 212025 - RNA, 64 nt, hsa; identical to SEQ ID NO: 144461

SEQ ID NO: 212026 - RNA, 64 nt, hsa; identical to SEQ ID NO: 144462

SEQ ID NO: 212027 - RNA, 64 nt, hsa; identical to SEQ ID NO: 144463

SEQ ID NO: 212028 - RNA, 64 nt, hsa; identical to SEQ ID NO: 144464

SEQ ID NO: 212029 - RNA, 64 nt, hsa; identical to SEQ ID NO: 144465

SEQ ID NO: 212030 - RNA, 64 nt, hsa; identical to SEQ ID NO: 144466

SEQ ID NO: 212031 - RNA, 64 nt, hsa; identical to SEQ ID NO: 144467

SEQ ID NO: 212032 - RNA, 64 nt, hsa; identical to SEQ ID NO: 144468

SEQ ID NO: 212033 - RNA, 64 nt, hsa; identical to SEQ ID NO: 144469

SEQ ID NO: 212034 - RNA, 64 nt, hsa; identical to SEQ ID NO: 144470

SEQ ID NO: 212035 - RNA, 64 nt, hsa; identical to SEQ ID NO: 144471

SEQ ID NO: 212036 - RNA, 64 nt, hsa; identical to SEQ ID NO: 144472

SEQ ID NO: 212037 - RNA, 64 nt, hsa; identical to SEQ ID NO: 144473

SEQ ID NO: 212038 - RNA, 64 nt, hsa; identical to SEQ ID NO: 144474

SEQ ID NO: 212039 - RNA, 64 nt, hsa; identical to SEQ ID NO: 144475

SEQ ID NO: 212040 - RNA, 64 nt, hsa; identical to SEQ ID NO: 144476

SEQ ID NO: 212041 - RNA, 64 nt, hsa; identical to SEQ ID NO: 144477

SEQ ID NO: 212042 - RNA, 64 nt, hsa; identical to SEQ ID NO: 144478

SEQ ID NO: 212043 - RNA, 64 nt, hsa; identical to SEQ ID NO: 144479

SEQ ID NO: 212044 - RNA, 64 nt, hsa; identical to SEQ ID NO: 144480

SEQ ID NO: 212045 - RNA, 64 nt, hsa; identical to SEQ ID NO: 144481

SEQ ID NO: 212046 - RNA, 64 nt, hsa; identical to SEQ ID NO: 144482

SEQ ID NO: 212047 - RNA, 64 nt, hsa; identical to SEQ ID NO: 144483

SEQ ID NO: 212048 - RNA, 64 nt, hsa; identical to SEQ ID NO: 144484

SEQ ID NO: 212049 - RNA, 64 nt, hsa; identical to SEQ ID NO: 144485

SEQ ID NO: 212050 - RNA, 64 nt, hsa; identical to SEQ ID NO: 144486

SEQ ID NO: 212051 - RNA, 62 nt, hsa; identical to SEQ ID NO: 144487

SEQ ID NO: 212052 - RNA, 64 nt, hsa; identical to SEQ ID NO: 144488

SEQ ID NO: 212053 - RNA, 64 nt, hsa; identical to SEQ ID NO: 144489

SEQ ID NO: 212054 - RNA, 64 nt, hsa; identical to SEQ ID NO: 144490

SEQ ID NO: 212055 - RNA, 64 nt, hsa; identical to SEQ ID NO: 144491

SEQ ID NO: 212056 - RNA, 64 nt, hsa; identical to SEQ ID NO: 144492

SEQ ID NO: 212057 - RNA, 64 nt, hsa; identical to SEQ ID NO: 144493

SEQ ID NO: 212058 - RNA, 64 nt, hsa; identical to SEQ ID NO: 144494

SEQ ID NO: 212059 - RNA, 64 nt, hsa; identical to SEQ ID NO: 144495

SEQ ID NO: 212060 - RNA, 64 nt, hsa; identical to SEQ ID NO: 144496

SEQ ID NO: 212061 - RNA, 64 nt, hsa; identical to SEQ ID NO: 144497

SEQ ID NO: 212062 - RNA, 64 nt, hsa; identical to SEQ ID NO: 144498

SEQ ID NO: 212063 - RNA, 64 nt, hsa; identical to SEQ ID NO: 144499

SEQ ID NO: 212064 - RNA, 64 nt, hsa; identical to SEQ ID NO: 144500

SEQ ID NO: 212065 - RNA, 64 nt, hsa; identical to SEQ ID NO: 144501

SEQ ID NO: 212066 - RNA, 64 nt, hsa; identical to SEQ ID NO: 144502

SEQ ID NO: 212067 - RNA, 64 nt, hsa; identical to SEQ ID NO: 144503

SEQ ID NO: 212068 - RNA, 64 nt, hsa; identical to SEQ ID NO: 144504

SEQ ID NO: 212069 - RNA, 64 nt, hsa
ccaacuacauuaccaugcugugccucaguuuacccauuuguaaaaugggauuaauaauacuuac

SEQ ID NO: 212070 - RNA, 64 nt, hsa
aggauuuuuggguuuaagaugcacuuuuagcacacauuuguauuucccuuggcauaucagauug

SEQ ID NO: 212071 - RNA, 64 nt, hsa
uuugcucccuuauguucuucggauaugguuauggcauuuguaggcuuggagguaaagaacugaa

SEQ ID NO: 212072 - RNA, 64 nt, hsa
uauuggucuagaaacguuaaacuuaauuuuuuuccauuuguacagggguaacgcacuguauuaa

SEQ ID NO: 212073 - RNA, 64 nt, hsa
cuguuuacaaauuugguuacagugugcuacggugcauuuguaacacucagauuugugcccauuc

SEQ ID NO: 212074 - RNA, 64 nt, hsa
aaauuaagaaguauuuauaggauuaaagugacuucauuuguauacauuuggaaucuaaaccagc

SEQ ID NO: 212075 - RNA, 64 nt, hsa
uggcacuuguauuuaauucuucaccuuuguaagacauuuguauauuguggauguguucauucaa

SEQ ID NO: 212076 - RNA, 64 nt, hsa
guaaauguuucuuuucccuuaaauacagauaauucauuuguauugcuuauuuuauuaugagcua

SEQ ID NO: 212077 - RNA, 64 nt, hsa
uccauuuauuuaugaaaaaauaugaaccuauuuucauuuguacaagguaauuguuuuuuaaagc

SEQ ID NO: 212078 - RNA, 64 nt, hsa
uuaaaccaauuuuacuuuaugaauauauucaugacauuuguaauaaaugucuugagaaagaauu

SEQ ID NO: 212079 - RNA, 64 nt, hsa
uucccucugcucccacccaccuaaacacagcagccauuuguaccuguuugcuucccaucccacu

SEQ ID NO: 212080 - RNA, 64 nt, hsa
uuggggaaguaaaagaagauggaaauggauguuucauuuguaugaguuuggagcagugcugaag

SEQ ID NO: 212081 - RNA, 64 nt, hsa
aaaguuugcuuagguuuauuacagcaguccuuggcauuuguaugguaauuuguacuuuacaaau

SEQ ID NO: 212082 - RNA, 64 nt, hsa
ccuuugaaucuaaguauuuguuuccuaaaugaaacauuuguacaacauuugauguuuuuacuua

SEQ ID NO: 212083 - RNA, 64 nt, hsa
uaguagugaugcuuuccuugguuguacagguguacauuuguaaaccuucaugcuguaaauggaa

SEQ ID NO: 212084 - RNA, 64 nt, hsa
uuuaaagcaaaacuauuuauugacuuuauucauccauuuguaaauuuuuuaagguucuugugua

SEQ ID NO: 212085 - RNA, 64 nt, hsa
ccauuucauagacauuuuacugagaaaugaccugcauuuguaugaagugaacugagcgucacac

SEQ ID NO: 212086 - RNA, 64 nt, hsa
cagaaucucacugcucuuuucauucauguguugucauuuguauaucaguaauucagguacccau

SEQ ID NO: 212087 - RNA, 64 nt, hsa
aaaggugaaaauguuuuauucggcauuuaacuuacauuuguacuuuauuuuuguauaaaaucca

SEQ ID NO: 212088 - RNA, 64 nt, hsa
gagaaaggguccaugaaggaaaguguaugaguugcauuuguaaaaaugagacuuuuucagugga

SEQ ID NO: 212089 - RNA, 64 nt, hsa
ccaggcuaaugacuugugugugcugauguguuuccauuuguauuuaauguguguagacccuccu

SEQ ID NO: 212090 - RNA, 64 nt, hsa
cagagacaucuuggcaccucaucccaacaaaucacauuuguagaaauguaaugcgguucugagu

SEQ ID NO: 212091 - RNA, 64 nt, hsa
gcacugucauuuguaaaugccauugucacagccucauuuguaagcagcacugccucucuguuug

SEQ ID NO: 212092 - RNA, 64 nt, hsa
gugggaaagcauuuuguacgguaacuggcacugucauuuguaaaugccauugucacagccucau

SEQ ID NO: 212093 - RNA, 64 nt, hsa
gauucacccacgaagguuacauuuaugcugaauacauuuguaaauacucaguuuuauacuguau

SEQ ID NO: 212094 - RNA, 64 nt, hsa
aaaacugugcaauacgaauuaugcaaucacaauacauuuguagcucccgaguguccuaaaggga

SEQ ID NO: 212095 - RNA, 64 nt, hsa
cuuuuagccuuuuuuaaaaacuccauuuauauuacauuuguaaccaugauacuuuaaucagaag

SEQ ID NO: 212096 - RNA, 64 nt, hsa
ccaccccacugccuuccuucagcaccuuuagcugcauuuguaugccagugcuuaacacauugcc

SEQ ID NO: 212097 - RNA, 64 nt, hsa
cagcuuauuuuuuucuacauaauugugaccaauacauuuguauuuugugaugaaucuacauuug

SEQ ID NO: 212098 - RNA, 64 nt, hsa
uuuuguauuaacaaacacugcaauuuauagauuacauuuguaggaaguuaugcuuuuuucuggu

SEQ ID NO: 212099 - RNA, 64 nt, hsa
caucacuagauaauaaagucuuuugugaacaaggcauuuguagccauuuuuaaaaguuuuuguc

SEQ ID NO: 212100 - RNA, 64 nt, hsa
uuugcauuccucuuaugcuuuaccuguauuuuaucauuuguaagcagaacucuagcuauauggg

SEQ ID NO: 212101 - RNA, 64 nt, hsa
uugucuuucuagugaggagauacauaucagagaacauuuguacaauuccccaugaaaauugcuc

SEQ ID NO: 212102 - RNA, 64 nt, hsa
ucuuuguuuauccauucuuuuauccuuuauauuucauuuguaaacuauauuugaacgacauucc

SEQ ID NO: 212103 - RNA, 64 nt, hsa
auuggacuuacgacccaaaugaaccucgauacugcauuuguaaucagguaaaagucuguuauau

SEQ ID NO: 212104 - RNA, 64 nt, hsa
gccuuggauuauuucaguggccaacauaugcagacauuuguacuccucaaccauuuucucaaag

SEQ ID NO: 212105 - RNA, 64 nt, hsa
uguuauuuuuuauuuaaaaacuuuauauuaaagucauuuguaauguuauuguauaguuauugug

SEQ ID NO: 212106 - RNA, 64 nt, hsa
uuagcagauacagucucuuagucacuaggcuuugcauuuguauguagcuguauguuuccgucca

SEQ ID NO: 212107 - RNA, 64 nt, hsa
aggaaauauuuaaugaauuuucucccuaaauuaucauuuguaaacauuuuuauuuuaaaacuag

SEQ ID NO: 212108 - RNA, 64 nt, hsa
uuuauugaaaaguggaauuuuuagugauaaaauacauuuguaaguguaaagcaauacagcauaa

SEQ ID NO: 212109 - RNA, 64 nt, hsa
auaauuuguugcauaguguccuuauuuguauaaacauuuguaugcacguuauauuguaauagcu

SEQ ID NO: 212110 - RNA, 64 nt, hsa
cauauauauauuuauaaugugucuuuuuauuaaccauuuguacaauaaaugucacuucccaugc

SEQ ID NO: 212111 - RNA, 64 nt, hsa
cccaggucuccucgaccuccauacaccacacaggcauuuguaagcacaguuuccacaagcaccu

SEQ ID NO: 212112 - RNA, 64 nt, hsa
uguucccuaggcugacugguaucuauuuauuucucauuuguaccaaggcaucuccuacucucca

SEQ ID NO: 212113 - RNA, 64 nt, hsa
aauguauuuccauaauguguugaaaacaugcuaacauuuguaugauuuuuauacuucugccgaa

SEQ ID NO: 212114 - RNA, 64 nt, hsa
uuuucccccuauucaguuuuaaucuuggaauaugcauuuguaaauugugaugucauugagacua

SEQ ID NO: 212115 - RNA, 64 nt, hsa
accucaaagaauuguugugaggcuugagauaaugcauuuguaaagggucugccagauaggaaga

SEQ ID NO: 212116 - RNA, 64 nt, hsa
gugaaugaaucucaagauucaguagaccuaaugacauuuguauuuuaugaucuuggcuguauuu

SEQ ID NO: 212117 - RNA, 64 nt, hsa
ucgauucuacuuuagaaugagagugugaaauagacauuuguaaauguaaaacuuuuaagguaua

SEQ ID NO: 212118 - RNA, 64 nt, hsa
uuauuagauaugaguuguuuucagacucagacuccauuuguauuauagucuaauauacagggua

SEQ ID NO: 212119 - RNA, 64 nt, hsa
guuuuaaaggcuuuuugguguauagaaguuuguccauuuguaaaacuccggauugcguuccucc

SEQ ID NO: 212120 - RNA, 64 nt, hsa
cuuccuucuguaaauacccguuaccauauuuauccauuuguaauuaaauuaugguauuaacuug

SEQ ID NO: 212121 - RNA, 64 nt, hsa
cugcagcuuugaugugcauauuugaacuuuuuaacauuuguaacuuugguggcaaagagaauuu

SEQ ID NO: 212122 - RNA, 64 nt, hsa
acacauaguuuuagcaaauuggaaauaauauauucauuuguauggcaagauaaaugcagucauc

SEQ ID NO: 212123 - RNA, 64 nt, hsa
aaaauagagucugccucguacuacagauguaacucauuuguauauugcagacagacccaaagug

SEQ ID NO: 212124 - RNA, 64 nt, hsa
aguaugguuugagacaacauauggaaaauguucacauuuguagauuaagcuggaauuauaauga

SEQ ID NO: 212125 - RNA, 64 nt, hsa
auuaaaacuguaaggggccuccaucccucuuacucauuuguagucuaggaaauugagauuuuga

SEQ ID NO: 212126 - RNA, 64 nt, hsa
uuuguuuuuuauuucuguugagauauagccuuuacauuuguacacaaaugugacuaugucuugg

SEQ ID NO: 212127 - RNA, 64 nt, hsa
acuacgguuguggaaaaccuuuccuagcuuagagcauuuguaucuauauuuuaaagucagaguu

SEQ ID NO: 212128 - RNA, 64 nt, hsa
ugauuauuuguguuucuaauuuauaguuuaaguucauuuguaaauaguuaaaagagaguggguc

SEQ ID NO: 212129 - RNA, 64 nt, hsa
uuuuguucugccucaaagcucaguuuauugaagacauuuguaagcuauuggaucaucacuugaa

SEQ ID NO: 212130 - RNA, 64 nt, hsa
aaaggcagaaaagcaacacagucacugcuguggucauuuguaauguaaagaucaguuauauaua

SEQ ID NO: 212131 - RNA, 64 nt, hsa
uugaauccgugaaaucaugccuguaaagcccaaacauuuguaacaaacucccuaauaaauuuag

SEQ ID NO: 212132 - RNA, 64 nt, hsa
ucuuggugugucucuaacagauacaguauguauacauuuguauaauuguuguuguugaaagucc

SEQ ID NO: 212133 - RNA, 64 nt, hsa
ugaggaaacaguaccgaaguucuuuuucuuguggcauuuguauuauaaaaacuugguguggggg

SEQ ID NO: 212134 - RNA, 64 nt, hsa
acuuuuuuuguaagaaauuguuuauaauauguugcauuuguacuuaagucauuccaucuuucac

SEQ ID NO: 212135 - RNA, 64 nt, hsa
gaaggauuuguaaagcuuugcucaaaguugugugcauuuguaaacacuaucaugauauuuucaa

SEQ ID NO: 212136 - RNA, 64 nt, hsa
uucagaaguugcugcuuuguuugucuaauugacucauuuguaaaugagcagaacuguuuuguug

SEQ ID NO: 212137 - RNA, 64 nt, hsa
cacauaaaugauuuuggcauaccauuagagaaaccauuuguaaaacucaaaugaccacauaaag

SEQ ID NO: 212138 - RNA, 64 nt, hsa
gcaaagaucaagauaagcuggaugaaguagugugcauuuguaauacuauugcaagacuccuccc

SEQ ID NO: 212139 - RNA, 64 nt, hsa
aaaauguguuccauuuuaguguaaagauguguaucauuuguaauugugugugaccugacuguga

SEQ ID NO: 212140 - RNA, 64 nt, hsa
acaagucucugucuuuuaauaaaagaacuuuacacauuuguaaaaaagagguucuugguaagau

SEQ ID NO: 212141 - RNA, 64 nt, hsa
augugaauaucauauuuuugaaagguaaaaaguacauuuguauauuacauauauggacauaacu

SEQ ID NO: 212142 - RNA, 64 nt, hsa
auacuggaaaagauuguugugcauaguuauuagucauuuguaaccuugcuuaaguauuucuuag

SEQ ID NO: 212143 - RNA, 64 nt, hsa
cuguuuucuguucuguaagucuagaccuucaaaccauuuguaaacuaaccccugggaaauuuga

SEQ ID NO: 212144 - RNA, 64 nt, hsa
cucuaucugguuuuggguguuuuucauguuuuagcauuuguauaaagaaacugguccauguaaa

SEQ ID NO: 212145 - RNA, 64 nt, hsa
uagcaauaaaugcuuuucuaaugccuuuugaauacauuuguauuuauguggcuguaaugacaaa

SEQ ID NO: 212146 - RNA, 64 nt, hsa
uuaaggacugccacucucuucagacagaaucugauuauuccagcuugagagaagcacucuguuu

SEQ ID NO: 212147 - RNA, 64 nt, hsa
gcaggaugcagggauuaauaaggacacauacacauuauuccaccaauugacuuugaaaagugga

SEQ ID NO: 212148 - RNA, 64 nt, hsa
uucuuaaaggggaacaaaugaucuugacaacauauuauuccauaaaaccaguuuagggcacagg

SEQ ID NO: 212149 - RNA, 64 nt, hsa
uuucuacauugucccugagugucagaacuauaauuuauuccauuucucucugugucugugccaa

SEQ ID NO: 212150 - RNA, 64 nt, hsa
guuccaucuucccccuucccaaaggccacagccuuuauuccaggcccagggauguaggaggggg

SEQ ID NO: 212151 - RNA, 64 nt, hsa
cauauugaaaccuuuuaaggaugccaagaaugcauuauuccacaaaaaaacagcagaccaacau

SEQ ID NO: 212152 - RNA, 64 nt, hsa
agcauuguuguccuucacugcaguccaguugggauuauuccaaaaguuuuuugagucuugagcu

SEQ ID NO: 212153 - RNA, 64 nt, hsa
gaaugaccuggaacaggccuuagaaacaauugauuuauuccaauaguuaaccacuggcuggcuc

SEQ ID NO: 212154 - RNA, 64 nt, hsa
uagagcuaggucaaaaaaacaacuguuucuuuucuuauuccacuauuaauaaauugaaagcuug

SEQ ID NO: 212155 - RNA, 64 nt, hsa
uguuccagugaaaauggaguucuggguuggaggcuuauuccauguuuacacaauuaaaauugca

SEQ ID NO: 212156 - RNA, 64 nt, hsa
guuucauuuguugcugaaugcuuuccagaauuauuuauuccauaggguuucucuccugugcagc

SEQ ID NO: 212157 - RNA, 64 nt, hsa
aaacuauuaaaaugauagauuguggagaaaguaauuauuccaacacccaucugccaugcgaugu

SEQ ID NO: 212158 - RNA, 64 nt, hsa
uacuuuuuuauggcacauauuagcauauaagccuuuauuccaagagguauuuauuuuuucacuu

SEQ ID NO: 212159 - RNA, 64 nt, hsa
gaguuacauguuuuaaccucuuuuuuuuuucuaauuauuccauccaaaauuucuggugaauuac

SEQ ID NO: 212160 - RNA, 64 nt, hsa
auggaaugucccaguuuaauauaaaacauacaguuuauuccacacagcaguuugacuuuguaaa

SEQ ID NO: 212161 - RNA, 64 nt, hsa
cacuaaacacuccuuuuuugacauauuaaagccuuuauuccaucucucaagauauauuauaaaa

SEQ ID NO: 212162 - RNA, 64 nt, hsa
aaaauauuuuuggauagcguugacacgauagaucuuauuccauacuucuuuauuauugauaauu

SEQ ID NO: 212163 - RNA, 64 nt, hsa
auuuaaauguuuauaacauaguuuaauuuuauauuuauuccagauaguauuuaauuuagugcuu

SEQ ID NO: 212164 - RNA, 64 nt, hsa
caaacuucaaaaaguuaauuauugucauaaugcauuauuccauguguggugucaauacauuuua

SEQ ID NO: 212165 - RNA, 64 nt, hsa
ugucuaaaguuugcuaguaguguuucuucaaagguuauuccagguaugguuaaguagugagaaa

SEQ ID NO: 212166 - RNA, 64 nt, hsa
cugcauguuugugaucacugugagucucagaugauuauuccaguuuucaaugauuuuucaaaau

SEQ ID NO: 212167 - RNA, 64 nt, hsa
aacagauugagguuagaggaucaguaggacauuuuuauuccaucuguccuauggggaaauuuac

SEQ ID NO: 212168 - RNA, 64 nt, hsa
guguuuguuuugguucuuggagggaaaagauucuuuauuccaauuuccagagagaagagaaaac

SEQ ID NO: 212169 - RNA, 64 nt, hsa
aucuaccugugacccagaagguccccaauuccaguuauuccaccuuuccagaccggaccaaugu

SEQ ID NO: 212170 - RNA, 64 nt, hsa
cuacaucacauucaguuauaaucauuuagcaauauuauuccauucaauauggcuuguaucucuu

SEQ ID NO: 212171 - RNA, 64 nt, hsa
uggauagauucucaauuguuauguccacuuauucacuagguaaauuuucaguuuuaauacuuuu

SEQ ID NO: 212172 - RNA, 64 nt, hsa
uuagcugugucccuguagcucuggaacugaaggaacuagguaggagaggaaggauuugagaaau

SEQ ID NO: 212173 - RNA, 64 nt, hsa; identical to SEQ ID NO: 156143

SEQ ID NO: 212174 - RNA, 64 nt, hsa; identical to SEQ ID NO: 156144

SEQ ID NO: 212175 - RNA, 64 nt, hsa; identical to SEQ ID NO: 156145

SEQ ID NO: 212176 - RNA, 64 nt, hsa; identical to SEQ ID NO: 156146

SEQ ID NO: 212177 - RNA, 64 nt, hsa; identical to SEQ ID NO: 156147

SEQ ID NO: 212178 - RNA, 64 nt, hsa; identical to SEQ ID NO: 156148

SEQ ID NO: 212179 - RNA, 64 nt, hsa; identical to SEQ ID NO: 156149

SEQ ID NO: 212180 - RNA, 64 nt, hsa; identical to SEQ ID NO: 156150

SEQ ID NO: 212181 - RNA, 64 nt, hsa; identical to SEQ ID NO: 156151

SEQ ID NO: 212182 - RNA, 64 nt, hsa; identical to SEQ ID NO: 156152

SEQ ID NO: 212183 - RNA, 64 nt, hsa; identical to SEQ ID NO: 156153

SEQ ID NO: 212184 - RNA, 64 nt, hsa; identical to SEQ ID NO: 156154

SEQ ID NO: 212185 - RNA, 64 nt, hsa; identical to SEQ ID NO: 156155

SEQ ID NO: 212186 - RNA, 64 nt, hsa; identical to SEQ ID NO: 156156

SEQ ID NO: 212187 - RNA, 64 nt, hsa; identical to SEQ ID NO: 156157

SEQ ID NO: 212188 - RNA, 64 nt, hsa; identical to SEQ ID NO: 156158

SEQ ID NO: 212189 - RNA, 64 nt, hsa; identical to SEQ ID NO: 156159

SEQ ID NO: 212190 - RNA, 64 nt, hsa; identical to SEQ ID NO: 156160

SEQ ID NO: 212191 - RNA, 64 nt, hsa; identical to SEQ ID NO: 156161

SEQ ID NO: 212192 - RNA, 64 nt, hsa; identical to SEQ ID NO: 156162

SEQ ID NO: 212193 - RNA, 64 nt, hsa; identical to SEQ ID NO: 156163

SEQ ID NO: 212194 - RNA, 64 nt, hsa; identical to SEQ ID NO: 156164

SEQ ID NO: 212195 - RNA, 64 nt, hsa; identical to SEQ ID NO: 156165

SEQ ID NO: 212196 - RNA, 64 nt, hsa; identical to SEQ ID NO: 156166

SEQ ID NO: 212197 - RNA, 64 nt, hsa; identical to SEQ ID NO: 156167

SEQ ID NO: 212198 - RNA, 64 nt, hsa; identical to SEQ ID NO: 156168

SEQ ID NO: 212199 - RNA, 64 nt, hsa; identical to SEQ ID NO: 156169

SEQ ID NO: 212200 - RNA, 64 nt, hsa; identical to SEQ ID NO: 156170

SEQ ID NO: 212201 - RNA, 64 nt, hsa; identical to SEQ ID NO: 156171

SEQ ID NO: 212202 - RNA, 64 nt, hsa; identical to SEQ ID NO: 156172

SEQ ID NO: 212203 - RNA, 64 nt, hsa; identical to SEQ ID NO: 156173

SEQ ID NO: 212204 - RNA, 64 nt, hsa; identical to SEQ ID NO: 156174

SEQ ID NO: 212205 - RNA, 64 nt, hsa; identical to SEQ ID NO: 156175

SEQ ID NO: 212206 - RNA, 64 nt, hsa; identical to SEQ ID NO: 156176

SEQ ID NO: 212207 - RNA, 64 nt, hsa; identical to SEQ ID NO: 156177

SEQ ID NO: 212208 - RNA, 64 nt, hsa; identical to SEQ ID NO: 156178

SEQ ID NO: 212209 - RNA, 64 nt, hsa; identical to SEQ ID NO: 156179

SEQ ID NO: 212210 - RNA, 64 nt, hsa; identical to SEQ ID NO: 156180

SEQ ID NO: 212211 - RNA, 64 nt, hsa; identical to SEQ ID NO: 156181

SEQ ID NO: 212212 - RNA, 64 nt, hsa; identical to SEQ ID NO: 156182

SEQ ID NO: 212213 - RNA, 64 nt, hsa; identical to SEQ ID NO: 156183

SEQ ID NO: 212214 - RNA, 64 nt, hsa; identical to SEQ ID NO: 156184

SEQ ID NO: 212215 - RNA, 64 nt, hsa; identical to SEQ ID NO: 156185

SEQ ID NO: 212216 - RNA, 64 nt, hsa; identical to SEQ ID NO: 156186

SEQ ID NO: 212217 - RNA, 64 nt, hsa; identical to SEQ ID NO: 156187

SEQ ID NO: 212218 - RNA, 64 nt, hsa; identical to SEQ ID NO: 156188

SEQ ID NO: 212219 - RNA, 64 nt, hsa; identical to SEQ ID NO: 156189

SEQ ID NO: 212220 - RNA, 64 nt, hsa; identical to SEQ ID NO: 156190

SEQ ID NO: 212221 - RNA, 64 nt, hsa; identical to SEQ ID NO: 156191

SEQ ID NO: 212222 - RNA, 64 nt, hsa; identical to SEQ ID NO: 156192

SEQ ID NO: 212223 - RNA, 64 nt, hsa; identical to SEQ ID NO: 156193

SEQ ID NO: 212224 - RNA, 64 nt, hsa; identical to SEQ ID NO: 156194

SEQ ID NO: 212225 - RNA, 64 nt, hsa; identical to SEQ ID NO: 156195

SEQ ID NO: 212226 - RNA, 64 nt, hsa; identical to SEQ ID NO: 156196

SEQ ID NO: 212227 - RNA, 64 nt, hsa; identical to SEQ ID NO: 156197

SEQ ID NO: 212228 - RNA, 64 nt, hsa; identical to SEQ ID NO: 156198

SEQ ID NO: 212229 - RNA, 64 nt, hsa; identical to SEQ ID NO: 156199

SEQ ID NO: 212230 - RNA, 64 nt, hsa; identical to SEQ ID NO: 156200

SEQ ID NO: 212231 - RNA, 64 nt, hsa; identical to SEQ ID NO: 156201

SEQ ID NO: 212232 - RNA, 64 nt, hsa; identical to SEQ ID NO: 156202

SEQ ID NO: 212233 - RNA, 64 nt, hsa; identical to SEQ ID NO: 156203

SEQ ID NO: 212234 - RNA, 64 nt, hsa; identical to SEQ ID NO: 156204

SEQ ID NO: 212235 - RNA, 64 nt, hsa; identical to SEQ ID NO: 156205

SEQ ID NO: 212236 - RNA, 64 nt, hsa; identical to SEQ ID NO: 156206

SEQ ID NO: 212237 - RNA, 64 nt, hsa; identical to SEQ ID NO: 156207

SEQ ID NO: 212238 - RNA, 64 nt, hsa; identical to SEQ ID NO: 156208

SEQ ID NO: 212239 - RNA, 64 nt, hsa; identical to SEQ ID NO: 156209

SEQ ID NO: 212240 - RNA, 53 nt, hsa; identical to SEQ ID NO: 156210

SEQ ID NO: 212241 - RNA, 64 nt, hsa; identical to SEQ ID NO: 156211

SEQ ID NO: 212242 - RNA, 64 nt, hsa; identical to SEQ ID NO: 156212

SEQ ID NO: 212243 - RNA, 64 nt, hsa; identical to SEQ ID NO: 156213

SEQ ID NO: 212244 - RNA, 64 nt, hsa; identical to SEQ ID NO: 156214

SEQ ID NO: 212245 - RNA, 64 nt, hsa; identical to SEQ ID NO: 156215

SEQ ID NO: 212246 - RNA, 64 nt, hsa; identical to SEQ ID NO: 156216

SEQ ID NO: 212247 - RNA, 64 nt, hsa; identical to SEQ ID NO: 156217

SEQ ID NO: 212248 - RNA, 64 nt, hsa; identical to SEQ ID NO: 156218

SEQ ID NO: 212249 - RNA, 64 nt, hsa; identical to SEQ ID NO: 156219

SEQ ID NO: 212250 - RNA, 64 nt, hsa; identical to SEQ ID NO: 156220

SEQ ID NO: 212251 - RNA, 64 nt, hsa; identical to SEQ ID NO: 156221

SEQ ID NO: 212252 - RNA, 64 nt, hsa; identical to SEQ ID NO: 156222

SEQ ID NO: 212253 - RNA, 64 nt, hsa; identical to SEQ ID NO: 156223

SEQ ID NO: 212254 - RNA, 64 nt, hsa; identical to SEQ ID NO: 156224

SEQ ID NO: 212255 - RNA, 64 nt, hsa; identical to SEQ ID NO: 156225

SEQ ID NO: 212256 - RNA, 64 nt, hsa; identical to SEQ ID NO: 156226

SEQ ID NO: 212257 - RNA, 64 nt, hsa; identical to SEQ ID NO: 156227

SEQ ID NO: 212258 - RNA, 64 nt, hsa; identical to SEQ ID NO: 156228

SEQ ID NO: 212259 - RNA, 64 nt, hsa; identical to SEQ ID NO: 156229

SEQ ID NO: 212260 - RNA, 64 nt, hsa; identical to SEQ ID NO: 156230

SEQ ID NO: 212261 - RNA, 64 nt, hsa; identical to SEQ ID NO: 156231

SEQ ID NO: 212262 - RNA, 64 nt, hsa; identical to SEQ ID NO: 156232

SEQ ID NO: 212263 - RNA, 64 nt, hsa; identical to SEQ ID NO: 156233

SEQ ID NO: 212264 - RNA, 64 nt, hsa; identical to SEQ ID NO: 156234

SEQ ID NO: 212265 - RNA, 64 nt, hsa; identical to SEQ ID NO: 156235

SEQ ID NO: 212266 - RNA, 64 nt, hsa; identical to SEQ ID NO: 156236

SEQ ID NO: 212267 - RNA, 64 nt, hsa; identical to SEQ ID NO: 156237

SEQ ID NO: 212268 - RNA, 64 nt, hsa; identical to SEQ ID NO: 156238

SEQ ID NO: 212269 - RNA, 64 nt, hsa; identical to SEQ ID NO: 156239

SEQ ID NO: 212270 - RNA, 64 nt, hsa; identical to SEQ ID NO: 156240

SEQ ID NO: 212271 - RNA, 64 nt, hsa; identical to SEQ ID NO: 156241

SEQ ID NO: 212272 - RNA, 64 nt, hsa; identical to SEQ ID NO: 156242

SEQ ID NO: 212273 - RNA, 64 nt, hsa; identical to SEQ ID NO: 156243

SEQ ID NO: 212274 - RNA, 64 nt, hsa; identical to SEQ ID NO: 156244

SEQ ID NO: 212275 - RNA, 64 nt, hsa; identical to SEQ ID NO: 156245

SEQ ID NO: 212276 - RNA, 64 nt, hsa; identical to SEQ ID NO: 156246

SEQ ID NO: 212277 - RNA, 64 nt, hsa; identical to SEQ ID NO: 156247

SEQ ID NO: 212278 - RNA, 64 nt, hsa; identical to SEQ ID NO: 156248

SEQ ID NO: 212279 - RNA, 64 nt, hsa; identical to SEQ ID NO: 156249

SEQ ID NO: 212280 - RNA, 64 nt, hsa; identical to SEQ ID NO: 156250

SEQ ID NO: 212281 - RNA, 64 nt, hsa; identical to SEQ ID NO: 156251

SEQ ID NO: 212282 - RNA, 64 nt, hsa; identical to SEQ ID NO: 156252

SEQ ID NO: 212283 - RNA, 64 nt, hsa; identical to SEQ ID NO: 156253

SEQ ID NO: 212284 - RNA, 64 nt, hsa; identical to SEQ ID NO: 156254

SEQ ID NO: 212285 - RNA, 64 nt, hsa; identical to SEQ ID NO: 156255

SEQ ID NO: 212286 - RNA, 64 nt, hsa; identical to SEQ ID NO: 156256

SEQ ID NO: 212287 - RNA, 64 nt, hsa; identical to SEQ ID NO: 156257

SEQ ID NO: 212288 - RNA, 64 nt, hsa; identical to SEQ ID NO: 156258

SEQ ID NO: 212289 - RNA, 64 nt, hsa; identical to SEQ ID NO: 156259

SEQ ID NO: 212290 - RNA, 64 nt, hsa; identical to SEQ ID NO: 156260

SEQ ID NO: 212291 - RNA, 64 nt, hsa; identical to SEQ ID NO: 156261

SEQ ID NO: 212292 - RNA, 64 nt, hsa; identical to SEQ ID NO: 156262

SEQ ID NO: 212293 - RNA, 64 nt, hsa; identical to SEQ ID NO: 156263

SEQ ID NO: 212294 - RNA, 64 nt, hsa; identical to SEQ ID NO: 156264

SEQ ID NO: 212295 - RNA, 64 nt, hsa; identical to SEQ ID NO: 156265

SEQ ID NO: 212296 - RNA, 64 nt, hsa; identical to SEQ ID NO: 156266

SEQ ID NO: 212297 - RNA, 64 nt, hsa; identical to SEQ ID NO: 156267

SEQ ID NO: 212298 - RNA, 64 nt, hsa; identical to SEQ ID NO: 156268

SEQ ID NO: 212299 - RNA, 64 nt, hsa; identical to SEQ ID NO: 156269

SEQ ID NO: 212300 - RNA, 64 nt, hsa; identical to SEQ ID NO: 156270

SEQ ID NO: 212301 - RNA, 64 nt, hsa; identical to SEQ ID NO: 156271

SEQ ID NO: 212302 - RNA, 64 nt, hsa; identical to SEQ ID NO: 156272

SEQ ID NO: 212303 - RNA, 64 nt, hsa; identical to SEQ ID NO: 156273

SEQ ID NO: 212304 - RNA, 64 nt, hsa; identical to SEQ ID NO: 156274

SEQ ID NO: 212305 - RNA, 64 nt, hsa; identical to SEQ ID NO: 156275

SEQ ID NO: 212306 - RNA, 64 nt, hsa; identical to SEQ ID NO: 156276

SEQ ID NO: 212307 - RNA, 64 nt, hsa; identical to SEQ ID NO: 156277

SEQ ID NO: 212308 - RNA, 64 nt, hsa; identical to SEQ ID NO: 156278

SEQ ID NO: 212309 - RNA, 64 nt, hsa; identical to SEQ ID NO: 156279

SEQ ID NO: 212310 - RNA, 64 nt, hsa; identical to SEQ ID NO: 156280

SEQ ID NO: 212311 - RNA, 64 nt, hsa; identical to SEQ ID NO: 156281

SEQ ID NO: 212312 - RNA, 64 nt, hsa; identical to SEQ ID NO: 156282

SEQ ID NO: 212313 - RNA, 64 nt, hsa; identical to SEQ ID NO: 156283

SEQ ID NO: 212314 - RNA, 64 nt, hsa; identical to SEQ ID NO: 156284

SEQ ID NO: 212315 - RNA, 64 nt, hsa; identical to SEQ ID NO: 156285

SEQ ID NO: 212316 - RNA, 64 nt, hsa; identical to SEQ ID NO: 156286

SEQ ID NO: 212317 - RNA, 64 nt, hsa; identical to SEQ ID NO: 156287

SEQ ID NO: 212318 - RNA, 64 nt, hsa; identical to SEQ ID NO: 95053

SEQ ID NO: 212319 - RNA, 64 nt, hsa; identical to SEQ ID NO: 95054

SEQ ID NO: 212320 - RNA, 64 nt, hsa; identical to SEQ ID NO: 95055

SEQ ID NO: 212321 - RNA, 64 nt, hsa; identical to SEQ ID NO: 95056

SEQ ID NO: 212322 - RNA, 64 nt, hsa; identical to SEQ ID NO: 95057

SEQ ID NO: 212323 - RNA, 64 nt, hsa; identical to SEQ ID NO: 95058

SEQ ID NO: 212324 - RNA, 64 nt, hsa; identical to SEQ ID NO: 95059

SEQ ID NO: 212325 - RNA, 64 nt, hsa; identical to SEQ ID NO: 95060

SEQ ID NO: 212326 - RNA, 64 nt, hsa; identical to SEQ ID NO: 95061

SEQ ID NO: 212327 - RNA, 64 nt, hsa; identical to SEQ ID NO: 95062

SEQ ID NO: 212328 - RNA, 64 nt, hsa; identical to SEQ ID NO: 95063

SEQ ID NO: 212329 - RNA, 64 nt, hsa; identical to SEQ ID NO: 95064

SEQ ID NO: 212330 - RNA, 64 nt, hsa; identical to SEQ ID NO: 95065

SEQ ID NO: 212331 - RNA, 64 nt, hsa; identical to SEQ ID NO: 95066

SEQ ID NO: 212332 - RNA, 64 nt, hsa; identical to SEQ ID NO: 95067

SEQ ID NO: 212333 - RNA, 64 nt, hsa; identical to SEQ ID NO: 95068

SEQ ID NO: 212334 - RNA, 64 nt, hsa; identical to SEQ ID NO: 95069

SEQ ID NO: 212335 - RNA, 64 nt, hsa; identical to SEQ ID NO: 95070

SEQ ID NO: 212336 - RNA, 64 nt, hsa; identical to SEQ ID NO: 95071

SEQ ID NO: 212337 - RNA, 64 nt, hsa; identical to SEQ ID NO: 95072

SEQ ID NO: 212338 - RNA, 64 nt, hsa; identical to SEQ ID NO: 95073

SEQ ID NO: 212339 - RNA, 64 nt, hsa; identical to SEQ ID NO: 95074

SEQ ID NO: 212340 - RNA, 64 nt, hsa; identical to SEQ ID NO: 95075

SEQ ID NO: 212341 - RNA, 64 nt, hsa; identical to SEQ ID NO: 95076

SEQ ID NO: 212342 - RNA, 64 nt, hsa; identical to SEQ ID NO: 95077

SEQ ID NO: 212343 - RNA, 64 nt, hsa; identical to SEQ ID NO: 95078

SEQ ID NO: 212344 - RNA, 64 nt, hsa; identical to SEQ ID NO: 95079

SEQ ID NO: 212345 - RNA, 64 nt, hsa; identical to SEQ ID NO: 77572

SEQ ID NO: 212346 - RNA, 64 nt, hsa; identical to SEQ ID NO: 77573

SEQ ID NO: 212347 - RNA, 64 nt, hsa; identical to SEQ ID NO: 77574

SEQ ID NO: 212348 - RNA, 64 nt, hsa; identical to SEQ ID NO: 77575

SEQ ID NO: 212349 - RNA, 64 nt, hsa; identical to SEQ ID NO: 77576

SEQ ID NO: 212350 - RNA, 64 nt, hsa; identical to SEQ ID NO: 77577

SEQ ID NO: 212351 - RNA, 64 nt, hsa; identical to SEQ ID NO: 77578

SEQ ID NO: 212352 - RNA, 64 nt, hsa; identical to SEQ ID NO: 77579

SEQ ID NO: 212353 - RNA, 64 nt, hsa; identical to SEQ ID NO: 77580

SEQ ID NO: 212354 - RNA, 64 nt, hsa; identical to SEQ ID NO: 77581

SEQ ID NO: 212355 - RNA, 64 nt, hsa; identical to SEQ ID NO: 77582

SEQ ID NO: 212356 - RNA, 64 nt, hsa; identical to SEQ ID NO: 77583

SEQ ID NO: 212357 - RNA, 64 nt, hsa; identical to SEQ ID NO: 77584

SEQ ID NO: 212358 - RNA, 64 nt, hsa; identical to SEQ ID NO: 77585

SEQ ID NO: 212359 - RNA, 64 nt, hsa; identical to SEQ ID NO: 77586

SEQ ID NO: 212360 - RNA, 64 nt, hsa; identical to SEQ ID NO: 77587

SEQ ID NO: 212361 - RNA, 64 nt, hsa; identical to SEQ ID NO: 77588

SEQ ID NO: 212362 - RNA, 64 nt, hsa; identical to SEQ ID NO: 77589

SEQ ID NO: 212363 - RNA, 56 nt, hsa; identical to SEQ ID NO: 77590

SEQ ID NO: 212364 - RNA, 64 nt, hsa; identical to SEQ ID NO: 77591

SEQ ID NO: 212365 - RNA, 64 nt, hsa; identical to SEQ ID NO: 77592

SEQ ID NO: 212366 - RNA, 64 nt, hsa; identical to SEQ ID NO: 77593

SEQ ID NO: 212367 - RNA, 64 nt, hsa; identical to SEQ ID NO: 77594

SEQ ID NO: 212368 - RNA, 64 nt, hsa; identical to SEQ ID NO: 77595

SEQ ID NO: 212369 - RNA, 64 nt, hsa; identical to SEQ ID NO: 77596

SEQ ID NO: 212370 - RNA, 64 nt, hsa; identical to SEQ ID NO: 77597

SEQ ID NO: 212371 - RNA, 64 nt, hsa; identical to SEQ ID NO: 77598

SEQ ID NO: 212372 - RNA, 64 nt, hsa; identical to SEQ ID NO: 77599

SEQ ID NO: 212373 - RNA, 64 nt, hsa; identical to SEQ ID NO: 77600

SEQ ID NO: 212374 - RNA, 64 nt, hsa; identical to SEQ ID NO: 77601

SEQ ID NO: 212375 - RNA, 64 nt, hsa; identical to SEQ ID NO: 77602

SEQ ID NO: 212376 - RNA, 64 nt, hsa; identical to SEQ ID NO: 77603

SEQ ID NO: 212377 - RNA, 64 nt, hsa; identical to SEQ ID NO: 77604

SEQ ID NO: 212378 - RNA, 64 nt, hsa; identical to SEQ ID NO: 77605

SEQ ID NO: 212379 - RNA, 64 nt, hsa; identical to SEQ ID NO: 77606

SEQ ID NO: 212380 - RNA, 64 nt, hsa; identical to SEQ ID NO: 77607

SEQ ID NO: 212381 - RNA, 64 nt, hsa; identical to SEQ ID NO: 77608

SEQ ID NO: 212382 - RNA, 64 nt, hsa; identical to SEQ ID NO: 77609

SEQ ID NO: 212383 - RNA, 64 nt, hsa; identical to SEQ ID NO: 77610

SEQ ID NO: 212384 - RNA, 64 nt, hsa; identical to SEQ ID NO: 77611

SEQ ID NO: 212385 - RNA, 64 nt, hsa; identical to SEQ ID NO: 77612

SEQ ID NO: 212386 - RNA, 64 nt, hsa; identical to SEQ ID NO: 77613

SEQ ID NO: 212387 - RNA, 64 nt, hsa; identical to SEQ ID NO: 77614

SEQ ID NO: 212388 - RNA, 64 nt, hsa; identical to SEQ ID NO: 77615

SEQ ID NO: 212389 - RNA, 64 nt, hsa; identical to SEQ ID NO: 77616

SEQ ID NO: 212390 - RNA, 64 nt, hsa; identical to SEQ ID NO: 77617

SEQ ID NO: 212391 - RNA, 64 nt, hsa; identical to SEQ ID NO: 77618

SEQ ID NO: 212392 - RNA, 64 nt, hsa; identical to SEQ ID NO: 77619

SEQ ID NO: 212393 - RNA, 64 nt, hsa; identical to SEQ ID NO: 77620

SEQ ID NO: 212394 - RNA, 64 nt, hsa; identical to SEQ ID NO: 77621

SEQ ID NO: 212395 - RNA, 64 nt, hsa; identical to SEQ ID NO: 77622

SEQ ID NO: 212396 - RNA, 64 nt, hsa; identical to SEQ ID NO: 77623

SEQ ID NO: 212397 - RNA, 64 nt, hsa; identical to SEQ ID NO: 77624

SEQ ID NO: 212398 - RNA, 64 nt, hsa; identical to SEQ ID NO: 77625

SEQ ID NO: 212399 - RNA, 64 nt, hsa; identical to SEQ ID NO: 77626

SEQ ID NO: 212400 - RNA, 64 nt, hsa; identical to SEQ ID NO: 77627

SEQ ID NO: 212401 - RNA, 64 nt, hsa; identical to SEQ ID NO: 77628

SEQ ID NO: 212402 - RNA, 64 nt, hsa; identical to SEQ ID NO: 77629

SEQ ID NO: 212403 - RNA, 64 nt, hsa; identical to SEQ ID NO: 77630

SEQ ID NO: 212404 - RNA, 64 nt, hsa; identical to SEQ ID NO: 77631

SEQ ID NO: 212405 - RNA, 64 nt, hsa; identical to SEQ ID NO: 77632

SEQ ID NO: 212406 - RNA, 64 nt, hsa; identical to SEQ ID NO: 77633

SEQ ID NO: 212407 - RNA, 64 nt, hsa; identical to SEQ ID NO: 77634

SEQ ID NO: 212408 - RNA, 64 nt, hsa; identical to SEQ ID NO: 77635

SEQ ID NO: 212409 - RNA, 64 nt, hsa; identical to SEQ ID NO: 77636

SEQ ID NO: 212410 - RNA, 64 nt, hsa; identical to SEQ ID NO: 77637

SEQ ID NO: 212411 - RNA, 64 nt, hsa; identical to SEQ ID NO: 77638

SEQ ID NO: 212412 - RNA, 64 nt, hsa; identical to SEQ ID NO: 77639

SEQ ID NO: 212413 - RNA, 64 nt, hsa; identical to SEQ ID NO: 77640

SEQ ID NO: 212414 - RNA, 64 nt, hsa; identical to SEQ ID NO: 77641

SEQ ID NO: 212415 - RNA, 64 nt, hsa; identical to SEQ ID NO: 77642

SEQ ID NO: 212416 - RNA, 64 nt, hsa; identical to SEQ ID NO: 77643

SEQ ID NO: 212417 - RNA, 64 nt, hsa; identical to SEQ ID NO: 77644

SEQ ID NO: 212418 - RNA, 64 nt, hsa; identical to SEQ ID NO: 77645

SEQ ID NO: 212419 - RNA, 64 nt, hsa; identical to SEQ ID NO: 77646

SEQ ID NO: 212420 - RNA, 64 nt, hsa; identical to SEQ ID NO: 77647

SEQ ID NO: 212421 - RNA, 64 nt, hsa; identical to SEQ ID NO: 77648

SEQ ID NO: 212422 - RNA, 64 nt, hsa; identical to SEQ ID NO: 77649

SEQ ID NO: 212423 - RNA, 64 nt, hsa; identical to SEQ ID NO: 77650

SEQ ID NO: 212424 - RNA, 64 nt, hsa; identical to SEQ ID NO: 77651

SEQ ID NO: 212425 - RNA, 64 nt, hsa; identical to SEQ ID NO: 77652

SEQ ID NO: 212426 - RNA, 64 nt, hsa; identical to SEQ ID NO: 77653

SEQ ID NO: 212427 - RNA, 64 nt, hsa; identical to SEQ ID NO: 77654

SEQ ID NO: 212428 - RNA, 64 nt, hsa; identical to SEQ ID NO: 77655

SEQ ID NO: 212429 - RNA, 64 nt, hsa; identical to SEQ ID NO: 77656

SEQ ID NO: 212430 - RNA, 64 nt, hsa; identical to SEQ ID NO: 77657

SEQ ID NO: 212431 - RNA, 64 nt, hsa; identical to SEQ ID NO: 77658

SEQ ID NO: 212432 - RNA, 64 nt, hsa; identical to SEQ ID NO: 77659

SEQ ID NO: 212433 - RNA, 64 nt, hsa; identical to SEQ ID NO: 77660

SEQ ID NO: 212434 - RNA, 63 nt, hsa; identical to SEQ ID NO: 77661

SEQ ID NO: 212435 - RNA, 64 nt, hsa; identical to SEQ ID NO: 77662

SEQ ID NO: 212436 - RNA, 64 nt, hsa; identical to SEQ ID NO: 77663

SEQ ID NO: 212437 - RNA, 64 nt, hsa; identical to SEQ ID NO: 77664

SEQ ID NO: 212438 - RNA, 64 nt, hsa; identical to SEQ ID NO: 77665

SEQ ID NO: 212439 - RNA, 64 nt, hsa; identical to SEQ ID NO: 77666

SEQ ID NO: 212440 - RNA, 64 nt, hsa; identical to SEQ ID NO: 77667

SEQ ID NO: 212441 - RNA, 64 nt, hsa; identical to SEQ ID NO: 77668

SEQ ID NO: 212442 - RNA, 64 nt, hsa; identical to SEQ ID NO: 77669

SEQ ID NO: 212443 - RNA, 64 nt, hsa; identical to SEQ ID NO: 77670

SEQ ID NO: 212444 - RNA, 64 nt, hsa; identical to SEQ ID NO: 77671

SEQ ID NO: 212445 - RNA, 64 nt, hsa; identical to SEQ ID NO: 77672

SEQ ID NO: 212446 - RNA, 64 nt, hsa; identical to SEQ ID NO: 77673

SEQ ID NO: 212447 - RNA, 64 nt, hsa; identical to SEQ ID NO: 77674

SEQ ID NO: 212448 - RNA, 64 nt, hsa; identical to SEQ ID NO: 77675

SEQ ID NO: 212449 - RNA, 64 nt, hsa; identical to SEQ ID NO: 77676

SEQ ID NO: 212450 - RNA, 64 nt, hsa; identical to SEQ ID NO: 77677

SEQ ID NO: 212451 - RNA, 64 nt, hsa; identical to SEQ ID NO: 77678

SEQ ID NO: 212452 - RNA, 64 nt, hsa; identical to SEQ ID NO: 77679

SEQ ID NO: 212453 - RNA, 64 nt, hsa; identical to SEQ ID NO: 77680

SEQ ID NO: 212454 - RNA, 64 nt, hsa; identical to SEQ ID NO: 77681

SEQ ID NO: 212455 - RNA, 64 nt, hsa; identical to SEQ ID NO: 77682

SEQ ID NO: 212456 - RNA, 64 nt, hsa; identical to SEQ ID NO: 77683

SEQ ID NO: 212457 - RNA, 57 nt, hsa; identical to SEQ ID NO: 77684

SEQ ID NO: 212458 - RNA, 64 nt, hsa; identical to SEQ ID NO: 77685

SEQ ID NO: 212459 - RNA, 64 nt, hsa; identical to SEQ ID NO: 77686

SEQ ID NO: 212460 - RNA, 64 nt, hsa; identical to SEQ ID NO: 77687

SEQ ID NO: 212461 - RNA, 64 nt, hsa; identical to SEQ ID NO: 77688

SEQ ID NO: 212462 - RNA, 64 nt, hsa; identical to SEQ ID NO: 77689

SEQ ID NO: 212463 - RNA, 64 nt, hsa; identical to SEQ ID NO: 77690

SEQ ID NO: 212464 - RNA, 64 nt, hsa; identical to SEQ ID NO: 77691

SEQ ID NO: 212465 - RNA, 64 nt, hsa; identical to SEQ ID NO: 77692

SEQ ID NO: 212466 - RNA, 64 nt, hsa; identical to SEQ ID NO: 77693

SEQ ID NO: 212467 - RNA, 64 nt, hsa; identical to SEQ ID NO: 77694

SEQ ID NO: 212468 - RNA, 64 nt, hsa; identical to SEQ ID NO: 77695

SEQ ID NO: 212469 - RNA, 64 nt, hsa; identical to SEQ ID NO: 77696

SEQ ID NO: 212470 - RNA, 64 nt, hsa; identical to SEQ ID NO: 77697

SEQ ID NO: 212471 - RNA, 64 nt, hsa; identical to SEQ ID NO: 77698

SEQ ID NO: 212472 - RNA, 64 nt, hsa; identical to SEQ ID NO: 77699

SEQ ID NO: 212473 - RNA, 64 nt, hsa; identical to SEQ ID NO: 77700

SEQ ID NO: 212474 - RNA, 64 nt, hsa; identical to SEQ ID NO: 77701

SEQ ID NO: 212475 - RNA, 64 nt, hsa; identical to SEQ ID NO: 77702

SEQ ID NO: 212476 - RNA, 63 nt, hsa; identical to SEQ ID NO: 77703

SEQ ID NO: 212477 - RNA, 64 nt, hsa; identical to SEQ ID NO: 77704

SEQ ID NO: 212478 - RNA, 64 nt, hsa; identical to SEQ ID NO: 77705

SEQ ID NO: 212479 - RNA, 64 nt, hsa; identical to SEQ ID NO: 77706

SEQ ID NO: 212480 - RNA, 64 nt, hsa; identical to SEQ ID NO: 77707

SEQ ID NO: 212481 - RNA, 64 nt, hsa; identical to SEQ ID NO: 77708

SEQ ID NO: 212482 - RNA, 64 nt, hsa; identical to SEQ ID NO: 77709

SEQ ID NO: 212483 - RNA, 64 nt, hsa; identical to SEQ ID NO: 77710

SEQ ID NO: 212484 - RNA, 64 nt, hsa; identical to SEQ ID NO: 77711

SEQ ID NO: 212485 - RNA, 64 nt, hsa; identical to SEQ ID NO: 77712

SEQ ID NO: 212486 - RNA, 64 nt, hsa; identical to SEQ ID NO: 77713

SEQ ID NO: 212487 - RNA, 64 nt, hsa; identical to SEQ ID NO: 77714

SEQ ID NO: 212488 - RNA, 64 nt, hsa; identical to SEQ ID NO: 77715

SEQ ID NO: 212489 - RNA, 64 nt, hsa; identical to SEQ ID NO: 77716

SEQ ID NO: 212490 - RNA, 64 nt, hsa; identical to SEQ ID NO: 77717

SEQ ID NO: 212491 - RNA, 64 nt, hsa; identical to SEQ ID NO: 77718

SEQ ID NO: 212492 - RNA, 64 nt, hsa; identical to SEQ ID NO: 77719

SEQ ID NO: 212493 - RNA, 64 nt, hsa; identical to SEQ ID NO: 77720

SEQ ID NO: 212494 - RNA, 64 nt, hsa; identical to SEQ ID NO: 77721

SEQ ID NO: 212495 - RNA, 64 nt, hsa; identical to SEQ ID NO: 77722

SEQ ID NO: 212496 - RNA, 64 nt, hsa; identical to SEQ ID NO: 77723

SEQ ID NO: 212497 - RNA, 64 nt, hsa; identical to SEQ ID NO: 77724

SEQ ID NO: 212498 - RNA, 64 nt, hsa; identical to SEQ ID NO: 77725

SEQ ID NO: 212499 - RNA, 64 nt, hsa; identical to SEQ ID NO: 77726

SEQ ID NO: 212500 - RNA, 64 nt, hsa; identical to SEQ ID NO: 77727

SEQ ID NO: 212501 - RNA, 64 nt, hsa; identical to SEQ ID NO: 77728

SEQ ID NO: 212502 - RNA, 64 nt, hsa; identical to SEQ ID NO: 77729

SEQ ID NO: 212503 - RNA, 64 nt, hsa; identical to SEQ ID NO: 77730

SEQ ID NO: 212504 - RNA, 64 nt, hsa; identical to SEQ ID NO: 77731

SEQ ID NO: 212505 - RNA, 64 nt, hsa; identical to SEQ ID NO: 77732

SEQ ID NO: 212506 - RNA, 64 nt, hsa; identical to SEQ ID NO: 77733

SEQ ID NO: 212507 - RNA, 64 nt, hsa; identical to SEQ ID NO: 77734

SEQ ID NO: 212508 - RNA, 64 nt, hsa; identical to SEQ ID NO: 77735

SEQ ID NO: 212509 - RNA, 50 nt, hsa; identical to SEQ ID NO: 77736

SEQ ID NO: 212510 - RNA, 64 nt, hsa; identical to SEQ ID NO: 77737

SEQ ID NO: 212511 - RNA, 64 nt, hsa; identical to SEQ ID NO: 77738

SEQ ID NO: 212512 - RNA, 64 nt, hsa; identical to SEQ ID NO: 77739

SEQ ID NO: 212513 - RNA, 64 nt, hsa; identical to SEQ ID NO: 77740

SEQ ID NO: 212514 - RNA, 64 nt, hsa; identical to SEQ ID NO: 77741

SEQ ID NO: 212515 - RNA, 64 nt, hsa; identical to SEQ ID NO: 77742

SEQ ID NO: 212516 - RNA, 64 nt, hsa; identical to SEQ ID NO: 77743

SEQ ID NO: 212517 - RNA, 64 nt, hsa; identical to SEQ ID NO: 77744

SEQ ID NO: 212518 - RNA, 64 nt, hsa; identical to SEQ ID NO: 52875

SEQ ID NO: 212519 - RNA, 64 nt, hsa; identical to SEQ ID NO: 52876

SEQ ID NO: 212520 - RNA, 64 nt, hsa; identical to SEQ ID NO: 52877

SEQ ID NO: 212521 - RNA, 64 nt, hsa; identical to SEQ ID NO: 52878

SEQ ID NO: 212522 - RNA, 64 nt, hsa; identical to SEQ ID NO: 52879

SEQ ID NO: 212523 - RNA, 64 nt, hsa; identical to SEQ ID NO: 52880

SEQ ID NO: 212524 - RNA, 64 nt, hsa; identical to SEQ ID NO: 52881

SEQ ID NO: 212525 - RNA, 64 nt, hsa; identical to SEQ ID NO: 52882

SEQ ID NO: 212526 - RNA, 64 nt, hsa; identical to SEQ ID NO: 52883

SEQ ID NO: 212527 - RNA, 64 nt, hsa; identical to SEQ ID NO: 52884

SEQ ID NO: 212528 - RNA, 64 nt, hsa; identical to SEQ ID NO: 52885

SEQ ID NO: 212529 - RNA, 64 nt, hsa; identical to SEQ ID NO: 52886

SEQ ID NO: 212530 - RNA, 64 nt, hsa; identical to SEQ ID NO: 52887

SEQ ID NO: 212531 - RNA, 64 nt, hsa; identical to SEQ ID NO: 52888

SEQ ID NO: 212532 - RNA, 64 nt, hsa; identical to SEQ ID NO: 52889

SEQ ID NO: 212533 - RNA, 64 nt, hsa; identical to SEQ ID NO: 52890

SEQ ID NO: 212534 - RNA, 64 nt, hsa; identical to SEQ ID NO: 52891

SEQ ID NO: 212535 - RNA, 64 nt, hsa; identical to SEQ ID NO: 52892

SEQ ID NO: 212536 - RNA, 64 nt, hsa; identical to SEQ ID NO: 52893

SEQ ID NO: 212537 - RNA, 64 nt, hsa; identical to SEQ ID NO: 52894

SEQ ID NO: 212538 - RNA, 64 nt, hsa; identical to SEQ ID NO: 52895

SEQ ID NO: 212539 - RNA, 64 nt, hsa; identical to SEQ ID NO: 52896

SEQ ID NO: 212540 - RNA, 64 nt, hsa; identical to SEQ ID NO: 52897

SEQ ID NO: 212541 - RNA, 64 nt, hsa; identical to SEQ ID NO: 52898

SEQ ID NO: 212542 - RNA, 64 nt, hsa; identical to SEQ ID NO: 52899

SEQ ID NO: 212543 - RNA, 64 nt, hsa; identical to SEQ ID NO: 52900

SEQ ID NO: 212544 - RNA, 64 nt, hsa; identical to SEQ ID NO: 52901

SEQ ID NO: 212545 - RNA, 64 nt, hsa; identical to SEQ ID NO: 52902

SEQ ID NO: 212546 - RNA, 64 nt, hsa; identical to SEQ ID NO: 52903

SEQ ID NO: 212547 - RNA, 64 nt, hsa; identical to SEQ ID NO: 52904

SEQ ID NO: 212548 - RNA, 64 nt, hsa; identical to SEQ ID NO: 52905

SEQ ID NO: 212549 - RNA, 64 nt, hsa; identical to SEQ ID NO: 52906

SEQ ID NO: 212550 - RNA, 64 nt, hsa; identical to SEQ ID NO: 52907

SEQ ID NO: 212551 - RNA, 64 nt, hsa; identical to SEQ ID NO: 52908

SEQ ID NO: 212552 - RNA, 64 nt, hsa; identical to SEQ ID NO: 52909

SEQ ID NO: 212553 - RNA, 64 nt, hsa; identical to SEQ ID NO: 52910

SEQ ID NO: 212554 - RNA, 64 nt, hsa; identical to SEQ ID NO: 52911

SEQ ID NO: 212555 - RNA, 64 nt, hsa; identical to SEQ ID NO: 52912

SEQ ID NO: 212556 - RNA, 64 nt, hsa; identical to SEQ ID NO: 52913

SEQ ID NO: 212557 - RNA, 64 nt, hsa; identical to SEQ ID NO: 52914

SEQ ID NO: 212558 - RNA, 64 nt, hsa
gacuuuuuuuaagcauccugacaggaaauguuuucuucuacauggaaagauagacagcagccaa

SEQ ID NO: 212559 - RNA, 64 nt, hsa
uaagucaauguaaaaaguauaaaaccccuucagacuucuacauuaaugauguauguguugcuga

SEQ ID NO: 212560 - RNA, 64 nt, hsa
uguauacuguacuucuacauacaaauguacuguacuucuacauacaaauguuauguuaaagaau

SEQ ID NO: 212561 - RNA, 64 nt, hsa
aguauauuguaaauucuuaucucuguauacuguacuucuacauacaaauguacuguacuucuac

SEQ ID NO: 212562 - RNA, 64 nt, hsa
uaugagccugguuugugcaaaauuaaaucagaggcuucuacaacaugguuuauuuauguuguag

SEQ ID NO: 212563 - RNA, 64 nt, hsa
uggaauaucgcuuuuaauaaaauggaaaaauaugcuucuacauauuuaccaccauaggcguuuu

SEQ ID NO: 212564 - RNA, 64 nt, hsa
aauaaggaacugggggcauuuguuuaggccaugacuucuacaagcagauuucuuuucuuuuagu

SEQ ID NO: 212565 - RNA, 64 nt, hsa
aaguacaaagguacauuuucaauuaaaaagcacacuucuacaaaagauuugguuuuuaaauuau

SEQ ID NO: 212566 - RNA, 64 nt, hsa
accacuacuccaaacaaaacacaauaugccuaggggcacggaugaacguccagggagcccgggc

SEQ ID NO: 212567 - RNA, 64 nt, hsa
gggagcacgcaggacagacacagcaggggucuggggcacggagccuugcuggcaucagcaucag

SEQ ID NO: 212568 - RNA, 64 nt, hsa
auuccaucauggucugaaagucaaacuucggcaaggcacggacgacugugcagacacagcagcg

SEQ ID NO: 212569 - RNA, 64 nt, hsa
aauggacugaaugagugcgugcugggugggguggggcacggaggcuggcggguugcuucagcca

SEQ ID NO: 212570 - RNA, 64 nt, hsa
ugcauccuguuuuccuaauucccagacuguucugggcacggaagggacccuggauguggagucu

SEQ ID NO: 212571 - RNA, 64 nt, hsa
aaagcacaaccccaaucacacacagaaacccguaggcacggacacacccagucucaaugcacga

SEQ ID NO: 212572 - RNA, 64 nt, hsa
cgccugacagugcaaggcaggggcacggugguggggcacggagggcagucccgggugggcuucu

SEQ ID NO: 212573 - RNA, 64 nt, hsa
ucuuuuuuuaggaguguuauuuuucacuauguguggcacggauacaauaaaagacuuuuacaaa

SEQ ID NO: 212574 - RNA, 64 nt, hsa
gggucaucagaggacugccugggacgguucagcgggcacggagcgcugugcuggccuggcuggg

SEQ ID NO: 212575 - RNA, 64 nt, hsa
ggacaaagggagggagcaagcccuacucggauggggcacggacuguccaccuuuucugaugugu

SEQ ID NO: 212576 - RNA, 64 nt, hsa
accacuuucccagcucuuagaugugguagcuaaaggcacggaauuuagacggccuuguaaauag

SEQ ID NO: 212577 - RNA, 64 nt, hsa
uauaugugaacuugacacuccaaacuccugucauggcacggaagcuaggagugcugcuggaccc

SEQ ID NO: 212578 - RNA, 64 nt, hsa
uuccuggaggcgaugcagccaggccccuguggguggcacggaggggcugugaccugguccccag

SEQ ID NO: 212579 - RNA, 64 nt, hsa
ccaauuuaugcaguaaauagacuaaaguucacagggcacggaugaguuuaucaaacuucguuau

SEQ ID NO: 212580 - RNA, 64 nt, hsa
cuaaugcccaacagcaucacggcacucugggacaggcacggaggacggcgugggcagccugggc

SEQ ID NO: 212581 - RNA, 64 nt, hsa
gauggaggcacucaggccuggguaggauuccucuggcacggagggagagacccugggugagacc

SEQ ID NO: 212582 - RNA, 64 nt, hsa
agagauucucugacauucacgugucagccacuuuggcacggaagccuuacaguguggggaacca

SEQ ID NO: 212583 - RNA, 64 nt, hsa
acgguggggcguagacuugacaacaucccacaguggcacggagagaaggcccauaccuucuggu

SEQ ID NO: 212584 - RNA, 64 nt, hsa
ggcucuggucugccauucgccagugcagggaucuggcacggaccagauguggcgaauggcagca

SEQ ID NO: 212585 - RNA, 64 nt, hsa
acgcagggcagcaguacccccguuuggcacuugaggcacggagaagggaagggaaguccgccca

SEQ ID NO: 212586 - RNA, 64 nt, hsa
uuucauuucccccaaugaaugucacaaggagaugggcacggagcugcuucgggugcaucacgcu

SEQ ID NO: 212587 - RNA, 64 nt, hsa
ugugugcucuuguguagucugugugugaucaaagggcacggaaguggcugcacuuucacauccc

SEQ ID NO: 212588 - RNA, 64 nt, hsa
aagagaagggcugcucagggaaacauuggcugggggcacggaauaagcacauaguaaaaaggga

SEQ ID NO: 212589 - RNA, 64 nt, hsa
gcacacguguggguguuuccauaggacauugucaggcacggauggcugguccgaagcacgugca

SEQ ID NO: 212590 - RNA, 64 nt, hsa
agucagucggaguacuugaagaaggcccacgggcggcacggaguuccugagcccuuucuguagu

SEQ ID NO: 212591 - RNA, 64 nt, hsa
ccucacccuuggcuggcagacccacuggaggucaggcacggaccaguggcccagcccugggugu

SEQ ID NO: 212592 - RNA, 64 nt, hsa
ucucgcagaaggucuggaagugcccagaaugggaggcacggaagccccucccggggaggacucc

SEQ ID NO: 212593 - RNA, 64 nt, hsa
cgaauguuguuacuggcacaaggccuaagggaugggcacggagcccaggcuguccuuuuugacc

SEQ ID NO: 212594 - RNA, 64 nt, hsa
gggugcacacgaauggcccgccuugaggggucauggcacggaauaugaaagccuccuccaccuc

SEQ ID NO: 212595 - RNA, 64 nt, hsa
ucauucucaacucuagcccugcacacucaccuguggcacggaaugaaaacagagcuucccgugc

SEQ ID NO: 212596 - RNA, 64 nt, hsa
gugucugcuggggcagcugugccccugaaucaugggcacggagggccgcccgccacgccccgcg

SEQ ID NO: 212597 - RNA, 64 nt, hsa
ggagcuccagguguccuaucuuucucagugggguggcacggagcggggccgccucccucuucuc

SEQ ID NO: 212598 - RNA, 64 nt, hsa
ucgugccucagccucccagguagcugguacuacaggcacggaccaccacgccuggcuaauuuuu

SEQ ID NO: 212599 - RNA, 64 nt, hsa
uccggaaaaaauaauaccugggggccaggcggggggcacggagccacuuccuguacagacccga

SEQ ID NO: 212600 - RNA, 56 nt, hsa
ccuucgucugcuccuucuaagccagcggcacggagacccugccagcagcucccucc

SEQ ID NO: 212601 - RNA, 57 nt, hsa
cuuguuguaauuucaacuaaaggcugaggcacggagaagaaaaggaaucagcaacug

SEQ ID NO: 212602 - RNA, 64 nt, hsa
augucuguccuagccaagaucauaugaagaguuuggcacggaggcugagaaugaccuggcauag

SEQ ID NO: 212603 - RNA, 64 nt, hsa
agacccacccacccccuggggcugcucagccucaggcacggacagggcacaugauaccaacugc

SEQ ID NO: 212604 - RNA, 64 nt, hsa
uuucaaguuugugguggcaacagcagcaggacagggcacggagggagcgagggagagaggaccg

SEQ ID NO: 212605 - RNA, 64 nt, hsa
cacccucuggcucagcggggcccagacccaccucggcacggacaccccugucuccaggaggggc

SEQ ID NO: 212606 - RNA, 64 nt, hsa
uggcacauccauguuaaggggcugaggcgucccuggcacggaaugcagagcccugagcuagggc

SEQ ID NO: 212607 - RNA, 64 nt, hsa
agaagugccaggauguccaucagccacucgccagggcacggagccgucaguccacuguuacggg

SEQ ID NO: 212608 - RNA, 64 nt, hsa
aaggcaugagaaagaauuugagacgcaccaugugggcacggagggggacggggcucagcaaugc

SEQ ID NO: 212609 - RNA, 64 nt, hsa
aaaauccuugccuucaaacgaaauggcucggccaggcacggaggcucgugcauguaauccuagc

SEQ ID NO: 212610 - RNA, 64 nt, hsa
uucacucugcagaggccgcccaggugcugggaauggcacggagcagagacucaggaacacuuga

SEQ ID NO: 212611 - RNA, 64 nt, hsa
gccucccgccgaggggcccagcccccaacccacaggcacggaggggcaucccucccugccggcc

SEQ ID NO: 212612 - RNA, 64 nt, hsa
guuuggaucugguaggacagggcucagagggcuaggcacggagggaaggucagaggagaaggca

SEQ ID NO: 212613 - RNA, 64 nt, hsa
agaacgccagggaccgccugcugccaagggcucaggcacggaccccuccccuucuagugcacgu

SEQ ID NO: 212614 - RNA, 64 nt, hsa
ccaugagcagacggccuguggucccugggccugaggcacggacucguagcaccaggguuuggag

SEQ ID NO: 212615 - RNA, 57 nt, hsa
accggaggguuguccucugacaggccuggcacggaggagggcccaccgagugguccc

SEQ ID NO: 212616 - RNA, 64 nt, hsa
gggagaccgagccggaggcugaggaaaggaagagggcacggaguugccaggagcaaaccaaagu

SEQ ID NO: 212617 - RNA, 64 nt, hsa
gagggggcacauguugggagacaccuaccaguguggcacggagagaacaaagcccauucaucca

SEQ ID NO: 212618 - RNA, 64 nt, hsa
ucagccaugcacaccuugagcagcgccggcaggaggcacggaaggaacugugcuccguucuccu

SEQ ID NO: 212619 - RNA, 64 nt, hsa
auauugaaccguuucugcacuaaucuucuccacgggcacggaguggagggaacgucuugggaaa

SEQ ID NO: 212620 - RNA, 64 nt, hsa
gcucggcccucagcccugccgcguggggcgcgugggcacggagcuuccugccucucugcuccga

SEQ ID NO: 212621 - RNA, 64 nt, hsa
ugggcagaggacgggguaaugugaggacgaagcgggcacggagccagauggccagucuccaggc

SEQ ID NO: 212622 - RNA, 64 nt, hsa
agauaacugaggaggggagaggugggccguaacgggcacggaucacgauguaaauuauuaagca

SEQ ID NO: 212623 - RNA, 64 nt, hsa
gaggcuucugaaagaugacugcguccuccucugcggcacggacgggagcaggugcagccacauc

SEQ ID NO: 212624 - RNA, 64 nt, hsa
gggagguugggaggggggacagaggggagacagaggcacggagagaaaggaauguuuagcacaa

SEQ ID NO: 212625 - RNA, 64 nt, hsa
ugauauaguacuuuauaaaagggagaucaggccaggcacggaggcucauguaaguaaucccagc

SEQ ID NO: 212626 - RNA, 64 nt, hsa
agccugagcucuccugcaagacagagccugauguggcacggagugggguugcgggggguggggg

SEQ ID NO: 212627 - RNA, 64 nt, hsa
uuuucuuuuuccauuuuggguuccuuuuguuucaggcacggauaacagcaaauggaauucugua

SEQ ID NO: 212628 - RNA, 64 nt, hsa
aaauuuggguuuuuaaguccucuaaacacacuugggcacggaaaugcaguacuguaaggaagag

SEQ ID NO: 212629 - RNA, 64 nt, hsa
uugcuuuccgaggugccacaaugcaaaugcuuaaggcacggagugugaaugugaagacacaagc

SEQ ID NO: 212630 - RNA, 64 nt, hsa
uuguccuggugcagugagggcagcccugcauccuggcacggacacugacucuuacagcaauaac

SEQ ID NO: 212631 - RNA, 60 nt, hsa
uccgcaggauccagcagugaacaggggugcggcacggaggagcgcaugcgugcuuaucug

SEQ ID NO: 212632 - RNA, 64 nt, hsa
ggggagguggugccccgcggaccccggggugccaggcacggaaggcgggacucugggagaagcg

SEQ ID NO: 212633 - RNA, 53 nt, hsa
cggucaugacuuuuuuaugauugggcacggagggauccagggcaucugugaac

SEQ ID NO: 212634 - RNA, 64 nt, hsa
cucacucuuacuucuagaaaaaagauccagcccaggcacggaaugggagggcccugcaaagcac

SEQ ID NO: 212635 - RNA, 64 nt, hsa
ccggaccccaagcccacggcucccucgacucuggggcacggaaccccgcccacucccaaucccc

SEQ ID NO: 212636 - RNA, 64 nt, hsa
cgacggcgccacguagccucccaucccuguccccggcacggauccggguaagguggcccggggc

SEQ ID NO: 212637 - RNA, 64 nt, hsa
ggugcauuguccugcuuucuugggacuuaccaaaggcacggaccccuccaccgacuccuucuag

SEQ ID NO: 212638 - RNA, 64 nt, hsa
gcccgaggggacacaggauggaaaccccaggaugagaagggagcagggagaguuccagaaaggg

SEQ ID NO: 212639 - RNA, 64 nt, hsa
guuucgcuuuucuguaaggauuaagcagauagggagaagggaaaaggggccucacuuuagaaug

SEQ ID NO: 212640 - RNA, 64 nt, hsa
gcugccagaaacccuguucuagaaggggcagcuaagaagggaggagccgaugaaucucuacagu

SEQ ID NO: 212641 - RNA, 64 nt, hsa
aaaaagucauuuggguccugggaagcacugggaaagaagggagagccggggaggauagggcagg

SEQ ID NO: 212642 - RNA, 64 nt, hsa
uuuagaguaaaaagccaaauuuaaauuauaagaaagaagggaaaaaagagaaaaacucaagucu

SEQ ID NO: 212643 - RNA, 64 nt, hsa
cccagaugugaaaugggagccuaccagcugguauagaagggaauggguaggaggcacugggugc

SEQ ID NO: 212644 - RNA, 64 nt, hsa
acagagaagggaagagaggaagaacgagaggaagagaagggaaggaaguguuuguguagaagag

SEQ ID NO: 212645 - RNA, 64 nt, hsa
augguuuucuuuuugaggcaaguuggaugaacagagaagggaagagaggaagaacgagaggaag

SEQ ID NO: 212646 - RNA, 64 nt, hsa
aaaaggaaugagaacuuugcaguuggaugaauagagaagggaaaaguugcuggagcacggagug

SEQ ID NO: 212647 - RNA, 64 nt, hsa
agcuguuagcaaggcccacugcugcuccugggugagaagggagcucuggagcaggaccagcugg

SEQ ID NO: 212648 - RNA, 64 nt, hsa
uagacacaguucaguuagagagacguauuuaaggagaagggaaggcaggauacccagaacuagc

SEQ ID NO: 212649 - RNA, 64 nt, hsa
uucagcaacauuuccaucauagaauuucagcguuagaagggaucuuagagguagauuauccagg

SEQ ID NO: 212650 - RNA, 64 nt, hsa
gcuuaggacuccaacagccacucugagggaggggagaagggagcagaggccacgcagaaugaac

SEQ ID NO: 212651 - RNA, 64 nt, hsa
agugcauuugugcacuucuguuuguuugucucaaagaagggacuguaacaaucugaguaauuuc

SEQ ID NO: 212652 - RNA, 64 nt, hsa
acggauucaaagacuuauuuugaaaguuggaaggagaagggagggaagagagcagaagggaaga

SEQ ID NO: 212653 - RNA, 64 nt, hsa
uugaaaguuggaaggagaagggagggaagagagcagaagggaagaagguguaagucaagcucuu

SEQ ID NO: 212654 - RNA, 64 nt, hsa
gugggaguacugcaaccugacgcgaugcucagacagaagggacuguggucgcuccuccgacugu

SEQ ID NO: 212655 - RNA, 64 nt, hsa
gggaguacugcaaccugacacgaugcucagacacagaagggacugcagucgugccucugacugu

SEQ ID NO: 212656 - RNA, 64 nt, hsa
cgauacccgugacucagcccuggacacugguccgagaagggacaugugggacgugagccgggcu

SEQ ID NO: 212657 - RNA, 64 nt, hsa
gccucuccaccagcccccuccucauuaaagggaaagaagggaauuugcaaguuuggugugguga

SEQ ID NO: 212658 - RNA, 64 nt, hsa
ucccuccccuucccacuccuuccggaguaagguuagaagggaaggaaggaaagaucaaggaacc

SEQ ID NO: 212659 - RNA, 64 nt, hsa
aggcucccauuaggaggaugagcugccuugacccagaagggaugagacgggcucuuaccucucu

SEQ ID NO: 212660 - RNA, 64 nt, hsa
guaguggccgauuugacuucagagugacagguagagaagggaagagcguguagaacuguggcca

SEQ ID NO: 212661 - RNA, 64 nt, hsa
auagcugguuagaaaaaugccacuguuuuuaucaagaagggaaauauauuugaaauauaaaaua

SEQ ID NO: 212662 - RNA, 64 nt, hsa
uauuuccaugacuucccuuguaaacagaagcaacagaagggacaagaggcuggccucuacauca

SEQ ID NO: 212663 - RNA, 64 nt, hsa
uucaaaaauauauucauguaccugugauccagcaagaagggaguuccagucaagagucacuaca

SEQ ID NO: 212664 - RNA, 64 nt, hsa
uaacucuuaguuuuuacuuguuuaauucuaaaagagaagggagcugaggccauucccuguagga

SEQ ID NO: 212665 - RNA, 64 nt, hsa
ugucuuuuaucauugcaggccaguggacagagggagaagggagaacaggggucgccaacacuug

SEQ ID NO: 212666 - RNA, 64 nt, hsa
guguuuccgguggguguaauaggggauuagccccagaagggacugagcuaaacaguguuauuau

SEQ ID NO: 212667 - RNA, 62 nt, hsa
ugggcccaaccucuccuuaaauaaccaugccaagaagggacauugucaccaagaaccaggau

SEQ ID NO: 212668 - RNA, 64 nt, hsa
aaaaagggacauuaaaauuaaaagcaaaaccacaagaagggaaagaccgcaacucggacagccc

SEQ ID NO: 212669 - RNA, 64 nt, hsa
ccagcacgcagccccuccagcuccacguggagacagaagggaucccggcacaucagugguaaca

SEQ ID NO: 212670 - RNA, 64 nt, hsa
caaguguccagaugccagaaccuucuuuuccucuagaagggauggugcuugguaaccuuaccuu

SEQ ID NO: 212671 - RNA, 64 nt, hsa
cuccccauggccccacugcagaauuaaagaaggaagaagggaaggcggaggagucuauaagaag

SEQ ID NO: 212672 - RNA, 64 nt, hsa
caguggcaaaaccuaggaaggcucauguucccagagaagggaccacaugagccuucucccaugc

SEQ ID NO: 212673 - RNA, 64 nt, hsa
ggcucggcaggucugcagcucagcuccuggaaggagaagggaggaacugggccuggggcuggag

SEQ ID NO: 212674 - RNA, 64 nt, hsa
aguguagcugcugugagcccacugccacugccucagaagggagccacugugaaccucucgagug

SEQ ID NO: 212675 - RNA, 64 nt, hsa
uggagccucaucuccaugucaagcaggaggguaaagaagggaacuaagagcaggucuuucaagc

SEQ ID NO: 212676 - RNA, 64 nt, hsa
aagcagagaaguagcaccauuauccccauuuaacagaagggaaacugaggcucggcaagcauag

SEQ ID NO: 212677 - RNA, 64 nt, hsa
gaaagggggaaugccccucccaggaguuuaugggagaagggacugggccggcugccucccagcg

SEQ ID NO: 212678 - RNA, 64 nt, hsa
aaaccccauuuugcagagaggaaaacugaggccuagaagggaggagugguccacccacgguccc

SEQ ID NO: 212679 - RNA, 64 nt, hsa
accagggauuaggcuguaggggggugagaaggagagaagggaccaccccauucuucucaagcaa

SEQ ID NO: 212680 - RNA, 64 nt, hsa
acacgggcagcugguugcucauaggguccuucucuagggagaaaccauuguuaauucaaauaag

SEQ ID NO: 212681 - RNA, 64 nt, hsa
uucacuacagaaagaacuagguggugucuacugcuagggagauuauaugaaggccaaaauaaug

SEQ ID NO: 212682 - RNA, 64 nt, hsa
guauuguguaacaaguacugcucccagcagcaauuagggagaaaacuagucuaaauuauuucaa

SEQ ID NO: 212683 - RNA, 64 nt, hsa
agguuacaccacuccuucguccuuacaggagauguagggagaagaaucugcaggcugcuuguag

SEQ ID NO: 212684 - RNA, 64 nt, hsa
agugacgggaaccuugaggaggaaacgccuguguuagggagagagugggugcgguguagaggau

SEQ ID NO: 212685 - RNA, 64 nt, hsa
ccuccguaaacucaggaagugucaggugauuuccuagggagagguucccagucccagcaggcag

SEQ ID NO: 212686 - RNA, 64 nt, hsa
uuagcccaggaguuaaagaccagccugggcaacauagggagacccugucuuuuuuuugggcagc

SEQ ID NO: 212687 - RNA, 64 nt, hsa
guuguuaaaaguagggacucugccuuuuuguugguagggagaaaaaacgcuauugcuuugucuu

SEQ ID NO: 212688 - RNA, 64 nt, hsa
cggagccgcacucuuuagccccggagcuccaggcccagcggaugcuggcacccaagcgcagcug

SEQ ID NO: 212689 - RNA, 64 nt, hsa
gcuccugcagccggcccugcagcgcuacuuucugccagcggacgcggacccugacaccuacagc

SEQ ID NO: 212690 - RNA, 64 nt, hsa
agguucacauguacagguaaguauauuguguauuucuguucauuuucuguucauagaguuguau

SEQ ID NO: 212691 - RNA, 64 nt, hsa
uacagguaaguauauuguguauuucuguucauuuucuguucauagaguuguauaauaaaacaug

SEQ ID NO: 212692 - RNA, 64 nt, hsa
ggaugacucagagcgucugucuuuguauuucugcucuguucauucugucccacuuucuucauag

SEQ ID NO: 212693 - RNA, 64 nt, hsa
gcguguguguguguguguacgugaccacguucuaucuguucauuugucuggguauagucacucc

SEQ ID NO: 212694 - RNA, 64 nt, hsa
aauucacuguaaaacauucagggguccuaccauuucuguucaggaaaucuuguaguuuauuguu

SEQ ID NO: 212695 - RNA, 64 nt, hsa
uguuuuaaauuuaguuaaaacuuaaccguagaagucuguucaaacgcgaaaggucuugcuuugu

SEQ ID NO: 212696 - RNA, 64 nt, hsa
aaugaucaaaagugagcuggcaaccuuugaccuuucuguucaaggugaguagcuuccaagguag

SEQ ID NO: 212697 - RNA, 64 nt, hsa
caguguuggcaaggaggacucugaagaugcacucucuguucaguuugacaugaaauuggcugau

SEQ ID NO: 212698 - RNA, 64 nt, hsa
uggaaacggaagauggaauacaucaaagugaauuucuguucaaguuuucccagauuaucauucu

SEQ ID NO: 212699 - RNA, 64 nt, hsa
aucauuuguuucuuuugacucaaauuguauugcuucuguucagaugaucuuucauucaaugugu

SEQ ID NO: 212700 - RNA, 64 nt, hsa
cccuggggaauugggaggaaccaagcccucuucaucuguucaugugcccagcauuuauuaagca

SEQ ID NO: 212701 - RNA, 64 nt, hsa
ucagguguggucccugccugcuugaugaaguugcucuguucaagccuuuggugggaucaugugu

SEQ ID NO: 212702 - RNA, 64 nt, hsa
uccauguagccuuuaauaugcuggguuaucaaauucuguucacugaguuaugaccagauaaaua

SEQ ID NO: 212703 - RNA, 64 nt, hsa
ucaugauuaaggauuguugcuguuuuauaguuacucuguucaucacaguguaaauggugaugcg

SEQ ID NO: 212704 - RNA, 64 nt, hsa; identical to SEQ ID NO: 111122

SEQ ID NO: 212705 - RNA, 64 nt, hsa; identical to SEQ ID NO: 111123

SEQ ID NO: 212706 - RNA, 64 nt, hsa; identical to SEQ ID NO: 111124

SEQ ID NO: 212707 - RNA, 64 nt, hsa; identical to SEQ ID NO: 111125

SEQ ID NO: 212708 - RNA, 64 nt, hsa; identical to SEQ ID NO: 111126

SEQ ID NO: 212709 - RNA, 64 nt, hsa; identical to SEQ ID NO: 111127

SEQ ID NO: 212710 - RNA, 64 nt, hsa; identical to SEQ ID NO: 111128

SEQ ID NO: 212711 - RNA, 64 nt, hsa; identical to SEQ ID NO: 111129

SEQ ID NO: 212712 - RNA, 64 nt, hsa; identical to SEQ ID NO: 111130

SEQ ID NO: 212713 - RNA, 64 nt, hsa; identical to SEQ ID NO: 111131

SEQ ID NO: 212714 - RNA, 64 nt, hsa; identical to SEQ ID NO: 111132

SEQ ID NO: 212715 - RNA, 64 nt, hsa; identical to SEQ ID NO: 111133

SEQ ID NO: 212716 - RNA, 64 nt, hsa; identical to SEQ ID NO: 111134

SEQ ID NO: 212717 - RNA, 64 nt, hsa; identical to SEQ ID NO: 111135

SEQ ID NO: 212718 - RNA, 64 nt, hsa; identical to SEQ ID NO: 111136

SEQ ID NO: 212719 - RNA, 64 nt, hsa; identical to SEQ ID NO: 111137

SEQ ID NO: 212720 - RNA, 64 nt, hsa; identical to SEQ ID NO: 111138

SEQ ID NO: 212721 - RNA, 64 nt, hsa; identical to SEQ ID NO: 111139

SEQ ID NO: 212722 - RNA, 64 nt, hsa; identical to SEQ ID NO: 111140

SEQ ID NO: 212723 - RNA, 64 nt, hsa; identical to SEQ ID NO: 111141

SEQ ID NO: 212724 - RNA, 64 nt, hsa; identical to SEQ ID NO: 111142

SEQ ID NO: 212725 - RNA, 64 nt, hsa; identical to SEQ ID NO: 111143

SEQ ID NO: 212726 - RNA, 64 nt, hsa; identical to SEQ ID NO: 111144

SEQ ID NO: 212727 - RNA, 64 nt, hsa; identical to SEQ ID NO: 111145

SEQ ID NO: 212728 - RNA, 64 nt, hsa; identical to SEQ ID NO: 111146

SEQ ID NO: 212729 - RNA, 64 nt, hsa; identical to SEQ ID NO: 111147

SEQ ID NO: 212730 - RNA, 64 nt, hsa; identical to SEQ ID NO: 111148

SEQ ID NO: 212731 - RNA, 64 nt, hsa; identical to SEQ ID NO: 111149

SEQ ID NO: 212732 - RNA, 64 nt, hsa; identical to SEQ ID NO: 111150

SEQ ID NO: 212733 - RNA, 64 nt, hsa; identical to SEQ ID NO: 111151

SEQ ID NO: 212734 - RNA, 64 nt, hsa; identical to SEQ ID NO: 111152

SEQ ID NO: 212735 - RNA, 64 nt, hsa; identical to SEQ ID NO: 111153

SEQ ID NO: 212736 - RNA, 64 nt, hsa; identical to SEQ ID NO: 111154

SEQ ID NO: 212737 - RNA, 64 nt, hsa; identical to SEQ ID NO: 111155

SEQ ID NO: 212738 - RNA, 64 nt, hsa; identical to SEQ ID NO: 111156

SEQ ID NO: 212739 - RNA, 64 nt, hsa; identical to SEQ ID NO: 111157

SEQ ID NO: 212740 - RNA, 64 nt, hsa; identical to SEQ ID NO: 111158

SEQ ID NO: 212741 - RNA, 64 nt, hsa; identical to SEQ ID NO: 111159

SEQ ID NO: 212742 - RNA, 64 nt, hsa; identical to SEQ ID NO: 111160

SEQ ID NO: 212743 - RNA, 64 nt, hsa; identical to SEQ ID NO: 111161

SEQ ID NO: 212744 - RNA, 64 nt, hsa; identical to SEQ ID NO: 111162

SEQ ID NO: 212745 - RNA, 64 nt, hsa; identical to SEQ ID NO: 111163

SEQ ID NO: 212746 - RNA, 64 nt, hsa; identical to SEQ ID NO: 111164

SEQ ID NO: 212747 - RNA, 64 nt, hsa; identical to SEQ ID NO: 111165

SEQ ID NO: 212748 - RNA, 64 nt, hsa; identical to SEQ ID NO: 111166

SEQ ID NO: 212749 - RNA, 64 nt, hsa; identical to SEQ ID NO: 111167

SEQ ID NO: 212750 - RNA, 64 nt, hsa; identical to SEQ ID NO: 111168

SEQ ID NO: 212751 - RNA, 64 nt, hsa; identical to SEQ ID NO: 111169

SEQ ID NO: 212752 - RNA, 64 nt, hsa; identical to SEQ ID NO: 111170

SEQ ID NO: 212753 - RNA, 64 nt, hsa; identical to SEQ ID NO: 111171

SEQ ID NO: 212754 - RNA, 64 nt, hsa; identical to SEQ ID NO: 111172

SEQ ID NO: 212755 - RNA, 64 nt, hsa; identical to SEQ ID NO: 111173

SEQ ID NO: 212756 - RNA, 64 nt, hsa; identical to SEQ ID NO: 111174

SEQ ID NO: 212757 - RNA, 64 nt, hsa; identical to SEQ ID NO: 111175

SEQ ID NO: 212758 - RNA, 64 nt, hsa; identical to SEQ ID NO: 111176

SEQ ID NO: 212759 - RNA, 64 nt, hsa; identical to SEQ ID NO: 111177

SEQ ID NO: 212760 - RNA, 64 nt, hsa; identical to SEQ ID NO: 111178

SEQ ID NO: 212761 - RNA, 64 nt, hsa; identical to SEQ ID NO: 111179

SEQ ID NO: 212762 - RNA, 64 nt, hsa; identical to SEQ ID NO: 111180

SEQ ID NO: 212763 - RNA, 64 nt, hsa; identical to SEQ ID NO: 111181

SEQ ID NO: 212764 - RNA, 64 nt, hsa; identical to SEQ ID NO: 111182

SEQ ID NO: 212765 - RNA, 64 nt, hsa; identical to SEQ ID NO: 111183

SEQ ID NO: 212766 - RNA, 64 nt, hsa; identical to SEQ ID NO: 111184

SEQ ID NO: 212767 - RNA, 64 nt, hsa; identical to SEQ ID NO: 111185

SEQ ID NO: 212768 - RNA, 64 nt, hsa; identical to SEQ ID NO: 111186

SEQ ID NO: 212769 - RNA, 64 nt, hsa; identical to SEQ ID NO: 111187

SEQ ID NO: 212770 - RNA, 64 nt, hsa; identical to SEQ ID NO: 111188

SEQ ID NO: 212771 - RNA, 64 nt, hsa; identical to SEQ ID NO: 111189

SEQ ID NO: 212772 - RNA, 64 nt, hsa; identical to SEQ ID NO: 111190

SEQ ID NO: 212773 - RNA, 64 nt, hsa; identical to SEQ ID NO: 111191

SEQ ID NO: 212774 - RNA, 64 nt, hsa; identical to SEQ ID NO: 111192

SEQ ID NO: 212775 - RNA, 64 nt, hsa; identical to SEQ ID NO: 111193

SEQ ID NO: 212776 - RNA, 64 nt, hsa; identical to SEQ ID NO: 111194

SEQ ID NO: 212777 - RNA, 64 nt, hsa; identical to SEQ ID NO: 111195

SEQ ID NO: 212778 - RNA, 64 nt, hsa; identical to SEQ ID NO: 111196

SEQ ID NO: 212779 - RNA, 64 nt, hsa; identical to SEQ ID NO: 111197

SEQ ID NO: 212780 - RNA, 64 nt, hsa; identical to SEQ ID NO: 111198

SEQ ID NO: 212781 - RNA, 64 nt, hsa; identical to SEQ ID NO: 111199

SEQ ID NO: 212782 - RNA, 64 nt, hsa; identical to SEQ ID NO: 111200

SEQ ID NO: 212783 - RNA, 64 nt, hsa; identical to SEQ ID NO: 111201

SEQ ID NO: 212784 - RNA, 64 nt, hsa; identical to SEQ ID NO: 111202

SEQ ID NO: 212785 - RNA, 64 nt, hsa; identical to SEQ ID NO: 111203

SEQ ID NO: 212786 - RNA, 64 nt, hsa; identical to SEQ ID NO: 111204

SEQ ID NO: 212787 - RNA, 64 nt, hsa; identical to SEQ ID NO: 111205

SEQ ID NO: 212788 - RNA, 64 nt, hsa; identical to SEQ ID NO: 111206

SEQ ID NO: 212789 - RNA, 64 nt, hsa; identical to SEQ ID NO: 111207

SEQ ID NO: 212790 - RNA, 64 nt, hsa; identical to SEQ ID NO: 111208

SEQ ID NO: 212791 - RNA, 64 nt, hsa; identical to SEQ ID NO: 111209

SEQ ID NO: 212792 - RNA, 64 nt, hsa; identical to SEQ ID NO: 111210

SEQ ID NO: 212793 - RNA, 64 nt, hsa; identical to SEQ ID NO: 111211

SEQ ID NO: 212794 - RNA, 64 nt, hsa; identical to SEQ ID NO: 111212

SEQ ID NO: 212795 - RNA, 64 nt, hsa; identical to SEQ ID NO: 111213

SEQ ID NO: 212796 - RNA, 64 nt, hsa; identical to SEQ ID NO: 111214

SEQ ID NO: 212797 - RNA, 64 nt, hsa; identical to SEQ ID NO: 111215

SEQ ID NO: 212798 - RNA, 64 nt, hsa; identical to SEQ ID NO: 111216

SEQ ID NO: 212799 - RNA, 64 nt, hsa; identical to SEQ ID NO: 111217

SEQ ID NO: 212800 - RNA, 64 nt, hsa; identical to SEQ ID NO: 111218

SEQ ID NO: 212801 - RNA, 64 nt, hsa; identical to SEQ ID NO: 111219

SEQ ID NO: 212802 - RNA, 64 nt, hsa; identical to SEQ ID NO: 111220

SEQ ID NO: 212803 - RNA, 64 nt, hsa; identical to SEQ ID NO: 111221

SEQ ID NO: 212804 - RNA, 64 nt, hsa; identical to SEQ ID NO: 111222

SEQ ID NO: 212805 - RNA, 64 nt, hsa; identical to SEQ ID NO: 111223

SEQ ID NO: 212806 - RNA, 64 nt, hsa; identical to SEQ ID NO: 111224

SEQ ID NO: 212807 - RNA, 64 nt, hsa; identical to SEQ ID NO: 111225

SEQ ID NO: 212808 - RNA, 64 nt, hsa; identical to SEQ ID NO: 111226

SEQ ID NO: 212809 - RNA, 64 nt, hsa; identical to SEQ ID NO: 111227

SEQ ID NO: 212810 - RNA, 64 nt, hsa; identical to SEQ ID NO: 111228

SEQ ID NO: 212811 - RNA, 64 nt, hsa; identical to SEQ ID NO: 111229

SEQ ID NO: 212812 - RNA, 64 nt, hsa; identical to SEQ ID NO: 111230

SEQ ID NO: 212813 - RNA, 64 nt, hsa; identical to SEQ ID NO: 111231

SEQ ID NO: 212814 - RNA, 64 nt, hsa; identical to SEQ ID NO: 111232

SEQ ID NO: 212815 - RNA, 64 nt, hsa; identical to SEQ ID NO: 111233

SEQ ID NO: 212816 - RNA, 64 nt, hsa; identical to SEQ ID NO: 111234

SEQ ID NO: 212817 - RNA, 64 nt, hsa; identical to SEQ ID NO: 111235

SEQ ID NO: 212818 - RNA, 64 nt, hsa; identical to SEQ ID NO: 111236

SEQ ID NO: 212819 - RNA, 64 nt, hsa; identical to SEQ ID NO: 111237

SEQ ID NO: 212820 - RNA, 64 nt, hsa; identical to SEQ ID NO: 111238

SEQ ID NO: 212821 - RNA, 64 nt, hsa; identical to SEQ ID NO: 111239

SEQ ID NO: 212822 - RNA, 64 nt, hsa; identical to SEQ ID NO: 111240

SEQ ID NO: 212823 - RNA, 64 nt, hsa; identical to SEQ ID NO: 111241

SEQ ID NO: 212824 - RNA, 64 nt, hsa; identical to SEQ ID NO: 111242

SEQ ID NO: 212825 - RNA, 64 nt, hsa; identical to SEQ ID NO: 111243

SEQ ID NO: 212826 - RNA, 64 nt, hsa; identical to SEQ ID NO: 111244

SEQ ID NO: 212827 - RNA, 64 nt, hsa; identical to SEQ ID NO: 111245

SEQ ID NO: 212828 - RNA, 64 nt, hsa; identical to SEQ ID NO: 111246

SEQ ID NO: 212829 - RNA, 64 nt, hsa; identical to SEQ ID NO: 111247

SEQ ID NO: 212830 - RNA, 64 nt, hsa; identical to SEQ ID NO: 111248

SEQ ID NO: 212831 - RNA, 64 nt, hsa; identical to SEQ ID NO: 111249

SEQ ID NO: 212832 - RNA, 64 nt, hsa; identical to SEQ ID NO: 111250

SEQ ID NO: 212833 - RNA, 64 nt, hsa; identical to SEQ ID NO: 111251

SEQ ID NO: 212834 - RNA, 64 nt, hsa; identical to SEQ ID NO: 111252

SEQ ID NO: 212835 - RNA, 64 nt, hsa; identical to SEQ ID NO: 111253

SEQ ID NO: 212836 - RNA, 64 nt, hsa; identical to SEQ ID NO: 111254

SEQ ID NO: 212837 - RNA, 64 nt, hsa; identical to SEQ ID NO: 111255

SEQ ID NO: 212838 - RNA, 64 nt, hsa; identical to SEQ ID NO: 111256

SEQ ID NO: 212839 - RNA, 64 nt, hsa; identical to SEQ ID NO: 111257

SEQ ID NO: 212840 - RNA, 64 nt, hsa; identical to SEQ ID NO: 111258

SEQ ID NO: 212841 - RNA, 64 nt, hsa; identical to SEQ ID NO: 111259

SEQ ID NO: 212842 - RNA, 64 nt, hsa; identical to SEQ ID NO: 111260

SEQ ID NO: 212843 - RNA, 64 nt, hsa; identical to SEQ ID NO: 111261

SEQ ID NO: 212844 - RNA, 64 nt, hsa; identical to SEQ ID NO: 111262

SEQ ID NO: 212845 - RNA, 64 nt, hsa; identical to SEQ ID NO: 111263

SEQ ID NO: 212846 - RNA, 64 nt, hsa; identical to SEQ ID NO: 111264

SEQ ID NO: 212847 - RNA, 64 nt, hsa; identical to SEQ ID NO: 111265

SEQ ID NO: 212848 - RNA, 64 nt, hsa; identical to SEQ ID NO: 111266

SEQ ID NO: 212849 - RNA, 64 nt, hsa; identical to SEQ ID NO: 111267

SEQ ID NO: 212850 - RNA, 64 nt, hsa; identical to SEQ ID NO: 111268

SEQ ID NO: 212851 - RNA, 64 nt, hsa; identical to SEQ ID NO: 111269

SEQ ID NO: 212852 - RNA, 64 nt, hsa; identical to SEQ ID NO: 111270

SEQ ID NO: 212853 - RNA, 64 nt, hsa; identical to SEQ ID NO: 111271

SEQ ID NO: 212854 - RNA, 64 nt, hsa; identical to SEQ ID NO: 111272

SEQ ID NO: 212855 - RNA, 64 nt, hsa; identical to SEQ ID NO: 111273

SEQ ID NO: 212856 - RNA, 64 nt, hsa; identical to SEQ ID NO: 111274

SEQ ID NO: 212857 - RNA, 64 nt, hsa; identical to SEQ ID NO: 111275

SEQ ID NO: 212858 - RNA, 64 nt, hsa; identical to SEQ ID NO: 111276

SEQ ID NO: 212859 - RNA, 64 nt, hsa; identical to SEQ ID NO: 111277

SEQ ID NO: 212860 - RNA, 64 nt, hsa; identical to SEQ ID NO: 111278

SEQ ID NO: 212861 - RNA, 64 nt, hsa; identical to SEQ ID NO: 111279

SEQ ID NO: 212862 - RNA, 64 nt, hsa; identical to SEQ ID NO: 111280

SEQ ID NO: 212863 - RNA, 64 nt, hsa; identical to SEQ ID NO: 111281

SEQ ID NO: 212864 - RNA, 64 nt, hsa; identical to SEQ ID NO: 111282

SEQ ID NO: 212865 - RNA, 64 nt, hsa; identical to SEQ ID NO: 111283

SEQ ID NO: 212866 - RNA, 64 nt, hsa; identical to SEQ ID NO: 111284

SEQ ID NO: 212867 - RNA, 64 nt, hsa; identical to SEQ ID NO: 111285

SEQ ID NO: 212868 - RNA, 64 nt, hsa; identical to SEQ ID NO: 111286

SEQ ID NO: 212869 - RNA, 64 nt, hsa; identical to SEQ ID NO: 111287

SEQ ID NO: 212870 - RNA, 64 nt, hsa; identical to SEQ ID NO: 111288

SEQ ID NO: 212871 - RNA, 64 nt, hsa; identical to SEQ ID NO: 111289

SEQ ID NO: 212872 - RNA, 64 nt, hsa; identical to SEQ ID NO: 111290

SEQ ID NO: 212873 - RNA, 64 nt, hsa; identical to SEQ ID NO: 111291

SEQ ID NO: 212874 - RNA, 64 nt, hsa; identical to SEQ ID NO: 111292

SEQ ID NO: 212875 - RNA, 64 nt, hsa; identical to SEQ ID NO: 111293

SEQ ID NO: 212876 - RNA, 64 nt, hsa; identical to SEQ ID NO: 111294

SEQ ID NO: 212877 - RNA, 64 nt, hsa; identical to SEQ ID NO: 111295

SEQ ID NO: 212878 - RNA, 64 nt, hsa; identical to SEQ ID NO: 111296

SEQ ID NO: 212879 - RNA, 64 nt, hsa; identical to SEQ ID NO: 111297

SEQ ID NO: 212880 - RNA, 64 nt, hsa; identical to SEQ ID NO: 111298

SEQ ID NO: 212881 - RNA, 64 nt, hsa; identical to SEQ ID NO: 111299

SEQ ID NO: 212882 - RNA, 64 nt, hsa; identical to SEQ ID NO: 111300

SEQ ID NO: 212883 - RNA, 64 nt, hsa; identical to SEQ ID NO: 111301

SEQ ID NO: 212884 - RNA, 64 nt, hsa; identical to SEQ ID NO: 111302

SEQ ID NO: 212885 - RNA, 64 nt, hsa; identical to SEQ ID NO: 111303

SEQ ID NO: 212886 - RNA, 64 nt, hsa; identical to SEQ ID NO: 111304

SEQ ID NO: 212887 - RNA, 64 nt, hsa
cacggccccugccguggggcucacucugcagcuggagagacagcauaccugaaaccugcaagga

SEQ ID NO: 212888 - RNA, 64 nt, hsa
uaaaacaacagaacagccaggaaaauggugcuaggagagacaguggagaggccagagaagcaaa

SEQ ID NO: 212889 - RNA, 64 nt, hsa
ugaaauuucuaccaagcguuuucauggaugcuaugagagacaauccugaagcugcuguacauau

SEQ ID NO: 212890 - RNA, 64 nt, hsa
aggcgaccuuggcuaucagacuugaaauauucacgagagacaauaaacgcugaaaggccagugc

SEQ ID NO: 212891 - RNA, 64 nt, hsa
cauacuuauuaaguucgaacauguuucacuuaaggagagacaccuagcuuagucauggcaaguu

SEQ ID NO: 212892 - RNA, 64 nt, hsa
aggaauauaaauauuugguaauucuguguaacaagagagacauggaaaaggaaaaaaauccacu

SEQ ID NO: 212893 - RNA, 64 nt, hsa
gguugagagacacagcugcuacgugauagauguugagagacagaagccaacgaaggaggucauu

SEQ ID NO: 212894 - RNA, 64 nt, hsa
ucucacugccuccagagaggugggugccuggguugagagacacagcugcuacgugauagauguu

SEQ ID NO: 212895 - RNA, 64 nt, hsa
gaagguuuauggauuugacagggugcaugucacagagagacaguucucagucagcacuuccugu

SEQ ID NO: 212896 - RNA, 64 nt, hsa
uuuccaagaaugugaaucuugccaagcuguccgugagagacacgggcuccccucgagggagacu

SEQ ID NO: 212897 - RNA, 64 nt, hsa
uccuugcugcaggccggguggccaauccaggugggagagacacucccagggacaagggaaggaa

SEQ ID NO: 212898 - RNA, 64 nt, hsa
auuaccugccacuuccaggagcccagagggccaagagagacauugccuccaccucuccuuggaa

SEQ ID NO: 212899 - RNA, 64 nt, hsa
aucucaaauaggcuugguggccuguggaaaagaagagagacagagagacagugucugaaacagg

SEQ ID NO: 212900 - RNA, 64 nt, hsa
uaggcuugguggccuguggaaaagaagagagacagagagacagugucugaaacaggauggcaga

SEQ ID NO: 212901 - RNA, 64 nt, hsa
guguguguguguguguguguaugagagagagagagagagacaacagagacagagagaggcagag

SEQ ID NO: 212902 - RNA, 64 nt, hsa
agacaacagagacagagagaggcagagaggcauagagagacagagagagagacaagaaacagag

SEQ ID NO: 212903 - RNA, 64 nt, hsa
cagagagaggcagagaggcauagagagacagagagagagacaagaaacagagauagacagaaaa

SEQ ID NO: 212904 - RNA, 64 nt, hsa
acuccggagugagaagcuuugcccuccuaagagagagagacagagagacagagagagagaaaga

SEQ ID NO: 212905 - RNA, 64 nt, hsa
gugagaagcuuugcccuccuaagagagagagacagagagacagagagagagaaagagagagugu

SEQ ID NO: 212906 - RNA, 64 nt, hsa
cagagagggagagaggcagagagggagagaggcagagagacagagagggagagagggacagaga

SEQ ID NO: 212907 - RNA, 64 nt, hsa
aggagacagagagggagagagagacagagggagagagagacagaggggaagagaggcagagagg

SEQ ID NO: 212908 - RNA, 64 nt, hsa
agagggagagaaacagaggagacagagagggagagagagacagagggagagagagacagagggg

SEQ ID NO: 212909 - RNA, 64 nt, hsa
agagguggggagaggggagagagauaugaggagagagagacagaggaggcagagagggagagaa

SEQ ID NO: 212910 - RNA, 64 nt, hsa
ucuuguuccagugacaguuggaaggccucugcuggagagacaccagcucucagggcagagauug

SEQ ID NO: 212911 - RNA, 64 nt, hsa
aauauguccucaggccagauacugauugcuaguagagagacacccggcacccaguccgaagccc

SEQ ID NO: 212912 - RNA, 64 nt, hsa
caacggggaaagaccugacagcuaguuacauacgcucugacauaguacucccaugauggcuucc

SEQ ID NO: 212913 - RNA, 64 nt, hsa
gaccauccaaauggaaauuccccuuucuuggugucucugacaaaugguccuuugccuuaucuug

SEQ ID NO: 212914 - RNA, 64 nt, hsa
guguguuggaucuacuaacauguuuagcaaauggcucugacaggguggccaugagcagaugaga

SEQ ID NO: 212915 - RNA, 64 nt, hsa
gcaaguagaauaguuucugagucuguguugcagccucugacacguggcucaccgcugucauuug

SEQ ID NO: 212916 - RNA, 64 nt, hsa
ugcuggcaccaaauauuaggauuacaagcugucucucugacaccagugguaaaaaagcaaguag

SEQ ID NO: 212917 - RNA, 64 nt, hsa
cuccccagcaccaccucauacuaagaauuccucacucugacaugacaguauuuuuucugaccag

SEQ ID NO: 212918 - RNA, 64 nt, hsa
uuuaaggucuagauaggguuugcuauaggguuugcucugacaauuuuuaaagcuuuuggauugu

SEQ ID NO: 212919 - RNA, 64 nt, hsa
auagcauguaacuucuccuauaucucuacuguccagcauguauuguuccaaauaugacucccua

SEQ ID NO: 212920 - RNA, 64 nt, hsa
ugcagauuuauggauauuaucaaugagaagacauagcauguaacuucuccuauaucucuacugu

SEQ ID NO: 212921 - RNA, 64 nt, hsa
cuauuuuaugcaaauauuuuuuuguagaugaaaaagcauguacaguguucuguuuaauacucau

SEQ ID NO: 212922 - RNA, 64 nt, hsa
augaaugugugugguuuuuuuucuaaaacuaaauagcauguauugugucuuuugcaugaugauc

SEQ ID NO: 212923 - RNA, 64 nt, hsa
uaagguguugaaagagugcaggggguugggaggaagcauguaagagagggaacauuuccuuaga

SEQ ID NO: 212924 - RNA, 64 nt, hsa
ccucagagguaggcaaguuugcuucuagggaguuagcauguagaugggauauugggaugaggaa

SEQ ID NO: 212925 - RNA, 64 nt, hsa
gagguuaacaucauccaugauaagcccuuuugauagcauguauccuugauagcaucacaucaua

SEQ ID NO: 212926 - RNA, 64 nt, hsa
uuaaaugaauuagugaauguaagauacuuuagaaagcauguaaaguacuagaaacaaugaggug

SEQ ID NO: 212927 - RNA, 64 nt, hsa
ucuuucaugagggagucaauauguaguggaaagaagcauguagcaaaaaagacaaccuugaucu

SEQ ID NO: 212928 - RNA, 64 nt, hsa
caaaaaaagcagaacccacuggaguagaaaaggaagcauguagcauauacucaguagugaaauu

SEQ ID NO: 212929 - RNA, 64 nt, hsa
gccugagugcuggccucugucaacccuuauuccacugccuuauuugacaagggguuacaugcug

SEQ ID NO: 212930 - RNA, 64 nt, hsa
gcuuucuuuggaaaccaggauggaaacuucuucccugccuuaccuuccuuucacuccauucauu

SEQ ID NO: 212931 - RNA, 64 nt, hsa
aaucccauuagagguacuuuuuuuugauggcaugcugccuuaaaagagccauuuauuuuuagag

SEQ ID NO: 212932 - RNA, 64 nt, hsa
auaccauguauaauuuucuacaaccuaagauguucugccuuaucggggcgaaccuuuuaggauu

SEQ ID NO: 212933 - RNA, 64 nt, hsa
cgacuccauccuuuuucagggguuauuuaaaaaucugccuuagauucuauagugaagacaagca

SEQ ID NO: 212934 - RNA, 64 nt, hsa
uucuucucauaggaaugcuagaggaaagagaacacugccuuacagucaccucauguugcagacc

SEQ ID NO: 212935 - RNA, 64 nt, hsa
ccugaaccacgccccagacuuccgccgggucuaccugccuuaugucaccaaccagaccuaucag

SEQ ID NO: 212936 - RNA, 64 nt, hsa
ccauuggggccugagccaaggaacuuuccuucuacugccuuauagugcuuaaacauucuccgcc

SEQ ID NO: 212937 - RNA, 64 nt, hsa
cauaaccuccgccucccagguucaagcaauucuccugccuuagccuccugaguagcugggauua

SEQ ID NO: 212938 - RNA, 64 nt, hsa
uagaaggauuuaaauaaguaaaagcuacuauguacugccuuagugcugaugccuguguacugcc

SEQ ID NO: 212939 - RNA, 64 nt, hsa
uacuauguacugccuuagugcugaugccuguguacugccuuaaauguaccuauggcaauuuagc

SEQ ID NO: 212940 - RNA, 64 nt, hsa
guuuucaucaaugucuuuguaaagcacaaauuaucugccuuaaaggggcucugggucggggaau

SEQ ID NO: 212941 - RNA, 64 nt, hsa
agggacccugccuacaccucauuuccagugugggcugccuuaguuaguuaugagaacagggaag

SEQ ID NO: 212942 - RNA, 64 nt, hsa
ucuugaaauuccuaguuuaauucgccuugauguucugccuuauaaaugcacaaugauuuguacu

SEQ ID NO: 212943 - RNA, 64 nt, hsa
gcccuuagucuucauuuaugaagugaauuauuaccugccuuagcuuugccaaagcaacggccac

SEQ ID NO: 212944 - RNA, 64 nt, hsa
ugcagccucuaccucccagguucaagugauuauccugccuuagccuccugaguagcugggauua

SEQ ID NO: 212945 - RNA, 64 nt, hsa
uaacaaagaaguaaccuuauaacugcucucuagucugccuuauuugugucauagaguaagauau

SEQ ID NO: 212946 - RNA, 64 nt, hsa
gaccauaucuccagggauguuguugauccccacacugccuuaagguauauuauagaaacaguuu

SEQ ID NO: 212947 - RNA, 64 nt, hsa
cuccuccagugagccccauauuuugggaaauuaucugccuuauacauuaacuaauucaauucau

SEQ ID NO: 212948 - RNA, 64 nt, hsa
gcaaaagcuuuacaaauggaaaccaugcaauuaccugccuuaguucuuuugucauaaaaacaau

SEQ ID NO: 212949 - RNA, 64 nt, hsa
guauuagacauacuguuuuuauaauguuuuacuucugccuuaagauuuagguuuuuuaaaugua

SEQ ID NO: 212950 - RNA, 64 nt, hsa
uuuaacagaaacauuugaaauagaauuugcaugucugccuuaauuaacuuaaagacugauuuua

SEQ ID NO: 212951 - RNA, 64 nt, hsa
uuuuuuuuuuuuacucccccucuaaacacugcugcugccuuaauuuuagaaagcagcuuacuag

SEQ ID NO: 212952 - RNA, 64 nt, hsa
aaauaaagguaacuuuaccuuucuuaaauauuuccugccuuaaagagagcauuuccaugacuuu

SEQ ID NO: 212953 - RNA, 64 nt, hsa
cgcuuugcaucuaucaguaaauaaaauucuucagcugccuuauuaggagugcuaugaggguaac

SEQ ID NO: 212954 - RNA, 64 nt, hsa
cuuaauuccucaggcuuugcgauuuaaggaggagcugccuuaaaaaaaaauaaaggccuuauuu

SEQ ID NO: 212955 - RNA, 64 nt, hsa
ucauuugcaguguuuucugccacagaccuuugggcugccuuauauugugugugugugugggugu

SEQ ID NO: 212956 - RNA, 64 nt, hsa
ggcugcugcggccccgcagugugaacguuggcugcugccuuagcugcugaugacggcaggaggg

SEQ ID NO: 212957 - RNA, 64 nt, hsa
gcacaggggaggcagguccuuggcgagguagccccugccuuaauccacggggcuccuuucccuc

SEQ ID NO: 212958 - RNA, 64 nt, hsa
ugacuacuuggugcuaacuacuaaagauuuuggcagaaucaauguuggauuuggcuuuccuguc

SEQ ID NO: 212959 - RNA, 64 nt, hsa
acuggcccacccacuuguguugaagcaaaaagcaagaaucaauuacuuaaaggcaaaggaguga

SEQ ID NO: 212960 - RNA, 64 nt, hsa
aagaggcaauucauuaaacucucaaauuuucuauagaaucaagauagaaccuuuagauacucca

SEQ ID NO: 212961 - RNA, 64 nt, hsa
aacucagucuuccaacugcaauaaaauacuggguagaaucaaaugggaaagggguugggugggg

SEQ ID NO: 212962 - RNA, 64 nt, hsa
uguuugguuauauggucagaccaagaucacacacagaaucaauugcagauuugaaacuaaccca

SEQ ID NO: 212963 - RNA, 64 nt, hsa
uuuuguuguuguucuuuuuuuggcuaagauucuuagaaucaaugaaugcuuucgagaaguucgc

SEQ ID NO: 212964 - RNA, 64 nt, hsa
agcuuccucaacuacuguuuuucagaaggaagaaagaaucaaauggaagaagaaucaaguccau

SEQ ID NO: 212965 - RNA, 64 nt, hsa
guuuuucagaaggaagaaagaaucaaauggaagaagaaucaaguccaugcccaagcccaaagcc

SEQ ID NO: 212966 - RNA, 64 nt, hsa
cuguaucaucauugggaccaccugggcgcuuguuagaaucaaagacucucaggccucaccuaga

SEQ ID NO: 212967 - RNA, 64 nt, hsa
gaaucaaagacucucaggccucaccuagacauccagaaucaaaaucugcauuuuaacaagaugc

SEQ ID NO: 212968 - RNA, 64 nt, hsa
ucaagaaacaaauuuuaauuaaacaaucuguaacagaaucaagaaacaaauacauuuuaauuaa

SEQ ID NO: 212969 - RNA, 64 nt, hsa
aucccuuuucacaugguuucuccauguauauaacagaaucaagaaacaaauuuuaauuaaacaa

SEQ ID NO: 212970 - RNA, 61 nt, hsa
gagagaaacauucagccuaauacuuuaggcuagaaucaaaaacaaguuaguguucuauggu

SEQ ID NO: 212971 - RNA, 64 nt, hsa
aaagcccaaagguuccuaagccuggcugcaaagaagaaucaacagggacacuuuuuaaaaacac

SEQ ID NO: 212972 - RNA, 64 nt, hsa
acacacacacacaugcacacauaccgcacuucauagaaucaaaguugcucucugaaggagcuuu

SEQ ID NO: 212973 - RNA, 64 nt, hsa
ucuugcugaauuugauauguuuuucuuucccuuaagaaucaaaagcagaaaacaaaaacaacag

SEQ ID NO: 212974 - RNA, 64 nt, hsa
ugggcauaaaaaagugaucaaaacauugcaaaggagaaucaaagauugauuguccuggggcuaa

SEQ ID NO: 212975 - RNA, 64 nt, hsa
guguccaauuucauuuuuaaaagauguagaaagaagaaucaagcaucaauuaauuauaaagccu

SEQ ID NO: 212976 - RNA, 64 nt, hsa
agaccgcuagcaagacuaaugaagaaaagagagaagaaucaaauagaugcaauaaaaaaugaua

SEQ ID NO: 212977 - RNA, 64 nt, hsa
gaaauggaagagcauuccaugcucauggguaggaagaaucaauaucaugaaaauggcccauacu

SEQ ID NO: 212978 - RNA, 64 nt, hsa
aaacaaaagaaacauuuauaaacuaaagaaaaacuaaaagaaugacagaacaaucaucuuagca

SEQ ID NO: 212979 - RNA, 64 nt, hsa
uuagcacccuuuccucacaauaauauaaaaauauuaaaagaacauaggcaggcuuuuuuuaaau

SEQ ID NO: 212980 - RNA, 64 nt, hsa
ugugaaauauauauacauauauauauauauuuccuaaaagaagaaaagauaccuuucuguucaa

SEQ ID NO: 212981 - RNA, 64 nt, hsa
gcugggggggagggaaaugacuaaugaagcuaauuaaaagaagcauucaaaucugcuuucuacc

SEQ ID NO: 212982 - RNA, 64 nt, hsa
ugcucuaguaugguguauuuaaauaauaaaaacuuaaaagaaaaaauauuuaaugguguuuggg

SEQ ID NO: 212983 - RNA, 64 nt, hsa
aggcagcuuucaucacacccuuuuaacauuuaucuaaaagaauuuaaauucuuuuucaaaaauu

SEQ ID NO: 212984 - RNA, 64 nt, hsa
uuggauuuacgacugaagaaggacauuuucucuuuaaaagaaaguuagguuauaagaaacagag

SEQ ID NO: 212985 - RNA, 64 nt, hsa
ugaaaaaacccugggcugaaguuggcauuucaguuaaaagaaaaaaagaaacuagucccagauu

SEQ ID NO: 212986 - RNA, 64 nt, hsa
gauucagggauacaaaugggcuucucucauucauuaaaagaaaacgcgacaucuuucuaagauu

SEQ ID NO: 212987 - RNA, 64 nt, hsa
ucuaguuuucauaaucuauuagaagauggggauauaaaagaaguauaaggcaaucauauauuca

SEQ ID NO: 212988 - RNA, 64 nt, hsa
agcuguguuagggauuaaacuauaauucuguucuuaaaagaaaauuuaucugcaaaugugcaag

SEQ ID NO: 212989 - RNA, 64 nt, hsa
guaaaauggacuucuuauucaaagcaucaauaauuaaaagaauuauuuuaaugaaauguguugg

SEQ ID NO: 212990 - RNA, 64 nt, hsa
aagucaggucaccagagggaagagaacauggcauuaaaagaaucacaucuucagaagagaagac

SEQ ID NO: 212991 - RNA, 64 nt, hsa
cuaagauaagagacuaaaauaaaaugcuaaaucuuaaaagaaacuggguuuaugcacuaaacgu

SEQ ID NO: 212992 - RNA, 64 nt, hsa
caaagaugcagcaagcuuauuaaguauuauuuucuaaaagaaauaggaggcauuuucaucuuua

SEQ ID NO: 212993 - RNA, 64 nt, hsa
gaccccugucuauauauuuuuuuaauuuaaaaaauaaaagaauaaaauuguguagcucaguaua

SEQ ID NO: 212994 - RNA, 64 nt, hsa
ccuacucacauuucuacacuuuauaaaaauguaauaaaagaaaauuaucuuucuaaaaagccua

SEQ ID NO: 212995 - RNA, 64 nt, hsa
guccuugcuuauauggcaaccacugcuagaacccuaaaagaaccaaaaaucugccacagccugc

SEQ ID NO: 212996 - RNA, 64 nt, hsa
aaaauaucaaauauaacucuuagagaaauguacauaaaagaaugcuucguaauuuuggaguagg

SEQ ID NO: 212997 - RNA, 64 nt, hsa
gccacuacccuauaauuagugcagucuuauguuauaaaagaaagaaguuaacuauauuugggga

SEQ ID NO: 212998 - RNA, 64 nt, hsa
uuugcccacaauuugcaaucuguggguuaauaguuaaaagaauguucccaaccaaaaaauucuu

SEQ ID NO: 212999 - RNA, 64 nt, hsa
ugcucagcuauuuuaaagaggaaauuaaauauuauaaaagaaauaguaaagauaaguuauccuc

SEQ ID NO: 213000 - RNA, 64 nt, hsa
aacaguaccuacuugaaaggaucauugugcggauuaaaagaaauaauauauguaaagcacuuua

SEQ ID NO: 213001 - RNA, 64 nt, hsa
acuacuugauuuacaaaaauguacauuuagagguuaaaagaaacagugagaaauguaaacauuc

SEQ ID NO: 213002 - RNA, 64 nt, hsa
gaacuuugauaauguugaagaugaagaaaaaguuuaaaagaaauucugacagaugacaucagaa

SEQ ID NO: 213003 - RNA, 64 nt, hsa
aguuguacugccagaauuaucuacagcacugguguaaaagaagggucugcaaacuuuuucugua

SEQ ID NO: 213004 - RNA, 64 nt, hsa
uuugaccugguuguguuauuuuaccagaccuugguaaaagaacuauuuuggaaacaguauuugu

SEQ ID NO: 213005 - RNA, 64 nt, hsa
accugcauaacuuuuugucuuuaagucguguuuguaaaagaaguaauugcuagaaacauuugau

SEQ ID NO: 213006 - RNA, 64 nt, hsa
accuuuuuuuuuuucuucuccacucuaacaaaaguaaaagaacaaaacuuuugcugaggucuug

SEQ ID NO: 213007 - RNA, 64 nt, hsa
acccuacauuccagcaucuuaccuucauaugcaguaaaagaaagaaagaaaaaaaaaggaaaaa

SEQ ID NO: 213008 - RNA, 64 nt, hsa
caguauaaaagcuacuuugcuccuggugagagcuuaaaagaaaugggcuguuuugcccaaaguu

SEQ ID NO: 213009 - RNA, 64 nt, hsa
ugguaaauugcacauugugcaacagaaccauuaauaaaagaaaggaguuaguuuugagguaacu

SEQ ID NO: 213010 - RNA, 64 nt, hsa
agagaaauaagaauaaaacuaaugaaggguuuuuuaaaagaacuaaauaaaacaaauaaaacua

SEQ ID NO: 213011 - RNA, 64 nt, hsa
guacuuguacuucccaccacuggaaauguuagcauaaaagaacuuggagaggaaaaaaguauua

SEQ ID NO: 213012 - RNA, 64 nt, hsa
uugauagauggggugugggaccaacaaaccaaauuaaaagaaauuguuuuucuuucaguacacu

SEQ ID NO: 213013 - RNA, 64 nt, hsa
uguuuuguuuuuuuaagaacagaaacaacuauuuuaaaagaacucuuuuaagaaauuucauaaa

SEQ ID NO: 213014 - RNA, 64 nt, hsa
gagcaguuacaagaaacccuaaaacccuuggauauaaaagaaaucuguuuauugauuuuuaaau

SEQ ID NO: 213015 - RNA, 64 nt, hsa
aaccuguucagaguccugguuuaaucaaucaagcuaaaagaaucgaagacaucccuagugcaug

SEQ ID NO: 213016 - RNA, 64 nt, hsa
uagagcugcaaaaaagggacacaccccacuucgguaaaagaaaauagggaaaggccauaaacaa

SEQ ID NO: 213017 - RNA, 64 nt, hsa
guggauucagcagaaggcaagaugguuauaauucuaaaagaauagcuuguuuguuuguuuggga

SEQ ID NO: 213018 - RNA, 64 nt, hsa
gggaagauaauuaaaggcagaaugacugcguuuguaaaagaaggaccaccaacuauacugacau

SEQ ID NO: 213019 - RNA, 64 nt, hsa
uaauugauauuugugcugaggugauauuccugucuaaaagaacaacauugucuuucuuuucuag

SEQ ID NO: 213020 - RNA, 64 nt, hsa
ugucagucauuguuaguucuugucuaguuuucauuaaaagaacaaagaucuuuuauauggauau

SEQ ID NO: 213021 - RNA, 64 nt, hsa
ucaaaaaugcaaaaugugauaaugggcacuuguuuaaaagaauuaguguauccagccuucacuc

SEQ ID NO: 213022 - RNA, 64 nt, hsa
cugcuaagcacuuugugggucucagcguuuuucauaaaagaacuuuuguauuuaauacaaaguu

SEQ ID NO: 213023 - RNA, 64 nt, hsa
gcuuaaauugcucuauuuuaacuuauuuauguccuaaaagaagaauguaauuuguuuacaaacc

SEQ ID NO: 213024 - RNA, 64 nt, hsa
aaauugggucuaugauuuuuugccaaucuuagccuaaaagaaauugcuuuagcuucuggucagc

SEQ ID NO: 213025 - RNA, 64 nt, hsa
guuaucuuugacuuuuaccacaaaucuucauuuauaaaagaaaaagccaaagugaaaaaaaguu

SEQ ID NO: 213026 - RNA, 64 nt, hsa
cgguucuaauucaugugcagugauauaguauagauaaaagaaugaguaaaagaaaauacaagaa

SEQ ID NO: 213027 - RNA, 64 nt, hsa
augugcagugauauaguauagauaaaagaaugaguaaaagaaaauacaagaauucuaaagaaag

SEQ ID NO: 213028 - RNA, 64 nt, hsa
auaauggcuuucaaugaguuccuauguggauuuuuaaaagaacagaacaguaaugaaauauuug

SEQ ID NO: 213029 - RNA, 64 nt, hsa
auuuaaaucagugaauauguuaaaaaguuugguuuaaaagaacuauaucuauauguauauuuuc

SEQ ID NO: 213030 - RNA, 64 nt, hsa
gaagaaguauauuuuagaaauuuguuaaugagaguaaaagaaaauaaauguguauagcucaguu

SEQ ID NO: 213031 - RNA, 64 nt, hsa
auagguuaaacaugguuagaaacaacugaaagcauaaaagaaaaaucuaggccgggugcagugg

SEQ ID NO: 213032 - RNA, 64 nt, hsa
uuuccauaucauuucuaauuauaguuuauauccuuaaaagaaggaugccacaguaguauguaaa

SEQ ID NO: 213033 - RNA, 64 nt, hsa
uagaaagaaaagcacaucuuccugaucacaguuauaaaagaaacccugaggccgggcgcggugg

SEQ ID NO: 213034 - RNA, 64 nt, hsa
acgugcaaggaaaugaagcggaaagcaucugagauaaaagaagcagaagccaaagcugcucuug

SEQ ID NO: 213035 - RNA, 64 nt, hsa
acugcaaccagaagguaaaacuuagauguccuuguaaaagaauaaaaaagguaaauauuuuaag

SEQ ID NO: 213036 - RNA, 64 nt, hsa
cuucucuaauuacuauacauugugcucauaugaauaaaagaaauuuuaaaagaaaaaaaaucag

SEQ ID NO: 213037 - RNA, 64 nt, hsa
uaauacccauuuaaugugaaaaacauaagagucuuaaaagaaauuaagccauuuaacauuuuuu

SEQ ID NO: 213038 - RNA, 64 nt, hsa
gucucauggaaaaauuaauuauaugguugaaauguaaaagaaaguaagcauaaaaaucgaguaa

SEQ ID NO: 213039 - RNA, 64 nt, hsa
ugaaaaggaucaacaguuaauuugagccaaguaauaaaagaaauucugcauuugucacgaagac

SEQ ID NO: 213040 - RNA, 64 nt, hsa
gcguccauguugcuuuauauguagccuugccuuuuaaaagaaaaaguaugugaauaugaauuga

SEQ ID NO: 213041 - RNA, 64 nt, hsa
aauuuguuuuauauucucuaagauauauauuuacuaaaagaauuugugacauuuuaaaaaacaa

SEQ ID NO: 213042 - RNA, 64 nt, hsa
acuauuugaaucaaaaauguauugaaucaucaaauaaaagaauguggcuauuuuggggagaaaa

SEQ ID NO: 213043 - RNA, 64 nt, hsa
ucuuaaccaguucacuuauuguacucuggcaauuuaaaagaaaaucaguaaaauauuuugcuug

SEQ ID NO: 213044 - RNA, 64 nt, hsa
auucauuguuuugcaaaaguguaugguaggggcuuaaaagaaacuauaaaguuuuauuugaaug

SEQ ID NO: 213045 - RNA, 64 nt, hsa
ccauuuguguuucagcucacaguucuuugcuggguaaaagaaauacuuucugacagucaccuga

SEQ ID NO: 213046 - RNA, 64 nt, hsa
gaaauuuuuuucaggacugcucuaugguuuccuuuaaaagaaaaaaacuucuguuuguuuuuag

SEQ ID NO: 213047 - RNA, 57 nt, hsa
ucgccaauuuuagcaaauaagagauuguaaaagaagcagauugaaugaagaauuuuu

SEQ ID NO: 213048 - RNA, 64 nt, hsa
caacggcucuuuucagggccacccacgucuucucuaaaagaacuuaacauuuauuccaugugaa

SEQ ID NO: 213049 - RNA, 64 nt, hsa
cuuuuugaaaacaguguagcgaacaccgcagauuuaaaagaaaaacuagagggaagguggucca

SEQ ID NO: 213050 - RNA, 64 nt, hsa
aucagcagacuggaagcugaggaagaucuagaaguaaaagaaaaaauuagaugcguuaaaauga

SEQ ID NO: 213051 - RNA, 64 nt, hsa
uauuuuuuuuucugugacuauguuuucacuuacauaaaagaaauugugauagaccuuuuucaua

SEQ ID NO: 213052 - RNA, 64 nt, hsa
uuacugaagaaugagguuuuucauaccugaagaguaaaagaaaaacuaagagaucaaacugaga

SEQ ID NO: 213053 - RNA, 64 nt, hsa
guuauauguaaugugauaaauuagcuaugaaugguaaaagaacaaaacugaucagaguaaauuc

SEQ ID NO: 213054 - RNA, 64 nt, hsa
uucuaucauauaagauguauuuuuuuauuguccuuaaaagaagcucuagcaugaaauuaaagga

SEQ ID NO: 213055 - RNA, 64 nt, hsa
uaauaagcaaauuauuggcuucuuucuucuagacuaaaagaaauuaaagagaugaaacaaucaa

SEQ ID NO: 213056 - RNA, 64 nt, hsa
agaagaaagagagaaagaaagaaacagaaaaaccuaaaagaaagcgaaugaauuugacaccugu

SEQ ID NO: 213057 - RNA, 64 nt, hsa
gccucuaaaaugaugcuguuuucucugcuaaagguaaaagaaaagaaaaaaauaguuggaaaau

SEQ ID NO: 213058 - RNA, 64 nt, hsa
ggucuguucuugcucucaaggagguuaccuuuaauaaaagaagacaaacccagauagauaugua

SEQ ID NO: 213059 - RNA, 64 nt, hsa
auuuuguggugauucgugccauugcuuuuuuauuuaaaagaaaauuuuguaauuaaaugccuuu

SEQ ID NO: 213060 - RNA, 64 nt, hsa
ucugucauaauucuugcugagucaagaguguaaauaaaagaaauggcaggacucauauuauuca

SEQ ID NO: 213061 - RNA, 64 nt, hsa
agucuuucagucagagcucaagucuuagucgacauaaaagaauacacacuagagaaaaaccuua

SEQ ID NO: 213062 - RNA, 64 nt, hsa
cacauuuuuguauuuuaauagucuacaggcuauauaaaagaacauggcuuuuugacugauaaaa

SEQ ID NO: 213063 - RNA, 64 nt, hsa
auaaauaaauaaauaaacaaaccagucuuuauuuuaaaagaaacuuuaggaaacaaacccacau

SEQ ID NO: 213064 - RNA, 64 nt, hsa
uggacacccuaaacugugugugccuuuaaccaguuaaaagaacagugccuucagcauacuuuuu

SEQ ID NO: 213065 - RNA, 64 nt, hsa
accuaauuacaucaggauagagguagaguuucuguaaaagaagagacauuaagaguuccugaaa

SEQ ID NO: 213066 - RNA, 64 nt, hsa
uacauuguacaguuaaagaaauugacuugguacuuaaaagaaagauuucccauugcauacaggu

SEQ ID NO: 213067 - RNA, 64 nt, hsa
uuugucucagaucccagauucuaugaucccugcuuaaaagaaaauguucacugcauguagguug

SEQ ID NO: 213068 - RNA, 64 nt, hsa
uaaaaauauaauuaccuguaagguuaucugguuuuaaaagaaaaaaaaaaagccuacaaacuca

SEQ ID NO: 213069 - RNA, 64 nt, hsa
uaccaggaguaauauuuggaauauuuaaaucuaguaaaagaagaaaguuguacuuccuggcugg

SEQ ID NO: 213070 - RNA, 64 nt, hsa
aauucagaaaauucaccugaaacguauuuugaccuaaaagaaacauauuuuuguaucaguauug

SEQ ID NO: 213071 - RNA, 64 nt, hsa
uuaaccuuugugcaauaccaagaaaauagcucuuuaaaagaaugucuuuguaugucucaaggua

SEQ ID NO: 213072 - RNA, 64 nt, hsa
caaggcagcaacaagcucuuuuguguuuaaggcauaaaagaagaauucugcauagaaacauggc

SEQ ID NO: 213073 - RNA, 64 nt, hsa
caugcuuaccagauucacacuguuccagugucuauaaaagaaacacuuugaagucuauaaaaaa

SEQ ID NO: 213074 - RNA, 64 nt, hsa
ugauauauaaauauauuuauagccugaguaaaguuaaaagaauguaaaauauaucaucaaguuc

SEQ ID NO: 213075 - RNA, 64 nt, hsa
ggaaaauauacaaucaagauaucucauggcauauuaaaagaaaaaucuuaauagcaguguuggc

SEQ ID NO: 213076 - RNA, 64 nt, hsa
uuaucugcuucuuaaagaaucagccgagacaccauaaaagaaauaggcuuuuugugccuuuugc

SEQ ID NO: 213077 - RNA, 64 nt, hsa
agcaaagugagucaucagauuaugaguuacuguuuaaaagaaaaaugcuguuuauucaugcuga

SEQ ID NO: 213078 - RNA, 64 nt, hsa
agccuuuuaaaauauucuacagaccuacggggcuuaaaagaaccccaguaccgacuaagcaaau

SEQ ID NO: 213079 - RNA, 64 nt, hsa
cagccugggugacagugaaacuccaucucaaaaauaaaagaauaaaaguaugucugucauccag

SEQ ID NO: 213080 - RNA, 64 nt, hsa
acaggaaguaguaaagcuuuuuuuuuuuuuuaauuaaaagaauuuuuuuugagacaaagucucg

SEQ ID NO: 213081 - RNA, 64 nt, hsa
aagcucugaguuuucagcaccaguagauuuguauuaaaagaaaaaaaaauggggccuuagcuuc

SEQ ID NO: 213082 - RNA, 64 nt, hsa
aaacaaauagccaucugcuaucagcaucauuauguaaaagaaaauauauuuuagccccuaaaau

SEQ ID NO: 213083 - RNA, 64 nt, hsa
ccauaugcuauauacagcuuaacucacagaacuguaaaagaaaauuauaaaauaauucaacaug

SEQ ID NO: 213084 - RNA, 64 nt, hsa
aaauaauucaacauguccaucuuuuuagugauaauaaaagaaagcaugguauuaaacuaucaua

SEQ ID NO: 213085 - RNA, 64 nt, hsa
uauacuuacuuccugcauuuagagggaguuuauuuaaaagaaauaaaugacaaucaaaccaaau

SEQ ID NO: 213086 - RNA, 64 nt, hsa
aauuauuuguaaaucauguggcaucuauguauaauaaaagaaagagacaacuauauuacucaau

SEQ ID NO: 213087 - RNA, 64 nt, hsa
cuaguguuguugggaacuaauugaacagcuacaguaaaagaaguuccuaucucauugccuuugu

SEQ ID NO: 213088 - RNA, 64 nt, hsa
cucauugccuuuguggaaaggcuucccuaugugguaaaagaaaggcauuccuccguaaccuagg

SEQ ID NO: 213089 - RNA, 64 nt, hsa
auauggcuucaaguuguaaaaaugaaagugacuuuaaaagaaaauaggggaugguccaggaucu

SEQ ID NO: 213090 - RNA, 64 nt, hsa
aaucagaacuaaccaguaccucuguauagaaaucuaaaagaauuuuaccauucaguuaauucaa

SEQ ID NO: 213091 - RNA, 64 nt, hsa
auuuaaaccuugguuaucuuggccugauaccacauaaaagaauguagaauggcugaagagauca

SEQ ID NO: 213092 - RNA, 64 nt, hsa
acaaaggagcuucuuguccccuuggucuuuuaauuaaaagaaauuccaacugacuuuuaaacuu

SEQ ID NO: 213093 - RNA, 64 nt, hsa
gcauguaaaagauguauuacaaucucaaagccaguaaaagaaaucuugcuucacuguucaccug

SEQ ID NO: 213094 - RNA, 64 nt, hsa
aggaggaucccuaugacucaaaauaacuuguuuguaaaagaaaauuuguuuacuuacccauuag

SEQ ID NO: 213095 - RNA, 64 nt, hsa
uuuauauaagaguuuugucaauauggucucuucuuaaaagaaguugacuaugaauugaaacaca

SEQ ID NO: 213096 - RNA, 64 nt, hsa
auaauucuugaaugaggcaauuucaagauauuuguaaaagaacaguaaacauugguaagaauga

SEQ ID NO: 213097 - RNA, 64 nt, hsa
ugcuuagcaauguucuaaucacuauggacagauguaaaagaaacuauacaucauuuuugcccuc

SEQ ID NO: 213098 - RNA, 64 nt, hsa
auuuaucuuauaucguagaucugauaacccuaucuaaaagaaagucacacgcuaaauguauucu

SEQ ID NO: 213099 - RNA, 64 nt, hsa
uucaguucacucacccaauguacaaccaaugaaauaaaagaagcauuuaaaaggauuguauagu

SEQ ID NO: 213100 - RNA, 64 nt, hsa
aaauguucuuucaguuuuuagaaccuccauuuuauaaaagaauuauccuaucaauggauucuuu

SEQ ID NO: 213101 - RNA, 64 nt, hsa
aacccagcuugcagguaagagcuuucaccuuugguaaaagaacagcuggggagguucaaggggu

SEQ ID NO: 213102 - RNA, 64 nt, hsa
acaugcuaaaaggcaaauuucaagggaagaaauguaaaagaauuuuacaaaugcuuuccaagug

SEQ ID NO: 213103 - RNA, 64 nt, hsa
ugaauuagacgacaaagcaucuauauagcuaagcuaaaagaauaaccauugacauuaccagaca

SEQ ID NO: 213104 - RNA, 64 nt, hsa
gauccaauaaguaaauucauggaaaggaagaaauuaaaagaaagugaggaaaaggaagugcuuc

SEQ ID NO: 213105 - RNA, 64 nt, hsa
aagacgaugugacugcaugaagugcccuucguuuuaaaagaaagauuauuggauuaaaagauga

SEQ ID NO: 213106 - RNA, 64 nt, hsa
uuagauuaauaauccaacuuuaauaguauacauuuaaaagaaaaaaaacaaaagcccuggaagu

SEQ ID NO: 213107 - RNA, 64 nt, hsa
ucagguauaaaaacaagagaucauaauaaaaaccuaaaagaaccuaugaucacggucuucccuu

SEQ ID NO: 213108 - RNA, 64 nt, hsa
auucaccaaauggagcuuggcacuaaaauuuauguaaaagaaaaaucacaaaccuugaaaaauu

SEQ ID NO: 213109 - RNA, 64 nt, hsa
ggaauauauauuagauguaaagaauuuucugcaauaaaagaaacuagacuuguuaaucccugcc

SEQ ID NO: 213110 - RNA, 64 nt, hsa
gaacuuuucugguauuacguuuauggcaaauguauaaaagaaacaaguuuugguuauauuuuua

SEQ ID NO: 213111 - RNA, 64 nt, hsa
uuauuuacaacugaauuccugcgcaguggagaaguaaaagaagccgcuugucucugugagcaca

SEQ ID NO: 213112 - RNA, 64 nt, hsa
uugugaaaggugauggguuuuauucguugggcuuuaaaagaaaagguuuggcagaacuaaaaac

SEQ ID NO: 213113 - RNA, 64 nt, hsa
ccuacacaugugccccugaaccuaaaaaaaaaguuaaaagaaaaacguuuggauuauuuucccu

SEQ ID NO: 213114 - RNA, 64 nt, hsa
acugaaaagaaaugaaaucucaguuccacuaugauaaaagaaacgaaucaccagugucugucag

SEQ ID NO: 213115 - RNA, 64 nt, hsa
gguugauugacuguuaauugauucaggguacccuuaaaagaaaagaaguuuucccauugugaac

SEQ ID NO: 213116 - RNA, 64 nt, hsa
augucauuucuuaagcaguuaugcucuuaaugcuuaaaagaaggcuagcauuguuugcacaaaa

SEQ ID NO: 213117 - RNA, 64 nt, hsa
ugaaugguacaguagauguaaaaaaaauucaguuuaaaagaacauuuguuuuuacauuaaaugu

SEQ ID NO: 213118 - RNA, 64 nt, hsa
acccuuuauaaagagauuuucaaguggauauauauaaaagaaacaguugcuuguaaaauauacu

SEQ ID NO: 213119 - RNA, 64 nt, hsa
agccacaucauguuaaacauuaacugguuuggauuaaaagaacauuaauauuauaauacacaua

SEQ ID NO: 213120 - RNA, 64 nt, hsa
augguggaguaccgcgcagacauuaaaagucauguaaaagaacaucugacugaaagaaaaaugc

SEQ ID NO: 213121 - RNA, 64 nt, hsa
aaccaucugcgaaaggacacacacaggaaauucauaaaagaaaucugaauggauaaaaccauga

SEQ ID NO: 213122 - RNA, 64 nt, hsa
gucccccagucugacauauuucauacagaauguuuaaaagaaaaacucugcuagucuuggcaaa

SEQ ID NO: 213123 - RNA, 64 nt, hsa
cuuucuaugugaauauaagcuugugcacaauguuuaaaagaaaaacaaugaauuagaagagauc

SEQ ID NO: 213124 - RNA, 64 nt, hsa
augcaaaucaaagauauuugguagucaaaauaaguaaaagaaauauaggaauauuccagucaau

SEQ ID NO: 213125 - RNA, 64 nt, hsa
ucuuuuauaaagagacucaaagcuaaugauagcuuaaaagaaaaguuaaugccuucucauugga

SEQ ID NO: 213126 - RNA, 64 nt, hsa
ugcaauguuuuaaacagaguuuuaguauugcuauuaaaagaaguuacuuugcuuuuaaagaaac

SEQ ID NO: 213127 - RNA, 64 nt, hsa
uaaaauaauagaagaaauagaaauuuugaauguauaaaagaaaaagaucaaguugucauuuuag

SEQ ID NO: 213128 - RNA, 60 nt, hsa
uuagaggacacacugguuaaaaauuaaacauaaaagaaauugcaucgauguaaucagaau

SEQ ID NO: 213129 - RNA, 64 nt, hsa
augcuuuuggcaacaccucagacuuuucugaauauaaaagaaaucauaugaaugagaaauccua

SEQ ID NO: 213130 - RNA, 64 nt, hsa
aagacuucaacuguuccucacaccuuacuacucauaaaagaauucauacuggaggaaaagcccu

SEQ ID NO: 213131 - RNA, 64 nt, hsa
gcccgacucucacuucauauguuuaaagaaugaguaaaagaaagcaauuacuacugcuaaaugu

SEQ ID NO: 213132 - RNA, 64 nt, hsa
gguuuuuacuuagaucaugaguugaacaaacauguaaaagaagagauacuuaacaauaauuggg

SEQ ID NO: 213133 - RNA, 64 nt, hsa
auaucaugcuuuaaaguguaauaauaugauuuuuuaaaagaaauuuauuacuuguugcaaaggu

SEQ ID NO: 213134 - RNA, 64 nt, hsa
uauuuauugaagaaacagauaccauacucauuucuaaaagaauauucagagaauaucaagauga

SEQ ID NO: 213135 - RNA, 64 nt, hsa
auuuucacaugucugcuuauuuauuuuauauuuuuaaaagaagacaguauucaccuauguauuu

SEQ ID NO: 213136 - RNA, 64 nt, hsa
uuuuuuacauaucuaucaauaucagagauuuggguaaaagaauggguaauguuuaaacaugugg

SEQ ID NO: 213137 - RNA, 64 nt, hsa
cuuguguaauuuccugcuccuccaguacaauaaauaaaagaaagaugcugaugacuuggugggu

SEQ ID NO: 213138 - RNA, 64 nt, hsa
auaguauacacaucauaaacaaagaguagaacuuuaaaagaagguaaauaaucauacacagaaa

SEQ ID NO: 213139 - RNA, 64 nt, hsa
uuaacagcuugaaacaucuacagauaguuccuacuaaaagaaguggccugcagaaguuuaauaa

SEQ ID NO: 213140 - RNA, 64 nt, hsa
aaagccauaaugguagaagauggcauacugauuauaaaagaagcagaaaaacauugauuuuuuu

SEQ ID NO: 213141 - RNA, 64 nt, hsa
cuuauuccugguuaaucacuaugcauauuugaaauaaaagaaagcguaagccucugcaauuuua

SEQ ID NO: 213142 - RNA, 64 nt, hsa
aauacccaauauauauuuuuuggaaaugaaacauuaaaagaacuuaaaaaguaauuuuuggaaa

SEQ ID NO: 213143 - RNA, 64 nt, hsa
uaugugugugcgugcgugugugcgcacauagcuuuaaaagaagacauucaaaauuugaugugcu

SEQ ID NO: 213144 - RNA, 64 nt, hsa
gaaauggcaggauucuaaagagagccugguuuguuaaaagaaaacacugucaugcugucaguuc

SEQ ID NO: 213145 - RNA, 64 nt, hsa
ggaucauuuuaacccugacuuccccuuauucccauaaaagaaguuuuccaguggaauggagauu

SEQ ID NO: 213146 - RNA, 64 nt, hsa
guaaauggguugccaacauaagcuggcugagaaauaaaagaaaacaagacaguuguucauaaag

SEQ ID NO: 213147 - RNA, 64 nt, hsa
guaacugaauugaaucaaccaguuugcauuuaaauaaaagaacaggcucaguggucuuccugua

SEQ ID NO: 213148 - RNA, 64 nt, hsa
cccuguuaauuauagaauggaccaaauacauuuuuaaaagaaaacugagaccaaucagauggaa

SEQ ID NO: 213149 - RNA, 64 nt, hsa
uugagcauugcuuacuuaugguuaaagugcuucuuaaaagaaccauaguccauuuacaauuuug

SEQ ID NO: 213150 - RNA, 64 nt, hsa
uggugguggugggggugguggugugggauacaugguggucaaguugucagcccugaucaguuug

SEQ ID NO: 213151 - RNA, 64 nt, hsa
uacuuuuuucccccuuguaaagagguucgagaauguggucaauuguauagauagcguguuaaag

SEQ ID NO: 213152 - RNA, 64 nt, hsa
cauuggccaggugugauuuuuacacaagguaaacguggucaagggcaucggggaauuugcucca

SEQ ID NO: 213153 - RNA, 64 nt, hsa
uccaaugcccugguuuuccugcuugaaucuguucguggucaaagguuugggggaauuugugacc

SEQ ID NO: 213154 - RNA, 64 nt, hsa
ccuggaugaugcugugcaguucaaccaucuggagguggucaaacugcuucaagauuaccaggac

SEQ ID NO: 213155 - RNA, 64 nt, hsa
acggcgugaaggggcagaaauucggaacaagacuguggucaaccuguuauuugcugccuauagu

SEQ ID NO: 213156 - RNA, 64 nt, hsa
aauguaaauagaacgaauuauuuucuuguuuugaauugucaauauauuaaauguugacucuuug

SEQ ID NO: 213157 - RNA, 64 nt, hsa
gaguuguuggcaaguuucaauggugagaaacauuauugucaacuugaaauguguucuguaaugg

SEQ ID NO: 213158 - RNA, 64 nt, hsa
ucuaggcaauguggacuaccucauucaguaacugauugucaaaaucacaauuaaaucagacuuc

SEQ ID NO: 213159 - RNA, 64 nt, hsa
uuucucaagaacuguguaccacuaaaaguaauauauugucaauguucacagaacuauuaaacau

SEQ ID NO: 213160 - RNA, 64 nt, hsa
uuauauuuuuguuuuauauaggucccaaauuauaauugucaaauauauauuuuaaauuaauaaa

SEQ ID NO: 213161 - RNA, 64 nt, hsa
gaaccaaggggaaauguugugagauaacauuuacauugucaaccuuuauugacuuuguuuuuac

SEQ ID NO: 213162 - RNA, 64 nt, hsa
uuugaugcagacauaaaaauagcaaucauuuuaaauugucaaaauuuccagauuacugguaaaa

SEQ ID NO: 213163 - RNA, 64 nt, hsa
uacauuauuccuaauaauagggauaaugcuguuuauugucaagaaaaaguaaaaucguucucuu

SEQ ID NO: 213164 - RNA, 64 nt, hsa
acaaggguuaccugaaaagaaaaaaaaagucaacauugucaagcuguuuguuuacucuuucuuu

SEQ ID NO: 213165 - RNA, 64 nt, hsa
ccucaccuuaaaggagacuaccccuuugccccauauugucaaccuaauuuucucucguacucuc

SEQ ID NO: 213166 - RNA, 64 nt, hsa
gugguuacacacuuuuuaagaaauacaauucuacauugucaagcuuaugaagguuccaaucaga

SEQ ID NO: 213167 - RNA, 64 nt, hsa
uuuuaagcaaaauauuauuuuaugaaagguuuacauugucaaagugaugaauauggaauaucca

SEQ ID NO: 213168 - RNA, 64 nt, hsa
aucccacagauucaaucuucaggugagaauuuucauugucaaaacccacugguuagauguugua

SEQ ID NO: 213169 - RNA, 64 nt, hsa
ugauagaaacagcaggugaugacucugcacucucauugucaagguuagauauauccccaguugc

SEQ ID NO: 213170 - RNA, 63 nt, hsa
auuuaauuagucaggcauccauuuugccuuuuaaacaacuaggauucccuacuaaccuccacc

SEQ ID NO: 213171 - RNA, 63 nt, hsa
uucaggauauaugaguuggcugauugagacugcaacaacuacaucuauauuuaugggcaauau

SEQ ID NO: 213172 - RNA, 63 nt, hsa
uucuuuuuuuuccugaaaaacaacuaaccuucuaacaacuaucuuucaaaaguaaauguaaua

SEQ ID NO: 213173 - RNA, 63 nt, hsa
auuuuuacaucagauuucuuuuuuuuccugaaaaacaacuaaccuucuaacaacuaucuuuca

SEQ ID NO: 213174 - RNA, 63 nt, hsa
auuugugugcccuggaauuuccaacuaguaauaaacaacuacuguugauguaguuuuaaacca

SEQ ID NO: 213175 - RNA, 63 nt, hsa
ggaguaccaugaggguugcuauuuguuguuuuuaacaacuaaucaagagugagugaacaacua

SEQ ID NO: 213176 - RNA, 63 nt, hsa
uuguuguuuuuaacaacuaaucaagagugagugaacaacuauuuauaaacuagaucuccuauu

SEQ ID NO: 213177 - RNA, 63 nt, hsa
cugaagcaugcacaugccacugucaccaaaacaaacaacuaccacuuuccaaauuucauucag

SEQ ID NO: 213178 - RNA, 63 nt, hsa
uguuauuuauguuauuuauauuagcuaacaggaaacaacuacuguguuucaacauaauaaaua

SEQ ID NO: 213179 - RNA, 64 nt, hsa
ggauauaugaacauuuuucuuuuauuguuuuaucuucacagaaaauaaaagguguuaauuugcu

SEQ ID NO: 213180 - RNA, 64 nt, hsa
acauacggagauauuugaagacccaagucugccuuucacagagcccuccauuccaaguuuaguu

SEQ ID NO: 213181 - RNA, 64 nt, hsa
uaguguccaauuguauucacagaaccaccaucaauucacagaauuacagucaacguugguacau

SEQ ID NO: 213182 - RNA, 64 nt, hsa
cauucaguuuacccauugcuaguguccaauuguauucacagaaccaccaucaauucacagaauu

SEQ ID NO: 213183 - RNA, 64 nt, hsa
ucaaaaaauaugucuaauguaauuaaaacacaaguucacagauuuacagugaacuugaucuaca

SEQ ID NO: 213184 - RNA, 64 nt, hsa
aguucacagauuuacagugaacuugaucuacaaguucacagauccauugugugguuuaauagac

SEQ ID NO: 213185 - RNA, 64 nt, hsa
agcagcauuguuaaauaguucuuacgcuuauacauucacagaacuacccuguuuuccuuguaua

SEQ ID NO: 213186 - RNA, 64 nt, hsa
acagguaaaaaugcaccuuuuaaagcacuacguuuucacagacaauaacuguucugcucaugga

SEQ ID NO: 213187 - RNA, 64 nt, hsa
agccacuaaauacguuauugcuugaugaagaccuuucacagaauccuauggauugcagcauuuc

SEQ ID NO: 213188 - RNA, 64 nt, hsa
ccaacugagaauuuauuuuuguuucauugguuguuucacagaauuagaacacacacgacuuuuu

SEQ ID NO: 213189 - RNA, 64 nt, hsa
aaugagaucuaccgacucacuugugagaauauuuuucacagauuaucuuugggccuuuucauua

SEQ ID NO: 213190 - RNA, 64 nt, hsa
aagcucaucacagccuagaguuaaguaaagucaauucacagaagcacaauuuugcccuuugcga

SEQ ID NO: 213191 - RNA, 64 nt, hsa
ccaacaguuacggagugcuugagaaggggcaaguuucacagaaauggccagauagggccuuccu

SEQ ID NO: 213192 - RNA, 64 nt, hsa
acaccagauaccucagcuuauuggagccaugcccuucacagagucccaacucagaggaaaaggg

SEQ ID NO: 213193 - RNA, 64 nt, hsa
caauuuucauucucauuaggaaguuaaauguagauucacagauacauuuacuuucagaauccuc

SEQ ID NO: 213194 - RNA, 64 nt, hsa
uucacagugggggauggagggcccccaccccugcuucacagaauaaugggaagugacucuaguc

SEQ ID NO: 213195 - RNA, 64 nt, hsa
cuauuguaggcucacuggauuggucauuuagaguuucacagacucuuaccagcauauauaguau

SEQ ID NO: 213196 - RNA, 64 nt, hsa
cagggauuugcucaccccaaggucaucugauaauuucacagaugcuguguaacagaacacagcc

SEQ ID NO: 213197 - RNA, 64 nt, hsa
gcaucuccccaccgaggccccggcagcagucuuguucacagaccuuaggcaccagacuggaggc

SEQ ID NO: 213198 - RNA, 64 nt, hsa
gcaggccaggacugcuuuuuuuuaaugcucccauuucacagaggauaccaccgagacucggagg

SEQ ID NO: 213199 - RNA, 64 nt, hsa
cuuaauaggacaguaaaucuguguggggcuagaacaaaauuaagacauguuuggcaauauuuca

SEQ ID NO: 213200 - RNA, 64 nt, hsa
uuuucauuguuuuaaguuuuucuucugaguaaaacaaaauuauagaaaacaaaugcaacaaugu

SEQ ID NO: 213201 - RNA, 64 nt, hsa
auuuagcaaaagagccagucauuuuaugaaaaaucaaaauuauaagugauuuuaaaaaccagaa

SEQ ID NO: 213202 - RNA, 64 nt, hsa
uaaauuugcucauacagcuugaacguuguauuugcaaaauuaagccuucgauuuuuauaaaugu

SEQ ID NO: 213203 - RNA, 64 nt, hsa
uguuucuaauauuguccaguugaaaacuguaugccaaaauuaguuguuuaagugaaguuuugug

SEQ ID NO: 213204 - RNA, 64 nt, hsa
uuuugugucaauggcuugaaacuggcaagauuaacaaaauuaggccgggcaugguggcucacgc

SEQ ID NO: 213205 - RNA, 64 nt, hsa
gaucauugucuuggaccuccugcaucagccuauucaaaauuaucucucucucuagcuuuccaca

SEQ ID NO: 213206 - RNA, 64 nt, hsa
gcaggagacaugugauuaugaucaggaaacugcacaaaauuauuguuuucagcccccguguuau

SEQ ID NO: 213207 - RNA, 64 nt, hsa
aaagaauaugucaggaaauaaggucacuuuaugucaaaauuauuugaguacuaugggaccuggc

SEQ ID NO: 213208 - RNA, 64 nt, hsa
caacaacaacaacaacaacaacaacaacaaaccacaaaauuauuugaguacugugaaggauuau

SEQ ID NO: 213209 - RNA, 64 nt, hsa
aaggggaaaaaaaacccaaaauuaugugaacaagcaaaauuaaaauuucauuuuaggcuauugg

SEQ ID NO: 213210 - RNA, 64 nt, hsa
agagaagucagaacagagaaggggaaaaaaaacccaaaauuaugugaacaagcaaaauuaaaau

SEQ ID NO: 213211 - RNA, 64 nt, hsa
cuuuugucacuaaacgguuuuguguuagaaccaccaaaauuauagcuuuuaagagcuuccuuug

SEQ ID NO: 213212 - RNA, 64 nt, hsa
acauuguuauuucuguaggagcaacuucucugaucaaaauuacuuuucuggguaugugcugauu

SEQ ID NO: 213213 - RNA, 64 nt, hsa
uuaauuacuuuuaucuuuugucuucauuuguggccaaaauuauguuuacuagaggaaauuuggg

SEQ ID NO: 213214 - RNA, 64 nt, hsa
uaaaguaggacagcuaagaaauuaauauuaauaucaaaauuauugauaaucuuaaauuauugau

SEQ ID NO: 213215 - RNA, 64 nt, hsa
caacauggugaaaccccgucucuacuaaaaauaccaaaauuagccaggcgugauggugggcgcc

SEQ ID NO: 213216 - RNA, 64 nt, hsa
uuacaaguguuugaauuugugaucugaaauaacacaaaauuaaaaacaugauuucucuaauuuu

SEQ ID NO: 213217 - RNA, 64 nt, hsa
uaacaaugguaaaacaagcauucaagcacuuuuacaaaauuaccaaauucuuaaaaugaagcca

SEQ ID NO: 213218 - RNA, 64 nt, hsa
cuaacacggugaaaccccaucucuacuaaaaauacaaaauuagcugggcgugguggccggcgcc

SEQ ID NO: 213219 - RNA, 64 nt, hsa
ggguaauauuuuauuuaucuucgaauuccauggacaaaauuaggcucacuuaaauuaauuuuug

SEQ ID NO: 213220 - RNA, 64 nt, hsa
augcuuucaauguuuuuaaugcuaacauagaccccaaaauuagauauaaagaauugggaaggau

SEQ ID NO: 213221 - RNA, 64 nt, hsa
aagggccccaugauuucauuuugugcugagcccucaaaauuaugucuguuucguggugggaaau

SEQ ID NO: 213222 - RNA, 64 nt, hsa
ccaaaacagugaaaccccgucucuacuaaaaauacaaaauuagccagaugugguggcgcacacc

SEQ ID NO: 213223 - RNA, 64 nt, hsa
gucaugaaaaugaaacagaucuauaguuuugggacaaaauuauaaaaugaaauguguagguaac

SEQ ID NO: 213224 - RNA, 64 nt, hsa
uugccuuaaaugguagaauauuuagaaauuugcacaaaauuaaaaaaauaaacauugucuugga

SEQ ID NO: 213225 - RNA, 64 nt, hsa
ucacuguagacuguuuuaaauugccaagacugcacaaaauuacagugcuaauguauaugguugc

SEQ ID NO: 213226 - RNA, 64 nt, hsa
ugaaaguauuauuaguuaaagauguaaaccuagccaaaauuaccaguuuauuaauaauuaggau

SEQ ID NO: 213227 - RNA, 64 nt, hsa
ggugacuucuguuguaaaauaauccagaacacuucaaaauuauuccuaaaucauuaagauuuuc

SEQ ID NO: 213228 - RNA, 64 nt, hsa
auuuucaaucuuaaaauauaauacaacaaucuugcaaaauuauggugucaguuacacaagcucu

SEQ ID NO: 213229 - RNA, 64 nt, hsa
augucaucaaagaucaccagggcauaauuauaaucaaaauuaguuuuauugaugcuugcugcag

SEQ ID NO: 213230 - RNA, 64 nt, hsa
uaacaauuacagauccugauauauagaaguuauucaaaauuauacaguuuucaaaaaaucaaga

SEQ ID NO: 213231 - RNA, 64 nt, hsa
uuugcuuuuagaaaagggaguuuaaaaaugguaucaaaauuacauauacuacagucaagauaga

SEQ ID NO: 213232 - RNA, 64 nt, hsa
ugaauugaauggugcauuguauagauauaaugaacaaaauuauuuguaagauauuugcaguuuu

SEQ ID NO: 213233 - RNA, 64 nt, hsa
augaagcaaaaguauggagcaagaccuguagugacaaaauuacacaguagugguuaguccacug

SEQ ID NO: 213234 - RNA, 64 nt, hsa
aaucaacauacugauaaaaugacuuuguacuccacaaaauuaugacugaaagguuuauuaaaau

SEQ ID NO: 213235 - RNA, 64 nt, hsa
guggacaauuuacacacccaacacauacuguuuccaaaauuauuucuauaugacacaaaguaug

SEQ ID NO: 213236 - RNA, 64 nt, hsa
uuacgauguuggaauuuagcagaacuaucaaauccaaaauuauuuucaaaucaagauguuuaaa

SEQ ID NO: 213237 - RNA, 64 nt, hsa
uacaaaauuauucaaauucucacgccuuccaacucaaaauuagcaaucuaaaguaauuuccaua

SEQ ID NO: 213238 - RNA, 64 nt, hsa
aucucaguuaucuuaaauauuccaauacuauuuacaaaauuauucaaauucucacgccuuccaa

SEQ ID NO: 213239 - RNA, 64 nt, hsa
uaacuaaucuuuuugccucagaauaccaaaacaacaaaauuauaaagcuguauuuggacaacua

SEQ ID NO: 213240 - RNA, 64 nt, hsa
uccagguacuaaggacccaaggcauacagauucacaaaauuaacuaaucuuuuugccucagaau

SEQ ID NO: 213241 - RNA, 64 nt, hsa
ccuuggaacucaauguggaacuuuaaacauuuugcaaaauuacauuuagagaaacccaauuuuu

SEQ ID NO: 213242 - RNA, 64 nt, hsa
auuuuucaaaguuuaagaaauauacaaaguaugacaaaauuaucuucauaagaacaugcugcau

SEQ ID NO: 213243 - RNA, 64 nt, hsa
gaacaacuuuugucauagauuugauuuauuaaaccaaaauuauacauauuaaaauuauaucaca

SEQ ID NO: 213244 - RNA, 64 nt, hsa
ccuucaguccauuccgcaaacucuugugaucuuccaaaauuagcucugauuagcuuucacuucc

SEQ ID NO: 213245 - RNA, 64 nt, hsa
cucugcuugguacuuagucuguguccaugugauccaaaauuaccuuccuauugcauuuccuacu

SEQ ID NO: 213246 - RNA, 64 nt, hsa
gguugaauuuguucaguauaagcucguucuugugcaaaauuaaauaaauauuucucuuaccuua

SEQ ID NO: 213247 - RNA, 64 nt, hsa
gcuugacaaaaucacaaaaggaaaauuacuggggcaaaauuagaccucaagucugccucuacug

SEQ ID NO: 213248 - RNA, 64 nt, hsa
gaacaguauagaucucagcccaccaaugccaagacaaaauuauuuuucuuauacuuauuuuuua

SEQ ID NO: 213249 - RNA, 64 nt, hsa
uuuuuacuugcauaucuguucaaaacacuuuuaacaaaauuaauucauuaaaguccaguuguug

SEQ ID NO: 213250 - RNA, 64 nt, hsa
cuuccaaaugcaauuugauugacugcccauucaccaaaauuauccugaacucuucugcaaaaau

SEQ ID NO: 213251 - RNA, 64 nt, hsa
uuuuuuuuucauagagauuugucuaauugcaucucaaaauuauucugcccuccuuaauuuggga

SEQ ID NO: 213252 - RNA, 64 nt, hsa
cacuggcauguucaaagccacauuauuucuaguccaaaauuacaaguaaucaagggucauuaug

SEQ ID NO: 213253 - RNA, 64 nt, hsa
cuaaccuuuuuguuuggggcaccaaaucugaagacaaaauuaauuugcaccaguaaacuucaag

SEQ ID NO: 213254 - RNA, 64 nt, hsa
auuuaauaguauacuugccauuugagccucacugcaaaauuagugcagaggagaaaacaauuuu

SEQ ID NO: 213255 - RNA, 64 nt, hsa
uaauagcuuuaaaauaauuuuuuaguaauuauuacaaaauuaaggaaaaucucuauuaccguua

SEQ ID NO: 213256 - RNA, 64 nt, hsa
cauuuugguaaagcaaauuucacaggaaaauagacaaaauuauaagagauuccuggagacaaca

SEQ ID NO: 213257 - RNA, 64 nt, hsa
uuuuuaagaauuugauguauuucaauacacuguucaaaauuaaauuguuuaauuuuauguauga

SEQ ID NO: 213258 - RNA, 64 nt, hsa
gacuuugucuguuuuacucuagucuuuaguacuucaaaauuaccuuuucauauccaugaucuug

SEQ ID NO: 213259 - RNA, 64 nt, hsa
ccauuuuuuuauuguuuaaagcugcauucaacgucaaaauuaccuuggguaacuuuugauaacu

SEQ ID NO: 213260 - RNA, 64 nt, hsa
agaccaaaaguuugcucagcaucacacuacaucucaaaauuaauguugccaacuuaauuuugug

SEQ ID NO: 213261 - RNA, 64 nt, hsa
ccaacacugagaaaccccaucucuauuaaagauacaaaauuagccaggcaugguggugcaugcc

SEQ ID NO: 213262 - RNA, 64 nt, hsa
gaaauuucaauaauaaaauguuuaaaaucaaaaccaaaauuauagacuauguagaaaugaauga

SEQ ID NO: 213263 - RNA, 64 nt, hsa
uugcuacauauaugaauuguaaaacuagaaucaucaaaauuauuuguuguugaagcagucauaa

SEQ ID NO: 213264 - RNA, 64 nt, hsa
gauaugagauguaugaggauuugaaauuaagagacaaaauuaucauuuuugugauguuuugcua

SEQ ID NO: 213265 - RNA, 64 nt, hsa
uuuuuucuuuuuuaguaaaaaccuguauaaaaaccaaaauuauaggauuuuuuuuucuucuuuu

SEQ ID NO: 213266 - RNA, 64 nt, hsa
uuuuuucuuuuuuaguaaaaaccuauaugaaaaccaaaauuauaggauuuuuuucuuuuuuagu

SEQ ID NO: 213267 - RNA, 64 nt, hsa
uuuuuucuuuuuuaguaaaaaccuauauaaaaaccaaaauuauaggauuuuuucuuuuuuagua

SEQ ID NO: 213268 - RNA, 64 nt, hsa
uuuuuucuuuuuuaguaaaaaccgguaucaaaaccaaaauuauaggauuuuuuucuuuuuuagu

SEQ ID NO: 213269 - RNA, 64 nt, hsa
agagccacuggugaguaaaaaccuauauaaaaaccaaaauuauaggauuuuuucuuuuuuagua

SEQ ID NO: 213270 - RNA, 64 nt, hsa
uucuacuccccaaagcagagauagauugauuuaucaaaauuauuaucuggccaacagugugacu

SEQ ID NO: 213271 - RNA, 64 nt, hsa
aaaauauacaacuuucaccauauauauaagccugcaaaauuagaguagugaaagucaugcuagu

SEQ ID NO: 213272 - RNA, 64 nt, hsa
aaacuaugacccauuuaauuucuauuguguuucacaaaauuaaguguuguucauuauacucucu

SEQ ID NO: 213273 - RNA, 64 nt, hsa
uuucuuaaccuaggcuucagggagcauaugaaaccaaaauuauauggaacauuuucugugugua

SEQ ID NO: 213274 - RNA, 64 nt, hsa
aaaauuaacugcuuaaauguuuugucggggcaaacaaaauuaugugaauuguguuguuuucuug

SEQ ID NO: 213275 - RNA, 64 nt, hsa
auuguucuucaaaaacaaacaaaacaaaacaaaacaaaauuaacugcuuaaauguuuugucggg

SEQ ID NO: 213276 - RNA, 64 nt, hsa
cauauuugaacuugucgaaccagaucuucucauguacuaggaaguuuguagccauuuuucugac

SEQ ID NO: 213277 - RNA, 64 nt, hsa
uuuaguuuuucauuaauuuugaucaauuguaucuuacuaggagaucacccauuuacuguaggua

SEQ ID NO: 213278 - RNA, 64 nt, hsa
cugaaccuccuuuugucuuucauaaaauaaaagcuacuaggaugaguuguuuuaaggauuucag

SEQ ID NO: 213279 - RNA, 64 nt, hsa
aaacucaaaucagaaugaaauaucacuucaaaccuacuaggaugguuauaauaaaaaagacaga

SEQ ID NO: 213280 - RNA, 64 nt, hsa
cugauguaugaguccucucagaagcacaagugcauacuaggaaggcuuuguaaacugguuuugu

SEQ ID NO: 213281 - RNA, 64 nt, hsa
acuuauuuuugccugaguuccuagcuuuacgcauuacuaggaauauuuucuuuuacaggaggga

SEQ ID NO: 213282 - RNA, 64 nt, hsa
cugguguuuuguucaaucuggaagaaugacuguaucagucaauggggauuuuaacagacugccu

SEQ ID NO: 213283 - RNA, 64 nt, hsa
cuucuuucuguagggaugagaauuccucuuuuaaucagucaagggagaugcuucaaagcuggag

SEQ ID NO: 213284 - RNA, 64 nt, hsa
ugugugcuaggaacagccuucccuccguuuccccucagucaaacuugagccagccucuggaucg

SEQ ID NO: 213285 - RNA, 64 nt, hsa
guccuaaacauucuucagugaaaauaauuuuauuucagucaaacauuuaugaggaaaugagauc

SEQ ID NO: 213286 - RNA, 64 nt, hsa
aaagcacaugaauguaaugaauguggaaaagcuuucagucaaaccucaugccuuauucagcauc

SEQ ID NO: 213287 - RNA, 64 nt, hsa
aaauuccauugcugcaaugaaugugaaaaagccaucagucaaagaaacuaccuuguuuaguauc

SEQ ID NO: 213288 - RNA, 64 nt, hsa
aaguguucccuaaggaacagcauuucucugcuccucagucaacccccguagccuagagcagugu

SEQ ID NO: 213289 - RNA, 64 nt, hsa
ucacugugguaggcauuuggcauauuuuguggacucagucaagcaaccacagucuguuaaucau

SEQ ID NO: 213290 - RNA, 64 nt, hsa
accaaacccuaaauugaaagacaaaacuaugguuucagucaacauauucaugaauuagggagcu

SEQ ID NO: 213291 - RNA, 64 nt, hsa
caccaggggaugcucuacaucaagggaugcaccuucagucaaacugucaaaaagcccagaauuc

SEQ ID NO: 213292 - RNA, 64 nt, hsa
cuauagauccaaaagaauugaaagcagggacuugaacagauauuuguacaccagcguuuauaac

SEQ ID NO: 213293 - RNA, 64 nt, hsa
aucuacaaaucccuuaccaauuugucacaagaagaacagauaacaaagcuguuaauacuuaaac

SEQ ID NO: 213294 - RNA, 64 nt, hsa
uacaugaauuaugcuuuccuucuaugcuuuaaggaacagauacuauagugacaauaaauguaau

SEQ ID NO: 213295 - RNA, 64 nt, hsa
caaccauucucuuaucauguagccccuuuagaacaacagauacuuuauuuuagacaaaaccuuu

SEQ ID NO: 213296 - RNA, 64 nt, hsa
ccuucuuauuuaaucuuuucuuauuuuuguacuuuaucaugaaugcuuuuagugugugcauaau

SEQ ID NO: 213297 - RNA, 64 nt, hsa
guugaauuagugaguauagugggguuccaugaguuaucaugaauuuuaaaguaugcauuauuaa

SEQ ID NO: 213298 - RNA, 64 nt, hsa
aacagaacuguaugaccccuuuagaaauaaaauuuaucaugaaaugcuaguucuuuuaaguuug

SEQ ID NO: 213299 - RNA, 64 nt, hsa
uguaagcauguguauauaauaaauaagcauguuuuaucaugaaaaauuauugugaacaauuuag

SEQ ID NO: 213300 - RNA, 64 nt, hsa
cacacacacacacucucgcgcucucucucucaacuaucaugaucaaagaugccuugacaaaggg

SEQ ID NO: 213301 - RNA, 64 nt, hsa
uucugccuggguuaguagauauuaucaaaguccauaucaugaauucagaacccuuuaauguaau

SEQ ID NO: 213302 - RNA, 64 nt, hsa
ugggaaagccuuuguuuccuucacuuccuuucgauaucaugaaaggacucacacuggagagaac

SEQ ID NO: 213303 - RNA, 64 nt, hsa
uggcaaagcuuucacuucuuccaguucuuuucaauaucaugaaagaacacacuagggagaaacc

SEQ ID NO: 213304 - RNA, 64 nt, hsa
ugcaaaagccuuuauuucuuccacuucuuuucaauaucaugaaaggacucacaugggagagaaa

SEQ ID NO: 213305 - RNA, 64 nt, hsa
ugggaaagccuucauuucuucuaguucccuucaauaucaugaaaggacucacacuggagagaag

SEQ ID NO: 213306 - RNA, 64 nt, hsa
uauaaaaccaucggaucucuugagacucguucacuaucaugagaauagcaugggaaagaccugc

SEQ ID NO: 213307 - RNA, 64 nt, hsa
uggaaguuucuaaucaaauccuuuuuagaaaaucuaucaugacucaauuguauuacuccuugua

SEQ ID NO: 213308 - RNA, 64 nt, hsa
ccauugugcagaacuggagucuuuacugacccgcuuuccacaucagcccaaggucuuuuuaaug

SEQ ID NO: 213309 - RNA, 64 nt, hsa
cauuguagaagcggucacuauuagcaggcauacuuuuccacacaucuuuggacuuuucuuaaaa

SEQ ID NO: 213310 - RNA, 64 nt, hsa
gacuuagaaccauccuugacccuuaggcccaaccuuuccacagagaaaucaccucucuuccuuu

SEQ ID NO: 213311 - RNA, 64 nt, hsa
auuugucagaaauguauuuggcuuuuuaaacuccuuuccacaaaaguuuaagucuaaugaccuu

SEQ ID NO: 213312 - RNA, 64 nt, hsa
gucucauucauuuugacaguuaucaaagauguacuuuccacaguuaaauuuacauuaauggcaa

SEQ ID NO: 213313 - RNA, 64 nt, hsa
uuucccgucccauuugcagagcucuacuacuucauuuccacaguaagcauauauauaaugauca

SEQ ID NO: 213314 - RNA, 64 nt, hsa
uuccuccuaauugugugguaauuugcuuuuacuguuuccacaguauuucaggucuuugcucauu

SEQ ID NO: 213315 - RNA, 64 nt, hsa
gcugaaucuuguaaaauuauaacuucauuaaauguuuccacaaguauuucugagauacaauauu

SEQ ID NO: 213316 - RNA, 64 nt, hsa
caccauguagccugaaguuuuucuuagauccuuauuuccacaaauauuuugcauuuuuaggagg

SEQ ID NO: 213317 - RNA, 64 nt, hsa
caagaguucuacuuagaacuuuucauggacacaauuuccacaaccuuucagaugcugauguaga

SEQ ID NO: 213318 - RNA, 64 nt, hsa
caagagaugucauccccccagggucuccaaggcauuuccacacuauugguggcaccuggaggac

SEQ ID NO: 213319 - RNA, 64 nt, hsa
ugucuccuuugcucuugccaaaaaauagcacacuuuuccacauuccagugaugugugagcuaug

SEQ ID NO: 213320 - RNA, 64 nt, hsa
ccuuguaagcuaucugugcaggauauuugcacuauuuccacauggaaucaaucuuuaacaaccu

SEQ ID NO: 213321 - RNA, 64 nt, hsa
auguacacaaauaacugacuuccacaagagggcuuuuccacacucggugugugcauacaguuuc

SEQ ID NO: 213322 - RNA, 64 nt, hsa
gugugcagugcgcucuggcuucuagcugaaaacuuuuccacaguuuuacauucaugugguuuuc

SEQ ID NO: 213323 - RNA, 64 nt, hsa
uugaaaauggaucuuguuugauucuguaguuaaauuuccacauuuggaaugggaaggcaucucc

SEQ ID NO: 213324 - RNA, 64 nt, hsa
gcacugggcuuuaaagagcgaaaugagugugucauuuccacaugaaggagaggcaaggaaaagc

SEQ ID NO: 213325 - RNA, 64 nt, hsa
uuuucuuuacagcauagauagaaaaaugcacauuuuuccacacucagcuuuccccuagcaugga

SEQ ID NO: 213326 - RNA, 64 nt, hsa
agggacauuguucagaugucaagccaugcccaauuuuccacaagauucaagaaucuuguauaaa

SEQ ID NO: 213327 - RNA, 64 nt, hsa
acauuuaaauagauuagugggaaaacuuuaagaguuuccacauauuaguuuucauuuuuugagu

SEQ ID NO: 213328 - RNA, 64 nt, hsa
cucucugcccaugggaaaagagauaggcuuuauauuuccacagagugaaaaauccucugucaug

SEQ ID NO: 213329 - RNA, 64 nt, hsa
cuggguagcucacagccagccaaaggcagcuacauuuccacagaagcccauccgcugccuccgu

SEQ ID NO: 213330 - RNA, 64 nt, hsa
gucaccaaacaggaggguccuggcacuacccagauuuccacagugcugcuaauaucccagcucc

SEQ ID NO: 213331 - RNA, 64 nt, hsa
auuaggaggaagauacaaccaugaugacuuuuuuuuuccacaaggaacaauauuuuaaaaaaua

SEQ ID NO: 213332 - RNA, 64 nt, hsa
uggugacuucacugcccugcuucuaaucugguucuuuccacagccuaguuuugauugacuucau

SEQ ID NO: 213333 - RNA, 64 nt, hsa
cauucaccaaccauaccagagaaacauuuccaguuuuccacaaauacuugauacaagauuuaau

SEQ ID NO: 213334 - RNA, 64 nt, hsa
cuuauugugaagagcgacacaacugccugcugccuuuccacagcuauaauggacaucagguuga

SEQ ID NO: 213335 - RNA, 64 nt, hsa
aagauguagugcuauugccgauaacaaguaagauuuuccacacuacagcuggguguuucucuuu

SEQ ID NO: 213336 - RNA, 64 nt, hsa
ugauaggacaucuuuucguggugugcaccagugcuuuccacacuugacagugguuggcuuugau

SEQ ID NO: 213337 - RNA, 64 nt, hsa
ucuggagagaagcugugguguguaugcuguagaguuuccacauuucacaugcaguguacuccaa

SEQ ID NO: 213338 - RNA, 64 nt, hsa
uugcaguauucauuaucugcaucuaauuugguaguuuccacaaucguauuugaugaaagaaacu

SEQ ID NO: 213339 - RNA, 64 nt, hsa
aaggagauaugauucuguaacuccaaucaguucagauguguaacucaaauuauuaugccuuuca

SEQ ID NO: 213340 - RNA, 64 nt, hsa
cacaucuguaaagcaaucaauuguauauuuuugugauguguaccauacugugugcuccagcaaa

SEQ ID NO: 213341 - RNA, 64 nt, hsa
ugauaaaauguugugacuucauggcaaacagguggauguguaaaaauggaauaaaaaaaaaaaa

SEQ ID NO: 213342 - RNA, 64 nt, hsa
aucacuaacccguuuuauucuauuccuaucuguggauguguaaauggcuggggggccagcccug

SEQ ID NO: 213343 - RNA, 64 nt, hsa
gauguaguguuguaauaaacuguuuaauggggcugauguguaaagcuguucaaguuauuugaug

SEQ ID NO: 213344 - RNA, 64 nt, hsa
guuuuaacacauaaguaaaaacccguacauauuugauguguaaugcagguuaauuacaacacag

SEQ ID NO: 213345 - RNA, 64 nt, hsa
uggucauuccauuucuuuuguuugaagcuaaagagauguguagcucacaggggcuaccuuacca

SEQ ID NO: 213346 - RNA, 64 nt, hsa
aacaugaauagauaccuuguaaacuuguauuguggauguguaaauaauauguacuuuggguuuu

SEQ ID NO: 213347 - RNA, 64 nt, hsa
uuuguaaauuuacauuuuuuuuaaagaagagacugauguguagauagaaaacccuuuuuuugcu

SEQ ID NO: 213348 - RNA, 64 nt, hsa
ucauuccccaccucuaccuuucuaauggcggcaugauguguaaacucugugcaggggugggggc

SEQ ID NO: 213349 - RNA, 64 nt, hsa
aggaauucauucuuagcuucuucaucuuuguguggauguguauacuuuacgcaucuuuccuuuu

SEQ ID NO: 213350 - RNA, 64 nt, hsa
agugauuuaaauaguuaaucauuuaaccaaagaagauguguagugccuuaacaagcaauccucu

SEQ ID NO: 213351 - RNA, 64 nt, hsa; identical to SEQ ID NO: 107033

SEQ ID NO: 213352 - RNA, 64 nt, hsa; identical to SEQ ID NO: 107034

SEQ ID NO: 213353 - RNA, 64 nt, hsa; identical to SEQ ID NO: 107035

SEQ ID NO: 213354 - RNA, 64 nt, hsa; identical to SEQ ID NO: 107036

SEQ ID NO: 213355 - RNA, 64 nt, hsa; identical to SEQ ID NO: 107037

SEQ ID NO: 213356 - RNA, 64 nt, hsa; identical to SEQ ID NO: 107038

SEQ ID NO: 213357 - RNA, 64 nt, hsa; identical to SEQ ID NO: 107039

SEQ ID NO: 213358 - RNA, 64 nt, hsa; identical to SEQ ID NO: 107040

SEQ ID NO: 213359 - RNA, 64 nt, hsa; identical to SEQ ID NO: 107041

SEQ ID NO: 213360 - RNA, 64 nt, hsa; identical to SEQ ID NO: 107042

SEQ ID NO: 213361 - RNA, 64 nt, hsa; identical to SEQ ID NO: 107043

SEQ ID NO: 213362 - RNA, 64 nt, hsa; identical to SEQ ID NO: 107044

SEQ ID NO: 213363 - RNA, 64 nt, hsa; identical to SEQ ID NO: 107045

SEQ ID NO: 213364 - RNA, 64 nt, hsa; identical to SEQ ID NO: 107046

SEQ ID NO: 213365 - RNA, 64 nt, hsa; identical to SEQ ID NO: 107047

SEQ ID NO: 213366 - RNA, 64 nt, hsa; identical to SEQ ID NO: 107048

SEQ ID NO: 213367 - RNA, 64 nt, hsa; identical to SEQ ID NO: 107049

SEQ ID NO: 213368 - RNA, 64 nt, hsa; identical to SEQ ID NO: 107050

SEQ ID NO: 213369 - RNA, 64 nt, hsa; identical to SEQ ID NO: 107051

SEQ ID NO: 213370 - RNA, 64 nt, hsa; identical to SEQ ID NO: 107052

SEQ ID NO: 213371 - RNA, 64 nt, hsa; identical to SEQ ID NO: 107053

SEQ ID NO: 213372 - RNA, 64 nt, hsa; identical to SEQ ID NO: 107054

SEQ ID NO: 213373 - RNA, 64 nt, hsa; identical to SEQ ID NO: 107055

SEQ ID NO: 213374 - RNA, 64 nt, hsa; identical to SEQ ID NO: 107056

SEQ ID NO: 213375 - RNA, 64 nt, hsa; identical to SEQ ID NO: 107057

SEQ ID NO: 213376 - RNA, 64 nt, hsa; identical to SEQ ID NO: 107058

SEQ ID NO: 213377 - RNA, 64 nt, hsa; identical to SEQ ID NO: 107059

SEQ ID NO: 213378 - RNA, 64 nt, hsa; identical to SEQ ID NO: 107060

SEQ ID NO: 213379 - RNA, 64 nt, hsa; identical to SEQ ID NO: 107061

SEQ ID NO: 213380 - RNA, 64 nt, hsa; identical to SEQ ID NO: 107062

SEQ ID NO: 213381 - RNA, 64 nt, hsa; identical to SEQ ID NO: 107063

SEQ ID NO: 213382 - RNA, 64 nt, hsa; identical to SEQ ID NO: 107064

SEQ ID NO: 213383 - RNA, 64 nt, hsa; identical to SEQ ID NO: 107065

SEQ ID NO: 213384 - RNA, 64 nt, hsa; identical to SEQ ID NO: 107066

SEQ ID NO: 213385 - RNA, 64 nt, hsa; identical to SEQ ID NO: 107067

SEQ ID NO: 213386 - RNA, 64 nt, hsa; identical to SEQ ID NO: 107068

SEQ ID NO: 213387 - RNA, 64 nt, hsa; identical to SEQ ID NO: 107069

SEQ ID NO: 213388 - RNA, 64 nt, hsa; identical to SEQ ID NO: 107070

SEQ ID NO: 213389 - RNA, 64 nt, hsa; identical to SEQ ID NO: 107071

SEQ ID NO: 213390 - RNA, 64 nt, hsa; identical to SEQ ID NO: 107072

SEQ ID NO: 213391 - RNA, 64 nt, hsa; identical to SEQ ID NO: 107073

SEQ ID NO: 213392 - RNA, 62 nt, hsa; identical to SEQ ID NO: 107074

SEQ ID NO: 213393 - RNA, 64 nt, hsa; identical to SEQ ID NO: 107075

SEQ ID NO: 213394 - RNA, 64 nt, hsa; identical to SEQ ID NO: 107076

SEQ ID NO: 213395 - RNA, 64 nt, hsa; identical to SEQ ID NO: 107077

SEQ ID NO: 213396 - RNA, 64 nt, hsa; identical to SEQ ID NO: 107078

SEQ ID NO: 213397 - RNA, 64 nt, hsa; identical to SEQ ID NO: 107079

SEQ ID NO: 213398 - RNA, 64 nt, hsa; identical to SEQ ID NO: 107080

SEQ ID NO: 213399 - RNA, 64 nt, hsa; identical to SEQ ID NO: 107081

SEQ ID NO: 213400 - RNA, 64 nt, hsa; identical to SEQ ID NO: 107082

SEQ ID NO: 213401 - RNA, 64 nt, hsa; identical to SEQ ID NO: 107083

SEQ ID NO: 213402 - RNA, 64 nt, hsa; identical to SEQ ID NO: 107084

SEQ ID NO: 213403 - RNA, 64 nt, hsa; identical to SEQ ID NO: 107085

SEQ ID NO: 213404 - RNA, 64 nt, hsa; identical to SEQ ID NO: 107086

SEQ ID NO: 213405 - RNA, 64 nt, hsa; identical to SEQ ID NO: 107087

SEQ ID NO: 213406 - RNA, 64 nt, hsa; identical to SEQ ID NO: 107088

SEQ ID NO: 213407 - RNA, 64 nt, hsa; identical to SEQ ID NO: 107089

SEQ ID NO: 213408 - RNA, 64 nt, hsa; identical to SEQ ID NO: 107090

SEQ ID NO: 213409 - RNA, 64 nt, hsa; identical to SEQ ID NO: 107091

SEQ ID NO: 213410 - RNA, 64 nt, hsa; identical to SEQ ID NO: 107092

SEQ ID NO: 213411 - RNA, 64 nt, hsa; identical to SEQ ID NO: 107093

SEQ ID NO: 213412 - RNA, 64 nt, hsa; identical to SEQ ID NO: 107094

SEQ ID NO: 213413 - RNA, 64 nt, hsa; identical to SEQ ID NO: 107095

SEQ ID NO: 213414 - RNA, 64 nt, hsa; identical to SEQ ID NO: 107096

SEQ ID NO: 213415 - RNA, 64 nt, hsa; identical to SEQ ID NO: 107097

SEQ ID NO: 213416 - RNA, 64 nt, hsa; identical to SEQ ID NO: 107098

SEQ ID NO: 213417 - RNA, 64 nt, hsa; identical to SEQ ID NO: 107099

SEQ ID NO: 213418 - RNA, 64 nt, hsa; identical to SEQ ID NO: 107100

SEQ ID NO: 213419 - RNA, 64 nt, hsa; identical to SEQ ID NO: 107101

SEQ ID NO: 213420 - RNA, 64 nt, hsa; identical to SEQ ID NO: 107102

SEQ ID NO: 213421 - RNA, 64 nt, hsa; identical to SEQ ID NO: 107103

SEQ ID NO: 213422 - RNA, 64 nt, hsa; identical to SEQ ID NO: 107104

SEQ ID NO: 213423 - RNA, 64 nt, hsa; identical to SEQ ID NO: 107105

SEQ ID NO: 213424 - RNA, 64 nt, hsa; identical to SEQ ID NO: 107106

SEQ ID NO: 213425 - RNA, 64 nt, hsa; identical to SEQ ID NO: 107107

SEQ ID NO: 213426 - RNA, 64 nt, hsa; identical to SEQ ID NO: 107108

SEQ ID NO: 213427 - RNA, 64 nt, hsa; identical to SEQ ID NO: 107109

SEQ ID NO: 213428 - RNA, 64 nt, hsa; identical to SEQ ID NO: 107110

SEQ ID NO: 213429 - RNA, 64 nt, hsa; identical to SEQ ID NO: 107111

SEQ ID NO: 213430 - RNA, 64 nt, hsa; identical to SEQ ID NO: 107112

SEQ ID NO: 213431 - RNA, 64 nt, hsa; identical to SEQ ID NO: 107113

SEQ ID NO: 213432 - RNA, 64 nt, hsa; identical to SEQ ID NO: 107114

SEQ ID NO: 213433 - RNA, 64 nt, hsa; identical to SEQ ID NO: 107115

SEQ ID NO: 213434 - RNA, 64 nt, hsa; identical to SEQ ID NO: 107116

SEQ ID NO: 213435 - RNA, 64 nt, hsa; identical to SEQ ID NO: 107117

SEQ ID NO: 213436 - RNA, 64 nt, hsa; identical to SEQ ID NO: 107118

SEQ ID NO: 213437 - RNA, 64 nt, hsa; identical to SEQ ID NO: 107119

SEQ ID NO: 213438 - RNA, 64 nt, hsa; identical to SEQ ID NO: 107120

SEQ ID NO: 213439 - RNA, 64 nt, hsa; identical to SEQ ID NO: 107121

SEQ ID NO: 213440 - RNA, 64 nt, hsa; identical to SEQ ID NO: 107122

SEQ ID NO: 213441 - RNA, 64 nt, hsa; identical to SEQ ID NO: 107123

SEQ ID NO: 213442 - RNA, 64 nt, hsa; identical to SEQ ID NO: 107124

SEQ ID NO: 213443 - RNA, 64 nt, hsa; identical to SEQ ID NO: 107125

SEQ ID NO: 213444 - RNA, 64 nt, hsa; identical to SEQ ID NO: 107126

SEQ ID NO: 213445 - RNA, 64 nt, hsa; identical to SEQ ID NO: 107127

SEQ ID NO: 213446 - RNA, 64 nt, hsa; identical to SEQ ID NO: 107128

SEQ ID NO: 213447 - RNA, 64 nt, hsa; identical to SEQ ID NO: 107129

SEQ ID NO: 213448 - RNA, 64 nt, hsa; identical to SEQ ID NO: 107130

SEQ ID NO: 213449 - RNA, 64 nt, hsa; identical to SEQ ID NO: 107131

SEQ ID NO: 213450 - RNA, 64 nt, hsa; identical to SEQ ID NO: 107132

SEQ ID NO: 213451 - RNA, 64 nt, hsa; identical to SEQ ID NO: 107133

SEQ ID NO: 213452 - RNA, 64 nt, hsa; identical to SEQ ID NO: 107134

SEQ ID NO: 213453 - RNA, 64 nt, hsa; identical to SEQ ID NO: 107135

SEQ ID NO: 213454 - RNA, 64 nt, hsa; identical to SEQ ID NO: 107136

SEQ ID NO: 213455 - RNA, 64 nt, hsa; identical to SEQ ID NO: 107137

SEQ ID NO: 213456 - RNA, 64 nt, hsa; identical to SEQ ID NO: 107138

SEQ ID NO: 213457 - RNA, 64 nt, hsa; identical to SEQ ID NO: 107139

SEQ ID NO: 213458 - RNA, 64 nt, hsa; identical to SEQ ID NO: 107140

SEQ ID NO: 213459 - RNA, 64 nt, hsa; identical to SEQ ID NO: 107141

SEQ ID NO: 213460 - RNA, 64 nt, hsa; identical to SEQ ID NO: 107142

SEQ ID NO: 213461 - RNA, 64 nt, hsa; identical to SEQ ID NO: 107143

SEQ ID NO: 213462 - RNA, 64 nt, hsa; identical to SEQ ID NO: 107144

SEQ ID NO: 213463 - RNA, 64 nt, hsa; identical to SEQ ID NO: 107145

SEQ ID NO: 213464 - RNA, 64 nt, hsa; identical to SEQ ID NO: 107146

SEQ ID NO: 213465 - RNA, 64 nt, hsa; identical to SEQ ID NO: 107147

SEQ ID NO: 213466 - RNA, 64 nt, hsa; identical to SEQ ID NO: 107148

SEQ ID NO: 213467 - RNA, 64 nt, hsa; identical to SEQ ID NO: 107149

SEQ ID NO: 213468 - RNA, 64 nt, hsa; identical to SEQ ID NO: 107150

SEQ ID NO: 213469 - RNA, 64 nt, hsa; identical to SEQ ID NO: 107151

SEQ ID NO: 213470 - RNA, 64 nt, hsa; identical to SEQ ID NO: 107152

SEQ ID NO: 213471 - RNA, 64 nt, hsa; identical to SEQ ID NO: 107153

SEQ ID NO: 213472 - RNA, 64 nt, hsa; identical to SEQ ID NO: 107154

SEQ ID NO: 213473 - RNA, 64 nt, hsa; identical to SEQ ID NO: 107155

SEQ ID NO: 213474 - RNA, 64 nt, hsa; identical to SEQ ID NO: 107156

SEQ ID NO: 213475 - RNA, 64 nt, hsa; identical to SEQ ID NO: 107157

SEQ ID NO: 213476 - RNA, 64 nt, hsa; identical to SEQ ID NO: 107158

SEQ ID NO: 213477 - RNA, 64 nt, hsa; identical to SEQ ID NO: 107159

SEQ ID NO: 213478 - RNA, 64 nt, hsa; identical to SEQ ID NO: 107160

SEQ ID NO: 213479 - RNA, 64 nt, hsa; identical to SEQ ID NO: 107161

SEQ ID NO: 213480 - RNA, 64 nt, hsa; identical to SEQ ID NO: 107162

SEQ ID NO: 213481 - RNA, 64 nt, hsa; identical to SEQ ID NO: 107163

SEQ ID NO: 213482 - RNA, 64 nt, hsa; identical to SEQ ID NO: 107164

SEQ ID NO: 213483 - RNA, 64 nt, hsa; identical to SEQ ID NO: 107165

SEQ ID NO: 213484 - RNA, 64 nt, hsa; identical to SEQ ID NO: 107166

SEQ ID NO: 213485 - RNA, 64 nt, hsa; identical to SEQ ID NO: 107167

SEQ ID NO: 213486 - RNA, 64 nt, hsa; identical to SEQ ID NO: 107168

SEQ ID NO: 213487 - RNA, 64 nt, hsa; identical to SEQ ID NO: 107169

SEQ ID NO: 213488 - RNA, 64 nt, hsa; identical to SEQ ID NO: 107170

SEQ ID NO: 213489 - RNA, 64 nt, hsa; identical to SEQ ID NO: 107171

SEQ ID NO: 213490 - RNA, 64 nt, hsa; identical to SEQ ID NO: 107172

SEQ ID NO: 213491 - RNA, 64 nt, hsa; identical to SEQ ID NO: 107173

SEQ ID NO: 213492 - RNA, 64 nt, hsa; identical to SEQ ID NO: 107174

SEQ ID NO: 213493 - RNA, 64 nt, hsa; identical to SEQ ID NO: 107175

SEQ ID NO: 213494 - RNA, 64 nt, hsa; identical to SEQ ID NO: 107176

SEQ ID NO: 213495 - RNA, 64 nt, hsa; identical to SEQ ID NO: 107177

SEQ ID NO: 213496 - RNA, 64 nt, hsa; identical to SEQ ID NO: 107178

SEQ ID NO: 213497 - RNA, 64 nt, hsa; identical to SEQ ID NO: 107179

SEQ ID NO: 213498 - RNA, 64 nt, hsa; identical to SEQ ID NO: 107180

SEQ ID NO: 213499 - RNA, 64 nt, hsa; identical to SEQ ID NO: 107181

SEQ ID NO: 213500 - RNA, 64 nt, hsa; identical to SEQ ID NO: 107182

SEQ ID NO: 213501 - RNA, 64 nt, hsa; identical to SEQ ID NO: 107183

SEQ ID NO: 213502 - RNA, 64 nt, hsa; identical to SEQ ID NO: 107184

SEQ ID NO: 213503 - RNA, 64 nt, hsa; identical to SEQ ID NO: 107185

SEQ ID NO: 213504 - RNA, 64 nt, hsa; identical to SEQ ID NO: 107186

SEQ ID NO: 213505 - RNA, 64 nt, hsa; identical to SEQ ID NO: 107187

SEQ ID NO: 213506 - RNA, 64 nt, hsa; identical to SEQ ID NO: 107188

SEQ ID NO: 213507 - RNA, 64 nt, hsa; identical to SEQ ID NO: 107189

SEQ ID NO: 213508 - RNA, 64 nt, hsa; identical to SEQ ID NO: 107190

SEQ ID NO: 213509 - RNA, 64 nt, hsa; identical to SEQ ID NO: 107191

SEQ ID NO: 213510 - RNA, 64 nt, hsa; identical to SEQ ID NO: 107192

SEQ ID NO: 213511 - RNA, 64 nt, hsa; identical to SEQ ID NO: 107193

SEQ ID NO: 213512 - RNA, 64 nt, hsa; identical to SEQ ID NO: 107194

SEQ ID NO: 213513 - RNA, 64 nt, hsa; identical to SEQ ID NO: 107195

SEQ ID NO: 213514 - RNA, 64 nt, hsa; identical to SEQ ID NO: 107196

SEQ ID NO: 213515 - RNA, 64 nt, hsa; identical to SEQ ID NO: 107197

SEQ ID NO: 213516 - RNA, 64 nt, hsa; identical to SEQ ID NO: 107198

SEQ ID NO: 213517 - RNA, 64 nt, hsa; identical to SEQ ID NO: 107199

SEQ ID NO: 213518 - RNA, 64 nt, hsa; identical to SEQ ID NO: 107200

SEQ ID NO: 213519 - RNA, 64 nt, hsa; identical to SEQ ID NO: 107201

SEQ ID NO: 213520 - RNA, 64 nt, hsa; identical to SEQ ID NO: 107202

SEQ ID NO: 213521 - RNA, 64 nt, hsa; identical to SEQ ID NO: 107203

SEQ ID NO: 213522 - RNA, 64 nt, hsa; identical to SEQ ID NO: 107204

SEQ ID NO: 213523 - RNA, 64 nt, hsa; identical to SEQ ID NO: 107205

SEQ ID NO: 213524 - RNA, 64 nt, hsa; identical to SEQ ID NO: 107206

SEQ ID NO: 213525 - RNA, 64 nt, hsa; identical to SEQ ID NO: 107207

SEQ ID NO: 213526 - RNA, 64 nt, hsa; identical to SEQ ID NO: 107208

SEQ ID NO: 213527 - RNA, 64 nt, hsa; identical to SEQ ID NO: 107209

SEQ ID NO: 213528 - RNA, 64 nt, hsa; identical to SEQ ID NO: 107210

SEQ ID NO: 213529 - RNA, 64 nt, hsa; identical to SEQ ID NO: 107211

SEQ ID NO: 213530 - RNA, 64 nt, hsa; identical to SEQ ID NO: 107212

SEQ ID NO: 213531 - RNA, 64 nt, hsa; identical to SEQ ID NO: 107213

SEQ ID NO: 213532 - RNA, 64 nt, hsa; identical to SEQ ID NO: 107214

SEQ ID NO: 213533 - RNA, 64 nt, hsa; identical to SEQ ID NO: 107215

SEQ ID NO: 213534 - RNA, 64 nt, hsa; identical to SEQ ID NO: 107216

SEQ ID NO: 213535 - RNA, 64 nt, hsa; identical to SEQ ID NO: 107217

SEQ ID NO: 213536 - RNA, 64 nt, hsa; identical to SEQ ID NO: 107218

SEQ ID NO: 213537 - RNA, 64 nt, hsa; identical to SEQ ID NO: 107219

SEQ ID NO: 213538 - RNA, 64 nt, hsa; identical to SEQ ID NO: 107220

SEQ ID NO: 213539 - RNA, 64 nt, hsa; identical to SEQ ID NO: 107221

SEQ ID NO: 213540 - RNA, 64 nt, hsa; identical to SEQ ID NO: 107222

SEQ ID NO: 213541 - RNA, 64 nt, hsa; identical to SEQ ID NO: 107223

SEQ ID NO: 213542 - RNA, 64 nt, hsa; identical to SEQ ID NO: 107224

SEQ ID NO: 213543 - RNA, 64 nt, hsa; identical to SEQ ID NO: 107225

SEQ ID NO: 213544 - RNA, 64 nt, hsa; identical to SEQ ID NO: 107226

SEQ ID NO: 213545 - RNA, 64 nt, hsa; identical to SEQ ID NO: 107227

SEQ ID NO: 213546 - RNA, 64 nt, hsa; identical to SEQ ID NO: 107228

SEQ ID NO: 213547 - RNA, 64 nt, hsa; identical to SEQ ID NO: 107229

SEQ ID NO: 213548 - RNA, 64 nt, hsa; identical to SEQ ID NO: 107230

SEQ ID NO: 213549 - RNA, 64 nt, hsa; identical to SEQ ID NO: 107231

SEQ ID NO: 213550 - RNA, 64 nt, hsa; identical to SEQ ID NO: 107232

SEQ ID NO: 213551 - RNA, 64 nt, hsa; identical to SEQ ID NO: 107233

SEQ ID NO: 213552 - RNA, 64 nt, hsa; identical to SEQ ID NO: 107234

SEQ ID NO: 213553 - RNA, 64 nt, hsa; identical to SEQ ID NO: 107235

SEQ ID NO: 213554 - RNA, 64 nt, hsa; identical to SEQ ID NO: 107236

SEQ ID NO: 213555 - RNA, 64 nt, hsa; identical to SEQ ID NO: 107237

SEQ ID NO: 213556 - RNA, 64 nt, hsa; identical to SEQ ID NO: 107238

SEQ ID NO: 213557 - RNA, 64 nt, hsa; identical to SEQ ID NO: 107239

SEQ ID NO: 213558 - RNA, 64 nt, hsa; identical to SEQ ID NO: 107240

SEQ ID NO: 213559 - RNA, 64 nt, hsa; identical to SEQ ID NO: 107241

SEQ ID NO: 213560 - RNA, 64 nt, hsa; identical to SEQ ID NO: 107242

SEQ ID NO: 213561 - RNA, 64 nt, hsa; identical to SEQ ID NO: 107243

SEQ ID NO: 213562 - RNA, 64 nt, hsa; identical to SEQ ID NO: 107244

SEQ ID NO: 213563 - RNA, 64 nt, hsa; identical to SEQ ID NO: 107245

SEQ ID NO: 213564 - RNA, 64 nt, hsa; identical to SEQ ID NO: 107246

SEQ ID NO: 213565 - RNA, 64 nt, hsa; identical to SEQ ID NO: 107247

SEQ ID NO: 213566 - RNA, 64 nt, hsa; identical to SEQ ID NO: 107248

SEQ ID NO: 213567 - RNA, 64 nt, hsa; identical to SEQ ID NO: 107249

SEQ ID NO: 213568 - RNA, 64 nt, hsa; identical to SEQ ID NO: 107250

SEQ ID NO: 213569 - RNA, 64 nt, hsa; identical to SEQ ID NO: 107251

SEQ ID NO: 213570 - RNA, 64 nt, hsa; identical to SEQ ID NO: 107252

SEQ ID NO: 213571 - RNA, 64 nt, hsa; identical to SEQ ID NO: 107253

SEQ ID NO: 213572 - RNA, 64 nt, hsa; identical to SEQ ID NO: 107254

SEQ ID NO: 213573 - RNA, 64 nt, hsa; identical to SEQ ID NO: 107255

SEQ ID NO: 213574 - RNA, 64 nt, hsa; identical to SEQ ID NO: 107256

SEQ ID NO: 213575 - RNA, 64 nt, hsa; identical to SEQ ID NO: 107257

SEQ ID NO: 213576 - RNA, 64 nt, hsa; identical to SEQ ID NO: 107258

SEQ ID NO: 213577 - RNA, 64 nt, hsa; identical to SEQ ID NO: 107259

SEQ ID NO: 213578 - RNA, 64 nt, hsa; identical to SEQ ID NO: 107260

SEQ ID NO: 213579 - RNA, 64 nt, hsa; identical to SEQ ID NO: 107261

SEQ ID NO: 213580 - RNA, 64 nt, hsa; identical to SEQ ID NO: 107262

SEQ ID NO: 213581 - RNA, 64 nt, hsa; identical to SEQ ID NO: 107263

SEQ ID NO: 213582 - RNA, 64 nt, hsa; identical to SEQ ID NO: 107264

SEQ ID NO: 213583 - RNA, 64 nt, hsa; identical to SEQ ID NO: 107265

SEQ ID NO: 213584 - RNA, 64 nt, hsa; identical to SEQ ID NO: 107266

SEQ ID NO: 213585 - RNA, 64 nt, hsa; identical to SEQ ID NO: 107267

SEQ ID NO: 213586 - RNA, 64 nt, hsa; identical to SEQ ID NO: 107268

SEQ ID NO: 213587 - RNA, 64 nt, hsa; identical to SEQ ID NO: 107269

SEQ ID NO: 213588 - RNA, 64 nt, hsa; identical to SEQ ID NO: 107270

SEQ ID NO: 213589 - RNA, 64 nt, hsa; identical to SEQ ID NO: 107271

SEQ ID NO: 213590 - RNA, 64 nt, hsa; identical to SEQ ID NO: 107272

SEQ ID NO: 213591 - RNA, 64 nt, hsa; identical to SEQ ID NO: 107273

SEQ ID NO: 213592 - RNA, 64 nt, hsa; identical to SEQ ID NO: 107274

SEQ ID NO: 213593 - RNA, 64 nt, hsa; identical to SEQ ID NO: 107275

SEQ ID NO: 213594 - RNA, 64 nt, hsa; identical to SEQ ID NO: 107276

SEQ ID NO: 213595 - RNA, 64 nt, hsa; identical to SEQ ID NO: 107277

SEQ ID NO: 213596 - RNA, 64 nt, hsa; identical to SEQ ID NO: 107278

SEQ ID NO: 213597 - RNA, 64 nt, hsa; identical to SEQ ID NO: 107279

SEQ ID NO: 213598 - RNA, 64 nt, hsa; identical to SEQ ID NO: 107280

SEQ ID NO: 213599 - RNA, 64 nt, hsa; identical to SEQ ID NO: 107281

SEQ ID NO: 213600 - RNA, 64 nt, hsa; identical to SEQ ID NO: 107282

SEQ ID NO: 213601 - RNA, 64 nt, hsa; identical to SEQ ID NO: 107283

SEQ ID NO: 213602 - RNA, 64 nt, hsa; identical to SEQ ID NO: 107284

SEQ ID NO: 213603 - RNA, 64 nt, hsa; identical to SEQ ID NO: 107285

SEQ ID NO: 213604 - RNA, 64 nt, hsa; identical to SEQ ID NO: 107286

SEQ ID NO: 213605 - RNA, 64 nt, hsa; identical to SEQ ID NO: 107287

SEQ ID NO: 213606 - RNA, 64 nt, hsa; identical to SEQ ID NO: 107288

SEQ ID NO: 213607 - RNA, 64 nt, hsa; identical to SEQ ID NO: 107289

SEQ ID NO: 213608 - RNA, 64 nt, hsa; identical to SEQ ID NO: 107290

SEQ ID NO: 213609 - RNA, 64 nt, hsa; identical to SEQ ID NO: 107291

SEQ ID NO: 213610 - RNA, 64 nt, hsa; identical to SEQ ID NO: 107292

SEQ ID NO: 213611 - RNA, 64 nt, hsa; identical to SEQ ID NO: 107293

SEQ ID NO: 213612 - RNA, 64 nt, hsa; identical to SEQ ID NO: 107294

SEQ ID NO: 213613 - RNA, 64 nt, hsa; identical to SEQ ID NO: 107295

SEQ ID NO: 213614 - RNA, 64 nt, hsa; identical to SEQ ID NO: 107296

SEQ ID NO: 213615 - RNA, 64 nt, hsa; identical to SEQ ID NO: 107297

SEQ ID NO: 213616 - RNA, 64 nt, hsa; identical to SEQ ID NO: 107298

SEQ ID NO: 213617 - RNA, 64 nt, hsa; identical to SEQ ID NO: 107299

SEQ ID NO: 213618 - RNA, 64 nt, hsa; identical to SEQ ID NO: 107300

SEQ ID NO: 213619 - RNA, 64 nt, hsa; identical to SEQ ID NO: 107301

SEQ ID NO: 213620 - RNA, 64 nt, hsa; identical to SEQ ID NO: 107302

SEQ ID NO: 213621 - RNA, 64 nt, hsa; identical to SEQ ID NO: 107303

SEQ ID NO: 213622 - RNA, 64 nt, hsa; identical to SEQ ID NO: 107304

SEQ ID NO: 213623 - RNA, 64 nt, hsa; identical to SEQ ID NO: 107305

SEQ ID NO: 213624 - RNA, 64 nt, hsa; identical to SEQ ID NO: 107306

SEQ ID NO: 213625 - RNA, 64 nt, hsa; identical to SEQ ID NO: 107307

SEQ ID NO: 213626 - RNA, 64 nt, hsa; identical to SEQ ID NO: 107308

SEQ ID NO: 213627 - RNA, 64 nt, hsa; identical to SEQ ID NO: 107309

SEQ ID NO: 213628 - RNA, 64 nt, hsa; identical to SEQ ID NO: 107310

SEQ ID NO: 213629 - RNA, 64 nt, hsa; identical to SEQ ID NO: 107311

SEQ ID NO: 213630 - RNA, 64 nt, hsa; identical to SEQ ID NO: 107312

SEQ ID NO: 213631 - RNA, 64 nt, hsa; identical to SEQ ID NO: 107313

SEQ ID NO: 213632 - RNA, 64 nt, hsa; identical to SEQ ID NO: 107314

SEQ ID NO: 213633 - RNA, 64 nt, hsa; identical to SEQ ID NO: 107315

SEQ ID NO: 213634 - RNA, 64 nt, hsa; identical to SEQ ID NO: 107316

SEQ ID NO: 213635 - RNA, 64 nt, hsa; identical to SEQ ID NO: 107317

SEQ ID NO: 213636 - RNA, 64 nt, hsa; identical to SEQ ID NO: 107318

SEQ ID NO: 213637 - RNA, 64 nt, hsa; identical to SEQ ID NO: 107319

SEQ ID NO: 213638 - RNA, 64 nt, hsa; identical to SEQ ID NO: 107320

SEQ ID NO: 213639 - RNA, 64 nt, hsa; identical to SEQ ID NO: 107321

SEQ ID NO: 213640 - RNA, 64 nt, hsa; identical to SEQ ID NO: 107322

SEQ ID NO: 213641 - RNA, 64 nt, hsa; identical to SEQ ID NO: 107323

SEQ ID NO: 213642 - RNA, 64 nt, hsa; identical to SEQ ID NO: 107324

SEQ ID NO: 213643 - RNA, 64 nt, hsa; identical to SEQ ID NO: 107325

SEQ ID NO: 213644 - RNA, 64 nt, hsa; identical to SEQ ID NO: 107326

SEQ ID NO: 213645 - RNA, 64 nt, hsa; identical to SEQ ID NO: 107327

SEQ ID NO: 213646 - RNA, 64 nt, hsa; identical to SEQ ID NO: 107328

SEQ ID NO: 213647 - RNA, 64 nt, hsa; identical to SEQ ID NO: 107329

SEQ ID NO: 213648 - RNA, 64 nt, hsa; identical to SEQ ID NO: 107330

SEQ ID NO: 213649 - RNA, 64 nt, hsa; identical to SEQ ID NO: 107331

SEQ ID NO: 213650 - RNA, 64 nt, hsa; identical to SEQ ID NO: 107332

SEQ ID NO: 213651 - RNA, 64 nt, hsa; identical to SEQ ID NO: 107333

SEQ ID NO: 213652 - RNA, 64 nt, hsa; identical to SEQ ID NO: 107334

SEQ ID NO: 213653 - RNA, 64 nt, hsa; identical to SEQ ID NO: 107335

SEQ ID NO: 213654 - RNA, 64 nt, hsa; identical to SEQ ID NO: 107336

SEQ ID NO: 213655 - RNA, 64 nt, hsa; identical to SEQ ID NO: 107337

SEQ ID NO: 213656 - RNA, 64 nt, hsa; identical to SEQ ID NO: 107338

SEQ ID NO: 213657 - RNA, 64 nt, hsa; identical to SEQ ID NO: 107339

SEQ ID NO: 213658 - RNA, 64 nt, hsa; identical to SEQ ID NO: 107340

SEQ ID NO: 213659 - RNA, 64 nt, hsa; identical to SEQ ID NO: 107341

SEQ ID NO: 213660 - RNA, 64 nt, hsa; identical to SEQ ID NO: 107342

SEQ ID NO: 213661 - RNA, 64 nt, hsa; identical to SEQ ID NO: 107343

SEQ ID NO: 213662 - RNA, 64 nt, hsa; identical to SEQ ID NO: 107344

SEQ ID NO: 213663 - RNA, 64 nt, hsa; identical to SEQ ID NO: 107345

SEQ ID NO: 213664 - RNA, 64 nt, hsa; identical to SEQ ID NO: 107346

SEQ ID NO: 213665 - RNA, 64 nt, hsa; identical to SEQ ID NO: 107347

SEQ ID NO: 213666 - RNA, 64 nt, hsa; identical to SEQ ID NO: 107348

SEQ ID NO: 213667 - RNA, 64 nt, hsa; identical to SEQ ID NO: 107349

SEQ ID NO: 213668 - RNA, 64 nt, hsa; identical to SEQ ID NO: 107350

SEQ ID NO: 213669 - RNA, 64 nt, hsa; identical to SEQ ID NO: 107351

SEQ ID NO: 213670 - RNA, 64 nt, hsa; identical to SEQ ID NO: 107352

SEQ ID NO: 213671 - RNA, 64 nt, hsa; identical to SEQ ID NO: 107353

SEQ ID NO: 213672 - RNA, 64 nt, hsa; identical to SEQ ID NO: 107354

SEQ ID NO: 213673 - RNA, 64 nt, hsa; identical to SEQ ID NO: 107355

SEQ ID NO: 213674 - RNA, 64 nt, hsa; identical to SEQ ID NO: 107356

SEQ ID NO: 213675 - RNA, 64 nt, hsa; identical to SEQ ID NO: 107357

SEQ ID NO: 213676 - RNA, 64 nt, hsa; identical to SEQ ID NO: 107358

SEQ ID NO: 213677 - RNA, 64 nt, hsa; identical to SEQ ID NO: 107359

SEQ ID NO: 213678 - RNA, 64 nt, hsa; identical to SEQ ID NO: 107360

SEQ ID NO: 213679 - RNA, 64 nt, hsa; identical to SEQ ID NO: 107361

SEQ ID NO: 213680 - RNA, 64 nt, hsa; identical to SEQ ID NO: 107362

SEQ ID NO: 213681 - RNA, 64 nt, hsa; identical to SEQ ID NO: 107363

SEQ ID NO: 213682 - RNA, 64 nt, hsa; identical to SEQ ID NO: 107364

SEQ ID NO: 213683 - RNA, 64 nt, hsa; identical to SEQ ID NO: 107365

SEQ ID NO: 213684 - RNA, 64 nt, hsa; identical to SEQ ID NO: 107366

SEQ ID NO: 213685 - RNA, 64 nt, hsa; identical to SEQ ID NO: 107367

SEQ ID NO: 213686 - RNA, 64 nt, hsa; identical to SEQ ID NO: 107368

SEQ ID NO: 213687 - RNA, 64 nt, hsa; identical to SEQ ID NO: 107369

SEQ ID NO: 213688 - RNA, 64 nt, hsa; identical to SEQ ID NO: 107370

SEQ ID NO: 213689 - RNA, 64 nt, hsa; identical to SEQ ID NO: 107371

SEQ ID NO: 213690 - RNA, 64 nt, hsa; identical to SEQ ID NO: 107372

SEQ ID NO: 213691 - RNA, 64 nt, hsa; identical to SEQ ID NO: 107373

SEQ ID NO: 213692 - RNA, 64 nt, hsa; identical to SEQ ID NO: 107374

SEQ ID NO: 213693 - RNA, 64 nt, hsa; identical to SEQ ID NO: 107375

SEQ ID NO: 213694 - RNA, 64 nt, hsa; identical to SEQ ID NO: 107376

SEQ ID NO: 213695 - RNA, 64 nt, hsa; identical to SEQ ID NO: 107377

SEQ ID NO: 213696 - RNA, 64 nt, hsa; identical to SEQ ID NO: 107378

SEQ ID NO: 213697 - RNA, 64 nt, hsa; identical to SEQ ID NO: 107379

SEQ ID NO: 213698 - RNA, 64 nt, hsa; identical to SEQ ID NO: 107380

SEQ ID NO: 213699 - RNA, 64 nt, hsa; identical to SEQ ID NO: 107381

SEQ ID NO: 213700 - RNA, 64 nt, hsa; identical to SEQ ID NO: 107382

SEQ ID NO: 213701 - RNA, 64 nt, hsa; identical to SEQ ID NO: 107383

SEQ ID NO: 213702 - RNA, 64 nt, hsa; identical to SEQ ID NO: 107384

SEQ ID NO: 213703 - RNA, 64 nt, hsa; identical to SEQ ID NO: 107385

SEQ ID NO: 213704 - RNA, 64 nt, hsa; identical to SEQ ID NO: 107386

SEQ ID NO: 213705 - RNA, 64 nt, hsa; identical to SEQ ID NO: 107387

SEQ ID NO: 213706 - RNA, 64 nt, hsa; identical to SEQ ID NO: 107388

SEQ ID NO: 213707 - RNA, 64 nt, hsa; identical to SEQ ID NO: 107389

SEQ ID NO: 213708 - RNA, 64 nt, hsa; identical to SEQ ID NO: 107390

SEQ ID NO: 213709 - RNA, 64 nt, hsa; identical to SEQ ID NO: 107391

SEQ ID NO: 213710 - RNA, 64 nt, hsa; identical to SEQ ID NO: 107392

SEQ ID NO: 213711 - RNA, 64 nt, hsa; identical to SEQ ID NO: 107393

SEQ ID NO: 213712 - RNA, 64 nt, hsa; identical to SEQ ID NO: 107394

SEQ ID NO: 213713 - RNA, 64 nt, hsa; identical to SEQ ID NO: 107395

SEQ ID NO: 213714 - RNA, 64 nt, hsa; identical to SEQ ID NO: 107396

SEQ ID NO: 213715 - RNA, 64 nt, hsa; identical to SEQ ID NO: 107397

SEQ ID NO: 213716 - RNA, 64 nt, hsa; identical to SEQ ID NO: 107398

SEQ ID NO: 213717 - RNA, 64 nt, hsa; identical to SEQ ID NO: 107399

SEQ ID NO: 213718 - RNA, 64 nt, hsa; identical to SEQ ID NO: 107400

SEQ ID NO: 213719 - RNA, 64 nt, hsa; identical to SEQ ID NO: 107401

SEQ ID NO: 213720 - RNA, 64 nt, hsa; identical to SEQ ID NO: 107402

SEQ ID NO: 213721 - RNA, 64 nt, hsa; identical to SEQ ID NO: 107403

SEQ ID NO: 213722 - RNA, 64 nt, hsa; identical to SEQ ID NO: 107404

SEQ ID NO: 213723 - RNA, 64 nt, hsa; identical to SEQ ID NO: 107405

SEQ ID NO: 213724 - RNA, 64 nt, hsa; identical to SEQ ID NO: 107406

SEQ ID NO: 213725 - RNA, 64 nt, hsa; identical to SEQ ID NO: 107407

SEQ ID NO: 213726 - RNA, 64 nt, hsa; identical to SEQ ID NO: 107408

SEQ ID NO: 213727 - RNA, 64 nt, hsa; identical to SEQ ID NO: 107409

SEQ ID NO: 213728 - RNA, 64 nt, hsa; identical to SEQ ID NO: 107410

SEQ ID NO: 213729 - RNA, 64 nt, hsa; identical to SEQ ID NO: 107411

SEQ ID NO: 213730 - RNA, 64 nt, hsa; identical to SEQ ID NO: 107412

SEQ ID NO: 213731 - RNA, 64 nt, hsa; identical to SEQ ID NO: 107413

SEQ ID NO: 213732 - RNA, 64 nt, hsa; identical to SEQ ID NO: 107414

SEQ ID NO: 213733 - RNA, 64 nt, hsa; identical to SEQ ID NO: 107415

SEQ ID NO: 213734 - RNA, 64 nt, hsa; identical to SEQ ID NO: 107416

SEQ ID NO: 213735 - RNA, 64 nt, hsa; identical to SEQ ID NO: 107417

SEQ ID NO: 213736 - RNA, 64 nt, hsa; identical to SEQ ID NO: 107418

SEQ ID NO: 213737 - RNA, 64 nt, hsa; identical to SEQ ID NO: 107419

SEQ ID NO: 213738 - RNA, 64 nt, hsa; identical to SEQ ID NO: 107420

SEQ ID NO: 213739 - RNA, 64 nt, hsa; identical to SEQ ID NO: 107421

SEQ ID NO: 213740 - RNA, 64 nt, hsa; identical to SEQ ID NO: 107422

SEQ ID NO: 213741 - RNA, 64 nt, hsa; identical to SEQ ID NO: 107423

SEQ ID NO: 213742 - RNA, 64 nt, hsa; identical to SEQ ID NO: 107424

SEQ ID NO: 213743 - RNA, 64 nt, hsa; identical to SEQ ID NO: 107425

SEQ ID NO: 213744 - RNA, 64 nt, hsa; identical to SEQ ID NO: 107426

SEQ ID NO: 213745 - RNA, 64 nt, hsa; identical to SEQ ID NO: 107427

SEQ ID NO: 213746 - RNA, 64 nt, hsa; identical to SEQ ID NO: 107428

SEQ ID NO: 213747 - RNA, 64 nt, hsa; identical to SEQ ID NO: 107429

SEQ ID NO: 213748 - RNA, 64 nt, hsa; identical to SEQ ID NO: 107430

SEQ ID NO: 213749 - RNA, 64 nt, hsa; identical to SEQ ID NO: 107431

SEQ ID NO: 213750 - RNA, 64 nt, hsa; identical to SEQ ID NO: 107432

SEQ ID NO: 213751 - RNA, 64 nt, hsa; identical to SEQ ID NO: 107433

SEQ ID NO: 213752 - RNA, 64 nt, hsa; identical to SEQ ID NO: 107434

SEQ ID NO: 213753 - RNA, 64 nt, hsa; identical to SEQ ID NO: 107435

SEQ ID NO: 213754 - RNA, 64 nt, hsa; identical to SEQ ID NO: 107436

SEQ ID NO: 213755 - RNA, 64 nt, hsa; identical to SEQ ID NO: 107437

SEQ ID NO: 213756 - RNA, 64 nt, hsa; identical to SEQ ID NO: 107438

SEQ ID NO: 213757 - RNA, 64 nt, hsa; identical to SEQ ID NO: 107439

SEQ ID NO: 213758 - RNA, 64 nt, hsa; identical to SEQ ID NO: 107440

SEQ ID NO: 213759 - RNA, 64 nt, hsa; identical to SEQ ID NO: 107441

SEQ ID NO: 213760 - RNA, 64 nt, hsa; identical to SEQ ID NO: 107442

SEQ ID NO: 213761 - RNA, 64 nt, hsa; identical to SEQ ID NO: 107443

SEQ ID NO: 213762 - RNA, 64 nt, hsa; identical to SEQ ID NO: 107444

SEQ ID NO: 213763 - RNA, 64 nt, hsa; identical to SEQ ID NO: 107445

SEQ ID NO: 213764 - RNA, 64 nt, hsa; identical to SEQ ID NO: 107446

SEQ ID NO: 213765 - RNA, 64 nt, hsa; identical to SEQ ID NO: 107447

SEQ ID NO: 213766 - RNA, 64 nt, hsa; identical to SEQ ID NO: 107448

SEQ ID NO: 213767 - RNA, 64 nt, hsa; identical to SEQ ID NO: 107449

SEQ ID NO: 213768 - RNA, 64 nt, hsa; identical to SEQ ID NO: 107450

SEQ ID NO: 213769 - RNA, 64 nt, hsa; identical to SEQ ID NO: 107451

SEQ ID NO: 213770 - RNA, 64 nt, hsa; identical to SEQ ID NO: 107452

SEQ ID NO: 213771 - RNA, 64 nt, hsa; identical to SEQ ID NO: 107453

SEQ ID NO: 213772 - RNA, 64 nt, hsa; identical to SEQ ID NO: 107454

SEQ ID NO: 213773 - RNA, 64 nt, hsa; identical to SEQ ID NO: 107455

SEQ ID NO: 213774 - RNA, 64 nt, hsa; identical to SEQ ID NO: 107456

SEQ ID NO: 213775 - RNA, 64 nt, hsa; identical to SEQ ID NO: 107457

SEQ ID NO: 213776 - RNA, 64 nt, hsa; identical to SEQ ID NO: 107458

SEQ ID NO: 213777 - RNA, 64 nt, hsa; identical to SEQ ID NO: 107459

SEQ ID NO: 213778 - RNA, 64 nt, hsa; identical to SEQ ID NO: 107460

SEQ ID NO: 213779 - RNA, 64 nt, hsa; identical to SEQ ID NO: 107461

SEQ ID NO: 213780 - RNA, 64 nt, hsa; identical to SEQ ID NO: 107462

SEQ ID NO: 213781 - RNA, 64 nt, hsa; identical to SEQ ID NO: 107463

SEQ ID NO: 213782 - RNA, 64 nt, hsa; identical to SEQ ID NO: 107464

SEQ ID NO: 213783 - RNA, 64 nt, hsa; identical to SEQ ID NO: 107465

SEQ ID NO: 213784 - RNA, 64 nt, hsa; identical to SEQ ID NO: 107466

SEQ ID NO: 213785 - RNA, 64 nt, hsa; identical to SEQ ID NO: 107467

SEQ ID NO: 213786 - RNA, 64 nt, hsa; identical to SEQ ID NO: 107468

SEQ ID NO: 213787 - RNA, 64 nt, hsa; identical to SEQ ID NO: 107469

SEQ ID NO: 213788 - RNA, 64 nt, hsa; identical to SEQ ID NO: 107470

SEQ ID NO: 213789 - RNA, 64 nt, hsa; identical to SEQ ID NO: 107471

SEQ ID NO: 213790 - RNA, 64 nt, hsa; identical to SEQ ID NO: 107472

SEQ ID NO: 213791 - RNA, 64 nt, hsa; identical to SEQ ID NO: 107473

SEQ ID NO: 213792 - RNA, 64 nt, hsa; identical to SEQ ID NO: 107474

SEQ ID NO: 213793 - RNA, 64 nt, hsa; identical to SEQ ID NO: 107475

SEQ ID NO: 213794 - RNA, 64 nt, hsa; identical to SEQ ID NO: 107476

SEQ ID NO: 213795 - RNA, 64 nt, hsa; identical to SEQ ID NO: 107477

SEQ ID NO: 213796 - RNA, 64 nt, hsa; identical to SEQ ID NO: 107478

SEQ ID NO: 213797 - RNA, 64 nt, hsa; identical to SEQ ID NO: 107479

SEQ ID NO: 213798 - RNA, 64 nt, hsa; identical to SEQ ID NO: 107480

SEQ ID NO: 213799 - RNA, 64 nt, hsa; identical to SEQ ID NO: 107481

SEQ ID NO: 213800 - RNA, 64 nt, hsa; identical to SEQ ID NO: 107482

SEQ ID NO: 213801 - RNA, 64 nt, hsa; identical to SEQ ID NO: 107483

SEQ ID NO: 213802 - RNA, 64 nt, hsa; identical to SEQ ID NO: 107484

SEQ ID NO: 213803 - RNA, 64 nt, hsa; identical to SEQ ID NO: 107485

SEQ ID NO: 213804 - RNA, 64 nt, hsa; identical to SEQ ID NO: 107486

SEQ ID NO: 213805 - RNA, 64 nt, hsa; identical to SEQ ID NO: 107487

SEQ ID NO: 213806 - RNA, 64 nt, hsa; identical to SEQ ID NO: 107488

SEQ ID NO: 213807 - RNA, 64 nt, hsa; identical to SEQ ID NO: 107489

SEQ ID NO: 213808 - RNA, 64 nt, hsa; identical to SEQ ID NO: 107490

SEQ ID NO: 213809 - RNA, 64 nt, hsa; identical to SEQ ID NO: 107491

SEQ ID NO: 213810 - RNA, 64 nt, hsa; identical to SEQ ID NO: 107492

SEQ ID NO: 213811 - RNA, 64 nt, hsa; identical to SEQ ID NO: 107493

SEQ ID NO: 213812 - RNA, 64 nt, hsa; identical to SEQ ID NO: 107494

SEQ ID NO: 213813 - RNA, 64 nt, hsa; identical to SEQ ID NO: 107495

SEQ ID NO: 213814 - RNA, 64 nt, hsa; identical to SEQ ID NO: 107496

SEQ ID NO: 213815 - RNA, 64 nt, hsa; identical to SEQ ID NO: 107497

SEQ ID NO: 213816 - RNA, 64 nt, hsa; identical to SEQ ID NO: 107498

SEQ ID NO: 213817 - RNA, 64 nt, hsa; identical to SEQ ID NO: 107499

SEQ ID NO: 213818 - RNA, 64 nt, hsa; identical to SEQ ID NO: 107500

SEQ ID NO: 213819 - RNA, 64 nt, hsa; identical to SEQ ID NO: 107501

SEQ ID NO: 213820 - RNA, 64 nt, hsa; identical to SEQ ID NO: 107502

SEQ ID NO: 213821 - RNA, 64 nt, hsa; identical to SEQ ID NO: 107503

SEQ ID NO: 213822 - RNA, 64 nt, hsa; identical to SEQ ID NO: 107504

SEQ ID NO: 213823 - RNA, 64 nt, hsa; identical to SEQ ID NO: 107505

SEQ ID NO: 213824 - RNA, 64 nt, hsa; identical to SEQ ID NO: 107506

SEQ ID NO: 213825 - RNA, 64 nt, hsa; identical to SEQ ID NO: 107507

SEQ ID NO: 213826 - RNA, 64 nt, hsa; identical to SEQ ID NO: 107508

SEQ ID NO: 213827 - RNA, 64 nt, hsa; identical to SEQ ID NO: 107509

SEQ ID NO: 213828 - RNA, 64 nt, hsa; identical to SEQ ID NO: 107510

SEQ ID NO: 213829 - RNA, 64 nt, hsa; identical to SEQ ID NO: 107511

SEQ ID NO: 213830 - RNA, 64 nt, hsa; identical to SEQ ID NO: 107512

SEQ ID NO: 213831 - RNA, 64 nt, hsa; identical to SEQ ID NO: 107513

SEQ ID NO: 213832 - RNA, 64 nt, hsa; identical to SEQ ID NO: 107514

SEQ ID NO: 213833 - RNA, 64 nt, hsa; identical to SEQ ID NO: 107515

SEQ ID NO: 213834 - RNA, 64 nt, hsa; identical to SEQ ID NO: 107516

SEQ ID NO: 213835 - RNA, 64 nt, hsa; identical to SEQ ID NO: 107517

SEQ ID NO: 213836 - RNA, 64 nt, hsa; identical to SEQ ID NO: 107518

SEQ ID NO: 213837 - RNA, 64 nt, hsa; identical to SEQ ID NO: 107519

SEQ ID NO: 213838 - RNA, 64 nt, hsa; identical to SEQ ID NO: 107520

SEQ ID NO: 213839 - RNA, 64 nt, hsa; identical to SEQ ID NO: 107521

SEQ ID NO: 213840 - RNA, 64 nt, hsa; identical to SEQ ID NO: 107522

SEQ ID NO: 213841 - RNA, 64 nt, hsa; identical to SEQ ID NO: 107523

SEQ ID NO: 213842 - RNA, 64 nt, hsa; identical to SEQ ID NO: 107524

SEQ ID NO: 213843 - RNA, 64 nt, hsa; identical to SEQ ID NO: 107525

SEQ ID NO: 213844 - RNA, 64 nt, hsa; identical to SEQ ID NO: 107526

SEQ ID NO: 213845 - RNA, 64 nt, hsa; identical to SEQ ID NO: 107527

SEQ ID NO: 213846 - RNA, 64 nt, hsa; identical to SEQ ID NO: 107528

SEQ ID NO: 213847 - RNA, 64 nt, hsa; identical to SEQ ID NO: 107529

SEQ ID NO: 213848 - RNA, 64 nt, hsa; identical to SEQ ID NO: 107530

SEQ ID NO: 213849 - RNA, 64 nt, hsa; identical to SEQ ID NO: 107531

SEQ ID NO: 213850 - RNA, 64 nt, hsa; identical to SEQ ID NO: 107532

SEQ ID NO: 213851 - RNA, 64 nt, hsa; identical to SEQ ID NO: 107533

SEQ ID NO: 213852 - RNA, 64 nt, hsa; identical to SEQ ID NO: 107534

SEQ ID NO: 213853 - RNA, 64 nt, hsa; identical to SEQ ID NO: 107535

SEQ ID NO: 213854 - RNA, 64 nt, hsa; identical to SEQ ID NO: 107536

SEQ ID NO: 213855 - RNA, 64 nt, hsa; identical to SEQ ID NO: 107537

SEQ ID NO: 213856 - RNA, 64 nt, hsa; identical to SEQ ID NO: 107538

SEQ ID NO: 213857 - RNA, 64 nt, hsa; identical to SEQ ID NO: 107539

SEQ ID NO: 213858 - RNA, 64 nt, hsa; identical to SEQ ID NO: 107540

SEQ ID NO: 213859 - RNA, 64 nt, hsa; identical to SEQ ID NO: 107541

SEQ ID NO: 213860 - RNA, 64 nt, hsa; identical to SEQ ID NO: 107542

SEQ ID NO: 213861 - RNA, 64 nt, hsa; identical to SEQ ID NO: 107543

SEQ ID NO: 213862 - RNA, 64 nt, hsa; identical to SEQ ID NO: 107544

SEQ ID NO: 213863 - RNA, 64 nt, hsa; identical to SEQ ID NO: 107545

SEQ ID NO: 213864 - RNA, 64 nt, hsa; identical to SEQ ID NO: 107546

SEQ ID NO: 213865 - RNA, 64 nt, hsa; identical to SEQ ID NO: 107547

SEQ ID NO: 213866 - RNA, 64 nt, hsa; identical to SEQ ID NO: 107548

SEQ ID NO: 213867 - RNA, 64 nt, hsa; identical to SEQ ID NO: 107549

SEQ ID NO: 213868 - RNA, 64 nt, hsa; identical to SEQ ID NO: 107550

SEQ ID NO: 213869 - RNA, 64 nt, hsa; identical to SEQ ID NO: 107551

SEQ ID NO: 213870 - RNA, 64 nt, hsa; identical to SEQ ID NO: 107552

SEQ ID NO: 213871 - RNA, 64 nt, hsa; identical to SEQ ID NO: 107553

SEQ ID NO: 213872 - RNA, 64 nt, hsa; identical to SEQ ID NO: 107554

SEQ ID NO: 213873 - RNA, 64 nt, hsa; identical to SEQ ID NO: 107555

SEQ ID NO: 213874 - RNA, 64 nt, hsa; identical to SEQ ID NO: 107556

SEQ ID NO: 213875 - RNA, 64 nt, hsa; identical to SEQ ID NO: 107557

SEQ ID NO: 213876 - RNA, 64 nt, hsa; identical to SEQ ID NO: 107558

SEQ ID NO: 213877 - RNA, 64 nt, hsa; identical to SEQ ID NO: 107559

SEQ ID NO: 213878 - RNA, 64 nt, hsa; identical to SEQ ID NO: 107560

SEQ ID NO: 213879 - RNA, 64 nt, hsa; identical to SEQ ID NO: 107561

SEQ ID NO: 213880 - RNA, 64 nt, hsa; identical to SEQ ID NO: 107562

SEQ ID NO: 213881 - RNA, 64 nt, hsa; identical to SEQ ID NO: 107563

SEQ ID NO: 213882 - RNA, 64 nt, hsa; identical to SEQ ID NO: 107564

SEQ ID NO: 213883 - RNA, 64 nt, hsa; identical to SEQ ID NO: 107565

SEQ ID NO: 213884 - RNA, 64 nt, hsa; identical to SEQ ID NO: 107566

SEQ ID NO: 213885 - RNA, 64 nt, hsa; identical to SEQ ID NO: 107567

SEQ ID NO: 213886 - RNA, 64 nt, hsa; identical to SEQ ID NO: 107568

SEQ ID NO: 213887 - RNA, 64 nt, hsa; identical to SEQ ID NO: 107569

SEQ ID NO: 213888 - RNA, 64 nt, hsa; identical to SEQ ID NO: 107570

SEQ ID NO: 213889 - RNA, 64 nt, hsa; identical to SEQ ID NO: 107571

SEQ ID NO: 213890 - RNA, 64 nt, hsa; identical to SEQ ID NO: 107572

SEQ ID NO: 213891 - RNA, 64 nt, hsa; identical to SEQ ID NO: 107573

SEQ ID NO: 213892 - RNA, 64 nt, hsa; identical to SEQ ID NO: 107574

SEQ ID NO: 213893 - RNA, 64 nt, hsa; identical to SEQ ID NO: 107575

SEQ ID NO: 213894 - RNA, 64 nt, hsa; identical to SEQ ID NO: 107576

SEQ ID NO: 213895 - RNA, 64 nt, hsa; identical to SEQ ID NO: 107577

SEQ ID NO: 213896 - RNA, 64 nt, hsa; identical to SEQ ID NO: 107578

SEQ ID NO: 213897 - RNA, 64 nt, hsa; identical to SEQ ID NO: 107579

SEQ ID NO: 213898 - RNA, 64 nt, hsa; identical to SEQ ID NO: 107580

SEQ ID NO: 213899 - RNA, 64 nt, hsa; identical to SEQ ID NO: 107581

SEQ ID NO: 213900 - RNA, 64 nt, hsa; identical to SEQ ID NO: 107582

SEQ ID NO: 213901 - RNA, 64 nt, hsa; identical to SEQ ID NO: 107583

SEQ ID NO: 213902 - RNA, 64 nt, hsa; identical to SEQ ID NO: 107584

SEQ ID NO: 213903 - RNA, 64 nt, hsa; identical to SEQ ID NO: 107585

SEQ ID NO: 213904 - RNA, 64 nt, hsa; identical to SEQ ID NO: 107586

SEQ ID NO: 213905 - RNA, 64 nt, hsa; identical to SEQ ID NO: 107587

SEQ ID NO: 213906 - RNA, 64 nt, hsa; identical to SEQ ID NO: 107588

SEQ ID NO: 213907 - RNA, 64 nt, hsa; identical to SEQ ID NO: 107589

SEQ ID NO: 213908 - RNA, 64 nt, hsa; identical to SEQ ID NO: 107590

SEQ ID NO: 213909 - RNA, 64 nt, hsa; identical to SEQ ID NO: 107591

SEQ ID NO: 213910 - RNA, 64 nt, hsa; identical to SEQ ID NO: 107592

SEQ ID NO: 213911 - RNA, 64 nt, hsa; identical to SEQ ID NO: 107593

SEQ ID NO: 213912 - RNA, 64 nt, hsa; identical to SEQ ID NO: 107594

SEQ ID NO: 213913 - RNA, 64 nt, hsa; identical to SEQ ID NO: 107595

SEQ ID NO: 213914 - RNA, 64 nt, hsa; identical to SEQ ID NO: 107596

SEQ ID NO: 213915 - RNA, 64 nt, hsa; identical to SEQ ID NO: 107597

SEQ ID NO: 213916 - RNA, 64 nt, hsa; identical to SEQ ID NO: 107598

SEQ ID NO: 213917 - RNA, 64 nt, hsa; identical to SEQ ID NO: 107599

SEQ ID NO: 213918 - RNA, 64 nt, hsa; identical to SEQ ID NO: 107600

SEQ ID NO: 213919 - RNA, 64 nt, hsa; identical to SEQ ID NO: 107601

SEQ ID NO: 213920 - RNA, 64 nt, hsa; identical to SEQ ID NO: 107602

SEQ ID NO: 213921 - RNA, 64 nt, hsa; identical to SEQ ID NO: 107603

SEQ ID NO: 213922 - RNA, 64 nt, hsa; identical to SEQ ID NO: 107604

SEQ ID NO: 213923 - RNA, 64 nt, hsa; identical to SEQ ID NO: 107605

SEQ ID NO: 213924 - RNA, 64 nt, hsa; identical to SEQ ID NO: 107606

SEQ ID NO: 213925 - RNA, 64 nt, hsa; identical to SEQ ID NO: 107607

SEQ ID NO: 213926 - RNA, 64 nt, hsa; identical to SEQ ID NO: 107608

SEQ ID NO: 213927 - RNA, 64 nt, hsa; identical to SEQ ID NO: 107609

SEQ ID NO: 213928 - RNA, 64 nt, hsa; identical to SEQ ID NO: 107610

SEQ ID NO: 213929 - RNA, 64 nt, hsa; identical to SEQ ID NO: 107611

SEQ ID NO: 213930 - RNA, 64 nt, hsa; identical to SEQ ID NO: 107612

SEQ ID NO: 213931 - RNA, 64 nt, hsa; identical to SEQ ID NO: 107613

SEQ ID NO: 213932 - RNA, 64 nt, hsa; identical to SEQ ID NO: 107614

SEQ ID NO: 213933 - RNA, 64 nt, hsa; identical to SEQ ID NO: 107615

SEQ ID NO: 213934 - RNA, 64 nt, hsa; identical to SEQ ID NO: 107616

SEQ ID NO: 213935 - RNA, 64 nt, hsa; identical to SEQ ID NO: 107617

SEQ ID NO: 213936 - RNA, 64 nt, hsa; identical to SEQ ID NO: 107618

SEQ ID NO: 213937 - RNA, 64 nt, hsa; identical to SEQ ID NO: 107619

SEQ ID NO: 213938 - RNA, 64 nt, hsa; identical to SEQ ID NO: 107620

SEQ ID NO: 213939 - RNA, 64 nt, hsa; identical to SEQ ID NO: 107621

SEQ ID NO: 213940 - RNA, 64 nt, hsa; identical to SEQ ID NO: 107622

SEQ ID NO: 213941 - RNA, 64 nt, hsa; identical to SEQ ID NO: 107623

SEQ ID NO: 213942 - RNA, 64 nt, hsa; identical to SEQ ID NO: 107624

SEQ ID NO: 213943 - RNA, 64 nt, hsa; identical to SEQ ID NO: 107625

SEQ ID NO: 213944 - RNA, 64 nt, hsa; identical to SEQ ID NO: 107626

SEQ ID NO: 213945 - RNA, 64 nt, hsa; identical to SEQ ID NO: 107627

SEQ ID NO: 213946 - RNA, 64 nt, hsa; identical to SEQ ID NO: 107628

SEQ ID NO: 213947 - RNA, 64 nt, hsa; identical to SEQ ID NO: 107629

SEQ ID NO: 213948 - RNA, 64 nt, hsa; identical to SEQ ID NO: 107630

SEQ ID NO: 213949 - RNA, 64 nt, hsa; identical to SEQ ID NO: 107631

SEQ ID NO: 213950 - RNA, 64 nt, hsa; identical to SEQ ID NO: 107632

SEQ ID NO: 213951 - RNA, 64 nt, hsa; identical to SEQ ID NO: 107633

SEQ ID NO: 213952 - RNA, 64 nt, hsa; identical to SEQ ID NO: 107634

SEQ ID NO: 213953 - RNA, 64 nt, hsa; identical to SEQ ID NO: 107635

SEQ ID NO: 213954 - RNA, 64 nt, hsa; identical to SEQ ID NO: 107636

SEQ ID NO: 213955 - RNA, 64 nt, hsa; identical to SEQ ID NO: 107637

SEQ ID NO: 213956 - RNA, 64 nt, hsa; identical to SEQ ID NO: 107638

SEQ ID NO: 213957 - RNA, 64 nt, hsa; identical to SEQ ID NO: 107639

SEQ ID NO: 213958 - RNA, 64 nt, hsa; identical to SEQ ID NO: 107640

SEQ ID NO: 213959 - RNA, 64 nt, hsa; identical to SEQ ID NO: 107641

SEQ ID NO: 213960 - RNA, 64 nt, hsa; identical to SEQ ID NO: 107642

SEQ ID NO: 213961 - RNA, 64 nt, hsa; identical to SEQ ID NO: 107643

SEQ ID NO: 213962 - RNA, 64 nt, hsa; identical to SEQ ID NO: 107644

SEQ ID NO: 213963 - RNA, 64 nt, hsa; identical to SEQ ID NO: 107645

SEQ ID NO: 213964 - RNA, 64 nt, hsa; identical to SEQ ID NO: 107646

SEQ ID NO: 213965 - RNA, 64 nt, hsa; identical to SEQ ID NO: 107647

SEQ ID NO: 213966 - RNA, 64 nt, hsa; identical to SEQ ID NO: 107648

SEQ ID NO: 213967 - RNA, 64 nt, hsa; identical to SEQ ID NO: 107649

SEQ ID NO: 213968 - RNA, 64 nt, hsa; identical to SEQ ID NO: 107650

SEQ ID NO: 213969 - RNA, 64 nt, hsa; identical to SEQ ID NO: 107651

SEQ ID NO: 213970 - RNA, 64 nt, hsa; identical to SEQ ID NO: 107652

SEQ ID NO: 213971 - RNA, 64 nt, hsa; identical to SEQ ID NO: 107653

SEQ ID NO: 213972 - RNA, 64 nt, hsa; identical to SEQ ID NO: 107654

SEQ ID NO: 213973 - RNA, 64 nt, hsa; identical to SEQ ID NO: 107655

SEQ ID NO: 213974 - RNA, 64 nt, hsa; identical to SEQ ID NO: 107656

SEQ ID NO: 213975 - RNA, 64 nt, hsa; identical to SEQ ID NO: 107657

SEQ ID NO: 213976 - RNA, 64 nt, hsa; identical to SEQ ID NO: 107658

SEQ ID NO: 213977 - RNA, 64 nt, hsa; identical to SEQ ID NO: 107659

SEQ ID NO: 213978 - RNA, 64 nt, hsa; identical to SEQ ID NO: 107660

SEQ ID NO: 213979 - RNA, 64 nt, hsa; identical to SEQ ID NO: 107661

SEQ ID NO: 213980 - RNA, 64 nt, hsa; identical to SEQ ID NO: 107662

SEQ ID NO: 213981 - RNA, 64 nt, hsa; identical to SEQ ID NO: 107663

SEQ ID NO: 213982 - RNA, 64 nt, hsa; identical to SEQ ID NO: 107664

SEQ ID NO: 213983 - RNA, 64 nt, hsa; identical to SEQ ID NO: 107665

SEQ ID NO: 213984 - RNA, 64 nt, hsa; identical to SEQ ID NO: 107666

SEQ ID NO: 213985 - RNA, 64 nt, hsa; identical to SEQ ID NO: 107667

SEQ ID NO: 213986 - RNA, 64 nt, hsa; identical to SEQ ID NO: 107668

SEQ ID NO: 213987 - RNA, 64 nt, hsa; identical to SEQ ID NO: 107669

SEQ ID NO: 213988 - RNA, 64 nt, hsa; identical to SEQ ID NO: 107670

SEQ ID NO: 213989 - RNA, 64 nt, hsa; identical to SEQ ID NO: 107671

SEQ ID NO: 213990 - RNA, 64 nt, hsa; identical to SEQ ID NO: 107672

SEQ ID NO: 213991 - RNA, 64 nt, hsa; identical to SEQ ID NO: 107673

SEQ ID NO: 213992 - RNA, 64 nt, hsa; identical to SEQ ID NO: 107674

SEQ ID NO: 213993 - RNA, 64 nt, hsa; identical to SEQ ID NO: 107675

SEQ ID NO: 213994 - RNA, 64 nt, hsa; identical to SEQ ID NO: 107676

SEQ ID NO: 213995 - RNA, 64 nt, hsa; identical to SEQ ID NO: 107677

SEQ ID NO: 213996 - RNA, 64 nt, hsa; identical to SEQ ID NO: 107678

SEQ ID NO: 213997 - RNA, 64 nt, hsa; identical to SEQ ID NO: 107679

SEQ ID NO: 213998 - RNA, 64 nt, hsa; identical to SEQ ID NO: 107680

SEQ ID NO: 213999 - RNA, 64 nt, hsa; identical to SEQ ID NO: 107681

SEQ ID NO: 214000 - RNA, 64 nt, hsa; identical to SEQ ID NO: 107682

SEQ ID NO: 214001 - RNA, 64 nt, hsa; identical to SEQ ID NO: 107683

SEQ ID NO: 214002 - RNA, 64 nt, hsa; identical to SEQ ID NO: 107684

SEQ ID NO: 214003 - RNA, 64 nt, hsa; identical to SEQ ID NO: 107685

SEQ ID NO: 214004 - RNA, 64 nt, hsa; identical to SEQ ID NO: 107686

SEQ ID NO: 214005 - RNA, 64 nt, hsa; identical to SEQ ID NO: 107687

SEQ ID NO: 214006 - RNA, 64 nt, hsa; identical to SEQ ID NO: 107688

SEQ ID NO: 214007 - RNA, 64 nt, hsa; identical to SEQ ID NO: 107689

SEQ ID NO: 214008 - RNA, 64 nt, hsa; identical to SEQ ID NO: 107690

SEQ ID NO: 214009 - RNA, 64 nt, hsa; identical to SEQ ID NO: 107691

SEQ ID NO: 214010 - RNA, 64 nt, hsa; identical to SEQ ID NO: 107692

SEQ ID NO: 214011 - RNA, 64 nt, hsa; identical to SEQ ID NO: 107693

SEQ ID NO: 214012 - RNA, 64 nt, hsa; identical to SEQ ID NO: 107694

SEQ ID NO: 214013 - RNA, 64 nt, hsa; identical to SEQ ID NO: 107695

SEQ ID NO: 214014 - RNA, 64 nt, hsa
aggcugcucaucugaccacugggcaccuuagugccaaccugaaccaaagagaccuccuuguuuc

SEQ ID NO: 214015 - RNA, 64 nt, hsa
gugggcggaucgccugaggucaggaguucaagaccaaccugacuaacauggugaaaccccaucu

SEQ ID NO: 214016 - RNA, 64 nt, hsa
ucuguagguggacccggucucccacaggugacaucaaccugaggguggcgucuuuagagacagg

SEQ ID NO: 214017 - RNA, 64 nt, hsa
uuaauccaagguacuggaaaaccuuccacaugcccaaccugagaccuguuccccaucgcuacca

SEQ ID NO: 214018 - RNA, 64 nt, hsa
uuaccacagaccccagcgucaggugggaguacugcaaccugacgcgaugcucagacagaaggga

SEQ ID NO: 214019 - RNA, 64 nt, hsa
acacaacugauccgugugugaggugggaguacugcaaccugacacaaugcucagaaacagaauc

SEQ ID NO: 214020 - RNA, 64 nt, hsa
acacgauggaucccaaagucagaugggaguacugcaaccugacacgaugcucagacacagaagg

SEQ ID NO: 214021 - RNA, 64 nt, hsa
auacaacggaucccaaagucaggugggaguacugcaaccugacaggaugcucagacaagaauag

SEQ ID NO: 214022 - RNA, 64 nt, hsa
acaacauuguaugugagagaaauauaaauauuuacaaccugauauucguuguuguuuuauuguu

SEQ ID NO: 214023 - RNA, 64 nt, hsa
gaucacaggcuauauucaugaaguuacuuuugaccaaccugaaaacugauaggauuuuguuugu

SEQ ID NO: 214024 - RNA, 64 nt, hsa
uucauggcagugcaagauugcaaaaaugacugugcaaccugaaacccaggaaagcagucuccau

SEQ ID NO: 214025 - RNA, 64 nt, hsa
cagugcuugccaauuucucuaguguaauaacucccaaccugaccaauuucacacugccaacagu

SEQ ID NO: 214026 - RNA, 64 nt, hsa; identical to SEQ ID NO: 98311

SEQ ID NO: 214027 - RNA, 64 nt, hsa; identical to SEQ ID NO: 98312

SEQ ID NO: 214028 - RNA, 64 nt, hsa; identical to SEQ ID NO: 98313

SEQ ID NO: 214029 - RNA, 64 nt, hsa; identical to SEQ ID NO: 98314

SEQ ID NO: 214030 - RNA, 64 nt, hsa; identical to SEQ ID NO: 98315

SEQ ID NO: 214031 - RNA, 64 nt, hsa; identical to SEQ ID NO: 98316

SEQ ID NO: 214032 - RNA, 64 nt, hsa; identical to SEQ ID NO: 98317

SEQ ID NO: 214033 - RNA, 64 nt, hsa; identical to SEQ ID NO: 98318

SEQ ID NO: 214034 - RNA, 64 nt, hsa; identical to SEQ ID NO: 98319

SEQ ID NO: 214035 - RNA, 64 nt, hsa; identical to SEQ ID NO: 98320

SEQ ID NO: 214036 - RNA, 64 nt, hsa; identical to SEQ ID NO: 98321

SEQ ID NO: 214037 - RNA, 64 nt, hsa; identical to SEQ ID NO: 98322

SEQ ID NO: 214038 - RNA, 64 nt, hsa; identical to SEQ ID NO: 98323

SEQ ID NO: 214039 - RNA, 64 nt, hsa; identical to SEQ ID NO: 98324

SEQ ID NO: 214040 - RNA, 64 nt, hsa; identical to SEQ ID NO: 98325

SEQ ID NO: 214041 - RNA, 64 nt, hsa; identical to SEQ ID NO: 98326

SEQ ID NO: 214042 - RNA, 64 nt, hsa; identical to SEQ ID NO: 98327

SEQ ID NO: 214043 - RNA, 64 nt, hsa; identical to SEQ ID NO: 98328

SEQ ID NO: 214044 - RNA, 64 nt, hsa; identical to SEQ ID NO: 98329

SEQ ID NO: 214045 - RNA, 64 nt, hsa; identical to SEQ ID NO: 98330

SEQ ID NO: 214046 - RNA, 64 nt, hsa; identical to SEQ ID NO: 98331

SEQ ID NO: 214047 - RNA, 64 nt, hsa; identical to SEQ ID NO: 98332

SEQ ID NO: 214048 - RNA, 64 nt, hsa; identical to SEQ ID NO: 98333

SEQ ID NO: 214049 - RNA, 64 nt, hsa; identical to SEQ ID NO: 98334

SEQ ID NO: 214050 - RNA, 64 nt, hsa; identical to SEQ ID NO: 98335

SEQ ID NO: 214051 - RNA, 64 nt, hsa; identical to SEQ ID NO: 98336

SEQ ID NO: 214052 - RNA, 64 nt, hsa; identical to SEQ ID NO: 98337

SEQ ID NO: 214053 - RNA, 64 nt, hsa; identical to SEQ ID NO: 98338

SEQ ID NO: 214054 - RNA, 64 nt, hsa; identical to SEQ ID NO: 98339

SEQ ID NO: 214055 - RNA, 64 nt, hsa; identical to SEQ ID NO: 98340

SEQ ID NO: 214056 - RNA, 64 nt, hsa; identical to SEQ ID NO: 98341

SEQ ID NO: 214057 - RNA, 64 nt, hsa; identical to SEQ ID NO: 98342

SEQ ID NO: 214058 - RNA, 64 nt, hsa; identical to SEQ ID NO: 98343

SEQ ID NO: 214059 - RNA, 64 nt, hsa; identical to SEQ ID NO: 98344

SEQ ID NO: 214060 - RNA, 64 nt, hsa; identical to SEQ ID NO: 98345

SEQ ID NO: 214061 - RNA, 64 nt, hsa; identical to SEQ ID NO: 98346

SEQ ID NO: 214062 - RNA, 64 nt, hsa; identical to SEQ ID NO: 98347

SEQ ID NO: 214063 - RNA, 64 nt, hsa; identical to SEQ ID NO: 98348

SEQ ID NO: 214064 - RNA, 64 nt, hsa; identical to SEQ ID NO: 98349

SEQ ID NO: 214065 - RNA, 64 nt, hsa; identical to SEQ ID NO: 98350

SEQ ID NO: 214066 - RNA, 64 nt, hsa; identical to SEQ ID NO: 98351

SEQ ID NO: 214067 - RNA, 64 nt, hsa; identical to SEQ ID NO: 98352

SEQ ID NO: 214068 - RNA, 64 nt, hsa; identical to SEQ ID NO: 98353

SEQ ID NO: 214069 - RNA, 64 nt, hsa; identical to SEQ ID NO: 98354

SEQ ID NO: 214070 - RNA, 64 nt, hsa; identical to SEQ ID NO: 98355

SEQ ID NO: 214071 - RNA, 64 nt, hsa; identical to SEQ ID NO: 98356

SEQ ID NO: 214072 - RNA, 64 nt, hsa; identical to SEQ ID NO: 98357

SEQ ID NO: 214073 - RNA, 64 nt, hsa; identical to SEQ ID NO: 98358

SEQ ID NO: 214074 - RNA, 64 nt, hsa; identical to SEQ ID NO: 98359

SEQ ID NO: 214075 - RNA, 64 nt, hsa; identical to SEQ ID NO: 98360

SEQ ID NO: 214076 - RNA, 64 nt, hsa; identical to SEQ ID NO: 98361

SEQ ID NO: 214077 - RNA, 64 nt, hsa; identical to SEQ ID NO: 98362

SEQ ID NO: 214078 - RNA, 64 nt, hsa; identical to SEQ ID NO: 98363

SEQ ID NO: 214079 - RNA, 64 nt, hsa; identical to SEQ ID NO: 98364

SEQ ID NO: 214080 - RNA, 64 nt, hsa; identical to SEQ ID NO: 98365

SEQ ID NO: 214081 - RNA, 64 nt, hsa; identical to SEQ ID NO: 98366

SEQ ID NO: 214082 - RNA, 64 nt, hsa; identical to SEQ ID NO: 98367

SEQ ID NO: 214083 - RNA, 64 nt, hsa; identical to SEQ ID NO: 98368

SEQ ID NO: 214084 - RNA, 64 nt, hsa; identical to SEQ ID NO: 98369

SEQ ID NO: 214085 - RNA, 64 nt, hsa; identical to SEQ ID NO: 98370

SEQ ID NO: 214086 - RNA, 64 nt, hsa; identical to SEQ ID NO: 98371

SEQ ID NO: 214087 - RNA, 64 nt, hsa; identical to SEQ ID NO: 98372

SEQ ID NO: 214088 - RNA, 64 nt, hsa; identical to SEQ ID NO: 98373

SEQ ID NO: 214089 - RNA, 64 nt, hsa; identical to SEQ ID NO: 98374

SEQ ID NO: 214090 - RNA, 64 nt, hsa; identical to SEQ ID NO: 98375

SEQ ID NO: 214091 - RNA, 64 nt, hsa; identical to SEQ ID NO: 98376

SEQ ID NO: 214092 - RNA, 64 nt, hsa; identical to SEQ ID NO: 98377

SEQ ID NO: 214093 - RNA, 64 nt, hsa; identical to SEQ ID NO: 98378

SEQ ID NO: 214094 - RNA, 64 nt, hsa; identical to SEQ ID NO: 98379

SEQ ID NO: 214095 - RNA, 64 nt, hsa; identical to SEQ ID NO: 98380

SEQ ID NO: 214096 - RNA, 64 nt, hsa; identical to SEQ ID NO: 98381

SEQ ID NO: 214097 - RNA, 64 nt, hsa; identical to SEQ ID NO: 98382

SEQ ID NO: 214098 - RNA, 64 nt, hsa; identical to SEQ ID NO: 98383

SEQ ID NO: 214099 - RNA, 64 nt, hsa; identical to SEQ ID NO: 98384

SEQ ID NO: 214100 - RNA, 64 nt, hsa; identical to SEQ ID NO: 98385

SEQ ID NO: 214101 - RNA, 64 nt, hsa; identical to SEQ ID NO: 98386

SEQ ID NO: 214102 - RNA, 64 nt, hsa; identical to SEQ ID NO: 98387

SEQ ID NO: 214103 - RNA, 64 nt, hsa; identical to SEQ ID NO: 98388

SEQ ID NO: 214104 - RNA, 64 nt, hsa; identical to SEQ ID NO: 98389

SEQ ID NO: 214105 - RNA, 64 nt, hsa; identical to SEQ ID NO: 98390

SEQ ID NO: 214106 - RNA, 64 nt, hsa; identical to SEQ ID NO: 98391

SEQ ID NO: 214107 - RNA, 64 nt, hsa; identical to SEQ ID NO: 98392

SEQ ID NO: 214108 - RNA, 64 nt, hsa; identical to SEQ ID NO: 98393

SEQ ID NO: 214109 - RNA, 64 nt, hsa; identical to SEQ ID NO: 98394

SEQ ID NO: 214110 - RNA, 64 nt, hsa; identical to SEQ ID NO: 98395

SEQ ID NO: 214111 - RNA, 64 nt, hsa; identical to SEQ ID NO: 98396

SEQ ID NO: 214112 - RNA, 64 nt, hsa; identical to SEQ ID NO: 98397

SEQ ID NO: 214113 - RNA, 64 nt, hsa; identical to SEQ ID NO: 98398

SEQ ID NO: 214114 - RNA, 64 nt, hsa; identical to SEQ ID NO: 98399

SEQ ID NO: 214115 - RNA, 64 nt, hsa; identical to SEQ ID NO: 98400

SEQ ID NO: 214116 - RNA, 64 nt, hsa; identical to SEQ ID NO: 98401

SEQ ID NO: 214117 - RNA, 64 nt, hsa; identical to SEQ ID NO: 98402

SEQ ID NO: 214118 - RNA, 64 nt, hsa; identical to SEQ ID NO: 98403

SEQ ID NO: 214119 - RNA, 64 nt, hsa; identical to SEQ ID NO: 98404

SEQ ID NO: 214120 - RNA, 64 nt, hsa; identical to SEQ ID NO: 98405

SEQ ID NO: 214121 - RNA, 64 nt, hsa; identical to SEQ ID NO: 98406

SEQ ID NO: 214122 - RNA, 64 nt, hsa; identical to SEQ ID NO: 98407

SEQ ID NO: 214123 - RNA, 64 nt, hsa; identical to SEQ ID NO: 98408

SEQ ID NO: 214124 - RNA, 64 nt, hsa; identical to SEQ ID NO: 98409

SEQ ID NO: 214125 - RNA, 64 nt, hsa; identical to SEQ ID NO: 98410

SEQ ID NO: 214126 - RNA, 64 nt, hsa; identical to SEQ ID NO: 98411

SEQ ID NO: 214127 - RNA, 64 nt, hsa; identical to SEQ ID NO: 98412

SEQ ID NO: 214128 - RNA, 64 nt, hsa; identical to SEQ ID NO: 98413

SEQ ID NO: 214129 - RNA, 64 nt, hsa; identical to SEQ ID NO: 98414

SEQ ID NO: 214130 - RNA, 64 nt, hsa; identical to SEQ ID NO: 98415

SEQ ID NO: 214131 - RNA, 64 nt, hsa; identical to SEQ ID NO: 98416

SEQ ID NO: 214132 - RNA, 64 nt, hsa; identical to SEQ ID NO: 98417

SEQ ID NO: 214133 - RNA, 64 nt, hsa; identical to SEQ ID NO: 98418

SEQ ID NO: 214134 - RNA, 64 nt, hsa; identical to SEQ ID NO: 98419

SEQ ID NO: 214135 - RNA, 64 nt, hsa; identical to SEQ ID NO: 98420

SEQ ID NO: 214136 - RNA, 64 nt, hsa; identical to SEQ ID NO: 98421

SEQ ID NO: 214137 - RNA, 64 nt, hsa; identical to SEQ ID NO: 98422

SEQ ID NO: 214138 - RNA, 64 nt, hsa; identical to SEQ ID NO: 98423

SEQ ID NO: 214139 - RNA, 64 nt, hsa; identical to SEQ ID NO: 98424

SEQ ID NO: 214140 - RNA, 64 nt, hsa; identical to SEQ ID NO: 98425

SEQ ID NO: 214141 - RNA, 64 nt, hsa; identical to SEQ ID NO: 98426

SEQ ID NO: 214142 - RNA, 64 nt, hsa; identical to SEQ ID NO: 98427

SEQ ID NO: 214143 - RNA, 64 nt, hsa; identical to SEQ ID NO: 98428

SEQ ID NO: 214144 - RNA, 64 nt, hsa; identical to SEQ ID NO: 98429

SEQ ID NO: 214145 - RNA, 64 nt, hsa; identical to SEQ ID NO: 98430

SEQ ID NO: 214146 - RNA, 64 nt, hsa; identical to SEQ ID NO: 98431

SEQ ID NO: 214147 - RNA, 64 nt, hsa; identical to SEQ ID NO: 98432

SEQ ID NO: 214148 - RNA, 64 nt, hsa; identical to SEQ ID NO: 98433

SEQ ID NO: 214149 - RNA, 64 nt, hsa; identical to SEQ ID NO: 98434

SEQ ID NO: 214150 - RNA, 64 nt, hsa; identical to SEQ ID NO: 98435

SEQ ID NO: 214151 - RNA, 64 nt, hsa; identical to SEQ ID NO: 98436

SEQ ID NO: 214152 - RNA, 64 nt, hsa; identical to SEQ ID NO: 98437

SEQ ID NO: 214153 - RNA, 64 nt, hsa; identical to SEQ ID NO: 98438

SEQ ID NO: 214154 - RNA, 64 nt, hsa; identical to SEQ ID NO: 98439

SEQ ID NO: 214155 - RNA, 64 nt, hsa; identical to SEQ ID NO: 98440

SEQ ID NO: 214156 - RNA, 64 nt, hsa; identical to SEQ ID NO: 98441

SEQ ID NO: 214157 - RNA, 64 nt, hsa; identical to SEQ ID NO: 98442

SEQ ID NO: 214158 - RNA, 64 nt, hsa; identical to SEQ ID NO: 98443

SEQ ID NO: 214159 - RNA, 64 nt, hsa; identical to SEQ ID NO: 98444

SEQ ID NO: 214160 - RNA, 64 nt, hsa; identical to SEQ ID NO: 98445

SEQ ID NO: 214161 - RNA, 64 nt, hsa; identical to SEQ ID NO: 98446

SEQ ID NO: 214162 - RNA, 64 nt, hsa; identical to SEQ ID NO: 98447

SEQ ID NO: 214163 - RNA, 64 nt, hsa; identical to SEQ ID NO: 98448

SEQ ID NO: 214164 - RNA, 64 nt, hsa; identical to SEQ ID NO: 98449

SEQ ID NO: 214165 - RNA, 64 nt, hsa; identical to SEQ ID NO: 98450

SEQ ID NO: 214166 - RNA, 64 nt, hsa; identical to SEQ ID NO: 98451

SEQ ID NO: 214167 - RNA, 64 nt, hsa; identical to SEQ ID NO: 98452

SEQ ID NO: 214168 - RNA, 64 nt, hsa; identical to SEQ ID NO: 98453

SEQ ID NO: 214169 - RNA, 64 nt, hsa; identical to SEQ ID NO: 98454

SEQ ID NO: 214170 - RNA, 64 nt, hsa; identical to SEQ ID NO: 98455

SEQ ID NO: 214171 - RNA, 64 nt, hsa; identical to SEQ ID NO: 98456

SEQ ID NO: 214172 - RNA, 64 nt, hsa; identical to SEQ ID NO: 98457

SEQ ID NO: 214173 - RNA, 64 nt, hsa; identical to SEQ ID NO: 98458

SEQ ID NO: 214174 - RNA, 64 nt, hsa; identical to SEQ ID NO: 98459

SEQ ID NO: 214175 - RNA, 64 nt, hsa; identical to SEQ ID NO: 98460

SEQ ID NO: 214176 - RNA, 64 nt, hsa; identical to SEQ ID NO: 98461

SEQ ID NO: 214177 - RNA, 64 nt, hsa; identical to SEQ ID NO: 98462

SEQ ID NO: 214178 - RNA, 64 nt, hsa; identical to SEQ ID NO: 98463

SEQ ID NO: 214179 - RNA, 64 nt, hsa; identical to SEQ ID NO: 98464

SEQ ID NO: 214180 - RNA, 64 nt, hsa; identical to SEQ ID NO: 98465

SEQ ID NO: 214181 - RNA, 64 nt, hsa; identical to SEQ ID NO: 98466

SEQ ID NO: 214182 - RNA, 64 nt, hsa; identical to SEQ ID NO: 98467

SEQ ID NO: 214183 - RNA, 64 nt, hsa; identical to SEQ ID NO: 98468

SEQ ID NO: 214184 - RNA, 64 nt, hsa; identical to SEQ ID NO: 98469

SEQ ID NO: 214185 - RNA, 64 nt, hsa; identical to SEQ ID NO: 98470

SEQ ID NO: 214186 - RNA, 64 nt, hsa; identical to SEQ ID NO: 98471

SEQ ID NO: 214187 - RNA, 64 nt, hsa; identical to SEQ ID NO: 98472

SEQ ID NO: 214188 - RNA, 64 nt, hsa; identical to SEQ ID NO: 98473

SEQ ID NO: 214189 - RNA, 64 nt, hsa; identical to SEQ ID NO: 98474

SEQ ID NO: 214190 - RNA, 64 nt, hsa; identical to SEQ ID NO: 98475

SEQ ID NO: 214191 - RNA, 64 nt, hsa; identical to SEQ ID NO: 98476

SEQ ID NO: 214192 - RNA, 64 nt, hsa; identical to SEQ ID NO: 98477

SEQ ID NO: 214193 - RNA, 64 nt, hsa; identical to SEQ ID NO: 98478

SEQ ID NO: 214194 - RNA, 64 nt, hsa; identical to SEQ ID NO: 98479

SEQ ID NO: 214195 - RNA, 64 nt, hsa; identical to SEQ ID NO: 98480

SEQ ID NO: 214196 - RNA, 64 nt, hsa; identical to SEQ ID NO: 98481

SEQ ID NO: 214197 - RNA, 64 nt, hsa; identical to SEQ ID NO: 98482

SEQ ID NO: 214198 - RNA, 64 nt, hsa; identical to SEQ ID NO: 98483

SEQ ID NO: 214199 - RNA, 64 nt, hsa; identical to SEQ ID NO: 98484

SEQ ID NO: 214200 - RNA, 64 nt, hsa; identical to SEQ ID NO: 98485

SEQ ID NO: 214201 - RNA, 64 nt, hsa; identical to SEQ ID NO: 98486

SEQ ID NO: 214202 - RNA, 64 nt, hsa; identical to SEQ ID NO: 98487

SEQ ID NO: 214203 - RNA, 64 nt, hsa; identical to SEQ ID NO: 98488

SEQ ID NO: 214204 - RNA, 64 nt, hsa; identical to SEQ ID NO: 98489

SEQ ID NO: 214205 - RNA, 64 nt, hsa; identical to SEQ ID NO: 98490

SEQ ID NO: 214206 - RNA, 64 nt, hsa; identical to SEQ ID NO: 98491

SEQ ID NO: 214207 - RNA, 64 nt, hsa; identical to SEQ ID NO: 98492

SEQ ID NO: 214208 - RNA, 64 nt, hsa; identical to SEQ ID NO: 98493

SEQ ID NO: 214209 - RNA, 64 nt, hsa; identical to SEQ ID NO: 98494

SEQ ID NO: 214210 - RNA, 64 nt, hsa; identical to SEQ ID NO: 98495

SEQ ID NO: 214211 - RNA, 64 nt, hsa; identical to SEQ ID NO: 98496

SEQ ID NO: 214212 - RNA, 64 nt, hsa; identical to SEQ ID NO: 98497

SEQ ID NO: 214213 - RNA, 64 nt, hsa; identical to SEQ ID NO: 98498

SEQ ID NO: 214214 - RNA, 64 nt, hsa; identical to SEQ ID NO: 98499

SEQ ID NO: 214215 - RNA, 64 nt, hsa; identical to SEQ ID NO: 98500

SEQ ID NO: 214216 - RNA, 64 nt, hsa; identical to SEQ ID NO: 98501

SEQ ID NO: 214217 - RNA, 64 nt, hsa; identical to SEQ ID NO: 98502

SEQ ID NO: 214218 - RNA, 64 nt, hsa; identical to SEQ ID NO: 98503

SEQ ID NO: 214219 - RNA, 64 nt, hsa; identical to SEQ ID NO: 98504

SEQ ID NO: 214220 - RNA, 63 nt, hsa
uauccccagcccuuggcaacacuggagugcacacgccgccacgguugcccagaaaaagugccc

SEQ ID NO: 214221 - RNA, 63 nt, hsa
ggaaggugcagcuuuuccauaucagcucaaccacgccgccaguccauucuuaaggaacugccg

SEQ ID NO: 214222 - RNA, 63 nt, hsa
aggcauugccaagccccccgagugaggacgcaccgccgccaccagcccgcaacucuccagccg

SEQ ID NO: 214223 - RNA, 63 nt, hsa
agcccaggcagcaccagcgcggccacgugcacgcgccgccacuacgagagguacggcggggcg

SEQ ID NO: 214224 - RNA, 63 nt, hsa
ucagccugccgagugccugcgauuacaggcgcgcgccgccacaccugacugguuuucguauuu

SEQ ID NO: 214225 - RNA, 54 nt, hsa
ccaaacugacgcaucuguagcggccgccgccagcccgaacucgcggcaaaauua

SEQ ID NO: 214226 - RNA, 63 nt, hsa
cugcccaggccuuuguuaggaaaacccaugggccgccgccacacucagugccauggggaagcg

SEQ ID NO: 214227 - RNA, 59 nt, hsa
agauacagguggacgauugaagacaaagccgccgccaauccugggcucuggggcccugg

SEQ ID NO: 214228 - RNA, 63 nt, hsa
cugguccucucgcaggaaugcugcugcugccuccgccgccacugcugcugccaccucuuauau

SEQ ID NO: 214229 - RNA, 63 nt, hsa
gcaggcucaccugggacucaacguuccuucccccgccgccacugugccccccgucccuccacc

SEQ ID NO: 214230 - RNA, 63 nt, hsa
cgcgacgccggccccggucgcagccgacgacgccgccgccagccugaccucacacccucuggg

SEQ ID NO: 214231 - RNA, 63 nt, hsa
ccgcgggcgggggcugcagggccgugccgccgccgccgccaggcacuccggagcuguccgcuu

SEQ ID NO: 214232 - RNA, 63 nt, hsa
gcuucauucgagagcugcugccaaaacgccuggcgccgccaccgucgggggcuggcuucgagg

SEQ ID NO: 214233 - RNA, 63 nt, hsa
gcugccccggguggugagcgggcaggaaccuggcgccgccaccgagacugagccuccugcaga

SEQ ID NO: 214234 - RNA, 59 nt, hsa
agcaagcaggcgaaucguaaugaggcgugcgccgccaauaugcacuguacauuccacaa

SEQ ID NO: 214235 - RNA, 63 nt, hsa
ucagccucccaaguagcugugacuaaaggugcacgccgccaugcccagcuaauuuuuuguauu

SEQ ID NO: 214236 - RNA, 63 nt, hsa
ugcuggacgugucccggagacccaccgggagggcgccgccaugccuuguacccccaccgugca

SEQ ID NO: 214237 - RNA, 63 nt, hsa
cauuaaucccaggaaccacuagcaguaguggggcgccgccaaucuaacaugagcacaggugcu

SEQ ID NO: 214238 - RNA, 63 nt, hsa
gcccagugacagaaagaacagccucugucaccccgccgccacugccuugguuacucagagcac

SEQ ID NO: 214239 - RNA, 63 nt, hsa
caggaguagggaggaaaaggaguucuggagaggcgccgccauccuguuuucuggaaaggcugc

SEQ ID NO: 214240 - RNA, 63 nt, hsa
ucagccugcugaguagcugguauacaggcacaucgccgccacacccagcucauuuuuguauua

SEQ ID NO: 214241 - RNA, 63 nt, hsa
gggaacucuccccauuggcaaaccggacccggccgccgccaggacuguguuuccaaagguucc

SEQ ID NO: 214242 - RNA, 63 nt, hsa
accccgugccucucgugguccuuugagggaucccgccgccaccacccuuguauuuuaucacgu

SEQ ID NO: 214243 - RNA, 63 nt, hsa
gcaagugcuggagucuccugaggacacgcgcgucgccgccaccgcgggugugggaaagcgcgg

SEQ ID NO: 214244 - RNA, 63 nt, hsa
caggcucaggcggccccacucacccacagcauccgccgccaccccuucgggugugagcgcuca

SEQ ID NO: 214245 - RNA, 63 nt, hsa
uuuuacaaaggggaaugguucuccagugcagcccgccgccacuggagugcccuguauggaagu

SEQ ID NO: 214246 - RNA, 63 nt, hsa
gccgcuccagaagggugcccagucaggccgcaccgccgccagccuccuccggcccuggaggga

SEQ ID NO: 214247 - RNA, 63 nt, hsa
cuuucacugcggucccgcuuagcgacccgccgccgccgccaagcgaggcugaggacuccgauc

SEQ ID NO: 214248 - RNA, 63 nt, hsa
agccgcggguugacgacgguguccucgcagugucgccgccaccccagcguaguccaagucaga

SEQ ID NO: 214249 - RNA, 63 nt, hsa
ccacacccggugcccacaucccgccgccgccgccgccgccaugcccaagagaaagacugaagg

SEQ ID NO: 214250 - RNA, 63 nt, hsa
uggcccaguccugggccucggcccuucccgcaccgccgccagcgcccgcagacacccuggcau

SEQ ID NO: 214251 - RNA, 63 nt, hsa
gguggugcugggggaggcaccccacagacucagcgccgccagagauaggguuuuuggagggcu

SEQ ID NO: 214252 - RNA, 63 nt, hsa
gaaguauguagggugggcagaagccacagucgccgccgccaggggcuugcuccuggcucuguc

SEQ ID NO: 214253 - RNA, 63 nt, hsa
gcauaccugcugguguguaaguguggacuaacccgccgccaccacccucuguuccagcaggcu

SEQ ID NO: 214254 - RNA, 63 nt, hsa
gcucucacucagcucccacgggacucagaagugcgccgccaugcugccuaggguacugucccc

SEQ ID NO: 214255 - RNA, 63 nt, hsa
gcacgccgcccuccgccacgccacagccacagccgccgccaucacucgcucgcccucccgcuu

SEQ ID NO: 214256 - RNA, 63 nt, hsa
aggcugcuggcuucagggaggguuagccugcaccgccgccacccugccccuaaguuauuaccu

SEQ ID NO: 214257 - RNA, 63 nt, hsa
ucagccugccgagugccugcaauugcaggcgagcgccgccacgccugacugccucggccuccc

SEQ ID NO: 214258 - RNA, 63 nt, hsa
guucugucugccaccugaagggaauuugaggaccgccgccagggcaccccguacauacacaca

SEQ ID NO: 214259 - RNA, 63 nt, hsa
ccagcccacccagccaguggucgagcacugccccgccgccaaagucugcagaaugugagauga

SEQ ID NO: 214260 - RNA, 63 nt, hsa
gccuccuccgggaagccuucccugcccagcccacgccgccaccgggaggaagccugacugucc

SEQ ID NO: 214261 - RNA, 55 nt, hsa
gcgcccuggcccuggccugagcccacgccgccaggaggcagggagggcuccgccg

SEQ ID NO: 214262 - RNA, 60 nt, hsa
aggccacaagaggaagcugaaugaagaggacgccgccagcgaguccagcagggaguccag

SEQ ID NO: 214263 - RNA, 63 nt, hsa
gacccggcucugagcgccccgcagcccggccgccgccgccaagcaucuguccccuccuccccc

SEQ ID NO: 214264 - RNA, 63 nt, hsa
gcacccacccagcugggguguuuuugggggagucgccgccaagcccaggcugcuggagccagg

SEQ ID NO: 214265 - RNA, 57 nt, hsa
ugccugugcccgucauguaaucucacccgccgccacuagguguccccaacguccccu

SEQ ID NO: 214266 - RNA, 63 nt, hsa
cugaagugccagcaccaccagcaccagauccuccgccgccacaccgcacugaggacacgccgg

SEQ ID NO: 214267 - RNA, 63 nt, hsa
ucagccuccugaguagcugggauuacaggugugcgccgccacacccagcuaauuuuguauuuu

SEQ ID NO: 214268 - RNA, 63 nt, hsa
agcagguccgcauccaggagaugcugcuucaggcgccgccacugggccccgggacccccacgg

SEQ ID NO: 214269 - RNA, 63 nt, hsa
cgcggcacccggagccacagcuggcggggucuccgccgccagcccugcagcgggccggccaga

SEQ ID NO: 214270 - RNA, 63 nt, hsa
agaaucuggcucucaggguggcuucugcguccccgccgccaggccccagacuauggucacagg

SEQ ID NO: 214271 - RNA, 63 nt, hsa
ucaacaucugguaccagcacuccgcggcggggccgccgccagcucccccagacccccuccacc

SEQ ID NO: 214272 - RNA, 63 nt, hsa
ccuccacccccuccaacucugcuccucuagggccgccgccaccuccccugggaccccgccccc

SEQ ID NO: 214273 - RNA, 63 nt, hsa
gccuugguccccagaagauggcggcuagggccucgccgccaggacagagaagggacggggugg

SEQ ID NO: 214274 - RNA, 63 nt, hsa
cagcuuugguaucuggagauuuccagggccccucgccgccacguccugacucucgggugaucu

SEQ ID NO: 214275 - RNA, 63 nt, hsa
ggagcccugucccuguugcuguggccccucucacgccgccaucucucugccccgccccgcccc

SEQ ID NO: 214276 - RNA, 63 nt, hsa
uuucugcucagugugauccugagauggcuuccccgccgccacccagagugugguccuuggccg

SEQ ID NO: 214277 - RNA, 63 nt, hsa
cugcccacagagggccgagggucacccgucggccgccgccaccccaggcgaggccggaggaag

SEQ ID NO: 214278 - RNA, 63 nt, hsa
cguugcagcccagagccacuggucccuacagggcgccgccacaccagcaggaaggaggauggc

SEQ ID NO: 214279 - RNA, 63 nt, hsa
caauccggagaaggggcucuguccacagucccccgccgccagguggcccacaugggaccagca

SEQ ID NO: 214280 - RNA, 63 nt, hsa
gcugcccagggcuggaggggacgcuguuccucccgccgccacugcccaaccuuuccugauaau

SEQ ID NO: 214281 - RNA, 63 nt, hsa
ggccagcacggaccacccaaggccucugcuucccgccgccacccuccucgcugccauucucug

SEQ ID NO: 214282 - RNA, 63 nt, hsa
gccaucccugcaggccagggcacacggugcgcccgccgccagcuccucggaggccagacccag

SEQ ID NO: 214283 - RNA, 63 nt, hsa
gccagguguguguacauacggggucucucuccacgccgccaagccagccgggcggccgacccg

SEQ ID NO: 214284 - RNA, 59 nt, hsa; identical to SEQ ID NO: 214234

SEQ ID NO: 214285 - RNA, 63 nt, hsa
cucaccagaggaugccaccuccgcccccacccccgccgccagaggaguacaagagccagaggc

SEQ ID NO: 214286 - RNA, 63 nt, hsa
cgacccucgggccucgggggggagggcccugcacgccgccacccccuccccgcagcccucacc

SEQ ID NO: 214287 - RNA, 64 nt, hsa
gugcgagcuacugcucccagcaagagccaagauuuuaaccuagaucucccuaacaccaaagcuu

SEQ ID NO: 214288 - RNA, 64 nt, hsa
auuuuuguuagccuaugaaaaaaaaaacauuuuguuaaccuauggaaaaagccuuggaagagaa

SEQ ID NO: 214289 - RNA, 64 nt, hsa
uucugggcuaucuuagcuaacuuauccuaaacccuuaaccuaaauuuaacuugagccccagucu

SEQ ID NO: 214290 - RNA, 64 nt, hsa
ggauuccaugugaaaauaaaauaugaggaaaaguuuaaccuaaauaauuagaaucccauuagag

SEQ ID NO: 214291 - RNA, 64 nt, hsa
uaaauggagcacuuagaaauuuguuguucugcacuuaaccuagagagagaaaaaaugcuuuucu

SEQ ID NO: 214292 - RNA, 64 nt, hsa
uuucugccaaaacaauaaucaaagaacucuugcuuuaaccuauuccuguacaaagacuguuuuu

SEQ ID NO: 214293 - RNA, 64 nt, hsa
aauuuaccuuuuaauaaauuaaaaaaucuaaauuuuaaccuacuuguauguucggagaguguuu

SEQ ID NO: 214294 - RNA, 64 nt, hsa
uaguugaauucaucuacguuuguuuaauauuaacuuaaccuauucuauuguauuauaaugauga

SEQ ID NO: 214295 - RNA, 64 nt, hsa
aaaggaccugcguuggacaacaauaaagaaaaauuuaaccuaucaugcacuguacacauuuccu

SEQ ID NO: 214296 - RNA, 64 nt, hsa
ccuaauccuauuaucuuucaaugguuaccuugacuuaaccuauugaguuaccuggucagcacug

SEQ ID NO: 214297 - RNA, 64 nt, hsa
gauuacaucacugauugguaaugguuagaaaccauuaaccuaaaacuuacuauuuaaccuagug

SEQ ID NO: 214298 - RNA, 64 nt, hsa
aaugguuagaaaccauuaaccuaaaacuuacuauuuaaccuaguguuuuuguugaugagguuua

SEQ ID NO: 214299 - RNA, 64 nt, hsa
auugccccugaucuuuuccauuuuuguuuccaccuuaaccuauagcagcuccuccaaaugagga

SEQ ID NO: 214300 - RNA, 64 nt, hsa
cugucccaaagugcugcuuccuaauaggaauucauuaaccuaaaacaagauguuacuauuauau

SEQ ID NO: 214301 - RNA, 64 nt, hsa
guaguuguuuccagguuuggcuaauaaucauuccuuaaccuagaauucagaugauccuggaauu

SEQ ID NO: 214302 - RNA, 64 nt, hsa
cuagcagcuacuaaaauagagaagaaauugagggcaaaguaauaugucuccaaaacugaacuga

SEQ ID NO: 214303 - RNA, 64 nt, hsa
ucugaugccuacccuagguugggaaccacucuuucaaaguaaacagugaugacacagcauuugc

SEQ ID NO: 214304 - RNA, 60 nt, hsa
acauggauaauagugaaugaaagcagaaagcaaaguaauaaaaucacaaauguuuggaaa

SEQ ID NO: 214305 - RNA, 64 nt, hsa
cugagaauuuuuaguacuaaagagcacagcugcucaaaguaaagccugagcaguguucucagua

SEQ ID NO: 214306 - RNA, 64 nt, hsa
gugacuggcauuaacaagacuggaaaucgggggucaaaguaaaauaucuuuguuuugcuuucau

SEQ ID NO: 214307 - RNA, 64 nt, hsa
ucaaaguaaaauaucuuuguuuugcuuucauucacaaaguaaugaagccagcugccaauuacau

SEQ ID NO: 214308 - RNA, 64 nt, hsa
uggauuguuuuucccuaaucuuccgucaaguacacaaaguaacuuugcgggauauuuaggguac

SEQ ID NO: 214309 - RNA, 64 nt, hsa
ugucuuuccuuaucauuggugggaggcuugguagcaaaguaacauuuuuuggaaaagaggacag

SEQ ID NO: 214310 - RNA, 64 nt, hsa
ugaccuuauuucaacacauucuaagaagccuugacaaaguaaguauauuuuagagcugaaucag

SEQ ID NO: 214311 - RNA, 64 nt, hsa
augaugaagaaaguuccugauuugagaaaugaaucaaaguaauuuuaaugaauuuuuagcuugu

SEQ ID NO: 214312 - RNA, 64 nt, hsa
aagagcugcuguccuuuuaggaauauguucaaugcaaaguaaaaaaauaugaauuguccccaau

SEQ ID NO: 214313 - RNA, 64 nt, hsa
cucccaauaacuaaugcuaagaaaugcugaaaaucaaaguaaaaaauuaaagcccauaaggcca

SEQ ID NO: 214314 - RNA, 64 nt, hsa
caguaacuauccacaaacucaccuuauguuacuccaaaguaauaguaggggauaaacccauaga

SEQ ID NO: 214315 - RNA, 64 nt, hsa
uuaggaaacuagaaaaagaagagcaaauuaaauccaaaguaaccugaaaaaacauuagaguaaa

SEQ ID NO: 214316 - RNA, 64 nt, hsa
uuggaaaacuagaaaaagaagagcaaauuaaauccaaaguaaccuggaaaaaaauuagaguaaa

SEQ ID NO: 214317 - RNA, 64 nt, hsa
caauaacuauccacaaacucgccuuauguuacuccaaaguaacaguaggggauaaacccauaga

SEQ ID NO: 214318 - RNA, 64 nt, hsa
cccuucccaaaacagaguucauaugcacuuccaccaaaguaaugccaaugaaagugcucguguu

SEQ ID NO: 214319 - RNA, 64 nt, hsa
acaguugauccucaucugucugggguaaagacaacaaaguaaauacaacccaaggcaacugggg

SEQ ID NO: 214320 - RNA, 64 nt, hsa
ggcugauuuauuuagguuuugucaagcuaucuaucaaaguaaugguacaguuacccaucuacuc

SEQ ID NO: 214321 - RNA, 64 nt, hsa
auuuauguaauauuuagaacgacauguuaauaaacaaaguaacauuaaaacaggcacauagagu

SEQ ID NO: 214322 - RNA, 64 nt, hsa
uugcguugaugacuuuuuuaacuucaagauaaaucaaaguaauaaguuuaacguauauuaaacc

SEQ ID NO: 214323 - RNA, 64 nt, hsa
cuucacauauggcccuuucugaaucaaagugcggcaaaguaaauauugucuaagcuuuaaucca

SEQ ID NO: 214324 - RNA, 64 nt, hsa
ugagucucuaaaucucucuguaagaaaaaaauuucaaaguaaagauuuuacucuugcaauuucu

SEQ ID NO: 214325 - RNA, 64 nt, hsa
aagaucaaugguuuacauagauaaacuuauuuaccaaaguaaaaagaacucaugguacuucuaa

SEQ ID NO: 214326 - RNA, 64 nt, hsa
uugucuguuuuccacuuggaguuauuuuaaaauucaaaguaaaucacucuauucuuauuuugaa

SEQ ID NO: 214327 - RNA, 64 nt, hsa
cacagggagugagauuauuaaaguaacacacacacaaaguaaauugcaaaaugaaaaaaauuag

SEQ ID NO: 214328 - RNA, 64 nt, hsa
gaagaggagcaaaaauaccucuguuuucucuugccaaaguaagaugaagcuauuccagguugag

SEQ ID NO: 214329 - RNA, 64 nt, hsa
auuuuguguuuucuuaggcauuucaagugacaagcaaaguaaauguauauauuaugugauaaau

SEQ ID NO: 214330 - RNA, 64 nt, hsa
auuauggaaaaugucucucagcauugcuuuauuacaaaguaaaggaugguuuuauaaaauugag

SEQ ID NO: 214331 - RNA, 64 nt, hsa
uaaauagacuaguuaguagaagacuuuugaagaacaaaguaaaacuuuuuuuuuucauuaaaag

SEQ ID NO: 214332 - RNA, 64 nt, hsa
agacaguaagguguuacucccagguuuguuuuuccaaaguaacagaugacauguggaauaaagu

SEQ ID NO: 214333 - RNA, 64 nt, hsa
ugaaguauuggaguucaugucuaacuucuucccagggcauuauguacagugcuuuuuauuacug

SEQ ID NO: 214334 - RNA, 64 nt, hsa
gggcagaagaggacgaaaugccuuugggugggcagggcauuaaacugcuaaaagcugguuagau

SEQ ID NO: 214335 - RNA, 64 nt, hsa; identical to SEQ ID NO: 172152

SEQ ID NO: 214336 - RNA, 64 nt, hsa; identical to SEQ ID NO: 172153

SEQ ID NO: 214337 - RNA, 64 nt, hsa; identical to SEQ ID NO: 172154

SEQ ID NO: 214338 - RNA, 64 nt, hsa; identical to SEQ ID NO: 172155

SEQ ID NO: 214339 - RNA, 64 nt, hsa; identical to SEQ ID NO: 172156

SEQ ID NO: 214340 - RNA, 64 nt, hsa; identical to SEQ ID NO: 172157

SEQ ID NO: 214341 - RNA, 64 nt, hsa; identical to SEQ ID NO: 172158

SEQ ID NO: 214342 - RNA, 64 nt, hsa; identical to SEQ ID NO: 172159

SEQ ID NO: 214343 - RNA, 64 nt, hsa; identical to SEQ ID NO: 172160

SEQ ID NO: 214344 - RNA, 64 nt, hsa; identical to SEQ ID NO: 172161

SEQ ID NO: 214345 - RNA, 64 nt, hsa; identical to SEQ ID NO: 172162

SEQ ID NO: 214346 - RNA, 64 nt, hsa; identical to SEQ ID NO: 172163

SEQ ID NO: 214347 - RNA, 64 nt, hsa; identical to SEQ ID NO: 172164

SEQ ID NO: 214348 - RNA, 64 nt, hsa; identical to SEQ ID NO: 172165

SEQ ID NO: 214349 - RNA, 64 nt, hsa
cauuacauugccagcgcauaucauuuagcaaguuggcauuaacauuuaugcuuuaauuaaaugc

SEQ ID NO: 214350 - RNA, 64 nt, hsa
ugauguaaauaguuaaccuucaguagucuauuaaggcauuaauacuucucuggacaugcgcguu

SEQ ID NO: 214351 - RNA, 64 nt, hsa
cagccaccgccggggggagggugaggcggccgggggcauuaacugaccucugaguacagcaaua

SEQ ID NO: 214352 - RNA, 64 nt, hsa
gccauuauguugaaauccuaauccccaaggugauggcauuaagaagugggccuuugggaaguga

SEQ ID NO: 214353 - RNA, 64 nt, hsa
aaccauaagagauauuacuuuauugaauaugguuggcauuaaauuuagcauuucauuaucuaac

SEQ ID NO: 214354 - RNA, 64 nt, hsa
uuuguguaugucuguguauguaaguuugucuuguggcauuaagacuauuuugcucuucuggaau

SEQ ID NO: 214355 - RNA, 64 nt, hsa
augaccagaggggaagaggaguuugacauguuagggcauuaaagcaaagguggauuuaagaauu

SEQ ID NO: 214356 - RNA, 64 nt, hsa
gcaccauguaagccuccuuguauugagauaauugggcauuaaacauuaaacugcagcucugggc

SEQ ID NO: 214357 - RNA, 64 nt, hsa
aggaaguugguuaugccaccuucuuggccuuaauggcauuaaaugaaauuuauaggaagaaggu

SEQ ID NO: 214358 - RNA, 64 nt, hsa
cauuuugucaagucaucaacuguauuuuuguacuggcauuaacaaaaaaagagauaaaauauug

SEQ ID NO: 214359 - RNA, 50 nt, hsa
uuaaagccauuuuaaacugaggcauuaagaagaaaugcacucaccaugag

SEQ ID NO: 214360 - RNA, 64 nt, hsa
uuugcuugcuuccauugaucagucuuuuacuugaggcauuaaauaucuaauuaaaucgugaaau

SEQ ID NO: 214361 - RNA, 64 nt, hsa
accaagaaccgcugacuaaauuuacucaaauuagggcauuaaauaucauguacuucauaguuug

SEQ ID NO: 214362 - RNA, 64 nt, hsa
augcuuuacaaucugcacuuuaacugacuuaaguggcauuaaacauuugagagcuaacuauauu

SEQ ID NO: 214363 - RNA, 64 nt, hsa
agcagauacucaaggaggcacugggcucagccugggcauuaaagggacagagucagcucacacg

SEQ ID NO: 214364 - RNA, 64 nt, hsa
ugccccacaaacagaucaccagccagcuuacacaggcauuaacucuccucaaugaggaagaauc

SEQ ID NO: 214365 - RNA, 64 nt, hsa
aaucuaagucaggucaccagagggaagagaacauggcauuaaaagaaucacaucuucagaagag

SEQ ID NO: 214366 - RNA, 64 nt, hsa
auuguuaugaauaagaaaggcaaacauaggucugggcauuaaauuauacaaacugaaaaugugu

SEQ ID NO: 214367 - RNA, 64 nt, hsa
auuuuaaaaaguauugacacaaagcccaucagugggcauuaaaaauauuaaaagugcagacuuu

SEQ ID NO: 214368 - RNA, 64 nt, hsa
aauuaauuacucuuggggaaaaaagacaccuuguggcauuaagucuugcuuugguuaaagccuu

SEQ ID NO: 214369 - RNA, 64 nt, hsa
cucagaagcuacuuacugcuuuauguacucuuugggcauuaaugccuucucuguaauuauaucu

SEQ ID NO: 214370 - RNA, 64 nt, hsa
cuuggucuuagcccuugggagcugacagcccaugggcauuaaggcaaaguaguuccagugauuu

SEQ ID NO: 214371 - RNA, 64 nt, hsa
augcugguauuugauuuccuguguguguugcccuggcauuaagggcauuuuacccuugcaguuu

SEQ ID NO: 214372 - RNA, 64 nt, hsa
ugcauguuuacuuuauuagaguaggaaggcuacuggcauuaauuauuaauaccaaauauuuuag

SEQ ID NO: 214373 - RNA, 64 nt, hsa
auaaaacauuuuucaaaauugaaauauuuuccugggcauuaaaaaccuuuacuauuggcuacaa

SEQ ID NO: 214374 - RNA, 64 nt, hsa
aaaauccaaggcuuuacugcugauagugcuaauuggcauuaaccacaaaaugagaauuauauuu

SEQ ID NO: 214375 - RNA, 64 nt, hsa
acaguacaggugcauggccuguggacaauugcugggcauuaaugaagucaagggagaacagcag

SEQ ID NO: 214376 - RNA, 64 nt, hsa
guauagguugacuuggcaauucggccuuuuuagaggcauuaacuacuccucguaaguguugcau

SEQ ID NO: 214377 - RNA, 64 nt, hsa
uggaggaacacagagaaauccuaaaagagaucugggcauuaagucaguggcuuugcauagcuuu

SEQ ID NO: 214378 - RNA, 64 nt, hsa
uuauaugugaauauaagugucccugaauggggcaggcauuaaauagaagaaucccugcuguuua

SEQ ID NO: 214379 - RNA, 64 nt, hsa
uucaucaaugccuacacauucaguacaaccugauggcauuaauucugugguuggggaaauguga

SEQ ID NO: 214380 - RNA, 64 nt, hsa
agggaccucccucuguacuguguacuguguaaucggcauuaauaccuagacucauauguaugga

SEQ ID NO: 214381 - RNA, 64 nt, hsa
uuggucuucagccagcauucuggugggagugacuggcauuaacaagacuggaaaucggggguca

SEQ ID NO: 214382 - RNA, 64 nt, hsa
agauaauggaacugaacuuucacucaauuaauugggcauuaacaaccuucuuuuauguuuguuc

SEQ ID NO: 214383 - RNA, 64 nt, hsa
uuacuggaaaaagaacuugaauuaugcauuuauuggcauuaauguaaacaguaaguccuaagcu

SEQ ID NO: 214384 - RNA, 64 nt, hsa
aacagaaccuagcacagugcuugggcagccaauaggcauuaaucaguaucuauugaguguuaug

SEQ ID NO: 214385 - RNA, 64 nt, hsa
cugcuaagcacaggcuccucacucuucuccaucaggcauuaaaugaauggucucuuggccaccc

SEQ ID NO: 214386 - RNA, 64 nt, hsa
gaggucagucuuaguggccuugagaguugcuuuuggcauuaauauucuaagagaauuaacugua

SEQ ID NO: 214387 - RNA, 64 nt, hsa
uccauggucacugcuaagcaguagccagccaucgggcauuaauugauuuccuacuauauuccca

SEQ ID NO: 214388 - RNA, 64 nt, hsa
uauaaagcugcagcuuucaacagguuuuaaaccuggcauuaaaauguaauggcaaaaccaauau

SEQ ID NO: 214389 - RNA, 64 nt, hsa
ccaagccugugaugacauggugcugauucuggggggcauuaaagcugcuguuuuaaaaggcucc

SEQ ID NO: 214390 - RNA, 64 nt, hsa
agcaagccaugaggcuguuggaguuucuguuuagggcauuaaaaauucccgcaaacuauaaaga

SEQ ID NO: 214391 - RNA, 64 nt, hsa
gcugaguuuauacauuaguucagaccuacuugguggcauuaaacuguuugaaugcaaauucgau

SEQ ID NO: 214392 - RNA, 64 nt, hsa
uccauuucuuauuuuccaccaaauuuaauugaagggcauuaauuagaugucuucacccugaauu

SEQ ID NO: 214393 - RNA, 64 nt, hsa
agguuuguuuuuccugcuguugauuguuacuaguggcauuaacuuuuagaauuugggcugguga

SEQ ID NO: 214394 - RNA, 64 nt, hsa
aaacagcaguugauaccuagcagcguuauugaugggcauuaaucuauguuaguuggcaccuuaa

SEQ ID NO: 214395 - RNA, 64 nt, hsa
auaugaugagauuuuagccuuucuccagaacuaaggcauuaaagaaaauagcaaauauuaaaaa

SEQ ID NO: 214396 - RNA, 64 nt, hsa
uggggcuucugcaugugaaaaacgguuuuccauaggcauuaaagugcugaaugcucagucugau

SEQ ID NO: 214397 - RNA, 64 nt, hsa
uuugcuaaaacacuuauuacccuucugcagcaaaggcauuaaaagcgcuaagcauauauuaaua

SEQ ID NO: 214398 - RNA, 64 nt, hsa
auuuuccaaauguaaaagucaccaaaaacuuaaaggcauuaaaauaaacuaaaaaaguacucau

SEQ ID NO: 214399 - RNA, 64 nt, hsa
aaguucaaauauacuuguuaauaaaaggauuaucggcauuaauacuuuaauuuaaagaaaaguu

SEQ ID NO: 214400 - RNA, 64 nt, hsa
cuugguuugcacauaaaacguauagucaauauggggcauuaauauucuuuuguuauuaaaaaaa

SEQ ID NO: 214401 - RNA, 64 nt, hsa
cugccucucaaucccugucccaagccacagcuauggcauuaaugucaccaguguucucacccuc

SEQ ID NO: 214402 - RNA, 64 nt, hsa
aaaauguuucuaacacgcuugcaacuucccuuauggcauuaaucuuguugagggagagagacag

SEQ ID NO: 214403 - RNA, 64 nt, hsa
uaagggauuuuccuuuuagcuuuucaucuccaguggcauuaaacauaaaaagacccuggcauuu

SEQ ID NO: 214404 - RNA, 64 nt, hsa
ugagaaaguuuaucaucaugauagcuguaagucaggcauuaaaaucaaauggaaauacaccuaa

SEQ ID NO: 214405 - RNA, 64 nt, hsa
uuguugcgaaggccaguggaauauaaaaaucaauggcauuaaugaggagcacauucuuugcuga

SEQ ID NO: 214406 - RNA, 64 nt, hsa
auuuagaaguuugauuaauuauauuaucuauuuaggcauuaauauaaaagagguaggagucugu

SEQ ID NO: 214407 - RNA, 64 nt, hsa
agugaauauucuguagaucagaugaauuaucaucggcauuaacgucaaguacacacuacugaga

SEQ ID NO: 214408 - RNA, 64 nt, hsa
uuccuucaaaacuguguuuugaccacacaaggugggcauuaacaaaccaaauuucaacuuaagu

SEQ ID NO: 214409 - RNA, 64 nt, hsa
cuuagaucuacuguaaggcagaugcuaauuauaaggcauuaaguaagcaaauagugcccucagc

SEQ ID NO: 214410 - RNA, 64 nt, hsa
ggauaccauauacagcucagaaguuucuucuuuaggcauuaaauuuuagcaaagauaucucauc

SEQ ID NO: 214411 - RNA, 64 nt, hsa
ugugucagagaauaggaaaagcagcuuuguuuggggcauuaaugcuuggaguggggucagcuaa

SEQ ID NO: 214412 - RNA, 64 nt, hsa
uuuuuuuuuuuuuuuuuuuuuugggaguaagccaggcauuaaaagcaaccguuugaauccuauu

SEQ ID NO: 214413 - RNA, 64 nt, hsa
gaaguguacauugauuuccaauuaaaaauuugcuggcauuaaaaauaagcacacuuacauaagc

SEQ ID NO: 214414 - RNA, 64 nt, hsa
cuuuuguuacugggacacuuuuaaacucugaauaggcauuaaaaaaaauauggcuaacuagugu

SEQ ID NO: 214415 - RNA, 64 nt, hsa
auuucuaugccauuuuuaguuuaaaaucuugcauggcauuaauuguuccuugcuuuuauaguug

SEQ ID NO: 214416 - RNA, 64 nt, hsa
guagcaaauuuuccuuuuaaaaaauccaggcaauggcauuaaacauucuugcuaucauuuacca

SEQ ID NO: 214417 - RNA, 64 nt, hsa
gcauauucagcauaacagcuugucuuccgaaaaaggcauuaagggcuagagaugucaaauggaa

SEQ ID NO: 214418 - RNA, 64 nt, hsa
caaggaacagaguugagugucuggagucaucaaaggcauuaaaaacuccaguaaaagcuggggc

SEQ ID NO: 214419 - RNA, 64 nt, hsa
agacugaugcuuugacugaaucaucacuagcuauggcauuaaaaggccucucuucucaucuggu

SEQ ID NO: 214420 - RNA, 64 nt, hsa
guguguaacgacacaaucagcacaacuggagagaggcauuaaagaaccagggaagguaguuuga

SEQ ID NO: 214421 - RNA, 64 nt, hsa
cccacauuugaguggugcuaacuugaugugaguaggcauuaauuaugggugcggcuacuaagau

SEQ ID NO: 214422 - RNA, 64 nt, hsa
gcugugcagaagagcagauaacuagcgcugcucuggcauuaaucccaggaaccacuagcaguag

SEQ ID NO: 214423 - RNA, 64 nt, hsa
ugcuucagaaugaauuuguaccuauaaagcauaaggcauuaaaugacaauaaaaauuccaaaug

SEQ ID NO: 214424 - RNA, 64 nt, hsa
cuaaauaacucaguuuuuaagcagaaguuuucagggcauuaaauauauguuguguaugaaguau

SEQ ID NO: 214425 - RNA, 64 nt, hsa
uguauuucuuaauauuaugaccaagaauuuuaucggcauuaauuuuucaguguaguuuguuguu

SEQ ID NO: 214426 - RNA, 64 nt, hsa
gacuuacuuucuuugcuguaguuaugaaccuuggggcauuaaaaucccauggcaaggagcauaa

SEQ ID NO: 214427 - RNA, 64 nt, hsa
cguggaugcagcguaaacaucuuccuucagacgaggcauuaaccccaugguuaauggacugguc

SEQ ID NO: 214428 - RNA, 64 nt, hsa
uuuguuucccagguauagcaggcuuauguuugguggcauuaaauugguuucuuuaaaaugcuuu

SEQ ID NO: 214429 - RNA, 64 nt, hsa
aaaaacaaacaccaaauaauuggaauauauugcaggcauuaagcucauuaaaaacaaacuggcu

SEQ ID NO: 214430 - RNA, 62 nt, hsa
guuugcguaauaaaacauuuguauuuaaugaguuggcauuaauucuuugagcacaucucucu

SEQ ID NO: 214431 - RNA, 64 nt, hsa
ccaagucaccacuccugacccaaaaaucaggcauggcauuaaaacguugcaaauuccuuuacug

SEQ ID NO: 214432 - RNA, 64 nt, hsa
gagcucagccugccugggagagcccuuguggcgaggcauuaaaacuugggcaccagcuucuuuc

SEQ ID NO: 214433 - RNA, 64 nt, hsa
gcggcagcuuccugcaccuuucagauuucuugguggcauuaaagcauuuucagaacauuucugu

SEQ ID NO: 214434 - RNA, 64 nt, hsa
cuauguguuucuguaacaaauugggaucugucuuggcauuaaaccacaucauggaccaaaugug

SEQ ID NO: 214435 - RNA, 64 nt, hsa
aaaaauuacauuuauuaaaaaaguguguuccaaaggcauuaaaauuauauauguuaauaaggaa

SEQ ID NO: 214436 - RNA, 64 nt, hsa
auauuaggcuggauugccaugggaaacauuuuuuggcauuaaugcagcaacauaauacucacuu

SEQ ID NO: 214437 - RNA, 53 nt, hsa
gcuuuuccgcugaagcuuaaacaggcauuaacgcuucuuuagaucugaaguug

SEQ ID NO: 214438 - RNA, 64 nt, hsa
ggguacuaugaacgugagugggguauuuuguucuggcauuaaaagaaaaacaagcaagcaaaca

SEQ ID NO: 214439 - RNA, 64 nt, hsa
ucagaaacauuguuuugaauccucuguaaaccaaggcauuaaucuuaauaaaccaggauccauu

SEQ ID NO: 214440 - RNA, 64 nt, hsa
gcuuagcacagcucuaguuacauucuuaugauauggcauuaaauuauuuccauauauuauauaa

SEQ ID NO: 214441 - RNA, 64 nt, hsa; identical to SEQ ID NO: 214438

SEQ ID NO: 214442 - RNA, 64 nt, hsa
ggacuucucagcuucucccauagguaguuuaacaggcauuaaaauuuguaauugaaauguugcu

SEQ ID NO: 214443 - RNA, 64 nt, hsa
aaauuacuacuuaauccuaauucacaauaacaauggcauuaagguuugacuugaguugguucuu

SEQ ID NO: 214444 - RNA, 64 nt, hsa
aaaacccauccaguucuucagaaauugcuuucuaggcauuaauacuacuuuacuaucuauacug

SEQ ID NO: 214445 - RNA, 64 nt, hsa
augugguaagcggaaacagaagacaggcagcagaggcauuaaaaaugcauaccaugcuuucaga

SEQ ID NO: 214446 - RNA, 64 nt, hsa
ucuuuuucauugcaaaauugccacauuuucuuauggcauuaaaaauuuuacaaaaacauaauuu

SEQ ID NO: 214447 - RNA, 64 nt, hsa
aagucauaaucuaucaaaaguuuauuuauuggauggcauuaaaacauuuuugaggcaguugucu

SEQ ID NO: 214448 - RNA, 64 nt, hsa
auaguuuuaaauacauaaagaaauguuucaguuaggcauuaaccuugauagaaucacucaguuu

SEQ ID NO: 214449 - RNA, 64 nt, hsa
gauaauugccuauguucuagguaacaggaaaacaggcauuaaguuuauuuuagucuucccauuu

SEQ ID NO: 214450 - RNA, 64 nt, hsa
uuuuuccauuuuuaugugccucacaggcuguuugggcauuaauuuugcuuuuugagccuuaagu

SEQ ID NO: 214451 - RNA, 64 nt, hsa
aguccacuaacugugaguaaaaaugauauauauaggcauuaaccacacacuuuaauggguauaa

SEQ ID NO: 214452 - RNA, 64 nt, hsa
uugacuauauuuuuggagucccauuguuucagugggcauuaacagaaugcuuuaaaaacuucua

SEQ ID NO: 214453 - RNA, 64 nt, hsa
aaggagccaaagugugaaugugggugucggcugcggcauuaaauucaucaucucaacccagagu

SEQ ID NO: 214454 - RNA, 64 nt, hsa
uaccaucuuaaccauuguuaaguguaugguuuguggcauuaaauacauucacauuguugugcaa

SEQ ID NO: 214455 - RNA, 64 nt, hsa
cuucuugcuaagagaaagaaaaacaaaaucagagggcauuaaauguuuuguaugugacaugauu

SEQ ID NO: 214456 - RNA, 64 nt, hsa
cauuccugggagcugggcaaggagauccucccguggcauuaaaagagagucaaaggguugcgag

SEQ ID NO: 214457 - RNA, 64 nt, hsa
uccccucuuugccaccuaggccaguuuugacccuggcauuaacuggccuuagaagaaacuggau

SEQ ID NO: 214458 - RNA, 64 nt, hsa
auauuaauguacuuguuucucuguuguaagaauaggcauuaacacaaaggaggcgucucgggag

SEQ ID NO: 214459 - RNA, 64 nt, hsa
ucauaauuaguuuauaaacaccuagaauaauacuggcauuaaagaauccuuguuggaugguaga

SEQ ID NO: 214460 - RNA, 64 nt, hsa
acuucugacauaacuaacccacaccugagauaacggcauuaauccauucaugaggucucugcuc

SEQ ID NO: 214461 - RNA, 63 nt, hsa
uugaaagguaaguuggcucagaguugcacaguagggcauuaaauguuuaagcaaagcaucugc

SEQ ID NO: 214462 - RNA, 64 nt, hsa
gcugcuuaucuccaaagcagcauaagcugcacauggcauuaaaggacagccaccaguaggcuug

SEQ ID NO: 214463 - RNA, 64 nt, hsa
uccacuugcuauuuauuuuuuuucaauuguugguggcauuaauuuaauaauucuuguuuuucac

SEQ ID NO: 214464 - RNA, 64 nt, hsa
aaaguuuugcaauuuauguauacaagaaauuguaggcauuaaaaauauuuuauugauauuuuug

SEQ ID NO: 214465 - RNA, 64 nt, hsa
guauauuuauauaauuauguuauugaaaaaaauuggcauuaaaacuuaaccgcaucagaagccu

SEQ ID NO: 214466 - RNA, 64 nt, hsa
ggcuguuuuucacuuuguucagauuuuguuuccaggcauuaagugugucauacaguuguugcca

SEQ ID NO: 214467 - RNA, 64 nt, hsa
uucagucuagcuuucacaguuuuuaugaauaaaaggcauuaaaggcugaaguagucugggauuu

SEQ ID NO: 214468 - RNA, 64 nt, hsa
agaaauccagucuuuaugaauauacuauuaguugggcauuaaaaaaucaguauauauuuuaacu

SEQ ID NO: 214469 - RNA, 64 nt, hsa
auauucauuuaaaaauacaauugugaguuguguuggcauuaaaacuguauuuuaaaaaaagaca

SEQ ID NO: 214470 - RNA, 64 nt, hsa
uugcagcuccaucugguugcugcauuugaagcauggcauuaauuuguauuugcccuguucuuug

SEQ ID NO: 214471 - RNA, 64 nt, hsa
aaaaguuuccguuugcacaagaaaauaacgcuugggcauuaaaugaaugccuuuauagauaguc

SEQ ID NO: 214472 - RNA, 64 nt, hsa
uauaauacuugcucaacaguauagugguaccaauggcauuaagaugguguuuuuguucuacaua

SEQ ID NO: 214473 - RNA, 64 nt, hsa
uuugauauauucaaguauauaugaaaaucuguuuggcauuaagugaauuuuaauguuuuuguuu

SEQ ID NO: 214474 - RNA, 64 nt, hsa
aaaaacaaaacaaugugaaacauuaaaauuaaaaggcauuaauaauauccacgugugccuucuu

SEQ ID NO: 214475 - RNA, 64 nt, hsa
gugccugagacugucagaaguugaccuuugcacuggcauuaaagagucauagaaaaagaaucau

SEQ ID NO: 214476 - RNA, 64 nt, hsa
uagcuuuggaaaaagggacuauuuguggaguaauggcauuaaucaacauagaacaucuuauuug

SEQ ID NO: 214477 - RNA, 64 nt, hsa
caaaauccccauaaauauccaucccuuccuagauggcauuaacuuucauuuuagauuuuaggug

SEQ ID NO: 214478 - RNA, 64 nt, hsa
uuuguggcauauccguguaauggaagauuaugcaggcauuaaaauauguacacaaaaaguuugg

SEQ ID NO: 214479 - RNA, 64 nt, hsa
ggcagaagaggacgaaaugccuuugggugggcagggcauuaaacugcuaaaagcugguuagaug

SEQ ID NO: 214480 - RNA, 64 nt, hsa
auagauauauguauaaaaauuuguaagcguuagcggcauuaauucaccaaugcauuuggacaac

SEQ ID NO: 214481 - RNA, 64 nt, hsa
guuuuuuuaaaaaaagcuaaauuacauagacuuaggcauuaacauguuuguggaagaauauagc

SEQ ID NO: 214482 - RNA, 64 nt, hsa
uaaauguguguucagaacuuuuuguguuuuuuaaggcauuaauaaagccuucgauaauauuaaa

SEQ ID NO: 214483 - RNA, 64 nt, hsa
uugcccagcuugccaaggugaggggcuggggcauggcauuaacacugucugacacagccagcca

SEQ ID NO: 214484 - RNA, 64 nt, hsa
ucucaguaggaaugcuggugcugucuaaagaccuggcauuaauggaggcggaggagcagccuua

SEQ ID NO: 214485 - RNA, 64 nt, hsa
uggucuccucugauuaucagguacuggggcugagggcauuaaaaauaguaagccucccuccucg

SEQ ID NO: 214486 - RNA, 64 nt, hsa
uaaucaacagcucagccagcugccugggaguuuuggcauuaagccccgccuugaagggcgagcu

SEQ ID NO: 214487 - RNA, 64 nt, hsa
gcgggcacccgucaugcuuuugcugagaguugggggcauuaaccuugagcuaauguuaaaaauc

SEQ ID NO: 214488 - RNA, 64 nt, hsa
aaaauuacaaguaaucaagggucauuauggguuaggcauuaauguuucuaucugauuuugugca

SEQ ID NO: 214489 - RNA, 64 nt, hsa
aaaucauugguagccccccaaguguuuaauaacuggcauuaagcuuagagggugaaaaaaaaaa

SEQ ID NO: 214490 - RNA, 64 nt, hsa
uccuuucuuucucugaauuacugcuuuuucugugggcauuaacuauauugcuacagcaucuagu

SEQ ID NO: 214491 - RNA, 64 nt, hsa
uaccucauaagugcauauauagugugaaagagaaggcauuaaaaagaagugcaauuccuuuuua

SEQ ID NO: 214492 - RNA, 64 nt, hsa
ucucagagagcauuugucuaauacaauaaaaacuggcauuaauacaaaccucaaaaacgugagc

SEQ ID NO: 214493 - RNA, 64 nt, hsa
gcuuuuuuuauccuuaaaauucaccugucagggaggcauuaaaaauuuggaaauguaugccagc

SEQ ID NO: 214494 - RNA, 64 nt, hsa
aggugccaaugacuaacuuuuugaauucuauguuggcauuaacaauaaagcauuuugcaaacac

SEQ ID NO: 214495 - RNA, 64 nt, hsa
acacaagcuuuccuagagaauaugauguuuuuuaggcauuaauaagguccuuuuuuauaaagga

SEQ ID NO: 214496 - RNA, 64 nt, hsa
acuuacaaagcacuauauugguaauucuuacaauggcauuaauagcuuacucuauaaauacaga

SEQ ID NO: 214497 - RNA, 64 nt, hsa
caaauaugaauuuuaugauguacacuuugugcuuggcauuaaaagaaaaaaacacacauccugg

SEQ ID NO: 214498 - RNA, 64 nt, hsa
uacagcccguguccgucugcucgugggccuggagggcauuaauauuacacucacaggugagggg

SEQ ID NO: 214499 - RNA, 64 nt, hsa
ccauacaaugggcagugucugcuauagggcuucaggcauuaaauaaaaccgaggguuguugauu

SEQ ID NO: 214500 - RNA, 64 nt, hsa
uuuagaagcucuggccaguaguuguuaagauguuggcauuaauggcauuuucauagauccuugg

SEQ ID NO: 214501 - RNA, 64 nt, hsa
uucucgugguaguucauucggccuaaauagaccuggcauuaaauuucaagaaggauuuggcauu

SEQ ID NO: 214502 - RNA, 64 nt, hsa
cuucacauuaucauaaccucuccucuaaaggggaggcauuaaaauucacugugcccagcacaug

SEQ ID NO: 214503 - RNA, 64 nt, hsa
ggcucccaacuccucccuauccuaaaggcccacuggcauuaaagugcuguauccaagagcugcg

SEQ ID NO: 214504 - RNA, 64 nt, hsa
uuagcaccaugcugcuucugucugucuuaaugcuggcauuaagaucaugagcccuuuuucucca

SEQ ID NO: 214505 - RNA, 64 nt, hsa
aauugcaaguugcccugcuaggcaguuguaaucuggcauuaacuuauuuucuauauccaguuua

SEQ ID NO: 214506 - RNA, 64 nt, hsa
aguauuuucagucaucagaagccagcuguugguaggcauuaaugaguuuaaaauuguucucaau

SEQ ID NO: 214507 - RNA, 64 nt, hsa
agauuugcugcugaugaaaauacucaguuuccugggcauuaagucuaagagagaggagccugga

SEQ ID NO: 214508 - RNA, 64 nt, hsa
gccgggcaacacgucaacauucuuuucuguucuuggcauuaauuauugcugucuuuuuuuuaaa

SEQ ID NO: 214509 - RNA, 64 nt, hsa
aagauacacacuggacccucucuugcugaaugugggcauuaauuuuuugacugcagcucugcuu

SEQ ID NO: 214510 - RNA, 64 nt, hsa
ugguuaaucaagagccuucuggguuugguuugguggcauuaaauggcaauuugugacugagaca

SEQ ID NO: 214511 - RNA, 64 nt, hsa
gccugguggggaucagacagagauuggagagaagggcauuaaccugucugggggccagcggcag

SEQ ID NO: 214512 - RNA, 64 nt, hsa
caaaggggacuuuagaggacuucauacaaagcugggcauuaagaaaaccacaaugcauggccgg

SEQ ID NO: 214513 - RNA, 64 nt, hsa
gucucuccaacugccuuucccauccucugaacuaggcauuaacagcccccgugggcucccaucu

SEQ ID NO: 214514 - RNA, 64 nt, hsa
ucugaacucuuugacaaauugcacagagcucuuuggcauuaaucuaauuuuaauguacugauaa

SEQ ID NO: 214515 - RNA, 64 nt, hsa
gggugagaguuaauuaugcagucuucuugacagcggcauuaauuuggaaggaaacugacaaguc

SEQ ID NO: 214516 - RNA, 64 nt, hsa
cuguuaaauaucacaucacaauaaaaaucaaauuggcauuaaaaguauagaagauauaggaagu

SEQ ID NO: 214517 - RNA, 64 nt, hsa
uaaauauuuuuccuccucugaacuggauuuuauaggcauuaaagacaagucggguggcuagagg

SEQ ID NO: 214518 - RNA, 64 nt, hsa
caggggugggggguauggggaccauucauucccuggcauuaaucccuuagagggaauaauaaag

SEQ ID NO: 214519 - RNA, 64 nt, hsa
ggagacagccaucuaaacagacucacuaacuauuggcauuaaagcuucagaaaucucugcguuu

SEQ ID NO: 214520 - RNA, 64 nt, hsa
auaagccauuaaaagcuuggagauuacuguauuuggcauuaaaaaaaaaugucacuuaggucag

SEQ ID NO: 214521 - RNA, 64 nt, hsa
agaaaucaaacaacuuggaaaucgaucacaaccaggcauuaaguucacaguaagaucauuuuau

SEQ ID NO: 214522 - RNA, 64 nt, hsa
uggcucuaccuaaaaguugguuaaaaaugcaauuggcauuaacaaggaaaaauacugaauuagu

SEQ ID NO: 214523 - RNA, 64 nt, hsa
gguguggaauauggggguuaucuguacauccuggggcauuaaaaaaaaaaucaaugguggggaa

SEQ ID NO: 214524 - RNA, 64 nt, hsa
cuaccuccucgaguugucaugaggaugaaagaauggcauuaaagcauuugguauacaguaggug

SEQ ID NO: 214525 - RNA, 64 nt, hsa
gacagaggcuuuauucaggccucacagcuuugcaggcauuaaaaucuacguauuugauggaacc

SEQ ID NO: 214526 - RNA, 64 nt, hsa
ccaccgcugggacugcuccuagauggaucucagcggcauuaagcugugccugagcgaguuugua

SEQ ID NO: 214527 - RNA, 64 nt, hsa
cugggaaggaaugggugcuuugugauggauaaaaggcauuaaauaaaaccacguuuacauuuug

SEQ ID NO: 214528 - RNA, 64 nt, hsa
cguuucuuuugaucucuugauugaaggaggauagggcauuaaagugcuuuugacaugaggaauu

SEQ ID NO: 214529 - RNA, 64 nt, hsa
ugcccugcuugugccuuagugggaagcccagugaggcauuaagcccagggguucacuuucaggc

SEQ ID NO: 214530 - RNA, 64 nt, hsa
cuuuggagcccagaggugcgggauucugaccaacggcauuaaaacugaggcgagaccgggcacg

SEQ ID NO: 214531 - RNA, 64 nt, hsa
caccaagaguagcaccuucagaauauauugaauaggcauuaaaugcaaaaauauauauguagcc

SEQ ID NO: 214532 - RNA, 64 nt, hsa
ccaucugugucuccugugcagaaggagaggaaggggcauuaagagaugaagggugauuauguau

SEQ ID NO: 214533 - RNA, 64 nt, hsa
uguuuaaaaaaaaaaagucagcaguaaaauguauggcauuaagaaauagagaaagaguguaaga

SEQ ID NO: 214534 - RNA, 64 nt, hsa
ccagucacugauuuuuacaaaucuuacaguccaaggcauuaaccucaaggcccucccagcaccc

SEQ ID NO: 214535 - RNA, 64 nt, hsa
ccaugcugggcauccuaggccacuuugcuuagagggcauuaaaggugccaugaaagguagacuc

SEQ ID NO: 214536 - RNA, 64 nt, hsa
uacucuuauguuccacaugcacauaugacaagguggcauuaauuagauucaauauuauuucuag

SEQ ID NO: 214537 - RNA, 64 nt, hsa
cucuaccacauagcaggcacugucacagaguaauggcauuaauccccauaauaauccugugaag

SEQ ID NO: 214538 - RNA, 64 nt, hsa
uuggaccugcuauaauaauauuucacuaaaaucuggcauuaaaaauuuuaaguauuuggagcuc

SEQ ID NO: 214539 - RNA, 64 nt, hsa
gcaaauguauuuacuaugcguguuuccagcaguuggcauuaaagugccuuuuucuaauaaaauc

SEQ ID NO: 214540 - RNA, 64 nt, hsa
uucaaauucauuuuguuuuugcuguuucauuucuggcauuaauaaaagucuuauaaggagaaau

SEQ ID NO: 214541 - RNA, 62 nt, hsa
ccucaagucuggucuccuggcagagagcacaugggcauuagauaccaucaacauccugcugu

SEQ ID NO: 214542 - RNA, 62 nt, hsa
agccaccgccggggggagggugaggcggccgggggcauuaacugaccucugaguacagcaau

SEQ ID NO: 214543 - RNA, 62 nt, hsa
ugaccagaggggaagaggaguuugacauguuagggcauuaaagcaaagguggauuuaagaau

SEQ ID NO: 214544 - RNA, 62 nt, hsa
caccauguaagccuccuuguauugagauaauugggcauuaaacauuaaacugcagcucuggg

SEQ ID NO: 214545 - RNA, 62 nt, hsa
cccagaggaccgaggacaggggccggacauuggggcauuacauggccaggugagcugucccc

SEQ ID NO: 214546 - RNA, 62 nt, hsa
uugaggguuuugcuggguucucaggcuagugggggcauuaggaacagaccucucauucucuc

SEQ ID NO: 214547 - RNA, 62 nt, hsa
uaauacaaaucacucacuaacuguagagccuugggcauuaucagugaacuacucugagauuu

SEQ ID NO: 214548 - RNA, 62 nt, hsa
uggagaggccgagcagcagccggccgggaugggggcauuagaggccugagguucucuaggac

SEQ ID NO: 214549 - RNA, 62 nt, hsa
uucaucauuuaucccauuuauuucuucuuagugggcauuauggaagaauauauuaaaaugug

SEQ ID NO: 214550 - RNA, 62 nt, hsa
gaaugauaaagaauagaccaugggcuacuacugggcauuagugcaauauaacagcgauaaua

SEQ ID NO: 214551 - RNA, 62 nt, hsa
ccaagaaccgcugacuaaauuuacucaaauuagggcauuaaauaucauguacuucauaguuu

SEQ ID NO: 214552 - RNA, 62 nt, hsa
ccucagguuguuuggccucucugguccaucuugggcauuagguucuccagcagagcucuggc

SEQ ID NO: 214553 - RNA, 62 nt, hsa
gcagauacucaaggaggcacugggcucagccugggcauuaaagggacagagucagcucacac

SEQ ID NO: 214554 - RNA, 62 nt, hsa
ccucaggccugauauguucuucagagauccuggggcauuagcuuuccaguauaccucuucug

SEQ ID NO: 214555 - RNA, 62 nt, hsa
uuguuaugaauaagaaaggcaaacauaggucugggcauuaaauuauacaaacugaaaaugug

SEQ ID NO: 214556 - RNA, 62 nt, hsa
uuuuaaaaaguauugacacaaagcccaucagugggcauuaaaaauauuaaaagugcagacuu

SEQ ID NO: 214557 - RNA, 62 nt, hsa
aguuugcaugguaaaggacauugugugguaaagggcauuauugaguaaugaauuuuaaguau

SEQ ID NO: 214558 - RNA, 62 nt, hsa
ucagaagcuacuuacugcuuuauguacucuuugggcauuaaugccuucucuguaauuauauc

SEQ ID NO: 214559 - RNA, 62 nt, hsa
uuggucuuagcccuugggagcugacagcccaugggcauuaaggcaaaguaguuccagugauu

SEQ ID NO: 214560 - RNA, 62 nt, hsa
aaaaccacacuggcuccaacuuccuccucauggggcauuacacuucaaaacaguggggagca

SEQ ID NO: 214561 - RNA, 62 nt, hsa
uaaaacauuuuucaaaauugaaauauuuuccugggcauuaaaaaccuuuacuauuggcuaca

SEQ ID NO: 214562 - RNA, 54 nt, hsa
aggagaaugggaagcugugacucugggcauuaucgacacguucacccaucuuau

SEQ ID NO: 214563 - RNA, 62 nt, hsa
ccaggugaacuggaaugccuuggggcguggaagggcauuaggaguguuucauuugauaugug

SEQ ID NO: 214564 - RNA, 62 nt, hsa
cagguugcauuuauuggauggggagcuccaaggggcauuagugguuugggcugggccuuuug

SEQ ID NO: 214565 - RNA, 62 nt, hsa
caguacaggugcauggccuguggacaauugcugggcauuaaugaagucaagggagaacagca

SEQ ID NO: 214566 - RNA, 62 nt, hsa
cuuaauuaauuauucuguauuuggccuuauucgggcauuaggaaaucuagagaucuaaaggg

SEQ ID NO: 214567 - RNA, 62 nt, hsa
agggccuaggguugaaagccuuccccggcuccgggcauuauuuggguuuaaucucggagccu

SEQ ID NO: 214568 - RNA, 62 nt, hsa
ggaggaacacagagaaauccuaaaagagaucugggcauuaagucaguggcuuugcauagcuu

SEQ ID NO: 214569 - RNA, 62 nt, hsa
acuaaugacaguuuguucucuuugcaagagaggggcauuacugucaccugacuugaggagcu

SEQ ID NO: 214570 - RNA, 62 nt, hsa
gauaauggaacugaacuuucacucaauuaauugggcauuaacaaccuucuuuuauguuuguu

SEQ ID NO: 214571 - RNA, 62 nt, hsa
ucuaugcuauauuuugcuauucaaaauuuagugggcauuacuuaacauuguuucuaauuauu

SEQ ID NO: 214572 - RNA, 62 nt, hsa
ggccuugcuuuuaaguggugcuguuucccauagggcauuaguucucagauuuuggaauguga

SEQ ID NO: 214573 - RNA, 62 nt, hsa
ccauggucacugcuaagcaguagccagccaucgggcauuaauugauuuccuacuauauuccc

SEQ ID NO: 214574 - RNA, 62 nt, hsa
agcaaugaauauuaaggacucucuagcugccugggcauuacuguugcuaaaagaagaaaguu

SEQ ID NO: 214575 - RNA, 62 nt, hsa
acccaagggugaggagaggggcuggaagcccugggcauuaggagaagggagugggugcuggc

SEQ ID NO: 214576 - RNA, 62 nt, hsa
caagccugugaugacauggugcugauucuggggggcauuaaagcugcuguuuuaaaaggcuc

SEQ ID NO: 214577 - RNA, 62 nt, hsa
gcaagccaugaggcuguuggaguuucuguuuagggcauuaaaaauucccgcaaacuauaaag

SEQ ID NO: 214578 - RNA, 62 nt, hsa
uccaaccuccauuucuguucacuuuguggagagggcauuacuuguucguuauagacauggac

SEQ ID NO: 214579 - RNA, 62 nt, hsa
ccauuucuuauuuuccaccaaauuuaauugaagggcauuaauuagaugucuucacccugaau

SEQ ID NO: 214580 - RNA, 62 nt, hsa
aacagcaguugauaccuagcagcguuauugaugggcauuaaucuauguuaguuggcaccuua

SEQ ID NO: 214581 - RNA, 62 nt, hsa
gacagucaccuuggugggaaugccagaggcaugggcauuagguccccccggccagccuccgu

SEQ ID NO: 214582 - RNA, 62 nt, hsa
acugguguaauuuaaguauaaaguaaaauaaugggcauuaucauuggauguuuccccacauu

SEQ ID NO: 214583 - RNA, 62 nt, hsa
uugguuugcacauaaaacguauagucaauauggggcauuaauauucuuuuguuauuaaaaaa

SEQ ID NO: 214584 - RNA, 62 nt, hsa
cugucaaugagguuaugagaaaaaaacagcaggggcauuaguuucaggcaaggcagcuccca

SEQ ID NO: 214585 - RNA, 62 nt, hsa
gcuauaugcaucuuuuugguuugucaaaacgagggcauuacaaaaauuuagcuacuuucaaa

SEQ ID NO: 214586 - RNA, 62 nt, hsa
uccaaacugggacacucuugagaguaaauggagggcauuauuaauaauuaucuuguaaugaa

SEQ ID NO: 214587 - RNA, 62 nt, hsa
ccacugccacugggugacacagacugucguuugggcauuauuucauggcagaugggccaguc

SEQ ID NO: 214588 - RNA, 62 nt, hsa
gggaacauuuccccaucagcaacggggcucuagggcauuauuaaguaggggugaaauaugau

SEQ ID NO: 214589 - RNA, 62 nt, hsa
aaaauuuaaaauggaagggaagaauaggggcagggcauuauuaggcuauuucugaugcuuca

SEQ ID NO: 214590 - RNA, 62 nt, hsa
aauuagaugccauauuaguuaguggagaaaaggggcauuagguauuaauugcaugggucuaa

SEQ ID NO: 214591 - RNA, 62 nt, hsa
uccuucaaaacuguguuuugaccacacaaggugggcauuaacaaaccaaauuucaacuuaag

SEQ ID NO: 214592 - RNA, 62 nt, hsa
gugucagagaauaggaaaagcagcuuuguuuggggcauuaaugcuuggaguggggucagcua

SEQ ID NO: 214593 - RNA, 62 nt, hsa
ucuguaagugcccaccgcgggaugccgggaaggggcauuauuugugcacugagaacaccgcg

SEQ ID NO: 214594 - RNA, 62 nt, hsa
aacaacugcuauuguaauaagugucaucuugugggcauuauacaaaggcauauuauaaaaua

SEQ ID NO: 214595 - RNA, 62 nt, hsa
uuuuucauuguuuaaaaugucaccuguaaaaugggcauuauuuauguuuuuuuuuuugcauu

SEQ ID NO: 214596 - RNA, 62 nt, hsa
ucaaagauaugagauuuuuuuuuuuauuaggugggcauuauuuaugaccuuuucuguggaag

SEQ ID NO: 214597 - RNA, 62 nt, hsa
aucagagauaugagagauucuuuuuuauaggugggcauuauuuaugccccuuucuguggaag

SEQ ID NO: 214598 - RNA, 62 nt, hsa
gacaucuuccuauacaccgagcugccuaugaggggcauuaucugugagugauaaauuauagg

SEQ ID NO: 214599 - RNA, 62 nt, hsa
uuuucuauaagaaaaaggaaaaguugaggggggggcauuagugcugauagcuguguguguua

SEQ ID NO: 214600 - RNA, 62 nt, hsa
aacguggcucaacuagauaucuuuauauguaugggcauuacucuuagugauauuuguuuccu

SEQ ID NO: 214601 - RNA, 62 nt, hsa
uaaauaacucaguuuuuaagcagaaguuuucagggcauuaaauauauguuguguaugaagua

SEQ ID NO: 214602 - RNA, 62 nt, hsa
augugggaaaauguaaaagcagggauaucagugggcauuagaauaaaaacuagggauacaau

SEQ ID NO: 214603 - RNA, 62 nt, hsa
acuuacuuucuuugcuguaguuaugaaccuuggggcauuaaaaucccauggcaaggagcaua

SEQ ID NO: 214604 - RNA, 62 nt, hsa
ugucuuuagcauuuucccucuucccuucuaaugggcauuauaauuguuucaucuacucugug

SEQ ID NO: 214605 - RNA, 62 nt, hsa
agcuuggaccuuuguagcaccucaacaugaaagggcauuagcuauguuuccuguuuuuacag

SEQ ID NO: 214606 - RNA, 62 nt, hsa
ugguuguuaugggggugcaccagaucauaggagggcauuauuuggaggaaaccgcuauaaug

SEQ ID NO: 214607 - RNA, 62 nt, hsa
agggaguuaagagggccaaccuuagggcacgugggcauuauuaaaggucuuaaaagcauuga

SEQ ID NO: 214608 - RNA, 62 nt, hsa
gugaguuguugacauuggacaggugaacaguagggcauuacauuugugugaauuaaauguga

SEQ ID NO: 214609 - RNA, 62 nt, hsa
gcugugcagucccugcagcucucuuuccucuggggcauuauccaucuuucacuaucuguaau

SEQ ID NO: 214610 - RNA, 62 nt, hsa
uuuuccauuuuuaugugccucacaggcuguuugggcauuaauuuugcuuuuugagccuuaag

SEQ ID NO: 214611 - RNA, 62 nt, hsa
ugacuauauuuuuggagucccauuguuucagugggcauuaacagaaugcuuuaaaaacuucu

SEQ ID NO: 214612 - RNA, 62 nt, hsa
aguuuugaauggcauuucauuaaggcaucuaugggcauuaugagcuaaaagcugugguaugu

SEQ ID NO: 214613 - RNA, 62 nt, hsa
gacgguuccuacacaggacagggguuccuucugggcauuacaucgcauagaaaucaauaauu

SEQ ID NO: 214614 - RNA, 62 nt, hsa
uucuugcuaagagaaagaaaaacaaaaucagagggcauuaaauguuuuguaugugacaugau

SEQ ID NO: 214615 - RNA, 62 nt, hsa
cccccuucgcuccuccucucaucauuugcauugggcauuaguguccccccuugaagcaauaa

SEQ ID NO: 214616 - RNA, 62 nt, hsa
uauugagucuguccagauaaguuauuuauaaugggcauuacugaauuuuuaaaaugccgauu

SEQ ID NO: 214617 - RNA, 62 nt, hsa
gccaagacaguaucagacacagccccagaagggggcauuaugggcccugccuccccauaggc

SEQ ID NO: 214618 - RNA, 62 nt, hsa
ugaaagguaaguuggcucagaguugcacaguagggcauuaaauguuuaagcaaagcaucugc

SEQ ID NO: 214619 - RNA, 62 nt, hsa
cugccugacgccacagucauuggcagaggucugggcauuauuaauuuauaaaaauccaugcu

SEQ ID NO: 214620 - RNA, 62 nt, hsa
cacccuccagccaaggagcagcccugcccagggggcauuagguguggguacccggggagcac

SEQ ID NO: 214621 - RNA, 62 nt, hsa
guaugugugcccucccugugggcacaccaccugggcauuaggacugaaauuccugaguucuu

SEQ ID NO: 214622 - RNA, 62 nt, hsa
cauagaugacuuggaauaaaagcuguaugcaugggcauuaccccucagguccuaagaaauaa

SEQ ID NO: 214623 - RNA, 62 nt, hsa
gaaauccagucuuuaugaauauacuauuaguugggcauuaaaaaaucaguauauauuuuaac

SEQ ID NO: 214624 - RNA, 62 nt, hsa
aaaguuuccguuugcacaagaaaauaacgcuugggcauuaaaugaaugccuuuauagauagu

SEQ ID NO: 214625 - RNA, 62 nt, hsa
uguugugugugaauauguguuacaccuaggaugggcauuaugcaaaagcacaaagauuauau

SEQ ID NO: 214626 - RNA, 62 nt, hsa
aaguauuggaguucaugucuaacuucuucccagggcauuauguacagugcuuuuuauuacug

SEQ ID NO: 214627 - RNA, 62 nt, hsa
gcagaagaggacgaaaugccuuugggugggcagggcauuaaacugcuaaaagcugguuagau

SEQ ID NO: 214628 - RNA, 62 nt, hsa
cguguuggugagauuaagggaagaaggugggagggcauuagucaagccggacugccccaguc

SEQ ID NO: 214629 - RNA, 62 nt, hsa
guuauaaccuauggggucaggauaugaguccugggcauuauuuauccaggacccauccucuu

SEQ ID NO: 214630 - RNA, 62 nt, hsa
ggucuccucugauuaucagguacuggggcugagggcauuaaaaauaguaagccucccuccuc

SEQ ID NO: 214631 - RNA, 62 nt, hsa
aucacacuguauaagcuacuuagaacuuugaagggcauuaugauccugacuuuuugagagcu

SEQ ID NO: 214632 - RNA, 62 nt, hsa
uauuucaaagccaguuuagaaaguauuaguacgggcauuacaaucuuuugguuguuuugugu

SEQ ID NO: 214633 - RNA, 62 nt, hsa
cgggcacccgucaugcuuuugcugagaguugggggcauuaaccuugagcuaauguuaaaaau

SEQ ID NO: 214634 - RNA, 62 nt, hsa
aaucacugauucacacagacuauugcacguuggggcauuaggggcaauaauucuuauccaga

SEQ ID NO: 214635 - RNA, 62 nt, hsa
ccuuucuuucucugaauuacugcuuuuucugugggcauuaacuauauugcuacagcaucuag

SEQ ID NO: 214636 - RNA, 62 nt, hsa
uagcaaagguuauuccuggacacaggaaagacgggcauuacagggaccaaagcucugaaagg

SEQ ID NO: 214637 - RNA, 62 nt, hsa
uggccaggcugcugccaaggucaagcccucaagggcauuaccccgccuccucuucaucacug

SEQ ID NO: 214638 - RNA, 62 nt, hsa
acauuucuggauugugguuccaugcagccuuggggcauuauggguucuucccccacuucccc

SEQ ID NO: 214639 - RNA, 62 nt, hsa
gucaacacaaaccugccuuugguguauaaacagggcauuacagaaugguacacccuauauau

SEQ ID NO: 214640 - RNA, 62 nt, hsa
auagaguuaaagggaagugauguacauuucgggggcauuaggguagggagaugaaucaaaaa

SEQ ID NO: 214641 - RNA, 62 nt, hsa
acagcccguguccgucugcucgugggccuggagggcauuaauauuacacucacaggugaggg

SEQ ID NO: 214642 - RNA, 62 nt, hsa
aaguucauuccaguguuucauuuuaauaaugugggcauuauuaaauuuuuguggaagcuaau

SEQ ID NO: 214643 - RNA, 62 nt, hsa
caaccccagcaauuuuuccaaaagccagucaagggcauuacauuuguuccugggacuggcag

SEQ ID NO: 214644 - RNA, 62 nt, hsa
gcagauugguuggaucacagaaugugugucuggggcauuaucugaaacguggugucaucuga

SEQ ID NO: 214645 - RNA, 62 nt, hsa
gauuugcugcugaugaaaauacucaguuuccugggcauuaagucuaagagagaggagccugg

SEQ ID NO: 214646 - RNA, 62 nt, hsa
agauacacacuggacccucucuugcugaaugugggcauuaauuuuuugacugcagcucugcu

SEQ ID NO: 214647 - RNA, 62 nt, hsa
ccugguggggaucagacagagauuggagagaagggcauuaaccugucugggggccagcggca

SEQ ID NO: 214648 - RNA, 62 nt, hsa
ugauuuuuuuucucucucucuuuguuacauaagggcauuauguaacacuagccgaaugguag

SEQ ID NO: 214649 - RNA, 62 nt, hsa
aaaggggacuuuagaggacuucauacaaagcugggcauuaagaaaaccacaaugcauggccg

SEQ ID NO: 214650 - RNA, 62 nt, hsa
uaaaguaauggaacuuugaugaugccuuugcugggcauuauguguccaugccagggaugcca

SEQ ID NO: 214651 - RNA, 62 nt, hsa
ccgucaugcccgcuugagggucaggacccacggggcauuaucuugucugugauuccggguug

SEQ ID NO: 214652 - RNA, 62 nt, hsa
gugccccaucauauuaacugucaguauuuugggggcauuagguuaauagacuuaauugccua

SEQ ID NO: 214653 - RNA, 62 nt, hsa
uuuuguucuccagacuccagugauucugcacugggcauuauggaagacuugugauagaucag

SEQ ID NO: 214654 - RNA, 62 nt, hsa
cugggagcuacagggggcgugguuggggcaaggggcauuacugggaagacaauggccauugu

SEQ ID NO: 214655 - RNA, 62 nt, hsa
acuucacuuuaugauaguguauuggaugauuugggcauuacgaucaccucuuaccacagcac

SEQ ID NO: 214656 - RNA, 62 nt, hsa
gguuaaaaugccauuuuauuguguaagcucuugggcauuauacaacaaauaaucuaggauuu

SEQ ID NO: 214657 - RNA, 62 nt, hsa
guguggaauauggggguuaucuguacauccuggggcauuaaaaaaaaaaucaauggugggga

SEQ ID NO: 214658 - RNA, 62 nt, hsa
cccgggaggaguuaacuuugcgccggccgucagggcauuaccgcuaacgucugcaggagcuu

SEQ ID NO: 214659 - RNA, 62 nt, hsa
ccuacuaugugcccagcccuguucuaggcacugggcauuaccauagagaacaaaauagacaa

SEQ ID NO: 214660 - RNA, 62 nt, hsa
ucaaagauaggagaguuucuuuuuuuuuaggugggcauuauuuaugaccuuuucuuuggaag

SEQ ID NO: 214661 - RNA, 62 nt, hsa
guuucuuuugaucucuugauugaaggaggauagggcauuaaagugcuuuugacaugaggaau

SEQ ID NO: 214662 - RNA, 62 nt, hsa
aagaccccgucuaacacugcauccucccaacugggcauuacccaccauuguagccaccugug

SEQ ID NO: 214663 - RNA, 62 nt, hsa
uguuuagggaacagagaugccaguugaggggagggcauuaccugggcuauuggggaaaugug

SEQ ID NO: 214664 - RNA, 62 nt, hsa
gucaaacaacuuauaagacuagugauucacuggggcauuauuuuguuagaggaccuuaaaau

SEQ ID NO: 214665 - RNA, 62 nt, hsa
cucugagcagugauauagcauaauaaagccccgggcauuauuauuauuauuucuuuuguuac

SEQ ID NO: 214666 - RNA, 62 nt, hsa
cuugcuuuuggcaggauagagcuaagagaauugggcauuaguauuucauuaugugcaauaag

SEQ ID NO: 214667 - RNA, 62 nt, hsa
gucagugaguggugaaugaaugugaaggccuagggcauuacuguauacuacuguaggcuuua

SEQ ID NO: 214668 - RNA, 62 nt, hsa
caucugugucuccugugcagaaggagaggaaggggcauuaagagaugaagggugauuaugua

SEQ ID NO: 214669 - RNA, 62 nt, hsa
ccuucuaaauucccaaauccuagacugcuccugggcauuagcaaggcagagccuuuuuaccu

SEQ ID NO: 214670 - RNA, 62 nt, hsa
caugcugggcauccuaggccacuuugcuuagagggcauuaaaggugccaugaaagguagacu

SEQ ID NO: 214671 - RNA, 62 nt, hsa
uuuagagauaauugcuugccagugccaauugagggcauuaguacuuugugcucauaaauugg

SEQ ID NO: 214672 - RNA, 61 nt, hsa
gcaaaggcuucugaagaagaggaagggcgaguaggggcaccuggacgcugaugguggccag

SEQ ID NO: 214673 - RNA, 61 nt, hsa
gaccacuacuccaaacaaaacacaauaugccuaggggcacggaugaacguccagggagccc

SEQ ID NO: 214674 - RNA, 61 nt, hsa
ggugggguggggugagcuggcuuuggaauucuaggggcaugaggguauuuuuuagguucua

SEQ ID NO: 214675 - RNA, 61 nt, hsa
aaccugagagugggggagcuaagccaugagguaggggcaggcaagagagaggauucagacg

SEQ ID NO: 214676 - RNA, 61 nt, hsa
auugugguguacuauauuugugagccuaggguaggggcacugcugcaacuucugcuuucau

SEQ ID NO: 214677 - RNA, 61 nt, hsa
augguuuauuucccaguuuaacaguucagaauaggggcauuuauuuuaucauauuuuaggg

SEQ ID NO: 214678 - RNA, 61 nt, hsa
uauauaguugacacuugaaaaaugcaggugguaggggcacugacccaccccuacgccccgc

SEQ ID NO: 214679 - RNA, 61 nt, hsa
caucagcgcaauacuugaaccuucucccagguaggggcaggaggagccacaugagagaggg

SEQ ID NO: 214680 - RNA, 61 nt, hsa
aggcaugauugguggggagggaauguguauuuaggggcauaauaaaaagguggcucgaagc

SEQ ID NO: 214681 - RNA, 61 nt, hsa
aacaaaacaaagaaaaagagcuuugagucuguaggggcagcaauuugggggaagcaaauau

SEQ ID NO: 214682 - RNA, 61 nt, hsa
ggaaagccuuuacaaauuacucucaguucuuuaggggcagaaggcuuguuucaagagguuu

SEQ ID NO: 214683 - RNA, 61 nt, hsa
acagguguugggggcagccuguauuuuacccuaggggcaggucugcauggugaccccacau

SEQ ID NO: 214684 - RNA, 61 nt, hsa
cccaccugaagcccuggggaugauguggaaauaggggcacacacagaugauucauggaugg

SEQ ID NO: 214685 - RNA, 55 nt, hsa
gcgcugagcagaaugaguagcuagguaggggcaggugggugaucucuaagcugca

SEQ ID NO: 214686 - RNA, 61 nt, hsa
auggggccgguuggagggcaggggcucucccuaggggcauagcuggugaggaggucugggc

SEQ ID NO: 214687 - RNA, 61 nt, hsa
ccuaguggucguggggcacagaaaaaauagauaggggcagcucuaaagaccagcuguuaag

SEQ ID NO: 214688 - RNA, 61 nt, hsa
gacuuggggccuccauucauaaccaaaguuguaggggcauggaggcaguggcgccuuaugg

SEQ ID NO: 214689 - RNA, 61 nt, hsa
ccaugugcccugcuccugugugcaguugggguaggggcagcuggcauggucagguaacacu

SEQ ID NO: 214690 - RNA, 61 nt, hsa
auuuuuaaaaggacuauugaugauagaagaauaggggcaagacgacaaaaguaccuuugaa

SEQ ID NO: 214691 - RNA, 61 nt, hsa
cagcugccaaguaggacaugacuaggaguguuaggggcagaaguuuugaaugcacuuaacc

SEQ ID NO: 214692 - RNA, 61 nt, hsa
gugugugugcaaaucugugugacuggagcucuaggggcaucucugugucugagugugccug

SEQ ID NO: 214693 - RNA, 61 nt, hsa
aagucaggagcaaaacccaaguagaugccucuaggggcacauggccccucacaucacaagc

SEQ ID NO: 214694 - RNA, 61 nt, hsa
gaacaacuacauuuucucauauacagguagcuaggggcaacacaguuccauucuagaggga

SEQ ID NO: 214695 - RNA, 61 nt, hsa
cuaucucccccaacccaccucuggcccuguguaggggcagggauggggguggcugggacuc

SEQ ID NO: 214696 - RNA, 61 nt, hsa
ggccaauugacauauaauuuguucuuaaaaauaggggcaugaaauaugugaucuggaaaag

SEQ ID NO: 214697 - RNA, 61 nt, hsa
ccagagcccuguggcuccccacacccugccauaggggcaguccugccuuacacauagaagc

SEQ ID NO: 214698 - RNA, 61 nt, hsa
aaaauagaucaaugaauauaauucagucuuuuaggggcaccaaguaaagcauaaggucaua

SEQ ID NO: 214699 - RNA, 61 nt, hsa
gcgucucccccaccagccccaccaggcgguguaggggcagcaggcugcacugaggaccgug

SEQ ID NO: 214700 - RNA, 61 nt, hsa
uuuuuauggaccauaaagguuuaaaagaaaauaggggcacaggcuguugagguuuuuaugu

SEQ ID NO: 214701 - RNA, 61 nt, hsa
aggcugcagggugaggccaggcaggccuggguaggggcagcuucuggagccuugggacaga

SEQ ID NO: 214702 - RNA, 61 nt, hsa
guucucaggaccuguucaagaaggugucuccuaggggcagccugaaugccucccucaaagg

SEQ ID NO: 214703 - RNA, 61 nt, hsa
uggauggaagagcuauaagaggugguaggcauaggggcaagccauguaagcugaggauugg

SEQ ID NO: 214704 - RNA, 61 nt, hsa
uccacuucagucuuaggcagauuugaccuuuuaggggcagcaaugcugaaggacacagcaa

SEQ ID NO: 214705 - RNA, 61 nt, hsa
gguuugcauuaacuuuucaaaguaguuccuauaggggcauugaggagcuuccucauucugg

SEQ ID NO: 214706 - RNA, 61 nt, hsa
guuaacugacuucacuaggcauugugauguuuaggggcaaacaucacaaaauguaauuuaa

SEQ ID NO: 214707 - RNA, 61 nt, hsa
ccuagccaaguuuaagaggcaaguaaaaauauaggggcaaugucagaugaagucuuguuca

SEQ ID NO: 214708 - RNA, 61 nt, hsa
aucuugaacagcccaaaguaucauucucagauaggggcacccaagcuaaggguauuagcca

SEQ ID NO: 214709 - RNA, 61 nt, hsa
aaggaaaugaaugugcauuuuauuaauuccuuaggggcacaaggaggacaauaauagcuga

SEQ ID NO: 214710 - RNA, 61 nt, hsa
ccugcugcuguuaccagccaugugggccccauaggggcacugcgccugcugcccuuuccug

SEQ ID NO: 214711 - RNA, 61 nt, hsa
acagcuguguuacugcuuggagaagcauauguaggggcauacccugugguguugugcugug

SEQ ID NO: 214712 - RNA, 61 nt, hsa
auuuuuguuaaagagcacuugguggagguaguaggggcagggaaaggucagcauaggagag

SEQ ID NO: 214713 - RNA, 61 nt, hsa
ucucauaaugugaaauaugaugagauucacuuaggggcagcauguuaguuuugggaggcaa

SEQ ID NO: 214714 - RNA, 61 nt, hsa
ccugucauuccagaggaugcugagaaauguguaggggcacuuuuuugguugucauauuuac

SEQ ID NO: 214715 - RNA, 61 nt, hsa
acuccuaauuaauucccacauucacuguaacuaggggcauaguccauucuguuaggauuau

SEQ ID NO: 214716 - RNA, 61 nt, hsa
auccaguuuuuuguuguuauuuuuaaucaauuaggggcaauaguagaauggacaauuucca

SEQ ID NO: 214717 - RNA, 61 nt, hsa
cuguaaggguacugggagaaguaggauuaguuaggggcagaucuugaauucuggccaagaa

SEQ ID NO: 214718 - RNA, 61 nt, hsa
ggugggcuggcaggaggccuaggccuugcccuaggggcaguccugcuuccucauuuuauag

SEQ ID NO: 214719 - RNA, 61 nt, hsa
ugguuuuuuuuauugggcugaguucacgaauuaggggcaggagcuggaagucgcccuagga

SEQ ID NO: 214720 - RNA, 61 nt, hsa
aaguuaaaauuagauaugagaauguuuugcguaggggcaacacagucugcugcuauauagu

SEQ ID NO: 214721 - RNA, 61 nt, hsa
gcacugaaaaccccucuggucucagagacaguaggggcagugccacuuucuacaaccugcc

SEQ ID NO: 214722 - RNA, 61 nt, hsa
augaggaauauaacauugcagaaauuucucauaggggcaugccagugagcaauuacuuuau

SEQ ID NO: 214723 - RNA, 61 nt, hsa
auagggacuauuguaauacccucacacauuauaggggcaucagagaauggcauggaagaga

SEQ ID NO: 214724 - RNA, 61 nt, hsa
aaauaaacacauuucuaacaauacaagggaguaggggcagaccuguguugaguauuugugu

SEQ ID NO: 214725 - RNA, 61 nt, hsa
uuucccucuuagaaaaucucagaagaaugauuaggggcacccaaaguucugguuaucuaug

SEQ ID NO: 214726 - RNA, 61 nt, hsa
acauuaaauaccagccagcaggaggugaucauaggggcauagccaguucugacaguguuuu

SEQ ID NO: 214727 - RNA, 61 nt, hsa
gaucaacaaaauaauucuaaauacucuuccauaggggcaucuauucaaaaugcuugcauga

SEQ ID NO: 214728 - RNA, 61 nt, hsa
accuuaugcaaacauuucugugccugcuggguaggggcacgucugaggggcccugcuccaa

SEQ ID NO: 214729 - RNA, 61 nt, hsa
uuuuuuaaaaauuuaaaauggaagggaagaauaggggcagggcauuauuaggcuauuucug

SEQ ID NO: 214730 - RNA, 61 nt, hsa
uacaacuauucuuaaugcuugaacauguauuuaggggcaaguuucucaugaugaugaaaaa

SEQ ID NO: 214731 - RNA, 61 nt, hsa
ugacuucaugaguuacacagaugcuaauucguaggggcacuuggaaucacaugguuguuuu

SEQ ID NO: 214732 - RNA, 61 nt, hsa
gagugccuguguagcuggggauggggauuccuaggggcagaugaaggacaagccccacugg

SEQ ID NO: 214733 - RNA, 61 nt, hsa
gcagcucccagugugaccugacaaaaacacguaggggcagggacgguccccacccccaggg

SEQ ID NO: 214734 - RNA, 61 nt, hsa
cauacauugcugaggaccugacaggacaaccuaggggcagggcugggguggggaccgcagg

SEQ ID NO: 214735 - RNA, 61 nt, hsa
acauaguuuguggggaaaacaaacguucagcuaggggcaaaaagcaugacugcuuuuuccu

SEQ ID NO: 214736 - RNA, 61 nt, hsa
cugcuggcagggccaggcaaggccagagugcuaggggcagggugaaggcuucagcucacug

SEQ ID NO: 214737 - RNA, 61 nt, hsa
aaauauauacuugaccaagcaccaugaucccuaggggcaugagaaaagcacauaauggaug

SEQ ID NO: 214738 - RNA, 61 nt, hsa
acaaagagagaaagaaaacccaguguuuccauaggggcacuuuuagccuucccacaacagu

SEQ ID NO: 214739 - RNA, 61 nt, hsa
auguguuucucuggagaagggcacauuuaucuaggggcauuucagguuuccaaagaaagga

SEQ ID NO: 214740 - RNA, 61 nt, hsa
uauucuugcaguuuuaaguggaugcuaauuuuaggggcauaagccuuuuauggcccucuug

SEQ ID NO: 214741 - RNA, 61 nt, hsa
cguaagagaugggguugcugcaguguuggaguaggggcagagggagggagccaaggucacu

SEQ ID NO: 214742 - RNA, 61 nt, hsa
cuagcaaaaucaggcagcucugccccaucgguaggggcaccgauuagucuacuaacagcca

SEQ ID NO: 214743 - RNA, 61 nt, hsa
gcugccauggcuccaggcucccuccccugccuaggggcaaaguccaucggguccugggccu

SEQ ID NO: 214744 - RNA, 61 nt, hsa
cucguccucuuccauaaggcugagucugauguaggggcaaagagacuggcuuuucaaacug

SEQ ID NO: 214745 - RNA, 61 nt, hsa
cugaccaccgauugagacgucuccaggaccuuaggggcagauccguuuucucacuguugga

SEQ ID NO: 214746 - RNA, 61 nt, hsa
uugggcaaugaggaaggaaagguuucaaauuuaggggcagaagugagagaaugagccaacc

SEQ ID NO: 214747 - RNA, 61 nt, hsa
aggugcuuuguaaucuggaauggagaagagguaggggcauuuggggauuccuguuuacuug

SEQ ID NO: 214748 - RNA, 61 nt, hsa
cucugaaguuauaaugcuuuggucucuacauuaggggcaagauccagucugagagaagucu

SEQ ID NO: 214749 - RNA, 61 nt, hsa
ucucuccugcucacccgccucuugccccuucuaggggcaggugaaaggaauaggaaauuga

SEQ ID NO: 214750 - RNA, 61 nt, hsa
aucuuuguuuaaauaagguuaguacauucacuaggggcaaauggguuuuucuaaauaaaug

SEQ ID NO: 214751 - RNA, 61 nt, hsa
ugcaaaugggaaaaaaguuuacauuucaguuuaggggcauaucuaagcuaugcuauucccu

SEQ ID NO: 214752 - RNA, 61 nt, hsa
gggcuugacaccugacucugagcuggaacaguaggggcagggagaagacaggucucaagaa

SEQ ID NO: 214753 - RNA, 61 nt, hsa
caggugccguggagcagcaggcuggcuuugguaggggcacccaucacccggcuugccugug

SEQ ID NO: 214754 - RNA, 61 nt, hsa
ucuguugguuaguagacacuaauucugucaguaggggcaugguauaaggaaauaucauaau

SEQ ID NO: 214755 - RNA, 61 nt, hsa
auuugacuaucuuggggguaaaaugcugucauaggggcagcagucucaggggguguaaacu

SEQ ID NO: 214756 - RNA, 61 nt, hsa
uuccucuugcaguguccacaaaucugaauauuaggggcaugaaauuaggcuuaccaucuga

SEQ ID NO: 214757 - RNA, 61 nt, hsa
ucuucacagccugcacugcccagugggccacuaggggcagucucuggaagggcugguucaa

SEQ ID NO: 214758 - RNA, 61 nt, hsa
aaugaguacagauaauuucacuuuccucuucuaggggcaaaggcugauggccucuaccuuu

SEQ ID NO: 214759 - RNA, 61 nt, hsa
uuacuuagaccucagccggcgccggacccgguaggggcagucugggcagcaggaaggaagg

SEQ ID NO: 214760 - RNA, 61 nt, hsa
uuguuguuuguuuguuuuccuacaagugauuuaggggcagauccugacuacacuaagucag

SEQ ID NO: 214761 - RNA, 61 nt, hsa
uuuacucuccuugucacuuauuugggagaaauaggggcacgugagauaagaagaagaauaa

SEQ ID NO: 214762 - RNA, 61 nt, hsa
cagucuggggucagggaucagcgaucagggauaggggcagguuguauggcagaugcaccug

SEQ ID NO: 214763 - RNA, 61 nt, hsa
gggcuggggccugggccucaggagccuaggcuaggggcaccuccgagagccccuuuuugug

SEQ ID NO: 214764 - RNA, 61 nt, hsa
gcuuauugguaugaaauagaagguggcuuuguaggggcaagcaggcaaagaguacuaucca

SEQ ID NO: 214765 - RNA, 61 nt, hsa
ggagucagauggcaauggguacuccagcagguaggggcacagugaauguguguauguauga

SEQ ID NO: 214766 - RNA, 61 nt, hsa
cugugugugugucugaguugugugauuuuauuaggggcaucugccaauucucucacugugg

SEQ ID NO: 214767 - RNA, 61 nt, hsa
ucuaccugcccucaaggguguguauauuguauaggggcaacuguaugaaaaauuggggagg

SEQ ID NO: 214768 - RNA, 61 nt, hsa
gcuuugguucuucagaugcucuugggguucauaggggcagguccuagucgggcagggcccc

SEQ ID NO: 214769 - RNA, 61 nt, hsa
ugaguugagucuccucucugagacugcuaaguaggggcagugaugguugccaggacgaauu

SEQ ID NO: 214770 - RNA, 61 nt, hsa
uaaacgauggggauggaugaucccgccucuguaggggcauggcugcuauuaucuggaaauu

SEQ ID NO: 214771 - RNA, 61 nt, hsa
ccaugacugaggcaggcauggaguugggcguuaggggcaggcagagggccuuugcuacacu

SEQ ID NO: 214772 - RNA, 61 nt, hsa
acugacaugauuagcagaagaaaggaacauuuaggggcaagcaggcgcugugcuaucauga

SEQ ID NO: 214773 - RNA, 61 nt, hsa
uggugcuuuuuaaaaaacaccaucacuacauuaggggcaauuuuuucacaccucccugucu

SEQ ID NO: 214774 - RNA, 61 nt, hsa
ucacccuggaaaauacagugcccugccuucuuaggggcaucagcccugaacgguugagagc

SEQ ID NO: 214775 - RNA, 61 nt, hsa
ggauugcacagagcuggagggaggggugagauaggggcagauaggagcugcaggggugccu

SEQ ID NO: 214776 - RNA, 61 nt, hsa
uggaauuauaauucagaaucaucuugguagauaggggcacugugcuuaaacaaaaugccau

SEQ ID NO: 214777 - RNA, 61 nt, hsa
ggggagggagaaaauggggcuaugccuggcuuaggggcaaccucguacugagaggagguga

SEQ ID NO: 214778 - RNA, 61 nt, hsa
uuuacaugauuugaugugcaauagggugggguaggggcagggaaaggacugggccagggca

SEQ ID NO: 214779 - RNA, 61 nt, hsa
ucuggcagcacugaagagccacugaaggggguaggggcaguguagguccuggggcagcccc

SEQ ID NO: 214780 - RNA, 61 nt, hsa
ggagacuauggggagcccaccgccuacacaguaggggcaguagcccccagcuccacgccug

SEQ ID NO: 214781 - RNA, 61 nt, hsa
cagucuguagcaguugaagcugugaaugugcuaggggcaagcauuugucuuuguauguggu

SEQ ID NO: 214782 - RNA, 61 nt, hsa
aagucugucuagggugggauugucagaggucuaggggcacugugggccuagugaagccuac

SEQ ID NO: 214783 - RNA, 61 nt, hsa
gauucacacagacuauugcacguuggggcauuaggggcaauaauucuuauccagacauggg

SEQ ID NO: 214784 - RNA, 58 nt, hsa
cuggcugugaaggcagcugacacagggcuaggggcagcagcugggccuucgaggcgca

SEQ ID NO: 214785 - RNA, 61 nt, hsa
cacagaggggaggggaauguuuuggcaaguuuaggggcacaggagauguagucguuccagg

SEQ ID NO: 214786 - RNA, 61 nt, hsa
agaaaacauucccucuugcaauggcaagaacuaggggcaguucucugucccuccucccaac

SEQ ID NO: 214787 - RNA, 61 nt, hsa
cccagaggguagagugccuccuguggaaguuuaggggcaaauuuguucccugaccuggaga

SEQ ID NO: 214788 - RNA, 61 nt, hsa
gcaagccucuccuccaccuucaccccaagacuaggggcaggaaugauaagaaggcugggug

SEQ ID NO: 214789 - RNA, 61 nt, hsa
gggacccugggggcgggcauggaaguggaaguaggggcaagcucuugccccacucccuggc

SEQ ID NO: 214790 - RNA, 61 nt, hsa
gagucagaugagcaaggacauugccccaagauaggggcacacuacagagcagcuccccagg

SEQ ID NO: 214791 - RNA, 61 nt, hsa
accucugaguuugcccacucaaggccacucauaggggcauccauccccaagcaccuccuca

SEQ ID NO: 214792 - RNA, 61 nt, hsa
gcucauauuuuuauaauucugauugagaauuuaggggcaugguaauuuuuaccaaaacuga

SEQ ID NO: 214793 - RNA, 61 nt, hsa
cuuauuuugggacuucaguucucgugguccauaggggcagagaugucaaagugaagguugc

SEQ ID NO: 214794 - RNA, 61 nt, hsa
cccagccucucccccacauugucccugacucuaggggcacauccagucuccaucgugcugc

SEQ ID NO: 214795 - RNA, 61 nt, hsa
acacuucggcagggucaccaggaggcacagcuaggggcaugcucacauggguaggucaguu

SEQ ID NO: 214796 - RNA, 61 nt, hsa
gcagagguauucaguuccuggcacaggggacuaggggcauguagaguauaugaggaggcag

SEQ ID NO: 214797 - RNA, 61 nt, hsa
uguggcuggccucagauacaccuaagaagcuuaggggcaagguucauucuccugcuuuaaa

SEQ ID NO: 214798 - RNA, 61 nt, hsa
uuaucugugcagggggcuggcaucauguauuuaggggcaaguaauaauggaaugcuacuaa

SEQ ID NO: 214799 - RNA, 61 nt, hsa
aaucuguuuaauguuaucaguacauuuuaaauaggggcauugaaauuuacucccaccacca

SEQ ID NO: 214800 - RNA, 61 nt, hsa
cucaugggacagcuagccaggcaugguuggauaggggcagggcacucauuaaagugcauca

SEQ ID NO: 214801 - RNA, 61 nt, hsa
ugcugcgcccugccucggccuugcgccuguguaggggcagcucggccucuggucgccuugg

SEQ ID NO: 214802 - RNA, 61 nt, hsa
gugggaauucccgcggccuccaccugcuugcuaggggcaggaucucauucaggcugcccug

SEQ ID NO: 214803 - RNA, 61 nt, hsa
ugucaucuugcaugcaaucaggagaaucucauaggggcaggaccuuccccuacucugccuc

SEQ ID NO: 214804 - RNA, 61 nt, hsa
uagcuggccaacgucagggucggggcuaggguaggggcaaggaaacucgaauaaaggaugg

SEQ ID NO: 214805 - RNA, 61 nt, hsa
acaccacugaugccacagaagccuuuaucguuaggggcaaaagcagacaucucugguagca

SEQ ID NO: 214806 - RNA, 61 nt, hsa
gaaaugucucugcuccuacauccagcuccucuaggggcagccuccgucauccaugcccucc

SEQ ID NO: 214807 - RNA, 61 nt, hsa
gucuagauuuuuucagaaaaacguggagugcuaggggcagccuggaaaagauggggaaccu

SEQ ID NO: 214808 - RNA, 61 nt, hsa
accaugaggaaauaaucagacaaauccacauuaggggcauucugcuaaacaucugacccag

SEQ ID NO: 214809 - RNA, 61 nt, hsa
ucgauugcugugagcagaggccacucggaguuaggggcaugggcaauagcaagcuggcggc

SEQ ID NO: 214810 - RNA, 61 nt, hsa
accgcugauguuugccuugucaauaucagaauaggggcaucagugucccgugaaauacauu

SEQ ID NO: 214811 - RNA, 61 nt, hsa
uagugggacccgugggguuggagcaugccuuuaggggcagugucugggccgaagcacgucc

SEQ ID NO: 214812 - RNA, 61 nt, hsa
ggcuggagccuucuccccuccccaguuggacuaggggcaguguuaauuuugaaaaggugug

SEQ ID NO: 214813 - RNA, 61 nt, hsa
ggcuggcaggggccagugggcucagcccagguaggggcaggauggagggcugagcccugug

SEQ ID NO: 214814 - RNA, 61 nt, hsa
gagccauacucuggcugccucuuugccuuccuaggggcauuuucuuuaacuuccagaauag

SEQ ID NO: 214815 - RNA, 61 nt, hsa
auaaaauacauuuuuugcauucuacuauuuuuaggggcaugaaaugaaugaaagcuuuagc

SEQ ID NO: 214816 - RNA, 61 nt, hsa
gagaacuuguaaugguguuagggaacaguuguaggggcagaaaacaacucugaaaguggua

SEQ ID NO: 214817 - RNA, 61 nt, hsa
ccuccaaucccaccggacccaggcccugggcuaggggcagagcaggccccgccccagggca

SEQ ID NO: 214818 - RNA, 61 nt, hsa
uauuuauuccccuuuagguuugcagaggggguaggggcagagucaggggcuggccagaggg

SEQ ID NO: 214819 - RNA, 61 nt, hsa
cgugcagcugaccugcccuccagcccaggacuaggggcaggacucuugccugaacccccag

SEQ ID NO: 214820 - RNA, 61 nt, hsa
ggggcuaucccuacaaagaagaauccagaaauaggggcacauugaggaaugauacugagcc

SEQ ID NO: 214821 - RNA, 61 nt, hsa
cuaaccaugaucuugagggacccaacauuuguaggggcacuaauccagcccuuaaaucccc

SEQ ID NO: 214822 - RNA, 61 nt, hsa
gccagccuccccagcccccuucccucaacucuaggggcagcauagccccaggccacccuag

SEQ ID NO: 214823 - RNA, 61 nt, hsa
acugagacucugauucagcgagaaacaaccauaggggcagaucccuucaucuguccuggga

SEQ ID NO: 214824 - RNA, 61 nt, hsa
cgcccgccucagccucccaaaguguuaggauuaggggcaugagccaccgcacccagcuugc

SEQ ID NO: 214825 - RNA, 61 nt, hsa
cuuggggccgugguggcccuaucugugugcauaggggcacugaagaauuacaaagugauuu

SEQ ID NO: 214826 - RNA, 58 nt, hsa
uauucaccucugcucucugaagggcauuuaggggcauuucuauggcaaagcuauaggu

SEQ ID NO: 214827 - RNA, 61 nt, hsa
uuguggguuuuauccugcucagucaguggccuaggggcagguccuguguucucucccucuc

SEQ ID NO: 214828 - RNA, 61 nt, hsa
uccuuacaucuaggcccagcugaacccagguuaggggcagaucagaagggcugcguguagc

SEQ ID NO: 214829 - RNA, 61 nt, hsa
ucccagggagccagaccugugcuguugggguuaggggcagccaugggccccagccaggaca

SEQ ID NO: 214830 - RNA, 61 nt, hsa
gccucaacauggagccuugccuggccugggcuaggggcacugucugaacuccugacuguca

SEQ ID NO: 214831 - RNA, 61 nt, hsa
uucuguacugucuugguuagcucuauauaaguaggggcagcuuagcccugaggcccagaga

SEQ ID NO: 214832 - RNA, 61 nt, hsa
gcucugaagcugccuucagacaaggcuagucuaggggcaagagugcgagcuggcugacaau

SEQ ID NO: 214833 - RNA, 61 nt, hsa
cuggggaaagggaugggagccaggaaagauuuaggggcaggagacagacacguaacaggaa

SEQ ID NO: 214834 - RNA, 61 nt, hsa
uuggaguggccaaauaggagggagacugugguaggggcagggaggcaacacugcuguccac

SEQ ID NO: 214835 - RNA, 61 nt, hsa
ucuugccuugaggcucugcaguggcaaaugguaggggcaauagcgcucccuuuucaccuga

SEQ ID NO: 214836 - RNA, 61 nt, hsa
cuuacugaagaacauucccagugccccuggcuaggggcagagggcacugccaggcuguguu

SEQ ID NO: 214837 - RNA, 61 nt, hsa
ucagaggcagaaccuagucuuguuguucauauaggggcaaaaauuugacauugucagaaug

SEQ ID NO: 214838 - RNA, 61 nt, hsa
gccaagaccuuucaaagccauuuuaggcuguuaggggcaguggagguagaaugacuccuug

SEQ ID NO: 214839 - RNA, 61 nt, hsa
cacaggugugugcaguugcucccagugcaguuaggggcagauauccagaagccuaggagau

SEQ ID NO: 214840 - RNA, 64 nt, hsa
guaaaggagaacagcuauauuguccuuucuauaagcuugucacugcaaaaaguugccuuuugcu

SEQ ID NO: 214841 - RNA, 64 nt, hsa
ucuauaagcuugucacugcaaaaaguugccuuuugcuugucagguuuggauagaauauaauuga

SEQ ID NO: 214842 - RNA, 64 nt, hsa
cuugguuaauuaaguaaccuaaaguaugcauuaggauugugaaaugucucgugaguaugccaau

SEQ ID NO: 214843 - RNA, 64 nt, hsa
uuuaaauuacaacucuuguuauaacuuuuuaaaagauugugaaaauaucaaaauauaaaugaau

SEQ ID NO: 214844 - RNA, 64 nt, hsa
uugagcccaggaggucgaggcugcagugugcugugauugugacacugcccuccagccuggguga

SEQ ID NO: 214845 - RNA, 64 nt, hsa
aaaaaaaaaaaaaaagaaaagaaaaagauaaagggauugugaaaagagcauuuauauuggacua

SEQ ID NO: 214846 - RNA, 64 nt, hsa
aggaaaaaagagaacaucaccuuguaaaacugaagauugugaccagucagaauaaugucaaagu

SEQ ID NO: 214847 - RNA, 64 nt, hsa
auugcacuugucccggccuguugaguuugguggggauugugaccagaagauuuugaaaauuaaa

SEQ ID NO: 214848 - RNA, 64 nt, hsa
ugcuaccauaguaauuaauguuuccaguuaucaagauugugauuagacacauuuaccuuucuuc

SEQ ID NO: 214849 - RNA, 64 nt, hsa
ggggauugcgaugauugaucugggaacauggcuggauugugauuuaaccaagaaugcugauguu

SEQ ID NO: 214850 - RNA, 64 nt, hsa
ggccucauccuccacugaagaguauggauugaaggauugugaacuauguuuagugugauuguga

SEQ ID NO: 214851 - RNA, 64 nt, hsa
uauggauugaaggauugugaacuauguuuagugugauugugaacuuggugccuaauguuccaug

SEQ ID NO: 214852 - RNA, 64 nt, hsa
agugcaauuuuaagucuaauucaugcagaugauugauugugauuauuguaagaaauuucuuaca

SEQ ID NO: 214853 - RNA, 64 nt, hsa
uuuuagcaucuuuuuuuuuuuuuacaaucauucagauugugaauucaggcucagaauuuaccca

SEQ ID NO: 214854 - RNA, 64 nt, hsa
uacucacuuagugauuuguaaaauuugcacaugugauugugaagaaauuuguacuaccuaaaag

SEQ ID NO: 214855 - RNA, 64 nt, hsa
gcauagaaagaauauaaauauccuguacacggcagauugugaacaaacuauauuccuuuaaguu

SEQ ID NO: 214856 - RNA, 64 nt, hsa
gaagaacuagugguaaaacauccaagagcacuaggauugugauacagaauuugugagguuuggu

SEQ ID NO: 214857 - RNA, 64 nt, hsa
aaauuguuucagaguuuguuuuuuuuuuaguuuagauugugaggcaauuauuaaaucaaaauua

SEQ ID NO: 214858 - RNA, 64 nt, hsa; identical to SEQ ID NO: 167761

SEQ ID NO: 214859 - RNA, 64 nt, hsa; identical to SEQ ID NO: 167762

SEQ ID NO: 214860 - RNA, 64 nt, hsa; identical to SEQ ID NO: 167763

SEQ ID NO: 214861 - RNA, 64 nt, hsa; identical to SEQ ID NO: 167764

SEQ ID NO: 214862 - RNA, 64 nt, hsa; identical to SEQ ID NO: 167765

SEQ ID NO: 214863 - RNA, 64 nt, hsa; identical to SEQ ID NO: 167766

SEQ ID NO: 214864 - RNA, 64 nt, hsa
ucauuccaaacucaccaagguggcuuauagaacagaagcagauggauaugaagaggagagggga

SEQ ID NO: 214865 - RNA, 64 nt, hsa
ggaagaaaagagggcaaagggaacaaugugaaaagaagcagaaaaucauaaaagaccauguguu

SEQ ID NO: 214866 - RNA, 64 nt, hsa
ccugcccgccagcccugcucuuguuguggagaaggaagcagaugugaucacaucaccccgucau

SEQ ID NO: 214867 - RNA, 64 nt, hsa
cuccagcugucuucuaccacuagaagacccaagagaagcagaagucgcucgcacuggucagucg

SEQ ID NO: 214868 - RNA, 64 nt, hsa
ggauguaagggaugagaaggauggcggggcuagggaagcagagagcagagcacacacuggcuca

SEQ ID NO: 214869 - RNA, 64 nt, hsa
agaggugaggaaacuuuuaggugguggaaccagggaagcagagagcagagcaugcagugaugga

SEQ ID NO: 214870 - RNA, 64 nt, hsa
augugacgaaaguggaaauggagaugguccugcagaagcagaagugcaauccagcccaugccga

SEQ ID NO: 214871 - RNA, 64 nt, hsa
ccaaggugaagagauacagccuuccguauccaucgaagcagaugcucugaacccugagcaggca

SEQ ID NO: 214872 - RNA, 64 nt, hsa
aacccugcuccuaccaaucuuuuuuaaagcaguugaagcagaauguauaggugucagagaagaa

SEQ ID NO: 214873 - RNA, 64 nt, hsa
accaacuugccagccauguaagggagccaucuuggaagcagauccuccagccuccagucaaguc

SEQ ID NO: 214874 - RNA, 64 nt, hsa
ucugagcccauguuuucugcucaguagcagcuuggaagcagauuuggaaugguuuacuauuuug

SEQ ID NO: 214875 - RNA, 64 nt, hsa
gguuuacuauuuuggcugcucuuggggacugcgagaagcagagagaaugagagaccaguggcaa

SEQ ID NO: 214876 - RNA, 64 nt, hsa
cggagagaaagaggagcccucccgcucagccucagaagcagacucugaagccggagagcugcgg

SEQ ID NO: 214877 - RNA, 64 nt, hsa
ccaccaugaggugcaaaacgagacagaagagugagaagcagauggaggagaagagaagagccaa

SEQ ID NO: 214878 - RNA, 64 nt, hsa
aggagcugaguuuggcaacaacccaagugagccugaagcagauucgccccagagccuccaggcg

SEQ ID NO: 214879 - RNA, 64 nt, hsa
cucuaacucuauacuguagagaugagucugguccgaagcagauuaguaauuuagagauaagcca

SEQ ID NO: 214880 - RNA, 64 nt, hsa
ccccagaugggccaaagaaagagccuaugaaggagaagcagaagcagacggcuggccuggcuca

SEQ ID NO: 214881 - RNA, 64 nt, hsa
augggccaaagaaagagccuaugaaggagaagcagaagcagacggcuggccuggcucaccuucc

SEQ ID NO: 214882 - RNA, 64 nt, hsa
agcuuacaucaguuguuuguuugauuagaaaaaugaagcagacacacacacacacacacacaca

SEQ ID NO: 214883 - RNA, 64 nt, hsa
uugaauuucauauuugagagacauuugucuucaugaagcagauuugcacuggaaccauugcuuu

SEQ ID NO: 214884 - RNA, 64 nt, hsa
cagcuuaucaacgaccgcuguguggacaugcagagaagcagagaagaagaaaggagcugaggag

SEQ ID NO: 214885 - RNA, 64 nt, hsa
ggaagcguuugaaggccaagaaccugauguaccugaagcagauccuguauuugcuggagaaauu

SEQ ID NO: 214886 - RNA, 64 nt, hsa
uuucucuaggauaagcuugugugguucugccagugaagcagagaaccaccugugcuguugugga

SEQ ID NO: 214887 - RNA, 64 nt, hsa
caguuagccagacuguuuuuaaagcaccuggcgggaagcagaagguuggauccaagcccuuguu

SEQ ID NO: 214888 - RNA, 64 nt, hsa
ugcuccccugugcuguuacuccuucugccaacuggaagcagauggugaccaggcucuggagaag

SEQ ID NO: 214889 - RNA, 64 nt, hsa
ccgccugcaccgccgcgaagccgaagccgaagccgaagcagagcucggcgccgcugcucccgcc

SEQ ID NO: 214890 - RNA, 64 nt, hsa
uucauauacaaagccuguaauuuuaggcgaaauggaagcagaaaucuaggaaguugugcuugcu

SEQ ID NO: 214891 - RNA, 64 nt, hsa
ggagggaggaaaggguaggaagggugggaagggagaagcagacauagucauuuaugauuugaaa

SEQ ID NO: 214892 - RNA, 64 nt, hsa
ugaaaugcgcccgccuggcggacagcucccuucugaagcagagaagccuccauggucacgaagc

SEQ ID NO: 214893 - RNA, 64 nt, hsa
gaaagucugaguugggagugacaguggcuggagagaagcagaucugugcaacgugcagggcaag

SEQ ID NO: 214894 - RNA, 64 nt, hsa
gcacccugggacugcggccuuucccagcuuuauugaagcagaaugguggaacuugugccggagg

SEQ ID NO: 214895 - RNA, 64 nt, hsa
gcgugcgccuguagucccagcuacucgggaggcugaagcagaagaaucgcuugaacccgggagg

SEQ ID NO: 214896 - RNA, 64 nt, hsa
agaucacacaacauuuauucuucuuacagguaaagaagcagauuuuagaugaaaagaucuacug

SEQ ID NO: 214897 - RNA, 64 nt, hsa
ccucgcagauggagcggcagcgccucgcucgagagaagcagaugagggaggaggcugaacgcac

SEQ ID NO: 214898 - RNA, 64 nt, hsa
aaaaagacuuuaaaaaaugguaaugaaaauggaaugcagcuacugcagcuaauaaaaaauuuua

SEQ ID NO: 214899 - RNA, 64 nt, hsa
uuaaaaaaugguaaugaaaauggaaugcagcuacugcagcuaauaaaaaauuuuagauagcaau

SEQ ID NO: 214900 - RNA, 64 nt, hsa
gccagggcagugcugcugcagagcuagaaggcccugcagcuacagcugcuucauucccugcauu

SEQ ID NO: 214901 - RNA, 64 nt, hsa
cauacacugagcgggcuacagagcuagaaggcccugcagcuacagcugcuucauucccugcauu

SEQ ID NO: 214902 - RNA, 64 nt, hsa
gcagcuaucaucugcagcuauaaucauagcucacugcagcuaugaucaugucucagcacuccag

SEQ ID NO: 214903 - RNA, 64 nt, hsa
uugagucuaggaguucggggcugcagcuaucaucugcagcuauaaucauagcucacugcagcua

SEQ ID NO: 214904 - RNA, 64 nt, hsa
aauguaggaucacuugagucuaggaguucggggcugcagcuaucaucugcagcuauaaucauag

SEQ ID NO: 214905 - RNA, 64 nt, hsa
aggggaaagccagaagguugcuugugucugugacugcagcuauggccuuguuugcuuaguuuau

SEQ ID NO: 214906 - RNA, 64 nt, hsa
cgcuuugguugucaugagaaagagacauucuccuugcagcuaccuccaugugagugaauuccug

SEQ ID NO: 214907 - RNA, 62 nt, hsa
gggcugggaggaccccagugcccuccucagaagaagcacaugggcuccugcagcccuguccu

SEQ ID NO: 214908 - RNA, 62 nt, hsa
cuuggugcuuuagugcaagaagccuaggcucagaagcacagcagcgccaucuuuccguuuca

SEQ ID NO: 214909 - RNA, 62 nt, hsa
ugcaggguaguaacccagugauguuucuuacagaagcacaauauguugaaaauccugggugu

SEQ ID NO: 214910 - RNA, 62 nt, hsa
gugcuuuguggcuuugggguccucugggagcugaagcacacggccauguuggagagcaaaac

SEQ ID NO: 214911 - RNA, 62 nt, hsa
cacagccuagaguuaaguaaagucaauucacagaagcacaauuuugcccuuugcgagacauu

SEQ ID NO: 214912 - RNA, 59 nt, hsa
ugcaucgggauucagaaugaccaaccuaagaagcacaaauuuaguuuggguguuccuca

SEQ ID NO: 214913 - RNA, 62 nt, hsa
cugggaaggccgcaagaggcauagagggagaggaagcacacugcagggcugcuguggcccag

SEQ ID NO: 214914 - RNA, 62 nt, hsa
agacggagaccccgguggcaguggaaaaaucagaagcacaaaggaaaacucuuggccucugc

SEQ ID NO: 214915 - RNA, 62 nt, hsa
ugugccuuaaaaaucaagacacuaguucagaggaagcacauaauguccagaucuauggcgaa

SEQ ID NO: 214916 - RNA, 62 nt, hsa
aggcugcagcgcccggugcucugugucaaggugaagcacauacggcagaccucuuagagucc

SEQ ID NO: 214917 - RNA, 62 nt, hsa
gguuugagagcccgcgugcuggagaauugacugaagcacagcaccgggggagagggacacuc

SEQ ID NO: 214918 - RNA, 62 nt, hsa
cgcagaccugcagcgggcaaagagcucccgaggaagcacagcuugggucagguucuugccuu

SEQ ID NO: 214919 - RNA, 62 nt, hsa
gcaagaaagagggucccagggcugcaaaacuggaagcacagccucggggauggggagggaaa

SEQ ID NO: 214920 - RNA, 62 nt, hsa
aaccagaagagugcgcugcaggugcacaugaagaagcacacgggggagcggcccuacaagug

SEQ ID NO: 214921 - RNA, 62 nt, hsa
ucuguguucagguccaggguuacauaauugcagaagcacaagccauacaucgcagguaggaa

SEQ ID NO: 214922 - RNA, 62 nt, hsa
ggcugaacucugggagugugucccagcugagggaagcacaaguagcaaagcucauuggucug

SEQ ID NO: 214923 - RNA, 62 nt, hsa
ggucauuagcuuugggaauagaaggcuacacagaagcacacuguuuuugaacuugacaacag

SEQ ID NO: 214924 - RNA, 56 nt, hsa; identical to SEQ ID NO: 55920

SEQ ID NO: 214925 - RNA, 64 nt, hsa; identical to SEQ ID NO: 55921

SEQ ID NO: 214926 - RNA, 64 nt, hsa; identical to SEQ ID NO: 55922

SEQ ID NO: 214927 - RNA, 64 nt, hsa; identical to SEQ ID NO: 55923

SEQ ID NO: 214928 - RNA, 64 nt, hsa
aagcccuuccaugucgccucugcauucaggaucaaaccccgaccaccugcccaaccugcucucc

SEQ ID NO: 214929 - RNA, 64 nt, hsa
aauaucuuaugaauuaaggcauuccucuuucccuaaccccgauggcuccauucccaaguacccc

SEQ ID NO: 214930 - RNA, 64 nt, hsa
ccaccugagaagguagccaacaucaucuguacccaaccccgacgaaucucugcaaucucuguug

SEQ ID NO: 214931 - RNA, 64 nt, hsa
agggccccugaagugaccccagcuccaggcaggaaaccccgagaaggaauggugcuuggcagga

SEQ ID NO: 214932 - RNA, 64 nt, hsa
cgagggggaggaggccaccugaccaaaugccgccaaccccgagggccaguuucuugucgaauug

SEQ ID NO: 214933 - RNA, 64 nt, hsa
cugaucccccuacugcaacuaacuguugccccccaaccccgaacccccaguugaggaguugaga

SEQ ID NO: 214934 - RNA, 64 nt, hsa
aaacgaggacauggagugacuaucggggcgggccaaccccgagaaugaagauuggaaaaaggaa

SEQ ID NO: 214935 - RNA, 64 nt, hsa
ggcgcugaccuuccagguagagcacagauggcacaaccccgaggcagccccaacuugcauuucc

SEQ ID NO: 214936 - RNA, 64 nt, hsa
uagcgcaucggaaccccacacaguugcaacucccaaccccgaaucuuugcagccguucggcccu

SEQ ID NO: 214937 - RNA, 64 nt, hsa
uuccugggcaguaguaugugauguccagcacccuaaccccgacuccccagcccugggacuauuc

SEQ ID NO: 214938 - RNA, 54 nt, hsa
uuuacgaaagccaugucuaauaccaaccccgaaaagcuaugcauaucaagaaaa

SEQ ID NO: 214939 - RNA, 64 nt, hsa
auccuuuuccaauacuuaugcaaaagcaaaagaaaaccccgacaccucaccuuucgcuguuugu

SEQ ID NO: 214940 - RNA, 64 nt, hsa
aggagauuggcaucccccagccccugcaguuagaaaccccgaagucuucccagccagugagcca

SEQ ID NO: 214941 - RNA, 64 nt, hsa
accccugcugcccaagagagccugcuacagacacaaccccgaggcaggagagugacuguggcca

SEQ ID NO: 214942 - RNA, 64 nt, hsa
ccuccacuucagcuugcccugaccuccgcucgcaaaccccgagcuuccaagccuuuugcuccag

SEQ ID NO: 214943 - RNA, 64 nt, hsa
gcagcugggccacaauugccccuuuccguuuucuaaccccgacucagauuucaccacccacacu

SEQ ID NO: 214944 - RNA, 64 nt, hsa
cagacagaauccaaaugcaugugcuuguucuacgaaccccgaaugcguugucuuuguggaaaug

SEQ ID NO: 214945 - RNA, 64 nt, hsa
auguguuaaguugaagaaagguaacucguguaugaaccccgagccauuucccuguuguccugag

SEQ ID NO: 214946 - RNA, 64 nt, hsa
uugcucgcccacagggcugccucagauuuuguacaaccccgaagcguccucugcgugugcgugc

SEQ ID NO: 214947 - RNA, 64 nt, hsa
ggugcugcagcagcagggcggugccccagggacaaaccccgaugguaagaacuggggcugagug

SEQ ID NO: 214948 - RNA, 64 nt, hsa
augagaaaagcagagaaccccaaagugggcaggcaaccccgacgagagcuuaucccuguggcgg

SEQ ID NO: 214949 - RNA, 64 nt, hsa
aggaguucgaggccagccuggccaagauggcaaaaaccccgacucuacuaaaaauacaaaauua

SEQ ID NO: 214950 - RNA, 64 nt, hsa
ccaauuucuguccuuuggaucacuccucucccuaaaccccgagauggcuuuucucccaguggcu

SEQ ID NO: 214951 - RNA, 64 nt, hsa
cagcagcucuccugucuccacagccgcguuuuuuaaccccgaccucucagcgucugaaugaaca

SEQ ID NO: 214952 - RNA, 64 nt, hsa
aguguucagugggccacagugaaccaaccaaaccaaccccgaaucaucgcucucgccaugugcg

SEQ ID NO: 214953 - RNA, 64 nt, hsa
aacaacuaaccacguuuacacgacuugaguuuugaaccccgauuaaugucuguacgucaccuuu

SEQ ID NO: 214954 - RNA, 64 nt, hsa
acauacuuuucuucuguuuuuugcuuuaagaacuaaccccgaucaagaguauuuucuuuagcua

SEQ ID NO: 214955 - RNA, 64 nt, hsa
ucuaaaaaccauguugaaugaauccacguucuggaaccccgaggcgggagaaguagggagcugu

SEQ ID NO: 214956 - RNA, 64 nt, hsa
cgccucccucucaaccuuguaaauuccccuucccaaccccgaggggcuugcagggacaaggcga

SEQ ID NO: 214957 - RNA, 64 nt, hsa
acuuguguuaggauuccgaugcaacaccaugcaaaaccccgaaacagcugcuuugccguccguc

SEQ ID NO: 214958 - RNA, 64 nt, hsa
ugcuuuaucucccacgggcuccccaagaaccuccaaccccgaggcuuaucgcuagcggauucac

SEQ ID NO: 214959 - RNA, 64 nt, hsa
acuucuaguuggcaggagcugaggagggugaacaaaccccgagggaggcccggcccuugcuccc

SEQ ID NO: 214960 - RNA, 64 nt, hsa
ggcugggccaagccagggauggggccacagccagaaccccgagcccuacuuccagguucugguu

SEQ ID NO: 214961 - RNA, 64 nt, hsa
gucccagcccagcguccaguggugccucucaagaaaccccgaacgaauguucggaugacuuugg

SEQ ID NO: 214962 - RNA, 64 nt, hsa
gggacccgccccacagacuccaacuuccccuccaaaccccgaagugaaacccgccaccggguua

SEQ ID NO: 214963 - RNA, 64 nt, hsa
ggcccaaccaaaucccuuguuuuguauuuucuugaaccccgaccacuaccccagguuucuaacu

SEQ ID NO: 214964 - RNA, 64 nt, hsa
caggaguucgagaccagccuggccaacacggugaaaccccgacucuacuaaaaauacaaaaaau

SEQ ID NO: 214965 - RNA, 64 nt, hsa
ccgacgccuggccugccagggaugggccccguggaaccccgaagccuggcgggagagagagaga

SEQ ID NO: 214966 - RNA, 64 nt, hsa
gacugauccccagaagcgauggcugaccagauugaaccccgaaacucaggaagagugaaaugcu

SEQ ID NO: 214967 - RNA, 64 nt, hsa
ggccccaaggcccugaggggaucucaaauccuggaaccccgauuucaaucuacguucuagucac

SEQ ID NO: 214968 - RNA, 64 nt, hsa
gagagcugaacaggcugggacugaggaaaggauaaaccccgauauugggaccucacagugggug

SEQ ID NO: 214969 - RNA, 64 nt, hsa
gaauuucugugacuuuuuucuggggucaaagagaaaccccgagacacuguacacuguuccuuuu

SEQ ID NO: 214970 - RNA, 64 nt, hsa
caugagcaaccuggugccccccguggagcuggccaaccccgagaaccaguucagaguggacuac

SEQ ID NO: 214971 - RNA, 64 nt, hsa
gggagcccaucucucggagaaacccuguccacccaaccccgagagcccuagcgugcagucagcg

SEQ ID NO: 214972 - RNA, 64 nt, hsa
accggccucucaccaagcaguccuccaugugagcaaccccgagacaaaaaugcuaagugggauc

SEQ ID NO: 214973 - RNA, 64 nt, hsa
uuaacuguuuucucaugaugccuuuuuauauuuaaaccccgagauagugcuggaacacugcuga

SEQ ID NO: 214974 - RNA, 64 nt, hsa
uacaccuccaccuccuuccccuucucccucaggcaaccccgacagacaguggcacuccuggucc

SEQ ID NO: 214975 - RNA, 64 nt, hsa
uccagcccauccaaacacugaggcagccuuggggaaccccgagcugggggguuggcagcccacu

SEQ ID NO: 214976 - RNA, 64 nt, hsa
gauuccuuuggaaaaccaaacuaguaucagaacaaaccccgaaacaguaagaaauuggagugag

SEQ ID NO: 214977 - RNA, 64 nt, hsa
guuccauguugacugacuuauggcaugacucuucaaccccgaggucccuguugucagaucuauu

SEQ ID NO: 214978 - RNA, 64 nt, hsa
gcgcuggcagaucugggagcuccugucgaccgacaaccccgaugcccugcccgagacgcugguc

SEQ ID NO: 214979 - RNA, 64 nt, hsa; identical to SEQ ID NO: 82791

SEQ ID NO: 214980 - RNA, 64 nt, hsa; identical to SEQ ID NO: 82792

SEQ ID NO: 214981 - RNA, 64 nt, hsa; identical to SEQ ID NO: 82793

SEQ ID NO: 214982 - RNA, 64 nt, hsa; identical to SEQ ID NO: 82794

SEQ ID NO: 214983 - RNA, 64 nt, hsa; identical to SEQ ID NO: 82795

SEQ ID NO: 214984 - RNA, 64 nt, hsa; identical to SEQ ID NO: 82796

SEQ ID NO: 214985 - RNA, 64 nt, hsa; identical to SEQ ID NO: 82797

SEQ ID NO: 214986 - RNA, 64 nt, hsa; identical to SEQ ID NO: 82798

SEQ ID NO: 214987 - RNA, 64 nt, hsa; identical to SEQ ID NO: 82799

SEQ ID NO: 214988 - RNA, 64 nt, hsa; identical to SEQ ID NO: 82800

SEQ ID NO: 214989 - RNA, 64 nt, hsa; identical to SEQ ID NO: 82801

SEQ ID NO: 214990 - RNA, 64 nt, hsa; identical to SEQ ID NO: 82802

SEQ ID NO: 214991 - RNA, 64 nt, hsa; identical to SEQ ID NO: 82803

SEQ ID NO: 214992 - RNA, 64 nt, hsa; identical to SEQ ID NO: 82804

SEQ ID NO: 214993 - RNA, 64 nt, hsa; identical to SEQ ID NO: 82805

SEQ ID NO: 214994 - RNA, 64 nt, hsa; identical to SEQ ID NO: 82806

SEQ ID NO: 214995 - RNA, 64 nt, hsa; identical to SEQ ID NO: 82807

SEQ ID NO: 214996 - RNA, 64 nt, hsa; identical to SEQ ID NO: 82808

SEQ ID NO: 214997 - RNA, 64 nt, hsa; identical to SEQ ID NO: 82809

SEQ ID NO: 214998 - RNA, 64 nt, hsa; identical to SEQ ID NO: 82810

SEQ ID NO: 214999 - RNA, 61 nt, hsa; identical to SEQ ID NO: 82811

SEQ ID NO: 215000 - RNA, 64 nt, hsa; identical to SEQ ID NO: 82812

SEQ ID NO: 215001 - RNA, 64 nt, hsa; identical to SEQ ID NO: 82813

SEQ ID NO: 215002 - RNA, 64 nt, hsa; identical to SEQ ID NO: 82814

SEQ ID NO: 215003 - RNA, 64 nt, hsa; identical to SEQ ID NO: 82815

SEQ ID NO: 215004 - RNA, 64 nt, hsa; identical to SEQ ID NO: 82816

SEQ ID NO: 215005 - RNA, 64 nt, hsa; identical to SEQ ID NO: 82817

SEQ ID NO: 215006 - RNA, 64 nt, hsa; identical to SEQ ID NO: 82818

SEQ ID NO: 215007 - RNA, 64 nt, hsa; identical to SEQ ID NO: 82819

SEQ ID NO: 215008 - RNA, 64 nt, hsa; identical to SEQ ID NO: 82820

SEQ ID NO: 215009 - RNA, 64 nt, hsa; identical to SEQ ID NO: 82821

SEQ ID NO: 215010 - RNA, 64 nt, hsa; identical to SEQ ID NO: 82822

SEQ ID NO: 215011 - RNA, 64 nt, hsa; identical to SEQ ID NO: 82823

SEQ ID NO: 215012 - RNA, 64 nt, hsa; identical to SEQ ID NO: 82824

SEQ ID NO: 215013 - RNA, 64 nt, hsa; identical to SEQ ID NO: 82825

SEQ ID NO: 215014 - RNA, 64 nt, hsa; identical to SEQ ID NO: 82826

SEQ ID NO: 215015 - RNA, 64 nt, hsa; identical to SEQ ID NO: 82827

SEQ ID NO: 215016 - RNA, 64 nt, hsa; identical to SEQ ID NO: 82828

SEQ ID NO: 215017 - RNA, 64 nt, hsa; identical to SEQ ID NO: 82829

SEQ ID NO: 215018 - RNA, 64 nt, hsa; identical to SEQ ID NO: 82830

SEQ ID NO: 215019 - RNA, 64 nt, hsa; identical to SEQ ID NO: 82831

SEQ ID NO: 215020 - RNA, 64 nt, hsa; identical to SEQ ID NO: 82832

SEQ ID NO: 215021 - RNA, 64 nt, hsa; identical to SEQ ID NO: 82833

SEQ ID NO: 215022 - RNA, 64 nt, hsa; identical to SEQ ID NO: 82834

SEQ ID NO: 215023 - RNA, 64 nt, hsa; identical to SEQ ID NO: 82835

SEQ ID NO: 215024 - RNA, 64 nt, hsa; identical to SEQ ID NO: 82836

SEQ ID NO: 215025 - RNA, 64 nt, hsa; identical to SEQ ID NO: 82837

SEQ ID NO: 215026 - RNA, 64 nt, hsa; identical to SEQ ID NO: 82838

SEQ ID NO: 215027 - RNA, 64 nt, hsa; identical to SEQ ID NO: 82839

SEQ ID NO: 215028 - RNA, 64 nt, hsa; identical to SEQ ID NO: 82840

SEQ ID NO: 215029 - RNA, 61 nt, hsa
aacaaaacaaaacaaaacuauacuugaacaaaagggucagaggaccuguauuuaagcaaau

SEQ ID NO: 215030 - RNA, 61 nt, hsa
caaaaugaaugaggucugggcuagguagaaaaagggucaaugcuauuuuuguuuuuagaau

SEQ ID NO: 215031 - RNA, 61 nt, hsa
ggucuuugacuucauuuccugaagggucaccaagggucagcucagggcuaggaaaaaccau

SEQ ID NO: 215032 - RNA, 61 nt, hsa
uugcccccaaggucuuugacuucauuuccugaagggucaccaagggucagcucagggcuag

SEQ ID NO: 215033 - RNA, 61 nt, hsa
ggaaagguggucaggaaaacucuggcuggacaagggucagucuucggggucagcagcgaga

SEQ ID NO: 215034 - RNA, 61 nt, hsa
caucugcggagccaaaacccagccaucggggaagggucagggcuucuguggaacuuggaac

SEQ ID NO: 215035 - RNA, 64 nt, hsa
gcuuagauugcaguuuguuuugcauuugcuauaauuuucaaaauuauuuuugaagcaagacaaa

SEQ ID NO: 215036 - RNA, 64 nt, hsa
ucgauuuuaugaagagaaagugaaguuugaaaacuuuucaaacuuuucuaguuacaauccaauu

SEQ ID NO: 215037 - RNA, 64 nt, hsa
cauuuggaauggguauuuucuguuucaugauguauuuucaaauagaguucaggaucugcaauuc

SEQ ID NO: 215038 - RNA, 64 nt, hsa
uauaaauagaugauuucaauagcuuuguaguuuuuuuucaaaaucuuaauguaaacuaggauug

SEQ ID NO: 215039 - RNA, 64 nt, hsa
ugguaaaacuuuaguuguauugccauccacuccuuuuucaaaugaguuuaaugccauaaagcug

SEQ ID NO: 215040 - RNA, 64 nt, hsa
uugaguucuauugaguauuauaagauagcuuacauuuucaaaauggaaauugucggucauauuu

SEQ ID NO: 215041 - RNA, 64 nt, hsa
uuaccaguuuaguaugcugugguauuuuaauaaguuuucaaagauaauugggaaaacaugagac

SEQ ID NO: 215042 - RNA, 64 nt, hsa
uaccuugcaaacuuaugaaccaaaccauauuggguuuucaaagugccuuuguauccaaaaaugu

SEQ ID NO: 215043 - RNA, 64 nt, hsa
aauuaucacauuuuaaauuacuuuguggacuguguuuucaaaacuuugcaaauucaucuguuac

SEQ ID NO: 215044 - RNA, 64 nt, hsa
aggggaggaaauaauucucugcuguguauuguauuuuucaaauaaaaauuuaaaaauucaauug

SEQ ID NO: 215045 - RNA, 64 nt, hsa
guauuuuaaauguuuauguuuuaagaaugaacacuuuucaaauauaaaacuauauaauaauuau

SEQ ID NO: 215046 - RNA, 64 nt, hsa
gcuagcacaugccagagguucacaucuguuuuguuuuucaaacaggucguagcuguauuuauug

SEQ ID NO: 215047 - RNA, 64 nt, hsa
ggcuaaugcuuagugccugaguauuuaaauuuucuuuucaaacaggcacaguucacauugcuag

SEQ ID NO: 215048 - RNA, 64 nt, hsa
uuacaguggcaaaaauaaugacauguagcaaagauuuucaaacaaaauauuuuuuccuuuugua

SEQ ID NO: 215049 - RNA, 64 nt, hsa
uuguccccgauuuuaccuuugucuuucuguguacuuuucaaagaguccuaaggaguuaaaucuu

SEQ ID NO: 215050 - RNA, 64 nt, hsa
uauauuaaaaaguuguuggacuuuuaaauacauuuuuucaaauaaaaaauuaagcaaaauaguu

SEQ ID NO: 215051 - RNA, 64 nt, hsa
gacugagguucuuuuuuuuuuuuuuuuuuuuuuuuuuucaaauuuccauguauuuucugccauu

SEQ ID NO: 215052 - RNA, 64 nt, hsa
cuccauuuucccucaucacuguuauuauuuggacuuuucaaauuacauuauucauuauaauuuu

SEQ ID NO: 215053 - RNA, 64 nt, hsa
guagacaaagaggauguggauaauauuaugacauuuuucaaaaaucccuuucaaguuauguuuu

SEQ ID NO: 215054 - RNA, 64 nt, hsa
uguggguggaaguuuguaaaggccauucauuugauuuucaaaaucaaagcgacagcucuacuuc

SEQ ID NO: 215055 - RNA, 64 nt, hsa
gggagguaagaguagggucagaguuacucaucccuuuucaaagaauuguggguggaaguuugua

SEQ ID NO: 215056 - RNA, 64 nt, hsa
uuuuuaaacugcugaaauaaaaugacuguuacauuuuucaaauaaaacuuuuacuuugaacuau

SEQ ID NO: 215057 - RNA, 64 nt, hsa
cuggacacaggcgcggccucauguaaacauuuuauuuucaaaugaaugaggccaagcugaagcu

SEQ ID NO: 215058 - RNA, 64 nt, hsa
aauaguaaaauccaaaguauuaauuacagauaacuuuucaaaaauucaucauucacccuugauu

SEQ ID NO: 215059 - RNA, 64 nt, hsa
uggacuuugacccuaauggacuuacuggugaacuuuuucaaauguuuaaauaaugucuauccau

SEQ ID NO: 215060 - RNA, 64 nt, hsa
uuuaaugucauuauugaaauacuuuuaauucuaauuuucaaaagaaagcuaaaugcugauugug

SEQ ID NO: 215061 - RNA, 64 nt, hsa
acauccuaugaauuugaaaguuuccuaaguguuguuuucaaagaacugguuuauuuuauaguca

SEQ ID NO: 215062 - RNA, 64 nt, hsa
ugaacuauggggaaucaugguucuuuuaaagcaauuuucaaaauaaguaccaauuaaagcuuua

SEQ ID NO: 215063 - RNA, 64 nt, hsa
uuggauauguuuguaacacauaaacacaaagcacuuuucaaacaugaugcacuuuuaucuuugu

SEQ ID NO: 215064 - RNA, 64 nt, hsa
aucacuaaucagcuccuggauuuuuuuuuuuuuuuuuucaaacaaugguuugaaacaacuacug

SEQ ID NO: 215065 - RNA, 64 nt, hsa
ucaaauauaacugacuguauacuauagugguaacuuuucaaacagcccuuagcacuuuuauacu

SEQ ID NO: 215066 - RNA, 64 nt, hsa
auuugguaccugucucucuccuacuguauugucauuuucaaaauguguuuguuuucuggcgcgu

SEQ ID NO: 215067 - RNA, 64 nt, hsa
auguaacaaaauauuuuguagauuacauauugauuuuucaaaaauuaaaaauguauuucaaacu

SEQ ID NO: 215068 - RNA, 64 nt, hsa
aagacaccaaauuccaaacuucuaaauguuggaauuuucaaaaauuguguuuagauuuuaugaa

SEQ ID NO: 215069 - RNA, 64 nt, hsa
cggaucaauagacuguacuuauuuuccaauaaaauuuucaaacuuuguacuguuauccugagaa

SEQ ID NO: 215070 - RNA, 64 nt, hsa
ugcaguguguuuucccccucaccuucaauaagguuuuucaaaaaggaaauggaaacuuuuuaac

SEQ ID NO: 215071 - RNA, 64 nt, hsa
caucguuaaacaacuuuuaaaagaaauaacuaaauuuucaaaugaguaagcagugccaccaacu

SEQ ID NO: 215072 - RNA, 64 nt, hsa
uacacuacaaugcuucuuugguuuccaggaauuuuuuucaaauggggcuguuucuggaaaaaug

SEQ ID NO: 215073 - RNA, 64 nt, hsa
ucauuuccauuuaccugaguucgcuuuaaagagcuuuucaaagagagcuuuauagacacccaca

SEQ ID NO: 215074 - RNA, 64 nt, hsa
guauauagaauaauauuuauguuuacaauguaacuuuucaaaauuuacaaaucaggauuauaua

SEQ ID NO: 215075 - RNA, 64 nt, hsa
aacauuucagaagagcacaauaugcauaaaacauuuuucaaaauugaaauauuuuccugggcau

SEQ ID NO: 215076 - RNA, 64 nt, hsa
ccuuuuuugagcaaacugagacuaaacuucucucuuuucaaaauuguguuaucuuccuuaaucc

SEQ ID NO: 215077 - RNA, 64 nt, hsa
cuuaaauaucuuucacaugcauuuuaggauauucuuuucaaauauuuguaggacaacuuugaau

SEQ ID NO: 215078 - RNA, 64 nt, hsa
auuugcaauuaauuuauuuaaacuaaguaaauacuuuucaaaauacauaauugaauucgucucu

SEQ ID NO: 215079 - RNA, 64 nt, hsa
uaguugugauguaucaguaacugcuguuaccccuuuuucaaagaaauguaauugauuuugaagu

SEQ ID NO: 215080 - RNA, 64 nt, hsa
gaaaaguuucuucucuccccuccuucccacccuuuuuucaaaggcaccacaaguauagacaguu

SEQ ID NO: 215081 - RNA, 64 nt, hsa
ccuaauuaaguacaaaaacagagucgcuuuugccuuuucaaaucaagaaaauaagugcucuguc

SEQ ID NO: 215082 - RNA, 64 nt, hsa
auacuguuauaucuaaauuuaaacaguauuuauuuuuucaaaaacagcuacuuaaguuaauggu

SEQ ID NO: 215083 - RNA, 64 nt, hsa
agagaauagcccccuucgauacacaucagcuggauuuucaaaagcuucaaagucuuggucugug

SEQ ID NO: 215084 - RNA, 64 nt, hsa
uuuucccgauguguccagccagcuccgcagcagcuuuucaaaaugcacuaugccugauugcuga

SEQ ID NO: 215085 - RNA, 64 nt, hsa
cuguuuucccaccucuaaggauuucauguacaucuuuucaaagcuagaaauaagcacugucuaa

SEQ ID NO: 215086 - RNA, 64 nt, hsa
auuuuuuuugucuguugacaaaaacaaaaaucuuuuuucaaauguagugcuggugaaaagguag

SEQ ID NO: 215087 - RNA, 64 nt, hsa
aaaaucauaauucauaucauuggagaaguauuuauuuucaaauaucaaauugaagaaaaacuca

SEQ ID NO: 215088 - RNA, 64 nt, hsa
ggcuuaccgcuuaccuuagaguuuuguuuuuuuuuuuucaaacccaucaaaaucuacuuauuua

SEQ ID NO: 215089 - RNA, 64 nt, hsa
uauagacuuguuuuauuagauuuuaccaaugaauuuuucaaaauacaaaaaaaaguaguuuuuc

SEQ ID NO: 215090 - RNA, 64 nt, hsa
uaaggugaaaucauggaucagauauuccuuacauuuuucaaaacuacugcauguuuaaaacuuc

SEQ ID NO: 215091 - RNA, 64 nt, hsa
uuugguuaugcuuauuuuuguuugaaauuuguuuuuuucaaauauguuuccuuuuugaacuuac

SEQ ID NO: 215092 - RNA, 64 nt, hsa
uaaguugauuuugggguuucuuucgccagggaucuuuucaaaacugguaguaguuauuuuuaaa

SEQ ID NO: 215093 - RNA, 64 nt, hsa
uuucaacaggacuuucuuauucccauuccuaauuuuuucaaacuaauugcuuaaaucuagaacc

SEQ ID NO: 215094 - RNA, 64 nt, hsa
cuuuaaauauuuuuaguugaccuuuuuccuuugguuuucaaauguucaacaugaaucagaauag

SEQ ID NO: 215095 - RNA, 64 nt, hsa
uuguguuaagugcaauuaauacaaguuauugugcuuuucaaaaauguacacggaaaucuggaca

SEQ ID NO: 215096 - RNA, 64 nt, hsa
cuuccccagcagggcugcuagcuugcuuucugcauuuucaaaaugauaauuuacaauggaagga

SEQ ID NO: 215097 - RNA, 64 nt, hsa
uuauaaaucuggauuugccuuguguccuucugaguuuucaaaggcaaguauucaacagucccug

SEQ ID NO: 215098 - RNA, 64 nt, hsa
gacauguucagcuaggcagaguucucauagauaauuuucaaauauuuuccuuggcuguaauuua

SEQ ID NO: 215099 - RNA, 64 nt, hsa
uauuagagaaguuuuuuagcuuuauaaagagguuuuuucaaauuucucccauuuuucucuccac

SEQ ID NO: 215100 - RNA, 64 nt, hsa
uuuguuauuccuuaaaaacauuuaaaagcagauuuuuucaaaaucgauaugugaaggacuacag

SEQ ID NO: 215101 - RNA, 64 nt, hsa
auucuguuuaacaauaagaaauaagaaauaauuuuuuucaaauaagaaaauuguguacucuaga

SEQ ID NO: 215102 - RNA, 64 nt, hsa
auauuuucauauucacaagauauuaaauuaccaauuuucaaauuauuguuaguaaagaacaaaa

SEQ ID NO: 215103 - RNA, 64 nt, hsa
uguaaggccuguagcucugguuguauacuuuugcuuuucaaauuauaguuuaucuucuguauaa

SEQ ID NO: 215104 - RNA, 64 nt, hsa
aauauucaauuaugaaacaaaaaaauuaugauguuuuucaaaaugcaagugagguuugauuuuu

SEQ ID NO: 215105 - RNA, 64 nt, hsa
aggagaucuaacaaaaacacuugaauauuuuuuauuuucaaaacuaaacacauaaaaugcuuuu

SEQ ID NO: 215106 - RNA, 64 nt, hsa
uacgguaguaagaaaccuuugagaucuuucugacuuuucaaaauuagagaaagcaaaugggaug

SEQ ID NO: 215107 - RNA, 64 nt, hsa
cuaaaguaauuguauugaugugaagcauaucauuuuuucaaauaugaaagugaucacuuagcaa

SEQ ID NO: 215108 - RNA, 64 nt, hsa
ggucucuuucauuuuucucuuccugggauucauuuuuucaaaacacaaugcuggaaaaaaaaga

SEQ ID NO: 215109 - RNA, 64 nt, hsa
gaaagacuucuuauggugcuauuccauaaacuuuuuuucaaacaaguuuuugaccuuugagcca

SEQ ID NO: 215110 - RNA, 64 nt, hsa
cagaucuuuuccgacacacaugucugaagacuuauuuucaaagacagcacauuuuuggaaacua

SEQ ID NO: 215111 - RNA, 64 nt, hsa
aaauuauacuuuugguuuagaaagggauuaggucuuuucaaaagggugagaacagucuuacauu

SEQ ID NO: 215112 - RNA, 64 nt, hsa
uuaccaaacuuuaucaaggacuuuccaaauggaguuuucaaauacuauugaccacauugcucua

SEQ ID NO: 215113 - RNA, 64 nt, hsa
aauguauaacgaaugaauaaauacaugcauaauauuuucaaaguucuauaccaguaccuauuuu

SEQ ID NO: 215114 - RNA, 64 nt, hsa
uagacuucuuucucaagaaaucaaauacagcuuuuuuucaaagcugauucaguucauuuccugu

SEQ ID NO: 215115 - RNA, 64 nt, hsa
cuuuccuuguauauaccaucaagcaagcacuuuguuuucaaagcaagugguauuuugaucaguu

SEQ ID NO: 215116 - RNA, 64 nt, hsa
cauuuuucaauaaucucaccuuaaaagugaccccuuuucaaacaaagcauaaacaauuuauuug

SEQ ID NO: 215117 - RNA, 64 nt, hsa
accacuuugaugucaguacaacuucagcaauugguuuucaaaauagaugagaauaugguacaga

SEQ ID NO: 215118 - RNA, 64 nt, hsa
aucucucuaagaguuuuuuuccuucugagcuuccuuuucaaaauaaaagugacaauuguagcau

SEQ ID NO: 215119 - RNA, 64 nt, hsa
uaccauuuuuucaagaauguuuggaaucuuuccuuuuucaaaaguagguuaggagcaaauuauc

SEQ ID NO: 215120 - RNA, 64 nt, hsa
uagccuucaauauacauucugcuuugaauuaauuuuuucaaaucaauaaauuauguagacauuu

SEQ ID NO: 215121 - RNA, 64 nt, hsa
ugcucaacaagaaaaaaaugcaaauguaauauuuuuuucaaauuacuucuuuauugacuugucc

SEQ ID NO: 215122 - RNA, 64 nt, hsa
ugaagaaagcaaagcaaaaacuguauagagagauuuuucaaaagcaguaaucccucaauuuuaa

SEQ ID NO: 215123 - RNA, 64 nt, hsa
ucugucuucacuguuuauaauacggauggauuuuuuuucaaaucaguguguguuuugaggucuu

SEQ ID NO: 215124 - RNA, 64 nt, hsa
uguuacagugauugcaauaauaguauauuggaguuuuucaaagaaacuuaaaguaaugcccaau

SEQ ID NO: 215125 - RNA, 64 nt, hsa
uguaauccaaaagauaagggugugguuuacaugcuuuucaaaaauuuuuguuaagaaguagcaa

SEQ ID NO: 215126 - RNA, 64 nt, hsa
uuggagaugggaagagcaucuccaggcaaugaguuuuucaaagaaugccuacuuaguaguaaga

SEQ ID NO: 215127 - RNA, 64 nt, hsa
aucuucugaggcuuuagaaauguggacaagcuaguuuucaaauuuugugugcgucuguaaguuc

SEQ ID NO: 215128 - RNA, 64 nt, hsa
uuuuccauuuaugaagcaguaugaauuagauguauuuucaaaacaggucccuaagacaauucuu

SEQ ID NO: 215129 - RNA, 64 nt, hsa
auaaaaacuaguauguuuucacgguguauauuuuuuuucaaaaauucuguaacaaauauauuua

SEQ ID NO: 215130 - RNA, 64 nt, hsa
aaaaaaaaaaaaauccuugaacuaaugacucaaauuuucaaaugaaacaaaauaagcaguggau

SEQ ID NO: 215131 - RNA, 64 nt, hsa
gaaacguauggguaggaguuuagguggcuucuguuuuucaaaagaugaucuuauccuaguaucu

SEQ ID NO: 215132 - RNA, 64 nt, hsa
aacacacacagauauggacacaguacaauucuucuuuucaaaugaagacauugauaauauuaaa

SEQ ID NO: 215133 - RNA, 64 nt, hsa
gaaaaagacugcaagcuuuccugccaauuugggauuuucaaauauuuaauucuaaauuccagau

SEQ ID NO: 215134 - RNA, 64 nt, hsa
guuaggaauaaaaaaaaaagaccaguaacuuuguuuuucaaaauuagucuuuguaacauagaau

SEQ ID NO: 215135 - RNA, 64 nt, hsa
guuaaagcauaauaauaacauaucuuuaaaaagcuuuucaaaauauauuuucacccugacagug

SEQ ID NO: 215136 - RNA, 64 nt, hsa
cauuauuauuuuuuaauuucccaauuuuuucaguuuuucaaauuguaccacaacauagaacugu

SEQ ID NO: 215137 - RNA, 64 nt, hsa
accugcugaaggauuuauuuauaaaaagugcaauuuuucaaaacacauuauuauuuuuuaauuu

SEQ ID NO: 215138 - RNA, 64 nt, hsa
uuagugcagaaauaacauuauuaauagaguauuguuuucaaaacagagaugauuaauuucaaga

SEQ ID NO: 215139 - RNA, 64 nt, hsa
auuaaugugaaaguugucucuaaauauuuuuuaauuuucaaacucauacuuuauuuucauuuga

SEQ ID NO: 215140 - RNA, 64 nt, hsa
aaaugugcauuccucuuuuagaguagcuguaugcuuuucaaaugcuaucugccgugaauuuuuu

SEQ ID NO: 215141 - RNA, 64 nt, hsa
uuauuccuaacaaaaauaaguacucaggacuuuuuuuucaaaaugaaauauuuauguacuguuu

SEQ ID NO: 215142 - RNA, 64 nt, hsa
agugaggcaggccuagcaguucccuuaccugaaguuuucaaauccauacugcaguucccucucg

SEQ ID NO: 215143 - RNA, 64 nt, hsa
caaacacagcacauaucuauuaucacuauauuaauuuucaaagguuuuucuuugacguuuaaaa

SEQ ID NO: 215144 - RNA, 64 nt, hsa
uaauaauuuuaguacaaaauuucauaaaccguguuuuucaaaauaaguuuaugucaaauccagc

SEQ ID NO: 215145 - RNA, 64 nt, hsa
aaauaggcaauaagaacuucauuuuacaauuuaguuuucaaaaaaaaaaugcaggaaacuguuu

SEQ ID NO: 215146 - RNA, 64 nt, hsa
cuugaauuugucauaaagcuaaauauuuuauauguuuucaaagauuauuuuuucauauuaauag

SEQ ID NO: 215147 - RNA, 64 nt, hsa
ucuguuggaucuuguaaacaugaaaagggcuuuauuuucaaaaauuaacuucaaaauaagugua

SEQ ID NO: 215148 - RNA, 64 nt, hsa
uacucuuacauaauaaaauuccuuuuaaguaauuuuuucaaagaaucacagaauucuaguacau

SEQ ID NO: 215149 - RNA, 64 nt, hsa
aaaaucaguggaaauaaaugaucauagaaggugcuuuucaaaacaacugcuauuauaauucuca

SEQ ID NO: 215150 - RNA, 64 nt, hsa
ggcauagcaugacuuauucuuguuuggaaaacucuuuucaaaacugaccaucuuaaacacauga

SEQ ID NO: 215151 - RNA, 64 nt, hsa
uauuugauagaaaagucacauuucuacaagguaauuuucaaaaagaaauaaaacauuucuguaa

SEQ ID NO: 215152 - RNA, 64 nt, hsa
caccaaauucacacauuuguacggggcccauuucuuuucaaacugaagaauacuuuaaacagcc

SEQ ID NO: 215153 - RNA, 64 nt, hsa
uccucuuaagaguucuauucuucagguagauaauuuuucaaaugugaauuaucuuuugugucua

SEQ ID NO: 215154 - RNA, 64 nt, hsa
auacuguucauuaauaguauuuuaaaaaaauuguuuuucaaaugucaccaauaaaaguuuuggc

SEQ ID NO: 215155 - RNA, 64 nt, hsa
acuugcacccaccauuuuuuuuaccugauuuuuguuuucaaauaagaauguaagcauuuuacuu

SEQ ID NO: 215156 - RNA, 64 nt, hsa
auaauagaauauuacauuuauuucuggaaguguguuuucaaaaagauauuuacauagucuguaa

SEQ ID NO: 215157 - RNA, 64 nt, hsa
ucagguggguguacucuggccucuugguucauuauuuucaaacaagcacacuuguacaauuauu

SEQ ID NO: 215158 - RNA, 64 nt, hsa
uuuuccguaaacauauaucuuacauauaauaaacuuuucaaaucuugcaauuuggcuugauuaa

SEQ ID NO: 215159 - RNA, 64 nt, hsa
uggaaagguuuggauuucuccaaaucugggagaauuuucaaaauaagaaaauaaccuuuauaug

SEQ ID NO: 215160 - RNA, 64 nt, hsa
ucccugggauuacuuagccaaggcuuaaauuuauuuuucaaagucaagaacauuagccuagaag

SEQ ID NO: 215161 - RNA, 64 nt, hsa
uuaccaggaguaauugcccauggaaacauucuguuuuucaaaagaagaauguacauauuccacu

SEQ ID NO: 215162 - RNA, 64 nt, hsa
cacgcgcgcgcgcgcacacacacucuucaaguuuuuuucaaaguccaacuacagccaaauugca

SEQ ID NO: 215163 - RNA, 64 nt, hsa
cauacccagugucuaccuucauuuucuaauucucuuuucaaacacacacacacacgcgcgcgcg

SEQ ID NO: 215164 - RNA, 64 nt, hsa
uuacacaugagggaccgaaggauagaaaaguuauuuuucaaaggucuugcaguuaauaaauggc

SEQ ID NO: 215165 - RNA, 64 nt, hsa
uauuuaaauaugaaucuauucaugcuaacauuauuuuucaaaacauacauggaaauuuagccca

SEQ ID NO: 215166 - RNA, 64 nt, hsa
caucaacaaaagauugguccuuggugaaauaaacuuuucaaaaaugaauguucuuuucaaaaaa

SEQ ID NO: 215167 - RNA, 64 nt, hsa
cuuggugaaauaaacuuuucaaaaaugaauguucuuuucaaaaaauaaaguagaaaaaugcacu

SEQ ID NO: 215168 - RNA, 64 nt, hsa
agcaaccacauuuagaaauguuuauugacaggucuuuucaaauaaugcuuuucuaauuaauagc

SEQ ID NO: 215169 - RNA, 64 nt, hsa
uacgcuaauaagugacaaauaagauuaauaagauuuuucaaaaucgccaggacuggugaauaua

SEQ ID NO: 215170 - RNA, 64 nt, hsa
augaauuuuuauugagauuuuccauuaacuauuuuuuucaaagacucaaauuuuguaccaagua

SEQ ID NO: 215171 - RNA, 64 nt, hsa
uuuguuuuucugugaacaguuagagagcuaauuuuuuucaaaggugauuguaagucauauuuua

SEQ ID NO: 215172 - RNA, 64 nt, hsa
aguuagacaaccaaagacgacuuuaguggacugguuuucaaaacuugagcagcugaaaagcaaa

SEQ ID NO: 215173 - RNA, 64 nt, hsa
uugcagcuauuaguugauugcuguaacuuuuucauuuucaaaccauguacaauucuuguauaga

SEQ ID NO: 215174 - RNA, 64 nt, hsa
ccguuacuaaaauaguuucaaaguugacaaaaaauuuucaaagauaaaagcaguuuuacauugg

SEQ ID NO: 215175 - RNA, 64 nt, hsa
uggaugcauuuuuauuaugaaaaaauaaaaugacuuuucaaauuauaaugaguaaguuuugguc

SEQ ID NO: 215176 - RNA, 64 nt, hsa
uauguuuauuaaugggccaaugcaaaaaaucauuuuuucaaagaaaaauuuguccauguaaagc

SEQ ID NO: 215177 - RNA, 64 nt, hsa
uugguauuuaaucaaagagaaaaugguaauaaacuuuucaaaaucuuuguuaaaccaaacauuc

SEQ ID NO: 215178 - RNA, 64 nt, hsa
auaugaagucagguuuguuuuuuuuuuuuuuuuuuuuucaaagcacaguacuguuagcuguuuu

SEQ ID NO: 215179 - RNA, 64 nt, hsa
auaacuuuaucaauucaugugaauuuuagcucaauuuucaaaguucacuaauauucucaauauu

SEQ ID NO: 215180 - RNA, 64 nt, hsa
gaaucucuauccacguaucagguuauagacugguuuuucaaaagugaacaauccugugauaagu

SEQ ID NO: 215181 - RNA, 64 nt, hsa
aauuaucgaauuaaaacuuaauguaugucaauuauuuucaaaugucuaaauuccuuuggaaaua

SEQ ID NO: 215182 - RNA, 64 nt, hsa
caacuuagugucucuauuuaugagaucacugaacuuuucaaaauaaagcuuuugcauagaauaa

SEQ ID NO: 215183 - RNA, 64 nt, hsa
aaauucagauaaugguaauuuaguguauaugugauuuucaaauauguaaacuuuaacuuccacu

SEQ ID NO: 215184 - RNA, 64 nt, hsa
uuauauauguuaauaaggaaguacauuuuuaaauuuuucaaacugcuccuagcuuuugauuagg

SEQ ID NO: 215185 - RNA, 64 nt, hsa
agccauuauuaguaguaaacuuuuacaaaucccauuuucaaauuacuuuuagaucuuaaaauuu

SEQ ID NO: 215186 - RNA, 64 nt, hsa
uuauuuucaaaggaaaacaccuuuauuuuauuuuuuuucaaaaugaagauacacauuacagcca

SEQ ID NO: 215187 - RNA, 64 nt, hsa
gaauguucauauagccagggauugaaguuuauuauuuucaaaggaaaacaccuuuauuuuauuu

SEQ ID NO: 215188 - RNA, 64 nt, hsa
uuagagucuuauuugauuauggugggagggaauguuuucaaauuucccauuucucaagaaaugu

SEQ ID NO: 215189 - RNA, 64 nt, hsa
ugagcaaggccuacuuggcccuggauagaaauuguuuucaaagagaagggcagcugcuuagagu

SEQ ID NO: 215190 - RNA, 64 nt, hsa
ucaagccaagccugcauguacagaauuuguuuuuuuuucaaauaaauuaguuguuuucuuauuu

SEQ ID NO: 215191 - RNA, 64 nt, hsa
cuuacauacuuuguuuuacaacuguguuuucauuuuuucaaaugucuggccauuuagcaaaguu

SEQ ID NO: 215192 - RNA, 64 nt, hsa
uuauauguuauaguuucuugccacaaauuuuguuuuuucaaacuuaccuuuccagguuuguuuu

SEQ ID NO: 215193 - RNA, 64 nt, hsa
auuuuuuaaguuuacugagagaccuuuauuauuauuuucaaauuaaguauagcuuuauguaacu

SEQ ID NO: 215194 - RNA, 64 nt, hsa
acauuacuaauauagcuuuuguaaaacucguuuguuuucaaaggucuggacuaagcaaaacaac

SEQ ID NO: 215195 - RNA, 64 nt, hsa
cacgaauauacuuuuuguuuguuuuccuuuuccauuuucaaaaugccaagaucugggagccucu

SEQ ID NO: 215196 - RNA, 64 nt, hsa
caagcauauguuagcauuaaaguucuaggcauacuuuucaaagcugggaagacccuuucagaau

SEQ ID NO: 215197 - RNA, 64 nt, hsa
guguaguuauaaaccaaugaaauuuugauuaaccuuuucaaauuaauguuccaguuugaagacc

SEQ ID NO: 215198 - RNA, 64 nt, hsa
auuaaagaacaaauuauaaaaguuugaacaaaucuuuucaaauuaaguauauaaaaguaaacuu

SEQ ID NO: 215199 - RNA, 64 nt, hsa
gcuaagcucuuuguacuacugcaaacuuaaaaguuuuucaaaugugggaaacgugugggaaggc

SEQ ID NO: 215200 - RNA, 64 nt, hsa
aaauugaaaucauauguugggaaugguaaaaagguuuucaaaugguuuauuuuuccucuuuuau

SEQ ID NO: 215201 - RNA, 64 nt, hsa
guuuucucucaguccuuuugcuacauucacuuucuuuucaaagaaauguuaauuauuacaaaaa

SEQ ID NO: 215202 - RNA, 64 nt, hsa
guuaaguuaaacuggagaaaguuugucauccucauuuucaaacugaaaacuaaucaaauauagu

SEQ ID NO: 215203 - RNA, 64 nt, hsa
aaugguagagauuuuuuuuucaaacacagucugauuuucaaacccauaugcuucuaaccacuaa

SEQ ID NO: 215204 - RNA, 64 nt, hsa
augauuacucagcuaaaaaaugguagagauuuuuuuuucaaacacagucugauuuucaaaccca

SEQ ID NO: 215205 - RNA, 64 nt, hsa
auaauguaauacuguagaaauauugcucuaauucuuuucaaaauuguugcaucccccuuagaau

SEQ ID NO: 215206 - RNA, 64 nt, hsa
agaauuuauagaauaauuucuccucauuuaauauuuuucaaaaucaaaguuaugguuuccucau

SEQ ID NO: 215207 - RNA, 64 nt, hsa
auuuuaagaacuuuauaaugacugaaggaauguguuuucaaaauauuauuugguaaagcaacag

SEQ ID NO: 215208 - RNA, 64 nt, hsa
guauaaauucagcuaauuauuucuauauuauuauuuuucaaaugucauuuaucaggcauagcuc

SEQ ID NO: 215209 - RNA, 64 nt, hsa
uuuuuguuaauuaaaauuaaauuuuuaagagauauuuucaaaacccuauuuauuuucuuguuca

SEQ ID NO: 215210 - RNA, 64 nt, hsa
cuuuuauaaaauucaaugacgacuacuagaauucuuuucaaaaguuaacuuaucuccaaagugg

SEQ ID NO: 215211 - RNA, 64 nt, hsa
auccucuuaccucucucacugcucguguucugccuuuucaaaaggaccacuaugaacagaucag

SEQ ID NO: 215212 - RNA, 64 nt, hsa
acauuuugcaaaauuacauuuagagaaacccaauuuuucaaaguuuaagaaauauacaaaguau

SEQ ID NO: 215213 - RNA, 64 nt, hsa
aucuaacaauaugaagggcucuuaugagucauuuuuuucaaaagaugaaaacuccagaaacgca

SEQ ID NO: 215214 - RNA, 64 nt, hsa
acacaaaaaaaaugguaugugaagaugcaccgucuuuucaaauggccugggagagucaaauggc

SEQ ID NO: 215215 - RNA, 64 nt, hsa
uuuauauguuaagagccugagcuuagaaguauuuuuuucaaagaaauguguuuuuuacuugcua

SEQ ID NO: 215216 - RNA, 64 nt, hsa
cuuaggauugcuuugaggucuaaaugaguuaacauuuucaaagcacuuagaauagugucugaga

SEQ ID NO: 215217 - RNA, 64 nt, hsa
uccuucaaaaauaaguuaaaauguuuuuguaaaauuuucaaaugucagucaaguuuugcauuag

SEQ ID NO: 215218 - RNA, 64 nt, hsa
uguuaugcacuacuacuuuuuguauucuagacaguuuucaaaaguuggcagauuuuuuuuuuug

SEQ ID NO: 215219 - RNA, 64 nt, hsa
uaguugcaauuacuggcucucaagcuauaguuuguuuucaaaaaggaaaaacaaaauaguuuuu

SEQ ID NO: 215220 - RNA, 64 nt, hsa
acaguuuguguuucacaaacauggcuuaucaauuuuuucaaagaauucuuuuuucccaaaaaga

SEQ ID NO: 215221 - RNA, 64 nt, hsa
guaaaaagaaauuauaauaaaagggauacuuugcuuuucaaaucuuuguuuucucuuauucuag

SEQ ID NO: 215222 - RNA, 64 nt, hsa
cacauauuaucauacagacagaaaauccagaaucuuuucaaagcccacauaugguagcacaggc

SEQ ID NO: 215223 - RNA, 64 nt, hsa
cuggccugugcaucggcaauucucauaucuguuuuuuucaaagaauaauaaaaucaaauaaaga

SEQ ID NO: 215224 - RNA, 64 nt, hsa
uguuauugauaggaucauguuguuaaauuguaaauuuucaaaauuaauugauguuuuaaaaaug

SEQ ID NO: 215225 - RNA, 64 nt, hsa
ugagucucagaugauuauuccaguuuucaaugauuuuucaaaauaaaagucaaucagcauuguu

SEQ ID NO: 215226 - RNA, 64 nt, hsa
gagggcaauucuguccuacuguuuuuacaggccuuuuucaaaugcagauuuugucauaaaguug

SEQ ID NO: 215227 - RNA, 64 nt, hsa
ugauacauuauuuuaaucauauauaugacuuuccuuuucaaaaauacuuuaauguacaagugua

SEQ ID NO: 215228 - RNA, 64 nt, hsa
caaaaccaagcaaaaugaaguugaucaaaucugcuuuucaaaguuuaucaauacccuuucaaaa

SEQ ID NO: 215229 - RNA, 64 nt, hsa
caccucagagcuguccucuucucuagaguggagguuuucaaagugcaucaucagcauuaccugu

SEQ ID NO: 215230 - RNA, 64 nt, hsa
cacuauauuugccuagcaacuugcagcuacuuccuuuucaaagccucauguaucucccagaccc

SEQ ID NO: 215231 - RNA, 64 nt, hsa
gaucuaauaacauggaagguuuguuuuauaugaauuuucaaaaagaugucucuuuacacuuuuu

SEQ ID NO: 215232 - RNA, 64 nt, hsa
caauauuaaaauguauguuagcaaaauggguggauuuucaaauaaaaugcagcuuccacaaaag

SEQ ID NO: 215233 - RNA, 64 nt, hsa
caccuaacuuuaagaaaaagaaccgcuuguaugauuuucaaaagaacauuuagaauucuauaga

SEQ ID NO: 215234 - RNA, 64 nt, hsa
ggucuagaaacaaaauacuccaagaaaaagaaaauuuucaaauaaaacccaaaauaauagcuuu

SEQ ID NO: 215235 - RNA, 64 nt, hsa
uuaggguuauuguaaucaaugugaauaucauguuuuuucaaaucuguucugagccuauaguguu

SEQ ID NO: 215236 - RNA, 64 nt, hsa
ggauaguauauggcuucuuugugccucuacuaucuuuucaaaagccauuuuauaaaaauccuag

SEQ ID NO: 215237 - RNA, 64 nt, hsa
uuugugaccuaaggacgauggugaaaagaucacguuuucaaaacaaucuggugaucagaauguu

SEQ ID NO: 215238 - RNA, 64 nt, hsa
ucccaccccaccccacccuucacaccuggcugauuuuucaaaaaguuuuuuuguagaaacaggg

SEQ ID NO: 215239 - RNA, 64 nt, hsa
ccuuuaauaucuguugggaaggaaauguccagacuuuucaaaucucuuauuauauguuuccuuu

SEQ ID NO: 215240 - RNA, 64 nt, hsa
guguacagugggggucuacaacaagaaguguauauuuucaaacaauuuuuuaaugauuuaacaa

SEQ ID NO: 215241 - RNA, 64 nt, hsa
auaaguuaaugccaaacguuauguuaaaguuauuuuuucaaauacaggauuuggggagagaagc

SEQ ID NO: 215242 - RNA, 64 nt, hsa
auuuuucauauuuuaguuugauuuuagacaauuauuuucaaaaagaaaccugacuuuuuuucac

SEQ ID NO: 215243 - RNA, 64 nt, hsa
gcaaaauugaaaaaaagauuuuagaauuuuaaaauuuucaaagauuucuuccauucauaaggag

SEQ ID NO: 215244 - RNA, 64 nt, hsa
cuggcucacgaaaaucugcccugcuagaauuugcuuuucaaaauggaaauaaauuccaacucuc

SEQ ID NO: 215245 - RNA, 64 nt, hsa
agaucucuuauuuaaaauuuaaauaaggaauacauuuucaaaaugcaguaaucaaaaugugauc

SEQ ID NO: 215246 - RNA, 64 nt, hsa
auaggccaaaauuauuguguccagagaguacacuuuuucaaaaugcucaccuacuggaagugug

SEQ ID NO: 215247 - RNA, 64 nt, hsa
acagaaaguguauauugguauauaauaaaugaacuuuucaaaugacuaugaugugauuuuugau

SEQ ID NO: 215248 - RNA, 64 nt, hsa
ucacagccuaaaacuucuggaguucacuaccuuuuuuucaaaucauaguaagaucacuugugua

SEQ ID NO: 215249 - RNA, 64 nt, hsa
acaugauagacagggcuaaaacugggcuacagaauuuucaaaaagaaugauacauucugaaggu

SEQ ID NO: 215250 - RNA, 64 nt, hsa
ucugccguuuaacuguccagcugugcuauuuuccuuuucaaaguauaacugauuucaggcuaac

SEQ ID NO: 215251 - RNA, 64 nt, hsa
ccucucccgauuuuaugacaucuuguguugaucuuuuucaaaaacucauuuucuuuuuuuuccu

SEQ ID NO: 215252 - RNA, 64 nt, hsa
uuccggggaaggagauccagaacuuuuuaccagauuuucaaagacaucugugacucccaaaagu

SEQ ID NO: 215253 - RNA, 64 nt, hsa
aguaugacuuuuaauguaaacaaacugcagguuuuuuucaaacuaauuuuaagaauuuagucuu

SEQ ID NO: 215254 - RNA, 64 nt, hsa
auaugucuuuuagauucugaauggugauuuaaaauuuucaaaaugaaauuccauauaugugcaa

SEQ ID NO: 215255 - RNA, 64 nt, hsa
ucucugacuugcucaggacaaacuaggccagugguuuucaaacugcuuggcagagcccugaagu

SEQ ID NO: 215256 - RNA, 64 nt, hsa
uuuaaaaaauaagggaaauaaauguaauugccauuuuucaaagauuaaguaggaggagaggggu

SEQ ID NO: 215257 - RNA, 64 nt, hsa
gcauuucugaugaaucuaugguucuuacagaaauuuuucaaaggaaucaauuuagagauagagu

SEQ ID NO: 215258 - RNA, 64 nt, hsa
aaacucaacaucaaaugcucugaugugcuauagauuuucaaaucuuuacucacauaauuaucuc

SEQ ID NO: 215259 - RNA, 64 nt, hsa
cagucacagcucccaugccucagcuuuguaccuguuuucaaaagcacaacugaggugugcgggc

SEQ ID NO: 215260 - RNA, 64 nt, hsa
uacagaaaaaaaauguuuuggguauaaaucuggguuuucaaaaccagcuuuuuucuauauauaa

SEQ ID NO: 215261 - RNA, 64 nt, hsa
acaaccugaaucuuuuuuuuauauaaauauauauuuuucaaauagauuuuugauucagcucauu

SEQ ID NO: 215262 - RNA, 64 nt, hsa
cuaggauuuuuuuaaauagaugcugcuugcuauguuuucaaaccuuuuugagccauaggaucca

SEQ ID NO: 215263 - RNA, 64 nt, hsa
gacuguaaauggcuugugauacucuugauacuuguuuucaaauauguuuacuaacuguaguguu

SEQ ID NO: 215264 - RNA, 64 nt, hsa
aaagucuguguuuuuguguuuuuuuaaauaaaaauuuucaaaaaguuaaaaaaaaagacauaua

SEQ ID NO: 215265 - RNA, 64 nt, hsa
ccuguaaacuguaucacuuugacugauauuguaauuuucaaauguauaauauguuuacagaugu

SEQ ID NO: 215266 - RNA, 64 nt, hsa
gacuccgucucaaaaaaaaaaaaaaaaaaaaauguuuucaaaguuccauucuguuaaaguaacc

SEQ ID NO: 215267 - RNA, 64 nt, hsa
cuaaaauauuuucaauacuauuuucucuguaaaguuuucaaaguucuccauccuggcuaacacg

SEQ ID NO: 215268 - RNA, 64 nt, hsa
augguuuuuauguaaaacauuuuuagaacuccaguuuucaaaucauguuugaaucuacauucac

SEQ ID NO: 215269 - RNA, 64 nt, hsa
uauaugcuuucuuuugcauggacaugggccagguuuuucaaaaggaauauaaacaggaucucaa

SEQ ID NO: 215270 - RNA, 64 nt, hsa
uuuuucaaaauguagaauuguagaaaaugucaauuuuucaaacucauuuuucauugcuaggauu

SEQ ID NO: 215271 - RNA, 64 nt, hsa
aauuguguucuguaaaaaaguauuagucaauuauuuuucaaaauguagaauuguagaaaauguc

SEQ ID NO: 215272 - RNA, 64 nt, hsa
caugagaauucaacauaaaauugugagcucugauuuuucaaauugaucauaaaaccuuuaggaa

SEQ ID NO: 215273 - RNA, 64 nt, hsa
auaaucauguauucaauggacuguaauuuaugauuuuucaaaaucauguuacaagauagacaua

SEQ ID NO: 215274 - RNA, 64 nt, hsa
ucauuaaaaaauaauaaacgaugcuauuuuaauauuuucaaauaaauaaucugaggauguguuu

SEQ ID NO: 215275 - RNA, 64 nt, hsa
uuuuuuacuaaaaugauauaggguuuauuuuauauuuucaaaaaaauuguuaaacaucauucuu

SEQ ID NO: 215276 - RNA, 64 nt, hsa
uucuuuuuaaggaagugcuguuuuuuuuugaggguuuucaaaacauuuugaaaagcauuuacuu

SEQ ID NO: 215277 - RNA, 64 nt, hsa
aaaagcauuuacuuuuuugaccacgagccaugaguuuucaaaaaaaucggggguuguguggguu

SEQ ID NO: 215278 - RNA, 64 nt, hsa
caaaugugaaaaauguggcaaagcuuuuaaccaauuuucaaaccuuacuaaacauaagauaacu

SEQ ID NO: 215279 - RNA, 64 nt, hsa
ugucuugcaaauguaauaaauuugggaaaacaaauuuucaaaaacuacagcuuagaaaacacca

SEQ ID NO: 215280 - RNA, 64 nt, hsa
gcuuagaaaacaccagaguuuauacgaaaauauauuuucaaagguguaguaaaaauaaaaaaaa

SEQ ID NO: 215281 - RNA, 64 nt, hsa
guaaaugccacuucagcaagguuuguuggugguuuuuucaaacucuuaugcacucaugaaacac

SEQ ID NO: 215282 - RNA, 64 nt, hsa
uugauuuuguuuaugaaaagcaaggauagcuuaauuuucaaaaacucaaucaauguaauucagu

SEQ ID NO: 215283 - RNA, 64 nt, hsa
aacugugcgaauguaauaaaguuggaaaaauacuuuuucaaaaacuacagcuuagaaaacacca

SEQ ID NO: 215284 - RNA, 64 nt, hsa
aaagaugugacagugcuuugaaaacaccucaaacuuuucaaaacauaaaucauaguguugagaa

SEQ ID NO: 215285 - RNA, 64 nt, hsa
auuauuuccagacccaccaccagaguggaucuuauuuucaaagcaguauagacaauuaugaguu

SEQ ID NO: 215286 - RNA, 64 nt, hsa
gucuaccucuccucacaccccagcaccccccauuuuuucaaaccuugguaucuguugggugaac

SEQ ID NO: 215287 - RNA, 64 nt, hsa
uugaagcauaucuugauuuuuaagcuuaucuugauuuucaaacaugcauagcuauuuuuaucac

SEQ ID NO: 215288 - RNA, 64 nt, hsa
uacuaucuagacucgaaugcuuucauacaagugauuuucaaaaauuagucaauaaaaauugaug

SEQ ID NO: 215289 - RNA, 64 nt, hsa
auauuauuuugauuguuaaacaaauaaaauccuguuuucaaaaugcauguauggugaaaauaug

SEQ ID NO: 215290 - RNA, 64 nt, hsa
uugggaaaggaguacgugauucccucccuuucacuuuucaaagugagccacuaaacagaaaguc

SEQ ID NO: 215291 - RNA, 64 nt, hsa
gggguauuuguaccaggucaggguuuuuguguuguuuucaaauaaguuugacuaaaauaaguuu

SEQ ID NO: 215292 - RNA, 64 nt, hsa
auauaguccaguuuuccaagauaagcucaguccuuuuucaaauguccccuuuuuaccaauacuu

SEQ ID NO: 215293 - RNA, 64 nt, hsa
ugcacugacacagcauucaugauguuaccuucacuuuucaaaauauuguagaaggauuuuucuc

SEQ ID NO: 215294 - RNA, 64 nt, hsa
aacuuaacauuaugagccuuuucugcucaaaaaauuuucaaagauuaaaacuauuauacauaua

SEQ ID NO: 215295 - RNA, 64 nt, hsa
uuucacuuaaaauuauuaugcaaaaaugaauguuuuuucaaaaaaugugaaauguauuuuauuu

SEQ ID NO: 215296 - RNA, 64 nt, hsa
aucuacaaauuacagguuuauccauuugcaaauauuuucaaaauggaaaucacuguuuauauug

SEQ ID NO: 215297 - RNA, 64 nt, hsa
cuuaauaugccauuggguuuuuguguguaugugauuuucaaaauucaugacuugaagugcaagg

SEQ ID NO: 215298 - RNA, 64 nt, hsa
uuauguauauuuuguuccuguuauauuggcuuuauuuucaaaauuguaguuuguaguauuaguu

SEQ ID NO: 215299 - RNA, 64 nt, hsa
aaaugauccauauaacuguugggugcaucagugcuuuucaaaggggcugcuuacuauaggguua

SEQ ID NO: 215300 - RNA, 64 nt, hsa
auguucagcaagagaacugcuugaguuuaagccauuuucaaaagaaacuugccuuuuacauuau

SEQ ID NO: 215301 - RNA, 64 nt, hsa
uuaguuggcaguuguuaaguccuuggcuugccauuuuucaaaaaguaaaaagguccucacaggu

SEQ ID NO: 215302 - RNA, 64 nt, hsa
uuuacaauccauauaagcccuugauuggaagggcuuuucaaaaucauuuagucuaacaacugcc

SEQ ID NO: 215303 - RNA, 64 nt, hsa
uuucuacuguauguaugaaccgaauggaggaauguuuucaaagauugauuugguguggauugca

SEQ ID NO: 215304 - RNA, 64 nt, hsa
accuacauauuacauggguguaguguguugaggcuuuucaaagaagggucuagugagcuaaguu

SEQ ID NO: 215305 - RNA, 64 nt, hsa
uucauaccaucucugcacccacaaucacacugauuuuucaaauucauuuuguuuuugcuguuuc

SEQ ID NO: 215306 - RNA, 64 nt, hsa
gaagucauuuugauuuucaaagaagccguuuugauuuucaaagaagcagguucuggugacauua

SEQ ID NO: 215307 - RNA, 64 nt, hsa
uucuuuuuucagaccauacaagaagucauuuugauuuucaaagaagccguuuugauuuucaaag

SEQ ID NO: 215308 - RNA, 64 nt, hsa
ggccaggacauuuguccacuuaaacucucaacaacagugugaucauugguuggacacugugguu

SEQ ID NO: 215309 - RNA, 64 nt, hsa
ugugucgagggaugggagcgaugcuuaucucucacagugugaguggucugugugaggcuguucc

SEQ ID NO: 215310 - RNA, 64 nt, hsa
cauuucuacacugauugcacugaggauuucuccccagugugaaguuucuggcauagaguccugg

SEQ ID NO: 215311 - RNA, 64 nt, hsa
uuuuccugcauuugcuguuuucucaugucucucccagugugaauucuuuggugugcagugcgcu

SEQ ID NO: 215312 - RNA, 64 nt, hsa
cgagacuucugcagagguggcugaccucaagaagcagugugaugugcugguggaagaguuugag

SEQ ID NO: 215313 - RNA, 64 nt, hsa
ggcaggccuugugguuucaggacugcaaggacuccagugugaacucaggaggggcaggugucag

SEQ ID NO: 215314 - RNA, 64 nt, hsa
caaagacuggggagagcugugugccucaguguugcagugugaauuccuaaauagaggguaaagu

SEQ ID NO: 215315 - RNA, 64 nt, hsa
cauggggaauguggggaucagggagguggagggacagugugaauaaauggcaucuaggaaggua

SEQ ID NO: 215316 - RNA, 64 nt, hsa
acuccacgggugccccuagcuggcccagagccggcagugugagcccaaguccgggcuggagccg

SEQ ID NO: 215317 - RNA, 64 nt, hsa
cccccccggccugggcaucugaccucccccaccccagugugauuuaacauccaggaacugaggc

SEQ ID NO: 215318 - RNA, 64 nt, hsa
caugguccucacuggccucagucucccugaccggcagugugaggggauguagcuauaguggagc

SEQ ID NO: 215319 - RNA, 64 nt, hsa
cguuuagccaggauguggcucuccagcuuggcuucagugugaucacuugucagugcgcuuucuc

SEQ ID NO: 215320 - RNA, 64 nt, hsa
cuugggugaugcuggaguugucauggccgcaguucagugugagauuuuuuaccagguauugcgc

SEQ ID NO: 215321 - RNA, 64 nt, hsa
ccucacaccucgcuguuccccaacauccccugagcagugugagcucaucucaccagaugagaag

SEQ ID NO: 215322 - RNA, 64 nt, hsa
gcauguguguggcacagauggcugggacgggugacagugugagugcaugugugcaugcaugugu

SEQ ID NO: 215323 - RNA, 64 nt, hsa
accuuuuuaacuuuauaguuagaaaaauuggccucagugugaaauuuuuccagucccauagcuc

SEQ ID NO: 215324 - RNA, 64 nt, hsa
auguuuagucugagauggaucauaaguaaaugagcagugugagaggggagggauggguaggugc

SEQ ID NO: 215325 - RNA, 58 nt, hsa
cgguaccaguggaggaauagaacaggagcagugugacaugaggugaccuacaggaaca

SEQ ID NO: 215326 - RNA, 64 nt, hsa
ucugaggccagggacgucacccaaggcugguggucagugugaagggcuccgugccaacugguca

SEQ ID NO: 215327 - RNA, 64 nt, hsa
gagccgagaguucgccccaacccuuccccaggcccagugugaaaaacagacucacaaggggcuu

SEQ ID NO: 215328 - RNA, 64 nt, hsa
auccaaagcuacccagucccuugacccagcacaguuggccgacccgugucacucccuggcuguc

SEQ ID NO: 215329 - RNA, 64 nt, hsa
gcggacccucacaugggcagaaaaaugguggucauuggccgacaucacaguuuuccuguuuccc

SEQ ID NO: 215330 - RNA, 64 nt, hsa
agaugcuggcaugccuuacuccaggugccuguguuuggccgaggccugugugauucccggucug

SEQ ID NO: 215331 - RNA, 64 nt, hsa
aacccccacaccucuuaccuuggacagguaaggcuuggccgaugucugauugggaccaggaggg

SEQ ID NO: 215332 - RNA, 64 nt, hsa
uaaagcgugaaauuagagcuggacuuaagacucauuggccgaccauccuguguccuggccuggc

SEQ ID NO: 215333 - RNA, 64 nt, hsa
cacuugccgaucugcguguguccagaaguggcccuuggccgagcgccgaacucgcucgcccucu

SEQ ID NO: 215334 - RNA, 64 nt, hsa
agcuaaccacaaaugucuccuccaggcuaugaaauuggccgauuucaagaacacaucuccuuuu

SEQ ID NO: 215335 - RNA, 64 nt, hsa
agcgaccacugcagccugcggacgaggccgggacuuggccgagcggauccuaauaaggggaaaa

SEQ ID NO: 215336 - RNA, 64 nt, hsa
cuccuugccaggggagagacagccacgguccucuuuggccgaugcuguauucucauuuuggccc

SEQ ID NO: 215337 - RNA, 64 nt, hsa
aggugguagaacauagcaaaaauauaaccgaaaguuggccgacugcacuugcuauggaauaaga

SEQ ID NO: 215338 - RNA, 64 nt, hsa
caggggucuggucucuuugacuccaggcuggccuuuggccgacugucugcucacccagagaccu

SEQ ID NO: 215339 - RNA, 64 nt, hsa
uuugccccacuuugcaucuccaaaauuacaacgguuggccgaucccauuugaggacaaugcuua

SEQ ID NO: 215340 - RNA, 64 nt, hsa
cuuaucuacgagguuccuagagcucugcugacccuuggccgaaacucuaaaauguaccuauuaa

SEQ ID NO: 215341 - RNA, 64 nt, hsa
uaugaaacagguccagaaaggggagguggccugcuuggccgacgucauggagccagcugggagc

SEQ ID NO: 215342 - RNA, 64 nt, hsa
cgcaccgcugggagucugaggccugagugaguguuuggccgaggccugcauguccggcugaagg

SEQ ID NO: 215343 - RNA, 64 nt, hsa
cgugaugaagacagaaggcuccggggugacgaauuuggccgauggcagauguuuugggggaacg

SEQ ID NO: 215344 - RNA, 64 nt, hsa
uuauacagaaaccggacccacuaauccucugggauuggccgacugugagcugcagauaaggcua

SEQ ID NO: 215345 - RNA, 64 nt, hsa
gcaaauccaaagacugaguuauguuuaaugacuuuuggccgaaucacuggaaauaucuguggug

SEQ ID NO: 215346 - RNA, 64 nt, hsa
ugguggcagcugggcaggucuccucugggaggucuuggccgacucagggaccuaagccacguua

SEQ ID NO: 215347 - RNA, 64 nt, hsa
ugggccccgcuggucacucaacagaguauuucccuuggccgagauggaaguuuugucccaauag

SEQ ID NO: 215348 - RNA, 52 nt, hsa
caccuuggccugguggaugaauuuggccgaaucuucaugcaaggaaauaaca

SEQ ID NO: 215349 - RNA, 64 nt, hsa
auucugaauaauauccguguuaagaagggguucuuuggccgaagacgugggucugcguggaauu

SEQ ID NO: 215350 - RNA, 64 nt, hsa; identical to SEQ ID NO: 215347

SEQ ID NO: 215351 - RNA, 64 nt, hsa
uuuuuuccgugaaagauuucuuaaaauauuacuuuuggccgagcaugguggcucaccccuguaa

SEQ ID NO: 215352 - RNA, 64 nt, hsa
uccacaaccaggggcuggcacuggagccagcagcuuggccgagucacaggugacccguggcccu

SEQ ID NO: 215353 - RNA, 64 nt, hsa
cuugaauucuuuuccucucuuaaauucauaucauuuggccgagucagcacguaguuugcauucc

SEQ ID NO: 215354 - RNA, 64 nt, hsa
agggccugauuugagccuccucucugaagaugauuuggccgagcggaagguguggaccaccgga

SEQ ID NO: 215355 - RNA, 64 nt, hsa
uggcagacggucuuagccaagggcugugguggcauuggccgagggucuucgggugcuucccagc

SEQ ID NO: 215356 - RNA, 64 nt, hsa
cgugcgcgaugccuggggucgucugcccguggacuuggccgaggagcggggccaccgcgacguu

SEQ ID NO: 215357 - RNA, 64 nt, hsa
uccggagagggugggguggagcagcgggggagccuuggccgaagagaaccaugcuuggcaccgu

SEQ ID NO: 215358 - RNA, 64 nt, hsa
aaagucuaccggcccuuucuuugugaacgucacauuggccgagccguguucaguucccaggugg

SEQ ID NO: 215359 - RNA, 64 nt, hsa
ugaugcaaacuucuccuuucagugguuggagaaauuggccgaguucaaccauucacugcaaugc

SEQ ID NO: 215360 - RNA, 64 nt, hsa
ucuucuguccauguugggcauaagggaugaaaacuuggccgagacuaauguguggcccacagcu

SEQ ID NO: 215361 - RNA, 64 nt, hsa
cgugggcugaauuuugcugaucagcuggguaguuuuggccgagaacugcacuugccucaguguu

SEQ ID NO: 215362 - RNA, 64 nt, hsa
gugcccgcuucuuaccacugugugucagcugggauuggccgacagcgugguggugacuucuagg

SEQ ID NO: 215363 - RNA, 64 nt, hsa
gccucuggccccucacccaccauggaccagcccauuggccgagcuccuggggagcuccugggac

SEQ ID NO: 215364 - RNA, 64 nt, hsa
caucuagcggccgcucgagggaagcacccgccgguuggccgaaguccacgaagccgcccucugc

SEQ ID NO: 215365 - RNA, 57 nt, hsa
gacgggagucagagaucugagccaaccuuggccgacaugcagcauccacccccggcu

SEQ ID NO: 215366 - RNA, 64 nt, hsa
cccuugucugcugcucccagccacguuggugguauuggccgaugagcugguuugacucauuaau

SEQ ID NO: 215367 - RNA, 64 nt, hsa
cucagucagugucaugaauguugcaugacaacaguuggccgauuagaaggcagacuuucuacau

SEQ ID NO: 215368 - RNA, 64 nt, hsa
ccugacauucuuucccuucagggauccaaaaugguuggccgagcucccagugggaaaacgugug

SEQ ID NO: 215369 - RNA, 64 nt, hsa
ccgggacguggggucacuuccuucauguaagacuuuggccgaaauuucuacaccugugucuagu

SEQ ID NO: 215370 - RNA, 64 nt, hsa
uguuuacagggucuuggaugucggguucgaccacuuggccgaugggaauggucugucacagucu

SEQ ID NO: 215371 - RNA, 64 nt, hsa
auacuuccugucaucugccccuuuccagaaaaacuuggccgacccuuggucuacagcacggguu

SEQ ID NO: 215372 - RNA, 64 nt, hsa
agagagacuuugucucuauuaaaaauaaaaaugauuggccgagcaugguggugcacaccaguau

SEQ ID NO: 215373 - RNA, 64 nt, hsa
aggaagaacgcaacagaagaguccuggucugaacuuggccgaguaggggugggggugggauggc

SEQ ID NO: 215374 - RNA, 56 nt, hsa
aaucaaugcuaaaccccuagauucuauuggccgaucacuacugugggcugaaggau

SEQ ID NO: 215375 - RNA, 64 nt, hsa
aucauccuguccccacgcuccuccacucccgcccuuggccgaagcauagauuguaaccccucca

SEQ ID NO: 215376 - RNA, 64 nt, hsa
ccugagccaagcucaucuucauugaaugucucauuuggccgaggaacaacugaacuuugugguu

SEQ ID NO: 215377 - RNA, 64 nt, hsa
gauaggcgcaguggagcggguugcuuggggggcguuggccgacuucuuagagaaggcccuccau

SEQ ID NO: 215378 - RNA, 64 nt, hsa
gucgcgugggaugaugaguccguuguugucugccuuggccgaaagaugaaaaaaagccugaacc

SEQ ID NO: 215379 - RNA, 64 nt, hsa
cuagaauuugcuaacuuguaauauugaauuuccuuuggccgauaaucaggauuucccuauaagu

SEQ ID NO: 215380 - RNA, 64 nt, hsa
ccugacaggcgcuuagcgggcgacucccuccccauuggccgaguuauggagcgcuccgaccaga

SEQ ID NO: 215381 - RNA, 64 nt, hsa
ccucuuuagggaggcccaugaucgacuaaugcaguuggccgacugggacuuuucaacauuggau

SEQ ID NO: 215382 - RNA, 64 nt, hsa
uccccaaaugaaaaaaaaaaguaaucucagaauguuggccgagcaugguggcucacaccuguaa

SEQ ID NO: 215383 - RNA, 64 nt, hsa
acggcucuguguucccuagcagcugcgggaggguuuggccgaugaaguaccugcucagcuuagc

SEQ ID NO: 215384 - RNA, 60 nt, hsa
gcucugcucagcugcgcccccuucuuugcagcugcccagccccuccucccugcccucggg

SEQ ID NO: 215385 - RNA, 60 nt, hsa
aaagguaggaagagagguccagccccccaggcugcccagagcugcuggucucauuugggg

SEQ ID NO: 215386 - RNA, 60 nt, hsa
gcggcaccugaagggggaggaugacaagccgcugcccaccuccaagcccaggaaacagua

SEQ ID NO: 215387 - RNA, 60 nt, hsa
ggcagcaagcgcagccuggaggaagagggugcugcccacagugggaagagacugcgggcc

SEQ ID NO: 215388 - RNA, 60 nt, hsa
cgucugggaagugaggagcgucucugccuggcugcccauugucugggacgugagcagccc

SEQ ID NO: 215389 - RNA, 60 nt, hsa
ugucugggacgugagcagccccucugccuggcugcccagucuggaaagugaggagcgucu

SEQ ID NO: 215390 - RNA, 60 nt, hsa
uccggacuauccauggcuccgaaucuaagugcugcccacucccaugcucacacccacaga

SEQ ID NO: 215391 - RNA, 60 nt, hsa
ugcuuuggaagggacaagacuaugugcuccgcugcccaccuucagccugcaaugagggac

SEQ ID NO: 215392 - RNA, 60 nt, hsa
cuguccccaggaaccaggcuuugcugaggugcugcccaaccugacaguccaggagaugga

SEQ ID NO: 215393 - RNA, 60 nt, hsa
ucugugacccgguggugugcccaccgcccagcugcccacacccggugcaggcucccgacc

SEQ ID NO: 215394 - RNA, 60 nt, hsa
ggugucgaggguauugggccgggaguacaagcugcccauggacgaccugcugccacuucu

SEQ ID NO: 215395 - RNA, 60 nt, hsa
ccaggugcauggauuggugcugccccucaugcugcccagcuucuacucagagcucuucac

SEQ ID NO: 215396 - RNA, 60 nt, hsa
uagggcuggcauugcuguagagugacggcugcugcccagagcgugucccagacaucacag

SEQ ID NO: 215397 - RNA, 60 nt, hsa
acacaccugucccccagugaugccgcccaagcugcccauggggcuuccuacggaaguuuc

SEQ ID NO: 215398 - RNA, 60 nt, hsa
ucacuggccucuguccuuggcagagaccuugcugcccaggcccaggggcaggcucuuggc

SEQ ID NO: 215399 - RNA, 60 nt, hsa
gcaacgccaggucugcaggccaggagagaugcugcccaggccuccugguuuccaagcugg

SEQ ID NO: 215400 - RNA, 60 nt, hsa
gcugucugcuggguucuuuucucaaguccugcugcccaggcccaggugagacaggcaacg

SEQ ID NO: 215401 - RNA, 60 nt, hsa
caguggucacuugaccaccauugucucagagcugcccacuuugugugugucacaugcugc

SEQ ID NO: 215402 - RNA, 60 nt, hsa
cccagguuccuucuugcacaaauccacucugcugcccaccuucccuggcauuuuaaacag

SEQ ID NO: 215403 - RNA, 60 nt, hsa
ucaggggaagaucaaacacaggugcacucagcugcccagggccucugggacacuugccuu

SEQ ID NO: 215404 - RNA, 60 nt, hsa
ggacuccaccuccuggcugguuuaccugcugcugcccauuuucucuggguacugcuggcc

SEQ ID NO: 215405 - RNA, 60 nt, hsa
ugcuucucaacuaaagaauagugccucagcgcugcccacaccaccgcccuccucgcugug

SEQ ID NO: 215406 - RNA, 60 nt, hsa
uccagugcuuggcugccccacaggccacacgcugcccaggcucugcugacuucugagcag

SEQ ID NO: 215407 - RNA, 60 nt, hsa
ggcacagccaacccuguugcccccagugccgcugcccagcuucggccauccagguggugg

SEQ ID NO: 215408 - RNA, 60 nt, hsa
gccgggaggucacacauguacauccuggaagcugcccaagguguggccacuuguagggca

SEQ ID NO: 215409 - RNA, 60 nt, hsa
ccccccaacugugguagcuccagcgauggugcugcccaggccucucggugcuccaucucc

SEQ ID NO: 215410 - RNA, 60 nt, hsa
ccucccuaguuagcauccaggcuggccagugcugcccaugagcaagccuagguacgaaga

SEQ ID NO: 215411 - RNA, 60 nt, hsa
gagacccgggaugugugugcuguaccccaagcugcccacugucuugcccgggcugagguc

SEQ ID NO: 215412 - RNA, 60 nt, hsa
ugugcacauccugcaggugcuacugagacugcugcccaacaugagcagugaucuccaagg

SEQ ID NO: 215413 - RNA, 60 nt, hsa
gccuguuuagccaaguagcuuugggcauaggcugcccaaucugagcaaacaccagugagg

SEQ ID NO: 215414 - RNA, 60 nt, hsa
agcacaacucagucugugggagcucagcucgcugcccagggauagguaugaccuaugucu

SEQ ID NO: 215415 - RNA, 60 nt, hsa
caccuccuccaccugcuucaaccugcucaagcugcccaacuacagcaagaagagcguccu

SEQ ID NO: 215416 - RNA, 60 nt, hsa
gcgccucuucccagacagccaggcccaucugcugcccagggaagcgcaggcgccugcuag

SEQ ID NO: 215417 - RNA, 60 nt, hsa
gucugcaaaaucccaggaaacuugggucuugcugcccauccuuccucagcacagggaacc

SEQ ID NO: 215418 - RNA, 60 nt, hsa
gaaggguuccaaccccaagucagucaggaagcugcccauuuuuuugcaaggcauuuuaau

SEQ ID NO: 215419 - RNA, 60 nt, hsa
uacacucauguugauggauaguauagauuugcugcccacaccagauaucuguaaggcauc

SEQ ID NO: 215420 - RNA, 60 nt, hsa
ggccucaaccacugggugcgggcccugguggcugcccagagcuaccuguacagcggcucc

SEQ ID NO: 215421 - RNA, 60 nt, hsa
gcgagccucccucuacucggcacuguccuugcugcccagccccucucugggugccaggua

SEQ ID NO: 215422 - RNA, 60 nt, hsa
gguccugugggcugagcggcuggggcuggggcugcccacguguggccuccgcuggcucug

SEQ ID NO: 215423 - RNA, 60 nt, hsa
uuuuuuuuuuugagauggaguuucacucuugcugcccaggcuggagugcaguggcucaau

SEQ ID NO: 215424 - RNA, 60 nt, hsa
gcuaccacagacuugcacugaagccggacagcugcccagacacaugggcuugugacauuc

SEQ ID NO: 215425 - RNA, 60 nt, hsa
ccacuccgguuccccgcaacccacagcucagcugcccaucccagucccucgccgucccuc

SEQ ID NO: 215426 - RNA, 60 nt, hsa
cugcccccggcccaggugucucggaggguggcugcccacggccuggguguggcuggaaug

SEQ ID NO: 215427 - RNA, 60 nt, hsa
ucaggaaaccaccaagugccucggaugguggcugcccacggcgcuucugcugagacccug

SEQ ID NO: 215428 - RNA, 60 nt, hsa
gagucagucucaguagccaucagccuggcagcugcccaucccauaaccaaagagcucaau

SEQ ID NO: 215429 - RNA, 60 nt, hsa
ugcggauagugccucaccauugcccacccugcugcccaacuccugugagagaaaaaccaa

SEQ ID NO: 215430 - RNA, 60 nt, hsa
ggugggagaggccagcuugagccagacagcgcugcccagggguggccgccuaguacacac

SEQ ID NO: 215431 - RNA, 60 nt, hsa
gcuggagggcccugaacccugcacugcguggcugcccagccagcugccuccuguccuggg

SEQ ID NO: 215432 - RNA, 60 nt, hsa
cccaaaacccgcagguccucauguccagacgcugcccaguccuguccugaaaacagcacg

SEQ ID NO: 215433 - RNA, 60 nt, hsa
gguggggcccggggccaagccugcauucuggcugcccagcuucggacagcgggaacuccu

SEQ ID NO: 215434 - RNA, 60 nt, hsa
cgugcaucuuccgaaggcaccagaggugaagcugcccagggcuccggaggugcagcuaaa

SEQ ID NO: 215435 - RNA, 60 nt, hsa
cgugcccgaugugcaccucccagaggugcagcugcccaaagucugugaaaugaaaguccc

SEQ ID NO: 215436 - RNA, 60 nt, hsa
ugugccggaggugcggcuuccagagguagagcugcccaaagugucagagaugaaacuccc

SEQ ID NO: 215437 - RNA, 60 nt, hsa
ugcuccugaaguuguagagagcaagcugaagcugcccaccaucaagaugcccucccuugg

SEQ ID NO: 215438 - RNA, 60 nt, hsa
uggagggguuuccuggguauaacccauugggcugcccaaggccagccagccugagcucuc

SEQ ID NO: 215439 - RNA, 60 nt, hsa
guacaguuugacacugaucugguccaugaggcugcccagagaaagcacugcuucuguaug

SEQ ID NO: 215440 - RNA, 60 nt, hsa
gacuuuugcccacagcacaugacaccgacagcugcccagccuguucacaugcuggggacc

SEQ ID NO: 215441 - RNA, 60 nt, hsa
aggucaccuuccugaaagaugaaugagaaagcugcccauucucaagacucaucugccuag

SEQ ID NO: 215442 - RNA, 60 nt, hsa
cuccaaagcaacgggcuggggcagccugcagcugcccacccaaccuggucuucacaccag

SEQ ID NO: 215443 - RNA, 60 nt, hsa
gucaugcccagcuuggagugccacauggccgcugcccacgucccgggcacugucaugccc

SEQ ID NO: 215444 - RNA, 60 nt, hsa
gucaugcccagcuuggagugccacguggccgcugcccacgucccgggcacugucaugccc

SEQ ID NO: 215445 - RNA, 60 nt, hsa
cccugcaaggugcaccugccccaggcucaggcugcccagcggcucuuccuggacagugag

SEQ ID NO: 215446 - RNA, 64 nt, hsa
cugccucagccuccaacuagcugggauuacaggcacaagccaccaugccuggcuaaaauucuuu

SEQ ID NO: 215447 - RNA, 64 nt, hsa
ucuguggguaccucccugcccagguuauucacucacaagccaccgggccuucaggacaucucaa

SEQ ID NO: 215448 - RNA, 64 nt, hsa
cuggaaauaggccauagggccccuacuacugccaacaagccauggccuaccuugacacuuguuu

SEQ ID NO: 215449 - RNA, 64 nt, hsa
uuagguaacugguacuuacuuccaaagacugaauacaagccacacuccaucauaucccuuaaac

SEQ ID NO: 215450 - RNA, 64 nt, hsa
cacagagacugccucuuaacaugaagaucauuggacaagccacacggguaucccaucccgaucu

SEQ ID NO: 215451 - RNA, 64 nt, hsa
auucagcagugucccggcacuacuaaccccugcaacaagccagaugaggaacauaaggaagaau

SEQ ID NO: 215452 - RNA, 64 nt, hsa
gacccuuccauuaccaauggccugucccucaccaacaagccaacugccacagaugacccacuuc

SEQ ID NO: 215453 - RNA, 64 nt, hsa
cacuucagccucccaaagugcagggauuacaggcacaagccaccgugcccagccaagaauuuuu

SEQ ID NO: 215454 - RNA, 64 nt, hsa
cugccagccaugccuacauccccaugggcacagaacaagccaaagccuucguuguauguugacg

SEQ ID NO: 215455 - RNA, 64 nt, hsa
ucacugggaauguguuuugaaaaugaauuugaagacaagccaacaaacccugcacuccaaaaaa

SEQ ID NO: 215456 - RNA, 64 nt, hsa
aaaucugggcugagccaaagucccuuuuggaaauacaagccauaacauucgaaggacaucagcg

SEQ ID NO: 215457 - RNA, 64 nt, hsa
ugauuaaucugcauucauucagcgaaugcucaagacaagccaggcaugcugagaagcggcgcuc

SEQ ID NO: 215458 - RNA, 64 nt, hsa
ggggggccgugcacaccccaaacccugagcuucacacuuaaacucauggggagggcccuucaga

SEQ ID NO: 215459 - RNA, 64 nt, hsa
aaacuugugugugcaacuuuugggggacaggaaucacuuaaaaucauauuuauuuggcuuuuua

SEQ ID NO: 215460 - RNA, 64 nt, hsa
ucucuuguucgcacaaucuacacugccuuaccuucacuuaaaccacacacacaaggugcucaga

SEQ ID NO: 215461 - RNA, 64 nt, hsa
gucacuuucucucuuauaaauucuguuagcugcucacuuaaacaauguccucuuugagaaaaug

SEQ ID NO: 215462 - RNA, 64 nt, hsa
ugaauuuucaggaauuuaaaaauuagcuuuuuuccacuuaaaggagaaaaauauuugggacuag

SEQ ID NO: 215463 - RNA, 64 nt, hsa
uucuaaaccaccuaugaguauuucuuuuagggcucacuuaaauacauguuuguauauacuguau

SEQ ID NO: 215464 - RNA, 64 nt, hsa
ugcagugaauugugaccaaguuauaaaucaaugucacuuaaaggcugugguaguacuccugcaa

SEQ ID NO: 215465 - RNA, 64 nt, hsa
uagauaaccuguacuucaaguuaaagugaauaaccacuuaaaaaauguccaugauggaauauuc

SEQ ID NO: 215466 - RNA, 64 nt, hsa
aaagaagcaccacgagauggccaggacauuuguccacuuaaacucucaacaacagugugaucau

SEQ ID NO: 215467 - RNA, 64 nt, hsa
uuaucucugauauacaaagggauauaaauauauacacuuaaauagagaaaaagagguugauuga

SEQ ID NO: 215468 - RNA, 64 nt, hsa
gugauuuuuauugggaauuuucuuaggguuauuacacuuaaagcaacaaccaacuaguaacagc

SEQ ID NO: 215469 - RNA, 64 nt, hsa
ucuccgcgguggagcaaacuguggacuugccuggcacuuaaaccuugguagaucuggguuuaua

SEQ ID NO: 215470 - RNA, 64 nt, hsa
caauuuuugucacaaaguaguccauuccugaucucacuuaaaauaaaucacaaguaaauuugaa

SEQ ID NO: 215471 - RNA, 64 nt, hsa
auuacagccaaauauuaucuuaauuaauuucuuacacuuaaaaguguccaucaacaguguguca

SEQ ID NO: 215472 - RNA, 64 nt, hsa
auuuuuucaacuucaagguauuaacagcuguuaacacuuaaaaaguacugccacauauguagcc

SEQ ID NO: 215473 - RNA, 64 nt, hsa
gaguuauaugugaucuuucuauaaccaugccauucacuuaaauaauucaugaagggaaugguuu

SEQ ID NO: 215474 - RNA, 64 nt, hsa
auacuuuuauuucucuugagaaccuucacccuuucacuuaaaggaggcgcuuuauagcuucucu

SEQ ID NO: 215475 - RNA, 64 nt, hsa
ugaggauuugcuaugcagacagggaagggaauuucacuuaaaaggaaggucauuuggagaugug

SEQ ID NO: 215476 - RNA, 64 nt, hsa
aaagauaaugcauauuuuugcacaguggagcuuacacuuaaaagaaaacaaagccccaugggcu

SEQ ID NO: 215477 - RNA, 64 nt, hsa
acaaaagaggcucccccuaaacacacagugcugccacuuaaaaagacuugagaaauuugaaagg

SEQ ID NO: 215478 - RNA, 64 nt, hsa
auuaauggauaauuuauagacaguuaaauuuauagacaguuaaguaaaaauggauaauuuauag

SEQ ID NO: 215479 - RNA, 64 nt, hsa
cagccaacauuuuaaaauuaauggauaauuuauagacaguuaaauuuauagacaguuaaguaaa

SEQ ID NO: 215480 - RNA, 64 nt, hsa
ggaagaggcauagucaugaucaaaaggauauauugacaguuaucuauagccaggguaguuguua

SEQ ID NO: 215481 - RNA, 64 nt, hsa
acauccuucucugauuucuucagcagggucaaaagacaguuacuagcaauggggaaugcuuguc

SEQ ID NO: 215482 - RNA, 64 nt, hsa
aaacacuaugauaggauuuccuaaaguauuuguggacaguuaaaugcuaauuauauacaucugu

SEQ ID NO: 215483 - RNA, 64 nt, hsa
acugucuaugauaggauuuccaaaaguauuuguggacaguuaaaugcuaauuaauauacaucug

SEQ ID NO: 215484 - RNA, 64 nt, hsa
ggaacagugacauggacaccugugacagagagaggacaguuaggagggacagacagcucuuccu

SEQ ID NO: 215485 - RNA, 64 nt, hsa
ugccauucgcuauugagaacuagaaaugaggaaggacaguuacgcuaacuccaaaaggcugucu

SEQ ID NO: 215486 - RNA, 64 nt, hsa; identical to SEQ ID NO: 84086

SEQ ID NO: 215487 - RNA, 64 nt, hsa; identical to SEQ ID NO: 84087

SEQ ID NO: 215488 - RNA, 64 nt, hsa; identical to SEQ ID NO: 84088

SEQ ID NO: 215489 - RNA, 64 nt, hsa; identical to SEQ ID NO: 84089

SEQ ID NO: 215490 - RNA, 64 nt, hsa; identical to SEQ ID NO: 84090

SEQ ID NO: 215491 - RNA, 64 nt, hsa; identical to SEQ ID NO: 84091

SEQ ID NO: 215492 - RNA, 64 nt, hsa; identical to SEQ ID NO: 84092

SEQ ID NO: 215493 - RNA, 64 nt, hsa; identical to SEQ ID NO: 84093

SEQ ID NO: 215494 - RNA, 64 nt, hsa; identical to SEQ ID NO: 84094

SEQ ID NO: 215495 - RNA, 64 nt, hsa; identical to SEQ ID NO: 84095

SEQ ID NO: 215496 - RNA, 64 nt, hsa; identical to SEQ ID NO: 84096

SEQ ID NO: 215497 - RNA, 64 nt, hsa; identical to SEQ ID NO: 84097

SEQ ID NO: 215498 - RNA, 64 nt, hsa; identical to SEQ ID NO: 84098

SEQ ID NO: 215499 - RNA, 64 nt, hsa; identical to SEQ ID NO: 84099

SEQ ID NO: 215500 - RNA, 64 nt, hsa; identical to SEQ ID NO: 84100

SEQ ID NO: 215501 - RNA, 64 nt, hsa; identical to SEQ ID NO: 84101

SEQ ID NO: 215502 - RNA, 64 nt, hsa; identical to SEQ ID NO: 84102

SEQ ID NO: 215503 - RNA, 64 nt, hsa; identical to SEQ ID NO: 84103

SEQ ID NO: 215504 - RNA, 64 nt, hsa; identical to SEQ ID NO: 84104

SEQ ID NO: 215505 - RNA, 64 nt, hsa; identical to SEQ ID NO: 84105

SEQ ID NO: 215506 - RNA, 64 nt, hsa; identical to SEQ ID NO: 84106

SEQ ID NO: 215507 - RNA, 64 nt, hsa; identical to SEQ ID NO: 84107

SEQ ID NO: 215508 - RNA, 64 nt, hsa; identical to SEQ ID NO: 84108

SEQ ID NO: 215509 - RNA, 64 nt, hsa; identical to SEQ ID NO: 84109

SEQ ID NO: 215510 - RNA, 64 nt, hsa; identical to SEQ ID NO: 84110

SEQ ID NO: 215511 - RNA, 64 nt, hsa; identical to SEQ ID NO: 84111

SEQ ID NO: 215512 - RNA, 64 nt, hsa; identical to SEQ ID NO: 84112

SEQ ID NO: 215513 - RNA, 64 nt, hsa; identical to SEQ ID NO: 84113

SEQ ID NO: 215514 - RNA, 64 nt, hsa; identical to SEQ ID NO: 84114

SEQ ID NO: 215515 - RNA, 64 nt, hsa; identical to SEQ ID NO: 84115

SEQ ID NO: 215516 - RNA, 64 nt, hsa; identical to SEQ ID NO: 84116

SEQ ID NO: 215517 - RNA, 64 nt, hsa; identical to SEQ ID NO: 84117

SEQ ID NO: 215518 - RNA, 64 nt, hsa; identical to SEQ ID NO: 84118

SEQ ID NO: 215519 - RNA, 64 nt, hsa; identical to SEQ ID NO: 84119

SEQ ID NO: 215520 - RNA, 64 nt, hsa; identical to SEQ ID NO: 84120

SEQ ID NO: 215521 - RNA, 64 nt, hsa; identical to SEQ ID NO: 84121

SEQ ID NO: 215522 - RNA, 64 nt, hsa; identical to SEQ ID NO: 84122

SEQ ID NO: 215523 - RNA, 64 nt, hsa; identical to SEQ ID NO: 84123

SEQ ID NO: 215524 - RNA, 64 nt, hsa; identical to SEQ ID NO: 84124

SEQ ID NO: 215525 - RNA, 64 nt, hsa; identical to SEQ ID NO: 84125

SEQ ID NO: 215526 - RNA, 64 nt, hsa; identical to SEQ ID NO: 84126

SEQ ID NO: 215527 - RNA, 64 nt, hsa; identical to SEQ ID NO: 84127

SEQ ID NO: 215528 - RNA, 64 nt, hsa; identical to SEQ ID NO: 84128

SEQ ID NO: 215529 - RNA, 64 nt, hsa; identical to SEQ ID NO: 84129

SEQ ID NO: 215530 - RNA, 64 nt, hsa; identical to SEQ ID NO: 84130

SEQ ID NO: 215531 - RNA, 64 nt, hsa; identical to SEQ ID NO: 84131

SEQ ID NO: 215532 - RNA, 64 nt, hsa
caucccaccuugaaaaucacugcucugaaccaguguucuccaccuuguccuccacagaucucau

SEQ ID NO: 215533 - RNA, 64 nt, hsa
ccucaauuguccucuuuggcaugcguuucuuacuguucuccaugugucggcaugucucuaccuc

SEQ ID NO: 215534 - RNA, 64 nt, hsa
gagccaagucugaagaaucagaggcaacuucaugguucuccaaagaagagcccguuacuaucag

SEQ ID NO: 215535 - RNA, 64 nt, hsa
ccagcucggagucaaucccaggaaaauaugcgaaguucuccaaacccauuuauuacuggcuuga

SEQ ID NO: 215536 - RNA, 64 nt, hsa
uucauugucauuauggccacaguuuggugcuugugcacgggacucaaagggcagcgucgaagcu

SEQ ID NO: 215537 - RNA, 64 nt, hsa
cccagacauacuuucagagcgcuagcuguguggugcacgggacuuuacaguuaggauucauguu

SEQ ID NO: 215538 - RNA, 64 nt, hsa
cggguggagcgugaagcaggcuggaggugccccugcacgggagguggcguuugcuaaccaaucg

SEQ ID NO: 215539 - RNA, 64 nt, hsa
gcccccuccuugcccaccugccugcccccgggcagcacgggagggagagcagggugagcacgcu

SEQ ID NO: 215540 - RNA, 64 nt, hsa
cugauaaggaucuaggagaagggucucaugcggacccucacaugggcagaaaaaugguggucau

SEQ ID NO: 215541 - RNA, 64 nt, hsa
aaacuggaauccuuucacccgcuccuacagcuaacccucacaagcaugaagugcuguggcuguu

SEQ ID NO: 215542 - RNA, 64 nt, hsa
cagucucaucuguacaccgacaggguugaugccucccucacaggguugagaacaagagccaguu

SEQ ID NO: 215543 - RNA, 64 nt, hsa
caucugccuauagcaauaggcacgggggugaggacccucacacucucauuugagccucccugag

SEQ ID NO: 215544 - RNA, 64 nt, hsa
ccuuucccaccgguagagaaacuuccagaccagccccucacaccacagccaagagaagccuuuc

SEQ ID NO: 215545 - RNA, 64 nt, hsa
ccuuuaccaccuggagagaagcuuccagaccagccccucacaccacagccaggagaggccuuuc

SEQ ID NO: 215546 - RNA, 64 nt, hsa
ccuuucucaccuggagagaaacuuccagaccagccccucacaccaccgccaggagaggccuuuc

SEQ ID NO: 215547 - RNA, 64 nt, hsa
ccuuucccaccgggagagaaacuuccagaccagccccucacaccacagccaggagaggccuuuc

SEQ ID NO: 215548 - RNA, 64 nt, hsa
ccuuucccaccgggagaggaacuuccagaccagccccucacaccacagccaggagaggccuuuc

SEQ ID NO: 215549 - RNA, 64 nt, hsa
acacacccaagugccccucacaccucgugccucccccucacaggguggccaccugcaccagcgu

SEQ ID NO: 215550 - RNA, 64 nt, hsa
cuguguuuccagaaggccccacacacccaagugccccucacaccucgugccucccccucacagg

SEQ ID NO: 215551 - RNA, 64 nt, hsa
ucacagagcuuccuguggcuucuccagccuuucucccucacaucaggagguagauagcucugaa

SEQ ID NO: 215552 - RNA, 64 nt, hsa
uuuuguucucucucuggucacugcccuuaccugacccucacagaaagagagcucugagcaggug

SEQ ID NO: 215553 - RNA, 64 nt, hsa
ucaauauguccaaaguggaacucuccaucuaccucccucacaugaaccuguuccucucucagga

SEQ ID NO: 215554 - RNA, 64 nt, hsa
cuuucguuuuggaguguucauuuucugaacuugacccucacauuguaggggugcaguuugucca

SEQ ID NO: 215555 - RNA, 64 nt, hsa
caaaggauacaccugaaccagaauaguuuucuuacccucacauugaaaugaggauuuugcuuaa

SEQ ID NO: 215556 - RNA, 64 nt, hsa
gggcugggggagggggcacccagcugccuuuccucccucacaggagccaccaccagccaccucu

SEQ ID NO: 215557 - RNA, 64 nt, hsa
ggacugacaucgcaguuccucuccucucuucauucccucacagcagauuggccggcaccaaucu

SEQ ID NO: 215558 - RNA, 64 nt, hsa
uuuccaucucaggcauguaucccaccaagugccucccucacagccaugcccagaagccucacac

SEQ ID NO: 215559 - RNA, 64 nt, hsa
gugguuaaggguagcaaaucucuaaagcacgaagcccucacaaaucuuugccauuucccaaaca

SEQ ID NO: 215560 - RNA, 64 nt, hsa
cauggauaugacaagcagggcagccuggacacugcccucacaggacagcgccaauaacaauaca

SEQ ID NO: 215561 - RNA, 64 nt, hsa
ggccugugggccucaccugccccucuguucucuccccucacauccuccugcccagcuccucaca

SEQ ID NO: 215562 - RNA, 64 nt, hsa
aaaaugacuuuauugcuuaauuucugccuuuccccccucacacaugcacuuuugggccuuuuuu

SEQ ID NO: 215563 - RNA, 64 nt, hsa
uucagaugggccugugcauccuggccaagcgucacccucacacuggaggaggaugucugcucug

SEQ ID NO: 215564 - RNA, 64 nt, hsa
agaugccacgucuucgugcauucgccaacacgugcccucacagggccagcguccuccuucccug

SEQ ID NO: 215565 - RNA, 64 nt, hsa
gcccguuggacuuugccccucacacuggcccagccccucacacugccccaccccgagaacccuc

SEQ ID NO: 215566 - RNA, 64 nt, hsa
aggccgcaggagugggaugcccguuggacuuugccccucacacuggcccagccccucacacugc

SEQ ID NO: 215567 - RNA, 64 nt, hsa
uuuucuguguuucuggacugcacuguuguccuugcccucacauagacacucagacacccucaca

SEQ ID NO: 215568 - RNA, 64 nt, hsa
cuguuguccuugcccucacauagacacucagacacccucacaaacacaguagucuauaguuagg

SEQ ID NO: 215569 - RNA, 64 nt, hsa
uuuggggaauggggugggggugggagaggagguagauggggaagaaauaccccagacccaacaa

SEQ ID NO: 215570 - RNA, 64 nt, hsa
ugacuguucauuuuuuuccugccccacugcuugggauggggaguugcaacuucaguguggaauu

SEQ ID NO: 215571 - RNA, 64 nt, hsa
cuucagaaauccuacuucagaaguguaauaaauggauggggaaaucguuugauggggaaaaguc

SEQ ID NO: 215572 - RNA, 64 nt, hsa
ucagaaguguaauaaauggauggggaaaucguuugauggggaaaagucucuuguaaguaaaagu

SEQ ID NO: 215573 - RNA, 64 nt, hsa
uggaggggcccgaggagccagguugcauuuauuggauggggagcuccaaggggcauuagugguu

SEQ ID NO: 215574 - RNA, 64 nt, hsa
guaguagcccaggucggcuugucacucgcugugagauggggagauuuugucuuuugauuuaucc

SEQ ID NO: 215575 - RNA, 64 nt, hsa
agggaagcuggaccaccuggaguugauccucugugauggggaggcggggggggggggggguguu

SEQ ID NO: 215576 - RNA, 64 nt, hsa
uuuucuuuucucucugucuuuaggaguagggugggauggggagggaggcugggcaucagggauc

SEQ ID NO: 215577 - RNA, 64 nt, hsa
ccugggcgaaucuccuccaaggaagucccaggaggauggggaccaggaaggcuguggaccccca

SEQ ID NO: 215578 - RNA, 64 nt, hsa
aagcucuggaaacuuguggguggggcccagggaggauggggagggaguggcccaggccugcccc

SEQ ID NO: 215579 - RNA, 64 nt, hsa
uucauuccagcaggaggcacuuaggggagacucggauggggacauggagaacaacccaagcucc

SEQ ID NO: 215580 - RNA, 64 nt, hsa
uuuacaguagaacucaucuaaaaauggauuuggggauggggaaacaugcacaaaaucuuuucau

SEQ ID NO: 215581 - RNA, 64 nt, hsa
aagagccaaguguuacauugagcuuggggugggagauggggaacaggcagugaggaaggagaca

SEQ ID NO: 215582 - RNA, 64 nt, hsa
cccaucaggagggaagauggugggccucagggaggauggggaucaagggacaggccaggagcca

SEQ ID NO: 215583 - RNA, 64 nt, hsa
uggaauguuaaggugaaccccaccccuucuuacagauggggacccagagccugcucuugggaac

SEQ ID NO: 215584 - RNA, 64 nt, hsa
gaagcuuucagagucuucacuggcaguagggggagauggggagaggaaugaucucugcccagcc

SEQ ID NO: 215585 - RNA, 64 nt, hsa
cccagagccaagguggcugggaucuggccccacagauggggaaagauggggaaggguguggagu

SEQ ID NO: 215586 - RNA, 64 nt, hsa
agguggcugggaucuggccccacagauggggaaagauggggaaggguguggaguggggaggagc

SEQ ID NO: 215587 - RNA, 64 nt, hsa
gaauuggacuugagauggggagcagacaggggaggauggggaaugugggacacggugugguggg

SEQ ID NO: 215588 - RNA, 64 nt, hsa
gcugccagggcucuggccuuggaauuggacuugagauggggagcagacaggggaggauggggaa

SEQ ID NO: 215589 - RNA, 64 nt, hsa
cuugucugugacggcguguuguuccccacucugggauggggaagaggcccgucgggaguucugc

SEQ ID NO: 215590 - RNA, 64 nt, hsa
caggaaaacaccaaacacacuauggaacucugcugauggggacccaagcgcccacgugcucagc

SEQ ID NO: 215591 - RNA, 64 nt, hsa
agagugggauccacuucuugguuccugggauggcgauggggacucugccgcuguguagggacca

SEQ ID NO: 215592 - RNA, 64 nt, hsa
cccagggcugcaaaacuggaagcacagccucggggauggggagggaaagacggugcuauaucca

SEQ ID NO: 215593 - RNA, 64 nt, hsa
auguggccaagggcuccagggccagggugugagggauggggagcagcugggcacugggccggca

SEQ ID NO: 215594 - RNA, 64 nt, hsa
caucacugcugucccuccugaggucuggauuggggauggggacaaagaaauagcaagagaugag

SEQ ID NO: 215595 - RNA, 64 nt, hsa
cuucucuugaaaaguucagggaccguccaggggagauggggaggagauauggagugagucaccu

SEQ ID NO: 215596 - RNA, 64 nt, hsa
cccuggccugccuucuucuugugucuuugguggggauggggaggccuauuccugcuggccccuu

SEQ ID NO: 215597 - RNA, 64 nt, hsa
acccauuacaccagaagaccaugggugaagucuagauggggaggagaagugaggccagggacag

SEQ ID NO: 215598 - RNA, 64 nt, hsa
aggagggugcugggaacggcaaggcggucugggggauggggaggggcaaaggugagagaucacc

SEQ ID NO: 215599 - RNA, 64 nt, hsa
ggccagugcacacaggaagaaauugaggcuuauggauggggaugacuucccuaagaucccaugg

SEQ ID NO: 215600 - RNA, 58 nt, hsa
aauauuuaagcuccuuuuagcucaaugggauggggaaccugccggaguccagaggcug

SEQ ID NO: 215601 - RNA, 64 nt, hsa
uucaaacagauaacauaaaaguucuguuacccucauucuauacaaccuauggauuucauguguu

SEQ ID NO: 215602 - RNA, 64 nt, hsa
uuaaguggcuuuccuuggcaucuacagagaaaacauucuauagcccuccuuccuagguguuacc

SEQ ID NO: 215603 - RNA, 64 nt, hsa
uuaaugaucguucugggucagcuugaauguccccauucuauaaauucaacacuuauuuucugaa

SEQ ID NO: 215604 - RNA, 64 nt, hsa
uguuauaucaucaauacuuuuguguauucuguggauucuauauuucauauugagaucagcauuc

SEQ ID NO: 215605 - RNA, 64 nt, hsa
cauagacauauuuuuuuaaaguauaaaaacaacaauucuauagauagauggcuuaauaaaauag

SEQ ID NO: 215606 - RNA, 64 nt, hsa
guuaaaaguacccaggcuugauuauuucaugcaaauucuauauuuuacauucuuggaaagucua

SEQ ID NO: 215607 - RNA, 64 nt, hsa
acaucagggcgcuugaguugcugagaugcaaggaauucuauaaauaacccauucauagcauagc

SEQ ID NO: 215608 - RNA, 64 nt, hsa
ucuguauuauuucucucugaucuauccuguaauuauucuauacuuuagaagaaaagaucaguuc

SEQ ID NO: 215609 - RNA, 64 nt, hsa
aaauaucaagugaaaauuuagaaaggccauuacuauucuauaaaccuuauaaacuugcucuggg

SEQ ID NO: 215610 - RNA, 64 nt, hsa
ucaugcuguuuaugcuauuaguuucuguacugcuauucuauauuuauuauuuuuaaauauauga

SEQ ID NO: 215611 - RNA, 64 nt, hsa
acaucacagacagaaaccuuuauaaaaauauaugauucuauaaagaaucauuagaaauuaugag

SEQ ID NO: 215612 - RNA, 62 nt, hsa
gcagccuggcuacugcuuuuuacugcagaaugaacugcaaguucagcauaguggaggggaga

SEQ ID NO: 215613 - RNA, 62 nt, hsa
cugcugcucucuuuccuucucccugagcugguaacugcaaugccaacuuccugggccuuucu

SEQ ID NO: 215614 - RNA, 62 nt, hsa
cuaucaccucuagaagguuccagagacagugaaacugcaagaugcucucaacaggauuaugu

SEQ ID NO: 215615 - RNA, 62 nt, hsa
uuguuucggcaaagcauuuugauggaauagggaacugcaaauguaugaugauuuugaaaagg

SEQ ID NO: 215616 - RNA, 62 nt, hsa
augaaacagccaucuuaaaaaaaaaaaaaguaaacugcaaaaguacaaaaucauuuuucaau

SEQ ID NO: 215617 - RNA, 62 nt, hsa
ucccagugaugccuuauuugaaacugggcuuaaacugcaaaaagaaugaaguuggauuuagg

SEQ ID NO: 215618 - RNA, 62 nt, hsa
gauaacuccaaguuuaauccagcucagcaugaaacugcaaaaacacugaacauauaaccauc

SEQ ID NO: 215619 - RNA, 62 nt, hsa
uucuugaaacagcaacagucaaaugcccaaccaacugcaaccaugaucugguacaggcaugc

SEQ ID NO: 215620 - RNA, 62 nt, hsa
aauuguuguauaucacuaaaagcaugaauuggaacugcaaugaaagucaaauuuacuuuaaa

SEQ ID NO: 215621 - RNA, 62 nt, hsa
aagauuccagagcucuuugaucgcuuuuaauaaacugcaaguucauuuuaaaugaagggcca

SEQ ID NO: 215622 - RNA, 62 nt, hsa
uuucugauuacucaugauaaacugacauggcuaacugcaagaauuaaaucuucuaucugaga

SEQ ID NO: 215623 - RNA, 62 nt, hsa
uucucuauggcaaagucuuucaaauacgagauaacugcaaaauauuuuccuuuuauacuaca

SEQ ID NO: 215624 - RNA, 62 nt, hsa
uuauuucaugucuuuacuggaccugaaauuuaaacugcaaugccaguccugcaggagugcug

SEQ ID NO: 215625 - RNA, 62 nt, hsa
aaaucacaaccucuuugagccucugucaccugaacugcaaaaugaguggguuagacaaaauc

SEQ ID NO: 215626 - RNA, 62 nt, hsa
uuguaucuaaaguggauacaagcguauguuuaaacugcaagauuuuuacuugcuagagaauc

SEQ ID NO: 215627 - RNA, 62 nt, hsa
aaaaacagcaaaacaaaaagcaaacaaaaaaaaacugcaaaagucuaaaauacccauuggug

SEQ ID NO: 215628 - RNA, 62 nt, hsa
ucuacuuaccauagauaccuuucauaacugguaacugcaaagccuuuugugcuggacccagg

SEQ ID NO: 215629 - RNA, 62 nt, hsa
guuugucauauaaccagguuuauccuuagucuaacugcaagggauggaaccugccccagguc

SEQ ID NO: 215630 - RNA, 64 nt, hsa; identical to SEQ ID NO: 101831

SEQ ID NO: 215631 - RNA, 64 nt, hsa; identical to SEQ ID NO: 101832

SEQ ID NO: 215632 - RNA, 64 nt, hsa; identical to SEQ ID NO: 101833

SEQ ID NO: 215633 - RNA, 64 nt, hsa; identical to SEQ ID NO: 101834

SEQ ID NO: 215634 - RNA, 61 nt, hsa; identical to SEQ ID NO: 101835

SEQ ID NO: 215635 - RNA, 64 nt, hsa; identical to SEQ ID NO: 101836

SEQ ID NO: 215636 - RNA, 64 nt, hsa; identical to SEQ ID NO: 101837

SEQ ID NO: 215637 - RNA, 64 nt, hsa; identical to SEQ ID NO: 101838

SEQ ID NO: 215638 - RNA, 64 nt, hsa; identical to SEQ ID NO: 101839

SEQ ID NO: 215639 - RNA, 64 nt, hsa; identical to SEQ ID NO: 101840

SEQ ID NO: 215640 - RNA, 64 nt, hsa; identical to SEQ ID NO: 101841

SEQ ID NO: 215641 - RNA, 64 nt, hsa; identical to SEQ ID NO: 101842

SEQ ID NO: 215642 - RNA, 64 nt, hsa; identical to SEQ ID NO: 101843

SEQ ID NO: 215643 - RNA, 64 nt, hsa; identical to SEQ ID NO: 101844

SEQ ID NO: 215644 - RNA, 64 nt, hsa; identical to SEQ ID NO: 101845

SEQ ID NO: 215645 - RNA, 64 nt, hsa; identical to SEQ ID NO: 101846

SEQ ID NO: 215646 - RNA, 64 nt, hsa; identical to SEQ ID NO: 101847

SEQ ID NO: 215647 - RNA, 64 nt, hsa; identical to SEQ ID NO: 101848

SEQ ID NO: 215648 - RNA, 64 nt, hsa; identical to SEQ ID NO: 101849

SEQ ID NO: 215649 - RNA, 64 nt, hsa; identical to SEQ ID NO: 101850

SEQ ID NO: 215650 - RNA, 64 nt, hsa; identical to SEQ ID NO: 101851

SEQ ID NO: 215651 - RNA, 64 nt, hsa; identical to SEQ ID NO: 101852

SEQ ID NO: 215652 - RNA, 64 nt, hsa; identical to SEQ ID NO: 101853

SEQ ID NO: 215653 - RNA, 64 nt, hsa; identical to SEQ ID NO: 101854

SEQ ID NO: 215654 - RNA, 64 nt, hsa
ccuaaauuugaaauagugauaagcauaaugaaaauagaugcaaaaaacuaaugugauaugaaaa

SEQ ID NO: 215655 - RNA, 64 nt, hsa
cagauggaucuuccuuacaacugcucuagauuaguagaugcaucuaagcaggcagcaggaacuu

SEQ ID NO: 215656 - RNA, 64 nt, hsa
ugugccuuugcuuuccacccuugcuagacacugguagaugcaacaaacucagauuuauauuugu

SEQ ID NO: 215657 - RNA, 64 nt, hsa
cacgugcagugcacacaaagaaaugacauggaaauagaugcaggcaggcuggucccugcuguga

SEQ ID NO: 215658 - RNA, 64 nt, hsa
aggcacauuggugagaugcacccuuuuuaguuaauagaugcauuccuaaggagcuuuuaauugc

SEQ ID NO: 215659 - RNA, 64 nt, hsa
aucugugaucaucaugauucuuuuaguucacuucuagaugcauauuuuguguuuucuaaagcau

SEQ ID NO: 215660 - RNA, 64 nt, hsa
uagagucuuacauauuugugcaccaaacuugaagaugaaccagaaaacagacuuaaacaaaaua

SEQ ID NO: 215661 - RNA, 64 nt, hsa
uauauuuuguacaaaaacuaauucuuuugguaaaaugaaccauuuacaguucgguuuuggacuc

SEQ ID NO: 215662 - RNA, 64 nt, hsa
agcuugugauaaagagaggagaauaugggacuccaugaaccaguguugauauguuugauuaaga

SEQ ID NO: 215663 - RNA, 64 nt, hsa
aaaaaauuguaacccucuagaaaauaucaaagaaaugaaccagacgugguuuaaauaguugauu

SEQ ID NO: 215664 - RNA, 64 nt, hsa
gaauaaaaaguccccaaacccaaacaaaugguuuaugaaccagaguauauguggaagauucuuu

SEQ ID NO: 215665 - RNA, 64 nt, hsa
agccaauaaguuuuaucuuuuauaaucugucaggaugaaccacuccuuagcuuuuauccaauau

SEQ ID NO: 215666 - RNA, 64 nt, hsa
ugggauuacaggugugagccaccacgccuggcccaugaaccaaguguuuuuaaggaaacaaaac

SEQ ID NO: 215667 - RNA, 64 nt, hsa
ggauagcaaauaucuaucugcuauuaaaugguaaaugaaccaaguguuuuuuuuuguuuuuuuu

SEQ ID NO: 215668 - RNA, 64 nt, hsa
gccucuugucaucaacagccgugaccacuuuagaaugaaccaguucauugcaugcugaagcgac

SEQ ID NO: 215669 - RNA, 64 nt, hsa
cuguaaugaaauuuuaaacuuguacaguauugccaugaaccauauaucgaccuaauggaaaugg

SEQ ID NO: 215670 - RNA, 64 nt, hsa
caccuuggccucccaaugcucugggauuacagacaugaaccacagugccuguuguagaaauuuu

SEQ ID NO: 215671 - RNA, 64 nt, hsa
ccauuggaaaguggcagcuaaacauuaaauucgcaugaaccacagaugcuggagaucaccagac

SEQ ID NO: 215672 - RNA, 64 nt, hsa
cuuuugcagauauucuucgguuugaauaauuaaaaugaaccagauaucagggugguuaauuaaa

SEQ ID NO: 215673 - RNA, 64 nt, hsa
uaaaaugaaccagauaucagggugguuaauuaaaaugaaccagauaucagggugguuuauaaag

SEQ ID NO: 215674 - RNA, 64 nt, hsa
ugugugugguaagagacuuguuccuaguggaucaaugaaccaucucuucugggcaguuuuguug

SEQ ID NO: 215675 - RNA, 64 nt, hsa
uuguauugucaacaugggucauuuaaaguccuguaugaaccauaaccugcugugguaccuuugu

SEQ ID NO: 215676 - RNA, 64 nt, hsa
cugggcuugacccgccaggggaguucuccaggccuagggccaggagagaggcccuggcacccug

SEQ ID NO: 215677 - RNA, 64 nt, hsa
aaccauuuugcauuucccccuccuccagccucuguagggccauggcuguauguacugucgcugu

SEQ ID NO: 215678 - RNA, 64 nt, hsa
guuggguugaguuggacugugcgaacgaguuccauagggccacaucgggcuguuuugcauuuag

SEQ ID NO: 215679 - RNA, 64 nt, hsa
aguucaguugggucaugccacuguuugagucucauagggccaugcugaauugaguuccauugag

SEQ ID NO: 215680 - RNA, 64 nt, hsa
cauuguguaggauucugugguuugguggguccccuagggccauguugggucaaguuagaugguc

SEQ ID NO: 215681 - RNA, 64 nt, hsa
ugauuuuacucuugccugugaaccucaugcaugaaagcagcacauuaaauuguaaaaauacaaa

SEQ ID NO: 215682 - RNA, 64 nt, hsa
aucucuacucucaaguaugaggggaauagaaacaaagcagcaguuuuagccaggguucaaugau

SEQ ID NO: 215683 - RNA, 64 nt, hsa
uuugaguuuaauuguacugacccuggacccagauaagcagcaacuuugugucuuuggggucaca

SEQ ID NO: 215684 - RNA, 64 nt, hsa
gggaugcagagcuuucuguuuuggguguugggagaagcagcaggaaggagucgccagaugauca

SEQ ID NO: 215685 - RNA, 64 nt, hsa
ggaacaccaaugcagagguaacucucaggcagcuaagcagcaccucaagaaaacauguuaaauu

SEQ ID NO: 215686 - RNA, 64 nt, hsa
guuuaaaaagaagaagaagaaaaaaaacaagaacaagcagcaacagcuguuuuguuggggcuau

SEQ ID NO: 215687 - RNA, 64 nt, hsa
gcugugaucgacuuagaauccaaauuugaggaguaagcagcauaaccuucuaccuuguaauaug

SEQ ID NO: 215688 - RNA, 64 nt, hsa
uccugagaggaaguuaggaucagaaagaagaagcaagcagcaaccucugcagggcugacaggau

SEQ ID NO: 215689 - RNA, 64 nt, hsa
gcagcagauugaagaccagcaggggcuuccuaaaaagcagcagcagcuggaauuccaaggccaa

SEQ ID NO: 215690 - RNA, 64 nt, hsa
ugccaucaaccccaacagcuucauccugggucugaagcagcagauugaagaccagcaggggcuu

SEQ ID NO: 215691 - RNA, 64 nt, hsa
ucuuucccuuuucuuuuguucaugaccugaccugaagcagcagauuugauagacuggcaaagau

SEQ ID NO: 215692 - RNA, 64 nt, hsa
ccucccaacugaaaacaacagugacauguuugaaaagcagcaaucgaaagucaguguguucuug

SEQ ID NO: 215693 - RNA, 64 nt, hsa
ccucuuuacacccacagaggugcugcgccaccggaagcagcacgugugagcugggccaggagcc

SEQ ID NO: 215694 - RNA, 64 nt, hsa
acacuguuguuaggccugcaccugcccauccagaaagcagcagcugccuuguuaguccucccca

SEQ ID NO: 215695 - RNA, 64 nt, hsa
acaccuaaauuuuuguaagaaaauuuaaaaauuaaagcagcaaaggaacuuuuugcuuucugcc

SEQ ID NO: 215696 - RNA, 64 nt, hsa
ccacaaggcccagcccugggcaaggaagcuuuggaagcagcaaggugggggucaggcuacaggu

SEQ ID NO: 215697 - RNA, 64 nt, hsa
ucuucacccuuucagaugugaccucuuuuggacuaagcagcaaucuguucucuugcucaaauaa

SEQ ID NO: 215698 - RNA, 64 nt, hsa
gucacaucuacucaacucugcuguugacaugcaaaagcagcaauagacaauaugcguguaaaug

SEQ ID NO: 215699 - RNA, 64 nt, hsa
auacugaagcaugaagauuccugggguggggggaaagcagcaagaaaagguagagaggaaccag

SEQ ID NO: 215700 - RNA, 64 nt, hsa
aaaaauaaaauaguacagaagggcuuauaaugagaagcagcaguucccugcuugcacccccaca

SEQ ID NO: 215701 - RNA, 64 nt, hsa
uagucauaaggagaaaaaaacacucaaauaguagaagcagcaaguagcaaacuucaggagagcu

SEQ ID NO: 215702 - RNA, 64 nt, hsa
acugucagugacaccaucuuggaauaccuuugggaagcagcaggaaaugugcauguggguagag

SEQ ID NO: 215703 - RNA, 64 nt, hsa
ugguucauuccgacuuuuccaauggaaacucagaucccaaaagucccuaaagcagucguagagu

SEQ ID NO: 215704 - RNA, 64 nt, hsa
cuuguauuguuuggaagaaaaaaugaugauagagucccaaaaagaagagaaaaaaaaugcccaa

SEQ ID NO: 215705 - RNA, 64 nt, hsa
cugcuggucacugcuuagaaccgucaugccagggucccaaaagugugggugccugacuuccucu

SEQ ID NO: 215706 - RNA, 64 nt, hsa
acugaacaguucccucaggacucacguacugaucucccaaaagaagagagggucucccuggggu

SEQ ID NO: 215707 - RNA, 64 nt, hsa
auacacaaggaaagcagccucaaagaauuaccccucccaaaaugucagaagugcugaggcugag

SEQ ID NO: 215708 - RNA, 64 nt, hsa
aaacaguuuuguuuuguuuuacuugagggggacgucccaaaauuaaaggaauggagaaauaauc

SEQ ID NO: 215709 - RNA, 64 nt, hsa
gaucuccugacgucgugauccacccgccucggccucccaaaaugcugggauuacaggugugagc

SEQ ID NO: 215710 - RNA, 64 nt, hsa
agcuguucauggcacugaagaugucccuucacugucccaaaacuggcacuagaaguggcugggc

SEQ ID NO: 215711 - RNA, 62 nt, hsa
gaugucucaaauuuccaguaaauaaauuuuaaugucccaaaauacccacuaugucuguaugu

SEQ ID NO: 215712 - RNA, 64 nt, hsa
agcuaaauaacuuuccuauguaaaaugugcugacucccaaaagaggagaaaugcaauggcuuga

SEQ ID NO: 215713 - RNA, 64 nt, hsa
ggcuuuaggcggcagaugauauacauaucugacuucccaaaagcuccaggauuugugugcuguu

SEQ ID NO: 215714 - RNA, 64 nt, hsa
aauacaaauucuuugccuuguggauaucaagaaaucccaaaauauuuucuuaccacuguaaauu

SEQ ID NO: 215715 - RNA, 64 nt, hsa
gggucagcucuuuuuaacuucuugcugcucuuuuucccaaaagguaaaaauauagauugaaaag

SEQ ID NO: 215716 - RNA, 64 nt, hsa
aucagaaaaaauguuaauugaugaugaagcuuauucccaaaaugccuuuugugcauaugauacu

SEQ ID NO: 215717 - RNA, 64 nt, hsa
acugaauucuugugaguggauuacagguuuuugaucccaaaauuccagagcuuucaacucucug

SEQ ID NO: 215718 - RNA, 64 nt, hsa
ugucaguuucuuaauguagacacuaugucuucaaucccaaaaauuauaaaacugaaacccauga

SEQ ID NO: 215719 - RNA, 64 nt, hsa
uaaaacagauaaucaaauagaucuucuccaggauucccaaaaagcuuuuggcagugaguaaaua

SEQ ID NO: 215720 - RNA, 64 nt, hsa
uucuuuaugcauugucucaacacuuucccuuuuuucccaaaaugaguagagaauuaaagccacc

SEQ ID NO: 215721 - RNA, 64 nt, hsa
cauuuuuucuuuucaccacccuguugagcaauuuucccaaaaaaagggcagcaauuauuaaauu

SEQ ID NO: 215722 - RNA, 64 nt, hsa
auacacaaaucuuuacuucucuaccaauuccuauucccaaaaugaacauauuacuggggaaagu

SEQ ID NO: 215723 - RNA, 64 nt, hsa
gaugcacuuaugcaguaaauuaucuugggauaguucccaaaagauugcugaaaaaguagauuga

SEQ ID NO: 215724 - RNA, 64 nt, hsa
guguaugcuuccagguggaggagaaaggggaaucucccaaaauuuaaaaacaaauuggaagaau

SEQ ID NO: 215725 - RNA, 64 nt, hsa
cagaucagcagucacccaucgcuuagcauagaaaucccaaaaccuccagcccgggaacacuaua

SEQ ID NO: 215726 - RNA, 64 nt, hsa
cccuaaaucugagucaguaauucucuuacauccuucccaaaaaucagugucuagggacuaguug

SEQ ID NO: 215727 - RNA, 64 nt, hsa
ccuaaaucugagucaguaauucucuaaaaauccuucccaaaaaucagugucuagggacugguug

SEQ ID NO: 215728 - RNA, 64 nt, hsa
cgugauguccccaaacugcugcuauugaagaacuucccaaaacuucuuuacaaagcccuaaagg

SEQ ID NO: 215729 - RNA, 64 nt, hsa
ccuguguuuuggcaaggugauccuuccagagccaucccaaaaagucagcacugacaugggaugc

SEQ ID NO: 215730 - RNA, 64 nt, hsa
gaacuccagaccucaugauucgccugccucggccucccaaaaugcugggauuacagauaugagc

SEQ ID NO: 215731 - RNA, 64 nt, hsa
caacaguuaucucauguaccucugagugccuucuucccaaaagccagcaguaccauaccugcug

SEQ ID NO: 215732 - RNA, 64 nt, hsa
uucguucucugccacagggacuugccucacugugucccaaaaacaaaucgcagccagcuuuucc

SEQ ID NO: 215733 - RNA, 64 nt, hsa
aggcaaucccuguagccgcagagaauaaacgccuucccaaaauggcaacuucccacagccacau

SEQ ID NO: 215734 - RNA, 64 nt, hsa
auguuggggcugaagacgagcaggggcaaccugccagcaucacagaauucaguguaguuuauac

SEQ ID NO: 215735 - RNA, 64 nt, hsa
agcaagggggcugcugaaaucgcagagacuuuugcagcaucagaucugaggaguaaaacggcac

SEQ ID NO: 215736 - RNA, 64 nt, hsa
cucagagugggggcuccuuaagccuccaggccagcagcaucagcaucaccugggagauuguuag

SEQ ID NO: 215737 - RNA, 64 nt, hsa
gugggggcuccuuaagccuccaggccagcagcaucagcaucaccugggagauuguuaggaaugc

SEQ ID NO: 215738 - RNA, 64 nt, hsa
uaaauccacacacaacucugagaauacccacugccagcaucaaaaagcaaagauacuaauuuuu

SEQ ID NO: 215739 - RNA, 64 nt, hsa
ucugugcuuucuuuaccaacuggcuagaacggaacagcaucacagcaacgcugcggaucuuggu

SEQ ID NO: 215740 - RNA, 64 nt, hsa
ccguguccagacuuugaacuugccugccagccuucagcaucaggaaaggccaaguccugggugu

SEQ ID NO: 215741 - RNA, 64 nt, hsa
uuacauguuuucgaacacagaauagcucuuuucucagcaucauuauugcucuuucagcaucugu

SEQ ID NO: 215742 - RNA, 64 nt, hsa
uguccccuggccguccugucaucccugugugcugcagcaucaccacggccuacuucccaauauc

SEQ ID NO: 215743 - RNA, 64 nt, hsa
uugaaaguccgcuuguaaaagcacaagugagaggcagcaucaggccccuggagggcuguggucc

SEQ ID NO: 215744 - RNA, 64 nt, hsa
uggaaaagacuucagauugaauucacaucuuauucagcaucaaagaauucacacaggagagaaa

SEQ ID NO: 215745 - RNA, 64 nt, hsa
uggaaaagcuuucagucaaaccucaugccuuauucagcaucacaaaaugcauaggaaagagaaa

SEQ ID NO: 215746 - RNA, 64 nt, hsa
ugguaaagccuucagucauagcucagccauugcucagcaucagauaauucacaccagagagaaa

SEQ ID NO: 215747 - RNA, 64 nt, hsa
aaaaaaccauacacacacacacacacacacaaaucagcaucauaagggaauguagccuuccaac

SEQ ID NO: 215748 - RNA, 64 nt, hsa
augaacacacuugugaccuuaguacuuggucauccagcaucauacaggcaucuccaaguuagac

SEQ ID NO: 215749 - RNA, 64 nt, hsa
gcaucauacaggcaucuccaaguuagacucuaugcagcaucaucuuuugcagcauuccucugcu

SEQ ID NO: 215750 - RNA, 64 nt, hsa
ggcuggccugcagucagcaucauugugcaugugacagcaucaaugugauuaguaauuugucugu

SEQ ID NO: 215751 - RNA, 64 nt, hsa
uuagcccugagauggugacaggcuggccugcagucagcaucauugugcaugugacagcaucaau

SEQ ID NO: 215752 - RNA, 64 nt, hsa
acagaguccccagaacucauguggccauuuccgccagcaucacuccccggugccuauggggucc

SEQ ID NO: 215753 - RNA, 64 nt, hsa
agcacaaggggccucccaaaaaggagccccaccucagcaucacugccuuaaucguggccucccu

SEQ ID NO: 215754 - RNA, 64 nt, hsa
gggccucauggaauggaaugucuccacuucacuccagcaucaacaaguggggaauucugaugga

SEQ ID NO: 215755 - RNA, 64 nt, hsa
uucaguuuauaccuugccuguaguccagucucuccagcaucaauuccaucagcacaaagacaua

SEQ ID NO: 215756 - RNA, 64 nt, hsa
cagugaguuacccagggcuccagggagcccacagcagcaucagacccauccaggggcuacaggg

SEQ ID NO: 215757 - RNA, 64 nt, hsa
uuucccacuguuaaggacucuguccaaagaaccucagcaucagcucccucaagcuuaaugaucc

SEQ ID NO: 215758 - RNA, 64 nt, hsa
cacccuugguggcugcuggaaggggagagguucucagcaucaggccaccuccaccccaaugcca

SEQ ID NO: 215759 - RNA, 64 nt, hsa
aauggauaaugggaggaaaaguugcugcuuccuucagcaucaaagccuuuccuugggaaucugc

SEQ ID NO: 215760 - RNA, 64 nt, hsa
acuuaugugaugacuugaucgaggcaggcuuuuccagcaucacuguccugguuccaucucugcu

SEQ ID NO: 215761 - RNA, 64 nt, hsa
ccgccuuagaauucggaaguguuuuggaauccagcagcaucauaagauaaccaaacucguccuc

SEQ ID NO: 215762 - RNA, 64 nt, hsa
aaaacggaagaaguuacccuuaagcuaggauguugcucagaagugaccaucccaacuuuggugc

SEQ ID NO: 215763 - RNA, 64 nt, hsa
gcaugggggagccuuuggccagaagagguauaaagcucagaaguuuuucagucugauaacuauu

SEQ ID NO: 215764 - RNA, 64 nt, hsa
uuacgacgugaucuaaaccaguccuuagcaaggggcucagaacaccccgcucuggcaguaggug

SEQ ID NO: 215765 - RNA, 64 nt, hsa
ugccgggccugggccuccugggaaggagggagcugcucagaaugccgcaugacaacugaaggca

SEQ ID NO: 215766 - RNA, 64 nt, hsa
agugagaugaggugggcuugaaaguaccuuguccgcucagaaggaccauucaagguucacuguu

SEQ ID NO: 215767 - RNA, 64 nt, hsa
cuccuggcuucuccuugucccuccugcagccucugcucagaacgcccuuccuccagacccugac

SEQ ID NO: 215768 - RNA, 64 nt, hsa
agugggaaaauccacaccacacucuaaguggacagcucagaauaauuuagcauauuuccuuuca

SEQ ID NO: 215769 - RNA, 64 nt, hsa
acagauucaccacaaauuuucaugggcguugagugcucagaauaaugcuugaacaccucaccuu

SEQ ID NO: 215770 - RNA, 64 nt, hsa
ggggcugggcguuugcucacgaccuugcugucucgcucagaacaugcuccgcaaaguucuccgc

SEQ ID NO: 215771 - RNA, 64 nt, hsa
gccacccacgggggcuccucccugccgggguccagcucagaaccacgggggucugugccggcag

SEQ ID NO: 215772 - RNA, 64 nt, hsa
ccucgagccauagagccugaaaucaucuuuguuggcucagaaaauaccuuagcuucacucagcu

SEQ ID NO: 215773 - RNA, 64 nt, hsa
guaggagucuuauaucccaggugaggaauuugaagcucagaaagguugaggggcuccccagagg

SEQ ID NO: 215774 - RNA, 64 nt, hsa
caaagacagcaagagagcugcagccugggcccgagcucagaaacagcugucgccucagucugcg

SEQ ID NO: 215775 - RNA, 64 nt, hsa
ugccugugccaggcaggccucaggugcaugccaugcucagaacccugcugcccuuucuaggcag

SEQ ID NO: 215776 - RNA, 64 nt, hsa; identical to SEQ ID NO: 126013

SEQ ID NO: 215777 - RNA, 64 nt, hsa; identical to SEQ ID NO: 126014

SEQ ID NO: 215778 - RNA, 64 nt, hsa; identical to SEQ ID NO: 126015

SEQ ID NO: 215779 - RNA, 64 nt, hsa; identical to SEQ ID NO: 126016

SEQ ID NO: 215780 - RNA, 64 nt, hsa; identical to SEQ ID NO: 126017

SEQ ID NO: 215781 - RNA, 64 nt, hsa; identical to SEQ ID NO: 126018

SEQ ID NO: 215782 - RNA, 64 nt, hsa; identical to SEQ ID NO: 126019

SEQ ID NO: 215783 - RNA, 64 nt, hsa; identical to SEQ ID NO: 126020

SEQ ID NO: 215784 - RNA, 64 nt, hsa; identical to SEQ ID NO: 126021

SEQ ID NO: 215785 - RNA, 64 nt, hsa; identical to SEQ ID NO: 126022

SEQ ID NO: 215786 - RNA, 64 nt, hsa; identical to SEQ ID NO: 126023

SEQ ID NO: 215787 - RNA, 64 nt, hsa; identical to SEQ ID NO: 126024

SEQ ID NO: 215788 - RNA, 64 nt, hsa; identical to SEQ ID NO: 126025

SEQ ID NO: 215789 - RNA, 64 nt, hsa; identical to SEQ ID NO: 126026

SEQ ID NO: 215790 - RNA, 64 nt, hsa; identical to SEQ ID NO: 126027

SEQ ID NO: 215791 - RNA, 64 nt, hsa; identical to SEQ ID NO: 126028

SEQ ID NO: 215792 - RNA, 64 nt, hsa; identical to SEQ ID NO: 126029

SEQ ID NO: 215793 - RNA, 64 nt, hsa; identical to SEQ ID NO: 126030

SEQ ID NO: 215794 - RNA, 61 nt, hsa; identical to SEQ ID NO: 126031

SEQ ID NO: 215795 - RNA, 64 nt, hsa; identical to SEQ ID NO: 126032

SEQ ID NO: 215796 - RNA, 64 nt, hsa; identical to SEQ ID NO: 126033

SEQ ID NO: 215797 - RNA, 64 nt, hsa; identical to SEQ ID NO: 126034

SEQ ID NO: 215798 - RNA, 64 nt, hsa; identical to SEQ ID NO: 126035

SEQ ID NO: 215799 - RNA, 64 nt, hsa; identical to SEQ ID NO: 126036

SEQ ID NO: 215800 - RNA, 64 nt, hsa; identical to SEQ ID NO: 126037

SEQ ID NO: 215801 - RNA, 64 nt, hsa; identical to SEQ ID NO: 126038

SEQ ID NO: 215802 - RNA, 64 nt, hsa
cuuaaguuggaaaaacuauuauuaauaauauuauccuauccauccauaucuauugaaauuguac

SEQ ID NO: 215803 - RNA, 64 nt, hsa
agaugcaagucugugcaaaacccaccaaaaugcuccuauccaacaauuauuuuuauuuucuccc

SEQ ID NO: 215804 - RNA, 64 nt, hsa; identical to SEQ ID NO: 152097

SEQ ID NO: 215805 - RNA, 64 nt, hsa; identical to SEQ ID NO: 152098

SEQ ID NO: 215806 - RNA, 64 nt, hsa; identical to SEQ ID NO: 152099

SEQ ID NO: 215807 - RNA, 64 nt, hsa; identical to SEQ ID NO: 152100

SEQ ID NO: 215808 - RNA, 64 nt, hsa; identical to SEQ ID NO: 152101

SEQ ID NO: 215809 - RNA, 64 nt, hsa; identical to SEQ ID NO: 152102

SEQ ID NO: 215810 - RNA, 64 nt, hsa; identical to SEQ ID NO: 152103

SEQ ID NO: 215811 - RNA, 64 nt, hsa; identical to SEQ ID NO: 152104

SEQ ID NO: 215812 - RNA, 64 nt, hsa; identical to SEQ ID NO: 152105

SEQ ID NO: 215813 - RNA, 64 nt, hsa; identical to SEQ ID NO: 152106

SEQ ID NO: 215814 - RNA, 64 nt, hsa; identical to SEQ ID NO: 152107

SEQ ID NO: 215815 - RNA, 64 nt, hsa; identical to SEQ ID NO: 152108

SEQ ID NO: 215816 - RNA, 64 nt, hsa; identical to SEQ ID NO: 152109

SEQ ID NO: 215817 - RNA, 64 nt, hsa; identical to SEQ ID NO: 152110

SEQ ID NO: 215818 - RNA, 64 nt, hsa; identical to SEQ ID NO: 152111

SEQ ID NO: 215819 - RNA, 64 nt, hsa; identical to SEQ ID NO: 152112

SEQ ID NO: 215820 - RNA, 64 nt, hsa; identical to SEQ ID NO: 152113

SEQ ID NO: 215821 - RNA, 64 nt, hsa; identical to SEQ ID NO: 152114

SEQ ID NO: 215822 - RNA, 64 nt, hsa; identical to SEQ ID NO: 152115

SEQ ID NO: 215823 - RNA, 64 nt, hsa; identical to SEQ ID NO: 152116

SEQ ID NO: 215824 - RNA, 64 nt, hsa; identical to SEQ ID NO: 152117

SEQ ID NO: 215825 - RNA, 64 nt, hsa; identical to SEQ ID NO: 152118

SEQ ID NO: 215826 - RNA, 64 nt, hsa; identical to SEQ ID NO: 152119

SEQ ID NO: 215827 - RNA, 64 nt, hsa; identical to SEQ ID NO: 152120

SEQ ID NO: 215828 - RNA, 64 nt, hsa; identical to SEQ ID NO: 152121

SEQ ID NO: 215829 - RNA, 64 nt, hsa; identical to SEQ ID NO: 152122

SEQ ID NO: 215830 - RNA, 64 nt, hsa; identical to SEQ ID NO: 152123

SEQ ID NO: 215831 - RNA, 63 nt, hsa; identical to SEQ ID NO: 152124

SEQ ID NO: 215832 - RNA, 64 nt, hsa; identical to SEQ ID NO: 152125

SEQ ID NO: 215833 - RNA, 64 nt, hsa; identical to SEQ ID NO: 152126

SEQ ID NO: 215834 - RNA, 64 nt, hsa; identical to SEQ ID NO: 152127

SEQ ID NO: 215835 - RNA, 64 nt, hsa; identical to SEQ ID NO: 152128

SEQ ID NO: 215836 - RNA, 64 nt, hsa; identical to SEQ ID NO: 152129

SEQ ID NO: 215837 - RNA, 64 nt, hsa; identical to SEQ ID NO: 152130

SEQ ID NO: 215838 - RNA, 64 nt, hsa; identical to SEQ ID NO: 152131

SEQ ID NO: 215839 - RNA, 64 nt, hsa; identical to SEQ ID NO: 152132

SEQ ID NO: 215840 - RNA, 64 nt, hsa; identical to SEQ ID NO: 152133

SEQ ID NO: 215841 - RNA, 64 nt, hsa; identical to SEQ ID NO: 152134

SEQ ID NO: 215842 - RNA, 64 nt, hsa; identical to SEQ ID NO: 152135

SEQ ID NO: 215843 - RNA, 64 nt, hsa; identical to SEQ ID NO: 152136

SEQ ID NO: 215844 - RNA, 64 nt, hsa; identical to SEQ ID NO: 152137

SEQ ID NO: 215845 - RNA, 64 nt, hsa; identical to SEQ ID NO: 152138

SEQ ID NO: 215846 - RNA, 64 nt, hsa; identical to SEQ ID NO: 152139

SEQ ID NO: 215847 - RNA, 64 nt, hsa; identical to SEQ ID NO: 152140

SEQ ID NO: 215848 - RNA, 64 nt, hsa; identical to SEQ ID NO: 152141

SEQ ID NO: 215849 - RNA, 64 nt, hsa; identical to SEQ ID NO: 152142

SEQ ID NO: 215850 - RNA, 64 nt, hsa; identical to SEQ ID NO: 152143

SEQ ID NO: 215851 - RNA, 64 nt, hsa; identical to SEQ ID NO: 152144

SEQ ID NO: 215852 - RNA, 64 nt, hsa; identical to SEQ ID NO: 152145

SEQ ID NO: 215853 - RNA, 64 nt, hsa; identical to SEQ ID NO: 152146

SEQ ID NO: 215854 - RNA, 64 nt, hsa; identical to SEQ ID NO: 152147

SEQ ID NO: 215855 - RNA, 64 nt, hsa; identical to SEQ ID NO: 152148

SEQ ID NO: 215856 - RNA, 64 nt, hsa; identical to SEQ ID NO: 152149

SEQ ID NO: 215857 - RNA, 61 nt, hsa; identical to SEQ ID NO: 152150

SEQ ID NO: 215858 - RNA, 64 nt, hsa; identical to SEQ ID NO: 152151

SEQ ID NO: 215859 - RNA, 64 nt, hsa; identical to SEQ ID NO: 152152

SEQ ID NO: 215860 - RNA, 64 nt, hsa; identical to SEQ ID NO: 152153

SEQ ID NO: 215861 - RNA, 64 nt, hsa; identical to SEQ ID NO: 152154

SEQ ID NO: 215862 - RNA, 64 nt, hsa; identical to SEQ ID NO: 152155

SEQ ID NO: 215863 - RNA, 64 nt, hsa; identical to SEQ ID NO: 152156

SEQ ID NO: 215864 - RNA, 64 nt, hsa; identical to SEQ ID NO: 152157

SEQ ID NO: 215865 - RNA, 64 nt, hsa; identical to SEQ ID NO: 152158

SEQ ID NO: 215866 - RNA, 64 nt, hsa; identical to SEQ ID NO: 152159

SEQ ID NO: 215867 - RNA, 64 nt, hsa; identical to SEQ ID NO: 152160

SEQ ID NO: 215868 - RNA, 64 nt, hsa; identical to SEQ ID NO: 152161

SEQ ID NO: 215869 - RNA, 64 nt, hsa; identical to SEQ ID NO: 152162

SEQ ID NO: 215870 - RNA, 64 nt, hsa; identical to SEQ ID NO: 152163

SEQ ID NO: 215871 - RNA, 64 nt, hsa; identical to SEQ ID NO: 152164

SEQ ID NO: 215872 - RNA, 64 nt, hsa; identical to SEQ ID NO: 152165

SEQ ID NO: 215873 - RNA, 64 nt, hsa; identical to SEQ ID NO: 210199

SEQ ID NO: 215874 - RNA, 64 nt, hsa; identical to SEQ ID NO: 210200

SEQ ID NO: 215875 - RNA, 64 nt, hsa; identical to SEQ ID NO: 210201

SEQ ID NO: 215876 - RNA, 64 nt, hsa; identical to SEQ ID NO: 210202

SEQ ID NO: 215877 - RNA, 64 nt, hsa; identical to SEQ ID NO: 210203

SEQ ID NO: 215878 - RNA, 64 nt, hsa; identical to SEQ ID NO: 210204

SEQ ID NO: 215879 - RNA, 64 nt, hsa; identical to SEQ ID NO: 210205

SEQ ID NO: 215880 - RNA, 64 nt, hsa; identical to SEQ ID NO: 210206

SEQ ID NO: 215881 - RNA, 64 nt, hsa; identical to SEQ ID NO: 210207

SEQ ID NO: 215882 - RNA, 64 nt, hsa; identical to SEQ ID NO: 210208

SEQ ID NO: 215883 - RNA, 64 nt, hsa; identical to SEQ ID NO: 210209

SEQ ID NO: 215884 - RNA, 64 nt, hsa; identical to SEQ ID NO: 210210

SEQ ID NO: 215885 - RNA, 64 nt, hsa; identical to SEQ ID NO: 210211

SEQ ID NO: 215886 - RNA, 60 nt, hsa; identical to SEQ ID NO: 44968

SEQ ID NO: 215887 - RNA, 64 nt, hsa; identical to SEQ ID NO: 210213

SEQ ID NO: 215888 - RNA, 64 nt, hsa; identical to SEQ ID NO: 210214

SEQ ID NO: 215889 - RNA, 64 nt, hsa; identical to SEQ ID NO: 210215

SEQ ID NO: 215890 - RNA, 64 nt, hsa; identical to SEQ ID NO: 210216

SEQ ID NO: 215891 - RNA, 64 nt, hsa
ccugaggcaggcagccgaccugaggccugggggcaccguggaccccuaugcccgggucagcguc

SEQ ID NO: 215892 - RNA, 64 nt, hsa
ugagccccugggugagcuccgucugccacugggcaccguggaucugcagcauguucuggagcac

SEQ ID NO: 215893 - RNA, 64 nt, hsa; identical to SEQ ID NO: 155629

SEQ ID NO: 215894 - RNA, 64 nt, hsa; identical to SEQ ID NO: 155630

SEQ ID NO: 215895 - RNA, 64 nt, hsa; identical to SEQ ID NO: 155631

SEQ ID NO: 215896 - RNA, 64 nt, hsa; identical to SEQ ID NO: 155632

SEQ ID NO: 215897 - RNA, 64 nt, hsa; identical to SEQ ID NO: 155633

SEQ ID NO: 215898 - RNA, 64 nt, hsa; identical to SEQ ID NO: 155634

SEQ ID NO: 215899 - RNA, 64 nt, hsa; identical to SEQ ID NO: 155635

SEQ ID NO: 215900 - RNA, 64 nt, hsa; identical to SEQ ID NO: 155636

SEQ ID NO: 215901 - RNA, 64 nt, hsa; identical to SEQ ID NO: 155637

SEQ ID NO: 215902 - RNA, 64 nt, hsa; identical to SEQ ID NO: 155638

SEQ ID NO: 215903 - RNA, 64 nt, hsa; identical to SEQ ID NO: 155639

SEQ ID NO: 215904 - RNA, 64 nt, hsa; identical to SEQ ID NO: 155640

SEQ ID NO: 215905 - RNA, 64 nt, hsa; identical to SEQ ID NO: 155641

SEQ ID NO: 215906 - RNA, 64 nt, hsa; identical to SEQ ID NO: 155642

SEQ ID NO: 215907 - RNA, 64 nt, hsa; identical to SEQ ID NO: 155643

SEQ ID NO: 215908 - RNA, 64 nt, hsa; identical to SEQ ID NO: 155644

SEQ ID NO: 215909 - RNA, 64 nt, hsa; identical to SEQ ID NO: 155645

SEQ ID NO: 215910 - RNA, 64 nt, hsa; identical to SEQ ID NO: 155646

SEQ ID NO: 215911 - RNA, 64 nt, hsa; identical to SEQ ID NO: 155647

SEQ ID NO: 215912 - RNA, 64 nt, hsa; identical to SEQ ID NO: 155648

SEQ ID NO: 215913 - RNA, 64 nt, hsa; identical to SEQ ID NO: 155649

SEQ ID NO: 215914 - RNA, 64 nt, hsa; identical to SEQ ID NO: 155650

SEQ ID NO: 215915 - RNA, 64 nt, hsa; identical to SEQ ID NO: 155651

SEQ ID NO: 215916 - RNA, 64 nt, hsa; identical to SEQ ID NO: 155652

SEQ ID NO: 215917 - RNA, 64 nt, hsa; identical to SEQ ID NO: 155653

SEQ ID NO: 215918 - RNA, 64 nt, hsa; identical to SEQ ID NO: 155654

SEQ ID NO: 215919 - RNA, 64 nt, hsa; identical to SEQ ID NO: 155655

SEQ ID NO: 215920 - RNA, 64 nt, hsa; identical to SEQ ID NO: 155656

SEQ ID NO: 215921 - RNA, 64 nt, hsa; identical to SEQ ID NO: 155657

SEQ ID NO: 215922 - RNA, 64 nt, hsa; identical to SEQ ID NO: 155658

SEQ ID NO: 215923 - RNA, 64 nt, hsa; identical to SEQ ID NO: 155659

SEQ ID NO: 215924 - RNA, 64 nt, hsa; identical to SEQ ID NO: 155660

SEQ ID NO: 215925 - RNA, 64 nt, hsa; identical to SEQ ID NO: 155661

SEQ ID NO: 215926 - RNA, 64 nt, hsa; identical to SEQ ID NO: 155662

SEQ ID NO: 215927 - RNA, 64 nt, hsa; identical to SEQ ID NO: 155663

SEQ ID NO: 215928 - RNA, 64 nt, hsa; identical to SEQ ID NO: 155664

SEQ ID NO: 215929 - RNA, 64 nt, hsa; identical to SEQ ID NO: 155665

SEQ ID NO: 215930 - RNA, 64 nt, hsa; identical to SEQ ID NO: 155666

SEQ ID NO: 215931 - RNA, 64 nt, hsa; identical to SEQ ID NO: 155667

SEQ ID NO: 215932 - RNA, 64 nt, hsa; identical to SEQ ID NO: 155668

SEQ ID NO: 215933 - RNA, 64 nt, hsa; identical to SEQ ID NO: 155669

SEQ ID NO: 215934 - RNA, 64 nt, hsa; identical to SEQ ID NO: 155670

SEQ ID NO: 215935 - RNA, 64 nt, hsa; identical to SEQ ID NO: 155671

SEQ ID NO: 215936 - RNA, 64 nt, hsa; identical to SEQ ID NO: 155672

SEQ ID NO: 215937 - RNA, 64 nt, hsa; identical to SEQ ID NO: 155673

SEQ ID NO: 215938 - RNA, 64 nt, hsa; identical to SEQ ID NO: 155674

SEQ ID NO: 215939 - RNA, 64 nt, hsa; identical to SEQ ID NO: 155675

SEQ ID NO: 215940 - RNA, 64 nt, hsa; identical to SEQ ID NO: 155676

SEQ ID NO: 215941 - RNA, 64 nt, hsa; identical to SEQ ID NO: 155677

SEQ ID NO: 215942 - RNA, 64 nt, hsa; identical to SEQ ID NO: 155678

SEQ ID NO: 215943 - RNA, 64 nt, hsa; identical to SEQ ID NO: 155679

SEQ ID NO: 215944 - RNA, 64 nt, hsa; identical to SEQ ID NO: 155680

SEQ ID NO: 215945 - RNA, 64 nt, hsa; identical to SEQ ID NO: 155681

SEQ ID NO: 215946 - RNA, 64 nt, hsa; identical to SEQ ID NO: 155682

SEQ ID NO: 215947 - RNA, 64 nt, hsa; identical to SEQ ID NO: 155683

SEQ ID NO: 215948 - RNA, 64 nt, hsa; identical to SEQ ID NO: 155684

SEQ ID NO: 215949 - RNA, 64 nt, hsa; identical to SEQ ID NO: 155685

SEQ ID NO: 215950 - RNA, 64 nt, hsa; identical to SEQ ID NO: 155686

SEQ ID NO: 215951 - RNA, 64 nt, hsa; identical to SEQ ID NO: 155687

SEQ ID NO: 215952 - RNA, 64 nt, hsa; identical to SEQ ID NO: 155688

SEQ ID NO: 215953 - RNA, 64 nt, hsa; identical to SEQ ID NO: 155689

SEQ ID NO: 215954 - RNA, 64 nt, hsa; identical to SEQ ID NO: 155690

SEQ ID NO: 215955 - RNA, 64 nt, hsa; identical to SEQ ID NO: 155691

SEQ ID NO: 215956 - RNA, 64 nt, hsa; identical to SEQ ID NO: 155692

SEQ ID NO: 215957 - RNA, 64 nt, hsa; identical to SEQ ID NO: 155693

SEQ ID NO: 215958 - RNA, 64 nt, hsa; identical to SEQ ID NO: 155694

SEQ ID NO: 215959 - RNA, 64 nt, hsa; identical to SEQ ID NO: 155695

SEQ ID NO: 215960 - RNA, 64 nt, hsa; identical to SEQ ID NO: 155696

SEQ ID NO: 215961 - RNA, 64 nt, hsa; identical to SEQ ID NO: 155697

SEQ ID NO: 215962 - RNA, 64 nt, hsa; identical to SEQ ID NO: 155698

SEQ ID NO: 215963 - RNA, 64 nt, hsa; identical to SEQ ID NO: 155699

SEQ ID NO: 215964 - RNA, 64 nt, hsa; identical to SEQ ID NO: 155700

SEQ ID NO: 215965 - RNA, 64 nt, hsa; identical to SEQ ID NO: 155701

SEQ ID NO: 215966 - RNA, 64 nt, hsa; identical to SEQ ID NO: 155702

SEQ ID NO: 215967 - RNA, 64 nt, hsa; identical to SEQ ID NO: 155703

SEQ ID NO: 215968 - RNA, 64 nt, hsa; identical to SEQ ID NO: 155704

SEQ ID NO: 215969 - RNA, 64 nt, hsa; identical to SEQ ID NO: 155705

SEQ ID NO: 215970 - RNA, 64 nt, hsa; identical to SEQ ID NO: 155706

SEQ ID NO: 215971 - RNA, 64 nt, hsa; identical to SEQ ID NO: 155707

SEQ ID NO: 215972 - RNA, 64 nt, hsa; identical to SEQ ID NO: 155708

SEQ ID NO: 215973 - RNA, 64 nt, hsa; identical to SEQ ID NO: 155709

SEQ ID NO: 215974 - RNA, 64 nt, hsa; identical to SEQ ID NO: 155710

SEQ ID NO: 215975 - RNA, 64 nt, hsa; identical to SEQ ID NO: 155711

SEQ ID NO: 215976 - RNA, 64 nt, hsa; identical to SEQ ID NO: 155712

SEQ ID NO: 215977 - RNA, 64 nt, hsa; identical to SEQ ID NO: 155713

SEQ ID NO: 215978 - RNA, 64 nt, hsa; identical to SEQ ID NO: 155714

SEQ ID NO: 215979 - RNA, 64 nt, hsa; identical to SEQ ID NO: 155715

SEQ ID NO: 215980 - RNA, 64 nt, hsa; identical to SEQ ID NO: 155716

SEQ ID NO: 215981 - RNA, 64 nt, hsa; identical to SEQ ID NO: 155717

SEQ ID NO: 215982 - RNA, 64 nt, hsa; identical to SEQ ID NO: 155718

SEQ ID NO: 215983 - RNA, 64 nt, hsa; identical to SEQ ID NO: 155719

SEQ ID NO: 215984 - RNA, 64 nt, hsa; identical to SEQ ID NO: 155720

SEQ ID NO: 215985 - RNA, 64 nt, hsa; identical to SEQ ID NO: 155721

SEQ ID NO: 215986 - RNA, 64 nt, hsa; identical to SEQ ID NO: 155722

SEQ ID NO: 215987 - RNA, 64 nt, hsa; identical to SEQ ID NO: 155723

SEQ ID NO: 215988 - RNA, 64 nt, hsa; identical to SEQ ID NO: 155724

SEQ ID NO: 215989 - RNA, 64 nt, hsa; identical to SEQ ID NO: 155725

SEQ ID NO: 215990 - RNA, 64 nt, hsa; identical to SEQ ID NO: 155726

SEQ ID NO: 215991 - RNA, 64 nt, hsa; identical to SEQ ID NO: 155727

SEQ ID NO: 215992 - RNA, 64 nt, hsa; identical to SEQ ID NO: 155728

SEQ ID NO: 215993 - RNA, 64 nt, hsa; identical to SEQ ID NO: 155729

SEQ ID NO: 215994 - RNA, 58 nt, hsa; identical to SEQ ID NO: 155730

SEQ ID NO: 215995 - RNA, 64 nt, hsa; identical to SEQ ID NO: 155731

SEQ ID NO: 215996 - RNA, 64 nt, hsa; identical to SEQ ID NO: 155732

SEQ ID NO: 215997 - RNA, 64 nt, hsa; identical to SEQ ID NO: 155733

SEQ ID NO: 215998 - RNA, 64 nt, hsa; identical to SEQ ID NO: 155734

SEQ ID NO: 215999 - RNA, 64 nt, hsa; identical to SEQ ID NO: 155735

SEQ ID NO: 216000 - RNA, 64 nt, hsa; identical to SEQ ID NO: 155736

SEQ ID NO: 216001 - RNA, 64 nt, hsa; identical to SEQ ID NO: 155737

SEQ ID NO: 216002 - RNA, 64 nt, hsa; identical to SEQ ID NO: 155738

SEQ ID NO: 216003 - RNA, 64 nt, hsa; identical to SEQ ID NO: 155739

SEQ ID NO: 216004 - RNA, 64 nt, hsa; identical to SEQ ID NO: 155740

SEQ ID NO: 216005 - RNA, 64 nt, hsa; identical to SEQ ID NO: 155741

SEQ ID NO: 216006 - RNA, 64 nt, hsa; identical to SEQ ID NO: 155742

SEQ ID NO: 216007 - RNA, 64 nt, hsa; identical to SEQ ID NO: 155743

SEQ ID NO: 216008 - RNA, 64 nt, hsa; identical to SEQ ID NO: 155744

SEQ ID NO: 216009 - RNA, 64 nt, hsa; identical to SEQ ID NO: 155745

SEQ ID NO: 216010 - RNA, 64 nt, hsa; identical to SEQ ID NO: 155746

SEQ ID NO: 216011 - RNA, 64 nt, hsa; identical to SEQ ID NO: 155747

SEQ ID NO: 216012 - RNA, 64 nt, hsa; identical to SEQ ID NO: 155748

SEQ ID NO: 216013 - RNA, 64 nt, hsa; identical to SEQ ID NO: 155749

SEQ ID NO: 216014 - RNA, 64 nt, hsa; identical to SEQ ID NO: 155750

SEQ ID NO: 216015 - RNA, 64 nt, hsa; identical to SEQ ID NO: 155751

SEQ ID NO: 216016 - RNA, 64 nt, hsa; identical to SEQ ID NO: 155752

SEQ ID NO: 216017 - RNA, 64 nt, hsa; identical to SEQ ID NO: 155753

SEQ ID NO: 216018 - RNA, 63 nt, hsa; identical to SEQ ID NO: 155754

SEQ ID NO: 216019 - RNA, 64 nt, hsa; identical to SEQ ID NO: 155755

SEQ ID NO: 216020 - RNA, 64 nt, hsa; identical to SEQ ID NO: 155756

SEQ ID NO: 216021 - RNA, 64 nt, hsa; identical to SEQ ID NO: 155757

SEQ ID NO: 216022 - RNA, 64 nt, hsa; identical to SEQ ID NO: 155758

SEQ ID NO: 216023 - RNA, 64 nt, hsa; identical to SEQ ID NO: 155759

SEQ ID NO: 216024 - RNA, 64 nt, hsa; identical to SEQ ID NO: 155760

SEQ ID NO: 216025 - RNA, 64 nt, hsa; identical to SEQ ID NO: 155761

SEQ ID NO: 216026 - RNA, 64 nt, hsa; identical to SEQ ID NO: 155762

SEQ ID NO: 216027 - RNA, 64 nt, hsa; identical to SEQ ID NO: 155763

SEQ ID NO: 216028 - RNA, 64 nt, hsa; identical to SEQ ID NO: 155764

SEQ ID NO: 216029 - RNA, 64 nt, hsa; identical to SEQ ID NO: 155765

SEQ ID NO: 216030 - RNA, 64 nt, hsa; identical to SEQ ID NO: 155766

SEQ ID NO: 216031 - RNA, 64 nt, hsa; identical to SEQ ID NO: 155767

SEQ ID NO: 216032 - RNA, 64 nt, hsa; identical to SEQ ID NO: 155768

SEQ ID NO: 216033 - RNA, 64 nt, hsa; identical to SEQ ID NO: 155769

SEQ ID NO: 216034 - RNA, 64 nt, hsa; identical to SEQ ID NO: 155770

SEQ ID NO: 216035 - RNA, 64 nt, hsa; identical to SEQ ID NO: 155771

SEQ ID NO: 216036 - RNA, 64 nt, hsa; identical to SEQ ID NO: 155772

SEQ ID NO: 216037 - RNA, 64 nt, hsa; identical to SEQ ID NO: 155773

SEQ ID NO: 216038 - RNA, 64 nt, hsa; identical to SEQ ID NO: 155774

SEQ ID NO: 216039 - RNA, 64 nt, hsa; identical to SEQ ID NO: 155775

SEQ ID NO: 216040 - RNA, 64 nt, hsa; identical to SEQ ID NO: 155776

SEQ ID NO: 216041 - RNA, 64 nt, hsa; identical to SEQ ID NO: 155777

SEQ ID NO: 216042 - RNA, 64 nt, hsa; identical to SEQ ID NO: 155778

SEQ ID NO: 216043 - RNA, 64 nt, hsa; identical to SEQ ID NO: 155779

SEQ ID NO: 216044 - RNA, 64 nt, hsa; identical to SEQ ID NO: 155780

SEQ ID NO: 216045 - RNA, 64 nt, hsa; identical to SEQ ID NO: 155781

SEQ ID NO: 216046 - RNA, 64 nt, hsa; identical to SEQ ID NO: 155782

SEQ ID NO: 216047 - RNA, 64 nt, hsa; identical to SEQ ID NO: 155783

SEQ ID NO: 216048 - RNA, 64 nt, hsa; identical to SEQ ID NO: 155784

SEQ ID NO: 216049 - RNA, 64 nt, hsa; identical to SEQ ID NO: 155785

SEQ ID NO: 216050 - RNA, 64 nt, hsa; identical to SEQ ID NO: 155786

SEQ ID NO: 216051 - RNA, 53 nt, hsa; identical to SEQ ID NO: 155787

SEQ ID NO: 216052 - RNA, 64 nt, hsa; identical to SEQ ID NO: 155788

SEQ ID NO: 216053 - RNA, 64 nt, hsa; identical to SEQ ID NO: 155789

SEQ ID NO: 216054 - RNA, 64 nt, hsa; identical to SEQ ID NO: 155790

SEQ ID NO: 216055 - RNA, 64 nt, hsa; identical to SEQ ID NO: 155791

SEQ ID NO: 216056 - RNA, 64 nt, hsa; identical to SEQ ID NO: 155792

SEQ ID NO: 216057 - RNA, 64 nt, hsa; identical to SEQ ID NO: 155793

SEQ ID NO: 216058 - RNA, 64 nt, hsa; identical to SEQ ID NO: 155794

SEQ ID NO: 216059 - RNA, 64 nt, hsa; identical to SEQ ID NO: 155795

SEQ ID NO: 216060 - RNA, 64 nt, hsa; identical to SEQ ID NO: 155796

SEQ ID NO: 216061 - RNA, 64 nt, hsa; identical to SEQ ID NO: 155797

SEQ ID NO: 216062 - RNA, 64 nt, hsa; identical to SEQ ID NO: 155798

SEQ ID NO: 216063 - RNA, 64 nt, hsa; identical to SEQ ID NO: 155799

SEQ ID NO: 216064 - RNA, 64 nt, hsa; identical to SEQ ID NO: 155800

SEQ ID NO: 216065 - RNA, 64 nt, hsa; identical to SEQ ID NO: 155801

SEQ ID NO: 216066 - RNA, 64 nt, hsa; identical to SEQ ID NO: 155802

SEQ ID NO: 216067 - RNA, 64 nt, hsa; identical to SEQ ID NO: 155803

SEQ ID NO: 216068 - RNA, 64 nt, hsa; identical to SEQ ID NO: 155804

SEQ ID NO: 216069 - RNA, 64 nt, hsa; identical to SEQ ID NO: 155805

SEQ ID NO: 216070 - RNA, 64 nt, hsa; identical to SEQ ID NO: 155806

SEQ ID NO: 216071 - RNA, 64 nt, hsa; identical to SEQ ID NO: 155807

SEQ ID NO: 216072 - RNA, 64 nt, hsa; identical to SEQ ID NO: 155808

SEQ ID NO: 216073 - RNA, 64 nt, hsa
uaagcuugggcgugugcaggaguuugacaguggccugcugcacuggcggauuggugggggggac

SEQ ID NO: 216074 - RNA, 64 nt, hsa
cccagggcugcugcucauccugggcaagcugauccugcugcaccacaagcacccagaacggaag

SEQ ID NO: 216075 - RNA, 64 nt, hsa
gaaaaaugucucuuuuuccugugccauuugccuucugcugcaacgaaaauauuuccugauucaa

SEQ ID NO: 216076 - RNA, 64 nt, hsa
uuugguaccucuaguagauaguguguucauuucccugcugcaaauuuugaaguauuugggcagg

SEQ ID NO: 216077 - RNA, 64 nt, hsa
ccugccaaggcugaaucccugggcccagucagcccugcugcacauggcacaggcauugcacacg

SEQ ID NO: 216078 - RNA, 64 nt, hsa
ccugcaagggcugaguucccaggcccugccagcccugcugcacagggugcaggcauugcacacg

SEQ ID NO: 216079 - RNA, 64 nt, hsa
aagcaaaauugguuaaucuacaccuuaacucuggcugcugcaauugaaaacuuucuuucuaaua

SEQ ID NO: 216080 - RNA, 64 nt, hsa
accuuuccuuaucaaauagaauaucacugauauacugcugcaugaauaagaaccauuauguggg

SEQ ID NO: 216081 - RNA, 64 nt, hsa
uuacguaugcagacuagucuuauuuuuuuaauuccugcugcacuaaagcuauuacaaauauaac

SEQ ID NO: 216082 - RNA, 64 nt, hsa
cuaaaguauugcuuuagaauaguuguuccacuuucugcugcaguauugcuuugccaucuucugc

SEQ ID NO: 216083 - RNA, 64 nt, hsa
ccugguggggcugaugucacagguguuuacugugcugcugcacugguccuaugccagccucacc

SEQ ID NO: 216084 - RNA, 64 nt, hsa
ggcuuggugguuauugucuucaaggagcucuucgcugcugcaucugcggugucccuuuguucuu

SEQ ID NO: 216085 - RNA, 64 nt, hsa
gacauaaagaacuaaaggccgaaagaaucucuugcugcugcaaagaacagauuuuauauuucuu

SEQ ID NO: 216086 - RNA, 64 nt, hsa
gaguccaaucccaccuccugguguagaauuuacacugcugcaccugaggucgauguuucaaagu

SEQ ID NO: 216087 - RNA, 64 nt, hsa
cugcccugggcugggugcccgaggggcucauaugcugcugcagaaugagcucuuccugaacgug

SEQ ID NO: 216088 - RNA, 64 nt, hsa
ccugugcccagccugugcgugucaaccccaccgacugcugcaaacaguguccaggugagagagg

SEQ ID NO: 216089 - RNA, 64 nt, hsa
cgagacugagccuccugcagacgggcgaagccgccugcugcagcccaggaagccagcccucugc

SEQ ID NO: 216090 - RNA, 64 nt, hsa
gaagccagcccucugcucggccucgccggccucccugcugcaggccucccucucuucaccgccu

SEQ ID NO: 216091 - RNA, 64 nt, hsa
gagggccugacuguccugcucacccacagccgaucugcugcaggucagcaacugugucgugagc

SEQ ID NO: 216092 - RNA, 64 nt, hsa
cuggaguccaccagccugccccauggccccggcucugcugcacuugguauuucccugacagaga

SEQ ID NO: 216093 - RNA, 64 nt, hsa
gucccgugcaugcuccuuuucccagaacuccucucugcugcacccacagcaucuguucccgagg

SEQ ID NO: 216094 - RNA, 64 nt, hsa
ugucuguauuaaacauggcguuauuuaaguaguccugcugcaagaaaggcacuucagugaauau

SEQ ID NO: 216095 - RNA, 64 nt, hsa
gcaccaaaaggcaaaugguacuguccacagugcacugcugcaaugaagagaagaggcagcagac

SEQ ID NO: 216096 - RNA, 64 nt, hsa
uuaaggaaaguauuuuauauucaacagguauauucugcugcauguacuguacuccagagcuguu

SEQ ID NO: 216097 - RNA, 64 nt, hsa
ucaucaccugcugucugcuuagaagaacggcuuucugcugcaauggagagaaaucauaacagac

SEQ ID NO: 216098 - RNA, 64 nt, hsa
agacaauuguucaaaagaugcaaaugauacacuacugcugcagcucacaaacaccucugcauau

SEQ ID NO: 216099 - RNA, 64 nt, hsa
caucuugccagcccaccagcagccccacucacagcugcugcaccaccaccuuccgcaggaugca

SEQ ID NO: 216100 - RNA, 64 nt, hsa
agcacccccaaacuuaccucagggggugccuccccugcugcacaaccaguaccucguagguccc

SEQ ID NO: 216101 - RNA, 64 nt, hsa
acaaugcagggcuccucauugcucccaucugccucugcugcacacacaggcaccagcagggaug

SEQ ID NO: 216102 - RNA, 64 nt, hsa
acucucucuugcucgggaccugccugagggcucccugcugcaguucgccguacuuccaucugcu

SEQ ID NO: 216103 - RNA, 64 nt, hsa
gcaacacugugucccuucgccccaccguucuucucugcugcauuuggacaucagccaaauuuga

SEQ ID NO: 216104 - RNA, 64 nt, hsa
ccagcagaucugaccacuguucuccagcaggccucugcugcagcuuuuucucucaguguucugg

SEQ ID NO: 216105 - RNA, 64 nt, hsa
aggcuaaagaaucccgaaggcaucgaggccauuucugcugcaacaagguuuccugucucuucac

SEQ ID NO: 216106 - RNA, 64 nt, hsa
gcccccuucugagaugcagccagaagcucugugccugcugcaaagauucagguggacccuccuc

SEQ ID NO: 216107 - RNA, 64 nt, hsa
agguguauauaaacguccucugugcuggguguuucugcugcagguggcagguggccccaggccu

SEQ ID NO: 216108 - RNA, 64 nt, hsa
gaucaccaggugcaggcccccacccucggagaugcugcugcagugagugguuccacugccugga

SEQ ID NO: 216109 - RNA, 64 nt, hsa
agcucccccgggaggggcccgcuugccucggcuccugcugcaccaacccagccgcugcccggcg

SEQ ID NO: 216110 - RNA, 64 nt, hsa
ggauccgacuugaauuuucccacugcacccccuccugcugcagaggggcaggcccugcacuguc

SEQ ID NO: 216111 - RNA, 64 nt, hsa
gagcacauggguuauaaugagaaacugaacuguacugcugcauuuccugucuuccuuccuaggu

SEQ ID NO: 216112 - RNA, 64 nt, hsa
ggcccugugagggcugggacuaagucacagggaucugcugcagccacagcuccuccagaaaggg

SEQ ID NO: 216113 - RNA, 64 nt, hsa
ccccucccagcugguggugcugcccuaucagaugcugcugcaugcggccacucggcaggccgcg

SEQ ID NO: 216114 - RNA, 64 nt, hsa
guucuuuccccagcucugccaggcccauucccagcugcugcaguacguggagcgauacggguga

SEQ ID NO: 216115 - RNA, 64 nt, hsa
gaccaaagcccaggauggcuuggugggagugucccugcugcaucugcaugaagccccugcuuuu

SEQ ID NO: 216116 - RNA, 64 nt, hsa
ggcacacaccuuucugaaauccuucuccagccagcugcugcagacaaaagaucacauuucuggg

SEQ ID NO: 216117 - RNA, 64 nt, hsa
cacugcagaguugaggccucauaucucaccugcacugcugcaacagcuuacuggucccuugcuc

SEQ ID NO: 216118 - RNA, 64 nt, hsa
gauacucauccuguucccccuagagcugcucuuccugcugcauucucucucucaauuacuggga

SEQ ID NO: 216119 - RNA, 64 nt, hsa
gcugaagccaccccugcugaugaugagcaagugccugcugcagguccaaacacagcauccaggg

SEQ ID NO: 216120 - RNA, 64 nt, hsa
aauccacugcuuuucaggcaaggagggagaaauccugcugcacacuggcuuugucccggagucg

SEQ ID NO: 216121 - RNA, 64 nt, hsa
cugccacagaccgucucagacacgcacagugggccugcugcaugauucacacccagucccugcc

SEQ ID NO: 216122 - RNA, 64 nt, hsa; identical to SEQ ID NO: 216121

SEQ ID NO: 216123 - RNA, 64 nt, hsa
cugccacagaccgucucagacacgcacagugggccugcugcaugcguguuaccuggcuuuuggc

SEQ ID NO: 216124 - RNA, 64 nt, hsa
ggaggagagguccacuucccuuagaacaccugagcugcugcaugaguggacgucagaagaaucu

SEQ ID NO: 216125 - RNA, 64 nt, hsa
uaugaagaaaacagcugcauggcacauaccaaagcugcugcacagcuggccaccauggcacccu

SEQ ID NO: 216126 - RNA, 64 nt, hsa
ccuagauggcacuuggugacacacacuccccucucugcugcagcggauuucggccuggcccggg

SEQ ID NO: 216127 - RNA, 64 nt, hsa
caaguucccauggcugucggaggccgggcugcgccugcugcacuuccuguucauguacgacccu

SEQ ID NO: 216128 - RNA, 64 nt, hsa
agggguccuggggagagagaauuuauccagaggccugcugcagauggggaagagcuggaaacca

SEQ ID NO: 216129 - RNA, 64 nt, hsa
cagaggaccccuacuccaugcaggacagggucuccugcugcaagucccaacuuugaauaaaaca

SEQ ID NO: 216130 - RNA, 64 nt, hsa
uggacaggugucugagaugggcccguacccagcccugcugcagcgcaacggcuccuuugccaac

SEQ ID NO: 216131 - RNA, 64 nt, hsa
uggcauccaggcugcccguguguugcaccaggcacugcugcacaacaagauacgcucgccacag

SEQ ID NO: 216132 - RNA, 64 nt, hsa
ccuccugcuguggcuucagcugcugcaggcucuccugcugcaucuccaguugcugccgccccaa

SEQ ID NO: 216133 - RNA, 64 nt, hsa
cuagcagcaguagcuccuccugcuguggcuucagcugcugcaggcucuccugcugcaucuccag

SEQ ID NO: 216134 - RNA, 64 nt, hsa
ccgugcgcuccucaccccucuacagacaggggcgcugcugcagaugcuccaggcccaccuuggu

SEQ ID NO: 216135 - RNA, 64 nt, hsa
ccccgugguguccccuggcccuccccccaccccucugcugcaggaggcguggccaccaccagau

SEQ ID NO: 216136 - RNA, 64 nt, hsa
ccaggagaacagggauuucuaucaaugucauucacugcugcauccccagugccuagaacagggc

SEQ ID NO: 216137 - RNA, 64 nt, hsa
agggcagcauccacccugcagcgccaaugaggaucugcugcaccugcucacggugagccccccu

SEQ ID NO: 216138 - RNA, 64 nt, hsa
uuuccaggacaucuccaucaagaggcugcagcggcugcugcaggcccucgaggccccggagggc

SEQ ID NO: 216139 - RNA, 64 nt, hsa
ccugggggcgcaggacggggcgcugcuggugcggcugcugcaggcgcugcgcguggccaggaug

SEQ ID NO: 216140 - RNA, 64 nt, hsa
uuagagacugugccuucagcaggacucuuaauaucugcugcaacuuggagaaccucccugcccu

SEQ ID NO: 216141 - RNA, 64 nt, hsa
uaauagaguggccucuuucgcucuucgauuaugacugcugcaguuuuaccccagcagucagcug

SEQ ID NO: 216142 - RNA, 64 nt, hsa
uauagaauaaaccuuuuauuuaaguugugauuaccugcugcaugaaaagugcaugggggacccu

SEQ ID NO: 216143 - RNA, 64 nt, hsa
aucaguaagguagcauucauuaccuguuuauucucugcugcaucuuacagaagaguaaacuggu

SEQ ID NO: 216144 - RNA, 64 nt, hsa; identical to SEQ ID NO: 107841

SEQ ID NO: 216145 - RNA, 64 nt, hsa; identical to SEQ ID NO: 107842

SEQ ID NO: 216146 - RNA, 64 nt, hsa; identical to SEQ ID NO: 107843

SEQ ID NO: 216147 - RNA, 64 nt, hsa; identical to SEQ ID NO: 107844

SEQ ID NO: 216148 - RNA, 64 nt, hsa; identical to SEQ ID NO: 107845

SEQ ID NO: 216149 - RNA, 64 nt, hsa; identical to SEQ ID NO: 107846

SEQ ID NO: 216150 - RNA, 64 nt, hsa; identical to SEQ ID NO: 107847

SEQ ID NO: 216151 - RNA, 64 nt, hsa; identical to SEQ ID NO: 107848

SEQ ID NO: 216152 - RNA, 64 nt, hsa
ugggcugggccucuuuccugugguucacagcuguaguauggagauuaauagacuggaucuuugc

SEQ ID NO: 216153 - RNA, 64 nt, hsa
acuuguacuggagagaaauccuacaagugugguaaguauggaaaaaucuucaguuguaucucuu

SEQ ID NO: 216154 - RNA, 64 nt, hsa
acaauauuuguuucuaaucacuggcuuucucaagaguauggauugacauauuguguuaugaaug

SEQ ID NO: 216155 - RNA, 64 nt, hsa
aagcuuaccugaaaucugccuuuuauaaaggaauaguauggauaaguggaauuguacauuuuuu

SEQ ID NO: 216156 - RNA, 64 nt, hsa
agccuggguguguauggaggaucuagccugggugaguauggagggucuagccugggugaguaug

SEQ ID NO: 216157 - RNA, 64 nt, hsa
agccugggugaguauggagggucuagccugggugaguauggagggucuagccuggguguguaug

SEQ ID NO: 216158 - RNA, 64 nt, hsa
agccuggguguguauggagggucuagccugggugaguauggagggucuagccuggguguguaug

SEQ ID NO: 216159 - RNA, 64 nt, hsa
agccuggguguguauggagggucuagccugggugaguauggagggucuagccuggguguguacg

SEQ ID NO: 216160 - RNA, 64 nt, hsa
gauguaaaaacccugucuuuuugcacgauacagccaaaaguauuggcugauuucuugcugagug

SEQ ID NO: 216161 - RNA, 64 nt, hsa
gcuaaugaagugaggggagggagggaugucaccccaaaaguaggcccucccauuggcuuuggcc

SEQ ID NO: 216162 - RNA, 64 nt, hsa
cuucagccugagcaacacgagcaaaacuccgucucaaaaguaaauaaaaauaaucaccuggagu

SEQ ID NO: 216163 - RNA, 64 nt, hsa
cugguagaacagaacaagcaaaagauuaagaguucaaaaguaaaugcaaccaauuuaacaugua

SEQ ID NO: 216164 - RNA, 64 nt, hsa
aauuaauuuuaggagcaucuauuuaugcaguguucaaaaguacugaauuagaaaccaggaaguu

SEQ ID NO: 216165 - RNA, 64 nt, hsa
caauuuauacaacgcugucauauuuuuaaaaaaacaaaaguaagccauccucaaauaaggaacc

SEQ ID NO: 216166 - RNA, 64 nt, hsa
gcgaucucuaccgagaagcaagcacaaaaguagacaaaaguauuaaugaguauuuccuuucucc

SEQ ID NO: 216167 - RNA, 64 nt, hsa
ucagguauaugcgaucucuaccgagaagcaagcacaaaaguagacaaaaguauuaaugaguauu

SEQ ID NO: 216168 - RNA, 64 nt, hsa
aauuaaguucuaguucugacucaucacaagaggucaaaaguauuugcuacuguaacauucaauu

SEQ ID NO: 216169 - RNA, 64 nt, hsa
cugaaaaacaacuaaccuucuaacaacuaucuuucaaaaguaaauguaauaaaaaugcacaaca

SEQ ID NO: 216170 - RNA, 64 nt, hsa
aaaaggagcaaagaaugcauaagcuauguguuggcaaaaguaauuuauauuaaaauuuugaccu

SEQ ID NO: 216171 - RNA, 64 nt, hsa
uggauuuuaaaccauaaaacuugaagauuaccuacaaaaguaacaguguggcuauaagccugag

SEQ ID NO: 216172 - RNA, 64 nt, hsa
ccuagaacauggauagaucucuuaguggucuuuccaaaaguacauguacuugaaauauuuucau

SEQ ID NO: 216173 - RNA, 64 nt, hsa
uucucuauaauauucuuagaguaaaacaaaaucucaaaaguauuaauagcucuucuacccuuga

SEQ ID NO: 216174 - RNA, 64 nt, hsa
aaagcuugcuaauaauagaaaacuacccauauuccaaaaguagauuuccucuguaucccagcau

SEQ ID NO: 216175 - RNA, 64 nt, hsa
caaaacuuuugcuauucauaccacugauguucaucaaaaguaugcgaucuaaaacaugacuauc

SEQ ID NO: 216176 - RNA, 64 nt, hsa
uucauuuuuucccucuaauuauuuaagauuggaacaaaaguauaaauauuauuuauuugaggua

SEQ ID NO: 216177 - RNA, 64 nt, hsa
aaauaguguugauguacugaaauaugaacuguaucaaaaguauugguaauuguauauggggugu

SEQ ID NO: 216178 - RNA, 64 nt, hsa
caagcauaaaaggcuaacuuguggauaguguuuacaaaaguacaaaaguacuacuuccaaggaa

SEQ ID NO: 216179 - RNA, 64 nt, hsa
aaaggcuaacuuguggauaguguuuacaaaaguacaaaaguacuacuuccaaggaaaaugcucu

SEQ ID NO: 216180 - RNA, 64 nt, hsa
ugugaaaaacuaaugugucucaggcucaaguuuuuauaguuauuaaauguuucaaaauagacaa

SEQ ID NO: 216181 - RNA, 64 nt, hsa
aaaugugcaauuuguaaauauugcuaaaagcauguauaguuagaacugauuacauccguaggac

SEQ ID NO: 216182 - RNA, 64 nt, hsa
caguguuguuaagcuauuguuauaguagcugcccuauaguuacaaaaauaaaaacuauaaaaac

SEQ ID NO: 216183 - RNA, 64 nt, hsa
uauguaauuaaguggcaacuucucuuuaccucaguauaguuaaaaaccauucauauuuuaagug

SEQ ID NO: 216184 - RNA, 64 nt, hsa
gguguuaaaaagugugcugcuuagaaugaccaaauauaguuauuguaaaaaaugauauuuauga

SEQ ID NO: 216185 - RNA, 64 nt, hsa
uauauuuaguuuugcuuuuccagauauuacauucuauaguuaccaaaaaugguugaagggaggg

SEQ ID NO: 216186 - RNA, 64 nt, hsa
ugagaaaauuauuuuuuuuaauuuaaguccuaaauauaguuaaaauaaauaauguuuuaguaaa

SEQ ID NO: 216187 - RNA, 64 nt, hsa
cucuauccaacauuuaauuguuugaaagccuccauauaguuagauugugcuuuguaauuuuguu

SEQ ID NO: 216188 - RNA, 64 nt, hsa
auauaguuguuacugguccuguuguagcagugaauauaguuaaaauacguacauuaaaaaaaaa

SEQ ID NO: 216189 - RNA, 64 nt, hsa
cuuaguuuagugacaaagucauugucuuuuaugauauaguuaauuuuaaagagauuuaguauua

SEQ ID NO: 216190 - RNA, 64 nt, hsa
uauuuuuaaaacuucauagugauaaaugagacuauauaguuauauuguuaauauaguuaacaca

SEQ ID NO: 216191 - RNA, 64 nt, hsa
agugauaaaugagacuauauaguuauauuguuaauauaguuaacacauuacaugauuuggugag

SEQ ID NO: 216192 - RNA, 64 nt, hsa
gaaggcuugcuuuuucuccaugucucccaguuuguauaguuaaauuguccaguuguauaguuaa

SEQ ID NO: 216193 - RNA, 64 nt, hsa
gucucccaguuuguauaguuaaauuguccaguuguauaguuaaauauuugaucuuauuaaaaac

SEQ ID NO: 216194 - RNA, 64 nt, hsa
guguaaagaaaucagucaauuacaagaguaauuguauaguuauugagaccuauaguguguggcu

SEQ ID NO: 216195 - RNA, 64 nt, hsa
aaguauauggcuaucaugacuaagugcuagaauuuauaguuacaggcgguguccuuuuaaaugu

SEQ ID NO: 216196 - RNA, 64 nt, hsa
auaaggcuugcuaugauuugcacuauuaguacaguauaguuagaaaggaaagcugaacacuaua

SEQ ID NO: 216197 - RNA, 64 nt, hsa
aaguuacagauaagaauuuauuucuacugaacucuauaguuaguguaauauaauucauauuuuu

SEQ ID NO: 216198 - RNA, 64 nt, hsa
cauaauucaacuagagauuugaagaauuggcuuguauaguuauaacaaccacaguagaaacauu

SEQ ID NO: 216199 - RNA, 64 nt, hsa
uccuuucuuuggucugauacuucauguauuugaauauaguuaaaucguauuauuuuuuucuuaa

SEQ ID NO: 216200 - RNA, 64 nt, hsa
aaucacaugaauuauuacaguguuuauccuuucauauaguuagcuaauaaaaagcuuuugucua

SEQ ID NO: 216201 - RNA, 64 nt, hsa
gauuuguuuuuaaacuguacagugucuuuuuuuguauaguuaacacacuaccgaaugugucuuu

SEQ ID NO: 216202 - RNA, 64 nt, hsa
uaucugggaggauuuuuugguugccuaaaguggcuauaguuacugauuuuuuauuauguaagca

SEQ ID NO: 216203 - RNA, 64 nt, hsa
gugguuaaaaugguuucuagcauauguauaaugcuauaguuaaaauacuauuuuucaaaaucau

SEQ ID NO: 216204 - RNA, 64 nt, hsa
aauuuaaaaaauuuugcugcauaauaaagauaauuauaguuacauguauugauuuaagucucac

SEQ ID NO: 216205 - RNA, 64 nt, hsa
uuucaaagcauuucugaaguuauuccuacuuggauauaguuaauggaauuggcuuaauuugaug

SEQ ID NO: 216206 - RNA, 64 nt, hsa
uauauuauaaaguaugcauucuuaucaccuaguauauaguuaguuuguagagugauuucccccc

SEQ ID NO: 216207 - RNA, 64 nt, hsa
gauuuuuuauuaaacaaauaguaaacccuucaauuauaguuagucuuggugaaguaagauguuu

SEQ ID NO: 216208 - RNA, 64 nt, hsa
uaucacuguagaugagcaacucaucuuuuuaaaguauaguuacugaacugauucugagaaaucu

SEQ ID NO: 216209 - RNA, 64 nt, hsa
auggcuucauuguuucuuucucaguauuagaaauuauaguuacaaugaauugcauaugaagaag

SEQ ID NO: 216210 - RNA, 64 nt, hsa
aacuaauuaggaguugauugagacuuuauuaugguauaguuaggacuugauuguagaagggacu

SEQ ID NO: 216211 - RNA, 64 nt, hsa
gauccacaucagguggccacgaggacuugcaggcuauaguuaugguggugacaugcaugaggug

SEQ ID NO: 216212 - RNA, 64 nt, hsa
cauacgcuugucuccugaauguccucugaauauuuauaguuaaaugauuuauauuugaaaugug

SEQ ID NO: 216213 - RNA, 64 nt, hsa
accugucuaucagacguauugauuauagcaguacuauaguuauucugcugucauuauuaaagau

SEQ ID NO: 216214 - RNA, 64 nt, hsa
cacugccuuaaacagauauuucuauagcugucaguauaguuauguugcucccaagccuaguuau

SEQ ID NO: 216215 - RNA, 64 nt, hsa; identical to SEQ ID NO: 97841

SEQ ID NO: 216216 - RNA, 64 nt, hsa; identical to SEQ ID NO: 97842

SEQ ID NO: 216217 - RNA, 64 nt, hsa; identical to SEQ ID NO: 97843

SEQ ID NO: 216218 - RNA, 64 nt, hsa; identical to SEQ ID NO: 97844

SEQ ID NO: 216219 - RNA, 64 nt, hsa; identical to SEQ ID NO: 97845

SEQ ID NO: 216220 - RNA, 64 nt, hsa; identical to SEQ ID NO: 97846

SEQ ID NO: 216221 - RNA, 64 nt, hsa; identical to SEQ ID NO: 97847

SEQ ID NO: 216222 - RNA, 64 nt, hsa; identical to SEQ ID NO: 97848

SEQ ID NO: 216223 - RNA, 64 nt, hsa
ugacaggggggcaguugugaggccacagagugccuugacacaaagauuacauuuuucagacccc

SEQ ID NO: 216224 - RNA, 64 nt, hsa
uguaauugacaggauggcugcugcagaaugcugguugacacagggauuauuauacugcuauuuu

SEQ ID NO: 216225 - RNA, 64 nt, hsa
uuuuugacuaugaacauuaguccaaauuuaauauuugacacaguucauaccagcuugcuacaau

SEQ ID NO: 216226 - RNA, 64 nt, hsa
auauauguguauauguuauaaacgugaaauauauuugacacacacauucacauauaaauuguua

SEQ ID NO: 216227 - RNA, 64 nt, hsa
ucagauaguccaaauuuagguuauuaugcuuaauuugacacauuaacuaaaugcccaguuuuaa

SEQ ID NO: 216228 - RNA, 64 nt, hsa
agauauuagccuugaauugggggaaaagaagacuuugacacauuuuaguuauuuuaauaacaga

SEQ ID NO: 216229 - RNA, 64 nt, hsa
auauguauuuacaagaauaucuuuaaguguuuuuuugacacauuaaaauaaaggaaauaaggaa

SEQ ID NO: 216230 - RNA, 64 nt, hsa
ucauauugaaaaaugauuugcauaguacugaauguugacacacagcuuauauguauuuacaaga

SEQ ID NO: 216231 - RNA, 64 nt, hsa
ccucuuggcucccaggaggagggauuuccugacuuugacacacauggccaccuuggcacaaaag

SEQ ID NO: 216232 - RNA, 64 nt, hsa
acugaaugugacugucaucacuucacacugcuguuugacacaucacaaaucacugaugugguug

SEQ ID NO: 216233 - RNA, 64 nt, hsa
aguaggaaucagugcagccuguaaguucuccacauugacacacacacacacacacacacacaca

SEQ ID NO: 216234 - RNA, 64 nt, hsa
ugaugguuuugcuacuaauuccuaucccauacauuugacacaaaagaaguguugguaauggaua

SEQ ID NO: 216235 - RNA, 62 nt, hsa
ccaagaucaagauccuguucugagucagaugaugaugacagcagugaaacuccuccucacug

SEQ ID NO: 216236 - RNA, 62 nt, hsa
cuagaauuuggugaagaggaggaggaggagauugaugacaagcaaguuacucaggaaucaaa

SEQ ID NO: 216237 - RNA, 62 nt, hsa
cuuccccuggaaaaaaaucguguuaagcuagaugaugacagugaugaugaugaagaaagcaa

SEQ ID NO: 216238 - RNA, 62 nt, hsa
uggacccuugguggcuuuuguaaauuaauuuuugaugacauuuugaguuuuaagauuucuga

SEQ ID NO: 216239 - RNA, 62 nt, hsa
cugauuuucaucuuuauaggaaauaguuuaagugaugacaaguuccaauagcuuauaugccc

SEQ ID NO: 216240 - RNA, 62 nt, hsa
agcuucucagcugaggacacucaaggcauacaugaugacagucuuuuuuuuuuuuguauguu

SEQ ID NO: 216241 - RNA, 64 nt, hsa
caagucucaggugugucugccuguggcugcacaggcucucuaaccgaaaccucacuuucagaga

SEQ ID NO: 216242 - RNA, 64 nt, hsa
acugggagaggaaucuaagaaccagauggcuucagcucucuagaggagcugagccuauucacag

SEQ ID NO: 216243 - RNA, 64 nt, hsa
acucuucuggcauaucucuccugucucuuccacugcucucuauguuuuaagcaaagagcaugga

SEQ ID NO: 216244 - RNA, 64 nt, hsa
ucucuucucucuccucuguccucaucauguuccagcucucuacagggccacauacucuucuggc

SEQ ID NO: 216245 - RNA, 64 nt, hsa; identical to SEQ ID NO: 93254

SEQ ID NO: 216246 - RNA, 64 nt, hsa; identical to SEQ ID NO: 93255

SEQ ID NO: 216247 - RNA, 64 nt, hsa; identical to SEQ ID NO: 93256

SEQ ID NO: 216248 - RNA, 64 nt, hsa; identical to SEQ ID NO: 93257

SEQ ID NO: 216249 - RNA, 64 nt, hsa; identical to SEQ ID NO: 93258

SEQ ID NO: 216250 - RNA, 64 nt, hsa; identical to SEQ ID NO: 93259

SEQ ID NO: 216251 - RNA, 64 nt, hsa; identical to SEQ ID NO: 93260

SEQ ID NO: 216252 - RNA, 64 nt, hsa; identical to SEQ ID NO: 93261

SEQ ID NO: 216253 - RNA, 64 nt, hsa; identical to SEQ ID NO: 93262

SEQ ID NO: 216254 - RNA, 64 nt, hsa; identical to SEQ ID NO: 93263

SEQ ID NO: 216255 - RNA, 64 nt, hsa; identical to SEQ ID NO: 93264

SEQ ID NO: 216256 - RNA, 64 nt, hsa; identical to SEQ ID NO: 93265

SEQ ID NO: 216257 - RNA, 64 nt, hsa; identical to SEQ ID NO: 93266

SEQ ID NO: 216258 - RNA, 64 nt, hsa; identical to SEQ ID NO: 93267

SEQ ID NO: 216259 - RNA, 64 nt, hsa; identical to SEQ ID NO: 93268

SEQ ID NO: 216260 - RNA, 64 nt, hsa; identical to SEQ ID NO: 93269

SEQ ID NO: 216261 - RNA, 64 nt, hsa; identical to SEQ ID NO: 93270

SEQ ID NO: 216262 - RNA, 64 nt, hsa; identical to SEQ ID NO: 93271

SEQ ID NO: 216263 - RNA, 64 nt, hsa; identical to SEQ ID NO: 93272

SEQ ID NO: 216264 - RNA, 64 nt, hsa; identical to SEQ ID NO: 93273

SEQ ID NO: 216265 - RNA, 64 nt, hsa; identical to SEQ ID NO: 93274

SEQ ID NO: 216266 - RNA, 64 nt, hsa; identical to SEQ ID NO: 93275

SEQ ID NO: 216267 - RNA, 64 nt, hsa; identical to SEQ ID NO: 93276

SEQ ID NO: 216268 - RNA, 64 nt, hsa; identical to SEQ ID NO: 93277

SEQ ID NO: 216269 - RNA, 64 nt, hsa; identical to SEQ ID NO: 93278

SEQ ID NO: 216270 - RNA, 64 nt, hsa; identical to SEQ ID NO: 93279

SEQ ID NO: 216271 - RNA, 64 nt, hsa; identical to SEQ ID NO: 93280

SEQ ID NO: 216272 - RNA, 64 nt, hsa; identical to SEQ ID NO: 93281

SEQ ID NO: 216273 - RNA, 64 nt, hsa; identical to SEQ ID NO: 93282

SEQ ID NO: 216274 - RNA, 64 nt, hsa; identical to SEQ ID NO: 93283

SEQ ID NO: 216275 - RNA, 64 nt, hsa; identical to SEQ ID NO: 93284

SEQ ID NO: 216276 - RNA, 64 nt, hsa; identical to SEQ ID NO: 93285

SEQ ID NO: 216277 - RNA, 64 nt, hsa; identical to SEQ ID NO: 93286

SEQ ID NO: 216278 - RNA, 64 nt, hsa; identical to SEQ ID NO: 93287

SEQ ID NO: 216279 - RNA, 64 nt, hsa; identical to SEQ ID NO: 93288

SEQ ID NO: 216280 - RNA, 64 nt, hsa; identical to SEQ ID NO: 93289

SEQ ID NO: 216281 - RNA, 64 nt, hsa; identical to SEQ ID NO: 93290

SEQ ID NO: 216282 - RNA, 64 nt, hsa; identical to SEQ ID NO: 93291

SEQ ID NO: 216283 - RNA, 64 nt, hsa; identical to SEQ ID NO: 93292

SEQ ID NO: 216284 - RNA, 64 nt, hsa; identical to SEQ ID NO: 93293

SEQ ID NO: 216285 - RNA, 64 nt, hsa; identical to SEQ ID NO: 93294

SEQ ID NO: 216286 - RNA, 64 nt, hsa; identical to SEQ ID NO: 93295

SEQ ID NO: 216287 - RNA, 64 nt, hsa; identical to SEQ ID NO: 93296

SEQ ID NO: 216288 - RNA, 64 nt, hsa; identical to SEQ ID NO: 93297

SEQ ID NO: 216289 - RNA, 64 nt, hsa; identical to SEQ ID NO: 93298

SEQ ID NO: 216290 - RNA, 64 nt, hsa; identical to SEQ ID NO: 93299

SEQ ID NO: 216291 - RNA, 64 nt, hsa; identical to SEQ ID NO: 93300

SEQ ID NO: 216292 - RNA, 64 nt, hsa; identical to SEQ ID NO: 93301

SEQ ID NO: 216293 - RNA, 64 nt, hsa; identical to SEQ ID NO: 93302

SEQ ID NO: 216294 - RNA, 64 nt, hsa; identical to SEQ ID NO: 93303

SEQ ID NO: 216295 - RNA, 64 nt, hsa; identical to SEQ ID NO: 93304

SEQ ID NO: 216296 - RNA, 64 nt, hsa; identical to SEQ ID NO: 93305

SEQ ID NO: 216297 - RNA, 64 nt, hsa; identical to SEQ ID NO: 93306

SEQ ID NO: 216298 - RNA, 64 nt, hsa; identical to SEQ ID NO: 93307

SEQ ID NO: 216299 - RNA, 64 nt, hsa; identical to SEQ ID NO: 93308

SEQ ID NO: 216300 - RNA, 64 nt, hsa; identical to SEQ ID NO: 93309

SEQ ID NO: 216301 - RNA, 64 nt, hsa; identical to SEQ ID NO: 93310

SEQ ID NO: 216302 - RNA, 64 nt, hsa; identical to SEQ ID NO: 93311

SEQ ID NO: 216303 - RNA, 64 nt, hsa; identical to SEQ ID NO: 93312

SEQ ID NO: 216304 - RNA, 64 nt, hsa; identical to SEQ ID NO: 93313

SEQ ID NO: 216305 - RNA, 64 nt, hsa; identical to SEQ ID NO: 93313

SEQ ID NO: 216306 - RNA, 64 nt, hsa; identical to SEQ ID NO: 93315

SEQ ID NO: 216307 - RNA, 64 nt, hsa; identical to SEQ ID NO: 93316

SEQ ID NO: 216308 - RNA, 64 nt, hsa; identical to SEQ ID NO: 93317

SEQ ID NO: 216309 - RNA, 64 nt, hsa; identical to SEQ ID NO: 93318

SEQ ID NO: 216310 - RNA, 64 nt, hsa; identical to SEQ ID NO: 93319

SEQ ID NO: 216311 - RNA, 64 nt, hsa; identical to SEQ ID NO: 93320

SEQ ID NO: 216312 - RNA, 64 nt, hsa; identical to SEQ ID NO: 93321

SEQ ID NO: 216313 - RNA, 64 nt, hsa; identical to SEQ ID NO: 93322

SEQ ID NO: 216314 - RNA, 64 nt, hsa; identical to SEQ ID NO: 93323

SEQ ID NO: 216315 - RNA, 64 nt, hsa; identical to SEQ ID NO: 93324

SEQ ID NO: 216316 - RNA, 64 nt, hsa; identical to SEQ ID NO: 93325

SEQ ID NO: 216317 - RNA, 64 nt, hsa; identical to SEQ ID NO: 93326

SEQ ID NO: 216318 - RNA, 64 nt, hsa; identical to SEQ ID NO: 93327

SEQ ID NO: 216319 - RNA, 64 nt, hsa; identical to SEQ ID NO: 93328

SEQ ID NO: 216320 - RNA, 64 nt, hsa; identical to SEQ ID NO: 93329

SEQ ID NO: 216321 - RNA, 64 nt, hsa; identical to SEQ ID NO: 93330

SEQ ID NO: 216322 - RNA, 64 nt, hsa; identical to SEQ ID NO: 44425

SEQ ID NO: 216323 - RNA, 64 nt, hsa; identical to SEQ ID NO: 44426

SEQ ID NO: 216324 - RNA, 64 nt, hsa; identical to SEQ ID NO: 44427

SEQ ID NO: 216325 - RNA, 64 nt, hsa; identical to SEQ ID NO: 44428

SEQ ID NO: 216326 - RNA, 64 nt, hsa; identical to SEQ ID NO: 44429

SEQ ID NO: 216327 - RNA, 64 nt, hsa; identical to SEQ ID NO: 44430

SEQ ID NO: 216328 - RNA, 64 nt, hsa; identical to SEQ ID NO: 44431

SEQ ID NO: 216329 - RNA, 64 nt, hsa; identical to SEQ ID NO: 44432

SEQ ID NO: 216330 - RNA, 64 nt, hsa; identical to SEQ ID NO: 44433

SEQ ID NO: 216331 - RNA, 64 nt, hsa; identical to SEQ ID NO: 44434

SEQ ID NO: 216332 - RNA, 64 nt, hsa; identical to SEQ ID NO: 44435

SEQ ID NO: 216333 - RNA, 64 nt, hsa; identical to SEQ ID NO: 44436

SEQ ID NO: 216334 - RNA, 64 nt, hsa; identical to SEQ ID NO: 199324

SEQ ID NO: 216335 - RNA, 64 nt, hsa; identical to SEQ ID NO: 199325

SEQ ID NO: 216336 - RNA, 64 nt, hsa; identical to SEQ ID NO: 199326

SEQ ID NO: 216337 - RNA, 64 nt, hsa; identical to SEQ ID NO: 199327

SEQ ID NO: 216338 - RNA, 64 nt, hsa; identical to SEQ ID NO: 199328

SEQ ID NO: 216339 - RNA, 64 nt, hsa; identical to SEQ ID NO: 199329

SEQ ID NO: 216340 - RNA, 64 nt, hsa; identical to SEQ ID NO: 199330

SEQ ID NO: 216341 - RNA, 64 nt, hsa; identical to SEQ ID NO: 199331

SEQ ID NO: 216342 - RNA, 64 nt, hsa; identical to SEQ ID NO: 199332

SEQ ID NO: 216343 - RNA, 64 nt, hsa; identical to SEQ ID NO: 199333

SEQ ID NO: 216344 - RNA, 64 nt, hsa; identical to SEQ ID NO: 199334

SEQ ID NO: 216345 - RNA, 64 nt, hsa; identical to SEQ ID NO: 199335

SEQ ID NO: 216346 - RNA, 64 nt, hsa; identical to SEQ ID NO: 199336

SEQ ID NO: 216347 - RNA, 64 nt, hsa; identical to SEQ ID NO: 199337

SEQ ID NO: 216348 - RNA, 64 nt, hsa; identical to SEQ ID NO: 199338

SEQ ID NO: 216349 - RNA, 64 nt, hsa; identical to SEQ ID NO: 199339

SEQ ID NO: 216350 - RNA, 64 nt, hsa; identical to SEQ ID NO: 199340

SEQ ID NO: 216351 - RNA, 64 nt, hsa; identical to SEQ ID NO: 199341

SEQ ID NO: 216352 - RNA, 64 nt, hsa; identical to SEQ ID NO: 199342

SEQ ID NO: 216353 - RNA, 64 nt, hsa; identical to SEQ ID NO: 199343

SEQ ID NO: 216354 - RNA, 64 nt, hsa; identical to SEQ ID NO: 199344

SEQ ID NO: 216355 - RNA, 64 nt, hsa; identical to SEQ ID NO: 199345

SEQ ID NO: 216356 - RNA, 64 nt, hsa; identical to SEQ ID NO: 199346

SEQ ID NO: 216357 - RNA, 64 nt, hsa; identical to SEQ ID NO: 199347

SEQ ID NO: 216358 - RNA, 64 nt, hsa; identical to SEQ ID NO: 199348

SEQ ID NO: 216359 - RNA, 64 nt, hsa; identical to SEQ ID NO: 199349

SEQ ID NO: 216360 - RNA, 64 nt, hsa; identical to SEQ ID NO: 199350

SEQ ID NO: 216361 - RNA, 64 nt, hsa; identical to SEQ ID NO: 199351

SEQ ID NO: 216362 - RNA, 64 nt, hsa; identical to SEQ ID NO: 199352

SEQ ID NO: 216363 - RNA, 64 nt, hsa; identical to SEQ ID NO: 199353

SEQ ID NO: 216364 - RNA, 64 nt, hsa; identical to SEQ ID NO: 199354

SEQ ID NO: 216365 - RNA, 64 nt, hsa; identical to SEQ ID NO: 199355

SEQ ID NO: 216366 - RNA, 64 nt, hsa; identical to SEQ ID NO: 199356

SEQ ID NO: 216367 - RNA, 64 nt, hsa; identical to SEQ ID NO: 199357

SEQ ID NO: 216368 - RNA, 64 nt, hsa; identical to SEQ ID NO: 199358

SEQ ID NO: 216369 - RNA, 64 nt, hsa; identical to SEQ ID NO: 199359

SEQ ID NO: 216370 - RNA, 64 nt, hsa; identical to SEQ ID NO: 199360

SEQ ID NO: 216371 - RNA, 64 nt, hsa; identical to SEQ ID NO: 199361

SEQ ID NO: 216372 - RNA, 64 nt, hsa; identical to SEQ ID NO: 199362

SEQ ID NO: 216373 - RNA, 64 nt, hsa; identical to SEQ ID NO: 199363

SEQ ID NO: 216374 - RNA, 64 nt, hsa; identical to SEQ ID NO: 199364

SEQ ID NO: 216375 - RNA, 64 nt, hsa; identical to SEQ ID NO: 199365

SEQ ID NO: 216376 - RNA, 64 nt, hsa; identical to SEQ ID NO: 199366

SEQ ID NO: 216377 - RNA, 64 nt, hsa; identical to SEQ ID NO: 199367

SEQ ID NO: 216378 - RNA, 64 nt, hsa; identical to SEQ ID NO: 199368

SEQ ID NO: 216379 - RNA, 64 nt, hsa; identical to SEQ ID NO: 199369

SEQ ID NO: 216380 - RNA, 64 nt, hsa; identical to SEQ ID NO: 199370

SEQ ID NO: 216381 - RNA, 64 nt, hsa; identical to SEQ ID NO: 199371

SEQ ID NO: 216382 - RNA, 64 nt, hsa; identical to SEQ ID NO: 199372

SEQ ID NO: 216383 - RNA, 64 nt, hsa; identical to SEQ ID NO: 199373

SEQ ID NO: 216384 - RNA, 64 nt, hsa; identical to SEQ ID NO: 199374

SEQ ID NO: 216385 - RNA, 64 nt, hsa; identical to SEQ ID NO: 199375

SEQ ID NO: 216386 - RNA, 64 nt, hsa; identical to SEQ ID NO: 199376

SEQ ID NO: 216387 - RNA, 64 nt, hsa; identical to SEQ ID NO: 199377

SEQ ID NO: 216388 - RNA, 64 nt, hsa; identical to SEQ ID NO: 199378

SEQ ID NO: 216389 - RNA, 64 nt, hsa; identical to SEQ ID NO: 199379

SEQ ID NO: 216390 - RNA, 64 nt, hsa; identical to SEQ ID NO: 199380

SEQ ID NO: 216391 - RNA, 64 nt, hsa; identical to SEQ ID NO: 199381

SEQ ID NO: 216392 - RNA, 64 nt, hsa; identical to SEQ ID NO: 199382

SEQ ID NO: 216393 - RNA, 64 nt, hsa; identical to SEQ ID NO: 199383

SEQ ID NO: 216394 - RNA, 64 nt, hsa; identical to SEQ ID NO: 199384

SEQ ID NO: 216395 - RNA, 64 nt, hsa; identical to SEQ ID NO: 199385

SEQ ID NO: 216396 - RNA, 64 nt, hsa; identical to SEQ ID NO: 199386

SEQ ID NO: 216397 - RNA, 64 nt, hsa; identical to SEQ ID NO: 199387

SEQ ID NO: 216398 - RNA, 62 nt, hsa; identical to SEQ ID NO: 199388

SEQ ID NO: 216399 - RNA, 64 nt, hsa; identical to SEQ ID NO: 199389

SEQ ID NO: 216400 - RNA, 64 nt, hsa; identical to SEQ ID NO: 199390

SEQ ID NO: 216401 - RNA, 64 nt, hsa; identical to SEQ ID NO: 199391

SEQ ID NO: 216402 - RNA, 64 nt, hsa; identical to SEQ ID NO: 199392

SEQ ID NO: 216403 - RNA, 64 nt, hsa; identical to SEQ ID NO: 199393

SEQ ID NO: 216404 - RNA, 64 nt, hsa; identical to SEQ ID NO: 199394

SEQ ID NO: 216405 - RNA, 64 nt, hsa; identical to SEQ ID NO: 199395

SEQ ID NO: 216406 - RNA, 64 nt, hsa; identical to SEQ ID NO: 199396

SEQ ID NO: 216407 - RNA, 64 nt, hsa; identical to SEQ ID NO: 199397

SEQ ID NO: 216408 - RNA, 64 nt, hsa; identical to SEQ ID NO: 199398

SEQ ID NO: 216409 - RNA, 64 nt, hsa; identical to SEQ ID NO: 199399

SEQ ID NO: 216410 - RNA, 64 nt, hsa; identical to SEQ ID NO: 199400

SEQ ID NO: 216411 - RNA, 64 nt, hsa; identical to SEQ ID NO: 199401

SEQ ID NO: 216412 - RNA, 64 nt, hsa; identical to SEQ ID NO: 199402

SEQ ID NO: 216413 - RNA, 64 nt, hsa
cuuuacaaauauaaagauagcuguuuaggauauuuuguuacauuuuuguaaauuuuugaaaugc

SEQ ID NO: 216414 - RNA, 64 nt, hsa
aaacuugaguucuauuuaccuugcacauuuuuuguuguuacagugaaaaaaaugguccaagaaa

SEQ ID NO: 216415 - RNA, 64 nt, hsa
gcuacugcagcuaauaaaaaauuuuagauagcaauuguuacaaccauaugccuuuauagcuaga

SEQ ID NO: 216416 - RNA, 64 nt, hsa
uaguuucacuuuguauaaaaguuaggaccagcuguuguuacauguaauauuuuaguucagaacu

SEQ ID NO: 216417 - RNA, 64 nt, hsa
aguuuuagaaauuucgugguaguaaguucggcauuuguuacauguauagagagaagacuaauaa

SEQ ID NO: 216418 - RNA, 64 nt, hsa
uuuuuaugaguuuauggcuaugaaaacagcuauuuuguuacagcuggcuguuuuuauaagugua

SEQ ID NO: 216419 - RNA, 64 nt, hsa
aauaaaaguucacuguacuuuuuuuucauucucauuguuacaugauuuuuuaaaaaaaggaaaa

SEQ ID NO: 216420 - RNA, 64 nt, hsa
guuagaacucuuacagccuuauuuauuuuuaaguuuguuacagccaaaggguuggagugugcca

SEQ ID NO: 216421 - RNA, 64 nt, hsa
auccuuauuguucuuaauuguguuucucuacguauuguuacagaugagccauacguuucuuugu

SEQ ID NO: 216422 - RNA, 64 nt, hsa
caagccagcugcuaagcuuguguuuaugugacucuuguuacagaucauggcggugcgucagccu

SEQ ID NO: 216423 - RNA, 64 nt, hsa
cauuuuuucucagacaccuggccguaaaaucaguuuguuacagcauucuucucuaggcugcuaa

SEQ ID NO: 216424 - RNA, 64 nt, hsa
aauuggacuguaguuuagaaauuacaggaccagcuuguuacagauuauacacuauucuguuacu

SEQ ID NO: 216425 - RNA, 64 nt, hsa
uucaagcucugaauugauuuuuugcuuggagcuguuguuacaguagcuguaauuuugcuaccag

SEQ ID NO: 216426 - RNA, 64 nt, hsa
uaccuuccguuacaguguugauucauaagaaauauuguuacauuugagauaacuucaucuguau

SEQ ID NO: 216427 - RNA, 64 nt, hsa
ggagcccacuggaaacgcccaccacgggggcuccuuguuacacauguucuuuuuuuauccgauc

SEQ ID NO: 216428 - RNA, 64 nt, hsa
ucuuguguuaacaaauuacgugcuauaugauuuuuuguuacauuguuacaaguguuaaugacau

SEQ ID NO: 216429 - RNA, 64 nt, hsa
uaacaaauuacgugcuauaugauuuuuuguuacauuguuacaaguguuaaugacauuuucauua

SEQ ID NO: 216430 - RNA, 64 nt, hsa
uauuuaauauaguaaaaucaaugcucccuuaauguuguuacaaagauaugguaacuguaauaug

SEQ ID NO: 216431 - RNA, 64 nt, hsa
uucugcuguuuuaagguacccaguucaugguaauuuguuacagcaauccuaggaagcuaauacu

SEQ ID NO: 216432 - RNA, 64 nt, hsa
auugccaaagugaagguguagauaauaccuagucuuguuacauaaaggggaugugguuugcaga

SEQ ID NO: 216433 - RNA, 64 nt, hsa
aaguccgcuuggauuagcugugccuuucauuacuuuguuacagaaaugcagugacuuauacuaa

SEQ ID NO: 216434 - RNA, 64 nt, hsa
ugaauugugagguaaacuaccugauuuuuuuuuguuguuacaugaaagaaugagugacaaaucu

SEQ ID NO: 216435 - RNA, 64 nt, hsa
cauuuuuuccuauuacaaaaaacucccacuuuuuuuguuacaaaaaguaauagaaaaugguaau

SEQ ID NO: 216436 - RNA, 64 nt, hsa
aaagaaaaaaaaagaaaaaaaaaggugacucacauuguuacacaugcuuuaaaauauguauuca

SEQ ID NO: 216437 - RNA, 64 nt, hsa
gagccuagcagacucaggccugugggaaugggauuuguuacaaaucuagguuuguuacuggcuu

SEQ ID NO: 216438 - RNA, 64 nt, hsa
aaucccuguccacauuggaauaaaaaagacauuuuuguuacaaaguuugcaguauaauagaguu

SEQ ID NO: 216439 - RNA, 64 nt, hsa
uguauauauuuaaaugaauaacuuuuuauacucuuuguuacauguuuguaucaguauuuagugg

SEQ ID NO: 216440 - RNA, 64 nt, hsa
agagagauacguucacauaauuuuauuacauauauuguuacaauuguucuauuuuguuaguuac

SEQ ID NO: 216441 - RNA, 64 nt, hsa
uucuuaguacacaaaacacagcaaacauaaaaaguuguuacacuucaucaaaaguacaaaguuc

SEQ ID NO: 216442 - RNA, 61 nt, hsa
auugugaagaggaggaaaagugaaucacggagagagaaaggaaaggauagaaucacaggcu

SEQ ID NO: 216443 - RNA, 61 nt, hsa
auccagcuauacuuacuugcacaguggauuggagagaaaggauucuccagugugcacacuc

SEQ ID NO: 216444 - RNA, 61 nt, hsa
gcccgagugacacaugagagcuguaugaauugagagaaaaggcaacaaguagcauucuuca

SEQ ID NO: 216445 - RNA, 61 nt, hsa
ugugcucuauuauacccugauagagaugggggagagaaaggaauguuuuugauggugguuu

SEQ ID NO: 216446 - RNA, 61 nt, hsa
uguguguguguguguguguguguggcagagagagagaaagagagagagagagagaaauucu

SEQ ID NO: 216447 - RNA, 61 nt, hsa
uguguggcagagagagagaaagagagagagagagagaaauucuguuaaaaucuauucugug

SEQ ID NO: 216448 - RNA, 61 nt, hsa
cccgcagaccuccccagccccuagcccaggagagagaaagccaggcagguagccaggggga

SEQ ID NO: 216449 - RNA, 61 nt, hsa
gugcuggaggugggagcaggagauugagaaggagagaaagugggugagaugcuggagaaga

SEQ ID NO: 216450 - RNA, 61 nt, hsa
cgcccuccccuccccugcugcaggggcucuggagagaaacaauaaagagauucacacacaa

SEQ ID NO: 216451 - RNA, 61 nt, hsa
gugucagcuuuucgucuaguaacuuaagugagagagaaagggcagcgccacagaagccccu

SEQ ID NO: 216452 - RNA, 61 nt, hsa
uuaccggaguagggggugggagagggaagaggagagaaaauacagggacuuugaaccuagg

SEQ ID NO: 216453 - RNA, 61 nt, hsa
aauuauuuguaugcuucaaaaaaaaaaaaaagagagaaacaaaaaagugugacauuacaga

SEQ ID NO: 216454 - RNA, 61 nt, hsa
ccaguuccguucugagagaaaaagagagagagagagaaaaagaccaugcugcauacauucu

SEQ ID NO: 216455 - RNA, 61 nt, hsa
gcaaacauguugcuguuuccaguuccguucugagagaaaaagagagagagagagaaaaaga

SEQ ID NO: 216456 - RNA, 61 nt, hsa
aaaacauagacuggaggagguaauccauggagagagaaaaagaagagggcucaggacaagg

SEQ ID NO: 216457 - RNA, 61 nt, hsa
uugggguuuugccagggaaguaaaaggaguugagagaaagaugggucaguucagaagacau

SEQ ID NO: 216458 - RNA, 61 nt, hsa
ugacuuuuugcacuucuguauauagucaaaagagagaaaccuguauaauaguaagaucuua

SEQ ID NO: 216459 - RNA, 61 nt, hsa
cuacugcauguuuaaaacuucaacaaaaaaagagagaaagaacuauacuaagaacauauau

SEQ ID NO: 216460 - RNA, 61 nt, hsa
agcaagaaaagagaaaauauuaaaacgaggagagagaaaaauaauauuaacacaaaaaaau

SEQ ID NO: 216461 - RNA, 61 nt, hsa
ugagcaaacaaaaaaaucgaaagacaaacgggagagaaaaagaggaagggaacuuauuucu

SEQ ID NO: 216462 - RNA, 61 nt, hsa
aaccuugauaaacauaagagaauucauaccggagagaaacuguacaaaugugaagaauaug

SEQ ID NO: 216463 - RNA, 61 nt, hsa
ccucaaugcuuaauaaauauaauucaugcuggagagaaacuucacaugugaaccguguggc

SEQ ID NO: 216464 - RNA, 61 nt, hsa
aacuuuguuaaacauaagagaauuuauaccagagagaaacccuacacauguaaagaaugug

SEQ ID NO: 216465 - RNA, 61 nt, hsa
caccacagccaggaggggccuuucccaccuggagagaaacuuccagaccagccccucauac

SEQ ID NO: 216466 - RNA, 61 nt, hsa
uaccacagccaagaggggccuuucucaccuggagagaaauuuccagaccauccccucucac

SEQ ID NO: 216467 - RNA, 61 nt, hsa
caccacagccaagagaagccuuuccagccuggagagaaacuuccagaccagcccucucacu

SEQ ID NO: 216468 - RNA, 61 nt, hsa
caccacagccaggagaggccuuucccaccuggagagaaacuuccagaccagccccucauac

SEQ ID NO: 216469 - RNA, 61 nt, hsa
uaccacagccaagaggggccuuucucaccuggagagaaacuuccagaccagccccucacac

SEQ ID NO: 216470 - RNA, 61 nt, hsa
caccaccgccaggagaggccuuucccaccgggagagaaacuuccagaccagccccucacac

SEQ ID NO: 216471 - RNA, 61 nt, hsa
caccacagccaggagaggccuuucccaccgggagagaaacuuccagaccagcccucucacu

SEQ ID NO: 216472 - RNA, 61 nt, hsa
caccacagccaggagagaccuuuucugccuggagagaaacuuucagaccagccccacacac

SEQ ID NO: 216473 - RNA, 61 nt, hsa
caccacagccaggagaggccuuucccaccuggagagaaacuuccagaccagccccucucac

SEQ ID NO: 216474 - RNA, 61 nt, hsa
uuuuuaaugaugaaaaguuacacauuuuuuggagagaaaagucuuagcugaagguaaauca

SEQ ID NO: 216475 - RNA, 61 nt, hsa
gaaaaugcauaagguuaguacaagaucaguagagagaaagucaaagauuacagaagugcug

SEQ ID NO: 216476 - RNA, 61 nt, hsa
auuuuaagccuucaaauuacauuaucaacaugagagaaaucaccaacaaagaagauguuca

SEQ ID NO: 216477 - RNA, 61 nt, hsa
aaaaagcauacaucaugauuauggcaaagaggagagaaagaaauuuauuuuacauugacau

SEQ ID NO: 216478 - RNA, 61 nt, hsa
gugagagcacaaagauaacgcaggagagagagagagaaagaaugagaaagaaaaggaaugc

SEQ ID NO: 216479 - RNA, 61 nt, hsa
guaaugacagagaguucuggugagauacccagagagaaaaagagagagcagggugggguaa

SEQ ID NO: 216480 - RNA, 61 nt, hsa
accaggaaauucuguuuauguucuugcagcagagagaaauaaaacuccuugaaaccagcuc

SEQ ID NO: 216481 - RNA, 61 nt, hsa
gacacgaacaaaccaaggaaaucuaaguuucgagagaaaggagggcaacuucuacucuuca

SEQ ID NO: 216482 - RNA, 61 nt, hsa
cccuucuccaaacgauuagucuaaauuuucagagagaaauagauaaaacacgccacagccu

SEQ ID NO: 216483 - RNA, 61 nt, hsa
caugcaucuagggcggagaggcugcacuugugagagaaaauacuauuucaagucauauucu

SEQ ID NO: 216484 - RNA, 61 nt, hsa
aagcuuacuacacauaggaaaauucauacuggagagaaacuacaaaugugaagaauguguu

SEQ ID NO: 216485 - RNA, 61 nt, hsa
cucauaccuuacuauacagaaauucauacuggagagaaagccuacaauugugaagaaugug

SEQ ID NO: 216486 - RNA, 61 nt, hsa
accuugcuacauauaagacaguuuauacuuugagagaaacccugcaaaugugaauaaugug

SEQ ID NO: 216487 - RNA, 61 nt, hsa
caacuuacugaacauaagaaaauuuacacuagagagaaagccuacaaaugugaagaaugug

SEQ ID NO: 216488 - RNA, 61 nt, hsa
acccuuauuacacauaagauaauucauagcggagagaaaccccacaaaugugaagaaugug

SEQ ID NO: 216489 - RNA, 61 nt, hsa
acucuuacugcacauaagaucauucauacuggagagaaaccuuacaaaugugaggaaugug

SEQ ID NO: 216490 - RNA, 61 nt, hsa
aaccuuacuaaacacaagaagauucauacuagagagaaacccuacaaaugugaagaaugug

SEQ ID NO: 216491 - RNA, 61 nt, hsa
aacuuuacuaugcauaagaaaauucaaacuggagagaaacucuacaaaugugaagaaugug

SEQ ID NO: 216492 - RNA, 61 nt, hsa
ucaaaacuucuuacaccuaaaauucaugcaggagagaaacaccacaaaugugaaaaauuug

SEQ ID NO: 216493 - RNA, 61 nt, hsa
acccuuucugcacauaauauaauucauacuggagagaaaccccacaaauaugaagaaugug

SEQ ID NO: 216494 - RNA, 61 nt, hsa
caucuuauucagcaucaaagaauucacacaggagagaaagcacaugaauguaaugaaugug

SEQ ID NO: 216495 - RNA, 61 nt, hsa
gccauugcucagcaucagauaauucacaccagagagaaacccucugaaugugacgaaugaa

SEQ ID NO: 216496 - RNA, 61 nt, hsa
auuucaggcuuuacccaacaucgaaauaauggagagaaaauuguugauuauuuguuuauga

SEQ ID NO: 216497 - RNA, 61 nt, hsa
aaacucauugaacacaagaaaauucauacuggagagaaaccuuacaagugugaagaaugug

SEQ ID NO: 216498 - RNA, 61 nt, hsa
acccuuauuggacauaagagaauucauacuggagagaaacccuacaaaugugaagaaugug

SEQ ID NO: 216499 - RNA, 61 nt, hsa
auuuuccccauuuuucucuuucuuguagaaggagagaaaccaugcucucuagcaacauuga

SEQ ID NO: 216500 - RNA, 61 nt, hsa
gaagagggagggagagagaaagacgaagggagagagaaagcaguuuccaaggauauguuuc

SEQ ID NO: 216501 - RNA, 61 nt, hsa
cugaagagaaaugggaaagaagagggagggagagagaaagacgaagggagagagaaagcag

SEQ ID NO: 216502 - RNA, 61 nt, hsa
uaagugccauccuuuaaucauagacuuugaggagagaaagcauaaaaauauagcauauaau

SEQ ID NO: 216503 - RNA, 61 nt, hsa
uuguaacagcguaauuaaacacaucauggaggagagaaacuuaaaauuaaaauaguauuuu

SEQ ID NO: 216504 - RNA, 61 nt, hsa
ggaaacacgaaagaaaagucaggaagguagagagagaaaaagggagggaaggagaaagaau

SEQ ID NO: 216505 - RNA, 61 nt, hsa
cuggaggaaagucauuccugccuaauccaucgagagaaagaggcuuacgaaaaacuuugcc

SEQ ID NO: 216506 - RNA, 61 nt, hsa
acacagagagaaggagaaagagggagggagagagagaaagagagagaaagagagagagaga

SEQ ID NO: 216507 - RNA, 61 nt, hsa
aaggagaaagagggagggagagagagaaagagagagaaagagagagagagagagagagaga

SEQ ID NO: 216508 - RNA, 61 nt, hsa
aaagagagagaaagagagagagagagagagagagagaaagcugaacgugcacucugacaag

SEQ ID NO: 216509 - RNA, 61 nt, hsa
cccucuaucccuucuccuguccaggggcccagagagaaacacaccuaccccuggccuugcc

SEQ ID NO: 216510 - RNA, 61 nt, hsa
ucuuuccguggcuggggguagacuuaauaaagagagaaauucaagaacugcuugcuuuauu

SEQ ID NO: 216511 - RNA, 61 nt, hsa
uuuaacugccuaaaauguucuccuuagaugugagagaaagagaaaucagaaaaauuaauuc

SEQ ID NO: 216512 - RNA, 61 nt, hsa
uguaaaauaagaaagcccuaaaauacuauuggagagaaaaaauuaacuagguugcuacuuu

SEQ ID NO: 216513 - RNA, 61 nt, hsa
auagagagguuggaaggggugguuggaaggggagagaaacugagauggcccucugugacuc

SEQ ID NO: 216514 - RNA, 61 nt, hsa
augcucugggacgugugggcccuggggagaggagagaaagggcucccaccugccagucccu

SEQ ID NO: 216515 - RNA, 61 nt, hsa
guggguaccuaucccagccacguuucagagggagagaaaugcuacaguugauccucaucug

SEQ ID NO: 216516 - RNA, 61 nt, hsa
uauggcuggcuuuccuuagcagcaagaacuugagagaaaaacacaucugucucugcaaugc

SEQ ID NO: 216517 - RNA, 61 nt, hsa
cggggauauauuaagauauuuuuguacauaagagagaaagagagagaaaaauuuauagaag

SEQ ID NO: 216518 - RNA, 61 nt, hsa
uuaagauauuuuuguacauaagagagaaagagagagaaaaauuuauagaaguuuuguacaa

SEQ ID NO: 216519 - RNA, 61 nt, hsa
guaagaauaaaaacuaccaaagugauauacagagagaaaaaaagacuuagagaagaggaag

SEQ ID NO: 216520 - RNA, 61 nt, hsa
uacuuucugacacuuuugaggaugcaugugggagagaaacccuauugaggcagugacuguu

SEQ ID NO: 216521 - RNA, 61 nt, hsa
caaaauagcugcccuuaaagaguuguuagcagagagaaaaauaacagugaaugugcuccug

SEQ ID NO: 216522 - RNA, 61 nt, hsa
uauacacucagcaauaauuagaaaaaaaggagagagaaaagugauuuaaacaggguggauu

SEQ ID NO: 216523 - RNA, 61 nt, hsa
augugcuuuuuauuguaauucaacagcuauagagagaaagauaacuuauuguguguuugau

SEQ ID NO: 216524 - RNA, 61 nt, hsa
aguguggcagagagugugcaugugagaaagcgagagaaagaggaacugaaggacgcgguua

SEQ ID NO: 216525 - RNA, 61 nt, hsa
agaguaagugaaagggugccugcgcugacgugagagaaaggaaucuguaaacaguggaaac

SEQ ID NO: 216526 - RNA, 61 nt, hsa
auuuaccuaggagcauguaagagaaagaagggagagaaaagguugcaucugcaggaugccu

SEQ ID NO: 216527 - RNA, 61 nt, hsa
auagaaucagauuaucucuuuuuuucuaaaggagagaaagacuuagaacauacacagaucc

SEQ ID NO: 216528 - RNA, 61 nt, hsa
ucuauagacuugagaauguuuuucucuaaaugagagaaagacuuagaauguacacagaucc

SEQ ID NO: 216529 - RNA, 61 nt, hsa
acugguuuggcaugcgguauggaaauucuaagagagaaaguuuuaaggcaaugaaucacag

SEQ ID NO: 216530 - RNA, 61 nt, hsa
auugccuuaagccaccuccccaggacuuacggagagaaauaaggggauguaaccagcaaug

SEQ ID NO: 216531 - RNA, 61 nt, hsa
cgacaucaccccaaggacaacggcagaaguagagagaaacuaccuaccucacuucaaauua

SEQ ID NO: 216532 - RNA, 61 nt, hsa
agcucggcuacuuuuguaaacuucagauuuggagagaaacacgaaagucugaauccugacc

SEQ ID NO: 216533 - RNA, 61 nt, hsa
agagugagagagagaaagagagugagagagagagagaaagagagagagagaugcuguugaa

SEQ ID NO: 216534 - RNA, 61 nt, hsa
uaaccaguuuccagagagccagagagugagagagagaaagagagugagagagagagagaaa

SEQ ID NO: 216535 - RNA, 61 nt, hsa
ugaggagagagagacagaggaggcagagagggagagaaacagaggagacagagagggagag

SEQ ID NO: 216536 - RNA, 61 nt, hsa
aggaggagggagagagauggagaggaggggagagagaaagagagguggggagaggggagag

SEQ ID NO: 216537 - RNA, 61 nt, hsa
ucauuucaaauacaugaaaaaucuuacacuggagagaaacccuaugaguguaagcaaugug

SEQ ID NO: 216538 - RNA, 61 nt, hsa
aaucuucgauuucauaaaaggacacacacuggagagaaacccugugaauguaagaaaugua

SEQ ID NO: 216539 - RNA, 61 nt, hsa
auccuuugaauacaugcaagaacacacaauggagagaaacccuaugaauguaaagaaugca

SEQ ID NO: 216540 - RNA, 61 nt, hsa
ucuuuucaauaucaugaaaggacucacaugggagagaaacccuaugaguguaugccaagug

SEQ ID NO: 216541 - RNA, 61 nt, hsa
uuauuucaaacacaugaaaaaauucacacuggagagaaacccuauaaaugcaagcaaugug

SEQ ID NO: 216542 - RNA, 61 nt, hsa
aaccuuucaauuuaugaaaggacacacacuggagagaaacccuaugaauguaagaaaugug

SEQ ID NO: 216543 - RNA, 61 nt, hsa
gaucguuugaauacaugcaaaacacacacuggagagaaaccuaugaauguaaggaaugcaa

SEQ ID NO: 216544 - RNA, 61 nt, hsa
ucauuucgaagacaugaaaaaacucacacuggagagaaacccuauaaaugcaugccaugug

SEQ ID NO: 216545 - RNA, 61 nt, hsa
uccuuucaguaucaugaaaggacucacacuggagagaaacccuaugaguguaagcaaugug

SEQ ID NO: 216546 - RNA, 61 nt, hsa
cacaccuucgaaggcaugguaggacucacuggagagaaacccuaugaguguaaggaaugug

SEQ ID NO: 216547 - RNA, 61 nt, hsa
uccuuuugguaccaugaaaggacucacacuggagagaaacccuaugaguguaagcaaugug

SEQ ID NO: 216548 - RNA, 61 nt, hsa
caccuucgaauccaugguagaacucacacuggagagaaacccuaugaguguaaggaaugug

SEQ ID NO: 216549 - RNA, 61 nt, hsa
ucauuucaaauaccugaaaaaucuuacacuggagagaaacccuaugaguguaagcaaugug

SEQ ID NO: 216550 - RNA, 61 nt, hsa
ucuuuucgauaacaugaaaggacucacacuggagagaaacccuaugaguguaagcaaugug

SEQ ID NO: 216551 - RNA, 61 nt, hsa
ugaaaacacaaagcacaggucaggauccucugagagaaaaucaacauugcaccacguaggg

SEQ ID NO: 216552 - RNA, 61 nt, hsa
gagggcaacaggagauguggggacguguuaggagagaaaaaaaaaaaaacaaaaauauaua

SEQ ID NO: 216553 - RNA, 61 nt, hsa
caaccaacacaagaucaaaaaggaaaaggacgagagaaaaauuauuuuuaagauaauuaaa

SEQ ID NO: 216554 - RNA, 61 nt, hsa
cccugaccgugcugaacagacccccccacacgagagaaaauaaaggagcaauaaagucacg

SEQ ID NO: 216555 - RNA, 61 nt, hsa
acccuuaauacacauaagauaauuaaugcuggagagaaacccuacaaaugugaagaaugug

SEQ ID NO: 216556 - RNA, 61 nt, hsa
uaccuuacuaaauauaagauaauucauauuggagagaaauucuacagaugugaagaaugug

SEQ ID NO: 216557 - RNA, 61 nt, hsa
uccauuaguaaacauaagauaauucauacuggagagaaaaccuacaaaugugaggaaugug

SEQ ID NO: 216558 - RNA, 61 nt, hsa
acccuuacuacacauuagauaauucaugcuggagagaaacccuacaaaugugaaaaaugug

SEQ ID NO: 216559 - RNA, 61 nt, hsa
ccucaacuccuaguaaacauaauuaaugauggagagaaaccauacaacugugaagaaugug

SEQ ID NO: 216560 - RNA, 61 nt, hsa
caaacuuuauugaacaaaauaauucauacaggagagaaacccuacaaaugugaagaaugug

SEQ ID NO: 216561 - RNA, 61 nt, hsa
auuuuuacuaaacauaagaaaauucauacuggagagaaacccuaugauugugaaaaauaug

SEQ ID NO: 216562 - RNA, 61 nt, hsa
ucccugcuucaacaucacaguauucauacuggagagaaaccuuacgaauguauuaaaugug

SEQ ID NO: 216563 - RNA, 61 nt, hsa
aaucuuacugcccaucaaagaguacauaauggagagaaacccaauagugugguaagugugg

SEQ ID NO: 216564 - RNA, 61 nt, hsa
aaucucauuacacaucagaaaauucacacuggagagaaaccuuaugaaugcagugaaugug

SEQ ID NO: 216565 - RNA, 61 nt, hsa
aaccucacugaacaugagaaaauucauacuggagagaaaccuuaucauuguaaucaaugug

SEQ ID NO: 216566 - RNA, 61 nt, hsa
aaucuucuugagcaugaaaaaauucauacuggagagaaaccauucaaauguaaugaaugug

SEQ ID NO: 216567 - RNA, 61 nt, hsa
cgggacagagugagacccugucugaaagaaagagagaaagaaagaaagaaagagagagaaa

SEQ ID NO: 216568 - RNA, 61 nt, hsa
ugaaagaaagagagaaagaaagaaagaaagagagagaaagaaagaaagaaagaaagggaaa

SEQ ID NO: 216569 - RNA, 61 nt, hsa
aaggaaggaaaaagaaagagaaagagagagagagagaaagaaaaagaaagaaaaguaagaa

SEQ ID NO: 216570 - RNA, 61 nt, hsa
agccuugcaugucaucauagacuucauacuggagagaaaccuuacaaaugugaagcaugug

SEQ ID NO: 216571 - RNA, 61 nt, hsa
cgccuuaaaagacauaggagaauucauacuggagagaaaccuuacaaguguaaugagugug

SEQ ID NO: 216572 - RNA, 61 nt, hsa
uaccuugcaguucaucagugaacucauacuggagagaaaccuuacaaaugucaugacugug

SEQ ID NO: 216573 - RNA, 61 nt, hsa
uccuaugcaaaacauaggagaauucaugcaggagagaaaugucacaagugugaugaguguu

SEQ ID NO: 216574 - RNA, 61 nt, hsa
caccucauuagacaucagagaaucccuacuggagagaaaucuuacaaaugucaucagugug

SEQ ID NO: 216575 - RNA, 61 nt, hsa
ccuuggagcacugagcaccauuuggaagcuugagagaaaccaaaauuaaagagagaaagag

SEQ ID NO: 216576 - RNA, 61 nt, hsa
auuuggaagcuugagagaaaccaaaauuaaagagagaaagagagagcgugcacgcuccugc

SEQ ID NO: 216577 - RNA, 61 nt, hsa
acaccccagugucacagggcgagcuguucuggagagaaaaccaucugucguggcugagcgg

SEQ ID NO: 216578 - RNA, 61 nt, hsa
agggucuggugauggcagggauggggggagagagagaaaauccacaaauuccaaugucaca

SEQ ID NO: 216579 - RNA, 61 nt, hsa
aacagaaacccgagaaagagagagacagagagagagaaaaaaaaucacccaccaccccccc

SEQ ID NO: 216580 - RNA, 61 nt, hsa
aaccuuaauguguguaugugaacucacauuggagagaaacccugcaauuuaaaugguaugg

SEQ ID NO: 216581 - RNA, 61 nt, hsa
agccuuaccaaacacaucagaaaucucacuggagagaaacuguaugaauguagagaaucug

SEQ ID NO: 216582 - RNA, 61 nt, hsa
aacuugagaaauaaagggacagaguacaaaagagagaaauuuuaaagcuggguguccgggg

SEQ ID NO: 216583 - RNA, 61 nt, hsa
uauuccucaccccaccugugaacuccuaccagagagaaaccuuuuguauguaaagaauuug

SEQ ID NO: 216584 - RNA, 61 nt, hsa
ggcuuucgagugcacaugagaaugcacacuggagagaaaccuuauaaauguaaggauugug

SEQ ID NO: 216585 - RNA, 61 nt, hsa
uauauucauauacaugaacgaauucauacuggagagaaacccuaugaauguaaagaaugug

SEQ ID NO: 216586 - RNA, 61 nt, hsa
gguuuccagauacaugaaagaacccacacuggagagaaaccuuaugaauguaaacagugug

SEQ ID NO: 216587 - RNA, 61 nt, hsa
ucagcucaaagacaugaaaggacucauacuggagagaaacccuacaaauguaaggaaugug

SEQ ID NO: 216588 - RNA, 61 nt, hsa
ucugcucaaagacaugaaaagacucauacuggagagaaacccuacaaaugcaaggaaugug

SEQ ID NO: 216589 - RNA, 61 nt, hsa
ucugcucaaaaacaugaaaaggcucauacuggagagaaacccuacaaauguaaggaaugug

SEQ ID NO: 216590 - RNA, 61 nt, hsa
ugccuucuacaacaugaaagaauucacacucgagagaaaccuuaugaagguaaacaaugug

SEQ ID NO: 216591 - RNA, 61 nt, hsa
ucuugucuaagacaugaaaaaacucacacuggagagaaacucuguacauguaaacaaugug

SEQ ID NO: 216592 - RNA, 61 nt, hsa
uuauuucguaugcaugaaagaacucacucuggagagaaacuauaugaauguaagcaguguu

SEQ ID NO: 216593 - RNA, 61 nt, hsa
aucuuuuaaagacaccugagaauauauacuggagagaaacuauaaagaaaauucuauaucc

SEQ ID NO: 216594 - RNA, 61 nt, hsa
uccuuuuggauguaugagaguacuuacgcuggagagaaauucaaggaauguaaacggugug

SEQ ID NO: 216595 - RNA, 61 nt, hsa
aaucuuacuaaacauaaaaaaacuuaaacuggagagaaacuacaaagcuggaagacaucac

SEQ ID NO: 216596 - RNA, 61 nt, hsa
auccuuaugaaacaaaagauaauucauacuagagagaaacccuacaaauguaaagaaugug

SEQ ID NO: 216597 - RNA, 61 nt, hsa
cuuuuauuaaaacacaagauaauucauacuggagagaaauccuacaaaugugauaaaugug

SEQ ID NO: 216598 - RNA, 61 nt, hsa
aggcuuacuacauauaagacaacucauacuggagagaaaccaugcaugugugaagaaugug

SEQ ID NO: 216599 - RNA, 61 nt, hsa
aaccuuguggaacauaagagaauucauacuggagagaaacccuacaaaugcgaagaaugug

SEQ ID NO: 216600 - RNA, 61 nt, hsa
aucuuuauuacacauaagaaaauucaugcuggagagaaacacuacaaacgugaagaaugug

SEQ ID NO: 216601 - RNA, 61 nt, hsa
cagucuaguaaacauaagaaaauucauacuggagagaaaaucuacaaaggugaagaaugug

SEQ ID NO: 216602 - RNA, 61 nt, hsa
uccuaugcaaaacauaggagaauuuauacaggagagaaaccucacaagugugaugauugug

SEQ ID NO: 216603 - RNA, 61 nt, hsa
cauauugcaggucaucggugaacucauacuggagagaaaccuuacaaaugucaugacugug

SEQ ID NO: 216604 - RNA, 61 nt, hsa
caccuggaacaacauacuggacuucacacuggagagaaaccuuacaaguguaaugagugug

SEQ ID NO: 216605 - RNA, 61 nt, hsa
acaccuuaaagacauaggagaauuuauacuggagagaaagcuuacaaauguaagguuucug

SEQ ID NO: 216606 - RNA, 61 nt, hsa
uccuaugcaaaacauaggagaauucauacaggagagaaaccucacaugugugaugauugug

SEQ ID NO: 216607 - RNA, 61 nt, hsa
uacauugcaguucauugacacacucauacuggagagaaaccuuacaaaugucaugacugug

SEQ ID NO: 216608 - RNA, 61 nt, hsa
uccuaugcaaaacauaggaggauucauacaggagagaaacucacaagugugaugauugugg

SEQ ID NO: 216609 - RNA, 61 nt, hsa
uauauugcuauucaucaucgaacucaugcuggagagaaaccuuauaaaugucaugauugug

SEQ ID NO: 216610 - RNA, 61 nt, hsa
caccuggcacaccauacuagaauucacacuggagagaaaccuuacaagugcaaugagugug

SEQ ID NO: 216611 - RNA, 61 nt, hsa
uaccuuguaauucaaaaggcaauucguauuggagagaaacccuacaaguguaaugaaugug

SEQ ID NO: 216612 - RNA, 61 nt, hsa
uaccuggcaaaacauauuagaauucaaacuggagagaaaccuuacaaaugugaugagugug

SEQ ID NO: 216613 - RNA, 61 nt, hsa
acccuuguaagucacaaagccauucauacuggagagaaacuuuacaaguguaaugaaugug

SEQ ID NO: 216614 - RNA, 61 nt, hsa
aaccuuguauaccaucauagacuucauaguggagagaaaccuuaaaaguguaaugagugug

SEQ ID NO: 216615 - RNA, 61 nt, hsa
uccuaugcaaaacauaggaggauucauacaggagagaaaccucacaagugugaugauugug

SEQ ID NO: 216616 - RNA, 61 nt, hsa
ugccuugcauuucacuggugaacucaugcuggagagaaaccuuauaaaugucaugauugag

SEQ ID NO: 216617 - RNA, 61 nt, hsa
cacguggcaccccauacuagaauucacacuggagagaaaccuuacaagugcaaugagugug

SEQ ID NO: 216618 - RNA, 61 nt, hsa
ggucaaaauucacaccuuguaauucauaguggagagaaaccuuacaagcacaaugaaugug

SEQ ID NO: 216619 - RNA, 61 nt, hsa
uaucuggcaaaacauacuagaauucacacuggagagaaacucauuauaaguguaaugagug

SEQ ID NO: 216620 - RNA, 61 nt, hsa
accuuugcacaucaccauagacuucauacuggagagaaaccuuacaaaugggaggaaugug

SEQ ID NO: 216621 - RNA, 61 nt, hsa
aacccuguaagucauaaggcaauucauacuggagagaaaccuuacaagcauaaugaaugug

SEQ ID NO: 216622 - RNA, 61 nt, hsa
uguuuuuuaaacaaaugaugcugagaauaaggagagaaaugaauguagagagagguagaga

SEQ ID NO: 216623 - RNA, 61 nt, hsa
aaggagagaaaugaauguagagagagguagagagagaaauaugaacucuaacaaaggacug

SEQ ID NO: 216624 - RNA, 61 nt, hsa
agagaccugccagaagauuaaaaaaaagaaugagagaaaagcccaguuaguggugugcaaa

SEQ ID NO: 216625 - RNA, 61 nt, hsa
ccucuuagaaucucuuaugaaaaaaugaucagagagaaaagugggguuuuguuuccccacc

SEQ ID NO: 216626 - RNA, 61 nt, hsa
cucugagcgagucucuagagggugagaauuugagagaaauaguaauuugauuauuucauuc

SEQ ID NO: 216627 - RNA, 61 nt, hsa
acuuucuuuuacaaaagaauauuacauauuugagagaaaauauuucuauuaaugguuuaau

SEQ ID NO: 216628 - RNA, 61 nt, hsa
ugucaagugaggacuucaucacauaugacacgagagaaaaguaagagcugguucuaaaauc

SEQ ID NO: 216629 - RNA, 61 nt, hsa
caauccagaggugccuucagggcaaagaauagagagaaagggagccgcugugcuggugggg

SEQ ID NO: 216630 - RNA, 61 nt, hsa
augauuggcauuaguuaccacagccugcccagagagaaacuaucuucucccaacauuuacu

SEQ ID NO: 216631 - RNA, 61 nt, hsa
auguuacaaccgcuguaaaaugacggagagagagagaaagaaucccagacauuaacgguau

SEQ ID NO: 216632 - RNA, 64 nt, hsa
gggaagagagacugaagucacaaccccugacugcuccucaaaagcuaacgguugcaccuccaag

SEQ ID NO: 216633 - RNA, 64 nt, hsa
ugcugccuauaaaucuuggaggaaucauuucuccuccucaaaaacugauucagaaacugacuug

SEQ ID NO: 216634 - RNA, 64 nt, hsa
accuuuguacccagacaaaacaauuauguuacauuccucaaaguggcaugggcuuucuucucua

SEQ ID NO: 216635 - RNA, 64 nt, hsa
agugccguauaaaacaaccugccucauauauuucuccucaaaacguuggacuauuugggaaaag

SEQ ID NO: 216636 - RNA, 64 nt, hsa
aaagcuuugguauuaaaagagguaaacaucaguuuccucaaacauuuuauucauguugaaugcc

SEQ ID NO: 216637 - RNA, 64 nt, hsa
uuuugugaaaauagaguuuugguaaucacuuucuuccucaaaauaaguccuucuguuaauuugu

SEQ ID NO: 216638 - RNA, 64 nt, hsa
uuggaacucuagcugauccuuggccaggaucagauccucaaaaggaaauauucaguuagcagug

SEQ ID NO: 216639 - RNA, 64 nt, hsa
gauuauuuacuuucucuuaucuuuuccuuaguguuccucaaauuauaucuauccucuaaaccag

SEQ ID NO: 216640 - RNA, 64 nt, hsa
cuauccucaaauuauuuauuuuauagugcugagauccucaaauaaucucaauuucaggagguuu

SEQ ID NO: 216641 - RNA, 64 nt, hsa
gaugaauucagugugagguccuguguccguacuauccucaaauuauuuauuuuauagugcugag

SEQ ID NO: 216642 - RNA, 64 nt, hsa
aagcugugcaauuauguaaaauuuucaacugucuuccucaaaauaaagaaguaugguaaucuuu

SEQ ID NO: 216643 - RNA, 64 nt, hsa
ugaacuuaauaacuguguacuguucggaagggguuccucaaauuuuuugacuuuuuuuguaugu

SEQ ID NO: 216644 - RNA, 52 nt, hsa
cugacaacagugaccagugagguccucaaauggaaacaagccacuuagccag

SEQ ID NO: 216645 - RNA, 64 nt, hsa
uaaagagaaauaugaauacaauuccccuaaacucuccucaaaagagaauucagucuacagccau

SEQ ID NO: 216646 - RNA, 64 nt, hsa
gaugacacucauugucauaauaaaacaaauaauuuccucaaauaacaaagaaaaaugauaccua

SEQ ID NO: 216647 - RNA, 64 nt, hsa
agaugggccauuaaggauucuucaaggaaaacauuccucaaaaugaucuuuagugccuuuauuc

SEQ ID NO: 216648 - RNA, 64 nt, hsa
ucaaaguuggggcaggcuggcuggcccgucauguuccucaaaagcacccuugacgucaagucuc

SEQ ID NO: 216649 - RNA, 64 nt, hsa
ugacaacaugcgaccgugaccaggaacacccgacuccucaaaagcaaaugagaucccgccucuu

SEQ ID NO: 216650 - RNA, 64 nt, hsa
auaaagaaaaaacuagaagaggagaaaaaggauuuccucaaauuuuaaauauguaacuucaggg

SEQ ID NO: 216651 - RNA, 64 nt, hsa
auuacauuuugaguaguaaggucuacagcauuguuccucaaacuuggcuacguauuggaaucac

SEQ ID NO: 216652 - RNA, 64 nt, hsa
uugaacuuccaguaggcccacaguuguugguuguuccucaaaacagguuguggcuccuguugaa

SEQ ID NO: 216653 - RNA, 64 nt, hsa
uguuugccauggagcacuagaugguccuuuucacuccucaaaaugcaugcccauugucuucagg

SEQ ID NO: 216654 - RNA, 64 nt, hsa
guguguuagggugagggaugauuguaaaauuugcuccucaaaggaaucaggccagacucaauuu

SEQ ID NO: 216655 - RNA, 64 nt, hsa
gucggcggcgcugggguugcagggaaaagacaaauccucaaagcguggacguguguccccaugg

SEQ ID NO: 216656 - RNA, 64 nt, hsa
gugaauaacugccuguuuuccuaaaucaaacccauccucaaaggaugaagacucaccaccaucc

SEQ ID NO: 216657 - RNA, 64 nt, hsa
auucagaagaguucacugcagaugcugcagguaguccucaaaaauggguuccagaaauguuuug

SEQ ID NO: 216658 - RNA, 64 nt, hsa
uuucugagucgccugcauuaucccauucuuauucuccucaaaccugugcauauaugacaugaaa

SEQ ID NO: 216659 - RNA, 64 nt, hsa
cacuucauagcaccaacagagauguaggaaaaauuccucaaaguauuugucauuucugagucgc

SEQ ID NO: 216660 - RNA, 64 nt, hsa
gaaauucuguuggacacucacuuccaccccaaacuccucaaaucaaaagccuucaaaacacgag

SEQ ID NO: 216661 - RNA, 64 nt, hsa
ucaauuggaauuuuuagagcauaaucuuuauggauccucaaagcugacuuugccaaagggauug

SEQ ID NO: 216662 - RNA, 64 nt, hsa
augguaacugugugauuuagaaaccugaguuuacuccucaaaucgaauuauuuucuuuuuaaau

SEQ ID NO: 216663 - RNA, 64 nt, hsa; identical to SEQ ID NO: 76961

SEQ ID NO: 216664 - RNA, 64 nt, hsa; identical to SEQ ID NO: 76962

SEQ ID NO: 216665 - RNA, 64 nt, hsa; identical to SEQ ID NO: 76963

SEQ ID NO: 216666 - RNA, 64 nt, hsa; identical to SEQ ID NO: 76964

SEQ ID NO: 216667 - RNA, 64 nt, hsa; identical to SEQ ID NO: 76965

SEQ ID NO: 216668 - RNA, 64 nt, hsa; identical to SEQ ID NO: 76966

SEQ ID NO: 216669 - RNA, 64 nt, hsa; identical to SEQ ID NO: 76967

SEQ ID NO: 216670 - RNA, 64 nt, hsa; identical to SEQ ID NO: 76968

SEQ ID NO: 216671 - RNA, 64 nt, hsa; identical to SEQ ID NO: 76969

SEQ ID NO: 216672 - RNA, 64 nt, hsa; identical to SEQ ID NO: 76970

SEQ ID NO: 216673 - RNA, 64 nt, hsa; identical to SEQ ID NO: 76971

SEQ ID NO: 216674 - RNA, 64 nt, hsa; identical to SEQ ID NO: 76972

SEQ ID NO: 216675 - RNA, 64 nt, hsa; identical to SEQ ID NO: 76973

SEQ ID NO: 216676 - RNA, 64 nt, hsa; identical to SEQ ID NO: 76974

SEQ ID NO: 216677 - RNA, 64 nt, hsa; identical to SEQ ID NO: 76975

SEQ ID NO: 216678 - RNA, 64 nt, hsa; identical to SEQ ID NO: 76976

SEQ ID NO: 216679 - RNA, 64 nt, hsa; identical to SEQ ID NO: 76977

SEQ ID NO: 216680 - RNA, 64 nt, hsa; identical to SEQ ID NO: 76978

SEQ ID NO: 216681 - RNA, 64 nt, hsa; identical to SEQ ID NO: 76979

SEQ ID NO: 216682 - RNA, 64 nt, hsa; identical to SEQ ID NO: 76980

SEQ ID NO: 216683 - RNA, 64 nt, hsa; identical to SEQ ID NO: 76981

SEQ ID NO: 216684 - RNA, 64 nt, hsa; identical to SEQ ID NO: 76982

SEQ ID NO: 216685 - RNA, 64 nt, hsa; identical to SEQ ID NO: 76983

SEQ ID NO: 216686 - RNA, 64 nt, hsa; identical to SEQ ID NO: 76984

SEQ ID NO: 216687 - RNA, 64 nt, hsa; identical to SEQ ID NO: 76985

SEQ ID NO: 216688 - RNA, 64 nt, hsa; identical to SEQ ID NO: 76986

SEQ ID NO: 216689 - RNA, 64 nt, hsa; identical to SEQ ID NO: 76987

SEQ ID NO: 216690 - RNA, 64 nt, hsa; identical to SEQ ID NO: 76988

SEQ ID NO: 216691 - RNA, 64 nt, hsa; identical to SEQ ID NO: 76989

SEQ ID NO: 216692 - RNA, 64 nt, hsa; identical to SEQ ID NO: 76990

SEQ ID NO: 216693 - RNA, 64 nt, hsa; identical to SEQ ID NO: 76991

SEQ ID NO: 216694 - RNA, 64 nt, hsa; identical to SEQ ID NO: 76992

SEQ ID NO: 216695 - RNA, 64 nt, hsa; identical to SEQ ID NO: 76993

SEQ ID NO: 216696 - RNA, 64 nt, hsa; identical to SEQ ID NO: 76994

SEQ ID NO: 216697 - RNA, 64 nt, hsa; identical to SEQ ID NO: 76995

SEQ ID NO: 216698 - RNA, 64 nt, hsa; identical to SEQ ID NO: 76996

SEQ ID NO: 216699 - RNA, 64 nt, hsa; identical to SEQ ID NO: 76997

SEQ ID NO: 216700 - RNA, 64 nt, hsa; identical to SEQ ID NO: 76998

SEQ ID NO: 216701 - RNA, 64 nt, hsa; identical to SEQ ID NO: 76999

SEQ ID NO: 216702 - RNA, 64 nt, hsa; identical to SEQ ID NO: 77000

SEQ ID NO: 216703 - RNA, 64 nt, hsa; identical to SEQ ID NO: 77001

SEQ ID NO: 216704 - RNA, 64 nt, hsa; identical to SEQ ID NO: 77002

SEQ ID NO: 216705 - RNA, 64 nt, hsa; identical to SEQ ID NO: 77003

SEQ ID NO: 216706 - RNA, 64 nt, hsa; identical to SEQ ID NO: 77004

SEQ ID NO: 216707 - RNA, 64 nt, hsa; identical to SEQ ID NO: 77005

SEQ ID NO: 216708 - RNA, 64 nt, hsa; identical to SEQ ID NO: 77006

SEQ ID NO: 216709 - RNA, 64 nt, hsa; identical to SEQ ID NO: 77007

SEQ ID NO: 216710 - RNA, 64 nt, hsa; identical to SEQ ID NO: 77008

SEQ ID NO: 216711 - RNA, 64 nt, hsa; identical to SEQ ID NO: 77009

SEQ ID NO: 216712 - RNA, 64 nt, hsa; identical to SEQ ID NO: 77010

SEQ ID NO: 216713 - RNA, 64 nt, hsa; identical to SEQ ID NO: 77011

SEQ ID NO: 216714 - RNA, 64 nt, hsa; identical to SEQ ID NO: 77012

SEQ ID NO: 216715 - RNA, 64 nt, hsa; identical to SEQ ID NO: 77013

SEQ ID NO: 216716 - RNA, 64 nt, hsa; identical to SEQ ID NO: 77014

SEQ ID NO: 216717 - RNA, 64 nt, hsa; identical to SEQ ID NO: 77015

SEQ ID NO: 216718 - RNA, 64 nt, hsa
ucauuuugaugaaaaauauuccaagacuaaguugagaaaagagauacuauuuuggauguguauc

SEQ ID NO: 216719 - RNA, 64 nt, hsa
agcauauaagugaaaagucuuauaaguguaauagagaaaagauuugucaguguguuuuuuuaaa

SEQ ID NO: 216720 - RNA, 64 nt, hsa
cacagaguauacuaaagugaauuauuuguuacaaagaaaagagaugccagccagguauuuuaag

SEQ ID NO: 216721 - RNA, 64 nt, hsa
uuaugucaugccuugcacaaaagugaugaaaucuagaaaagauugugugucaccccuguuuauu

SEQ ID NO: 216722 - RNA, 64 nt, hsa
gucuaggaccuaucauuucaucagagacaugaucagaaaagaaacugcuucugccccauuucuu

SEQ ID NO: 216723 - RNA, 64 nt, hsa
cuguaaauaugaaagaacaaagguuauuuccuggagaaaagacaauuuauucaacaccaacgag

SEQ ID NO: 216724 - RNA, 64 nt, hsa
ucugaaaagcaauugcccuguaacuuaucuagaaagaaaagacccugagacuccagaaucugcu

SEQ ID NO: 216725 - RNA, 64 nt, hsa
ccaaaggggcugcuggggcaugugugccuguggcagaaaagaggagacccuggaauucagcacc

SEQ ID NO: 216726 - RNA, 64 nt, hsa
gcagagagagaaggaauggcgugggaugggggaaagaaaagaaagagaagaagcuggggucucc

SEQ ID NO: 216727 - RNA, 64 nt, hsa
aauuuucaaggggaaaaaaccugagaagaaagggagaaaagaccaugaaauuuaccagauaaca

SEQ ID NO: 216728 - RNA, 64 nt, hsa
gcuaaaacacuucuacuagggccaaaaagagaaaagaaaagaaaauuucuacuaauuucagacc

SEQ ID NO: 216729 - RNA, 64 nt, hsa
uggaagcuaaaacacuucuacuagggccaaaaagagaaaagaaaagaaaauuucuacuaauuuc

SEQ ID NO: 216730 - RNA, 64 nt, hsa
gggaagaagaucaaagaagaaaagaagaaggggaagaaaagaaggggaagaagaucaaaaccca

SEQ ID NO: 216731 - RNA, 64 nt, hsa
aaggggaagaaaagaaggggaagaagaucaaagaagaaaagaagaaggggaagaaaagaagggg

SEQ ID NO: 216732 - RNA, 64 nt, hsa
uuuauugcagaaauugaaaagaaggggaaggggaagaaaagaaggggaagaagaucaaagaaga

SEQ ID NO: 216733 - RNA, 64 nt, hsa
augaagaaaaguaauuagaauauuuucaacauaaagaaaagacgaauauuuaaggugacagaua

SEQ ID NO: 216734 - RNA, 64 nt, hsa
aaaaagaagagagggaggaagaaagggagagagaagaaaagaaaaaugaagaaaaguaauuaga

SEQ ID NO: 216735 - RNA, 64 nt, hsa
uaaugucauuagugacaaagauuugcaacauuagagaaaagagacacaaauauaaaauuaaaaa

SEQ ID NO: 216736 - RNA, 64 nt, hsa
caagagcaaaacuccagcucaaaaaaaaaaagaaagaaaagaaagcuggagcugguggcuuagg

SEQ ID NO: 216737 - RNA, 64 nt, hsa
uugaagccaaaaggauuuaaaaccgcugcucuaaagaaaagaaaacuggaggcugggcgcagug

SEQ ID NO: 216738 - RNA, 64 nt, hsa
cuaguuucuagugucacugaugaacuagugauguagaaaagagacuucucuguaaguaauugcc

SEQ ID NO: 216739 - RNA, 64 nt, hsa
uuccuuaugggaucauuuuuccaggacucuuugaagaaaagaaaaaacaacuaaaaaaauuuuu

SEQ ID NO: 216740 - RNA, 64 nt, hsa
uccuauauuuccauauugugugcaaaggaugggcagaaaagaaagugcuugaaagauuucaaau

SEQ ID NO: 216741 - RNA, 64 nt, hsa
ucauuuaaacuuugaugcuuaguuauguugcuggagaaaagauacuuauguuuugcucaucuaa

SEQ ID NO: 216742 - RNA, 64 nt, hsa
ugcuccucacagcuuugggaaucugaauggaagaagaaaagagagaaguuaacaaccuccacug

SEQ ID NO: 216743 - RNA, 64 nt, hsa
gacuacuguccaguaaggaggcccauugucacuuagaaaagacaccuggaacccaugugcauuu

SEQ ID NO: 216744 - RNA, 64 nt, hsa
cucuguuguggugggcauagguggcaccaucuaaagaaaagaggucuuguuuuuuguuuaaaaa

SEQ ID NO: 216745 - RNA, 64 nt, hsa
ucccuucacugcuggaaaaauccacuggcucccaagaaaagaaaauggucugaagccucuguug

SEQ ID NO: 216746 - RNA, 64 nt, hsa
gugaccuaguguacugggcagcugguggcggugcagaaaagagucucagguuauuuuuuguuuu

SEQ ID NO: 216747 - RNA, 64 nt, hsa
agagaaaacugguaaagaacauuccaguaggaaaagaaaagaacaaucuuccauuucugggcuu

SEQ ID NO: 216748 - RNA, 64 nt, hsa
caaaggcuuaaaggcagugaaaauggccagccagagaaaagaucucaagaaccagaaauaaaua

SEQ ID NO: 216749 - RNA, 64 nt, hsa
agcuagacacaaugaaacaucagagccagcuaagagaaaagaaauauuuggaggauauugaaag

SEQ ID NO: 216750 - RNA, 64 nt, hsa
ggugagaaaacuaaaacuacaugaguuucauguuagaaaagaauuuuuaaacaaucuucagaug

SEQ ID NO: 216751 - RNA, 64 nt, hsa
caaauccccuugaugcuaccuuugaaauauaacuagaaaagaaugacuugccaccauauccacu

SEQ ID NO: 216752 - RNA, 64 nt, hsa
uuuacuagaaaauaguucaguguaauauuaaguuagaaaagaaguugcugcccaguuaaagggg

SEQ ID NO: 216753 - RNA, 64 nt, hsa
auccgaaagaauagacugugaaaugaguucuuaaagaaaagacuuguuuauguauuaaaaaaac

SEQ ID NO: 216754 - RNA, 64 nt, hsa
agaaagaaaugucuuuauacaaaagacaugauagagaaaagaugagagaggggacuaauuauuu

SEQ ID NO: 216755 - RNA, 64 nt, hsa
aguauaaaugaaugggccaugaguguucagagggagaaaagaaagguuuaauauacuccuucag

SEQ ID NO: 216756 - RNA, 64 nt, hsa
ugguaaaaggagggagccugcugagccaggagggagaaaagaagauugaccagcuugcuagaaa

SEQ ID NO: 216757 - RNA, 64 nt, hsa
gaggaacaaggauggggagguaggaaugagguauagaaaagagauagcaucuucuuuggcacaa

SEQ ID NO: 216758 - RNA, 64 nt, hsa
uuuaguucacuauuauauaguggguuauauuaaaagaaaagaagaaaaauaucuaauuucucuu

SEQ ID NO: 216759 - RNA, 64 nt, hsa
auggucauauuugaaauguauaaguccauaaaauagaaaagaacaagugaauuguugcuauuua

SEQ ID NO: 216760 - RNA, 64 nt, hsa
ggugacagagugagacucuguuucaaaaaagaaaagaaaagaaacaugguucaaauuauaucua

SEQ ID NO: 216761 - RNA, 64 nt, hsa
agccuggugacagagugagacucuguuucaaaaaagaaaagaaaagaaacaugguucaaauuau

SEQ ID NO: 216762 - RNA, 64 nt, hsa
augugguuagaagccaucagaggugcaagggcuuagaaaagacccuggccagaccugacuccac

SEQ ID NO: 216763 - RNA, 64 nt, hsa
cagugaacuagcaaagaaaagcaaagaaguauucagaaaagagaugucccaguucaucguccag

SEQ ID NO: 216764 - RNA, 64 nt, hsa
gcagaggaaagccaagaacagccuuuauuggugaagaaaagaaugaaugauucuuuguaggcgc

SEQ ID NO: 216765 - RNA, 64 nt, hsa
aaaaaguuuuuuuuaaucugucuuucaaguuuacagaaaagaaagcaguaaaugcauugauguc

SEQ ID NO: 216766 - RNA, 64 nt, hsa
aagcagaucacauguaaaucauuccuaaagcacaagaaaagaaugugccuugauguacauauau

SEQ ID NO: 216767 - RNA, 64 nt, hsa
auacuauuucuucaaggcaaguaaauugaccaugagaaaagaacacaguuauuaaacacuguug

SEQ ID NO: 216768 - RNA, 64 nt, hsa
ucaucuccugcuugucugacugcaaguuuuuuaaagaaaagaggaacuggagaaacgacuucca

SEQ ID NO: 216769 - RNA, 64 nt, hsa
caagcgauucuucugccucagccucccaaaugucagaaaagaaagcauacaugcuuaugcauga

SEQ ID NO: 216770 - RNA, 64 nt, hsa
ugcaugugguuuccugccaagccuaaaccugagaagaaaagauauuuccucuuuggaaugcugu

SEQ ID NO: 216771 - RNA, 64 nt, hsa
uuuuuaagaaaugccagcugcuguagaccccaugagaaaagaugucuuaaucauccuuaugaaa

SEQ ID NO: 216772 - RNA, 64 nt, hsa
uuucuaacuuuauggacacuaaacuggagccaauagaaaagacaaaaaugaaagagacacaggg

SEQ ID NO: 216773 - RNA, 64 nt, hsa
uacucccugcccuucccccugcaaaaagaaaaaaagaaaagaaaaagaaaaaaaucccuuguuc

SEQ ID NO: 216774 - RNA, 55 nt, hsa
uugauguggacaugaagugaagagcagaaaagaugaauuuguccaauuguguaga

SEQ ID NO: 216775 - RNA, 64 nt, hsa
augaucaucucagccaacaugcaucaguacugcaagaaaagaagucaaucagcagaggagagca

SEQ ID NO: 216776 - RNA, 64 nt, hsa
guuucuggaauuccuuguuagggaacuuuaaagaagaaaagaaaaacuugaauuguguugaauu

SEQ ID NO: 216777 - RNA, 64 nt, hsa
uuuagauagcagaauuauuugcaauuuguagcauagaaaagauuuuuaaauuuuuuuacaaaag

SEQ ID NO: 216778 - RNA, 64 nt, hsa
acagggugagacccuuuuacacagaaugguggagagaaaagagaaugcugaaaaguggcucaga

SEQ ID NO: 216779 - RNA, 64 nt, hsa
gucuggccccaucgggucacaggugauggcaaauagaaaagaagcaaauggaggaaauagucgg

SEQ ID NO: 216780 - RNA, 64 nt, hsa
aggcucucacuagaguuaccauucauauuugagaagaaaagaacauuuaauaaauguaugugug

SEQ ID NO: 216781 - RNA, 64 nt, hsa
acaaaugauaucuaaagaucuauuuugccuuaccagaaaagaaaaaaaaaacccuaaaaccaaa

SEQ ID NO: 216782 - RNA, 64 nt, hsa
cuuuagggagcagccacacauacaggaagcucuuagaaaagaacuuuuuuuuuuuuuugagaca

SEQ ID NO: 216783 - RNA, 64 nt, hsa
ucacgacuuaauguauguuguaagaaaagaaaaaagaaaagaaaaaaagggaaaaaagaaaagc

SEQ ID NO: 216784 - RNA, 64 nt, hsa
cuaacaucugauucacgacuuaauguauguuguaagaaaagaaaaaagaaaagaaaaaaaggga

SEQ ID NO: 216785 - RNA, 64 nt, hsa
uaaagguaauauuagcaguuaaagaacacggaugagaaaagaauguguuacauagguugcauca

SEQ ID NO: 216786 - RNA, 64 nt, hsa
aaucuuggugccuucuguuaaaagucaguguaucagaaaagaaagcagccauguaagaggcuaa

SEQ ID NO: 216787 - RNA, 64 nt, hsa
cuaaauggugcaauaggcuaggaauugagccaggagaaaagagaagauaucccagaagucaaaa

SEQ ID NO: 216788 - RNA, 64 nt, hsa
augugaaaauauguuuugagaauaaaaacacagcagaaaagauuaaguacuacugccuaguugc

SEQ ID NO: 216789 - RNA, 64 nt, hsa
augcucugugaugguaaauaaaauuggagcagacagaaaagauauagcaaaugaagaaauauuu

SEQ ID NO: 216790 - RNA, 64 nt, hsa
guuagucuuaaagauuauuguuaaaaaauucagaagaaaagagagacaagugcucuucucucua

SEQ ID NO: 216791 - RNA, 64 nt, hsa
uaccacuuucauguaagcugguaggggauuuuugagaaaagaaggugggcacuaguauaucuaa

SEQ ID NO: 216792 - RNA, 64 nt, hsa
ucaagacauucacccuaaauucugaauuuuugucagaaaagagauuugauuuucaugaagguaa

SEQ ID NO: 216793 - RNA, 64 nt, hsa
gaaggaaauaauaaagugauagacagggaaggauagaaaagacuuaacaauauacauauguucc

SEQ ID NO: 216794 - RNA, 64 nt, hsa
uuguguauauagagaccauaauuauaugguccuuagaaaagacuuugcuuuuauaaagcauuua

SEQ ID NO: 216795 - RNA, 64 nt, hsa
uguguuuuuuaaaugguggccagguagaggaacuagaaaagagauuuuguugccuguuuucuga

SEQ ID NO: 216796 - RNA, 64 nt, hsa
ugcaccauguuaguaauaaacagaucugccuuaaagaaaagaaaauuuuagaaagaaauauugu

SEQ ID NO: 216797 - RNA, 58 nt, hsa
uauggaagauuaagucaugacaauucaaagaaaagaagauguagccucuuuuccagaa

SEQ ID NO: 216798 - RNA, 64 nt, hsa
uaauugcuaguuguaaaacuguauccaaauuuucagaaaagacagcuucagcuugcaaauucua

SEQ ID NO: 216799 - RNA, 64 nt, hsa
cuucuagauuccagacagaaaaaaauuacacuucagaaaagacaucaaaggcaacauaugacaa

SEQ ID NO: 216800 - RNA, 64 nt, hsa
aagagcgagacuccgucucaaaaacaaaaaaaaaagaaaagaaauauauuuuauucauucacau

SEQ ID NO: 216801 - RNA, 64 nt, hsa
uuguacccuguugcucagagaaauuauucauaagagaaaagaauuccaauuaauuaaauaucac

SEQ ID NO: 216802 - RNA, 64 nt, hsa
cucuugggugagcaacggcaccuauuuggaacuuagaaaagaucuugguuuuuccaaacuggac

SEQ ID NO: 216803 - RNA, 64 nt, hsa
aagagcaaaacuccgucucaaaaaagaaaagaaaagaaaagaaaucauagggccaaguucaaag

SEQ ID NO: 216804 - RNA, 64 nt, hsa
gcaacaagagcaaaacuccgucucaaaaaagaaaagaaaagaaaagaaaucauagggccaaguu

SEQ ID NO: 216805 - RNA, 64 nt, hsa
ccugggcaacaagagcaaaacuccgucucaaaaaagaaaagaaaagaaaagaaaucauagggcc

SEQ ID NO: 216806 - RNA, 64 nt, hsa
aaugcaguuaagaauucuggcacccuuguaaggaagaaaagagaguucaacaccuucgagucug

SEQ ID NO: 216807 - RNA, 64 nt, hsa
uguccaaaaagggcuucaaggcccacuucuucucagaaaagaggccagcucugcagcccccucg

SEQ ID NO: 216808 - RNA, 64 nt, hsa
cggggacgcccccaccagcucaaauuccgagugcagaaaagaaaccggaccccccagugaggcc

SEQ ID NO: 216809 - RNA, 64 nt, hsa
guuuaauugaacccauccacucugggcagguaagagaaaagaaaaagauaaggaaagaagagag

SEQ ID NO: 216810 - RNA, 64 nt, hsa
agaaaaaaauagcucaagacacaguuaaucgagaagaaaagaaauauguacagaaccauaaaga

SEQ ID NO: 216811 - RNA, 64 nt, hsa
ugaguacauuaaguaaaauaaaauggaccagaaaagaaaagaaaccauaaauaucgugucauau

SEQ ID NO: 216812 - RNA, 64 nt, hsa
acuagugaguacauuaaguaaaauaaaauggaccagaaaagaaaagaaaccauaaauaucgugu

SEQ ID NO: 216813 - RNA, 64 nt, hsa
uuccuuuugcaauuacugaaaguggcugcaacagagaaaagacuuccauaaaggacgacaaaag

SEQ ID NO: 216814 - RNA, 64 nt, hsa
auauuuacagacuccuaacuacagguacaauagaagaaaagaucuaucaaaggcagaucaguaa

SEQ ID NO: 216815 - RNA, 64 nt, hsa
aaaaggaauguagcucaacuugugauaaaaaugaagaaaagagucuauacaaaggcuugcuaag

SEQ ID NO: 216816 - RNA, 64 nt, hsa
aagacaacuacagcccucauuagccuuucuugugagaaaagaauaauucuaacuggucaguauu

SEQ ID NO: 216817 - RNA, 64 nt, hsa
uuaccaagacauuaaaguagcauggcugcccaggagaaaagaagacauucuaauuccagucauu

SEQ ID NO: 216818 - RNA, 64 nt, hsa
ggcaagaaggacagcaguaaaugaagaccauggaagaaaagaaggaaugccaaagaucgaggaa

SEQ ID NO: 216819 - RNA, 64 nt, hsa
ccauacuguauaauuccauuuacaugaagcauccagaaaagauaaauguauagggacaaaaagu

SEQ ID NO: 216820 - RNA, 64 nt, hsa
aauaaaagauagaggugagagaugauuuacuuugagaaaagacauugugucaccuaugaaauuu

SEQ ID NO: 216821 - RNA, 64 nt, hsa
uaauauucaagugaucagacuuugagugacaucaagaaaagaugauaucagguucauuuuucaa

SEQ ID NO: 216822 - RNA, 64 nt, hsa
aacccucuuauuuuauaacuaaauaaauaaucacagaaaagaaugaucugaacaagaacagcug

SEQ ID NO: 216823 - RNA, 64 nt, hsa; identical to SEQ ID NO: 216820

SEQ ID NO: 216824 - RNA, 64 nt, hsa; identical to SEQ ID NO: 216819

SEQ ID NO: 216825 - RNA, 64 nt, hsa
uguuucacuaauacuuacuguuaacugucuugagagaaaagaaaaauaugagagaacuauuguu

SEQ ID NO: 216826 - RNA, 64 nt, hsa
uagacuuuccuuugcaccaugugaaguguuguggagaaaagagccagaaguugaugugggaaga

SEQ ID NO: 216827 - RNA, 64 nt, hsa
ugucaucuaaauauuccgaauguuuggccuucugagaaaagagcuucuaguaauugaaccaugg

SEQ ID NO: 216828 - RNA, 64 nt, hsa
ggcaccucugaacccaggcacuuuaaacuucuauagaaaagauaucguguacauaggaacuggu

SEQ ID NO: 216829 - RNA, 64 nt, hsa
ugggaauauagagaggguucauguggcauuuuagagaaaagauaauuuauccucauucaacaca

SEQ ID NO: 216830 - RNA, 64 nt, hsa
aaaaugagugguucaguucauuccccuaaacagaagaaaagaccaaauaauuaccuuccauucc

SEQ ID NO: 216831 - RNA, 64 nt, hsa
gaugcauuaaaagaaaauaaaaaaaagaaaaaagagaaaagaaaaaaaaagaaaaaaguuguag

SEQ ID NO: 216832 - RNA, 64 nt, hsa
guuguuuguauguauaauucaaagcaccaaaauaagaaaagauguagauuuauuucaucauauu

SEQ ID NO: 216833 - RNA, 64 nt, hsa
aaaaacaagaaugaaaaacagaaauaaaagaaguagaaaagacaaagaaagaaagcccaaaguc

SEQ ID NO: 216834 - RNA, 64 nt, hsa
gaaaaugucaagcugauuuacuuuauucacauggagaaaagaauccacaaauuaaacugagucc

SEQ ID NO: 216835 - RNA, 64 nt, hsa
cucacauuaagcgguuacucagacaguuaaucauagaaaagauuauuugcuucaucaguucaua

SEQ ID NO: 216836 - RNA, 64 nt, hsa
aucauagaaaagauuauuugcuucaucaguucauagaaaagauuauuugcuucaucaguuaacu

SEQ ID NO: 216837 - RNA, 64 nt, hsa
uccccccgcaaaaaaaaaaaagaaagaaagaaagagaaaagaaaagaaaagcaaccacagccag

SEQ ID NO: 216838 - RNA, 64 nt, hsa
ccgcaaaaaaaaaaaagaaagaaagaaagagaaaagaaaagaaaagcaaccacagccagccuua

SEQ ID NO: 216839 - RNA, 64 nt, hsa
gggcauuuuuuauguuacaaaaaaaaauuacgaaagaaaagaaaucucuaugcaaaaugacgaa

SEQ ID NO: 216840 - RNA, 64 nt, hsa
cccugcgagcccuuuuuauuugagaaggaaaaagagaaaagagaaucguuuaagggaacccggc

SEQ ID NO: 216841 - RNA, 64 nt, hsa
cacagucacucacugccauucucacacuauaacaagaaaagaaaugaagugcauaagucuccug

SEQ ID NO: 216842 - RNA, 64 nt, hsa
ugcuagacaccuucgcuuguuaucuugucaagauagaaaagauaguaucauuucacccuugcca

SEQ ID NO: 216843 - RNA, 64 nt, hsa
auuaauggcaugauuuuuuuuaugcaaaaagaaaagaaaagaaaaccacccacauuuuaauuua

SEQ ID NO: 216844 - RNA, 64 nt, hsa
cacacauuaauggcaugauuuuuuuuaugcaaaaagaaaagaaaagaaaaccacccacauuuua

SEQ ID NO: 216845 - RNA, 64 nt, hsa
uuuucauggagguuucauuuuaauggagcaggagagaaaagagagaucuacuuuggugguuucu

SEQ ID NO: 216846 - RNA, 64 nt, hsa
ccugcacaaagcaaccgccaaauuguuucagagcagaaaagaaaaagggagaaaaccucuuagc

SEQ ID NO: 216847 - RNA, 64 nt, hsa
uaugguaacuguaauauggguaaaaguuuauucaagaaaagaguacuugguagaagauucuuua

SEQ ID NO: 216848 - RNA, 64 nt, hsa
ccaaaaaauucuuaucucuguaugugauuggaaaagaaaagaucacauuuguauauucaacaau

SEQ ID NO: 216849 - RNA, 64 nt, hsa
cuccaucucaaaaauaaaauaaaaaaagaaagaaagaaaagaagaagaaaagagaagaaggaga

SEQ ID NO: 216850 - RNA, 64 nt, hsa
aaauaaaauaaaaaaagaaagaaagaaaagaagaagaaaagagaagaaggagaaggagaugaag

SEQ ID NO: 216851 - RNA, 64 nt, hsa
cagaauuaaaauuauauuguagaaggaaacaccaagaaaagaauuuccagggaaaauccucuuu

SEQ ID NO: 216852 - RNA, 64 nt, hsa
aacgaucuugacugugcaacucagacauuccugcagaaaagacauauguugcuuuacaagaagg

SEQ ID NO: 216853 - RNA, 64 nt, hsa
acaccugcuucaggggaacacaggcgcuugaaaaagaaaagagagaacagcccauaaugcuccc

SEQ ID NO: 216854 - RNA, 64 nt, hsa
gaaaaauagacuuuauuuacaaguaauaacauuuagaaaagauccauccccggcccuuaaaaac

SEQ ID NO: 216855 - RNA, 64 nt, hsa
ugcccuuucacacugaaucuucaaguucuaaggaagaaaagagucuccuuucgaaugugaagaa

SEQ ID NO: 216856 - RNA, 64 nt, hsa
auggcaagagcccaacucuacuaaaaauacaaaaagaaaagaaaacagccaagcuuggugguau

SEQ ID NO: 216857 - RNA, 64 nt, hsa
gcucuaaaaauuuaaagguuguaauugaaauacaagaaaagagccuucuuuuagaagaaagcaa

SEQ ID NO: 216858 - RNA, 64 nt, hsa
aaccauauuuuaaaaguaccaauuuuguuuuuacagaaaagauaaaacucaaaagagaacagug

SEQ ID NO: 216859 - RNA, 64 nt, hsa
cuaccuuagcuggaccucgucucccagggauuagagaaaagagcaggaguccugggucuuccca

SEQ ID NO: 216860 - RNA, 64 nt, hsa
aaaaucagagccacgaugacccaaaggauaagaaagaaaagagagcucaggcccaaguggaguu

SEQ ID NO: 216861 - RNA, 64 nt, hsa
guucaagauggccaccacugguagacguguagauagaaaagaggacuggucuugggaacaucuu

SEQ ID NO: 216862 - RNA, 64 nt, hsa
ccuuagauguuacccagaugguucugggggagacagaaaagaggugcggcaggacucuuaucuu

SEQ ID NO: 216863 - RNA, 64 nt, hsa
aaucauaacuaaaacauugaaaacagaacaaaugagaaaagaaaaaaaaccugccgauuaacaa

SEQ ID NO: 216864 - RNA, 64 nt, hsa
uaggacuuggcugugagaaaaucaccuaaaucccagaaaagaggaagacagauuuaaagugccc

SEQ ID NO: 216865 - RNA, 64 nt, hsa
gcaagcugauauuuuaggugcucuaaagcaccuaagaaaagaacugcaaagucugagaaauagg

SEQ ID NO: 216866 - RNA, 64 nt, hsa
uccaaaauucugaagucuggaaguuuuuccuucaagaaaagaaacugcauaaaaaauuuaaaac

SEQ ID NO: 216867 - RNA, 64 nt, hsa
ugaaaauacauucuuaaacuaguugucugaauugagaaaagagugagaacuaggugugcaagaa

SEQ ID NO: 216868 - RNA, 64 nt, hsa
aacugauacaucugaugcaugcuuugagaccagaagaaaagacuuaccugaauaauuacuacau

SEQ ID NO: 216869 - RNA, 64 nt, hsa
caccaaaccaaaagaagguaggagugccauuuuuagaaaagacacaacuuuaauuccugucaag

SEQ ID NO: 216870 - RNA, 64 nt, hsa
uuuaaguguugucuaaacaguugauuuuuacuuuagaaaagaucaucuucaacuguuuauugac

SEQ ID NO: 216871 - RNA, 64 nt, hsa
guggccaaacaucagaaucgauuaaaaaaagugaagaaaagaagcgaauaaguaugcuauacau

SEQ ID NO: 216872 - RNA, 64 nt, hsa
auggucaggacacaagccucugucaaaaaagaagagaaaagaucgucugagaaaucugaaaaaa

SEQ ID NO: 216873 - RNA, 64 nt, hsa
uguuccuuucaguaguugccaucuuggccaugcaagaaaagaaaagaaggcauuuacucuaugu

SEQ ID NO: 216874 - RNA, 64 nt, hsa
cuuucaguaguugccaucuuggccaugcaagaaaagaaaagaaggcauuuacucuaugucgggg

SEQ ID NO: 216875 - RNA, 64 nt, hsa
gugcaauggguaagggagggaaggggaauggaagagaaaagacagggugggagggaggagggag

SEQ ID NO: 216876 - RNA, 64 nt, hsa
uggggagauaaaaagauuaagccccaacauguucagaaaagaagugaagucuuggguauuuuaa

SEQ ID NO: 216877 - RNA, 64 nt, hsa
uugaauuucgaaagaaauaauuggcaagauaaugagaaaagaaaaaagucaugguaggugaggu

SEQ ID NO: 216878 - RNA, 64 nt, hsa
uuguagccaagcagaguuguagagggggauaaaaagaaaagaaauuggauguauuuacagcugu

SEQ ID NO: 216879 - RNA, 64 nt, hsa
aaagcucaucaguucccauaaaugcaguugucaaagaaaagauuugguugccauagucauaagc

SEQ ID NO: 216880 - RNA, 64 nt, hsa
uguuuaauugcuacagagcuuuauagauauuuagagaaaagacuuaaucaauuaguaaauaaaa

SEQ ID NO: 216881 - RNA, 64 nt, hsa
auguuaucaugggagggaagucaaauaagaggagagaaaagaacucaagggggaaacugcauuu

SEQ ID NO: 216882 - RNA, 64 nt, hsa
caccaagucuccccuuugaagacuuugaggccacagaaaagacaguuaaagcaaagaagagaag

SEQ ID NO: 216883 - RNA, 64 nt, hsa
gaaugaagcaguguugucuauggaaguggggaguagaaaagaagauccccauugacagugagga

SEQ ID NO: 216884 - RNA, 64 nt, hsa
ccauugccgagaguccuguuauugagguagaaacagaaaagaaagacguucuugauuuugguga

SEQ ID NO: 216885 - RNA, 64 nt, hsa
gaguaaaacuauuugcaacugguuuucagaaaagagaaaagaaacaacaaaggaauugaaacag

SEQ ID NO: 216886 - RNA, 64 nt, hsa
aaaaguugaguaaaacuauuugcaacugguuuucagaaaagagaaaagaaacaacaaaggaauu

SEQ ID NO: 216887 - RNA, 64 nt, hsa
gccaccuaagucuucauuuaauuuauugucccccagaaaagauuaagaugcuacuugaaaagac

SEQ ID NO: 216888 - RNA, 64 nt, hsa
ggugggucugaaauucauacaugaagucaggaaaagaaaagaaacuuaguucuaccuugauuac

SEQ ID NO: 216889 - RNA, 64 nt, hsa
uuccucucuaguguauaacuuuaaauauuugcucagaaaagaugcugacucuuucauuauggaa

SEQ ID NO: 216890 - RNA, 64 nt, hsa
ggcaacaagagcaaaacuccgucucaaaauaaaaagaaaagaaaagaauggacaguguuugcag

SEQ ID NO: 216891 - RNA, 64 nt, hsa
caagagcaaaacuccgucucaaaauaaaaagaaaagaaaagaauggacaguguuugcagagagu

SEQ ID NO: 216892 - RNA, 64 nt, hsa
ucaaaaaaaaaaaaaaaaaaaaggaaagaaagaaagaaaagaaaagaaaauccuuuuugcuuua

SEQ ID NO: 216893 - RNA, 64 nt, hsa
aaaaaaaaaaaaaaaaaggaaagaaagaaagaaaagaaaagaaaauccuuuuugcuuuaacuug

SEQ ID NO: 216894 - RNA, 64 nt, hsa
gaagagagugggggccaauauucaacauucuuaaagaaaagaauuuucaacccagaauuucaua

SEQ ID NO: 216895 - RNA, 64 nt, hsa
aacaaaauugauagaccgcuagcaagacuaaugaagaaaagagagaagaaucaaauagaugcaa

SEQ ID NO: 216896 - RNA, 64 nt, hsa
agucuaaaauugcuucuuuaccaaggauauuuacagaaaagacucugaccagagaucgagacca

SEQ ID NO: 216897 - RNA, 64 nt, hsa
cagucuggcaacagagcaagacuccaucucaaaaagaaaagaaaagaagacucugaccuguacu

SEQ ID NO: 216898 - RNA, 64 nt, hsa
uggcaacagagcaagacuccaucucaaaaagaaaagaaaagaagacucugaccuguacucuuga

SEQ ID NO: 216899 - RNA, 64 nt, hsa
gggcaacacagcaagauccugucuaaaaauaaaaagaaaagagaaggaaaggaaagagacgggg

SEQ ID NO: 216900 - RNA, 64 nt, hsa
uucugaaacuacgguagggggcaggaagaggagcagaaaagaagggcugggcaaggcauagugg

SEQ ID NO: 216901 - RNA, 64 nt, hsa
cagagcaacacucugucucaaaaaaaaaaagaaaagaaaagaaaaagccagaaaaaguuggugc

SEQ ID NO: 216902 - RNA, 64 nt, hsa
ggcagcagagcaacacucugucucaaaaaaaaaaagaaaagaaaagaaaaagccagaaaaaguu

SEQ ID NO: 216903 - RNA, 64 nt, hsa
ggaaaggacucauucaugucacgcuuccuugagcagaaaagagcacugagagcacuugggaccc

SEQ ID NO: 216904 - RNA, 64 nt, hsa
cuuuuucacauuacuguuaaagaccagacguucuagaaaagaccccuccucucaugagcucccc

SEQ ID NO: 216905 - RNA, 64 nt, hsa
uuauuuuucucuuuaaaaaaaauagaagcuauaaagaaaagagggagagaugaguggguuagcu

SEQ ID NO: 216906 - RNA, 64 nt, hsa
guccaggggagggaaaagcuaagagggugaacaaagaaaagacauugaaagcucuauggauuau

SEQ ID NO: 216907 - RNA, 64 nt, hsa
aaguaauuuaccuguccaggaucaaaagaagccuagaaaagaagcaguaaucuaccucugccga

SEQ ID NO: 216908 - RNA, 64 nt, hsa
cugaacaaaagcagguuuuuauauguaaacagugagaaaagaaaggcuaaacacuauguaaaug

SEQ ID NO: 216909 - RNA, 64 nt, hsa
augcagcggccuccuugaagauccugauaaaugaagaaaagacacagagaaggaugugacaugc

SEQ ID NO: 216910 - RNA, 64 nt, hsa
acagagugaacucugucucaaaaaaaaaaaaaaaagaaaagaaagaagaagccauucccaacgu

SEQ ID NO: 216911 - RNA, 64 nt, hsa
uauuuagaaguaaaacacaaaacaaaaaagagagagaaaagaaaagaaaucacaauguauauaa

SEQ ID NO: 216912 - RNA, 64 nt, hsa
agaaguaaaacacaaaacaaaaaagagagagaaaagaaaagaaaucacaauguauauaaaacag

SEQ ID NO: 216913 - RNA, 64 nt, hsa
ccuuguaaagcuaaaauaguuacuucaaauuuucagaaaagauguauauagucaaaauuuaaga

SEQ ID NO: 216914 - RNA, 64 nt, hsa
uugauguugaaaauuuuaaacuuggggaagauuaagaaaagaaccaauagugacaaaaaucagu

SEQ ID NO: 216915 - RNA, 64 nt, hsa
acacaagaacuuaagagaaaaagaaaccuacucaagaaaagacagaagagacagugauuuggga

SEQ ID NO: 216916 - RNA, 64 nt, hsa
caaggagaacauaagagaaaaggaaaccuguuacagaaaagacaagaaucuguguuuuggaaug

SEQ ID NO: 216917 - RNA, 64 nt, hsa
aagaaggaaaaaaaaagcccaaacuuaaccucugagaaaagaacauaagaacucaaggagaaca

SEQ ID NO: 216918 - RNA, 64 nt, hsa
uggugaaaugucacuccauugacccaccgaaaaaagaaaagaaaucuguuucuaccaaacauuu

SEQ ID NO: 216919 - RNA, 64 nt, hsa
gcccaagugucaagaaccacaccagauuggagauagaaaagaauagcugaaauuaugucagugg

SEQ ID NO: 216920 - RNA, 64 nt, hsa
auaggccuggaagagacuguugaugccacuuugaagaaaagaacacugagaacuagaggaggga

SEQ ID NO: 216921 - RNA, 64 nt, hsa
uuuaggaaagaagaccuguuuauacauugaaggaagaaaagaaggaagcaguugccuuccggag

SEQ ID NO: 216922 - RNA, 64 nt, hsa; identical to SEQ ID NO: 216913

SEQ ID NO: 216923 - RNA, 64 nt, hsa
uugauguugaaaauuguaaacuuggggaagauuaagaaaagaaccaauagugacaaaaaucagu

SEQ ID NO: 216924 - RNA, 64 nt, hsa
uaacugccaggacacuuuuguguuugcccaggacuccuaguaagaauugaaucuugagggagua

SEQ ID NO: 216925 - RNA, 64 nt, hsa
aauucuuuuuuaaaauuuuaauuagauuuccuuuuccuaguaagaguugaugucugcuaguggu

SEQ ID NO: 216926 - RNA, 64 nt, hsa; identical to SEQ ID NO: 161670

SEQ ID NO: 216927 - RNA, 64 nt, hsa; identical to SEQ ID NO: 161671

SEQ ID NO: 216928 - RNA, 64 nt, hsa; identical to SEQ ID NO: 161672

SEQ ID NO: 216929 - RNA, 64 nt, hsa; identical to SEQ ID NO: 161673

SEQ ID NO: 216930 - RNA, 64 nt, hsa; identical to SEQ ID NO: 161674

SEQ ID NO: 216931 - RNA, 64 nt, hsa; identical to SEQ ID NO: 161675

SEQ ID NO: 216932 - RNA, 64 nt, hsa; identical to SEQ ID NO: 161676

SEQ ID NO: 216933 - RNA, 64 nt, hsa; identical to SEQ ID NO: 161677

SEQ ID NO: 216934 - RNA, 64 nt, hsa; identical to SEQ ID NO: 161678

SEQ ID NO: 216935 - RNA, 64 nt, hsa; identical to SEQ ID NO: 161679

SEQ ID NO: 216936 - RNA, 64 nt, hsa; identical to SEQ ID NO: 161680

SEQ ID NO: 216937 - RNA, 64 nt, hsa; identical to SEQ ID NO: 161681

SEQ ID NO: 216938 - RNA, 64 nt, hsa; identical to SEQ ID NO: 161682

SEQ ID NO: 216939 - RNA, 64 nt, hsa; identical to SEQ ID NO: 161683

SEQ ID NO: 216940 - RNA, 64 nt, hsa; identical to SEQ ID NO: 161684

SEQ ID NO: 216941 - RNA, 64 nt, hsa; identical to SEQ ID NO: 161685

SEQ ID NO: 216942 - RNA, 64 nt, hsa; identical to SEQ ID NO: 161686

SEQ ID NO: 216943 - RNA, 64 nt, hsa; identical to SEQ ID NO: 161687

SEQ ID NO: 216944 - RNA, 64 nt, hsa; identical to SEQ ID NO: 161688

SEQ ID NO: 216945 - RNA, 64 nt, hsa; identical to SEQ ID NO: 161689

SEQ ID NO: 216946 - RNA, 64 nt, hsa; identical to SEQ ID NO: 161690

SEQ ID NO: 216947 - RNA, 64 nt, hsa; identical to SEQ ID NO: 161691

SEQ ID NO: 216948 - RNA, 64 nt, hsa; identical to SEQ ID NO: 161692

SEQ ID NO: 216949 - RNA, 64 nt, hsa; identical to SEQ ID NO: 161693

SEQ ID NO: 216950 - RNA, 64 nt, hsa; identical to SEQ ID NO: 161694

SEQ ID NO: 216951 - RNA, 64 nt, hsa; identical to SEQ ID NO: 161695

SEQ ID NO: 216952 - RNA, 64 nt, hsa; identical to SEQ ID NO: 161696

SEQ ID NO: 216953 - RNA, 64 nt, hsa; identical to SEQ ID NO: 161697

SEQ ID NO: 216954 - RNA, 64 nt, hsa; identical to SEQ ID NO: 161698

SEQ ID NO: 216955 - RNA, 64 nt, hsa; identical to SEQ ID NO: 161699

SEQ ID NO: 216956 - RNA, 64 nt, hsa; identical to SEQ ID NO: 161700

SEQ ID NO: 216957 - RNA, 64 nt, hsa; identical to SEQ ID NO: 161701

SEQ ID NO: 216958 - RNA, 64 nt, hsa; identical to SEQ ID NO: 161702

SEQ ID NO: 216959 - RNA, 64 nt, hsa; identical to SEQ ID NO: 161703

SEQ ID NO: 216960 - RNA, 64 nt, hsa; identical to SEQ ID NO: 161704

SEQ ID NO: 216961 - RNA, 64 nt, hsa; identical to SEQ ID NO: 161705

SEQ ID NO: 216962 - RNA, 64 nt, hsa; identical to SEQ ID NO: 161706

SEQ ID NO: 216963 - RNA, 64 nt, hsa; identical to SEQ ID NO: 161707

SEQ ID NO: 216964 - RNA, 64 nt, hsa; identical to SEQ ID NO: 161708

SEQ ID NO: 216965 - RNA, 64 nt, hsa; identical to SEQ ID NO: 161709

SEQ ID NO: 216966 - RNA, 64 nt, hsa
ucccguccccccgguagacucuguccugcuggucccaccacacauggcugggacaucuguuccc

SEQ ID NO: 216967 - RNA, 64 nt, hsa
caaccucccaaagugcugagauuacaggcgugagccaccacacccagcucagggaggcguaguu

SEQ ID NO: 216968 - RNA, 64 nt, hsa
cagccucccaaguagcugggauuacaggcacccgccaccacaccuggcuaauuuuuuuguauuu

SEQ ID NO: 216969 - RNA, 64 nt, hsa
gccauugaacccacagagcuguguugcuuuaaagccaccacaaggguacagcauuaaauggcag

SEQ ID NO: 216970 - RNA, 64 nt, hsa
gaccucccaaagugcugggauuacuagacguaagccaccacaccuggcaauucccugcuuuuuu

SEQ ID NO: 216971 - RNA, 64 nt, hsa
ucagcucccaaguagcugggacuacaggugcacgccaccacaacuggcuaauuuuuguauuuuu

SEQ ID NO: 216972 - RNA, 64 nt, hsa
cggccucccaaagcgcugggauuacaggcgugagccaccacacccggccguggaaugguuuucu

SEQ ID NO: 216973 - RNA, 64 nt, hsa
cagccuccugaguagcugggaucauaggcacgcgccaccacacccagcuaauuuuuuguauuuu

SEQ ID NO: 216974 - RNA, 64 nt, hsa
aaguggggcaaagccagcaugcaagcagaccccaccaccacagcccaccuccguccucacauac

SEQ ID NO: 216975 - RNA, 64 nt, hsa
cggccucccaaaguccucggauuacaggcaugagccaccacacccggccaaucaguccaccuuu

SEQ ID NO: 216976 - RNA, 64 nt, hsa
cagccuccugaguagcuaggacuacagaugcucgccaccacaccuggcuaauuuuuuuuuuuug

SEQ ID NO: 216977 - RNA, 64 nt, hsa
uagccucccaaguagcugggacuacagguguacgccaccacacccagcuaauuuuuguauuuuu

SEQ ID NO: 216978 - RNA, 64 nt, hsa
cagccuccugaguagcugggauuacaggcaugaaccaccacaccuggauaauuuuuguauuuuu

SEQ ID NO: 216979 - RNA, 64 nt, hsa
cagccucccaaagugcugggauuacaggcgugagccaccacaccuggccuuucugcaacauuuu

SEQ ID NO: 216980 - RNA, 56 nt, hsa
accuccagaacaccagguagccguggccaccacagccagacugaacguuugugaaa

SEQ ID NO: 216981 - RNA, 64 nt, hsa
agccagacugaacguuugugaaagcugggacaucccaccacacgcugagccagaccugcagagu

SEQ ID NO: 216982 - RNA, 64 nt, hsa
uggccucccaaagugcugggauuacagggacgagccaccacaccccaccuauugucuauauuuc

SEQ ID NO: 216983 - RNA, 64 nt, hsa
cagccuucugaguagcugggacuacagaugcacaccaccacaccuggcuaauuuuuguguuuuu

SEQ ID NO: 216984 - RNA, 64 nt, hsa
cagccucccaaagugcugggaugauaggcgugagccaccacacccggccaagcacaggcuuuug

SEQ ID NO: 216985 - RNA, 64 nt, hsa
ggccuccuuuaguaggugggauuacaggugcauaccaccacaccuuucuaauuuuugcauuuuu

SEQ ID NO: 216986 - RNA, 64 nt, hsa
cagccucccaaagugcugggauuacaggcgugagccaccacaccaggcccgagaaaugcuuuuu

SEQ ID NO: 216987 - RNA, 64 nt, hsa
cagccuccggaguagcugggauuacaggcacaugccaccacacccagugaauuuuuguauuuuu

SEQ ID NO: 216988 - RNA, 64 nt, hsa
ucggcccccaaagugcugggauuacaggcaugagccaccacaucuggccuaggaccuuaaauau

SEQ ID NO: 216989 - RNA, 64 nt, hsa
cagccucccaaguagcuggaauuacagacaccugccaccacauccagcuaacuuuuuuuguauu

SEQ ID NO: 216990 - RNA, 64 nt, hsa
aauggcuguggaguguggcaguuuggcaaacucuccaccacacguaaugaaacuuggauuugcu

SEQ ID NO: 216991 - RNA, 64 nt, hsa
guggcaucagugucuuuccacuccuccuagccacccaccacacugauccagcccugaguuccua

SEQ ID NO: 216992 - RNA, 64 nt, hsa
auugggccccugccagacccccuggagacuaaccccaccacacccucccucuacugggagccua

SEQ ID NO: 216993 - RNA, 64 nt, hsa
cagccucuugaguggcugggauuacaggcacaugccaccacacccggcuaauuuuuguauuuuu

SEQ ID NO: 216994 - RNA, 64 nt, hsa
cggccucucaaauugcuggaauuacaguugugagccaccacaccuggcuugaauguagauuuua

SEQ ID NO: 216995 - RNA, 64 nt, hsa
uagucccaggaguagcugggacuacaggugcccaccaccacacccagcuaauuuuuuuguauuu

SEQ ID NO: 216996 - RNA, 64 nt, hsa
gccuccugaguagccggggagcuacaagcaugcaccaccacacccagcuaauuuuuuuuuuuuu

SEQ ID NO: 216997 - RNA, 64 nt, hsa
aggcaaucuggaagcagaaaugcaaacuccagccccaccacacauccaccgaugcauuuguggc

SEQ ID NO: 216998 - RNA, 64 nt, hsa
uuucucucuuuuucuuugaggagaaugauggucaccaccacaauuaauuguaauuaagggaaau

SEQ ID NO: 216999 - RNA, 64 nt, hsa
cagccucccaaguagcugggauuacagucaggcaccaccacacccggcuaauuuuguauuuuuu

SEQ ID NO: 217000 - RNA, 64 nt, hsa
uggccucccaaagugcugggauuacagaugugagccaccacaccuggccccaagcuugaauuuu

SEQ ID NO: 217001 - RNA, 64 nt, hsa
cggccucccaaagugcugggauuacaggcaugagccaccacagcuggcccccuucuguuuuaug

SEQ ID NO: 217002 - RNA, 64 nt, hsa
cagccuccuaaguaucugggauuacaggcaugugccaccacaccugggugauuuuuguauuuuu

SEQ ID NO: 217003 - RNA, 64 nt, hsa
aguuuaccgaccugaauguuuaccugugggauguccaccacaguaaaaggcuuauuaaagugga

SEQ ID NO: 217004 - RNA, 64 nt, hsa
ucaaaagcaugauuuuuaauaguuguugaguauuccaccacaggaauguaucacaacuuaaccg

SEQ ID NO: 217005 - RNA, 64 nt, hsa
agcaggacugagggaacugcuggcucgccuggcaccaccacacggccacagccagccaucugcu

SEQ ID NO: 217006 - RNA, 64 nt, hsa
gcccacccuguguacccagguccagaggguccguccaccacagcagccccagguggagggcugg

SEQ ID NO: 217007 - RNA, 64 nt, hsa
cagccucccaaguagcugggacuacaggcacacgccaccacacccaacuaauuuuuguauuuuu

SEQ ID NO: 217008 - RNA, 64 nt, hsa
cagccucccaaagugcugggauuacaggcaugagccaccacacccagcgagacgggguuucauu

SEQ ID NO: 217009 - RNA, 64 nt, hsa
agccuuccaaaagugcugggauuacaggcgugagccaccacauccggccagugcacucuuaaua

SEQ ID NO: 217010 - RNA, 64 nt, hsa
cagccuccugaguagcugggacuacaggcuugcgccaccacaccuggcuaauuuuuguauuuuu

SEQ ID NO: 217011 - RNA, 64 nt, hsa
accugaaaaggauuuuagaaaacccugggaaaacccaccacaccaccacaaaauggccuuuagu

SEQ ID NO: 217012 - RNA, 64 nt, hsa
aggauuuuagaaaacccugggaaaacccaccacaccaccacaaaauggccuuuaguguaugaaa

SEQ ID NO: 217013 - RNA, 64 nt, hsa
uagccuccuaaguagcugagacuacagacgugcgccaccacacccaguucauuuuuguauuuuu

SEQ ID NO: 217014 - RNA, 64 nt, hsa
cucagccugaaagugcuaggauuacaggcgugagccaccacaccuggccagcucagcauauucu

SEQ ID NO: 217015 - RNA, 64 nt, hsa
cagccuccugaguagcugggacuauaggcgcgugccaccacaaccagcuaaauuuuuuuguauu

SEQ ID NO: 217016 - RNA, 64 nt, hsa
auccacucuccugcgguuaccagcccugcaccaaccaccacagucagaauaaucucaaaacugc

SEQ ID NO: 217017 - RNA, 64 nt, hsa
uggccucccaaagugcugggauuacaggcgugagccaccacacccggcccccaguucuuuuuuu

SEQ ID NO: 217018 - RNA, 64 nt, hsa
gugccgugccguguaauaaagucccagugcucauccaccacagaugccugguccuguugcagga

SEQ ID NO: 217019 - RNA, 64 nt, hsa
ggccagggcaucaagaacccagugaacaagggcaccaccacaguggacggcgcuggcuucggca

SEQ ID NO: 217020 - RNA, 64 nt, hsa
cagccucccgaguagcugggacuacaggugcacaccaccacaccuggcuaauuuuuuguauuuu

SEQ ID NO: 217021 - RNA, 64 nt, hsa
uuggagccucuuggccuucagagcagaggcaaacccaccacagggcagcugcguuuuaggaaga

SEQ ID NO: 217022 - RNA, 64 nt, hsa
cagccuccugaguagcugagacuacaggugagugccaccacacucagcuaauuuucaaauuuuu

SEQ ID NO: 217023 - RNA, 64 nt, hsa
uggccucccaaagugcugggauuacaggugugagccaccacacccagccucuguaguucuuuuu

SEQ ID NO: 217024 - RNA, 64 nt, hsa
ccucugccucccaaguaacugggacuauagcaugccaccacacccagcugauuaucauauuuuu

SEQ ID NO: 217025 - RNA, 64 nt, hsa
cuucugccucccaaguaacugggacuauagcaugccaccacacccagcugauuaucauauuuuu

SEQ ID NO: 217026 - RNA, 64 nt, hsa
cagucucccgaagugcugggauuacugacaugagccaccacacucagcccuuuaaaccuuuccc

SEQ ID NO: 217027 - RNA, 64 nt, hsa
cagccucgcgaguaguuggaauuauaggcaugugccaccacacccagcugauuuuugcauuuuu

SEQ ID NO: 217028 - RNA, 64 nt, hsa
cagccucccgaguagcugggauuacaggcaugcaccaccacaccuggcuaauuuuuguguuuuu

SEQ ID NO: 217029 - RNA, 64 nt, hsa
cagccucccgaguagcugagauuauaggcgugcaccaccacaccuggcuaauuuuuguauuuuu

SEQ ID NO: 217030 - RNA, 64 nt, hsa
gagccuuuuuuuuuaagcuuggcaaacaucccagcuaaucaaaauagucauauuccugagaagu

SEQ ID NO: 217031 - RNA, 64 nt, hsa
auuuuaaauggauuuucaguagaaaugauuuuuacuaaucaaguuaaucccaccccaucaaaag

SEQ ID NO: 217032 - RNA, 64 nt, hsa
cucuuccucagcagaccucuuggaauuaggguuucuaaucaaacuaagucuugcaucauaaauu

SEQ ID NO: 217033 - RNA, 64 nt, hsa
uggaaauagucucaacgugcauguaguagcuaaacuaaucaaaaucuuauaugaauaauuuuga

SEQ ID NO: 217034 - RNA, 64 nt, hsa
acuaauuuggcuuucacauuuaaaugguucugugcuaaucaaaacuuucguuguuauuauucau

SEQ ID NO: 217035 - RNA, 52 nt, hsa
cuggauaucagacucuguaacacuaaucaauacgugaucucuguuacaaaag

SEQ ID NO: 217036 - RNA, 64 nt, hsa
agaaugcuucaaguuuagugcaugcaucucuuuagauccaaaauaaauggacugaaguuaucau

SEQ ID NO: 217037 - RNA, 64 nt, hsa
aagugauauuugauuuuguaaaaauaaccaguaggauccaaagaacuuuagcuauuuauguuca

SEQ ID NO: 217038 - RNA, 64 nt, hsa
gacacgguauuaggagggaaugccagauuggagagauccaaacaacacagggagacuugcuuac

SEQ ID NO: 217039 - RNA, 64 nt, hsa
auauuauuuuagcuucugugaagugggauuuauugauccaaagugcuggacacgguauuaggag

SEQ ID NO: 217040 - RNA, 64 nt, hsa
cuugcugaccauucacucucugugucuguuguuggauccaaauacgaguguuuuucuuucuuuu

SEQ ID NO: 217041 - RNA, 64 nt, hsa
uuccagcuguuauugggcucugaggcccucuccugauccaaaucuuuuuuuguuuguuugagau

SEQ ID NO: 217042 - RNA, 64 nt, hsa
uaucccuugguucacuugagugugcaagucauuaaauccucaucauuuuaggguugccagugau

SEQ ID NO: 217043 - RNA, 64 nt, hsa
acagguaccuacugcuggccucuucaguggccacaauccucaguccucaccugcugguuuggag

SEQ ID NO: 217044 - RNA, 64 nt, hsa
gguuaagacguuggaaggaaaucuaaggaaaauuaauccucacagagguccggguuuaguauau

SEQ ID NO: 217045 - RNA, 64 nt, hsa
aauaagcuuucucagaauguuggcaaaucacuucaauccucaaaucagucuuccuuguggaaug

SEQ ID NO: 217046 - RNA, 64 nt, hsa
gugcccaaaagggcacccaccagaaauuccaguaaauccucauuugaggaagcucucccuuguu

SEQ ID NO: 217047 - RNA, 64 nt, hsa
aacuccugugaaagaaagacuuuuuauuguguuuaauccucauccuuuaccuuuagacguauua

SEQ ID NO: 217048 - RNA, 64 nt, hsa
uucuuucuacagaacaaagacuaaauaaugacauaauccucagcugacugacugaaaaugugac

SEQ ID NO: 217049 - RNA, 64 nt, hsa
aggcucaacauuuggaauugcacuuuaauugauuaauccucaauucauguggccuuacgggaug

SEQ ID NO: 217050 - RNA, 64 nt, hsa
gagacugagcugggugcacuggccaugcccugugaauccucaggcugugacgcccucagguacu

SEQ ID NO: 217051 - RNA, 64 nt, hsa
uauaguugugaagaauguggcaaagcuuuuaaccaauccucauaccuuacuauacagaaauuca

SEQ ID NO: 217052 - RNA, 64 nt, hsa
ugcaaaugugaauaauguggcaauacuuuaaaccaauccucaaaccucacuaaacauaagauaa

SEQ ID NO: 217053 - RNA, 64 nt, hsa
guugcaaaacgagcuuguuucccugaaccucagaaauccucagcuucaaacauggggaaacagg

SEQ ID NO: 217054 - RNA, 64 nt, hsa
ucucaucgucuugcaggucggagacuacguauguaauccucacucuuuggacagaaaaaaaaaa

SEQ ID NO: 217055 - RNA, 64 nt, hsa
uacaaaugugaagaauguggcaaagcuuuuaacaaauccucauccauuaguaaacauaagauaa

SEQ ID NO: 217056 - RNA, 64 nt, hsa
uacaaaugugaaaaauguggcaaaccuuuuaaccaauccucaacccuuacuacacauuagauaa

SEQ ID NO: 217057 - RNA, 64 nt, hsa
uugauacucuuuccacaauacugagcugccucagaauccucaaaaucaguuuuuauauucccca

SEQ ID NO: 217058 - RNA, 64 nt, hsa
ucuuugucauacuacuauuccuuucgucucccagaauccucagggcacugaggguaggucugac

SEQ ID NO: 217059 - RNA, 64 nt, hsa; identical to SEQ ID NO: 60066

SEQ ID NO: 217060 - RNA, 64 nt, hsa; identical to SEQ ID NO: 60067

SEQ ID NO: 217061 - RNA, 64 nt, hsa; identical to SEQ ID NO: 60068

SEQ ID NO: 217062 - RNA, 64 nt, hsa; identical to SEQ ID NO: 60069

SEQ ID NO: 217063 - RNA, 64 nt, hsa; identical to SEQ ID NO: 60070

SEQ ID NO: 217064 - RNA, 64 nt, hsa; identical to SEQ ID NO: 60071

SEQ ID NO: 217065 - RNA, 64 nt, hsa; identical to SEQ ID NO: 60072

SEQ ID NO: 217066 - RNA, 64 nt, hsa; identical to SEQ ID NO: 60073

SEQ ID NO: 217067 - RNA, 64 nt, hsa; identical to SEQ ID NO: 60074

SEQ ID NO: 217068 - RNA, 64 nt, hsa; identical to SEQ ID NO: 60075

SEQ ID NO: 217069 - RNA, 64 nt, hsa; identical to SEQ ID NO: 60076

SEQ ID NO: 217070 - RNA, 64 nt, hsa
uuuugcuuuagagaaugccacuuuggcugaacuacaaguguaggccaccauuauaauuuauaaa

SEQ ID NO: 217071 - RNA, 64 nt, hsa
ccuggugccuuaccaaguugugcuuuucuguuuucaaguguaaaugauguugagcagaauguug

SEQ ID NO: 217072 - RNA, 64 nt, hsa
acuugaagcagaaccuuguaauuuguguaaaugacaaguguaaaauccuaccauaaaaugcuaa

SEQ ID NO: 217073 - RNA, 64 nt, hsa
gauaggcuguaguguacaugggauguaaaacaaacaaguguaucaaagguggaugauucuguua

SEQ ID NO: 217074 - RNA, 64 nt, hsa
aaacagugaaucuuaugguggaagagguucucagcaaguguacaguauuuaccuuccuuugucu

SEQ ID NO: 217075 - RNA, 64 nt, hsa
aaauuuuccauuaauuucaacauaauuaugggaacaaguguacagaagaauuuuuuuuuuaaga

SEQ ID NO: 217076 - RNA, 64 nt, hsa
gugucacuuguucaccucuuuacuucauucuuaacaaguguauaguucucuaggacaguugaug

SEQ ID NO: 217077 - RNA, 64 nt, hsa
cgaauuugguauuuagguacauuguuuauauagccaaguguauaugcuuuacuaccuaacaauu

SEQ ID NO: 217078 - RNA, 64 nt, hsa
uauaaggguauacacauacauauauggcauauaacaaguguacacauauacacauaacaagugu

SEQ ID NO: 217079 - RNA, 64 nt, hsa
auggcauauaacaaguguacacauauacacauaacaaguguagaaguauauauuacauacauac

SEQ ID NO: 217080 - RNA, 64 nt, hsa
aagcuugucuaugguacaaaaaucacaaggcauucaaguguacagugaaaagucucccuuucca

SEQ ID NO: 217081 - RNA, 64 nt, hsa
ugagguuuccuucagacagauuccaggcgaugugcaaguguaugcacgugugcacacacaccac

SEQ ID NO: 217082 - RNA, 64 nt, hsa
gggucuaucgccuuguggauggcaccaaauuauccaaguguauuaggagacuggggcuuuuuuc

SEQ ID NO: 217083 - RNA, 64 nt, hsa
cacuucucgugacauuuguugauaaucuuuacugcaaguguaaugauauuugagugaauuaaaa

SEQ ID NO: 217084 - RNA, 64 nt, hsa
aucauuggagaauccauaaugaagagagaucuuacaaguguaauaaauguggcaaauuuuucag

SEQ ID NO: 217085 - RNA, 64 nt, hsa
aacauacuggacuucacacuggagagaaaccuuacaaguguaaugaguguggcaaagccuuugg

SEQ ID NO: 217086 - RNA, 64 nt, hsa
caaaucauuggagaauccauaaugagagaucuuacaaguguaauaaaugugacagauuuuucag

SEQ ID NO: 217087 - RNA, 64 nt, hsa
uucaaaaggcaauucguauuggagagaaacccuacaaguguaaugaauguggcauaguuuuuaa

SEQ ID NO: 217088 - RNA, 64 nt, hsa
gucacaaagccauucauacuggagagaaacuuuacaaguguaaugaauguggcaagguuuuuaa

SEQ ID NO: 217089 - RNA, 64 nt, hsa
aaguguaauuagcuuuuggagagugggcugacaucaaguguaauuagcuuuuggagaguggguu

SEQ ID NO: 217090 - RNA, 64 nt, hsa
accuauaauuuugcaaaucuguuaccucugacaucaaguguaauuagcuuuuggagagugggcu

SEQ ID NO: 217091 - RNA, 64 nt, hsa
ggaugggccacggauggagcuugccaugggaagcacugggaaguaaugggguguggggugccac

SEQ ID NO: 217092 - RNA, 64 nt, hsa
uuuugguucuuuuauaaagacuugucuagacuccacugggaagaguccuuugcuuuggggccca

SEQ ID NO: 217093 - RNA, 64 nt, hsa
gggaggugaggggcgccucugcccagcugccccuacugggaagugaggagccccucugccccgc

SEQ ID NO: 217094 - RNA, 64 nt, hsa
gggaggcgaggggcgccucugcccggcugccccuacugggaagugaggagccccucugcccggc

SEQ ID NO: 217095 - RNA, 64 nt, hsa
gggagguuaggggcgccucugcccggccgccccuacugggaagugaggagccccucugcccggc

SEQ ID NO: 217096 - RNA, 64 nt, hsa
ccguuuucacgcugcugauaaagacauacccgagacugggaagaaaaagugguuuaauuggacu

SEQ ID NO: 217097 - RNA, 64 nt, hsa
cuguauuaaugcugcugauaaagacguacccgagacugggaagaaaaagagguuuacuuggacu

SEQ ID NO: 217098 - RNA, 64 nt, hsa
augggagcacaguacugggaaaugggagcauaguacugggaaaccccagaccuggauucugagu

SEQ ID NO: 217099 - RNA, 64 nt, hsa
augggagcauaguacugggaaaugggagcacaguacugggaaaugggagcauaguacugggaaa

SEQ ID NO: 217100 - RNA, 64 nt, hsa
gggaguucacaguacucggaaaugggagcauaguacugggaaaugggagcacaguacugggaaa

SEQ ID NO: 217101 - RNA, 64 nt, hsa
gggagcacaguacugggaaaugggagcccacaguacugggaaaggggaguucacaguacucgga

SEQ ID NO: 217102 - RNA, 64 nt, hsa
gggagcacacaguacugggaaaugggagcacaguacugggaaaugggagcccacaguacuggga

SEQ ID NO: 217103 - RNA, 64 nt, hsa
gggcauacaguacugagaaaugggagcacacaguacugggaaaugggagcacaguacugggaaa

SEQ ID NO: 217104 - RNA, 64 nt, hsa
augggaguacacuacugagaaaugggagcacaguacugggaaaugggcauacaguacugagaaa

SEQ ID NO: 217105 - RNA, 64 nt, hsa
augggagcacaguauugggaaaugggagcacaguacugggaagugggagcacaguacugagaag

SEQ ID NO: 217106 - RNA, 64 nt, hsa
augggagcacaguacugggaaaugggagcacaguacugggaaaugggggcucacagcacugcaa

SEQ ID NO: 217107 - RNA, 64 nt, hsa
augggagcacaguacuaggaaaugggagcacaguacugggaaaugggagcacaguacugggaaa

SEQ ID NO: 217108 - RNA, 64 nt, hsa
gccgggcauguuggcucacaccugugagcacaguacugggaaaugggagcacaguacuaggaaa

SEQ ID NO: 217109 - RNA, 59 nt, hsa
gcccucagagugcucuguaggagcuguagacugggaagagaggccaggcgugguggcuc

SEQ ID NO: 217110 - RNA, 64 nt, hsa
acagcuagacccugucucaaaaaaaaaaaaaaagacugggaagagagcuagagggacuaggaga

SEQ ID NO: 217111 - RNA, 64 nt, hsa
auccuccugcaagagugggcuuuccagggucuuuacugggaagcaguuaagcccccuccucacc

SEQ ID NO: 217112 - RNA, 64 nt, hsa
uucauucccacugcacuuggugcugcuuuggcugacugggaacaccccauaacuacagagucug

SEQ ID NO: 217113 - RNA, 64 nt, hsa
ugugggaacaggaauaaaggagaaaccacuauugacugggaagacacacaaagaacuuugucaa

SEQ ID NO: 217114 - RNA, 64 nt, hsa
ccaggcuuggucaugcaugccuguaauccuagcuacugggaaggcugaggaaggagaauugcuu

SEQ ID NO: 217115 - RNA, 64 nt, hsa
uaucaaaaaguacaauaauaaauccucagguaguacugggaauggaaggcuuugccaugggccu

SEQ ID NO: 217116 - RNA, 64 nt, hsa
aggcuuugccaugggccugcugcgucagaccaguacugggaaggaggacgguuguaagcaguug

SEQ ID NO: 217117 - RNA, 64 nt, hsa
gugccagcauccagcaugagcagaugucggggagacugggaagucuccagcguuacugcucucc

SEQ ID NO: 217118 - RNA, 64 nt, hsa
gugccagcauccagcgugagcagacgucggggagacugggaagucuccgauguuacugccugcc

SEQ ID NO: 217119 - RNA, 64 nt, hsa
aguuugacuucguuccugaauacaaucuugaguaacugggaaagucugagugaaaggauggccu

SEQ ID NO: 217120 - RNA, 64 nt, hsa
ucacacagcugagaagccggcguccugcucacaaacugggaaagugugaaaacuauuuaagaua

SEQ ID NO: 217121 - RNA, 64 nt, hsa
acuaagugcuuauucaaagacuagguuauuuucaacugggaaaaaagcagugcuaacaggauau

SEQ ID NO: 217122 - RNA, 64 nt, hsa
uagaaccgguaagauggugacauuguugaucaagacugggaauauaagagagaagcagguuugg

SEQ ID NO: 217123 - RNA, 64 nt, hsa; identical to SEQ ID NO: 161557

SEQ ID NO: 217124 - RNA, 64 nt, hsa; identical to SEQ ID NO: 161558

SEQ ID NO: 217125 - RNA, 64 nt, hsa; identical to SEQ ID NO: 161559

SEQ ID NO: 217126 - RNA, 64 nt, hsa; identical to SEQ ID NO: 161560

SEQ ID NO: 217127 - RNA, 64 nt, hsa; identical to SEQ ID NO: 161561

SEQ ID NO: 217128 - RNA, 64 nt, hsa; identical to SEQ ID NO: 161562

SEQ ID NO: 217129 - RNA, 64 nt, hsa; identical to SEQ ID NO: 161563

SEQ ID NO: 217130 - RNA, 64 nt, hsa; identical to SEQ ID NO: 161564

SEQ ID NO: 217131 - RNA, 64 nt, hsa; identical to SEQ ID NO: 161565

SEQ ID NO: 217132 - RNA, 64 nt, hsa; identical to SEQ ID NO: 161566

SEQ ID NO: 217133 - RNA, 64 nt, hsa; identical to SEQ ID NO: 161567

SEQ ID NO: 217134 - RNA, 64 nt, hsa; identical to SEQ ID NO: 161568

SEQ ID NO: 217135 - RNA, 64 nt, hsa; identical to SEQ ID NO: 161569

SEQ ID NO: 217136 - RNA, 64 nt, hsa; identical to SEQ ID NO: 161570

SEQ ID NO: 217137 - RNA, 64 nt, hsa; identical to SEQ ID NO: 161571

SEQ ID NO: 217138 - RNA, 64 nt, hsa; identical to SEQ ID NO: 161572

SEQ ID NO: 217139 - RNA, 64 nt, hsa; identical to SEQ ID NO: 161573

SEQ ID NO: 217140 - RNA, 64 nt, hsa; identical to SEQ ID NO: 161574

SEQ ID NO: 217141 - RNA, 64 nt, hsa; identical to SEQ ID NO: 161575

SEQ ID NO: 217142 - RNA, 64 nt, hsa; identical to SEQ ID NO: 161576

SEQ ID NO: 217143 - RNA, 64 nt, hsa; identical to SEQ ID NO: 161577

SEQ ID NO: 217144 - RNA, 64 nt, hsa; identical to SEQ ID NO: 161578

SEQ ID NO: 217145 - RNA, 64 nt, hsa; identical to SEQ ID NO: 161579

SEQ ID NO: 217146 - RNA, 64 nt, hsa; identical to SEQ ID NO: 161580

SEQ ID NO: 217147 - RNA, 64 nt, hsa; identical to SEQ ID NO: 161581

SEQ ID NO: 217148 - RNA, 64 nt, hsa; identical to SEQ ID NO: 161582

SEQ ID NO: 217149 - RNA, 64 nt, hsa; identical to SEQ ID NO: 161583

SEQ ID NO: 217150 - RNA, 64 nt, hsa; identical to SEQ ID NO: 161584

SEQ ID NO: 217151 - RNA, 64 nt, hsa; identical to SEQ ID NO: 161585

SEQ ID NO: 217152 - RNA, 64 nt, hsa; identical to SEQ ID NO: 161586

SEQ ID NO: 217153 - RNA, 64 nt, hsa; identical to SEQ ID NO: 161587

SEQ ID NO: 217154 - RNA, 64 nt, hsa; identical to SEQ ID NO: 161588

SEQ ID NO: 217155 - RNA, 64 nt, hsa; identical to SEQ ID NO: 161589

SEQ ID NO: 217156 - RNA, 64 nt, hsa; identical to SEQ ID NO: 161590

SEQ ID NO: 217157 - RNA, 64 nt, hsa; identical to SEQ ID NO: 161591

SEQ ID NO: 217158 - RNA, 64 nt, hsa; identical to SEQ ID NO: 161592

SEQ ID NO: 217159 - RNA, 64 nt, hsa; identical to SEQ ID NO: 161593

SEQ ID NO: 217160 - RNA, 64 nt, hsa; identical to SEQ ID NO: 161594

SEQ ID NO: 217161 - RNA, 64 nt, hsa; identical to SEQ ID NO: 161595

SEQ ID NO: 217162 - RNA, 64 nt, hsa; identical to SEQ ID NO: 161596

SEQ ID NO: 217163 - RNA, 64 nt, hsa; identical to SEQ ID NO: 161597

SEQ ID NO: 217164 - RNA, 64 nt, hsa; identical to SEQ ID NO: 161598

SEQ ID NO: 217165 - RNA, 64 nt, hsa; identical to SEQ ID NO: 161599

SEQ ID NO: 217166 - RNA, 64 nt, hsa; identical to SEQ ID NO: 161600

SEQ ID NO: 217167 - RNA, 64 nt, hsa; identical to SEQ ID NO: 161601

SEQ ID NO: 217168 - RNA, 64 nt, hsa; identical to SEQ ID NO: 161602

SEQ ID NO: 217169 - RNA, 64 nt, hsa; identical to SEQ ID NO: 161603

SEQ ID NO: 217170 - RNA, 64 nt, hsa; identical to SEQ ID NO: 161604

SEQ ID NO: 217171 - RNA, 64 nt, hsa; identical to SEQ ID NO: 161605

SEQ ID NO: 217172 - RNA, 64 nt, hsa; identical to SEQ ID NO: 161606

SEQ ID NO: 217173 - RNA, 64 nt, hsa; identical to SEQ ID NO: 161607

SEQ ID NO: 217174 - RNA, 64 nt, hsa; identical to SEQ ID NO: 161608

SEQ ID NO: 217175 - RNA, 64 nt, hsa; identical to SEQ ID NO: 161609

SEQ ID NO: 217176 - RNA, 64 nt, hsa; identical to SEQ ID NO: 161610

SEQ ID NO: 217177 - RNA, 64 nt, hsa; identical to SEQ ID NO: 161611

SEQ ID NO: 217178 - RNA, 64 nt, hsa; identical to SEQ ID NO: 161612

SEQ ID NO: 217179 - RNA, 64 nt, hsa; identical to SEQ ID NO: 161613

SEQ ID NO: 217180 - RNA, 64 nt, hsa; identical to SEQ ID NO: 161614

SEQ ID NO: 217181 - RNA, 64 nt, hsa; identical to SEQ ID NO: 161615

SEQ ID NO: 217182 - RNA, 64 nt, hsa; identical to SEQ ID NO: 161616

SEQ ID NO: 217183 - RNA, 64 nt, hsa; identical to SEQ ID NO: 161617

SEQ ID NO: 217184 - RNA, 64 nt, hsa; identical to SEQ ID NO: 161618

SEQ ID NO: 217185 - RNA, 64 nt, hsa; identical to SEQ ID NO: 161619

SEQ ID NO: 217186 - RNA, 64 nt, hsa; identical to SEQ ID NO: 161620

SEQ ID NO: 217187 - RNA, 64 nt, hsa; identical to SEQ ID NO: 161621

SEQ ID NO: 217188 - RNA, 64 nt, hsa; identical to SEQ ID NO: 161622

SEQ ID NO: 217189 - RNA, 64 nt, hsa
gaaaacaacuguuacaguuuuauugcucugaguaacugacaaagcagaaacuauucaguuuuug

SEQ ID NO: 217190 - RNA, 64 nt, hsa
gggcuguggugaauggaugaacguacaucguaaaacugacaaaauauuuuaaaaauauauaaaa

SEQ ID NO: 217191 - RNA, 64 nt, hsa
uaagaaggaaaagaagaagagaugacaaaccauaacugacaagagaggcgucugcugucucauc

SEQ ID NO: 217192 - RNA, 64 nt, hsa
ugugaagauggaacuaaacuggaaauuaaauuauacugacaauauuauggcauuuuuaagauca

SEQ ID NO: 217193 - RNA, 64 nt, hsa
cgcaagaugcuugccccgcuaguggcagaugugaacugacaaggagugaagcgcccacccagcg

SEQ ID NO: 217194 - RNA, 64 nt, hsa
uggcagccacccucuaggagacaaaacuacccccacugacaaggcuuuaggagacccuaaaguc

SEQ ID NO: 217195 - RNA, 64 nt, hsa
gcuguuuuguucuaguaacaauuuuggaaugaauacugacaauauuccaugagggugugcaagc

SEQ ID NO: 217196 - RNA, 64 nt, hsa
uggaugacuguacauuuuagugauuugaaaaauaacugacaaaccauugaaacaguuuauuuua

SEQ ID NO: 217197 - RNA, 64 nt, hsa
aacuuaaauauauauaaauaaaggaaccuuuuauacugacaaaccagagaaaaauggaccuuuu

SEQ ID NO: 217198 - RNA, 64 nt, hsa; identical to SEQ ID NO: 161557

SEQ ID NO: 217199 - RNA, 64 nt, hsa; identical to SEQ ID NO: 161558

SEQ ID NO: 217200 - RNA, 64 nt, hsa; identical to SEQ ID NO: 161559

SEQ ID NO: 217201 - RNA, 64 nt, hsa; identical to SEQ ID NO: 161560

SEQ ID NO: 217202 - RNA, 64 nt, hsa; identical to SEQ ID NO: 161561

SEQ ID NO: 217203 - RNA, 64 nt, hsa; identical to SEQ ID NO: 161562

SEQ ID NO: 217204 - RNA, 64 nt, hsa; identical to SEQ ID NO: 161563

SEQ ID NO: 217205 - RNA, 64 nt, hsa; identical to SEQ ID NO: 161564

SEQ ID NO: 217206 - RNA, 64 nt, hsa; identical to SEQ ID NO: 161565

SEQ ID NO: 217207 - RNA, 64 nt, hsa; identical to SEQ ID NO: 161566

SEQ ID NO: 217208 - RNA, 64 nt, hsa; identical to SEQ ID NO: 161567

SEQ ID NO: 217209 - RNA, 64 nt, hsa; identical to SEQ ID NO: 161568

SEQ ID NO: 217210 - RNA, 64 nt, hsa; identical to SEQ ID NO: 161569

SEQ ID NO: 217211 - RNA, 64 nt, hsa; identical to SEQ ID NO: 161570

SEQ ID NO: 217212 - RNA, 64 nt, hsa; identical to SEQ ID NO: 161571

SEQ ID NO: 217213 - RNA, 64 nt, hsa; identical to SEQ ID NO: 161572

SEQ ID NO: 217214 - RNA, 64 nt, hsa; identical to SEQ ID NO: 161573

SEQ ID NO: 217215 - RNA, 64 nt, hsa; identical to SEQ ID NO: 161574

SEQ ID NO: 217216 - RNA, 64 nt, hsa; identical to SEQ ID NO: 161575

SEQ ID NO: 217217 - RNA, 64 nt, hsa; identical to SEQ ID NO: 161576

SEQ ID NO: 217218 - RNA, 64 nt, hsa; identical to SEQ ID NO: 161577

SEQ ID NO: 217219 - RNA, 64 nt, hsa; identical to SEQ ID NO: 161578

SEQ ID NO: 217220 - RNA, 64 nt, hsa; identical to SEQ ID NO: 161579

SEQ ID NO: 217221 - RNA, 64 nt, hsa; identical to SEQ ID NO: 161580

SEQ ID NO: 217222 - RNA, 64 nt, hsa; identical to SEQ ID NO: 161581

SEQ ID NO: 217223 - RNA, 64 nt, hsa; identical to SEQ ID NO: 161582

SEQ ID NO: 217224 - RNA, 64 nt, hsa; identical to SEQ ID NO: 161583

SEQ ID NO: 217225 - RNA, 64 nt, hsa; identical to SEQ ID NO: 161584

SEQ ID NO: 217226 - RNA, 64 nt, hsa; identical to SEQ ID NO: 161585

SEQ ID NO: 217227 - RNA, 64 nt, hsa; identical to SEQ ID NO: 161586

SEQ ID NO: 217228 - RNA, 64 nt, hsa; identical to SEQ ID NO: 161587

SEQ ID NO: 217229 - RNA, 64 nt, hsa; identical to SEQ ID NO: 161588

SEQ ID NO: 217230 - RNA, 64 nt, hsa; identical to SEQ ID NO: 161589

SEQ ID NO: 217231 - RNA, 64 nt, hsa; identical to SEQ ID NO: 161590

SEQ ID NO: 217232 - RNA, 64 nt, hsa; identical to SEQ ID NO: 161591

SEQ ID NO: 217233 - RNA, 64 nt, hsa; identical to SEQ ID NO: 161592

SEQ ID NO: 217234 - RNA, 64 nt, hsa; identical to SEQ ID NO: 161593

SEQ ID NO: 217235 - RNA, 64 nt, hsa; identical to SEQ ID NO: 161594

SEQ ID NO: 217236 - RNA, 64 nt, hsa; identical to SEQ ID NO: 161595

SEQ ID NO: 217237 - RNA, 64 nt, hsa; identical to SEQ ID NO: 161596

SEQ ID NO: 217238 - RNA, 64 nt, hsa; identical to SEQ ID NO: 161597

SEQ ID NO: 217239 - RNA, 64 nt, hsa; identical to SEQ ID NO: 161598

SEQ ID NO: 217240 - RNA, 64 nt, hsa; identical to SEQ ID NO: 161599

SEQ ID NO: 217241 - RNA, 64 nt, hsa; identical to SEQ ID NO: 161600

SEQ ID NO: 217242 - RNA, 64 nt, hsa; identical to SEQ ID NO: 161601

SEQ ID NO: 217243 - RNA, 64 nt, hsa; identical to SEQ ID NO: 161602

SEQ ID NO: 217244 - RNA, 64 nt, hsa; identical to SEQ ID NO: 161603

SEQ ID NO: 217245 - RNA, 64 nt, hsa; identical to SEQ ID NO: 161604

SEQ ID NO: 217246 - RNA, 64 nt, hsa; identical to SEQ ID NO: 161605

SEQ ID NO: 217247 - RNA, 64 nt, hsa; identical to SEQ ID NO: 161606

SEQ ID NO: 217248 - RNA, 64 nt, hsa; identical to SEQ ID NO: 161607

SEQ ID NO: 217249 - RNA, 64 nt, hsa; identical to SEQ ID NO: 161608

SEQ ID NO: 217250 - RNA, 64 nt, hsa; identical to SEQ ID NO: 161609

SEQ ID NO: 217251 - RNA, 64 nt, hsa; identical to SEQ ID NO: 161610

SEQ ID NO: 217252 - RNA, 64 nt, hsa; identical to SEQ ID NO: 161611

SEQ ID NO: 217253 - RNA, 64 nt, hsa; identical to SEQ ID NO: 161612

SEQ ID NO: 217254 - RNA, 64 nt, hsa; identical to SEQ ID NO: 161613

SEQ ID NO: 217255 - RNA, 64 nt, hsa; identical to SEQ ID NO: 161614

SEQ ID NO: 217256 - RNA, 64 nt, hsa; identical to SEQ ID NO: 161615

SEQ ID NO: 217257 - RNA, 64 nt, hsa; identical to SEQ ID NO: 161616

SEQ ID NO: 217258 - RNA, 64 nt, hsa; identical to SEQ ID NO: 161617

SEQ ID NO: 217259 - RNA, 64 nt, hsa; identical to SEQ ID NO: 161618

SEQ ID NO: 217260 - RNA, 64 nt, hsa; identical to SEQ ID NO: 161619

SEQ ID NO: 217261 - RNA, 64 nt, hsa; identical to SEQ ID NO: 161620

SEQ ID NO: 217262 - RNA, 64 nt, hsa; identical to SEQ ID NO: 161621

SEQ ID NO: 217263 - RNA, 64 nt, hsa; identical to SEQ ID NO: 161622

SEQ ID NO: 217264 - RNA, 64 nt, hsa; identical to SEQ ID NO: 217189

SEQ ID NO: 217265 - RNA, 64 nt, hsa; identical to SEQ ID NO: 217190

SEQ ID NO: 217266 - RNA, 64 nt, hsa; identical to SEQ ID NO: 217191

SEQ ID NO: 217267 - RNA, 64 nt, hsa; identical to SEQ ID NO: 217192

SEQ ID NO: 217268 - RNA, 64 nt, hsa; identical to SEQ ID NO: 217193

SEQ ID NO: 217269 - RNA, 64 nt, hsa; identical to SEQ ID NO: 217194

SEQ ID NO: 217270 - RNA, 64 nt, hsa; identical to SEQ ID NO: 217195

SEQ ID NO: 217271 - RNA, 64 nt, hsa; identical to SEQ ID NO: 217196

SEQ ID NO: 217272 - RNA, 64 nt, hsa; identical to SEQ ID NO: 217197

SEQ ID NO: 217273 - RNA, 64 nt, hsa
caauagaguugaaagagaggccuuaggauucuccucucucuaggugcugagcccucaccucccu

SEQ ID NO: 217274 - RNA, 64 nt, hsa
agauugugccauaccagcugagguuuuuccucugucucucuaggaauagggucuguuucacagg

SEQ ID NO: 217275 - RNA, 64 nt, hsa
cugaguccccgaucuagggccagcugcagagggcucucucuaggcagagcguuccuggccagag

SEQ ID NO: 217276 - RNA, 64 nt, hsa
cauucucacucacacugggcagcccgcugucgggucucucuaggccuaugaaccacaaagcagg

SEQ ID NO: 217277 - RNA, 64 nt, hsa
uacgcacauaccuucauguggcucagugccuuccucucucuaccagucuauuuccauucuuuca

SEQ ID NO: 217278 - RNA, 64 nt, hsa
uacacacauaccuucaugugguucagugccuuccucucucuaccagucuauuuccacugaacaa

SEQ ID NO: 217279 - RNA, 64 nt, hsa
uacacacguaccuucaugugauucacugccuuccucucucuaccagucuauuuccacugaacaa

SEQ ID NO: 217280 - RNA, 64 nt, hsa
uuugucauauugccucuagauuuucuucugugcuucucucuaucugcucuggaauggaugagug

SEQ ID NO: 217281 - RNA, 64 nt, hsa
gccuacuguguuccaggaacuaugcuagaaacugucucucuaggaaagcucuugcaccuuuauc

SEQ ID NO: 217282 - RNA, 64 nt, hsa
uuugaucauuugauuuuggauccaagauuuaucaucucucuauuuugcuauuugccaccauccu

SEQ ID NO: 217283 - RNA, 64 nt, hsa
aaaguagugccaaaaaucuugaaaucucucucucucucucuauuuggaugaaucaaaauguaau

SEQ ID NO: 217284 - RNA, 64 nt, hsa
acuuaaaacaaucuccucucucucucucucucucucucucuaucucucucucuaucuccucucu

SEQ ID NO: 217285 - RNA, 64 nt, hsa
cuccucucucucucucucucucucucucuaucucucucucuaucuccucucucucucuccucuc

SEQ ID NO: 217286 - RNA, 64 nt, hsa
uaccauuuuucugcgugcucucacucucucuuucucucucuagcuuuuuaauucaugaauauuu

SEQ ID NO: 217287 - RNA, 64 nt, hsa
caucacaaaguaggucauuccaucaccacccuugucucucuacacauuuugccuuuggggaucu

SEQ ID NO: 217288 - RNA, 64 nt, hsa
uuguucgguuuuguuuuccaucaggaauuugaguucucucuaacccagcuuacugugggacaua

SEQ ID NO: 217289 - RNA, 64 nt, hsa
uugccaaagccauccuuggcaucuagcacuuacaucucucuaugcuguucuacaagcaaacaaa

SEQ ID NO: 217290 - RNA, 64 nt, hsa
agggacaaggcgggccguggccuccuccaccaagucucucuagacaauucagggccugcuuucc

SEQ ID NO: 217291 - RNA, 64 nt, hsa
caagugaaagucaacccuauguaaacugguguccucucucuagcccucucccuuacuggcccac

SEQ ID NO: 217292 - RNA, 64 nt, hsa
aucuggcuuugcugcuuucuaacugcuaggcaccucucucuaacccucauugucagagggaauu

SEQ ID NO: 217293 - RNA, 64 nt, hsa
uguaggugacucccacauacacaguugccauuuuucucucuaacugggcaccagugaacaugcg

SEQ ID NO: 217294 - RNA, 64 nt, hsa
ggccccaggacacccagccugugccccacaaggaucucucuaaaugggagggauugaggcuacu

SEQ ID NO: 217295 - RNA, 64 nt, hsa
ucaguauucaucucuuuguuuuuugucacucuuuucucucuaauugugucauuuguacuguuug

SEQ ID NO: 217296 - RNA, 63 nt, hsa
uuuuuuuuuuuuuuuuuuuuuuaacaauggauauucuguaaaauauccuguacaaaacaagac

SEQ ID NO: 217297 - RNA, 63 nt, hsa
auuuugacuuaaaacaucugcugaauuccaaauuucuguaauagcuacuguaucugugauaaa

SEQ ID NO: 217298 - RNA, 63 nt, hsa
uauuaugcugccucuccaguguaauauuugccuuucuguaaaugggauuaaauaugauuugua

SEQ ID NO: 217299 - RNA, 63 nt, hsa
gcuaauccgccgaagaaaaggugaagaaaggaauucuguaaagaaaccaucagauuuguuaag

SEQ ID NO: 217300 - RNA, 63 nt, hsa
auaaauaaaacuuuguuucuuaggagaaaaugauucuguaauuccagugucacuaauuuauau

SEQ ID NO: 217301 - RNA, 61 nt, hsa
ggcuuacuucugaugcauaguauugaucuacuucuguaauugguaauugaucaauguuuuu

SEQ ID NO: 217302 - RNA, 63 nt, hsa
cuuagucacaaaauauauuuuguuuacaaaaauuucuguaaaacagguuauaacaguguuuaa

SEQ ID NO: 217303 - RNA, 63 nt, hsa
gguagggaaaagaacugcugggugggggccuguuucuguaacuuucucccccucuacugagaa

SEQ ID NO: 217304 - RNA, 63 nt, hsa
uuaaauuuauuaaucuuaaaucauguacuuuuuuucuguaauagaacucggauucuuuugcau

SEQ ID NO: 217305 - RNA, 63 nt, hsa
gauuguaauuugguuuauuggaugugauggacguucuguaauagaaaaccugaaacgaugauu

SEQ ID NO: 217306 - RNA, 63 nt, hsa
gguuccuaucucuucaggcaaacauggucaguauucuguaaaguuccccuggccuaaaugauu

SEQ ID NO: 217307 - RNA, 63 nt, hsa
gagugcagaacugugguuuuguuuuccuuugacuucuguaaaaugugaccguuugacaucugu

SEQ ID NO: 217308 - RNA, 63 nt, hsa
cuuucgggguugucauuaaguaaguugugaaauuucuguaauaacaaaggcaguccgcauucu

SEQ ID NO: 217309 - RNA, 63 nt, hsa
aguuacuuuuaaauauuuauuuaaaaccucuguuucuguaacuguauguuaaacguauucuuc

SEQ ID NO: 217310 - RNA, 63 nt, hsa
cucuguuucuguaacuguauguuaaacguauucuucuguaaugagaauagacuggaacaugug

SEQ ID NO: 217311 - RNA, 63 nt, hsa
aaccucaaagacagauguuacagaaucagccaguucuguaaaacugauauugucuauugguua

SEQ ID NO: 217312 - RNA, 63 nt, hsa
guuuuaguuuuuuguuucguuucguuuuguauuuucuguaacagaggacuauccucagucugc

SEQ ID NO: 217313 - RNA, 63 nt, hsa
uuucuccuuucuacaugacauugcaguggugguuucuguaauuaaaauuuguuugccucaugu

SEQ ID NO: 217314 - RNA, 63 nt, hsa
uguucuuacauaagcacucaugaaaauaugguauucuguaacuugaauuccauccauuuucca

SEQ ID NO: 217315 - RNA, 63 nt, hsa
auuggcugauauuuauauacuuaauagauugaguucuguaagggcaaaaacggauugaaauga

SEQ ID NO: 217316 - RNA, 63 nt, hsa
uauuacaucauuuauaugugaaaaguuggacauuucuguaaguuuuuaaaauuauccauuugu

SEQ ID NO: 217317 - RNA, 63 nt, hsa
ucauagcucaagaauuguuagcaaaugacagauuucuguaagccuauauauauagucaaaucg

SEQ ID NO: 217318 - RNA, 63 nt, hsa
uucugccuauguaaaaugaauugaaaaacaauuuucuguaaucuuuuauuuaaguagugggca

SEQ ID NO: 217319 - RNA, 63 nt, hsa
uaacuaguaaugagcuucuguuuacaauaaaaauucuguaaauuguuugcuguuaauuuuuua

SEQ ID NO: 217320 - RNA, 63 nt, hsa
ucagcaacucauugucuccaccagauaguauuuuucuguaaaugaaaugcugacuucgccucu

SEQ ID NO: 217321 - RNA, 63 nt, hsa
gguuauccuuucugacccacaaaguaugaaaaguucuguaaucuguaaacucaguucuguaau

SEQ ID NO: 217322 - RNA, 63 nt, hsa
aaguaugaaaaguucuguaaucuguaaacucaguucuguaaucuguauuauugagaugauuaa

SEQ ID NO: 217323 - RNA, 63 nt, hsa
uuuuuacaccuaauuuacuaggaaaauauuuuauucuguaauucauguuaagauuauguaugg

SEQ ID NO: 217324 - RNA, 63 nt, hsa
uuuaaggggauuuauguuagguuaauuaguuguuucuguaaaucauuuguaauagcauagugc

SEQ ID NO: 217325 - RNA, 63 nt, hsa
ccuagguguaaaauuuuaauaguuaaugcagaauucuguaaucauugaaucauuagugguuaa

SEQ ID NO: 217326 - RNA, 63 nt, hsa
aaauacauuccuaaaaauguauuugaacauugguucuguaaaagauaauggacuaaaaaagua

SEQ ID NO: 217327 - RNA, 63 nt, hsa
acauuccuauccccaacacaucaauuguauuuuuucuguaaaacucagauuuuccucaguauu

SEQ ID NO: 217328 - RNA, 63 nt, hsa
auaauccagggaaacccaagagccuuacuggucuucuguaacuuccaagacugacagcuuuuu

SEQ ID NO: 217329 - RNA, 63 nt, hsa
ucugugacauguuuauauucacccauguacauuuucuguaaauaccaaacgcuacugauuccc

SEQ ID NO: 217330 - RNA, 63 nt, hsa
uguggaaaguuaacacuagcuuuguauuuuuuuuucuguaaaacugugaacugauauauuuuc

SEQ ID NO: 217331 - RNA, 63 nt, hsa
aacccacuuggguaguuacuauccccaaaucuguucuguaaauaauauuauggaaggguuucu

SEQ ID NO: 217332 - RNA, 63 nt, hsa
aaacgcugaagagaguaacaacugcacuaggauuucuguaaggaguaauuuugaucaaaagac

SEQ ID NO: 217333 - RNA, 63 nt, hsa
ucucugauaaagcgucugaucuaaucccagcacuucuguaaccuucagcauuucuuugaagga

SEQ ID NO: 217334 - RNA, 63 nt, hsa
gccaaugaaggacugcaguauuugugugcccgauucuguaaacacacacacacagaguauaua

SEQ ID NO: 217335 - RNA, 63 nt, hsa
aaaaucaguugacguugccuggugguuccuaccuucuguaaaacgaacagauuccuuaagauu

SEQ ID NO: 217336 - RNA, 63 nt, hsa
ucuugguuaaacauugcacaguucuuaccucauuucuguaaauaaaguuuugugaaucuguuu

SEQ ID NO: 217337 - RNA, 63 nt, hsa
guuuauuuuacuuauuuaacccacugguuguuauucuguaacaguuuguauaaaugguaaauu

SEQ ID NO: 217338 - RNA, 63 nt, hsa
gaaauggagaauaagcagcacaguguuauucauuucuguaaauuccuauguagaaggcucagu

SEQ ID NO: 217339 - RNA, 63 nt, hsa
cuuuucugagguuuuucagcuaccucugggucauucuguaauguaaauguuguuaauaagaau

SEQ ID NO: 217340 - RNA, 63 nt, hsa
ucgugagcacaucuuuagggaccaagagugacuuucuguaaggagugacucguggcuugccuu

SEQ ID NO: 217341 - RNA, 63 nt, hsa
cuagugcaguuuuugucauaaauuacaagugaauucuguaaguaaggcugucagucugcuuaa

SEQ ID NO: 217342 - RNA, 63 nt, hsa
cagacagcggggaccaggggaaaacccagccccuucuguaaucccccuucauuuccuaccuuc

SEQ ID NO: 217343 - RNA, 63 nt, hsa
ugucuuccagaaaaauacauaagcuaguuucuguucuguaaagugauaucuuucauacuugac

SEQ ID NO: 217344 - RNA, 63 nt, hsa
aaaauauaaucaaaauucaaagauuuuuuuuguuucuguaacuggaacuaaaucaaaugauua

SEQ ID NO: 217345 - RNA, 63 nt, hsa
gaaaagugaaaccuuaauuuuaucaaaagaaauuucuguaaaugguaugucuccuuagaauac

SEQ ID NO: 217346 - RNA, 63 nt, hsa
uguuacacucugccuauucauugauauaugauauucuguaaauauuguacaauuugaucuuuu

SEQ ID NO: 217347 - RNA, 63 nt, hsa
ugugguggccuuuaugugugcauuaaaauugguuucuguaaaacguguaauaaguugaguauc

SEQ ID NO: 217348 - RNA, 63 nt, hsa
uucaguuuuuauuaaucuacuguaucaauaaaauucuguaauuugaaugaguuuuuaauaguc

SEQ ID NO: 217349 - RNA, 63 nt, hsa
ugaaaaaaagugcugaaaaugggaugugcuguuuucuguaaauucauauuuagccauaguaua

SEQ ID NO: 217350 - RNA, 63 nt, hsa
gcuuaucuuauccuguuuauuuuuccaaugcuuuucuguaauacauuauguaauuuaaaaaau

SEQ ID NO: 217351 - RNA, 63 nt, hsa
uuaauugcauuuccagcaaggaaugacauucaguucuguaagaaaugagugguauuugaugua

SEQ ID NO: 217352 - RNA, 63 nt, hsa
cauaauuucaagaggaggauuuauaaaaccauuuucuguaaucaaaugauuggugucauuuuc

SEQ ID NO: 217353 - RNA, 63 nt, hsa
ugccuuacagacuuuacaggcuuggcuuugagauucuguaacugcagacuucauuagcacaca

SEQ ID NO: 217354 - RNA, 63 nt, hsa
uuauucuuggauguauaaagugaacuuuuuggcuucuguaaguaugcucuaugcaccucuaau

SEQ ID NO: 217355 - RNA, 63 nt, hsa
auguauuuauauguuguacacaguacuggcugauucuguaaauggauguauuguacagagaac

SEQ ID NO: 217356 - RNA, 63 nt, hsa
agguuuggcaaaaaaaaaaauauuaacaaaauauucuguaagaaucaauugucuauauggaau

SEQ ID NO: 217357 - RNA, 63 nt, hsa
guaaaauuuauacacacaaaaauuaacaaaagauucuguaagaauuaauuggcuauauggaau

SEQ ID NO: 217358 - RNA, 63 nt, hsa
uuuuauuuuuguuuuuuagccuguuauauuuccuucuguaaaauaaaauauguccagaagagg

SEQ ID NO: 217359 - RNA, 63 nt, hsa
gacauacaucauucugugauuaaaucuccagauuucuguaaaugauaccuacauucuaaagag

SEQ ID NO: 217360 - RNA, 63 nt, hsa; identical to SEQ ID NO: 217358

SEQ ID NO: 217361 - RNA, 63 nt, hsa; identical to SEQ ID NO: 217359

SEQ ID NO: 217362 - RNA, 64 nt, hsa
uaacugguaugucacugaguaacuugacucggugucagagcauuuuaacuagccacucagauga

SEQ ID NO: 217363 - RNA, 64 nt, hsa
ugacuuuauuuuguaaugggaggaagaaauuuucucagagcaaacuuucuauuuuuuaccugug

SEQ ID NO: 217364 - RNA, 64 nt, hsa
ugcaggcuuagguccucacuucugucuccugucuucagagcaaaagacuugagccauccaaaga

SEQ ID NO: 217365 - RNA, 64 nt, hsa
cccuccccugcucccagguugaggugcgcucaccucagagcagggccaaagcacagcugggcau

SEQ ID NO: 217366 - RNA, 64 nt, hsa
ccaggccugcaggggcaaggggcuggcuggagucucagagcacagagguaggagaacugggguu

SEQ ID NO: 217367 - RNA, 64 nt, hsa
uguucucauuccguauaugagcacaaguaagguuucagagcaacacacaugagaaagagaguaa

SEQ ID NO: 217368 - RNA, 64 nt, hsa
cauggaucaagccccuaaaaugugguaaguguugucagagcagggcaauaucucuacucucaag

SEQ ID NO: 217369 - RNA, 64 nt, hsa
acucgcucggcaggauuaugcgaucacggaucagucagagcagggucaggagacggggcugacg

SEQ ID NO: 217370 - RNA, 64 nt, hsa
cacauugaauccugcccgucagggcaccuuuuccucagagcaauccggccacacgaauagaagg

SEQ ID NO: 217371 - RNA, 64 nt, hsa
ccaccggcacuguccauuugccugucugucaagcucagagcauggauaagccacacagcagggc

SEQ ID NO: 217372 - RNA, 64 nt, hsa
uuauaaaugugcuuugccugccucagccucauggucagagcaguggagacuggagcccuguuug

SEQ ID NO: 217373 - RNA, 64 nt, hsa
cuaauuuuuucuuuugugugaauuacugaauauuucagagcaaagcuaucaacuuggagaaaca

SEQ ID NO: 217374 - RNA, 64 nt, hsa
auuguuucaugaguucacuuaacuacugagauauucagagcauuuuuaccucucucuuaaaugu

SEQ ID NO: 217375 - RNA, 64 nt, hsa
caaccacaaacccuaucagaucuauucaccuuuuucagagcagauauuuuguaacauucucuuu

SEQ ID NO: 217376 - RNA, 64 nt, hsa
ucuguucccuucuaaguuguuugcuguguuuucuucagagcaagaagguuauauuuuuuaaaau

SEQ ID NO: 217377 - RNA, 64 nt, hsa
uguuugugccaguacaugaccuuaacuuccuuccucagagcacugagcugccaucugggcuauu

SEQ ID NO: 217378 - RNA, 64 nt, hsa
gcugccccuuuaggaucaagaaagauguacacugucagagcauuguuaaugagacaaaaguugu

SEQ ID NO: 217379 - RNA, 64 nt, hsa
uggcaucacgucagugcucagaaauuuucugaucucagagcauuucaauuagggaugcucaaac

SEQ ID NO: 217380 - RNA, 64 nt, hsa
ugggagucuaaccugcgucauuucagcucuugcuucagagcagauuucgauuuuuuuuggaaga

SEQ ID NO: 217381 - RNA, 64 nt, hsa
uaauauaggauuauaaaucagcuagugaaagaccucagagcaguuguaaguagaucugccaucu

SEQ ID NO: 217382 - RNA, 64 nt, hsa
gccauuucgccauuauuugugaucgguaggcaguucagagcauaaguuaacugugaaaaaaaug

SEQ ID NO: 217383 - RNA, 64 nt, hsa
accugcuguuugcuuucugaaagaauuucagaaaucagagcaaaugugucuuuaggcagauuca

SEQ ID NO: 217384 - RNA, 64 nt, hsa
ugcuguuuucugaaggugagaagccauuuuuagcucagagcaacccuuaagagaacuuuuggca

SEQ ID NO: 217385 - RNA, 64 nt, hsa
cuuuuucccugcccaacccuguggccuucagggcucagagcagcaaaggccugaagagugagcu

SEQ ID NO: 217386 - RNA, 55 nt, hsa
ccucccaccucuuccucugagccguucagagcaccuugugguguagugggggcug

SEQ ID NO: 217387 - RNA, 64 nt, hsa
gcugaccaccucuccaacagaagccuaguccuguucagagcagcacugucacugcaaguccagc

SEQ ID NO: 217388 - RNA, 64 nt, hsa
ccugggaugccuaacugucuacucccugcaagccucagagcagccaagucauugguguucauuu

SEQ ID NO: 217389 - RNA, 64 nt, hsa
cccaucugauggaggaacuuuaaacgcuguuuucucagagcaagcuaugcaccugggaguuccu

SEQ ID NO: 217390 - RNA, 64 nt, hsa
uaggacucaguaucugugaaauguccgucauaucucagagcauauagagggaauuaaauaaaca

SEQ ID NO: 217391 - RNA, 64 nt, hsa
agcacuuggcccggggucuccugcucgccucccuucagagcaucugccaaacuucgggcaucua

SEQ ID NO: 217392 - RNA, 64 nt, hsa
auguuuuaguuaagaguccuguuggcugcaggacucagagcauggacagguggauaguaaauca

SEQ ID NO: 217393 - RNA, 64 nt, hsa
uagccucauuucuuacagacggggaaacugaggcucagagcagcagguguuacccaaggucaca

SEQ ID NO: 217394 - RNA, 64 nt, hsa
ccucacucuguuuuccaggggagaaaccugagucucagagcaggggaguggcuucccaaggucu

SEQ ID NO: 217395 - RNA, 64 nt, hsa
ccuagaaugggagaguaaguagacaguggugauaaccccacacugcuuauaagugcaucuuuau

SEQ ID NO: 217396 - RNA, 64 nt, hsa
gaaacauacugcugcacugacuuuucuccgugugaccccacaauugacauggcuccuccauccc

SEQ ID NO: 217397 - RNA, 64 nt, hsa
gugaauaggcugcuuuuugcuuucuucuuuccagaccccacaguagagcacuuuucacuuauuu

SEQ ID NO: 217398 - RNA, 64 nt, hsa
cuuaaccguggacucuuccuuuauccccuccuuuaccccacauaugcaaugacuuuuaauuuuc

SEQ ID NO: 217399 - RNA, 64 nt, hsa
ucacuuagaaugaaguaaccucaagguaccaaauaccccacauaaggaaaguacuacacuaaau

SEQ ID NO: 217400 - RNA, 64 nt, hsa
cauauaguagagugaggugagggucguggcuaaaaccccacaauaacuuuacauuccuagcuuu

SEQ ID NO: 217401 - RNA, 64 nt, hsa
uuauuacacauaagauaauucauagcggagagaaaccccacaaaugugaagaauguggcagagc

SEQ ID NO: 217402 - RNA, 64 nt, hsa
uuaguacacauaagaaaauucauacuggggagaaaccccacaaauguggagaaugcggaaaagc

SEQ ID NO: 217403 - RNA, 64 nt, hsa
uuucugcacauaauauaauucauacuggagagaaaccccacaaauaugaagaaugugguaaugc

SEQ ID NO: 217404 - RNA, 64 nt, hsa
agcaggccccacagaccccacagaggaugaagccaccccacagaggaugcagcccccagcugca

SEQ ID NO: 217405 - RNA, 64 nt, hsa
auggaaugcugaugacuuggagcaggccccacagaccccacagaggaugaagccaccccacaga

SEQ ID NO: 217406 - RNA, 64 nt, hsa
ccuccuuggucgggcaccauaccuccuccccuccaccccacacccuguguccauaucaagccag

SEQ ID NO: 217407 - RNA, 64 nt, hsa
agucuggcucagcagcccccucccgggcagcuucaccccacacccaggggccaggcucucccgg

SEQ ID NO: 217408 - RNA, 64 nt, hsa
gcgagacaggccaggcucguggcucggaagacaaaccccacacacacucaaggggucgaaaaca

SEQ ID NO: 217409 - RNA, 64 nt, hsa
caaaccccacacacacucaaggggucgaaaacaaaccccacacgagggcucucaccuccuucuc

SEQ ID NO: 217410 - RNA, 64 nt, hsa
gggcugcucaguucacaggaggcucccagcagccaccccacauccagccuacacagaacuucgu

SEQ ID NO: 217411 - RNA, 64 nt, hsa
uucucaccugcaguuuuggugaagcaggagaugcaccccacagcucuagcucucaaauggcuuc

SEQ ID NO: 217412 - RNA, 64 nt, hsa
uuucaaucuacguucuagucacuggccucaaaggaccccacagcaccugggccagaccaacagc

SEQ ID NO: 217413 - RNA, 64 nt, hsa
agacaccucaagcccuauucacaggcaccaggaaaccccacacaggaauucccaucccuggaaa

SEQ ID NO: 217414 - RNA, 64 nt, hsa
ccucaagaaacccccagugccuuguaugaagcccaccccacauggcccacagcuccugugcugg

SEQ ID NO: 217415 - RNA, 64 nt, hsa
ugggaaucagcauaacagggcaaugcagcaauuaaccccacaucguuuucuguaguuccuuuuu

SEQ ID NO: 217416 - RNA, 64 nt, hsa
uagacuuugcuacaggauuucaggguuuccaaucaccccacagguaagugaaugccaaagucuu

SEQ ID NO: 217417 - RNA, 64 nt, hsa
auuuacuuggaaagauuuuaccugugaagugaaauucuuucauuggggguaaggguaugaggug

SEQ ID NO: 217418 - RNA, 64 nt, hsa
gccaagcaaaaugauaguaaauucuuugucuuuguucuuucagucagagguauuuauuaaguac

SEQ ID NO: 217419 - RNA, 64 nt, hsa
aacagugugacugagugaaugaagauaaguuggauucuuucagagcauucuuuuccucaaaacg

SEQ ID NO: 217420 - RNA, 64 nt, hsa
ucuuaauaacaaaggucccuuuaugaguuauuccuucuuucaguucaucucacuggagcacagc

SEQ ID NO: 217421 - RNA, 64 nt, hsa
cuuucccauugccuugaaggucuggcaaucccuguucuuucauuugacaaguacuuacugagua

SEQ ID NO: 217422 - RNA, 64 nt, hsa
uggcuacuugagaaaaaggagaggggagaaccccuucuuucauuccaacugccuccgaccccaa

SEQ ID NO: 217423 - RNA, 64 nt, hsa
uccccuccuccaaacacacacagaaugggcugguuucuuucaaguuuaaaaaaagcccccuucu

SEQ ID NO: 217424 - RNA, 64 nt, hsa
ucugacagcugccuuugaaacccaaagccucggguucuuucaagcuacauguacuaaauugucg

SEQ ID NO: 217425 - RNA, 64 nt, hsa
uuuguucaaagauuaaugccaacucuuaagauuauucuuucaccaacuauagaauguauuuuau

SEQ ID NO: 217426 - RNA, 64 nt, hsa
cucagcccucuacugagucccuuagccaagcaguuucuuucaaagaagccagcaggcgaaaagc

SEQ ID NO: 217427 - RNA, 64 nt, hsa
uccuuuucuucuuucaccucccuuauuucuuugcuucuuucauuccuaguucccauucuccuuu

SEQ ID NO: 217428 - RNA, 64 nt, hsa
acauuucucuuucucuuuauuuuuucuccuuuucuucuuucaccucccuuauuucuuugcuucu

SEQ ID NO: 217429 - RNA, 64 nt, hsa
cugccuuuaauguguuuuugaggaacuuaaaauuuucuuucaugucgcugauccauauuaccaa

SEQ ID NO: 217430 - RNA, 64 nt, hsa
ugauuuacuuauuuuuccaaauuucguuugaauuuucuuucauaugauugcauugaucuaugca

SEQ ID NO: 217431 - RNA, 64 nt, hsa
aauauuaaauauauuuuagugacagagugccaacuucuuucaucaggaaaccuuauucaggagg

SEQ ID NO: 217432 - RNA, 64 nt, hsa
uauuucuuaaggggguagggaaaauuaguucccauucuuucaacccccuuaacuguauagcucu

SEQ ID NO: 217433 - RNA, 64 nt, hsa
agaccaagauauaauuuuuuaaaaauaaguuuauuucuuucaagguuuacaaauaacaaaggug

SEQ ID NO: 217434 - RNA, 64 nt, hsa
uaugugauuguuuuuuaauugcuguaggauccuguucuuucagcaggugaaaaauaaaacgcag

SEQ ID NO: 217435 - RNA, 64 nt, hsa
aaaguaguuguucacaaaagaauucgccauggaauucuuucaguuaccaagcucuccugguaau

SEQ ID NO: 217436 - RNA, 64 nt, hsa
auuggcaugaaauggccaacuguggcuguuacaguucuuucauucaauuauaacuuguaaacca

SEQ ID NO: 217437 - RNA, 64 nt, hsa
aucaaacauuucaacuagguaucagaaaaaggcuuucuuucauaagacuauuuuaaauagaaau

SEQ ID NO: 217438 - RNA, 64 nt, hsa
cugacgcccucuccaugccccacaguaauguggcuucuuucauggguuuuuuuuucuucuuuuu

SEQ ID NO: 217439 - RNA, 64 nt, hsa
uucuguguggguauaauauagcuuucuaauuuuuuucuuucacaaaggcagguucaaaauucug

SEQ ID NO: 217440 - RNA, 64 nt, hsa
auuaagaauuaccuuucauuuucucuuuauguuauucuuucacuuuuguagauuacauuuaaua

SEQ ID NO: 217441 - RNA, 64 nt, hsa
ucagugccuuccucucucuaccagucuauuuccauucuuucagcugugucugacauguuugugc

SEQ ID NO: 217442 - RNA, 64 nt, hsa
gccacaagaccuagccuaauuuaccaaggaugaauucuuucaauucuucaugcgugcccuuuuc

SEQ ID NO: 217443 - RNA, 64 nt, hsa
ugccaagauucaagcagucggagcagccagaacuuucuuucacgguuacuguuccugaaaagaa

SEQ ID NO: 217444 - RNA, 64 nt, hsa
auuugagaguacaggugcauauuaauuuucuugguucuuucagcugaauuauauugguccagaa

SEQ ID NO: 217445 - RNA, 64 nt, hsa
ucucagacagcauaaaugcuguuuuagcacuggauucuuucacugagcacaaagaguuguuggg

SEQ ID NO: 217446 - RNA, 64 nt, hsa
aauuuuacuggaacuauugaauaaaucuuuuauuuucuuucagguuuacuugauaguggauaca

SEQ ID NO: 217447 - RNA, 64 nt, hsa
aauguggugaugaaauugccagguugucugauauuucuuucagacuucgccagacagauugcug

SEQ ID NO: 217448 - RNA, 64 nt, hsa
uuuagacaauugucuuuuuuucaagaugcuuuguuucuuucauaugaaaaaaaugcauuuuaua

SEQ ID NO: 217449 - RNA, 64 nt, hsa
cucuuacugaguaaaccagaggcuugcaucgcuauucuuucaccugucaauauuaauaagaaaa

SEQ ID NO: 217450 - RNA, 64 nt, hsa
uaaauucuguauuaaaauggaauuauaugcaacauucuuucauucuguaaacuaauuccauuug

SEQ ID NO: 217451 - RNA, 64 nt, hsa
guuuuauuaccuuuuauugucuguucuucuuuucuucuuucauuucaguggcauuuggaagcaa

SEQ ID NO: 217452 - RNA, 64 nt, hsa
gcauuuggaagcaaagagugcuaggcaccugcuguucuuucaggaaacagcuuggcugugguaa

SEQ ID NO: 217453 - RNA, 64 nt, hsa
uuuaccugcacaugcuuucuuucauuuccucggauucuuucaccacuuuuuaaguuuuuuuucc

SEQ ID NO: 217454 - RNA, 64 nt, hsa
guccuugcccugccucaguuuaccugcacaugcuuucuuucauuuccucggauucuuucaccac

SEQ ID NO: 217455 - RNA, 64 nt, hsa
cucaguagauaagguguauuuuucccuaucugguuucuuucaauacuuuuucuuuguuugauuu

SEQ ID NO: 217456 - RNA, 64 nt, hsa
cuuuuccuucccuccagagaacuucuuuuaaugcuucuuucaaggcaugucuacuggcaacuaa

SEQ ID NO: 217457 - RNA, 64 nt, hsa
guauuucuuuuuugcauuuaauggccucagacauuucuuucaucagucuaaaaguuagaaauau

SEQ ID NO: 217458 - RNA, 64 nt, hsa
ccagaaaaccgcuuuuuaaaaaaacacuuggugauucuuucaagugccgaauguuauuagaauc

SEQ ID NO: 217459 - RNA, 64 nt, hsa
aaaauuucucaaacuuacuugacaacaaaacccauucuuucaguuacaucuacuaagagcucgu

SEQ ID NO: 217460 - RNA, 51 nt, hsa
aauuaugugaagaaaauuaauuucuuucaaaguuugcuuuuuaaagcaaag

SEQ ID NO: 217461 - RNA, 64 nt, hsa
acauacucucuucaaagagcaugagaugcagccauucuuucagcaaagcuucauugacaccugc

SEQ ID NO: 217462 - RNA, 64 nt, hsa
aaucccguaacaccugauuaacugaggcauccacuucuuucagcagacugaucaggaccuccaa

SEQ ID NO: 217463 - RNA, 64 nt, hsa
cuccaagaugagaaaggagcaugggacagagagcuucuuucagcaccuccugccccagcauuuc

SEQ ID NO: 217464 - RNA, 64 nt, hsa
uuuguucucuaaaaccacacuaaaguuuucugacuucuuucacacucuuuaugauaauccucug

SEQ ID NO: 217465 - RNA, 64 nt, hsa
cugacuacagcauggaaaaaaauaguucuuuuaauucuuucaccuuaaagcauauuuuaugucu

SEQ ID NO: 217466 - RNA, 64 nt, hsa
gguuuucaggauauaacagcacuucaccgaaauauucuuucagccauaccacugguaacauuuc

SEQ ID NO: 217467 - RNA, 64 nt, hsa
ugccaacuuuccccacguuaaaggugaacauugguucuuucauuugcuuuggaaguuuuaaucu

SEQ ID NO: 217468 - RNA, 64 nt, hsa
aaaacaaaggccuaauucuaugccugucuuaauuuucuuucacuuaaguuaguuccacugagac

SEQ ID NO: 217469 - RNA, 64 nt, hsa
uagccaauagaaaaguuugcuugacauggugcuuuucuuucaucuagaggcaaaacugcuuuuu

SEQ ID NO: 217470 - RNA, 64 nt, hsa
uaucuacaauuuuuucaggauuauuaaaaucuucuucuuucacuaucguagcuuaaacucuguu

SEQ ID NO: 217471 - RNA, 64 nt, hsa
caaaaaaaguaacacccucccuuuuuccugacaguucuuucagcuuuacagaacuguauuauaa

SEQ ID NO: 217472 - RNA, 64 nt, hsa
agguguuuaugucuuaauuaauuguuugaguacauucuuucaacacuacacaugaaugaaucca

SEQ ID NO: 217473 - RNA, 64 nt, hsa
cauaugagguccuaaugaaguacuacaguuuucauucuuucaaggguagacuaaaauauaguuu

SEQ ID NO: 217474 - RNA, 64 nt, hsa
aauacuguacuucauuuaacagaaugauugauuuuucuuucaaucagcauguucaccaaaaaua

SEQ ID NO: 217475 - RNA, 64 nt, hsa
cucuccucugcaauccuggaagcaucgugcauaguucuuucauuguaagccgcuauuuaaauuc

SEQ ID NO: 217476 - RNA, 64 nt, hsa
ggcuuacaugaacgugaaacugugauauaagguuuucuuucauacucauaauuagcccaaaaca

SEQ ID NO: 217477 - RNA, 64 nt, hsa
cuggcccuguagacacguguaagauuauuuaaaauucuuucauuuuuuucugccucuuacuaua

SEQ ID NO: 217478 - RNA, 64 nt, hsa
uagucaacauuuuauauaauguuucaauaaauguuucuuucaauaaagauacuaugugcccuuc

SEQ ID NO: 217479 - RNA, 64 nt, hsa
ccacauuguuuuaauugauuuuucuuaucuugauuucuuucauuagaaacuaucccuaaaugua

SEQ ID NO: 217480 - RNA, 64 nt, hsa
guuauuagaaggaaauacaaagagaaaaauuucuuucuuucaugggcauuugauaauuucaguc

SEQ ID NO: 217481 - RNA, 64 nt, hsa
agagugguguuuacuaugugugugcuugagcauuuucuuucaguuacauggguguaauuuaaaa

SEQ ID NO: 217482 - RNA, 64 nt, hsa
guguuuuccaguuuaaagcaauaacuuucauaguuucuuucaaaguuuaauacauccaauaugu

SEQ ID NO: 217483 - RNA, 64 nt, hsa
auuauggauauuauauaugaaauuuugccuuguauucuuucacuugaaaaaacuccaaaauucc

SEQ ID NO: 217484 - RNA, 64 nt, hsa
uaccaauuuagacucuaguuuguguuacgagguauucuuucaaauuuuuuuuaaaagccaacua

SEQ ID NO: 217485 - RNA, 64 nt, hsa
cuuugugaauuuccuugucuauuuugcucgcuuguucuuucaggugaaauuuauuauuuuauua

SEQ ID NO: 217486 - RNA, 64 nt, hsa
gugccugcaaccaaaugaaaauuaauauagugaguucuuucaggagcuuucucuguuuuucuau

SEQ ID NO: 217487 - RNA, 64 nt, hsa
agggucagcccuuuucuauuuggagcugaaucuuuucuuucauguagaaaucuacauguauaua

SEQ ID NO: 217488 - RNA, 64 nt, hsa
auauucuaaacuggcaaaaauuuucagggugcacuucuuucaucaaaaugaucauccaucuuuu

SEQ ID NO: 217489 - RNA, 61 nt, hsa
auuaggcacgacccaucugugguuccugguugguggcuaaugaagugaggggagggaggga

SEQ ID NO: 217490 - RNA, 61 nt, hsa
cuuucugacuaagcuaaaaaugaaugaaaaugguggcuaaagaaaauagggacucugaaga

SEQ ID NO: 217491 - RNA, 61 nt, hsa
uuugaaagguuauuaugcacuaaccuuuuuugguggcuaauuaggguuuaaauacagaaac

SEQ ID NO: 217492 - RNA, 61 nt, hsa
cagacuugucacugacuuuccuucuggagcagguggcuagaaaaagaggcugugggcagga

SEQ ID NO: 217493 - RNA, 61 nt, hsa
uuucacccaugggcauggucagguagccucugguggcuaugcauuuauuacucaaaaguug

SEQ ID NO: 217494 - RNA, 61 nt, hsa
agcugugggcaggcaagcccuucagucaccugguggcuaauuagaccccuccccuuguguc

SEQ ID NO: 217495 - RNA, 61 nt, hsa
aacuaugaacuacaaagcuucuaucccaggagguggcuauggccacccguucugcuggccu

SEQ ID NO: 217496 - RNA, 61 nt, hsa
agcagagaugaauggcaaacucauagcugcagguggcuauaacagagaggaaugucuucga

SEQ ID NO: 217497 - RNA, 61 nt, hsa
guucagauaucggggcuuucauacuccuguugguggcuauuugggaggcagcaagauguga

SEQ ID NO: 217498 - RNA, 61 nt, hsa
aaaggauccuuauuacaggaaaagcaugagugguggcuaaccugaccaauaaaguuauuuu

SEQ ID NO: 217499 - RNA, 61 nt, hsa
gggcucuaccugagaaggacggcaaggcugagguggcuaagggggaccauggggagguggc

SEQ ID NO: 217500 - RNA, 61 nt, hsa
gcacaggggaugauuacccuccuaggaccgcgguggcuaagucauugcaggaacggggcug

SEQ ID NO: 217501 - RNA, 61 nt, hsa
ccagggagggacccaccagagcacaagagaagguggcuaccugggggugucccagggacuc

SEQ ID NO: 217502 - RNA, 61 nt, hsa
ggaacucuggagguggguucuggucaucugagguggcuacucaacagguuugaggccccac

SEQ ID NO: 217503 - RNA, 61 nt, hsa
aggcccuucagagccagggcagaggaugcacgguggcuagagccgcugcacuauccuuuuc

SEQ ID NO: 217504 - RNA, 61 nt, hsa
caauauaauugaugcuaucuccuaauuacuugguggcuaauaaauguuacauucuuuguua

SEQ ID NO: 217505 - RNA, 61 nt, hsa
auuuuuaagugcucaguagccacauguggcugguggcuacuggauuagacagcacgagucu

SEQ ID NO: 217506 - RNA, 61 nt, hsa
gggcucucuggucucaggccagcuggcgauggguggcuagagugaugaacucaagcccugu

SEQ ID NO: 217507 - RNA, 61 nt, hsa
aucucaguacccaguguuuuagccaugcucggguggcuaaauuacauccaggaauggugcc

SEQ ID NO: 217508 - RNA, 61 nt, hsa
ggcuucugccacccugagcccuagacccauggguggcuaaauccacuggacugugaagacu

SEQ ID NO: 217509 - RNA, 61 nt, hsa
uuucccucugguucuuccuggcuuugcaccugguggcuauuacaaagcaguacugcaguau

SEQ ID NO: 217510 - RNA, 61 nt, hsa
agccaagaaagcagaauaugaaggcaugauggguggcuauccgccaggccuuccaccuuug

SEQ ID NO: 217511 - RNA, 61 nt, hsa
cacaucuggggugcaacgucugcaucauccugguggcuagccagugcggggaggcccugcc

SEQ ID NO: 217512 - RNA, 61 nt, hsa
uccugcuccagaaucgcuagacuaagaauuagguggcuacagaugguagaacuaaacaaua

SEQ ID NO: 217513 - RNA, 61 nt, hsa
cuuuguguugguguguaauuuuuguacucuugguggcuaguuuuugucaaaucuuuuuugg

SEQ ID NO: 217514 - RNA, 61 nt, hsa
caagcugccccugacagcacagggccugggggguggcuaacgagagaggccuuacagugcc

SEQ ID NO: 217515 - RNA, 61 nt, hsa
ucaugaaauagaaacguguuuggcacuuguggguggcuauuuugauuuggcaugacuacuu

SEQ ID NO: 217516 - RNA, 61 nt, hsa
uucagccuccucgucuccacuccagagaggagguggcuaugucuucuuaagccucuggccc

SEQ ID NO: 217517 - RNA, 61 nt, hsa
gcacuguugcuuuaagaacaaggccuuuggagguggcuaaacuugcacgcacgugugugaa

SEQ ID NO: 217518 - RNA, 61 nt, hsa
aaaacuaaggaacaagaaugagucucuuuuugguggcuaaguagaaucuuccuaaaaccau

SEQ ID NO: 217519 - RNA, 61 nt, hsa
uuggcacaccugacuugugggcuguguguaagguggcuagcuaagugaaaaaagccugcua

SEQ ID NO: 217520 - RNA, 61 nt, hsa
gagaugccaagaagggcuauggaacuaugcagguggcuaguggucagacugaagucaccag

SEQ ID NO: 217521 - RNA, 61 nt, hsa
ccuccccucugaccagggacauccugaguuugguggcuacuucccucuggccuaagguagg

SEQ ID NO: 217522 - RNA, 61 nt, hsa
auaaauacacuuccugcuuaaacuugacccagguggcuagcaaauuagaaacaccauucau

SEQ ID NO: 217523 - RNA, 61 nt, hsa
cuggugcucagcuuccccaucagugaaaagggguggcuagaguaacuaaccucagcaggcc

SEQ ID NO: 217524 - RNA, 61 nt, hsa
ccagagagcugggagggaccaagguuguaaggguggcuaagucccaccauaacagcuaagg

SEQ ID NO: 217525 - RNA, 61 nt, hsa
ccgugucugucagacugucugccuguccugggguggcuaggagcugggucugaccguugua

SEQ ID NO: 217526 - RNA, 61 nt, hsa
uugucuugguaauugcaauuuaacuaggugcgguggcuacuaaaguucgaaggcacgauau

SEQ ID NO: 217527 - RNA, 61 nt, hsa
uaaggggcccggccagccaugucugcauuucgguggcuagucaagcuccuccucccugcau

SEQ ID NO: 217528 - RNA, 61 nt, hsa
ugugcauuguaggauaauuagcaguaucccugguggcuacccaauagacgccaguagcacc

SEQ ID NO: 217529 - RNA, 61 nt, hsa
ggcauggggugggggaaacuuggaguuggaagguggcuaaucuuugauucuauguuuuuga

SEQ ID NO: 217530 - RNA, 61 nt, hsa
ccugaccccgaggacuuggucuggucucucugguggcuacaaccccagaguuuuaaggacu

SEQ ID NO: 217531 - RNA, 52 nt, hsa
aaaaggaauggcucauuugagggguggcuacuuggcuaugggauagggagga

SEQ ID NO: 217532 - RNA, 61 nt, hsa
agggccccaugccagucaguguccccaucaugguggcuaugaagcucacggcugaagauuc

SEQ ID NO: 217533 - RNA, 61 nt, hsa
acugggcguggcugauugaggguuuggaacugguggcuaugccagcuauuccaucucaaaa

SEQ ID NO: 217534 - RNA, 61 nt, hsa
gucuuuaugugccuggaaucccaccugcucagguggcuaggguggauggaucgcuugagcc

SEQ ID NO: 217535 - RNA, 61 nt, hsa
cugucuuguggguauuaaugcaaucuucagugguggcuacuguucucuagcuguucuacaa

SEQ ID NO: 217536 - RNA, 61 nt, hsa
caauaaaucugccaucuuugaacucaucuuugguggcuagacugcuacggcagcuucucug

SEQ ID NO: 217537 - RNA, 61 nt, hsa
acuuggucccacguccuccuauagcucugaugguggcuacacaaacugacccucuugggac

SEQ ID NO: 217538 - RNA, 61 nt, hsa
guugaaagaaaaggcacaguuaacaaaaaaggguggcuagauuuaucuugggugauggagg

SEQ ID NO: 217539 - RNA, 61 nt, hsa
gaaagugcauaugaaauccuugacuggaccugguggcuacgaaucuuccgauggaugaauc

SEQ ID NO: 217540 - RNA, 61 nt, hsa
ccaggggacagcagcaggagacuacuccaaagguggcuaugcuggaucaucgcaggcacca

SEQ ID NO: 217541 - RNA, 61 nt, hsa
auuuuccagucuucguugugugaagcuaaaugguggcuaaaaggaacacuuuuugugugau

SEQ ID NO: 217542 - RNA, 61 nt, hsa
cccagcugggccccauuccuggauuuaagaugguggcuaucccugaggagucaccauaagg

SEQ ID NO: 217543 - RNA, 61 nt, hsa
uuaucuaaaagccugcuucagggcugggcgcgguggcuaacaccuauaauucccagcacuu

SEQ ID NO: 217544 - RNA, 61 nt, hsa
cugucugucuagacaggcugucccaccccaggguggcuaguggccauaugcagggaauggu

SEQ ID NO: 217545 - RNA, 61 nt, hsa
agcuuagacauccaaaacuaaucaaugcugagguggcuaaauaccuagccuuuuacaugua

SEQ ID NO: 217546 - RNA, 61 nt, hsa
gugauuaacaaugucuccaaacaccaaaggagguggcuaaagaguauuuugagaugagccc

SEQ ID NO: 217547 - RNA, 61 nt, hsa
caguaauuaauaaccuuccaagaccaggcgcgguggcuaaaaauacaaaaaguuagccggg

SEQ ID NO: 217548 - RNA, 61 nt, hsa
cuauucuucuggaauaagaugccaaugaugugguggcuagaaaugcaacuuguauaaaaca

SEQ ID NO: 217549 - RNA, 61 nt, hsa
uauucuuccauaagaccauguggguuuccaugguggcuaucaauaaaacuccuuaggaaaa

SEQ ID NO: 217550 - RNA, 61 nt, hsa
ugcccaccacgcagcagucaggggagaaaaugguggcuaucccuucugcuuagagaaagaa

SEQ ID NO: 217551 - RNA, 61 nt, hsa
cucaaaaaggacacaaccaguuuggggaagggguggcuaaggaagaugguauaggugaagg

SEQ ID NO: 217552 - RNA, 61 nt, hsa
gccuggcuugcuguggcuaugggaaucagcugguggcuagguuucuagcgcauuugauuuc

SEQ ID NO: 217553 - RNA, 61 nt, hsa
cugauagccuuuggugaugucacugcugggagguggcuauccuguggaccaccuggccucc

SEQ ID NO: 217554 - RNA, 61 nt, hsa
ucuuucacuuccagcuugcccuguucuaggugguggcuaaaucugggccuaaucugggugg

SEQ ID NO: 217555 - RNA, 61 nt, hsa
uggaugcugagcauucuuacucauuaauuuagguggcuaggaauuaaugaaaaaauuuuca

SEQ ID NO: 217556 - RNA, 61 nt, hsa
ucauuuccccccuugaccacugggccaguuggguggcuagguugccucauuuugcauccuu

SEQ ID NO: 217557 - RNA, 53 nt, hsa
gccaguguuguagcaacugaggggguggcuagcagcaaacaaguauggagcua

SEQ ID NO: 217558 - RNA, 61 nt, hsa
acugacuugacacguuuguaaaugguagaacgguggcuacugugaguggggagcagaaccg

SEQ ID NO: 217559 - RNA, 61 nt, hsa
agaaaugucauguggcuaccuguaacuugaagguggcuacaaagaugacuguggacguggg

SEQ ID NO: 217560 - RNA, 61 nt, hsa
caauuucccuuucguugggagugggcagugggguggcuaauugucuucggccaaccagggg

SEQ ID NO: 217561 - RNA, 61 nt, hsa
ccccaucaccuacucacacaggcauuuccuggguggcuacucugugccagagccuggggcu

SEQ ID NO: 217562 - RNA, 61 nt, hsa
gggcuucaguuauccuuugauguccugcagggguggcuaaugugcugggguuuuucugugu

SEQ ID NO: 217563 - RNA, 61 nt, hsa
uauagguuugugacacaagaagucauacuuugguggcuaaguuuuacuaaggaaaauaacu

SEQ ID NO: 217564 - RNA, 61 nt, hsa
aucuuguaaaaacugggagcaggccagguacgguggcuaacgccuguaauccugacacuuu

SEQ ID NO: 217565 - RNA, 61 nt, hsa
gagugugggaagggagagcggggcagucucggguggcuagucagagagaguguuugggggu

SEQ ID NO: 217566 - RNA, 61 nt, hsa
acauuuaaaaggcuauuucaagacgaggugcgguggcuauaauccuagcacuuugggaggc

SEQ ID NO: 217567 - RNA, 61 nt, hsa
gaggaaacgaggacguagggugugacugaaugguggcuagauuagugggagcaguucaccu

SEQ ID NO: 217568 - RNA, 61 nt, hsa
auuuauccaccuccaucuucuuugcagccuggguggcuauggguacuucguggccgcacau

SEQ ID NO: 217569 - RNA, 61 nt, hsa
cauaugcagugccuuuuuuccuuuuaacauagguggcuagccaaaguuuagaauuuuuguc

SEQ ID NO: 217570 - RNA, 61 nt, hsa
ugcugugcuucccacccuugucagagggaaggguggcuauguguuauuuucacugucuuuu

SEQ ID NO: 217571 - RNA, 61 nt, hsa
agcccugcccccuuucccuccuuccuggagugguggcuacagaagcuuggggccaacccug

SEQ ID NO: 217572 - RNA, 61 nt, hsa
ugaaggcacagggccugcuagugggcacagggguggcuaguuggggccuggggcagaggag

SEQ ID NO: 217573 - RNA, 61 nt, hsa
aggucuuccuguguugcccaggcuggagugcgguggcuauucacagaugcuaucauagcac

SEQ ID NO: 217574 - RNA, 61 nt, hsa
cugaaauugcuuugguccucauagagccugugguggcuacuuuuggucugaaacccacuug

SEQ ID NO: 217575 - RNA, 61 nt, hsa
uauuuagcaaaugcauacaacgaggaaaggagguggcuagugguaucaguucucugaucca

SEQ ID NO: 217576 - RNA, 61 nt, hsa
aguccacgcugacauacagaaugacgaaaaggguggcuacagugucaauggaggaucuggg

SEQ ID NO: 217577 - RNA, 61 nt, hsa
accugguggauggaguugaccaacaucgcuggguggcuacggcccuccuuaggaagcccag

SEQ ID NO: 217578 - RNA, 61 nt, hsa
gagaauacuuguugauuucugaugugcaggggguggcuacagaaaagccccuuucuuccuc

SEQ ID NO: 217579 - RNA, 61 nt, hsa
agagggucacuuuacauaggauuaaguucgagguggcuaccgauuucagcacaugcacuac

SEQ ID NO: 217580 - RNA, 61 nt, hsa
uagagaugccucccugacccugcagagaugcgguggcuaaaggucccaaggcaaggggugc

SEQ ID NO: 217581 - RNA, 61 nt, hsa
cccuggggauggggcggcgguagcagcuguggguggcuaauuaagauagaucgcguuagcc

SEQ ID NO: 217582 - RNA, 61 nt, hsa
ucuaaagccgcagacccuggugcaaugcucugguggcuagggauguacucaugcucauaug

SEQ ID NO: 217583 - RNA, 61 nt, hsa
gucuggaaaggguuacuugccuauggguucugguggcuagagagaaaaguagaaaaccaga

SEQ ID NO: 217584 - RNA, 61 nt, hsa
gagcaaagagccagcacccugaugucccugggguggcuaggcaggaguggcguggggccaa

SEQ ID NO: 217585 - RNA, 61 nt, hsa
ggguuggccacaauugaucucuugugagagggguggcuaccagugugugugugggggucau

SEQ ID NO: 217586 - RNA, 61 nt, hsa
cuucuugaguucuuugcucuucugaguucuugguggcuaauaacagucagauuagggucuc

SEQ ID NO: 217587 - RNA, 61 nt, hsa
acuggauuuuauaggcauuaaagacaagucggguggcuagagggcuccuugagacauaccu

SEQ ID NO: 217588 - RNA, 61 nt, hsa
cugagacccaugaucaggggauguggcgggggguggcuagagggagaaaaaggaaaugucu

SEQ ID NO: 217589 - RNA, 61 nt, hsa
agagccaauaaaaggacuggugggggccggggguggcuauugugggaagucauaacccaca

SEQ ID NO: 217590 - RNA, 61 nt, hsa
cucugcuccagcaagcaaacaggguggcccagguggcuauuuugagaacuccagcuggugc

SEQ ID NO: 217591 - RNA, 61 nt, hsa
ccuuaccuaaguuuggacucucggggccaaagguggcuaaggcagaggcugagggggcugg

SEQ ID NO: 217592 - RNA, 61 nt, hsa
ugggggcaggauggcggaaaggaaggggcgugguggcuagagggaagagaagaaacagaag

SEQ ID NO: 217593 - RNA, 61 nt, hsa
uggggggaagaugcgggaaaggaaggggcgugguggcuagagggaagagaagaaacagaag

SEQ ID NO: 217594 - RNA, 61 nt, hsa
uucucccccacagguucgaaccucugacauggguggcuaugcuacuugccaugacuucacu

SEQ ID NO: 217595 - RNA, 61 nt, hsa
cuagccauauuucaagugcucaacagccacugguggcuauugguuaccuuacugaccagcc

SEQ ID NO: 217596 - RNA, 61 nt, hsa
uaugugugccaggcuggcuggcaggaacugggguggcuaucaauauuggauggcgaggaca

SEQ ID NO: 217597 - RNA, 61 nt, hsa
aaugcaaaguuauuugcagguugaauuucuugguggcuauuagcagaagugcagaguaggg

SEQ ID NO: 217598 - RNA, 61 nt, hsa
gucugugcucaggaagagggaaggggauggggguggcuaguaggcuccuggccucuuuggu

SEQ ID NO: 217599 - RNA, 61 nt, hsa
cuaagagcauagaacucaaaugcuggggguagguggcuaaucucaggacugggaagauuac

SEQ ID NO: 217600 - RNA, 61 nt, hsa
ucaugggggguggagggaggugaggugcccagguggcuauuugcccugcagagcugggagu

SEQ ID NO: 217601 - RNA, 61 nt, hsa
ugguuggaauuucauuguaucgcauuauccagguggcuaguggcauuugauaauauagaga

SEQ ID NO: 217602 - RNA, 61 nt, hsa
ggagaaucuuuccuugccacguccaccuuuugguggcuauuggcauuuuuuggcuuauggc

SEQ ID NO: 217603 - RNA, 61 nt, hsa
gaacagacuggccugaggagcagcaguugcugguggcuaaugguguaaccugagauggccc

SEQ ID NO: 217604 - RNA, 61 nt, hsa
gcuuucauugccauagucuguaaaagacuuugguggcuagaccacuuuauaccuucgcagu

SEQ ID NO: 217605 - RNA, 61 nt, hsa
uugccaaggcugcuugugcuaccaguuugcugguggcuaacggcuugugcuugaaagucuu

SEQ ID NO: 217606 - RNA, 61 nt, hsa
ucuuagacaugaggauauuggaacucagagagguggcuauugcauugcgcagaacgcuaca

SEQ ID NO: 217607 - RNA, 61 nt, hsa
ccuagaagccccucacccccacuggcccacugguggcuaggucuccccuuauccuucuggu

SEQ ID NO: 217608 - RNA, 61 nt, hsa
ugaauuuauacgaauacugggacuguuaacagguggcuauacaucgacguuuucaaugugc

SEQ ID NO: 217609 - RNA, 61 nt, hsa
ggccccacccucuggcuggugcugggccggagguggcuauggaggauuuuggcaugcgugg

SEQ ID NO: 217610 - RNA, 64 nt, hsa; identical to SEQ ID NO: 181517

SEQ ID NO: 217611 - RNA, 64 nt, hsa; identical to SEQ ID NO: 181518

SEQ ID NO: 217612 - RNA, 64 nt, hsa; identical to SEQ ID NO: 181519

SEQ ID NO: 217613 - RNA, 64 nt, hsa; identical to SEQ ID NO: 181520

SEQ ID NO: 217614 - RNA, 64 nt, hsa; identical to SEQ ID NO: 181521

SEQ ID NO: 217615 - RNA, 64 nt, hsa; identical to SEQ ID NO: 181522

SEQ ID NO: 217616 - RNA, 64 nt, hsa; identical to SEQ ID NO: 181523

SEQ ID NO: 217617 - RNA, 64 nt, hsa; identical to SEQ ID NO: 181524

SEQ ID NO: 217618 - RNA, 64 nt, hsa; identical to SEQ ID NO: 181525

SEQ ID NO: 217619 - RNA, 64 nt, hsa; identical to SEQ ID NO: 181526

SEQ ID NO: 217620 - RNA, 64 nt, hsa; identical to SEQ ID NO: 181527

SEQ ID NO: 217621 - RNA, 64 nt, hsa; identical to SEQ ID NO: 181528

SEQ ID NO: 217622 - RNA, 64 nt, hsa; identical to SEQ ID NO: 181529

SEQ ID NO: 217623 - RNA, 64 nt, hsa; identical to SEQ ID NO: 181530

SEQ ID NO: 217624 - RNA, 64 nt, hsa; identical to SEQ ID NO: 181531

SEQ ID NO: 217625 - RNA, 64 nt, hsa; identical to SEQ ID NO: 181532

SEQ ID NO: 217626 - RNA, 64 nt, hsa; identical to SEQ ID NO: 181533

SEQ ID NO: 217627 - RNA, 64 nt, hsa; identical to SEQ ID NO: 181534

SEQ ID NO: 217628 - RNA, 64 nt, hsa; identical to SEQ ID NO: 181535

SEQ ID NO: 217629 - RNA, 64 nt, hsa; identical to SEQ ID NO: 181536

SEQ ID NO: 217630 - RNA, 64 nt, hsa; identical to SEQ ID NO: 181537

SEQ ID NO: 217631 - RNA, 64 nt, hsa; identical to SEQ ID NO: 181538

SEQ ID NO: 217632 - RNA, 64 nt, hsa; identical to SEQ ID NO: 181539

SEQ ID NO: 217633 - RNA, 64 nt, hsa; identical to SEQ ID NO: 181540

SEQ ID NO: 217634 - RNA, 64 nt, hsa; identical to SEQ ID NO: 181541

SEQ ID NO: 217635 - RNA, 64 nt, hsa; identical to SEQ ID NO: 181542

SEQ ID NO: 217636 - RNA, 64 nt, hsa; identical to SEQ ID NO: 181543

SEQ ID NO: 217637 - RNA, 64 nt, hsa; identical to SEQ ID NO: 181544

SEQ ID NO: 217638 - RNA, 64 nt, hsa; identical to SEQ ID NO: 181545

SEQ ID NO: 217639 - RNA, 64 nt, hsa; identical to SEQ ID NO: 181546

SEQ ID NO: 217640 - RNA, 64 nt, hsa; identical to SEQ ID NO: 181547

SEQ ID NO: 217641 - RNA, 64 nt, hsa; identical to SEQ ID NO: 181548

SEQ ID NO: 217642 - RNA, 53 nt, hsa; identical to SEQ ID NO: 181549

SEQ ID NO: 217643 - RNA, 59 nt, hsa; identical to SEQ ID NO: 181550

SEQ ID NO: 217644 - RNA, 64 nt, hsa; identical to SEQ ID NO: 181551

SEQ ID NO: 217645 - RNA, 64 nt, hsa; identical to SEQ ID NO: 181552

SEQ ID NO: 217646 - RNA, 64 nt, hsa; identical to SEQ ID NO: 181553

SEQ ID NO: 217647 - RNA, 64 nt, hsa; identical to SEQ ID NO: 181554

SEQ ID NO: 217648 - RNA, 64 nt, hsa; identical to SEQ ID NO: 181555

SEQ ID NO: 217649 - RNA, 64 nt, hsa; identical to SEQ ID NO: 181556

SEQ ID NO: 217650 - RNA, 64 nt, hsa; identical to SEQ ID NO: 181557

SEQ ID NO: 217651 - RNA, 64 nt, hsa; identical to SEQ ID NO: 181558

SEQ ID NO: 217652 - RNA, 64 nt, hsa; identical to SEQ ID NO: 181559

SEQ ID NO: 217653 - RNA, 64 nt, hsa; identical to SEQ ID NO: 181560

SEQ ID NO: 217654 - RNA, 64 nt, hsa; identical to SEQ ID NO: 181561

SEQ ID NO: 217655 - RNA, 64 nt, hsa; identical to SEQ ID NO: 181562

SEQ ID NO: 217656 - RNA, 64 nt, hsa; identical to SEQ ID NO: 181563

SEQ ID NO: 217657 - RNA, 64 nt, hsa; identical to SEQ ID NO: 181564

SEQ ID NO: 217658 - RNA, 64 nt, hsa; identical to SEQ ID NO: 181565

SEQ ID NO: 217659 - RNA, 64 nt, hsa; identical to SEQ ID NO: 181566

SEQ ID NO: 217660 - RNA, 64 nt, hsa; identical to SEQ ID NO: 181567

SEQ ID NO: 217661 - RNA, 64 nt, hsa; identical to SEQ ID NO: 181568

SEQ ID NO: 217662 - RNA, 64 nt, hsa
aaggaacuugaaauguggggagugauaauaguccagugauuaaacuacaguccagugauuacca

SEQ ID NO: 217663 - RNA, 64 nt, hsa
gagugauaauaguccagugauuaaacuacaguccagugauuaccaccaacuuucugacuaagcu

SEQ ID NO: 217664 - RNA, 64 nt, hsa
auucugacuggugugagaugguaugcauuucuguagugauuagugaugaugagugauuuuuaua

SEQ ID NO: 217665 - RNA, 64 nt, hsa
agcaguuucauucaagaaaaguuuaaaauuaaaaagugauuaucaaagaauaucagggccugac

SEQ ID NO: 217666 - RNA, 64 nt, hsa
uauaaauuguaaagguaauguuuaaucauuguauagugauuaugccucugguauagcuuuccua

SEQ ID NO: 217667 - RNA, 64 nt, hsa
aaaagaaaugugcauauauuuauucuguaauuucagugauuauaaauuguaaagguaauguuua

SEQ ID NO: 217668 - RNA, 64 nt, hsa
aguacuuuccuuauuggcaacuuauggacucgcuagugauuaaacgaggcaaugacugugagcg

SEQ ID NO: 217669 - RNA, 64 nt, hsa
gcauuggccuuaauauaccuaaaucuccaaaaacagugauuaaagcaagagaauuauuacaagg

SEQ ID NO: 217670 - RNA, 64 nt, hsa
accuuuacaauggagacaucuaccagaucauccaagugauuaaauuuaacaucaucaaugaugg

SEQ ID NO: 217671 - RNA, 64 nt, hsa
uggguggcggggagaaggauacaccaaaaaacuaagugauuaucuuuggaugggaaaauguuug

SEQ ID NO: 217672 - RNA, 64 nt, hsa
aagacauuagugauuagacaggagggaagauauuagugauuagacagcagggaagauauuagug

SEQ ID NO: 217673 - RNA, 64 nt, hsa
cuuaacucagugauuagacaggaaggaagacauuagugauuagacaggagggaagauauuagug

SEQ ID NO: 217674 - RNA, 64 nt, hsa
uccuguaaguaaaugacuauuuuucccuuaacucagugauuagacaggaaggaagacauuagug

SEQ ID NO: 217675 - RNA, 64 nt, hsa
aauuuuaccuauuuuuauaauuauuauuucuuaaagugauuaaaugagaacauggaugagugga

SEQ ID NO: 217676 - RNA, 64 nt, hsa
cuaaauaagauuuuaaacuaauucauauguaaaaagugauuaggaagaacuugaaguaucauuu

SEQ ID NO: 217677 - RNA, 64 nt, hsa
cauuucuugccacuuccccaacuagaccacuccuagugauuacugacuuuagugccuaaaccuu

SEQ ID NO: 217678 - RNA, 64 nt, hsa
cauucaggccagagacacagagaccacauagcccagugauuaaaccccgguuucacucuggccc

SEQ ID NO: 217679 - RNA, 64 nt, hsa
gcugggggcuuccccuucauguggcaccuuugugccaggccaccaggcagacucuucccaccuu

SEQ ID NO: 217680 - RNA, 64 nt, hsa
ucaccccaaaaguaggcccucccauuggcuuuggccaggccagacacuucacaucguuuacaug

SEQ ID NO: 217681 - RNA, 64 nt, hsa
cgcagaagcccugccugguccaguccgggggcggccaggccaacugcaagauucuggacuguuu

SEQ ID NO: 217682 - RNA, 64 nt, hsa
cuguuaacaccccuuugcuuuuucuaugggaccuccaggccaccauauuuagaacuaguuaccu

SEQ ID NO: 217683 - RNA, 64 nt, hsa
ugcgcuuugccggacuggauggaguggaggaggcccaggccacaguaccaccccaccugcccag

SEQ ID NO: 217684 - RNA, 64 nt, hsa
augaguuucacagugcuguaggggccuacacguuccaggccaguggccaggccuugugccgugg

SEQ ID NO: 217685 - RNA, 64 nt, hsa
ucuuuacuagagcugaaaggcccccuugacacauccaggccaaccucccauggaauagguaggc

SEQ ID NO: 217686 - RNA, 64 nt, hsa
gggagcagcccagggccaagccccgcugccuuccccaggccacagugcguccagucuccugucc

SEQ ID NO: 217687 - RNA, 64 nt, hsa
accuagcaggagugccaggccacagccggaacagccaggccaugacccaggggagccagcgcug

SEQ ID NO: 217688 - RNA, 64 nt, hsa
gucgcucccacccuccgugcaccuagcaggagugccaggccacagccggaacagccaggccaug

SEQ ID NO: 217689 - RNA, 64 nt, hsa
caaccacuuuuugaauggugugccauuuaaaaauccaggccagauccuauuauaaccaacucuc

SEQ ID NO: 217690 - RNA, 64 nt, hsa
uaucagaaggucuccuuuuuagcccagcacaggcccaggccacuuugucguguuuguuuuaacu

SEQ ID NO: 217691 - RNA, 64 nt, hsa
ugcccugcccugagcugaguccuuucccugggagccaggccaccuuagaaugggguuuggaagu

SEQ ID NO: 217692 - RNA, 64 nt, hsa
ucuccugaccccauugggaacacggaagucuauuccaggccaaccagcccaaaauuauuucauc

SEQ ID NO: 217693 - RNA, 64 nt, hsa
acaucgugaugggccccucagccagggcugccagccaggccacucggguaaggggcugggcagg

SEQ ID NO: 217694 - RNA, 64 nt, hsa
cgacgaggaggacagaggcugcugcugcugcaaaccaggccacuugccucaccugcuguccugc

SEQ ID NO: 217695 - RNA, 64 nt, hsa
aggggccgaguccaggagccccagccagcccuucccaggccagcgaggcgaggcugccucuggg

SEQ ID NO: 217696 - RNA, 64 nt, hsa
cccugcuacuccacugaccuggaagagcuggguaccaggccacccacuguggggcaagccugag

SEQ ID NO: 217697 - RNA, 64 nt, hsa
accccccucuucaggcugcugcaggaggccaggcccaggccagagaccccaggcagccugagcu

SEQ ID NO: 217698 - RNA, 64 nt, hsa
ggcaggacucucuggccuucuguggccugcaaugccaggccaugugccccucugcccucuaguu

SEQ ID NO: 217699 - RNA, 64 nt, hsa
agccacagcugggcccaccgaggugcuauccugcccaggccagcacuuggcugaguuggguugg

SEQ ID NO: 217700 - RNA, 64 nt, hsa
uaaggagagcucugauugcagcacagagcaguggccaggccacccaaaggagcuccgccuggac

SEQ ID NO: 217701 - RNA, 64 nt, hsa
agcuggacuacggcggcaguauggaauuccagugccaggccagugaccucauucccgagcagcc

SEQ ID NO: 217702 - RNA, 64 nt, hsa
uggaauugaguggccaaguauggggucauggauuccaggccacaaauuccaggccuaguucagu

SEQ ID NO: 217703 - RNA, 64 nt, hsa
cuaguucagucugggggcagggucaguccuucucccaggccagcccuugacauuaaaaaaaaug

SEQ ID NO: 217704 - RNA, 64 nt, hsa
uaaauguggcucaguggagggagacccagcauagccaggccaguauggagcaccucacgcacag

SEQ ID NO: 217705 - RNA, 64 nt, hsa
cugagucacuggcccaucucuuugcucuugugccccaggccagaauaaagaauagaguguagag

SEQ ID NO: 217706 - RNA, 64 nt, hsa
agccugccuaaccaggcccagccaguugguggggccaggccaggaccacacaguccccagacuc

SEQ ID NO: 217707 - RNA, 64 nt, hsa
agaugggugggggcuccugguggccuucugcugcccaggccacagccgccuuuggguuccaucu

SEQ ID NO: 217708 - RNA, 64 nt, hsa
cacugggccuaggugauggcaguccauguggcugccaggccaaggcagucacaggggcccugac

SEQ ID NO: 217709 - RNA, 64 nt, hsa
cugccaggccaaggcagucacaggggcccugaccccaggccacacagacggacaugggcccaca

SEQ ID NO: 217710 - RNA, 64 nt, hsa
gauuugcagcugaagugggccagccuugcaccagccaggccagaccaccauggugaaggcuucu

SEQ ID NO: 217711 - RNA, 64 nt, hsa
ugggaucucagugugccccuaccuguucuccccuccaggccaccugucucuguaaaggaugucu

SEQ ID NO: 217712 - RNA, 64 nt, hsa
gggguggccuuucauuuggggugcccuuucacucccaggccaagcccuggagcaaucuucuuca

SEQ ID NO: 217713 - RNA, 64 nt, hsa
agacauagauguugaauuguuuguggggggugugccaggccacgucucguguguccguaugcag

SEQ ID NO: 217714 - RNA, 58 nt, hsa
gcaagaaggagaagaaguaacauggaggccaggccaagagccacagggcggccucucc

SEQ ID NO: 217715 - RNA, 64 nt, hsa
ggucagcggagccccagcaggaagggugggccagccaggccauucuuagucccuggguugggga

SEQ ID NO: 217716 - RNA, 64 nt, hsa
aaaaaguaaggaagcuaaacuaagacuauacucaccaggccauuuagaaguuuuaaauaaugcc

SEQ ID NO: 217717 - RNA, 64 nt, hsa
aaagugcugggacuacaggcaugagccacuacguccaggccaccucuaccuucuaaccauucuc

SEQ ID NO: 217718 - RNA, 64 nt, hsa
cccccaaccacugcuuaggccucccaacuucuccccaggccaaguauggggcccuggcuguguu

SEQ ID NO: 217719 - RNA, 64 nt, hsa
ugcuugccucauaccucugugcuccacacugcggccaggccagcugagucccuccauccgugga

SEQ ID NO: 217720 - RNA, 64 nt, hsa
cgcacaugcuggugcccgucuuccuccuaaggggccaggccacauccaagugggccucugucgg

SEQ ID NO: 217721 - RNA, 64 nt, hsa
aaaccagucugaauugggucugucuuugagaugcccaggccagcagaaagcagcucagaaguau

SEQ ID NO: 217722 - RNA, 64 nt, hsa
ggaagagagggaaggacaccaagcaaaaaauguuccaggccaggauucggauucuugaauuacu

SEQ ID NO: 217723 - RNA, 64 nt, hsa
agccagacagagcaggugcggggaagggaagggcccaggccagacccaucccaaacggaugaug

SEQ ID NO: 217724 - RNA, 64 nt, hsa
gacagguguacgucugcacccaucacccucagcaccaggccacccugcaguccacuuacuguac

SEQ ID NO: 217725 - RNA, 64 nt, hsa
ccccauuauguacagaauaggaccuauccaguagccaggccaguaggcaguuggggaagguggg

SEQ ID NO: 217726 - RNA, 64 nt, hsa
ugaacacaguggaaggcagaggguuuacuacaggccaggccauggacaccccacccagguacug

SEQ ID NO: 217727 - RNA, 64 nt, hsa
agaaaggugugauuugacugguuuuauuuuucucccaggccagaaguauuacuccacuagauca

SEQ ID NO: 217728 - RNA, 64 nt, hsa
uccagcaccuuccccugguuaugacagggagcucccaggccaggccacaugaccccacagguag

SEQ ID NO: 217729 - RNA, 64 nt, hsa
caccuuccccugguuaugacagggagcucccaggccaggccacaugaccccacagguaggcuga

SEQ ID NO: 217730 - RNA, 64 nt, hsa
cugacaagcacugcuaggcgagugccaggacuccccaggccaggccaccaggauggcccuuccc

SEQ ID NO: 217731 - RNA, 64 nt, hsa
aagcacugcuaggcgagugccaggacuccccaggccaggccaccaggauggcccuucccacugg

SEQ ID NO: 217732 - RNA, 64 nt, hsa
cggucucuggaaagucaggcugagaaauccuuucccaggccaggccgcugcgguacacuggaug

SEQ ID NO: 217733 - RNA, 64 nt, hsa
gcugcgaugugaacugccccuccccucgcaucccccaggccaccaacggcaguccuucugccuu

SEQ ID NO: 217734 - RNA, 64 nt, hsa
auccaucacagacggauacuggggaguaaacggcccaggccaggugcccaggaaaggacggcug

SEQ ID NO: 217735 - RNA, 64 nt, hsa
gcccugugggagccgcagagccugacgcucagccccaggccagcugcggccaggccugcgggcc

SEQ ID NO: 217736 - RNA, 64 nt, hsa
caaaaucacugccaugguucaauguucccaggccccaggccauccacuugccggcccccaccag

SEQ ID NO: 217737 - RNA, 64 nt, hsa
uugucaggggccaggacuggccccacugcagugcccaggccagucuugagcagcagggagggcu

SEQ ID NO: 217738 - RNA, 64 nt, hsa
uuguuguuuaguuacauuaggcuuugcuauauccccaggccaaauagcaugugacacaggacag

SEQ ID NO: 217739 - RNA, 64 nt, hsa
cgaaagugcugggauuacaggcgugagccaccagccaggccaagcuauucuuuuaaaguaagcu

SEQ ID NO: 217740 - RNA, 64 nt, hsa
cgucgggcuaggaggggccaagccgaagagccacccaggccacaguuccugugccugccuuccc

SEQ ID NO: 217741 - RNA, 64 nt, hsa
uuggagcugcuccuugcaggggcgggucaguuucccaggccaugccgggguggccaucuauggu

SEQ ID NO: 217742 - RNA, 64 nt, hsa
ugucccugugcuccaagcugcccccggcugcagcccaggccauggacaugugcaccaguaugua

SEQ ID NO: 217743 - RNA, 64 nt, hsa
ucuggagacaagcucuuccggagugcucugggagccaggccagggugugagggaggugcagagg

SEQ ID NO: 217744 - RNA, 64 nt, hsa
ggcuguguugccccucuccuccucacuauucucaccaggccaugggacuuugggggcagugaga

SEQ ID NO: 217745 - RNA, 64 nt, hsa
cugcacugagccaguucagucacuagugcgccagccaggccaggagggagugcagagcaugucu

SEQ ID NO: 217746 - RNA, 64 nt, hsa
gggggugucuucugagcucaagccugcuucugggccaggccauugucacuguuaguugaagaaa

SEQ ID NO: 217747 - RNA, 64 nt, hsa
ggucuccagaguuuuccuguccucuagaggcaagccaggccagggagcugggagcgagcaagcu

SEQ ID NO: 217748 - RNA, 64 nt, hsa
uugguuuuguggggagaggggaaggaucagggggccaggccagcagcucgggggccacaaggag

SEQ ID NO: 217749 - RNA, 64 nt, hsa
uucauggcugagugcugggaagggcugagcucacccaggccagcaggugggguaucaucugcuc

SEQ ID NO: 217750 - RNA, 64 nt, hsa
guuccuugguccauaacuggugagcuauggagacccaggccaacaaauuauccccagugauaug

SEQ ID NO: 217751 - RNA, 64 nt, hsa
cuccuguccucucccaguucauuccuggaaccagccaggccaggcaaccaguggcccccaaagg

SEQ ID NO: 217752 - RNA, 64 nt, hsa
gaccuccugugacaccacgccagaucacagggcaccaggccagagauagucuucuuuuuguccu

SEQ ID NO: 217753 - RNA, 64 nt, hsa
cugagucccugagggcagacacagcuccagggacccaggccagcugccacacccccgacacucc

SEQ ID NO: 217754 - RNA, 64 nt, hsa
gggagcgugcagccagcaugugcaguggccaacuccaggccaguggaaaguuacuguguggaua

SEQ ID NO: 217755 - RNA, 64 nt, hsa
gauguucugggggaggaggcaaucgcuguagcugccaggccagccccaucuggaaggagucccu

SEQ ID NO: 217756 - RNA, 64 nt, hsa
gugugaagcuggggcagaguaugcuacgaagggaccaggccaggccacagggcucuccucccag

SEQ ID NO: 217757 - RNA, 64 nt, hsa
aagcuggggcagaguaugcuacgaagggaccaggccaggccacagggcucuccucccagucuuu

SEQ ID NO: 217758 - RNA, 64 nt, hsa
guccuuacauagaccuuaaaaagagcucacccuuccaggccaaugcugaagacacagcuccgcu

SEQ ID NO: 217759 - RNA, 64 nt, hsa
cagcuccgcuugggagccugagaacccaggcuucccaggccagaguguggcuucuuaaacggca

SEQ ID NO: 217760 - RNA, 64 nt, hsa
uuuuuugagacagaaucucaucacacucugucacccaggccaaguucaauggugcaaucuggcu

SEQ ID NO: 217761 - RNA, 64 nt, hsa
auggcuggcuugagaugaguugaaaauaacuucgccaggccaguguguagaacagcugguccaa

SEQ ID NO: 217762 - RNA, 64 nt, hsa
cagauguggucaccucaguccagcucuggggccuccaggccauguggcuguucccacggcccag

SEQ ID NO: 217763 - RNA, 64 nt, hsa
gccuccuaaaggccacacccuccccacgcacuucccaggccagaauccaaacaucgggaacccu

SEQ ID NO: 217764 - RNA, 64 nt, hsa
ugaggugggaaagccacggcaggcagcgagcagcccaggccagcuuucugcauggauggucagu

SEQ ID NO: 217765 - RNA, 64 nt, hsa
agcucuucagccagggcauuggaggggagcaggcccaggccaaguuugacagcugccuuucuga

SEQ ID NO: 217766 - RNA, 64 nt, hsa
gagaccaugagaaggagaguucaggggucccaaaccaggccauccuagaccagccagcuccagc

SEQ ID NO: 217767 - RNA, 64 nt, hsa
ugcuucggaccuccgccucugcccgggagaaagcccaggccagccugcuggacaagcagagacc

SEQ ID NO: 217768 - RNA, 64 nt, hsa
acccaucugggugacccggggcaggccacagaggccaggccagggcuggaaggacaggccugcc

SEQ ID NO: 217769 - RNA, 64 nt, hsa
uugaugucuugacagauugaccaucugucuccagccaggccaccccuuuccaaaauucccucuu

SEQ ID NO: 217770 - RNA, 64 nt, hsa
gccucugcgccuccacagggaaaaggcaaggcuuccaggccaguuggcccaggccccuggcagu

SEQ ID NO: 217771 - RNA, 64 nt, hsa
gaggaaccugaguaugagaauguuguacccaucuccaggccaccagaacccugaugaccuugaa

SEQ ID NO: 217772 - RNA, 64 nt, hsa
caccuccauagggaaaggcuucucuccaagugugccaggccaggacagcccucccagccaugaa

SEQ ID NO: 217773 - RNA, 64 nt, hsa
gcuggccguaugaucuguguggauggcaaacuccccaggccauucugggaccuaaguuuaagaa

SEQ ID NO: 217774 - RNA, 64 nt, hsa
gugaucgauuucacuagaugucucacucaucagaccaggccauugggccuaagugguaaaugug

SEQ ID NO: 217775 - RNA, 64 nt, hsa
ugggugggguuucuuagugagccccccggaggguccaggccacguccuuggucaccuccccagc

SEQ ID NO: 217776 - RNA, 64 nt, hsa
uuccugccugguccaguggggaacaggucccacgccaggccagcaggcgggcuccuuuguacag

SEQ ID NO: 217777 - RNA, 64 nt, hsa
cacccccuuugacucuggggugcagcuucacccaccaggccagcucaggaauucccuggaaaag

SEQ ID NO: 217778 - RNA, 64 nt, hsa
ccucccagccucugcccagggaccccugccuuccccaggccaucugcucugccgucgacacucg

SEQ ID NO: 217779 - RNA, 64 nt, hsa
gguggcaucugccacgaaggaagcgccagccucgccaggccagcaggggcgucguuuuguugcc

SEQ ID NO: 217780 - RNA, 64 nt, hsa
uguggcugcuggaucagggcagccggggagguggccaggccaguggccaggcccuguggagaca

SEQ ID NO: 217781 - RNA, 64 nt, hsa
acaccgcccucccuccguggggauagccgcagccccaggccaucaucugcugcuggggcccccc

SEQ ID NO: 217782 - RNA, 64 nt, hsa
ccggccaccguguccgaggcgcaacgcuaggccuccaggccacgcauccaucuccaaguuaaca

SEQ ID NO: 217783 - RNA, 64 nt, hsa
ccucaccccucucccacccuccccagggguaaccccaggccaagcacagauagcucagcugcga

SEQ ID NO: 217784 - RNA, 64 nt, hsa
gcccccuucccucaacucuaggggcagcauagccccaggccacccuagcccagccccugcauug

SEQ ID NO: 217785 - RNA, 64 nt, hsa
ucugagggcaccucauggaccaggggcugguggcccaggccagggagggaacccugggcagggc

SEQ ID NO: 217786 - RNA, 64 nt, hsa
ggaacccuuuuucgacugccccaacucuuggacaccaggccaacuagaacacccaacaccaaac

SEQ ID NO: 217787 - RNA, 64 nt, hsa
accaaauuaugguguagacagcccucccccaaccccaggccagucaggcacaauccccccaccc

SEQ ID NO: 217788 - RNA, 64 nt, hsa
gcucaggaggguugggucccugggaggccggcagccaggccacagaauccacacguggaccauu

SEQ ID NO: 217789 - RNA, 64 nt, hsa
cguggaccauugugggucccugggaggccggcagccaggccacggaauccacacguggaccauu

SEQ ID NO: 217790 - RNA, 64 nt, hsa
auggcuuggaugcccucaggggugcugaccccugccaggccacgaauaucaggcuagagaccca

SEQ ID NO: 217791 - RNA, 64 nt, hsa
uggcugacaauccuggaaaucuguucuccagaauccaggccaaaaaguucacagucaaaugggg

SEQ ID NO: 217792 - RNA, 64 nt, hsa
cugaggcuucugugcuccuggcuucuuacgccguccaggccaagguaggcucaaagaagaaaaa

SEQ ID NO: 217793 - RNA, 64 nt, hsa
aagccgauucuuuggaaguucagcagaugaaagcccaggccagggaggagaaggcuagaaagca

SEQ ID NO: 217794 - RNA, 64 nt, hsa
uggcaugcagcgaagcagcccagcccggcggaucccaggccagcacgccugccggcuucucauc

SEQ ID NO: 217795 - RNA, 64 nt, hsa
ccaaagacccugagggucugagcagcuagaaguccuagacaaagaacuuguggaugacuuuugu

SEQ ID NO: 217796 - RNA, 64 nt, hsa
aggcaaagggacaauuaucacugcaugucaucuccuagacaaucagucaaauagagcugguggc

SEQ ID NO: 217797 - RNA, 64 nt, hsa
aacucauauaucagucucucacauggccacaauucuagacaaaaaccaaagacccagaggccag

SEQ ID NO: 217798 - RNA, 64 nt, hsa
cuguuacacauaguuuuugacuugaauuaaaauacuagacaaagcagaaauguacaauuucugg

SEQ ID NO: 217799 - RNA, 64 nt, hsa
uugaugauuaaguggggucacugaauuccauuuguggacugaaaaguauucaauccacuuuugg

SEQ ID NO: 217800 - RNA, 64 nt, hsa
uaaggauucaggagaagcaucucccuugcauuucuggacugaaccagucuuaccugagacugga

SEQ ID NO: 217801 - RNA, 64 nt, hsa
aagaaauagaguugcuccauucauauuggacugauggacugaaaacauugaugugauucuugaa

SEQ ID NO: 217802 - RNA, 64 nt, hsa
agaagaaaaagaaauagaguugcuccauucauauuggacugauggacugaaaacauugauguga

SEQ ID NO: 217803 - RNA, 64 nt, hsa
acugcggaagccaaaggcagcuaagauagaaagcuggacugaccaaagacugcagaacccccag

SEQ ID NO: 217804 - RNA, 64 nt, hsa
cugggcuucauuccggacuggcagaagcauugccuggacugaccacaccaaccaggccuucauc

SEQ ID NO: 217805 - RNA, 64 nt, hsa
ggggcacauccagucuccaucgugcugcagcagcuggacugagggcagagccuguaggugcaga

SEQ ID NO: 217806 - RNA, 64 nt, hsa
uucccuccugugucaaguagcuaacugcagcagcuggacugagggcagagucugugggugcaga

SEQ ID NO: 217807 - RNA, 64 nt, hsa
gaugaagcucucucuaaauauuuucuugcuuuacuggacugauuuuaacccgcugcacaacacc

SEQ ID NO: 217808 - RNA, 64 nt, hsa
auguggaaagagaaaagaaucauauuaaguacuuuggacugaacaaugacccccaaaauucgua

SEQ ID NO: 217809 - RNA, 64 nt, hsa
guguuuuaaagguagaguuaacagaauauacugguggacugaauguagguugagagaggaagcg

SEQ ID NO: 217810 - RNA, 64 nt, hsa
ugcucaccucagcaaaaguuaagacagcuguaaauggacugaucuacaaaaagguaaaaauucc

SEQ ID NO: 217811 - RNA, 64 nt, hsa
aggccagagaagguggcaugggccugaacccaccuggacugacuucugcacugaagccacagau

SEQ ID NO: 217812 - RNA, 64 nt, hsa
ccagcuguuucuaguuaccaccuaccccuggccguggacugaucagaccagcauucaaaauaaa

SEQ ID NO: 217813 - RNA, 64 nt, hsa
cucuuagcuuuaguuuaucucucugccugaagacaggaaacaggcccaagugcauacucggguu

SEQ ID NO: 217814 - RNA, 64 nt, hsa
cuccuaguugugugugggcaacagaaacaaguuaaggaaacaaaaauacuuauauauacacaga

SEQ ID NO: 217815 - RNA, 64 nt, hsa
accugcugaggcacagacuuccaccaugugcaucaggaaacaccucacucauacugucauauaa

SEQ ID NO: 217816 - RNA, 64 nt, hsa
uuuuuaaguacaaaaaaguuuaagauugcaaggaaggaaacaauggucacaaggucuuuacuua

SEQ ID NO: 217817 - RNA, 64 nt, hsa
cacuuugagggaaacccuggugcagccagcccugaggaaacauggccugagugcccucacuggu

SEQ ID NO: 217818 - RNA, 64 nt, hsa
aaacuuggugaauagucccagugcuaggucauauaggaaacagaaagcaugacaguggccuuuu

SEQ ID NO: 217819 - RNA, 64 nt, hsa
acucucacuaacauugcuuccuuuuuugaccagcaggaaacagcaggucuggccagauucucac

SEQ ID NO: 217820 - RNA, 64 nt, hsa
gccaguguuuugaucugggcucugagcacaagucaggaaacaccaacauauucacacucuccca

SEQ ID NO: 217821 - RNA, 64 nt, hsa
aguaaguucuucucauuucauuauguuucuuccaaggaaacaggagagacugaauuaauaauuc

SEQ ID NO: 217822 - RNA, 64 nt, hsa
agcuucagcaccucaguaacuucacuucauccacaggaaacacugcucuuccucaccugucaca

SEQ ID NO: 217823 - RNA, 64 nt, hsa
uguaagaagcagaggccauuucugccccauguugaggaaacaaucuguugauagaccuggaauu

SEQ ID NO: 217824 - RNA, 64 nt, hsa
auuauugccucauaaacucucucuuuguuuuuaaaggaaacaucuauuaugguaauacaaagaa

SEQ ID NO: 217825 - RNA, 64 nt, hsa
guauagaaguagauuaagagccauauaaguuugaaggaaacaguuaauaccauuuuuuaaggaa

SEQ ID NO: 217826 - RNA, 64 nt, hsa
uaaguuugaaggaaacaguuaauaccauuuuuuaaggaaacaauauaaccacaaagcacaguuu

SEQ ID NO: 217827 - RNA, 64 nt, hsa
uugcagaaagguggucagaugaccaguguagugcaggaaacagcccugucucaacuaauggaaa

SEQ ID NO: 217828 - RNA, 64 nt, hsa
uaggcuaguaaccaaaauaauguggaccuucuuuaggaaacagugugggagaauaggaguccag

SEQ ID NO: 217829 - RNA, 64 nt, hsa
ggacucagaauuguagggauaauaugaaugcaggaggaaacauucugucaggcgguaugacugg

SEQ ID NO: 217830 - RNA, 64 nt, hsa
acuugaccaagcaaaggggcugaaaaacugaauaaggaaacaacuuuauaagagaaacaguggu

SEQ ID NO: 217831 - RNA, 64 nt, hsa
gagggaggguggauauuuuuauuccuagauauggaggaaacauaagucuguaguauuauaaaac

SEQ ID NO: 217832 - RNA, 64 nt, hsa
gaucagucuauggucccaguaaaaguaaagaugcaggaaacacagucuguaaaugagcgacuuu

SEQ ID NO: 217833 - RNA, 64 nt, hsa
gugggacauagucuuccauugcuggcugucccugaggaaacagacaugagucuuggagguucug

SEQ ID NO: 217834 - RNA, 64 nt, hsa
cguuucucuuucuccuucucuuucccuugagguuaggaaacagguuaaaacucagagaacucca

SEQ ID NO: 217835 - RNA, 64 nt, hsa
caguauccaauucaauauaucuuagaaaaagcacaggaaacagaccuuaaaauuguaaccuacc

SEQ ID NO: 217836 - RNA, 64 nt, hsa
uuggcuuagaguagagguuuuuuuuaaguuauggaggaaacauuuuuguaaaaguuuaaugacc

SEQ ID NO: 217837 - RNA, 64 nt, hsa
uucaaacacuggcaccuugggucucacccaccauaggaaacaagacaacauucaauuugauaga

SEQ ID NO: 217838 - RNA, 64 nt, hsa
auucucaagucaucuuucuugcuggguuuuaaugaggaaacaggaaagggugaaggaaauccuu

SEQ ID NO: 217839 - RNA, 64 nt, hsa
ucugaguucugaauggagagcauggauugugaugaggaaacaaggcuggaagagcugccaaggg

SEQ ID NO: 217840 - RNA, 64 nt, hsa
ugcggggucaggggcuccagcauccgagcuggcgaggaaacaguacagggucugaguucugaau

SEQ ID NO: 217841 - RNA, 64 nt, hsa
cauucaauacuguuauaucagaggaguaggagagaggaaacauuugacuuaucuggaaaagcaa

SEQ ID NO: 217842 - RNA, 63 nt, hsa
ggaaaauauuaaaaggcuaacauuaaaagacuaaaggaaacagacucagaagucucuaauuua

SEQ ID NO: 217843 - RNA, 64 nt, hsa
ugccagcucagcccguuaggaugagggugcugagaggaaacaggaaacaagacugcgaauggcg

SEQ ID NO: 217844 - RNA, 64 nt, hsa
ucagcccguuaggaugagggugcugagaggaaacaggaaacaagacugcgaauggcgcucaggc

SEQ ID NO: 217845 - RNA, 64 nt, hsa
ggaaauaucaaguuccagaagauugaauacaugcaggaaacaaauguuuuuugggcccuagagu

SEQ ID NO: 217846 - RNA, 64 nt, hsa
ugcuauauuguauagcauucacauuccacaggugaggaaacaggcucagaggaauaaguggcau

SEQ ID NO: 217847 - RNA, 64 nt, hsa
ugcacuuuaugaaacuggcacuugacugaacagaaggaaacagcuguaccucuaagcuccuuuc

SEQ ID NO: 217848 - RNA, 64 nt, hsa
gcuuuuuaaaacuagugucacagucucucuugggaggaaacaaugaauugguucauuucuucuc

SEQ ID NO: 217849 - RNA, 64 nt, hsa
acuuaauucuuguuuuuuucccaguuuuauauagaggaaacacuaugauaggauuuccuaaagu

SEQ ID NO: 217850 - RNA, 64 nt, hsa
gacuuacuucuuguuuuuucccaguuuuauauagaggaaacacugucuaugauaggauuuccaa

SEQ ID NO: 217851 - RNA, 64 nt, hsa
ugcuuacuucuagagggagaagacugugcggcacaggaaacagcaaacaguggggugaucugca

SEQ ID NO: 217852 - RNA, 64 nt, hsa
ucccuuuauaaagagugcuacaugguuuagauaaaggaaacauauaacuauugaguuacagggg

SEQ ID NO: 217853 - RNA, 64 nt, hsa
gguaugaaacaaacuacugugucacuguccagguaggaaacaauucuuucaacuggguuuucag

SEQ ID NO: 217854 - RNA, 64 nt, hsa
cccccaaccagagauguuaaagugagccugucccaggaaacaucuccacccaagacgucuuugg

SEQ ID NO: 217855 - RNA, 64 nt, hsa
ccugcaaccccaacacccacaaguuuguuucucuaggaaacacauucacugucucagcuggcug

SEQ ID NO: 217856 - RNA, 64 nt, hsa
gggucaggugccagaccuggacuaaacugcaccaaggaaacacccagcagggucuccugugagc

SEQ ID NO: 217857 - RNA, 64 nt, hsa
ggagagaaugggggaggaggcggucaggcugcugaggaaacaccacaggcugaacgggggagga

SEQ ID NO: 217858 - RNA, 64 nt, hsa
uuggcaaaggcaucucaggaacaucaccuuagugaggaaacaaaauguucugcuagcuuguuuu

SEQ ID NO: 217859 - RNA, 64 nt, hsa
gcaaggagccaacauaacagaugggcuggaaguaaggaaacauguaaugauaggcggacuccca

SEQ ID NO: 217860 - RNA, 64 nt, hsa
cauaggccuuacuauucaugugucugugcauccuaggaaacaaacugaacguaggaaaccuguc

SEQ ID NO: 217861 - RNA, 64 nt, hsa
aagagauguuggaaagcccuugaacuuggucguuaggaaacauccacacugaagaggaaccuga

SEQ ID NO: 217862 - RNA, 64 nt, hsa
guagucuaauaaaguguaaaaugguguuaugucuaggaaacaaggcacauacuuuaauuuuaaa

SEQ ID NO: 217863 - RNA, 64 nt, hsa
augaccaaaaaauggagaaaaaguaggcugacucaggaaacacuuagaaaguacagccauaccu

SEQ ID NO: 217864 - RNA, 64 nt, hsa
aggugagcaguggagagaaggggggcccugcacaaggaaacagggaagagccaucgaaguuuca

SEQ ID NO: 217865 - RNA, 64 nt, hsa
agacuuuaggaucacgugugugacuaauacagaaaggaaacauggcgucggggagagggauaaa

SEQ ID NO: 217866 - RNA, 64 nt, hsa; identical to SEQ ID NO: 94836

SEQ ID NO: 217867 - RNA, 64 nt, hsa; identical to SEQ ID NO: 94837

SEQ ID NO: 217868 - RNA, 64 nt, hsa; identical to SEQ ID NO: 94838

SEQ ID NO: 217869 - RNA, 64 nt, hsa; identical to SEQ ID NO: 94839

SEQ ID NO: 217870 - RNA, 64 nt, hsa; identical to SEQ ID NO: 94840

SEQ ID NO: 217871 - RNA, 64 nt, hsa; identical to SEQ ID NO: 94841

SEQ ID NO: 217872 - RNA, 64 nt, hsa; identical to SEQ ID NO: 94842

SEQ ID NO: 217873 - RNA, 52 nt, hsa; identical to SEQ ID NO: 94843

SEQ ID NO: 217874 - RNA, 64 nt, hsa; identical to SEQ ID NO: 94844

SEQ ID NO: 217875 - RNA, 64 nt, hsa; identical to SEQ ID NO: 94845

SEQ ID NO: 217876 - RNA, 64 nt, hsa; identical to SEQ ID NO: 94846

SEQ ID NO: 217877 - RNA, 64 nt, hsa; identical to SEQ ID NO: 94847

SEQ ID NO: 217878 - RNA, 64 nt, hsa; identical to SEQ ID NO: 94848

SEQ ID NO: 217879 - RNA, 64 nt, hsa; identical to SEQ ID NO: 94849

SEQ ID NO: 217880 - RNA, 64 nt, hsa
uugcaggaaacaccauauuaauagacauccucaccaucuccauccgcucucacgccuccugcag

SEQ ID NO: 217881 - RNA, 64 nt, hsa
aaaaauacacagcacuccccaccuuucuuucguucaucuccagggccccaccucagaucaaagc

SEQ ID NO: 217882 - RNA, 64 nt, hsa
guugacauagcacugggcuguuugaaugccuuuucaucuccauggucucauuugaaagugagcg

SEQ ID NO: 217883 - RNA, 64 nt, hsa
gagggcagaggaggagaucagaaaaucccucugacaucuccacugcccccaaagaccuccguug

SEQ ID NO: 217884 - RNA, 64 nt, hsa
caagugauucaauggacaaguucucuuuuuguuccaucuccauuauuuccugcucuaauguaua

SEQ ID NO: 217885 - RNA, 64 nt, hsa
auugcuaacugacaaauaaaguuaauaguuaaaucaucuccaaggaauguugcuaauccaaagu

SEQ ID NO: 217886 - RNA, 64 nt, hsa
guauggaaaacugauauuacuagguuuuacguugcaucuccaguauugaucuuuggaaacugau

SEQ ID NO: 217887 - RNA, 64 nt, hsa
uauucucucauggacuucucauccuuucuuuuuucaucuccaacaguuaaaugguaaggagagc

SEQ ID NO: 217888 - RNA, 64 nt, hsa
caacaugaauguuucugugagcucuggugucacucaucuccaugaucaucucagccaacaugca

SEQ ID NO: 217889 - RNA, 64 nt, hsa
aucccuugggcuuuggauuuggagaugggaagagcaucuccaggcaaugaguuuuucaaagaau

SEQ ID NO: 217890 - RNA, 64 nt, hsa
gcucaaagcagcaggacugugggaaagagccuaacaucuccauggggaggccucaccccaggga

SEQ ID NO: 217891 - RNA, 64 nt, hsa
ucaccucuaacccccuccccucgcugcugggccccaucuccacaggagagacugguucagcucu

SEQ ID NO: 217892 - RNA, 64 nt, hsa
ucagggagugcguggucuuggaugccauccugcucaucuccagcauuuccucucaccuccgugu

SEQ ID NO: 217893 - RNA, 64 nt, hsa
ucggggagugcguggugucagaucccauccugcucaucuccagcauuuccucucaccucugugu

SEQ ID NO: 217894 - RNA, 64 nt, hsa
gugaaaauuuaccuaaaaccuugguuaucaaauacaucuccaguacauuccguucuuuuuuuuu

SEQ ID NO: 217895 - RNA, 64 nt, hsa
ugaugaaggcaucugaugccuucaucuguucagucaucuccaaaaacaguaaaaauaaccacuu

SEQ ID NO: 217896 - RNA, 64 nt, hsa
agguacagcaaggagagcuccaucccccacaguccaucuccauucggggucaccuacgucaucu

SEQ ID NO: 217897 - RNA, 64 nt, hsa
auuuuaguuuuuuuuuuucuuucaaccagugugccaucuccaauauuucuauaguauaccaacc

SEQ ID NO: 217898 - RNA, 64 nt, hsa
ggauuucuuagaauuuucuguagacagaucaugccaucuccaaauagagaugguuuuacuucuu

SEQ ID NO: 217899 - RNA, 64 nt, hsa
agaacagcuggacggagcugagaggagacccuagcaucuccauguccaucccccagaccucccc

SEQ ID NO: 217900 - RNA, 64 nt, hsa
ucauccucaugcugcucaauuccuucuucaacgccaucuccacucuuguggucaucauggccag

SEQ ID NO: 217901 - RNA, 64 nt, hsa
uggaugccaaccagagaagcugcuaccccuacaucaucuccaaccggucagaagccgccucccu

SEQ ID NO: 217902 - RNA, 64 nt, hsa
ggagggggaauggcagcagggguuggggaaacagcaucuccaagcagcuuagaguuggccauau

SEQ ID NO: 217903 - RNA, 64 nt, hsa
aaaaaaaaaaaaaaagccagugcccagggaugggcaucuccagggagcuggggauuagugccag

SEQ ID NO: 217904 - RNA, 64 nt, hsa
uuggccccaaagcgagcuaugcugaacucuucuccaucuccaagcagacaaccuuugucuuuac

SEQ ID NO: 217905 - RNA, 64 nt, hsa
agccagaaugugguuuguagaaucccagccccagcaucuccaagcauaggauggauuuugaagc

SEQ ID NO: 217906 - RNA, 64 nt, hsa
acuguuaucuugguaucccucaucccagaagaggcaucuccauaucccagaaaagaagauccua

SEQ ID NO: 217907 - RNA, 64 nt, hsa
acaccaguaagugcuacccaccccucugcagcaacaucuccaaacugucaaguuuagauaaucc

SEQ ID NO: 217908 - RNA, 64 nt, hsa
augggccagcauggacccugggcuagagcaagcacaucuccaucucuuccaccucaggcagugu

SEQ ID NO: 217909 - RNA, 64 nt, hsa
gaugcggagucaugaagcagaguccucgggaaggcaucuccacagccccggguccucugucuaa

SEQ ID NO: 217910 - RNA, 64 nt, hsa
ccaagaucacaugcaggauaccaugggaaggagccaucuccacucuccuucuccagaacccccu

SEQ ID NO: 217911 - RNA, 64 nt, hsa
cgcugcccagagccauguccagaacccagccggccaucuccauggugccaauuaccagcaagug

SEQ ID NO: 217912 - RNA, 64 nt, hsa
uucagcacacgaauuaugcugcguugcucacauucaaaccaaaccaacgacuauguuuaaugaa

SEQ ID NO: 217913 - RNA, 64 nt, hsa
cacacgaauuaugcugcguugcucacauucaaaccaaaccaacgacuauguuuaaugaacucag

SEQ ID NO: 217914 - RNA, 64 nt, hsa
uugagccuugcuggacaagugguuuguuugugugcaaaccaaacuuucuuuacccagugcaaua

SEQ ID NO: 217915 - RNA, 64 nt, hsa
cguuucacauuaaauggugugaagcguuguuuggcaaaccaacagcuuuggcuucugguguggu

SEQ ID NO: 217916 - RNA, 64 nt, hsa
auaaucucuuggaucugccgccccccucuccucccaaaccaaaaaccauugucuuaccucccaa

SEQ ID NO: 217917 - RNA, 64 nt, hsa
ccaguucagggacagaauuauaguguuugggauucaaaccaacagucugucaguguacagcagc

SEQ ID NO: 217918 - RNA, 64 nt, hsa
ccuugcauucuaagugauagaagagcaacacuuucaaaccaaaucucacugaaugccagugauu

SEQ ID NO: 217919 - RNA, 64 nt, hsa
gucaggcucaaaagaagaauuaagagacucaagacaaaccaagauaaaguaacuguguguugaa

SEQ ID NO: 217920 - RNA, 64 nt, hsa
ccuagcguuuuggaagaggaaaacaggaacccaccaaaccaaccaaucaaccaaacaaagaaaa

SEQ ID NO: 217921 - RNA, 64 nt, hsa
gaaugagaccaaacgcagccagccagaucgggagcaaaccaaagaccaucugaggaaugagaag

SEQ ID NO: 217922 - RNA, 64 nt, hsa
auugcuucuuuuauugguuuccaaagaaacaaaccaaaccaaccagcucuuggaugugaagaua

SEQ ID NO: 217923 - RNA, 64 nt, hsa
aaaaaauugcuucuuuuauugguuuccaaagaaacaaaccaaaccaaccagcucuuggauguga

SEQ ID NO: 217924 - RNA, 64 nt, hsa
auuagaaugacuugagaacgggcaaauaacaaagcaaaccaauauaauuauauggucauucuga

SEQ ID NO: 217925 - RNA, 64 nt, hsa
auugauugaauacaguuuuuacuaauuaguuuaucaaaccaaauacugugaacguaccaggugu

SEQ ID NO: 217926 - RNA, 64 nt, hsa
aaacuguaagugcugaaagcaaguuuagccaugacaaaccaaagagugcccaggucagccaaga

SEQ ID NO: 217927 - RNA, 64 nt, hsa
gaagugucagcccucaauguuggguacuuagacccaaaccaauaaauggugaguuuugaacaag

SEQ ID NO: 217928 - RNA, 64 nt, hsa
aaauucauuguguauauuacuacaaagacaaccccaaaccaauuuuuuuccugcgaaguuuaau

SEQ ID NO: 217929 - RNA, 64 nt, hsa
aagagagaaaaaaucaacagcaaacaaaaccacacaaaccaaaccgucaacagcauaauaaaau

SEQ ID NO: 217930 - RNA, 64 nt, hsa
cagaggaagacugccucaaacaaacaaaaaacaacaaaccaaaccaaaccaaaccaaaaaaauc

SEQ ID NO: 217931 - RNA, 64 nt, hsa
gaagacugccucaaacaaacaaaaaacaacaaaccaaaccaaaccaaaccaaaaaaaucucaaa

SEQ ID NO: 217932 - RNA, 64 nt, hsa
cugccucaaacaaacaaaaaacaacaaaccaaaccaaaccaaaccaaaaaaaucucaaagcgau

SEQ ID NO: 217933 - RNA, 64 nt, hsa
ucaaacaaacaaaaaacaacaaaccaaaccaaaccaaaccaaaaaaaucucaaagcgauuggac

SEQ ID NO: 217934 - RNA, 64 nt, hsa
aaaaaagagcuagcccaaaaucccaaacucaaaccaaaccaaacagaaagcaguggaggugggg

SEQ ID NO: 217935 - RNA, 64 nt, hsa
caaagaaaaaagagcuagcccaaaaucccaaacucaaaccaaaccaaacagaaagcaguggagg

SEQ ID NO: 217936 - RNA, 64 nt, hsa
uguuuaaaugugacacuugugagaaggcauuugccaaaccaagccagcuggagcgccacagccg

SEQ ID NO: 217937 - RNA, 64 nt, hsa
uaguaucgucaauggugccacauaaaacaugucccaaaccaaaucccacccgugcugggcagag

SEQ ID NO: 217938 - RNA, 64 nt, hsa
ccuagggacaccaaaaaagaaaaaaaaaaaaacccaaaccaaaaacgcaaaccaaagcaggcag

SEQ ID NO: 217939 - RNA, 64 nt, hsa
aaaaagaaaaaaaaaaaaacccaaaccaaaaacgcaaaccaaagcaggcaggcagacagcugcu

SEQ ID NO: 217940 - RNA, 64 nt, hsa
auccagacucaggguuccagaaaucccccguucccaaaccaaaccaaucauggaucuucccuuu

SEQ ID NO: 217941 - RNA, 64 nt, hsa
gacucaggguuccagaaaucccccguucccaaaccaaaccaaucauggaucuucccuuuaaggg

SEQ ID NO: 217942 - RNA, 64 nt, hsa
cccgucucauuuguaucuucugauauucuuuauacaaaccaaaaguccccuucaacauuuuuua

SEQ ID NO: 217943 - RNA, 64 nt, hsa
ugcuucagaugaaaacaaaucacacaccguuucccaaaccaacagucuucacauuucuaucccu

SEQ ID NO: 217944 - RNA, 64 nt, hsa
uaucagcgguaaaaaugcauuuacaaccuuucauuuaaccgaaaaacacagaccgcuuuaaccu

SEQ ID NO: 217945 - RNA, 64 nt, hsa
ucugguaacauaucuggaauauuguuguuguuuuuuaaccgaguuuucccaucagugccaaaac

SEQ ID NO: 217946 - RNA, 64 nt, hsa
caguuaagaggauauuagguauauaauucucuucuuaaccgaaugucagauggucuuacgccac

SEQ ID NO: 217947 - RNA, 64 nt, hsa
aaauacauaauauauugaauuuaaaauguguuuauuaaccgauucuccauaaauaaaaauaaga

SEQ ID NO: 217948 - RNA, 64 nt, hsa
cauguuuugguugcuaaagaaaaaagcauaaucuuuaaccgaguauaaguacuugcuguguauu

SEQ ID NO: 217949 - RNA, 64 nt, hsa
gauauauuuguguuuuuauuucaaguaagucauuuuaaccgaauguucauucauauucauuuau

SEQ ID NO: 217950 - RNA, 64 nt, hsa
aauguugaggguauuagacaucccugaaacucaguuaaccgaauuuccagucuccaaagcggaa

SEQ ID NO: 217951 - RNA, 63 nt, hsa
gugaaacccugucucuacuaaaaauacaaaaaaauuaaccgagcaugguggcacgugccugua

SEQ ID NO: 217952 - RNA, 64 nt, hsa
uuuaaaucaacuuuuuaaaaaaauaaaguguaaauuaaccgacuagaguacuuggaaaauguga

SEQ ID NO: 217953 - RNA, 64 nt, hsa
ccuuuggaauugugcuccaaaugucuacugaagcuuaaccgaagaacuaauaaauggacuacag

SEQ ID NO: 217954 - RNA, 64 nt, hsa
ucaaguagcugggauuuuaaacuagaugaccucauuaaccgaugcuuuaccaaacagcaaacca

SEQ ID NO: 217955 - RNA, 64 nt, hsa
aagaaaggagagaagguuuuuagguuagaaaccuuuaaccgauagaaggauaugguauguugua

SEQ ID NO: 217956 - RNA, 64 nt, hsa
uuaaggcagcacagacugccaaguacuguuuuuuuuaaccgacugaaaucacuuugggauauuu

SEQ ID NO: 217957 - RNA, 64 nt, hsa
acauguacaaaauacauauaauuguuaacguguauuaaccgaaaaaugacccaagacuuaguuc

SEQ ID NO: 217958 - RNA, 64 nt, hsa
ucugaaguacaaacaugaaaaacaaacaaaaaaauuaaccgagacacuuuauauggcccugcac

SEQ ID NO: 217959 - RNA, 64 nt, hsa
acaucuuuccuaugcaagagugucucacaugugcuuaaccgaggugcuucuaguuggugagcag

SEQ ID NO: 217960 - RNA, 64 nt, hsa
guugcucacauucucaagcaaaaauucaacugcauuaaccgaucugagaguuuuccuuuaaccu

SEQ ID NO: 217961 - RNA, 64 nt, hsa
uaaaucacauacuuuguuuagagaggcgagggguuuaaccgagucacccagcuggucucauaca

SEQ ID NO: 217962 - RNA, 64 nt, hsa
gugaaaauaauaacauuauuaugagaaaguggacuuaaccgaaauggaaccaacugacauucua

SEQ ID NO: 217963 - RNA, 64 nt, hsa
cacuucucauugcuaaaaauaaauaaaccaaaguuuaaccgaaucaguuagggaaagugauuua

SEQ ID NO: 217964 - RNA, 64 nt, hsa
aaucccgugugcacgcugaacgacacagcucaguuuaaccgaaugacaguugaguaugucuaug

SEQ ID NO: 217965 - RNA, 64 nt, hsa
ucccauugguggcagaugugagcgacaucaggcgcuuccucagugcauuucacgagccacaggu

SEQ ID NO: 217966 - RNA, 64 nt, hsa
ugcaaccuccgccucucagguucaagugguucuccuuccucagccucccaaguagcugggauua

SEQ ID NO: 217967 - RNA, 64 nt, hsa
uuuuuaguuuuuaaaauauuccguggucaaaauucuuccucacuauaauugguauuuacuuuua

SEQ ID NO: 217968 - RNA, 64 nt, hsa
cauaggagggaacagaccauggaaauuuaaacgacuuccucacggucacagaacuaguuuuuua

SEQ ID NO: 217969 - RNA, 64 nt, hsa
gcucaggcaacgagugggccacaucucacuucugcuuccucaucucagcccacucugaaaaugu

SEQ ID NO: 217970 - RNA, 64 nt, hsa
ugcuccucccccagcuccagggcuccuggauguccuuccucaacucccuccaccccuagacaau

SEQ ID NO: 217971 - RNA, 64 nt, hsa
uccucccuucccuccuccuuccucauccuucugucuuccucaauucuccgucucuuuuuuuuca

SEQ ID NO: 217972 - RNA, 64 nt, hsa
aguguuaaccuuccaccuccucccuucccuccuccuuccucauccuucugucuuccucaauucu

SEQ ID NO: 217973 - RNA, 64 nt, hsa
ugcuugagcugccaaagaagggucacaaaguguucuuccucauggaagaagugccucgggguug

SEQ ID NO: 217974 - RNA, 64 nt, hsa
uauuggugcaucucagaugcacuugacuucaagccuuccucaaccaaacugguccauuagauuc

SEQ ID NO: 217975 - RNA, 64 nt, hsa
ggucuccagccaccccuaccccagucacucgccccuuccucaucucuggaauuuggccaggcag

SEQ ID NO: 217976 - RNA, 64 nt, hsa
auugcucaaccaguauuuauuucccuaaacgacccuuccucacauucccuucccuccaccucuc

SEQ ID NO: 217977 - RNA, 64 nt, hsa
cccuauuuccguguucuuaccuagccuccccccacuuccucaaaacaaacaagagauggcaaag

SEQ ID NO: 217978 - RNA, 64 nt, hsa
auaaagaugaaaagacaacaaaaguaucuucauacuuccucauccccucauugcaacaaaaccu

SEQ ID NO: 217979 - RNA, 64 nt, hsa
auguagacuugaaaugucuccacauuuuggaggacuuccucagcccuuuucauugagggaaaau

SEQ ID NO: 217980 - RNA, 64 nt, hsa
auuuuugugaaaauagaguuuugguaaucacuuucuuccucaaaauaaguccuucuguuaauuu

SEQ ID NO: 217981 - RNA, 64 nt, hsa
ccuguuugcuauuuuuguuuaacuuauuuuguagcuuccucacugguuuguguugcuaagcaaa

SEQ ID NO: 217982 - RNA, 64 nt, hsa
ggaauauuuuccugacagacuugaaaacuaggaucuuccucagaugucuguaaauaacucuggu

SEQ ID NO: 217983 - RNA, 64 nt, hsa
gcagccagauuccgaaacucccauucuccaaugacuuccucaaccaauggguggccuugugacu

SEQ ID NO: 217984 - RNA, 64 nt, hsa
uuuucaaaguaguuccuauaggggcauugaggagcuuccucauucugggaaaacugagaaaacc

SEQ ID NO: 217985 - RNA, 64 nt, hsa
guuucccaccucaccugagagccauugaauuugccuuccucaugaauuaaaaccucccccaagc

SEQ ID NO: 217986 - RNA, 64 nt, hsa
cuuccucaugaauuaaaaccucccccaagcagagcuuccucagagaaagugguucuaugaugac

SEQ ID NO: 217987 - RNA, 64 nt, hsa
ucuccccaagugaguggaagugacaugaugcagucuuccucauggggcaccugaaagaaauuag

SEQ ID NO: 217988 - RNA, 56 nt, hsa
auaucacaucucugaguuaagcaagccuuccucaaagagaggggcagaagcaagaa

SEQ ID NO: 217989 - RNA, 64 nt, hsa
cuucccuacagauuugcaggcugggaaggcuagacuuccucagcccgagggcugcccuuccaaa

SEQ ID NO: 217990 - RNA, 64 nt, hsa
gcugaggucugagcagggccuggccuuuccuccucuuccucacccucauccuuugggaggcuga

SEQ ID NO: 217991 - RNA, 64 nt, hsa
aggaaagagaggaaccaauaccuucaaggcucuucuuccucaccgagcaugcuucccuaggauc

SEQ ID NO: 217992 - RNA, 64 nt, hsa
gugagugacaaagccucugaaagaugcaucaucucuuccucacacccauuuagugggggauggg

SEQ ID NO: 217993 - RNA, 64 nt, hsa
uaugaauauauuaaauccacaaacacacuauauacuuccucaccacugacuauuuuaucaaauu

SEQ ID NO: 217994 - RNA, 64 nt, hsa
acgcccuuuauagugugaaaugaaaaauuagucacuuccucacauggaaggcagcuuuucagaa

SEQ ID NO: 217995 - RNA, 64 nt, hsa
aaaagauaaucugaagcucacaaagaugaagugacuuccucaaaaucacaugguucaggacaga

SEQ ID NO: 217996 - RNA, 64 nt, hsa
ggggaagaucuguccugcaccaucugccuaauuccuuccucacagucuguagccaucugauauc

SEQ ID NO: 217997 - RNA, 64 nt, hsa
gcuagaacagucucguagcugcaguucagcugugcuuccucagccuacuaucauaggcuuccuc

SEQ ID NO: 217998 - RNA, 64 nt, hsa
guucagcugugcuuccucagccuacuaucauaggcuuccucagcccucugucauauggcuguuu

SEQ ID NO: 217999 - RNA, 64 nt, hsa
aaaaaggguagcaaaggccaaugucuucuagcugcuuccucaaccccuguccccuggagaccag

SEQ ID NO: 218000 - RNA, 64 nt, hsa
acacuuuaauggguauaauuuccuggcugccucccuuccucagcccauuagguuaaacaccaaa

SEQ ID NO: 218001 - RNA, 64 nt, hsa
auaaagaugaaaagacaacaaaaauaucuucauacuuccucauccccucauuggaacaaaaccu

SEQ ID NO: 218002 - RNA, 64 nt, hsa
cccuauuacccuauucuuaccuagccucccccgacuuccucaaaacaaacaagagauggcaaag

SEQ ID NO: 218003 - RNA, 64 nt, hsa
gaagagauuuuaaagacguucccuuuuguauucucuuccucauccaccgccacugggccuguca

SEQ ID NO: 218004 - RNA, 64 nt, hsa
cuggccuggccagcaccccacacuggagccaucucuuccucauauuucagcagugcagccgggg

SEQ ID NO: 218005 - RNA, 64 nt, hsa
cgacgacgacugcaaaguguaugcacaccgcaugcuuccucauccacauagugccagcagcagu

SEQ ID NO: 218006 - RNA, 64 nt, hsa
cuuguuucuuagcuuggggagaugauggacuuagcuuccucaagauaaauuucuaguuuauuaa

SEQ ID NO: 218007 - RNA, 64 nt, hsa
uguucauuauaaucuguauugacuuaaaaaguuucuuccucaugaugcuaauaguuuuuuguau

SEQ ID NO: 218008 - RNA, 64 nt, hsa
uucaaggucagugaagucuaucaaucauucuccccuuccucaucagcaaugguagauagaaaug

SEQ ID NO: 218009 - RNA, 64 nt, hsa
aguagugggaagugugaaggugaccgugaacauccuuccucaucgggucuguccccgucauuuc

SEQ ID NO: 218010 - RNA, 64 nt, hsa
acgccaccguuguguccgagcccgcccuccccugcuuccucagcgggaccccuucaucuguugg

SEQ ID NO: 218011 - RNA, 64 nt, hsa
cgccuccaccccugcagccuccuggcccgcucaccuuccucaccccuccucugacccacccaug

SEQ ID NO: 218012 - RNA, 64 nt, hsa
uuguucaacaguggcuuuuucuuagauaaucgugcuuccucagcgcccgucggguuguggcauc

SEQ ID NO: 218013 - RNA, 64 nt, hsa
ugucacuguguuuccucugcacuguucccuuccacuuccucauccucuuugugacauggaaguu

SEQ ID NO: 218014 - RNA, 64 nt, hsa
auguagauauaaaaaugauugugcccuaaccaaacuuccucagauugugcacuguuuguuuaaa

SEQ ID NO: 218015 - RNA, 64 nt, hsa
ucacaggggugagccaccgcacccagcccucucucuuccucaaugcacucugcuucuuccguuc

SEQ ID NO: 218016 - RNA, 64 nt, hsa
guccucaggagcuccaaccccggacggcagaugccuuccucagucucgagccucagucucccgu

SEQ ID NO: 218017 - RNA, 64 nt, hsa
aggacugaccaucucucacuguccuccccaccuucuuccucacucacacauuuuuuguacaucu

SEQ ID NO: 218018 - RNA, 64 nt, hsa
cucuagccggggcagacacccagcuggcuggguccuuccucagccuugccuccuccugucccca

SEQ ID NO: 218019 - RNA, 64 nt, hsa
auuuaaaauucuuauuuaaccuuccucccuucaucuuccucacccuuuuuacaguggaagaaag

SEQ ID NO: 218020 - RNA, 64 nt, hsa
ccucuuuuccaauccuaguugucuaccuucuuuucuuccucauuuccuucuuuuauuccucccc

SEQ ID NO: 218021 - RNA, 64 nt, hsa
acucuuaaaauacgguaccuggcaauguuuauuucauaaagaauugugaacuucuugaaucuag

SEQ ID NO: 218022 - RNA, 64 nt, hsa
uauguucaguaggaacuguacauguguugggaggcauaaagacuaauuagcaaccauaauaugg

SEQ ID NO: 218023 - RNA, 64 nt, hsa
ucugugaagugugaggacucuggagucuagcucacauaaagagaguguuauauaaaaauccgac

SEQ ID NO: 218024 - RNA, 64 nt, hsa
ugagaaauacgagucugucagagcggccauaagccauaaagagucaaucucuuaauuauauuuu

SEQ ID NO: 218025 - RNA, 64 nt, hsa
ccccugcuccaucccccauugcaugggggaagggcauaaagaaucauuuauaugcacguggaga

SEQ ID NO: 218026 - RNA, 64 nt, hsa
gguuggaugccguugcagagaaaaucagcaaugacauaaagagauuucuagaauaguugauggu

SEQ ID NO: 218027 - RNA, 64 nt, hsa
uguggcacauauacaccauggaauacuaugcagccauaaagaaggaugaguuuaugcccuuugu

SEQ ID NO: 218028 - RNA, 64 nt, hsa
aucccuucugagaaauguacccuauuauuuccuucauaaagaaugccacccaucugauuccuca

SEQ ID NO: 218029 - RNA, 64 nt, hsa
cuugugaaaguguaaugugcgauggcuauguagacauaaagaagaaacuuguaaauaucuuuuu

SEQ ID NO: 218030 - RNA, 64 nt, hsa
ucagcaguacaaaggcauguuuuaaaaucuauaacauaaagaauaaggaauagcuuuguauuuu

SEQ ID NO: 218031 - RNA, 64 nt, hsa
cuggaaggaaaaaagcuauucucuaacaggagaacauaaagauucauuucucucccacccucaa

SEQ ID NO: 218032 - RNA, 64 nt, hsa
gguaacauucuacaguuacuuuucaugucauacccauaaagauaguuuaugcauucaucugaaa

SEQ ID NO: 218033 - RNA, 64 nt, hsa; identical to SEQ ID NO: 70892

SEQ ID NO: 218034 - RNA, 64 nt, hsa; identical to SEQ ID NO: 70893

SEQ ID NO: 218035 - RNA, 64 nt, hsa; identical to SEQ ID NO: 70894

SEQ ID NO: 218036 - RNA, 64 nt, hsa; identical to SEQ ID NO: 70895

SEQ ID NO: 218037 - RNA, 64 nt, hsa; identical to SEQ ID NO: 70896

SEQ ID NO: 218038 - RNA, 64 nt, hsa; identical to SEQ ID NO: 70897

SEQ ID NO: 218039 - RNA, 64 nt, hsa; identical to SEQ ID NO: 70898

SEQ ID NO: 218040 - RNA, 64 nt, hsa; identical to SEQ ID NO: 70899

SEQ ID NO: 218041 - RNA, 64 nt, hsa; identical to SEQ ID NO: 70900

SEQ ID NO: 218042 - RNA, 64 nt, hsa; identical to SEQ ID NO: 70901

SEQ ID NO: 218043 - RNA, 64 nt, hsa; identical to SEQ ID NO: 70902

SEQ ID NO: 218044 - RNA, 64 nt, hsa; identical to SEQ ID NO: 70903

SEQ ID NO: 218045 - RNA, 64 nt, hsa; identical to SEQ ID NO: 70904

SEQ ID NO: 218046 - RNA, 64 nt, hsa; identical to SEQ ID NO: 70905

SEQ ID NO: 218047 - RNA, 64 nt, hsa; identical to SEQ ID NO: 70906

SEQ ID NO: 218048 - RNA, 64 nt, hsa; identical to SEQ ID NO: 70907

SEQ ID NO: 218049 - RNA, 63 nt, hsa
gcaggucugcccuuucauugggguguauacauaucaggggacccugagguggcaccguacuca

SEQ ID NO: 218050 - RNA, 63 nt, hsa
gaggccaggguucgggaaguacacugccaucggucaggggacagcugccucccaccuugccug

SEQ ID NO: 218051 - RNA, 63 nt, hsa
cugaaauuuacccacagugaggcuguggauggaucaggggaccuguauaaaauguuugagccu

SEQ ID NO: 218052 - RNA, 63 nt, hsa
uguauccucaaucauacuauacagcaguuuuugucaggggaacauaaaaauauccaagagagg

SEQ ID NO: 218053 - RNA, 63 nt, hsa
cgaacugugcucccacggggaccacugggccccucaggggaagcugcuaggggaaggacuggc

SEQ ID NO: 218054 - RNA, 63 nt, hsa
agcugaggccucccuugaguaggcccugcuuuaucaggggacaaaccagggguaccaggcaca

SEQ ID NO: 218055 - RNA, 63 nt, hsa
gcuaacuggagcauaauccuuacaguuuugcacucaggggauuaaguuugaaacauagugucu

SEQ ID NO: 218056 - RNA, 63 nt, hsa
guauuugauucacaagaggauucucccugagugucaggggaggcugugggacuucaccacgug

SEQ ID NO: 218057 - RNA, 63 nt, hsa
agagccuuuuuuguuucugcucuuugucagcuuucaggggagaaggaggccacuggaaaauua

SEQ ID NO: 218058 - RNA, 63 nt, hsa
cauggcuuuauuuaugaaccugguuuucgggagucaggggaggagaugacuuugcuucugugc

SEQ ID NO: 218059 - RNA, 63 nt, hsa
guucuugcagacaccccaccugugccccuaucaucaggggaacugcuccaccugagaggacca

SEQ ID NO: 218060 - RNA, 63 nt, hsa
uuaucuaugugugacaaaugaggaaacugaggcucaggggauaaagggacuugcccaaguccc

SEQ ID NO: 218061 - RNA, 63 nt, hsa
gccuucgugaaaagccaauagcacucucagauaucaggggauuuuaguuccaagcagggaccc

SEQ ID NO: 218062 - RNA, 63 nt, hsa
ggcagugacucgguggcuucccaagcaggagugucaggggaaccaugagagagagucuaggag

SEQ ID NO: 218063 - RNA, 63 nt, hsa
gcucuucuccagagauuacaaaaauguagcuucucaggggaggcaggaagaaaggaaggaagg

SEQ ID NO: 218064 - RNA, 63 nt, hsa
uucuuuuuuuuuuuaacucgaacuuuucauaacucaggggauucccugaaaaauuaccugcag

SEQ ID NO: 218065 - RNA, 64 nt, hsa; identical to SEQ ID NO: 180322

SEQ ID NO: 218066 - RNA, 64 nt, hsa; identical to SEQ ID NO: 180323

SEQ ID NO: 218067 - RNA, 64 nt, hsa; identical to SEQ ID NO: 180324

SEQ ID NO: 218068 - RNA, 64 nt, hsa; identical to SEQ ID NO: 180325

SEQ ID NO: 218069 - RNA, 64 nt, hsa; identical to SEQ ID NO: 180326

SEQ ID NO: 218070 - RNA, 64 nt, hsa; identical to SEQ ID NO: 180327

SEQ ID NO: 218071 - RNA, 64 nt, hsa; identical to SEQ ID NO: 180328

SEQ ID NO: 218072 - RNA, 64 nt, hsa; identical to SEQ ID NO: 180329

SEQ ID NO: 218073 - RNA, 64 nt, hsa; identical to SEQ ID NO: 180330

SEQ ID NO: 218074 - RNA, 64 nt, hsa; identical to SEQ ID NO: 180331

SEQ ID NO: 218075 - RNA, 64 nt, hsa; identical to SEQ ID NO: 180332

SEQ ID NO: 218076 - RNA, 64 nt, hsa; identical to SEQ ID NO: 180333

SEQ ID NO: 218077 - RNA, 64 nt, hsa; identical to SEQ ID NO: 180334

SEQ ID NO: 218078 - RNA, 64 nt, hsa; identical to SEQ ID NO: 180335

SEQ ID NO: 218079 - RNA, 64 nt, hsa; identical to SEQ ID NO: 180336

SEQ ID NO: 218080 - RNA, 64 nt, hsa; identical to SEQ ID NO: 180337

SEQ ID NO: 218081 - RNA, 64 nt, hsa; identical to SEQ ID NO: 180338

SEQ ID NO: 218082 - RNA, 64 nt, hsa; identical to SEQ ID NO: 180339

SEQ ID NO: 218083 - RNA, 63 nt, hsa
cugucccuggaguucccagguucccagcucccccccugcaagccuugaagccuccagcaacgu

SEQ ID NO: 218084 - RNA, 63 nt, hsa
ggucugaaaaucagccagugccaacauugcuugcccugcaaggugcaacugagcccacauagc

SEQ ID NO: 218085 - RNA, 63 nt, hsa
uggugaaaagcuuuucacuaagugagguuccuucccugcaaaugcugaaucuagccuaauucg

SEQ ID NO: 218086 - RNA, 63 nt, hsa
ccccuccaucaagaucuuugagggaccaccucacccugcaaaagagacagguccuccaguacc

SEQ ID NO: 218087 - RNA, 63 nt, hsa
guggaguggggagguugggccuggacccucaaccccugcaaccuucccuagcccccucaauag

SEQ ID NO: 218088 - RNA, 63 nt, hsa
gcccagccccaguacugccaccuuuacaccuaccccugcaaguccccagagggcugcccacga

SEQ ID NO: 218089 - RNA, 63 nt, hsa
cauuuuaauuuggcaaucucuuaaauaauauugcccugcaaguacccaguaaaugguaaggua

SEQ ID NO: 218090 - RNA, 63 nt, hsa
uauuuccagccuaugacuccuacgcugucuauacccugcaaccuuucugcucccucucuugcu

SEQ ID NO: 218091 - RNA, 63 nt, hsa
gcccucccugaaccccugcaacccucccugaaccccugcaaaugaaaccaaacguccaccugg

SEQ ID NO: 218092 - RNA, 63 nt, hsa
uccccgguugugggacaagagcccucccugaaccccugcaacccucccugaaccccugcaaau

SEQ ID NO: 218093 - RNA, 63 nt, hsa
acagggugagaagagucagggccgcaccucugucccugcaaaccaacaggugcauggugagug

SEQ ID NO: 218094 - RNA, 63 nt, hsa
cucaggguugcggcagagccauggacuuccggucccugcaacgggugaccuaagcguggugca

SEQ ID NO: 218095 - RNA, 63 nt, hsa
aaaugucaaaucugguuuuuaaacaagguccaacccugcaaugaagcagccacuucagcccag

SEQ ID NO: 218096 - RNA, 63 nt, hsa
ccgagguccaaguaugagccagggcugccuccacccugcaacuccuggcagcuuuggcccugg

SEQ ID NO: 218097 - RNA, 63 nt, hsa
cuuggccuagcccacccugcugccuucugacggcccugcaauguaucccuucucacagcacau

SEQ ID NO: 218098 - RNA, 63 nt, hsa
gagcaggcgguggggagagauggacaguucacacccugcaaggcccacaggaggcaagcaagc

SEQ ID NO: 218099 - RNA, 63 nt, hsa
ccagagguauuagcugcugagcccugcaagggccccugcaauccugucccugcccuccucacc

SEQ ID NO: 218100 - RNA, 58 nt, hsa
cguccagccagagguauuagcugcugagcccugcaagggccccugcaauccugucccu

SEQ ID NO: 218101 - RNA, 63 nt, hsa
cuugucacugccgucugugcacugauucacacucccugcaaaauggucacucugccaucuugg

SEQ ID NO: 218102 - RNA, 63 nt, hsa
gacauccaugcaggcagcagugcugaauccaugcccugcaauguccaaccgccaacugcagug

SEQ ID NO: 218103 - RNA, 63 nt, hsa
acacguggaggaaugcucccccauccuccccuucccugcaaacaugggguuggcugggcccag

SEQ ID NO: 218104 - RNA, 63 nt, hsa
ugaccuguggggauuucucccagcucuagacaacccugcaaaggacuguuuuuuccugagcuu

SEQ ID NO: 218105 - RNA, 63 nt, hsa
aagagccucccaccagagccgggaggaaaaggccccugcaauguggugacaccucccccuuuc

SEQ ID NO: 218106 - RNA, 63 nt, hsa
acuaccagccagccucagaaggccccagagagacccugcaagaccacggagggagcgacacuu

SEQ ID NO: 218107 - RNA, 64 nt, hsa
aaggggagauuucagaagacgggcgaaacaacugaugggggaagauaccuggggugagaagaug

SEQ ID NO: 218108 - RNA, 64 nt, hsa
ucugccccaauacacauaccucccuuaagccaggaugggggaaagagugggauuaggcugaagu

SEQ ID NO: 218109 - RNA, 64 nt, hsa
gguucaaguuaccgagagauagguguguuccuuuaugggggauggggggguguguuggggauuc

SEQ ID NO: 218110 - RNA, 64 nt, hsa
caguucuucugugcucuauuauacccugauagagaugggggagagaaaggaauguuuuugaugg

SEQ ID NO: 218111 - RNA, 64 nt, hsa
cuaauugauauauguguuggaagacugaguauugaugggggaguggaccagacaaagagguaag

SEQ ID NO: 218112 - RNA, 64 nt, hsa
uuucaguugauuuuuugaaagaaacaaagguuaaaugggggauuaaaguaaaauugagagaccc

SEQ ID NO: 218113 - RNA, 64 nt, hsa
uuacaaguuguguaaaauggacucuaguuuaauaaugggggaaaaaagauuagguugcuccuga

SEQ ID NO: 218114 - RNA, 64 nt, hsa
auauuccuugaugggacagcuuguggggauggcuaugggggaaggggagguugagaaaggaagu

SEQ ID NO: 218115 - RNA, 64 nt, hsa
uuccacauucaaaaguuuuguaggguggugggaaaugggggaucuucaauguuuauuuuaaaau

SEQ ID NO: 218116 - RNA, 64 nt, hsa
acacagugaccucugaaucaguuucagagaagggaugggggagaaaaugccuucuagguuuuga

SEQ ID NO: 218117 - RNA, 64 nt, hsa
aagcacucgggaaaccuggggcuaaucaaauccaaugggggaaaugacuaaaagucuucggucg

SEQ ID NO: 218118 - RNA, 64 nt, hsa
ggugcgucuccccggaguucaguuuuaccagaugaugggggaggggggaaggaguuuuauguua

SEQ ID NO: 218119 - RNA, 64 nt, hsa
gugagguggaugggggagugaaauugugagguggaugggggagugaaaucuccaugguuccugc

SEQ ID NO: 218120 - RNA, 64 nt, hsa
uaagaugugcuagauuaauuucauugugagguggaugggggagugaaauugugagguggauggg

SEQ ID NO: 218121 - RNA, 64 nt, hsa
cagcaagcuuuugggaucgggggaauaagaggguaugggggaaagguucauagacuuaggugug

SEQ ID NO: 218122 - RNA, 64 nt, hsa
ugugagaaugaggugggaggugucugguaaggucaugggggaagggagaugagagaggagauag

SEQ ID NO: 218123 - RNA, 64 nt, hsa
ggucccaugaugaugggccagggcucguguagaaaugggggaauugguuccccauggcccagga

SEQ ID NO: 218124 - RNA, 64 nt, hsa
gaaaccgagcagaccuggcccauguggagcuggcaugggggacacagcccagagacagagaagc

SEQ ID NO: 218125 - RNA, 64 nt, hsa
gacgacccuugucucccuggguaggggggggggaaugggggagggcugaugaggccccagcugg

SEQ ID NO: 218126 - RNA, 64 nt, hsa
cccuuccuuucacagccggucucucugccaggaaaugggggaaggaacuagaaccaccugcacc

SEQ ID NO: 218127 - RNA, 61 nt, hsa
acaacaaagugcaauacaggcugaaccuggcccaacagaaaaacccugccccaaugcaccu

SEQ ID NO: 218128 - RNA, 61 nt, hsa
aggguggggaggugcaguggcacccccagagccaacagagggagcaggcagaggguggggg

SEQ ID NO: 218129 - RNA, 61 nt, hsa
ggcagggacuguguucagggaaaguaccugaccaacagaacuucaagucucuuccagagug

SEQ ID NO: 218130 - RNA, 61 nt, hsa
cucuuuguagaugauguauuuugcuugggcaccaacagaauuaaaaacgaaaaacaaaaaa

SEQ ID NO: 218131 - RNA, 61 nt, hsa
ggcuucucauuuacaccaacagguuucaguuccaacagaaaggucgggguagguucgugca

SEQ ID NO: 218132 - RNA, 61 nt, hsa
uuccacagagguggcaggucuugcccuuuggccaacagauuucuuguccugccuucuagau

SEQ ID NO: 218133 - RNA, 64 nt, hsa
gaauuuuaaguauagcaaaauauguauaguguuuauacaugaugcugauuucuuaaaaccuaca

SEQ ID NO: 218134 - RNA, 64 nt, hsa
aagucugaaugaauuauuauauacauuugcuaucauacaugacaguugugucauuauuagagau

SEQ ID NO: 218135 - RNA, 64 nt, hsa
cucgagugagccaugcaaaaauagcuuuaaaauuauacaugagcagcucaaaguaaacguguau

SEQ ID NO: 218136 - RNA, 64 nt, hsa
uucacaugaauaguaaugugacaaacuaaaguuaauacaugaagcauugcaauauggaauuuug

SEQ ID NO: 218137 - RNA, 64 nt, hsa
uuuaaugaauaguagaggugucaagggacuauguauacaugauuaggguaagauagaauguauu

SEQ ID NO: 218138 - RNA, 64 nt, hsa
auggggaggcagagagucacuugaccauccagaaauacaugacuacaaguccuuuaugacuguu

SEQ ID NO: 218139 - RNA, 64 nt, hsa
acugaugaggcaugcagcuuucagcacaucuuuuauacaugaagaaauuaauuuuguguugcua

SEQ ID NO: 218140 - RNA, 64 nt, hsa
gguuuaauucggguggggaauauaacauaucaaaauacaugaacaaauggaaaguuacuucuag

SEQ ID NO: 218141 - RNA, 64 nt, hsa
aaaagugaagcaacaagauuuagguugaugaaagauacaugaguuugcauuuugaccuguucag

SEQ ID NO: 218142 - RNA, 64 nt, hsa
augacagucucaguauagaucaguugguacagaaauacaugaacacauuuugauagggcuuauu

SEQ ID NO: 218143 - RNA, 64 nt, hsa
guugauaguagauuaugucucuagguagagacagauacaugagaagagccuccaaaacuggaag

SEQ ID NO: 218144 - RNA, 64 nt, hsa
agaaaccaugcaauuuaacacuucaguuaaagaaauacaugagaacugcuugucaugaccagac

SEQ ID NO: 218145 - RNA, 64 nt, hsa
uaaugcccaguuauuaaaauuacaucuuuaaagaauacaugacaacaugggaaauuacguaagu

SEQ ID NO: 218146 - RNA, 64 nt, hsa
uagugggagaaaaacauuuuagauauguauuacuauacaugaauguauuauacacacacacuuu

SEQ ID NO: 218147 - RNA, 64 nt, hsa
uuuguuuacagaauccaaaaauacaauagagaagauacaugagggcuuaaacaagaaauaguaa

SEQ ID NO: 218148 - RNA, 64 nt, hsa
augcaaaaguguaauacauaaauugucacaaauuauacaugaaauugauuacaaauacauuuga

SEQ ID NO: 218149 - RNA, 64 nt, hsa
aaaaaaugcacucucacaguggaguugaagucuaauacaugauacaugugggccuguuagucuu

SEQ ID NO: 218150 - RNA, 64 nt, hsa
ccuauauaaaagcuauugaggcuuagcuuuauucauacaugagugauuugguuauaacucaauc

SEQ ID NO: 218151 - RNA, 64 nt, hsa
gcauuucuuuuuucucaaaaagaaacuguaggaaauacaugacagagaaaguuacacucaggga

SEQ ID NO: 218152 - RNA, 64 nt, hsa
gcuucuuagucuuuguuguaggaugcauaauaaaauacaugaaugaguuuuaaaugguuagcuu

SEQ ID NO: 218153 - RNA, 64 nt, hsa
auauaauguaauauuauguaccuaccacuaagaaauacaugaaccgugccaugaggacaguaag

SEQ ID NO: 218154 - RNA, 64 nt, hsa
aaucuuagacauuaccuguugacucccuguugucauacaugaggcuuuagcucucuuuugucag

SEQ ID NO: 218155 - RNA, 64 nt, hsa
gcacagaacuuugaaccuaggaggcagucaauaaauacaugagaaauucagcugucauucaguu

SEQ ID NO: 218156 - RNA, 64 nt, hsa
accauauguaugcuauuaaaauauauugagauuaauacaugaaaaugcuuaaaagugauaggaa

SEQ ID NO: 218157 - RNA, 64 nt, hsa
ugaagauuucgacuuccacuguuaaauguacaagauacaugaaauauuaaagaaaauguguaac

SEQ ID NO: 218158 - RNA, 64 nt, hsa
aauuuguuucuauuaagcaaguaccaguuuaccaauacaugaguaacugaaguguaacuguuaa

SEQ ID NO: 218159 - RNA, 64 nt, hsa
gguuguauacuuacauuuuuucuuuccuuaauuuauacaugauccuuuuuccuuaauuuauaca

SEQ ID NO: 218160 - RNA, 64 nt, hsa
ccuuaauuuauacaugauccuuuuuccuuaauuuauacaugauccaggcacauuugaaauuugg

SEQ ID NO: 218161 - RNA, 64 nt, hsa
ugggaggggcuuuuauucugccaagucauuucaaauacaugaaaaaucuuacacuggagagaaa

SEQ ID NO: 218162 - RNA, 64 nt, hsa
uagaaaagcauuccauaauuucucuucuuugcaaauacaugaaaggaugcacagaggagagaag

SEQ ID NO: 218163 - RNA, 64 nt, hsa
uggaaaagcguuccauaauuucucuucuuuucaaauacaugaaaguugcacagaggagaggcgc

SEQ ID NO: 218164 - RNA, 64 nt, hsa
caaacaagcauucaauuauuuuucuuccuugcauauacaugaaaggacucauacgagagagaau

SEQ ID NO: 218165 - RNA, 64 nt, hsa
gggaaagcaugaaauucugucagugccuuuuuuaauacaugaaagaauucuagagagaagccau

SEQ ID NO: 218166 - RNA, 64 nt, hsa
ugggaaagcuuucaaucauuuuaguuccuuucaaauacaugaaagaacucaucauggagaaaac

SEQ ID NO: 218167 - RNA, 64 nt, hsa
ugguaaagccuucaguaguuccaguuauauucauauacaugaacgaauucauacuggagagaaa

SEQ ID NO: 218168 - RNA, 64 nt, hsa
ugggaaaacauacauuacucuugcagguuuccagauacaugaaagaacccacacuggagagaaa

SEQ ID NO: 218169 - RNA, 64 nt, hsa; identical to SEQ ID NO: 99128

SEQ ID NO: 218170 - RNA, 64 nt, hsa; identical to SEQ ID NO: 99129

SEQ ID NO: 218171 - RNA, 64 nt, hsa; identical to SEQ ID NO: 99130

SEQ ID NO: 218172 - RNA, 64 nt, hsa; identical to SEQ ID NO: 99131

SEQ ID NO: 218173 - RNA, 64 nt, hsa; identical to SEQ ID NO: 99132

SEQ ID NO: 218174 - RNA, 64 nt, hsa; identical to SEQ ID NO: 99133

SEQ ID NO: 218175 - RNA, 64 nt, hsa; identical to SEQ ID NO: 99134

SEQ ID NO: 218176 - RNA, 64 nt, hsa; identical to SEQ ID NO: 99135

SEQ ID NO: 218177 - RNA, 64 nt, hsa; identical to SEQ ID NO: 99136

SEQ ID NO: 218178 - RNA, 64 nt, hsa; identical to SEQ ID NO: 99137

SEQ ID NO: 218179 - RNA, 64 nt, hsa; identical to SEQ ID NO: 99138

SEQ ID NO: 218180 - RNA, 64 nt, hsa; identical to SEQ ID NO: 99139

SEQ ID NO: 218181 - RNA, 64 nt, hsa; identical to SEQ ID NO: 99140

SEQ ID NO: 218182 - RNA, 64 nt, hsa; identical to SEQ ID NO: 99141

SEQ ID NO: 218183 - RNA, 64 nt, hsa; identical to SEQ ID NO: 99142

SEQ ID NO: 218184 - RNA, 64 nt, hsa; identical to SEQ ID NO: 99143

SEQ ID NO: 218185 - RNA, 64 nt, hsa; identical to SEQ ID NO: 99144

SEQ ID NO: 218186 - RNA, 64 nt, hsa; identical to SEQ ID NO: 99145

SEQ ID NO: 218187 - RNA, 64 nt, hsa; identical to SEQ ID NO: 99146

SEQ ID NO: 218188 - RNA, 64 nt, hsa; identical to SEQ ID NO: 99147

SEQ ID NO: 218189 - RNA, 64 nt, hsa; identical to SEQ ID NO: 99148

SEQ ID NO: 218190 - RNA, 64 nt, hsa; identical to SEQ ID NO: 99149

SEQ ID NO: 218191 - RNA, 64 nt, hsa
ccaaggaagagagauuguucugaaguuacccucugaaaaauauuuugucucucugacuugauuu

SEQ ID NO: 218192 - RNA, 64 nt, hsa
uauuuuacauaauuaaauauguacauauugauuagaaaaauauaacaagcaauuuuuccugcua

SEQ ID NO: 218193 - RNA, 64 nt, hsa
guaaugcauuguucucaguuucccugccaacauugaaaaauaaaaacagcagcuuuucuccuuu

SEQ ID NO: 218194 - RNA, 64 nt, hsa
aaacuuuauauaaugugugguuucaauucagcuugaaaaauaaucucacuacauguagcaguac

SEQ ID NO: 218195 - RNA, 64 nt, hsa
cgagggguggggggaggggggagauuuuucuuuugaaaaauaaugacucuuaggacauuuguuu

SEQ ID NO: 218196 - RNA, 64 nt, hsa
ugguacaaaaccacucgccagagcuguggugucagaaaaauaaaauauauuguuucuuacaaaa

SEQ ID NO: 218197 - RNA, 64 nt, hsa
agugcugccaacccugauauaggggaguuguauggaaaaauaguagaauuacacagcaugaaaa

SEQ ID NO: 218198 - RNA, 64 nt, hsa
ugcaauaacauuuaggauaaucuuugacauuuuggaaaaauaagaauugaggaaaaaaagugua

SEQ ID NO: 218199 - RNA, 64 nt, hsa
ucaaaagcuaaauauggcacacuuguucuuuacagaaaaauaaagauauuuuaaacaaaauacu

SEQ ID NO: 218200 - RNA, 64 nt, hsa
aauauuuguagaaggguuauauuuuacuacuguggaaaaauauuuaagauaguuuugccagaac

SEQ ID NO: 218201 - RNA, 64 nt, hsa
auauagcuauuuuuauggaauuuuucauugauaugaaaaauaugauauugcauaugcauaguuc

SEQ ID NO: 218202 - RNA, 64 nt, hsa
aaacaagcugagcuuugguccacuaaaacaagaugaaaaauacaagagugacucuauaacucug

SEQ ID NO: 218203 - RNA, 64 nt, hsa
gcauggaucaaguaagcauaguuuuauccagggagaaaaauaaaaggaagccauagaauugcuc

SEQ ID NO: 218204 - RNA, 64 nt, hsa
ucacauucuuggcuuaaucauuuucauuccuaaagaaaaauaucuuggccuaaaccucaguuau

SEQ ID NO: 218205 - RNA, 64 nt, hsa
aaaaccggucacugaugggaaaacugccaauauagaaaaauaaaaaucucuuuuccacuccauu

SEQ ID NO: 218206 - RNA, 64 nt, hsa
cuauggcuuauuucuaugacaaauucaagagcuagaaaaauaaaauguuucauuaugcacuuuu

SEQ ID NO: 218207 - RNA, 64 nt, hsa
gcucaaaguaugcaaugcuucauuauucaagaaugaaaaauauaauguugauaauauauauuaa

SEQ ID NO: 218208 - RNA, 64 nt, hsa
aacgaccccuuguuaccuugauucacuguauguggaaaaauaauguaaccaaaagggaagagcu

SEQ ID NO: 218209 - RNA, 64 nt, hsa
uuucuuuaaaaaauguaaggauuucauuuauauugaaaaauaauauuaaucauuuugcuguuaa

SEQ ID NO: 218210 - RNA, 64 nt, hsa
agggcuaaaguugugucuuaugccaagcgaaagugaaaaauaucauuuucacuuuaucaacuga

SEQ ID NO: 218211 - RNA, 64 nt, hsa
aggaaugucaaaaauacauuuuacuuuauucaaagaaaaauauauugguuacugggaaaagguc

SEQ ID NO: 218212 - RNA, 64 nt, hsa
uuuugcauuuaaguuguuugaaggcauguauuuugaaaaauaucuguuacaaauuuauaauuuc

SEQ ID NO: 218213 - RNA, 64 nt, hsa
cuaugaaauacauaaaccauauaucaaguuauuugaaaaauaccuauuuuuuuccaaagugugu

SEQ ID NO: 218214 - RNA, 64 nt, hsa
uaagacaggguacuaauuuuuauacugguuuuuagaaaaauauuuauauuguuggugcucaaau

SEQ ID NO: 218215 - RNA, 64 nt, hsa
aucggaccugguugaguaaggaccucuuaaaagggaaaaauaaauuuugccgucagcuucuuca

SEQ ID NO: 218216 - RNA, 64 nt, hsa
ugugaugaagacaaauauguauaccuggcauagagaaaaauauauaccugguacauuggagaaa

SEQ ID NO: 218217 - RNA, 64 nt, hsa
ggcauagagaaaaauauauaccugguacauuggagaaaaauaauuacacuuucaaagagaauuc

SEQ ID NO: 218218 - RNA, 64 nt, hsa
uuaaaugcugcuggcuauuccuuuguauauaaaugaaaaauaccauucauuaaaauuaaguacu

SEQ ID NO: 218219 - RNA, 64 nt, hsa
uuugauauucauagaguugugccuaccuuuaauggaaaaauacaugucagauacuuagauguuu

SEQ ID NO: 218220 - RNA, 64 nt, hsa
aaaagcugauauuuccuaccuaagcaucucccgagaaaaauaucucauuaaaaagcccauaaau

SEQ ID NO: 218221 - RNA, 64 nt, hsa
uauuaacuauccugaauauuuuauaauuuuguaggaaaaauaugcaucuauuuuuucuugacuu

SEQ ID NO: 218222 - RNA, 64 nt, hsa
agccugagcaguguucucaguaauguauuugaaggaaaaauacccugauuugaaaccaacagca

SEQ ID NO: 218223 - RNA, 64 nt, hsa
aagcgugacguguuucuaaugccccuugagaggugaaaaauaccacauaaugaucaguaugcug

SEQ ID NO: 218224 - RNA, 64 nt, hsa
guuagcuacuaugaauggugccagugaagacacugaaaaauaagugauuucaguaaccuucugg

SEQ ID NO: 218225 - RNA, 64 nt, hsa
ugcauuaauaaaagcagccaaauagggccaaagagaaaaauaacaggacucuguacuggaccua

SEQ ID NO: 218226 - RNA, 64 nt, hsa
cuacaauauucacaaaauucuuauguucucuuaugaaaaauauacacuuuucauuuugucuucu

SEQ ID NO: 218227 - RNA, 64 nt, hsa
cauacaccaaauauaggucuguuuuaaaggagaggaaaaauaguucaaggaguuuuugccucuu

SEQ ID NO: 218228 - RNA, 64 nt, hsa
uauuuuuauuaccaauaaauuuaaaauuuuuuaagaaaaauauuuuuauccuagggccaagugu

SEQ ID NO: 218229 - RNA, 64 nt, hsa
uauauagguauuuauuucagaauugauauuuugagaaaaauacaugugagucauuuuuucuguu

SEQ ID NO: 218230 - RNA, 64 nt, hsa
auuuaauucauauuugggaaacuuuuagggaaaugaaaaauaaaagucacugagucugggugac

SEQ ID NO: 218231 - RNA, 64 nt, hsa
uguauguugcguaucccaaggcacugaagagguggaaaaauaaucgugucaaucuggaugauag

SEQ ID NO: 218232 - RNA, 64 nt, hsa
caauggaauacaaccuuugacaagauuuucagaggaaaaauacacuguuuggucaaguuaagga

SEQ ID NO: 218233 - RNA, 64 nt, hsa
caaucagugauuuucaauguauuauauuucuuuugaaaaauauaauauuuuuaugagaguggac

SEQ ID NO: 218234 - RNA, 64 nt, hsa
uuuuaagauuuguucauaaaauggucugauccaggaaaaauaaaaugggaacauggacaccauu

SEQ ID NO: 218235 - RNA, 64 nt, hsa
caaagaauugaaugaauacaacagaauugagguugaaaaauauuugauugccacauuccuuuaa

SEQ ID NO: 218236 - RNA, 64 nt, hsa
auuuuuuaagggaugugccuaugcauugaugccugaaaaauauguauaaagaaaugagguugac

SEQ ID NO: 218237 - RNA, 64 nt, hsa
guccuggauuaauacuuugucucccaauaucacagaaaaauacaugccagugacucuugagguu

SEQ ID NO: 218238 - RNA, 64 nt, hsa
cucucugcuuaaucuuuucuaaaaucgccuguaugaaaaauaccucgcuggauggaaaaguaga

SEQ ID NO: 218239 - RNA, 64 nt, hsa
aagaaguaaagaagaggucacuagauguugcagugaaaaauaguaggccacuuggcucacacag

SEQ ID NO: 218240 - RNA, 64 nt, hsa
uuaauugcuguaggauccuguucuuucagcaggugaaaaauaaaacgcaguucaaauuucaugg

SEQ ID NO: 218241 - RNA, 64 nt, hsa
uuauuauuacugcaguaguugacuuugcuguauggaaaaauaaagugaaauugcccuaauaaaa

SEQ ID NO: 218242 - RNA, 64 nt, hsa
uauauaaauaacucuuauaacacaacaauaaggagaaaaauaaaucaauuuaaaaaaugggcua

SEQ ID NO: 218243 - RNA, 64 nt, hsa
uuagauaugauaccaaagacacaagcaaccaauggaaaaauagguaaauuggacuuaaucaaga

SEQ ID NO: 218244 - RNA, 64 nt, hsa
agccccagaucugagccuugacgcaggccaaguggaaaaauacuuucccgccccccuccccugu

SEQ ID NO: 218245 - RNA, 64 nt, hsa
agccccaucguagcacaguauuacaugugguugggaaaaauaaaaauacagugguguggaauac

SEQ ID NO: 218246 - RNA, 64 nt, hsa
agaagagcugcagcuuugacagugcuuauuuaaagaaaaauacugcuggaaaauuuccaauuuc

SEQ ID NO: 218247 - RNA, 64 nt, hsa
augcaacugauuuauacaaaaugaacuuuggcaagaaaaauaacauuaaccucauuguuuaugg

SEQ ID NO: 218248 - RNA, 64 nt, hsa
uguugucuuauuauuauauagaaaaauaacuuuagaaaaauauugaagacauuguauuaccacu

SEQ ID NO: 218249 - RNA, 64 nt, hsa
ccuauaugcuaugcuguugucuuauuauuauauagaaaaauaacuuuagaaaaauauugaagac

SEQ ID NO: 218250 - RNA, 64 nt, hsa
ucaguuugauuggauacuuaaguuuuagaaaugagaaaaauacagaguuuuagaaaugagaucu

SEQ ID NO: 218251 - RNA, 64 nt, hsa
guuguauaagcuacuguaagaaacuuaucauaaggaaaaauagaaaggaaaacuugaaucaaua

SEQ ID NO: 218252 - RNA, 64 nt, hsa
auuuagaaguuuuggauaugaaaaacagaagagagaaaaauauacauuauaaaagcagaacaua

SEQ ID NO: 218253 - RNA, 64 nt, hsa
ugucauauauuaaaaaagagcuugcuuacuacaagaaaaauauugaaauauugaaaauauugaa

SEQ ID NO: 218254 - RNA, 64 nt, hsa
aauauuugguuaguaccuucacugagcaauaguggaaaaauaaaaaaauaaguaaacagaaaaa

SEQ ID NO: 218255 - RNA, 64 nt, hsa
accaccacaaccaaguuccagcuggcaagaagaggaaaaauaacacagaggaguuaugaccagu

SEQ ID NO: 218256 - RNA, 64 nt, hsa
auaugucaacugaagaucugacuguacuaaauaugaaaaauaaagcagcacauacuuucucuac

SEQ ID NO: 218257 - RNA, 64 nt, hsa
caguaguaaaauauguaaccauugucccaguaaagaaaaauaacaaaaguuguaaaauguauau

SEQ ID NO: 218258 - RNA, 64 nt, hsa
auguuuaaauguccauuuuuauucauuaugcuuugaaaaauaauuauggggaaauacauguuug

SEQ ID NO: 218259 - RNA, 64 nt, hsa
aacuucaaaauauauauauauauauaauuuaaaggaaaaauaggugccuccuuuauaaacagua

SEQ ID NO: 218260 - RNA, 64 nt, hsa
agagucucauuagacaaugauuuuuaaagcauuggaaaaauauuuugccuguaaaaguuaguaa

SEQ ID NO: 218261 - RNA, 64 nt, hsa
uuuugggauaacuuauuuguauguugguagcugagaaaaauaucaucagucuagaauugauauu

SEQ ID NO: 218262 - RNA, 64 nt, hsa
ucauuggaagaaaucaccaaagauuauuacaaaagaaaaauauguugcuaagauuguguugguc

SEQ ID NO: 218263 - RNA, 64 nt, hsa
caaucacuuuuacuuuuuguaauucugucucuuagaaaaauacauaaucuaaucaauuucuuug

SEQ ID NO: 218264 - RNA, 64 nt, hsa
uacaaaauguuuuugucuaccaaagaaaaauguugaaaaauaagcaaauguauaccuagcaauc

SEQ ID NO: 218265 - RNA, 64 nt, hsa
aggugccaucuuaaauuaauugcaucuucauuaggaaaaauaaaaagcauaaaacacaauuucu

SEQ ID NO: 218266 - RNA, 64 nt, hsa
ucauuguguuuuuuguugguugccacagcuuggggaaaaauagaaaaaaauuaaugacuguauu

SEQ ID NO: 218267 - RNA, 64 nt, hsa
acaugaaaugcuuccaagcaugacaacuuuuaaagaaaaauaugauacucucagauuuuaaggg

SEQ ID NO: 218268 - RNA, 64 nt, hsa
agggagcuauuuucauuuagugcuaaacaaguaagaaaaauaagcucgagugaauuucuaaaug

SEQ ID NO: 218269 - RNA, 64 nt, hsa
ccuuagaaaucauuguagaaacacaguuuugaaagaaaaauaccaugucucuaagccaacuuua

SEQ ID NO: 218270 - RNA, 64 nt, hsa
ugacuuuuucugagcuuuucauggaaguggcagugaaaaauauguugaguguucauuuuaguga

SEQ ID NO: 218271 - RNA, 64 nt, hsa
ucuuaaggcaucauaucuagaagcaaagaaaaaagaaaaauaacaauuuaaguuguguaaauug

SEQ ID NO: 218272 - RNA, 64 nt, hsa
cugucucagaaaaaaaaaaaaagaaaaggaaaaagaaaaauauauauucuauauuuuuuuaacu

SEQ ID NO: 218273 - RNA, 64 nt, hsa
ucauaaugcauuuuccaacuugaaaacaauaauugaaaaauagccuuauuguauauuuuaugcc

SEQ ID NO: 218274 - RNA, 64 nt, hsa
aauacacauggcuuaauuauuuuauugggauacagaaaaauauaaauucuggacaaauaaguca

SEQ ID NO: 218275 - RNA, 64 nt, hsa
aaaaaccuucuuuuagaucuuccuugggccuuuggaaaaauaugugacaagugaauguaagucu

SEQ ID NO: 218276 - RNA, 64 nt, hsa
aaaaucaaugauuuuaaugcauagcaguauguuugaaaaauagaccauucuaaaaagcccauga

SEQ ID NO: 218277 - RNA, 64 nt, hsa
uaccagaaagccaaauuuuauaaugcgggugaaagaaaaauauagauuaaaauugcugggcacu

SEQ ID NO: 218278 - RNA, 64 nt, hsa
auuauauuuuuauuuuauuauuuuagugucuugagaaaaauaccaagagauauaauguuucuuu

SEQ ID NO: 218279 - RNA, 64 nt, hsa
uuuaguacuuuugucuucucccaugugcuugaaggaaaaauaaagugucacuaccguauuucuu

SEQ ID NO: 218280 - RNA, 64 nt, hsa
uuauagcuaugucuugugaaaauaaccucaaaaagaaaaauacgacucuguugucuuacuugau

SEQ ID NO: 218281 - RNA, 64 nt, hsa
agcgugagacccugucucaaagaagaaaaaaagagaaaaauaacucuuuugaacaaacagacaa

SEQ ID NO: 218282 - RNA, 64 nt, hsa
ucauugugguguauuauaauuaguuuugugaauagaaaaauaaagcacuuauguuuaaauuugu

SEQ ID NO: 218283 - RNA, 64 nt, hsa
agauauauugcaaagucuguauuccagcucuuaagaaaaauauaagcauguuaaauaccauauu

SEQ ID NO: 218284 - RNA, 64 nt, hsa
gugaaaauuaagucuaaugucagaauaacuuacagaaaaauagaaaaugcacagcuuuaaaaug

SEQ ID NO: 218285 - RNA, 64 nt, hsa
aguuuuuaaaaauaaauuauaaacuuggagauuagaaaaauaaagcaguugcuguagaauaggc

SEQ ID NO: 218286 - RNA, 64 nt, hsa
ugcuuuagaguuaaauauuccuaucuuaaguuuagaaaaauacaaaaaaccauuccaaggauga

SEQ ID NO: 218287 - RNA, 64 nt, hsa
uugguaugcgauacagacagcuaacuuuucuuaugaaaaauacauauuugcauguaaacaauga

SEQ ID NO: 218288 - RNA, 64 nt, hsa
auauuugcauguaaacaaugauuucaaaauacuugaaaaauaaaauuuuaacccaaaugaauaa

SEQ ID NO: 218289 - RNA, 64 nt, hsa
ugcuuagcuucucuagacaucaguuuccacaucugaaaaauaagaagaugagaguacacgguug

SEQ ID NO: 218290 - RNA, 64 nt, hsa
gcagucaaaaaaaaaaauaccuuuuguaauguuugaaaaauaaagcuguuugacuugucaggug

SEQ ID NO: 218291 - RNA, 64 nt, hsa
ucauuuaaaucugcauucagugaauguauugggagaaaaauaggucuugcagguuuccuuuuga

SEQ ID NO: 218292 - RNA, 64 nt, hsa
ugaaugcagucuuucaugcuaaugaguuagucuggaaaaauaaagucuuauuuucuauguuuua

SEQ ID NO: 218293 - RNA, 64 nt, hsa
acuaauacuuacuguuaacugucuugagagaaaagaaaaauaugagagaacuauuguuugggga

SEQ ID NO: 218294 - RNA, 64 nt, hsa
ucucaaauuuuucaucucuucaaucacuagucaagaaaaauauaaaaacaacaaauacuuccau

SEQ ID NO: 218295 - RNA, 64 nt, hsa
cugcauugcaccaugagcaagaacugcucugcaagaaaaauaucugucccuguggucugaauuu

SEQ ID NO: 218296 - RNA, 64 nt, hsa
caggauuauaaagucaagugaggaauaaauagcagaaaaauaccuuaaaggaacaaaaaaucca

SEQ ID NO: 218297 - RNA, 64 nt, hsa
aauagguuacuacaaaaaagguuauauucugaaagaaaaauaacugacauuauauauaaccaau

SEQ ID NO: 218298 - RNA, 64 nt, hsa
uaacuuuguauagcccauguaccuaccuuguauagaaaaauaauuuuaaaaauuugaauggaag

SEQ ID NO: 218299 - RNA, 64 nt, hsa
guuaggguuuaaaaccauauugaucaacuagaaagaaaaauaugaaaagagaaaaauauuuuaa

SEQ ID NO: 218300 - RNA, 64 nt, hsa
auauugaucaacuagaaagaaaaauaugaaaagagaaaaauauuuuaauuuaaaaauuguaaua

SEQ ID NO: 218301 - RNA, 64 nt, hsa
auaauguaucccagaauuuuaaaucuugaccauagaaaaauacagucauucauuggcaaagaug

SEQ ID NO: 218302 - RNA, 64 nt, hsa
aauuuaagugacaaauguuagaagaugauggauugaaaaauauaaguaauuuggcauauugacc

SEQ ID NO: 218303 - RNA, 64 nt, hsa
ucuauagcgaauguaauaugccucuuaucuucaugaaaaauaaauauugcuuuugaacaaaacu

SEQ ID NO: 218304 - RNA, 64 nt, hsa
cuuacauauacaucuuaguugauuauuaaaaaaggaaaaauaugguuuccagagaaaaggccaa

SEQ ID NO: 218305 - RNA, 64 nt, hsa
agaccagccugacauggugaaaccccaucucuacgaaaaauacaaaaauuagcugggcauagug

SEQ ID NO: 218306 - RNA, 64 nt, hsa
auuuggaauagagaaaccaguauauuuuaaaaaagaaaaauauucuuuguagcaacuguaaauu

SEQ ID NO: 218307 - RNA, 64 nt, hsa
ugauggagaggcauaguaaucuguuugugcuuuggaaaaauauauaaaaguuuuuuuccccuau

SEQ ID NO: 218308 - RNA, 64 nt, hsa
auucaguguugcgguagcagaugcauuaucaaaggaaaaauauuuggcuccuuuaauuccucug

SEQ ID NO: 218309 - RNA, 64 nt, hsa
aauucagcaggaauuacacauuagaaagaagccagaaaaauaaauggcauauauccaaucacaa

SEQ ID NO: 218310 - RNA, 64 nt, hsa
gcauuauugagguauuuaagaagauuauuuuagagaaaaauauuucucauuugauauaauuuuu

SEQ ID NO: 218311 - RNA, 64 nt, hsa
ugaagaguuuggauguguaacuugugaugccuuagaaaaauauccuaagcacaaaauaaaccuu

SEQ ID NO: 218312 - RNA, 64 nt, hsa
uacaaaugaaaugauaggcaucuauguaaagugagaaaaauauguuucguaaauauuugcaucu

SEQ ID NO: 218313 - RNA, 64 nt, hsa
uauguaaaaacaagccaguuagcaaacaguccuggaaaaauauggugagaaugguuuaauuccg

SEQ ID NO: 218314 - RNA, 64 nt, hsa
aggcaucacaguuuugcaaccucugcuccaaagagaaaaauagaaugaguuuucuuucuuuuuu

SEQ ID NO: 218315 - RNA, 64 nt, hsa
uuaggaaaaaggaaagucauuuugaccucagguagaaaaauagauugcuuugaguuuuauguag

SEQ ID NO: 218316 - RNA, 64 nt, hsa
guacuuguacccccuaaauuuauuuuuaaaaaaggaaaaauaaaaguaucaugaaaaaaccuau

SEQ ID NO: 218317 - RNA, 64 nt, hsa
uugugguggcaaauguuugguagaacuguaauuagaaaaauacaaguauauuugcgugaugguu

SEQ ID NO: 218318 - RNA, 64 nt, hsa
uuuuacauuaaaccuuuucuaaaaauuguaaauagaaaaauaauuugguuuuuuaucaagaaca

SEQ ID NO: 218319 - RNA, 64 nt, hsa
uuaacauuaucauggcagggaaauauauaaagaagaaaaauauuuuuacauuaaaccuuuucua

SEQ ID NO: 218320 - RNA, 64 nt, hsa
gcuauaauccucacuguauuuucuuguucuucuugaaaaauauaggauuugauuccacaguucu

SEQ ID NO: 218321 - RNA, 64 nt, hsa
agagagagagagaggagaagacagagagauuaaagaaaaauauguucacucccacuuauguguu

SEQ ID NO: 218322 - RNA, 64 nt, hsa
gauuuuuaaaaagcaaagaaaacaaaauauaagggaaaaauaugagaaaaauaaaaauaaaaag

SEQ ID NO: 218323 - RNA, 64 nt, hsa
agcaaagaaaacaaaauauaagggaaaaauaugagaaaaauaaaaauaaaaagagaauaauagg

SEQ ID NO: 218324 - RNA, 64 nt, hsa
cagccugcccaacguggugaaaccccaucucuaugaaaaauacaaaaaucagacgggcacagug

SEQ ID NO: 218325 - RNA, 64 nt, hsa
uuucuacuaagggguuuagccauaacugugcauagaaaaauaauuaucuguaaaaaaugaaggg

SEQ ID NO: 218326 - RNA, 64 nt, hsa
ucuugcucaucagaaccucagcuaaucuaccuaggaaaaauaguaucaaaggaaaugagaaagu

SEQ ID NO: 218327 - RNA, 64 nt, hsa
ggaacccuaaaaaguuggcccgaugacuuaaagggaaaaauaauucauucccagagaugaguca

SEQ ID NO: 218328 - RNA, 64 nt, hsa
ucgugguuuaaaauuacuaacaaguugugggaaagaaaaauaauauuugauuuugaaucuuaaa

SEQ ID NO: 218329 - RNA, 64 nt, hsa
ggagaaaaagaaaacucuggcguuagaggauauagaaaaauauaaguacaauuguuacaaauaa

SEQ ID NO: 218330 - RNA, 64 nt, hsa
ugaacgcccccagaaaauugugccaaagaguuuagaaaaauaaauauacaauaaaaguaaacac

SEQ ID NO: 218331 - RNA, 64 nt, hsa
uaguucuaguguggucguuauaaaccaauauugugaaaaauagcaacuauucauuuguucacaa

SEQ ID NO: 218332 - RNA, 64 nt, hsa
acacaaugauuuuccagacaaaugguaugguguugaaaaauaacuguuacuucuuaaagcagca

SEQ ID NO: 218333 - RNA, 64 nt, hsa
uuaaaaaugcagaacugcuuuauccaagaaugcugaaaaauacuguucuauccagguuuccuaa

SEQ ID NO: 218334 - RNA, 64 nt, hsa
uucaguguauguuuaauaauauacauuuaaugaugaaaaauauuuucagcaaagcuuuaaaacc

SEQ ID NO: 218335 - RNA, 64 nt, hsa
gguacaggcaacaggagaaaggaaucaaaccacagaaaaauacaaagggaaacuucugcuucac

SEQ ID NO: 218336 - RNA, 64 nt, hsa
gauacuaguugucugaauugaguuacuuugauaggaaaaauacuucauuaccuaaaaucauuuu

SEQ ID NO: 218337 - RNA, 64 nt, hsa
gcauccuuguacuuauaaucccaaugacuaugaagaaaaauaauuuagccaaauaguuccuaga

SEQ ID NO: 218338 - RNA, 64 nt, hsa
gaaaaauaauuuagccaaauaguuccuagaacaggaaaaauaaggaauuauauuuugagauaag

SEQ ID NO: 218339 - RNA, 64 nt, hsa
gauuuucaagcuuucaaauccucccuacuuccaagaaaaauaauuaaaaaaaaaacuucauucu

SEQ ID NO: 218340 - RNA, 64 nt, hsa
gccuuggcucguucucuucucucuucaaucucuggaaaaauaaguacauauaguugauaacccc

SEQ ID NO: 218341 - RNA, 64 nt, hsa
uuuuaaaggugauguaaauagugauuuccuuaaugaaaaauacauauuuuguauuguucuaaug

SEQ ID NO: 218342 - RNA, 64 nt, hsa
uucacagcuuauuauccaauucaaaaauaaauuagaaaaauauaugcuuacauuuuucacuuuu

SEQ ID NO: 218343 - RNA, 64 nt, hsa
gguaccugagucaaaauugucauuuuuguucugugaaaaauaaauuuccuucuuguaccauuuc

SEQ ID NO: 218344 - RNA, 64 nt, hsa
acuuugagguuucaucaauauaaauaaaagagcagaaaaauaugucuugguuuucauuugcuua

SEQ ID NO: 218345 - RNA, 64 nt, hsa
accauaaaaaacaauuaccuggugagaaguugcauaaacagaauuagguaguauauugaagaca

SEQ ID NO: 218346 - RNA, 64 nt, hsa
agaaaacuugccucuauuuauaaugaagauaacuuaaacagaaauauccauuuuguaguuauag

SEQ ID NO: 218347 - RNA, 64 nt, hsa
gugguaguaaugauguauauuuuucaaauuuaccuaaacagaaagauuauuggcuaaggcaggc

SEQ ID NO: 218348 - RNA, 64 nt, hsa
uaauauaaugccuuucaaauuaguuaccaaaucauaaacagaguggaauaaauauaaaugagau

SEQ ID NO: 218349 - RNA, 64 nt, hsa
gaauuuuucagaacucauccaguccuuguaaucuuaaacagaugcaaauccuaccccugcccuu

SEQ ID NO: 218350 - RNA, 64 nt, hsa
ugccucucacuuugaaagaaagacuccguaaucuuaaacagaugcaaauccaauuaggcggcca

SEQ ID NO: 218351 - RNA, 64 nt, hsa
gcauugcuuuaaccuuugguuacuuuuauucuguuaaacagaauugaagaaagaguauuauacc

SEQ ID NO: 218352 - RNA, 64 nt, hsa
auagaaaccccauuucuacugaacauccuaguuuuaaacagaagaaaaacuguaauccuggggu

SEQ ID NO: 218353 - RNA, 64 nt, hsa
uuucuaaaauguauuacgcacuucccugccuuaguaaacagaguauacuggagaguauuuaacc

SEQ ID NO: 218354 - RNA, 64 nt, hsa
cuugugaacuccuuggauaugauauuauuuggaauaaacagaauuuaucauugaacccaaagua

SEQ ID NO: 218355 - RNA, 64 nt, hsa
ucacacucuccauguuaguaauggcagagcagucuaaacagaguccgggagaaugcuggcaaag

SEQ ID NO: 218356 - RNA, 64 nt, hsa
ggcaguucugauaagcuuccuagaaaguucuguguaaacagaagccuguuucagaaaucuggag

SEQ ID NO: 218357 - RNA, 64 nt, hsa
gcugagguaacaguaaucugcccauuuaguucaguaaacagacuguagagugucugacuauacu

SEQ ID NO: 218358 - RNA, 64 nt, hsa
agauuguuuuagugggcccugauggucauuuuucuaaacagaggcccugcuuuguaauaugugg

SEQ ID NO: 218359 - RNA, 64 nt, hsa
gggguaggaauggaagaugguaucuuuuauaugcuaaacagauuagaaaauuaacauaggauac

SEQ ID NO: 218360 - RNA, 64 nt, hsa
ucuugaagaagcuuguuugccuuuagaagaaucguaaacagagucuaaacuaaaggcuuuuugg

SEQ ID NO: 218361 - RNA, 64 nt, hsa
gauguauuuaucacuuggacaucuguuuauaauauaaacagacaugugacugggaacaucuugc

SEQ ID NO: 218362 - RNA, 64 nt, hsa
aaacuacaguccuuauaaaccauuggcaugguaauaaacagaucuuaaguauaaaaauuuugua

SEQ ID NO: 218363 - RNA, 64 nt, hsa; identical to SEQ ID NO: 108409

SEQ ID NO: 218364 - RNA, 64 nt, hsa; identical to SEQ ID NO: 108410

SEQ ID NO: 218365 - RNA, 64 nt, hsa; identical to SEQ ID NO: 108411

SEQ ID NO: 218366 - RNA, 64 nt, hsa; identical to SEQ ID NO: 108412

SEQ ID NO: 218367 - RNA, 55 nt, hsa; identical to SEQ ID NO: 113265

SEQ ID NO: 218368 - RNA, 64 nt, hsa; identical to SEQ ID NO: 113266

SEQ ID NO: 218369 - RNA, 64 nt, hsa; identical to SEQ ID NO: 113267

SEQ ID NO: 218370 - RNA, 64 nt, hsa; identical to SEQ ID NO: 113268

SEQ ID NO: 218371 - RNA, 64 nt, hsa; identical to SEQ ID NO: 113269

SEQ ID NO: 218372 - RNA, 64 nt, hsa; identical to SEQ ID NO: 113270

SEQ ID NO: 218373 - RNA, 64 nt, hsa; identical to SEQ ID NO: 113271

SEQ ID NO: 218374 - RNA, 64 nt, hsa; identical to SEQ ID NO: 113272

SEQ ID NO: 218375 - RNA, 64 nt, hsa; identical to SEQ ID NO: 113273

SEQ ID NO: 218376 - RNA, 64 nt, hsa; identical to SEQ ID NO: 113274

SEQ ID NO: 218377 - RNA, 64 nt, hsa; identical to SEQ ID NO: 113275

SEQ ID NO: 218378 - RNA, 64 nt, hsa; identical to SEQ ID NO: 113276

SEQ ID NO: 218379 - RNA, 64 nt, hsa; identical to SEQ ID NO: 113277

SEQ ID NO: 218380 - RNA, 64 nt, hsa; identical to SEQ ID NO: 113278

SEQ ID NO: 218381 - RNA, 64 nt, hsa
acccuccgcacucaccugccgggacccucccuauuccauccaagggaagcagaacugccaaaga

SEQ ID NO: 218382 - RNA, 64 nt, hsa
cuggaagacaagguguuucugccaaacggggaccuccauccagagaaaaggaagaaggugcagg

SEQ ID NO: 218383 - RNA, 64 nt, hsa
ucagcugggucacauccaucccuccauucauccuuccauccaucuuuccauccauuaccuccau

SEQ ID NO: 218384 - RNA, 64 nt, hsa
cauccaucccuccauucauccuuccauccaucuuuccauccauuaccuccauccauccuuccaa

SEQ ID NO: 218385 - RNA, 64 nt, hsa
auucauccuuccauccaucuuuccauccauuaccuccauccauccuuccaacauauauuuauug

SEQ ID NO: 218386 - RNA, 64 nt, hsa
caccagccaccucauccccaacccccuguaagguuccauccaccccugcgucgagcugggaagg

SEQ ID NO: 218387 - RNA, 64 nt, hsa
ccuccucccugcccucgggucuccccaccugcacuccauccagcuacaggagagauagaagccu

SEQ ID NO: 218388 - RNA, 64 nt, hsa
ugucaccuccauccagauucuuuuaaauuauugauccauccauaguauauauugcuacucauuc

SEQ ID NO: 218389 - RNA, 64 nt, hsa
guuuggggguuuuauaaaagcaacuacugucaccuccauccagauucuuuuaaauuauugaucc

SEQ ID NO: 218390 - RNA, 64 nt, hsa
cauuugggucuuaacuuauuggaacuguagagcauccauccauccauccauccagcaaugugac

SEQ ID NO: 218391 - RNA, 64 nt, hsa
ugggucuuaacuuauuggaacuguagagcauccauccauccauccauccagcaaugugacuuuu

SEQ ID NO: 218392 - RNA, 64 nt, hsa
ucuuaacuuauuggaacuguagagcauccauccauccauccauccagcaaugugacuuuuucau

SEQ ID NO: 218393 - RNA, 64 nt, hsa
aacuuauuggaacuguagagcauccauccauccauccauccagcaaugugacuuuuucaugucu

SEQ ID NO: 218394 - RNA, 64 nt, hsa
auggaacuguuuucugguccacaugaacacaggcuccauccaggcccagcuccuacccaccgcc

SEQ ID NO: 218395 - RNA, 64 nt, hsa
gguaaccuugucugcucugccauuccacugcuccuccauccacucgccaaucccaagagucugg

SEQ ID NO: 218396 - RNA, 64 nt, hsa
uaggauugaaacagucuauaaacuguauuuuugguccauccaggaagcuagucccuuguuucuc

SEQ ID NO: 218397 - RNA, 64 nt, hsa
cacucaugaaaauaugguauucuguaacuugaauuccauccauuuuccagaccucuacucaugu

SEQ ID NO: 218398 - RNA, 64 nt, hsa
cuucccaggucuaugcccaagagaauugaaaacauccauccacacaauaccugugcucccgcgu

SEQ ID NO: 218399 - RNA, 64 nt, hsa
acucaaaagucaaacgguagcaacaacccaaauguccauccacagaugaauuaagacaugaagu

SEQ ID NO: 218400 - RNA, 64 nt, hsa
aaggaagcuggggcagugaaaaacacuucguugauccauccagcccuaaaguucauugacuaau

SEQ ID NO: 218401 - RNA, 64 nt, hsa
uugcuaggacaccaaaagaccuagcugggcuaacuccauccaaaugauuuuacaguuuuauuuu

SEQ ID NO: 218402 - RNA, 64 nt, hsa
uuugugucugggucuugucaacaucuaauuuuuuuccauccauucuguuacacuuuguauuuuc

SEQ ID NO: 218403 - RNA, 64 nt, hsa
agcaaaaaauaggguacauaaagcaggguggcuguccauccacugauucuggggugagaagcga

SEQ ID NO: 218404 - RNA, 64 nt, hsa
ccggcucccuccagacaaugccagcauaaauccauccauccaaaggcagagaaccaaaggggcc

SEQ ID NO: 218405 - RNA, 64 nt, hsa
acacccggcucccuccagacaaugccagcauaaauccauccauccaaaggcagagaaccaaagg

SEQ ID NO: 218406 - RNA, 64 nt, hsa
ggcugguuacagcuucagucccuuugucugucuguccauccauuccuccauccacccaucuguc

SEQ ID NO: 218407 - RNA, 64 nt, hsa
cuucagucccuuugucugucuguccauccauuccuccauccacccaucuguccauccgcccauc

SEQ ID NO: 218408 - RNA, 64 nt, hsa
cauccacccaucuguccauccgcccaucugcccguccauccauccauccacucuuccacccucu

SEQ ID NO: 218409 - RNA, 64 nt, hsa
cacccaucuguccauccgcccaucugcccguccauccauccauccacucuuccacccucuaccc

SEQ ID NO: 218410 - RNA, 64 nt, hsa
caucuguccauccgcccaucugcccguccauccauccauccacucuuccacccucuaccccuua

SEQ ID NO: 218411 - RNA, 64 nt, hsa
auacucacugggcaccagccuugcccucuuagccuccauccauccagacagcccuucccaccuc

SEQ ID NO: 218412 - RNA, 64 nt, hsa
ucacugggcaccagccuugcccucuuagccuccauccauccagacagcccuucccaccuccugg

SEQ ID NO: 218413 - RNA, 64 nt, hsa
agcacuuuuagaaaucuucucugaccuagaagaauccauccaaaucccugccuuccucucugaa

SEQ ID NO: 218414 - RNA, 64 nt, hsa
aguucccuucucugacaggggccauccucuaucuuccauccagcggcucuucuuuuuaggaagg

SEQ ID NO: 218415 - RNA, 64 nt, hsa
ccugcuccauccaucccuccugggcgccagacccuccauccaagcccugugucuuuccauaguc

SEQ ID NO: 218416 - RNA, 64 nt, hsa
gagucugacuggagucucgcauccuggggccugcuccauccaucccuccugggcgccagacccu

SEQ ID NO: 218417 - RNA, 64 nt, hsa
caccaaggagcaaugcugggauugcaacuguagggaacaccauuuaugcagugggaggauucga

SEQ ID NO: 218418 - RNA, 64 nt, hsa
cauacagaucacugguccuuucuugcucccaugagaacaccaagagcccgauuucaaauggcug

SEQ ID NO: 218419 - RNA, 64 nt, hsa
uguuagauguauccuagcuuuuagcuauaaaccacucaaagauucagcccccagaucccacagu

SEQ ID NO: 218420 - RNA, 64 nt, hsa
auuuucugcuccugaaggcagggugaguucucuccucaaagaagacuucaaaccauuuaacugg

SEQ ID NO: 218421 - RNA, 64 nt, hsa
auggaaauggauugaaagagugaaagucacuggucucaaagaaucuacggaauuuagcauuuug

SEQ ID NO: 218422 - RNA, 64 nt, hsa
cacacauuugacuuggaagcaauguuugaacaaacucaaagaacagcuguggaaagaagucaca

SEQ ID NO: 218423 - RNA, 64 nt, hsa
cauuuguaccuuauugaucuuugcccauggaagucucaaagaucuuucguugguuguuucucug

SEQ ID NO: 218424 - RNA, 64 nt, hsa
gucuagaauccugcuuuacaggaucauguaaaugcucaaagauguaauguaguucuuuguuccu

SEQ ID NO: 218425 - RNA, 64 nt, hsa
aauaacuucacauaaacuuccuguucuccaaaaccucaaagagauagaguuaaugaguuguugu

SEQ ID NO: 218426 - RNA, 64 nt, hsa
agcuucuaaagacauugucaccgagugugugugacucaaagaucaagagugaggcuaaacugcg

SEQ ID NO: 218427 - RNA, 64 nt, hsa
cauuaccaccaaccccacagaaauacgaaaaacccucaaagauuacuauaaacaccuguaugca

SEQ ID NO: 218428 - RNA, 64 nt, hsa
aauucagccauuguggaaagcacugcagcgauuucucaaagacauaaaagaacauagcauucaa

SEQ ID NO: 218429 - RNA, 64 nt, hsa
uauaagugggagcuaaacauugauuacacauggacucaaagaagggaacaguagacacgggcuu

SEQ ID NO: 218430 - RNA, 64 nt, hsa
aaauguggaaaagcauuuagauacuacuacucagcucaaagacaugaaaggacucauacuggag

SEQ ID NO: 218431 - RNA, 64 nt, hsa
aaaugugggaaaguguucguauaucacaacucugcucaaagacaugaaaagacucauacuggag

SEQ ID NO: 218432 - RNA, 64 nt, hsa
ugcucacauuucucuaauguacugcacuugaugccaguaggaaagaagcuuaagugucuucagu

SEQ ID NO: 218433 - RNA, 64 nt, hsa
gguaaauguguuuccacuauacuugggaaaaggucaguaggaugugcauccuagggaagauaaa

SEQ ID NO: 218434 - RNA, 64 nt, hsa
auauguaugaaugccagaaauuugucaguucaugcaguaggauaaaaaaaaaaaaaaaaaaaaa

SEQ ID NO: 218435 - RNA, 64 nt, hsa
ccugaggccucggcuugcucuuggaaguguugugcaguaggaccugcuccccugaaggacgggg

SEQ ID NO: 218436 - RNA, 64 nt, hsa
uugauuucuccagguuugcugugucucacagaggcaguaggaacccagcucucagggcugucuu

SEQ ID NO: 218437 - RNA, 64 nt, hsa
gcaucagaguugauaaauuagauugaaaccauuccaguaggaaaucaggcaguucccuguugaa

SEQ ID NO: 218438 - RNA, 64 nt, hsa
uguuguacauagaguucagcuuguuuuuuggcuccaguaggaaaaaaaauccauccaucugaga

SEQ ID NO: 218439 - RNA, 64 nt, hsa
uaaagccugacauucuugcacaggguggggcgcgcaguaggaaccucccccgcaggagcuggcg

SEQ ID NO: 218440 - RNA, 64 nt, hsa
gcauuacuugcuuccuugcaugauugucuuuaugcauccccaaucuuaauugagaccauacuug

SEQ ID NO: 218441 - RNA, 64 nt, hsa
uguggaauugcacaucuaccuuacaauuacugaccauccccaguagacuccccagucccauaau

SEQ ID NO: 218442 - RNA, 57 nt, hsa; identical to SEQ ID NO: 54899

SEQ ID NO: 218443 - RNA, 64 nt, hsa
agugucuauaguguuggacagcacauucuuagagcauccccaaucaauaguuucagaaguuaua

SEQ ID NO: 218444 - RNA, 64 nt, hsa
gucgcccagcagugcugcucugaugacuugugcacauccccaaggguaagagcuucgaucucug

SEQ ID NO: 218445 - RNA, 64 nt, hsa
gagugacugagagcacuuaacauucagcuugucucauccccagucuaccuccuuccuucuaccc

SEQ ID NO: 218446 - RNA, 64 nt, hsa
cccuaacagguugggcuggcccagccuaggaaaacauccccauuucuaacuucagccagaccug

SEQ ID NO: 218447 - RNA, 64 nt, hsa
ucuaggccuugguaacuaugcgcccccccuccaucauccccaaggcugcccaaaccaccacugc

SEQ ID NO: 218448 - RNA, 64 nt, hsa
gugguggggaggggaggcagguguggguagcgcacauccccacagaucaaucucugcagaugac

SEQ ID NO: 218449 - RNA, 64 nt, hsa
cuuaggaugagagucagagccuuuggaaaggcugcauccccagggcuagagcucagaugaccuu

SEQ ID NO: 218450 - RNA, 64 nt, hsa
ccccacucgaugacugccucaucuuccucaguuucauccccauccccaggucuuccuagacgcu

SEQ ID NO: 218451 - RNA, 64 nt, hsa
ucgaugacugccucaucuuccucaguuucauccccauccccaggucuuccuagacgcucagcac

SEQ ID NO: 218452 - RNA, 64 nt, hsa
cccugcccuggccuggguggaggaacugugccuccauccccagaagaaacagcccccucugcug

SEQ ID NO: 218453 - RNA, 64 nt, hsa
cagagccccucccgccgccucagaccccugugcacauccccagggccucagccgucucauuggu

SEQ ID NO: 218454 - RNA, 64 nt, hsa
aaggucuguggcuccucccgaaacccaaguuaugcauccccauccccaugcccucaucccgacc

SEQ ID NO: 218455 - RNA, 64 nt, hsa
uguggcuccucccgaaacccaaguuaugcauccccauccccaugcccucaucccgaccucuuag

SEQ ID NO: 218456 - RNA, 64 nt, hsa
ccugggagagggugagguucagcacaucacacaccauccccacugucauucagggccugggucu

SEQ ID NO: 218457 - RNA, 64 nt, hsa
cuccauggagccacuaggccuggccuccucuacacauccccagggcuaucugguuaauuccauc

SEQ ID NO: 218458 - RNA, 64 nt, hsa
uuaucccaguaacuccucuucccauuuuccaauccauccccagccuuuuuuuuuuuucuucugu

SEQ ID NO: 218459 - RNA, 64 nt, hsa
gaacacuuuggggcugauuugucucuuuaggggacauccccaacaugguuaauuccaacucuca

SEQ ID NO: 218460 - RNA, 64 nt, hsa
gcagauuucaggcugaucccugcuuaagcccucucauccccacgcugguccugguauugauaca

SEQ ID NO: 218461 - RNA, 64 nt, hsa
gaggcguuuggccccggccuggccaggagaggcccauccccagggcaguuucaggugccggcug

SEQ ID NO: 218462 - RNA, 64 nt, hsa
gaugcaacugguuuuacuagugugcaaguguguucauccccaaguucucuuuuguccucacaug

SEQ ID NO: 218463 - RNA, 64 nt, hsa
cuaugagcccagcauggaugugucucaggcaccucauccccaccccaccucaccccaacaaacu

SEQ ID NO: 218464 - RNA, 64 nt, hsa
gaggcagagaggcuccauggccgugcugcugggccauccccaacucccuaucccauccccagcc

SEQ ID NO: 218465 - RNA, 64 nt, hsa
gccgugcugcugggccauccccaacucccuaucccauccccagccuccacccccauccagaugg

SEQ ID NO: 218466 - RNA, 64 nt, hsa
ccacgccgugugucacgggcuagggcggcguguucauccccacaccgugugucacaacaggcua

SEQ ID NO: 218467 - RNA, 64 nt, hsa
aaaacagggucaccagugcauuauguggcguguucauccccacgccgugugucacgggcuaggg

SEQ ID NO: 218468 - RNA, 64 nt, hsa
ccgccgggcucugcguccccacguccccucgucccauccccacguccccucaucccgucaccuc

SEQ ID NO: 218469 - RNA, 64 nt, hsa
ccugucaccucguccccacguccccucgucuccucauccccacguccucucguccccuuguccc

SEQ ID NO: 218470 - RNA, 64 nt, hsa
gugccagguacgacgcuugccccggcccacccuccauccccacccuccauccccacccuagaug

SEQ ID NO: 218471 - RNA, 64 nt, hsa
cgcuugccccggcccacccuccauccccacccuccauccccacccuagauggagcgagggccuu

SEQ ID NO: 218472 - RNA, 64 nt, hsa
cuuuacccagcucuuggggugucucuguuuuuuccauccccacuuccugccuucucguggcccu

SEQ ID NO: 218473 - RNA, 64 nt, hsa
aucucagccaccuuccucaggcucacuccaccuacauccccagucugccacaccccaucccuuu

SEQ ID NO: 218474 - RNA, 64 nt, hsa
ugcagcuucaacucucucggcgguagggcggugccauccccacccauagggcuggcucacaucc

SEQ ID NO: 218475 - RNA, 64 nt, hsa
accuucucuggucuucaguccagcacugggugcccauccccaucucuaaaaccaguaaaucagc

SEQ ID NO: 218476 - RNA, 64 nt, hsa
gauuagugccaggcagcccugccagccaugccuacauccccaugggcacagaacaagccaaagc

SEQ ID NO: 218477 - RNA, 64 nt, hsa
uugguggcugcacacucuuccuggcccgcacccccauccccagucccuguuccccaagaggaua

SEQ ID NO: 218478 - RNA, 64 nt, hsa
ccugcuaucugcaaugaccaccauagcuuaaccccauccccacccucaaccccaagcucaaccc

SEQ ID NO: 218479 - RNA, 64 nt, hsa
uauccuccaccccacaucccaccacauccaccuccauccccaacccauccucauccccaacuac

SEQ ID NO: 218480 - RNA, 64 nt, hsa
cccaccacauccaccuccauccccaacccauccucauccccaacuacagccccaaacccagccc

SEQ ID NO: 218481 - RNA, 64 nt, hsa
cagccccaaacccagccccagacuaauccacagccauccccaacucauccucauccccaacugc

SEQ ID NO: 218482 - RNA, 64 nt, hsa
ccagacuaauccacagccauccccaacucauccucauccccaacugcagccccaaacccaaccc

SEQ ID NO: 218483 - RNA, 64 nt, hsa
auccccaacugcagccccaaacccaacccagggccauccccaaacccauccccaagccaaacuc

SEQ ID NO: 218484 - RNA, 64 nt, hsa
agccccaaacccaacccagggccauccccaaacccauccccaagccaaacucaacaccaucccc

SEQ ID NO: 218485 - RNA, 64 nt, hsa
ucccuaaucaccucuccugccccuagcucagccucauccccaacuccaugccugucuccaaucc

SEQ ID NO: 218486 - RNA, 64 nt, hsa
cauccucaacuaagcuccucuccagcccuggccacauccccauccucccccaaccuccagcccc

SEQ ID NO: 218487 - RNA, 64 nt, hsa
uccaccgucccgaagccaacuucacccauguccccauccccaaucuuguccccauuccugacuc

SEQ ID NO: 218488 - RNA, 64 nt, hsa
uuccccuugcauccugggagccccacugcccugccauccccaguacugccgggaagugucggcc

SEQ ID NO: 218489 - RNA, 64 nt, hsa
cugagccacgcccagugugugaacuugacaucuccauccccaggcucucaaccgucucccucgg

SEQ ID NO: 218490 - RNA, 64 nt, hsa
uugggaccaggugggcuguguccgccacaucacccauccccauccccugacucuuucaccggca

SEQ ID NO: 218491 - RNA, 64 nt, hsa
gcagcugggccccucuuccagcagcggccguauccauccccaggggcugugcuccgggccaaug

SEQ ID NO: 218492 - RNA, 64 nt, hsa
aaaccaucgggagcuaagaaacaacauaauguugacaaaucaggaaccuaacagauuauuuugu

SEQ ID NO: 218493 - RNA, 64 nt, hsa
caccuuuagacaaaggugacuuuugucugauuuuacaaaucagauuuuauucaagcuuucuaaa

SEQ ID NO: 218494 - RNA, 64 nt, hsa
acuccaauaaauuuaaugacuaaaugccaaguuaacaaaucaacuuccauuuggauuguaggug

SEQ ID NO: 218495 - RNA, 64 nt, hsa
agcuaucuaacaacuaauuacuaauuuuuaaagaacaaaucacacauuuaaaaaaucuguagaa

SEQ ID NO: 218496 - RNA, 64 nt, hsa
agccuacaacauagaugcauuuagcaaaccauguacaaaucaaucacuauaauaaacugcauca

SEQ ID NO: 218497 - RNA, 64 nt, hsa
gucacuguaacagcacuuugcugagaggguuuuaacaaaucauauuagccaaaaagccuacaac

SEQ ID NO: 218498 - RNA, 64 nt, hsa
ucaggguuaccaaagaaggcguacauagauuguuacaaaucaaagcaaagaaaaaucccaaagu

SEQ ID NO: 218499 - RNA, 64 nt, hsa
ucugacuucuuauuaccuccgauuggaacgcgccacaaaucauccugcuuucuuuauccucucu

SEQ ID NO: 218500 - RNA, 64 nt, hsa
uuuaguguugggcugcaagguugguucaguauacacaaaucaauaaaugugauuuaucacauac

SEQ ID NO: 218501 - RNA, 64 nt, hsa
caaagaucuaauccagaaucuauaaagaacucaaacaaaucaacaaugagaaaaacaaccccau

SEQ ID NO: 218502 - RNA, 64 nt, hsa
ugggugagguauaucccacuucugugaaaacauuacaaaucaaaccgcuucucucaguuuauuu

SEQ ID NO: 218503 - RNA, 64 nt, hsa
ucccuauauccugaagaagaacaugauccucaugacaaaucauuucuaugcagcgaucuuggga

SEQ ID NO: 218504 - RNA, 64 nt, hsa
ccucuucccuuucuguguguuuuuauuuuagcagauaguucaaagcaauaaaagauuucuuuuu

SEQ ID NO: 218505 - RNA, 64 nt, hsa
auuucucucugcguccuauuucauuagugaagacauaguucaccuaaaauggcauccugcucug

SEQ ID NO: 218506 - RNA, 64 nt, hsa
aaaauacggaucauuuguauuuuggggugauaaaauaguucaccauggguaugagauauuuauu

SEQ ID NO: 218507 - RNA, 64 nt, hsa
uggugaauuuccugacagacaaugcuaucuaaccauaguucauguuaggggaagcauuuuucca

SEQ ID NO: 218508 - RNA, 64 nt, hsa
cagcaugcuggguugucauggguuugcugcauacauaguucacccuaauuuauacuuacucauc

SEQ ID NO: 218509 - RNA, 64 nt, hsa
cuucucaugaacuauuucucguacaaaucauuaaauaguucauuggaugaggcugggugacauu

SEQ ID NO: 218510 - RNA, 64 nt, hsa
uccucugggaggaaugucuucugucuuugguauuauaguucaucuucccauucuuuuacuuagu

SEQ ID NO: 218511 - RNA, 64 nt, hsa
gaacuuuguucuguuuucugccacaaaaaugugaauaguucagagugaaaaccuuuugugaugg

SEQ ID NO: 218512 - RNA, 64 nt, hsa
caaaaaauuagcugggcaugguggcauauaccuguaaccccaacuacuuggguggcugaggcag

SEQ ID NO: 218513 - RNA, 64 nt, hsa
ucagaaguaguaaacuaucuuugaggaaauacuguaaccccagaauauuuccucuugacuucuu

SEQ ID NO: 218514 - RNA, 64 nt, hsa
caggucuaaauguaaugguugguuuauuguucuauaaccccagcccaucauuuucuguguaaau

SEQ ID NO: 218515 - RNA, 64 nt, hsa
ugaaaacuugcacagggucaucuuuguaauuauauaaccccaaacuaagaugcacaaugucucc

SEQ ID NO: 218516 - RNA, 64 nt, hsa
gggauuugggaugagauauggucagacuuguagauaaccccaaagaugugaagaucgcuuguga

SEQ ID NO: 218517 - RNA, 64 nt, hsa
gggaugugcugugugugcaccugcucacaggauguaaccccaccuucugcuuacccuugauuuu

SEQ ID NO: 218518 - RNA, 64 nt, hsa
gcaccaggcugcugggugugguggcucauaccuguaaccccagcacuuugggaggcugagguag

SEQ ID NO: 218519 - RNA, 64 nt, hsa
augauaugcaaaggcaccuguucuccucaugaccuaaccccaauucuuacuccacggguucaug

SEQ ID NO: 218520 - RNA, 64 nt, hsa
ggaguggcgagcccagcugcccagcccugcccccccuccccauagccagcacagcuaucccgcg

SEQ ID NO: 218521 - RNA, 64 nt, hsa
gucagaacacgaucugggggggggauccugucuuccuccccaccccaccccacucuuacccaau

SEQ ID NO: 218522 - RNA, 64 nt, hsa
caauucugaauagccaguggggcacacugacuguccuccccaggggaacugcagcgcccuccuc

SEQ ID NO: 218523 - RNA, 64 nt, hsa
cugacuguccuccccaggggaacugcagcgcccuccuccccacugcccccugcagccccugaga

SEQ ID NO: 218524 - RNA, 64 nt, hsa
ccccugcagccccugagauauuuugcucacuaucccuccccacuugcuucccugauaugugcuc

SEQ ID NO: 218525 - RNA, 64 nt, hsa
ggcaucuucccugaagcccccaaucuggccccccccuccccagacuuccuccccaaaacacccc

SEQ ID NO: 218526 - RNA, 64 nt, hsa
aagcccccaaucuggccccccccuccccagacuuccuccccaaaacaccccagcuuucuggcuu

SEQ ID NO: 218527 - RNA, 64 nt, hsa
auuagggcuuagccaucucccuguccccagcaccccuccccagcccacagugguggccucugcc

SEQ ID NO: 218528 - RNA, 64 nt, hsa
aguccugacaguguuugaaaagggccgccugcccccuccccacugugcuuuugaugccuuugga

SEQ ID NO: 218529 - RNA, 64 nt, hsa
ggcagugguuuuggcaaacgcuaaagagcccuugccuccccauuucccaucugcaccccuucuc

SEQ ID NO: 218530 - RNA, 64 nt, hsa
uugccuccccauuucccaucugcaccccuucucuccuccccaaaucaauacacuaguuguuucu

SEQ ID NO: 218531 - RNA, 64 nt, hsa
gccaucguccugggacucggagacuauggccucgccuccccacccuccucuuggaauuacaagc

SEQ ID NO: 218532 - RNA, 64 nt, hsa
uguacauagagaucuauuuuuucuaaaacauuccccuccccacuccucucccacagagugcugg

SEQ ID NO: 218533 - RNA, 64 nt, hsa
aaaaaaauccuucaagggagcugcuuggaaguggccuccccaggugccuuuggagagaacuguu

SEQ ID NO: 218534 - RNA, 64 nt, hsa
aaucuucaccccacuuccucuacccccagguucuccuccccacagccaguccccuuuccuggau

SEQ ID NO: 218535 - RNA, 64 nt, hsa
gccacggcuguuucuucuuugugcuucccgugugccuccccaguagcccucaccugcauaccaa

SEQ ID NO: 218536 - RNA, 64 nt, hsa
ccaggcugaccucagcucccgaaggcucgcacagccuccccauccuuccuucccagcccuugug

SEQ ID NO: 218537 - RNA, 64 nt, hsa
cugcccugcccaccucaggcccccacccuccacuccuccccacgguacugugaacgucguguga

SEQ ID NO: 218538 - RNA, 64 nt, hsa
ccccgcuuuggagaggcugagcuggagccauuggccuccccaggggcuuuccacccacacugca

SEQ ID NO: 218539 - RNA, 61 nt, hsa
cgcugggcuccgcguccuaggaccgccggcgccuccccacggacgccaggcaggccaggcc

SEQ ID NO: 218540 - RNA, 64 nt, hsa
ggaauuuuccaaaacagccuguucucuccucucuccuccccagagcacccccugccaucagggg

SEQ ID NO: 218541 - RNA, 64 nt, hsa
agcucugagcacgggcucuucccgccggguccucccuccccagaccccagagggagaggcccac

SEQ ID NO: 218542 - RNA, 64 nt, hsa
acaccagcccgugggcugcccccugccuccccacccuccccauggcccacccaucugggcuguc

SEQ ID NO: 218543 - RNA, 64 nt, hsa
ugaagaccaacaccagcccgugggcugcccccugccuccccacccuccccauggcccacccauc

SEQ ID NO: 218544 - RNA, 64 nt, hsa
cgccucccgggaagcauccuccccaccagagcugccuccccaauccauuuggcagaacugcugg

SEQ ID NO: 218545 - RNA, 64 nt, hsa
cacagcuccuccccugccgccucccgggaagcauccuccccaccagagcugccuccccaaucca

SEQ ID NO: 218546 - RNA, 64 nt, hsa
agauucucccaccuccucccuuugauggaaccacccuccccagaggcugcauugaggagacucc

SEQ ID NO: 218547 - RNA, 64 nt, hsa
cgucuuacagucgccauccuccaggcguguggucccuccccauugggugcacagugcagagggg

SEQ ID NO: 218548 - RNA, 64 nt, hsa
uccacuauuccaccucucuaaaagaagguaauuuccuccccaaauugaccuuggggaauuauuc

SEQ ID NO: 218549 - RNA, 64 nt, hsa
uuagcauuuguucuucaucuccugucucuucaagccuccccacuccaccgugccgaaggagcuc

SEQ ID NO: 218550 - RNA, 64 nt, hsa
ccacauccacucaaugugaacucuacuaccacgaccuccccauauuccucacuucuccaucacc

SEQ ID NO: 218551 - RNA, 64 nt, hsa
uaaaaacauaaaacacuggagguuaguggaggccccuccccaagcagggagccugggaugggca

SEQ ID NO: 218552 - RNA, 64 nt, hsa
gagugcaggaguggacucuccacugaugggucucccuccccauccugguuuccaccccgggcug

SEQ ID NO: 218553 - RNA, 64 nt, hsa
uuagucagaaugugagcagauggcuaaguucucuccuccccagaauggauuaacagcugcgugg

SEQ ID NO: 218554 - RNA, 63 nt, hsa
ccacucugcuggcucuguaacccagugcaccucccuccccagcuccggaggggguccuccucg

SEQ ID NO: 218555 - RNA, 64 nt, hsa
ggccuggaccuuccccagaugcugccaggcagccccuccccaagccucaaagaagcauuugcug

SEQ ID NO: 218556 - RNA, 64 nt, hsa
gggauacugcagggccaggacugagccccgcagaccuccccagccccuagcccaggagagagaa

SEQ ID NO: 218557 - RNA, 64 nt, hsa
gagagcggucucaggcuggugggaggggcgcccaccuccccacgcccuccccuccccugcugca

SEQ ID NO: 218558 - RNA, 64 nt, hsa
ccaggccugccggcccggacccgucccagccuccccuccccaccccaugcagcccccaggggga

SEQ ID NO: 218559 - RNA, 64 nt, hsa
cagggggauagcccaugggccccuguggacccucccuccccaaguggacacauggcugugcagg

SEQ ID NO: 218560 - RNA, 64 nt, hsa
cugggugcaggacacuggucgagagccaaaggucccuccccagacaucuggacacugggcauag

SEQ ID NO: 218561 - RNA, 64 nt, hsa
gggcauagauuucucaagaaggaagacuccccugccuccccagggccucugcucuccugggaga

SEQ ID NO: 218562 - RNA, 64 nt, hsa
gcaggaggcccucagcacccgaacacaucuuccuccuccccacccgagccuggagcacucuaac

SEQ ID NO: 218563 - RNA, 64 nt, hsa
ggcaucuuuccuggagccccgagccagcccugucccuccccagugcagcauggcacucaggaga

SEQ ID NO: 218564 - RNA, 64 nt, hsa
cccaagccccacuuccucccugaccuccccaugcccuccccagccucucccagcacaagugggg

SEQ ID NO: 218565 - RNA, 64 nt, hsa
ucuuuaucaaccccaagccccacuuccucccugaccuccccaugcccuccccagccucucccag

SEQ ID NO: 218566 - RNA, 64 nt, hsa
uccuccacaggucccuccacucauauggccucucccuccccagcuaguggaggggaagcagucu

SEQ ID NO: 218567 - RNA, 64 nt, hsa
aaaaauaucuauuuaagccucucucucuuucucuccuccccaacuuuuuucugaaagccuugau

SEQ ID NO: 218568 - RNA, 64 nt, hsa
cacugucuauccauccgguggacugggcagcauuccuccccagggcucuucccuugggggccuc

SEQ ID NO: 218569 - RNA, 64 nt, hsa
gaaacuggauagauacacucauaaaacccccaccccuccccaccccaccccugcucccauugug

SEQ ID NO: 218570 - RNA, 64 nt, hsa
cacagugacgguggccuggccagcccucgggaccccuccccaccuaacugcacugaaaccauuu

SEQ ID NO: 218571 - RNA, 64 nt, hsa
uuguuuuucagacaguauggguuaaguucucugcccuccccaggggucugaggaggcucugggu

SEQ ID NO: 218572 - RNA, 64 nt, hsa
aggcccaagcugggacuucuccaggccuguguucccuccccaggaagugcgccccaaaccucuu

SEQ ID NO: 218573 - RNA, 64 nt, hsa
uauugaagauggauuaggagagggggugaugaccccuccccaagccccucagggcccagaccuu

SEQ ID NO: 218574 - RNA, 64 nt, hsa
caucucccggguucaagcgauuuuccugccucagccuccccaguagcugggacuacagacgugu

SEQ ID NO: 218575 - RNA, 64 nt, hsa
ucgaacuccugaccucaucguccaccugccucggccuccccaaagugcugagauuaggcguuag

SEQ ID NO: 218576 - RNA, 64 nt, hsa
ugcggagcugagccccgcccugccaugagguuuuccuccccaggcaggcaggaggccgcgggga

SEQ ID NO: 218577 - RNA, 64 nt, hsa
cguggaaaguuggcugcugccuggggaagcuucuccuccccaaggcggccauggggcagccugc

SEQ ID NO: 218578 - RNA, 64 nt, hsa
gcccugccucccucugucagggaaccugggacccccuccccacugccugcacagaggacccuga

SEQ ID NO: 218579 - RNA, 64 nt, hsa
cacggaggggcugugaccugguccccaguguugcccuccccaguggcuggcaggggccugcuug

SEQ ID NO: 218580 - RNA, 64 nt, hsa
cucuacccaucucccccaucccccacugccacacccuccccauucagacacuucauggaccaag

SEQ ID NO: 218581 - RNA, 64 nt, hsa
ucaaagaagucauggcccaaauccagugugcaccccuccccauucacagagccuuuuucacaau

SEQ ID NO: 218582 - RNA, 64 nt, hsa
acuccuucuccuucuaccacucuuaaauuuacucccuccccacccagaacccagauggggugga

SEQ ID NO: 218583 - RNA, 64 nt, hsa
ugcccuuuccccaccucaggcccuaccccuggacccuccccaaccuuccuucucucuucuuugg

SEQ ID NO: 218584 - RNA, 64 nt, hsa
uuccuggcccccuccccccccgccccucugcuucccuccccacccaccaccucaaggguaggga

SEQ ID NO: 218585 - RNA, 64 nt, hsa
cuuccuaccuguuuuauuuuguuuucucguucucccuccccaccccacucccagccuuaucuau

SEQ ID NO: 218586 - RNA, 64 nt, hsa
guugggugggccggcuucaugccagcuacuuccuccuccccacuuguccgcugggugguacccu

SEQ ID NO: 218587 - RNA, 64 nt, hsa
aaaucguccagcgaccuuccucauccaccccaucccuccccaguucauugcacuuugauuagca

SEQ ID NO: 218588 - RNA, 64 nt, hsa
cacacacacacacacacacauacauccugcuuucccuccccaaacccaucagacagguaaaugg

SEQ ID NO: 218589 - RNA, 64 nt, hsa
gucagucucucucucccuuuuaaauggugggaacccuccccaaaaccuuuccccagacacauuc

SEQ ID NO: 218590 - RNA, 64 nt, hsa
agaggacacggaggguucagaccccuccucagacccuccccacaucugaaacugccucccccca

SEQ ID NO: 218591 - RNA, 64 nt, hsa
aaccaaaacuuuuuguuggcuuuuuccuuugucgccuccccagcaccugcccucccagucuccc

SEQ ID NO: 218592 - RNA, 64 nt, hsa
ccaccccuccugagaggcagggggcccuccgcccccuccccauguauuccccaccuguguuccg

SEQ ID NO: 218593 - RNA, 64 nt, hsa
agagccgucauggguagcccacgccguccuuuccccuccccaaguguuucucuccugacccagg

SEQ ID NO: 218594 - RNA, 64 nt, hsa
cccccuccggagaccaaacucaccaucccucaguccuccccaacaggguacuaggacugcagcc

SEQ ID NO: 218595 - RNA, 64 nt, hsa
gaugcagggucugcucaccccaacacaugccuucccuccccagccacaccgugcacgaaggggg

SEQ ID NO: 218596 - RNA, 64 nt, hsa
aagaauguuuacaugccaaacagaauguaacaccccuccccaagcccuucccagucacugcaug

SEQ ID NO: 218597 - RNA, 64 nt, hsa
aaacgcuaauaauuuauuagaucuaaagccccuuccuccccagccccugcuuucauuaagguau

SEQ ID NO: 218598 - RNA, 64 nt, hsa
cagagggaguucccccagaucaguaccccccaccccuccccagcuaguagcaugaccaggagag

SEQ ID NO: 218599 - RNA, 64 nt, hsa
uggccauggugggaaaugggcaugagaauaaauaccuccccaaauucaaucugagcccagcagg

SEQ ID NO: 218600 - RNA, 64 nt, hsa
gugggagaaaagcuugugugaaauucccucuucaccuccccaccccccaaaaaauaaaaggggg

SEQ ID NO: 218601 - RNA, 64 nt, hsa
acagaccgacaggcagcccaagggccuggacaccccuccccaggcaggugcugccccaggagga

SEQ ID NO: 218602 - RNA, 64 nt, hsa
gggcuuuggacugaggucccuguggccucggucuccuccccaugaagugggagcgaggcucccc

SEQ ID NO: 218603 - RNA, 64 nt, hsa
auguccuuggggaggggucagcucuggccacaauccuccccaccagucucacccacuaggauag

SEQ ID NO: 218604 - RNA, 64 nt, hsa
guccuguuaacccuccaccuccucucuuggacucccuccccaccccaaccacucuuucuuucuc

SEQ ID NO: 218605 - RNA, 64 nt, hsa
aacaugucacuuuucuguuaagaaaacugagcccccuccccacagguuaaaaaacuuuaguaac

SEQ ID NO: 218606 - RNA, 64 nt, hsa
cgccuccuggguucacgccauucuccugccucagccuccccagcagcugggacuacaggcacac

SEQ ID NO: 218607 - RNA, 64 nt, hsa
auguccaaucucauccaaauaacauuguucccauccuccccacccaccacaucaaaacauaaca

SEQ ID NO: 218608 - RNA, 64 nt, hsa
acauaacacaucacagcacucaguagagguccugccuccccauuucucaagggaagccaguagg

SEQ ID NO: 218609 - RNA, 64 nt, hsa
cguguggccgcccggguguggcucagccauguccccuccccagguccuucauucaccccucccc

SEQ ID NO: 218610 - RNA, 64 nt, hsa
auguccccuccccagguccuucauucaccccuccccuccccacaguggaauuguugaagugugg

SEQ ID NO: 218611 - RNA, 64 nt, hsa
uuucaucucagaguccacuguggcacuggccaccccuccccaguacaggggugcugcagguggc

SEQ ID NO: 218612 - RNA, 64 nt, hsa
ucauguggcccaacucuccuggccuggccaucucccuccccagaaacagugugcauggguuauu

SEQ ID NO: 218613 - RNA, 62 nt, hsa
ucaaagucaaggucccuugaaucccaaaagugccuccccagccucagcccccaccuccagcc

SEQ ID NO: 218614 - RNA, 64 nt, hsa
aaacaccugccuugggggugaagugaaggcccagccuccccaccccaccgcgccccagggguug

SEQ ID NO: 218615 - RNA, 64 nt, hsa
accagaggaaaaggaagugcccaacaucucccagccuccccaggugccccccucaccuugaugg

SEQ ID NO: 218616 - RNA, 64 nt, hsa
ugaccugcaggaacuccccaccccagggacaccgccuccccauuuuccggggcagaguggggac

SEQ ID NO: 218617 - RNA, 64 nt, hsa
cccacacauccauaguucugccuccccagcuucuccuccccaguuguaaauaguauuuauuagc

SEQ ID NO: 218618 - RNA, 64 nt, hsa
ccacaaccugguuccccacacauccauaguucugccuccccagcuucuccuccccaguuguaaa

SEQ ID NO: 218619 - RNA, 64 nt, hsa
uauuuuaacaacauauaaaacuguuucaagcccuccuccccagagcuggcgcucagcagcccua

SEQ ID NO: 218620 - RNA, 64 nt, hsa
gcccugccccacccaacuccacagggcuguuuugccuccccacggaaggcgggcugaggagaca

SEQ ID NO: 218621 - RNA, 64 nt, hsa
cacucaaacaucuccucuuggugccuuccugggcccuccccagcuccagcucucccagaccuac

SEQ ID NO: 218622 - RNA, 64 nt, hsa
gagagcaugagcacuucccugaguccucaccagcccuccccauuuguccuccaagacuccacuc

SEQ ID NO: 218623 - RNA, 64 nt, hsa
ugccccacggagacagaggaaagggcuggcucccccuccccaggcuggagacccccccccaacu

SEQ ID NO: 218624 - RNA, 64 nt, hsa
cacguuggccggcggcuacucuggaauguuuuucccuccccagaaucaagcuuuugcuugaucc

SEQ ID NO: 218625 - RNA, 64 nt, hsa
cagaggguguggcuuuccaggcacccucagggagccuccccaucuguccagcuggggccagagg

SEQ ID NO: 218626 - RNA, 64 nt, hsa
gagaugggggugggggaugcuucugggggcccugccuccccauugugugcccagaacaucccug

SEQ ID NO: 218627 - RNA, 64 nt, hsa
cuuaaccuaaaccauaauuguaaccagugccuuuccuccccacuggagggcaagcccccccacc

SEQ ID NO: 218628 - RNA, 64 nt, hsa
auuuggaaauuguugcuguguucugugaaaauaaccuccccaaaauaauuaguaacugguuguu

SEQ ID NO: 218629 - RNA, 64 nt, hsa
aggcccccuaccagugcaugagacacacaccuacccuccccagcuuuccaggaacccuacuggc

SEQ ID NO: 218630 - RNA, 64 nt, hsa
ggcuacugggcuguggucucugacccccuggaggccuccccacgccucacagaacacagugcag

SEQ ID NO: 218631 - RNA, 64 nt, hsa
gggaggcccagcccugcaggugggacuggcucucccuccccagccacgaguaugccacaggggg

SEQ ID NO: 218632 - RNA, 64 nt, hsa
cccucucucucccucucucucccucucucuuuacccuccccagggcuccaucuccgccucaggg

SEQ ID NO: 218633 - RNA, 64 nt, hsa
accaccgcccgccucaguuccuuugcgucuguugccuccccagcccugcacgcccuggcuggca

SEQ ID NO: 218634 - RNA, 64 nt, hsa
ggccagcguccuccuccacagccugucacugcccccuccccagccuguguccacagugcuguga

SEQ ID NO: 218635 - RNA, 64 nt, hsa
ucguggcaagaacuagcgugagcccagccaggcgccuccccaccgggcucucaggacacccugc

SEQ ID NO: 218636 - RNA, 64 nt, hsa
cccgacuccccguucagaccagagugccccggccccuccccagccugagucuucuccuugcucu

SEQ ID NO: 218637 - RNA, 64 nt, hsa
uaacagcagucagguuguuuaccagcccuuugcaccuccccaggcagagggagccucuguucug

SEQ ID NO: 218638 - RNA, 64 nt, hsa
gcaccuacugugcagaacucuccacuuccccaacccuccccaggugggcagggcggagggagcc

SEQ ID NO: 218639 - RNA, 64 nt, hsa
gccuucaugcccuagggccccccaagugccugccccuccccagaguauuaacgcuccaagagua

SEQ ID NO: 218640 - RNA, 64 nt, hsa
ggccccgcccagucccgcaguacauccccuguccccuccccaaccccaagugccuucaugcccu

SEQ ID NO: 218641 - RNA, 64 nt, hsa
cuccuuaucccccaugguguuuauuauuuauuucccuccccaugccccuggggaccccaaggcc

SEQ ID NO: 218642 - RNA, 64 nt, hsa
caagaccuuuagugccacaaauaagcaucgagcaccuccccauucacacccccauuccuccugg

SEQ ID NO: 218643 - RNA, 64 nt, hsa
cuguguccaccggccaugaggagcccacgccuguccuccccaucacuuuccugucccugagaac

SEQ ID NO: 218644 - RNA, 64 nt, hsa
acccccauggcucgggucaguccucaucgcucccccuccccaccccgcgcaggccacugagacg

SEQ ID NO: 218645 - RNA, 64 nt, hsa
uugacgugcagaaucucaguggcaucuggguucaccuccccacucugaugaucuccagccucca

SEQ ID NO: 218646 - RNA, 64 nt, hsa
ggcucacccucccuuuccuuuuccccucuucuacccuccccaagaaaaagggccuucaaggcag

SEQ ID NO: 218647 - RNA, 64 nt, hsa
guuucucgaaggugcuuggcggucuugccuucccccuccccacaggcucuccuugugggguccc

SEQ ID NO: 218648 - RNA, 64 nt, hsa
gggccgagucccgccuggugggcauuugccgccgccuccccaccaccagucacugccucgcaga

SEQ ID NO: 218649 - RNA, 64 nt, hsa
gccgccugaaugccgagcuaacuguugccacucuccuccccagacuaugaaaucccuggagaau

SEQ ID NO: 218650 - RNA, 64 nt, hsa
accaaggucgguuuccgcccucuagcgaugcuguccuccccacuccuccgcucugcucccuggc

SEQ ID NO: 218651 - RNA, 64 nt, hsa
gggacaagcuguggagcuggcugagucacagccaccuccccaccuccccgcaagcuggucccau

SEQ ID NO: 218652 - RNA, 64 nt, hsa
gugugggugaccugcccucaaaccuugccugccaccuccccauucaggccugguggcaggaagg

SEQ ID NO: 218653 - RNA, 64 nt, hsa
uugcugagaugaccucuuuuaaaagcaaagccccccuccccauacaccccaagccugagcccug

SEQ ID NO: 218654 - RNA, 64 nt, hsa
acggcguggcugugcuuccuggggaaaugaacccccuccccacagacaccacccuggguggauc

SEQ ID NO: 218655 - RNA, 64 nt, hsa
gccaaggagcugcuucucucuucucccaguucuaccuccccagaagccuuccuccccagguggg

SEQ ID NO: 218656 - RNA, 64 nt, hsa
ucucuucucccaguucuaccuccccagaagccuuccuccccagguggggcugauggagcaaggg

SEQ ID NO: 218657 - RNA, 64 nt, hsa
cugacccugggcuuucacgggccccauuccaccgccuccccaacuugagccugugaccuuggga

SEQ ID NO: 218658 - RNA, 64 nt, hsa
ggagggcacuggagcugggaggucucgucccagcccuccccaucucggggcugcuguguggacg

SEQ ID NO: 218659 - RNA, 64 nt, hsa
ucccagccugggcucugggagugggggcuccagcccuccccacuaugcccaggagucuucccaa

SEQ ID NO: 218660 - RNA, 64 nt, hsa
uggagaggccuggggcugugggaugccccaucccccuccccaucaccuuuggugggggcagggc

SEQ ID NO: 218661 - RNA, 64 nt, hsa
cugccaccuaccaugcaccauguuccuugccaggccuccccaaccccuggccucaauuucccuu

SEQ ID NO: 218662 - RNA, 61 nt, hsa
ccccgagcccagcuuccuaacccaagacacaccuccccaaccucagucuucccaucugaac

SEQ ID NO: 218663 - RNA, 64 nt, hsa
agaguagggagaagaagggcaccauccucucuuuccuccccagggucuacugcugauuucuaga

SEQ ID NO: 218664 - RNA, 64 nt, hsa
ugguguggugcuggugaggguucgccagcccuccccuccccagggucauagagggggccaugag

SEQ ID NO: 218665 - RNA, 64 nt, hsa
ccuggagaaagaacagugugccucaaacuccugcccuccccaggccucuggggcccacuggaaa

SEQ ID NO: 218666 - RNA, 64 nt, hsa
cuaagaaccccacggccccacuguccacacacugccuccccaccgcccaccucggcugcuaggc

SEQ ID NO: 218667 - RNA, 64 nt, hsa
uguccagcaccagccaagcuggugcuccagcgcaccuccccagagcuccccgcacugacggggc

SEQ ID NO: 218668 - RNA, 64 nt, hsa
gcaaagaacugccccaucuccucccauggccuucccuccccacaguccucacagccucucccuu

SEQ ID NO: 218669 - RNA, 64 nt, hsa
cagccucucccuuaaugagcaaggacaaccugccccuccccagcccuuugcaggcccagcagac

SEQ ID NO: 218670 - RNA, 64 nt, hsa
agcugcaggagaagauggccuacuuggaucaaacccuccccagagcccccggccaggcaccccc

SEQ ID NO: 218671 - RNA, 64 nt, hsa
cagaaggucaguccuaccuuuuucuuucugagagccuccccaccccgagaucacauuucucacu

SEQ ID NO: 218672 - RNA, 64 nt, hsa
cagggacuucccgguuccuaguucuuugccagcuccuccccacucugugcgaccuuuccaagcc

SEQ ID NO: 218673 - RNA, 64 nt, hsa
gagcccaggucuggguacugaguguccagagcugccuccccaggagguuaaggugggggcaaag

SEQ ID NO: 218674 - RNA, 64 nt, hsa
gacuuacguaucuuuucuccuccucccuaguguuccuccccauuuuuucagaaaacacuucuga

SEQ ID NO: 218675 - RNA, 64 nt, hsa
ugaauuuagucccuccauccuuaauccccccaucccuccccaucaugcaaccagugguuuaauc

SEQ ID NO: 218676 - RNA, 64 nt, hsa
acggaauccagacucuuccuggacuggcuugccuccuccccaccuccccacccuggaaccccug

SEQ ID NO: 218677 - RNA, 64 nt, hsa
cagacucuuccuggacuggcuugccuccuccccaccuccccacccuggaaccccugagggccaa

SEQ ID NO: 218678 - RNA, 64 nt, hsa
uugggggcaggaucuggcccgagcucuccucagaccuccccagaccugucuucucaucagccac

SEQ ID NO: 218679 - RNA, 64 nt, hsa
gagacgaggugugcuguuccuucccagccccaucccuccccacccuuccuacucccagcuuuca

SEQ ID NO: 218680 - RNA, 64 nt, hsa
gcuuucuuuccaauccuuuauagcuuuggagacgccuccccaauuccccagggaaggaaacugu

SEQ ID NO: 218681 - RNA, 64 nt, hsa
ugacaugaacccauccaauggauugugcaaauccccuccccaaacccacccauaccagcuagaa

SEQ ID NO: 218682 - RNA, 64 nt, hsa
ucuuuauacucaggaaaaugucaccaagcacccuccuccccaguucacaaaaggaagaagauga

SEQ ID NO: 218683 - RNA, 64 nt, hsa
aggaagaagaugaagauucugucucccuguucccccuccccaguuuuccaaagugucugagcau

SEQ ID NO: 218684 - RNA, 64 nt, hsa
cccacgccucugcaagugggagagacccgagcauccuccccacccccauagcuccagugcacgc

SEQ ID NO: 218685 - RNA, 64 nt, hsa
agggacgcccccagaggaccgggaggcaccccacccuccccaccagugcaacagaaaccaccug

SEQ ID NO: 218686 - RNA, 59 nt, hsa
auagaaauaugcauagguagaauguacccccuccccaagcaugaaaaucaucucacuga

SEQ ID NO: 218687 - RNA, 64 nt, hsa
aauagccucaaucucccaccccauguaggcacuaccuccccaauuacccuuagaaaaugaucac

SEQ ID NO: 218688 - RNA, 64 nt, hsa
gguguucuucaugagaguacuagccuccuccacuccuccccacagcgcagaggaaacaggccag

SEQ ID NO: 218689 - RNA, 64 nt, hsa
aggcgagaugagcuggcgcagccccgcccuccauccuccccacaucccugcagccaccucccag

SEQ ID NO: 218690 - RNA, 64 nt, hsa
aggaaguagggauauuuuuauaaaacaauuguguccuccccacauuuugcuauguuaauauuug

SEQ ID NO: 218691 - RNA, 64 nt, hsa
ugagaagugauaaacaccuccagcuuucuaacauccuccccacaccaucucaccauauccaucu

SEQ ID NO: 218692 - RNA, 64 nt, hsa
agcacaagcucacccacuuuggagcagcauuucuccuccccagaggaccucgaaggcugcaacg

SEQ ID NO: 218693 - RNA, 64 nt, hsa
ucaccguguguccuccccuccccucccuuccucuccuccccacaggcggaauugcuuucuucug

SEQ ID NO: 218694 - RNA, 64 nt, hsa
ucaaacaagaagcucagagcugccccuuccacuuccuccccaaaagggaugaagaaaacccugu

SEQ ID NO: 218695 - RNA, 64 nt, hsa
agagccgugccucacugacccccaggggccucauccuccccauggaaugggcuguauguccugc

SEQ ID NO: 218696 - RNA, 64 nt, hsa
caucgaggagggagggcagacggaggcccgagagccuccccaggccucuucgugggaaggcccc

SEQ ID NO: 218697 - RNA, 64 nt, hsa
gggacuugggcugggcuaaaugggagggguugucccuccccaucauccauuccugugagguguc

SEQ ID NO: 218698 - RNA, 64 nt, hsa
uagcuccacccuccccgugcugcuguguucugcuccuccccacgcuucccugcuauaguuccca

SEQ ID NO: 218699 - RNA, 64 nt, hsa
cagcccacucauccuuuccccagcccucuucagcccuccccaguccuccccagccuucuucagc

SEQ ID NO: 218700 - RNA, 64 nt, hsa
auccuuuccccagcccucuucagcccuccccaguccuccccagccuucuucagccuucuucagc

SEQ ID NO: 218701 - RNA, 64 nt, hsa
ccccacccccagcugaccagggaggcagaggacaccuccccaucacucagcauucccagcucag

SEQ ID NO: 218702 - RNA, 64 nt, hsa
ucucccucuggaggaccaagcccuccccuaaugcccuccccauggauuccuuagugaucugugc

SEQ ID NO: 218703 - RNA, 64 nt, hsa
ccaaaugcugugaccuguuuggcucccaucuauaccuccccaugacaccuaggcugucagucuc

SEQ ID NO: 218704 - RNA, 64 nt, hsa
cuggcugcgacuaggagcagggcugccucuucucccuccccaaggucugcuugugggcacgcuc

SEQ ID NO: 218705 - RNA, 64 nt, hsa
ugcuucccggguucaagcauuucuccugucucagccuccccaguagcugggauuacaggcaccc

SEQ ID NO: 218706 - RNA, 64 nt, hsa
ugcuuccgggaaucuuggucggaaacaagccgggccuccccagcugccugggcuugaccggcgg

SEQ ID NO: 218707 - RNA, 64 nt, hsa
ccuggcagcccacauuuuuguugcuccccaaaucccuccccacguggggaugagaaccuuccug

SEQ ID NO: 218708 - RNA, 64 nt, hsa
cuccguccucgcucaguugugauccagcagccccccuccccacugccuccccagcucucaguga

SEQ ID NO: 218709 - RNA, 64 nt, hsa
cucaguugugauccagcagccccccuccccacugccuccccagcucucagugaccccgacuguc

SEQ ID NO: 218710 - RNA, 64 nt, hsa
gcugaguggucaggagccaguuucuccagccccuccuccccacaaccccuaguggggaggggca

SEQ ID NO: 218711 - RNA, 64 nt, hsa
ccuuucuagccugcccccccacccccacuucaccccuccccagcuucccaaacuucugucugcc

SEQ ID NO: 218712 - RNA, 64 nt, hsa
uuuucacaccgcaucaguccccaucaucacuacuccuccccagagacauacagauugcccuccc

SEQ ID NO: 218713 - RNA, 64 nt, hsa
cuuuuguguuuuggccaccuggggccgcccccaaccuccccaccccaagaggggucugaguggg

SEQ ID NO: 218714 - RNA, 64 nt, hsa
ucaggcaggccaaggccuucuccuccccacccgcccuccccacggggccucgggaccucaggug

SEQ ID NO: 218715 - RNA, 64 nt, hsa
gaggccuccagcuucaggcaggccaaggccuucuccuccccacccgcccuccccacggggccuc

SEQ ID NO: 218716 - RNA, 64 nt, hsa
uggacccauaagucuguucauccugcugaaguccccuccccauugcuccuucaagccaaaacua

SEQ ID NO: 218717 - RNA, 64 nt, hsa
gucucugucccucucucuuugacucucccuuuguccuccccauagagcuggggugggguggauc

SEQ ID NO: 218718 - RNA, 64 nt, hsa
cacuuccuguccagagagagaagugccccugcugccuccccaacccugccccugccccgucacc

SEQ ID NO: 218719 - RNA, 64 nt, hsa
ggggagugggacagagucuggguguauuuauuuuccuccccagcagguggggaggggguuuggg

SEQ ID NO: 218720 - RNA, 64 nt, hsa
ccaagggagucugggcccuaggccuagccccaucccuccccaugaggggccaagacacugccua

SEQ ID NO: 218721 - RNA, 64 nt, hsa
ccaggaggcuccaguucugggcugggagcugugaccuccccaacgcucaccccucaaccccaag

SEQ ID NO: 218722 - RNA, 64 nt, hsa
ggaggacagcugccuguuuccuccccaucagccuccuccccacauccccagcugccuggcuggg

SEQ ID NO: 218723 - RNA, 64 nt, hsa
cucuuagcucuaccgggaggacagcugccuguuuccuccccaucagccuccuccccacaucccc

SEQ ID NO: 218724 - RNA, 64 nt, hsa
acgaccagguucucaagacacgaguccccuuguuccuccccauuaaaggggguuugucagaagc

SEQ ID NO: 218725 - RNA, 64 nt, hsa
uggcugagauuuuucuaaauugaaaacacgccccccuccccacaccuccaggaacuccacuccc

SEQ ID NO: 218726 - RNA, 64 nt, hsa
gccuuccuuguucugguggagcugggguuucucuccuccccagucccacaacacugccaaaaau

SEQ ID NO: 218727 - RNA, 64 nt, hsa
cugccucaucuuuccucccgucccugccccgccaccuccccaaagaauugaaacgucagcucag

SEQ ID NO: 218728 - RNA, 64 nt, hsa
cucagggcagagauuggcuuggggccagaaggacccuccccaacccuggagacacccugaaggu

SEQ ID NO: 218729 - RNA, 64 nt, hsa
uacuaauacagaagcuugacaagcauguccucacccuccccaccacauaaacacauggacacac

SEQ ID NO: 218730 - RNA, 64 nt, hsa
ccauccccugaucugugcggcuccagccucgcccccuccccacgugcaccauaccuggggaguu

SEQ ID NO: 218731 - RNA, 64 nt, hsa
cugaccacaacuuuggacaccccaggcugccaccccuccccacccguucacccccaggaugcug

SEQ ID NO: 218732 - RNA, 64 nt, hsa
ugcuguugcuguaggacgccugcugcccuggagcccuccccaggaugugagccaguccccucgc

SEQ ID NO: 218733 - RNA, 64 nt, hsa
ucgcccggcugccacaagcucucugcggguccauccuccccaccgggguccguccucgcaggcc

SEQ ID NO: 218734 - RNA, 64 nt, hsa
ugcucaccagcugcuucggccuucaggugaccucccuccccacggcauccugcucuccgggugg

SEQ ID NO: 218735 - RNA, 64 nt, hsa
cucagccagaggugccuggccaugccugcacacuccuccccauuuuaauaaauggucgcaacuu

SEQ ID NO: 218736 - RNA, 64 nt, hsa
agcaggggugacguauguagaaugcuuaggguguccuccccacagagcagauacuugaaccgac

SEQ ID NO: 218737 - RNA, 64 nt, hsa
ccuguguaaagagcacuuuguccugcuucacggaccuccccaaagugugcagaguucuauauag

SEQ ID NO: 218738 - RNA, 64 nt, hsa
caucucccgggccagacagcuguccccccguccuccuccccagcccagccugcucagagaagcu

SEQ ID NO: 218739 - RNA, 64 nt, hsa
ccaucuagggcaaguccugaaaggcccaaggcccccuccccagucuggccuuggccuccagccu

SEQ ID NO: 218740 - RNA, 64 nt, hsa
caccugccaucuuggucaugagcuacugucugucccuccccaggacccgcggugggugcugcau

SEQ ID NO: 218741 - RNA, 64 nt, hsa
gggagggggcuggccugggggucuugggaaggccccuccccaggcccuaggccaccucgcggaa

SEQ ID NO: 218742 - RNA, 64 nt, hsa
guuucuggcccucguccucccugccucucaucugccuccccaacccccaccuacccacugcucc

SEQ ID NO: 218743 - RNA, 64 nt, hsa
ggcugcccacccuguccacgugaagugccaacgcccuccccacccugggccgagcccccacccc

SEQ ID NO: 218744 - RNA, 64 nt, hsa
accugggccaccagaaggugacacccccagaaucccuccccagagacugcaccagcgcagccag

SEQ ID NO: 218745 - RNA, 64 nt, hsa
aaccuuccccaucucccugccagccccuaacuacccuccccagccuccaggaacuauccaucca

SEQ ID NO: 218746 - RNA, 64 nt, hsa
ucuuccaaggccugaugcauucauaaguugaagcccuccccagauccccuuggggagccucugc

SEQ ID NO: 218747 - RNA, 64 nt, hsa
cuuuucuguucauuucaucuggcuccccccaccaccuccccaccccaccccccacccccugcuu

SEQ ID NO: 218748 - RNA, 64 nt, hsa
cccacucccacagggagccccggccauuugcugcccuccccaccccugccccagccucaggacu

SEQ ID NO: 218749 - RNA, 64 nt, hsa
gacugcaggagccauccgccccccucagccccuuccuccccagggagcaaagccauaaggggca

SEQ ID NO: 218750 - RNA, 64 nt, hsa
guuacccccaggagauccuggacugccugacuccccuccccagacuggcuugggagccugggcc

SEQ ID NO: 218751 - RNA, 64 nt, hsa
cagcuguggcccccagggcuacccuacacaacgcccuccccaggccccccuaagcugcucuccc

SEQ ID NO: 218752 - RNA, 64 nt, hsa
cguguuucugcccugugacuccuggaaccugcguccuccccaaagccaugggagggguguccuc

SEQ ID NO: 218753 - RNA, 64 nt, hsa
gugggagccacccccaggugcugggggcacagccccuccccacuccggccacgcccccacccac

SEQ ID NO: 218754 - RNA, 64 nt, hsa
cgccucccagauucacgccauucuccugccucagccuccccagcagcugggacuacaggcaccc

SEQ ID NO: 218755 - RNA, 64 nt, hsa
aggcacaaccuggacccaggcagccucuuuccucccuccccaaucucuuccauuuuucuacaga

SEQ ID NO: 218756 - RNA, 64 nt, hsa
cucugcccucucuggaguuugccucccccagcccccuccccaucaauaaaacucuguuuacaac

SEQ ID NO: 218757 - RNA, 64 nt, hsa
cagaccuaagcccucccccaccccuggaaaggucccuccccaacccaggccccuggcgugugug

SEQ ID NO: 218758 - RNA, 64 nt, hsa
acuuccacgcucugcuggucaguggcggcuguccccuccccagcccagccgcccagccacaugu

SEQ ID NO: 218759 - RNA, 64 nt, hsa
cccaagcaugcaauugccugucccccccggccagccuccccaacuugauguuuguguuuuguuu

SEQ ID NO: 218760 - RNA, 64 nt, hsa
ugacccgucccucccccauccccccuccccacccccuccccaauacagcuacguuuguacauca

SEQ ID NO: 218761 - RNA, 64 nt, hsa
ugaaggaagacugacccgucccucccccauccccccuccccacccccuccccaauacagcuacg

SEQ ID NO: 218762 - RNA, 64 nt, hsa
cccagcucugcaaauccccucccccugccccccaccuccccaggcucaccuugccaugccaggu

SEQ ID NO: 218763 - RNA, 64 nt, hsa
uccgucgcugcccuucacaccuuuuggugcuaccccuccccagaguuaagcacuggaugucucc

SEQ ID NO: 218764 - RNA, 64 nt, hsa
gcucuuucuccccucccuccccacccaagccucaccuccccaccccuugaacccccaugcaaug

SEQ ID NO: 218765 - RNA, 64 nt, hsa
gguggcauacugcagucuggcucuuucuccccucccuccccacccaagccucaccuccccaccc

SEQ ID NO: 218766 - RNA, 64 nt, hsa
acccuggggggggccaggcuccagagagggggcaccuccccacacaccccccccccaccgaggc

SEQ ID NO: 218767 - RNA, 64 nt, hsa
ccagggggugcccucccagacccccuugcccaggccuccccagcaccuagguggggccuggggu

SEQ ID NO: 218768 - RNA, 64 nt, hsa
ucucuuauccucaacuuucuguccauucgggccuccuccccaccucccacgccccagccccucc

SEQ ID NO: 218769 - RNA, 64 nt, hsa
ucccggcccccuccucuccagccugucaggccagccuccccagcccccuucccucaacucuagg

SEQ ID NO: 218770 - RNA, 64 nt, hsa
ccugccccaggaccagaggccugucucccccuucccuccccaccggcccgggggagaccucuuc

SEQ ID NO: 218771 - RNA, 64 nt, hsa
accuccccagacucugcacggauguccuaggcccccuccccaacucuaaccagaccccaucccc

SEQ ID NO: 218772 - RNA, 64 nt, hsa
ccaacaccaaacuguacagacucucccaccccaaccuccccagacucugcacggauguccuagg

SEQ ID NO: 218773 - RNA, 64 nt, hsa
ggacaggcagccccgcgccccugagacuggagacccuccccaguguggcauuuccugccagggg

SEQ ID NO: 218774 - RNA, 64 nt, hsa
ucccccuuuggaugggaggccucucuguuacagcccuccccaugcugugcccugccauauacgu

SEQ ID NO: 218775 - RNA, 64 nt, hsa
gcccaacccccaccccuuccccgacacccaagccccuccccacgucgcccccuccugcacagcc

SEQ ID NO: 218776 - RNA, 64 nt, hsa
gccgccaucucucugccccgccccgccccuccggccuccccacaccccccuugcccucacuacc

SEQ ID NO: 218777 - RNA, 64 nt, hsa
acuuaugacaccucacuucccuagagaaggccugccuccccauagggaaucuggggguuucuuc

SEQ ID NO: 218778 - RNA, 64 nt, hsa
ccagccuaaugagccccuuauuuucuuuuuuuucccuccccaggucuaguagcucuaacuaaaa

SEQ ID NO: 218779 - RNA, 64 nt, hsa
ccucggaguguggccuggauccauccugcuagcaccuccccagacagggcuccagccugucggc

SEQ ID NO: 218780 - RNA, 64 nt, hsa
gacuccaggcccccguugaagccgcucccgguucccuccccagcuccucgucuuugaacugccg

SEQ ID NO: 218781 - RNA, 64 nt, hsa
ggcuuugugagagaggaccuccaugcccccgccaccuccccacuccagcagauaaggccgagcc

SEQ ID NO: 218782 - RNA, 64 nt, hsa
gugaccuccugcagggagccuucugccaccagccccuccccagacucucagguggaggcaacag

SEQ ID NO: 218783 - RNA, 64 nt, hsa
acaacaaaguuccacuuccaggucugccugguucccuccccaaggccacagggagcuccgucag

SEQ ID NO: 218784 - RNA, 64 nt, hsa
gcgggcuccugagccugcuucugccugcuuuccaccuccccagucccuuucucuggcccugucc

SEQ ID NO: 218785 - RNA, 64 nt, hsa
gccugcuuauugccucuuucucagaauccucuuuccuccccauuuggcccugggcucaggggac

SEQ ID NO: 218786 - RNA, 64 nt, hsa
cuguguugagggcagaugccacaagauucccgaaccuccccaaaccccgcccuacugucucuuc

SEQ ID NO: 218787 - RNA, 64 nt, hsa
gccacauggccuucagaaccuucucucuggucuuccuccccacuucuucccugccuucuagaga

SEQ ID NO: 218788 - RNA, 64 nt, hsa
ggauggcuguguccggagccuggcggggaggcggccuccccaguaugugagugcagggaucugc

SEQ ID NO: 218789 - RNA, 64 nt, hsa
aauugucagccucuacgggcagaguccggcauccccuccccagacugccugcugucaaaccacg

SEQ ID NO: 218790 - RNA, 64 nt, hsa
aaucacaagccugggcauggccugggucgcacccccuccccacggccccacccacagggaccuc

SEQ ID NO: 218791 - RNA, 64 nt, hsa
acagccccucaccacggacacggacagaggaccaccuccccauacagagagaggcuucccuccc

SEQ ID NO: 218792 - RNA, 64 nt, hsa
gcucccucagcagccacucauagcacagauuccuccuccccaggccuucccuacucaacgguca

SEQ ID NO: 218793 - RNA, 64 nt, hsa
ccagagcugccccccacgggcauccuacccacugccuccccauccccgcuggccccagacccgc

SEQ ID NO: 218794 - RNA, 64 nt, hsa
ugccacggggaccaggaccccacagcgcacccccccuccccaccaacuucucugccccagggac

SEQ ID NO: 218795 - RNA, 64 nt, hsa
ugcugccacagggggcuggugacacccagagcccccuccccagcccucaggcccucccugccaa

SEQ ID NO: 218796 - RNA, 64 nt, hsa
ccaugccucagccacgccccuccggccucagcucccuccccaaagugccugagcgccgccucug

SEQ ID NO: 218797 - RNA, 64 nt, hsa
ucucagucccucccccaacacuguccacacugccccuccccacuguuuauuuauugcacggauc

SEQ ID NO: 218798 - RNA, 64 nt, hsa
ggcuacugagccacagugaccgccugcccccgccccuccccaucuguccccucucuccacaccc

SEQ ID NO: 218799 - RNA, 64 nt, hsa
ccuccugcagcuggacccugcaggguggcucccuccuccccaucaagcacaagagagggcccag

SEQ ID NO: 218800 - RNA, 64 nt, hsa
auagaaaccgcagugggccugcaagccgcccgagccuccccagcagccuccuacagagcaggaa

SEQ ID NO: 218801 - RNA, 64 nt, hsa
ugucaguauccaggaccccccggauucuccacgcccuccccaucucccagucucccugcccccc

SEQ ID NO: 218802 - RNA, 64 nt, hsa
aagauguacugcuuuaaaacacaacuccagagccccuccccaagcuccccuccccaagcuccug

SEQ ID NO: 218803 - RNA, 64 nt, hsa
uaaaacacaacuccagagccccuccccaagcuccccuccccaagcuccugaagacccgguuucu

SEQ ID NO: 218804 - RNA, 64 nt, hsa
aggaagaaucacacccuuggaauagaaauuuccaccuccccaaccuuucucucagacagcuuau

SEQ ID NO: 218805 - RNA, 64 nt, hsa
cuaaccuuuuagggugguuaggacaucucccccaccuccccacuuuuuuccccaagacaagaca

SEQ ID NO: 218806 - RNA, 64 nt, hsa
uucccaaacccuucgguauuguucaaagaaccccccuccccaaggaagaacaaauaugauucuc

SEQ ID NO: 218807 - RNA, 64 nt, hsa
uggggcuuccauggugguuucagaaagggcagccccuccccauggugcagugaagaaaauguuu

SEQ ID NO: 218808 - RNA, 64 nt, hsa
ccuccccaacugcucaauaaaccuccugcccuccccuccccagcaggaggcaggcauggaccac

SEQ ID NO: 218809 - RNA, 59 nt, hsa
ccugcguccacgcccucugaauucccaccccuccccaacugcucaauaaaccuccugcc

SEQ ID NO: 218810 - RNA, 64 nt, hsa
uuuucaaaaauauauauacacauagcaauguccuccuccccauguccucccugccuugggaccc

SEQ ID NO: 218811 - RNA, 64 nt, hsa
cuaccucccaccccagcagcccucucuucccccaccuccccagcagcccccacccuugccccag

SEQ ID NO: 218812 - RNA, 64 nt, hsa
uuggauguaagggaugagaaggauggcggggcuagggaagcagagagcagagcacacacuggcu

SEQ ID NO: 218813 - RNA, 64 nt, hsa
auagaggugaggaaacuuuuaggugguggaaccagggaagcagagagcagagcaugcagugaug

SEQ ID NO: 218814 - RNA, 64 nt, hsa
gaaaaaguuaagcauuguuuacuugaagugggcagggaagcagcacugaguaaaguucaauuga

SEQ ID NO: 218815 - RNA, 64 nt, hsa
gcagugguucccaacucuccgaucagaaucaucugggaagcauuuucaaacagcaaaguacuuu

SEQ ID NO: 218816 - RNA, 64 nt, hsa
cggugcaggagguggcucaguuauugaaccuuuugggaagcagcaccugggaaugcugccucgu

SEQ ID NO: 218817 - RNA, 64 nt, hsa
ugugccuuucuggcaggguuuuguggggucacaugggaagcaauguguuacgcaagcagucucc

SEQ ID NO: 218818 - RNA, 64 nt, hsa
agggugaccccucaucugaaaggcccaaaccagggggaagcaccagccucagugcagcccccuc

SEQ ID NO: 218819 - RNA, 64 nt, hsa
uugcagaccaggaaggaagagcaagcuguacaaagggaagcagagccuggggugggugugagca

SEQ ID NO: 218820 - RNA, 64 nt, hsa
gugcaggggagggggcaaugguggagguggcggggggaagcagagggaggugggcugaggccuc

SEQ ID NO: 218821 - RNA, 64 nt, hsa
aagguuagaaggcaaaagugggguagggggaugugggaagcagcauuguccucugggcaugugg

SEQ ID NO: 218822 - RNA, 64 nt, hsa
ccuggcugcgggauggaggcucuccuugaggaaggggaagcaggauacccuggcgggccacccu

SEQ ID NO: 218823 - RNA, 64 nt, hsa
uguauugucuuuucaaagugcugccaguugaaaagggaagcauuauguuuacaaaucuguuuug

SEQ ID NO: 218824 - RNA, 64 nt, hsa
uuagcuacacugcuucccacuugauuagagcaaugggaagcauacuguggccuaccagcaucug

SEQ ID NO: 218825 - RNA, 64 nt, hsa
uucccuucuggaggaagcacaagccucagggaaggggaagcaggaugcggagggccaaagcccg

SEQ ID NO: 218826 - RNA, 64 nt, hsa
uucaagggcuggcagccagggagaaugggcccaggggaagcaaagaccucuucccucugccguu

SEQ ID NO: 218827 - RNA, 64 nt, hsa
ccauuugaugaaaagucuuacaucacauauaacugggaagcaggggucccuccucaauuuucag

SEQ ID NO: 218828 - RNA, 64 nt, hsa
guugcugauuuugaaaacagccaccuuuuuucaggggaagcauucagcaacccuuuaaagaaaa

SEQ ID NO: 218829 - RNA, 64 nt, hsa
ucacugucaaggaugcagagagcuggugguaggugggaagcaugguguccaccugccugcugac

SEQ ID NO: 218830 - RNA, 64 nt, hsa
uucaauccuccacucuaagugauuccuccagggugggaagcacggggagcaauggaaucagaug

SEQ ID NO: 218831 - RNA, 64 nt, hsa
ucgccauggucccugcauucacagguuucucagugggaagcaggcccagguccucuuacauuug

SEQ ID NO: 218832 - RNA, 64 nt, hsa
cagcaguaaaggagugggcacuguuuggacucuggggaagcagugugauguucaacagcaucgc

SEQ ID NO: 218833 - RNA, 64 nt, hsa
ccagccccucuggccaggacugaggaggaguggagggaagcagggagggagggagcaaguguga

SEQ ID NO: 218834 - RNA, 64 nt, hsa
uugggaggcugaggcaggagaaucgcuugagcccgggaagcagagguugcagugaacugagaua

SEQ ID NO: 218835 - RNA, 64 nt, hsa
gucaagcccacccgggaaacugagcccuggagaggggaagcagccagcccaggaugcuucaggg

SEQ ID NO: 218836 - RNA, 64 nt, hsa
ugcuccuggcugacccugagcucucgcaguuggagggaagcagacagacuugacuuuuugcaag

SEQ ID NO: 218837 - RNA, 64 nt, hsa
gucauuucauggcuuaauagugcauuuauuuuuagcacugaauaauacuccauugucuagauga

SEQ ID NO: 218838 - RNA, 64 nt, hsa
uucaaacccagauccucugguccaaguuguaugugcacugaacuaaucaggcaggaaaaaagcc

SEQ ID NO: 218839 - RNA, 64 nt, hsa
gccauggccugugccuugcauggaggcggcgguggcacugaagagauagcuuucaagggcccaa

SEQ ID NO: 218840 - RNA, 64 nt, hsa
ccacaggugcgaucagugccucacgcaggcaaaugcacugaaacccaggggcacacgcgcgcag

SEQ ID NO: 218841 - RNA, 64 nt, hsa
uuccuugacugucuuuguguuucuguaccucaaggcacugaagcuggaggacucuguccaugcc

SEQ ID NO: 218842 - RNA, 64 nt, hsa
guguauuacagugggcagguauuugcuuuugcuugcacugaaaauuaaauugcuaucaagaaua

SEQ ID NO: 218843 - RNA, 64 nt, hsa
auggcagugagcagguauguguuugcuuuugcuugcacugaaaauuaaauugcuaucaagagca

SEQ ID NO: 218844 - RNA, 64 nt, hsa
ccuaguuugaccucacagugacccuucccaaucagcacugaaaauaccaucaggccuaaucuca

SEQ ID NO: 218845 - RNA, 64 nt, hsa
ccuaaucucauaccucugaccaacaggcuguucugcacugaaaagguucuucaucccuuuccag

SEQ ID NO: 218846 - RNA, 64 nt, hsa
ggugggugggaugaaacauguuuuggggggggaugcacugaaaaucugagaacuauuuaccuau

SEQ ID NO: 218847 - RNA, 52 nt, hsa
agccagaugccgacgagugauggcacugaaggggcuggggaaacccugcuga

SEQ ID NO: 218848 - RNA, 64 nt, hsa
gugugugugcuaaguacagucucuuuaccaaagggcacugaaacacacaauugacuggacaggu

SEQ ID NO: 218849 - RNA, 64 nt, hsa
acuuuaugcuuaauuuagauccuuucugcaaagugcacugaauugcugaaaguugacuugaguc

SEQ ID NO: 218850 - RNA, 64 nt, hsa
aucuaaaaagauuaccuuuggcuggaggugagcugcacugaaacuuuacgacaaaaugucucug

SEQ ID NO: 218851 - RNA, 64 nt, hsa
agcucauucacguuucaugaccaacugguaguuggcacugaaaaaacuuuucagggcuguguga

SEQ ID NO: 218852 - RNA, 64 nt, hsa
ccgaugcuuugcacugaaguugcaaaagaucugugcacugaacagugaagguggcuuccggcac

SEQ ID NO: 218853 - RNA, 64 nt, hsa
aagacguuuuggucucgauuagcuccgaugcuuugcacugaaguugcaaaagaucugugcacug

SEQ ID NO: 218854 - RNA, 64 nt, hsa
uugauuucauucuguuuaaugaauuuggaaauaugcacugaaagaaauguaaaacauuuagaau

SEQ ID NO: 218855 - RNA, 64 nt, hsa
aacauuuagaauagcucguguuauggaaaaaagugcacugaauuuauuagacaaacuuacgaau

SEQ ID NO: 218856 - RNA, 64 nt, hsa
aaaaccaaggcccccuucccccaccucuuccauggggugagacuugagcagaacaggggcuucc

SEQ ID NO: 218857 - RNA, 64 nt, hsa
aggggcuuccccaaguugcccagaaagacugucugggugagaagccauggccagagcuucuccc

SEQ ID NO: 218858 - RNA, 64 nt, hsa
acuucaggccagucauuuccucccgauggggaaagggugagauuuacauccccaaaugcuugag

SEQ ID NO: 218859 - RNA, 64 nt, hsa
ggggaagagauuugaggaggaaagaaaggagauggggugagaggguuuuuaagucugaaacucu

SEQ ID NO: 218860 - RNA, 64 nt, hsa
ggcuuuuucuugguuacacugcaguuucaggauugggugagacagagacaaaugaaccccccuc

SEQ ID NO: 218861 - RNA, 64 nt, hsa
caguaaaucacagacccaggggcccugugguccagggugagagucacaccacauuacacaugug

SEQ ID NO: 218862 - RNA, 64 nt, hsa
acagccuuuugaaagcuauuuccaucuaguaucagggugagagcauccuugaucuggcugccug

SEQ ID NO: 218863 - RNA, 64 nt, hsa
gauggguucaaagagaaagguuggagaugauagugggugagaagcaggcuggugagacugggcu

SEQ ID NO: 218864 - RNA, 64 nt, hsa
aaucuguguauucuuuuucuccuacuuuuuacuggggugagaggggcaugaagagaaauacgcc

SEQ ID NO: 218865 - RNA, 64 nt, hsa
ccuuggccacucccagcacaauuuggagugucaagggugagagccuaaaacccagcuugccugu

SEQ ID NO: 218866 - RNA, 64 nt, hsa
uucccucgggcccuuaugaaggacugaggcuccagggugagaaggcucacuucugccccgggca

SEQ ID NO: 218867 - RNA, 64 nt, hsa
uuuguuuuuggguccgcuggugucacuauggccugggugagaggccagcacugcugcugcccug

SEQ ID NO: 218868 - RNA, 64 nt, hsa
aaagcaugauuaguuugcagguuaugguaggagagggugagauauaagacauacauacuuuaga

SEQ ID NO: 218869 - RNA, 64 nt, hsa
gcuuacauuuggauucagaguuguugucuauggagggugagagcagaaacucuuaagaaauccu

SEQ ID NO: 218870 - RNA, 64 nt, hsa
aacccuuccuccagcgucuuuggcaugguuucuagggugagaguucccaauuuggauagaacgg

SEQ ID NO: 218871 - RNA, 64 nt, hsa
aggugaauauaaucaaugccaauguaaugccagcgggugagauggccgauggagguuucaaaga

SEQ ID NO: 218872 - RNA, 64 nt, hsa
auggcuccacaccuccaaugcugccugggagccagggugagagucuggguccaggccuggccau

SEQ ID NO: 218873 - RNA, 64 nt, hsa
cugcuuuugccuacgugacaacacaaauuugggagggugagacacugcacagaagacagcagca

SEQ ID NO: 218874 - RNA, 64 nt, hsa
cucuguuucagacugggcugggggcacacgugcugggugagacagugggcccucguccccuccc

SEQ ID NO: 218875 - RNA, 64 nt, hsa
cccuuucuugacugagacgcaugagugccuucuggggugagagcagccccaggguuuaaguugg

SEQ ID NO: 218876 - RNA, 64 nt, hsa
gccugcgcuaauuguaggagccacagcgcuccuagggugagaggcuuagccaucccugacccug

SEQ ID NO: 218877 - RNA, 64 nt, hsa
uguugaucauggaucauacuccccuuguuucuuugggugagaagggaucgcaguuuggaaacuc

SEQ ID NO: 218878 - RNA, 64 nt, hsa
cacugacccucugaccuccuuccugggccugcggcuggaggagaagaucacagagccauucuug

SEQ ID NO: 218879 - RNA, 64 nt, hsa
aauacuugagcaauuucagaaaaccaucuaagugcuggaggaaccacgcuuccuaacugcugcu

SEQ ID NO: 218880 - RNA, 64 nt, hsa
uucuaaguaaaggcaaugaauucuccauuuccuacuggaggauuuauuuaaauaaaauaugcuu

SEQ ID NO: 218881 - RNA, 64 nt, hsa
ugaaggcuggcgcccguaaucccagcuacuaaggcuggaggaucacuucagcccaggaguuuaa

SEQ ID NO: 218882 - RNA, 64 nt, hsa
cagggcucugcucgucgggggcugggagauguuccuggaggaggacacucccaucagaacuugg

SEQ ID NO: 218883 - RNA, 64 nt, hsa
cugggcucugcccgcugggggccugaagacauuccuggaggacacucccaucagaaccuggcag

SEQ ID NO: 218884 - RNA, 64 nt, hsa
gacuguuuggacccaggccucaucaucagggguccuggaggaagccuccaaguagaggggagac

SEQ ID NO: 218885 - RNA, 64 nt, hsa
ggauuucugcaagucgacuaucaugaugacuucgcuggaggaaaggugauacguacauacgcau

SEQ ID NO: 218886 - RNA, 64 nt, hsa
ccagcuccuggaggagggacccagcuccaucgcgcuggaggagagucaccuccagacaacaucu

SEQ ID NO: 218887 - RNA, 64 nt, hsa
acuccagacucauuuaaucaccccaauccagcuccuggaggagggacccagcuccaucgcgcug

SEQ ID NO: 218888 - RNA, 64 nt, hsa
cucugggguggucaccucgucagugccuuuuguucuggaggagaggaccccccccgccugccga

SEQ ID NO: 218889 - RNA, 64 nt, hsa
cacagagggagacuauggaccaaggugugugugucuggaggaaccacugcccaccccaccaccc

SEQ ID NO: 218890 - RNA, 64 nt, hsa
ucccugcuccaggguagaccugagaugaaccucccuggaggagacuuauuucaaugaguccacc

SEQ ID NO: 218891 - RNA, 64 nt, hsa
uaugcaggagucacacggucauaggccaucaaagcuggaggagaccucagaaucauucauucac

SEQ ID NO: 218892 - RNA, 64 nt, hsa
ugcccgugaggagggggagaaggguuagacaagccuggaggacaaaacagcgggaguguggggg

SEQ ID NO: 218893 - RNA, 64 nt, hsa
ggagcaguugaccuuugccaaacacuuuacaguucuggaggaggagguaacauagaugccuggg

SEQ ID NO: 218894 - RNA, 64 nt, hsa
ggucuccaaggcauuuccacacuauugguggcaccuggaggacaugcaccaaggcuugccagag

SEQ ID NO: 218895 - RNA, 64 nt, hsa
aggcaggcuggagcagggcuggggaaugaugggacuggaggaccugggaauuucaucuuucugc

SEQ ID NO: 218896 - RNA, 64 nt, hsa
uggauggggccggcagguccuguguccccugcaccuggaggagagcaggcuagaggcacagcgg

SEQ ID NO: 218897 - RNA, 64 nt, hsa
ugucuuuguguuucuguaccucaaggcacugaagcuggaggacucuguccaugcccgugucacc

SEQ ID NO: 218898 - RNA, 64 nt, hsa
uuggagcuugguuucccugccagaggaaacugagcuggaggagccugagguccugccuuucauu

SEQ ID NO: 218899 - RNA, 64 nt, hsa
ggccguguuuugccagcaugagauacuguccccucuggaggauuuuaggggaggaagagccacg

SEQ ID NO: 218900 - RNA, 64 nt, hsa
cuacuccuagccacgucccuugggaccggugggacuggaggaggaacggucacccuccuccccc

SEQ ID NO: 218901 - RNA, 64 nt, hsa
uccaggggucccccagacaugaaagaggggugagcuggaggaagucauggugucacugggguac

SEQ ID NO: 218902 - RNA, 64 nt, hsa
acagugaagacaguaacuuggaacugaccacggccuggaggacuggcccaggcagggggacagg

SEQ ID NO: 218903 - RNA, 64 nt, hsa
ggcucacgaaugccagaggcagugaugucccauccuggaggagaggaaacagugacuaaaagcu

SEQ ID NO: 218904 - RNA, 64 nt, hsa
ggugaagauuggggccaguaucgaucuuaugaagcuggaggacuugugcagugcuggacucacc

SEQ ID NO: 218905 - RNA, 64 nt, hsa
aagcagaguuggucuagagaggaggagggcggggcuggaggaaugugggggauugaaacuagcu

SEQ ID NO: 218906 - RNA, 64 nt, hsa
agagguuaaauccucaucaagagagaccaggcggcuggaggacaagcggcucuaacccuggggg

SEQ ID NO: 218907 - RNA, 64 nt, hsa
cgguaaaggcugagaugaaguggacugaguagaacuggaggacaggagucgacgugaguuccug

SEQ ID NO: 218908 - RNA, 64 nt, hsa
uuccugggagucuccagagauggggccuggaggccuggaggaaggggccaggccucacauucgu

SEQ ID NO: 218909 - RNA, 64 nt, hsa
cccgcacuccaaccagcagcuggauuccugggaacuggaggaucagguagaggcucaggcagag

SEQ ID NO: 218910 - RNA, 64 nt, hsa
caaggccggccugcgcacuugcugccaccagaaacuggaggacaugauccaggagcuucagguu

SEQ ID NO: 218911 - RNA, 64 nt, hsa
cgggccugcucagcugcccggagagccgccgccgcuggaggagaccgacuggucgcacucgcag

SEQ ID NO: 218912 - RNA, 64 nt, hsa
gagcaucuccccuaacaccaccuaccccucccuccuggaggauggucgugucgaguacagagug

SEQ ID NO: 218913 - RNA, 64 nt, hsa
cagaguggcccucaccgaggaccggcugccccgccuggaggagauccgcaucuggggaccccuc

SEQ ID NO: 218914 - RNA, 60 nt, hsa
aggacuuccugggcccauaggugaagccuucuggaggagaaggugacguggcccagcguc

SEQ ID NO: 218915 - RNA, 64 nt, hsa
acagacucagcuccaggcugcuuggcagcccagccuggaggagaaggcuaaugacggaggggcc

SEQ ID NO: 218916 - RNA, 64 nt, hsa
ugaggaugagauggaagaggaggaggaggaggagcuggaggaggaggucgacgagcugcagacg

SEQ ID NO: 218917 - RNA, 64 nt, hsa
ccacccagcuguucuaacccugcuauccacagcccuggaggaacuggggcuccuggaaggagga

SEQ ID NO: 218918 - RNA, 64 nt, hsa
ccucccaucucaacucccugagagccacaggugccuggaggagcugugcugccggaaaaagccg

SEQ ID NO: 218919 - RNA, 64 nt, hsa
uggcugacuuugccaaccugcccagcugcugccgcuggaggauccggaaagaguuuccgaagag

SEQ ID NO: 218920 - RNA, 64 nt, hsa
aggagagcugagauuggagggaauuguguuguuccuggaggaagcccaggcaucauuaaacaag

SEQ ID NO: 218921 - RNA, 64 nt, hsa
gggagacugguugcaaggugugaccgcaggaauccuggaggaacagagaguaaagcuucuaggc

SEQ ID NO: 218922 - RNA, 64 nt, hsa
uagaaccuagagaagcuaaaaccugagcuagaagcuggaggacuagaaccuggagggcuggaau

SEQ ID NO: 218923 - RNA, 64 nt, hsa
cccaccacccacucuccucugccucaguaaguaucuggaggaagaaaacaggugaaagaagaag

SEQ ID NO: 218924 - RNA, 64 nt, hsa
augaguuccgagaugacccaaucugccuuugaaucuggaggaaauaggcagaaacaaaaugacu

SEQ ID NO: 218925 - RNA, 64 nt, hsa
aggcuguuccuugaaaauguguuguugcuguguccuggaggagacaugaguuccgagaugaccc

SEQ ID NO: 218926 - RNA, 64 nt, hsa
cuguccccaaauguccauuuuugaagugauuuuccuggaggauuaggguauuuagcaguugaag

SEQ ID NO: 218927 - RNA, 64 nt, hsa
gagcuugucaaugugauuuuaaaaaauugacuaccuggaggaaugauuaggaaucuaaaugaag

SEQ ID NO: 218928 - RNA, 64 nt, hsa
ccucagcugccuccugcgcccugugcccgacugacuggaggaggccugucccaauucugcccgc

SEQ ID NO: 218929 - RNA, 64 nt, hsa
gaccgagcgugugccacuggaccucaguccucgccuggaggagacgcuggacuucggcgaggug

SEQ ID NO: 218930 - RNA, 64 nt, hsa
gccccuggccauccacaaacagcagaggccuucccuggaggaggcuuugggaccaccccugggg

SEQ ID NO: 218931 - RNA, 64 nt, hsa
ccgcagagcacagagcaggagaagggcuugggcccuggaggagaaagccauucuggacaccagg

SEQ ID NO: 218932 - RNA, 64 nt, hsa
ugggguggagcacuggacuccggggccccacuggcuggaggaaguggggucuggccuguugaug

SEQ ID NO: 218933 - RNA, 64 nt, hsa
cuggccuguugauguuuacauggcgcccugccuccuggaggaccagauugcucugccccaccuu

SEQ ID NO: 218934 - RNA, 64 nt, hsa
cgaggaaggcggcugggcgggcggggagcugggccuggaggauccuggagucucauuaaaugcc

SEQ ID NO: 218935 - RNA, 64 nt, hsa
ggccugugcauccuggccaagcgucacccucacacuggaggaggaugucugcucuggacuuauc

SEQ ID NO: 218936 - RNA, 64 nt, hsa
ucucuuguccaaauaguggauugggcagacuggccuggaggaaaugcuagaacagagggaaagg

SEQ ID NO: 218937 - RNA, 64 nt, hsa
gauccugccccuuccuucuugccuguagcuccugcuggaggaagaggauuccagccuguuggcc

SEQ ID NO: 218938 - RNA, 64 nt, hsa
uggucagaaccguuacugugaaugagugaagauccuggaggacccugggccccaggccagcucc

SEQ ID NO: 218939 - RNA, 64 nt, hsa
cucccuccccaccccugucgcauccacgugcgaccuggaggacuggucagaaccguuacuguga

SEQ ID NO: 218940 - RNA, 64 nt, hsa
caguggucucagccacauccuauguauuuuggcucuggaggagcaaagcuguauccuggaguug

SEQ ID NO: 218941 - RNA, 64 nt, hsa
agcugucugcagggaacgccaccauguugacccucuggaggagagcgcuguggagccccucccg

SEQ ID NO: 218942 - RNA, 64 nt, hsa
agaggugguagaaccacuuggcugcucauuccuucuggaggacacacagucucaguccagaugc

SEQ ID NO: 218943 - RNA, 64 nt, hsa
uagcccucccuggcaugucagagccaggcucugccuggaggaucccuccauccggcuccuguca

SEQ ID NO: 218944 - RNA, 64 nt, hsa
ccuugggacucaggagcucagucaaggccacaggcuggaggagagacggggcugggcgcaaggu

SEQ ID NO: 218945 - RNA, 64 nt, hsa
gaugaggguuccuaaaccuuaaaccucucugccucuggaggagggugggguauucuggcaggau

SEQ ID NO: 218946 - RNA, 59 nt, hsa
uuggcaguuuggcagcuugacuucugcagcuggaggaggccccucaggccggggaucug

SEQ ID NO: 218947 - RNA, 64 nt, hsa
uuugugagggugucgaguagccucaccggccugucuggaggagcagcuggcucugcucugagaa

SEQ ID NO: 218948 - RNA, 64 nt, hsa
uuuaauuacagguccagggaugagcugaugguugcuggaggaggccaguguagagccagugaga

SEQ ID NO: 218949 - RNA, 64 nt, hsa
augaaaaaucaggcagggaaucgaaacgacagugcuggaggagacucaggaagcagaggcgucc

SEQ ID NO: 218950 - RNA, 64 nt, hsa
gcgaccccucagacagggguccaagaagccccugcuggaggacgacccucagggugccaggaag

SEQ ID NO: 218951 - RNA, 64 nt, hsa
ugaacacagaacccucaagacaaggaugacagagcuggaggacacaucuagcugccauugcaac

SEQ ID NO: 218952 - RNA, 64 nt, hsa
gaccaagcuggugaaccgcggcuaccagccccaccuggaggacuuucugcugcgcaucaacuuc

SEQ ID NO: 218953 - RNA, 64 nt, hsa
cgaguucagggccagguuggccaccgugggcgaccuggaggagauccagcgugcgcacgcagag

SEQ ID NO: 218954 - RNA, 64 nt, hsa
ccuggccacacacuuccaugugucuuuuugccugcuggaggacacggaccauugaugcacuugg

SEQ ID NO: 218955 - RNA, 64 nt, hsa
uugggccggccaggcagggcacccagacggggggcuggaggacacccucaguuugcuccacaug

SEQ ID NO: 218956 - RNA, 64 nt, hsa
cccuguuuuguauaccccuccccugacccugcuccuaucccacaguauuuaaugcccugucagu

SEQ ID NO: 218957 - RNA, 64 nt, hsa
acauccgauuucuccuccugccccagccuccugucuaucccagggucucuguugccaccaucag

SEQ ID NO: 218958 - RNA, 64 nt, hsa
uuugguacaguccacauuaugaggcucugauuuccuaucccaguuuagggcuccagaaaagcca

SEQ ID NO: 218959 - RNA, 62 nt, hsa
aagaaaugguuuacagaugaaccggauaaugccuaucccagaaacauucaaaucaagcccau

SEQ ID NO: 218960 - RNA, 64 nt, hsa
caauguggcuggugaacacuucugaauucagaaacuaucccagaucucagcuagaaccauccac

SEQ ID NO: 218961 - RNA, 64 nt, hsa
auguguuaucuucagccaugagaagcagugaugacuaucccauaucacagauaugauuuaccac

SEQ ID NO: 218962 - RNA, 64 nt, hsa
aaggagucuugaccauagaguccucucucugccucuaucccauucuuuuuacauuuaacaaaac

SEQ ID NO: 218963 - RNA, 64 nt, hsa
ccugcagccuuaacauucucuuccccugcuccuccuaucccauugcccucugcccagcugacag

SEQ ID NO: 218964 - RNA, 64 nt, hsa
augagaccguuacucggauguugaaaguuggaaacuaucccauugcaaguuucucuccaaauaa

SEQ ID NO: 218965 - RNA, 64 nt, hsa
uaaccucccaagcuucucacuuaaagaggacucccuaucccacaaacacaugcucccucuuccu

SEQ ID NO: 218966 - RNA, 64 nt, hsa
caagaacaucaaaccagagugcccaaccccggccugugggcagccgcgccagcugccgggacac

SEQ ID NO: 218967 - RNA, 64 nt, hsa
agagcuucgggggcacguggcugcccugcccuacugugggcauagcgcccgccaugacagugag

SEQ ID NO: 218968 - RNA, 64 nt, hsa
acccguaaaauaugaaauacucagaaguaaagugugugggcaaucagaagcauagccuugaagg

SEQ ID NO: 218969 - RNA, 64 nt, hsa
uugagaaagaaugaugcagauuacaugacucuaaugugggcagucugaaaauaucuuuaacugu

SEQ ID NO: 218970 - RNA, 64 nt, hsa
ugcagacuuccucuuucaagggaggcagggccccugugggcacuagguguaaaaggugcuggcc

SEQ ID NO: 218971 - RNA, 64 nt, hsa
caccucacagagucuggaggccuccaggaucaacugugggcaaagugccugccucugaccucau

SEQ ID NO: 218972 - RNA, 64 nt, hsa
uacuuuacguaggauuucccaucagccucuguccugugggcagacccaggcacacgugggcagg

SEQ ID NO: 218973 - RNA, 64 nt, hsa
cugcugccuccaggaucagcaccuugaagaagugugugggcacugccacgugguucuugccgau

SEQ ID NO: 218974 - RNA, 64 nt, hsa
uggccagccgggcccaggcaggagcagguggcccugugggcaccuggugccugcccccugccgg

SEQ ID NO: 218975 - RNA, 64 nt, hsa
ccuccucugccaggguggguccugggaccucuaaugugggcaugucguccaccccaggacgagc

SEQ ID NO: 218976 - RNA, 64 nt, hsa
uuguacuugugaugagagauaaccuugcccuaguugugggcaacacaugcagaauaauccuguu

SEQ ID NO: 218977 - RNA, 64 nt, hsa
uuuauauuaucaaggggacuaaagucacacggcuugugggcacugugccaagauuuaaaauuaa

SEQ ID NO: 218978 - RNA, 64 nt, hsa
uuaggccacggcccuaaauaggaauucccuggauugugggcaagugggcggaaguuauucuggc

SEQ ID NO: 218979 - RNA, 64 nt, hsa
gugucgugaucaagguucacugaagccuugacgcugugggcacugccucagccgcccaaguauc

SEQ ID NO: 218980 - RNA, 64 nt, hsa
ccacgaagggaauucuugcacaugcucgugcuggugugggcaugggacuggcuggaaacgucug

SEQ ID NO: 218981 - RNA, 64 nt, hsa
cccagcucuugaguacagugguggggacuaaaaaugugggcauguggagagggguauuugcccu

SEQ ID NO: 218982 - RNA, 64 nt, hsa
gaaauuggaagggcccuuuucaggcuggguucccugugggcauuugcuuaguaaaugccuguug

SEQ ID NO: 218983 - RNA, 64 nt, hsa
ggaugacacucaagauacuugccagucucuccagugugggcaccagccggccagaacagaugcg

SEQ ID NO: 218984 - RNA, 64 nt, hsa
agugugugugucucgaguggcuaccuguugggcuugugggcagugauuguacagagccugucca

SEQ ID NO: 218985 - RNA, 64 nt, hsa
ggcugggggaggugggagggaucacgccuauaggugugggcacaugaaacgaccuggaacuugc

SEQ ID NO: 218986 - RNA, 64 nt, hsa
aaauuggggcccuaacuaauuuuccuuuugagguugugggcauaagugcugaucuagaauacag

SEQ ID NO: 218987 - RNA, 64 nt, hsa
agcugccauccagggaugccaucugugggcacgcugugggcaggugggagcuugauucucagca

SEQ ID NO: 218988 - RNA, 64 nt, hsa
caguccaccugagcugccauccagggaugccaucugugggcacgcugugggcaggugggagcuu

SEQ ID NO: 218989 - RNA, 64 nt, hsa
accugacacaucucgucuccccucuuuuccgcacugugggcacaaagacacuuuuucuuccgca

SEQ ID NO: 218990 - RNA, 64 nt, hsa
uggagcaccucccuggggagucgggggauuggguugugggcaguccccauggccgccuggagaa

SEQ ID NO: 218991 - RNA, 64 nt, hsa
cuggggcuacguccauguggacacagaccacagaugugggcacacgaauccauccaccugucca

SEQ ID NO: 218992 - RNA, 64 nt, hsa
aaaaauccccaaaaaagcgaaccgugaggaggggugugggcacccccggcccagugcccccugg

SEQ ID NO: 218993 - RNA, 64 nt, hsa
gacccugggaggaggugacaucgccgggggagguugugggcaacgguggaggaggagagacggg

SEQ ID NO: 218994 - RNA, 64 nt, hsa
cgggcccugcgguggcaugaagcaucccuucuggugugggcaucgcuacguguuuugggggcag

SEQ ID NO: 218995 - RNA, 64 nt, hsa
ggaaccagccaaccaucauguguagagccccuacugugggcaaaguccuccuuucauuacccua

SEQ ID NO: 218996 - RNA, 64 nt, hsa
ccaaugcuugcauggagaaugggacgaggacauuugugggcaagcagaugacagagguuugaag

SEQ ID NO: 218997 - RNA, 62 nt, hsa
acgucuagcggccccgcgggacuggggacugagcccaggagguuugcacaagccgggcgauu

SEQ ID NO: 218998 - RNA, 62 nt, hsa
uggggaacagauggcugaggcugcagacucaggcccaggacacucaaccccaggaggggagc

SEQ ID NO: 218999 - RNA, 62 nt, hsa
ggggagccgcucggcgaaugagcugggugggugcccaggagccggcccgcagcaccugcaca

SEQ ID NO: 219000 - RNA, 62 nt, hsa
gcuugggaggcugagguugcaggaucacuugagcccaggaggucaaggcugcagugagccaa

SEQ ID NO: 219001 - RNA, 62 nt, hsa
cuuuggaaggcugaggcagaaggaucacuugagcccaggaauuugagguuguaguaagcuac

SEQ ID NO: 219002 - RNA, 62 nt, hsa
augcagaugucuaagacaggaggaucacaagagcccaggagguugagaaugcagugagcuug

SEQ ID NO: 219003 - RNA, 62 nt, hsa
uuugggaggcugaaguaggaggaucgucuugagcccaggaguucaagaccagccuggacaac

SEQ ID NO: 219004 - RNA, 62 nt, hsa
uuccacaggccauccucuuauuccguucuggggcccaggaaguggggaagaguagguucucg

SEQ ID NO: 219005 - RNA, 61 nt, hsa; identical to SEQ ID NO: 108624

SEQ ID NO: 219006 - RNA, 62 nt, hsa
ggaagugaacuacccagggcagccccuuuguggcccaggauaaucaacacuguucucucugu

SEQ ID NO: 219007 - RNA, 62 nt, hsa
acgugagaugaacacuggagugggcagagguggcccaggaccauggcacccuuagagugcag

SEQ ID NO: 219008 - RNA, 62 nt, hsa
cucugaguucugugcugucucuuggaggcagggcccaggagaacaaaguguggaggccucgg

SEQ ID NO: 219009 - RNA, 62 nt, hsa
cccuacuccaccuccuuccaaguccagcucaggcccaggaggugggagaaggucacagagcc

SEQ ID NO: 219010 - RNA, 62 nt, hsa
gggggugcuggccaagagccaacacauucuuggcccaggagcauugcuuuucugugaauuca

SEQ ID NO: 219011 - RNA, 62 nt, hsa
uuucugccuuggccucggcgggcuuuucuggggcccaggaagcccacacuaugcacagagcc

SEQ ID NO: 219012 - RNA, 62 nt, hsa
ccaagucagacagaugucagcuucccagccaugcccaggacguccuaucucccccaacccac

SEQ ID NO: 219013 - RNA, 62 nt, hsa
cagcacuuagggugccaauguggauuaccugagcccaggaguuugagaccagccuggguaac

SEQ ID NO: 219014 - RNA, 62 nt, hsa
aaaaucuaggcagugaacaagucuucauccuggcccaggaaauagccuauuaaaaaaugcug

SEQ ID NO: 219015 - RNA, 62 nt, hsa
ggggaggaugacaagccgcugcccaccuccaagcccaggaaacaguacaagauggcuaagga

SEQ ID NO: 219016 - RNA, 62 nt, hsa
aaaacuggguuuaucucaaggcagcagccugagcccaggagcagaggacccaguuguuauaa

SEQ ID NO: 219017 - RNA, 62 nt, hsa
agggaagcaugugacacccacaaucccaccuagcccaggagagagcuacggcagggugugug

SEQ ID NO: 219018 - RNA, 62 nt, hsa
gagaauuacuugaacgcaggagaaucacugcagcccaggaggcagagguugcagugagccga

SEQ ID NO: 219019 - RNA, 62 nt, hsa
aauaugaaauuuuuuuucaugcuuuaucaauagcccaggauauauuuuauuuuuagaauuuu

SEQ ID NO: 219020 - RNA, 62 nt, hsa
agagacaauuucugcagguggcaggugagcaagcccaggagaaugcugcaaucuugggggug

SEQ ID NO: 219021 - RNA, 62 nt, hsa
acucaggaggcugaggcaggaggaucacuugagcccaggagguugaggcuggagugagccau

SEQ ID NO: 219022 - RNA, 62 nt, hsa
acuuugggaggcugaugugggcggauaguugagcccaggaguucgagaccagccugggcaac

SEQ ID NO: 219023 - RNA, 62 nt, hsa
acucaggaggcugaggugggaaaaucacuugagcccaggaggucgaggcugcagugugcugu

SEQ ID NO: 219024 - RNA, 62 nt, hsa
cuaugggaggcugaggcaagcagguuguuugagcccaggaauuugagaacaggauuuugaga

SEQ ID NO: 219025 - RNA, 62 nt, hsa
ccgccacugcaguucugcuaggucugcuuccugcccaggaaggugccugcacaugagaggag

SEQ ID NO: 219026 - RNA, 62 nt, hsa
gcauccuggugccugcauaccucuggcagcuggcccaggaagagccagcaagagcaaggcau

SEQ ID NO: 219027 - RNA, 62 nt, hsa
uucuuauaccacguuccacggaggagugaggagcccaggaacgacguggucuuccagcccau

SEQ ID NO: 219028 - RNA, 62 nt, hsa
agugccaagauuggcuuggcaucugcacuccagcccaggacuguggucugccauugcaaugc

SEQ ID NO: 219029 - RNA, 62 nt, hsa
aaggcuggcacgugcagcguccuuggcaguuggcccaggaacuggagccacagagcuggugc

SEQ ID NO: 219030 - RNA, 62 nt, hsa
uuuugggaggccgaggagagaggaucacuuaagcccaggagucugagaccagccugggcaac

SEQ ID NO: 219031 - RNA, 62 nt, hsa
acaugggaggcugaggugggaggaucacuugagcccaggaaguccagaacguagugagccuu

SEQ ID NO: 219032 - RNA, 62 nt, hsa
ggaagggcccucgaaugccauucacaggaacagcccaggaacccagggacuucagaagggcu

SEQ ID NO: 219033 - RNA, 62 nt, hsa
aucccagcucuggaagcugaaggauagcuugagcccaggaguucgaggcugcagugagcuau

SEQ ID NO: 219034 - RNA, 62 nt, hsa
acugaggaggcugaggugggaggauugcuugagcccaggaggcagagguugcagugagccaa

SEQ ID NO: 219035 - RNA, 62 nt, hsa
cuuugggaggcugagguggguagauuacuugagcccaggaauucaagaccagccugggcaac

SEQ ID NO: 219036 - RNA, 62 nt, hsa
ucucaggaggcuggggugggaagaucacuugagcccaggaggucgaggcugcagugagccau

SEQ ID NO: 219037 - RNA, 62 nt, hsa
cuuugggaggcugagucgggaggauagcgugagcccaggaguuugagaccagcuaaggcaau

SEQ ID NO: 219038 - RNA, 62 nt, hsa
ggguucguaccagcaaguagacuaggaacugagcccaggaaagggggauguuuuccuggugu

SEQ ID NO: 219039 - RNA, 62 nt, hsa
cacugcccaagucauggcaacaggcuggagcagcccaggagaugggccuaaaauguucugga

SEQ ID NO: 219040 - RNA, 62 nt, hsa
ccucccucgucccacccccacccaggcaggaagcccaggaggagugcgggcagggccugacc

SEQ ID NO: 219041 - RNA, 62 nt, hsa
gaaggggucccccauuguuuugcuuccccagcgcccaggaugagcgguuuaccaucgagcuu

SEQ ID NO: 219042 - RNA, 62 nt, hsa
agagaagggcccaggaaggaugcucucauaaggcccaggaaggaugcucucauaagcaccuu

SEQ ID NO: 219043 - RNA, 62 nt, hsa
ugccauccacggccuuuucuggcaagagaagggcccaggaaggaugcucucauaaggcccag

SEQ ID NO: 219044 - RNA, 62 nt, hsa
acaaaacaaacagugauuguacagcaggcugggcccaggaggucagguucauuuuguuacau

SEQ ID NO: 219045 - RNA, 62 nt, hsa
aggagaaggaauuggagcagcuuuuccuggaggcccaggauauuucuuuucuggguaucuug

SEQ ID NO: 219046 - RNA, 62 nt, hsa
ccagcugcucugauaagaggaggcucacuugagcccaggagguugaggcugcagugagcaga

SEQ ID NO: 219047 - RNA, 62 nt, hsa
gcucagguggcuaggguggauggaucgcuugagcccaggagguggagguugcagugagcuga

SEQ ID NO: 219048 - RNA, 62 nt, hsa
ucuugggaggucgaggcaagcugaucgcuugagcccaggaguuuaagaccggccugaguagc

SEQ ID NO: 219049 - RNA, 62 nt, hsa
acugggggugcugaggugggaggaucgcuugagcccaggagagugaggcugcagugagcuga

SEQ ID NO: 219050 - RNA, 62 nt, hsa
auagcuaggaaucauguucaauauugaauucugcccaggagcaugaacugauccaugaaugc

SEQ ID NO: 219051 - RNA, 62 nt, hsa
ggcugagguggaagaauggaagaaucacuugagcccaggaguuugaggcugcagugagcuau

SEQ ID NO: 219052 - RNA, 62 nt, hsa
gcuccccaccugcccugcacucugcccucuuugcccaggauacugaggagggcuggagcucg

SEQ ID NO: 219053 - RNA, 62 nt, hsa
cuugggccacugccugggacccagcagacacugcccaggacucuuuagugcacucacucuug

SEQ ID NO: 219054 - RNA, 62 nt, hsa
cagauaaauaaccauacacugaccucauacuugcccaggacccauuaaaguugcgguauuua

SEQ ID NO: 219055 - RNA, 62 nt, hsa
acuccuguugggacacaguuggucugcagucggcccaggacggucuacucagcacaacugac

SEQ ID NO: 219056 - RNA, 62 nt, hsa
acucaggaggcugaggcaggaggauugcuugagcccaggaguucgaggcugcagucagucau

SEQ ID NO: 219057 - RNA, 62 nt, hsa
agcccaagugaaaucaaaggugcuaaauggucgcccaggagacauccguugugcuugccugc

SEQ ID NO: 219058 - RNA, 62 nt, hsa
ggcuacucuggaggcccuugaggaucacuugagcccaggagauugaggcugcagugagccau

SEQ ID NO: 219059 - RNA, 62 nt, hsa
aucccagcacuuugaggugggcaauggcuugagcccaggaguucgacaccagccuggccaac

SEQ ID NO: 219060 - RNA, 62 nt, hsa
ucacuguccuguaaugucucccggucagggcagcccaggacugcccagccuggugggcuggg

SEQ ID NO: 219061 - RNA, 62 nt, hsa
aauccauagaaagacaaacggccaccuugggugcccaggauacuggugccuggccccacgua

SEQ ID NO: 219062 - RNA, 62 nt, hsa
cuuuaggaggcugaggcaggaggacuguuugagcccaggaguuugagaccaaccugaguaag

SEQ ID NO: 219063 - RNA, 62 nt, hsa
acuuggggugcugaggcgggaggauuacuugagcccaggaggauuacuucaaccugggaggu

SEQ ID NO: 219064 - RNA, 62 nt, hsa
acuuuggaggccaaggcaggaggacugcuugagcccaggaguuugagaccagccugggcaau

SEQ ID NO: 219065 - RNA, 62 nt, hsa
cuuugggaggccgaggcaggaagacugcuugagcccaggaguucaagaccagccugggcaac

SEQ ID NO: 219066 - RNA, 62 nt, hsa
acucaggagguugaggugggaagauugcuugagcccaggaguuugagguugcagugagcuga

SEQ ID NO: 219067 - RNA, 62 nt, hsa
cuuugggaggccauagcaggaggauugcuugagcccaggaguucgagaccagccagagcaac

SEQ ID NO: 219068 - RNA, 62 nt, hsa
acuugggagguugaggugggaggauugcuugagcccaggauuucaaggcugcagugagccau

SEQ ID NO: 219069 - RNA, 62 nt, hsa
gcagcugcuagcucagacaccaaagggguaaggcccaggacauucauaucuuuaaaagcugc

SEQ ID NO: 219070 - RNA, 62 nt, hsa
ccugaaccagagcuggagugaggaucaaacaggcccaggagccugaggaaauacccagucag

SEQ ID NO: 219071 - RNA, 62 nt, hsa
gccccggcugugccagggugagggagggccaagcccaggaggauuugucugagacauuucca

SEQ ID NO: 219072 - RNA, 62 nt, hsa
cgggaucccagaacucuggucuccaaauuacagcccaggacaccuuucucugccgccugcug

SEQ ID NO: 219073 - RNA, 62 nt, hsa
agucuuuuuuuccucugcccugaucaacuggggcccaggaaaagcaaugucucuucacgggc

SEQ ID NO: 219074 - RNA, 62 nt, hsa
agggcugcaggcaaagcuggacaugugcccuggcccaggaggccauguugggcccucguuuc

SEQ ID NO: 219075 - RNA, 62 nt, hsa
aaguacagccacuguaaauaacccucgucccugcccaggaacccagacuggacuucagucuc

SEQ ID NO: 219076 - RNA, 62 nt, hsa
aagaaggucauuuccaaacccauccuggaagggcccaggauccaaaggucaucaguccugcu

SEQ ID NO: 219077 - RNA, 62 nt, hsa
cgaugggaggccaagacaggcagaucacuugagcccaggaguuugaggccagccugggcaac

SEQ ID NO: 219078 - RNA, 62 nt, hsa
acucaggaggcaaagaugggaggauuacuugagcccaggaggucaaggcuacagugagccau

SEQ ID NO: 219079 - RNA, 62 nt, hsa
gcccagagugaccaagcagcaccagcaggccugcccaggaugcugaaagcagauuucuucuu

SEQ ID NO: 219080 - RNA, 62 nt, hsa
aauaagaaaauaggggugauggagggggagaagcccaggacugggagaaucgcacaugcccc

SEQ ID NO: 219081 - RNA, 62 nt, hsa
agcaggaggaagcccaggagcuggguccugccgcccaggagcugggcccugccacccaggcc

SEQ ID NO: 219082 - RNA, 62 nt, hsa
cacuuccccaagggcggacccagcaggaggaagcccaggagcuggguccugccgcccaggag

SEQ ID NO: 219083 - RNA, 62 nt, hsa
cugcugaugagcccacucuaggagccccaguagcccaggagcuugggugugcugacgagcag

SEQ ID NO: 219084 - RNA, 62 nt, hsa
caggacugagguccugagaaggggauagcacugcccaggacgugugucccuagccuggaaug

SEQ ID NO: 219085 - RNA, 62 nt, hsa
ccagcugcccucuacgaucaggugcaggggcugcccaggacaaagcgggggcaggggaaaga

SEQ ID NO: 219086 - RNA, 62 nt, hsa
cuuugggaggcccaggcagaaggaucgcugcagcccaggaguucgagacuagccugggcaac

SEQ ID NO: 219087 - RNA, 62 nt, hsa
acucaggaggccaaggcaggaggauugcuugagcccaggaguuugagaccagccugggcaac

SEQ ID NO: 219088 - RNA, 62 nt, hsa
gaaucaacugcuauccuuccccucaccccucagcccaggagggaaagggcauuuucuuuuuc

SEQ ID NO: 219089 - RNA, 62 nt, hsa
ucagugcugacucacgggcaugcuucauugaggcccaggaagaggcccugguuuggggcugu

SEQ ID NO: 219090 - RNA, 62 nt, hsa
uacucaggaggcugaggcuagaggauccuugagcccaggagguugaggcugcagugaggugu

SEQ ID NO: 219091 - RNA, 62 nt, hsa
cuuugggaggcugaggcaggaggaucacuugagcccaggaguucaagacuagccuaggcaac

SEQ ID NO: 219092 - RNA, 62 nt, hsa
gccugagcuuagguuguggaguggcugagagggcccaggagggcucgggacagcugugugcu

SEQ ID NO: 219093 - RNA, 62 nt, hsa
ccauuccucucuugcuacaaauaaggaaacaggcccaggagauuaagugacuuggcuaaagu

SEQ ID NO: 219094 - RNA, 62 nt, hsa
cagggacaccccugcagggucucgggcucugagcccaggacauucccugccccuuacucacc

SEQ ID NO: 219095 - RNA, 62 nt, hsa
agggggccacuggcuaccccuacugcgcggcggcccaggagcucggacugcugguccuggag

SEQ ID NO: 219096 - RNA, 62 nt, hsa
gaccacucccaccucaggaagcuaguauucaugcccaggaucggugaguucaggggauccau

SEQ ID NO: 219097 - RNA, 62 nt, hsa
ccacucacaccccagggggaugagcucuccaagcccaggauucuggcaagagaggugaagaa

SEQ ID NO: 219098 - RNA, 62 nt, hsa
aagcaggugucggacugcucagaguccgcauggcccaggagcagguggucggaggccccugg

SEQ ID NO: 219099 - RNA, 62 nt, hsa
ccagguggcgaaaggggcccagucguucuugggcccaggauggggccucuagacuugcaagg

SEQ ID NO: 219100 - RNA, 62 nt, hsa
uggcccaggccccuggcagugcucccggaggggcccaggaaggccugggcagagacccugua

SEQ ID NO: 219101 - RNA, 62 nt, hsa
ggcugggggcuggcaccgagaguucaaggagagcccaggagccagucucuggcuguggcucc

SEQ ID NO: 219102 - RNA, 62 nt, hsa
acaguuaugugauaaaggaaaaauucuuuccugcccaggaccugcgccauccuuuaggccga

SEQ ID NO: 219103 - RNA, 62 nt, hsa
ugaccgaccauugccauuucuggccucgcuaggcccaggagaggagggaggcaagccagucg

SEQ ID NO: 219104 - RNA, 62 nt, hsa
gauguggccagagcaccggccucccagagaaagcccaggaaguccccgugguguccccuggc

SEQ ID NO: 219105 - RNA, 62 nt, hsa
uggcucagccaucccggcuggguuugccaucagcccaggauacucaccgugucacagcugug

SEQ ID NO: 219106 - RNA, 62 nt, hsa
ucagauucaagcccaggaggcugaaaacgagggcccaggaccagaaucgcugccuccucucc

SEQ ID NO: 219107 - RNA, 62 nt, hsa
uggccaccagccccagcugccaucagauucaagcccaggaggcugaaaacgagggcccagga

SEQ ID NO: 219108 - RNA, 62 nt, hsa
cuuuaagaggccaaggcggauggaucacuugagcccaggaguucaacaccagccugagcaac

SEQ ID NO: 219109 - RNA, 62 nt, hsa
agcugccuggcauguggcacuuugucagggcagcccaggaaucugaaacaggaucaaacucu

SEQ ID NO: 219110 - RNA, 62 nt, hsa
cugcauucccuggagacucacugcaaguuccugcccaggaggcugagggcaccccauccuca

SEQ ID NO: 219111 - RNA, 62 nt, hsa
ggcucaagacaccacccccuccagcuucuggggcccaggagccucucccugcuacagggggu

SEQ ID NO: 219112 - RNA, 62 nt, hsa
aacugggaggcugaggcaggaggaucacuugagcccaggagauugaggcugcagugagcaug

SEQ ID NO: 219113 - RNA, 62 nt, hsa
ccagcugcccacucaugggcccuucaccaccugcccaggaucucacccaguacugacagcuc

SEQ ID NO: 219114 - RNA, 62 nt, hsa
gaugagggggucgacagguugaacgucuucaggcccaggaccccaagcuccucagccuggcc

SEQ ID NO: 219115 - RNA, 62 nt, hsa
cacacacuccacgagagcagccccuccacucugcccaggagaggggccgacccuccucggga

SEQ ID NO: 219116 - RNA, 62 nt, hsa
auggcugugggaaucccccacuuccaagaugugcccaggaugugaggagcuggaguggaagc

SEQ ID NO: 219117 - RNA, 62 nt, hsa
cgacacgcguccucgggcgccaccgggcgcucgcccaggacuccccgggccucgggcccggc

SEQ ID NO: 219118 - RNA, 62 nt, hsa
ccgcccacggggggccacagcagcggccgcucgcccaggauggagaggcgggucccaggccc

SEQ ID NO: 219119 - RNA, 62 nt, hsa
gcggcccccggggauuccccccccccgagggugcccaggacucgacaagcuggacccccugc

SEQ ID NO: 219120 - RNA, 62 nt, hsa
ugcggcccuggggacccccccuccccgagugugcccaggaacucagagagggcgcggccccc

SEQ ID NO: 219121 - RNA, 62 nt, hsa
agaagccaccgggaaagcagccagcacaaagggcccaggaagccagcccccgagagcugagc

SEQ ID NO: 219122 - RNA, 62 nt, hsa
gacuuggcagcauggagccaaggucuguccccgcccaggagggugccuuccucggggguagg

SEQ ID NO: 219123 - RNA, 62 nt, hsa
cccacuccauggggacagaagcuccagcauuugcccaggacccguccagaccucacccugug

SEQ ID NO: 219124 - RNA, 62 nt, hsa
gccaugccuauccaaugacgucuccauaaaaggcccaggaacacgggagcuucugaagagcu

SEQ ID NO: 219125 - RNA, 62 nt, hsa
uuacugaggccaugagaaccugaggggcaucugcccaggacaggagccauggcauaugacaa

SEQ ID NO: 219126 - RNA, 62 nt, hsa
cccugcugcagagagcacagcccuugccuggagcccaggaaccccauccuugcuucaucuca

SEQ ID NO: 219127 - RNA, 62 nt, hsa
uguuuggggaagaugcaaggaaguaaugagaagcccaggaaauuucuccaccuguguuuaug

SEQ ID NO: 219128 - RNA, 62 nt, hsa
guggcaaggcuuggaugagauggggcaccagugcccaggaauuugaacauuuuccuuuaccc

SEQ ID NO: 219129 - RNA, 62 nt, hsa
gaucagcuggauccccacgugagcaacagcuggcccaggaaaggcugccugcagaggacagg

SEQ ID NO: 219130 - RNA, 62 nt, hsa
gaaacgacgguacccaggagaagggauuuugggcccaggagaaacacuuacauucuggugcc

SEQ ID NO: 219131 - RNA, 62 nt, hsa
aaaucgauuucacaauccaaaaauggcccacagcccaggaagcuacccugaacaugccaguu

SEQ ID NO: 219132 - RNA, 62 nt, hsa
uuccacugcaaaaguggcugcuuuggaugccagcccaggaugaguaguuccuguucucaggg

SEQ ID NO: 219133 - RNA, 62 nt, hsa
auuugggaggcagaggugagagaaucgcuugagcccaggaauucgagaccagccugggccac

SEQ ID NO: 219134 - RNA, 62 nt, hsa
gggucauucauguccuacgcagcuaaaacagagcccaggagccagggaggaaaagcagucag

SEQ ID NO: 219135 - RNA, 62 nt, hsa
uuccccaucaggcugggcucuggcagggaccugcccaggauggagaugagagagggugagag

SEQ ID NO: 219136 - RNA, 62 nt, hsa
ggcucccuccuccccaucaagcacaagagagggcccaggaaaaaagguuucacauaagugua

SEQ ID NO: 219137 - RNA, 62 nt, hsa
auucacucccaggcaggggugaggguggccuggcccaggaggccaggaaggagggcccuguc

SEQ ID NO: 219138 - RNA, 62 nt, hsa
cucagucugugaguaaaacugggggcucaaaugcccaggaugaggggaucagugacugucua

SEQ ID NO: 219139 - RNA, 62 nt, hsa
cuuugggaggccgaggugggaggaucacuugagcccaggaguucgagaccagccuaggcaac

SEQ ID NO: 219140 - RNA, 62 nt, hsa
gggcagaaacccagaacucagcauucaaggaugcccaggagagcugucccuguuuuaaagag

SEQ ID NO: 219141 - RNA, 62 nt, hsa
uggucucaucuccauugccuuaaugccagguggcccaggaguacccaugcacagcagcugug

SEQ ID NO: 219142 - RNA, 62 nt, hsa
cuugucuaucuugauggagaagagggguuccugcccaggaucuuacaacacagcaaguagca

SEQ ID NO: 219143 - RNA, 62 nt, hsa
gaagcacagaucucuagagcuguccugucgcugcccaggauugaccuguguguaagucccaa

SEQ ID NO: 219144 - RNA, 62 nt, hsa
uuuuuuuuuuugagauggagucucgcucuaucgcccaggauggagugcaguggcucaaucuc

SEQ ID NO: 219145 - RNA, 62 nt, hsa
cuuccacugguagaaggccuuuaaugaucugggcccaggaugauuuccugcccuuuuaucau

SEQ ID NO: 219146 - RNA, 62 nt, hsa
gccucaucuuccuuccugcuguaccacagauggcccaggagaggcacuugucuuuuauuaua

SEQ ID NO: 219147 - RNA, 64 nt, hsa
uauuaauuaggcuuauacagcgggggauuugagcuuacaggauuccuccaugguaaagcugaac

SEQ ID NO: 219148 - RNA, 64 nt, hsa
uaaccuggcauuuacuuagcaacugccuuaucaauuacaggauuugccgguaaaagcagacuca

SEQ ID NO: 219149 - RNA, 64 nt, hsa
aaugaacgucaucggcuacagaaacagccuaaguuuacaggacuuuuuagagucuuacauauuu

SEQ ID NO: 219150 - RNA, 64 nt, hsa
cauuucuaauuuauugcuuauuacuuucuuaauuuuacaggauaauuauaagcaaguggaacua

SEQ ID NO: 219151 - RNA, 64 nt, hsa
gggccaucaccuguggccucugagaccgccccauuuacaggaaucugcacugggucucagugaa

SEQ ID NO: 219152 - RNA, 64 nt, hsa
uuguuggaagagugcuuacuuaccucgagagaauuuacaggaguccacaugacaguguccugcc

SEQ ID NO: 219153 - RNA, 64 nt, hsa
uuaagauugagcuaaauuaucuaccauugccuauuuacaggauaaguacauucaggacaauuua

SEQ ID NO: 219154 - RNA, 64 nt, hsa
ugagaauucacuucuucuuguaaaaauaaguaauuuacaggaaaggcaaaaugcuaauacuaac

SEQ ID NO: 219155 - RNA, 62 nt, hsa
ggaacuugaaauguggggagugauaauaguccagugauuaaacuacaguccagugauuacca

SEQ ID NO: 219156 - RNA, 62 nt, hsa
gugauaauaguccagugauuaaacuacaguccagugauuaccaccaacuuucugacuaagcu

SEQ ID NO: 219157 - RNA, 62 nt, hsa
ucugacuggugugagaugguaugcauuucuguagugauuagugaugaugagugauuuuuaua

SEQ ID NO: 219158 - RNA, 62 nt, hsa
caguuucauucaagaaaaguuuaaaauuaaaaagugauuaucaaagaauaucagggccugac

SEQ ID NO: 219159 - RNA, 62 nt, hsa
uaaauuguaaagguaauguuuaaucauuguauagugauuaugccucugguauagcuuuccua

SEQ ID NO: 219160 - RNA, 62 nt, hsa
aagaaaugugcauauauuuauucuguaauuucagugauuauaaauuguaaagguaauguuua

SEQ ID NO: 219161 - RNA, 62 nt, hsa
uacuuuccuuauuggcaacuuauggacucgcuagugauuaaacgaggcaaugacugugagcg

SEQ ID NO: 219162 - RNA, 62 nt, hsa
auuggccuuaauauaccuaaaucuccaaaaacagugauuaaagcaagagaauuauuacaagg

SEQ ID NO: 219163 - RNA, 62 nt, hsa
cuuuacaauggagacaucuaccagaucauccaagugauuaaauuuaacaucaucaaugaugg

SEQ ID NO: 219164 - RNA, 62 nt, hsa
gguggcggggagaaggauacaccaaaaaacuaagugauuaucuuuggaugggaaaauguuug

SEQ ID NO: 219165 - RNA, 62 nt, hsa
gacauuagugauuagacaggagggaagauauuagugauuagacagcagggaagauauuagug

SEQ ID NO: 219166 - RNA, 62 nt, hsa
uaacucagugauuagacaggaaggaagacauuagugauuagacaggagggaagauauuagug

SEQ ID NO: 219167 - RNA, 62 nt, hsa
cuguaaguaaaugacuauuuuucccuuaacucagugauuagacaggaaggaagacauuagug

SEQ ID NO: 219168 - RNA, 62 nt, hsa
uuuuaccuauuuuuauaauuauuauuucuuaaagugauuaaaugagaacauggaugagugga

SEQ ID NO: 219169 - RNA, 62 nt, hsa
aaauaagauuuuaaacuaauucauauguaaaaagugauuaggaagaacuugaaguaucauuu

SEQ ID NO: 219170 - RNA, 62 nt, hsa
uuucuugccacuuccccaacuagaccacuccuagugauuacugacuuuagugccuaaaccuu

SEQ ID NO: 219171 - RNA, 62 nt, hsa
uucaggccagagacacagagaccacauagcccagugauuaaaccccgguuucacucuggccc

SEQ ID NO: 219172 - RNA, 64 nt, hsa
caggugaucagggcagagcugggacuccagcucauggcccuagcagccaguacagugcccuguc

SEQ ID NO: 219173 - RNA, 64 nt, hsa
cagauguccguguggaggggacauagacacugcauggcccuauguggcucugcauucuagucag

SEQ ID NO: 219174 - RNA, 64 nt, hsa
cccacacacgacaaagucacagacauccugcaccugccacuaggcauccucauccuacugacau

SEQ ID NO: 219175 - RNA, 64 nt, hsa
gucugagaaggcaggauaagugaccacauauuuaugccacuaccuccaccagggagaguccuuc

SEQ ID NO: 219176 - RNA, 64 nt, hsa
aacauaaagagagcaacugauuucagccagguuuugccacuacccuauaauuagugcagucuua

SEQ ID NO: 219177 - RNA, 64 nt, hsa
aaagagaaaaugcaaugagcccaguuacugcacuugccacuaccaugcuguccauggaaggaau

SEQ ID NO: 219178 - RNA, 64 nt, hsa
agcgaugaugguugcucaacauuuugaauguuaaugccacuaaauuguacccauaaaaaugguu

SEQ ID NO: 219179 - RNA, 64 nt, hsa
auacaugaggauggauuuguacaaauguauaaaaugccacuauuuauacaccaaguucauagca

SEQ ID NO: 219180 - RNA, 64 nt, hsa
uuguucuuucaaauccuguucucaggaaagaaacugccacuaauucauucacacuaagguguaa

SEQ ID NO: 219181 - RNA, 64 nt, hsa
ggcaaggcuucucuucagacugaagcagcaauucugccacuaccagcagcaaccaggacgucug

SEQ ID NO: 219182 - RNA, 64 nt, hsa
cucguuuaaggacuuuccacuccauugcaacugaugccacuauauuugccuagcaacuugcagc

SEQ ID NO: 219183 - RNA, 64 nt, hsa
acaucaggcaauuuccaggguuggucuagagucuugccacuaaauauugaucacucguuuaagg

SEQ ID NO: 219184 - RNA, 64 nt, hsa
aaaucagccugagugaccaaauuuuggucuggugggaacagaugggaaccagcucaauugggug

SEQ ID NO: 219185 - RNA, 64 nt, hsa
aauucuagaaucaggcaacagacucauugaaucaggaacagauucacuccauaaaauacagaga

SEQ ID NO: 219186 - RNA, 64 nt, hsa
accugaagacaaugauuauuucuggaggagcaagggaacagaaacuacauuguaaccuguuugu

SEQ ID NO: 219187 - RNA, 64 nt, hsa
cagggaaguuuuuaaaaaugucauuacuuucaaaggaacagaaguaguuaaccaaacuaacaag

SEQ ID NO: 219188 - RNA, 64 nt, hsa
cucucuuccccaggcaauuacuggccucaaaagaggaacagaggugcugcgaggugcucaccuc

SEQ ID NO: 219189 - RNA, 64 nt, hsa
cauuuaccaauuaaauaacugagaccuaagucugggaacagagccacgaaucugccuuugagau

SEQ ID NO: 219190 - RNA, 64 nt, hsa
cucuuuuaagaaucaaaauauggauuugauacuaggaacagaaucugcucuuuauuucauuccu

SEQ ID NO: 219191 - RNA, 64 nt, hsa
cacgugacuacaauggauaaauaauuuguuugcuggaacagaagccgucuuugaauucuccaac

SEQ ID NO: 219192 - RNA, 64 nt, hsa
gccccagggcccuaacgggggugcggcaggagcaggaacagagacucuggaagccccccaccuu

SEQ ID NO: 219193 - RNA, 64 nt, hsa
uugucaggacccaggccgccugccauaccgcuggggaacagagcgggccucuucccucaguuuu

SEQ ID NO: 219194 - RNA, 64 nt, hsa
ugcugaucaaagaugaucaagcuuucuguguauuggaacagaaaguaacaaagaggaaugagcc

SEQ ID NO: 219195 - RNA, 64 nt, hsa
uacucgucaaagaguuuucagaggcaaugaaaggggaacagauuuuucauuguaauaguggaag

SEQ ID NO: 219196 - RNA, 64 nt, hsa
aaaacggggcagccaaacccaugaggcaaugucaggaacagaaggaugaaugaggucccaggca

SEQ ID NO: 219197 - RNA, 64 nt, hsa
accaaaagaacaagaauuucuugguaagaagccgggaacagacaacagaagucaugaagcccaa

SEQ ID NO: 219198 - RNA, 64 nt, hsa
aagucucccugccgugggcucucauugccaauauggaacagagcccagggccaggcagacuggg

SEQ ID NO: 219199 - RNA, 64 nt, hsa
ucuuuguuuacaggacucugcuaacuucucacuuggaacagacugcguaagagccaggugggau

SEQ ID NO: 219200 - RNA, 64 nt, hsa
guguuuugaggauaguauuucuaaauagcauucaggaacagaguauuauugcacagaucugaag

SEQ ID NO: 219201 - RNA, 64 nt, hsa
uuaaggaggaaagcaacagaggaaacagugaaggggaacagaaggggguagcaaaguguuacag

SEQ ID NO: 219202 - RNA, 64 nt, hsa
uguucuaguuuuggcugaaaacaaaacaacaaaaggaacagauccuugaccgcauggcggcagc

SEQ ID NO: 219203 - RNA, 64 nt, hsa
uugaagcaaugccucucugcauuuuuuccccaguggaacagacucugcaguacauuaaucaggu

SEQ ID NO: 219204 - RNA, 64 nt, hsa
ugguaugaagccagaccuccccggcgggccucagggaacagaaugaucagaccuuugaaugauu

SEQ ID NO: 219205 - RNA, 64 nt, hsa
acccuucuuaagacauguaucacuguagagggaaggaacagaggcccugggcccuuccuaucag

SEQ ID NO: 219206 - RNA, 64 nt, hsa
uggugaaaguuuaggcacauuuucacuaaaagugggaacagaaaauggaggccuguuuuuuauu

SEQ ID NO: 219207 - RNA, 64 nt, hsa
guaacaagaaaaauuaaguuguaaauauuggaaaggaacagacaaaaauagaugacauggucau

SEQ ID NO: 219208 - RNA, 64 nt, hsa
gccauaauuucugagccucgguuuccccaucuaaggaacagauguggucguuccgcccucucag

SEQ ID NO: 219209 - RNA, 64 nt, hsa
cagcuggaugagacuguccuggaggauccaccccggaacagacagaauggugucucucaggaug

SEQ ID NO: 219210 - RNA, 64 nt, hsa
agcuauaguaaucaagauagaugguauuggcagaggaacagacacauacgucaauggaacagau

SEQ ID NO: 219211 - RNA, 64 nt, hsa
ugguauuggcagaggaacagacacauacgucaauggaacagaugagagaacccagaaauaaacc

SEQ ID NO: 219212 - RNA, 64 nt, hsa
aaagugggggauggcuaagaaagcugggagauagggaacagaagaggguagugggugggcuagg

SEQ ID NO: 219213 - RNA, 64 nt, hsa
gggcagaaggaaggagggaagaaaagaaagcaaaggaacagaaggaaggaaagaaagaugggag

SEQ ID NO: 219214 - RNA, 64 nt, hsa
gaccauacuuuaguugugcccuucccaggcaucauccuccuaccaccaaccuggggccccaucu

SEQ ID NO: 219215 - RNA, 64 nt, hsa
ucucuggaccagaucugucccaguccuggaugccuccuccuacuggugccuucuuuucuuccag

SEQ ID NO: 219216 - RNA, 64 nt, hsa
ccccagcccagaacucuucagagauuuaagaaucuccuccuaccuccugacucagcaccaugua

SEQ ID NO: 219217 - RNA, 64 nt, hsa
aagauguacauaguacuccauacuccuuuccuuuuccuccuauugaaacuguuccuauaaacuu

SEQ ID NO: 219218 - RNA, 64 nt, hsa
ggacugggcuggaugagagagcacagcugugacuuccuccuaacugucaggguggggagcuggu

SEQ ID NO: 219219 - RNA, 64 nt, hsa
agaagaaucugcaguuuacugagggcauuucaguuccuccuaccaccucaacaggacuuugucc

SEQ ID NO: 219220 - RNA, 64 nt, hsa
accgagcuggcuaacaggcuugucugccugguuuuccuccuacacguggacauuauucuccuga

SEQ ID NO: 219221 - RNA, 64 nt, hsa
guuuuccuccuacacguggacauuauucuccugauccuccuaccugguccaccccagggcuacc

SEQ ID NO: 219222 - RNA, 64 nt, hsa
caaaagcagaaacaugccgccaguucucaaguuuuccuccuaacuccauuugaauguaagggca

SEQ ID NO: 219223 - RNA, 64 nt, hsa
cucccguguggccagagacauccuagcaaauccuuccuccuauuauaucugacacuaauuucuu

SEQ ID NO: 219224 - RNA, 64 nt, hsa
aggcccaacccaucccccacccagcucccggccguccuccuaccuggggcagcuggggcugcca

SEQ ID NO: 219225 - RNA, 64 nt, hsa
gacagagagcagggggcagacagcaccccuggaguccuccuagcagaucguggggaacgucagg

SEQ ID NO: 219226 - RNA, 64 nt, hsa
ccccgcgguucauacgcaucccaucucucccacuuccuccuaccuggggacuccucaaaccacu

SEQ ID NO: 219227 - RNA, 64 nt, hsa
cucuucuuccccuuuguccugcguuuucuccggguccuccuaagucccuuccuauucuccugcc

SEQ ID NO: 219228 - RNA, 64 nt, hsa; identical to SEQ ID NO: 69094

SEQ ID NO: 219229 - RNA, 64 nt, hsa; identical to SEQ ID NO: 69095

SEQ ID NO: 219230 - RNA, 64 nt, hsa; identical to SEQ ID NO: 69096

SEQ ID NO: 219231 - RNA, 64 nt, hsa; identical to SEQ ID NO: 69097

SEQ ID NO: 219232 - RNA, 64 nt, hsa; identical to SEQ ID NO: 69098

SEQ ID NO: 219233 - RNA, 64 nt, hsa; identical to SEQ ID NO: 69099

SEQ ID NO: 219234 - RNA, 63 nt, hsa
caggggcacaagcccagguccugcugccucucuuucacacaaugcccaacuuacugucuucuu

SEQ ID NO: 219235 - RNA, 63 nt, hsa
aaagcauuucuuuucucuuuaaucuccuauuccuucacacaguucaacauaaagagcaauaaa

SEQ ID NO: 219236 - RNA, 63 nt, hsa
uagaaauugacgcaagugaacugaaaacuuauguucacacaaaaacucgcacaugacuguuua

SEQ ID NO: 219237 - RNA, 63 nt, hsa
auccauacucaacaguaaaaaaugaacucuugguucacacaauaauauagacauaucuuaaau

SEQ ID NO: 219238 - RNA, 63 nt, hsa
auacgcaauauuauauuauauuggauauuuauguucacacaggaauuugguuuacugcuuugu

SEQ ID NO: 219239 - RNA, 63 nt, hsa
gcuacuguucaaauacauaaagauaaauuuauuuucacacaguccacaagggguauaucuugu

SEQ ID NO: 219240 - RNA, 63 nt, hsa
gaaauacucacauucccacauacauucacuauuuucacacacacacacacacacacacacaca

SEQ ID NO: 219241 - RNA, 63 nt, hsa
uuauuuucaaaaaugugaaauauaaggcacguuuucacacaaaauuucaaaacaaaaacaaga

SEQ ID NO: 219242 - RNA, 63 nt, hsa
uacacacauuacacacacacacagaaugcacauuucacacacauauacuuauuauucaaguug

SEQ ID NO: 219243 - RNA, 63 nt, hsa
uccgagggaugagauuaaggcagaggcaaaaguuucacacaaaguuucugcaaccuaacguuu

SEQ ID NO: 219244 - RNA, 63 nt, hsa
agaaauacaugaacacauuuugauagggcuuauuucacacaaagaaguuuaugguuauuugug

SEQ ID NO: 219245 - RNA, 63 nt, hsa
gaggggcuggggggacucaaauugguggcuguuuucacacagauguguugguuugugguccaa

SEQ ID NO: 219246 - RNA, 63 nt, hsa
auauccaggugcuaaauaggcagcagaucucaauucacacaugacuaccuuugagcuaaugac

SEQ ID NO: 219247 - RNA, 63 nt, hsa
uuugcaccacuacuccaagauaguauuuuucuuuucacacaaucucuuuacagcagaauccag

SEQ ID NO: 219248 - RNA, 63 nt, hsa
uuuuguuuucuguauguuguugggggaucaacuuucacacauagcaagcacauggccucccug

SEQ ID NO: 219249 - RNA, 63 nt, hsa
acuaaaaauuuguuccuuuuucacuaugggcaguucacacaaggcaaaaacuauugaacaguu

SEQ ID NO: 219250 - RNA, 63 nt, hsa
cugccuggcucugugccagggccccucuucugauucacacaucccauuuuuacacagacccuu

SEQ ID NO: 219251 - RNA, 63 nt, hsa
cuugccugggucggggccugcggccagcaccauuucacacacacuccuuguagaugggagcca

SEQ ID NO: 219252 - RNA, 63 nt, hsa
auguggccagaaagaaagagcaauaauaauuaauucacacaccauauggauucuauuuauaaa

SEQ ID NO: 219253 - RNA, 63 nt, hsa
acuucaacauagcucuuaacaacuuccaggauauucacacaacacuuaggcuuaaaaaugagc

SEQ ID NO: 219254 - RNA, 63 nt, hsa
cccuggcccuuggcuucucacuugauggacagcuucacacacccuuaagcgguggacuccagc

SEQ ID NO: 219255 - RNA, 63 nt, hsa
gguccuucugaacugaccuugaccucugaucucuucacacaucuccccuuagcaucuccacuu

SEQ ID NO: 219256 - RNA, 63 nt, hsa
guuuugaucucagcauccuggaaauuugugugcuucacacaaagugaaauuaguauuuugagc

SEQ ID NO: 219257 - RNA, 63 nt, hsa
guuucuaguaacaguauuuccauacgugcccauuucacacaacuguggauaaauuuuggaaga

SEQ ID NO: 219258 - RNA, 64 nt, hsa; identical to SEQ ID NO: 107011

SEQ ID NO: 219259 - RNA, 64 nt, hsa; identical to SEQ ID NO: 107012

SEQ ID NO: 219260 - RNA, 64 nt, hsa; identical to SEQ ID NO: 107013

SEQ ID NO: 219261 - RNA, 64 nt, hsa; identical to SEQ ID NO: 107014

SEQ ID NO: 219262 - RNA, 64 nt, hsa; identical to SEQ ID NO: 107015

SEQ ID NO: 219263 - RNA, 64 nt, hsa; identical to SEQ ID NO: 107016

SEQ ID NO: 219264 - RNA, 64 nt, hsa; identical to SEQ ID NO: 107017

SEQ ID NO: 219265 - RNA, 64 nt, hsa; identical to SEQ ID NO: 107018

SEQ ID NO: 219266 - RNA, 64 nt, hsa; identical to SEQ ID NO: 107019

SEQ ID NO: 219267 - RNA, 64 nt, hsa; identical to SEQ ID NO: 107020

SEQ ID NO: 219268 - RNA, 64 nt, hsa; identical to SEQ ID NO: 107021

SEQ ID NO: 219269 - RNA, 64 nt, hsa; identical to SEQ ID NO: 107022

SEQ ID NO: 219270 - RNA, 64 nt, hsa; identical to SEQ ID NO: 107023

SEQ ID NO: 219271 - RNA, 64 nt, hsa; identical to SEQ ID NO: 107024

SEQ ID NO: 219272 - RNA, 64 nt, hsa; identical to SEQ ID NO: 107025

SEQ ID NO: 219273 - RNA, 64 nt, hsa; identical to SEQ ID NO: 107026

SEQ ID NO: 219274 - RNA, 64 nt, hsa; identical to SEQ ID NO: 107027

SEQ ID NO: 219275 - RNA, 64 nt, hsa; identical to SEQ ID NO: 107028

SEQ ID NO: 219276 - RNA, 64 nt, hsa; identical to SEQ ID NO: 107029

SEQ ID NO: 219277 - RNA, 64 nt, hsa; identical to SEQ ID NO: 107030

SEQ ID NO: 219278 - RNA, 64 nt, hsa; identical to SEQ ID NO: 107031

SEQ ID NO: 219279 - RNA, 64 nt, hsa; identical to SEQ ID NO: 107032

SEQ ID NO: 219280 - RNA, 64 nt, hsa
uagaaaugaagguuucauaaugaucauuuuguuaaaggucuacuuuaaucagaaauagcaacga

SEQ ID NO: 219281 - RNA, 64 nt, hsa
uuuggucuucagcuaaaaaauaggauaagaaauuaaggucuauuccauucuccauauccugggu

SEQ ID NO: 219282 - RNA, 64 nt, hsa
aaaggucuagagugauuuguauuggaugguaacuaaggucuauacaucuacucuuuuaauucuu

SEQ ID NO: 219283 - RNA, 64 nt, hsa
cuguaaggacaguuucgguaguuaaguggaauuaaaggucuagagugauuuguauuggauggua

SEQ ID NO: 219284 - RNA, 64 nt, hsa
caggaauccuagaagcaaauggauggggauaagaauaggucauuuucuauucaccauccuuuac

SEQ ID NO: 219285 - RNA, 64 nt, hsa
uguauacuucauuagcaagugaguuugguguuuuauaggucacauaugucuguaucuacuuagc

SEQ ID NO: 219286 - RNA, 64 nt, hsa
caacuguuacuuuccuaaggaguccuucuacagaauaggucagaucuuggccucccaaaccccu

SEQ ID NO: 219287 - RNA, 64 nt, hsa
ggagaaaaugaggauauauucuugcagacgagcuauaggucauacaugaaugucuagugagaca

SEQ ID NO: 219288 - RNA, 64 nt, hsa
cugccuaaggcugaacuuguuuucugggaacaccauaggucaccuuuauucuggcagaggaggg

SEQ ID NO: 219289 - RNA, 64 nt, hsa
aaacauuaugaugugugaaaacugguuaauauuuauaggucacuuuguuuuacugucuuaaguu

SEQ ID NO: 219290 - RNA, 64 nt, hsa
cuucgcuccuuaucacugcauugugaagaggaggaaaagugaaucacggagagagaaaggaaag

SEQ ID NO: 219291 - RNA, 64 nt, hsa
gaaaggauagaaucacaggcugcgucugcaccugaaaagugacccgcggaaacucuauggcgga

SEQ ID NO: 219292 - RNA, 64 nt, hsa
uacuuauugucuauuauaaagcucauuauaauauaaaagugaaguacaaaaguuguaaguuucc

SEQ ID NO: 219293 - RNA, 64 nt, hsa
uuauaagugguauauuuguuuuuugucauugauuaaaagugauuuuagcccuaggcccgaaaug

SEQ ID NO: 219294 - RNA, 64 nt, hsa
uucuaguauuucucugaaagaucguuuuggggacaaaagugacuugacauguccaauuucauuu

SEQ ID NO: 219295 - RNA, 64 nt, hsa
agaaauguagcuugcuaauaagauagaaugauacaaaagugaaguaguagccacaguacaacac

SEQ ID NO: 219296 - RNA, 64 nt, hsa
guucuuuccaacucagaaucaucucugauuccacaaaagugaguuuaguuuccuaucugaauua

SEQ ID NO: 219297 - RNA, 64 nt, hsa
aaagagaagucacacagacaaucaugugcccuauaaaagugaguguuuauaggacuaaaaaacu

SEQ ID NO: 219298 - RNA, 64 nt, hsa
gcuuucagaaacuuugagaacuuggcuauuuagaaaaagugauaaugggucaguuucucagacu

SEQ ID NO: 219299 - RNA, 64 nt, hsa
caaauacuucuaauuuuuuucccuaaacauuuuuaaaagugaaauaugggaagagcuuuacaga

SEQ ID NO: 219300 - RNA, 64 nt, hsa
accuagaguuuuaauuaccuuuauaauguuucuuaaaagugaaacuuagauacaauugugauug

SEQ ID NO: 219301 - RNA, 64 nt, hsa
ucaauaccaagcuucugauuccuccucacauaugaaaagugaaaguugugaguuguuuuccucu

SEQ ID NO: 219302 - RNA, 64 nt, hsa
auuuuucagaagcgacauuucauauauaggugccaaaagugaaucggggugcggagagugggaa

SEQ ID NO: 219303 - RNA, 64 nt, hsa
guucuauuuauguauauauauguauguuucuccaaaaagugauaaaaccaaaauaucacugacu

SEQ ID NO: 219304 - RNA, 64 nt, hsa
uaagaaaaaaaucaaaucgaagucagccugcuggaaaagugaucacauggcaguugcaguaacu

SEQ ID NO: 219305 - RNA, 64 nt, hsa
gcuucaagucugugcaguugacuuggcuguacugaaaagugaacagcauggauuaacucauccu

SEQ ID NO: 219306 - RNA, 64 nt, hsa
acugcagaaaucaguugacauugucccacaaggaaaaagugaugccaguaaagugggggaagag

SEQ ID NO: 219307 - RNA, 64 nt, hsa
gcaucuuuuuucaaaguuuaaugugaacuuuuagaaaagugauuaauguugcccuaauacuuua

SEQ ID NO: 219308 - RNA, 64 nt, hsa
uuuucuaaauauuucaaacuugaaaacagaguaaaaaagugauagaaaaguugccaguuugggg

SEQ ID NO: 219309 - RNA, 64 nt, hsa
gaacuuugaggacuguuggucagaaaaugggcucaaaagugaguuugcuuaaugaagacauuua

SEQ ID NO: 219310 - RNA, 64 nt, hsa
guuacuuaauguugaucuaucccuuggggaaaguaaaagugacugugaguggugccauugugug

SEQ ID NO: 219311 - RNA, 64 nt, hsa
acuuugaaaggucauuuuucaauaaucucaccuuaaaagugaccccuuuucaaacaaagcauaa

SEQ ID NO: 219312 - RNA, 64 nt, hsa
caguuauugggagaguuaauuaauuccugagugaaaaagugaacuauguuuuuuuucagaaaaa

SEQ ID NO: 219313 - RNA, 64 nt, hsa
cuucucuucuccauaguacauggacuuguuacagaaaagugauaggaugaaaggucaauacugc

SEQ ID NO: 219314 - RNA, 64 nt, hsa
aauaguucauauaaaaauaugcuaaagauaggauaaaagugagugugagaucacccagggaagc

SEQ ID NO: 219315 - RNA, 64 nt, hsa
ucccucugucaaccccacgccuuuuaggaaaaagaaaagugagugaacagcaaggaagaguguu

SEQ ID NO: 219316 - RNA, 64 nt, hsa
auguaaaaggggaaauuaguauaugauguaggcuaaaagugaaaucauaguaacauauguuuua

SEQ ID NO: 219317 - RNA, 64 nt, hsa
aucucaaaaaaaaaaaaaagaaagaaagaaacugaaaagugagguguggaacuccaggcaacga

SEQ ID NO: 219318 - RNA, 64 nt, hsa
ucuugauauguaaagcacuuaauauuaaaggcauaaaagugaaacugcuaaauauguauagaga

SEQ ID NO: 219319 - RNA, 64 nt, hsa
uuuucaucugcacaaugaggcuguugaaaggaaaaaaagugagccucuaggaauuauucaaaaa

SEQ ID NO: 219320 - RNA, 64 nt, hsa
aacuguguagccagcagggaccuaaacuuuggcaaaaagugaacacaauucaaauacgaaugaa

SEQ ID NO: 219321 - RNA, 64 nt, hsa
aauugcauaguugagucuaggaaaaaauaauguuaaaagugaauaugccaccauaauuacuuaa

SEQ ID NO: 219322 - RNA, 64 nt, hsa
auucaaggucaggucuacucaaagucucacauggaaaagugaguucugccuuuccuuugaucga

SEQ ID NO: 219323 - RNA, 64 nt, hsa
aggcacugugauauacuugggacccuuuaaauuaaaaagugaagauagucaccagggccagaaa

SEQ ID NO: 219324 - RNA, 64 nt, hsa
gcuugaauaaguagaccccaagcauccuuuucuaaaaagugacuuaaaauaagccaacagacuc

SEQ ID NO: 219325 - RNA, 64 nt, hsa
uggguuaacuccucagauuuggaguggcaaggauaaaagugagggcagaaguagcugugggaaa

SEQ ID NO: 219326 - RNA, 64 nt, hsa
gugugguggaggagguagaauugcagaucagauaaaaagugagcuuacacuugaacuuaguuau

SEQ ID NO: 219327 - RNA, 64 nt, hsa
aguguggagaaaccaacaggcaaaacgugggugcaaaagugaugagaccccacacuuuacacuc

SEQ ID NO: 219328 - RNA, 64 nt, hsa
uauguggaaaauuucuuugaugguuuuuccuugaaaaagugaaaccuaaauccacuccguuugg

SEQ ID NO: 219329 - RNA, 64 nt, hsa
acaggaaauuagaaguguuaggguuagauaaaggaaaagugaaaaagcauaagaaauuugggac

SEQ ID NO: 219330 - RNA, 64 nt, hsa
auaucaucuugaaccauuauaaaacaccuuaaauaaaagugauugugacuaaggcacguuggag

SEQ ID NO: 219331 - RNA, 64 nt, hsa
ugacuuuuuaauauguuaucacuguaaaacacagaaaagugauuaaugaaugauaauuuagauc

SEQ ID NO: 219332 - RNA, 64 nt, hsa
uggccacuuucuagauaagaauggcaacuuuaagaaaagugacuacuucaugccuuucucagca

SEQ ID NO: 219333 - RNA, 64 nt, hsa
acuauaguuaaaauggcuguaagaauaguuuuauaaaagugaauacacagaucuauuguauuug

SEQ ID NO: 219334 - RNA, 64 nt, hsa
cccucuaaguguuauuuugguuguucuaacuuacaaaagugauuuugaauaagaaauauuuggu

SEQ ID NO: 219335 - RNA, 64 nt, hsa
agaaugcuuggaaacuugagucucccuagaggugaaaagugagcagaggcccguagaaacccuc

SEQ ID NO: 219336 - RNA, 64 nt, hsa
uaccaaaaauccuuuuauggaaaccauuuuuuuaaaaagugaauguacacaaauccacagagga

SEQ ID NO: 219337 - RNA, 64 nt, hsa
ugcaaauacuacacgucccuuugcucucaauagcaaaagugauguuauaguuuuuuuuacuuuu

SEQ ID NO: 219338 - RNA, 64 nt, hsa
ggaacagaaaacaaacaucugugcaaaacccuauaaaagugauauuccuauggcagaguccagg

SEQ ID NO: 219339 - RNA, 64 nt, hsa
cagagcaaaauauggauaaugaaaguguugggaaaaaagugaugugacagggagugaagacacu

SEQ ID NO: 219340 - RNA, 64 nt, hsa
uaaaauauauugagauuaauacaugaaaaugcuuaaaagugauaggaauuauugagaaacuuau

SEQ ID NO: 219341 - RNA, 64 nt, hsa
cuaaguuuuacuaaggaaaauaacugaaaagauuaaaagugagagcugaaaagagaaaugauaa

SEQ ID NO: 219342 - RNA, 64 nt, hsa
uuugaauauacauauauauauauauguauauuuaaaaagugaauauaauuugaggcacagaaga

SEQ ID NO: 219343 - RNA, 64 nt, hsa
aaagaaagagaaaaaagauaaaguagaaaaagaaaaaagugaaaaggaaacaacuagcaaaaag

SEQ ID NO: 219344 - RNA, 64 nt, hsa
ugcaucuuuccuacaugagaagcuucucugccacaaaagugacuucaaagacggauggguugag

SEQ ID NO: 219345 - RNA, 64 nt, hsa
auaaauuaccuuagcuuuuauguagaauggguucaaaagugaguguuucuauuugagaaggaca

SEQ ID NO: 219346 - RNA, 64 nt, hsa
ggcagggcccaauccuuccagacccaccagcuggaaaagugaaggaagcauguccacugacaaa

SEQ ID NO: 219347 - RNA, 64 nt, hsa
uggagcaaguggccaaacaucagaaucgauuaaaaaaagugaagaaaagaagcgaauaaguaug

SEQ ID NO: 219348 - RNA, 64 nt, hsa
ucaucauaggcaaacauauauccguuccaaggcuaaaagugaccuuaacuguauuuauucucaa

SEQ ID NO: 219349 - RNA, 64 nt, hsa
uucuguauucauuauagauguagcccuuauuuaaaaaagugaauuccauacuaaaacuaggaau

SEQ ID NO: 219350 - RNA, 64 nt, hsa
acaaagcaaaaugaaauccagugaagaaaugaucaaaagugagcuggcaaccuuugaccuuucu

SEQ ID NO: 219351 - RNA, 64 nt, hsa
uguugaagaccugaaagauaacacuccuucaggaaaaagugaugaugauuuugcugacuuccac

SEQ ID NO: 219352 - RNA, 64 nt, hsa
cuagugagauuucuguaauaauuuuaauucuuuaaaaagugaaagcuuguuguaaagauauuuu

SEQ ID NO: 219353 - RNA, 64 nt, hsa
uuuguuuaaaauuuuguauaucaccaaauuuuuaaaaagugauagucacagugcuaaguuaucu

SEQ ID NO: 219354 - RNA, 64 nt, hsa
uuucguuaugauuaaagaugucucauguacuuggaaaagugagcauuuuuuuuuuuuuuguauu

SEQ ID NO: 219355 - RNA, 64 nt, hsa
uacugccugaguugugccucuugugugcuagauuaaaagugagacagagacuugacuugauccu

SEQ ID NO: 219356 - RNA, 64 nt, hsa
augauuaugugaaaguugaauauaauauaccacuaaaagugacaguugaaagugguggcauagg

SEQ ID NO: 219357 - RNA, 64 nt, hsa
cugcagugauuaaccaagacauuuuuguuaacuaaaaagugaaauaugggauggauucuagaaa

SEQ ID NO: 219358 - RNA, 64 nt, hsa
uaaguguugacuuuuuaaaauauaaguuuauuguaaaagugacaugaaaauuacaacagauauu

SEQ ID NO: 219359 - RNA, 64 nt, hsa
cauuugcguauguaaacauucauauuugcaauaaaaaagugagcuuuuauauucuaaauuuuua

SEQ ID NO: 219360 - RNA, 64 nt, hsa
uuuggagccucgggauaaaaugacagugagguugaaaagugaaaacccuagaacuugaauaggu

SEQ ID NO: 219361 - RNA, 64 nt, hsa
uauuuauuuguaucaucucuuugucuaggaauguaaaagugauucuaaacuaagauguguaaua

SEQ ID NO: 219362 - RNA, 64 nt, hsa
aaauagcuauuuugcuuaaauuucuacaguauguaaaagugaaaaaaugaugaagacgggugca

SEQ ID NO: 219363 - RNA, 64 nt, hsa
caggacugguuuuguuuuuauauauauaaaaaaaaaaagugaaaacaccaaugugugaaaugcc

SEQ ID NO: 219364 - RNA, 64 nt, hsa
uauuguuaaauauuugaacaauaaaaaagguacaaaaagugaaguacaaauuacccaaaucucu

SEQ ID NO: 219365 - RNA, 64 nt, hsa
auaccuauguacccagauagauauaugcauagauaaaagugaugaaauauaagugcuguucuau

SEQ ID NO: 219366 - RNA, 64 nt, hsa
ccgcuggaauuggcuugugggucacuuguugugcaaaagugaauuaauuucaaauaggaaucau

SEQ ID NO: 219367 - RNA, 64 nt, hsa
ccauuguuuguggaggauuacauuuaaaaaagcaaaaagugaaaaaaaaaagcucuggacaccu

SEQ ID NO: 219368 - RNA, 64 nt, hsa
agugccucccagaacauuuuguaguuaauugggaaaaagugauacuuggauuaggggguguggg

SEQ ID NO: 219369 - RNA, 64 nt, hsa
ugucuguagcuaccagaaacauuuucgguucaggaaaagugagaugaugguaguacugguuucu

SEQ ID NO: 219370 - RNA, 64 nt, hsa
uucucccagaguuuucuuuggagaacagaaagaagaaaggaaagaaaggaaccagaggcagaga

SEQ ID NO: 219371 - RNA, 64 nt, hsa
aguuuucuuuggagaacagaaagaagaaaggaaagaaaggaaccagaggcagagagacgaggau

SEQ ID NO: 219372 - RNA, 64 nt, hsa
acaauggcgauguggugagaaacuccugaaugaagaaaggaaccuugucuuucagggcauaagg

SEQ ID NO: 219373 - RNA, 64 nt, hsa
uuaaaguacuucuuccccuuauccccucaauaaagaaaggaaauccaaauuugaagcaucacuc

SEQ ID NO: 219374 - RNA, 64 nt, hsa
aaacaaaauugacgcauguuaaucuaugcaaagagaaaggaaaggaugaggugauguauugacu

SEQ ID NO: 219375 - RNA, 64 nt, hsa
agauauuaaaguaauucaaaucuuccccaaaggggaaaggaagagagugauacugaccuuuuua

SEQ ID NO: 219376 - RNA, 64 nt, hsa
agccagccaugguaagggcuggugagguuggggagaaaggaagagcuuuauguuucucuguugu

SEQ ID NO: 219377 - RNA, 64 nt, hsa
uucugcaggaugcuuuuaacugauguaggaaacugaaaggaaauagauuuuuuccaaaacccag

SEQ ID NO: 219378 - RNA, 64 nt, hsa
aaagaaggcaaggagguaggaagagagggaggaggaaaggaaggagagaugccucaggcuucag

SEQ ID NO: 219379 - RNA, 64 nt, hsa
agaaugaggagaaaaaggagaaaagggaaaagcagaaaggaaaaaaaggaagagagaggaaggg

SEQ ID NO: 219380 - RNA, 64 nt, hsa
cuucugcaccccccucaaugaggagucccucccagaaaggaaacugaucucugggacgucagcu

SEQ ID NO: 219381 - RNA, 64 nt, hsa
gaggcagaaagaggaggaagaagcuacagcaucugaaaggaaugaugcagaugagaagcaccca

SEQ ID NO: 219382 - RNA, 64 nt, hsa
guuagagugaaaaaguguguuuuaugucaauugugaaaggaaaauguuaggaguaugguuuuua

SEQ ID NO: 219383 - RNA, 64 nt, hsa
guuuugcaugcucaauuucuagguccuuugucuagaaaggaaauuugccucaguugaauuagug

SEQ ID NO: 219384 - RNA, 64 nt, hsa
guggagcccucugacaauuugcaaggcccucugagaaaggaagcugcuuagagccaggggguua

SEQ ID NO: 219385 - RNA, 64 nt, hsa
gcugccugcaaagccagcuggaggugaagugcaggaaaggaaaggucaccccauucuacuccau

SEQ ID NO: 219386 - RNA, 64 nt, hsa
uaaaggcaaagaaugcaauaggugaugguugguugaaaggaauuguuauugcuguuuuuauuuu

SEQ ID NO: 219387 - RNA, 64 nt, hsa
aaacccuugcuuuuaggggagggaagcggggaaggaaaggaaugagggaggaaauauuccuuuc

SEQ ID NO: 219388 - RNA, 64 nt, hsa
aaaugauaaacuuuaagaccuuguauaccauauugaaaggaagaggcugacaauaagguuugac

SEQ ID NO: 219389 - RNA, 64 nt, hsa
augucugucucuaaaggguuaaauguaucaauuggaaaggaagaaaaaaggccuugaauugaca

SEQ ID NO: 219390 - RNA, 64 nt, hsa
caaaggugcuauccuagggauuuuaugaauuccugaaaggaaaauagaauaugaucaauuccuu

SEQ ID NO: 219391 - RNA, 64 nt, hsa
uaaaaugucuuaauggcugugugacacacguaaggaaaggaaagggggucacgcacaucaugua

SEQ ID NO: 219392 - RNA, 60 nt, hsa
acccacaacaaccagcauaagcaaaugaaagaaaggaauuguauuuaccuuuuauaauua

SEQ ID NO: 219393 - RNA, 64 nt, hsa
cacaugauuucuuuucuugauggaugaaaaauaugaaaggaaacuuuuauaucuguugccuagu

SEQ ID NO: 219394 - RNA, 64 nt, hsa
uagugaagacaugcaucauggaaugagaaaaugagaaaggaaugaguugucuaacaucacagug

SEQ ID NO: 219395 - RNA, 64 nt, hsa
uuauaauuaggcuuuauuaucuuccuaaaucaaggaaaggaaaucauccccagaccauuuaugc

SEQ ID NO: 219396 - RNA, 64 nt, hsa
uucuuacugugcuaugcauuuuauugagaguacagaaaggaagaggaaccuuuuuuuaaucacu

SEQ ID NO: 219397 - RNA, 64 nt, hsa
aaaaucuaacguugaguaaaugugauagugaugagaaaggaauuuuguguacuguaaccuugca

SEQ ID NO: 219398 - RNA, 64 nt, hsa
aaacuuuggguaccaaaccaaaaagaagaaaaaagaaaggaaaagaucuucuuugaagaaaagu

SEQ ID NO: 219399 - RNA, 64 nt, hsa
cacccuccuugagccaaugcacugaacugccuuugaaaggaaauugcauguucugaccauuuua

SEQ ID NO: 219400 - RNA, 64 nt, hsa
cucauguuagagcgacauucaaauggaagguuuggaaaggaaugccucugucuugugaaguagg

SEQ ID NO: 219401 - RNA, 64 nt, hsa
uuggcaguaauugucuguuuaaaaaaauaaaaaggaaaggaagcguucaccgccacaaaucaua

SEQ ID NO: 219402 - RNA, 64 nt, hsa
gcaugaacuaaguaguuaaauauuuacauauucagaaaggaauaguggaaaagguaucuugguu

SEQ ID NO: 219403 - RNA, 64 nt, hsa
guucuuucccuucugguuaucugaagacuguccugaaaggaagacauaaguguugugauuagua

SEQ ID NO: 219404 - RNA, 64 nt, hsa
cguuuauccugacugaaauagacaaaguaagagggaaaggaaaagagguaucaaguaaauacug

SEQ ID NO: 219405 - RNA, 64 nt, hsa
aaauccagaagcaaagagauaguaggacccaagggaaaggaagggaagagugcuccaagacuug

SEQ ID NO: 219406 - RNA, 64 nt, hsa
cugagccuugguuaaaccagggagaaggggagcagaaaggaaacguuguuacugaugaguacca

SEQ ID NO: 219407 - RNA, 64 nt, hsa
auuuucuaaauauuuugauaucaauuuggguaaagaaaggaauacuuuuguuagaaugagaauu

SEQ ID NO: 219408 - RNA, 64 nt, hsa
agacaaaccaaagguaaccagcuagcccaccacugaaaggaaagaucugagacaugggauuccc

SEQ ID NO: 219409 - RNA, 64 nt, hsa
guugggcauuucuuuuccagauuggccugugauggaaaggaaggcuucuaauuagaaaacacag

SEQ ID NO: 219410 - RNA, 64 nt, hsa
agcuuuuccaacaaaucuuugaaaagcaaucuuggaaaggaauucauuaacuaaaugggguaaa

SEQ ID NO: 219411 - RNA, 64 nt, hsa
uuuauacugcacuuuuuaaagcuuuuauguugaggaaaggaaaagggcauuugucuaaacaugg

SEQ ID NO: 219412 - RNA, 64 nt, hsa
uacaaagaaaugcauucauaucaaaauuggaauagaaaggaaaaccuauuuuuaagauaucaac

SEQ ID NO: 219413 - RNA, 64 nt, hsa
uggucugucauaaauuauuuccccgguaauuuuugaaaggaaaaauguauaacaaguacuauuu

SEQ ID NO: 219414 - RNA, 64 nt, hsa
ugugguguuuguuuccauccccaaggcaaacaaggaaaggaaaggaaagaagaaaaggugccuu

SEQ ID NO: 219415 - RNA, 64 nt, hsa
uguuuguuuccauccccaaggcaaacaaggaaaggaaaggaaagaagaaaaggugccuuagucc

SEQ ID NO: 219416 - RNA, 64 nt, hsa
aggagcggucagggcuccaggcauccccggggaagaaaggaacggggcuucacagugccugccu

SEQ ID NO: 219417 - RNA, 63 nt, hsa
ggucuaauguaggcaaguagaggcagcgugggggaaaggaaacguggcucucccuuaucauuu

SEQ ID NO: 219418 - RNA, 64 nt, hsa
uuucaauuccucagaaacaacuuuuuucacaacggaaaggaaagaacacuaguguucuuucagu

SEQ ID NO: 219419 - RNA, 64 nt, hsa
agugcugugagaauucuccuuugagauuucagaagaaaggaaacaaugugauucaagauauuua

SEQ ID NO: 219420 - RNA, 64 nt, hsa
uuaagggguuguuguguaguugcauuggaagagagaaaggaaacacacucuuucauugcugaau

SEQ ID NO: 219421 - RNA, 64 nt, hsa
guuaaggacaaagauguaaaaaugccaaauuugggaaaggaaauuuuguaugaccacuguucua

SEQ ID NO: 219422 - RNA, 64 nt, hsa
gggaagucagcugaaacuugucuuguuuugccaggaaaggaaguaguugccuuuggucauccau

SEQ ID NO: 219423 - RNA, 64 nt, hsa
uuaugagugauugcucuacauuauuucuucaaaggaaaggaaaggaauugaagacuuugcuacu

SEQ ID NO: 219424 - RNA, 64 nt, hsa
agugauugcucuacauuauuucuucaaaggaaaggaaaggaauugaagacuuugcuacucucug

SEQ ID NO: 219425 - RNA, 64 nt, hsa
agcccauuucuguuaaccucuuaucacuaagaaagaaaggaaagaaggagaugaauagaagaaa

SEQ ID NO: 219426 - RNA, 64 nt, hsa
uuuuaaaccacagucuggagugauagcuacuguagaaaggaaauagacuuuguaugaacucuuu

SEQ ID NO: 219427 - RNA, 64 nt, hsa
gaucucaaauuuucaucugcacaaugaggcuguugaaaggaaaaaaagugagccucuaggaauu

SEQ ID NO: 219428 - RNA, 64 nt, hsa
gaaauggcugcagauagaucccgcagucccuucugaaaggaacuguguagccagcagggaccua

SEQ ID NO: 219429 - RNA, 64 nt, hsa
ucuuuuaaaacuugaauauaggugggagacauaagaaaggaaagaaaagacuuaaaacuggagu

SEQ ID NO: 219430 - RNA, 64 nt, hsa
aggcuuuucuauauacuucucagagcacugaaaagaaaggaaggguuugcagaggagaguguag

SEQ ID NO: 219431 - RNA, 64 nt, hsa
agcuuccuucucuggcucaagggcugaguuaagugaaaggaaaaacagcacaauggugaccacu

SEQ ID NO: 219432 - RNA, 64 nt, hsa
agacaacacccuuacaaggauccgccagggcugggaaaggaacucaaaacacuagaaaaagcau

SEQ ID NO: 219433 - RNA, 64 nt, hsa
cucagcaauccugcugcuggguauauacccgaaagaaaggaaaaggaagccaguauauugaaga

SEQ ID NO: 219434 - RNA, 64 nt, hsa
acauagagaguagaagguugguuaccagaagcuggaaaggaaagugggguugggaggaaggugg

SEQ ID NO: 219435 - RNA, 64 nt, hsa
auacucugcuuuucugucaacaucccauuuuggggaaaggaaaagucauauuuauuccugcacc

SEQ ID NO: 219436 - RNA, 64 nt, hsa
agucuaacaacacugauaauaggaaguaaaaacagaaaggaaaagaaauuaccacugggaaaau

SEQ ID NO: 219437 - RNA, 64 nt, hsa
cuuuugccaauuccacuaauuguuugggugaagagaaaggaaguacagaaaacaugcagaaagc

SEQ ID NO: 219438 - RNA, 64 nt, hsa
agaaaggaaguacagaaaacaugcagaaagcacagaaaggaaaaccaagguucucaugaaucuc

SEQ ID NO: 219439 - RNA, 64 nt, hsa
agcuggaggcugggcgccugcguucuccuacacggaaaggaaucuaauuccaagagucuaggaa

SEQ ID NO: 219440 - RNA, 64 nt, hsa
uuauuacguaauuagaggguuauccuuuuguugugaaaggaaggaggggacugaaaucucccaa

SEQ ID NO: 219441 - RNA, 64 nt, hsa
gggacaugcagaauugaauuugcucaaaaaagaugaaaggaaaugcaaacuguaaauguauaaa

SEQ ID NO: 219442 - RNA, 64 nt, hsa
uuugaaugaagcaagggaaggcauguagggacaggaaaggaaacaauggaaggaaagugauucu

SEQ ID NO: 219443 - RNA, 64 nt, hsa
ggacaggagcugucuggagcuccaccuuugcaaagaaaggaaaaacacaaauugcccccagauu

SEQ ID NO: 219444 - RNA, 64 nt, hsa
aacuguucaaaagcaaaagagaaggaacaggaaugaaaggaaaccuucccuuaacucuuucugc

SEQ ID NO: 219445 - RNA, 64 nt, hsa
ggauugcaaacacauggcuccaucuucugcacacgaaaggaaagucccucuccuuuucuacagu

SEQ ID NO: 219446 - RNA, 64 nt, hsa
gcugaucccagggugaggagaagauugggacauagaaaggaaacugcaucagaaacaugaacag

SEQ ID NO: 219447 - RNA, 64 nt, hsa
gaucauggguguggcauucucuaacaaaugaugugaaaggaaaguaguuuucauaaaacucaug

SEQ ID NO: 219448 - RNA, 64 nt, hsa
gucagccaaucuuuuauuguuccuuugcuacuuugaaaggaaaaaaaagguugucucuugauuu

SEQ ID NO: 219449 - RNA, 64 nt, hsa
uuuuucuaaaaaggaaaggacagaaaaaaaugaagaaaggaaaggaagacaaauguaaagaaau

SEQ ID NO: 219450 - RNA, 64 nt, hsa
cuaaaaaggaaaggacagaaaaaaaugaagaaaggaaaggaagacaaauguaaagaaauaagga

SEQ ID NO: 219451 - RNA, 64 nt, hsa
guggccuccuuggauucuucugacuuuggcuucugaaaggaaggccuagauccagcccuggugg

SEQ ID NO: 219452 - RNA, 64 nt, hsa
aagcucgaggugaaguuuuaaaaaaaaaguuguggaaaggaaaguuccaaagaggugguuucug

SEQ ID NO: 219453 - RNA, 64 nt, hsa
gcaucuaugugagaccauuuagcacacugcuugugaaaggaaagaggcucuggcuaaauucaug

SEQ ID NO: 219454 - RNA, 64 nt, hsa
caugggcccucucagcaggggaggguagagcggagaaaggaagggcugcaugcgggcuuccucc

SEQ ID NO: 219455 - RNA, 64 nt, hsa
agguaauagaauacuaguaggauagaaacaacuagaaaggaaagugugacacaguuuuuaaauu

SEQ ID NO: 219456 - RNA, 64 nt, hsa
uagauguagaaaauaaugaauuaaugagauuggugaaaggaaaucaugcaaaacauuugaaugc

SEQ ID NO: 219457 - RNA, 64 nt, hsa
cuucauuccggggaacaaagacggguauuguugggaaaggaacaggcuuggagggaagggagaa

SEQ ID NO: 219458 - RNA, 64 nt, hsa
agcucacugcugcugccucugaaacagaaaguuggaaaggaaaaaagaaaaaagcaauuaggua

SEQ ID NO: 219459 - RNA, 64 nt, hsa
acagcuguccuugaacaaguaucaauguguuuaugaaaggaagaucuaaaucagacaggaguug

SEQ ID NO: 219460 - RNA, 64 nt, hsa
uggaauggaacccuugcuauaguagugacaaagugaaaggaaauuuaggaggcauaggccauuu

SEQ ID NO: 219461 - RNA, 64 nt, hsa
aaauccacaccguacaucugcaauaugaauucaagaaaggaaauaguaccuucaauacuuaaaa

SEQ ID NO: 219462 - RNA, 64 nt, hsa
cuuuuguuguuuauauacaguacacagauaccuugaaaggaagagcuaauaaaucucuucuuug

SEQ ID NO: 219463 - RNA, 64 nt, hsa
ccuuucuggcuccugauaggguggagcaaaaguggaaaggaaaggaaagaggccuuuucucaca

SEQ ID NO: 219464 - RNA, 64 nt, hsa
cuggcuccugauaggguggagcaaaaguggaaaggaaaggaaagaggccuuuucucacagccau

SEQ ID NO: 219465 - RNA, 64 nt, hsa
aucuuguaauguuagaauuuggagggaauuugaagaaaggaacugaggcccagaaagaggcagu

SEQ ID NO: 219466 - RNA, 64 nt, hsa
gcagccuccugccugcuccaagaaaagggcuugcgaaaggaaagccaaacacuguuucuaacuc

SEQ ID NO: 219467 - RNA, 64 nt, hsa
cugcaggguguggggaaggaggacacaaccucaagaaaggaagcgugaaccccagggaacagcg

SEQ ID NO: 219468 - RNA, 64 nt, hsa
uaccacccauccaaccuuugggccuaugugaaaagaaaggaacuaagcuggguguguucugucu

SEQ ID NO: 219469 - RNA, 64 nt, hsa
uggucaaauugauacccuuaauaagaaaggaaaggaaaggaaaacagauccuccccucugcuuu

SEQ ID NO: 219470 - RNA, 64 nt, hsa
ucuuauggucaaauugauacccuuaauaagaaaggaaaggaaaggaaaacagauccuccccucu

SEQ ID NO: 219471 - RNA, 64 nt, hsa
ccuugucuuauggucaaauugauacccuuaauaagaaaggaaaggaaaggaaaacagauccucc

SEQ ID NO: 219472 - RNA, 64 nt, hsa
cggaugcugguauuuuaacagauggagagacaaggaaaggaaaggaaaggccuggcaugggcau

SEQ ID NO: 219473 - RNA, 64 nt, hsa
gcugguauuuuaacagauggagagacaaggaaaggaaaggaaaggccuggcaugggcauuguga

SEQ ID NO: 219474 - RNA, 64 nt, hsa
acccauuuuuaagcugguuuucuccugauaagaagaaaggaagaaagccccagacgcuugguuu

SEQ ID NO: 219475 - RNA, 64 nt, hsa
uaaaccgagcuuuaaaggauaaaguguuaauaaagaaaggaagcugggcacaugucaaaaaggg

SEQ ID NO: 219476 - RNA, 64 nt, hsa
uguucuuaucacugagacacaguggauuuuuauugaaaggaaccacguacagcaaugcggagug

SEQ ID NO: 219477 - RNA, 64 nt, hsa
ggucugguguucaaguaaaaaugaugugacuauggaaaggaaggcaaucgacacaguuauuagc

SEQ ID NO: 219478 - RNA, 64 nt, hsa
aggggaugauccuaaugucuuagaaagcuagauuacuaguaaggcuuccagacuucuaucaguu

SEQ ID NO: 219479 - RNA, 64 nt, hsa
gccaagacaggguaaauaacaugccaaaucacaaacuaguaagagacauaguugaagcuuaaau

SEQ ID NO: 219480 - RNA, 64 nt, hsa
cuugauuugguuucuguuguguuuuugccuaaauacuaguaacauaucagugaaaaacccuaau

SEQ ID NO: 219481 - RNA, 64 nt, hsa
gugaaaaacccuaauuuuuuuucucuucaaugucacuaguaagagaggugguaauuuuucaccu

SEQ ID NO: 219482 - RNA, 64 nt, hsa; identical to SEQ ID NO: 93499

SEQ ID NO: 219483 - RNA, 64 nt, hsa; identical to SEQ ID NO: 93500

SEQ ID NO: 219484 - RNA, 64 nt, hsa; identical to SEQ ID NO: 93501

SEQ ID NO: 219485 - RNA, 64 nt, hsa; identical to SEQ ID NO: 93502

SEQ ID NO: 219486 - RNA, 64 nt, hsa; identical to SEQ ID NO: 93503

SEQ ID NO: 219487 - RNA, 64 nt, hsa; identical to SEQ ID NO: 93504

SEQ ID NO: 219488 - RNA, 64 nt, hsa; identical to SEQ ID NO: 93505

SEQ ID NO: 219489 - RNA, 64 nt, hsa; identical to SEQ ID NO: 93506

SEQ ID NO: 219490 - RNA, 64 nt, hsa; identical to SEQ ID NO: 93507

SEQ ID NO: 219491 - RNA, 64 nt, hsa; identical to SEQ ID NO: 93508

SEQ ID NO: 219492 - RNA, 64 nt, hsa; identical to SEQ ID NO: 93509

SEQ ID NO: 219493 - RNA, 64 nt, hsa; identical to SEQ ID NO: 93510

SEQ ID NO: 219494 - RNA, 64 nt, hsa; identical to SEQ ID NO: 93511

SEQ ID NO: 219495 - RNA, 64 nt, hsa; identical to SEQ ID NO: 93512

SEQ ID NO: 219496 - RNA, 64 nt, hsa; identical to SEQ ID NO: 93513

SEQ ID NO: 219497 - RNA, 64 nt, hsa; identical to SEQ ID NO: 93514

SEQ ID NO: 219498 - RNA, 64 nt, hsa; identical to SEQ ID NO: 93515

SEQ ID NO: 219499 - RNA, 64 nt, hsa; identical to SEQ ID NO: 93516

SEQ ID NO: 219500 - RNA, 64 nt, hsa; identical to SEQ ID NO: 93517

SEQ ID NO: 219501 - RNA, 64 nt, hsa; identical to SEQ ID NO: 93518

SEQ ID NO: 219502 - RNA, 64 nt, hsa; identical to SEQ ID NO: 93519

SEQ ID NO: 219503 - RNA, 64 nt, hsa; identical to SEQ ID NO: 93520

SEQ ID NO: 219504 - RNA, 64 nt, hsa; identical to SEQ ID NO: 93521

SEQ ID NO: 219505 - RNA, 64 nt, hsa; identical to SEQ ID NO: 93522

SEQ ID NO: 219506 - RNA, 64 nt, hsa; identical to SEQ ID NO: 93523

SEQ ID NO: 219507 - RNA, 64 nt, hsa; identical to SEQ ID NO: 93524

SEQ ID NO: 219508 - RNA, 64 nt, hsa; identical to SEQ ID NO: 93525

SEQ ID NO: 219509 - RNA, 64 nt, hsa; identical to SEQ ID NO: 93526

SEQ ID NO: 219510 - RNA, 64 nt, hsa; identical to SEQ ID NO: 93527

SEQ ID NO: 219511 - RNA, 64 nt, hsa; identical to SEQ ID NO: 93528

SEQ ID NO: 219512 - RNA, 64 nt, hsa; identical to SEQ ID NO: 93529

SEQ ID NO: 219513 - RNA, 64 nt, hsa; identical to SEQ ID NO: 93530

SEQ ID NO: 219514 - RNA, 64 nt, hsa; identical to SEQ ID NO: 93531

SEQ ID NO: 219515 - RNA, 64 nt, hsa; identical to SEQ ID NO: 93532

SEQ ID NO: 219516 - RNA, 64 nt, hsa; identical to SEQ ID NO: 93533

SEQ ID NO: 219517 - RNA, 64 nt, hsa; identical to SEQ ID NO: 93534

SEQ ID NO: 219518 - RNA, 64 nt, hsa; identical to SEQ ID NO: 93535

SEQ ID NO: 219519 - RNA, 64 nt, hsa; identical to SEQ ID NO: 93536

SEQ ID NO: 219520 - RNA, 64 nt, hsa; identical to SEQ ID NO: 93537

SEQ ID NO: 219521 - RNA, 64 nt, hsa; identical to SEQ ID NO: 93538

SEQ ID NO: 219522 - RNA, 64 nt, hsa; identical to SEQ ID NO: 93539

SEQ ID NO: 219523 - RNA, 64 nt, hsa; identical to SEQ ID NO: 93540

SEQ ID NO: 219524 - RNA, 64 nt, hsa; identical to SEQ ID NO: 93541

SEQ ID NO: 219525 - RNA, 64 nt, hsa; identical to SEQ ID NO: 93542

SEQ ID NO: 219526 - RNA, 64 nt, hsa; identical to SEQ ID NO: 93543

SEQ ID NO: 219527 - RNA, 64 nt, hsa; identical to SEQ ID NO: 93544

SEQ ID NO: 219528 - RNA, 64 nt, hsa; identical to SEQ ID NO: 93545

SEQ ID NO: 219529 - RNA, 64 nt, hsa; identical to SEQ ID NO: 93546

SEQ ID NO: 219530 - RNA, 64 nt, hsa; identical to SEQ ID NO: 93547

SEQ ID NO: 219531 - RNA, 64 nt, hsa; identical to SEQ ID NO: 93548

SEQ ID NO: 219532 - RNA, 64 nt, hsa; identical to SEQ ID NO: 93549

SEQ ID NO: 219533 - RNA, 64 nt, hsa; identical to SEQ ID NO: 93550

SEQ ID NO: 219534 - RNA, 64 nt, hsa; identical to SEQ ID NO: 93551

SEQ ID NO: 219535 - RNA, 64 nt, hsa; identical to SEQ ID NO: 93552

SEQ ID NO: 219536 - RNA, 64 nt, hsa; identical to SEQ ID NO: 93553

SEQ ID NO: 219537 - RNA, 64 nt, hsa; identical to SEQ ID NO: 93554

SEQ ID NO: 219538 - RNA, 64 nt, hsa; identical to SEQ ID NO: 93555

SEQ ID NO: 219539 - RNA, 64 nt, hsa; identical to SEQ ID NO: 93556

SEQ ID NO: 219540 - RNA, 64 nt, hsa; identical to SEQ ID NO: 93557

SEQ ID NO: 219541 - RNA, 64 nt, hsa; identical to SEQ ID NO: 93558

SEQ ID NO: 219542 - RNA, 64 nt, hsa; identical to SEQ ID NO: 93559

SEQ ID NO: 219543 - RNA, 64 nt, hsa; identical to SEQ ID NO: 93560

SEQ ID NO: 219544 - RNA, 64 nt, hsa; identical to SEQ ID NO: 93561

SEQ ID NO: 219545 - RNA, 64 nt, hsa; identical to SEQ ID NO: 93562

SEQ ID NO: 219546 - RNA, 64 nt, hsa; identical to SEQ ID NO: 93563

SEQ ID NO: 219547 - RNA, 64 nt, hsa; identical to SEQ ID NO: 93564

SEQ ID NO: 219548 - RNA, 64 nt, hsa; identical to SEQ ID NO: 93565

SEQ ID NO: 219549 - RNA, 64 nt, hsa; identical to SEQ ID NO: 93566

SEQ ID NO: 219550 - RNA, 64 nt, hsa; identical to SEQ ID NO: 93567

SEQ ID NO: 219551 - RNA, 64 nt, hsa; identical to SEQ ID NO: 93568

SEQ ID NO: 219552 - RNA, 64 nt, hsa; identical to SEQ ID NO: 93569

SEQ ID NO: 219553 - RNA, 64 nt, hsa; identical to SEQ ID NO: 93570

SEQ ID NO: 219554 - RNA, 64 nt, hsa; identical to SEQ ID NO: 93571

SEQ ID NO: 219555 - RNA, 64 nt, hsa; identical to SEQ ID NO: 93572

SEQ ID NO: 219556 - RNA, 64 nt, hsa; identical to SEQ ID NO: 93573

SEQ ID NO: 219557 - RNA, 64 nt, hsa; identical to SEQ ID NO: 93574

SEQ ID NO: 219558 - RNA, 64 nt, hsa; identical to SEQ ID NO: 93575

SEQ ID NO: 219559 - RNA, 64 nt, hsa; identical to SEQ ID NO: 93576

SEQ ID NO: 219560 - RNA, 64 nt, hsa; identical to SEQ ID NO: 93577

SEQ ID NO: 219561 - RNA, 64 nt, hsa; identical to SEQ ID NO: 93578

SEQ ID NO: 219562 - RNA, 64 nt, hsa; identical to SEQ ID NO: 93579

SEQ ID NO: 219563 - RNA, 64 nt, hsa; identical to SEQ ID NO: 93580

SEQ ID NO: 219564 - RNA, 64 nt, hsa; identical to SEQ ID NO: 93581

SEQ ID NO: 219565 - RNA, 64 nt, hsa; identical to SEQ ID NO: 93582

SEQ ID NO: 219566 - RNA, 62 nt, hsa
cagcagauagaggaaaagacacacauaaacucgcuucugagcguccacuucugcacucucug

SEQ ID NO: 219567 - RNA, 62 nt, hsa
ucagaguugaauaucucuuucccuaucaugcugcuucugaaaauucaguuuuggagcaaguc

SEQ ID NO: 219568 - RNA, 62 nt, hsa
auacuucaucauguauguaaccuuccauguuugcuucugauaaauggaaauguagguucacu

SEQ ID NO: 219569 - RNA, 62 nt, hsa
guaacuggagcgucaccaccggcggaaucgcagcuucugagacuggaacucuggaggaagac

SEQ ID NO: 219570 - RNA, 62 nt, hsa
cucuuguacacauuuuaauaaaauaaggguuggcuucugaacuacaaaacaaaugugcuaug

SEQ ID NO: 219571 - RNA, 62 nt, hsa
ugauuuggccugugaacuugggcugugccagggcuucugacuucagggacaaaacucaguga

SEQ ID NO: 219572 - RNA, 62 nt, hsa
cuugaaaggccaauaccagaacacaggcugaugcuucugagaaagucuuuuccuaguauuua

SEQ ID NO: 219573 - RNA, 62 nt, hsa
cagcucauuuccauuccacuauuucccauaaugcuucugagagccacuaacuugauugauaa

SEQ ID NO: 219574 - RNA, 62 nt, hsa
gugugugucuugugcuuccucagaccuuucucgcuucugagcuugguggccuguucccucca

SEQ ID NO: 219575 - RNA, 62 nt, hsa
cuuauccuucugguccagcgcaaggaggggcugcuucugaggucgguggcugucuuuccauu

SEQ ID NO: 219576 - RNA, 64 nt, hsa; identical to SEQ ID NO: 54328

SEQ ID NO: 219577 - RNA, 64 nt, hsa; identical to SEQ ID NO: 54329

SEQ ID NO: 219578 - RNA, 64 nt, hsa; identical to SEQ ID NO: 54330

SEQ ID NO: 219579 - RNA, 64 nt, hsa; identical to SEQ ID NO: 54331

SEQ ID NO: 219580 - RNA, 64 nt, hsa; identical to SEQ ID NO: 54332

SEQ ID NO: 219581 - RNA, 64 nt, hsa; identical to SEQ ID NO: 54333

SEQ ID NO: 219582 - RNA, 64 nt, hsa; identical to SEQ ID NO: 54334

SEQ ID NO: 219583 - RNA, 64 nt, hsa; identical to SEQ ID NO: 54335

SEQ ID NO: 219584 - RNA, 64 nt, hsa; identical to SEQ ID NO: 54336

SEQ ID NO: 219585 - RNA, 64 nt, hsa; identical to SEQ ID NO: 54337

SEQ ID NO: 219586 - RNA, 64 nt, hsa; identical to SEQ ID NO: 54338

SEQ ID NO: 219587 - RNA, 64 nt, hsa; identical to SEQ ID NO: 54339

SEQ ID NO: 219588 - RNA, 64 nt, hsa; identical to SEQ ID NO: 54340

SEQ ID NO: 219589 - RNA, 64 nt, hsa; identical to SEQ ID NO: 54341

SEQ ID NO: 219590 - RNA, 64 nt, hsa; identical to SEQ ID NO: 54342

SEQ ID NO: 219591 - RNA, 64 nt, hsa; identical to SEQ ID NO: 54343

SEQ ID NO: 219592 - RNA, 64 nt, hsa; identical to SEQ ID NO: 54344

SEQ ID NO: 219593 - RNA, 64 nt, hsa; identical to SEQ ID NO: 54345

SEQ ID NO: 219594 - RNA, 64 nt, hsa; identical to SEQ ID NO: 54346

SEQ ID NO: 219595 - RNA, 64 nt, hsa; identical to SEQ ID NO: 54347

SEQ ID NO: 219596 - RNA, 64 nt, hsa; identical to SEQ ID NO: 54348

SEQ ID NO: 219597 - RNA, 64 nt, hsa; identical to SEQ ID NO: 54349

SEQ ID NO: 219598 - RNA, 64 nt, hsa; identical to SEQ ID NO: 54350

SEQ ID NO: 219599 - RNA, 64 nt, hsa; identical to SEQ ID NO: 54351

SEQ ID NO: 219600 - RNA, 64 nt, hsa; identical to SEQ ID NO: 54352

SEQ ID NO: 219601 - RNA, 64 nt, hsa; identical to SEQ ID NO: 54353

SEQ ID NO: 219602 - RNA, 64 nt, hsa; identical to SEQ ID NO: 54354

SEQ ID NO: 219603 - RNA, 64 nt, hsa; identical to SEQ ID NO: 54355

SEQ ID NO: 219604 - RNA, 64 nt, hsa; identical to SEQ ID NO: 54356

SEQ ID NO: 219605 - RNA, 64 nt, hsa; identical to SEQ ID NO: 54357

SEQ ID NO: 219606 - RNA, 64 nt, hsa; identical to SEQ ID NO: 54358

SEQ ID NO: 219607 - RNA, 64 nt, hsa; identical to SEQ ID NO: 54359

SEQ ID NO: 219608 - RNA, 64 nt, hsa; identical to SEQ ID NO: 54360

SEQ ID NO: 219609 - RNA, 64 nt, hsa; identical to SEQ ID NO: 54361

SEQ ID NO: 219610 - RNA, 64 nt, hsa; identical to SEQ ID NO: 54362

SEQ ID NO: 219611 - RNA, 64 nt, hsa; identical to SEQ ID NO: 54363

SEQ ID NO: 219612 - RNA, 64 nt, hsa; identical to SEQ ID NO: 54364

SEQ ID NO: 219613 - RNA, 64 nt, hsa; identical to SEQ ID NO: 54365

SEQ ID NO: 219614 - RNA, 64 nt, hsa; identical to SEQ ID NO: 54366

SEQ ID NO: 219615 - RNA, 64 nt, hsa; identical to SEQ ID NO: 54367

SEQ ID NO: 219616 - RNA, 64 nt, hsa; identical to SEQ ID NO: 54368

SEQ ID NO: 219617 - RNA, 64 nt, hsa; identical to SEQ ID NO: 54369

SEQ ID NO: 219618 - RNA, 64 nt, hsa; identical to SEQ ID NO: 54370

SEQ ID NO: 219619 - RNA, 64 nt, hsa; identical to SEQ ID NO: 54371

SEQ ID NO: 219620 - RNA, 64 nt, hsa; identical to SEQ ID NO: 54372

SEQ ID NO: 219621 - RNA, 64 nt, hsa; identical to SEQ ID NO: 54373

SEQ ID NO: 219622 - RNA, 64 nt, hsa; identical to SEQ ID NO: 54374

SEQ ID NO: 219623 - RNA, 64 nt, hsa; identical to SEQ ID NO: 54375

SEQ ID NO: 219624 - RNA, 64 nt, hsa; identical to SEQ ID NO: 54376

SEQ ID NO: 219625 - RNA, 64 nt, hsa; identical to SEQ ID NO: 54377

SEQ ID NO: 219626 - RNA, 64 nt, hsa; identical to SEQ ID NO: 54378

SEQ ID NO: 219627 - RNA, 64 nt, hsa; identical to SEQ ID NO: 54379

SEQ ID NO: 219628 - RNA, 64 nt, hsa; identical to SEQ ID NO: 54380

SEQ ID NO: 219629 - RNA, 64 nt, hsa; identical to SEQ ID NO: 54381

SEQ ID NO: 219630 - RNA, 64 nt, hsa; identical to SEQ ID NO: 54382

SEQ ID NO: 219631 - RNA, 64 nt, hsa; identical to SEQ ID NO: 54383

SEQ ID NO: 219632 - RNA, 64 nt, hsa; identical to SEQ ID NO: 54384

SEQ ID NO: 219633 - RNA, 64 nt, hsa; identical to SEQ ID NO: 54385

SEQ ID NO: 219634 - RNA, 64 nt, hsa; identical to SEQ ID NO: 54386

SEQ ID NO: 219635 - RNA, 64 nt, hsa; identical to SEQ ID NO: 54387

SEQ ID NO: 219636 - RNA, 64 nt, hsa; identical to SEQ ID NO: 54388

SEQ ID NO: 219637 - RNA, 64 nt, hsa; identical to SEQ ID NO: 54389

SEQ ID NO: 219638 - RNA, 64 nt, hsa; identical to SEQ ID NO: 54390

SEQ ID NO: 219639 - RNA, 64 nt, hsa; identical to SEQ ID NO: 54391

SEQ ID NO: 219640 - RNA, 64 nt, hsa; identical to SEQ ID NO: 54392

SEQ ID NO: 219641 - RNA, 64 nt, hsa; identical to SEQ ID NO: 54393

SEQ ID NO: 219642 - RNA, 64 nt, hsa; identical to SEQ ID NO: 54394

SEQ ID NO: 219643 - RNA, 64 nt, hsa; identical to SEQ ID NO: 54395

SEQ ID NO: 219644 - RNA, 64 nt, hsa; identical to SEQ ID NO: 54396

SEQ ID NO: 219645 - RNA, 64 nt, hsa; identical to SEQ ID NO: 54397

SEQ ID NO: 219646 - RNA, 64 nt, hsa; identical to SEQ ID NO: 54398

SEQ ID NO: 219647 - RNA, 64 nt, hsa; identical to SEQ ID NO: 54399

SEQ ID NO: 219648 - RNA, 64 nt, hsa; identical to SEQ ID NO: 54400

SEQ ID NO: 219649 - RNA, 64 nt, hsa; identical to SEQ ID NO: 54401

SEQ ID NO: 219650 - RNA, 64 nt, hsa; identical to SEQ ID NO: 54402

SEQ ID NO: 219651 - RNA, 64 nt, hsa; identical to SEQ ID NO: 54403

SEQ ID NO: 219652 - RNA, 64 nt, hsa; identical to SEQ ID NO: 54404

SEQ ID NO: 219653 - RNA, 64 nt, hsa; identical to SEQ ID NO: 54405

SEQ ID NO: 219654 - RNA, 64 nt, hsa; identical to SEQ ID NO: 54406

SEQ ID NO: 219655 - RNA, 64 nt, hsa; identical to SEQ ID NO: 54407

SEQ ID NO: 219656 - RNA, 64 nt, hsa; identical to SEQ ID NO: 54408

SEQ ID NO: 219657 - RNA, 64 nt, hsa; identical to SEQ ID NO: 54409

SEQ ID NO: 219658 - RNA, 64 nt, hsa; identical to SEQ ID NO: 54410

SEQ ID NO: 219659 - RNA, 64 nt, hsa; identical to SEQ ID NO: 54411

SEQ ID NO: 219660 - RNA, 64 nt, hsa; identical to SEQ ID NO: 54412

SEQ ID NO: 219661 - RNA, 64 nt, hsa; identical to SEQ ID NO: 54413

SEQ ID NO: 219662 - RNA, 64 nt, hsa; identical to SEQ ID NO: 54414

SEQ ID NO: 219663 - RNA, 64 nt, hsa; identical to SEQ ID NO: 54415

SEQ ID NO: 219664 - RNA, 64 nt, hsa; identical to SEQ ID NO: 54416

SEQ ID NO: 219665 - RNA, 64 nt, hsa; identical to SEQ ID NO: 54417

SEQ ID NO: 219666 - RNA, 64 nt, hsa; identical to SEQ ID NO: 54418

SEQ ID NO: 219667 - RNA, 64 nt, hsa; identical to SEQ ID NO: 54419

SEQ ID NO: 219668 - RNA, 64 nt, hsa; identical to SEQ ID NO: 54420

SEQ ID NO: 219669 - RNA, 64 nt, hsa; identical to SEQ ID NO: 54421

SEQ ID NO: 219670 - RNA, 64 nt, hsa; identical to SEQ ID NO: 54422

SEQ ID NO: 219671 - RNA, 64 nt, hsa; identical to SEQ ID NO: 54423

SEQ ID NO: 219672 - RNA, 64 nt, hsa; identical to SEQ ID NO: 54424

SEQ ID NO: 219673 - RNA, 64 nt, hsa; identical to SEQ ID NO: 54425

SEQ ID NO: 219674 - RNA, 64 nt, hsa; identical to SEQ ID NO: 54426

SEQ ID NO: 219675 - RNA, 64 nt, hsa; identical to SEQ ID NO: 54427

SEQ ID NO: 219676 - RNA, 64 nt, hsa; identical to SEQ ID NO: 54428

SEQ ID NO: 219677 - RNA, 64 nt, hsa; identical to SEQ ID NO: 54429

SEQ ID NO: 219678 - RNA, 64 nt, hsa; identical to SEQ ID NO: 54430

SEQ ID NO: 219679 - RNA, 64 nt, hsa; identical to SEQ ID NO: 54431

SEQ ID NO: 219680 - RNA, 64 nt, hsa; identical to SEQ ID NO: 54432

SEQ ID NO: 219681 - RNA, 64 nt, hsa; identical to SEQ ID NO: 54433

SEQ ID NO: 219682 - RNA, 64 nt, hsa; identical to SEQ ID NO: 54434

SEQ ID NO: 219683 - RNA, 64 nt, hsa; identical to SEQ ID NO: 54435

SEQ ID NO: 219684 - RNA, 64 nt, hsa; identical to SEQ ID NO: 54436

SEQ ID NO: 219685 - RNA, 64 nt, hsa; identical to SEQ ID NO: 54437

SEQ ID NO: 219686 - RNA, 64 nt, hsa; identical to SEQ ID NO: 54438

SEQ ID NO: 219687 - RNA, 64 nt, hsa; identical to SEQ ID NO: 54439

SEQ ID NO: 219688 - RNA, 64 nt, hsa; identical to SEQ ID NO: 54440

SEQ ID NO: 219689 - RNA, 64 nt, hsa; identical to SEQ ID NO: 54441

SEQ ID NO: 219690 - RNA, 64 nt, hsa; identical to SEQ ID NO: 54442

SEQ ID NO: 219691 - RNA, 64 nt, hsa; identical to SEQ ID NO: 54443

SEQ ID NO: 219692 - RNA, 64 nt, hsa; identical to SEQ ID NO: 54444

SEQ ID NO: 219693 - RNA, 64 nt, hsa; identical to SEQ ID NO: 54445

SEQ ID NO: 219694 - RNA, 64 nt, hsa; identical to SEQ ID NO: 54446

SEQ ID NO: 219695 - RNA, 64 nt, hsa; identical to SEQ ID NO: 54447

SEQ ID NO: 219696 - RNA, 64 nt, hsa; identical to SEQ ID NO: 54448

SEQ ID NO: 219697 - RNA, 64 nt, hsa; identical to SEQ ID NO: 54449

SEQ ID NO: 219698 - RNA, 64 nt, hsa; identical to SEQ ID NO: 54450

SEQ ID NO: 219699 - RNA, 64 nt, hsa; identical to SEQ ID NO: 54451

SEQ ID NO: 219700 - RNA, 64 nt, hsa; identical to SEQ ID NO: 54452

SEQ ID NO: 219701 - RNA, 58 nt, hsa; identical to SEQ ID NO: 54453

SEQ ID NO: 219702 - RNA, 64 nt, hsa; identical to SEQ ID NO: 54454

SEQ ID NO: 219703 - RNA, 64 nt, hsa; identical to SEQ ID NO: 54455

SEQ ID NO: 219704 - RNA, 64 nt, hsa; identical to SEQ ID NO: 54456

SEQ ID NO: 219705 - RNA, 64 nt, hsa; identical to SEQ ID NO: 54457

SEQ ID NO: 219706 - RNA, 64 nt, hsa; identical to SEQ ID NO: 54458

SEQ ID NO: 219707 - RNA, 64 nt, hsa; identical to SEQ ID NO: 54459

SEQ ID NO: 219708 - RNA, 64 nt, hsa; identical to SEQ ID NO: 54460

SEQ ID NO: 219709 - RNA, 64 nt, hsa; identical to SEQ ID NO: 54461

SEQ ID NO: 219710 - RNA, 64 nt, hsa; identical to SEQ ID NO: 54462

SEQ ID NO: 219711 - RNA, 64 nt, hsa; identical to SEQ ID NO: 54463

SEQ ID NO: 219712 - RNA, 64 nt, hsa; identical to SEQ ID NO: 54464

SEQ ID NO: 219713 - RNA, 53 nt, hsa; identical to SEQ ID NO: 54465

SEQ ID NO: 219714 - RNA, 64 nt, hsa; identical to SEQ ID NO: 54466

SEQ ID NO: 219715 - RNA, 64 nt, hsa; identical to SEQ ID NO: 54467

SEQ ID NO: 219716 - RNA, 64 nt, hsa; identical to SEQ ID NO: 54468

SEQ ID NO: 219717 - RNA, 64 nt, hsa; identical to SEQ ID NO: 54469

SEQ ID NO: 219718 - RNA, 64 nt, hsa; identical to SEQ ID NO: 54470

SEQ ID NO: 219719 - RNA, 64 nt, hsa; identical to SEQ ID NO: 54471

SEQ ID NO: 219720 - RNA, 64 nt, hsa; identical to SEQ ID NO: 54472

SEQ ID NO: 219721 - RNA, 64 nt, hsa; identical to SEQ ID NO: 54473

SEQ ID NO: 219722 - RNA, 64 nt, hsa; identical to SEQ ID NO: 54474

SEQ ID NO: 219723 - RNA, 64 nt, hsa; identical to SEQ ID NO: 54475

SEQ ID NO: 219724 - RNA, 64 nt, hsa; identical to SEQ ID NO: 54476

SEQ ID NO: 219725 - RNA, 64 nt, hsa; identical to SEQ ID NO: 54477

SEQ ID NO: 219726 - RNA, 64 nt, hsa; identical to SEQ ID NO: 54478

SEQ ID NO: 219727 - RNA, 64 nt, hsa; identical to SEQ ID NO: 54479

SEQ ID NO: 219728 - RNA, 64 nt, hsa; identical to SEQ ID NO: 54480

SEQ ID NO: 219729 - RNA, 64 nt, hsa; identical to SEQ ID NO: 54481

SEQ ID NO: 219730 - RNA, 64 nt, hsa; identical to SEQ ID NO: 54482

SEQ ID NO: 219731 - RNA, 64 nt, hsa; identical to SEQ ID NO: 54483

SEQ ID NO: 219732 - RNA, 64 nt, hsa; identical to SEQ ID NO: 54484

SEQ ID NO: 219733 - RNA, 64 nt, hsa; identical to SEQ ID NO: 54485

SEQ ID NO: 219734 - RNA, 64 nt, hsa; identical to SEQ ID NO: 54486

SEQ ID NO: 219735 - RNA, 64 nt, hsa; identical to SEQ ID NO: 54487

SEQ ID NO: 219736 - RNA, 64 nt, hsa; identical to SEQ ID NO: 54488

SEQ ID NO: 219737 - RNA, 64 nt, hsa; identical to SEQ ID NO: 54489

SEQ ID NO: 219738 - RNA, 64 nt, hsa; identical to SEQ ID NO: 54490

SEQ ID NO: 219739 - RNA, 64 nt, hsa; identical to SEQ ID NO: 54491

SEQ ID NO: 219740 - RNA, 64 nt, hsa; identical to SEQ ID NO: 54492

SEQ ID NO: 219741 - RNA, 64 nt, hsa; identical to SEQ ID NO: 54493

SEQ ID NO: 219742 - RNA, 64 nt, hsa; identical to SEQ ID NO: 54494

SEQ ID NO: 219743 - RNA, 64 nt, hsa; identical to SEQ ID NO: 54495

SEQ ID NO: 219744 - RNA, 64 nt, hsa; identical to SEQ ID NO: 54496

SEQ ID NO: 219745 - RNA, 64 nt, hsa; identical to SEQ ID NO: 54497

SEQ ID NO: 219746 - RNA, 64 nt, hsa; identical to SEQ ID NO: 54498

SEQ ID NO: 219747 - RNA, 64 nt, hsa; identical to SEQ ID NO: 54499

SEQ ID NO: 219748 - RNA, 64 nt, hsa; identical to SEQ ID NO: 54500

SEQ ID NO: 219749 - RNA, 64 nt, hsa; identical to SEQ ID NO: 54501

SEQ ID NO: 219750 - RNA, 64 nt, hsa; identical to SEQ ID NO: 54502

SEQ ID NO: 219751 - RNA, 64 nt, hsa; identical to SEQ ID NO: 54503

SEQ ID NO: 219752 - RNA, 64 nt, hsa; identical to SEQ ID NO: 54504

SEQ ID NO: 219753 - RNA, 64 nt, hsa; identical to SEQ ID NO: 54505

SEQ ID NO: 219754 - RNA, 64 nt, hsa; identical to SEQ ID NO: 54506

SEQ ID NO: 219755 - RNA, 64 nt, hsa; identical to SEQ ID NO: 54507

SEQ ID NO: 219756 - RNA, 64 nt, hsa; identical to SEQ ID NO: 54508

SEQ ID NO: 219757 - RNA, 64 nt, hsa; identical to SEQ ID NO: 54509

SEQ ID NO: 219758 - RNA, 64 nt, hsa; identical to SEQ ID NO: 54510

SEQ ID NO: 219759 - RNA, 64 nt, hsa; identical to SEQ ID NO: 54511

SEQ ID NO: 219760 - RNA, 64 nt, hsa; identical to SEQ ID NO: 54512

SEQ ID NO: 219761 - RNA, 64 nt, hsa; identical to SEQ ID NO: 54513

SEQ ID NO: 219762 - RNA, 64 nt, hsa; identical to SEQ ID NO: 54514

SEQ ID NO: 219763 - RNA, 64 nt, hsa; identical to SEQ ID NO: 54515

SEQ ID NO: 219764 - RNA, 64 nt, hsa; identical to SEQ ID NO: 54516

SEQ ID NO: 219765 - RNA, 64 nt, hsa; identical to SEQ ID NO: 54517

SEQ ID NO: 219766 - RNA, 64 nt, hsa; identical to SEQ ID NO: 54518

SEQ ID NO: 219767 - RNA, 64 nt, hsa; identical to SEQ ID NO: 54519

SEQ ID NO: 219768 - RNA, 64 nt, hsa; identical to SEQ ID NO: 54520

SEQ ID NO: 219769 - RNA, 64 nt, hsa; identical to SEQ ID NO: 54521

SEQ ID NO: 219770 - RNA, 64 nt, hsa; identical to SEQ ID NO: 54522

SEQ ID NO: 219771 - RNA, 64 nt, hsa; identical to SEQ ID NO: 54523

SEQ ID NO: 219772 - RNA, 64 nt, hsa; identical to SEQ ID NO: 54524

SEQ ID NO: 219773 - RNA, 64 nt, hsa; identical to SEQ ID NO: 54525

SEQ ID NO: 219774 - RNA, 64 nt, hsa; identical to SEQ ID NO: 54526

SEQ ID NO: 219775 - RNA, 64 nt, hsa; identical to SEQ ID NO: 54527

SEQ ID NO: 219776 - RNA, 64 nt, hsa; identical to SEQ ID NO: 54528

SEQ ID NO: 219777 - RNA, 64 nt, hsa; identical to SEQ ID NO: 54529

SEQ ID NO: 219778 - RNA, 64 nt, hsa; identical to SEQ ID NO: 54530

SEQ ID NO: 219779 - RNA, 64 nt, hsa; identical to SEQ ID NO: 54531

SEQ ID NO: 219780 - RNA, 64 nt, hsa; identical to SEQ ID NO: 54532

SEQ ID NO: 219781 - RNA, 64 nt, hsa; identical to SEQ ID NO: 54533

SEQ ID NO: 219782 - RNA, 64 nt, hsa; identical to SEQ ID NO: 54534

SEQ ID NO: 219783 - RNA, 64 nt, hsa; identical to SEQ ID NO: 54535

SEQ ID NO: 219784 - RNA, 64 nt, hsa; identical to SEQ ID NO: 54536

SEQ ID NO: 219785 - RNA, 64 nt, hsa; identical to SEQ ID NO: 54537

SEQ ID NO: 219786 - RNA, 64 nt, hsa; identical to SEQ ID NO: 54538

SEQ ID NO: 219787 - RNA, 64 nt, hsa; identical to SEQ ID NO: 54539

SEQ ID NO: 219788 - RNA, 64 nt, hsa; identical to SEQ ID NO: 54540

SEQ ID NO: 219789 - RNA, 64 nt, hsa; identical to SEQ ID NO: 54541

SEQ ID NO: 219790 - RNA, 64 nt, hsa; identical to SEQ ID NO: 54542

SEQ ID NO: 219791 - RNA, 64 nt, hsa; identical to SEQ ID NO: 54543

SEQ ID NO: 219792 - RNA, 64 nt, hsa; identical to SEQ ID NO: 54544

SEQ ID NO: 219793 - RNA, 64 nt, hsa; identical to SEQ ID NO: 54545

SEQ ID NO: 219794 - RNA, 64 nt, hsa; identical to SEQ ID NO: 54546

SEQ ID NO: 219795 - RNA, 64 nt, hsa; identical to SEQ ID NO: 54547

SEQ ID NO: 219796 - RNA, 64 nt, hsa; identical to SEQ ID NO: 54548

SEQ ID NO: 219797 - RNA, 64 nt, hsa; identical to SEQ ID NO: 54549

SEQ ID NO: 219798 - RNA, 64 nt, hsa; identical to SEQ ID NO: 54550

SEQ ID NO: 219799 - RNA, 64 nt, hsa; identical to SEQ ID NO: 54551

SEQ ID NO: 219800 - RNA, 64 nt, hsa; identical to SEQ ID NO: 54552

SEQ ID NO: 219801 - RNA, 64 nt, hsa; identical to SEQ ID NO: 54553

SEQ ID NO: 219802 - RNA, 64 nt, hsa; identical to SEQ ID NO: 54554

SEQ ID NO: 219803 - RNA, 64 nt, hsa; identical to SEQ ID NO: 54555

SEQ ID NO: 219804 - RNA, 64 nt, hsa; identical to SEQ ID NO: 54556

SEQ ID NO: 219805 - RNA, 64 nt, hsa; identical to SEQ ID NO: 54557

SEQ ID NO: 219806 - RNA, 64 nt, hsa; identical to SEQ ID NO: 54558

SEQ ID NO: 219807 - RNA, 64 nt, hsa; identical to SEQ ID NO: 54559

SEQ ID NO: 219808 - RNA, 64 nt, hsa; identical to SEQ ID NO: 54560

SEQ ID NO: 219809 - RNA, 64 nt, hsa; identical to SEQ ID NO: 54561

SEQ ID NO: 219810 - RNA, 64 nt, hsa; identical to SEQ ID NO: 54562

SEQ ID NO: 219811 - RNA, 64 nt, hsa; identical to SEQ ID NO: 54563

SEQ ID NO: 219812 - RNA, 64 nt, hsa; identical to SEQ ID NO: 54564

SEQ ID NO: 219813 - RNA, 64 nt, hsa; identical to SEQ ID NO: 54565

SEQ ID NO: 219814 - RNA, 64 nt, hsa; identical to SEQ ID NO: 54566

SEQ ID NO: 219815 - RNA, 64 nt, hsa; identical to SEQ ID NO: 54567

SEQ ID NO: 219816 - RNA, 64 nt, hsa; identical to SEQ ID NO: 54568

SEQ ID NO: 219817 - RNA, 64 nt, hsa; identical to SEQ ID NO: 54569

SEQ ID NO: 219818 - RNA, 64 nt, hsa; identical to SEQ ID NO: 54570

SEQ ID NO: 219819 - RNA, 64 nt, hsa; identical to SEQ ID NO: 54571

SEQ ID NO: 219820 - RNA, 64 nt, hsa; identical to SEQ ID NO: 54572

SEQ ID NO: 219821 - RNA, 64 nt, hsa; identical to SEQ ID NO: 54573

SEQ ID NO: 219822 - RNA, 64 nt, hsa; identical to SEQ ID NO: 54574

SEQ ID NO: 219823 - RNA, 64 nt, hsa; identical to SEQ ID NO: 54575

SEQ ID NO: 219824 - RNA, 64 nt, hsa; identical to SEQ ID NO: 54576

SEQ ID NO: 219825 - RNA, 64 nt, hsa; identical to SEQ ID NO: 54577

SEQ ID NO: 219826 - RNA, 64 nt, hsa; identical to SEQ ID NO: 54578

SEQ ID NO: 219827 - RNA, 64 nt, hsa; identical to SEQ ID NO: 54579

SEQ ID NO: 219828 - RNA, 64 nt, hsa; identical to SEQ ID NO: 54580

SEQ ID NO: 219829 - RNA, 64 nt, hsa; identical to SEQ ID NO: 54581

SEQ ID NO: 219830 - RNA, 64 nt, hsa; identical to SEQ ID NO: 54582

SEQ ID NO: 219831 - RNA, 64 nt, hsa; identical to SEQ ID NO: 54583

SEQ ID NO: 219832 - RNA, 64 nt, hsa
cugcccuuguugaguuuucucuuaaguaaaguccaaaguccaaggggcagauggccagaugcac

SEQ ID NO: 219833 - RNA, 64 nt, hsa
gggcuuucugcccuuguugaguuuucucuuaaguaaaguccaaaguccaaggggcagauggcca

SEQ ID NO: 219834 - RNA, 64 nt, hsa
gucccuuucuacugugguguuggagcaggacaauaaaguccacuagaaaugcaccccagaacca

SEQ ID NO: 219835 - RNA, 64 nt, hsa
ugaaaaaacugguccuuuggccuauccaugggucaaaguccaccucuccugggggccuggagag

SEQ ID NO: 219836 - RNA, 64 nt, hsa
uguuuuauccauucaacugaaaauugguaucaagaaaguccacugguuaguguacuaguccauc

SEQ ID NO: 219837 - RNA, 64 nt, hsa
ccaguuaugccuuccaagaggaacuucagacacaaaaguccacugaugcaaauuggacuggcga

SEQ ID NO: 219838 - RNA, 64 nt, hsa
gagcaagcaucuuccugacagcauuuugucaucuaaaguccagugacaugguuccccguggugg

SEQ ID NO: 219839 - RNA, 64 nt, hsa
ggaagaaugagacaauuuuguguaggcuuuuucuaaaguccaguacuuuguccagauuuuagau

SEQ ID NO: 219840 - RNA, 64 nt, hsa
gugugugugugucucuuugagcaucucucuucauuccuggaaugagccauggacaguaaaguug

SEQ ID NO: 219841 - RNA, 64 nt, hsa
gugugugugugugucuuugagcauuucucuucauuccuggaaugugugugugugugugucucuu

SEQ ID NO: 219842 - RNA, 64 nt, hsa
cccuguucagagguguggccaauuuaucccgaucuccuggaaggcuguugugauuuccaucuaa

SEQ ID NO: 219843 - RNA, 64 nt, hsa
gagaccccaaauuucucaccaauguuuugggagauccuggaaaagaucccuucaguuuggggug

SEQ ID NO: 219844 - RNA, 64 nt, hsa
uauucaucuuccuauccccagaaccuugcacagauccuggaaugugguaggugcucaguaaaug

SEQ ID NO: 219845 - RNA, 64 nt, hsa
aacaaggcacugucacugcccaccuccuugggccuccuggaacgccagggccucggcggcugcu

SEQ ID NO: 219846 - RNA, 64 nt, hsa
acuccaaguccugcccugccacccucggccucuguccuggaagccccaccccuuuccuccugua

SEQ ID NO: 219847 - RNA, 64 nt, hsa
aacaugucauuuugaaacuggauugauuugcauuuccuggaacucugccaccucauuucacaag

SEQ ID NO: 219848 - RNA, 64 nt, hsa
cccgcaaccccuccucucugugucccccgcccguuccuggaaacugagcuugacguuuguaaac

SEQ ID NO: 219849 - RNA, 64 nt, hsa
ugguugggggcuccuguuucucauccuagcuuuuuccuggaaagcccgcuagaagguuugggaa

SEQ ID NO: 219850 - RNA, 64 nt, hsa
augcauggccucuaagagugcccgugucgguucuuccuggaaguugacuuuccuuagacccgcc

SEQ ID NO: 219851 - RNA, 64 nt, hsa
uauucccuucugaucuuggaaagagguucugcacuccuggaaccggucacaggaacgcacagau

SEQ ID NO: 219852 - RNA, 64 nt, hsa
ccaucggggaaugacacacugcggugucugcagcuccuggaaggugucauuugacaacacaugu

SEQ ID NO: 219853 - RNA, 64 nt, hsa
cccuccuucccauuggcuuucucuccuuggccuuuccuggaagccaguuaguaaacuuccuauu

SEQ ID NO: 219854 - RNA, 64 nt, hsa
auauuuaggaaaaccucaagcaguaauuaauaucuccuggaacacuauagagaaccaagugacc

SEQ ID NO: 219855 - RNA, 64 nt, hsa
gcuuaccucuucuuugugaaaauacuaucucauuuccuggaaauaaaauguaaaaccugucagu

SEQ ID NO: 219856 - RNA, 64 nt, hsa
uuuguauugugguccuaaucuaagaucaggagaauccuggaauuguuaucugucucuugcucug

SEQ ID NO: 219857 - RNA, 64 nt, hsa
aaggcuagagaguugauuuuuuuuuuuuuuggcauccuggaaaugauacaggaaacauauuaag

SEQ ID NO: 219858 - RNA, 64 nt, hsa
uagucugaguucugguggggaauuuaaaaaugcauccuggaaauccuuuaaagauuucagacuu

SEQ ID NO: 219859 - RNA, 64 nt, hsa
cucaguuguaaaacaugaugucauccugcaugccuccuggaauucuccaauggggucgccaaac

SEQ ID NO: 219860 - RNA, 64 nt, hsa
uggcagcuguggcugcagcugugcuccugcucccuccuggaaugugcgacaagcccaaauguuc

SEQ ID NO: 219861 - RNA, 64 nt, hsa
acuaauaggacacauguaaauccuugaagacacauccuggaauucauaccccacaaggacagug

SEQ ID NO: 219862 - RNA, 64 nt, hsa
uguuuuugaugaucuaucuguauuggaaauauguuccuggaaaaugcauuuaaauaauaguaaa

SEQ ID NO: 219863 - RNA, 64 nt, hsa
gaaagggaugggagccacagugcccuucacucucuccuggaaaccaacuguaagcuggugggcu

SEQ ID NO: 219864 - RNA, 64 nt, hsa
acccugcuauccacagcccuggaggaacuggggcuccuggaaggaggaggaggcucuccacugu

SEQ ID NO: 219865 - RNA, 64 nt, hsa
uugcaccuuuccugaugcuuccagccaggagaaguccuggaauaagaguuaucaaccaaugugu

SEQ ID NO: 219866 - RNA, 64 nt, hsa
ccccagcugcagcuauccugacacagugcccuguuccuggaauguuucagauacagcugagccc

SEQ ID NO: 219867 - RNA, 64 nt, hsa
agugcccaagcagcuaaacuuggcuuccuucuaauccuggaaaacccuguaccccuccuccuca

SEQ ID NO: 219868 - RNA, 64 nt, hsa
cagaguggcgcuggggccucggcuucccuuuggcuccuggaaggcaggaggguccccugcccug

SEQ ID NO: 219869 - RNA, 64 nt, hsa
agcucucccucuggcccugccuucuucggggaacuccuggaaauaucaguuacucagcccuggg

SEQ ID NO: 219870 - RNA, 64 nt, hsa
auguuaaagucagugggaacgugacugccccaacuccuggaagcuguguccuugcaccugcauc

SEQ ID NO: 219871 - RNA, 64 nt, hsa
uguucaucaccugcccaccggagccgcaugcucuuccuggaacugcccacgucugcacagaaca

SEQ ID NO: 219872 - RNA, 64 nt, hsa
uucuuuggauuuguuuuguguuuuuguugacuaguccuggaaauguuugaggcuagacggggag

SEQ ID NO: 219873 - RNA, 64 nt, hsa
ggccccgcagggcgggcugcaacuuuucuguugauccuggaauguagcuggugcagugagaggg

SEQ ID NO: 219874 - RNA, 64 nt, hsa
ccgcagguggugcuggguggguuccgccaccuucuccuggaaggugagccuuuuccuggccaag

SEQ ID NO: 219875 - RNA, 64 nt, hsa
cgagagcagucugcauccugggaccagaaugcuuuccuggaaaaagaagccuuucagguuuccc

SEQ ID NO: 219876 - RNA, 64 nt, hsa
auggaaggccccaaggcccugaggggaucucaaauccuggaaccccgauuucaaucuacguucu

SEQ ID NO: 219877 - RNA, 64 nt, hsa
cacugucaccccuaauuuacagacaccaaaacaguccuggaagugcuaauuacaggacccccca

SEQ ID NO: 219878 - RNA, 64 nt, hsa
uuuuuccuuucuggcgcaugaauccauacaucauuccuggaagugaggcaagacucuugcaucu

SEQ ID NO: 219879 - RNA, 64 nt, hsa
acaauuuuuugucccuaauguucuuccuuuuacauccuggaacaacaauaaaaacauuuuuuua

SEQ ID NO: 219880 - RNA, 64 nt, hsa
gugugauggaggagggagaugccuggggaggggcuccuggaauccaggccagcccaacagcccu

SEQ ID NO: 219881 - RNA, 64 nt, hsa
ccagggguggagggggaaaaccaggcaauuucguuccuggaaucaaccaaaucauguuuuccuc

SEQ ID NO: 219882 - RNA, 64 nt, hsa
uggaagacauggauuuccuggaagacguggauuuuccuggaagaucuggauuugguggaagacc

SEQ ID NO: 219883 - RNA, 64 nt, hsa
uggaagaccuugaaauuauuggaagacauggauuuccuggaagacguggauuuuccuggaagau

SEQ ID NO: 219884 - RNA, 64 nt, hsa
uaguaaugugacaaacuaaaguuaauacaugaagcauugcaauauggaauuuugcacauuuuug

SEQ ID NO: 219885 - RNA, 64 nt, hsa
uugaaucguuaacauuauuuaaagacugaaaauucauugcaauuagggaacgcacagccucaca

SEQ ID NO: 219886 - RNA, 64 nt, hsa
uuuugaauucagauuuaaaaaccaacuuauaaagcauugcaacaagguuaccucuauuuugcca

SEQ ID NO: 219887 - RNA, 64 nt, hsa
aaaaaaaaaaggaaacuuuuuuuguuugcucuugcauugcaaaaauuauaaaguaauuuauuau

SEQ ID NO: 219888 - RNA, 64 nt, hsa
cuucuuuuggggguuggucagcaacuuugagugccauugcaagcagcaucauuuaaguaguuuu

SEQ ID NO: 219889 - RNA, 64 nt, hsa
uaagggugaugaguuugggaaagccuucagucaucauugcaaccuuauuaggcauuuuagaauc

SEQ ID NO: 219890 - RNA, 64 nt, hsa
uccaaauaaggauaccccucagggcucagcuagacauugcaauuuugcauagcuuuccaguucc

SEQ ID NO: 219891 - RNA, 64 nt, hsa
cuaauccuuacuauccuauuaggauaccacuuuucauugcaaaguuugugucaauaaagucauu

SEQ ID NO: 219892 - RNA, 64 nt, hsa
gaaaagcccaugcguggaguuccccuccuuucaacauugcaacaacaguaacaacaagacaacc

SEQ ID NO: 219893 - RNA, 64 nt, hsa
cccucucgcccucagagagguccaccugguuugucauugcaaugcuuuucauuuuuuuuuuuug

SEQ ID NO: 219894 - RNA, 64 nt, hsa
cugagcuaggauuagggaggguuauugccccaaccauugcaaugggagguggagggacaggcuc

SEQ ID NO: 219895 - RNA, 64 nt, hsa
gggaaguacagagugggauggucaggaccugggccauugcaaccaaaauggggacuuccugggu

SEQ ID NO: 219896 - RNA, 64 nt, hsa
guugauuacuacuuuaagugauauucauuuaaaacauugcaaauuuauuuuauuuauuuaauuu

SEQ ID NO: 219897 - RNA, 64 nt, hsa
gauuacaggcuugagccaccacgcccggcuaaaacauugcaaauuuaaaugagaguuuuaaaaa

SEQ ID NO: 219898 - RNA, 64 nt, hsa
cucuuugucuguaagcuugcucugggacucagccucuuaggaccuacgaugccagcagcucuca

SEQ ID NO: 219899 - RNA, 64 nt, hsa
cuacaaugugguaggcugaaacgaugguguuaauucuuaggacuacuuuucuagucacagaugu

SEQ ID NO: 219900 - RNA, 64 nt, hsa
aggcaucuguaagaaguagagaacccagaugaucucuuaggaagccuuuuauucgugggaacuc

SEQ ID NO: 219901 - RNA, 64 nt, hsa
uggcugugugacuuugaacacaucucuuagucccucuuaggaguacuuuccuuauuggcaacuu

SEQ ID NO: 219902 - RNA, 64 nt, hsa
agcuucaccguuaguaaucccucacuuuaauaccucuuaggaaccaaagaaugccucuacaagc

SEQ ID NO: 219903 - RNA, 64 nt, hsa
auccauauuguaccagaaugacuaugucuguguuucuuaggaauguugaagcuuuuugugaaaa

SEQ ID NO: 219904 - RNA, 64 nt, hsa
uuuucaguucuucauugaguuugauuauggaaauccauucaaagucacuaugaaaauuuuacuc

SEQ ID NO: 219905 - RNA, 64 nt, hsa
uuuggauacuuugaaagaugacagauuguuaaauccauucaaugguaaagaaacucaccaucug

SEQ ID NO: 219906 - RNA, 64 nt, hsa
ggcugaaagguuugaaauacguaccccaguaaaaccauucaaucaauaauugguaaauaauauu

SEQ ID NO: 219907 - RNA, 64 nt, hsa
gcguuguaacaggaaaaguuuucauuaacuccugccauucaaugauuaaugcaugauagggccu

SEQ ID NO: 219908 - RNA, 64 nt, hsa
aggaaaguacuggacuacccguggguaaguccugccauucaagacuggagacaccugggaaaua

SEQ ID NO: 219909 - RNA, 64 nt, hsa
aucuuugauccuuccauuucauuuauucauccauccauucaacaaguauuugcuaaacacuaac

SEQ ID NO: 219910 - RNA, 64 nt, hsa
uuauuuuauuuauuuuugaauccacuaucucuuuccauucaaaauauuuccauucaaaaugugg

SEQ ID NO: 219911 - RNA, 64 nt, hsa
uugaauccacuaucucuuuccauucaaaauauuuccauucaaaaugugguucacagacccgcca

SEQ ID NO: 219912 - RNA, 64 nt, hsa
ucuuuguaaagaaaguggcuugaaaucuuuuuuguucaaagauuaaugccaacucuuaagauua

SEQ ID NO: 219913 - RNA, 64 nt, hsa
gcccucuacugagucccuuagccaagcaguuucuuucaaagaagccagcaggcgaaaagcaggg

SEQ ID NO: 219914 - RNA, 64 nt, hsa
uuuauuuuuauuaacuuuuuucaguuucuuuuuauucaaagaaacaaaauucaaucucugauaa

SEQ ID NO: 219915 - RNA, 64 nt, hsa
uauccaagugacucuauugauguauguauguucauucaaagaaugggaaaaggauaugacauau

SEQ ID NO: 219916 - RNA, 64 nt, hsa
gccauucuccuucacugguuggcaaccuugagaguucaaagaaaaucaaccucuguggugguca

SEQ ID NO: 219917 - RNA, 64 nt, hsa
ucuuggcagugcuuuuucuuuagcauucugucaauucaaagaagggauccucuuucaaaggcua

SEQ ID NO: 219918 - RNA, 64 nt, hsa
agccaaccaacugaaaaccugagauggagauauguucaaagaaugagauacaauuuuuuaguuu

SEQ ID NO: 219919 - RNA, 64 nt, hsa
auguuugcugugcuuuucugaauuuuauguugcauucaaagacuguugucuuguucuuguggug

SEQ ID NO: 219920 - RNA, 64 nt, hsa
ugggcuuucucuugaucuuugugucauuucagaauucaaagacugugcuacgggaguucugaac

SEQ ID NO: 219921 - RNA, 64 nt, hsa
uggauauguugaaggguauuuguuaauuuuacuuuucaaagauacuuuaaaacaguagagcuag

SEQ ID NO: 219922 - RNA, 64 nt, hsa
aucagaggaaagcuuauuuucugcauggugucuuuucaaagauagaauauuugaagcauguuuu

SEQ ID NO: 219923 - RNA, 64 nt, hsa
augggcaaagagcuacuuugaauacauaauucucuucaaagacuucagcagcaaaccaaaacag

SEQ ID NO: 219924 - RNA, 64 nt, hsa
cagucucucauagaguauaaagcagcugucacacuucaaagagcagugagucuaauguagugaa

SEQ ID NO: 219925 - RNA, 64 nt, hsa
aaggaagaagaggaccucaaauuacaauugcaacuucaaagacagagagccaugagacuuuccc

SEQ ID NO: 219926 - RNA, 64 nt, hsa
auucagaagccuuguuauuuuaaaaaugaaauauuucaaagacugaauauuuucaaagaaaaug

SEQ ID NO: 219927 - RNA, 64 nt, hsa
uuuuaaaaaugaaauauuucaaagacugaauauuuucaaagaaaaugaauaauucauugcccuu

SEQ ID NO: 219928 - RNA, 64 nt, hsa
aggaaacuuaagaugugcaaggagauuuaaugauuucaaagaaaauaaugguucuuuguuuuua

SEQ ID NO: 219929 - RNA, 64 nt, hsa
ccauuuggaaaaaugaaauuuaguaguuccaaguuucaaagaaaugucaacauuuuauuccauu

SEQ ID NO: 219930 - RNA, 64 nt, hsa
ucuugugcugggacaggggauuacaccaucucuguucaaagagggggaaaugugccuaugccuu

SEQ ID NO: 219931 - RNA, 64 nt, hsa
uagacaagccaaauggcuggcagaugauguggauuucaaagagcccagaaugaacucaucacug

SEQ ID NO: 219932 - RNA, 64 nt, hsa
aaguuuaaguaaaaagugauacuccaccuuguguuucaaagaauuuaguuccaccucuucauac

SEQ ID NO: 219933 - RNA, 64 nt, hsa
uaauacaucuuagauuccuuauaucuaauaagaguucaaagaguuaugaguugaagucuugaau

SEQ ID NO: 219934 - RNA, 53 nt, hsa; identical to SEQ ID NO: 168469

SEQ ID NO: 219935 - RNA, 64 nt, hsa
aauuguaaaauaucacauaauauagaaauggcaguucaaagagaauuguggcagauguugugug

SEQ ID NO: 219936 - RNA, 64 nt, hsa
uagucauugugcauguuaaauuucuuucaaugcuuucaaagauaaauuccaauuucuauuuacu

SEQ ID NO: 219937 - RNA, 64 nt, hsa
ggguugcaaaucagaacuaaaauucuaagcacguuucaaagaugaacacuuuuguuaagacccc

SEQ ID NO: 219938 - RNA, 64 nt, hsa
uguuuauuaaugggccaaugcaaaaaaucauuuuuucaaagaaaaauuuguccauguaaagcuu

SEQ ID NO: 219939 - RNA, 64 nt, hsa
uugcuucaucauaagaauaauuuauaacuugaccuucaaagagauuagagcauuuguuucaucu

SEQ ID NO: 219940 - RNA, 64 nt, hsa
guuugagggaaauaugucccuagcaggaaaagaauucaaagagguucaaagaauaugucacuua

SEQ ID NO: 219941 - RNA, 64 nt, hsa
aauaugucccuagcaggaaaagaauucaaagagguucaaagaauaugucacuuacuccuacuug

SEQ ID NO: 219942 - RNA, 64 nt, hsa
uuuucuuucuuaacuuaaaggcauugguuauaaauucaaagagcuugaaaagauugaagagggc

SEQ ID NO: 219943 - RNA, 64 nt, hsa
uaguuaaauauuucaguguuguuugguguaagccuucaaagaaaaaacauaaaaagugggaagg

SEQ ID NO: 219944 - RNA, 64 nt, hsa
cucccaacccuguggugaucaggguuauguaauguucaaagauucagacacaccuggguuugga

SEQ ID NO: 219945 - RNA, 64 nt, hsa
auggcuuuuauaaacaucuuuuacuuuguuuugauucaaagaccaaacuagaacuuuaaaaguu

SEQ ID NO: 219946 - RNA, 64 nt, hsa
uaggggagaaccacgagagaagcauuaagugacuuucaaagacuuucagaguacagccacuugg

SEQ ID NO: 219947 - RNA, 64 nt, hsa
aaaaugacguuuguggcucuuucccaaguuggccuucaaagagccugccugcuguugagccaga

SEQ ID NO: 219948 - RNA, 64 nt, hsa
uguguaauuuuacauuucaugaaaugaugucaguuucaaagagaaaguggagaggaccuaacau

SEQ ID NO: 219949 - RNA, 64 nt, hsa
agaagacuccaccugugcuuggaauuccaugggcuucaaagaacauuucuucuuuuagcuuugg

SEQ ID NO: 219950 - RNA, 64 nt, hsa
augacuagaagaaaaaggagacaauaccauguuguucaaagaaacauugaaggaaauugggaug

SEQ ID NO: 219951 - RNA, 64 nt, hsa
aggcagaggggauucaaaugugugagaggcuagauucaaagacccucaguguucuauguuaucu

SEQ ID NO: 219952 - RNA, 64 nt, hsa
aaaauauugaaugcuuucuaacaaaacagaauauuucaaagaaauuagcaagcuucauuaaaga

SEQ ID NO: 219953 - RNA, 64 nt, hsa
ccaccauuuucauuugugcaguguauuuuuucuauucaaagaugcuuuugccaguuacaugcau

SEQ ID NO: 219954 - RNA, 64 nt, hsa
cuccaccuugggaccuguuuagagaagccggcucuucaaagacaauggaaacuguaccauacac

SEQ ID NO: 219955 - RNA, 64 nt, hsa
aguuuagaaauaauugaaaggaaauguuugaguuuucaaagaucccgugaaauugaugccagug

SEQ ID NO: 219956 - RNA, 64 nt, hsa
uuuccacugaaaacauuuuugucauauucuuguauucaaagaaaaaggaaaaaagauuauugua

SEQ ID NO: 219957 - RNA, 64 nt, hsa
aagacagauuuaaagugcccccacccccauuuguuucaaagaggucugcauguugggcgaaaac

SEQ ID NO: 219958 - RNA, 64 nt, hsa
aaauagauuagguuugcgggggucugagucuauguucaaagacugugaacagcuugcugucacu

SEQ ID NO: 219959 - RNA, 64 nt, hsa
gaauuuucaaggccuucaguuuauuuccacuauuuucaaagaaaauagauuagguuugcggggg

SEQ ID NO: 219960 - RNA, 64 nt, hsa
auaugugggaaagccuuuguuuauuucauuggauuucaaagacaugaaaggacucacacuaggg

SEQ ID NO: 219961 - RNA, 64 nt, hsa
caaugugggaaagccuucagugcuuccacuucccuucaaagacgugaaaccacucacagugcag

SEQ ID NO: 219962 - RNA, 64 nt, hsa
gaauguaggaaguccuucaauucuuugggaaaccuucaaagacacauggcagugcagcauggag

SEQ ID NO: 219963 - RNA, 64 nt, hsa
cuuaacauuaugagccuuuucugcucaaaaaauuuucaaagauuaaaacuauuauacauauaca

SEQ ID NO: 219964 - RNA, 64 nt, hsa
caagucuuuuuugcaaucuugaacuuucauuagcuucaaagagaagcuguauuuacaggagaaa

SEQ ID NO: 219965 - RNA, 64 nt, hsa
cuuaaacuuaaauauccaaagaugccuuuugaauuucaaagauuaaaacacagcuagaguagua

SEQ ID NO: 219966 - RNA, 64 nt, hsa
ucuacuguauguaugaaccgaauggaggaauguuuucaaagauugauuugguguggauugcaau

SEQ ID NO: 219967 - RNA, 64 nt, hsa
cuacauauuacauggguguaguguguugaggcuuuucaaagaagggucuagugagcuaaguuuc

SEQ ID NO: 219968 - RNA, 64 nt, hsa
uggaaagccaguuaccucaguggcuaccaacccauucaaagaggacauaugauucuuuccaaga

SEQ ID NO: 219969 - RNA, 64 nt, hsa
auauuucacaagcaauggaaaagcaguuaccucauucaaagaagacauaugacucuuuccaaga

SEQ ID NO: 219970 - RNA, 64 nt, hsa
agucauuuugauuuucaaagaagccguuuugauuuucaaagaagcagguucuggugacauuauu

SEQ ID NO: 219971 - RNA, 64 nt, hsa
cuuuuuucagaccauacaagaagucauuuugauuuucaaagaagccguuuugauuuucaaagaa

SEQ ID NO: 219972 - RNA, 64 nt, hsa; identical to SEQ ID NO: 168534

SEQ ID NO: 219973 - RNA, 64 nt, hsa; identical to SEQ ID NO: 168535

SEQ ID NO: 219974 - RNA, 64 nt, hsa; identical to SEQ ID NO: 168536

SEQ ID NO: 219975 - RNA, 64 nt, hsa; identical to SEQ ID NO: 168537

SEQ ID NO: 219976 - RNA, 64 nt, hsa; identical to SEQ ID NO: 168538

SEQ ID NO: 219977 - RNA, 64 nt, hsa; identical to SEQ ID NO: 168539

SEQ ID NO: 219978 - RNA, 64 nt, hsa; identical to SEQ ID NO: 168540

SEQ ID NO: 219979 - RNA, 64 nt, hsa; identical to SEQ ID NO: 168541

SEQ ID NO: 219980 - RNA, 64 nt, hsa; identical to SEQ ID NO: 168542

SEQ ID NO: 219981 - RNA, 64 nt, hsa; identical to SEQ ID NO: 168543

SEQ ID NO: 219982 - RNA, 64 nt, hsa; identical to SEQ ID NO: 168544

SEQ ID NO: 219983 - RNA, 64 nt, hsa; identical to SEQ ID NO: 168545

SEQ ID NO: 219984 - RNA, 64 nt, hsa
cuucacucuccucugauuagaugaaacuguuaccuuacccuaaacacaguauuucuuuuuaacu

SEQ ID NO: 219985 - RNA, 64 nt, hsa
uccuauucagcuccccaagaugauguguuuuugcuuacccuaagagagguuuucuucuuauuuu

SEQ ID NO: 219986 - RNA, 64 nt, hsa
ccauuacauaaugauuuugcccuuguuauaaauguuacccuaggaauuguuuuaaccauuuccu

SEQ ID NO: 219987 - RNA, 64 nt, hsa
aacagcucaaagcaccuucacaaguugccuugacuuacccuaggugggugugaaagagcacccg

SEQ ID NO: 219988 - RNA, 64 nt, hsa
auuuacuuugguauauuuuuacacuaaggacauuucaaauuaaguacuaaggcacaaagacaug

SEQ ID NO: 219989 - RNA, 64 nt, hsa
uuaugauuuccagaguuuuugagcuagaaggagaucaaauuacauuuauguuccuauauauuac

SEQ ID NO: 219990 - RNA, 64 nt, hsa
uaggaaggaaguggcauaguuuuaucaauaucugucaaauuaaacuucaaggcaaaacuuuuuu

SEQ ID NO: 219991 - RNA, 64 nt, hsa
acauuuagcuagauugaccacccccucaaaagacucaaauuacuagaaucagaaacaaaaguca

SEQ ID NO: 219992 - RNA, 64 nt, hsa
uuuucauauucacaagauauuaaauuaccaauuuucaaauuauuguuaguaaagaacaaaauga

SEQ ID NO: 219993 - RNA, 64 nt, hsa
aaggccuguagcucugguuguauacuuuugcuuuucaaauuauaguuuaucuucuguauaacug

SEQ ID NO: 219994 - RNA, 64 nt, hsa
cauuacaagguauggauuuuaaauggaugaaacuucaaauuaucuuauuuggauagaagucuau

SEQ ID NO: 219995 - RNA, 64 nt, hsa
ucaaacaucauggccucccauccaaucaacaucaucaaauuacauguguaaucaaggcucugug

SEQ ID NO: 219996 - RNA, 64 nt, hsa
uugccuuacauaucagcccucccacuucugaaguucaaauuagugccucggaaauguagaauuu

SEQ ID NO: 219997 - RNA, 64 nt, hsa
guauaauuguuaaucacuuugcaaauaggggcuaucaaauuaccuauauuggcauugcuggauu

SEQ ID NO: 219998 - RNA, 64 nt, hsa
uuuaugacuucuacguucaguuacaaguaugcugucaaauuaucguggguugaaacuuguuaaa

SEQ ID NO: 219999 - RNA, 64 nt, hsa
aauaguaacaagguauauuauacuuucauuacaaucaaauuauagaaauuacuuguguaaaagg

SEQ ID NO: 220000 - RNA, 64 nt, hsa
aaauuauugucaacuuguucucuuccauuuucauucaaauuaacuuugacuccuggaaguauug

SEQ ID NO: 220001 - RNA, 64 nt, hsa
uaaacgucauucagcccuagaagcaugaauugcuucaaauuauugucaacuuguucucuuccau

SEQ ID NO: 220002 - RNA, 64 nt, hsa
acuuuauucuguuuaaaauguacuuaagaagucaucaaauuagugaacugagacauuggccuua

SEQ ID NO: 220003 - RNA, 64 nt, hsa
cauuauuaguaguaaacuuuuacaaaucccauuuucaaauuacuuuuagaucuuaaaauuuuca

SEQ ID NO: 220004 - RNA, 64 nt, hsa
uaaauggaaauguuuacaccugaagugaguauuuucaaauuaaaauuuaauuaagugauuuucu

SEQ ID NO: 220005 - RNA, 64 nt, hsa
uguuauuauucauauuaacaaaucugaaaauaugucaaauuacguguuuuuaugaccauguaau

SEQ ID NO: 220006 - RNA, 64 nt, hsa; identical to SEQ ID NO: 220005

SEQ ID NO: 220007 - RNA, 64 nt, hsa; identical to SEQ ID NO: 220004

SEQ ID NO: 220008 - RNA, 64 nt, hsa
cccagagggcgcucagccaagcuuagagcagcuaucaaauuauaaguuaucaucaucuuauucu

SEQ ID NO: 220009 - RNA, 64 nt, hsa
uuaaauguguguuauacugauaaaauuucaucuuucaaauuauagucuauuauuuuaaagggau

SEQ ID NO: 220010 - RNA, 64 nt, hsa
aacauggaauuucuuuuaggugcagugguggucuucaaauuacauuaguuuuuuuuauauauau

SEQ ID NO: 220011 - RNA, 64 nt, hsa
ggagacuaccuuuuuagauuuuuuuuauuauauaucaaauuauaguuguauauacuuaugagaa

SEQ ID NO: 220012 - RNA, 64 nt, hsa
gggauucaaaaggugucacaguccacuuaauuagucaaauuagcaauggcuaaacaguaucaag

SEQ ID NO: 220013 - RNA, 64 nt, hsa
gccuuacaacuuacaggcaucagaaaauaaguaaucaaauuagguaccuggaaacauagcuauu

SEQ ID NO: 220014 - RNA, 64 nt, hsa
agaagaaaaauuauuaaacaacucauuuuaagauucaaauuaacuaauuccugcauauaugaca

SEQ ID NO: 220015 - RNA, 64 nt, hsa
ucuccaguugauucaagaaacucauuacuuugccucaaauuauauguaaaauauuuguuuuacu

SEQ ID NO: 220016 - RNA, 64 nt, hsa
gcauuuccuuauucuuuaguguaauuguaauuuuucaaauuaaauguguauauaucucuacacu

SEQ ID NO: 220017 - RNA, 64 nt, hsa
gaaaaagggaagaucauagcuaauuuauaauagcucaaauuacuaauuuaauaacugggucacc

SEQ ID NO: 220018 - RNA, 64 nt, hsa
auugcccagccugggaaucuuuucuuugugggaaucaaauuacaagcuauuuaaguuuauauuc

SEQ ID NO: 220019 - RNA, 64 nt, hsa
acagagcccaccugaucaagaucaucagcuaccuucaaauuauugaccuggacaggguccaagu

SEQ ID NO: 220020 - RNA, 64 nt, hsa; identical to SEQ ID NO: 128804

SEQ ID NO: 220021 - RNA, 64 nt, hsa; identical to SEQ ID NO: 128805

SEQ ID NO: 220022 - RNA, 64 nt, hsa; identical to SEQ ID NO: 128806

SEQ ID NO: 220023 - RNA, 64 nt, hsa; identical to SEQ ID NO: 128807

SEQ ID NO: 220024 - RNA, 64 nt, hsa; identical to SEQ ID NO: 128808

SEQ ID NO: 220025 - RNA, 64 nt, hsa; identical to SEQ ID NO: 128809

SEQ ID NO: 220026 - RNA, 64 nt, hsa; identical to SEQ ID NO: 128810

SEQ ID NO: 220027 - RNA, 64 nt, hsa; identical to SEQ ID NO: 128811

SEQ ID NO: 220028 - RNA, 64 nt, hsa; identical to SEQ ID NO: 128812

SEQ ID NO: 220029 - RNA, 64 nt, hsa; identical to SEQ ID NO: 128813

SEQ ID NO: 220030 - RNA, 64 nt, hsa; identical to SEQ ID NO: 128814

SEQ ID NO: 220031 - RNA, 64 nt, hsa; identical to SEQ ID NO: 128815

SEQ ID NO: 220032 - RNA, 64 nt, hsa; identical to SEQ ID NO: 128816

SEQ ID NO: 220033 - RNA, 64 nt, hsa; identical to SEQ ID NO: 128817

SEQ ID NO: 220034 - RNA, 64 nt, hsa; identical to SEQ ID NO: 128818

SEQ ID NO: 220035 - RNA, 64 nt, hsa; identical to SEQ ID NO: 128819

SEQ ID NO: 220036 - RNA, 64 nt, hsa; identical to SEQ ID NO: 128820

SEQ ID NO: 220037 - RNA, 64 nt, hsa; identical to SEQ ID NO: 128821

SEQ ID NO: 220038 - RNA, 64 nt, hsa; identical to SEQ ID NO: 128822

SEQ ID NO: 220039 - RNA, 64 nt, hsa; identical to SEQ ID NO: 128823

SEQ ID NO: 220040 - RNA, 64 nt, hsa; identical to SEQ ID NO: 128824

SEQ ID NO: 220041 - RNA, 64 nt, hsa; identical to SEQ ID NO: 128825

SEQ ID NO: 220042 - RNA, 64 nt, hsa; identical to SEQ ID NO: 128826

SEQ ID NO: 220043 - RNA, 64 nt, hsa; identical to SEQ ID NO: 128827

SEQ ID NO: 220044 - RNA, 62 nt, hsa
cgcccuggcccuuggguuagccgccucccggccagcgccaucucccgcccuuggugcugccc

SEQ ID NO: 220045 - RNA, 64 nt, hsa
uuggugcugcccccgggcgguaccugcucucucccagcgccacuuggccucuuccucuccuccu

SEQ ID NO: 220046 - RNA, 64 nt, hsa
gcagagaggagcugacaggguaccugcuccgggccagcgccaucugcuccaaguugggccuggc

SEQ ID NO: 220047 - RNA, 64 nt, hsa
agcugguggcccuccaagggcagcauccacccugcagcgccaaugaggaucugcugcaccugcu

SEQ ID NO: 220048 - RNA, 64 nt, hsa
ugguagaaaaaucaaauaccuuagagauuaugaagucauuaauuuauacugaaauuggauugac

SEQ ID NO: 220049 - RNA, 64 nt, hsa
uuaagccugagccauauucucacaugcaagugaagucauuaaagaacuuuacauaugugagaua

SEQ ID NO: 220050 - RNA, 64 nt, hsa
agacauuugcacaaucuaaaauguaagcaaaguagucauuaaaaauacacccucuacuugggcu

SEQ ID NO: 220051 - RNA, 64 nt, hsa
aucuaaauaaauggcuuucaaacaaagcaacugggucauuaaaaccagcucaaaggggguuuaa

SEQ ID NO: 220052 - RNA, 64 nt, hsa
uaauaacuaaccuuuagguaaaaaauuuacuucugucauuaauuacacuucaacuggucaauau

SEQ ID NO: 220053 - RNA, 64 nt, hsa
uaauauuuguuggcugggccacguaacuugauuagucauuaaaaaucuuguacguauauaauuc

SEQ ID NO: 220054 - RNA, 64 nt, hsa
accucacuucccacuugcuauugaauugugaauagucauuaaaaaccugugauaccaaaucuuc

SEQ ID NO: 220055 - RNA, 64 nt, hsa
aaaaaaauggugucuuaagugcuuaguguuugaugucauuaacaguuucguaaaacucuacagu

SEQ ID NO: 220056 - RNA, 64 nt, hsa; identical to SEQ ID NO: 189120

SEQ ID NO: 220057 - RNA, 64 nt, hsa; identical to SEQ ID NO: 189121

SEQ ID NO: 220058 - RNA, 64 nt, hsa; identical to SEQ ID NO: 189122

SEQ ID NO: 220059 - RNA, 64 nt, hsa; identical to SEQ ID NO: 189123

SEQ ID NO: 220060 - RNA, 64 nt, hsa; identical to SEQ ID NO: 189124

SEQ ID NO: 220061 - RNA, 64 nt, hsa; identical to SEQ ID NO: 189125

SEQ ID NO: 220062 - RNA, 64 nt, hsa; identical to SEQ ID NO: 189126

SEQ ID NO: 220063 - RNA, 64 nt, hsa; identical to SEQ ID NO: 189127

SEQ ID NO: 220064 - RNA, 64 nt, hsa; identical to SEQ ID NO: 189128

SEQ ID NO: 220065 - RNA, 64 nt, hsa; identical to SEQ ID NO: 189129

SEQ ID NO: 220066 - RNA, 64 nt, hsa; identical to SEQ ID NO: 189130

SEQ ID NO: 220067 - RNA, 64 nt, hsa; identical to SEQ ID NO: 189131

SEQ ID NO: 220068 - RNA, 64 nt, hsa; identical to SEQ ID NO: 189132

SEQ ID NO: 220069 - RNA, 64 nt, hsa; identical to SEQ ID NO: 189133

SEQ ID NO: 220070 - RNA, 64 nt, hsa; identical to SEQ ID NO: 189134

SEQ ID NO: 220071 - RNA, 64 nt, hsa; identical to SEQ ID NO: 189135

SEQ ID NO: 220072 - RNA, 64 nt, hsa; identical to SEQ ID NO: 189136

SEQ ID NO: 220073 - RNA, 64 nt, hsa; identical to SEQ ID NO: 189137

SEQ ID NO: 220074 - RNA, 64 nt, hsa; identical to SEQ ID NO: 189138

SEQ ID NO: 220075 - RNA, 64 nt, hsa; identical to SEQ ID NO: 189139

SEQ ID NO: 220076 - RNA, 64 nt, hsa; identical to SEQ ID NO: 189140

SEQ ID NO: 220077 - RNA, 64 nt, hsa; identical to SEQ ID NO: 189141

SEQ ID NO: 220078 - RNA, 64 nt, hsa; identical to SEQ ID NO: 189142

SEQ ID NO: 220079 - RNA, 64 nt, hsa; identical to SEQ ID NO: 189143

SEQ ID NO: 220080 - RNA, 64 nt, hsa; identical to SEQ ID NO: 189144

SEQ ID NO: 220081 - RNA, 64 nt, hsa; identical to SEQ ID NO: 189145

SEQ ID NO: 220082 - RNA, 64 nt, hsa; identical to SEQ ID NO: 189146

SEQ ID NO: 220083 - RNA, 64 nt, hsa; identical to SEQ ID NO: 189147

SEQ ID NO: 220084 - RNA, 64 nt, hsa; identical to SEQ ID NO: 189148

SEQ ID NO: 220085 - RNA, 64 nt, hsa; identical to SEQ ID NO: 189149

SEQ ID NO: 220086 - RNA, 64 nt, hsa; identical to SEQ ID NO: 189150

SEQ ID NO: 220087 - RNA, 64 nt, hsa; identical to SEQ ID NO: 189151

SEQ ID NO: 220088 - RNA, 64 nt, hsa; identical to SEQ ID NO: 189152

SEQ ID NO: 220089 - RNA, 64 nt, hsa; identical to SEQ ID NO: 189153

SEQ ID NO: 220090 - RNA, 64 nt, hsa; identical to SEQ ID NO: 189154

SEQ ID NO: 220091 - RNA, 64 nt, hsa; identical to SEQ ID NO: 189155

SEQ ID NO: 220092 - RNA, 64 nt, hsa; identical to SEQ ID NO: 189156

SEQ ID NO: 220093 - RNA, 64 nt, hsa; identical to SEQ ID NO: 189157

SEQ ID NO: 220094 - RNA, 64 nt, hsa; identical to SEQ ID NO: 189158

SEQ ID NO: 220095 - RNA, 64 nt, hsa; identical to SEQ ID NO: 189159

SEQ ID NO: 220096 - RNA, 64 nt, hsa; identical to SEQ ID NO: 189160

SEQ ID NO: 220097 - RNA, 64 nt, hsa; identical to SEQ ID NO: 189161

SEQ ID NO: 220098 - RNA, 64 nt, hsa; identical to SEQ ID NO: 189162

SEQ ID NO: 220099 - RNA, 64 nt, hsa; identical to SEQ ID NO: 189163

SEQ ID NO: 220100 - RNA, 64 nt, hsa; identical to SEQ ID NO: 189164

SEQ ID NO: 220101 - RNA, 64 nt, hsa; identical to SEQ ID NO: 189165

SEQ ID NO: 220102 - RNA, 64 nt, hsa; identical to SEQ ID NO: 189166

SEQ ID NO: 220103 - RNA, 64 nt, hsa; identical to SEQ ID NO: 189167

SEQ ID NO: 220104 - RNA, 64 nt, hsa; identical to SEQ ID NO: 189168

SEQ ID NO: 220105 - RNA, 64 nt, hsa; identical to SEQ ID NO: 189169

SEQ ID NO: 220106 - RNA, 64 nt, hsa; identical to SEQ ID NO: 189170

SEQ ID NO: 220107 - RNA, 64 nt, hsa; identical to SEQ ID NO: 189171

SEQ ID NO: 220108 - RNA, 64 nt, hsa; identical to SEQ ID NO: 189172

SEQ ID NO: 220109 - RNA, 64 nt, hsa; identical to SEQ ID NO: 189173

SEQ ID NO: 220110 - RNA, 64 nt, hsa; identical to SEQ ID NO: 189174

SEQ ID NO: 220111 - RNA, 64 nt, hsa; identical to SEQ ID NO: 189175

SEQ ID NO: 220112 - RNA, 64 nt, hsa; identical to SEQ ID NO: 189176

SEQ ID NO: 220113 - RNA, 64 nt, hsa; identical to SEQ ID NO: 189177

SEQ ID NO: 220114 - RNA, 64 nt, hsa; identical to SEQ ID NO: 189178

SEQ ID NO: 220115 - RNA, 64 nt, hsa; identical to SEQ ID NO: 189179

SEQ ID NO: 220116 - RNA, 64 nt, hsa; identical to SEQ ID NO: 189180

SEQ ID NO: 220117 - RNA, 64 nt, hsa; identical to SEQ ID NO: 189181

SEQ ID NO: 220118 - RNA, 64 nt, hsa; identical to SEQ ID NO: 189182

SEQ ID NO: 220119 - RNA, 64 nt, hsa; identical to SEQ ID NO: 189183

SEQ ID NO: 220120 - RNA, 64 nt, hsa; identical to SEQ ID NO: 189184

SEQ ID NO: 220121 - RNA, 64 nt, hsa
ugguucuuucuaaucuuaaacuuccuggugagcauugccccagccacacuuucucccugguuuu

SEQ ID NO: 220122 - RNA, 64 nt, hsa
ucuuugucucugugguugggugggaugauaaacauugccccagucucucuguugagccugcuug

SEQ ID NO: 220123 - RNA, 64 nt, hsa
acauuugccaagaaauuuucccuguuuggaaaguuugccccagcuuucccgggcacaccaccuu

SEQ ID NO: 220124 - RNA, 64 nt, hsa
gccgcucaguuccaggcuuuugcccaggucacuguugccccauguucggagaaccuggcccacc

SEQ ID NO: 220125 - RNA, 64 nt, hsa
uagagauguuuuauaguuacaugagcaaaagcuguugccccaaagugauggcccuggaggcggg

SEQ ID NO: 220126 - RNA, 64 nt, hsa
uuuauuuuuaaaacuggaucugggguauauucauuugccccaucaccucugucuaaaggcccaa

SEQ ID NO: 220127 - RNA, 64 nt, hsa
ucaucuccacuccaccugaccacccacccgcugcuugccccaucuauuuaugucuccgcuuugu

SEQ ID NO: 220128 - RNA, 64 nt, hsa
aacugcauuuccuggggccaggugggagcugccuuugccccacugccuccccuguucugcucuc

SEQ ID NO: 220129 - RNA, 64 nt, hsa
uguguuccugaucccacauaagcaugucucauccuugccccacuggugagaggaggaccuugug

SEQ ID NO: 220130 - RNA, 64 nt, hsa
cuuggggccaccucugccuccagcaggcuugagcuugccccaggccuugggcauaauuauuucc

SEQ ID NO: 220131 - RNA, 64 nt, hsa
cagugcaauggcccuccugccacuucagcacaccuugccccaccugggaccaucacacgugaag

SEQ ID NO: 220132 - RNA, 64 nt, hsa
agcccaggccuccaugaaggagaaccugguggcauugccccagagcucuccagagaugagccuc

SEQ ID NO: 220133 - RNA, 62 nt, hsa
acgccuuuccaaaucugaaggacuucaucucccgcuuugagggcuuggagaagaucucugcc

SEQ ID NO: 220134 - RNA, 62 nt, hsa
ccagugagccuccuugaacaugcuuauuccaacgcuuugaggggcuggaagccuugacacau

SEQ ID NO: 220135 - RNA, 62 nt, hsa
guccacagcccgagaccgaggacgagaagaagcgcuuugaggaaggcaaagggcgguaccug

SEQ ID NO: 220136 - RNA, 62 nt, hsa
cucuccaaagcaaauucacaugcauuaugagucgcuuugagcuucugacaugucacuugccc

SEQ ID NO: 220137 - RNA, 62 nt, hsa
cacccuucccuguggccuuaugagcucagccucgcuuugagguacccaccguccugucagcu

SEQ ID NO: 220138 - RNA, 62 nt, hsa
gguguaacaacauuuaauugcauguccucuaacgcuuugaaaccuuuagagggaagauccuc

SEQ ID NO: 220139 - RNA, 62 nt, hsa
gagccgaugcggugaggagaagcgucaggcggcgcuuugaugaucagaacuugcguucuguu

SEQ ID NO: 220140 - RNA, 62 nt, hsa
gaagggguccagaugggaaugcacacaaccuccgcuuugaagggauggagaggcaguacgca

SEQ ID NO: 220141 - RNA, 62 nt, hsa
gagaaaccacgugaauguaaugaaugugggaacgcuuugaucagaggaugcauauuauucag

SEQ ID NO: 220142 - RNA, 62 nt, hsa
acauggaguucccgugcaccuacggaaggggacgcuuugaaggaaccaagugcauuuuuauc

SEQ ID NO: 220143 - RNA, 62 nt, hsa
aggaagggguugcuguccaguguuggccuggucgcuuugauucuuccugcacagcucagccc

SEQ ID NO: 220144 - RNA, 62 nt, hsa
ccaguuuuauaaauggucuuuauuuugaaauacgcuuugaccccauguucauaaaacugaau

SEQ ID NO: 220145 - RNA, 62 nt, hsa
acggggaccugaaggauggagaggcuggaccccgcuuugaagagggugcagccugggaaggg

SEQ ID NO: 220146 - RNA, 62 nt, hsa
auuuacauucacugucaguaaagaccuggcuacgcuuugagaaaucaggaucuccuagguca

SEQ ID NO: 220147 - RNA, 62 nt, hsa
aguugacuugagagaagggcugaucucagagccgcuuugagcuaaguuggauuagucacacu

SEQ ID NO: 220148 - RNA, 62 nt, hsa
uucuuguaaagagugagaaaaaaaaucaaaggcgcuuugaaacaggggcucucugugcaagg

SEQ ID NO: 220149 - RNA, 62 nt, hsa
caaacccuguucaggcuggcucguaggccugccgcuuugauggaggagguauuguaagcuuu

SEQ ID NO: 220150 - RNA, 62 nt, hsa
agaagcaggaccccuacuugcugaagacaggccgcuuugaagaggcggcgggugccgcgccg

SEQ ID NO: 220151 - RNA, 62 nt, hsa
ggacuacauuuugcucugugaacuauccccugcgcuuugaacgugccagcagcccuuguuua

SEQ ID NO: 220152 - RNA, 62 nt, hsa
ugugauacagccuacauaaagacuguuaugaucgcuuugauuuuaaaguucauuggaacuac

SEQ ID NO: 220153 - RNA, 62 nt, hsa
ggcacaagacucgugacaucacacacuucauucgcuuugaggcccugcuuuaaccuuaaguu

SEQ ID NO: 220154 - RNA, 62 nt, hsa
aaauguaacuguuaccgaguuaaauguuuuuccgcuuugagggauguaaccacauccacuca

SEQ ID NO: 220155 - RNA, 62 nt, hsa
uauugugcauauggcagacccugcccagcgugcgcuuugauacagcaaauggagcagcugac

SEQ ID NO: 220156 - RNA, 62 nt, hsa
ucuccuugauuuuggguaccauguauauuuuccgcuuugacuuuaacgcuuucuaggauagg

SEQ ID NO: 220157 - RNA, 62 nt, hsa
cuggaggccccuuccaaaccucaaguguccggcgcuuugauugccugaguuucugacacuuc

SEQ ID NO: 220158 - RNA, 62 nt, hsa
aaucaccugggaaaauaccagaaaaugagggccgcuuugagucccccagagaugucaucaga

SEQ ID NO: 220159 - RNA, 62 nt, hsa
uccuguaguguguaaauguguugcccucugcccgcuuugauacauaaacuuuugcaggaaug

SEQ ID NO: 220160 - RNA, 62 nt, hsa
gggaaacauuagugaaaauucuguuggugccacgcuuugaugagcauuuguuugaccccagu

SEQ ID NO: 220161 - RNA, 62 nt, hsa
aauucaaggucauuauuauuguacaaaauaagcgcuuugauuaacacagcuauauaguuuuu

SEQ ID NO: 220162 - RNA, 62 nt, hsa
ccagugugacacuaagcauuuuguucacaccacgcuuugauaacuaaacuggaaaacaaagg

SEQ ID NO: 220163 - RNA, 62 nt, hsa
cuuguuuucaugagacaauaauccgaaaaguucgcuuugauauauuccuggagggccaagcc

SEQ ID NO: 220164 - RNA, 62 nt, hsa
agagaagccagccacagaccccugggagcuuccgcuuugaaagaagcaagacacguggccuc

SEQ ID NO: 220165 - RNA, 62 nt, hsa
uucucuucugucucugcccccaccccaugcagcgcuuugaggaauuggaaaagaaccugcug

SEQ ID NO: 220166 - RNA, 62 nt, hsa
aacaaaagaacuaguccucuuagaauuucuugcgcuuugauuuuuuuagggcuugugcccug

SEQ ID NO: 220167 - RNA, 62 nt, hsa
augaaugggcacauuuuacugcacacuucagacgcuuugacuuuuuuaaaaaaauuguuucu

SEQ ID NO: 220168 - RNA, 62 nt, hsa
uuaccacggagauccucaagucacugguggcucgcuuugaugcuggagaacuaaucacccag

SEQ ID NO: 220169 - RNA, 62 nt, hsa
gacuuccuccaggcgcugugcccccaggagcucgcuuugaccccuuuggacccauugggacc

SEQ ID NO: 220170 - RNA, 62 nt, hsa
ucuaaauuuaucaguaccuaaguaagauguagcgcuuugaauaugaaaucauaggugaagac

SEQ ID NO: 220171 - RNA, 62 nt, hsa
ucgcucccaccgagggacuagcuuggccuuugcgcuuugauuccagauaguaagaugagugg

SEQ ID NO: 220172 - RNA, 62 nt, hsa
ccccuuauuuuuaagacaucaggaagccagaccgcuuugaguugggagaauuuuguagcuca

SEQ ID NO: 220173 - RNA, 62 nt, hsa
cccaucugccuuucuuucccccagcccccacccgcuuugaauguagagacccgugggcacuu

SEQ ID NO: 220174 - RNA, 62 nt, hsa
aacuuuauauugaagcuguauuuuaauaugaccgcuuugaauccuuacaugaaauguucugg

SEQ ID NO: 220175 - RNA, 62 nt, hsa
auugaauuuucugaauuuggguggagcagagucgcuuugaagccuuguuccgaucuaauucu

SEQ ID NO: 220176 - RNA, 62 nt, hsa
guuguagagcuggaacgagugcagaguaggaacgcuuugaugcgcaugcacauuggggaaga

SEQ ID NO: 220177 - RNA, 62 nt, hsa
caucgugauaggaaggccuaagaauggcaaaucgcuuugagauauaauauugaacuucagua

SEQ ID NO: 220178 - RNA, 62 nt, hsa
auuuuggauuguauauuguguuuguguauuuacgcuuugauucauaguaacuucuuauggaa

SEQ ID NO: 220179 - RNA, 64 nt, hsa
acgcaucaaauuugauucucagagcaauaaauuauccaugaagugcucucguucucaguagcgg

SEQ ID NO: 220180 - RNA, 64 nt, hsa
gugaccuaucaagacauucauagcauucaggccuuccaugaacagaucgucauugcaguuaaag

SEQ ID NO: 220181 - RNA, 64 nt, hsa
agaggcuuuaaaauuuaaaaccucagcaaaauaauccaugaauuuacugauucuucuguaucgu

SEQ ID NO: 220182 - RNA, 64 nt, hsa
augaguuuugucucagcaggauagaauaagcaaauccaugaacuggucuucuauuaauacuuug

SEQ ID NO: 220183 - RNA, 64 nt, hsa
ucuacaugguuuucuuuuucuuaguaugggaguguccaugaauaaauucaugggcauccucaua

SEQ ID NO: 220184 - RNA, 64 nt, hsa
ccaugaauaaauucaugggcauccucauaacucuuccaugaauggcaagggguacuuauggaaa

SEQ ID NO: 220185 - RNA, 64 nt, hsa
uagaagcaguuagagcaauguguuugaaauuauguccaugaaaucacagggaucucugaaauau

SEQ ID NO: 220186 - RNA, 64 nt, hsa
gagaagccaacacuugauagcacuacuuggaguuuccaugaauaagauggagaaagcucauugu

SEQ ID NO: 220187 - RNA, 64 nt, hsa
ucaauauugaauucugcccaggagcaugaacugauccaugaaugccuuuuccagguuaaaauuu

SEQ ID NO: 220188 - RNA, 64 nt, hsa
uccugccuuaaaaaaaaaaaaaaaaucccaauaguccaugaaggcuuugaucucuugggaaguu

SEQ ID NO: 220189 - RNA, 64 nt, hsa
ccucuccuauccucuugccauaugaauagcguuuuccaugaaauaggaaaauauuacuugguau

SEQ ID NO: 220190 - RNA, 64 nt, hsa
ggaguuguuuuaaaagacauaaucacuuugaacuuccaugaaaccugucuuccaccacaacaac

SEQ ID NO: 220191 - RNA, 64 nt, hsa
cagccucauuuggacuaaaaaaagaaagcagaaauccaugaacacauugcuucucggccuuuug

SEQ ID NO: 220192 - RNA, 64 nt, hsa
uucucggccuuuuggcuaagaucaaguguagaaauccaugaacacuaaaggacuucauugauuu

SEQ ID NO: 220193 - RNA, 64 nt, hsa
uuauaaaaguauuaauuuggggaacuaauaaauguccaugaaaccuucacaauccauguuuuuc

SEQ ID NO: 220194 - RNA, 64 nt, hsa
aucacaaggguauugacuggggaagugauaaguguccaugaaaucuuuacaauuuauguuuaga

SEQ ID NO: 220195 - RNA, 64 nt, hsa
ucucuucucacuucuguuaagauggcugauauaguccaugaaucccacucaugaucucuuuauc

SEQ ID NO: 220196 - RNA, 64 nt, hsa
ccauggaugauuaauuacucaaaacuacaagucccaagcaaagugaacuauuuguuccuggaag

SEQ ID NO: 220197 - RNA, 64 nt, hsa
ugcuaugagcaucagcuuacuuugucacuuagagcaagcaaaacccagugcaagagucucguuc

SEQ ID NO: 220198 - RNA, 64 nt, hsa
aguucugaaccuauaguaucuuuuacccuguucccaagcaaagacuggugacuuuaucugaaaa

SEQ ID NO: 220199 - RNA, 64 nt, hsa
guacaucagacuuuuaaaaucuguaauauacaagcaagcaaaauuauuuuaaaugacuuaauug

SEQ ID NO: 220200 - RNA, 64 nt, hsa
guccuuuagcucaauugauagggucagcgucucgcaagcaaaaaaucucaugaccucauauuug

SEQ ID NO: 220201 - RNA, 64 nt, hsa
uaaagcauuccucagaacugucccauuugaagggcaagcaaaccugggguauuuauccacugac

SEQ ID NO: 220202 - RNA, 61 nt, hsa
aacuggccaaugaaauuugaacaucacuaaacaagcaaauggaaugacuuuggaccauauc

SEQ ID NO: 220203 - RNA, 64 nt, hsa
gcuugauguuguagaaacugggacauauagauaccaagcaaaauuauaagaaaccuauaaggug

SEQ ID NO: 220204 - RNA, 64 nt, hsa
uuguagauugagcugaauaaccaugggaagugaccaagcaaagacacucgauuggagucaguug

SEQ ID NO: 220205 - RNA, 64 nt, hsa
gagcaguugugaaaauugcuaauggugccaaggccaagcaaagaguuucagaaaaugacugaga

SEQ ID NO: 220206 - RNA, 64 nt, hsa
ucaccuggagaaaaggaacguugcucuuggacagcaagcaaaccauuucucuccgucuguucug

SEQ ID NO: 220207 - RNA, 64 nt, hsa
caccaucacaaucucacccaaacuccugcucacucaagcaaaagcagccucuggccuucccucc

SEQ ID NO: 220208 - RNA, 64 nt, hsa
uuaugguuacuaugauuguuauuauuuguccaaucaagcaaagcaccauuauuucuaacauaua

SEQ ID NO: 220209 - RNA, 64 nt, hsa
ugcuuauauauuuucauauucuaacuugucuuuucaagcaaauaacuaauauauaugugcaugc

SEQ ID NO: 220210 - RNA, 64 nt, hsa
uuacacuacuagauuggguauuuugcuaaauuaccaagcaaagcagacaaucuuuuucuugaaa

SEQ ID NO: 220211 - RNA, 64 nt, hsa
aaugcauuauguuuuacaaagauaucuaaggauccaagcaaacuacuuuaagcaaauauuugua

SEQ ID NO: 220212 - RNA, 64 nt, hsa
agacucuguggaguuuguucagugguacgguguccaagcaaacagcagaaugcaacuuucuaaa

SEQ ID NO: 220213 - RNA, 64 nt, hsa
agcaaacagcagaaugcaacuuucuaaacagccccaagcaaacagcagaauucaacuuuuuaaa

SEQ ID NO: 220214 - RNA, 64 nt, hsa
gugaucacggauguuggcucccccucgcccuaugcaagcaaacacacucucaccuccucuccca

SEQ ID NO: 220215 - RNA, 64 nt, hsa
caucccaagguucaauaaggccuuauuuaacaagcaagcaaaaugcaaaccaaaccauuauuca

SEQ ID NO: 220216 - RNA, 64 nt, hsa
uuuucguaaucuucaucaagaaguuuuuaaaaggcaagcaaaaacagaagcaaaucauaucaaa

SEQ ID NO: 220217 - RNA, 64 nt, hsa
aggcuccaucccuggcuuccccagccugcggccgcaagcaaaaccaagcgcgagaugcagcuag

SEQ ID NO: 220218 - RNA, 64 nt, hsa
uuguauuuuuauguccaaacuuuuccauuuuagauuccuuuauagacacgucagccuaaaaauc

SEQ ID NO: 220219 - RNA, 64 nt, hsa
auuccauuauuauauuuugcgcuuggcauauuuauuccuuuaugcuuuuaaucacuaacauauu

SEQ ID NO: 220220 - RNA, 64 nt, hsa
aucacuuguaaaaauugucagugcuugaagcuguuuccuuuacucacauugaagggacuucguu

SEQ ID NO: 220221 - RNA, 64 nt, hsa
gucacucguaaaaacugucagugcuugaaacuguuuccuuuacucauguugaagggacuuuguu

SEQ ID NO: 220222 - RNA, 64 nt, hsa
gagggugugauaguaaggaaggccacuguuagguuuccuuuagaaauaaagagaucucagcagc

SEQ ID NO: 220223 - RNA, 64 nt, hsa
gaaaaaaacuuuagaguucaguugauccaacacuuuccuuuaaaaguugagggagcagaggccc

SEQ ID NO: 220224 - RNA, 64 nt, hsa
ggaguuuaagauauagcuguagaggugguuuuaauuccuuuagaugucucauaaaaugagacuu

SEQ ID NO: 220225 - RNA, 64 nt, hsa
caacugcacgggacauuguuuuugagaaguucuuuuccuuuauauaggcuuccaacaccaaaua

SEQ ID NO: 220226 - RNA, 64 nt, hsa
aaaaauauauauguauauauugcauauucacuuuuuccuuuagguagagaugauuucaauccaa

SEQ ID NO: 220227 - RNA, 64 nt, hsa
aucaacugagccaaaugucugugugcaauuguguuuccuuuaccuuguaaaauuuuguacagca

SEQ ID NO: 220228 - RNA, 64 nt, hsa
gaaugaacauguaauaauuuguuuaggucaauuuuuccuuuacuuuuuuaauuuaaaaauuguu

SEQ ID NO: 220229 - RNA, 64 nt, hsa
caauaacuuaccuaguagagauuuagugaguuguuuccuuuaaagaauuuuacacuacauauuu

SEQ ID NO: 220230 - RNA, 64 nt, hsa
cacuacauauuuuaauaguaaacagggaucacuuuuccuuuagcauucagaaugacaccauauu

SEQ ID NO: 220231 - RNA, 64 nt, hsa
uucauacuugaagacggauauaaaggaagaauauuuccuuuauguguuucuccagaauggugcc

SEQ ID NO: 220232 - RNA, 64 nt, hsa
uugauaguuuaaguguguucuuaccgccuccuuuuuccuuuaaucuuauuuuugaugaacacau

SEQ ID NO: 220233 - RNA, 64 nt, hsa
agaugacccauuauguccuaguuaaucaucauuuuuccuuuaguuuaauuuuauaaacaaaacu

SEQ ID NO: 220234 - RNA, 64 nt, hsa
ucuuuuucuuuuuucuuuuuccuuuuuuuuuuuuuuccuuuauguucucaccguuugaaugcau

SEQ ID NO: 220235 - RNA, 64 nt, hsa
uugauuugagaagaaaucuggcugguuugaggguuuccuuuaguucacccucauacucucagga

SEQ ID NO: 220236 - RNA, 64 nt, hsa
uuuucuuauuagcacauuugagaaaaauauuccuuuccuuuauuguaguaaaucuauuaaaggc

SEQ ID NO: 220237 - RNA, 64 nt, hsa
uagagaauaaacagccacacacacauuuuuuuuuuuccuuuaaaacaguaacuuggaaauauga

SEQ ID NO: 220238 - RNA, 64 nt, hsa
auuuuuuuucuugaauuucgcuguuuucuucugcuuccuuuagauaaaaagcagcucaagagac

SEQ ID NO: 220239 - RNA, 64 nt, hsa
cuaaaaaggucuuauacucaagagugggguagucuuccuuuaauuuuguuaccaauacgcuuua

SEQ ID NO: 220240 - RNA, 64 nt, hsa
gguaaggaauuuaagaacuggaugagguuauuucuuccuuuacucuucaaaauguauuuuugau

SEQ ID NO: 220241 - RNA, 64 nt, hsa
ucagugagcuaggaaagcaccaaucgauauuuguuuccuuuagggauacuuuguucucaccacu

SEQ ID NO: 220242 - RNA, 64 nt, hsa
acauuuuuggaaacuaaucucuuuuccguaauauuuccuuuauuucaaugauucucagaaggcc

SEQ ID NO: 220243 - RNA, 64 nt, hsa
cuguugagcugguuuuugagucauagaucuuggcuuccuuuagaagccacuuaacuuccauaca

SEQ ID NO: 220244 - RNA, 64 nt, hsa
acuucuauggcuuccagggucuucuuacaaugcauuccuuuaacuugucccuggaagcauugcu

SEQ ID NO: 220245 - RNA, 64 nt, hsa
gauagugaaacagcuuucuggguaauucaccaauuuccuuuaaaacauaagcuaccugaaugga

SEQ ID NO: 220246 - RNA, 64 nt, hsa
agggaggaccuguuguguuccagccauucugguauuccuuuauguaucuaauuucauucaaacc

SEQ ID NO: 220247 - RNA, 64 nt, hsa
uuuuuuuuaguuuuaaaccaccaaaccaauauuuuuccuuuaaauuuuaaucuuauaauauaga

SEQ ID NO: 220248 - RNA, 64 nt, hsa
aaccaaacaaacccaggccugaugggaaaaaugauuccuuuauucuagcaacuuacuuucuguu

SEQ ID NO: 220249 - RNA, 64 nt, hsa
ggcaaaaucaccuucccuuuaccagggaaaucacuuccuuuaggacugaaagcuaggcguccuc

SEQ ID NO: 220250 - RNA, 64 nt, hsa
ggucugcuggagacgccugaaagacaguuccaucuuccuuuagacuccagccuuggcaaaauca

SEQ ID NO: 220251 - RNA, 64 nt, hsa
aguuauuuuagcuuuugaaaguguuuuaaaagauuuccuuuaucggacaggaccaucuuuauga

SEQ ID NO: 220252 - RNA, 64 nt, hsa
caaaaagccauaauaauaaguauaaaaaagcuuuuuccuuuacaauuucauguuaaucugguuu

SEQ ID NO: 220253 - RNA, 64 nt, hsa
uuugaacaaauaaauaaaagcuuucuguaguugcuuccuuuaucagaaaagaacauuugauacc

SEQ ID NO: 220254 - RNA, 64 nt, hsa
uacuggugaacagugguuaauaaauaguuuuauauuccuuuaugcaauuauuagacuuuuuucu

SEQ ID NO: 220255 - RNA, 64 nt, hsa
uucugggagaugucauuuuccaucucccgauuacuuccuuuacgucuagcaguaugugccgaga

SEQ ID NO: 220256 - RNA, 64 nt, hsa
uguguagcacacacucaucauggauugcucagaguuccuuuagggcagagcugagggccuggga

SEQ ID NO: 220257 - RNA, 64 nt, hsa
ggucaaaauauucagaugagacauuuggcaugucuuccuuuauucacugauauuuucuacccau

SEQ ID NO: 220258 - RNA, 64 nt, hsa
aauaucagugaaauauuuugagaucuuugaauaauuccuuuagaggaauuauacaaaauuaaua

SEQ ID NO: 220259 - RNA, 64 nt, hsa
agagaaauguuugccuuauguauauucccuuuauuuccuuuaccuuuuguuuuuccuuggaccu

SEQ ID NO: 220260 - RNA, 64 nt, hsa
uaacaaagaggaaugagccaggagaacaaacuaauuccuuuaaauaaauaaaaaaaaaaaaugc

SEQ ID NO: 220261 - RNA, 64 nt, hsa
augacaauccccuuugauuccucagaaucuggccuuccuuuauagcacuggucauauuguauug

SEQ ID NO: 220262 - RNA, 64 nt, hsa
auucacuugaaacuuguccauaugaguaucuuuauuccuuuauuaacuuagggcagauauaaaa

SEQ ID NO: 220263 - RNA, 64 nt, hsa
uuuucccacuuuccuucugucucuccuuccucccuuccuuuacaguuuaaaaaaaaaaucuaaa

SEQ ID NO: 220264 - RNA, 64 nt, hsa
ucuaagcauucuuuuuuuuuuccuaguugaugccuuccuuuauuacaaaucaguauuaaaacuu

SEQ ID NO: 220265 - RNA, 64 nt, hsa
auagucauguugggcuaacagucaauuggauauauuccuuuaccucacaugaccccagcaacug

SEQ ID NO: 220266 - RNA, 64 nt, hsa
ugcccaugugucaggaguggcugucucuggucucuuccuuuagcugacaaggacacuccugagg

SEQ ID NO: 220267 - RNA, 64 nt, hsa
ggugcaaggcagggaggcagagagaauguugugcuuccuuuagcuuuuguauuucgauggccag

SEQ ID NO: 220268 - RNA, 64 nt, hsa
gauaccauucaccgccuucagcccagaugauacuuuccuuuaaaucugugucucuguguguaua

SEQ ID NO: 220269 - RNA, 64 nt, hsa
aguuaacucugcugccaucuuguuuuuuuuuuuuuuccuuuauuuugauaagugauuauuaugc

SEQ ID NO: 220270 - RNA, 64 nt, hsa
auaguauugucugacuuuuuauuuucuacuaugguuccuuuagcagaaaaguaacuuuugugca

SEQ ID NO: 220271 - RNA, 64 nt, hsa
auuccuuuauuuuuauaaauuauucccccuaucauuccuuuacagugccuagugcuacucauua

SEQ ID NO: 220272 - RNA, 64 nt, hsa
aguuguaagcuccuugagagcaggauccaugucauuccuuuauuuuuauaaauuauucccccua

SEQ ID NO: 220273 - RNA, 64 nt, hsa
caugcuuccagugauuugucuccguaaugccuucuuccuuuauuuggccuuucuuucuuucugu

SEQ ID NO: 220274 - RNA, 64 nt, hsa
uuauuccauuuucuucuggucaccagaugauuucuuccuuuaccaucaaauacuucuucauaau

SEQ ID NO: 220275 - RNA, 64 nt, hsa
auguguauuaaugucuaacuacauacgcaaaaacuuccuuuacagagguucggacuaacauuuc

SEQ ID NO: 220276 - RNA, 64 nt, hsa
uuucacuuuuuucuucugccauccacccucauuuuuccuuuagcaagauuuuuauaucuaacuu

SEQ ID NO: 220277 - RNA, 64 nt, hsa
ucaaaauaaguguaauccacgguagcagccacacuuccuuuagaaggaacuguuauaauuuauu

SEQ ID NO: 220278 - RNA, 64 nt, hsa
acaacuuuaccaggguuuuggcauuuccuuuccuuuccuuuauaaaacaugcucagcaaacugc

SEQ ID NO: 220279 - RNA, 64 nt, hsa
uacacagcaauaauuacaguaaauuaaauaaagauuccuuuaaggcagacaagggcuaagauuu

SEQ ID NO: 220280 - RNA, 64 nt, hsa
gcacugcuuuauaauaaaaugaaauauauucuacuuccuuuauuuugugguuuacacgguuguc

SEQ ID NO: 220281 - RNA, 64 nt, hsa
ccaggcuuugugcugagugcuguacauguauuaguuccuuuacugcugaccacauuguacccau

SEQ ID NO: 220282 - RNA, 64 nt, hsa
aaagucuugucggagucugcacaggagagaggccuuccuuuaacaaaaguaugauugacagaaa

SEQ ID NO: 220283 - RNA, 64 nt, hsa
ccguugggaaguccaugcugaugauugugaaaaguuccuuuaaaacuagaagcuucaaagaauc

SEQ ID NO: 220284 - RNA, 64 nt, hsa
aaugaaauuugccuugucuuauuccacuaguuuauuccuuuaacaacaauauuuuauguguguc

SEQ ID NO: 220285 - RNA, 64 nt, hsa
auuuuugcagccugggaucucccuacuccauuuuuuccuuuaauuuaaguggccacauguauau

SEQ ID NO: 220286 - RNA, 64 nt, hsa
ucaguauuuaccaaaguguaucugauuuuaaaaauuccuuuagucuguaaaacuccuagaggga

SEQ ID NO: 220287 - RNA, 64 nt, hsa
ugcuuuucggcuccuagaauccuuagagucugaauuccuuuagcugggaacagcugucaugguc

SEQ ID NO: 220288 - RNA, 64 nt, hsa
auaugaccaucuguugcucaacaauacuguuuuuuuccuuuaguaguuuaccauaagggaauuu

SEQ ID NO: 220289 - RNA, 64 nt, hsa
guuuuuuuccuuuaguaguuuaccauaagggaauuuccuuuaagucaaccaugauuucuccuug

SEQ ID NO: 220290 - RNA, 64 nt, hsa
auuuggagcagaguuguuuguuuuuguuguuuguuuccuuuaagaaaaaccacagggaccaaga

SEQ ID NO: 220291 - RNA, 64 nt, hsa
caccauauaauagaaauacccaauuauauucuaguuccuuuauguccuguacaucauucucugc

SEQ ID NO: 220292 - RNA, 64 nt, hsa
caagcaauccaugaucuauacacauaagcauaauuuccuuuaguucuaguuagucaucagagaa

SEQ ID NO: 220293 - RNA, 64 nt, hsa
cagauauaagacuuuccccaacaaugugauuggauuccuuuauggcaaaaucgagagaagcugc

SEQ ID NO: 220294 - RNA, 64 nt, hsa
uaaaguaaacaagugaccagcagcccacagaugauuccuuuauauagauguauaaugauucaaa

SEQ ID NO: 220295 - RNA, 64 nt, hsa
cucuguaccugcagcucugcucucgggauggugcuuccuuuaucuugaaggguggcacauguuu

SEQ ID NO: 220296 - RNA, 64 nt, hsa
uuacaugaagauuugguuuuugucuugcauuuuuuuccuuuaugugacgcuggaccuuuucuuu

SEQ ID NO: 220297 - RNA, 64 nt, hsa
agcuucaccacuuguccauugcguuauuuucuuuuuccuuuauaauucuuucuuuuuccuucau

SEQ ID NO: 220298 - RNA, 64 nt, hsa
ccuuuuacuuuucagugucuucugagaaaccaccaggcuugaagguaaugaaacugucauuuau

SEQ ID NO: 220299 - RNA, 64 nt, hsa
ccuuuuacuuuucagugucuucugagaaaccaccaggcuugaagguaaugaaacugucguuuau

SEQ ID NO: 220300 - RNA, 64 nt, hsa
ucacuuucuaugucuaccucaaagaauuguugugaggcuugagauaaugcauuuguaaaggguc

SEQ ID NO: 220301 - RNA, 64 nt, hsa
gcguaguccgcuuucucuugcugccacauucuaaaggcuugauauuuuccaaauggauccuguu

SEQ ID NO: 220302 - RNA, 64 nt, hsa
ggugggcccucaguggugaagcaccgcugcccucaggcuugaggggugcuuggggccaggcuac

SEQ ID NO: 220303 - RNA, 64 nt, hsa
guacauaaaccucagacucucccccucucaacaaaggcuugaugcaccaggccugacuuugucu

SEQ ID NO: 220304 - RNA, 64 nt, hsa
aucguuuguuagaguuauagauuuaugauuucauaggcuugauucuaugugaaauaucuuuuua

SEQ ID NO: 220305 - RNA, 64 nt, hsa
gaccuguuugcugaaguguucauaagauaacaauaggcuugaaucuccaauucaaaugaauguc

SEQ ID NO: 220306 - RNA, 64 nt, hsa
cuucaggaucuuuaguauuuuccugguucugaggaggcuugagacaggguuauggauuuccuug

SEQ ID NO: 220307 - RNA, 64 nt, hsa
aguguuuuguuaggugguaugaaccaaugugaggaggcuugagacaggguuauggauuuccaga

SEQ ID NO: 220308 - RNA, 64 nt, hsa
ggugcagaagcauacaucuuuauaaaaaauauggaggcuugaguuaugaaacacuuuuauaagg

SEQ ID NO: 220309 - RNA, 64 nt, hsa
gaugugugacuuucacaguugucaccauggacuuaggcuugauuaaaaugcuacacauuuagag

SEQ ID NO: 220310 - RNA, 64 nt, hsa; identical to SEQ ID NO: 216223

SEQ ID NO: 220311 - RNA, 64 nt, hsa; identical to SEQ ID NO: 216224

SEQ ID NO: 220312 - RNA, 64 nt, hsa; identical to SEQ ID NO: 216225

SEQ ID NO: 220313 - RNA, 64 nt, hsa; identical to SEQ ID NO: 216226

SEQ ID NO: 220314 - RNA, 64 nt, hsa; identical to SEQ ID NO: 216227

SEQ ID NO: 220315 - RNA, 64 nt, hsa; identical to SEQ ID NO: 216228

SEQ ID NO: 220316 - RNA, 64 nt, hsa; identical to SEQ ID NO: 216229

SEQ ID NO: 220317 - RNA, 64 nt, hsa; identical to SEQ ID NO: 216230

SEQ ID NO: 220318 - RNA, 64 nt, hsa; identical to SEQ ID NO: 216231

SEQ ID NO: 220319 - RNA, 64 nt, hsa; identical to SEQ ID NO: 216232

SEQ ID NO: 220320 - RNA, 64 nt, hsa; identical to SEQ ID NO: 216233

SEQ ID NO: 220321 - RNA, 64 nt, hsa; identical to SEQ ID NO: 216234

SEQ ID NO: 220322 - RNA, 64 nt, hsa
uuuacaucaaaaagcuuuuagaaaaugguacgagguaaccaauucuugucauggugaaaucuga

SEQ ID NO: 220323 - RNA, 64 nt, hsa
guaaccaauucuugucauggugaaaucugauugaguaaccaagcaguuuuacuauucuggugcu

SEQ ID NO: 220324 - RNA, 64 nt, hsa
gguguuggaugucaaugaugauuuuucugaggaaguaaccaaacaagaagaccucaugagagag

SEQ ID NO: 220325 - RNA, 64 nt, hsa
ccuucccacagguaaacaccuuuguaaagaaucuguaaccaauaccaugaaguucaggcuguga

SEQ ID NO: 220326 - RNA, 64 nt, hsa
acgacuucuuccucgacaucuuccuccucuacugguaaccaaggcaaucaggccuaccagaauc

SEQ ID NO: 220327 - RNA, 64 nt, hsa
guaccaaagcuguuuuuauagcacauagaugucuguaaccaauaauguagcaguucugcacuuu

SEQ ID NO: 220328 - RNA, 64 nt, hsa
acuagaagugcgcaugaaggaugcuucaugcccuguuccccacacagagaagagaugaagaggg

SEQ ID NO: 220329 - RNA, 64 nt, hsa
accaccgccaccgagagccccgccuccagcagccguuccccagggggcaggaaguaggcucccc

SEQ ID NO: 220330 - RNA, 64 nt, hsa
caggaccuuuuuaaagcuccccaagugauucuacguuccccaaguuugaggaccacuuuucugu

SEQ ID NO: 220331 - RNA, 64 nt, hsa
acccgcccugagauuugguaaagaacacugccuuguuccccaucaguaaacaagguuaccuacc

SEQ ID NO: 220332 - RNA, 64 nt, hsa
agacuuuguccuguagccuccacuucugcccuaaguuccccagcauccugacuaccugucugca

SEQ ID NO: 220333 - RNA, 64 nt, hsa
acauucucucucucucucucucucugucuaucuaguuccccagcuuggagagccuuuccccuug

SEQ ID NO: 220334 - RNA, 64 nt, hsa
cugaggccaacuuauggcagagggcggcgccuggguuccccaggcaccuguuggcacgugacag

SEQ ID NO: 220335 - RNA, 64 nt, hsa
uggugcagggccccuccacgcccacucuucccuuguuccccagaaguagagggcucugggugcc

SEQ ID NO: 220336 - RNA, 64 nt, hsa
uuggcuucugccuguuggggucucauuccuuucuguuccccagugccccggggcggcauuuuac

SEQ ID NO: 220337 - RNA, 64 nt, hsa
gaggaggaacggugggggugggcagucacugccuguuccccacugccuguguucgcaggagcca

SEQ ID NO: 220338 - RNA, 64 nt, hsa
gcauccuguccuccagccacccuugcuugccacuguuccccaugacgagagccuccugucugca

SEQ ID NO: 220339 - RNA, 64 nt, hsa
ucuguagauagcagaggacacccuccaaacacugguuccccacugcccugugccuuccggcccc

SEQ ID NO: 220340 - RNA, 64 nt, hsa
gagcuggucagcguuucgucucuuuaacugacauguuccccagugcuguuugaacuguugaguu

SEQ ID NO: 220341 - RNA, 64 nt, hsa
cgaugccagucugugugccgugaugccgcacuguguuccccaugacagugguccaucaucgugc

SEQ ID NO: 220342 - RNA, 64 nt, hsa
ggcacuugggguuucugggaaugacaucaucucuguuccccauccccaguaguuuacauuccug

SEQ ID NO: 220343 - RNA, 64 nt, hsa
gggucacagcaacaugcccuggccuuucugcucuguuccccaaccccacugaggccugcugcac

SEQ ID NO: 220344 - RNA, 64 nt, hsa
agguuguggccuuugcgcuccuggcccagccuuuguuccccacuggagcagaaggggagaugga

SEQ ID NO: 220345 - RNA, 64 nt, hsa
cucuuccuggcccgcacccccauccccagucccuguuccccaagaggauacagagcacggugcu

SEQ ID NO: 220346 - RNA, 64 nt, hsa
cgggagggaacuccaggggaagugaggggagaagguuccccagggacagaguuagggaaagagu

SEQ ID NO: 220347 - RNA, 64 nt, hsa
gccaaaggaaccugugcaagacacuggcucagcaguuccccaggccacaguaucagcaagauaa

SEQ ID NO: 220348 - RNA, 64 nt, hsa
guauaagaauaacaaucugcuagucugucauuucuggagugauacuuuuuuuuuugagacggag

SEQ ID NO: 220349 - RNA, 64 nt, hsa
ugggauuauaggcgugagccaccgcgcccagcccuggagugauacuuuuuauggaagacaaaag

SEQ ID NO: 220350 - RNA, 64 nt, hsa
auucccugcaccucgaggccgcugcgggccaaucuggagugaaacacggggaccugaaggaugg

SEQ ID NO: 220351 - RNA, 64 nt, hsa
gcuccgccucaucagcuaugugaagggguguguguggagugauccugccgcccccucccugggc

SEQ ID NO: 220352 - RNA, 64 nt, hsa
gcccccagauguuccugggcuggguaaaagcagcuggagugaagcacucauuuuccauaaaggu

SEQ ID NO: 220353 - RNA, 64 nt, hsa
gaguuggaagugauuucagcacauucuuuuuuaguggagugaaaguucugaagcccccuuuuaa

SEQ ID NO: 220354 - RNA, 64 nt, hsa
agggugaagacugaggcuaggugccagaauggacuggagugaaggcgugucuagagugugggcu

SEQ ID NO: 220355 - RNA, 64 nt, hsa
cucaggagguccaggccucuaaggcuucucucccuggagugaggguggaggugagggagagcug

SEQ ID NO: 220356 - RNA, 64 nt, hsa
uugacuaauuucacaugcucuaaaaaccuucaaaggugauuauuuuucuccuggaaacuccagg

SEQ ID NO: 220357 - RNA, 64 nt, hsa
uugguucagggugauaacuacuuagcacugcccuggugauuacccagagauaucuaugaaaacc

SEQ ID NO: 220358 - RNA, 64 nt, hsa
uguuucauuaaauaauagggaaauauccauuuaaaacagguauaucaguggaaacacagaguua

SEQ ID NO: 220359 - RNA, 64 nt, hsa
auucacuuuugacuuuauaugacaguugaucaagaacagguacuaccccuuuuuuucauuucaa

SEQ ID NO: 220360 - RNA, 64 nt, hsa
acagacagagaugugcugauuuuguuuuagcuguaacagguaaugguuuuuggauagaugauug

SEQ ID NO: 220361 - RNA, 64 nt, hsa
cugggcucaugacuuguaaauggaagcugaugugaacagguaauuaauauuaugacccacuucu

SEQ ID NO: 220362 - RNA, 64 nt, hsa
gaugaggagccagggcuaagggggcagccuucucucuucccagugaugcacauccuucacauug

SEQ ID NO: 220363 - RNA, 64 nt, hsa
cauucugucucagcaccauccagccuggcacuucucuucccauauauccauuggauuuuuuuuu

SEQ ID NO: 220364 - RNA, 64 nt, hsa
cauuugacuucucuacucggugucucagacagugucuucccagaaaaccaccacccucuaccca

SEQ ID NO: 220365 - RNA, 64 nt, hsa
cuucuuauaacuuuauccugcuauaacuuuauccucuucccagccucaucccuguuuuucuguu

SEQ ID NO: 220366 - RNA, 64 nt, hsa
uuuugcuuuauaguuuggcuggggagcacuuaauucuucccauuucaaaagguaauguugccug

SEQ ID NO: 220367 - RNA, 64 nt, hsa
uguuccaaccccauaaaucucacggcucuuaaguucuucccaaugaucugaggucauggaacuu

SEQ ID NO: 220368 - RNA, 64 nt, hsa
acgugugcuuuuucaagggagcugauaaagaacuucuucccaaaauggccgaagcuggacugua

SEQ ID NO: 220369 - RNA, 64 nt, hsa
cggccgccaucccaucuaggaagugaggagcgccucuucccacccgccaucccaucuaggaagu

SEQ ID NO: 220370 - RNA, 64 nt, hsa
caggaauaauguuuugggaaacacugaaaugaaaucuucccaguauuauaaauuguguauuuaa

SEQ ID NO: 220371 - RNA, 64 nt, hsa
acugugaagccacccugggcuacagaaaccacagucuucccagcaauuauuacaauucuugaau

SEQ ID NO: 220372 - RNA, 64 nt, hsa
acuuuuaauuuaaaaacacaaaaaaaauuuuagcucuucccacuuuuuuuuuccuauuuauuug

SEQ ID NO: 220373 - RNA, 64 nt, hsa
uucaagggccuuccaaguuguagaagaacaaugaucuucccauaaucaaaaguggagagucgaa

SEQ ID NO: 220374 - RNA, 64 nt, hsa
caacagggcauuggguacuugcaucuuagguauuucuucccagucacauccauuuuguggaaga

SEQ ID NO: 220375 - RNA, 64 nt, hsa
acacagggaggccaguucuguuucagagcaauuaucuucccaaauucucuguucugguguugga

SEQ ID NO: 220376 - RNA, 64 nt, hsa
ggaaggcucaguugucggaaagacaaaagcgauuucuucccacuccugcagggccagaaguuca

SEQ ID NO: 220377 - RNA, 64 nt, hsa
accaucucuacucuuuuugguuaggacacuagguucuucccagcauaugagugagaauauuggu

SEQ ID NO: 220378 - RNA, 64 nt, hsa
cugagaaucugcaaagucucugaagagaacucucucuucccacuaagugauauaaccuacuugg

SEQ ID NO: 220379 - RNA, 64 nt, hsa
uucauaggaaacagacuaugauuaauccauuuauucuucccacacacuuaccuuacuaagucuu

SEQ ID NO: 220380 - RNA, 64 nt, hsa
ccucugccguaaauccuggggcaagggaucagccucuucccaggaaccaucgccuucuauaaac

SEQ ID NO: 220381 - RNA, 64 nt, hsa
ugacggcaucuucccaguuccccaaggcacgccuucuucccaggcagcucuaacagcccuuuca

SEQ ID NO: 220382 - RNA, 64 nt, hsa
cuggcuguccuccugcccacccacacugacggcaucuucccaguuccccaaggcacgccuucuu

SEQ ID NO: 220383 - RNA, 64 nt, hsa
uggcugguuccagggcucgucccggcauuucaugucuucccacgggguugagucgggccauagg

SEQ ID NO: 220384 - RNA, 64 nt, hsa
cugggacuugcggugucucggcauaccccucuccucuucccaccuccuccuggcuauguucugc

SEQ ID NO: 220385 - RNA, 64 nt, hsa
cccggacccgcagggccugccugguuccuggaagucuucccagucuucccagccagcccgggcc

SEQ ID NO: 220386 - RNA, 64 nt, hsa
gcagggccugccugguuccuggaagucuucccagucuucccagccagcccgggcccuggggagc

SEQ ID NO: 220387 - RNA, 64 nt, hsa
gaguugggaaugaggaugcuguuacuuggccauuucuucccaucuccaaaaauccagagacauu

SEQ ID NO: 220388 - RNA, 64 nt, hsa
ccaaucaagugcagcacaugggugaugucagaauucuucccagcacaguguucugggcagccag

SEQ ID NO: 220389 - RNA, 64 nt, hsa
ccugagaaagacuugucauuuuuuuuccuggaguucuucccauugagguccuaggauuugcaca

SEQ ID NO: 220390 - RNA, 64 nt, hsa
ccacaacugaaccagaagagagugaagacuccccucuucccauccucugugccaggugccagac

SEQ ID NO: 220391 - RNA, 64 nt, hsa
ggucucuuaucuucagugagaaggugacccgccuucuucccaugguggcugccuaaagugcuuc

SEQ ID NO: 220392 - RNA, 64 nt, hsa
uuugugugucaucguacuggaguagagggccgacucuucccaugaaggugagcacagcugugag

SEQ ID NO: 220393 - RNA, 64 nt, hsa
uucuagagauuugccucuaucuuccuuuccucagucuucccagacugcuaucaagcuguguaaa

SEQ ID NO: 220394 - RNA, 64 nt, hsa
aauuguucuuuauuuuacaggcaguuacugaggcucuucccagaucucaguaaacagccacuca

SEQ ID NO: 220395 - RNA, 64 nt, hsa
ggccuccugccugccuucucuuuguuucuguuccucuucccaucuacuccccuacgccccuuca

SEQ ID NO: 220396 - RNA, 64 nt, hsa
cacccagcuggucuccccaggcaagaagguauccucuucccaagguguacccacugaauguugu

SEQ ID NO: 220397 - RNA, 64 nt, hsa
aaaaaaaauauaguauuuucuguuguccagaaaaucuucccagauagggaaacugaggcagaga

SEQ ID NO: 220398 - RNA, 64 nt, hsa
gggccugucugcugugcuauuuauuugccuuccgucuucccaaccucagcugccuguauucaug

SEQ ID NO: 220399 - RNA, 64 nt, hsa
ccacccuccagcuuucucuuaucccaguaacuccucuucccauuuuccaauccauccccagccu

SEQ ID NO: 220400 - RNA, 64 nt, hsa
guuaguucucucucucuaccaccuucuuccuaccucuucccauauugcuugccugauaaaacag

SEQ ID NO: 220401 - RNA, 64 nt, hsa
aaaauagacaguaaggauuuaucuguucaguuuuucuucccagugaauuaauuucagcuuauau

SEQ ID NO: 220402 - RNA, 64 nt, hsa
cugucauagccucugcguuugaccuuaaaauagcucuucccaguaagauugugcaauuuuuauu

SEQ ID NO: 220403 - RNA, 64 nt, hsa
ucagccccuaagaaaccuaauuugugcuuaggaaucuucccagguaagaagaacuaguuccucu

SEQ ID NO: 220404 - RNA, 64 nt, hsa
ggagggcccagagcccagugaggacccuucugcaucuucccaugacagaggacagagugacagg

SEQ ID NO: 220405 - RNA, 64 nt, hsa
aagcccuuaaaaaaauaaaaccucugaaccaaaaucuucccaggaauaguacuuaauagauuuu

SEQ ID NO: 220406 - RNA, 64 nt, hsa
cuguccuuuacucuuugauaguaucccucuauuuucuucccaauucucuaaaugcuuuaucauu

SEQ ID NO: 220407 - RNA, 64 nt, hsa
uauauuaacaagcaaagucgauucaacaacagcuucuucccagucacuuuuuuuuuucucacug

SEQ ID NO: 220408 - RNA, 64 nt, hsa
cacccucuuuaacccaucccucagcaaacgcagcucuucccaaggaccaggucccuugacguuc

SEQ ID NO: 220409 - RNA, 64 nt, hsa
gcauauggcagcaacaagagaacccuacuuuucuucuucccaucaccagaaacaucuuuucagg

SEQ ID NO: 220410 - RNA, 64 nt, hsa
ggcacugaugacucugcaacagaauaugacaccaucuucccaggcaaaagcaacaucugguuga

SEQ ID NO: 220411 - RNA, 64 nt, hsa
guuccaauguccaccccacccccagguacccgccucuucccacagaagcaauuuuagaauuuug

SEQ ID NO: 220412 - RNA, 64 nt, hsa
cuucgacuauucuucccuguccugccuugcuaauucuucccacuagcacuaaucucgacucuuu

SEQ ID NO: 220413 - RNA, 64 nt, hsa
cccaauauucuguagagagggagucaggaugcugucuucccacgaauaguacucaguaacaaac

SEQ ID NO: 220414 - RNA, 64 nt, hsa
auuuguguucagucugaauuaugggaaaguuagcucuucccagaccuaagcugccuucucuccc

SEQ ID NO: 220415 - RNA, 64 nt, hsa
cuguccuugacccacugguguucugugcaaggcuucuucccauucaccaagugcacaccuugca

SEQ ID NO: 220416 - RNA, 64 nt, hsa
accccuagugggcaguuugcaaaaugugauuccuucuucccaacuccccauccccccuucccuu

SEQ ID NO: 220417 - RNA, 64 nt, hsa
cuugcauaagccucaggccuggcccuuucaccccucuucccaccaacucucucugcccccaaaa

SEQ ID NO: 220418 - RNA, 64 nt, hsa
cuggugcccacccuucgcaguuacugguugguguucuucccaaagcaagcaccugggugugcuc

SEQ ID NO: 220419 - RNA, 64 nt, hsa
uuaauuaacugguaaccucaaaauucguggccugucuucccauucaccccgcuuuugacuauug

SEQ ID NO: 220420 - RNA, 64 nt, hsa
acugggagcacgggcugacggcugcuggugccuuucuucccaccucgcuugccuguuuccgcuu

SEQ ID NO: 220421 - RNA, 64 nt, hsa
cccucaauucugcucccugaacuucacacauaaaucuucccaaguggguuuuaggguguauaga

SEQ ID NO: 220422 - RNA, 64 nt, hsa
uauugcauugcgcagaacgcuacagagcccaugcucuucccagagcagcacccacaaaagcaag

SEQ ID NO: 220423 - RNA, 64 nt, hsa
ucccugaacauaguuuucacccaagagcuguccuggugaccaaaaaagauuacuaggguuuugc

SEQ ID NO: 220424 - RNA, 64 nt, hsa
cauuaaaaucuugaaagcgaaauacuugaaaagaggugaccauaaagaucacaccaauuuagaa

SEQ ID NO: 220425 - RNA, 64 nt, hsa; identical to SEQ ID NO: 44100

SEQ ID NO: 220426 - RNA, 64 nt, hsa; identical to SEQ ID NO: 44101

SEQ ID NO: 220427 - RNA, 64 nt, hsa; identical to SEQ ID NO: 44102

SEQ ID NO: 220428 - RNA, 64 nt, hsa; identical to SEQ ID NO: 44103

SEQ ID NO: 220429 - RNA, 64 nt, hsa; identical to SEQ ID NO: 44104

SEQ ID NO: 220430 - RNA, 64 nt, hsa; identical to SEQ ID NO: 44105

SEQ ID NO: 220431 - RNA, 64 nt, hsa; identical to SEQ ID NO: 44106

SEQ ID NO: 220432 - RNA, 64 nt, hsa; identical to SEQ ID NO: 44107

SEQ ID NO: 220433 - RNA, 64 nt, hsa; identical to SEQ ID NO: 44108

SEQ ID NO: 220434 - RNA, 64 nt, hsa; identical to SEQ ID NO: 44109

SEQ ID NO: 220435 - RNA, 64 nt, hsa; identical to SEQ ID NO: 44110

SEQ ID NO: 220436 - RNA, 64 nt, hsa; identical to SEQ ID NO: 44111

SEQ ID NO: 220437 - RNA, 64 nt, hsa; identical to SEQ ID NO: 44112

SEQ ID NO: 220438 - RNA, 64 nt, hsa; identical to SEQ ID NO: 44113

SEQ ID NO: 220439 - RNA, 64 nt, hsa; identical to SEQ ID NO: 44114

SEQ ID NO: 220440 - RNA, 64 nt, hsa; identical to SEQ ID NO: 44115

SEQ ID NO: 220441 - RNA, 64 nt, hsa; identical to SEQ ID NO: 44116

SEQ ID NO: 220442 - RNA, 64 nt, hsa; identical to SEQ ID NO: 44117

SEQ ID NO: 220443 - RNA, 64 nt, hsa; identical to SEQ ID NO: 44118

SEQ ID NO: 220444 - RNA, 64 nt, hsa; identical to SEQ ID NO: 44119

SEQ ID NO: 220445 - RNA, 64 nt, hsa; identical to SEQ ID NO: 44120

SEQ ID NO: 220446 - RNA, 64 nt, hsa; identical to SEQ ID NO: 44121

SEQ ID NO: 220447 - RNA, 64 nt, hsa; identical to SEQ ID NO: 44122

SEQ ID NO: 220448 - RNA, 64 nt, hsa; identical to SEQ ID NO: 44123

SEQ ID NO: 220449 - RNA, 64 nt, hsa; identical to SEQ ID NO: 44124

SEQ ID NO: 220450 - RNA, 64 nt, hsa; identical to SEQ ID NO: 44125

SEQ ID NO: 220451 - RNA, 64 nt, hsa; identical to SEQ ID NO: 44126

SEQ ID NO: 220452 - RNA, 64 nt, hsa; identical to SEQ ID NO: 44127

SEQ ID NO: 220453 - RNA, 64 nt, hsa; identical to SEQ ID NO: 44128

SEQ ID NO: 220454 - RNA, 64 nt, hsa; identical to SEQ ID NO: 44129

SEQ ID NO: 220455 - RNA, 64 nt, hsa; identical to SEQ ID NO: 44130

SEQ ID NO: 220456 - RNA, 64 nt, hsa; identical to SEQ ID NO: 44131

SEQ ID NO: 220457 - RNA, 64 nt, hsa; identical to SEQ ID NO: 44132

SEQ ID NO: 220458 - RNA, 64 nt, hsa; identical to SEQ ID NO: 44133

SEQ ID NO: 220459 - RNA, 64 nt, hsa; identical to SEQ ID NO: 44134

SEQ ID NO: 220460 - RNA, 64 nt, hsa; identical to SEQ ID NO: 44135

SEQ ID NO: 220461 - RNA, 64 nt, hsa; identical to SEQ ID NO: 44136

SEQ ID NO: 220462 - RNA, 64 nt, hsa; identical to SEQ ID NO: 44137

SEQ ID NO: 220463 - RNA, 64 nt, hsa; identical to SEQ ID NO: 44138

SEQ ID NO: 220464 - RNA, 64 nt, hsa; identical to SEQ ID NO: 44139

SEQ ID NO: 220465 - RNA, 64 nt, hsa; identical to SEQ ID NO: 44140

SEQ ID NO: 220466 - RNA, 64 nt, hsa; identical to SEQ ID NO: 44141

SEQ ID NO: 220467 - RNA, 64 nt, hsa; identical to SEQ ID NO: 44142

SEQ ID NO: 220468 - RNA, 64 nt, hsa; identical to SEQ ID NO: 44143

SEQ ID NO: 220469 - RNA, 64 nt, hsa; identical to SEQ ID NO: 44144

SEQ ID NO: 220470 - RNA, 64 nt, hsa; identical to SEQ ID NO: 44145

SEQ ID NO: 220471 - RNA, 64 nt, hsa; identical to SEQ ID NO: 44146

SEQ ID NO: 220472 - RNA, 64 nt, hsa; identical to SEQ ID NO: 44147

SEQ ID NO: 220473 - RNA, 64 nt, hsa; identical to SEQ ID NO: 44148

SEQ ID NO: 220474 - RNA, 64 nt, hsa; identical to SEQ ID NO: 44149

SEQ ID NO: 220475 - RNA, 64 nt, hsa; identical to SEQ ID NO: 44150

SEQ ID NO: 220476 - RNA, 64 nt, hsa; identical to SEQ ID NO: 44151

SEQ ID NO: 220477 - RNA, 64 nt, hsa; identical to SEQ ID NO: 44152

SEQ ID NO: 220478 - RNA, 64 nt, hsa; identical to SEQ ID NO: 44153

SEQ ID NO: 220479 - RNA, 64 nt, hsa; identical to SEQ ID NO: 44154

SEQ ID NO: 220480 - RNA, 64 nt, hsa; identical to SEQ ID NO: 44155

SEQ ID NO: 220481 - RNA, 64 nt, hsa; identical to SEQ ID NO: 44156

SEQ ID NO: 220482 - RNA, 64 nt, hsa; identical to SEQ ID NO: 44157

SEQ ID NO: 220483 - RNA, 64 nt, hsa; identical to SEQ ID NO: 44158

SEQ ID NO: 220484 - RNA, 64 nt, hsa; identical to SEQ ID NO: 44159

SEQ ID NO: 220485 - RNA, 64 nt, hsa; identical to SEQ ID NO: 44160

SEQ ID NO: 220486 - RNA, 64 nt, hsa; identical to SEQ ID NO: 44161

SEQ ID NO: 220487 - RNA, 64 nt, hsa; identical to SEQ ID NO: 44162

SEQ ID NO: 220488 - RNA, 64 nt, hsa; identical to SEQ ID NO: 44163

SEQ ID NO: 220489 - RNA, 64 nt, hsa; identical to SEQ ID NO: 44164

SEQ ID NO: 220490 - RNA, 64 nt, hsa; identical to SEQ ID NO: 44165

SEQ ID NO: 220491 - RNA, 64 nt, hsa; identical to SEQ ID NO: 44166

SEQ ID NO: 220492 - RNA, 64 nt, hsa; identical to SEQ ID NO: 44167

SEQ ID NO: 220493 - RNA, 64 nt, hsa; identical to SEQ ID NO: 44168

SEQ ID NO: 220494 - RNA, 64 nt, hsa; identical to SEQ ID NO: 44169

SEQ ID NO: 220495 - RNA, 64 nt, hsa; identical to SEQ ID NO: 44170

SEQ ID NO: 220496 - RNA, 64 nt, hsa; identical to SEQ ID NO: 44171

SEQ ID NO: 220497 - RNA, 64 nt, hsa; identical to SEQ ID NO: 44172

SEQ ID NO: 220498 - RNA, 64 nt, hsa; identical to SEQ ID NO: 44173

SEQ ID NO: 220499 - RNA, 64 nt, hsa; identical to SEQ ID NO: 44174

SEQ ID NO: 220500 - RNA, 64 nt, hsa; identical to SEQ ID NO: 44175

SEQ ID NO: 220501 - RNA, 64 nt, hsa; identical to SEQ ID NO: 44176

SEQ ID NO: 220502 - RNA, 64 nt, hsa; identical to SEQ ID NO: 44177

SEQ ID NO: 220503 - RNA, 64 nt, hsa; identical to SEQ ID NO: 44178

SEQ ID NO: 220504 - RNA, 64 nt, hsa; identical to SEQ ID NO: 44179

SEQ ID NO: 220505 - RNA, 64 nt, hsa; identical to SEQ ID NO: 44180

SEQ ID NO: 220506 - RNA, 64 nt, hsa; identical to SEQ ID NO: 44181

SEQ ID NO: 220507 - RNA, 64 nt, hsa; identical to SEQ ID NO: 44182

SEQ ID NO: 220508 - RNA, 64 nt, hsa; identical to SEQ ID NO: 44183

SEQ ID NO: 220509 - RNA, 64 nt, hsa; identical to SEQ ID NO: 44184

SEQ ID NO: 220510 - RNA, 64 nt, hsa; identical to SEQ ID NO: 44185

SEQ ID NO: 220511 - RNA, 64 nt, hsa; identical to SEQ ID NO: 44186

SEQ ID NO: 220512 - RNA, 64 nt, hsa; identical to SEQ ID NO: 44187

SEQ ID NO: 220513 - RNA, 64 nt, hsa; identical to SEQ ID NO: 44188

SEQ ID NO: 220514 - RNA, 64 nt, hsa; identical to SEQ ID NO: 44189

SEQ ID NO: 220515 - RNA, 64 nt, hsa; identical to SEQ ID NO: 44190

SEQ ID NO: 220516 - RNA, 64 nt, hsa; identical to SEQ ID NO: 44191

SEQ ID NO: 220517 - RNA, 64 nt, hsa; identical to SEQ ID NO: 44192

SEQ ID NO: 220518 - RNA, 64 nt, hsa; identical to SEQ ID NO: 44193

SEQ ID NO: 220519 - RNA, 64 nt, hsa; identical to SEQ ID NO: 44194

SEQ ID NO: 220520 - RNA, 64 nt, hsa; identical to SEQ ID NO: 44195

SEQ ID NO: 220521 - RNA, 64 nt, hsa; identical to SEQ ID NO: 44196

SEQ ID NO: 220522 - RNA, 64 nt, hsa; identical to SEQ ID NO: 44197

SEQ ID NO: 220523 - RNA, 64 nt, hsa; identical to SEQ ID NO: 44198

SEQ ID NO: 220524 - RNA, 64 nt, hsa; identical to SEQ ID NO: 44199

SEQ ID NO: 220525 - RNA, 64 nt, hsa; identical to SEQ ID NO: 44200

SEQ ID NO: 220526 - RNA, 64 nt, hsa; identical to SEQ ID NO: 44201

SEQ ID NO: 220527 - RNA, 64 nt, hsa; identical to SEQ ID NO: 44202

SEQ ID NO: 220528 - RNA, 64 nt, hsa; identical to SEQ ID NO: 44203

SEQ ID NO: 220529 - RNA, 64 nt, hsa; identical to SEQ ID NO: 44204

SEQ ID NO: 220530 - RNA, 64 nt, hsa; identical to SEQ ID NO: 44205

SEQ ID NO: 220531 - RNA, 64 nt, hsa; identical to SEQ ID NO: 44206

SEQ ID NO: 220532 - RNA, 64 nt, hsa; identical to SEQ ID NO: 44207

SEQ ID NO: 220533 - RNA, 64 nt, hsa; identical to SEQ ID NO: 44208

SEQ ID NO: 220534 - RNA, 64 nt, hsa; identical to SEQ ID NO: 44209

SEQ ID NO: 220535 - RNA, 64 nt, hsa; identical to SEQ ID NO: 44210

SEQ ID NO: 220536 - RNA, 64 nt, hsa; identical to SEQ ID NO: 44211

SEQ ID NO: 220537 - RNA, 64 nt, hsa; identical to SEQ ID NO: 44212

SEQ ID NO: 220538 - RNA, 64 nt, hsa; identical to SEQ ID NO: 44213

SEQ ID NO: 220539 - RNA, 64 nt, hsa; identical to SEQ ID NO: 44214

SEQ ID NO: 220540 - RNA, 64 nt, hsa; identical to SEQ ID NO: 44215

SEQ ID NO: 220541 - RNA, 64 nt, hsa; identical to SEQ ID NO: 44216

SEQ ID NO: 220542 - RNA, 64 nt, hsa; identical to SEQ ID NO: 44217

SEQ ID NO: 220543 - RNA, 64 nt, hsa; identical to SEQ ID NO: 44218

SEQ ID NO: 220544 - RNA, 64 nt, hsa; identical to SEQ ID NO: 44219

SEQ ID NO: 220545 - RNA, 64 nt, hsa; identical to SEQ ID NO: 44220

SEQ ID NO: 220546 - RNA, 64 nt, hsa; identical to SEQ ID NO: 44221

SEQ ID NO: 220547 - RNA, 64 nt, hsa; identical to SEQ ID NO: 44222

SEQ ID NO: 220548 - RNA, 64 nt, hsa; identical to SEQ ID NO: 44223

SEQ ID NO: 220549 - RNA, 64 nt, hsa; identical to SEQ ID NO: 44224

SEQ ID NO: 220550 - RNA, 64 nt, hsa; identical to SEQ ID NO: 44225

SEQ ID NO: 220551 - RNA, 64 nt, hsa; identical to SEQ ID NO: 44226

SEQ ID NO: 220552 - RNA, 64 nt, hsa; identical to SEQ ID NO: 44227

SEQ ID NO: 220553 - RNA, 64 nt, hsa; identical to SEQ ID NO: 44228

SEQ ID NO: 220554 - RNA, 64 nt, hsa; identical to SEQ ID NO: 44229

SEQ ID NO: 220555 - RNA, 64 nt, hsa; identical to SEQ ID NO: 44230

SEQ ID NO: 220556 - RNA, 64 nt, hsa; identical to SEQ ID NO: 44231

SEQ ID NO: 220557 - RNA, 64 nt, hsa; identical to SEQ ID NO: 44232

SEQ ID NO: 220558 - RNA, 64 nt, hsa; identical to SEQ ID NO: 44233

SEQ ID NO: 220559 - RNA, 64 nt, hsa; identical to SEQ ID NO: 44234

SEQ ID NO: 220560 - RNA, 64 nt, hsa; identical to SEQ ID NO: 44235

SEQ ID NO: 220561 - RNA, 64 nt, hsa; identical to SEQ ID NO: 44236

SEQ ID NO: 220562 - RNA, 64 nt, hsa; identical to SEQ ID NO: 44237

SEQ ID NO: 220563 - RNA, 64 nt, hsa; identical to SEQ ID NO: 44238

SEQ ID NO: 220564 - RNA, 64 nt, hsa; identical to SEQ ID NO: 44239

SEQ ID NO: 220565 - RNA, 64 nt, hsa; identical to SEQ ID NO: 44240

SEQ ID NO: 220566 - RNA, 64 nt, hsa; identical to SEQ ID NO: 44241

SEQ ID NO: 220567 - RNA, 64 nt, hsa; identical to SEQ ID NO: 44242

SEQ ID NO: 220568 - RNA, 64 nt, hsa; identical to SEQ ID NO: 44243

SEQ ID NO: 220569 - RNA, 64 nt, hsa; identical to SEQ ID NO: 44244

SEQ ID NO: 220570 - RNA, 64 nt, hsa; identical to SEQ ID NO: 44245

SEQ ID NO: 220571 - RNA, 64 nt, hsa; identical to SEQ ID NO: 44246

SEQ ID NO: 220572 - RNA, 64 nt, hsa; identical to SEQ ID NO: 44247

SEQ ID NO: 220573 - RNA, 64 nt, hsa; identical to SEQ ID NO: 44248

SEQ ID NO: 220574 - RNA, 64 nt, hsa; identical to SEQ ID NO: 44249

SEQ ID NO: 220575 - RNA, 64 nt, hsa; identical to SEQ ID NO: 44250

SEQ ID NO: 220576 - RNA, 64 nt, hsa; identical to SEQ ID NO: 44251

SEQ ID NO: 220577 - RNA, 64 nt, hsa; identical to SEQ ID NO: 44252

SEQ ID NO: 220578 - RNA, 64 nt, hsa; identical to SEQ ID NO: 44253

SEQ ID NO: 220579 - RNA, 64 nt, hsa
uaagagacaaguccuuacuauauugcccugucucucaagggaagacaucaagacuggacuugaa

SEQ ID NO: 220580 - RNA, 64 nt, hsa
cuguguugcccagacuggucuugaacuccuggacucaagggauccuccugucuugggcucccaa

SEQ ID NO: 220581 - RNA, 64 nt, hsa
uuuuauucggauugacgaaaaucaaccauaauuuucaagggaucuucauggguugugacuggaa

SEQ ID NO: 220582 - RNA, 64 nt, hsa
aaaguaguguguggcuggugccaguagaggucagucaagggaucccugacgagaauaaagagcc

SEQ ID NO: 220583 - RNA, 64 nt, hsa
cuuuuuuccuuagccuucagugccauggaacuaaucaagggaggaaaaggucaccagggagaac

SEQ ID NO: 220584 - RNA, 64 nt, hsa
cagcaguuuuauuuccucuagaacucauccuguuucaagggaaguaccuaagaagauauagagu

SEQ ID NO: 220585 - RNA, 64 nt, hsa
gcagcucccuaagagcggggcccugcucccuuucucaagggaaccuguccccaaauuggccucg

SEQ ID NO: 220586 - RNA, 64 nt, hsa
guuuaugcuggugggccacuugucgucgucaaagucaagggaaaguucuccuggaccaaggcuu

SEQ ID NO: 220587 - RNA, 64 nt, hsa; identical to SEQ ID NO: 93597

SEQ ID NO: 220588 - RNA, 64 nt, hsa; identical to SEQ ID NO: 93598

SEQ ID NO: 220589 - RNA, 64 nt, hsa; identical to SEQ ID NO: 93599

SEQ ID NO: 220590 - RNA, 64 nt, hsa; identical to SEQ ID NO: 93600

SEQ ID NO: 220591 - RNA, 64 nt, hsa; identical to SEQ ID NO: 93601

SEQ ID NO: 220592 - RNA, 64 nt, hsa; identical to SEQ ID NO: 93602

SEQ ID NO: 220593 - RNA, 64 nt, hsa; identical to SEQ ID NO: 93603

SEQ ID NO: 220594 - RNA, 64 nt, hsa; identical to SEQ ID NO: 93604

SEQ ID NO: 220595 - RNA, 64 nt, hsa; identical to SEQ ID NO: 93605

SEQ ID NO: 220596 - RNA, 64 nt, hsa; identical to SEQ ID NO: 93606

SEQ ID NO: 220597 - RNA, 64 nt, hsa; identical to SEQ ID NO: 93607

SEQ ID NO: 220598 - RNA, 64 nt, hsa; identical to SEQ ID NO: 93608

SEQ ID NO: 220599 - RNA, 64 nt, hsa; identical to SEQ ID NO: 93609

SEQ ID NO: 220600 - RNA, 64 nt, hsa; identical to SEQ ID NO: 93610

SEQ ID NO: 220601 - RNA, 64 nt, hsa; identical to SEQ ID NO: 93611

SEQ ID NO: 220602 - RNA, 64 nt, hsa; identical to SEQ ID NO: 93612

SEQ ID NO: 220603 - RNA, 64 nt, hsa; identical to SEQ ID NO: 93613

SEQ ID NO: 220604 - RNA, 64 nt, hsa; identical to SEQ ID NO: 93614

SEQ ID NO: 220605 - RNA, 64 nt, hsa; identical to SEQ ID NO: 93615

SEQ ID NO: 220606 - RNA, 64 nt, hsa; identical to SEQ ID NO: 93616

SEQ ID NO: 220607 - RNA, 64 nt, hsa; identical to SEQ ID NO: 93617

SEQ ID NO: 220608 - RNA, 64 nt, hsa; identical to SEQ ID NO: 93618

SEQ ID NO: 220609 - RNA, 64 nt, hsa; identical to SEQ ID NO: 93619

SEQ ID NO: 220610 - RNA, 64 nt, hsa; identical to SEQ ID NO: 93620

SEQ ID NO: 220611 - RNA, 64 nt, hsa; identical to SEQ ID NO: 93621

SEQ ID NO: 220612 - RNA, 64 nt, hsa; identical to SEQ ID NO: 93622

SEQ ID NO: 220613 - RNA, 64 nt, hsa
auaaaaccccauaucuguuuugguauauuguacacaaaccuacaaaaauaaacugaacuugcaa

SEQ ID NO: 220614 - RNA, 64 nt, hsa
cucccugcccuuugagcuuuauucuaauguaucccaaaccuaaucuuuuuaaaagauagaagau

SEQ ID NO: 220615 - RNA, 64 nt, hsa
uuuuagaaaguaaucauaaaaguaaauugaauuucaaaccuauuuggcuucuguuuugugaacc

SEQ ID NO: 220616 - RNA, 64 nt, hsa
cauaacugcugccaccaccaucagaauucauaaucaaaccuaaccuuuuuguuuggggcaccaa

SEQ ID NO: 220617 - RNA, 64 nt, hsa
auaauaugcucaguuuggaccuuuuuuucaguuaaaugcuaaauauaugaaaauuacuauaccu

SEQ ID NO: 220618 - RNA, 64 nt, hsa
ggaaccuucuuaaucucuucugugggauuuucaaaaugcuaaagacucacacugcagcaaucau

SEQ ID NO: 220619 - RNA, 64 nt, hsa
acuucuuuaauagcuagaaaucaccauaaauaagaaugcuaaacagaauugaaaauuauaucaa

SEQ ID NO: 220620 - RNA, 64 nt, hsa
uauaugaaaaugguguguuauuggaagauguuaaaaugcuaauuugagagaaguaggaguguau

SEQ ID NO: 220621 - RNA, 64 nt, hsa
augccuugcuaaauguagacuaaagaacuuguugaaugcuaaggcugaaaucccaaccugagau

SEQ ID NO: 220622 - RNA, 64 nt, hsa
uauuaugauuauaguaaacagacuaguggguaguaaugcuaaauuaccaucacaguuaugugcc

SEQ ID NO: 220623 - RNA, 64 nt, hsa
uugaacaggaaguaggaacaugcauacacgaagaaaugcuaacggaaggauuuguuauguuuag

SEQ ID NO: 220624 - RNA, 64 nt, hsa
aaaauauaaaaucacaguagauuuuauuuuuuaaaaugcuaacugaaaguaauagagacugucc

SEQ ID NO: 220625 - RNA, 64 nt, hsa
aggaaaauaaaucaaacccaaagaaaguuuauucaaugcuaauuugaaagaaaauugauaagaa

SEQ ID NO: 220626 - RNA, 64 nt, hsa
ugacuauuaaccagaaaagaaacauuuuacauaaaaugcuaaaauuuauuauaggaaaauaaau

SEQ ID NO: 220627 - RNA, 64 nt, hsa
aaaggguggggaugauaagaaaugcuaauauaaaaaugcuaagugaaaaaaagacuuggccagg

SEQ ID NO: 220628 - RNA, 64 nt, hsa
acaaacugucaaagaaaggguggggaugauaagaaaugcuaauauaaaaaugcuaagugaaaaa

SEQ ID NO: 220629 - RNA, 64 nt, hsa
uaagcuacuuugucauagaucacaaaagaaucauaaugcuaacaaacucuauuucuuccuuauu

SEQ ID NO: 220630 - RNA, 64 nt, hsa
ucuuguaaaaauaaguaauuuacaggaaaggcaaaaugcuaauacuaacauuuguagcacuuga

SEQ ID NO: 220631 - RNA, 64 nt, hsa
ugauaggauuuccuaaaguauuuguggacaguuaaaugcuaauuauauacaucuguaguuauuc

SEQ ID NO: 220632 - RNA, 64 nt, hsa
ugauaggauuuccaaaaguauuuguggacaguuaaaugcuaauuaauauacaucuguaguuauu

SEQ ID NO: 220633 - RNA, 64 nt, hsa
gcagggagggccagggagguugggggugggagugaaugcuaaaagcagaucguccagugcccuu

SEQ ID NO: 220634 - RNA, 64 nt, hsa
aagcaguccuccaugugagcaaccccgagacaaaaaugcuaagugggaucaagagagcagcacu

SEQ ID NO: 220635 - RNA, 64 nt, hsa
aauacacuuuuguguauuagcaaugguuuuuacuaaugcuaaaacuuuuaaaguuuauuuuuua

SEQ ID NO: 220636 - RNA, 64 nt, hsa
acucuucugcuuccugauaagaaaagguauaugcaaugcuaaaacuguagaagcccaaucacca

SEQ ID NO: 220637 - RNA, 64 nt, hsa
ccugccucugcagagcagaaagaucauagacaacauuuaugaaugugcccagugcugccaagaa

SEQ ID NO: 220638 - RNA, 64 nt, hsa
gacauuauuaaaagaacaggggcagaaguggcucauuuaugacccauucacuagccccagggau

SEQ ID NO: 220639 - RNA, 64 nt, hsa
auaugauguauuuguuacacauaguuuucucauuauuuaugaaacuuaaccauacagaaugaua

SEQ ID NO: 220640 - RNA, 64 nt, hsa
uaaaagaaggcaggggaaacuuacguuggaugacauuuaugagggucagucccacauaccucuu

SEQ ID NO: 220641 - RNA, 64 nt, hsa
agaggagccagaaguaaaguuuauuucauggauuauuuaugagagcuaauuuaaggaugacuuu

SEQ ID NO: 220642 - RNA, 64 nt, hsa
uggauguguuugauuuuuuaaagcguagacauauauuuaugaaugugcauuucuugacuucaca

SEQ ID NO: 220643 - RNA, 64 nt, hsa
uucagcauuuacagugaaaagugagaauuuuaaaauuuaugaaaucuauauuccagguauuguu

SEQ ID NO: 220644 - RNA, 64 nt, hsa
auugaaaucuguucaaaaacagauuaagacaaacauuuaugauggucuguaucaaucagcagau

SEQ ID NO: 220645 - RNA, 64 nt, hsa
uaacugauaaaggucuaguauccaaaauauuuaaauuuaugaguguuaauaaaauuuaucuugu

SEQ ID NO: 220646 - RNA, 64 nt, hsa
auuucuauaaaagcaagauuuugucaaaaacuaaauuuaugauuauucaagaaagugaaaaaaa

SEQ ID NO: 220647 - RNA, 64 nt, hsa
aaacauucuuuguuuagaaggagauucuaaaguuauuuaugaugcuuagccauaguauucaggc

SEQ ID NO: 220648 - RNA, 64 nt, hsa
uauuuaaguguuggacugcuaggagaacuuguacauuuaugauaaugcagaauuaggaaaacgg

SEQ ID NO: 220649 - RNA, 64 nt, hsa
uaagacaagaaauuuaugauuugccagauucaacauuuaugaccuccccuuccaaagacugucu

SEQ ID NO: 220650 - RNA, 64 nt, hsa
gaugauaguaaaugcggcaauguuaagacaagaaauuuaugauuugccagauucaacauuuaug

SEQ ID NO: 220651 - RNA, 64 nt, hsa
aaaaucuccuuauacuuuugguauggcuugcagcauuuaugaguuuuccaaaauauagaaagca

SEQ ID NO: 220652 - RNA, 64 nt, hsa
aacaacaacuaugaguuaucaaaauauugacuccauuuaugacuagacuacauuucugaaagau

SEQ ID NO: 220653 - RNA, 64 nt, hsa
caaaaguuacaguaccuuuguggcuucauugaauauuuaugaagauaaugucagauguagacaa

SEQ ID NO: 220654 - RNA, 64 nt, hsa
guauuguagagacuuuaugauuagaauugcauauauuuaugaaacuuaaagaugaauguuuuau

SEQ ID NO: 220655 - RNA, 64 nt, hsa
aaccagguucuccaaaguuaggaauagggaacuaauuuaugaaacagccaucuuaaaaaaaaaa

SEQ ID NO: 220656 - RNA, 64 nt, hsa
ucaaucuguucccaguuucuaaacaauuuuaaauauuuaugagaagcaaacccuauguguaggg

SEQ ID NO: 220657 - RNA, 64 nt, hsa
ccuuuaugauuguauaugauccacagaagaccugauuuaugaaauuuuguacuaaaaucauuug

SEQ ID NO: 220658 - RNA, 64 nt, hsa
uaaucauuccuuuuuuaagaagaaguaauuuuccauuuaugaagcaguaugaauuagauguauu

SEQ ID NO: 220659 - RNA, 64 nt, hsa
cuagaacaaaauuauucauagugcguuuuuuguaauuuaugauuguuaaguaagcuugacuuau

SEQ ID NO: 220660 - RNA, 64 nt, hsa
ggagguaauuuguugauauuacaauuuuuaacacauuuaugauucugugauaauauuauucaau

SEQ ID NO: 220661 - RNA, 64 nt, hsa
uuuauucauuagaaauuuuccucauuucaaaauaauuuaugacucauggaauguugaucgccua

SEQ ID NO: 220662 - RNA, 64 nt, hsa
uauguuagacuuuuuacauuguuuaucuaauauuauuuaugacaguaauuuuaaaauauauuau

SEQ ID NO: 220663 - RNA, 64 nt, hsa
aauuaucauuccagcuuuuuauauacuauauuucauuuaugaagaaauugauuuucuuuuggga

SEQ ID NO: 220664 - RNA, 64 nt, hsa
agggagcaugcuguuuugucaaucaauauaaaauauuuaugaggucucccccacccccaggagg

SEQ ID NO: 220665 - RNA, 64 nt, hsa
ggcauuaaagagucauagaaaaagaaucauggauauuuaugaauuaagguaagagguguggcuu

SEQ ID NO: 220666 - RNA, 64 nt, hsa
gccucaaaucauguaauuaauaauuugccuguuuauuuaugaccuaauugugauucuuuuauua

SEQ ID NO: 220667 - RNA, 64 nt, hsa
agguaaaagcugcuaguauucuuuuaaaaguuauauuuaugacuugcaaugauagaaaacuccu

SEQ ID NO: 220668 - RNA, 64 nt, hsa
cuccaggaggguggugauagaaacagaugguaguauuuaugaacugauguucucgugaaauguu

SEQ ID NO: 220669 - RNA, 64 nt, hsa
augauguacuguaauuuuauuuuaauguauuuugauuuaugauuauuuauuaguuuuuuuuuaa

SEQ ID NO: 220670 - RNA, 64 nt, hsa
augcaggaaacgauuucgagucaagaagacuuuuauuuaugaaccuuugaaaggaucgucuugu

SEQ ID NO: 220671 - RNA, 64 nt, hsa
gauacugauuuuaaugccaguaucugcucuaaauauuuaugauaaaaaugcauuauuuuuuuaa

SEQ ID NO: 220672 - RNA, 64 nt, hsa
uuguauguuaacuuauuuucaauaucuugaccuuauuuaugaucugcuaaaguggugauuuauc

SEQ ID NO: 220673 - RNA, 64 nt, hsa
ucccugcuaaaaaucuguuuaucauacauuuauuauuuaugacuuuaugucacauugaagaauu

SEQ ID NO: 220674 - RNA, 64 nt, hsa
uaaugacugcugucugcagccagaaagaaucugaauuuaugaauuggaaagauauauauagugu

SEQ ID NO: 220675 - RNA, 64 nt, hsa
gcugcugcuuggaguggaugcccuggggcuucacauuuaugacccugagaacagacugaccccc

SEQ ID NO: 220676 - RNA, 64 nt, hsa
agauucuccagcuauguaucgggaaccaugaucuauuuaugaggagaaggaaagccgauucuuu

SEQ ID NO: 220677 - RNA, 64 nt, hsa
gacauagauuuuguaauguauaacuugauauuuaauuuaugauuaaacuguguguaaauuuugu

SEQ ID NO: 220678 - RNA, 64 nt, hsa
guauuacugaagguguguauacucccuaauacacauuuaugaaaaucuacuuguuuaggcuuuu

SEQ ID NO: 220679 - RNA, 64 nt, hsa
gacauagauuuuguaauguauaacuugauauuuaauuuaugauuaaacuguaauuuuguaacau

SEQ ID NO: 220680 - RNA, 64 nt, hsa
guauuacugaagguguguauacucccuaauacacauuuaugaaaaucuacuuguuuagacuuuu

SEQ ID NO: 220681 - RNA, 64 nt, hsa
uuccuaucagcuggauucuauccaagugacucuauugauguauguauguucauucaaagaaugg

SEQ ID NO: 220682 - RNA, 64 nt, hsa
auacauauaacauaaacauaacaaaguugccuaguugauguaacaguggaaaguuaucuggaaa

SEQ ID NO: 220683 - RNA, 64 nt, hsa
aauuaaaugaaugcugcacagguccagauguguguugauguagacuugaaaugucuccacauuu

SEQ ID NO: 220684 - RNA, 64 nt, hsa
aguuucagaaccuuaacacuccccaacagcuuuguugauguagcuuguaucucugagaauuuau

SEQ ID NO: 220685 - RNA, 64 nt, hsa
gcauggaccccagagauaguuuuggagccaggcauugauguagagguucaccaaacauauuuag

SEQ ID NO: 220686 - RNA, 64 nt, hsa
uuuggucauacuauuuaccaaauuguuggcaaacuugauguaaccuuauauggugguuuuaguc

SEQ ID NO: 220687 - RNA, 64 nt, hsa
cugaauaaggaguagcuuguuacauccuagccauuugauguaauacaaauguucuuauuuggcu

SEQ ID NO: 220688 - RNA, 64 nt, hsa
uuucuuauuguuaaaguuuuuauauguuguaagauugauguaucuguaaauauugcaguuuuua

SEQ ID NO: 220689 - RNA, 64 nt, hsa
uaguguauucaacauugucugccucuuccugcaguugauguaauugcuuuguuugcaauagcac

SEQ ID NO: 220690 - RNA, 64 nt, hsa
uaaugcuguuaaacaggaguugaccuucauuuaguugauguaauacauagcuguaugggguuuu

SEQ ID NO: 220691 - RNA, 64 nt, hsa
ugagguuuucguuuugaauauauauguuguuauuuugauguagauacguuagcagauggagagg

SEQ ID NO: 220692 - RNA, 64 nt, hsa
augagucugucugagcaugauacuuaacaugaacuugauguaguaggugcacauuugccuaaca

SEQ ID NO: 220693 - RNA, 64 nt, hsa
gaggggccugaagagccuccgggcuccugggacauugauguagaguuuuuagugaagugggcac

SEQ ID NO: 220694 - RNA, 64 nt, hsa
cugucccguguagaugcaauucgguuuaauggcauugauguauagucacugugccuuucuuuuu

SEQ ID NO: 220695 - RNA, 64 nt, hsa
aauuaaguuacucuuaaaacucuaguuaaaauacuugauguacauaaagugcuuagcaaaauga

SEQ ID NO: 220696 - RNA, 64 nt, hsa
ugcuuaguaaauguuagauaaguauucuccagaauugauguaaauuauuuuuaaacagugcauu

SEQ ID NO: 220697 - RNA, 64 nt, hsa
acaagauggaaaauugauuccucugacuuugcuauugauguagugugauagaaaauucaccccu

SEQ ID NO: 220698 - RNA, 64 nt, hsa
gggggccuuuggaaggcacugugaauuugcuauuuugauguaguguuacaagauggaaaauuga

SEQ ID NO: 220699 - RNA, 64 nt, hsa
cguaggcugacauaguaucacccaaucccugaagcaagaauacaaaggguauacucuguuggau

SEQ ID NO: 220700 - RNA, 64 nt, hsa
gagaaacucauacauguacaccaggagauguguacaagaauauucauagcaacccuauucacaa

SEQ ID NO: 220701 - RNA, 64 nt, hsa
ugaagucuggaggcuagacuuccugaaagcaagucaagaauauagagcaccuugcaggaguuca

SEQ ID NO: 220702 - RNA, 64 nt, hsa
guucacagauauuuuauguuuuuuuaauuuucuccaagaauauuuauagaauuccaaagaauca

SEQ ID NO: 220703 - RNA, 64 nt, hsa
agaucaauucuuaucccauauaaugcuuagcuuccaagaauauucuuuacuuucuucugucuuu

SEQ ID NO: 220704 - RNA, 64 nt, hsa
aggugauaacuguccuaauauuuagauguccaaacaagaauacuuccaacauaaaaauuauaau

SEQ ID NO: 220705 - RNA, 64 nt, hsa
aaaauuuaaacuguauaauggagcuagauacaagcaagaauaguauuugaaagacuuuuccagc

SEQ ID NO: 220706 - RNA, 64 nt, hsa
ggggggacacaaccaaaccauaucagcauccuuucaagaauauuagauaauuggagcugaguac

SEQ ID NO: 220707 - RNA, 64 nt, hsa
agccaucagaucuugugaaacuuauucacuaucacaagaauagcaugggaaagacuggccccca

SEQ ID NO: 220708 - RNA, 64 nt, hsa
gauguauuuuuacuuuccaagaugccgugugugccaagaauaaaugaaaugauguuaaagcaua

SEQ ID NO: 220709 - RNA, 64 nt, hsa
uuguuagauagucagaguuggaaacaaaacaauccaagaauagggauauaagcauugcuagucu

SEQ ID NO: 220710 - RNA, 64 nt, hsa
agacaugcuuguguuuuggaauuucacacccuuacaagaauaccacauuuugaaacccagaaag

SEQ ID NO: 220711 - RNA, 64 nt, hsa
caucuuuucaaagauacaacaaaagcagaaguuacaagaauauugcggagagguuggaaagcag

SEQ ID NO: 220712 - RNA, 64 nt, hsa
gagacggaagcaggugcgauacuaagccucagcccaagaauaaaagagaguucaacuguuacuc

SEQ ID NO: 220713 - RNA, 64 nt, hsa; identical to SEQ ID NO: 51693

SEQ ID NO: 220714 - RNA, 64 nt, hsa; identical to SEQ ID NO: 51694

SEQ ID NO: 220715 - RNA, 64 nt, hsa; identical to SEQ ID NO: 51695

SEQ ID NO: 220716 - RNA, 64 nt, hsa; identical to SEQ ID NO: 51696

SEQ ID NO: 220717 - RNA, 64 nt, hsa; identical to SEQ ID NO: 51697

SEQ ID NO: 220718 - RNA, 64 nt, hsa; identical to SEQ ID NO: 51698

SEQ ID NO: 220719 - RNA, 64 nt, hsa; identical to SEQ ID NO: 51699

SEQ ID NO: 220720 - RNA, 64 nt, hsa; identical to SEQ ID NO: 51700

SEQ ID NO: 220721 - RNA, 64 nt, hsa; identical to SEQ ID NO: 51701

SEQ ID NO: 220722 - RNA, 64 nt, hsa; identical to SEQ ID NO: 51702

SEQ ID NO: 220723 - RNA, 64 nt, hsa; identical to SEQ ID NO: 51703

SEQ ID NO: 220724 - RNA, 64 nt, hsa; identical to SEQ ID NO: 51704

SEQ ID NO: 220725 - RNA, 64 nt, hsa; identical to SEQ ID NO: 51705

SEQ ID NO: 220726 - RNA, 64 nt, hsa
uaagugacuccggaugcaucaguguccaccaguuggaagcaaugacaaggauggcuggcuggug

SEQ ID NO: 220727 - RNA, 64 nt, hsa
ggaaaaagucuagacccagaacaaucaggagauuggaagcaaauuuaugaagaaugaugguggg

SEQ ID NO: 220728 - RNA, 64 nt, hsa
auucacuggcaaaugccugaauggucugucugaaggaagcaacagagaaguggggaauccaguc

SEQ ID NO: 220729 - RNA, 64 nt, hsa
guuuuuagugaaguaucuuucagauagcaggcagggaagcaauguaguguggugggcagagccc

SEQ ID NO: 220730 - RNA, 64 nt, hsa
aggacagauguccucuuaagaaaaugaugcaucaggaagcaacgugauggaggacuugggggaa

SEQ ID NO: 220731 - RNA, 64 nt, hsa
gacuugggggaaaaggaucacauacucagucuauggaagcaacgucccuggaagaagaggcugc

SEQ ID NO: 220732 - RNA, 64 nt, hsa
gcacacacaaaaugcccaaggcacucacuggggaggaagcaaggaagcaaacagucugagaaaa

SEQ ID NO: 220733 - RNA, 64 nt, hsa
aaaaugcccaaggcacucacuggggaggaagcaaggaagcaaacagucugagaaaaugaugcaa

SEQ ID NO: 220734 - RNA, 64 nt, hsa
guggcugcucugcugacuaucuuuuaggaauucaggaagcaaaucacauagugacaaguccuua

SEQ ID NO: 220735 - RNA, 64 nt, hsa
auuucuccauuuguaauagcuggguauuuaaacuggaagcaaauaguuuucuuucuuaacaauu

SEQ ID NO: 220736 - RNA, 64 nt, hsa
cccugcagaaucaaucugagggaggggauaaagaggaagcaauaaaaaaaaaacauccgacaga

SEQ ID NO: 220737 - RNA, 64 nt, hsa
uaacuguaauauuugguugcucagcauaagugauggaagcaaacacuaauuucuaauaaaauug

SEQ ID NO: 220738 - RNA, 64 nt, hsa
ugcaucugcuaaugggagaccaaaucuuuguccgggaagcaagaagugggugggagaauguauc

SEQ ID NO: 220739 - RNA, 64 nt, hsa
uuaggucccuguccucugucuuugaggcugguuaggaagcaagaguccugaucuuucaugcugc

SEQ ID NO: 220740 - RNA, 64 nt, hsa
caugagaccaacaacacugucugccucagaacauagccgugaucaagaugagcacggaggcucg

SEQ ID NO: 220741 - RNA, 64 nt, hsa
ccaggcaggcaguccugucugcguguggaggagcagccgugacugcccguggcucugcugccgc

SEQ ID NO: 220742 - RNA, 64 nt, hsa
gggggucacggccuggacaagaaaggcuugacugagccgugaacugaagaaugguauccaguca

SEQ ID NO: 220743 - RNA, 64 nt, hsa
guuuuccagguuuaagcuguuacugucuucaguaagccgugauuuucauugcugggcuugucug

SEQ ID NO: 220744 - RNA, 64 nt, hsa
auugcccgagggcucagcaaggccaagaggagacagccgugacgguaaacuuccccucuaccag

SEQ ID NO: 220745 - RNA, 64 nt, hsa
ugcccuacaaaauuuguuuggcuuaaacgucaaaagccgugacaauuuguucuuugaugugauu

SEQ ID NO: 220746 - RNA, 64 nt, hsa
aagucugagcacuuuauguaaauuucuaggugugagccgugaucacauuuucuauuuauuucca

SEQ ID NO: 220747 - RNA, 64 nt, hsa
gcuugcuugagcccaggaggucaaggcugcagugagccgugauggcgccacugcacuucagccu

SEQ ID NO: 220748 - RNA, 64 nt, hsa
uaguugguguucaaaaaaacacuaguuuugugccagccgugaugcucaggcuugaaaugcauua

SEQ ID NO: 220749 - RNA, 64 nt, hsa
cugccuguuucuaaggaaaugcaugugugcccugagccgugaugauccucccauccguguugug

SEQ ID NO: 220750 - RNA, 64 nt, hsa
gauuguuugagccuaggagagggagguugcagugagccgugauugcaccacugcacuccagccu

SEQ ID NO: 220751 - RNA, 64 nt, hsa
gugaugggcucuucaaggucuuuaccccagaagaagccgugaacuucaucuuguccugucucga

SEQ ID NO: 220752 - RNA, 64 nt, hsa
acuguggcuggugccgucuugcaugaaacgcaugagccgugagcgcccaguucagacuggggcc

SEQ ID NO: 220753 - RNA, 64 nt, hsa
agccuggacugcuaccuuucaaagcuuggagggaagccgugaauucaguugguucguucuguac

SEQ ID NO: 220754 - RNA, 64 nt, hsa
gacgcuggcaccgugcugcuuguacagccugcagagccgugagccaaguaaaccucuuuaauua

SEQ ID NO: 220755 - RNA, 64 nt, hsa
aacccugucucuacuaaaaauacaaaaaguagccagccgugaugacaggcaccuguaaucccag

SEQ ID NO: 220756 - RNA, 64 nt, hsa
aggcagccugcagaccacacucugccuggccuugagccgugaccuccaggaagggaccccacug

SEQ ID NO: 220757 - RNA, 64 nt, hsa
gccauauaaaaauacaaagccucuugucaucaacagccgugaccacuuuagaaugaaccaguuc

SEQ ID NO: 220758 - RNA, 64 nt, hsa
cagcaggaggagcaccgggcuugggcuuccucugagccgugaugccaaagguugcgacuccuga

SEQ ID NO: 220759 - RNA, 64 nt, hsa
gaucucuugagcccaggaggucaaggcuauggugagccgugauugugccacugcauaccagccu

SEQ ID NO: 220760 - RNA, 64 nt, hsa
gccagauacugaauccaguacuuucaguuuggcgagccgugaggucucugucgaaacuacucaa

SEQ ID NO: 220761 - RNA, 64 nt, hsa
gugcgagccugagauggucuggaggauucucucuagccgugacuccgcugcucugaaggucaac

SEQ ID NO: 220762 - RNA, 64 nt, hsa
gccagcgcccugggagacagcaccguggacagcaagccgugaggagggagcccgcucaggaugg

SEQ ID NO: 220763 - RNA, 64 nt, hsa
guugcugugaauacuucucucagugugagagguuagccgugaugaaagcagcguuacuucugac

SEQ ID NO: 220764 - RNA, 64 nt, hsa
uagcgaguccauggagcugagcagcaggaggaggagccgugacccuguggaaggugcgucgggc

SEQ ID NO: 220765 - RNA, 64 nt, hsa
uuacucauaacuucucuuccaaaauguguaacacagccgugaaagugaacauuaggaauaugua

SEQ ID NO: 220766 - RNA, 64 nt, hsa
caucuuagaaaaugccucugaauguuuucauaggagccgugaccuuugguucuucaucucuacc

SEQ ID NO: 220767 - RNA, 64 nt, hsa
gcuuggucccacaggccacggaccaauggccugcagccgugacaacacuccugucauauuggag

SEQ ID NO: 220768 - RNA, 64 nt, hsa
aauugcuugggcccaggaauucaaggcuagagugagccgugaucaccagugcacucuagccugg

SEQ ID NO: 220769 - RNA, 64 nt, hsa
auguugaccuacguuaaaagaugaauaggucuagagccgugauuucaagcuauuuuccugaaau

SEQ ID NO: 220770 - RNA, 64 nt, hsa
uagucuucauccccacgugaacaaaaugggaaggagccgugaggagaggagugaggcaacaggc

SEQ ID NO: 220771 - RNA, 64 nt, hsa
gcucucccaagcuuccccgccccuccccugggucagccgugaggcccaccuuugccacccucag

SEQ ID NO: 220772 - RNA, 64 nt, hsa
gguuucacacuuuuuaaccccucugugcuuuagcagccgugaccuugccuucauugcuucaucc

SEQ ID NO: 220773 - RNA, 64 nt, hsa
ugaauugggaauguuguuccaggauguggaaugcagccgugaucacacuuaccgagcuuacuuu

SEQ ID NO: 220774 - RNA, 64 nt, hsa
ucaggggcccuccccucgguguggcuggugggugagccgugaagggacccugccuuucagggca

SEQ ID NO: 220775 - RNA, 64 nt, hsa
uaagggucucgaccccuuggcuucugaagacacgagccgugaguaggcaggggauuguaguagc

SEQ ID NO: 220776 - RNA, 64 nt, hsa
aaagcgaucugacaugaaagucauuaacaaagccagccgugaaaaggugccccagaguugcugu

SEQ ID NO: 220777 - RNA, 64 nt, hsa
acuagacaagccagaacuugacccugagcugaccagccgugagcauguuuggaaggggucugua

SEQ ID NO: 220778 - RNA, 64 nt, hsa
gcucugucugaugcccucuccauagcccagcuggagccgugaacacugggguccccuggcagag

SEQ ID NO: 220779 - RNA, 64 nt, hsa
uaggcuggaagaacaguuauuggcaaguaugcagagccgugaacgucauggcauguccaaggaa

SEQ ID NO: 220780 - RNA, 64 nt, hsa
gcucuugucccacgugucuuccacuuugcauaugagccgugaacugugcauagugcugggaugg

SEQ ID NO: 220781 - RNA, 64 nt, hsa
ugauuucaaggcaugagcugaacagcguugacacagccgugacuuacaauuaaacccuuucaau

SEQ ID NO: 220782 - RNA, 64 nt, hsa
ggcugacgacaaaguuguacauccugaaccccaaagccgugagugucauagaacucuacggcau

SEQ ID NO: 220783 - RNA, 63 nt, hsa
aucacaugccaccacacugauaccauggggggaagccgugacuagccuuucaucaguguccug

SEQ ID NO: 220784 - RNA, 64 nt, hsa
uugauuuccgcucguguuuauaggauuuccacuuagccgugaucaguaguuaagcacaggaaaa

SEQ ID NO: 220785 - RNA, 64 nt, hsa
gaucaccuaaggccaggaggucaaggcugcggugagccgugauugugccaauguacuccagccu

SEQ ID NO: 220786 - RNA, 64 nt, hsa
agaaaacgcgaccuuggccgcaccuaaagcagccagccgugagugcagaccccuuggccagcgu

SEQ ID NO: 220787 - RNA, 64 nt, hsa
aaucacuugagaccaggaaguugaggcugcaaugagccgugaucaugccacugcacuccagccu

SEQ ID NO: 220788 - RNA, 64 nt, hsa
ugagacccucguggccuuccccagccucuucuagagccgugaugccucccuguugaagcucugg

SEQ ID NO: 220789 - RNA, 64 nt, hsa
augcuuuugugagcaagcaaaagcagaaacgugaagccgugauacaaauuggugaacaaaaaau

SEQ ID NO: 220790 - RNA, 64 nt, hsa
agggcugagguggggccggcagggggcgccaggcagccgugaucacaggugacgaccgcaccgc

SEQ ID NO: 220791 - RNA, 64 nt, hsa
uaaugaucaagcccuauaauuagcuucucauuagagccgugauggugaugugugcugucuaaaa

SEQ ID NO: 220792 - RNA, 64 nt, hsa
ucuccguguuuuccaguuaauuacauccucaugcagccgugaucaagggaauguaacugcugaa

SEQ ID NO: 220793 - RNA, 64 nt, hsa
aaucuuuccccagauaauauuuugcccuagaagaagccgugauuuagcucuuuuauugugcuua

SEQ ID NO: 220794 - RNA, 64 nt, hsa
cuggcccugccccuccucauuacaguaugaagggagccgugacacgcagcauuuuccugccguu

SEQ ID NO: 220795 - RNA, 64 nt, hsa
uuaguuuaaaaaaaagacaaaaaaaaaaaagccaagccgugagccgaccagaaggccguccucu

SEQ ID NO: 220796 - RNA, 56 nt, hsa
acgugcucugugaugguuagcauccuagccgugaguuggaacuuaaagguuuuuac

SEQ ID NO: 220797 - RNA, 64 nt, hsa
gggacagagaggggcagguugaccgggacuucaaagccgugaucgugaauaucgagaacugcca

SEQ ID NO: 220798 - RNA, 64 nt, hsa
ccaccgggacaacuucagcccuuaccuguuugccagccgugaccaccugcugugaggcccgacc

SEQ ID NO: 220799 - RNA, 64 nt, hsa
aucacuugagccugggagauagaggcuugcagugagccgugauggcaccauugcacuccaaccg

SEQ ID NO: 220800 - RNA, 64 nt, hsa
aggccagaguucaaaugugacuccaccucuuaaaagccgugauuucuagcaguugacuucaccu

SEQ ID NO: 220801 - RNA, 64 nt, hsa
gcgaggucccccaggccucagccuggagcuccugagccgugacaguuuucaggggccgugcagg

SEQ ID NO: 220802 - RNA, 64 nt, hsa
gauugccugagaccaggagguugaggcugcagugagccgugauuucaccaccacuccagccugg

SEQ ID NO: 220803 - RNA, 51 nt, hsa
cuggccuuaauccauuauagcagccgugaugucauuucuguauuucaggaa

SEQ ID NO: 220804 - RNA, 51 nt, hsa
cuuucaauaauccaacguagcagccgugaugucauuuuuguauuucaggaa

SEQ ID NO: 220805 - RNA, 51 nt, hsa
cucuccuuaauccaauauagcagccgugaagucauuucuguauuucaggaa

SEQ ID NO: 220806 - RNA, 64 nt, hsa
gaucaugugagccugggaggucaaggcugcagugagccgugauugcaccacugcacuccagccu

SEQ ID NO: 220807 - RNA, 64 nt, hsa
acaguauuccuuugucugucgaggcugggaggguagccgugagcguggugggugggugguguga

SEQ ID NO: 220808 - RNA, 64 nt, hsa
cacauguaauuaaauuccaggcaaccagcacaagagccgugagcuuggcacaugugcugcucgu

SEQ ID NO: 220809 - RNA, 64 nt, hsa
gcuugucgggcuugggugaggaagggggcacaggagccgugaccccugaggaggcacagcgccu

SEQ ID NO: 220810 - RNA, 64 nt, hsa
acccgccuucagccucccaacgugcugggauuacagccgugagccgccgcgccuggccuagacu

SEQ ID NO: 220811 - RNA, 64 nt, hsa
gacagggcaccccaaacccccaacucccaauaaaagccgugacguucggacaaaccgcguacug

SEQ ID NO: 220812 - RNA, 64 nt, hsa
uuugauccuguuggccagaggauguuugacacccagccgugacucagccuggacaccggacaug

SEQ ID NO: 220813 - RNA, 64 nt, hsa
auauuaucgaaaaaagaaaagaauucuaaugaccagccgugaauguguaggguugcagcucuau

SEQ ID NO: 220814 - RNA, 64 nt, hsa
gaucgcuggagccugggaaguugaggcugcagugagccgugaucaugccacugcauuccagccu

SEQ ID NO: 220815 - RNA, 64 nt, hsa
gcuguagcacaggcuucacagugauuuuguguucagccgugagucacacuacaugcccccguga

SEQ ID NO: 220816 - RNA, 64 nt, hsa
agccucugcucuguggcuccauucaggcuuuuucaucuacgaaggcccugagguucccaucaac

SEQ ID NO: 220817 - RNA, 64 nt, hsa
cuaaacauauaacuauauguuuuaagaagaaaacaucuacgaaagguaaaaagagaugaucagu

SEQ ID NO: 220818 - RNA, 64 nt, hsa
uuaaucugagcaggucugaauugaccaaaugcuuaucuacgagguuccuagagcucugcugacc

SEQ ID NO: 220819 - RNA, 64 nt, hsa
uuugacaaagcucagcagaaacuugaugugaaaaaucuacgauuuucuucuacauucauugaug

SEQ ID NO: 220820 - RNA, 64 nt, hsa
accgcaaggguagacugguuuauccacccacaacaucuacgaaucguacuucuuuaauugaucu

SEQ ID NO: 220821 - RNA, 64 nt, hsa
aauuaaggacugagaaaugaccauaucuuaaacuaucuacgacaaagugaacuuaaaaggacau

SEQ ID NO: 220822 - RNA, 64 nt, hsa
agggucuuugugugcuguggauuuuguggcuucaaucuacgauguuaaaacaaauuaaaaacac

SEQ ID NO: 220823 - RNA, 64 nt, hsa
uaauauuuuuuucuagaaaacaggugacauuuguaucuacgauaaaaauuuuuauacagaaccu

SEQ ID NO: 220824 - RNA, 64 nt, hsa
aaccuagaccuaucagugccauuuuuuuuucauaaucuacgaagaacuuggcuauggcugaucu

SEQ ID NO: 220825 - RNA, 64 nt, hsa
uuuuuuuguuguuuguucauuuuguaucaguauaaucuacgauucuguuagaaguaucuucuca

SEQ ID NO: 220826 - RNA, 64 nt, hsa
aaagccaucuuauacaaaauuauucacauuuuucaucuacgauucaacuaaucgaaggauuaaa

SEQ ID NO: 220827 - RNA, 64 nt, hsa
gguacuauuauaauucuuacuugcagaauguucaaucuacgaguguucauggaagccaaaaaau

SEQ ID NO: 220828 - RNA, 64 nt, hsa
aauugguuucuguaaaacguguaauaaguugaguaucuacgaagaguaucaaguucugaaguuu

SEQ ID NO: 220829 - RNA, 64 nt, hsa
ccagaugaccagcggcaaccucaucgccuucaucaucuacgaguuuguccugggagauuguaug

SEQ ID NO: 220830 - RNA, 64 nt, hsa
uaaugcuuugaugaaaaggcuuuauaugcaguagaucuacgaaaauauuguucauacugaucag

SEQ ID NO: 220831 - RNA, 64 nt, hsa
uccaagguccaauugacugacgcccuugacagccaucuacgacuuuauuaacagguuacuguga

SEQ ID NO: 220832 - RNA, 64 nt, hsa
ugccuugaacaacccaaucuggcugguaaaugacaucuacgaagccacaggccuggccucaacu

SEQ ID NO: 220833 - RNA, 64 nt, hsa
gcuaggggccagucucuucaccauuggcuucgccaucuacgagguucccaaagagguauagcag

SEQ ID NO: 220834 - RNA, 64 nt, hsa
aacccucugugugcaggccagccuguccccggucaucuacgacagccuaaccggccucaugacu

SEQ ID NO: 220835 - RNA, 64 nt, hsa
cacacauaggcucaaaauaaaaggauggaggaagaucuacgaagcaaauggaaaacaaacaaaa

SEQ ID NO: 220836 - RNA, 50 nt, hsa
gaacacaugcuggagcgugaaucuacgaauacaguggaccugggagagug

SEQ ID NO: 220837 - RNA, 64 nt, hsa; identical to SEQ ID NO: 99154

SEQ ID NO: 220838 - RNA, 64 nt, hsa; identical to SEQ ID NO: 99155

SEQ ID NO: 220839 - RNA, 64 nt, hsa; identical to SEQ ID NO: 99156

SEQ ID NO: 220840 - RNA, 64 nt, hsa; identical to SEQ ID NO: 99157

SEQ ID NO: 220841 - RNA, 64 nt, hsa; identical to SEQ ID NO: 99158

SEQ ID NO: 220842 - RNA, 64 nt, hsa; identical to SEQ ID NO: 99159

SEQ ID NO: 220843 - RNA, 64 nt, hsa; identical to SEQ ID NO: 99160

SEQ ID NO: 220844 - RNA, 64 nt, hsa; identical to SEQ ID NO: 99161

SEQ ID NO: 220845 - RNA, 64 nt, hsa; identical to SEQ ID NO: 99162

SEQ ID NO: 220846 - RNA, 64 nt, hsa; identical to SEQ ID NO: 99163

SEQ ID NO: 220847 - RNA, 64 nt, hsa; identical to SEQ ID NO: 99164

SEQ ID NO: 220848 - RNA, 64 nt, hsa; identical to SEQ ID NO: 99165

SEQ ID NO: 220849 - RNA, 64 nt, hsa; identical to SEQ ID NO: 99166

SEQ ID NO: 220850 - RNA, 64 nt, hsa; identical to SEQ ID NO: 99167

SEQ ID NO: 220851 - RNA, 64 nt, hsa; identical to SEQ ID NO: 99168

SEQ ID NO: 220852 - RNA, 64 nt, hsa; identical to SEQ ID NO: 99169

SEQ ID NO: 220853 - RNA, 64 nt, hsa; identical to SEQ ID NO: 99170

SEQ ID NO: 220854 - RNA, 64 nt, hsa; identical to SEQ ID NO: 99171

SEQ ID NO: 220855 - RNA, 64 nt, hsa; identical to SEQ ID NO: 99172

SEQ ID NO: 220856 - RNA, 64 nt, hsa; identical to SEQ ID NO: 99173

SEQ ID NO: 220857 - RNA, 64 nt, hsa; identical to SEQ ID NO: 99174

SEQ ID NO: 220858 - RNA, 64 nt, hsa; identical to SEQ ID NO: 99175

SEQ ID NO: 220859 - RNA, 64 nt, hsa; identical to SEQ ID NO: 99176

SEQ ID NO: 220860 - RNA, 64 nt, hsa; identical to SEQ ID NO: 99177

SEQ ID NO: 220861 - RNA, 64 nt, hsa; identical to SEQ ID NO: 99178

SEQ ID NO: 220862 - RNA, 64 nt, hsa; identical to SEQ ID NO: 99179

SEQ ID NO: 220863 - RNA, 64 nt, hsa; identical to SEQ ID NO: 92519

SEQ ID NO: 220864 - RNA, 64 nt, hsa; identical to SEQ ID NO: 92520

SEQ ID NO: 220865 - RNA, 64 nt, hsa; identical to SEQ ID NO: 92521

SEQ ID NO: 220866 - RNA, 64 nt, hsa; identical to SEQ ID NO: 92522

SEQ ID NO: 220867 - RNA, 64 nt, hsa; identical to SEQ ID NO: 92523

SEQ ID NO: 220868 - RNA, 64 nt, hsa; identical to SEQ ID NO: 92524

SEQ ID NO: 220869 - RNA, 64 nt, hsa; identical to SEQ ID NO: 92525

SEQ ID NO: 220870 - RNA, 64 nt, hsa; identical to SEQ ID NO: 92526

SEQ ID NO: 220871 - RNA, 64 nt, hsa; identical to SEQ ID NO: 92527

SEQ ID NO: 220872 - RNA, 64 nt, hsa; identical to SEQ ID NO: 92528

SEQ ID NO: 220873 - RNA, 64 nt, hsa; identical to SEQ ID NO: 92529

SEQ ID NO: 220874 - RNA, 64 nt, hsa; identical to SEQ ID NO: 92530

SEQ ID NO: 220875 - RNA, 64 nt, hsa; identical to SEQ ID NO: 92531

SEQ ID NO: 220876 - RNA, 64 nt, hsa; identical to SEQ ID NO: 92532

SEQ ID NO: 220877 - RNA, 64 nt, hsa; identical to SEQ ID NO: 92533

SEQ ID NO: 220878 - RNA, 64 nt, hsa; identical to SEQ ID NO: 92534

SEQ ID NO: 220879 - RNA, 64 nt, hsa; identical to SEQ ID NO: 92535

SEQ ID NO: 220880 - RNA, 64 nt, hsa; identical to SEQ ID NO: 92536

SEQ ID NO: 220881 - RNA, 64 nt, hsa; identical to SEQ ID NO: 92537

SEQ ID NO: 220882 - RNA, 64 nt, hsa; identical to SEQ ID NO: 92538

SEQ ID NO: 220883 - RNA, 64 nt, hsa; identical to SEQ ID NO: 92539

SEQ ID NO: 220884 - RNA, 64 nt, hsa; identical to SEQ ID NO: 92540

SEQ ID NO: 220885 - RNA, 64 nt, hsa; identical to SEQ ID NO: 92541

SEQ ID NO: 220886 - RNA, 64 nt, hsa; identical to SEQ ID NO: 92542

SEQ ID NO: 220887 - RNA, 64 nt, hsa; identical to SEQ ID NO: 92543

SEQ ID NO: 220888 - RNA, 64 nt, hsa; identical to SEQ ID NO: 92544

SEQ ID NO: 220889 - RNA, 64 nt, hsa; identical to SEQ ID NO: 92545

SEQ ID NO: 220890 - RNA, 64 nt, hsa; identical to SEQ ID NO: 92546

SEQ ID NO: 220891 - RNA, 64 nt, hsa; identical to SEQ ID NO: 92547

SEQ ID NO: 220892 - RNA, 64 nt, hsa; identical to SEQ ID NO: 92548

SEQ ID NO: 220893 - RNA, 64 nt, hsa; identical to SEQ ID NO: 92549

SEQ ID NO: 220894 - RNA, 64 nt, hsa; identical to SEQ ID NO: 92550

SEQ ID NO: 220895 - RNA, 64 nt, hsa; identical to SEQ ID NO: 92551

SEQ ID NO: 220896 - RNA, 64 nt, hsa; identical to SEQ ID NO: 92552

SEQ ID NO: 220897 - RNA, 64 nt, hsa; identical to SEQ ID NO: 92553

SEQ ID NO: 220898 - RNA, 64 nt, hsa; identical to SEQ ID NO: 92554

SEQ ID NO: 220899 - RNA, 64 nt, hsa; identical to SEQ ID NO: 92555

SEQ ID NO: 220900 - RNA, 64 nt, hsa; identical to SEQ ID NO: 92556

SEQ ID NO: 220901 - RNA, 64 nt, hsa; identical to SEQ ID NO: 92557

SEQ ID NO: 220902 - RNA, 64 nt, hsa; identical to SEQ ID NO: 92558

SEQ ID NO: 220903 - RNA, 64 nt, hsa; identical to SEQ ID NO: 92559

SEQ ID NO: 220904 - RNA, 64 nt, hsa; identical to SEQ ID NO: 92560

SEQ ID NO: 220905 - RNA, 64 nt, hsa; identical to SEQ ID NO: 92561

SEQ ID NO: 220906 - RNA, 64 nt, hsa; identical to SEQ ID NO: 92562

SEQ ID NO: 220907 - RNA, 64 nt, hsa; identical to SEQ ID NO: 92563

SEQ ID NO: 220908 - RNA, 64 nt, hsa; identical to SEQ ID NO: 92564

SEQ ID NO: 220909 - RNA, 64 nt, hsa; identical to SEQ ID NO: 92565

SEQ ID NO: 220910 - RNA, 64 nt, hsa; identical to SEQ ID NO: 92566

SEQ ID NO: 220911 - RNA, 64 nt, hsa; identical to SEQ ID NO: 92567

SEQ ID NO: 220912 - RNA, 64 nt, hsa; identical to SEQ ID NO: 92568

SEQ ID NO: 220913 - RNA, 64 nt, hsa; identical to SEQ ID NO: 92569

SEQ ID NO: 220914 - RNA, 64 nt, hsa; identical to SEQ ID NO: 92570

SEQ ID NO: 220915 - RNA, 64 nt, hsa; identical to SEQ ID NO: 92571

SEQ ID NO: 220916 - RNA, 64 nt, hsa; identical to SEQ ID NO: 92572

SEQ ID NO: 220917 - RNA, 64 nt, hsa; identical to SEQ ID NO: 92573

SEQ ID NO: 220918 - RNA, 64 nt, hsa; identical to SEQ ID NO: 92574

SEQ ID NO: 220919 - RNA, 64 nt, hsa; identical to SEQ ID NO: 92575

SEQ ID NO: 220920 - RNA, 64 nt, hsa; identical to SEQ ID NO: 92576

SEQ ID NO: 220921 - RNA, 64 nt, hsa; identical to SEQ ID NO: 92577

SEQ ID NO: 220922 - RNA, 64 nt, hsa; identical to SEQ ID NO: 92578

SEQ ID NO: 220923 - RNA, 64 nt, hsa; identical to SEQ ID NO: 92579

SEQ ID NO: 220924 - RNA, 64 nt, hsa; identical to SEQ ID NO: 92580

SEQ ID NO: 220925 - RNA, 64 nt, hsa; identical to SEQ ID NO: 92581

SEQ ID NO: 220926 - RNA, 64 nt, hsa; identical to SEQ ID NO: 92582

SEQ ID NO: 220927 - RNA, 64 nt, hsa; identical to SEQ ID NO: 92583

SEQ ID NO: 220928 - RNA, 64 nt, hsa; identical to SEQ ID NO: 92584

SEQ ID NO: 220929 - RNA, 64 nt, hsa; identical to SEQ ID NO: 92585

SEQ ID NO: 220930 - RNA, 64 nt, hsa; identical to SEQ ID NO: 92586

SEQ ID NO: 220931 - RNA, 64 nt, hsa; identical to SEQ ID NO: 92587

SEQ ID NO: 220932 - RNA, 64 nt, hsa; identical to SEQ ID NO: 92588

SEQ ID NO: 220933 - RNA, 64 nt, hsa; identical to SEQ ID NO: 92589

SEQ ID NO: 220934 - RNA, 64 nt, hsa; identical to SEQ ID NO: 92590

SEQ ID NO: 220935 - RNA, 64 nt, hsa; identical to SEQ ID NO: 92591

SEQ ID NO: 220936 - RNA, 64 nt, hsa; identical to SEQ ID NO: 92592

SEQ ID NO: 220937 - RNA, 64 nt, hsa; identical to SEQ ID NO: 92593

SEQ ID NO: 220938 - RNA, 64 nt, hsa; identical to SEQ ID NO: 92594

SEQ ID NO: 220939 - RNA, 64 nt, hsa; identical to SEQ ID NO: 92595

SEQ ID NO: 220940 - RNA, 64 nt, hsa; identical to SEQ ID NO: 92596

SEQ ID NO: 220941 - RNA, 64 nt, hsa; identical to SEQ ID NO: 92597

SEQ ID NO: 220942 - RNA, 64 nt, hsa; identical to SEQ ID NO: 92598

SEQ ID NO: 220943 - RNA, 64 nt, hsa; identical to SEQ ID NO: 92599

SEQ ID NO: 220944 - RNA, 64 nt, hsa; identical to SEQ ID NO: 92600

SEQ ID NO: 220945 - RNA, 64 nt, hsa; identical to SEQ ID NO: 92601

SEQ ID NO: 220946 - RNA, 64 nt, hsa; identical to SEQ ID NO: 92602

SEQ ID NO: 220947 - RNA, 64 nt, hsa; identical to SEQ ID NO: 92603

SEQ ID NO: 220948 - RNA, 64 nt, hsa; identical to SEQ ID NO: 92604

SEQ ID NO: 220949 - RNA, 64 nt, hsa; identical to SEQ ID NO: 92605

SEQ ID NO: 220950 - RNA, 64 nt, hsa; identical to SEQ ID NO: 92606

SEQ ID NO: 220951 - RNA, 64 nt, hsa; identical to SEQ ID NO: 92607

SEQ ID NO: 220952 - RNA, 64 nt, hsa; identical to SEQ ID NO: 92608

SEQ ID NO: 220953 - RNA, 64 nt, hsa; identical to SEQ ID NO: 92609

SEQ ID NO: 220954 - RNA, 64 nt, hsa; identical to SEQ ID NO: 92610

SEQ ID NO: 220955 - RNA, 64 nt, hsa; identical to SEQ ID NO: 92611

SEQ ID NO: 220956 - RNA, 64 nt, hsa; identical to SEQ ID NO: 92612

SEQ ID NO: 220957 - RNA, 64 nt, hsa; identical to SEQ ID NO: 92613

SEQ ID NO: 220958 - RNA, 64 nt, hsa
ucccucucugaccugcagguuaacaaagaaugcguccgaggacuuugggccgggcagcagcagg

SEQ ID NO: 220959 - RNA, 64 nt, hsa
ggucuugucaccuuucaacuucgaggacuggaauuccgaggaaccuacugccagcagagggagg

SEQ ID NO: 220960 - RNA, 64 nt, hsa
gaagugcgugaauguauguaaugugugguggccucagcugaaugccuccuguggggaaaggggu

SEQ ID NO: 220961 - RNA, 64 nt, hsa
caaggacgguucuuacacaggcuucaucaagguucagcugaagcuggugcgcccugucucugug

SEQ ID NO: 220962 - RNA, 64 nt, hsa
agggcguuuuucagagcugcagggacagggugagcagcugaagggcuaggagggaagccggccc

SEQ ID NO: 220963 - RNA, 64 nt, hsa
ggaagccggcccccgcucugcagaagcugcauuucagcugaaucuguguuucagccucaguugg

SEQ ID NO: 220964 - RNA, 64 nt, hsa
aaccauucuuuaaaggugaguggaggcugauuugcagcugaagugggccagccuugcaccagcc

SEQ ID NO: 220965 - RNA, 64 nt, hsa
gacagcuaucuaagcucuggacuaccccuuugugcagcugaaucacugcaggguugaccaugcc

SEQ ID NO: 220966 - RNA, 64 nt, hsa
guacgucugacaugaaaacuucucaccgccucagcagcugaacuaaaaaccugaauagccauga

SEQ ID NO: 220967 - RNA, 64 nt, hsa
caguauuuggcaauaaaagaaagaagaaauagaacagcugaagucucaaaucauugucuggaau

SEQ ID NO: 220968 - RNA, 64 nt, hsa
gcucacauaaagagaguguuauauaaaaauccgacagcugaacuagguugcucuuuuuuggcag

SEQ ID NO: 220969 - RNA, 64 nt, hsa
aaugugcauagaguuuguauuuuauuuuuauuagcagcugaaaugccuuugguuuuggcuucuc

SEQ ID NO: 220970 - RNA, 64 nt, hsa
ugucuaugguguuacagaagugcuacacgggcuacagcugaagauuggaauacuaaaguaagug

SEQ ID NO: 220971 - RNA, 64 nt, hsa
ucagcaaaagaacauggaaugccugaaaagaauccagcugaagggaauacaguauuuguuuaua

SEQ ID NO: 220972 - RNA, 64 nt, hsa
gaaaucuaacucccugaaaccucuuucuaugucccagcugaagcaauggaaacauuuuucugga

SEQ ID NO: 220973 - RNA, 64 nt, hsa
ccauaggaagaaaaggaguuaggagaaagaagagcagcugaacuuacuugccucacuggacucu

SEQ ID NO: 220974 - RNA, 64 nt, hsa
uucccauccagagacauucucuggcaaguguucucagcugaaaagugguuggggaugauucuua

SEQ ID NO: 220975 - RNA, 64 nt, hsa
augcccaauauuugagguggcucugauuuccuggcagcugaacucggguaguccaguggccuag

SEQ ID NO: 220976 - RNA, 64 nt, hsa
cagugccgaagaggagcaggcacagcuacaugggcagcugaaggagcaaagggugcacugccag

SEQ ID NO: 220977 - RNA, 64 nt, hsa
ugcuagagcagaagcggaaggccgcuuccuuucucagcugaaccccuacucccggagcccccag

SEQ ID NO: 220978 - RNA, 64 nt, hsa
ugcuagagcagaagcggaaggccgcuuccuuucucagcugaaccccuacccggagcccccagca

SEQ ID NO: 220979 - RNA, 64 nt, hsa
ccaguccaagaggaggaggacgaaggccuagacucagcugaaggaucuucaaagcaggaugaag

SEQ ID NO: 220980 - RNA, 64 nt, hsa
gaugaagaccuagacuuaccugaaggccuagacucagcugaaggaucuucaaagcaggaugaag

SEQ ID NO: 220981 - RNA, 64 nt, hsa
cagggaguggaauuucgucaaccgguacuuuuaagguuaggaugggacgggaaaagugaagcag

SEQ ID NO: 220982 - RNA, 64 nt, hsa
uagauagugcuaaauauuuuagcucaugaaacuugguuaggauggcuggggguacaagucccca

SEQ ID NO: 220983 - RNA, 64 nt, hsa
uacacagaaaauuuugacuuaaaacaucugcugaauuccaaauuucuguaauagcuacuguauc

SEQ ID NO: 220984 - RNA, 64 nt, hsa
agagauuauuaauaugguagaacccuguuauguaauuccaaaacuuaagaaccauauuuacauu

SEQ ID NO: 220985 - RNA, 64 nt, hsa
uaaaacauucugcuuaaaaaccauauaaaauauaauuccaaagucucugcugucaagauagauu

SEQ ID NO: 220986 - RNA, 64 nt, hsa
caaagaaaauauuaaggucuccccuuuuucuaugauuccaaaaggaccaguagaauuuaaauug

SEQ ID NO: 220987 - RNA, 64 nt, hsa
aaaugauauucuuaaaauuuuuucccaccaagguauuccaaagaaaauauuaaggucuccccuu

SEQ ID NO: 220988 - RNA, 64 nt, hsa
uuuacaccuggcagcacggcagccacacaccgguauuccaaaccuuaacaaugaaggggguuag

SEQ ID NO: 220989 - RNA, 64 nt, hsa
cuuuuuaauauucuggcaaucuuuagaaagggagauuccaaacucccauuugguaaaccaguug

SEQ ID NO: 220990 - RNA, 64 nt, hsa
aaacucacuucaaugaacaaagggauucuccaggauuccaaaguuuugaagucaucuuagcuuu

SEQ ID NO: 220991 - RNA, 64 nt, hsa
ccgagucuaggaaugcuuuuauucaagacaccaaauuccaaacuucuaaauguuggaauuuuca

SEQ ID NO: 220992 - RNA, 64 nt, hsa
uugcccaguacauuuaaauuuuuuggcacuugccauuccaaaauauuaugccccaccaaggcug

SEQ ID NO: 220993 - RNA, 64 nt, hsa
cuuguuuugaaaauaaccuaauuaauauauuaaaauuccaaauucauggcaugcuuaaauuuua

SEQ ID NO: 220994 - RNA, 64 nt, hsa
gggacuuuuagauguacauuggcacuuggauuagauuccaaaagacaaaaguguugggugcuuc

SEQ ID NO: 220995 - RNA, 64 nt, hsa
uguguaugugcuuugguuguaggaaaacuugaaaauuccaaaauccuuauuuuccuauuugaga

SEQ ID NO: 220996 - RNA, 64 nt, hsa
gaccuaauacauuuccucuguguguguguguaacauuccaaauacuuuuuuuuucuuuuccacu

SEQ ID NO: 220997 - RNA, 64 nt, hsa
agcaauucauuucugaaagcaguugagccacuuuauuccaaaguacacugcagauguucaaacu

SEQ ID NO: 220998 - RNA, 64 nt, hsa
caaucacuguccgauuguaagcuauguugggccaauuccaaaauauuauacgauggagagguca

SEQ ID NO: 220999 - RNA, 64 nt, hsa
gaauucaggcaugacucaaaccuggauguacuugauuccaaaugccauguuguuuucacucucu

SEQ ID NO: 221000 - RNA, 64 nt, hsa
caaguguaggaaggcacgcuggaucgucuaucugauuccaaagcuguccuuugccaucucaucc

SEQ ID NO: 221001 - RNA, 64 nt, hsa
ggagcacauuuuguggaccugguuccaccuuuccauuccaaaccaccuguuuccccuuccauua

SEQ ID NO: 221002 - RNA, 64 nt, hsa
aauauaggagacccuucacauucccaaggaauauauuccaaaacauuuuugugaauaucuaagu

SEQ ID NO: 221003 - RNA, 64 nt, hsa
cuuguugauauaaccuuuuuaguuaaccugaaagauuccaaaaauuguucuuaagugcuugaga

SEQ ID NO: 221004 - RNA, 64 nt, hsa
uaaugaccaaaucacauuaucuauuuuagcacucauuccaaaauucaguauuuaauguaauuaa

SEQ ID NO: 221005 - RNA, 64 nt, hsa
cacuuuaaaaaccgccuuguaaguucuggggagcauuccaaagcaguauauugguuccaauuag

SEQ ID NO: 221006 - RNA, 64 nt, hsa
auaaauaaauuuuuaaagaguaagugcuauuggcauuccaaaauucagcuaaaggaaaaaugau

SEQ ID NO: 221007 - RNA, 64 nt, hsa
uacauguaauaugaaaauugagauugaagcacuaauuccaaaauuauggcugaauauacuaaau

SEQ ID NO: 221008 - RNA, 64 nt, hsa
ugacauaguugaugcauccaauccuaaaacuuacauuccaaaggaauuauaucauuauguuccu

SEQ ID NO: 221009 - RNA, 64 nt, hsa
guacaucuugaggccucucagcaggagacaaaggauuccaaaaagagauguggaggugcugagg

SEQ ID NO: 221010 - RNA, 64 nt, hsa
uucauuaacaguacuaaguggaagggaucugcagauuccaaacuggaauaagcucuaucauauu

SEQ ID NO: 221011 - RNA, 64 nt, hsa
uauauguaacucauuuuaaaauauauuaaauuguauuccaaaccuguucuucuguuucuguggc

SEQ ID NO: 221012 - RNA, 64 nt, hsa
ucucaagaaucaagguaccccaauauaucucgcaauuccaaacuuuguuugagggacucguuau

SEQ ID NO: 221013 - RNA, 64 nt, hsa
cagggaauguaaguuuauuaccaaagugauauguauuccaaaaaagucauagaagaugaagcac

SEQ ID NO: 221014 - RNA, 64 nt, hsa
aacuguaacuuaaauuccaaacuaugacuacuacauuccaaagaaacaguugaauuaaacauuu

SEQ ID NO: 221015 - RNA, 64 nt, hsa
cauaaaaaccacauagaacugaacuguaacuuaaauuccaaacuaugacuacuacauuccaaag

SEQ ID NO: 221016 - RNA, 64 nt, hsa
agccucagccagcguggguccugggggaaauaccauuccaaaggaagccaucccuauggggaaa

SEQ ID NO: 221017 - RNA, 64 nt, hsa
aauuuaauucugcucuguccggcgcauaggcugaauuccaaaagaacuuucuuccuaggaugug

SEQ ID NO: 221018 - RNA, 64 nt, hsa
cuaaagugcauguucuaaaacaagagcuauccucauuccaaauuuuaaaauauguacucuggcc

SEQ ID NO: 221019 - RNA, 64 nt, hsa
caacauuaaggagaaauuguaccuuaaguuaguaauuccaaaucuaucugaguuguauacccau

SEQ ID NO: 221020 - RNA, 64 nt, hsa
cucuuguggcugaugccauuauugcacauuggccauuccaaaccuguggagaacuuuguuguca

SEQ ID NO: 221021 - RNA, 64 nt, hsa
agaaggaggcuagcuucuagccuggguggccauuauuccaaaaggucauuguuucucacuagac

SEQ ID NO: 221022 - RNA, 64 nt, hsa
cugucuaaagucaaucauccgagauggguuuuccauuccaaagaaaggcaauaugguuccuucc

SEQ ID NO: 221023 - RNA, 64 nt, hsa
guguucaagggaaaugaucagucauugcauuguuauuccaaagagcagccaacaguggccuccc

SEQ ID NO: 221024 - RNA, 64 nt, hsa
cugcguuaugaagagcuaauuuacuggacaaagaauuccaaagcaaaaccagaacaguaugaau

SEQ ID NO: 221025 - RNA, 64 nt, hsa
cauuccaaaguucaacuuggugacacucuauaagauuccaaaaagcacauauuagugcagccaa

SEQ ID NO: 221026 - RNA, 64 nt, hsa
gcccggcacagaugcuccagggaugauucaagccauuccaaaguucaacuuggugacacucuau

SEQ ID NO: 221027 - RNA, 64 nt, hsa
gcccucugccucagcaguaccaguauaagaugacauuccaaagacuggaggcaacucagccuga

SEQ ID NO: 221028 - RNA, 64 nt, hsa
uuaucaguggcucuuggguucaaaguaauaaagaauuccaaaacugagauguuugcuuucucua

SEQ ID NO: 221029 - RNA, 64 nt, hsa
cauguauugguuuaaacucgauaaugacaggaaaauuccaaacuagagcaguaaauucaaaugg

SEQ ID NO: 221030 - RNA, 64 nt, hsa
augaaauugagcuauaugauuuaucagagaucugauuccaaagagcacagaauacuguucucag

SEQ ID NO: 221031 - RNA, 64 nt, hsa
uuuacaaaggaggaacggaagaaaccuauugugaauuccaaaucuaaaaaaagaaauauuuuua

SEQ ID NO: 221032 - RNA, 64 nt, hsa; identical to SEQ ID NO: 91802

SEQ ID NO: 221033 - RNA, 64 nt, hsa; identical to SEQ ID NO: 91803

SEQ ID NO: 221034 - RNA, 64 nt, hsa; identical to SEQ ID NO: 91804

SEQ ID NO: 221035 - RNA, 64 nt, hsa; identical to SEQ ID NO: 91805

SEQ ID NO: 221036 - RNA, 64 nt, hsa; identical to SEQ ID NO: 91806

SEQ ID NO: 221037 - RNA, 64 nt, hsa; identical to SEQ ID NO: 91807

SEQ ID NO: 221038 - RNA, 64 nt, hsa; identical to SEQ ID NO: 91808

SEQ ID NO: 221039 - RNA, 64 nt, hsa; identical to SEQ ID NO: 91809

SEQ ID NO: 221040 - RNA, 64 nt, hsa; identical to SEQ ID NO: 91810

SEQ ID NO: 221041 - RNA, 64 nt, hsa; identical to SEQ ID NO: 91811

SEQ ID NO: 221042 - RNA, 64 nt, hsa; identical to SEQ ID NO: 91812

SEQ ID NO: 221043 - RNA, 64 nt, hsa; identical to SEQ ID NO: 91813

SEQ ID NO: 221044 - RNA, 64 nt, hsa; identical to SEQ ID NO: 91814

SEQ ID NO: 221045 - RNA, 64 nt, hsa; identical to SEQ ID NO: 91815

SEQ ID NO: 221046 - RNA, 64 nt, hsa; identical to SEQ ID NO: 91816

SEQ ID NO: 221047 - RNA, 64 nt, hsa; identical to SEQ ID NO: 91817

SEQ ID NO: 221048 - RNA, 64 nt, hsa; identical to SEQ ID NO: 91818

SEQ ID NO: 221049 - RNA, 64 nt, hsa; identical to SEQ ID NO: 91819

SEQ ID NO: 221050 - RNA, 64 nt, hsa; identical to SEQ ID NO: 91820

SEQ ID NO: 221051 - RNA, 64 nt, hsa; identical to SEQ ID NO: 91821

SEQ ID NO: 221052 - RNA, 64 nt, hsa; identical to SEQ ID NO: 91822

SEQ ID NO: 221053 - RNA, 64 nt, hsa; identical to SEQ ID NO: 91823

SEQ ID NO: 221054 - RNA, 64 nt, hsa; identical to SEQ ID NO: 91824

SEQ ID NO: 221055 - RNA, 64 nt, hsa; identical to SEQ ID NO: 91825

SEQ ID NO: 221056 - RNA, 64 nt, hsa; identical to SEQ ID NO: 91826

SEQ ID NO: 221057 - RNA, 64 nt, hsa; identical to SEQ ID NO: 91827

SEQ ID NO: 221058 - RNA, 64 nt, hsa; identical to SEQ ID NO: 91828

SEQ ID NO: 221059 - RNA, 64 nt, hsa; identical to SEQ ID NO: 91829

SEQ ID NO: 221060 - RNA, 64 nt, hsa; identical to SEQ ID NO: 91830

SEQ ID NO: 221061 - RNA, 64 nt, hsa; identical to SEQ ID NO: 91831

SEQ ID NO: 221062 - RNA, 64 nt, hsa; identical to SEQ ID NO: 91832

SEQ ID NO: 221063 - RNA, 64 nt, hsa; identical to SEQ ID NO: 91833

SEQ ID NO: 221064 - RNA, 64 nt, hsa; identical to SEQ ID NO: 91834

SEQ ID NO: 221065 - RNA, 64 nt, hsa; identical to SEQ ID NO: 91835

SEQ ID NO: 221066 - RNA, 64 nt, hsa; identical to SEQ ID NO: 91836

SEQ ID NO: 221067 - RNA, 64 nt, hsa; identical to SEQ ID NO: 91837

SEQ ID NO: 221068 - RNA, 64 nt, hsa; identical to SEQ ID NO: 91838

SEQ ID NO: 221069 - RNA, 64 nt, hsa; identical to SEQ ID NO: 91839

SEQ ID NO: 221070 - RNA, 64 nt, hsa; identical to SEQ ID NO: 91840

SEQ ID NO: 221071 - RNA, 64 nt, hsa; identical to SEQ ID NO: 91841

SEQ ID NO: 221072 - RNA, 64 nt, hsa; identical to SEQ ID NO: 91842

SEQ ID NO: 221073 - RNA, 64 nt, hsa; identical to SEQ ID NO: 91843

SEQ ID NO: 221074 - RNA, 64 nt, hsa; identical to SEQ ID NO: 91844

SEQ ID NO: 221075 - RNA, 64 nt, hsa; identical to SEQ ID NO: 91845

SEQ ID NO: 221076 - RNA, 64 nt, hsa; identical to SEQ ID NO: 91846

SEQ ID NO: 221077 - RNA, 64 nt, hsa; identical to SEQ ID NO: 91847

SEQ ID NO: 221078 - RNA, 64 nt, hsa; identical to SEQ ID NO: 91848

SEQ ID NO: 221079 - RNA, 64 nt, hsa; identical to SEQ ID NO: 91849

SEQ ID NO: 221080 - RNA, 64 nt, hsa; identical to SEQ ID NO: 91850

SEQ ID NO: 221081 - RNA, 64 nt, hsa; identical to SEQ ID NO: 91851

SEQ ID NO: 221082 - RNA, 64 nt, hsa; identical to SEQ ID NO: 91852

SEQ ID NO: 221083 - RNA, 64 nt, hsa; identical to SEQ ID NO: 91853

SEQ ID NO: 221084 - RNA, 64 nt, hsa; identical to SEQ ID NO: 91854

SEQ ID NO: 221085 - RNA, 64 nt, hsa; identical to SEQ ID NO: 91855

SEQ ID NO: 221086 - RNA, 64 nt, hsa; identical to SEQ ID NO: 91856

SEQ ID NO: 221087 - RNA, 64 nt, hsa; identical to SEQ ID NO: 91857

SEQ ID NO: 221088 - RNA, 64 nt, hsa; identical to SEQ ID NO: 91858

SEQ ID NO: 221089 - RNA, 64 nt, hsa; identical to SEQ ID NO: 91859

SEQ ID NO: 221090 - RNA, 64 nt, hsa; identical to SEQ ID NO: 91860

SEQ ID NO: 221091 - RNA, 64 nt, hsa; identical to SEQ ID NO: 91861

SEQ ID NO: 221092 - RNA, 64 nt, hsa; identical to SEQ ID NO: 91862

SEQ ID NO: 221093 - RNA, 64 nt, hsa
agaaugugggaguaugucugccgguuucaacacacacagacaaacacagccacacgcgcacaca

SEQ ID NO: 221094 - RNA, 64 nt, hsa
gcauacuuucuuuuuucuuuuccuuuuuucccuccacagacaauguccucuguucaauuccuaa

SEQ ID NO: 221095 - RNA, 64 nt, hsa
acggcuuccucuccagaauguggcuuugccugagcacagacagagucagcauggaaugcucuug

SEQ ID NO: 221096 - RNA, 64 nt, hsa
aggcggauugaggcugcugggucagccuugaucgcacagacagagcuugugccggauuuggccc

SEQ ID NO: 221097 - RNA, 64 nt, hsa
ugugugcugugagccccccacucugccgugcucacacagacacacccagcugcacacaugaggc

SEQ ID NO: 221098 - RNA, 64 nt, hsa
aagucaugugcgaacagcccuccaaagccuaugccacagacagcucuugccccagccagaauca

SEQ ID NO: 221099 - RNA, 64 nt, hsa
cagacagcugcgaccaggacgucagccagcacugcacagacagcugcgaccagagacuggaggu

SEQ ID NO: 221100 - RNA, 64 nt, hsa
aggccgugguuagcguggacaucagccagcacugcacagacagcugcgaccaggacgucagcca

SEQ ID NO: 221101 - RNA, 64 nt, hsa
agcacaaggcuggcagagauuuauguaugacuugcacagacacaaaaauauacagacaaucaaa

SEQ ID NO: 221102 - RNA, 64 nt, hsa
gcuauuagguaugucuugugcggucagucagcaucacagacacauagaugcucaccagccuggc

SEQ ID NO: 221103 - RNA, 64 nt, hsa
guccgacaacaggccauuucccuuuacauuccuccacagacagaaauggcuauuaaaaauguuu

SEQ ID NO: 221104 - RNA, 64 nt, hsa
agaacggguaacuagugcaggauggggaaauguucacagacaucaucuguaugugguugugcau

SEQ ID NO: 221105 - RNA, 64 nt, hsa
ucugcaguaccagugagccaagccugaugggcagcacagacacagacacacaccgcagggcccg

SEQ ID NO: 221106 - RNA, 64 nt, hsa
guaccagugagccaagccugaugggcagcacagacacagacacacaccgcagggcccgacccuc

SEQ ID NO: 221107 - RNA, 64 nt, hsa
uauuaagauuuauaaccuuuguaauguucuucaccacagacaccuucuugugaguuuucagucu

SEQ ID NO: 221108 - RNA, 64 nt, hsa
aggcaaaagaauccucgaagcuuauguauccagccacagacagcucccgaugcgcugcccccug

SEQ ID NO: 221109 - RNA, 64 nt, hsa
ggugacagggcgcucacugagcaccaugugucaucacagacacuuacacauacuugaaacuugg

SEQ ID NO: 221110 - RNA, 64 nt, hsa
caucagcuugucccauucaagccaccgagcucaccacagacacaguggagccgcgcucuucucc

SEQ ID NO: 221111 - RNA, 64 nt, hsa
agcaccaagagccagucuugaccgggaugaggcccacagacagguugucaucagcuugucccau

SEQ ID NO: 221112 - RNA, 64 nt, hsa
aauaggaaggagaaauuaauugagauuuucaggacacagacauaugaugugaaugccuacaaag

SEQ ID NO: 221113 - RNA, 64 nt, hsa
gagccccuguauucugcuggccagacacacauggcacagacacagcugaccauaacccaggaau

SEQ ID NO: 221114 - RNA, 64 nt, hsa
gccccuccccgccacagagacacaccauuacauacacagacacacacagaaagacacacacaga

SEQ ID NO: 221115 - RNA, 64 nt, hsa
cacaccauuacacacacauacacagaaagacacacacagacacacaaucacacgcagccccucc

SEQ ID NO: 221116 - RNA, 64 nt, hsa
cacccuccccgccacagagacacaccauuacauacacagacacgcaaucgcagauacgcccuuc

SEQ ID NO: 221117 - RNA, 64 nt, hsa
gacaccauuacauacacagacacacacagaaagacacagacacaaaaucacacacacacccucc

SEQ ID NO: 221118 - RNA, 64 nt, hsa
cacacccuccccgccacagagacaccauuacauacacagacacacacagaaagacacagacaca

SEQ ID NO: 221119 - RNA, 64 nt, hsa
ccauuacauacacagacacacacagaaagacacacacagacacaaaaucacacacacacccucc

SEQ ID NO: 221120 - RNA, 64 nt, hsa
cacccccuccccaccacagagacaccauuacauacacagacacacacagaaagacacacacaga

SEQ ID NO: 221121 - RNA, 64 nt, hsa
acaacacacacacauacacaccccugaacacacacacagacacacauacacccaugaugugagc

SEQ ID NO: 221122 - RNA, 64 nt, hsa
cuggcccucuccacaugcacacccugaaaacacacacagacacacaacacacacacauacacac

SEQ ID NO: 221123 - RNA, 64 nt, hsa
ggagagcaugcccauauuggcuuacuuugucugccacagacacagacagagggaguugggacau

SEQ ID NO: 221124 - RNA, 64 nt, hsa
caugcccauauuggcuuacuuugucugccacagacacagacagagggaguugggacaugcaugc

SEQ ID NO: 221125 - RNA, 64 nt, hsa
aacugugaaaaacaaguugugccauacuacauggcacagacacaaaauauuauacuaauauguu

SEQ ID NO: 221126 - RNA, 64 nt, hsa
cuuggugacccauguauugcauaagcuaaagcaacacagacacuccuaggcaaaguuuuuguuu

SEQ ID NO: 221127 - RNA, 64 nt, hsa
ucagcuccuugcagauguagcccuugcccaucuucacagacacauacacccaucuuggcacccu

SEQ ID NO: 221128 - RNA, 64 nt, hsa
cacuuccagcagaguccugccuccucccaauccccacagacacacacauugauccuccuccuca

SEQ ID NO: 221129 - RNA, 64 nt, hsa
aaacgaacucugguugggguacuacgaucacagacacagacauacuuuuccuaaaguugaagca

SEQ ID NO: 221130 - RNA, 64 nt, hsa
aaaacaaaacgaacucugguugggguacuacgaucacagacacagacauacuuuuccuaaaguu

SEQ ID NO: 221131 - RNA, 64 nt, hsa
gcuacuaagauacuccauauucuuccccgaaucacacagacaguuucugacaggcgcaacuccu

SEQ ID NO: 221132 - RNA, 64 nt, hsa
auuagggacacuuucacaguccuguccucuggaucacagacacugcacagaccuuagggaaugg

SEQ ID NO: 221133 - RNA, 64 nt, hsa
acaagaaaacgggacagcccaugauuaauuuguacacagacagggaaacuggcaagcugaaggg

SEQ ID NO: 221134 - RNA, 64 nt, hsa
cuuuggcccuggcaagauggauuccaggggugagcacagacaggaucgcagggagaggccguau

SEQ ID NO: 221135 - RNA, 64 nt, hsa
augauguaagagaugagaaaaacccaacaggaaacacagacacauccuccaguucuaucaaugg

SEQ ID NO: 221136 - RNA, 64 nt, hsa
gcauugucuaaauccauucucaaauuccaaauaucacagacaccccucacacaaggaauauaaa

SEQ ID NO: 221137 - RNA, 64 nt, hsa
agaaaagacuuaaauggagaaccagcccaugccucacagacaguaggaucccaguaaauauggg

SEQ ID NO: 221138 - RNA, 64 nt, hsa
guggcccucagccaugcguggacucagugggccacacagacacagugucaccucucccagcucu

SEQ ID NO: 221139 - RNA, 64 nt, hsa
gccggcccccgagaccccggcccccaccccacaccacagacacccaccagcccggccccucccg

SEQ ID NO: 221140 - RNA, 64 nt, hsa
cacucguccccagaggcacauucgugcacauucucacagacaccgucucacacguuggcuuugg

SEQ ID NO: 221141 - RNA, 64 nt, hsa
agggaggggacuggggaagugcgcacacagcccacacagacaacacgcacccacacagacacag

SEQ ID NO: 221142 - RNA, 64 nt, hsa
ugcgcacacagcccacacagacaacacgcacccacacagacacagagggaagggguugggaugg

SEQ ID NO: 221143 - RNA, 64 nt, hsa
acagucagaauaaucucaaaacugcuaguggagucacagacacacucugccaugucuuagcugu

SEQ ID NO: 221144 - RNA, 64 nt, hsa
ccccaagugggaucugccuaugcacauccuaauucacagacauugucagcauugcauuauucca

SEQ ID NO: 221145 - RNA, 64 nt, hsa
gcgauggcaucacacagacggugaugaugucacacacagacacagugacaacacacaccaugac

SEQ ID NO: 221146 - RNA, 64 nt, hsa
uagcgauggcgucgugcagaugcagcacgucgcacacagacauggggaacuuggcaugacguca

SEQ ID NO: 221147 - RNA, 64 nt, hsa
ccaccacacacacacacacacacacacacacacacacagacacacagacacauacgcacacacg

SEQ ID NO: 221148 - RNA, 64 nt, hsa
cacacacacacacacacacacacacacacagacacacagacacauacgcacacacgugcacaca

SEQ ID NO: 221149 - RNA, 64 nt, hsa
gacacacaaacacacacacacagacacacacacacacagacacaccaaguaccaguauaagcau

SEQ ID NO: 221150 - RNA, 64 nt, hsa
cugcauuuacacaccagacacacaaacacacacacacagacacacacacacacagacacaccaa

SEQ ID NO: 221151 - RNA, 64 nt, hsa
uacacacacacagacacacacacacgaaacacaacacagacacuacagauuuacuacauuaaag

SEQ ID NO: 221152 - RNA, 64 nt, hsa
cacacacacaaacacauacacacacauacacacacacagacacacacacacgaaacacaacaca

SEQ ID NO: 221153 - RNA, 64 nt, hsa
ugacagguguccuuccaagagacagaagaggagacacagacacagagcaggaggacacguggag

SEQ ID NO: 221154 - RNA, 64 nt, hsa
aauccagugucccuaugagagacggaagaggagacacagacacaaagcaggaggccacauaaag

SEQ ID NO: 221155 - RNA, 64 nt, hsa
agauugugcuugugauuuucaggcaagcuaaaugucugaugaagacugcucuucuuuuguucug

SEQ ID NO: 221156 - RNA, 64 nt, hsa
gagaguaucucauugugguuauauuuuguauuccucugaugauuagugauguugagcauuuuuu

SEQ ID NO: 221157 - RNA, 64 nt, hsa
uugcagacauggcugcaguacuguaccuuaucauucugaugaaacugauuuggagcacccuuuu

SEQ ID NO: 221158 - RNA, 64 nt, hsa
augcccggcuggcaguuguauuuuuuaaagcccuucugaugauuccaauguguuggaaaguuua

SEQ ID NO: 221159 - RNA, 64 nt, hsa
caaaucuaaaaucaaccaggcuacuuaagucugcucugaugaaacccaauaaucucucaauacc

SEQ ID NO: 221160 - RNA, 64 nt, hsa
caauucuaagaucaaccagguuacuuaaguccgcucugaugaaacccagucucucaauaccuuc

SEQ ID NO: 221161 - RNA, 64 nt, hsa
auuugcaauacaaacuggcauaagaauuacuuauucugaugaugcacuuuuauguauuuuucau

SEQ ID NO: 221162 - RNA, 64 nt, hsa
ucugaaucuggacaaagucgacuuaacagauuuuucugaugagcauguuuuaugaauccuccau

SEQ ID NO: 221163 - RNA, 64 nt, hsa
cuaggaugaucuguucccccucugaugaacauccucugaugaucuaggcucccagcaggcuacu

SEQ ID NO: 221164 - RNA, 64 nt, hsa
aacuccucugugaucuaggaugaucuguucccccucugaugaacauccucugaugaucuaggcu

SEQ ID NO: 221165 - RNA, 64 nt, hsa
ucauuuggcaagggaagucuuuuuaacuaguuuaucugaugauuuucuuacaugagcuuuugaa

SEQ ID NO: 221166 - RNA, 64 nt, hsa
ugccugcuaguuaugauggacaggauccagaauuucugaugauuuggguucuuuuccauagucc

SEQ ID NO: 221167 - RNA, 64 nt, hsa
ggggacagaacaaaaaucaaaacaaagaaccugcucugaugacacuuagaggggagagaugaaa

SEQ ID NO: 221168 - RNA, 64 nt, hsa
aauaaaguuuuaaauguaucuaugucucgacuuuucugaugaaguuauaccagaaaaguuaauu

SEQ ID NO: 221169 - RNA, 64 nt, hsa
auuuucacauuuucucucugcaaaacuuuaguuuucugaugaucuacacacacacacacacaca

SEQ ID NO: 221170 - RNA, 64 nt, hsa
ggccuuggaaaccuguuacuucuagggcuucagaucugaugauaucuuuuucaucacauuacaa

SEQ ID NO: 221171 - RNA, 64 nt, hsa
auuuucacauuuucucucugcaaaccuuuaguuuucugaugaucuacacacacacauacacaca

SEQ ID NO: 221172 - RNA, 64 nt, hsa
ggccuuggaaaucuguuacuucuacggcuucagaucugaugauaucuuuuucaucacauuacaa

SEQ ID NO: 221173 - RNA, 64 nt, hsa; identical to SEQ ID NO: 198753

SEQ ID NO: 221174 - RNA, 64 nt, hsa; identical to SEQ ID NO: 198754

SEQ ID NO: 221175 - RNA, 64 nt, hsa; identical to SEQ ID NO: 198755

SEQ ID NO: 221176 - RNA, 64 nt, hsa; identical to SEQ ID NO: 198756

SEQ ID NO: 221177 - RNA, 64 nt, hsa; identical to SEQ ID NO: 198757

SEQ ID NO: 221178 - RNA, 64 nt, hsa; identical to SEQ ID NO: 198758

SEQ ID NO: 221179 - RNA, 64 nt, hsa; identical to SEQ ID NO: 198759

SEQ ID NO: 221180 - RNA, 64 nt, hsa; identical to SEQ ID NO: 198760

SEQ ID NO: 221181 - RNA, 64 nt, hsa; identical to SEQ ID NO: 198761

SEQ ID NO: 221182 - RNA, 64 nt, hsa; identical to SEQ ID NO: 198762

SEQ ID NO: 221183 - RNA, 64 nt, hsa; identical to SEQ ID NO: 198763

SEQ ID NO: 221184 - RNA, 64 nt, hsa; identical to SEQ ID NO: 198764

SEQ ID NO: 221185 - RNA, 64 nt, hsa; identical to SEQ ID NO: 198765

SEQ ID NO: 221186 - RNA, 64 nt, hsa; identical to SEQ ID NO: 198766

SEQ ID NO: 221187 - RNA, 64 nt, hsa; identical to SEQ ID NO: 198767

SEQ ID NO: 221188 - RNA, 64 nt, hsa; identical to SEQ ID NO: 198768

SEQ ID NO: 221189 - RNA, 64 nt, hsa; identical to SEQ ID NO: 198769

SEQ ID NO: 221190 - RNA, 64 nt, hsa; identical to SEQ ID NO: 198770

SEQ ID NO: 221191 - RNA, 64 nt, hsa; identical to SEQ ID NO: 198771

SEQ ID NO: 221192 - RNA, 64 nt, hsa; identical to SEQ ID NO: 198772

SEQ ID NO: 221193 - RNA, 64 nt, hsa; identical to SEQ ID NO: 198773

SEQ ID NO: 221194 - RNA, 64 nt, hsa; identical to SEQ ID NO: 198774

SEQ ID NO: 221195 - RNA, 64 nt, hsa; identical to SEQ ID NO: 198775

SEQ ID NO: 221196 - RNA, 64 nt, hsa; identical to SEQ ID NO: 198776

SEQ ID NO: 221197 - RNA, 64 nt, hsa; identical to SEQ ID NO: 198777

SEQ ID NO: 221198 - RNA, 64 nt, hsa; identical to SEQ ID NO: 198778

SEQ ID NO: 221199 - RNA, 64 nt, hsa; identical to SEQ ID NO: 198779

SEQ ID NO: 221200 - RNA, 64 nt, hsa; identical to SEQ ID NO: 198780

SEQ ID NO: 221201 - RNA, 64 nt, hsa; identical to SEQ ID NO: 198781

SEQ ID NO: 221202 - RNA, 64 nt, hsa; identical to SEQ ID NO: 198782

SEQ ID NO: 221203 - RNA, 64 nt, hsa; identical to SEQ ID NO: 198783

SEQ ID NO: 221204 - RNA, 64 nt, hsa; identical to SEQ ID NO: 198784

SEQ ID NO: 221205 - RNA, 64 nt, hsa; identical to SEQ ID NO: 198785

SEQ ID NO: 221206 - RNA, 64 nt, hsa; identical to SEQ ID NO: 198786

SEQ ID NO: 221207 - RNA, 64 nt, hsa; identical to SEQ ID NO: 198787

SEQ ID NO: 221208 - RNA, 64 nt, hsa; identical to SEQ ID NO: 198788

SEQ ID NO: 221209 - RNA, 64 nt, hsa; identical to SEQ ID NO: 198789

SEQ ID NO: 221210 - RNA, 64 nt, hsa; identical to SEQ ID NO: 198790

SEQ ID NO: 221211 - RNA, 64 nt, hsa; identical to SEQ ID NO: 198791

SEQ ID NO: 221212 - RNA, 64 nt, hsa; identical to SEQ ID NO: 198792

SEQ ID NO: 221213 - RNA, 64 nt, hsa; identical to SEQ ID NO: 198793

SEQ ID NO: 221214 - RNA, 64 nt, hsa; identical to SEQ ID NO: 198794

SEQ ID NO: 221215 - RNA, 64 nt, hsa; identical to SEQ ID NO: 198795

SEQ ID NO: 221216 - RNA, 64 nt, hsa; identical to SEQ ID NO: 198796

SEQ ID NO: 221217 - RNA, 64 nt, hsa; identical to SEQ ID NO: 198797

SEQ ID NO: 221218 - RNA, 64 nt, hsa; identical to SEQ ID NO: 198798

SEQ ID NO: 221219 - RNA, 64 nt, hsa; identical to SEQ ID NO: 198799

SEQ ID NO: 221220 - RNA, 64 nt, hsa
ccauucugugggagaguguggaaaggcacucuuuuuucuccauauuaguuaacaagaggugucu

SEQ ID NO: 221221 - RNA, 64 nt, hsa
cuggcuaauuucauauuuuuuaguagagacaggauuucuccauguuggucaggcuggucuugaa

SEQ ID NO: 221222 - RNA, 64 nt, hsa
uucaaaucaaauauuuacauauugcuuaucacuuuuucuccauuuuaauaauggaaugaacuaa

SEQ ID NO: 221223 - RNA, 64 nt, hsa
ugaguuguucacagauauuuuauguuuuuuuaauuuucuccaagaauauuuauagaauuccaaa

SEQ ID NO: 221224 - RNA, 64 nt, hsa
gauugucccuguguugucccaucugcccucccuguuucuccacaacagccugggguuguccccg

SEQ ID NO: 221225 - RNA, 64 nt, hsa
ccauuuuuguuuauuuuccuuaaauuuuuagccauuucuccaugggccaccgcccagcucaugu

SEQ ID NO: 221226 - RNA, 64 nt, hsa
cuuggacaaggcgcuucaucucucugggccucuauuucuccauuuguaaaacaaguggcugcag

SEQ ID NO: 221227 - RNA, 64 nt, hsa
uuacuguuuucaaacugcucacauuuauucaguauuucuccaaguugcuaucuacucagccuua

SEQ ID NO: 221228 - RNA, 64 nt, hsa
ccagaggccugggccucugauaacacuuuggcuuuuucuccauucacgcugauuuggcaaaagg

SEQ ID NO: 221229 - RNA, 64 nt, hsa
ccaguauguucuucuuuuuuauguaagggacagcuuucuccacagaguccuuucugcuggugag

SEQ ID NO: 221230 - RNA, 64 nt, hsa
cuccaugagugcacaaucccugaacucacugucuuuucuccacacuuguccuaagccaagguag

SEQ ID NO: 221231 - RNA, 64 nt, hsa
ucccaacuuaggcucuuuauuaauugguuaagguuuucuccaaaaagggcauuucaacaauggg

SEQ ID NO: 221232 - RNA, 64 nt, hsa
agguguguugugaaaguuuggaaggucagaccuuuuucuccaagaaggacaagccccuguguaa

SEQ ID NO: 221233 - RNA, 64 nt, hsa
uuucuacauauuauucaugaagcauaauguugcauuucuccaaauuuuaugccugaaaggguag

SEQ ID NO: 221234 - RNA, 64 nt, hsa
uuauucuuucuccauaucuuuuaaggaauuauucuuucuccauaucaucuuuuaauuccuguua

SEQ ID NO: 221235 - RNA, 64 nt, hsa
gacuuaccuguaaaguuaucuuacggaauuauucuuucuccauaucuuuuaaggaauuauucuu

SEQ ID NO: 221236 - RNA, 64 nt, hsa
ccccuguaccuuuugaggagccccagcuacccuuuuucuccagcugggcucugcaauuccccuc

SEQ ID NO: 221237 - RNA, 64 nt, hsa
uuuucucucggcuccccauguguccugguucccguuucuccaccuagacuguaaaccucucgag

SEQ ID NO: 221238 - RNA, 64 nt, hsa
auggaauaucaaguauaaugauguaguaaaaagauuucuccagaaaacacuuugagauacuuaa

SEQ ID NO: 221239 - RNA, 64 nt, hsa
gggguaguucuguucuguggguuugugcuuccucuuucuccagaagccuucuggcugauuguuc

SEQ ID NO: 221240 - RNA, 64 nt, hsa
cuuguuuagcaagcauauguuguuccucagcucuuuucuccagcuuuugcaguguccuggcauc

SEQ ID NO: 221241 - RNA, 64 nt, hsa
ucaagugauaauuuuguguuuuucucauauaaguuuucuccagagcacccaccuucucuuccuu

SEQ ID NO: 221242 - RNA, 64 nt, hsa
ccaugugggaauaggugggccaagagcccuccccuuucuccaucccuccagcuaggaggaaaug

SEQ ID NO: 221243 - RNA, 64 nt, hsa
cuugguccacuccagccaucagucagcacggcccuuucuccagcacagcagacuauuguccgug

SEQ ID NO: 221244 - RNA, 64 nt, hsa
aaucagcugguggcuagguuucuagcgcauuugauuucuccagguuugcugugucucacagagg

SEQ ID NO: 221245 - RNA, 64 nt, hsa
aaauucuagaagcagaagguuguuuuuuuuuuuuuuucuccauucugaaaauagcaggacauuu

SEQ ID NO: 221246 - RNA, 64 nt, hsa
uugucaaguuuucuaggguugaauuuuuuucuuuuuucuccaugguguuaaugauauuagagau

SEQ ID NO: 221247 - RNA, 64 nt, hsa
auucaguuuuauuuauuuauuuuuaauuuguuuuuuucuccaaguccaccagucucugaaauua

SEQ ID NO: 221248 - RNA, 64 nt, hsa
caaauggagaagaaacauccaaaagcacauuucauuucuccaaacuuuguguuuuaaauuauag

SEQ ID NO: 221249 - RNA, 64 nt, hsa
auuguaagguaauuuuaaauugucccucguauuauuucuccacgucuguuuuaguuuaaugucu

SEQ ID NO: 221250 - RNA, 64 nt, hsa
gaguaaaaaggugguauguaauuuaugcaagguauuucuccaguugggacucaggauauuaguu

SEQ ID NO: 221251 - RNA, 64 nt, hsa
agaagaaugaaaaugcaguccugaggagaggaguuuucuccauaucaaaacgagggcugaugga

SEQ ID NO: 221252 - RNA, 64 nt, hsa
ugauuuucaguuuuaaaugugggcaaaaaggcauuuucuccaagauuuuaaaacuaauucuuau

SEQ ID NO: 221253 - RNA, 64 nt, hsa
uuuuucaagagcuauuuuguaaacagaugauguauuucuccauugaaaacacaauaaaaaaaaa

SEQ ID NO: 221254 - RNA, 64 nt, hsa
uuuuuucuucuaucuguuccaucugcuguauucauuucuccaaucucauguccauuuuggugug

SEQ ID NO: 221255 - RNA, 64 nt, hsa
aaaaacuacauauuuuauuauagaaaaaguauuuuuucuccaccagacaaauggaaaaaaagag

SEQ ID NO: 221256 - RNA, 64 nt, hsa
auuaccuucccuucccuugaaaguagagaugagguuucuccauguuggucaggcuggucucgaa

SEQ ID NO: 221257 - RNA, 64 nt, hsa
uugcaacuggccugagcaacacagggagacucaguuucuccaaaaaaauaaaaaauuagccgau

SEQ ID NO: 221258 - RNA, 64 nt, hsa
uuuaucucggcauccucuugaaugauagugcaaguuucuccaguugggauguugucucugcccg

SEQ ID NO: 221259 - RNA, 64 nt, hsa
cuggaauauuaaaccaaacucuccccgguccuuuuuucuccaacuuuucucaaagaguuuacau

SEQ ID NO: 221260 - RNA, 64 nt, hsa
uuggugauggaaaaagcgcuguuuccuugccugcuuucuccaagacagauuuucggaacacauu

SEQ ID NO: 221261 - RNA, 64 nt, hsa
guguucugcugagacugagcaccuuacagauauuuuucuccagaagauggugcuggguaauaaa

SEQ ID NO: 221262 - RNA, 64 nt, hsa
auccacagcuucucacugccgaaguuucuccagauuucuccaauguguccugacaggucagccc

SEQ ID NO: 221263 - RNA, 64 nt, hsa
uccuucccucauccacagcuucucacugccgaaguuucuccagauuucuccaauguguccugac

SEQ ID NO: 221264 - RNA, 64 nt, hsa
gggcugcuaugguuugaauggaugccaucacucuuuucuccacauacagugcagagagcugucu

SEQ ID NO: 221265 - RNA, 64 nt, hsa
gguauuauaauaccaaauuguaaaucaugagcguuuucuccacugugcaccugaggcagaucau

SEQ ID NO: 221266 - RNA, 64 nt, hsa
gcuuacugaauggcuucauuucagauuuaguugauuucuccaccaaaugcaugucauguauucu

SEQ ID NO: 221267 - RNA, 54 nt, hsa
uccagcguugcacgccauaaccauuuucuccagaagcguggaggaaagauuaug

SEQ ID NO: 221268 - RNA, 64 nt, hsa
uugcuuaccugaucucauguuaggccuaagaggcuuucuccaggaggauuagcuuggaguucuc

SEQ ID NO: 221269 - RNA, 64 nt, hsa
agagagaaaguaaaggcaguaaugccuucuccuauuucuccaaagccuugugugaacucaccaa

SEQ ID NO: 221270 - RNA, 64 nt, hsa
agcaggccgacuccacucccacgccgcagguagguuucuccagugcgcucuugcugggaggucc

SEQ ID NO: 221271 - RNA, 64 nt, hsa
uggccucagcuccucccuggggaaggaacuagucuuucuccaagaagaacucgacuugucugaa

SEQ ID NO: 221272 - RNA, 64 nt, hsa
uuuugucaucuuuguaucuccaguuugucuuucuuuucuccauagcccugccucuacuuuccuu

SEQ ID NO: 221273 - RNA, 64 nt, hsa
accuggguccuccaucgggaacuuuucaugcuucuuucuccaccugaggucuuggucugaagaa

SEQ ID NO: 221274 - RNA, 64 nt, hsa; identical to SEQ ID NO: 55178

SEQ ID NO: 221275 - RNA, 64 nt, hsa; identical to SEQ ID NO: 55179

SEQ ID NO: 221276 - RNA, 64 nt, hsa; identical to SEQ ID NO: 55180

SEQ ID NO: 221277 - RNA, 64 nt, hsa; identical to SEQ ID NO: 55181

SEQ ID NO: 221278 - RNA, 64 nt, hsa; identical to SEQ ID NO: 55182

SEQ ID NO: 221279 - RNA, 64 nt, hsa; identical to SEQ ID NO: 55183

SEQ ID NO: 221280 - RNA, 64 nt, hsa; identical to SEQ ID NO: 55184

SEQ ID NO: 221281 - RNA, 64 nt, hsa; identical to SEQ ID NO: 55185

SEQ ID NO: 221282 - RNA, 64 nt, hsa; identical to SEQ ID NO: 55186

SEQ ID NO: 221283 - RNA, 64 nt, hsa; identical to SEQ ID NO: 55187

SEQ ID NO: 221284 - RNA, 64 nt, hsa; identical to SEQ ID NO: 55188

SEQ ID NO: 221285 - RNA, 64 nt, hsa; identical to SEQ ID NO: 55189

SEQ ID NO: 221286 - RNA, 64 nt, hsa; identical to SEQ ID NO: 97683

SEQ ID NO: 221287 - RNA, 64 nt, hsa; identical to SEQ ID NO: 97684

SEQ ID NO: 221288 - RNA, 64 nt, hsa; identical to SEQ ID NO: 97685

SEQ ID NO: 221289 - RNA, 64 nt, hsa; identical to SEQ ID NO: 97686

SEQ ID NO: 221290 - RNA, 64 nt, hsa; identical to SEQ ID NO: 97687

SEQ ID NO: 221291 - RNA, 64 nt, hsa; identical to SEQ ID NO: 97688

SEQ ID NO: 221292 - RNA, 64 nt, hsa; identical to SEQ ID NO: 97689

SEQ ID NO: 221293 - RNA, 64 nt, hsa; identical to SEQ ID NO: 97690

SEQ ID NO: 221294 - RNA, 64 nt, hsa; identical to SEQ ID NO: 97691

SEQ ID NO: 221295 - RNA, 64 nt, hsa; identical to SEQ ID NO: 97692

SEQ ID NO: 221296 - RNA, 56 nt, hsa; identical to SEQ ID NO: 97693

SEQ ID NO: 221297 - RNA, 64 nt, hsa; identical to SEQ ID NO: 97694

SEQ ID NO: 221298 - RNA, 64 nt, hsa; identical to SEQ ID NO: 97695

SEQ ID NO: 221299 - RNA, 64 nt, hsa; identical to SEQ ID NO: 97696

SEQ ID NO: 221300 - RNA, 64 nt, hsa; identical to SEQ ID NO: 97697

SEQ ID NO: 221301 - RNA, 64 nt, hsa; identical to SEQ ID NO: 97698

SEQ ID NO: 221302 - RNA, 64 nt, hsa; identical to SEQ ID NO: 97699

SEQ ID NO: 221303 - RNA, 64 nt, hsa; identical to SEQ ID NO: 97700

SEQ ID NO: 221304 - RNA, 64 nt, hsa; identical to SEQ ID NO: 97701

SEQ ID NO: 221305 - RNA, 64 nt, hsa; identical to SEQ ID NO: 97702

SEQ ID NO: 221306 - RNA, 64 nt, hsa; identical to SEQ ID NO: 97703

SEQ ID NO: 221307 - RNA, 64 nt, hsa; identical to SEQ ID NO: 97704

SEQ ID NO: 221308 - RNA, 64 nt, hsa; identical to SEQ ID NO: 97705

SEQ ID NO: 221309 - RNA, 64 nt, hsa; identical to SEQ ID NO: 97706

SEQ ID NO: 221310 - RNA, 64 nt, hsa; identical to SEQ ID NO: 97707

SEQ ID NO: 221311 - RNA, 64 nt, hsa; identical to SEQ ID NO: 97708

SEQ ID NO: 221312 - RNA, 64 nt, hsa; identical to SEQ ID NO: 97709

SEQ ID NO: 221313 - RNA, 64 nt, hsa; identical to SEQ ID NO: 97710

SEQ ID NO: 221314 - RNA, 64 nt, hsa; identical to SEQ ID NO: 97711

SEQ ID NO: 221315 - RNA, 64 nt, hsa; identical to SEQ ID NO: 97712

SEQ ID NO: 221316 - RNA, 64 nt, hsa; identical to SEQ ID NO: 97713

SEQ ID NO: 221317 - RNA, 64 nt, hsa; identical to SEQ ID NO: 97714

SEQ ID NO: 221318 - RNA, 64 nt, hsa; identical to SEQ ID NO: 97715

SEQ ID NO: 221319 - RNA, 64 nt, hsa; identical to SEQ ID NO: 97716

SEQ ID NO: 221320 - RNA, 64 nt, hsa; identical to SEQ ID NO: 97717

SEQ ID NO: 221321 - RNA, 64 nt, hsa; identical to SEQ ID NO: 97718

SEQ ID NO: 221322 - RNA, 64 nt, hsa; identical to SEQ ID NO: 97719

SEQ ID NO: 221323 - RNA, 64 nt, hsa; identical to SEQ ID NO: 97720

SEQ ID NO: 221324 - RNA, 64 nt, hsa; identical to SEQ ID NO: 97721

SEQ ID NO: 221325 - RNA, 64 nt, hsa; identical to SEQ ID NO: 97722

SEQ ID NO: 221326 - RNA, 64 nt, hsa; identical to SEQ ID NO: 97723

SEQ ID NO: 221327 - RNA, 64 nt, hsa; identical to SEQ ID NO: 97724

SEQ ID NO: 221328 - RNA, 64 nt, hsa; identical to SEQ ID NO: 97725

SEQ ID NO: 221329 - RNA, 64 nt, hsa; identical to SEQ ID NO: 97726

SEQ ID NO: 221330 - RNA, 64 nt, hsa; identical to SEQ ID NO: 97727

SEQ ID NO: 221331 - RNA, 64 nt, hsa; identical to SEQ ID NO: 97728

SEQ ID NO: 221332 - RNA, 64 nt, hsa; identical to SEQ ID NO: 97729

SEQ ID NO: 221333 - RNA, 64 nt, hsa; identical to SEQ ID NO: 97730

SEQ ID NO: 221334 - RNA, 64 nt, hsa; identical to SEQ ID NO: 97731

SEQ ID NO: 221335 - RNA, 64 nt, hsa; identical to SEQ ID NO: 97732

SEQ ID NO: 221336 - RNA, 64 nt, hsa; identical to SEQ ID NO: 97733

SEQ ID NO: 221337 - RNA, 64 nt, hsa; identical to SEQ ID NO: 97734

SEQ ID NO: 221338 - RNA, 64 nt, hsa
gcuacagcccucugcauaaaccaaggacuuggcugccucgcaggcagccuccguuccucccgcu

SEQ ID NO: 221339 - RNA, 64 nt, hsa
gaugcagagggcacgcccauagucccucugcagagccucgcacuggggccagggcaggcaccag

SEQ ID NO: 221340 - RNA, 64 nt, hsa
gggugagggccaugcaugcaguaugaggggucuacaccugcaaggacugagaggcuuuucuagc

SEQ ID NO: 221341 - RNA, 64 nt, hsa
agugcaggcauugcacauggugugagaaggucuacaccugcaagggacgaguccccgggccugg

SEQ ID NO: 221342 - RNA, 64 nt, hsa
uggcacaggcauugcacacggugugaggaguguacaccugcaagggcugaggcccugggcccag

SEQ ID NO: 221343 - RNA, 64 nt, hsa
gguacaggcauugcacacagugugaaugggucuacaccugcaugggcugagucccugggcucag

SEQ ID NO: 221344 - RNA, 64 nt, hsa
gggugcaggcauugcacacggugugaagggucuacaccugcacaggcugaguuccugggcucga

SEQ ID NO: 221345 - RNA, 64 nt, hsa
gcccccuccugaccccaccuagaauggaagccuccaccugcagccccaggccucccucccccgg

SEQ ID NO: 221346 - RNA, 64 nt, hsa
ggagcugaggggcagggccguagacucacggcugcaccugcagggagcagcacgccaaccccag

SEQ ID NO: 221347 - RNA, 64 nt, hsa
caccacccuuugcugacucuuuuuggacucagcccaccugcacccaggugauuaaaaagcuuua

SEQ ID NO: 221348 - RNA, 64 nt, hsa
aaagugcugcaguauggccagacgugguggcucacaccugcaaucccagcaccuuaggaggccg

SEQ ID NO: 221349 - RNA, 64 nt, hsa
cuggggacccugccagggaaggccacuggguguucaccugcaaaguuucugguugucacugcac

SEQ ID NO: 221350 - RNA, 64 nt, hsa
gaaccuggcccaacagaaaaacccugccccaaugcaccugcaggcaagguacccgaagaagcag

SEQ ID NO: 221351 - RNA, 64 nt, hsa
agggcacgccuggcuuuccuuggauacccacugucaccugcacuaugaagugcugcuggcuggg

SEQ ID NO: 221352 - RNA, 64 nt, hsa
ugccccccuuuggcuuaauuaagugugcugucugcaccugcaagguauggccacccaaucuucu

SEQ ID NO: 221353 - RNA, 64 nt, hsa
ccucagugcccccuuuuggagagaugagcuguaucaccugcagaugugggguaaguggggagca

SEQ ID NO: 221354 - RNA, 64 nt, hsa
acaccugcaaggcugucaacagucuuggagaagccaccugcacagcagagcucauuguggaaac

SEQ ID NO: 221355 - RNA, 64 nt, hsa
uuagugauguuugcggggaugacgaugccaaguacaccugcaaggcugucaacagucuuggaga

SEQ ID NO: 221356 - RNA, 64 nt, hsa
acugccuugccaucgggcccaguucuccgggccccaccugcaccccuuucuucccccugggaua

SEQ ID NO: 221357 - RNA, 64 nt, hsa
gccuuugccccagggugggugcaggugcgagugucaccugcagcugccucagucauucagaguu

SEQ ID NO: 221358 - RNA, 64 nt, hsa
ucucuacuaaaaauuagccaagugugguaauguucaccugcagucccagcuacuugggaggcca

SEQ ID NO: 221359 - RNA, 64 nt, hsa
aaaaaugaugaaguugcaaauggcagugugcugucaccugcaacagaagugcguaccagaagua

SEQ ID NO: 221360 - RNA, 64 nt, hsa
uacccgugcacaggcacacgugcuggucugcacacaccugcacacaccugcacacucgcuaugc

SEQ ID NO: 221361 - RNA, 64 nt, hsa
caggcacacgugcuggucugcacacaccugcacacaccugcacacucgcuaugccaggccuccu

SEQ ID NO: 221362 - RNA, 64 nt, hsa
agccgcaaucuggcuccuccuggaaaauuucccccaccugcagcgcugggccccaaggcuugcc

SEQ ID NO: 221363 - RNA, 64 nt, hsa
gucccauacucccacuuugugccaaaugacuuugcaccugcaaauggugcuucaaugucguuuu

SEQ ID NO: 221364 - RNA, 64 nt, hsa
aaaaauacaaaaaucagccagacaugguggcaugcaccugcaaucccagcuacucgggaggcug

SEQ ID NO: 221365 - RNA, 64 nt, hsa
auguuaacaugacauuuaccagcaacuugaacuucaccugcaaagcucuguggccacauuuuca

SEQ ID NO: 221366 - RNA, 64 nt, hsa
gugacugccccaacuccuggaagcuguguccuugcaccugcauccguaguucccugaaaaccca

SEQ ID NO: 221367 - RNA, 64 nt, hsa
caggagaaaugcauccauuccucagggacagagacaccugcaccuccccccacugcaggccccg

SEQ ID NO: 221368 - RNA, 64 nt, hsa
aaaaguacaaaaauuagcugggcaugauggcacgcaccugcagucccagcuacuugggaggcug

SEQ ID NO: 221369 - RNA, 64 nt, hsa
cuacagccauguccuauuccuugaucauccaaagcaccugcagaguccagugaaaugauauauu

SEQ ID NO: 221370 - RNA, 64 nt, hsa
ccacggugccaucucuuguguaugcagggcuaugcaccugcaggcacguguguaugcacucccc

SEQ ID NO: 221371 - RNA, 64 nt, hsa
acagccacauuuccauuugcaucauuacugccuucaccugcauagucacucuuuugaugcuggg

SEQ ID NO: 221372 - RNA, 64 nt, hsa
ccaaagggucccaggcugucaggggcguuugcgccaccugcaagggcgugggucagagaguuuu

SEQ ID NO: 221373 - RNA, 64 nt, hsa
ccugcugucccggcuccaucuugguucuagccgccaccugcaugaacacaguggcccggcuuaa

SEQ ID NO: 221374 - RNA, 64 nt, hsa
aguguucuggucaaaacuaaaggaacucccuccccaccugcaggacuccgaagacagugcgacu

SEQ ID NO: 221375 - RNA, 64 nt, hsa
cacugagucagacaagugggagcuguaggaacugcaccugcagccucuucuuacuccccauuga

SEQ ID NO: 221376 - RNA, 64 nt, hsa
cuguuguuggugucagggaggcuuacuggagccacaccugcaggcgcuguguucaggcaccacc

SEQ ID NO: 221377 - RNA, 64 nt, hsa
gggugucagcccagaugacuccucacccauccaccaccugcagcuugagauguuaacuauuaga

SEQ ID NO: 221378 - RNA, 64 nt, hsa
aaagaagacgagagauagugggugugguggcucacaccugcaaucccagcacuuuggaaggccg

SEQ ID NO: 221379 - RNA, 64 nt, hsa
ccugacugcuggggacccucgccuucccuccucucaccugcaggcugauccuucuuuucacuuu

SEQ ID NO: 221380 - RNA, 64 nt, hsa
uauuacaccccgacccuccuccugucagcccccucaccugcagccuguugcccaauaaauuuaa

SEQ ID NO: 221381 - RNA, 64 nt, hsa
caaugcugacccuaggauuuuccuucccugcccucaccugcaaaugaguuaaagaagaggcgug

SEQ ID NO: 221382 - RNA, 64 nt, hsa
ucugcacgugcacacaccugcacaccccugcacacaccugcacaccgucccucuccccggacaa

SEQ ID NO: 221383 - RNA, 64 nt, hsa
uccugcccuagcaguuugccucugcacgugcacacaccugcacaccccugcacacaccugcaca

SEQ ID NO: 221384 - RNA, 64 nt, hsa
uagaacgcucaacuugguugcgguaccaucagcccaccugcauuuggcuuucgacuugcuuguu

SEQ ID NO: 221385 - RNA, 64 nt, hsa
guguuuagauccaugccauucacugacucacuaacaccugcaaaaucuuuaaggaaaaaagcug

SEQ ID NO: 221386 - RNA, 64 nt, hsa
ggaacuugcccugagcacuccuggugcaggucuccaccugcacauuggguggggcuccugggag

SEQ ID NO: 221387 - RNA, 64 nt, hsa
aaggagagacauggaaagggagacagccagguggcaccugcagcggcugcccucuggggccacu

SEQ ID NO: 221388 - RNA, 64 nt, hsa
ucuggcagccaauaaaaucaucauaagcccuuuguaauaaaaagcuaguuuccugagugaacaa

SEQ ID NO: 221389 - RNA, 64 nt, hsa
aacacaauuucuaacugccuguuuuuguauaauuuaauaaaaaccuuuuaaacauuacugcuuu

SEQ ID NO: 221390 - RNA, 64 nt, hsa
guuaggaaggucaaaaaaaaggaaaaaagaaaaauaauaaaaaauaauaaaaauccuuaggaua

SEQ ID NO: 221391 - RNA, 64 nt, hsa
ucaaaaaaaaggaaaaaagaaaaauaauaaaaaauaauaaaaauccuuaggauaacuugaggcc

SEQ ID NO: 221392 - RNA, 64 nt, hsa
auagaaaguauauagcaaaguaauuuuacucugauaauaaaaauuguuugacauguauuuuguu

SEQ ID NO: 221393 - RNA, 64 nt, hsa
auuuuaaaguguagaagaauacacugcuaauaaauaauaaaaguuuuauucaauuuacuuauuu

SEQ ID NO: 221394 - RNA, 64 nt, hsa
aaagauuauuuguaagucauuguauuaauaauacuaauaaaauuuaucaagccuuuauagcaag

SEQ ID NO: 221395 - RNA, 64 nt, hsa
gauauuuuaaacaaaauacuagggccaugguauguaauaaaauuugaaacaauaauuucaaaua

SEQ ID NO: 221396 - RNA, 64 nt, hsa
ccuuaaucucuacagccuugcucuccggggugguuaauaaaaugcaacacuuggcauuuuuaug

SEQ ID NO: 221397 - RNA, 64 nt, hsa
uuuuuauguuuuaagaaaaacaguauuuuauuuauaauaaaaucugaauauuuguaacccuuua

SEQ ID NO: 221398 - RNA, 64 nt, hsa
cuucaccugggaaacugaucacuucacaugccauuaauaaaacccaagaucuuuuaaaucaaaa

SEQ ID NO: 221399 - RNA, 64 nt, hsa
guauuuugaacuuuaagccaaguuuaaaacauuauaauaaaaggaauaccauuugugcauuuua

SEQ ID NO: 221400 - RNA, 64 nt, hsa
ugccauaaaagcuaugacacgagaaucagaauauuaauaaaacuuuauguacugcuguagcaac

SEQ ID NO: 221401 - RNA, 64 nt, hsa
ccaaucuuaccagaugcuacuggacuugaaugguuaauaaaacugcacagugcuguugguggca

SEQ ID NO: 221402 - RNA, 64 nt, hsa
cuucauaaaaucuaugaauacuguacaaugcugauaauaaaaacuuuuuauaccugugucagac

SEQ ID NO: 221403 - RNA, 64 nt, hsa
ccagcaaacugaccugccccuauuguaagucaauuaauaaaaagagccaucuggaggaaauaaa

SEQ ID NO: 221404 - RNA, 64 nt, hsa
uaacucaaaagaaauagggugauuuuuaaaggauuaauaaaauucugaaauguuaaguagaaga

SEQ ID NO: 221405 - RNA, 64 nt, hsa
ggagaucaccccucuaauuauuucugaacuugguuaauaaaaguuuauaagauuuuuaugaagc

SEQ ID NO: 221406 - RNA, 64 nt, hsa
aguuacugcaugccacgcacuguguugggcuuaguaauaaaaaaaagaaaagauaagugcuugu

SEQ ID NO: 221407 - RNA, 64 nt, hsa
accaaaaaauuuuuaaguauuuucuuaauuugaauaauaaaaccagaggaaaugcauacagggc

SEQ ID NO: 221408 - RNA, 64 nt, hsa
ugcuaccaguuacauugaacugcuuuaaaauaaauaauaaaauuauuucuaaugaugaaaacuc

SEQ ID NO: 221409 - RNA, 64 nt, hsa
uucuuuucauaaugaagcagaucaacuuaaaggauaauaaaauuuuuaaagaaaagauauucua

SEQ ID NO: 221410 - RNA, 64 nt, hsa
ggcggggauacugauucagaaauccuguagcguguaauaaaagaagaggaaauggcauggaauc

SEQ ID NO: 221411 - RNA, 64 nt, hsa
auuuauuuaucuuucuggguauuuuuauagcccuuaauaaaaaauauuaaaauagccugugcua

SEQ ID NO: 221412 - RNA, 64 nt, hsa
uauguguauaucauggaaaaagacaaggauauuuuaauaaaacauuacuuauuucauuucacuu

SEQ ID NO: 221413 - RNA, 64 nt, hsa
uuguauaacugauuaauuuucugauauggcuuccuaauaaaauaugaauaaggaaggauauguu

SEQ ID NO: 221414 - RNA, 64 nt, hsa
aaaauuagaugacugaauuucuauggcauauugauaauaaaauucauuccauuugcugauuguc

SEQ ID NO: 221415 - RNA, 64 nt, hsa
ccauuugcugauugucugaaauuuucuagaauacuaauaaaauacauacuauagauucuuuauu

SEQ ID NO: 221416 - RNA, 64 nt, hsa
cauggauaauagugaaugaaagcagaaagcaaaguaauaaaaucacaaauguuuggaaaacaca

SEQ ID NO: 221417 - RNA, 64 nt, hsa
aauccauaugauuauacauaaaguucugaugcauuaauaaaagcagccaaauagggccaaagag

SEQ ID NO: 221418 - RNA, 64 nt, hsa
aacauagggugacuuguguuuuuagguauuuaaauaauaaaauuucaagggauaguuuuuauuc

SEQ ID NO: 221419 - RNA, 64 nt, hsa
aguucguuaguauaaauuacuuuucuaggauuauuaauaaaagccacauagguggcaaguugua

SEQ ID NO: 221420 - RNA, 64 nt, hsa
aacacuuacauuuccauaaagaaaacucaaguauuaauaaaagagacuuuacuggcuuaagagg

SEQ ID NO: 221421 - RNA, 64 nt, hsa
uuauuauuccaaaugauaaaauuuaagauuuuucuaauaaaagaguacagauaaugggacaguu

SEQ ID NO: 221422 - RNA, 64 nt, hsa
cuaaugagaaguuacugaaaucuauuacuguccuuaauaaaaauugaguagaaaaaaguggaac

SEQ ID NO: 221423 - RNA, 64 nt, hsa
cccagggccucugcucuccugggagacaaagcaauaauaaaaggaaguguuuguaaucccagca

SEQ ID NO: 221424 - RNA, 64 nt, hsa
aaaaauaaacaaauaaauuuuaaaaauaaauaaauaauaaaaggaaguguuagacaauguaaug

SEQ ID NO: 221425 - RNA, 64 nt, hsa
caagaucguauacccauaauauaacaacuucauauaauaaaaugcugauuccaacaggacugag

SEQ ID NO: 221426 - RNA, 64 nt, hsa
auuugucuagcuuaauaaauauugguaauugauguaauaaaaccauagaacuaugaaaauauca

SEQ ID NO: 221427 - RNA, 64 nt, hsa
uuauuucugauacuuuugaaaaacuaauaaaaacuaauaaaagaagcguaaaaagugaguuuac

SEQ ID NO: 221428 - RNA, 64 nt, hsa
caacauucuguuauuucugauacuuuugaaaaacuaauaaaaacuaauaaaagaagcguaaaaa

SEQ ID NO: 221429 - RNA, 64 nt, hsa
gaccauccuggccaacauggugaaaccccgucucuaauaaaaauacaaaaauuagccgggcaug

SEQ ID NO: 221430 - RNA, 64 nt, hsa
cucucucaucaccaaagucccauccauuuuuuuuuaauaaaagauccucagcuacagucuuucc

SEQ ID NO: 221431 - RNA, 64 nt, hsa
uguaguugagacauuacauauauuuuauuguuuauaauaaaaaucaucuauacaaaagaagucc

SEQ ID NO: 221432 - RNA, 64 nt, hsa
acugugagauucuuaaaacuuuuuugcuucauaauaauaaaacaacucauguuagagacccuuu

SEQ ID NO: 221433 - RNA, 64 nt, hsa
accaacauuguuuagaauuucaagcagauggugauaauaaaaagcagaccaacuuuuaguuagc

SEQ ID NO: 221434 - RNA, 64 nt, hsa
auucuuauuugcuacucauaaaaaccagaguuuguaauaaaauggaagcaugguauucuuuucu

SEQ ID NO: 221435 - RNA, 64 nt, hsa
agaguaaucuuucaggaacuaaaauagcaauuguuaauaaaauuuaguuucucauuauagucua

SEQ ID NO: 221436 - RNA, 64 nt, hsa
uuguauugauaauguauuaaaaguuguuugugcuuaauaaaagacuucuuuaaacaucuuauuu

SEQ ID NO: 221437 - RNA, 64 nt, hsa
gagacccgucuuuaguaaauaaaaauaaauuuauuaauaaaacuaaaaauuuaauaauaaaaag

SEQ ID NO: 221438 - RNA, 64 nt, hsa
aaaaauaaauuuauuaauaaaacuaaaaauuuaauaauaaaaaguggacauuguuuuuuaaaau

SEQ ID NO: 221439 - RNA, 64 nt, hsa
aaugguaaugaaaauggaaugcagcuacugcagcuaauaaaaaauuuuagauagcaauuguuac

SEQ ID NO: 221440 - RNA, 64 nt, hsa
uuuuuccucccuuucucauguuuuuauaaauagguaauaaaaaauguuuugccugccaauugaa

SEQ ID NO: 221441 - RNA, 64 nt, hsa
ucuccccacuucuguauuuguuugcaauuuuucauaauaaaaaaguuuuaaaaguccuccaguu

SEQ ID NO: 221442 - RNA, 64 nt, hsa
cuuuuuuccguaugucacuuucuugaauguguucuaauaaaaugauucuaaagcaggcuguuga

SEQ ID NO: 221443 - RNA, 64 nt, hsa
guaguaagggccuccagaauugacuuagcccuaguaauaaaagcacugccaaaacaucucagag

SEQ ID NO: 221444 - RNA, 64 nt, hsa
guuuaauagcauaacauuaccaagguaaucaaacuaauaaaauuccauauaucuucccugcauc

SEQ ID NO: 221445 - RNA, 64 nt, hsa
auuuuuuacuugugccacuuaauaucaggcauuuuaauaaaauauuguuacaaaaaauguacag

SEQ ID NO: 221446 - RNA, 64 nt, hsa
aauguacaguacugacaccaccacaaaucaugguuaauaaaagagaguaguuuuaacuuuauuu

SEQ ID NO: 221447 - RNA, 64 nt, hsa
gagcguauucaagaucuucccaauacaagaaaauuaauaaaaaauuuauauauaggcagcagca

SEQ ID NO: 221448 - RNA, 64 nt, hsa
augacggauaguuuaggaugacuacaugucaaaguaauaaaagaguggugaauuuuaccaaaac

SEQ ID NO: 221449 - RNA, 64 nt, hsa
uuuguaaauauuacccuguaauauuauauauacuuaauaaaacauuuuaagcuauuuuguuggg

SEQ ID NO: 221450 - RNA, 64 nt, hsa
cucaaaacacgauaaguuuacuccuccaucucaguaauaaaaauuaagcuguaaucaaccuucu

SEQ ID NO: 221451 - RNA, 64 nt, hsa
guuaaguuuuuauucaaagcagcuguaauuuaguuaauaaaauaauuaugaucuauguuguuug

SEQ ID NO: 221452 - RNA, 64 nt, hsa
aauacuuaguaaucgaaaaccauauccuguaauuuaauaaaaaaaacuaaggacgaaaaaaccc

SEQ ID NO: 221453 - RNA, 64 nt, hsa
aaaaccuccggcucucugugguggaauacccuucuaauaaaaggguaaccagaacggcccacuc

SEQ ID NO: 221454 - RNA, 64 nt, hsa
uuaauaaaacauugaauuguaguaaagguuuuuguaauaaaaacuuacuuuggagauuugugca

SEQ ID NO: 221455 - RNA, 64 nt, hsa
acucaguaaguuggcaagguccugacuuuagucuuaauaaaacauugaauuguaguaaagguuu

SEQ ID NO: 221456 - RNA, 64 nt, hsa
ggaugccuacgucugaaauugcucuuacgaacuuuaauaaaauaguuagcuaauagaaaaacag

SEQ ID NO: 221457 - RNA, 64 nt, hsa
uauauuuauagugacaaaugugguagacuaaagguaauaaaaaucauugucuuaagauuauguu

SEQ ID NO: 221458 - RNA, 64 nt, hsa
aaacuagaauuuguaaugcaaauggagcucagucuaauaaaaaagagguuuugguauuaaaagu

SEQ ID NO: 221459 - RNA, 64 nt, hsa
guuauuaauguguaauacugagcacuuuacuucuuaauaaaaacuugauauaguagcagaugug

SEQ ID NO: 221460 - RNA, 64 nt, hsa
aacguguuucugaaaaacagauuuucauaaguaauaauaaaaauaauaauaaaaaaguuuuggu

SEQ ID NO: 221461 - RNA, 64 nt, hsa
aaaaacagauuuucauaaguaauaauaaaaauaauaauaaaaaaguuuugguaugguaagccuu

SEQ ID NO: 221462 - RNA, 64 nt, hsa
auagcaacauugcauuuuggaugccauuugauuguaauaaaacuguggcaccuuaauuuugaau

SEQ ID NO: 221463 - RNA, 64 nt, hsa
uaguguaaacugcaaauacuacagauaauucugauaauaaaaugauaugcacgcugaauccugc

SEQ ID NO: 221464 - RNA, 64 nt, hsa
aaaaugcauaguaaaccacuaacguuagcuguuuuaauaaaaguuuucaguuauaaguuuagua

SEQ ID NO: 221465 - RNA, 64 nt, hsa
uauuucaguuuuaagucaaaagguauucugaauauaauaaaagccucacaaauuauuuguaaaa

SEQ ID NO: 221466 - RNA, 64 nt, hsa
auauuagaaaaaguccuuccaagaugauuuuggauaauaaaaguuguauuuguggaaauuggua

SEQ ID NO: 221467 - RNA, 64 nt, hsa
aagauaaaucaggagauggcugauucauaauggguaauaaaauaaauagcacuuucgagcugau

SEQ ID NO: 221468 - RNA, 64 nt, hsa
uucugaauuuugaguaucuucuguuguagaauaauaauaaaaagacuauuaagagcaauaaauu

SEQ ID NO: 221469 - RNA, 64 nt, hsa
guguuguucuugaugacauugcuucugcuaaauuuaauaaaaacuucagaaaaaccuccauuuu

SEQ ID NO: 221470 - RNA, 64 nt, hsa
uugauauuacaaucauuuauuuuauguccuauuauaauaaaaggugaggacuccuuguaaaaaa

SEQ ID NO: 221471 - RNA, 64 nt, hsa
uucaaaccaacaaacucucuuaagguucaauauguaauaaaaaacauaacacaaauaauuauuc

SEQ ID NO: 221472 - RNA, 64 nt, hsa
uauuauguaaaauaauaagacucuuccaaagccuuaauaaaaacaucaacauugaaaacaguuu

SEQ ID NO: 221473 - RNA, 64 nt, hsa
auccucuaaaugugaauuuugauguaauaacugcuaauaaaauuauauugaaacuguuuuauag

SEQ ID NO: 221474 - RNA, 64 nt, hsa
uuauuucuacccuuaaugcaaugaaauguuucauuaauaaaaaaccacuuuauauaaaauugcu

SEQ ID NO: 221475 - RNA, 64 nt, hsa
ggcaugucuuaauuaugcauguacuuauccauacuaauaaaauugacaaugcuagugcauacuu

SEQ ID NO: 221476 - RNA, 64 nt, hsa
uucaguaaauacuaaaguuacuuguauuagaacauaauaaaaguagagaauuaaacuaccuaaa

SEQ ID NO: 221477 - RNA, 64 nt, hsa
ugauuuuuaaaaacuuuuuuuuggaccuaaauaauaauaaaaaaaaaagcccuuuaaacuuugu

SEQ ID NO: 221478 - RNA, 64 nt, hsa
cccaaaugccaagguaauuuuaaauuuacauuuuuaauaaaagcaacauguugaaacaagagag

SEQ ID NO: 221479 - RNA, 64 nt, hsa
aaaaagaccuuccugugauacuuuauuuccgaacuaauaaaaaucuauaugacuuuuuauuauu

SEQ ID NO: 221480 - RNA, 64 nt, hsa
auucuuuaaucuguccagucccaguuucucuuauuaauaaaacuuuggaaauugcuuuaaacca

SEQ ID NO: 221481 - RNA, 64 nt, hsa
aaaaaaaaauaaaaagaaucuuaaaauaggaacauaauaaaagaucggcccuaaguaaagagca

SEQ ID NO: 221482 - RNA, 64 nt, hsa
guaaaacaacugcuacauacauaugcagaauguguaauaaaacaaaaagcaauugcuauaugaa

SEQ ID NO: 221483 - RNA, 64 nt, hsa
acuacgccaagcucugaagggcacacuacacuauuaauaaaaauggaaucauuaaauacucucu

SEQ ID NO: 221484 - RNA, 64 nt, hsa
uaauuauccuucuguucuuagaucuguaucuucauaauaaaaaauuuugcccaaguccuguuuc

SEQ ID NO: 221485 - RNA, 64 nt, hsa
uauuauacuuuguacuuuugcccaaacguguaaauaauaaaaaaguuuuggcuuuuuucuuuag

SEQ ID NO: 221486 - RNA, 64 nt, hsa
ucuuuuccguuccuuuuauuuaagucuuuuuauuuaauaaaaaaguuagcuauuucacuuaacg

SEQ ID NO: 221487 - RNA, 64 nt, hsa
gaaaaucauaugccacaacauucauuguaagguuuaauaaaauuaaauuugcaccaaauuuaag

SEQ ID NO: 221488 - RNA, 64 nt, hsa
ucagaaaguauucucacaauuaugagauggauuauaauaaaauacuuaaauuuguguuauuuuu

SEQ ID NO: 221489 - RNA, 64 nt, hsa
ugaaagccaaaggauuuaagaguuuuguuguuguuaauaaaaggaauacuccuuuuccuuuugg

SEQ ID NO: 221490 - RNA, 64 nt, hsa
ggccuccaggggcaauuccuaaaagcugaauggauaauaaaauuggacuggaaaguaaguaggu

SEQ ID NO: 221491 - RNA, 64 nt, hsa
uaguuuauauuaauauaguuuuuuucucccuuuuuaauaaaauaauuacagucaucccucagug

SEQ ID NO: 221492 - RNA, 64 nt, hsa
acuauuuuguuauauggaaugguuaauuuuuaccuaauaaaaacauagaugaaauacauuguau

SEQ ID NO: 221493 - RNA, 64 nt, hsa
cuagagaagacaguauuggcaaucaugacaccuguaauaaaaacuugaauccaaagucaaaacu

SEQ ID NO: 221494 - RNA, 64 nt, hsa
agcauuacugcaccucuuguuagacucugugcauuaauaaaacacaccuagagucuguugucau

SEQ ID NO: 221495 - RNA, 64 nt, hsa
gaaggucuguucuugcucucaaggagguuaccuuuaauaaaagaagacaaacccagauagauau

SEQ ID NO: 221496 - RNA, 64 nt, hsa
uuacguucguauuuaucuaguuucagggaaggucuaauaaaaagacaagcggugggacagaggg

SEQ ID NO: 221497 - RNA, 64 nt, hsa
aaagccaagauauuauuuaaguuguaaagccagcuaauaaaaugccuuaguuugagcauaauac

SEQ ID NO: 221498 - RNA, 64 nt, hsa
caguuaaugcuaagaaaagauuuggggaagguuauaauaaaaguauuuuguggugaccauaaga

SEQ ID NO: 221499 - RNA, 64 nt, hsa
ucaaguaaugaauccaacugcuuaaaguugguauuaauaaaaagacaaccacauaguucguuua

SEQ ID NO: 221500 - RNA, 64 nt, hsa
uaucuauauaaaauaacuaaaauguaucuaagaauaauaaaaucacguuaaaccaaauacacgu

SEQ ID NO: 221501 - RNA, 64 nt, hsa
aguauuuauuguugacauuauucagaauuagugauaauaaaaagcagagugauuuuggucaauu

SEQ ID NO: 221502 - RNA, 64 nt, hsa
uugaguuuguccauugcuagggagagacuuccaguaauaaaauuuacuauucuagaugcuucua

SEQ ID NO: 221503 - RNA, 64 nt, hsa
cucagauuuuacucaacauuagagaguuaguacguaauaaaagcauuauaaaugcaauuuuugu

SEQ ID NO: 221504 - RNA, 64 nt, hsa
aguaguauaucauuuuacuauuuguacuuuuauguaauaaaaugcaauguguuuaaaaauuuuu

SEQ ID NO: 221505 - RNA, 64 nt, hsa
ucugcucauaucuuaacaucagcgaguugguauuuaauaaaagcauuaucaaugaaauuacugu

SEQ ID NO: 221506 - RNA, 64 nt, hsa
auuguuauggacuacaggguuauuuuuauggucauaauaaaaauuacaaaaguaugaauaaaau

SEQ ID NO: 221507 - RNA, 64 nt, hsa
uaucugcucacauguaaaaacaucaguucauacuuaauaaaaugcaauuaccgucaaaucuuuc

SEQ ID NO: 221508 - RNA, 64 nt, hsa
aauuaauuaucauuuuguugauugugcuuuuauguaauaaaaugcaguacuuuaaaacauuuag

SEQ ID NO: 221509 - RNA, 64 nt, hsa
auuugguuauguugauaaaccaaaaacauuugauuaauaaaauaucuauuugaauaaauuauga

SEQ ID NO: 221510 - RNA, 64 nt, hsa
aguuuuaaacccaaaauauauacacauaguucuguaauaaaacuguuugacuucucaaguaaca

SEQ ID NO: 221511 - RNA, 64 nt, hsa
aaaaagauggcuccaagcuaugucauguuaccuguaauaaaaucuuuucuucuagauucuuucu

SEQ ID NO: 221512 - RNA, 64 nt, hsa
cccacugcauugaauuuuuugcuuauguuguuuauaauaaaacuuuucaauuaucucauauuug

SEQ ID NO: 221513 - RNA, 64 nt, hsa
ccaaggcugguauuccuugagucauagguauuaauaauaaaagccucaaugcagcuucuccaug

SEQ ID NO: 221514 - RNA, 64 nt, hsa
acaccuugacauuucuuuuuauauauaaacuauuuaauaaaaaugaaagauugaauguucaugu

SEQ ID NO: 221515 - RNA, 64 nt, hsa
cuggaaaauuccugaacaauauagauuuuaucguuaauaaaaaacacuagcuuucguuccuuag

SEQ ID NO: 221516 - RNA, 64 nt, hsa
ucuucauuuuuaaguaacugauuuaaaaggaaaauaauaaaauauguucguuuaucauuucaga

SEQ ID NO: 221517 - RNA, 64 nt, hsa
uaaaaauuguuaaauguauauuuugguuguauuauaauaaaaugcaaacaugacuguucuauga

SEQ ID NO: 221518 - RNA, 64 nt, hsa
uguuucacuauaaggaacagcuaaggaauaauuuuaauaaaagugaaccagaacaaaucacuca

SEQ ID NO: 221519 - RNA, 64 nt, hsa
aauaaauacuuuaauaagauaugggaaaauauuuuaauaaaacaaggaaaacauaaugauguau

SEQ ID NO: 221520 - RNA, 64 nt, hsa
gugcuuaaaucagaguaaaaugucagcuuuacaauaauaaaaaaaggacuuugguuuaaaguag

SEQ ID NO: 221521 - RNA, 64 nt, hsa
uaguucagacucauauauggauuucaaaucuuuguaauaaaaauuauuuguauuuuuaaguuuu

SEQ ID NO: 221522 - RNA, 64 nt, hsa
ugaagcacuucacuuuuuuuuauucaaagccauuuaauaaaacacaguuggucagcccagugca

SEQ ID NO: 221523 - RNA, 64 nt, hsa
aucuucaccaguguucuaucuuguuccccuaaauuaauaaaauguuuuucuccaggauuuuggu

SEQ ID NO: 221524 - RNA, 64 nt, hsa
cuguugcaauaacuuugcugaaauauuaacacauuaauaaaacuuuucuuaaacaaguugucuc

SEQ ID NO: 221525 - RNA, 64 nt, hsa
uugaagcauaggauuuuucaaauauauuuauuauuaauaaaauaauaaaagaauucaugggcua

SEQ ID NO: 221526 - RNA, 64 nt, hsa
uaggauuuuucaaauauauuuauuauuaauaaaauaauaaaagaauucaugggcuacaacuagc

SEQ ID NO: 221527 - RNA, 64 nt, hsa
uaggauuuuuaaguauucccaaagaucugaaggguaauaaaauguacuggauuuuuuaaggugg

SEQ ID NO: 221528 - RNA, 64 nt, hsa
ucucagaucacaagaaauacaaaucuauauaguauaauaaaaucagcaaaaagaucaacuaaug

SEQ ID NO: 221529 - RNA, 64 nt, hsa
ucuagacccuucaucucuuacuugauagacuuacuaauaaaaugugaagacuagaccaauuguc

SEQ ID NO: 221530 - RNA, 64 nt, hsa
aacuuaauaaauauuguauuuuagauauauucucuaauaaaauucagaauucuauucuggguua

SEQ ID NO: 221531 - RNA, 64 nt, hsa
cugcucaacaagcucagaaauuaaauauuuuuaauaauaaaaaucuguucugguuauaaaccuu

SEQ ID NO: 221532 - RNA, 64 nt, hsa
cuuugaaaaacucaggaaaaaaggaagauugaacuaauaaaauuuuauuucuuaaauauaaauu

SEQ ID NO: 221533 - RNA, 64 nt, hsa
gguuguguaagagaauguugaauacuuauauuuuuaauaaaaguugcaaagguaaucaugacuu

SEQ ID NO: 221534 - RNA, 64 nt, hsa
ucuuugaaacaacuuucucuuguaaacguuucaguaauaaaacaucuuuccaguccuuggucag

SEQ ID NO: 221535 - RNA, 64 nt, hsa
acagaauuuuucuucauuaauuuuguguuuaaguuaauaaaauuuauuugugauguacuguaag

SEQ ID NO: 221536 - RNA, 64 nt, hsa
uauguacuacaugacaggcaucaaucuggggaaauaauaaaauuaucaccuuugucagaccaua

SEQ ID NO: 221537 - RNA, 64 nt, hsa
acaaagaauauagaugauaguagauauauuuuauuaauaaaaugguucaugaaucggagacuaa

SEQ ID NO: 221538 - RNA, 64 nt, hsa
guauaauguacaguuuucacaacuguaucugcucuaauaaaaaaaaguugguuauuaaugaagu

SEQ ID NO: 221539 - RNA, 64 nt, hsa
auuuuggacagcacaugaagucugccaauguacuuaauaaaacaugacuuuguuuauuuaaagu

SEQ ID NO: 221540 - RNA, 64 nt, hsa
uuacgcugggaaagcugguuuuuuaaaaaaauaauaauaaaauauuuaaucuuauuaaguguuc

SEQ ID NO: 221541 - RNA, 64 nt, hsa
aggaacgggggaccauugcauugugcccaaguaauaauaaaacuauuucagauguauuauauga

SEQ ID NO: 221542 - RNA, 64 nt, hsa
cuaaucuauguugaacuuuguauacuugaaaugauaauaaaaaggauauaauuucuuaguaaaa

SEQ ID NO: 221543 - RNA, 64 nt, hsa
uaaaaccuaauuugucuugauccauuccacucuauaauaaaacaaaagauuuuguaggcaacuc

SEQ ID NO: 221544 - RNA, 64 nt, hsa
aagaaaugcgccgguggggaaugaacuguuucauuaauaaaaccuaauuugucuugauccauuc

SEQ ID NO: 221545 - RNA, 64 nt, hsa
aucaggaacaacuuucuccuuauugacaaucccauaauaaaacucaggaaccaaggcaaaauga

SEQ ID NO: 221546 - RNA, 64 nt, hsa
ucagaauauuugaaguuucuuacguagacagaaauaauaaaaauauuaacuaggaaaaaacagu

SEQ ID NO: 221547 - RNA, 64 nt, hsa
accuaaaauaucuuuuuuguuggaaaaaaguuuauaauaaaaaaguuugucaucucuagugacu

SEQ ID NO: 221548 - RNA, 64 nt, hsa
ggacuccucaucauauacuugguauauaauacucuaauaaaagcugccugaguugaauuguaua

SEQ ID NO: 221549 - RNA, 64 nt, hsa
uugagaagguuacugagugaguuauugggagucuuaauaaaauaaacuagauauuagguccauu

SEQ ID NO: 221550 - RNA, 64 nt, hsa
gcuaauuguacuaaucugagauuguguuuguucauaauaaaagugaagugaaucugauugcacu

SEQ ID NO: 221551 - RNA, 64 nt, hsa
ugauugcauuuccucucauuaacaauuggguguguaauaaaaagcauuguacuucaucuuaaau

SEQ ID NO: 221552 - RNA, 64 nt, hsa
agacagggacucuuuuuggaucucuauugacaaguaauaaaagucuggcccucauaacuuguuu

SEQ ID NO: 221553 - RNA, 64 nt, hsa
caagauuucauuuacuuaagugccauguugaugauaauaaaacaauucguacuccccaauggug

SEQ ID NO: 221554 - RNA, 64 nt, hsa
uuccacuguggaaauaaauguuuguaaauaaguguaauaaaaaucccuuugcauucuuucugga

SEQ ID NO: 221555 - RNA, 64 nt, hsa
auuuuucuagauuaacuucuguacaugaaaugucuaauaaaacuauaagagguuuagagauuuu

SEQ ID NO: 221556 - RNA, 64 nt, hsa
uuucuuuuuaccuacuaauguagauugcuuuguauaauaaaacacaggguuuggaagguuuugu

SEQ ID NO: 221557 - RNA, 64 nt, hsa
uacgaaagaaagucaaucuguauccuaagcauuuuaauaaaaaguuaaaacaaauacgcuauuu

SEQ ID NO: 221558 - RNA, 64 nt, hsa
gauuuugaugaucuuaaucuauauucuacccuuauaauaaaagaucaaaagauauaucuccuau

SEQ ID NO: 221559 - RNA, 64 nt, hsa
auuugugaauuguguauaaauuuauucuaacauuuaauaaaaauguauuuuaaccuauuuggga

SEQ ID NO: 221560 - RNA, 64 nt, hsa
uguugauaccuugcaauaguauugcuucugaaaguaauaaaaaauuuuaggagaauuugagaag

SEQ ID NO: 221561 - RNA, 64 nt, hsa
cauuguaaauagucuuuguuguacauugucaguguaauaaaaacagaaucuuuguauaucaaaa

SEQ ID NO: 221562 - RNA, 64 nt, hsa
gguugaacucugguuaaacaagauaauauguuauuaauaaaaauagaagaagaaagaauaaagc

SEQ ID NO: 221563 - RNA, 64 nt, hsa
agacauuuuaugaaaucuucauugucaaaaccuuuaauaaaaguggaaauauuuugaaaugccc

SEQ ID NO: 221564 - RNA, 64 nt, hsa
cauugagaauuucaacuagcuucugaucaauuuuuaauaaaaaauuuucaaaucauguuagcug

SEQ ID NO: 221565 - RNA, 64 nt, hsa
uauuguacuucacuagugcugccagaggaauuguuaauaaaagcaccuucuuuaacaauaaaug

SEQ ID NO: 221566 - RNA, 64 nt, hsa
ccaaugauuguagaccuugcuugaguauuuuuucuaauaaaacaaagcaaaucacauuuagcuu

SEQ ID NO: 221567 - RNA, 64 nt, hsa
uuaugguggaaguauaaauaagccuaugaacuuauaauaaaacaaacuguagguagaaaaaaug

SEQ ID NO: 221568 - RNA, 64 nt, hsa
cauacaaauuaaagugagagacaugguuacuguguaauaaaagaaaaaauacuuguucagguaa

SEQ ID NO: 221569 - RNA, 64 nt, hsa
aagaaaaaauacuuguucagguaauucuaauucuuaauaaaacaaaugaguaucauacagguag

SEQ ID NO: 221570 - RNA, 64 nt, hsa
uaaucucacuaauuuucaugauaaaugaaguuuuuaauaaaauauacuuguuauuaguaauuuu

SEQ ID NO: 221571 - RNA, 64 nt, hsa
auguagggauaucagcguuucucugugugcuuguuaauaaaacuauauaaaaauuaaaauuuuc

SEQ ID NO: 221572 - RNA, 64 nt, hsa
uagacuuuaaagaauugugaucaggucacauuguuaauaaaaaaaaaaaacgggcuagucccua

SEQ ID NO: 221573 - RNA, 64 nt, hsa
aacuuuuugccugagacauaaaaccuuuuuuuaauaauaaaauauugugcaauauauucaaaga

SEQ ID NO: 221574 - RNA, 64 nt, hsa
uguagcuaaauaaaguacauauauuucagucacuuaauaaaagaauaaaggagaauuauucaau

SEQ ID NO: 221575 - RNA, 64 nt, hsa
agauuuguuaguaacaaucuugaagagcuaauuuuaauaaaaauaagaaaaauuaauacuauca

SEQ ID NO: 221576 - RNA, 64 nt, hsa
agaacuuagugauuaaaaucuugccccagcacaguaauaaaaaucaagauuuguuaguaacaau

SEQ ID NO: 221577 - RNA, 64 nt, hsa
uucuagaaauuugaaguauguaaccugaaauccuuaauaaaauuuggauuuaauuuuauaaaau

SEQ ID NO: 221578 - RNA, 64 nt, hsa
uugucauuagaggaaggucuagauuuccugcucuuaauaaaauuacauugaauugauuuuuaga

SEQ ID NO: 221579 - RNA, 64 nt, hsa
auagucuuaguugguuuagggucucaauuuuaauuaauaaaauacuugguuuuuauuugcuugu

SEQ ID NO: 221580 - RNA, 64 nt, hsa
cagagcaagacucugucucaaaaaaaaaaaauaauaauaaaauaagugagcugaacucaccuga

SEQ ID NO: 221581 - RNA, 64 nt, hsa
aaugagaaaauaaaauauuucuuaauuguaaucauaauaaaacaauugcagauugcuaaguagc

SEQ ID NO: 221582 - RNA, 64 nt, hsa
aucacagccugcauuaauuugcuuuucuuuuaauuaauaaaacagacacagaguuaagauaguu

SEQ ID NO: 221583 - RNA, 64 nt, hsa
uaaauacaaaaaaaaaaaagaagaaauuccaaaguaauaaaacuuuucuugagacaaacaaaaa

SEQ ID NO: 221584 - RNA, 64 nt, hsa
uuucugucauggaaaccuuguuugagaaagguguuaauaaaauucuauugcaaaaauuucuuuu

SEQ ID NO: 221585 - RNA, 64 nt, hsa
aguauaaaaacaacaauucuauagauagauggcuuaauaaaauagcauuaggucuaucuagcca

SEQ ID NO: 221586 - RNA, 64 nt, hsa
agugauccaaaauuugaaauauuaaaauaauaucuaauaaaaagucacaaaguuaucuucuuua

SEQ ID NO: 221587 - RNA, 64 nt, hsa
aucuguauaaaugugaaauuuuuauuuguauuaguaauaaaacauuaguaguuuaaacaauuuc

SEQ ID NO: 221588 - RNA, 64 nt, hsa
guuuuauuguaaucauaaauacugcuguauaagguaauaaaacucugcaccuaauccccauaac

SEQ ID NO: 221589 - RNA, 64 nt, hsa
gcacugcuaccuucuuugauuguauuaaugauuauaauaaaaaguuacaggucacuuuaaaagc

SEQ ID NO: 221590 - RNA, 64 nt, hsa
auguacauuaucuaucguucauuuaaguaaaugguaauaaaauauuuuaaggggcuauuaauau

SEQ ID NO: 221591 - RNA, 64 nt, hsa
gguuuuccguaaaccgugucacuuauaagcacaguaauaaaagauuugucauguguuugaagaa

SEQ ID NO: 221592 - RNA, 64 nt, hsa
uuuguauauaaugaaauuuuguuauauuuuuauauaauaaaagcuaaaguggaaguuauugcca

SEQ ID NO: 221593 - RNA, 64 nt, hsa
cuaaaaagucaaaacguuaacaauaguuuuuaucuaauaaaagcacugcaagaaaauaggguag

SEQ ID NO: 221594 - RNA, 64 nt, hsa
uccauauagaaaucuagaauuuuuacuuagauacuaauaaaauacauuuagaaacuuuuaaagu

SEQ ID NO: 221595 - RNA, 64 nt, hsa
uauaauagauaucuaucgcuauagaauaaugcauuaauaaaaugaggcuuuuuuagaggaagac

SEQ ID NO: 221596 - RNA, 64 nt, hsa
uggcagauuugauuuuuaaaaaacguauuaucuuuaauaaaauguuauuaugucaaccagugag

SEQ ID NO: 221597 - RNA, 64 nt, hsa
auauuguaaugaauuuuuacuuuuuugauuuuuguaauaaaaauuggugcagauaaaaugucaa

SEQ ID NO: 221598 - RNA, 64 nt, hsa
uauauccaguuaacugagagaauuuugacucucuuaauaaaacugcauuaaguuuuugauuuug

SEQ ID NO: 221599 - RNA, 64 nt, hsa
uaaauacuaauguauuaaguauuuaaguacuuucuaauaaaaucuuuaacaauaauaauguaaa

SEQ ID NO: 221600 - RNA, 64 nt, hsa
gaccaucgugacuaacacagugaaaccccgucucuaauaaaaauacgaaaaauuagccaggcgu

SEQ ID NO: 221601 - RNA, 64 nt, hsa
uaaacauuguugcccuucaacaaggcucuugaauuaauaaaauuauagucucuaagaauuccac

SEQ ID NO: 221602 - RNA, 64 nt, hsa
uacauacauuguaucuuuguuuuaugguaauaaguaauaaaaauguagacuucauauuuuguac

SEQ ID NO: 221603 - RNA, 64 nt, hsa
cuccuuuacugccaauuaacuaucaccauaaaaguaauaaaaaaugaaauuauuuagaacgggg

SEQ ID NO: 221604 - RNA, 64 nt, hsa
gacuuacauguagugaaauagaauuuguauuauuuaauaaaauuuuaggguuugguuuuuacua

SEQ ID NO: 221605 - RNA, 64 nt, hsa
ggacuuuaguugaacuucauauuguaagaacuguuaauaaaaguugucaaguaaaaagcgcuau

SEQ ID NO: 221606 - RNA, 64 nt, hsa
aagcuuguuauuugucaugcaccagcauuggagauaauaaaauuucuuguucuguguauuuugu

SEQ ID NO: 221607 - RNA, 64 nt, hsa
agaacaggcagggguggaauauaucaggaauuuauaauaaaauugccuuaaucucuacaacagu

SEQ ID NO: 221608 - RNA, 64 nt, hsa
ggauugacuacauauuuuuaaaccuucaagucccuaauaaaacaugagccaucugagugagucc

SEQ ID NO: 221609 - RNA, 64 nt, hsa
ugaaaagauuuguauacaaauguuuucuaugauuuaauaaaaauauauggcacaccuuuuguuu

SEQ ID NO: 221610 - RNA, 64 nt, hsa
guuaacuaucuuuuaaauucgugguugauguaaguaauaaaaaacauucuuaaaguugaggguu

SEQ ID NO: 221611 - RNA, 64 nt, hsa
ugacuuuuauauuaugggagggaaaaaauaacauuaauaaaaaggugauaaaaaagcacuguuu

SEQ ID NO: 221612 - RNA, 64 nt, hsa
uucuauuuuuuucuuuuuuuccaaaaaaagaaaguaauaaaaacuuaaauucuuuguaccaguu

SEQ ID NO: 221613 - RNA, 64 nt, hsa
uagucaagguguuuugauaugguauuaaaaugucuaauaaaagauggcacugcgugauuuuauu

SEQ ID NO: 221614 - RNA, 64 nt, hsa
ucuuucaacuuuucuguauguuuggaauuuuucuuaauaaaagauugugggaaauggucauuug

SEQ ID NO: 221615 - RNA, 64 nt, hsa
aggcaagagacagaggacacgagcuguuccaguauaauaaaauauaaaacaagaauaguuauac

SEQ ID NO: 221616 - RNA, 64 nt, hsa
aacaacaagcaaugauggcgauggcgauucuaguuaauaaaaaggggggagaugugggcggcaa

SEQ ID NO: 221617 - RNA, 64 nt, hsa
gugaucaaacuuaaaagucauugccauucaucauuaauaaaaguugccauuucaacuacguccc

SEQ ID NO: 221618 - RNA, 64 nt, hsa
aagacccugucuccgaaacaaauaaaaaauacuguaauaaaaguacuuauaaacauacuaaucc

SEQ ID NO: 221619 - RNA, 64 nt, hsa
ucaugugacuuuucuguacuguuaaacuucauuguaauaaaaugagagaaaaauuuaugccuuu

SEQ ID NO: 221620 - RNA, 64 nt, hsa
uuuguacagaugcaugccacaguagauguccacauaauaaaauucauaguuaccaaugcaguuu

SEQ ID NO: 221621 - RNA, 64 nt, hsa
aaauaaauaaaaaauaaaaauguaaauaugauaguaauaaaauagagcauaacgaaacugugaa

SEQ ID NO: 221622 - RNA, 64 nt, hsa
uguuuuaaaaaaauaauuaaaaaacaguuggcguuaauaaaaaugucaaugugaaacugauguc

SEQ ID NO: 221623 - RNA, 64 nt, hsa
gauuuauuggguuucuuaaaaaucuugaagaaaauaauaaaauuuaucucacaauaaguuaacu

SEQ ID NO: 221624 - RNA, 64 nt, hsa
uuuauaugcaguauagaaaaguuaacacaaguacuaauaaaagagggacaucccgacuuacguu

SEQ ID NO: 221625 - RNA, 64 nt, hsa
uucuuucaauaaagauacuaugugcccuucauaguaauaaaaucucaaucuuaaagcaugaauc

SEQ ID NO: 221626 - RNA, 64 nt, hsa
auugaaguuuugguaaaaauucuuuuuucuuuuuuaauaaaaaauuagguuauuacuuuuuuua

SEQ ID NO: 221627 - RNA, 64 nt, hsa
uucuuugguugucccuauuaacaaaaaaguauuuuaauaaaaaauugaaaugagugagucauau

SEQ ID NO: 221628 - RNA, 64 nt, hsa
ugaagucaccguuacaguaacuugauguguauauuaauaaaaguaauucagucauuuuaguuuu

SEQ ID NO: 221629 - RNA, 64 nt, hsa
cuuuucuacacugaacauuuuuuuuaacuugauuuaauaaaaauguuaauuuuggaagugcagu

SEQ ID NO: 221630 - RNA, 64 nt, hsa
ggggccaguaaaucaguagacugaacauucaauauaauaaaagaacauggggauuuuguauaac

SEQ ID NO: 221631 - RNA, 64 nt, hsa
auaaaagaacauggggauuuuguauaaccagggauaauaaaaagaaaaaagaaguuaauuuuua

SEQ ID NO: 221632 - RNA, 64 nt, hsa
uuccauuuaaaaugucuugggauaucuggaucaguaauaaaauauuucaaaggcacagauguug

SEQ ID NO: 221633 - RNA, 64 nt, hsa
gccuuugcuuuaccacucuuuccuuuuaucuuauuaauaaaaauguuggucuccaccacugacu

SEQ ID NO: 221634 - RNA, 64 nt, hsa
cgauguuuucccguguuguagagcuuccaggguuuaauaaaacugguuaaaaauugagucuuuc

SEQ ID NO: 221635 - RNA, 64 nt, hsa
agaacaggucucacaaguauauauuugaugucuguaauaaaagugggaaggugggucuuaaaac

SEQ ID NO: 221636 - RNA, 64 nt, hsa
gcacaggaaaugacugguaauggaaaaaauguuguaauaaaauaaucuaaucaaagaauauuau

SEQ ID NO: 221637 - RNA, 64 nt, hsa
cuccucuucccuugggggaaaaaaaaaaaugugcuaauaaaacuucccuccauggcuaagaggg

SEQ ID NO: 221638 - RNA, 64 nt, hsa
gcucacauuuuacucaacacagagaguuccugcuuaauaaaagcauuauaagugcaauuacugu

SEQ ID NO: 221639 - RNA, 64 nt, hsa
auuuuuauuuaccacaguguuauuuuuaucgucauaauaaaaauuauauacgaguauaaaugaa

SEQ ID NO: 221640 - RNA, 64 nt, hsa
ggaaaugacagaugugacuuuggaaccaaacuuguaauaaaaggaauuccaaauggacaagcag

SEQ ID NO: 221641 - RNA, 64 nt, hsa
ucugucaccccuucuuagugucgaguguauuuauuaauaaaagcuuauuagaguguagaaaugc

SEQ ID NO: 221642 - RNA, 64 nt, hsa
aaaaauuaaagcugcaaaagaaauaaaaugguguuaauaaaaauuuggcaucuaauaaaaucau

SEQ ID NO: 221643 - RNA, 64 nt, hsa
agaaauaaaaugguguuaauaaaaauuuggcaucuaauaaaaucauuuuguauaucaugaacuc

SEQ ID NO: 221644 - RNA, 64 nt, hsa
aauauuuaugaacuauauuucucauugcacucuguaauaaaaagcaguuaguuguuacuuaccu

SEQ ID NO: 221645 - RNA, 64 nt, hsa
gauggauauuuguauuuuuuauacuuuuguguaauaauaaaaauacugcuguaaauauucuugu

SEQ ID NO: 221646 - RNA, 64 nt, hsa
agacaaucauaaaugaaugaucauggcuauguuuuaauaaaacuuuauggacacugagcuugaa

SEQ ID NO: 221647 - RNA, 64 nt, hsa
agacaaucauaaaugaaugaucauggcuauguuuuaauaaaacuuuacagacacugaacuugaa

SEQ ID NO: 221648 - RNA, 64 nt, hsa
auguaacauacuuuuauuaaaauauauacuuauauaauaaaaguauaacauaauuuuuuuuuuu

SEQ ID NO: 221649 - RNA, 64 nt, hsa
uuuuuauggucauaauaaaaguuauguagaaguauaauaaaaucccuacauuucugaggccuga

SEQ ID NO: 221650 - RNA, 64 nt, hsa
auuguuauugauuacaguguuauuuuuauggucauaauaaaaguuauguagaaguauaauaaaa

SEQ ID NO: 221651 - RNA, 64 nt, hsa
auauuucuacuuuuguauguguuugaaauuucaauaauaaaauguuuaaaaucaaaaccaaaau

SEQ ID NO: 221652 - RNA, 64 nt, hsa
ggccaccucugaacccuuugaucuguuuuaaccuuaauaaaaaugggucuaucagacaacacac

SEQ ID NO: 221653 - RNA, 64 nt, hsa
cugaauuauguaugaaaauuauucuauguuuuuauaauaaaaauaauauaucagacaucgacau

SEQ ID NO: 221654 - RNA, 64 nt, hsa
ucuuuucuucuauggggucuauaaauguaucuuauaauaaaaaggaaggacaggaggaagacag

SEQ ID NO: 221655 - RNA, 64 nt, hsa
aauguauuuggaggagaaauccugcaaguaaucuuaauaaaaucauuucaaguaaauauuugaa

SEQ ID NO: 221656 - RNA, 64 nt, hsa
uaaggcuuauaaaauaugaguauggucaggaauuuaauaaaaguacagugaugagcaugccuaa

SEQ ID NO: 221657 - RNA, 64 nt, hsa
uagcuacagugacagauuuuagagcaaaaauuaguaauaaaaauaagaaauaaaauuacaggag

SEQ ID NO: 221658 - RNA, 64 nt, hsa
uacguacuaccuaaaaggaugucuaaauguuuguuaauaaaaauaagaaauagcuacagugaca

SEQ ID NO: 221659 - RNA, 64 nt, hsa
accaucaauauugaaauuaaacuuccaacuucucuaauaaaaaauuaaaacacgcauaacacuc

SEQ ID NO: 221660 - RNA, 64 nt, hsa
cuuuuggcacuaacaucucaugaaaaauuaugguuaauaaaauaucaccacauuuggauugcca

SEQ ID NO: 221661 - RNA, 64 nt, hsa
gcaaacauccugugucugcuuugauggagaucuguaauaaaagaagguggcaaccaccugaauu

SEQ ID NO: 221662 - RNA, 64 nt, hsa
aaaaugauaauuaaaaugcuguaaccaacuuaucuaauaaaauuggcaaccagccacuauuuug

SEQ ID NO: 221663 - RNA, 64 nt, hsa
augauggauuuuauuucacucacacuccaguuuguaauaaaaugccaaauucugucagcuaucc

SEQ ID NO: 221664 - RNA, 64 nt, hsa
uuucuaagaugcugcgaucccguucugcugcccguaauaaaaaugcucucagacacugguuagu

SEQ ID NO: 221665 - RNA, 64 nt, hsa
uguauuuugaaccaaucuacaagucucugucuuuuaauaaaagaacuuuacacauuuguaaaaa

SEQ ID NO: 221666 - RNA, 64 nt, hsa
uuccuaaaauuaacacacauuauuauugcuagaauaauaaaaguuuuauaaaaaagaagcaaca

SEQ ID NO: 221667 - RNA, 64 nt, hsa
uuugaggcucaccagaauuauuuuuaagugguuuuaauaaaauaauaaaauuuccccuaaucuu

SEQ ID NO: 221668 - RNA, 64 nt, hsa
ucaccagaauuauuuuuaagugguuuuaauaaaauaauaaaauuuccccuaaucuuuucugaau

SEQ ID NO: 221669 - RNA, 64 nt, hsa
cuauaaguuuuuuaauuaacaucacuagugacacuaauaaaauuaacuucuuagaaugcaugau

SEQ ID NO: 221670 - RNA, 64 nt, hsa
aaaucagaaaacaaaaugaugugcuuuggucaguuaauaaaaaugguuuuacccacuauagugu

SEQ ID NO: 221671 - RNA, 64 nt, hsa
guggucauuuaaagucaauauuuauuuauguauguaauaaaaaaaguuggauuuuuguguaugu

SEQ ID NO: 221672 - RNA, 64 nt, hsa
ugguguuauuggaagaaaaaugcuauuaaugggcuaauaaaaaacauguguuucucuuauggau

SEQ ID NO: 221673 - RNA, 64 nt, hsa
aauuaauauaaaguaaaauucaccauuuuaauuauaauaaaaauaaaguauauaauucaauggu

SEQ ID NO: 221674 - RNA, 64 nt, hsa
auaugugaauacacaaauuuuacuggauuuaucuuaauaaaaagacucugacgaugauuguguu

SEQ ID NO: 221675 - RNA, 64 nt, hsa
uguggaugcuucguuaauuuguucagccacaauuuauugagaaaauauucugugucaagcacug

SEQ ID NO: 221676 - RNA, 64 nt, hsa
auuugugaauaaauuuuuagaaaucugauuggcauauugagauauuuaagguugaauguuuguc

SEQ ID NO: 221677 - RNA, 64 nt, hsa
gaaucugggggcauuggagggaggggguuuuauuuauugagaaauggacuucgccugaggcugu

SEQ ID NO: 221678 - RNA, 64 nt, hsa
uguuuuguguucucuaugucaaaguuuaguuuuauauugagaauguuaacuuauugcuuuguau

SEQ ID NO: 221679 - RNA, 64 nt, hsa
gcacgugggaaacuuuaguaaaauaucaccuccuuauugagacaaguuuggacaucuggccuua

SEQ ID NO: 221680 - RNA, 64 nt, hsa
uuaauucauuauugaaugccuuaaaugucccagguauugagaauaaaugaauaugauacaaaug

SEQ ID NO: 221681 - RNA, 64 nt, hsa
uugcuuguggaucuccacuugucccacugcugauuauugagaaaaauauccuuucuccacggaa

SEQ ID NO: 221682 - RNA, 64 nt, hsa
gaggagaagcggggaguggguuaacuaacagcuuuauugagaugucauucacaugccauucagu

SEQ ID NO: 221683 - RNA, 64 nt, hsa
gacuuugccccauggcagaacucugcuggaauccuauugagaagguagacauugugcuuuauua

SEQ ID NO: 221684 - RNA, 64 nt, hsa
ccauucccaugccaugaagacaccaaggcagcccuauugagaaaucuaccugucguggccgggc

SEQ ID NO: 221685 - RNA, 64 nt, hsa
uuuauauuuauagagcaucaaucaauauaagcauuauugagaaaaaugugacccguaacacugu

SEQ ID NO: 221686 - RNA, 64 nt, hsa
acuguucggcugaauuugaagauuggaagacuuauauugagaccaguaacuuuacuguaaauuu

SEQ ID NO: 221687 - RNA, 64 nt, hsa
gggcaacauauugagacucugucucuaaaaagcauauugagacucugucucuacaaaaaaauuu

SEQ ID NO: 221688 - RNA, 64 nt, hsa
ugcuugaguucagaaguuugagaucugggcaacauauugagacucugucucuaaaaagcauauu

SEQ ID NO: 221689 - RNA, 64 nt, hsa
agcagugacaaucuacacccuuuaucuaaauaaauauugagaugugcuuuuuuccuguguuagu

SEQ ID NO: 221690 - RNA, 64 nt, hsa
aguggauuuuauuucaugguuuaaauucaaucauuauugagaaccuacaguagugugagcguau

SEQ ID NO: 221691 - RNA, 64 nt, hsa
gucuauuuucuaaaguuuuaaguauuuuaagagguauugagacuaaugaauauaauaguucagu

SEQ ID NO: 221692 - RNA, 64 nt, hsa
aaacaaacaaauacacuauuucugggaacauuuauauugagauucuuuguggcuauuggugugu

SEQ ID NO: 221693 - RNA, 64 nt, hsa
uuaauacaugaaaaugcuuaaaagugauaggaauuauugagaaacuuaugaugguggcauugcc

SEQ ID NO: 221694 - RNA, 64 nt, hsa
gguuuuuugagaccauauguaugcuauuaaaauauauugagauuaauacaugaaaaugcuuaaa

SEQ ID NO: 221695 - RNA, 64 nt, hsa
gacuggcuuuuauagugacaggcaaagaggaauuuauugagaucacugcucauggcauuuguug

SEQ ID NO: 221696 - RNA, 64 nt, hsa
aaguggaaguauuaggagauucauaaaucuucuauauugagaauuggcuauguuaauaaauauu

SEQ ID NO: 221697 - RNA, 64 nt, hsa
uauuguauuaaccauuauugagaauaaauuuuuuuauugagaauaaauuuucuaaaauuacaug

SEQ ID NO: 221698 - RNA, 64 nt, hsa
uuuaaugcuguuucugaguuauuguauuaaccauuauugagaauaaauuuuuuuauugagaaua

SEQ ID NO: 221699 - RNA, 64 nt, hsa
aaugucaccacuaucuggagaguuggacauguuuuauugagaauguauuuuuuuucucuggauc

SEQ ID NO: 221700 - RNA, 64 nt, hsa
gauguugaauuuugugaaaugcuuuuucuccauguauugagaugaugugguuuucaucuuucau

SEQ ID NO: 221701 - RNA, 64 nt, hsa
ugauugcuauuuuggggggcuggaguggguagaguauugagaccuuuuuuauuagggugcuguu

SEQ ID NO: 221702 - RNA, 64 nt, hsa
guauugagaccuuuuuuauuagggugcuguuuguuauugagagcccaaucucugcaugaauaac

SEQ ID NO: 221703 - RNA, 63 nt, hsa
guuuggcccauggggcccccccaggccccugccccaacugauucugcccagauaaucgugucu

SEQ ID NO: 221704 - RNA, 63 nt, hsa
cacaacaggacugagcagaaccaaacacuucuuccaacugacucugcucccugcccucaccau

SEQ ID NO: 221705 - RNA, 63 nt, hsa
ucuauugcuaggguaaaauaaauacauuuguguccaacugaaauauaauugucauuaaaauaa

SEQ ID NO: 221706 - RNA, 63 nt, hsa
gagagguuaguuuuuuuccuacacuuuuuuuugccaacugacuuaacaacauugcugucaggu

SEQ ID NO: 221707 - RNA, 62 nt, hsa
acacaccaaccugcuggcuuuagaauaaaagcaccaacugaacugagaugugugguguggua

SEQ ID NO: 221708 - RNA, 63 nt, hsa
uggacuuuccacuguaggaguggacauuucaagccaacugagccuuuuccucaagugccgaca

SEQ ID NO: 221709 - RNA, 63 nt, hsa
auuucauauucuacagaaguaaaucagguuucaccaacugaaaugucucccuuugaaaguagc

SEQ ID NO: 221710 - RNA, 63 nt, hsa
ugaaaauacaucuaucccucauuuugagagccuccaacugauccaagugucauccggaggagg

SEQ ID NO: 221711 - RNA, 63 nt, hsa
aagaugagccucgauuuuaaaaucuauccacauccaacugauggcaccauugaugugcaaaua

SEQ ID NO: 221712 - RNA, 63 nt, hsa
gguauacuguuuuagucuugaauugccaacuuuccaacugaucuauccauauuccuuaaguac

SEQ ID NO: 221713 - RNA, 63 nt, hsa
aaacccuaucuuucacuuuacauuccuuucaauccaacugaucaaaacugguacccacacuug

SEQ ID NO: 221714 - RNA, 63 nt, hsa
cagaagguuuggguacauuacagcuuggguuuuccaacugacuuaggauuucugacuuuuuau

SEQ ID NO: 221715 - RNA, 63 nt, hsa
auccacauuugguguugcagaugaguuguaaagccaacugaaagaguuccuucaagaaguucc

SEQ ID NO: 221716 - RNA, 63 nt, hsa
cucaccccacuccagggccuuccccagcggccaccaacugaccuggggcgcugcuccccacag

SEQ ID NO: 221717 - RNA, 63 nt, hsa
ugaaucgcugcgauacuggcauuucccuacuccccaacugaguucaagggcuguagguucaug

SEQ ID NO: 221718 - RNA, 63 nt, hsa
uuccuuccauaucuuuagcaggugccaguuuuuccaacugauucauugaauuuaaaauagagc

SEQ ID NO: 221719 - RNA, 63 nt, hsa
cuuuuuugcccuuucauggagucauaaauuuucccaacugaagucuuguauauucuguuagau

SEQ ID NO: 221720 - RNA, 63 nt, hsa
uucccaucccaggagcucauuauccagucugugccaacugaaguaggagacugacugugagug

SEQ ID NO: 221721 - RNA, 63 nt, hsa
uuaaaguacuugggcuucagaaguaagagccaaccaacugaaaaccugagauggagauauguu

SEQ ID NO: 221722 - RNA, 63 nt, hsa
ugcaauauucaguaucaaauuagagcauuuugaccaacugaaacauauaacguuuucaucucc

SEQ ID NO: 221723 - RNA, 63 nt, hsa
uuaguaaaauccuuuuuagaagguauuuuuuuuccaacugaguagugaaaaucaacaaggugc

SEQ ID NO: 221724 - RNA, 63 nt, hsa
uaguauuugaaaaucagugugauuccuuaauggccaacugaagauugaauugccgcuaacaac

SEQ ID NO: 221725 - RNA, 63 nt, hsa
uucuucauagggaccuuuaaaaagcaggaaauaccaacugaagucaauuugggggacaugcua

SEQ ID NO: 221726 - RNA, 63 nt, hsa
ugucgaaagagcuggcugggggccuugcccaaaccaacugaggucuuaaaguccagggaaaaa

SEQ ID NO: 221727 - RNA, 63 nt, hsa
agauggaaauuucuuuuuaggcuaauuugaaauccaacugaagcuuuuuaaccaauauuuuaa

SEQ ID NO: 221728 - RNA, 63 nt, hsa
acucaaaauugcaaauauaaacaaaagaaaaauccaacugaaaauaacacuaaguauuuuuga

SEQ ID NO: 221729 - RNA, 63 nt, hsa
guucaacauuuuugaauacauuaaaagaaguaaccaacugaacgacaaagcaugguauuugaa

SEQ ID NO: 221730 - RNA, 63 nt, hsa
acguuccauacccccacaugccaauuucagcacccaacugagauccgaggagcuccugggaag

SEQ ID NO: 221731 - RNA, 63 nt, hsa
gaaugagacaauuccuugggcuguaguuuggacccaacugaauccugagugcucuguggcuga

SEQ ID NO: 221732 - RNA, 63 nt, hsa
cuccuacccuuccagggaccccuauccugauccccaacugaagcuucaaaaagccacuuuucc

SEQ ID NO: 221733 - RNA, 63 nt, hsa
ucucaauuaaaaagaaguguauccuuaaucuggccaacugaaagugaacuuguucauucaccu

SEQ ID NO: 221734 - RNA, 63 nt, hsa
gggcagcugaagcucacggugacucagcagugcccaacugaccaaucucccgcagcucuccug

SEQ ID NO: 221735 - RNA, 63 nt, hsa
ugcuucucccauguaccagggcaccaggcccacccaacugaaggcauggcggcggggugcagg

SEQ ID NO: 221736 - RNA, 63 nt, hsa
caauucauuuuucucuucuaaagguagucuuucccaacugacuguaggguugugucuuuuccc

SEQ ID NO: 221737 - RNA, 63 nt, hsa
uggucagccuuuuuggguaacacaguuaauuuaccaacugauacagauaauagaauauauuca

SEQ ID NO: 221738 - RNA, 63 nt, hsa
auagccaaaaaguggaaacaacccaaaugucuaccaacugaugaaugggaaauaaaauguggu

SEQ ID NO: 221739 - RNA, 63 nt, hsa
gcccucccaugucugcugguuucaguuccccacccaacugacugaagucuugaccuugauacc

SEQ ID NO: 221740 - RNA, 63 nt, hsa
gcuacccuggaaugguggcguguccugcuguacccaacugacuugcuuagguaccuggcagcu

SEQ ID NO: 221741 - RNA, 63 nt, hsa
guguugucauucaaggacuuccucuccugcaggccaacugaaauaccagaaaaugacauucug

SEQ ID NO: 221742 - RNA, 63 nt, hsa
uaucuuugcagguaucacagccuugcagaagaaccaacugaaaaaaaaauucucaggcuuuac

SEQ ID NO: 221743 - RNA, 63 nt, hsa
cucaugagcacuauaauaaccaucaggaagcucccaacugaagcaauguaacaguguaaucua

SEQ ID NO: 221744 - RNA, 63 nt, hsa
aguucagcugcugucacagucucauuuguucuuccaacugaaagccguaaaaccuuuguugcu

SEQ ID NO: 221745 - RNA, 63 nt, hsa
ggguccacuuucugagaugcuuucuaaaaccaaccaacugauaaaaaguagaugagacuucuc

SEQ ID NO: 221746 - RNA, 63 nt, hsa
cacauucaauauuuugauucuugcacaauaaagccaacugauugcaacugauucuuugagagg

SEQ ID NO: 221747 - RNA, 63 nt, hsa
ccaccuggaccuccauuuuucccuguaaauucuccaacugauccuacccucccuacuccugca

SEQ ID NO: 221748 - RNA, 63 nt, hsa
gaacccugaaacaaagauaaugauuuggaccacccaacugaaguggcauguuauguuuuuggc

SEQ ID NO: 221749 - RNA, 63 nt, hsa
gaguuuugaucucuuuuuaaggagaggcacuuuccaacugaaggugauugauguagggaaaug

SEQ ID NO: 221750 - RNA, 63 nt, hsa
ugguauauaguaggugcucaauaaauguugaaaccaacugaacugccaacaaaauaaaaauaa

SEQ ID NO: 221751 - RNA, 63 nt, hsa
uuuuuucaccuuaagggaggauuuaauuugcucccaacugauugucacuuaaaugaaaauuua

SEQ ID NO: 221752 - RNA, 63 nt, hsa
gaauggcuaugaagcgucauuucacauuuuaccccaacugaccugcaugcccaggacacaagu

SEQ ID NO: 221753 - RNA, 63 nt, hsa
aauggauguaaaaaagccuauuucuacauuauaccaacugagaaaaaaauggucgguaaagug

SEQ ID NO: 221754 - RNA, 63 nt, hsa
ugcaauuagccucauaguuauuauccagaggacccaacugaacugaacuaauccuucuggcag

SEQ ID NO: 221755 - RNA, 63 nt, hsa
ugcugaacauuuggaaaccaugcacuagccaacccaacugacuucugcuagguagaggcauuu

SEQ ID NO: 221756 - RNA, 63 nt, hsa
guuagggcuucaaggcccucagagaugaucaguccaacugaacgaccuuacaaaugaggaaac

SEQ ID NO: 221757 - RNA, 63 nt, hsa
uuuuuuauccagaaauauuuucagcaaaacuuuccaacugaguggagucugauuaaggauuua

SEQ ID NO: 221758 - RNA, 63 nt, hsa
ggauuagcuagcaccuuuaagcccugcauuucuccaacugacaagugggugggggugauggca

SEQ ID NO: 221759 - RNA, 63 nt, hsa
aaggacagaacuugacuggcuccauuucauggaccaacugaucaauugccaguacuaagccac

SEQ ID NO: 221760 - RNA, 63 nt, hsa
cuacaagccauacugaggcggcagcaggagcgaccaacugaucgcacacaugcuuuguuugga

SEQ ID NO: 221761 - RNA, 63 nt, hsa
caagcauugcuaccaaccgccucaucugagggcccaacugauaugauuugauuuauccuugua

SEQ ID NO: 221762 - RNA, 63 nt, hsa
auucuugcuauaacuaagugcuucuccaagaccccaacugaguccccagcaccugcuacagug

SEQ ID NO: 221763 - RNA, 63 nt, hsa
cauagggacagcuuguauaauuaccuucagaggccaacugacagaauccuggcaggaacagac

SEQ ID NO: 221764 - RNA, 63 nt, hsa
ggggccgugaccagcccucugccuccagggaggccaacugacucugagccaggguucccccag

SEQ ID NO: 221765 - RNA, 63 nt, hsa
gccuucacuugucaguaucauaaagaguauugcccaacugaacuuugcucccacugguuuaau

SEQ ID NO: 221766 - RNA, 63 nt, hsa
cccaaagcuguagucccaaucaaucaaaggcuaccaacugaguccucagguucauuucuuuuu

SEQ ID NO: 221767 - RNA, 63 nt, hsa
auugccccuccgaugcugaggccacccacugacccaacugauccugcuccagcagcacaccuc

SEQ ID NO: 221768 - RNA, 63 nt, hsa
ucucaccucacauugucccuacaaggacaggccccaacugauaaccguugcuuuuuuuuuuuu

SEQ ID NO: 221769 - RNA, 63 nt, hsa
cugcccuugggauuccaaaccucccuagggcucccaacugaccucaggccucugagucacuga

SEQ ID NO: 221770 - RNA, 63 nt, hsa
auggcugguguuauuggccaguuuuuagccaauccaacugaccuagugaagguucagaugcaa

SEQ ID NO: 221771 - RNA, 63 nt, hsa
gaaucccuuaggacuggaacacuucaagcucaaccaacugacucaguugucauucuucacaaa

SEQ ID NO: 221772 - RNA, 63 nt, hsa
gauguuccacuccacuuuguauagacaucugccccaacugaauguguucugucacucagcuuu

SEQ ID NO: 221773 - RNA, 63 nt, hsa
aagaauaauucauggauuuguucauuguucuuuccaacugaaggcaguaaccauuacuucuaa

SEQ ID NO: 221774 - RNA, 63 nt, hsa
uaugcccuaggaaaguacaaccagaauugaaaaccaacugaucuauaccaguucuuucaauua

SEQ ID NO: 221775 - RNA, 63 nt, hsa
cuuuaacaaugaaggggaaggggaagauuuccaccaacugaaucauuugugcacguguauagc

SEQ ID NO: 221776 - RNA, 63 nt, hsa
auauucuucuacugauucagucagacacgaaauccaacugaauuacccgguagacugaauauc

SEQ ID NO: 221777 - RNA, 63 nt, hsa
agugaaacaacaucauuuaagccaaaauaucucccaacugacugauagacucugagcacuaau

SEQ ID NO: 221778 - RNA, 63 nt, hsa
guuccaagcauggaggcucauucugaagcagcaccaacugagcaaaccccugugguccggcag

SEQ ID NO: 221779 - RNA, 63 nt, hsa
cuuuccucuccuggguacugaggugcuaugaagccaacugacaaagaugcaucacgugucuua

SEQ ID NO: 221780 - RNA, 63 nt, hsa
aaaacaaccucaaggguccaugaacaauaucugccaacugaaccuguugucuucaaauacuaa

SEQ ID NO: 221781 - RNA, 63 nt, hsa
uuuuacaguuaauccaggagagggaguccuuugccaacugaugaccaacaguuccaagccaga

SEQ ID NO: 221782 - RNA, 63 nt, hsa
uuccucauaagcauaaaaagaaaaucuuuguugccaacugaagcacaugaugauuuugugguc

SEQ ID NO: 221783 - RNA, 63 nt, hsa
ggcuuugacuaugucauuagguggguacaaaacccaacugauguggagaaaaauugauguuug

SEQ ID NO: 221784 - RNA, 63 nt, hsa
ggggggaugucuugagauguauuaugcaaaguaccaacugagccaaaaacaauaaacgaaaca

SEQ ID NO: 221785 - RNA, 63 nt, hsa
ucaaucaugggaauuacauaaggauaaugaggcccaacugaaaccaaguuucagucugccuua

SEQ ID NO: 221786 - RNA, 63 nt, hsa
agcaguauuuuaaguggggaaugcaacgugaggccaacugaacaauuccccccguggcugccc

SEQ ID NO: 221787 - RNA, 63 nt, hsa
gaaugaaauuaucacagguugucucaagcacaaccaacugaaugucucuuaacuguggggacc

SEQ ID NO: 221788 - RNA, 63 nt, hsa
guguucugcccuagauugguucaaggaggucauccaacugacuuuaucaaguggaauugggau

SEQ ID NO: 221789 - RNA, 63 nt, hsa
uuuuaaugauuguguguucuaauucaugugcugccaacugaguuaucuagugauaugaccuca

SEQ ID NO: 221790 - RNA, 63 nt, hsa
acaggagaaaggacaaccaggaugaggaugucaccaacugaauuaaacuuaaguccagaagcc

SEQ ID NO: 221791 - RNA, 63 nt, hsa
cugugugagcuacuuaacugacgcccucuuccuccaacugaaggaucgcccaacguuuuugga

SEQ ID NO: 221792 - RNA, 63 nt, hsa
ccagucuggagagcugugucuauuuguuucaacccaacugaccugccagccgguucugcuaga

SEQ ID NO: 221793 - RNA, 63 nt, hsa
caaagacuucaacaauugcacaucuucauucucccaacugaguguaguauguggagcauaaaa

SEQ ID NO: 221794 - RNA, 63 nt, hsa
uuaugucuuaguuauaauuagauugugaaucagccaacugaaaauccuuuuugcauauuucaa

SEQ ID NO: 221795 - RNA, 63 nt, hsa
cucucucucuaguauucuaaacugaccccaugaccaacugagaauuuauuuuuguuucauugg

SEQ ID NO: 221796 - RNA, 63 nt, hsa
aggacauacuaguucccuggcaggcaagggcuuccaacugaggcagugcauguguggcagaga

SEQ ID NO: 221797 - RNA, 55 nt, hsa
uccaguggccuccagguugaaccugccaacugauuaaaggacaccagacucugga

SEQ ID NO: 221798 - RNA, 63 nt, hsa
acuguaauugggccuggcucacugaugcuuucgccaacugaaacuacuaggauccugugugug

SEQ ID NO: 221799 - RNA, 63 nt, hsa
aucccauaaauaaaaaauacuuuaguuugcuaaccaacugaauauaugaggacugcauguaau

SEQ ID NO: 221800 - RNA, 63 nt, hsa
cagccagaaagcacuacaaucauggucaaguucccaacugagucaucuugugaguggauaauc

SEQ ID NO: 221801 - RNA, 63 nt, hsa
uuucauucauaccagauaauagcugcauuacugccaacugaccuuauaacccucugcaccuuc

SEQ ID NO: 221802 - RNA, 63 nt, hsa
ucaagcuguaacagaaaggucaauggacuugacccaacugagaaggaaaaacuucuguaugga

SEQ ID NO: 221803 - RNA, 63 nt, hsa
ucucaggcugcaccaaagauuccaucaucagggccaacugagagugagggagucucacccacc

SEQ ID NO: 221804 - RNA, 63 nt, hsa
ggcugaggccagaggcccaucgccugccccuguccaacugagauggccuucaggagccuaggu

SEQ ID NO: 221805 - RNA, 63 nt, hsa
ucacaagccaaguagggcauauaucagauuuggccaacugaauggcgucuguccugucaucca

SEQ ID NO: 221806 - RNA, 63 nt, hsa
uacguaggaauuuuuuccuuuuguguucugucaccaacugaaguggcuaaagagcuuugugau

SEQ ID NO: 221807 - RNA, 63 nt, hsa
gcccacacaacaggcuuauuuucugugaaggaaccaacugaucucccccacccuuggauuaga

SEQ ID NO: 221808 - RNA, 63 nt, hsa
uguuaagaggaaauaaucaagaucacucauaucccaacugaaucugagguuuuauaaaucccu

SEQ ID NO: 221809 - RNA, 63 nt, hsa
uugccagaugccccuaggggacagagucaacccccaacugaggaccacuguccuacagaguca

SEQ ID NO: 221810 - RNA, 63 nt, hsa
gguuuuuuuuuuuuuaaccaaaguguugucaggccaacugaaugaugaugugguugcuaugga

SEQ ID NO: 221811 - RNA, 63 nt, hsa
gaagagguguccuuacagaggccucuuuacugaccaacugaaguauagacuuacugcuggaca

SEQ ID NO: 221812 - RNA, 63 nt, hsa
ggguauuuaagugcuagggcuggucacacacaaccaacugaaaaagacuagagggauuaguac

SEQ ID NO: 221813 - RNA, 63 nt, hsa
gugcuuggcagcuguucuguguuuuccaggaauccaacugagcauugaaaucucucauuugcc

SEQ ID NO: 221814 - RNA, 63 nt, hsa
cccaccuggcuaccaggccgacagcuacauccuccaacugacccugaucaacgaagagggauu

SEQ ID NO: 221815 - RNA, 52 nt, hsa
auaagcucuucccacuguaaugccaacugauccauagccucuucagauuccu

SEQ ID NO: 221816 - RNA, 63 nt, hsa
cuuguccccuuggucuuuuaauuaaaagaaauuccaacugacuuuuaaacuuuguucuugucc

SEQ ID NO: 221817 - RNA, 63 nt, hsa
aagucacucacuuaaaauggggaaacugagguuccaacugacagaaacugaggguccugcccu

SEQ ID NO: 221818 - RNA, 63 nt, hsa
ccccaacccacucccuuccaacaacaaccagcuccaacugacucuggucuugggaggugaggc

SEQ ID NO: 221819 - RNA, 63 nt, hsa
ugacgucugaccucuaccaucgccauuuuugcuccaacugaggaaacuacaggggaagugggg

SEQ ID NO: 221820 - RNA, 63 nt, hsa
uaguaguuagaggcuuacaacuuaggagcagcaccaacugaaggugcuaauugcuuggaucuc

SEQ ID NO: 221821 - RNA, 63 nt, hsa
aacagagaagagauuacaccagcgguaacacugccaacugagacuaaaggaaacaaacaaaaa

SEQ ID NO: 221822 - RNA, 63 nt, hsa
aacuuacgauaucugccccaaaccucuguaaccccaacugaaaugaggagcuuccucucuucc

SEQ ID NO: 221823 - RNA, 63 nt, hsa
ugcucuuugaaaauuucuuuuuacacguguaagccaacugagauaccgugaugguguugauuu

SEQ ID NO: 221824 - RNA, 63 nt, hsa
cugggauuuaagacaccccugauggaaugaaagccaacugaaccacguaaagcucgaaccacg

SEQ ID NO: 221825 - RNA, 63 nt, hsa
aguccagaaagaaaggguucaucuuuuugacuuccaacugauauugggaaguuugguugaggu

SEQ ID NO: 221826 - RNA, 63 nt, hsa
ugaaccucuuagccacauuuccagcagggcaaaccaacugaugcccuggaagagucuuccgca

SEQ ID NO: 221827 - RNA, 63 nt, hsa
auuggaaagcuaauccuaccuugucaguuucaaccaacugaguuuuuucuuuaagaaagguaa

SEQ ID NO: 221828 - RNA, 63 nt, hsa
caggucucauagguugagcaauuucccccuaaaccaacugaaggcuaaaaagcaacaggccau

SEQ ID NO: 221829 - RNA, 63 nt, hsa
uccaaauauaagaguacucauguuuauuuauuuccaacugagcagcaaccuccuuuguuucac

SEQ ID NO: 221830 - RNA, 63 nt, hsa
uugccagacaagucuccaggggaucccuguuucccaacugaaaggugugaacggacacacaca

SEQ ID NO: 221831 - RNA, 63 nt, hsa
acucaaaauaaauggucuuuagcaucucaaauuccaacugaaaucauuuuaguauuaacucuu

SEQ ID NO: 221832 - RNA, 63 nt, hsa
cuuucuucccguguguauuucuaagaaauagagccaacugauuuuguauguaaauaccaagag

SEQ ID NO: 221833 - RNA, 63 nt, hsa
aaaagccuaacaaacagauaagguaggacucaaccaacugaaaccugacuuucccccuguacc

SEQ ID NO: 221834 - RNA, 63 nt, hsa
uauuccauuaccaggcacuccgccacccacaugccaacugacuugaugcuuaauaaaacugcu

SEQ ID NO: 221835 - RNA, 63 nt, hsa
uaaacccuuaccaaggaaaaaaaagggauguuaccaacugagaucgaucaguucauccaauca

SEQ ID NO: 221836 - RNA, 63 nt, hsa
agaaauauuauugauucuauagaaaaccauuuaccaacugaaaggacacgaagucuagcuccg

SEQ ID NO: 221837 - RNA, 63 nt, hsa
aaggagguugugggugggauuccaaggugaggcccaacugaaucguggggugagcuuuauagc

SEQ ID NO: 221838 - RNA, 63 nt, hsa
ugugacugacagguaauccuaauauauccaaauccaacugaauaccaaauugagauggcaaau

SEQ ID NO: 221839 - RNA, 63 nt, hsa
ggaaaauuaaaggccacuuguggcuuuuuccuaccaacugauacguuuaaauuugcccuagga

SEQ ID NO: 221840 - RNA, 63 nt, hsa
uuuuguauuuuaaaggaaaaaugacuuucauucccaacugauuaugaccuuucaggaugucgu

SEQ ID NO: 221841 - RNA, 63 nt, hsa
uguuuuuuuuuuaugaggcuccugagaaucaacccaacugaagcauuucaauucacuugaaug

SEQ ID NO: 221842 - RNA, 63 nt, hsa
uugugauuccuaccccucuuccagcuucuuuugccaacugaagccuucuucugccacuucugc

SEQ ID NO: 221843 - RNA, 63 nt, hsa
uugcuccaccccacucacagagacacagggcauccaacugagaaaacgaaacugcucuaagca

SEQ ID NO: 221844 - RNA, 63 nt, hsa
cccuuggccugcucccuguaggaagucauccugccaacugauuuaaaagggcucuuuagccag

SEQ ID NO: 221845 - RNA, 63 nt, hsa
aagaggugacugucaguggaggggucucugcagccaacugagacuaucuugcugugcccugag

SEQ ID NO: 221846 - RNA, 63 nt, hsa
acccccuugggguggggcagaaggugaagcaucccaacugacuagagacucaggcccugcagg

SEQ ID NO: 221847 - RNA, 63 nt, hsa
agccaguuagacuaguccccggucucccgauucccaacugaguguuauuugcacacugcacug

SEQ ID NO: 221848 - RNA, 63 nt, hsa
guaauauugguuagggaaacaaacuucaggucaccaacugaagucauuacaaacuccuuguac

SEQ ID NO: 221849 - RNA, 63 nt, hsa
augccagccaggcccaggagugcccagcaucccccaacugaugacacaguagcacugauucug

SEQ ID NO: 221850 - RNA, 63 nt, hsa
cgcuugcugcccaacaccauggcccucacaggcccaacugaccugcgcuggagcugcucuuau

SEQ ID NO: 221851 - RNA, 63 nt, hsa
cuuaccccaauaccaagaccaacuggcauagagccaacugagauaaaugcuauuuaaauaaag

SEQ ID NO: 221852 - RNA, 63 nt, hsa
cccugccagaaaaaugugcucugcaguguccucccaacugaaaacaacagugacauguuugaa

SEQ ID NO: 221853 - RNA, 63 nt, hsa
ggaaacccaagagcugccuggacacacggaaacccaacugagaacaaaauccuggcccgugcu

SEQ ID NO: 221854 - RNA, 63 nt, hsa
uggagggcugagcccugugacaaccugcuguuaccaacugaagagccccaagcucuccauggc

SEQ ID NO: 221855 - RNA, 63 nt, hsa
gggcagccagggagagcccaggagcuccccuccccaacugaccaccuuuguuucucccccaug

SEQ ID NO: 221856 - RNA, 63 nt, hsa
gucucagguuggauuauuuguuggccuuaagucccaacugauguccauuagccggacucgaaa

SEQ ID NO: 221857 - RNA, 63 nt, hsa
uccacuaucaugaaggacucugaauagacuuggccaacugauguuuacaaaccagacuuuuau

SEQ ID NO: 221858 - RNA, 63 nt, hsa
aacugaacucacaccugguaccacucagaaccuccaacugacugaaugccaggagcugaacau

SEQ ID NO: 221859 - RNA, 63 nt, hsa
aaccagagccuauauggaguucccucuucuaacccaacugacuuguaucuguccguggaaaau

SEQ ID NO: 221860 - RNA, 63 nt, hsa
auaucuuuuuguucaucaguaauaacuaguuggccaacugacugugguccauggacuacacag

SEQ ID NO: 221861 - RNA, 63 nt, hsa
cuggacagggggcagccguggaggccaccguuaccaacugaagcugggggccuggguccuacc

SEQ ID NO: 221862 - RNA, 63 nt, hsa
gcauugagccaguggugcuaaaugcuacauacuccaacugaaauguuaaggaagaagauagau

SEQ ID NO: 221863 - RNA, 63 nt, hsa
uaagauucaagggaguguugcuucucaacucagccaacugaguagcaaaucauuuguucuaga

SEQ ID NO: 221864 - RNA, 63 nt, hsa
gcaaggauguaugauaauauguacaaaguaauuccaacugaggaagcucaccugauccuuagu

SEQ ID NO: 221865 - RNA, 63 nt, hsa
uccugacauaagugcacagagcuucaguguccaccaacugaccaugaaauagaguaugcugua

SEQ ID NO: 221866 - RNA, 63 nt, hsa
uuagaaaugcaaauucuugggucacucucuagaccaacugaugcagaaacaggaggugugagc

SEQ ID NO: 221867 - RNA, 63 nt, hsa
accucccacccuccuccucuucuccuucaagacccaacugagcacccgcucugauuccccaca

SEQ ID NO: 221868 - RNA, 63 nt, hsa
agcuggagcacuacgacuugcaggccacccauuccaacugaguguagucggcucaacacccuc

SEQ ID NO: 221869 - RNA, 63 nt, hsa
gugcgaaccagcauuaacggauggggcacgugcccaacugaggaacaggagaagaaaucacca

SEQ ID NO: 221870 - RNA, 63 nt, hsa
ggaaaguuucagcucacugugaagccagacuccccaacugaaacaccagaagguuuggaguga

SEQ ID NO: 221871 - RNA, 63 nt, hsa
uaaguuucuuuuagcuuguacagcauccucagaccaacugaggagcuuuccuuguuaacaauu

SEQ ID NO: 221872 - RNA, 63 nt, hsa
gccuggaguugccgaggaagucacagaaaaugaccaacugauggggccuggagugcaggaggg

SEQ ID NO: 221873 - RNA, 63 nt, hsa
uaaaggacuuuuuuaacugcuggauuuguuuuuccaacugaguccaaacuuuucuaaugucug

SEQ ID NO: 221874 - RNA, 63 nt, hsa
aguagcugagauuacaggcgcacaccaccacgcccaacugauuuuuguauuuuuaguagagac

SEQ ID NO: 221875 - RNA, 63 nt, hsa
auuuucuguuaguacaaguugaacuugauugugccaacugaaaccccagagguuuguauauca

SEQ ID NO: 221876 - RNA, 63 nt, hsa
guggccagguggggcgggaccccagcaccucccccaacugacccuggacguccaggugggccc

SEQ ID NO: 221877 - RNA, 63 nt, hsa
cucacuuuuuguauuuaaauauuaaaaaugauuccaacugaaagugucauccuaaguaccuug

SEQ ID NO: 221878 - RNA, 63 nt, hsa
uucuaacuucucaaguucuagagaaagaauuaaccaacugaugacuuaccugccuaguuaaua

SEQ ID NO: 221879 - RNA, 63 nt, hsa
agugccugaugcccgcgucagagaccagaggagccaacugagaugauggggugggggugcucc

SEQ ID NO: 221880 - RNA, 63 nt, hsa
aaaauuauauugagcaaucgccaaggccuaaagccaacugacuuaaagguaaucauuucagcu

SEQ ID NO: 221881 - RNA, 63 nt, hsa
cccugccaugcucuggucuguucugaaacugugccaacugaaagaugauaguccacacagcac

SEQ ID NO: 221882 - RNA, 63 nt, hsa
aauuacaucccauaacuugucaggauaguugcuccaacugaauugcuaucauuuggcuggaug

SEQ ID NO: 221883 - RNA, 63 nt, hsa
uauuaugagaaaguggacuuaaccgaaauggaaccaacugacauucuaucguguuguacauag

SEQ ID NO: 221884 - RNA, 63 nt, hsa
agaagggugcuaagucaccuacugaagagagaaccaacugacuuuccuauugacucaucagga

SEQ ID NO: 221885 - RNA, 63 nt, hsa
ccuucuaucuugaaucuucuagagaguugcugaccaacugacguauguuucccuuugugaauu

SEQ ID NO: 221886 - RNA, 63 nt, hsa
aucuuugugugaaggauuggaaaaggcuauuuuccaacugaagucagggacauugccagcucc

SEQ ID NO: 221887 - RNA, 63 nt, hsa
aucugcccccaacucccaaaagcuagaacacugccaacugaucuguuauagguccuuuagaaa

SEQ ID NO: 221888 - RNA, 63 nt, hsa
ggguaugcuacucauaagauuucagggugucuuccaacugaaaucucaauguucucaguacga

SEQ ID NO: 221889 - RNA, 63 nt, hsa
guuuacagagaugucucuuauaucuaaaucuguccaacugagaaguaccuuaucaaaguagca

SEQ ID NO: 221890 - RNA, 64 nt, hsa
aaagcacaaagugcauguguacucacuucuggccauauaacauuuacacagggaaauggaucau

SEQ ID NO: 221891 - RNA, 64 nt, hsa
uuuuuugguuuuguuuuguuuuguuuuuuacaagauauaacauaacccaggaaacagacccagc

SEQ ID NO: 221892 - RNA, 64 nt, hsa
uuguauauauauaaagaaaucuauuacaauaaaaauauaacauaaucuauucaucuauuuauau

SEQ ID NO: 221893 - RNA, 64 nt, hsa
agcuucuaaauuaaucucugccuuuucugaccucauauaacacauuauguagguuucuuaucac

SEQ ID NO: 221894 - RNA, 64 nt, hsa
auaauuaacauaauuuaaauuugaugcaauuuaaauauaacaggagacuuaaaauauuuuauua

SEQ ID NO: 221895 - RNA, 64 nt, hsa
gguuuagcuuugauaagugcuauuaguaaugaauauauaacaugggaaccaauguuaucuuuaa

SEQ ID NO: 221896 - RNA, 64 nt, hsa
cacucucaucagauaucugacauaauuagauacaauauaacauuuuacuaaguucaguauucau

SEQ ID NO: 221897 - RNA, 64 nt, hsa
uuuaggaaacauacccaggaaguacaguugauaaauauaacaucaacugaaauagucaauuagc

SEQ ID NO: 221898 - RNA, 64 nt, hsa
uacauuuuaucauauuuauacuauuuauauucuuauauaacaaauguuugccuuuacauuguau

SEQ ID NO: 221899 - RNA, 64 nt, hsa
ucaucuugaaaugauucucauugauuaauuugccauauaacacuugcacaugugacucugguca

SEQ ID NO: 221900 - RNA, 64 nt, hsa
uaacaugcuucgugccaucaugauccuugccuucauauaacaaacaugcuucgucagagguguu

SEQ ID NO: 221901 - RNA, 64 nt, hsa
uauaacaugcuucgugcucauggucauugccuucauauaacaugcuucgugccaucaugauccu

SEQ ID NO: 221902 - RNA, 64 nt, hsa
uuugguggcagcugccaucauggucauugccuucauauaacaugcuucgugcucauggucauug

SEQ ID NO: 221903 - RNA, 64 nt, hsa
auugcuuaaacuauugacuugguaagucuacuguauauaacaucuaauauauauauauuauagg

SEQ ID NO: 221904 - RNA, 64 nt, hsa
auugcuuaaacuauugacuugguaagucuacuguauauaacaucuaauauauauauuacaggcc

SEQ ID NO: 221905 - RNA, 64 nt, hsa
caaaugaaguauggagguguguauguuuauauguauauaacaaaauauuuucauugugaccacu

SEQ ID NO: 221906 - RNA, 64 nt, hsa
uuaggaauaaaaggaaucuuccuagauaugauaaauauaacaucuaugaaaagcccacaccuaa

SEQ ID NO: 221907 - RNA, 64 nt, hsa
aauuuccucuuacaguucgaugcccauuaguuuuauauaacauuuauuugacacguacugacuu

SEQ ID NO: 221908 - RNA, 64 nt, hsa
aauauucaauuuaagagcaaggaaauucuuauaaauauaacaauagaggcagaacucauguaag

SEQ ID NO: 221909 - RNA, 64 nt, hsa
ccuuuaagaaaaaccacagggaccaagaaagaaaauauaacaguuugauuucugucauacccau

SEQ ID NO: 221910 - RNA, 64 nt, hsa
agcugcauacguaauauucaguaacugccauauuauauaacaaauuuacauucacaaauucagu

SEQ ID NO: 221911 - RNA, 64 nt, hsa; identical to SEQ ID NO: 52875

SEQ ID NO: 221912 - RNA, 64 nt, hsa; identical to SEQ ID NO: 52876

SEQ ID NO: 221913 - RNA, 64 nt, hsa; identical to SEQ ID NO: 52877

SEQ ID NO: 221914 - RNA, 64 nt, hsa; identical to SEQ ID NO: 52878

SEQ ID NO: 221915 - RNA, 64 nt, hsa; identical to SEQ ID NO: 52879

SEQ ID NO: 221916 - RNA, 64 nt, hsa; identical to SEQ ID NO: 52880

SEQ ID NO: 221917 - RNA, 64 nt, hsa; identical to SEQ ID NO: 52881

SEQ ID NO: 221918 - RNA, 64 nt, hsa; identical to SEQ ID NO: 52882

SEQ ID NO: 221919 - RNA, 64 nt, hsa; identical to SEQ ID NO: 52883

SEQ ID NO: 221920 - RNA, 64 nt, hsa; identical to SEQ ID NO: 52884

SEQ ID NO: 221921 - RNA, 64 nt, hsa; identical to SEQ ID NO: 52885

SEQ ID NO: 221922 - RNA, 64 nt, hsa; identical to SEQ ID NO: 52886

SEQ ID NO: 221923 - RNA, 64 nt, hsa; identical to SEQ ID NO: 52887

SEQ ID NO: 221924 - RNA, 64 nt, hsa; identical to SEQ ID NO: 52888

SEQ ID NO: 221925 - RNA, 64 nt, hsa; identical to SEQ ID NO: 52889

SEQ ID NO: 221926 - RNA, 64 nt, hsa; identical to SEQ ID NO: 52890

SEQ ID NO: 221927 - RNA, 64 nt, hsa; identical to SEQ ID NO: 52891

SEQ ID NO: 221928 - RNA, 64 nt, hsa; identical to SEQ ID NO: 52892

SEQ ID NO: 221929 - RNA, 64 nt, hsa; identical to SEQ ID NO: 52893

SEQ ID NO: 221930 - RNA, 64 nt, hsa; identical to SEQ ID NO: 52894

SEQ ID NO: 221931 - RNA, 64 nt, hsa; identical to SEQ ID NO: 52895

SEQ ID NO: 221932 - RNA, 64 nt, hsa; identical to SEQ ID NO: 52896

SEQ ID NO: 221933 - RNA, 64 nt, hsa; identical to SEQ ID NO: 52897

SEQ ID NO: 221934 - RNA, 64 nt, hsa; identical to SEQ ID NO: 52898

SEQ ID NO: 221935 - RNA, 64 nt, hsa; identical to SEQ ID NO: 52899

SEQ ID NO: 221936 - RNA, 64 nt, hsa; identical to SEQ ID NO: 52900

SEQ ID NO: 221937 - RNA, 64 nt, hsa; identical to SEQ ID NO: 52901

SEQ ID NO: 221938 - RNA, 64 nt, hsa; identical to SEQ ID NO: 52902

SEQ ID NO: 221939 - RNA, 64 nt, hsa; identical to SEQ ID NO: 52903

SEQ ID NO: 221940 - RNA, 64 nt, hsa; identical to SEQ ID NO: 52904

SEQ ID NO: 221941 - RNA, 64 nt, hsa; identical to SEQ ID NO: 52905

SEQ ID NO: 221942 - RNA, 64 nt, hsa; identical to SEQ ID NO: 52906

SEQ ID NO: 221943 - RNA, 64 nt, hsa; identical to SEQ ID NO: 52907

SEQ ID NO: 221944 - RNA, 64 nt, hsa; identical to SEQ ID NO: 52908

SEQ ID NO: 221945 - RNA, 64 nt, hsa; identical to SEQ ID NO: 52909

SEQ ID NO: 221946 - RNA, 64 nt, hsa; identical to SEQ ID NO: 52910

SEQ ID NO: 221947 - RNA, 64 nt, hsa; identical to SEQ ID NO: 52911

SEQ ID NO: 221948 - RNA, 64 nt, hsa; identical to SEQ ID NO: 52912

SEQ ID NO: 221949 - RNA, 64 nt, hsa; identical to SEQ ID NO: 52913

SEQ ID NO: 221950 - RNA, 64 nt, hsa; identical to SEQ ID NO: 52914

SEQ ID NO: 221951 - RNA, 64 nt, hsa
uuuaccucaaguugcuuggcagcacaacuaucuuugcaaaaaaaaguaaagaaaaaguaaauga

SEQ ID NO: 221952 - RNA, 64 nt, hsa
augaauaaucaaagugauuuuucagaauuaugugugcaaaaaauuaaugugcauucauauauuc

SEQ ID NO: 221953 - RNA, 64 nt, hsa
uauuaagacuuauauaauaagugcauguaggaauugcaaaaaauauuuuaaaaauuuauuacug

SEQ ID NO: 221954 - RNA, 64 nt, hsa
agcacaguaauguguguuuuguucagcauuauuaugcaaaaauucacuaguugagaugguuugu

SEQ ID NO: 221955 - RNA, 64 nt, hsa
ccacugcaaauuuuuucaguauaaaauuuuucacugcaaaaaaauuucaguagaaaauaaggau

SEQ ID NO: 221956 - RNA, 64 nt, hsa
cagguuaaauauucauugcauuuauaagaucuucugcaaaaagcccagaaaugguccuuuucag

SEQ ID NO: 221957 - RNA, 64 nt, hsa
aguugaugagcuuaaaaaaauaaaaauagaaaauugcaaaaaaaaaaaaaaaaaaaaaucucag

SEQ ID NO: 221958 - RNA, 64 nt, hsa
uuacaaaguauuuuuuuaccuguuaugcccuguuugcaaaaacaauuuagaaaaaaacaacaaa

SEQ ID NO: 221959 - RNA, 64 nt, hsa
uuaguuggaaguacccagaauuaucagaaacgaaugcaaaaaaaaaaaaaaaaaaaaaaagcuu

SEQ ID NO: 221960 - RNA, 64 nt, hsa
aagggcugccagagguucugauauguaagaaaacugcaaaaacaaauauagacaaauauuuuga

SEQ ID NO: 221961 - RNA, 64 nt, hsa
aguuuuagggucuaaguugaccucgagugagccaugcaaaaauagcuuuaaaauuauacaugag

SEQ ID NO: 221962 - RNA, 64 nt, hsa
acuuuuaaggaggguggauacauaguuuuucaacugcaaaaaucaugucaucucuucaguaacu

SEQ ID NO: 221963 - RNA, 64 nt, hsa
uuuauguauaauucuuucugccugccuacuuuucugcaaaaaugagauguacagauuucgguuc

SEQ ID NO: 221964 - RNA, 64 nt, hsa
aaaugaaggccaaacagaagcaggcuccagcuucugcaaaaacuuggauucacaaaugucccug

SEQ ID NO: 221965 - RNA, 64 nt, hsa
caugauauguacuauagugauucuguuuuugaggugcaaaaaacauacauauauaccaguuggu

SEQ ID NO: 221966 - RNA, 64 nt, hsa
aaggagaugcuuauagaugauaguuguacauaugugcaaaaaaaaauccacuugcaaugguaag

SEQ ID NO: 221967 - RNA, 64 nt, hsa
uaacuccaaguacaaggccgaccacaauggaugcugcaaaaacguugacuggggcaaaggauuu

SEQ ID NO: 221968 - RNA, 64 nt, hsa
uucauugccuggucaggucucuggccuauaaacaugcaaaaaaacuaauucauguuaaaguccu

SEQ ID NO: 221969 - RNA, 64 nt, hsa
uuaugcuuugaugauauagugagaaugcaucacuugcaaaaacgaucucaaaagugucagccuu

SEQ ID NO: 221970 - RNA, 64 nt, hsa
agucagccuggccaacauggcaaaacuccgucucugcaaaaaauacaaaaaugagcccgguaug

SEQ ID NO: 221971 - RNA, 64 nt, hsa
ucaaaccaauucacccagaaaaaagaccaauaggugcaaaaauaaaaggaaaaccagugaagug

SEQ ID NO: 221972 - RNA, 64 nt, hsa
caggcauaaauuagagaaaugguucuggauauggugcaaaaaugaguuuucaccugguauccau

SEQ ID NO: 221973 - RNA, 64 nt, hsa
agugcugaaagguuuugaauccuuuacccaacaaugcaaaaauagagccaaugguuauaacuug

SEQ ID NO: 221974 - RNA, 64 nt, hsa
gguuuuaaaugacccgucuagguuacugcuuccuugcaaaaaaagucgaauccugcauugaauu

SEQ ID NO: 221975 - RNA, 64 nt, hsa
aaccuacaaaaauaaacugaacuugcaauauuuuugcaaaaaaaucugucguuaaaacugagga

SEQ ID NO: 221976 - RNA, 64 nt, hsa
cuucacagcuaugacaaaaccgaaaaagcaaaacugcaaaaaaguacuaagauguacgggucuu

SEQ ID NO: 221977 - RNA, 64 nt, hsa
cuccucuucuccccucacuuuucccuacuuccucugcaaaaagauuuaacaaauacauucauaa

SEQ ID NO: 221978 - RNA, 64 nt, hsa
auucauaaggaaauguguguuguaacaaauauauugcaaaaacauaguuuguaaaggcauucua

SEQ ID NO: 221979 - RNA, 64 nt, hsa
guaauuauauacuugaaaguacauaauauaguauugcaaaaaugacuuugguauauuacaaauu

SEQ ID NO: 221980 - RNA, 64 nt, hsa
uaagaaguuaaaacuugagaagcaaaaaaaugccugcaaaaagaagaucauuuuguauacagag

SEQ ID NO: 221981 - RNA, 64 nt, hsa
aaaaaaaaaaagacucccuggaucucugaauauaugcaaaaagaaggccccauuuaguggagcc

SEQ ID NO: 221982 - RNA, 64 nt, hsa
auuccaacauugucuuuaggagugauuugcaccuugcaaaaaugguccuggaguugguagauug

SEQ ID NO: 221983 - RNA, 64 nt, hsa
aaauucuuuugaauuguuacaucaugcuggaaccugcaaaaaauacuuuuucuaaugaggagag

SEQ ID NO: 221984 - RNA, 64 nt, hsa
aaguuaauagauuuuuucagacuugucaagccugugcaaaaaaauuaaaauggaugccuugaau

SEQ ID NO: 221985 - RNA, 64 nt, hsa
gcauuuuaagguucucagaccuccagugaguaccugcaaaaaugaguugucacagaaauuauga

SEQ ID NO: 221986 - RNA, 64 nt, hsa
acaucauuccaaaaagaacaauaaugagagcaaaugcaaaaauaaccaaguccuccgaaggcau

SEQ ID NO: 221987 - RNA, 64 nt, hsa
gacuguuugaaucuugucucacuaguuuuuccugugcaaaaauaaaauggacagaauugcagcc

SEQ ID NO: 221988 - RNA, 64 nt, hsa
gagguuuacuuauuuuccacuuaucuuggaaucaugcaaaaaaaaaaaugucaagaguauuuau

SEQ ID NO: 221989 - RNA, 64 nt, hsa
acaaaacugguuaccuguaucaaagacccauuuaugcaaaaauguuaaaaaaaaaaaaaaacac

SEQ ID NO: 221990 - RNA, 64 nt, hsa
caauaaguugauuuacugaugauaugucauaugaugcaaaaaagguuuugugucauuaacugaa

SEQ ID NO: 221991 - RNA, 64 nt, hsa
cucagcugucugccugccacuuuguuguaaacauugcaaaaauguggaucauguagguuagaag

SEQ ID NO: 221992 - RNA, 64 nt, hsa
ucacagaaaacuuuugacuguauuuauuuauuguugcaaaaaagacgcuuuuuuauugcugccc

SEQ ID NO: 221993 - RNA, 64 nt, hsa
cuauaaaaucugccauaguuggauuaugcagcuuugcaaaaauuuuuacuagauuuugcacuaa

SEQ ID NO: 221994 - RNA, 64 nt, hsa
cucaaggaaccagggaugaaaucaguuuggauucugcaaaaaaggguaauggcaaaguuugcca

SEQ ID NO: 221995 - RNA, 64 nt, hsa
ccuuguauuuuacagaugcaaacagcuauaauuuugcaaaaaaggaaaauaacucuccugaaca

SEQ ID NO: 221996 - RNA, 64 nt, hsa
gucacaaagaggcaacguagccacugccucccuaugcaaaaaauuaaccagaugaugcagauaa

SEQ ID NO: 221997 - RNA, 64 nt, hsa
caaucuagcugaggagacaagacacauccaaugcugcaaaaauggugaauaaccugauucaggg

SEQ ID NO: 221998 - RNA, 64 nt, hsa
auaaauauauauauauaugucaaaagguaggaaaugcaaaaaagaaaaaaaaaaaaggugacag

SEQ ID NO: 221999 - RNA, 64 nt, hsa
caagagccucuggacuaaauggacauauuucuuaugcaaaaaggaaaacacacacaaccaauaa

SEQ ID NO: 222000 - RNA, 64 nt, hsa
aaguucacuuuuuuuguucuaggggaaaugaaugugcaaaaaaagaaaaagaacuguugguuau

SEQ ID NO: 222001 - RNA, 64 nt, hsa
uguuuuuuuucagcacauguuaccaugucugaccugcaaaaaugcuggagaaaaaugaaggaaa

SEQ ID NO: 222002 - RNA, 64 nt, hsa
caugucuaggcuacagggaaagagaauuauuugaugcaaaaauaauauaugaaaagagacgaaa

SEQ ID NO: 222003 - RNA, 64 nt, hsa
uugaaguauuuuucuugccaugccuauuuauuuuugcaaaaaaauuaucugcuauauagaacca

SEQ ID NO: 222004 - RNA, 64 nt, hsa
cacccaugcaggggcaaucagaucagcaucuucaugcaaaaaaaaaaaaaaaguugagugcucu

SEQ ID NO: 222005 - RNA, 64 nt, hsa
aagcggcccugcagccacaaagcaacccgcccucugcaaaaacuaggcacauccgcagugcgca

SEQ ID NO: 222006 - RNA, 64 nt, hsa
aauuaacacuuaagguugggugcugcuaauucuuugcaaaaauccaaauauuguuaagggacca

SEQ ID NO: 222007 - RNA, 64 nt, hsa
aaauauucacacuugaaccauaguuacuguaaaaugcaaaaaaucuuaauacuguuauucuuug

SEQ ID NO: 222008 - RNA, 75 nt, hsa
ugcagaggaaucuggaaauauuuauauccacggaguccuuggauccagugcuacgucaguaaauagcaccagcau

SEQ ID NO: 222009 - RNA, 75 nt, hsa
gcagcacuggugcccaccauacacacaggugucucaugugacucacagugcuaaagacucaugcuugacagcuug

SEQ ID NO: 222010 - RNA, 75 nt, hsa
aguuuagaagggaaguaggcauuaccauagacgacuccuagaggacagugcuauguaaaaaugugugucuauaaa

SEQ ID NO: 222011 - RNA, 75 nt, hsa
acagucuguuuuccaaccaguguggaagcaauuaaauaugcguaacagugcuacggccacaccagcaccuccugg

SEQ ID NO: 222012 - RNA, 75 nt, hsa
uuuauaagggaguacauuuugacugagcacuuagggcaucaggaacagugcuacuuacugauggguagacuggga

SEQ ID NO: 222013 - RNA, 75 nt, hsa
ugccuagggacacuguccagccuccaggcccaugcagaaagaguucagugcuacucugcgugauucaagcuuucc

SEQ ID NO: 222014 - RNA, 75 nt, hsa
cuguggcuccaaccccaagacucccaggcacaugggauggauguccagugcuaccacccaagcccccuccuucuu

SEQ ID NO: 222015 - RNA, 75 nt, hsa
uacugcuacgucucuaacagacucuucucuccuggucuccuugagcagugcuacuuaaacaguuuucacaguuuc

SEQ ID NO: 222016 - RNA, 75 nt, hsa
aggugggugaccaagcugcggaagcccaggacaguucgcugggaccagugcuaauggcagcuucugcuccugacc

SEQ ID NO: 222017 - RNA, 75 nt, hsa
aacagcugggccuccucacucaggacuucucuccugaagaacacgcagugcuaaaacugaggaugauuucccuaa

SEQ ID NO: 222018 - RNA, 75 nt, hsa
uugugugcuuuaaacaaaauaccuuggguugaugaaacaucaacccagugcuaggaauacuguguaucuaucauu

SEQ ID NO: 222019 - RNA, 75 nt, hsa
cgguagucuuuaaacauucuuuuagugaaauugucauuguuuuaucagugcuaaugugugcaagcaguuuuuuua

SEQ ID NO: 222020 - RNA, 75 nt, hsa
guagguuuguguggauggccuggagggcaggugcccucugcuccccagugcuaccucucucuucccuagggccuu

SEQ ID NO: 222021 - RNA, 75 nt, hsa
uacugcagggacagccccagagaggcccaacucuggccccuuucucagugcuaucugaugacggggaaacaaaau

SEQ ID NO: 222022 - RNA, 75 nt, hsa
aagcugcaaagcagacugguggcaaguacacagcccuuuuuuuugcagugcuaacuugucuacuguguauuauga

SEQ ID NO: 222023 - RNA, 75 nt, hsa
gugcacagaggagaugucagaagaccaaaacuuggugaauagucccagugcuaggucauauaggaaacagaaagc

SEQ ID NO: 222024 - RNA, 75 nt, hsa
aaaaaaaauucuguauaaaacuguaauccuuuguauucauguuuacagugcuauuacuauaauucaaaauuaugu

SEQ ID NO: 222025 - RNA, 75 nt, hsa
acauuuauguuuguggauuuaauuaaaguauuuuaauaugguuuucagugcuaaaauuggagucagauacuucuu

SEQ ID NO: 222026 - RNA, 75 nt, hsa
auuguguuacaguugccuacaguaugauuacaguaacauucuguacagugcuauagcugaagaguaauaggcuag

SEQ ID NO: 222027 - RNA, 75 nt, hsa
gucuaaugaaacaaaaaauauucaucuguugacaauuugccauagcagugcuaggauaaaccaaucaucuuaacu

SEQ ID NO: 222028 - RNA, 75 nt, hsa
uggauuuaauauuuguauuaaggauuaacuggaaaaaaugugucucagugcuaauucuuggaccuuuaauacagu

SEQ ID NO: 222029 - RNA, 75 nt, hsa
ccuaaauccuccucuaaaagaaggcacuugccauuaauccuaauucagugcuauccaguuauaaauggaaucuug

SEQ ID NO: 222030 - RNA, 75 nt, hsa
ucacucugagaggagugauaccaaugaaaaaaggucaguugauuccagugcuaaaagggaaaaaccugugguccg

SEQ ID NO: 222031 - RNA, 75 nt, hsa
uggggggaaaucacaagucacugagguguuuguuuguuuguuaggcagugcuagagcuugaagccacucaagcca

SEQ ID NO: 222032 - RNA, 75 nt, hsa
aucauuaugguauauaaucuacccuuaacagagcuuuucuuauuacagugcuaaaaugauuucugauaaaauggu

SEQ ID NO: 222033 - RNA, 75 nt, hsa
uaauacucuaaaaauagaaagaccaguaauauauaagucacuuuacagugcuacuucacacuuaaaagugcaugg

SEQ ID NO: 222034 - RNA, 75 nt, hsa
ugagacugguccugguuuuguucccuuuggguacagaccucuugucagugcuauaaauuguuuaaugaggccauu

SEQ ID NO: 222035 - RNA, 75 nt, hsa
uuacacauaaagcacuaccuaaguaauucucucucuguuuugugccagugcuaaacuacugauuacuuguaauua

SEQ ID NO: 222036 - RNA, 75 nt, hsa
accgccacagcccggcagaggggcacacucuggagaccuugcuggcagugcuagccaggaaacagagugaccaag

SEQ ID NO: 222037 - RNA, 75 nt, hsa
ugcuucugauacuaaggacguauccaggaguaccacaaccaccaccagugcuaccaccguugccacugagcccac

SEQ ID NO: 222038 - RNA, 75 nt, hsa
accuagaucacaguauuuaaguguuuugcguuuuauacaugaggucagugcuacagccaccuagcaugaacuaac

SEQ ID NO: 222039 - RNA, 75 nt, hsa
gcuucacaaacaugaccagauaacugacuagaaagaaguaguugacagugcuauuuugugcccacugucucuccu

SEQ ID NO: 222040 - RNA, 75 nt, hsa
cugagagaguuaagugaaugucuaaggucacacaguauuaagugacagugcuagaaaucaaacccagagcugugg

SEQ ID NO: 222041 - RNA, 75 nt, hsa
ucugagcugugggauucuaugaaaaauucuugccuuuccuuguuucagugcuaacgauuucucaccucgaagcgc

SEQ ID NO: 222042 - RNA, 75 nt, hsa
uuuaaauucuucauaguugaguauuauuugcaauuuuauuaguuacagugcuauuaaagaauaugugcuccuuuu

SEQ ID NO: 222043 - RNA, 75 nt, hsa
gagacacuaacccuucaaagaagcaggcugugaacauugggugcccagugcuaucagaugaguuaaaaccuuuga

SEQ ID NO: 222044 - RNA, 75 nt, hsa
ucacaggccagcaguccaugucagccacaucaggcacauggaacacagugcuauucaugaagguggguucaccau

SEQ ID NO: 222045 - RNA, 75 nt, hsa
ccugggccugggccugccuauggcccagagcuacccugggagugucagugcuagcagcacagcuaccucuggugg

SEQ ID NO: 222046 - RNA, 75 nt, hsa
gcuuuagcuuuuaacucuggaagcgcaugcacacugaacucugcucagugcuaaacagucaccagcagguuccuc

SEQ ID NO: 222047 - RNA, 75 nt, hsa
aguuugguaaacauugggauugucccugcaucugaacaucuuucccagugcuaucaguauacaucuagagaggaa

SEQ ID NO: 222048 - RNA, 75 nt, hsa
uucaguaggguuugagacuuacgugugauacugacagguaagcaacagugcuagcauucuagauuccugccuuuu

SEQ ID NO: 222049 - RNA, 75 nt, hsa
uuacaaaacaaacaaacaaacaaaaaacccauguguuaaaauacucagugcuaaacauggcuuaaucuuauuuua

SEQ ID NO: 222050 - RNA, 75 nt, hsa
ccuaugaauucuucuaauacgugaagaaaauaguuugaguagcagcagugcuauaggugggaaauacaguuuagc

SEQ ID NO: 222051 - RNA, 75 nt, hsa
guuagaaugcuuuuucagcauuauggcuaaaauauaugucuaacccagugcuauuuaggugaaaaugcuaauuga

SEQ ID NO: 222052 - RNA, 75 nt, hsa
ccgaaguaauaagugaggacgaaugcacugcucuggaacauaacccagugcuaacuggggguuucauuuauucag

SEQ ID NO: 222053 - RNA, 75 nt, hsa
aggcacagugaaaaagaagucaaaaaaaaaaguucuacuuuucaucagugcuauuaaagguggcagcaaauguaa

SEQ ID NO: 222054 - RNA, 75 nt, hsa
gaaaagauuugcugauuauuaguuuaaaaaucuuguaacacucagcagugcuauuuugagucaucccaguuuccu

SEQ ID NO: 222055 - RNA, 75 nt, hsa
cuugcaaagcaacuagugggugcuugagagacacugggacacugucagugcuagauuuagcacaguauuuugauc

SEQ ID NO: 222056 - RNA, 75 nt, hsa
uguuuuaugacucugcugcaguuuguggaaaugcuggacuuggcucagugcuauaaauuguagccaggaaauaag

SEQ ID NO: 222057 - RNA, 75 nt, hsa
acuaaaauacaugggcaugcaucuuacacugaucuuauuagaggucagugcuaaguacccaucuugauugaaguu

SEQ ID NO: 222058 - RNA, 75 nt, hsa
acagggccaaagccauaguguccggucccaaggacaaggcucuuccagugcuaggagagguaugagcagccucuc

SEQ ID NO: 222059 - RNA, 75 nt, hsa
uggcuuggcuuuagucuuacauuuaaauucuuugaaaguggcucccagugcuauucaggguccuuucuugaggcc

SEQ ID NO: 222060 - RNA, 75 nt, hsa
ugugugugugugugucuaagaaaacuugugugcuuuucaaaaaggcagugcuaagcacaagauuucaagaaagcc

SEQ ID NO: 222061 - RNA, 75 nt, hsa
auuucacuguagacuguuuuaaauugccaagacugcacaaaauuacagugcuaauguauaugguugcaguucaca

SEQ ID NO: 222062 - RNA, 75 nt, hsa
gagaggcauguuagguuucagagauuuucuccauggagcaaggugcagugcuagaauauggugguugauucccaa

SEQ ID NO: 222063 - RNA, 75 nt, hsa
cucaguuugccuugcggggagggggcuccugggccaugggacuuccagugcuaaaacugggaaagccccagguaa

SEQ ID NO: 222064 - RNA, 75 nt, hsa
aaauuauuagaaauuaugcuuuuuccauuuuaauuguauugcugccagugcuauuuuuuucuuuaaaaaauuuua

SEQ ID NO: 222065 - RNA, 75 nt, hsa
ucggggcuuggaagagcucuucaguuuuucuguuuccucaagucucagugcuauccuauuacaacauggcugauc

SEQ ID NO: 222066 - RNA, 75 nt, hsa
cagagcuuggcaggaggcucccggcggaccaaggaggaggagcugcagugcuaaguccagccagcgugcagcugc

SEQ ID NO: 222067 - RNA, 75 nt, hsa
agaaaugugugacccuucauuuauggauauugacuauauguaaugcagugcuaucccaauauuuucaauaaagga

SEQ ID NO: 222068 - RNA, 75 nt, hsa
agaauucauuuuaucaaaaagacaccugcaccaauauguucauuacagugcuauucucaccagcaaggacagaga

SEQ ID NO: 222069 - RNA, 75 nt, hsa
ugcacugauuguuauacuuuaaauaacuaaaaaucugagaauccacagugcuacagacaauaagugauaaaaugg

SEQ ID NO: 222070 - RNA, 75 nt, hsa
cacucaggugcugaaggguaauauggacucagccuugcaaauagccagugcuaguucugacccaaccacagagga

SEQ ID NO: 222071 - RNA, 75 nt, hsa
gccccucccggccccaaaccacaggggcucaggucgugugggccccagugcuagaucucucccucccuucgucuc

SEQ ID NO: 222072 - RNA, 75 nt, hsa
auucaggugaaaaguuggcguggcauguuugaggacucugcggaucagugcuacaggaguacaucugcccugcca

SEQ ID NO: 222073 - RNA, 75 nt, hsa
cuuuauauuugauaucuaaaauguuaggagaaaaauuaauauauucagugcuaauauaauaaaguauuaauaauu

SEQ ID NO: 222074 - RNA, 75 nt, hsa
uuuuucuauuuuacuugcagagcaucacaaaagaacagguauuuucagugcuacauaauguguuuucccacauuu

SEQ ID NO: 222075 - RNA, 75 nt, hsa
uuuugacuauuuucagcaccaacugagcaaaccccugugguccggcagugcuaccaugguaauggacagaguuau

SEQ ID NO: 222076 - RNA, 75 nt, hsa
ucucuuuuaauuucagcaccaacagagccaaggccuugggagcagcagugcuaccacgguaauggacagaguuau

SEQ ID NO: 222077 - RNA, 65 nt, hsa
ccaagccagaauucaucuagacccuagggcagugccagugcuaggcugagcaccaucagcucucc

SEQ ID NO: 222078 - RNA, 75 nt, hsa
ggagaaaagauguuggcauugcugauuguuugguuaagcaauguccagugcuaggauuauuugcagguuugguuu

SEQ ID NO: 222079 - RNA, 75 nt, hsa
uggaggcauguauagguaugaucuguguaaaaucugacauaaaaacagugcuauucugagugaaaauuuuuuuga

SEQ ID NO: 222080 - RNA, 75 nt, hsa
cuuuuugggaugagaacauuuuaguuguuuaguuuguuucuuaagcagugcuauuuuuuguaaacacagauaaau

SEQ ID NO: 222081 - RNA, 75 nt, hsa
aaagccagaaauucuugcuucccauuucuagaauaguuucuagaacagugcuaugcacauauuagaucuuaauaa

SEQ ID NO: 222082 - RNA, 75 nt, hsa
ccauuugaugauucuguauuucagagucaguuucuugaguaacuccagugcuacaaaaagaauuaguaauguggu

SEQ ID NO: 222083 - RNA, 75 nt, hsa
aagauuaaaaauuguacaugaagcucauguuaacuuucuuuuggucagugcuauuuuaaaggaaguaugaguuga

SEQ ID NO: 222084 - RNA, 75 nt, hsa
uauguggucaaaaacuagauaaugaaaguagcaggugcuaaguaucagugcuaaaugcucuguaugucacuacau

SEQ ID NO: 222085 - RNA, 75 nt, hsa
ccauccuguuaaccacagugaaacgcugcaguauuuugauuuggucagugcuacggaggaagaccaugaaagcug

SEQ ID NO: 222086 - RNA, 75 nt, hsa
uagaucuuaaagggcaaagcaguauauugguaguugucaauauagcagugcuagcucugucuauauaaauagaga

SEQ ID NO: 222087 - RNA, 75 nt, hsa
gcccugcaagcaaccccgcgcuugggaaggcucuucuccggggcacagugcuaguggggccuccccacaggccac

SEQ ID NO: 222088 - RNA, 75 nt, hsa
uuuaaacugcuaacagaccuuaaaauaucccccuaccuggguccucagugcuauguuuaaagugcugcagggaug

SEQ ID NO: 222089 - RNA, 75 nt, hsa
gaaaugcuuaggacuuuguggcuuguuacauuugucauuuaacugcagugcuauucuuugaaagcugcuaugugu

SEQ ID NO: 222090 - RNA, 75 nt, hsa
uagguccuacugucugccaguacucaugugaguuguaugugcccccagugcuacauacgcagguaugcguaagug

SEQ ID NO: 222091 - RNA, 75 nt, hsa
aacugacccucuugggacaaggacaaaagaugucauugacguagucagugcuaagagcagaaaugcaauucuuug

SEQ ID NO: 222092 - RNA, 75 nt, hsa
aagaaguagauagaaauacgaagauuaugauaagaaagucugucacagugcuauuuggaaaacggaaaauuuaca

SEQ ID NO: 222093 - RNA, 75 nt, hsa
gggauuaaaugagauaauaugaguggcagcucuucaugaguccugcagugcuaagcaaaugucagaaauuggugu

SEQ ID NO: 222094 - RNA, 75 nt, hsa
caugucuaguauauuaagucuccauagcccuccugaugcaguagacagugcuaugcuguggauauaauaccaacc

SEQ ID NO: 222095 - RNA, 75 nt, hsa
gcuuucucugcggugggguagagaauggagcucccgccuugcgggcagugcuaaagguggagcugggggauuuuc

SEQ ID NO: 222096 - RNA, 75 nt, hsa
cuuuuugugaagccauauguccuaacaggagcuucaucaccaacucagugcuauuaauucuccuucucugaauga

SEQ ID NO: 222097 - RNA, 75 nt, hsa
caaaagaggaccacacaucuguuggucacagaguucaugucacaccagugcuagaaguuucaugauuuuauuucc

SEQ ID NO: 222098 - RNA, 75 nt, hsa
uuuucucaauuguaacgacuucuccaucuccuguguaaucaaggccagugcuaaaauucagaugcuguuaguacc

SEQ ID NO: 222099 - RNA, 75 nt, hsa
cauucuuaaaaaguuauuucaagggauggcauaacuguaagaggucagugcuagaauaaaguccuguagguuuau

SEQ ID NO: 222100 - RNA, 75 nt, hsa
cucccauucuccccucccguucugccacagcggccugggcugguccagugcuaugccuggaggcucaacacaaaa

SEQ ID NO: 222101 - RNA, 75 nt, hsa
cuuuuuuccuuguggucauccaggaggugaucaauuacaugugcacagugcuaggacgggaggcagagccggcuc

SEQ ID NO: 222102 - RNA, 75 nt, hsa
aggaacaagggaugagggagaaaaauccguuuuauccaucagagucagugcuauaaaauugccuauuaagguaaa

SEQ ID NO: 222103 - RNA, 75 nt, hsa
acauucuuguuuuaagugccuuuaguuuuaacaguucacuuuuuacagugcuauuuacugaaguuauuuauuaaa

SEQ ID NO: 222104 - RNA, 75 nt, hsa
ggagaguucccccaugaugagggccaagauagaaucuguaccacucagugcuaccauccccaccccuacaccacu

SEQ ID NO: 222105 - RNA, 75 nt, hsa
uuaucuggcugugcagccuugcucuguggcuuuucccaacacaaucagugcuagugcuggggaggaacagucaag

SEQ ID NO: 222106 - RNA, 75 nt, hsa
acuaucuuaugagggagauggugacuucuccuuuuuucuguggaucagugcuauuguguguucucaguuuaagau

SEQ ID NO: 222107 - RNA, 75 nt, hsa
aguguugccuuucugagggauuucugcucaaugcaauacacuguucagugcuauucucccagcuagguuuaucca

SEQ ID NO: 222108 - RNA, 75 nt, hsa
cuuacugauaagaagcugaaacaagaaauucucuucauuuuaucccagugcuauuuuauugauuaauuacuaaaa

SEQ ID NO: 222109 - RNA, 75 nt, hsa
auaugcugauuugcucuuucucauuguaugucuaugcuuugucaucagugcuauaguaaauuacaaagaaauagg

SEQ ID NO: 222110 - RNA, 75 nt, hsa
aauuuaauuucaagaugaguuuuggaggggacauucaaaccauagcagugcuauaauuuuaaaguacuucaaagc

SEQ ID NO: 222111 - RNA, 75 nt, hsa
gucacugcuccugggacccaguccccuggaggggagguggaaaaucagugcuacggggccagucuuucccguggc

SEQ ID NO: 222112 - RNA, 75 nt, hsa
aagaaaaaaaaguggcuggucuacuaggcagccuuugugccacuucagugcuagaaaguuaaagaaaaaaaaacu

SEQ ID NO: 222113 - RNA, 75 nt, hsa
uggcuccaugcuccucacugcccgcacacccucacucugccagggcagugcuagugagcugggcaugguaccagc

SEQ ID NO: 222114 - RNA, 75 nt, hsa
caugacaggggcgcuugggaggggccggaggaaccgagguguugccagugcuaagcugcccugaggguuuccuuc

SEQ ID NO: 222115 - RNA, 75 nt, hsa
aguggguggauuuguugccaugugcaccuugggguuuuguaaugacagugcuaaaaaaaaaaagcauuuuuuuuu

SEQ ID NO: 222116 - RNA, 75 nt, hsa
auuauaauuacuugccacuugaauguguuuuguguaauguuuuaacagugcuaguaaauaaauacggguuuaccc

SEQ ID NO: 222117 - RNA, 75 nt, hsa
uguuuguccuguauuuacaguuguuuuugacuaugcaggagcuaucagugcuagagugagcaugcuucaaaacug

SEQ ID NO: 222118 - RNA, 75 nt, hsa
ucguuugagaauuguagccuguuguuuucgcugugacuugggucucagugcuaggguauugagucaggcagcugg

SEQ ID NO: 222119 - RNA, 75 nt, hsa
auguguaaucaguuuacauuguuuuguauagugaagguguauuuucagugcuacccgcuagcugauuuuaacuuu

SEQ ID NO: 222120 - RNA, 75 nt, hsa
aucuccuaacaaaagaacuaagaggcccagcccucagaaacccuucagugcuacauuuuguggcuuuuuaaugga

SEQ ID NO: 222121 - RNA, 75 nt, hsa
aaugcuuauaauguaguacaauuaaaaacaacacaucuccacuaccagugcuaacccauuuuuaaguacauuugc

SEQ ID NO: 222122 - RNA, 75 nt, hsa
cccagggcauuauguacagugcuuuuuauuacuguggggagagggcagugcuaaauaaauuaaucacuacugaua

SEQ ID NO: 222123 - RNA, 75 nt, hsa
uggccucuaauagguugggaaguuuuagcguguuuuaugcaauuucagugcuaacaauuucuuccuuuccugcuu

SEQ ID NO: 222124 - RNA, 75 nt, hsa
uaucuuguuuuugaagccaggguaguuguaugauuuuguuaccagcagugcuaaccugaaugugaccugguuacc

SEQ ID NO: 222125 - RNA, 75 nt, hsa
uccuuuuuuccuaagaccauuuauaauuauuaguggcaacagagucagugcuaaucuagccaaauuacauaugua

SEQ ID NO: 222126 - RNA, 75 nt, hsa
gcccuuaugccccaguucaagccacugcagcuaaguauuaauccccagugcuaaaagauaccaggcaucuaguuu

SEQ ID NO: 222127 - RNA, 75 nt, hsa
auuugcaggcucuugugucaucgcuuauugauauuccuuguuccacagugcuauggaucuuccucagaagaacau

SEQ ID NO: 222128 - RNA, 75 nt, hsa
ccaacaaacaauaguucuagggagaugagaaaaaaauucaccuuacagugcuaagaaagugcauuagaauggaau

SEQ ID NO: 222129 - RNA, 75 nt, hsa
uucuggaacuuucuaccgaguauccaccacccuuagacacaaucccagugcuacccgucugaccugcacugcuca

SEQ ID NO: 222130 - RNA, 75 nt, hsa
uuuguaucuaauguguacaguguaaaauugacuuuaaaaauauugcagugcuauuuuuucuuaaucagaaaggaa

SEQ ID NO: 222131 - RNA, 75 nt, hsa
gugcuuuaaaaagaacccucacaaguuaaaaauuaagaguuguuucagugcuagaucuuaccagcuaaagacuug

SEQ ID NO: 222132 - RNA, 75 nt, hsa
uaccaagguucagaaauacguaauuuagcaggaaacuauaaauaccagugcuaucacagccacacauacacacac

SEQ ID NO: 222133 - RNA, 75 nt, hsa
guuuagagagccugucaccagagcuucucugggcugaauguaugucagugcuauaaaugccagagccaaccugga

SEQ ID NO: 222134 - RNA, 75 nt, hsa
cuguauggcauauuacuguacugauuacuguaggcgguuguaacacagugcuaaguauuuguguaucuaaacaua

SEQ ID NO: 222135 - RNA, 66 nt, hsa
augggccaccccccacauagagggcauagcuggccacagugcuacaccaccugccugauugccaag

SEQ ID NO: 222136 - RNA, 75 nt, hsa
ugauucuagacauagacagggaugauccacuguuacugagggcaucagugcuauaaguuaaggcuuucugcacug

SEQ ID NO: 222137 - RNA, 75 nt, hsa
ucagaaugugaagauuuuacucuuggcuuaauuuuucccuccacucagugcuaaggcugagccuccagaugcugu

SEQ ID NO: 222138 - RNA, 75 nt, hsa
aggacaauucaugaacuucgcaucaaaagacaauucuuuauacaacagugcuaaaaaugggacuucuuuucacau

SEQ ID NO: 222139 - RNA, 75 nt, hsa
cuaccaugaguaaaagcuuccugaggcuuccccagaagcagaugccagugcuaugcuuccuauagccuggagaac

SEQ ID NO: 222140 - RNA, 75 nt, hsa
auaagcguuaaaaauuguguuuuucagaaucuuuaaaauauaagacagugcuaucuagugaauaaaaaaauuagu

SEQ ID NO: 222141 - RNA, 75 nt, hsa
acaguaugucagauaagccgguggggggaugagauuaggcugaggcagugcuagucaacuggggaaaaggaugau

SEQ ID NO: 222142 - RNA, 75 nt, hsa
ccguacauguuaagggcauuucaguggcagugcuguaccccugggcagugcuaccugggcacacacguagacaag

SEQ ID NO: 222143 - RNA, 75 nt, hsa
gucucuguuaguacuauuggcauuuagaagacuuuaccauuauuucagugcuaggcauuauugauuaggucuugg

SEQ ID NO: 222144 - RNA, 75 nt, hsa
gcauuguaguaugcauuaaucuuucaauguagugguguaaaaaugcagugcuaaacuaaugaagcaggugacugc

SEQ ID NO: 222145 - RNA, 75 nt, hsa
uaagcaagguaagaugagaagcaaggggucucaguucuaggaauacagugcuaguugauugucagguauguugua

SEQ ID NO: 222146 - RNA, 75 nt, hsa
uguccguaucaagcaucagucucucaaacaguugccccagccugacagugcuagucucuguuuaaugguaaaagg

SEQ ID NO: 222147 - RNA, 75 nt, hsa
uaaaaccucauuugauaagcacuccuagucucuggccuguggauccagugcuauucugucaccaaccuaagaauc

SEQ ID NO: 222148 - RNA, 75 nt, hsa
uauauauauauuuuuuauuacuugggagaaugaauuuuaaaaugucagugcuagugucaaguguuguccuaggau

SEQ ID NO: 222149 - RNA, 75 nt, hsa
ggcuagaaccaucuuccauauuuccaagauuuuccaagaugaagccagugcuagcugagaagcagcaaugaacag

SEQ ID NO: 222150 - RNA, 75 nt, hsa
aacuuuuaugccuuuuaaaauaaauuuauuuucauaaaugguuugcagugcuaaauuacauuuagauuaagaaca

SEQ ID NO: 222151 - RNA, 75 nt, hsa
acuuacacuguugacaucuauuuucugaaguguguuuaaauuauucagugcuaaucauuguuuuuuccuuuguaa

SEQ ID NO: 222152 - RNA, 75 nt, hsa
cauauacaaauucgugaauucuuguucauuuugcauuccugcagucagugcuaauccgucguucuuaaucaggag

SEQ ID NO: 222153 - RNA, 75 nt, hsa
aauauagccugaagacagaggauaaauaguugucaaugucagagacagugcuauuaauguauaugugagcgacaa

SEQ ID NO: 222154 - RNA, 75 nt, hsa
uccugguugccauggaaauagcagccaacggacaccucccgaugccagugcuaaggcuggaaauggcccccucuu

SEQ ID NO: 222155 - RNA, 75 nt, hsa
cuuacugucaaauugcaacuuuuuuuuuagauacagaguggaaaacagugcuaagucauuuggcaccuccuuaca

SEQ ID NO: 222156 - RNA, 75 nt, hsa
gccucaacuuccccuaacagauaugcauauuccuuccagaugccucagugcuacaccacagugggccugguccca

SEQ ID NO: 222157 - RNA, 75 nt, hsa
caagcuuugguuuaugguuuucauucauuggugaaguaaauuaggcagugcuaaagccuguggguuugguccuug

SEQ ID NO: 222158 - RNA, 75 nt, hsa
guuccacugaugcaaaagggucuuuuccuagcuuccuggucugaucagugcuaugagauggacagauaaguguga

SEQ ID NO: 222159 - RNA, 75 nt, hsa
uaacaucacacaauaggaaacaccacuuccacaagucucaagccucagugcuaaaguacuacugaaaaggaacua

SEQ ID NO: 222160 - RNA, 75 nt, hsa
uuaauccaguacauuguagaagauggaggucauguguuugccggccagugcuaugcugagauugaggucagggug

SEQ ID NO: 222161 - RNA, 75 nt, hsa
gaugcaggauaugccugacaggaacagucuguggauggacaugaucagugcuaaggaaagcagcagagagagacg

SEQ ID NO: 222162 - RNA, 75 nt, hsa
gccaaaaagaauacauuguuuaaauucacaaaauuagcauaauugcagugcuaaugaauaucggaauaugugcac

SEQ ID NO: 222163 - RNA, 75 nt, hsa
uucgucuuucuuuaacacacacuaggcucuuuguguauuaugauucagugcuauuuguaacugugucccagugac

SEQ ID NO: 222164 - RNA, 75 nt, hsa
aucuaauuuugaauucugaccauggauacccaucacuuuggcauucagugcuacauguguauuuuauauaaaaau

SEQ ID NO: 222165 - RNA, 75 nt, hsa
guuuaaaauuuuguauaucaccaaauuuuuaaaaagugauagucacagugcuaaguuaucuaguuggcuacuauu

SEQ ID NO: 222166 - RNA, 75 nt, hsa
uuaauggaauucuuuucuuugauuaucaaggacuuucacugcaggcagugcuauuucuugugccuaagaauguuu

SEQ ID NO: 222167 - RNA, 75 nt, hsa
acauucuuauuaauucuucaccuguuauguaugaaggaaucauuccagugcuagaaaauuuagcccuuuaaaacg

SEQ ID NO: 222168 - RNA, 75 nt, hsa
auaaacaauuaauuuugcccagcaagcuucugcacuaguaacugacagugcuacauuaaucauagggguuugucu

SEQ ID NO: 222169 - RNA, 75 nt, hsa
caaauuuauuacauuagcagaagcaugcacaaagagauaaugucacagugcuacaauuaggucuuugucagacau

SEQ ID NO: 222170 - RNA, 75 nt, hsa
uaccaaagccuggaaguucucaucaccuccagguggacugcuuggcagugcuaggagguggacucaggacuucag

SEQ ID NO: 222171 - RNA, 75 nt, hsa
uguacugagagaauccugaagaauggaacagcuguagaaagccuucagugcuaucagcagggauucaugugacag

SEQ ID NO: 222172 - RNA, 75 nt, hsa
gaccuuccugucccugccuucgaccuccugccugggucuucagcucagugcuacucugaauacaauacugcugac

SEQ ID NO: 222173 - RNA, 75 nt, hsa
auuuacucuuggaucucauucucccuuuuuauccugaguuaccaucagugcuaauguuccucuuuuggguauagu

SEQ ID NO: 222174 - RNA, 75 nt, hsa
gcauucauacaaaaauccaagaagauacaggaauucuguguaugacagugcuauugaaaucacuggggaaugaau

SEQ ID NO: 222175 - RNA, 75 nt, hsa
uucucgagcagaugacacgagcuaguccacguugacagcuuaagacagugcuagcucugcccuggcucuccuaga

SEQ ID NO: 222176 - RNA, 75 nt, hsa
gggagacuccggcaaccuucagcaacauauauccucgaccagaugcagugcuauaagaacagaacgcauuuugga

SEQ ID NO: 222177 - RNA, 75 nt, hsa
aaaggaauuuuauacauugacucagucggauucaauggacggucacagugcuauuacuuugaaaacccugcugau

SEQ ID NO: 222178 - RNA, 75 nt, hsa
uccaguucugugggggaugaguuuuuuuguggguugcuuuuucuucagugcuaagaaaguucccuccaacaggaa

SEQ ID NO: 222179 - RNA, 75 nt, hsa
acuuuucuaaacugcaucuggauugaaagguguaaauaucaauaacagugcuacuuaguuaucaguauuuaauau

SEQ ID NO: 222180 - RNA, 75 nt, hsa
uggauucauugcagcggaccaccgggcacuguugaccccacugagcagugcuaaguguugguuuaguggauguuc

SEQ ID NO: 222181 - RNA, 75 nt, hsa
ccugucuucuccccuaggugguuccugagcccccacccccaaucccagugcuacaccugagguucuggagcucag

SEQ ID NO: 222182 - RNA, 75 nt, hsa
uacaauguucccuuguggccaaauuucccucccagggagcaauuucagugcuaggaucauuggauucaguuccca

SEQ ID NO: 222183 - RNA, 75 nt, hsa
cccagaggucccucugggccacaacccaacccuucucacucuccucagugcuagcacuuuguauuuuuugauacu

SEQ ID NO: 222184 - RNA, 75 nt, hsa
cuuugcccucuggaacuugauuuuuguguaucugagauuuauuaacagugcuaacugcuaaggauacuguuuauc

SEQ ID NO: 222185 - RNA, 75 nt, hsa
ccuuuucucuccuugagcuuuauaaacagauuuguaccugagccccagugcuacacucauccuugcuuuccagcc

SEQ ID NO: 222186 - RNA, 75 nt, hsa
accaggcuucgugggcacagacaccuccugggcugggcagagugacagugcuagaagaccccagagagagggcaa

SEQ ID NO: 222187 - RNA, 75 nt, hsa
gagauucaaaagcugcauuccuuccuccaaaggcccaggacaggacagugcuacccuagauucugugagauucug

SEQ ID NO: 222188 - RNA, 75 nt, hsa
cuugcugaguauucugucacagacaagccuccauuaaagccacagcagugcuacccaccacacacaccuugcugg

SEQ ID NO: 222189 - RNA, 75 nt, hsa
gagccaggaguauggagaucugagaccgugagcagggaagaaagccagugcuaacaugcaaccauuccucacgcc

SEQ ID NO: 222190 - RNA, 75 nt, hsa
gggggugggagugaaugcuaaaagcagaucguccagugcccuuuucagugcuaccggccucucaccaagcagucc

SEQ ID NO: 222191 - RNA, 75 nt, hsa
auuaaucucucugggucucaguuuucucaucuguauuggagguagcagugcuagcucugccuucaggcaugcaau

SEQ ID NO: 222192 - RNA, 75 nt, hsa
ggucaccugugcccuguccagacucgaggcagugguaacacugcacagugcuauguggcuucucuuugaggauuu

SEQ ID NO: 222193 - RNA, 75 nt, hsa
uccugaccacuuguagucccuccgacuucucuagacaucuagucucagugcuagcuuauuuguauuuuuccucuu

SEQ ID NO: 222194 - RNA, 75 nt, hsa
ugauugugaacuuggugccuaauguuccaugucugaaguuugccccagugcuacacguuggaguauaccuaugug

SEQ ID NO: 222195 - RNA, 75 nt, hsa
auaccucaauauaauuccucuaguucugcuucuaaaaucugaggacagugcuagugggaaaauaauuuucaaacu

SEQ ID NO: 222196 - RNA, 75 nt, hsa
uaagugcuuauucaaagacuagguuauuuucaacugggaaaaaagcagugcuaacaggauauuguucugggauag

SEQ ID NO: 222197 - RNA, 75 nt, hsa
ccauauggcugugcagccuugcucuguggcuuuucccagcacaaucagugcuagugcuggggaagggacagucaa

SEQ ID NO: 222198 - RNA, 75 nt, hsa
cgaguuucuacgugguggagggccugguugaggcuggagagaacacagugcuauuugcauuucuguuccauaugg

SEQ ID NO: 222199 - RNA, 75 nt, hsa
uacuuuaagucaucucucgauuauuuguaacaccuaauacaaugucagugcuauguaaauagcuguuauauugua

SEQ ID NO: 222200 - RNA, 75 nt, hsa
ggcaguauacacagcacuacucaagaagccaaagaaacacuugugcagugcuaagugucacaugucugcuuccac

SEQ ID NO: 222201 - RNA, 75 nt, hsa
uuuuauuuuucauuuuuuugcuuauacacucugauuccuauaauacagugcuauaagcuaugcacagaaaauaaa

SEQ ID NO: 222202 - RNA, 75 nt, hsa
ggcccagcccaggccuugggaccuggggguuggugauuugggggacagugcuacacucgucuccacuguuuguuu

SEQ ID NO: 222203 - RNA, 75 nt, hsa
ugcgcugcacccacuaaugugucaucuagcauuagguauaucucccagugcuaucccuccccccucccccgaccc

SEQ ID NO: 222204 - RNA, 75 nt, hsa
uacaugcacacucaugugcaaacccacucagagaugcauuuggaacagugcuacugaaaggcaguagucauuuuc

SEQ ID NO: 222205 - RNA, 75 nt, hsa
cucuccuggcacgaauauaaagcacaucucuuaacugcauggugccagugcuaaugcuucauccuguugcuggca

SEQ ID NO: 222206 - RNA, 75 nt, hsa
agcuaucagauaaggcaaacuacccugcccaucuuuguugccauucagugcuacgcgcugcccaugcugggucaa

SEQ ID NO: 222207 - RNA, 75 nt, hsa
ccacacauacauagaaaaagauuauuauguucugagaaagcuuuacagugcuacugugccuucuauuuaauucuu

SEQ ID NO: 222208 - RNA, 71 nt, hsa
ugccuaagugcuacgugauccucugccgcccagaccucaacagcacagagcacuuccaggccuccauucag

SEQ ID NO: 222209 - RNA, 71 nt, hsa
aucggaagcgaccgcgggcuuuuuugcccuucucuuaguugagcacagaacccucagcucuggugcgggca

SEQ ID NO: 222210 - RNA, 71 nt, hsa
cuuggaaacuaaaaccuaggucuuagguacauccuaaagggagcacagaacccaucauuucacacauaggc

SEQ ID NO: 222211 - RNA, 71 nt, hsa
aggagcuggugacauucugaugcuggaggcaggugacggggagcacagacuuuguguccugcacacugagc

SEQ ID NO: 222212 - RNA, 71 nt, hsa
gccaucaaggagagcagcaaguuuccauuuggcauuagcccagcacagagccaccggaacaucaagauccu

SEQ ID NO: 222213 - RNA, 71 nt, hsa
gaaggauugaaauuaaacccugagccaccguguccuuguagagcacagaguagagaacaacuggcagcuuu

SEQ ID NO: 222214 - RNA, 71 nt, hsa
gcugauucuccagcugcugccccagccuuuccgccuugcacagcacagagguggucaccccagggacagcc

SEQ ID NO: 222215 - RNA, 71 nt, hsa
acaucugauucuuccagccauguuucccagucugaagaacaagcacagauugaugcugaaauggacucuac

SEQ ID NO: 222216 - RNA, 71 nt, hsa
ggugagagaggaguuggccuagagcaggccacugugagcucagcacagaguaggaagaacagugacaucau

SEQ ID NO: 222217 - RNA, 71 nt, hsa
uguaagagaggugagaagugcucccaagcagacacaacagcagcacagaggucuggaggccacacaaaaag

SEQ ID NO: 222218 - RNA, 71 nt, hsa
ccaggcacuacggcuuccucuccagaauguggcuuugccugagcacagacagagucagcauggaaugcucu

SEQ ID NO: 222219 - RNA, 71 nt, hsa
caguggccuuugugaguugucugcaacucagcucuucccccagcacagaucuguuccccuuauccugcaga

SEQ ID NO: 222220 - RNA, 71 nt, hsa
ccccuuccacuuccaucagggcuauuccgcagcuugcagcaagcacagagugugaccucccaggauuugcu

SEQ ID NO: 222221 - RNA, 71 nt, hsa
gggcugggugcagccagcuguccugcagcucuggggagaccagcacagaacugaggaacaucugcaggagg

SEQ ID NO: 222222 - RNA, 71 nt, hsa
ucuuaaauguuguaguauuaauuucaaaacuaaaaaucgucagcacagaguauguguaaaaaucuguaaua

SEQ ID NO: 222223 - RNA, 71 nt, hsa
aaugauagaaguuuccaucuacaauauauguuccuaaauggagcacagauguucaaacuaugcuuucauuu

SEQ ID NO: 222224 - RNA, 71 nt, hsa
agaagcaauauaagugugauugcaagaaugguagaggaccgagcacagaaaucuuagagauuucuuguccc

SEQ ID NO: 222225 - RNA, 71 nt, hsa
uuuuuuuuuucaacuuuuuccuuuaaaggacuccuaaacuaagcacagaagaguuggcgucaucuuaaaaa

SEQ ID NO: 222226 - RNA, 71 nt, hsa
gaccucaguuugcguaugugugguugcucugggaagcccaaagcacagaccuauaucccuuugcagcuugu

SEQ ID NO: 222227 - RNA, 71 nt, hsa
gaggcuagaaucaucuuuccuagugauccugacauuuagacagcacagaaauaaagagcaauaaaaagaac

SEQ ID NO: 222228 - RNA, 71 nt, hsa
uaguaaaaggcagucuauaauuaacugacagaccuaacugaagcacagagaauacaucagacuuaugcauc

SEQ ID NO: 222229 - RNA, 71 nt, hsa
gaccaauccccauggcagacagcgggcuggugaacaggaagagcacagaaucucuguggggcgaugcugca

SEQ ID NO: 222230 - RNA, 71 nt, hsa
uuccgcacaggauuuccuaagacgagagggauuuagccaagagcacagacuuggauuccuucugucccucc

SEQ ID NO: 222231 - RNA, 71 nt, hsa
ugugugugaagugaaccucuaccugaccaugaagaggcaagagcacagacuuacaaggauuucaacuuaag

SEQ ID NO: 222232 - RNA, 71 nt, hsa
acaacucagcuucggggccggugaggggaggggccucccccagcacagaugaggagcagcugggguaggcu

SEQ ID NO: 222233 - RNA, 71 nt, hsa
aagauaaaaguuugaggagaacaaacaggaauucugaauuaagcacagaguugaaguuuauacccguuuca

SEQ ID NO: 222234 - RNA, 71 nt, hsa
uuauggaguaccuacuauaauacaguagcuaacauguauugagcacagauuuuuuuugguaaaacugugaa

SEQ ID NO: 222235 - RNA, 71 nt, hsa
uauuagcugcaagcuuuaccaaguaauuggcaugacaucugagcacagaaauuaaggcaaaaaaccaaagc

SEQ ID NO: 222236 - RNA, 71 nt, hsa
ccgauuuucacauccuuccauguauuuaucuugaagagauaagcacagaagagaaggugcucacuaacaga

SEQ ID NO: 222237 - RNA, 71 nt, hsa
gcguuucacuugugucugcuccuagccugugcucugccagcagcacagacaucugcuccaucagaccucuu

SEQ ID NO: 222238 - RNA, 71 nt, hsa
aaauauuaacauuuuagguuucucuugcagauaugagagauagcacagauggaccaaagguuaugcacagg

SEQ ID NO: 222239 - RNA, 71 nt, hsa
ccgggcugcccccgccagcucuggcuguuuagcuugagggcagcacagaggccccugggacaccuacaggc

SEQ ID NO: 222240 - RNA, 71 nt, hsa
aagcaugugguugcauuggguggcccaggaugacaaugcacagcacagaugccaucauuucccuuuccccu

SEQ ID NO: 222241 - RNA, 71 nt, hsa
uuuuuuuuucuuugaaccuuaaagguucuauuauuaaaagcagcacagauuccacauuuuuauacaugagg

SEQ ID NO: 222242 - RNA, 71 nt, hsa
cuuagcuccugucggguucauuaaggagaaaugugucugaaagcacagaacuauuauuauuuuuuucuuuu

SEQ ID NO: 222243 - RNA, 71 nt, hsa
gcaagaaaggugcaagaaagugagcagucugccugugagugagcacagaugccggggugugugugugugug

SEQ ID NO: 222244 - RNA, 71 nt, hsa
auguccaugcuguguccaaggaggaguagguacauacaaucagcacagauuaauauauguaaaggguuugg

SEQ ID NO: 222245 - RNA, 71 nt, hsa
aaaacaguuuaguagccuucaguuuugugaaaauaguuuucagcacagaaacugacuucuuuagacaaagu

SEQ ID NO: 222246 - RNA, 71 nt, hsa
gcugggucuguucuuacucuuggagggaauucugagaagacagcacagaauuguaaaccuucccuuuugac

SEQ ID NO: 222247 - RNA, 71 nt, hsa
acaauggguagagcacaccgcaugucagucuaugcagcaaaagcacagagacuuaagacuacugaguugug

SEQ ID NO: 222248 - RNA, 71 nt, hsa
ucauuggcaaauaagcauucugucucuuuggcugcugccucagcacagagagccagaacucuaucgggcac

SEQ ID NO: 222249 - RNA, 71 nt, hsa
aaaauuugcccuuaugcacggaacucuguuucuaagugccaagcacagaaagccgcuaaauaaaaucuuug

SEQ ID NO: 222250 - RNA, 71 nt, hsa
caaugaugccuuugaucuggaauuggacauuucucugucagagcacagaggaggcucauaucaccucuucc

SEQ ID NO: 222251 - RNA, 71 nt, hsa
cugugcccaucauucaguccaagugcuuucucugcccagacagcacagaacuccagccccgcuacuuacau

SEQ ID NO: 222252 - RNA, 71 nt, hsa
gugcauaaugucugcucuuguguagcucaggagacaauuccagcacagacacuacaguuaacgcugaacug

SEQ ID NO: 222253 - RNA, 71 nt, hsa
ugucaucuuugccuacugacacccuuguccccacaagcagaagcacagaggggucacuagcaccuugugug

SEQ ID NO: 222254 - RNA, 71 nt, hsa
aggaggcggcuugggauccucugggccaucccuggcccuguagcacagacacauacaaguuccuuggacuu

SEQ ID NO: 222255 - RNA, 71 nt, hsa
gcgguggacagauggguagauguggcaggcaugucaucgacagcacagaagggcuguccugugucccccca

SEQ ID NO: 222256 - RNA, 71 nt, hsa
ggccacuccccagauaccagaccugaggcaauucacuugccagcacagauggccaacccaccuccagauuc

SEQ ID NO: 222257 - RNA, 71 nt, hsa
uugacauucuggagagagacuaucuucuggaguugaguacaagcacagaaacaucuuuacgguggcaucau

SEQ ID NO: 222258 - RNA, 71 nt, hsa
uauugcauauugugaauucauuuuuauuuugaauauaguccagcacagagcuguucaaauuuuuaguucac

SEQ ID NO: 222259 - RNA, 71 nt, hsa
uuaaaauagaguuuucugcaguaugcuuuuagucuaagaaaagcacagauggagcaauacuuuccuucuuu

SEQ ID NO: 222260 - RNA, 71 nt, hsa
caguucucuuaguaagaacuuuagaaguaaucuugauaauaagcacagacagccuaacagcagaggcaacu

SEQ ID NO: 222261 - RNA, 71 nt, hsa
uucugaaucugaaagcccgccucuguccuaaaauacaaacaagcacagacauuaaaccuggauacuauaug

SEQ ID NO: 222262 - RNA, 71 nt, hsa
guuggguguaauuaggugaaaacagcccagguccucccgggagcacagaggggcuaggggcugguccuucu

SEQ ID NO: 222263 - RNA, 71 nt, hsa
uacuuggccagggugucaaagggacaggccuccuuguugggagcacagaagugcuaugggccagaagcccc

SEQ ID NO: 222264 - RNA, 71 nt, hsa
guucagugggaaugcaguggguggggcuguacacacccuccagcacagacuguucccuccaagguccucuu

SEQ ID NO: 222265 - RNA, 71 nt, hsa
cugacccagcaccacuucccagccaggagccccccaggaacagcacagaacagcagggccuggccucuggg

SEQ ID NO: 222266 - RNA, 71 nt, hsa
uacaaguucauaggagcacaauuccuugauucagggaaaguagcacagaaugcaauuugaaaacuacaggc

SEQ ID NO: 222267 - RNA, 71 nt, hsa
uuugagaaacaguauuuugacuaggaccucucuuauuugucagcacagaacugauuaauauguaaugcuac

SEQ ID NO: 222268 - RNA, 71 nt, hsa
augcuucagagcucaugcgcguuacccacgauggcaugacuagcacagagcugaucucuguuucuguuuug

SEQ ID NO: 222269 - RNA, 71 nt, hsa
acuugucaggauuucuccucuucagagagauuuuuuuuuauagcacagauuccuuugccccuuuuaucucc

SEQ ID NO: 222270 - RNA, 71 nt, hsa
cuaacucuugaggucucuaacauaccuugucauagaggaaaagcacagauuauaccuggaugauucaggag

SEQ ID NO: 222271 - RNA, 71 nt, hsa
cuccuggccuugcugaccucagcgguugccaggaaggggugagcacagagugccucuuacgguaguuagga

SEQ ID NO: 222272 - RNA, 71 nt, hsa
guugaaaaauguugcucugggagacuuacugcauugccgacagcacagaugugaaggacaugagacuaaga

SEQ ID NO: 222273 - RNA, 71 nt, hsa
uuagagauccauguguucagguuuagaucauaugacacucgagcacagaagaauaauuucaaggaggucau

SEQ ID NO: 222274 - RNA, 71 nt, hsa
aguucuuuucaacuuauaacacuguauacaguuauuucuaaagcacagaugaaauaaguucugcauauuuu

SEQ ID NO: 222275 - RNA, 71 nt, hsa
uguaaauaggauuuugugcuuucuguaacagugcaugcuucagcacagaaaacucagcauugauuauugua

SEQ ID NO: 222276 - RNA, 71 nt, hsa
uuugagaaauaagguucaaaaaauaagaaugcuaacacuuaagcacagacuagagcuugcuuggguuucuu

SEQ ID NO: 222277 - RNA, 71 nt, hsa
aucucaauugcuuuguaagugaaaaacaugacccagaggacagcacagacuauggccauggcucacauggu

SEQ ID NO: 222278 - RNA, 71 nt, hsa
gaggaacugagaucacagggaaggagauuggaggugauaccagcacagacagacucucaccucuucuccug

SEQ ID NO: 222279 - RNA, 71 nt, hsa
aauuaguugagagcgcuggguugacuaaccucugguaucugagcacagacagagggugcugugggucugcu

SEQ ID NO: 222280 - RNA, 71 nt, hsa
caucucuucucugaggagcucgacggcauaaaucagaagcaagcacagaguuugucagguuugaagccccu

SEQ ID NO: 222281 - RNA, 71 nt, hsa
aacuggaccaccagagaauggacaccauccaggaagaccccagcacagacucacauauggacgaggauggg

SEQ ID NO: 222282 - RNA, 71 nt, hsa
acagcacccaucucuuaguguugccugagacuaaagugcuuagcacagaaccuggugcguaguagaugcuc

SEQ ID NO: 222283 - RNA, 71 nt, hsa
ucagcccugaguggagaccuaucagauuggauugcuggcaaagcacagaaugccuguauaugauguaacug

SEQ ID NO: 222284 - RNA, 71 nt, hsa
uggggcagggaagcuucaugcccacggguucugccagccccagcacagacccaaacuggggcugggccucu

SEQ ID NO: 222285 - RNA, 71 nt, hsa
aaaucuucauuuauucuucuuuuccaauugaacuuucacauagcacagaaaaaauucaaacugccuauauu

SEQ ID NO: 222286 - RNA, 71 nt, hsa
auuuagcaaacuguuuugacaaaugagcaccagugguacuaagcacagaaacucacuauauaagucacaua

SEQ ID NO: 222287 - RNA, 71 nt, hsa
ggcaagaaucaucucguccugcccuuuuguucugcugaaggagcacagagaacauuuguugaaguauaguu

SEQ ID NO: 222288 - RNA, 71 nt, hsa
uucucaauggcuacgugugacuagugcuuaccauacuggacagcacagacacagaauauuuucaucaccac

SEQ ID NO: 222289 - RNA, 60 nt, hsa
ccuggauccucaguaacuaagagcaaccugagcacagacacccucaggguacuccuucuc

SEQ ID NO: 222290 - RNA, 71 nt, hsa
aacuaaauauguuggacguguuccuuuauauauuuaaguucagcacagaaacuuuccuaccuuuuugugga

SEQ ID NO: 222291 - RNA, 64 nt, hsa
ccagcuccaauuuuuuguaaaacagaaguuccagagcacagaaggucaucaucacaagcaaacu

SEQ ID NO: 222292 - RNA, 71 nt, hsa
guauggcaucauuuagggaugccugagauggcaguucaugaagcacagaagauaaagaagaagucuuucau

SEQ ID NO: 222293 - RNA, 71 nt, hsa
aaguuuaauuauauguagagugagaaggcaguuccaguuuuagcacagauuuguuuauguguucagauuuu

SEQ ID NO: 222294 - RNA, 71 nt, hsa
aggaagguaaaauacuaauaaauugcauauuccuugaccagagcacagauuacuuaugcuucuuaauuuuu

SEQ ID NO: 222295 - RNA, 71 nt, hsa
auguuauuuucuucuuguuccauuaagucagaauacaaaucagcacagauauucgaauguuuccaauauuu

SEQ ID NO: 222296 - RNA, 71 nt, hsa
gucuuagauaauaccaugcaaggcaauuaaaucacugugacagcacagaggucagaguuccgucauuuugc

SEQ ID NO: 222297 - RNA, 71 nt, hsa
gaccuaauaauagcccguuucgucucugacccaacagaggaagcacagaucaaaucaccuuggagugguca

SEQ ID NO: 222298 - RNA, 71 nt, hsa
ugggaguucccuucccacuugcucuccgugggaccgggugaagcacagaccuugccaagcuucagguucac

SEQ ID NO: 222299 - RNA, 71 nt, hsa
cauacaaaaauagaaaugugaaagcauuuggugaaagccaaagcacagagucagaagcugccaccuuagag

SEQ ID NO: 222300 - RNA, 71 nt, hsa
gaauuccuggucuuggcagauggcucugggaacagcgagggagcacagaagucguggccugaggcuguucu

SEQ ID NO: 222301 - RNA, 71 nt, hsa
ugcaaguggccauuaccaucucuaaggagagcucugauugcagcacagagcaguggccaggccacccaaag

SEQ ID NO: 222302 - RNA, 71 nt, hsa
cuggaaaggacccaauguaccaguauuuauaccucuaaugaagcacagagagaggaagagagcugcuuaaa

SEQ ID NO: 222303 - RNA, 71 nt, hsa
agcagccacagccaggcuucugucauacagguagaucccgaagcacagagacauaaaaaaggucucccaga

SEQ ID NO: 222304 - RNA, 71 nt, hsa
aggccauguuuugacucauuugguaaccauugccuguaagcagcacagaauuggugccauggauuaucuuu

SEQ ID NO: 222305 - RNA, 71 nt, hsa
uagucuucaagcagauuggagaaacccuugaaaagacaucaagcacagaaggaggaggaggagguuuaggu

SEQ ID NO: 222306 - RNA, 51 nt, hsa
augugguugucuccguuuaauagcacagacuugaaggaguuuaaaaggagg

SEQ ID NO: 222307 - RNA, 67 nt, hsa
cagaaagcugcaguugcugagggggcagugagaguugagcacagaguccuucacaaaccaagaacac

SEQ ID NO: 222308 - RNA, 71 nt, hsa
uugcuuucuggaaaagugucccagcuuagggauaagugucuagcacagaauggggcacacaguaggugcuu

SEQ ID NO: 222309 - RNA, 71 nt, hsa
gacccugggauggcuggauugagcaaugagcagagccaagcagcacagaguccccuggggcuagaggugga

SEQ ID NO: 222310 - RNA, 66 nt, hsa
acuaucugcaguaccagugagccaagccugaugggcagcacagacacagacacacaccgcagggcc

SEQ ID NO: 222311 - RNA, 71 nt, hsa
ugauauuccugucuaaaagaacaacauugucuuucuuuucuagcacagaguuaugcauucaaagaugcaua

SEQ ID NO: 222312 - RNA, 71 nt, hsa
cagaaagacucuuuuagggcauuuuucugacucaugaaaagagcacagaaaaggauguuuggcaauuuguc

SEQ ID NO: 222313 - RNA, 71 nt, hsa
uuuuauacuguuugauaagaaaaguagguccagccuuaagcagcacagaugcgcugguagaugcauaguca

SEQ ID NO: 222314 - RNA, 71 nt, hsa
ccuucucuuuagcuccuggauaugaaaggccaucugcuuggagcacagaaagauauugccauuuuacagcu

SEQ ID NO: 222315 - RNA, 71 nt, hsa
ugccgggaccgggucugacaugccagugccuuccugggcugagcacagauuagagacucucccccuuguca

SEQ ID NO: 222316 - RNA, 71 nt, hsa
gcccuuugaaaccccuuagagagaagcauauauggccacaaagcacagaggcuuagguuugccacaugcag

SEQ ID NO: 222317 - RNA, 71 nt, hsa
gucugauuggcuuguagaauuguuauagacugccgugcauuagcacagauuuuaauugucaugguuacaaa

SEQ ID NO: 222318 - RNA, 71 nt, hsa
aggggagguguuuuugccaucaccaguuucucaggcuggggagcacagaggggaggaggaggacuaaauga

SEQ ID NO: 222319 - RNA, 71 nt, hsa
gaacaaggcauguccccaauuaccauggcaaccuuugccagagcacagaccccagagucuugugguucucu

SEQ ID NO: 222320 - RNA, 71 nt, hsa
gcccuagaagagcgagcccagcagcacagagaagcucugauagcacagaucagcaccaacguugaacagcu

SEQ ID NO: 222321 - RNA, 71 nt, hsa
acacuacuuuaugggcagggcccuagaagagcgagcccagcagcacagagaagcucugauagcacagauca

SEQ ID NO: 222322 - RNA, 71 nt, hsa
cugacagagaauucuuugagguccgcaguagugcuuuugucagcacagacugcuaaucuacaucuugcugc

SEQ ID NO: 222323 - RNA, 71 nt, hsa
ggagacuggcuguaacccccuucacaccuggguuuggcaucagcacagacuacgggaggggcuggcucccu

SEQ ID NO: 222324 - RNA, 71 nt, hsa
auuaaaauaagaauugaaugucaauaugagauauuaaaauaagcacagaaaaucauuggucucuuuguuuu

SEQ ID NO: 222325 - RNA, 71 nt, hsa
uaacugaccuucaguuuacccuucugaaggagcagggacucagcacagaauucacuuuagacggggcugaa

SEQ ID NO: 222326 - RNA, 71 nt, hsa
gucagugacacuaggaauauaauaaagguaacacagcaagaagcacagaacuacucccucuucaucuccau

SEQ ID NO: 222327 - RNA, 71 nt, hsa
uuugugaggugauuuugaaucuuguccauauaggaaaaugaagcacagaauuacucagucuuccauauugu

SEQ ID NO: 222328 - RNA, 71 nt, hsa
cuaaaaugaaguaacacaaucagaaaucccaugugcccauaagcacagauuuuucuuuuucauugaaacuu

SEQ ID NO: 222329 - RNA, 71 nt, hsa
aaugaaacagcuaauuuccauuuugaaaauuaaaagaaaacagcacagagaaguuaaaugcgguguagcaa

SEQ ID NO: 222330 - RNA, 71 nt, hsa
auggguguggauuuagguuauacugggggagaacuuuucucagcacagauucuaugccagcuucuuugggc

SEQ ID NO: 222331 - RNA, 71 nt, hsa
cuucacuugccugugcagcugggcgcugaccuuccagguagagcacagauggcacaaccccgaggcagccc

SEQ ID NO: 222332 - RNA, 71 nt, hsa
cugacuucgccucuuccugcuguaugcucaucccugcacugagcacagauaugacaagcaguagccauggg

SEQ ID NO: 222333 - RNA, 71 nt, hsa
ggcauauuagcaauuagaguuguaugcuauauaauacauagagcacagagcccuuugcccauaauaucaac

SEQ ID NO: 222334 - RNA, 71 nt, hsa
uauauuauacaaacuaaaauguagaugaauuaaccucucaaagcacagaaugugcaagaacuuuugcauuu

SEQ ID NO: 222335 - RNA, 56 nt, hsa
uauuggagacagcuggaugaugaaguagcacagacuccuaugccaucagaauauca

SEQ ID NO: 222336 - RNA, 71 nt, hsa
uuguagagagauggacaaccaaagucagugggacaaacuccagcacagaagccugcgaggaagccuaugga

SEQ ID NO: 222337 - RNA, 71 nt, hsa
augauuuaaaagggaagucuagaguuccuagucucccucacagcacagagaagacaaaauuagcaaaaccc

SEQ ID NO: 222338 - RNA, 71 nt, hsa
uuaacugcauuaagauaaucacguuaaaauuguuacuaugcagcacagaacuucauucuuauaguauucuu

SEQ ID NO: 222339 - RNA, 71 nt, hsa
aaaaagaaaagaaauagaauuaucaagcuuuuaaaaacuagagcacagaaggaauaaggucaugaaauuua

SEQ ID NO: 222340 - RNA, 71 nt, hsa
ucaguaaaaguaaauucauguaauagcaaugcaagcagccuagcacagacuaagcauugagcauaauaggc

SEQ ID NO: 222341 - RNA, 71 nt, hsa
augguaaucuuuaccuguauacagugcagagccuucucagaagcacagaauauuuuuauauuuccuuuaug

SEQ ID NO: 222342 - RNA, 71 nt, hsa
auaaugggaaacaguaauacguacucugagaaaaauugcaaagcacagauaaauggaaauaaacaggaaaa

SEQ ID NO: 222343 - RNA, 71 nt, hsa
ucacucuaccaguguaaacaaacucuaagcuagggcaagacagcacagacacaaguauauacuaaccaggg

SEQ ID NO: 222344 - RNA, 71 nt, hsa
gaggagagcugcugcgcugaccugcagagguugguggucccagcacagagcugugcccaugggcuuguuag

SEQ ID NO: 222345 - RNA, 71 nt, hsa
aucaggagcaucuugggauuuauuaaauuauguaagaagauagcacagauaucgggauauuauugugugaa

SEQ ID NO: 222346 - RNA, 71 nt, hsa
agcgccaccuucuguugggucaguggagaugggugaggaacagcacagagcagcagggaucaucacaugca

SEQ ID NO: 222347 - RNA, 71 nt, hsa
auuaaacuggcuccaucagaagacguugaagggcagugaagagcacagacucugugggcuucuuagauaag

SEQ ID NO: 222348 - RNA, 71 nt, hsa
ggacuugcuucuccugccucuggggaagagagggaagagaaagcacagagcagagaagcagagauguuccu

SEQ ID NO: 222349 - RNA, 71 nt, hsa
acagaggacagcuuccccaucgccuucuggcugcugcagucagcacagagagcggcuuccccaucgccuuc

SEQ ID NO: 222350 - RNA, 71 nt, hsa
acagaggacggcuuccccaucgccuucuggccgcugcagucagcacagagagcggcuuccccauugccuuc

SEQ ID NO: 222351 - RNA, 71 nt, hsa
gugggagccgucagccugugaacugccaggcagcugcaguuagcacagaggauggcuuccccauugccuuc

SEQ ID NO: 222352 - RNA, 71 nt, hsa
guuuauuugccugacguuuacuccuuucuagaugaaaaccaagcacagauuuuaaaacuucuaagauuauu

SEQ ID NO: 222353 - RNA, 71 nt, hsa
aucacugauucaggaagauaguaucucagaaugaccagagcagcacagaaacaagcuacucugacauuaug

SEQ ID NO: 222354 - RNA, 71 nt, hsa
cugcaacugaagaacugcagccaagaccuuaauuccaggaaagcacagaggacaaaguuaauucaaaaaga

SEQ ID NO: 222355 - RNA, 71 nt, hsa
acugcgcccggccaaaaagaacauuuugucaaucugaacagagcacagaacauuuuuucagacugaacaga

SEQ ID NO: 222356 - RNA, 71 nt, hsa
ggaccccaaaaaaccagaacaaguucugugugccuccuuucagcacagaagggagacaucucauuagucag

SEQ ID NO: 222357 - RNA, 71 nt, hsa
uuguauuagcagaauauuguccucauugcauguguaguuugagcacagaucccaaaccuuacggccaaguu

SEQ ID NO: 222358 - RNA, 71 nt, hsa
ggaggugaaugucucugccuccuguaggccucagcagggacagcacagacccucuggcuggggcagcgcag

SEQ ID NO: 222359 - RNA, 71 nt, hsa
cucgacaugccuaugcagccacacagugguaacuugaaggcagcacagaggugagggauuaaaaggaaagg

SEQ ID NO: 222360 - RNA, 67 nt, hsa
agcucguggggauggagugacagccucagucccccucagcacagacaaaagccagcagagcaaagcg

SEQ ID NO: 222361 - RNA, 71 nt, hsa
acaggaaaguuuccagauagguauuguaucauugagaaugcagcacagauagugugggcuucacacuauag

SEQ ID NO: 222362 - RNA, 71 nt, hsa
cuuuaaaugcuguuuuuauagaugugauaugaggcaacacaagcacagacaguugcauagauuuuaauuua

SEQ ID NO: 222363 - RNA, 71 nt, hsa
aggugaggggcacagcaccccuccccggcaucugccagcucagcacagaagacaccgaaugugcaucugga

SEQ ID NO: 222364 - RNA, 71 nt, hsa
cggcagagguuugagugaacccucuuucaaagacaauaaauagcacagaauuguccgugcuucugugaggc

SEQ ID NO: 222365 - RNA, 71 nt, hsa
caggugacuaaggaaaagagcagaagcuccuugguuuaaccagcacagagaaaauaauauaaaucccauaa

SEQ ID NO: 222366 - RNA, 71 nt, hsa
ccuccaggccugcaggggcaaggggcuggcuggagucucagagcacagagguaggagaacugggguucaag

SEQ ID NO: 222367 - RNA, 71 nt, hsa
uuuauaaugugcaucaacaugugaaagcaaucuaggucacuagcacagaggaaguugccaggaagguggcu

SEQ ID NO: 222368 - RNA, 71 nt, hsa
gcccccuccccauguauuccccaccuguguuccguuugaccagcacagaaauauuaaacguccucuauuca

SEQ ID NO: 222369 - RNA, 71 nt, hsa
guauuugauguauucugugauaagagguacuaauaguauccagcacagauuugcuuuucuuugcuagcaca

SEQ ID NO: 222370 - RNA, 71 nt, hsa
uccucauacuugcuggcaucccucaucugguggucuguuaaagcacagauugcugggccgcacccucaggg

SEQ ID NO: 222371 - RNA, 71 nt, hsa
uuucuuaccuugcaacugucagugccuccagccaaaugccuagcacagagcucaguggauuugauucuucc

SEQ ID NO: 222372 - RNA, 71 nt, hsa
cugccuuccugggccagcuuccugcuugcagucacucgcauagcacagagguggggcuucgggcagggagc

SEQ ID NO: 222373 - RNA, 71 nt, hsa
cauuccauagucugucuccucacaucuguuaguauugacacagcacagacaccacaagccaucagguucuu

SEQ ID NO: 222374 - RNA, 71 nt, hsa
ggaccguaggccaugugaugggccugaaguggaggcugcucagcacagagcccuuucuggugccucucgaa

SEQ ID NO: 222375 - RNA, 71 nt, hsa
gcagcuuauggaagucucagcugggcuauccugcccuugggagcacagacaggcuccuagggugcugagug

SEQ ID NO: 222376 - RNA, 71 nt, hsa
uccaggaaauauccauccaugaauuaugccagcaagaaugaagcacagaugaaggcagcgccccucacuug

SEQ ID NO: 222377 - RNA, 71 nt, hsa
ccauguugcuucacucuauccaaagugucacuuggugcauaagcacagaaaucugaaaaauggccauguug

SEQ ID NO: 222378 - RNA, 71 nt, hsa
uuaaggaauaagaggaaaauuauguuaugaagugcaggaacagcacagacccagacgaggggaugcagccc

SEQ ID NO: 222379 - RNA, 71 nt, hsa
cacugcuauggucuugauacauccucaaacuuucccuucccagcacagaggaauauuggcuggcaugcaac

SEQ ID NO: 222380 - RNA, 71 nt, hsa
cccgguagacugaauaucugacgggauuucuauauggacauagcacagaugaaccaaaaauguauuuauau

SEQ ID NO: 222381 - RNA, 71 nt, hsa
gugggagguucacuugaaccugggagguugagguugcagugagcacagaucacaccacugcacuccagccu

SEQ ID NO: 222382 - RNA, 71 nt, hsa
acauaaaaugacagcaaagagacugagagacuguugaucaaagcacagaacagguucaaauaacuuuucca

SEQ ID NO: 222383 - RNA, 71 nt, hsa
accaacaggcguucucagccuccggaugacacaaauaccagagcacagauucaagugcaauccauguaucu

SEQ ID NO: 222384 - RNA, 71 nt, hsa
ccacguacugcacggucguauuucaugagcuuucuguccauagcacagaaacagagcagaaaguaguacaa

SEQ ID NO: 222385 - RNA, 71 nt, hsa
uuuuuuuaaguaaaguuuguagcuccucccaugcccaggaaagcacagaacucaagugugguggccgucug

SEQ ID NO: 222386 - RNA, 71 nt, hsa
aauucagucaguaauaauuuacguguauucuuuuucucuauagcacagaaaacagauaguuaacugaugau

SEQ ID NO: 222387 - RNA, 71 nt, hsa
cauccccaucucaaggccgaaccugugugaaccucaugccaagcacagauauagggcuggcgcaggugcuu

SEQ ID NO: 222388 - RNA, 71 nt, hsa
ugggccggagccucugcccgcagguuucuaugcuguuucuuagcacagaauccagccuagccuuagccgca

SEQ ID NO: 222389 - RNA, 71 nt, hsa
ccagccuugcccucacgcuuacccgagcucccagugugguuagcacagagcucacccaccuugccuggcuc

SEQ ID NO: 222390 - RNA, 71 nt, hsa
uuugugcugccaaccugagauugaaggcagugccucagagcagcacagagaguuggggcccccugagcccu

SEQ ID NO: 222391 - RNA, 71 nt, hsa
caagcaacaugaacaacugaauacagaaaguaacugaaagcagcacagagacugugucgucccuacagacu

SEQ ID NO: 222392 - RNA, 71 nt, hsa
acccccuaggguccccaugggaaagggacaugcaaggaaacagcacagaacacgaggugguccccaugucc

SEQ ID NO: 222393 - RNA, 71 nt, hsa
uauuuuuaagaauauauucuaaguucuguacuucaaauaauagcacagauuuuacaucugauugacauagu

SEQ ID NO: 222394 - RNA, 71 nt, hsa
acagaauucgauggauuccuuuaguuggaguccgcguagucagcacagacagcaguggaaaggacgcucug

SEQ ID NO: 222395 - RNA, 71 nt, hsa
ucucauuaccccuacacaucucuccacggagcccagaccccagcacagauauccacacaccccagcccugc

SEQ ID NO: 222396 - RNA, 71 nt, hsa
agcccccaagcaagucccuucucuagggugucccugaggacagcacagaggcgggacucagagaccccauu

SEQ ID NO: 222397 - RNA, 71 nt, hsa
cagugauuuaacagucuuuccaacuuuucaugauuuuuaugagcacagacuuucaagaaaauacuugaaaa

SEQ ID NO: 222398 - RNA, 71 nt, hsa
uggagaauccugaaaaagacggugcuucaaccagcuugcauagcacagagaauauucuugguuacagaauu

SEQ ID NO: 222399 - RNA, 71 nt, hsa
aaggacgggcccccuacggagaugaaauuuguuuccuggugagcacagaaucagaacaaagaacaauaucc

SEQ ID NO: 222400 - RNA, 71 nt, hsa
gccgcugccagcucugguaacuugguuaccaaagaugccacagcacagaaauaucgaccaacaccucccug

SEQ ID NO: 222401 - RNA, 71 nt, hsa
auuucucuugcuaacagauucagaaaagugucucaaagcagagcacagaguuauuugguguuugcugaaga

SEQ ID NO: 222402 - RNA, 71 nt, hsa
cuguauccugccagugucccuccgucccagggggcugugcuagcacagaccugagaauggggacacagguc

SEQ ID NO: 222403 - RNA, 71 nt, hsa
ggccucuccgguacuaacauccugcgauagcuugucccaugagcacagaagagccucaguagagucaaguc

SEQ ID NO: 222404 - RNA, 71 nt, hsa
aaguuuaugaaaacauucauuugaaaguuccaugcagcuuuagcacagaguugaccaaacacuggcguaag

SEQ ID NO: 222405 - RNA, 71 nt, hsa
uguauccaaauaaugaaucuucggguguuucccuuuagcuaagcacagaucuaccuuggugauuuggaccc

SEQ ID NO: 222406 - RNA, 71 nt, hsa
acuacguuguuguuuucauuucuguuauaaguaaaacuaaaagcacagaauggugggaaaggggcuauaau

SEQ ID NO: 222407 - RNA, 71 nt, hsa
cuugaaaauaaacagucucuuuuuuacaaagccuguguuagagcacagauuuaccuaggcuugaagauuug

SEQ ID NO: 222408 - RNA, 71 nt, hsa
gaguauauguaacaguuuaaaaaaaaaguugguauuuuauaagcacagacaauucuaaugguaacuuuugu

SEQ ID NO: 222409 - RNA, 71 nt, hsa
acaggugcgugcuaccacgccuggccaauuuuuuaaauuuuagcacagaugaggucucacuauguugcccg

SEQ ID NO: 222410 - RNA, 71 nt, hsa
uuuaaaaucauauccagcacaaaaacuauuucuggcugaauagcacagaaaaguauuuuaaccuaccugua

SEQ ID NO: 222411 - RNA, 71 nt, hsa
ugugguuacagugcagacaggccaugugagccaccgcugccagcacagagcguccuucccccuguagacua

SEQ ID NO: 222412 - RNA, 71 nt, hsa
cugccucucuggaaagaggcucuggacagcagaagccuccaagcacagagccuggccccaggccccagaca

SEQ ID NO: 222413 - RNA, 71 nt, hsa
ucugcgggaguguccucgggacacacuuaaaccuuccaaguagcacagaagcccccuccacgucagaggcc

SEQ ID NO: 222414 - RNA, 71 nt, hsa
agugaucaguuauacuguuuucuauagcuacuuuauuuaacagcacagauuucuaugcaccuuuacucuuu

SEQ ID NO: 222415 - RNA, 71 nt, hsa
uuaaagaguagaaaauaagaugaaauauccuaaaauauaggagcacagacauuuaaaauucauaaucaggc

SEQ ID NO: 222416 - RNA, 71 nt, hsa
cuuuucaauggagaagagacaguucacacaauucccugguuagcacagauguggacugagugcuuugucac

SEQ ID NO: 222417 - RNA, 71 nt, hsa
aggugaaaaacuaaaugauguuuuguauuuuucuugccuauagcacagauauucucaaacuuucucagcuc

SEQ ID NO: 222418 - RNA, 71 nt, hsa
uugaauauuuuuugaagguuucagaugaggucaacacagguagcacagauuuugaaucugugugcauauuu

SEQ ID NO: 222419 - RNA, 71 nt, hsa
accagggcaacucuuggaagaaauauauuugcauauugaaaagcacagaggauuucuuuagugucauugcc

SEQ ID NO: 222420 - RNA, 71 nt, hsa
cauucuggcacuacauuugcuuaaauugcuauuuuggcaacagcacagaaaacuaauauuuuuaagcagag

SEQ ID NO: 222421 - RNA, 71 nt, hsa
ucccaggaagaugggcagagacuugaguggcgauuaccuccagcacagagacgugccaggcgguguuggcg

SEQ ID NO: 222422 - RNA, 71 nt, hsa
uacuuggccuuuuaaaguuacuguuauguuuaucuauauugagcacagauaauggcauuauucuuauaauu

SEQ ID NO: 222423 - RNA, 71 nt, hsa
gcaaguugcgauuaauuauuucuggagucaugggaacacacagcacagaggguaggggggcccucuaggug

SEQ ID NO: 222424 - RNA, 71 nt, hsa
uaauguugcacauaaguuuauacagaguggaugaccacacuagcacagaagagaacaacauguauuaaagc

SEQ ID NO: 222425 - RNA, 71 nt, hsa
gagacucagccucugcuggagaaagccacgcccucccugcuagcacagaggccugacugacuuuuuugcuu

SEQ ID NO: 222426 - RNA, 71 nt, hsa
agggacgcuaauucggguacccauuccccaaguaaccagagagcacagagaaaugcuggugaaacuggcca

SEQ ID NO: 222427 - RNA, 71 nt, hsa
gaaguuguuuccaggugugcucaagugccuuccucuagcagagcacagaaagcuagaauacccccagggag

SEQ ID NO: 222428 - RNA, 71 nt, hsa
cggaccaacguugccaugugcguuugcucuguggggaacagagcacagagggugagcgacaugugcagaac

SEQ ID NO: 222429 - RNA, 71 nt, hsa
ccuguuagauauagugcuaaagaggugcuggcaugcuuuacagcacagaucugauuuuuuaaaauguccug

SEQ ID NO: 222430 - RNA, 71 nt, hsa
gcugggcaguguagaccugccaccgugugaagaaaaaugaaagcacagauagccuaagacugcacaggccu

SEQ ID NO: 222431 - RNA, 71 nt, hsa
gcaccagaagaugucugcauuacucauugcuaaaaauguguagcacagaacugcacuaggauuaauuuguu

SEQ ID NO: 222432 - RNA, 71 nt, hsa
ucauugccaguagugccuucaucaguuaagggaggugucccagcacagaucauucucaaaagcgagcaggg

SEQ ID NO: 222433 - RNA, 71 nt, hsa
caguucaaagccaccuuagacaguguggcaaagugggaaaaagcacagauccugggaccaagguucagauu

SEQ ID NO: 222434 - RNA, 71 nt, hsa
agcaagugcugagccucggcauuuccacagacaaggccuccagcacagauggccacaggccucucuauaca

SEQ ID NO: 222435 - RNA, 71 nt, hsa
gggaguccaagggccggugagggaggguauugcccuccgugagcacagagacucuccaugggagggggagc

SEQ ID NO: 222436 - RNA, 71 nt, hsa
aaguagaucauuaugauugagaguaggagaagcuuagagaaagcacagaaucccagauccagcuggugaag

SEQ ID NO: 222437 - RNA, 71 nt, hsa
cuagaagccagucccuccccaccugcccagagcuccaggccagcacagaaauuccugaggccaacgucacc

SEQ ID NO: 222438 - RNA, 71 nt, hsa
uccuccuggccugagcgcagcgccuccacccugcccugcugagcacagacggaggaagccgcuuauccugu

SEQ ID NO: 222439 - RNA, 71 nt, hsa
aaaaauaaggacaccggcagcccuuaguuucacuguuugccagcacagaccuuugaugggugcaggcuuuu

SEQ ID NO: 222440 - RNA, 71 nt, hsa
guuuuaagaaauguaguugauguauccaacaagccagaaucagcacagauaaaaaguggaauuucuuguuu

SEQ ID NO: 222441 - RNA, 71 nt, hsa
acccuaucccuugcauccacuugacuaugaaguuuuuuuaaagcacagauaaauugaauaaucagggcaau

SEQ ID NO: 222442 - RNA, 71 nt, hsa
gcauuuugauacuucagcuguuuguuccugggagaauucugagcacagauuccagaggucacaguaagccu

SEQ ID NO: 222443 - RNA, 71 nt, hsa
ugaccaggucagcugcccuggccuugcaccccucugcaugcagcacagaagggugugaccaugcccucagc

SEQ ID NO: 222444 - RNA, 71 nt, hsa
guucuuuugauaugcaguuuccagcccuccaaugaguccccagcacagaucucaggcuuguggcugggaau

SEQ ID NO: 222445 - RNA, 71 nt, hsa
ccccucucauggggaggaaagagcuuccagggggcgaacgcagcacagaggaagaggccugcuccacuugu

SEQ ID NO: 222446 - RNA, 71 nt, hsa
aaggccagccccgcaucucccacugccaacagcugaagccgagcacagaccucccuuugcacgcuggaaca

SEQ ID NO: 222447 - RNA, 71 nt, hsa
ucuuucagugaagagaaaggaaguacagaaaacaugcagaaagcacagaaaggaaaaccaagguucucaug

SEQ ID NO: 222448 - RNA, 71 nt, hsa
ugcuaucccugcacucaaaaguuuugaaagaaacuaaucacagcacagaaguaccuugauuuaauuuuuua

SEQ ID NO: 222449 - RNA, 71 nt, hsa
agaagugggacucagccauguuggcgcgugauugacauuacagcacagaaaacuguuagugacugguuucc

SEQ ID NO: 222450 - RNA, 71 nt, hsa
uugaguggcagccauucucuccacgugaaccacacgucuggagcacagacaggccucucaaggucauugau

SEQ ID NO: 222451 - RNA, 71 nt, hsa
gcaagagugaucugcauguuuuuuaaccugcuuuuccccauagcacagaccauaagaaacaacaaaugggg

SEQ ID NO: 222452 - RNA, 71 nt, hsa
aguuuucaguuuuuaaugauugccaguggaggggcuucuucagcacagagaccccccacuguguccaggga

SEQ ID NO: 222453 - RNA, 71 nt, hsa
auuuaccaguuagcaaagucuguguuuucagaauuacagugagcacagagguguucauaaaaugggaauug

SEQ ID NO: 222454 - RNA, 71 nt, hsa
ggaccauccucaaaggcacucucaggacagacggcguggggagcacagaggaggcuggcagagcuggggac

SEQ ID NO: 222455 - RNA, 71 nt, hsa
aguuuaauguagauuugccauuagcuuuuucguaaaauaaaagcacagaacagaugugguggugguaugga

SEQ ID NO: 222456 - RNA, 71 nt, hsa
gauuuuaaaaauugaguuaaagaugacuguguaaauguccaagcacagagagcaugcaccugacuuucuaa

SEQ ID NO: 222457 - RNA, 71 nt, hsa
cugcccacucuguaaaugaagggcucaguggagucuggccaagcacagaggcugcugucaggaagagggag

SEQ ID NO: 222458 - RNA, 71 nt, hsa
uccuaucugggcuuccuggagcagaagcagcaacuuguccuagcacagauggccagccccuuagacagagg

SEQ ID NO: 222459 - RNA, 71 nt, hsa
guaguaccuuuuauaucccauuuauagaugggggaaagcaaagcacagagagucuggauaacuuccacagg

SEQ ID NO: 222460 - RNA, 71 nt, hsa
auggaugucaggacuaaaaaaaggcaucacagugagcagugagcacagagggaguuucgaguauaagaauc

SEQ ID NO: 222461 - RNA, 71 nt, hsa
uuuaucuuaccacacacauggguguuucuauuauccuuggaagcacagaccucgggcauccccuuauugcc

SEQ ID NO: 222462 - RNA, 71 nt, hsa
gcgccagccaggccaggagggagugcagagcaugucugccaagcacagagcaucucaguuggacuggacca

SEQ ID NO: 222463 - RNA, 71 nt, hsa
uggcguugaauagauguguauuuccuccccugcagaaaauaagcacagaaaauuauaauguaggugaucgg

SEQ ID NO: 222464 - RNA, 71 nt, hsa
ugaaaauauuuauuuuaaaaauugaaauguuuggaaccuuuagcacagauuugcuuuggugaaggacacgu

SEQ ID NO: 222465 - RNA, 71 nt, hsa
gggccugcugagccggcugcccugggcacccgguuccaggcagcacagacguggggcauccccagaaagac

SEQ ID NO: 222466 - RNA, 54 nt, hsa
guucaucugacauaccuuaauguuagcacagaggacuuauucaaccuguccuuu

SEQ ID NO: 222467 - RNA, 71 nt, hsa
cucaggauucguauuuuuaaagauuuaguuaauaugaacacagcacagauuuguuagaagaaaaaaaauuu

SEQ ID NO: 222468 - RNA, 71 nt, hsa
aagccuuauuguuacaaugcacaguggaggacugcuuauagagcacagaccuuuguauuauaauuuuuaaa

SEQ ID NO: 222469 - RNA, 71 nt, hsa
uggagcaaagucggaaacacagagaagcacggcuuccccucagcacagacccuccagacugggucucagag

SEQ ID NO: 222470 - RNA, 71 nt, hsa
aggacacccuggcccugcugaggcauacagagcuucagcccagcacagaagcaagacaaaaucaguggcuc

SEQ ID NO: 222471 - RNA, 71 nt, hsa
ugagcuccugcgggaguaguuggaaaguuggaaccguguccagcacagaaggaaucugugcagaugagcag

SEQ ID NO: 222472 - RNA, 71 nt, hsa
cacuguaaagccaguuggcuucugugccugacucugugcugagcacagagaaaagucaggugcagucccag

SEQ ID NO: 222473 - RNA, 71 nt, hsa
ggaguaacugguuuuucuuggguggcugaugacauggaugcagcacagacucagccuuggccuggagcaca

SEQ ID NO: 222474 - RNA, 71 nt, hsa
ugcucuaugggaaaaaaacgauuuaccaauuaauauuacucagcacagagaugggggcccgguuuccauau

SEQ ID NO: 222475 - RNA, 71 nt, hsa
aauaaaaaggcaccuauaaaacaggucaauacaguacaggcagcacagagacccccggaacaagccuaaaa

SEQ ID NO: 222476 - RNA, 71 nt, hsa
agaacaggccaucucagcccuacacacuugccauccccuacagcacagaggaagagugaugguggcaugcu

SEQ ID NO: 222477 - RNA, 67 nt, hsa
aggaggcucagcaaagcugaauuaacucaggcagaagagcacagaugugugggauugggggaggagu

SEQ ID NO: 222478 - RNA, 71 nt, hsa
accagcaccucccaccaaccaaccacacccggugggggcacagcacagaccccagagccaggaaccucuca

SEQ ID NO: 222479 - RNA, 71 nt, hsa
accagcaccucccaccaaccagccacacccggugggggcacagcacagaccccagaggcaggaaccucuca

SEQ ID NO: 222480 - RNA, 71 nt, hsa
accagcaccucccaccaaccagccacacccagugggggcacagcacagaccccagagccaggaaccucuca

SEQ ID NO: 222481 - RNA, 71 nt, hsa
aacagcaccucccaccaaccagccacucccgguggggacacagcacagaccccaaagccaggaaccucuca

SEQ ID NO: 222482 - RNA, 71 nt, hsa
ucugucucuccaucuguuugguggggguagagcugauccagagcacagaucuguuucgugcauuggaagac

SEQ ID NO: 222483 - RNA, 71 nt, hsa
ccgaggcugcccgccucuaguucccaaggcguccgcgcgccagcacagaaacagaggagagucccagagca

SEQ ID NO: 222484 - RNA, 71 nt, hsa
uaucagaaacugaaguguguucucauggcacacuucauggcagcacagauauaccucauuuuaaccaauag

SEQ ID NO: 222485 - RNA, 71 nt, hsa
cucccuauuggacuacuaggaggggcuggcagggccuccauagcacagaauugccccaaagccuuguuaag

SEQ ID NO: 222486 - RNA, 71 nt, hsa
caggggcagggacagaccagaccagacccaggagucuccaaagcacagaguggcaaacaaaacccgagcug

SEQ ID NO: 222487 - RNA, 71 nt, hsa
agucuucccaucugaacgauggguccugaggcacagcucugagcacagaggucccuucugccaccuaccau

SEQ ID NO: 222488 - RNA, 71 nt, hsa
ccuucaagggaauuccgaguguccagcacugccguauugccagcacagacggauuuucucuaaucaguguc

SEQ ID NO: 222489 - RNA, 71 nt, hsa
ggugaggugaccacagcugcaguuagggaagggagccauugagcacagacuuuggaaggaaccuuuuuuuu

SEQ ID NO: 222490 - RNA, 71 nt, hsa
cucuuucagguucaacuuucauuugagcagccagaugauaaagcacagaugcccagcacugaaagaguuac

SEQ ID NO: 222491 - RNA, 71 nt, hsa
gaggcgcagaugcccacacagccagcacugacuuguguucgagcacagaacggauauaaucagucuggccu

SEQ ID NO: 222492 - RNA, 71 nt, hsa
auucuauugaguggcagugucauugagcaguauauauauaaagcacagauuugcauuucagaauauuagcc

SEQ ID NO: 222493 - RNA, 71 nt, hsa
gggcuguugucagaauucuacgugauguaagucaagcaccuagcacagaucagucugucaauaaauggcca

SEQ ID NO: 222494 - RNA, 71 nt, hsa
uaaaggauuuggggucucuccuuccuauaagggucaccucuagcacagaggccugagucaugggaaagagu

SEQ ID NO: 222495 - RNA, 71 nt, hsa
gagagcccagccugaugccagaacaaaggacagagaauuuaagcacagaaaucccagaccuguuguucucu

SEQ ID NO: 222496 - RNA, 71 nt, hsa
caccuaaacagaaucagugacccgggugcuuuguggccagcagcacagaaucaaacccgcaucccagcauu

SEQ ID NO: 222497 - RNA, 71 nt, hsa
ccaucguuuuggaagacgagagaaaguugagaagaacacgaagcacagacccugaugugauaaaacauuuu

SEQ ID NO: 222498 - RNA, 71 nt, hsa
uuaaugggcuguguauuaaaugguuuuauuuucaguuuugcagcacagaacacuguugaaauauccauauc

SEQ ID NO: 222499 - RNA, 71 nt, hsa
cuugggagacaggaacuggcgaguucaggugggguggggacagcacagacuguuccaccguugugcauauu

SEQ ID NO: 222500 - RNA, 71 nt, hsa
accccuccaacaccccucugccucuggcucagguugcucaaagcacagauccucucuuaccccguccccag

SEQ ID NO: 222501 - RNA, 71 nt, hsa
gauuuucuccuaggguuauguccaguugggguuuuuaaggcagcacagacugccaaguacuguuuuuuuua

SEQ ID NO: 222502 - RNA, 71 nt, hsa
cccccagccugcgcaugcacccuccucuugcccaaguggggagcacagaggcggagaggaaucccuuacca

SEQ ID NO: 222503 - RNA, 71 nt, hsa
uguaaagccacuggcaucugauuaucuccauuugaacacacagcacagaacaaucauuuaaauguuauuuu

SEQ ID NO: 222504 - RNA, 69 nt, hsa
agcagaaaaguuucagaugagaaaaccugccaaaacuucagcacagaaauagguauuuaaaugcaagug

SEQ ID NO: 222505 - RNA, 71 nt, hsa
aaaaacaaacuauaaacucucuagacugggcugacaguaaaagcacagaauacaaaacccaggggaugggg

SEQ ID NO: 222506 - RNA, 71 nt, hsa
uaagccagcccccgacuggccuggccacacugcucuccaguagcacagaugucugcuccuccucuugaacu

SEQ ID NO: 222507 - RNA, 71 nt, hsa
ccuccagcucccgugacuuggaggggacugugggacugaggagcacagagcagagagcagacucugugcgg

SEQ ID NO: 222508 - RNA, 71 nt, hsa
cagaugggaagacagaagcgccccugagugcuuugucauauagcacagaaguccuccacacugccugggac

SEQ ID NO: 222509 - RNA, 71 nt, hsa
caugauccaaagauauaagaaauuuugauaugucugcaugcagcacagaacuuugaaccuaggaggcaguc

SEQ ID NO: 222510 - RNA, 71 nt, hsa
ucaaagacauucuguuauacugcaugaaguauguuaagcuaagcacagagaaaaaaaggcagcaagacaug

SEQ ID NO: 222511 - RNA, 71 nt, hsa
ucuagacccuuacucagugccuucgauggcacuuucacuacagcacagauuucaccucugucuugaauaaa

SEQ ID NO: 222512 - RNA, 71 nt, hsa
uuucacugaccauacauuuuucuuagccccucaaguaauauagcacagaguuaugaaugacaauuccccua

SEQ ID NO: 222513 - RNA, 71 nt, hsa
ccacgauuucaggaucagucaggaccugccaauguccucucagcacagagaaucaagagguggccuuuggg

SEQ ID NO: 222514 - RNA, 71 nt, hsa
uaggcuaaacuggugcauacuggcauuggcccuugguggggagcacagacacaggauaggacuccauuucu

SEQ ID NO: 222515 - RNA, 71 nt, hsa
agaauuuccacagcaagaauacacuuauuuuaauuaacaauagcacagauauagcauagggcaguggguuu

SEQ ID NO: 222516 - RNA, 71 nt, hsa
aaccugcccugccucuccaucucucaccaaggcugcgucaaagcacagaggcuccccggacucggaggggg

SEQ ID NO: 222517 - RNA, 71 nt, hsa
uugagacugaggagaaugauagagagugaagcagaaacaggagcacagaccucugcuguagcuuuaaugca

SEQ ID NO: 222518 - RNA, 71 nt, hsa
aauaaugaucuuacuuccaaaucuccuuggaauuucacgacagcacagacugacuuuauaccuucauuuca

SEQ ID NO: 222519 - RNA, 71 nt, hsa
gugaguccauguggagagagcacugugugcgcagcggcagcagcacagacguccaugaggaaaacucccag

SEQ ID NO: 222520 - RNA, 71 nt, hsa
gccaaauucccuccucccuucuacugcuucuaccaacuggaagcacagaaaacuagaauuucauuuauuuu

SEQ ID NO: 222521 - RNA, 71 nt, hsa
uagauguucuuuagaagaucuggccauuugguacauaauccagcacagauaagcugggugguaaugauaau

SEQ ID NO: 222522 - RNA, 71 nt, hsa
ccaaugcccacggcuucaucauggaacuccaggacggcuacagcacagagacaggggagaagggcgcccag

SEQ ID NO: 222523 - RNA, 71 nt, hsa
aggauauaaacuuuccacaccuuccugucgugacagauaaaagcacagaaaggacaacccuugaaaucaug

SEQ ID NO: 222524 - RNA, 71 nt, hsa
cuguuacucauuaacuuugcuuauaaugcuuuuuauagcccagcacagaauuuaaagccauaccaccaaaa

SEQ ID NO: 222525 - RNA, 71 nt, hsa
augaaaauggggacaggauaaaagguggcaacuaaauuuaaagcacagaagaaaugauuuccuucuagcua

SEQ ID NO: 222526 - RNA, 71 nt, hsa
uauaugauuauggugggugauuucagauauauaagcagauaagcacagauuauuguccuuucaaguuaaga

SEQ ID NO: 222527 - RNA, 71 nt, hsa
uagguauuuucauauuacucagguaaagauggaaaugacagagcacagacauuuauuuuuuaaauugauag

SEQ ID NO: 222528 - RNA, 71 nt, hsa
aggcaggggaaucuuccugagugacagcuugguuuaaauuuagcacagaacuagaugaguugcacuuuucu

SEQ ID NO: 222529 - RNA, 71 nt, hsa
gguaauuauauauuuauuauuuagcaaaacugaagaaaaaaagcacagaauuguuucaacagaugucucuc

SEQ ID NO: 222530 - RNA, 71 nt, hsa
gcagcacugugcaggacguggaccagcuggagcugcugcccagcacagaggagagucgccgcagaugaccu

SEQ ID NO: 222531 - RNA, 71 nt, hsa
ugcuuauuuuuaugacuauuuauuccaauguuuuaacaagaagcacagagauuuauaguauucuuaauagu

SEQ ID NO: 222532 - RNA, 71 nt, hsa
ucuuggacuccccucuuccucaaggguagaugagaggaacgagcacagagguuggcuguggguccugggua

SEQ ID NO: 222533 - RNA, 71 nt, hsa
ugacaaaacaaauccuguaacuacccagccagcaaguauauagcacagaacacuguguuacuuuacaaggg

SEQ ID NO: 222534 - RNA, 71 nt, hsa
uggaauuugcuagaacuguggaagcuucuacuccugcaguaagcacagaucgcacugccucaauaacuugg

SEQ ID NO: 222535 - RNA, 71 nt, hsa
uuuucaggucugcagaaccauagcuuccacgcaccugaacgagcacagaaugaacugacgguggaagacau

SEQ ID NO: 222536 - RNA, 71 nt, hsa
uuaguagcugcuaucagagacauuauagcacagugguuaugagcacagauuccaaagccagauuaccuagg

SEQ ID NO: 222537 - RNA, 71 nt, hsa
agcaucucacauuauucugguuugaauauguccauaagcccagcacagaaacagcuggauucuucuacguu

SEQ ID NO: 222538 - RNA, 71 nt, hsa
gagaaguuugugguauaaaaaggaaguggggacagauucgcagcacagagucgcuggcauguuucacuccu

SEQ ID NO: 222539 - RNA, 71 nt, hsa
ggggaggcgguggggggugguggggggagcgggugcucacaagcacagagcugccuguugugaaugucccu

SEQ ID NO: 222540 - RNA, 71 nt, hsa
ucugauggugccaggaaagccacuggaauugucacacggcgagcacagagggccggccaccaguccucgau

SEQ ID NO: 222541 - RNA, 71 nt, hsa
gcaaauguagaagaauauauucaaaguuaaaauucaguggcagcacagauuauuuuuaucagagcuguaaa

SEQ ID NO: 222542 - RNA, 71 nt, hsa
ugcguuuuauaauagcuuuuucccuucuguucuguucauguagcacagauaagcauugcacuugguaccau

SEQ ID NO: 222543 - RNA, 71 nt, hsa
ccgcagaugcuucauuuugacccuuggcugcaguggaagucagcacagagcagugcccuggcugugucccu

SEQ ID NO: 222544 - RNA, 71 nt, hsa
ccucccugccccgacaccucgggcacaucgcaugcacucagagcacagagccgggcagacgcagcaccugc

SEQ ID NO: 222545 - RNA, 71 nt, hsa
ccaccccaaaucuuuguauuguccacauucuccaacaauaaagcacagaguggauuuaauuaagcacacaa

SEQ ID NO: 222546 - RNA, 71 nt, hsa
aaaauacucuaauagccuugagugaccaacuuuuuuuuuaaagcacagauguaauugucuaauguucugau

SEQ ID NO: 222547 - RNA, 71 nt, hsa
ggagccugcaggggagcagacuuggugcccagcugccagaaagcacagauuugacccaagcuauuuauaug

SEQ ID NO: 222548 - RNA, 71 nt, hsa
agcagagugcacagcccucguucugccagcuggagccaagaagcacagagacacagaggcgccugccccuc

SEQ ID NO: 222549 - RNA, 71 nt, hsa
gaaguguggucagaggggagcaaugggcuuugcugcuuaugagcacagaggaauucaguccccaggcagcc

SEQ ID NO: 222550 - RNA, 71 nt, hsa
ugcauccucacgugcugccucuuuccugugauauguagacuagcacagagugguacauccuaaaaacuugg

SEQ ID NO: 222551 - RNA, 71 nt, hsa
ucauucagaagaggaacacaaaggaagccacccaggaaggaagcacagagcugggggcucuggaaacgccc

SEQ ID NO: 222552 - RNA, 71 nt, hsa
caagaauguugaugaugaugauauagaauuguggcuuuaguagcacagaggaugccccaacaaacucaugg

SEQ ID NO: 222553 - RNA, 71 nt, hsa
ggcaaaggagcacaaggaaaccaagcagcagaggccccaucagcacagagggccucguuccacgaacguag

SEQ ID NO: 222554 - RNA, 71 nt, hsa
augcacggaggacccccuacccacccuggaaugacuaugucagcacagagccccacaauguuaaauucugu

SEQ ID NO: 222555 - RNA, 71 nt, hsa
caacauauuugaaucaggcugguaauucggguaacccagguagcacagauuuuuaaugacauaucuaaaga

SEQ ID NO: 222556 - RNA, 71 nt, hsa
guccuggggcaaaaugcuauggcauuguaacuaugucuucaagcacagagguguccagguguauugcacau

SEQ ID NO: 222557 - RNA, 71 nt, hsa
acaacaacagaaacagaagagugagaagaaaggagaggaaaagcacagaaacgcuugagcagcccuucccg

SEQ ID NO: 222558 - RNA, 71 nt, hsa
ugcacuuuccgugggugccuuaugugguggugguugugcccagcacagaccuggcaggguucuugccgugg

SEQ ID NO: 222559 - RNA, 71 nt, hsa
caauacagccuccgauccucacucuugaaagcuccaugauaagcacagagaugggcagugugggucagaag

SEQ ID NO: 222560 - RNA, 71 nt, hsa
augagggcagcccagcccccgcacccacccccaaccagagaagcacagaucuuggggagcugccccacaag

SEQ ID NO: 222561 - RNA, 71 nt, hsa
ccauuucccuuugaugcuuugguggccuugccccgcucugcagcacagacaggccagaugcauuuguccuu

SEQ ID NO: 222562 - RNA, 71 nt, hsa
cagagguggcuuuggcccuggcaagauggauuccaggggugagcacagacaggaucgcagggagaggccgu

SEQ ID NO: 222563 - RNA, 71 nt, hsa
aagucuaaaugugucagagaauuuaugugagaaaggacuaaagcacagacacuuucagccuuuauacuaaa

SEQ ID NO: 222564 - RNA, 71 nt, hsa
ggacccugaggcccagagggccugcaagggagugaguugauagcacagacccugcccugugggcccccaaa

SEQ ID NO: 222565 - RNA, 71 nt, hsa
acugcuaaugaaaugggaaccucccccucccuugugguuucagcacagaaccugaaugccaggaaaaauuc

SEQ ID NO: 222566 - RNA, 71 nt, hsa
ugaguuccagagagcugccggaauuccagguuugacucuccagcacagagcagagcuacacagaggugacc

SEQ ID NO: 222567 - RNA, 71 nt, hsa
gccccgggaccagggauggggcagcgcacaggcccgggcccagcacagaacugcccaucgggacgcccggc

SEQ ID NO: 222568 - RNA, 71 nt, hsa
ugucgggagguuagcugcggaaagaaaucgggaugccgcggagcacagagugauuuggaacuccauuccac

SEQ ID NO: 222569 - RNA, 71 nt, hsa
ccugcccuagcugaggcacacagggagacccagugaggauaagcacagauugaauuguacaguuugcagau

SEQ ID NO: 222570 - RNA, 71 nt, hsa
ggaccaccaagagagccagggcugcuguuucgcgacucaccagcacagauuugcucagaaacucugcccaa

SEQ ID NO: 222571 - RNA, 71 nt, hsa
gggugcugacugucaagcauccccuguccccaaguuccaaaagcacagacucaaagggaaaccccccaguc

SEQ ID NO: 222572 - RNA, 71 nt, hsa
cagaggcccccgagguguguguaggaggcggaggcccgcagagcacagagcaggagaagggcuugggcccu

SEQ ID NO: 222573 - RNA, 71 nt, hsa
cucugagcuggugggcaggauggcuggguggcccccagagaagcacagaccugagauggggucuccaugcc

SEQ ID NO: 222574 - RNA, 71 nt, hsa
gccucaggcccagcacccaguuccuccucacauggcaggugagcacagacuucuaguuggcaggagcugag

SEQ ID NO: 222575 - RNA, 71 nt, hsa
cugggcgucuguucuuuaccaaaaccauccaucccuagaagagcacagagcccugaggggcugggcugggc

SEQ ID NO: 222576 - RNA, 71 nt, hsa
agccagccauagguuguuucuuugucuuccggguccuaaagagcacagagaaaauggagguccccagucua

SEQ ID NO: 222577 - RNA, 71 nt, hsa
cuugaagccaaugaauuuuaaucuauagauucuuuaauauuagcacagaauaauaucuuugggucuuacua

SEQ ID NO: 222578 - RNA, 71 nt, hsa
cccugcugugggagagcgaagggggucaaaggaagacuugaagcacagagggcuagggaggugggguacau

SEQ ID NO: 222579 - RNA, 71 nt, hsa
agacaucucugguguucccaccacccuagaugaaaauccacagcacagaccucuaccguguuucucuucca

SEQ ID NO: 222580 - RNA, 71 nt, hsa
acugguuggcccaagcccugccugacugaccacccccucagagcacagaucagggaccucacgcaucucuu

SEQ ID NO: 222581 - RNA, 71 nt, hsa
gucgccuggcuuauucccaugugugacuccagccugcccucagcacagacucuuucagauggaggugccau

SEQ ID NO: 222582 - RNA, 71 nt, hsa
ugucagugucuucugagggcaauugcguugcucaaaucacuagcacagagguuccuuaauuuggggccuua

SEQ ID NO: 222583 - RNA, 71 nt, hsa
cccaauauuuccuuuuggugugagucuggguuguugggaacagcacagaauuuggagucuuaagcucuaaa

SEQ ID NO: 222584 - RNA, 71 nt, hsa
ggccacccgggcugccugccccugcugcuugggacguguacagcacagaaugaguauuuauuuaaauaaag

SEQ ID NO: 222585 - RNA, 71 nt, hsa
uuuuacauuuugaugugucaaaggcuuuuggagugaccaaaagcacagaggcagcggguggggcgccuggg

SEQ ID NO: 222586 - RNA, 71 nt, hsa
aauguuggacaagcagacacacucacacucguccccagcuuagcacagagcuggagcgcccauuucuggaa

SEQ ID NO: 222587 - RNA, 71 nt, hsa
ggcccucucuccaguuuuauccccugccuaaugcugcgagaagcacagaauaaacuuuuugucacucucug

SEQ ID NO: 222588 - RNA, 71 nt, hsa
cgagccacuuguaggcacauuagcuccgcucauguucccugagcacagauaaugucuuuuaauccaaaggu

SEQ ID NO: 222589 - RNA, 71 nt, hsa
uggggccuagaguggaaguggggguggguuaaccucacacaagcacagaucccagacuuugccagaggcaa

SEQ ID NO: 222590 - RNA, 71 nt, hsa
uggggucuguggugagaguccuguaggaucccugcucaagcagcacagaggaaggggcaagacguggccug

SEQ ID NO: 222591 - RNA, 71 nt, hsa
gagccuacaaguggucuggguuagaggcgagccuggcaggcagcacagacugaacucagagguagacaggu

SEQ ID NO: 222592 - RNA, 71 nt, hsa
gggcuggaaguaaggaaacauguaaugauaggcggacucccagcacagaaaaaaagguagaucugaaugcu

SEQ ID NO: 222593 - RNA, 71 nt, hsa
uccuuggguaacagcucccagcaggcccuaagucuggcuucagcacagaggcgugcacugccagggaggug

SEQ ID NO: 222594 - RNA, 71 nt, hsa
agagaagcugaucuuuguuaaugucuugauucuguucgcaaagcacagacuagugcuuaaaaaaaaaaaag

SEQ ID NO: 222595 - RNA, 71 nt, hsa
aggcuuuggguaggacuucggguguucgguccuggucgcagagcacagaucuuuaaagaagcgagagagga

SEQ ID NO: 222596 - RNA, 71 nt, hsa
ucucccucauaauuccagagaagggcauuucugucuuuuuaagcacagacuaaggcuggaacaguccaucc

SEQ ID NO: 222597 - RNA, 71 nt, hsa
ucauucaggcaacgcacaaaacagaaaaugaagguggaacaagcacagauguucuucaacuguuuuugucu

SEQ ID NO: 222598 - RNA, 71 nt, hsa
agugcccacugugaccugccgaaguccacugccuuugccccagcacagaagaggccccugccacccuaggg

SEQ ID NO: 222599 - RNA, 71 nt, hsa
cauuaaaaaaaaaugucacuuaggucagcacucccagacguagcacagaaaaacccuuugacacaaaccau

SEQ ID NO: 222600 - RNA, 71 nt, hsa
cccaaguggcaugcagcccccaugcccaccgggaccuggucagcacagaucuugaugacuucccuuucuag

SEQ ID NO: 222601 - RNA, 71 nt, hsa
gaaguuaggaggcaacuuugggauggugcuagagcauggaaagcacagagaauuggacaaacaggucuuuu

SEQ ID NO: 222602 - RNA, 71 nt, hsa
aaggcagcauucaaauuauauagaaucuaguuuuuaaaaucagcacagaucuucuuaaaaacugugaacua

SEQ ID NO: 222603 - RNA, 71 nt, hsa
agaaucaugguucugcagucugguguagacacuggaauaacagcacagaaaaaucuaugacucccaauauc

SEQ ID NO: 222604 - RNA, 71 nt, hsa
aaaauauccagauguaaaccccaaacuuguacacaaaagaaagcacagauuguuuaccuguuguggauuuu

SEQ ID NO: 222605 - RNA, 71 nt, hsa
uucugccuucuuucuugaguuugcuccuguugacuucccacagcacagauaauugacaugucccuuugugu

SEQ ID NO: 222606 - RNA, 71 nt, hsa
uccuaggggucaggggguggggguuucauuuuccauuccucagcacagagcagaaaugauagauuuuuauu

SEQ ID NO: 222607 - RNA, 71 nt, hsa
gaguuuaagcaggacagugugcgugcacgagcuccgagcccagcacagacaugccuggaacccccgccgcc

SEQ ID NO: 222608 - RNA, 71 nt, hsa
caaguggaugaugagaccaauuacaggccgucucucugcacagcacagaaauucucaaucacugaaaugag

SEQ ID NO: 222609 - RNA, 71 nt, hsa
guguauuggaugauuugggcauuacgaucaccucuuaccacagcacagaacauacauucuucaacagcauu

SEQ ID NO: 222610 - RNA, 71 nt, hsa
gagagauccagagcccuacacuccacgaccugggggcucacagcacagaaccuagaagcaccugcugacac

SEQ ID NO: 222611 - RNA, 71 nt, hsa
gaaauugagcuauaugauuuaucagagaucugauuccaaagagcacagaauacuguucucagaccaugaaa

SEQ ID NO: 222612 - RNA, 71 nt, hsa
ggauccuuugguccuuggaugcuucucagccaaguggcgguagcacagauguggugaacaaugacgaauug

SEQ ID NO: 222613 - RNA, 71 nt, hsa
ugacaugcgggcugggcagcuguuagaguccaacguggggcagcacagagagggggccaccuccccaggcc

SEQ ID NO: 222614 - RNA, 71 nt, hsa
cccgguccugccugucagcuccagguccuggagccacguccagcacagaguggacggauucaccguggccg

SEQ ID NO: 222615 - RNA, 71 nt, hsa
aacucagccgaggugggaaauggugucccugucccucccaaagcacagagcacagaaaugaggccguuuac

SEQ ID NO: 222616 - RNA, 71 nt, hsa
ccgaggugggaaauggugucccugucccucccaaagcacagagcacagaaaugaggccguuuacauggcga

SEQ ID NO: 222617 - RNA, 71 nt, hsa
ccuuuauuuucaggcauagacuccucuguggucacagcuggagcacagagagggacccugggaacuuggcc

SEQ ID NO: 222618 - RNA, 71 nt, hsa
cuguucacugggaucagccagggcgccgggccccacuucugagcacagagcagagacagacgcaggcgggg

SEQ ID NO: 222619 - RNA, 71 nt, hsa
cccugacccgcccucaugggcaccgggcaggcgccucacagagcacagacgugcccucggccuuggucgug

SEQ ID NO: 222620 - RNA, 71 nt, hsa
ugaauuuggagggaagaaguaauggcgcuagugugggacgaagcacagaucccagcacuuuucccagcuuu

SEQ ID NO: 222621 - RNA, 71 nt, hsa
gccgcccacgccggccucugcugcccccuuccccagcccuuagcacagagagggacacaugccccuccccc

SEQ ID NO: 222622 - RNA, 71 nt, hsa
uucaagacuuagacuucccauuuuccucagaaaauccacacagcacagaauauuuauaaaaugucauguuu

SEQ ID NO: 222623 - RNA, 71 nt, hsa
gcacagaagcacaugcaccuacccauacacccccucuucugagcacagauguucccccaucucgcucccuc

SEQ ID NO: 222624 - RNA, 71 nt, hsa
ggggcaaagauuguccccucugcuguucucuggggccgcucagcacagaagaaggaugagggggcucagcg

SEQ ID NO: 222625 - RNA, 71 nt, hsa
agaaauaucuucagaggaagacugccgccauacugaggcugagcacagauuugucuuuuucauugcaucug

SEQ ID NO: 222626 - RNA, 71 nt, hsa
gggggguuagggggagucccccucccucccuuucccccccaagcacagaggggagaggggccagggaagug

SEQ ID NO: 222627 - RNA, 71 nt, hsa
cagaaagaaauaugcauggauucaauaaguauauacaucugagcacagauuauuuuuauagugauuuuugc

SEQ ID NO: 222628 - RNA, 71 nt, hsa
cucaccccucucccacccuccccagggguaaccccaggccaagcacagauagcucagcugcgaccucuggc

SEQ ID NO: 222629 - RNA, 71 nt, hsa
acagcccccagacccuucuugaaacgagagccagcaagcugagcacagaccagcagcgaccucccuuccag

SEQ ID NO: 222630 - RNA, 71 nt, hsa
uuccucuacuacaggaagaagguggcugagauaagaaaggaagcacagaagucgcaggcagccucucagaa

SEQ ID NO: 222631 - RNA, 71 nt, hsa
caccauaugagaaccuuuguauaaaauauuggcauguaaacagcacagacaccguaacacacucugugccc

SEQ ID NO: 222632 - RNA, 71 nt, hsa
ucauccucauccuccuccuccuccacuugcagcgagacggcagcacagaccccuggagguccaggggggcc

SEQ ID NO: 222633 - RNA, 71 nt, hsa
ugucaccaucacuacucaagaccggaggcacagagggcaggagcacagaccccuuaaaccggcauuguauu

SEQ ID NO: 222634 - RNA, 71 nt, hsa
gucaaauuggcauaauccucuugggaagcuguguggaaauaagcacagagaagcagaacucuaauugcuua

SEQ ID NO: 222635 - RNA, 71 nt, hsa
gccuuucauccaucuccacucucucaacugccuaaagucacagcacagauacugcccagugccuuaagagg

SEQ ID NO: 222636 - RNA, 71 nt, hsa
ugcucaauaagcaaaaguggucgguggcugcuguauuggacagcacagaaaaagauuuccaucaccacaga

SEQ ID NO: 222637 - RNA, 71 nt, hsa
ucccagugcccaagggccaccaaccccagggaaacagggccagcacagaggggccuuccucccccacagag

SEQ ID NO: 222638 - RNA, 71 nt, hsa
caaggccggggcucugcguggcuugcugggaggugggcugcagcacagaggccugugacugcguuccagcg

SEQ ID NO: 222639 - RNA, 71 nt, hsa
aacaaaacaaccaaaaaccauguuuuaugucaaagcucuguagcacagagaauguggugucacagauacau

SEQ ID NO: 222640 - RNA, 71 nt, hsa
cuauugcccccagaggccucugaaccccaggcugggaccccagcacagaggcaauaaaggcaguggucccu

SEQ ID NO: 222641 - RNA, 71 nt, hsa
uggugaaugacuggugugccuucuguggccuggacacaaccagcacagagcugucagugguggagaguguc

SEQ ID NO: 222642 - RNA, 71 nt, hsa
ugagcuggguugcacaggaagaaugucacagggaaccaaaaagcacagaaaaaggaagugcuggugcauau

SEQ ID NO: 222643 - RNA, 71 nt, hsa
cuugucuccucccccaucagggcccaccgaaagcucaggggagcacagaagcccauggaagcccagggaga

SEQ ID NO: 222644 - RNA, 71 nt, hsa
agggaagcugggugggguggguguugagacccccucagaccagcacagagaccuguccuugugcagucugc

SEQ ID NO: 222645 - RNA, 71 nt, hsa
aagaugaagcaauaauuuuuaaauuguguaugugcauaugaagcacagacaugcaugugugugugugucug

SEQ ID NO: 222646 - RNA, 62 nt, hsa
aguccuccuccgaggccuaggccgcccccagcagcacagaccccgccgccuccuacggccga

SEQ ID NO: 222647 - RNA, 71 nt, hsa
acacuaguuggaagcucucaauaaaaaugccugcugcucacagcacagaaaauggggcagggggagccuca

SEQ ID NO: 222648 - RNA, 71 nt, hsa
ggcucuugggguccccugagcgucuuccaggguggcuggagagcacagacgcgccagggagcccccucugu

SEQ ID NO: 222649 - RNA, 71 nt, hsa
aaguacuguuaucauccccauuucacaggugaagaaacagaagcacagagauguugauacagacucaagga

SEQ ID NO: 222650 - RNA, 71 nt, hsa
aggaauaagugugcugugagggaagggcugccuuauuuuagagcacagauuuucugaauaucuauuuugac

SEQ ID NO: 222651 - RNA, 71 nt, hsa
aguccuuggaccucccagcccacccagccucagcacagcucagcacagaaggagcagccccagccacagcc

SEQ ID NO: 222652 - RNA, 71 nt, hsa
aacucaaaauucagaagggacucuaccauaucuuagcucagagcacagaggagugccuuauccccacacuu

SEQ ID NO: 222653 - RNA, 71 nt, hsa
ccugccaccaucauucagcagcucccucagcagccacucauagcacagauuccuccuccccaggccuuccc

SEQ ID NO: 222654 - RNA, 71 nt, hsa
cacucaagccuuucuccaccaggccccucaucugaauaccaagcacagaaaugaguggugugacuaauucc

SEQ ID NO: 222655 - RNA, 71 nt, hsa
uguccccaguguuccuagcagagguaugcuuaccagcugucagcacagacccuccugcugccuggguccug

SEQ ID NO: 222656 - RNA, 71 nt, hsa
uggcaauuccaucugguuuugagaaacuuagcagcucacagagcacagagauccugccuucuuccuacuau

SEQ ID NO: 222657 - RNA, 71 nt, hsa
cacagagcccaaaacagaagggggcugccccagcccagcagagcacagaguuucuggagcucccauccaca

SEQ ID NO: 222658 - RNA, 71 nt, hsa
gcagagucugggguagggagacagcgacuuguccaaggucaagcacagagggagagguucaggagucaggu

SEQ ID NO: 222659 - RNA, 71 nt, hsa
aagggcauuuuugguuuuuagcuuguucaaaaacagaggccagcacagaugacauuuuagauacacucuaa

SEQ ID NO: 222660 - RNA, 71 nt, hsa
ggggcccuaccugcaugcccagccuuaccccucauucucacagcacagaugagguugagaccaugcaguca

SEQ ID NO: 222661 - RNA, 71 nt, hsa
uggucucauugggaaagacucuuaauuaagaggcucaggcaagcacagaggcagcccgugggucucugucu

SEQ ID NO: 222662 - RNA, 71 nt, hsa
gcauggcaugguggcagcugugcccccgcccauugcuuuggagcacagaugacucugggggcagagguggg

SEQ ID NO: 222663 - RNA, 71 nt, hsa
agucagaagauuagcaugaaagcaguuuagcauugggaggaagcacagaucucuagagcuguccugucgcu

SEQ ID NO: 222664 - RNA, 71 nt, hsa
augcacaugcccucuuucugggaccaggcuaacucugcagaagcacagacacuacagaccacagcauucag

SEQ ID NO: 222665 - RNA, 71 nt, hsa
gcucugcacgauuucauguuccuaaacccaugucuuagggcagcacagagccaggucaugucaugccccaa

SEQ ID NO: 222666 - RNA, 71 nt, hsa
augagcuucucucuacaacauuucuagaaaauagaaaaaaaagcacagagaaauguuuaacuguuugacuc

SEQ ID NO: 222667 - RNA, 71 nt, hsa
cucccccgccauucaaggacuccucucuuucuucaccaagaagcacagaauucugcugggccuuugcuugu

SEQ ID NO: 222668 - RNA, 71 nt, hsa
aagaaucaaguaugugaauggauggaugaauggaauugugaagcacagaugagcucuuucacacuccaagg

SEQ ID NO: 222669 - RNA, 71 nt, hsa
auaucugaagcauguacucauugucagauguucccucugagagcacagaggaggcaaaagcuucuguggga

SEQ ID NO: 222670 - RNA, 71 nt, hsa
auuuuuaguaaagauuaaauccaaaacuuuacuuuuaauguagcacagaauaguuuuaaugagaaaugcag

SEQ ID NO: 222671 - RNA, 71 nt, hsa
aguaguuaaaaguuuuugucacuaucuucacaaguguguaaagcacagauuucaacagagugcuuggcaua

SEQ ID NO: 222672 - RNA, 71 nt, hsa
auuuacugugucuuugguuugugcuaggcccccgggugugaagcacagaccccuuccagggguuuacaguc

SEQ ID NO: 222673 - RNA, 71 nt, hsa
cucuucucuucugugaucucaguaggccuaaccuauaaccuagcacagacugcuacagcugcuccccuccc

SEQ ID NO: 222674 - RNA, 71 nt, hsa
ggagugaagugugaggacccuuuucccccgcuugcugugaaagcacagauucauugacuacaguacacugu

SEQ ID NO: 222675 - RNA, 71 nt, hsa
uaagcugccaugcauuuuuuuuuuuacaguucucaaggaagagcacagaacaauuucucauuucauauuug

SEQ ID NO: 222676 - RNA, 71 nt, hsa
uggagugcugugaucucgacaacuuacuuucaaagacauaaagcacagaucuccgcacaggggaugugugu

SEQ ID NO: 222677 - RNA, 71 nt, hsa
uuuuuuuccuuccaauuuugugauaaauucaugauguuuacagcacagauaaaacuuugugccauaauccu

SEQ ID NO: 222678 - RNA, 64 nt, hsa
cgccucagcaacaguugugacaguggcugagccuagcacagacccugacagagaccccccucgg

SEQ ID NO: 222679 - RNA, 71 nt, hsa
cauuuaguaagaccaaucagcuuaguguuuauuucuucuacagcacagauucacuggcugggucuccaguc

SEQ ID NO: 222680 - RNA, 71 nt, hsa
gucuuggcccucauccagguaucugguuuuuuuuuguagaaagcacagauaagugguaaauggucuuuuuc

SEQ ID NO: 222681 - RNA, 71 nt, hsa
aguggacuggaggagcugggcccgauuugguaguugaggaaagcacagaggccuccuguggccugccaguc

SEQ ID NO: 222682 - RNA, 71 nt, hsa
agguaucauuccaaccucuauuuuacagaugagaaaacugaagcacagagaaguuaagugacuugccaaaa

SEQ ID NO: 222683 - RNA, 71 nt, hsa
uaccugccuuucacggcugcugacuucucagggcugcaagcagcacagaauguuauccuuacguccugagc

SEQ ID NO: 222684 - RNA, 73 nt, hsa
cgugccacggggaggcuccugcaggaggcucaacccgacggaucacagugaaagggauuccucccacgccaga

SEQ ID NO: 222685 - RNA, 73 nt, hsa
uuguuguuuuuauguucauuugcuggagcgcaagacgugcugacacagugaguuuucucugauguauuuaagg

SEQ ID NO: 222686 - RNA, 73 nt, hsa
gagcugaagagucuugagaggggcugucaucuguagcugccaucacagugaguuggcagaagugacuugagca

SEQ ID NO: 222687 - RNA, 73 nt, hsa
agggacuggagcugcuggaucccaguguggugguguaggaggccacagugagcagguggccccagcuggguuu

SEQ ID NO: 222688 - RNA, 73 nt, hsa
ucgacuuuugugaaugugugacauaaacagauguaaugcaugucacagugacggagauaacacugccaugaua

SEQ ID NO: 222689 - RNA, 73 nt, hsa
cuauucuaccaaauuuuuaauuucuuucuucccuuucuugcuacacagugaucaagaguuucucauagugcuu

SEQ ID NO: 222690 - RNA, 73 nt, hsa
ggcaucuugugacccaguuaaguggauacauaagauuaacuaucacagugacucaguggaauuuuuuguuugc

SEQ ID NO: 222691 - RNA, 73 nt, hsa
aauggaaggcaacacugaauaggaguuaagggaauggcacgaucacagugagagagcugcacucaccugcaga

SEQ ID NO: 222692 - RNA, 66 nt, hsa
ccuuugcaaaugggauuuaaacuaagauaauauaugcacagugaugugcaggaacaacuuccuaga

SEQ ID NO: 222693 - RNA, 73 nt, hsa
aagggaggaagccuggugaauuuagugagcagcuggccugggucacagugaccugaccucaaaccagcuuaag

SEQ ID NO: 222694 - RNA, 73 nt, hsa
uugcagugagccaagaucgugccacugcacuccagccuggcgacacagugagacucugucucaaaaaaacaaa

SEQ ID NO: 222695 - RNA, 73 nt, hsa
uuacugagagucaggcuagaccuguguuuagagaagcaguuuucacagugacuaccauuuccacccaaugaga

SEQ ID NO: 222696 - RNA, 73 nt, hsa
cccaguaagauuguggcaagaccuggcacuccuccaagcuuggcacagugagcccaccagcucagaugguuga

SEQ ID NO: 222697 - RNA, 73 nt, hsa
uuaacuuauugucuaggccagagcgggggugggaggggaaugccacagugaagggaguggcagaaucaaauug

SEQ ID NO: 222698 - RNA, 67 nt, hsa
agucauauaugcacaguuagaccacuccggcggacaucacagugacaagauuaacaagucagagucu

SEQ ID NO: 222699 - RNA, 73 nt, hsa
cuguauuauagcaaguucuuuauuaaagauuuuugaggccgggcacagugacucacgccuguaaccccagcac

SEQ ID NO: 222700 - RNA, 73 nt, hsa
gaagugacuucugagaauuaugcagagucaacauggaucauuucacagugagaugcuuuauggauugaaggau

SEQ ID NO: 222701 - RNA, 73 nt, hsa
uucucaccuuugacagcugaauguuccuaaagaacugcugccccacagugagggugggagcagcggaacaggg

SEQ ID NO: 222702 - RNA, 73 nt, hsa
ucccugagagucucuguuucaucaggacauucugaaauuuacccacagugaggcuguggauggaucaggggac

SEQ ID NO: 222703 - RNA, 73 nt, hsa
aguaucuuguaucgcuguuuacaaaucuugcauggacuccugccacagugaaagaagaaaaucuucaugucuu

SEQ ID NO: 222704 - RNA, 73 nt, hsa
cauguacagaacuuugucuacagcacaaauuaaguuauauaaacacagugacugguauuuaaugcugaucuac

SEQ ID NO: 222705 - RNA, 73 nt, hsa
cggguggaucacgaggucaggagaucgagaccauccuggcuaacacagugaaacguguuuuuacuaaaaguac

SEQ ID NO: 222706 - RNA, 73 nt, hsa
uccaggugggaacaaggccugguaaaguuguuugugucuggcccacagugacucucugugcacgacucaacug

SEQ ID NO: 222707 - RNA, 73 nt, hsa
ggcagaucaccugaagucaggaguucaagaccauccuggccaacacagugaaaccccaucuguacuaaaaaua

SEQ ID NO: 222708 - RNA, 73 nt, hsa
ggcaaaacuucuuuucuaaaagguauagcugagcgguugaaaccacagugaucucuauuuucucccuuugcca

SEQ ID NO: 222709 - RNA, 73 nt, hsa
uguauuuuuauuacuauuuaaacaagugauuaaauuuagucugcacagugagcaaggguucacaugcauucuu

SEQ ID NO: 222710 - RNA, 73 nt, hsa
uaauuugaggugaaauucaguuauaaagucaaggacgaauuugcacagugauauauuucuauguguaugcaag

SEQ ID NO: 222711 - RNA, 73 nt, hsa
cagaucccacuuacucuuuuuuuuuuuuucagagaccacagaccacagugauuuuucuuuucccuuguuuaau

SEQ ID NO: 222712 - RNA, 73 nt, hsa
cuauccuagucuucacaacuuugacguaauuaaauccaacuuucacagugaagugccuuuuuccuagaagugg

SEQ ID NO: 222713 - RNA, 73 nt, hsa
cagcaucucuugaguugccugcaucaguguggaggaagugugucacagugaacaaauccagggagcugauaau

SEQ ID NO: 222714 - RNA, 73 nt, hsa
uggaugaagggugcuguucauuuccauuagauguaugugaaggcacagugaaaauggaaauguucuuggagcu

SEQ ID NO: 222715 - RNA, 73 nt, hsa
uuuuggcaagcucuaucaccaaggagccaaacauccuacaagacacagugaccauacuaauuauacccccugc

SEQ ID NO: 222716 - RNA, 73 nt, hsa
ugaggugggcggcucacgaggagaucaagaccauccuggcuaacacagugaaaccccgucuccacuaaaaaau

SEQ ID NO: 222717 - RNA, 73 nt, hsa
cugaggcuggaggauugcuugaguucaagaccagccugagcaacacagugaaaacccaucucaaaaaaaaaaa

SEQ ID NO: 222718 - RNA, 73 nt, hsa
ugguggggguaugugaagcaaaaggggcaggugcacacaccuccacagugaccucugugcacacgguuaccac

SEQ ID NO: 222719 - RNA, 73 nt, hsa
aucuuaauguuuuugaucguugcguuaaaguggaagugccacccacagugaaaccagaucccauuaauaaaua

SEQ ID NO: 222720 - RNA, 73 nt, hsa
uaauuuauauccauguuuaggcuuuucauaagaugaaacaugccacagugaacacacucguguacauaucaag

SEQ ID NO: 222721 - RNA, 73 nt, hsa
uuggcauauucgggagcuucuuagagggaugagguucuuugaacacagugaaaauuuaaauuaguaacuuuuu

SEQ ID NO: 222722 - RNA, 73 nt, hsa
accugaaagccagcaauuuccugacacugagaaugaagaguaucacagugacgaacaaaaugauacucagaag

SEQ ID NO: 222723 - RNA, 73 nt, hsa
uacuguuccccaacccacaacuaucuuuuaagaagucuuaguucacagugaaaggaaugaugacuuugaaauu

SEQ ID NO: 222724 - RNA, 73 nt, hsa
ccauaauaacccugccagugccagggugggcuggggacucuggcacagugaugccgggcgccaggacagcagc

SEQ ID NO: 222725 - RNA, 73 nt, hsa
agguugugcccuccaccuaccugccggacacagagggggccuucacagugaccaucgcaaccaggauugacag

SEQ ID NO: 222726 - RNA, 73 nt, hsa
guguaaaaugcugaucauuuguuuauuaaaauguguccuauuacacagugaguuaacucucaaugaagucauc

SEQ ID NO: 222727 - RNA, 73 nt, hsa
uucaacaaaaauugguuggucauuaaauauaucauauguuaggcacagugaccugguuauuuucacauguuac

SEQ ID NO: 222728 - RNA, 73 nt, hsa
aaaauucucaaaauacauugguuuauugaaccaauuugcaauacacagugaggaacaaggagaaagcaaugau

SEQ ID NO: 222729 - RNA, 73 nt, hsa
cugcuuccccuguaguccccauuucaguaccaguucugccagccacagugagccccuauuauuacuuucagau

SEQ ID NO: 222730 - RNA, 73 nt, hsa
gcagaccagccuuaacucuggguuugaauccuaaggagauugccacagugagacuuaaggaaauguuugguug

SEQ ID NO: 222731 - RNA, 73 nt, hsa
ucccuguguugcuaagagcugaaaauggcaucuucgugaucaccacagugagcuuggcucgccucggccggcc

SEQ ID NO: 222732 - RNA, 73 nt, hsa
gucacacucaccuggcuccagccuccccuacccagggucucugcacagugaccuucacagcaguuguuggagu

SEQ ID NO: 222733 - RNA, 73 nt, hsa
cggacagaucacgaggucaggaguucgagaccauccuggcuaacacagugaaacccugucucuccuaaaaaua

SEQ ID NO: 222734 - RNA, 73 nt, hsa
aaguugcaagauaaacagcuguaauucggacaaacaugacaaacacagugaagccaacuaucccauaaaauga

SEQ ID NO: 222735 - RNA, 73 nt, hsa
cagacgguaucagaaacagcaaauagauauuccucuacccuuucacagugagugagugaguacagaagaaugc

SEQ ID NO: 222736 - RNA, 73 nt, hsa
uauaagcaggcugggcaggcccagcuuauaaguuaaagggcaucacagugaggguguaguagauaaauucaag

SEQ ID NO: 222737 - RNA, 73 nt, hsa
uuaaaauaacuagcaauuaaucacagcauaucaggaaaaaguacacagugaguucuguuuauuuuuuguaggu

SEQ ID NO: 222738 - RNA, 73 nt, hsa
uuguuuuugauguuaaacaguaaaugccaguagugaccaagaacacagugauuauauacacuauacuggaggg

SEQ ID NO: 222739 - RNA, 73 nt, hsa
guucuuaaagaaaagacuuguuuauguauuaaaaaaaccacuucacagugagucgcuuuggcuuuuugauaaa

SEQ ID NO: 222740 - RNA, 73 nt, hsa
agucugcauaaacuucaucuucaaccuuaaggacuuagcuggccacagugagcugaugugcccaccaccgugu

SEQ ID NO: 222741 - RNA, 73 nt, hsa
ggaguuuugcuugaggccagagguucaagaccagccugggcaacacagugacaccugacucuacuaaaaaauu

SEQ ID NO: 222742 - RNA, 73 nt, hsa
gaucuggcugaagugaacgggccgccuucugcuccagcugcaucacagugauggccaagcugcaucagccgca

SEQ ID NO: 222743 - RNA, 73 nt, hsa
aggaaaauguuucagauguuuauuuguauaauuacuugauucacacagugagaaaaaaugaauguauuccugu

SEQ ID NO: 222744 - RNA, 73 nt, hsa
cuggccacugcugugaccacgacacugcuggggcagcuucuuccacagugaugccuacugaugcuucagugcc

SEQ ID NO: 222745 - RNA, 73 nt, hsa
ggcucucuugaucuccucaaucuggaguccccugcccucaaaacacagugauguucagaacagaacacaaggu

SEQ ID NO: 222746 - RNA, 73 nt, hsa
ugccuccucucucugcucacuucagggcccagugcacucacuucacagugacagcccuccccuacaauccuug

SEQ ID NO: 222747 - RNA, 73 nt, hsa
cccuccccuacaauccuugggcagagcauguggucugagggcccacagugaaagaacagcagugguggcaacu

SEQ ID NO: 222748 - RNA, 73 nt, hsa
gccauggcccuaauugugccugagcuugacuuucagucagggccacagugagcauuaaauuauuauuccauac

SEQ ID NO: 222749 - RNA, 73 nt, hsa
cuuaaugguauccuacugagcauuugcaccucuguucauuucacacagugaaacgcaauuuuaccuaguuugc

SEQ ID NO: 222750 - RNA, 73 nt, hsa
uugcauuuuaaauucucagccaaccuacagccaugaucuuuagcacagugauaucaccaugacuucacagaca

SEQ ID NO: 222751 - RNA, 73 nt, hsa
aaauucugaaaauaauuguaguaguagugauauagucaauggacacagugaaauagagcaaacaccuuuaguu

SEQ ID NO: 222752 - RNA, 73 nt, hsa
uggguggaucacgaggucaggagaucgagaccauccuggcuaacacagugaaaccccgucucuacuaaaaaua

SEQ ID NO: 222753 - RNA, 73 nt, hsa
ugcagugagcugugacugugccacugcacuccagcuugagcaacacagugauacugucucaauaaauaaauaa

SEQ ID NO: 222754 - RNA, 68 nt, hsa
ugcaaugugugaucuugugacaggccugaggcccugggcacagugacgguggccuggccagcccucgg

SEQ ID NO: 222755 - RNA, 73 nt, hsa
guuauacuaacuaauaaugaauauuaaaugauuuuucuucagucacagugagagcaucuugcuuugugguuga

SEQ ID NO: 222756 - RNA, 73 nt, hsa
gauaauguguggagucucauuauggcugagaguuuaguguuuucacagugaagugcagacauuugauuucuuu

SEQ ID NO: 222757 - RNA, 73 nt, hsa
ccgccacccucccacugccaaagaacuuggaaauagugauuuccacagugacuccacucugagucccagagcc

SEQ ID NO: 222758 - RNA, 73 nt, hsa
uuaggggagcugguggccaggggugccccuucaggccugcucucacagugaaaccacuucaagacagggcagg

SEQ ID NO: 222759 - RNA, 66 nt, hsa
cccgugucggccacugcugagccugagagagggggucacagugauagggccacccuggaugggaag

SEQ ID NO: 222760 - RNA, 73 nt, hsa
acuuucugcugacagcugcacacauuacagcugucuccaaacccacagugaugcuuagggaaagacccugcuc

SEQ ID NO: 222761 - RNA, 73 nt, hsa
guagccuaauuuucugggagcagguggagaacuuucccuccuacacagugaggacagucccagucugcuggga

SEQ ID NO: 222762 - RNA, 73 nt, hsa
ggccuacagccacauccccaagcccaccaggugucaggauagucacagugauaccaguucagacacuacccca

SEQ ID NO: 222763 - RNA, 73 nt, hsa
agguaucagcuugcucucuuugcacuuucggggaaggaggacucacagugaggaagcaaaaacugugcacaga

SEQ ID NO: 222764 - RNA, 73 nt, hsa
ggcuucuaagggaauacuguaaacaugacccacuuauauuuaucacagugaaaggcaaaauuauucacucaga

SEQ ID NO: 222765 - RNA, 73 nt, hsa
cugcuguugacucuuccauucaguuuuauuuauuguguguucucacagugacaccauuuguccuuuucugcaa

SEQ ID NO: 222766 - RNA, 73 nt, hsa
aauccucaugaucuacaaaacaaaaucauagugacuaggacuccacagugaagaugguugacuagugacacag

SEQ ID NO: 222767 - RNA, 73 nt, hsa
gaaggcguccacaaaagaggggagaaaaggcgacgaaucaggacacagugaacuugggaaugaagagguagca

SEQ ID NO: 222768 - RNA, 73 nt, hsa
agaccuguuguguauacuucagaguacuuuucaugaguucuuccacagugaacccuuggauuaccugguggcu

SEQ ID NO: 222769 - RNA, 73 nt, hsa
gugggaagcagcauuguccucugggcauguggcucagagguaucacagugacaaaagagccagggcuagggcu

SEQ ID NO: 222770 - RNA, 73 nt, hsa
ucccugucuuucugggguacguuucaaacugaggaagcuacaacacagugaagacccaaggaaggccuaugaa

SEQ ID NO: 222771 - RNA, 73 nt, hsa
uucagaaucuuggcaauugaaguuuagaagguuuggucuacaacacagugaucgaaaaugcauguaaaugccc

SEQ ID NO: 222772 - RNA, 73 nt, hsa
guuuauuuuauccaaguaccccagugaauaggggaaaaauaaacacagugaaaaaaaaaaucaaacaguggag

SEQ ID NO: 222773 - RNA, 73 nt, hsa
uccugccugccuucccauauuggucccuugacauugacaaaagcacagugacugucagcagauuccuuuacuu

SEQ ID NO: 222774 - RNA, 73 nt, hsa
ucauuggcagcucaaagacuuccacccuggagaccacacugcacacagugacuuccuggggaugucauagcca

SEQ ID NO: 222775 - RNA, 73 nt, hsa
caggcggaucacgaggucaggaggucgagaucauccuggcuaacacagugaaaccccaucucuacuaaaaaua

SEQ ID NO: 222776 - RNA, 73 nt, hsa
aggagcgacagauucuccuugaugguacacuuucuaguuuuuacacagugauuuagguccacguuccugauac

SEQ ID NO: 222777 - RNA, 73 nt, hsa
uucaucuguaagcggugguuuguaauuccugaucuucccaccucacagugauguuguggggauccagugagau

SEQ ID NO: 222778 - RNA, 73 nt, hsa
cucauuuuuuuccucaaauuuuaccuacugaggcucaagccuucacagugagcugauggucucuacagggagg

SEQ ID NO: 222779 - RNA, 73 nt, hsa
ugcagucagauuuaugacagcugacaguuuuucagaggucgcacacagugacucuccucucucaggaugacga

SEQ ID NO: 222780 - RNA, 73 nt, hsa
cuaguagagcuuuauguucgcuguccaugaaaccuucuguaaccacagugacuacaaguaguucuuucucuau

SEQ ID NO: 222781 - RNA, 73 nt, hsa
ccaccagccacaccauuauaccagaaggcggaucccccaagaccacagugagagcuuuuucccuuugcuaacc

SEQ ID NO: 222782 - RNA, 73 nt, hsa
ccuuuauuucuaaguggaaaaaguauuagccaccaucuuaccucacagugauguugugaggacauguggaagc

SEQ ID NO: 222783 - RNA, 73 nt, hsa
gcugcauuccauaccucagugaagaagccgaaggaugcugacacacagugauguggagggcauuccggagaaa

SEQ ID NO: 222784 - RNA, 73 nt, hsa
uaggauucaauacuuaguuugcaaaagcacuuugaaauuauggcacagugaguuguuuuggauaagaaaaucu

SEQ ID NO: 222785 - RNA, 73 nt, hsa
aacugaauuggaaaaauagcuccauuuuuuggugcuugggaagcacagugaccaaaaaaguuguauggcugcu

SEQ ID NO: 222786 - RNA, 73 nt, hsa
accccaacaucucccucccacauugucaccauuucaaagggcccacagugacuuuugcugggcauuuucccag

SEQ ID NO: 222787 - RNA, 73 nt, hsa
uuaaaaacccuuaauauuuuaacaaaaauuucuugauuagaggcacagugaaaaagaagucaaaaaaaaaagu

SEQ ID NO: 222788 - RNA, 73 nt, hsa
uuuuaaagugugcuuguguugucaaaaauaucagauaguaauacacagugagcauuuuuaaacaaagggaaac

SEQ ID NO: 222789 - RNA, 73 nt, hsa
aacagaaagagaauguagccauucuagccaccguuaaaagauacacagugagguguuguguuuuguuuuuuua

SEQ ID NO: 222790 - RNA, 73 nt, hsa
uuugaaugauugaauaucuugaaauguugaaauguaaggugugcacagugaucuucaacuuaacaaacacuua

SEQ ID NO: 222791 - RNA, 73 nt, hsa
uuuaggaucuccauggugggaaggaaggcaggcccuuccuauccacagugaaccugguuacgaagaaaacuca

SEQ ID NO: 222792 - RNA, 73 nt, hsa
ugcacaagugauuucaggugcaauucugauuagccugcguccacacagugaucgaugauccuaugugccuaga

SEQ ID NO: 222793 - RNA, 73 nt, hsa
uuuugcagacaguagagggagauuuuguaacaagggcuuguuacacagugauaugguaaugauaaaauugcga

SEQ ID NO: 222794 - RNA, 73 nt, hsa
gcagagucucagcaugaucaguccugauugaauuucauuaugucacagugaugcaugucuuagcacugauuau

SEQ ID NO: 222795 - RNA, 73 nt, hsa
ucugaucaguguugcaaaaaauugcuacuuugagauuuauuuccacagugauauauuaaacccaaaaggaauc

SEQ ID NO: 222796 - RNA, 73 nt, hsa
guacuuuagcuauuguuugccugcacauacauguuguaauaugcacagugauuacaaccuuuaaagcaagagg

SEQ ID NO: 222797 - RNA, 73 nt, hsa
gcuuagggcaguucagaacccacuuguuucccuaucagagggacacagugaaguggagguuaaaguaaauuac

SEQ ID NO: 222798 - RNA, 73 nt, hsa
ggagguggaagcaaauuaguuuacauggcauguccucccuaggcacagugacagcuguaaaguaugacggaac

SEQ ID NO: 222799 - RNA, 73 nt, hsa
ucuuuuauacugaaaaaacacuuaaaguaguuuuguguggcaucacagugauuugucaugaaaagccauauau

SEQ ID NO: 222800 - RNA, 73 nt, hsa
uacacuuggagcuaggaaaccaaagcaagcuuugugaaacuggcacagugauagagaauugcuguggagaguu

SEQ ID NO: 222801 - RNA, 73 nt, hsa
agucagcagccgcuauuaccguaucuuacaauuuaauuacauacacagugaauugaaaccauugugcaaaaug

SEQ ID NO: 222802 - RNA, 73 nt, hsa
ccguuaagaagaccuuggauguuguuccaguuaugcuggauuccacagugaaaucauuuaaaaccaucuaaau

SEQ ID NO: 222803 - RNA, 73 nt, hsa
uuucucacccgcaacuugagccaggacagcugguccaaguggccacagugauggguuuaaguaccuugguagg

SEQ ID NO: 222804 - RNA, 73 nt, hsa
uaaaauuaagcaaguggaacauaugcccuuugccucugcucugcacagugaaaugaaaagucaaccuuugaac

SEQ ID NO: 222805 - RNA, 73 nt, hsa
ugagguguaugaggagagaugguuuucuccugcucagcucuuacacagugauagguuuguuccaugggacuua

SEQ ID NO: 222806 - RNA, 73 nt, hsa
caguuggcgguagcagcuacuccgagcgccguuuacaguuuugcacagugaucuuccccauuguccacucaag

SEQ ID NO: 222807 - RNA, 73 nt, hsa
cugggccaggacacguggggugccugggacgcugcuugccaugcacagugaucagagagaggcuggggugugu

SEQ ID NO: 222808 - RNA, 73 nt, hsa
uugcuguucagugcuuuuuccuuuucaucuguuguucuguggucacagugaccuuagcuacauagcagacuuu

SEQ ID NO: 222809 - RNA, 73 nt, hsa
ucagucuugaugaacaucuguguacccuagaauuuccucuauacacagugaaaagugucaagauaacaaaaaa

SEQ ID NO: 222810 - RNA, 73 nt, hsa
ucauuuuguuguucauugugcaguauguauauagcauaauauacacagugaauuauaggucucaggcuuacuu

SEQ ID NO: 222811 - RNA, 73 nt, hsa
uugcagugagcugagaucaugccacugugcuccagccugguggcacagugagacuccaccucaaaaaaaaaaa

SEQ ID NO: 222812 - RNA, 73 nt, hsa
gagaauuaacaaugucuaggucacauccccuuuuuguguucaacacagugaagauuaucugcuuuuuaaauua

SEQ ID NO: 222813 - RNA, 73 nt, hsa
gacaaugagcgugugauccauuaccaagucuccucaugaaaaccacagugagucagcccuucacagaacuacu

SEQ ID NO: 222814 - RNA, 73 nt, hsa
auuuaauuauucaguuuuuaaagggaaaaagggcgugagcucacacagugagcuguuuauuuaaauaucauua

SEQ ID NO: 222815 - RNA, 73 nt, hsa
uggguggaucacaagguugggagauugagaccauccuggcuaacacagugaaacccugucucuacuaaaaaaa

SEQ ID NO: 222816 - RNA, 73 nt, hsa
aaauagagacuauucuuuuagagacuacucaagugaaugcacacacagugaaaauucucggaguugugagaac

SEQ ID NO: 222817 - RNA, 73 nt, hsa
ggcacauuuuuuaccuggugguuaugagcauggacuugggggccacagugacugaguuugauucccgacacag

SEQ ID NO: 222818 - RNA, 73 nt, hsa
aucauucaguugcacccauggggaagauuguguuacugcccuucacagugaaaaaaagaaaaaucuuucauuu

SEQ ID NO: 222819 - RNA, 73 nt, hsa
cucuguguucauacgccccagauaugugaguuacaugagauggcacagugauaaagccccauuuagugaccuu

SEQ ID NO: 222820 - RNA, 73 nt, hsa
agaccaccacuucgaaaccugggauucaggaauguguggccugcacagugaagugcuggcaaccacuaagaau

SEQ ID NO: 222821 - RNA, 73 nt, hsa
ucugucuuugugggaggguaagacaauaugaacaaacuaugaucacagugacuuuacaggagguuguggaugc

SEQ ID NO: 222822 - RNA, 73 nt, hsa
ugcagugagccaagaucgugccauuccacuccagccugagcaacacagugagacccuaucucaaaaaaauaau

SEQ ID NO: 222823 - RNA, 73 nt, hsa
cauggguuucaacacguuuuguauuaaauauauuuucaaaguccacagugauuuuucuaaacgcuuacagauu

SEQ ID NO: 222824 - RNA, 73 nt, hsa
gcccucaugaguuccaauguugugugaagacaggcagaugcugcacagugaauugcagaugauauuacagaag

SEQ ID NO: 222825 - RNA, 73 nt, hsa
auccgaguggcacuggcagagaaggauaggaguggaaugcccacacagugaccaacagaacuggucugcgugc

SEQ ID NO: 222826 - RNA, 73 nt, hsa
ucaccucccugggcagcgagacgcaguugcucugggaagaugccacagugaccagggccauggccggucccuc

SEQ ID NO: 222827 - RNA, 73 nt, hsa
caagcugaacgcacccgcugguuguggaccgucugccaggcaccacagugagcauuguguucuuggcauguga

SEQ ID NO: 222828 - RNA, 73 nt, hsa
cuaauagauuuguaaggcuauuaauuugaagcaacuccuugcucacagugauucuugcuucucugagaccugc

SEQ ID NO: 222829 - RNA, 73 nt, hsa
ucuuuucuuguagaacauuucaaacauacauaaaagagaagagcacagugaacccccauguacuccauguagc

SEQ ID NO: 222830 - RNA, 73 nt, hsa
cuuucuauacaggagauuggaaucuacuuugucauuuauccaccacagugacaaaggaaaaguggugccguua

SEQ ID NO: 222831 - RNA, 73 nt, hsa
cuccuccuaccccucaggauagagagagaagacacacuugggacacagugaagacaguaacuuggaacugacc

SEQ ID NO: 222832 - RNA, 73 nt, hsa
gcaagagaauuucaaggcaggggauuuuaucccccaccaaaaacacagugaaaggccugcuuuugugucccau

SEQ ID NO: 222833 - RNA, 51 nt, hsa
cauccccugccuggaagugaccacagugagagcugccuuauauuccuacau

SEQ ID NO: 222834 - RNA, 73 nt, hsa
uugaguuuuuaguuugagaagcuggaaagagagagaagggccucacagugauggguucaggacgggucaaagg

SEQ ID NO: 222835 - RNA, 73 nt, hsa
cacccauguuagccacaagaagagguuggcuguuuaugguuugcacagugacuuuguuuuuaucugugcucag

SEQ ID NO: 222836 - RNA, 73 nt, hsa
cagugauucccuccucccgucacuccacgcagcuggcagagagcacagugaucaccagcgugagugguggagg

SEQ ID NO: 222837 - RNA, 73 nt, hsa
gugaaaauuauuuuggaaauugagucugaagcacucucgcacacacagugauucccuccucccgucacuccac

SEQ ID NO: 222838 - RNA, 73 nt, hsa
uuuuauuugauuaggauugaacaguucaguuguaucuaugccccacagugaccaguaaaguccaauuaaaaua

SEQ ID NO: 222839 - RNA, 73 nt, hsa
ggggacuccgcacaugccugugaugucacaguuacugucaguucacagugaaccuucccuccuuuuccuguug

SEQ ID NO: 222840 - RNA, 73 nt, hsa
agcaguguacugagauguggcuggcugugccaucgucauagugcacagugacuuuucuguuucuuaucacuaa

SEQ ID NO: 222841 - RNA, 73 nt, hsa
caacagggacacuuuuuaaaaacacucuuaucagccugggcaacacagugagacuccaucucuuaaaaaaaaa

SEQ ID NO: 222842 - RNA, 73 nt, hsa
uugacuagacuucccaaauaauuuuaauauauacuuuuagacccacagugaaaccacagaaggucauauuuug

SEQ ID NO: 222843 - RNA, 73 nt, hsa
uggcuggagcuagaauuugauaugugaacaguuguguuugaagcacagugaucaaguuauuuuuaauuugguu

SEQ ID NO: 222844 - RNA, 73 nt, hsa
uugacacgugguguaauaaaauggacaaauucuguagaguagacacagugaguauguggaccucuuuuauaag

SEQ ID NO: 222845 - RNA, 73 nt, hsa
uacguuuauugccucgucuuauucacugaccuuuguaaugauacacagugaauucuuuuugacaaagagaaau

SEQ ID NO: 222846 - RNA, 73 nt, hsa
acucguggaaagggaaaggggaggagaugggacuuugaccacacacagugaugccucacacccugaagguggg

SEQ ID NO: 222847 - RNA, 73 nt, hsa
cuaccuccacucaugucccauuuuagccaagcuuauuuaagaucacagugaacuuaguccuguuauagacgag

SEQ ID NO: 222848 - RNA, 73 nt, hsa
gacaugagucuuggagguucugaaugauuuuauugcuaauuaucacagugacauagacuagaacagaaauuag

SEQ ID NO: 222849 - RNA, 73 nt, hsa
gcaugugcagucccagcuacucaggaggcugaggcaggaggaucacagugaccuauaaugagccguugugcuc

SEQ ID NO: 222850 - RNA, 73 nt, hsa
uuuauagaggguuuacacaaagugccacuuauuaaagagcuuccacagugaagauggagaaggugaacuugcu

SEQ ID NO: 222851 - RNA, 73 nt, hsa
caacuuuugcuuauaacuacaauuuaauuucacguugacaaaacacagugaaaagacaacuuugugaagaucu

SEQ ID NO: 222852 - RNA, 73 nt, hsa
ggaggaucguuugagcccaggaguugaagaccagccugggcaacacagugagacuucauuucuacaaaaauua

SEQ ID NO: 222853 - RNA, 73 nt, hsa
cauugugucacaugggcugccaggcucagcucccagcugcguccacagugaccuggaucaggguggggacaag

SEQ ID NO: 222854 - RNA, 73 nt, hsa
ccauuucuccacagagaccccauuuaaauaacacaaaauugaccacagugauuagaugaaaaaauuauuugua

SEQ ID NO: 222855 - RNA, 73 nt, hsa
aauacuuuguuuuuaguuuuuuccuccuuuccauccuguuaaccacagugaaacgcugcaguauuuugauuug

SEQ ID NO: 222856 - RNA, 73 nt, hsa
gaguaguccccaguuauuaugaaaccaccaauaacccacugaccacagugagaaccacugauuuuuuccacug

SEQ ID NO: 222857 - RNA, 73 nt, hsa
ugcagugagccgagaucacgccauugcacuccagccugggugacacagugagacuccaucucaaaaaaaaaaa

SEQ ID NO: 222858 - RNA, 73 nt, hsa
ccacgacagcugugccuacgacuaucuggaggugcgcgacgggcacagugagagcagcacccucaucgggcgc

SEQ ID NO: 222859 - RNA, 73 nt, hsa
uuccaggucccccagggcuuccucccacagcagcugugaauggcacagugaccuuccugcagcguggagaugg

SEQ ID NO: 222860 - RNA, 73 nt, hsa
gauuuacuccacuuuuuaugccuuccauugugaugacgucaaacacagugaaagccuucagucaugcuauggg

SEQ ID NO: 222861 - RNA, 73 nt, hsa
uugacuuuuaagaaaaacaugucacuaaccugaagcucagccacacagugacuuuuaagguuuuauuuagacu

SEQ ID NO: 222862 - RNA, 73 nt, hsa
ugcgcugcggaggacaggaagcacccccucaauagccagcacccacagugagcugagcacuuacagcaacaau

SEQ ID NO: 222863 - RNA, 73 nt, hsa
gggggaugauggaggugacaucaggcagaggagagugcagccucacagugacuuucucagaggugacagagau

SEQ ID NO: 222864 - RNA, 73 nt, hsa
gguggauugcuugagcucgggaguuugagaccagccucaucaacacagugaaacuccaucucaauuuaaaaag

SEQ ID NO: 222865 - RNA, 73 nt, hsa
ggaggggcagccugugccugccuuugugucagaaaaaggaaaccacagugagccugagagagacggcgauuuu

SEQ ID NO: 222866 - RNA, 73 nt, hsa
uugguagcugguguugaauagggccuuugagaaucagacugaacacagugaaauaugugcccaaaguucagaa

SEQ ID NO: 222867 - RNA, 73 nt, hsa
uacccacugguuuccccaacaggcugcguaagggacccugagccacagugaguuggucaaaugcuccugacag

SEQ ID NO: 222868 - RNA, 73 nt, hsa
agacagggguggaauucgucuucugggaggaagcuggagagagcacagugaaauugaaauacccauucccaga

SEQ ID NO: 222869 - RNA, 73 nt, hsa
aacacucacugccugcagcugagauuccagaacgcccuguguccacagugauuagccucgucuuucagcgagc

SEQ ID NO: 222870 - RNA, 73 nt, hsa
ggguuguuggccugaagaugccccguuauugucuuuuuggagacacagugaacacugcuucucgaauggaguc

SEQ ID NO: 222871 - RNA, 73 nt, hsa
uaaucagcacugaauucagaggguuugacuuuuucaucuauaacacagugacuaaaagaguuaaggguauaua

SEQ ID NO: 222872 - RNA, 73 nt, hsa
ccugagucugacccauggacaccuguuucauucacuuuagcaucacagugaccuuuguaugcucuguucaguc

SEQ ID NO: 222873 - RNA, 73 nt, hsa
cagcuccuggaagcugaguuacagaguaauuaaaugggguguucacagugacuuggauacaccaauuagaaau

SEQ ID NO: 222874 - RNA, 73 nt, hsa
gagauaccagcaaugugugcacagaacaaagaccaggagaggacacagugagaaggcaguuaucugcaagcaa

SEQ ID NO: 222875 - RNA, 73 nt, hsa
ccugaaccugcccauggagacaguuguggugaggguugccacacacagugagggcggagcaggguggcugagg

SEQ ID NO: 222876 - RNA, 73 nt, hsa
augagguguacggaugagugaccugcacuaagaagugaguugccacagugaaaauggguugguuuuugucuuc

SEQ ID NO: 222877 - RNA, 73 nt, hsa
accuaaauguucccuucucaggaauucugucucaucaguucuucacagugagaaaagaggcuagaugauggug

SEQ ID NO: 222878 - RNA, 73 nt, hsa
ccuuccauuccucagcugaaagaacaucucaggaagcacuggacacagugauucugcagagccugagcugcug

SEQ ID NO: 222879 - RNA, 73 nt, hsa
caaagcuauguaagagaauaaaugccauuguuuuaaggaaauacacagugaaguuuuuaggaaauacacacua

SEQ ID NO: 222880 - RNA, 73 nt, hsa
uuucuuaauuggccaaauauaaguuggugucguaacuccaggccacagugaguuaugggcaaagcuuuuuucc

SEQ ID NO: 222881 - RNA, 73 nt, hsa
cugguguacauauguccgcugggugaguugaccuguggccucgcacagugauucugggcccuuuaugcuugcu

SEQ ID NO: 222882 - RNA, 73 nt, hsa
caaguugcucccucuccagggagcgcauagauacagcagagcucacagugagucagaaagucuccacuuucug

SEQ ID NO: 222883 - RNA, 73 nt, hsa
guaacaguccagugggggugcuucugcuuggcagguugguucacacagugaugcagggacucagcuccuuuca

SEQ ID NO: 222884 - RNA, 73 nt, hsa
ugcagugagccaagaucacggcacugcgcugcagccugggcaacacagugagacccugucaaaaaaaaaaaaa

SEQ ID NO: 222885 - RNA, 73 nt, hsa
auaugccccuuuucuuauaaaaacaaaaaaaaaaauaaugaaacacagugaauuuguagaguggggguauuug

SEQ ID NO: 222886 - RNA, 73 nt, hsa
acuuuaugccggaugugcuuuucuccaauaucagugcucgagacacagugaagcaaauuaaaaaaaaaaaaaa

SEQ ID NO: 222887 - RNA, 73 nt, hsa
uucauuuauguuugcugaccuguggagaccagucuuucugacacacagugaagcucaacuugccuccuggcug

SEQ ID NO: 222888 - RNA, 73 nt, hsa
ugggcggaucacgaggucuggaguuugagaccauccuggcuaacacagugaaaucccgucucuacuaaaaaua

SEQ ID NO: 222889 - RNA, 73 nt, hsa
guaaucaagccaauggccuuugucaggaagggaaggggcucaacacagugauggacugauccagauggcuccc

SEQ ID NO: 222890 - RNA, 73 nt, hsa
gacaguuccucugugucacugacacaggaaaucauuucuaggacacagugaucagggaagggugccugggacu

SEQ ID NO: 222891 - RNA, 73 nt, hsa
uuccacaaaaccaaaauccauguugaacaaaguuaaguccguacacagugacuuuuugggugagccgugugug

SEQ ID NO: 222892 - RNA, 73 nt, hsa
gaguuaucuaagaauacagcuuucugaccuucagcucacgcuucacagugaucgaugauucaggugcagagga

SEQ ID NO: 222893 - RNA, 73 nt, hsa
aauucucggauauagggauucaaaagacaggacacagaacuaacacagugaaaaaaaucaguaccacauuugg

SEQ ID NO: 222894 - RNA, 73 nt, hsa
accaggggcagcucccgagggcacugugaaggcucccaugccacacagugagaacuguagccucugcguccaa

SEQ ID NO: 222895 - RNA, 73 nt, hsa
gggcaauggcuugagcccaggaguucgacaccagccuggccaacacagugaaaugugucucuacuuacaaaaa

SEQ ID NO: 222896 - RNA, 73 nt, hsa
uguaacuguuaauucagugaaaguuuguuagguuacaugguuacacagugaggugaggugagguagcaagaag

SEQ ID NO: 222897 - RNA, 73 nt, hsa
uaaguaguuuaaguauguuaaauguggaucuuuuacaccacaucacagugaacacacuggggagacgugcuuu

SEQ ID NO: 222898 - RNA, 73 nt, hsa
gaaagggaaaugcuuuucugcagaggccccugcuugggcaguucacagugagaccgacccccucugaauauga

SEQ ID NO: 222899 - RNA, 73 nt, hsa
uccugcccaggagaggggcuguggggccccaggauaaaacagacacagugacagggccaagagccagcacugc

SEQ ID NO: 222900 - RNA, 73 nt, hsa
cuuggaaagugugggcagccacagaugcccccaaaucagagcucacagugagugagccccuaagcuucagucu

SEQ ID NO: 222901 - RNA, 73 nt, hsa
aaaccugaaaauauggauggaugucaggacuaaaaaaaggcaucacagugagcagugagcacagagggaguuu

SEQ ID NO: 222902 - RNA, 73 nt, hsa
auacugccgucuaggagaaccuguggucacugggaacgugccccacagugacuggccaugcaaccaggugauu

SEQ ID NO: 222903 - RNA, 73 nt, hsa
ccuccuccuaaccaagccggauaugguauggcaaguuaccaaacacagugagccgggacucuaaaaaaaaauu

SEQ ID NO: 222904 - RNA, 73 nt, hsa
uggaaugaccuccuucagauaucgugccucuuagugccaaacccacagugagaccaaaagugucagguguuuu

SEQ ID NO: 222905 - RNA, 73 nt, hsa
agccuggcacaggacugauucugggaugcuccuaguuugaccucacagugacccuucccaaucagcacugaaa

SEQ ID NO: 222906 - RNA, 73 nt, hsa
agucuuggcugagaucaaagggaugagcaacagggacuucugccacagugacaauggaauuguguugugccuu

SEQ ID NO: 222907 - RNA, 73 nt, hsa
agccaaggagucagauggcaauggguacuccagcagguaggggcacagugaauguguguauguaugaaggcca

SEQ ID NO: 222908 - RNA, 73 nt, hsa
uaauuucaugacauuuacaaucaggacugaaguaaguucuucacacagugaccucugaaucaguuucagagaa

SEQ ID NO: 222909 - RNA, 73 nt, hsa
gaccuacuuuuguaacagaccaugguuguguccaagguaaaaccacagugauauuuuuggaugcuuugucugc

SEQ ID NO: 222910 - RNA, 73 nt, hsa
uccaucagagacaguaucucuaggcuugggcaagagaaaaguccacagugauaagcaacuccaccuaaggcau

SEQ ID NO: 222911 - RNA, 73 nt, hsa
gcgagaggaggggcccguugucucccuggcccucaaggccucccacagugacucgggcuccugugcccuuauu

SEQ ID NO: 222912 - RNA, 73 nt, hsa
ggcggugagcucaguggauugcaguggugugcuggugauuuugcacagugagcucugcggaaggggucaggcu

SEQ ID NO: 222913 - RNA, 73 nt, hsa
cugacugaaaacugaguuaacaagaugaaaucuaaaggauauucacagugacuucaauucaggaagaaugcuu

SEQ ID NO: 222914 - RNA, 73 nt, hsa
uuguuagaucucugcuuaggucgcagcucacgcauugaaugcacacagugauuguaugcaugccuuuugguac

SEQ ID NO: 222915 - RNA, 73 nt, hsa
gaaagggcaguguggggacugucauuuuugugauuuaauaacacacagugaaaauccaggaagaaugaauuaa

SEQ ID NO: 222916 - RNA, 73 nt, hsa
auuuauuuauuuuguucauuuauuuauuggagaggcagcauugcacagugaaagaauucuggauaucucagga

SEQ ID NO: 222917 - RNA, 73 nt, hsa
uggggcuaggcuggagcccagggagcggaaagcagcucaaaggcacagugaaggcuguccuuacccaucugca

SEQ ID NO: 222918 - RNA, 73 nt, hsa
acucaaguggcaccuagaagggcaggaguuccuuuggugacuucacagugaagucuugcccucucugugggau

SEQ ID NO: 222919 - RNA, 73 nt, hsa
cgacgagcugcagacgacaaaugucagcgaccugggcuuggaacacagugacucccuggaguagucgggcagc

SEQ ID NO: 222920 - RNA, 73 nt, hsa
aggguucuuuuaacacucggcacuucugugggagcuauucauacacagugacuugauguucuuggaggaucaa

SEQ ID NO: 222921 - RNA, 73 nt, hsa
gcugugaugcugaucuuccuugaaaccauagcaugcuacucuucacagugacguuguacucuccucauucugc

SEQ ID NO: 222922 - RNA, 73 nt, hsa
auuggauguuauuugcuuauauucuuauaauuuuaaaugagggcacagugaaaugaaaauuuuauacucuaug

SEQ ID NO: 222923 - RNA, 73 nt, hsa
gucuggggagagacagggccucugcugcccuguucuucacccucacagugauaccuccuuuccuugggucucu

SEQ ID NO: 222924 - RNA, 73 nt, hsa
aaauguuucccagaaaacuagacagaaugaucauucaauggaucacagugaagcaaaggacacaacuuuuuau

SEQ ID NO: 222925 - RNA, 73 nt, hsa
cagccuacagcaguguggucucuuacauggccacaaagggacacacagugacaaaaggcucggaauguuacaa

SEQ ID NO: 222926 - RNA, 73 nt, hsa
ggagccugagguacagagaagagugaggacugacucaaggucacacagugauccgggaucccagaacucuggu

SEQ ID NO: 222927 - RNA, 73 nt, hsa
guguguguggcuuugaaaacaaauuauuugagaaagaccauaacacagugaguagccuauaugugcauuuacu

SEQ ID NO: 222928 - RNA, 73 nt, hsa
gccucuggagaagaccuggggugggggcugaugggggcaggcccacagugagagacugccucugcuucauagg

SEQ ID NO: 222929 - RNA, 73 nt, hsa
cucacucguauuucccaccccuaguggccagaggagggaggggcacagugaagaagggagcccaccaccucuc

SEQ ID NO: 222930 - RNA, 73 nt, hsa
gggagcacagugaagaccaugggagcacccuggcaccugggagcacagugaagacccugagagcauccuggca

SEQ ID NO: 222931 - RNA, 64 nt, hsa
aauggauuugucaguauuagaguuugacaaaauucacagugaaauaaucaaugaucacuauuuu

SEQ ID NO: 222932 - RNA, 73 nt, hsa
agaaacugagccauugccaaaugguaaagaaaugaaaaguuuucacagugacuacugaauauaccaagagcuu

SEQ ID NO: 222933 - RNA, 73 nt, hsa
ccaaggagcugguggugcagaaaggcuggcgguugccggaguacacagugacccaggagucugggccagccca

SEQ ID NO: 222934 - RNA, 73 nt, hsa
cuuguuccagcccggaguuuugggaaagaaagaaaggaaaggucacagugaccuaggauuggaaccuuccugc

SEQ ID NO: 222935 - RNA, 73 nt, hsa
guuugguaaaagaauauuuucuucucugaauaauaauuauuuucacagugaaaauuucaguauuuuaucacua

SEQ ID NO: 222936 - RNA, 73 nt, hsa
ggaaacgugacucuuucuuaaugccacuggguuuuagucaggccacagugagaaggaacagcccuaacaggcc

SEQ ID NO: 222937 - RNA, 73 nt, hsa
caauccaagcaggaagaaggaaaagauacccaaaggucaagaacacagugauuuuauuagaaguuucauccgc

SEQ ID NO: 222938 - RNA, 73 nt, hsa
cuuuggagaucagaaaauucauauuuaagcaaagugauacaaacacagugauuugggaaugccuucauuuaca

SEQ ID NO: 222939 - RNA, 73 nt, hsa
gaagaagaugacgaugaugaccagucguacuaucuuacugagccacagugaugcaugcuuuucggggaaaacu

SEQ ID NO: 222940 - RNA, 73 nt, hsa
ccgaccaaaccccaagaccuggaucccaggagacaacagucuccacagugagagcaacauuaagggcaaagcc

SEQ ID NO: 222941 - RNA, 73 nt, hsa
gucuauauuauugcauaauuuugcugcuucucaauaucauagacacagugaauagaugaugacuauauggcuu

SEQ ID NO: 222942 - RNA, 73 nt, hsa
uugaaggaaagcuaagucuugucucauuuaggacuggguuccccacagugacagucacuuccuucagcaucuc

SEQ ID NO: 222943 - RNA, 73 nt, hsa
gacucuguuccaaaaaaaauaaaaaagaacagccuuuuuaggccacagugaccugcgcaauguuuauaugcuu

SEQ ID NO: 222944 - RNA, 73 nt, hsa
cgucauccaacacaacauggcuuucaucagaaguuacacagaccacagugauuuagccaaauaagucuuaacc

SEQ ID NO: 222945 - RNA, 73 nt, hsa
uaguuaacuguaaaguaaccugacucaguauaguuacugguaccacagugaggugaauaaaacgggauuuuca

SEQ ID NO: 222946 - RNA, 73 nt, hsa
uugugcauuuaauaccaguuagaguuccgacucugcauggugucacagugaaagcgccgacugacuuaugguu

SEQ ID NO: 222947 - RNA, 73 nt, hsa
cuaaaacgugaaacacuguaacacuuuuaaccacugagcauuccacagugaaauguuauuucuaugcucuuau

SEQ ID NO: 222948 - RNA, 73 nt, hsa
uuaucuagagaauaaucauauauaugcauacguaaaaauggaccacagugacuuauuuguaguuguuaguugc

SEQ ID NO: 222949 - RNA, 73 nt, hsa
augaaguuuauuucaacagauauuuuaugaaaugcaguuuaaccacagugaaugaauuuuagcuuugcuuuug

SEQ ID NO: 222950 - RNA, 73 nt, hsa
acuguugguuaaaugacaauuuauguggauuuugcauguaauacacagugagacacaguaauuuuaucuaaau

SEQ ID NO: 222951 - RNA, 73 nt, hsa
ucuuggagcuuuugcauuuaaaacaaacaagcaagcagacacacacagugaacacauuugauuaauuguguug

SEQ ID NO: 222952 - RNA, 73 nt, hsa
acagcaggcauaugaaacuccacucauugcaguacuuucacagcacagugacagguagaggacucuggcacag

SEQ ID NO: 222953 - RNA, 73 nt, hsa
gauagucccuucauucuguagacguguauugguugguccaagacacagugaguaggagcucuguggaccaaga

SEQ ID NO: 222954 - RNA, 73 nt, hsa
auggauuaucugggguaauuuucuucaaagggaguuuguuauacacagugaaaauguauuauagaguagaaua

SEQ ID NO: 222955 - RNA, 73 nt, hsa
uuuaaaaauuuuucccuuucaauguuguuuuuuugauugauagcacagugauaaaucauaauacuagacaaaa

SEQ ID NO: 222956 - RNA, 73 nt, hsa
ugggcggaucacgaggucaggagaucgagaccaucgugacuaacacagugaaaccccgucucuaauaaaaaua

SEQ ID NO: 222957 - RNA, 73 nt, hsa
cuuucaaaagaagaguuuuagagaaaauaaauuuaacuuuaaccacagugaaaguugacccuuagcgggacaa

SEQ ID NO: 222958 - RNA, 73 nt, hsa
gaucagcagcuguggaaauaaagcuugugagcccucugcuggccacagugaggaaaguagcacaaauaggaua

SEQ ID NO: 222959 - RNA, 73 nt, hsa
gauugcagggcuggcagcccccacgugguggcauccugacaggcacagugagacccuugcugggucaggucuc

SEQ ID NO: 222960 - RNA, 73 nt, hsa
agcuagaggguuuuggcuguugcuuuuuuuaaaguuagguccacacagugaagggaaaagagucugugaaggu

SEQ ID NO: 222961 - RNA, 73 nt, hsa
gaggaagcuaaggccuagaagguuaaggauguccccagggucacacagugagcggggcucagagcuugagugu

SEQ ID NO: 222962 - RNA, 73 nt, hsa
guacauagauuugauuucuccaaaauacagaaaugcugcugggcacagugaugugcaguuauagucccagcua

SEQ ID NO: 222963 - RNA, 73 nt, hsa
accugaaagccagcaauuuccugacacugagaaugaacaguaucacagugaugaacaaaaugauacucagaag

SEQ ID NO: 222964 - RNA, 73 nt, hsa
agcugcuuguguuucuuggggugacugucauugguaauacggacacagugacccauccuccauccuauuuaua

SEQ ID NO: 222965 - RNA, 73 nt, hsa
ugcagggaccagugccaggcacugggggguggaaguguggugacacagugaaugggagguggaggaggguugc

SEQ ID NO: 222966 - RNA, 73 nt, hsa
gaggccaaagcacuguccuguaagucuuacuuccugcuuagggcacagugaaguaggaaacaauauuuugaaa

SEQ ID NO: 222967 - RNA, 73 nt, hsa
ucacuucuaaauauuuugcuuucuaaauacuagccuucugguucacagugaaauaauuuaauuaucaaucagu

SEQ ID NO: 222968 - RNA, 73 nt, hsa
ugcuacaacaugugaggcauucggggaagcugcacaugugccacacagugacuuggccccagacgcauagacu

SEQ ID NO: 222969 - RNA, 73 nt, hsa
gaaugcaggggucugugcuuggcucuuagcaaagcagguggcccacagugaccuccaggagguggcugauuuu

SEQ ID NO: 222970 - RNA, 73 nt, hsa
guuuuguguaagaacagcugcauaugaguaaaguuaccccaaccacagugaggaggaagauguucacauacug

SEQ ID NO: 222971 - RNA, 73 nt, hsa
augaaucugccacacugaggccagggacgaguguucagugggccacagugaaccaaccaaaccaaccccgaau

SEQ ID NO: 222972 - RNA, 73 nt, hsa
uaaaauuugccuauguucugcuauuguuugaucuaaucuuaaucacagugagcucuucauuagcacaauaugu

SEQ ID NO: 222973 - RNA, 73 nt, hsa
ggcagagacugcccucagaaguuccuuguccagggugggcacccacagugacucagaggacagggcuaggcag

SEQ ID NO: 222974 - RNA, 73 nt, hsa
cgggcggaucacaaggucaggagaucgagaccauccuggcuaacacagugaaaccccgucucuacuaaaaaua

SEQ ID NO: 222975 - RNA, 73 nt, hsa
cauugaucuguuuuacaggaaacaaaccuugccuugaaauuuacacagugagacuguacauaauugcaugaaa

SEQ ID NO: 222976 - RNA, 73 nt, hsa
aaaugugcuuauguucugcuaugacguuugaucgaauccuaaccacagugagcucuucauuagcucaauaugu

SEQ ID NO: 222977 - RNA, 73 nt, hsa
gaauuccguagggucuuguucccacgaccggagugcuggcucucacagugaauuuugaugcauuuaaaauaag

SEQ ID NO: 222978 - RNA, 73 nt, hsa
gucaguaaugauuggucccuggggaaggucuggcuggcuccagcacagugaggcauuuagguaucucucggug

SEQ ID NO: 222979 - RNA, 73 nt, hsa
gacucugagagaccuugcacuccauacugaaaggagguggggucacagugaauuucacauccccucucaacca

SEQ ID NO: 222980 - RNA, 73 nt, hsa
cucguggccagcccggcugguuuuguaagaugcuggguuggugcacagugauuuuuuucuuguaauuuaaaca

SEQ ID NO: 222981 - RNA, 73 nt, hsa
ccucugugcacacugacacguggucccguccauccugaacaugcacagugauuuuccucucccguugcacaca

SEQ ID NO: 222982 - RNA, 73 nt, hsa
uugguuuuuguuuuuuguuuucuuguuuuuaaaaaaaggauuucacagugagaaaguuuugguuagugcauac

SEQ ID NO: 222983 - RNA, 73 nt, hsa
guuguucacuuggaguggauccagcuucacugucaugugcgaacacagugacacguuuggccagugacauuuc

SEQ ID NO: 222984 - RNA, 73 nt, hsa
uaaaaugugccuauguucugcuguuguuugaucuaaucuuaaucacagugagcucuucauuagcacaauaugu

SEQ ID NO: 222985 - RNA, 73 nt, hsa
aaauuugcuaauguucugcuaugauguuugaucucaucuuaaucacagugagcucuucuauagcucaauaugc

SEQ ID NO: 222986 - RNA, 73 nt, hsa
aguucacauacaaaucauccauccuugccaauagugucauccucacagugaacacucaguggcccauggcauu

SEQ ID NO: 222987 - RNA, 73 nt, hsa
aagaaaacagacuuuucucaaauggaccacaucaucucucacucacagugacaaugcugcuccuguaauuuug

SEQ ID NO: 222988 - RNA, 73 nt, hsa
agggcggaucacgaggucaggagaucgagaccauccuggcuaacacagugaaaccccaucucuacuaaaaaaa

SEQ ID NO: 222989 - RNA, 73 nt, hsa
cagguggcccaugccugggaucuucucuaugauugauacauggcacagugagagauuaaugggcauuguguac

SEQ ID NO: 222990 - RNA, 73 nt, hsa
ugguuuuaauuucugagcagaugauugugcugugggaacagcacacagugagggugccuagcacaaugucugg

SEQ ID NO: 222991 - RNA, 73 nt, hsa
ccagcuggccacguagguuuuaaagcaaggggcgugaagaaggcacagugagguauguggcuguucucguggu

SEQ ID NO: 222992 - RNA, 73 nt, hsa
gcagggauggccgccugcuggccuuugugggacccuccaggugcacagugacagucaugggcucggccucccu

SEQ ID NO: 222993 - RNA, 73 nt, hsa
gccaccaggcuccgaggggccguggugacucuugaucaaagagcacagugaacugucccuucugagucucccu

SEQ ID NO: 222994 - RNA, 73 nt, hsa
uugccuaauucauguuuucacuuaaaaguaucagaggugaaugcacagugaagggugauuuguggggagggag

SEQ ID NO: 222995 - RNA, 73 nt, hsa
aaugaaagggcccagagaggguggugaccucugccugaagucacacagugagucgaggacagggaggugaccc

SEQ ID NO: 222996 - RNA, 73 nt, hsa
aaaaguaccuuuagauaaaaacaaagaagaguaauauaugcagcacagugacguuaggauucugguaauuaac

SEQ ID NO: 222997 - RNA, 73 nt, hsa
agagacacuuagguggaaggcacacagagaggccacgugaggacacagugagaagguggccgucugcaagccg

SEQ ID NO: 222998 - RNA, 73 nt, hsa
auaaauugaggcacagaaagauuaaguuaccggcccaaggugacacagugaggagguggcagagcuaggauuu

SEQ ID NO: 222999 - RNA, 73 nt, hsa
gggugggucuagacauacuauauucagagaacuauacuacccucacagugaggcccucagaccugccacaggg

SEQ ID NO: 223000 - RNA, 73 nt, hsa
aagguuuuaacugcuuuguuauguaagcuuacccagcccggcgcacagugacucacgccuguaaucccagcac

SEQ ID NO: 223001 - RNA, 73 nt, hsa
auuggaggaggccauuucacucccugaacccagccugacaaaucacagugagaauguucaccuuauaggcuug

SEQ ID NO: 223002 - RNA, 73 nt, hsa
agcgccuggguccaggggaggccuuccagggacgaagaagagccacagugagggagaucccauccccuugucu

SEQ ID NO: 223003 - RNA, 73 nt, hsa
gccaaggccuccccgaggcagaaguugccugguccucuguccccacagugaccugacugggggugagggagaa

SEQ ID NO: 223004 - RNA, 73 nt, hsa
auagacugacugguccagaagacagaggguacaacaguggcaucacagugacagugucauggggagcugggcg

SEQ ID NO: 223005 - RNA, 73 nt, hsa
gauggcuugaggccagagguuugagaccgaccagccagggcaacacagugagaccccuucucaaaaaaaaaaa

SEQ ID NO: 223006 - RNA, 73 nt, hsa
gcaccuuguaugauggcaggacaggcuccagcagagagaacugcacagugaccacuguauuuuucacgcucuu

SEQ ID NO: 223007 - RNA, 73 nt, hsa
ccaucacucuauaaaagugcuucaugagcccagaccaaaagcccacagugaaaugaaguacccuuuuguaaau

SEQ ID NO: 223008 - RNA, 73 nt, hsa
ccucagacacugcccugccaccugucagacuugggugagcagacacagugaggcuguuagguccugcaguucc

SEQ ID NO: 223009 - RNA, 73 nt, hsa
ugcaaugagccaugauuacaccacggcacuacaaccuugguggcacagugagaaccugacucuuaaaaaaaaa

SEQ ID NO: 223010 - RNA, 73 nt, hsa
gggugcuuuuccuccaguuugcuggcuggcuucuccgucuacccacagugaccucacagagaggcccuccugc

SEQ ID NO: 223011 - RNA, 73 nt, hsa
uacugugaacccaaucuuaaaggagguucucaugcccaggguccacagugaccagccagcaagucucugguag

SEQ ID NO: 223012 - RNA, 73 nt, hsa
cugcaagccucagagcagccaagucauugguguucauuuuccccacagugauuuuuguaacuucucuuucuaa

SEQ ID NO: 223013 - RNA, 73 nt, hsa
guaggaggagagaaggcuggggagggcugggcagcaagccaggcacagugaguggcagagcaagagggggaaa

SEQ ID NO: 223014 - RNA, 73 nt, hsa
augccgcccuuggcuacaucauugccuuccugguacuccuguccacagugaagcuuuggcaucugcucagguu

SEQ ID NO: 223015 - RNA, 73 nt, hsa
caauggcuguggcgauggcuacagcaauggucagcuuggaaaccacagugaagaagacagcacugaugaccaa

SEQ ID NO: 223016 - RNA, 73 nt, hsa
cuacuggaaugguguuuugucagacuuccaaauccuggaaggacacagugaugaauguacuaugucugaacau

SEQ ID NO: 223017 - RNA, 73 nt, hsa
ggaggauugcuugaguccaggaauuugagaccagccuggacaacacagugagaccucaucucuaucaaaaaau

SEQ ID NO: 223018 - RNA, 73 nt, hsa
cuguuuacaaguagaauagccaauuauuuaaauguuuaguugccacagugaaccaggagucacugagccaaug

SEQ ID NO: 223019 - RNA, 73 nt, hsa
aggguaugaagagcugucuuccccugagaguuuccucagaacccacagugagaggggagggcuccuggggcag

SEQ ID NO: 223020 - RNA, 73 nt, hsa
cugugagggccgugugccccaugcuacccuccccgccucccuccacagugaucagcugugccucucugccugu

SEQ ID NO: 223021 - RNA, 73 nt, hsa
ggaggaucgcucaagccccggaguuggagaccagccagagcaacacagugagacccccaucucuacaaaaaua

SEQ ID NO: 223022 - RNA, 69 nt, hsa
gcccccuugauuuugauugaaaaugaacuauuugaaacacacagugaccaagggaagugaccaagguga

SEQ ID NO: 223023 - RNA, 73 nt, hsa
guggcuuuguucacauagcugaugcgugcccugggaagguguccacagugagcccugugugcaggacugucca

SEQ ID NO: 223024 - RNA, 73 nt, hsa
uugaacacuaaaauguuuuaaguuuucuuauugcuaacaaugucacagugaacauuuauauauucauuaaauc

SEQ ID NO: 223025 - RNA, 73 nt, hsa
uuuugcuagagcugacagcuuuguucgcgugggcagagccuuccacagugaaugugucuggaccucauguugu

SEQ ID NO: 223026 - RNA, 73 nt, hsa
uggcuggggucuaaccuugaacccucaccacgugcaggucacacacagugaagccacuuguaacugcacacuu

SEQ ID NO: 223027 - RNA, 73 nt, hsa
gagugccuuaagaucaaacuaacaagaucugacccucuccccucacagugagccacugccccacuucagaggg

SEQ ID NO: 223028 - RNA, 73 nt, hsa
auuuguuauuagugauacuuuauuuuauauaauauuuuuuauucacagugaaauuucauucauguucuuucag

SEQ ID NO: 223029 - RNA, 73 nt, hsa
uaaugcaguuaccuguaggcauaauugaugcacaugauguucacacagugagagucuuaaagauacaaaaugg

SEQ ID NO: 223030 - RNA, 73 nt, hsa
aggcugaaggccacaggggaggccucagccaggggcaagugcccacagugacuccauuuaggaugcugucguu

SEQ ID NO: 223031 - RNA, 73 nt, hsa
aagaggaagccaguccuguuccucuaaccagcaacgugggcagcacagugaaggguggacaaaacucgacugc

SEQ ID NO: 223032 - RNA, 73 nt, hsa
aauaguuaauauuauccccauuugacagacgaaaaaauagaggcacagugaaguaacuugccuaagaccacac

SEQ ID NO: 223033 - RNA, 73 nt, hsa
cucuagagaagcaccuuccuccuacaggaggggaaacugagcccacagugaguauguaacuugaccaagguca

SEQ ID NO: 223034 - RNA, 73 nt, hsa
ucgugugcgaggccaggagaucaagaccauccugacuaacaaacacagugaaaccccgucucuacuaaaaaua

SEQ ID NO: 223035 - RNA, 73 nt, hsa
auugacauuauugaaggaaaggggaugaggacaacugugaacucacagugagcccuguggaaagaagagacag

SEQ ID NO: 223036 - RNA, 73 nt, hsa
gaaucagagggaaugcaggacguggucuauggugagccaacgacacagugagaaggagcaggaaguugcuguu

SEQ ID NO: 223037 - RNA, 73 nt, hsa
agccuccaguuguagcagguuucacuauuccuaugcugggguacacagugagaguacucacuuuucacuuguc

SEQ ID NO: 223038 - RNA, 73 nt, hsa
ucagggaacaaugagcacuugaagauuuuuuuauacaaaaggccacagugaggccaccuugagucaagccgac

SEQ ID NO: 223039 - RNA, 73 nt, hsa
uauguuaaugcaaucuugaaaugacugaaagguagauugccagcacagugaguuucccagccugcucccccau

SEQ ID NO: 223040 - RNA, 73 nt, hsa
uauaucaaaguuuuaguaguuuccuccacauucacgaaauuaccacagugagagcuaagcauuucuacugggc

SEQ ID NO: 223041 - RNA, 73 nt, hsa
cuccucuagaagcagguuugaaauuauggguauguuuucuugucacagugacugaguacgguggugguagugg

SEQ ID NO: 223042 - RNA, 73 nt, hsa
aauucagugaauuuugaaaacauauauacaguugucugucugccacagugaucaugauacagaacacuuucuu

SEQ ID NO: 223043 - RNA, 73 nt, hsa
gacaggauuucuaaaauucugugauucagauuugucagggaagcacagugaagcuugcuuaaaggcacuggcc

SEQ ID NO: 223044 - RNA, 73 nt, hsa
ggaagaaaaaagcagcuaaaaaagaguggaccaaaacacugcacacagugaaguguuccaguuuccacugggc

SEQ ID NO: 223045 - RNA, 73 nt, hsa
cugugggugauuuaauuuauuuggauccaccucugagugagcgcacagugaucaggugcuucaaagccaacag

SEQ ID NO: 223046 - RNA, 73 nt, hsa
cggguggaucaugaggucaggagaucgagaccauccuggcuaacacagugaaacccugucucuacuaaaaaua

SEQ ID NO: 223047 - RNA, 73 nt, hsa
gggucuggccccgggcugcugggcucacaaagucacacuagaccacagugacgaucucuguaagcacaaaggg

SEQ ID NO: 223048 - RNA, 73 nt, hsa
gaccacaggaaggacgguguuugugucugagggagcugcuggccacagugaacacccacguuuauuccugccu

SEQ ID NO: 223049 - RNA, 73 nt, hsa
aauaggcuuuuucugcuccccgauucugguguaguucuaaguacacagugauguccucuguaggggcgugccu

SEQ ID NO: 223050 - RNA, 73 nt, hsa
cgggcggaucacuaggucaggaaauggagaccauccuggccaacacagugaaacccagucucuacuaaaaaau

SEQ ID NO: 223051 - RNA, 73 nt, hsa
cccaguugcagggaggguagauggccccacccagaccgagagacacagugaugaccucagccuagggacacca

SEQ ID NO: 223052 - RNA, 73 nt, hsa
ucaccacacugaccacccucaacccauugcgcccaguccccaccacagugaccacacccucacuggcucggcc

SEQ ID NO: 223053 - RNA, 73 nt, hsa
agaacuggggguucagagggcaggugccucagaguugaggccacacagugaggucuggugggugaaaggaccc

SEQ ID NO: 223054 - RNA, 73 nt, hsa
caauagcccauugacuuagaaacuguuacuuucccauuuuacacacagugaaacugaggcucagauauaaagg

SEQ ID NO: 223055 - RNA, 73 nt, hsa
cuaacgucugcaggagcuuuauucccuauuaauagaaaaccgucacagugacccuagaucccuccgaguuaau

SEQ ID NO: 223056 - RNA, 73 nt, hsa
ucaguaauaacuaguuggccaacugacugugguccauggacuacacagugaguagagguucuuuaaaagaagg

SEQ ID NO: 223057 - RNA, 73 nt, hsa
ggaggaucgcuugaggccaggaguuugagacuagccuaggcaacacagugaggccuuaucucaacaacaacca

SEQ ID NO: 223058 - RNA, 73 nt, hsa
augagccccaccacuacacuccagccuggaagacaccaugacacacagugaggccuggauggggaaagagucc

SEQ ID NO: 223059 - RNA, 73 nt, hsa
aaaacuucauccucuuuugucccuuucgaguuaacauuacagccacagugaccuuucaaaaaugcaaauuaag

SEQ ID NO: 223060 - RNA, 73 nt, hsa
uaaguuuuggugucuguaaauaaaguuuuguuggcuucagccacacagugauuuacaccuugauugugcugcu

SEQ ID NO: 223061 - RNA, 73 nt, hsa
cuugcuggaguuccucaaugacuacccaccuuuacgaugcacccacagugaaguuccucacacccugcuacca

SEQ ID NO: 223062 - RNA, 73 nt, hsa
gcccucuuuagcgacauauuuugugacauuccuuccauuacaccacagugaguucacagguaauauaaccuac

SEQ ID NO: 223063 - RNA, 73 nt, hsa
gcuuauuccucggaguagaaggguguacagggggcccagacuccacagugacuugccacauuugccccccauu

SEQ ID NO: 223064 - RNA, 73 nt, hsa
gccacugaagccagaggaucgauugaaccagggagaucauggucacagugaacuaugauuacgccaaccuggg

SEQ ID NO: 223065 - RNA, 73 nt, hsa
gcggcgauggcaucacacagacggugaugaugucacacacagacacagugacaacacacaccaugacaacgac

SEQ ID NO: 223066 - RNA, 73 nt, hsa
cccccaccccgccugccgcccccuguccagguucccuccccgccacagugaaauaaagcaucccacccugcag

SEQ ID NO: 223067 - RNA, 73 nt, hsa
ggaagaucucuugagcucaggaguucaagaucagccugggcaacacagugagaccucaucuccacuaaaaaua

SEQ ID NO: 223068 - RNA, 73 nt, hsa
aguuuucaguaaugcuacaaccauugcacaucauuggagaauccacagugaagagaucuuacaaguguaauaa

SEQ ID NO: 223069 - RNA, 73 nt, hsa
ggaggaucgcuugagcucaggaguucgagacuagccuuagcaacacagugagacacaauugcuacaaaaagau

SEQ ID NO: 223070 - RNA, 73 nt, hsa
aauguggaaaaucuguuagcacccuggagaaaguccuugaguacacagugaaugucagaaagcuucagcugaa

SEQ ID NO: 223071 - RNA, 73 nt, hsa
ggcaaagauggggcggggccucccccugagagagcucacccuccacagugacccuuuuccuuccugccuaaua

SEQ ID NO: 223072 - RNA, 73 nt, hsa
uguggacagcuuuggccagagcucccguguggcaucugggagccacagugacccagccaccuggcucaggcua

SEQ ID NO: 223073 - RNA, 73 nt, hsa
augauaacaggguguccugaacuggcugccguugucguguucucacagugaagggcgugcccugugugccggg

SEQ ID NO: 223074 - RNA, 73 nt, hsa
uucuuccuugugagcagaagguuggcugcuguuagcaggaucccacagugauaaccaggcccuucccuuccua

SEQ ID NO: 223075 - RNA, 73 nt, hsa
uaaauauugucacaacacugaaccucuggcuagaggacauauucacagugaacauaacuguaacauauaugaa

SEQ ID NO: 223076 - RNA, 73 nt, hsa
aagaagugauaaagucuccagaugcaguagcucacacuguaaucacagugacucaggaggcugaggugagagg

SEQ ID NO: 223077 - RNA, 73 nt, hsa
gagugauaaacuaagucacauacagauaaagcacugaaaacaccacagugacccucccaccccccaccaauau

SEQ ID NO: 223078 - RNA, 73 nt, hsa
accagccucacccaucaaaccagugaauuucucaaucuugccucacagugacugcagcgccaagcggcaucca

SEQ ID NO: 223079 - RNA, 73 nt, hsa
cccauucucagggcccccacaucagugucucguuuacaucucacacagugacccugcgaggcaaggguuugcc

SEQ ID NO: 223080 - RNA, 73 nt, hsa
cccaccccacuguccuccaaggcuacaggaccccugcuucugacacagugagcaacaagccuggguuucccug

SEQ ID NO: 223081 - RNA, 73 nt, hsa
aacaggccaggagaagugcgugccgagcugaggcagauguucccacagugaccccagagcccugggcuauagu

SEQ ID NO: 223082 - RNA, 73 nt, hsa
aguguuucuccugcagcacuccaaaacccacucugcacugcagcacagugaaugauaugcacucaccauuagc

SEQ ID NO: 223083 - RNA, 73 nt, hsa
cugguggaucacaaggucaggagauugagaccauccuggcuaacacagugaaaccccgucucuacuaaaaaua

SEQ ID NO: 223084 - RNA, 73 nt, hsa
gucgcugaggggguuggcugggucugagugccaccccccaggccacagugauaccaucccagugccaugagcc

SEQ ID NO: 223085 - RNA, 73 nt, hsa
uuuaccucccucgcccugccccgcaccguggggaugcccaacucacagugacuucccguuuggggcccggugu

SEQ ID NO: 223086 - RNA, 73 nt, hsa
aucaucucuuuggggaccacuccucuggcuuucauuuuucagccacagugauucuuuggaaaagucaaaucau

SEQ ID NO: 223087 - RNA, 73 nt, hsa
ugacaacccaaggucagaggaguggcccucagugucaucuguccacagugauaccugccaagaugaccacuga

SEQ ID NO: 223088 - RNA, 73 nt, hsa
ucaacacauggugcuccuuuaccgugacauuuucucaccugugcacagugagccgguagcuuccuuuuagucu

SEQ ID NO: 223089 - RNA, 73 nt, hsa
aaagagaaaaguacaagacagaaaucuucuagcacuuuguaaacacagugaauaaccucuuggaguauuuuug

SEQ ID NO: 223090 - RNA, 72 nt, hsa
agagguccaugguuggguagaagaauguguaugacaaccacacacagugaagcucuuuuuucaaaguaaauu

SEQ ID NO: 223091 - RNA, 73 nt, hsa
gcggucagcuaagggagaacuugcguggaaggagcaaugcagacacagugaaaucucuagaaucugcuuuguu

SEQ ID NO: 223092 - RNA, 73 nt, hsa
ggccccaaagcuaggcucugagaaggaaacacacucggcugggcacagugacguacuccaucucacaucugcc

SEQ ID NO: 223093 - RNA, 73 nt, hsa
ccuuguacgaugcucuaaucauauugcauuuaauuuuauuuugcacagugaccuuguagccacaugagaaagc

SEQ ID NO: 223094 - RNA, 73 nt, hsa
augcuugcaccugugaauagccacugcacuccaucuugggcaacacagugagacccccaucuauaaaaagaga

SEQ ID NO: 223095 - RNA, 73 nt, hsa
auuuuuaaagcuuuugugauauuuuagcauuuugaaagacuuucacagugagaguagaagguagauuuggaau

SEQ ID NO: 223096 - RNA, 73 nt, hsa
cucagacaccaagcugggccugcagaggaggggcacaguaggacacagugacugcccagguguccacacaccu

SEQ ID NO: 223097 - RNA, 73 nt, hsa
ugaagccaccaugggugaccguccagccucacccgguggccugcacagugagggaagggcuucagggccaucu

SEQ ID NO: 223098 - RNA, 73 nt, hsa
cgggcggaucacgaggucaggagaucgagaccauccuggcuaacacagugaaaccccgucucuacuaaaaaua

SEQ ID NO: 223099 - RNA, 52 nt, hsa
accagucgcagggcuacugagccacagugaccgccugcccccgccccucccc

SEQ ID NO: 223100 - RNA, 73 nt, hsa
accaccccauucuucucaagcaaggauugccagcgcgcgcugacacagugaugggcugcccagggcuggaggg

SEQ ID NO: 223101 - RNA, 73 nt, hsa
gaacaggcccugagcucacaggcagccaauguaaagagggaaacacagugaguuaugcaguucccagugucca

SEQ ID NO: 223102 - RNA, 73 nt, hsa
gcuggcugagcaaauucauccucuggaaauauucucucucagccacagugacauugacccucuugguuuucuc

SEQ ID NO: 223103 - RNA, 73 nt, hsa
guagaugcuagcaagcaaugucaucaacugucagguuguuuuucacagugacaucucaucagcucccuauugu

SEQ ID NO: 223104 - RNA, 73 nt, hsa
cuuggagcagauuuugucuguggauggagacaguggcagcucccacagugaugcugcugcuaagggcuuccaa

SEQ ID NO: 223105 - RNA, 73 nt, hsa
ugagcccacacacacgcucaaccccaaguccuuuaugcuuugucacagugaagaugagaccucugacguccaa

SEQ ID NO: 223106 - RNA, 73 nt, hsa
gcaaaaaugcugccccccucacagggugaccaugaggaccagucacagugaugugugaaagggcucgcugguc

SEQ ID NO: 223107 - RNA, 73 nt, hsa
gucccgagggcgccuggguccucccagcugacggcaguaaauccacagugaguuggggcgacugugaaacugg

SEQ ID NO: 223108 - RNA, 73 nt, hsa
auuuuauucguguucuguuuccgaaacacuuagcaaagaaggucacagugauguggagucgccgcacccaucu

SEQ ID NO: 223109 - RNA, 73 nt, hsa
cagacauagcaugacagaccuuccuagaguguuuggucggguucacagugaccgagagucagguccagcacac

SEQ ID NO: 223110 - RNA, 73 nt, hsa
uugcgcuuacuuuguugaaaaagaaaaagaaauuaaauuugaacacagugaaagcugcaaguaugccaguggg

SEQ ID NO: 223111 - RNA, 73 nt, hsa
cagacccugggaccuucuugccucaguguugugcuuguaaauacacagugaaauugucuuuauaucacuuuga

SEQ ID NO: 223112 - RNA, 73 nt, hsa
cucuucagaauacacucuagacccaaaggugugcuaaucacuucacagugaccacuacagaguacuaagaaga

SEQ ID NO: 223113 - RNA, 73 nt, hsa
agaauuuuccccucuguuuuccuaaauuguaugagagcuuucacacagugagaaauagagcaggcugccccau

SEQ ID NO: 223114 - RNA, 73 nt, hsa
uuaucauggguggaauuuuuuuuuccauuucccucacucuagucacagugaaucuuuaacuguguccugaggg

SEQ ID NO: 223115 - RNA, 73 nt, hsa
aaggaaaguuuuaaaaauguuuuuaaaacuucaaauaucucaccacagugaauuauggguaaggugauaauau

SEQ ID NO: 223116 - RNA, 73 nt, hsa
auuuuuuuucaugaaaaugucaacaugguucuucugaaucuaucacagugaaaaguucuaacuuguuuuugag

SEQ ID NO: 223117 - RNA, 73 nt, hsa
acacuguguuggcaccauauuuuacaaguuuuuuuccucuucucacagugaucuugugaguuaguuacuuaua

SEQ ID NO: 223118 - RNA, 73 nt, hsa
ugguugcacucuguagacuggaucuguuuuaggaaguuacuuucacagugauguuguguguucuguuaguuuu

SEQ ID NO: 223119 - RNA, 73 nt, hsa
uccgucuuuucucccauuuuacaguauuacucaaauaagggcacacagugaucauauuagcauuuagcaaaaa

SEQ ID NO: 223120 - RNA, 73 nt, hsa
ucaucucuggugacugaguguaaaauaugugccaagucugcagcacagugaccaaaucugacaaucgagcucu

SEQ ID NO: 223121 - RNA, 73 nt, hsa
gggcccgacuuuugccacccuccugaggaagccccuagguccacacagugaugccaugggggacccuugccuu

SEQ ID NO: 223122 - RNA, 73 nt, hsa
guaacccucgcccugucccucccacucccugggggcgcuguuccacagugacugggcccuguccagggcagug

SEQ ID NO: 223123 - RNA, 73 nt, hsa
caaaucauguuuauaaaauaggacgcugggagcaguugcaggccacagugaaguguguugcuucugucacuuu

SEQ ID NO: 223124 - RNA, 73 nt, hsa
uuuuuucccagguguuaaaaaaaaaauccauuuuacacagcaccacagugaauccagaccaaccuuccauuca

SEQ ID NO: 223125 - RNA, 73 nt, hsa
cagccagagcuauaauuguuuuuuaaaugugucuugaagaaugcacagugacaaggggaguagcuauugggaa

SEQ ID NO: 223126 - RNA, 73 nt, hsa
gagcccuaagaacaccacauuuguugaaaacuagcacucuacccacagugacgugguaucugaugaagaccug

SEQ ID NO: 223127 - RNA, 73 nt, hsa
auuuuauaaaugauauucucguaaaacugcgcuuugccaguagcacagugaauguaugccaaaugcaagucca

SEQ ID NO: 223128 - RNA, 73 nt, hsa
uuuccccaauaucuagucuuugcaaauucuaguagaagauuuccacagugaaaucagugagccagaccaacuc

SEQ ID NO: 223129 - RNA, 73 nt, hsa
agaauuggaaaauacugcagacauuuccgaagaguuuauaaagcacagugaauuccuggucaaucucuccacu

SEQ ID NO: 223130 - RNA, 73 nt, hsa
auuacucuuugugauuuucuaauaaccaugcuaaguguauuuccacagugagcuuuuggcuuacuauauacau

SEQ ID NO: 223131 - RNA, 73 nt, hsa
agggaacauccugaagugucagagaaaaguaaggcauauggcucacagugaugaugccagucagagccaggcc

SEQ ID NO: 223132 - RNA, 73 nt, hsa
ucuguguuugaugagagaagucaguguucucaguaguagaaggcacagugaauggaagggaacacauuguaua

SEQ ID NO: 223133 - RNA, 73 nt, hsa
cucuugcguguccaaaaguagcccagggcuguagcacaggcuucacagugauuuuguguucagccgugaguca

SEQ ID NO: 223134 - RNA, 73 nt, hsa
aguaaacagucugcuugcuucuucaggcacgugacagugacaacacagugacugccucugaaaagagcccuga

SEQ ID NO: 223135 - RNA, 73 nt, hsa
aggcugagaugagaggaucacuugagccugaggagguccaggccacagugaucugagaucacaccauugcccu

SEQ ID NO: 223136 - RNA, 73 nt, hsa
gaggacugauugaguccggguguucaagggccaaccuaggcaacacagugagaacucaucucuguaaaaaaua

SEQ ID NO: 223137 - RNA, 64 nt, hsa
acucuaccucugaaugugcugggaaccucuuggagccugucaggaacuccucacuguuuaaaua

SEQ ID NO: 223138 - RNA, 64 nt, hsa
cuucgaagggcaggacuggggauaaucagaaccugccugucaccucagggcaucacugaacaaa

SEQ ID NO: 223139 - RNA, 64 nt, hsa
gauccuuugggcagaugucccauugcucccuggagccugucaugccuguuggggaucaggcagc

SEQ ID NO: 223140 - RNA, 64 nt, hsa
ucuucuccagcuuacccuagggugaccaaguagggccugucacaccaggguggcgcagcuuucu

SEQ ID NO: 223141 - RNA, 64 nt, hsa
guacauauuuagcaaauuuugguuucuuacaugugccugucaugacuguaauucauuaugacug

SEQ ID NO: 223142 - RNA, 64 nt, hsa
cuccaggaagggcuaauggggccaauauauuauugccugucauguggcacauccauguuaaggg

SEQ ID NO: 223143 - RNA, 64 nt, hsa
ugccugucauacuugcuaaacaagagcacagcgggccugucagaugaagucaggagccauacgu

SEQ ID NO: 223144 - RNA, 64 nt, hsa
aguggagcaguugacauccaggguuuuuuuuccugccugucauacuugcuaaacaagagcacag

SEQ ID NO: 223145 - RNA, 64 nt, hsa
ugaggcccuucagaaauuugugcugauuuggucccugugccagggcacagggggucaggcacug

SEQ ID NO: 223146 - RNA, 64 nt, hsa
ggcaggcgugcugacagccggcaguuugcgugggcugugccaucugaugucuauucccagcccu

SEQ ID NO: 223147 - RNA, 64 nt, hsa
auucucucccauccuggggcagcacuccccagagcugugccagcaggggggcugugccaaccug

SEQ ID NO: 223148 - RNA, 64 nt, hsa
ggcagcacuccccagagcugugccagcaggggggcugugccaaccuguucuuagaguguagcug

SEQ ID NO: 223149 - RNA, 64 nt, hsa
ccacacucugguccaugaggcagcaaggccagugcugugccaagcccgguaaggccaagugccg

SEQ ID NO: 223150 - RNA, 64 nt, hsa
uugccugcaaauaguauaaacaacacuaaauuuacugugccaggaaaucuuccugaacuccuug

SEQ ID NO: 223151 - RNA, 64 nt, hsa
gcuauucaaucuuagggugucuauccacgucuggcugugccaaauggucuggcagcugguuuug

SEQ ID NO: 223152 - RNA, 64 nt, hsa
uccugccacuguuggccaugucguaaggcagcagcugugccaggauagcuggguccauucagag

SEQ ID NO: 223153 - RNA, 64 nt, hsa
gagaggugaaaaauaccacauaaugaucaguaugcugugccagcuucauuuggggagaaauaac

SEQ ID NO: 223154 - RNA, 64 nt, hsa
cauucauucaacacauauucauagagcuccuucucugugccagacacuguucuggaagauagcu

SEQ ID NO: 223155 - RNA, 64 nt, hsa
gcucugggaagggguucccagaaucccuccugagcugugccauuuacucaggggacucccaaac

SEQ ID NO: 223156 - RNA, 64 nt, hsa
ccaugcuuugggucaccucgggcugcaacccugucugugccagauugcccggucugacccugca

SEQ ID NO: 223157 - RNA, 64 nt, hsa
cgagcaugccauggguccgcucugcaugcccugucugugccaugagugucccuggccccuuccu

SEQ ID NO: 223158 - RNA, 64 nt, hsa
gagggauggcguuggcagugccagccuccccagccugugccaagcuucaacaggggcaagagga

SEQ ID NO: 223159 - RNA, 64 nt, hsa
uggggagugggugggaggcaccaaaacuuggcagcugugccagaaaccaaagccaggcccagau

SEQ ID NO: 223160 - RNA, 64 nt, hsa
cugaauguucguucaccauccgugggcaccaggucugugccaagcacagggacuccaggggcag

SEQ ID NO: 223161 - RNA, 64 nt, hsa
cccagguggguuggaacacguuugcugccugagccugugccacugagcauguuagguggagcag

SEQ ID NO: 223162 - RNA, 64 nt, hsa
ugcgucugugccagcucaaauccagccccucgcccugugccaccccaacugugccugauagacc

SEQ ID NO: 223163 - RNA, 64 nt, hsa
acauguaacucaggaccccuuuucccucuugcgucugugccagcucaaauccagccccucgccc

SEQ ID NO: 223164 - RNA, 64 nt, hsa
cacugacuagagugaugacugcuuguagguaugucugugccauuucucagggaaguaagaugua

SEQ ID NO: 223165 - RNA, 64 nt, hsa
ucuguccaaguacuuaacuaucuguucccuuccucugugccacgcuccucuguuuguuuggcug

SEQ ID NO: 223166 - RNA, 64 nt, hsa
ccagcuagacuauuggguaugaacuaaaaagagacugugccauggugagaaaaauguaaaaucc

SEQ ID NO: 223167 - RNA, 64 nt, hsa
ggugaaugaagggcaugcaggcccucagcccgggcugugccagcccucccagccccaggcccau

SEQ ID NO: 223168 - RNA, 64 nt, hsa
gcaaucugcaccuuggggccugggcucccccucucugugccagcggcuucccagcaccugggag

SEQ ID NO: 223169 - RNA, 64 nt, hsa
ggaagaggccugguaccgccucacccacagaggucugugccaggugcgcuucugcagguggagc

SEQ ID NO: 223170 - RNA, 64 nt, hsa
gauggagaggaccaccgccgcaggguucuuuuaccugugccaccagcucuggagacauccacac

SEQ ID NO: 223171 - RNA, 64 nt, hsa
ugccucagcgcugcccacaccaccgcccuccucgcugugccaccaccccucccucugcucucau

SEQ ID NO: 223172 - RNA, 64 nt, hsa
ccaauggagacuuucugaugcaucguuuucuuugcugugccaaagcaggucagaagagggagag

SEQ ID NO: 223173 - RNA, 64 nt, hsa
ccauccacugguucuugcccugagccacauaugucugugccaugggcugagugccacgacaggc

SEQ ID NO: 223174 - RNA, 64 nt, hsa
cccugcagcagagcagggcgcaaacccaggacaucugugccaggcuucccaugcccucccccaa

SEQ ID NO: 223175 - RNA, 64 nt, hsa
auuccacaaagggagaguggcaucccugcugcugcugugccagaccagaguuuccugaggggcc

SEQ ID NO: 223176 - RNA, 64 nt, hsa
agcccugccagacuccccuggcugugauggcauucugugccauccuccuuguccccagccucug

SEQ ID NO: 223177 - RNA, 64 nt, hsa
uguggaugcucaccugugccaucuguccuccugucugugccaggaggcaccugaguucucugcu

SEQ ID NO: 223178 - RNA, 64 nt, hsa
acccccuguggcaauggaguguguggaugcucaccugugccaucuguccuccugucugugccag

SEQ ID NO: 223179 - RNA, 64 nt, hsa
uuuuccuagaccaggaauggggaauauauaacaccugugccaccgcucuuuuaaggaggcauua

SEQ ID NO: 223180 - RNA, 64 nt, hsa
gaggcauuaugaaugagugcagcauuccuguccucugugccaggauuuggucuuagaauccaug

SEQ ID NO: 223181 - RNA, 64 nt, hsa
uuuuauggcuccccucacugauggacaaggaggucugugccaaagaagaauccaauaagcacau

SEQ ID NO: 223182 - RNA, 64 nt, hsa
aaccauuuaguauuaguauuagaaugaagucaaacugugccacacauggugaaugaaaaaaaaa

SEQ ID NO: 223183 - RNA, 64 nt, hsa
gguuugggaagcaggacuccgucccuguccccgacugugccacgugguaggacacauaggacac

SEQ ID NO: 223184 - RNA, 64 nt, hsa
uaggacacaggaauuccuggguccuugcccaugacugugccaugugguaggacacaggacacag

SEQ ID NO: 223185 - RNA, 64 nt, hsa
gaaccugggaggcagagguugcagugagcugagacugugccauugcacuccagucggguuaaca

SEQ ID NO: 223186 - RNA, 64 nt, hsa
gaauauggagaugaagauuguuuucuccaauuuucugugccauuuuaaauuuaacuuugacauc

SEQ ID NO: 223187 - RNA, 64 nt, hsa
agggaugggcaccucaugccugucucgccaccuccugugccaaugucccacccuccaccugggg

SEQ ID NO: 223188 - RNA, 64 nt, hsa
agagggggccccucugcaucugagccccccaucccugugccaccuggguguggagcccauggaa

SEQ ID NO: 223189 - RNA, 64 nt, hsa
uguuucucacagccgguauuuauugucugcuccucugugccaggugcugugcucugggcagggg

SEQ ID NO: 223190 - RNA, 64 nt, hsa
cagagacccugugggcccuggcccugugcuggcacugugccagucaugaggcagcucugaucac

SEQ ID NO: 223191 - RNA, 64 nt, hsa
cccgcugccagggcagagggaggagggggcacagcugugccaagcccggccccacugguguguc

SEQ ID NO: 223192 - RNA, 64 nt, hsa
auguuagccauggguccuuucugcaggguccccucugugccagaaauggguuuucgggacuugc

SEQ ID NO: 223193 - RNA, 64 nt, hsa
ccagagaugaaacucccuaaaaugccugagauggcugugccagagguucgacuccccgaggugc

SEQ ID NO: 223194 - RNA, 64 nt, hsa
ucagagaugaaacucccagaggugucagagguggcugugccagaggugcggcuuccagaggugc

SEQ ID NO: 223195 - RNA, 64 nt, hsa
cacuccuggacaaccuggacccagaugcaagacacugugccaccgccuucccugacacccuggg

SEQ ID NO: 223196 - RNA, 57 nt, hsa
uacggccuuuggacaucuaacgagcagcugugccagaggcuggaccacacaggagaa

SEQ ID NO: 223197 - RNA, 64 nt, hsa
uggcccccacccugcgggaggccuccccaugugccugugccaagagacagacagagaaggcugc

SEQ ID NO: 223198 - RNA, 54 nt, hsa
ccaggugucaagaagccuaggggucugugccaggccagucacaccgaccaccac

SEQ ID NO: 223199 - RNA, 64 nt, hsa
uaauuuugaagcauuugaaaaagccaaaguguacgguagaaauuucuacaaaaugaauauuauc

SEQ ID NO: 223200 - RNA, 64 nt, hsa
uaccuaaaaauuguuagaaauuggugggaaaauagguagaaaccaaggaagcagacacaacaug

SEQ ID NO: 223201 - RNA, 64 nt, hsa
guugcagacugcugacuucuuauuguguccucgugguagaaagaggguuagagccucuggcaug

SEQ ID NO: 223202 - RNA, 64 nt, hsa
guuaacauucauaaauggugggggcccuuacugugguagaaaccauugucacugcaaggcagcc

SEQ ID NO: 223203 - RNA, 64 nt, hsa
cuaaacucaucugauccuuucaucagcccuagaggguagaaaguuuucccaauucuacacaugg

SEQ ID NO: 223204 - RNA, 64 nt, hsa
cagagugcccagcugucuggaaugaagugacagagguagaaaacaguaggcccucacaggaggc

SEQ ID NO: 223205 - RNA, 64 nt, hsa
caaauuuauagcaaggcacugaauuuuaucuuuugguagaaauguguuuauuuaacacacacac

SEQ ID NO: 223206 - RNA, 64 nt, hsa
cccuugaagaaagcaguuauauucccauuuuauagguagaaauauuauaauagagagauuaagu

SEQ ID NO: 223207 - RNA, 64 nt, hsa
guugaggggugcaguuucugguguaggccagguagguagaaagugaggaacaggguugccucuu

SEQ ID NO: 223208 - RNA, 64 nt, hsa
uguugcccuggggcuuaucugauuaugggacgaggguagaaaguaagaagcacuuuugaauuug

SEQ ID NO: 223209 - RNA, 64 nt, hsa
agcagauuggaugggcagguggagaaugccuggggguagaaauguuagaucuugcaacaucaga

SEQ ID NO: 223210 - RNA, 64 nt, hsa
auaauuaagucuaugcaaauaucagagaauuuaugguagaaauauauaagguacugacacuuca

SEQ ID NO: 223211 - RNA, 64 nt, hsa
gagugcuaaguauagaaaaucugaaacuaaaguugguagaaaaguuauuuguauagaacuuuaa

SEQ ID NO: 223212 - RNA, 63 nt, hsa
ugucugcaaacauuacuaaucuagguccuauuacuaaucuaugucugcaaacauuaaaggaau

SEQ ID NO: 223213 - RNA, 63 nt, hsa
gaccauuacuaaggucuaugucugcaaacauuacuaaucuagguccuauuacuaaucuauguc

SEQ ID NO: 223214 - RNA, 63 nt, hsa
uaaguugauucgguauccccccaucuugcuucccuaaucuauggucgggagacagcaucaggg

SEQ ID NO: 223215 - RNA, 63 nt, hsa
gggacaggaguccacuuuguuucguggggaggucuaaucuagauaucgacuuguuuuugcaca

SEQ ID NO: 223216 - RNA, 63 nt, hsa
cauauauuugugguuuaagugugagaaaucuugcuaaucuauaugccacagaagagcaaaauu

SEQ ID NO: 223217 - RNA, 63 nt, hsa
aucaugaauucccuuguuucaaaagacuugcagcuaaucuaaaaaacuggugauauuuaauau

SEQ ID NO: 223218 - RNA, 63 nt, hsa
uuauaggccacuguuuuguaauguaguacauuucuaaucuauuauuccuaaccuauuauaacu

SEQ ID NO: 223219 - RNA, 63 nt, hsa
caugacuguucuuuauacacuaaaagcaugcaucuaaucuaauaguccucuuauuaugcuuuu

SEQ ID NO: 223220 - RNA, 64 nt, hsa
augaaacuagucuuaacuguugagccuuuccuuucauauccacagaagacacugucucaaaugu

SEQ ID NO: 223221 - RNA, 64 nt, hsa
cuuggacugcauuuuaagcccugcaggcuucugccauauccaugagaagauucuacacuagcgu

SEQ ID NO: 223222 - RNA, 64 nt, hsa
aaccacacauauugauggagucugcauuccaccacauauccacccuugagaaguaugucaaaag

SEQ ID NO: 223223 - RNA, 64 nt, hsa
auuuuauuuuuuucagggggucuuuuuuuuaauacauauccaauaaugccuuccaucugaaugu

SEQ ID NO: 223224 - RNA, 64 nt, hsa
aaggguuuagagacuccccuuggcucccagucaccauauccaguguuguguaaagagacuggcc

SEQ ID NO: 223225 - RNA, 64 nt, hsa
acaauccugggcauugacucugugacauuucuagcauauccaaggcaccaccagugauuucucc

SEQ ID NO: 223226 - RNA, 64 nt, hsa
uuccacacaggauuccguuggugaaccuguaaaaacaaaacaaacaaaacaaaacaaaaaagac

SEQ ID NO: 223227 - RNA, 64 nt, hsa
ggauuccguuggugaaccuguaaaaacaaaacaaacaaaacaaaacaaaaaagacaaaaccuaa

SEQ ID NO: 223228 - RNA, 64 nt, hsa
ccguuggugaaccuguaaaaacaaaacaaacaaaacaaaacaaaaaagacaaaaccuaaaacug

SEQ ID NO: 223229 - RNA, 64 nt, hsa
uccagccugguuacagagcaagacucugucucaaacaaaacaaaacaaaacaaaaacacacuac

SEQ ID NO: 223230 - RNA, 64 nt, hsa
ccugguuacagagcaagacucugucucaaacaaaacaaaacaaaacaaaaacacacuacuguau

SEQ ID NO: 223231 - RNA, 64 nt, hsa
uuacagagcaagacucugucucaaacaaaacaaaacaaaacaaaaacacacuacuguauuuugg

SEQ ID NO: 223232 - RNA, 64 nt, hsa
cucauuacuguagugcugagguuauugaaguuauacaaaacacaucucagucucuguuucuugg

SEQ ID NO: 223233 - RNA, 64 nt, hsa
gaguugaauauugaacucuaacaguuuucuacauacaaaacacagugucaugaagguuauucau

SEQ ID NO: 223234 - RNA, 64 nt, hsa
ggccauuauuuucuaauccauuuuuaaaauacagacaaaacacuucuuuaaacagaacaagaau

SEQ ID NO: 223235 - RNA, 64 nt, hsa
guauaaggagagaaauaacuuuaaaguuuauuagacaaaacagaguauagaugccaagaugucu

SEQ ID NO: 223236 - RNA, 64 nt, hsa
cagagcgacacucggucucaaaaaacaaaacaaaacaaaacaaaauuagagauugggucuuucc

SEQ ID NO: 223237 - RNA, 64 nt, hsa
ggugacagagcgacacucggucucaaaaaacaaaacaaaacaaaacaaaauuagagauuggguc

SEQ ID NO: 223238 - RNA, 64 nt, hsa
gccugggugacagagcgacacucggucucaaaaaacaaaacaaaacaaaacaaaauuagagauu

SEQ ID NO: 223239 - RNA, 64 nt, hsa
agucucagaaaaggcuaacaauuuuauauagaggacaaaacagcauuaaacucaucaguugcaa

SEQ ID NO: 223240 - RNA, 64 nt, hsa
guacaaaggggaaagaacauaaagguaaaacaaaacaaaacaacauuuugagaacaaagaugac

SEQ ID NO: 223241 - RNA, 64 nt, hsa
caucuguacaaaggggaaagaacauaaagguaaaacaaaacaaaacaacauuuugagaacaaag

SEQ ID NO: 223242 - RNA, 64 nt, hsa
uccacaucgugcagucgugucauaaaaaaacaaaacaaaacaaaaaaacacuaggaguccacuc

SEQ ID NO: 223243 - RNA, 64 nt, hsa
ccagauccacaucgugcagucgugucauaaaaaaacaaaacaaaacaaaaaaacacuaggaguc

SEQ ID NO: 223244 - RNA, 64 nt, hsa
cuauguugguuucaguggcuggaauuaaaacaaaacaaaacaaacuuccaaacaguguguuggu

SEQ ID NO: 223245 - RNA, 64 nt, hsa
aacuucuauguugguuucaguggcuggaauuaaaacaaaacaaaacaaacuuccaaacagugug

SEQ ID NO: 223246 - RNA, 64 nt, hsa
uaaccaguagcugaucuuaaggcuuuuuuaaaaaacaaaacaaaacaacaaaaaaaaaucuuua

SEQ ID NO: 223247 - RNA, 64 nt, hsa
aguagcugaucuuaaggcuuuuuuaaaaaacaaaacaaaacaacaaaaaaaaaucuuuauaaga

SEQ ID NO: 223248 - RNA, 64 nt, hsa
caguuuggacuacagagugagacuccaucucaaaacaaaacaaaacaacaacagcaaaaaacaa

SEQ ID NO: 223249 - RNA, 64 nt, hsa
uggacuacagagugagacuccaucucaaaacaaaacaaaacaacaacagcaaaaaacaacaaaa

SEQ ID NO: 223250 - RNA, 64 nt, hsa
ucaaaacaaaacaaaacaacaacagcaaaaaacaacaaaacaaaacacaaauacucucacaggg

SEQ ID NO: 223251 - RNA, 64 nt, hsa
acaaaacaaaacaacaacagcaaaaaacaacaaaacaaaacacaaauacucucacagggcaugg

SEQ ID NO: 223252 - RNA, 64 nt, hsa
aauuuagagcuuucaaacuggaaaaaaaaaugaaacaaaacaaauacaccaagaccaaaauagg

SEQ ID NO: 223253 - RNA, 64 nt, hsa
ccagggagcuguagugauuggaacccacguuugcacaaaacauuuuugcagaaggaaagucaac

SEQ ID NO: 223254 - RNA, 64 nt, hsa
gaugacuuaguacaaaguuucaauuuguuuccccacaaaacaaagcaauucuuucaagucaguu

SEQ ID NO: 223255 - RNA, 64 nt, hsa
uaaggucugaauaauagcagaaaaaccaacaucuacaaaacauuaaacuaguguuauacuugau

SEQ ID NO: 223256 - RNA, 64 nt, hsa
aaauuauucagauuuuauuuuuguaucugugguaacaaaacauuaaccaaaagauuuucugucc

SEQ ID NO: 223257 - RNA, 64 nt, hsa
guauaggaggugagcuaguuaacaaacuuguaccacaaaacaauaucgcuuuaacuuuucuaaa

SEQ ID NO: 223258 - RNA, 64 nt, hsa
guuuucuccuucccaaggcagcuggauugaaaaaacaaaacaaaacaaaaaaacccaggggcgu

SEQ ID NO: 223259 - RNA, 64 nt, hsa
cuccuucccaaggcagcuggauugaaaaaacaaaacaaaacaaaaaaacccaggggcgucaguc

SEQ ID NO: 223260 - RNA, 64 nt, hsa
aacuuugaagauuguuuguaucuuuuuuuaaaaaacaaaacaaaacaaaaauccccaaaauaua

SEQ ID NO: 223261 - RNA, 64 nt, hsa
ugaagauuguuuguaucuuuuuuuaaaaaacaaaacaaaacaaaaauccccaaaauauauagaa

SEQ ID NO: 223262 - RNA, 64 nt, hsa
aagaaguuggauggguggguacuauucugauuacacaaaacaaaugccacacaucacccuuacc

SEQ ID NO: 223263 - RNA, 64 nt, hsa
uucuuacaggcacaaaaugauggacccaaugcacacaaaacaacccuagaguguuguugagaau

SEQ ID NO: 223264 - RNA, 64 nt, hsa
uacacaaagaccaucgagacggccauucuuguuuacaaaacacuuaccaagaaagcacuuugua

SEQ ID NO: 223265 - RNA, 64 nt, hsa
guuuaagcucaaguuugcugugcucucugcagcuacaaaacaucuuggcauauuuaagaguggc

SEQ ID NO: 223266 - RNA, 64 nt, hsa
caauuuugccaauaccaaguuucaauuuguuuuuacaaaacauuauucaagccacuagaauuau

SEQ ID NO: 223267 - RNA, 64 nt, hsa
ugcaagauaaaaggucuugggaaaacaaaacaaaacaaaacaaaccucccuuccccagcagggc

SEQ ID NO: 223268 - RNA, 64 nt, hsa
ucuggugcaagauaaaaggucuugggaaaacaaaacaaaacaaaacaaaccucccuuccccagc

SEQ ID NO: 223269 - RNA, 64 nt, hsa
aauucucuggugcaagauaaaaggucuugggaaaacaaaacaaaacaaaacaaaccucccuucc

SEQ ID NO: 223270 - RNA, 64 nt, hsa
aaccgaacucaaggcuuaauuaacggggcacuaaacaaaacaaccaauaaagucaccagcagua

SEQ ID NO: 223271 - RNA, 64 nt, hsa
agccacuucauauaaagguuacuccagaccauguacaaaacacagccacucuugaaaucacaag

SEQ ID NO: 223272 - RNA, 64 nt, hsa
uucuagaaguuaaacaagagcuaagacaaacaaaacaaaacacagcuuaucuaaucuaaugaga

SEQ ID NO: 223273 - RNA, 64 nt, hsa
uaguuuucuagaaguuaaacaagagcuaagacaaacaaaacaaaacacagcuuaucuaaucuaa

SEQ ID NO: 223274 - RNA, 64 nt, hsa
uaaguaguaucuuucucucuuucuuaugaacaaaacaaaacaacaacaaaaaacaaacaaacaa

SEQ ID NO: 223275 - RNA, 64 nt, hsa
acggauaaguaguaucuuucucucuuucuuaugaacaaaacaaaacaacaacaaaaaacaaaca

SEQ ID NO: 223276 - RNA, 64 nt, hsa
cuggauauuauucuuguaguuuaccucuuuaaaaacaaaacaaaacaaaacaaaaaacuccccu

SEQ ID NO: 223277 - RNA, 64 nt, hsa
uauuauucuuguaguuuaccucuuuaaaaacaaaacaaaacaaaacaaaaaacuccccuuccuc

SEQ ID NO: 223278 - RNA, 64 nt, hsa
uucuuguaguuuaccucuuuaaaaacaaaacaaaacaaaacaaaaaacuccccuuccucacugc

SEQ ID NO: 223279 - RNA, 64 nt, hsa
ugucuguuggauaauggcuguaaaauguuuaaaaacaaaacaaaacaaaaaagaggcacuaguc

SEQ ID NO: 223280 - RNA, 64 nt, hsa
guuggauaauggcuguaaaauguuuaaaaacaaaacaaaacaaaaaagaggcacuagucuaucu

SEQ ID NO: 223281 - RNA, 64 nt, hsa
acagagucagacuccgucccaaaaaaacaaacaaacaaaacaaaacaaaaaaaaacagaaguua

SEQ ID NO: 223282 - RNA, 64 nt, hsa
gucagacuccgucccaaaaaaacaaacaaacaaaacaaaacaaaaaaaaacagaaguuacaaau

SEQ ID NO: 223283 - RNA, 64 nt, hsa
ccagccuggaugacagagugagaccuugucucaaacaaaacaaaacaaaaaugaaauguucuag

SEQ ID NO: 223284 - RNA, 64 nt, hsa
cuggaugacagagugagaccuugucucaaacaaaacaaaacaaaaaugaaauguucuaguuuug

SEQ ID NO: 223285 - RNA, 64 nt, hsa
agaagccuaagaaguuauauauuuaaucagguagacaaaacaguucaaagcauaagguccaugg

SEQ ID NO: 223286 - RNA, 64 nt, hsa
uucuccuacuuuacacucucuguacaaaaacaaaacaaaacaacaacaauacaacaagaacaac

SEQ ID NO: 223287 - RNA, 64 nt, hsa
ggaauuucuccuacuuuacacucucuguacaaaaacaaaacaaaacaacaacaauacaacaaga

SEQ ID NO: 223288 - RNA, 64 nt, hsa
aauaggauucugugauaauauuuaaauggcaaaaacaaaacauaauuuugugcaauuaacaaag

SEQ ID NO: 223289 - RNA, 64 nt, hsa
gggaccagagagagcuuggaauguuaaaaacaaaacaaaacaaaaaaaaacaaggagaaguugu

SEQ ID NO: 223290 - RNA, 64 nt, hsa
gauaggggaccagagagagcuuggaauguuaaaaacaaaacaaaacaaaaaaaaacaaggagaa

SEQ ID NO: 223291 - RNA, 64 nt, hsa
ugaggauaggaguuauauauucuuauaagacaaaacaaaacaggacaauguuacaagaguaaga

SEQ ID NO: 223292 - RNA, 64 nt, hsa
cucugugaggauaggaguuauauauucuuauaagacaaaacaaaacaggacaauguuacaagag

SEQ ID NO: 223293 - RNA, 64 nt, hsa
auuuacaaauuaaaucuucuggagggucgcuaucacaaaacauugacgauguauguauuauaau

SEQ ID NO: 223294 - RNA, 64 nt, hsa
gcaacaacacgaagaugauaccaaaacaaggaccacaaaacaacuagccaugaugggagacagg

SEQ ID NO: 223295 - RNA, 64 nt, hsa
gaauagaaacacauuuucuggcuagcagaaaaaaacaaaacaaaacuguuguuucucuuucuug

SEQ ID NO: 223296 - RNA, 64 nt, hsa
cacaaggaaucacacguggugcagcuaaaacaaaacaaaacaugagcaaacacaaaacccaagg

SEQ ID NO: 223297 - RNA, 64 nt, hsa
aauggcacaaggaaucacacguggugcagcuaaaacaaaacaaaacaugagcaaacacaaaacc

SEQ ID NO: 223298 - RNA, 64 nt, hsa
gccugggcgacagagcgagacucugccucaaaaaacaaaacaaaacaaaacacucacccaucaa

SEQ ID NO: 223299 - RNA, 64 nt, hsa
ggcgacagagcgagacucugccucaaaaaacaaaacaaaacaaaacacucacccaucaacgaau

SEQ ID NO: 223300 - RNA, 64 nt, hsa
cagagcgagacucugccucaaaaaacaaaacaaaacaaaacacucacccaucaacgaauauaga

SEQ ID NO: 223301 - RNA, 64 nt, hsa
ucacaaguccugugaggcaaaaaaacaaaacaaaacaaaacaaccaaacaaauacaaucuaacu

SEQ ID NO: 223302 - RNA, 64 nt, hsa
cuauuucacaaguccugugaggcaaaaaaacaaaacaaaacaaaacaaccaaacaaauacaauc

SEQ ID NO: 223303 - RNA, 64 nt, hsa
uaagacuauuucacaaguccugugaggcaaaaaaacaaaacaaaacaaaacaaccaaacaaaua

SEQ ID NO: 223304 - RNA, 64 nt, hsa
aaaauguguaaggcuugcuaaaaaacaaaacaaaacaaaacacaguccugcauacucaccacca

SEQ ID NO: 223305 - RNA, 64 nt, hsa
aaaagaaaauguguaaggcuugcuaaaaaacaaaacaaaacaaaacacaguccugcauacucac

SEQ ID NO: 223306 - RNA, 64 nt, hsa
cauacaaaagaaaauguguaaggcuugcuaaaaaacaaaacaaaacaaaacacaguccugcaua

SEQ ID NO: 223307 - RNA, 64 nt, hsa
gcuugaccugguuaaauacugucuuaaagcucauacaaaacaaauaggcuuuuccauaaguggc

SEQ ID NO: 223308 - RNA, 64 nt, hsa
ucuuaaaacuuguuuguggucagcacaacaaggaacaaaacaaagcuuugaaaaaacuuuaaca

SEQ ID NO: 223309 - RNA, 64 nt, hsa
agaagccucggguaacacugaaaaacaaaacaaaacaaaacaaaaacaggaaaaaaacaaaaaa

SEQ ID NO: 223310 - RNA, 64 nt, hsa
uucagagaagccucggguaacacugaaaaacaaaacaaaacaaaacaaaaacaggaaaaaaaca

SEQ ID NO: 223311 - RNA, 64 nt, hsa
agcucuucagagaagccucggguaacacugaaaaacaaaacaaaacaaaacaaaaacaggaaaa

SEQ ID NO: 223312 - RNA, 64 nt, hsa
agaaagcugcaauuauccgccaacugcauuuaaaacaaaacaaaacagaaaaaucaaaauaaca

SEQ ID NO: 223313 - RNA, 64 nt, hsa
gcugcaauuauccgccaacugcauuuaaaacaaaacaaaacagaaaaaucaaaauaacauugac

SEQ ID NO: 223314 - RNA, 64 nt, hsa
uaauuguuuuaaauuuuucauaggggaguuuuggacaaaacagucacuggggagaucacugcca

SEQ ID NO: 223315 - RNA, 64 nt, hsa
uuugggacaugagccagaguuuaaaagggaaccaacaaaacacuauaacuuaaaaggauggggu

SEQ ID NO: 223316 - RNA, 64 nt, hsa
ugaacauaagguauagcauuugguuuuuaagaaaacaaaacauuaagacgcaacucauuuuaua

SEQ ID NO: 223317 - RNA, 64 nt, hsa
agaucaccacagaauccauuuuuuucccaguuccacaaaacacucuguuugccuucaguuuuua

SEQ ID NO: 223318 - RNA, 64 nt, hsa
gagaaggaaacuaaggacuuggcuccaaaacaaaacaaaacaaaaucuggagaugcugaauuuu

SEQ ID NO: 223319 - RNA, 64 nt, hsa
uuacugagaaggaaacuaaggacuuggcuccaaaacaaaacaaaacaaaaucuggagaugcuga

SEQ ID NO: 223320 - RNA, 64 nt, hsa
ugcacagaauaucaccauugcaguucaaaacaaaacaaaacaaaaagucuuuuguuugugaaca

SEQ ID NO: 223321 - RNA, 64 nt, hsa
uuugcugcacagaauaucaccauugcaguucaaaacaaaacaaaacaaaaagucuuuuguuugu

SEQ ID NO: 223322 - RNA, 64 nt, hsa
gggacugggacuccagaaccauuaauaaaacaaaacaaaacaaagcaaaauauugaugaucagg

SEQ ID NO: 223323 - RNA, 64 nt, hsa
ggguagggacugggacuccagaaccauuaauaaaacaaaacaaaacaaagcaaaauauugauga

SEQ ID NO: 223324 - RNA, 64 nt, hsa
uucugccaugaggauuucucuuuaggccagaaguacaaaacaaaaaaaccaauggauuuuaacc

SEQ ID NO: 223325 - RNA, 64 nt, hsa
acacugguugacaguauaauuuucccaaagggcaacaaaacauacagauagcaaauuuauauuc

SEQ ID NO: 223326 - RNA, 64 nt, hsa
uuccguuaggccaauaaaagaagggccucacaagacaaaacaggagccagaaguaaggacugaa

SEQ ID NO: 223327 - RNA, 64 nt, hsa
uuaagagaaaucaucaguuaagaaaucuacuuuaacaaaacaaaaaggagaaaaaguaauaaug

SEQ ID NO: 223328 - RNA, 64 nt, hsa
aaaaaaaaagcgaaagacugcaguugugcuaaaaacaaaacaaaacaaacaaacaaacaaaaaa

SEQ ID NO: 223329 - RNA, 64 nt, hsa
aaaagcgaaagacugcaguugugcuaaaaacaaaacaaaacaaacaaacaaacaaaaaaguaaa

SEQ ID NO: 223330 - RNA, 64 nt, hsa
cuuaccaaaucuucuccuaugcauuuuuaauaugacaaaacaaauuuuaaaagauuugaaauaa

SEQ ID NO: 223331 - RNA, 64 nt, hsa
cccauauaacuaagacauaugcauuuaugggaagacaaaacaagaaugaaacacuuauacugac

SEQ ID NO: 223332 - RNA, 64 nt, hsa
uucugugaagaaugaaguggaggaaguaacuuuuacaaaacauacccaguguuugggguguuuc

SEQ ID NO: 223333 - RNA, 64 nt, hsa
acagagccaacucacucuuaugaaaugggcuuuaacaaaacaagaaagaaacguacuuaacugu

SEQ ID NO: 223334 - RNA, 64 nt, hsa
uugaaaagccuuucuguugcaacuaugaaugaaaacaaaacaccacaaaacagacuucacuaac

SEQ ID NO: 223335 - RNA, 64 nt, hsa
uuucuguugcaacuaugaaugaaaacaaaacaccacaaaacagacuucacuaacacagaaaaac

SEQ ID NO: 223336 - RNA, 64 nt, hsa
agcaugugacuaguuacaaaagcaauaaauugaaacaaaacaaaacaaaacaaaacuuguuucu

SEQ ID NO: 223337 - RNA, 64 nt, hsa
gugacuaguuacaaaagcaauaaauugaaacaaaacaaaacaaaacaaaacuuguuucuuaaaa

SEQ ID NO: 223338 - RNA, 64 nt, hsa
uaguuacaaaagcaauaaauugaaacaaaacaaaacaaaacaaaacuuguuucuuaaaaaugcg

SEQ ID NO: 223339 - RNA, 64 nt, hsa
aaugaacucccccaaacauggcuguggagagacaacaaaacaaaacaaagcacaaaagucucug

SEQ ID NO: 223340 - RNA, 64 nt, hsa
acucccccaaacauggcuguggagagacaacaaaacaaaacaaagcacaaaagucucugccaac

SEQ ID NO: 223341 - RNA, 64 nt, hsa
aucacauucguuucccagugaaaagcaaaccagaacaaaacaaaaagccaccgcaauaauucgg

SEQ ID NO: 223342 - RNA, 64 nt, hsa
augggauuggugcugauugaaagaacaaaacaaaacaaaacaaacacaaacaaacaaaaaaccu

SEQ ID NO: 223343 - RNA, 64 nt, hsa
cauuuaugggauuggugcugauugaaagaacaaaacaaaacaaaacaaacacaaacaaacaaaa

SEQ ID NO: 223344 - RNA, 64 nt, hsa
uagaucauuuaugggauuggugcugauugaaagaacaaaacaaaacaaaacaaacacaaacaaa

SEQ ID NO: 223345 - RNA, 64 nt, hsa
auucaauacaugguuuuuaacaaaacagaacaaaacaaaacaauacagaaucucucccugaguu

SEQ ID NO: 223346 - RNA, 64 nt, hsa
uuuaaauucaauacaugguuuuuaacaaaacagaacaaaacaaaacaauacagaaucucucccu

SEQ ID NO: 223347 - RNA, 64 nt, hsa
uuuacuaaaauuuaaauucaauacaugguuuuuaacaaaacagaacaaaacaaaacaauacaga

SEQ ID NO: 223348 - RNA, 64 nt, hsa
uauuacagugcuguaacugggugguccuuuuuaaacaaaacauuauuugcaaaacagaggguau

SEQ ID NO: 223349 - RNA, 64 nt, hsa
guugcuacaaagguaaauaauggagagauuugguacaaaacaacaaaauauauauauauucuca

SEQ ID NO: 223350 - RNA, 64 nt, hsa
uuaaggauugucuuaaaguuccuuagccagcaaaacaaaacaaaacaaaacaaacaaaugaaaa

SEQ ID NO: 223351 - RNA, 64 nt, hsa
gauugucuuaaaguuccuuagccagcaaaacaaaacaaaacaaaacaaacaaaugaaaaacguu

SEQ ID NO: 223352 - RNA, 64 nt, hsa
ucuuaaaguuccuuagccagcaaaacaaaacaaaacaaaacaaacaaaugaaaaacguuuaaaa

SEQ ID NO: 223353 - RNA, 64 nt, hsa
aaugaggaagauguguucauuguggacucuaaaaacaaaacaaaacacaaaauccccuguucaa

SEQ ID NO: 223354 - RNA, 64 nt, hsa
ggaagauguguucauuguggacucuaaaaacaaaacaaaacacaaaauccccuguucaaauaaa

SEQ ID NO: 223355 - RNA, 64 nt, hsa
aguaaccauuguuaaggguugggggaaagcauggacaaaacaucacuggaaacaaaggcuguaa

SEQ ID NO: 223356 - RNA, 64 nt, hsa
ucucuuggaauguguauuguuuuuauuuugcgaaacaaaacaaaacaaaaaaaaaagcuuggaa

SEQ ID NO: 223357 - RNA, 64 nt, hsa
uggaauguguauuguuuuuauuuugcgaaacaaaacaaaacaaaaaaaaaagcuuggaacucca

SEQ ID NO: 223358 - RNA, 64 nt, hsa
uaaauuggguucaugaugcagucuccucuuuaaaacaaaacaaaacaaaacaaaacuauacuug

SEQ ID NO: 223359 - RNA, 64 nt, hsa
uggguucaugaugcagucuccucuuuaaaacaaaacaaaacaaaacaaaacuauacuugaacaa

SEQ ID NO: 223360 - RNA, 64 nt, hsa
ucaugaugcagucuccucuuuaaaacaaaacaaaacaaaacaaaacuauacuugaacaaaaggg

SEQ ID NO: 223361 - RNA, 64 nt, hsa
cguuucaggugcuagggacuuaaugaaaaacaggacaaaacaauuccuuuuuguggcccaggua

SEQ ID NO: 223362 - RNA, 64 nt, hsa
gugacagagccaaacuccgucaaaaaaaaacaaaacaaaacaaaaaaaagacaugggagagaug

SEQ ID NO: 223363 - RNA, 64 nt, hsa
cuggagugacagagccaaacuccgucaaaaaaaaacaaaacaaaacaaaaaaaagacaugggag

SEQ ID NO: 223364 - RNA, 64 nt, hsa
aggacgccaguaaaaaaacaaaaacaaaaacaaaacaaaacauaaaauauaaacaaucaaaauc

SEQ ID NO: 223365 - RNA, 64 nt, hsa
aauggaggacgccaguaaaaaaacaaaaacaaaaacaaaacaaaacauaaaauauaaacaauca

SEQ ID NO: 223366 - RNA, 64 nt, hsa
cagcuugggcaacagagugagacuccaucucaaaacaaaacaaaacaaaacaaaacaaaaaaac

SEQ ID NO: 223367 - RNA, 64 nt, hsa
ugggcaacagagugagacuccaucucaaaacaaaacaaaacaaaacaaaacaaaaaaacccggc

SEQ ID NO: 223368 - RNA, 64 nt, hsa
aacagagugagacuccaucucaaaacaaaacaaaacaaaacaaaacaaaaaaacccggcuuugc

SEQ ID NO: 223369 - RNA, 64 nt, hsa
agugagacuccaucucaaaacaaaacaaaacaaaacaaaacaaaaaaacccggcuuugcugcuu

SEQ ID NO: 223370 - RNA, 64 nt, hsa
gggagaagauauucucgugaaagaaaaaaacaaaacaaaacaacagugcuuuuuucaaaccuga

SEQ ID NO: 223371 - RNA, 64 nt, hsa
uccaagggagaagauauucucgugaaagaaaaaaacaaaacaaaacaacagugcuuuuuucaaa

SEQ ID NO: 223372 - RNA, 64 nt, hsa
gaaaugacaacuuuauuccacauaaacaaggguaacaaaacaagcugcuuaaauauaccaguca

SEQ ID NO: 223373 - RNA, 64 nt, hsa
cucaucaaacucauauauuccuccuggcuuccuuacaaaacaagccuuucaaacaaucauuguc

SEQ ID NO: 223374 - RNA, 64 nt, hsa
ugagauuaaaagaagacaauuauucaaagccaucacaaaacacuauaagacugaccaaaauuua

SEQ ID NO: 223375 - RNA, 64 nt, hsa
cagcccaggcugcagucuccacaccaaacagucaacaaaacacaaacccugaaggaaaaccuuu

SEQ ID NO: 223376 - RNA, 64 nt, hsa
cugggaacacagcgagacccucucauuaaaaacaacaaaacaaaacaauuccagucuuggagua

SEQ ID NO: 223377 - RNA, 64 nt, hsa
aacacagcgagacccucucauuaaaaacaacaaaacaaaacaauuccagucuuggaguagucua

SEQ ID NO: 223378 - RNA, 64 nt, hsa
ucuuacuguaaaaaaaagugcacugaacuucaaaacaaaacaaaaaacaacaacaacaaaaaac

SEQ ID NO: 223379 - RNA, 64 nt, hsa
uguaauagaugcacgacaggcauaaacaagaacaacaaaacagguguuauguguacauucggag

SEQ ID NO: 223380 - RNA, 64 nt, hsa
cuaaugcuuuguuuaaaaaaacgaaaaaaacaaaacaaaacaaaaaaacaugagcagugguguu

SEQ ID NO: 223381 - RNA, 64 nt, hsa
uaacacuaaugcuuuguuuaaaaaaacgaaaaaaacaaaacaaaacaaaaaaacaugagcagug

SEQ ID NO: 223382 - RNA, 64 nt, hsa
accacuauacauaguuucuuuuguacuugaauauacaaaacaugaacacagugccauaugaaua

SEQ ID NO: 223383 - RNA, 64 nt, hsa
aagauggauagcacauaauggcacuugucuauguacaaaacacaaacuuuagagcaagaagacc

SEQ ID NO: 223384 - RNA, 64 nt, hsa
cucuuaucuuaaaaaguaaacaaaacaaaacaaaacaaaacaaaaaacuagauauguaauuucu

SEQ ID NO: 223385 - RNA, 64 nt, hsa
caggacucuuaucuuaaaaaguaaacaaaacaaaacaaaacaaaacaaaaaacuagauauguaa

SEQ ID NO: 223386 - RNA, 64 nt, hsa
ugcggcaggacucuuaucuuaaaaaguaaacaaaacaaaacaaaacaaaacaaaaaacuagaua

SEQ ID NO: 223387 - RNA, 64 nt, hsa
agaggugcggcaggacucuuaucuuaaaaaguaaacaaaacaaaacaaaacaaaacaaaaaacu

SEQ ID NO: 223388 - RNA, 64 nt, hsa
gcuuuacuucuuuugcaugcacuuuaaaaacaaaacaaaacauuuuucagguuccaaggaagag

SEQ ID NO: 223389 - RNA, 64 nt, hsa
aaaaggcuuuacuucuuuugcaugcacuuuaaaaacaaaacaaaacauuuuucagguuccaagg

SEQ ID NO: 223390 - RNA, 64 nt, hsa
ggagacagagcaagacuccaucucaaaaacaaaaacaaaacaaaacaacaacaaaaaaagaagu

SEQ ID NO: 223391 - RNA, 64 nt, hsa
cagagcaagacuccaucucaaaaacaaaaacaaaacaaaacaacaacaaaaaaagaaguuaaau

SEQ ID NO: 223392 - RNA, 64 nt, hsa
agugccccaaauggaaaaaagauacucacacagaacaaaacaguucuuggucuuguucuugguc

SEQ ID NO: 223393 - RNA, 64 nt, hsa
aagaguuuuguauaugucugauaccguuguuauaacaaaacaaauuuuuuuacuauaguuuuuu

SEQ ID NO: 223394 - RNA, 64 nt, hsa
uuguguuuauauuuccuguaagugaauaaauaaaacaaaacaaaacaaaaaaaacuugugccug

SEQ ID NO: 223395 - RNA, 64 nt, hsa
uuuauauuuccuguaagugaauaaauaaaacaaaacaaaacaaaaaaaacuugugccugauaag

SEQ ID NO: 223396 - RNA, 64 nt, hsa
ccagccugggugacagagcgagacuaucucagaaacaaaacaaaacaaaacaacaaaaaaagaa

SEQ ID NO: 223397 - RNA, 64 nt, hsa
cugggugacagagcgagacuaucucagaaacaaaacaaaacaaaacaacaaaaaaagaaaaggc

SEQ ID NO: 223398 - RNA, 64 nt, hsa
ugacagagcgagacuaucucagaaacaaaacaaaacaaaacaacaaaaaaagaaaaggcagagu

SEQ ID NO: 223399 - RNA, 64 nt, hsa
ggcacugcaauuuuauuuuugaguugggacuuuuacaaaacacuuuuuucccuggagucuucuc

SEQ ID NO: 223400 - RNA, 64 nt, hsa
cacaaccagucuuuuuguauuuauuguuacugagacaaaacaguacucacugaguguuuuucag

SEQ ID NO: 223401 - RNA, 64 nt, hsa
caaaaacauucacaaauauagaaaaguauacaaaacaaaacaguaagauugucuguaaucacau

SEQ ID NO: 223402 - RNA, 64 nt, hsa
uauuucaaaaacauucacaaauauagaaaaguauacaaaacaaaacaguaagauugucuguaau

SEQ ID NO: 223403 - RNA, 56 nt, hsa
aaggauuuggcaugcuguaaaacaaaacaaaacaaaauaaaacaaaaaaaaggaag

SEQ ID NO: 223404 - RNA, 51 nt, hsa
aaggauuuggcaugcuguaaaacaaaacaaaacaaaauaaaacaaaaaaaa

SEQ ID NO: 223405 - RNA, 64 nt, hsa
ugggcgacacagcgagacuccaucucaaaacaaaacaaaacaaaauuagcugagcaugguggug

SEQ ID NO: 223406 - RNA, 64 nt, hsa
gagccugggcgacacagcgagacuccaucucaaaacaaaacaaaacaaaauuagcugagcaugg

SEQ ID NO: 223407 - RNA, 64 nt, hsa
ucaacaagaguaaaacuucaucucaaaaaacaaaacaaaacaaaaacaacaacaaaaaacaaaa

SEQ ID NO: 223408 - RNA, 64 nt, hsa
ccuggucaacaagaguaaaacuucaucucaaaaaacaaaacaaaacaaaaacaacaacaaaaaa

SEQ ID NO: 223409 - RNA, 64 nt, hsa
ucuccccauucugugcccuacuauuuucaacaaaacaaaacaaacaagcaaaaaacacaaaaac

SEQ ID NO: 223410 - RNA, 64 nt, hsa
ucuccucuccccauucugugcccuacuauuuucaacaaaacaaaacaaacaagcaaaaaacaca

SEQ ID NO: 223411 - RNA, 64 nt, hsa
gcaaguuugcuggggaguuugauaaaaguauaaaacaaaacaaaaaaagccucgguauaauuuu

SEQ ID NO: 223412 - RNA, 64 nt, hsa
aagucacaagcuuucggaugggcgguggcuuuucacaaaacauuuagcucaucuuauucucucu

SEQ ID NO: 223413 - RNA, 64 nt, hsa
uucuuuuuccuuuuuuuuuaaaaaaacaaaacaaacaaaacaccuugaaucaaguuuguuugua

SEQ ID NO: 223414 - RNA, 64 nt, hsa
ccuuugucuuucuuuuuccuuuuuuuuuaaaaaaacaaaacaaacaaaacaccuugaaucaagu

SEQ ID NO: 223415 - RNA, 64 nt, hsa
aguauguucccaaaucugugcuggcauugaaaggacaaaacauuauacuaguggguuuuucuac

SEQ ID NO: 223416 - RNA, 64 nt, hsa
uuccagugcugccuucuuuacacugccaguuuugacaaaacagguuuguuuuuuauuuuacaac

SEQ ID NO: 223417 - RNA, 64 nt, hsa
gaaaauauagaauuccuggauaagaccaaacaaaacaaaacauuaaaauaccuguauguuuugu

SEQ ID NO: 223418 - RNA, 64 nt, hsa
ggagagaaaauauagaauuccuggauaagaccaaacaaaacaaaacauuaaaauaccuguaugu

SEQ ID NO: 223419 - RNA, 64 nt, hsa
aaaguuguuuucuagauuuguggcuuuaagaaaaacaaaacaaaacaaacacauuguuuuucuc

SEQ ID NO: 223420 - RNA, 64 nt, hsa
uguuuucuagauuuguggcuuuaagaaaaacaaaacaaaacaaacacauuguuuuucucagaac

SEQ ID NO: 223421 - RNA, 64 nt, hsa
ggggagggggacauagcgagacucggucucaaaaacaaaacaaaacaaaacaaaacaaaacaaa

SEQ ID NO: 223422 - RNA, 64 nt, hsa
gggggacauagcgagacucggucucaaaaacaaaacaaaacaaaacaaaacaaaacaaaaacaa

SEQ ID NO: 223423 - RNA, 64 nt, hsa
acauagcgagacucggucucaaaaacaaaacaaaacaaaacaaaacaaaacaaaaacaaaacaa

SEQ ID NO: 223424 - RNA, 64 nt, hsa
gcgagacucggucucaaaaacaaaacaaaacaaaacaaaacaaaacaaaacaaaacaaaacaaa

SEQ ID NO: 223425 - RNA, 64 nt, hsa
acucggucucaaaaacaaaacaaaacaaaacaaaacaaaacaaaacaaaacaaaacaaaacacu

SEQ ID NO: 223426 - RNA, 64 nt, hsa
gucucaaaaacaaaacaaaacaaaacaaaacaaaacaaaacaaaacaaaacaaaacacugccaa

SEQ ID NO: 223427 - RNA, 64 nt, hsa
aaaaacaaaacaaaacaaaacaaaacaaaacaaaacaaaacaaaacaaaacacugccaaacugu

SEQ ID NO: 223428 - RNA, 64 nt, hsa
caaaacaaaacaaaacaaaacaaaacaaaacaaaacaaaacaaaacacugccaaacuguuucca

SEQ ID NO: 223429 - RNA, 64 nt, hsa
aaaacaaaacaaaacaaaaacaaaacaaaacaaaacaaaacacugccaaacuguuuccaaagca

SEQ ID NO: 223430 - RNA, 64 nt, hsa
uucuuuccugaguucaggugacugaggaagagccacaaaacaaaacacaacaaaaccaaaccac

SEQ ID NO: 223431 - RNA, 64 nt, hsa
uccugaguucaggugacugaggaagagccacaaaacaaaacacaacaaaaccaaaccacagaau

SEQ ID NO: 223432 - RNA, 64 nt, hsa
uggucucagaggcucugcuuccuuagguuacaaaacaaaacagggagagaaaaagcaaaccgcg

SEQ ID NO: 223433 - RNA, 64 nt, hsa
guguguggucucagaggcucugcuuccuuagguuacaaaacaaaacagggagagaaaaagcaaa

SEQ ID NO: 223434 - RNA, 64 nt, hsa
uucaguauguuggcauuacuuggaccugguuugaacaaaacauaaaaagccauuuuggagacag

SEQ ID NO: 223435 - RNA, 64 nt, hsa
uuauguguguguauaaaacuccugugggaaagaaacaaaacaucauucuauaagucaguauacu

SEQ ID NO: 223436 - RNA, 64 nt, hsa
acacagcaaguucuuguuuccaaacaacaacaaaacaaaacaaaaaaaaaaccggauagaauaa

SEQ ID NO: 223437 - RNA, 64 nt, hsa
gggcgacacagcaaguucuuguuuccaaacaacaacaaaacaaaacaaaaaaaaaaccggauag

SEQ ID NO: 223438 - RNA, 64 nt, hsa
gucuggucggcaagagugagacuccgucucaaaaacaaaacaaaacaaaaaaaccacauaacau

SEQ ID NO: 223439 - RNA, 64 nt, hsa
gucggcaagagugagacuccgucucaaaaacaaaacaaaacaaaaaaaccacauaacauaaauu

SEQ ID NO: 223440 - RNA, 64 nt, hsa
gggucuauuuguguggcaguuauuggguuuggucacaaaacauccugaaaauucgugcgugggc

SEQ ID NO: 223441 - RNA, 64 nt, hsa
uuuuauacaugaaaauuuguuugacaauaaucucacaaaacauauuuuacaucugaacaaaaug

SEQ ID NO: 223442 - RNA, 64 nt, hsa
cauauauauauaaauauaaauauauauaaaaacaacaaaacaaaacaaaaaaagaaaaaaaaac

SEQ ID NO: 223443 - RNA, 64 nt, hsa
auauauaaauauaaauauauauaaaaacaacaaaacaaaacaaaaaaagaaaaaaaaacaaaaa

SEQ ID NO: 223444 - RNA, 64 nt, hsa
aucaugacugagccaaucacuguuucucagaaaaacaaaacaaaacaaaacaaaugacaguaac

SEQ ID NO: 223445 - RNA, 64 nt, hsa
gacugagccaaucacuguuucucagaaaaacaaaacaaaacaaaacaaaugacaguaacccuuc

SEQ ID NO: 223446 - RNA, 64 nt, hsa
agccaaucacuguuucucagaaaaacaaaacaaaacaaaacaaaugacaguaacccuuccccgg

SEQ ID NO: 223447 - RNA, 64 nt, hsa
agccugggugacagagcaagacucugucuaaaaaacaaaacaaaacaaaacaaaacaaaaaaac

SEQ ID NO: 223448 - RNA, 64 nt, hsa
gggugacagagcaagacucugucuaaaaaacaaaacaaaacaaaacaaaacaaaaaaaccucuu

SEQ ID NO: 223449 - RNA, 64 nt, hsa
acagagcaagacucugucuaaaaaacaaaacaaaacaaaacaaaacaaaaaaaccucuuaauau

SEQ ID NO: 223450 - RNA, 64 nt, hsa
gcaagacucugucuaaaaaacaaaacaaaacaaaacaaaacaaaaaaaccucuuaauauucugg

SEQ ID NO: 223451 - RNA, 64 nt, hsa
aagcaauauuuaauaaaacuaggucaaaaacaaaacaaaacagugacacucacuuguguguaua

SEQ ID NO: 223452 - RNA, 64 nt, hsa
caaggaagcaauauuuaauaaaacuaggucaaaaacaaaacaaaacagugacacucacuugugu

SEQ ID NO: 223453 - RNA, 64 nt, hsa
acaaaaacgaaacuccaucucaaaacaaaacaaaacaaaacaaacaaacaaacaaaacuugcau

SEQ ID NO: 223454 - RNA, 64 nt, hsa
gggcgacaaaaacgaaacuccaucucaaaacaaaacaaaacaaaacaaacaaacaaacaaaacu

SEQ ID NO: 223455 - RNA, 64 nt, hsa
agccugggcgacaaaaacgaaacuccaucucaaaacaaaacaaaacaaaacaaacaaacaaaca

SEQ ID NO: 223456 - RNA, 64 nt, hsa
accacaauuguucuucaaaaacaaacaaaacaaaacaaaacaaaauuaacugcuuaaauguuuu

SEQ ID NO: 223457 - RNA, 64 nt, hsa
aaaagaccacaauuguucuucaaaaacaaacaaaacaaaacaaaacaaaauuaacugcuuaaau

SEQ ID NO: 223458 - RNA, 64 nt, hsa
aauguaaaagaccacaauuguucuucaaaaacaaacaaaacaaaacaaaacaaaauuaacugcu

SEQ ID NO: 223459 - RNA, 64 nt, hsa; identical to SEQ ID NO: 172363

SEQ ID NO: 223460 - RNA, 64 nt, hsa; identical to SEQ ID NO: 172364

SEQ ID NO: 223461 - RNA, 64 nt, hsa; identical to SEQ ID NO: 172365

SEQ ID NO: 223462 - RNA, 64 nt, hsa; identical to SEQ ID NO: 172366

SEQ ID NO: 223463 - RNA, 64 nt, hsa; identical to SEQ ID NO: 172367

SEQ ID NO: 223464 - RNA, 64 nt, hsa; identical to SEQ ID NO: 172368

SEQ ID NO: 223465 - RNA, 64 nt, hsa
cugugccaaauggucuggcagcugguuuuggcauccccagcaucaccacucucccaacccauca

SEQ ID NO: 223466 - RNA, 64 nt, hsa
agauccgcccagcugccaccauuuucauugcuuuccccagcagcaugaugggaacccaagcuga

SEQ ID NO: 223467 - RNA, 64 nt, hsa
caguguucagaguuuuagggaaaggguuugggugccccagcauccagguguuguguggcuuagc

SEQ ID NO: 223468 - RNA, 64 nt, hsa
gggaccuguugauuaauugaguggcccugccugcccccagcagccugcccccgacucuaccucc

SEQ ID NO: 223469 - RNA, 64 nt, hsa
ccgguauccucagcacuacccacccccgccagcuccccagcacaaaggacccuuucgacaagac

SEQ ID NO: 223470 - RNA, 64 nt, hsa
aggacccuuucgacaagacguuccgccuuccccuccccagcaccaaagaaugccagccuaucag

SEQ ID NO: 223471 - RNA, 64 nt, hsa
ccccaucuucuaaauggcaaaggaagguggauggccccagcacagcuugaccugaggcuguggu

SEQ ID NO: 223472 - RNA, 64 nt, hsa
gcaggcccuggccuccccugccaccaggccaccuccccagcauuccagccccucuggucgcucc

SEQ ID NO: 223473 - RNA, 64 nt, hsa
uacuccccucugcaacccccauuuugggaguugaccccagcaaugaccuugguggcacgcucac

SEQ ID NO: 223474 - RNA, 64 nt, hsa
ccuuccugguagaccuuaaaccucgcacacauguccccagcauuuucucaccuggauaaagccc

SEQ ID NO: 223475 - RNA, 64 nt, hsa
agucauagacuagguaggaaggcccuauauugguccccagcaucuacugaggcagaccugcaac

SEQ ID NO: 223476 - RNA, 64 nt, hsa
cugaggcagaccugcaacagaaguggcauucaguccccagcagacaugggugagcucaccccag

SEQ ID NO: 223477 - RNA, 64 nt, hsa
ggcauucaguccccagcagacaugggugagcucaccccagcacugcuguugggaaggugacugc

SEQ ID NO: 223478 - RNA, 64 nt, hsa
guaccaucuuggauccuucaaaaccaaagacuugccccagcacugcuguggaaccaccuggcuu

SEQ ID NO: 223479 - RNA, 64 nt, hsa
cagagaagagaaagcauguugcuuaaacauccuuccccagcaccagcuauugguguaccuauaa

SEQ ID NO: 223480 - RNA, 64 nt, hsa
cuuugucuguguauuagcucuuuccauucuuugcccccagcaugaguuaacucgcguggacucu

SEQ ID NO: 223481 - RNA, 64 nt, hsa
uuaacucgcguggacucugcagugcgaguagugaccccagcauaccuuguccucuggaccuccu

SEQ ID NO: 223482 - RNA, 64 nt, hsa
uugacuuagagugacagccgguguccuggaaagcccccagcagcugccccagggacaugggaag

SEQ ID NO: 223483 - RNA, 64 nt, hsa
cuggggacucaggaaccaugccccuuccccaggcccccagcaagucucaagaacacagcugcac

SEQ ID NO: 223484 - RNA, 64 nt, hsa
caaaacuuuuuguuggcuuuuuccuuugucgccuccccagcaccugcccucccagucucccacc

SEQ ID NO: 223485 - RNA, 64 nt, hsa
cuaagccaaagauggccccugacaccucccccagccccagcacaccagccugcaccucuuaucc

SEQ ID NO: 223486 - RNA, 64 nt, hsa
uucgcccaccaggccuaggcuacgcuccaugcucccccagcaaucucugccuacaccuccugcg

SEQ ID NO: 223487 - RNA, 64 nt, hsa
cauccagggaaagaggaagaaaggccuuagugugccccagcagucuggcugcguccagccacca

SEQ ID NO: 223488 - RNA, 64 nt, hsa
aagccagccaggggccccaggaagauggggcaccccccagcacccuccagauugagagcaaggu

SEQ ID NO: 223489 - RNA, 64 nt, hsa
cucaggcccaggacccaggaggccuccccaccuaccccagcacacacacucccugccacuguuc

SEQ ID NO: 223490 - RNA, 64 nt, hsa
caaggcugggcccugcaguggggcgggccgccagccccagcaguuuacagacgcauggcucuuc

SEQ ID NO: 223491 - RNA, 64 nt, hsa
gaggagcccaggggcuuaccucacugagagugcuccccagcaggcauccacuaccccagggccc

SEQ ID NO: 223492 - RNA, 64 nt, hsa
accauaccucugacccacccagccccugugguagccccagcaguucucagggugcugaccucuc

SEQ ID NO: 223493 - RNA, 64 nt, hsa
ggggcagcguguuccccuguaccuguccaaggccccccagcagaugaugggcucccugaaacug

SEQ ID NO: 223494 - RNA, 64 nt, hsa
ggagagcuggcaggcccagggcuuguccugcugaccccagcagacccuccuguugguuccagcg

SEQ ID NO: 223495 - RNA, 64 nt, hsa
agucuguucugacgcccuggggguuccuguccaaccccagcaggggcgcagcgggaccagcccc

SEQ ID NO: 223496 - RNA, 64 nt, hsa
caccugccauggacacuucacccacccuccaggaccccagcaaguggauucugggcaagccugu

SEQ ID NO: 223497 - RNA, 64 nt, hsa
uccugaagauagccagagagcccaugagaccgucccccagcaucccccacuugccugaagcucc

SEQ ID NO: 223498 - RNA, 64 nt, hsa
cccugcguguucauccugggcccagaucccccugccccagcaagacucgcagugggauggcugc

SEQ ID NO: 223499 - RNA, 64 nt, hsa
uagugcagagcccguccuuuuguacuuggggugaccccagcagccaauuauccggccuuccaua

SEQ ID NO: 223500 - RNA, 64 nt, hsa
cuuuugauaugcaguuuccagcccuccaaugaguccccagcacagaucucaggcuuguggcugg

SEQ ID NO: 223501 - RNA, 64 nt, hsa
acccuguggcugcccuucacacuuacaggccuaaccccagcaggaccugccagcugcuucauga

SEQ ID NO: 223502 - RNA, 64 nt, hsa
gaccacagcccccagcaggggaggcccacaccugccccagcaccugcaggaccaagugcagagg

SEQ ID NO: 223503 - RNA, 64 nt, hsa
gcgccaucuaccggcugaacuuucugaccacagcccccagcaggggaggcccacaccugcccca

SEQ ID NO: 223504 - RNA, 64 nt, hsa
cuucugucucuuuagcugccagagacauuuaugcccccagcaccaauuacugcuccaguuauga

SEQ ID NO: 223505 - RNA, 64 nt, hsa
accaguuuggagggaagcugguuacuuuuggccuccccagcaccccugcccaucuggugccaca

SEQ ID NO: 223506 - RNA, 64 nt, hsa
aaaauuuaugcauacguucuucacaaggggguacccccagcagccucucgaaaauugcacuucu

SEQ ID NO: 223507 - RNA, 64 nt, hsa
gugacccccgucaacccacugccucccaccccgaccccagcaucaaaaaaccaaugauuuugcu

SEQ ID NO: 223508 - RNA, 64 nt, hsa
caggaaaagcaaugucucuucacgggccucagggccccagcagauggggcugggucaggaacca

SEQ ID NO: 223509 - RNA, 64 nt, hsa
agggcacagcugcuggcaaaugccccauucccugccccagcacuucccagccuuuccaggagcu

SEQ ID NO: 223510 - RNA, 64 nt, hsa
agcagcccccuccuccuggcugggaagaauggucccccagcaagcacuugccuguucauuccug

SEQ ID NO: 223511 - RNA, 64 nt, hsa
cacccacaacccgagaaucagggagaaagucccuccccagcagcccccuccuccuggcugggaa

SEQ ID NO: 223512 - RNA, 64 nt, hsa
uuuucuucauuuacuucauaccccaggaccccuuccccagcagcagagacccuggagcacagga

SEQ ID NO: 223513 - RNA, 64 nt, hsa
ccuccucccugcuuccucuccuccccuguacgugccccagcauucugggguuauuuaacaauag

SEQ ID NO: 223514 - RNA, 64 nt, hsa
acaaagaccagggcaggucacggguuucccaauuccccagcaauuaagauuucgagcagaauuu

SEQ ID NO: 223515 - RNA, 64 nt, hsa
ucucaggauugagauucuauccccccuuccccgcccccagcagugucgcuccaauucaaauuag

SEQ ID NO: 223516 - RNA, 64 nt, hsa
acgggugagaacugcuaagugaugacagguggagccccagcaggggccacucuauugaauggca

SEQ ID NO: 223517 - RNA, 64 nt, hsa
ccuucacaaaagcagaaggaacacuggcccaaacccccagcaccccggaagcagaggugagaug

SEQ ID NO: 223518 - RNA, 64 nt, hsa
cuuccuuucucagcugaaccccuacucccggagcccccagcagggcccuccgagguggagcagc

SEQ ID NO: 223519 - RNA, 64 nt, hsa
cgcuuccuuucucagcugaaccccuacccggagcccccagcagggcccuccgagguggaacagc

SEQ ID NO: 223520 - RNA, 64 nt, hsa
gcaucaguuuucuccacuucuuucucccacucacccccagcaaggugccuggggagacuugagc

SEQ ID NO: 223521 - RNA, 64 nt, hsa
agccaggccuccaaugcacugugaccucuggcuuccccagcagcuuucccagagaggcagaggg

SEQ ID NO: 223522 - RNA, 64 nt, hsa
cucgggggcuuucggcucccacacugaugauucuccccagcauccacaccgggccuggcgcuac

SEQ ID NO: 223523 - RNA, 64 nt, hsa
agccuucuauuugugaagugcccuguggcccccuccccagcaccucugucugccaugcgcuucu

SEQ ID NO: 223524 - RNA, 64 nt, hsa
cuuuucccauuguuccugcgcugcaaauugcaggccccagcaaucgugacugacguuugcuccu

SEQ ID NO: 223525 - RNA, 64 nt, hsa
gcuguucuggaagaaacagaucuccuggcaaaggccccagcaucucccucacugaaaccaggug

SEQ ID NO: 223526 - RNA, 64 nt, hsa
gagugggacagagucuggguguauuuauuuuccuccccagcagguggggaggggguuugggggc

SEQ ID NO: 223527 - RNA, 64 nt, hsa
uuggcccccgagcugggggccaugagcuccagacccccagcaacccuccuaucaccuccccucc

SEQ ID NO: 223528 - RNA, 64 nt, hsa
caucauccacccgcugccccuccccgucccugucccccagcaucgggggccugcaaaucuagug

SEQ ID NO: 223529 - RNA, 64 nt, hsa
ggucaccauccucagaggcugagcccuguacccaccccagcacagccaccuccgccagaccccg

SEQ ID NO: 223530 - RNA, 64 nt, hsa
ccucccagccccggugcccgcagaagacgcuuuuccccagcaggucacccacggccccggaacc

SEQ ID NO: 223531 - RNA, 64 nt, hsa
gaauccagccgggcgugguggcucacaccuguaaccccagcacuuugggaggcuaaggcggcgg

SEQ ID NO: 223532 - RNA, 64 nt, hsa
uagggguggggagguggucugccggugcccugccccccagcacugcccuaccccuccacuccga

SEQ ID NO: 223533 - RNA, 64 nt, hsa
uccagggugggucuggggaggggacagcuguucaccccagcacccuuugaacccacccuuaggg

SEQ ID NO: 223534 - RNA, 64 nt, hsa
acgcagggaauacaggggagaggguuguccuuccccccagcaaaugcaauaaugcccucacccc

SEQ ID NO: 223535 - RNA, 64 nt, hsa
ugcgaugaugacccgggcgcaaccuggugggggcccccagcagggacacugacgucaggacccg

SEQ ID NO: 223536 - RNA, 64 nt, hsa
cggagugagacucccucucaaaaaaagaaaaaagccccagcauguagcaaaagcauuucuuggu

SEQ ID NO: 223537 - RNA, 64 nt, hsa
cuuacccuccggugugcuuguguucuuagaaaagccccagcauggccgggcaugguggcucaug

SEQ ID NO: 223538 - RNA, 64 nt, hsa
gcuaucacagaacuccaccagcaacuccacccgaccccagcaguggugcaggacagcugccagc

SEQ ID NO: 223539 - RNA, 64 nt, hsa
aggcauucaucuuggagaugugguuuuucggguuccccagcagcaucucccgacaccaacugug

SEQ ID NO: 223540 - RNA, 64 nt, hsa
cccacugaagccccgcgccuccuccugccagcacccccagcaccugcuagcaggaggcaccugg

SEQ ID NO: 223541 - RNA, 64 nt, hsa
uggguuugagugaagggagagcacgguccuaaguccccagcagguggugcgggugugugagugg

SEQ ID NO: 223542 - RNA, 64 nt, hsa
acggaaaccagcccugcgggcuaagcaggugcgaccccagcaagaggggugcucugggaccaga

SEQ ID NO: 223543 - RNA, 64 nt, hsa
ucuguccacccacccagcccaguucuaggucguuccccagcaccuccagguuggcccacacagg

SEQ ID NO: 223544 - RNA, 64 nt, hsa
aauguccuagcugcugcugaggcuugaacccagaccccagcacugugaugggaguccacggcua

SEQ ID NO: 223545 - RNA, 64 nt, hsa
agucccuucccaccaggggcugaccucccagcugccccagcaagcucugcccucucuggcuuug

SEQ ID NO: 223546 - RNA, 64 nt, hsa
cuacucccccagacccaaguucugcagaacuaacccccagcaggccugguuccacccugggcag

SEQ ID NO: 223547 - RNA, 64 nt, hsa
ggcggggcccugccuggggaucucaaggaugaggccccagcauggaggauuggggguagaauuc

SEQ ID NO: 223548 - RNA, 64 nt, hsa
cauggaggauuggggguagaauuccacccuugaaccccagcagacagucccuccccugacuccc

SEQ ID NO: 223549 - RNA, 64 nt, hsa
guggucccaggacuggcaccuacucuuuagagagccccagcaucuuugauguggauuggagaca

SEQ ID NO: 223550 - RNA, 64 nt, hsa
agggucccaccacagccagcgggcuggccucccaccccagcauccauacacguaggccuguugc

SEQ ID NO: 223551 - RNA, 64 nt, hsa
auagcagaggagagagggguguacugucuguggcccccagcaugggccacauaccaacccacca

SEQ ID NO: 223552 - RNA, 64 nt, hsa
agccugcgugccccuaaccuggcuuuucccaucuccccagcauaaccaaaucuuacuaaacuca

SEQ ID NO: 223553 - RNA, 64 nt, hsa
ccuaggcugggcauggugacucacgccuguaaucccccagcaauuugggaggcaaaggugggag

SEQ ID NO: 223554 - RNA, 64 nt, hsa
agccugcaugccccuaaccugccuuuucccaucuccccagcauaaccuaauauuuuuuuuuuuu

SEQ ID NO: 223555 - RNA, 64 nt, hsa
ccuaggcuggccgcggugacucaugccuauaaucccccagcaauuugggaggcagaggugagag

SEQ ID NO: 223556 - RNA, 64 nt, hsa
auuccagggggcugguucacacuguucuugggcgccccagcauuguguugugaggcgcacuguu

SEQ ID NO: 223557 - RNA, 64 nt, hsa
ggugagacagcagggcccaggggaguggaccagcccccagcaaauuaucaccaucugugccuuu

SEQ ID NO: 223558 - RNA, 64 nt, hsa
ugcauucagcccucucuaggacgcagcagccucuccccagcacugaguccccccuccuuugugu

SEQ ID NO: 223559 - RNA, 64 nt, hsa
cacucagccuuccaaagggaacaggaacaaauuuccccagcaccacuguuugggucccgcuuuu

SEQ ID NO: 223560 - RNA, 64 nt, hsa
cgugcuugguggggggaugugaacuuucucucucccccagcagugucugcucaggccugacagc

SEQ ID NO: 223561 - RNA, 64 nt, hsa
gcggggccagagcggcgggucuauguucacguccccccagcagcaggcggaaccacccagccag

SEQ ID NO: 223562 - RNA, 64 nt, hsa
ugcaggcaaggagaccaaagauugaugagaagacccccagcagggguacuggguacccggcagg

SEQ ID NO: 223563 - RNA, 64 nt, hsa
uguguucuucucugagcagcuccuccccggagucccccagcacagucccaggagaugacaggaa

SEQ ID NO: 223564 - RNA, 64 nt, hsa
aggcugaaaucuggcaucaucucagguucccuguccccagcacuguccccauggagcugguggc

SEQ ID NO: 223565 - RNA, 64 nt, hsa
gaaauggaccccgcaacccuguccucugcugggcccccagcaaacucuagcaauagcagcugcu

SEQ ID NO: 223566 - RNA, 64 nt, hsa
cauguccucccugccuugggacccguccucucacccccagcaguugccaugggguuuccuucca

SEQ ID NO: 223567 - RNA, 64 nt, hsa
gcccacauccccacugccccuguacaguccugccccccagcacccuccagcccacaaacagggc

SEQ ID NO: 223568 - RNA, 64 nt, hsa
ccucccaccccagcagcccucucuucccccaccuccccagcagcccccacccuugccccagcug

SEQ ID NO: 223569 - RNA, 64 nt, hsa
aggaccgggcccugccccgccacccuaccucccaccccagcagcccucucuucccccaccuccc

SEQ ID NO: 223570 - RNA, 64 nt, hsa
cuucucuguguaccaccucugcugucucagaugcccccagcaaauaaacacucuucucguuggu

SEQ ID NO: 223571 - RNA, 64 nt, hsa
agagcugggacugggcguaggccuuuguccucauccccagcacuggccucccuguggaagauga

SEQ ID NO: 223572 - RNA, 64 nt, hsa; identical to SEQ ID NO: 148065

SEQ ID NO: 223573 - RNA, 64 nt, hsa; identical to SEQ ID NO: 148066

SEQ ID NO: 223574 - RNA, 64 nt, hsa; identical to SEQ ID NO: 148067

SEQ ID NO: 223575 - RNA, 64 nt, hsa; identical to SEQ ID NO: 148068

SEQ ID NO: 223576 - RNA, 64 nt, hsa; identical to SEQ ID NO: 148069

SEQ ID NO: 223577 - RNA, 64 nt, hsa; identical to SEQ ID NO: 148070

SEQ ID NO: 223578 - RNA, 64 nt, hsa; identical to SEQ ID NO: 148071

SEQ ID NO: 223579 - RNA, 64 nt, hsa; identical to SEQ ID NO: 148072

SEQ ID NO: 223580 - RNA, 64 nt, hsa; identical to SEQ ID NO: 148073

SEQ ID NO: 223581 - RNA, 64 nt, hsa; identical to SEQ ID NO: 148074

SEQ ID NO: 223582 - RNA, 64 nt, hsa; identical to SEQ ID NO: 148075

SEQ ID NO: 223583 - RNA, 64 nt, hsa; identical to SEQ ID NO: 148076

SEQ ID NO: 223584 - RNA, 64 nt, hsa; identical to SEQ ID NO: 148077

SEQ ID NO: 223585 - RNA, 64 nt, hsa; identical to SEQ ID NO: 148078

SEQ ID NO: 223586 - RNA, 64 nt, hsa; identical to SEQ ID NO: 148079

SEQ ID NO: 223587 - RNA, 64 nt, hsa; identical to SEQ ID NO: 148080

SEQ ID NO: 223588 - RNA, 64 nt, hsa; identical to SEQ ID NO: 148081

SEQ ID NO: 223589 - RNA, 64 nt, hsa; identical to SEQ ID NO: 148082

SEQ ID NO: 223590 - RNA, 64 nt, hsa; identical to SEQ ID NO: 148083

SEQ ID NO: 223591 - RNA, 64 nt, hsa; identical to SEQ ID NO: 148084

SEQ ID NO: 223592 - RNA, 64 nt, hsa; identical to SEQ ID NO: 148085

SEQ ID NO: 223593 - RNA, 64 nt, hsa; identical to SEQ ID NO: 148086

SEQ ID NO: 223594 - RNA, 64 nt, hsa; identical to SEQ ID NO: 148087

SEQ ID NO: 223595 - RNA, 64 nt, hsa; identical to SEQ ID NO: 148088

SEQ ID NO: 223596 - RNA, 64 nt, hsa; identical to SEQ ID NO: 148089

SEQ ID NO: 223597 - RNA, 64 nt, hsa; identical to SEQ ID NO: 148090

SEQ ID NO: 223598 - RNA, 64 nt, hsa; identical to SEQ ID NO: 148091

SEQ ID NO: 223599 - RNA, 64 nt, hsa; identical to SEQ ID NO: 148092

SEQ ID NO: 223600 - RNA, 64 nt, hsa; identical to SEQ ID NO: 148093

SEQ ID NO: 223601 - RNA, 64 nt, hsa; identical to SEQ ID NO: 148094

SEQ ID NO: 223602 - RNA, 64 nt, hsa; identical to SEQ ID NO: 148095

SEQ ID NO: 223603 - RNA, 64 nt, hsa; identical to SEQ ID NO: 148096

SEQ ID NO: 223604 - RNA, 64 nt, hsa; identical to SEQ ID NO: 148097

SEQ ID NO: 223605 - RNA, 64 nt, hsa; identical to SEQ ID NO: 148098

SEQ ID NO: 223606 - RNA, 64 nt, hsa; identical to SEQ ID NO: 148099

SEQ ID NO: 223607 - RNA, 64 nt, hsa; identical to SEQ ID NO: 148100

SEQ ID NO: 223608 - RNA, 64 nt, hsa; identical to SEQ ID NO: 148101

SEQ ID NO: 223609 - RNA, 64 nt, hsa; identical to SEQ ID NO: 148102

SEQ ID NO: 223610 - RNA, 64 nt, hsa
gucaguuuaccucuguguauggucacuagagauugggacuuacccuuuagguuuuaggaggcuu

SEQ ID NO: 223611 - RNA, 64 nt, hsa
uuuaaauaccuauauauucucugaaugcaauaaagggacuuaagagugaacaagaguaauggug

SEQ ID NO: 223612 - RNA, 57 nt, hsa
ucaauguggaugagaacuaaucgcugaucgucagaucaaauaaaguuauaaaauugc

SEQ ID NO: 223613 - RNA, 64 nt, hsa
ggugaugggugauggaggguucagagaggagugaucgucagaugugugaauggacgguuuaggu

SEQ ID NO: 223614 - RNA, 64 nt, hsa
cacaggagaggaagaauuuggaaugaaaagcacuucgucagaaccuucugugggagccauugag

SEQ ID NO: 223615 - RNA, 64 nt, hsa
agcauucagcccagggaaugugguuuucacuucuucgucagauaagaccaacaugaagggguau

SEQ ID NO: 223616 - RNA, 64 nt, hsa
agcgagcaacacacgucuaacagccuagacaaucucgucagaugcucauacuggaccaucagcc

SEQ ID NO: 223617 - RNA, 64 nt, hsa
cuguuucacagcugccaccaccuuuagaggaauuucgucagaaaaauguggaggcuccauauua

SEQ ID NO: 223618 - RNA, 64 nt, hsa
cagauuaucaaagcuaauuugacuaguuugaaccucgucagacauucauuccuuuggccauugc

SEQ ID NO: 223619 - RNA, 64 nt, hsa
aaagggaacaggugccucagccaucccaacagugucgucagaggguccccagggcauuuucaug

SEQ ID NO: 223620 - RNA, 64 nt, hsa
ccagaaaagucacuggacaaagaacacagauguaucgucagacaugagaauaauaaaaacggag

SEQ ID NO: 223621 - RNA, 64 nt, hsa
ggucuucccuccuuguuccgauucugcguucccaucgucagacaacuuuggaguauuagaaacc

SEQ ID NO: 223622 - RNA, 64 nt, hsa
aaggcuuugaaaucuccccuugcacugagauuagucgucagaucucuccccgucucccucccaa

SEQ ID NO: 223623 - RNA, 64 nt, hsa
aucaugauccuugccuucauauaacaaacaugcuucgucagagguguugggguugaaaaaggag

SEQ ID NO: 223624 - RNA, 64 nt, hsa
gcggggaggaagccagcagccccuguguuuacugucgucagaaaggucuuguguuuugguuuug

SEQ ID NO: 223625 - RNA, 64 nt, hsa
uauuuauauauuuuaaaaauaaacauuuuuuaaaucgucagaaggcaacauuuaccauguuccu

SEQ ID NO: 223626 - RNA, 64 nt, hsa
cuuuaaaacuuauccagugcaacucccuuguuuuucgucagaggaaaaggaggccuagaaaggu

SEQ ID NO: 223627 - RNA, 64 nt, hsa
cuugcacucguuaaagaaacacggagcugggccaucgucagaacuaagucagggaaggagaugg

SEQ ID NO: 223628 - RNA, 64 nt, hsa
aaaaaacaaaaaaaaaaacccuccuuuuuuccuuucgucagacuuggcagcaaagacauuuuuc

SEQ ID NO: 223629 - RNA, 64 nt, hsa
aacggcugugcaguaggcccagcgcugcugugucucgucagaggaauagcuuaccacgaacccc

SEQ ID NO: 223630 - RNA, 64 nt, hsa
gaggguacccaucuagcuacuuggggucaggaccucgucagaccagguucggauacaaucaucu

SEQ ID NO: 223631 - RNA, 64 nt, hsa
ccagauguugagugaccagcucuguggcccugugucgucagaggcuugugauuaacuguggcgg

SEQ ID NO: 223632 - RNA, 64 nt, hsa
gguggggauaaaguagaguggaaauaauguagagucgucagacugaaaggccagguuguagucc

SEQ ID NO: 223633 - RNA, 64 nt, hsa
ccagcagcuucacaaaugucugcugcaaggggaaucgucagaguccaaugugugccucuacagu

SEQ ID NO: 223634 - RNA, 64 nt, hsa
ucugccagggauggucccuguggcccaggcagggucgucagaggccagccuggcugcaggugcu

SEQ ID NO: 223635 - RNA, 64 nt, hsa
ggccguagaugcuccccgccggucagucacuuagucgucagaucgcccguccugguaucacagu

SEQ ID NO: 223636 - RNA, 64 nt, hsa
cccaggcucugcucugcccugcccugcaccccccucgucagaaguacaugaggggcgcagagau

SEQ ID NO: 223637 - RNA, 64 nt, hsa
uaaucuuaucccuuuucucuguaugcaguuggacucgucagagauaguaaaaucaucuuuuagu

SEQ ID NO: 223638 - RNA, 64 nt, hsa
ugugugcugggacgcuguacagagaccagcucagucgucagagaaaccaugaggugguguccug

SEQ ID NO: 223639 - RNA, 64 nt, hsa
uuuuuguagaaauaaaaauugaccuuagaauuuaucgucagauaaacuuguaaagauuugaaua

SEQ ID NO: 223640 - RNA, 64 nt, hsa
uugauuauguacuuuaucuguauagcaggcuuugucgucagaaguuuuuauaucgauuuaaauu

SEQ ID NO: 223641 - RNA, 64 nt, hsa
gauggaggaagaagacccagacucaucugaaggaucgucagaggagggugaggaagacuaauua

SEQ ID NO: 223642 - RNA, 63 nt, hsa
uaugccaaauaucaagaugugaaggacuaauucaggaugcaaaaacguuauugggggguugua

SEQ ID NO: 223643 - RNA, 63 nt, hsa
gggggguuguaaauaucaacuauucaacaguuuaggaugcaauuacgaguguaaacugugugc

SEQ ID NO: 223644 - RNA, 63 nt, hsa
cuagucagggccuugggcaagacauugggcucuaggaugcaauuggcaaauacguccccguua

SEQ ID NO: 223645 - RNA, 63 nt, hsa
uguaggaaagcaaauguagguaaggggagagcaaggaugcacagaaaacacacugacuguggg

SEQ ID NO: 223646 - RNA, 63 nt, hsa
gcacagaaaacacacugacugugggacugugccaggaugcauuuggaaagauagagcauucug

SEQ ID NO: 223647 - RNA, 63 nt, hsa
ccugggggaugacacucaguucugucacugucaaggaugcagagagcuggugguaggugggaa

SEQ ID NO: 223648 - RNA, 63 nt, hsa
ccagugggauugaaaaccagcagaagccaagacaggaugcacagcugaauuggaggagaguag

SEQ ID NO: 223649 - RNA, 63 nt, hsa
ccucaaucccauuuugauauucauuuuagugaaaggaugcaucagaccuguuccacaucaugc

SEQ ID NO: 223650 - RNA, 63 nt, hsa
augaggaguuguugaacccacugcuaggaagcaaggaugcaacaagaugaugcugagcgugaa

SEQ ID NO: 223651 - RNA, 63 nt, hsa
auagccaaguaaguuuuaaaaaccaaagcauccaggaugcacaccccugcaccauuugcugug

SEQ ID NO: 223652 - RNA, 63 nt, hsa
gaugaauguuugacggggaagaggaaggguaggaggaugcauggaugaguggaugaguggauc

SEQ ID NO: 223653 - RNA, 63 nt, hsa
aagugggaggaucaccugagcccagggaggucaaggaugcagugagccauggucucaccacug

SEQ ID NO: 223654 - RNA, 64 nt, hsa
gggucucuaccauccccuguagagugggagcugagugggggaucacagccucugaaaaccaaug

SEQ ID NO: 223655 - RNA, 64 nt, hsa
ucgcugugucagcauagaaguaacuuacuuaggugugggggaagcaccauaacuuuguuuagcc

SEQ ID NO: 223656 - RNA, 64 nt, hsa
cagcaggcagaggagaguaccccccugagagcaugugggggaaggccuugcugucaugugaauc

SEQ ID NO: 223657 - RNA, 64 nt, hsa
ugccaagccuggagccccuguguuggggggcaaggugggggagccuggagccccugugugggag

SEQ ID NO: 223658 - RNA, 64 nt, hsa
uccuaauggguuaaauccuuuaaaacaaggaguugugggggaagggugucgugcacuccuagag

SEQ ID NO: 223659 - RNA, 64 nt, hsa
cugcgacauuauagaaucggccguguccccccuggugggggauuggggaucuguguuuagccau

SEQ ID NO: 223660 - RNA, 64 nt, hsa
agguagggauacccaugggggcagcugugccugugugggggaacaggguagggaaaucuccaua

SEQ ID NO: 223661 - RNA, 64 nt, hsa
cccucagaggugguguuuggaccaaagcaucggggugggggaggggucugccgcugucccccac

SEQ ID NO: 223662 - RNA, 64 nt, hsa
aaugcacaaguguaacuccugguuguuugcuggggugggggagcaucugcuguuugaggacggg

SEQ ID NO: 223663 - RNA, 64 nt, hsa
aaauggacaaagggcucuguccuccucgacccuagugggggaucaagaaggaaacuccguugca

SEQ ID NO: 223664 - RNA, 64 nt, hsa
accaagaggguuuuuaguggcuugggucuccccagugggggauaagucuuuugucaucaaggag

SEQ ID NO: 223665 - RNA, 64 nt, hsa
gagaugaaaggcuuugcagaaagcuuugagcucugugggggaacacacuagagaaccaaaaaug

SEQ ID NO: 223666 - RNA, 64 nt, hsa
ggucccagugaagcuuccccuugccggcuuagcugugggggaccccuucuccacccucucccug

SEQ ID NO: 223667 - RNA, 64 nt, hsa
ccccuugcguuggcucuuugcugccagccaucaggugggggauuagagccugguguaagugcgc

SEQ ID NO: 223668 - RNA, 64 nt, hsa
uuuaauucaauuuguaaguagcgcagcagccucugugggggaggauaggcugaaaaaaaaaagu

SEQ ID NO: 223669 - RNA, 64 nt, hsa
agccaggcccaggguggcugcugcuuccugcuaagugggggaggugagacagaucuggaaagcc

SEQ ID NO: 223670 - RNA, 64 nt, hsa
aucccaugccugggggagagacagcggcucaggagugggggagcacgggccuucuacaccacau

SEQ ID NO: 223671 - RNA, 64 nt, hsa
ggcccagcacuuucaucagauccugccuccuggagugggggaaacgcagcaccccacugguucu

SEQ ID NO: 223672 - RNA, 64 nt, hsa
cuaaaaggaauaucacgguuuuuugaaacacucagugggggacauuuuggugaagaugcaauau

SEQ ID NO: 223673 - RNA, 64 nt, hsa
ccccaggggguacucuggagugagcagugccccugugggggagccuguaaaugcgggcucagug

SEQ ID NO: 223674 - RNA, 64 nt, hsa
uucccauggaaucuagacagcauuuaucccucuggugggggaaucucacacugacuaacugaau

SEQ ID NO: 223675 - RNA, 64 nt, hsa
aaaagauucauguguuucagccuagugggagagagugggggagaggaagagagagagagagcau

SEQ ID NO: 223676 - RNA, 64 nt, hsa
agcacacgcggcgccccgccaggccuuagggcccgugggggacgcggccccgcgccgcggggag

SEQ ID NO: 223677 - RNA, 64 nt, hsa
caggccucugagucacugaaugucaccaggagaggugggggagggaaagugggccaguggggag

SEQ ID NO: 223678 - RNA, 64 nt, hsa
gucauggccccacaugggguaagggggguugggggugggggagagggagagagcgaacacccac

SEQ ID NO: 223679 - RNA, 57 nt, hsa
ggucuaauguaggcaaguagaggcagcgugggggaaaggaaacguggcucucccuua

SEQ ID NO: 223680 - RNA, 64 nt, hsa
ucuccccaccccagcuucaagcagaggccucggggugggggagcuacaaagcacaacaauguac

SEQ ID NO: 223681 - RNA, 64 nt, hsa
augugcagacagaucagggaggaaccuccaaugggugggggacagugagcuucggccuggccga

SEQ ID NO: 223682 - RNA, 64 nt, hsa
ccucucugucuccaccccaugggcccacacccaggugggggaggaggaagccacugcaucuguu

SEQ ID NO: 223683 - RNA, 64 nt, hsa
gaaguacuuagggagguuggugucagaggcaggagugggggaucagggaagguggauucuagga

SEQ ID NO: 223684 - RNA, 64 nt, hsa
ggcaucacccaagguuccuucucuuaaacuaagggugggggaucugaauguuuuuauguugacu

SEQ ID NO: 223685 - RNA, 64 nt, hsa
agguguccugagcaccacacccagugggaagagugugggggaggcgcacagugugagcccgccc

SEQ ID NO: 223686 - RNA, 64 nt, hsa
augaucucuucugguguugacuggacugcuuggggugggggacgaucaggaggaagugagcagu

SEQ ID NO: 223687 - RNA, 64 nt, hsa
gggagcagaaagagcaaguggguuaaggaagccugugggggaccugguggauggaguugaccaa

SEQ ID NO: 223688 - RNA, 64 nt, hsa
agaggugggcuagguguaaggcaucaguugccgugugggggagaaggccagcuuuaagacguag

SEQ ID NO: 223689 - RNA, 64 nt, hsa
ucgguggagccaggggcaaaucuuaaugggaccagugggggauaccccagagcccauggccuga

SEQ ID NO: 223690 - RNA, 64 nt, hsa
accauccucuuccaacccacgccacggccaugcugugggggaccugcuccucacagagccccuc

SEQ ID NO: 223691 - RNA, 64 nt, hsa
guccguguugccuucuuuaacacacacucgugcagugggggaguucuggcuccccaaccuaacc

SEQ ID NO: 223692 - RNA, 64 nt, hsa
cggggccugaaaccuuagcccccagccggccugagugggggauauugacacccccagcuaaagc

SEQ ID NO: 223693 - RNA, 64 nt, hsa
gcuugcuccguccucggacaggaagccacccugcgugggggacugcaggcacgcaaaauaaaau

SEQ ID NO: 223694 - RNA, 64 nt, hsa
aaucuugcguuuuucgucaucuuauuccaguucugugggggaugaguuuuuuuguggguugcuu

SEQ ID NO: 223695 - RNA, 64 nt, hsa
ggacaagauggaggauguccacagaggcugaccugugggggaaaagaagugcucagguaagguu

SEQ ID NO: 223696 - RNA, 64 nt, hsa
uuggccugaggcagggcgggaggcaugcaagccagugggggaaaaccccucugaagcugggcag

SEQ ID NO: 223697 - RNA, 63 nt, hsa
cagaacaagaggcgcggggccacacccgugaaccaugcagacggccgaagaagucuuaggcag

SEQ ID NO: 223698 - RNA, 63 nt, hsa
uggggaagucgagggccuguggcuuggauccgccaugcagagauguggccgggcacccaucuu

SEQ ID NO: 223699 - RNA, 63 nt, hsa
auauguugucaugcaggguuugggccaagaaagcaugcagaaaaaaaugccaugugauuguaa

SEQ ID NO: 223700 - RNA, 63 nt, hsa
ugauucucucacaggcuugggaaauccuguuagcaugcagaauaaugugguaacuuugucaau

SEQ ID NO: 223701 - RNA, 63 nt, hsa
aagagaccccaaauagccugcucaguagagggucaugcagacaaggaagaaaacuuaggggcu

SEQ ID NO: 223702 - RNA, 63 nt, hsa
gccugccuagggacacuguccagccuccaggcccaugcagaaagaguucagugcuacucugcg

SEQ ID NO: 223703 - RNA, 63 nt, hsa
ugugcacagauaugcugucuggacacgcacacacaugcagauaugcugccuggacacacacuu

SEQ ID NO: 223704 - RNA, 63 nt, hsa
cagauaugcuguccggauacacacgcacgcacacaugcagauaugcugccugggcacacacuu

SEQ ID NO: 223705 - RNA, 63 nt, hsa
uaguaguagcugccaccacaucucuaggguagccaugcagaggagggcuucauauucccaaua

SEQ ID NO: 223706 - RNA, 63 nt, hsa
gaauccaugcaagccccauaaaacaguuccuagcaugcagaaaaugcccacguaaauagcugu

SEQ ID NO: 223707 - RNA, 63 nt, hsa
agggacauucugcuggcccacccugcgcgcugucaugcagaggccauucccccaggccugugu

SEQ ID NO: 223708 - RNA, 63 nt, hsa
uguacaugcaccaaagcaugugugaccuacagacaugcagaacaugcacguguacacauacca

SEQ ID NO: 223709 - RNA, 63 nt, hsa
acucuugcucacaaugggcauggaucagaagaccaugcagaaguuacuguaucucuugugacc

SEQ ID NO: 223710 - RNA, 63 nt, hsa
accccuggagggguggaguuucuaccccugacucaugcagacaucuauuacauggaggcagua

SEQ ID NO: 223711 - RNA, 63 nt, hsa
agaagacucuccgccccacgccaaucccaaaggcaugcagauggcugugcauguuggcuucuu

SEQ ID NO: 223712 - RNA, 63 nt, hsa
uucaaaacuagaaggaucuacuccgcaugggugcaugcagaggcuccuggaucugggaagccc

SEQ ID NO: 223713 - RNA, 63 nt, hsa
uggccacauuuggaggaaguucacauuuccuggcaugcagacccaaaacuggguucuggcucu

SEQ ID NO: 223714 - RNA, 63 nt, hsa
accacuaacuagguaguguaugccccuucagaacaugcagaguguaucuuuuuuuaaauuucu

SEQ ID NO: 223715 - RNA, 64 nt, hsa
aagauaccaacuucaacacuguaauaacauauacugugaaaacauuccuaaaaaguaaccaaag

SEQ ID NO: 223716 - RNA, 64 nt, hsa
acaaaggauggucuuggccauaugcuagggccccugugaaaauaaguaguuuugagaaguuuuu

SEQ ID NO: 223717 - RNA, 64 nt, hsa
uaaauaacuagaaauaacaugauuuagucauaauugugaaaaauaauaauaauuuuucuuggau

SEQ ID NO: 223718 - RNA, 64 nt, hsa
aauaauaauuuuucuuggauuuauguucuguaucugugaaaaaauaaauuucuuauaaaacucg

SEQ ID NO: 223719 - RNA, 64 nt, hsa
ggcuaguacuguauuggcucugugaaaacauauuugugaaaagaguauguaguggcuucuuuug

SEQ ID NO: 223720 - RNA, 64 nt, hsa
uguacuggguuaauggcuaguacuguauuggcucugugaaaacauauuugugaaaagaguaugu

SEQ ID NO: 223721 - RNA, 64 nt, hsa
aagaugaggauuaagagcaagaaguugggggggaugugaaaauaauuuuaugagguugucuaaa

SEQ ID NO: 223722 - RNA, 64 nt, hsa
cacuauuugagcauggaaaucauaguccccacucugugaaaacuuaacgcuuuuuggaagacau

SEQ ID NO: 223723 - RNA, 64 nt, hsa
agccuuaugaaugccccucgcuuuucuaaggccaugugaaaaucacggcacugcccuuagccuu

SEQ ID NO: 223724 - RNA, 64 nt, hsa
gaacaugagcccagcugagagaggagcaggaaugugugaaaaacagcugcucuccuugucccag

SEQ ID NO: 223725 - RNA, 64 nt, hsa
gcuggcuucuuuggacucccuauaugauugaugaugugaaaaccuaaauuacuugcagcauagu

SEQ ID NO: 223726 - RNA, 64 nt, hsa
uaaggaaacacucauuuagugucuguauuuuuggugugaaaauuauuuaguugccaguauauuc

SEQ ID NO: 223727 - RNA, 64 nt, hsa
aggcuuuggaaacccccagaugaacuucuauacaugugaaaacacaagucuuugagugugcacu

SEQ ID NO: 223728 - RNA, 64 nt, hsa
gaacaaaaauaauguucuuuuuaugcaaauccccugugaaaauaaaauuuucaauguuuuuuug

SEQ ID NO: 223729 - RNA, 64 nt, hsa
cucuaauuuccaaaaauguaagaaauuuuacaauugugaaaaccucauggauuugggcaaacug

SEQ ID NO: 223730 - RNA, 64 nt, hsa
uguguguguaaacuguaaagucuagcccagcccuugugaaaaaaaaaaucacaaauaaaacagu

SEQ ID NO: 223731 - RNA, 64 nt, hsa
gcaaacuguaaugaaacuacauuguauuucuaagugugaaaacgacaggcugccccguuuuuac

SEQ ID NO: 223732 - RNA, 64 nt, hsa
auuugggagauuguaaaaucuguaaaguuuguuuugugaaaauaaaauguucacaguagaauuu

SEQ ID NO: 223733 - RNA, 64 nt, hsa
augccucauucaucuagagguaaucuggcagucuugugaaaaccgaacacaacucagaaacuug

SEQ ID NO: 223734 - RNA, 64 nt, hsa
ccauuuuuugaaauagagaauauuuuauuauuuuugugaaaauagaguuuugguaaucacuuuc

SEQ ID NO: 223735 - RNA, 64 nt, hsa
uugcuaaucauugacuguagucccaaaaaagccuugugaaaauguuaugcccuauguaacagca

SEQ ID NO: 223736 - RNA, 64 nt, hsa
aaccaguucugcaagugacuguguuuuguauuacugugaaaauaagaaaauguaguuaauuaca

SEQ ID NO: 223737 - RNA, 64 nt, hsa
uacguucuaagaaaugcauaguuagggaaucuugugugaaaaucagcuuguauuuacacaaacc

SEQ ID NO: 223738 - RNA, 64 nt, hsa
cuuauuccaguaacauuuuuauguacucaucugcugugaaaagucuuuagguucauuaaaaaaa

SEQ ID NO: 223739 - RNA, 64 nt, hsa
uuaaauaagaaaaacauuccuagaagaugauaauugugaaaaccuccuuuggcuuauuugcuuu

SEQ ID NO: 223740 - RNA, 64 nt, hsa
uuauauuuugcaagggucauucuagcugccauauugugaaaaacuuuaguggacaagggcagaa

SEQ ID NO: 223741 - RNA, 64 nt, hsa
ggggagaaugguaguauuuuuuuuuuuuaucagcugugaaaaaaauguuacagaucugcacauu

SEQ ID NO: 223742 - RNA, 64 nt, hsa
uauuuggggaaaguuugcuaauauacauuuugucugugaaaauauaguaaauuuuaaaauacua

SEQ ID NO: 223743 - RNA, 64 nt, hsa
ugugcagaaagauuccaaaggagaauauauaucuugugaaaauauggagauuugaaaauuugac

SEQ ID NO: 223744 - RNA, 64 nt, hsa
aaaaaaaaaaaagaaaagaaaaagauaaagggauugugaaaagagcauuuauauuggacuaauc

SEQ ID NO: 223745 - RNA, 64 nt, hsa
caccguuugucuucuuaccucauuuuaagaagcaugugaaaaugggauacuauagacuacugag

SEQ ID NO: 223746 - RNA, 64 nt, hsa
acuucaaauuagccucaugaagagaauuuuucccugugaaaaguaagaccaagaaaaaacaaac

SEQ ID NO: 223747 - RNA, 64 nt, hsa
acacacuuugaauaacugcaaaggauuuacgguuugugaaaaauguguacuguggaaaagauaa

SEQ ID NO: 223748 - RNA, 64 nt, hsa
aagcuacaguaauuucuguauuacaucauuuauaugugaaaaguuggacauuucuguaaguuuu

SEQ ID NO: 223749 - RNA, 61 nt, hsa
cagaggcuaccaaugucuaaggaagcuguggugugaaaauguauggaugaauucugaccag

SEQ ID NO: 223750 - RNA, 64 nt, hsa
uuuaauuccuggaaaacuggcugggcagagccugugugaaaauacuggaauucaaagauaaggc

SEQ ID NO: 223751 - RNA, 64 nt, hsa
uuauuaucuuucugucuuuuacaccugcucuuuaugugaaaauguauaugaauccuuuuaaaau

SEQ ID NO: 223752 - RNA, 64 nt, hsa
uaauuuaauuuuaagacugaaacccuuaauauugugugaaaaagaguaauaaaaccuuugaaag

SEQ ID NO: 223753 - RNA, 64 nt, hsa
aauuaauguacuaaauccuauguuuacauuaauaugugaaaaaagauuuagaagauauuuugga

SEQ ID NO: 223754 - RNA, 64 nt, hsa
ucuuuaauauauuuacacaaugaauccaagugacugugaaaaggucucauuacaaugaaaccaa

SEQ ID NO: 223755 - RNA, 64 nt, hsa
aaaucaguuauagguuaauguagauaggauguuuugugaaaaagcaaucuauuguguccaaaua

SEQ ID NO: 223756 - RNA, 64 nt, hsa
agaugaaaaacgauuaauguuucauuauuauuauugugaaaauauuauuaacacuggggacucc

SEQ ID NO: 223757 - RNA, 64 nt, hsa
auaugaguugaaugcaauuuuuauuuuugguaacugugaaaaauaagauacuguggauauauac

SEQ ID NO: 223758 - RNA, 64 nt, hsa
guacauuuuuaguuacuuaccuugaacauauucgugugaaaaagaauacaucauuucucacagu

SEQ ID NO: 223759 - RNA, 64 nt, hsa
auuaugggauugcuaccuguauaaacaauggcacugugaaaauacuguuaguuuuaauacaaga

SEQ ID NO: 223760 - RNA, 64 nt, hsa
ugaguuccucauuuguugguaaaaagaaaaagaaugugaaaaugucucuuuuuuucuuggcuau

SEQ ID NO: 223761 - RNA, 64 nt, hsa
ccaggcauauggucuuuaguaauggcuuguaauuugugaaaacauuaauuuggggguuuucccu

SEQ ID NO: 223762 - RNA, 64 nt, hsa
uccuuuugcaaaagcagacuaaaauguuuuaaaaugugaaaaaacauuauuuuuucaaagcaag

SEQ ID NO: 223763 - RNA, 64 nt, hsa
uugagaaaauucguacuggagagaauccuacaaaugugaaaaauguggcaaauccuuuaacuga

SEQ ID NO: 223764 - RNA, 64 nt, hsa
uaacauaaaucauacuggugaaaaauccuagaaaugugaaaaauaucacaaagccuuuaaaugg

SEQ ID NO: 223765 - RNA, 64 nt, hsa
auauuggagaaaagcacuguaaauguaaugcauuugugaaaacauuuuuuaaaaaacuacagcu

SEQ ID NO: 223766 - RNA, 64 nt, hsa
uaauuggucauaaauaauuggcaaaauaacaaauugugaaaauagaagccauugcucagcaccg

SEQ ID NO: 223767 - RNA, 64 nt, hsa
auacuggagcuuuaagaacauacuuaguuucucaugugaaaacuuaggcuuugucugauguuuu

SEQ ID NO: 223768 - RNA, 64 nt, hsa
ccauacuagagagaagcccuacaaauguaaagaaugugaaaagucuuucagucagagcucaagu

SEQ ID NO: 223769 - RNA, 64 nt, hsa
ucacaugggaauaaaauuccauugcugcaaugaaugugaaaaagccaucagucaaagaaacuac

SEQ ID NO: 223770 - RNA, 64 nt, hsa
aaucuaaaauauacuauaacaaccguguuuuauuugugaaaaaaauauuaaagugauuugcucu

SEQ ID NO: 223771 - RNA, 64 nt, hsa
uguagcuguuauuuucaguacuuggcugcuuuucugugaaaauuauuauuuuacuuuuggaaga

SEQ ID NO: 223772 - RNA, 64 nt, hsa
gaggaauguuuaauaugaaaacauacaucggauaugugaaaagcacaacaaaauucuuaaugua

SEQ ID NO: 223773 - RNA, 64 nt, hsa
ucuaaaagcauacacaauguguaacugaaugguuugugaaaaauauauugauauauauacuagu

SEQ ID NO: 223774 - RNA, 64 nt, hsa
aaucacaucacgaaaauucugugccugucgucagugugaaaaugccuuugcugauaauuuaucc

SEQ ID NO: 223775 - RNA, 64 nt, hsa
uucauuauaagguaacugauaaaaacaggaaauaugugaaaauauuuuuuauuagguggaugag

SEQ ID NO: 223776 - RNA, 64 nt, hsa
aaggguuaguggagaguuuuuaauuaaaagaaugugugaaaaguacaugacacaguaguugcuu

SEQ ID NO: 223777 - RNA, 64 nt, hsa
cauaguggguauaaucauggaucgcuuguaccccugugaaaauauauuuuuuaaaaauaucuuu

SEQ ID NO: 223778 - RNA, 64 nt, hsa
gcuuccauuugaccuaagauuggccauuuguuggugugaaaauauuuucuuuucagaaauaguu

SEQ ID NO: 223779 - RNA, 64 nt, hsa
uguggccaguaaaauuauaccauuggcaugaagcugugaaaaaugagaaauucuaccuuuacca

SEQ ID NO: 223780 - RNA, 64 nt, hsa
guuguguugugaaauguuuuaggauuuuuuguauugugaaaauaugaauaugauuggauucaga

SEQ ID NO: 223781 - RNA, 64 nt, hsa
aauuaacuuucugaauuugaucugucuucagucuugugaaaaaguugaacaaauuuccuaauca

SEQ ID NO: 223782 - RNA, 64 nt, hsa
ugauagacuuuugcauugggaccaaugaaucuggugugaaaaacccugcuguaguagugaaaga

SEQ ID NO: 223783 - RNA, 64 nt, hsa
uccaucucucucucucuuucccuuuccucagugaugugaaaauaauuguguuuugcugaacuug

SEQ ID NO: 223784 - RNA, 64 nt, hsa
gugguaaaucaagauuuaguuguaauuuuccagcugugaaaauguugccuuguauuuaaaaggg

SEQ ID NO: 223785 - RNA, 64 nt, hsa
aguauuauugagucuuuucauacacuucuuaaaaugugaaaaucuauguuuucaguauuaugac

SEQ ID NO: 223786 - RNA, 64 nt, hsa
uuguggacagucccuaaaaguccaguucuacauuugugaaaauuguggugccaugaauuaagau

SEQ ID NO: 223787 - RNA, 64 nt, hsa
uccuauuuauauuauuuuucaguccugugaaugcugugaaaagauuuauuccuuugaggccagg

SEQ ID NO: 223788 - RNA, 64 nt, hsa
cauguacuucccuaggacuagaugcauaccguuuugugaaaaccagccauaggaaaacauguga

SEQ ID NO: 223789 - RNA, 64 nt, hsa
uaugucuguguuucuuaggaauguugaagcuuuuugugaaaacuguacuguauacauauauaaa

SEQ ID NO: 223790 - RNA, 64 nt, hsa
ucaaggcggcagcauaauuugaagggcaauugcgugugaaaauugaugugacuugauuuacaca

SEQ ID NO: 223791 - RNA, 64 nt, hsa
acuucuugaaaauccaauaaaauuggcaaaagauugugaaaauucuggaagaauaagggaaaca

SEQ ID NO: 223792 - RNA, 64 nt, hsa
aaagaagaaauuggcagauauuggaaaaauauuuugugaaaagcuguauuuauuauaaauacua

SEQ ID NO: 223793 - RNA, 64 nt, hsa
uuuaaauucucaguuuaugucucagaugcuaacgugugaaaauauaaauauauauaauauauaa

SEQ ID NO: 223794 - RNA, 64 nt, hsa
uucucauuugauauaauuuuucucuguuucacugugugaaaaaaagaagauauuucccauaaau

SEQ ID NO: 223795 - RNA, 64 nt, hsa
gaugugaaggugaacauuccugauuuuugucugaugugaaaaagccuugguauuuuacauuuug

SEQ ID NO: 223796 - RNA, 64 nt, hsa
ugguuuugguuuuguuuggguaaauuuuaaauggugugaaaaucgaugacaacaguccucuuac

SEQ ID NO: 223797 - RNA, 64 nt, hsa
uaaggagauuuuuuuuuucacaguugaguuaguuugugaaaauaaagaacucuguagcucacca

SEQ ID NO: 223798 - RNA, 64 nt, hsa
cauuuuggaaauguccucauuauguagaauggaaugugaaaauuauuuuuguuaaaacaggauu

SEQ ID NO: 223799 - RNA, 64 nt, hsa
ugauaacugugaaauauuugugauacgugucaugugugaaaaguuugaugcauuuugagaugga

SEQ ID NO: 223800 - RNA, 64 nt, hsa
aauccauacuagagaaacacuauagauguaaaaaugugaaaaguuuuauucaaaauaucaaacu

SEQ ID NO: 223801 - RNA, 64 nt, hsa
ucuguugcugcuuuuccuuaauccgugguguucaugugaaaauauguguucuguuuuuuuuucu

SEQ ID NO: 223802 - RNA, 64 nt, hsa
uuuacauauaagucuguuuaauuucaaaggaguuugugaaaaaaaauccauggugaaaaugaaa

SEQ ID NO: 223803 - RNA, 64 nt, hsa
cuuuguuucuuacauguguacuuuuuuguuuacuugugaaaauggccaucuuuaagcauauuua

SEQ ID NO: 223804 - RNA, 64 nt, hsa
gaacuuugauguauaauaagcagcagcaacuucaugugaaaauauggucagguaguuauaugua

SEQ ID NO: 223805 - RNA, 64 nt, hsa
cuuccacgcuuagaucaugucuucagaacuuagaugugaaaaucuacacacugggagaugcugu

SEQ ID NO: 223806 - RNA, 64 nt, hsa
cauuugcaaaacacacauaauaccgucagagugcugugaaaaaccuuaaggguguguggauggc

SEQ ID NO: 223807 - RNA, 64 nt, hsa
uuguggccaucuuugcaaaugacuaccuauagccugugaaaauacauuucaaaaaauguuaugu

SEQ ID NO: 223808 - RNA, 64 nt, hsa
gauuucaaggacuacuaaaggaaggcaauauacaugugaaaaccauaaaauacauuuuuugcau

SEQ ID NO: 223809 - RNA, 64 nt, hsa
guuuuuagcuuuuaaaauuuaaaguguuuuugagugugaaaaguugaguaaaacuauuugcaac

SEQ ID NO: 223810 - RNA, 64 nt, hsa
auuaagauuuaaaaacgaaaaguaugccuugccuugugaaaauuuauccauuuaucuucagguu

SEQ ID NO: 223811 - RNA, 64 nt, hsa
aaaagaaacaaagucuccaagaaauaugggacuaugugaaaagaccaaaucuaccucugauugg

SEQ ID NO: 223812 - RNA, 64 nt, hsa
agaauuuuagaccaauauccuugaugaacauugaugugaaaauccucaauaaaauacuggcaaa

SEQ ID NO: 223813 - RNA, 64 nt, hsa
aaaaaaaauuuauacuguacaaaaaccccacaagugugaaaaacauggcaaagccuuuaagaag

SEQ ID NO: 223814 - RNA, 64 nt, hsa
uuauacuugagauaaauuauacaaauauaaagacugugaaaaagccaucauuaucugcucacau

SEQ ID NO: 223815 - RNA, 64 nt, hsa
uaagauaauuuauacuggagagaagcccuacaaaugugaaaaauguggcaaaccuuuuaaccaa

SEQ ID NO: 223816 - RNA, 64 nt, hsa
uuagauaauucaugcuggagagaaacccuacaaaugugaaaaauguggcaaagcuuuuaaccaa

SEQ ID NO: 223817 - RNA, 64 nt, hsa
uaagaaaauucauacuggagagaaacccuaugauugugaaaaauauggcaaaggcuuuaacuag

SEQ ID NO: 223818 - RNA, 64 nt, hsa
auuuauauuugagaaaaauuguagaaauauagacugugaaaaagacgucaauaucugcucacau

SEQ ID NO: 223819 - RNA, 64 nt, hsa
gaacaguuauacaaacgagggcuugaaaacauuuugugaaaacuugcuuaguccugcaacguuc

SEQ ID NO: 223820 - RNA, 64 nt, hsa
gaaggaaugucauuuuuaaucuuuuuaaagagugugugaaaauucacuuuaacuggaauuuuaa

SEQ ID NO: 223821 - RNA, 64 nt, hsa
caauggggcugccucuuuuccuuucaucagacacugugaaaacauucccuuaagcgugcacuuu

SEQ ID NO: 223822 - RNA, 64 nt, hsa
ggcaaagggauccauaugugcaauggcaaagaaaugugaaaaggcauugggagaagcagucugg

SEQ ID NO: 223823 - RNA, 64 nt, hsa
aacaagauaagauuugauuauuuuccaaaguguaugugaaaagaaacuuucuuuuggagggugu

SEQ ID NO: 223824 - RNA, 64 nt, hsa
aaugauuuugccuccuggauaucagaaaaauccaugugaaaauguaguaaaccuuuaaaacuca

SEQ ID NO: 223825 - RNA, 64 nt, hsa
gucagcuacugggaauauuuuuguagagcugcauugugaaaaaaagauggucuuaccugaaucu

SEQ ID NO: 223826 - RNA, 64 nt, hsa
acacgcagcgcguuggugucuccguguuugucccugugaaaacauguaacgucugccuuagagc

SEQ ID NO: 223827 - RNA, 64 nt, hsa
cuggucuucauugugaaacgugccagucgugcuuugugaaaaauaacaaaguggucacagaaau

SEQ ID NO: 223828 - RNA, 64 nt, hsa
guaauuuacuacacuuauaaaauagugugacuuuugugaaaauuuugaauuagcuuucauauga

SEQ ID NO: 223829 - RNA, 64 nt, hsa
aaugccacuauuguggaaauaggauaauuguaauugugaaaaaauaauuuuaaggaaaucuuac

SEQ ID NO: 223830 - RNA, 64 nt, hsa
acuuuuccucacuuuguugugcacuguaaugaaaugugaaaaaugcuuuauuuagcuguaugug

SEQ ID NO: 223831 - RNA, 64 nt, hsa
uugucacugcaauaaguggguuuuagaaaauaagugugaaaagaaucagguguuaauauaauac

SEQ ID NO: 223832 - RNA, 64 nt, hsa
gcaugagaaauaugauauuuggauagggauuucagcaacuaaacauucucuguucugagaucuc

SEQ ID NO: 223833 - RNA, 64 nt, hsa
auggaaggaaguauuaauaauagggaauaaguuugcaacuaaucucaugcugcaaacuuguguu

SEQ ID NO: 223834 - RNA, 64 nt, hsa
uagaaaucagaauaaguaaaaggaacguucacucacaggguacgcucauggagagagggcgcag

SEQ ID NO: 223835 - RNA, 64 nt, hsa
ugcaauucgauccucaaucaguggguggaggauaacaggguagauucacuugugugcacuugua

SEQ ID NO: 223836 - RNA, 64 nt, hsa
caaguccuucccauacucaaguggccaggaccucacaggguauggcugucaagaggcaggggcu

SEQ ID NO: 223837 - RNA, 64 nt, hsa
gacagagggcacagucccaugucaugcagaggugacaggguaucccuuccccucugccccagug

SEQ ID NO: 223838 - RNA, 64 nt, hsa
ggauucuguucauucaacaugcaacuuuagggaauggaaguaaguucauuuuuaaguuguguug

SEQ ID NO: 223839 - RNA, 64 nt, hsa
uguaaaacugguaggagcuaugguuuaagagcauuggaaguaguuacaacucaaggauuuuggu

SEQ ID NO: 223840 - RNA, 64 nt, hsa
auguaaauccacaggguagauuucuuucuagauguggaaguacaagaaaaucuuuuuuaguuau

SEQ ID NO: 223841 - RNA, 64 nt, hsa
acucacuuuggucaaaugauuauuguguugucacuggaaguacugucaaagacuuugggggucu

SEQ ID NO: 223842 - RNA, 64 nt, hsa
aaaaugccaucucuuuuuaguugaaggaaaacucuggaaguaggugccauuggucauucugcag

SEQ ID NO: 223843 - RNA, 64 nt, hsa
aggaaauauaauuugagaauacuuuaaagggaaguggaaguauaagugaaugauauuuuucuuu

SEQ ID NO: 223844 - RNA, 64 nt, hsa
aaguuucauuguacauucaaagaaaauguaaguuuggaaguacuaaaagacuauuuuauacuug

SEQ ID NO: 223845 - RNA, 64 nt, hsa
gcuacuacauaagccaaaacauguaucucaucauuggaaguaagaucagggcugauauucaccu

SEQ ID NO: 223846 - RNA, 64 nt, hsa
agaaaagcaaccacagccagccuuagggaaaacuuggaaguaagugaaauuugucuucagaaua

SEQ ID NO: 223847 - RNA, 64 nt, hsa
gagcagguguugcagacaggagggccacagcguguggaaguaaagacuuuggagcuagagaagc

SEQ ID NO: 223848 - RNA, 64 nt, hsa
cauuuagcuuuggaaguuuucuuugccuuaguuuuggaaguaaauucuaguuuguaguucucau

SEQ ID NO: 223849 - RNA, 64 nt, hsa
auuuuggcccuucaauuuggaggagggcaaaaguuggaaguaagaaguuuuauuuuaaguacuu

SEQ ID NO: 223850 - RNA, 64 nt, hsa
uguuuuuauuagccaaauucuaaugauuggcuccuggaaguauagaaaacucccauuaacauaa

SEQ ID NO: 223851 - RNA, 64 nt, hsa
aaacucuguuuucuuuggcacgauauuaauauuuuggaaguaaucauaacucuuuaccaguagu

SEQ ID NO: 223852 - RNA, 64 nt, hsa
ucuucugcacccacuucuaaauuuaauguuuuucuggaaguaguaauugcaagaguucgaauag

SEQ ID NO: 223853 - RNA, 64 nt, hsa
ugaggucuauuuuauguuuuugcugcuacuucuguggaaguagcuuugaacuaguuuuacuuug

SEQ ID NO: 223854 - RNA, 64 nt, hsa
uuuugcaaccugaggucuauaaacaaagucuuccuggaaguaauuguaagcauccugaaauaaa

SEQ ID NO: 223855 - RNA, 64 nt, hsa
cuggcuuagcaaggagccaacauaacagaugggcuggaaguaaggaaacauguaaugauaggcg

SEQ ID NO: 223856 - RNA, 61 nt, hsa
gaaauauuuuuaagcuccucugaugcagcagcaaugcaaauuaugacauagugaauauaga

SEQ ID NO: 223857 - RNA, 61 nt, hsa
agccucaacaauccaaaucuacaaacuuuaacaaugcaagucuuacucuaauuuuuaagua

SEQ ID NO: 223858 - RNA, 61 nt, hsa
gcagccuuuuuuuuuuuuuuuuuaauugcaacaaugcaaaagccaagaaaguauaaggguc

SEQ ID NO: 223859 - RNA, 61 nt, hsa
cuguacugauacuauucaaugcaaugcaauucaaugcaaugaaaacaaaauuccauuacag

SEQ ID NO: 223860 - RNA, 61 nt, hsa
aaacuggauacuguacugauacuauucaaugcaaugcaauucaaugcaaugaaaacaaaau

SEQ ID NO: 223861 - RNA, 61 nt, hsa
gaaguaaacuggauacuguacugauacuauucaaugcaaugcaauucaaugcaaugaaaac

SEQ ID NO: 223862 - RNA, 61 nt, hsa
uuguuaugcaugaaaccagugguagaagaaacaaugcaagacauacauuuccacuaugguc

SEQ ID NO: 223863 - RNA, 61 nt, hsa
gguuucaggaauuucaaaagaaaucugacgucaaugcaauuauccauuauuuaaaagcuau

SEQ ID NO: 223864 - RNA, 61 nt, hsa
aacugcuguaaacacaggggacacagcuuaacaaugcaacuuuuaauuacuguuuucuuuu

SEQ ID NO: 223865 - RNA, 61 nt, hsa
cuaguacuuauuacaugcugcuauacacaagcaaugcaagaaaaaaacuuacuggguaggu

SEQ ID NO: 223866 - RNA, 61 nt, hsa
gugugcauuuauuagcuauuacucaacuuuacaaugcaaacaucuuauuucucaucuuuaa

SEQ ID NO: 223867 - RNA, 61 nt, hsa
aaauugugccagcgagcaccgugaacgacugcaaugcaagcgggucuugcuggcuaaaaug

SEQ ID NO: 223868 - RNA, 64 nt, hsa
uauguauauguuuucucuguccuaauuuaaaaguacauugcaaacaucaugaaacuugaucccu

SEQ ID NO: 223869 - RNA, 64 nt, hsa
cugguuuuggaaucagcauccagucacggugcacacauugcauuuucuaacuauguuuuuaaaa

SEQ ID NO: 223870 - RNA, 64 nt, hsa
aaauauguagcugugguucuugaaaacacauccuacauugcauaugggcauagcaguuuuugac

SEQ ID NO: 223871 - RNA, 64 nt, hsa
cgucaggguagcauguauaaugcccacguguuaaacauugcauuuaaucgagaugcguccuauu

SEQ ID NO: 223872 - RNA, 64 nt, hsa
agaaggguaagugcuugcuguucccaucccugaaacauugcauguauuuaagaaaaacaaaaug

SEQ ID NO: 223873 - RNA, 64 nt, hsa
auuuauucaucugcaauuuggcuucccuaacuuaacauugcaucaugaaacucuuuggaacaac

SEQ ID NO: 223874 - RNA, 64 nt, hsa
uguugauuacuacuuuaagugauauucauuuaaaacauugcaaauuuauuuuauuuauuuaauu

SEQ ID NO: 223875 - RNA, 64 nt, hsa
ggauuacaggcuugagccaccacgcccggcuaaaacauugcaaauuuaaaugagaguuuuaaaa

SEQ ID NO: 223876 - RNA, 64 nt, hsa; identical to SEQ ID NO: 45363

SEQ ID NO: 223877 - RNA, 64 nt, hsa; identical to SEQ ID NO: 45364

SEQ ID NO: 223878 - RNA, 64 nt, hsa; identical to SEQ ID NO: 45365

SEQ ID NO: 223879 - RNA, 64 nt, hsa; identical to SEQ ID NO: 45366

SEQ ID NO: 223880 - RNA, 64 nt, hsa; identical to SEQ ID NO: 45367

SEQ ID NO: 223881 - RNA, 64 nt, hsa; identical to SEQ ID NO: 45368

SEQ ID NO: 223882 - RNA, 64 nt, hsa; identical to SEQ ID NO: 45369

SEQ ID NO: 223883 - RNA, 64 nt, hsa; identical to SEQ ID NO: 45370

SEQ ID NO: 223884 - RNA, 64 nt, hsa; identical to SEQ ID NO: 45371

SEQ ID NO: 223885 - RNA, 64 nt, hsa; identical to SEQ ID NO: 45372

SEQ ID NO: 223886 - RNA, 64 nt, hsa; identical to SEQ ID NO: 45373

SEQ ID NO: 223887 - RNA, 64 nt, hsa; identical to SEQ ID NO: 45374

SEQ ID NO: 223888 - RNA, 64 nt, hsa; identical to SEQ ID NO: 45375

SEQ ID NO: 223889 - RNA, 64 nt, hsa; identical to SEQ ID NO: 45376

SEQ ID NO: 223890 - RNA, 64 nt, hsa; identical to SEQ ID NO: 45377

SEQ ID NO: 223891 - RNA, 64 nt, hsa; identical to SEQ ID NO: 45378

SEQ ID NO: 223892 - RNA, 64 nt, hsa; identical to SEQ ID NO: 45379

SEQ ID NO: 223893 - RNA, 64 nt, hsa; identical to SEQ ID NO: 45380

SEQ ID NO: 223894 - RNA, 64 nt, hsa; identical to SEQ ID NO: 45381

SEQ ID NO: 223895 - RNA, 64 nt, hsa; identical to SEQ ID NO: 45382

SEQ ID NO: 223896 - RNA, 64 nt, hsa; identical to SEQ ID NO: 45383

SEQ ID NO: 223897 - RNA, 64 nt, hsa; identical to SEQ ID NO: 45384

SEQ ID NO: 223898 - RNA, 64 nt, hsa; identical to SEQ ID NO: 45385

SEQ ID NO: 223899 - RNA, 64 nt, hsa; identical to SEQ ID NO: 45386

SEQ ID NO: 223900 - RNA, 64 nt, hsa; identical to SEQ ID NO: 45387

SEQ ID NO: 223901 - RNA, 64 nt, hsa; identical to SEQ ID NO: 45388

SEQ ID NO: 223902 - RNA, 64 nt, hsa; identical to SEQ ID NO: 45389

SEQ ID NO: 223903 - RNA, 64 nt, hsa; identical to SEQ ID NO: 45390

SEQ ID NO: 223904 - RNA, 64 nt, hsa; identical to SEQ ID NO: 45391

SEQ ID NO: 223905 - RNA, 64 nt, hsa; identical to SEQ ID NO: 45392

SEQ ID NO: 223906 - RNA, 64 nt, hsa; identical to SEQ ID NO: 45393

SEQ ID NO: 223907 - RNA, 64 nt, hsa; identical to SEQ ID NO: 45394

SEQ ID NO: 223908 - RNA, 64 nt, hsa; identical to SEQ ID NO: 45395

SEQ ID NO: 223909 - RNA, 64 nt, hsa; identical to SEQ ID NO: 45396

SEQ ID NO: 223910 - RNA, 64 nt, hsa; identical to SEQ ID NO: 45397

SEQ ID NO: 223911 - RNA, 64 nt, hsa; identical to SEQ ID NO: 45398

SEQ ID NO: 223912 - RNA, 58 nt, hsa
aggcacugccccaggacaacacaacaaggacagucacaacaaggacaacaaggacaca

SEQ ID NO: 223913 - RNA, 58 nt, hsa
acaaggacacaacacaacacacaacaaggacagucacaacaagccuagagccagaaag

SEQ ID NO: 223914 - RNA, 58 nt, hsa
ggaaggaaggagccugugucccugggacgacagucaacuggagcuagguguugaccuc

SEQ ID NO: 223915 - RNA, 58 nt, hsa
ucuaggugcuguuuucaaaaccccagaugacagucauagaaaauuuggaacuuaggaa

SEQ ID NO: 223916 - RNA, 58 nt, hsa
aacugucucaaaaaagagagacuuccgggacagucauuaucagauaggccccaaaccu

SEQ ID NO: 223917 - RNA, 58 nt, hsa
cacagauugcaggguucugacaaggcaggacagucaagaguggggacacuuucagcuu

SEQ ID NO: 223918 - RNA, 58 nt, hsa
ggugcugagcccugcccugggccccacggacagucagccugccggccucccugcagcu

SEQ ID NO: 223919 - RNA, 58 nt, hsa
caugugcaaaagcuccccguccagcuuugacagucaguuuugaugucagcuccucggc

SEQ ID NO: 223920 - RNA, 64 nt, hsa; identical to SEQ ID NO: 70908

SEQ ID NO: 223921 - RNA, 64 nt, hsa; identical to SEQ ID NO: 70909

SEQ ID NO: 223922 - RNA, 63 nt, hsa; identical to SEQ ID NO: 70910

SEQ ID NO: 223923 - RNA, 64 nt, hsa; identical to SEQ ID NO: 70911

SEQ ID NO: 223924 - RNA, 64 nt, hsa; identical to SEQ ID NO: 70912

SEQ ID NO: 223925 - RNA, 64 nt, hsa; identical to SEQ ID NO: 70913

SEQ ID NO: 223926 - RNA, 64 nt, hsa; identical to SEQ ID NO: 70914

SEQ ID NO: 223927 - RNA, 64 nt, hsa; identical to SEQ ID NO: 70915

SEQ ID NO: 223928 - RNA, 63 nt, hsa; identical to SEQ ID NO: 70916

SEQ ID NO: 223929 - RNA, 64 nt, hsa; identical to SEQ ID NO: 70917

SEQ ID NO: 223930 - RNA, 64 nt, hsa; identical to SEQ ID NO: 70918

SEQ ID NO: 223931 - RNA, 64 nt, hsa; identical to SEQ ID NO: 70919

SEQ ID NO: 223932 - RNA, 64 nt, hsa; identical to SEQ ID NO: 70920

SEQ ID NO: 223933 - RNA, 64 nt, hsa; identical to SEQ ID NO: 70921

SEQ ID NO: 223934 - RNA, 64 nt, hsa; identical to SEQ ID NO: 70922

SEQ ID NO: 223935 - RNA, 64 nt, hsa; identical to SEQ ID NO: 70923

SEQ ID NO: 223936 - RNA, 64 nt, hsa; identical to SEQ ID NO: 70924

SEQ ID NO: 223937 - RNA, 64 nt, hsa; identical to SEQ ID NO: 70925

SEQ ID NO: 223938 - RNA, 64 nt, hsa; identical to SEQ ID NO: 70926

SEQ ID NO: 223939 - RNA, 64 nt, hsa; identical to SEQ ID NO: 70927

SEQ ID NO: 223940 - RNA, 64 nt, hsa; identical to SEQ ID NO: 70928

SEQ ID NO: 223941 - RNA, 64 nt, hsa; identical to SEQ ID NO: 70929

SEQ ID NO: 223942 - RNA, 64 nt, hsa; identical to SEQ ID NO: 70930

SEQ ID NO: 223943 - RNA, 64 nt, hsa; identical to SEQ ID NO: 70931

SEQ ID NO: 223944 - RNA, 64 nt, hsa; identical to SEQ ID NO: 70932

SEQ ID NO: 223945 - RNA, 64 nt, hsa; identical to SEQ ID NO: 70933

SEQ ID NO: 223946 - RNA, 64 nt, hsa; identical to SEQ ID NO: 70934

SEQ ID NO: 223947 - RNA, 64 nt, hsa; identical to SEQ ID NO: 70935

SEQ ID NO: 223948 - RNA, 64 nt, hsa; identical to SEQ ID NO: 70936

SEQ ID NO: 223949 - RNA, 64 nt, hsa; identical to SEQ ID NO: 70937

SEQ ID NO: 223950 - RNA, 64 nt, hsa; identical to SEQ ID NO: 70938

SEQ ID NO: 223951 - RNA, 64 nt, hsa; identical to SEQ ID NO: 70939

SEQ ID NO: 223952 - RNA, 64 nt, hsa; identical to SEQ ID NO: 70940

SEQ ID NO: 223953 - RNA, 64 nt, hsa; identical to SEQ ID NO: 70941

SEQ ID NO: 223954 - RNA, 64 nt, hsa; identical to SEQ ID NO: 70942

SEQ ID NO: 223955 - RNA, 64 nt, hsa; identical to SEQ ID NO: 70943

SEQ ID NO: 223956 - RNA, 64 nt, hsa; identical to SEQ ID NO: 70944

SEQ ID NO: 223957 - RNA, 64 nt, hsa; identical to SEQ ID NO: 70945

SEQ ID NO: 223958 - RNA, 64 nt, hsa; identical to SEQ ID NO: 70946

SEQ ID NO: 223959 - RNA, 64 nt, hsa; identical to SEQ ID NO: 70947

SEQ ID NO: 223960 - RNA, 64 nt, hsa; identical to SEQ ID NO: 70948

SEQ ID NO: 223961 - RNA, 64 nt, hsa; identical to SEQ ID NO: 70949

SEQ ID NO: 223962 - RNA, 64 nt, hsa; identical to SEQ ID NO: 70950

SEQ ID NO: 223963 - RNA, 64 nt, hsa; identical to SEQ ID NO: 70951

SEQ ID NO: 223964 - RNA, 64 nt, hsa; identical to SEQ ID NO: 70952

SEQ ID NO: 223965 - RNA, 64 nt, hsa; identical to SEQ ID NO: 70953

SEQ ID NO: 223966 - RNA, 64 nt, hsa; identical to SEQ ID NO: 70954

SEQ ID NO: 223967 - RNA, 64 nt, hsa; identical to SEQ ID NO: 70955

SEQ ID NO: 223968 - RNA, 64 nt, hsa; identical to SEQ ID NO: 70956

SEQ ID NO: 223969 - RNA, 64 nt, hsa; identical to SEQ ID NO: 70957

SEQ ID NO: 223970 - RNA, 64 nt, hsa; identical to SEQ ID NO: 70958

SEQ ID NO: 223971 - RNA, 64 nt, hsa; identical to SEQ ID NO: 70959

SEQ ID NO: 223972 - RNA, 64 nt, hsa; identical to SEQ ID NO: 70960

SEQ ID NO: 223973 - RNA, 64 nt, hsa; identical to SEQ ID NO: 70961

SEQ ID NO: 223974 - RNA, 64 nt, hsa; identical to SEQ ID NO: 70962

SEQ ID NO: 223975 - RNA, 64 nt, hsa; identical to SEQ ID NO: 70963

SEQ ID NO: 223976 - RNA, 64 nt, hsa; identical to SEQ ID NO: 70964

SEQ ID NO: 223977 - RNA, 62 nt, hsa; identical to SEQ ID NO: 70965

SEQ ID NO: 223978 - RNA, 64 nt, hsa; identical to SEQ ID NO: 70966

SEQ ID NO: 223979 - RNA, 64 nt, hsa; identical to SEQ ID NO: 70967

SEQ ID NO: 223980 - RNA, 64 nt, hsa; identical to SEQ ID NO: 70968

SEQ ID NO: 223981 - RNA, 64 nt, hsa; identical to SEQ ID NO: 70969

SEQ ID NO: 223982 - RNA, 64 nt, hsa; identical to SEQ ID NO: 70970

SEQ ID NO: 223983 - RNA, 64 nt, hsa; identical to SEQ ID NO: 70971

SEQ ID NO: 223984 - RNA, 64 nt, hsa; identical to SEQ ID NO: 70972

SEQ ID NO: 223985 - RNA, 64 nt, hsa; identical to SEQ ID NO: 70973

SEQ ID NO: 223986 - RNA, 64 nt, hsa; identical to SEQ ID NO: 70974

SEQ ID NO: 223987 - RNA, 64 nt, hsa; identical to SEQ ID NO: 70975

SEQ ID NO: 223988 - RNA, 64 nt, hsa; identical to SEQ ID NO: 70976

SEQ ID NO: 223989 - RNA, 64 nt, hsa; identical to SEQ ID NO: 70977

SEQ ID NO: 223990 - RNA, 64 nt, hsa; identical to SEQ ID NO: 70978

SEQ ID NO: 223991 - RNA, 64 nt, hsa; identical to SEQ ID NO: 70979

SEQ ID NO: 223992 - RNA, 64 nt, hsa; identical to SEQ ID NO: 70980

SEQ ID NO: 223993 - RNA, 64 nt, hsa; identical to SEQ ID NO: 70981

SEQ ID NO: 223994 - RNA, 64 nt, hsa; identical to SEQ ID NO: 70982

SEQ ID NO: 223995 - RNA, 64 nt, hsa; identical to SEQ ID NO: 70983

SEQ ID NO: 223996 - RNA, 64 nt, hsa; identical to SEQ ID NO: 70984

SEQ ID NO: 223997 - RNA, 64 nt, hsa; identical to SEQ ID NO: 70985

SEQ ID NO: 223998 - RNA, 64 nt, hsa; identical to SEQ ID NO: 70986

SEQ ID NO: 223999 - RNA, 64 nt, hsa; identical to SEQ ID NO: 70987

SEQ ID NO: 224000 - RNA, 64 nt, hsa; identical to SEQ ID NO: 70988

SEQ ID NO: 224001 - RNA, 64 nt, hsa; identical to SEQ ID NO: 70989

SEQ ID NO: 224002 - RNA, 64 nt, hsa; identical to SEQ ID NO: 70990

SEQ ID NO: 224003 - RNA, 64 nt, hsa; identical to SEQ ID NO: 70991

SEQ ID NO: 224004 - RNA, 64 nt, hsa; identical to SEQ ID NO: 70992

SEQ ID NO: 224005 - RNA, 64 nt, hsa; identical to SEQ ID NO: 70993

SEQ ID NO: 224006 - RNA, 64 nt, hsa; identical to SEQ ID NO: 70994

SEQ ID NO: 224007 - RNA, 64 nt, hsa; identical to SEQ ID NO: 70995

SEQ ID NO: 224008 - RNA, 64 nt, hsa; identical to SEQ ID NO: 70996

SEQ ID NO: 224009 - RNA, 64 nt, hsa; identical to SEQ ID NO: 70997

SEQ ID NO: 224010 - RNA, 64 nt, hsa; identical to SEQ ID NO: 70998

SEQ ID NO: 224011 - RNA, 64 nt, hsa; identical to SEQ ID NO: 70999

SEQ ID NO: 224012 - RNA, 64 nt, hsa; identical to SEQ ID NO: 71000

SEQ ID NO: 224013 - RNA, 64 nt, hsa; identical to SEQ ID NO: 71001

SEQ ID NO: 224014 - RNA, 64 nt, hsa; identical to SEQ ID NO: 71002

SEQ ID NO: 224015 - RNA, 64 nt, hsa; identical to SEQ ID NO: 71003

SEQ ID NO: 224016 - RNA, 64 nt, hsa; identical to SEQ ID NO: 71004

SEQ ID NO: 224017 - RNA, 64 nt, hsa; identical to SEQ ID NO: 71005

SEQ ID NO: 224018 - RNA, 64 nt, hsa; identical to SEQ ID NO: 71006

SEQ ID NO: 224019 - RNA, 64 nt, hsa; identical to SEQ ID NO: 71007

SEQ ID NO: 224020 - RNA, 64 nt, hsa; identical to SEQ ID NO: 71008

SEQ ID NO: 224021 - RNA, 64 nt, hsa; identical to SEQ ID NO: 71009

SEQ ID NO: 224022 - RNA, 64 nt, hsa; identical to SEQ ID NO: 71010

SEQ ID NO: 224023 - RNA, 64 nt, hsa; identical to SEQ ID NO: 71011

SEQ ID NO: 224024 - RNA, 64 nt, hsa; identical to SEQ ID NO: 71012

SEQ ID NO: 224025 - RNA, 64 nt, hsa; identical to SEQ ID NO: 71013

SEQ ID NO: 224026 - RNA, 64 nt, hsa; identical to SEQ ID NO: 71014

SEQ ID NO: 224027 - RNA, 64 nt, hsa; identical to SEQ ID NO: 71015

SEQ ID NO: 224028 - RNA, 64 nt, hsa; identical to SEQ ID NO: 71016

SEQ ID NO: 224029 - RNA, 64 nt, hsa; identical to SEQ ID NO: 71017

SEQ ID NO: 224030 - RNA, 64 nt, hsa; identical to SEQ ID NO: 71018

SEQ ID NO: 224031 - RNA, 64 nt, hsa; identical to SEQ ID NO: 71019

SEQ ID NO: 224032 - RNA, 64 nt, hsa; identical to SEQ ID NO: 71020

SEQ ID NO: 224033 - RNA, 64 nt, hsa; identical to SEQ ID NO: 71021

SEQ ID NO: 224034 - RNA, 64 nt, hsa; identical to SEQ ID NO: 71022

SEQ ID NO: 224035 - RNA, 64 nt, hsa; identical to SEQ ID NO: 71023

SEQ ID NO: 224036 - RNA, 64 nt, hsa; identical to SEQ ID NO: 71024

SEQ ID NO: 224037 - RNA, 64 nt, hsa; identical to SEQ ID NO: 71025

SEQ ID NO: 224038 - RNA, 64 nt, hsa; identical to SEQ ID NO: 71026

SEQ ID NO: 224039 - RNA, 64 nt, hsa; identical to SEQ ID NO: 71027

SEQ ID NO: 224040 - RNA, 64 nt, hsa; identical to SEQ ID NO: 71028

SEQ ID NO: 224041 - RNA, 64 nt, hsa; identical to SEQ ID NO: 71029

SEQ ID NO: 224042 - RNA, 64 nt, hsa; identical to SEQ ID NO: 71030

SEQ ID NO: 224043 - RNA, 64 nt, hsa; identical to SEQ ID NO: 71031

SEQ ID NO: 224044 - RNA, 64 nt, hsa; identical to SEQ ID NO: 71032

SEQ ID NO: 224045 - RNA, 64 nt, hsa; identical to SEQ ID NO: 71033

SEQ ID NO: 224046 - RNA, 64 nt, hsa; identical to SEQ ID NO: 71034

SEQ ID NO: 224047 - RNA, 64 nt, hsa; identical to SEQ ID NO: 71035

SEQ ID NO: 224048 - RNA, 64 nt, hsa; identical to SEQ ID NO: 71036

SEQ ID NO: 224049 - RNA, 64 nt, hsa; identical to SEQ ID NO: 71037

SEQ ID NO: 224050 - RNA, 64 nt, hsa; identical to SEQ ID NO: 71038

SEQ ID NO: 224051 - RNA, 64 nt, hsa; identical to SEQ ID NO: 71039

SEQ ID NO: 224052 - RNA, 64 nt, hsa; identical to SEQ ID NO: 71040

SEQ ID NO: 224053 - RNA, 64 nt, hsa; identical to SEQ ID NO: 71041

SEQ ID NO: 224054 - RNA, 64 nt, hsa; identical to SEQ ID NO: 71042

SEQ ID NO: 224055 - RNA, 64 nt, hsa; identical to SEQ ID NO: 71043

SEQ ID NO: 224056 - RNA, 64 nt, hsa; identical to SEQ ID NO: 71044

SEQ ID NO: 224057 - RNA, 64 nt, hsa; identical to SEQ ID NO: 71045

SEQ ID NO: 224058 - RNA, 64 nt, hsa; identical to SEQ ID NO: 71046

SEQ ID NO: 224059 - RNA, 64 nt, hsa; identical to SEQ ID NO: 71047

SEQ ID NO: 224060 - RNA, 64 nt, hsa; identical to SEQ ID NO: 71048

SEQ ID NO: 224061 - RNA, 64 nt, hsa; identical to SEQ ID NO: 71049

SEQ ID NO: 224062 - RNA, 64 nt, hsa; identical to SEQ ID NO: 71050

SEQ ID NO: 224063 - RNA, 64 nt, hsa; identical to SEQ ID NO: 71051

SEQ ID NO: 224064 - RNA, 64 nt, hsa; identical to SEQ ID NO: 71052

SEQ ID NO: 224065 - RNA, 64 nt, hsa; identical to SEQ ID NO: 71053

SEQ ID NO: 224066 - RNA, 64 nt, hsa; identical to SEQ ID NO: 71054

SEQ ID NO: 224067 - RNA, 64 nt, hsa; identical to SEQ ID NO: 71055

SEQ ID NO: 224068 - RNA, 50 nt, hsa; identical to SEQ ID NO: 71056

SEQ ID NO: 224069 - RNA, 64 nt, hsa; identical to SEQ ID NO: 71057

SEQ ID NO: 224070 - RNA, 64 nt, hsa; identical to SEQ ID NO: 71058

SEQ ID NO: 224071 - RNA, 64 nt, hsa; identical to SEQ ID NO: 71059

SEQ ID NO: 224072 - RNA, 64 nt, hsa; identical to SEQ ID NO: 71060

SEQ ID NO: 224073 - RNA, 64 nt, hsa; identical to SEQ ID NO: 71061

SEQ ID NO: 224074 - RNA, 64 nt, hsa; identical to SEQ ID NO: 71062

SEQ ID NO: 224075 - RNA, 64 nt, hsa; identical to SEQ ID NO: 71063

SEQ ID NO: 224076 - RNA, 64 nt, hsa; identical to SEQ ID NO: 71064

SEQ ID NO: 224077 - RNA, 64 nt, hsa; identical to SEQ ID NO: 71065

SEQ ID NO: 224078 - RNA, 64 nt, hsa; identical to SEQ ID NO: 71066

SEQ ID NO: 224079 - RNA, 64 nt, hsa; identical to SEQ ID NO: 71067

SEQ ID NO: 224080 - RNA, 64 nt, hsa; identical to SEQ ID NO: 71068

SEQ ID NO: 224081 - RNA, 64 nt, hsa; identical to SEQ ID NO: 71069

SEQ ID NO: 224082 - RNA, 64 nt, hsa; identical to SEQ ID NO: 71070

SEQ ID NO: 224083 - RNA, 64 nt, hsa; identical to SEQ ID NO: 71071

SEQ ID NO: 224084 - RNA, 64 nt, hsa; identical to SEQ ID NO: 71072

SEQ ID NO: 224085 - RNA, 64 nt, hsa; identical to SEQ ID NO: 71073

SEQ ID NO: 224086 - RNA, 64 nt, hsa; identical to SEQ ID NO: 71074

SEQ ID NO: 224087 - RNA, 64 nt, hsa; identical to SEQ ID NO: 71075

SEQ ID NO: 224088 - RNA, 64 nt, hsa; identical to SEQ ID NO: 71076

SEQ ID NO: 224089 - RNA, 64 nt, hsa; identical to SEQ ID NO: 71077

SEQ ID NO: 224090 - RNA, 64 nt, hsa; identical to SEQ ID NO: 71078

SEQ ID NO: 224091 - RNA, 64 nt, hsa; identical to SEQ ID NO: 71079

SEQ ID NO: 224092 - RNA, 64 nt, hsa; identical to SEQ ID NO: 71080

SEQ ID NO: 224093 - RNA, 64 nt, hsa; identical to SEQ ID NO: 71081

SEQ ID NO: 224094 - RNA, 64 nt, hsa; identical to SEQ ID NO: 71082

SEQ ID NO: 224095 - RNA, 64 nt, hsa; identical to SEQ ID NO: 71083

SEQ ID NO: 224096 - RNA, 64 nt, hsa; identical to SEQ ID NO: 71084

SEQ ID NO: 224097 - RNA, 64 nt, hsa; identical to SEQ ID NO: 71085

SEQ ID NO: 224098 - RNA, 64 nt, hsa; identical to SEQ ID NO: 71086

SEQ ID NO: 224099 - RNA, 64 nt, hsa; identical to SEQ ID NO: 71087

SEQ ID NO: 224100 - RNA, 64 nt, hsa; identical to SEQ ID NO: 71088

SEQ ID NO: 224101 - RNA, 64 nt, hsa; identical to SEQ ID NO: 71089

SEQ ID NO: 224102 - RNA, 64 nt, hsa
aaucgagugauaauacaguuuuacugcaaaagaagcacuucaaaccuauuauguccuuagaacu

SEQ ID NO: 224103 - RNA, 64 nt, hsa
cuccgaaugucaaaaacaaaugcgacaaacaauggcacuucaucauuuaaaguaauguugccaa

SEQ ID NO: 224104 - RNA, 64 nt, hsa
ggccucguggccuagcacugguguugagcaaugugcacuucacuggagagaaagaacuggaauu

SEQ ID NO: 224105 - RNA, 64 nt, hsa
ucccuuacuauucccacuuucauucaaucaaccugcacuucauaucuagauuucuagaaaagcu

SEQ ID NO: 224106 - RNA, 63 nt, hsa
agccugggaaccuggucugauuccuuccaacgugcacuucagcuggagaaagaaaccaagaag

SEQ ID NO: 224107 - RNA, 64 nt, hsa
gcggcucuucuuuuuaggaaggcucuggugcagagcacuucaaauauguccucaggccagauac

SEQ ID NO: 224108 - RNA, 64 nt, hsa
cgggcagucagcucuccauccaucccccucuuuaaucuaugaaucuauaggcucggugugugua

SEQ ID NO: 224109 - RNA, 64 nt, hsa
gcucugcaggacagacagacagacaaacccucugaucuaugaagucucugcagggcaaggggac

SEQ ID NO: 224110 - RNA, 64 nt, hsa
gaucaagccccacgaugacugcacaguagagcaaaucuaugagauuuugaaaaucuaccaacuc

SEQ ID NO: 224111 - RNA, 64 nt, hsa
caucaucuauggcacugauggacaggaggcccccaucuaugagcugacaucucaguucacuggu

SEQ ID NO: 224112 - RNA, 64 nt, hsa
uggcauugccccaggucgucagcagugugguauuaucuaugagaacuugagcgacagaguauuu

SEQ ID NO: 224113 - RNA, 64 nt, hsa
gcagguuuuauuuccauuauuuuauuuccacuauaucuaugauaagaugcaauuauaaggagag

SEQ ID NO: 224114 - RNA, 64 nt, hsa
uaagaaauguuuauguuucuuuauuaccaauguaaucuaugauuauugaaggaaauuuagaaaa

SEQ ID NO: 224115 - RNA, 64 nt, hsa
uaugaaggguuuuuugaaaucccauaggugccacaucuaugagauguuugauaaaugugaauau

SEQ ID NO: 224116 - RNA, 64 nt, hsa
ucauggggcugcuguguggguuugggaggcaaaaaucuaugaaggguuuuuugaaaucccauag

SEQ ID NO: 224117 - RNA, 64 nt, hsa
ccacugucacaggaagaaccugccaagcuuggucaucuaugacgccacaucagcacaguaggac

SEQ ID NO: 224118 - RNA, 64 nt, hsa
ccaccgucacaggaagcacuugccaagcuuggucaucuaugacaccacaccagcacaguaggac

SEQ ID NO: 224119 - RNA, 64 nt, hsa
uauuauaugugcuccugaagcgagcacucuuuuuaucuaugauacuuccauaauaaucucuucu

SEQ ID NO: 224120 - RNA, 64 nt, hsa
uauuacacgugcugcugaagggagcaugguuuuuaucuaugauacuuaguuaacauauauauua

SEQ ID NO: 224121 - RNA, 64 nt, hsa
uaaacaaaagaaacauuuauaaacuaaagaaaaacuaaaagaaugacagaacaaucaucuuagc

SEQ ID NO: 224122 - RNA, 64 nt, hsa
ggagaaauccucuuugugucucuacucuagaugccuaaaagaguuuauauacuucuaaaagcuc

SEQ ID NO: 224123 - RNA, 64 nt, hsa
augugaaauauauauacauauauauauauauuuccuaaaagaagaaaagauaccuuucuguuca

SEQ ID NO: 224124 - RNA, 64 nt, hsa
aauuugauaauuucauguaugaugugcauauaugcuaaaagaaugcagaaaaucauuuuaugaa

SEQ ID NO: 224125 - RNA, 64 nt, hsa
uagaaagucauugaacugacaguguuugaugcaacuaaaagaggauuguaagacauagcuuucu

SEQ ID NO: 224126 - RNA, 64 nt, hsa
auaauaagcaaauuauuggcuucuuucuucuagacuaaaagaaauuaaagagaugaaacaauca

SEQ ID NO: 224127 - RNA, 64 nt, hsa
aagaagaaagagagaaagaaagaaacagaaaaaccuaaaagaaagcgaaugaauuugacaccug

SEQ ID NO: 224128 - RNA, 64 nt, hsa
gggauccuuuuuacuuguagcccauuccugcccucuaaaagaauccuuccaacuuccuauaggg

SEQ ID NO: 224129 - RNA, 64 nt, hsa
uuauacuauauucuguuuccaaguaaccuuuuaacuaaaagauuuguuggguuuuagaucucuu

SEQ ID NO: 224130 - RNA, 64 nt, hsa
caguagucacuuuuguaagccagucucuucaugccuaaaagacacuaccagucaccuuugauuc

SEQ ID NO: 224131 - RNA, 64 nt, hsa
gcuggguggacucuuagugguccugcagcguauccuaaaagacuaccuuugaaacaggauucuu

SEQ ID NO: 224132 - RNA, 64 nt, hsa
cuugucuccccucauacacaaaaguacaauaugaagccuucauuuaaucucugcaguucaucuc

SEQ ID NO: 224133 - RNA, 64 nt, hsa
ugguacucggggaccuccaaagacuaaacugacaagccuucaaggagcccagggguaaguuaac

SEQ ID NO: 224134 - RNA, 64 nt, hsa
agaaauuuuagaaugauaggaaguuucucgaguuagccuucaugcaauuuuguagauuaaaaca

SEQ ID NO: 224135 - RNA, 64 nt, hsa
aaacagaaggagggaaaaaccaaccuacucugaaagccuucagacauuaugacucuggugauaa

SEQ ID NO: 224136 - RNA, 64 nt, hsa
gaauggauucaacacugugcacggaaaagacaagagccuucaacgacccuggacagugacgagg

SEQ ID NO: 224137 - RNA, 64 nt, hsa
gcugaaauacacgcuaguaacuccucugcccuucagccuucaaaguaagagucagcuuuuucuc

SEQ ID NO: 224138 - RNA, 64 nt, hsa
cuuuagauugauugccgagcggggcaguuuugugagccuucaucugaagccuucaguucacccc

SEQ ID NO: 224139 - RNA, 64 nt, hsa
gccgagcggggcaguuuugugagccuucaucugaagccuucaguucaccccucugcacaggccu

SEQ ID NO: 224140 - RNA, 64 nt, hsa
ugagaaaaaccugugaauguggguaaugugggagagccuucagccaaaccucauugcuuuauaa

SEQ ID NO: 224141 - RNA, 64 nt, hsa
ggggaggagccuuaucaaugcagugaguguggcaagccuucaguuacauacugauucuuuaaga

SEQ ID NO: 224142 - RNA, 64 nt, hsa
uggauuccucgguuucugggcuaccuauggcuucagccuucagcuccugggagucccagcuguu

SEQ ID NO: 224143 - RNA, 64 nt, hsa
caccuggaagccaaugaagggaacuggagaacucagccuucaucuucccccacccccauuugcu

SEQ ID NO: 224144 - RNA, 64 nt, hsa
gagagaaacccuacacauguaaagaauguggcaaagccuucaauagguucucaacccuuacugu

SEQ ID NO: 224145 - RNA, 64 nt, hsa
gaaaaaaaugcuacaaaugugaaaaacguggcagagccuucagaccauccacaaaccuuuauga

SEQ ID NO: 224146 - RNA, 64 nt, hsa
gugagaagccacaaaaauaugaaaaauguggcaaagccuucaaaugcuugucacaucuuacugu

SEQ ID NO: 224147 - RNA, 64 nt, hsa
gccugguacugauaguaguggcucgauuuuuaagagccuucaauuguagaugaacaucucuguu

SEQ ID NO: 224148 - RNA, 64 nt, hsa
uuuaucccucauucauccauccguucauucauucagccuucaaucaacaucucuugagugucua

SEQ ID NO: 224149 - RNA, 64 nt, hsa
ggccgcuuucugcccaguggcguugggggaauucagccuucauuuauaaucagugagauucccc

SEQ ID NO: 224150 - RNA, 64 nt, hsa
acagugucccugaaaccacaugcaucauucaggaagccuucacccugugacuauucagccuccc

SEQ ID NO: 224151 - RNA, 64 nt, hsa
agagagaaaacuuagugcuuccagcccuucuuggagccuucaugguccagggguaggggcccca

SEQ ID NO: 224152 - RNA, 64 nt, hsa
cacaggcuggggggcuccgguucccugagggaugagccuucagccucccuuuguaaugcugcuc

SEQ ID NO: 224153 - RNA, 64 nt, hsa
gagagaaccccuaugaguguaagcaauuugggaaagccuucagaucugucaaaaaucuucgauu

SEQ ID NO: 224154 - RNA, 64 nt, hsa
gagagaaacccuaugaguguaugccaagugggaaagccuucauuucuucuaguucccuucaaua

SEQ ID NO: 224155 - RNA, 64 nt, hsa
gagagaagcccuaugaauauaagcaaugugggaaagccuucagaucagccucgcaccuucaaau

SEQ ID NO: 224156 - RNA, 64 nt, hsa
gagagaaacccuauaaaugcaugccaugugguaaagccuucaaucuuuccaguuccuuucagua

SEQ ID NO: 224157 - RNA, 64 nt, hsa
gagagaaacccuaugaguguaagcaaugugggaaagccuucagaugugccccacaccuucgaag

SEQ ID NO: 224158 - RNA, 64 nt, hsa
gagagaaacccuaugaguguaaggaaugugggaaagccuucagaucugccucacaccuucaaau

SEQ ID NO: 224159 - RNA, 64 nt, hsa
cagagaaacccuaugaaugcaagcaaugugguaaagccuucaguaguuccaguuccuuuuggua

SEQ ID NO: 224160 - RNA, 64 nt, hsa
gagagaaacccuaugaguguaagcaaugugggaaagccuucagaucugccucaauccuucaaau

SEQ ID NO: 224161 - RNA, 64 nt, hsa
aagagaagcccuacgaguguaagcaaugugggaaagccuucagaucugccccacaccuucgaau

SEQ ID NO: 224162 - RNA, 64 nt, hsa
gagagaaacccuaugaguguaaggaaugugggaaagccuucagaucugccaagaaccuucgaau

SEQ ID NO: 224163 - RNA, 64 nt, hsa
uacagagaaacuugaaauauaaagaagaagagaaagccuucagugaugccucuguguuagggaa

SEQ ID NO: 224164 - RNA, 64 nt, hsa
ugagagaauccugaagaauggaacagcuguagaaagccuucagugcuaucagcagggauucaug

SEQ ID NO: 224165 - RNA, 64 nt, hsa
gagagaaaccuuaugaauguaaacagugugguaaagccuucaguaguuccaguuauauucauau

SEQ ID NO: 224166 - RNA, 64 nt, hsa
gagagaaacccuacaaaugcaaggaaugugggaaagccuucaguuaccacuguacugcucaaaa

SEQ ID NO: 224167 - RNA, 64 nt, hsa
cagggauagucuacaaauguaaggccugugggaaagccuucaguugucaacguucuuuccaaau

SEQ ID NO: 224168 - RNA, 64 nt, hsa
gagagaaaccuuaugaagguaaacaaugugguaaagccuucacucauucccguuuccuucaagg

SEQ ID NO: 224169 - RNA, 64 nt, hsa
cagaaaaaccuuaugagugucaaacauguagaaaagccuucagucauuuuggucacuuaaagca

SEQ ID NO: 224170 - RNA, 64 nt, hsa
gagagaaacucuguacauguaaacaaugugggaaagccuucagugcuuccacuucccuucaaag

SEQ ID NO: 224171 - RNA, 64 nt, hsa
gacagaaaagcuacgaauguauggaguguaggaaagccuucacuucacguaaucuuuuaaagac

SEQ ID NO: 224172 - RNA, 64 nt, hsa
gagagaaauucaaggaauguaaacggugugauuaagccuucaguuguccuaauucccuuugaag

SEQ ID NO: 224173 - RNA, 64 nt, hsa
gggugaaagucuauaaauguaagacauuugggaaagccuucacacagccuuuugagcacacaug

SEQ ID NO: 224174 - RNA, 64 nt, hsa
gugagaaacaguaugaauguaaacauugugauuaagccuucaguugaccuaauucauuucaaag

SEQ ID NO: 224175 - RNA, 64 nt, hsa
uacauucuuuucaccccucccagucuacccauccagccuucaugauucauuccugugucaaggu

SEQ ID NO: 224176 - RNA, 64 nt, hsa
uguauaugugauuaaaaugaagauuauuuucuaaagccuucaaauuagaaguggauuucuguuu

SEQ ID NO: 224177 - RNA, 64 nt, hsa; identical to SEQ ID NO: 87137

SEQ ID NO: 224178 - RNA, 64 nt, hsa; identical to SEQ ID NO: 87138

SEQ ID NO: 224179 - RNA, 64 nt, hsa; identical to SEQ ID NO: 87139

SEQ ID NO: 224180 - RNA, 64 nt, hsa; identical to SEQ ID NO: 87140

SEQ ID NO: 224181 - RNA, 64 nt, hsa; identical to SEQ ID NO: 87141

SEQ ID NO: 224182 - RNA, 64 nt, hsa; identical to SEQ ID NO: 87142

SEQ ID NO: 224183 - RNA, 64 nt, hsa; identical to SEQ ID NO: 87143

SEQ ID NO: 224184 - RNA, 64 nt, hsa; identical to SEQ ID NO: 87144

SEQ ID NO: 224185 - RNA, 64 nt, hsa; identical to SEQ ID NO: 87145

SEQ ID NO: 224186 - RNA, 64 nt, hsa; identical to SEQ ID NO: 87146

SEQ ID NO: 224187 - RNA, 64 nt, hsa; identical to SEQ ID NO: 87147

SEQ ID NO: 224188 - RNA, 64 nt, hsa; identical to SEQ ID NO: 87148

SEQ ID NO: 224189 - RNA, 64 nt, hsa; identical to SEQ ID NO: 87149

SEQ ID NO: 224190 - RNA, 64 nt, hsa; identical to SEQ ID NO: 87150

SEQ ID NO: 224191 - RNA, 64 nt, hsa; identical to SEQ ID NO: 87151

SEQ ID NO: 224192 - RNA, 64 nt, hsa; identical to SEQ ID NO: 87152

SEQ ID NO: 224193 - RNA, 64 nt, hsa; identical to SEQ ID NO: 87153

SEQ ID NO: 224194 - RNA, 64 nt, hsa; identical to SEQ ID NO: 87154

SEQ ID NO: 224195 - RNA, 64 nt, hsa; identical to SEQ ID NO: 87155

SEQ ID NO: 224196 - RNA, 64 nt, hsa; identical to SEQ ID NO: 87156

SEQ ID NO: 224197 - RNA, 64 nt, hsa; identical to SEQ ID NO: 87157

SEQ ID NO: 224198 - RNA, 64 nt, hsa; identical to SEQ ID NO: 87158

SEQ ID NO: 224199 - RNA, 64 nt, hsa; identical to SEQ ID NO: 87159

SEQ ID NO: 224200 - RNA, 64 nt, hsa; identical to SEQ ID NO: 87160

SEQ ID NO: 224201 - RNA, 64 nt, hsa; identical to SEQ ID NO: 87161

SEQ ID NO: 224202 - RNA, 64 nt, hsa; identical to SEQ ID NO: 87162

SEQ ID NO: 224203 - RNA, 64 nt, hsa; identical to SEQ ID NO: 87163

SEQ ID NO: 224204 - RNA, 64 nt, hsa; identical to SEQ ID NO: 87164

SEQ ID NO: 224205 - RNA, 64 nt, hsa; identical to SEQ ID NO: 87165

SEQ ID NO: 224206 - RNA, 64 nt, hsa; identical to SEQ ID NO: 87166

SEQ ID NO: 224207 - RNA, 64 nt, hsa; identical to SEQ ID NO: 87167

SEQ ID NO: 224208 - RNA, 64 nt, hsa; identical to SEQ ID NO: 87168

SEQ ID NO: 224209 - RNA, 64 nt, hsa; identical to SEQ ID NO: 87169

SEQ ID NO: 224210 - RNA, 64 nt, hsa; identical to SEQ ID NO: 87170

SEQ ID NO: 224211 - RNA, 64 nt, hsa; identical to SEQ ID NO: 87171

SEQ ID NO: 224212 - RNA, 64 nt, hsa; identical to SEQ ID NO: 87172

SEQ ID NO: 224213 - RNA, 64 nt, hsa; identical to SEQ ID NO: 87173

SEQ ID NO: 224214 - RNA, 64 nt, hsa; identical to SEQ ID NO: 87174

SEQ ID NO: 224215 - RNA, 64 nt, hsa; identical to SEQ ID NO: 87175

SEQ ID NO: 224216 - RNA, 64 nt, hsa; identical to SEQ ID NO: 87176

SEQ ID NO: 224217 - RNA, 64 nt, hsa; identical to SEQ ID NO: 55231

SEQ ID NO: 224218 - RNA, 64 nt, hsa; identical to SEQ ID NO: 55232

SEQ ID NO: 224219 - RNA, 64 nt, hsa; identical to SEQ ID NO: 55233

SEQ ID NO: 224220 - RNA, 64 nt, hsa; identical to SEQ ID NO: 55234

SEQ ID NO: 224221 - RNA, 64 nt, hsa; identical to SEQ ID NO: 55235

SEQ ID NO: 224222 - RNA, 64 nt, hsa; identical to SEQ ID NO: 55236

SEQ ID NO: 224223 - RNA, 64 nt, hsa; identical to SEQ ID NO: 55237

SEQ ID NO: 224224 - RNA, 64 nt, hsa; identical to SEQ ID NO: 55238

SEQ ID NO: 224225 - RNA, 64 nt, hsa; identical to SEQ ID NO: 55239

SEQ ID NO: 224226 - RNA, 64 nt, hsa; identical to SEQ ID NO: 55240

SEQ ID NO: 224227 - RNA, 64 nt, hsa; identical to SEQ ID NO: 55241

SEQ ID NO: 224228 - RNA, 64 nt, hsa; identical to SEQ ID NO: 55242

SEQ ID NO: 224229 - RNA, 64 nt, hsa; identical to SEQ ID NO: 55243

SEQ ID NO: 224230 - RNA, 64 nt, hsa; identical to SEQ ID NO: 55244

SEQ ID NO: 224231 - RNA, 64 nt, hsa; identical to SEQ ID NO: 55245

SEQ ID NO: 224232 - RNA, 64 nt, hsa; identical to SEQ ID NO: 55246

SEQ ID NO: 224233 - RNA, 64 nt, hsa; identical to SEQ ID NO: 55247

SEQ ID NO: 224234 - RNA, 64 nt, hsa; identical to SEQ ID NO: 55248

SEQ ID NO: 224235 - RNA, 64 nt, hsa; identical to SEQ ID NO: 55249

SEQ ID NO: 224236 - RNA, 64 nt, hsa; identical to SEQ ID NO: 55250

SEQ ID NO: 224237 - RNA, 64 nt, hsa; identical to SEQ ID NO: 55251

SEQ ID NO: 224238 - RNA, 64 nt, hsa; identical to SEQ ID NO: 55252

SEQ ID NO: 224239 - RNA, 64 nt, hsa; identical to SEQ ID NO: 55253

SEQ ID NO: 224240 - RNA, 64 nt, hsa; identical to SEQ ID NO: 55254

SEQ ID NO: 224241 - RNA, 64 nt, hsa; identical to SEQ ID NO: 55255

SEQ ID NO: 224242 - RNA, 64 nt, hsa; identical to SEQ ID NO: 55256

SEQ ID NO: 224243 - RNA, 64 nt, hsa; identical to SEQ ID NO: 55257

SEQ ID NO: 224244 - RNA, 64 nt, hsa; identical to SEQ ID NO: 55258

SEQ ID NO: 224245 - RNA, 64 nt, hsa; identical to SEQ ID NO: 55259

SEQ ID NO: 224246 - RNA, 64 nt, hsa; identical to SEQ ID NO: 55260

SEQ ID NO: 224247 - RNA, 64 nt, hsa; identical to SEQ ID NO: 55261

SEQ ID NO: 224248 - RNA, 64 nt, hsa; identical to SEQ ID NO: 55262

SEQ ID NO: 224249 - RNA, 64 nt, hsa; identical to SEQ ID NO: 55263

SEQ ID NO: 224250 - RNA, 64 nt, hsa; identical to SEQ ID NO: 55264

SEQ ID NO: 224251 - RNA, 64 nt, hsa; identical to SEQ ID NO: 55265

SEQ ID NO: 224252 - RNA, 64 nt, hsa; identical to SEQ ID NO: 55266

SEQ ID NO: 224253 - RNA, 64 nt, hsa; identical to SEQ ID NO: 55267

SEQ ID NO: 224254 - RNA, 64 nt, hsa; identical to SEQ ID NO: 55268

SEQ ID NO: 224255 - RNA, 64 nt, hsa; identical to SEQ ID NO: 55269

SEQ ID NO: 224256 - RNA, 64 nt, hsa; identical to SEQ ID NO: 55270

SEQ ID NO: 224257 - RNA, 64 nt, hsa; identical to SEQ ID NO: 55271

SEQ ID NO: 224258 - RNA, 64 nt, hsa; identical to SEQ ID NO: 55272

SEQ ID NO: 224259 - RNA, 64 nt, hsa; identical to SEQ ID NO: 55273

SEQ ID NO: 224260 - RNA, 64 nt, hsa; identical to SEQ ID NO: 55274

SEQ ID NO: 224261 - RNA, 64 nt, hsa; identical to SEQ ID NO: 55275

SEQ ID NO: 224262 - RNA, 64 nt, hsa; identical to SEQ ID NO: 55276

SEQ ID NO: 224263 - RNA, 64 nt, hsa; identical to SEQ ID NO: 55277

SEQ ID NO: 224264 - RNA, 64 nt, hsa; identical to SEQ ID NO: 55278

SEQ ID NO: 224265 - RNA, 64 nt, hsa; identical to SEQ ID NO: 55279

SEQ ID NO: 224266 - RNA, 64 nt, hsa
gggguuuuguccauagcuuugguugggccugugucacauccaggcagccauguggagggaguca

SEQ ID NO: 224267 - RNA, 64 nt, hsa
cagaagcccacugguaugggccucccgccccuuccacauccauguugugauuggauccauaagu

SEQ ID NO: 224268 - RNA, 64 nt, hsa
acugaccccucggcgccuggccuggccggugcugcacauccaccggggcacaacagggacuugu

SEQ ID NO: 224269 - RNA, 64 nt, hsa
augaggagacagagguccaggguggguuacauagcacauccagggcuaagcaagaaauaauuca

SEQ ID NO: 224270 - RNA, 64 nt, hsa
uguggcgguuucuguguacguuugcucauacacgcacauccaaaagccugugccucauuccugg

SEQ ID NO: 224271 - RNA, 64 nt, hsa
agacaauggacgugucaaugacuugaaaaaaagucacauccagcaaaugcagggucacaugaaa

SEQ ID NO: 224272 - RNA, 64 nt, hsa
ugauguaaaugguauuuuaggccaagugugcacccacauccaauggugcuacaagugacugaaa

SEQ ID NO: 224273 - RNA, 64 nt, hsa
cacuaugcauaucuuaucauuuuauuauuauacacacauccauccuaaacuauacuaaagcccu

SEQ ID NO: 224274 - RNA, 64 nt, hsa
acauccauggugagcauuuugauggacaaaguggcacauccaguggagcggugguagauccuga

SEQ ID NO: 224275 - RNA, 64 nt, hsa
uuuccccacucugcccaccucucucaugcugaaucacauccauggugagcauuuugauggacaa

SEQ ID NO: 224276 - RNA, 64 nt, hsa
augugucuguagacuuagauacauccucuugaagcacauccauuucuuuagcgucucucaguaa

SEQ ID NO: 224277 - RNA, 64 nt, hsa
ccaccaagcuagaaaauaaaaaacuuaguucuaccacauccaauuaacuuacacacccccuucc

SEQ ID NO: 224278 - RNA, 64 nt, hsa
uugaggagcucacaaucuagcugaggagacaagacacauccaaugcugcaaaaauggugaauaa

SEQ ID NO: 224279 - RNA, 64 nt, hsa
aguggagaagaggcagggucaggccucagcaucucacauccaccaccuccaggaggggagacca

SEQ ID NO: 224280 - RNA, 64 nt, hsa
uagauaagaaaagguggggcuauacuagcaacaaaaaaagaaugcuguuccugcaccugccggu

SEQ ID NO: 224281 - RNA, 64 nt, hsa
auauuaaaacagagauaugugcaugaaaucaagaaaaaagaaaugaacaaaagcaaagcauuag

SEQ ID NO: 224282 - RNA, 64 nt, hsa
cagcucgcuguagccuuggagagggaagugauggaaaaagaauauagcagcuuauuagggacuc

SEQ ID NO: 224283 - RNA, 64 nt, hsa
cccgguuauuuaugauuaaauuacugaagugucuaaaaagaacagaaggacccaccccagccau

SEQ ID NO: 224284 - RNA, 64 nt, hsa
caaaagacauaggacuuaacuggaaaaugaaaaaaaaaagaaaaagaaaaaacuaaacaaaaaa

SEQ ID NO: 224285 - RNA, 64 nt, hsa
acauaggacuuaacuggaaaaugaaaaaaaaaagaaaaagaaaaaacuaaacaaaaaaucccuc

SEQ ID NO: 224286 - RNA, 64 nt, hsa
agcccagagaagcccccuacauccccccgggaaaaaaaagaaaacuagacagaaacucaucuau

SEQ ID NO: 224287 - RNA, 64 nt, hsa
caggccaccauauuuagaacuaguuaccuuauuaaaaaagaaaaaacagucuguuggcuucuca

SEQ ID NO: 224288 - RNA, 64 nt, hsa
caucauaaacuuuuuaaaggaaaauaagcaaacuaaaaagaacauugguuuagauaaauacuua

SEQ ID NO: 224289 - RNA, 64 nt, hsa
ugaggguuuacauuuguuuuguuuuguaaccguuaaaaagaaguuguuuccagcuaauuauugu

SEQ ID NO: 224290 - RNA, 64 nt, hsa
guccuaauguugcuacucccauggcaaagaaaaaaaaaagaaugaaaaaaagaaaaaaauuugg

SEQ ID NO: 224291 - RNA, 64 nt, hsa
cuacucccauggcaaagaaaaaaaaaagaaugaaaaaaagaaaaaaauuuggaaaaaaaaauca

SEQ ID NO: 224292 - RNA, 64 nt, hsa
aauaguauaauuauaucaguaacaagaagacucaaaaaagaaacaggaguaccuaucccuaucu

SEQ ID NO: 224293 - RNA, 64 nt, hsa
uuuuaaauaaacuacuaguucuuuauauuuugacaaaaagaacuuaaauuuuaucaggaacugu

SEQ ID NO: 224294 - RNA, 64 nt, hsa
ccugggugacagagcaagugagacccugucucaaaaaaagaaaaagaaaaagaaaaaauauuuu

SEQ ID NO: 224295 - RNA, 64 nt, hsa
ugacagagcaagugagacccugucucaaaaaaagaaaaagaaaaagaaaaaauauuuucccuau

SEQ ID NO: 224296 - RNA, 64 nt, hsa
agcaagugagacccugucucaaaaaaagaaaaagaaaaagaaaaaauauuuucccuauuagaga

SEQ ID NO: 224297 - RNA, 64 nt, hsa
caggaugggguguaagccauagaguaagguuaacaaaaagaauaaagcuaaucauguauuacaa

SEQ ID NO: 224298 - RNA, 64 nt, hsa
ugggugguagaucaaggcuuuguuucauuugaaaaaaaagaaagaaagaaagaaagaaagaaau

SEQ ID NO: 224299 - RNA, 64 nt, hsa
ugacaggauuccaauaauuaagaauacuucauacaaaaagaaauguaaaugaccuuuaacaugu

SEQ ID NO: 224300 - RNA, 64 nt, hsa
aagagaauaaaccaguguuuuuaccuuucacuugaaaaagaaguauaaaaacaacuguauugag

SEQ ID NO: 224301 - RNA, 64 nt, hsa
cauugucucuaaaauacauaaguaaauuuaaaaaaaaaagaauaauaauuugaacagugaaugu

SEQ ID NO: 224302 - RNA, 64 nt, hsa
auaaggaaugaaguuggaaccacaggcagaucugaaaaagaaccaaauagagcuccuaaaaaug

SEQ ID NO: 224303 - RNA, 64 nt, hsa
ccagccuggguaacagagcaagacuccaucucaaaaaaagaaagaaagaaaaaagaaaguacaa

SEQ ID NO: 224304 - RNA, 64 nt, hsa
gagcaagacuccaucucaaaaaaagaaagaaagaaaaaagaaaguacaaguuuauaaaguauua

SEQ ID NO: 224305 - RNA, 64 nt, hsa
aguaaucccagaacaauggcuauucaugugggaaaaaaagaaauuuuacuuucucucaccuuac

SEQ ID NO: 224306 - RNA, 64 nt, hsa
agcauacguauacaauaaaacuaugcuauuaaaaaaaaagaagguaacugauaaaccaaaauug

SEQ ID NO: 224307 - RNA, 64 nt, hsa
aauaaauguucuuuauacagccuaguuaauguuuaaaaagaaaaaaauagcuugguuuuauuug

SEQ ID NO: 224308 - RNA, 64 nt, hsa
ugguugguuuaacaaaaaaaaaaagcuuuaaaaaaaaaagaaaaaaaggaaaagguuuuuagcu

SEQ ID NO: 224309 - RNA, 64 nt, hsa
ggagacaggggagacccuaugucaaaaaagaaauaaaaagaaaguaaaaguccccuagugauag

SEQ ID NO: 224310 - RNA, 64 nt, hsa
cuucagccuuggagacaggggagacccuaugucaaaaaagaaauaaaaagaaaguaaaaguccc

SEQ ID NO: 224311 - RNA, 64 nt, hsa
auauauuuuccuuucugacacauaauuuggggcaaaaaagaaagucuuaagaguuuaucuuuuc

SEQ ID NO: 224312 - RNA, 64 nt, hsa
uggaucaucccauucugguucccguucaaguucaaaaaagaaauaauguauuaaaauuuacauc

SEQ ID NO: 224313 - RNA, 64 nt, hsa
aaaagaauucagaacuacuuuccucugugacaccaaaaagaaaagucuauaaccugaaaauguu

SEQ ID NO: 224314 - RNA, 64 nt, hsa
agcaaauuaaguuauuuuccuaaaaaaaaaagaaaaaaagaauucagaacuacuuuccucugug

SEQ ID NO: 224315 - RNA, 64 nt, hsa
augaauuuagcaaauuaaguuauuuuccuaaaaaaaaaagaaaaaaagaauucagaacuacuuu

SEQ ID NO: 224316 - RNA, 64 nt, hsa
auauguaaagcaauuguaggaaauuugaaaggaaaaaaagaaaccgaagccaguauuuuaauaa

SEQ ID NO: 224317 - RNA, 64 nt, hsa
acacauuagagguacaggagcggcucagucaugaaaaaagaaggucuuuugccccauuucuuua

SEQ ID NO: 224318 - RNA, 64 nt, hsa
uaacacagcaagacucuaucucaaaaaaaagaaaaaaaagaaauacauagaguucagucccuag

SEQ ID NO: 224319 - RNA, 64 nt, hsa
cacccuggguaacacagcaagacucuaucucaaaaaaaagaaaaaaaagaaauacauagaguuc

SEQ ID NO: 224320 - RNA, 64 nt, hsa
cucacuucuacuccugcucuccuaguuccccccaaaaaagaaauacugaccagugucucuacuu

SEQ ID NO: 224321 - RNA, 64 nt, hsa
caccucccucucucuugcuucauuuggcuuuaucaaaaagaacagaccuagcucugaauuuguu

SEQ ID NO: 224322 - RNA, 64 nt, hsa
cuuuucuagucacagauguuuucaaauuucuaagaaaaagaaaaugaggcucaagaggcugcuu

SEQ ID NO: 224323 - RNA, 64 nt, hsa
ggaaagagcuggagucagcacuguccagaaagccaaaaagaaacagaagaagagagacuaaagg

SEQ ID NO: 224324 - RNA, 64 nt, hsa
agagcaaaccaaucagucccucaggaaagggaagaaaaagaagagguggcaccaugaagaggag

SEQ ID NO: 224325 - RNA, 64 nt, hsa
acugcagucagagagcaagccccccaaaaaaaagaaaaagaaaaggaggcagaaagaggaggaa

SEQ ID NO: 224326 - RNA, 64 nt, hsa
cccucaacugcagucagagagcaagccccccaaaaaaaagaaaaagaaaaggaggcagaaagag

SEQ ID NO: 224327 - RNA, 64 nt, hsa
gaauuugucacauguaucacccccaaaaaaagagaaaaagaaaaauagaagacauauaaauuaa

SEQ ID NO: 224328 - RNA, 64 nt, hsa
cuucuauaacaaauaaaugggaaaaaaaugaaauaaaaagaagagagggaggaagaaagggaga

SEQ ID NO: 224329 - RNA, 64 nt, hsa
ucccuaacagaauugaguuuucuauuaaggauccaaaaagaaaaacaaaaugcuaaugaagcca

SEQ ID NO: 224330 - RNA, 64 nt, hsa
ccuggcaacaagagcaaaacuccagcucaaaaaaaaaaagaaagaaaagaaagcuggagcuggu

SEQ ID NO: 224331 - RNA, 64 nt, hsa
uagaaacucuucuaauaaaugaaguaaaaaaauuaaaaagaauacaaauauuccagccccaaau

SEQ ID NO: 224332 - RNA, 64 nt, hsa
acagggucccaugagagcaguucuguggagauauaaaaagaauggaagaaggaaugccuuauag

SEQ ID NO: 224333 - RNA, 64 nt, hsa
gguuaaguaauagauuuccagcuaaauuggucuaaaaaagaauauuaaguguggacagaccuau

SEQ ID NO: 224334 - RNA, 64 nt, hsa
aaaaaagaaaaaaaaagaaaaaagagggaggaaaaaaaagaaccuacuuaagauagaacauggu

SEQ ID NO: 224335 - RNA, 64 nt, hsa
ugaugauggucuggggagagauuuuauuaaaaaaaaaaagaaaaaagagggaggaaaaaaaaga

SEQ ID NO: 224336 - RNA, 64 nt, hsa
ugacagagaaggacuccgucucaaaaaaaaaagaaaaaagaauagucauuuuuaaacuaccuau

SEQ ID NO: 224337 - RNA, 64 nt, hsa
gccugggugacagagaaggacuccgucucaaaaaaaaaagaaaaaagaauagucauuuuuaaac

SEQ ID NO: 224338 - RNA, 64 nt, hsa
caucaguacccgaucuugaagaaauucaagauucaaaaagaauuuuaaauacaccaacaugaga

SEQ ID NO: 224339 - RNA, 64 nt, hsa
augauugauagcuggacagacaugcucgucaugaaaaaagaaccauuucugaagcccgauuggg

SEQ ID NO: 224340 - RNA, 64 nt, hsa
ucucuuuccaguaaguucacauuuggauaauuuuaaaaagaaaaguaauuaccuuuguguuucc

SEQ ID NO: 224341 - RNA, 64 nt, hsa
gguccuguguuaccaaguuuauaugugacaguugaaaaagaaauucccuugaaaugaucaugag

SEQ ID NO: 224342 - RNA, 64 nt, hsa
cugaagauuaaccauuuuuuugucuuagaauaucaaaaagaaaaagaaaaagguguucuagcug

SEQ ID NO: 224343 - RNA, 64 nt, hsa
auuaaccauuuuuuugucuuagaauaucaaaaagaaaaagaaaaagguguucuagcuguuugca

SEQ ID NO: 224344 - RNA, 64 nt, hsa
aagcaacuucaguucuuuuacugcaaagaacagaaaaaagaaagaaagcaaacaagaagacucc

SEQ ID NO: 224345 - RNA, 64 nt, hsa
aguuugugucuuguggaagaaauccucuuuguggaaaaagaaacaggguuuugaacucuguuaa

SEQ ID NO: 224346 - RNA, 64 nt, hsa
ggugaaaaaacaaugcauucuugcuuuaaaaaaaaaaaagaaggcuaaaaaauuaccucuuuuu

SEQ ID NO: 224347 - RNA, 64 nt, hsa
uuuguaguuacuauaaaucaagcuuuggaaguccaaaaagaauaaaagacugccuuccuuuuag

SEQ ID NO: 224348 - RNA, 64 nt, hsa
gcuuauaauguaccuggaaaauaaaccucuugagaaaaagaaaaguucauacugauuauuggaa

SEQ ID NO: 224349 - RNA, 64 nt, hsa
uuuuugucuuaaaauauuaguggcuuacauuuuaaaaaagaaaaaucaccagcaugaacuugca

SEQ ID NO: 224350 - RNA, 64 nt, hsa
aaaaguguugcuagagaaaauuagggaaaaggugaaaaagaaaaaaugguaguaauugagcaga

SEQ ID NO: 224351 - RNA, 64 nt, hsa
cagauuuaucuaaguagaacugaauuggcuaggaaaaaagaaaaacugcauguuaaucauuuuc

SEQ ID NO: 224352 - RNA, 64 nt, hsa
uccagcccaggcaacaagagugaaacccugucucaaaaagaaaaaaaaaguugaccuugagaau

SEQ ID NO: 224353 - RNA, 64 nt, hsa
accuccagaacugugaaaaauaaauuuguuauuuaaaaagaaaaaaaaaaaaacaaaaaccuga

SEQ ID NO: 224354 - RNA, 64 nt, hsa
aaaaaaaaaaaaaaaaaaaaaaaaaaggaaaaaaaaaaagaaaaagaaaacgugugcauuuugu

SEQ ID NO: 224355 - RNA, 64 nt, hsa
aaaaaaaaaaaaaaaaaaaaggaaaaaaaaaaagaaaaagaaaacgugugcauuuuguauaaug

SEQ ID NO: 224356 - RNA, 64 nt, hsa
guuuucuuuuuucuagaaaacacuuuccuggauaaaaaagaaaacauuccagaugcaugaucca

SEQ ID NO: 224357 - RNA, 64 nt, hsa
uuugacauuuaauaacuuugcuggaaaaucuguaaaaaagaaaaacaaguuugcuagugacuaa

SEQ ID NO: 224358 - RNA, 64 nt, hsa
gcagccacugcaagcucugaaucaguuuuuuaaaaaaaagaaaaaaaaaaaaaaggagcugugc

SEQ ID NO: 224359 - RNA, 64 nt, hsa
gcuaaaacguuuuuauagagaaucuuguuuuucaaaaaagaauaaaaaguuugaauagcuauua

SEQ ID NO: 224360 - RNA, 64 nt, hsa
gcacaacacaaaaaccaacacaaaacauaacacaaaaaagaagcuaccuaugauccuggauuua

SEQ ID NO: 224361 - RNA, 64 nt, hsa
aauaaaaacaaguaucucaugcucuuguuucucaaaaaagaaaaacaaaaaacaaaaaacaggg

SEQ ID NO: 224362 - RNA, 64 nt, hsa
gaaauuccgaacccccuccuuccugaaaaagagcaaaaagaaggagaaaguggaguccugauuc

SEQ ID NO: 224363 - RNA, 64 nt, hsa
agagggcucaccuuccaagucucccucaaagaagaaaaagaaauuccgaacccccuccuuccug

SEQ ID NO: 224364 - RNA, 64 nt, hsa
uguauaccaggcagugugccaguuuaaaaagaugaaaaagaauaaaaacuuuugaggaacucuc

SEQ ID NO: 224365 - RNA, 64 nt, hsa
aaaucuucccaguauuauaaauuguguauuuaaaaaaaagaaacuuuucugaaugccuaccugg

SEQ ID NO: 224366 - RNA, 64 nt, hsa
aaaucgcaguuaaagcaugaaacacuugaauuggaaaaagaacucuguaguuugagguaugacc

SEQ ID NO: 224367 - RNA, 64 nt, hsa
aauaaggcuaguguacuacaaaagagacuaucugaaaaagaagaaauaaaaucgcaguuaaagc

SEQ ID NO: 224368 - RNA, 64 nt, hsa
gauuuuuuuguuaauaaugugcuaggauuugcuaaaaaagaaaaaaaaaaaacccuuuugaguu

SEQ ID NO: 224369 - RNA, 64 nt, hsa
cagauugcagaaaaacaggauuagaaacacacuuaaaaagaacacacauuuagagucucucuuc

SEQ ID NO: 224370 - RNA, 64 nt, hsa
guuuguaaguguuguauguaccguugauguugauaaaaagaaaguuuauaucuugauuauuuug

SEQ ID NO: 224371 - RNA, 64 nt, hsa
uuacaaauucuaaaagauaaguguguuugcaaaaaaaaagaaaauaaauacauaaaaaagggac

SEQ ID NO: 224372 - RNA, 64 nt, hsa
aaauguuaugaugcaaaaaaagaaaaagaaaaaaaaaaagaaaagaaaacuucaauuuucuggg

SEQ ID NO: 224373 - RNA, 64 nt, hsa
aagauuuuuaucaaauguuaugaugcaaaaaaagaaaaagaaaaaaaaaaagaaaagaaaacuu

SEQ ID NO: 224374 - RNA, 64 nt, hsa
aaacaaaagauuuuuaucaaauguuaugaugcaaaaaaagaaaaagaaaaaaaaaaagaaaaga

SEQ ID NO: 224375 - RNA, 64 nt, hsa
auugaagaacugcaugcagggaauugcuauugcuaaaaagaauggugagcuacgucauuauuga

SEQ ID NO: 224376 - RNA, 64 nt, hsa
uugccagagagauaaaauuuuugcucaaaaccagaaaaagaauuguaauggcuacaguuucagu

SEQ ID NO: 224377 - RNA, 64 nt, hsa
ucgacuggagaagaaaaaaaagaaaaaagauagaaaaaagaaaaaguuucagaagagcagaagu

SEQ ID NO: 224378 - RNA, 64 nt, hsa
caauuacaggaaauuagaucgacuggagaagaaaaaaaagaaaaaagauagaaaaaagaaaaag

SEQ ID NO: 224379 - RNA, 64 nt, hsa
guacuaaaaaaaaaaaaaaagaaaaagaaaaagaaaaaagaauacccaggugugguagugcaug

SEQ ID NO: 224380 - RNA, 64 nt, hsa
ccggucuguacuaaaaaaaaaaaaaaagaaaaagaaaaagaaaaaagaauacccagguguggua

SEQ ID NO: 224381 - RNA, 64 nt, hsa
ugaaacccggucuguacuaaaaaaaaaaaaaaagaaaaagaaaaagaaaaaagaauacccaggu

SEQ ID NO: 224382 - RNA, 64 nt, hsa
acguggugaaacccggucuguacuaaaaaaaaaaaaaaagaaaaagaaaaagaaaaaagaauac

SEQ ID NO: 224383 - RNA, 64 nt, hsa
augacaacuuuauauuuuuugauagcaucucuugaaaaagaauuuuaaugauucuaauaagagg

SEQ ID NO: 224384 - RNA, 64 nt, hsa
caaugaaggauuucuuauuuucuuggaauuuuguaaaaagaaauugugaaaaaugagcuuguaa

SEQ ID NO: 224385 - RNA, 64 nt, hsa
uugauaagaguguaacauccagcucuaugugggaaaaaagaaauccugguuuguaauguuuguc

SEQ ID NO: 224386 - RNA, 64 nt, hsa
uaaguuccaaaaauaccauuuaucuacuauuugaaaaaagaagaggauaucccuuccuacagua

SEQ ID NO: 224387 - RNA, 64 nt, hsa
uuauaacaccaucuggagucuuccuguaguggcaaaaaagaacaguguugaaauuggaaaggac

SEQ ID NO: 224388 - RNA, 64 nt, hsa
uuugaguuauaacuaguauuauucauguuuucauaaaaagaaguuagugacccagagcuauaau

SEQ ID NO: 224389 - RNA, 64 nt, hsa
gacaguagccacuuacaaacaaaucaacauuuuuaaaaagaaaauguaaagguguguuuugggg

SEQ ID NO: 224390 - RNA, 64 nt, hsa
gcaaaaucucuacugcuuuggauccugggucaaaaaaaagaaaaaaaaaagaaaugcaaaacuu

SEQ ID NO: 224391 - RNA, 64 nt, hsa
acugcuuuggauccugggucaaaaaaaagaaaaaaaaaagaaaugcaaaacuuuaggcccugcc

SEQ ID NO: 224392 - RNA, 64 nt, hsa
ugcuaagaggauaaaggaacugagaccagaugagaaaaagaaaggauauagauuccuugagugg

SEQ ID NO: 224393 - RNA, 64 nt, hsa
guggacaaauuuaacaaguuuucuguuacuuuuuaaaaagaaaaaauccagaacauaagaacua

SEQ ID NO: 224394 - RNA, 64 nt, hsa
auuuuacuggguuugcuuuucuuaaaacauaccaaaaaagaaaaaaauagaaaaaaaaaaaaaa

SEQ ID NO: 224395 - RNA, 64 nt, hsa
gacagucuguaaaguauugcucuuaaaaacaauuaaaaagaacccuuucauauuggcaccauug

SEQ ID NO: 224396 - RNA, 64 nt, hsa
aacuauucagaggacugugugaaguaguuacuggaaaaagaacuugaauuaugcauuuauuggc

SEQ ID NO: 224397 - RNA, 64 nt, hsa
uuuaccaugugucugaauuacauagugugcuuguaaaaagaagaguuuucucucuugcacaaau

SEQ ID NO: 224398 - RNA, 64 nt, hsa
uaaaaaacgcagaaaagaaaaaaagguuaagcauaaaaagaaagggaaaaagcagaaacacugc

SEQ ID NO: 224399 - RNA, 64 nt, hsa
aauccaagucugaacgggaaugcccucauucaaaaaaaagaacuuugaaagagaaucuuucuga

SEQ ID NO: 224400 - RNA, 64 nt, hsa
acucagggcuggggccaagaggaaaaacagggaaaaaaagaaaaaaaaaagaaaaaggaaaagg

SEQ ID NO: 224401 - RNA, 64 nt, hsa
gggccaagaggaaaaacagggaaaaaaagaaaaaaaaaagaaaaaggaaaaggaagcggugugu

SEQ ID NO: 224402 - RNA, 64 nt, hsa
auguaaaguuuaauugaaagaauguaaagcaaccaaaaagaaaaaaaaaaagaaagaaagagga

SEQ ID NO: 224403 - RNA, 64 nt, hsa
auugaaagaauguaaagcaaccaaaaagaaaaaaaaaaagaaagaaagaggaaaagaaauccau

SEQ ID NO: 224404 - RNA, 64 nt, hsa
acccaccuuaacucuuucuugucaggaguauauaaaaaagaaagaaaacaaaacucgcccuaca

SEQ ID NO: 224405 - RNA, 64 nt, hsa
augcagguagcaaagauguaauaaauuugcuuaaaaaaagaaauuaaaguuuuauuuagaauca

SEQ ID NO: 224406 - RNA, 64 nt, hsa
ggggcuuugcugcauucccuaagauaauuacaggaaaaagaaaauguaaaagugcuaacaaggc

SEQ ID NO: 224407 - RNA, 64 nt, hsa
gugaaagaccgagacuccgccucaaaaaaaaaaaaaaaagaaagaaagaaagaaagaaagaaau

SEQ ID NO: 224408 - RNA, 64 nt, hsa
ggauucuuccugauucaaagacugucaaauaggaaaaaagaaaacaguaaaugaacaaaaacau

SEQ ID NO: 224409 - RNA, 64 nt, hsa
cagaaacauuugcugaguguuuuuaauaggagucaaaaagaaagggucuuuucagaaacugaag

SEQ ID NO: 224410 - RNA, 64 nt, hsa
cguuuuucuuuuguuugcauuuucugcaaaaaggaaaaagaaaccacaaauuggggaaaaaaaa

SEQ ID NO: 224411 - RNA, 64 nt, hsa
caaaaaggaaaaagaaaccacaaauuggggaaaaaaaaagaagaaaaaccuguuuccgugugca

SEQ ID NO: 224412 - RNA, 64 nt, hsa
uaggaaaagguuaaacuggauuuuuuuuuuuaaaaaaaagaaaaaaaaagaagaaaaguauacc

SEQ ID NO: 224413 - RNA, 64 nt, hsa
uuaaacuggauuuuuuuuuuuaaaaaaaagaaaaaaaaagaagaaaaguauaccagauaccaaa

SEQ ID NO: 224414 - RNA, 64 nt, hsa
agcaaacugcccuuuguccucaaagaaauuguugaaaaagaaaacuuuuuaaagagauuuuuug

SEQ ID NO: 224415 - RNA, 64 nt, hsa
uggacauacauuccaagcuuuucaacucuaggagaaaaagaaaaucauguuuuccuguauugua

SEQ ID NO: 224416 - RNA, 64 nt, hsa
auguuuauugcuguuuugucuuucuuuuuucuaaaaaaagaaaaaaaagaaaaaaaggaaaaga

SEQ ID NO: 224417 - RNA, 64 nt, hsa
gcuguuuugucuuucuuuuuucuaaaaaaagaaaaaaaagaaaaaaaggaaaagaagaacaaag

SEQ ID NO: 224418 - RNA, 64 nt, hsa
aaguuauugaaauaggacuuaagaauuaccuauuaaaaagaaaucugauauauaaaaauaugua

SEQ ID NO: 224419 - RNA, 64 nt, hsa
ucuaaagaaucaaauuucuauuucugccucugacaaaaagaacuuacuaugaaagaaauaguug

SEQ ID NO: 224420 - RNA, 64 nt, hsa
ggucuguccacgcaauggaacauuauuagacucuaaaaagaaaugaaguacucacacaugccac

SEQ ID NO: 224421 - RNA, 64 nt, hsa
augcaagggacccagaauauccaaauaagccuugaaaaagaacaaaguugguggauucacacuu

SEQ ID NO: 224422 - RNA, 64 nt, hsa
uaagaagcuaauguuuaagaagcauuugggaaagaaaaagaaauaaauguauccagauaggaaa

SEQ ID NO: 224423 - RNA, 64 nt, hsa
cuagucuuguuuguaaaaaaaaaaaaaaaaaaagaaaaagaaaaaaguguauuuuacuguuuuc

SEQ ID NO: 224424 - RNA, 64 nt, hsa
uauaagcuagucuuguuuguaaaaaaaaaaaaaaaaaaagaaaaagaaaaaaguguauuuuacu

SEQ ID NO: 224425 - RNA, 64 nt, hsa
agaaaagaaacaugguucaaauuauaucuaaacaaaaaagaauaagaaacaaaaaacacauuaa

SEQ ID NO: 224426 - RNA, 64 nt, hsa
cuccagccuggugacagagugagacucuguuucaaaaaagaaaagaaaagaaacaugguucaaa

SEQ ID NO: 224427 - RNA, 64 nt, hsa
gaaacagagcaugagcccacaaaaauguucuacaaaaaagaaguauuucugaguaaucuggaag

SEQ ID NO: 224428 - RNA, 64 nt, hsa
agucgagcugaagacaauuuuaacuuggaaaaggaaaaagaagaugucccuguggaaaugucca

SEQ ID NO: 224429 - RNA, 64 nt, hsa
gaaacauuccaccuggcuacacgaaaauuucuagaaaaagaaguuuuuaagagugacuauuaca

SEQ ID NO: 224430 - RNA, 64 nt, hsa
uggugucucuaugcccuuugaaagcaguuuuuauaaaaagaaagcccgggucugcagagaauga

SEQ ID NO: 224431 - RNA, 64 nt, hsa
cuuuuccuauauauguuccuuacaaaaaaaaaaaaaaaagaaaucaagcagauggcuuaaagcu

SEQ ID NO: 224432 - RNA, 64 nt, hsa
cauaaauauguaugcauacuucugacaacuugauaaaaagaaaagcuacacccaaacaauacaa

SEQ ID NO: 224433 - RNA, 64 nt, hsa
gacuuuguucuuccaaguccuaguggaaaagacaaaaaagaaacuaaguuacuugucugcaguc

SEQ ID NO: 224434 - RNA, 64 nt, hsa
gccuuaauauugaauauacuguuuaccucacacuaaaaagaaaaccagaagccuuauuugugau

SEQ ID NO: 224435 - RNA, 64 nt, hsa
aagaauuuuggugggcaucuaauccuacauaaugaaaaagaaaaacagaccauuuaaaaacuca

SEQ ID NO: 224436 - RNA, 64 nt, hsa
gugaaaaagaagcucuaaaacagugucauugauuaaaaagaauaucuggaauguagccccacuc

SEQ ID NO: 224437 - RNA, 64 nt, hsa
aaacuaaagacaugugacuuauucaaugaaagugaaaaagaagcucuaaaacagugucauugau

SEQ ID NO: 224438 - RNA, 64 nt, hsa
agauucugugauuuauuugcccuguuuauggauuaaaaagaaaauucuaauauaaagcauuuca

SEQ ID NO: 224439 - RNA, 64 nt, hsa
auuucaggaggagaaugaguauguuaaugaagauaaaaagaagugacaucucuuguacacugaa

SEQ ID NO: 224440 - RNA, 64 nt, hsa
acuucaacaaucuugagugccaagaauaauacagaaaaagaagacaguugaugaaugaguuuau

SEQ ID NO: 224441 - RNA, 64 nt, hsa
cagagccuacaaaacauuguauauuucaaaagacaaaaagaagcagcagcaguaucuuguucuc

SEQ ID NO: 224442 - RNA, 64 nt, hsa
uucauaaaaauauauuuacuuugccaauaaaaagaaaaagaacucacagcuuuuggcauucaug

SEQ ID NO: 224443 - RNA, 64 nt, hsa
ugguccuucauaaaaauauauuuacuuugccaauaaaaagaaaaagaacucacagcuuuuggca

SEQ ID NO: 224444 - RNA, 64 nt, hsa
ucagguugucuaaguguuuuuauguaaaaccaacaaaaagaacaaaucagcuuauauuuuuuau

SEQ ID NO: 224445 - RNA, 64 nt, hsa
uugcgcccggccuuaaauguuuuuuuuaaucaucaaaaagaacaacauaucucagguugucuaa

SEQ ID NO: 224446 - RNA, 64 nt, hsa
uucugugacaaaaaaaaaaaaaaaaaaaagaaaaaaaaagaaaaaacagaaauauauccagcua

SEQ ID NO: 224447 - RNA, 64 nt, hsa
gcaaacaguguucugugacaaaaaaaaaaaaaaaaaaaagaaaaaaaaagaaaaaacagaaaua

SEQ ID NO: 224448 - RNA, 64 nt, hsa
aauaugaacuuugguucuucaugagugcauuuugaaaaagaaaaaaaguacacauucagaaucu

SEQ ID NO: 224449 - RNA, 64 nt, hsa
accaagaagcucaaagaaaagaaguacguuaaagaaaaagaaaaaaccucacuuuuccuuuaua

SEQ ID NO: 224450 - RNA, 64 nt, hsa
cuccuagugaaagaaaaaucucuguacaaaggagaaaaagaaccccacuuauucuuaguuaaua

SEQ ID NO: 224451 - RNA, 64 nt, hsa
cauaauucaguccuuuagauuuauuuuaugcagcaaaaagaagcucuuuuuuuuuuuuaaucac

SEQ ID NO: 224452 - RNA, 64 nt, hsa
ggugacagaguaacacucugucucagaaaaaaaaaaaaagaaaaauauaugggguaaauacagu

SEQ ID NO: 224453 - RNA, 64 nt, hsa
uguauaccuauguuaaugaaacaacagaaguacaaaaaagaauaucagauacaaaaaucaaucg

SEQ ID NO: 224454 - RNA, 64 nt, hsa
uugcuguauuaacugaugauaaaacuaauggcagaaaaagaaguugagcaauuucuauguaaug

SEQ ID NO: 224455 - RNA, 64 nt, hsa
agaauuugaguccuguuaauguaguagaaaaaaaaaaaagaaauuuucuuuuucuuuugugcug

SEQ ID NO: 224456 - RNA, 64 nt, hsa
ccauuugcuauaaaguugaacuuuguauggcuugaaaaagaaaugacaauauggaacaucccaa

SEQ ID NO: 224457 - RNA, 64 nt, hsa
uaacauuuauaauugcaaaauaaaccaacuauaaaaaaagaaacuaagagagaauugguacuuu

SEQ ID NO: 224458 - RNA, 64 nt, hsa
uucuaacacagacuuucuucacugucuuucauuuaaaaagaaauuaaugcucuuaagauauaua

SEQ ID NO: 224459 - RNA, 64 nt, hsa
augguuagauacacagcauguugauuuggucacuaaaaagaagaaaaggacuaacaagcuucac

SEQ ID NO: 224460 - RNA, 64 nt, hsa
guuuuaaacuuuggguaccaaaccaaaaagaagaaaaaagaaaggaaaagaucuucuuugaaga

SEQ ID NO: 224461 - RNA, 64 nt, hsa
ccuuacuucuguuuuaaacuuuggguaccaaaccaaaaagaagaaaaaagaaaggaaaagaucu

SEQ ID NO: 224462 - RNA, 64 nt, hsa
uaccuggcuacaauuacuuugaacauuaauguugaaaaagaaaacaaccaaagaaaauugguac

SEQ ID NO: 224463 - RNA, 64 nt, hsa
uuugcucaauaugaucuugauauuccuacaaagaaaaaagaagggguagggauuuggcuaugcc

SEQ ID NO: 224464 - RNA, 64 nt, hsa
acaguguuuuaggugccuggauauuuuuugauggaaaaagaauauauugccaaauauuaagaag

SEQ ID NO: 224465 - RNA, 64 nt, hsa
uuucaaauagcuaaaaggagauuuuguccccaacaaaaagaaaugauaaauauuugaaaccaug

SEQ ID NO: 224466 - RNA, 64 nt, hsa
uaaaaauaacauauuggugaagaugcgggaaaaaaaaaagaacucuuagacacugcugguggga

SEQ ID NO: 224467 - RNA, 50 nt, hsa
ugauuccauucauauuguaaaaaaagaaucuuaucuccuauagaaaacag

SEQ ID NO: 224468 - RNA, 64 nt, hsa
gcaaaggaaaaagugauagaauaauauucaagacaaaaagaacaguaugaggcaagagaaauaa

SEQ ID NO: 224469 - RNA, 64 nt, hsa
cugucuuaaauuccaaagcuuuacauuucaacugaaaaagaaacuagaaauguccuaauuuaac

SEQ ID NO: 224470 - RNA, 64 nt, hsa
acucagaaaaaagaagcugccaguucuuggaaugaaaaagaaauacagucuuacaccaucaagg

SEQ ID NO: 224471 - RNA, 64 nt, hsa
gaaacauaaucaauggauucagaaaugacucagaaaaaagaagcugccaguucuuggaaugaaa

SEQ ID NO: 224472 - RNA, 64 nt, hsa
auguuggcaaucaaagcaugcacuuguaacaaugaaaaagaaaaagcauuuuauauuacuacuc

SEQ ID NO: 224473 - RNA, 64 nt, hsa
cagucuuaaaaaaaaaaaaaaacagaaaaagaaaaaaaagaacguugcaaauuuguuaaaaugc

SEQ ID NO: 224474 - RNA, 64 nt, hsa
ugaauuaggcagucuuaaaaaaaaaaaaaaacagaaaaagaaaaaaaagaacguugcaaauuug

SEQ ID NO: 224475 - RNA, 64 nt, hsa
ccuuuuaaaaaugcuuauagagaaaaaaaauuuuaaaaagaaagcuaaugcuaguauauacugc

SEQ ID NO: 224476 - RNA, 64 nt, hsa
aaaucaggcugagaaaaagcaaaagaaaagcaaaaaaaagaagaagaaacagcagaaagcaguc

SEQ ID NO: 224477 - RNA, 64 nt, hsa
ggucuggggaccaugguauaaagaggaaaccaagaaaaagaagccaagcaaaaaucaggcugag

SEQ ID NO: 224478 - RNA, 64 nt, hsa
ugcccuucccccugcaaaaagaaaaaaagaaaagaaaaagaaaaaaaucccuuguucucagugg

SEQ ID NO: 224479 - RNA, 64 nt, hsa
gauauacucccugcccuucccccugcaaaaagaaaaaaagaaaagaaaaagaaaaaaaucccuu

SEQ ID NO: 224480 - RNA, 64 nt, hsa
guguagacgauauacucccugcccuucccccugcaaaaagaaaaaaagaaaagaaaaagaaaaa

SEQ ID NO: 224481 - RNA, 64 nt, hsa
aucaacuuaccaggcaccaaaagaaguaaaagcaaaaaagaaaaccuuucuucaccaaaucuug

SEQ ID NO: 224482 - RNA, 64 nt, hsa
ugaguggacuggccucaaagcaagcauucagaagaaaaagaagcaaccucaguaauuuagaaau

SEQ ID NO: 224483 - RNA, 64 nt, hsa
gagagcauugggauaucuccugaaaagguuuaugaaaaagaagaaucucaucucagugaagaau

SEQ ID NO: 224484 - RNA, 64 nt, hsa
cuuucuuuggaugggacuagagcuuucuuucacaaaaaagaaguaggggaagacaugcagccua

SEQ ID NO: 224485 - RNA, 64 nt, hsa
aauuuaaagccacaaccacauacaacacaaagagaaaaagaaaugcaaaaaucucugcgugcag

SEQ ID NO: 224486 - RNA, 64 nt, hsa
ccugauaagcuucaaagcugcuuuauucaauaaaaaaaagaaaugaaaaagauauaugaauaug

SEQ ID NO: 224487 - RNA, 64 nt, hsa
uccagcuugggcaacagagcaagacuccaucucaaaaaagaaaaaagaaaagaaauagaauuau

SEQ ID NO: 224488 - RNA, 64 nt, hsa
ugggcaacagagcaagacuccaucucaaaaaagaaaaaagaaaagaaauagaauuaucaagcuu

SEQ ID NO: 224489 - RNA, 64 nt, hsa
auuugaagauggagcacugcugauuuaugaaggaaaaaagaagaauuuucuaaagauuacacau

SEQ ID NO: 224490 - RNA, 64 nt, hsa
auaaauaauaaaguaggcauuuguuuauuuuguaaaaaagaaaugaaaaucugcuggccagcua

SEQ ID NO: 224491 - RNA, 64 nt, hsa
cuaggcaauguagugagacccugucucuaauuuaaaaaagaaaaagaaaaaaacauucccagug

SEQ ID NO: 224492 - RNA, 64 nt, hsa
aauguagugagacccugucucuaauuuaaaaaagaaaaagaaaaaaacauucccaguggcagcc

SEQ ID NO: 224493 - RNA, 64 nt, hsa
ugaaagcuugcuguacaaaggcaacagcaacuuaaaaaagaaaaucuggacaauagauguggac

SEQ ID NO: 224494 - RNA, 64 nt, hsa
auuuugauaugacugaauugcaaucuauauuuuuaaaaagaaaaaucaaaauacauuaggguuu

SEQ ID NO: 224495 - RNA, 64 nt, hsa
cuuucuugauacuuagucaugggaggauauuacaaaaaagaaauuuaaauuguguucauagucu

SEQ ID NO: 224496 - RNA, 64 nt, hsa
augguacuccuaaagcauaugccucaccugguuaaaaaagaacaaacauguuuuugugaaagcu

SEQ ID NO: 224497 - RNA, 64 nt, hsa
aaaccaaccacagaucaaaaauagaaaaaaaaaaaaaaagaaaaaaagaauguaaaauuuuaaa

SEQ ID NO: 224498 - RNA, 64 nt, hsa
cacagaucaaaaauagaaaaaaaaaaaaaaagaaaaaaagaauguaaaauuuuaaaaauacagu

SEQ ID NO: 224499 - RNA, 64 nt, hsa
auuguucuuaaggcaucauaucuagaagcaaagaaaaaagaaaaauaacaauuuaaguugugua

SEQ ID NO: 224500 - RNA, 64 nt, hsa
caguuacuuauauuaauaauauucagaaaaaaaaaaaaagaaaaggaaaaagaaaaauauauau

SEQ ID NO: 224501 - RNA, 64 nt, hsa
agacucugucucagaaaaaaaaaaaaagaaaaggaaaaagaaaaauauauauucuauauuuuuu

SEQ ID NO: 224502 - RNA, 64 nt, hsa
aauugcaaagcacagauaaauggaaauaaacaggaaaaagaaucaccuauaaccucaccaucca

SEQ ID NO: 224503 - RNA, 64 nt, hsa
cuaaagggaaaggggaaagaaagggaaaagggagaaaaagaaacacaagagacuuaaaggacag

SEQ ID NO: 224504 - RNA, 64 nt, hsa
auuuggaguuagguccucacuugggggaaaaaaaaaaaagaaaagccaagcaaaccaaugguga

SEQ ID NO: 224505 - RNA, 64 nt, hsa
uguugucguuuuaacaucuccacgucccuagcauaaaaagaaaaagaaaaaaauuuaaacugcu

SEQ ID NO: 224506 - RNA, 64 nt, hsa
cguuuuaacaucuccacgucccuagcauaaaaagaaaaagaaaaaaauuuaaacugcuuuuucg

SEQ ID NO: 224507 - RNA, 64 nt, hsa
uuucaauuacauccugacuuguauagacacagccaaaaagaaacuguuaauagccauccgucca

SEQ ID NO: 224508 - RNA, 64 nt, hsa
agguuugaauggaguugaaaguuuuacauaagugaaaaagaaaguuuaucuugggaguugaguu

SEQ ID NO: 224509 - RNA, 64 nt, hsa
cacacugcagcagagcuuguagcuggacagagucaaaaagaagaaaauacgguuucaggcuuuc

SEQ ID NO: 224510 - RNA, 64 nt, hsa
agugaugccuuauuugaaacugggcuuaaacugcaaaaagaaugaaguuggauuuaggaagcug

SEQ ID NO: 224511 - RNA, 64 nt, hsa
uucacuagcagggaaguuuccuugagccuaaaauaaaaagaaaaaauuaaaaagaaucaguuuu

SEQ ID NO: 224512 - RNA, 64 nt, hsa
aguuuccuugagccuaaaauaaaaagaaaaaauuaaaaagaaucaguuuuuuuaauuaaaaaaa

SEQ ID NO: 224513 - RNA, 64 nt, hsa
uucuucugagaaugugacuuuuucugguguuguaaaaaagaaaaaaaaaagaaugcucauugua

SEQ ID NO: 224514 - RNA, 64 nt, hsa
augugacuuuuucugguguuguaaaaaagaaaaaaaaaagaaugcucauuguaaaaauaaaaaa

SEQ ID NO: 224515 - RNA, 64 nt, hsa
ccccuccuaccccagucccuaaaagaaauggggaaaaaagaaaacaacagcaagucagaaaaaa

SEQ ID NO: 224516 - RNA, 64 nt, hsa
cagaggauaacacuugucucuuaaaaacuaagcuaaaaagaaccuagaaccuucaauugagcag

SEQ ID NO: 224517 - RNA, 64 nt, hsa
auaaccuauggcaguugguugaauaauuauugaaaaaaagaacacgacugaaaaaguucaucug

SEQ ID NO: 224518 - RNA, 64 nt, hsa
agugcauagguccauaauauuucauaaaaugaagaaaaagaauguggccaaacaauuauucacc

SEQ ID NO: 224519 - RNA, 64 nt, hsa
aaaauacaaccgagaggggagauuuuuaaaaaagaaaaagaaacacaaauauuaauagaaaucu

SEQ ID NO: 224520 - RNA, 64 nt, hsa
gaggcuaaaauacaaccgagaggggagauuuuuaaaaaagaaaaagaaacacaaauauuaauag

SEQ ID NO: 224521 - RNA, 64 nt, hsa
gaucaaggucacagcacugccuacaccuguuuacaaaaagaaucaaauaccacuaugaauaagg

SEQ ID NO: 224522 - RNA, 64 nt, hsa
caaucccgacaguagcagaauggcauucuacaacaaaaagaagcuaguuaugggaguuaaguuu

SEQ ID NO: 224523 - RNA, 64 nt, hsa
aucauggauaaaaacuaagcgcuugccuucuuuuaaaaagaaaaacugaugauuagauuagguu

SEQ ID NO: 224524 - RNA, 64 nt, hsa
ccucuuuacuuauaucaaauuauucuugucuuucaaaaagaaccaaaaaaaaaaaauucaucau

SEQ ID NO: 224525 - RNA, 64 nt, hsa
aguugaauaagaguuggcuuaaauuuuaaaaaagaaaaagaaaauugagguuuuaggauuuuca

SEQ ID NO: 224526 - RNA, 64 nt, hsa
aagaaaaguugaauaagaguuggcuuaaauuuuaaaaaagaaaaagaaaauugagguuuuagga

SEQ ID NO: 224527 - RNA, 64 nt, hsa
uguaagaaaagaaaaaagaaaagaaaaaaagggaaaaaagaaaagcaaggaaaaggcucuuuau

SEQ ID NO: 224528 - RNA, 64 nt, hsa
ugauucacgacuuaauguauguuguaagaaaagaaaaaagaaaagaaaaaaagggaaaaaagaa

SEQ ID NO: 224529 - RNA, 64 nt, hsa
uccaguucgaucuucuggguuuaguuuugucuuuaaaaagaauucaaaaaaagacugacaauga

SEQ ID NO: 224530 - RNA, 64 nt, hsa
uuuuuaaaaucaagaaaauuuaaaaagacaaaaaaaaaagaauucauugauaauucuaacucag

SEQ ID NO: 224531 - RNA, 64 nt, hsa
agaagauugaccaaaccauccaaaugccaaaaagaaaaagaaaaaaaaaagccucucuguccua

SEQ ID NO: 224532 - RNA, 64 nt, hsa
aggaagagaagauugaccaaaccauccaaaugccaaaaagaaaaagaaaaaaaaaagccucucu

SEQ ID NO: 224533 - RNA, 64 nt, hsa
cuccucacucugggacagacgauguauggaaacuaaaaagaacaugcggcaccuuauuuaugug

SEQ ID NO: 224534 - RNA, 64 nt, hsa
cagagcaagacuccgucucaaaaaaaagaaaagaaaaaagaaagcauuguuuuaauugagaggg

SEQ ID NO: 224535 - RNA, 64 nt, hsa
cagcccgggugacagagcaagacuccgucucaaaaaaaagaaaagaaaaaagaaagcauuguuu

SEQ ID NO: 224536 - RNA, 64 nt, hsa
uaaaauugcaguauuuaaagcuuaagcuuucaggaaaaagaaaauaagaauucagugugugcau

SEQ ID NO: 224537 - RNA, 64 nt, hsa
uaaucaguuuagcuuuguguuguaugcuaguuuaaaaaagaaaauauguaauauaauguaaaaa

SEQ ID NO: 224538 - RNA, 64 nt, hsa
cgggggggguaggagaggagaaaaaaaaagugaaaaaaagaaacgaaaaggacagacgaagagu

SEQ ID NO: 224539 - RNA, 64 nt, hsa
aaaggacagacgaagaguuuaaagagaaaagggaaaaaagaaagaaaaaguaagcagggcuggc

SEQ ID NO: 224540 - RNA, 64 nt, hsa
gcagucaguggagggcgagugguuucggaaaaaaaaaaagaaaaaaagaaaaaaaaagaaaaaa

SEQ ID NO: 224541 - RNA, 64 nt, hsa
uggagggcgagugguuucggaaaaaaaaaaagaaaaaaagaaaaaaaaagaaaaaaaaaagauu

SEQ ID NO: 224542 - RNA, 64 nt, hsa
gugguuucggaaaaaaaaaaagaaaaaaagaaaaaaaaagaaaaaaaaaagauuuuuuucuucu

SEQ ID NO: 224543 - RNA, 64 nt, hsa
aauucaaggccacaaaaacaauguuugggggaaaaaaaagaaaaaaucaugccagcuaaucaug

SEQ ID NO: 224544 - RNA, 64 nt, hsa
uuguggaguaucccauucugaugaguacagaaaaaaaaagaaaaagaaaagaagagaaaaaauu

SEQ ID NO: 224545 - RNA, 64 nt, hsa
aguaucccauucugaugaguacagaaaaaaaaagaaaaagaaaagaagagaaaaaauuaagaaa

SEQ ID NO: 224546 - RNA, 64 nt, hsa
cagauaauguugaugacauugacccuuuguuuaaaaaaagaaacuguaaauuugacauaauuuc

SEQ ID NO: 224547 - RNA, 64 nt, hsa
aggcccuauagccacauaaauauaaauuucauagaaaaagaauaaaagcggagauauauuuuuu

SEQ ID NO: 224548 - RNA, 64 nt, hsa
uuaacaaaugugaauuauugaaaugugaagggacaaaaagaaucauacauuuaaacugucuugu

SEQ ID NO: 224549 - RNA, 64 nt, hsa
acuggguucgaucagcccuccuaaagcuggcuggaaaaagaagccccagcccagccugccucau

SEQ ID NO: 224550 - RNA, 64 nt, hsa
auuuuuaguuacuuaccuugaacauauucgugugaaaaagaauacaucauuucucacagucuua

SEQ ID NO: 224551 - RNA, 64 nt, hsa
aacuggggaguucuugaguuccucauuuguugguaaaaagaaaaagaaugugaaaaugucucuu

SEQ ID NO: 224552 - RNA, 64 nt, hsa
ggaguucuugaguuccucauuuguugguaaaaagaaaaagaaugugaaaaugucucuuuuuuuc

SEQ ID NO: 224553 - RNA, 64 nt, hsa
uacacaugugagguuugaaaaaaaaaaaaaaaaaaaaaagaacuaccuugugaguuuugcucaa

SEQ ID NO: 224554 - RNA, 60 nt, hsa
gccacagcacaaaguuuuaaugucuuuaagaaaaagaaaucaaucugcagaaaugugaag

SEQ ID NO: 224555 - RNA, 64 nt, hsa
gcuuggcuuucacgggggaggguuguauucaguaaaaaagaauaguaaauauaaggucacugag

SEQ ID NO: 224556 - RNA, 64 nt, hsa
uccuuaagggacuaaauuaaugcuugggugcauuaaaaagaacaaaacauucccacauguuggg

SEQ ID NO: 224557 - RNA, 64 nt, hsa
cugugugcuccugagaacucuuacuugagacaucaaaaagaagcagcaagagcuucugggacag

SEQ ID NO: 224558 - RNA, 64 nt, hsa
ucauuuccuucaauuuccuuugaccuauaggcuaaaaaagaaaggcucauuccagccacagggc

SEQ ID NO: 224559 - RNA, 64 nt, hsa
agcacaauuauggguuacuuccuuuuucuuaacaaaaaagaauguuugauuuccucugggugac

SEQ ID NO: 224560 - RNA, 64 nt, hsa
uuuauauauuuuuucauuagggccauaucuccaaaaaaagaaagaaaaaauacaaaaaacaaaa

SEQ ID NO: 224561 - RNA, 64 nt, hsa
uuuguauuucaagauaauguaguuuaaaaaaaaaaaaaagaaaaaaacuugauguaaauuccuc

SEQ ID NO: 224562 - RNA, 64 nt, hsa
uuaaaccucucuucucuuugacaaaacuuccuuaaaaaagaauacaagauaauauagguaaaua

SEQ ID NO: 224563 - RNA, 64 nt, hsa
aaagugaaaauuauguuccuagaacaaaauguacaaaaagaacaauauaauuuucacaugaacc

SEQ ID NO: 224564 - RNA, 64 nt, hsa
uuauuuuacaaaaauauuuuucauacaaaugguuaaaaagaaacaaaaucuauaacaacaacuu

SEQ ID NO: 224565 - RNA, 64 nt, hsa
uuuuaauauuuuaugauugccaucaaagaagaagaaaaagaaggaacagacaaagguuugaaaa

SEQ ID NO: 224566 - RNA, 64 nt, hsa
cugggaucccucugucaaccccacgccuuuuaggaaaaagaaaagugagugaacagcaaggaag

SEQ ID NO: 224567 - RNA, 64 nt, hsa
uugccuuuccaagugaccucuccucuucuuuuaaaaaaagaacacuuucugcucauaucauaac

SEQ ID NO: 224568 - RNA, 64 nt, hsa
cagaccuugucucaaaaaaaaaaaaaaaaaaagaaaaaagaaaguacugucugucuuaaauuuu

SEQ ID NO: 224569 - RNA, 64 nt, hsa
acagagccagaccuugucucaaaaaaaaaaaaaaaaaaagaaaaaagaaaguacugucugucuu

SEQ ID NO: 224570 - RNA, 64 nt, hsa
auuuaaaaauuaaucaguuacaguaaagacuuugaaaaagaaauguacuuguuaggaaguagcu

SEQ ID NO: 224571 - RNA, 64 nt, hsa
agccucagcaacaaacauuuccuaaaugggaugcaaaaagaaacugaaugauguugaauuuuag

SEQ ID NO: 224572 - RNA, 64 nt, hsa
uaauugaccacuuccuuggcccccagcuacaaugaaaaagaagaauuaugcacacaucuaacau

SEQ ID NO: 224573 - RNA, 64 nt, hsa
ggggaaaauaaagauuuaauauuucuuuaaauagaaaaagaauuugguuuugcucguuuaagag

SEQ ID NO: 224574 - RNA, 64 nt, hsa
uggauagcuuuucuaauaauuuucaucaauaggaaaaaagaaauacgucucauucuucaauacu

SEQ ID NO: 224575 - RNA, 64 nt, hsa
cucucacuauaguauaagaaucuauuuuggagaaaaaaagaaaauaugagggucucgaagcaug

SEQ ID NO: 224576 - RNA, 64 nt, hsa
gaagaaucaaaacaaaagcaaaaaaaaaaagcaaaaaaagaaaagagaaaaaaagaaaaaaugc

SEQ ID NO: 224577 - RNA, 64 nt, hsa
aagcaaaaaaaaaaagcaaaaaaagaaaagagaaaaaaagaaaaaaugcaaauggaauaauuuu

SEQ ID NO: 224578 - RNA, 64 nt, hsa
cuggcuuccuaagaaauguuuaagacucagcuuuaaaaagaaguuaacauucauaucucuguuu

SEQ ID NO: 224579 - RNA, 64 nt, hsa
acuccagccugggugauagagcaagacugucucaaaaaagaaaaaaaagaaaaaauuuuaauuu

SEQ ID NO: 224580 - RNA, 64 nt, hsa
ugggugauagagcaagacugucucaaaaaagaaaaaaaagaaaaaauuuuaauuuaauccuucu

SEQ ID NO: 224581 - RNA, 64 nt, hsa
gucuguuucaaauaaaugaacucaaucuaaauuaaaaaagaaagaaauuugaaaaaacuuucuc

SEQ ID NO: 224582 - RNA, 64 nt, hsa
gcacaucuacuugcuuaaauugugggcaaaagagaaaaagaaggauugaucagagcauugugca

SEQ ID NO: 224583 - RNA, 64 nt, hsa
uuuauuuuuacuuuuuuauuauaauuuugauauuaaaaagaacagagauggggucuugcuuugu

SEQ ID NO: 224584 - RNA, 64 nt, hsa
ugucuuauuuccuaaagugaagcaucuuuuuuuaaaaaagaauuugauugacaauauauccagu

SEQ ID NO: 224585 - RNA, 64 nt, hsa
uaaaauuauuucagagaugugugcuccuggagggaaaaagaaauacagccucaacagauuaaaa

SEQ ID NO: 224586 - RNA, 64 nt, hsa
ugggugacuagcaaaacuccaucucaaaaaaaaaaaaaagaaagaaagaaacugaaaagugagg

SEQ ID NO: 224587 - RNA, 64 nt, hsa
gccuggcaacagagcaagagucugucucaaaaaaaaaaagaaaaaaagaaaaaaagaaaaaaga

SEQ ID NO: 224588 - RNA, 64 nt, hsa
acagagcaagagucugucucaaaaaaaaaaagaaaaaaagaaaaaaagaaaaaagaaaaaucuc

SEQ ID NO: 224589 - RNA, 64 nt, hsa
agagucugucucaaaaaaaaaaagaaaaaaagaaaaaaagaaaaaagaaaaaucucauuauuuc

SEQ ID NO: 224590 - RNA, 64 nt, hsa
gucucaaaaaaaaaaagaaaaaaagaaaaaaagaaaaaagaaaaaucucauuauuucaaaauga

SEQ ID NO: 224591 - RNA, 64 nt, hsa
auaaacuucagcugaagauuuuauauaggacuuuaaaaagaagagaagagaaagaagaaacaau

SEQ ID NO: 224592 - RNA, 64 nt, hsa
augguugcaaaaaaaaaaaaaagucagugcuucuaaaaagaauuuaagauaaugguuuuuaaaa

SEQ ID NO: 224593 - RNA, 64 nt, hsa
uuacccuuucauguacuuccaaagaaagguaaucaaaaagaaucuucuuaagugauauaauauc

SEQ ID NO: 224594 - RNA, 64 nt, hsa
auaauaaauuauauuaguaaaagucuuaacuggaaaaaagaaucuaaaucagaauagugaucaa

SEQ ID NO: 224595 - RNA, 64 nt, hsa
uaugacaguguacauauaugaaaauaaaugaugaaaaaagaacuauaauauuuuuaaaaauaug

SEQ ID NO: 224596 - RNA, 64 nt, hsa
ucaauuuuauguuuccuuuuggcauucuuugugcaaaaagaagcaugugguggcucucauuuaa

SEQ ID NO: 224597 - RNA, 64 nt, hsa
gcuguuaaauuggccugcuccagagacuggcucaaaaaagaaagaagcaacgaaaacaaaaugc

SEQ ID NO: 224598 - RNA, 64 nt, hsa
aaaaugaaagauugaauguucauguguggguuaaaaaaagaagcuuuaacacuaauuuuccaaa

SEQ ID NO: 224599 - RNA, 64 nt, hsa
uacaugcauaaaagggucaaaccuguagaugcagaaaaagaaaaaaacuauaaauacaaaucug

SEQ ID NO: 224600 - RNA, 64 nt, hsa
uccucuguaagauaucccagcuuuaaaaagaaaaaaaaagaauuaccaagagaaggggacuucu

SEQ ID NO: 224601 - RNA, 64 nt, hsa
aauuuuuccuuccucuguaagauaucccagcuuuaaaaagaaaaaaaaagaauuaccaagagaa

SEQ ID NO: 224602 - RNA, 64 nt, hsa
cugacuauuuuaucaaauuugccuuaaaauaaugaaaaagaaaaguauaguuaaugguuucaaa

SEQ ID NO: 224603 - RNA, 64 nt, hsa
uuguaauuuaacaauaaauaagccugcuacauguaaaaagaaccaaacucacaauauuaacaua

SEQ ID NO: 224604 - RNA, 64 nt, hsa
uugcacaggguggagucaaaacaaccuacauauaaaaaagaaacuuguccauuuagcuuucaua

SEQ ID NO: 224605 - RNA, 64 nt, hsa
agguuuagggaguguaccucagauagauuuuaaaaaaaagaauagaaagccuuuauuuccuggu

SEQ ID NO: 224606 - RNA, 64 nt, hsa
gugaccucccgucucucucggaaaaaaaaaaagaaaaaagaaaaagccgggugagguggugugu

SEQ ID NO: 224607 - RNA, 64 nt, hsa
caacauggugaccucccgucucucucggaaaaaaaaaaagaaaaaagaaaaagccgggugaggu

SEQ ID NO: 224608 - RNA, 64 nt, hsa
gggauaagaauagucuucuagaagugaggaugcgaaaaagaaugaguuuccaauuacccugaug

SEQ ID NO: 224609 - RNA, 64 nt, hsa
caaaacagaaaaauaaaugauuuaaaaucaaaucaaaaagaaaaaacuaaacauuuaaacaaaa

SEQ ID NO: 224610 - RNA, 64 nt, hsa
uaacauugcaaugaaaaaaugaaaaaaagaaggaaaaaagaauaagaaugaaaacugcugacgu

SEQ ID NO: 224611 - RNA, 64 nt, hsa
cucugguguguuaacauugcaaugaaaaaaugaaaaaaagaaggaaaaaagaauaagaaugaaa

SEQ ID NO: 224612 - RNA, 64 nt, hsa
gacagagugagacucuaucucaaaaaaaaaaaaaaaaaagaaagguuguuauggacuggacacc

SEQ ID NO: 224613 - RNA, 64 nt, hsa
agacuaaauagaaaccccucagcccuaaaauagaaaaaagaacaguucuggacuauugaacagc

SEQ ID NO: 224614 - RNA, 64 nt, hsa
gaaaaagaaaaagaaaauaaaaauuaaauuaaaaaaaaagaagacaaagaaaaccuaaaguugu

SEQ ID NO: 224615 - RNA, 64 nt, hsa
aguuucaauacaagccauaggcucacagaaaaagaaaaagaaaauaaaaauuaaauuaaaaaaa

SEQ ID NO: 224616 - RNA, 64 nt, hsa
accuaaaguuucaauacaagccauaggcucacagaaaaagaaaaagaaaauaaaaauuaaauua

SEQ ID NO: 224617 - RNA, 64 nt, hsa
acugucuuuauuuuuguauauuguauuuauauauaaaaagaaacgucuacguaugcaugcuaaa

SEQ ID NO: 224618 - RNA, 64 nt, hsa
cgccucuggagccgccauucugcagaguauuuggaaaaagaaaaaaggguuuaugcuuacgucu

SEQ ID NO: 224619 - RNA, 64 nt, hsa
ggcaaguuucccuaaguuugaguugauaguuauuaaaaagaaaacaaaacaaaaaaaaaaggca

SEQ ID NO: 224620 - RNA, 64 nt, hsa
gaaacuggguauauuuaugauuucuuucagcguuaaaaagaaacauaguguugcccuuuuucuu

SEQ ID NO: 224621 - RNA, 64 nt, hsa
gacuucuuuguugauuuuuuaagauagaaagauuaaaaagaaagaaagaugggaagaaaaugaa

SEQ ID NO: 224622 - RNA, 64 nt, hsa
uuaaggaucugcucuaugaaggagaagaaagaggaaaaagaaguaaaggaguuaggaggagaca

SEQ ID NO: 224623 - RNA, 64 nt, hsa
gaauaaagagagagaugaauuuauaaaguaggaaaaaaagaaucugaaagauacaaagugauua

SEQ ID NO: 224624 - RNA, 64 nt, hsa
aucaaggaaagcaagagagcagauaauacaaaagaaaaagaagaagguucacauaaauagcuuc

SEQ ID NO: 224625 - RNA, 64 nt, hsa
uauaguagaaaaggaaacuaguagggccaaaaaaaaaaagaaaaagaaaaagaaaaaagaaaaa

SEQ ID NO: 224626 - RNA, 64 nt, hsa
agaaaaggaaacuaguagggccaaaaaaaaaaagaaaaagaaaaagaaaaaagaaaaaaaaaga

SEQ ID NO: 224627 - RNA, 64 nt, hsa
ggaaacuaguagggccaaaaaaaaaaagaaaaagaaaaagaaaaaagaaaaaaaaagaaaaaac

SEQ ID NO: 224628 - RNA, 64 nt, hsa
aguagggccaaaaaaaaaaagaaaaagaaaaagaaaaaagaaaaaaaaagaaaaaacugggacc

SEQ ID NO: 224629 - RNA, 64 nt, hsa
aaaaaaaaaagaaaaagaaaaagaaaaaagaaaaaaaaagaaaaaacugggaccuaaguauaaa

SEQ ID NO: 224630 - RNA, 64 nt, hsa
agaucacuacagaccaaaacagaagaagaagaaaaaaaagaaaaagaaaucuaagcaacauggu

SEQ ID NO: 224631 - RNA, 64 nt, hsa
cuacagaccaaaacagaagaagaagaaaaaaaagaaaaagaaaucuaagcaacaugguaaguac

SEQ ID NO: 224632 - RNA, 64 nt, hsa
cagaacgaaguuaccagcaggauggaccuaauagaaaaagaagucgaugguaauuuaagaaaga

SEQ ID NO: 224633 - RNA, 64 nt, hsa
cauagucaguaauaauaaaacucagcauaguagcaaaaagaacgacaucaguuuaaaggcacaa

SEQ ID NO: 224634 - RNA, 64 nt, hsa
acaaagauauucucuauguuuuguaaguaaaaacaaaaagaaaaccuuucuuuuguuuuuuaca

SEQ ID NO: 224635 - RNA, 64 nt, hsa
caacaccgccacaccaacaccaccacuacaaaaaaaaaagaauuaauaagucacaaccccuuca

SEQ ID NO: 224636 - RNA, 64 nt, hsa
uguaggaucguaaaaaaauagaaaaaaagaaaaaaaaaagaaagaaagagggaaaaagagcugg

SEQ ID NO: 224637 - RNA, 64 nt, hsa
uggaccaucucuguaggaucguaaaaaaauagaaaaaaagaaaaaaaaaagaaagaaagaggga

SEQ ID NO: 224638 - RNA, 64 nt, hsa
ccagccugggcaacgggcgagacucugucucaaaaaaaagaaagaaagaaaagguacauguaua

SEQ ID NO: 224639 - RNA, 64 nt, hsa
uuuaagacucugucuuaaaaaaaacuaaaaagaaaaaaagaagccccuucacucuacaggggac

SEQ ID NO: 224640 - RNA, 64 nt, hsa
gcaauuuuuuuaagacucugucuuaaaaaaaacuaaaaagaaaaaaagaagccccuucacucua

SEQ ID NO: 224641 - RNA, 64 nt, hsa
aucugccugagggcuugcauagcuuucacauuaaaaaaagaaaaagcuagcagauuuacuccuu

SEQ ID NO: 224642 - RNA, 64 nt, hsa
uaaaaacaaauuggcuuugucucauugaucagacaaaaagaaacuaguauuaagggaagcgcaa

SEQ ID NO: 224643 - RNA, 64 nt, hsa
acaugacuuuguuuauuuaaaguuucuugcugugaaaaagaacucccuaccugugaguuccuuu

SEQ ID NO: 224644 - RNA, 64 nt, hsa
agaaacuaaauggucuuuauaaaaguaauuacuuaaaaagaaaucaggggaagaaagauaucua

SEQ ID NO: 224645 - RNA, 64 nt, hsa
auuaaaauuauuauucuagacuuacaaaaggcuuaaaaagaacaaucauuuaaucaguaccauu

SEQ ID NO: 224646 - RNA, 64 nt, hsa
aaauauagauucuaaauaaauaggggcuuauacaaaaaagaaaauaaaaagccauauauacugc

SEQ ID NO: 224647 - RNA, 64 nt, hsa
aaacucauauuacaaaaacaaaauaaaauaauaaaaaaagaaagcaugauauuuacuguuuugu

SEQ ID NO: 224648 - RNA, 64 nt, hsa
uggcaaaacuauuauauguaagggaaauauauacaaaaagaaaauuaaucauagucaccugacu

SEQ ID NO: 224649 - RNA, 64 nt, hsa
acuccauuacucugauuuuugauacaguuuucagaaaaagaaaugaacauaaucaaguaaggau

SEQ ID NO: 224650 - RNA, 64 nt, hsa
gguggcuuuuuucauacuacuguuaacuuuuuuaaaaaagaagcaauguaaagaccguaaugca

SEQ ID NO: 224651 - RNA, 64 nt, hsa
gaagcuuugaaauaaauacugcaccaaaaaugugaaaaagaaucacguaguaaauguauacuua

SEQ ID NO: 224652 - RNA, 64 nt, hsa
cuguauaaacuuaacagggaagggcuggggugugaaaaagaagauuguaugaaaaccauuggua

SEQ ID NO: 224653 - RNA, 64 nt, hsa
auuuuaaauauucuaguagccacauuaauaaaguaaaaagaaacaggugagguuaauuugaaug

SEQ ID NO: 224654 - RNA, 64 nt, hsa
caucucuguucaucccuuccuauaaccucuagguaaaaagaaaagaaaaaaagaaauuucgaga

SEQ ID NO: 224655 - RNA, 64 nt, hsa
cccuuccuauaaccucuagguaaaaagaaaagaaaaaaagaaauuucgagauauuuucaacauu

SEQ ID NO: 224656 - RNA, 64 nt, hsa
uaucucaaaccgcagaaaggcuuuaauacuggaaaaaaagaauucaagacuacaggcagcuccc

SEQ ID NO: 224657 - RNA, 64 nt, hsa
gccugggugacaagagugaaacuccaucucaaaaaaaaagaaaagaagguccagcuuuuggauu

SEQ ID NO: 224658 - RNA, 64 nt, hsa
agcccgggugacaaagcaagacccugucucagaaaaaaagaaaauucaaggccaguuaagacaa

SEQ ID NO: 224659 - RNA, 64 nt, hsa
ugcuguaguaggaauguuuuaacagugucauaugaaaaagaacaaaauaaauauuuugauuuug

SEQ ID NO: 224660 - RNA, 64 nt, hsa
augacucgcaaccccucaccccacaauuucuuuaaaaaagaaauuaucuuuaguugaauuccaa

SEQ ID NO: 224661 - RNA, 64 nt, hsa
acauuuuaggaucucgccuggaaacagagguaaaaaaaagaagugugcgcccggcuaaugcagc

SEQ ID NO: 224662 - RNA, 64 nt, hsa
cuguauggaaucaacaccaccgagcucugugggaaaaaagaaaaaccugcucccuucgcucugc

SEQ ID NO: 224663 - RNA, 64 nt, hsa
accaacauguaucugucuacuuucucuuguuuaaaaaaagaaaaaaaaacuuaaaaaaaugggg

SEQ ID NO: 224664 - RNA, 64 nt, hsa
aucuuaaaaaaagaaaaaaugaaaaaaaaaggaaaaaaagaaaaaaggaaaaaaacaguuugaa

SEQ ID NO: 224665 - RNA, 64 nt, hsa
cuuuuccaguguguaacccaguuugaaaucuuaaaaaaagaaaaaaugaaaaaaaaaggaaaaa

SEQ ID NO: 224666 - RNA, 64 nt, hsa
accuuuccuucaagcagaaacaagcaacugagggaaaaagaaacacaacaauaguuuaagaaau

SEQ ID NO: 224667 - RNA, 64 nt, hsa
acacucauuuccaaggcccuaacccuuauccuuuaaaaagaaauccucugaacugggucggucu

SEQ ID NO: 224668 - RNA, 64 nt, hsa
auucauuuauguuagcauuaaugcacauuuuuaaaaaaagaaaaaaacauggucuuguuuuuac

SEQ ID NO: 224669 - RNA, 64 nt, hsa
cuguugccugcaaaaauaaaagggaaaaaaaagaaaaaagaaacaaaaaggaacuucuuauagu

SEQ ID NO: 224670 - RNA, 64 nt, hsa
cccaugacuguugccugcaaaaauaaaagggaaaaaaaagaaaaaagaaacaaaaaggaacuuc

SEQ ID NO: 224671 - RNA, 64 nt, hsa
aaacugaauuuuugaaagacuauugcagguguuuaaaaagaaagaaaaguuguuuuaucuaaua

SEQ ID NO: 224672 - RNA, 64 nt, hsa
gcugaaggagaaggaggguaguguuuugcaaaagaaaaagaaaagaaccaacagaauuuuaacu

SEQ ID NO: 224673 - RNA, 64 nt, hsa
gcacacugagauauaauaaaagguguuuaucauaaaaaagaaacaguauuagauuuuggucucc

SEQ ID NO: 224674 - RNA, 64 nt, hsa
auuuuuauggauuguagacccaguuuugaaaccaaaaaagaaaccuagaaucuaaugcagaaga

SEQ ID NO: 224675 - RNA, 64 nt, hsa
cuuuuaguaaggcauuugggguuggggaagcuagaaaaagaaaugggagcuggucacacagggc

SEQ ID NO: 224676 - RNA, 64 nt, hsa
gaacauuuggcaggaauuguccuuaugaaacaagaaaaagaaaaugaaaaguauuauuaagcuu

SEQ ID NO: 224677 - RNA, 64 nt, hsa
agauuucuaaguuaaaucauuuucauuaaaaggaaaaaagaaaaaaaauuuuguaugucaauaa

SEQ ID NO: 224678 - RNA, 64 nt, hsa
uuaaauuuacagaauauuauauaacccacugcugaaaaagaaaaaaaugauuguuuuagaaguu

SEQ ID NO: 224679 - RNA, 64 nt, hsa
gcauuacaggcugcauucuugccuuacuguauagaaaaagaaaaaaggcuggguuuacuauugc

SEQ ID NO: 224680 - RNA, 64 nt, hsa
ugucuucuguacaucuuacuggguuuaauuaaaaaaaaagaaaaaacucuguuguaaaaacagu

SEQ ID NO: 224681 - RNA, 64 nt, hsa
gccacaguuguuugaugcauuaaaagaaaauaaaaaaaagaaaaaagagaaaagaaaaaaaaag

SEQ ID NO: 224682 - RNA, 64 nt, hsa
agaaaauaaaaaaaagaaaaaagagaaaagaaaaaaaaagaaaaaaguuguaggcgaaucauuu

SEQ ID NO: 224683 - RNA, 64 nt, hsa
aaauaggaaaacaacaaaagaaaaacaauaacaaaaaaagaaagugugauggcugggugcagug

SEQ ID NO: 224684 - RNA, 64 nt, hsa
aaaauaaauaaauagaaagagagagagaggaaaaaaaaagaaaagaacacuucuuuauuugagg

SEQ ID NO: 224685 - RNA, 64 nt, hsa
aaguaccugaucaggaucugggagaauuugaaaaaaaaagaaaaacuagaaaaauaaacaaaau

SEQ ID NO: 224686 - RNA, 64 nt, hsa
aaaaaaaagaaaaacuagaaaaauaaacaaaauuaaaaagaaaaaaaaauaccugagacugagu

SEQ ID NO: 224687 - RNA, 64 nt, hsa
uuauaggauuccguuuuuucacaagacuuuuaauaaaaagaaauuguagaaauaaacacauuaa

SEQ ID NO: 224688 - RNA, 64 nt, hsa
aguaauaaaggaagaauuaugacuucauuaugaaaaaaagaaguuuuaaaguuuucaauuacga

SEQ ID NO: 224689 - RNA, 64 nt, hsa
ccgaacagccugaaaugugaacugaacaggagaaaaaaagaaaagcaaaaaacuccuguaaccc

SEQ ID NO: 224690 - RNA, 64 nt, hsa
acacuaaauucaagucauuuguuuuaagucucuaaaaaagaagauugcagucauccauucauau

SEQ ID NO: 224691 - RNA, 64 nt, hsa
uuucuaaccucuuauagacaugccaaaugcuggcaaaaagaagugcuuuuuggauauggcagca

SEQ ID NO: 224692 - RNA, 64 nt, hsa
ccagccugagcaacaagagcgaaacugucucaaaaaaaagaagaaaauaaauaaauaaaaauca

SEQ ID NO: 224693 - RNA, 64 nt, hsa
uuuuuucuuaaguuauauuuguuuuuacuuuuuaaaaaagaagaggaaacaaagcccccuuuua

SEQ ID NO: 224694 - RNA, 64 nt, hsa
cuaguggucccuuuugaauuucaugagccucucaaaaaagaaaaacuuaaaaaaaaaaaaaaaa

SEQ ID NO: 224695 - RNA, 64 nt, hsa
uuuuauuuccuaagaaauaauuuaauguuuaguaaaaaagaaaacagaaaaaagaaagaugcgu

SEQ ID NO: 224696 - RNA, 64 nt, hsa
aaauaauuuaauguuuaguaaaaaagaaaacagaaaaaagaaagaugcguguguuggcuuacgc

SEQ ID NO: 224697 - RNA, 64 nt, hsa
gaccaaagaccucaaacacugguccuguucaaagaaaaagaaagaacaugaggguuaaaaauca

SEQ ID NO: 224698 - RNA, 58 nt, hsa
acaagaccccugaggcaugacaagaaaaaaaaagaagaccaaagaccucaaacacugg

SEQ ID NO: 224699 - RNA, 64 nt, hsa
aggguuguagaauguaguccucagguauaugauaaaaaagaauuagacaucaagucauuaaaag

SEQ ID NO: 224700 - RNA, 64 nt, hsa
acaaguaaucuaagcuuccacuuuggaaaacuagaaaaagaagagcaaauuaaauccaaaguaa

SEQ ID NO: 224701 - RNA, 64 nt, hsa
cagauaacagcaggaaggacuuaagguguauaagaaaaagaaaguauucauacagaaauuaccu

SEQ ID NO: 224702 - RNA, 64 nt, hsa
gaucaacaccuuaaaauucauuuaauacuuauuuaaaaagaagaugagagauucaaaaauauca

SEQ ID NO: 224703 - RNA, 64 nt, hsa
gugggcuuuuuuuuccucucaaaaaaaaaaaaagaaaaagaaaaagaggaagaagcagcuuugc

SEQ ID NO: 224704 - RNA, 64 nt, hsa
auuccagugggcuuuuuuuuccucucaaaaaaaaaaaaagaaaaagaaaaagaggaagaagcag

SEQ ID NO: 224705 - RNA, 64 nt, hsa
guguguuaaguuuuucaucugugcaucaaaucacaaaaagaauaaauagagcuuuuuccuuuau

SEQ ID NO: 224706 - RNA, 64 nt, hsa
accaagagacagugaaaaauagaugaacuaagagaaaaagaaucggauggucuuuguaacugau

SEQ ID NO: 224707 - RNA, 64 nt, hsa
aauaaauaaaacaaacuuaaucuucaucuuuaaaaaaaagaaaaaagaaaccaaaaugagaauc

SEQ ID NO: 224708 - RNA, 64 nt, hsa
aaaacaaacuuaaucuucaucuuuaaaaaaaagaaaaaagaaaccaaaaugagaaucaacacuu

SEQ ID NO: 224709 - RNA, 64 nt, hsa
guuauaucuuggauauuguauuacccuggguauuaaaaagaacuccuuucacauuuuaaaauaa

SEQ ID NO: 224710 - RNA, 64 nt, hsa
accuuuaguagucaaaccaaaaaucuaagauuccaaaaagaacagcauucauugaaauaauauu

SEQ ID NO: 224711 - RNA, 64 nt, hsa
uaaugcaugaauauaaaucuauauuauuugcuaaaaaaagaaaaaacauuuguguuuuaguuuc

SEQ ID NO: 224712 - RNA, 64 nt, hsa
ucucugauacuuuugaaacagaugugaaaaacagaaaaagaaaaaauugucugaaauguuuauu

SEQ ID NO: 224713 - RNA, 64 nt, hsa
aaaauugauguugucuuuaccagaaagguagacaaaaaagaagcagcagcagcucuuaaaguga

SEQ ID NO: 224714 - RNA, 64 nt, hsa
cucuuggaaagaaugacguuuugcuggaaaaaaaaaaaagaacaguuuguguuucacaaacaug

SEQ ID NO: 224715 - RNA, 64 nt, hsa
guaguuaccugaauauagguugaaaagguuauguaaaaagaaauuauaauaaaagggauacuuu

SEQ ID NO: 224716 - RNA, 64 nt, hsa
uuaacuguuugauuauaacugugcaaauacagaaaaaaagaaggcuggcugaaaguugaguuaa

SEQ ID NO: 224717 - RNA, 64 nt, hsa
aacauuucacaaauguuuagugaaacauuugugaaaaaagaagacuaaauuaagaccugagcug

SEQ ID NO: 224718 - RNA, 64 nt, hsa
ucauuuauuuuaaauaaaugaauaaaauaaaauaaaaaagaauauucagucguuggcacauaaa

SEQ ID NO: 224719 - RNA, 64 nt, hsa
aauuguuaaauguucuuaaauguucucacuacaaaaaaagaaaaaagauaacuacgugagguga

SEQ ID NO: 224720 - RNA, 64 nt, hsa
aggaccaaaccaugcacauaaagcuuguaguuuaaaaaagaaaagcaaaaaaauaauuaugccu

SEQ ID NO: 224721 - RNA, 64 nt, hsa
agccugggcaacagagggagacucugucucaaaaaaaaagaaguuacuuccaagacagacuuuu

SEQ ID NO: 224722 - RNA, 64 nt, hsa
auucagaaaaggaggaaaggguaguuuaauuucaaaaaagaaucccuuccucuuuccucugcug

SEQ ID NO: 224723 - RNA, 64 nt, hsa
aacuguggccugaagggauggggaguagcaacauaaaaagaaguggcucaagucuucuuggagu

SEQ ID NO: 224724 - RNA, 64 nt, hsa
uccugaacggaaaaggaagaagaaagagaagaagaaaaagaagguagaguagaggccuauugcc

SEQ ID NO: 224725 - RNA, 64 nt, hsa
ccaucugauucagaucacaagaagaagaaaaagaaaaaagaagaggauccugaacggaaaagga

SEQ ID NO: 224726 - RNA, 64 nt, hsa
agaaacaccaucugauucagaucacaagaagaagaaaaagaaaaaagaagaggauccugaacgg

SEQ ID NO: 224727 - RNA, 64 nt, hsa
cuuggaaaacaccccaaccccggaaaugugugggaaaaagaaaacaaaaacuuuccaaauucca

SEQ ID NO: 224728 - RNA, 64 nt, hsa
ugccucaggcuucucuuacgaagaggaaacgcaaaaaaagaaaaggaaaaaccccgugcucgcc

SEQ ID NO: 224729 - RNA, 64 nt, hsa
uuuuuaauugaguguaaacacaccuaacuuuaagaaaaagaaccgcuuguaugauuuucaaaag

SEQ ID NO: 224730 - RNA, 64 nt, hsa
uguaguaguuggucuagaaacaaaauacuccaagaaaaagaaaauuuucaaauaaaacccaaaa

SEQ ID NO: 224731 - RNA, 64 nt, hsa
aagcuauuuguuaaaauauuugccuuuuuaaguaaaaaagaaaaaucagaacagggcuauuuga

SEQ ID NO: 224732 - RNA, 64 nt, hsa
uugcacuuagguaccaggugucaggaaacagacuaaaaagaauuccaccaggcuguuuggagau

SEQ ID NO: 224733 - RNA, 64 nt, hsa
uccauuugaucuauagcaaugugauuuuauuuuuaaaaagaaaagcaguguguuuucuuuuuuu

SEQ ID NO: 224734 - RNA, 64 nt, hsa
uuaucugauguugguuugauacuguuaacacaccaaaaagaauauggaauugaaaugagcuagc

SEQ ID NO: 224735 - RNA, 64 nt, hsa
ugaagacaauuucuguaaugguuuuaagagauuuaaaaagaaauucacugguucuuuacaaaau

SEQ ID NO: 224736 - RNA, 64 nt, hsa
aaaauaccguuaauucaaauugacagagauugauaaaaagaaacugauuuaccuaaguuuacuu

SEQ ID NO: 224737 - RNA, 64 nt, hsa
gggcgacagugcaagacucugucuccaaaaaaaaaaaaagaaaaaagaaaaucccccuucaucc

SEQ ID NO: 224738 - RNA, 64 nt, hsa
agugcaagacucugucuccaaaaaaaaaaaaagaaaaaagaaaaucccccuucaucccccagga

SEQ ID NO: 224739 - RNA, 64 nt, hsa
gccaucaaauggcuacaguucauuuaaauuuaaaaaaaagaaaaaagaaacagaaaacgugucu

SEQ ID NO: 224740 - RNA, 64 nt, hsa
aauggcuacaguucauuuaaauuuaaaaaaaagaaaaaagaaacagaaaacgugucucagaugg

SEQ ID NO: 224741 - RNA, 64 nt, hsa
agugaaucccuuuguucucuguuuaaaaaaaucuaaaaagaaaaaggaaaaaaaaaaaagaacu

SEQ ID NO: 224742 - RNA, 64 nt, hsa
guuuaaaaaaaucuaaaaagaaaaaggaaaaaaaaaaaagaacugcugugggauugucaaccag

SEQ ID NO: 224743 - RNA, 64 nt, hsa
caauuuugaggguucagauuuagcuuggaagaaaaaaaagaaacauacauccuucaguauagga

SEQ ID NO: 224744 - RNA, 64 nt, hsa
gaauguuagcaucuucacuaggguaaagaagaacaaaaagaauguugcuggaacguaaaauagu

SEQ ID NO: 224745 - RNA, 64 nt, hsa
gaagcacaugaucaugggaaugauagcccagaacaaaaagaaaucuugucuuaccacaguguuu

SEQ ID NO: 224746 - RNA, 64 nt, hsa
auuaugaauggaggauauucuacuguacuuuuuuaaaaagaaacuauuuuuguguuugaaagug

SEQ ID NO: 224747 - RNA, 64 nt, hsa
cacaaaauaccccaacacaggcgggggagagacgaaaaagaaaaggaaagagcaagauagacaa

SEQ ID NO: 224748 - RNA, 64 nt, hsa
ggaaagagcaagauagacaaaagccaaucagcuuaaaaagaaaaacaaggaaggggaaaagaaa

SEQ ID NO: 224749 - RNA, 53 nt, hsa
aggaagaaaacaaggacuaagcaaaaaagaaagacccccccccccuuagcaac

SEQ ID NO: 224750 - RNA, 64 nt, hsa
acauacuaccuaaagggaaccugcaauaaucuugaaaaagaaaaagagaaaaauuuuaaaaucc

SEQ ID NO: 224751 - RNA, 64 nt, hsa
aaaaaaagagaaaaaaauaaaaaucaaaaaaaaaaaaaagaaagaaagaaaccuccagcguauu

SEQ ID NO: 224752 - RNA, 64 nt, hsa
aguacuuuguauuguauacgugagucauaauaauaaaaagaagaagaaaaauaauagaagcugg

SEQ ID NO: 224753 - RNA, 64 nt, hsa
ugugauuaugaccauuguuucauauuccaauuaaaaaaagaacagcagccuagcuacuuaaggu

SEQ ID NO: 224754 - RNA, 64 nt, hsa
ucucucagccugggaaacuaucaacucuuucuuuaaaaagaaagaggguugaaaauccucugga

SEQ ID NO: 224755 - RNA, 64 nt, hsa
uaaucuggcaucuucuccaggccuaaaucuuaagaaaaagaaaugggugcugggguuuggggga

SEQ ID NO: 224756 - RNA, 64 nt, hsa
gauaaacugaaguggcacugugacuuuaaaaauaaaaaagaaaucuacuuggaaguccuuuuug

SEQ ID NO: 224757 - RNA, 64 nt, hsa
caaagauccaccgagagaagaagagaaagaaaagaaaaagaaaaagcacaaaaaaagaucucga

SEQ ID NO: 224758 - RNA, 64 nt, hsa
ucucucucucucugcauuaggggagucucucaggaaaaagaagcccagaucucuucagcaaucg

SEQ ID NO: 224759 - RNA, 64 nt, hsa
accacccuaaaguuggauuuuuacauauaaauaaaaaaagaaucccuuuuauuuuucucucucu

SEQ ID NO: 224760 - RNA, 64 nt, hsa
ucauuuuuuuucuuuguaaugcaccugacagaaaaaaaagaaaaaugaauuucucuuuacuucu

SEQ ID NO: 224761 - RNA, 64 nt, hsa
ugaauguguuuuguuguuuugugcuacaauuuuuaaaaagaaaaaaguuuuguuuuguuuuuug

SEQ ID NO: 224762 - RNA, 64 nt, hsa
ggucacucuccccaaaauauuauauuuuuucuauaaaaagaaaaaaauggaaaaaaauuacaag

SEQ ID NO: 224763 - RNA, 64 nt, hsa
cagaguuuugguuuuugaacuagcaaugccugugaaaaagaaacugaauaccuaagauuucugu

SEQ ID NO: 224764 - RNA, 64 nt, hsa
uaaagaaaagaugagcaaagaugguaaaaagaagaaaaagaagucaaagacaaaguguguaauu

SEQ ID NO: 224765 - RNA, 64 nt, hsa
ucgaaaacauaaagaaaagaugagcaaagaugguaaaaagaagaaaaagaagucaaagacaaag

SEQ ID NO: 224766 - RNA, 64 nt, hsa
uugagcacuggguucuuuuagccaaauuccauacaaaaagaauuuggauguuuuccagcauuua

SEQ ID NO: 224767 - RNA, 64 nt, hsa
agaaaaagaaaaaagugaaaaggaaacaacuagcaaaaagaauagccauaagaaaaccagguaa

SEQ ID NO: 224768 - RNA, 64 nt, hsa
acacagucaaagaaagagaaaaaagauaaaguagaaaaagaaaaaagugaaaaggaaacaacua

SEQ ID NO: 224769 - RNA, 56 nt, hsa
uuccaccccuuccuaaguaaaaaaagaaaaagaagaggagaaaaaaacuucuuuaa

SEQ ID NO: 224770 - RNA, 50 nt, hsa
uuccaccccuuccuaaguaaaaaaagaaaaagaagaggagaaaaaaacuu

SEQ ID NO: 224771 - RNA, 64 nt, hsa
uauuuuuaggaccaaucucauuuuuaauaagguuaaaaagaaaaaaaaagucuagcgaaaaaac

SEQ ID NO: 224772 - RNA, 64 nt, hsa
ugcagagaugagguccuucuggacuaaaagccaaaaaaagaaagaaaaaaauaauuuuucuuuu

SEQ ID NO: 224773 - RNA, 64 nt, hsa
cagagcgaaccucugucucaaaaaaaaaaaaagaaaaaagaaagaaagaaaaaaggcagaagcc

SEQ ID NO: 224774 - RNA, 64 nt, hsa
ggggugacagagcgaaccucugucucaaaaaaaaaaaaagaaaaaagaaagaaagaaaaaaggc

SEQ ID NO: 224775 - RNA, 64 nt, hsa
gaaguuaaaacuugagaagcaaaaaaaugccugcaaaaagaagaucauuuuguauacagagaac

SEQ ID NO: 224776 - RNA, 64 nt, hsa
cugggaaagacaccaaaucaugggcucacuuuaaaaaaagaaagaauaaaaaaaccuucagcug

SEQ ID NO: 224777 - RNA, 64 nt, hsa
gcaguaugccacuucuuaaaacagaacaaaacaaaaaaagaaaauugugcucuuuucuaaucca

SEQ ID NO: 224778 - RNA, 64 nt, hsa
aaguacuugacuaaaaaaaaaagaaaaaaagaaaaaaaagaaagcauagacauauuuuuuuaaa

SEQ ID NO: 224779 - RNA, 64 nt, hsa
ucuuuaagaaaguacuugacuaaaaaaaaaagaaaaaaagaaaaaaaagaaagcauagacauau

SEQ ID NO: 224780 - RNA, 64 nt, hsa
cuauuguuucuuuaagaaaguacuugacuaaaaaaaaaagaaaaaaagaaaaaaaagaaagcau

SEQ ID NO: 224781 - RNA, 64 nt, hsa
aaaaaaaagacucccuggaucucugaauauaugcaaaaagaaggccccauuuaguggagccagc

SEQ ID NO: 224782 - RNA, 64 nt, hsa
acacaaagcuuuauuuuuccacaucaugcuuacaaaaaagaauaaugcaaauaguugcaacuuu

SEQ ID NO: 224783 - RNA, 64 nt, hsa
gcaacaaaagcgaaacucugucucaaaaaagaaaaaaaagaaaaaaaagcacgugaccuuauga

SEQ ID NO: 224784 - RNA, 64 nt, hsa
ccagccugggcaacaaaagcgaaacucugucucaaaaaagaaaaaaaagaaaaaaaagcacgug

SEQ ID NO: 224785 - RNA, 64 nt, hsa
uuucauaaaacauuuucuugagagaguucaguuaaaaaagaaaaaaucagcgucauuuguuccc

SEQ ID NO: 224786 - RNA, 64 nt, hsa
ucaaauucagacgcagaacucuucagauuucuacaaaaagaaacauuuaaugacgguuuaaaac

SEQ ID NO: 224787 - RNA, 64 nt, hsa
aguaccuaugacuuuuuuaaacuaagaucuguuaaaaaagaaaucuguuucaacagaugaccgu

SEQ ID NO: 224788 - RNA, 64 nt, hsa
ugguuauaacagcaaaugaaagacucuucacuccaaaaagaaaaguguuuuguuuuuuaauucu

SEQ ID NO: 224789 - RNA, 64 nt, hsa
auagcgcugguacaguacacuaaaagacuuugauaaaaagaaacaauaauaaaaggccuccauu

SEQ ID NO: 224790 - RNA, 64 nt, hsa
ggcuuuucuucccuagaaacccaauucuaagcagaaaaagaaaaaaaacacaaaaaauaaaaaa

SEQ ID NO: 224791 - RNA, 64 nt, hsa
uucaacguuaauaauucuggauuuucuuaucacaaaaaagaaaaugaaggaccucaaagcaccu

SEQ ID NO: 224792 - RNA, 64 nt, hsa
aaugugucuuucuuuuuggacauuuaccuuuuugaaaaagaaaacacuuaaaaugaucauuagg

SEQ ID NO: 224793 - RNA, 64 nt, hsa
cuuucccaucaguucucaccggaaauaugcugccaaaaagaaaaucagcuuuucuaagaucaag

SEQ ID NO: 224794 - RNA, 64 nt, hsa
uuguuaaaaucccgaguggagagauuagauacagaaaaagaagaaaaaaucaaugaacuugaag

SEQ ID NO: 224795 - RNA, 64 nt, hsa
gccgcugcacuccagccugggagacugcaucucaaaaaagaaaaauaaacgaaguaaaagauau

SEQ ID NO: 224796 - RNA, 64 nt, hsa
agauugugucacugcacucuagccugggcgacagaaaaagaaaauuuagguggggaaaaaaauc

SEQ ID NO: 224797 - RNA, 64 nt, hsa
ugaguccacguuugguagcaucaguuguugaguuaaaaagaaaauuauugcauuugaucuggau

SEQ ID NO: 224798 - RNA, 64 nt, hsa
uucacauuugccaccauaauguucuuuuuuauguaaaaagaagaacuuggagacauuaacauga

SEQ ID NO: 224799 - RNA, 64 nt, hsa
uuuuuugacaaaucauauuguauucuuuuguacaaaaaagaacuacuuguauucuagaagaaau

SEQ ID NO: 224800 - RNA, 64 nt, hsa
uuagugauuauuaagcacuucugucagucuuugaaaaaagaacguauuuuuugugcuuugaaga

SEQ ID NO: 224801 - RNA, 64 nt, hsa
aucugugcuguagaaaaacauuaacccuuguucaaaaaagaaauggauaaacuuggccuuucua

SEQ ID NO: 224802 - RNA, 64 nt, hsa
agcacauugcauguaguugagccacauuuuuuaaaaaaagaaaauggaugaccauuaauugacu

SEQ ID NO: 224803 - RNA, 64 nt, hsa
augacccuuuugaauauaccuaaugauuuccuuaaaaaagaaauuuuaaacagacuuguuuaau

SEQ ID NO: 224804 - RNA, 64 nt, hsa
aucaugaggucagcaguugagaccagccaaaaggaaaaagaaaauuaugagaguuacuuaaagg

SEQ ID NO: 224805 - RNA, 64 nt, hsa
ccagcuauugucuguuguguucagcugagaugcaaaaaagaaauuaagcaaaaaagaaaaagau

SEQ ID NO: 224806 - RNA, 64 nt, hsa
guguucagcugagaugcaaaaaagaaauuaagcaaaaaagaaaaagaugaagacuuuucaugaa

SEQ ID NO: 224807 - RNA, 64 nt, hsa
uucaaauuuagcaauaaacaauuagcauuaguuaaaaaagaaacauauuccaagggcagguucg

SEQ ID NO: 224808 - RNA, 64 nt, hsa
aucaugugauucuagauuaacauuaaauagauugaaaaagaaacuuugcacgguaugagcuuca

SEQ ID NO: 224809 - RNA, 64 nt, hsa
gaugcaccaaccguaucauuauuuguuugaggaaaaaaagaaaucugcauuuuaauucauguug

SEQ ID NO: 224810 - RNA, 64 nt, hsa
uauguagaaugacuauucuaaauauuaauguauuaaaaagaaaauacaacaaaauguauauuua

SEQ ID NO: 224811 - RNA, 64 nt, hsa
uuuuaaagggaaugauuggggggaaaaacuggugaaaaagaaauauaaaaaggacccuaaaaag

SEQ ID NO: 224812 - RNA, 64 nt, hsa
aaaacuggugaaaaagaaauauaaaaaggacccuaaaaagaauucugcaaaauaagagaagaaa

SEQ ID NO: 224813 - RNA, 64 nt, hsa
uuaauaccuaauaucauaguuguacaauaugaaaaaaaagaauaaaaaguagcaguaaaauuau

SEQ ID NO: 224814 - RNA, 64 nt, hsa
ccacaugaacacugucaucuuuucucaugaaaguaaaaagaaccaagaacauuuuucacucuga

SEQ ID NO: 224815 - RNA, 64 nt, hsa
ucuaguugugucaccaaaucaucaaaaaaccuuaaaaaagaaguaacuugcuuuguagguuugu

SEQ ID NO: 224816 - RNA, 64 nt, hsa
cucaaaaaaaaaaaaaaaaaaaaaaggaaaaaaaaaaaagaaaaaaaaccauauguguauuagg

SEQ ID NO: 224817 - RNA, 64 nt, hsa
aagugaauggugauuggaaauuuuuagcuguaacaaaaagaaagaaaacaacuuuuuuuaaagc

SEQ ID NO: 224818 - RNA, 64 nt, hsa
uuugaaauaagacaggaauaaagaguauucugaaaaaaagaagauauggaugaagugaacccau

SEQ ID NO: 224819 - RNA, 64 nt, hsa
auaagugcauauauagugugaaagagaaggcauuaaaaagaagugcaauuccuuuuuagcaagg

SEQ ID NO: 224820 - RNA, 64 nt, hsa
aaauuaaauuucacccuauuuaaacauaugauaaaaaaagaaaugcacuuguaaacagaauguu

SEQ ID NO: 224821 - RNA, 64 nt, hsa
cagcaguaaacuauggggaaaaaaaaagaagaagaaaaagaaacucagggaucacugggagaag

SEQ ID NO: 224822 - RNA, 64 nt, hsa
agaaccuaagcacagcaguaaacuauggggaaaaaaaaagaagaagaaaaagaaacucagggau

SEQ ID NO: 224823 - RNA, 64 nt, hsa
ggacagcuacuucugggaaaaacaacaucauuccaaaaagaacaauaaugagagcaaaugcaaa

SEQ ID NO: 224824 - RNA, 64 nt, hsa
ugcugcugccucugaaacagaaaguuggaaaggaaaaaagaaaaaagcaauuagguagcacagc

SEQ ID NO: 224825 - RNA, 64 nt, hsa
ggcauuccagccccuauguuauugauggaaaaagaaaaagaagaaaagcaaucucgcaguacau

SEQ ID NO: 224826 - RNA, 64 nt, hsa
aaaagaggcauuccagccccuauguuauugauggaaaaagaaaaagaagaaaagcaaucucgca

SEQ ID NO: 224827 - RNA, 64 nt, hsa
gucaaccagugaggcugcccugaacaaaaaaaacaaaaagaaaaaaaaaaaaggaaagaaagaa

SEQ ID NO: 224828 - RNA, 64 nt, hsa
gagagagaggaaaaaaagaggaaagaaggaaaaaaaaaagaauuaaaaaaaaaaaaaagaaaaa

SEQ ID NO: 224829 - RNA, 64 nt, hsa
ggaaagaaggaaaaaaaaaagaauuaaaaaaaaaaaaaagaaaaacagaagaugaccuugaugg

SEQ ID NO: 224830 - RNA, 64 nt, hsa
uuuaaucuuuaucauuuucuugaaguaaauaaacaaaaagaaacauuuguuugcauaggaauuc

SEQ ID NO: 224831 - RNA, 64 nt, hsa
uugcauaggaauucaugaaggcgacccaaccuggaaaaagaacuauucacuuuggccauggggg

SEQ ID NO: 224832 - RNA, 64 nt, hsa
ucccaaaugggaaaggugcugacagaguuggagaaaaaagaauagacucauuuuuccccauuau

SEQ ID NO: 224833 - RNA, 64 nt, hsa
ccucucucaccccguaaacugacaagcaugaugaaaaaagaagcacauccaaguuucugccucu

SEQ ID NO: 224834 - RNA, 64 nt, hsa
uuuaauuauguaaaaaacaaaacuacaacaacaaaaaaagaaaaaaguuaaaaaagaaaaaaac

SEQ ID NO: 224835 - RNA, 64 nt, hsa
acaaaacuacaacaacaaaaaaagaaaaaaguuaaaaaagaaaaaaacaccaaaaaacaaaaac

SEQ ID NO: 224836 - RNA, 64 nt, hsa
aaaauuuugaaaaagaagauaaaaagaagaaacgaaaaagaaagcccaaggcaaagaaggggga

SEQ ID NO: 224837 - RNA, 64 nt, hsa
ugagaaaacaccaaaaaauuuugaaaaagaagauaaaaagaagaaacgaaaaagaaagcccaag

SEQ ID NO: 224838 - RNA, 64 nt, hsa
ugauguuccacugagaaaacaccaaaaaauuuugaaaaagaagauaaaaagaagaaacgaaaaa

SEQ ID NO: 224839 - RNA, 64 nt, hsa
uuaaacuuauuuugcuuuaaaaaaaaaaaaaaagaaaaagaaaauuuaacuuaaaauauuuuag

SEQ ID NO: 224840 - RNA, 64 nt, hsa
ucccuuuuaaacuuauuuugcuuuaaaaaaaaaaaaaaagaaaaagaaaauuuaacuuaaaaua

SEQ ID NO: 224841 - RNA, 64 nt, hsa
uacaaaaaaaaaguuuuauuuuucuaaaaaaagaaaaaagaagaaaaaauuuaaaggguguacu

SEQ ID NO: 224842 - RNA, 64 nt, hsa
auauuuguacaaaaaaaaaguuuuauuuuucuaaaaaaagaaaaaagaagaaaaaauuuaaagg

SEQ ID NO: 224843 - RNA, 64 nt, hsa
auaaauauguuguucaaauuaugaguauuauuuaaaaaagaaaaaggaacauaacccaggaguc

SEQ ID NO: 224844 - RNA, 64 nt, hsa
gauccugguguuucuauguucuuuuuuaagcaccaaaaagaagauggggaagaaaagaaggaaa

SEQ ID NO: 224845 - RNA, 64 nt, hsa
ugccuaguuuuuaguaaucuguacauuuuguuguaaaaagaaaaaccacucccaguccccagcc

SEQ ID NO: 224846 - RNA, 64 nt, hsa
ucccccccuaaaauuuguggguuuuuuuuuuuaaaaaaagaaaaugaaaaacaaccaagcgcau

SEQ ID NO: 224847 - RNA, 64 nt, hsa
agccacggaaacauagaaacauacacaaggccagaaaaagaagaaggagcucaacuaaaagugg

SEQ ID NO: 224848 - RNA, 64 nt, hsa
aggguuaauuucuaggcagguggagagagugguaaaaaagaaaugaaauugacaagcuaggaaa

SEQ ID NO: 224849 - RNA, 64 nt, hsa
ucaguuucuuagaauccuagguaaauaaaacaauaaaaagaaaacccuuacauuuaaaagagcu

SEQ ID NO: 224850 - RNA, 64 nt, hsa
aauuucagcuuaauugaccauaagaacuguggccaaaaagaacaguuuuuuggagaggcagaug

SEQ ID NO: 224851 - RNA, 64 nt, hsa
acaggagaaaaaggguuguuugacaaccuuugagaaaaagaaacaaaaggaaguaguuaaaugc

SEQ ID NO: 224852 - RNA, 64 nt, hsa
uuuaauguaccuuuuuguuagugaauuuggaaauaaaaagaaaaaaaaaacaaaaacaaacagg

SEQ ID NO: 224853 - RNA, 64 nt, hsa
gaccaucgucaaagaccugcucaagaaauuuuuaaaaaagaaacaaaguuaugggguuaaucuc

SEQ ID NO: 224854 - RNA, 64 nt, hsa
guguagauauuugucauauauuuaagaaaaagcuaaaaagaauggaaaucgcaugacuauaacu

SEQ ID NO: 224855 - RNA, 64 nt, hsa
aaaacacaaagaaguuuuucuuuguguuuggaucaaaaagaaacuuuguuuuuccgcaauugaa

SEQ ID NO: 224856 - RNA, 64 nt, hsa
uuuuaaucuuaagauucuuugugaugagggugagaaaaagaauccucaguuuauuuuuccacua

SEQ ID NO: 224857 - RNA, 64 nt, hsa
ccacucuuccacccucuaccccuuaccuuauucuaaaaagaacuuagguagguuauggugccuc

SEQ ID NO: 224858 - RNA, 64 nt, hsa
acuaucucagaaacaaaacaaaacaaaacaacaaaaaaagaaaaggcagaguacaaggagauac

SEQ ID NO: 224859 - RNA, 64 nt, hsa
cuguggcacuuuucaccauaauuuaauuuaguggaaaaagaagacaaugcuuuccauauuguga

SEQ ID NO: 224860 - RNA, 64 nt, hsa
caaaacaaaauaaaacaaaaaaaaggaaggaaaaaaaaagaaaaaauuuaaaaaauuuuaaaaa

SEQ ID NO: 224861 - RNA, 64 nt, hsa
uuuuuuaaaauucuaaguagaguauauugaaaagaaaaagaagagccuuaacauauauaaaagu

SEQ ID NO: 224862 - RNA, 64 nt, hsa
uuucccaggcuaauacaggaaacaagagguaccaaaaaagaaaguuuauuuuuuaaaauucuaa

SEQ ID NO: 224863 - RNA, 64 nt, hsa
aaagaagagaaaagaucgucugagaaaucugaaaaaaaagaaagcaaggauacuaagaaaauag

SEQ ID NO: 224864 - RNA, 64 nt, hsa
uggggcgguauggucaggacacaagccucugucaaaaaagaagagaaaagaucgucugagaaau

SEQ ID NO: 224865 - RNA, 64 nt, hsa
cuuaagcaaacagucccaaaccucuuaggggugaaaaaagaaacaugccacuugauuaggagag

SEQ ID NO: 224866 - RNA, 64 nt, hsa
ugggcaagaagagcgaaacugggucucaaguuaaaaaaagaaagcaaggaaagaguaauuuaca

SEQ ID NO: 224867 - RNA, 64 nt, hsa
aaagcacuguuucuauuuuuuucuuuuuuuccaaaaaaagaaaguaauaaaaacuuaaauucuu

SEQ ID NO: 224868 - RNA, 64 nt, hsa
uccaaggcccaggacacuugucagaaggaugcaaaaaaagaaaaaaguacauccacccucuuaa

SEQ ID NO: 224869 - RNA, 64 nt, hsa
ugggguuuuguuucuguuguuguucaaaugcaaaaaaaagaaaaaaaaagaaaaaaaaagguga

SEQ ID NO: 224870 - RNA, 64 nt, hsa
uuucuguuguuguucaaaugcaaaaaaaagaaaaaaaaagaaaaaaaaaggugacucacauugu

SEQ ID NO: 224871 - RNA, 64 nt, hsa
gaaaaagcacagcucucacuggccaguagcugccaaaaagaacacccaucguauaaggaaaucc

SEQ ID NO: 224872 - RNA, 64 nt, hsa
cgcucucucauguggggauguuugugcugcagacaaaaagaacaaaaaaaaauuuuuaaauacc

SEQ ID NO: 224873 - RNA, 64 nt, hsa
auuguuauuuuuuuaaaggaaacaaacagacaacaaaaagaagaaaaaaaaaaagaaccuccuu

SEQ ID NO: 224874 - RNA, 64 nt, hsa
aaggaaacaaacagacaacaaaaagaagaaaaaaaaaaagaaccuccuuggaaaaauuaauugc

SEQ ID NO: 224875 - RNA, 64 nt, hsa
ccacuaugcccucauuuuuuuaaaaaaggaaaaaaaaaagaaacuggguuccagucuuaauuca

SEQ ID NO: 224876 - RNA, 64 nt, hsa
aaauaaaaauaaaaaaaauaaaaaaggaaaaaaaaaaaagaagaaacaagacaugccaccuuuc

SEQ ID NO: 224877 - RNA, 64 nt, hsa
agccaaaaaaaaaaaaaaaaaaaaaaaaaaaagaaaaaagaaaaaaaaaauccaaaagagagaa

SEQ ID NO: 224878 - RNA, 64 nt, hsa
cuuuaaaagccaaaaaaaaaaaaaaaaaaaaaaaaaaaagaaaaaagaaaaaaaaaauccaaaa

SEQ ID NO: 224879 - RNA, 64 nt, hsa
ggagugaaacuccgucucaaaaaaaaaaaagaaaaaaaagaaguacaagaguauaauaccuuca

SEQ ID NO: 224880 - RNA, 64 nt, hsa
uggacaacaggagugaaacuccgucucaaaaaaaaaaaagaaaaaaaagaaguacaagaguaua

SEQ ID NO: 224881 - RNA, 64 nt, hsa
gcaaucaggcaagagaaagaaauaaaaggcaaccaaaaagaaaggaagucgaaguaucucuguu

SEQ ID NO: 224882 - RNA, 64 nt, hsa
aaaucaagaaugcaauccuauucacaauugccacaaaaagaauaaaauaccuaggaauacagcu

SEQ ID NO: 224883 - RNA, 64 nt, hsa
aaaaagagcccaaaaagccaaagcaauccuaagcaaaaagaacaaagcuggaggcaucgcauua

SEQ ID NO: 224884 - RNA, 64 nt, hsa
gggcaaccaagcgagacucugccuuaaaaaaaaaaaaaagaaaauguggcacauauacaccaug

SEQ ID NO: 224885 - RNA, 64 nt, hsa
gcacauauacaccauggaauacuaugcagccauaaaaaagaaugggaucauguccugugcagca

SEQ ID NO: 224886 - RNA, 64 nt, hsa
gguuugcccaaggacuacaaauaaaccaacgggaaaaaagaaagguuccaguuuugucugaaaa

SEQ ID NO: 224887 - RNA, 64 nt, hsa
ucagaacagcaaccaaauaaaacugaacuuggcaaaaaagaacuuugccgagaaaauuguguac

SEQ ID NO: 224888 - RNA, 64 nt, hsa
uuuucucauaaaauagucugauaagcuaauuuuuaaaaagaaaugccauuaacuguguuguauc

SEQ ID NO: 224889 - RNA, 64 nt, hsa
uggcccaacuugggaguggggaaauugcuuaaaaaaaaagaaaaagaaaaaaaaaaagauuauu

SEQ ID NO: 224890 - RNA, 64 nt, hsa
aacuugggaguggggaaauugcuuaaaaaaaaagaaaaagaaaaaaaaaaagauuauucuaaau

SEQ ID NO: 224891 - RNA, 64 nt, hsa
aaaagagaaaaacaauggaguuacuuauuuaaaaaaaaagaaagaaaguuaucucuucccagga

SEQ ID NO: 224892 - RNA, 64 nt, hsa
aacugugaauguagaagugggggggaggggggagaaaaagaaaacucuggcguuagaggauaua

SEQ ID NO: 224893 - RNA, 64 nt, hsa
guggcagaagcgagaaaacuuuguuuauugaaaaaaaaagaaaaagaaagcaagaaaaaaagau

SEQ ID NO: 224894 - RNA, 64 nt, hsa
gaagcgagaaaacuuuguuuauugaaaaaaaaagaaaaagaaagcaagaaaaaaagauacuaug

SEQ ID NO: 224895 - RNA, 64 nt, hsa
cagaguauuuuuguacagauuugcuuucucuuacaaaaagaaaaaaaaaauccuguuguauuaa

SEQ ID NO: 224896 - RNA, 63 nt, hsa
uauauuauuguuuacaauaaauauacauugcauuaaaaagaaaguggcccuguggauuuauuc

SEQ ID NO: 224897 - RNA, 64 nt, hsa
aaggcucgccgugagccaggucuaaaguuugaagaaaaagaaaaaucuuaaaaaaaaaaaaaaa

SEQ ID NO: 224898 - RNA, 64 nt, hsa
gaaaaagaaaaaucuuaaaaaaaaaaaaaaaaaaaaaaagaaaaaaagaaaaacaggaaaaagg

SEQ ID NO: 224899 - RNA, 64 nt, hsa
aaaaucuuaaaaaaaaaaaaaaaaaaaaaaagaaaaaaagaaaaacaggaaaaaggacuuuuuu

SEQ ID NO: 224900 - RNA, 64 nt, hsa
cugucuccgaaaaaaaaaaaaaaaaaaagaacggaaaaagaaaugcuuacauugucagggaucc

SEQ ID NO: 224901 - RNA, 64 nt, hsa
agagugagacccugucuccgaaaaaaaaaaaaaaaaaaagaacggaaaaagaaaugcuuacauu

SEQ ID NO: 224902 - RNA, 64 nt, hsa
ugggugacagagcgagacuccgucucaaaaaaaaaaaaagaaagcagauccucauggcuauaga

SEQ ID NO: 224903 - RNA, 64 nt, hsa
aaagaauuugucaauccuagccuuccaagagaagaaaaagaagagaaacuagaaacaguuaaag

SEQ ID NO: 224904 - RNA, 64 nt, hsa
acucgaauuaaauauccacaauucaaaagcaccuaaaaagaauaggcugaggaggaagucuucu

SEQ ID NO: 224905 - RNA, 64 nt, hsa
aaugagaaaaauccuaacccaauagaaucacucgaaaaagaaucugcuuucaaaacgaaagcug

SEQ ID NO: 224906 - RNA, 64 nt, hsa
auucaaaucucuugcuuucuuucuuaaaaaaaagaaaaagaaaaagcaagaagaaggaagaaag

SEQ ID NO: 224907 - RNA, 64 nt, hsa
agcaagauucaaaucucuugcuuucuuucuuaaaaaaaagaaaaagaaaaagcaagaagaagga

SEQ ID NO: 224908 - RNA, 64 nt, hsa
agagcucuaauuguuuguuuuggaagaaaaaaagaaaaagaacaaaaaauauauaucacucuag

SEQ ID NO: 224909 - RNA, 64 nt, hsa
gggccuagagcucuaauuguuuguuuuggaagaaaaaaagaaaaagaacaaaaaauauauauca

SEQ ID NO: 224910 - RNA, 64 nt, hsa
aauagaaacuuugcuaguuaaaaaaaaaagaaaaaaaaagaaaaaaaaucccuuucuuguaaac

SEQ ID NO: 224911 - RNA, 64 nt, hsa
aagaaaguauaauagaaacuuugcuaguuaaaaaaaaaagaaaaaaaaagaaaaaaaaucccuu

SEQ ID NO: 224912 - RNA, 64 nt, hsa
aguuugaaaaucauucccuaaagcaugcaauaggaaaaagaaccuccuggcugggacugcccaa

SEQ ID NO: 224913 - RNA, 64 nt, hsa
uuugccagccuggcaacagaacaagacucugucuaaaaagaaaaaaaaauuuuuuuguuuaaga

SEQ ID NO: 224914 - RNA, 64 nt, hsa
uguuuugcuuuuccauauagcucgagcaaaauucaaaaagaacuaaauaugcaauauauguuca

SEQ ID NO: 224915 - RNA, 64 nt, hsa
aaaugauuuacauaggccgagcuguggacaaaaaaaaaagaagcagcagcuuguaguaugcuua

SEQ ID NO: 224916 - RNA, 64 nt, hsa
aagaacauggggauuuuguauaaccagggauaauaaaaagaaaaaagaaguuaauuuuuaauug

SEQ ID NO: 224917 - RNA, 64 nt, hsa
uggggauuuuguauaaccagggauaauaaaaagaaaaaagaaguuaauuuuuaauugauguuuu

SEQ ID NO: 224918 - RNA, 64 nt, hsa
acaacacuggugacagucauaugguuuugaaaaaaaaaagaaauuuugcuucuucccagcuuuu

SEQ ID NO: 224919 - RNA, 64 nt, hsa
aacagauugcuagacaagagaaaaaacuugaagaaaaaagaagcuuaauuucaugcuucauaag

SEQ ID NO: 224920 - RNA, 64 nt, hsa
ccaaacugcuuuguguauuguauauuuuuuuaagaaaaagaaaagccuuauuugacuuaugcuu

SEQ ID NO: 224921 - RNA, 64 nt, hsa
gugaaucuagagccuacuuuuauuuugguuaaagaaaaagaaaauaucaauaauucaauuuugu

SEQ ID NO: 224922 - RNA, 64 nt, hsa
uggaguaauagggaaagaagaguuacagaaaaugaaaaagaaaaugaguuacacugagaaugaa

SEQ ID NO: 224923 - RNA, 64 nt, hsa
gcgagacuccgccucaaaaaaaaaaaaaaaagaaaaaaagaaauguaccuguuggcaggagaag

SEQ ID NO: 224924 - RNA, 64 nt, hsa
gcgacagagcgagacuccgccucaaaaaaaaaaaaaaaagaaaaaaagaaauguaccuguuggc

SEQ ID NO: 224925 - RNA, 64 nt, hsa
aaaaggucuucugacacacuuaucuugcacaaagaaaaagaaaauuucuuuuacuguguuuaau

SEQ ID NO: 224926 - RNA, 64 nt, hsa
gcggguucuuguucgggaggcaaauuucccuaggaaaaagaagacagacuuuucuaaugugguc

SEQ ID NO: 224927 - RNA, 64 nt, hsa
ccugggcaacaagagcaaaacuccgucucaaaauaaaaagaaaagaaaagaauggacaguguuu

SEQ ID NO: 224928 - RNA, 64 nt, hsa
cucaaagacucuuguccucuugucccuccugagaaaaaagaaaacgaaaagugggguuuuuuuc

SEQ ID NO: 224929 - RNA, 64 nt, hsa
uuauuuuuuugaauuuuaauuguaacauuuuuagaaaaagaacaaaaaaagaaaaaaaaaagaa

SEQ ID NO: 224930 - RNA, 64 nt, hsa
aauuuuaauuguaacauuuuuagaaaaagaacaaaaaaagaaaaaaaaaagaaagaaacacagc

SEQ ID NO: 224931 - RNA, 64 nt, hsa
uaacauuuuuagaaaaagaacaaaaaaagaaaaaaaaaagaaagaaacacagcaacuguagaug

SEQ ID NO: 224932 - RNA, 64 nt, hsa
cgggaagggaccuugcagggaccucucccuccaaaaaaagaaaaaaagaaaaagaaagaaaaaa

SEQ ID NO: 224933 - RNA, 64 nt, hsa
gaccuugcagggaccucucccuccaaaaaaagaaaaaaagaaaaagaaagaaaaaauaaaugag

SEQ ID NO: 224934 - RNA, 64 nt, hsa
gcagggaccucucccuccaaaaaaagaaaaaaagaaaaagaaagaaaaaauaaaugaggaaacg

SEQ ID NO: 224935 - RNA, 64 nt, hsa
aucaaaaucccccaaauguuaagguauaugguaaaaaaagaaauaucugggaucccgauguucu

SEQ ID NO: 224936 - RNA, 64 nt, hsa
uauaccaguuauaugaauugacuuaaguaucuugaaaaagaaacuuuagagaaagcaucagggg

SEQ ID NO: 224937 - RNA, 64 nt, hsa
aaagaaagaaagggaaagauggaaggaaggaaggaaaaagaaagagaaagagagagagagagaa

SEQ ID NO: 224938 - RNA, 64 nt, hsa
ggaaaaagaaagagaaagagagagagagagaaagaaaaagaaagaaaaguaagaaagaaaaaag

SEQ ID NO: 224939 - RNA, 64 nt, hsa
agagagaaagaaaaagaaagaaaaguaagaaagaaaaaagaaaaagaaagaaaaguaagaaaga

SEQ ID NO: 224940 - RNA, 64 nt, hsa
aaagaaaaagaaagaaaaguaagaaagaaaaaagaaaaagaaagaaaaguaagaaagaaaaaaa

SEQ ID NO: 224941 - RNA, 64 nt, hsa
ucggcaacaugccaagaccccgucucuauuuuuaaaaaagaaaaagaaccgacuucugaaucgc

SEQ ID NO: 224942 - RNA, 64 nt, hsa
acaugccaagaccccgucucuauuuuuaaaaaagaaaaagaaccgacuucugaaucgcagcucc

SEQ ID NO: 224943 - RNA, 64 nt, hsa
ugggugacacagcaagacuccaucucaaaaaaaaaaaaagaaaaagaaaugaauggguucaaag

SEQ ID NO: 224944 - RNA, 64 nt, hsa
acacagcaagacuccaucucaaaaaaaaaaaaagaaaaagaaaugaauggguucaaagaccaua

SEQ ID NO: 224945 - RNA, 64 nt, hsa
ucauucuaauaccaaaaccugacaggcacaaugaaaaaagaaaacuucaggcugguacuccuga

SEQ ID NO: 224946 - RNA, 64 nt, hsa
guacauauacaccauggaauacuaugcagccauaaaaaagaacaagacuguguccuuuacagca

SEQ ID NO: 224947 - RNA, 64 nt, hsa
cagccugggcaacauagccagaccuccucucuacaaaaagaaaaaagaaugacaugcuucuugu

SEQ ID NO: 224948 - RNA, 64 nt, hsa
ggcaacauagccagaccuccucucuacaaaaagaaaaaagaaugacaugcuucuuguuuuuguc

SEQ ID NO: 224949 - RNA, 64 nt, hsa
gcaaaaaaaaaaguaaaaagaaaagaaaaaaaaaaaaaagaaacaaaccaccucuacauauuau

SEQ ID NO: 224950 - RNA, 64 nt, hsa
aagagcucugccaggggcgggcaaaaaaaaaaguaaaaagaaaagaaaaaaaaaaaaaagaaac

SEQ ID NO: 224951 - RNA, 64 nt, hsa
aaaacacaaacagaagaggaaaaaaaagcaacaaaaaaagaaaacacacagaagagauuuaaaa

SEQ ID NO: 224952 - RNA, 64 nt, hsa
uuaaacgucuguggagcuucugcugcaaggaacaaaaaagaaaaaaaucaaaaaagcgacaaaa

SEQ ID NO: 224953 - RNA, 64 nt, hsa
ugaaaaaaaaaaacacaaaaaaagacaaaaaaaaaaaaagaaaauauuuuggcagguuauguuu

SEQ ID NO: 224954 - RNA, 64 nt, hsa
uucauggugaagguuuuuguuucuuuuuucggcuaaaaagaaugcagagaugugcccccacccc

SEQ ID NO: 224955 - RNA, 64 nt, hsa
gugagacuccaucucaaaaaaaauaaaaaaaaagaaaaagaaauaaacucuaugaauguaaacc

SEQ ID NO: 224956 - RNA, 64 nt, hsa
aacagagugagacuccaucucaaaaaaaauaaaaaaaaagaaaaagaaauaaacucuaugaaug

SEQ ID NO: 224957 - RNA, 64 nt, hsa
uauuugaaaagguuaaaaaaaagaacaaaaaaaaaaaaagaacuuguacuguauuuccuaaaca

SEQ ID NO: 224958 - RNA, 64 nt, hsa
gcucaaaggguuaagucuauuugaaaagguuaaaaaaaagaacaaaaaaaaaaaaagaacuugu

SEQ ID NO: 224959 - RNA, 64 nt, hsa
ugugccaugaguuagccaugguccuggacccagcaaaaagaaugauuaugauggucagaguaag

SEQ ID NO: 224960 - RNA, 64 nt, hsa
aaaggauacuucaauuuuguaucuauuucuuauuaaaaagaaacauucuaaguaaacauaacga

SEQ ID NO: 224961 - RNA, 64 nt, hsa
cugggugacagagcgagacccugucucaaaaaaaaaaaagaauuuggagaugguucugcccacu

SEQ ID NO: 224962 - RNA, 64 nt, hsa
cuccagccugggcaacacagcgagacuccgucucaaaaagaaaaaguuuggaucaggcagggug

SEQ ID NO: 224963 - RNA, 64 nt, hsa
ccugaugcccuuauuugaagcuccauuauuuuuuaaaaagaaauuauauaaaaauacuuuauug

SEQ ID NO: 224964 - RNA, 64 nt, hsa
cugggcaauauagggagauccugucucuauuuaaaaaaagaaguuauggccgggcgcgguggcu

SEQ ID NO: 224965 - RNA, 64 nt, hsa
uaaaacugaucaaaagcauaauugaaaguucugaaaaaagaaaaauaauaauauguagaaaaau

SEQ ID NO: 224966 - RNA, 64 nt, hsa
ucauuagacacuuaauaaaacuuaacuuccaaugaaaaagaaaucuuuuguaaaucauucuacu

SEQ ID NO: 224967 - RNA, 64 nt, hsa
uuuucauuugagagggagagcugugguacuggcuaaaaagaaaggaagauaacauccaguaacc

SEQ ID NO: 224968 - RNA, 64 nt, hsa
caagaauaagcagcagaacccuguuccauauggaaaaaagaaaaacaauuuuuugucccuaaug

SEQ ID NO: 224969 - RNA, 64 nt, hsa
agcaagacacgcacagucaaccauuuuccgagaaaaaaagaaaauuccccacuuggaaagaaag

SEQ ID NO: 224970 - RNA, 64 nt, hsa
agggccacugcagaugacucuccuuugaaaugagaaaaagaaaagaaagcaagaacagaaaacg

SEQ ID NO: 224971 - RNA, 64 nt, hsa
ccagccugggcaacauagcgagaccucaucuccaaaaaagaaaacaaaaaacaaaaaaaggaau

SEQ ID NO: 224972 - RNA, 64 nt, hsa
aaaaauuuaugcacugauuuaaaacaaaccaaaaaaaaagaaaaaaacaaaaaaaaaaaucccu

SEQ ID NO: 224973 - RNA, 64 nt, hsa
caagcacacccgugguugugaaaauaguauagcaaaaaagaaaaauccccgguuauugauguac

SEQ ID NO: 224974 - RNA, 64 nt, hsa
uaucaugggauuuaaauuuaucauaaccauguguaaaaagaaauuaauguaugaugacaucuca

SEQ ID NO: 224975 - RNA, 64 nt, hsa
augggauuuggcuugugagucuguaacaguucuuaaaaagaauaucugagaaacuacucuguuu

SEQ ID NO: 224976 - RNA, 64 nt, hsa
uuuaaccaggacuauguagaaguagaaagaaaagaaaaagaaaaucuuuuuuaaaccagaauaa

SEQ ID NO: 224977 - RNA, 64 nt, hsa
uauugaaagaauacuuuucuggcaaaaaaaaaaaaaaaagaaagaaaggaaaacaaaaagcacu

SEQ ID NO: 224978 - RNA, 64 nt, hsa
uucuuugccuuguucucugugaaguccuuuccuaaaaaagaaacuuauacaauuuaguucacaa

SEQ ID NO: 224979 - RNA, 64 nt, hsa
aauuuggauuuuguuccaaaagacaaguguuuuuaaaaagaaccuuuccauacuucguguucug

SEQ ID NO: 224980 - RNA, 64 nt, hsa
acgguauuuuuguuuguaaguuaaaaagaaaaaaaaaaagaaaaaguuccgggcauuuugcauc

SEQ ID NO: 224981 - RNA, 64 nt, hsa
ggguuuauuauuacgguauuuuuguuuguaaguuaaaaagaaaaaaaaaaagaaaaaguuccgg

SEQ ID NO: 224982 - RNA, 64 nt, hsa
aaaaaaaaaaaaaaagcaaccaaccccaacaacaaaaaagaauguuuugguauuggagaaggga

SEQ ID NO: 224983 - RNA, 64 nt, hsa
uguauuaacuuuaacuuauuaaaaaaaaaaaaagaaaaagaaaaacgauuuaaaaaaaaaaaaa

SEQ ID NO: 224984 - RNA, 64 nt, hsa
uauauuuguauuaacuuuaacuuauuaaaaaaaaaaaaagaaaaagaaaaacgauuuaaaaaaa

SEQ ID NO: 224985 - RNA, 64 nt, hsa
caggucuugcccaaagucauugauuuugaugauuaaaaagaauaaacacaguguuuccugagua

SEQ ID NO: 224986 - RNA, 64 nt, hsa
gagccagccaggacuccuuagacugaucaagccaaaaaagaaggugccgauuucaugcauucua

SEQ ID NO: 224987 - RNA, 64 nt, hsa
auuggggucuaguuuggaaucugacaacuggaacaaaaagaaccuugaauccggugcaugccuu

SEQ ID NO: 224988 - RNA, 52 nt, hsa
gacaguguuacagcaauuaaucaaaaagaaaaaccacaggcccuuccccuuc

SEQ ID NO: 224989 - RNA, 64 nt, hsa
gcacaagcuaagagagcuugcaaaaaaaaaaagaaaaaagaaaaaaaaaaaccacguuucuuug

SEQ ID NO: 224990 - RNA, 64 nt, hsa
ucugaaugcacaagcuaagagagcuugcaaaaaaaaaaagaaaaaagaaaaaaaaaaaccacgu

SEQ ID NO: 224991 - RNA, 64 nt, hsa
gaaauugagaaguauguugcugaaauugaaaaagaaaaagaagaaaacgaaaagaagaaacaaa

SEQ ID NO: 224992 - RNA, 64 nt, hsa
ccugaagaaauugagaaguauguugcugaaauugaaaaagaaaaagaagaaaacgaaaagaaga

SEQ ID NO: 224993 - RNA, 64 nt, hsa
cacaaacuuaagaggaaauaaggaaaaggagagaaaaaagaaauugguuaugaauaaaagugac

SEQ ID NO: 224994 - RNA, 64 nt, hsa
gggcggggacaaauaucaaauuaagcaaguaaagaaaaagaacagguaagagugugugugugug

SEQ ID NO: 224995 - RNA, 64 nt, hsa
uugacagggugcagucauuggugagaagaaucagaaaaagaagacccaucagcacagguuggau

SEQ ID NO: 224996 - RNA, 64 nt, hsa
cagcuuagguggcaaagugagacccugucuccaaaaaaagaaaauagagcuuuauaagcagaga

SEQ ID NO: 224997 - RNA, 64 nt, hsa
gaauucccuguaucaucuggaucucaacaucggaaaaaagaagcggauaguguuuauggagaau

SEQ ID NO: 224998 - RNA, 64 nt, hsa
ccaccaucuccccucaaaauuuuguagagguucuaaaaagaaagugguauguugugugaugauc

SEQ ID NO: 224999 - RNA, 64 nt, hsa
ggguagauguaguugcuuaguagcauuuuggaaaaaaaagaaaaaaagguuugguuugguuuug

SEQ ID NO: 225000 - RNA, 64 nt, hsa
agagcgaaacuccgucucaaaaaaaaaaaaaaaaaaaaagaaagaaaagaguaacagaaagaua

SEQ ID NO: 225001 - RNA, 64 nt, hsa
uuuuguucuaggggaaaugaaugugcaaaaaaagaaaaagaacuguugguuauuuguguuauuc

SEQ ID NO: 225002 - RNA, 64 nt, hsa
cacuuuuuuuguucuaggggaaaugaaugugcaaaaaaagaaaaagaacuguugguuauuugug

SEQ ID NO: 225003 - RNA, 64 nt, hsa
aaaguuaaauguaucacauugaagaaggcuagaaaaaaagaaugaguaaugugaucgcuugguu

SEQ ID NO: 225004 - RNA, 64 nt, hsa
cugugaaugcuucugauuuagcaaugcugugaauaaaaagaaagauuuuauacccuugacuuaa

SEQ ID NO: 225005 - RNA, 64 nt, hsa
guagaagaauggacuaucuguccaaacuaagaauaaaaagaaugacacuuguauuuuguauguc

SEQ ID NO: 225006 - RNA, 64 nt, hsa
uuacaacaacagggacagggcaaaagaggggaguaaaaagaaauagccaaaaaguacaauuguu

SEQ ID NO: 225007 - RNA, 64 nt, hsa
cugggcaacagagcgagacucagucucaaaaagaaaaaagaaauuuauugcugaucacaaggac

SEQ ID NO: 225008 - RNA, 64 nt, hsa
cuccagccugggcaacagagcgagacucagucucaaaaagaaaaaagaaauuuauugcugauca

SEQ ID NO: 225009 - RNA, 64 nt, hsa
ggcaccaaugugagaaccugucuuggaaaaaaaaaaaaagaaacauguuuuaguagaaguuuua

SEQ ID NO: 225010 - RNA, 64 nt, hsa
aaaaagaaacauguuuuaguagaaguuuuauuugaaaaagaaaaauaagcauaaauauauuccc

SEQ ID NO: 225011 - RNA, 64 nt, hsa
cucaauugaaagugggcaaaagcuuacaaauacuaaaaagaagugcugccgcgcaguguggagg

SEQ ID NO: 225012 - RNA, 64 nt, hsa
ugacuuuuucaacuucguuuccuuuguuggagucaaaaagaaccacuugugguucuaaaaggug

SEQ ID NO: 225013 - RNA, 64 nt, hsa
ucuuuccagcugcuguuuuguaaaaagaaaaagaaaaaagaagcccaaacuagugagaguaaua

SEQ ID NO: 225014 - RNA, 64 nt, hsa
acauuucucuuuccagcugcuguuuuguaaaaagaaaaagaaaaaagaagcccaaacuagugag

SEQ ID NO: 225015 - RNA, 64 nt, hsa
ccaccuacauuucucuuuccagcugcuguuuuguaaaaagaaaaagaaaaaagaagcccaaacu

SEQ ID NO: 225016 - RNA, 64 nt, hsa
uggaucugcggaaguaaccacaaaauauuaucgaaaaaagaaaagaauucuaaugaccagccgu

SEQ ID NO: 225017 - RNA, 64 nt, hsa
ucagacauagagagcuuugugugauucauguuuuaaaaagaaccgaagaagccacaggcagggc

SEQ ID NO: 225018 - RNA, 64 nt, hsa
uuucuguuuuuuaaccuuuuguuccgccauuuaaaaaaagaaaaaaaaaaagcuuauguuucuu

SEQ ID NO: 225019 - RNA, 64 nt, hsa
aauuauuuucagaaaaacacugacugugucauuuaaaaagaaauaaaugauauguuauuauccc

SEQ ID NO: 225020 - RNA, 64 nt, hsa
aaucauacuaaagacauuugcgcuuacuuuguugaaaaagaaaaagaaauuaaauuugaacaca

SEQ ID NO: 225021 - RNA, 64 nt, hsa
acuaaagacauuugcgcuuacuuuguugaaaaagaaaaagaaauuaaauuugaacacagugaaa

SEQ ID NO: 225022 - RNA, 64 nt, hsa
guagaccuguggcuuaaaauaaagaaaaugcagcaaaaagaaugcuauagaaauauuugguggu

SEQ ID NO: 225023 - RNA, 64 nt, hsa
ucccuuacauuuuuauuuaauugucuuagcuuaaaaaaagaagaaacuguggaauacuacagua

SEQ ID NO: 225024 - RNA, 64 nt, hsa
uucuagaagacagagcugauaggguaaauguugaaaaaagaagcaugccuccuucucccuccca

SEQ ID NO: 225025 - RNA, 64 nt, hsa
ucucugggugaggcaucugguuacugguuauuuuaaaaagaauaaagacauuccuggaaucacu

SEQ ID NO: 225026 - RNA, 64 nt, hsa
aaauugcaauuuguuuaauucagaauguguauuuaaaaagaaaaggaauuuaacaauuugcauc

SEQ ID NO: 225027 - RNA, 64 nt, hsa
cacacgugcacacacacacacauuuaaaugauauaaaaagaagagguugaaagauuauuaaaua

SEQ ID NO: 225028 - RNA, 64 nt, hsa
guguaagucacccccaccaaaaacaaaagagaagaaaaagaauagaaagaauuauccaguguca

SEQ ID NO: 225029 - RNA, 64 nt, hsa
aggcagggaauagacuucuagaaaaccugagaggaaaaagaauucuuuuuacaggaggcagcag

SEQ ID NO: 225030 - RNA, 64 nt, hsa
cucuuuccaauuucacuuugguggucugaagaagaaaaagaaauuuuauguauguauguguaaa

SEQ ID NO: 225031 - RNA, 64 nt, hsa
caucaauaaaauuguauguuaaugcuggaaagaaaaaaagaagaaagaaagaaaccaucccugu

SEQ ID NO: 225032 - RNA, 64 nt, hsa
ucuaaaauggguauugauuuuuaggacgguuuugaaaaagaaaaguguugggaaugaagcaagu

SEQ ID NO: 225033 - RNA, 64 nt, hsa
ucaaaagaauuggcacugggauaagauuuuucagaaaaagaaaaacaucggcaaacugugugug

SEQ ID NO: 225034 - RNA, 64 nt, hsa
uagacuacacaaaagcuuccuuccaguauuaaacaaaaagaauuaaacauaacuaugaaaaaac

SEQ ID NO: 225035 - RNA, 64 nt, hsa
agaaaaaauauacuugcuaucuauaaaaaagagaaaaaagaaaaaaaaugagaaaaaaguaaga

SEQ ID NO: 225036 - RNA, 64 nt, hsa
agugauauaucaguguuugagagugaccucuagaaaaaagaaaaguguuuuuagaaaugcguac

SEQ ID NO: 225037 - RNA, 64 nt, hsa
ggaagaguugcuucccauuucagggcccugccaaaaaaagaagaaagcuugccuuugguggggc

SEQ ID NO: 225038 - RNA, 64 nt, hsa
uugccagccugaacuauauuuaagagacuuuguaaaaaagaaaaauguauauagcugugaguuu

SEQ ID NO: 225039 - RNA, 64 nt, hsa
ccuuuuccucaaguuacuuuccuucauuuucuuaaaaaagaaaaaaaauuauuaaauguuucuc

SEQ ID NO: 225040 - RNA, 64 nt, hsa
acaacacuaacaugagaacacaagaacuuaagagaaaaagaaaccuacucaagaaaagacagaa

SEQ ID NO: 225041 - RNA, 64 nt, hsa
cuccgagaaagaagaacguaagcacaggaaagagaaaaagaaaucuguugaagaaaggacagaa

SEQ ID NO: 225042 - RNA, 64 nt, hsa
agucaaggucaguucaggaaagcuuaagcaucgaaaaaagaaaaaaagccaugauguacccucc

SEQ ID NO: 225043 - RNA, 64 nt, hsa
augggggcaccuaaacucuugaugaaagaacuuuaaaaagaaauguaaaccucaaauuaccucu

SEQ ID NO: 225044 - RNA, 64 nt, hsa
uauguacuuuuuaaugaacacgugucucacacacaaaaagaauuaaggauuuuuuuuacaagua

SEQ ID NO: 225045 - RNA, 64 nt, hsa
ccucuucuuucccauuuuaaaaaagaaaagaaggaaaaagaaaaaaggggcaaggagccccgcg

SEQ ID NO: 225046 - RNA, 64 nt, hsa
cucuucuacccucccccucuucuuucccauuuuaaaaaagaaaagaaggaaaaagaaaaaaggg

SEQ ID NO: 225047 - RNA, 64 nt, hsa
uguuauucaguuacuaaauuugaggugaauaauuaaaaagaaaaggacauuaggagagugaaaa

SEQ ID NO: 225048 - RNA, 64 nt, hsa
guauggauauaauauaaaaugaauucauauaauuaaaaagaauuugguuaauaagaauuuggag

SEQ ID NO: 225049 - RNA, 64 nt, hsa; identical to SEQ ID NO: 225026

SEQ ID NO: 225050 - RNA, 64 nt, hsa
cacacacgugcacacacacacauuuaaaggauauaaaaagaagagguugaaagauuauuaaaua

SEQ ID NO: 225051 - RNA, 64 nt, hsa
gggaagaguugcuuccuauuucaggacccugccaaaaaagaagaaagcuugccuuugguggggc

SEQ ID NO: 225052 - RNA, 64 nt, hsa
agugauauaucaguguuugggagugaccucuagaaaaaagaaaacuguuuuuagaaauacauaa

SEQ ID NO: 225053 - RNA, 64 nt, hsa
ccugggcgacaagagcgagacucucucaaaaagaaaaaagaagacacaagagagguggcuuuga

SEQ ID NO: 225054 - RNA, 64 nt, hsa
acuccagccugggcgacaagagcgagacucucucaaaaagaaaaaagaagacacaagagaggug

SEQ ID NO: 225055 - RNA, 64 nt, hsa
uggugacuucagauuuuuuuguacaguauuuugaaugugagaugauugucaggacuaacugucu

SEQ ID NO: 225056 - RNA, 64 nt, hsa
acuuacaguuaacauaggaaaaauacaaguaaggaugugagaauuugcauuuuaaugggaaauu

SEQ ID NO: 225057 - RNA, 64 nt, hsa
gagaagagacuuagcuucugauacugccaauuuaaugugagaacaugggguauacugcaucauu

SEQ ID NO: 225058 - RNA, 64 nt, hsa
uauuuauucagcuucacuugcagaucacuagugaaugugagauuuagagcucauugaguauauu

SEQ ID NO: 225059 - RNA, 64 nt, hsa
aauguacaaagauacuugaugcacuuauuuuuuaaugugagacagcaaguuuauaaaacaucca

SEQ ID NO: 225060 - RNA, 64 nt, hsa
gaacaaguguacagaagaauuuuuuuuuuaagauaugugagaacuuuucauagaugaacuuuuu

SEQ ID NO: 225061 - RNA, 64 nt, hsa
cuguguggagccuggaaaaaaaaauuaggaccacaugugagauguuuacaagacacccagaaca

SEQ ID NO: 225062 - RNA, 64 nt, hsa
ggaccaaaauacuuacaccugcaaaggaauaaagaugugagaguaugucuccauuguucacugu

SEQ ID NO: 225063 - RNA, 64 nt, hsa
cuuugccacugacuguaguauuaauaagguuuuaaugugagauauuccugcaaaccaucccauu

SEQ ID NO: 225064 - RNA, 64 nt, hsa
cauguaccgagaggacuaaaugucaucuacgugcaugugagagcguguuaaccuagaguuaccu

SEQ ID NO: 225065 - RNA, 64 nt, hsa
aacaugagacguggcaugugagaugagacuuggcaugugagacauagggucacuagagacccuu

SEQ ID NO: 225066 - RNA, 64 nt, hsa
uacagggcaucugacaccuaacaugagacguggcaugugagaugagacuuggcaugugagacau

SEQ ID NO: 225067 - RNA, 64 nt, hsa
acuuuuuugcauauuagguuaauuuuuaccuuacaugugagagucuuaccacuaagccauucug

SEQ ID NO: 225068 - RNA, 64 nt, hsa
uucaguggcuuuuuuuuuucuuuucuggaaacauaugugagacacucagaguaaugucuacugu

SEQ ID NO: 225069 - RNA, 64 nt, hsa
uuuagcacuuggcagccucaugauccuuuuauaaaugugagauuaacaggagagcagcaauacg

SEQ ID NO: 225070 - RNA, 64 nt, hsa
gaaaguaauaacaaacauuauuauaaacuaauauaugugagaguacuuaguugaaacaaaaagg

SEQ ID NO: 225071 - RNA, 64 nt, hsa
cauuugccucauaaagcacagcaucagauaauuuaugugagagaaaaugguagugucauucaua

SEQ ID NO: 225072 - RNA, 64 nt, hsa
ugacuugguuggggggcacuguaugccauaaugaaugugagaaagcugucauuuaaaucucauc

SEQ ID NO: 225073 - RNA, 64 nt, hsa
uauuuuuuucauuggggauacauuuaguacauucaugugagaggaaggcccuguggguguaaga

SEQ ID NO: 225074 - RNA, 64 nt, hsa
cauuuauaaagucagaaccuaucucugaaaauuaaugugagaaagaaaucucuagauuugaugg

SEQ ID NO: 225075 - RNA, 64 nt, hsa
ugaacaccuuuguuggcuugguucaguaauaaauaugugagacuuuucauuuaaaaaaagucaa

SEQ ID NO: 225076 - RNA, 64 nt, hsa
gauugaauagaaggggugagagcauucuugcaucaugugagauccuacaggaaaagcauuccau

SEQ ID NO: 225077 - RNA, 64 nt, hsa
aauauguuuuauugaaauuagauucauuucucuaaugugagaaaaauauauccaguaauaguau

SEQ ID NO: 225078 - RNA, 64 nt, hsa
uucuuggggaugccuuuuaauauuugauccuauuaugugagagauuuuccugauauguuaucuu

SEQ ID NO: 225079 - RNA, 64 nt, hsa; identical to SEQ ID NO: 89905

SEQ ID NO: 225080 - RNA, 64 nt, hsa; identical to SEQ ID NO: 89906

SEQ ID NO: 225081 - RNA, 64 nt, hsa; identical to SEQ ID NO: 89907

SEQ ID NO: 225082 - RNA, 64 nt, hsa; identical to SEQ ID NO: 89908

SEQ ID NO: 225083 - RNA, 64 nt, hsa; identical to SEQ ID NO: 89909

SEQ ID NO: 225084 - RNA, 64 nt, hsa; identical to SEQ ID NO: 89910

SEQ ID NO: 225085 - RNA, 64 nt, hsa; identical to SEQ ID NO: 89911

SEQ ID NO: 225086 - RNA, 64 nt, hsa; identical to SEQ ID NO: 89912

SEQ ID NO: 225087 - RNA, 64 nt, hsa; identical to SEQ ID NO: 89913

SEQ ID NO: 225088 - RNA, 64 nt, hsa; identical to SEQ ID NO: 89914

SEQ ID NO: 225089 - RNA, 64 nt, hsa; identical to SEQ ID NO: 89915

SEQ ID NO: 225090 - RNA, 64 nt, hsa; identical to SEQ ID NO: 89916

SEQ ID NO: 225091 - RNA, 64 nt, hsa; identical to SEQ ID NO: 89917

SEQ ID NO: 225092 - RNA, 64 nt, hsa; identical to SEQ ID NO: 89918

SEQ ID NO: 225093 - RNA, 64 nt, hsa; identical to SEQ ID NO: 89919

SEQ ID NO: 225094 - RNA, 64 nt, hsa; identical to SEQ ID NO: 89920

SEQ ID NO: 225095 - RNA, 64 nt, hsa; identical to SEQ ID NO: 89921

SEQ ID NO: 225096 - RNA, 64 nt, hsa; identical to SEQ ID NO: 89922

SEQ ID NO: 225097 - RNA, 64 nt, hsa; identical to SEQ ID NO: 89923

SEQ ID NO: 225098 - RNA, 64 nt, hsa; identical to SEQ ID NO: 89924

SEQ ID NO: 225099 - RNA, 64 nt, hsa; identical to SEQ ID NO: 89925

SEQ ID NO: 225100 - RNA, 64 nt, hsa; identical to SEQ ID NO: 89926

SEQ ID NO: 225101 - RNA, 64 nt, hsa; identical to SEQ ID NO: 89927

SEQ ID NO: 225102 - RNA, 64 nt, hsa; identical to SEQ ID NO: 89928

SEQ ID NO: 225103 - RNA, 50 nt, hsa; identical to SEQ ID NO: 89929

SEQ ID NO: 225104 - RNA, 64 nt, hsa; identical to SEQ ID NO: 89930

SEQ ID NO: 225105 - RNA, 64 nt, hsa; identical to SEQ ID NO: 89931

SEQ ID NO: 225106 - RNA, 64 nt, hsa; identical to SEQ ID NO: 89932

SEQ ID NO: 225107 - RNA, 64 nt, hsa; identical to SEQ ID NO: 89933

SEQ ID NO: 225108 - RNA, 64 nt, hsa; identical to SEQ ID NO: 89934

SEQ ID NO: 225109 - RNA, 64 nt, hsa; identical to SEQ ID NO: 89935

SEQ ID NO: 225110 - RNA, 64 nt, hsa; identical to SEQ ID NO: 89936

SEQ ID NO: 225111 - RNA, 64 nt, hsa; identical to SEQ ID NO: 89937

SEQ ID NO: 225112 - RNA, 64 nt, hsa; identical to SEQ ID NO: 89938

SEQ ID NO: 225113 - RNA, 64 nt, hsa; identical to SEQ ID NO: 89939

SEQ ID NO: 225114 - RNA, 64 nt, hsa; identical to SEQ ID NO: 89940

SEQ ID NO: 225115 - RNA, 64 nt, hsa; identical to SEQ ID NO: 89941

SEQ ID NO: 225116 - RNA, 55 nt, hsa; identical to SEQ ID NO: 89942

SEQ ID NO: 225117 - RNA, 64 nt, hsa; identical to SEQ ID NO: 89943

SEQ ID NO: 225118 - RNA, 64 nt, hsa; identical to SEQ ID NO: 89944

SEQ ID NO: 225119 - RNA, 64 nt, hsa; identical to SEQ ID NO: 89945

SEQ ID NO: 225120 - RNA, 64 nt, hsa; identical to SEQ ID NO: 89946

SEQ ID NO: 225121 - RNA, 64 nt, hsa; identical to SEQ ID NO: 89947

SEQ ID NO: 225122 - RNA, 64 nt, hsa; identical to SEQ ID NO: 89948

SEQ ID NO: 225123 - RNA, 64 nt, hsa; identical to SEQ ID NO: 89949

SEQ ID NO: 225124 - RNA, 64 nt, hsa; identical to SEQ ID NO: 89950

SEQ ID NO: 225125 - RNA, 64 nt, hsa; identical to SEQ ID NO: 89951

SEQ ID NO: 225126 - RNA, 64 nt, hsa; identical to SEQ ID NO: 89952

SEQ ID NO: 225127 - RNA, 64 nt, hsa; identical to SEQ ID NO: 89953

SEQ ID NO: 225128 - RNA, 64 nt, hsa; identical to SEQ ID NO: 89954

SEQ ID NO: 225129 - RNA, 64 nt, hsa; identical to SEQ ID NO: 89955

SEQ ID NO: 225130 - RNA, 64 nt, hsa; identical to SEQ ID NO: 89956

SEQ ID NO: 225131 - RNA, 64 nt, hsa; identical to SEQ ID NO: 89957

SEQ ID NO: 225132 - RNA, 64 nt, hsa; identical to SEQ ID NO: 89958

SEQ ID NO: 225133 - RNA, 64 nt, hsa; identical to SEQ ID NO: 89959

SEQ ID NO: 225134 - RNA, 64 nt, hsa; identical to SEQ ID NO: 89960

SEQ ID NO: 225135 - RNA, 64 nt, hsa; identical to SEQ ID NO: 89961

SEQ ID NO: 225136 - RNA, 64 nt, hsa; identical to SEQ ID NO: 89962

SEQ ID NO: 225137 - RNA, 64 nt, hsa; identical to SEQ ID NO: 89963

SEQ ID NO: 225138 - RNA, 64 nt, hsa; identical to SEQ ID NO: 89964

SEQ ID NO: 225139 - RNA, 64 nt, hsa; identical to SEQ ID NO: 89965

SEQ ID NO: 225140 - RNA, 64 nt, hsa; identical to SEQ ID NO: 89966

SEQ ID NO: 225141 - RNA, 64 nt, hsa; identical to SEQ ID NO: 89967

SEQ ID NO: 225142 - RNA, 64 nt, hsa; identical to SEQ ID NO: 89968

SEQ ID NO: 225143 - RNA, 64 nt, hsa; identical to SEQ ID NO: 89969

SEQ ID NO: 225144 - RNA, 64 nt, hsa; identical to SEQ ID NO: 89970

SEQ ID NO: 225145 - RNA, 64 nt, hsa; identical to SEQ ID NO: 89971

SEQ ID NO: 225146 - RNA, 64 nt, hsa; identical to SEQ ID NO: 89972

SEQ ID NO: 225147 - RNA, 64 nt, hsa; identical to SEQ ID NO: 89973

SEQ ID NO: 225148 - RNA, 64 nt, hsa; identical to SEQ ID NO: 89974

SEQ ID NO: 225149 - RNA, 64 nt, hsa; identical to SEQ ID NO: 89975

SEQ ID NO: 225150 - RNA, 64 nt, hsa; identical to SEQ ID NO: 89976

SEQ ID NO: 225151 - RNA, 64 nt, hsa; identical to SEQ ID NO: 89977

SEQ ID NO: 225152 - RNA, 64 nt, hsa; identical to SEQ ID NO: 89978

SEQ ID NO: 225153 - RNA, 64 nt, hsa; identical to SEQ ID NO: 89979

SEQ ID NO: 225154 - RNA, 64 nt, hsa; identical to SEQ ID NO: 89980

SEQ ID NO: 225155 - RNA, 64 nt, hsa; identical to SEQ ID NO: 89981

SEQ ID NO: 225156 - RNA, 64 nt, hsa; identical to SEQ ID NO: 89982

SEQ ID NO: 225157 - RNA, 64 nt, hsa; identical to SEQ ID NO: 89983

SEQ ID NO: 225158 - RNA, 64 nt, hsa; identical to SEQ ID NO: 89984

SEQ ID NO: 225159 - RNA, 64 nt, hsa; identical to SEQ ID NO: 89985

SEQ ID NO: 225160 - RNA, 64 nt, hsa; identical to SEQ ID NO: 89986

SEQ ID NO: 225161 - RNA, 64 nt, hsa; identical to SEQ ID NO: 89987

SEQ ID NO: 225162 - RNA, 64 nt, hsa; identical to SEQ ID NO: 89988

SEQ ID NO: 225163 - RNA, 59 nt, hsa; identical to SEQ ID NO: 89989

SEQ ID NO: 225164 - RNA, 64 nt, hsa; identical to SEQ ID NO: 89990

SEQ ID NO: 225165 - RNA, 64 nt, hsa; identical to SEQ ID NO: 89991

SEQ ID NO: 225166 - RNA, 64 nt, hsa; identical to SEQ ID NO: 89992

SEQ ID NO: 225167 - RNA, 64 nt, hsa; identical to SEQ ID NO: 89993

SEQ ID NO: 225168 - RNA, 64 nt, hsa; identical to SEQ ID NO: 89994

SEQ ID NO: 225169 - RNA, 64 nt, hsa; identical to SEQ ID NO: 89995

SEQ ID NO: 225170 - RNA, 64 nt, hsa; identical to SEQ ID NO: 89996

SEQ ID NO: 225171 - RNA, 64 nt, hsa; identical to SEQ ID NO: 89997

SEQ ID NO: 225172 - RNA, 64 nt, hsa; identical to SEQ ID NO: 89998

SEQ ID NO: 225173 - RNA, 64 nt, hsa; identical to SEQ ID NO: 89999

SEQ ID NO: 225174 - RNA, 64 nt, hsa; identical to SEQ ID NO: 90000

SEQ ID NO: 225175 - RNA, 64 nt, hsa; identical to SEQ ID NO: 90001

SEQ ID NO: 225176 - RNA, 64 nt, hsa; identical to SEQ ID NO: 90002

SEQ ID NO: 225177 - RNA, 64 nt, hsa; identical to SEQ ID NO: 90003

SEQ ID NO: 225178 - RNA, 64 nt, hsa; identical to SEQ ID NO: 90004

SEQ ID NO: 225179 - RNA, 64 nt, hsa; identical to SEQ ID NO: 90005

SEQ ID NO: 225180 - RNA, 64 nt, hsa; identical to SEQ ID NO: 90006

SEQ ID NO: 225181 - RNA, 64 nt, hsa; identical to SEQ ID NO: 90007

SEQ ID NO: 225182 - RNA, 64 nt, hsa; identical to SEQ ID NO: 90008

SEQ ID NO: 225183 - RNA, 64 nt, hsa; identical to SEQ ID NO: 90009

SEQ ID NO: 225184 - RNA, 64 nt, hsa; identical to SEQ ID NO: 90010

SEQ ID NO: 225185 - RNA, 64 nt, hsa; identical to SEQ ID NO: 90011

SEQ ID NO: 225186 - RNA, 64 nt, hsa; identical to SEQ ID NO: 90012

SEQ ID NO: 225187 - RNA, 64 nt, hsa; identical to SEQ ID NO: 90013

SEQ ID NO: 225188 - RNA, 64 nt, hsa; identical to SEQ ID NO: 90014

SEQ ID NO: 225189 - RNA, 64 nt, hsa; identical to SEQ ID NO: 90015

SEQ ID NO: 225190 - RNA, 64 nt, hsa; identical to SEQ ID NO: 90016

SEQ ID NO: 225191 - RNA, 64 nt, hsa; identical to SEQ ID NO: 90017

SEQ ID NO: 225192 - RNA, 64 nt, hsa; identical to SEQ ID NO: 90018

SEQ ID NO: 225193 - RNA, 64 nt, hsa; identical to SEQ ID NO: 90019

SEQ ID NO: 225194 - RNA, 64 nt, hsa; identical to SEQ ID NO: 90020

SEQ ID NO: 225195 - RNA, 64 nt, hsa; identical to SEQ ID NO: 90021

SEQ ID NO: 225196 - RNA, 64 nt, hsa; identical to SEQ ID NO: 90022

SEQ ID NO: 225197 - RNA, 64 nt, hsa; identical to SEQ ID NO: 90023

SEQ ID NO: 225198 - RNA, 64 nt, hsa; identical to SEQ ID NO: 90024

SEQ ID NO: 225199 - RNA, 64 nt, hsa; identical to SEQ ID NO: 90025

SEQ ID NO: 225200 - RNA, 64 nt, hsa; identical to SEQ ID NO: 90026

SEQ ID NO: 225201 - RNA, 64 nt, hsa; identical to SEQ ID NO: 90027

SEQ ID NO: 225202 - RNA, 64 nt, hsa; identical to SEQ ID NO: 90028

SEQ ID NO: 225203 - RNA, 64 nt, hsa; identical to SEQ ID NO: 90029

SEQ ID NO: 225204 - RNA, 64 nt, hsa; identical to SEQ ID NO: 90030

SEQ ID NO: 225205 - RNA, 64 nt, hsa; identical to SEQ ID NO: 90031

SEQ ID NO: 225206 - RNA, 64 nt, hsa; identical to SEQ ID NO: 90032

SEQ ID NO: 225207 - RNA, 64 nt, hsa; identical to SEQ ID NO: 90033

SEQ ID NO: 225208 - RNA, 64 nt, hsa; identical to SEQ ID NO: 90034

SEQ ID NO: 225209 - RNA, 64 nt, hsa; identical to SEQ ID NO: 90035

SEQ ID NO: 225210 - RNA, 64 nt, hsa; identical to SEQ ID NO: 90036

SEQ ID NO: 225211 - RNA, 64 nt, hsa; identical to SEQ ID NO: 90037

SEQ ID NO: 225212 - RNA, 64 nt, hsa; identical to SEQ ID NO: 90038

SEQ ID NO: 225213 - RNA, 64 nt, hsa; identical to SEQ ID NO: 90039

SEQ ID NO: 225214 - RNA, 64 nt, hsa; identical to SEQ ID NO: 90040

SEQ ID NO: 225215 - RNA, 64 nt, hsa; identical to SEQ ID NO: 90041

SEQ ID NO: 225216 - RNA, 64 nt, hsa; identical to SEQ ID NO: 90042

SEQ ID NO: 225217 - RNA, 64 nt, hsa; identical to SEQ ID NO: 90043

SEQ ID NO: 225218 - RNA, 64 nt, hsa; identical to SEQ ID NO: 90044

SEQ ID NO: 225219 - RNA, 64 nt, hsa; identical to SEQ ID NO: 90045

SEQ ID NO: 225220 - RNA, 64 nt, hsa; identical to SEQ ID NO: 90046

SEQ ID NO: 225221 - RNA, 64 nt, hsa; identical to SEQ ID NO: 90047

SEQ ID NO: 225222 - RNA, 64 nt, hsa; identical to SEQ ID NO: 90048

SEQ ID NO: 225223 - RNA, 64 nt, hsa; identical to SEQ ID NO: 90049

SEQ ID NO: 225224 - RNA, 64 nt, hsa; identical to SEQ ID NO: 90050

SEQ ID NO: 225225 - RNA, 64 nt, hsa; identical to SEQ ID NO: 90051

SEQ ID NO: 225226 - RNA, 64 nt, hsa; identical to SEQ ID NO: 90052

SEQ ID NO: 225227 - RNA, 64 nt, hsa; identical to SEQ ID NO: 90053

SEQ ID NO: 225228 - RNA, 64 nt, hsa; identical to SEQ ID NO: 90054

SEQ ID NO: 225229 - RNA, 64 nt, hsa; identical to SEQ ID NO: 90055

SEQ ID NO: 225230 - RNA, 64 nt, hsa; identical to SEQ ID NO: 90056

SEQ ID NO: 225231 - RNA, 64 nt, hsa; identical to SEQ ID NO: 90057

SEQ ID NO: 225232 - RNA, 64 nt, hsa; identical to SEQ ID NO: 90058

SEQ ID NO: 225233 - RNA, 64 nt, hsa; identical to SEQ ID NO: 90059

SEQ ID NO: 225234 - RNA, 64 nt, hsa; identical to SEQ ID NO: 90060

SEQ ID NO: 225235 - RNA, 64 nt, hsa; identical to SEQ ID NO: 90061

SEQ ID NO: 225236 - RNA, 64 nt, hsa; identical to SEQ ID NO: 90062

SEQ ID NO: 225237 - RNA, 64 nt, hsa; identical to SEQ ID NO: 90063

SEQ ID NO: 225238 - RNA, 64 nt, hsa; identical to SEQ ID NO: 90064

SEQ ID NO: 225239 - RNA, 64 nt, hsa; identical to SEQ ID NO: 90065

SEQ ID NO: 225240 - RNA, 64 nt, hsa; identical to SEQ ID NO: 90066

SEQ ID NO: 225241 - RNA, 64 nt, hsa; identical to SEQ ID NO: 90067

SEQ ID NO: 225242 - RNA, 64 nt, hsa; identical to SEQ ID NO: 90068

SEQ ID NO: 225243 - RNA, 64 nt, hsa; identical to SEQ ID NO: 90069

SEQ ID NO: 225244 - RNA, 64 nt, hsa; identical to SEQ ID NO: 90070

SEQ ID NO: 225245 - RNA, 64 nt, hsa; identical to SEQ ID NO: 90071

SEQ ID NO: 225246 - RNA, 64 nt, hsa; identical to SEQ ID NO: 90072

SEQ ID NO: 225247 - RNA, 64 nt, hsa; identical to SEQ ID NO: 90073

SEQ ID NO: 225248 - RNA, 64 nt, hsa; identical to SEQ ID NO: 90074

SEQ ID NO: 225249 - RNA, 64 nt, hsa; identical to SEQ ID NO: 90075

SEQ ID NO: 225250 - RNA, 64 nt, hsa; identical to SEQ ID NO: 90076

SEQ ID NO: 225251 - RNA, 64 nt, hsa; identical to SEQ ID NO: 90077

SEQ ID NO: 225252 - RNA, 64 nt, hsa; identical to SEQ ID NO: 90078

SEQ ID NO: 225253 - RNA, 64 nt, hsa; identical to SEQ ID NO: 90079

SEQ ID NO: 225254 - RNA, 64 nt, hsa; identical to SEQ ID NO: 90080

SEQ ID NO: 225255 - RNA, 64 nt, hsa; identical to SEQ ID NO: 90081

SEQ ID NO: 225256 - RNA, 64 nt, hsa; identical to SEQ ID NO: 90082

SEQ ID NO: 225257 - RNA, 64 nt, hsa; identical to SEQ ID NO: 90083

SEQ ID NO: 225258 - RNA, 64 nt, hsa; identical to SEQ ID NO: 90084

SEQ ID NO: 225259 - RNA, 62 nt, hsa
caucuuagugccugagaguauuuaggcagauugaaaaggacaccuuuuaacucaccucucaa

SEQ ID NO: 225260 - RNA, 62 nt, hsa
uacaugguugugaccugaggauuuaagggauggaaaaggaagacuagaggcuugcauaauaa

SEQ ID NO: 225261 - RNA, 62 nt, hsa
cagagagaacccagguuagaaggaugggaagagaaaaggagcaguuuuauugcuuauagaaa

SEQ ID NO: 225262 - RNA, 62 nt, hsa
cacugaaacauguggucuggucugacuugagagaaaaggaauguugcacaaggguugugaau

SEQ ID NO: 225263 - RNA, 62 nt, hsa
aaauagauguguguuuaauggaauugaagucugaaaaggaaguaguuauuuuagcagaaaau

SEQ ID NO: 225264 - RNA, 62 nt, hsa
uugaauuauuuuucuccaaauugagacucucagaaaaggaagauugaauuagcguguuuuuu

SEQ ID NO: 225265 - RNA, 62 nt, hsa
agaacucuuguuucuuggggaaggagaggagggaaaaggaccagggucaagggggaccagag

SEQ ID NO: 225266 - RNA, 62 nt, hsa
ugacugauuaauuauuccugauaacaucucaagaaaaggagaaggaaaguguuucuggagaa

SEQ ID NO: 225267 - RNA, 62 nt, hsa
aagaaagaucagauuguuacugugucuguguagaaaaggaagacauaagaaacuccauuuug

SEQ ID NO: 225268 - RNA, 62 nt, hsa
caucccuccguggugugugucuuggugcauuggaaaaggagucaggagccacugugagguga

SEQ ID NO: 225269 - RNA, 62 nt, hsa
acaauggugauuuuauuuauuuuuacucucuggaaaaggagauaauacaauuccagaaagug

SEQ ID NO: 225270 - RNA, 62 nt, hsa
ccuugcauggaaaacuguuuauuuuuuucagugaaaaggaauucugcuuucguguuuuuggg

SEQ ID NO: 225271 - RNA, 62 nt, hsa
cuuaucacacugauguguucaacuguuuaugggaaaaggaaacuaggaugguuuuauuugug

SEQ ID NO: 225272 - RNA, 62 nt, hsa
cuacaacgcuagaacuguugaacuucuugggagaaaaggagaaucuuuguuuuguugugcug

SEQ ID NO: 225273 - RNA, 62 nt, hsa
agcgcagagcagagugcugaguaaagaugucagaaaaggaaagcaauggucugguacaaguc

SEQ ID NO: 225274 - RNA, 62 nt, hsa
cuauuacauaagaaacaauggacccaagagaagaaaaggaagaaagaaagguuuuuugguuu

SEQ ID NO: 225275 - RNA, 62 nt, hsa
aauuuuaggcucaaaaauuaaagcuaacacaggaaaaggaacuguacuggcuauuacauaag

SEQ ID NO: 225276 - RNA, 62 nt, hsa
uuccauuacuccauuuacaggagcguuccuaggaaaaggaauuuuaggaggagaauuuguga

SEQ ID NO: 225277 - RNA, 62 nt, hsa
gcuuaaucuucagcuucuaugcaccaagcguggaaaaggagaaaguccugcagaaucaaucc

SEQ ID NO: 225278 - RNA, 62 nt, hsa
cagagaaaaaucacagcuuccuugucggaggggaaaaggacaggugaucuggggaaaacgca

SEQ ID NO: 225279 - RNA, 62 nt, hsa
auuuucuucagccugugcaaaacaaagcaauggaaaaggaaacuaaaaaauauacauacuag

SEQ ID NO: 225280 - RNA, 62 nt, hsa
uuccugcugacuacaacccucuccuguuuacugaaaaggagucaggaaaacuacagguguug

SEQ ID NO: 225281 - RNA, 62 nt, hsa
aucaccccugccuuuuguucaacucuauaaaggaaaaggaauguagcucaacuugugauaaa

SEQ ID NO: 225282 - RNA, 62 nt, hsa
uuuuaucgagagaaccuucugcuucugaggaagaaaaggaguuaggagaaagaagagcagcu

SEQ ID NO: 225283 - RNA, 62 nt, hsa
agguuugaggggcuggggagugggaggggggagaaaaggaauguauuuaaacaauuuccgau

SEQ ID NO: 225284 - RNA, 62 nt, hsa
acaagaaauuuaaagaaucaaaacgaugguuugaaaaggaaaccuaugauacaugcaggaga

SEQ ID NO: 225285 - RNA, 62 nt, hsa
auccugcugcuggguauauacccgaaagaaaggaaaaggaagccaguauauugaagagguau

SEQ ID NO: 225286 - RNA, 62 nt, hsa
augagauucugucauuugcaauaauauagauggaaaaggaggcccuuaugugaagugaaaua

SEQ ID NO: 225287 - RNA, 62 nt, hsa
uagucuccuuuuucaacaaaggaguguguucagaaaaggagagagaggcugagaucauucag

SEQ ID NO: 225288 - RNA, 62 nt, hsa
gagccuguccguucagagccucuggcugcauagaaaaggauucuggugcuuccccuguuugc

SEQ ID NO: 225289 - RNA, 62 nt, hsa
agugugacggagcaggcgggcugaggagaguggaaaaggaagcgacccagaaauggcaggga

SEQ ID NO: 225290 - RNA, 62 nt, hsa
aaaaaaaaaaaugcuuuuaaaaaagauaaaaugaaaaggagagcucucuuuuucucucucuu

SEQ ID NO: 225291 - RNA, 62 nt, hsa
ugaggggacauuuucuggauucugggaggcaagaaaaggacaaauaucuuuuuuggaacuaa

SEQ ID NO: 225292 - RNA, 62 nt, hsa
aguccucuagcaggccuaagacaugugaggaggaaaaggaaaaaaagcaaaaagcaagggag

SEQ ID NO: 225293 - RNA, 61 nt, hsa; identical to SEQ ID NO: 123342

SEQ ID NO: 225294 - RNA, 62 nt, hsa
cuaagucaagugcaaggacuuaacuugcguuugaaaaggaauuagagggucagaaacaccca

SEQ ID NO: 225295 - RNA, 62 nt, hsa
ugaggaaucaaggggccauuaccaaggggcaggaaaaggauauguaagagguggccuucaug

SEQ ID NO: 225296 - RNA, 62 nt, hsa
cuccaguauuuccuuuggauacucaggaaugggaaaaggacagcacaggaugcccuccaagg

SEQ ID NO: 225297 - RNA, 62 nt, hsa
uuuuggcuuacucuuuggaugagaccagacaagaaaaggauuaaacggguggcuccuuuaau

SEQ ID NO: 225298 - RNA, 62 nt, hsa
cuuagacaaaaaaagcagaacccacuggaguagaaaaggaagcauguagcauauacucagua

SEQ ID NO: 225299 - RNA, 62 nt, hsa
auuucuucuucucacgucugugacaaaugguugaaaaggagucaacauggccccaacuauag

SEQ ID NO: 225300 - RNA, 62 nt, hsa
gggaacuccagacugacacagcaguuguuuuugaaaaggaaauaaacuuugaugaauuagau

SEQ ID NO: 225301 - RNA, 62 nt, hsa
aacucuggagugagaggaugccagaggaucaagaaaaggaucacaguuucuugaagaagcuu

SEQ ID NO: 225302 - RNA, 62 nt, hsa
ugagagaaaaaccaaucaauguuuacaaaauggaaaaggacacagcauguccuuugaacucc

SEQ ID NO: 225303 - RNA, 62 nt, hsa
acgacagccccaaucuucccgucuuuaugagagaaaaggaaaaaggaaucaaagguggaaga

SEQ ID NO: 225304 - RNA, 62 nt, hsa
guguggaagggggucuaggagagggagagcuggaaaaggagcugauggggucuuauccuggc

SEQ ID NO: 225305 - RNA, 62 nt, hsa
aggcggcagagcugugcgcccacccagcuauugaaaaggacuuucugugggcacacacucug

SEQ ID NO: 225306 - RNA, 62 nt, hsa
uuucccauaagacaaugacauacgcuuuuaaugaaaaggaaucacguuagaggaaaaauauu

SEQ ID NO: 225307 - RNA, 62 nt, hsa
ggaacuugucucuucaucuaauaugauagcgggaaaaggagaggaaacuacugccuuuagaa

SEQ ID NO: 225308 - RNA, 62 nt, hsa
ucugugcguugggucaguuucuguuacguaacgaaaaggauaaacaucucccacgggagagg

SEQ ID NO: 225309 - RNA, 62 nt, hsa
uuuaagugcuguauuaauaauacuuucugaaagaaaaggacacuuaccccaaaacuucaauc

SEQ ID NO: 225310 - RNA, 62 nt, hsa
aauuaaaaacccaaagaaccagcucauguuuggaaaaggaaucuuccacugaaacauuugga

SEQ ID NO: 225311 - RNA, 62 nt, hsa
gcuuuuccucaggaaauucggcaagacuuggagaaaaggaaagcuccaucaaagaggacccc

SEQ ID NO: 225312 - RNA, 62 nt, hsa
uuauuaugagugggggacuggugacuuuauaugaaaaggaaggaagagugaccuaagcuagc

SEQ ID NO: 225313 - RNA, 62 nt, hsa
uaacugugcuugucucagucaaacuuaauugggaaaaggaggaguaagagcaggcccuuucu

SEQ ID NO: 225314 - RNA, 62 nt, hsa
uccaucucaaaaaaaaaaaaaaaaguaagaaagaaaaggacucccuuagaaugggaaagaaa

SEQ ID NO: 225315 - RNA, 62 nt, hsa
auuuguaccuaagagaaaaauaggcucaguuagaaaaggacucccuggccaggcgcagugac

SEQ ID NO: 225316 - RNA, 62 nt, hsa
gacuuuagacaaaagcaagaggaucagaugaagaaaaggagagguagauacagucaguguca

SEQ ID NO: 225317 - RNA, 62 nt, hsa
aaagaacauaagaacucaaggagaacauaagagaaaaggaaaccuguuacagaaaagacaag

SEQ ID NO: 225318 - RNA, 62 nt, hsa
auauggauuuagaaaaaggaacaccugaugaagaaaaggagagguagauacagucaguguca

SEQ ID NO: 225319 - RNA, 62 nt, hsa
caaagucaacugaaucuuuuauucauagaaaugaaaaggaaaauaaaaacuguggcugacca

SEQ ID NO: 225320 - RNA, 62 nt, hsa
aaaauacuguuucuucuauccaacucucuuaugaaaaggaacucuguauuuucuauuagcca

SEQ ID NO: 225321 - RNA, 64 nt, hsa
caauuuccacaugaaaaagguggagcuuucuagaaaaaccaaccucuaaggcauuaggaauuua

SEQ ID NO: 225322 - RNA, 64 nt, hsa
cacuucuuccuuuguuaggcugugcuuuacugauaaaaccaaguauugaauaaagagaguuaau

SEQ ID NO: 225323 - RNA, 64 nt, hsa
agagugggagcugagugggggaucacagccucugaaaaccaauguucucucuucuccaccuccc

SEQ ID NO: 225324 - RNA, 64 nt, hsa
ggugugggggaagcaccauaacuuuguuuagcccaaaaccaagucaagugaaaaaggaggaaga

SEQ ID NO: 225325 - RNA, 64 nt, hsa
aaggagcugguagccuaccuacacagcugcuacaaaaaccaaaauacagaauggcuucugugau

SEQ ID NO: 225326 - RNA, 64 nt, hsa
uuggcaugacaucugagcacagaaauuaaggcaaaaaaccaaagcaaaacaaauacauggugcu

SEQ ID NO: 225327 - RNA, 64 nt, hsa
gucagauugauuugaaaggugugcagccugauuuaaaaccaaacccugaacccuuuuaaagaac

SEQ ID NO: 225328 - RNA, 64 nt, hsa
uuuuuugagauuaaaaaaaaaaaaucccugguuuaaaaccaacaaugaugccuagugaguaugu

SEQ ID NO: 225329 - RNA, 64 nt, hsa
uaugucaacuuaaaaaaaaauaggcccuuucauaaaaaccaaacuguagcaagaugcaaaugca

SEQ ID NO: 225330 - RNA, 64 nt, hsa
guuaaggcaacauuccuuucuugugcccugggccaaaaccaaugcugaugaccuuaucagcuuc

SEQ ID NO: 225331 - RNA, 64 nt, hsa
aaaacguacuguaccguacagagaaaaggagcaaaaaaccaagucuucuguuuauccugaggcu

SEQ ID NO: 225332 - RNA, 64 nt, hsa
uuacacuucccuguggauuuguggauuaauuaggaaaaccaauaguaaucacgucugagccaag

SEQ ID NO: 225333 - RNA, 64 nt, hsa
ccauucuaauuaaugcccuuucuuauuuaaaaacaaaaccaaaugauaucuaaguaguucucag

SEQ ID NO: 225334 - RNA, 64 nt, hsa
gggucuaccuuuaaaauaagcaauaacaaagaagaaaaccaaauuauuguucaaauuuagguuu

SEQ ID NO: 225335 - RNA, 64 nt, hsa
agcaauuaaggucacagaaaucauuagguaaaggaaaaccaaugaggaguucugcaguuuucuu

SEQ ID NO: 225336 - RNA, 64 nt, hsa
aauauuuugugacuuuaauugguaaauauguuacaaaaccaaguacuuaaucuuuuacaucaug

SEQ ID NO: 225337 - RNA, 64 nt, hsa
guaagaagaaaauggagacaaacagaaggagggaaaaaccaaccuacucugaaagccuucagac

SEQ ID NO: 225338 - RNA, 64 nt, hsa
aauaccaugaucgaugaugucccaugcuucgaggaaaaccaaacacuuuccgccucucuugcaa

SEQ ID NO: 225339 - RNA, 64 nt, hsa
aacgagcaacaaucggaaaccaaauacuggagagaaaaccaacguuuccacccacagacccuuu

SEQ ID NO: 225340 - RNA, 64 nt, hsa
cuaaagugguagaugaugaaauuuacuacuucagaaaaccaauuguuccucagaaggagccauc

SEQ ID NO: 225341 - RNA, 64 nt, hsa
ggauguuuuugucugugaaucacgguauucugccaaaaccaaaucuuuuaagaaaauuaaacug

SEQ ID NO: 225342 - RNA, 64 nt, hsa
aaacagcuccaguguuuuuaagagaauguuucuuaaaaccaauaggaaacuuaagcgagguuuc

SEQ ID NO: 225343 - RNA, 64 nt, hsa
agaaaacuaagauuauaaauuagcaucuaguuccaaaaccaaaaaaagugccuguggauguaua

SEQ ID NO: 225344 - RNA, 64 nt, hsa
aauaguggcccugaaggaauaaauuccagcuuuaaaaaccaagucugaggaaauauuuggcuuc

SEQ ID NO: 225345 - RNA, 64 nt, hsa
uccuguauuuuaugcccauaaaauaagcuuuauaaaaaccaauuuccugauggacuauuaaauu

SEQ ID NO: 225346 - RNA, 64 nt, hsa
cucagauuuccacagagacuguuugaauguuuucaaaaccaaguaucacacuuuaauguacaug

SEQ ID NO: 225347 - RNA, 64 nt, hsa
uauugugacagagccaugguguguuuguaauaauaaaaccaaagaaacauacguccugugugca

SEQ ID NO: 225348 - RNA, 64 nt, hsa
uguuacaguacacuuguagccaaaacuggaagacaaaaccaauauauaauuuggcugcugauug

SEQ ID NO: 225349 - RNA, 64 nt, hsa
uugcgcuaccuaacaguaccaucuuggauccuucaaaaccaaagacuugccccagcacugcugu

SEQ ID NO: 225350 - RNA, 64 nt, hsa
uaaagccauuauuuuuauaucaauagcacaaaggaaaaccaaaaguccuuaaccacugaccauu

SEQ ID NO: 225351 - RNA, 64 nt, hsa
uuuuucccacugccuuuuuauuauugacauaucuaaaaccaaacugaaaucgcuuuggaaauca

SEQ ID NO: 225352 - RNA, 64 nt, hsa
aguaugucauaaaauauaacauuacagcuuauuuaaaaccaaauauaguugaacauauuuaaaa

SEQ ID NO: 225353 - RNA, 64 nt, hsa
cuuuuaccuuucuguccuugauaaaauaguaaagaaaaccaaacaaacccaggccugaugggaa

SEQ ID NO: 225354 - RNA, 64 nt, hsa
uauuuucaaacgaaacguaagagaagucaacaauaaaaccaagaaaagugaguauuuuuauacc

SEQ ID NO: 225355 - RNA, 64 nt, hsa
aaagaugucaagaagcuuuuaaaggucaacacaaaaaaccaaggccaggagugaggggcucuuu

SEQ ID NO: 225356 - RNA, 64 nt, hsa
acuuuuucaguuaguccuaacuuuuaaaagaaggaaaaccaagagacauaucugguguacgugu

SEQ ID NO: 225357 - RNA, 64 nt, hsa
acaccgcacaagucaaacgcuaggaaguuugaauaaaaccaauuuuucuaacuuguugcucauu

SEQ ID NO: 225358 - RNA, 64 nt, hsa
caucacaagcauaggaagauacuucaaaaccaaaaaaaccaaggugcaucauuaauauucauuu

SEQ ID NO: 225359 - RNA, 64 nt, hsa
ucauacagucaucacaagcauaggaagauacuucaaaaccaaaaaaaccaaggugcaucauuaa

SEQ ID NO: 225360 - RNA, 64 nt, hsa
guugcuguguugaguucucuuuaaaaacaaggacaaaaccaaccagcguucaaaggaaccuccc

SEQ ID NO: 225361 - RNA, 64 nt, hsa
uuuccaauguauguuuguuaaaaauaauaauaauaaaaccaaaagccuuuguggaaacccacuc

SEQ ID NO: 225362 - RNA, 64 nt, hsa
uuccuuuugcuggauaugcagaaaugauaggaaaaaaaccaauggugaaauuucaaguuucaaa

SEQ ID NO: 225363 - RNA, 64 nt, hsa
aggaaaaaaaccaauggugaaauuucaaguuucaaaaaccaaccuuucauuaccaaucccaggc

SEQ ID NO: 225364 - RNA, 64 nt, hsa
auaguguguuuauuguaacuccucauacacuuuuaaaaccaacaucuuuuuucauaaauguugg

SEQ ID NO: 225365 - RNA, 64 nt, hsa
gacaauuuacuuaacaaguaaccaguaguucaucaaaaccaacuuguacagacuaauaaaucuu

SEQ ID NO: 225366 - RNA, 64 nt, hsa
auacauuuuauggugguuucaguaggucauuuuaaaaaccaaugugcauuaguuuucaaguaua

SEQ ID NO: 225367 - RNA, 64 nt, hsa
ccuggcaccuccaaaucucauguccucacauuucaaaaccaaucaugccuucccaacagucccc

SEQ ID NO: 225368 - RNA, 64 nt, hsa
gccaaucuguuagcaguccugacuugauuuaauaaaaaccaaggagagccaccccugcuuucug

SEQ ID NO: 225369 - RNA, 64 nt, hsa
aaaagaugcuuuucauaauuuucacuauaccucuaaaaccaauuguaccgacaucacguagaca

SEQ ID NO: 225370 - RNA, 64 nt, hsa
uagccaucugcuauaacucuuucaacagaaaaccaaaaccaaacgaaaugucuaaggaaaaugu

SEQ ID NO: 225371 - RNA, 64 nt, hsa
uugaaauagccaucugcuauaacucuuucaacagaaaaccaaaaccaaacgaaaugucuaagga

SEQ ID NO: 225372 - RNA, 64 nt, hsa
auuacucuuguuugucuaguaugcucuuggaaagaaaaccaagcaagcaaguugcugccuauuc

SEQ ID NO: 225373 - RNA, 64 nt, hsa
caucucaggagaaauauuggaaaauuauauguauaaaaccaaagugcuauuuuuaaaagcauca

SEQ ID NO: 225374 - RNA, 64 nt, hsa
ccucacuaucggaaauucauuuugauucagaauaaaaaccaaauguauagagcuuuggguguag

SEQ ID NO: 225375 - RNA, 64 nt, hsa
uggaacuuucuguaucucuuaggaggaacaaguaaaaaccaaaugguuacauugugcugcuaga

SEQ ID NO: 225376 - RNA, 64 nt, hsa
guggcuauaguuacugauuuuuuauuauguaagcaaaaccaauaaaaauuuaaguuuuuuuaac

SEQ ID NO: 225377 - RNA, 64 nt, hsa
aaguaagaaacaauuauaauuucuuuacauacucaaaaccaagauagaaaaaggugcuaucguu

SEQ ID NO: 225378 - RNA, 64 nt, hsa
uuguucacuucuaaaccaaaaauuauguguugccaaaaccaaacccagguucaugaauauggug

SEQ ID NO: 225379 - RNA, 64 nt, hsa
aaugcacugaugugugaagugagaacuccaucagaaaaccaaagggugcuaggaggugugggug

SEQ ID NO: 225380 - RNA, 64 nt, hsa
agugcugaaaacuguauauuuagcaguagcacccaaaaccaagccuuuaaccccaacaaugugu

SEQ ID NO: 225381 - RNA, 64 nt, hsa
uuuauucuuuguuaacaugagagucccaugucugaaaaccaaaguccaauuucugucuggccuu

SEQ ID NO: 225382 - RNA, 64 nt, hsa
ucauuggaaugauauaauuauacaaguaaugccaaaaaccaagucaaagccuaauuaaccaaag

SEQ ID NO: 225383 - RNA, 64 nt, hsa
aucugaugagaaugguuguuauaaacuuuauuuuaaaaccaaauuuagguguucuuacauauuu

SEQ ID NO: 225384 - RNA, 64 nt, hsa
ugugaauuuuaacaguucucugucaucguuuaacaaaaccaacaacugacacaacuccuuaagc

SEQ ID NO: 225385 - RNA, 64 nt, hsa
uucuggaagaauguaguaaucuucuagaccgcuuaaaaccaaugcucccaagcugaauauucuu

SEQ ID NO: 225386 - RNA, 64 nt, hsa
gugaugaacuugugauuuuguguuuuacuugaccaaaaccaaguguauauguuuacauguuuuu

SEQ ID NO: 225387 - RNA, 64 nt, hsa
aagauuauaaaagggaaaauagaacaaaaauauuaaaaccaaugagaauaaaagaauggaaaga

SEQ ID NO: 225388 - RNA, 64 nt, hsa
cuuucuacaguuuugcaccacggcaagaaaaccaaaaaccaaaacaaacaaacaaaaaaaaccc

SEQ ID NO: 225389 - RNA, 64 nt, hsa
uaagcaacuuucuacaguuuugcaccacggcaagaaaaccaaaaaccaaaacaaacaaacaaaa

SEQ ID NO: 225390 - RNA, 64 nt, hsa
uugaaaauaaucuauuuguagcuucucuucuaucaaaaccaacacauccucuucuuucugccaa

SEQ ID NO: 225391 - RNA, 64 nt, hsa
auuuuaaaaagaaaaacagaaaaagguuaaucacaaaaccaacccucacuucacagggucugua

SEQ ID NO: 225392 - RNA, 64 nt, hsa
uagaugguguuugcauguaaauugcagagaaaacaaaaccaaagcugauuggaaacaauuaauu

SEQ ID NO: 225393 - RNA, 64 nt, hsa
cccagcgcaaacuucaagagacagggcuuugcugaaaaccaaacaugggccagcugggcuuuuu

SEQ ID NO: 225394 - RNA, 64 nt, hsa
aguauuuccgucaagaaaaaggaaacaacaaaauaaaaccaacccaaguaaagaacagccaagu

SEQ ID NO: 225395 - RNA, 64 nt, hsa
uguuugaaauuucaauaauaaaauguuuaaaaucaaaaccaaaauuauagacuauguagaaaug

SEQ ID NO: 225396 - RNA, 64 nt, hsa
cccaaaggaaccagaggugaaaaacaaacaaaaaaaaaccaaaaacaaaccaaaaaaaaaaaaa

SEQ ID NO: 225397 - RNA, 64 nt, hsa
aaaaaaaaaggaaagaaacuaaccaacaaaagagaaaaccaaaaauaaucacaacagaaaccag

SEQ ID NO: 225398 - RNA, 64 nt, hsa
auugacaaugacccaaaucucuuccacaagacuuaaaaccaaauucagggacaaauggauagag

SEQ ID NO: 225399 - RNA, 64 nt, hsa
cugacuguagcuuugugaaauaucuuaaaacgcaaaaaccaauuguguccugaaaauuguuuca

SEQ ID NO: 225400 - RNA, 64 nt, hsa
acacgcggcccugacggugguauccaguuaacucaaaaccaacacacagagugcaggaaaagac

SEQ ID NO: 225401 - RNA, 64 nt, hsa
agucacagcgcccucaucuuuuuagcaagguaaaaaaaccaaaauggguguuaucucugauauc

SEQ ID NO: 225402 - RNA, 64 nt, hsa
aggauuuuuuucuuuuuuaguaaaaaccuguauaaaaaccaaaauuauaggauuuuuuuuucuu

SEQ ID NO: 225403 - RNA, 64 nt, hsa
uaggauuuuuucuuuuuuaguaaaaaccuauaugaaaaccaaaauuauaggauuuuuuucuuuu

SEQ ID NO: 225404 - RNA, 64 nt, hsa
aggauuuuuuucuuuuuuaguaaaaaccuauauaaaaaccaaaauuauaggauuuuuucuuuuu

SEQ ID NO: 225405 - RNA, 64 nt, hsa
uaggauuuuuucuuuuuuaguaaaaaccgguaucaaaaccaaaauuauaggauuuuuuucuuuu

SEQ ID NO: 225406 - RNA, 64 nt, hsa
guaauagagccacuggugaguaaaaaccuauauaaaaaccaaaauuauaggauuuuuucuuuuu

SEQ ID NO: 225407 - RNA, 64 nt, hsa
aacccuuucaagggaaauuuuaaucuaaaaggaaaaaaccaaaauauugaugagaaggaguccu

SEQ ID NO: 225408 - RNA, 64 nt, hsa
agaaggcuugucucaccuccaccggcauccacacaaaaccaaacaggagcaggcgucaucccca

SEQ ID NO: 225409 - RNA, 64 nt, hsa
acuuaauuuaaguuugcacuuuaauaccaaacuuaaaaccaaacacucauuuaaaaguagguua

SEQ ID NO: 225410 - RNA, 64 nt, hsa
agucauuugaacaugcuucuaaauaaaauaaaacaaaaccaaaacuauacuuuugaucuauaau

SEQ ID NO: 225411 - RNA, 64 nt, hsa
uucucuucucucuucucaauuuugagguccucauucccaagauugaggaggcaguaguuaaucu

SEQ ID NO: 225412 - RNA, 64 nt, hsa
caguagaauggccagcauuccugccuguaagucuucccaagacagaggcccggugacacaguuc

SEQ ID NO: 225413 - RNA, 64 nt, hsa
acagcccuccucucccaagaaauccaggcuccucucccaagaaauccaggugcuuuccagacuc

SEQ ID NO: 225414 - RNA, 64 nt, hsa
agaagaacugauuggggcuuccacagcccuccucucccaagaaauccaggcuccucucccaaga

SEQ ID NO: 225415 - RNA, 64 nt, hsa
ucacucacagcaaacuuggaaagaaggcuaugacucccaagaggcagugaaccauugccuuaaa

SEQ ID NO: 225416 - RNA, 64 nt, hsa
ucauuauucugccucuuacuuacccuauuauggcucccaagaaaguuccugcuuuaguguuuug

SEQ ID NO: 225417 - RNA, 64 nt, hsa
gggauguuagcauucauuagaguaugaggaugagucccaagaagguucuuuggaaggaggacga

SEQ ID NO: 225418 - RNA, 64 nt, hsa
uuuaagugggcuuccauuccauggauuuaaucagucccaagaagaucaaacucagcaguacuug

SEQ ID NO: 225419 - RNA, 64 nt, hsa
gcacuccagccugggcgacagagcaagauuccguucccaagaaaaaaaaauuguucaacaauaa

SEQ ID NO: 225420 - RNA, 64 nt, hsa
ucucugcuguauccuuucggcuucccaguugagcucccaagaccaggacccacuggggcauaua

SEQ ID NO: 225421 - RNA, 64 nt, hsa
ucucugcuguguccuuucggcuucccaguugagcucccaagaccaggacccacuggggcauaua

SEQ ID NO: 225422 - RNA, 64 nt, hsa
ugugaaacuguuuaggauuuucuuuaagugguguucccaagagcuuuuuucugguaaguuggag

SEQ ID NO: 225423 - RNA, 64 nt, hsa
aauugaagacacguucuugccagcuucccuuuucucccaagaugcagaaauguggaugcucuuu

SEQ ID NO: 225424 - RNA, 64 nt, hsa
ggcaggcagcccuacaaauccuggugaccugcucucccaagaacagagccuguccccagauguc

SEQ ID NO: 225425 - RNA, 64 nt, hsa
cugcaugauggggagugaagcagcaggaaggggcucccaagagcuccugguggugcagccugug

SEQ ID NO: 225426 - RNA, 64 nt, hsa
aguuaauacuaucauaguaauauuauuauugucaucccaagaaaaaauauauuaaaaagauauu

SEQ ID NO: 225427 - RNA, 64 nt, hsa
aauuaauacuaucauguuaauacuauuauugucaucccaagaaaaaagauauuuuaaaaauuua

SEQ ID NO: 225428 - RNA, 64 nt, hsa
ggcugaaagaugaaaauggugcccucaucagagucaucagcaaacuguccaaguaggcuaggcu

SEQ ID NO: 225429 - RNA, 64 nt, hsa
cuucuacuagccagcaguucucucuggauacuggcaucagcaggucuccuuuuucuugugcugc

SEQ ID NO: 225430 - RNA, 64 nt, hsa
ucuaacgugggaucuucuggacagacaaccgugacaucagcagugcuggugcugcugugugugg

SEQ ID NO: 225431 - RNA, 64 nt, hsa
ucuuguucaagagaaagugaucaccgagcugucacaucagcaaauauguagucaaggcagccag

SEQ ID NO: 225432 - RNA, 64 nt, hsa
aucuggcagggcaccacagcgcccccuacugaaccaucagcaugucaguggcauuuaaagccau

SEQ ID NO: 225433 - RNA, 64 nt, hsa
gccugcucuaagaugccuugcuuguccuuugacccaucagcauggagcucagugguugcuguuu

SEQ ID NO: 225434 - RNA, 64 nt, hsa
acauuugcaggaagguaacuguuauaacccacaccaucagcagggggaaagccaagcugagaau

SEQ ID NO: 225435 - RNA, 64 nt, hsa
uccuuugauaagacccauaggcaaacuucgagcccaucagcaggucaacccuaugcugggaaag

SEQ ID NO: 225436 - RNA, 64 nt, hsa
ggaaagggcuggcucacugaugagaauguggaggcaucagcaaggaucucgguggguugcucag

SEQ ID NO: 225437 - RNA, 64 nt, hsa
aacugaucauauugcuugucucagaaaaaaacaccaucagcaaagugggccuccaaagccagau

SEQ ID NO: 225438 - RNA, 64 nt, hsa
aaacaaaagucacacuuaaggauccuucuagucacaucagcaguguucugccuuuauguaguag

SEQ ID NO: 225439 - RNA, 64 nt, hsa
caacuacaacuucccuauagcuucuaagcaguuucaucagcauuacuugggaaaacguguugca

SEQ ID NO: 225440 - RNA, 64 nt, hsa
accugcagacacuuucugcaauaagcucucagaccaucagcauccuccuggccagccacauaag

SEQ ID NO: 225441 - RNA, 64 nt, hsa
acaugcacacauuuucugcaauucacucucagaccaucagcauccuccuggccagcugcauaaa

SEQ ID NO: 225442 - RNA, 64 nt, hsa
cucaacugauuuacucacuuagcuucccuucccucaucagcauaguauaauagaauguauguua

SEQ ID NO: 225443 - RNA, 64 nt, hsa
gucagugaagucuaucaaucauucuccccuuccucaucagcaaugguagauagaaauguccuaa

SEQ ID NO: 225444 - RNA, 64 nt, hsa
ucuguucccuucuccuuucaucccagaggggccucaucagcaaagacagaaacugauguuccau

SEQ ID NO: 225445 - RNA, 64 nt, hsa
cagcacuacucagcauguaguccaggaccugcggcaucagcauccccugggagcuucuuagaaa

SEQ ID NO: 225446 - RNA, 64 nt, hsa
aaaggagcacaaggaaaccaagcagcagaggccccaucagcacagagggccucguuccacgaac

SEQ ID NO: 225447 - RNA, 64 nt, hsa
ucacccucucucguccaucucuguugccucugcacaucagcacacacugacuccaccugggcug

SEQ ID NO: 225448 - RNA, 64 nt, hsa
acuggcguccucuccugagucccuccgcacucuccaucagcaaccucacaccugccuucagacc

SEQ ID NO: 225449 - RNA, 64 nt, hsa
agguggggcugcaccagacucagcacuagcacuccaucagcacuagcaccucacuccaucagca

SEQ ID NO: 225450 - RNA, 64 nt, hsa
gcacuagcacuccaucagcacuagcaccucacuccaucagcacuagcaccucacuccaucggcc

SEQ ID NO: 225451 - RNA, 64 nt, hsa
caucggcacuaaugccccacucggcgccccacuccaucagcacuaaugcuccacuccauuggca

SEQ ID NO: 225452 - RNA, 64 nt, hsa
aaugacccgcuccuuugacauuggugccccacuccaucagcacuaacgcccugcuccaucggca

SEQ ID NO: 225453 - RNA, 64 nt, hsa
ucugauagcaccacacgcaaaccaaccuuucugacaucagcacuuuaccagaggcauaaacaca

SEQ ID NO: 225454 - RNA, 64 nt, hsa
gaagucuuuaauauuuuaagcccuaucacugacacaucagcauguuuucugcuuuaaauuaaaa

SEQ ID NO: 225455 - RNA, 64 nt, hsa
auccuuuaaugaucugguggucuccucgucaauccaucagcaaugcuucucucauagugucaua

SEQ ID NO: 225456 - RNA, 64 nt, hsa
caaaugggucaaaaccaugggaccugccaccucccaucagcaauucuggaaaugcacuauuucu

SEQ ID NO: 225457 - RNA, 64 nt, hsa
ccugagggcaccccgacucugucuccaggagucucaucagcaaaccgcugacaagucuuucuag

SEQ ID NO: 225458 - RNA, 64 nt, hsa
cccuccauucuccuggagcugccaccgcuguccccaucagcaaccauguucuugcaggcugggg

SEQ ID NO: 225459 - RNA, 64 nt, hsa
guagaacccaaaagauuggagccuuaacaauaaacaucagcacuaagugaccuguuccuccuuu

SEQ ID NO: 225460 - RNA, 64 nt, hsa
ucuugagccuaaucauguaguguagaucauuaaacaucagcauuuuaagaaacuuugugugcug

SEQ ID NO: 225461 - RNA, 64 nt, hsa
ggcuuguccaugugcugcucccacauuccguggacaucagcacuacucuccugaggacucuuca

SEQ ID NO: 225462 - RNA, 64 nt, hsa
guaaggaagcuguuucuuuuaaaacacaaaccaccaccaaaaauuuaaauguacauauugcuua

SEQ ID NO: 225463 - RNA, 64 nt, hsa
uauuuggcuguuuuuauuuuuuaaaagguauaaacaccaaaaaaaaaauuaacauuguaugaag

SEQ ID NO: 225464 - RNA, 64 nt, hsa
ucgugucucuuauucaguaagaugguuacucagccaccaaaauauauuucacucaaggcuugua

SEQ ID NO: 225465 - RNA, 64 nt, hsa
auucaaaugcucuuuucccuauaaccucuuuucucaccaaaaaggagauaaauuugaaaacaga

SEQ ID NO: 225466 - RNA, 64 nt, hsa
acuguauauguuacugccuuguacuuuucucauacaccaaaaacacaccaaaaaaaucaauaaa

SEQ ID NO: 225467 - RNA, 64 nt, hsa
uacugccuuguacuuuucucauacaccaaaaacacaccaaaaaaaucaauaaaauaagcaaucu

SEQ ID NO: 225468 - RNA, 64 nt, hsa
uaauggccuaaugcacccccaaacauggaaauaucaccaaaaaauacuuaauaguccaccaaaa

SEQ ID NO: 225469 - RNA, 64 nt, hsa
acauggaaauaucaccaaaaaauacuuaauaguccaccaaaaggcaagacugcccuuagaaauu

SEQ ID NO: 225470 - RNA, 56 nt, hsa
agcaggaguguaaagauuagauaucacaccaaaagcucaggcaagaaaagcaaaaa

SEQ ID NO: 225471 - RNA, 64 nt, hsa
aaacccaaaacuccugcacaacaaaggaaacgaucaccaaaaugaaaagguggacuguagauug

SEQ ID NO: 225472 - RNA, 64 nt, hsa
ugaccagaaaacaaugauuuuauaauauuuaacccaccaaaaagucccuccaacagcaauaucu

SEQ ID NO: 225473 - RNA, 64 nt, hsa
cauucugacacaagaugcaagucugugcaaaacccaccaaaaugcuccuauccaacaauuauuu

SEQ ID NO: 225474 - RNA, 64 nt, hsa
aggccaaaugaacuaaacauugccuugcuauauucaccaaaaggacuuaauucuuguuuuuuuc

SEQ ID NO: 225475 - RNA, 64 nt, hsa
uauaaaaaugaacuaaacauugccuugcuauauucaccaaaaggacuuacuucuuguuuuuucc

SEQ ID NO: 225476 - RNA, 64 nt, hsa
gaacaccacgcuguagucuccaacagaaaaacaccaccaaaacagauacccauguugagggguu

SEQ ID NO: 225477 - RNA, 64 nt, hsa
uuaccuagagggcuuuuacagagaauuagagcaacaccaaaaggauugccucuuuuccuuccuu

SEQ ID NO: 225478 - RNA, 64 nt, hsa
ccuacccuguauuugccauaaacuccacaauucacaccaaaaugucuguacuuagagcuaauuc

SEQ ID NO: 225479 - RNA, 64 nt, hsa
aguuuguuauuuuuaaaauguuuauacauaaaaccaccaaaauacauagcuucgacaagaugga

SEQ ID NO: 225480 - RNA, 64 nt, hsa
cuuagacuuguucugcauuuuauuuuuuauuucucaccaaaauaaaagcauuuaugagaauuau

SEQ ID NO: 225481 - RNA, 64 nt, hsa
gauauuguguucaagaaugauuccaaauuugagccaccaaaauacacugcauuacagaaauugc

SEQ ID NO: 225482 - RNA, 64 nt, hsa
aaaaauuuaaaaucuuaaauguguaagucacccccaccaaaaacaaaagagaagaaaaagaaua

SEQ ID NO: 225483 - RNA, 64 nt, hsa
uugcaguuuuguuuuagaugauuggaaaguauaucaccaaaaaaaguauauagugacauuuuua

SEQ ID NO: 225484 - RNA, 64 nt, hsa
aauuccaaguguauacuugcucgggugaugggugcaccaaaaucucacaaaucaccacuaaaua

SEQ ID NO: 225485 - RNA, 64 nt, hsa
auaauguacucauguaaccaaaugcuaccuguuccaccaaaaccuauggaaauuuaaaaaaaac

SEQ ID NO: 225486 - RNA, 64 nt, hsa
ucuuuagaauuacacagcuaaaaaggaaaaaaaacaccaaaauaagauaaaauaaaacaaauuu

SEQ ID NO: 225487 - RNA, 64 nt, hsa
acaccaaaauaagauaaaauaaaacaaauuuaaacaccaaaauaagauauaauaaaacauuugu

SEQ ID NO: 225488 - RNA, 64 nt, hsa; identical to SEQ ID NO: 119840

SEQ ID NO: 225489 - RNA, 64 nt, hsa; identical to SEQ ID NO: 119841

SEQ ID NO: 225490 - RNA, 64 nt, hsa; identical to SEQ ID NO: 100156

SEQ ID NO: 225491 - RNA, 64 nt, hsa; identical to SEQ ID NO: 100157

SEQ ID NO: 225492 - RNA, 64 nt, hsa; identical to SEQ ID NO: 100158

SEQ ID NO: 225493 - RNA, 64 nt, hsa; identical to SEQ ID NO: 100159

SEQ ID NO: 225494 - RNA, 64 nt, hsa; identical to SEQ ID NO: 100160

SEQ ID NO: 225495 - RNA, 64 nt, hsa; identical to SEQ ID NO: 100161

SEQ ID NO: 225496 - RNA, 64 nt, hsa; identical to SEQ ID NO: 100162

SEQ ID NO: 225497 - RNA, 64 nt, hsa; identical to SEQ ID NO: 100163

SEQ ID NO: 225498 - RNA, 64 nt, hsa; identical to SEQ ID NO: 100164

SEQ ID NO: 225499 - RNA, 64 nt, hsa; identical to SEQ ID NO: 100165

SEQ ID NO: 225500 - RNA, 64 nt, hsa; identical to SEQ ID NO: 100166

SEQ ID NO: 225501 - RNA, 64 nt, hsa; identical to SEQ ID NO: 100167

SEQ ID NO: 225502 - RNA, 64 nt, hsa
ccucaggugggcuggcuggcugacagaccuucuggccagacagacuccuaaccaaccagaugga

SEQ ID NO: 225503 - RNA, 64 nt, hsa
uggccagacagacuccuaaccaaccagauggacugccagacaggcagacaucagccacauggaa

SEQ ID NO: 225504 - RNA, 64 nt, hsa
aggaccuaucuaggcagaccccagccagacccccgccagacagacucccaaccagacugacccc

SEQ ID NO: 225505 - RNA, 64 nt, hsa
cggcaccguaucugcagugggcacgggggggccggccagacaggcagacugggaggauggagga

SEQ ID NO: 225506 - RNA, 64 nt, hsa
cuuucagccaugcugaugaccacaccccguccaggccagacaccaccccccaccccacugucgu

SEQ ID NO: 225507 - RNA, 64 nt, hsa
gccaugauggcaacagaucuggaaccucagccuggccagacacaggcccucccuguuccccaga

SEQ ID NO: 225508 - RNA, 64 nt, hsa
aagauaacuaggaaauccauucacaguucuuugggccagacaugccacaaggacuuccugucca

SEQ ID NO: 225509 - RNA, 64 nt, hsa
gggguccuguccaggcccagggacaucuuugcaagccagacacacuuccucuugagaccucguu

SEQ ID NO: 225510 - RNA, 64 nt, hsa
acaugucccaggauuugcuccacccucgagggcagccagacagcgucgccaggcaaugaggaaa

SEQ ID NO: 225511 - RNA, 64 nt, hsa
acacccugaaauugugacccccugggggacagcugccagacacagcuggcggcagcaccagaug

SEQ ID NO: 225512 - RNA, 64 nt, hsa
accucaccugaagggggugagacccuuguuggcagccagacaaggguggggcuccacaggcagc

SEQ ID NO: 225513 - RNA, 64 nt, hsa
ggaucacagccacuauggaugacauguugucuacucggucuagcaccuugaccgaggauggagc

SEQ ID NO: 225514 - RNA, 64 nt, hsa
gacuuuaaaccaccuaguucuccccgauggggcaucggucuaaagcuuugggggagugggcgca

SEQ ID NO: 225515 - RNA, 64 nt, hsa
ggguccauugcccacauucucugucuccuucucgucggucuaccccacuaccuccaggguuuug

SEQ ID NO: 225516 - RNA, 64 nt, hsa
gacgaucaucacaccugugucguuaccucagccaucggucuagcauaucagucacugggcccaa

SEQ ID NO: 225517 - RNA, 64 nt, hsa
cuuuuauuaaaauaaccaugcaacaauaacacuaucggucuaucugacaguuuuucccccaggg

SEQ ID NO: 225518 - RNA, 64 nt, hsa
gcgaggcccauguacuccuguggcuuucucacauucggucuacuugcaggguaucuccacagca

SEQ ID NO: 225519 - RNA, 64 nt, hsa
ggacugccaggcuggguuggggacccagggaacaucggucuacucaggugugagggggcagguc

SEQ ID NO: 225520 - RNA, 64 nt, hsa
aauugaaugagagcaguggacacaucucagcaggucggucuagagaguugcgaaucuaaaccug

SEQ ID NO: 225521 - RNA, 64 nt, hsa
cuccugacccguauagugugccacaggaccugggucggucuagaacucucucaggaugccuuuu

SEQ ID NO: 225522 - RNA, 64 nt, hsa
guaagcaggccuuaguacggcugcugcacacuucucggucuaggugggagagagugcauaaagg

SEQ ID NO: 225523 - RNA, 64 nt, hsa
ucaaagugugccccagcacaagaggcacugguguucggucuacauuuaguucuccccacucuga

SEQ ID NO: 225524 - RNA, 64 nt, hsa
gcaagagaauacuguaacaaacuucguacagaguucggucuauuaauuguuucauguuagauau

SEQ ID NO: 225525 - RNA, 64 nt, hsa
aaauuucugcccugagcccuccacgucagugccaucggucuagaaccacuaaccccgcauugcu

SEQ ID NO: 225526 - RNA, 64 nt, hsa
ugaaggggagaacgucuccagacagaauucuacaucggucuaaucuacuuuaggacuggauccc

SEQ ID NO: 225527 - RNA, 64 nt, hsa
uuuucuugcagguaagugacacucccuguccuagucggucuaucuggacuugcccuugucuguu

SEQ ID NO: 225528 - RNA, 64 nt, hsa
gcuggagugguggcuccauccucucugggccacuucggucuaggaacucaucuuugcaggaacc

SEQ ID NO: 225529 - RNA, 64 nt, hsa
uccaguguucgggggccucuggcugcugaaggauucggucuaccacggagggcugugcuguuag

SEQ ID NO: 225530 - RNA, 64 nt, hsa
uguucauucugauuugucauuuuauuaucuguuaucggucuaaagugcuaauuuacccauuuga

SEQ ID NO: 225531 - RNA, 64 nt, hsa
gccucaagaggccucagaacugcaaacuccugcgucggucuauacuacucggccauggcccaca

SEQ ID NO: 225532 - RNA, 64 nt, hsa
caugagccaccaugcccagcugcuccuuuauuuuaaucccuaaauauaaucccuaaauauaguu

SEQ ID NO: 225533 - RNA, 64 nt, hsa
gcccagcugcuccuuuauuuuaaucccuaaauauaaucccuaaauauaguuauauuucauacuu

SEQ ID NO: 225534 - RNA, 64 nt, hsa
auggaugccggcacaaaacugccuuaaaauauucauaguuaauacagguauaucuauuuuuauu

SEQ ID NO: 225535 - RNA, 64 nt, hsa
aggaaaugguugaaaacugaagguagaugguguuauaguuaauaauaaaugcuguaaauaagca

SEQ ID NO: 225536 - RNA, 64 nt, hsa
ugguugucuacaauuuguuuuccuguaaaugcagauaguuaaaaucuaaaggauagaaugcuuu

SEQ ID NO: 225537 - RNA, 64 nt, hsa
uaagcgcauaguuuuugguccugccucauguaaaauaguuaaugauuaucauuuacuuggaaag

SEQ ID NO: 225538 - RNA, 64 nt, hsa
gcucucagagaguauuaauauugauauuaauaauauaguuaauaguaauauugcuauuuacaug

SEQ ID NO: 225539 - RNA, 64 nt, hsa
uuucuuuaccauuuugcuuucccagccuccaaacauaguuaauagaaauuucccuucaaagaac

SEQ ID NO: 225540 - RNA, 64 nt, hsa
uauaguuguuacugguccuguuguagcagugaauauaguuaaaauacguacauuaaaaaaaaaa

SEQ ID NO: 225541 - RNA, 64 nt, hsa
uuaguuuagugacaaagucauugucuuuuaugauauaguuaauuuuaaagagauuuaguauuaa

SEQ ID NO: 225542 - RNA, 64 nt, hsa
aauuucugguguucuauaccacuguaggacgacuauaguuaagaacauuauauuccauuuaguu

SEQ ID NO: 225543 - RNA, 64 nt, hsa
acauauaaauucaauaaauaagacuuaguuaaggauaguuaacuauuauacuccaacaauucau

SEQ ID NO: 225544 - RNA, 64 nt, hsa
aucccaaguugcuuaccuagaagaacuugacaggauaguuaauaauaaaccuuaaaacccauga

SEQ ID NO: 225545 - RNA, 64 nt, hsa
gugauaaaugagacuauauaguuauauuguuaauauaguuaacacauuacaugauuuggugagc

SEQ ID NO: 225546 - RNA, 64 nt, hsa
ucuacugccuugaaaaaugacaauugugaacaugauaguuaaacuaccacuuuuuuuaaccauu

SEQ ID NO: 225547 - RNA, 64 nt, hsa
uuuagaagaaaaguuauuggcaugguuguugcauauaguuaaacugagaguaauucaucuguga

SEQ ID NO: 225548 - RNA, 64 nt, hsa
aaggcuugcuuuuucuccaugucucccaguuuguauaguuaaauuguccaguuguauaguuaaa

SEQ ID NO: 225549 - RNA, 64 nt, hsa
ucucccaguuuguauaguuaaauuguccaguuguauaguuaaauauuugaucuuauuaaaaaca

SEQ ID NO: 225550 - RNA, 64 nt, hsa
ugauaauauaugaggaggccucgcuauagcaaaaauaguuaaaaugcugacauaacaccaaacu

SEQ ID NO: 225551 - RNA, 64 nt, hsa
uaccuaauccaaauaucauauaaacauuuuauuuauaguuaauaaucuaugaugaagguaauua

SEQ ID NO: 225552 - RNA, 64 nt, hsa
uugugauaugauucugaacaguuggaauagaaucauaguuaagugguacagccauggcuaucgu

SEQ ID NO: 225553 - RNA, 64 nt, hsa
caaaaccacagcagccuccuauuaaguguaacaaauaguuaagcaaacucgggcuacaaacaaa

SEQ ID NO: 225554 - RNA, 64 nt, hsa
uuaguguugugguaaugccuguuuucaucuguaaauaguuaaguauguacacgaggcacuacuu

SEQ ID NO: 225555 - RNA, 64 nt, hsa
uacaccagaaaaggacuggcagucuacuucuaccauaguuaaacuucacccucuuuaauuucac

SEQ ID NO: 225556 - RNA, 64 nt, hsa
uacauguuugugugcaacugcuucauugcuauuaauaguuaaaugaaaucugcauauucuggau

SEQ ID NO: 225557 - RNA, 64 nt, hsa
cccuuccuuuacaguuuaaaaaaaaaaucuaaaaauaguuaagcacugugucaaagaguguuuc

SEQ ID NO: 225558 - RNA, 64 nt, hsa
acuaaauuagagaacugcucuugcugaaauuaugauaguuaagauuccuaagaacuugacaaug

SEQ ID NO: 225559 - RNA, 64 nt, hsa
auucuucacaaaauucugagauuauaaaauguauauaguuaauauuuguuugagcuugugaccu

SEQ ID NO: 225560 - RNA, 64 nt, hsa
auuguaacuggggaguauagaguagaaaaaaaguauaguuaaaacauuuguucuacaaauuaac

SEQ ID NO: 225561 - RNA, 64 nt, hsa
gaggaaaggcccuagggagauuuauuucuguuaaauaguuaacucugcugaguaugacaaauag

SEQ ID NO: 225562 - RNA, 64 nt, hsa
aaaugucagaagauauucugaacuggaugccugaauaguuaacuaaaccagucuuguuagauga

SEQ ID NO: 225563 - RNA, 64 nt, hsa
ugccauaggaaaaaauuaucuuaaaacuuuggccauaguuaauaacauuaacacuucaauagca

SEQ ID NO: 225564 - RNA, 64 nt, hsa
cacuuuuuuuaaaaauuuuaaccagaaaauaaagauaguuaaauccuaagauagagauuaaguc

SEQ ID NO: 225565 - RNA, 64 nt, hsa
agauucuguccucuucucugcauaccgugaauuuauaguuaaggaucccuuugcugugagggua

SEQ ID NO: 225566 - RNA, 64 nt, hsa
cuaaucuaucacuucaaaagaugguaaucuuucaacucauuauuccuccaauuuuuaaugucga

SEQ ID NO: 225567 - RNA, 64 nt, hsa
augcaagucaagcuuuauuguuaggcuugcugcuacucauuaacccaaauauuuguacaaaaaa

SEQ ID NO: 225568 - RNA, 64 nt, hsa
aauauacucauuagaauuaccauuuguuaauaucacucauuaauuaaccccauaauuagaucca

SEQ ID NO: 225569 - RNA, 64 nt, hsa
cccaagugacgaaaacauuguccccaaugaauauacucauuagaauuaccauuuguuaauauca

SEQ ID NO: 225570 - RNA, 64 nt, hsa; identical to SEQ ID NO: 167914

SEQ ID NO: 225571 - RNA, 64 nt, hsa; identical to SEQ ID NO: 167915

SEQ ID NO: 225572 - RNA, 64 nt, hsa
uuccggucccuuuucccugccaucucaaagaggagcaauguaucuuccagagaagauuuuauuu

SEQ ID NO: 225573 - RNA, 64 nt, hsa
agaaauaacacacggaaaggucagggaauggacagcaauguauuuggagauacuugagcugaga

SEQ ID NO: 225574 - RNA, 64 nt, hsa
acuaaaauuuaacaaauaguauuuucuuauagaagcaauguauuaaaugauuagauacacagga

SEQ ID NO: 225575 - RNA, 64 nt, hsa
ugggauuuuguuucccaucucuuucuagguguuugcaauguacaaauaauacagcugugcuaau

SEQ ID NO: 225576 - RNA, 64 nt, hsa
uuuucauacuacuguuaacuuuuuuaaaaaagaagcaauguaaagaccguaaugcacuaagcuu

SEQ ID NO: 225577 - RNA, 64 nt, hsa
uuaacuauagcuuuauuaguaauuccaaaaugcugcaauguagcugauuuccucacucagacag

SEQ ID NO: 225578 - RNA, 64 nt, hsa
ccaaaguuaaacuacugcaguugguggaaguucugcaauguaaauagaacacuaauuaaaaaac

SEQ ID NO: 225579 - RNA, 64 nt, hsa
uaaguuuuucuguuacuuagagcugaaaauaaaagcaauguagaguuacgcuuuuauaaguauu

SEQ ID NO: 225580 - RNA, 64 nt, hsa
auuuauuacaaucuccacaaugaaaacaaauagugcaauguaagaaauauuauguaucuuacug

SEQ ID NO: 225581 - RNA, 64 nt, hsa
gcauccuuaggaaucugggauuugccaguugcuggcaauguagagcaggcauggaauuuuauau

SEQ ID NO: 225582 - RNA, 64 nt, hsa
guaugugugaaguauauacugggacuucagaagugcaauguauuuuucuccugugaaaccugaa

SEQ ID NO: 225583 - RNA, 64 nt, hsa
auuuccccuccuaucccucugccccuacugcucagcaauguaaaagagacaaauaaggagaaag

SEQ ID NO: 225584 - RNA, 64 nt, hsa
uuuucauagaucuauaaucaggcaauuucugcaagcaauguaugaccccaccugagcaaccaca

SEQ ID NO: 225585 - RNA, 64 nt, hsa; identical to SEQ ID NO: 172369

SEQ ID NO: 225586 - RNA, 64 nt, hsa; identical to SEQ ID NO: 172370

SEQ ID NO: 225587 - RNA, 64 nt, hsa; identical to SEQ ID NO: 172371

SEQ ID NO: 225588 - RNA, 64 nt, hsa; identical to SEQ ID NO: 172372

SEQ ID NO: 225589 - RNA, 64 nt, hsa; identical to SEQ ID NO: 172373

SEQ ID NO: 225590 - RNA, 64 nt, hsa; identical to SEQ ID NO: 172374

SEQ ID NO: 225591 - RNA, 64 nt, hsa; identical to SEQ ID NO: 172375

SEQ ID NO: 225592 - RNA, 64 nt, hsa; identical to SEQ ID NO: 172376

SEQ ID NO: 225593 - RNA, 64 nt, hsa; identical to SEQ ID NO: 172377

SEQ ID NO: 225594 - RNA, 64 nt, hsa; identical to SEQ ID NO: 172378

SEQ ID NO: 225595 - RNA, 64 nt, hsa; identical to SEQ ID NO: 172379

SEQ ID NO: 225596 - RNA, 64 nt, hsa; identical to SEQ ID NO: 172380

SEQ ID NO: 225597 - RNA, 64 nt, hsa
gauucuaagaagagacuguccaagcaaguuaggcuugcaggaagauaugacccagcugagaagc

SEQ ID NO: 225598 - RNA, 64 nt, hsa
aggcccugcauucagaggucuuguaaucuacuuguugcaggagaaagaagguaaaaaaugauuu

SEQ ID NO: 225599 - RNA, 64 nt, hsa
cagggagcugcuggagguaguagagccugaagucuugcaggacucacuggauguuauucaacuc

SEQ ID NO: 225600 - RNA, 64 nt, hsa
cagggagcugcuggcugagaaagagccugaagucuugcaggacucacuggauagauguuauucg

SEQ ID NO: 225601 - RNA, 64 nt, hsa
cagggagcugcuggaugagaaagagccugaagucuugcaggacucacuggauagauguuauuca

SEQ ID NO: 225602 - RNA, 64 nt, hsa
cggaauguaugguucaaccuuaauuauagcuucauugcaggacuuuacuguuucuccauuuucu

SEQ ID NO: 225603 - RNA, 64 nt, hsa
ggauuguauaggcagaaaaaugauuguaggaaaguugcaggauuagcggaauguaugguucaac

SEQ ID NO: 225604 - RNA, 64 nt, hsa
gcccuguggcccucugggaagcuuuguaccucuuuugcaggaucuggggguggggagggacaag

SEQ ID NO: 225605 - RNA, 64 nt, hsa
cccacucauuucugggaacacauucacacgcccauugcaggaguauuaauagcaacccacauuu

SEQ ID NO: 225606 - RNA, 64 nt, hsa
guguugcccucugcccgcuuugauacauaaacuuuugcaggaaugggcaaccugagagcuguua

SEQ ID NO: 225607 - RNA, 64 nt, hsa
caucaucgcucccaaaggaaagagcagucuaucauugcaggagccauaugacaagccuuugugc

SEQ ID NO: 225608 - RNA, 64 nt, hsa
uuugccuucauucuuaccaccuggccugcaaaguuugcaggagggccagguauauucacuugug

SEQ ID NO: 225609 - RNA, 64 nt, hsa
cagccccaagaaccuaaagacugcaggcugcuaauugcaggaaaugacuuuggaagggcaggcu

SEQ ID NO: 225610 - RNA, 64 nt, hsa
cugggucuuggagggaugugggaaugaauuggcauugcaggaaagacagguaaagugauugcug

SEQ ID NO: 225611 - RNA, 64 nt, hsa
acuacuuagaauuaaauuaggaagucuuuuaucauugcaggauuguacauacuacuuuauaaaa

SEQ ID NO: 225612 - RNA, 64 nt, hsa
agaaaaucuuacuuagaaaaaagccccuugaaacuugcaggauuuacuuaauaaaaauacacgc

SEQ ID NO: 225613 - RNA, 64 nt, hsa
auacaauucauugagcagcuaccacuuaaaaaacuugcaggacaguuagagccugcauuucuag

SEQ ID NO: 225614 - RNA, 64 nt, hsa
cuuuguaaagggugcagccaagcucugcagacuuuugcaggauugucuagccugaguaccgggc

SEQ ID NO: 225615 - RNA, 64 nt, hsa
ucagguuaucuugaacugccugacuuaggccagcccuacagaagugcuguuuacucauuggagg

SEQ ID NO: 225616 - RNA, 64 nt, hsa
ucaguuuaucuuggacugacugacucaugccagcccuacagaagugccuuuuacguauuggagc

SEQ ID NO: 225617 - RNA, 64 nt, hsa
acacuucucagagggcagaguggcagccgggcacccuacagaaacucagagggcagaguggcag

SEQ ID NO: 225618 - RNA, 64 nt, hsa
guaucuggggcgaguguuggggguaaaagcccacccuacagaaaguggaacagcccggagccug

SEQ ID NO: 225619 - RNA, 64 nt, hsa
cagaaucuucuggauguuccuacagagggaaagaccuacagagggaaagacccucgggccgcuc

SEQ ID NO: 225620 - RNA, 64 nt, hsa
aaugugugcuugcuuccagaaucuucuggauguuccuacagagggaaagaccuacagagggaaa

SEQ ID NO: 225621 - RNA, 64 nt, hsa
uauuagaauuggaaggcaaauuuuuguccaaaaaccuacagacaaguacuuugagagaauuucc

SEQ ID NO: 225622 - RNA, 64 nt, hsa
ugcugguguauaaaaaccuggauguaaagcugagccuacagaccuguccucaccaacuguuuug

SEQ ID NO: 225623 - RNA, 64 nt, hsa
uagaaaauaggcuaggcacaguggcucacgccuguaaucucaacacuuugggaggccaaggugg

SEQ ID NO: 225624 - RNA, 64 nt, hsa
uaaaaguacaaaagggcaugauggcaggugccuguaaucucagcuacucaguaggcuggagcgg

SEQ ID NO: 225625 - RNA, 64 nt, hsa
agguguuugcaauguacaaauaauacagcugugcuaaucucacauuuagccaugauagaugaug

SEQ ID NO: 225626 - RNA, 64 nt, hsa
aacauuccaacuccagaaugauccccaaucacccuaaucucagaaugcuggaaugaugucuguu

SEQ ID NO: 225627 - RNA, 64 nt, hsa
aauuuauuuggccgggcacgguggcucacaccuguaaucucagcacuuuggcaggccaaggcag

SEQ ID NO: 225628 - RNA, 64 nt, hsa
uuuauaauauagaugguuuuguuugacuaaagaauaaucucauauaacuagaauacuuguggcu

SEQ ID NO: 225629 - RNA, 64 nt, hsa
ugaaaagaggcauuuguuugauccuugaacgaauuaaucucacguacuucccuguuugugguuu

SEQ ID NO: 225630 - RNA, 64 nt, hsa
aaguauuugccacuuucgaguacagcuaauuggauaaucucaaacccuuuagugaaaauaucuu

SEQ ID NO: 225631 - RNA, 64 nt, hsa
ccugagaaauauucucuuaaaaugaccuuuguuuuaaucucauucaugauguugauuuuuuuuc

SEQ ID NO: 225632 - RNA, 64 nt, hsa
uauaaaaucagccaggcaugguggcgcacaccuauaaucucagcuacucaggaggcugaggcac

SEQ ID NO: 225633 - RNA, 64 nt, hsa
augagaacauuugcuuugcuuucugcugaaucccuaaucucaacaaucuauaccuggacugucc

SEQ ID NO: 225634 - RNA, 64 nt, hsa
caacguuuugcagcuuccaaauuucugaagaaacuaaucucagauuggcaguuaaagucaaaau

SEQ ID NO: 225635 - RNA, 64 nt, hsa
aaaaauguuggcugugcacgguagcuuaugccuguaaucucagcacuuugggaggccaaggcag

SEQ ID NO: 225636 - RNA, 64 nt, hsa
uggaaaaacuuaugaaacuucuuauaagagagaguaaucucaggccggacaugcuggcucauac

SEQ ID NO: 225637 - RNA, 64 nt, hsa
agggucgugggcugggcgcgguggcucacaccuguaaucucaacgcuuugggaggggaggcagg

SEQ ID NO: 225638 - RNA, 64 nt, hsa
ucucugaaggcauuugaguuugccucuucugcuuuaaucucauccugacaggaggggucguuga

SEQ ID NO: 225639 - RNA, 58 nt, hsa
acaccagugaaggcaaaugaaaguggagauucaggagcagcaaugggucucaccauag

SEQ ID NO: 225640 - RNA, 64 nt, hsa
aaccaaaaaaacuguccagcuguggacuuucaggauucaggacugcuggggaucaagcccaagg

SEQ ID NO: 225641 - RNA, 64 nt, hsa
gccugcauaauguuucuggauuucauacuguaacauucaggaauucuuggagaaaauggguuua

SEQ ID NO: 225642 - RNA, 64 nt, hsa
uagugcgguuuacucacugcugcaaauacuguauauucaggacuugaaagaaauggugaaugcc

SEQ ID NO: 225643 - RNA, 64 nt, hsa
aacuaauauguuuucugaaaccaggaugaugcucauucaggaaauccacuauguugaaugucca

SEQ ID NO: 225644 - RNA, 64 nt, hsa
cuauuuuuuguuauuucaauauacccuccuguuuauucaggaaaaaauaauaaagucacuaucu

SEQ ID NO: 225645 - RNA, 64 nt, hsa
uacuaggucagaacauuuugagucaccuugggagauucaggauggggagagcaaauuugaacaa

SEQ ID NO: 225646 - RNA, 64 nt, hsa
ggaggguuacugaaagaauuuuagcaauauauugauucaggaaaaggagcuguuuuauaaauga

SEQ ID NO: 225647 - RNA, 64 nt, hsa
gaucuauucauuguuucaacucagaaugcacuugauucaggaggucaucugaccuucaccuugg

SEQ ID NO: 225648 - RNA, 64 nt, hsa
guacucggcuuccugugggguguagguucucgcgauucaggacguccuuccauaucccugccca

SEQ ID NO: 225649 - RNA, 64 nt, hsa
uauugcauuuugaaauaaucauuaacaugcugcaauucaggagcugguuagaacauuuuaagug

SEQ ID NO: 225650 - RNA, 64 nt, hsa
ugacacaccuugucgucuaaauguucgguauucuauucaggacuuacgguaacuauuaugaggg

SEQ ID NO: 225651 - RNA, 64 nt, hsa
cuuccccaaucuagcaaggcaggccaacauucagauucaggaaauacagagaacgccacaaaga

SEQ ID NO: 225652 - RNA, 64 nt, hsa
uuggauaaauagucaagacccaucagggugcuguauucaggaaacccaucucacgugcagagac

SEQ ID NO: 225653 - RNA, 64 nt, hsa
cauaaaaacccuagaagaaaaccuaggcaauaccauucaggacauaggcaugggcaaggacuuc

SEQ ID NO: 225654 - RNA, 64 nt, hsa
guggauucauccugcugguuuuacuuuagucccuccaugucaaagugggccugagaaaagcuca

SEQ ID NO: 225655 - RNA, 64 nt, hsa
gauuuguauugaauuuauagauuaaucugguaaaccaugucaucuuuacaauguugucuuccaa

SEQ ID NO: 225656 - RNA, 64 nt, hsa
acccggagcuaagucacccagagcacaggagcugccaugucagaugggaaaucugccuauguca

SEQ ID NO: 225657 - RNA, 64 nt, hsa
cugggccaccgggcagccuggggcggugugugugccaugucacagcauggccucucggccuugg

SEQ ID NO: 225658 - RNA, 64 nt, hsa
gccacaucguggcccgcagccccagagucacuguccaugucaccauccuucuccuccuuuggaa

SEQ ID NO: 225659 - RNA, 64 nt, hsa
cugaauuugacagagaacaccuucccuuuccuugccaugucacccuccagaggaagucacaccu

SEQ ID NO: 225660 - RNA, 64 nt, hsa; identical to SEQ ID NO: 209315

SEQ ID NO: 225661 - RNA, 64 nt, hsa; identical to SEQ ID NO: 209316

SEQ ID NO: 225662 - RNA, 64 nt, hsa; identical to SEQ ID NO: 209317

SEQ ID NO: 225663 - RNA, 64 nt, hsa; identical to SEQ ID NO: 209318

SEQ ID NO: 225664 - RNA, 64 nt, hsa; identical to SEQ ID NO: 209319

SEQ ID NO: 225665 - RNA, 64 nt, hsa; identical to SEQ ID NO: 209320

SEQ ID NO: 225666 - RNA, 64 nt, hsa; identical to SEQ ID NO: 209321

SEQ ID NO: 225667 - RNA, 64 nt, hsa; identical to SEQ ID NO: 209322

SEQ ID NO: 225668 - RNA, 64 nt, hsa; identical to SEQ ID NO: 209323

SEQ ID NO: 225669 - RNA, 64 nt, hsa; identical to SEQ ID NO: 209324

SEQ ID NO: 225670 - RNA, 64 nt, hsa; identical to SEQ ID NO: 209325

SEQ ID NO: 225671 - RNA, 64 nt, hsa; identical to SEQ ID NO: 209326

SEQ ID NO: 225672 - RNA, 64 nt, hsa; identical to SEQ ID NO: 209327

SEQ ID NO: 225673 - RNA, 64 nt, hsa; identical to SEQ ID NO: 209328

SEQ ID NO: 225674 - RNA, 64 nt, hsa; identical to SEQ ID NO: 209329

SEQ ID NO: 225675 - RNA, 64 nt, hsa; identical to SEQ ID NO: 209330

SEQ ID NO: 225676 - RNA, 64 nt, hsa; identical to SEQ ID NO: 209331

SEQ ID NO: 225677 - RNA, 64 nt, hsa; identical to SEQ ID NO: 209332

SEQ ID NO: 225678 - RNA, 64 nt, hsa; identical to SEQ ID NO: 209333

SEQ ID NO: 225679 - RNA, 64 nt, hsa; identical to SEQ ID NO: 209334

SEQ ID NO: 225680 - RNA, 64 nt, hsa; identical to SEQ ID NO: 209335

SEQ ID NO: 225681 - RNA, 64 nt, hsa; identical to SEQ ID NO: 209336

SEQ ID NO: 225682 - RNA, 64 nt, hsa; identical to SEQ ID NO: 209337

SEQ ID NO: 225683 - RNA, 64 nt, hsa; identical to SEQ ID NO: 209338

SEQ ID NO: 225684 - RNA, 64 nt, hsa; identical to SEQ ID NO: 209339

SEQ ID NO: 225685 - RNA, 64 nt, hsa; identical to SEQ ID NO: 209340

SEQ ID NO: 225686 - RNA, 64 nt, hsa; identical to SEQ ID NO: 209341

SEQ ID NO: 225687 - RNA, 64 nt, hsa; identical to SEQ ID NO: 209342

SEQ ID NO: 225688 - RNA, 64 nt, hsa; identical to SEQ ID NO: 209343

SEQ ID NO: 225689 - RNA, 64 nt, hsa; identical to SEQ ID NO: 209344

SEQ ID NO: 225690 - RNA, 64 nt, hsa; identical to SEQ ID NO: 209345

SEQ ID NO: 225691 - RNA, 64 nt, hsa; identical to SEQ ID NO: 209346

SEQ ID NO: 225692 - RNA, 64 nt, hsa; identical to SEQ ID NO: 209347

SEQ ID NO: 225693 - RNA, 64 nt, hsa; identical to SEQ ID NO: 209348

SEQ ID NO: 225694 - RNA, 64 nt, hsa; identical to SEQ ID NO: 209349

SEQ ID NO: 225695 - RNA, 64 nt, hsa; identical to SEQ ID NO: 209350

SEQ ID NO: 225696 - RNA, 64 nt, hsa; identical to SEQ ID NO: 209351

SEQ ID NO: 225697 - RNA, 64 nt, hsa; identical to SEQ ID NO: 209352

SEQ ID NO: 225698 - RNA, 64 nt, hsa
uuucaacaauguucucuaguuucaagcuccagcuucucagaaagaauuaaagaacuugcuguuc

SEQ ID NO: 225699 - RNA, 64 nt, hsa
aaaccugggacacgagucugugaauagucgguuuucucagaauaauuugaaucuguuuucuuag

SEQ ID NO: 225700 - RNA, 64 nt, hsa
aaggaaggauucaccaccuccaggaaaagugucuucucagaaacaaccagcugagaagguaauu

SEQ ID NO: 225701 - RNA, 64 nt, hsa
aauaaaggagggaccaauaucugggacagugucuucucagaaacaaccagcugagaagguaauu

SEQ ID NO: 225702 - RNA, 64 nt, hsa
aauaauggguggugggaaaucuggaacagugucuucucagaaacaaccagccucaaagguaauu

SEQ ID NO: 225703 - RNA, 64 nt, hsa
aauaaaggauggacuacagugugggacagugucuucucagaaacaaccagccuugaagguaauu

SEQ ID NO: 225704 - RNA, 64 nt, hsa
aauaaaggauggagaaaaaucugggacagugucuucucagaaacaaccagccuugaagguaauu

SEQ ID NO: 225705 - RNA, 64 nt, hsa
aauaaaggauggagaaaaaucugggacagugucuucucagaaaccaccagccuugacgguaaug

SEQ ID NO: 225706 - RNA, 64 nt, hsa
aaaaaaggauggagaaauaucuaggaaagugucuucucagaaaccaccaaccuugaagguaaug

SEQ ID NO: 225707 - RNA, 64 nt, hsa
aaaaaaggauggagaaauaucuaggaaagugucuucucagaaaccaccagccuugaagguaaug

SEQ ID NO: 225708 - RNA, 64 nt, hsa
auuuugcugaagaagcaguuucucagacacaacaucucagaauuuuaauuuuuagaaauucaug

SEQ ID NO: 225709 - RNA, 64 nt, hsa
uaccauacuguaaauaugagcuuuauggugucauucucagaaacuuacacauuucugcucuccu

SEQ ID NO: 225710 - RNA, 64 nt, hsa
gcucaaaagugacaaguccuuuucacagcaccauucucagaacaccucugaguaacguguuugc

SEQ ID NO: 225711 - RNA, 64 nt, hsa
cucagccucaaucaugucuuaacaaaaugacaggucucagaaagggggagcucaauagcucaaa

SEQ ID NO: 225712 - RNA, 64 nt, hsa
uuagauuuuuaaaaaagaauuaaaaugugggaguucucagaaagaaauaaacacaugagaauaa

SEQ ID NO: 225713 - RNA, 64 nt, hsa
aaauaacgccugauguauagauuaguuagcaaauucucagaaaucccccacauaaaagccuuac

SEQ ID NO: 225714 - RNA, 64 nt, hsa
cuuaaucaaaaagaauagccaguacagcauacaaucucagaaacuuagaagcaaguagaaaaua

SEQ ID NO: 225715 - RNA, 64 nt, hsa
ggcaugggguggauauagggcauaggauuacuugucucagaagcugucauagaauuucuugcug

SEQ ID NO: 225716 - RNA, 64 nt, hsa
gaauugacugggacuaauaucacaggaucaaucaucucagaaucuuacuugaugcauuauuuau

SEQ ID NO: 225717 - RNA, 64 nt, hsa
uuucuacgccauucaggaaggcagcacaaauuuaucucagaaagguuccuguguauugcaaggu

SEQ ID NO: 225718 - RNA, 64 nt, hsa
aaaaacuaagguaacuucucagaaagauaucaaaucucagaaagaaugucaaaucagaugaagu

SEQ ID NO: 225719 - RNA, 64 nt, hsa
uucacucacuguggaaauaaaaacuaagguaacuucucagaaagauaucaaaucucagaaagaa

SEQ ID NO: 225720 - RNA, 64 nt, hsa
cccagcauguuucuaccaaagcuuuaucuaagcuucucagaacacucuccuaauaagcagaugu

SEQ ID NO: 225721 - RNA, 64 nt, hsa
acaguaagguggaugguaccuuauggcaaaaaucucucagaaauuuaugugugguuuuaaaguc

SEQ ID NO: 225722 - RNA, 64 nt, hsa
auaauccuagggcagacuaaauucagacgacccaucucagaaugguggaucaaagcagcaaguc

SEQ ID NO: 225723 - RNA, 64 nt, hsa
aggacuaaagggcaaaauucuagagagugguaaaucucagaaagcacaagcauaaaaugcagcu

SEQ ID NO: 225724 - RNA, 64 nt, hsa
augccucuuuuguacauguucauguuuaguguuuucucagaaucagcaacucaagguacuauga

SEQ ID NO: 225725 - RNA, 64 nt, hsa
guuuucuuaaucuuugaaaugcaaauaauguuuaucucagaagacuauuucuaggauuaacuga

SEQ ID NO: 225726 - RNA, 64 nt, hsa
ggauacauuauuuuuucuuucuuucauagcugugucucagaaaggacccauuuguggcucuuuu

SEQ ID NO: 225727 - RNA, 64 nt, hsa
uucuagccaucuaaauugacucuuccaauauaggucucagaaauccaauauuuggaguacaauu

SEQ ID NO: 225728 - RNA, 64 nt, hsa
gcacuccagccugggcgacaagagcaagacucugucucagaaaaaaaaaaaaaaaagagagaga

SEQ ID NO: 225729 - RNA, 64 nt, hsa
gaggaaaaucuauuggcucucgugggucucuucaucucagaaaugccaaucaggucaagguuug

SEQ ID NO: 225730 - RNA, 64 nt, hsa
aucuuggucacugcagaauuuuaaaaggcaaacuucucagaacagaugugcacaucuuaauuug

SEQ ID NO: 225731 - RNA, 64 nt, hsa
cguuagcagcauuagcaccuucugaauuccacccucucagaagaauccacaguguuugaacaau

SEQ ID NO: 225732 - RNA, 64 nt, hsa
gaaauaaacccacagcuccagagaaggugaccauucucagaacuccagcuauucacucuccagg

SEQ ID NO: 225733 - RNA, 64 nt, hsa
ccagacgauuuccacuauucacagcauuuccuuuucucagaaggacucuuuauauuuccaugua

SEQ ID NO: 225734 - RNA, 64 nt, hsa
agaagagaagggcacugagaaaaagcaaaaggcuucucagaaccugguggugcuggccagggag

SEQ ID NO: 225735 - RNA, 64 nt, hsa
acugcacuccagccugggugacagagcgagacuaucucagaaacaaaacaaaacaaaacaacaa

SEQ ID NO: 225736 - RNA, 64 nt, hsa
caggcuuccuccuccucaucagcuauuuuacccaucucagaacguccugugucuccauguagga

SEQ ID NO: 225737 - RNA, 64 nt, hsa
uugauauuuuaagcauuuucccaugucaugaguuucucagaaacauguuuuuaacaauuguacu

SEQ ID NO: 225738 - RNA, 64 nt, hsa
gguguggaggcuguugauguuucuggugucaaguucucagaaguugcugccaccaacucuuuaa

SEQ ID NO: 225739 - RNA, 64 nt, hsa
uucuaaaguccaguacuuuguccagauuuuagauucucagaauaaauguuuuucacagauagac

SEQ ID NO: 225740 - RNA, 64 nt, hsa
auuggccauugccuggcuaaugagaaccccugguucucagaauuuuaaccaaaaggaguuggcu

SEQ ID NO: 225741 - RNA, 64 nt, hsa
gggagaugaggucauuguuugucauugagucuucucucagaaucagcgagcccagcuguagggu

SEQ ID NO: 225742 - RNA, 64 nt, hsa
aaugcuaaauauauggagccauuauuauuuccugucucagaaagucuggcuguuaaagaauguu

SEQ ID NO: 225743 - RNA, 64 nt, hsa
aagggaaaggggugcagcuuccacccuggcaggcucucagaaauuuuuaguuccuuuuuccacc

SEQ ID NO: 225744 - RNA, 64 nt, hsa
aacaaugaccugauucugucuuuaaaaaaaaaaaucucagaauucuuuuuuuguuuguguuuuu

SEQ ID NO: 225745 - RNA, 64 nt, hsa
auuacaggcgugagccaccuugccuggccaaaaaucucagaauucuuuaagacuguuuuaauug

SEQ ID NO: 225746 - RNA, 64 nt, hsa
agauuucacaaauugugcuaagaaccguccguguucucagaaagcccaguguuuuugcaaagaa

SEQ ID NO: 225747 - RNA, 64 nt, hsa
ggcccucuuuuccaguaggaaguuagauggggguucucagaaguggcugauuggaaggggacaa

SEQ ID NO: 225748 - RNA, 64 nt, hsa
cuaaaaaguaguucuuuaguaucaacuuuaauucuacuucuaagaaucauacucuacuucuaag

SEQ ID NO: 225749 - RNA, 64 nt, hsa
aucaacuuuaauucuacuucuaagaaucauacucuacuucuaagaaaauaauuagaaguagaca

SEQ ID NO: 225750 - RNA, 64 nt, hsa
ucuguauacuguacuucuacauacaaauguacuguacuucuacauacaaauguuauguuaaaga

SEQ ID NO: 225751 - RNA, 64 nt, hsa
acaguauauuguaaauucuuaucucuguauacuguacuucuacauacaaauguacuguacuucu

SEQ ID NO: 225752 - RNA, 64 nt, hsa
gagucugauaaaagucuucuuugaaaaaaguuuuuacuucuaagauuugcauuuacaucauaaa

SEQ ID NO: 225753 - RNA, 64 nt, hsa
uuucauuuugcagauguggccauaaaauauuauuuacuucuauauaggugauuuuaccagguuu

SEQ ID NO: 225754 - RNA, 64 nt, hsa
gaaucccuauuccaggauuucugggaauaauguuuacuucuagaaugggccuguuguaaaccau

SEQ ID NO: 225755 - RNA, 64 nt, hsa
caccuuccacgcccgcuuuggggagguucgccccuacuucuaccuggggggugcacggggcgcc

SEQ ID NO: 225756 - RNA, 57 nt, hsa
uaaaagaucuuuuugggugaggugucuuacuucuauuuugaaggauuauuucaguuu

SEQ ID NO: 225757 - RNA, 64 nt, hsa
gauuuacaucuuuauauaguuggcuuggaggaaguacuucuaugggaaagugaacaguucugug

SEQ ID NO: 225758 - RNA, 64 nt, hsa
uuuucucuaaucauuuuuucuauuuuuuuuuuuguacuucuagauguuuugguuauacagcuuc

SEQ ID NO: 225759 - RNA, 64 nt, hsa
gcccuuuuucuccaguaguacaggcuuugaaaacuacuucuauuaaguuauugaugcaauuuga

SEQ ID NO: 225760 - RNA, 64 nt, hsa
ucuuccuguuugaggaaacaaagacuggacacucuacuucuaaggacgccucccauccaccuac

SEQ ID NO: 225761 - RNA, 64 nt, hsa
gcuuagaccccaaugggaaggcccacccucucuuuacuucuaacuuuucuuccuguuugaggaa

SEQ ID NO: 225762 - RNA, 64 nt, hsa
ucagacuggaaggaguuuuuauagucuuugugcauacuucuagguauuacagaaacagucugua

SEQ ID NO: 225763 - RNA, 64 nt, hsa
agauucuugaaggcaaaauuugaaaaacagugaauacuucuaauuguuuccuuuuagugccaga

SEQ ID NO: 225764 - RNA, 64 nt, hsa
uuuauuucugacaucuauucauggacacuuggguuacuucuaccucuggcuauugugaauauug

SEQ ID NO: 225765 - RNA, 64 nt, hsa
guaccccaaaaaguggaacugcuggaucacaugguacuucuaacuuuaauucuuugaugaacug

SEQ ID NO: 225766 - RNA, 53 nt, hsa
aagaaguuggccugcccuaacaauacuucuacagaacguuuguagagauauug

SEQ ID NO: 225767 - RNA, 64 nt, hsa
uauauugauuuaugcuguguacaaauagaauuauuacuucuaguugacuuuuuuuuaaauauac

SEQ ID NO: 225768 - RNA, 64 nt, hsa; identical to SEQ ID NO: 156063

SEQ ID NO: 225769 - RNA, 64 nt, hsa; identical to SEQ ID NO: 156064

SEQ ID NO: 225770 - RNA, 64 nt, hsa; identical to SEQ ID NO: 156065

SEQ ID NO: 225771 - RNA, 64 nt, hsa; identical to SEQ ID NO: 156066

SEQ ID NO: 225772 - RNA, 64 nt, hsa; identical to SEQ ID NO: 156067

SEQ ID NO: 225773 - RNA, 64 nt, hsa; identical to SEQ ID NO: 156068

SEQ ID NO: 225774 - RNA, 64 nt, hsa; identical to SEQ ID NO: 156069

SEQ ID NO: 225775 - RNA, 64 nt, hsa; identical to SEQ ID NO: 156070

SEQ ID NO: 225776 - RNA, 64 nt, hsa; identical to SEQ ID NO: 156071

SEQ ID NO: 225777 - RNA, 64 nt, hsa; identical to SEQ ID NO: 156072

SEQ ID NO: 225778 - RNA, 64 nt, hsa; identical to SEQ ID NO: 156073

SEQ ID NO: 225779 - RNA, 64 nt, hsa; identical to SEQ ID NO: 156074

SEQ ID NO: 225780 - RNA, 64 nt, hsa; identical to SEQ ID NO: 156075

SEQ ID NO: 225781 - RNA, 64 nt, hsa; identical to SEQ ID NO: 156076

SEQ ID NO: 225782 - RNA, 64 nt, hsa; identical to SEQ ID NO: 156077

SEQ ID NO: 225783 - RNA, 64 nt, hsa; identical to SEQ ID NO: 156078

SEQ ID NO: 225784 - RNA, 64 nt, hsa; identical to SEQ ID NO: 156079

SEQ ID NO: 225785 - RNA, 64 nt, hsa; identical to SEQ ID NO: 156080

SEQ ID NO: 225786 - RNA, 64 nt, hsa; identical to SEQ ID NO: 156081

SEQ ID NO: 225787 - RNA, 64 nt, hsa; identical to SEQ ID NO: 156082

SEQ ID NO: 225788 - RNA, 64 nt, hsa; identical to SEQ ID NO: 156083

SEQ ID NO: 225789 - RNA, 64 nt, hsa; identical to SEQ ID NO: 156084

SEQ ID NO: 225790 - RNA, 64 nt, hsa; identical to SEQ ID NO: 156085

SEQ ID NO: 225791 - RNA, 64 nt, hsa; identical to SEQ ID NO: 156086

SEQ ID NO: 225792 - RNA, 64 nt, hsa; identical to SEQ ID NO: 156087

SEQ ID NO: 225793 - RNA, 64 nt, hsa; identical to SEQ ID NO: 156088

SEQ ID NO: 225794 - RNA, 64 nt, hsa; identical to SEQ ID NO: 156089

SEQ ID NO: 225795 - RNA, 64 nt, hsa; identical to SEQ ID NO: 156090

SEQ ID NO: 225796 - RNA, 64 nt, hsa; identical to SEQ ID NO: 156091

SEQ ID NO: 225797 - RNA, 64 nt, hsa; identical to SEQ ID NO: 156092

SEQ ID NO: 225798 - RNA, 64 nt, hsa; identical to SEQ ID NO: 156093

SEQ ID NO: 225799 - RNA, 64 nt, hsa; identical to SEQ ID NO: 156094

SEQ ID NO: 225800 - RNA, 64 nt, hsa; identical to SEQ ID NO: 156095

SEQ ID NO: 225801 - RNA, 64 nt, hsa; identical to SEQ ID NO: 156096

SEQ ID NO: 225802 - RNA, 64 nt, hsa; identical to SEQ ID NO: 156097

SEQ ID NO: 225803 - RNA, 64 nt, hsa; identical to SEQ ID NO: 156098

SEQ ID NO: 225804 - RNA, 64 nt, hsa; identical to SEQ ID NO: 156099

SEQ ID NO: 225805 - RNA, 64 nt, hsa; identical to SEQ ID NO: 156100

SEQ ID NO: 225806 - RNA, 64 nt, hsa; identical to SEQ ID NO: 156101

SEQ ID NO: 225807 - RNA, 64 nt, hsa; identical to SEQ ID NO: 156102

SEQ ID NO: 225808 - RNA, 64 nt, hsa; identical to SEQ ID NO: 156103

SEQ ID NO: 225809 - RNA, 64 nt, hsa; identical to SEQ ID NO: 156104

SEQ ID NO: 225810 - RNA, 64 nt, hsa; identical to SEQ ID NO: 156105

SEQ ID NO: 225811 - RNA, 64 nt, hsa; identical to SEQ ID NO: 156106

SEQ ID NO: 225812 - RNA, 64 nt, hsa; identical to SEQ ID NO: 156107

SEQ ID NO: 225813 - RNA, 64 nt, hsa; identical to SEQ ID NO: 156108

SEQ ID NO: 225814 - RNA, 64 nt, hsa; identical to SEQ ID NO: 156109

SEQ ID NO: 225815 - RNA, 64 nt, hsa; identical to SEQ ID NO: 156110

SEQ ID NO: 225816 - RNA, 64 nt, hsa; identical to SEQ ID NO: 156111

SEQ ID NO: 225817 - RNA, 64 nt, hsa
gagcacugugguagagcacuggcccugccuugagaagagacacaggucucccgucccugcacca

SEQ ID NO: 225818 - RNA, 64 nt, hsa
aucaagaucuuugagggaccaccucacccugcaaaagagacagguccuccaguacccugucuuc

SEQ ID NO: 225819 - RNA, 64 nt, hsa
uauaaauacugauauuucauuccuuuguuuacuaaagagacauauuuaucaguugcagauagcc

SEQ ID NO: 225820 - RNA, 64 nt, hsa
caaugguuuacaugaacacagcugcugaagaggcaagagacagaaugauauccaguaagcacau

SEQ ID NO: 225821 - RNA, 64 nt, hsa
auauuuugguggagaagagguugggcuuuuuugaaagagacaaaaauuuauuauaacacuaaac

SEQ ID NO: 225822 - RNA, 64 nt, hsa
uguuugcauauuaaaaaaagagaaaagagaaagcaagagacagaaaucaggacuaaguccucug

SEQ ID NO: 225823 - RNA, 64 nt, hsa
aagaacugcugucaugaaggaggggccaccuuguaagagacaucauuacuaccagaacuguggu

SEQ ID NO: 225824 - RNA, 64 nt, hsa
uuugcccccuuggaacacauuggucagcaguucuaagagacacugcccacaugauggccauucc

SEQ ID NO: 225825 - RNA, 64 nt, hsa
gaagauguaugcaaagugaaaugccagcccuuuaaagagacauuaguuaguguaaaauggaucu

SEQ ID NO: 225826 - RNA, 64 nt, hsa
uguaaaucauguggcaucuauguauaauaaaagaaagagacaacuauauuacucaauuucauau

SEQ ID NO: 225827 - RNA, 64 nt, hsa
caucuguaauuuacuguugguaagccuagcaguaaagagacauuggucaauugcucugacccug

SEQ ID NO: 225828 - RNA, 64 nt, hsa
aaaauaauguucauaaggagucaauauguaguuuaagagacaaucagugugugucuuauaaaug

SEQ ID NO: 225829 - RNA, 64 nt, hsa
uguaaaaacacauacauggccaaaugcaauacugaagagacaaucauccuguaucuuuuauggu

SEQ ID NO: 225830 - RNA, 64 nt, hsa
aggguaugguuuggucgcuuugguugucaugagaaagagacauucuccuugcagcuaccuccau

SEQ ID NO: 225831 - RNA, 64 nt, hsa
guuggccguccccaggccucccagcgcaaacuucaagagacagggcuuugcugaaaaccaaaca

SEQ ID NO: 225832 - RNA, 64 nt, hsa
cacagcgagacccugucucaagaaagaaaagaaaaagagacaaauuacccagaaaccccucccu

SEQ ID NO: 225833 - RNA, 64 nt, hsa
aaagcauguauauaagagcacguuguaaacuugaaagagacaaaggcacaaauguggcuguuga

SEQ ID NO: 225834 - RNA, 64 nt, hsa
ccccuagacuaggacuccagugcccuccucucccaagagacaaaggccauugcauugaaggagg

SEQ ID NO: 225835 - RNA, 64 nt, hsa
uuuaagucaaccaugauuucuccuugauuucuacaagagacaaagaaaugauuuugccuccugg

SEQ ID NO: 225836 - RNA, 64 nt, hsa
uauaguguugauuucaccaaaaucagagggcugaaagagacacuucuauagacugcauccugag

SEQ ID NO: 225837 - RNA, 64 nt, hsa
gguuucaaugccuaaggacagugaagucuggagcccaaaguacaguuucagcaaagcuguuuga

SEQ ID NO: 225838 - RNA, 64 nt, hsa
ugagcauggcagugccacucaagaaaaugaaucuccaaaguaucuucaaagaauaaauacuaau

SEQ ID NO: 225839 - RNA, 64 nt, hsa
ucaguaacuauccacaaacucaccuuauguuacuccaaaguaauaguaggggauaaacccauag

SEQ ID NO: 225840 - RNA, 64 nt, hsa
uuuaggaaacuagaaaaagaagagcaaauuaaauccaaaguaaccugaaaaaacauuagaguaa

SEQ ID NO: 225841 - RNA, 64 nt, hsa
uuuggaaaacuagaaaaagaagagcaaauuaaauccaaaguaaccuggaaaaaaauuagaguaa

SEQ ID NO: 225842 - RNA, 64 nt, hsa
ucaauaacuauccacaaacucgccuuauguuacuccaaaguaacaguaggggauaaacccauag

SEQ ID NO: 225843 - RNA, 64 nt, hsa
ccccuucccaaaacagaguucauaugcacuuccaccaaaguaaugccaaugaaagugcucgugu

SEQ ID NO: 225844 - RNA, 64 nt, hsa
uccuauccacccaagggagacacuaacagauaggccaaaguagcaagcuaaugaucagucacuc

SEQ ID NO: 225845 - RNA, 64 nt, hsa
gaugacucacaugauggggagucugaaucaaaugccaaaguagcugauguauuggacguucuaa

SEQ ID NO: 225846 - RNA, 64 nt, hsa
cuccugaacaucuaaaagaugaaguuucuaucauccaaaguaugggcuacagaaaccgugccaa

SEQ ID NO: 225847 - RNA, 64 nt, hsa
uuguguguccaguuuggccuccugcccaaacuguccauuccagcagcuccugcccccuucucug

SEQ ID NO: 225848 - RNA, 64 nt, hsa
ccugccccauccucucucugaagccagggcccuuccauuccauuuagccuuuggaucauccugg

SEQ ID NO: 225849 - RNA, 64 nt, hsa
cagauugccuguuucugauuugcugcucuucaucccauuccaggcagccucugucaggccuuca

SEQ ID NO: 225850 - RNA, 64 nt, hsa
uuccuggaauugccagcugacaucuugaauccuuccauuccacacagaaugcaaccaagucaca

SEQ ID NO: 225851 - RNA, 64 nt, hsa
ccucaggucaaaccaagccaagagcacccuguccccauuccaaggggccagcagcacuuuggcc

SEQ ID NO: 225852 - RNA, 64 nt, hsa
ggagggugauggguagagcuuuccagaaccuucuccauuccagaaucucugccccuguguaauc

SEQ ID NO: 225853 - RNA, 64 nt, hsa
ucauccgcacugcccuugggacuuccgaagugaaccauuccaccagaaccuuugauucugcaca

SEQ ID NO: 225854 - RNA, 64 nt, hsa
agggagcacauuuuguggaccugguuccaccuuuccauuccaaaccaccuguuuccccuuccau

SEQ ID NO: 225855 - RNA, 64 nt, hsa
caugugcaaucuuugcuucuuguaggcuaucgccccauuccagcggagacuuauguaggaggga

SEQ ID NO: 225856 - RNA, 64 nt, hsa
aaacaccaggcacccucugccacuuagacauaauccauuccacucauuauuccagcaaacacuu

SEQ ID NO: 225857 - RNA, 64 nt, hsa
ugcaccauuaaaacauuugacuuaaauuguuugaccauuccaguugguguacuguucugauuuu

SEQ ID NO: 225858 - RNA, 64 nt, hsa
uaaaggacugcuucugcccucugccugccagugcccauuccacugugaggugucauucccugca

SEQ ID NO: 225859 - RNA, 64 nt, hsa
cuuccagauugguuuaaccaauuacucguccccgccauuccagggauugauucucaccagcguu

SEQ ID NO: 225860 - RNA, 64 nt, hsa
ugugccucccacugaauggcaguuuccaggaccuccauuccacucaucucuggccugagugaca

SEQ ID NO: 225861 - RNA, 64 nt, hsa
gaaagcaagcaaagauguaaguuuuuuuaauuuagggggaaaaaaugggagccuugcucuccaa

SEQ ID NO: 225862 - RNA, 64 nt, hsa
ucgugagacuuauuuacuaccaugagaacaguaugggggaaacaacuccaugauucaguuaucu

SEQ ID NO: 225863 - RNA, 64 nt, hsa
caggaaaugacauguuaaugcuuugcucccugaagggggaaaaaaucuguccuuuaacaagcua

SEQ ID NO: 225864 - RNA, 64 nt, hsa
acguccagaugcauuacugcuaucuuaguuuaaagggggaaagaaaagggaagaagaaaggaaa

SEQ ID NO: 225865 - RNA, 64 nt, hsa
auagcuuuugaagaaaggccagugauccagcaaagggggaaaaauaugcauuucaccccacaug

SEQ ID NO: 225866 - RNA, 64 nt, hsa
ugcagccagcacaaugugacccaacuuaaaauuugggggaaaaagaaugcaggagugaaauaac

SEQ ID NO: 225867 - RNA, 64 nt, hsa
aggaagguaacuguuauaacccacaccaucagcagggggaaagccaagcugagaauaaacccag

SEQ ID NO: 225868 - RNA, 64 nt, hsa
uguagcucuucgagaaagaaaguucaagucauuugggggaaacuuaagaauagucaucaggguu

SEQ ID NO: 225869 - RNA, 64 nt, hsa
ggaaauaauagggaaaauaccuauuuuauaugaugggggaaaaaaaguaaucuuuaaacuggcu

SEQ ID NO: 225870 - RNA, 64 nt, hsa
uuuuaaagaaaaauaugauacucucagauuuuaagggggaaaacuguucucuuuaaaauauuug

SEQ ID NO: 225871 - RNA, 64 nt, hsa
uccuucaggacagcugcugugcauuagauauuaggggggaaagucaucuguuuaauuuacacac

SEQ ID NO: 225872 - RNA, 64 nt, hsa
uaggucacucgggaagggggaaaaaguuuaaaaugggggaaaaaaagccaucuuuuuaaacaaa

SEQ ID NO: 225873 - RNA, 64 nt, hsa
caucagucuaacaagucauuaggucacucgggaagggggaaaaaguuuaaaaugggggaaaaaa

SEQ ID NO: 225874 - RNA, 64 nt, hsa
ugucggaauuuagccucugaauaccuucuccauugggggaaagauauucuuggaaccacucaug

SEQ ID NO: 225875 - RNA, 64 nt, hsa
uaaaaugugccuaguuuaccaaaauuaacaaagggggggaaaggaccuuagaacuuuuuaaggu

SEQ ID NO: 225876 - RNA, 64 nt, hsa
gguuuuagaaucacugcccuguugagagaaauuagggggaaaugauuacauuuagaagcugcua

SEQ ID NO: 225877 - RNA, 64 nt, hsa
uagcuuuuccagaagcugauucccauuuuaagaugggggaaaauuaagguuugagguuuuagaa

SEQ ID NO: 225878 - RNA, 64 nt, hsa
gcacagguguccugugcuuccugugagacuuccugggggaaauauacaaacuaauauauuuuuu

SEQ ID NO: 225879 - RNA, 64 nt, hsa
gcauccugauauuauaagcuuaaaacuaucuugagggggaaaugacuucuuuucuccuucuguc

SEQ ID NO: 225880 - RNA, 64 nt, hsa
uuggggggcaauaaucaacugaauugcaaaauuugggggaaaauggcacuauccguguacgaau

SEQ ID NO: 225881 - RNA, 64 nt, hsa
ugaucuagaugucuguuuguuguauggaaauuuugggggaaaaaauccaaaacacaaacugugg

SEQ ID NO: 225882 - RNA, 64 nt, hsa
aaaugauugaagagguggaacggaaaugaccuuagggggaaaaaaaaggaccaaagaagucuga

SEQ ID NO: 225883 - RNA, 64 nt, hsa
gugccucugaggcagaaccaaaggagccugcacugggggaaaucccuuuuccugccugccuguc

SEQ ID NO: 225884 - RNA, 64 nt, hsa
caggagugggcagcagucagggagagacagaacugggggaaagggaugguugugggucuuucug

SEQ ID NO: 225885 - RNA, 64 nt, hsa
cagucuauaccagcaugaguacugccccaccccugggggaaaccuggcuccaaccaaccccucc

SEQ ID NO: 225886 - RNA, 64 nt, hsa
acauuauguggaaaacuuaugcugauuuauuuaagggggaaaaagugucaacucuuuguuauuu

SEQ ID NO: 225887 - RNA, 64 nt, hsa
aauuuugaguugccacaggaggggaaguagggaggggggaaauacaguucugcucugguuguuu

SEQ ID NO: 225888 - RNA, 64 nt, hsa
guaauuaaaauuggcauaauaaacacagauuauugggggaaaaggaaaauuagugaucucuucu

SEQ ID NO: 225889 - RNA, 64 nt, hsa
ccagacaucuaguugcaguguucaagaggauuaugggggaaagagauuagagauaauugucuag

SEQ ID NO: 225890 - RNA, 64 nt, hsa
gaaaagaaaucauuuggguuggguggggcgggaugggggaaaaguauauaaugcuugcaccuca

SEQ ID NO: 225891 - RNA, 61 nt, hsa
caaaugacaaaaaaacuugauucacuaauuagggggaaaaaaggugagcauauguuucaau

SEQ ID NO: 225892 - RNA, 64 nt, hsa
acaagauggaggauguccacagaggcugaccugugggggaaaagaagugcucagguaagguugu

SEQ ID NO: 225893 - RNA, 64 nt, hsa
ggccugaggcagggcgggaggcaugcaagccagugggggaaaaccccucugaagcugggcagcc

SEQ ID NO: 225894 - RNA, 64 nt, hsa
aaaagcaaaaugcugugauaaaccaaacagggaagggggaaaaacccuccuccuugggauuuuu

SEQ ID NO: 225895 - RNA, 64 nt, hsa
uaacccgacacggacuuauuuuugucauuagcaagggggaaaaggccaaaggacaagggccucu

SEQ ID NO: 225896 - RNA, 64 nt, hsa
gacuuuagggacucaauuucuccccaggguggaugggggaaauggugccuucaagaccuucacc

SEQ ID NO: 225897 - RNA, 64 nt, hsa
gccuuaaagucaguaacuuacccuuagggaggcugggggaaaagguuagauuuuguauucaggg

SEQ ID NO: 225898 - RNA, 64 nt, hsa
aaaccuaagguuuuuuuuuuuuccguagacaugaccacuuuauuaacugguggugggaugcugu

SEQ ID NO: 225899 - RNA, 64 nt, hsa
auugcucaacuuuaauuaaaaugauugauaauaaccacuuuauuaaaaaccuaagguuuuuuuu

SEQ ID NO: 225900 - RNA, 64 nt, hsa
auuuuguuaacauguauauauguacaacaguguguuuguaaauauauaggaacguuucugaaca

SEQ ID NO: 225901 - RNA, 64 nt, hsa
ggcccugccccuggcuccuuaaaugccccgucucuuuguaaacugauauucagccagcaaugcc

SEQ ID NO: 225902 - RNA, 64 nt, hsa
cucgcagggggcuguggggaggcauaagcugauguuuguaaagcgcuuuguaaauaaacgugcu

SEQ ID NO: 225903 - RNA, 64 nt, hsa
uguggggaggcauaagcugauguuuguaaagcgcuuuguaaauaaacgugcucucugaaugcca

SEQ ID NO: 225904 - RNA, 64 nt, hsa
aaccuuugucaucuguuagacucuguaugugugauuuguaaaaagcaggcugaaacuauggaca

SEQ ID NO: 225905 - RNA, 64 nt, hsa
uuuuugaaccccuaggcuucaggaaaacugcucuuuuguaaaaagaauagcgaugacauuuucu

SEQ ID NO: 225906 - RNA, 64 nt, hsa
guggcauguugauuucuauggccaacuuucucucuuuguaaaacaaagauugauugauuuucuu

SEQ ID NO: 225907 - RNA, 64 nt, hsa
uuuaauacagcagagcauggcaugaccaagcaucuuuguaaaguguuagauggaaaaugcugug

SEQ ID NO: 225908 - RNA, 64 nt, hsa
ggagcuuguggaguugaugacuuucuguuuucuguuuguaaauuauuugcuaagcauauuuucu

SEQ ID NO: 225909 - RNA, 64 nt, hsa
uuggggagggaggggaaauguaauacuggaauaauuuguaaaugauuuuaauuuuauauucagu

SEQ ID NO: 225910 - RNA, 64 nt, hsa
ucagaccucugcauguauauuugauaacaugucuuuuguaaaacaaaaauuacaaaaaaauuug

SEQ ID NO: 225911 - RNA, 64 nt, hsa
aaaauguuaugcaauguuuuccaaacugauaaaguuuguaaagugcuauaaauguauuuuguua

SEQ ID NO: 225912 - RNA, 64 nt, hsa
auuccuauauaguuuauugacaauaauuucagguuuuguaaagaugccggguuuuauauuuuua

SEQ ID NO: 225913 - RNA, 64 nt, hsa
uguggccuaaaaaugcaacuucuuuuuauuuucuuuuguaaauguuuagguuuuuuuguauagu

SEQ ID NO: 225914 - RNA, 64 nt, hsa
acauggugaaacccugucucuacugucucuaacauuuguaaaccugucucuaauuuguaauuug

SEQ ID NO: 225915 - RNA, 64 nt, hsa
cucuaacauuuguaaaccugucucuaauuuguaauuuguaaacccugucucucauauuuguaaa

SEQ ID NO: 225916 - RNA, 64 nt, hsa
ucuaauuuguaauuuguaaacccugucucucauauuuguaaaacuacaaaaauuagcuuggcau

SEQ ID NO: 225917 - RNA, 64 nt, hsa
uucaucuuuuaaagaaauaaccacugcaaguccuuuuguaaagugaagaauccuuuuguagaau

SEQ ID NO: 225918 - RNA, 64 nt, hsa
gaagugcuccccucugaaaguuguacaugaaauuuuuguaaaucacauccuuauccuucaucuu

SEQ ID NO: 225919 - RNA, 64 nt, hsa
auauuuauguucacacaggaauuugguuuacugcuuuguaaauaaaaggaaaaacuccggguau

SEQ ID NO: 225920 - RNA, 64 nt, hsa
gggggggcuuuuuuagguuuuggggcauuuguuuuuuguaaauaagaugauuaugcuuuguggc

SEQ ID NO: 225921 - RNA, 64 nt, hsa
acauuaaauugucaguauuuuuguaagguuccauuuuguaaagagaauaauauucaaagacuuu

SEQ ID NO: 225922 - RNA, 64 nt, hsa
caugauguaggugccacccaccuccugagcuguuuuuguaaaaugacugcugacagcaaguucu

SEQ ID NO: 225923 - RNA, 64 nt, hsa
uuuccccuuuaaaaggaauuagcuauagaacugcuuuguaaagaugcuucuugauauuuuacuu

SEQ ID NO: 225924 - RNA, 64 nt, hsa
gccaaccagcccaaaauuauuucaucuuguauucuuuguaaaauucucccucaccccacccugc

SEQ ID NO: 225925 - RNA, 64 nt, hsa
uucuuuuuccuuuucuuccuuuuuuuuuuuuuuuuuuguaaacacaaaugacauucaguucaau

SEQ ID NO: 225926 - RNA, 64 nt, hsa
acauguuaaaauuagagguaguaaaaugacacauuuuguaaauaacuuuuuguuaaaauucaua

SEQ ID NO: 225927 - RNA, 64 nt, hsa
uugcuauauauacacauguugacugucaucuuguuuuguaaacuccuugcguuguuguucagcu

SEQ ID NO: 225928 - RNA, 59 nt, hsa
uuggagauaccacuguuuaaggaaauaccuuuguaaaccugcagaacauuuuacuuaaa

SEQ ID NO: 225929 - RNA, 64 nt, hsa
cauuagugugcucuucauguuaauauggcagaguuuuguaaacuaaauuaaaacuuacugauau

SEQ ID NO: 225930 - RNA, 64 nt, hsa
uguucacauuucaugaaaccuaugaaacuauauuuuuguaaaauguauuugugacagugaaauc

SEQ ID NO: 225931 - RNA, 63 nt, hsa
guuaaaguuucucuccuuuaaaaauuuuaguacauuuguaaauaguccaugguucucaguguu

SEQ ID NO: 225932 - RNA, 64 nt, hsa
ucuguugccagccugcauugauauaccagucccauuuguaaauauuuacguaccuuuauaaauu

SEQ ID NO: 225933 - RNA, 64 nt, hsa
guuuugugccuugacaaccucucccuaugugagguuuguaaaaaguguccugugacuuaacaca

SEQ ID NO: 225934 - RNA, 64 nt, hsa
uguacugucuuagaauauuauuuauuuuuuuguauuuguaaaucuguggacaaaagaggguuuc

SEQ ID NO: 225935 - RNA, 64 nt, hsa
ucccccuguaccaggccauagcuuugaaguguauuuuguaaauucaacuauagguuagucagaa

SEQ ID NO: 225936 - RNA, 64 nt, hsa
ucuuuugugcuguaucuuuuaagugcaugugaaauuuguaaaauagagauaaguacaguaugua

SEQ ID NO: 225937 - RNA, 64 nt, hsa
auuuguaaaauagagauaaguacaguauguauauuuuguaaaucucccauuuuuguaagaaaau

SEQ ID NO: 225938 - RNA, 64 nt, hsa
guagugaugcuuuccuugguuguacagguguacauuuguaaaccuucaugcuguaaauggaauu

SEQ ID NO: 225939 - RNA, 64 nt, hsa
guaacuguaucaaaaauaaaaagcugucacauauuuuguaaauuuuuaccuuguaaagucacaa

SEQ ID NO: 225940 - RNA, 64 nt, hsa
uaaagcaaaacuauuuauugacuuuauucauccauuuguaaauuuuuuaagguucuuguguaua

SEQ ID NO: 225941 - RNA, 64 nt, hsa
cuguaccccaucaagcuuacucugaaucaaagguuuuguaaaacuuuugaaaaugaacuuagcu

SEQ ID NO: 225942 - RNA, 64 nt, hsa
ucuauaaugaugacucuuggcagcccuuugggaguuuguaaaaugaggugauacaguucugaau

SEQ ID NO: 225943 - RNA, 64 nt, hsa
agaccuugguaaaagaacuauuuuggaaacaguauuuguaaauggaacuaaugcuauauuuaaa

SEQ ID NO: 225944 - RNA, 64 nt, hsa
acauuuuuaauauuuuuuugguuauauccaacuuuuuguaaauauacuggaagcuugauaauaa

SEQ ID NO: 225945 - RNA, 64 nt, hsa
uauaaccugcauaacuuuuugucuuuaagucguguuuguaaaagaaguaauugcuagaaacauu

SEQ ID NO: 225946 - RNA, 64 nt, hsa
uuguuguuaaaugccuaagaaguuuucuaaaaauuuuguaaaggcacugucagagaaucuggag

SEQ ID NO: 225947 - RNA, 64 nt, hsa
cgauguuguauugauuuuuaagaaaguaauuuaauuuguaaaacuucugcucguuuacacugca

SEQ ID NO: 225948 - RNA, 64 nt, hsa
uuauuugaggucaguguuuguuuuugcacaccauuuuguaaaugaaacuuaagaauugaauugg

SEQ ID NO: 225949 - RNA, 64 nt, hsa
gaaaggguccaugaaggaaaguguaugaguugcauuuguaaaaaugagacuuuuucaguggaac

SEQ ID NO: 225950 - RNA, 64 nt, hsa
uuugcauuuucugauguauuacaugacuguuucuuuuguaaagagaaucaacuagguauuuaag

SEQ ID NO: 225951 - RNA, 64 nt, hsa
uauuuguauaaaaauacucaucuuuucagacuuuuuuguaaacccccaguugugaaaacugcag

SEQ ID NO: 225952 - RNA, 64 nt, hsa
auucaggauuauuagccuggacuuggacacagaguuuguaaauaaaggugucugugcagauuuu

SEQ ID NO: 225953 - RNA, 64 nt, hsa
uaaugaauauauuucugcauuuauuuacuucuguuuuguaaauugggauuuuguuaaucaaauu

SEQ ID NO: 225954 - RNA, 64 nt, hsa
acaaugcauuuauauaauauguauacaauauuguuuuguaaauaagugucuccuuuuuuauuua

SEQ ID NO: 225955 - RNA, 64 nt, hsa
cuauagaagcacuuggaaaaugcacuuguccuguuuuguaaaauaaaaagguauuaaaugugua

SEQ ID NO: 225956 - RNA, 64 nt, hsa
cuauaguaauuucuuuuuauauaauaaaaauauauuuguaaagucgacagacaacuuguaauua

SEQ ID NO: 225957 - RNA, 64 nt, hsa
uugauaugggcuuucucuuugguuucucaucacauuuguaaaugucuuuucaaaaggauuuacu

SEQ ID NO: 225958 - RNA, 64 nt, hsa
acauuuguaaaugucuuuucaaaaggauuuacuuuuuguaaaaagcuucauucucacucugcuu

SEQ ID NO: 225959 - RNA, 64 nt, hsa
acuaauuuuuaugaugcaaauuuauacacugauuuuuguaaaggacaaaguuuuaaaagcguau

SEQ ID NO: 225960 - RNA, 64 nt, hsa
ugcaaaugcuuuaacagcugauaaaaauuuuacauuuguaaaauuaauauauuguacugguaca

SEQ ID NO: 225961 - RNA, 64 nt, hsa
acacucagaacuccuuucauaucaagacaaguuauuuguaaaaaauaaagaagggguuuuaaua

SEQ ID NO: 225962 - RNA, 64 nt, hsa
uuuuuaaaaaagguagcauuuuguugacaguuauuuuguaaacauaagcaaauaagggcuugga

SEQ ID NO: 225963 - RNA, 64 nt, hsa
cuauauauguauauauauauguaguaaaccacuuuuuguaaaagaagaaagagcaaaaagcugu

SEQ ID NO: 225964 - RNA, 64 nt, hsa
uaaaaguguguuugaaaaauauuaucuuggguucuuuguaaaauuuauuuuuuacaugcugaau

SEQ ID NO: 225965 - RNA, 64 nt, hsa
ccucgaucuuuuugauuaagagcacaaacuuuuuuuuguaaaacauguaaaaaaaaaaacuggg

SEQ ID NO: 225966 - RNA, 64 nt, hsa
gggcaguuauaaauggacacauugcccagaauguuuuguaaaaugaagaccagcaaauguaggc

SEQ ID NO: 225967 - RNA, 64 nt, hsa
uuuuuuaucacauguagucacaaccuguuuuguuuuuguaaaacauaggaagucucuuuaaugc

SEQ ID NO: 225968 - RNA, 64 nt, hsa
caaguugauucaguguauuacugauuuuuuucuauuuguaaaggauuaugaguuguauaaaaua

SEQ ID NO: 225969 - RNA, 64 nt, hsa
ucaugaaacugguuucuguuuuaugcaguugucauuuguaaagucuaauaaaauauucucuaua

SEQ ID NO: 225970 - RNA, 64 nt, hsa
accacaguuauuacccaaauacuaugaacauauuuuuguaaaccagucauucugaauuauagug

SEQ ID NO: 225971 - RNA, 64 nt, hsa
agagacaccuagcuuagucauggcaaguugccauuuuguaaacuaaggauuuuggacugagauu

SEQ ID NO: 225972 - RNA, 64 nt, hsa
aaauaguagaaaaaucagagucuauaacagaaaguuuguaaaaauauacugauuuugaaaagua

SEQ ID NO: 225973 - RNA, 64 nt, hsa
ucccaagccacaaguagucauucuuagccuugcuuuuguaaaguuaggugacaaguuauuccau

SEQ ID NO: 225974 - RNA, 64 nt, hsa
uuaagccccuuuggaaucucccauuuggaggggauuuguaaaggacacucaguccuugaacagg

SEQ ID NO: 225975 - RNA, 64 nt, hsa
uugcuauaaauagauuuagucuguuauauuuccuuuuguaaaguaaaauauguccagaagaguc

SEQ ID NO: 225976 - RNA, 64 nt, hsa
acauaagcuucucaaugagucaccauucuucuuuuuuguaaaaacuuuuuucuuugaaaugcua

SEQ ID NO: 225977 - RNA, 64 nt, hsa
acgguagucagugacuuaaccugaauuguaaauguuuguaaaggguuaauuguccuacaucaaa

SEQ ID NO: 225978 - RNA, 64 nt, hsa
aaggcauaaguaguuugaagaaugcagcagccuuuuuguaaacuucccagauaucaaaauagac

SEQ ID NO: 225979 - RNA, 64 nt, hsa
uuccuguaggauuuuauuguagaguuuugcugguuuuguaaaauggauggaagaacuuuguauu

SEQ ID NO: 225980 - RNA, 64 nt, hsa
uuuguaacauuuaauaauuacuguuaaaaugcuguuuguaaaugagauuggucuacuuuuuccu

SEQ ID NO: 225981 - RNA, 64 nt, hsa
gguucuucuuuuacccaaucugcuuauagcuuuuuuuguaaacagggaaauguugagugguacu

SEQ ID NO: 225982 - RNA, 64 nt, hsa
auggauugauucaauuaagaccugagugacacuauuuguaaauauaacuaguugugaagcacac

SEQ ID NO: 225983 - RNA, 64 nt, hsa
aggaagugaaauauuuaauucagaaccaaaugcuuuuguaaaacuuuuuggauuuuguaaaagc

SEQ ID NO: 225984 - RNA, 64 nt, hsa
ucagaaccaaaugcuuuuguaaaacuuuuuggauuuuguaaaagcauuuucauucucuuagaaa

SEQ ID NO: 225985 - RNA, 64 nt, hsa
gauuuccagccuuuacugcuuugaagaaacagaauuuguaaagguaugcauguagaacauaaaa

SEQ ID NO: 225986 - RNA, 64 nt, hsa
uugcagucucuuucuaccuucccucuguuagucauuuguaaauucuaaauggucaccauaaaau

SEQ ID NO: 225987 - RNA, 64 nt, hsa
aauugauuugaugaaaauuaguuuuaaguaaauguuuguaaauagauauugguugaauuuuugg

SEQ ID NO: 225988 - RNA, 64 nt, hsa
gguauucugaauauaauaaaagccucacaaauuauuuguaaaauuuaguaguucauauuuagua

SEQ ID NO: 225989 - RNA, 64 nt, hsa
ccuuucuuuuuauaguauauuucuuguaugauauuuuguaaagcucucaccugguucuuuuaug

SEQ ID NO: 225990 - RNA, 64 nt, hsa
aagaaagacaauuggacccuuaagaauuuaugcauuuguaaaguugcuguugauccaaauauuu

SEQ ID NO: 225991 - RNA, 64 nt, hsa
uccauggacaaaauuaggcucacuuaaauuaauuuuuguaaacccaaguaaguucuaaaaaaaa

SEQ ID NO: 225992 - RNA, 64 nt, hsa
gggaaggauaccuggagcacaaggaauaagaucauuuguaaaaauguuuguuuauauagaccua

SEQ ID NO: 225993 - RNA, 64 nt, hsa
uaaauguugacaauauuuacaaguggaaauaaaauuuguaaauauaugaaagaugccuuuccuu

SEQ ID NO: 225994 - RNA, 64 nt, hsa
accuagccaaaaccagaugcggugacuuucuuuuuuuguaaagcaaauuacuuaagaaaauaca

SEQ ID NO: 225995 - RNA, 64 nt, hsa
cugaauuaacacaguauucauucaucuguguuauuuuguaaaaauaacuguagcuuauauucuu

SEQ ID NO: 225996 - RNA, 64 nt, hsa
aaguacuaucuuugucuaaacaagguaauuuuuuuuuguaaagugcaauguccugcaugcauaa

SEQ ID NO: 225997 - RNA, 64 nt, hsa
auuaugaaggaccugaaauaagguauaaggaucuuuuguaaaugagacacauacaaaaaaaauc

SEQ ID NO: 225998 - RNA, 64 nt, hsa
agugaucaagcauuuuuauaagauauuugcaauuuuuguaaauauuuuuggccugcaacuggga

SEQ ID NO: 225999 - RNA, 64 nt, hsa
accaauuuguacauuuuaauuauucaauuucuacuuuguaaaaauagggaaauuauuugaagug

SEQ ID NO: 226000 - RNA, 64 nt, hsa
ugauaaacuuuguagcugccucuuuaaccaagaauuuguaaacacaacucuaauaaaugugagu

SEQ ID NO: 226001 - RNA, 64 nt, hsa
guaauuagaacaaugcacaucugucuuccaagauuuuguaaauauuuuugauuuuuuucauuaa

SEQ ID NO: 226002 - RNA, 64 nt, hsa
cuucaagaaguaagagcuaaguucuaaguucauguuuguaaauuaauacuucauuuggugcugg

SEQ ID NO: 226003 - RNA, 64 nt, hsa
agacauuuuuauuuaguugaaaaaucuaguuuuuuuuguaaacuguaucaaaucuguauauguu

SEQ ID NO: 226004 - RNA, 64 nt, hsa
uuguuucaaaugaaacuuuaaaagacugaaaaauuuuguaaauagguuugauucuuguuagagg

SEQ ID NO: 226005 - RNA, 64 nt, hsa
gacuccaaugccuguacugugucuacugcaccacuuuguaaacacuucaauuuacuaucuuuga

SEQ ID NO: 226006 - RNA, 64 nt, hsa
cugcaugaauuucuuccacaguaaaaauacguuuuuuguaaaggcaauuguacauaauacucau

SEQ ID NO: 226007 - RNA, 64 nt, hsa
gauacuuuuaucuuaaaaguauguuguuaaagauuuuguaaauuguauuucaacaauuuuaaau

SEQ ID NO: 226008 - RNA, 64 nt, hsa
auuuuagacccagaagagaggaguuugcucugaauuuguaaauaagucuuccccauuccucaua

SEQ ID NO: 226009 - RNA, 64 nt, hsa
uaagaugcuuguaaauacuauuuauguuuuuaauuuuguaaaauaaagauuucuuuuuaaccac

SEQ ID NO: 226010 - RNA, 64 nt, hsa
cuuccauacuuuacucccuccuuuuucagacuuguuuguaaaguacagaaucugaauuuagccu

SEQ ID NO: 226011 - RNA, 64 nt, hsa
auaacuuuuuaugggguuuuguuauugguuuuuuuuuguaaagugugaauaaaagguauguuua

SEQ ID NO: 226012 - RNA, 64 nt, hsa
gaaaacaaugcuauuccaugacguuuguaaaauguuuguaaaagcucaaacaugacgauuccau

SEQ ID NO: 226013 - RNA, 64 nt, hsa
ugaauugggaagaaaacaaugcuauuccaugacguuuguaaaauguuuguaaaagcucaaacau

SEQ ID NO: 226014 - RNA, 64 nt, hsa
auuuaaaucucuguacuaugcauuuuuguuucaguuuguaaauguguaacauuuauaguuaaau

SEQ ID NO: 226015 - RNA, 64 nt, hsa
uauucccaaacuguggaaaggacaccuuuuuuuauuuguaaagguggaaaaacuuuggaacuca

SEQ ID NO: 226016 - RNA, 64 nt, hsa
uuauuuagcaauuuuguacaaaaauagcaauuaauuuguaaacacugccagaauacuuucuagc

SEQ ID NO: 226017 - RNA, 64 nt, hsa
gugugggaauuucuuuuccuacgggguacgugauuuuguaaaaaggaaguauuucucccaaaau

SEQ ID NO: 226018 - RNA, 64 nt, hsa
uaaaaaaaaacaaaaaaaagcuuuuaugauggauuuuguaaauagauuuguuacagggugaccu

SEQ ID NO: 226019 - RNA, 64 nt, hsa
uaguacgucucacuugaaauugcuuuguauacauuuuguaaaaauauuuauaaaauguuuugua

SEQ ID NO: 226020 - RNA, 64 nt, hsa
uuguauacauuuuguaaaaauauuuauaaaauguuuuguaaaaaaaaaaaaacuauaacaaauu

SEQ ID NO: 226021 - RNA, 64 nt, hsa
ugucagacugugccuacucugaugguaugugccauuuguaaaauaaaauagagcagaaaaacac

SEQ ID NO: 226022 - RNA, 64 nt, hsa
uagaaauguugcuaucuuuauaagugcaauuuaauuuguaaauagaguuugaaucaaaguauca

SEQ ID NO: 226023 - RNA, 64 nt, hsa
cacaugaaguuugcaacuuuccacccugcccauuuuuguaaaacugcagucaucuuggaccuuu

SEQ ID NO: 226024 - RNA, 64 nt, hsa
gcaaugguuuuguguagcaucuugucuaucauguuuuguaaauacuggagaagcuuugaccaau

SEQ ID NO: 226025 - RNA, 64 nt, hsa
aucuuuugguucuguucacugagcuaaauuuaucuuuguaaaucuuuuugagucuggggggugg

SEQ ID NO: 226026 - RNA, 64 nt, hsa
ugguaauggggggcagaguaagaacuuuuggcauuuuguaaacauuguugaauucucuuucaug

SEQ ID NO: 226027 - RNA, 64 nt, hsa
gacauaaucaucacucaguagguaaaagauaccuuuuguaaaguugucaucucucuguaauaga

SEQ ID NO: 226028 - RNA, 64 nt, hsa
ugaggagcacaauacagagauuuuaaaaagugauuuuguaaaaucuacacuacggucucuguuu

SEQ ID NO: 226029 - RNA, 64 nt, hsa
aaaacucaucaauaaaucaugaaaggcacugaguuuuguaaaucaggacccuaaauguuuaauu

SEQ ID NO: 226030 - RNA, 64 nt, hsa
uucuuacucuggagcaaccuacugucuaagcaguuuuguaaauguacugguaauuguacaauac

SEQ ID NO: 226031 - RNA, 64 nt, hsa
uguuugccauaauuugucaauaaagcugaaaacuuuuguaaaaauuaaauuuggaauuacuugu

SEQ ID NO: 226032 - RNA, 64 nt, hsa
aucuguuaguuagacaaagauguuugauauuaaguuuguaaauuuaauuuuaaugcuguuuuaa

SEQ ID NO: 226033 - RNA, 64 nt, hsa
aacaaauaacagaaacaaaaucuguaaauguuccuuuguaaaacuuguaaauuuuauuuauacu

SEQ ID NO: 226034 - RNA, 64 nt, hsa
gccaagagcucugauauuuuuuaaaaagaauuuuuuuguaaagaucagacaacacacuaucuuu

SEQ ID NO: 226035 - RNA, 64 nt, hsa
uggugacuuuuugagcaccuuucaguauuauguauuuguaaaaaccauuguuuuuggauauaaa

SEQ ID NO: 226036 - RNA, 64 nt, hsa
auuuuuaaaaguaguaagccacauuacauuuaucuuuguaaaaagauuuaugguaacugguuuc

SEQ ID NO: 226037 - RNA, 64 nt, hsa
aacggaggggauggaauucuuccuuagacuuacuuuuguaaaaauguccccacgguacuuacuc

SEQ ID NO: 226038 - RNA, 64 nt, hsa
ugugcccuguaaccugacugguuaacagcaguccuuuguaaacaguguuuuaaacucuccuagu

SEQ ID NO: 226039 - RNA, 64 nt, hsa
aauuucugcauggucuaaaucuuuguguacuuuauuuguaaauuauuugcccuggaguuuuaga

SEQ ID NO: 226040 - RNA, 64 nt, hsa
cagguuaucagagaucaaagauuguaauaauaauuuuguaaauuguaagcaaaaaguuauuuuu

SEQ ID NO: 226041 - RNA, 64 nt, hsa
agaaaagcacccuuuaaauguguaaagacaguguuuuguaaagaauuuuguuuaaaaaguuucu

SEQ ID NO: 226042 - RNA, 64 nt, hsa
guuuuguaaagaauuuuguuuaaaaaguuucuauuuuguaaauacaguacuuaaguuauaugau

SEQ ID NO: 226043 - RNA, 64 nt, hsa
gugggggcgcaaacccuuuuccucccagccuauuuuuguaaauaaaauguuuaaacuugaaaua

SEQ ID NO: 226044 - RNA, 64 nt, hsa
uccuugcaccauuguaauaaaagcuguuagaauauuuguaaauaucuuucugcuguaguguggu

SEQ ID NO: 226045 - RNA, 64 nt, hsa
uuaaauaccaaaagagggaaaauaaaaaagaaccuuuguaaaauauaucugaaccuaaugguuu

SEQ ID NO: 226046 - RNA, 64 nt, hsa
cugccccucuuccuucuuccuucugugacuuaacuuuguaaaggggauauggacaaguaaguaa

SEQ ID NO: 226047 - RNA, 64 nt, hsa
uaaaucuucauaguaauuauaaacauuuguaaaauuuguaaaauacuauaagucauuuugagug

SEQ ID NO: 226048 - RNA, 64 nt, hsa
aggguuuuguaaaucuucauaguaauuauaaacauuuguaaaauuuguaaaauacuauaaguca

SEQ ID NO: 226049 - RNA, 64 nt, hsa
augaguguucgauauuugcuauagguuuuaggguuuuguaaaucuucauaguaauuauaaacau

SEQ ID NO: 226050 - RNA, 64 nt, hsa
cacagaaugaaagggcaucucagccucucugaacuuuguaaaaaucuguccccaguucuuccau

SEQ ID NO: 226051 - RNA, 64 nt, hsa
gugagagauucugugaucuuuuaaaguguuacuuuuuguaaacgacaagaauaauucaauuuua

SEQ ID NO: 226052 - RNA, 64 nt, hsa
aaaauauaaaaaauuuaaauuguccugauucuauuuuguaaauggagaaacaaucauaucuuuc

SEQ ID NO: 226053 - RNA, 64 nt, hsa
ggcuauuucgccuucgcuuuucuuucucgaccuuuuuguaaacccuauaauuaugaagcgauug

SEQ ID NO: 226054 - RNA, 64 nt, hsa
guuugcagaaacuaacucuuuucucacaucaacauuuguaaaauugauguguuauaguggaaaa

SEQ ID NO: 226055 - RNA, 64 nt, hsa
uuuucauauguuugaugaaaacuggcucaagauguuuguaaauagaaucaagagcaaaacugca

SEQ ID NO: 226056 - RNA, 64 nt, hsa
acccuaaacacaguauuucuuuuuaacuuuuuuauuuguaaacuaauaaagguaaucacagcca

SEQ ID NO: 226057 - RNA, 64 nt, hsa
agaacaaacauauuuaugaucaugaauaaugugcuuuguaaaaagauuucaaguuauuaggaag

SEQ ID NO: 226058 - RNA, 64 nt, hsa
gaauuugcaaauauaguguuauauuuuauaaaguuuuguaaaaucccaaacaauauuucuauuu

SEQ ID NO: 226059 - RNA, 64 nt, hsa
aaaguuuuguaaaaucccaaacaauauuucuauuuuuguaaaacaauuguauguauaaucugua

SEQ ID NO: 226060 - RNA, 64 nt, hsa
cugaacucaacaagaucuuggcuguacauaaauauuuguaaaagagacccuuugcaccuuuuua

SEQ ID NO: 226061 - RNA, 64 nt, hsa
ccacuuucuagcucuggagagguuggauuuugcuuuuguaaacacaugaauccuuaugauaaaa

SEQ ID NO: 226062 - RNA, 64 nt, hsa
guaaaugugguaggaaauauaaaucauaugguccuuuguaaaauauacaaauaaucuaacacau

SEQ ID NO: 226063 - RNA, 64 nt, hsa
uuauauauuuuuuaacauuuagcgauuuuuaauguuuguaaaugugguaggaaauauaaaucau

SEQ ID NO: 226064 - RNA, 64 nt, hsa
acuauguuaaugaucaauacuguaaauugggucuuuuguaaacaaaaaggcaaugauguaugca

SEQ ID NO: 226065 - RNA, 64 nt, hsa
uuuucuuuuauuucuucauuguacucuuuuuuuuuuuguaaaguauauguaaaauaaaugugac

SEQ ID NO: 226066 - RNA, 64 nt, hsa
uugauacaauagucaaaauugagugguuuaauguuuuguaaauauuaaguguuuaaaugaaaaa

SEQ ID NO: 226067 - RNA, 64 nt, hsa
gaaugaucugcaagaauuuuuugcauuaauugauuuuguaaauccaggaauauuaggcucuuug

SEQ ID NO: 226068 - RNA, 64 nt, hsa
gccaggaaauguuucucuaacccuuucaaaaguguuuguaaaccaaguucaaaggaaaauagac

SEQ ID NO: 226069 - RNA, 64 nt, hsa
uuuuguaaagaaguauauuuuuaugaaaagaaacuuuguaaaaguaugauguaaauuuucagug

SEQ ID NO: 226070 - RNA, 64 nt, hsa
aacuggcuacuccucuuauauuaaugcauacacuuuuguaaagaaguauauuuuuaugaaaaga

SEQ ID NO: 226071 - RNA, 64 nt, hsa
uaugaugugccuguaaaccaaggaguuuuccccguuuguaaaaagacauuguagauaauugaau

SEQ ID NO: 226072 - RNA, 64 nt, hsa
aaagauaggacugaccugguuuaaaguguucuauuuuguaaaucauuccauuugagucuuucug

SEQ ID NO: 226073 - RNA, 64 nt, hsa
aggugccaaauuccauuuaacuuuuuuacaagucuuuguaaaauuuuaaaugcauaaagggggu

SEQ ID NO: 226074 - RNA, 64 nt, hsa
aaccuauguaacugacauaaucuugaucuuuuaauuuguaaauauugacaauuuucuuucugca

SEQ ID NO: 226075 - RNA, 64 nt, hsa
uugaaauagaaauuugauuguacuauaaaugauuuuuguaaauaauuuauauucugcucuaaua

SEQ ID NO: 226076 - RNA, 64 nt, hsa
uauugagagauauguuuuuaaacuuuuaucaucauuuguaaauguggaaguugguggauugcug

SEQ ID NO: 226077 - RNA, 64 nt, hsa
uugacaacuauucacccuaccucagaucauagaguuuguaaaguuugugucccuccccaguuuu

SEQ ID NO: 226078 - RNA, 64 nt, hsa
uuagagaaaguaacuuacaaccacccauuccggauuuguaaagcaacaugaaaaccuuugauaa

SEQ ID NO: 226079 - RNA, 64 nt, hsa
uuaaugcaaauguuucaaaacuggguuucugauauuuguaaauguguuucuuuauuagauaaga

SEQ ID NO: 226080 - RNA, 64 nt, hsa
cucugugggaaaugugaggaagccuaaguuuguauuuguaaauuucuuaugccauccucuaguc

SEQ ID NO: 226081 - RNA, 64 nt, hsa
aguguuuugcaauuugugaaacaguguauuguguuuuguaaaaugaugucaugaaauggugggu

SEQ ID NO: 226082 - RNA, 64 nt, hsa
gcuggcuguuuaagggaacccagaagugaauucuuuuguaaaguaaagcacccuuuuguaaugc

SEQ ID NO: 226083 - RNA, 64 nt, hsa
cauuugauguaacaaaaugcuauuaaucuaaauauuuguaaauaaaguaccuguaucuagauua

SEQ ID NO: 226084 - RNA, 64 nt, hsa
aggggcuguuuuaugucauguuggcauaaauuguuuuguaaaagggaaaguguuucuaaaggug

SEQ ID NO: 226085 - RNA, 64 nt, hsa
ugcaaucgacaaugugcuaaccugcuuuucucuuuuuguaaacguuuuugcauuacaggcugca

SEQ ID NO: 226086 - RNA, 64 nt, hsa
augucuguuuuguuacauaccuuucaugucgugcuuuguaaaugucuuauuuguguaauaaagu

SEQ ID NO: 226087 - RNA, 64 nt, hsa
acacacacacggaaaaaaaauuguaagcacuuuuuuuguaaaaccaaugucuguuuuguuacau

SEQ ID NO: 226088 - RNA, 64 nt, hsa
uuaauacaauagagacuuuucauuuaacuuuaacuuuguaaauauugaaguguguaauaaagcc

SEQ ID NO: 226089 - RNA, 64 nt, hsa
cugcuuucuuugaacacauacuugaucaaaauuauuuguaaagaacaucuuuccuacuuuuuga

SEQ ID NO: 226090 - RNA, 64 nt, hsa
cugccacuugggccugguuuuagauguuuuuaauuuuguaaaagaaaacaaguauaauaaacuc

SEQ ID NO: 226091 - RNA, 64 nt, hsa
gugagggaaagucaguugagggacacaaaaguguuuuguaaacuauaaaguacguggcaugugu

SEQ ID NO: 226092 - RNA, 64 nt, hsa
guauacucuguacgguucuguaaaccgaaaaacuuuuguaaauauauaaauauacauagacaua

SEQ ID NO: 226093 - RNA, 64 nt, hsa
uuaaaaagcaacaaguuugcacagcuagaguguuuuuguaaauaaauguauuuguauaacacag

SEQ ID NO: 226094 - RNA, 64 nt, hsa
aauaacuaauccuucaaaaauaaguuaaaauguuuuuguaaaauuuucaaaugucagucaaguu

SEQ ID NO: 226095 - RNA, 64 nt, hsa
uaaauuauaaggcaucuuuuuauccuuuuuuguguuuguaaauggauauagacagugguaauaa

SEQ ID NO: 226096 - RNA, 64 nt, hsa
aaaaaggcuuuuaaaauuuuguuuguuuuaaaucuuuguaaaguuauuauuccagagaguauac

SEQ ID NO: 226097 - RNA, 64 nt, hsa
augauagacacagaaagguuugguaacuuuggguuuuguaaaaucagcaaaggcaguguuucaa

SEQ ID NO: 226098 - RNA, 64 nt, hsa
uauuuuauacgaaaacauguuuauuauuuucauuuuuguaaaaggaaguaaaaggucaacauuu

SEQ ID NO: 226099 - RNA, 64 nt, hsa
auauacauuuuucuuaauguuccaacaucuauacuuuguaaagucaaaacauuucccaugagcu

SEQ ID NO: 226100 - RNA, 64 nt, hsa
cccaggugagcccuggauuggcucccagaaggccuuuguaaaaucaguagccguccugcaggca

SEQ ID NO: 226101 - RNA, 64 nt, hsa
cuuggcccagagcuucauucuccuggcuuuuagguuuguaaaagaaaaagggauaucuuuuuua

SEQ ID NO: 226102 - RNA, 64 nt, hsa
uguuuuuaaaacucucugagucucagugacuucauuuguaaaugagagugauucaucuagauga

SEQ ID NO: 226103 - RNA, 64 nt, hsa
uuccucccaaggguucuggcaccuuaugauguacuuuguaaaaaaauugauugaagauuuuaaa

SEQ ID NO: 226104 - RNA, 64 nt, hsa
cacuccccaagucucagagcuuuuagccuggaaguuuguaaaacugauuaguaguuuuacuuua

SEQ ID NO: 226105 - RNA, 64 nt, hsa
uuuguaccaguuucaugaaguaugucuuuggguuuuuguaaauaauuuuaacucaaauaaaauu

SEQ ID NO: 226106 - RNA, 64 nt, hsa
cuuucagguaguuacaucauguuucuucauuggauuuguaaaacuugaagccauaaaaauauua

SEQ ID NO: 226107 - RNA, 64 nt, hsa
agcuguaaccugacuauccuuuguguuuacuguuuuuguaaauuuuuuuccucuauaaaugaaa

SEQ ID NO: 226108 - RNA, 64 nt, hsa
uaaauaauuucaauuuggggcaguuauucugcuuuuuguaaagccguggccaauugucuccugu

SEQ ID NO: 226109 - RNA, 64 nt, hsa
gauguauagcccuguauacaguguagauacuauuuuuguaaaaacacaaggcuaaauuaaugaa

SEQ ID NO: 226110 - RNA, 64 nt, hsa
agcugucguucaguuaagcuuaaagauagguuaauuuguaaauggcaaaguuuguuuugagguu

SEQ ID NO: 226111 - RNA, 64 nt, hsa
cuguagcuuuucagaagaagcaauuuaccuuggauuuguaaaucaagcugaaacuuuuuugaug

SEQ ID NO: 226112 - RNA, 64 nt, hsa
auuuugaaucagagaauacuuggccaagcucguauuuguaaacuaaaaccccuuguuauuugua

SEQ ID NO: 226113 - RNA, 64 nt, hsa
uucccccuauucaguuuuaaucuuggaauaugcauuuguaaauugugaugucauugagacuaua

SEQ ID NO: 226114 - RNA, 64 nt, hsa
uuauaagaaauaaaagcauuauugggugccuuuguuuguaaaccaaaaaguaauaaaugaaucc

SEQ ID NO: 226115 - RNA, 64 nt, hsa
uuuuuuguguuuuguucuuuaaagucagguccaauuuguaaaaacagcauugcuuucugaaauu

SEQ ID NO: 226116 - RNA, 64 nt, hsa
cauguagauccuguuugacauuuuuauggcuguauuuguaaacuuaaacacaccagugucuguu

SEQ ID NO: 226117 - RNA, 64 nt, hsa
ugcuuguauguauaaauccuaugaauagagggcuuuuguaaauuaugcauuuauuguaauuauc

SEQ ID NO: 226118 - RNA, 64 nt, hsa
uauuuuucuuauguaaaucaucuuuuuacauuuguuuguaaacauguuuaaagaacgaaccuag

SEQ ID NO: 226119 - RNA, 64 nt, hsa
aaauauuacuuauccaucagguuucucuuugguuuuuguaaacggagaggacaguucuuagucc

SEQ ID NO: 226120 - RNA, 64 nt, hsa
ccaguaaaaauaugcagauuguauguaaugaauuuuuguaaacaaagguaauuucugucaaaug

SEQ ID NO: 226121 - RNA, 64 nt, hsa
auuugauuuuuuuaaaaacauggaaacguacuguuuuguaaauucuuuuuaacugcacaucuac

SEQ ID NO: 226122 - RNA, 64 nt, hsa
caagagcugcugcuauaacuuccaguuuuacaucuuuguaaaauuguaucucaaaggcagaaaa

SEQ ID NO: 226123 - RNA, 64 nt, hsa
cuuuugauguuugaaguuacaaaccuguaauuuuuuuguaaaggaaauaauugccaaauaccua

SEQ ID NO: 226124 - RNA, 64 nt, hsa
uguguguuguaacaaauauauugcaaaaacauaguuuguaaaggcauucuauaagcuauuuaug

SEQ ID NO: 226125 - RNA, 64 nt, hsa
uaacaacuaaaucaaaaucacccuuuuuuuuuuuuuuguaaagcuuuccaggugguucuaaagg

SEQ ID NO: 226126 - RNA, 64 nt, hsa
cuagguacauaguaaguguaugauagauguuugauuuguaaauuacaaauauaaauuaucaccc

SEQ ID NO: 226127 - RNA, 64 nt, hsa
gaagaguagaauuccaagaaaaaugagaaauaauuuuguaaaacuuaacaaaaucacuaaauua

SEQ ID NO: 226128 - RNA, 64 nt, hsa
uuugucaugugauuuuugagucucaauuuaaggcuuuguaaaaugaagaguagaauuccaagaa

SEQ ID NO: 226129 - RNA, 64 nt, hsa
gaucacucuguucucuuuguuuuaaagagagaauuuuguaaaccauuuauugaauguucugauc

SEQ ID NO: 226130 - RNA, 64 nt, hsa
ucuaaaucaugcuguuucugaaacagcuuccuaguuuguaaauagacuuacuugguauauuuuu

SEQ ID NO: 226131 - RNA, 64 nt, hsa
gccaaagaucauuuuuuuauauagacuucagcccuuuguaaauauuguaacuggggaguauaga

SEQ ID NO: 226132 - RNA, 64 nt, hsa
cagacaaaguagaaacugugcugcaugauguuauuuuguaaacagaugacauuuucugaccagg

SEQ ID NO: 226133 - RNA, 64 nt, hsa
uaaauuuugugcccagcaagcuguuaguuuuauuuuuguaaagguauguaaguuauuaaauggu

SEQ ID NO: 226134 - RNA, 64 nt, hsa
ggacucaccauaacauugucaguucuaaugaaauuuuguaaaagauggcaaguuuguuaccuca

SEQ ID NO: 226135 - RNA, 64 nt, hsa
cagggugcuuuuauauauaagagcagcagccgccuuuguaaagugugaucuaugagaauuggag

SEQ ID NO: 226136 - RNA, 64 nt, hsa
accucacugcacgcaucgaaggaucugauuugaauuuguaaaggcaauucuuuugagagcagga

SEQ ID NO: 226137 - RNA, 64 nt, hsa
uggauaaaucuauuuuuuaacaaucuuuuuauuauuuguaaaagauauaaaaacaacucccauc

SEQ ID NO: 226138 - RNA, 64 nt, hsa
uccaccuggccgccuccauggacccuugguggcuuuuguaaauuaauuuuugaugacauuuuga

SEQ ID NO: 226139 - RNA, 64 nt, hsa
uaagauuucugaccagcagucucuuaccuguauauuuguaaauauaucauguuucugugaaaau

SEQ ID NO: 226140 - RNA, 64 nt, hsa
cauaugauagcuugugcugauuaauuuaaccccauuuguaaacagaugaaaauuuuauuuucuu

SEQ ID NO: 226141 - RNA, 64 nt, hsa
gacauugaguugugacuucuauauucaauagauuuuuguaaauguuaaaacaucuauauuuaaa

SEQ ID NO: 226142 - RNA, 64 nt, hsa
aucaucuuauguaccacuaauaugcccagcacauuuuguaaaacaguccugauuuggccuccaa

SEQ ID NO: 226143 - RNA, 64 nt, hsa
cauacccaaaacuccuugacuagaacuaucuccuuuuguaaaggauuuugagauaucaggcauu

SEQ ID NO: 226144 - RNA, 64 nt, hsa
cacagaggcugugugugcccuacacugaccaggguuuguaaaacccuuucauucugguacaaga

SEQ ID NO: 226145 - RNA, 64 nt, hsa
gccaucagauauggaugccuucuaacaauugcuguuuguaaaauaaaucaggaugguagaaagu

SEQ ID NO: 226146 - RNA, 64 nt, hsa
caccaggaggaucccuaugacucaaaauaacuuguuuguaaaagaaaauuuguuuacuuaccca

SEQ ID NO: 226147 - RNA, 64 nt, hsa
uuaaaugaaauggggagauauuuacauuccguacuuuguaaacuugagcuauuggacuucacug

SEQ ID NO: 226148 - RNA, 64 nt, hsa
uauuuuagccacugagccuuuuauuauuugucuauuuguaaaguuuauuugucuuaacucauuu

SEQ ID NO: 226149 - RNA, 64 nt, hsa
agcauacauguuuuccuuuuguuuuugaaacuuguuuguaaacauaaauaaauaugcccuuuua

SEQ ID NO: 226150 - RNA, 64 nt, hsa
auauacacgaauagacaucaaacucaaugcuuuauuuguaaauuuaguguuuuuuuauuucuac

SEQ ID NO: 226151 - RNA, 64 nt, hsa
uacuuccaugaauuuuaaaaucugagggaaauguuuuguaaacauuuauuuuuuuuaaagaaaa

SEQ ID NO: 226152 - RNA, 64 nt, hsa
augguuucuacuuuauggaauuauauggucaauauuuguaaauauucuaugaguuuuggguggg

SEQ ID NO: 226153 - RNA, 64 nt, hsa
cuguccuuuugacauacagcuaaaagggacuaaauuuguaaaaaauuaguuuguuauaguugaa

SEQ ID NO: 226154 - RNA, 64 nt, hsa
uaguguagauuuuuuuaaaguucacauacacuuuuuuguaaaaugagaauaauguuuauuuccu

SEQ ID NO: 226155 - RNA, 64 nt, hsa
auugucucaauuuguacaguuuguaauuguaauuuuuguaaauaaauuuguuuguacauuguau

SEQ ID NO: 226156 - RNA, 64 nt, hsa
uaguuaauuuguucuuaccaaaaaauaaaauuacuuuguaaauagcaguucacauuuuuccaca

SEQ ID NO: 226157 - RNA, 64 nt, hsa
aguggacacuuguaagucaaucaguguuaaaguauuuguaaauagaagcaagcuauuauuaaca

SEQ ID NO: 226158 - RNA, 64 nt, hsa
acugaccaagauguuggggugggggggauuguuuuuuguaaaaaugucauuaucaggucacaua

SEQ ID NO: 226159 - RNA, 64 nt, hsa
ccacgucguguuucacaugucggagucgaaugcauuuguaaaucccuaagucaaguaggcuggc

SEQ ID NO: 226160 - RNA, 64 nt, hsa
augucauugucuacugcauaguuuccugagucuguuuguaaagugcuuauggcuaacaguucag

SEQ ID NO: 226161 - RNA, 64 nt, hsa
uuugagauacuagguuuuaucaccugcugcuguauuuguaaacaaagacaaauguugcuuuaag

SEQ ID NO: 226162 - RNA, 64 nt, hsa
cagaaaauaaaauauucacucuccauuagaaaauuuuguaaaacaaugccaugaacaaauucuu

SEQ ID NO: 226163 - RNA, 64 nt, hsa
cuuugauaacaaaaaauaaauuuuaaaaaggaauuuuguaaaguuucuagaauuuuauaucauu

SEQ ID NO: 226164 - RNA, 64 nt, hsa
cuaggauaauuuuuuuuucauauuugccaaaauuuuuguaaacccugucuugucaaauaagugu

SEQ ID NO: 226165 - RNA, 64 nt, hsa
aagacuaguuucuucagggcaguggacguaguaguuuguaaaaacguuuucuaugacgcauaag

SEQ ID NO: 226166 - RNA, 64 nt, hsa
uuuauuaauuuaaaauagaacgcuugagaggcacuuuguaaagauuuguuaaacuggaaacguu

SEQ ID NO: 226167 - RNA, 64 nt, hsa
cagaaaaugacaggacugggcaaauuaacaaauguuuguaaacaugaauguucaggaacuacug

SEQ ID NO: 226168 - RNA, 64 nt, hsa
auuuuaaacuugugauaggcauaucuaugaaaccuuuguaaauuuaguuuauugcuuuaccauu

SEQ ID NO: 226169 - RNA, 64 nt, hsa
uguuuguauuuucaacuggaguacauguauuuucuuuguaaaguagcuuccuaugaaaaugugg

SEQ ID NO: 226170 - RNA, 64 nt, hsa
acugcaguuacuauuuacuaauguaaacguaggguuuguaaaagucacaaacuuauaagcaaug

SEQ ID NO: 226171 - RNA, 64 nt, hsa
uacugaagguggccaccuccacucuaaaugacauuuuguaaauaguaaaaaacugcuucuaauc

SEQ ID NO: 226172 - RNA, 64 nt, hsa
guuccuccccuaauccucuauuuuauuuuuauuuuuuguaaagccaaguagcuuuaagauaaag

SEQ ID NO: 226173 - RNA, 64 nt, hsa
gaaauuauuuguguugaguggaaaaaaaucaguuuuuguaaagaugucaguaacauuccacauc

SEQ ID NO: 226174 - RNA, 64 nt, hsa
uuccccagaguacuacuuacauuuuaaauuucauuuuguaaaguuaaaugucagcauucccuuu

SEQ ID NO: 226175 - RNA, 64 nt, hsa
aggaccagcaauaauaccuuguaaguugcuuuuguuuguaaaaucugagcuuauaguuuuccuu

SEQ ID NO: 226176 - RNA, 64 nt, hsa
ugggguuuuuuuguuuguucagacagucuguucuuuuguaaacauuuuuaguuggaaaaacagc

SEQ ID NO: 226177 - RNA, 64 nt, hsa
cggccccggccgccccuccucgugaaagugcauuuuuguaaauguguacauauuaaaggaagca

SEQ ID NO: 226178 - RNA, 64 nt, hsa
gaaaacaauggaguauucucggauaguugcuauuuuuguaaaguuuccgugcguggcacucgcu

SEQ ID NO: 226179 - RNA, 64 nt, hsa
ucucuacuuuucccuguacuuuucccauuuguaauuuguaaaauguucucuuaugaucaccaug

SEQ ID NO: 226180 - RNA, 64 nt, hsa
auuuguaaaauguucucuuaugaucaccauguauuuuguaaauaauaaaauaguaucuguuaaa

SEQ ID NO: 226181 - RNA, 64 nt, hsa
ugggacaaguaauaaaacaacugcuugaguuuuguuuguaaaauacauaauuaauauuugaccu

SEQ ID NO: 226182 - RNA, 64 nt, hsa
gugcauuaacuguugaauucacuuuugugccauuuuuguaaauacaguaguuuugcacaaccuc

SEQ ID NO: 226183 - RNA, 64 nt, hsa
uuguauugauuucuucuguauuuaccuuuuggauuuuguaaaacagaaguuuaagaccacaagu

SEQ ID NO: 226184 - RNA, 64 nt, hsa
agaaguuccagacagaugagaaagcaaaaaguacuuuguaaaguguuauacaaucagaaggugc

SEQ ID NO: 226185 - RNA, 64 nt, hsa
ugauccucaaggaacuugcaaaugugucuaugaauuuguaaaacaaucaaaaguaggcguaagc

SEQ ID NO: 226186 - RNA, 64 nt, hsa
auuuuaucaaaccaaauguuaaaaagacuuuccuuuuguaaaacuggauuagagaagacuuuuc

SEQ ID NO: 226187 - RNA, 64 nt, hsa
aaauuuucuuagauuuggucaucaucaggaagcauuuguaaaaauaaaaaucuccacaaauuac

SEQ ID NO: 226188 - RNA, 64 nt, hsa
uccuaauaaaggagaaaugcauguuuauggcuuuuuuguaaauauaaaugcagugaucuauggc

SEQ ID NO: 226189 - RNA, 64 nt, hsa
ucuauggcuuaaaaaauuuguuucugugacaauguuuguaaaucuagccaauagagucauuuac

SEQ ID NO: 226190 - RNA, 64 nt, hsa
aacuguuucccccucaaaaccugaaccugaauuauuuguaaaaacugaaauuuaaugauuaaag

SEQ ID NO: 226191 - RNA, 64 nt, hsa
ggaacuaagcaguuuguaaacuuucauccuuuuuuuuguaaauucacaaagcuuuggaaggaga

SEQ ID NO: 226192 - RNA, 64 nt, hsa
uucucaccucuuaugcuuaguuggaacuaagcaguuuguaaacuuucauccuuuuuuuuguaaa

SEQ ID NO: 226193 - RNA, 64 nt, hsa
uuaucauaugcagucacuucuuuguaaaugauuuuuuguaaagucauuggauauaaaagaguga

SEQ ID NO: 226194 - RNA, 64 nt, hsa
uuggcacaaauauuuuaucauaugcagucacuucuuuguaaaugauuuuuuguaaagucauugg

SEQ ID NO: 226195 - RNA, 64 nt, hsa
auaugugugugacuugaguaauguuaucaacguuuuuguaaauauuuacuauguuuuucuauua

SEQ ID NO: 226196 - RNA, 64 nt, hsa
uuagauucauuuugggaaaucuccauaauuucaauuuguaaacuuuguuaagaccugucuacau

SEQ ID NO: 226197 - RNA, 64 nt, hsa
aaaaaaaaauaaaauuauuuugaauuauucuaccuuuguaaacaauuggcuaaaagaaucaucu

SEQ ID NO: 226198 - RNA, 64 nt, hsa
aauacaugaucuugaacagcuccuguacuugcucuuuguaaaaaaaaauaaaauuauuuugaau

SEQ ID NO: 226199 - RNA, 64 nt, hsa
aauuuagagucacugauauuacgagaggggucuuuuuguaaaccuccuuuucaaugucaaagcg

SEQ ID NO: 226200 - RNA, 64 nt, hsa
uggaugugcaugaagcucuuguuuucgauguguguuuguaaagggaaaauuaguacucugcucg

SEQ ID NO: 226201 - RNA, 64 nt, hsa
ucauauuguguggcugaucugaagucagucggaauuuguaaacaggguagcaaacaagauauuu

SEQ ID NO: 226202 - RNA, 64 nt, hsa
auugcaacaacacuuuacuaccuaacggauagcauuuguaaauacucuagguaucuguaaacac

SEQ ID NO: 226203 - RNA, 64 nt, hsa
caacaacaaacauuuuuaaaauuaaaauggauaauuuguaaauaguuuuuagcuuuuaaaauuu

SEQ ID NO: 226204 - RNA, 64 nt, hsa
agcaguuuuugagaauguguuugauaucacaguguuuguaaauucuaugaaaaaugcauuuucc

SEQ ID NO: 226205 - RNA, 64 nt, hsa
uuucuccccccuaagguuacaugugagucaaaauuuuguaaaauauaaccucacauaagaacca

SEQ ID NO: 226206 - RNA, 64 nt, hsa
uguuuaaacuuuuuuuuauucuuuugaaaaaugauuuguaaauugagggucauaguucagcauc

SEQ ID NO: 226207 - RNA, 64 nt, hsa
ugugugaaaucuaagcaguaauguacuuucucccuuuguaaagacuuggggaguaaggacauua

SEQ ID NO: 226208 - RNA, 64 nt, hsa
aaaugugacuaaaauauagcagaaauucagguuguuuguaaaaauuuuaauaacaaauagcauu

SEQ ID NO: 226209 - RNA, 64 nt, hsa
acacuguaucuuauuaaaauaggaugauuugcauuuuguaaaauuauccugcacaucaagcugc

SEQ ID NO: 226210 - RNA, 64 nt, hsa
agaaaucuacaaauguaugucauaaauaagcaaauuuguaaacuuuucugaacuuuagugaaac

SEQ ID NO: 226211 - RNA, 64 nt, hsa
aggauuuguaaagcuuugcucaaaguugugugcauuuguaaacacuaucaugauauuuucaauu

SEQ ID NO: 226212 - RNA, 64 nt, hsa
uuauuuucucauuugcuuuguaugguaugaaggauuuguaaagcuuugcucaaaguugugugca

SEQ ID NO: 226213 - RNA, 64 nt, hsa
cagaaguugcugcuuuguuugucuaauugacucauuuguaaaugagcagaacuguuuuguuggu

SEQ ID NO: 226214 - RNA, 64 nt, hsa
cauaaaugauuuuggcauaccauuagagaaaccauuuguaaaacucaaaugaccacauaaagcu

SEQ ID NO: 226215 - RNA, 64 nt, hsa
augaccagcaguugguaugaagaaccuuugacauuuuguaaaaggccauuucuugggaguuuuu

SEQ ID NO: 226216 - RNA, 64 nt, hsa
guugauguaugucccaaguuuugaugaaacuguauuuguaaaaaaaauuuuguaguuuaaguau

SEQ ID NO: 226217 - RNA, 64 nt, hsa
ggacaauguuuugcaauauauaaaucauucuauuuuuguaaauuguauaucacuuuaauugaaa

SEQ ID NO: 226218 - RNA, 64 nt, hsa
guaagaugaaauauuaugcuauuauaugaugcuguuuguaaagguauuaauguacuaguaaggu

SEQ ID NO: 226219 - RNA, 64 nt, hsa
aaaguuuagaaacuucauaugugucaucacagcuuuuguaaagaaaguauccuuaauauuuuau

SEQ ID NO: 226220 - RNA, 64 nt, hsa
uauuccuucuacauuuauuuuaaaauaaguuuauuuuguaaaaacaugcauaaacugucuuagc

SEQ ID NO: 226221 - RNA, 64 nt, hsa
gcuggguuagagaugaggcaccuuuuauauuauauuuguaaaagaaccacagcagcuauuuugg

SEQ ID NO: 226222 - RNA, 64 nt, hsa
cacaggaugcugaaagcuauguuacuauucuuaguuuguaaauuguccuuuugauaccaucauc

SEQ ID NO: 226223 - RNA, 64 nt, hsa
cugcccaccaaaaugauccagucuggaauaacauuuuguaaaaaaaaaaaaaauauauauauau

SEQ ID NO: 226224 - RNA, 64 nt, hsa
uaaaauauuugugcaaagcuauuaauauacacauuuuguaaaaaaaaaaaaaaaacacguauau

SEQ ID NO: 226225 - RNA, 64 nt, hsa
ccugcuuuccuuuuuacauuuauuaaaaguggauuuuguaaaagcauuucauugacacgcgacc

SEQ ID NO: 226226 - RNA, 64 nt, hsa
cuuugcuaauaucuguguuuuucagauuucauuuuuuguaaaaucagaaauuaaucuaaacaua

SEQ ID NO: 226227 - RNA, 62 nt, hsa
caaugaaucauuguucaaccuugaaaaauaaaauuuuguaaaacaucgguugaugucauuau

SEQ ID NO: 226228 - RNA, 64 nt, hsa
acaggucuuucaaagucauucucaauauucagcuuuuguaaauuaucaagcuucaaaaagcuuu

SEQ ID NO: 226229 - RNA, 64 nt, hsa
uuuugcaacucauguuauggguuaaaugaauauuuuuguaaaaguaaaagcaacaaauuuauaa

SEQ ID NO: 226230 - RNA, 64 nt, hsa
gaaagcuauauacuugugcuaucuaaagcacuacuuuguaaagaugacuacccaagauuguaaa

SEQ ID NO: 226231 - RNA, 64 nt, hsa
augauugugcaaaaagucacguguaaauugaacuuuuguaaaucaaauuguauuuuaaaugcau

SEQ ID NO: 226232 - RNA, 64 nt, hsa
aaauaaaggcgauagcugacuuucauuuggggcauuuguaaaaaguagauuaaaauauuugccu

SEQ ID NO: 226233 - RNA, 64 nt, hsa
uuugcuaucugaacuaauucauuuauuaaguauauuuguaaaagcuaaggcucgaguuaaaaca

SEQ ID NO: 226234 - RNA, 64 nt, hsa
gcucgaguuaaaacaaugaaguguuuuacaaugauuuguaaaggacuauuuauaacuaauaugg

SEQ ID NO: 226235 - RNA, 64 nt, hsa
uguuuucaaugaauuaagaaagauuaaauauaucuuuguaaauuauuuuaugucauaguuuaau

SEQ ID NO: 226236 - RNA, 64 nt, hsa
aguauaagaaauuuuauuagacauucucuuacuuuuuguaaaugcuguaaauauuucauaaauu

SEQ ID NO: 226237 - RNA, 64 nt, hsa
cuuugaggagcucacuguuuaguuggggaaaccauuuguaaaacagccauuaaccauacagugu

SEQ ID NO: 226238 - RNA, 64 nt, hsa
ggugguuaucaaccuuggcugcgcaucagaaucguuuguaaagcuuuuucuuuuuccuuuuuaa

SEQ ID NO: 226239 - RNA, 64 nt, hsa
gaaaaaucaaguauuauaaacaagaaugaagguuuuuguaaagauuucuguucagcguuuugca

SEQ ID NO: 226240 - RNA, 64 nt, hsa
cuguuuuuaaaaauuagccuaagauauacuuguuuuuguaaagaaaaauauuuaauguugaaca

SEQ ID NO: 226241 - RNA, 64 nt, hsa
acaaguacaaacauugaacaauuaccuauaaagauuuguaaaaguaaaauuuuuccaauagauu

SEQ ID NO: 226242 - RNA, 64 nt, hsa
ucuguauauuaccucguaccagugcuucauccuauuuguaaaaucuuucuccuuuaaaauuauu

SEQ ID NO: 226243 - RNA, 64 nt, hsa
aaauauauugaauguacagaaaggaaauauucagagacuuuagcauugggggcagauaucuugg

SEQ ID NO: 226244 - RNA, 64 nt, hsa
ugccaugaggccauuuucagacaaguuaaaaaguagacuuuaagagaucaaacucagccuauuc

SEQ ID NO: 226245 - RNA, 64 nt, hsa
auauuacacuacaguuuacuuuucagaauacuaaagacuuuauaacugcaugaacuuggauuuu

SEQ ID NO: 226246 - RNA, 64 nt, hsa
auuuccauaaagaaaacucaaguauuaauaaaagagacuuuacuggcuuaagagggcugugaaa

SEQ ID NO: 226247 - RNA, 64 nt, hsa
agcccuccuggaauggagcuguauaacugugcagagacuuuauccaugccaauaguugcugucc

SEQ ID NO: 226248 - RNA, 64 nt, hsa
ccaaacuucuuguucaaaacggggggaguuuaggagacuuuaaucccgguuucagaagcugcag

SEQ ID NO: 226249 - RNA, 64 nt, hsa
aauuugaaaaacgucuuuagaugaccaagcaaaaagacuuuaaaaaaugguaaugaaaauggaa

SEQ ID NO: 226250 - RNA, 64 nt, hsa
ugaagaauaaaauugauuaaagguuuuuuuggugagacuuuauuuaaugcacaucugucuuaaa

SEQ ID NO: 226251 - RNA, 64 nt, hsa
cauuauuccuuuucagucacuguacgaacacggcagacuuuagccuacacaguagacuguguua

SEQ ID NO: 226252 - RNA, 64 nt, hsa
agucacauugauguaaggacuguaaacaucagcaagacuuuauaauuccuucugccuaacuugu

SEQ ID NO: 226253 - RNA, 64 nt, hsa
uauuaacuuuacuuuuuuuaaaucaacuugcuauagacuuuauauacauuuuguuaaauauagu

SEQ ID NO: 226254 - RNA, 64 nt, hsa
ucuggaaagcauagacauuuuuuacacucuggauagacuuuauucuugaagaucaucagaaaug

SEQ ID NO: 226255 - RNA, 64 nt, hsa
caaccugaagaaaauaucaauuuuuaauugacaaagacuuuauaucuuagugauuuuaguuuug

SEQ ID NO: 226256 - RNA, 64 nt, hsa
uguacgaaaagguuuggaguucauuuuuguggaaagacuuuaaauugguguuagaaccacuaaa

SEQ ID NO: 226257 - RNA, 64 nt, hsa
aaaaaauaaaaaauaaaaaaauaaaaaaaaaauaagacuuuaacugcaguuccaaagcuucucu

SEQ ID NO: 226258 - RNA, 64 nt, hsa
gaaagcauuuucuagguguguuuaguguacaaagagacuuuauaacccuuacuggacaacacac

SEQ ID NO: 226259 - RNA, 64 nt, hsa
uuuaauuuuauugugaucucuuaaagcagagguuagacuuuaccuuucugacucugucguccag

SEQ ID NO: 226260 - RNA, 64 nt, hsa
cugggauuacaggcaugagccaccacgcccggcuagacuuuaccuuucuaaagaaauuguuuac

SEQ ID NO: 226261 - RNA, 64 nt, hsa
aguuuuguaaaaaccuuuuucagucaaacaguaaagacuuuauuuauggauuguaauaacaacc

SEQ ID NO: 226262 - RNA, 64 nt, hsa
ccccucuuuuugucagugcauugggaauagggauagacuuuacagauuuauggaaauuaaauuu

SEQ ID NO: 226263 - RNA, 64 nt, hsa
ucuuaucuuuugguguugucuugguuuuucucauagacuuuauaaguuugaacuggacuuauuu

SEQ ID NO: 226264 - RNA, 64 nt, hsa
ucaguaucuuuaguucuuccuaccuaguaacuugagacuuuaaaagaagaaacauggagaagau

SEQ ID NO: 226265 - RNA, 64 nt, hsa
uuugcugucuacagccaacuauucuauuaguuacaaaacucaaucauuuuauucagcaacugga

SEQ ID NO: 226266 - RNA, 64 nt, hsa
ucaucaaaaaaauaaaguaaaauagaaaacugagaaaacucaauccaugaccagggagaacuua

SEQ ID NO: 226267 - RNA, 64 nt, hsa
agcccauguucucuaaugccacugcucuguuuuaaaaacucagaggcaauuuuuacauaucagu

SEQ ID NO: 226268 - RNA, 64 nt, hsa
gguaguagaggauuagguugucuauuauaaaaccaaaacucauucguuuaaugaacuugacugu

SEQ ID NO: 226269 - RNA, 64 nt, hsa
cagcgucaaaauaguucaaauaauuuuacgaaaaaaaacucagcuucuguuguuuaucaggcag

SEQ ID NO: 226270 - RNA, 64 nt, hsa
ugugguaccauguagagagaugggaugguaucuaaaaacucaaguauuuucgaugauagaggua

SEQ ID NO: 226271 - RNA, 64 nt, hsa
ucuguacuagaauucagauaugucaguuuucugcaaaacucacucuuguucaagacuagcuaau

SEQ ID NO: 226272 - RNA, 64 nt, hsa
uuauguugaggcauggaaaaaaaauuggaaaagaaaaacucaguuuaaauacggagacuauaau

SEQ ID NO: 226273 - RNA, 64 nt, hsa
uggauauaaaagaacaccagagaucagaaauucaaaaacucagaauaaaaaugaaaaagcuaca

SEQ ID NO: 226274 - RNA, 64 nt, hsa
guggcauagaguuaauauuuaaaauucaaauauuaaaacucaaauaaaccccaaagaacuuuug

SEQ ID NO: 226275 - RNA, 64 nt, hsa
cauuuuuuuuguuccuuuucuuguuacuuuuaagaaaacucaugcucuguuucucugaaucaaa

SEQ ID NO: 226276 - RNA, 64 nt, hsa
uaacguccuuaagaccaucuguucagggguucacaaaacucaaauuugugucauucuauuuuau

SEQ ID NO: 226277 - RNA, 64 nt, hsa
uuccuuuuucuuuuuguguaccucuacagagaccaaaacucauucucuuaaagagauuuuaugg

SEQ ID NO: 226278 - RNA, 64 nt, hsa
uuaugcaauauuauaucaccaacccaguaucacaaaaacucauagaagauaucauguaggcccu

SEQ ID NO: 226279 - RNA, 64 nt, hsa
aaggacuauuucucuaaaacucaaaaaaaaaaaaaaaacucaagauaguaaaagcaccuagugu

SEQ ID NO: 226280 - RNA, 64 nt, hsa
aguuucuaagucauauuaaaaggacuauuucucuaaaacucaaaaaaaaaaaaaaaacucaaga

SEQ ID NO: 226281 - RNA, 64 nt, hsa
auuaaucauuugaaauuaugcuauaauauuuuuuaaaacucaccuguuugguucugggugaagc

SEQ ID NO: 226282 - RNA, 64 nt, hsa
gaaguuaaauagaauuuuuauuucauucuuaagaaaaacucauguuuguaacaaaugauaucua

SEQ ID NO: 226283 - RNA, 64 nt, hsa
gaagcaggaaauauugagggcuucuugaucacagaaaacucagaagagauaguaaugcucagga

SEQ ID NO: 226284 - RNA, 64 nt, hsa
acauguagauguuuuguguguauuuuuuuaaaugaaaacucaaaauaagacaaguaauuuguug

SEQ ID NO: 226285 - RNA, 64 nt, hsa
uaauucauaauugaaaauaugcaguaacaagcauaaaacucacaucuuaaugaagauguaucua

SEQ ID NO: 226286 - RNA, 64 nt, hsa
uaucuacauuuuccucagccucuaucugaaggacaaaacucauuuuuccuucuucauuuuguau

SEQ ID NO: 226287 - RNA, 64 nt, hsa
uaauuugugcagcagcaauagaugauaaccaaaaaaaacucauaauaaucugaauaucuugauc

SEQ ID NO: 226288 - RNA, 64 nt, hsa
ugacccacuacauuuuuucuuuccuaccccucuuaaaacucaguucagguagcagcuccacuag

SEQ ID NO: 226289 - RNA, 64 nt, hsa
uacucuaauucaacuaaaguuauaaauaaagagaaaaacucauucagaaaucauggauuuuaaa

SEQ ID NO: 226290 - RNA, 64 nt, hsa
auguguucugaauauccuucuucauaaaucauggaaaacucacugcugagauaguaaaccauga

SEQ ID NO: 226291 - RNA, 64 nt, hsa
caauuuuucucaaagggaucuggaaaaaauguuuaaaacucaguagugucagccacuguacagu

SEQ ID NO: 226292 - RNA, 64 nt, hsa
gccauguggcucacuuauuuaaaaaaaaaaaaaaaaaacucacccguuuuccugggauuuguug

SEQ ID NO: 226293 - RNA, 64 nt, hsa
gaaaagccauuuuuaguaggugacuaccauuugaaaaacucaauuggauguauaucugaauguu

SEQ ID NO: 226294 - RNA, 64 nt, hsa
aacuguuugguugauuaaaauacaucagcucuuaaaaacucauuaacugaggguaauuacagua

SEQ ID NO: 226295 - RNA, 64 nt, hsa
aaagcuucaaugucuuuuuuuuuuuuuucauggaaaaacucaaaccucuguuauuugggagcuc

SEQ ID NO: 226296 - RNA, 64 nt, hsa
gacacuauucucuuugauuagaaaauaaacucauaaaacucauaauguugauauaaucaagaug

SEQ ID NO: 226297 - RNA, 64 nt, hsa
ggguauggcuuacagugacuacuauuauaauacuaaaacucagagaaucaaagauggauuaaac

SEQ ID NO: 226298 - RNA, 64 nt, hsa
gaucccacguugaugucugaacgaccgucuuuugaaaacucaucgggagugaauggcaucucgu

SEQ ID NO: 226299 - RNA, 64 nt, hsa
uaaaaaucagaaagacauucuuaguuaaucuuugaaaacucauacagugguauugcuaguuuaa

SEQ ID NO: 226300 - RNA, 64 nt, hsa
gacagagugagacuccgucucaaaaaaaaaaaaaaaaacucagcuucuucagagagauaaaauu

SEQ ID NO: 226301 - RNA, 64 nt, hsa
gugucgcuuuccagccuuuuguuucuggauccucaaaacucagaacguggccgggcgugguggc

SEQ ID NO: 226302 - RNA, 64 nt, hsa
uucauucagaaauaucugucacugcucuguugccaaaacucagaauagaacuuagacguauguc

SEQ ID NO: 226303 - RNA, 64 nt, hsa
acaaugguuaccauaaaaaaucuggcaggauuuuaaaacucaaucagucuuuccuuugagcuag

SEQ ID NO: 226304 - RNA, 64 nt, hsa
cagggacagcagucagaaucgacauaaagcuuuaaaaacucaagguuuuuucaaccuacugagg

SEQ ID NO: 226305 - RNA, 64 nt, hsa
ugaaugaagcugagagagagaucuagcaaaagcuaaaacucauguugucuaucuuugaacuugg

SEQ ID NO: 226306 - RNA, 64 nt, hsa
agaaaaaaauaaguaucuguguguuuguguauugaaaacucaauauguaaucuuguguuuuuau

SEQ ID NO: 226307 - RNA, 64 nt, hsa
ugugccacugcacucuagccugagcaacaagagcaaaacucagucucaaaaaaaaaaaaaaaaa

SEQ ID NO: 226308 - RNA, 64 nt, hsa
ccuuuauucugccaagucauuucgaagacaugaaaaaacucacacuggagagaaacccuauaaa

SEQ ID NO: 226309 - RNA, 64 nt, hsa
cuuuuauucucccacgucauuucaaagacaugaaaaaacucacacugcagagaaacccuaugaa

SEQ ID NO: 226310 - RNA, 64 nt, hsa
uugugucccauaaauuauuucagaaaaugcugauaaaacucaggauauugacauuuuuguugag

SEQ ID NO: 226311 - RNA, 64 nt, hsa
uucauacuaggacuugggaugauguagccagaauaaaacucaaguugcacccuccgguuggugg

SEQ ID NO: 226312 - RNA, 64 nt, hsa
uaucugaucaauuuggaauauauaaaguguacuaaaaacucaacugaagucaggcaugguagcu

SEQ ID NO: 226313 - RNA, 64 nt, hsa
gugaggccucaucucaaaaaaaaaaaaaggccacaaaacucaacaauaaaaacaaacaguccaa

SEQ ID NO: 226314 - RNA, 64 nt, hsa
gguuguuuccugagccaagcauccaauaucaugccccacucaauggccuagaagcugccuguac

SEQ ID NO: 226315 - RNA, 64 nt, hsa
augaccacuguaggagugaugacagcucagcguccccacucaguguaucugaccauguguguaa

SEQ ID NO: 226316 - RNA, 64 nt, hsa
gcgcaaggaggccaagcucagcugugugucugagcccacucagcagcaggcaugaucagggcag

SEQ ID NO: 226317 - RNA, 64 nt, hsa
gggugcagaagacccaugggaggaggagguggggcccacucaacacaccuaagccaguggcccu

SEQ ID NO: 226318 - RNA, 64 nt, hsa
gagcuguggggcgaucuuucuuagucccacucaccccacucagggccaaccacagaaugccccc

SEQ ID NO: 226319 - RNA, 64 nt, hsa
agaugcagagagcuguggggcgaucuuucuuagucccacucaccccacucagggccaaccacag

SEQ ID NO: 226320 - RNA, 64 nt, hsa
cucuucuaagucuucaucucagagacccugaguucccacucagacccacucagccaaaucucau

SEQ ID NO: 226321 - RNA, 64 nt, hsa
ucuucaucucagagacccugaguucccacucagacccacucagccaaaucucauggaagaccaa

SEQ ID NO: 226322 - RNA, 64 nt, hsa
ggaacagggucacccaggaggguggaugccaggucccacucaggcauaccuuaggagguggaaa

SEQ ID NO: 226323 - RNA, 64 nt, hsa
uugaacgaggagagcacugcugaucagacuaggccccacucagccuggccuggacaccgccaug

SEQ ID NO: 226324 - RNA, 64 nt, hsa
cagugacaaugugcccccugccagccggggcucgcccacucaucauucauucauccauucuaga

SEQ ID NO: 226325 - RNA, 64 nt, hsa
caggcugacuuggggggcagacuugacacuaggccccacucacucagauguccugaaauuccac

SEQ ID NO: 226326 - RNA, 64 nt, hsa
ccacucccaccauccugugagccccacuccuggccccacucacaccauccuaugagcccacgcc

SEQ ID NO: 226327 - RNA, 64 nt, hsa
cccauucacuccauccugugagaccacgcccggccccacucacucuauccugugagaccacgcc

SEQ ID NO: 226328 - RNA, 64 nt, hsa
ccacucacaccaaccugugagccccacucccggccccacucacaacaucuuguaagacugugcc

SEQ ID NO: 226329 - RNA, 64 nt, hsa
ccacucacuccauccugugagccccacucccagccccacucacaccaaccugugagccccacuc

SEQ ID NO: 226330 - RNA, 64 nt, hsa
ccacucccaccauccugugagccccacucccggccccacucacuccauccugugagccccacuc

SEQ ID NO: 226331 - RNA, 64 nt, hsa
ccacucacaccaaccugugagccccacucccggccccacucacuccaucuuguaagacuaugcc

SEQ ID NO: 226332 - RNA, 64 nt, hsa
cccacucccaccauccugugagcccaugcccggccccacucacaccaaccugugagccccacuc

SEQ ID NO: 226333 - RNA, 64 nt, hsa
cccacucccaccaucuuguaagacugugcccagccccacucacuccauccugugagucccacuc

SEQ ID NO: 226334 - RNA, 64 nt, hsa
gguaccugcucaggaccccccgcacugucccaaucccacucaggcccaccuccagcuggccuca

SEQ ID NO: 226335 - RNA, 64 nt, hsa
uucguaccugcucaggagcccccacugucccagucccacucaggcccaucucuggcuggccuca

SEQ ID NO: 226336 - RNA, 64 nt, hsa
cucccccggcccccaccacccucagcagccccaccccacucaacccugaggguccccagggucc

SEQ ID NO: 226337 - RNA, 64 nt, hsa
cucccaaccugccucccgcccggaagccacaggacccacucaugugugugcccacaaguguagu

SEQ ID NO: 226338 - RNA, 64 nt, hsa
caaaccaaaggggguuacguccaggggcugaguucccacucaccuguguagagugccaucuggg

SEQ ID NO: 226339 - RNA, 64 nt, hsa
ucugacguccaagccuuguuccugugcugcaucacccacucagccuuccaaagggaacaggaac

SEQ ID NO: 226340 - RNA, 64 nt, hsa
cuugucccaguccacuccuaacacuagcaucagucccacucaucucaggcugagccacaucuca

SEQ ID NO: 226341 - RNA, 64 nt, hsa
guuguccugaggggcuccaaagaagacaauaguucccacucaugauuuuccguuacaaacaggc

SEQ ID NO: 226342 - RNA, 64 nt, hsa
auucugaauaauuaguuacuuauucucaaagaaaaucuuugaaagaaucaggaggucaagucaa

SEQ ID NO: 226343 - RNA, 64 nt, hsa
agcaccaagucaggcucagaugcaacuaaaacacaucuuugagccuuuucuuuuucccuucucc

SEQ ID NO: 226344 - RNA, 64 nt, hsa
aaugaaagauaccuaugcaauaacauuuaggauaaucuuugacauuuuggaaaaauaagaauug

SEQ ID NO: 226345 - RNA, 64 nt, hsa
agaaaucucucaaaaucuuuccaaauguucugguaucuuugaaaaauguaaauaguuuauuuau

SEQ ID NO: 226346 - RNA, 64 nt, hsa
uacccguaaugcuuucuuuuuuccuuuauugccaaucuuugaacucauucaacuccaggacaug

SEQ ID NO: 226347 - RNA, 64 nt, hsa
cugaaaaacuaaucauaacuguuaauucucagccaucuuugaagcuugaaagaagagucuuugg

SEQ ID NO: 226348 - RNA, 64 nt, hsa
aauaguguuauagccuucauucucugaauaggccaucuuugacucauaaaauuacccuuacugu

SEQ ID NO: 226349 - RNA, 64 nt, hsa
uucauaauuuuuccuuuugccaguuuuucacauuaucuuugauaugugagcaacauuuauuauu

SEQ ID NO: 226350 - RNA, 64 nt, hsa
uaugagagccuauauaguuguuuuauccauuaucaucuuugauuaagacuuuaaaaaaaugcua

SEQ ID NO: 226351 - RNA, 64 nt, hsa
cagugacaaaugaugcccugugugacuuggaguuaucuuugacuuuuaccacaaaucuucauuu

SEQ ID NO: 226352 - RNA, 64 nt, hsa
aucuaaauuggauggauuugaccaucauucuauuaucuuugauuucuacaaugucuauaucuua

SEQ ID NO: 226353 - RNA, 64 nt, hsa
auagucaacucuuaauuaaugcuuauuguaccaaaucuuugagauauuuguacauaaaugaaau

SEQ ID NO: 226354 - RNA, 64 nt, hsa
uuggaacugauucauaagaaaaguuauuaaaauuaucuuugaaacaccucuugaagcuaauuua

SEQ ID NO: 226355 - RNA, 64 nt, hsa
auagcacuuuaucuagaugaaaacuggauuucuuaucuuugaaauaucuugaacuguuuauugc

SEQ ID NO: 226356 - RNA, 64 nt, hsa
accaggguauuaaaauacagaggaguauggucaaaucuuugacaaaauuuucaugaucuucucu

SEQ ID NO: 226357 - RNA, 64 nt, hsa
agaaccuguuuaauaagagcaaauauaggggaaaaucuuugaaaugaaagcuacaaauacaugu

SEQ ID NO: 226358 - RNA, 64 nt, hsa
ucuacccauuggcucaagcagaaaucuggaagucaucuuugacuccuuccucucccuccugaua

SEQ ID NO: 226359 - RNA, 64 nt, hsa
ccauuagacaccacuagcuggauauuucacaggcaucuuugauucaauauguccaaaguggaac

SEQ ID NO: 226360 - RNA, 64 nt, hsa
uuugcuuugguaaugaguuuacagagagugggucaucuuugaagcaucaaauccugaucaaaug

SEQ ID NO: 226361 - RNA, 64 nt, hsa
augaaugugccgagugacuucugacucugccagcaucuuugaccucugacucugcccgcgucuu

SEQ ID NO: 226362 - RNA, 64 nt, hsa
agacguauuaaagcucuuuucugcuuaaggugacaucuuugaacacuuuaacacaaaguugacu

SEQ ID NO: 226363 - RNA, 64 nt, hsa
uaugguacccaaacucaccauuugguccucuuuaaucuuugaggguuucaauaaaaauuguuca

SEQ ID NO: 226364 - RNA, 64 nt, hsa
ccuuuugcucaggaagucuuuggggaaauuaaggaucuuugaagcucugaaauaggugaucagg

SEQ ID NO: 226365 - RNA, 64 nt, hsa
acuauuagguaugugagcuugggcaaaucgcuuaaucuuugagucuaguuuucucucaaaauga

SEQ ID NO: 226366 - RNA, 64 nt, hsa
auacgugaaugaaaccaggccauagcugucauaaaucuuugacuuuugaauauuuacauucuuc

SEQ ID NO: 226367 - RNA, 64 nt, hsa
gauuuucuuuuuuuuacuuuuauacaaaggcagcaucuuugaauuuuuuuuucuuuugauguug

SEQ ID NO: 226368 - RNA, 64 nt, hsa
uagggagcucacucccacuggaacagcccauuuuaucuuugaauggucuucugccagcccauuu

SEQ ID NO: 226369 - RNA, 64 nt, hsa
cauuaucauucaaaacaaccauccugcucauaacaucuuugaaaagaaaaauauauaugugcag

SEQ ID NO: 226370 - RNA, 64 nt, hsa
ugaagcaaguucacuacagcaucaauagaaagucaucuuugagauaauuuaacccugccucuca

SEQ ID NO: 226371 - RNA, 64 nt, hsa
gugucugugguccagaagaaauuauuuaauaugcaucuuugagaauauuauaaaaauaucaaaa

SEQ ID NO: 226372 - RNA, 64 nt, hsa
ucacuuucucaucccauguguacaaaaaccaauuaucuuugacugcuguucucaaccacguagu

SEQ ID NO: 226373 - RNA, 64 nt, hsa
cuuauguaauguggaugcugggcacagagcugccaucuuugaccaauuccguggaguacagaac

SEQ ID NO: 226374 - RNA, 64 nt, hsa
uguuugguuucagacaaaaccuuuucuccuguguaucuuugaaguggcagacaaggcgaagcau

SEQ ID NO: 226375 - RNA, 64 nt, hsa
gauuucagacaaaauuaacccuuuucuccuguguaucuuugaaguggcagauaaggugaagcau

SEQ ID NO: 226376 - RNA, 64 nt, hsa
ugcaaaacagccagacuugagcugugcucuggucaucuuugaguuuaaggccuuuuguuguaua

SEQ ID NO: 226377 - RNA, 64 nt, hsa
cggagguugaaguuggaguuugagguuggaaaauaucuuugaaggcagaaucaguugaguugug

SEQ ID NO: 226378 - RNA, 64 nt, hsa
uuuaguguuauauaucuuugguuuuuuuaauaaaaucuuugaaaaccuaccucuuugucccguu

SEQ ID NO: 226379 - RNA, 64 nt, hsa
uuaaaaaaacacacacacacaaaugaaauuuuuaaucuuugaaaauuauuuuuaagcgaauugg

SEQ ID NO: 226380 - RNA, 62 nt, hsa
gaaucucguuaguagcauguggccuaacaaaaggaaaaaauguuuuuaaacacacacacaca

SEQ ID NO: 226381 - RNA, 62 nt, hsa
gaggagacaucuggccuuuuuagaaccugagaggaaaaaaagagucuuuuuuuccccucugu

SEQ ID NO: 226382 - RNA, 62 nt, hsa
acgucaccaagaaaacaugcaacucaaacgacggaaaaaaaaagggaaugggaaaaaagaaa

SEQ ID NO: 226383 - RNA, 62 nt, hsa
gcaacucaaacgacggaaaaaaaaagggaaugggaaaaaagaaaacagauccugggaggggg

SEQ ID NO: 226384 - RNA, 62 nt, hsa
aagcuaucuaccuauccugagucuaucuuaaaggaaaaaaagaaaaaaaccuuaucucuugc

SEQ ID NO: 226385 - RNA, 62 nt, hsa
cucuuucauuaauuuguuuuaagcuccguguuggaaaaaagggguagugcauuuuaaauuga

SEQ ID NO: 226386 - RNA, 62 nt, hsa
cuaacuccaguuuuacuauuauuauuuugguuggaaaaaaaauucacucuuuacgugcuaau

SEQ ID NO: 226387 - RNA, 62 nt, hsa
cucucguaucucaccccaaaccccaaacugggggaaaaaaaguuaacucuuugugaauggaa

SEQ ID NO: 226388 - RNA, 62 nt, hsa
gcacuuucugguaaaaaguuaaaaauuuuuaaggaaaaaauaauuucaaugguuaaaguuuu

SEQ ID NO: 226389 - RNA, 62 nt, hsa
uuacauuuaaagaucauuugcaccuuuuucaaggaaaaaaaguauugaguaaacaauuguuu

SEQ ID NO: 226390 - RNA, 62 nt, hsa
gacaagcuuuauuaaguugagagagagagaggggaaaaaaaaaagccuuucguaguucagua

SEQ ID NO: 226391 - RNA, 62 nt, hsa
aaauacaaaauacccaagauuuaagaccggggggaaaaaaccacaaauugguaaauaaaggu

SEQ ID NO: 226392 - RNA, 62 nt, hsa
uaaguaaucccagaacaauggcuauucaugugggaaaaaaagaaauuuuacuuucucucacc

SEQ ID NO: 226393 - RNA, 62 nt, hsa
ucacaauaagaaugaaucucagaaaauauuaaggaaaaaagcaaguuugaagagaccacaug

SEQ ID NO: 226394 - RNA, 62 nt, hsa
aucuacgccauauacccaucaccaucccaugaggaaaaaaaaaaaaguaaaacaaagacaaa

SEQ ID NO: 226395 - RNA, 62 nt, hsa
gcacagcggcagcaaggauuaccccaagggcaggaaaaaagucuuuggaaauagauugaaaa

SEQ ID NO: 226396 - RNA, 62 nt, hsa
auugcuuucuuuuaugguagaccuguuaauggggaaaaaauacaucaaaucaaauagaaucu

SEQ ID NO: 226397 - RNA, 62 nt, hsa
guuuuuguacuuuacuaaucuuuaaacuaucaggaaaaaaaccaaaacuuuauaccaaugau

SEQ ID NO: 226398 - RNA, 62 nt, hsa
uuccccagccacagguauguggaauacggugaggaaaaaaaaaauuaaaaaaaaaaugcaag

SEQ ID NO: 226399 - RNA, 62 nt, hsa
ucaaacaaugguuucucugcguuaauuauugaggaaaaaaaaagaugggguaagaaaacuac

SEQ ID NO: 226400 - RNA, 62 nt, hsa
aaauauguaaagcaauuguaggaaauuugaaaggaaaaaaagaaaccgaagccaguauuuua

SEQ ID NO: 226401 - RNA, 62 nt, hsa
aucaugggcuugauugaauuaauuacucuuggggaaaaaagacaccuuguggcauuaagucu

SEQ ID NO: 226402 - RNA, 62 nt, hsa
aggagauauagugacccagacuucaugcaaauggaaaaaaaguuuuaacugaaauauuuauu

SEQ ID NO: 226403 - RNA, 62 nt, hsa
uugcaucacacuaauuacaaaauacaaguucuggaaaaaauauuuuucuucauuuuaaaacu

SEQ ID NO: 226404 - RNA, 62 nt, hsa
uuuaacuggaguugucaaguaugagucccucaggaaaaaaaaaaaauucuguuuuaaaaagc

SEQ ID NO: 226405 - RNA, 62 nt, hsa
ggauggagaaaaaucuaggacagugucuucucggaaaaaaccagccuugaagguaaugaaac

SEQ ID NO: 226406 - RNA, 62 nt, hsa
augagaaggauucuuuuucgaauauaaccagaggaaaaaaggauggagaaauaucuaggaaa

SEQ ID NO: 226407 - RNA, 62 nt, hsa
cugagaaaccaccaggcuugaagugucuucucggaaaaaaccauccuuggagguaaugaaac

SEQ ID NO: 226408 - RNA, 62 nt, hsa
cuuguuuauauuucauacuuuuuauacuuugaggaaaaaaagucaaagaaaaauuguauuug

SEQ ID NO: 226409 - RNA, 62 nt, hsa
ggaaaaaaagucaaagaaaaauuguauuugagggaaaaaaccaugaccaaguaaaggauaaa

SEQ ID NO: 226410 - RNA, 62 nt, hsa
acccgccgaccuucagcuuugugggacuaucaggaaaaaacaaaacaaaaacaaaauguaga

SEQ ID NO: 226411 - RNA, 62 nt, hsa
uugagaauguuaacuuauugcuuuguaucuugggaaaaaaacuuuguaaauaaguuauaaag

SEQ ID NO: 226412 - RNA, 62 nt, hsa
cauaugcaguaaaagaaagaaagaaaaaaaaaggaaaaaaaaaaaaaaaccaauguuuugca

SEQ ID NO: 226413 - RNA, 62 nt, hsa
uuaaaagguaucaauguaccuuuuuugguaguggaaaaaaaaaagacaggcugccacaguau

SEQ ID NO: 226414 - RNA, 62 nt, hsa
uagcuugccuggagaugauguuucuugcuuuuggaaaaaaaaaaaaagucucugaaauuuga

SEQ ID NO: 226415 - RNA, 62 nt, hsa
cauguugagaucauuguuguuucauuguuuaaggaaaaaaaaaaaugccuguaccuacaaug

SEQ ID NO: 226416 - RNA, 62 nt, hsa
uacugggacuuuuaaaucuagcuauagaguugggaaaaaauauuuccacuuagauauuuuac

SEQ ID NO: 226417 - RNA, 62 nt, hsa
gcugggagagacuaggaaggcuugguaggaggggaaaaaagucaggaaaauauaucaaauca

SEQ ID NO: 226418 - RNA, 62 nt, hsa
auaagcuauaacaucaaaucagggaaaaaugaggaaaaaaaauagauucugaaccauuuauu

SEQ ID NO: 226419 - RNA, 62 nt, hsa
uguggcuuuuagggcuugguucauaccaugggggaaaaaaaaguccuaggagaaagcgacgu

SEQ ID NO: 226420 - RNA, 62 nt, hsa
ggugaucuaauccuaaauuuaaaagauuuguuggaaaaaauuuuuaggaaacucaccuuccu

SEQ ID NO: 226421 - RNA, 62 nt, hsa
cuuuggcaacccuuuugaaaaguagcaauuauggaaaaaaaauauucaauaagagauuagga

SEQ ID NO: 226422 - RNA, 62 nt, hsa
auaauacagugggcuucuggauggauuuuauaggaaaaaauaaacaggucaaugaaugaaac

SEQ ID NO: 226423 - RNA, 62 nt, hsa
cccuuugacugaucagugugauaaggacuuuaggaaaaaaagcauguauguuuuuuacuguu

SEQ ID NO: 226424 - RNA, 62 nt, hsa
cguuaaucuugcugcuuaugugccaauuuaguggaaaaaaacaacccuugcugaaaaauucc

SEQ ID NO: 226425 - RNA, 62 nt, hsa
uaguuuauaaugucuuacuaaugcagaaacaaggaaaaaagcaaaauuggccugaauauucu

SEQ ID NO: 226426 - RNA, 62 nt, hsa
uaguugauucacaguacagaacaagguauaaaggaaaaaacccugcuagguaguguuauaau

SEQ ID NO: 226427 - RNA, 62 nt, hsa
cugaagauacaugucuuucuccagggacauguggaaaaaaaaaagauguuauacaaccauca

SEQ ID NO: 226428 - RNA, 62 nt, hsa
aaaggguaucccaaaaauaaaacuauccuuuuggaaaaaaaaagauuuaaaauaauuccugg

SEQ ID NO: 226429 - RNA, 62 nt, hsa
aaggcgagcuaagaggagacuuagauccagugggaaaaaaaauagcguuucacauaaaaagc

SEQ ID NO: 226430 - RNA, 62 nt, hsa
acacaccaaaaaagugaaagagaaauugaaagggaaaaaagacaaaaagcauaaggcuccaa

SEQ ID NO: 226431 - RNA, 62 nt, hsa
ucugcaaaaaggaaaaagaaaccacaaauuggggaaaaaaaaagaagaaaaaccuguuuccg

SEQ ID NO: 226432 - RNA, 62 nt, hsa
gaagagaggagagggagaaaaauaaaaugaaaggaaaaaaaaaaguuugcaaauucagacag

SEQ ID NO: 226433 - RNA, 62 nt, hsa
gcuugacacccaccaagcaaaaguuucagccuggaaaaaaaaugggggggaaggguggauga

SEQ ID NO: 226434 - RNA, 62 nt, hsa
uggggugccagaaagugucugcugauauuuguggaaaaaaaaucuauuuuguuuaccuacug

SEQ ID NO: 226435 - RNA, 62 nt, hsa
uggagaaaacccgguacgcucaaaaagaaaaaggaaaaaaaaaaaucccaucacccacagca

SEQ ID NO: 226436 - RNA, 62 nt, hsa
ggacauuuuaauuguuuaaaaauuguacaaaaggaaaaaauuagaauaaguacuggcgaacc

SEQ ID NO: 226437 - RNA, 62 nt, hsa
uuauauuaacgauacuaaaaaaaaauagcuuuggaaaaaaaacuacuguauguaacggaauu

SEQ ID NO: 226438 - RNA, 62 nt, hsa
cgggccaaccccgagaaugaagauuggaaaaaggaaaaaaaaaaaaacacgucaaaaguuag

SEQ ID NO: 226439 - RNA, 62 nt, hsa
gcauagagaaacaaaaaucuuuuaugauguacggaaaaaaaccaugcugauacagcuggcua

SEQ ID NO: 226440 - RNA, 62 nt, hsa
agagccaaaauaaauauacuuuggcacuuuuuggaaaaaaaguuugcagacaccugcccuaa

SEQ ID NO: 226441 - RNA, 62 nt, hsa
cugccucaugacaaguacauguuauuuaaggaggaaaaaauauuaaauuuugaauugagugu

SEQ ID NO: 226442 - RNA, 62 nt, hsa
aaaaguguggccacugagcauuugauuuuauaggaaaaaauaguauuuuugagaauaacaua

SEQ ID NO: 226443 - RNA, 62 nt, hsa
uugccacuagauggcagugccuguauagauggggaaaaaauugccaccauucuugguauaau

SEQ ID NO: 226444 - RNA, 62 nt, hsa
ggaaacucagaguacuaggacguuuauuaaaaggaaaaaaaugucuugcaaugugcuguaau

SEQ ID NO: 226445 - RNA, 62 nt, hsa
gaagaaacugccgcucugagacugcacauccaggaaaaaagacuaggacuugccacacacug

SEQ ID NO: 226446 - RNA, 62 nt, hsa
gccuauuaucuggaugucccuugccuagagcaggaaaaaagucucagaauuaccuaaaaaca

SEQ ID NO: 226447 - RNA, 62 nt, hsa
uucauaucacacaaaaugaauuuucuauaaagggaaaaaaguuugcuccuccauagauuuuu

SEQ ID NO: 226448 - RNA, 62 nt, hsa
uucuuggagaauuuggaugccuaaggcauaaaggaaaaaaacagaguucauaguuugagcug

SEQ ID NO: 226449 - RNA, 62 nt, hsa
ucaauuauuucccaucuccacaaauagucgggggaaaaaauuaaaauuuuccuuuaugauuc

SEQ ID NO: 226450 - RNA, 62 nt, hsa
uuuagucagaaaugauucaggguuauuugaggggaaaaaaccccauagugccuugauuuuaa

SEQ ID NO: 226451 - RNA, 62 nt, hsa
aaguacauugguaauuugggcacauucagaguggaaaaaauuuguucuauuuuuacaucuuu

SEQ ID NO: 226452 - RNA, 62 nt, hsa
uaaaauaaaaauaacauauuggugaagaugcgggaaaaaaaaaagaacucuuagacacugcu

SEQ ID NO: 226453 - RNA, 62 nt, hsa
uauuugaagauggagcacugcugauuuaugaaggaaaaaagaagaauuuucuaaagauuaca

SEQ ID NO: 226454 - RNA, 62 nt, hsa
ucaggauuuaagucugagguagucaacccucaggaaaaaaaaaauggcuuaucugaaaucag

SEQ ID NO: 226455 - RNA, 62 nt, hsa
uaauuaugacaugagaaugaagaaauuauuuuggaaaaaaaaaaugaccuaauuuaccuauc

SEQ ID NO: 226456 - RNA, 62 nt, hsa
gcuuauggcaugaucucuggaacaaauuuguaggaaaaaauuacuccaauugaaugacugau

SEQ ID NO: 226457 - RNA, 62 nt, hsa
auuaaccuccuaaaaggaauucauauuuuaaaggaaaaaaauacaacuaaugaugcacauuu

SEQ ID NO: 226458 - RNA, 62 nt, hsa
cauaugguauugugauuuucuuuccccugcuaggaaaaaauugcacugaaaugcugacaaaa

SEQ ID NO: 226459 - RNA, 62 nt, hsa
caauaggugccuaguaaauguuaacuguucuuggaaaaaauaaaaacaucaguaacaaaaga

SEQ ID NO: 226460 - RNA, 62 nt, hsa
ccaguauguuuuaacaaaaaaaaaaaaaagcaggaaaaaaggaauauuuagcaguauuguuc

SEQ ID NO: 226461 - RNA, 62 nt, hsa
aagaaauaaaaauauuuuuauuuucuauaaaaggaaaaaaguauaacaaaauguuuuauuuu

SEQ ID NO: 226462 - RNA, 62 nt, hsa
gagaccagagaccgccuacuggagagaaaggaggaaaaaagaaauaaaaauauuuuuauuuu

SEQ ID NO: 226463 - RNA, 62 nt, hsa
aauguaauauguaaacugugauuugguccucuggaaaaaaaaaaaugaaaugaagaguggga

SEQ ID NO: 226464 - RNA, 62 nt, hsa
ugacacaaucucuuuauaauuuuacaaauaaaggaaaaaagaaccauguaagauaugugugc

SEQ ID NO: 226465 - RNA, 62 nt, hsa
agcaccguuuguucugugagcuggaaacagaaggaaaaaacauacccuuggguacccauagc

SEQ ID NO: 226466 - RNA, 62 nt, hsa
gauaaugaaaagugauaucuucgcauacgaaaggaaaaaagguugagguauauaugauuuuu

SEQ ID NO: 226467 - RNA, 62 nt, hsa
uccuuaagauuuaaaaaaaaaaaaaaaaaaaaggaaaaaaaagugauggaagccguaagugc

SEQ ID NO: 226468 - RNA, 62 nt, hsa
gucuauuuuuucucuucauguuguaacaaaaaggaaaaaagaaaaaaaaaucccaucccuuu

SEQ ID NO: 226469 - RNA, 62 nt, hsa
aaaaggacagacgaagaguuuaaagagaaaagggaaaaaagaaagaaaaaguaagcagggcu

SEQ ID NO: 226470 - RNA, 62 nt, hsa
acaggggcagucaguggagggcgagugguuucggaaaaaaaaaaagaaaaaaagaaaaaaaa

SEQ ID NO: 226471 - RNA, 62 nt, hsa
uaaaauucaaggccacaaaaacaauguuugggggaaaaaaaagaaaaaaucaugccagcuaa

SEQ ID NO: 226472 - RNA, 62 nt, hsa
auaccuggcaaaacuaaauaaauuaccaaaaaggaaaaaaaauccaccaaaccaugauaaac

SEQ ID NO: 226473 - RNA, 62 nt, hsa
guuuauuuauuguggauucccaucaggaaagaggaaaaaauacacauguucuuucauauagg

SEQ ID NO: 226474 - RNA, 62 nt, hsa
ggaagcauauaccggggaauguguagccuucaggaaaaaaaugccaauugacacaaagcauu

SEQ ID NO: 226475 - RNA, 62 nt, hsa
ucacauuuugauuuauuagguacuagcacugaggaaaaaaaauucagcacuuggacuaucau

SEQ ID NO: 226476 - RNA, 62 nt, hsa
aacacuacaagucuugaguuaagaaggaaagaggaaaaaagaaaaaacaccaauacccagau

SEQ ID NO: 226477 - RNA, 62 nt, hsa
ugcuuucuuuuccagucgucuuugagaauaaaggaaaaaaaaaucuucagaugcaaugguuu

SEQ ID NO: 226478 - RNA, 62 nt, hsa
cuuuuaugaaagccaaagacugcuugcuaguaggaaaaaauuucaaauaauaaccaaagcug

SEQ ID NO: 226479 - RNA, 62 nt, hsa
caccaucugcaaccauaugcuauuaauaaaauggaaaaaaacaaaauggucauuuugcauau

SEQ ID NO: 226480 - RNA, 62 nt, hsa
uaaauaauaaaacuugucauaauuuugaacuuggaaaaaaguuucuuuugcucucauagaaa

SEQ ID NO: 226481 - RNA, 62 nt, hsa
ugcucugauaugugaaguaauggacaagagugggaaaaaagagauccuuuucaaaaagauua

SEQ ID NO: 226482 - RNA, 62 nt, hsa
auaacaaaguugcuaggcaggaaaaaaaaucaggaaaaaagcuugucgcuauuugagaaucu

SEQ ID NO: 226483 - RNA, 62 nt, hsa
gacagugaggauaauaacaaaguugcuaggcaggaaaaaaaaucaggaaaaaagcuugucgc

SEQ ID NO: 226484 - RNA, 62 nt, hsa
cauugguauaugguggcuguuuaccaauaaaaggaaaaaauucauuaaccgguugcuuccaa

SEQ ID NO: 226485 - RNA, 62 nt, hsa
agaguuauccacuguauuuauaaggaagagucggaaaaaacaaugaccuuaguuuuuuuuaa

SEQ ID NO: 226486 - RNA, 62 nt, hsa
aaaaaaauguaagaggaaaaaaaguaaauuaaggaaaaaauccucacucauucccauguugu

SEQ ID NO: 226487 - RNA, 62 nt, hsa
ucaauggagcaugugugcaaaaaaauguaagaggaaaaaaaguaaauuaaggaaaaaauccu

SEQ ID NO: 226488 - RNA, 61 nt, hsa
auauggaugaaaauuaauaaaguacugucaagggaaaaaauauguauaaccuuguaaguga

SEQ ID NO: 226489 - RNA, 62 nt, hsa
ccugggcaacauggugaccucccgucucucucggaaaaaaaaaaagaaaaaagaaaaagccg

SEQ ID NO: 226490 - RNA, 62 nt, hsa
uucagccauuuuugccacauauacauuuuuaaggaaaaaagauuuuucucuguaagaaaguu

SEQ ID NO: 226491 - RNA, 62 nt, hsa
uacagcauauuuaagucuugugaaacuguauaggaaaaaaguaucuacguuuuuaguuuuuu

SEQ ID NO: 226492 - RNA, 62 nt, hsa
uaaaaccuuuuagugacaaaauccuaauauguggaaaaaagcauaugcauaaaggaauaaua

SEQ ID NO: 226493 - RNA, 62 nt, hsa
auuuuccuguuuuucccccuuugaaaaacucaggaaaaaaggaagauugaacuaauaaaauu

SEQ ID NO: 226494 - RNA, 62 nt, hsa
ucacauuuuaauuuagcaaauugauuuaccuaggaaaaaauuaucaccuucaaagauaggca

SEQ ID NO: 226495 - RNA, 62 nt, hsa
uucuauaaugcuuauuaugguaaaauaaaauuggaaaaaauuaaaacugaccuauaagagug

SEQ ID NO: 226496 - RNA, 62 nt, hsa
aguggucuguaucucaacauuuucuuuuuaaaggaaaaaauauauauauauaguuucuuuuu

SEQ ID NO: 226497 - RNA, 62 nt, hsa
ucucuuacuacguacucacagguuugcaaaugggaaaaaaguuuacauuucaguuuaggggc

SEQ ID NO: 226498 - RNA, 62 nt, hsa
gcacuuaaaguugcauugccuacuguuauacuggaaaaaauagaguucaagaauaauaugac

SEQ ID NO: 226499 - RNA, 62 nt, hsa
aagugugauagcgauauuagugccaaucaaauggaaaaaagguaguuuuaauaaacaagaca

SEQ ID NO: 226500 - RNA, 62 nt, hsa
uuuaaaaaagaucucaauuuauauaaaguacuggaaaaaagcuaaguaauuuuuaguucuau

SEQ ID NO: 226501 - RNA, 62 nt, hsa
uuuuuccccuauuuauucuuuguuuccuucugggaaaaaaccccacaaaaaucagcacuccu

SEQ ID NO: 226502 - RNA, 62 nt, hsa
aguuucuggggaaagaauaguaaccaugcaauggaaaaaaauggacaaccucuugacuaggu

SEQ ID NO: 226503 - RNA, 62 nt, hsa
gaaaaaaauaaaauaaauucccaauuccauugggaaaaaauagaaauccaugaauccauacu

SEQ ID NO: 226504 - RNA, 62 nt, hsa
ugauauuucucuaguaguuaaaaaaaaaaaaaggaaaaaaagacucuuuuugguuguccuca

SEQ ID NO: 226505 - RNA, 62 nt, hsa
uaaaagucacaauguucuuuauauacaauaauggaaaaaaaaaaaagaggaaaacccucaag

SEQ ID NO: 226506 - RNA, 62 nt, hsa
ggauucuuuucuaagguaauauuaaugagaagggaaaaaaguaucuuuaacagcucuuuguu

SEQ ID NO: 226507 - RNA, 62 nt, hsa
gaaggaaaugaaaauauuuuuaugccuacuuaggaaaaaaaggguagcacuuauucauucca

SEQ ID NO: 226508 - RNA, 62 nt, hsa
uuauuucauuaaagaaguugggagaacaaauaggaaaaaaaaaacuuauuuuucuaguaaau

SEQ ID NO: 226509 - RNA, 62 nt, hsa
cagaagaaaagcaaaugacuaguaaacaugugggaaaaaauauuacauuuuaagggggaaaa

SEQ ID NO: 226510 - RNA, 62 nt, hsa
aacaugugggaaaaaauauuacauuuuaagggggaaaaaaaaacccaccauucucuucuccc

SEQ ID NO: 226511 - RNA, 62 nt, hsa
ggacaacauagggagaccccaucucuaccggaggaaaaaaaaaagagucaggccugguggug

SEQ ID NO: 226512 - RNA, 62 nt, hsa
gagugagaccuugucucaaaaaaguaacauaaggaaaaaagaagccuugcuuuagcacaggu

SEQ ID NO: 226513 - RNA, 62 nt, hsa
aaaaaugaaaaaaaaaggaaaaaaagaaaaaaggaaaaaaacaguuugaacacaaaggcucu

SEQ ID NO: 226514 - RNA, 62 nt, hsa
aaaucuuaaaaaaagaaaaaaugaaaaaaaaaggaaaaaaagaaaaaaggaaaaaaacaguu

SEQ ID NO: 226515 - RNA, 62 nt, hsa
cucucuagagcgagcaagagagggagagaggaggaaaaaauacacauaauacaaacauacau

SEQ ID NO: 226516 - RNA, 62 nt, hsa
uacguagacagaaauaauaaaaauauuaacuaggaaaaaacaguauagcaccaagccaguau

SEQ ID NO: 226517 - RNA, 62 nt, hsa
uuuuaaaaauguagcacuugacuuuuugccaaggaaaaaaauaaaaauuauuccagugcaca

SEQ ID NO: 226518 - RNA, 62 nt, hsa
cccccucuucucuggguguaagaagggaaauuggaaaaaaaauuauauauauauucuccuuu

SEQ ID NO: 226519 - RNA, 62 nt, hsa
uaaugauaccccaaaaugauuacacccagggaggaaaaaaaggagcgcuuucuagggucaga

SEQ ID NO: 226520 - RNA, 62 nt, hsa
cauuagagacuaacuguaacuuaagugcugggggaaaaaaaaugugaacuaacuuauuuaau

SEQ ID NO: 226521 - RNA, 62 nt, hsa
aaauuguugcaaauuuguuuuuaugaauaaaaggaaaaaaccugucgucuuuaaugccuacu

SEQ ID NO: 226522 - RNA, 62 nt, hsa
aagagagguuauggagguacuguagcuuuuagggaaaaaaaaauguuaacacaucacagguc

SEQ ID NO: 226523 - RNA, 62 nt, hsa
auaagaugucagaauaacuaauaauuuuauuaggaaaaaaucauguuuuaaauuucaaaaug

SEQ ID NO: 226524 - RNA, 62 nt, hsa
uacaaaaauaaccuucaggaaaaagaaaaucaggaaaaaaauuuuuuuucaauaaucuuauu

SEQ ID NO: 226525 - RNA, 62 nt, hsa
aaguuguuugcuuaaaaaaaauuucaugugagggaaaaaaaaaaaaccuauuccagaauaag

SEQ ID NO: 226526 - RNA, 62 nt, hsa
acagaaaacaauuccacgaggccaaucuaaagggaaaaaauccuacacuacuuuuacuacuu

SEQ ID NO: 226527 - RNA, 62 nt, hsa
aacuucuucugguugauaccugagacuguuaaggaaaaaaauuuuaaaccccugauuuauau

SEQ ID NO: 226528 - RNA, 62 nt, hsa
uauagauguaaaaugaaauuucauuuguaauuggaaaaaauccaauaaaaaggauauucauu

SEQ ID NO: 226529 - RNA, 62 nt, hsa
aguucucacaguauagaagagaacuuaaagagggaaaaaacaauaugaagauagggaaugca

SEQ ID NO: 226530 - RNA, 62 nt, hsa
uggaccauacacuauguuacaaaacuaaaaguggaaaaaacuuauuggugaaugaauauagg

SEQ ID NO: 226531 - RNA, 62 nt, hsa
guugcaggauaucuagcaauuuaagaaaauguggaaaaaauauuuuuauugagaaauagcau

SEQ ID NO: 226532 - RNA, 62 nt, hsa
uagccuggaagacagagugagaccccaucucaggaaaaaagaaaaaaaaaaagaugucauuc

SEQ ID NO: 226533 - RNA, 62 nt, hsa
gugaggaaggaugggccuugcugaaguguggaggaaaaaauuaugaacgggccaaggccugc

SEQ ID NO: 226534 - RNA, 62 nt, hsa
agaucagccauauuucauuuugaaucugcaguggaaaaaaagcccacauuugagguggcuca

SEQ ID NO: 226535 - RNA, 62 nt, hsa
aucuaauagucaccuaaaauaucuuuuuuguuggaaaaaaguuuauaauaaaaaaguuuguc

SEQ ID NO: 226536 - RNA, 62 nt, hsa
aauguuuauuaaguagcuagaaauaauuauguggaaaaaaaugaauaauggaaaauagugag

SEQ ID NO: 226537 - RNA, 62 nt, hsa
uuagaguauuucccuuccaaagagggauguuuggaaaaaacucugaaggagaggaggaauua

SEQ ID NO: 226538 - RNA, 62 nt, hsa
acagccuagggcagacaauaguauagaagucuggaaaaaaacaaaaacagaauuugagaacc

SEQ ID NO: 226539 - RNA, 62 nt, hsa
cuucaauuccauauauccuuuucuucuauguaggaaaaaaauagucuaguguaguauucuuc

SEQ ID NO: 226540 - RNA, 62 nt, hsa
aggcuuucagcuuacacaaaucuauuuaauuaggaaaaaaacuauuaaggauguagcuuuuc

SEQ ID NO: 226541 - RNA, 62 nt, hsa
auggagcaaaagagacagggagagguggagaaggaaaaaacccuacaaaacaaaaacaaacc

SEQ ID NO: 226542 - RNA, 62 nt, hsa
ggugcccacaaaaagaaucaggacuuguacugggaaaaaaaccccuaaauuaauuauauuuc

SEQ ID NO: 226543 - RNA, 62 nt, hsa
cagcaaggcauguuacuacuuuuaucaucuaaggaaaaaagacaagggaauuccagucaggc

SEQ ID NO: 226544 - RNA, 62 nt, hsa
ccguuucaagaccuuuuucuuuuauugcaaggggaaaaaaaugucaucuccccccaccucau

SEQ ID NO: 226545 - RNA, 62 nt, hsa
uuuuaauuaaugcacuuuaaauaagguagaauggaaaaaacccagagagcaaagugcauuac

SEQ ID NO: 226546 - RNA, 62 nt, hsa
cuggaugagcggugagacgaacaaaagggaaaggaaaaaaugggggugggggguggggggug

SEQ ID NO: 226547 - RNA, 62 nt, hsa
aucugaacaauccuacagggaaaucagaauuaggaaaaaaaucuggagaacaauaugguuga

SEQ ID NO: 226548 - RNA, 62 nt, hsa
gagugauacauugugggaacccucagaagauaggaaaaaagcauggaauagauucucccuca

SEQ ID NO: 226549 - RNA, 62 nt, hsa
cugaccccagauucaacuuugcaaacaacaggggaaaaaaauggggaaaagaaaaaccacga

SEQ ID NO: 226550 - RNA, 62 nt, hsa
aaaaaauggggaaaagaaaaaccacgagagagggaaaaaaaauuauucugcaccuguaaaaa

SEQ ID NO: 226551 - RNA, 62 nt, hsa
uaaguucuucaaacacccauuuuugcucuaugggaaaaaaacgauuuaccaauuaauauuac

SEQ ID NO: 226552 - RNA, 62 nt, hsa
gguauugcacuacauuauggaaucaugcaaaaggaaaaaaaguuucaugauaucuguuguug

SEQ ID NO: 226553 - RNA, 62 nt, hsa
ggaaauaucaucguauuucuuuuuuuuaauaaggaaaaaauaauauccauacagucaagaua

SEQ ID NO: 226554 - RNA, 62 nt, hsa
guuuugacuugaauaaaguacuacaucaguguggaaaaaaauucugauacauuagcagcuau

SEQ ID NO: 226555 - RNA, 62 nt, hsa
uuuuaugcaagggcaaaaaucuuuguaucuggggaaaaaaaacuuuuuuuuaaauuaaaaag

SEQ ID NO: 226556 - RNA, 62 nt, hsa
aggcagggaagaaggauguguguguccaggaaggaaaaaaagguggaucagugauuuuacuu

SEQ ID NO: 226557 - RNA, 62 nt, hsa
acccucaguuaagcauguuaacauuuauaggaggaaaaaaaucacuuugggagaaaauaaaa

SEQ ID NO: 226558 - RNA, 62 nt, hsa
ugcuccaaauucuuauuuuacuuaaccagaagggaaaaaaaguuguauuuuccugaagcuac

SEQ ID NO: 226559 - RNA, 62 nt, hsa
uuaaggaaaaaaugggauuuuguuuuagaguuggaaaaaaagccugauuaaagaguuucugc

SEQ ID NO: 226560 - RNA, 62 nt, hsa
aaaguucucuguuccugaggaacuaaauuuaaggaaaaaaugggauuuuguuuuagaguugg

SEQ ID NO: 226561 - RNA, 62 nt, hsa
acuguuguuugguuaaaggacacagauuugaaggaaaaaaauuuugauguaacaauuuuuua

SEQ ID NO: 226562 - RNA, 62 nt, hsa
auuaaaaauuuucuaaauauuaauacuaacugggaaaaaaaaacuagugugaaguuuacagu

SEQ ID NO: 226563 - RNA, 62 nt, hsa
aaacaaacaaaaaaaaauuuuaaacaaagaaaggaaaaaaauugacaauaaaagucacucuu

SEQ ID NO: 226564 - RNA, 62 nt, hsa
agauucuuucuucugaaagccaagcaccacaaggaaaaaaaaaauuauuaauagcucagguu

SEQ ID NO: 226565 - RNA, 62 nt, hsa
agcuuacuugaacuaauuacuugaaaacugguggaaaaaagagaccaacuuuguuauuuuuu

SEQ ID NO: 226566 - RNA, 62 nt, hsa
gcaugugccucacuuuaagaaaguccuguaggggaaaaaaaaaacugucagagcgaauucau

SEQ ID NO: 226567 - RNA, 62 nt, hsa
caaaguuaagaucgaauccauccgcuuguaggggaaaaaaaggaaaaaaauuaaccagagag

SEQ ID NO: 226568 - RNA, 62 nt, hsa
gaucgaauccauccgcuuguaggggaaaaaaaggaaaaaaauuaaccagagagggucuguaa

SEQ ID NO: 226569 - RNA, 62 nt, hsa
uaauguaguugaacuuuuuaaauuuuugaauuggaaaaaaauucuaaugaaacccugauauc

SEQ ID NO: 226570 - RNA, 62 nt, hsa
aagguuaaucaggaaaaauagcuuuugacaggggaaaaaacucaauaacuagcuauuuuuga

SEQ ID NO: 226571 - RNA, 62 nt, hsa
gcuacuugugaggcagaagaguuuucugugaaggaaaaaagcccauuagaguucuucaauuc

SEQ ID NO: 226572 - RNA, 62 nt, hsa
uauauuuuaagacuuuaaguagaauaaacccuggaaaaaagaucaagaguaaaaauauauag

SEQ ID NO: 226573 - RNA, 62 nt, hsa
caugauugauuagcaaugucugcacuggauacggaaaaaagaaggugcuugcagguuuacag

SEQ ID NO: 226574 - RNA, 62 nt, hsa
augcaguuagguggcucuuuccaagacucuggggaaaaaaguaguaaaaagcuaaaugcaau

SEQ ID NO: 226575 - RNA, 62 nt, hsa
uguauuaacucauacugccugucuuuuauaggggaaaaaaauaaccuuuuuuauuuuaaagu

SEQ ID NO: 226576 - RNA, 62 nt, hsa
caccagcagguuccaaauugauguguaugauaggaaaaaaaccuuaauuuuaaauauaauau

SEQ ID NO: 226577 - RNA, 62 nt, hsa
accagcacgcugucucagaaaacgaaaacggaggaaaaaaaccccaaaccccaaacaaucuu

SEQ ID NO: 226578 - RNA, 62 nt, hsa
cguggaacuacacacgaaguguaauuagugggggaaaaaauauuuuuuaaacaaaggauaua

SEQ ID NO: 226579 - RNA, 62 nt, hsa
gcuaaaugaaauaaaguggaaaaaaaaaaaaaggaaaaaaccaaaagcauaaaaaaccacag

SEQ ID NO: 226580 - RNA, 62 nt, hsa
ucuagccacugagcggcuaaaugaaauaaaguggaaaaaaaaaaaaaggaaaaaaccaaaag

SEQ ID NO: 226581 - RNA, 62 nt, hsa
agcagagcaaaauauggauaaugaaaguguugggaaaaaagugaugugacagggagugaaga

SEQ ID NO: 226582 - RNA, 62 nt, hsa
gagcguuuuuauguaugcuguuccugcaguuaggaaaaaaaaauccaagaaauguauugaau

SEQ ID NO: 226583 - RNA, 62 nt, hsa
gaaccuuaaaaaaaaaaaaaaagguuuugaagggaaaaaaagugguuucacaccucuuguua

SEQ ID NO: 226584 - RNA, 62 nt, hsa
gaccaaaaaaugagguuuugcuuuuguaaucaggaaaaaaaaaaauuaaugaaccuuaaaaa

SEQ ID NO: 226585 - RNA, 62 nt, hsa
uauuugaagaaagaaaaaacagauuuuaggguggaaaaaacagucaacucacacaaagaaug

SEQ ID NO: 226586 - RNA, 62 nt, hsa
gguggaaaaaacagucaacucacacaaagaauggaaaaaaauacugaguuaaauuaagcaaa

SEQ ID NO: 226587 - RNA, 62 nt, hsa
guuaauucuaauuaucuauuucaaauuuagcaggaaaaaagagaacaucaccuuguaaaacu

SEQ ID NO: 226588 - RNA, 62 nt, hsa
agguuuaauaaauagccuuaacuauuuggaggggaaaaaaugggucaacuuuuuuuuuuuuu

SEQ ID NO: 226589 - RNA, 62 nt, hsa
uuggauuaaaggguuguaacugacuacagcauggaaaaaaauaguucuuuuaauucuuucac

SEQ ID NO: 226590 - RNA, 62 nt, hsa
uagaugcaccaaccguaucauuauuuguuugaggaaaaaaagaaaucugcauuuuaauucau

SEQ ID NO: 226591 - RNA, 62 nt, hsa
uuuguaaaauuauuuugguuuucuucuacaaaggaaaaaauuggauuuauauauauaagguu

SEQ ID NO: 226592 - RNA, 62 nt, hsa
uguauuuuaaacacauaucguuucuuuuucuuggaaaaaaaguugauuaggaccacagauuu

SEQ ID NO: 226593 - RNA, 62 nt, hsa
ucaccuaucuggaaaaaaaaaaauaugagauuggaaaaaauuagacaagucuaguggaacca

SEQ ID NO: 226594 - RNA, 62 nt, hsa
ggaaggcacacugagcaaguuuucaccuaucuggaaaaaaaaaaauaugagauuggaaaaaa

SEQ ID NO: 226595 - RNA, 62 nt, hsa
cggcagugucauuccccuuugcacuguaaugaggaaaaaaugguauaaaagguugccaaauu

SEQ ID NO: 226596 - RNA, 62 nt, hsa
cuaugguaacacuuugcuuucugaauuggaagggaaaaaaaauguagcgacagcauuuuaag

SEQ ID NO: 226597 - RNA, 62 nt, hsa
cugcugcugccucugaaacagaaaguuggaaaggaaaaaagaaaaaagcaauuagguagcac

SEQ ID NO: 226598 - RNA, 62 nt, hsa
acuaaaaaaaguguguauuaggaggagagagaggaaaaaaagaggaaagaaggaaaaaaaaa

SEQ ID NO: 226599 - RNA, 62 nt, hsa
aggaggagagagaggaaaaaaagaggaaagaaggaaaaaaaaaagaauuaaaaaaaaaaaaa

SEQ ID NO: 226600 - RNA, 62 nt, hsa
aaaaaaaaagaaaaacagaagaugaccuugauggaaaaaaaauauuuuuuaaaaaaaagaua

SEQ ID NO: 226601 - RNA, 62 nt, hsa
uaauaccagaccaaagacauuuucuguuuccuggaaaaaaaaaaugaaucauguuaggcuuu

SEQ ID NO: 226602 - RNA, 62 nt, hsa
auuaguaggcuccugcugccaaaaugcaaaggggaaaaaaaggcagggauugggggggaugg

SEQ ID NO: 226603 - RNA, 62 nt, hsa
agaucacauacguuaucaaaaacuacucccuuggaaaaaauaucuuucgaaaaucaaauuua

SEQ ID NO: 226604 - RNA, 62 nt, hsa
agucaagguugcgaguacaggccaagaccaugggaaaaaaagccaugcucacuggccaauaa

SEQ ID NO: 226605 - RNA, 62 nt, hsa
gggaaagcaaagcagaaaacagugccccaaauggaaaaaagauacucacacagaacaaaaca

SEQ ID NO: 226606 - RNA, 62 nt, hsa
cacuuuguucugguauugacgcaauuauauuaggaaaaaaguugguugacuguuuuuguuua

SEQ ID NO: 226607 - RNA, 62 nt, hsa
uuggguauacuugugguuaguuuugugccauaggaaaaaauuaucuuaaaacuuuggccaua

SEQ ID NO: 226608 - RNA, 62 nt, hsa
aaguauuccagcaaaagaggauguagccucugggaaaaaacaaacauguuacaguguuuuuu

SEQ ID NO: 226609 - RNA, 62 nt, hsa
agcagcacuguauauaccugucucuaaguaaaggaaaaaacaaaauaaggacuucaauccaa

SEQ ID NO: 226610 - RNA, 62 nt, hsa
aauugaaguucagagucacccguggcuccuaaggaaaaaacagcaucaugaaaggcaaaaag

SEQ ID NO: 226611 - RNA, 62 nt, hsa
aaugcauaaugcuuucucaccaacagaaaaaaggaaaaaaauuguuuucaguuaaacacuac

SEQ ID NO: 226612 - RNA, 62 nt, hsa
gcuugcugccuuuaauugucuugcucucuaugggaaaaaaacaaaagggcuucagucucaug

SEQ ID NO: 226613 - RNA, 62 nt, hsa
accucauuucaagaaaauaugcuuaacagagaggaaaaaaaugugguuuggccuugcugcug

SEQ ID NO: 226614 - RNA, 62 nt, hsa
gcuuguugaaauguuuugcaucugucaauuaaggaaaaaaaaaaucacucuauguugcccca

SEQ ID NO: 226615 - RNA, 62 nt, hsa
uaaacuagcucauuauuuccaucuuuggaaaaggaaaaaaaaaaaaacuucuuuaggcauuu

SEQ ID NO: 226616 - RNA, 62 nt, hsa
uagggagaaaacuagucuaaauuauuucaacuggaaaaaagaaaaaagaguccucuucuuuu

SEQ ID NO: 226617 - RNA, 62 nt, hsa
uauggaagucgugucuuacuccaggugaagggggaaaaaaaaagccuauacuuuggcagguu

SEQ ID NO: 226618 - RNA, 62 nt, hsa
auguuuccauguucccaacuauguugagaaguggaaaaaaacccagguucuagaugggugaa

SEQ ID NO: 226619 - RNA, 62 nt, hsa
uaggcgggaucgcuuuguuggucaaagugaggggaaaaaagcacgaccuacugcacgaaggg

SEQ ID NO: 226620 - RNA, 62 nt, hsa
aacucuaaaaaaaaaaaaaauacaaauaaaaaggaaaaaaaauuacauuuuuuaucuuauac

SEQ ID NO: 226621 - RNA, 62 nt, hsa
caguauucagcuucuuaaccagucgcuauuuaggaaaaaaaacccacuaguuaggccaucaa

SEQ ID NO: 226622 - RNA, 62 nt, hsa
ugauaucacugcugacuuuuauauuaugggagggaaaaaauaacauuaauaaaaaggugaua

SEQ ID NO: 226623 - RNA, 62 nt, hsa
cccccccacuaugcccucauuuuuuuaaaaaaggaaaaaaaaaagaaacuggguuccagucu

SEQ ID NO: 226624 - RNA, 62 nt, hsa
aaaaaauaaauaaaaauaaaaaaaauaaaaaaggaaaaaaaaaaaagaagaaacaagacaug

SEQ ID NO: 226625 - RNA, 62 nt, hsa
ccgucuucacagacaaacuugaaagguauuaaggaaaaaauuccacauagcucugggccuuu

SEQ ID NO: 226626 - RNA, 62 nt, hsa
cuacaguagaagaacuuacuucugaaaugaagggaaaaaaaccaccccaucguucccuacuc

SEQ ID NO: 226627 - RNA, 62 nt, hsa
uccauuccaccugacccuguguguacaauccaggaaaaaaacaaaccccacucagaaacaga

SEQ ID NO: 226628 - RNA, 62 nt, hsa
acacaauggguuuggagcugacugggaacaauggaaaaaauuacauuagcugugguuguaaa

SEQ ID NO: 226629 - RNA, 62 nt, hsa
uuucauagccuguaucuaucauuuagaugcauggaaaaaaaugggcuuugcacacaaugggu

SEQ ID NO: 226630 - RNA, 62 nt, hsa
gcuuguauuauaguuauuaagcuuguuuuuguggaaaaaaacuuacuaaaaccuagguaacu

SEQ ID NO: 226631 - RNA, 62 nt, hsa
aaaaaggaaucuugccagauguagcuacuuaaggaaaaaaggguuuuuaauagaaaugaacu

SEQ ID NO: 226632 - RNA, 62 nt, hsa
gcagucauguggaaccuugcuuucuaguccugggaaaaaaagaugucucuaauuacuggcuu

SEQ ID NO: 226633 - RNA, 62 nt, hsa
gaauuuaauguauaaaauguugucaaaccaagggaaaaaaccacaguucaccauguggaguu

SEQ ID NO: 226634 - RNA, 62 nt, hsa
caacggccacuguguguggcugcucugagugaggaaaaaauuaaaaagaaaaacugguucca

SEQ ID NO: 226635 - RNA, 62 nt, hsa
aggcucagcuggggaugguguuugacuucggaggaaaaaaguugcuauugcccguuaaaggc

SEQ ID NO: 226636 - RNA, 62 nt, hsa
ccuguuugcaauugcuucccucaucucaguagggaaaaaauugagugggaguacugagaugu

SEQ ID NO: 226637 - RNA, 62 nt, hsa
uacagagguugaauugaguauauauuugaaaaggaaaaaacaaaaaacaaacccagacccca

SEQ ID NO: 226638 - RNA, 62 nt, hsa
uuaaaaaaaaagacauauaagguugauuaaagggaaaaaaggcuccaguuuguuuuacaggu

SEQ ID NO: 226639 - RNA, 62 nt, hsa
aauaacaaaagaggaaaaaaaaaaucccuccuggaaaaaaaaaaaaacccuggaaaauagaa

SEQ ID NO: 226640 - RNA, 62 nt, hsa
gcgagcaagccuuuuugaaaaauaacaaaagaggaaaaaaaaaaucccuccuggaaaaaaaa

SEQ ID NO: 226641 - RNA, 62 nt, hsa
ccuaggcaacagagugauacgcuguuuaaaaaggaaaaaauccuucccuagagcuaguaucc

SEQ ID NO: 226642 - RNA, 62 nt, hsa
gggugacagagugagacuccaucucaacagaaggaaaaaaaaggaaaauaggagaaggugga

SEQ ID NO: 226643 - RNA, 62 nt, hsa
uuuugcaaaaaucuuuauugguguugaaaacuggaaaaaauaacucauccagaauucauauu

SEQ ID NO: 226644 - RNA, 62 nt, hsa
cagaacaaaucgucaggugccuggagcaaaaaggaaaaaaaaaaaagaaaggacauugaguu

SEQ ID NO: 226645 - RNA, 62 nt, hsa
gaaacugugaguuguuuuuuuuuuaacaacugggaaaaaacaaaaacaaaaaacuauaguua

SEQ ID NO: 226646 - RNA, 62 nt, hsa
aaugauaaauugaccccuuuuuauaaauggagggaaaaaaugaacagauuucagagauuaaa

SEQ ID NO: 226647 - RNA, 62 nt, hsa
uuauaugccaaaaagauccuacauuuugguagggaaaaaacaacacuguguuugacguauuu

SEQ ID NO: 226648 - RNA, 62 nt, hsa
uacaguauaaacuaccucacuugccuuucuugggaaaaaaaaaaugaauggacuuuaacaau

SEQ ID NO: 226649 - RNA, 62 nt, hsa
gauuuguagugcauagguguguguuucaagaaggaaaaaaaaagacuucuguucaaaguuaa

SEQ ID NO: 226650 - RNA, 62 nt, hsa
auuauacacuguacauuuuuuucacagcaauuggaaaaaaacaaccacuugcaaucauucaa

SEQ ID NO: 226651 - RNA, 62 nt, hsa
ugaucauuaccuguaaaugaaagaccuuaauaggaaaaaaagaguaaagcucagugugaaug

SEQ ID NO: 226652 - RNA, 62 nt, hsa
ucauaaaauuuucauauaugccuagauaauggggaaaaaaagucuugugauugacuuucgca

SEQ ID NO: 226653 - RNA, 62 nt, hsa
aauguaacugugcacaggaaaugacugguaauggaaaaaauguuguaauaaaauaaucuaau

SEQ ID NO: 226654 - RNA, 62 nt, hsa
ccuucuccuccuccuccuccucuucccuugggggaaaaaaaaaaaugugcuaauaaaacuuc

SEQ ID NO: 226655 - RNA, 62 nt, hsa
acaucacacaguguccuguagcuaagugucuaggaaaaaacaaaaacuccaaacccuucagu

SEQ ID NO: 226656 - RNA, 62 nt, hsa
ccuauaacuuuucagcuggugcuuuuacuuagggaaaaaaacaauuuguaaauacagaacau

SEQ ID NO: 226657 - RNA, 62 nt, hsa
uuuauaaauuaaacuuuagauauguauguacaggaaaaaauguaguauauaguaucguauau

SEQ ID NO: 226658 - RNA, 62 nt, hsa
aaauguaguauauaguaucguauauauguacaggaaaaaaacguacuaucugugguuucagg

SEQ ID NO: 226659 - RNA, 62 nt, hsa
aaaacacacagaagagauuuaaaaaaaaaaaaggaaaaaaaaaaaagacauaaacuggcacc

SEQ ID NO: 226660 - RNA, 62 nt, hsa
caaaaaagcgacaaaaaaacacaaacagaagaggaaaaaaaagcaacaaaaaaagaaaacac

SEQ ID NO: 226661 - RNA, 62 nt, hsa
ugggcagcguggugggggauaaauaaauaaaaggaaaaaaaacuuagccuagaauuagaauu

SEQ ID NO: 226662 - RNA, 62 nt, hsa
ccaagaauaagcagcagaacccuguuccauauggaaaaaagaaaaacaauuuuuugucccua

SEQ ID NO: 226663 - RNA, 62 nt, hsa
uaguauuuaaaaauagagaaauugcacuuccuggaaaaaauuaaaaaguaguuaguuuaauu

SEQ ID NO: 226664 - RNA, 62 nt, hsa
aacuagaccccacaccagggcacccuaagaggggaaaaaagugaauucaaagcaaaaauaac

SEQ ID NO: 226665 - RNA, 62 nt, hsa
agaauucccuguaucaucuggaucucaacaucggaaaaaagaagcggauaguguuuauggag

SEQ ID NO: 226666 - RNA, 62 nt, hsa
gaaaaaugggcuggagagaaggagaaggauuaggaaaaaacaaagaaggcaauaaggaaccc

SEQ ID NO: 226667 - RNA, 62 nt, hsa
uguauuuauucaagugcauuaaagucuacaauggaaaaaaagcagugaagcauuagaugcug

SEQ ID NO: 226668 - RNA, 62 nt, hsa
aucucagucuuuauuuguguaauucauuuugaggaaaaaacaacuccauguauuuauucaag

SEQ ID NO: 226669 - RNA, 62 nt, hsa
auuuguguuauucuggauguauaaaaaucaauggaaaaaaauaaacuuucaaauugaaauga

SEQ ID NO: 226670 - RNA, 62 nt, hsa
ggacuuuuucuuagguuugcuaaauacuguagggaaaaaaaugcuucuuucuacuuuguuua

SEQ ID NO: 226671 - RNA, 62 nt, hsa
ucugaccugcaaaaaugcuggagaaaaaugaaggaaaaaauuauguuuuucaguuuaauucu

SEQ ID NO: 226672 - RNA, 62 nt, hsa
gaggaaaaaacauucagacaaauguucagugaggaaaaaaaggggaaguuggggauaggcag

SEQ ID NO: 226673 - RNA, 62 nt, hsa
uucagugugagugaggaaaacauguucagugaggaaaaaacauucagacaaauguucaguga

SEQ ID NO: 226674 - RNA, 62 nt, hsa
gcagauaaguggccuugacacauuacaagccuggaaaaaaacaucagaaauaauaaaaaauu

SEQ ID NO: 226675 - RNA, 62 nt, hsa
aaguaguaaaagaagaaauaguucugugacuaggaaaaaauugcuuuugagagaacauagau

SEQ ID NO: 226676 - RNA, 62 nt, hsa
caacuuuuuaguuuuguuccuucaaaguugaaggaaaaaaaguuugguuuuauaaaauucau

SEQ ID NO: 226677 - RNA, 62 nt, hsa
uuuguauaaaaauuuaaauugaauuaaaagaaggaaaaaaaaagcccaaacuuaaccucuga

SEQ ID NO: 226678 - RNA, 62 nt, hsa
gggagcucaaagucacaagaagaaaaaugaaaggaaaaaacagcagcccuauucagaaauug

SEQ ID NO: 226679 - RNA, 62 nt, hsa
ggagucaucaauucauccauaaauauaaaaagggaaaaaaacuuaaggcaguagucugcauu

SEQ ID NO: 226680 - RNA, 64 nt, hsa; identical to SEQ ID NO: 123933

SEQ ID NO: 226681 - RNA, 64 nt, hsa; identical to SEQ ID NO: 123934

SEQ ID NO: 226682 - RNA, 64 nt, hsa; identical to SEQ ID NO: 123935

SEQ ID NO: 226683 - RNA, 64 nt, hsa; identical to SEQ ID NO: 123936

SEQ ID NO: 226684 - RNA, 64 nt, hsa; identical to SEQ ID NO: 123937

SEQ ID NO: 226685 - RNA, 57 nt, hsa; identical to SEQ ID NO: 123938

SEQ ID NO: 226686 - RNA, 64 nt, hsa; identical to SEQ ID NO: 123939

SEQ ID NO: 226687 - RNA, 64 nt, hsa; identical to SEQ ID NO: 123940

SEQ ID NO: 226688 - RNA, 64 nt, hsa; identical to SEQ ID NO: 123941

SEQ ID NO: 226689 - RNA, 64 nt, hsa; identical to SEQ ID NO: 123942

SEQ ID NO: 226690 - RNA, 64 nt, hsa; identical to SEQ ID NO: 123943

SEQ ID NO: 226691 - RNA, 64 nt, hsa; identical to SEQ ID NO: 123944

SEQ ID NO: 226692 - RNA, 64 nt, hsa; identical to SEQ ID NO: 123945

SEQ ID NO: 226693 - RNA, 64 nt, hsa; identical to SEQ ID NO: 123946

SEQ ID NO: 226694 - RNA, 64 nt, hsa; identical to SEQ ID NO: 123947

SEQ ID NO: 226695 - RNA, 64 nt, hsa; identical to SEQ ID NO: 123948

SEQ ID NO: 226696 - RNA, 64 nt, hsa; identical to SEQ ID NO: 123949

SEQ ID NO: 226697 - RNA, 64 nt, hsa; identical to SEQ ID NO: 123950

SEQ ID NO: 226698 - RNA, 64 nt, hsa; identical to SEQ ID NO: 123951

SEQ ID NO: 226699 - RNA, 64 nt, hsa; identical to SEQ ID NO: 123952

SEQ ID NO: 226700 - RNA, 64 nt, hsa; identical to SEQ ID NO: 123953

SEQ ID NO: 226701 - RNA, 64 nt, hsa; identical to SEQ ID NO: 123954

SEQ ID NO: 226702 - RNA, 64 nt, hsa; identical to SEQ ID NO: 123955

SEQ ID NO: 226703 - RNA, 64 nt, hsa; identical to SEQ ID NO: 123956

SEQ ID NO: 226704 - RNA, 64 nt, hsa; identical to SEQ ID NO: 123957

SEQ ID NO: 226705 - RNA, 64 nt, hsa; identical to SEQ ID NO: 123958

SEQ ID NO: 226706 - RNA, 62 nt, hsa
guggacagcccagacccugaaaggacguguggagacagcagcaguccuguggugcaguuacu

SEQ ID NO: 226707 - RNA, 62 nt, hsa
guuaugcuaaaguggagguuucagccuccagaagacagcagagccuucuagggucaccuuaa

SEQ ID NO: 226708 - RNA, 62 nt, hsa
cgccucccccgcagguuaugucagcagcucugagacagcaguaucacaggccagauguuguu

SEQ ID NO: 226709 - RNA, 62 nt, hsa
augagccccacguggagcucgggacggauaguagacagcaauaacucgguguguggccgccu

SEQ ID NO: 226710 - RNA, 62 nt, hsa
auaaaaaagggaaaacuauagcuuugaguggcagacagcacacaucacaugcaucaacucac

SEQ ID NO: 226711 - RNA, 62 nt, hsa
gcuuucuccuacagggcuuuuccugaguccccagacagcagaguaugaacugcugacaccca

SEQ ID NO: 226712 - RNA, 62 nt, hsa
ugaaugaaugaaaguugagucuuucuuaaucuagacagcaaacuuaacaggcuuuccaauua

SEQ ID NO: 226713 - RNA, 62 nt, hsa
caaagacaaguacaacuccauuagaaaaauucagacagcaucuucucuauuggccucucagg

SEQ ID NO: 226714 - RNA, 62 nt, hsa
gaagcugucagcuuaauaacaagaauggccuaagacagcaaagacagcacuguuccugggcu

SEQ ID NO: 226715 - RNA, 62 nt, hsa
agcuuaauaacaagaauggccuaagacagcaaagacagcacuguuccugggcugggacgcaa

SEQ ID NO: 226716 - RNA, 62 nt, hsa
gaaaaaagaaacaugccacuugauuaggagagagacagcaguguuugaacuacagcaucuuu

SEQ ID NO: 226717 - RNA, 62 nt, hsa
uggaggucagagucugcuuucguaggcucuuuagacagcaccuaccacuugguucuccagcg

SEQ ID NO: 226718 - RNA, 62 nt, hsa
aagaaauucaugcuugcaccgaguacaaggacagacagcaggcacggcccgcagccuggcau

SEQ ID NO: 226719 - RNA, 62 nt, hsa
ucaagcauccucagaagccucgacugagcuuuagacagcagagcagaugccgcaggcgcggc

SEQ ID NO: 226720 - RNA, 62 nt, hsa
uagccaggccccagggagccuccgcugggcccagacagcagcguuugguuuuauccacuuuu

SEQ ID NO: 226721 - RNA, 62 nt, hsa
ucucaaaaaaaaaaaaaaaaacaauggaaggcagacagcaagucccugaggacacaucacac

SEQ ID NO: 226722 - RNA, 64 nt, hsa; identical to SEQ ID NO: 73453

SEQ ID NO: 226723 - RNA, 64 nt, hsa; identical to SEQ ID NO: 73454

SEQ ID NO: 226724 - RNA, 64 nt, hsa; identical to SEQ ID NO: 73455

SEQ ID NO: 226725 - RNA, 64 nt, hsa; identical to SEQ ID NO: 73456

SEQ ID NO: 226726 - RNA, 64 nt, hsa; identical to SEQ ID NO: 73457

SEQ ID NO: 226727 - RNA, 64 nt, hsa; identical to SEQ ID NO: 73458

SEQ ID NO: 226728 - RNA, 64 nt, hsa; identical to SEQ ID NO: 73459

SEQ ID NO: 226729 - RNA, 64 nt, hsa; identical to SEQ ID NO: 73460

SEQ ID NO: 226730 - RNA, 64 nt, hsa; identical to SEQ ID NO: 73461

SEQ ID NO: 226731 - RNA, 64 nt, hsa; identical to SEQ ID NO: 73462

SEQ ID NO: 226732 - RNA, 64 nt, hsa; identical to SEQ ID NO: 73463

SEQ ID NO: 226733 - RNA, 64 nt, hsa; identical to SEQ ID NO: 73464

SEQ ID NO: 226734 - RNA, 64 nt, hsa; identical to SEQ ID NO: 73465

SEQ ID NO: 226735 - RNA, 64 nt, hsa; identical to SEQ ID NO: 73466

SEQ ID NO: 226736 - RNA, 64 nt, hsa; identical to SEQ ID NO: 73467

SEQ ID NO: 226737 - RNA, 64 nt, hsa; identical to SEQ ID NO: 73468

SEQ ID NO: 226738 - RNA, 64 nt, hsa; identical to SEQ ID NO: 73469

SEQ ID NO: 226739 - RNA, 64 nt, hsa; identical to SEQ ID NO: 73470

SEQ ID NO: 226740 - RNA, 64 nt, hsa; identical to SEQ ID NO: 73471

SEQ ID NO: 226741 - RNA, 64 nt, hsa; identical to SEQ ID NO: 73472

SEQ ID NO: 226742 - RNA, 64 nt, hsa; identical to SEQ ID NO: 73473

SEQ ID NO: 226743 - RNA, 64 nt, hsa; identical to SEQ ID NO: 73474

SEQ ID NO: 226744 - RNA, 64 nt, hsa; identical to SEQ ID NO: 73475

SEQ ID NO: 226745 - RNA, 64 nt, hsa; identical to SEQ ID NO: 73476

SEQ ID NO: 226746 - RNA, 64 nt, hsa; identical to SEQ ID NO: 73477

SEQ ID NO: 226747 - RNA, 64 nt, hsa; identical to SEQ ID NO: 73478

SEQ ID NO: 226748 - RNA, 64 nt, hsa; identical to SEQ ID NO: 73479

SEQ ID NO: 226749 - RNA, 64 nt, hsa; identical to SEQ ID NO: 73480

SEQ ID NO: 226750 - RNA, 64 nt, hsa; identical to SEQ ID NO: 73481

SEQ ID NO: 226751 - RNA, 64 nt, hsa; identical to SEQ ID NO: 73482

SEQ ID NO: 226752 - RNA, 64 nt, hsa; identical to SEQ ID NO: 73483

SEQ ID NO: 226753 - RNA, 64 nt, hsa; identical to SEQ ID NO: 73484

SEQ ID NO: 226754 - RNA, 64 nt, hsa; identical to SEQ ID NO: 73485

SEQ ID NO: 226755 - RNA, 64 nt, hsa; identical to SEQ ID NO: 73486

SEQ ID NO: 226756 - RNA, 64 nt, hsa; identical to SEQ ID NO: 73487

SEQ ID NO: 226757 - RNA, 64 nt, hsa; identical to SEQ ID NO: 73488

SEQ ID NO: 226758 - RNA, 64 nt, hsa; identical to SEQ ID NO: 73489

SEQ ID NO: 226759 - RNA, 64 nt, hsa; identical to SEQ ID NO: 73490

SEQ ID NO: 226760 - RNA, 64 nt, hsa; identical to SEQ ID NO: 73491

SEQ ID NO: 226761 - RNA, 64 nt, hsa; identical to SEQ ID NO: 73492

SEQ ID NO: 226762 - RNA, 64 nt, hsa; identical to SEQ ID NO: 73493

SEQ ID NO: 226763 - RNA, 64 nt, hsa; identical to SEQ ID NO: 73494

SEQ ID NO: 226764 - RNA, 64 nt, hsa; identical to SEQ ID NO: 73495

SEQ ID NO: 226765 - RNA, 64 nt, hsa; identical to SEQ ID NO: 73496

SEQ ID NO: 226766 - RNA, 64 nt, hsa; identical to SEQ ID NO: 73497

SEQ ID NO: 226767 - RNA, 64 nt, hsa; identical to SEQ ID NO: 73498

SEQ ID NO: 226768 - RNA, 64 nt, hsa; identical to SEQ ID NO: 73499

SEQ ID NO: 226769 - RNA, 64 nt, hsa; identical to SEQ ID NO: 73500

SEQ ID NO: 226770 - RNA, 64 nt, hsa; identical to SEQ ID NO: 73501

SEQ ID NO: 226771 - RNA, 64 nt, hsa; identical to SEQ ID NO: 73502

SEQ ID NO: 226772 - RNA, 64 nt, hsa; identical to SEQ ID NO: 73503

SEQ ID NO: 226773 - RNA, 64 nt, hsa; identical to SEQ ID NO: 73504

SEQ ID NO: 226774 - RNA, 64 nt, hsa; identical to SEQ ID NO: 73505

SEQ ID NO: 226775 - RNA, 64 nt, hsa; identical to SEQ ID NO: 73506

SEQ ID NO: 226776 - RNA, 64 nt, hsa; identical to SEQ ID NO: 73507

SEQ ID NO: 226777 - RNA, 64 nt, hsa; identical to SEQ ID NO: 73508

SEQ ID NO: 226778 - RNA, 64 nt, hsa; identical to SEQ ID NO: 73509

SEQ ID NO: 226779 - RNA, 64 nt, hsa; identical to SEQ ID NO: 73510

SEQ ID NO: 226780 - RNA, 64 nt, hsa; identical to SEQ ID NO: 73511

SEQ ID NO: 226781 - RNA, 64 nt, hsa; identical to SEQ ID NO: 73512

SEQ ID NO: 226782 - RNA, 64 nt, hsa; identical to SEQ ID NO: 73513

SEQ ID NO: 226783 - RNA, 60 nt, hsa
cagggcagucgugugucuuacccagcuacacagggugacauuuuggucuagaaccuaguc

SEQ ID NO: 226784 - RNA, 60 nt, hsa
acccaaggaguccugugauuugagcuucagcagggugaucuacauuugggugcuuguuuc

SEQ ID NO: 226785 - RNA, 60 nt, hsa
uuucaaguacggugucauuuucacagucuccagggugacaaaugccaauagauaugugag

SEQ ID NO: 226786 - RNA, 60 nt, hsa
ugaaucauuacaucaaggagcugccccugucagggugaguguaauuaggaacgauaccag

SEQ ID NO: 226787 - RNA, 60 nt, hsa
auaaagauacguuugcaaucagugacuacucagggugacacccuugcccuaaagcaggag

SEQ ID NO: 226788 - RNA, 60 nt, hsa
cagcucucccuggacuugcccugccuggaacagggugauuugcuggaauggaguuaccac

SEQ ID NO: 226789 - RNA, 60 nt, hsa
auguuuuacuuuucacuggagaagacaaaacagggugaucuucauguuauuguuuuauac

SEQ ID NO: 226790 - RNA, 60 nt, hsa
cucgauauuaaaaucauccuugacaugaaacagggugaagagaagcuguccguggcggcu

SEQ ID NO: 226791 - RNA, 60 nt, hsa
ugccuucaggggguuguuacuugagagcuccagggugaagggagaaagccugugcucugg

SEQ ID NO: 226792 - RNA, 60 nt, hsa
ugggcuuccuuuaaagggagggggagaagccagggugauagcccagacucugcccuguug

SEQ ID NO: 226793 - RNA, 60 nt, hsa
guggagaguaggguggucuugugaguugugcagggugaagaccgcuucccugagacaggg

SEQ ID NO: 226794 - RNA, 60 nt, hsa
gccugcccccgggcagcacgggagggagagcagggugagcacgcuuguugguuucagaug

SEQ ID NO: 226795 - RNA, 60 nt, hsa
ccuucaguacccagccagguucucuggguccagggugacucuccaaagaaauuggccuuc

SEQ ID NO: 226796 - RNA, 60 nt, hsa
aagguuuggcuacuuguauaggucugccugcagggugaaaaugccagugugaauauucua

SEQ ID NO: 226797 - RNA, 60 nt, hsa
gguggcacuguucacuggcgcugggacagucagggugaccccaccgccuaccucucuaca

SEQ ID NO: 226798 - RNA, 60 nt, hsa
ggaggguggcaggucuuugcagcucccggccagggugaggcggaagugagcccucauccu

SEQ ID NO: 226799 - RNA, 60 nt, hsa
gccccaguguuauuuauuccccagugacuccagggugacaaggccugcuugacuuuccag

SEQ ID NO: 226800 - RNA, 60 nt, hsa
agcaaccacacugcuuggcccuucaagggucagggugagacgugaugggcuaggccuccg

SEQ ID NO: 226801 - RNA, 64 nt, hsa
ucauguagaauaaaaauuuuaaaucucacuucacuuagccgacauuccaugcccugaccaaucc

SEQ ID NO: 226802 - RNA, 64 nt, hsa
cagcgcccccugcuggagaaguuuuuucauuuuguuagccgacuucugguagcuuagcaaagag

SEQ ID NO: 226803 - RNA, 64 nt, hsa
agguugacaagugaaguuucucuaauguugauuguuagccgauuuguaaccuggcauuuacuua

SEQ ID NO: 226804 - RNA, 64 nt, hsa
accggggaaaauguuccuaaaccaggaagcugcguuagccgaucaggcuuuguaagaucucgcc

SEQ ID NO: 226805 - RNA, 64 nt, hsa
aaauuuaugugguuguuacacuuccauaguugucuuagccgaauccuuccauauucuuaugauu

SEQ ID NO: 226806 - RNA, 64 nt, hsa
ggugaaaccccaucucuacuaaaaauacaaaaaauuagccgagcacgguggugcaugccuguaa

SEQ ID NO: 226807 - RNA, 64 nt, hsa
ggagaguagaguuaagacaaggcccaguuuuguguuagccgaccgucuuugcccaccucuauga

SEQ ID NO: 226808 - RNA, 64 nt, hsa
uggugaaaaccugucucuacuaaaaauacaaaaauuagccgagcgugguggugcgugccuguag

SEQ ID NO: 226809 - RNA, 64 nt, hsa
gaacgugauuagucaucgccgagaagaaagcauauuagccgaggagguagucacgcggcacgcg

SEQ ID NO: 226810 - RNA, 64 nt, hsa
gcugugacuguaaaaguguacuuuccauuaauuauuagccgaguuaagagaauggucacauuga

SEQ ID NO: 226811 - RNA, 64 nt, hsa
uucuguucauuuccauugcugcuuauaugcaguguuagccgaauuagauuuacaagacaaucua

SEQ ID NO: 226812 - RNA, 64 nt, hsa
uggagaaaccccgucucuaucagaaauacaaaauuuagccgagugugguggcacaugccugugg

SEQ ID NO: 226813 - RNA, 64 nt, hsa
uggugaaaccccaucucuacuaaaaguacaaauauuagccgacuauguggcgggcaccuguaau

SEQ ID NO: 226814 - RNA, 64 nt, hsa
ggugaaaccuccgucucuauuaaaaauacaaaaauuagccgagagugguggcaugcaccuguca

SEQ ID NO: 226815 - RNA, 64 nt, hsa
aaauauugccauguuuacaauauguaauauguuuuuagccgauggauuuaaacauguagauuca

SEQ ID NO: 226816 - RNA, 64 nt, hsa
cuguacucccccugcccuccccgacccgcccagcuuagccgaugaccugcacaucgcuccacug

SEQ ID NO: 226817 - RNA, 64 nt, hsa
gugaaacccccaucucuacuaaaaauaccaaaaauuagccgagcguagugacgggugcccguaa

SEQ ID NO: 226818 - RNA, 64 nt, hsa
cguggcguuccauugagugucugucaucauguguuuagccgaguggauggauagucugcuuguu

SEQ ID NO: 226819 - RNA, 64 nt, hsa
ggggggaggcacuccuccagggcucucccuguccuuagccgauuuugagggaacccuguggcac

SEQ ID NO: 226820 - RNA, 64 nt, hsa
cuggacuugguacaguugcaggagcgugaaggacuuagccgacugcgcugcuuuuucaaaacgg

SEQ ID NO: 226821 - RNA, 64 nt, hsa
uggcggaacccugucucuaccaaaauuacaaaaauuagccgagcaugguggcgcaugccuguag

SEQ ID NO: 226822 - RNA, 64 nt, hsa
aaaaaugcguauauuucuauguuuacuuaaucuguuagccgaggcuuagaggagcucuugugag

SEQ ID NO: 226823 - RNA, 64 nt, hsa
auuuuugucuaauaauaaagaauuucuauaaacuuuagccgaaauuggagucaacacuuauuca

SEQ ID NO: 226824 - RNA, 64 nt, hsa
agaauggcgugaacccggaaggcggagcuugcaguuagccgagaucaugccacugcacuccagc

SEQ ID NO: 226825 - RNA, 64 nt, hsa
aggugaaacccugucucuacuaaaaauacaaaaauuagccgagcaugguggccugugccuguaa

SEQ ID NO: 226826 - RNA, 64 nt, hsa
uguuuaguauucucuugugcauuugguuuguugguuagccgacugucuugaaacuauucauuuu

SEQ ID NO: 226827 - RNA, 64 nt, hsa
cagggagacucaguuucuccaaaaaaauaaaaaauuagccgaucaugguggugcgugcuuauag

SEQ ID NO: 226828 - RNA, 64 nt, hsa
agccacacaugcaaacaucaguguccuucuagcuuuagccgagaaagaaaccagucccagggaa

SEQ ID NO: 226829 - RNA, 64 nt, hsa
ccccagcucucagugaccccgacugucuccugacuuagccgagguaaggucagugcagcagaca

SEQ ID NO: 226830 - RNA, 64 nt, hsa
uggugaaaccccgucucuacuaaaaauagaagcauuagccgagccugguggugcgugccuguaa

SEQ ID NO: 226831 - RNA, 64 nt, hsa
gaaaggcaugagugcgggcagugugggaaauccuuuagccgaaaaucuagccuuauuauacauc

SEQ ID NO: 226832 - RNA, 64 nt, hsa
cucccccagaacuuugcacacaucuugcuauguauuagccgaugucuuuaguguugagccucug

SEQ ID NO: 226833 - RNA, 64 nt, hsa
ggccaggguagaggcugacggcgcaagaccagcuuuagccgacaacagagacuggacugugggc

SEQ ID NO: 226834 - RNA, 64 nt, hsa
uguucaagguaauaugccaggcgcuguaugucuccacugccaaguagaagugacucaaaacccu

SEQ ID NO: 226835 - RNA, 64 nt, hsa
caugaccccaccuuuacuaagcacaaguacuugccacugccaucacugccaaguaacuagaugu

SEQ ID NO: 226836 - RNA, 64 nt, hsa
accuuuacuaagcacaaguacuugccacugccaucacugccaaguaacuagaugucucuguuuc

SEQ ID NO: 226837 - RNA, 64 nt, hsa
cugguuaucuuccuguuccuguagcauagccaggcacugccagucaccugugcccccauugcug

SEQ ID NO: 226838 - RNA, 64 nt, hsa
ggguccugaguguggguauccacuuuuacccgcucacugccaccuguggacacucugugucuac

SEQ ID NO: 226839 - RNA, 64 nt, hsa
caccaaauugcuuuauuccccuuugcaagaugggcacugccauaguucugccucuuugcugggg

SEQ ID NO: 226840 - RNA, 64 nt, hsa
ccucccucaccagcucuuacgccucagccagcaccacugccaccagggcaacugcagcagcauc

SEQ ID NO: 226841 - RNA, 64 nt, hsa
uuugccaagggaauuauagcugcagguucucucucacugccaucaaacuguaaaagauuaaacu

SEQ ID NO: 226842 - RNA, 64 nt, hsa
gcccaugauggucacuuaaaaugugcaguaauagcacugccaggaucaagcaugaaaggcuuuu

SEQ ID NO: 226843 - RNA, 64 nt, hsa
cuuccuugggaccaaggaccguuccaacagcauucacugccaguucuaauaggcgaggaaaaug

SEQ ID NO: 226844 - RNA, 64 nt, hsa
cccugguugcaucccagaagcaucugacugucaccacugccaguggcuguggaacaguccuggg

SEQ ID NO: 226845 - RNA, 64 nt, hsa
cucagcaguccucccucuggggacucccugccaccacugccaguuucugaaacggucccacugg

SEQ ID NO: 226846 - RNA, 64 nt, hsa
gaccagacgccacaccuugugcuucuuaucuguccacugccacucccccaguucaaauccuuac

SEQ ID NO: 226847 - RNA, 64 nt, hsa
ggagugcaggguggacaucaccuuggaggcccugcacugccagcaucuggagaccguccuggag

SEQ ID NO: 226848 - RNA, 64 nt, hsa
cacccccaaccuccaucgccuugcagguuuucuucacugccaggaguagugagcuguacgaguc

SEQ ID NO: 226849 - RNA, 64 nt, hsa
uggagcaagcuggggcgggggguggguaaacccucacugccagcaggccccaaguggcuuguaa

SEQ ID NO: 226850 - RNA, 64 nt, hsa
gccuuuccuggacagacugaagagcugagcagggcacugccagccugucccucauuacccaagg

SEQ ID NO: 226851 - RNA, 64 nt, hsa
gacagccuggacauuggacauugcuaaguugggucacugccacauggagucuugccaugccugu

SEQ ID NO: 226852 - RNA, 64 nt, hsa
ggacgcugccacaucugggcauacagugucuggacacugccacauggagccacugucaugcagg

SEQ ID NO: 226853 - RNA, 64 nt, hsa
uacucaauauucucuucaagcauuuuuuuucuuccacugccacucucuuuaccuuuaucauuuc

SEQ ID NO: 226854 - RNA, 64 nt, hsa
gcacauccaggaaaaaagacuaggacuugccacacacugccaauucauaauccgcaggaucugu

SEQ ID NO: 226855 - RNA, 64 nt, hsa
cgccuuuggggaggucuggaccacccagggccuccacugccaccuuggcuggcaagggagaaau

SEQ ID NO: 226856 - RNA, 64 nt, hsa
gaccccauaccguuagcccuuguauguauaccaacacugccaaaguaaaacauuaggucaggca

SEQ ID NO: 226857 - RNA, 64 nt, hsa
guguggugacccccauacauuccucccugcuccccacugccaggaggaccacuguccccagcca

SEQ ID NO: 226858 - RNA, 64 nt, hsa
uccucacccccaccccacuuagguccugggcccccacugccaggcugggcccagcuugcucagu

SEQ ID NO: 226859 - RNA, 64 nt, hsa
gaaaauuucugccuggcacacaccuggcuccaaccacugccaagugaucacucuuaggcccagg

SEQ ID NO: 226860 - RNA, 64 nt, hsa
ggcagguguguguucucuucugcauguuuuuaugcacugccaauuagcuucuacuaaccacggu

SEQ ID NO: 226861 - RNA, 64 nt, hsa
cugacggguguggccacccgcugucacaauggcacacugccacugucccuuggcacgcacacag

SEQ ID NO: 226862 - RNA, 64 nt, hsa
agggggcugagcagagcccauccaggacacuccacacugccaggacacacccaggcggcccgcc

SEQ ID NO: 226863 - RNA, 64 nt, hsa
aggaggaggagccggggacucccaggcuggagagcacugccaggacccaccacuggaagcagga

SEQ ID NO: 226864 - RNA, 64 nt, hsa
ccucguucugcucagaggccuugcuguggagcuccacugccauguacccaguaggguuugacau

SEQ ID NO: 226865 - RNA, 64 nt, hsa
aggcaccuuggucccagugucuuccuuuuguucucacugccaaacugccuguccugggaucuag

SEQ ID NO: 226866 - RNA, 64 nt, hsa
acacuuaaauuggguuuucaacagucccagcuuucacugccagggucccagucagauuccagga

SEQ ID NO: 226867 - RNA, 64 nt, hsa
acuaaugaaaacagaaugucucuuccugguagaccacugccauaugauuuacauuuccucacca

SEQ ID NO: 226868 - RNA, 64 nt, hsa
cucuggcuagaagcuaggggucccagugaagagccacugccauuaaagaauaugaaacauagau

SEQ ID NO: 226869 - RNA, 64 nt, hsa
agccugugcccccaucaucucacuccuuugccugcacugccaggguggggcccaccaagauucc

SEQ ID NO: 226870 - RNA, 64 nt, hsa
cccgagacugcugaugucuguaaccacuggggagcacugccaaaaauacagcuuucugguuugu

SEQ ID NO: 226871 - RNA, 64 nt, hsa
caggaguggccugugccucccaccucuuccuucccacugccaaaggccuguguugagaaagaug

SEQ ID NO: 226872 - RNA, 64 nt, hsa
ccucagccccagucgagaggaaagagaaucgggccacugccagaaagagagucaagcaaaccug

SEQ ID NO: 226873 - RNA, 64 nt, hsa
ugaggcccugucucccagccacuuucccuccuggcacugccaccagccucaccgccugcgggca

SEQ ID NO: 226874 - RNA, 64 nt, hsa
gggucugccucucacucgcccaggucccgaaggacacugccacagggacgccuucccuccccuc

SEQ ID NO: 226875 - RNA, 64 nt, hsa
ugcugcuguggcuuuuuugccuucuccaaagacgcacugccaggucccaagcuucagacugcug

SEQ ID NO: 226876 - RNA, 64 nt, hsa
guugugguguccagugugcagcagcccugggagccacugccaccuucagagggguuccuugcug

SEQ ID NO: 226877 - RNA, 64 nt, hsa
acuuuacccaccuagaacacuaacucaccagccccacugccagcagcagcaggugauuggacca

SEQ ID NO: 226878 - RNA, 64 nt, hsa
uagagguccucuggagcccuaaccccuuccagaucacugccacacucuccaucacccucuuccu

SEQ ID NO: 226879 - RNA, 64 nt, hsa
acucaucagcucaguaccuaacugccaaucaacacacugccaaugcgggugggcuaagccgcca

SEQ ID NO: 226880 - RNA, 64 nt, hsa
aaaaaaaaaaaggcaauugugcggagccaaccaucacugccauuacacucacauucaauggaaa

SEQ ID NO: 226881 - RNA, 64 nt, hsa
guugucacugcugcucccuccugcuaugaaacgacacugccagugccagcaguguccuugggaa

SEQ ID NO: 226882 - RNA, 64 nt, hsa
ugugugugugugugugugugagagagagcccucccacugccagcucagguuguucacagauuug

SEQ ID NO: 226883 - RNA, 64 nt, hsa
cucugcuccccucucacacaucugggaguagccccacugccaccugcagccgcagccuggacug

SEQ ID NO: 226884 - RNA, 64 nt, hsa
gugggcccugggugggagcagcccacuucagcagcacugccacugccuuuggccaccugaggug

SEQ ID NO: 226885 - RNA, 64 nt, hsa
ugguucccuuucauacagaggguuuucuauggaucacugccaaacauugggaucaucuccucug

SEQ ID NO: 226886 - RNA, 64 nt, hsa
augauagcguucuggugagcugggaaggacccaccacugccacugaggauuguuuuggaagaaa

SEQ ID NO: 226887 - RNA, 64 nt, hsa
gugccuaagcgggggugaaagaggacguguuacccacugccaugcaccaggacuggcuguguaa

SEQ ID NO: 226888 - RNA, 64 nt, hsa
caccauggcccccucaucauagcaauaacauucccacugccagggguucuugagccagccaggc

SEQ ID NO: 226889 - RNA, 64 nt, hsa
ggcccucuguagggcguuuaacuggaaauacccucacugccaaguggagacuggggcgugugcc

SEQ ID NO: 226890 - RNA, 64 nt, hsa
ugccugcugagccuuuuccuuccacgccgccucucacugccaggccagcggcuuccgcugagac

SEQ ID NO: 226891 - RNA, 64 nt, hsa; identical to SEQ ID NO: 117700

SEQ ID NO: 226892 - RNA, 64 nt, hsa; identical to SEQ ID NO: 117701

SEQ ID NO: 226893 - RNA, 64 nt, hsa; identical to SEQ ID NO: 117702

SEQ ID NO: 226894 - RNA, 64 nt, hsa; identical to SEQ ID NO: 117703

SEQ ID NO: 226895 - RNA, 64 nt, hsa; identical to SEQ ID NO: 117704

SEQ ID NO: 226896 - RNA, 64 nt, hsa; identical to SEQ ID NO: 117705

SEQ ID NO: 226897 - RNA, 64 nt, hsa; identical to SEQ ID NO: 117706

SEQ ID NO: 226898 - RNA, 64 nt, hsa; identical to SEQ ID NO: 117707

SEQ ID NO: 226899 - RNA, 64 nt, hsa; identical to SEQ ID NO: 117708

SEQ ID NO: 226900 - RNA, 64 nt, hsa; identical to SEQ ID NO: 117709

SEQ ID NO: 226901 - RNA, 64 nt, hsa
acuaggcagcuggaaaaguauuugaaacuaaauugacauuaaaauuaagauuuguuuucaagug

SEQ ID NO: 226902 - RNA, 64 nt, hsa
aagucggaacaauugccuguugauauauuaauaagacauuaaagucaaauuuuaauguuggccu

SEQ ID NO: 226903 - RNA, 64 nt, hsa
acacugaccucauguaggcaccuuaccaauauaugacauuaagugagagugaaucccuuaggac

SEQ ID NO: 226904 - RNA, 64 nt, hsa
aaaucaauaucugcagccacuguuacuuuuaauugacauuaagagacacuucauagguucccac

SEQ ID NO: 226905 - RNA, 64 nt, hsa
auaaguuucuguuaugauugccauuucaauaaaugacauuaaaaaucuaaaggauauuauuguu

SEQ ID NO: 226906 - RNA, 64 nt, hsa
aacuuguuuccuugaugagcccugaaauacuguugacauuaacuuucauaaaugaagcauaaca

SEQ ID NO: 226907 - RNA, 64 nt, hsa
caaaaguugagauuuuggggugguggugugccaagacauuaauuuuuuuuuuaaacaaugaagu

SEQ ID NO: 226908 - RNA, 64 nt, hsa
uugagucuuugaagauaguuuuaauucugcuugugacauuaaaagauuauuugggccaguuaua

SEQ ID NO: 226909 - RNA, 64 nt, hsa
uauugugcauucagugaaguguuauuaugccacagacauuaaccuauuccaccuuacucaaggg

SEQ ID NO: 226910 - RNA, 64 nt, hsa
ggugagcauuauuuauaaacuuugcuaugaaaaagacauuaaaauaugagauguaugaugaaaa

SEQ ID NO: 226911 - RNA, 64 nt, hsa
uguaaaaugacggagagagagagaaagaaucccagacauuaacgguauuagagaguuugccuca

SEQ ID NO: 226912 - RNA, 64 nt, hsa
cuggggaggagagaggcuuucgguggacacguuugacauuaaaaaaaaaaaaaaaaaaaaaaaa

SEQ ID NO: 226913 - RNA, 64 nt, hsa; identical to SEQ ID NO: 117710

SEQ ID NO: 226914 - RNA, 64 nt, hsa; identical to SEQ ID NO: 117711

SEQ ID NO: 226915 - RNA, 64 nt, hsa; identical to SEQ ID NO: 117712

SEQ ID NO: 226916 - RNA, 64 nt, hsa; identical to SEQ ID NO: 117713

SEQ ID NO: 226917 - RNA, 64 nt, hsa; identical to SEQ ID NO: 117714

SEQ ID NO: 226918 - RNA, 64 nt, hsa; identical to SEQ ID NO: 117715

SEQ ID NO: 226919 - RNA, 64 nt, hsa; identical to SEQ ID NO: 117716

SEQ ID NO: 226920 - RNA, 64 nt, hsa; identical to SEQ ID NO: 117717

SEQ ID NO: 226921 - RNA, 64 nt, hsa; identical to SEQ ID NO: 117718

SEQ ID NO: 226922 - RNA, 64 nt, hsa; identical to SEQ ID NO: 117719

SEQ ID NO: 226923 - RNA, 64 nt, hsa; identical to SEQ ID NO: 117720

SEQ ID NO: 226924 - RNA, 64 nt, hsa; identical to SEQ ID NO: 117721

SEQ ID NO: 226925 - RNA, 64 nt, hsa; identical to SEQ ID NO: 117722

SEQ ID NO: 226926 - RNA, 64 nt, hsa; identical to SEQ ID NO: 117723

SEQ ID NO: 226927 - RNA, 64 nt, hsa; identical to SEQ ID NO: 117724

SEQ ID NO: 226928 - RNA, 64 nt, hsa; identical to SEQ ID NO: 117725

SEQ ID NO: 226929 - RNA, 64 nt, hsa; identical to SEQ ID NO: 117726

SEQ ID NO: 226930 - RNA, 64 nt, hsa; identical to SEQ ID NO: 117727

SEQ ID NO: 226931 - RNA, 64 nt, hsa; identical to SEQ ID NO: 117728

SEQ ID NO: 226932 - RNA, 64 nt, hsa; identical to SEQ ID NO: 117729

SEQ ID NO: 226933 - RNA, 64 nt, hsa; identical to SEQ ID NO: 117730

SEQ ID NO: 226934 - RNA, 64 nt, hsa; identical to SEQ ID NO: 117731

SEQ ID NO: 226935 - RNA, 64 nt, hsa; identical to SEQ ID NO: 117732

SEQ ID NO: 226936 - RNA, 64 nt, hsa; identical to SEQ ID NO: 117733

SEQ ID NO: 226937 - RNA, 64 nt, hsa; identical to SEQ ID NO: 117734

SEQ ID NO: 226938 - RNA, 64 nt, hsa; identical to SEQ ID NO: 117735

SEQ ID NO: 226939 - RNA, 64 nt, hsa; identical to SEQ ID NO: 117736

SEQ ID NO: 226940 - RNA, 64 nt, hsa; identical to SEQ ID NO: 117737

SEQ ID NO: 226941 - RNA, 64 nt, hsa; identical to SEQ ID NO: 117738

SEQ ID NO: 226942 - RNA, 64 nt, hsa; identical to SEQ ID NO: 117739

SEQ ID NO: 226943 - RNA, 64 nt, hsa; identical to SEQ ID NO: 117740

SEQ ID NO: 226944 - RNA, 64 nt, hsa; identical to SEQ ID NO: 117741

SEQ ID NO: 226945 - RNA, 64 nt, hsa; identical to SEQ ID NO: 117742

SEQ ID NO: 226946 - RNA, 64 nt, hsa; identical to SEQ ID NO: 117743

SEQ ID NO: 226947 - RNA, 64 nt, hsa; identical to SEQ ID NO: 117744

SEQ ID NO: 226948 - RNA, 64 nt, hsa; identical to SEQ ID NO: 117745

SEQ ID NO: 226949 - RNA, 64 nt, hsa; identical to SEQ ID NO: 117746

SEQ ID NO: 226950 - RNA, 64 nt, hsa; identical to SEQ ID NO: 117747

SEQ ID NO: 226951 - RNA, 64 nt, hsa; identical to SEQ ID NO: 117748

SEQ ID NO: 226952 - RNA, 64 nt, hsa; identical to SEQ ID NO: 117749

SEQ ID NO: 226953 - RNA, 64 nt, hsa; identical to SEQ ID NO: 117750

SEQ ID NO: 226954 - RNA, 64 nt, hsa; identical to SEQ ID NO: 117751

SEQ ID NO: 226955 - RNA, 64 nt, hsa; identical to SEQ ID NO: 117752

SEQ ID NO: 226956 - RNA, 64 nt, hsa; identical to SEQ ID NO: 117753

SEQ ID NO: 226957 - RNA, 64 nt, hsa; identical to SEQ ID NO: 117754

SEQ ID NO: 226958 - RNA, 64 nt, hsa; identical to SEQ ID NO: 117755

SEQ ID NO: 226959 - RNA, 64 nt, hsa; identical to SEQ ID NO: 117756

SEQ ID NO: 226960 - RNA, 64 nt, hsa; identical to SEQ ID NO: 117757

SEQ ID NO: 226961 - RNA, 64 nt, hsa; identical to SEQ ID NO: 117758

SEQ ID NO: 226962 - RNA, 64 nt, hsa; identical to SEQ ID NO: 117759

SEQ ID NO: 226963 - RNA, 64 nt, hsa; identical to SEQ ID NO: 117760

SEQ ID NO: 226964 - RNA, 64 nt, hsa; identical to SEQ ID NO: 117761

SEQ ID NO: 226965 - RNA, 64 nt, hsa; identical to SEQ ID NO: 117762

SEQ ID NO: 226966 - RNA, 64 nt, hsa; identical to SEQ ID NO: 117763

SEQ ID NO: 226967 - RNA, 64 nt, hsa; identical to SEQ ID NO: 117764

SEQ ID NO: 226968 - RNA, 64 nt, hsa; identical to SEQ ID NO: 117765

SEQ ID NO: 226969 - RNA, 64 nt, hsa; identical to SEQ ID NO: 117766

SEQ ID NO: 226970 - RNA, 64 nt, hsa; identical to SEQ ID NO: 117767

SEQ ID NO: 226971 - RNA, 64 nt, hsa; identical to SEQ ID NO: 117768

SEQ ID NO: 226972 - RNA, 64 nt, hsa; identical to SEQ ID NO: 117769

SEQ ID NO: 226973 - RNA, 64 nt, hsa; identical to SEQ ID NO: 117770

SEQ ID NO: 226974 - RNA, 64 nt, hsa; identical to SEQ ID NO: 117771

SEQ ID NO: 226975 - RNA, 64 nt, hsa; identical to SEQ ID NO: 117772

SEQ ID NO: 226976 - RNA, 64 nt, hsa; identical to SEQ ID NO: 117773

SEQ ID NO: 226977 - RNA, 64 nt, hsa; identical to SEQ ID NO: 117774

SEQ ID NO: 226978 - RNA, 64 nt, hsa; identical to SEQ ID NO: 117775

SEQ ID NO: 226979 - RNA, 64 nt, hsa; identical to SEQ ID NO: 117776

SEQ ID NO: 226980 - RNA, 64 nt, hsa; identical to SEQ ID NO: 117777

SEQ ID NO: 226981 - RNA, 64 nt, hsa; identical to SEQ ID NO: 117778

SEQ ID NO: 226982 - RNA, 64 nt, hsa; identical to SEQ ID NO: 117779

SEQ ID NO: 226983 - RNA, 64 nt, hsa; identical to SEQ ID NO: 117780

SEQ ID NO: 226984 - RNA, 64 nt, hsa; identical to SEQ ID NO: 117781

SEQ ID NO: 226985 - RNA, 64 nt, hsa; identical to SEQ ID NO: 117782

SEQ ID NO: 226986 - RNA, 64 nt, hsa; identical to SEQ ID NO: 117783

SEQ ID NO: 226987 - RNA, 64 nt, hsa; identical to SEQ ID NO: 117784

SEQ ID NO: 226988 - RNA, 64 nt, hsa; identical to SEQ ID NO: 117785

SEQ ID NO: 226989 - RNA, 64 nt, hsa; identical to SEQ ID NO: 117786

SEQ ID NO: 226990 - RNA, 59 nt, hsa; identical to SEQ ID NO: 58889

SEQ ID NO: 226991 - RNA, 64 nt, hsa; identical to SEQ ID NO: 117788

SEQ ID NO: 226992 - RNA, 64 nt, hsa; identical to SEQ ID NO: 117789

SEQ ID NO: 226993 - RNA, 64 nt, hsa; identical to SEQ ID NO: 117790

SEQ ID NO: 226994 - RNA, 64 nt, hsa; identical to SEQ ID NO: 117791

SEQ ID NO: 226995 - RNA, 64 nt, hsa; identical to SEQ ID NO: 117792

SEQ ID NO: 226996 - RNA, 64 nt, hsa; identical to SEQ ID NO: 117793

SEQ ID NO: 226997 - RNA, 64 nt, hsa; identical to SEQ ID NO: 117794

SEQ ID NO: 226998 - RNA, 64 nt, hsa; identical to SEQ ID NO: 117795

SEQ ID NO: 226999 - RNA, 64 nt, hsa; identical to SEQ ID NO: 117796

SEQ ID NO: 227000 - RNA, 64 nt, hsa; identical to SEQ ID NO: 117797

SEQ ID NO: 227001 - RNA, 64 nt, hsa; identical to SEQ ID NO: 117798

SEQ ID NO: 227002 - RNA, 64 nt, hsa; identical to SEQ ID NO: 117799

SEQ ID NO: 227003 - RNA, 64 nt, hsa; identical to SEQ ID NO: 117800

SEQ ID NO: 227004 - RNA, 64 nt, hsa; identical to SEQ ID NO: 117801

SEQ ID NO: 227005 - RNA, 64 nt, hsa; identical to SEQ ID NO: 117802

SEQ ID NO: 227006 - RNA, 64 nt, hsa; identical to SEQ ID NO: 117803

SEQ ID NO: 227007 - RNA, 64 nt, hsa; identical to SEQ ID NO: 117804

SEQ ID NO: 227008 - RNA, 64 nt, hsa; identical to SEQ ID NO: 117805

SEQ ID NO: 227009 - RNA, 64 nt, hsa; identical to SEQ ID NO: 117806

SEQ ID NO: 227010 - RNA, 64 nt, hsa; identical to SEQ ID NO: 117807

SEQ ID NO: 227011 - RNA, 64 nt, hsa; identical to SEQ ID NO: 117808

SEQ ID NO: 227012 - RNA, 64 nt, hsa; identical to SEQ ID NO: 117809

SEQ ID NO: 227013 - RNA, 64 nt, hsa; identical to SEQ ID NO: 117810

SEQ ID NO: 227014 - RNA, 64 nt, hsa; identical to SEQ ID NO: 117811

SEQ ID NO: 227015 - RNA, 64 nt, hsa; identical to SEQ ID NO: 117812

SEQ ID NO: 227016 - RNA, 64 nt, hsa; identical to SEQ ID NO: 117813

SEQ ID NO: 227017 - RNA, 64 nt, hsa; identical to SEQ ID NO: 117814

SEQ ID NO: 227018 - RNA, 64 nt, hsa; identical to SEQ ID NO: 117815

SEQ ID NO: 227019 - RNA, 64 nt, hsa; identical to SEQ ID NO: 117816

SEQ ID NO: 227020 - RNA, 64 nt, hsa; identical to SEQ ID NO: 117817

SEQ ID NO: 227021 - RNA, 64 nt, hsa; identical to SEQ ID NO: 117818

SEQ ID NO: 227022 - RNA, 64 nt, hsa; identical to SEQ ID NO: 117819

SEQ ID NO: 227023 - RNA, 64 nt, hsa; identical to SEQ ID NO: 117820

SEQ ID NO: 227024 - RNA, 64 nt, hsa; identical to SEQ ID NO: 117821

SEQ ID NO: 227025 - RNA, 64 nt, hsa; identical to SEQ ID NO: 117822

SEQ ID NO: 227026 - RNA, 64 nt, hsa; identical to SEQ ID NO: 117823

SEQ ID NO: 227027 - RNA, 64 nt, hsa
ggcucuuagagaaaucuggagaacuauaccugcuucagugaaauaauuacagaauauacuuaga

SEQ ID NO: 227028 - RNA, 64 nt, hsa
agcuaauuggacuuuuauggcucuaucuuuuccuucagugaagaacccuauuuaaaacuggguc

SEQ ID NO: 227029 - RNA, 64 nt, hsa
aggagaauugcuagaaccugggggugugaagguuucagugaacugagaucacuccaaccugggc

SEQ ID NO: 227030 - RNA, 64 nt, hsa
caugauuaguuauguuugccugucuccccacccaucagugaaaucccugagggcaggggcuguc

SEQ ID NO: 227031 - RNA, 64 nt, hsa
gaacuugaggcugaaacauugcuuccacccaccaucagugaagauguaacuagcauguuacaag

SEQ ID NO: 227032 - RNA, 64 nt, hsa
gaagauuggaaugcuuccaaagcaagaaucuuucucagugaaaucucauuauacaaagagaacc

SEQ ID NO: 227033 - RNA, 64 nt, hsa
uguauauugucagugaagaacuguuaguugguugucagugaacaauaacuuuauuauaugaguu

SEQ ID NO: 227034 - RNA, 64 nt, hsa
ugaaggcucgaaggcacugcacacuuguauauugucagugaagaacuguuaguugguugucagu

SEQ ID NO: 227035 - RNA, 64 nt, hsa
aagagaucaguaguaagaauuccauuuucccucaucagugaagacaccacaaauugaaacucag

SEQ ID NO: 227036 - RNA, 64 nt, hsa
auguguguaauuauggcuaaagacaaaccauuauucagugaauuacuaaugacagauuuuaugc

SEQ ID NO: 227037 - RNA, 64 nt, hsa
auauccuaaaguaucacauaguuaaauuuuucagucagugaagaccgggagggaaugucaguga

SEQ ID NO: 227038 - RNA, 64 nt, hsa
aaauuuuucagucagugaagaccgggagggaaugucagugaauuggcuugaauguucuguggca

SEQ ID NO: 227039 - RNA, 64 nt, hsa
uucugaaucugguuuucaaauccaguggagccuuucagugaaauaggugacuauuaaaaaagua

SEQ ID NO: 227040 - RNA, 64 nt, hsa
gguaguggagcuucccuccccacccccauauguaucagugaagccuuugaaauuacuuaaggca

SEQ ID NO: 227041 - RNA, 64 nt, hsa
acuuugguuugauauuaagaaacagcauucuucuucagugaaauuuugggugccaaacaccuac

SEQ ID NO: 227042 - RNA, 64 nt, hsa
uucaaguagaacagaagcccguuuccuucccucaucagugaaaaaaucuaauguuucaaaugua

SEQ ID NO: 227043 - RNA, 64 nt, hsa
ucuguuguguuuuugccuaaauacuaguaacauaucagugaaaaacccuaauuuuuuuucucuu

SEQ ID NO: 227044 - RNA, 64 nt, hsa
cagugugaucugaucaacacucugguuaccuuggucagugaaaagaugcuacuauauugcuuuu

SEQ ID NO: 227045 - RNA, 64 nt, hsa
aagaguuaucuuucagugaaauuuuauaacaguuucagugaauagagaaaaaauucugaacuga

SEQ ID NO: 227046 - RNA, 64 nt, hsa
caggugucagaucagaauuuuuaagaguuaucuuucagugaaauuuuauaacaguuucagugaa

SEQ ID NO: 227047 - RNA, 64 nt, hsa
aaaaaggaaugaaguacugacacaugcugugacaucagugaacccugaaaacauccuucucagu

SEQ ID NO: 227048 - RNA, 64 nt, hsa
gcugugacaucagugaacccugaaaacauccuucucagugaaacaagccagagagauguacaag

SEQ ID NO: 227049 - RNA, 64 nt, hsa
cuucuuuagguggaagaaaguaaaguucuuauugucagugaacuuuauuagcaccagaaaucuc

SEQ ID NO: 227050 - RNA, 64 nt, hsa
ucuauucuuauuuuucauccuuguuccucacgguucagugaacaggcucauaucaugacagaau

SEQ ID NO: 227051 - RNA, 64 nt, hsa
ugaaaacuuauuuuagcuuuagacuccaguguguucagugaauaaguagaauauaaaaaaauau

SEQ ID NO: 227052 - RNA, 64 nt, hsa
cuucauguucaaguagaaguucucuaccauugaaucagugaacuagaaagaucugauuuggccu

SEQ ID NO: 227053 - RNA, 64 nt, hsa
uacucuuuugaaguguuuuagucuaguuauuggaucagugaaaaacauuaguauacguuuuuaa

SEQ ID NO: 227054 - RNA, 64 nt, hsa
aagcauuagauuccuuuccugugugaagaaagccucagugaaacaggucuuugccauaacuuua

SEQ ID NO: 227055 - RNA, 64 nt, hsa
caacuaaagacaacaaacuaucagauucauucauucagugaagcagccucugauucucuaagag

SEQ ID NO: 227056 - RNA, 64 nt, hsa
uuauuguuuuaauuuuuaaaccuaauuuauucacucagugaacauucuuaccuaagcaaggcua

SEQ ID NO: 227057 - RNA, 64 nt, hsa
cagggagaacagaaagguagaguuacuaaggccuucagugaacagaaaggagcagagagcaaga

SEQ ID NO: 227058 - RNA, 64 nt, hsa
cgucgggccaggaagagcaccuguugcugcaagcucagugaaguggggcacucccagaccugcc

SEQ ID NO: 227059 - RNA, 64 nt, hsa
gugaagaugcguugggcugcaaguaacagaaaucucagugaacaguggccuggcgugguggcuc

SEQ ID NO: 227060 - RNA, 64 nt, hsa
augaucauugcuagaacugagagaccagccuggcucagugaacuucagggcguuccguucauuc

SEQ ID NO: 227061 - RNA, 64 nt, hsa
gaagaaccuccuuuuuaucaucaucccuuuaaacucagugaacccaaaccuauuuuuuucaauc

SEQ ID NO: 227062 - RNA, 64 nt, hsa
cuuauggcuaggcuacuguaacacuugccuguaaucagugaagggcugugcaccuuguacuauu

SEQ ID NO: 227063 - RNA, 65 nt, hsa
accuacagguuguguacuuuucauaaugguuuccaugaauguaguacguucauacaggcuucauu

SEQ ID NO: 227064 - RNA, 65 nt, hsa
ucuuacaaaaauggaguauuuuaguaugaauuugcugaauguaagaccguggacuguuuuuuaua

SEQ ID NO: 227065 - RNA, 65 nt, hsa
uagaaaguggggucaggaggccaagaaagggaauaugaauguauauccaagucacucaggaacuu

SEQ ID NO: 227066 - RNA, 65 nt, hsa
gcauccucugggaucuucugagguggacagcacuuugaauguagcauuucacuggaacagagucu

SEQ ID NO: 227067 - RNA, 65 nt, hsa
uugauucuuggucuauaauugcagauguuauuguaugaauguaccauaauauauuugagcagucc

SEQ ID NO: 227068 - RNA, 65 nt, hsa
ccguuguuuaggguagaauaggcuguguauuuacaugaauguauaauaucuaugucagcaguauu

SEQ ID NO: 227069 - RNA, 65 nt, hsa
gaccuaccucaaacacacuguuuccacccucuucuugaauguauucaguagccuuuacugaaugu

SEQ ID NO: 227070 - RNA, 65 nt, hsa
uguuuuaauaugucaguuauugcccuuuuauauugugaauguaaugugcauaagcuauauccgua

SEQ ID NO: 227071 - RNA, 65 nt, hsa
uuuuguaucucacaauucuggucuagauucaguuaugaauguaggcauuaguuaaaauuaacaag

SEQ ID NO: 227072 - RNA, 65 nt, hsa
uugagaaaaacaaugagcugagaggcagacuucccugaauguauugaacuuggaaagaaaugccc

SEQ ID NO: 227073 - RNA, 65 nt, hsa
uauuuuguuguguuaaaaguacuuuucuugauuuuugaauguauuuguuucagcagaagucauuu

SEQ ID NO: 227074 - RNA, 54 nt, hsa
aagaaaugcagaaugcuuaaaggcugaauguaggauucuucaguauguggaaag

SEQ ID NO: 227075 - RNA, 65 nt, hsa
acuccuaagagaguuguaaaaauagaggcuuggcuugaauguacauagaugguaccuggcaugga

SEQ ID NO: 227076 - RNA, 65 nt, hsa
gggugacuuucauuccaguugcugggacggaaggcugaauguagggucauuuuguaugggauaug

SEQ ID NO: 227077 - RNA, 65 nt, hsa
uuauagauauaggacaguacuguaucauaccucugugaauguaaaauaucuuguaccugcuuuau

SEQ ID NO: 227078 - RNA, 65 nt, hsa
caaguaaucuagaagaauguggauacucuuaggcgugaauguaaaugccuuaauauugaaggucc

SEQ ID NO: 227079 - RNA, 65 nt, hsa
caagauuucuuuauuuacaaaugauuacauuuaaaugaauguacauucuucucacugacuuuggu

SEQ ID NO: 227080 - RNA, 65 nt, hsa
acccccgucuuauuaaggagcuuuuaaaguuuuucugaauguauagacauuucucggguuccuac

SEQ ID NO: 227081 - RNA, 65 nt, hsa
ugcaacuguggcuuagcuaauauugcaauguggcuugaauguagguagcauccuuugaugcuucu

SEQ ID NO: 227082 - RNA, 65 nt, hsa
gcugcuucaugaguagaaauuucaacaacucuuuuugaauguaugaagaguagcaguccccuuug

SEQ ID NO: 227083 - RNA, 65 nt, hsa
gguuaaagguuuuggcugcuguaagaaugugaauuugaauguauuuugaauuguaagagcaaaag

SEQ ID NO: 227084 - RNA, 65 nt, hsa; identical to SEQ ID NO: 58812

SEQ ID NO: 227085 - RNA, 65 nt, hsa; identical to SEQ ID NO: 58813

SEQ ID NO: 227086 - RNA, 65 nt, hsa
acuaguggaagauaguguucugcuuauaauuaaacugaauguagaguaucucuguauguuaauug

SEQ ID NO: 227087 - RNA, 65 nt, hsa
gaugaacuguauuuugcauuuugucuacuuguaagugaauguaacauacugucaauuuuccuugu

SEQ ID NO: 227088 - RNA, 65 nt, hsa
cagcaacaacccucacauaugcacugagugaaggaugaauguauggacacaucugggaguauuuu

SEQ ID NO: 227089 - RNA, 65 nt, hsa
cucauaggguuguugugaggauuaaaaugaggaaaugaauguaaagcacuuaguacaguauauga

SEQ ID NO: 227090 - RNA, 65 nt, hsa
accaauguuugaugggaaaacguggcacucauaguugaauguauacuucuguaccaaaacuugaa

SEQ ID NO: 227091 - RNA, 65 nt, hsa
uccuuuucccucucaccuaaaugucaacuugucauugaauguaaagaaugaaaccuucugacaca

SEQ ID NO: 227092 - RNA, 65 nt, hsa
guagcaugauguauuuaaaguaaggccuuuaguaaugaauguaaugagagaaaauguuuugaaaa

SEQ ID NO: 227093 - RNA, 65 nt, hsa
cuaacuagcuuauuaaaauuuacaaaaugucuuuuugaauguaucaaggauauauuuaguuugag

SEQ ID NO: 227094 - RNA, 65 nt, hsa
caaauauaguuggcauuggaaguuuagccuuuacuugaauguauacuguagauuuuuaacaaagc

SEQ ID NO: 227095 - RNA, 65 nt, hsa
uuaaaggucuacuuuaaucagaaauagcaacgagaugaauguauccaacauuucaauuugcauuc

SEQ ID NO: 227096 - RNA, 65 nt, hsa
cuuacucuaugagucuucauuuuucuaaaauaaagugaauguauuuuuauauucucuguauaucu

SEQ ID NO: 227097 - RNA, 65 nt, hsa
uauuagaauaaaaugugcaaauaaugacaauuauuugaauguaacaaggaauucaacugaaaucc

SEQ ID NO: 227098 - RNA, 65 nt, hsa
aggugguuuagggauuuuggcccuaaccaauacauugaauguaugaugacuauuugggaggacac

SEQ ID NO: 227099 - RNA, 65 nt, hsa; identical to SEQ ID NO: 58814

SEQ ID NO: 227100 - RNA, 65 nt, hsa; identical to SEQ ID NO: 58815

SEQ ID NO: 227101 - RNA, 65 nt, hsa
aagauguauauagauguauauaugcccaaauauauugaauguacagaaaggaaauauucagagac

SEQ ID NO: 227102 - RNA, 65 nt, hsa
ccuauaccuuaccagagcauggaagagcccagaucugaauguaaaacgucucuguucugccagag

SEQ ID NO: 227103 - RNA, 65 nt, hsa
ugagucaaggaguguaaccuucuccuuuacuauguugaauguauuuuuuucuggacaagcuuaca

SEQ ID NO: 227104 - RNA, 65 nt, hsa
gcucccauguccccaagaccucuggaguuuccucuugaauguacaugaaccacuguaauagcauu

SEQ ID NO: 227105 - RNA, 65 nt, hsa
ggcagccucuagagccuucuugcuuucauuuuccuugaauguacauaggaacaagggggaaaguc

SEQ ID NO: 227106 - RNA, 65 nt, hsa
uuacaauugugaaaaccucauggauuugggcaaacugaauguauauaggcuuuugacaaaaguug

SEQ ID NO: 227107 - RNA, 65 nt, hsa
guagcuacacaguaaguagcuugguagauaguuauugaauguauuuauguaguguauuaagaagc

SEQ ID NO: 227108 - RNA, 65 nt, hsa
uauguaaauggcucacaagucaauugcaaacaaacugaauguacaaaucuuagugcuggugcuga

SEQ ID NO: 227109 - RNA, 65 nt, hsa
auuugcauguuuuuuguuaauuuagcuaaagcaauugaauguagauacucagaagaaauaaaaaa

SEQ ID NO: 227110 - RNA, 65 nt, hsa
acagaguuuaaaugaauacauaaauguagaaguacugaauguauauauuuaaaaggagccucuug

SEQ ID NO: 227111 - RNA, 65 nt, hsa
auuuuugcauugccuucgguuuguauuuagugucuugaauguaagaacaugaccuccguguagug

SEQ ID NO: 227112 - RNA, 65 nt, hsa; identical to SEQ ID NO: 58816

SEQ ID NO: 227113 - RNA, 65 nt, hsa; identical to SEQ ID NO: 58817

SEQ ID NO: 227114 - RNA, 65 nt, hsa
aaaaacaugaacagucacauacuugagagaaacugugaauguaagguguaggaaaguacuuaauu

SEQ ID NO: 227115 - RNA, 65 nt, hsa
gugggaaaaauauugcuacaauuuuuuuuaaucucugaauguaauuucgauacuguguacauagc

SEQ ID NO: 227116 - RNA, 65 nt, hsa
aacaugauuuuauucuaugccaacauuugggccucugaauguaucuguuauuugaauuuaaguau

SEQ ID NO: 227117 - RNA, 65 nt, hsa
auauauuuauacacauacaauuuauguuuuccuguugaauguauuuuuaugagauuuuaaccaga

SEQ ID NO: 227118 - RNA, 65 nt, hsa
uuaucugaaagaaguuucuggguuaggagaaguaaugaauguauccauuuguacaugguuuacau

SEQ ID NO: 227119 - RNA, 65 nt, hsa
ugaacaaucauuaauucuucgauauuucuguagcuugaauguaacugcuuuaagaaagguucuca

SEQ ID NO: 227120 - RNA, 65 nt, hsa
uagaguacuuuuuaaaauuauuucucacaaagaaaugaauguacaauccaaugaaaacauuuguu

SEQ ID NO: 227121 - RNA, 65 nt, hsa
uuaaaacaaugaaagagcauuuaucguuugucccuugaauguagaauuuguuuuugauuucauaa

SEQ ID NO: 227122 - RNA, 65 nt, hsa
cccaggggugggaaguuuucauuugcaggggggucugaauguaacucaccauguggugugcaagg

SEQ ID NO: 227123 - RNA, 65 nt, hsa
acaauguauuauuaucacugucagaugagcaugcuugaauguagcaugacugccucuuuuugcuu

SEQ ID NO: 227124 - RNA, 65 nt, hsa
aagacauccaaucaauaaugaaggaaauuuuuuucugaauguagguuugagugaggggcaccucu

SEQ ID NO: 227125 - RNA, 65 nt, hsa
cagucccagccagaagaaucucugaaagcauauugugaauguauacaauguaguacaaacaaucu

SEQ ID NO: 227126 - RNA, 65 nt, hsa
cuuuccuccugucuuagaagaacagaccuaacuagugaauguauuaaugaaaaugcaucuauuuc

SEQ ID NO: 227127 - RNA, 65 nt, hsa
caccacacagcagaauuucuaauggaaguuuguugugaauguaaaggagggagcauucuuugcuu

SEQ ID NO: 227128 - RNA, 65 nt, hsa
aaauuuaauguaguaacucacuuuuccauauauuuugaauguauauuucuauuuaugauaccaau

SEQ ID NO: 227129 - RNA, 65 nt, hsa
uaacuugucuuuuuguuaugcaaaugagauuucuuugaauguauuguucuguuuguguuauuuca

SEQ ID NO: 227130 - RNA, 65 nt, hsa
uuuauguaauuuagggaggacuggucuguaauuucugaauguauauagaauaauauuuauguuua

SEQ ID NO: 227131 - RNA, 65 nt, hsa
cgagucauuucguucccugauuauuuauccuugucugaauguauuuauguguauauuuguagauu

SEQ ID NO: 227132 - RNA, 65 nt, hsa
aucugaacuauaucuugacaaauauuauucaaacuugaauguaaauauauacaguauguauauuu

SEQ ID NO: 227133 - RNA, 65 nt, hsa
aauaaagaaaugggugacaggcuuaaccucaccuaugaauguacaguauguggauuugugaaacu

SEQ ID NO: 227134 - RNA, 65 nt, hsa; identical to SEQ ID NO: 58818

SEQ ID NO: 227135 - RNA, 65 nt, hsa; identical to SEQ ID NO: 58819

SEQ ID NO: 227136 - RNA, 65 nt, hsa
acacuguucugauaucucugauugucauguggauuugaauguagcuugacagagggaaugucuaa

SEQ ID NO: 227137 - RNA, 65 nt, hsa
aaacagaaaagaacaacagcaacaaaaacauugugugaauguauguuuguauguguguauguaua

SEQ ID NO: 227138 - RNA, 65 nt, hsa
uuuaacuauugauuuuuuuuaaaaaaaauugucuuugaauguauuggaaguagacaugcauuaac

SEQ ID NO: 227139 - RNA, 65 nt, hsa
agggcacacacugaaguuggcuuuucagccagcacugaauguauccaucaggacaugcgucuuca

SEQ ID NO: 227140 - RNA, 65 nt, hsa
cacuuguccguagggucacacgcgugcccuguugcugaauguauguugcguaucccaaggcacug

SEQ ID NO: 227141 - RNA, 65 nt, hsa
aagguauuuacacauacaacuucauauaacugagaugaauguaauuuugaacuguuuaacacuuu

SEQ ID NO: 227142 - RNA, 65 nt, hsa
gcuguucccuaaucccacccccugcccugagacagugaauguaguccgugaagggagugccucuc

SEQ ID NO: 227143 - RNA, 65 nt, hsa
guaaauucacagcaguaagauaauauaaauuuuguugaauguauuaacaucauauggucugaaaa

SEQ ID NO: 227144 - RNA, 65 nt, hsa
cuggagugaauuaaguucaccugauaacucaaaagugaauguauaauacaauucuguuuuaaucu

SEQ ID NO: 227145 - RNA, 65 nt, hsa
uuacaguguaguguuuauucuaaggaagauauguaugaauguauauacaaagacucagcuacuuc

SEQ ID NO: 227146 - RNA, 65 nt, hsa
ggaggccucugcaagauucugugggcagcuggcucugaauguagccagcccacauccauuccaga

SEQ ID NO: 227147 - RNA, 65 nt, hsa
aagacaucaugagaaaauaccagcaguaucuaucaugaauguagaaauaaaaguccuuaaaauaa

SEQ ID NO: 227148 - RNA, 65 nt, hsa
aaacaugggagaauccauacuagugagaaaccacgugaauguaaugaaugugggaacgcuuugau

SEQ ID NO: 227149 - RNA, 65 nt, hsa; identical to SEQ ID NO: 58820

SEQ ID NO: 227150 - RNA, 65 nt, hsa; identical to SEQ ID NO: 58821

SEQ ID NO: 227151 - RNA, 65 nt, hsa
ucccuuccagcuuuucuguagaaucuuacugguauugaauguaaaggaagcaaggccuguauugc

SEQ ID NO: 227152 - RNA, 65 nt, hsa
gauaagaauaauucagguagcaucugaaauuuuaaugaauguauaauuggcauaucauggaaaau

SEQ ID NO: 227153 - RNA, 65 nt, hsa
uugcccugcaaauaaaaagacaauuccuuauugucugaauguaauacagucuucauuguacuauu

SEQ ID NO: 227154 - RNA, 65 nt, hsa
uuuuucauuuuuuuacuuuguaguuuauuuuuuagugaauguauuuaauuuuaugaauuauuuau

SEQ ID NO: 227155 - RNA, 65 nt, hsa
uaaaagcaaguuauaucagugaaguaagauccuuuugaauguacaaagacccacacuauugagac

SEQ ID NO: 227156 - RNA, 65 nt, hsa
auaaagguaaaaaaaauuccccaaauauuuugcacugaauguaccaaaggugaagggacauuaca

SEQ ID NO: 227157 - RNA, 65 nt, hsa
cagucaaauggcuucaugagaacaguagaaccuuaugaauguauacuagcauacaaggaucucaa

SEQ ID NO: 227158 - RNA, 65 nt, hsa
ugcauuugacacaauauuguaauaauccaugauuuugaauguaaaguauauaugaugucauuaau

SEQ ID NO: 227159 - RNA, 65 nt, hsa
auguuuucauauuuuucaaaauagguuuuuauuguugaauguacaucuaccccagccccucaaaa

SEQ ID NO: 227160 - RNA, 65 nt, hsa
aaagaucauuuuauuaucuuuaacuguaucuauuuugaauguaaauuuaaaaaaaguaauucucu

SEQ ID NO: 227161 - RNA, 65 nt, hsa
uuguauaauuacuugauucacacagugagaaaaaaugaauguauuccuguuuuugaagagaagaa

SEQ ID NO: 227162 - RNA, 65 nt, hsa
uguuuaaggcucuucauccugguuagcaaaaggugugaauguaaugugauggaauuuaaaaguuu

SEQ ID NO: 227163 - RNA, 65 nt, hsa
caacuggaauagcuaauuacagucuauuaaaacugugaauguauguagcaauccugcgugugaag

SEQ ID NO: 227164 - RNA, 65 nt, hsa; identical to SEQ ID NO: 58822

SEQ ID NO: 227165 - RNA, 65 nt, hsa; identical to SEQ ID NO: 58823

SEQ ID NO: 227166 - RNA, 65 nt, hsa
agggggaacauuguaaagaaacaaaaagguccagaugaauguaugcuagaaauaaaaguugaaag

SEQ ID NO: 227167 - RNA, 65 nt, hsa
gaauaaucuuccauuuggcugucgugaggaguaauugaauguaauccaucucuuacaaaauggag

SEQ ID NO: 227168 - RNA, 65 nt, hsa
agcugcgcgggcuuauuuauuaacaggauaacccuugaauguagcagccccgggagggcggcaca

SEQ ID NO: 227169 - RNA, 65 nt, hsa
ucggagggaaauuguaaauccuguguuucauuacuugaauguaguuaucuauugaaaauauauau

SEQ ID NO: 227170 - RNA, 65 nt, hsa
uaaggguuucaaucaauuauuaaugcagagaguauugaauguaaaucagagcucucuagucuuca

SEQ ID NO: 227171 - RNA, 65 nt, hsa
uacuuguuuaucuuguugcugcaaugagaaauaaaugaauguauguauuuuggugcagacaccug

SEQ ID NO: 227172 - RNA, 65 nt, hsa
ucuauacacuaucaaauauauaaagcuuucuauauugaauguacauuauacagaucauucauaug

SEQ ID NO: 227173 - RNA, 65 nt, hsa
uaccaucgccuuccaaagucagcacucuacacucuugaauguaccaaggaucucuuggcgacagu

SEQ ID NO: 227174 - RNA, 65 nt, hsa
uuaugguauuuauuuucaguaguaaagacccagcuugaauguaaauuuuguauaguguaaguaug

SEQ ID NO: 227175 - RNA, 65 nt, hsa
uuuccauuuuggcgcuauuacaaauagugcaacuaugaauguacugcauguuaccaucuuacuug

SEQ ID NO: 227176 - RNA, 65 nt, hsa
auauucaauauuggucuguguuuaaguuuguuauuugaauguaauuuacauagaggaauauaaua

SEQ ID NO: 227177 - RNA, 65 nt, hsa; identical to SEQ ID NO: 58824

SEQ ID NO: 227178 - RNA, 65 nt, hsa; identical to SEQ ID NO: 58825

SEQ ID NO: 227179 - RNA, 65 nt, hsa; identical to SEQ ID NO: 58826

SEQ ID NO: 227180 - RNA, 65 nt, hsa; identical to SEQ ID NO: 58827

SEQ ID NO: 227181 - RNA, 65 nt, hsa
agggucucucccucagguguuuuuuaugaagugcgugaauguauguaaugugugguggccucagc

SEQ ID NO: 227182 - RNA, 65 nt, hsa
aaaguuuuggcaguaaaauacucuguuuuuaaguaugaauguauuucauucauauuuccucucac

SEQ ID NO: 227183 - RNA, 65 nt, hsa
uacagaaggaagggagucccaucucaaaaaaaaaaugaauguaugccacugcaauuagaguaucc

SEQ ID NO: 227184 - RNA, 65 nt, hsa
gauucuuaauguaugauuucuuuguucauauauuaugaauguauuauuuuauuugcuucguaaua

SEQ ID NO: 227185 - RNA, 65 nt, hsa
uuuacuauguauuuauacguuaagaccucuaugaaugaauguaucagagaaugucuuuguaacug

SEQ ID NO: 227186 - RNA, 65 nt, hsa
uuggaaaccaucacuauugagagaugggaaaaaccugaauguauaaagcauuuauuugucaauaa

SEQ ID NO: 227187 - RNA, 65 nt, hsa
uaucauggugauuaugaugguuaaagccuuuacacugaauguaauguuuaauaaagaaauuacaa

SEQ ID NO: 227188 - RNA, 65 nt, hsa
auaaccauuucaccuggacuaucuaaucaguccuaugaauguaucccuaaaugugguuauugaaa

SEQ ID NO: 227189 - RNA, 65 nt, hsa
guuucuuauugcuuuuccuucccuaauucauacaaugaauguauuuggaauacuuacauauuaua

SEQ ID NO: 227190 - RNA, 65 nt, hsa
gcuuccugauugcgcagacugaaacuagcuaaaccugaauguaccuacuagggcaccauaauacu

SEQ ID NO: 227191 - RNA, 65 nt, hsa
acuagcuuguuuugacagguuuauuucacauccuaugaauguauguaaauaaacuguacauaggu

SEQ ID NO: 227192 - RNA, 65 nt, hsa
cugcauuaccuaauaauuaccucagcguuagaauuugaauguauuaauugauuuaaacaucaugu

SEQ ID NO: 227193 - RNA, 65 nt, hsa
caaagucguuucaacucuuaaagacaucuuaauccugaauguaaacaauuguuauguguuuagaa

SEQ ID NO: 227194 - RNA, 65 nt, hsa
auaggaccaaaacagaauauuguagauggcaguuaugaauguauauuuauauuuugauuaagauu

SEQ ID NO: 227195 - RNA, 65 nt, hsa
agugaggcucccacaggcaccagcaaaacaacggaugaauguagcccuuccaacaccugacagaa

SEQ ID NO: 227196 - RNA, 65 nt, hsa
ugagaguuguauguaaccagugauaugauuauuccugaauguacagacagaaguaagccuggaca

SEQ ID NO: 227197 - RNA, 65 nt, hsa
uggcuagauguuuacauuuguaagaaauaacacugugaauguaaaacagagccauucccuuggaa

SEQ ID NO: 227198 - RNA, 65 nt, hsa
ccuccagacguagccauuuccugacaucaagauguugaauguaaucuggucugagcugggccugu

SEQ ID NO: 227199 - RNA, 65 nt, hsa
aaaaccucaauuuaagucuuuaaaagguuguauuuugaauguaaccaaaaguuuacaguuuuuug

SEQ ID NO: 227200 - RNA, 65 nt, hsa
ugguuuuaugcugcuuuguuaggacagauguguuuugaauguaccauuauaagaagaauucuaug

SEQ ID NO: 227201 - RNA, 65 nt, hsa
acaauguggaauuaccaaauuaaaagagaauacuaugaauguauucauauuuuuucuauauugaa

SEQ ID NO: 227202 - RNA, 65 nt, hsa
caauggaauauuuucuaaaacauuuaguauacauuugaauguauuuuaaaccaugccaaacuacu

SEQ ID NO: 227203 - RNA, 65 nt, hsa
aagguaauauuuuuaauaugauacauuacauauugugaauguauacuaaaaaaacauuuuaaaug

SEQ ID NO: 227204 - RNA, 65 nt, hsa
uaagccuuuuuuuucuuuuuuuuuuuuuuggcaaaugaauguaccauuucaacuuugauuuuaau

SEQ ID NO: 227205 - RNA, 65 nt, hsa
ugacuuuccucucccaguuuccagacagggcucuuugaauguaugucaaacucaguuacuccaga

SEQ ID NO: 227206 - RNA, 65 nt, hsa
auuaucuuuuuguggugugaauaaaucuuuuaucuugaauguaauaagaauuugguggugucaau

SEQ ID NO: 227207 - RNA, 65 nt, hsa
gacuuucuccaauguggacucugugugucagugaaugaauguaguaaaauucacuuuggaagguu

SEQ ID NO: 227208 - RNA, 65 nt, hsa
ggugauaauuuugcuuuguguuacuuuuuugcucuugaauguaucguuaugauggucucuuauaa

SEQ ID NO: 227209 - RNA, 65 nt, hsa
gauuucauugagggcaaggcugguggcagguacuaugaauguaauucauaauuuaaaaggaaaac

SEQ ID NO: 227210 - RNA, 65 nt, hsa
aaauaaguaucuauguaaauuuguuuaaaauaaacugaauguauuuaaugguccauuuauauguu

SEQ ID NO: 227211 - RNA, 65 nt, hsa; identical to SEQ ID NO: 58828

SEQ ID NO: 227212 - RNA, 65 nt, hsa; identical to SEQ ID NO: 58829

SEQ ID NO: 227213 - RNA, 65 nt, hsa
auacuaguguguucauuauagaguaucuguagaggugaauguaaaaguaaguccaaucuauuuuc

SEQ ID NO: 227214 - RNA, 65 nt, hsa
gcaugaacauuacugcagguuuuugaugaauauaaugaauguauggaauucaauugaauuugcau

SEQ ID NO: 227215 - RNA, 65 nt, hsa
uucugcuuuaaaggcauguguguuuuuaaaauuaaugaauguagaugugugauugucugagugag

SEQ ID NO: 227216 - RNA, 65 nt, hsa
auuuaagacacuuuuuggacucaacguuacauuuuugaauguaguaaguaaauuaaccaaaaaag

SEQ ID NO: 227217 - RNA, 65 nt, hsa
gucagagcuagggugggggugcccgauucgggugcugaauguaaggaggggagccuccaagugug

SEQ ID NO: 227218 - RNA, 65 nt, hsa
uuuaaggagcauuuaaaaauauguauauaugugacugaauguaagauuaacuuuauuuuggucug

SEQ ID NO: 227219 - RNA, 65 nt, hsa
aggucugugcuaccucugugagguauauacuaaaaugaauguaaaauaaggaucguauucccugc

SEQ ID NO: 227220 - RNA, 65 nt, hsa
uauaaauuauaaaugcaauuaacuaagaacagcucugaauguauuugcaugggauugguccuuga

SEQ ID NO: 227221 - RNA, 65 nt, hsa
aguucauuucacugggauuuugaagcauuucugucugaauguaaagccuguucuaguccuggugg

SEQ ID NO: 227222 - RNA, 65 nt, hsa
ugugugagaaaagaauagaagugaaauuugcauaaugaauguaaaagggaaauaaaagucuuuug

SEQ ID NO: 227223 - RNA, 65 nt, hsa; identical to SEQ ID NO: 58830

SEQ ID NO: 227224 - RNA, 65 nt, hsa; identical to SEQ ID NO: 58831

SEQ ID NO: 227225 - RNA, 65 nt, hsa
uauuuauuuaaauauuuaaauuuuauauuuauuguugaauguaugguuugcuaccuauuguaacu

SEQ ID NO: 227226 - RNA, 65 nt, hsa
uguuuuguagccuuaagaaguguuucaaacauaucugaauguauaaaauaagaguaaaugcccua

SEQ ID NO: 227227 - RNA, 65 nt, hsa
gaaguaccuggagcaucauucucuucuaccacaucugaauguaacuuaaauuugcucaaagaagc

SEQ ID NO: 227228 - RNA, 65 nt, hsa
uucaggcuugacaacuucacauugccucucuuccuugaauguauuuuaucuggucuuuucuauau

SEQ ID NO: 227229 - RNA, 65 nt, hsa
gguuacucagcucccuggaaagcaggcaagcauguugaauguaucuaguggucugauuuuaauuu

SEQ ID NO: 227230 - RNA, 65 nt, hsa
aacuggauuugauuucuuuuuaugaaaguuucauaugaauguaacuugauuuuuuacuauuauaa

SEQ ID NO: 227231 - RNA, 65 nt, hsa
uacauaugguagacaauuugccuuaggaagugacuugaauguacaaagauacuugaugcacuuau

SEQ ID NO: 227232 - RNA, 65 nt, hsa
uacacauaagccaaaacugagcauaaguccucuagugaauguaggcuggcuuucagaguaggcua

SEQ ID NO: 227233 - RNA, 65 nt, hsa
ggaaauuaacacuggaacugacccuuuucuggcagugaauguaagcucuagcucccccaucuacu

SEQ ID NO: 227234 - RNA, 65 nt, hsa
gaugguuacacuguuagaacacuauuuucagaaucugaauguaauuuguguaauaaaguguuuuc

SEQ ID NO: 227235 - RNA, 65 nt, hsa
ugauggguuuguugguauuuaaaaugaauacaacuugaauguaauuaaagugcuguuuuuuggaa

SEQ ID NO: 227236 - RNA, 65 nt, hsa
gagucuugaacacagaauaacgauugugaccauuaugaauguaacuaauuucaguuguacuguga

SEQ ID NO: 227237 - RNA, 65 nt, hsa
auucuaaauagcgauuauaaucuccaacuuuauuuugaauguaccucuauuaguuucaauugagu

SEQ ID NO: 227238 - RNA, 65 nt, hsa
uucaggcagauuaaaagaaucauuuguugaacaacugaauguauaaaaaaauuauaaacuggugu

SEQ ID NO: 227239 - RNA, 65 nt, hsa
aacuauuaccuagagugaacuuuaagcuuuauuguugaauguaauuccauuauauuuccuuuugu

SEQ ID NO: 227240 - RNA, 65 nt, hsa
gaggggcaaaaauauuuugcaagcucuggaauuguugaauguauucuuuuauauaacuacauuaa

SEQ ID NO: 227241 - RNA, 65 nt, hsa
cuuuuauuuuguguccuugggcuauaaaagauuccugaauguaauuauaaggauuuggguuugga

SEQ ID NO: 227242 - RNA, 65 nt, hsa
cugaaguaguguuuaggauccuccauggcaguuagugaauguaagaaguacaguguuaaaguguu

SEQ ID NO: 227243 - RNA, 65 nt, hsa
aaacucgaucuaaaguuuagcauuuccaucugcgaugaauguaggccacaaaccacaguaguauu

SEQ ID NO: 227244 - RNA, 65 nt, hsa
ccggccgccggggcacauagggguuuuaucgggcgugaauguaaauaaauuauauauauauauug

SEQ ID NO: 227245 - RNA, 65 nt, hsa
agcugaacagugaugaucuguagacauuuauggacugaauguaaugguugauauauguacauucu

SEQ ID NO: 227246 - RNA, 65 nt, hsa
cguggcgacuuagaguuggcggauauucggaacugugaauguacauagcguugaguuaaaccccu

SEQ ID NO: 227247 - RNA, 65 nt, hsa
uuggcagcaguuuuauaaaguccgucauuugcauuugaauguaaggcucaguaaaugacagaacu

SEQ ID NO: 227248 - RNA, 65 nt, hsa
gugucuuaaaacaaggcuuacuuacuagacauaacugaauguaaaaagugcuuuuucaaaucugu

SEQ ID NO: 227249 - RNA, 65 nt, hsa
ggaaaacuuacuuuucauggagugccaccuaacagugaauguauuagaguauaaaauguuugcca

SEQ ID NO: 227250 - RNA, 65 nt, hsa
gccaacagaguugugaaugugugugggaaggccuuugaauguaaagcugcauaagcuguuagguu

SEQ ID NO: 227251 - RNA, 65 nt, hsa
auaauuuucuaguuccuuuuuaaugaugauuauucugaauguauuugccacuacauuuacaauaa

SEQ ID NO: 227252 - RNA, 65 nt, hsa
aauucauuaauuuaguguaagaagaaaguuaagucugaauguaaauucaguguaagaugaaaauu

SEQ ID NO: 227253 - RNA, 65 nt, hsa; identical to SEQ ID NO: 58832

SEQ ID NO: 227254 - RNA, 65 nt, hsa; identical to SEQ ID NO: 58833

SEQ ID NO: 227255 - RNA, 65 nt, hsa; identical to SEQ ID NO: 58834

SEQ ID NO: 227256 - RNA, 65 nt, hsa; identical to SEQ ID NO: 58835

SEQ ID NO: 227257 - RNA, 65 nt, hsa
aaugauuuauuaauuaccaggauccuuuucuaaauugaauguacuuuugaauuacuagguuucuu

SEQ ID NO: 227258 - RNA, 65 nt, hsa
agacuugguucuaguccaauuucugccacugaggaugaauguaacugugggcaaacuauuuaccc

SEQ ID NO: 227259 - RNA, 65 nt, hsa
gaauuuuguuccaccaugguuaguuauuugccauaugaauguauucuuguuucuaccaauauucu

SEQ ID NO: 227260 - RNA, 65 nt, hsa; identical to SEQ ID NO: 58836

SEQ ID NO: 227261 - RNA, 65 nt, hsa; identical to SEQ ID NO: 58837

SEQ ID NO: 227262 - RNA, 65 nt, hsa
gcggaagucagggcggcuggauuccaggacaggagugaauguaaaaauaaauaucgcuuagaaug

SEQ ID NO: 227263 - RNA, 65 nt, hsa
aagucucuccgaacucaaauggaagaaauaccuuaugaauguaagaauguagggggucauggcuu

SEQ ID NO: 227264 - RNA, 65 nt, hsa
uauuauuaguuaggcuucugagcuugcaaucauauugaauguaugaagagcgaaaucaaauucuu

SEQ ID NO: 227265 - RNA, 65 nt, hsa
cuacuuauccagguuugcaaauguacauguucauuugaauguaaaucaccauuucuuggaacccc

SEQ ID NO: 227266 - RNA, 65 nt, hsa
auuuauuauuuauuuauuauuuauuuauuuacagaugaauguauuuauuugggagaccgggguau

SEQ ID NO: 227267 - RNA, 65 nt, hsa
ggcuggggagggaagcacugucauguggacguggaugaauguaggaccagcaucacccucugcuc

SEQ ID NO: 227268 - RNA, 65 nt, hsa
aucugucauuauugcccugaucacaaacaaaagccugaauguacuauguuuaaaagacaaaccaa

SEQ ID NO: 227269 - RNA, 65 nt, hsa
acuacucuaaugcauuugguauguaacuuuaaauuugaauguauucuuguaaaacauccaguauu

SEQ ID NO: 227270 - RNA, 65 nt, hsa
ggcccugggccugcuccuugccaccaaccgaaccgugaauguagggcccccagccucaccucugc

SEQ ID NO: 227271 - RNA, 65 nt, hsa
uugaacagcauggaaucucauugccaaauuauuagugaauguauaguucagguauucuuugagac

SEQ ID NO: 227272 - RNA, 65 nt, hsa
aaaauuuuauucuuagcacacuguuauguccuaacugaauguauucaguauucaaauaaaagaca

SEQ ID NO: 227273 - RNA, 65 nt, hsa
uauuuuggauguaaagauuccugugucucauaauaugaauguauuuuuugauauacaagaaacug

SEQ ID NO: 227274 - RNA, 65 nt, hsa
aucuaauaaggagauuuaagauaagacccaauaaaugaauguauucuguaaugcuuuuaggaugu

SEQ ID NO: 227275 - RNA, 65 nt, hsa
gcaccaugaaauuaaaaucaucucauuccugaagaugaauguaggaccagacauuuuagcuucac

SEQ ID NO: 227276 - RNA, 65 nt, hsa
acuccaccucaaaaaauaaaaucaagauaaccucuugaauguaauagcucauagcacuuuaauuu

SEQ ID NO: 227277 - RNA, 65 nt, hsa
ucaaguuagugauugcauuugaucccaaaacaagaugaauguaugcaaugggauguacauaaguu

SEQ ID NO: 227278 - RNA, 65 nt, hsa
aucuuccuugggccuuuggaaaaauaugugacaagugaauguaagucugugccuggagagcuaau

SEQ ID NO: 227279 - RNA, 65 nt, hsa
cucucagacuauucugaguaaugcuugcuugcuaaugaauguauaggagaccacauuguaauugu

SEQ ID NO: 227280 - RNA, 65 nt, hsa
uuuuuugaaauuacauugcuuguuuaucagacaauugaauguaguaauucuguucuggauuuaau

SEQ ID NO: 227281 - RNA, 65 nt, hsa
aaccaaaggcacagauuuguguacaauauacccauugaauguauauccugagaaaaauuggggcc

SEQ ID NO: 227282 - RNA, 65 nt, hsa
uguucugaaaauauggugaugguugcacaccauugugaauguacugaaugccauucagugguacc

SEQ ID NO: 227283 - RNA, 65 nt, hsa
guucguaaagaaaauuacuucugguauuuaggcugugaauguaccuugaaggggagaguucaugg

SEQ ID NO: 227284 - RNA, 65 nt, hsa
aaugaaggguugugaguuuaguuucucuccuaaaaugaauguaugcccaccagagcagacaucuu

SEQ ID NO: 227285 - RNA, 65 nt, hsa
accuugauauacacagagauggucuuggagaauugugaauguauguacuguauugucaucaagga

SEQ ID NO: 227286 - RNA, 65 nt, hsa
ugagacuaacuuuguauguuaagguuugaacuaagugaauguaucugcagaggaaguauuacaaa

SEQ ID NO: 227287 - RNA, 65 nt, hsa
acuuacgcagggagaugcaggucucucuaaacgcaugaauguauguaguguguaggcacuguagu

SEQ ID NO: 227288 - RNA, 65 nt, hsa
auauagaaaaaaacauucuaucuacugauuugggcugaauguauguaaauagguuucuaaaaagu

SEQ ID NO: 227289 - RNA, 65 nt, hsa
ucuguuuauuuuuuauucuaaguacacugauucugugaauguaccuuuuuuauuaacagggaaag

SEQ ID NO: 227290 - RNA, 65 nt, hsa
aauuauaauuugagaaaaauauuacccaguaacauugaauguagauggcuaaacgauucuuacuc

SEQ ID NO: 227291 - RNA, 65 nt, hsa
aauaaaguguucuaugaaauucagaacuuuauuucugaauguaacaucccuaauaacaaccuuca

SEQ ID NO: 227292 - RNA, 65 nt, hsa
ugaguuucugacaaauuuguuuuaaaaaucaaauuugaauguacuauucuauaaauugccuuucu

SEQ ID NO: 227293 - RNA, 65 nt, hsa
aaaacgugugucuggauauuaacucuuguuuaaacugaauguaugauauuuuguuagaauggaaa

SEQ ID NO: 227294 - RNA, 65 nt, hsa
gccaggagagguagagugaaaaucccagccauggaugaauguacuaauuugaaagccaaguguua

SEQ ID NO: 227295 - RNA, 65 nt, hsa
gaaaccaagaaauguaaucaagcaguaaaaacaucugaauguagaccaugaucucaaguucuucc

SEQ ID NO: 227296 - RNA, 65 nt, hsa
uguuccuaagacccuugucccagauacucuaaaugugaauguaugagcugggggagucaacccag

SEQ ID NO: 227297 - RNA, 65 nt, hsa
acuuauuucauaauugccuacauuuaucaugguccugaauguagcguguaagcuuguguuucuug

SEQ ID NO: 227298 - RNA, 65 nt, hsa
ccuucuauuccugagggcucagagcugaccaugcaugaauguauggcaguguccacuuuucugua

SEQ ID NO: 227299 - RNA, 65 nt, hsa
cagaaaaauugacauugcugccuuuaagaauaccaugaauguaagaaauugaaagaaauuguaaa

SEQ ID NO: 227300 - RNA, 65 nt, hsa
ugagugaguccuuuuuuuaugguguccucccucugugaauguacaggcggaacuguacgaacagc

SEQ ID NO: 227301 - RNA, 65 nt, hsa; identical to SEQ ID NO: 58838

SEQ ID NO: 227302 - RNA, 65 nt, hsa; identical to SEQ ID NO: 58839

SEQ ID NO: 227303 - RNA, 65 nt, hsa; identical to SEQ ID NO: 58840

SEQ ID NO: 227304 - RNA, 65 nt, hsa; identical to SEQ ID NO: 58841

SEQ ID NO: 227305 - RNA, 65 nt, hsa
accaauuuaugggagaauugcacacagaugugaaaugaauguaaucuaauagaagccuaaucagc

SEQ ID NO: 227306 - RNA, 65 nt, hsa; identical to SEQ ID NO: 58842

SEQ ID NO: 227307 - RNA, 65 nt, hsa; identical to SEQ ID NO: 58843

SEQ ID NO: 227308 - RNA, 65 nt, hsa
auuuaaacuaaaacuaguauaauuuagucuuuucaugaauguacauacauaaaauuauacauaaa

SEQ ID NO: 227309 - RNA, 65 nt, hsa
ggggaagggauuguuguguagucaagucaccaugcugaauguacacugauuccuuuaugaugacu

SEQ ID NO: 227310 - RNA, 65 nt, hsa
aggccagccggccucucgagagccagagcagcaguugaauguaaugcuggggacaggcaugcugc

SEQ ID NO: 227311 - RNA, 65 nt, hsa; identical to SEQ ID NO: 58844

SEQ ID NO: 227312 - RNA, 65 nt, hsa; identical to SEQ ID NO: 58845

SEQ ID NO: 227313 - RNA, 65 nt, hsa
uuucagcucaauuguuaaugugauggauggcacaaugaauguauauuuuguguuauucgugaaua

SEQ ID NO: 227314 - RNA, 65 nt, hsa
ccuggacugccggaaucccagcauuagcuuccugcugaauguaguauuuggcauucucugaauuu

SEQ ID NO: 227315 - RNA, 65 nt, hsa
uuccgugguuaaacucgcucacugcuaagaauauuugaauguaugcuucauacagggaugguguu

SEQ ID NO: 227316 - RNA, 65 nt, hsa
guaaggaugggaauauuuuguuauacuguguauagugaauguauuguacugugucugugaaaacu

SEQ ID NO: 227317 - RNA, 65 nt, hsa
caaauacuuagaacuggaaggcucuuuguuauuauugaauguaccccucagccuucucagcauuu

SEQ ID NO: 227318 - RNA, 65 nt, hsa
ggacauuugacuuuuauuuuuguauuuaauugacaugaauguaaaggggacagcucaggguuguu

SEQ ID NO: 227319 - RNA, 65 nt, hsa
aaaaauguagaaauucuucaugaacauaacucugcugaauguaaaagaaaauuuuuuuucaaaaa

SEQ ID NO: 227320 - RNA, 65 nt, hsa
ugugucaugaguguuuaaaucaagaggaagcugcaugaauguaaucaacauuccaacuggagcuc

SEQ ID NO: 227321 - RNA, 65 nt, hsa
auuucuucacugugacagcaaagauuuaaauaagaugaauguaaaagagaaagcuuauuggacuc

SEQ ID NO: 227322 - RNA, 65 nt, hsa; identical to SEQ ID NO: 58846

SEQ ID NO: 227323 - RNA, 65 nt, hsa; identical to SEQ ID NO: 58847

SEQ ID NO: 227324 - RNA, 65 nt, hsa
uuuuugaacuaaauaguggugauggcuacacauugugaauguaauuaacaccacugaguuaaaca

SEQ ID NO: 227325 - RNA, 65 nt, hsa
ugaugaacuuuggaguacuguuucuuccuucaaacugaauguaauuaauucaugaauaaaugcac

SEQ ID NO: 227326 - RNA, 65 nt, hsa
aauaaaaaugcuuguauuucuuuaaaaaguaagccugaauguagaguaaaaggggaaaugccaag

SEQ ID NO: 227327 - RNA, 65 nt, hsa
gaaagacuguaacuauugcuggaaauguucuauauugaauguacaugcucuuguuggaaaaaugu

SEQ ID NO: 227328 - RNA, 65 nt, hsa
uugcuaaaaauauuaagaccaagucaugcaauaauugaauguaccucaaauuuuuaggggagggu

SEQ ID NO: 227329 - RNA, 65 nt, hsa
ucuaaagauuucaaauaguggcagacagugucuucugaauguaaguuuugagaaauacgagucug

SEQ ID NO: 227330 - RNA, 56 nt, hsa
aggagacagaaacggagugaccgccgugaauguagacgcccuaggaggagaacuug

SEQ ID NO: 227331 - RNA, 65 nt, hsa
uucagaaguauauagauacuuccggugacuacauaugaauguacuuucaauauuauuuuuuuauu

SEQ ID NO: 227332 - RNA, 65 nt, hsa
cauauacugcacauacugaaauagagggaaaucacugaauguaaagagguuucaucuaugccccc

SEQ ID NO: 227333 - RNA, 65 nt, hsa
accaggacaugagagacauagaaaaacagaagucaugaauguaaauugaaugagaggcuuaacau

SEQ ID NO: 227334 - RNA, 65 nt, hsa
auaaacuauaucuuggcuaguggcuacugugucugugaauguaaccaguacuucuuuaagcucua

SEQ ID NO: 227335 - RNA, 65 nt, hsa
uuuuagucaugaguuguuuucaguuuucagacgaaugaauguaauaggaaacuauggaguuacca

SEQ ID NO: 227336 - RNA, 65 nt, hsa
uuuagacuucuuaauaaccuaaauauuuaaaauaaugaauguaacaccuuuuuuaguucacugau

SEQ ID NO: 227337 - RNA, 65 nt, hsa
gcuggaauuacaguugugagccaccacaccuggcuugaauguagauuuuaauaauugaauuuauu

SEQ ID NO: 227338 - RNA, 65 nt, hsa
uaccagauucacuucugaauuggccagaggaaaucugaauguauuauccugugugugucuaggua

SEQ ID NO: 227339 - RNA, 65 nt, hsa
cuggggaaaacaguuguggaauucuuacuucauuaugaauguauuuaaaaaacaaacaccaaaua

SEQ ID NO: 227340 - RNA, 65 nt, hsa
ucaagaaaaaaaaaaaaaaaagaauaugcacagucugaauguauaccaggagugugagagacaca

SEQ ID NO: 227341 - RNA, 65 nt, hsa
uggcagcauaauuuugugguuaagagaaugaauucugaauguacacuuucugucucaaacccugg

SEQ ID NO: 227342 - RNA, 65 nt, hsa
uugcucucugccacagcuugcagcauggucuugacugaauguacuguuccuguuagcguuacuuc

SEQ ID NO: 227343 - RNA, 65 nt, hsa
ccuacugugugcaaaguguuucauguauaucucauugaauguauacagccacccuguugugguau

SEQ ID NO: 227344 - RNA, 65 nt, hsa
uuucagugaaagaggaaggaaaggaguagggcuagugaauguaucugccaggucuuagaagucag

SEQ ID NO: 227345 - RNA, 65 nt, hsa
acuuuagguauuacuacauaguugaaggauuuaacugaauguauggaucaaauuuauuuauuuga

SEQ ID NO: 227346 - RNA, 65 nt, hsa
aauguugacaggcaaauuucauacccaugucagauugaauguauuuaaauguauguauuuaagga

SEQ ID NO: 227347 - RNA, 65 nt, hsa
gacuaguaaauugucugccuccuauagcagaaaggugaauguacaaacuguugguggcccugaau

SEQ ID NO: 227348 - RNA, 65 nt, hsa
gaagcugauuugcaacauuugcuaaauggauuagaugaauguacuucuuuuugugagcuuacuug

SEQ ID NO: 227349 - RNA, 65 nt, hsa
gggagaaaaacauuuuagauauguauuacuauacaugaauguauuauacacacacacuuuagaga

SEQ ID NO: 227350 - RNA, 65 nt, hsa
uauaaauuaucugaauauuagaugcucugagaaauugaauguaccuuauuuaaaagauuuuaugg

SEQ ID NO: 227351 - RNA, 65 nt, hsa; identical to SEQ ID NO: 58848

SEQ ID NO: 227352 - RNA, 65 nt, hsa; identical to SEQ ID NO: 58849

SEQ ID NO: 227353 - RNA, 65 nt, hsa
ggcuauuucaaaggaaccagccaacguaugagaaaugaauguaacacuguggacauugacuuccc

SEQ ID NO: 227354 - RNA, 65 nt, hsa
aagcugcuaauuguuccuguuggggugacagauacugaauguauacguauugugccugagcucac

SEQ ID NO: 227355 - RNA, 65 nt, hsa
ggucuuuuauuuguacccaugugucugucacaccaugaauguaccuggggaaaucaacugaccuc

SEQ ID NO: 227356 - RNA, 65 nt, hsa
auaauuguugacuuucuuagauucacuuccauaugugaauguaagcucuuaacuaugucucuuug

SEQ ID NO: 227357 - RNA, 65 nt, hsa
caaaaugagaugcacucauuuaaaucugcauucagugaauguauugggagaaaaauaggucuugc

SEQ ID NO: 227358 - RNA, 65 nt, hsa
cuuaauauuaauggacuguuucagguaaaagagaaugaauguaugauugugaacugugaagagaa

SEQ ID NO: 227359 - RNA, 65 nt, hsa
gccgccaguucucaaguuuuccuccuaacuccauuugaauguaagggcagcuggcccccaaugug

SEQ ID NO: 227360 - RNA, 65 nt, hsa
auucugaaccacuagaguuuccuugauucagacuuugaauguacuguucuauaguuuuucaggau

SEQ ID NO: 227361 - RNA, 65 nt, hsa
uauuuggcaggugaguggauggauagauggauaggugaauguagguggacaggugacugggugga

SEQ ID NO: 227362 - RNA, 65 nt, hsa
uuuuauguaauaucauguguaccuuuacauuguggugaauguaacaauauauguucuucauauuu

SEQ ID NO: 227363 - RNA, 65 nt, hsa
gcauucaguggccuaucuccagauugucugauuucugaauguaaaguuguuguguuuuuuuuuaa

SEQ ID NO: 227364 - RNA, 65 nt, hsa
aaccucccccauuuaaauacucagaagauaaggugugaauguauguauuauuagaguccgaaagu

SEQ ID NO: 227365 - RNA, 65 nt, hsa
auaucagagauacacaaaaaaccaauugaggguagugaauguaagaagacagucccagaaguaaa

SEQ ID NO: 227366 - RNA, 65 nt, hsa
uuuaacaauucuccuuaaaagauauuuuggagugaugaauguaguuuacuuuuguauuugaauuu

SEQ ID NO: 227367 - RNA, 65 nt, hsa
ccucauuuuucuauauauuuauuucacgacagaguugaauguauggccuucaacaugaugcacau

SEQ ID NO: 227368 - RNA, 65 nt, hsa
cccuuaguaccaaauacacucaauugccuuuuuaaugaauguacuugucuuggauagguugcugg

SEQ ID NO: 227369 - RNA, 65 nt, hsa
aagugaguuuaacaaagaaacauuuagaauagaucugaauguaagaacuacagaacuguuucaga

SEQ ID NO: 227370 - RNA, 65 nt, hsa
acuuuuuuuuuuuaacacacuaaucuucaguuggaugaauguaauguauaacuauguuuucagca

SEQ ID NO: 227371 - RNA, 65 nt, hsa
auaaccuauuguuagaaaauauguguuuuuauaaaugaauguaaaauaauuaaaugaauugugaa

SEQ ID NO: 227372 - RNA, 65 nt, hsa
ucaaaggagcugaauguguuaugcuuccaaacaacugaauguaaaacacuccuagccaguuguug

SEQ ID NO: 227373 - RNA, 65 nt, hsa
acugaccuguuguaggcagcuaucuuacagacgcaugaauguaagaguaggaagggguggguguc

SEQ ID NO: 227374 - RNA, 65 nt, hsa
auucuacccucuuuuuccugcuaauccugucauaaugaauguagcuucucaguucacuguauaug

SEQ ID NO: 227375 - RNA, 65 nt, hsa
cacuaacgacuucagggcagggcucugauauuccaugaauguaucaggaaauauauaugugugug

SEQ ID NO: 227376 - RNA, 57 nt, hsa
uuguguuggaucugaggugauauguucugaauguaagcaccgucaacaucagacacc

SEQ ID NO: 227377 - RNA, 65 nt, hsa
uuaugcucuggcaucuaacauaugauucuguaguaugaauguaaucaguguauguuaguacaaau

SEQ ID NO: 227378 - RNA, 65 nt, hsa
caauuuucaguauuuuaacuaccucaauaaugcuaugaauguaagauauugggauagagauccca

SEQ ID NO: 227379 - RNA, 65 nt, hsa; identical to SEQ ID NO: 58850

SEQ ID NO: 227380 - RNA, 65 nt, hsa; identical to SEQ ID NO: 58851

SEQ ID NO: 227381 - RNA, 65 nt, hsa
cccuucacccaaccucucccaccuccaccccacaaugaauguauuuauugugagaauggcuacac

SEQ ID NO: 227382 - RNA, 65 nt, hsa
ccuguccagcacagcuucuggcacaggaugcuuggugaauguacccuuucuuucccucccugcag

SEQ ID NO: 227383 - RNA, 65 nt, hsa
acugacggggaaaaaaaaaaaaaaagaauggggugugaauguaccaacacugaaucuuacagcag

SEQ ID NO: 227384 - RNA, 65 nt, hsa
ucuauuaccaauuuuucagaacucauagauaaauaugaauguagggaagcuguaagccagcccau

SEQ ID NO: 227385 - RNA, 65 nt, hsa
cacaugcuuuaagauuucuauccaucuuucagaguugaauguaauaauguuugguauuuaauucu

SEQ ID NO: 227386 - RNA, 65 nt, hsa
agggcaguuuggugcaauuuauguuaaaugccauuugaauguaaucaccuguguuaccacgaaug

SEQ ID NO: 227387 - RNA, 65 nt, hsa
uucuguggguuugggugggaagagggccaucugccugaauguaaccugcuagcucuccgaaggcc

SEQ ID NO: 227388 - RNA, 65 nt, hsa
uugaugccaguaaucuauaagggaucuuuauaguuugaauguauuugaauaacuucaguauacuu

SEQ ID NO: 227389 - RNA, 65 nt, hsa
uagauccauuuugugccacacuccauuguagacuuugaauguaguagucuuuccaagagccuacu

SEQ ID NO: 227390 - RNA, 65 nt, hsa
gaggguaaauggagaaaauauuucugggauuacaaugaauguaagcccaaauuguggaauugcca

SEQ ID NO: 227391 - RNA, 65 nt, hsa
uguucugcauugagccuaguuuugccauuguccccugaauguaguauuaucuauagauuauacau

SEQ ID NO: 227392 - RNA, 65 nt, hsa
uaguaugggaauuauuuuuuauguuaaauagaaacugaauguacuggguugaaugguguccucuc

SEQ ID NO: 227393 - RNA, 65 nt, hsa
ugcauggagugaccauagcuccuucucucuuacauugaauguagagaauguagccauuguagcag

SEQ ID NO: 227394 - RNA, 65 nt, hsa
aaaaauccuuuuauggaaaccauuuuuuuaaaaagugaauguacacaaauccacagaggacugug

SEQ ID NO: 227395 - RNA, 65 nt, hsa
aaucauguucuuauaccuaauuuuagucuuucaaaugaauguacuguaaugcuuguauguauaaa

SEQ ID NO: 227396 - RNA, 65 nt, hsa
gccccuucaggaaggaccccccaaagcugaggggcugaauguagccuuuucaacagagaaggcuc

SEQ ID NO: 227397 - RNA, 65 nt, hsa
aucucaucguaaggcagcuaguucuaauuugcauuugaauguauaacaaauugcaucacuuuuca

SEQ ID NO: 227398 - RNA, 65 nt, hsa
uuagaguugucuuucagcauucaaucaggcugagcugaauguagugauguuuacauuguuuacau

SEQ ID NO: 227399 - RNA, 65 nt, hsa
cuucaucucuuuagagaaguccaagcaacagccuuugaauguaaccaauccuacuaauaaaccag

SEQ ID NO: 227400 - RNA, 65 nt, hsa
aaaaggauggucacucuuccgaggucucccugaaaugaauguauuucucccccaaaagagcugau

SEQ ID NO: 227401 - RNA, 65 nt, hsa
acagaugcagaagguuucucuggauagcacaccucugaauguaaaucaugauaaaauggauauuu

SEQ ID NO: 227402 - RNA, 65 nt, hsa
cauuuuuuaaugugcucuguaccugucaaaaauuuugaauguacaccacaugcuauugucugaac

SEQ ID NO: 227403 - RNA, 65 nt, hsa
cugaaagaugcuaaucuauuugccaaacuuggucuugaauguacugggggcuucaagguaugggu

SEQ ID NO: 227404 - RNA, 65 nt, hsa
cccaacuggggcuccuggggguacaggaauccuuaugaauguauagaaugcauacugccuaggcc

SEQ ID NO: 227405 - RNA, 65 nt, hsa
cuguuccaaaacaaaauucaccuccuuucuuuaugugaauguauucuccauaaaauuccaguauu

SEQ ID NO: 227406 - RNA, 65 nt, hsa
ccaggccucgggaccaacucuuuguauaaccuaccugaauguauuaaaaacuaauuuuggagaag

SEQ ID NO: 227407 - RNA, 65 nt, hsa
uucuuuucccagaagagucuuugauucaccaaacaugaauguacauuuucuaacaaacucaaaau

SEQ ID NO: 227408 - RNA, 65 nt, hsa
gugugugacuuugagcaaaaagugacuucuuuuugugaauguaaaauuugugaaacuugaguuuu

SEQ ID NO: 227409 - RNA, 65 nt, hsa
ggagcauuuacagaugaauccccacacuuagccauugaauguaaaggggaaaaauaaggugagaa

SEQ ID NO: 227410 - RNA, 65 nt, hsa
guaguauaauuuguuacuuucaaauacccguacuuugaauguagguuuuuuuguuguuguuaucu

SEQ ID NO: 227411 - RNA, 65 nt, hsa
uuuguauuguaguaaccaauaugugcaguauacguugaauguauaugaacauacuuuccuauuuc

SEQ ID NO: 227412 - RNA, 65 nt, hsa
aucccaagauccuggggaaaggagagaccauggugugaauguagagaugccaccucccucucucu

SEQ ID NO: 227413 - RNA, 65 nt, hsa
aucauuauuuauuuuuuuguaguaguaaugucauaugaauguaucuuaaaacgugugcccuuuua

SEQ ID NO: 227414 - RNA, 65 nt, hsa
ccuuucuaggcuuggagauggcuuugguugguccgugaauguaguuaugagagugcugccauuaa

SEQ ID NO: 227415 - RNA, 65 nt, hsa
uuaauguugagcuaagaagcauuaagucuuugaacugaauguauuuugcaucccugguuuuggac

SEQ ID NO: 227416 - RNA, 65 nt, hsa
ggugucugccccgcguuuccugccugcggaccagaugaauguagcagauccccagccucuggccu

SEQ ID NO: 227417 - RNA, 65 nt, hsa
augauacuaguaauucauaagggaucuguguaaucugaauguauuugaauaacuuuagcucuacu

SEQ ID NO: 227418 - RNA, 65 nt, hsa
uuuucaggucauuuccugauagucuagucagcuuaugaauguaagcaaaacaggaccaaugaaag

SEQ ID NO: 227419 - RNA, 65 nt, hsa
gaaagacugaggcauuuuccagucuacuugccuaaugaauguauaggaacugucuaugaguaugg

SEQ ID NO: 227420 - RNA, 65 nt, hsa
ccacagcucaggaaaaagaugaggcauaacgaccuugaauguaauuggaguaagugacaaaauaa

SEQ ID NO: 227421 - RNA, 65 nt, hsa
uaagaaaaaaauuugccuuuaagaguuacuuuuguugaauguauuugacuuaguucuuauuuuaa

SEQ ID NO: 227422 - RNA, 65 nt, hsa
gucuucucuucauuaccuuuuaaggacagugucuuugaauguagggcccacccugaucuagggug

SEQ ID NO: 227423 - RNA, 65 nt, hsa; identical to SEQ ID NO: 58852

SEQ ID NO: 227424 - RNA, 65 nt, hsa; identical to SEQ ID NO: 58853

SEQ ID NO: 227425 - RNA, 65 nt, hsa; identical to SEQ ID NO: 58854

SEQ ID NO: 227426 - RNA, 65 nt, hsa; identical to SEQ ID NO: 58855

SEQ ID NO: 227427 - RNA, 65 nt, hsa
cuuagugacccccaucuuguaaccuguugcaagagugaauguaaaaaauaguuguggcauuuuaa

SEQ ID NO: 227428 - RNA, 65 nt, hsa
guugaacacacuaugaagaauuccagguguacuagugaauguaauuuauaguugccaaaaaaaaa

SEQ ID NO: 227429 - RNA, 65 nt, hsa
uuacccucauauucuuuaaaaaacuuaaagcauuaugaauguagagaaauucaccagagcucacu

SEQ ID NO: 227430 - RNA, 57 nt, hsa
ccuuagucauugcacaauaaggauuuuugaauguauaauaucaucuaagguaagcuu

SEQ ID NO: 227431 - RNA, 65 nt, hsa
ggguuuuuuaguugaauuuuuuuuaacauuccucaugaauguaaauuuguacuauuuaacugacu

SEQ ID NO: 227432 - RNA, 65 nt, hsa
ggauuugggcugccccaggcccacccagggggcucugaauguauuuuguaccguguuucuuuccc

SEQ ID NO: 227433 - RNA, 65 nt, hsa
cccacugcucugaugggugguuuguccaaggaugcugaauguaaugccuggucaauguggaagcc

SEQ ID NO: 227434 - RNA, 65 nt, hsa
ugcccuugaggagcacaggcagaagugugaacuugugaauguaauugaucuuuccuuccuuccag

SEQ ID NO: 227435 - RNA, 65 nt, hsa
caucguuaacggguaccauuaaauauucugagaggugaauguaaaauauaaaagguauagguuuu

SEQ ID NO: 227436 - RNA, 65 nt, hsa
uauuagucauguauauuuuaaaugcuaacauuugaugaauguaaguuuccacauuguugcuguuu

SEQ ID NO: 227437 - RNA, 65 nt, hsa
cacauauuuuucacuugaauuuuuuuggaaauagcugaauguaaauagcagggaggaagaagcaa

SEQ ID NO: 227438 - RNA, 65 nt, hsa; identical to SEQ ID NO: 58856

SEQ ID NO: 227439 - RNA, 65 nt, hsa; identical to SEQ ID NO: 58857

SEQ ID NO: 227440 - RNA, 65 nt, hsa; identical to SEQ ID NO: 58858

SEQ ID NO: 227441 - RNA, 65 nt, hsa; identical to SEQ ID NO: 58859

SEQ ID NO: 227442 - RNA, 65 nt, hsa
acuauuggaaggaguuagauguugguacuagauacugaauguaaacaaaggaauuauggcuggua

SEQ ID NO: 227443 - RNA, 65 nt, hsa
auuguuaaacauuuagacaaacauauauguauguaugaauguacauaaauauuuuuaacuccuau

SEQ ID NO: 227444 - RNA, 65 nt, hsa
ucuaggcaucauguccuauaguuugucaucccugaugaauguaaaguuacacuguucacaaaggu

SEQ ID NO: 227445 - RNA, 65 nt, hsa
gugaccugguuaccuuggaaaugcaggaacuuauaugaauguacuauaaaauaaaaugcggacug

SEQ ID NO: 227446 - RNA, 65 nt, hsa
uuauaaauugugauguagccucgcuagucaagcugugaauguauauuguuugcacuuaauccuua

SEQ ID NO: 227447 - RNA, 65 nt, hsa
gccuaaaaugugaaagcauauuuuguauccuaaaaugaauguaugauauucuaaacaucuguuuu

SEQ ID NO: 227448 - RNA, 65 nt, hsa
uaguuuuuuuuuaaaugcuuguucuaagacauuucugaauguagaccauuuuccaaaaaggaaac

SEQ ID NO: 227449 - RNA, 65 nt, hsa; identical to SEQ ID NO: 58860

SEQ ID NO: 227450 - RNA, 65 nt, hsa; identical to SEQ ID NO: 58861

SEQ ID NO: 227451 - RNA, 65 nt, hsa
uguagggcauuuucugauugcacuuccuuaaguuaugaauguacuagaaagggacucauccagaa

SEQ ID NO: 227452 - RNA, 65 nt, hsa
ucaguuuucuuuuuuauuuugguuaugcuuaaauaugaauguaauuaccaaaagauuuagaagug

SEQ ID NO: 227453 - RNA, 65 nt, hsa
uuacauuugaguaugguaacuuaugucaucuauguugaauguaagcuuauaaagcacaaagcaua

SEQ ID NO: 227454 - RNA, 65 nt, hsa
ggugggaagguuuugcugcuaauguauuuauggaaugaauguauuucauucaaaucuguauuccu

SEQ ID NO: 227455 - RNA, 65 nt, hsa
aaucucccuucacaaguuuuuuuacuguuuuuagaugaauguacgaugagaaauucaacguuaau

SEQ ID NO: 227456 - RNA, 65 nt, hsa
uaauacaaccucagugugucauugggcaguuuaaaugaauguacauuccugaggcaucagaacuu

SEQ ID NO: 227457 - RNA, 65 nt, hsa
gguuaggagacuaaaauauaaauuaaguugugauuugaauguagauugguaucaccuccaacucc

SEQ ID NO: 227458 - RNA, 65 nt, hsa
aguaagaaacuguccgauaugaaucacaacgugggugaauguaguauuuuccugaagugugaaag

SEQ ID NO: 227459 - RNA, 65 nt, hsa
cauauuagugauugaaguauuuugacuuuugagauugaauguaaaauauuuuaaauuugggauca

SEQ ID NO: 227460 - RNA, 65 nt, hsa
agcacacacauacacaccaccaccaacaacgcuugugaauguauuuuucuguuagcuggguuuac

SEQ ID NO: 227461 - RNA, 65 nt, hsa
aaguguucauugcacaauauauuuuuacugcuuucugaauguagacggaacaguguggaagcaga

SEQ ID NO: 227462 - RNA, 65 nt, hsa
uguuuagagagccugucaccagagcuucucugggcugaauguaugucagugcuauaaaugccaga

SEQ ID NO: 227463 - RNA, 65 nt, hsa
ucagaauuaaauuuguauagagcagaguuuuaaaaugaauguaaauagcacuaaacguuuucuuu

SEQ ID NO: 227464 - RNA, 65 nt, hsa
ccaagucugagucccaguuacuugggaggaucacuugaauguaggaucacuugagucuaggaguu

SEQ ID NO: 227465 - RNA, 65 nt, hsa
agcaucuuuguauauugcaauauacuugaaaaaaaugaauguauuuuuuucuccaaagaacagca

SEQ ID NO: 227466 - RNA, 65 nt, hsa; identical to SEQ ID NO: 58862

SEQ ID NO: 227467 - RNA, 65 nt, hsa; identical to SEQ ID NO: 58863

SEQ ID NO: 227468 - RNA, 65 nt, hsa
guauuaugucuuuauuguuguuaaaaaguuuuuauugaauguaugaaaauuaucaaauuguauuc

SEQ ID NO: 227469 - RNA, 65 nt, hsa
gacaauagcccaaagccaagaaagaaaaauuaucuugaauguaguauucaaugauuuuuuaugau

SEQ ID NO: 227470 - RNA, 65 nt, hsa
acuuuagaacagaggauuguauugcaagacaaaguugaauguaaagugaucucccugaacauuuu

SEQ ID NO: 227471 - RNA, 65 nt, hsa
uuugacauggaugauucugaggaggaagcuguuauugaauguauagagauuuauccaaauaaaua

SEQ ID NO: 227472 - RNA, 65 nt, hsa
uuuguauugaaaugaaaccaccaguguuaucaacuugaauguaaauguacaugugcagauauucc

SEQ ID NO: 227473 - RNA, 65 nt, hsa
guagaccugaccuuguuauuuauuagauaacauuuugaauguauccauuggauuucuaaaaugua

SEQ ID NO: 227474 - RNA, 65 nt, hsa
caucacaguauuguuaggagauuuaaaugaauuagugaauguaagauacuuuagaaagcauguaa

SEQ ID NO: 227475 - RNA, 65 nt, hsa
auggccuaagaaauaaggaucaauaaggaaugauuugaauguaauuuugugaauguguggaaaau

SEQ ID NO: 227476 - RNA, 65 nt, hsa
uccauuccuacuguauuucuguaugaauguguuugugaauguauguguaaaagucuuucuuuucc

SEQ ID NO: 227477 - RNA, 65 nt, hsa
ugaugcacuuugaauauugagauauuuugcacggaugaauguaugggaacuacccaugaugaugu

SEQ ID NO: 227478 - RNA, 65 nt, hsa
caaauuccuguacauagagauauauuuuuuaagugugaauguaacaacauacugugaauuccauc

SEQ ID NO: 227479 - RNA, 65 nt, hsa
caugacgcgccaggcacaguucugcaaguauauugugaauguauuguucuagugggauacacaaa

SEQ ID NO: 227480 - RNA, 65 nt, hsa; identical to SEQ ID NO: 58864

SEQ ID NO: 227481 - RNA, 65 nt, hsa; identical to SEQ ID NO: 58865

SEQ ID NO: 227482 - RNA, 65 nt, hsa
aaaaaaaaaacaugcaccuguuucacugugaauagugaauguaaaggaaagaaaggaaaaacuga

SEQ ID NO: 227483 - RNA, 65 nt, hsa
auaaauuuguauuuauguguauauaaaauguacaaugaauguaaauaugacuuucuggaaaguuu

SEQ ID NO: 227484 - RNA, 65 nt, hsa
uuuuuuccccucacauugaauuuuaauuccauucuugaauguagaaauuucagauucucuaaaac

SEQ ID NO: 227485 - RNA, 65 nt, hsa
uuaauguaaacagaacuggcacacacacauuaagaugaauguaauuauuauuccucuugcugguc

SEQ ID NO: 227486 - RNA, 65 nt, hsa
uucuacucuucuaagcuuacagagaccagaccaggugaauguaacuggggaaaaucaagauggua

SEQ ID NO: 227487 - RNA, 65 nt, hsa
cuucacucagagaagcaaggcugauauuagcuuguugaauguaagagacacaaaugaagaagaac

SEQ ID NO: 227488 - RNA, 65 nt, hsa
aaugucagguuauacuaaaacuaaaucagaaagucugaauguagcacauaaugguucucuucugu

SEQ ID NO: 227489 - RNA, 65 nt, hsa
ugcagugagcaucacuacagucucagucaacagugugaauguaucauguuuuacuuuaaaugugu

SEQ ID NO: 227490 - RNA, 65 nt, hsa
guccuugugacuucaacggacucuuccaaauuguaugaauguaucaauguauuagauaaacccag

SEQ ID NO: 227491 - RNA, 65 nt, hsa; identical to SEQ ID NO: 58866

SEQ ID NO: 227492 - RNA, 65 nt, hsa; identical to SEQ ID NO: 58867

SEQ ID NO: 227493 - RNA, 65 nt, hsa
auuaaaaaguuucaaaucuagacacuaaaugugugugaauguacaaagaaaacaaaccauugcuu

SEQ ID NO: 227494 - RNA, 65 nt, hsa
gcggggcagcguggccccaccggacuagcacaugaugaauguaaaguuggcacaaugaaaaugac

SEQ ID NO: 227495 - RNA, 65 nt, hsa
uaaugcccuuuagggcacaacuaguuaucaguaacugaauguaucuuaaucauuauggcugcuuc

SEQ ID NO: 227496 - RNA, 58 nt, hsa
uguuucuagggagaaagugacguauacaugaauguauuuaucuaucaaauuacugaag

SEQ ID NO: 227497 - RNA, 65 nt, hsa; identical to SEQ ID NO: 227490

SEQ ID NO: 227498 - RNA, 65 nt, hsa
uauauauaaaaaucuugagaugguagaaacauguaugaauguacuaaguaguauuccacuguacu

SEQ ID NO: 227499 - RNA, 65 nt, hsa
agguaacaaauuuggggaagacagcacaaucuucuugaauguagcucuugggaaugcauuauuac

SEQ ID NO: 227500 - RNA, 65 nt, hsa
ccauccucucccauaagcacccaugucuuugaauaugaauguauuuguaaaauaccacguuucau

SEQ ID NO: 227501 - RNA, 65 nt, hsa
cuccuccucuccccaccuuugccauucuuaaguauugaauguacuuuguauaauuuuaguggaau

SEQ ID NO: 227502 - RNA, 65 nt, hsa
acauugacauucauuccuauuuuacugggcaccuaugaauguaugcugugugcuagaaauagacu

SEQ ID NO: 227503 - RNA, 65 nt, hsa
agggguucucaauggaaaaacgaaugcucuuacacugaauguacaggcagugggcuugcagcacu

SEQ ID NO: 227504 - RNA, 65 nt, hsa
cuuguuugaauuaauuguauuguaauauuauuuguugaauguaguaauuagguauuuaugaauau

SEQ ID NO: 227505 - RNA, 65 nt, hsa
ggguuacuaaccuugaaauguaagagaucugguuuugaauguaaaaguugcaacacacaaacgga

SEQ ID NO: 227506 - RNA, 65 nt, hsa; identical to SEQ ID NO: 58868

SEQ ID NO: 227507 - RNA, 65 nt, hsa; identical to SEQ ID NO: 58869

SEQ ID NO: 227508 - RNA, 65 nt, hsa
uacauaaauucuacuuuauuccucaacuucuuugaugaauguaacccaauuuuacuucuuuaaaa

SEQ ID NO: 227509 - RNA, 65 nt, hsa
gggagagagccgcgggguccugcccgugguuacuaugaauguauugcuguuggaggacaucucga

SEQ ID NO: 227510 - RNA, 65 nt, hsa
cgccagaggccugaagcugagcguguacguuaaugugaauguauauagucuuugcagagguccaa

SEQ ID NO: 227511 - RNA, 65 nt, hsa
gccgcugugugucuuagcauggaaauaaauaaaccugaauguacgugcucgccucuggccugugu

SEQ ID NO: 227512 - RNA, 65 nt, hsa
cuuuauuugcacgucaggggagccggcuccccccuugaauguaccagacccuggggggggucacu

SEQ ID NO: 227513 - RNA, 65 nt, hsa
acuuucuggauuucucuugaagugcuacacugcacugaauguaaggaauuguugcuuguggaagu

SEQ ID NO: 227514 - RNA, 65 nt, hsa
uugucagacuuccaaauccuggaaggacacagugaugaauguacuaugucugaacauagaaacuc

SEQ ID NO: 227515 - RNA, 65 nt, hsa
cuuucuaauuaggcauuuuauguuagucacagucuugaauguauaaacagcacuaagacucucag

SEQ ID NO: 227516 - RNA, 65 nt, hsa
aacaagacuuucccagcuuguauuaccuagaagcgugaauguauaggauaccugacuacuaagac

SEQ ID NO: 227517 - RNA, 65 nt, hsa
guugauguuuuaacucuaucugucauacauccuagugaauguaaaaugcaaaauccuggugaugu

SEQ ID NO: 227518 - RNA, 65 nt, hsa; identical to SEQ ID NO: 58870

SEQ ID NO: 227519 - RNA, 65 nt, hsa; identical to SEQ ID NO: 58871

SEQ ID NO: 227520 - RNA, 65 nt, hsa
uggagucuucuuucaaaccaguggggguuggacaaugaauguaguuaacugguuccugcucacac

SEQ ID NO: 227521 - RNA, 65 nt, hsa
aucaaggcgccuuuccuaauaauaugguucaacugugaauguagaagugggggggaggggggaga

SEQ ID NO: 227522 - RNA, 65 nt, hsa
gagagacccugcaagaccacggagggagcgacacuugaauguagaauaggcagggggcccugccc

SEQ ID NO: 227523 - RNA, 65 nt, hsa; identical to SEQ ID NO: 58872

SEQ ID NO: 227524 - RNA, 65 nt, hsa; identical to SEQ ID NO: 58873

SEQ ID NO: 227525 - RNA, 65 nt, hsa
acguaugugcucuuauaaaguggacuucugaaaaaugaauguaaaagacacugguguaucucaga

SEQ ID NO: 227526 - RNA, 65 nt, hsa
auuuaguugacuguauuauuugauuucggauugaaugaauguaaauagaaauuaaaugcaaauuu

SEQ ID NO: 227527 - RNA, 65 nt, hsa
agguucaucuguccaugcaguccucuuggauucucugaauguaguaacuaugaagcuaugccaaa

SEQ ID NO: 227528 - RNA, 65 nt, hsa
caaagccuucguuguauguugacgaugcacuuuuaugaauguaguuucuaucgcuguuuuuagcc

SEQ ID NO: 227529 - RNA, 65 nt, hsa
agauuucaaauccaggggauuccaugcucaauggaugaauguagacacaaaacagcaacacuugu

SEQ ID NO: 227530 - RNA, 65 nt, hsa
cugucacugaggguuuugguuggcaucguuguuuuugaauguagcacaagcgaugagcaaacucu

SEQ ID NO: 227531 - RNA, 65 nt, hsa
ccugacuugccuuauuuauuuguucgacgcgucucugaauguauccgccucgguucccaccacug

SEQ ID NO: 227532 - RNA, 65 nt, hsa
ggucuuggccacagccugagugacgaauuuccuacugaauguaccaaguuccaauuuuuaagggg

SEQ ID NO: 227533 - RNA, 65 nt, hsa
gauuucaacccaggugccccuggccuggccagcagugaauguaggagaugaauugugcaagugac

SEQ ID NO: 227534 - RNA, 65 nt, hsa
cccuauguagcaacagugguuagaugaucuuugucugaauguaauuaaacuuugaauaguuuuag

SEQ ID NO: 227535 - RNA, 65 nt, hsa
caucaggacucagaccccaggccgagaucuugcccugaauguacccugccucugcuuucuccugc

SEQ ID NO: 227536 - RNA, 65 nt, hsa
ccuuccacacagggugcaugugaggaugaaaggagugaauguauaaagacaccuuucccgauaac

SEQ ID NO: 227537 - RNA, 65 nt, hsa
ugagaacagcaguuuauuacucacuaaagacagaaugaauguagaaaaggcugaauucuguaaua

SEQ ID NO: 227538 - RNA, 65 nt, hsa
acuuguuuauccaacuaaguguccaaaaccuaaauugaauguacuaaguuuucacaugucccauu

SEQ ID NO: 227539 - RNA, 65 nt, hsa
augucuaaacuauaagcuuccaacuauuaccugcuugaauguaaauauuaaauggagauguugaa

SEQ ID NO: 227540 - RNA, 65 nt, hsa
uauagcauuuuucaacauuuaauggucuguacaguugaauguaaguguucaauauguauugcuga

SEQ ID NO: 227541 - RNA, 65 nt, hsa
aucauuugcauaagauuuaacagcauuuuuuauaaugaauguaaacauuuuaacuuaaugguacu

SEQ ID NO: 227542 - RNA, 65 nt, hsa
cuccauuacacgaucaccugcaucacagcccauggugaauguauguuucugcauagcgaaauaaa

SEQ ID NO: 227543 - RNA, 65 nt, hsa
cuccugaguggaugacaggucuucauucucuaucuugaauguauuaugguuacuaauaguuuuau

SEQ ID NO: 227544 - RNA, 65 nt, hsa
gagaaauuuuaaaauaauagaagaaauagaaauuuugaauguauaaaagaaaaagaucaaguugu

SEQ ID NO: 227545 - RNA, 65 nt, hsa
uaugcugauaaauguaagauuaguaggaggagaagugaauguaaauuuuauuauagaauuuucug

SEQ ID NO: 227546 - RNA, 65 nt, hsa
cauuuuccuuauuguuaaaaacauguuagaagcaaugaauguauauaaaagccucaacuagucau

SEQ ID NO: 227547 - RNA, 65 nt, hsa
gucccucuguaauuucaaaaugaaugaaauucaugugaauguagguugagagggcacugaagacc

SEQ ID NO: 227548 - RNA, 65 nt, hsa
ucacaaacaaacaaaggaggggggagcagguuuuaugaauguaacugugcacaggaaaugacugg

SEQ ID NO: 227549 - RNA, 65 nt, hsa
ggcgcgggggggaggcuggggucccgccgccgugaugaauguacugacgagccgaggcagcagug

SEQ ID NO: 227550 - RNA, 65 nt, hsa; identical to SEQ ID NO: 58874

SEQ ID NO: 227551 - RNA, 65 nt, hsa; identical to SEQ ID NO: 58875

SEQ ID NO: 227552 - RNA, 65 nt, hsa
gucugggucauucaggcaguacaucugaauuaagcugaauguagacaaauaaagaaaaacaaaac

SEQ ID NO: 227553 - RNA, 65 nt, hsa
gggcccccuccccaccaaaggguucaccucacacuugaauguacaacccaccccacugucgggaa

SEQ ID NO: 227554 - RNA, 65 nt, hsa
uuacaugaaagauuucaaacugcagagaaccacuaugaauguaaacaaugugguaaagcauuuag

SEQ ID NO: 227555 - RNA, 65 nt, hsa; identical to SEQ ID NO: 58876

SEQ ID NO: 227556 - RNA, 65 nt, hsa; identical to SEQ ID NO: 58877

SEQ ID NO: 227557 - RNA, 65 nt, hsa; identical to SEQ ID NO: 58878

SEQ ID NO: 227558 - RNA, 65 nt, hsa; identical to SEQ ID NO: 58879

SEQ ID NO: 227559 - RNA, 65 nt, hsa; identical to SEQ ID NO: 58880

SEQ ID NO: 227560 - RNA, 65 nt, hsa; identical to SEQ ID NO: 58881

SEQ ID NO: 227561 - RNA, 65 nt, hsa; identical to SEQ ID NO: 58882

SEQ ID NO: 227562 - RNA, 65 nt, hsa; identical to SEQ ID NO: 58883

SEQ ID NO: 227563 - RNA, 65 nt, hsa; identical to SEQ ID NO: 58884

SEQ ID NO: 227564 - RNA, 65 nt, hsa; identical to SEQ ID NO: 58885

SEQ ID NO: 227565 - RNA, 65 nt, hsa; identical to SEQ ID NO: 58886

SEQ ID NO: 227566 - RNA, 65 nt, hsa
agauacauuaaaauacucacugaagagaagcccuaugaauguaaguaacgugggaaagcaugaaa

SEQ ID NO: 227567 - RNA, 65 nt, hsa
cuguucuggggcuuguccuuccuuugcagcuguuuugaauguaguuuuccuuuucuauuuauuug

SEQ ID NO: 227568 - RNA, 65 nt, hsa; identical to SEQ ID NO: 58887

SEQ ID NO: 227569 - RNA, 65 nt, hsa; identical to SEQ ID NO: 58888

SEQ ID NO: 227570 - RNA, 65 nt, hsa
aaacucaaucaauguuauugugaaaacugggaaugugaauguaauauauguagaaaaacauuuag

SEQ ID NO: 227571 - RNA, 59 nt, hsa; identical to SEQ ID NO: 58889

SEQ ID NO: 227572 - RNA, 65 nt, hsa; identical to SEQ ID NO: 58890

SEQ ID NO: 227573 - RNA, 65 nt, hsa; identical to SEQ ID NO: 58891

SEQ ID NO: 227574 - RNA, 65 nt, hsa
uaaggccugcccaccaccgcccgccugggcagccaugaauguagcgccccaggcccugccccagc

SEQ ID NO: 227575 - RNA, 65 nt, hsa
agcauauaaugagaugcuugaugaauggugcauauugaauguauaaagcccaccgguccugagag

SEQ ID NO: 227576 - RNA, 65 nt, hsa
uucuugcuucuucuaccuuuauuuauucucagcucugaauguaugaaccugcucaaucaccucau

SEQ ID NO: 227577 - RNA, 65 nt, hsa
caaguuaguuuuguggcuuuccaucugacccuaugugaauguaaggugaugugaccuuguuggug

SEQ ID NO: 227578 - RNA, 65 nt, hsa
guaguucacacuggaaaaaggccacguaugugccuugaauguagccaaaaugacgaacaacaccc

SEQ ID NO: 227579 - RNA, 65 nt, hsa
cagcaucagagaguucacacuagagaaaggccuuaugaauguagugaaugugggaaauccuuuag

SEQ ID NO: 227580 - RNA, 65 nt, hsa
aggcugguggcauggccccccugccccgugcugaaugaauguacagagccagacaaagcugugaa

SEQ ID NO: 227581 - RNA, 65 nt, hsa; identical to SEQ ID NO: 58892

SEQ ID NO: 227582 - RNA, 65 nt, hsa; identical to SEQ ID NO: 58893

SEQ ID NO: 227583 - RNA, 60 nt, hsa
aacauuuaaaaacacacugaagaaaaacucugaauguaaggaauguggaaaucuuuuagg

SEQ ID NO: 227584 - RNA, 65 nt, hsa
augcaugaaagaauucacacuggggagaaauacuaugaauguaaggauaugaguguuguuaccau

SEQ ID NO: 227585 - RNA, 65 nt, hsa
gcacacgaauccauccaccuguccacgugcacacgugaauguagcgauagauauuuggacaucaa

SEQ ID NO: 227586 - RNA, 65 nt, hsa; identical to SEQ ID NO: 58894

SEQ ID NO: 227587 - RNA, 65 nt, hsa; identical to SEQ ID NO: 58895

SEQ ID NO: 227588 - RNA, 65 nt, hsa; identical to SEQ ID NO: 58896

SEQ ID NO: 227589 - RNA, 65 nt, hsa; identical to SEQ ID NO: 58897

SEQ ID NO: 227590 - RNA, 65 nt, hsa; identical to SEQ ID NO: 58898

SEQ ID NO: 227591 - RNA, 65 nt, hsa; identical to SEQ ID NO: 58899

SEQ ID NO: 227592 - RNA, 65 nt, hsa; identical to SEQ ID NO: 58900

SEQ ID NO: 227593 - RNA, 65 nt, hsa; identical to SEQ ID NO: 58901

SEQ ID NO: 227594 - RNA, 65 nt, hsa; identical to SEQ ID NO: 58902

SEQ ID NO: 227595 - RNA, 65 nt, hsa; identical to SEQ ID NO: 58903

SEQ ID NO: 227596 - RNA, 65 nt, hsa; identical to SEQ ID NO: 58904

SEQ ID NO: 227597 - RNA, 65 nt, hsa; identical to SEQ ID NO: 58905

SEQ ID NO: 227598 - RNA, 65 nt, hsa; identical to SEQ ID NO: 58906

SEQ ID NO: 227599 - RNA, 65 nt, hsa; identical to SEQ ID NO: 58907

SEQ ID NO: 227600 - RNA, 65 nt, hsa; identical to SEQ ID NO: 58908

SEQ ID NO: 227601 - RNA, 65 nt, hsa
gauacuuguacgaaacacauuggagauagacccugugaauguaagcacuugguaaagccuuaagu

SEQ ID NO: 227602 - RNA, 65 nt, hsa
cccccacagcaguaucagaaacuucugacaaucagugaauguacaacccagccgaggggacggug

SEQ ID NO: 227603 - RNA, 65 nt, hsa
gagcacgaaagaauucccacuggugagaaacaguaugaauguaaacauugugauuaagccuucag

SEQ ID NO: 227604 - RNA, 65 nt, hsa; identical to SEQ ID NO: 58909

SEQ ID NO: 227605 - RNA, 65 nt, hsa; identical to SEQ ID NO: 58910

SEQ ID NO: 227606 - RNA, 65 nt, hsa
aagucuuuucaacuucuguguuauagaacauucuaugaauguaguaauuaaucuauuuugcucca

SEQ ID NO: 227607 - RNA, 65 nt, hsa
auuuaagaaaaucuucaucuauuucauaucuauaaugaauguagaacaucuugcuucugcucaga

SEQ ID NO: 227608 - RNA, 65 nt, hsa; identical to SEQ ID NO: 58911

SEQ ID NO: 227609 - RNA, 65 nt, hsa; identical to SEQ ID NO: 58912

SEQ ID NO: 227610 - RNA, 65 nt, hsa; identical to SEQ ID NO: 58913

SEQ ID NO: 227611 - RNA, 65 nt, hsa; identical to SEQ ID NO: 58914

SEQ ID NO: 227612 - RNA, 65 nt, hsa; identical to SEQ ID NO: 58915

SEQ ID NO: 227613 - RNA, 65 nt, hsa
ggacauauaacuacuuaucucuaguggugggauucugaauguauaauacauauguuguacuuuua

SEQ ID NO: 227614 - RNA, 65 nt, hsa
auaauuuauacuggagaaaaacuuugcaaguauaaugaauguagcagagccuuuaguuuuuguuc

SEQ ID NO: 227615 - RNA, 65 nt, hsa
agcagucacuuuggagagaagcccugugaauacagugaauguaaggaucccuucagucaccacuc

SEQ ID NO: 227616 - RNA, 65 nt, hsa
ugggugcccaggaguagaauaugaagugcuaaaucugaauguaagaaaaauaauaguauugaaug

SEQ ID NO: 227617 - RNA, 65 nt, hsa
ugcacacaccacagaaugugugagauuuuccuguuugaauguaugucugcauuauacuccugcaa

SEQ ID NO: 227618 - RNA, 65 nt, hsa
ggcuauuuuaaaugucaaggucagcaguguuacuuugaauguaaacugguauaauagguaguuuu

SEQ ID NO: 227619 - RNA, 65 nt, hsa
ucaguugacugguuuuguguccuguuugaacuugcugaauguaaggcaggcuacuaugcguuaua

SEQ ID NO: 227620 - RNA, 65 nt, hsa
guaugucauucuggauaaauccccaagccccuuuaugaauguagugaaauacauggcaugugggu

SEQ ID NO: 227621 - RNA, 65 nt, hsa
uuuuaaacaaaugaugcugagaauaaggagagaaaugaauguagagagagguagagagagaaaua

SEQ ID NO: 227622 - RNA, 65 nt, hsa; identical to SEQ ID NO: 58916

SEQ ID NO: 227623 - RNA, 65 nt, hsa; identical to SEQ ID NO: 58917

SEQ ID NO: 227624 - RNA, 65 nt, hsa
cuuuuccugucugacucugacaaguccucccucacugaauguagaaucguugccaaguuucugag

SEQ ID NO: 227625 - RNA, 65 nt, hsa
gguagaaauucucccuguaugccuagaaggaucagugaauguaagagccuuggaaauuaacaaaa

SEQ ID NO: 227626 - RNA, 65 nt, hsa
auuggaauggguggcgguaauuggugauacuucuuugaauguagauuuccaaucacaucuuuagu

SEQ ID NO: 227627 - RNA, 65 nt, hsa
ggacagcucccaguauacuguggacugugauaaacugaauguauguuuuuuaaugguuuauugcu

SEQ ID NO: 227628 - RNA, 65 nt, hsa
agcucuaugcuaaauaaugaagaguagcacaagaaugaauguauuugcugauacguugcucacau

SEQ ID NO: 227629 - RNA, 65 nt, hsa
agggcuggauagauuaucuaagucaagcuugagaaugaauguauguaauuuuccuguuuauugua

SEQ ID NO: 227630 - RNA, 65 nt, hsa
aaauuaaugacaacucaugcuuuaauuuuguauuuugaauguacacgcaugcugaagcuaaguaa

SEQ ID NO: 227631 - RNA, 65 nt, hsa
uugggcuuucagauuucucuuuuuaaccacauuucugaauguauaaaaauaccaauuauuuuccu

SEQ ID NO: 227632 - RNA, 65 nt, hsa; identical to SEQ ID NO: 58918

SEQ ID NO: 227633 - RNA, 65 nt, hsa; identical to SEQ ID NO: 58919

SEQ ID NO: 227634 - RNA, 65 nt, hsa
ccucguucaguugcacuucaguauuuucacggauaugaauguaaaauauauaaauauauaaaccu

SEQ ID NO: 227635 - RNA, 65 nt, hsa
cauugagcagcugaagcuaacucaugacucuguuuugaauguaaauauuuguaauuaagccugca

SEQ ID NO: 227636 - RNA, 65 nt, hsa
uuuuauuguuaguucucacuuguuuccauauuuagugaauguacauuuaauugcaaagcugucau

SEQ ID NO: 227637 - RNA, 65 nt, hsa
ucaacuugagcucuugaacuccuccugugggccugugaauguauucauucauuccacaacucugg

SEQ ID NO: 227638 - RNA, 65 nt, hsa
cuuuuaauuugauuuuagaaucuggacacuuucuaugaauguaauucggcugagaaacauguugc

SEQ ID NO: 227639 - RNA, 65 nt, hsa
uauugaacauccccugggcuuacaagaaacacugaugaauguaaaaucaggggacauuugaagau

SEQ ID NO: 227640 - RNA, 65 nt, hsa
agggcacuuggccaguuuucuguucagcuuuucagugaauguaccccuuuaagguucagacuuaa

SEQ ID NO: 227641 - RNA, 65 nt, hsa; identical to SEQ ID NO: 58920

SEQ ID NO: 227642 - RNA, 65 nt, hsa; identical to SEQ ID NO: 58921

SEQ ID NO: 227643 - RNA, 65 nt, hsa
ugggguauuggaaauguuuggggacuagguagaggugaauguacuaaaugccacugaauuuguau

SEQ ID NO: 227644 - RNA, 65 nt, hsa
uuuuccuccauguuauuuaugaauuuuauauuccgugaauguauauugucuuguaauguugcaua

SEQ ID NO: 227645 - RNA, 65 nt, hsa
auauaugcauuccauuugggagcauagcagcugugugaauguauguaauugugugugggggguuu

SEQ ID NO: 227646 - RNA, 65 nt, hsa
cuucuccuuugaaugcuguuuugugaaagaaacugugaauguaauggaaacguaggagcaucugg

SEQ ID NO: 227647 - RNA, 65 nt, hsa
ugugaagcuugcaacuuuaugucuugcuuuggacaugaauguauuacagcuugcagcuauucugu

SEQ ID NO: 227648 - RNA, 65 nt, hsa; identical to SEQ ID NO: 58922

SEQ ID NO: 227649 - RNA, 65 nt, hsa; identical to SEQ ID NO: 58923

SEQ ID NO: 227650 - RNA, 65 nt, hsa
aagcacauggccuugggugacaaauuccucuuugaugaauguacccuguggggauguuucauacu

SEQ ID NO: 227651 - RNA, 65 nt, hsa; identical to SEQ ID NO: 58924

SEQ ID NO: 227652 - RNA, 65 nt, hsa; identical to SEQ ID NO: 58925

SEQ ID NO: 227653 - RNA, 65 nt, hsa
aauuucaaaccauuuaccaucugaaaguuuugauuugaauguaaaacaggaaauuggaauuccuu

SEQ ID NO: 227654 - RNA, 65 nt, hsa
cuguuucucccuugggacugugucucauguuugugugaauguagaccaggaaagggggcugcaaa

SEQ ID NO: 227655 - RNA, 65 nt, hsa
aagguuucaaaaaucauguaaggauuuaaacuugcugaauguaaagauugaaccucaagucacug

SEQ ID NO: 227656 - RNA, 65 nt, hsa
uucauuuuuacuuuuucuuauuuuuaaaauuaggcugaauguacuucaugugauuugucaaccau

SEQ ID NO: 227657 - RNA, 65 nt, hsa
cccaguagcaauaaacauauaauauaggaggagucugaauguagagaugaaaaauacagaaugua

SEQ ID NO: 227658 - RNA, 65 nt, hsa
uaugucuugaacuuuuccucaaagcauuacacuugugaauguauuuuugucuaauagggucgaaa

SEQ ID NO: 227659 - RNA, 65 nt, hsa
aaauauauaugcauaccuggauuuccuuggcuucgugaauguaagagaaauuaaaucugaauaaa

SEQ ID NO: 227660 - RNA, 65 nt, hsa
ucuuaucaggcauuuucauuuggaaauuucauuauugaauguagcaagguuguaguuguuuuuuu

SEQ ID NO: 227661 - RNA, 65 nt, hsa
ucucagaagucaagcugauggaguaugugauaaagugaauguacauguauauacacacacaccuc

SEQ ID NO: 227662 - RNA, 65 nt, hsa
acaugcauaaaaauagaagacaaucugcuuguuucugaauguauggaaagacauuuugguuauac

SEQ ID NO: 227663 - RNA, 65 nt, hsa
ggaucuuaaacccaaaguacgagaaauguuucuguugaauguaaugcuacaugaaugcuugauuu

SEQ ID NO: 227664 - RNA, 65 nt, hsa
caguccuaaaaauggccagauuguggaacagcuguugaauguaauacuuccaaaauguacauauc

SEQ ID NO: 227665 - RNA, 65 nt, hsa
uauucucguaaaacugcgcuuugccaguagcacagugaauguaugccaaaugcaaguccauucca

SEQ ID NO: 227666 - RNA, 65 nt, hsa
aaaaugaacugcccuucagcaucuaaugggaguugugaauguaacugguuaaugauacacauucc

SEQ ID NO: 227667 - RNA, 65 nt, hsa
aacuguauuucccaauacacuugagcaguugccugugaauguaagaggugucaacaaacugggaa

SEQ ID NO: 227668 - RNA, 65 nt, hsa
guugccuuaguacuaucaagacuugugaauauauuugaauguauguuguuugaaaaacuugcaca

SEQ ID NO: 227669 - RNA, 65 nt, hsa
uucugucaaggaauuacaaguagcaagggaaggucugaauguaaggacaggccuagggaccuugc

SEQ ID NO: 227670 - RNA, 65 nt, hsa
aaagucugcuuaauuucaaaagaaaaaugccuaauugaauguaacucaucuugguguuauuauac

SEQ ID NO: 227671 - RNA, 65 nt, hsa
agcaacagacuguauuuuugugacgccccguaguaugaauguacaucuuguaaaacugagauaua

SEQ ID NO: 227672 - RNA, 65 nt, hsa
agcaguauucuucaguaaauaaagaauggaauugcugaauguaaucauugaaccucgagucacug

SEQ ID NO: 227673 - RNA, 64 nt, hsa; identical to SEQ ID NO: 55558

SEQ ID NO: 227674 - RNA, 64 nt, hsa; identical to SEQ ID NO: 55559

SEQ ID NO: 227675 - RNA, 64 nt, hsa; identical to SEQ ID NO: 55560

SEQ ID NO: 227676 - RNA, 64 nt, hsa; identical to SEQ ID NO: 55561

SEQ ID NO: 227677 - RNA, 64 nt, hsa; identical to SEQ ID NO: 55562

SEQ ID NO: 227678 - RNA, 64 nt, hsa; identical to SEQ ID NO: 55563

SEQ ID NO: 227679 - RNA, 64 nt, hsa; identical to SEQ ID NO: 55564

SEQ ID NO: 227680 - RNA, 64 nt, hsa; identical to SEQ ID NO: 55565

SEQ ID NO: 227681 - RNA, 64 nt, hsa; identical to SEQ ID NO: 55566

SEQ ID NO: 227682 - RNA, 64 nt, hsa; identical to SEQ ID NO: 55567

SEQ ID NO: 227683 - RNA, 64 nt, hsa; identical to SEQ ID NO: 55568

SEQ ID NO: 227684 - RNA, 64 nt, hsa; identical to SEQ ID NO: 55569

SEQ ID NO: 227685 - RNA, 64 nt, hsa; identical to SEQ ID NO: 55570

SEQ ID NO: 227686 - RNA, 64 nt, hsa; identical to SEQ ID NO: 55571

SEQ ID NO: 227687 - RNA, 64 nt, hsa; identical to SEQ ID NO: 55572

SEQ ID NO: 227688 - RNA, 64 nt, hsa; identical to SEQ ID NO: 55573

SEQ ID NO: 227689 - RNA, 64 nt, hsa; identical to SEQ ID NO: 55574

SEQ ID NO: 227690 - RNA, 64 nt, hsa; identical to SEQ ID NO: 55575

SEQ ID NO: 227691 - RNA, 64 nt, hsa; identical to SEQ ID NO: 55576

SEQ ID NO: 227692 - RNA, 64 nt, hsa; identical to SEQ ID NO: 55577

SEQ ID NO: 227693 - RNA, 64 nt, hsa; identical to SEQ ID NO: 55578

SEQ ID NO: 227694 - RNA, 64 nt, hsa; identical to SEQ ID NO: 55579

SEQ ID NO: 227695 - RNA, 64 nt, hsa; identical to SEQ ID NO: 55580

SEQ ID NO: 227696 - RNA, 64 nt, hsa; identical to SEQ ID NO: 55581

SEQ ID NO: 227697 - RNA, 64 nt, hsa; identical to SEQ ID NO: 55582

SEQ ID NO: 227698 - RNA, 64 nt, hsa; identical to SEQ ID NO: 55583

SEQ ID NO: 227699 - RNA, 64 nt, hsa; identical to SEQ ID NO: 55584

SEQ ID NO: 227700 - RNA, 64 nt, hsa; identical to SEQ ID NO: 55585

SEQ ID NO: 227701 - RNA, 64 nt, hsa; identical to SEQ ID NO: 55586

SEQ ID NO: 227702 - RNA, 64 nt, hsa; identical to SEQ ID NO: 55587

SEQ ID NO: 227703 - RNA, 64 nt, hsa; identical to SEQ ID NO: 55588

SEQ ID NO: 227704 - RNA, 64 nt, hsa; identical to SEQ ID NO: 55589

SEQ ID NO: 227705 - RNA, 64 nt, hsa; identical to SEQ ID NO: 55590

SEQ ID NO: 227706 - RNA, 64 nt, hsa; identical to SEQ ID NO: 55591

SEQ ID NO: 227707 - RNA, 64 nt, hsa; identical to SEQ ID NO: 55592

SEQ ID NO: 227708 - RNA, 64 nt, hsa; identical to SEQ ID NO: 55593

SEQ ID NO: 227709 - RNA, 64 nt, hsa; identical to SEQ ID NO: 55594

SEQ ID NO: 227710 - RNA, 64 nt, hsa; identical to SEQ ID NO: 55595

SEQ ID NO: 227711 - RNA, 64 nt, hsa; identical to SEQ ID NO: 55596

SEQ ID NO: 227712 - RNA, 64 nt, hsa; identical to SEQ ID NO: 55597

SEQ ID NO: 227713 - RNA, 64 nt, hsa; identical to SEQ ID NO: 55598

SEQ ID NO: 227714 - RNA, 64 nt, hsa; identical to SEQ ID NO: 55599

SEQ ID NO: 227715 - RNA, 64 nt, hsa; identical to SEQ ID NO: 55600

SEQ ID NO: 227716 - RNA, 64 nt, hsa; identical to SEQ ID NO: 55601

SEQ ID NO: 227717 - RNA, 64 nt, hsa; identical to SEQ ID NO: 55602

SEQ ID NO: 227718 - RNA, 64 nt, hsa; identical to SEQ ID NO: 55603

SEQ ID NO: 227719 - RNA, 64 nt, hsa; identical to SEQ ID NO: 55604

SEQ ID NO: 227720 - RNA, 64 nt, hsa; identical to SEQ ID NO: 55605

SEQ ID NO: 227721 - RNA, 64 nt, hsa; identical to SEQ ID NO: 55606

SEQ ID NO: 227722 - RNA, 64 nt, hsa; identical to SEQ ID NO: 55607

SEQ ID NO: 227723 - RNA, 64 nt, hsa; identical to SEQ ID NO: 55608

SEQ ID NO: 227724 - RNA, 64 nt, hsa; identical to SEQ ID NO: 55609

SEQ ID NO: 227725 - RNA, 64 nt, hsa; identical to SEQ ID NO: 55610

SEQ ID NO: 227726 - RNA, 64 nt, hsa; identical to SEQ ID NO: 55611

SEQ ID NO: 227727 - RNA, 64 nt, hsa; identical to SEQ ID NO: 55612

SEQ ID NO: 227728 - RNA, 64 nt, hsa; identical to SEQ ID NO: 55613

SEQ ID NO: 227729 - RNA, 64 nt, hsa; identical to SEQ ID NO: 55614

SEQ ID NO: 227730 - RNA, 64 nt, hsa; identical to SEQ ID NO: 55615

SEQ ID NO: 227731 - RNA, 64 nt, hsa; identical to SEQ ID NO: 55616

SEQ ID NO: 227732 - RNA, 64 nt, hsa; identical to SEQ ID NO: 55617

SEQ ID NO: 227733 - RNA, 64 nt, hsa; identical to SEQ ID NO: 55618

SEQ ID NO: 227734 - RNA, 64 nt, hsa; identical to SEQ ID NO: 55619

SEQ ID NO: 227735 - RNA, 64 nt, hsa; identical to SEQ ID NO: 55620

SEQ ID NO: 227736 - RNA, 64 nt, hsa; identical to SEQ ID NO: 55621

SEQ ID NO: 227737 - RNA, 64 nt, hsa; identical to SEQ ID NO: 55622

SEQ ID NO: 227738 - RNA, 64 nt, hsa; identical to SEQ ID NO: 55623

SEQ ID NO: 227739 - RNA, 64 nt, hsa; identical to SEQ ID NO: 55624

SEQ ID NO: 227740 - RNA, 64 nt, hsa; identical to SEQ ID NO: 55625

SEQ ID NO: 227741 - RNA, 64 nt, hsa; identical to SEQ ID NO: 55626

SEQ ID NO: 227742 - RNA, 64 nt, hsa; identical to SEQ ID NO: 55627

SEQ ID NO: 227743 - RNA, 64 nt, hsa; identical to SEQ ID NO: 55628

SEQ ID NO: 227744 - RNA, 64 nt, hsa; identical to SEQ ID NO: 55629

SEQ ID NO: 227745 - RNA, 64 nt, hsa; identical to SEQ ID NO: 55630

SEQ ID NO: 227746 - RNA, 64 nt, hsa; identical to SEQ ID NO: 55631

SEQ ID NO: 227747 - RNA, 64 nt, hsa; identical to SEQ ID NO: 55632

SEQ ID NO: 227748 - RNA, 64 nt, hsa; identical to SEQ ID NO: 55633

SEQ ID NO: 227749 - RNA, 64 nt, hsa; identical to SEQ ID NO: 55634

SEQ ID NO: 227750 - RNA, 64 nt, hsa; identical to SEQ ID NO: 55635

SEQ ID NO: 227751 - RNA, 64 nt, hsa; identical to SEQ ID NO: 55636

SEQ ID NO: 227752 - RNA, 64 nt, hsa; identical to SEQ ID NO: 55637

SEQ ID NO: 227753 - RNA, 64 nt, hsa; identical to SEQ ID NO: 55638

SEQ ID NO: 227754 - RNA, 64 nt, hsa; identical to SEQ ID NO: 55639

SEQ ID NO: 227755 - RNA, 64 nt, hsa; identical to SEQ ID NO: 55640

SEQ ID NO: 227756 - RNA, 64 nt, hsa; identical to SEQ ID NO: 55641

SEQ ID NO: 227757 - RNA, 64 nt, hsa
caaacuaaaacuucugggcagcaaaaauauauaaaugcuucagaugucaaauacccaugcuuga

SEQ ID NO: 227758 - RNA, 64 nt, hsa
uaacaggugucauuugacuaaacguuucgguagaaugcuucauacuugagugaugcuggauaag

SEQ ID NO: 227759 - RNA, 64 nt, hsa
acuuuuuuuagaaugggccagaugguaaauauuuaugcuucacgguccauacagucucugucac

SEQ ID NO: 227760 - RNA, 64 nt, hsa
aucuagcuacugaugucuuacuuugaguuuauuuaugcuucagaauacaguuguuugcccugug

SEQ ID NO: 227761 - RNA, 64 nt, hsa
ucaucuucuucuuuaaucacuuaacauuccuaaaaugcuucacuguacguaguuaagucguagc

SEQ ID NO: 227762 - RNA, 64 nt, hsa
aaacaaaaacaucccaagauuuuuucauuucaaaaugcuucaaaguccacauuagaucagauac

SEQ ID NO: 227763 - RNA, 64 nt, hsa
aagaaaugaaauguccuaucaauuuuauuuugucaugcuucaaacaauaaagacauuucugcuu

SEQ ID NO: 227764 - RNA, 64 nt, hsa
ugauauuuaaaaauauacacacauguauguacacaugcuucagaaauauuguugcuuaggguga

SEQ ID NO: 227765 - RNA, 64 nt, hsa
guaggggacaauaguagcauucgcaguggugauaaugcuucaagguggauguguuuggaaguuu

SEQ ID NO: 227766 - RNA, 64 nt, hsa
acaaaugagcuuucaagaccauuuaaggaaacagaugcuucauuugcucuuaucucauauuuca

SEQ ID NO: 227767 - RNA, 64 nt, hsa; identical to SEQ ID NO: 141798

SEQ ID NO: 227768 - RNA, 64 nt, hsa; identical to SEQ ID NO: 141799

SEQ ID NO: 227769 - RNA, 64 nt, hsa; identical to SEQ ID NO: 141800

SEQ ID NO: 227770 - RNA, 64 nt, hsa; identical to SEQ ID NO: 141801

SEQ ID NO: 227771 - RNA, 64 nt, hsa; identical to SEQ ID NO: 141802

SEQ ID NO: 227772 - RNA, 64 nt, hsa; identical to SEQ ID NO: 141803

SEQ ID NO: 227773 - RNA, 64 nt, hsa; identical to SEQ ID NO: 141804

SEQ ID NO: 227774 - RNA, 64 nt, hsa; identical to SEQ ID NO: 141805

SEQ ID NO: 227775 - RNA, 64 nt, hsa
auuuaacagaacuucucuaaccuuccaacugcuucccacaaacacauuggccucaaggcuccuu

SEQ ID NO: 227776 - RNA, 64 nt, hsa
uuuccuccaagccacaugaggacucuggcacccacccacaaagcaagaccuguauuuauaagcc

SEQ ID NO: 227777 - RNA, 64 nt, hsa
gucauuuccacaugaaggagaggcaaggaaaagccccacaaaauuccuguuacccgcugaacuc

SEQ ID NO: 227778 - RNA, 64 nt, hsa
auacucccugcacccuucugacugacaguucauccccacaaaacacauugguuuugagagguga

SEQ ID NO: 227779 - RNA, 64 nt, hsa
auuacacauaagauaauucauagcggagagaaaccccacaaaugugaagaauguggcagagcuu

SEQ ID NO: 227780 - RNA, 64 nt, hsa
aguacacauaagaaaauucauacuggggagaaaccccacaaauguggagaaugcggaaaagccu

SEQ ID NO: 227781 - RNA, 64 nt, hsa
ucugcacauaauauaauucauacuggagagaaaccccacaaauaugaagaaugugguaaugcuu

SEQ ID NO: 227782 - RNA, 64 nt, hsa
cuaaagaaagaaauucaaaaguagcuauuuggggcccacaaaaauaacuauuauuuuagccuua

SEQ ID NO: 227783 - RNA, 64 nt, hsa
aggaaaugagaauaugauccccucuuccgaguugcccacaaacuugcuucuuugcuuuugcucc

SEQ ID NO: 227784 - RNA, 64 nt, hsa
uucagcuguagcacuuggcagaaacgugaugugucccacaaacugcugguggaggaagaagaug

SEQ ID NO: 227785 - RNA, 64 nt, hsa
cagaugggacugucaaaguugugcugcccucccucccacaaacaaaugaauccagcguggagga

SEQ ID NO: 227786 - RNA, 64 nt, hsa; identical to SEQ ID NO: 155489

SEQ ID NO: 227787 - RNA, 64 nt, hsa; identical to SEQ ID NO: 155490

SEQ ID NO: 227788 - RNA, 64 nt, hsa; identical to SEQ ID NO: 155491

SEQ ID NO: 227789 - RNA, 64 nt, hsa; identical to SEQ ID NO: 155492

SEQ ID NO: 227790 - RNA, 64 nt, hsa; identical to SEQ ID NO: 155493

SEQ ID NO: 227791 - RNA, 64 nt, hsa; identical to SEQ ID NO: 155494

SEQ ID NO: 227792 - RNA, 64 nt, hsa; identical to SEQ ID NO: 155495

SEQ ID NO: 227793 - RNA, 64 nt, hsa; identical to SEQ ID NO: 155496

SEQ ID NO: 227794 - RNA, 64 nt, hsa; identical to SEQ ID NO: 155497

SEQ ID NO: 227795 - RNA, 64 nt, hsa; identical to SEQ ID NO: 155498

SEQ ID NO: 227796 - RNA, 64 nt, hsa; identical to SEQ ID NO: 155499

SEQ ID NO: 227797 - RNA, 64 nt, hsa; identical to SEQ ID NO: 155500

SEQ ID NO: 227798 - RNA, 64 nt, hsa; identical to SEQ ID NO: 155501

SEQ ID NO: 227799 - RNA, 64 nt, hsa; identical to SEQ ID NO: 155502

SEQ ID NO: 227800 - RNA, 64 nt, hsa; identical to SEQ ID NO: 155503

SEQ ID NO: 227801 - RNA, 64 nt, hsa; identical to SEQ ID NO: 155504

SEQ ID NO: 227802 - RNA, 64 nt, hsa; identical to SEQ ID NO: 155505

SEQ ID NO: 227803 - RNA, 64 nt, hsa; identical to SEQ ID NO: 155506

SEQ ID NO: 227804 - RNA, 64 nt, hsa; identical to SEQ ID NO: 155507

SEQ ID NO: 227805 - RNA, 64 nt, hsa; identical to SEQ ID NO: 155508

SEQ ID NO: 227806 - RNA, 64 nt, hsa; identical to SEQ ID NO: 155509

SEQ ID NO: 227807 - RNA, 64 nt, hsa; identical to SEQ ID NO: 155510

SEQ ID NO: 227808 - RNA, 64 nt, hsa; identical to SEQ ID NO: 155511

SEQ ID NO: 227809 - RNA, 64 nt, hsa; identical to SEQ ID NO: 155512

SEQ ID NO: 227810 - RNA, 64 nt, hsa; identical to SEQ ID NO: 155513

SEQ ID NO: 227811 - RNA, 61 nt, hsa; identical to SEQ ID NO: 155514

SEQ ID NO: 227812 - RNA, 64 nt, hsa; identical to SEQ ID NO: 155515

SEQ ID NO: 227813 - RNA, 64 nt, hsa; identical to SEQ ID NO: 155516

SEQ ID NO: 227814 - RNA, 64 nt, hsa; identical to SEQ ID NO: 155517

SEQ ID NO: 227815 - RNA, 64 nt, hsa; identical to SEQ ID NO: 155518

SEQ ID NO: 227816 - RNA, 64 nt, hsa; identical to SEQ ID NO: 155519

SEQ ID NO: 227817 - RNA, 64 nt, hsa; identical to SEQ ID NO: 155520

SEQ ID NO: 227818 - RNA, 64 nt, hsa; identical to SEQ ID NO: 155521

SEQ ID NO: 227819 - RNA, 64 nt, hsa
gauuggaguggaccacggccaagcuugcuccguccucggacaggaagccacccugcguggggga

SEQ ID NO: 227820 - RNA, 64 nt, hsa
ucaccacugaggccacgacaaagcacagcuccagcucggacagcacccucagugccagccagcc

SEQ ID NO: 227821 - RNA, 64 nt, hsa
caugagaugguagaaggaacaucaucacauaccccucucacagagaaaauuaucaaagaaccag

SEQ ID NO: 227822 - RNA, 64 nt, hsa
auagaaaaaaagucuuuucacaugacaaaugacacucucacaccagucuuagcccuaguaguuu

SEQ ID NO: 227823 - RNA, 64 nt, hsa
ccccucuccucuuccaaacaaaacauacauugaucucucacauccagcugccaaaagaaaaccc

SEQ ID NO: 227824 - RNA, 64 nt, hsa
aaaaccccaucaaacacaguuacaccccacauaucucucacacacacacacacacgcacacaca

SEQ ID NO: 227825 - RNA, 64 nt, hsa
ucugcaguagccuuuugugagucugcuaagguagcucucacacaccucggcucugggguugaua

SEQ ID NO: 227826 - RNA, 64 nt, hsa
ggccccgcuggucccauuugcucauuagaauuuccucucacaucagugggauacagaauucagu

SEQ ID NO: 227827 - RNA, 64 nt, hsa
uucugaacccauucuauuuugaaucuccccuuuccucucacaauacuugaacauuuuaaucuuu

SEQ ID NO: 227828 - RNA, 64 nt, hsa
aggccaucacacuggccuguuccggagaauauuucucucacaauauuauuaucuacuuauaauu

SEQ ID NO: 227829 - RNA, 64 nt, hsa
aagcccacauuuccaaagucacccccaacgcguccucucacaccguccacugugcguuuguaug

SEQ ID NO: 227830 - RNA, 64 nt, hsa
gaccaggugcuugugaccuacaagucagaguccucucucacagucggccacuggauuucccuca

SEQ ID NO: 227831 - RNA, 64 nt, hsa
gcaggccgcgugacguggggcugccuggccgcggcucucacauggugguuccugcugcacugau

SEQ ID NO: 227832 - RNA, 64 nt, hsa
cucaagcgugugugcugggccggggagucccugucucucacagcaucuagcaguauuauuaaau

SEQ ID NO: 227833 - RNA, 64 nt, hsa
ccagcgagacaccugagacaugcugaaauuauuucucucacacuuuugcuugaauuuaauacag

SEQ ID NO: 227834 - RNA, 64 nt, hsa
uauggcaauuuagcucucuuggguucccaaaucccucucacaagaaugugcagaagaaaucaua

SEQ ID NO: 227835 - RNA, 64 nt, hsa
uacugggacaaguuuacugcucuuguaggagcuccucucacaaguaguuguaaugcuguagcau

SEQ ID NO: 227836 - RNA, 64 nt, hsa
ugccauuuuuguaaauacaguaguuuugcacaaccucucacaaaugucuguauuaauuucacau

SEQ ID NO: 227837 - RNA, 64 nt, hsa
uuuuucuggcagacauuucaguacauucacauuucucucacauuugcugaaugugagaucagaa

SEQ ID NO: 227838 - RNA, 64 nt, hsa
ggagucaacaugcccaagucauuugcaccuuuaccucucacauggaugcucccaaggguuaggg

SEQ ID NO: 227839 - RNA, 64 nt, hsa
gagcgagaggcgcugccccagccaggcccaccaccucucacagucagugcacgcaagcagggac

SEQ ID NO: 227840 - RNA, 64 nt, hsa
gcaccuccaggucucuggacuccaguuuuggccccucucacacagagcugucagcaggggccgc

SEQ ID NO: 227841 - RNA, 64 nt, hsa
aacgagcccuccuauuuucacaguguucugauugcucucacagcccaggcccaucgucuguucu

SEQ ID NO: 227842 - RNA, 64 nt, hsa
gucgauagugugcacucuuucucucucucucucucucucacacacacacacacacacacacaca

SEQ ID NO: 227843 - RNA, 64 nt, hsa
uuuaugggauaguauggacuauggaaaaacaaauuugcacaauggccugggaaguugaggucac

SEQ ID NO: 227844 - RNA, 64 nt, hsa
uuccguuuucccccuaaagaacauaucauaaucauugcacaaauaaccauguucuuugguaaug

SEQ ID NO: 227845 - RNA, 64 nt, hsa
uucccuaucaaaacauaucaauucaacacauuacuugcacaagcuuguauauacauauuauaaa

SEQ ID NO: 227846 - RNA, 64 nt, hsa
aaaaaaaaaaaaaaaaaaaaaaaaaaaaaaaaaauugcacaauuugagcaauucauuucacuuu

SEQ ID NO: 227847 - RNA, 64 nt, hsa
gcuaugcauauuuuuaaugaaagaugacauguauuugcacaaaaauucucaggcacauuaaauu

SEQ ID NO: 227848 - RNA, 64 nt, hsa
auguggucuggucugacuugagagaaaaggaauguugcacaaggguugugaaugugaaaggggg

SEQ ID NO: 227849 - RNA, 64 nt, hsa
uagggcacuggacuuucuggcaugggggcuguguuugcacaaguuauuuucauguuaccuggag

SEQ ID NO: 227850 - RNA, 64 nt, hsa
uaaggagggucuggccagaggaacagaccagcuuuugcacaaugaagcgcaagggaacaagugg

SEQ ID NO: 227851 - RNA, 64 nt, hsa
aaagcaaacuggcaugguucguauuuuaaaaaucuugcacaaauuguaaugugauacugugaaa

SEQ ID NO: 227852 - RNA, 64 nt, hsa
aaauguguagauauuuuuaaacauuuugccauaauugcacaauuuuuugcauuuuuaccugaug

SEQ ID NO: 227853 - RNA, 64 nt, hsa
aagacaggacccugggaccacagagggcaggaacuugcacaaaaucacacagccaagccaguca

SEQ ID NO: 227854 - RNA, 64 nt, hsa
uaugugggugggaccacagacucacauccugaccuugcacaaacagccccucuggacacagccc

SEQ ID NO: 227855 - RNA, 64 nt, hsa
cauagaaacuuuguggggcauguuaaguuacaguuugcacaaguucaucucauuuguauuccau

SEQ ID NO: 227856 - RNA, 64 nt, hsa
uaacuuuuauagguuaucaaaacuguugucaccauugcacaauuuuguccuaauauauacauag

SEQ ID NO: 227857 - RNA, 64 nt, hsa
ugacuccugagcaggaccugggcccgguucagcuccccacaaggacuucucugucuggagacag

SEQ ID NO: 227858 - RNA, 64 nt, hsa
gccacagcugcagacugagagggugggucugaguccccacaaugucugaagcugccccugggau

SEQ ID NO: 227859 - RNA, 57 nt, hsa
aagaagacacauacaaguaagaccuguccccacaacaaggacccuguguggagccag

SEQ ID NO: 227860 - RNA, 64 nt, hsa
gucagccccuuguauguaagagaggacacugaggccccacaaggccucaucuccuuaaggcuag

SEQ ID NO: 227861 - RNA, 64 nt, hsa
cauguugguuucaucuucgcugucucucucauuuccccacaaaguguugucucacuuucugccu

SEQ ID NO: 227862 - RNA, 64 nt, hsa
auauaguagagugaggugagggucguggcuaaaaccccacaauaacuuuacauuccuagcuuua

SEQ ID NO: 227863 - RNA, 64 nt, hsa
ugucauuuccacaugaaggagaggcaaggaaaagccccacaaaauuccuguuacccgcugaacu

SEQ ID NO: 227864 - RNA, 64 nt, hsa
uauacucccugcacccuucugacugacaguucauccccacaaaacacauugguuuugagaggug

SEQ ID NO: 227865 - RNA, 64 nt, hsa
uauuacacauaagauaauucauagcggagagaaaccccacaaaugugaagaauguggcagagcu

SEQ ID NO: 227866 - RNA, 64 nt, hsa
uaguacacauaagaaaauucauacuggggagaaaccccacaaauguggagaaugcggaaaagcc

SEQ ID NO: 227867 - RNA, 64 nt, hsa
uucugcacauaauauaauucauacuggagagaaaccccacaaauaugaagaaugugguaaugcu

SEQ ID NO: 227868 - RNA, 64 nt, hsa
agauaaguggcucuuacccagcucucagugacucccccacaaaacagcaacagccuccaccgcc

SEQ ID NO: 227869 - RNA, 64 nt, hsa
agaccuccgguccgagacccugccuggguucaccccccacaacccagacccagaaccgcucucc

SEQ ID NO: 227870 - RNA, 64 nt, hsa
uggaucuggcuguugaguugacggguuccuugaaccccacaaaaucccucuccaaccacaggac

SEQ ID NO: 227871 - RNA, 64 nt, hsa
aggccuauucgcugcacuuccugccaaacuuugcccccacaagccuggucaucagccaggcagc

SEQ ID NO: 227872 - RNA, 64 nt, hsa
auaauuuuugccuucgaauuuuuuuaagucaaguugagguuauuuuuguaagaaacccaaccua

SEQ ID NO: 227873 - RNA, 64 nt, hsa
aaaaacaagcuauauucccacuuuauaaagaauuugagguuaagauaaaaggacucauuuaagc

SEQ ID NO: 227874 - RNA, 64 nt, hsa
caaagaaucuacuccuuaaaccuggagaagaacaugagguuauuguuucauuuacuccaaagga

SEQ ID NO: 227875 - RNA, 64 nt, hsa
aaaacuggacguuuccagauugugaauaacucugugagguuacugagauuugagcugugcuggc

SEQ ID NO: 227876 - RNA, 64 nt, hsa
caccacuuugggaggccaagaugggaggagugcuugagguuaggcguuccagaccagccugggc

SEQ ID NO: 227877 - RNA, 64 nt, hsa
ugaugauuacgauguugauuauaacauuugauuaugagguuaagcacaugagucuuuaccugug

SEQ ID NO: 227878 - RNA, 64 nt, hsa; identical to SEQ ID NO: 160772

SEQ ID NO: 227879 - RNA, 64 nt, hsa; identical to SEQ ID NO: 160773

SEQ ID NO: 227880 - RNA, 64 nt, hsa; identical to SEQ ID NO: 160774

SEQ ID NO: 227881 - RNA, 64 nt, hsa; identical to SEQ ID NO: 160775

SEQ ID NO: 227882 - RNA, 64 nt, hsa; identical to SEQ ID NO: 160776

SEQ ID NO: 227883 - RNA, 64 nt, hsa; identical to SEQ ID NO: 160777

SEQ ID NO: 227884 - RNA, 64 nt, hsa; identical to SEQ ID NO: 160778

SEQ ID NO: 227885 - RNA, 64 nt, hsa; identical to SEQ ID NO: 160779

SEQ ID NO: 227886 - RNA, 64 nt, hsa; identical to SEQ ID NO: 160780

SEQ ID NO: 227887 - RNA, 64 nt, hsa; identical to SEQ ID NO: 160781

SEQ ID NO: 227888 - RNA, 64 nt, hsa; identical to SEQ ID NO: 160782

SEQ ID NO: 227889 - RNA, 64 nt, hsa; identical to SEQ ID NO: 160783

SEQ ID NO: 227890 - RNA, 64 nt, hsa; identical to SEQ ID NO: 160784

SEQ ID NO: 227891 - RNA, 64 nt, hsa; identical to SEQ ID NO: 160785

SEQ ID NO: 227892 - RNA, 64 nt, hsa; identical to SEQ ID NO: 160786

SEQ ID NO: 227893 - RNA, 64 nt, hsa; identical to SEQ ID NO: 160787

SEQ ID NO: 227894 - RNA, 64 nt, hsa; identical to SEQ ID NO: 160788

SEQ ID NO: 227895 - RNA, 64 nt, hsa; identical to SEQ ID NO: 160789

SEQ ID NO: 227896 - RNA, 64 nt, hsa; identical to SEQ ID NO: 160790

SEQ ID NO: 227897 - RNA, 64 nt, hsa; identical to SEQ ID NO: 160791

SEQ ID NO: 227898 - RNA, 64 nt, hsa; identical to SEQ ID NO: 160792

SEQ ID NO: 227899 - RNA, 64 nt, hsa; identical to SEQ ID NO: 160793

SEQ ID NO: 227900 - RNA, 64 nt, hsa; identical to SEQ ID NO: 160794

SEQ ID NO: 227901 - RNA, 64 nt, hsa; identical to SEQ ID NO: 160795

SEQ ID NO: 227902 - RNA, 64 nt, hsa; identical to SEQ ID NO: 160796

SEQ ID NO: 227903 - RNA, 64 nt, hsa; identical to SEQ ID NO: 160797

SEQ ID NO: 227904 - RNA, 64 nt, hsa; identical to SEQ ID NO: 160798

SEQ ID NO: 227905 - RNA, 64 nt, hsa; identical to SEQ ID NO: 160799

SEQ ID NO: 227906 - RNA, 64 nt, hsa; identical to SEQ ID NO: 160800

SEQ ID NO: 227907 - RNA, 64 nt, hsa; identical to SEQ ID NO: 160801

SEQ ID NO: 227908 - RNA, 64 nt, hsa; identical to SEQ ID NO: 160802

SEQ ID NO: 227909 - RNA, 64 nt, hsa; identical to SEQ ID NO: 160803

SEQ ID NO: 227910 - RNA, 64 nt, hsa; identical to SEQ ID NO: 160804

SEQ ID NO: 227911 - RNA, 64 nt, hsa; identical to SEQ ID NO: 160805

SEQ ID NO: 227912 - RNA, 64 nt, hsa; identical to SEQ ID NO: 160806

SEQ ID NO: 227913 - RNA, 64 nt, hsa; identical to SEQ ID NO: 160807

SEQ ID NO: 227914 - RNA, 64 nt, hsa; identical to SEQ ID NO: 160808

SEQ ID NO: 227915 - RNA, 64 nt, hsa; identical to SEQ ID NO: 160809

SEQ ID NO: 227916 - RNA, 64 nt, hsa; identical to SEQ ID NO: 160810

SEQ ID NO: 227917 - RNA, 64 nt, hsa; identical to SEQ ID NO: 160811

SEQ ID NO: 227918 - RNA, 64 nt, hsa; identical to SEQ ID NO: 160812

SEQ ID NO: 227919 - RNA, 64 nt, hsa; identical to SEQ ID NO: 160813

SEQ ID NO: 227920 - RNA, 64 nt, hsa; identical to SEQ ID NO: 160814

SEQ ID NO: 227921 - RNA, 64 nt, hsa; identical to SEQ ID NO: 160815

SEQ ID NO: 227922 - RNA, 64 nt, hsa; identical to SEQ ID NO: 160816

SEQ ID NO: 227923 - RNA, 64 nt, hsa; identical to SEQ ID NO: 160817

SEQ ID NO: 227924 - RNA, 64 nt, hsa; identical to SEQ ID NO: 160818

SEQ ID NO: 227925 - RNA, 64 nt, hsa; identical to SEQ ID NO: 160819

SEQ ID NO: 227926 - RNA, 64 nt, hsa; identical to SEQ ID NO: 160820

SEQ ID NO: 227927 - RNA, 64 nt, hsa; identical to SEQ ID NO: 160821

SEQ ID NO: 227928 - RNA, 64 nt, hsa; identical to SEQ ID NO: 160822

SEQ ID NO: 227929 - RNA, 64 nt, hsa; identical to SEQ ID NO: 160823

SEQ ID NO: 227930 - RNA, 64 nt, hsa; identical to SEQ ID NO: 160824

SEQ ID NO: 227931 - RNA, 64 nt, hsa; identical to SEQ ID NO: 160825

SEQ ID NO: 227932 - RNA, 64 nt, hsa; identical to SEQ ID NO: 160826

SEQ ID NO: 227933 - RNA, 64 nt, hsa; identical to SEQ ID NO: 160827

SEQ ID NO: 227934 - RNA, 64 nt, hsa; identical to SEQ ID NO: 160828

SEQ ID NO: 227935 - RNA, 64 nt, hsa; identical to SEQ ID NO: 160829

SEQ ID NO: 227936 - RNA, 64 nt, hsa; identical to SEQ ID NO: 160830

SEQ ID NO: 227937 - RNA, 64 nt, hsa; identical to SEQ ID NO: 160831

SEQ ID NO: 227938 - RNA, 64 nt, hsa; identical to SEQ ID NO: 160832

SEQ ID NO: 227939 - RNA, 64 nt, hsa; identical to SEQ ID NO: 160833

SEQ ID NO: 227940 - RNA, 64 nt, hsa; identical to SEQ ID NO: 160834

SEQ ID NO: 227941 - RNA, 64 nt, hsa; identical to SEQ ID NO: 160835

SEQ ID NO: 227942 - RNA, 64 nt, hsa; identical to SEQ ID NO: 160836

SEQ ID NO: 227943 - RNA, 64 nt, hsa; identical to SEQ ID NO: 160837

SEQ ID NO: 227944 - RNA, 64 nt, hsa; identical to SEQ ID NO: 160838

SEQ ID NO: 227945 - RNA, 64 nt, hsa; identical to SEQ ID NO: 160839

SEQ ID NO: 227946 - RNA, 64 nt, hsa; identical to SEQ ID NO: 160840

SEQ ID NO: 227947 - RNA, 64 nt, hsa; identical to SEQ ID NO: 160841

SEQ ID NO: 227948 - RNA, 64 nt, hsa; identical to SEQ ID NO: 160842

SEQ ID NO: 227949 - RNA, 64 nt, hsa; identical to SEQ ID NO: 160843

SEQ ID NO: 227950 - RNA, 64 nt, hsa; identical to SEQ ID NO: 160844

SEQ ID NO: 227951 - RNA, 64 nt, hsa; identical to SEQ ID NO: 160845

SEQ ID NO: 227952 - RNA, 64 nt, hsa; identical to SEQ ID NO: 160846

SEQ ID NO: 227953 - RNA, 64 nt, hsa; identical to SEQ ID NO: 160847

SEQ ID NO: 227954 - RNA, 64 nt, hsa; identical to SEQ ID NO: 160848

SEQ ID NO: 227955 - RNA, 64 nt, hsa; identical to SEQ ID NO: 160849

SEQ ID NO: 227956 - RNA, 64 nt, hsa; identical to SEQ ID NO: 160850

SEQ ID NO: 227957 - RNA, 64 nt, hsa; identical to SEQ ID NO: 160851

SEQ ID NO: 227958 - RNA, 64 nt, hsa; identical to SEQ ID NO: 160852

SEQ ID NO: 227959 - RNA, 64 nt, hsa; identical to SEQ ID NO: 160853

SEQ ID NO: 227960 - RNA, 64 nt, hsa; identical to SEQ ID NO: 160854

SEQ ID NO: 227961 - RNA, 64 nt, hsa; identical to SEQ ID NO: 160850

SEQ ID NO: 227962 - RNA, 64 nt, hsa; identical to SEQ ID NO: 160856

SEQ ID NO: 227963 - RNA, 64 nt, hsa; identical to SEQ ID NO: 160857

SEQ ID NO: 227964 - RNA, 64 nt, hsa; identical to SEQ ID NO: 160858

SEQ ID NO: 227965 - RNA, 64 nt, hsa; identical to SEQ ID NO: 160859

SEQ ID NO: 227966 - RNA, 64 nt, hsa; identical to SEQ ID NO: 160860

SEQ ID NO: 227967 - RNA, 64 nt, hsa; identical to SEQ ID NO: 160861

SEQ ID NO: 227968 - RNA, 64 nt, hsa; identical to SEQ ID NO: 160862

SEQ ID NO: 227969 - RNA, 64 nt, hsa; identical to SEQ ID NO: 160863

SEQ ID NO: 227970 - RNA, 64 nt, hsa; identical to SEQ ID NO: 160864

SEQ ID NO: 227971 - RNA, 64 nt, hsa; identical to SEQ ID NO: 160865

SEQ ID NO: 227972 - RNA, 64 nt, hsa; identical to SEQ ID NO: 160866

SEQ ID NO: 227973 - RNA, 64 nt, hsa; identical to SEQ ID NO: 160867

SEQ ID NO: 227974 - RNA, 64 nt, hsa; identical to SEQ ID NO: 160868

SEQ ID NO: 227975 - RNA, 64 nt, hsa; identical to SEQ ID NO: 160869

SEQ ID NO: 227976 - RNA, 64 nt, hsa; identical to SEQ ID NO: 160870

SEQ ID NO: 227977 - RNA, 64 nt, hsa; identical to SEQ ID NO: 160871

SEQ ID NO: 227978 - RNA, 64 nt, hsa; identical to SEQ ID NO: 160872

SEQ ID NO: 227979 - RNA, 64 nt, hsa; identical to SEQ ID NO: 160873

SEQ ID NO: 227980 - RNA, 64 nt, hsa; identical to SEQ ID NO: 160874

SEQ ID NO: 227981 - RNA, 64 nt, hsa; identical to SEQ ID NO: 160870

SEQ ID NO: 227982 - RNA, 64 nt, hsa; identical to SEQ ID NO: 160876

SEQ ID NO: 227983 - RNA, 64 nt, hsa; identical to SEQ ID NO: 160877

SEQ ID NO: 227984 - RNA, 64 nt, hsa; identical to SEQ ID NO: 160878

SEQ ID NO: 227985 - RNA, 64 nt, hsa; identical to SEQ ID NO: 160879

SEQ ID NO: 227986 - RNA, 64 nt, hsa; identical to SEQ ID NO: 160880

SEQ ID NO: 227987 - RNA, 64 nt, hsa; identical to SEQ ID NO: 160881

SEQ ID NO: 227988 - RNA, 64 nt, hsa; identical to SEQ ID NO: 160882

SEQ ID NO: 227989 - RNA, 64 nt, hsa; identical to SEQ ID NO: 160883

SEQ ID NO: 227990 - RNA, 64 nt, hsa; identical to SEQ ID NO: 160884

SEQ ID NO: 227991 - RNA, 64 nt, hsa; identical to SEQ ID NO: 160885

SEQ ID NO: 227992 - RNA, 64 nt, hsa; identical to SEQ ID NO: 160886

SEQ ID NO: 227993 - RNA, 64 nt, hsa; identical to SEQ ID NO: 160887

SEQ ID NO: 227994 - RNA, 64 nt, hsa; identical to SEQ ID NO: 160888

SEQ ID NO: 227995 - RNA, 64 nt, hsa; identical to SEQ ID NO: 160889

SEQ ID NO: 227996 - RNA, 64 nt, hsa; identical to SEQ ID NO: 160890

SEQ ID NO: 227997 - RNA, 64 nt, hsa; identical to SEQ ID NO: 160891

SEQ ID NO: 227998 - RNA, 64 nt, hsa; identical to SEQ ID NO: 160892

SEQ ID NO: 227999 - RNA, 64 nt, hsa; identical to SEQ ID NO: 160893

SEQ ID NO: 228000 - RNA, 64 nt, hsa; identical to SEQ ID NO: 160894

SEQ ID NO: 228001 - RNA, 64 nt, hsa; identical to SEQ ID NO: 160895

SEQ ID NO: 228002 - RNA, 64 nt, hsa; identical to SEQ ID NO: 160896

SEQ ID NO: 228003 - RNA, 64 nt, hsa; identical to SEQ ID NO: 160897

SEQ ID NO: 228004 - RNA, 64 nt, hsa; identical to SEQ ID NO: 160898

SEQ ID NO: 228005 - RNA, 64 nt, hsa; identical to SEQ ID NO: 160899

SEQ ID NO: 228006 - RNA, 64 nt, hsa; identical to SEQ ID NO: 160900

SEQ ID NO: 228007 - RNA, 64 nt, hsa; identical to SEQ ID NO: 160901

SEQ ID NO: 228008 - RNA, 64 nt, hsa; identical to SEQ ID NO: 160902

SEQ ID NO: 228009 - RNA, 64 nt, hsa; identical to SEQ ID NO: 160903

SEQ ID NO: 228010 - RNA, 64 nt, hsa; identical to SEQ ID NO: 160904

SEQ ID NO: 228011 - RNA, 64 nt, hsa; identical to SEQ ID NO: 160905

SEQ ID NO: 228012 - RNA, 64 nt, hsa; identical to SEQ ID NO: 160906

SEQ ID NO: 228013 - RNA, 64 nt, hsa; identical to SEQ ID NO: 160907

SEQ ID NO: 228014 - RNA, 64 nt, hsa; identical to SEQ ID NO: 160908

SEQ ID NO: 228015 - RNA, 64 nt, hsa; identical to SEQ ID NO: 160909

SEQ ID NO: 228016 - RNA, 64 nt, hsa; identical to SEQ ID NO: 160910

SEQ ID NO: 228017 - RNA, 64 nt, hsa; identical to SEQ ID NO: 160911

SEQ ID NO: 228018 - RNA, 64 nt, hsa; identical to SEQ ID NO: 160912

SEQ ID NO: 228019 - RNA, 64 nt, hsa; identical to SEQ ID NO: 160913

SEQ ID NO: 228020 - RNA, 64 nt, hsa; identical to SEQ ID NO: 160914

SEQ ID NO: 228021 - RNA, 64 nt, hsa; identical to SEQ ID NO: 160915

SEQ ID NO: 228022 - RNA, 64 nt, hsa; identical to SEQ ID NO: 160916

SEQ ID NO: 228023 - RNA, 64 nt, hsa; identical to SEQ ID NO: 160917

SEQ ID NO: 228024 - RNA, 64 nt, hsa; identical to SEQ ID NO: 160918

SEQ ID NO: 228025 - RNA, 64 nt, hsa; identical to SEQ ID NO: 160919

SEQ ID NO: 228026 - RNA, 64 nt, hsa; identical to SEQ ID NO: 160920

SEQ ID NO: 228027 - RNA, 64 nt, hsa; identical to SEQ ID NO: 160921

SEQ ID NO: 228028 - RNA, 64 nt, hsa; identical to SEQ ID NO: 160922

SEQ ID NO: 228029 - RNA, 64 nt, hsa; identical to SEQ ID NO: 160923

SEQ ID NO: 228030 - RNA, 64 nt, hsa; identical to SEQ ID NO: 160924

SEQ ID NO: 228031 - RNA, 64 nt, hsa; identical to SEQ ID NO: 160925

SEQ ID NO: 228032 - RNA, 64 nt, hsa; identical to SEQ ID NO: 160926

SEQ ID NO: 228033 - RNA, 64 nt, hsa; identical to SEQ ID NO: 160927

SEQ ID NO: 228034 - RNA, 64 nt, hsa; identical to SEQ ID NO: 160928

SEQ ID NO: 228035 - RNA, 64 nt, hsa; identical to SEQ ID NO: 160929

SEQ ID NO: 228036 - RNA, 64 nt, hsa; identical to SEQ ID NO: 160930

SEQ ID NO: 228037 - RNA, 64 nt, hsa; identical to SEQ ID NO: 160931

SEQ ID NO: 228038 - RNA, 64 nt, hsa; identical to SEQ ID NO: 160932

SEQ ID NO: 228039 - RNA, 64 nt, hsa; identical to SEQ ID NO: 160933

SEQ ID NO: 228040 - RNA, 64 nt, hsa; identical to SEQ ID NO: 160934

SEQ ID NO: 228041 - RNA, 64 nt, hsa; identical to SEQ ID NO: 160935

SEQ ID NO: 228042 - RNA, 64 nt, hsa; identical to SEQ ID NO: 160936

SEQ ID NO: 228043 - RNA, 64 nt, hsa; identical to SEQ ID NO: 160937

SEQ ID NO: 228044 - RNA, 64 nt, hsa; identical to SEQ ID NO: 160938

SEQ ID NO: 228045 - RNA, 64 nt, hsa; identical to SEQ ID NO: 160939

SEQ ID NO: 228046 - RNA, 64 nt, hsa; identical to SEQ ID NO: 160940

SEQ ID NO: 228047 - RNA, 62 nt, hsa; identical to SEQ ID NO: 160941

SEQ ID NO: 228048 - RNA, 64 nt, hsa; identical to SEQ ID NO: 160942

SEQ ID NO: 228049 - RNA, 64 nt, hsa; identical to SEQ ID NO: 160943

SEQ ID NO: 228050 - RNA, 64 nt, hsa; identical to SEQ ID NO: 160944

SEQ ID NO: 228051 - RNA, 64 nt, hsa; identical to SEQ ID NO: 160945

SEQ ID NO: 228052 - RNA, 64 nt, hsa; identical to SEQ ID NO: 160945

SEQ ID NO: 228053 - RNA, 64 nt, hsa; identical to SEQ ID NO: 160947

SEQ ID NO: 228054 - RNA, 64 nt, hsa; identical to SEQ ID NO: 160948

SEQ ID NO: 228055 - RNA, 64 nt, hsa; identical to SEQ ID NO: 160949

SEQ ID NO: 228056 - RNA, 64 nt, hsa; identical to SEQ ID NO: 160950

SEQ ID NO: 228057 - RNA, 64 nt, hsa; identical to SEQ ID NO: 160951

SEQ ID NO: 228058 - RNA, 64 nt, hsa; identical to SEQ ID NO: 160952

SEQ ID NO: 228059 - RNA, 64 nt, hsa; identical to SEQ ID NO: 160953

SEQ ID NO: 228060 - RNA, 64 nt, hsa; identical to SEQ ID NO: 160954

SEQ ID NO: 228061 - RNA, 64 nt, hsa; identical to SEQ ID NO: 160955

SEQ ID NO: 228062 - RNA, 64 nt, hsa; identical to SEQ ID NO: 160956

SEQ ID NO: 228063 - RNA, 64 nt, hsa; identical to SEQ ID NO: 160957

SEQ ID NO: 228064 - RNA, 64 nt, hsa; identical to SEQ ID NO: 160958

SEQ ID NO: 228065 - RNA, 64 nt, hsa; identical to SEQ ID NO: 160959

SEQ ID NO: 228066 - RNA, 64 nt, hsa; identical to SEQ ID NO: 160960

SEQ ID NO: 228067 - RNA, 64 nt, hsa; identical to SEQ ID NO: 160961

SEQ ID NO: 228068 - RNA, 64 nt, hsa; identical to SEQ ID NO: 160962

SEQ ID NO: 228069 - RNA, 64 nt, hsa; identical to SEQ ID NO: 160963

SEQ ID NO: 228070 - RNA, 64 nt, hsa; identical to SEQ ID NO: 160963

SEQ ID NO: 228071 - RNA, 64 nt, hsa; identical to SEQ ID NO: 160965

SEQ ID NO: 228072 - RNA, 64 nt, hsa; identical to SEQ ID NO: 160966

SEQ ID NO: 228073 - RNA, 64 nt, hsa; identical to SEQ ID NO: 160967

SEQ ID NO: 228074 - RNA, 64 nt, hsa; identical to SEQ ID NO: 160968

SEQ ID NO: 228075 - RNA, 64 nt, hsa; identical to SEQ ID NO: 160969

SEQ ID NO: 228076 - RNA, 64 nt, hsa; identical to SEQ ID NO: 160970

SEQ ID NO: 228077 - RNA, 64 nt, hsa; identical to SEQ ID NO: 160971

SEQ ID NO: 228078 - RNA, 64 nt, hsa; identical to SEQ ID NO: 160972

SEQ ID NO: 228079 - RNA, 64 nt, hsa
auaaauuggagagcuuauaaaaugcagaacauuucuauccuauccuaccaaauauuuauccuuc

SEQ ID NO: 228080 - RNA, 64 nt, hsa
uuggagagcuuauaaaaugcagaacauuucuauccuauccuaccaaauauuuauccuucucugu

SEQ ID NO: 228081 - RNA, 64 nt, hsa
aucccggagauggauugaugucuccauuguauuuaaaccaaaaugaacugauacuuguuggaau

SEQ ID NO: 228082 - RNA, 64 nt, hsa
uguuguuuuuguaagaaaugagaugcaggaaagaaaaccaaaucccauuccugcaccccagucc

SEQ ID NO: 228083 - RNA, 64 nt, hsa
aggagcugguagccuaccuacacagcugcuacaaaaaccaaaauacagaauggcuucugugaua

SEQ ID NO: 228084 - RNA, 64 nt, hsa
uggcaugacaucugagcacagaaauuaaggcaaaaaaccaaagcaaaacaaauacauggugcug

SEQ ID NO: 228085 - RNA, 64 nt, hsa
ggcguacuauuuuuauugagcccaaaaacaagcaaaaccaaagaauauguagucuaagcauacg

SEQ ID NO: 228086 - RNA, 64 nt, hsa
aacuaugcuauuaaaaaaaaagaagguaacugauaaaccaaaauugagcauaguaauuacccac

SEQ ID NO: 228087 - RNA, 64 nt, hsa
uaagguuggaacagcagcacuauacaugaaauauaaaccaaaaaccuuuacuguuucuaaauuu

SEQ ID NO: 228088 - RNA, 64 nt, hsa
agccaccauuuaacccuuccuuguucuaaaacaaaaaccaaagggcgcugguugguagggugag

SEQ ID NO: 228089 - RNA, 64 nt, hsa
aguaucaugcaauaaggcuuaauuacuaaaugucaaaccaaacuuuuucucaaaccagggacua

SEQ ID NO: 228090 - RNA, 64 nt, hsa
accuaucugcuccaauuauauuuuuaacauuuaaaaaccaaaguccucuacacuugauuuauau

SEQ ID NO: 228091 - RNA, 64 nt, hsa
acaguauacauauauauuuauaucacaauuuacgaaaccaaaaaguugaguuuccaauggaacc

SEQ ID NO: 228092 - RNA, 64 nt, hsa
gccgucccagugaaaauccucauuguuggaguguaaaccaaauacgaagcccucuugcaaagua

SEQ ID NO: 228093 - RNA, 64 nt, hsa
ggcuaaccuuucuaagcucccuaacuugggccagaaaccaaagcugagcuuuuaacuuucuccc

SEQ ID NO: 228094 - RNA, 64 nt, hsa
auccucccuccuugcuugucacccaguugccuuuaaaccaaauucuaaccagccuauccccagg

SEQ ID NO: 228095 - RNA, 64 nt, hsa
cauucuaauuaaugcccuuucuuauuuaaaaacaaaaccaaaugauaucuaaguaguucucagc

SEQ ID NO: 228096 - RNA, 64 nt, hsa
ggucuaccuuuaaaauaagcaauaacaaagaagaaaaccaaauuauuguucaaauuuagguuua

SEQ ID NO: 228097 - RNA, 64 nt, hsa
uccuggaaucaaggaauccugagucugggcaaugaaaccaaagccaggaguugacgcauccugc

SEQ ID NO: 228098 - RNA, 64 nt, hsa
ucuuggcaguauuccaugggauguuaagcaaaggaaaccaaaggaaucguuucaaauggacuca

SEQ ID NO: 228099 - RNA, 64 nt, hsa
uucuuuuuuuaaauuguaucuaauccucaacaacaaaccaaaacagaacaauuaaacagccaaa

SEQ ID NO: 228100 - RNA, 64 nt, hsa
cucugaaggccgggacccagucauacauccuuagaaaccaaaguaugguuuuuguuuucucuug

SEQ ID NO: 228101 - RNA, 64 nt, hsa
cacagugaaaacccaucucaaaaaaaaaaaaaaaaaaccaaaaaaacuguccagcuguggacuu

SEQ ID NO: 228102 - RNA, 64 nt, hsa
uuuuuucaagaacccuuggauuuaugugaggucaaaaccaaacucuuauucucaguggaaaacu

SEQ ID NO: 228103 - RNA, 64 nt, hsa
uaccuaacaugauauaaauuuuuguuuuuugcacaaaccaaaaguuuaauguuaauucuuuuua

SEQ ID NO: 228104 - RNA, 64 nt, hsa
ucgguuuucuuacacugugaucuuaaaaguuaccaaaccaaagucauuuucaguuugaggcaac

SEQ ID NO: 228105 - RNA, 64 nt, hsa
cucagaggcccuucucacugagacagcaacauuuaaaccaaaccagaggaaguauuuguggaac

SEQ ID NO: 228106 - RNA, 64 nt, hsa
agucaaagggcaccauucuuuuuuuuuuuuuuugaaaccaaagcugucucagaaauggccaauu

SEQ ID NO: 228107 - RNA, 64 nt, hsa
aagaagaaagcagcacugucaucagaugcaugauaaaccaaaauaugaaaaugggaaauguuua

SEQ ID NO: 228108 - RNA, 64 nt, hsa
auugacuuucacaaaauuuaaaucauaaacaggcaaaccaaacagcacacuguagcuauaguug

SEQ ID NO: 228109 - RNA, 64 nt, hsa
auaccaugaucgaugaugucccaugcuucgaggaaaaccaaacacuuuccgccucucuugcaaa

SEQ ID NO: 228110 - RNA, 64 nt, hsa
gauguguauauugagauguacucagugugauuuuaaaccaaauugucuuccuguagucacaaua

SEQ ID NO: 228111 - RNA, 64 nt, hsa
ccaacucacccaagcagcaacgagcaacaaucggaaaccaaauacuggagagaaaaccaacguu

SEQ ID NO: 228112 - RNA, 64 nt, hsa
ugauuuuuaaaacaagagacucagggaaaguacuaaaccaaaaucucugauuuuacuuugcguu

SEQ ID NO: 228113 - RNA, 64 nt, hsa
aagcucagcaaguaaccugguacauuugaaauaaaaaccaaauuuuuagauucaaacaaucccu

SEQ ID NO: 228114 - RNA, 64 nt, hsa
uaaaccaaaacaaaauuuccaaaaacaaugaaggaaaccaaaauaaauauuucugcauuucagg

SEQ ID NO: 228115 - RNA, 64 nt, hsa
uuugcuuuaaguguuggcuauuucuauguuuuauaaaccaaaacaaaauuuccaaaaacaauga

SEQ ID NO: 228116 - RNA, 64 nt, hsa
ucgccuaguaaccacggcaacccaaccuacucuaaaaccaaaccaaaaaaauaaaauaacacau

SEQ ID NO: 228117 - RNA, 64 nt, hsa
uaguaaccacggcaacccaaccuacucuaaaaccaaaccaaaaaaauaaaauaacacauccucu

SEQ ID NO: 228118 - RNA, 64 nt, hsa
uuugucucauuguguuauugucugacuaaaucuaaaaccaaacccauguugaaacuaguacuuu

SEQ ID NO: 228119 - RNA, 64 nt, hsa
ccauguugaaacuaguacuuuucccuuuaaaaacaaaccaaaaaaaaaaacaaaaaaaaacuuu

SEQ ID NO: 228120 - RNA, 64 nt, hsa
uuuugccuuaccagaaaagaaaaaaaaaacccuaaaaccaaaaacuccuuuucccuaggaaguc

SEQ ID NO: 228121 - RNA, 64 nt, hsa
aacuguguuuugaccacacaaggugggcauuaacaaaccaaauuucaacuuaaguuuguuugua

SEQ ID NO: 228122 - RNA, 64 nt, hsa
aaagccauuauuuuuauaucaauagcacaaaggaaaaccaaaaguccuuaaccacugaccauuu

SEQ ID NO: 228123 - RNA, 64 nt, hsa
uuuucccacugccuuuuuauuauugacauaucuaaaaccaaacugaaaucgcuuuggaaaucag

SEQ ID NO: 228124 - RNA, 64 nt, hsa
ggaugaccaaagaccuuucuuaugccggaagcaaaaaccaaaacuuuuuguuggcuuuuuccuu

SEQ ID NO: 228125 - RNA, 64 nt, hsa
cuggaagcccucccuccacuuaaguuauuguuuuaaaccaaaguuuacagugucuguugguggc

SEQ ID NO: 228126 - RNA, 64 nt, hsa
guaugucauaaaauauaacauuacagcuuauuuaaaaccaaauauaguugaacauauuuaaaau

SEQ ID NO: 228127 - RNA, 64 nt, hsa
uuuuaccuuucuguccuugauaaaauaguaaagaaaaccaaacaaacccaggccugaugggaaa

SEQ ID NO: 228128 - RNA, 64 nt, hsa
gauguggcuauaaugagaauugcaugauugcuuuaaaccaaaucaggugguggauuuuuuuuuu

SEQ ID NO: 228129 - RNA, 64 nt, hsa
gagggaacgagcuguagguuugcagaaaugugugaaaccaaaaugaucacugccuacuugugau

SEQ ID NO: 228130 - RNA, 64 nt, hsa
aacauaagucaagggaggaugaauaaaaacagcaaaaccaaauaaaguggagaugagugauuga

SEQ ID NO: 228131 - RNA, 64 nt, hsa
ugagguagauugcugucccguuaacauagugcugaaaccaaaggcaguggggguccaaacucgu

SEQ ID NO: 228132 - RNA, 64 nt, hsa
gucaacggugugguuaugaccuuuauuuauauaaaaaccaaauauuuagucaauuuaccguguc

SEQ ID NO: 228133 - RNA, 64 nt, hsa
ucaucacaaauccuuuaaaacaauuaccuaaaagaaaccaaaaauccugccuucuuuguggggg

SEQ ID NO: 228134 - RNA, 64 nt, hsa
uggaauacuggucaucuuucugacaucacaguagaaaccaaaccuuggauuuagauucaaaagg

SEQ ID NO: 228135 - RNA, 64 nt, hsa
uugcuuuuucagccauucacaagcauucaaaaccaaaccaaacagcaguucauauaccugccug

SEQ ID NO: 228136 - RNA, 64 nt, hsa
cgccauugcuuuuucagccauucacaagcauucaaaaccaaaccaaacagcaguucauauaccu

SEQ ID NO: 228137 - RNA, 64 nt, hsa
caauuacaccacgauucaaauaauuccccuccuaaaaccaaaaaggagggaaacgucaacucca

SEQ ID NO: 228138 - RNA, 64 nt, hsa
guccucucauuuggguuuuguaacugcaauuuucaaaccaaaguuuaaaaucaccuuuucuucc

SEQ ID NO: 228139 - RNA, 64 nt, hsa
cccccaugucuacaaaaaugaaaaaccaaaaagcaaaccaaaagaaaaaucugaaauuuccauc

SEQ ID NO: 228140 - RNA, 64 nt, hsa
acauagcaacaccccccaugucuacaaaaaugaaaaaccaaaaagcaaaccaaaagaaaaaucu

SEQ ID NO: 228141 - RNA, 64 nt, hsa
aaucuguauggcaccaaaaaucaaagugaaaaccaaaccaaaaacccaaacacccuauguaacu

SEQ ID NO: 228142 - RNA, 64 nt, hsa
auauaaaucuguauggcaccaaaaaucaaagugaaaaccaaaccaaaaacccaaacacccuaug

SEQ ID NO: 228143 - RNA, 64 nt, hsa
uuggggaauuuuggccaggagacccugaaacaugaaaccaaacaggcuuugauauuuuuuuuuu

SEQ ID NO: 228144 - RNA, 64 nt, hsa
uguggcuuugagaaguuaacuuuuguggaauaugaaaccaaaggaagaauuuccauguagauaa

SEQ ID NO: 228145 - RNA, 64 nt, hsa
ggaaacaaaauagagaauucuuaagauuuuguuuaaaccaaauguuucauguagaaugcaaaau

SEQ ID NO: 228146 - RNA, 64 nt, hsa
cacuugaauugacgcaauauaaaacaaaaugugaaaaccaaaguggauuuauccugcagcucaa

SEQ ID NO: 228147 - RNA, 64 nt, hsa
gaaccaacauucaaauucugccucaucuggagggaaaccaaaauugggagggggaagaggaccc

SEQ ID NO: 228148 - RNA, 64 nt, hsa
acugacuagcccccgggggugccagggguccugaaaaccaaaggaggagcagcagaagccauag

SEQ ID NO: 228149 - RNA, 64 nt, hsa
ccagguccucauuuccaaagucccaaugcucugaaaaccaaaaguauuuucauaacccauuuga

SEQ ID NO: 228150 - RNA, 64 nt, hsa
ucugaaaaccaaaaguauuuucauaacccauuugaaaccaaaccugaccugaacuuacacugau

SEQ ID NO: 228151 - RNA, 64 nt, hsa
cuuagucauaccauccaucccuggugaaagaguaaaaccaaagguuauuauuuccuuuccaugg

SEQ ID NO: 228152 - RNA, 64 nt, hsa
uagguauuguguaaaucuauaaauauuugaauccaaaccaaauauaauuuuuuaacuuacauua

SEQ ID NO: 228153 - RNA, 64 nt, hsa
agccaucugcuauaacucuuucaacagaaaaccaaaaccaaacgaaaugucuaaggaaaauguu

SEQ ID NO: 228154 - RNA, 64 nt, hsa
ugaaauagccaucugcuauaacucuuucaacagaaaaccaaaaccaaacgaaaugucuaaggaa

SEQ ID NO: 228155 - RNA, 64 nt, hsa
uacaguggccucaaagcaaccauggccuacuuaaaaaccaaaccaaaaauaaagaguuuaguug

SEQ ID NO: 228156 - RNA, 64 nt, hsa
uggccucaaagcaaccauggccuacuuaaaaaccaaaccaaaaauaaagaguuuaguugaggag

SEQ ID NO: 228157 - RNA, 64 nt, hsa
cucacuaucggaaauucauuuugauucagaauaaaaaccaaauguauagagcuuuggguguagg

SEQ ID NO: 228158 - RNA, 64 nt, hsa
ggaacuuucuguaucucuuaggaggaacaaguaaaaaccaaaugguuacauugugcugcuagaa

SEQ ID NO: 228159 - RNA, 64 nt, hsa
cauggcaauucuggaagcugauuaaaacacacauaaaccaaaaccaaacaacaggcccuugggu

SEQ ID NO: 228160 - RNA, 64 nt, hsa
aauucuggaagcugauuaaaacacacauaaaccaaaaccaaacaacaggcccuugggugaaagg

SEQ ID NO: 228161 - RNA, 64 nt, hsa
cacagccaucccacucucugcuuccuugagauucaaaccaaaggcuguuuuucuauguuuaaag

SEQ ID NO: 228162 - RNA, 64 nt, hsa
cuguuuuucuauguuuaaagaaaaaaaaaaguaaaaaccaaacacaacaccucacaaguuguaa

SEQ ID NO: 228163 - RNA, 64 nt, hsa
cuccuuguuuuguuugcauauuuaauuuuaaauuaaaccaaagaauauguuaauucugaaagag

SEQ ID NO: 228164 - RNA, 64 nt, hsa
aucaaggucuuguugauauuauauaguaaaaauaaaaccaaaaauaaauauuauucaaguggcu

SEQ ID NO: 228165 - RNA, 64 nt, hsa
uguucacuucuaaaccaaaaauuauguguugccaaaaccaaacccagguucaugaauauggugu

SEQ ID NO: 228166 - RNA, 64 nt, hsa
gaaugugaaacauccguuuucauuguucacuucuaaaccaaaaauuauguguugccaaaaccaa

SEQ ID NO: 228167 - RNA, 64 nt, hsa
augcacugaugugugaagugagaacuccaucagaaaaccaaagggugcuaggaggugugggugc

SEQ ID NO: 228168 - RNA, 64 nt, hsa
ucugaugagaaugguuguuauaaacuuuauuuuaaaaccaaauuuagguguucuuacauauuua

SEQ ID NO: 228169 - RNA, 52 nt, hsa
caccuccuuugaggucauagccaaaccaaaggguacacucauauuugugcac

SEQ ID NO: 228170 - RNA, 64 nt, hsa
ucccuccccaucauccauuccugugaggugucucaaaccaaaguuaacagggagaggauggggg

SEQ ID NO: 228171 - RNA, 64 nt, hsa
caugugggcuugccuucucugccaaacgacugggaaaccaaaaugagcccaccuuguguucuuc

SEQ ID NO: 228172 - RNA, 64 nt, hsa
gccagcugauuggaugucuaggaaugacugaaagaaaccaaaacagccuguccacugcugcugu

SEQ ID NO: 228173 - RNA, 64 nt, hsa
acaucuugauugcuuuuccucggcagcuuucaaaaaaccaaauaauaauaguuauccgucuucu

SEQ ID NO: 228174 - RNA, 64 nt, hsa
ucaguaccccugguaaaccaagccucccacacugaaaccaaaacauaaaaaccaaacccagaca

SEQ ID NO: 228175 - RNA, 64 nt, hsa
aaaccaagccucccacacugaaaccaaaacauaaaaaccaaacccagacaaccaaaacauauuc

SEQ ID NO: 228176 - RNA, 64 nt, hsa
agaggaagacugccucaaacaaacaaaaaacaacaaaccaaaccaaaccaaaccaaaaaaaucu

SEQ ID NO: 228177 - RNA, 64 nt, hsa
aagacugccucaaacaaacaaaaaacaacaaaccaaaccaaaccaaaccaaaaaaaucucaaag

SEQ ID NO: 228178 - RNA, 64 nt, hsa
ugccucaaacaaacaaaaaacaacaaaccaaaccaaaccaaaccaaaaaaaucucaaagcgauu

SEQ ID NO: 228179 - RNA, 64 nt, hsa
caaacaaacaaaaaacaacaaaccaaaccaaaccaaaccaaaaaaaucucaaagcgauuggacc

SEQ ID NO: 228180 - RNA, 64 nt, hsa
gugacagucacugcauuugccugcuucuuuccagaaaccaaacuaggagaugaaacugguuccu

SEQ ID NO: 228181 - RNA, 64 nt, hsa
uuuucuaaguuauuuuguacauuuuucagcagcaaaaccaaacugggucuucagcuuuaucccc

SEQ ID NO: 228182 - RNA, 64 nt, hsa
uuucuacaguuuugcaccacggcaagaaaaccaaaaaccaaaacaaacaaacaaaaaaaaccca

SEQ ID NO: 228183 - RNA, 64 nt, hsa
aagcaacuuucuacaguuuugcaccacggcaagaaaaccaaaaaccaaaacaaacaaacaaaaa

SEQ ID NO: 228184 - RNA, 64 nt, hsa
agaaucagaaaaaaaaagcauuaaaauuuauuugaaaccaaaaaagagcccaaaaagccaaagc

SEQ ID NO: 228185 - RNA, 64 nt, hsa
gccauuauccuaaaugaacucacucagaaacagaaaaccaaauaccacauguucucacuuauaa

SEQ ID NO: 228186 - RNA, 64 nt, hsa
gaagauaccucccucccaguccaccucauuuagaaaaccaaaguguggguagaaaccccaaaug

SEQ ID NO: 228187 - RNA, 64 nt, hsa
aaaaagagcuagcccaaaaucccaaacucaaaccaaaccaaacagaaagcaguggagguggggg

SEQ ID NO: 228188 - RNA, 64 nt, hsa
aaagaaaaaagagcuagcccaaaaucccaaacucaaaccaaaccaaacagaaagcaguggaggu

SEQ ID NO: 228189 - RNA, 64 nt, hsa
cuagggacaccaaaaaagaaaaaaaaaaaaacccaaaccaaaaacgcaaaccaaagcaggcagg

SEQ ID NO: 228190 - RNA, 64 nt, hsa
aaaagaaaaaaaaaaaaacccaaaccaaaaacgcaaaccaaagcaggcaggcagacagcugcug

SEQ ID NO: 228191 - RNA, 64 nt, hsa
agaugguguuugcauguaaauugcagagaaaacaaaaccaaagcugauuggaaacaauuaauug

SEQ ID NO: 228192 - RNA, 64 nt, hsa
cuaaaaaugugcuuugugaucaggagugcgcuccaaaccaaauacgcgcgcugcccuuucgagg

SEQ ID NO: 228193 - RNA, 64 nt, hsa
ccagcgcaaacuucaagagacagggcuuugcugaaaaccaaacaugggccagcugggcuuuuua

SEQ ID NO: 228194 - RNA, 64 nt, hsa
agaggugaaaaacaaacaaaaaaaaaccaaaaacaaaccaaaaaaaaaaaaaacccacaaaauc

SEQ ID NO: 228195 - RNA, 64 nt, hsa
ccaaaggaaccagaggugaaaaacaaacaaaaaaaaaccaaaaacaaaccaaaaaaaaaaaaaa

SEQ ID NO: 228196 - RNA, 64 nt, hsa
aaaaaaaaggaaagaaacuaaccaacaaaagagaaaaccaaaaauaaucacaacagaaaccagc

SEQ ID NO: 228197 - RNA, 64 nt, hsa
uuuacuggcaguucuauaguaguccagacuuuagaaaccaaacacaacaaaauggcuuguugcc

SEQ ID NO: 228198 - RNA, 64 nt, hsa
caauacagaaggagagauagaugagagaucaugaaaaccaaauuuuaucuuuuacauggccccu

SEQ ID NO: 228199 - RNA, 64 nt, hsa
caggagaggagagccagccaagaagaaaauuuuaaaaccaaaccucguuuaggauuuuccuaaa

SEQ ID NO: 228200 - RNA, 64 nt, hsa
ccccuucugccuuccaggagaggucuugcuuuugaaaccaaaaucauguucuucuaaaguguca

SEQ ID NO: 228201 - RNA, 64 nt, hsa
guauucgaggauuauugcaacaaagccaguaguuaaaccaaacuacagucucagccugucauuc

SEQ ID NO: 228202 - RNA, 64 nt, hsa
ggcaggugugugggacagacuggaggaugaggacaaaccaaagccuuuguucuuucuuauugug

SEQ ID NO: 228203 - RNA, 64 nt, hsa
ggauuuuuuucuuuuuuaguaaaaaccuguauaaaaaccaaaauuauaggauuuuuuuuucuuc

SEQ ID NO: 228204 - RNA, 64 nt, hsa
aggauuuuuucuuuuuuaguaaaaaccuauaugaaaaccaaaauuauaggauuuuuuucuuuuu

SEQ ID NO: 228205 - RNA, 64 nt, hsa
ggauuuuuuucuuuuuuaguaaaaaccuauauaaaaaccaaaauuauaggauuuuuucuuuuuu

SEQ ID NO: 228206 - RNA, 64 nt, hsa
aggauuuuuucuuuuuuaguaaaaaccgguaucaaaaccaaaauuauaggauuuuuuucuuuuu

SEQ ID NO: 228207 - RNA, 64 nt, hsa
uaauagagccacuggugaguaaaaaccuauauaaaaaccaaaauuauaggauuuuuucuuuuuu

SEQ ID NO: 228208 - RNA, 64 nt, hsa
guuccucuguuuuucuuuuugauuuuuguuuuuuaaaccaaaacagacaauagcuuauuuucuu

SEQ ID NO: 228209 - RNA, 64 nt, hsa
aagcucauacccaaauucacaaagccuauuuuuuaaaccaaagcacauuuugaaugaguaugga

SEQ ID NO: 228210 - RNA, 64 nt, hsa
uuguugggcuucugcaaaauacaagcucauuuuuaaaccaaaugaacagaccaugagcuggcuu

SEQ ID NO: 228211 - RNA, 64 nt, hsa
auaguugggcucugcuuuuuuaagguucaguugaaaaccaaacuggggccgggugcgguggcuc

SEQ ID NO: 228212 - RNA, 64 nt, hsa
auauugcaagcacuucucauugcuaaaaauaaauaaaccaaaguuuaaccgaaucaguuaggga

SEQ ID NO: 228213 - RNA, 64 nt, hsa
accaaaaaaaguauauagugacauuuuuaguaugaaaccaaauuacacuaaggucuuuuguugg

SEQ ID NO: 228214 - RNA, 64 nt, hsa
acccuuucaagggaaauuuuaaucuaaaaggaaaaaaccaaaauauugaugagaaggaguccuc

SEQ ID NO: 228215 - RNA, 64 nt, hsa
gaaggcuugucucaccuccaccggcauccacacaaaaccaaacaggagcaggcgucauccccac

SEQ ID NO: 228216 - RNA, 64 nt, hsa
cuuaauuuaaguuugcacuuuaauaccaaacuuaaaaccaaacacucauuuaaaaguagguuaa

SEQ ID NO: 228217 - RNA, 64 nt, hsa
gucauuugaacaugcuucuaaauaaaauaaaacaaaaccaaaacuauacuuuugaucuauaaua

SEQ ID NO: 228218 - RNA, 64 nt, hsa
ccgucucauuuguaucuucugauauucuuuauacaaaccaaaaguccccuucaacauuuuuuau

SEQ ID NO: 228219 - RNA, 64 nt, hsa
gguagaaaaaaaacaaacaaacaaacagaaaaaaaaaccaaaaaaaaccacccugaguuucucu

SEQ ID NO: 228220 - RNA, 64 nt, hsa
gacuuuauuuuuucauuggaagaaaaugccugccaaguauaaaugacucucaucuuaaaacaag

SEQ ID NO: 228221 - RNA, 64 nt, hsa
uuucauaaucuauuagaagauggggauauaaaagaaguauaaggcaaucauauauucauucaaa

SEQ ID NO: 228222 - RNA, 64 nt, hsa
ugaauuaguuguuugggguuacuucuuuguuucuaaguauaagaaugugaagaauauuugaaaa

SEQ ID NO: 228223 - RNA, 64 nt, hsa
guuauauaauuuuaagccaccagggccuaaauuaaaguauaaucauuuguauccauguggaaua

SEQ ID NO: 228224 - RNA, 64 nt, hsa
gcaaggcacauacauaaugacuuucuuuuuccuuaaguauaaaaaaaaaguaucagaagaauga

SEQ ID NO: 228225 - RNA, 64 nt, hsa
guuucuugcuucuggcuuuguucuugucaucaguaaguauaacaaacuauguaaugcuuaugug

SEQ ID NO: 228226 - RNA, 64 nt, hsa
uaauuggucauuccuaaugcauuagauuaucaaaaaguauaaauucgcugugagugaguggugu

SEQ ID NO: 228227 - RNA, 64 nt, hsa
uccagcacuaaagcugaaaugccacaaacacuaaaaguauaaauaugucugauuuuugaaacac

SEQ ID NO: 228228 - RNA, 64 nt, hsa
gcaacuucgcauauuuucauugacaccaguguauaaguauaaauuuaaaugaacuaauuacuuu

SEQ ID NO: 228229 - RNA, 64 nt, hsa
acucucaugacaugaaaaauaaauacaacuaguuaaguauaaaaugccaaauaaaagugacacg

SEQ ID NO: 228230 - RNA, 64 nt, hsa
caauaaauucuagaagaguugccuugauucaaacaaguauaauucucaaguuaucacaaaauuu

SEQ ID NO: 228231 - RNA, 64 nt, hsa
accugcacauucagcacauguaucccagaacuuaaaguauaauaaaaauaaauaaauaauuuca

SEQ ID NO: 228232 - RNA, 64 nt, hsa
auauuaaauauuuucuuauuuauuuuuuugauuaaaguauaaauuaagacacccuauugacuuc

SEQ ID NO: 228233 - RNA, 64 nt, hsa
acuuagcuauauucugagacuuugaagaguuauaaaguauaacuauaaaacuaauuuuucuuac

SEQ ID NO: 228234 - RNA, 64 nt, hsa
ugauuaaauguuagaccacagaaguggaauuugaaaguauaaugcaguacauuaauauucaugu

SEQ ID NO: 228235 - RNA, 64 nt, hsa
cauacuuuuauuaaaauauauacuuauauaauaaaaguauaacauaauuuuuuuuuuucucaca

SEQ ID NO: 228236 - RNA, 64 nt, hsa
uguuauuuuuauggucauaauaaaaguuauguagaaguauaauaaaaucccuacauuucugagg

SEQ ID NO: 228237 - RNA, 64 nt, hsa; identical to SEQ ID NO: 58734

SEQ ID NO: 228238 - RNA, 64 nt, hsa; identical to SEQ ID NO: 58735

SEQ ID NO: 228239 - RNA, 64 nt, hsa; identical to SEQ ID NO: 58736

SEQ ID NO: 228240 - RNA, 64 nt, hsa; identical to SEQ ID NO: 58737

SEQ ID NO: 228241 - RNA, 64 nt, hsa; identical to SEQ ID NO: 58738

SEQ ID NO: 228242 - RNA, 64 nt, hsa; identical to SEQ ID NO: 58739

SEQ ID NO: 228243 - RNA, 64 nt, hsa
caacaucaauuaugaaauacugauaacgaaagguaguaaugaaauauauaugaugaaaagaauu

SEQ ID NO: 228244 - RNA, 64 nt, hsa
agcuguuucuuugauagaagggccaugaaaauagaguaaugauauaguaggagauaagggauug

SEQ ID NO: 228245 - RNA, 64 nt, hsa
gcugcgccacccaccaucaaaggaauauaagaaaaguaaugaagaaucacgauuucauccuuga

SEQ ID NO: 228246 - RNA, 64 nt, hsa
uuuaguuuuacacuaggaaacguguuguaucuacaguaaugaaauguuuacuaaguggacuggu

SEQ ID NO: 228247 - RNA, 64 nt, hsa
uuacagcuaagcuguaguugcagaguacauguacaguaaugaaguucacuguguuuauaaauug

SEQ ID NO: 228248 - RNA, 64 nt, hsa
accuuuuuuuuuuccagucacaguauuugugaaaaguaaugagccauaguacccagucauguua

SEQ ID NO: 228249 - RNA, 64 nt, hsa
uagaugugggcucuguuuggggaagaugcaaggaaguaaugagaagcccaggaaauuucuccac

SEQ ID NO: 228250 - RNA, 64 nt, hsa
ucuccuccaaugaggaaacccacgcaccuuccuuaguaaugaaauccuggguuccaaaggggca

SEQ ID NO: 228251 - RNA, 64 nt, hsa
aauggccuguauuucucacgcuauacuuaaaaaaaauaacuaaccuuuuaaacaaagauauuca

SEQ ID NO: 228252 - RNA, 64 nt, hsa
uccugagaaaucuucuuaaacucugaguuuauaaaauaacuacuucugaacuccugagaucuag

SEQ ID NO: 228253 - RNA, 64 nt, hsa
guaaagugugggauuguuguuuugcugggaugcaaauaacuaaaugcuuuggugguuaauugcu

SEQ ID NO: 228254 - RNA, 64 nt, hsa
guuuucaccaagaccuguuugggggcgcugcaggaauaacuauauaggaagauuuuuccuaaaa

SEQ ID NO: 228255 - RNA, 64 nt, hsa
aauaccaacugaagucaauuugggggacaugcuaaauaacuauauaagacauuaagagaacaaa

SEQ ID NO: 228256 - RNA, 64 nt, hsa
gaaggucugauuugcaggauuuuuagagcauuaaaauaacuaucaggcagaagaaucuuucuuc

SEQ ID NO: 228257 - RNA, 64 nt, hsa
ucgaggaguuuuaaaguacuguaacuuuaaaauaaauaacuacaaagcuucuuuguccaaacgu

SEQ ID NO: 228258 - RNA, 64 nt, hsa
uggguuuuaaauaguuuuucugacccuucugaaaaauaacuacauaagugcuucuuguugcugg

SEQ ID NO: 228259 - RNA, 64 nt, hsa
guauuaguguauuuuaaaguaauaaugauuaaagaauaacuaaaugacucugauuuuguuuuau

SEQ ID NO: 228260 - RNA, 64 nt, hsa
uccuguuucccagaagagagaaauaaaaguccuaaauaacuaagaaugaucagcgggagcguug

SEQ ID NO: 228261 - RNA, 64 nt, hsa
aagauucuucucagcaguugcugaaaagcauguaaauaacuacauaauagccugagaauaaugg

SEQ ID NO: 228262 - RNA, 64 nt, hsa
aagcaagccaaauuuuuagaugacgaaguccauaaauaacuagagaauuuuuguuaucuguugu

SEQ ID NO: 228263 - RNA, 64 nt, hsa
uggguauucauugguuauuggccugaaaugaucaaauaacuacaaaugaucuguugaauaaaaa

SEQ ID NO: 228264 - RNA, 64 nt, hsa
auuuuuaugaaaauuauuuuauuuaacuuuaagcaauaacuagagauuacaauuaaauuuuaau

SEQ ID NO: 228265 - RNA, 64 nt, hsa
gggugaguauagucaauaauagcuuaauuguacaaauaacuaagaguauaauuggauuguuugu

SEQ ID NO: 228266 - RNA, 64 nt, hsa
ucauuuagcagggaaguggaauaauaucuuuugaaauaacuaaguccacuaaauuauacaguau

SEQ ID NO: 228267 - RNA, 64 nt, hsa; identical to SEQ ID NO: 158460

SEQ ID NO: 228268 - RNA, 64 nt, hsa; identical to SEQ ID NO: 158461

SEQ ID NO: 228269 - RNA, 64 nt, hsa; identical to SEQ ID NO: 158462

SEQ ID NO: 228270 - RNA, 64 nt, hsa; identical to SEQ ID NO: 158463

SEQ ID NO: 228271 - RNA, 64 nt, hsa; identical to SEQ ID NO: 158464

SEQ ID NO: 228272 - RNA, 64 nt, hsa; identical to SEQ ID NO: 158465

SEQ ID NO: 228273 - RNA, 64 nt, hsa; identical to SEQ ID NO: 158466

SEQ ID NO: 228274 - RNA, 64 nt, hsa; identical to SEQ ID NO: 158467

SEQ ID NO: 228275 - RNA, 64 nt, hsa; identical to SEQ ID NO: 158468

SEQ ID NO: 228276 - RNA, 64 nt, hsa; identical to SEQ ID NO: 158469

SEQ ID NO: 228277 - RNA, 64 nt, hsa; identical to SEQ ID NO: 158470

SEQ ID NO: 228278 - RNA, 64 nt, hsa
ugugaagaaaaacagacucuguccagguagaaauggugaggagggggaagagaauuacauuucc

SEQ ID NO: 228279 - RNA, 64 nt, hsa
ucaguguguguuggggggaugcuuggcagcugggggugaggagacaacaaaccucgggaacugg

SEQ ID NO: 228280 - RNA, 64 nt, hsa
agggaagcccauccaucuggaugguuucaaggauggugaggaauuuagaguugaccuccagccc

SEQ ID NO: 228281 - RNA, 64 nt, hsa
cuguucuuguggcccuuaaugggaagggggcaggggugaggagcugagccugcucaaggagugg

SEQ ID NO: 228282 - RNA, 64 nt, hsa
agggcaaggagaccaccaacagcccucaggucagggugaggauggccucugcuaagcucaaggc

SEQ ID NO: 228283 - RNA, 64 nt, hsa
cuaggaacauacuucagcucacacaugagaucuaggugaggauugauuaccuaguagucauuuc

SEQ ID NO: 228284 - RNA, 64 nt, hsa
cauuacugugcugaaagucagcccacgucggagcggugaggaggagccacagcacauggggugc

SEQ ID NO: 228285 - RNA, 64 nt, hsa
cggauugugaaaacauuggccaccuaguagcaguggugaggagugggagggcccagcaagcauu

SEQ ID NO: 228286 - RNA, 64 nt, hsa
uugccaaccacaggccucucuucacacacuuggcggugaggaucggagggcgcuaugucguggc

SEQ ID NO: 228287 - RNA, 64 nt, hsa
ccuguauugugcccgggcccauggggaggacgauggugaggagauccuguuggacacccagugc

SEQ ID NO: 228288 - RNA, 64 nt, hsa
agcaagaaaacgguaacucaagaggacagaggcuggugaggagguaaagcaggcccagugaaau

SEQ ID NO: 228289 - RNA, 64 nt, hsa
gugguggaggggggagaaugacuccuuucugaggggugaggagggaagugggguauggaauaug

SEQ ID NO: 228290 - RNA, 64 nt, hsa
agccaguuccuauccccuaaccuaaacacuuauaggugaggacuccauccuccuguuccauuca

SEQ ID NO: 228291 - RNA, 64 nt, hsa
aaucaauucugacugagcucccccauuccccucgggugaggaugacuguuauuuuuguagcuga

SEQ ID NO: 228292 - RNA, 64 nt, hsa
cucuuggaaguuuucugaaccuuccaagcucuguggugaggacaaaccaguguuugaaucauau

SEQ ID NO: 228293 - RNA, 64 nt, hsa
uagaaacagcccaccugugcccacuuugaccauuggugaggauagauauaaaaucacuucuucc

SEQ ID NO: 228294 - RNA, 64 nt, hsa
cacgcguagggauggugaggagacgcguagggauggugaggaggggagaggagggagaccugcu

SEQ ID NO: 228295 - RNA, 64 nt, hsa
auuuuuaucaggaaagucagucacgcguagggauggugaggagacgcguagggauggugaggag

SEQ ID NO: 228296 - RNA, 64 nt, hsa
aggcugggaggacugguguugcccuuuggagcuuggugaggagggugggccuagggcuuggcga

SEQ ID NO: 228297 - RNA, 64 nt, hsa
ggguccuugcuggggccgcagacacguaggcuggggugaggagugucugcugucacccucuacu

SEQ ID NO: 228298 - RNA, 64 nt, hsa
aaucaaaggauggaagggcucacucacuucauuaggugaggauuauuucucuccaagcuccuga

SEQ ID NO: 228299 - RNA, 64 nt, hsa
augcugagacuauuacuccuggaccacaacuguaggugaggauucauaggaagaguagaacuca

SEQ ID NO: 228300 - RNA, 64 nt, hsa
guaacaaaugaaggacaagcauacuacauaauauaauccauacaauucucuucaguuaguguaa

SEQ ID NO: 228301 - RNA, 64 nt, hsa
aagaaaccaaggggaaguaauaaguugaaaaagaaauccauaacuauuaaaagauuuuaacuuu

SEQ ID NO: 228302 - RNA, 64 nt, hsa
ccuuuuuucuaaauagcucuggaaccaggcuuguaauccauagcaucaccgacucugcaaagga

SEQ ID NO: 228303 - RNA, 64 nt, hsa
aauuuucguaaacuuuguuuuauauuaaaagaaaaauccauaagucuguguguguuaaacauga

SEQ ID NO: 228304 - RNA, 64 nt, hsa
auguauuaacaaauauauacauuucuauuuuuauaauccauaaggauaugccuguuuuaaauaa

SEQ ID NO: 228305 - RNA, 64 nt, hsa
cucaaacuauauuuauaaaaauuugcuagggccaaauccauacuugcagaauaauucaucaaau

SEQ ID NO: 228306 - RNA, 64 nt, hsa
gccuuacacaauagcagagaauauaaacugaaaaaauccauacaaauauuaaaaauguggcaaa

SEQ ID NO: 228307 - RNA, 64 nt, hsa
uuauuuuaaacugugcucaacccuuacucaagauaauccauacuagagaaacacuauagaugua

SEQ ID NO: 228308 - RNA, 64 nt, hsa
aacaacuuaauuucuaaggguccaagucccagagaauccauagucgucaaagcuuugagaguau

SEQ ID NO: 228309 - RNA, 64 nt, hsa
uccucugagaacagucagugcaagagacuccaauaauccauauugaaagagucagcaccagcag

SEQ ID NO: 228310 - RNA, 64 nt, hsa
ucaguaaugcuacaaccauugcaaaucauuggagaauccauaaugagagaucuuacaaguguaa

SEQ ID NO: 228311 - RNA, 64 nt, hsa
uuagugggcagucaccacuuauucaccaucaagcaauccauaguauagggaaacuugacuaaua

SEQ ID NO: 228312 - RNA, 64 nt, hsa
uacuauugcuuaaacaaaacuggaacuguuguugaauccauagccaauacauuuacagcaaucu

SEQ ID NO: 228313 - RNA, 64 nt, hsa
auaaacuacaaaaacuuuuuguuguuuaucaggaaauccauauuuauuuuguaauuaacuguca

SEQ ID NO: 228314 - RNA, 62 nt, hsa; identical to SEQ ID NO: 64857

SEQ ID NO: 228315 - RNA, 62 nt, hsa; identical to SEQ ID NO: 64858

SEQ ID NO: 228316 - RNA, 62 nt, hsa; identical to SEQ ID NO: 64859

SEQ ID NO: 228317 - RNA, 62 nt, hsa; identical to SEQ ID NO: 64860

SEQ ID NO: 228318 - RNA, 62 nt, hsa; identical to SEQ ID NO: 64861

SEQ ID NO: 228319 - RNA, 62 nt, hsa; identical to SEQ ID NO: 64862

SEQ ID NO: 228320 - RNA, 62 nt, hsa; identical to SEQ ID NO: 64863

SEQ ID NO: 228321 - RNA, 62 nt, hsa; identical to SEQ ID NO: 64864

SEQ ID NO: 228322 - RNA, 62 nt, hsa; identical to SEQ ID NO: 64865

SEQ ID NO: 228323 - RNA, 62 nt, hsa; identical to SEQ ID NO: 64866

SEQ ID NO: 228324 - RNA, 62 nt, hsa; identical to SEQ ID NO: 64867

SEQ ID NO: 228325 - RNA, 62 nt, hsa; identical to SEQ ID NO: 64868

SEQ ID NO: 228326 - RNA, 62 nt, hsa; identical to SEQ ID NO: 64869

SEQ ID NO: 228327 - RNA, 62 nt, hsa; identical to SEQ ID NO: 64870

SEQ ID NO: 228328 - RNA, 62 nt, hsa; identical to SEQ ID NO: 64871

SEQ ID NO: 228329 - RNA, 62 nt, hsa; identical to SEQ ID NO: 64872

SEQ ID NO: 228330 - RNA, 62 nt, hsa; identical to SEQ ID NO: 64873

SEQ ID NO: 228331 - RNA, 62 nt, hsa; identical to SEQ ID NO: 64874

SEQ ID NO: 228332 - RNA, 62 nt, hsa; identical to SEQ ID NO: 64875

SEQ ID NO: 228333 - RNA, 62 nt, hsa; identical to SEQ ID NO: 64876

SEQ ID NO: 228334 - RNA, 62 nt, hsa; identical to SEQ ID NO: 64877

SEQ ID NO: 228335 - RNA, 62 nt, hsa; identical to SEQ ID NO: 64878

SEQ ID NO: 228336 - RNA, 62 nt, hsa; identical to SEQ ID NO: 64879

SEQ ID NO: 228337 - RNA, 62 nt, hsa; identical to SEQ ID NO: 64880

SEQ ID NO: 228338 - RNA, 62 nt, hsa; identical to SEQ ID NO: 64881

SEQ ID NO: 228339 - RNA, 62 nt, hsa; identical to SEQ ID NO: 64882

SEQ ID NO: 228340 - RNA, 62 nt, hsa; identical to SEQ ID NO: 64883

SEQ ID NO: 228341 - RNA, 62 nt, hsa; identical to SEQ ID NO: 64884

SEQ ID NO: 228342 - RNA, 62 nt, hsa; identical to SEQ ID NO: 64885

SEQ ID NO: 228343 - RNA, 62 nt, hsa; identical to SEQ ID NO: 64886

SEQ ID NO: 228344 - RNA, 62 nt, hsa; identical to SEQ ID NO: 64887

SEQ ID NO: 228345 - RNA, 62 nt, hsa; identical to SEQ ID NO: 64888

SEQ ID NO: 228346 - RNA, 62 nt, hsa; identical to SEQ ID NO: 64889

SEQ ID NO: 228347 - RNA, 62 nt, hsa; identical to SEQ ID NO: 64890

SEQ ID NO: 228348 - RNA, 62 nt, hsa; identical to SEQ ID NO: 64891

SEQ ID NO: 228349 - RNA, 62 nt, hsa; identical to SEQ ID NO: 64892

SEQ ID NO: 228350 - RNA, 62 nt, hsa; identical to SEQ ID NO: 64893

SEQ ID NO: 228351 - RNA, 62 nt, hsa; identical to SEQ ID NO: 64894

SEQ ID NO: 228352 - RNA, 62 nt, hsa; identical to SEQ ID NO: 64895

SEQ ID NO: 228353 - RNA, 62 nt, hsa; identical to SEQ ID NO: 64896

SEQ ID NO: 228354 - RNA, 62 nt, hsa; identical to SEQ ID NO: 64897

SEQ ID NO: 228355 - RNA, 62 nt, hsa; identical to SEQ ID NO: 64898

SEQ ID NO: 228356 - RNA, 62 nt, hsa; identical to SEQ ID NO: 64899

SEQ ID NO: 228357 - RNA, 62 nt, hsa; identical to SEQ ID NO: 64900

SEQ ID NO: 228358 - RNA, 62 nt, hsa; identical to SEQ ID NO: 64901

SEQ ID NO: 228359 - RNA, 62 nt, hsa; identical to SEQ ID NO: 64902

SEQ ID NO: 228360 - RNA, 62 nt, hsa; identical to SEQ ID NO: 64903

SEQ ID NO: 228361 - RNA, 62 nt, hsa; identical to SEQ ID NO: 64904

SEQ ID NO: 228362 - RNA, 62 nt, hsa; identical to SEQ ID NO: 64905

SEQ ID NO: 228363 - RNA, 62 nt, hsa; identical to SEQ ID NO: 64906

SEQ ID NO: 228364 - RNA, 62 nt, hsa; identical to SEQ ID NO: 64907

SEQ ID NO: 228365 - RNA, 62 nt, hsa; identical to SEQ ID NO: 64908

SEQ ID NO: 228366 - RNA, 62 nt, hsa; identical to SEQ ID NO: 64909

SEQ ID NO: 228367 - RNA, 62 nt, hsa; identical to SEQ ID NO: 64910

SEQ ID NO: 228368 - RNA, 62 nt, hsa; identical to SEQ ID NO: 64911

SEQ ID NO: 228369 - RNA, 62 nt, hsa; identical to SEQ ID NO: 64912

SEQ ID NO: 228370 - RNA, 62 nt, hsa; identical to SEQ ID NO: 64913

SEQ ID NO: 228371 - RNA, 62 nt, hsa; identical to SEQ ID NO: 64914

SEQ ID NO: 228372 - RNA, 62 nt, hsa; identical to SEQ ID NO: 64915

SEQ ID NO: 228373 - RNA, 62 nt, hsa; identical to SEQ ID NO: 64916

SEQ ID NO: 228374 - RNA, 62 nt, hsa; identical to SEQ ID NO: 64917

SEQ ID NO: 228375 - RNA, 62 nt, hsa; identical to SEQ ID NO: 64918

SEQ ID NO: 228376 - RNA, 62 nt, hsa; identical to SEQ ID NO: 64919

SEQ ID NO: 228377 - RNA, 62 nt, hsa; identical to SEQ ID NO: 64920

SEQ ID NO: 228378 - RNA, 62 nt, hsa; identical to SEQ ID NO: 64921

SEQ ID NO: 228379 - RNA, 62 nt, hsa; identical to SEQ ID NO: 64922

SEQ ID NO: 228380 - RNA, 62 nt, hsa; identical to SEQ ID NO: 64923

SEQ ID NO: 228381 - RNA, 62 nt, hsa; identical to SEQ ID NO: 64924

SEQ ID NO: 228382 - RNA, 62 nt, hsa; identical to SEQ ID NO: 64925

SEQ ID NO: 228383 - RNA, 62 nt, hsa; identical to SEQ ID NO: 64926

SEQ ID NO: 228384 - RNA, 62 nt, hsa; identical to SEQ ID NO: 64927

SEQ ID NO: 228385 - RNA, 62 nt, hsa; identical to SEQ ID NO: 64928

SEQ ID NO: 228386 - RNA, 62 nt, hsa; identical to SEQ ID NO: 64929

SEQ ID NO: 228387 - RNA, 62 nt, hsa; identical to SEQ ID NO: 64930

SEQ ID NO: 228388 - RNA, 62 nt, hsa; identical to SEQ ID NO: 64931

SEQ ID NO: 228389 - RNA, 62 nt, hsa; identical to SEQ ID NO: 64932

SEQ ID NO: 228390 - RNA, 62 nt, hsa; identical to SEQ ID NO: 64933

SEQ ID NO: 228391 - RNA, 62 nt, hsa; identical to SEQ ID NO: 64934

SEQ ID NO: 228392 - RNA, 62 nt, hsa; identical to SEQ ID NO: 64935

SEQ ID NO: 228393 - RNA, 62 nt, hsa; identical to SEQ ID NO: 64936

SEQ ID NO: 228394 - RNA, 62 nt, hsa; identical to SEQ ID NO: 64937

SEQ ID NO: 228395 - RNA, 62 nt, hsa; identical to SEQ ID NO: 64938

SEQ ID NO: 228396 - RNA, 62 nt, hsa; identical to SEQ ID NO: 64939

SEQ ID NO: 228397 - RNA, 62 nt, hsa; identical to SEQ ID NO: 64940

SEQ ID NO: 228398 - RNA, 62 nt, hsa; identical to SEQ ID NO: 64941

SEQ ID NO: 228399 - RNA, 62 nt, hsa; identical to SEQ ID NO: 64942

SEQ ID NO: 228400 - RNA, 62 nt, hsa; identical to SEQ ID NO: 64943

SEQ ID NO: 228401 - RNA, 62 nt, hsa; identical to SEQ ID NO: 64944

SEQ ID NO: 228402 - RNA, 62 nt, hsa; identical to SEQ ID NO: 64945

SEQ ID NO: 228403 - RNA, 62 nt, hsa; identical to SEQ ID NO: 64946

SEQ ID NO: 228404 - RNA, 62 nt, hsa; identical to SEQ ID NO: 64947

SEQ ID NO: 228405 - RNA, 62 nt, hsa; identical to SEQ ID NO: 64948

SEQ ID NO: 228406 - RNA, 62 nt, hsa; identical to SEQ ID NO: 64949

SEQ ID NO: 228407 - RNA, 62 nt, hsa; identical to SEQ ID NO: 64950

SEQ ID NO: 228408 - RNA, 62 nt, hsa; identical to SEQ ID NO: 64951

SEQ ID NO: 228409 - RNA, 62 nt, hsa; identical to SEQ ID NO: 64952

SEQ ID NO: 228410 - RNA, 62 nt, hsa; identical to SEQ ID NO: 64953

SEQ ID NO: 228411 - RNA, 62 nt, hsa; identical to SEQ ID NO: 64954

SEQ ID NO: 228412 - RNA, 62 nt, hsa; identical to SEQ ID NO: 64955

SEQ ID NO: 228413 - RNA, 62 nt, hsa; identical to SEQ ID NO: 64956

SEQ ID NO: 228414 - RNA, 62 nt, hsa; identical to SEQ ID NO: 64957

SEQ ID NO: 228415 - RNA, 62 nt, hsa; identical to SEQ ID NO: 64958

SEQ ID NO: 228416 - RNA, 62 nt, hsa; identical to SEQ ID NO: 64959

SEQ ID NO: 228417 - RNA, 62 nt, hsa; identical to SEQ ID NO: 64960

SEQ ID NO: 228418 - RNA, 62 nt, hsa; identical to SEQ ID NO: 64961

SEQ ID NO: 228419 - RNA, 62 nt, hsa; identical to SEQ ID NO: 64962

SEQ ID NO: 228420 - RNA, 62 nt, hsa; identical to SEQ ID NO: 64963

SEQ ID NO: 228421 - RNA, 62 nt, hsa; identical to SEQ ID NO: 64964

SEQ ID NO: 228422 - RNA, 62 nt, hsa; identical to SEQ ID NO: 64965

SEQ ID NO: 228423 - RNA, 62 nt, hsa; identical to SEQ ID NO: 64966

SEQ ID NO: 228424 - RNA, 62 nt, hsa; identical to SEQ ID NO: 64967

SEQ ID NO: 228425 - RNA, 62 nt, hsa; identical to SEQ ID NO: 64968

SEQ ID NO: 228426 - RNA, 62 nt, hsa; identical to SEQ ID NO: 64969

SEQ ID NO: 228427 - RNA, 62 nt, hsa; identical to SEQ ID NO: 64970

SEQ ID NO: 228428 - RNA, 62 nt, hsa; identical to SEQ ID NO: 64971

SEQ ID NO: 228429 - RNA, 62 nt, hsa; identical to SEQ ID NO: 64972

SEQ ID NO: 228430 - RNA, 62 nt, hsa; identical to SEQ ID NO: 64973

SEQ ID NO: 228431 - RNA, 62 nt, hsa; identical to SEQ ID NO: 64974

SEQ ID NO: 228432 - RNA, 62 nt, hsa; identical to SEQ ID NO: 64975

SEQ ID NO: 228433 - RNA, 62 nt, hsa; identical to SEQ ID NO: 64976

SEQ ID NO: 228434 - RNA, 62 nt, hsa; identical to SEQ ID NO: 64977

SEQ ID NO: 228435 - RNA, 62 nt, hsa; identical to SEQ ID NO: 64978

SEQ ID NO: 228436 - RNA, 62 nt, hsa; identical to SEQ ID NO: 64979

SEQ ID NO: 228437 - RNA, 62 nt, hsa; identical to SEQ ID NO: 64980

SEQ ID NO: 228438 - RNA, 62 nt, hsa; identical to SEQ ID NO: 64981

SEQ ID NO: 228439 - RNA, 62 nt, hsa; identical to SEQ ID NO: 64982

SEQ ID NO: 228440 - RNA, 62 nt, hsa; identical to SEQ ID NO: 64983

SEQ ID NO: 228441 - RNA, 62 nt, hsa; identical to SEQ ID NO: 64984

SEQ ID NO: 228442 - RNA, 62 nt, hsa; identical to SEQ ID NO: 64985

SEQ ID NO: 228443 - RNA, 62 nt, hsa; identical to SEQ ID NO: 64986

SEQ ID NO: 228444 - RNA, 62 nt, hsa; identical to SEQ ID NO: 64987

SEQ ID NO: 228445 - RNA, 62 nt, hsa; identical to SEQ ID NO: 64988

SEQ ID NO: 228446 - RNA, 62 nt, hsa; identical to SEQ ID NO: 64989

SEQ ID NO: 228447 - RNA, 62 nt, hsa; identical to SEQ ID NO: 64990

SEQ ID NO: 228448 - RNA, 62 nt, hsa; identical to SEQ ID NO: 64991

SEQ ID NO: 228449 - RNA, 62 nt, hsa; identical to SEQ ID NO: 64992

SEQ ID NO: 228450 - RNA, 62 nt, hsa; identical to SEQ ID NO: 64993

SEQ ID NO: 228451 - RNA, 62 nt, hsa; identical to SEQ ID NO: 64994

SEQ ID NO: 228452 - RNA, 56 nt, hsa; identical to SEQ ID NO: 61369

SEQ ID NO: 228453 - RNA, 62 nt, hsa; identical to SEQ ID NO: 64996

SEQ ID NO: 228454 - RNA, 62 nt, hsa; identical to SEQ ID NO: 64997

SEQ ID NO: 228455 - RNA, 62 nt, hsa; identical to SEQ ID NO: 64998

SEQ ID NO: 228456 - RNA, 62 nt, hsa; identical to SEQ ID NO: 64999

SEQ ID NO: 228457 - RNA, 62 nt, hsa; identical to SEQ ID NO: 65000

SEQ ID NO: 228458 - RNA, 62 nt, hsa; identical to SEQ ID NO: 65001

SEQ ID NO: 228459 - RNA, 62 nt, hsa; identical to SEQ ID NO: 65002

SEQ ID NO: 228460 - RNA, 62 nt, hsa; identical to SEQ ID NO: 65003

SEQ ID NO: 228461 - RNA, 62 nt, hsa; identical to SEQ ID NO: 65004

SEQ ID NO: 228462 - RNA, 62 nt, hsa; identical to SEQ ID NO: 65005

SEQ ID NO: 228463 - RNA, 62 nt, hsa; identical to SEQ ID NO: 65006

SEQ ID NO: 228464 - RNA, 62 nt, hsa; identical to SEQ ID NO: 65007

SEQ ID NO: 228465 - RNA, 62 nt, hsa; identical to SEQ ID NO: 65008

SEQ ID NO: 228466 - RNA, 62 nt, hsa; identical to SEQ ID NO: 65009

SEQ ID NO: 228467 - RNA, 62 nt, hsa; identical to SEQ ID NO: 65010

SEQ ID NO: 228468 - RNA, 62 nt, hsa; identical to SEQ ID NO: 65011

SEQ ID NO: 228469 - RNA, 62 nt, hsa; identical to SEQ ID NO: 65012

SEQ ID NO: 228470 - RNA, 62 nt, hsa; identical to SEQ ID NO: 65013

SEQ ID NO: 228471 - RNA, 62 nt, hsa; identical to SEQ ID NO: 65014

SEQ ID NO: 228472 - RNA, 62 nt, hsa; identical to SEQ ID NO: 65015

SEQ ID NO: 228473 - RNA, 62 nt, hsa; identical to SEQ ID NO: 65016

SEQ ID NO: 228474 - RNA, 62 nt, hsa; identical to SEQ ID NO: 65017

SEQ ID NO: 228475 - RNA, 62 nt, hsa; identical to SEQ ID NO: 65018

SEQ ID NO: 228476 - RNA, 62 nt, hsa; identical to SEQ ID NO: 65019

SEQ ID NO: 228477 - RNA, 62 nt, hsa; identical to SEQ ID NO: 65020

SEQ ID NO: 228478 - RNA, 62 nt, hsa; identical to SEQ ID NO: 65021

SEQ ID NO: 228479 - RNA, 62 nt, hsa; identical to SEQ ID NO: 65022

SEQ ID NO: 228480 - RNA, 62 nt, hsa; identical to SEQ ID NO: 65023

SEQ ID NO: 228481 - RNA, 62 nt, hsa; identical to SEQ ID NO: 65024

SEQ ID NO: 228482 - RNA, 62 nt, hsa; identical to SEQ ID NO: 65025

SEQ ID NO: 228483 - RNA, 62 nt, hsa; identical to SEQ ID NO: 65026

SEQ ID NO: 228484 - RNA, 62 nt, hsa; identical to SEQ ID NO: 65027

SEQ ID NO: 228485 - RNA, 62 nt, hsa; identical to SEQ ID NO: 65028

SEQ ID NO: 228486 - RNA, 62 nt, hsa; identical to SEQ ID NO: 65029

SEQ ID NO: 228487 - RNA, 62 nt, hsa; identical to SEQ ID NO: 65030

SEQ ID NO: 228488 - RNA, 62 nt, hsa; identical to SEQ ID NO: 65031

SEQ ID NO: 228489 - RNA, 62 nt, hsa; identical to SEQ ID NO: 65032

SEQ ID NO: 228490 - RNA, 62 nt, hsa; identical to SEQ ID NO: 65033

SEQ ID NO: 228491 - RNA, 62 nt, hsa; identical to SEQ ID NO: 65034

SEQ ID NO: 228492 - RNA, 62 nt, hsa; identical to SEQ ID NO: 65035

SEQ ID NO: 228493 - RNA, 62 nt, hsa; identical to SEQ ID NO: 65036

SEQ ID NO: 228494 - RNA, 62 nt, hsa; identical to SEQ ID NO: 65037

SEQ ID NO: 228495 - RNA, 62 nt, hsa; identical to SEQ ID NO: 65038

SEQ ID NO: 228496 - RNA, 62 nt, hsa; identical to SEQ ID NO: 65039

SEQ ID NO: 228497 - RNA, 62 nt, hsa; identical to SEQ ID NO: 65040

SEQ ID NO: 228498 - RNA, 62 nt, hsa; identical to SEQ ID NO: 65041

SEQ ID NO: 228499 - RNA, 62 nt, hsa; identical to SEQ ID NO: 65042

SEQ ID NO: 228500 - RNA, 62 nt, hsa; identical to SEQ ID NO: 65043

SEQ ID NO: 228501 - RNA, 62 nt, hsa; identical to SEQ ID NO: 65044

SEQ ID NO: 228502 - RNA, 62 nt, hsa; identical to SEQ ID NO: 65045

SEQ ID NO: 228503 - RNA, 62 nt, hsa; identical to SEQ ID NO: 65046

SEQ ID NO: 228504 - RNA, 62 nt, hsa; identical to SEQ ID NO: 65047

SEQ ID NO: 228505 - RNA, 62 nt, hsa; identical to SEQ ID NO: 65048

SEQ ID NO: 228506 - RNA, 62 nt, hsa; identical to SEQ ID NO: 65049

SEQ ID NO: 228507 - RNA, 62 nt, hsa; identical to SEQ ID NO: 65050

SEQ ID NO: 228508 - RNA, 62 nt, hsa; identical to SEQ ID NO: 65051

SEQ ID NO: 228509 - RNA, 62 nt, hsa; identical to SEQ ID NO: 65052

SEQ ID NO: 228510 - RNA, 62 nt, hsa; identical to SEQ ID NO: 65053

SEQ ID NO: 228511 - RNA, 62 nt, hsa; identical to SEQ ID NO: 65054

SEQ ID NO: 228512 - RNA, 62 nt, hsa; identical to SEQ ID NO: 65055

SEQ ID NO: 228513 - RNA, 62 nt, hsa; identical to SEQ ID NO: 65056

SEQ ID NO: 228514 - RNA, 62 nt, hsa; identical to SEQ ID NO: 65057

SEQ ID NO: 228515 - RNA, 62 nt, hsa; identical to SEQ ID NO: 65058

SEQ ID NO: 228516 - RNA, 62 nt, hsa; identical to SEQ ID NO: 65059

SEQ ID NO: 228517 - RNA, 62 nt, hsa; identical to SEQ ID NO: 65060

SEQ ID NO: 228518 - RNA, 62 nt, hsa; identical to SEQ ID NO: 65061

SEQ ID NO: 228519 - RNA, 62 nt, hsa; identical to SEQ ID NO: 65062

SEQ ID NO: 228520 - RNA, 62 nt, hsa; identical to SEQ ID NO: 65063

SEQ ID NO: 228521 - RNA, 62 nt, hsa; identical to SEQ ID NO: 65064

SEQ ID NO: 228522 - RNA, 62 nt, hsa; identical to SEQ ID NO: 65065

SEQ ID NO: 228523 - RNA, 62 nt, hsa; identical to SEQ ID NO: 65066

SEQ ID NO: 228524 - RNA, 62 nt, hsa; identical to SEQ ID NO: 65067

SEQ ID NO: 228525 - RNA, 62 nt, hsa; identical to SEQ ID NO: 65068

SEQ ID NO: 228526 - RNA, 62 nt, hsa; identical to SEQ ID NO: 65069

SEQ ID NO: 228527 - RNA, 62 nt, hsa; identical to SEQ ID NO: 65070

SEQ ID NO: 228528 - RNA, 62 nt, hsa; identical to SEQ ID NO: 65071

SEQ ID NO: 228529 - RNA, 62 nt, hsa; identical to SEQ ID NO: 65072

SEQ ID NO: 228530 - RNA, 62 nt, hsa; identical to SEQ ID NO: 65073

SEQ ID NO: 228531 - RNA, 62 nt, hsa; identical to SEQ ID NO: 65074

SEQ ID NO: 228532 - RNA, 62 nt, hsa; identical to SEQ ID NO: 65075

SEQ ID NO: 228533 - RNA, 62 nt, hsa; identical to SEQ ID NO: 65076

SEQ ID NO: 228534 - RNA, 62 nt, hsa; identical to SEQ ID NO: 65077

SEQ ID NO: 228535 - RNA, 62 nt, hsa; identical to SEQ ID NO: 65078

SEQ ID NO: 228536 - RNA, 62 nt, hsa; identical to SEQ ID NO: 65079

SEQ ID NO: 228537 - RNA, 62 nt, hsa; identical to SEQ ID NO: 65080

SEQ ID NO: 228538 - RNA, 62 nt, hsa; identical to SEQ ID NO: 65081

SEQ ID NO: 228539 - RNA, 62 nt, hsa; identical to SEQ ID NO: 65082

SEQ ID NO: 228540 - RNA, 62 nt, hsa; identical to SEQ ID NO: 65083

SEQ ID NO: 228541 - RNA, 62 nt, hsa; identical to SEQ ID NO: 65084

SEQ ID NO: 228542 - RNA, 62 nt, hsa; identical to SEQ ID NO: 65085

SEQ ID NO: 228543 - RNA, 62 nt, hsa; identical to SEQ ID NO: 65086

SEQ ID NO: 228544 - RNA, 60 nt, hsa; identical to SEQ ID NO: 65087

SEQ ID NO: 228545 - RNA, 62 nt, hsa; identical to SEQ ID NO: 65088

SEQ ID NO: 228546 - RNA, 62 nt, hsa; identical to SEQ ID NO: 65089

SEQ ID NO: 228547 - RNA, 62 nt, hsa; identical to SEQ ID NO: 65090

SEQ ID NO: 228548 - RNA, 62 nt, hsa; identical to SEQ ID NO: 65091

SEQ ID NO: 228549 - RNA, 62 nt, hsa; identical to SEQ ID NO: 65092

SEQ ID NO: 228550 - RNA, 62 nt, hsa; identical to SEQ ID NO: 65093

SEQ ID NO: 228551 - RNA, 51 nt, hsa; identical to SEQ ID NO: 65094

SEQ ID NO: 228552 - RNA, 62 nt, hsa; identical to SEQ ID NO: 65095

SEQ ID NO: 228553 - RNA, 62 nt, hsa; identical to SEQ ID NO: 65096

SEQ ID NO: 228554 - RNA, 62 nt, hsa; identical to SEQ ID NO: 65097

SEQ ID NO: 228555 - RNA, 62 nt, hsa; identical to SEQ ID NO: 65098

SEQ ID NO: 228556 - RNA, 62 nt, hsa; identical to SEQ ID NO: 65099

SEQ ID NO: 228557 - RNA, 62 nt, hsa; identical to SEQ ID NO: 65100

SEQ ID NO: 228558 - RNA, 62 nt, hsa; identical to SEQ ID NO: 65101

SEQ ID NO: 228559 - RNA, 62 nt, hsa; identical to SEQ ID NO: 65102

SEQ ID NO: 228560 - RNA, 62 nt, hsa; identical to SEQ ID NO: 65103

SEQ ID NO: 228561 - RNA, 62 nt, hsa; identical to SEQ ID NO: 65104

SEQ ID NO: 228562 - RNA, 62 nt, hsa; identical to SEQ ID NO: 65105

SEQ ID NO: 228563 - RNA, 62 nt, hsa; identical to SEQ ID NO: 65106

SEQ ID NO: 228564 - RNA, 62 nt, hsa; identical to SEQ ID NO: 65107

SEQ ID NO: 228565 - RNA, 62 nt, hsa; identical to SEQ ID NO: 65108

SEQ ID NO: 228566 - RNA, 62 nt, hsa; identical to SEQ ID NO: 65109

SEQ ID NO: 228567 - RNA, 62 nt, hsa; identical to SEQ ID NO: 65110

SEQ ID NO: 228568 - RNA, 62 nt, hsa; identical to SEQ ID NO: 65111

SEQ ID NO: 228569 - RNA, 62 nt, hsa; identical to SEQ ID NO: 65112

SEQ ID NO: 228570 - RNA, 62 nt, hsa; identical to SEQ ID NO: 65113

SEQ ID NO: 228571 - RNA, 62 nt, hsa; identical to SEQ ID NO: 65114

SEQ ID NO: 228572 - RNA, 62 nt, hsa; identical to SEQ ID NO: 65115

SEQ ID NO: 228573 - RNA, 62 nt, hsa; identical to SEQ ID NO: 65116

SEQ ID NO: 228574 - RNA, 62 nt, hsa; identical to SEQ ID NO: 65117

SEQ ID NO: 228575 - RNA, 62 nt, hsa; identical to SEQ ID NO: 65118

SEQ ID NO: 228576 - RNA, 62 nt, hsa; identical to SEQ ID NO: 65119

SEQ ID NO: 228577 - RNA, 62 nt, hsa; identical to SEQ ID NO: 65120

SEQ ID NO: 228578 - RNA, 62 nt, hsa; identical to SEQ ID NO: 65121

SEQ ID NO: 228579 - RNA, 62 nt, hsa; identical to SEQ ID NO: 65122

SEQ ID NO: 228580 - RNA, 62 nt, hsa; identical to SEQ ID NO: 65123

SEQ ID NO: 228581 - RNA, 62 nt, hsa; identical to SEQ ID NO: 65124

SEQ ID NO: 228582 - RNA, 62 nt, hsa; identical to SEQ ID NO: 65125

SEQ ID NO: 228583 - RNA, 62 nt, hsa; identical to SEQ ID NO: 65126

SEQ ID NO: 228584 - RNA, 62 nt, hsa; identical to SEQ ID NO: 65127

SEQ ID NO: 228585 - RNA, 62 nt, hsa; identical to SEQ ID NO: 65128

SEQ ID NO: 228586 - RNA, 62 nt, hsa; identical to SEQ ID NO: 65129

SEQ ID NO: 228587 - RNA, 62 nt, hsa; identical to SEQ ID NO: 65130

SEQ ID NO: 228588 - RNA, 62 nt, hsa; identical to SEQ ID NO: 65131

SEQ ID NO: 228589 - RNA, 62 nt, hsa; identical to SEQ ID NO: 65132

SEQ ID NO: 228590 - RNA, 62 nt, hsa; identical to SEQ ID NO: 65133

SEQ ID NO: 228591 - RNA, 62 nt, hsa; identical to SEQ ID NO: 65134

SEQ ID NO: 228592 - RNA, 62 nt, hsa; identical to SEQ ID NO: 65135

SEQ ID NO: 228593 - RNA, 63 nt, hsa; identical to SEQ ID NO: 65136

SEQ ID NO: 228594 - RNA, 63 nt, hsa; identical to SEQ ID NO: 65137

SEQ ID NO: 228595 - RNA, 63 nt, hsa; identical to SEQ ID NO: 65138

SEQ ID NO: 228596 - RNA, 63 nt, hsa; identical to SEQ ID NO: 65139

SEQ ID NO: 228597 - RNA, 63 nt, hsa; identical to SEQ ID NO: 65140

SEQ ID NO: 228598 - RNA, 63 nt, hsa; identical to SEQ ID NO: 65141

SEQ ID NO: 228599 - RNA, 63 nt, hsa; identical to SEQ ID NO: 65142

SEQ ID NO: 228600 - RNA, 63 nt, hsa; identical to SEQ ID NO: 65143

SEQ ID NO: 228601 - RNA, 63 nt, hsa; identical to SEQ ID NO: 65144

SEQ ID NO: 228602 - RNA, 63 nt, hsa; identical to SEQ ID NO: 65145

SEQ ID NO: 228603 - RNA, 63 nt, hsa; identical to SEQ ID NO: 65146

SEQ ID NO: 228604 - RNA, 63 nt, hsa; identical to SEQ ID NO: 65147

SEQ ID NO: 228605 - RNA, 63 nt, hsa; identical to SEQ ID NO: 65148

SEQ ID NO: 228606 - RNA, 63 nt, hsa; identical to SEQ ID NO: 65149

SEQ ID NO: 228607 - RNA, 63 nt, hsa; identical to SEQ ID NO: 65150

SEQ ID NO: 228608 - RNA, 63 nt, hsa; identical to SEQ ID NO: 65151

SEQ ID NO: 228609 - RNA, 63 nt, hsa; identical to SEQ ID NO: 65152

SEQ ID NO: 228610 - RNA, 63 nt, hsa; identical to SEQ ID NO: 65153

SEQ ID NO: 228611 - RNA, 63 nt, hsa; identical to SEQ ID NO: 65154

SEQ ID NO: 228612 - RNA, 63 nt, hsa; identical to SEQ ID NO: 65155

SEQ ID NO: 228613 - RNA, 63 nt, hsa; identical to SEQ ID NO: 65156

SEQ ID NO: 228614 - RNA, 63 nt, hsa; identical to SEQ ID NO: 65157

SEQ ID NO: 228615 - RNA, 63 nt, hsa; identical to SEQ ID NO: 65158

SEQ ID NO: 228616 - RNA, 63 nt, hsa; identical to SEQ ID NO: 65159

SEQ ID NO: 228617 - RNA, 63 nt, hsa; identical to SEQ ID NO: 65160

SEQ ID NO: 228618 - RNA, 63 nt, hsa; identical to SEQ ID NO: 65161

SEQ ID NO: 228619 - RNA, 63 nt, hsa; identical to SEQ ID NO: 65162

SEQ ID NO: 228620 - RNA, 63 nt, hsa; identical to SEQ ID NO: 65163

SEQ ID NO: 228621 - RNA, 63 nt, hsa; identical to SEQ ID NO: 65164

SEQ ID NO: 228622 - RNA, 63 nt, hsa; identical to SEQ ID NO: 65165

SEQ ID NO: 228623 - RNA, 63 nt, hsa; identical to SEQ ID NO: 65166

SEQ ID NO: 228624 - RNA, 63 nt, hsa; identical to SEQ ID NO: 65167

SEQ ID NO: 228625 - RNA, 63 nt, hsa; identical to SEQ ID NO: 65168

SEQ ID NO: 228626 - RNA, 63 nt, hsa; identical to SEQ ID NO: 65169

SEQ ID NO: 228627 - RNA, 63 nt, hsa; identical to SEQ ID NO: 65170

SEQ ID NO: 228628 - RNA, 63 nt, hsa; identical to SEQ ID NO: 65171

SEQ ID NO: 228629 - RNA, 63 nt, hsa; identical to SEQ ID NO: 65172

SEQ ID NO: 228630 - RNA, 63 nt, hsa; identical to SEQ ID NO: 65173

SEQ ID NO: 228631 - RNA, 63 nt, hsa; identical to SEQ ID NO: 65174

SEQ ID NO: 228632 - RNA, 63 nt, hsa; identical to SEQ ID NO: 65175

SEQ ID NO: 228633 - RNA, 63 nt, hsa; identical to SEQ ID NO: 65176

SEQ ID NO: 228634 - RNA, 63 nt, hsa; identical to SEQ ID NO: 65177

SEQ ID NO: 228635 - RNA, 63 nt, hsa; identical to SEQ ID NO: 65178

SEQ ID NO: 228636 - RNA, 63 nt, hsa; identical to SEQ ID NO: 65179

SEQ ID NO: 228637 - RNA, 63 nt, hsa; identical to SEQ ID NO: 65180

SEQ ID NO: 228638 - RNA, 63 nt, hsa; identical to SEQ ID NO: 65181

SEQ ID NO: 228639 - RNA, 63 nt, hsa; identical to SEQ ID NO: 65182

SEQ ID NO: 228640 - RNA, 63 nt, hsa; identical to SEQ ID NO: 65183

SEQ ID NO: 228641 - RNA, 63 nt, hsa; identical to SEQ ID NO: 65184

SEQ ID NO: 228642 - RNA, 63 nt, hsa; identical to SEQ ID NO: 65185

SEQ ID NO: 228643 - RNA, 63 nt, hsa; identical to SEQ ID NO: 65186

SEQ ID NO: 228644 - RNA, 63 nt, hsa; identical to SEQ ID NO: 65187

SEQ ID NO: 228645 - RNA, 63 nt, hsa; identical to SEQ ID NO: 65188

SEQ ID NO: 228646 - RNA, 63 nt, hsa; identical to SEQ ID NO: 65189

SEQ ID NO: 228647 - RNA, 63 nt, hsa; identical to SEQ ID NO: 65190

SEQ ID NO: 228648 - RNA, 63 nt, hsa; identical to SEQ ID NO: 65191

SEQ ID NO: 228649 - RNA, 63 nt, hsa; identical to SEQ ID NO: 65192

SEQ ID NO: 228650 - RNA, 63 nt, hsa; identical to SEQ ID NO: 65193

SEQ ID NO: 228651 - RNA, 63 nt, hsa; identical to SEQ ID NO: 65194

SEQ ID NO: 228652 - RNA, 63 nt, hsa; identical to SEQ ID NO: 65195

SEQ ID NO: 228653 - RNA, 63 nt, hsa; identical to SEQ ID NO: 65196

SEQ ID NO: 228654 - RNA, 63 nt, hsa; identical to SEQ ID NO: 65197

SEQ ID NO: 228655 - RNA, 63 nt, hsa; identical to SEQ ID NO: 65198

SEQ ID NO: 228656 - RNA, 63 nt, hsa; identical to SEQ ID NO: 65199

SEQ ID NO: 228657 - RNA, 63 nt, hsa; identical to SEQ ID NO: 65200

SEQ ID NO: 228658 - RNA, 63 nt, hsa; identical to SEQ ID NO: 65201

SEQ ID NO: 228659 - RNA, 63 nt, hsa; identical to SEQ ID NO: 65202

SEQ ID NO: 228660 - RNA, 63 nt, hsa; identical to SEQ ID NO: 65203

SEQ ID NO: 228661 - RNA, 63 nt, hsa; identical to SEQ ID NO: 65204

SEQ ID NO: 228662 - RNA, 63 nt, hsa; identical to SEQ ID NO: 65205

SEQ ID NO: 228663 - RNA, 63 nt, hsa; identical to SEQ ID NO: 65206

SEQ ID NO: 228664 - RNA, 63 nt, hsa; identical to SEQ ID NO: 65207

SEQ ID NO: 228665 - RNA, 63 nt, hsa; identical to SEQ ID NO: 65208

SEQ ID NO: 228666 - RNA, 63 nt, hsa; identical to SEQ ID NO: 65209

SEQ ID NO: 228667 - RNA, 63 nt, hsa; identical to SEQ ID NO: 65210

SEQ ID NO: 228668 - RNA, 63 nt, hsa; identical to SEQ ID NO: 65211

SEQ ID NO: 228669 - RNA, 63 nt, hsa; identical to SEQ ID NO: 65212

SEQ ID NO: 228670 - RNA, 63 nt, hsa; identical to SEQ ID NO: 65213

SEQ ID NO: 228671 - RNA, 63 nt, hsa; identical to SEQ ID NO: 65214

SEQ ID NO: 228672 - RNA, 63 nt, hsa; identical to SEQ ID NO: 65215

SEQ ID NO: 228673 - RNA, 63 nt, hsa; identical to SEQ ID NO: 65216

SEQ ID NO: 228674 - RNA, 63 nt, hsa; identical to SEQ ID NO: 65217

SEQ ID NO: 228675 - RNA, 63 nt, hsa; identical to SEQ ID NO: 65218

SEQ ID NO: 228676 - RNA, 63 nt, hsa; identical to SEQ ID NO: 65219

SEQ ID NO: 228677 - RNA, 63 nt, hsa; identical to SEQ ID NO: 65220

SEQ ID NO: 228678 - RNA, 63 nt, hsa; identical to SEQ ID NO: 65221

SEQ ID NO: 228679 - RNA, 63 nt, hsa; identical to SEQ ID NO: 65222

SEQ ID NO: 228680 - RNA, 63 nt, hsa; identical to SEQ ID NO: 65223

SEQ ID NO: 228681 - RNA, 63 nt, hsa; identical to SEQ ID NO: 65224

SEQ ID NO: 228682 - RNA, 63 nt, hsa; identical to SEQ ID NO: 65225

SEQ ID NO: 228683 - RNA, 63 nt, hsa; identical to SEQ ID NO: 65226

SEQ ID NO: 228684 - RNA, 63 nt, hsa; identical to SEQ ID NO: 65227

SEQ ID NO: 228685 - RNA, 63 nt, hsa; identical to SEQ ID NO: 65228

SEQ ID NO: 228686 - RNA, 63 nt, hsa; identical to SEQ ID NO: 65229

SEQ ID NO: 228687 - RNA, 63 nt, hsa; identical to SEQ ID NO: 65230

SEQ ID NO: 228688 - RNA, 63 nt, hsa; identical to SEQ ID NO: 65231

SEQ ID NO: 228689 - RNA, 63 nt, hsa; identical to SEQ ID NO: 65232

SEQ ID NO: 228690 - RNA, 63 nt, hsa; identical to SEQ ID NO: 65233

SEQ ID NO: 228691 - RNA, 63 nt, hsa; identical to SEQ ID NO: 65234

SEQ ID NO: 228692 - RNA, 63 nt, hsa; identical to SEQ ID NO: 65235

SEQ ID NO: 228693 - RNA, 63 nt, hsa; identical to SEQ ID NO: 65236

SEQ ID NO: 228694 - RNA, 63 nt, hsa; identical to SEQ ID NO: 65237

SEQ ID NO: 228695 - RNA, 63 nt, hsa; identical to SEQ ID NO: 65238

SEQ ID NO: 228696 - RNA, 63 nt, hsa; identical to SEQ ID NO: 65239

SEQ ID NO: 228697 - RNA, 63 nt, hsa; identical to SEQ ID NO: 65240

SEQ ID NO: 228698 - RNA, 63 nt, hsa; identical to SEQ ID NO: 65241

SEQ ID NO: 228699 - RNA, 63 nt, hsa; identical to SEQ ID NO: 65242

SEQ ID NO: 228700 - RNA, 63 nt, hsa; identical to SEQ ID NO: 65243

SEQ ID NO: 228701 - RNA, 63 nt, hsa; identical to SEQ ID NO: 65244

SEQ ID NO: 228702 - RNA, 63 nt, hsa; identical to SEQ ID NO: 65245

SEQ ID NO: 228703 - RNA, 63 nt, hsa; identical to SEQ ID NO: 65246

SEQ ID NO: 228704 - RNA, 63 nt, hsa; identical to SEQ ID NO: 65247

SEQ ID NO: 228705 - RNA, 63 nt, hsa; identical to SEQ ID NO: 65248

SEQ ID NO: 228706 - RNA, 63 nt, hsa; identical to SEQ ID NO: 65249

SEQ ID NO: 228707 - RNA, 63 nt, hsa; identical to SEQ ID NO: 65250

SEQ ID NO: 228708 - RNA, 63 nt, hsa; identical to SEQ ID NO: 65251

SEQ ID NO: 228709 - RNA, 63 nt, hsa; identical to SEQ ID NO: 65252

SEQ ID NO: 228710 - RNA, 63 nt, hsa; identical to SEQ ID NO: 65253

SEQ ID NO: 228711 - RNA, 63 nt, hsa; identical to SEQ ID NO: 65254

SEQ ID NO: 228712 - RNA, 63 nt, hsa; identical to SEQ ID NO: 65255

SEQ ID NO: 228713 - RNA, 63 nt, hsa; identical to SEQ ID NO: 65256

SEQ ID NO: 228714 - RNA, 63 nt, hsa; identical to SEQ ID NO: 65257

SEQ ID NO: 228715 - RNA, 63 nt, hsa; identical to SEQ ID NO: 65258

SEQ ID NO: 228716 - RNA, 63 nt, hsa; identical to SEQ ID NO: 65259

SEQ ID NO: 228717 - RNA, 63 nt, hsa; identical to SEQ ID NO: 65260

SEQ ID NO: 228718 - RNA, 63 nt, hsa; identical to SEQ ID NO: 65261

SEQ ID NO: 228719 - RNA, 63 nt, hsa; identical to SEQ ID NO: 65262

SEQ ID NO: 228720 - RNA, 63 nt, hsa; identical to SEQ ID NO: 65263

SEQ ID NO: 228721 - RNA, 63 nt, hsa; identical to SEQ ID NO: 65264

SEQ ID NO: 228722 - RNA, 63 nt, hsa; identical to SEQ ID NO: 65265

SEQ ID NO: 228723 - RNA, 63 nt, hsa; identical to SEQ ID NO: 65266

SEQ ID NO: 228724 - RNA, 63 nt, hsa; identical to SEQ ID NO: 65267

SEQ ID NO: 228725 - RNA, 63 nt, hsa; identical to SEQ ID NO: 65268

SEQ ID NO: 228726 - RNA, 63 nt, hsa; identical to SEQ ID NO: 65269

SEQ ID NO: 228727 - RNA, 63 nt, hsa; identical to SEQ ID NO: 65270

SEQ ID NO: 228728 - RNA, 63 nt, hsa; identical to SEQ ID NO: 65271

SEQ ID NO: 228729 - RNA, 63 nt, hsa; identical to SEQ ID NO: 65272

SEQ ID NO: 228730 - RNA, 63 nt, hsa; identical to SEQ ID NO: 65273

SEQ ID NO: 228731 - RNA, 56 nt, hsa; identical to SEQ ID NO: 61369

SEQ ID NO: 228732 - RNA, 63 nt, hsa; identical to SEQ ID NO: 65275

SEQ ID NO: 228733 - RNA, 63 nt, hsa; identical to SEQ ID NO: 65276

SEQ ID NO: 228734 - RNA, 63 nt, hsa; identical to SEQ ID NO: 65277

SEQ ID NO: 228735 - RNA, 63 nt, hsa; identical to SEQ ID NO: 65278

SEQ ID NO: 228736 - RNA, 63 nt, hsa; identical to SEQ ID NO: 65279

SEQ ID NO: 228737 - RNA, 63 nt, hsa; identical to SEQ ID NO: 65280

SEQ ID NO: 228738 - RNA, 63 nt, hsa; identical to SEQ ID NO: 65281

SEQ ID NO: 228739 - RNA, 63 nt, hsa; identical to SEQ ID NO: 65282

SEQ ID NO: 228740 - RNA, 63 nt, hsa; identical to SEQ ID NO: 65283

SEQ ID NO: 228741 - RNA, 63 nt, hsa; identical to SEQ ID NO: 65284

SEQ ID NO: 228742 - RNA, 63 nt, hsa; identical to SEQ ID NO: 65285

SEQ ID NO: 228743 - RNA, 63 nt, hsa; identical to SEQ ID NO: 65286

SEQ ID NO: 228744 - RNA, 63 nt, hsa; identical to SEQ ID NO: 65287

SEQ ID NO: 228745 - RNA, 63 nt, hsa; identical to SEQ ID NO: 65288

SEQ ID NO: 228746 - RNA, 63 nt, hsa; identical to SEQ ID NO: 65289

SEQ ID NO: 228747 - RNA, 63 nt, hsa; identical to SEQ ID NO: 65290

SEQ ID NO: 228748 - RNA, 63 nt, hsa; identical to SEQ ID NO: 65291

SEQ ID NO: 228749 - RNA, 63 nt, hsa; identical to SEQ ID NO: 65292

SEQ ID NO: 228750 - RNA, 63 nt, hsa; identical to SEQ ID NO: 65293

SEQ ID NO: 228751 - RNA, 63 nt, hsa; identical to SEQ ID NO: 65294

SEQ ID NO: 228752 - RNA, 63 nt, hsa; identical to SEQ ID NO: 65295

SEQ ID NO: 228753 - RNA, 63 nt, hsa; identical to SEQ ID NO: 65296

SEQ ID NO: 228754 - RNA, 63 nt, hsa; identical to SEQ ID NO: 65297

SEQ ID NO: 228755 - RNA, 63 nt, hsa; identical to SEQ ID NO: 65298

SEQ ID NO: 228756 - RNA, 63 nt, hsa; identical to SEQ ID NO: 65299

SEQ ID NO: 228757 - RNA, 63 nt, hsa; identical to SEQ ID NO: 65300

SEQ ID NO: 228758 - RNA, 63 nt, hsa; identical to SEQ ID NO: 65301

SEQ ID NO: 228759 - RNA, 63 nt, hsa; identical to SEQ ID NO: 65302

SEQ ID NO: 228760 - RNA, 63 nt, hsa; identical to SEQ ID NO: 65303

SEQ ID NO: 228761 - RNA, 63 nt, hsa; identical to SEQ ID NO: 65304

SEQ ID NO: 228762 - RNA, 63 nt, hsa; identical to SEQ ID NO: 65305

SEQ ID NO: 228763 - RNA, 63 nt, hsa; identical to SEQ ID NO: 65306

SEQ ID NO: 228764 - RNA, 63 nt, hsa; identical to SEQ ID NO: 65307

SEQ ID NO: 228765 - RNA, 63 nt, hsa; identical to SEQ ID NO: 65308

SEQ ID NO: 228766 - RNA, 63 nt, hsa; identical to SEQ ID NO: 65309

SEQ ID NO: 228767 - RNA, 63 nt, hsa; identical to SEQ ID NO: 65310

SEQ ID NO: 228768 - RNA, 63 nt, hsa; identical to SEQ ID NO: 65311

SEQ ID NO: 228769 - RNA, 63 nt, hsa; identical to SEQ ID NO: 65312

SEQ ID NO: 228770 - RNA, 63 nt, hsa; identical to SEQ ID NO: 65313

SEQ ID NO: 228771 - RNA, 63 nt, hsa; identical to SEQ ID NO: 65314

SEQ ID NO: 228772 - RNA, 63 nt, hsa; identical to SEQ ID NO: 65315

SEQ ID NO: 228773 - RNA, 63 nt, hsa; identical to SEQ ID NO: 65316

SEQ ID NO: 228774 - RNA, 63 nt, hsa; identical to SEQ ID NO: 65317

SEQ ID NO: 228775 - RNA, 63 nt, hsa; identical to SEQ ID NO: 65318

SEQ ID NO: 228776 - RNA, 63 nt, hsa; identical to SEQ ID NO: 65319

SEQ ID NO: 228777 - RNA, 63 nt, hsa; identical to SEQ ID NO: 65320

SEQ ID NO: 228778 - RNA, 63 nt, hsa; identical to SEQ ID NO: 65321

SEQ ID NO: 228779 - RNA, 63 nt, hsa; identical to SEQ ID NO: 65322

SEQ ID NO: 228780 - RNA, 63 nt, hsa; identical to SEQ ID NO: 65323

SEQ ID NO: 228781 - RNA, 63 nt, hsa; identical to SEQ ID NO: 65324

SEQ ID NO: 228782 - RNA, 63 nt, hsa; identical to SEQ ID NO: 65325

SEQ ID NO: 228783 - RNA, 63 nt, hsa; identical to SEQ ID NO: 65326

SEQ ID NO: 228784 - RNA, 63 nt, hsa; identical to SEQ ID NO: 65327

SEQ ID NO: 228785 - RNA, 63 nt, hsa; identical to SEQ ID NO: 65328

SEQ ID NO: 228786 - RNA, 63 nt, hsa; identical to SEQ ID NO: 65329

SEQ ID NO: 228787 - RNA, 63 nt, hsa; identical to SEQ ID NO: 65330

SEQ ID NO: 228788 - RNA, 63 nt, hsa; identical to SEQ ID NO: 65331

SEQ ID NO: 228789 - RNA, 63 nt, hsa; identical to SEQ ID NO: 65332

SEQ ID NO: 228790 - RNA, 63 nt, hsa; identical to SEQ ID NO: 65333

SEQ ID NO: 228791 - RNA, 63 nt, hsa; identical to SEQ ID NO: 65334

SEQ ID NO: 228792 - RNA, 63 nt, hsa; identical to SEQ ID NO: 65335

SEQ ID NO: 228793 - RNA, 63 nt, hsa; identical to SEQ ID NO: 65336

SEQ ID NO: 228794 - RNA, 63 nt, hsa; identical to SEQ ID NO: 65337

SEQ ID NO: 228795 - RNA, 63 nt, hsa; identical to SEQ ID NO: 65338

SEQ ID NO: 228796 - RNA, 63 nt, hsa; identical to SEQ ID NO: 65339

SEQ ID NO: 228797 - RNA, 63 nt, hsa; identical to SEQ ID NO: 65340

SEQ ID NO: 228798 - RNA, 63 nt, hsa; identical to SEQ ID NO: 65341

SEQ ID NO: 228799 - RNA, 63 nt, hsa; identical to SEQ ID NO: 65342

SEQ ID NO: 228800 - RNA, 63 nt, hsa; identical to SEQ ID NO: 65343

SEQ ID NO: 228801 - RNA, 63 nt, hsa; identical to SEQ ID NO: 65344

SEQ ID NO: 228802 - RNA, 63 nt, hsa; identical to SEQ ID NO: 65345

SEQ ID NO: 228803 - RNA, 63 nt, hsa; identical to SEQ ID NO: 65346

SEQ ID NO: 228804 - RNA, 63 nt, hsa; identical to SEQ ID NO: 65347

SEQ ID NO: 228805 - RNA, 63 nt, hsa; identical to SEQ ID NO: 65348

SEQ ID NO: 228806 - RNA, 63 nt, hsa; identical to SEQ ID NO: 65349

SEQ ID NO: 228807 - RNA, 63 nt, hsa; identical to SEQ ID NO: 65350

SEQ ID NO: 228808 - RNA, 63 nt, hsa; identical to SEQ ID NO: 65351

SEQ ID NO: 228809 - RNA, 63 nt, hsa; identical to SEQ ID NO: 65352

SEQ ID NO: 228810 - RNA, 63 nt, hsa; identical to SEQ ID NO: 65353

SEQ ID NO: 228811 - RNA, 63 nt, hsa; identical to SEQ ID NO: 65354

SEQ ID NO: 228812 - RNA, 63 nt, hsa; identical to SEQ ID NO: 65355

SEQ ID NO: 228813 - RNA, 63 nt, hsa; identical to SEQ ID NO: 65356

SEQ ID NO: 228814 - RNA, 63 nt, hsa; identical to SEQ ID NO: 65357

SEQ ID NO: 228815 - RNA, 63 nt, hsa; identical to SEQ ID NO: 65358

SEQ ID NO: 228816 - RNA, 63 nt, hsa; identical to SEQ ID NO: 65359

SEQ ID NO: 228817 - RNA, 63 nt, hsa; identical to SEQ ID NO: 65360

SEQ ID NO: 228818 - RNA, 63 nt, hsa; identical to SEQ ID NO: 65361

SEQ ID NO: 228819 - RNA, 63 nt, hsa; identical to SEQ ID NO: 65362

SEQ ID NO: 228820 - RNA, 63 nt, hsa; identical to SEQ ID NO: 65363

SEQ ID NO: 228821 - RNA, 63 nt, hsa; identical to SEQ ID NO: 65364

SEQ ID NO: 228822 - RNA, 63 nt, hsa; identical to SEQ ID NO: 65365

SEQ ID NO: 228823 - RNA, 60 nt, hsa; identical to SEQ ID NO: 65087

SEQ ID NO: 228824 - RNA, 63 nt, hsa; identical to SEQ ID NO: 65367

SEQ ID NO: 228825 - RNA, 63 nt, hsa; identical to SEQ ID NO: 65368

SEQ ID NO: 228826 - RNA, 63 nt, hsa; identical to SEQ ID NO: 65369

SEQ ID NO: 228827 - RNA, 63 nt, hsa; identical to SEQ ID NO: 65370

SEQ ID NO: 228828 - RNA, 63 nt, hsa; identical to SEQ ID NO: 65371

SEQ ID NO: 228829 - RNA, 63 nt, hsa; identical to SEQ ID NO: 65372

SEQ ID NO: 228830 - RNA, 51 nt, hsa; identical to SEQ ID NO: 65094

SEQ ID NO: 228831 - RNA, 63 nt, hsa; identical to SEQ ID NO: 65374

SEQ ID NO: 228832 - RNA, 63 nt, hsa; identical to SEQ ID NO: 65375

SEQ ID NO: 228833 - RNA, 63 nt, hsa; identical to SEQ ID NO: 65376

SEQ ID NO: 228834 - RNA, 63 nt, hsa; identical to SEQ ID NO: 65377

SEQ ID NO: 228835 - RNA, 63 nt, hsa; identical to SEQ ID NO: 65378

SEQ ID NO: 228836 - RNA, 63 nt, hsa; identical to SEQ ID NO: 65379

SEQ ID NO: 228837 - RNA, 63 nt, hsa; identical to SEQ ID NO: 65380

SEQ ID NO: 228838 - RNA, 63 nt, hsa; identical to SEQ ID NO: 65381

SEQ ID NO: 228839 - RNA, 63 nt, hsa; identical to SEQ ID NO: 65382

SEQ ID NO: 228840 - RNA, 63 nt, hsa; identical to SEQ ID NO: 65383

SEQ ID NO: 228841 - RNA, 63 nt, hsa; identical to SEQ ID NO: 65384

SEQ ID NO: 228842 - RNA, 63 nt, hsa; identical to SEQ ID NO: 65385

SEQ ID NO: 228843 - RNA, 63 nt, hsa; identical to SEQ ID NO: 65386

SEQ ID NO: 228844 - RNA, 63 nt, hsa; identical to SEQ ID NO: 65387

SEQ ID NO: 228845 - RNA, 63 nt, hsa; identical to SEQ ID NO: 65388

SEQ ID NO: 228846 - RNA, 63 nt, hsa; identical to SEQ ID NO: 65389

SEQ ID NO: 228847 - RNA, 63 nt, hsa; identical to SEQ ID NO: 65390

SEQ ID NO: 228848 - RNA, 63 nt, hsa; identical to SEQ ID NO: 65391

SEQ ID NO: 228849 - RNA, 63 nt, hsa; identical to SEQ ID NO: 65392

SEQ ID NO: 228850 - RNA, 63 nt, hsa; identical to SEQ ID NO: 65393

SEQ ID NO: 228851 - RNA, 63 nt, hsa; identical to SEQ ID NO: 65394

SEQ ID NO: 228852 - RNA, 63 nt, hsa; identical to SEQ ID NO: 65395

SEQ ID NO: 228853 - RNA, 63 nt, hsa; identical to SEQ ID NO: 65396

SEQ ID NO: 228854 - RNA, 63 nt, hsa; identical to SEQ ID NO: 65397

SEQ ID NO: 228855 - RNA, 63 nt, hsa; identical to SEQ ID NO: 65398

SEQ ID NO: 228856 - RNA, 63 nt, hsa; identical to SEQ ID NO: 65399

SEQ ID NO: 228857 - RNA, 63 nt, hsa; identical to SEQ ID NO: 65400

SEQ ID NO: 228858 - RNA, 63 nt, hsa; identical to SEQ ID NO: 65401

SEQ ID NO: 228859 - RNA, 63 nt, hsa; identical to SEQ ID NO: 65402

SEQ ID NO: 228860 - RNA, 63 nt, hsa; identical to SEQ ID NO: 65403

SEQ ID NO: 228861 - RNA, 63 nt, hsa; identical to SEQ ID NO: 65404

SEQ ID NO: 228862 - RNA, 63 nt, hsa; identical to SEQ ID NO: 65405

SEQ ID NO: 228863 - RNA, 63 nt, hsa; identical to SEQ ID NO: 65406

SEQ ID NO: 228864 - RNA, 63 nt, hsa; identical to SEQ ID NO: 65407

SEQ ID NO: 228865 - RNA, 63 nt, hsa; identical to SEQ ID NO: 65408

SEQ ID NO: 228866 - RNA, 63 nt, hsa; identical to SEQ ID NO: 65409

SEQ ID NO: 228867 - RNA, 63 nt, hsa; identical to SEQ ID NO: 65410

SEQ ID NO: 228868 - RNA, 63 nt, hsa; identical to SEQ ID NO: 65411

SEQ ID NO: 228869 - RNA, 63 nt, hsa; identical to SEQ ID NO: 65412

SEQ ID NO: 228870 - RNA, 63 nt, hsa; identical to SEQ ID NO: 65413

SEQ ID NO: 228871 - RNA, 63 nt, hsa; identical to SEQ ID NO: 65414

SEQ ID NO: 228872 - RNA, 64 nt, hsa
gggaacaucgacuucuaauccagcuuucuuguuuaauuaugaccuaaaucuaauuuacuuccac

SEQ ID NO: 228873 - RNA, 64 nt, hsa
auaggugucauugaaauguaaaaucuaaguaugaaauuaugaaaggacauucuuuaauuacugc

SEQ ID NO: 228874 - RNA, 64 nt, hsa
auuucaauaguauaugaguaugagauuucuuaucaauuaugagugaaauauucuaucugaaugc

SEQ ID NO: 228875 - RNA, 64 nt, hsa
ucauagcuuuuggcucaaauaaacaaucaagaauaauuaugagagaaaacacaaaucuaaagua

SEQ ID NO: 228876 - RNA, 64 nt, hsa
uccuucaaaauaauuuuagacaaugccauaacuuaauuaugauuuucuagcacuugauuaaagu

SEQ ID NO: 228877 - RNA, 64 nt, hsa
ggacacgaucaugcuugagcaugugaguuagucaaauuaugagucccugccuauuguccauuac

SEQ ID NO: 228878 - RNA, 64 nt, hsa
uuuauuuccucuuacaauccauguuuucagguagaauuaugacuuuccccccauuguuacacau

SEQ ID NO: 228879 - RNA, 64 nt, hsa
ugugcugucuauguggacacuuugguaaaaugcaaauuaugauauggacguuaucauuggucug

SEQ ID NO: 228880 - RNA, 64 nt, hsa
ugagauguuucauauuugugacaguuaauuuaaaaauuaugaguuaaugcugccugugucuaug

SEQ ID NO: 228881 - RNA, 64 nt, hsa
acccuaaagauguguuuuauuauaaauaauauucaauuaugaaacaaaaaaauuaugauguuuu

SEQ ID NO: 228882 - RNA, 64 nt, hsa
uuauuauaaauaauauucaauuaugaaacaaaaaaauuaugauguuuuucaaaaugcaagugag

SEQ ID NO: 228883 - RNA, 64 nt, hsa
auauuuaucaguugcagauagccuauuuauuauaaauuaugagaugaugaaaauaauaaagcca

SEQ ID NO: 228884 - RNA, 64 nt, hsa
gcuaaauuuuucuuaaucaagaauauucaaauguaauuaugaggugaaacaauuauuguacacu

SEQ ID NO: 228885 - RNA, 64 nt, hsa
gccauguacauauuacagcaugacaagcucaaauaauuaugagucagcccgaaaggauguuaau

SEQ ID NO: 228886 - RNA, 64 nt, hsa
agcucuuaaguagggguauuuucuacuguugcuuaauuaugauggaagauaacauugucauucc

SEQ ID NO: 228887 - RNA, 64 nt, hsa
cagagauuuaauuuuauauugaaagucagugcaaaauuaugaauaggauauacuaauaaauaca

SEQ ID NO: 228888 - RNA, 64 nt, hsa
auuuugucucaaaaguggaaaaauuauauugucuaauuaugaugaauuauuuucuuguaucaag

SEQ ID NO: 228889 - RNA, 64 nt, hsa
gauuagaugccacuaaucuccaaagauucccuccaauuaugaaauauuuuaaugucuacuuuua

SEQ ID NO: 228890 - RNA, 64 nt, hsa
gaauuauuaaauauuccauuuccgcuuuggcuacaauuaugaagaaguugaagguacuucuuuu

SEQ ID NO: 228891 - RNA, 64 nt, hsa
auccauuauuuuaaauaaacuaauagguuuucagaauuaugaauuuuucagaacucauccaguc

SEQ ID NO: 228892 - RNA, 64 nt, hsa
caaaugugagcaaaucuguuuuacuguuaacuucaauuaugaacuugaaauugugccacaugac

SEQ ID NO: 228893 - RNA, 64 nt, hsa
cuggcuuacaaugagaugcuucaaaugaaaagggaauuaugaguaaaauugaacuuugaugggg

SEQ ID NO: 228894 - RNA, 64 nt, hsa
acuauugcccauguuccccagggucagaaguucuaauuaugaugauagaggcuggguuguaagu

SEQ ID NO: 228895 - RNA, 64 nt, hsa
uugccguaaugauucuauaaugccaucaugcagcaauuaugagaggcuaggucauccaaagaga

SEQ ID NO: 228896 - RNA, 64 nt, hsa
acugauuacaaauacuuuccuauucauacuuuccaauuaugagauggacuguggguacugggag

SEQ ID NO: 228897 - RNA, 64 nt, hsa
aauaauauuggggaccaaaucaaaugaaugauuaaauuaugaagcucauauccuuuugaaggua

SEQ ID NO: 228898 - RNA, 64 nt, hsa
aaaacauuugauuaauaaaauaucuauuugaauaaauuaugagcuauccuuucaaacagcuauu

SEQ ID NO: 228899 - RNA, 64 nt, hsa
ugugaauccagccucagacugagugaacuguaauaauuaugaauucauuacagaguccaggugg

SEQ ID NO: 228900 - RNA, 64 nt, hsa
cuucuuguuaaauugggaggaaauuuaugauagcaauuaugaagauuguuuuaugacauucuuu

SEQ ID NO: 228901 - RNA, 64 nt, hsa
cacaggaucagcaccuuguauaggaauucccaugaauuaugacuucucauucuguuuuaucaga

SEQ ID NO: 228902 - RNA, 64 nt, hsa
uuaaacuaaugaaugacauuuagauacuucauaaaauuaugaacagauauggaggccagagcuc

SEQ ID NO: 228903 - RNA, 64 nt, hsa
ccagagauuuaagaagaaaaccucuaaauuucaaaauuaugaagaauuacagaauuacucauuu

SEQ ID NO: 228904 - RNA, 64 nt, hsa
uggcuaauucuguaacauagucuugguauuuuuuaauuaugaaugcauauccuauuuccaggca

SEQ ID NO: 228905 - RNA, 64 nt, hsa
uaggcgguuuucauacauuuuucaccuuguacaaaauuaugaauucauuuuuccuccaggccga

SEQ ID NO: 228906 - RNA, 64 nt, hsa
uucuacuuuuaauuucuguguguuggccauacugaauuaugagacuaacagaugucuacaauac

SEQ ID NO: 228907 - RNA, 64 nt, hsa
acaaugaaaauuaucaagagauaauuuaccuuucaauuaugauaaauagaugugauugguugcc

SEQ ID NO: 228908 - RNA, 64 nt, hsa
uucucauuugcuuuaaaaaauuuaaaaguguaaaaauuaugagagacuuuauucguuaacaaug

SEQ ID NO: 228909 - RNA, 64 nt, hsa
aacuuguauguauacauauauacacauaacauccaauuaugacuggguaauaagugugaaaauu

SEQ ID NO: 228910 - RNA, 64 nt, hsa
guagccuauucucuuaaaaaguaugugaaaagaaaauuaugaaaaaauaugcauaccuaaugaa

SEQ ID NO: 228911 - RNA, 64 nt, hsa
auuucaauuuccaccaugggagagccuaaaaauaaauuaugacauuuaguaucuaagguuagaa

SEQ ID NO: 228912 - RNA, 64 nt, hsa
ccagugaguaccugcaaaaaugaguugucacagaaauuaugauccucuauuuccugaaccugga

SEQ ID NO: 228913 - RNA, 64 nt, hsa
cggcagaccucuuagaguccuuaagacggaaguaaauuaugauguccagggggagaaggaagau

SEQ ID NO: 228914 - RNA, 64 nt, hsa
gagaggaaucuuguuuuugugugcaacauaagaaaauuaugaaaacuaauagccaaaaaaccuu

SEQ ID NO: 228915 - RNA, 64 nt, hsa
uagaacuaggcauaaccuuacauaauacuaggaaaauuaugagaaaggggaaauuuuugguuaa

SEQ ID NO: 228916 - RNA, 64 nt, hsa
aguagauauuaauuugauaccuucaugguaaugaaauuaugauggagcuguguuauaaauuccu

SEQ ID NO: 228917 - RNA, 64 nt, hsa
caaauguccccuuuuuaccaauacuuuuucauuaaauuaugaaaacugcuaccuacugucagug

SEQ ID NO: 228918 - RNA, 64 nt, hsa
auuuuguuucccaucucuuucuagguguuugcaauguacaaauaauacagcugugcuaaucuca

SEQ ID NO: 228919 - RNA, 64 nt, hsa
uggucacuucuuuacuauuuaaaauacuacacauuguacaaaauaucgaagacacuaccauaug

SEQ ID NO: 228920 - RNA, 64 nt, hsa
cuuuuuuuucugaaggcuuguuuuuaguccucauuguacaaaauauaaaauaaucauauugcua

SEQ ID NO: 228921 - RNA, 64 nt, hsa
aauuaauugccaguuuuuacaugugauagucaguuguacaaagaaaaugcacuuaaaccuguuu

SEQ ID NO: 228922 - RNA, 64 nt, hsa
aucagucagugcuggagaaaucuugaauagcuuauguacaaaacuuuuuaaauuuuauauuauu

SEQ ID NO: 228923 - RNA, 64 nt, hsa
cagggagacuccgcugugggaaaccucauuguucuguacaaaguacuagcuaaaccagaaaggu

SEQ ID NO: 228924 - RNA, 64 nt, hsa
uacaagcguaccuaaugcacacuuuaucuuuuauuguacaaagaaauaguguacaaaauucuuu

SEQ ID NO: 228925 - RNA, 64 nt, hsa
ugcacacuuuaucuuuuauuguacaaagaaauaguguacaaaauucuuugguuucuauggagua

SEQ ID NO: 228926 - RNA, 64 nt, hsa
uggaaaacacaaaaguaacuuguuuaucucagucuguacaaaaacaguaaggaggcagaaagcc

SEQ ID NO: 228927 - RNA, 64 nt, hsa
ccaugcuacuaguuucucugucuauucacacauauguacaaauacaugaacacagccugucugu

SEQ ID NO: 228928 - RNA, 64 nt, hsa
uugcugugauacuucauuuuuaaauugugaacuuuguacaaauuuugucaugcuggauguuaac

SEQ ID NO: 228929 - RNA, 64 nt, hsa
uauguauaucccagcggcacuuuauacuguucacuguacaaaagcuuacaguuuuccacaagga

SEQ ID NO: 228930 - RNA, 64 nt, hsa
gagaggcaaugugaaagagggaguauuacuuuuauguacaaaguuauuuauuuauagaaauuuu

SEQ ID NO: 228931 - RNA, 64 nt, hsa
gaucugaagcacaguaaacgcaagaggggauuuguguacaaaaggcaaaaaaaguauuugauau

SEQ ID NO: 228932 - RNA, 64 nt, hsa
augcacacuaaauuaaaugugacauaaauuaauuuguacaaaaagaacucuuuauaagguggcu

SEQ ID NO: 228933 - RNA, 64 nt, hsa
gcugaauaaagaccgaugaagagguuugaguagauguacaaaucaaguaaugguuugaacaccu

SEQ ID NO: 228934 - RNA, 64 nt, hsa
auaaauauauuuucaauuguguacaaauuaaggguguacaaauuauaauaaugcaucucuaucu

SEQ ID NO: 228935 - RNA, 64 nt, hsa
cuuguaaaauuucacauaaauauauuuucaauuguguacaaauuaaggguguacaaauuauaau

SEQ ID NO: 228936 - RNA, 64 nt, hsa
ugccucccacuccauaccccgccaaggaaaggcauguacaaaaauuaugcaauucaguguucca

SEQ ID NO: 228937 - RNA, 64 nt, hsa
auuagugauguccuuaaaauguggucugccaaucuguacaaaaugguccuauuuuugugaagag

SEQ ID NO: 228938 - RNA, 64 nt, hsa
cgagccguggaccccggccaggaaccacuccuguuguacaaagcucacacccaccgcccagguc

SEQ ID NO: 228939 - RNA, 64 nt, hsa
guguaaauuguguuauuauguauauggguaaagauguacaaauauauguccucuuuguagcaga

SEQ ID NO: 228940 - RNA, 64 nt, hsa
uugaaagcuuuuuaggaaauuuugacaguauuuuuguacaaaacauuuuuuugaaaaaauacuu

SEQ ID NO: 228941 - RNA, 64 nt, hsa
uuugagaacuuggaaacaaaguaaacuauaaacuuguacaaauugguuuuaaaaaaaauugcug

SEQ ID NO: 228942 - RNA, 64 nt, hsa
uaauuucuaauauuuuuaaaguuuauauucgaguuguacaaaguuaagcauuaaucagauauuu

SEQ ID NO: 228943 - RNA, 64 nt, hsa
aaagaggaaauggacagcaugcaauucauccuaauguacaaaacguuauaugcacucaaauguu

SEQ ID NO: 228944 - RNA, 64 nt, hsa
cuacuaugcauuaaaucuugaacuuuauaaaacauguacaaaaauuguacaagauaaguuccac

SEQ ID NO: 228945 - RNA, 64 nt, hsa
uguaacuuaauauacuagauguuaagguuguuaauguacaaaaaaaaaacccuuauacucaccu

SEQ ID NO: 228946 - RNA, 64 nt, hsa
uugucauuuuuuccaguauucaauaaguagccuuuguacaaauuuaaaaccaaaaacuauucug

SEQ ID NO: 228947 - RNA, 64 nt, hsa
uuuguuuuauuggaaaacuucauguuaacuagaguguacaaaaagucuguuuccugcugagcca

SEQ ID NO: 228948 - RNA, 64 nt, hsa
caguauuuauugaacagcugucuaugccaggcucuguacaaagugauaggaguagagcugugaa

SEQ ID NO: 228949 - RNA, 64 nt, hsa
uggaauuacuucucccauguugccauuuuugagguguacaaaggucaggccguacacaccucug

SEQ ID NO: 228950 - RNA, 64 nt, hsa
ccccauauguauauaguauguuguacacugcacauguacaaagaaugucuucagaucaaagaaa

SEQ ID NO: 228951 - RNA, 64 nt, hsa
cccuuaagaugaaaaguuccuuuucuuguguuaauguacaaagcuuuucuuuuggcacugacaa

SEQ ID NO: 228952 - RNA, 64 nt, hsa
aaaguaccauuuuugugguuguuuggagcagggauguacaaaauaauuuuaauguauuaacuca

SEQ ID NO: 228953 - RNA, 64 nt, hsa
uguaaaccuagaacugcggaaggacugggacuuuuguacaaauuucacauuuauuuuacagcaa

SEQ ID NO: 228954 - RNA, 64 nt, hsa
uuuauuuugcauuggagaacuccuggagauaagcuguacaaauugaaucuauguggaaaugcuu

SEQ ID NO: 228955 - RNA, 64 nt, hsa
cagcuuguaauguuguauacacauuuauucuguuuguacaaagguuuuccauucuauggagagg

SEQ ID NO: 228956 - RNA, 64 nt, hsa
ucaacaauauucuuccaaaauggcauacaucuuuuguacaaagaacuugaaauguaaauacugu

SEQ ID NO: 228957 - RNA, 64 nt, hsa
ucuaaaaauguaaaaaccauguuuagcuugcagcuguacaaaaacugcccaccagccagaugug

SEQ ID NO: 228958 - RNA, 64 nt, hsa
gcgauuuuaccuuuguugaauuuguauaaacaauuguacaaaaaaaaccacucuugaacuuuga

SEQ ID NO: 228959 - RNA, 64 nt, hsa
uuuuguuacaucuuacauuaugcagaacuauuuuuguacaaauuguuuaaaaguuauuuaugca

SEQ ID NO: 228960 - RNA, 64 nt, hsa
uaaaagguuauuacgaauuuuguuguacaaaaucuguacaaaaaucuguuuuuacaucauaaug

SEQ ID NO: 228961 - RNA, 64 nt, hsa
ucuaaaaaugauaaaagguuauuacgaauuuuguuguacaaaaucuguacaaaaaucuguuuuu

SEQ ID NO: 228962 - RNA, 64 nt, hsa
uaucuuucaggaaauuuuugcauguuuaauaauauguacaaauaauauugccuugauguuucua

SEQ ID NO: 228963 - RNA, 64 nt, hsa
cacguuuuccauuaugaggaaacuuggacauuuauguacaaaaugaauugccuuugauaauucu

SEQ ID NO: 228964 - RNA, 64 nt, hsa
uguggguaaaauaugcaaacgaaaagaaauauauuguacaaauucuauauaauaagguacgccu

SEQ ID NO: 228965 - RNA, 64 nt, hsa
gcuguaaagaaauccuguuccagagcauaccuguuguacaaacagacacuguuccuaacgagag

SEQ ID NO: 228966 - RNA, 64 nt, hsa
cauauaauucucccugcaaggauguaugauaauauguacaaaguaauuccaacugaggaagcuc

SEQ ID NO: 228967 - RNA, 64 nt, hsa
uucaaacagauacagcaugguccagagucccagauguacaaaaacagggauucaucacaaaucc

SEQ ID NO: 228968 - RNA, 64 nt, hsa
acaaccgggugaguauagucaauaauagcuuaauuguacaaauaacuaagaguauaauuggauu

SEQ ID NO: 228969 - RNA, 64 nt, hsa
aggggugugcgaggggaacuggggaugcuuaauguguacaaaaacuauguaguuagaaaguaua

SEQ ID NO: 228970 - RNA, 64 nt, hsa
caaacauuaucuccuuuaguuuuucagaaaaugcaucccugauuucauucauuuccagcuugaa

SEQ ID NO: 228971 - RNA, 64 nt, hsa
caaauuaacgaguauuauaaaaggauaauaaagcaucccugaagccaaagauccucaaagucau

SEQ ID NO: 228972 - RNA, 64 nt, hsa
cuguggcucccaauauagggugcagacaagagcaaucccugacaugacauuauagccugggaaa

SEQ ID NO: 228973 - RNA, 64 nt, hsa
gugucuguggccacaauccuguacuguuccuuccaucccugauaaaaggaggucuacaugaaag

SEQ ID NO: 228974 - RNA, 64 nt, hsa
cauuuuucugaaaauucaugaacuauucucucauaucccugaaauauaaaaguaaguggccacu

SEQ ID NO: 228975 - RNA, 64 nt, hsa
aacagaccuaauuuggauggggagaaaaacucucaucccugacccuuccccccccgcaaauguu

SEQ ID NO: 228976 - RNA, 64 nt, hsa
gugugaaaucacacucuuccucugggcauccuggaucccugaauuauccccccccccaugaagu

SEQ ID NO: 228977 - RNA, 64 nt, hsa
ggaaauaaaagucaccccguuggugagaggugcuaucccugagucucagugcaggaccagugga

SEQ ID NO: 228978 - RNA, 64 nt, hsa
uccugcaaccaaacucccaucagcccaaucccugaucccugaucccuuccaccugcucugcuga

SEQ ID NO: 228979 - RNA, 64 nt, hsa
aagcaaguccugcaaccaaacucccaucagcccaaucccugaucccugaucccuuccaccugcu

SEQ ID NO: 228980 - RNA, 64 nt, hsa
uuacaggcggcuauugcagacggcuaauuuaugcuuaacuuaggaagagauaaggcaagagcua

SEQ ID NO: 228981 - RNA, 64 nt, hsa
gauuuuuuucaugugaucuuuuccaagcuucaacuuaacuuaacuacauuucucuguaugauga

SEQ ID NO: 228982 - RNA, 64 nt, hsa
auuauauaguuuguacugagcuauugaagucccauuaacuuaaaguauauguuuucaaauugcc

SEQ ID NO: 228983 - RNA, 64 nt, hsa
uuguuuuugacuuuggaagagaugaacuguguauuuaacuuaagcuauugcucuuaaaaccagg

SEQ ID NO: 228984 - RNA, 64 nt, hsa
ccagccauuugacacccuuuaugaugucacaccuuuaacuuaaggagacggguaaaggaucuua

SEQ ID NO: 228985 - RNA, 64 nt, hsa
auugacacugauuuggauuugugcacucuaauuuuuaacuuauugaugcucuauugugcaguag

SEQ ID NO: 228986 - RNA, 64 nt, hsa
uaucgucuuugaaaauguuaaauugagaaaccuguuaacuuacauuuuaugaauuggcacauug

SEQ ID NO: 228987 - RNA, 64 nt, hsa
aauggcuuuucuuuugcaacaguuaauguauuuauuaacuuaauaauuacuuuaugucuucuau

SEQ ID NO: 228988 - RNA, 64 nt, hsa
uugaagccaaaauucuaguuuuccaauauaagguuuaacuuacaguuuuuuauguagccaaagg

SEQ ID NO: 228989 - RNA, 64 nt, hsa
ggacugaauuuauugugaaguaacauuggcaaucuuaacuuauucauuuaacuuauuuuuauag

SEQ ID NO: 228990 - RNA, 64 nt, hsa
ugugaaguaacauuggcaaucuuaacuuauucauuuaacuuauuuuuauagcuagauaaauauu

SEQ ID NO: 228991 - RNA, 64 nt, hsa
acuuuguuuuuaagcaauaggucuggauacacauuuaacuuaggaggcuccuccaauuugccuc

SEQ ID NO: 228992 - RNA, 64 nt, hsa
gacuucuuuuauguauacuggaguucaaagaucuuuaacuuaccuggcuuaauguaauuucaca

SEQ ID NO: 228993 - RNA, 64 nt, hsa
aauaugaccaaaauauuuaaaaugcacaaugcuuuuaacuuaaaugugcuaacccuguuucugu

SEQ ID NO: 228994 - RNA, 64 nt, hsa
gggacuaaguguuuaugggacaauuauguacuauuuaacuuaaauauauuuuguuuaauaggaa

SEQ ID NO: 228995 - RNA, 64 nt, hsa
uucuuauuuaacuuaacauucuguaaaaugucuguuaacuuaauaguauuuaugaaaugguuaa

SEQ ID NO: 228996 - RNA, 64 nt, hsa
uccuccaggcaaaauugauauacuuuuuucuuauuuaacuuaacauucuguaaaaugucuguua

SEQ ID NO: 228997 - RNA, 64 nt, hsa
guauuuaaacucuagacacaguuuuuauccuggauuaacuuagauaacuuuuguagcagugguu

SEQ ID NO: 228998 - RNA, 64 nt, hsa
ugauuuacuauaaugauauauacaugcaagauauuuaacuuaauaucuuagacaagaguucugg

SEQ ID NO: 228999 - RNA, 64 nt, hsa
auauugaucccaaaguuacuuugacugcauuaacuuaacuuacggggugggggcgggggugagg

SEQ ID NO: 229000 - RNA, 64 nt, hsa
ugcuaauauugaucccaaaguuacuuugacugcauuaacuuaacuuacggggugggggcggggg

SEQ ID NO: 229001 - RNA, 64 nt, hsa
aguguuguauuucuauacaguagcuugaaauugauuaacuuauacuguagguguuauguauucc

SEQ ID NO: 229002 - RNA, 64 nt, hsa
uagauucaugcaaguggagcugucugucucuaauuuaacuuauugcuagauaauaggguuuuca

SEQ ID NO: 229003 - RNA, 64 nt, hsa
gccuaauuuguagauugugaaagcagcuuuuaguuuaacuuauucacagaccccuuauaauuac

SEQ ID NO: 229004 - RNA, 64 nt, hsa
guuuuccccaccaaguggccucuuagacuagucauuaacuuaugauuagcucuaaagauuucaa

SEQ ID NO: 229005 - RNA, 64 nt, hsa
ucaagaucaggaaaacacccuuuugcuagugugcuuaacuuauuuauuucuucuaggaaacaau

SEQ ID NO: 229006 - RNA, 64 nt, hsa
aacaucauaucauauaggauaacaaaggaggaaguuaacuuaauucaccucagacuucagccua

SEQ ID NO: 229007 - RNA, 64 nt, hsa
agggaguuacucagccuaauugagcccuauuauuuuaacuuaacaaaauaaauacagaaguacc

SEQ ID NO: 229008 - RNA, 64 nt, hsa
uugauuggcauaugguaauagagcaaccauagccuuaacuuacagaccugugaaauaaagggca

SEQ ID NO: 229009 - RNA, 64 nt, hsa
uguuuuuugaagcacuuugagaaauuaauuuuaauuaacuuaaugagcaaauuuuuauuacuac

SEQ ID NO: 229010 - RNA, 64 nt, hsa
augcuacaaggaauauuaaaaaaaucuauucacuuuaacuuauaauaguuuaugaaauaaaaac

SEQ ID NO: 229011 - RNA, 64 nt, hsa
uguuuuguuucguuuucuccuuaauagaaaaauguuaacuuacugggaauagcuacucagccuu

SEQ ID NO: 229012 - RNA, 64 nt, hsa
uacaaguaaagacuuauacagauagauuuuuguuuuaacuuacaauccguuuuuuccucuuuuu

SEQ ID NO: 229013 - RNA, 64 nt, hsa
uguuuuaucaucagugcuuuuagaaaugcaggccuuaacuuacugaacugaacuuucugaaaac

SEQ ID NO: 229014 - RNA, 64 nt, hsa
caaaucaauuucagugccuuuaucacuugaauuauuaacuuaauuugacucuuaauguguauau

SEQ ID NO: 229015 - RNA, 64 nt, hsa
uuuaacagcauuuuuuauaaugaauguaaacauuuuaacuuaaugguacuuaaaauaauuuaaa

SEQ ID NO: 229016 - RNA, 64 nt, hsa
uuaaugguacuuaaaauaauuuaaaagaaaaauguuaacuuagacauucuuaugcuucuuuuac

SEQ ID NO: 229017 - RNA, 62 nt, hsa
agacugaacauaugguuauauucacaguuauuuauuaacuuaaauguuauuccaacauuaga

SEQ ID NO: 229018 - RNA, 64 nt, hsa
caguuucugucaucuuaacugucuagucuagccguuaacuuagacaaagaagugcaaaugucaa

SEQ ID NO: 229019 - RNA, 64 nt, hsa
uucaggagcaguugacuaaacuuuuauccuuccuuuaacuuaaucuuuuuauccuucuguuuuu

SEQ ID NO: 229020 - RNA, 64 nt, hsa
ugcaugaaguuucugugagcuuucuuuaucuugcuuaacuuauccuccuuuccuuccccaccaa

SEQ ID NO: 229021 - RNA, 64 nt, hsa
guuccuuccucuuucuccucuccaauuuaugcuuuuaacuuauuuucuaccuggauaaacuucu

SEQ ID NO: 229022 - RNA, 64 nt, hsa
aguccauuuuuucuuaugucuuuauaagguucacuuaacuuaaaaacagcuuuuaaaacaacuu

SEQ ID NO: 229023 - RNA, 64 nt, hsa
uucaugagauacuguguuacacaaaguccuuguuuuaacuuagguauggguaaauuuacauugg

SEQ ID NO: 229024 - RNA, 64 nt, hsa
ugaauugcccgaacuucuuugggggaaaacuggauuaacuuaauaagaguauuugauaaacuca

SEQ ID NO: 229025 - RNA, 64 nt, hsa
cccuguaacuugccaccugcaguucuuagggcuguggggucagauggugguggugagaggccuu

SEQ ID NO: 229026 - RNA, 64 nt, hsa
cugugcuuuugaugccuuuggagucaaaggcagguggggucaccugaugagcuaagauccagcc

SEQ ID NO: 229027 - RNA, 64 nt, hsa
ggacacucccaucagaacuuggcagccuugaaguuggggucagccucggcaggagucccacucc

SEQ ID NO: 229028 - RNA, 64 nt, hsa
ggacacucccaucagaaccuggcagccccaaaacuggggucagccucagggcaggagucccacu

SEQ ID NO: 229029 - RNA, 64 nt, hsa
gcuuugcaacaggaaacauccuguuuuaugguaguggggucaggaauguaggaacugguaucca

SEQ ID NO: 229030 - RNA, 64 nt, hsa
cucuacucccucuggccauagccccuccuggagauggggucaaggcagcaggacugaucaagug

SEQ ID NO: 229031 - RNA, 64 nt, hsa
cuuuguugauaaauugccaaagagugggaacagguggggucaggggccagagugcaggggaggg

SEQ ID NO: 229032 - RNA, 64 nt, hsa
gcucuuagcaaccugcccuuuuauucaugccauuuggggucacagaugccuagcuggacacagc

SEQ ID NO: 229033 - RNA, 64 nt, hsa
agccucacaaccuuucugcuggggcugaaguuucuggggucacauggucagaaggggcugagcu

SEQ ID NO: 229034 - RNA, 64 nt, hsa
ucagcacagcauggggucacggcccacagcuagguggggucacggcccacagcuagguggggac

SEQ ID NO: 229035 - RNA, 64 nt, hsa
uucuguguagcuucucauuuucaucagcacagcauggggucacggcccacagcuaggugggguc

SEQ ID NO: 229036 - RNA, 64 nt, hsa
cuuacaccgcacucagggagaccacuucucaggauggggucagauggagagaccucuagggaga

SEQ ID NO: 229037 - RNA, 64 nt, hsa
uccagguagauuuccacaauaugcaaaguggugguggggucaagacagaugacaccagcacuuu

SEQ ID NO: 229038 - RNA, 64 nt, hsa
cccuggacccagauaagcagcaacuuugugucuuuggggucacagaacauuuuggggcaguuua

SEQ ID NO: 229039 - RNA, 64 nt, hsa
gcccagacugauccucgaggccuccugccguggcuggggucauggucggcugcgcauguccaga

SEQ ID NO: 229040 - RNA, 64 nt, hsa
acagcacagccccuauugcguggcugcugguguguggggucaguuccagcagaugaauguguca

SEQ ID NO: 229041 - RNA, 64 nt, hsa
uaacccccccucccccaccaacauccugcagggauggggucagugguuccaccuucacaggcca

SEQ ID NO: 229042 - RNA, 64 nt, hsa
uucacacagaccaccccggaggacacguggaugauggggucagagaucacugagcugccccuca

SEQ ID NO: 229043 - RNA, 64 nt, hsa
agcugccccucaagggggccuggaacccgggugcuggggucaugcugccuccguggcuccaagg

SEQ ID NO: 229044 - RNA, 64 nt, hsa
cucuuucucuauaacugggauagauguccugccuuggggucacuaaaggggugaccuuguuccu

SEQ ID NO: 229045 - RNA, 64 nt, hsa
accagcaaguauugaggguacccaucuagcuacuuggggucaggaccucgucagaccagguucg

SEQ ID NO: 229046 - RNA, 64 nt, hsa
cuagcaggaagacugaaagcaagguggcccaguguggggucauagggcuugauagaccuggcac

SEQ ID NO: 229047 - RNA, 64 nt, hsa
ccauaggggcccuguucucucuggggucccacacuggggucaugagagcuaguuaguacucagc

SEQ ID NO: 229048 - RNA, 64 nt, hsa
guaccucagugaagagugcaggcaaguagagugauggggucaguguccauccaguuuacgcuga

SEQ ID NO: 229049 - RNA, 64 nt, hsa
aaaggucuuggugccucugcaguacuugauguauuggggucaaaucucuacaaauuuuucugug

SEQ ID NO: 229050 - RNA, 64 nt, hsa
ggagacuguguuugguccuguaggaguucuauuuuggggucaaaugcuagaaaaauuguuaagg

SEQ ID NO: 229051 - RNA, 64 nt, hsa
ucuuggggucuucaggacugaagaggagggagaguggggucagaagauucuccuggccaccaag

SEQ ID NO: 229052 - RNA, 64 nt, hsa
cccucucuucccuccagaucccagcccuccugcuuggggucacuggucucauucuggggcuaaa

SEQ ID NO: 229053 - RNA, 64 nt, hsa
caggggcccugcagcucucaugcugccccugccuuggggucagguugacaggagguuggaggga

SEQ ID NO: 229054 - RNA, 64 nt, hsa
ggaggcaguaggacaaggugcaggcaggcuggccuggggucaggccgggcagagcacagcgggg

SEQ ID NO: 229055 - RNA, 64 nt, hsa
aaaagcaccacuguucuguucauuuccuagcuguucuaauuaagaaaacuauuaagaugagcaa

SEQ ID NO: 229056 - RNA, 64 nt, hsa
auguuuauugacaggucuuuucaaauaaugcuuuucuaauuaauagccaaagauuucauaucua

SEQ ID NO: 229057 - RNA, 64 nt, hsa
auuucuuuuaucuugauaacuccuagugagggaaucuaauuaagauuucaugcuguucuuugua

SEQ ID NO: 229058 - RNA, 64 nt, hsa
uauuguuuauuuccaaggcauguauuauucaauuucuaauuaaaauauaucagggcuuauauuu

SEQ ID NO: 229059 - RNA, 64 nt, hsa
gaagauuacuuucauucuagaagaauguaguuucucuaauuauuugaaauguucauuuagccuu

SEQ ID NO: 229060 - RNA, 64 nt, hsa
guugauuggugaaaugcaggguauguggaaguuaucuaauuaaccucaguuguauaugaauaac

SEQ ID NO: 229061 - RNA, 64 nt, hsa
aaauguaguuauuuuauccuguuagaacaaaaauucuaauuaaaauaguuaacuugaagaguag

SEQ ID NO: 229062 - RNA, 64 nt, hsa
aaguuauguuucuuugcuuacuucauuuuuucccucuaauuauuuaagauuggaacaaaaguau

SEQ ID NO: 229063 - RNA, 64 nt, hsa
cuaaaacaaauaguuuauaaaugugaacuuaaacucuaauuaauuccaacuguacuuuuaaggc

SEQ ID NO: 229064 - RNA, 64 nt, hsa
ucauuuuuuucuccucuucuuuuuuuucauuauaucuaauuauuuugcaguugggcaacagaga

SEQ ID NO: 229065 - RNA, 64 nt, hsa
uaaaugcugaaaaggaaaacgauuucauuguucaucuaauuaaauaaauuaaaagagcgguuug

SEQ ID NO: 229066 - RNA, 64 nt, hsa
augaaaaacaaauuuucucacugucauaaaaggcucuaauuaugguuacuuuccuugugaugaa

SEQ ID NO: 229067 - RNA, 64 nt, hsa
uguccuugucaugaaaacacuugccuuacaaggcucuaauuaugauuucccuagucagugcucu

SEQ ID NO: 229068 - RNA, 64 nt, hsa
uauuaguccguuuucacgcugcugauaaagacauacccgagacugggaagaaaaagugguuuaa

SEQ ID NO: 229069 - RNA, 64 nt, hsa
uauuagucuguauuaaugcugcugauaaagacguacccgagacugggaagaaaaagagguuuac

SEQ ID NO: 229070 - RNA, 64 nt, hsa
gcagcugugaugguuucagagcucagacugaucaggcaucaagcuacccucaagaguuucuggg

SEQ ID NO: 229071 - RNA, 64 nt, hsa
gaguauaaauccugugcauagauuccucuagaaaggcaucaaaaggcucaacagacugaauggc

SEQ ID NO: 229072 - RNA, 64 nt, hsa
acagcagaacagaaaguucaacugcuucguaauuggcaucaacuucauggaaagaaagaagcgu

SEQ ID NO: 229073 - RNA, 64 nt, hsa
uuuuacuggcucaaaacuaccuacuucuuucucaggcaucaaaagcauuuugagcaggagagua

SEQ ID NO: 229074 - RNA, 64 nt, hsa
ggcaucugauaugcagaguuagucaacagacacuggcaucaauuacaaaaucacugcuguuucu

SEQ ID NO: 229075 - RNA, 59 nt, hsa
ggcaggaagacaagcuaugaucugcuccaggcaucaagcucauuuuauggauuucuguc

SEQ ID NO: 229076 - RNA, 64 nt, hsa
acaaauguaacgugcaugcuuaagcuuuuacccaggcaucaaaaccggaacaucacaggguuua

SEQ ID NO: 229077 - RNA, 64 nt, hsa
ugauagagauuuuccgcaggccaaagucucacuaggcaucaaaaacuuuuuugaugaaaccaua

SEQ ID NO: 229078 - RNA, 64 nt, hsa
gacaugucccuuuguguuuauaaauacuacuaaggugaccuaguuguucuccuuguugcaauaa

SEQ ID NO: 229079 - RNA, 64 nt, hsa
uuuccacccccuccaauuugugaaaaacagagcagugaccuagcuguugcaucaucaugacugc

SEQ ID NO: 229080 - RNA, 64 nt, hsa; identical to SEQ ID NO: 193740

SEQ ID NO: 229081 - RNA, 64 nt, hsa; identical to SEQ ID NO: 193741

SEQ ID NO: 229082 - RNA, 64 nt, hsa; identical to SEQ ID NO: 193742

SEQ ID NO: 229083 - RNA, 64 nt, hsa; identical to SEQ ID NO: 193743

SEQ ID NO: 229084 - RNA, 64 nt, hsa; identical to SEQ ID NO: 193744

SEQ ID NO: 229085 - RNA, 64 nt, hsa; identical to SEQ ID NO: 193745

SEQ ID NO: 229086 - RNA, 64 nt, hsa
uucccccuuccuuuggugccucacugggggcuuugggccgaaucccccagggaaucagggacca

SEQ ID NO: 229087 - RNA, 64 nt, hsa
ccgguccuuccugggcaaaucuaagccuuggccagggccgaaguuuaggccccugucuuguuca

SEQ ID NO: 229088 - RNA, 64 nt, hsa
cuccauuuuuauuucuucgugaacauagaguuuggggccgaaaauguuuuuaaaguauguguuu

SEQ ID NO: 229089 - RNA, 64 nt, hsa
gugggguggggguguauuccuugggggaugguuugggccgaauggggaguggaauauuugacau

SEQ ID NO: 229090 - RNA, 64 nt, hsa
gcgauccgagucgcggucuccggggugccugggagggccgaaccacuggugagggcguggggag

SEQ ID NO: 229091 - RNA, 62 nt, hsa
agucccaagagccuucgugaggccgguacuuggggccgaaaaacuguggccugcagaagucc

SEQ ID NO: 229092 - RNA, 64 nt, hsa
gcaugagugcugagauauggacucucuaaggaaggggccgaacgcuuguaauuggaauacaugg

SEQ ID NO: 229093 - RNA, 64 nt, hsa
auggaauccagcuucaagagcauacucuguacuagggccgaaguaaaaaaccaucaccucccau

SEQ ID NO: 229094 - RNA, 64 nt, hsa
uagaauuugaguuuuagcaagaguccugagggcggggccgaacaccuaacuccgggaggcuccc

SEQ ID NO: 229095 - RNA, 64 nt, hsa
uuggagauguacacauacauacccuauaccaagagggccgaaacucuucaccuugauguauguu

SEQ ID NO: 229096 - RNA, 64 nt, hsa
cuccgccccugcaccagucacaugcacuggacgagggccgaaacuccugucugcuaucgagccc

SEQ ID NO: 229097 - RNA, 64 nt, hsa
caguuccuaggcaacuuguucaccagguacgcaagggccgaauaguugagaaauggacauucuu

SEQ ID NO: 229098 - RNA, 64 nt, hsa
ucugaauugaacuggaaucacauauuucacaacagggccgaagagaugacuauaaaauguucau

SEQ ID NO: 229099 - RNA, 64 nt, hsa
ugcugcgagcugcugcguggaaaggccucuguaugggccgaagacccuucuucccuggcugcca

SEQ ID NO: 229100 - RNA, 64 nt, hsa
ccuccucaaaccuaccacucaggaauguuugcuggggccgaaagaacaguccauugaaagggag

SEQ ID NO: 229101 - RNA, 64 nt, hsa
gguuccccuuggccgccaguuccguucuccucacgggccgaacggaacaagggguccagcuugc

SEQ ID NO: 229102 - RNA, 64 nt, hsa
ucuucccuugaagccacuggcgcccaggagcggugggccgaagacgugcccuacccuaccacaa

SEQ ID NO: 229103 - RNA, 64 nt, hsa
cccaagccugucuaagguuacuguguauuagacagggccgaacuagugugcugagcaaaaagaa

SEQ ID NO: 229104 - RNA, 64 nt, hsa
gcgcccuggcaaaggcugacaacuggcugucuuggggccgaacagccccugcccugccucugag

SEQ ID NO: 229105 - RNA, 61 nt, hsa
ugcgggauaucgaccugugaggaugccaguugggccgaaagagagagacgcguccauaauc

SEQ ID NO: 229106 - RNA, 64 nt, hsa
ucuaguuuaguaaaagaugugcaaaggccagagagggccgaaaaugaagcuuucuugcuacaca

SEQ ID NO: 229107 - RNA, 64 nt, hsa
acaacuaggagcccagcugggauugguguagggagggccgaacgcugacuaguguggccucacu

SEQ ID NO: 229108 - RNA, 64 nt, hsa
cuacccaucccucccucccaauuaggcugcacuggggccgaacgcuucccugggcucccacugc

SEQ ID NO: 229109 - RNA, 64 nt, hsa
gcucgcagcuggagugagaggcagguggcggccggggccgaagccagcagugucuaaacccccg

SEQ ID NO: 229110 - RNA, 64 nt, hsa
gucucaagggcuagcaucccugaggagccaggccgggccgaauccccucccugucaaagcuguc

SEQ ID NO: 229111 - RNA, 64 nt, hsa
caggaagcuucuguguaagcugcgaggauggcuugggccgaaggguugcucugcccgccgcgcu

SEQ ID NO: 229112 - RNA, 64 nt, hsa
gugggguuggagcaugccuuuaggggcagugucugggccgaagcacgucccaccacacagugcc

SEQ ID NO: 229113 - RNA, 64 nt, hsa
uuaccccaucacccgacucuggccacugaccucagggccgaaggggaggugguguacauaggaa

SEQ ID NO: 229114 - RNA, 64 nt, hsa
uaaggucccgcccccaaagacccuggggccagcggggccgaaagcggaguuggguuugccuuau

SEQ ID NO: 229115 - RNA, 64 nt, hsa
uccucaccccuccucugacccacccauggugccagggccgaagcugaccuuuagcucccuccug

SEQ ID NO: 229116 - RNA, 64 nt, hsa
cccguguccccccaggugcuggaggcagacucgagggccgaauuguuucuaguuaggccacgcu

SEQ ID NO: 229117 - RNA, 64 nt, hsa
uugauggcaggaggguccuuguggacguggagaggggccgaaccgugaagggcuggaggccccg

SEQ ID NO: 229118 - RNA, 64 nt, hsa
ggaucccgggaaagcgauggacagacagacgauggggccgaagccccaagcugggcacaaagua

SEQ ID NO: 229119 - RNA, 64 nt, hsa
cccagcccugcccagaguaugggcacucaggugugggccgaaccugauaccugccugggacagc

SEQ ID NO: 229120 - RNA, 64 nt, hsa; identical to SEQ ID NO: 158491

SEQ ID NO: 229121 - RNA, 64 nt, hsa; identical to SEQ ID NO: 158492

SEQ ID NO: 229122 - RNA, 64 nt, hsa; identical to SEQ ID NO: 158493

SEQ ID NO: 229123 - RNA, 64 nt, hsa; identical to SEQ ID NO: 158494

SEQ ID NO: 229124 - RNA, 64 nt, hsa; identical to SEQ ID NO: 158495

SEQ ID NO: 229125 - RNA, 64 nt, hsa; identical to SEQ ID NO: 158496

SEQ ID NO: 229126 - RNA, 64 nt, hsa; identical to SEQ ID NO: 158497

SEQ ID NO: 229127 - RNA, 64 nt, hsa; identical to SEQ ID NO: 158498

SEQ ID NO: 229128 - RNA, 64 nt, hsa; identical to SEQ ID NO: 158499

SEQ ID NO: 229129 - RNA, 64 nt, hsa; identical to SEQ ID NO: 158500

SEQ ID NO: 229130 - RNA, 64 nt, hsa; identical to SEQ ID NO: 158501

SEQ ID NO: 229131 - RNA, 64 nt, hsa; identical to SEQ ID NO: 158502

SEQ ID NO: 229132 - RNA, 64 nt, hsa; identical to SEQ ID NO: 158503

SEQ ID NO: 229133 - RNA, 64 nt, hsa; identical to SEQ ID NO: 158504

SEQ ID NO: 229134 - RNA, 64 nt, hsa; identical to SEQ ID NO: 158505

SEQ ID NO: 229135 - RNA, 64 nt, hsa; identical to SEQ ID NO: 158506

SEQ ID NO: 229136 - RNA, 64 nt, hsa; identical to SEQ ID NO: 158507

SEQ ID NO: 229137 - RNA, 64 nt, hsa; identical to SEQ ID NO: 158508

SEQ ID NO: 229138 - RNA, 64 nt, hsa; identical to SEQ ID NO: 158509

SEQ ID NO: 229139 - RNA, 64 nt, hsa; identical to SEQ ID NO: 158510

SEQ ID NO: 229140 - RNA, 64 nt, hsa; identical to SEQ ID NO: 158511

SEQ ID NO: 229141 - RNA, 64 nt, hsa; identical to SEQ ID NO: 158512

SEQ ID NO: 229142 - RNA, 64 nt, hsa; identical to SEQ ID NO: 158513

SEQ ID NO: 229143 - RNA, 64 nt, hsa; identical to SEQ ID NO: 158514

SEQ ID NO: 229144 - RNA, 64 nt, hsa; identical to SEQ ID NO: 158515

SEQ ID NO: 229145 - RNA, 64 nt, hsa; identical to SEQ ID NO: 158516

SEQ ID NO: 229146 - RNA, 64 nt, hsa; identical to SEQ ID NO: 158517

SEQ ID NO: 229147 - RNA, 64 nt, hsa; identical to SEQ ID NO: 158518

SEQ ID NO: 229148 - RNA, 64 nt, hsa; identical to SEQ ID NO: 158519

SEQ ID NO: 229149 - RNA, 64 nt, hsa; identical to SEQ ID NO: 158520

SEQ ID NO: 229150 - RNA, 64 nt, hsa; identical to SEQ ID NO: 158521

SEQ ID NO: 229151 - RNA, 64 nt, hsa; identical to SEQ ID NO: 158522

SEQ ID NO: 229152 - RNA, 64 nt, hsa; identical to SEQ ID NO: 158523

SEQ ID NO: 229153 - RNA, 64 nt, hsa; identical to SEQ ID NO: 158524

SEQ ID NO: 229154 - RNA, 64 nt, hsa; identical to SEQ ID NO: 158525

SEQ ID NO: 229155 - RNA, 64 nt, hsa; identical to SEQ ID NO: 158526

SEQ ID NO: 229156 - RNA, 64 nt, hsa
auuucucuucugcacagagcauaaugugaaguuuuauaccuacuuuuaaaauucugcuuuccag

SEQ ID NO: 229157 - RNA, 64 nt, hsa
gaauauuaacaugaaggauaaaccaacuuauuuguauaccuaaggcaggcauuuggaucaguaa

SEQ ID NO: 229158 - RNA, 64 nt, hsa
ucauaacccaacgcucauucaacaucaaagaauuuauaccuaagagaacuuauuuggguguagu

SEQ ID NO: 229159 - RNA, 64 nt, hsa
uacagauguuggcucaaguucagggccaccaucauauaccuaacaagaguucaugauucuuuag

SEQ ID NO: 229160 - RNA, 64 nt, hsa
cauuuuuucucauccuugcauuccuugcuuguuauauaccuaaaauguuaaccauauaguuuuu

SEQ ID NO: 229161 - RNA, 62 nt, hsa
aagaaaaggggcuuuucuaaagcaagaaggccuauaccuauugcaaggccacagaaaagagc

SEQ ID NO: 229162 - RNA, 64 nt, hsa
uaagcacuauagaauuugcaaauucagaacauuuuauaccuaaaaguaauucugucuuuccuaa

SEQ ID NO: 229163 - RNA, 64 nt, hsa
aaagaaauauuuuuaaaauguucuuaagcaaauauauaccuauuuuaucuaguuaccuuucauu

SEQ ID NO: 229164 - RNA, 64 nt, hsa
auggaauagguaagagaacccagaaauaaaggcauauaccuacaaccaugugauccucaacaaa

SEQ ID NO: 229165 - RNA, 64 nt, hsa
cauagcauucaacccagcaucccauuacuggguguauaccuaaaggaauauaaucauuccacca

SEQ ID NO: 229166 - RNA, 64 nt, hsa
accuauugaaauucucucacucuguguauguauauauaccuauggaaaacuaguuguugggaaa

SEQ ID NO: 229167 - RNA, 64 nt, hsa
uguguguguauaccugacauauauaguagauauauauaccuauugaaauucucucacucugugu

SEQ ID NO: 229168 - RNA, 64 nt, hsa
uaaggcaucauuuucgagggucuaaaauuaucugguaaaacaaaugaaauuaagugauccaaag

SEQ ID NO: 229169 - RNA, 64 nt, hsa
ucccuguuucaaauguguucagaggaaauagaauguaaaacaucacaaaaaaaauugcaguaca

SEQ ID NO: 229170 - RNA, 64 nt, hsa
caucuuuccuucggguuggcaaaauauuuuaaagguaaaacaugcuggugaaccagggguguug

SEQ ID NO: 229171 - RNA, 64 nt, hsa
uuuauuuaugacagugaacauucugauuuuacauguaaaacaagaaaaguugaagaagauaugu

SEQ ID NO: 229172 - RNA, 64 nt, hsa
aucagaucuugauucuucuggguuuauacugguuguaaaacagaaugauauuagaaaauguuuu

SEQ ID NO: 229173 - RNA, 64 nt, hsa
cuuccguaauuuuuauguucuugugaggaaaaaaguaaaacauguuuaauuuuauuugacuuua

SEQ ID NO: 229174 - RNA, 64 nt, hsa
agcugaguccgcgacagaaauuugcccuaugugaguaaaacauacuuugggagaagaacuuggu

SEQ ID NO: 229175 - RNA, 64 nt, hsa
cuggguuuucuuuuugacaauucuuggacuugagguaaaacaaggaggauuguggccggauuuc

SEQ ID NO: 229176 - RNA, 64 nt, hsa
uguuagcuccacgagugcaaacugcagucaccaaguaaaacaacaaauagcuaccacuuuugcu

SEQ ID NO: 229177 - RNA, 64 nt, hsa
uguguuuuuacuuuuuauucccguuaaaacugauguaaaacaggauaaaggcuuguuauaguca

SEQ ID NO: 229178 - RNA, 64 nt, hsa
agagcuaauguggguuaccaaaaggccuguaccuguaaaacaaaaugcagguguaaugauuaua

SEQ ID NO: 229179 - RNA, 64 nt, hsa
gcugcauucuuguugguagcauguacucuguugaguaaaacacauauucaaauuccguauacca

SEQ ID NO: 229180 - RNA, 64 nt, hsa
aaccugguuaaacagauauuaaagcugcuuuuggguaaaacagguuuccaccaguauuuucccu

SEQ ID NO: 229181 - RNA, 64 nt, hsa
uuuuagaaauaagauaaucaacguacaacucuuuguaaaacaaaagcaacuuugggugaguuuu

SEQ ID NO: 229182 - RNA, 64 nt, hsa
auuuugcuauucugcccuuguaaucggugucccuguaaaacaauccccacagauuacuuucaga

SEQ ID NO: 229183 - RNA, 64 nt, hsa
gaugugguucauagauauaugaauacguaucuguguaaaacagugagugugcaguguguaaaua

SEQ ID NO: 229184 - RNA, 64 nt, hsa
aacuuuguagugaugacuaccaaagaaauacauaguaaaacaaccuuuuauuuccaaauuguua

SEQ ID NO: 229185 - RNA, 64 nt, hsa
uauuuucauuguguuauugacauccaugucucucguaaaacagauggcccaaaguaaugaauca

SEQ ID NO: 229186 - RNA, 54 nt, hsa
auacuagagaaaaacuuuaaaaauguaaaacauggagcagauuuuuuacuuguu

SEQ ID NO: 229187 - RNA, 64 nt, hsa
uaucagcauuuuucauggaaguuuaaugccaaauguaaaacacaugaaaauuuuuaaaaauaug

SEQ ID NO: 229188 - RNA, 64 nt, hsa
agccaucuuagguccccgaggugcccagcaucacguaaaacaucgauaugcuaagaagaacaaa

SEQ ID NO: 229189 - RNA, 64 nt, hsa
aauuugaaccuucaccauccaccacucuauucagguaaaacaaugaaugagccaccuuagcagg

SEQ ID NO: 229190 - RNA, 64 nt, hsa; identical to SEQ ID NO: 137738

SEQ ID NO: 229191 - RNA, 64 nt, hsa; identical to SEQ ID NO: 137739

SEQ ID NO: 229192 - RNA, 64 nt, hsa; identical to SEQ ID NO: 137740

SEQ ID NO: 229193 - RNA, 64 nt, hsa; identical to SEQ ID NO: 137741

SEQ ID NO: 229194 - RNA, 64 nt, hsa; identical to SEQ ID NO: 137742

SEQ ID NO: 229195 - RNA, 64 nt, hsa; identical to SEQ ID NO: 137743

SEQ ID NO: 229196 - RNA, 64 nt, hsa; identical to SEQ ID NO: 137744

SEQ ID NO: 229197 - RNA, 64 nt, hsa; identical to SEQ ID NO: 137745

SEQ ID NO: 229198 - RNA, 64 nt, hsa; identical to SEQ ID NO: 137746

SEQ ID NO: 229199 - RNA, 64 nt, hsa; identical to SEQ ID NO: 137747

SEQ ID NO: 229200 - RNA, 64 nt, hsa; identical to SEQ ID NO: 137748

SEQ ID NO: 229201 - RNA, 64 nt, hsa; identical to SEQ ID NO: 137749

SEQ ID NO: 229202 - RNA, 64 nt, hsa; identical to SEQ ID NO: 137750

SEQ ID NO: 229203 - RNA, 64 nt, hsa; identical to SEQ ID NO: 137751

SEQ ID NO: 229204 - RNA, 64 nt, hsa; identical to SEQ ID NO: 137752

SEQ ID NO: 229205 - RNA, 64 nt, hsa; identical to SEQ ID NO: 137753

SEQ ID NO: 229206 - RNA, 64 nt, hsa; identical to SEQ ID NO: 137754

SEQ ID NO: 229207 - RNA, 64 nt, hsa; identical to SEQ ID NO: 137755

SEQ ID NO: 229208 - RNA, 64 nt, hsa; identical to SEQ ID NO: 137756

SEQ ID NO: 229209 - RNA, 64 nt, hsa; identical to SEQ ID NO: 137757

SEQ ID NO: 229210 - RNA, 64 nt, hsa; identical to SEQ ID NO: 137758

SEQ ID NO: 229211 - RNA, 64 nt, hsa; identical to SEQ ID NO: 137759

SEQ ID NO: 229212 - RNA, 64 nt, hsa; identical to SEQ ID NO: 137760

SEQ ID NO: 229213 - RNA, 64 nt, hsa; identical to SEQ ID NO: 137761

SEQ ID NO: 229214 - RNA, 64 nt, hsa; identical to SEQ ID NO: 137762

SEQ ID NO: 229215 - RNA, 64 nt, hsa; identical to SEQ ID NO: 137763

SEQ ID NO: 229216 - RNA, 64 nt, hsa; identical to SEQ ID NO: 137764

SEQ ID NO: 229217 - RNA, 64 nt, hsa; identical to SEQ ID NO: 137765

SEQ ID NO: 229218 - RNA, 64 nt, hsa; identical to SEQ ID NO: 137766

SEQ ID NO: 229219 - RNA, 64 nt, hsa; identical to SEQ ID NO: 137767

SEQ ID NO: 229220 - RNA, 64 nt, hsa; identical to SEQ ID NO: 125003

SEQ ID NO: 229221 - RNA, 64 nt, hsa; identical to SEQ ID NO: 125004

SEQ ID NO: 229222 - RNA, 64 nt, hsa; identical to SEQ ID NO: 125005

SEQ ID NO: 229223 - RNA, 64 nt, hsa; identical to SEQ ID NO: 125006

SEQ ID NO: 229224 - RNA, 64 nt, hsa; identical to SEQ ID NO: 125007

SEQ ID NO: 229225 - RNA, 64 nt, hsa; identical to SEQ ID NO: 125008

SEQ ID NO: 229226 - RNA, 64 nt, hsa; identical to SEQ ID NO: 125009

SEQ ID NO: 229227 - RNA, 64 nt, hsa; identical to SEQ ID NO: 125010

SEQ ID NO: 229228 - RNA, 64 nt, hsa; identical to SEQ ID NO: 125011

SEQ ID NO: 229229 - RNA, 64 nt, hsa; identical to SEQ ID NO: 125012

SEQ ID NO: 229230 - RNA, 64 nt, hsa; identical to SEQ ID NO: 125013

SEQ ID NO: 229231 - RNA, 64 nt, hsa; identical to SEQ ID NO: 125014

SEQ ID NO: 229232 - RNA, 64 nt, hsa; identical to SEQ ID NO: 125015

SEQ ID NO: 229233 - RNA, 64 nt, hsa; identical to SEQ ID NO: 125016

SEQ ID NO: 229234 - RNA, 64 nt, hsa; identical to SEQ ID NO: 125017

SEQ ID NO: 229235 - RNA, 64 nt, hsa; identical to SEQ ID NO: 82479

SEQ ID NO: 229236 - RNA, 64 nt, hsa; identical to SEQ ID NO: 82480

SEQ ID NO: 229237 - RNA, 64 nt, hsa; identical to SEQ ID NO: 82481

SEQ ID NO: 229238 - RNA, 64 nt, hsa; identical to SEQ ID NO: 82482

SEQ ID NO: 229239 - RNA, 64 nt, hsa; identical to SEQ ID NO: 82483

SEQ ID NO: 229240 - RNA, 64 nt, hsa; identical to SEQ ID NO: 82484

SEQ ID NO: 229241 - RNA, 64 nt, hsa; identical to SEQ ID NO: 82485

SEQ ID NO: 229242 - RNA, 64 nt, hsa; identical to SEQ ID NO: 82486

SEQ ID NO: 229243 - RNA, 64 nt, hsa; identical to SEQ ID NO: 82487

SEQ ID NO: 229244 - RNA, 64 nt, hsa; identical to SEQ ID NO: 82488

SEQ ID NO: 229245 - RNA, 64 nt, hsa; identical to SEQ ID NO: 82489

SEQ ID NO: 229246 - RNA, 64 nt, hsa; identical to SEQ ID NO: 82490

SEQ ID NO: 229247 - RNA, 64 nt, hsa; identical to SEQ ID NO: 82491

SEQ ID NO: 229248 - RNA, 64 nt, hsa; identical to SEQ ID NO: 82492

SEQ ID NO: 229249 - RNA, 64 nt, hsa; identical to SEQ ID NO: 82493

SEQ ID NO: 229250 - RNA, 64 nt, hsa; identical to SEQ ID NO: 82494

SEQ ID NO: 229251 - RNA, 64 nt, hsa; identical to SEQ ID NO: 82495

SEQ ID NO: 229252 - RNA, 63 nt, hsa; identical to SEQ ID NO: 82496

SEQ ID NO: 229253 - RNA, 64 nt, hsa; identical to SEQ ID NO: 82497

SEQ ID NO: 229254 - RNA, 64 nt, hsa; identical to SEQ ID NO: 82498

SEQ ID NO: 229255 - RNA, 64 nt, hsa; identical to SEQ ID NO: 82499

SEQ ID NO: 229256 - RNA, 64 nt, hsa; identical to SEQ ID NO: 82500

SEQ ID NO: 229257 - RNA, 64 nt, hsa; identical to SEQ ID NO: 82501

SEQ ID NO: 229258 - RNA, 64 nt, hsa; identical to SEQ ID NO: 82502

SEQ ID NO: 229259 - RNA, 64 nt, hsa; identical to SEQ ID NO: 82503

SEQ ID NO: 229260 - RNA, 64 nt, hsa; identical to SEQ ID NO: 82504

SEQ ID NO: 229261 - RNA, 64 nt, hsa; identical to SEQ ID NO: 82505

SEQ ID NO: 229262 - RNA, 64 nt, hsa; identical to SEQ ID NO: 82506

SEQ ID NO: 229263 - RNA, 64 nt, hsa; identical to SEQ ID NO: 82507

SEQ ID NO: 229264 - RNA, 64 nt, hsa; identical to SEQ ID NO: 82508

SEQ ID NO: 229265 - RNA, 64 nt, hsa; identical to SEQ ID NO: 82509

SEQ ID NO: 229266 - RNA, 64 nt, hsa; identical to SEQ ID NO: 82510

SEQ ID NO: 229267 - RNA, 64 nt, hsa; identical to SEQ ID NO: 82511

SEQ ID NO: 229268 - RNA, 64 nt, hsa; identical to SEQ ID NO: 82512

SEQ ID NO: 229269 - RNA, 57 nt, hsa; identical to SEQ ID NO: 82513

SEQ ID NO: 229270 - RNA, 64 nt, hsa; identical to SEQ ID NO: 82514

SEQ ID NO: 229271 - RNA, 64 nt, hsa; identical to SEQ ID NO: 82515

SEQ ID NO: 229272 - RNA, 64 nt, hsa; identical to SEQ ID NO: 82516

SEQ ID NO: 229273 - RNA, 64 nt, hsa; identical to SEQ ID NO: 82517

SEQ ID NO: 229274 - RNA, 64 nt, hsa; identical to SEQ ID NO: 82518

SEQ ID NO: 229275 - RNA, 64 nt, hsa; identical to SEQ ID NO: 82519

SEQ ID NO: 229276 - RNA, 64 nt, hsa; identical to SEQ ID NO: 82520

SEQ ID NO: 229277 - RNA, 64 nt, hsa; identical to SEQ ID NO: 82521

SEQ ID NO: 229278 - RNA, 64 nt, hsa; identical to SEQ ID NO: 82522

SEQ ID NO: 229279 - RNA, 64 nt, hsa; identical to SEQ ID NO: 82523

SEQ ID NO: 229280 - RNA, 64 nt, hsa; identical to SEQ ID NO: 82524

SEQ ID NO: 229281 - RNA, 64 nt, hsa; identical to SEQ ID NO: 82525

SEQ ID NO: 229282 - RNA, 64 nt, hsa; identical to SEQ ID NO: 82526

SEQ ID NO: 229283 - RNA, 64 nt, hsa; identical to SEQ ID NO: 82527

SEQ ID NO: 229284 - RNA, 64 nt, hsa; identical to SEQ ID NO: 82528

SEQ ID NO: 229285 - RNA, 64 nt, hsa; identical to SEQ ID NO: 82529

SEQ ID NO: 229286 - RNA, 64 nt, hsa; identical to SEQ ID NO: 82530

SEQ ID NO: 229287 - RNA, 64 nt, hsa; identical to SEQ ID NO: 82531

SEQ ID NO: 229288 - RNA, 64 nt, hsa; identical to SEQ ID NO: 82532

SEQ ID NO: 229289 - RNA, 64 nt, hsa; identical to SEQ ID NO: 82533

SEQ ID NO: 229290 - RNA, 64 nt, hsa; identical to SEQ ID NO: 82534

SEQ ID NO: 229291 - RNA, 64 nt, hsa; identical to SEQ ID NO: 82535

SEQ ID NO: 229292 - RNA, 64 nt, hsa; identical to SEQ ID NO: 82536

SEQ ID NO: 229293 - RNA, 64 nt, hsa; identical to SEQ ID NO: 82537

SEQ ID NO: 229294 - RNA, 64 nt, hsa; identical to SEQ ID NO: 82538

SEQ ID NO: 229295 - RNA, 64 nt, hsa; identical to SEQ ID NO: 82539

SEQ ID NO: 229296 - RNA, 64 nt, hsa; identical to SEQ ID NO: 82540

SEQ ID NO: 229297 - RNA, 64 nt, hsa; identical to SEQ ID NO: 82541

SEQ ID NO: 229298 - RNA, 64 nt, hsa; identical to SEQ ID NO: 82542

SEQ ID NO: 229299 - RNA, 64 nt, hsa; identical to SEQ ID NO: 82543

SEQ ID NO: 229300 - RNA, 64 nt, hsa; identical to SEQ ID NO: 82544

SEQ ID NO: 229301 - RNA, 64 nt, hsa; identical to SEQ ID NO: 82545

SEQ ID NO: 229302 - RNA, 64 nt, hsa; identical to SEQ ID NO: 82546

SEQ ID NO: 229303 - RNA, 64 nt, hsa; identical to SEQ ID NO: 82547

SEQ ID NO: 229304 - RNA, 64 nt, hsa; identical to SEQ ID NO: 82548

SEQ ID NO: 229305 - RNA, 64 nt, hsa; identical to SEQ ID NO: 82549

SEQ ID NO: 229306 - RNA, 64 nt, hsa; identical to SEQ ID NO: 82550

SEQ ID NO: 229307 - RNA, 64 nt, hsa; identical to SEQ ID NO: 82551

SEQ ID NO: 229308 - RNA, 64 nt, hsa; identical to SEQ ID NO: 82552

SEQ ID NO: 229309 - RNA, 64 nt, hsa; identical to SEQ ID NO: 82553

SEQ ID NO: 229310 - RNA, 64 nt, hsa; identical to SEQ ID NO: 82554

SEQ ID NO: 229311 - RNA, 64 nt, hsa; identical to SEQ ID NO: 82555

SEQ ID NO: 229312 - RNA, 64 nt, hsa; identical to SEQ ID NO: 82556

SEQ ID NO: 229313 - RNA, 64 nt, hsa; identical to SEQ ID NO: 82557

SEQ ID NO: 229314 - RNA, 64 nt, hsa; identical to SEQ ID NO: 82558

SEQ ID NO: 229315 - RNA, 64 nt, hsa; identical to SEQ ID NO: 82559

SEQ ID NO: 229316 - RNA, 64 nt, hsa; identical to SEQ ID NO: 82560

SEQ ID NO: 229317 - RNA, 64 nt, hsa; identical to SEQ ID NO: 82561

SEQ ID NO: 229318 - RNA, 64 nt, hsa; identical to SEQ ID NO: 82562

SEQ ID NO: 229319 - RNA, 64 nt, hsa; identical to SEQ ID NO: 82563

SEQ ID NO: 229320 - RNA, 64 nt, hsa; identical to SEQ ID NO: 82564

SEQ ID NO: 229321 - RNA, 64 nt, hsa; identical to SEQ ID NO: 82565

SEQ ID NO: 229322 - RNA, 64 nt, hsa; identical to SEQ ID NO: 82566

SEQ ID NO: 229323 - RNA, 64 nt, hsa; identical to SEQ ID NO: 82567

SEQ ID NO: 229324 - RNA, 64 nt, hsa; identical to SEQ ID NO: 82568

SEQ ID NO: 229325 - RNA, 64 nt, hsa; identical to SEQ ID NO: 82569

SEQ ID NO: 229326 - RNA, 59 nt, hsa; identical to SEQ ID NO: 82570

SEQ ID NO: 229327 - RNA, 64 nt, hsa; identical to SEQ ID NO: 82571

SEQ ID NO: 229328 - RNA, 64 nt, hsa; identical to SEQ ID NO: 82572

SEQ ID NO: 229329 - RNA, 64 nt, hsa; identical to SEQ ID NO: 82573

SEQ ID NO: 229330 - RNA, 64 nt, hsa; identical to SEQ ID NO: 82574

SEQ ID NO: 229331 - RNA, 64 nt, hsa; identical to SEQ ID NO: 82575

SEQ ID NO: 229332 - RNA, 64 nt, hsa; identical to SEQ ID NO: 82576

SEQ ID NO: 229333 - RNA, 64 nt, hsa; identical to SEQ ID NO: 82577

SEQ ID NO: 229334 - RNA, 52 nt, hsa; identical to SEQ ID NO: 82578

SEQ ID NO: 229335 - RNA, 64 nt, hsa; identical to SEQ ID NO: 82579

SEQ ID NO: 229336 - RNA, 64 nt, hsa; identical to SEQ ID NO: 82580

SEQ ID NO: 229337 - RNA, 64 nt, hsa; identical to SEQ ID NO: 82581

SEQ ID NO: 229338 - RNA, 64 nt, hsa; identical to SEQ ID NO: 82582

SEQ ID NO: 229339 - RNA, 64 nt, hsa; identical to SEQ ID NO: 82583

SEQ ID NO: 229340 - RNA, 64 nt, hsa; identical to SEQ ID NO: 82584

SEQ ID NO: 229341 - RNA, 64 nt, hsa; identical to SEQ ID NO: 82585

SEQ ID NO: 229342 - RNA, 64 nt, hsa; identical to SEQ ID NO: 82586

SEQ ID NO: 229343 - RNA, 64 nt, hsa; identical to SEQ ID NO: 82587

SEQ ID NO: 229344 - RNA, 64 nt, hsa; identical to SEQ ID NO: 82588

SEQ ID NO: 229345 - RNA, 64 nt, hsa; identical to SEQ ID NO: 82589

SEQ ID NO: 229346 - RNA, 64 nt, hsa; identical to SEQ ID NO: 82590

SEQ ID NO: 229347 - RNA, 64 nt, hsa
gacuauaauaguuugguuucuaaugaaaagucaauagcauuagcaguuauaauucuguuuauaa

SEQ ID NO: 229348 - RNA, 64 nt, hsa
ccaaauggauugucuguggcaaugcagaagcugauagcauuaacagcaggguguuacagcauaa

SEQ ID NO: 229349 - RNA, 64 nt, hsa
auaccaacuauuucaauaaguguuguaccauauguagcauuaaauauaaaauacauaaaagaau

SEQ ID NO: 229350 - RNA, 64 nt, hsa
uaaacacacuuagaauacuacagcauaaaucuguuagcauuauugccaaauaagacaguuggga

SEQ ID NO: 229351 - RNA, 64 nt, hsa
acuuuauuaccuucuuucuaauacaagcauauguuagcauuaaaguucuaggcauacuuuucaa

SEQ ID NO: 229352 - RNA, 64 nt, hsa
uaaauaguauuccaaucacugugcuuaauuuaaauagcauuaucuuaucauuuaucagccuuuu

SEQ ID NO: 229353 - RNA, 64 nt, hsa
gguuucugcagagcacaguuagcuagaaaggugauagcauuaaauguucaucuagaguuaauag

SEQ ID NO: 229354 - RNA, 64 nt, hsa
aacaagcuaccaggaacugugaggcuuugucauuuagcauuagacuuuaaacaagaauuaaaau

SEQ ID NO: 229355 - RNA, 64 nt, hsa
auagaucaacaaauggucauugaaaacacuuguuuagcauuagaauaaaauuauauauguccuu

SEQ ID NO: 229356 - RNA, 64 nt, hsa
agagccaggaaauuucacaggucacaccgauuuuuagcauuaaaaacuaaggaauauacuuagc

SEQ ID NO: 229357 - RNA, 64 nt, hsa
gauaggacauauggaaaaccaacacaaagugcuuuagcauuaaaacucaccaucaaauagaugu

SEQ ID NO: 229358 - RNA, 64 nt, hsa
augacucuugauaacuuguuaaucuguugcugacuagcauuagacuguuacacgaagauaaacu

SEQ ID NO: 229359 - RNA, 64 nt, hsa
cuugguuuaaauuucucucuaccuauaaacaguuuagcauuaaggguuucuauuaaugacacag

SEQ ID NO: 229360 - RNA, 64 nt, hsa
cagaauuauuggccaaguguaauuucuuaaaauuuagcauuacuuuaaauagccagcauguaau

SEQ ID NO: 229361 - RNA, 64 nt, hsa
uggccauaagugggaaaguuuucuguauauugcauagcauuacacauuuaugccuauuuuaaca

SEQ ID NO: 229362 - RNA, 64 nt, hsa
ccaaagccccaagccuuuggugagaagccaauucccacuugacagaaggcguccauccauucau

SEQ ID NO: 229363 - RNA, 64 nt, hsa
cuuggacacaaguguucagagaggucccccucugccacuugacagggaccuucaaaccucgaca

SEQ ID NO: 229364 - RNA, 64 nt, hsa
cuggagggacucggcaccacuugauauucaacagccacuugagccaaauauaaaauuguauuua

SEQ ID NO: 229365 - RNA, 64 nt, hsa
agggggucaguaggugcucuggagggacucggcaccacuugauauucaacagccacuugagcca

SEQ ID NO: 229366 - RNA, 64 nt, hsa
aaugauuuccauuuguauuuguguugaugauggaccacuugaccaucacauuucaguauucaua

SEQ ID NO: 229367 - RNA, 64 nt, hsa
uauucauagaugacugucacauuuuaaaauguucccacuugagcagguacacaacuggucauaa

SEQ ID NO: 229368 - RNA, 64 nt, hsa
aacuuacuaacuuuauugugaaaggucuaaaugcccacuugaaugaagcugagagagagaucua

SEQ ID NO: 229369 - RNA, 64 nt, hsa
uuauccuauuuuuagcaauaauucguuaaugauuccacuugauuuucagaauauuguccugguu

SEQ ID NO: 229370 - RNA, 64 nt, hsa
cugcagggaccucaguguccacccuuccugccucaugucucaaggcagcagcuccucucuggua

SEQ ID NO: 229371 - RNA, 64 nt, hsa
ucaagauuguuguauaugugaaugaaaugauacgaugucucagauuugcuuuaaaauaauaggg

SEQ ID NO: 229372 - RNA, 64 nt, hsa
uuccuugugugaugccuccuuaggcacacaggcaaugucucaaguacuuugaccuuaggguaga

SEQ ID NO: 229373 - RNA, 64 nt, hsa
uugaccuuaggguagaaggcaaagcugccaguaaaugucucagcauugcugcuaauuuuggucc

SEQ ID NO: 229374 - RNA, 64 nt, hsa; identical to SEQ ID NO: 229373

SEQ ID NO: 229375 - RNA, 64 nt, hsa; identical to SEQ ID NO: 229372

SEQ ID NO: 229376 - RNA, 64 nt, hsa; identical to SEQ ID NO: 189946

SEQ ID NO: 229377 - RNA, 64 nt, hsa; identical to SEQ ID NO: 189947

SEQ ID NO: 229378 - RNA, 64 nt, hsa; identical to SEQ ID NO: 189948

SEQ ID NO: 229379 - RNA, 64 nt, hsa; identical to SEQ ID NO: 189949

SEQ ID NO: 229380 - RNA, 64 nt, hsa; identical to SEQ ID NO: 189950

SEQ ID NO: 229381 - RNA, 64 nt, hsa; identical to SEQ ID NO: 189951

SEQ ID NO: 229382 - RNA, 64 nt, hsa; identical to SEQ ID NO: 189952

SEQ ID NO: 229383 - RNA, 64 nt, hsa; identical to SEQ ID NO: 189953

SEQ ID NO: 229384 - RNA, 64 nt, hsa; identical to SEQ ID NO: 189954

SEQ ID NO: 229385 - RNA, 64 nt, hsa
cugguuugacguagucuuuuguauuuucccugccgaagugaauuguuggagaauguaaaccgcc

SEQ ID NO: 229386 - RNA, 64 nt, hsa
ugaccgcagauguccucucggcugaagacuggaggaagugaacacuggagugaagaagcggucu

SEQ ID NO: 229387 - RNA, 64 nt, hsa
uccaggaagaacggaaaugcugucuugugagcaugaagugaacgggcuguuuugcuccagccac

SEQ ID NO: 229388 - RNA, 64 nt, hsa
uguauuugagaagcuggcuguuuaagggaacccagaagugaauucuuuuguaaaguaaagcacc

SEQ ID NO: 229389 - RNA, 64 nt, hsa
gugaagcaagccgcugguagcaucacccuuaugagaagugaagguuuuguaaacuuuccaguau

SEQ ID NO: 229390 - RNA, 64 nt, hsa
accugccaagcaaggcaauagaaggcaaaaaauggaagugaauuaagaugaacucaucugaaau

SEQ ID NO: 229391 - RNA, 64 nt, hsa
cugggggagggggauuagcuagacuaggagaccagaagugaaugggaaagggugaggacuucac

SEQ ID NO: 229392 - RNA, 64 nt, hsa
uacuguguaaauaaacuuucagaacugcuaccaugaagugaaaaugccacauuuugcuuuauaa

SEQ ID NO: 229393 - RNA, 64 nt, hsa
aaaguaaaaaaaguaaaaucaaggugguauauuugaagugaauggugauuggaaauuuuuagcu

SEQ ID NO: 229394 - RNA, 64 nt, hsa
auaaagaguauucugaaaaaaagaagauauggaugaagugaacccaugcagugacuggaugauu

SEQ ID NO: 229395 - RNA, 64 nt, hsa
uaauucauccuagcaaauucuaccuuauuuuacagaagugaaagugagguaucagaaguguuaa

SEQ ID NO: 229396 - RNA, 64 nt, hsa
aagcuaauaaagaaaagagguuuauacugcaaaagaagugaaacuauauguauucacaguugau

SEQ ID NO: 229397 - RNA, 64 nt, hsa
guucacaguagacuuugagugaccgucccaccgugaagugaauucucugagcuggugguguggu

SEQ ID NO: 229398 - RNA, 64 nt, hsa
uugcuguuuuuuaaaugaacacaguugaguauuugaagugaauuugaaaaagaaauguuacuua

SEQ ID NO: 229399 - RNA, 64 nt, hsa
augacuagcaaugguuuaaaaaggaagaagaguggaagugaagaaggugguauaaaugcuguca

SEQ ID NO: 229400 - RNA, 64 nt, hsa
ugagguuuuuaauaucaucuaaaaauaaagcauugaagugaaguuggugaaaauuuguuccugg

SEQ ID NO: 229401 - RNA, 64 nt, hsa
ggccagggauugccuucuaaauuaugauaaaacagaagugaagaguuucagagcaucagauuga

SEQ ID NO: 229402 - RNA, 64 nt, hsa
cguccacaucacaccugugacggaagcacuucuggaagugaacacucguuuugaaagcuugauu

SEQ ID NO: 229403 - RNA, 53 nt, hsa; identical to SEQ ID NO: 167525

SEQ ID NO: 229404 - RNA, 64 nt, hsa; identical to SEQ ID NO: 167526

SEQ ID NO: 229405 - RNA, 64 nt, hsa; identical to SEQ ID NO: 167527

SEQ ID NO: 229406 - RNA, 64 nt, hsa; identical to SEQ ID NO: 167528

SEQ ID NO: 229407 - RNA, 64 nt, hsa; identical to SEQ ID NO: 167529

SEQ ID NO: 229408 - RNA, 64 nt, hsa; identical to SEQ ID NO: 167530

SEQ ID NO: 229409 - RNA, 64 nt, hsa; identical to SEQ ID NO: 167531

SEQ ID NO: 229410 - RNA, 64 nt, hsa; identical to SEQ ID NO: 167532

SEQ ID NO: 229411 - RNA, 64 nt, hsa; identical to SEQ ID NO: 167533

SEQ ID NO: 229412 - RNA, 64 nt, hsa; identical to SEQ ID NO: 167534

SEQ ID NO: 229413 - RNA, 64 nt, hsa; identical to SEQ ID NO: 167535

SEQ ID NO: 229414 - RNA, 64 nt, hsa; identical to SEQ ID NO: 167536

SEQ ID NO: 229415 - RNA, 64 nt, hsa; identical to SEQ ID NO: 167537

SEQ ID NO: 229416 - RNA, 64 nt, hsa; identical to SEQ ID NO: 167538

SEQ ID NO: 229417 - RNA, 64 nt, hsa; identical to SEQ ID NO: 167539

SEQ ID NO: 229418 - RNA, 64 nt, hsa; identical to SEQ ID NO: 167540

SEQ ID NO: 229419 - RNA, 64 nt, hsa; identical to SEQ ID NO: 167541

SEQ ID NO: 229420 - RNA, 64 nt, hsa; identical to SEQ ID NO: 167542

SEQ ID NO: 229421 - RNA, 64 nt, hsa; identical to SEQ ID NO: 167543

SEQ ID NO: 229422 - RNA, 64 nt, hsa; identical to SEQ ID NO: 167544

SEQ ID NO: 229423 - RNA, 64 nt, hsa; identical to SEQ ID NO: 167545

SEQ ID NO: 229424 - RNA, 64 nt, hsa; identical to SEQ ID NO: 167546

SEQ ID NO: 229425 - RNA, 64 nt, hsa; identical to SEQ ID NO: 167547

SEQ ID NO: 229426 - RNA, 64 nt, hsa; identical to SEQ ID NO: 167548

SEQ ID NO: 229427 - RNA, 64 nt, hsa; identical to SEQ ID NO: 167549

SEQ ID NO: 229428 - RNA, 64 nt, hsa; identical to SEQ ID NO: 167550

SEQ ID NO: 229429 - RNA, 64 nt, hsa; identical to SEQ ID NO: 167551

SEQ ID NO: 229430 - RNA, 64 nt, hsa; identical to SEQ ID NO: 167552

SEQ ID NO: 229431 - RNA, 64 nt, hsa; identical to SEQ ID NO: 167553

SEQ ID NO: 229432 - RNA, 64 nt, hsa; identical to SEQ ID NO: 167554

SEQ ID NO: 229433 - RNA, 64 nt, hsa; identical to SEQ ID NO: 167555

SEQ ID NO: 229434 - RNA, 64 nt, hsa; identical to SEQ ID NO: 167556

SEQ ID NO: 229435 - RNA, 64 nt, hsa; identical to SEQ ID NO: 167557

SEQ ID NO: 229436 - RNA, 64 nt, hsa; identical to SEQ ID NO: 167558

SEQ ID NO: 229437 - RNA, 64 nt, hsa; identical to SEQ ID NO: 167559

SEQ ID NO: 229438 - RNA, 64 nt, hsa; identical to SEQ ID NO: 167560

SEQ ID NO: 229439 - RNA, 64 nt, hsa; identical to SEQ ID NO: 167561

SEQ ID NO: 229440 - RNA, 64 nt, hsa; identical to SEQ ID NO: 167562

SEQ ID NO: 229441 - RNA, 64 nt, hsa; identical to SEQ ID NO: 167563

SEQ ID NO: 229442 - RNA, 64 nt, hsa; identical to SEQ ID NO: 167564

SEQ ID NO: 229443 - RNA, 64 nt, hsa; identical to SEQ ID NO: 167565

SEQ ID NO: 229444 - RNA, 64 nt, hsa; identical to SEQ ID NO: 167566

SEQ ID NO: 229445 - RNA, 64 nt, hsa; identical to SEQ ID NO: 167567

SEQ ID NO: 229446 - RNA, 64 nt, hsa; identical to SEQ ID NO: 167568

SEQ ID NO: 229447 - RNA, 64 nt, hsa; identical to SEQ ID NO: 167569

SEQ ID NO: 229448 - RNA, 64 nt, hsa; identical to SEQ ID NO: 167570

SEQ ID NO: 229449 - RNA, 64 nt, hsa; identical to SEQ ID NO: 167571

SEQ ID NO: 229450 - RNA, 64 nt, hsa; identical to SEQ ID NO: 167572

SEQ ID NO: 229451 - RNA, 64 nt, hsa; identical to SEQ ID NO: 167573

SEQ ID NO: 229452 - RNA, 64 nt, hsa; identical to SEQ ID NO: 167574

SEQ ID NO: 229453 - RNA, 64 nt, hsa; identical to SEQ ID NO: 167575

SEQ ID NO: 229454 - RNA, 64 nt, hsa; identical to SEQ ID NO: 199847

SEQ ID NO: 229455 - RNA, 64 nt, hsa; identical to SEQ ID NO: 199848

SEQ ID NO: 229456 - RNA, 64 nt, hsa; identical to SEQ ID NO: 199849

SEQ ID NO: 229457 - RNA, 64 nt, hsa; identical to SEQ ID NO: 199850

SEQ ID NO: 229458 - RNA, 64 nt, hsa; identical to SEQ ID NO: 199851

SEQ ID NO: 229459 - RNA, 64 nt, hsa; identical to SEQ ID NO: 199852

SEQ ID NO: 229460 - RNA, 64 nt, hsa; identical to SEQ ID NO: 199853

SEQ ID NO: 229461 - RNA, 64 nt, hsa; identical to SEQ ID NO: 199854

SEQ ID NO: 229462 - RNA, 55 nt, hsa; identical to SEQ ID NO: 199855

SEQ ID NO: 229463 - RNA, 64 nt, hsa; identical to SEQ ID NO: 199856

SEQ ID NO: 229464 - RNA, 64 nt, hsa; identical to SEQ ID NO: 199857

SEQ ID NO: 229465 - RNA, 64 nt, hsa; identical to SEQ ID NO: 199858

SEQ ID NO: 229466 - RNA, 64 nt, hsa; identical to SEQ ID NO: 199859

SEQ ID NO: 229467 - RNA, 64 nt, hsa; identical to SEQ ID NO: 199860

SEQ ID NO: 229468 - RNA, 64 nt, hsa; identical to SEQ ID NO: 199861

SEQ ID NO: 229469 - RNA, 64 nt, hsa; identical to SEQ ID NO: 199862

SEQ ID NO: 229470 - RNA, 64 nt, hsa; identical to SEQ ID NO: 199863

SEQ ID NO: 229471 - RNA, 64 nt, hsa; identical to SEQ ID NO: 199864

SEQ ID NO: 229472 - RNA, 64 nt, hsa; identical to SEQ ID NO: 199865

SEQ ID NO: 229473 - RNA, 64 nt, hsa; identical to SEQ ID NO: 199866

SEQ ID NO: 229474 - RNA, 64 nt, hsa; identical to SEQ ID NO: 39347

SEQ ID NO: 229475 - RNA, 64 nt, hsa; identical to SEQ ID NO: 39348

SEQ ID NO: 229476 - RNA, 64 nt, hsa; identical to SEQ ID NO: 39349

SEQ ID NO: 229477 - RNA, 64 nt, hsa; identical to SEQ ID NO: 39350

SEQ ID NO: 229478 - RNA, 64 nt, hsa; identical to SEQ ID NO: 39351

SEQ ID NO: 229479 - RNA, 64 nt, hsa; identical to SEQ ID NO: 39352

SEQ ID NO: 229480 - RNA, 64 nt, hsa; identical to SEQ ID NO: 39353

SEQ ID NO: 229481 - RNA, 64 nt, hsa; identical to SEQ ID NO: 39354

SEQ ID NO: 229482 - RNA, 64 nt, hsa; identical to SEQ ID NO: 39355

SEQ ID NO: 229483 - RNA, 64 nt, hsa; identical to SEQ ID NO: 39356

SEQ ID NO: 229484 - RNA, 64 nt, hsa; identical to SEQ ID NO: 39357

SEQ ID NO: 229485 - RNA, 64 nt, hsa; identical to SEQ ID NO: 39358

SEQ ID NO: 229486 - RNA, 64 nt, hsa; identical to SEQ ID NO: 39359

SEQ ID NO: 229487 - RNA, 64 nt, hsa; identical to SEQ ID NO: 39360

SEQ ID NO: 229488 - RNA, 64 nt, hsa; identical to SEQ ID NO: 39361

SEQ ID NO: 229489 - RNA, 64 nt, hsa; identical to SEQ ID NO: 39362

SEQ ID NO: 229490 - RNA, 64 nt, hsa; identical to SEQ ID NO: 39363

SEQ ID NO: 229491 - RNA, 64 nt, hsa; identical to SEQ ID NO: 39364

SEQ ID NO: 229492 - RNA, 64 nt, hsa; identical to SEQ ID NO: 39365

SEQ ID NO: 229493 - RNA, 64 nt, hsa; identical to SEQ ID NO: 39366

SEQ ID NO: 229494 - RNA, 64 nt, hsa; identical to SEQ ID NO: 39367

SEQ ID NO: 229495 - RNA, 64 nt, hsa; identical to SEQ ID NO: 39368

SEQ ID NO: 229496 - RNA, 64 nt, hsa; identical to SEQ ID NO: 39369

SEQ ID NO: 229497 - RNA, 64 nt, hsa; identical to SEQ ID NO: 39370

SEQ ID NO: 229498 - RNA, 64 nt, hsa; identical to SEQ ID NO: 39371

SEQ ID NO: 229499 - RNA, 64 nt, hsa; identical to SEQ ID NO: 39372

SEQ ID NO: 229500 - RNA, 64 nt, hsa; identical to SEQ ID NO: 39373

SEQ ID NO: 229501 - RNA, 64 nt, hsa; identical to SEQ ID NO: 39374

SEQ ID NO: 229502 - RNA, 64 nt, hsa; identical to SEQ ID NO: 39375

SEQ ID NO: 229503 - RNA, 64 nt, hsa; identical to SEQ ID NO: 39376

SEQ ID NO: 229504 - RNA, 64 nt, hsa; identical to SEQ ID NO: 39377

SEQ ID NO: 229505 - RNA, 64 nt, hsa; identical to SEQ ID NO: 39378

SEQ ID NO: 229506 - RNA, 64 nt, hsa; identical to SEQ ID NO: 39379

SEQ ID NO: 229507 - RNA, 64 nt, hsa; identical to SEQ ID NO: 39380

SEQ ID NO: 229508 - RNA, 64 nt, hsa; identical to SEQ ID NO: 39381

SEQ ID NO: 229509 - RNA, 64 nt, hsa; identical to SEQ ID NO: 39382

SEQ ID NO: 229510 - RNA, 64 nt, hsa; identical to SEQ ID NO: 39383

SEQ ID NO: 229511 - RNA, 64 nt, hsa; identical to SEQ ID NO: 39384

SEQ ID NO: 229512 - RNA, 64 nt, hsa; identical to SEQ ID NO: 39385

SEQ ID NO: 229513 - RNA, 64 nt, hsa; identical to SEQ ID NO: 39386

SEQ ID NO: 229514 - RNA, 64 nt, hsa; identical to SEQ ID NO: 39387

SEQ ID NO: 229515 - RNA, 64 nt, hsa; identical to SEQ ID NO: 39388

SEQ ID NO: 229516 - RNA, 64 nt, hsa; identical to SEQ ID NO: 39389

SEQ ID NO: 229517 - RNA, 64 nt, hsa; identical to SEQ ID NO: 39390

SEQ ID NO: 229518 - RNA, 64 nt, hsa; identical to SEQ ID NO: 39391

SEQ ID NO: 229519 - RNA, 64 nt, hsa; identical to SEQ ID NO: 39392

SEQ ID NO: 229520 - RNA, 64 nt, hsa; identical to SEQ ID NO: 39393

SEQ ID NO: 229521 - RNA, 64 nt, hsa; identical to SEQ ID NO: 39394

SEQ ID NO: 229522 - RNA, 64 nt, hsa; identical to SEQ ID NO: 39395

SEQ ID NO: 229523 - RNA, 64 nt, hsa; identical to SEQ ID NO: 39396

SEQ ID NO: 229524 - RNA, 64 nt, hsa; identical to SEQ ID NO: 39397

SEQ ID NO: 229525 - RNA, 64 nt, hsa; identical to SEQ ID NO: 39398

SEQ ID NO: 229526 - RNA, 64 nt, hsa; identical to SEQ ID NO: 39399

SEQ ID NO: 229527 - RNA, 64 nt, hsa; identical to SEQ ID NO: 39400

SEQ ID NO: 229528 - RNA, 64 nt, hsa; identical to SEQ ID NO: 39401

SEQ ID NO: 229529 - RNA, 64 nt, hsa; identical to SEQ ID NO: 39402

SEQ ID NO: 229530 - RNA, 64 nt, hsa; identical to SEQ ID NO: 39403

SEQ ID NO: 229531 - RNA, 64 nt, hsa; identical to SEQ ID NO: 39404

SEQ ID NO: 229532 - RNA, 64 nt, hsa; identical to SEQ ID NO: 39405

SEQ ID NO: 229533 - RNA, 64 nt, hsa; identical to SEQ ID NO: 39406

SEQ ID NO: 229534 - RNA, 64 nt, hsa; identical to SEQ ID NO: 39407

SEQ ID NO: 229535 - RNA, 64 nt, hsa; identical to SEQ ID NO: 39408

SEQ ID NO: 229536 - RNA, 64 nt, hsa; identical to SEQ ID NO: 39409

SEQ ID NO: 229537 - RNA, 64 nt, hsa; identical to SEQ ID NO: 39410

SEQ ID NO: 229538 - RNA, 64 nt, hsa; identical to SEQ ID NO: 39411

SEQ ID NO: 229539 - RNA, 64 nt, hsa; identical to SEQ ID NO: 39412

SEQ ID NO: 229540 - RNA, 64 nt, hsa; identical to SEQ ID NO: 39413

SEQ ID NO: 229541 - RNA, 64 nt, hsa; identical to SEQ ID NO: 39414

SEQ ID NO: 229542 - RNA, 64 nt, hsa; identical to SEQ ID NO: 39415

SEQ ID NO: 229543 - RNA, 64 nt, hsa; identical to SEQ ID NO: 39416

SEQ ID NO: 229544 - RNA, 64 nt, hsa; identical to SEQ ID NO: 39417

SEQ ID NO: 229545 - RNA, 64 nt, hsa; identical to SEQ ID NO: 39418

SEQ ID NO: 229546 - RNA, 64 nt, hsa; identical to SEQ ID NO: 39419

SEQ ID NO: 229547 - RNA, 64 nt, hsa; identical to SEQ ID NO: 39420

SEQ ID NO: 229548 - RNA, 64 nt, hsa; identical to SEQ ID NO: 39421

SEQ ID NO: 229549 - RNA, 64 nt, hsa; identical to SEQ ID NO: 39422

SEQ ID NO: 229550 - RNA, 64 nt, hsa; identical to SEQ ID NO: 39423

SEQ ID NO: 229551 - RNA, 64 nt, hsa; identical to SEQ ID NO: 39424

SEQ ID NO: 229552 - RNA, 64 nt, hsa; identical to SEQ ID NO: 39425

SEQ ID NO: 229553 - RNA, 64 nt, hsa; identical to SEQ ID NO: 39426

SEQ ID NO: 229554 - RNA, 64 nt, hsa; identical to SEQ ID NO: 39427

SEQ ID NO: 229555 - RNA, 64 nt, hsa; identical to SEQ ID NO: 39428

SEQ ID NO: 229556 - RNA, 64 nt, hsa; identical to SEQ ID NO: 39429

SEQ ID NO: 229557 - RNA, 64 nt, hsa; identical to SEQ ID NO: 39430

SEQ ID NO: 229558 - RNA, 64 nt, hsa; identical to SEQ ID NO: 39431

SEQ ID NO: 229559 - RNA, 64 nt, hsa; identical to SEQ ID NO: 39432

SEQ ID NO: 229560 - RNA, 64 nt, hsa; identical to SEQ ID NO: 39433

SEQ ID NO: 229561 - RNA, 64 nt, hsa; identical to SEQ ID NO: 39434

SEQ ID NO: 229562 - RNA, 64 nt, hsa; identical to SEQ ID NO: 39435

SEQ ID NO: 229563 - RNA, 64 nt, hsa; identical to SEQ ID NO: 39436

SEQ ID NO: 229564 - RNA, 64 nt, hsa; identical to SEQ ID NO: 39437

SEQ ID NO: 229565 - RNA, 64 nt, hsa; identical to SEQ ID NO: 39438

SEQ ID NO: 229566 - RNA, 64 nt, hsa; identical to SEQ ID NO: 39439

SEQ ID NO: 229567 - RNA, 64 nt, hsa; identical to SEQ ID NO: 39440

SEQ ID NO: 229568 - RNA, 64 nt, hsa; identical to SEQ ID NO: 39441

SEQ ID NO: 229569 - RNA, 64 nt, hsa; identical to SEQ ID NO: 39442

SEQ ID NO: 229570 - RNA, 64 nt, hsa; identical to SEQ ID NO: 39443

SEQ ID NO: 229571 - RNA, 64 nt, hsa; identical to SEQ ID NO: 39444

SEQ ID NO: 229572 - RNA, 64 nt, hsa; identical to SEQ ID NO: 39445

SEQ ID NO: 229573 - RNA, 64 nt, hsa; identical to SEQ ID NO: 39446

SEQ ID NO: 229574 - RNA, 64 nt, hsa; identical to SEQ ID NO: 39447

SEQ ID NO: 229575 - RNA, 64 nt, hsa; identical to SEQ ID NO: 39448

SEQ ID NO: 229576 - RNA, 64 nt, hsa; identical to SEQ ID NO: 39449

SEQ ID NO: 229577 - RNA, 64 nt, hsa; identical to SEQ ID NO: 39450

SEQ ID NO: 229578 - RNA, 64 nt, hsa; identical to SEQ ID NO: 39451

SEQ ID NO: 229579 - RNA, 64 nt, hsa; identical to SEQ ID NO: 39452

SEQ ID NO: 229580 - RNA, 64 nt, hsa; identical to SEQ ID NO: 39453

SEQ ID NO: 229581 - RNA, 64 nt, hsa; identical to SEQ ID NO: 39454

SEQ ID NO: 229582 - RNA, 64 nt, hsa; identical to SEQ ID NO: 39455

SEQ ID NO: 229583 - RNA, 64 nt, hsa; identical to SEQ ID NO: 39456

SEQ ID NO: 229584 - RNA, 64 nt, hsa; identical to SEQ ID NO: 39457

SEQ ID NO: 229585 - RNA, 64 nt, hsa; identical to SEQ ID NO: 39458

SEQ ID NO: 229586 - RNA, 64 nt, hsa; identical to SEQ ID NO: 39459

SEQ ID NO: 229587 - RNA, 64 nt, hsa; identical to SEQ ID NO: 39460

SEQ ID NO: 229588 - RNA, 64 nt, hsa; identical to SEQ ID NO: 39461

SEQ ID NO: 229589 - RNA, 64 nt, hsa; identical to SEQ ID NO: 39462

SEQ ID NO: 229590 - RNA, 64 nt, hsa; identical to SEQ ID NO: 39463

SEQ ID NO: 229591 - RNA, 64 nt, hsa; identical to SEQ ID NO: 39464

SEQ ID NO: 229592 - RNA, 64 nt, hsa; identical to SEQ ID NO: 39465

SEQ ID NO: 229593 - RNA, 64 nt, hsa; identical to SEQ ID NO: 39466

SEQ ID NO: 229594 - RNA, 64 nt, hsa; identical to SEQ ID NO: 39467

SEQ ID NO: 229595 - RNA, 64 nt, hsa; identical to SEQ ID NO: 39468

SEQ ID NO: 229596 - RNA, 64 nt, hsa; identical to SEQ ID NO: 39469

SEQ ID NO: 229597 - RNA, 64 nt, hsa; identical to SEQ ID NO: 39470

SEQ ID NO: 229598 - RNA, 64 nt, hsa; identical to SEQ ID NO: 39471

SEQ ID NO: 229599 - RNA, 64 nt, hsa; identical to SEQ ID NO: 39472

SEQ ID NO: 229600 - RNA, 64 nt, hsa; identical to SEQ ID NO: 39473

SEQ ID NO: 229601 - RNA, 64 nt, hsa; identical to SEQ ID NO: 39474

SEQ ID NO: 229602 - RNA, 64 nt, hsa; identical to SEQ ID NO: 39475

SEQ ID NO: 229603 - RNA, 64 nt, hsa; identical to SEQ ID NO: 39476

SEQ ID NO: 229604 - RNA, 64 nt, hsa; identical to SEQ ID NO: 39477

SEQ ID NO: 229605 - RNA, 64 nt, hsa; identical to SEQ ID NO: 39478

SEQ ID NO: 229606 - RNA, 64 nt, hsa; identical to SEQ ID NO: 39479

SEQ ID NO: 229607 - RNA, 64 nt, hsa; identical to SEQ ID NO: 39480

SEQ ID NO: 229608 - RNA, 64 nt, hsa; identical to SEQ ID NO: 39481

SEQ ID NO: 229609 - RNA, 64 nt, hsa; identical to SEQ ID NO: 39482

SEQ ID NO: 229610 - RNA, 64 nt, hsa; identical to SEQ ID NO: 39483

SEQ ID NO: 229611 - RNA, 64 nt, hsa; identical to SEQ ID NO: 39484

SEQ ID NO: 229612 - RNA, 64 nt, hsa; identical to SEQ ID NO: 39485

SEQ ID NO: 229613 - RNA, 64 nt, hsa; identical to SEQ ID NO: 39486

SEQ ID NO: 229614 - RNA, 64 nt, hsa; identical to SEQ ID NO: 39487

SEQ ID NO: 229615 - RNA, 64 nt, hsa; identical to SEQ ID NO: 39488

SEQ ID NO: 229616 - RNA, 64 nt, hsa; identical to SEQ ID NO: 39489

SEQ ID NO: 229617 - RNA, 64 nt, hsa; identical to SEQ ID NO: 39490

SEQ ID NO: 229618 - RNA, 64 nt, hsa; identical to SEQ ID NO: 39491

SEQ ID NO: 229619 - RNA, 64 nt, hsa; identical to SEQ ID NO: 39492

SEQ ID NO: 229620 - RNA, 64 nt, hsa; identical to SEQ ID NO: 39493

SEQ ID NO: 229621 - RNA, 64 nt, hsa; identical to SEQ ID NO: 39494

SEQ ID NO: 229622 - RNA, 64 nt, hsa; identical to SEQ ID NO: 39495

SEQ ID NO: 229623 - RNA, 64 nt, hsa; identical to SEQ ID NO: 39496

SEQ ID NO: 229624 - RNA, 64 nt, hsa; identical to SEQ ID NO: 39497

SEQ ID NO: 229625 - RNA, 64 nt, hsa; identical to SEQ ID NO: 39498

SEQ ID NO: 229626 - RNA, 64 nt, hsa; identical to SEQ ID NO: 39499

SEQ ID NO: 229627 - RNA, 64 nt, hsa; identical to SEQ ID NO: 39500

SEQ ID NO: 229628 - RNA, 64 nt, hsa; identical to SEQ ID NO: 39501

SEQ ID NO: 229629 - RNA, 64 nt, hsa; identical to SEQ ID NO: 39502

SEQ ID NO: 229630 - RNA, 64 nt, hsa; identical to SEQ ID NO: 39503

SEQ ID NO: 229631 - RNA, 64 nt, hsa; identical to SEQ ID NO: 39504

SEQ ID NO: 229632 - RNA, 64 nt, hsa; identical to SEQ ID NO: 39505

SEQ ID NO: 229633 - RNA, 64 nt, hsa; identical to SEQ ID NO: 39506

SEQ ID NO: 229634 - RNA, 64 nt, hsa; identical to SEQ ID NO: 39507

SEQ ID NO: 229635 - RNA, 64 nt, hsa; identical to SEQ ID NO: 39508

SEQ ID NO: 229636 - RNA, 64 nt, hsa; identical to SEQ ID NO: 39509

SEQ ID NO: 229637 - RNA, 64 nt, hsa; identical to SEQ ID NO: 39510

SEQ ID NO: 229638 - RNA, 64 nt, hsa; identical to SEQ ID NO: 39511

SEQ ID NO: 229639 - RNA, 64 nt, hsa; identical to SEQ ID NO: 39512

SEQ ID NO: 229640 - RNA, 64 nt, hsa; identical to SEQ ID NO: 39513

SEQ ID NO: 229641 - RNA, 64 nt, hsa; identical to SEQ ID NO: 39514

SEQ ID NO: 229642 - RNA, 64 nt, hsa; identical to SEQ ID NO: 39515

SEQ ID NO: 229643 - RNA, 64 nt, hsa; identical to SEQ ID NO: 39516

SEQ ID NO: 229644 - RNA, 64 nt, hsa; identical to SEQ ID NO: 39517

SEQ ID NO: 229645 - RNA, 64 nt, hsa; identical to SEQ ID NO: 39518

SEQ ID NO: 229646 - RNA, 64 nt, hsa; identical to SEQ ID NO: 39519

SEQ ID NO: 229647 - RNA, 64 nt, hsa; identical to SEQ ID NO: 39520

SEQ ID NO: 229648 - RNA, 64 nt, hsa; identical to SEQ ID NO: 39521

SEQ ID NO: 229649 - RNA, 64 nt, hsa; identical to SEQ ID NO: 39522

SEQ ID NO: 229650 - RNA, 64 nt, hsa; identical to SEQ ID NO: 39523

SEQ ID NO: 229651 - RNA, 64 nt, hsa; identical to SEQ ID NO: 39524

SEQ ID NO: 229652 - RNA, 64 nt, hsa; identical to SEQ ID NO: 39525

SEQ ID NO: 229653 - RNA, 64 nt, hsa; identical to SEQ ID NO: 39526

SEQ ID NO: 229654 - RNA, 64 nt, hsa; identical to SEQ ID NO: 39527

SEQ ID NO: 229655 - RNA, 64 nt, hsa; identical to SEQ ID NO: 39528

SEQ ID NO: 229656 - RNA, 64 nt, hsa; identical to SEQ ID NO: 39529

SEQ ID NO: 229657 - RNA, 64 nt, hsa; identical to SEQ ID NO: 39530

SEQ ID NO: 229658 - RNA, 64 nt, hsa; identical to SEQ ID NO: 39531

SEQ ID NO: 229659 - RNA, 64 nt, hsa; identical to SEQ ID NO: 39532

SEQ ID NO: 229660 - RNA, 64 nt, hsa; identical to SEQ ID NO: 39533

SEQ ID NO: 229661 - RNA, 64 nt, hsa; identical to SEQ ID NO: 39534

SEQ ID NO: 229662 - RNA, 64 nt, hsa; identical to SEQ ID NO: 39535

SEQ ID NO: 229663 - RNA, 64 nt, hsa; identical to SEQ ID NO: 39536

SEQ ID NO: 229664 - RNA, 64 nt, hsa; identical to SEQ ID NO: 39537

SEQ ID NO: 229665 - RNA, 64 nt, hsa; identical to SEQ ID NO: 39538

SEQ ID NO: 229666 - RNA, 64 nt, hsa; identical to SEQ ID NO: 39539

SEQ ID NO: 229667 - RNA, 64 nt, hsa; identical to SEQ ID NO: 39540

SEQ ID NO: 229668 - RNA, 64 nt, hsa; identical to SEQ ID NO: 39541

SEQ ID NO: 229669 - RNA, 64 nt, hsa; identical to SEQ ID NO: 39542

SEQ ID NO: 229670 - RNA, 64 nt, hsa; identical to SEQ ID NO: 39543

SEQ ID NO: 229671 - RNA, 64 nt, hsa; identical to SEQ ID NO: 39544

SEQ ID NO: 229672 - RNA, 64 nt, hsa; identical to SEQ ID NO: 39545

SEQ ID NO: 229673 - RNA, 64 nt, hsa; identical to SEQ ID NO: 39546

SEQ ID NO: 229674 - RNA, 64 nt, hsa; identical to SEQ ID NO: 39547

SEQ ID NO: 229675 - RNA, 64 nt, hsa; identical to SEQ ID NO: 39548

SEQ ID NO: 229676 - RNA, 64 nt, hsa; identical to SEQ ID NO: 39549

SEQ ID NO: 229677 - RNA, 64 nt, hsa; identical to SEQ ID NO: 39550

SEQ ID NO: 229678 - RNA, 64 nt, hsa; identical to SEQ ID NO: 39551

SEQ ID NO: 229679 - RNA, 64 nt, hsa; identical to SEQ ID NO: 39552

SEQ ID NO: 229680 - RNA, 64 nt, hsa; identical to SEQ ID NO: 39553

SEQ ID NO: 229681 - RNA, 64 nt, hsa; identical to SEQ ID NO: 39554

SEQ ID NO: 229682 - RNA, 64 nt, hsa; identical to SEQ ID NO: 39555

SEQ ID NO: 229683 - RNA, 64 nt, hsa; identical to SEQ ID NO: 39556

SEQ ID NO: 229684 - RNA, 64 nt, hsa; identical to SEQ ID NO: 39557

SEQ ID NO: 229685 - RNA, 64 nt, hsa; identical to SEQ ID NO: 39558

SEQ ID NO: 229686 - RNA, 64 nt, hsa; identical to SEQ ID NO: 39559

SEQ ID NO: 229687 - RNA, 64 nt, hsa; identical to SEQ ID NO: 39560

SEQ ID NO: 229688 - RNA, 64 nt, hsa; identical to SEQ ID NO: 39561

SEQ ID NO: 229689 - RNA, 64 nt, hsa; identical to SEQ ID NO: 39562

SEQ ID NO: 229690 - RNA, 64 nt, hsa; identical to SEQ ID NO: 39563

SEQ ID NO: 229691 - RNA, 64 nt, hsa; identical to SEQ ID NO: 39564

SEQ ID NO: 229692 - RNA, 64 nt, hsa; identical to SEQ ID NO: 39565

SEQ ID NO: 229693 - RNA, 64 nt, hsa; identical to SEQ ID NO: 39566

SEQ ID NO: 229694 - RNA, 64 nt, hsa; identical to SEQ ID NO: 39567

SEQ ID NO: 229695 - RNA, 64 nt, hsa; identical to SEQ ID NO: 39568

SEQ ID NO: 229696 - RNA, 64 nt, hsa; identical to SEQ ID NO: 39569

SEQ ID NO: 229697 - RNA, 64 nt, hsa; identical to SEQ ID NO: 39570

SEQ ID NO: 229698 - RNA, 64 nt, hsa; identical to SEQ ID NO: 39571

SEQ ID NO: 229699 - RNA, 64 nt, hsa; identical to SEQ ID NO: 39572

SEQ ID NO: 229700 - RNA, 64 nt, hsa; identical to SEQ ID NO: 39573

SEQ ID NO: 229701 - RNA, 64 nt, hsa; identical to SEQ ID NO: 39574

SEQ ID NO: 229702 - RNA, 64 nt, hsa; identical to SEQ ID NO: 39575

SEQ ID NO: 229703 - RNA, 64 nt, hsa; identical to SEQ ID NO: 39576

SEQ ID NO: 229704 - RNA, 64 nt, hsa; identical to SEQ ID NO: 39577

SEQ ID NO: 229705 - RNA, 64 nt, hsa; identical to SEQ ID NO: 39578

SEQ ID NO: 229706 - RNA, 64 nt, hsa; identical to SEQ ID NO: 39579

SEQ ID NO: 229707 - RNA, 64 nt, hsa; identical to SEQ ID NO: 39580

SEQ ID NO: 229708 - RNA, 64 nt, hsa; identical to SEQ ID NO: 39581

SEQ ID NO: 229709 - RNA, 64 nt, hsa; identical to SEQ ID NO: 39582

SEQ ID NO: 229710 - RNA, 64 nt, hsa; identical to SEQ ID NO: 39583

SEQ ID NO: 229711 - RNA, 64 nt, hsa; identical to SEQ ID NO: 39584

SEQ ID NO: 229712 - RNA, 64 nt, hsa; identical to SEQ ID NO: 39585

SEQ ID NO: 229713 - RNA, 64 nt, hsa; identical to SEQ ID NO: 39586

SEQ ID NO: 229714 - RNA, 64 nt, hsa; identical to SEQ ID NO: 39587

SEQ ID NO: 229715 - RNA, 64 nt, hsa; identical to SEQ ID NO: 39588

SEQ ID NO: 229716 - RNA, 64 nt, hsa; identical to SEQ ID NO: 39589

SEQ ID NO: 229717 - RNA, 64 nt, hsa; identical to SEQ ID NO: 39590

SEQ ID NO: 229718 - RNA, 64 nt, hsa; identical to SEQ ID NO: 39591

SEQ ID NO: 229719 - RNA, 64 nt, hsa; identical to SEQ ID NO: 39592

SEQ ID NO: 229720 - RNA, 64 nt, hsa; identical to SEQ ID NO: 39593

SEQ ID NO: 229721 - RNA, 64 nt, hsa; identical to SEQ ID NO: 39594

SEQ ID NO: 229722 - RNA, 64 nt, hsa; identical to SEQ ID NO: 39595

SEQ ID NO: 229723 - RNA, 64 nt, hsa; identical to SEQ ID NO: 39596

SEQ ID NO: 229724 - RNA, 64 nt, hsa; identical to SEQ ID NO: 39597

SEQ ID NO: 229725 - RNA, 64 nt, hsa; identical to SEQ ID NO: 39598

SEQ ID NO: 229726 - RNA, 64 nt, hsa; identical to SEQ ID NO: 39599

SEQ ID NO: 229727 - RNA, 64 nt, hsa; identical to SEQ ID NO: 39600

SEQ ID NO: 229728 - RNA, 64 nt, hsa; identical to SEQ ID NO: 39601

SEQ ID NO: 229729 - RNA, 64 nt, hsa; identical to SEQ ID NO: 39602

SEQ ID NO: 229730 - RNA, 64 nt, hsa; identical to SEQ ID NO: 39603

SEQ ID NO: 229731 - RNA, 64 nt, hsa; identical to SEQ ID NO: 39604

SEQ ID NO: 229732 - RNA, 64 nt, hsa; identical to SEQ ID NO: 39605

SEQ ID NO: 229733 - RNA, 64 nt, hsa; identical to SEQ ID NO: 39606

SEQ ID NO: 229734 - RNA, 64 nt, hsa; identical to SEQ ID NO: 39607

SEQ ID NO: 229735 - RNA, 64 nt, hsa; identical to SEQ ID NO: 39608

SEQ ID NO: 229736 - RNA, 64 nt, hsa; identical to SEQ ID NO: 39609

SEQ ID NO: 229737 - RNA, 64 nt, hsa; identical to SEQ ID NO: 39610

SEQ ID NO: 229738 - RNA, 64 nt, hsa; identical to SEQ ID NO: 39611

SEQ ID NO: 229739 - RNA, 64 nt, hsa; identical to SEQ ID NO: 39612

SEQ ID NO: 229740 - RNA, 64 nt, hsa; identical to SEQ ID NO: 39613

SEQ ID NO: 229741 - RNA, 64 nt, hsa; identical to SEQ ID NO: 39614

SEQ ID NO: 229742 - RNA, 64 nt, hsa; identical to SEQ ID NO: 39615

SEQ ID NO: 229743 - RNA, 64 nt, hsa; identical to SEQ ID NO: 39616

SEQ ID NO: 229744 - RNA, 64 nt, hsa; identical to SEQ ID NO: 39617

SEQ ID NO: 229745 - RNA, 64 nt, hsa; identical to SEQ ID NO: 39618

SEQ ID NO: 229746 - RNA, 64 nt, hsa; identical to SEQ ID NO: 39619

SEQ ID NO: 229747 - RNA, 64 nt, hsa; identical to SEQ ID NO: 39620

SEQ ID NO: 229748 - RNA, 64 nt, hsa; identical to SEQ ID NO: 39621

SEQ ID NO: 229749 - RNA, 64 nt, hsa; identical to SEQ ID NO: 39622

SEQ ID NO: 229750 - RNA, 64 nt, hsa; identical to SEQ ID NO: 39623

SEQ ID NO: 229751 - RNA, 64 nt, hsa; identical to SEQ ID NO: 39624

SEQ ID NO: 229752 - RNA, 64 nt, hsa; identical to SEQ ID NO: 39625

SEQ ID NO: 229753 - RNA, 64 nt, hsa; identical to SEQ ID NO: 39626

SEQ ID NO: 229754 - RNA, 64 nt, hsa; identical to SEQ ID NO: 39627

SEQ ID NO: 229755 - RNA, 64 nt, hsa; identical to SEQ ID NO: 39628

SEQ ID NO: 229756 - RNA, 64 nt, hsa; identical to SEQ ID NO: 39629

SEQ ID NO: 229757 - RNA, 64 nt, hsa; identical to SEQ ID NO: 39630

SEQ ID NO: 229758 - RNA, 64 nt, hsa; identical to SEQ ID NO: 39631

SEQ ID NO: 229759 - RNA, 64 nt, hsa; identical to SEQ ID NO: 39632

SEQ ID NO: 229760 - RNA, 64 nt, hsa; identical to SEQ ID NO: 39633

SEQ ID NO: 229761 - RNA, 64 nt, hsa; identical to SEQ ID NO: 39634

SEQ ID NO: 229762 - RNA, 64 nt, hsa; identical to SEQ ID NO: 39635

SEQ ID NO: 229763 - RNA, 64 nt, hsa; identical to SEQ ID NO: 39636

SEQ ID NO: 229764 - RNA, 64 nt, hsa; identical to SEQ ID NO: 39637

SEQ ID NO: 229765 - RNA, 64 nt, hsa; identical to SEQ ID NO: 39638

SEQ ID NO: 229766 - RNA, 64 nt, hsa; identical to SEQ ID NO: 39639

SEQ ID NO: 229767 - RNA, 64 nt, hsa; identical to SEQ ID NO: 39640

SEQ ID NO: 229768 - RNA, 64 nt, hsa; identical to SEQ ID NO: 39641

SEQ ID NO: 229769 - RNA, 64 nt, hsa; identical to SEQ ID NO: 39642

SEQ ID NO: 229770 - RNA, 64 nt, hsa; identical to SEQ ID NO: 39643

SEQ ID NO: 229771 - RNA, 64 nt, hsa; identical to SEQ ID NO: 39644

SEQ ID NO: 229772 - RNA, 64 nt, hsa; identical to SEQ ID NO: 39645

SEQ ID NO: 229773 - RNA, 64 nt, hsa; identical to SEQ ID NO: 39646

SEQ ID NO: 229774 - RNA, 64 nt, hsa; identical to SEQ ID NO: 39647

SEQ ID NO: 229775 - RNA, 64 nt, hsa; identical to SEQ ID NO: 39648

SEQ ID NO: 229776 - RNA, 64 nt, hsa; identical to SEQ ID NO: 39649

SEQ ID NO: 229777 - RNA, 64 nt, hsa; identical to SEQ ID NO: 39650

SEQ ID NO: 229778 - RNA, 64 nt, hsa; identical to SEQ ID NO: 39651

SEQ ID NO: 229779 - RNA, 64 nt, hsa; identical to SEQ ID NO: 39652

SEQ ID NO: 229780 - RNA, 64 nt, hsa; identical to SEQ ID NO: 39653

SEQ ID NO: 229781 - RNA, 64 nt, hsa; identical to SEQ ID NO: 39654

SEQ ID NO: 229782 - RNA, 64 nt, hsa; identical to SEQ ID NO: 39655

SEQ ID NO: 229783 - RNA, 64 nt, hsa; identical to SEQ ID NO: 39656

SEQ ID NO: 229784 - RNA, 64 nt, hsa; identical to SEQ ID NO: 39657

SEQ ID NO: 229785 - RNA, 64 nt, hsa; identical to SEQ ID NO: 39658

SEQ ID NO: 229786 - RNA, 64 nt, hsa; identical to SEQ ID NO: 39659

SEQ ID NO: 229787 - RNA, 64 nt, hsa; identical to SEQ ID NO: 39660

SEQ ID NO: 229788 - RNA, 64 nt, hsa; identical to SEQ ID NO: 39661

SEQ ID NO: 229789 - RNA, 64 nt, hsa; identical to SEQ ID NO: 39662

SEQ ID NO: 229790 - RNA, 64 nt, hsa; identical to SEQ ID NO: 39663

SEQ ID NO: 229791 - RNA, 64 nt, hsa; identical to SEQ ID NO: 39664

SEQ ID NO: 229792 - RNA, 64 nt, hsa; identical to SEQ ID NO: 39665

SEQ ID NO: 229793 - RNA, 64 nt, hsa; identical to SEQ ID NO: 39666

SEQ ID NO: 229794 - RNA, 64 nt, hsa; identical to SEQ ID NO: 39667

SEQ ID NO: 229795 - RNA, 64 nt, hsa; identical to SEQ ID NO: 39668

SEQ ID NO: 229796 - RNA, 64 nt, hsa; identical to SEQ ID NO: 39669

SEQ ID NO: 229797 - RNA, 64 nt, hsa; identical to SEQ ID NO: 39670

SEQ ID NO: 229798 - RNA, 64 nt, hsa; identical to SEQ ID NO: 39671

SEQ ID NO: 229799 - RNA, 64 nt, hsa; identical to SEQ ID NO: 39672

SEQ ID NO: 229800 - RNA, 64 nt, hsa; identical to SEQ ID NO: 39673

SEQ ID NO: 229801 - RNA, 64 nt, hsa; identical to SEQ ID NO: 39674

SEQ ID NO: 229802 - RNA, 64 nt, hsa; identical to SEQ ID NO: 39675

SEQ ID NO: 229803 - RNA, 64 nt, hsa; identical to SEQ ID NO: 39676

SEQ ID NO: 229804 - RNA, 64 nt, hsa; identical to SEQ ID NO: 39677

SEQ ID NO: 229805 - RNA, 64 nt, hsa; identical to SEQ ID NO: 39678

SEQ ID NO: 229806 - RNA, 64 nt, hsa; identical to SEQ ID NO: 39679

SEQ ID NO: 229807 - RNA, 64 nt, hsa; identical to SEQ ID NO: 39680

SEQ ID NO: 229808 - RNA, 64 nt, hsa; identical to SEQ ID NO: 39681

SEQ ID NO: 229809 - RNA, 64 nt, hsa; identical to SEQ ID NO: 39682

SEQ ID NO: 229810 - RNA, 64 nt, hsa; identical to SEQ ID NO: 39683

SEQ ID NO: 229811 - RNA, 64 nt, hsa; identical to SEQ ID NO: 39684

SEQ ID NO: 229812 - RNA, 64 nt, hsa; identical to SEQ ID NO: 39685

SEQ ID NO: 229813 - RNA, 64 nt, hsa; identical to SEQ ID NO: 39686

SEQ ID NO: 229814 - RNA, 64 nt, hsa; identical to SEQ ID NO: 39687

SEQ ID NO: 229815 - RNA, 64 nt, hsa; identical to SEQ ID NO: 39688

SEQ ID NO: 229816 - RNA, 64 nt, hsa; identical to SEQ ID NO: 39689

SEQ ID NO: 229817 - RNA, 64 nt, hsa; identical to SEQ ID NO: 39690

SEQ ID NO: 229818 - RNA, 64 nt, hsa; identical to SEQ ID NO: 39691

SEQ ID NO: 229819 - RNA, 64 nt, hsa; identical to SEQ ID NO: 39692

SEQ ID NO: 229820 - RNA, 64 nt, hsa; identical to SEQ ID NO: 39693

SEQ ID NO: 229821 - RNA, 64 nt, hsa; identical to SEQ ID NO: 39694

SEQ ID NO: 229822 - RNA, 64 nt, hsa; identical to SEQ ID NO: 39695

SEQ ID NO: 229823 - RNA, 64 nt, hsa; identical to SEQ ID NO: 39696

SEQ ID NO: 229824 - RNA, 64 nt, hsa; identical to SEQ ID NO: 39697

SEQ ID NO: 229825 - RNA, 64 nt, hsa; identical to SEQ ID NO: 39698

SEQ ID NO: 229826 - RNA, 64 nt, hsa; identical to SEQ ID NO: 39699

SEQ ID NO: 229827 - RNA, 64 nt, hsa; identical to SEQ ID NO: 39700

SEQ ID NO: 229828 - RNA, 64 nt, hsa; identical to SEQ ID NO: 39701

SEQ ID NO: 229829 - RNA, 64 nt, hsa; identical to SEQ ID NO: 39702

SEQ ID NO: 229830 - RNA, 64 nt, hsa; identical to SEQ ID NO: 39703

SEQ ID NO: 229831 - RNA, 64 nt, hsa; identical to SEQ ID NO: 39704

SEQ ID NO: 229832 - RNA, 64 nt, hsa; identical to SEQ ID NO: 39705

SEQ ID NO: 229833 - RNA, 64 nt, hsa; identical to SEQ ID NO: 39706

SEQ ID NO: 229834 - RNA, 64 nt, hsa; identical to SEQ ID NO: 39707

SEQ ID NO: 229835 - RNA, 64 nt, hsa; identical to SEQ ID NO: 39708

SEQ ID NO: 229836 - RNA, 64 nt, hsa; identical to SEQ ID NO: 39709

SEQ ID NO: 229837 - RNA, 64 nt, hsa; identical to SEQ ID NO: 39710

SEQ ID NO: 229838 - RNA, 64 nt, hsa; identical to SEQ ID NO: 39711

SEQ ID NO: 229839 - RNA, 64 nt, hsa; identical to SEQ ID NO: 39712

SEQ ID NO: 229840 - RNA, 64 nt, hsa; identical to SEQ ID NO: 39713

SEQ ID NO: 229841 - RNA, 64 nt, hsa; identical to SEQ ID NO: 39714

SEQ ID NO: 229842 - RNA, 64 nt, hsa; identical to SEQ ID NO: 39715

SEQ ID NO: 229843 - RNA, 64 nt, hsa; identical to SEQ ID NO: 39716

SEQ ID NO: 229844 - RNA, 64 nt, hsa; identical to SEQ ID NO: 39717

SEQ ID NO: 229845 - RNA, 64 nt, hsa; identical to SEQ ID NO: 39718

SEQ ID NO: 229846 - RNA, 64 nt, hsa; identical to SEQ ID NO: 39719

SEQ ID NO: 229847 - RNA, 64 nt, hsa; identical to SEQ ID NO: 39720

SEQ ID NO: 229848 - RNA, 64 nt, hsa; identical to SEQ ID NO: 39721

SEQ ID NO: 229849 - RNA, 64 nt, hsa; identical to SEQ ID NO: 39722

SEQ ID NO: 229850 - RNA, 64 nt, hsa; identical to SEQ ID NO: 39723

SEQ ID NO: 229851 - RNA, 64 nt, hsa; identical to SEQ ID NO: 39724

SEQ ID NO: 229852 - RNA, 64 nt, hsa; identical to SEQ ID NO: 39725

SEQ ID NO: 229853 - RNA, 64 nt, hsa; identical to SEQ ID NO: 39726

SEQ ID NO: 229854 - RNA, 64 nt, hsa; identical to SEQ ID NO: 39727

SEQ ID NO: 229855 - RNA, 64 nt, hsa; identical to SEQ ID NO: 39728

SEQ ID NO: 229856 - RNA, 64 nt, hsa; identical to SEQ ID NO: 39729

SEQ ID NO: 229857 - RNA, 64 nt, hsa; identical to SEQ ID NO: 39730

SEQ ID NO: 229858 - RNA, 64 nt, hsa; identical to SEQ ID NO: 39731

SEQ ID NO: 229859 - RNA, 64 nt, hsa; identical to SEQ ID NO: 39732

SEQ ID NO: 229860 - RNA, 64 nt, hsa; identical to SEQ ID NO: 39733

SEQ ID NO: 229861 - RNA, 64 nt, hsa; identical to SEQ ID NO: 39734

SEQ ID NO: 229862 - RNA, 64 nt, hsa; identical to SEQ ID NO: 39735

SEQ ID NO: 229863 - RNA, 64 nt, hsa; identical to SEQ ID NO: 39736

SEQ ID NO: 229864 - RNA, 64 nt, hsa; identical to SEQ ID NO: 39737

SEQ ID NO: 229865 - RNA, 64 nt, hsa; identical to SEQ ID NO: 39738

SEQ ID NO: 229866 - RNA, 64 nt, hsa; identical to SEQ ID NO: 39739

SEQ ID NO: 229867 - RNA, 64 nt, hsa; identical to SEQ ID NO: 39740

SEQ ID NO: 229868 - RNA, 64 nt, hsa; identical to SEQ ID NO: 39741

SEQ ID NO: 229869 - RNA, 64 nt, hsa; identical to SEQ ID NO: 39742

SEQ ID NO: 229870 - RNA, 64 nt, hsa; identical to SEQ ID NO: 39743

SEQ ID NO: 229871 - RNA, 64 nt, hsa; identical to SEQ ID NO: 39744

SEQ ID NO: 229872 - RNA, 64 nt, hsa; identical to SEQ ID NO: 39745

SEQ ID NO: 229873 - RNA, 64 nt, hsa; identical to SEQ ID NO: 39746

SEQ ID NO: 229874 - RNA, 64 nt, hsa; identical to SEQ ID NO: 39747

SEQ ID NO: 229875 - RNA, 64 nt, hsa; identical to SEQ ID NO: 39748

SEQ ID NO: 229876 - RNA, 64 nt, hsa; identical to SEQ ID NO: 39749

SEQ ID NO: 229877 - RNA, 64 nt, hsa; identical to SEQ ID NO: 39750

SEQ ID NO: 229878 - RNA, 64 nt, hsa; identical to SEQ ID NO: 39751

SEQ ID NO: 229879 - RNA, 64 nt, hsa; identical to SEQ ID NO: 39752

SEQ ID NO: 229880 - RNA, 64 nt, hsa; identical to SEQ ID NO: 39753

SEQ ID NO: 229881 - RNA, 64 nt, hsa; identical to SEQ ID NO: 39754

SEQ ID NO: 229882 - RNA, 64 nt, hsa; identical to SEQ ID NO: 39755

SEQ ID NO: 229883 - RNA, 64 nt, hsa; identical to SEQ ID NO: 39756

SEQ ID NO: 229884 - RNA, 64 nt, hsa; identical to SEQ ID NO: 39757

SEQ ID NO: 229885 - RNA, 64 nt, hsa; identical to SEQ ID NO: 39758

SEQ ID NO: 229886 - RNA, 64 nt, hsa; identical to SEQ ID NO: 39759

SEQ ID NO: 229887 - RNA, 64 nt, hsa; identical to SEQ ID NO: 39760

SEQ ID NO: 229888 - RNA, 64 nt, hsa; identical to SEQ ID NO: 39761

SEQ ID NO: 229889 - RNA, 64 nt, hsa; identical to SEQ ID NO: 39762

SEQ ID NO: 229890 - RNA, 64 nt, hsa; identical to SEQ ID NO: 39763

SEQ ID NO: 229891 - RNA, 64 nt, hsa; identical to SEQ ID NO: 39764

SEQ ID NO: 229892 - RNA, 64 nt, hsa; identical to SEQ ID NO: 39765

SEQ ID NO: 229893 - RNA, 64 nt, hsa; identical to SEQ ID NO: 39766

SEQ ID NO: 229894 - RNA, 64 nt, hsa; identical to SEQ ID NO: 39767

SEQ ID NO: 229895 - RNA, 64 nt, hsa; identical to SEQ ID NO: 39768

SEQ ID NO: 229896 - RNA, 64 nt, hsa; identical to SEQ ID NO: 39769

SEQ ID NO: 229897 - RNA, 64 nt, hsa; identical to SEQ ID NO: 39770

SEQ ID NO: 229898 - RNA, 64 nt, hsa; identical to SEQ ID NO: 39771

SEQ ID NO: 229899 - RNA, 64 nt, hsa; identical to SEQ ID NO: 39772

SEQ ID NO: 229900 - RNA, 64 nt, hsa; identical to SEQ ID NO: 39773

SEQ ID NO: 229901 - RNA, 64 nt, hsa; identical to SEQ ID NO: 39774

SEQ ID NO: 229902 - RNA, 64 nt, hsa; identical to SEQ ID NO: 39775

SEQ ID NO: 229903 - RNA, 64 nt, hsa; identical to SEQ ID NO: 39776

SEQ ID NO: 229904 - RNA, 64 nt, hsa; identical to SEQ ID NO: 39777

SEQ ID NO: 229905 - RNA, 64 nt, hsa; identical to SEQ ID NO: 39778

SEQ ID NO: 229906 - RNA, 64 nt, hsa; identical to SEQ ID NO: 39779

SEQ ID NO: 229907 - RNA, 64 nt, hsa; identical to SEQ ID NO: 39780

SEQ ID NO: 229908 - RNA, 64 nt, hsa; identical to SEQ ID NO: 39781

SEQ ID NO: 229909 - RNA, 64 nt, hsa; identical to SEQ ID NO: 39782

SEQ ID NO: 229910 - RNA, 64 nt, hsa; identical to SEQ ID NO: 39783

SEQ ID NO: 229911 - RNA, 64 nt, hsa; identical to SEQ ID NO: 39784

SEQ ID NO: 229912 - RNA, 64 nt, hsa; identical to SEQ ID NO: 39785

SEQ ID NO: 229913 - RNA, 64 nt, hsa; identical to SEQ ID NO: 39786

SEQ ID NO: 229914 - RNA, 64 nt, hsa; identical to SEQ ID NO: 39787

SEQ ID NO: 229915 - RNA, 64 nt, hsa; identical to SEQ ID NO: 39788

SEQ ID NO: 229916 - RNA, 64 nt, hsa; identical to SEQ ID NO: 39789

SEQ ID NO: 229917 - RNA, 64 nt, hsa; identical to SEQ ID NO: 39790

SEQ ID NO: 229918 - RNA, 64 nt, hsa; identical to SEQ ID NO: 39791

SEQ ID NO: 229919 - RNA, 64 nt, hsa; identical to SEQ ID NO: 39792

SEQ ID NO: 229920 - RNA, 64 nt, hsa; identical to SEQ ID NO: 39793

SEQ ID NO: 229921 - RNA, 64 nt, hsa; identical to SEQ ID NO: 39794

SEQ ID NO: 229922 - RNA, 64 nt, hsa; identical to SEQ ID NO: 39795

SEQ ID NO: 229923 - RNA, 64 nt, hsa; identical to SEQ ID NO: 39796

SEQ ID NO: 229924 - RNA, 64 nt, hsa; identical to SEQ ID NO: 39797

SEQ ID NO: 229925 - RNA, 64 nt, hsa; identical to SEQ ID NO: 39798

SEQ ID NO: 229926 - RNA, 64 nt, hsa; identical to SEQ ID NO: 39799

SEQ ID NO: 229927 - RNA, 64 nt, hsa; identical to SEQ ID NO: 39800

SEQ ID NO: 229928 - RNA, 64 nt, hsa; identical to SEQ ID NO: 39801

SEQ ID NO: 229929 - RNA, 64 nt, hsa; identical to SEQ ID NO: 39802

SEQ ID NO: 229930 - RNA, 64 nt, hsa; identical to SEQ ID NO: 39803

SEQ ID NO: 229931 - RNA, 64 nt, hsa; identical to SEQ ID NO: 39804

SEQ ID NO: 229932 - RNA, 64 nt, hsa; identical to SEQ ID NO: 39805

SEQ ID NO: 229933 - RNA, 64 nt, hsa; identical to SEQ ID NO: 39806

SEQ ID NO: 229934 - RNA, 64 nt, hsa; identical to SEQ ID NO: 39807

SEQ ID NO: 229935 - RNA, 64 nt, hsa; identical to SEQ ID NO: 39808

SEQ ID NO: 229936 - RNA, 64 nt, hsa; identical to SEQ ID NO: 39809

SEQ ID NO: 229937 - RNA, 64 nt, hsa; identical to SEQ ID NO: 39810

SEQ ID NO: 229938 - RNA, 64 nt, hsa; identical to SEQ ID NO: 39811

SEQ ID NO: 229939 - RNA, 64 nt, hsa; identical to SEQ ID NO: 39812

SEQ ID NO: 229940 - RNA, 64 nt, hsa; identical to SEQ ID NO: 39813

SEQ ID NO: 229941 - RNA, 64 nt, hsa; identical to SEQ ID NO: 39814

SEQ ID NO: 229942 - RNA, 64 nt, hsa; identical to SEQ ID NO: 39815

SEQ ID NO: 229943 - RNA, 64 nt, hsa; identical to SEQ ID NO: 39816

SEQ ID NO: 229944 - RNA, 64 nt, hsa; identical to SEQ ID NO: 39817

SEQ ID NO: 229945 - RNA, 64 nt, hsa; identical to SEQ ID NO: 39818

SEQ ID NO: 229946 - RNA, 64 nt, hsa; identical to SEQ ID NO: 39819

SEQ ID NO: 229947 - RNA, 64 nt, hsa; identical to SEQ ID NO: 39820

SEQ ID NO: 229948 - RNA, 64 nt, hsa; identical to SEQ ID NO: 39821

SEQ ID NO: 229949 - RNA, 64 nt, hsa; identical to SEQ ID NO: 39822

SEQ ID NO: 229950 - RNA, 64 nt, hsa; identical to SEQ ID NO: 39823

SEQ ID NO: 229951 - RNA, 64 nt, hsa; identical to SEQ ID NO: 39824

SEQ ID NO: 229952 - RNA, 64 nt, hsa; identical to SEQ ID NO: 39825

SEQ ID NO: 229953 - RNA, 64 nt, hsa; identical to SEQ ID NO: 39826

SEQ ID NO: 229954 - RNA, 64 nt, hsa; identical to SEQ ID NO: 39827

SEQ ID NO: 229955 - RNA, 64 nt, hsa; identical to SEQ ID NO: 39828

SEQ ID NO: 229956 - RNA, 64 nt, hsa; identical to SEQ ID NO: 39829

SEQ ID NO: 229957 - RNA, 64 nt, hsa; identical to SEQ ID NO: 39830

SEQ ID NO: 229958 - RNA, 64 nt, hsa; identical to SEQ ID NO: 39831

SEQ ID NO: 229959 - RNA, 64 nt, hsa; identical to SEQ ID NO: 39832

SEQ ID NO: 229960 - RNA, 64 nt, hsa; identical to SEQ ID NO: 39833

SEQ ID NO: 229961 - RNA, 64 nt, hsa; identical to SEQ ID NO: 39834

SEQ ID NO: 229962 - RNA, 64 nt, hsa; identical to SEQ ID NO: 39835

SEQ ID NO: 229963 - RNA, 64 nt, hsa; identical to SEQ ID NO: 39836

SEQ ID NO: 229964 - RNA, 64 nt, hsa; identical to SEQ ID NO: 39837

SEQ ID NO: 229965 - RNA, 64 nt, hsa; identical to SEQ ID NO: 39838

SEQ ID NO: 229966 - RNA, 64 nt, hsa; identical to SEQ ID NO: 39839

SEQ ID NO: 229967 - RNA, 64 nt, hsa; identical to SEQ ID NO: 39840

SEQ ID NO: 229968 - RNA, 64 nt, hsa; identical to SEQ ID NO: 39841

SEQ ID NO: 229969 - RNA, 64 nt, hsa; identical to SEQ ID NO: 39842

SEQ ID NO: 229970 - RNA, 64 nt, hsa; identical to SEQ ID NO: 39843

SEQ ID NO: 229971 - RNA, 64 nt, hsa; identical to SEQ ID NO: 39844

SEQ ID NO: 229972 - RNA, 64 nt, hsa; identical to SEQ ID NO: 39845

SEQ ID NO: 229973 - RNA, 64 nt, hsa; identical to SEQ ID NO: 39846

SEQ ID NO: 229974 - RNA, 64 nt, hsa; identical to SEQ ID NO: 39847

SEQ ID NO: 229975 - RNA, 64 nt, hsa; identical to SEQ ID NO: 39848

SEQ ID NO: 229976 - RNA, 64 nt, hsa; identical to SEQ ID NO: 39849

SEQ ID NO: 229977 - RNA, 64 nt, hsa; identical to SEQ ID NO: 39850

SEQ ID NO: 229978 - RNA, 64 nt, hsa; identical to SEQ ID NO: 39851

SEQ ID NO: 229979 - RNA, 64 nt, hsa; identical to SEQ ID NO: 39852

SEQ ID NO: 229980 - RNA, 64 nt, hsa; identical to SEQ ID NO: 39853

SEQ ID NO: 229981 - RNA, 64 nt, hsa; identical to SEQ ID NO: 39854

SEQ ID NO: 229982 - RNA, 64 nt, hsa; identical to SEQ ID NO: 39855

SEQ ID NO: 229983 - RNA, 64 nt, hsa; identical to SEQ ID NO: 39856

SEQ ID NO: 229984 - RNA, 64 nt, hsa; identical to SEQ ID NO: 39857

SEQ ID NO: 229985 - RNA, 64 nt, hsa; identical to SEQ ID NO: 39858

SEQ ID NO: 229986 - RNA, 64 nt, hsa; identical to SEQ ID NO: 39859

SEQ ID NO: 229987 - RNA, 64 nt, hsa; identical to SEQ ID NO: 39860

SEQ ID NO: 229988 - RNA, 64 nt, hsa; identical to SEQ ID NO: 39861

SEQ ID NO: 229989 - RNA, 64 nt, hsa; identical to SEQ ID NO: 39862

SEQ ID NO: 229990 - RNA, 64 nt, hsa; identical to SEQ ID NO: 39863

SEQ ID NO: 229991 - RNA, 64 nt, hsa; identical to SEQ ID NO: 39864

SEQ ID NO: 229992 - RNA, 64 nt, hsa; identical to SEQ ID NO: 39865

SEQ ID NO: 229993 - RNA, 64 nt, hsa; identical to SEQ ID NO: 39866

SEQ ID NO: 229994 - RNA, 64 nt, hsa; identical to SEQ ID NO: 39867

SEQ ID NO: 229995 - RNA, 64 nt, hsa; identical to SEQ ID NO: 39868

SEQ ID NO: 229996 - RNA, 64 nt, hsa; identical to SEQ ID NO: 39869

SEQ ID NO: 229997 - RNA, 64 nt, hsa; identical to SEQ ID NO: 39870

SEQ ID NO: 229998 - RNA, 64 nt, hsa; identical to SEQ ID NO: 39871

SEQ ID NO: 229999 - RNA, 64 nt, hsa; identical to SEQ ID NO: 39872

SEQ ID NO: 230000 - RNA, 64 nt, hsa; identical to SEQ ID NO: 39873

SEQ ID NO: 230001 - RNA, 64 nt, hsa; identical to SEQ ID NO: 39874

SEQ ID NO: 230002 - RNA, 64 nt, hsa; identical to SEQ ID NO: 39875

SEQ ID NO: 230003 - RNA, 64 nt, hsa; identical to SEQ ID NO: 39876

SEQ ID NO: 230004 - RNA, 64 nt, hsa; identical to SEQ ID NO: 39877

SEQ ID NO: 230005 - RNA, 64 nt, hsa; identical to SEQ ID NO: 39878

SEQ ID NO: 230006 - RNA, 64 nt, hsa; identical to SEQ ID NO: 39879

SEQ ID NO: 230007 - RNA, 64 nt, hsa; identical to SEQ ID NO: 39880

SEQ ID NO: 230008 - RNA, 64 nt, hsa; identical to SEQ ID NO: 39881

SEQ ID NO: 230009 - RNA, 64 nt, hsa; identical to SEQ ID NO: 39882

SEQ ID NO: 230010 - RNA, 64 nt, hsa; identical to SEQ ID NO: 39883

SEQ ID NO: 230011 - RNA, 64 nt, hsa; identical to SEQ ID NO: 39884

SEQ ID NO: 230012 - RNA, 64 nt, hsa; identical to SEQ ID NO: 39885

SEQ ID NO: 230013 - RNA, 64 nt, hsa; identical to SEQ ID NO: 39886

SEQ ID NO: 230014 - RNA, 64 nt, hsa; identical to SEQ ID NO: 39887

SEQ ID NO: 230015 - RNA, 64 nt, hsa; identical to SEQ ID NO: 39888

SEQ ID NO: 230016 - RNA, 64 nt, hsa; identical to SEQ ID NO: 39889

SEQ ID NO: 230017 - RNA, 64 nt, hsa; identical to SEQ ID NO: 39890

SEQ ID NO: 230018 - RNA, 64 nt, hsa; identical to SEQ ID NO: 39891

SEQ ID NO: 230019 - RNA, 64 nt, hsa; identical to SEQ ID NO: 39892

SEQ ID NO: 230020 - RNA, 64 nt, hsa; identical to SEQ ID NO: 39893

SEQ ID NO: 230021 - RNA, 64 nt, hsa; identical to SEQ ID NO: 39894

SEQ ID NO: 230022 - RNA, 64 nt, hsa; identical to SEQ ID NO: 39895

SEQ ID NO: 230023 - RNA, 64 nt, hsa; identical to SEQ ID NO: 39896

SEQ ID NO: 230024 - RNA, 64 nt, hsa; identical to SEQ ID NO: 39897

SEQ ID NO: 230025 - RNA, 64 nt, hsa; identical to SEQ ID NO: 39898

SEQ ID NO: 230026 - RNA, 64 nt, hsa; identical to SEQ ID NO: 39899

SEQ ID NO: 230027 - RNA, 64 nt, hsa; identical to SEQ ID NO: 39900

SEQ ID NO: 230028 - RNA, 64 nt, hsa; identical to SEQ ID NO: 39901

SEQ ID NO: 230029 - RNA, 64 nt, hsa; identical to SEQ ID NO: 39902

SEQ ID NO: 230030 - RNA, 64 nt, hsa; identical to SEQ ID NO: 39903

SEQ ID NO: 230031 - RNA, 64 nt, hsa; identical to SEQ ID NO: 39904

SEQ ID NO: 230032 - RNA, 64 nt, hsa; identical to SEQ ID NO: 39905

SEQ ID NO: 230033 - RNA, 64 nt, hsa; identical to SEQ ID NO: 39906

SEQ ID NO: 230034 - RNA, 64 nt, hsa; identical to SEQ ID NO: 39907

SEQ ID NO: 230035 - RNA, 64 nt, hsa; identical to SEQ ID NO: 39908

SEQ ID NO: 230036 - RNA, 64 nt, hsa; identical to SEQ ID NO: 39909

SEQ ID NO: 230037 - RNA, 64 nt, hsa; identical to SEQ ID NO: 39910

SEQ ID NO: 230038 - RNA, 64 nt, hsa; identical to SEQ ID NO: 39911

SEQ ID NO: 230039 - RNA, 64 nt, hsa; identical to SEQ ID NO: 39912

SEQ ID NO: 230040 - RNA, 64 nt, hsa; identical to SEQ ID NO: 39913

SEQ ID NO: 230041 - RNA, 64 nt, hsa; identical to SEQ ID NO: 39914

SEQ ID NO: 230042 - RNA, 64 nt, hsa; identical to SEQ ID NO: 39915

SEQ ID NO: 230043 - RNA, 64 nt, hsa; identical to SEQ ID NO: 39916

SEQ ID NO: 230044 - RNA, 64 nt, hsa; identical to SEQ ID NO: 39917

SEQ ID NO: 230045 - RNA, 64 nt, hsa; identical to SEQ ID NO: 39918

SEQ ID NO: 230046 - RNA, 64 nt, hsa; identical to SEQ ID NO: 39919

SEQ ID NO: 230047 - RNA, 64 nt, hsa; identical to SEQ ID NO: 39920

SEQ ID NO: 230048 - RNA, 64 nt, hsa; identical to SEQ ID NO: 39921

SEQ ID NO: 230049 - RNA, 64 nt, hsa; identical to SEQ ID NO: 39922

SEQ ID NO: 230050 - RNA, 64 nt, hsa; identical to SEQ ID NO: 39923

SEQ ID NO: 230051 - RNA, 64 nt, hsa; identical to SEQ ID NO: 39924

SEQ ID NO: 230052 - RNA, 64 nt, hsa; identical to SEQ ID NO: 39925

SEQ ID NO: 230053 - RNA, 64 nt, hsa; identical to SEQ ID NO: 39926

SEQ ID NO: 230054 - RNA, 64 nt, hsa; identical to SEQ ID NO: 39927

SEQ ID NO: 230055 - RNA, 64 nt, hsa; identical to SEQ ID NO: 39928

SEQ ID NO: 230056 - RNA, 64 nt, hsa; identical to SEQ ID NO: 39929

SEQ ID NO: 230057 - RNA, 64 nt, hsa; identical to SEQ ID NO: 39930

SEQ ID NO: 230058 - RNA, 64 nt, hsa; identical to SEQ ID NO: 39931

SEQ ID NO: 230059 - RNA, 64 nt, hsa; identical to SEQ ID NO: 39932

SEQ ID NO: 230060 - RNA, 64 nt, hsa; identical to SEQ ID NO: 39933

SEQ ID NO: 230061 - RNA, 64 nt, hsa; identical to SEQ ID NO: 39934

SEQ ID NO: 230062 - RNA, 64 nt, hsa; identical to SEQ ID NO: 39935

SEQ ID NO: 230063 - RNA, 64 nt, hsa; identical to SEQ ID NO: 39936

SEQ ID NO: 230064 - RNA, 64 nt, hsa; identical to SEQ ID NO: 39937

SEQ ID NO: 230065 - RNA, 64 nt, hsa; identical to SEQ ID NO: 39938

SEQ ID NO: 230066 - RNA, 64 nt, hsa; identical to SEQ ID NO: 39939

SEQ ID NO: 230067 - RNA, 64 nt, hsa; identical to SEQ ID NO: 39940

SEQ ID NO: 230068 - RNA, 64 nt, hsa; identical to SEQ ID NO: 39941

SEQ ID NO: 230069 - RNA, 64 nt, hsa; identical to SEQ ID NO: 39942

SEQ ID NO: 230070 - RNA, 64 nt, hsa; identical to SEQ ID NO: 39943

SEQ ID NO: 230071 - RNA, 64 nt, hsa; identical to SEQ ID NO: 39944

SEQ ID NO: 230072 - RNA, 64 nt, hsa; identical to SEQ ID NO: 39945

SEQ ID NO: 230073 - RNA, 64 nt, hsa; identical to SEQ ID NO: 39946

SEQ ID NO: 230074 - RNA, 64 nt, hsa; identical to SEQ ID NO: 39947

SEQ ID NO: 230075 - RNA, 64 nt, hsa; identical to SEQ ID NO: 39948

SEQ ID NO: 230076 - RNA, 64 nt, hsa; identical to SEQ ID NO: 39949

SEQ ID NO: 230077 - RNA, 64 nt, hsa; identical to SEQ ID NO: 39950

SEQ ID NO: 230078 - RNA, 64 nt, hsa; identical to SEQ ID NO: 39951

SEQ ID NO: 230079 - RNA, 64 nt, hsa; identical to SEQ ID NO: 39952

SEQ ID NO: 230080 - RNA, 64 nt, hsa; identical to SEQ ID NO: 39953

SEQ ID NO: 230081 - RNA, 64 nt, hsa; identical to SEQ ID NO: 39954

SEQ ID NO: 230082 - RNA, 64 nt, hsa; identical to SEQ ID NO: 39955

SEQ ID NO: 230083 - RNA, 64 nt, hsa; identical to SEQ ID NO: 39956

SEQ ID NO: 230084 - RNA, 64 nt, hsa; identical to SEQ ID NO: 39957

SEQ ID NO: 230085 - RNA, 64 nt, hsa; identical to SEQ ID NO: 39958

SEQ ID NO: 230086 - RNA, 64 nt, hsa; identical to SEQ ID NO: 39959

SEQ ID NO: 230087 - RNA, 64 nt, hsa; identical to SEQ ID NO: 39960

SEQ ID NO: 230088 - RNA, 64 nt, hsa; identical to SEQ ID NO: 39961

SEQ ID NO: 230089 - RNA, 64 nt, hsa; identical to SEQ ID NO: 39962

SEQ ID NO: 230090 - RNA, 64 nt, hsa; identical to SEQ ID NO: 39963

SEQ ID NO: 230091 - RNA, 64 nt, hsa; identical to SEQ ID NO: 39964

SEQ ID NO: 230092 - RNA, 64 nt, hsa; identical to SEQ ID NO: 39965

SEQ ID NO: 230093 - RNA, 64 nt, hsa; identical to SEQ ID NO: 39966

SEQ ID NO: 230094 - RNA, 64 nt, hsa; identical to SEQ ID NO: 39967

SEQ ID NO: 230095 - RNA, 64 nt, hsa; identical to SEQ ID NO: 39968

SEQ ID NO: 230096 - RNA, 64 nt, hsa; identical to SEQ ID NO: 39969

SEQ ID NO: 230097 - RNA, 64 nt, hsa; identical to SEQ ID NO: 39970

SEQ ID NO: 230098 - RNA, 64 nt, hsa; identical to SEQ ID NO: 39971

SEQ ID NO: 230099 - RNA, 64 nt, hsa; identical to SEQ ID NO: 39972

SEQ ID NO: 230100 - RNA, 64 nt, hsa; identical to SEQ ID NO: 39973

SEQ ID NO: 230101 - RNA, 64 nt, hsa; identical to SEQ ID NO: 39974

SEQ ID NO: 230102 - RNA, 64 nt, hsa; identical to SEQ ID NO: 39975

SEQ ID NO: 230103 - RNA, 64 nt, hsa; identical to SEQ ID NO: 39976

SEQ ID NO: 230104 - RNA, 64 nt, hsa; identical to SEQ ID NO: 39977

SEQ ID NO: 230105 - RNA, 64 nt, hsa; identical to SEQ ID NO: 39978

SEQ ID NO: 230106 - RNA, 64 nt, hsa; identical to SEQ ID NO: 39979

SEQ ID NO: 230107 - RNA, 64 nt, hsa; identical to SEQ ID NO: 39980

SEQ ID NO: 230108 - RNA, 64 nt, hsa; identical to SEQ ID NO: 39981

SEQ ID NO: 230109 - RNA, 64 nt, hsa; identical to SEQ ID NO: 39982

SEQ ID NO: 230110 - RNA, 64 nt, hsa; identical to SEQ ID NO: 39983

SEQ ID NO: 230111 - RNA, 64 nt, hsa; identical to SEQ ID NO: 39984

SEQ ID NO: 230112 - RNA, 64 nt, hsa; identical to SEQ ID NO: 39985

SEQ ID NO: 230113 - RNA, 64 nt, hsa; identical to SEQ ID NO: 39986

SEQ ID NO: 230114 - RNA, 64 nt, hsa; identical to SEQ ID NO: 39987

SEQ ID NO: 230115 - RNA, 64 nt, hsa; identical to SEQ ID NO: 39988

SEQ ID NO: 230116 - RNA, 64 nt, hsa; identical to SEQ ID NO: 39989

SEQ ID NO: 230117 - RNA, 64 nt, hsa; identical to SEQ ID NO: 39990

SEQ ID NO: 230118 - RNA, 64 nt, hsa; identical to SEQ ID NO: 39991

SEQ ID NO: 230119 - RNA, 64 nt, hsa; identical to SEQ ID NO: 39992

SEQ ID NO: 230120 - RNA, 64 nt, hsa; identical to SEQ ID NO: 39993

SEQ ID NO: 230121 - RNA, 64 nt, hsa; identical to SEQ ID NO: 39994

SEQ ID NO: 230122 - RNA, 64 nt, hsa; identical to SEQ ID NO: 39995

SEQ ID NO: 230123 - RNA, 64 nt, hsa; identical to SEQ ID NO: 39996

SEQ ID NO: 230124 - RNA, 64 nt, hsa; identical to SEQ ID NO: 39997

SEQ ID NO: 230125 - RNA, 64 nt, hsa; identical to SEQ ID NO: 39998

SEQ ID NO: 230126 - RNA, 64 nt, hsa; identical to SEQ ID NO: 39999

SEQ ID NO: 230127 - RNA, 64 nt, hsa; identical to SEQ ID NO: 40000

SEQ ID NO: 230128 - RNA, 64 nt, hsa; identical to SEQ ID NO: 40001

SEQ ID NO: 230129 - RNA, 64 nt, hsa; identical to SEQ ID NO: 40002

SEQ ID NO: 230130 - RNA, 64 nt, hsa; identical to SEQ ID NO: 40003

SEQ ID NO: 230131 - RNA, 64 nt, hsa; identical to SEQ ID NO: 40004

SEQ ID NO: 230132 - RNA, 64 nt, hsa; identical to SEQ ID NO: 40005

SEQ ID NO: 230133 - RNA, 64 nt, hsa; identical to SEQ ID NO: 40006

SEQ ID NO: 230134 - RNA, 64 nt, hsa; identical to SEQ ID NO: 40007

SEQ ID NO: 230135 - RNA, 64 nt, hsa; identical to SEQ ID NO: 40008

SEQ ID NO: 230136 - RNA, 64 nt, hsa; identical to SEQ ID NO: 40009

SEQ ID NO: 230137 - RNA, 64 nt, hsa; identical to SEQ ID NO: 40010

SEQ ID NO: 230138 - RNA, 64 nt, hsa; identical to SEQ ID NO: 40011

SEQ ID NO: 230139 - RNA, 64 nt, hsa; identical to SEQ ID NO: 40012

SEQ ID NO: 230140 - RNA, 64 nt, hsa; identical to SEQ ID NO: 40013

SEQ ID NO: 230141 - RNA, 64 nt, hsa; identical to SEQ ID NO: 40014

SEQ ID NO: 230142 - RNA, 64 nt, hsa; identical to SEQ ID NO: 40015

SEQ ID NO: 230143 - RNA, 64 nt, hsa; identical to SEQ ID NO: 40016

SEQ ID NO: 230144 - RNA, 64 nt, hsa; identical to SEQ ID NO: 40017

SEQ ID NO: 230145 - RNA, 64 nt, hsa; identical to SEQ ID NO: 40018

SEQ ID NO: 230146 - RNA, 64 nt, hsa; identical to SEQ ID NO: 40019

SEQ ID NO: 230147 - RNA, 64 nt, hsa; identical to SEQ ID NO: 40020

SEQ ID NO: 230148 - RNA, 64 nt, hsa; identical to SEQ ID NO: 40021

SEQ ID NO: 230149 - RNA, 64 nt, hsa; identical to SEQ ID NO: 40022

SEQ ID NO: 230150 - RNA, 64 nt, hsa; identical to SEQ ID NO: 40023

SEQ ID NO: 230151 - RNA, 64 nt, hsa; identical to SEQ ID NO: 40024

SEQ ID NO: 230152 - RNA, 64 nt, hsa; identical to SEQ ID NO: 40025

SEQ ID NO: 230153 - RNA, 64 nt, hsa; identical to SEQ ID NO: 40026

SEQ ID NO: 230154 - RNA, 64 nt, hsa; identical to SEQ ID NO: 40027

SEQ ID NO: 230155 - RNA, 64 nt, hsa; identical to SEQ ID NO: 40028

SEQ ID NO: 230156 - RNA, 64 nt, hsa; identical to SEQ ID NO: 40029

SEQ ID NO: 230157 - RNA, 64 nt, hsa; identical to SEQ ID NO: 40030

SEQ ID NO: 230158 - RNA, 64 nt, hsa; identical to SEQ ID NO: 40031

SEQ ID NO: 230159 - RNA, 64 nt, hsa; identical to SEQ ID NO: 40032

SEQ ID NO: 230160 - RNA, 64 nt, hsa; identical to SEQ ID NO: 40033

SEQ ID NO: 230161 - RNA, 64 nt, hsa; identical to SEQ ID NO: 40034

SEQ ID NO: 230162 - RNA, 64 nt, hsa; identical to SEQ ID NO: 40035

SEQ ID NO: 230163 - RNA, 64 nt, hsa; identical to SEQ ID NO: 40036

SEQ ID NO: 230164 - RNA, 64 nt, hsa; identical to SEQ ID NO: 40037

SEQ ID NO: 230165 - RNA, 64 nt, hsa; identical to SEQ ID NO: 40038

SEQ ID NO: 230166 - RNA, 64 nt, hsa; identical to SEQ ID NO: 40039

SEQ ID NO: 230167 - RNA, 64 nt, hsa; identical to SEQ ID NO: 40040

SEQ ID NO: 230168 - RNA, 64 nt, hsa; identical to SEQ ID NO: 40041

SEQ ID NO: 230169 - RNA, 64 nt, hsa; identical to SEQ ID NO: 40042

SEQ ID NO: 230170 - RNA, 64 nt, hsa; identical to SEQ ID NO: 40043

SEQ ID NO: 230171 - RNA, 64 nt, hsa; identical to SEQ ID NO: 40044

SEQ ID NO: 230172 - RNA, 64 nt, hsa; identical to SEQ ID NO: 40045

SEQ ID NO: 230173 - RNA, 64 nt, hsa; identical to SEQ ID NO: 40046

SEQ ID NO: 230174 - RNA, 64 nt, hsa; identical to SEQ ID NO: 40047

SEQ ID NO: 230175 - RNA, 64 nt, hsa; identical to SEQ ID NO: 40048

SEQ ID NO: 230176 - RNA, 64 nt, hsa; identical to SEQ ID NO: 40049

SEQ ID NO: 230177 - RNA, 64 nt, hsa; identical to SEQ ID NO: 40050

SEQ ID NO: 230178 - RNA, 64 nt, hsa; identical to SEQ ID NO: 40051

SEQ ID NO: 230179 - RNA, 64 nt, hsa; identical to SEQ ID NO: 40052

SEQ ID NO: 230180 - RNA, 64 nt, hsa; identical to SEQ ID NO: 40053

SEQ ID NO: 230181 - RNA, 64 nt, hsa; identical to SEQ ID NO: 40054

SEQ ID NO: 230182 - RNA, 64 nt, hsa; identical to SEQ ID NO: 40055

SEQ ID NO: 230183 - RNA, 64 nt, hsa; identical to SEQ ID NO: 40056

SEQ ID NO: 230184 - RNA, 64 nt, hsa; identical to SEQ ID NO: 40057

SEQ ID NO: 230185 - RNA, 64 nt, hsa; identical to SEQ ID NO: 40058

SEQ ID NO: 230186 - RNA, 64 nt, hsa; identical to SEQ ID NO: 40059

SEQ ID NO: 230187 - RNA, 64 nt, hsa; identical to SEQ ID NO: 40060

SEQ ID NO: 230188 - RNA, 64 nt, hsa; identical to SEQ ID NO: 40061

SEQ ID NO: 230189 - RNA, 64 nt, hsa; identical to SEQ ID NO: 40062

SEQ ID NO: 230190 - RNA, 64 nt, hsa; identical to SEQ ID NO: 40063

SEQ ID NO: 230191 - RNA, 64 nt, hsa; identical to SEQ ID NO: 40064

SEQ ID NO: 230192 - RNA, 64 nt, hsa; identical to SEQ ID NO: 40065

SEQ ID NO: 230193 - RNA, 64 nt, hsa; identical to SEQ ID NO: 40066

SEQ ID NO: 230194 - RNA, 64 nt, hsa; identical to SEQ ID NO: 40067

SEQ ID NO: 230195 - RNA, 64 nt, hsa; identical to SEQ ID NO: 40068

SEQ ID NO: 230196 - RNA, 64 nt, hsa; identical to SEQ ID NO: 40069

SEQ ID NO: 230197 - RNA, 64 nt, hsa; identical to SEQ ID NO: 40070

SEQ ID NO: 230198 - RNA, 64 nt, hsa; identical to SEQ ID NO: 40071

SEQ ID NO: 230199 - RNA, 64 nt, hsa; identical to SEQ ID NO: 40072

SEQ ID NO: 230200 - RNA, 64 nt, hsa; identical to SEQ ID NO: 40073

SEQ ID NO: 230201 - RNA, 64 nt, hsa; identical to SEQ ID NO: 40074

SEQ ID NO: 230202 - RNA, 64 nt, hsa; identical to SEQ ID NO: 40075

SEQ ID NO: 230203 - RNA, 64 nt, hsa; identical to SEQ ID NO: 40076

SEQ ID NO: 230204 - RNA, 64 nt, hsa; identical to SEQ ID NO: 40077

SEQ ID NO: 230205 - RNA, 64 nt, hsa; identical to SEQ ID NO: 40078

SEQ ID NO: 230206 - RNA, 64 nt, hsa; identical to SEQ ID NO: 40079

SEQ ID NO: 230207 - RNA, 64 nt, hsa; identical to SEQ ID NO: 40080

SEQ ID NO: 230208 - RNA, 64 nt, hsa; identical to SEQ ID NO: 40081

SEQ ID NO: 230209 - RNA, 64 nt, hsa; identical to SEQ ID NO: 40082

SEQ ID NO: 230210 - RNA, 64 nt, hsa; identical to SEQ ID NO: 40083

SEQ ID NO: 230211 - RNA, 64 nt, hsa; identical to SEQ ID NO: 40084

SEQ ID NO: 230212 - RNA, 64 nt, hsa; identical to SEQ ID NO: 40085

SEQ ID NO: 230213 - RNA, 64 nt, hsa; identical to SEQ ID NO: 40086

SEQ ID NO: 230214 - RNA, 64 nt, hsa; identical to SEQ ID NO: 40087

SEQ ID NO: 230215 - RNA, 64 nt, hsa; identical to SEQ ID NO: 40088

SEQ ID NO: 230216 - RNA, 64 nt, hsa; identical to SEQ ID NO: 40089

SEQ ID NO: 230217 - RNA, 64 nt, hsa; identical to SEQ ID NO: 40090

SEQ ID NO: 230218 - RNA, 64 nt, hsa; identical to SEQ ID NO: 40091

SEQ ID NO: 230219 - RNA, 64 nt, hsa; identical to SEQ ID NO: 40092

SEQ ID NO: 230220 - RNA, 64 nt, hsa; identical to SEQ ID NO: 40093

SEQ ID NO: 230221 - RNA, 64 nt, hsa; identical to SEQ ID NO: 40094

SEQ ID NO: 230222 - RNA, 64 nt, hsa; identical to SEQ ID NO: 40095

SEQ ID NO: 230223 - RNA, 64 nt, hsa; identical to SEQ ID NO: 40096

SEQ ID NO: 230224 - RNA, 64 nt, hsa; identical to SEQ ID NO: 40097

SEQ ID NO: 230225 - RNA, 64 nt, hsa; identical to SEQ ID NO: 40098

SEQ ID NO: 230226 - RNA, 64 nt, hsa; identical to SEQ ID NO: 40099

SEQ ID NO: 230227 - RNA, 64 nt, hsa; identical to SEQ ID NO: 40100

SEQ ID NO: 230228 - RNA, 64 nt, hsa; identical to SEQ ID NO: 40101

SEQ ID NO: 230229 - RNA, 64 nt, hsa; identical to SEQ ID NO: 40102

SEQ ID NO: 230230 - RNA, 64 nt, hsa; identical to SEQ ID NO: 40103

SEQ ID NO: 230231 - RNA, 64 nt, hsa; identical to SEQ ID NO: 40104

SEQ ID NO: 230232 - RNA, 64 nt, hsa; identical to SEQ ID NO: 40105

SEQ ID NO: 230233 - RNA, 64 nt, hsa; identical to SEQ ID NO: 40106

SEQ ID NO: 230234 - RNA, 64 nt, hsa; identical to SEQ ID NO: 40107

SEQ ID NO: 230235 - RNA, 64 nt, hsa; identical to SEQ ID NO: 40108

SEQ ID NO: 230236 - RNA, 64 nt, hsa; identical to SEQ ID NO: 40109

SEQ ID NO: 230237 - RNA, 64 nt, hsa; identical to SEQ ID NO: 40110

SEQ ID NO: 230238 - RNA, 64 nt, hsa; identical to SEQ ID NO: 40111

SEQ ID NO: 230239 - RNA, 64 nt, hsa; identical to SEQ ID NO: 40112

SEQ ID NO: 230240 - RNA, 64 nt, hsa; identical to SEQ ID NO: 40113

SEQ ID NO: 230241 - RNA, 64 nt, hsa; identical to SEQ ID NO: 40114

SEQ ID NO: 230242 - RNA, 64 nt, hsa; identical to SEQ ID NO: 40115

SEQ ID NO: 230243 - RNA, 64 nt, hsa; identical to SEQ ID NO: 40116

SEQ ID NO: 230244 - RNA, 64 nt, hsa; identical to SEQ ID NO: 40117

SEQ ID NO: 230245 - RNA, 64 nt, hsa; identical to SEQ ID NO: 40118

SEQ ID NO: 230246 - RNA, 64 nt, hsa; identical to SEQ ID NO: 40119

SEQ ID NO: 230247 - RNA, 64 nt, hsa; identical to SEQ ID NO: 40120

SEQ ID NO: 230248 - RNA, 64 nt, hsa; identical to SEQ ID NO: 40121

SEQ ID NO: 230249 - RNA, 64 nt, hsa; identical to SEQ ID NO: 40122

SEQ ID NO: 230250 - RNA, 64 nt, hsa; identical to SEQ ID NO: 40123

SEQ ID NO: 230251 - RNA, 64 nt, hsa; identical to SEQ ID NO: 40124

SEQ ID NO: 230252 - RNA, 64 nt, hsa; identical to SEQ ID NO: 40125

SEQ ID NO: 230253 - RNA, 64 nt, hsa; identical to SEQ ID NO: 40126

SEQ ID NO: 230254 - RNA, 64 nt, hsa; identical to SEQ ID NO: 40127

SEQ ID NO: 230255 - RNA, 64 nt, hsa; identical to SEQ ID NO: 40128

SEQ ID NO: 230256 - RNA, 64 nt, hsa; identical to SEQ ID NO: 40129

SEQ ID NO: 230257 - RNA, 64 nt, hsa; identical to SEQ ID NO: 40130

SEQ ID NO: 230258 - RNA, 64 nt, hsa; identical to SEQ ID NO: 40131

SEQ ID NO: 230259 - RNA, 64 nt, hsa; identical to SEQ ID NO: 40132

SEQ ID NO: 230260 - RNA, 64 nt, hsa; identical to SEQ ID NO: 40133

SEQ ID NO: 230261 - RNA, 64 nt, hsa; identical to SEQ ID NO: 40134

SEQ ID NO: 230262 - RNA, 64 nt, hsa; identical to SEQ ID NO: 40135

SEQ ID NO: 230263 - RNA, 64 nt, hsa; identical to SEQ ID NO: 40136

SEQ ID NO: 230264 - RNA, 64 nt, hsa; identical to SEQ ID NO: 40137

SEQ ID NO: 230265 - RNA, 64 nt, hsa; identical to SEQ ID NO: 40138

SEQ ID NO: 230266 - RNA, 64 nt, hsa; identical to SEQ ID NO: 40139

SEQ ID NO: 230267 - RNA, 64 nt, hsa; identical to SEQ ID NO: 40140

SEQ ID NO: 230268 - RNA, 64 nt, hsa; identical to SEQ ID NO: 40141

SEQ ID NO: 230269 - RNA, 64 nt, hsa; identical to SEQ ID NO: 40142

SEQ ID NO: 230270 - RNA, 64 nt, hsa; identical to SEQ ID NO: 40143

SEQ ID NO: 230271 - RNA, 64 nt, hsa; identical to SEQ ID NO: 40144

SEQ ID NO: 230272 - RNA, 64 nt, hsa; identical to SEQ ID NO: 40145

SEQ ID NO: 230273 - RNA, 64 nt, hsa; identical to SEQ ID NO: 40146

SEQ ID NO: 230274 - RNA, 64 nt, hsa; identical to SEQ ID NO: 40147

SEQ ID NO: 230275 - RNA, 64 nt, hsa; identical to SEQ ID NO: 40148

SEQ ID NO: 230276 - RNA, 64 nt, hsa; identical to SEQ ID NO: 40149

SEQ ID NO: 230277 - RNA, 64 nt, hsa; identical to SEQ ID NO: 40150

SEQ ID NO: 230278 - RNA, 64 nt, hsa; identical to SEQ ID NO: 40151

SEQ ID NO: 230279 - RNA, 64 nt, hsa; identical to SEQ ID NO: 40152

SEQ ID NO: 230280 - RNA, 64 nt, hsa; identical to SEQ ID NO: 40153

SEQ ID NO: 230281 - RNA, 64 nt, hsa; identical to SEQ ID NO: 40154

SEQ ID NO: 230282 - RNA, 64 nt, hsa; identical to SEQ ID NO: 40155

SEQ ID NO: 230283 - RNA, 64 nt, hsa; identical to SEQ ID NO: 40156

SEQ ID NO: 230284 - RNA, 64 nt, hsa; identical to SEQ ID NO: 40157

SEQ ID NO: 230285 - RNA, 64 nt, hsa; identical to SEQ ID NO: 40158

SEQ ID NO: 230286 - RNA, 64 nt, hsa; identical to SEQ ID NO: 40159

SEQ ID NO: 230287 - RNA, 64 nt, hsa; identical to SEQ ID NO: 40160

SEQ ID NO: 230288 - RNA, 64 nt, hsa; identical to SEQ ID NO: 40161

SEQ ID NO: 230289 - RNA, 64 nt, hsa; identical to SEQ ID NO: 40162

SEQ ID NO: 230290 - RNA, 64 nt, hsa; identical to SEQ ID NO: 40163

SEQ ID NO: 230291 - RNA, 64 nt, hsa; identical to SEQ ID NO: 40164

SEQ ID NO: 230292 - RNA, 64 nt, hsa; identical to SEQ ID NO: 40165

SEQ ID NO: 230293 - RNA, 64 nt, hsa; identical to SEQ ID NO: 40166

SEQ ID NO: 230294 - RNA, 64 nt, hsa; identical to SEQ ID NO: 40167

SEQ ID NO: 230295 - RNA, 64 nt, hsa; identical to SEQ ID NO: 40168

SEQ ID NO: 230296 - RNA, 64 nt, hsa; identical to SEQ ID NO: 40169

SEQ ID NO: 230297 - RNA, 64 nt, hsa; identical to SEQ ID NO: 40170

SEQ ID NO: 230298 - RNA, 64 nt, hsa; identical to SEQ ID NO: 40171

SEQ ID NO: 230299 - RNA, 64 nt, hsa; identical to SEQ ID NO: 40172

SEQ ID NO: 230300 - RNA, 64 nt, hsa; identical to SEQ ID NO: 40173

SEQ ID NO: 230301 - RNA, 64 nt, hsa; identical to SEQ ID NO: 40174

SEQ ID NO: 230302 - RNA, 64 nt, hsa; identical to SEQ ID NO: 40175

SEQ ID NO: 230303 - RNA, 64 nt, hsa; identical to SEQ ID NO: 40176

SEQ ID NO: 230304 - RNA, 64 nt, hsa; identical to SEQ ID NO: 40177

SEQ ID NO: 230305 - RNA, 64 nt, hsa; identical to SEQ ID NO: 40178

SEQ ID NO: 230306 - RNA, 64 nt, hsa; identical to SEQ ID NO: 40179

SEQ ID NO: 230307 - RNA, 64 nt, hsa; identical to SEQ ID NO: 40180

SEQ ID NO: 230308 - RNA, 64 nt, hsa; identical to SEQ ID NO: 40181

SEQ ID NO: 230309 - RNA, 64 nt, hsa; identical to SEQ ID NO: 40182

SEQ ID NO: 230310 - RNA, 64 nt, hsa; identical to SEQ ID NO: 40183

SEQ ID NO: 230311 - RNA, 64 nt, hsa; identical to SEQ ID NO: 40184

SEQ ID NO: 230312 - RNA, 64 nt, hsa; identical to SEQ ID NO: 40185

SEQ ID NO: 230313 - RNA, 64 nt, hsa; identical to SEQ ID NO: 40186

SEQ ID NO: 230314 - RNA, 64 nt, hsa; identical to SEQ ID NO: 40187

SEQ ID NO: 230315 - RNA, 64 nt, hsa; identical to SEQ ID NO: 40188

SEQ ID NO: 230316 - RNA, 64 nt, hsa; identical to SEQ ID NO: 40189

SEQ ID NO: 230317 - RNA, 64 nt, hsa; identical to SEQ ID NO: 40190

SEQ ID NO: 230318 - RNA, 64 nt, hsa; identical to SEQ ID NO: 40191

SEQ ID NO: 230319 - RNA, 64 nt, hsa; identical to SEQ ID NO: 40192

SEQ ID NO: 230320 - RNA, 64 nt, hsa; identical to SEQ ID NO: 40193

SEQ ID NO: 230321 - RNA, 64 nt, hsa; identical to SEQ ID NO: 40194

SEQ ID NO: 230322 - RNA, 64 nt, hsa; identical to SEQ ID NO: 40195

SEQ ID NO: 230323 - RNA, 64 nt, hsa; identical to SEQ ID NO: 40196

SEQ ID NO: 230324 - RNA, 64 nt, hsa; identical to SEQ ID NO: 40197

SEQ ID NO: 230325 - RNA, 64 nt, hsa; identical to SEQ ID NO: 40198

SEQ ID NO: 230326 - RNA, 64 nt, hsa; identical to SEQ ID NO: 40199

SEQ ID NO: 230327 - RNA, 64 nt, hsa; identical to SEQ ID NO: 40200

SEQ ID NO: 230328 - RNA, 64 nt, hsa; identical to SEQ ID NO: 40201

SEQ ID NO: 230329 - RNA, 64 nt, hsa; identical to SEQ ID NO: 40202

SEQ ID NO: 230330 - RNA, 64 nt, hsa; identical to SEQ ID NO: 40203

SEQ ID NO: 230331 - RNA, 64 nt, hsa; identical to SEQ ID NO: 40204

SEQ ID NO: 230332 - RNA, 64 nt, hsa; identical to SEQ ID NO: 40205

SEQ ID NO: 230333 - RNA, 64 nt, hsa; identical to SEQ ID NO: 40206

SEQ ID NO: 230334 - RNA, 64 nt, hsa; identical to SEQ ID NO: 40207

SEQ ID NO: 230335 - RNA, 64 nt, hsa; identical to SEQ ID NO: 40208

SEQ ID NO: 230336 - RNA, 64 nt, hsa; identical to SEQ ID NO: 40209

SEQ ID NO: 230337 - RNA, 64 nt, hsa; identical to SEQ ID NO: 40210

SEQ ID NO: 230338 - RNA, 64 nt, hsa; identical to SEQ ID NO: 40211

SEQ ID NO: 230339 - RNA, 64 nt, hsa; identical to SEQ ID NO: 40212

SEQ ID NO: 230340 - RNA, 64 nt, hsa; identical to SEQ ID NO: 40213

SEQ ID NO: 230341 - RNA, 64 nt, hsa; identical to SEQ ID NO: 40214

SEQ ID NO: 230342 - RNA, 64 nt, hsa; identical to SEQ ID NO: 40215

SEQ ID NO: 230343 - RNA, 64 nt, hsa; identical to SEQ ID NO: 40216

SEQ ID NO: 230344 - RNA, 64 nt, hsa; identical to SEQ ID NO: 40217

SEQ ID NO: 230345 - RNA, 64 nt, hsa; identical to SEQ ID NO: 40218

SEQ ID NO: 230346 - RNA, 64 nt, hsa; identical to SEQ ID NO: 40219

SEQ ID NO: 230347 - RNA, 64 nt, hsa; identical to SEQ ID NO: 40220

SEQ ID NO: 230348 - RNA, 64 nt, hsa; identical to SEQ ID NO: 40221

SEQ ID NO: 230349 - RNA, 64 nt, hsa; identical to SEQ ID NO: 40222

SEQ ID NO: 230350 - RNA, 64 nt, hsa; identical to SEQ ID NO: 40223

SEQ ID NO: 230351 - RNA, 64 nt, hsa; identical to SEQ ID NO: 40224

SEQ ID NO: 230352 - RNA, 64 nt, hsa; identical to SEQ ID NO: 40225

SEQ ID NO: 230353 - RNA, 64 nt, hsa; identical to SEQ ID NO: 40226

SEQ ID NO: 230354 - RNA, 64 nt, hsa; identical to SEQ ID NO: 40227

SEQ ID NO: 230355 - RNA, 64 nt, hsa; identical to SEQ ID NO: 40228

SEQ ID NO: 230356 - RNA, 64 nt, hsa; identical to SEQ ID NO: 40229

SEQ ID NO: 230357 - RNA, 64 nt, hsa; identical to SEQ ID NO: 40230

SEQ ID NO: 230358 - RNA, 64 nt, hsa; identical to SEQ ID NO: 40231

SEQ ID NO: 230359 - RNA, 64 nt, hsa; identical to SEQ ID NO: 40232

SEQ ID NO: 230360 - RNA, 64 nt, hsa; identical to SEQ ID NO: 40233

SEQ ID NO: 230361 - RNA, 64 nt, hsa; identical to SEQ ID NO: 40234

SEQ ID NO: 230362 - RNA, 64 nt, hsa; identical to SEQ ID NO: 40235

SEQ ID NO: 230363 - RNA, 64 nt, hsa; identical to SEQ ID NO: 40236

SEQ ID NO: 230364 - RNA, 64 nt, hsa; identical to SEQ ID NO: 40237

SEQ ID NO: 230365 - RNA, 64 nt, hsa; identical to SEQ ID NO: 40238

SEQ ID NO: 230366 - RNA, 64 nt, hsa; identical to SEQ ID NO: 40239

SEQ ID NO: 230367 - RNA, 64 nt, hsa; identical to SEQ ID NO: 40240

SEQ ID NO: 230368 - RNA, 64 nt, hsa; identical to SEQ ID NO: 40241

SEQ ID NO: 230369 - RNA, 64 nt, hsa; identical to SEQ ID NO: 40242

SEQ ID NO: 230370 - RNA, 64 nt, hsa; identical to SEQ ID NO: 40243

SEQ ID NO: 230371 - RNA, 64 nt, hsa; identical to SEQ ID NO: 40244

SEQ ID NO: 230372 - RNA, 64 nt, hsa; identical to SEQ ID NO: 40245

SEQ ID NO: 230373 - RNA, 64 nt, hsa; identical to SEQ ID NO: 40246

SEQ ID NO: 230374 - RNA, 64 nt, hsa; identical to SEQ ID NO: 40247

SEQ ID NO: 230375 - RNA, 64 nt, hsa; identical to SEQ ID NO: 40248

SEQ ID NO: 230376 - RNA, 64 nt, hsa; identical to SEQ ID NO: 40249

SEQ ID NO: 230377 - RNA, 64 nt, hsa; identical to SEQ ID NO: 40250

SEQ ID NO: 230378 - RNA, 64 nt, hsa; identical to SEQ ID NO: 40251

SEQ ID NO: 230379 - RNA, 64 nt, hsa; identical to SEQ ID NO: 40252

SEQ ID NO: 230380 - RNA, 64 nt, hsa; identical to SEQ ID NO: 40253

SEQ ID NO: 230381 - RNA, 64 nt, hsa; identical to SEQ ID NO: 40254

SEQ ID NO: 230382 - RNA, 64 nt, hsa; identical to SEQ ID NO: 40255

SEQ ID NO: 230383 - RNA, 64 nt, hsa; identical to SEQ ID NO: 40256

SEQ ID NO: 230384 - RNA, 64 nt, hsa; identical to SEQ ID NO: 40257

SEQ ID NO: 230385 - RNA, 64 nt, hsa; identical to SEQ ID NO: 40258

SEQ ID NO: 230386 - RNA, 64 nt, hsa; identical to SEQ ID NO: 40259

SEQ ID NO: 230387 - RNA, 64 nt, hsa; identical to SEQ ID NO: 40260

SEQ ID NO: 230388 - RNA, 64 nt, hsa; identical to SEQ ID NO: 40261

SEQ ID NO: 230389 - RNA, 64 nt, hsa; identical to SEQ ID NO: 40262

SEQ ID NO: 230390 - RNA, 64 nt, hsa; identical to SEQ ID NO: 40263

SEQ ID NO: 230391 - RNA, 64 nt, hsa; identical to SEQ ID NO: 40264

SEQ ID NO: 230392 - RNA, 64 nt, hsa; identical to SEQ ID NO: 40265

SEQ ID NO: 230393 - RNA, 64 nt, hsa; identical to SEQ ID NO: 40266

SEQ ID NO: 230394 - RNA, 64 nt, hsa; identical to SEQ ID NO: 40267

SEQ ID NO: 230395 - RNA, 64 nt, hsa; identical to SEQ ID NO: 40268

SEQ ID NO: 230396 - RNA, 64 nt, hsa; identical to SEQ ID NO: 40269

SEQ ID NO: 230397 - RNA, 64 nt, hsa; identical to SEQ ID NO: 40270

SEQ ID NO: 230398 - RNA, 64 nt, hsa; identical to SEQ ID NO: 40271

SEQ ID NO: 230399 - RNA, 64 nt, hsa; identical to SEQ ID NO: 40272

SEQ ID NO: 230400 - RNA, 64 nt, hsa; identical to SEQ ID NO: 40273

SEQ ID NO: 230401 - RNA, 64 nt, hsa; identical to SEQ ID NO: 40274

SEQ ID NO: 230402 - RNA, 64 nt, hsa; identical to SEQ ID NO: 40275

SEQ ID NO: 230403 - RNA, 64 nt, hsa; identical to SEQ ID NO: 40276

SEQ ID NO: 230404 - RNA, 64 nt, hsa; identical to SEQ ID NO: 40277

SEQ ID NO: 230405 - RNA, 64 nt, hsa; identical to SEQ ID NO: 40278

SEQ ID NO: 230406 - RNA, 64 nt, hsa; identical to SEQ ID NO: 40279

SEQ ID NO: 230407 - RNA, 64 nt, hsa; identical to SEQ ID NO: 40280

SEQ ID NO: 230408 - RNA, 64 nt, hsa; identical to SEQ ID NO: 40281

SEQ ID NO: 230409 - RNA, 64 nt, hsa; identical to SEQ ID NO: 40282

SEQ ID NO: 230410 - RNA, 64 nt, hsa; identical to SEQ ID NO: 40283

SEQ ID NO: 230411 - RNA, 64 nt, hsa; identical to SEQ ID NO: 40284

SEQ ID NO: 230412 - RNA, 64 nt, hsa; identical to SEQ ID NO: 40285

SEQ ID NO: 230413 - RNA, 64 nt, hsa; identical to SEQ ID NO: 40286

SEQ ID NO: 230414 - RNA, 64 nt, hsa; identical to SEQ ID NO: 40287

SEQ ID NO: 230415 - RNA, 64 nt, hsa; identical to SEQ ID NO: 40288

SEQ ID NO: 230416 - RNA, 64 nt, hsa; identical to SEQ ID NO: 40289

SEQ ID NO: 230417 - RNA, 64 nt, hsa; identical to SEQ ID NO: 40290

SEQ ID NO: 230418 - RNA, 64 nt, hsa; identical to SEQ ID NO: 40291

SEQ ID NO: 230419 - RNA, 64 nt, hsa; identical to SEQ ID NO: 40292

SEQ ID NO: 230420 - RNA, 64 nt, hsa; identical to SEQ ID NO: 40293

SEQ ID NO: 230421 - RNA, 64 nt, hsa; identical to SEQ ID NO: 40294

SEQ ID NO: 230422 - RNA, 64 nt, hsa; identical to SEQ ID NO: 40295

SEQ ID NO: 230423 - RNA, 64 nt, hsa; identical to SEQ ID NO: 40296

SEQ ID NO: 230424 - RNA, 64 nt, hsa; identical to SEQ ID NO: 40297

SEQ ID NO: 230425 - RNA, 64 nt, hsa; identical to SEQ ID NO: 40298

SEQ ID NO: 230426 - RNA, 64 nt, hsa; identical to SEQ ID NO: 40299

SEQ ID NO: 230427 - RNA, 64 nt, hsa; identical to SEQ ID NO: 40300

SEQ ID NO: 230428 - RNA, 64 nt, hsa; identical to SEQ ID NO: 40301

SEQ ID NO: 230429 - RNA, 64 nt, hsa; identical to SEQ ID NO: 40302

SEQ ID NO: 230430 - RNA, 64 nt, hsa; identical to SEQ ID NO: 40303

SEQ ID NO: 230431 - RNA, 64 nt, hsa; identical to SEQ ID NO: 40304

SEQ ID NO: 230432 - RNA, 64 nt, hsa; identical to SEQ ID NO: 40305

SEQ ID NO: 230433 - RNA, 64 nt, hsa; identical to SEQ ID NO: 40306

SEQ ID NO: 230434 - RNA, 64 nt, hsa; identical to SEQ ID NO: 40307

SEQ ID NO: 230435 - RNA, 64 nt, hsa; identical to SEQ ID NO: 40308

SEQ ID NO: 230436 - RNA, 64 nt, hsa; identical to SEQ ID NO: 40309

SEQ ID NO: 230437 - RNA, 64 nt, hsa; identical to SEQ ID NO: 40310

SEQ ID NO: 230438 - RNA, 64 nt, hsa; identical to SEQ ID NO: 40311

SEQ ID NO: 230439 - RNA, 64 nt, hsa; identical to SEQ ID NO: 40312

SEQ ID NO: 230440 - RNA, 64 nt, hsa; identical to SEQ ID NO: 40313

SEQ ID NO: 230441 - RNA, 64 nt, hsa; identical to SEQ ID NO: 40314

SEQ ID NO: 230442 - RNA, 64 nt, hsa; identical to SEQ ID NO: 40315

SEQ ID NO: 230443 - RNA, 64 nt, hsa; identical to SEQ ID NO: 40316

SEQ ID NO: 230444 - RNA, 64 nt, hsa; identical to SEQ ID NO: 40317

SEQ ID NO: 230445 - RNA, 64 nt, hsa; identical to SEQ ID NO: 40318

SEQ ID NO: 230446 - RNA, 64 nt, hsa; identical to SEQ ID NO: 40319

SEQ ID NO: 230447 - RNA, 64 nt, hsa; identical to SEQ ID NO: 40320

SEQ ID NO: 230448 - RNA, 64 nt, hsa; identical to SEQ ID NO: 40321

SEQ ID NO: 230449 - RNA, 64 nt, hsa; identical to SEQ ID NO: 40322

SEQ ID NO: 230450 - RNA, 64 nt, hsa; identical to SEQ ID NO: 40323

SEQ ID NO: 230451 - RNA, 64 nt, hsa; identical to SEQ ID NO: 40324

SEQ ID NO: 230452 - RNA, 64 nt, hsa; identical to SEQ ID NO: 40325

SEQ ID NO: 230453 - RNA, 64 nt, hsa; identical to SEQ ID NO: 40326

SEQ ID NO: 230454 - RNA, 64 nt, hsa; identical to SEQ ID NO: 40327

SEQ ID NO: 230455 - RNA, 64 nt, hsa; identical to SEQ ID NO: 40328

SEQ ID NO: 230456 - RNA, 64 nt, hsa; identical to SEQ ID NO: 40329

SEQ ID NO: 230457 - RNA, 64 nt, hsa; identical to SEQ ID NO: 40330

SEQ ID NO: 230458 - RNA, 64 nt, hsa; identical to SEQ ID NO: 40331

SEQ ID NO: 230459 - RNA, 64 nt, hsa; identical to SEQ ID NO: 40332

SEQ ID NO: 230460 - RNA, 64 nt, hsa; identical to SEQ ID NO: 40333

SEQ ID NO: 230461 - RNA, 64 nt, hsa; identical to SEQ ID NO: 40334

SEQ ID NO: 230462 - RNA, 64 nt, hsa; identical to SEQ ID NO: 40335

SEQ ID NO: 230463 - RNA, 64 nt, hsa; identical to SEQ ID NO: 40336

SEQ ID NO: 230464 - RNA, 64 nt, hsa; identical to SEQ ID NO: 40337

SEQ ID NO: 230465 - RNA, 64 nt, hsa; identical to SEQ ID NO: 40338

SEQ ID NO: 230466 - RNA, 64 nt, hsa; identical to SEQ ID NO: 40339

SEQ ID NO: 230467 - RNA, 64 nt, hsa; identical to SEQ ID NO: 40340

SEQ ID NO: 230468 - RNA, 64 nt, hsa; identical to SEQ ID NO: 40341

SEQ ID NO: 230469 - RNA, 64 nt, hsa; identical to SEQ ID NO: 40342

SEQ ID NO: 230470 - RNA, 64 nt, hsa; identical to SEQ ID NO: 40343

SEQ ID NO: 230471 - RNA, 64 nt, hsa; identical to SEQ ID NO: 40344

SEQ ID NO: 230472 - RNA, 64 nt, hsa; identical to SEQ ID NO: 40345

SEQ ID NO: 230473 - RNA, 64 nt, hsa; identical to SEQ ID NO: 40346

SEQ ID NO: 230474 - RNA, 64 nt, hsa; identical to SEQ ID NO: 40347

SEQ ID NO: 230475 - RNA, 64 nt, hsa; identical to SEQ ID NO: 40348

SEQ ID NO: 230476 - RNA, 64 nt, hsa; identical to SEQ ID NO: 40349

SEQ ID NO: 230477 - RNA, 64 nt, hsa; identical to SEQ ID NO: 40350

SEQ ID NO: 230478 - RNA, 64 nt, hsa; identical to SEQ ID NO: 40351

SEQ ID NO: 230479 - RNA, 64 nt, hsa; identical to SEQ ID NO: 40352

SEQ ID NO: 230480 - RNA, 64 nt, hsa; identical to SEQ ID NO: 40353

SEQ ID NO: 230481 - RNA, 64 nt, hsa; identical to SEQ ID NO: 40354

SEQ ID NO: 230482 - RNA, 64 nt, hsa; identical to SEQ ID NO: 40355

SEQ ID NO: 230483 - RNA, 64 nt, hsa; identical to SEQ ID NO: 40356

SEQ ID NO: 230484 - RNA, 64 nt, hsa; identical to SEQ ID NO: 40357

SEQ ID NO: 230485 - RNA, 64 nt, hsa; identical to SEQ ID NO: 40358

SEQ ID NO: 230486 - RNA, 64 nt, hsa; identical to SEQ ID NO: 40359

SEQ ID NO: 230487 - RNA, 64 nt, hsa; identical to SEQ ID NO: 40360

SEQ ID NO: 230488 - RNA, 64 nt, hsa; identical to SEQ ID NO: 40361

SEQ ID NO: 230489 - RNA, 64 nt, hsa; identical to SEQ ID NO: 40362

SEQ ID NO: 230490 - RNA, 64 nt, hsa; identical to SEQ ID NO: 40363

SEQ ID NO: 230491 - RNA, 64 nt, hsa; identical to SEQ ID NO: 40364

SEQ ID NO: 230492 - RNA, 64 nt, hsa; identical to SEQ ID NO: 40365

SEQ ID NO: 230493 - RNA, 64 nt, hsa; identical to SEQ ID NO: 40366

SEQ ID NO: 230494 - RNA, 64 nt, hsa; identical to SEQ ID NO: 40367

SEQ ID NO: 230495 - RNA, 64 nt, hsa; identical to SEQ ID NO: 40368

SEQ ID NO: 230496 - RNA, 64 nt, hsa; identical to SEQ ID NO: 40369

SEQ ID NO: 230497 - RNA, 64 nt, hsa; identical to SEQ ID NO: 40370

SEQ ID NO: 230498 - RNA, 64 nt, hsa; identical to SEQ ID NO: 40371

SEQ ID NO: 230499 - RNA, 64 nt, hsa; identical to SEQ ID NO: 40372

SEQ ID NO: 230500 - RNA, 64 nt, hsa; identical to SEQ ID NO: 40373

SEQ ID NO: 230501 - RNA, 64 nt, hsa; identical to SEQ ID NO: 40374

SEQ ID NO: 230502 - RNA, 64 nt, hsa; identical to SEQ ID NO: 40375

SEQ ID NO: 230503 - RNA, 64 nt, hsa; identical to SEQ ID NO: 40376

SEQ ID NO: 230504 - RNA, 64 nt, hsa; identical to SEQ ID NO: 40377

SEQ ID NO: 230505 - RNA, 64 nt, hsa; identical to SEQ ID NO: 40378

SEQ ID NO: 230506 - RNA, 64 nt, hsa; identical to SEQ ID NO: 40379

SEQ ID NO: 230507 - RNA, 64 nt, hsa; identical to SEQ ID NO: 40380

SEQ ID NO: 230508 - RNA, 64 nt, hsa; identical to SEQ ID NO: 40381

SEQ ID NO: 230509 - RNA, 64 nt, hsa; identical to SEQ ID NO: 40382

SEQ ID NO: 230510 - RNA, 64 nt, hsa; identical to SEQ ID NO: 40383

SEQ ID NO: 230511 - RNA, 64 nt, hsa; identical to SEQ ID NO: 40384

SEQ ID NO: 230512 - RNA, 64 nt, hsa; identical to SEQ ID NO: 40385

SEQ ID NO: 230513 - RNA, 64 nt, hsa; identical to SEQ ID NO: 40386

SEQ ID NO: 230514 - RNA, 64 nt, hsa; identical to SEQ ID NO: 40387

SEQ ID NO: 230515 - RNA, 64 nt, hsa; identical to SEQ ID NO: 40388

SEQ ID NO: 230516 - RNA, 64 nt, hsa; identical to SEQ ID NO: 40389

SEQ ID NO: 230517 - RNA, 64 nt, hsa; identical to SEQ ID NO: 40390

SEQ ID NO: 230518 - RNA, 64 nt, hsa; identical to SEQ ID NO: 40391

SEQ ID NO: 230519 - RNA, 64 nt, hsa; identical to SEQ ID NO: 40392

SEQ ID NO: 230520 - RNA, 64 nt, hsa; identical to SEQ ID NO: 40393

SEQ ID NO: 230521 - RNA, 64 nt, hsa; identical to SEQ ID NO: 40394

SEQ ID NO: 230522 - RNA, 64 nt, hsa; identical to SEQ ID NO: 40395

SEQ ID NO: 230523 - RNA, 64 nt, hsa; identical to SEQ ID NO: 40396

SEQ ID NO: 230524 - RNA, 64 nt, hsa; identical to SEQ ID NO: 40397

SEQ ID NO: 230525 - RNA, 64 nt, hsa; identical to SEQ ID NO: 40398

SEQ ID NO: 230526 - RNA, 64 nt, hsa; identical to SEQ ID NO: 40399

SEQ ID NO: 230527 - RNA, 64 nt, hsa; identical to SEQ ID NO: 40400

SEQ ID NO: 230528 - RNA, 64 nt, hsa; identical to SEQ ID NO: 40401

SEQ ID NO: 230529 - RNA, 64 nt, hsa; identical to SEQ ID NO: 40402

SEQ ID NO: 230530 - RNA, 64 nt, hsa; identical to SEQ ID NO: 40403

SEQ ID NO: 230531 - RNA, 64 nt, hsa; identical to SEQ ID NO: 40404

SEQ ID NO: 230532 - RNA, 64 nt, hsa; identical to SEQ ID NO: 40405

SEQ ID NO: 230533 - RNA, 64 nt, hsa; identical to SEQ ID NO: 40406

SEQ ID NO: 230534 - RNA, 64 nt, hsa; identical to SEQ ID NO: 40407

SEQ ID NO: 230535 - RNA, 64 nt, hsa; identical to SEQ ID NO: 40408

SEQ ID NO: 230536 - RNA, 64 nt, hsa; identical to SEQ ID NO: 40409

SEQ ID NO: 230537 - RNA, 64 nt, hsa; identical to SEQ ID NO: 40410

SEQ ID NO: 230538 - RNA, 64 nt, hsa; identical to SEQ ID NO: 40411

SEQ ID NO: 230539 - RNA, 64 nt, hsa; identical to SEQ ID NO: 40412

SEQ ID NO: 230540 - RNA, 64 nt, hsa; identical to SEQ ID NO: 40413

SEQ ID NO: 230541 - RNA, 64 nt, hsa; identical to SEQ ID NO: 40414

SEQ ID NO: 230542 - RNA, 64 nt, hsa; identical to SEQ ID NO: 40415

SEQ ID NO: 230543 - RNA, 64 nt, hsa; identical to SEQ ID NO: 40416

SEQ ID NO: 230544 - RNA, 64 nt, hsa; identical to SEQ ID NO: 40417

SEQ ID NO: 230545 - RNA, 64 nt, hsa; identical to SEQ ID NO: 40418

SEQ ID NO: 230546 - RNA, 64 nt, hsa; identical to SEQ ID NO: 40419

SEQ ID NO: 230547 - RNA, 64 nt, hsa; identical to SEQ ID NO: 40420

SEQ ID NO: 230548 - RNA, 64 nt, hsa; identical to SEQ ID NO: 40421

SEQ ID NO: 230549 - RNA, 64 nt, hsa; identical to SEQ ID NO: 40422

SEQ ID NO: 230550 - RNA, 64 nt, hsa; identical to SEQ ID NO: 40423

SEQ ID NO: 230551 - RNA, 64 nt, hsa; identical to SEQ ID NO: 40424

SEQ ID NO: 230552 - RNA, 64 nt, hsa; identical to SEQ ID NO: 40425

SEQ ID NO: 230553 - RNA, 64 nt, hsa; identical to SEQ ID NO: 40426

SEQ ID NO: 230554 - RNA, 64 nt, hsa; identical to SEQ ID NO: 40427

SEQ ID NO: 230555 - RNA, 64 nt, hsa; identical to SEQ ID NO: 40428

SEQ ID NO: 230556 - RNA, 64 nt, hsa; identical to SEQ ID NO: 40429

SEQ ID NO: 230557 - RNA, 64 nt, hsa; identical to SEQ ID NO: 40430

SEQ ID NO: 230558 - RNA, 64 nt, hsa; identical to SEQ ID NO: 40431

SEQ ID NO: 230559 - RNA, 64 nt, hsa; identical to SEQ ID NO: 40432

SEQ ID NO: 230560 - RNA, 64 nt, hsa; identical to SEQ ID NO: 40433

SEQ ID NO: 230561 - RNA, 64 nt, hsa; identical to SEQ ID NO: 40434

SEQ ID NO: 230562 - RNA, 64 nt, hsa; identical to SEQ ID NO: 40435

SEQ ID NO: 230563 - RNA, 64 nt, hsa; identical to SEQ ID NO: 40436

SEQ ID NO: 230564 - RNA, 64 nt, hsa; identical to SEQ ID NO: 40437

SEQ ID NO: 230565 - RNA, 64 nt, hsa; identical to SEQ ID NO: 40438

SEQ ID NO: 230566 - RNA, 64 nt, hsa; identical to SEQ ID NO: 40439

SEQ ID NO: 230567 - RNA, 64 nt, hsa; identical to SEQ ID NO: 40440

SEQ ID NO: 230568 - RNA, 64 nt, hsa; identical to SEQ ID NO: 40441

SEQ ID NO: 230569 - RNA, 64 nt, hsa; identical to SEQ ID NO: 40442

SEQ ID NO: 230570 - RNA, 64 nt, hsa; identical to SEQ ID NO: 40443

SEQ ID NO: 230571 - RNA, 64 nt, hsa; identical to SEQ ID NO: 40444

SEQ ID NO: 230572 - RNA, 64 nt, hsa; identical to SEQ ID NO: 40445

SEQ ID NO: 230573 - RNA, 64 nt, hsa; identical to SEQ ID NO: 40446

SEQ ID NO: 230574 - RNA, 64 nt, hsa; identical to SEQ ID NO: 40447

SEQ ID NO: 230575 - RNA, 64 nt, hsa; identical to SEQ ID NO: 40448

SEQ ID NO: 230576 - RNA, 64 nt, hsa; identical to SEQ ID NO: 40449

SEQ ID NO: 230577 - RNA, 64 nt, hsa; identical to SEQ ID NO: 40450

SEQ ID NO: 230578 - RNA, 64 nt, hsa; identical to SEQ ID NO: 40451

SEQ ID NO: 230579 - RNA, 64 nt, hsa; identical to SEQ ID NO: 40452

SEQ ID NO: 230580 - RNA, 64 nt, hsa; identical to SEQ ID NO: 40453

SEQ ID NO: 230581 - RNA, 64 nt, hsa; identical to SEQ ID NO: 40454

SEQ ID NO: 230582 - RNA, 64 nt, hsa; identical to SEQ ID NO: 40455

SEQ ID NO: 230583 - RNA, 64 nt, hsa; identical to SEQ ID NO: 40456

SEQ ID NO: 230584 - RNA, 64 nt, hsa; identical to SEQ ID NO: 40457

SEQ ID NO: 230585 - RNA, 64 nt, hsa; identical to SEQ ID NO: 40458

SEQ ID NO: 230586 - RNA, 64 nt, hsa; identical to SEQ ID NO: 40459

SEQ ID NO: 230587 - RNA, 64 nt, hsa; identical to SEQ ID NO: 40460

SEQ ID NO: 230588 - RNA, 64 nt, hsa; identical to SEQ ID NO: 40461

SEQ ID NO: 230589 - RNA, 64 nt, hsa; identical to SEQ ID NO: 40462

SEQ ID NO: 230590 - RNA, 64 nt, hsa; identical to SEQ ID NO: 40463

SEQ ID NO: 230591 - RNA, 64 nt, hsa; identical to SEQ ID NO: 40464

SEQ ID NO: 230592 - RNA, 64 nt, hsa; identical to SEQ ID NO: 40465

SEQ ID NO: 230593 - RNA, 64 nt, hsa; identical to SEQ ID NO: 40466

SEQ ID NO: 230594 - RNA, 64 nt, hsa; identical to SEQ ID NO: 40467

SEQ ID NO: 230595 - RNA, 64 nt, hsa; identical to SEQ ID NO: 40468

SEQ ID NO: 230596 - RNA, 64 nt, hsa; identical to SEQ ID NO: 40469

SEQ ID NO: 230597 - RNA, 64 nt, hsa; identical to SEQ ID NO: 40470

SEQ ID NO: 230598 - RNA, 64 nt, hsa; identical to SEQ ID NO: 40471

SEQ ID NO: 230599 - RNA, 64 nt, hsa; identical to SEQ ID NO: 40472

SEQ ID NO: 230600 - RNA, 64 nt, hsa; identical to SEQ ID NO: 40473

SEQ ID NO: 230601 - RNA, 64 nt, hsa; identical to SEQ ID NO: 40474

SEQ ID NO: 230602 - RNA, 64 nt, hsa; identical to SEQ ID NO: 40475

SEQ ID NO: 230603 - RNA, 64 nt, hsa; identical to SEQ ID NO: 40476

SEQ ID NO: 230604 - RNA, 64 nt, hsa; identical to SEQ ID NO: 40477

SEQ ID NO: 230605 - RNA, 64 nt, hsa; identical to SEQ ID NO: 40478

SEQ ID NO: 230606 - RNA, 64 nt, hsa; identical to SEQ ID NO: 40479

SEQ ID NO: 230607 - RNA, 64 nt, hsa; identical to SEQ ID NO: 40480

SEQ ID NO: 230608 - RNA, 64 nt, hsa; identical to SEQ ID NO: 40481

SEQ ID NO: 230609 - RNA, 64 nt, hsa; identical to SEQ ID NO: 40482

SEQ ID NO: 230610 - RNA, 64 nt, hsa; identical to SEQ ID NO: 40483

SEQ ID NO: 230611 - RNA, 64 nt, hsa; identical to SEQ ID NO: 40484

SEQ ID NO: 230612 - RNA, 64 nt, hsa; identical to SEQ ID NO: 40485

SEQ ID NO: 230613 - RNA, 64 nt, hsa; identical to SEQ ID NO: 40486

SEQ ID NO: 230614 - RNA, 64 nt, hsa; identical to SEQ ID NO: 40487

SEQ ID NO: 230615 - RNA, 64 nt, hsa; identical to SEQ ID NO: 40488

SEQ ID NO: 230616 - RNA, 64 nt, hsa; identical to SEQ ID NO: 40489

SEQ ID NO: 230617 - RNA, 64 nt, hsa; identical to SEQ ID NO: 40490

SEQ ID NO: 230618 - RNA, 64 nt, hsa; identical to SEQ ID NO: 40491

SEQ ID NO: 230619 - RNA, 64 nt, hsa; identical to SEQ ID NO: 40492

SEQ ID NO: 230620 - RNA, 64 nt, hsa; identical to SEQ ID NO: 40493

SEQ ID NO: 230621 - RNA, 64 nt, hsa; identical to SEQ ID NO: 40494

SEQ ID NO: 230622 - RNA, 64 nt, hsa; identical to SEQ ID NO: 40495

SEQ ID NO: 230623 - RNA, 64 nt, hsa; identical to SEQ ID NO: 40496

SEQ ID NO: 230624 - RNA, 64 nt, hsa; identical to SEQ ID NO: 40497

SEQ ID NO: 230625 - RNA, 64 nt, hsa; identical to SEQ ID NO: 40498

SEQ ID NO: 230626 - RNA, 64 nt, hsa; identical to SEQ ID NO: 40499

SEQ ID NO: 230627 - RNA, 64 nt, hsa; identical to SEQ ID NO: 40500

SEQ ID NO: 230628 - RNA, 64 nt, hsa; identical to SEQ ID NO: 40501

SEQ ID NO: 230629 - RNA, 64 nt, hsa; identical to SEQ ID NO: 40502

SEQ ID NO: 230630 - RNA, 64 nt, hsa; identical to SEQ ID NO: 40503

SEQ ID NO: 230631 - RNA, 64 nt, hsa; identical to SEQ ID NO: 40504

SEQ ID NO: 230632 - RNA, 64 nt, hsa; identical to SEQ ID NO: 40505

SEQ ID NO: 230633 - RNA, 64 nt, hsa; identical to SEQ ID NO: 40506

SEQ ID NO: 230634 - RNA, 64 nt, hsa; identical to SEQ ID NO: 40507

SEQ ID NO: 230635 - RNA, 64 nt, hsa; identical to SEQ ID NO: 40508

SEQ ID NO: 230636 - RNA, 64 nt, hsa; identical to SEQ ID NO: 40509

SEQ ID NO: 230637 - RNA, 64 nt, hsa; identical to SEQ ID NO: 40510

SEQ ID NO: 230638 - RNA, 64 nt, hsa; identical to SEQ ID NO: 40511

SEQ ID NO: 230639 - RNA, 64 nt, hsa; identical to SEQ ID NO: 40512

SEQ ID NO: 230640 - RNA, 64 nt, hsa; identical to SEQ ID NO: 40513

SEQ ID NO: 230641 - RNA, 64 nt, hsa; identical to SEQ ID NO: 40514

SEQ ID NO: 230642 - RNA, 64 nt, hsa; identical to SEQ ID NO: 40515

SEQ ID NO: 230643 - RNA, 64 nt, hsa; identical to SEQ ID NO: 40516

SEQ ID NO: 230644 - RNA, 64 nt, hsa; identical to SEQ ID NO: 40517

SEQ ID NO: 230645 - RNA, 64 nt, hsa; identical to SEQ ID NO: 40518

SEQ ID NO: 230646 - RNA, 64 nt, hsa; identical to SEQ ID NO: 40519

SEQ ID NO: 230647 - RNA, 64 nt, hsa; identical to SEQ ID NO: 40520

SEQ ID NO: 230648 - RNA, 64 nt, hsa; identical to SEQ ID NO: 40521

SEQ ID NO: 230649 - RNA, 64 nt, hsa; identical to SEQ ID NO: 40522

SEQ ID NO: 230650 - RNA, 64 nt, hsa; identical to SEQ ID NO: 40523

SEQ ID NO: 230651 - RNA, 64 nt, hsa; identical to SEQ ID NO: 40524

SEQ ID NO: 230652 - RNA, 64 nt, hsa; identical to SEQ ID NO: 40525

SEQ ID NO: 230653 - RNA, 64 nt, hsa; identical to SEQ ID NO: 40526

SEQ ID NO: 230654 - RNA, 64 nt, hsa; identical to SEQ ID NO: 40527

SEQ ID NO: 230655 - RNA, 64 nt, hsa; identical to SEQ ID NO: 40528

SEQ ID NO: 230656 - RNA, 64 nt, hsa; identical to SEQ ID NO: 40529

SEQ ID NO: 230657 - RNA, 64 nt, hsa; identical to SEQ ID NO: 40530

SEQ ID NO: 230658 - RNA, 64 nt, hsa; identical to SEQ ID NO: 40531

SEQ ID NO: 230659 - RNA, 64 nt, hsa; identical to SEQ ID NO: 40532

SEQ ID NO: 230660 - RNA, 64 nt, hsa; identical to SEQ ID NO: 40533

SEQ ID NO: 230661 - RNA, 64 nt, hsa; identical to SEQ ID NO: 40534

SEQ ID NO: 230662 - RNA, 64 nt, hsa; identical to SEQ ID NO: 40535

SEQ ID NO: 230663 - RNA, 64 nt, hsa; identical to SEQ ID NO: 40536

SEQ ID NO: 230664 - RNA, 64 nt, hsa; identical to SEQ ID NO: 40537

SEQ ID NO: 230665 - RNA, 64 nt, hsa; identical to SEQ ID NO: 40538

SEQ ID NO: 230666 - RNA, 64 nt, hsa; identical to SEQ ID NO: 40539

SEQ ID NO: 230667 - RNA, 64 nt, hsa; identical to SEQ ID NO: 40540

SEQ ID NO: 230668 - RNA, 64 nt, hsa; identical to SEQ ID NO: 40541

SEQ ID NO: 230669 - RNA, 64 nt, hsa; identical to SEQ ID NO: 40542

SEQ ID NO: 230670 - RNA, 64 nt, hsa; identical to SEQ ID NO: 40543

SEQ ID NO: 230671 - RNA, 64 nt, hsa; identical to SEQ ID NO: 40544

SEQ ID NO: 230672 - RNA, 64 nt, hsa; identical to SEQ ID NO: 40545

SEQ ID NO: 230673 - RNA, 64 nt, hsa; identical to SEQ ID NO: 40546

SEQ ID NO: 230674 - RNA, 64 nt, hsa; identical to SEQ ID NO: 40547

SEQ ID NO: 230675 - RNA, 64 nt, hsa; identical to SEQ ID NO: 40548

SEQ ID NO: 230676 - RNA, 64 nt, hsa; identical to SEQ ID NO: 40549

SEQ ID NO: 230677 - RNA, 64 nt, hsa; identical to SEQ ID NO: 40550

SEQ ID NO: 230678 - RNA, 64 nt, hsa; identical to SEQ ID NO: 40551

SEQ ID NO: 230679 - RNA, 64 nt, hsa; identical to SEQ ID NO: 40552

SEQ ID NO: 230680 - RNA, 64 nt, hsa; identical to SEQ ID NO: 40553

SEQ ID NO: 230681 - RNA, 64 nt, hsa; identical to SEQ ID NO: 40554

SEQ ID NO: 230682 - RNA, 64 nt, hsa; identical to SEQ ID NO: 40555

SEQ ID NO: 230683 - RNA, 64 nt, hsa; identical to SEQ ID NO: 40556

SEQ ID NO: 230684 - RNA, 64 nt, hsa; identical to SEQ ID NO: 40557

SEQ ID NO: 230685 - RNA, 64 nt, hsa; identical to SEQ ID NO: 40558

SEQ ID NO: 230686 - RNA, 64 nt, hsa; identical to SEQ ID NO: 40559

SEQ ID NO: 230687 - RNA, 64 nt, hsa; identical to SEQ ID NO: 40560

SEQ ID NO: 230688 - RNA, 64 nt, hsa; identical to SEQ ID NO: 40561

SEQ ID NO: 230689 - RNA, 64 nt, hsa; identical to SEQ ID NO: 40562

SEQ ID NO: 230690 - RNA, 64 nt, hsa; identical to SEQ ID NO: 40563

SEQ ID NO: 230691 - RNA, 64 nt, hsa; identical to SEQ ID NO: 40564

SEQ ID NO: 230692 - RNA, 64 nt, hsa; identical to SEQ ID NO: 40565

SEQ ID NO: 230693 - RNA, 64 nt, hsa; identical to SEQ ID NO: 40566

SEQ ID NO: 230694 - RNA, 64 nt, hsa; identical to SEQ ID NO: 40567

SEQ ID NO: 230695 - RNA, 64 nt, hsa; identical to SEQ ID NO: 40568

SEQ ID NO: 230696 - RNA, 64 nt, hsa; identical to SEQ ID NO: 40569

SEQ ID NO: 230697 - RNA, 64 nt, hsa; identical to SEQ ID NO: 40570

SEQ ID NO: 230698 - RNA, 64 nt, hsa; identical to SEQ ID NO: 40571

SEQ ID NO: 230699 - RNA, 64 nt, hsa; identical to SEQ ID NO: 40572

SEQ ID NO: 230700 - RNA, 64 nt, hsa; identical to SEQ ID NO: 40573

SEQ ID NO: 230701 - RNA, 64 nt, hsa; identical to SEQ ID NO: 40574

SEQ ID NO: 230702 - RNA, 64 nt, hsa; identical to SEQ ID NO: 40575

SEQ ID NO: 230703 - RNA, 64 nt, hsa; identical to SEQ ID NO: 40576

SEQ ID NO: 230704 - RNA, 64 nt, hsa; identical to SEQ ID NO: 40577

SEQ ID NO: 230705 - RNA, 64 nt, hsa; identical to SEQ ID NO: 40578

SEQ ID NO: 230706 - RNA, 64 nt, hsa; identical to SEQ ID NO: 40579

SEQ ID NO: 230707 - RNA, 64 nt, hsa; identical to SEQ ID NO: 40580

SEQ ID NO: 230708 - RNA, 64 nt, hsa; identical to SEQ ID NO: 40581

SEQ ID NO: 230709 - RNA, 64 nt, hsa; identical to SEQ ID NO: 40582

SEQ ID NO: 230710 - RNA, 64 nt, hsa; identical to SEQ ID NO: 40583

SEQ ID NO: 230711 - RNA, 64 nt, hsa; identical to SEQ ID NO: 40584

SEQ ID NO: 230712 - RNA, 64 nt, hsa; identical to SEQ ID NO: 40585

SEQ ID NO: 230713 - RNA, 64 nt, hsa; identical to SEQ ID NO: 40586

SEQ ID NO: 230714 - RNA, 64 nt, hsa; identical to SEQ ID NO: 40587

SEQ ID NO: 230715 - RNA, 64 nt, hsa; identical to SEQ ID NO: 40588

SEQ ID NO: 230716 - RNA, 64 nt, hsa; identical to SEQ ID NO: 40589

SEQ ID NO: 230717 - RNA, 64 nt, hsa; identical to SEQ ID NO: 40590

SEQ ID NO: 230718 - RNA, 64 nt, hsa; identical to SEQ ID NO: 40591

SEQ ID NO: 230719 - RNA, 64 nt, hsa; identical to SEQ ID NO: 40592

SEQ ID NO: 230720 - RNA, 64 nt, hsa; identical to SEQ ID NO: 40593

SEQ ID NO: 230721 - RNA, 64 nt, hsa; identical to SEQ ID NO: 40594

SEQ ID NO: 230722 - RNA, 64 nt, hsa; identical to SEQ ID NO: 40595

SEQ ID NO: 230723 - RNA, 64 nt, hsa; identical to SEQ ID NO: 40596

SEQ ID NO: 230724 - RNA, 64 nt, hsa; identical to SEQ ID NO: 40597

SEQ ID NO: 230725 - RNA, 64 nt, hsa; identical to SEQ ID NO: 40598

SEQ ID NO: 230726 - RNA, 64 nt, hsa; identical to SEQ ID NO: 40599

SEQ ID NO: 230727 - RNA, 64 nt, hsa; identical to SEQ ID NO: 40600

SEQ ID NO: 230728 - RNA, 64 nt, hsa; identical to SEQ ID NO: 40601

SEQ ID NO: 230729 - RNA, 64 nt, hsa; identical to SEQ ID NO: 40602

SEQ ID NO: 230730 - RNA, 64 nt, hsa; identical to SEQ ID NO: 40603

SEQ ID NO: 230731 - RNA, 64 nt, hsa; identical to SEQ ID NO: 40604

SEQ ID NO: 230732 - RNA, 64 nt, hsa; identical to SEQ ID NO: 40605

SEQ ID NO: 230733 - RNA, 64 nt, hsa; identical to SEQ ID NO: 40606

SEQ ID NO: 230734 - RNA, 64 nt, hsa; identical to SEQ ID NO: 40607

SEQ ID NO: 230735 - RNA, 64 nt, hsa; identical to SEQ ID NO: 40608

SEQ ID NO: 230736 - RNA, 64 nt, hsa; identical to SEQ ID NO: 40609

SEQ ID NO: 230737 - RNA, 64 nt, hsa; identical to SEQ ID NO: 40610

SEQ ID NO: 230738 - RNA, 64 nt, hsa; identical to SEQ ID NO: 40611

SEQ ID NO: 230739 - RNA, 64 nt, hsa; identical to SEQ ID NO: 40612

SEQ ID NO: 230740 - RNA, 64 nt, hsa; identical to SEQ ID NO: 40613

SEQ ID NO: 230741 - RNA, 64 nt, hsa; identical to SEQ ID NO: 40614

SEQ ID NO: 230742 - RNA, 64 nt, hsa; identical to SEQ ID NO: 40615

SEQ ID NO: 230743 - RNA, 64 nt, hsa; identical to SEQ ID NO: 40616

SEQ ID NO: 230744 - RNA, 64 nt, hsa; identical to SEQ ID NO: 40617

SEQ ID NO: 230745 - RNA, 64 nt, hsa; identical to SEQ ID NO: 40618

SEQ ID NO: 230746 - RNA, 64 nt, hsa; identical to SEQ ID NO: 40619

SEQ ID NO: 230747 - RNA, 64 nt, hsa; identical to SEQ ID NO: 40620

SEQ ID NO: 230748 - RNA, 64 nt, hsa; identical to SEQ ID NO: 40621

SEQ ID NO: 230749 - RNA, 64 nt, hsa; identical to SEQ ID NO: 40622

SEQ ID NO: 230750 - RNA, 64 nt, hsa; identical to SEQ ID NO: 40623

SEQ ID NO: 230751 - RNA, 64 nt, hsa; identical to SEQ ID NO: 40624

SEQ ID NO: 230752 - RNA, 64 nt, hsa; identical to SEQ ID NO: 40625

SEQ ID NO: 230753 - RNA, 64 nt, hsa; identical to SEQ ID NO: 40626

SEQ ID NO: 230754 - RNA, 64 nt, hsa; identical to SEQ ID NO: 40627

SEQ ID NO: 230755 - RNA, 64 nt, hsa; identical to SEQ ID NO: 40628

SEQ ID NO: 230756 - RNA, 64 nt, hsa; identical to SEQ ID NO: 40629

SEQ ID NO: 230757 - RNA, 64 nt, hsa; identical to SEQ ID NO: 40630

SEQ ID NO: 230758 - RNA, 64 nt, hsa; identical to SEQ ID NO: 40631

SEQ ID NO: 230759 - RNA, 64 nt, hsa; identical to SEQ ID NO: 40632

SEQ ID NO: 230760 - RNA, 64 nt, hsa; identical to SEQ ID NO: 40633

SEQ ID NO: 230761 - RNA, 64 nt, hsa; identical to SEQ ID NO: 40634

SEQ ID NO: 230762 - RNA, 64 nt, hsa; identical to SEQ ID NO: 40635

SEQ ID NO: 230763 - RNA, 64 nt, hsa; identical to SEQ ID NO: 40636

SEQ ID NO: 230764 - RNA, 64 nt, hsa; identical to SEQ ID NO: 40637

SEQ ID NO: 230765 - RNA, 64 nt, hsa; identical to SEQ ID NO: 40638

SEQ ID NO: 230766 - RNA, 64 nt, hsa; identical to SEQ ID NO: 40639

SEQ ID NO: 230767 - RNA, 64 nt, hsa; identical to SEQ ID NO: 40640

SEQ ID NO: 230768 - RNA, 64 nt, hsa; identical to SEQ ID NO: 40641

SEQ ID NO: 230769 - RNA, 64 nt, hsa; identical to SEQ ID NO: 40642

SEQ ID NO: 230770 - RNA, 64 nt, hsa; identical to SEQ ID NO: 40643

SEQ ID NO: 230771 - RNA, 64 nt, hsa; identical to SEQ ID NO: 40644

SEQ ID NO: 230772 - RNA, 64 nt, hsa; identical to SEQ ID NO: 40645

SEQ ID NO: 230773 - RNA, 64 nt, hsa; identical to SEQ ID NO: 40646

SEQ ID NO: 230774 - RNA, 64 nt, hsa; identical to SEQ ID NO: 40647

SEQ ID NO: 230775 - RNA, 64 nt, hsa; identical to SEQ ID NO: 40648

SEQ ID NO: 230776 - RNA, 64 nt, hsa; identical to SEQ ID NO: 40649

SEQ ID NO: 230777 - RNA, 64 nt, hsa; identical to SEQ ID NO: 40650

SEQ ID NO: 230778 - RNA, 64 nt, hsa; identical to SEQ ID NO: 40651

SEQ ID NO: 230779 - RNA, 64 nt, hsa; identical to SEQ ID NO: 40652

SEQ ID NO: 230780 - RNA, 64 nt, hsa; identical to SEQ ID NO: 40653

SEQ ID NO: 230781 - RNA, 64 nt, hsa; identical to SEQ ID NO: 40654

SEQ ID NO: 230782 - RNA, 64 nt, hsa; identical to SEQ ID NO: 40655

SEQ ID NO: 230783 - RNA, 64 nt, hsa; identical to SEQ ID NO: 40656

SEQ ID NO: 230784 - RNA, 64 nt, hsa; identical to SEQ ID NO: 40657

SEQ ID NO: 230785 - RNA, 64 nt, hsa; identical to SEQ ID NO: 40658

SEQ ID NO: 230786 - RNA, 64 nt, hsa; identical to SEQ ID NO: 40659

SEQ ID NO: 230787 - RNA, 64 nt, hsa; identical to SEQ ID NO: 40660

SEQ ID NO: 230788 - RNA, 64 nt, hsa; identical to SEQ ID NO: 40661

SEQ ID NO: 230789 - RNA, 64 nt, hsa; identical to SEQ ID NO: 40662

SEQ ID NO: 230790 - RNA, 64 nt, hsa; identical to SEQ ID NO: 40663

SEQ ID NO: 230791 - RNA, 64 nt, hsa; identical to SEQ ID NO: 40664

SEQ ID NO: 230792 - RNA, 64 nt, hsa; identical to SEQ ID NO: 40665

SEQ ID NO: 230793 - RNA, 64 nt, hsa; identical to SEQ ID NO: 40666

SEQ ID NO: 230794 - RNA, 64 nt, hsa; identical to SEQ ID NO: 40667

SEQ ID NO: 230795 - RNA, 64 nt, hsa; identical to SEQ ID NO: 40668

SEQ ID NO: 230796 - RNA, 64 nt, hsa; identical to SEQ ID NO: 40669

SEQ ID NO: 230797 - RNA, 64 nt, hsa; identical to SEQ ID NO: 40670

SEQ ID NO: 230798 - RNA, 64 nt, hsa; identical to SEQ ID NO: 40671

SEQ ID NO: 230799 - RNA, 64 nt, hsa; identical to SEQ ID NO: 40672

SEQ ID NO: 230800 - RNA, 64 nt, hsa; identical to SEQ ID NO: 40673

SEQ ID NO: 230801 - RNA, 64 nt, hsa; identical to SEQ ID NO: 40674

SEQ ID NO: 230802 - RNA, 64 nt, hsa; identical to SEQ ID NO: 40675

SEQ ID NO: 230803 - RNA, 64 nt, hsa; identical to SEQ ID NO: 40676

SEQ ID NO: 230804 - RNA, 64 nt, hsa; identical to SEQ ID NO: 40677

SEQ ID NO: 230805 - RNA, 64 nt, hsa; identical to SEQ ID NO: 40678

SEQ ID NO: 230806 - RNA, 64 nt, hsa; identical to SEQ ID NO: 40679

SEQ ID NO: 230807 - RNA, 64 nt, hsa; identical to SEQ ID NO: 40680

SEQ ID NO: 230808 - RNA, 64 nt, hsa; identical to SEQ ID NO: 40681

SEQ ID NO: 230809 - RNA, 64 nt, hsa; identical to SEQ ID NO: 40682

SEQ ID NO: 230810 - RNA, 64 nt, hsa; identical to SEQ ID NO: 40683

SEQ ID NO: 230811 - RNA, 64 nt, hsa; identical to SEQ ID NO: 40684

SEQ ID NO: 230812 - RNA, 64 nt, hsa; identical to SEQ ID NO: 40685

SEQ ID NO: 230813 - RNA, 64 nt, hsa; identical to SEQ ID NO: 40686

SEQ ID NO: 230814 - RNA, 64 nt, hsa; identical to SEQ ID NO: 40687

SEQ ID NO: 230815 - RNA, 64 nt, hsa; identical to SEQ ID NO: 40688

SEQ ID NO: 230816 - RNA, 64 nt, hsa; identical to SEQ ID NO: 40689

SEQ ID NO: 230817 - RNA, 64 nt, hsa; identical to SEQ ID NO: 40690

SEQ ID NO: 230818 - RNA, 64 nt, hsa; identical to SEQ ID NO: 40691

SEQ ID NO: 230819 - RNA, 64 nt, hsa; identical to SEQ ID NO: 40692

SEQ ID NO: 230820 - RNA, 64 nt, hsa; identical to SEQ ID NO: 40693

SEQ ID NO: 230821 - RNA, 64 nt, hsa; identical to SEQ ID NO: 40694

SEQ ID NO: 230822 - RNA, 64 nt, hsa; identical to SEQ ID NO: 40695

SEQ ID NO: 230823 - RNA, 64 nt, hsa; identical to SEQ ID NO: 40696

SEQ ID NO: 230824 - RNA, 64 nt, hsa; identical to SEQ ID NO: 40697

SEQ ID NO: 230825 - RNA, 64 nt, hsa; identical to SEQ ID NO: 40698

SEQ ID NO: 230826 - RNA, 64 nt, hsa; identical to SEQ ID NO: 40699

SEQ ID NO: 230827 - RNA, 64 nt, hsa; identical to SEQ ID NO: 40700

SEQ ID NO: 230828 - RNA, 64 nt, hsa; identical to SEQ ID NO: 40701

SEQ ID NO: 230829 - RNA, 64 nt, hsa; identical to SEQ ID NO: 40702

SEQ ID NO: 230830 - RNA, 64 nt, hsa; identical to SEQ ID NO: 40703

SEQ ID NO: 230831 - RNA, 64 nt, hsa; identical to SEQ ID NO: 40704

SEQ ID NO: 230832 - RNA, 64 nt, hsa; identical to SEQ ID NO: 40705

SEQ ID NO: 230833 - RNA, 64 nt, hsa; identical to SEQ ID NO: 40706

SEQ ID NO: 230834 - RNA, 64 nt, hsa; identical to SEQ ID NO: 40707

SEQ ID NO: 230835 - RNA, 64 nt, hsa; identical to SEQ ID NO: 40708

SEQ ID NO: 230836 - RNA, 64 nt, hsa; identical to SEQ ID NO: 40709

SEQ ID NO: 230837 - RNA, 64 nt, hsa; identical to SEQ ID NO: 40710

SEQ ID NO: 230838 - RNA, 64 nt, hsa; identical to SEQ ID NO: 40711

SEQ ID NO: 230839 - RNA, 64 nt, hsa; identical to SEQ ID NO: 40712

SEQ ID NO: 230840 - RNA, 64 nt, hsa; identical to SEQ ID NO: 40713

SEQ ID NO: 230841 - RNA, 64 nt, hsa; identical to SEQ ID NO: 40714

SEQ ID NO: 230842 - RNA, 64 nt, hsa; identical to SEQ ID NO: 40715

SEQ ID NO: 230843 - RNA, 64 nt, hsa; identical to SEQ ID NO: 40716

SEQ ID NO: 230844 - RNA, 64 nt, hsa; identical to SEQ ID NO: 40717

SEQ ID NO: 230845 - RNA, 64 nt, hsa; identical to SEQ ID NO: 40718

SEQ ID NO: 230846 - RNA, 64 nt, hsa; identical to SEQ ID NO: 40719

SEQ ID NO: 230847 - RNA, 64 nt, hsa; identical to SEQ ID NO: 40720

SEQ ID NO: 230848 - RNA, 64 nt, hsa; identical to SEQ ID NO: 40721

SEQ ID NO: 230849 - RNA, 64 nt, hsa; identical to SEQ ID NO: 40722

SEQ ID NO: 230850 - RNA, 64 nt, hsa; identical to SEQ ID NO: 40723

SEQ ID NO: 230851 - RNA, 64 nt, hsa; identical to SEQ ID NO: 40724

SEQ ID NO: 230852 - RNA, 64 nt, hsa; identical to SEQ ID NO: 40725

SEQ ID NO: 230853 - RNA, 64 nt, hsa; identical to SEQ ID NO: 40726

SEQ ID NO: 230854 - RNA, 64 nt, hsa; identical to SEQ ID NO: 40727

SEQ ID NO: 230855 - RNA, 64 nt, hsa; identical to SEQ ID NO: 40728

SEQ ID NO: 230856 - RNA, 64 nt, hsa; identical to SEQ ID NO: 40729

SEQ ID NO: 230857 - RNA, 64 nt, hsa; identical to SEQ ID NO: 40730

SEQ ID NO: 230858 - RNA, 64 nt, hsa; identical to SEQ ID NO: 40731

SEQ ID NO: 230859 - RNA, 64 nt, hsa; identical to SEQ ID NO: 40732

SEQ ID NO: 230860 - RNA, 64 nt, hsa; identical to SEQ ID NO: 40733

SEQ ID NO: 230861 - RNA, 64 nt, hsa; identical to SEQ ID NO: 40734

SEQ ID NO: 230862 - RNA, 64 nt, hsa; identical to SEQ ID NO: 40735

SEQ ID NO: 230863 - RNA, 64 nt, hsa; identical to SEQ ID NO: 40736

SEQ ID NO: 230864 - RNA, 64 nt, hsa; identical to SEQ ID NO: 40737

SEQ ID NO: 230865 - RNA, 64 nt, hsa; identical to SEQ ID NO: 40738

SEQ ID NO: 230866 - RNA, 64 nt, hsa; identical to SEQ ID NO: 40739

SEQ ID NO: 230867 - RNA, 64 nt, hsa; identical to SEQ ID NO: 40740

SEQ ID NO: 230868 - RNA, 64 nt, hsa; identical to SEQ ID NO: 40741

SEQ ID NO: 230869 - RNA, 64 nt, hsa; identical to SEQ ID NO: 40742

SEQ ID NO: 230870 - RNA, 64 nt, hsa; identical to SEQ ID NO: 40743

SEQ ID NO: 230871 - RNA, 64 nt, hsa; identical to SEQ ID NO: 40744

SEQ ID NO: 230872 - RNA, 64 nt, hsa; identical to SEQ ID NO: 40745

SEQ ID NO: 230873 - RNA, 64 nt, hsa; identical to SEQ ID NO: 40746

SEQ ID NO: 230874 - RNA, 64 nt, hsa; identical to SEQ ID NO: 40747

SEQ ID NO: 230875 - RNA, 64 nt, hsa; identical to SEQ ID NO: 40748

SEQ ID NO: 230876 - RNA, 64 nt, hsa; identical to SEQ ID NO: 40749

SEQ ID NO: 230877 - RNA, 64 nt, hsa; identical to SEQ ID NO: 40750

SEQ ID NO: 230878 - RNA, 64 nt, hsa; identical to SEQ ID NO: 40751

SEQ ID NO: 230879 - RNA, 64 nt, hsa; identical to SEQ ID NO: 40752

SEQ ID NO: 230880 - RNA, 64 nt, hsa; identical to SEQ ID NO: 40753

SEQ ID NO: 230881 - RNA, 64 nt, hsa; identical to SEQ ID NO: 40754

SEQ ID NO: 230882 - RNA, 64 nt, hsa; identical to SEQ ID NO: 40755

SEQ ID NO: 230883 - RNA, 64 nt, hsa; identical to SEQ ID NO: 40756

SEQ ID NO: 230884 - RNA, 64 nt, hsa; identical to SEQ ID NO: 40757

SEQ ID NO: 230885 - RNA, 64 nt, hsa; identical to SEQ ID NO: 40758

SEQ ID NO: 230886 - RNA, 64 nt, hsa; identical to SEQ ID NO: 40759

SEQ ID NO: 230887 - RNA, 64 nt, hsa; identical to SEQ ID NO: 40760

SEQ ID NO: 230888 - RNA, 64 nt, hsa; identical to SEQ ID NO: 40761

SEQ ID NO: 230889 - RNA, 64 nt, hsa; identical to SEQ ID NO: 40762

SEQ ID NO: 230890 - RNA, 64 nt, hsa; identical to SEQ ID NO: 40763

SEQ ID NO: 230891 - RNA, 64 nt, hsa; identical to SEQ ID NO: 40764

SEQ ID NO: 230892 - RNA, 64 nt, hsa; identical to SEQ ID NO: 40765

SEQ ID NO: 230893 - RNA, 64 nt, hsa; identical to SEQ ID NO: 40766

SEQ ID NO: 230894 - RNA, 64 nt, hsa; identical to SEQ ID NO: 40767

SEQ ID NO: 230895 - RNA, 64 nt, hsa; identical to SEQ ID NO: 40768

SEQ ID NO: 230896 - RNA, 64 nt, hsa; identical to SEQ ID NO: 40769

SEQ ID NO: 230897 - RNA, 64 nt, hsa; identical to SEQ ID NO: 40770

SEQ ID NO: 230898 - RNA, 64 nt, hsa; identical to SEQ ID NO: 40771

SEQ ID NO: 230899 - RNA, 64 nt, hsa; identical to SEQ ID NO: 40772

SEQ ID NO: 230900 - RNA, 64 nt, hsa; identical to SEQ ID NO: 40773

SEQ ID NO: 230901 - RNA, 64 nt, hsa; identical to SEQ ID NO: 40774

SEQ ID NO: 230902 - RNA, 64 nt, hsa; identical to SEQ ID NO: 40775

SEQ ID NO: 230903 - RNA, 64 nt, hsa; identical to SEQ ID NO: 40776

SEQ ID NO: 230904 - RNA, 64 nt, hsa; identical to SEQ ID NO: 40777

SEQ ID NO: 230905 - RNA, 64 nt, hsa; identical to SEQ ID NO: 40778

SEQ ID NO: 230906 - RNA, 64 nt, hsa; identical to SEQ ID NO: 40779

SEQ ID NO: 230907 - RNA, 64 nt, hsa; identical to SEQ ID NO: 40780

SEQ ID NO: 230908 - RNA, 64 nt, hsa; identical to SEQ ID NO: 40781

SEQ ID NO: 230909 - RNA, 64 nt, hsa; identical to SEQ ID NO: 40782

SEQ ID NO: 230910 - RNA, 64 nt, hsa; identical to SEQ ID NO: 40783

SEQ ID NO: 230911 - RNA, 64 nt, hsa; identical to SEQ ID NO: 40784

SEQ ID NO: 230912 - RNA, 64 nt, hsa; identical to SEQ ID NO: 40785

SEQ ID NO: 230913 - RNA, 64 nt, hsa; identical to SEQ ID NO: 40786

SEQ ID NO: 230914 - RNA, 64 nt, hsa; identical to SEQ ID NO: 40787

SEQ ID NO: 230915 - RNA, 64 nt, hsa; identical to SEQ ID NO: 40788

SEQ ID NO: 230916 - RNA, 64 nt, hsa; identical to SEQ ID NO: 40789

SEQ ID NO: 230917 - RNA, 64 nt, hsa; identical to SEQ ID NO: 40790

SEQ ID NO: 230918 - RNA, 64 nt, hsa; identical to SEQ ID NO: 40791

SEQ ID NO: 230919 - RNA, 64 nt, hsa; identical to SEQ ID NO: 40792

SEQ ID NO: 230920 - RNA, 64 nt, hsa; identical to SEQ ID NO: 40793

SEQ ID NO: 230921 - RNA, 64 nt, hsa; identical to SEQ ID NO: 40794

SEQ ID NO: 230922 - RNA, 64 nt, hsa; identical to SEQ ID NO: 40795

SEQ ID NO: 230923 - RNA, 64 nt, hsa; identical to SEQ ID NO: 40796

SEQ ID NO: 230924 - RNA, 64 nt, hsa; identical to SEQ ID NO: 40797

SEQ ID NO: 230925 - RNA, 64 nt, hsa; identical to SEQ ID NO: 40798

SEQ ID NO: 230926 - RNA, 64 nt, hsa; identical to SEQ ID NO: 40799

SEQ ID NO: 230927 - RNA, 64 nt, hsa; identical to SEQ ID NO: 40800

SEQ ID NO: 230928 - RNA, 64 nt, hsa; identical to SEQ ID NO: 40801

SEQ ID NO: 230929 - RNA, 64 nt, hsa; identical to SEQ ID NO: 40802

SEQ ID NO: 230930 - RNA, 64 nt, hsa; identical to SEQ ID NO: 40803

SEQ ID NO: 230931 - RNA, 64 nt, hsa; identical to SEQ ID NO: 40804

SEQ ID NO: 230932 - RNA, 64 nt, hsa; identical to SEQ ID NO: 40805

SEQ ID NO: 230933 - RNA, 64 nt, hsa; identical to SEQ ID NO: 40806

SEQ ID NO: 230934 - RNA, 64 nt, hsa; identical to SEQ ID NO: 40807

SEQ ID NO: 230935 - RNA, 64 nt, hsa; identical to SEQ ID NO: 40808

SEQ ID NO: 230936 - RNA, 64 nt, hsa; identical to SEQ ID NO: 40809

SEQ ID NO: 230937 - RNA, 64 nt, hsa; identical to SEQ ID NO: 40810

SEQ ID NO: 230938 - RNA, 64 nt, hsa; identical to SEQ ID NO: 40811

SEQ ID NO: 230939 - RNA, 64 nt, hsa; identical to SEQ ID NO: 40812

SEQ ID NO: 230940 - RNA, 64 nt, hsa; identical to SEQ ID NO: 40813

SEQ ID NO: 230941 - RNA, 64 nt, hsa; identical to SEQ ID NO: 40814

SEQ ID NO: 230942 - RNA, 64 nt, hsa; identical to SEQ ID NO: 40815

SEQ ID NO: 230943 - RNA, 64 nt, hsa; identical to SEQ ID NO: 40816

SEQ ID NO: 230944 - RNA, 64 nt, hsa; identical to SEQ ID NO: 40817

SEQ ID NO: 230945 - RNA, 64 nt, hsa; identical to SEQ ID NO: 40818

SEQ ID NO: 230946 - RNA, 64 nt, hsa; identical to SEQ ID NO: 40819

SEQ ID NO: 230947 - RNA, 64 nt, hsa; identical to SEQ ID NO: 40820

SEQ ID NO: 230948 - RNA, 64 nt, hsa; identical to SEQ ID NO: 40821

SEQ ID NO: 230949 - RNA, 64 nt, hsa; identical to SEQ ID NO: 40822

SEQ ID NO: 230950 - RNA, 64 nt, hsa; identical to SEQ ID NO: 40823

SEQ ID NO: 230951 - RNA, 64 nt, hsa; identical to SEQ ID NO: 40824

SEQ ID NO: 230952 - RNA, 64 nt, hsa; identical to SEQ ID NO: 40825

SEQ ID NO: 230953 - RNA, 64 nt, hsa; identical to SEQ ID NO: 40826

SEQ ID NO: 230954 - RNA, 64 nt, hsa; identical to SEQ ID NO: 40827

SEQ ID NO: 230955 - RNA, 64 nt, hsa; identical to SEQ ID NO: 40828

SEQ ID NO: 230956 - RNA, 64 nt, hsa; identical to SEQ ID NO: 40829

SEQ ID NO: 230957 - RNA, 64 nt, hsa; identical to SEQ ID NO: 40830

SEQ ID NO: 230958 - RNA, 64 nt, hsa; identical to SEQ ID NO: 40831

SEQ ID NO: 230959 - RNA, 64 nt, hsa; identical to SEQ ID NO: 40832

SEQ ID NO: 230960 - RNA, 64 nt, hsa; identical to SEQ ID NO: 40833

SEQ ID NO: 230961 - RNA, 64 nt, hsa; identical to SEQ ID NO: 40834

SEQ ID NO: 230962 - RNA, 64 nt, hsa; identical to SEQ ID NO: 40835

SEQ ID NO: 230963 - RNA, 64 nt, hsa; identical to SEQ ID NO: 40836

SEQ ID NO: 230964 - RNA, 64 nt, hsa; identical to SEQ ID NO: 40837

SEQ ID NO: 230965 - RNA, 64 nt, hsa; identical to SEQ ID NO: 40838

SEQ ID NO: 230966 - RNA, 64 nt, hsa; identical to SEQ ID NO: 40839

SEQ ID NO: 230967 - RNA, 64 nt, hsa; identical to SEQ ID NO: 40840

SEQ ID NO: 230968 - RNA, 64 nt, hsa; identical to SEQ ID NO: 40841

SEQ ID NO: 230969 - RNA, 64 nt, hsa; identical to SEQ ID NO: 40842

SEQ ID NO: 230970 - RNA, 64 nt, hsa; identical to SEQ ID NO: 40843

SEQ ID NO: 230971 - RNA, 64 nt, hsa; identical to SEQ ID NO: 40844

SEQ ID NO: 230972 - RNA, 64 nt, hsa; identical to SEQ ID NO: 40845

SEQ ID NO: 230973 - RNA, 64 nt, hsa; identical to SEQ ID NO: 40846

SEQ ID NO: 230974 - RNA, 64 nt, hsa; identical to SEQ ID NO: 40847

SEQ ID NO: 230975 - RNA, 64 nt, hsa; identical to SEQ ID NO: 40848

SEQ ID NO: 230976 - RNA, 64 nt, hsa; identical to SEQ ID NO: 40849

SEQ ID NO: 230977 - RNA, 64 nt, hsa; identical to SEQ ID NO: 40850

SEQ ID NO: 230978 - RNA, 64 nt, hsa; identical to SEQ ID NO: 40851

SEQ ID NO: 230979 - RNA, 64 nt, hsa; identical to SEQ ID NO: 40852

SEQ ID NO: 230980 - RNA, 64 nt, hsa; identical to SEQ ID NO: 40853

SEQ ID NO: 230981 - RNA, 64 nt, hsa; identical to SEQ ID NO: 40854

SEQ ID NO: 230982 - RNA, 64 nt, hsa; identical to SEQ ID NO: 40855

SEQ ID NO: 230983 - RNA, 64 nt, hsa; identical to SEQ ID NO: 40856

SEQ ID NO: 230984 - RNA, 64 nt, hsa; identical to SEQ ID NO: 40857

SEQ ID NO: 230985 - RNA, 64 nt, hsa; identical to SEQ ID NO: 40858

SEQ ID NO: 230986 - RNA, 64 nt, hsa; identical to SEQ ID NO: 40859

SEQ ID NO: 230987 - RNA, 64 nt, hsa; identical to SEQ ID NO: 40860

SEQ ID NO: 230988 - RNA, 64 nt, hsa; identical to SEQ ID NO: 40861

SEQ ID NO: 230989 - RNA, 64 nt, hsa; identical to SEQ ID NO: 40862

SEQ ID NO: 230990 - RNA, 64 nt, hsa; identical to SEQ ID NO: 40863

SEQ ID NO: 230991 - RNA, 64 nt, hsa; identical to SEQ ID NO: 40864

SEQ ID NO: 230992 - RNA, 64 nt, hsa; identical to SEQ ID NO: 40865

SEQ ID NO: 230993 - RNA, 64 nt, hsa; identical to SEQ ID NO: 40866

SEQ ID NO: 230994 - RNA, 64 nt, hsa; identical to SEQ ID NO: 40867

SEQ ID NO: 230995 - RNA, 64 nt, hsa; identical to SEQ ID NO: 40868

SEQ ID NO: 230996 - RNA, 64 nt, hsa; identical to SEQ ID NO: 40869

SEQ ID NO: 230997 - RNA, 64 nt, hsa; identical to SEQ ID NO: 40870

SEQ ID NO: 230998 - RNA, 64 nt, hsa; identical to SEQ ID NO: 40871

SEQ ID NO: 230999 - RNA, 64 nt, hsa; identical to SEQ ID NO: 40872

SEQ ID NO: 231000 - RNA, 64 nt, hsa; identical to SEQ ID NO: 40873

SEQ ID NO: 231001 - RNA, 64 nt, hsa; identical to SEQ ID NO: 40874

SEQ ID NO: 231002 - RNA, 64 nt, hsa; identical to SEQ ID NO: 40875

SEQ ID NO: 231003 - RNA, 64 nt, hsa; identical to SEQ ID NO: 40876

SEQ ID NO: 231004 - RNA, 64 nt, hsa; identical to SEQ ID NO: 40877

SEQ ID NO: 231005 - RNA, 64 nt, hsa; identical to SEQ ID NO: 40878

SEQ ID NO: 231006 - RNA, 64 nt, hsa; identical to SEQ ID NO: 40879

SEQ ID NO: 231007 - RNA, 64 nt, hsa; identical to SEQ ID NO: 40880

SEQ ID NO: 231008 - RNA, 64 nt, hsa; identical to SEQ ID NO: 40881

SEQ ID NO: 231009 - RNA, 64 nt, hsa; identical to SEQ ID NO: 40882

SEQ ID NO: 231010 - RNA, 64 nt, hsa; identical to SEQ ID NO: 40883

SEQ ID NO: 231011 - RNA, 64 nt, hsa; identical to SEQ ID NO: 40884

SEQ ID NO: 231012 - RNA, 64 nt, hsa; identical to SEQ ID NO: 40885

SEQ ID NO: 231013 - RNA, 64 nt, hsa; identical to SEQ ID NO: 40886

SEQ ID NO: 231014 - RNA, 64 nt, hsa; identical to SEQ ID NO: 40887

SEQ ID NO: 231015 - RNA, 64 nt, hsa; identical to SEQ ID NO: 40888

SEQ ID NO: 231016 - RNA, 64 nt, hsa; identical to SEQ ID NO: 40889

SEQ ID NO: 231017 - RNA, 64 nt, hsa; identical to SEQ ID NO: 40890

SEQ ID NO: 231018 - RNA, 64 nt, hsa; identical to SEQ ID NO: 40891

SEQ ID NO: 231019 - RNA, 64 nt, hsa; identical to SEQ ID NO: 40892

SEQ ID NO: 231020 - RNA, 64 nt, hsa; identical to SEQ ID NO: 40893

SEQ ID NO: 231021 - RNA, 64 nt, hsa; identical to SEQ ID NO: 40894

SEQ ID NO: 231022 - RNA, 64 nt, hsa; identical to SEQ ID NO: 40895

SEQ ID NO: 231023 - RNA, 64 nt, hsa; identical to SEQ ID NO: 40896

SEQ ID NO: 231024 - RNA, 64 nt, hsa; identical to SEQ ID NO: 40897

SEQ ID NO: 231025 - RNA, 64 nt, hsa; identical to SEQ ID NO: 40898

SEQ ID NO: 231026 - RNA, 64 nt, hsa; identical to SEQ ID NO: 40899

SEQ ID NO: 231027 - RNA, 64 nt, hsa; identical to SEQ ID NO: 40900

SEQ ID NO: 231028 - RNA, 64 nt, hsa; identical to SEQ ID NO: 40901

SEQ ID NO: 231029 - RNA, 64 nt, hsa; identical to SEQ ID NO: 40902

SEQ ID NO: 231030 - RNA, 64 nt, hsa; identical to SEQ ID NO: 40903

SEQ ID NO: 231031 - RNA, 64 nt, hsa; identical to SEQ ID NO: 40904

SEQ ID NO: 231032 - RNA, 64 nt, hsa; identical to SEQ ID NO: 40905

SEQ ID NO: 231033 - RNA, 64 nt, hsa; identical to SEQ ID NO: 40906

SEQ ID NO: 231034 - RNA, 64 nt, hsa; identical to SEQ ID NO: 40907

SEQ ID NO: 231035 - RNA, 64 nt, hsa; identical to SEQ ID NO: 40908

SEQ ID NO: 231036 - RNA, 64 nt, hsa; identical to SEQ ID NO: 40909

SEQ ID NO: 231037 - RNA, 64 nt, hsa; identical to SEQ ID NO: 40910

SEQ ID NO: 231038 - RNA, 64 nt, hsa; identical to SEQ ID NO: 40911

SEQ ID NO: 231039 - RNA, 64 nt, hsa; identical to SEQ ID NO: 40912

SEQ ID NO: 231040 - RNA, 64 nt, hsa; identical to SEQ ID NO: 40913

SEQ ID NO: 231041 - RNA, 64 nt, hsa; identical to SEQ ID NO: 40914

SEQ ID NO: 231042 - RNA, 64 nt, hsa; identical to SEQ ID NO: 40915

SEQ ID NO: 231043 - RNA, 64 nt, hsa; identical to SEQ ID NO: 40916

SEQ ID NO: 231044 - RNA, 64 nt, hsa; identical to SEQ ID NO: 40917

SEQ ID NO: 231045 - RNA, 64 nt, hsa; identical to SEQ ID NO: 40918

SEQ ID NO: 231046 - RNA, 64 nt, hsa; identical to SEQ ID NO: 40919

SEQ ID NO: 231047 - RNA, 64 nt, hsa; identical to SEQ ID NO: 40920

SEQ ID NO: 231048 - RNA, 64 nt, hsa; identical to SEQ ID NO: 40921

SEQ ID NO: 231049 - RNA, 64 nt, hsa; identical to SEQ ID NO: 40922

SEQ ID NO: 231050 - RNA, 64 nt, hsa; identical to SEQ ID NO: 40923

SEQ ID NO: 231051 - RNA, 64 nt, hsa; identical to SEQ ID NO: 40924

SEQ ID NO: 231052 - RNA, 64 nt, hsa; identical to SEQ ID NO: 40925

SEQ ID NO: 231053 - RNA, 64 nt, hsa; identical to SEQ ID NO: 40926

SEQ ID NO: 231054 - RNA, 64 nt, hsa; identical to SEQ ID NO: 40927

SEQ ID NO: 231055 - RNA, 64 nt, hsa; identical to SEQ ID NO: 40928

SEQ ID NO: 231056 - RNA, 64 nt, hsa; identical to SEQ ID NO: 40929

SEQ ID NO: 231057 - RNA, 64 nt, hsa; identical to SEQ ID NO: 40930

SEQ ID NO: 231058 - RNA, 64 nt, hsa; identical to SEQ ID NO: 40931

SEQ ID NO: 231059 - RNA, 64 nt, hsa; identical to SEQ ID NO: 40932

SEQ ID NO: 231060 - RNA, 64 nt, hsa; identical to SEQ ID NO: 40933

SEQ ID NO: 231061 - RNA, 64 nt, hsa; identical to SEQ ID NO: 40934

SEQ ID NO: 231062 - RNA, 64 nt, hsa; identical to SEQ ID NO: 40935

SEQ ID NO: 231063 - RNA, 64 nt, hsa; identical to SEQ ID NO: 40936

SEQ ID NO: 231064 - RNA, 64 nt, hsa; identical to SEQ ID NO: 40937

SEQ ID NO: 231065 - RNA, 64 nt, hsa; identical to SEQ ID NO: 40938

SEQ ID NO: 231066 - RNA, 64 nt, hsa; identical to SEQ ID NO: 40939

SEQ ID NO: 231067 - RNA, 64 nt, hsa; identical to SEQ ID NO: 40940

SEQ ID NO: 231068 - RNA, 64 nt, hsa; identical to SEQ ID NO: 40941

SEQ ID NO: 231069 - RNA, 64 nt, hsa; identical to SEQ ID NO: 40942

SEQ ID NO: 231070 - RNA, 64 nt, hsa; identical to SEQ ID NO: 40943

SEQ ID NO: 231071 - RNA, 64 nt, hsa; identical to SEQ ID NO: 40944

SEQ ID NO: 231072 - RNA, 64 nt, hsa; identical to SEQ ID NO: 40945

SEQ ID NO: 231073 - RNA, 64 nt, hsa; identical to SEQ ID NO: 40946

SEQ ID NO: 231074 - RNA, 64 nt, hsa; identical to SEQ ID NO: 40947

SEQ ID NO: 231075 - RNA, 64 nt, hsa; identical to SEQ ID NO: 40948

SEQ ID NO: 231076 - RNA, 64 nt, hsa; identical to SEQ ID NO: 40949

SEQ ID NO: 231077 - RNA, 64 nt, hsa; identical to SEQ ID NO: 40950

SEQ ID NO: 231078 - RNA, 64 nt, hsa; identical to SEQ ID NO: 40951

SEQ ID NO: 231079 - RNA, 64 nt, hsa; identical to SEQ ID NO: 40952

SEQ ID NO: 231080 - RNA, 64 nt, hsa; identical to SEQ ID NO: 40953

SEQ ID NO: 231081 - RNA, 64 nt, hsa; identical to SEQ ID NO: 40954

SEQ ID NO: 231082 - RNA, 64 nt, hsa; identical to SEQ ID NO: 40955

SEQ ID NO: 231083 - RNA, 64 nt, hsa; identical to SEQ ID NO: 40956

SEQ ID NO: 231084 - RNA, 64 nt, hsa; identical to SEQ ID NO: 40957

SEQ ID NO: 231085 - RNA, 64 nt, hsa; identical to SEQ ID NO: 40958

SEQ ID NO: 231086 - RNA, 64 nt, hsa; identical to SEQ ID NO: 40959

SEQ ID NO: 231087 - RNA, 64 nt, hsa; identical to SEQ ID NO: 40960

SEQ ID NO: 231088 - RNA, 64 nt, hsa; identical to SEQ ID NO: 40961

SEQ ID NO: 231089 - RNA, 64 nt, hsa; identical to SEQ ID NO: 40962

SEQ ID NO: 231090 - RNA, 64 nt, hsa; identical to SEQ ID NO: 40963

SEQ ID NO: 231091 - RNA, 64 nt, hsa; identical to SEQ ID NO: 40964

SEQ ID NO: 231092 - RNA, 64 nt, hsa; identical to SEQ ID NO: 40965

SEQ ID NO: 231093 - RNA, 64 nt, hsa; identical to SEQ ID NO: 40966

SEQ ID NO: 231094 - RNA, 64 nt, hsa; identical to SEQ ID NO: 40967

SEQ ID NO: 231095 - RNA, 64 nt, hsa; identical to SEQ ID NO: 40968

SEQ ID NO: 231096 - RNA, 64 nt, hsa; identical to SEQ ID NO: 40969

SEQ ID NO: 231097 - RNA, 64 nt, hsa; identical to SEQ ID NO: 40970

SEQ ID NO: 231098 - RNA, 64 nt, hsa; identical to SEQ ID NO: 40971

SEQ ID NO: 231099 - RNA, 64 nt, hsa; identical to SEQ ID NO: 40972

SEQ ID NO: 231100 - RNA, 64 nt, hsa; identical to SEQ ID NO: 40973

SEQ ID NO: 231101 - RNA, 64 nt, hsa; identical to SEQ ID NO: 40974

SEQ ID NO: 231102 - RNA, 64 nt, hsa; identical to SEQ ID NO: 40975

SEQ ID NO: 231103 - RNA, 64 nt, hsa; identical to SEQ ID NO: 40976

SEQ ID NO: 231104 - RNA, 64 nt, hsa; identical to SEQ ID NO: 40977

SEQ ID NO: 231105 - RNA, 64 nt, hsa; identical to SEQ ID NO: 40978

SEQ ID NO: 231106 - RNA, 64 nt, hsa; identical to SEQ ID NO: 40979

SEQ ID NO: 231107 - RNA, 64 nt, hsa; identical to SEQ ID NO: 40980

SEQ ID NO: 231108 - RNA, 64 nt, hsa; identical to SEQ ID NO: 40981

SEQ ID NO: 231109 - RNA, 64 nt, hsa; identical to SEQ ID NO: 40982

SEQ ID NO: 231110 - RNA, 64 nt, hsa; identical to SEQ ID NO: 40983

SEQ ID NO: 231111 - RNA, 64 nt, hsa; identical to SEQ ID NO: 40984

SEQ ID NO: 231112 - RNA, 64 nt, hsa; identical to SEQ ID NO: 40985

SEQ ID NO: 231113 - RNA, 64 nt, hsa; identical to SEQ ID NO: 40986

SEQ ID NO: 231114 - RNA, 64 nt, hsa; identical to SEQ ID NO: 40987

SEQ ID NO: 231115 - RNA, 64 nt, hsa; identical to SEQ ID NO: 40988

SEQ ID NO: 231116 - RNA, 64 nt, hsa; identical to SEQ ID NO: 40989

SEQ ID NO: 231117 - RNA, 64 nt, hsa; identical to SEQ ID NO: 40990

SEQ ID NO: 231118 - RNA, 64 nt, hsa; identical to SEQ ID NO: 40991

SEQ ID NO: 231119 - RNA, 64 nt, hsa; identical to SEQ ID NO: 40992

SEQ ID NO: 231120 - RNA, 64 nt, hsa; identical to SEQ ID NO: 40993

SEQ ID NO: 231121 - RNA, 64 nt, hsa; identical to SEQ ID NO: 40994

SEQ ID NO: 231122 - RNA, 64 nt, hsa; identical to SEQ ID NO: 40995

SEQ ID NO: 231123 - RNA, 64 nt, hsa; identical to SEQ ID NO: 40996

SEQ ID NO: 231124 - RNA, 64 nt, hsa; identical to SEQ ID NO: 40997

SEQ ID NO: 231125 - RNA, 64 nt, hsa; identical to SEQ ID NO: 40998

SEQ ID NO: 231126 - RNA, 64 nt, hsa; identical to SEQ ID NO: 40999

SEQ ID NO: 231127 - RNA, 64 nt, hsa; identical to SEQ ID NO: 41000

SEQ ID NO: 231128 - RNA, 64 nt, hsa; identical to SEQ ID NO: 41001

SEQ ID NO: 231129 - RNA, 64 nt, hsa; identical to SEQ ID NO: 41002

SEQ ID NO: 231130 - RNA, 64 nt, hsa; identical to SEQ ID NO: 41003

SEQ ID NO: 231131 - RNA, 64 nt, hsa; identical to SEQ ID NO: 41004

SEQ ID NO: 231132 - RNA, 64 nt, hsa; identical to SEQ ID NO: 41005

SEQ ID NO: 231133 - RNA, 64 nt, hsa; identical to SEQ ID NO: 41006

SEQ ID NO: 231134 - RNA, 63 nt, hsa; identical to SEQ ID NO: 41007

SEQ ID NO: 231135 - RNA, 64 nt, hsa; identical to SEQ ID NO: 41008

SEQ ID NO: 231136 - RNA, 64 nt, hsa; identical to SEQ ID NO: 41009

SEQ ID NO: 231137 - RNA, 64 nt, hsa; identical to SEQ ID NO: 41010

SEQ ID NO: 231138 - RNA, 64 nt, hsa; identical to SEQ ID NO: 41011

SEQ ID NO: 231139 - RNA, 64 nt, hsa; identical to SEQ ID NO: 41012

SEQ ID NO: 231140 - RNA, 64 nt, hsa; identical to SEQ ID NO: 41013

SEQ ID NO: 231141 - RNA, 64 nt, hsa; identical to SEQ ID NO: 41014

SEQ ID NO: 231142 - RNA, 64 nt, hsa; identical to SEQ ID NO: 41015

SEQ ID NO: 231143 - RNA, 64 nt, hsa; identical to SEQ ID NO: 41016

SEQ ID NO: 231144 - RNA, 64 nt, hsa; identical to SEQ ID NO: 41017

SEQ ID NO: 231145 - RNA, 64 nt, hsa; identical to SEQ ID NO: 41018

SEQ ID NO: 231146 - RNA, 64 nt, hsa; identical to SEQ ID NO: 41019

SEQ ID NO: 231147 - RNA, 64 nt, hsa; identical to SEQ ID NO: 41020

SEQ ID NO: 231148 - RNA, 64 nt, hsa; identical to SEQ ID NO: 41021

SEQ ID NO: 231149 - RNA, 64 nt, hsa; identical to SEQ ID NO: 41022

SEQ ID NO: 231150 - RNA, 64 nt, hsa; identical to SEQ ID NO: 41023

SEQ ID NO: 231151 - RNA, 64 nt, hsa; identical to SEQ ID NO: 41024

SEQ ID NO: 231152 - RNA, 64 nt, hsa; identical to SEQ ID NO: 41025

SEQ ID NO: 231153 - RNA, 64 nt, hsa; identical to SEQ ID NO: 41026

SEQ ID NO: 231154 - RNA, 64 nt, hsa; identical to SEQ ID NO: 41027

SEQ ID NO: 231155 - RNA, 64 nt, hsa; identical to SEQ ID NO: 41028

SEQ ID NO: 231156 - RNA, 64 nt, hsa; identical to SEQ ID NO: 41029

SEQ ID NO: 231157 - RNA, 64 nt, hsa; identical to SEQ ID NO: 41030

SEQ ID NO: 231158 - RNA, 64 nt, hsa; identical to SEQ ID NO: 41031

SEQ ID NO: 231159 - RNA, 64 nt, hsa; identical to SEQ ID NO: 41032

SEQ ID NO: 231160 - RNA, 64 nt, hsa; identical to SEQ ID NO: 41033

SEQ ID NO: 231161 - RNA, 64 nt, hsa; identical to SEQ ID NO: 41034

SEQ ID NO: 231162 - RNA, 64 nt, hsa; identical to SEQ ID NO: 41035

SEQ ID NO: 231163 - RNA, 64 nt, hsa; identical to SEQ ID NO: 41036

SEQ ID NO: 231164 - RNA, 64 nt, hsa; identical to SEQ ID NO: 41037

SEQ ID NO: 231165 - RNA, 64 nt, hsa; identical to SEQ ID NO: 41038

SEQ ID NO: 231166 - RNA, 64 nt, hsa; identical to SEQ ID NO: 41039

SEQ ID NO: 231167 - RNA, 64 nt, hsa; identical to SEQ ID NO: 41040

SEQ ID NO: 231168 - RNA, 64 nt, hsa; identical to SEQ ID NO: 41041

SEQ ID NO: 231169 - RNA, 64 nt, hsa; identical to SEQ ID NO: 41042

SEQ ID NO: 231170 - RNA, 64 nt, hsa; identical to SEQ ID NO: 41043

SEQ ID NO: 231171 - RNA, 64 nt, hsa; identical to SEQ ID NO: 41044

SEQ ID NO: 231172 - RNA, 64 nt, hsa; identical to SEQ ID NO: 41045

SEQ ID NO: 231173 - RNA, 64 nt, hsa; identical to SEQ ID NO: 41046

SEQ ID NO: 231174 - RNA, 64 nt, hsa; identical to SEQ ID NO: 41047

SEQ ID NO: 231175 - RNA, 64 nt, hsa; identical to SEQ ID NO: 41048

SEQ ID NO: 231176 - RNA, 64 nt, hsa; identical to SEQ ID NO: 41049

SEQ ID NO: 231177 - RNA, 64 nt, hsa; identical to SEQ ID NO: 41050

SEQ ID NO: 231178 - RNA, 64 nt, hsa; identical to SEQ ID NO: 41051

SEQ ID NO: 231179 - RNA, 64 nt, hsa; identical to SEQ ID NO: 41052

SEQ ID NO: 231180 - RNA, 64 nt, hsa; identical to SEQ ID NO: 41053

SEQ ID NO: 231181 - RNA, 64 nt, hsa; identical to SEQ ID NO: 41054

SEQ ID NO: 231182 - RNA, 64 nt, hsa; identical to SEQ ID NO: 41055

SEQ ID NO: 231183 - RNA, 64 nt, hsa; identical to SEQ ID NO: 41056

SEQ ID NO: 231184 - RNA, 64 nt, hsa; identical to SEQ ID NO: 41057

SEQ ID NO: 231185 - RNA, 64 nt, hsa; identical to SEQ ID NO: 41058

SEQ ID NO: 231186 - RNA, 64 nt, hsa; identical to SEQ ID NO: 41059

SEQ ID NO: 231187 - RNA, 64 nt, hsa; identical to SEQ ID NO: 41060

SEQ ID NO: 231188 - RNA, 64 nt, hsa; identical to SEQ ID NO: 41061

SEQ ID NO: 231189 - RNA, 64 nt, hsa; identical to SEQ ID NO: 41062

SEQ ID NO: 231190 - RNA, 64 nt, hsa; identical to SEQ ID NO: 41063

SEQ ID NO: 231191 - RNA, 64 nt, hsa; identical to SEQ ID NO: 41064

SEQ ID NO: 231192 - RNA, 64 nt, hsa; identical to SEQ ID NO: 41065

SEQ ID NO: 231193 - RNA, 64 nt, hsa; identical to SEQ ID NO: 41066

SEQ ID NO: 231194 - RNA, 64 nt, hsa; identical to SEQ ID NO: 41067

SEQ ID NO: 231195 - RNA, 64 nt, hsa; identical to SEQ ID NO: 41068

SEQ ID NO: 231196 - RNA, 64 nt, hsa; identical to SEQ ID NO: 41069

SEQ ID NO: 231197 - RNA, 64 nt, hsa; identical to SEQ ID NO: 41070

SEQ ID NO: 231198 - RNA, 64 nt, hsa; identical to SEQ ID NO: 41071

SEQ ID NO: 231199 - RNA, 64 nt, hsa; identical to SEQ ID NO: 41072

SEQ ID NO: 231200 - RNA, 64 nt, hsa; identical to SEQ ID NO: 41073

SEQ ID NO: 231201 - RNA, 64 nt, hsa; identical to SEQ ID NO: 41074

SEQ ID NO: 231202 - RNA, 64 nt, hsa; identical to SEQ ID NO: 41075

SEQ ID NO: 231203 - RNA, 64 nt, hsa; identical to SEQ ID NO: 41076

SEQ ID NO: 231204 - RNA, 64 nt, hsa; identical to SEQ ID NO: 41077

SEQ ID NO: 231205 - RNA, 64 nt, hsa; identical to SEQ ID NO: 41078

SEQ ID NO: 231206 - RNA, 64 nt, hsa; identical to SEQ ID NO: 41079

SEQ ID NO: 231207 - RNA, 64 nt, hsa; identical to SEQ ID NO: 41080

SEQ ID NO: 231208 - RNA, 64 nt, hsa; identical to SEQ ID NO: 41081

SEQ ID NO: 231209 - RNA, 64 nt, hsa; identical to SEQ ID NO: 41082

SEQ ID NO: 231210 - RNA, 64 nt, hsa; identical to SEQ ID NO: 41083

SEQ ID NO: 231211 - RNA, 64 nt, hsa; identical to SEQ ID NO: 41084

SEQ ID NO: 231212 - RNA, 64 nt, hsa; identical to SEQ ID NO: 41085

SEQ ID NO: 231213 - RNA, 64 nt, hsa; identical to SEQ ID NO: 41086

SEQ ID NO: 231214 - RNA, 64 nt, hsa; identical to SEQ ID NO: 41087

SEQ ID NO: 231215 - RNA, 64 nt, hsa; identical to SEQ ID NO: 41088

SEQ ID NO: 231216 - RNA, 64 nt, hsa; identical to SEQ ID NO: 41089

SEQ ID NO: 231217 - RNA, 64 nt, hsa; identical to SEQ ID NO: 41090

SEQ ID NO: 231218 - RNA, 64 nt, hsa; identical to SEQ ID NO: 41091

SEQ ID NO: 231219 - RNA, 64 nt, hsa; identical to SEQ ID NO: 41092

SEQ ID NO: 231220 - RNA, 64 nt, hsa; identical to SEQ ID NO: 41093

SEQ ID NO: 231221 - RNA, 64 nt, hsa; identical to SEQ ID NO: 41094

SEQ ID NO: 231222 - RNA, 64 nt, hsa; identical to SEQ ID NO: 41095

SEQ ID NO: 231223 - RNA, 64 nt, hsa; identical to SEQ ID NO: 41096

SEQ ID NO: 231224 - RNA, 64 nt, hsa; identical to SEQ ID NO: 41097

SEQ ID NO: 231225 - RNA, 64 nt, hsa; identical to SEQ ID NO: 41098

SEQ ID NO: 231226 - RNA, 64 nt, hsa; identical to SEQ ID NO: 41099

SEQ ID NO: 231227 - RNA, 64 nt, hsa; identical to SEQ ID NO: 41100

SEQ ID NO: 231228 - RNA, 64 nt, hsa; identical to SEQ ID NO: 41101

SEQ ID NO: 231229 - RNA, 64 nt, hsa; identical to SEQ ID NO: 41102

SEQ ID NO: 231230 - RNA, 64 nt, hsa; identical to SEQ ID NO: 41103

SEQ ID NO: 231231 - RNA, 64 nt, hsa; identical to SEQ ID NO: 41104

SEQ ID NO: 231232 - RNA, 64 nt, hsa; identical to SEQ ID NO: 41105

SEQ ID NO: 231233 - RNA, 64 nt, hsa; identical to SEQ ID NO: 41106

SEQ ID NO: 231234 - RNA, 64 nt, hsa; identical to SEQ ID NO: 41107

SEQ ID NO: 231235 - RNA, 64 nt, hsa; identical to SEQ ID NO: 41108

SEQ ID NO: 231236 - RNA, 64 nt, hsa; identical to SEQ ID NO: 41109

SEQ ID NO: 231237 - RNA, 64 nt, hsa; identical to SEQ ID NO: 41110

SEQ ID NO: 231238 - RNA, 64 nt, hsa; identical to SEQ ID NO: 41111

SEQ ID NO: 231239 - RNA, 64 nt, hsa; identical to SEQ ID NO: 41112

SEQ ID NO: 231240 - RNA, 64 nt, hsa; identical to SEQ ID NO: 41113

SEQ ID NO: 231241 - RNA, 64 nt, hsa; identical to SEQ ID NO: 41114

SEQ ID NO: 231242 - RNA, 64 nt, hsa; identical to SEQ ID NO: 41115

SEQ ID NO: 231243 - RNA, 64 nt, hsa; identical to SEQ ID NO: 41116

SEQ ID NO: 231244 - RNA, 64 nt, hsa; identical to SEQ ID NO: 41117

SEQ ID NO: 231245 - RNA, 64 nt, hsa; identical to SEQ ID NO: 41118

SEQ ID NO: 231246 - RNA, 64 nt, hsa; identical to SEQ ID NO: 41119

SEQ ID NO: 231247 - RNA, 64 nt, hsa; identical to SEQ ID NO: 41120

SEQ ID NO: 231248 - RNA, 64 nt, hsa; identical to SEQ ID NO: 41121

SEQ ID NO: 231249 - RNA, 64 nt, hsa; identical to SEQ ID NO: 41122

SEQ ID NO: 231250 - RNA, 64 nt, hsa; identical to SEQ ID NO: 41123

SEQ ID NO: 231251 - RNA, 64 nt, hsa; identical to SEQ ID NO: 41124

SEQ ID NO: 231252 - RNA, 64 nt, hsa; identical to SEQ ID NO: 41125

SEQ ID NO: 231253 - RNA, 64 nt, hsa; identical to SEQ ID NO: 41126

SEQ ID NO: 231254 - RNA, 64 nt, hsa; identical to SEQ ID NO: 41127

SEQ ID NO: 231255 - RNA, 64 nt, hsa; identical to SEQ ID NO: 41128

SEQ ID NO: 231256 - RNA, 64 nt, hsa; identical to SEQ ID NO: 41129

SEQ ID NO: 231257 - RNA, 64 nt, hsa; identical to SEQ ID NO: 41130

SEQ ID NO: 231258 - RNA, 64 nt, hsa; identical to SEQ ID NO: 41131

SEQ ID NO: 231259 - RNA, 64 nt, hsa; identical to SEQ ID NO: 41132

SEQ ID NO: 231260 - RNA, 64 nt, hsa; identical to SEQ ID NO: 41133

SEQ ID NO: 231261 - RNA, 64 nt, hsa; identical to SEQ ID NO: 41134

SEQ ID NO: 231262 - RNA, 64 nt, hsa; identical to SEQ ID NO: 41135

SEQ ID NO: 231263 - RNA, 64 nt, hsa; identical to SEQ ID NO: 41136

SEQ ID NO: 231264 - RNA, 64 nt, hsa; identical to SEQ ID NO: 41137

SEQ ID NO: 231265 - RNA, 64 nt, hsa; identical to SEQ ID NO: 41138

SEQ ID NO: 231266 - RNA, 64 nt, hsa; identical to SEQ ID NO: 41139

SEQ ID NO: 231267 - RNA, 64 nt, hsa; identical to SEQ ID NO: 41140

SEQ ID NO: 231268 - RNA, 64 nt, hsa; identical to SEQ ID NO: 41141

SEQ ID NO: 231269 - RNA, 64 nt, hsa; identical to SEQ ID NO: 41142

SEQ ID NO: 231270 - RNA, 64 nt, hsa; identical to SEQ ID NO: 41143

SEQ ID NO: 231271 - RNA, 64 nt, hsa; identical to SEQ ID NO: 41144

SEQ ID NO: 231272 - RNA, 64 nt, hsa; identical to SEQ ID NO: 41145

SEQ ID NO: 231273 - RNA, 64 nt, hsa; identical to SEQ ID NO: 41146

SEQ ID NO: 231274 - RNA, 64 nt, hsa; identical to SEQ ID NO: 41147

SEQ ID NO: 231275 - RNA, 64 nt, hsa; identical to SEQ ID NO: 41148

SEQ ID NO: 231276 - RNA, 64 nt, hsa; identical to SEQ ID NO: 41149

SEQ ID NO: 231277 - RNA, 64 nt, hsa; identical to SEQ ID NO: 41150

SEQ ID NO: 231278 - RNA, 64 nt, hsa; identical to SEQ ID NO: 41151

SEQ ID NO: 231279 - RNA, 64 nt, hsa; identical to SEQ ID NO: 41152

SEQ ID NO: 231280 - RNA, 64 nt, hsa; identical to SEQ ID NO: 41153

SEQ ID NO: 231281 - RNA, 64 nt, hsa; identical to SEQ ID NO: 41154

SEQ ID NO: 231282 - RNA, 64 nt, hsa; identical to SEQ ID NO: 41155

SEQ ID NO: 231283 - RNA, 64 nt, hsa; identical to SEQ ID NO: 41156

SEQ ID NO: 231284 - RNA, 64 nt, hsa; identical to SEQ ID NO: 41157

SEQ ID NO: 231285 - RNA, 64 nt, hsa; identical to SEQ ID NO: 41158

SEQ ID NO: 231286 - RNA, 64 nt, hsa; identical to SEQ ID NO: 41159

SEQ ID NO: 231287 - RNA, 64 nt, hsa; identical to SEQ ID NO: 41160

SEQ ID NO: 231288 - RNA, 64 nt, hsa; identical to SEQ ID NO: 41161

SEQ ID NO: 231289 - RNA, 64 nt, hsa; identical to SEQ ID NO: 41162

SEQ ID NO: 231290 - RNA, 64 nt, hsa; identical to SEQ ID NO: 41163

SEQ ID NO: 231291 - RNA, 64 nt, hsa; identical to SEQ ID NO: 41164

SEQ ID NO: 231292 - RNA, 64 nt, hsa; identical to SEQ ID NO: 41165

SEQ ID NO: 231293 - RNA, 64 nt, hsa; identical to SEQ ID NO: 41166

SEQ ID NO: 231294 - RNA, 64 nt, hsa; identical to SEQ ID NO: 41167

SEQ ID NO: 231295 - RNA, 64 nt, hsa; identical to SEQ ID NO: 41168

SEQ ID NO: 231296 - RNA, 64 nt, hsa; identical to SEQ ID NO: 41169

SEQ ID NO: 231297 - RNA, 64 nt, hsa; identical to SEQ ID NO: 41170

SEQ ID NO: 231298 - RNA, 64 nt, hsa; identical to SEQ ID NO: 41171

SEQ ID NO: 231299 - RNA, 64 nt, hsa; identical to SEQ ID NO: 41172

SEQ ID NO: 231300 - RNA, 64 nt, hsa; identical to SEQ ID NO: 41173

SEQ ID NO: 231301 - RNA, 64 nt, hsa; identical to SEQ ID NO: 41174

SEQ ID NO: 231302 - RNA, 64 nt, hsa; identical to SEQ ID NO: 41175

SEQ ID NO: 231303 - RNA, 64 nt, hsa; identical to SEQ ID NO: 41176

SEQ ID NO: 231304 - RNA, 64 nt, hsa; identical to SEQ ID NO: 41177

SEQ ID NO: 231305 - RNA, 64 nt, hsa; identical to SEQ ID NO: 41178

SEQ ID NO: 231306 - RNA, 64 nt, hsa; identical to SEQ ID NO: 41179

SEQ ID NO: 231307 - RNA, 64 nt, hsa; identical to SEQ ID NO: 41180

SEQ ID NO: 231308 - RNA, 64 nt, hsa; identical to SEQ ID NO: 41181

SEQ ID NO: 231309 - RNA, 64 nt, hsa; identical to SEQ ID NO: 41182

SEQ ID NO: 231310 - RNA, 64 nt, hsa; identical to SEQ ID NO: 41183

SEQ ID NO: 231311 - RNA, 64 nt, hsa; identical to SEQ ID NO: 41184

SEQ ID NO: 231312 - RNA, 64 nt, hsa; identical to SEQ ID NO: 41185

SEQ ID NO: 231313 - RNA, 64 nt, hsa; identical to SEQ ID NO: 41186

SEQ ID NO: 231314 - RNA, 64 nt, hsa; identical to SEQ ID NO: 41187

SEQ ID NO: 231315 - RNA, 64 nt, hsa; identical to SEQ ID NO: 41188

SEQ ID NO: 231316 - RNA, 64 nt, hsa; identical to SEQ ID NO: 41189

SEQ ID NO: 231317 - RNA, 64 nt, hsa; identical to SEQ ID NO: 41190

SEQ ID NO: 231318 - RNA, 64 nt, hsa; identical to SEQ ID NO: 41191

SEQ ID NO: 231319 - RNA, 64 nt, hsa; identical to SEQ ID NO: 41192

SEQ ID NO: 231320 - RNA, 64 nt, hsa; identical to SEQ ID NO: 41193

SEQ ID NO: 231321 - RNA, 64 nt, hsa; identical to SEQ ID NO: 41194

SEQ ID NO: 231322 - RNA, 64 nt, hsa; identical to SEQ ID NO: 41195

SEQ ID NO: 231323 - RNA, 64 nt, hsa; identical to SEQ ID NO: 41196

SEQ ID NO: 231324 - RNA, 64 nt, hsa; identical to SEQ ID NO: 41197

SEQ ID NO: 231325 - RNA, 64 nt, hsa; identical to SEQ ID NO: 41198

SEQ ID NO: 231326 - RNA, 64 nt, hsa; identical to SEQ ID NO: 41199

SEQ ID NO: 231327 - RNA, 64 nt, hsa; identical to SEQ ID NO: 41200

SEQ ID NO: 231328 - RNA, 64 nt, hsa; identical to SEQ ID NO: 41201

SEQ ID NO: 231329 - RNA, 64 nt, hsa; identical to SEQ ID NO: 41202

SEQ ID NO: 231330 - RNA, 64 nt, hsa; identical to SEQ ID NO: 41203

SEQ ID NO: 231331 - RNA, 64 nt, hsa; identical to SEQ ID NO: 41204

SEQ ID NO: 231332 - RNA, 64 nt, hsa; identical to SEQ ID NO: 41205

SEQ ID NO: 231333 - RNA, 64 nt, hsa; identical to SEQ ID NO: 41206

SEQ ID NO: 231334 - RNA, 64 nt, hsa; identical to SEQ ID NO: 41207

SEQ ID NO: 231335 - RNA, 64 nt, hsa; identical to SEQ ID NO: 41208

SEQ ID NO: 231336 - RNA, 64 nt, hsa; identical to SEQ ID NO: 41209

SEQ ID NO: 231337 - RNA, 64 nt, hsa; identical to SEQ ID NO: 41210

SEQ ID NO: 231338 - RNA, 64 nt, hsa; identical to SEQ ID NO: 41211

SEQ ID NO: 231339 - RNA, 64 nt, hsa; identical to SEQ ID NO: 41212

SEQ ID NO: 231340 - RNA, 64 nt, hsa; identical to SEQ ID NO: 41213

SEQ ID NO: 231341 - RNA, 64 nt, hsa; identical to SEQ ID NO: 41214

SEQ ID NO: 231342 - RNA, 64 nt, hsa; identical to SEQ ID NO: 41215

SEQ ID NO: 231343 - RNA, 64 nt, hsa; identical to SEQ ID NO: 41216

SEQ ID NO: 231344 - RNA, 64 nt, hsa; identical to SEQ ID NO: 41217

SEQ ID NO: 231345 - RNA, 64 nt, hsa; identical to SEQ ID NO: 41218

SEQ ID NO: 231346 - RNA, 64 nt, hsa; identical to SEQ ID NO: 41219

SEQ ID NO: 231347 - RNA, 64 nt, hsa; identical to SEQ ID NO: 41220

SEQ ID NO: 231348 - RNA, 64 nt, hsa; identical to SEQ ID NO: 41221

SEQ ID NO: 231349 - RNA, 64 nt, hsa; identical to SEQ ID NO: 41222

SEQ ID NO: 231350 - RNA, 64 nt, hsa; identical to SEQ ID NO: 41223

SEQ ID NO: 231351 - RNA, 64 nt, hsa; identical to SEQ ID NO: 41224

SEQ ID NO: 231352 - RNA, 64 nt, hsa; identical to SEQ ID NO: 41225

SEQ ID NO: 231353 - RNA, 64 nt, hsa; identical to SEQ ID NO: 41226

SEQ ID NO: 231354 - RNA, 64 nt, hsa; identical to SEQ ID NO: 41227

SEQ ID NO: 231355 - RNA, 64 nt, hsa; identical to SEQ ID NO: 41228

SEQ ID NO: 231356 - RNA, 64 nt, hsa; identical to SEQ ID NO: 41229

SEQ ID NO: 231357 - RNA, 64 nt, hsa; identical to SEQ ID NO: 41230

SEQ ID NO: 231358 - RNA, 64 nt, hsa; identical to SEQ ID NO: 41231

SEQ ID NO: 231359 - RNA, 64 nt, hsa; identical to SEQ ID NO: 41232

SEQ ID NO: 231360 - RNA, 64 nt, hsa; identical to SEQ ID NO: 41233

SEQ ID NO: 231361 - RNA, 64 nt, hsa; identical to SEQ ID NO: 41234

SEQ ID NO: 231362 - RNA, 64 nt, hsa; identical to SEQ ID NO: 41235

SEQ ID NO: 231363 - RNA, 62 nt, hsa; identical to SEQ ID NO: 41236

SEQ ID NO: 231364 - RNA, 60 nt, hsa; identical to SEQ ID NO: 41237

SEQ ID NO: 231365 - RNA, 58 nt, hsa; identical to SEQ ID NO: 41238

SEQ ID NO: 231366 - RNA, 56 nt, hsa; identical to SEQ ID NO: 41239

SEQ ID NO: 231367 - RNA, 54 nt, hsa; identical to SEQ ID NO: 41240

SEQ ID NO: 231368 - RNA, 64 nt, hsa; identical to SEQ ID NO: 41241

SEQ ID NO: 231369 - RNA, 64 nt, hsa; identical to SEQ ID NO: 41242

SEQ ID NO: 231370 - RNA, 64 nt, hsa; identical to SEQ ID NO: 41243

SEQ ID NO: 231371 - RNA, 64 nt, hsa; identical to SEQ ID NO: 41244

SEQ ID NO: 231372 - RNA, 64 nt, hsa; identical to SEQ ID NO: 41245

SEQ ID NO: 231373 - RNA, 64 nt, hsa; identical to SEQ ID NO: 41246

SEQ ID NO: 231374 - RNA, 64 nt, hsa; identical to SEQ ID NO: 41247

SEQ ID NO: 231375 - RNA, 64 nt, hsa; identical to SEQ ID NO: 41248

SEQ ID NO: 231376 - RNA, 64 nt, hsa; identical to SEQ ID NO: 41249

SEQ ID NO: 231377 - RNA, 64 nt, hsa; identical to SEQ ID NO: 41250

SEQ ID NO: 231378 - RNA, 64 nt, hsa; identical to SEQ ID NO: 41251

SEQ ID NO: 231379 - RNA, 64 nt, hsa; identical to SEQ ID NO: 41252

SEQ ID NO: 231380 - RNA, 64 nt, hsa; identical to SEQ ID NO: 41253

SEQ ID NO: 231381 - RNA, 64 nt, hsa; identical to SEQ ID NO: 41254

SEQ ID NO: 231382 - RNA, 64 nt, hsa; identical to SEQ ID NO: 41255

SEQ ID NO: 231383 - RNA, 64 nt, hsa; identical to SEQ ID NO: 41256

SEQ ID NO: 231384 - RNA, 64 nt, hsa; identical to SEQ ID NO: 41257

SEQ ID NO: 231385 - RNA, 64 nt, hsa; identical to SEQ ID NO: 41258

SEQ ID NO: 231386 - RNA, 64 nt, hsa; identical to SEQ ID NO: 41259

SEQ ID NO: 231387 - RNA, 64 nt, hsa; identical to SEQ ID NO: 41260

SEQ ID NO: 231388 - RNA, 64 nt, hsa; identical to SEQ ID NO: 41261

SEQ ID NO: 231389 - RNA, 64 nt, hsa; identical to SEQ ID NO: 41262

SEQ ID NO: 231390 - RNA, 64 nt, hsa; identical to SEQ ID NO: 41263

SEQ ID NO: 231391 - RNA, 64 nt, hsa; identical to SEQ ID NO: 41264

SEQ ID NO: 231392 - RNA, 64 nt, hsa; identical to SEQ ID NO: 41265

SEQ ID NO: 231393 - RNA, 64 nt, hsa; identical to SEQ ID NO: 41266

SEQ ID NO: 231394 - RNA, 64 nt, hsa; identical to SEQ ID NO: 41267

SEQ ID NO: 231395 - RNA, 64 nt, hsa; identical to SEQ ID NO: 41268

SEQ ID NO: 231396 - RNA, 64 nt, hsa; identical to SEQ ID NO: 41269

SEQ ID NO: 231397 - RNA, 64 nt, hsa; identical to SEQ ID NO: 41270

SEQ ID NO: 231398 - RNA, 64 nt, hsa; identical to SEQ ID NO: 41271

SEQ ID NO: 231399 - RNA, 64 nt, hsa; identical to SEQ ID NO: 41272

SEQ ID NO: 231400 - RNA, 64 nt, hsa; identical to SEQ ID NO: 41273

SEQ ID NO: 231401 - RNA, 64 nt, hsa; identical to SEQ ID NO: 41274

SEQ ID NO: 231402 - RNA, 64 nt, hsa; identical to SEQ ID NO: 41275

SEQ ID NO: 231403 - RNA, 64 nt, hsa; identical to SEQ ID NO: 41276

SEQ ID NO: 231404 - RNA, 64 nt, hsa; identical to SEQ ID NO: 41277

SEQ ID NO: 231405 - RNA, 64 nt, hsa; identical to SEQ ID NO: 41278

SEQ ID NO: 231406 - RNA, 64 nt, hsa; identical to SEQ ID NO: 41279

SEQ ID NO: 231407 - RNA, 64 nt, hsa; identical to SEQ ID NO: 41280

SEQ ID NO: 231408 - RNA, 64 nt, hsa; identical to SEQ ID NO: 41281

SEQ ID NO: 231409 - RNA, 64 nt, hsa; identical to SEQ ID NO: 41282

SEQ ID NO: 231410 - RNA, 64 nt, hsa; identical to SEQ ID NO: 41283

SEQ ID NO: 231411 - RNA, 64 nt, hsa; identical to SEQ ID NO: 41284

SEQ ID NO: 231412 - RNA, 64 nt, hsa; identical to SEQ ID NO: 41285

SEQ ID NO: 231413 - RNA, 64 nt, hsa; identical to SEQ ID NO: 41286

SEQ ID NO: 231414 - RNA, 64 nt, hsa; identical to SEQ ID NO: 41287

SEQ ID NO: 231415 - RNA, 64 nt, hsa; identical to SEQ ID NO: 41288

SEQ ID NO: 231416 - RNA, 64 nt, hsa; identical to SEQ ID NO: 41289

SEQ ID NO: 231417 - RNA, 64 nt, hsa; identical to SEQ ID NO: 41290

SEQ ID NO: 231418 - RNA, 64 nt, hsa; identical to SEQ ID NO: 41291

SEQ ID NO: 231419 - RNA, 64 nt, hsa; identical to SEQ ID NO: 41292

SEQ ID NO: 231420 - RNA, 64 nt, hsa; identical to SEQ ID NO: 41293

SEQ ID NO: 231421 - RNA, 64 nt, hsa; identical to SEQ ID NO: 41294

SEQ ID NO: 231422 - RNA, 64 nt, hsa; identical to SEQ ID NO: 41295

SEQ ID NO: 231423 - RNA, 64 nt, hsa; identical to SEQ ID NO: 41296

SEQ ID NO: 231424 - RNA, 64 nt, hsa; identical to SEQ ID NO: 41297

SEQ ID NO: 231425 - RNA, 64 nt, hsa; identical to SEQ ID NO: 41298

SEQ ID NO: 231426 - RNA, 64 nt, hsa; identical to SEQ ID NO: 41299

SEQ ID NO: 231427 - RNA, 64 nt, hsa; identical to SEQ ID NO: 41300

SEQ ID NO: 231428 - RNA, 64 nt, hsa; identical to SEQ ID NO: 41301

SEQ ID NO: 231429 - RNA, 64 nt, hsa; identical to SEQ ID NO: 41302

SEQ ID NO: 231430 - RNA, 64 nt, hsa; identical to SEQ ID NO: 41303

SEQ ID NO: 231431 - RNA, 64 nt, hsa; identical to SEQ ID NO: 41304

SEQ ID NO: 231432 - RNA, 64 nt, hsa; identical to SEQ ID NO: 41305

SEQ ID NO: 231433 - RNA, 64 nt, hsa; identical to SEQ ID NO: 41306

SEQ ID NO: 231434 - RNA, 64 nt, hsa; identical to SEQ ID NO: 41307

SEQ ID NO: 231435 - RNA, 64 nt, hsa; identical to SEQ ID NO: 41308

SEQ ID NO: 231436 - RNA, 64 nt, hsa; identical to SEQ ID NO: 41309

SEQ ID NO: 231437 - RNA, 64 nt, hsa; identical to SEQ ID NO: 41310

SEQ ID NO: 231438 - RNA, 64 nt, hsa; identical to SEQ ID NO: 41311

SEQ ID NO: 231439 - RNA, 64 nt, hsa; identical to SEQ ID NO: 41312

SEQ ID NO: 231440 - RNA, 64 nt, hsa; identical to SEQ ID NO: 41313

SEQ ID NO: 231441 - RNA, 64 nt, hsa; identical to SEQ ID NO: 41314

SEQ ID NO: 231442 - RNA, 64 nt, hsa; identical to SEQ ID NO: 41315

SEQ ID NO: 231443 - RNA, 64 nt, hsa; identical to SEQ ID NO: 41316

SEQ ID NO: 231444 - RNA, 64 nt, hsa; identical to SEQ ID NO: 41317

SEQ ID NO: 231445 - RNA, 64 nt, hsa; identical to SEQ ID NO: 41318

SEQ ID NO: 231446 - RNA, 64 nt, hsa; identical to SEQ ID NO: 41319

SEQ ID NO: 231447 - RNA, 64 nt, hsa; identical to SEQ ID NO: 41320

SEQ ID NO: 231448 - RNA, 64 nt, hsa; identical to SEQ ID NO: 41321

SEQ ID NO: 231449 - RNA, 64 nt, hsa; identical to SEQ ID NO: 41322

SEQ ID NO: 231450 - RNA, 64 nt, hsa; identical to SEQ ID NO: 41323

SEQ ID NO: 231451 - RNA, 64 nt, hsa; identical to SEQ ID NO: 41324

SEQ ID NO: 231452 - RNA, 64 nt, hsa; identical to SEQ ID NO: 41325

SEQ ID NO: 231453 - RNA, 64 nt, hsa; identical to SEQ ID NO: 41326

SEQ ID NO: 231454 - RNA, 64 nt, hsa; identical to SEQ ID NO: 41327

SEQ ID NO: 231455 - RNA, 64 nt, hsa; identical to SEQ ID NO: 41328

SEQ ID NO: 231456 - RNA, 64 nt, hsa; identical to SEQ ID NO: 41329

SEQ ID NO: 231457 - RNA, 64 nt, hsa; identical to SEQ ID NO: 41330

SEQ ID NO: 231458 - RNA, 64 nt, hsa; identical to SEQ ID NO: 41331

SEQ ID NO: 231459 - RNA, 64 nt, hsa; identical to SEQ ID NO: 41332

SEQ ID NO: 231460 - RNA, 64 nt, hsa; identical to SEQ ID NO: 41333

SEQ ID NO: 231461 - RNA, 64 nt, hsa; identical to SEQ ID NO: 41334

SEQ ID NO: 231462 - RNA, 64 nt, hsa; identical to SEQ ID NO: 41335

SEQ ID NO: 231463 - RNA, 64 nt, hsa; identical to SEQ ID NO: 41336

SEQ ID NO: 231464 - RNA, 64 nt, hsa; identical to SEQ ID NO: 41337

SEQ ID NO: 231465 - RNA, 64 nt, hsa; identical to SEQ ID NO: 41338

SEQ ID NO: 231466 - RNA, 64 nt, hsa; identical to SEQ ID NO: 41339

SEQ ID NO: 231467 - RNA, 64 nt, hsa; identical to SEQ ID NO: 41340

SEQ ID NO: 231468 - RNA, 64 nt, hsa; identical to SEQ ID NO: 41341

SEQ ID NO: 231469 - RNA, 64 nt, hsa; identical to SEQ ID NO: 41342

SEQ ID NO: 231470 - RNA, 64 nt, hsa; identical to SEQ ID NO: 41343

SEQ ID NO: 231471 - RNA, 64 nt, hsa; identical to SEQ ID NO: 41344

SEQ ID NO: 231472 - RNA, 64 nt, hsa; identical to SEQ ID NO: 41345

SEQ ID NO: 231473 - RNA, 64 nt, hsa; identical to SEQ ID NO: 41346

SEQ ID NO: 231474 - RNA, 64 nt, hsa; identical to SEQ ID NO: 41347

SEQ ID NO: 231475 - RNA, 64 nt, hsa; identical to SEQ ID NO: 41348

SEQ ID NO: 231476 - RNA, 64 nt, hsa; identical to SEQ ID NO: 41349

SEQ ID NO: 231477 - RNA, 64 nt, hsa; identical to SEQ ID NO: 41350

SEQ ID NO: 231478 - RNA, 64 nt, hsa; identical to SEQ ID NO: 41351

SEQ ID NO: 231479 - RNA, 64 nt, hsa; identical to SEQ ID NO: 41352

SEQ ID NO: 231480 - RNA, 64 nt, hsa; identical to SEQ ID NO: 41353

SEQ ID NO: 231481 - RNA, 64 nt, hsa; identical to SEQ ID NO: 41354

SEQ ID NO: 231482 - RNA, 64 nt, hsa; identical to SEQ ID NO: 41355

SEQ ID NO: 231483 - RNA, 64 nt, hsa; identical to SEQ ID NO: 41356

SEQ ID NO: 231484 - RNA, 64 nt, hsa; identical to SEQ ID NO: 41357

SEQ ID NO: 231485 - RNA, 64 nt, hsa; identical to SEQ ID NO: 41358

SEQ ID NO: 231486 - RNA, 64 nt, hsa; identical to SEQ ID NO: 41359

SEQ ID NO: 231487 - RNA, 64 nt, hsa; identical to SEQ ID NO: 41360

SEQ ID NO: 231488 - RNA, 64 nt, hsa; identical to SEQ ID NO: 41361

SEQ ID NO: 231489 - RNA, 64 nt, hsa; identical to SEQ ID NO: 41362

SEQ ID NO: 231490 - RNA, 64 nt, hsa; identical to SEQ ID NO: 41363

SEQ ID NO: 231491 - RNA, 64 nt, hsa; identical to SEQ ID NO: 41364

SEQ ID NO: 231492 - RNA, 64 nt, hsa; identical to SEQ ID NO: 41365

SEQ ID NO: 231493 - RNA, 64 nt, hsa; identical to SEQ ID NO: 41366

SEQ ID NO: 231494 - RNA, 64 nt, hsa; identical to SEQ ID NO: 41367

SEQ ID NO: 231495 - RNA, 64 nt, hsa; identical to SEQ ID NO: 41368

SEQ ID NO: 231496 - RNA, 64 nt, hsa; identical to SEQ ID NO: 41369

SEQ ID NO: 231497 - RNA, 64 nt, hsa; identical to SEQ ID NO: 41370

SEQ ID NO: 231498 - RNA, 64 nt, hsa; identical to SEQ ID NO: 41371

SEQ ID NO: 231499 - RNA, 64 nt, hsa; identical to SEQ ID NO: 41372

SEQ ID NO: 231500 - RNA, 64 nt, hsa; identical to SEQ ID NO: 41373

SEQ ID NO: 231501 - RNA, 64 nt, hsa; identical to SEQ ID NO: 41374

SEQ ID NO: 231502 - RNA, 64 nt, hsa; identical to SEQ ID NO: 41375

SEQ ID NO: 231503 - RNA, 64 nt, hsa; identical to SEQ ID NO: 41376

SEQ ID NO: 231504 - RNA, 64 nt, hsa; identical to SEQ ID NO: 41377

SEQ ID NO: 231505 - RNA, 64 nt, hsa; identical to SEQ ID NO: 41378

SEQ ID NO: 231506 - RNA, 64 nt, hsa; identical to SEQ ID NO: 41379

SEQ ID NO: 231507 - RNA, 64 nt, hsa; identical to SEQ ID NO: 41380

SEQ ID NO: 231508 - RNA, 64 nt, hsa; identical to SEQ ID NO: 41381

SEQ ID NO: 231509 - RNA, 64 nt, hsa; identical to SEQ ID NO: 41382

SEQ ID NO: 231510 - RNA, 64 nt, hsa; identical to SEQ ID NO: 41383

SEQ ID NO: 231511 - RNA, 64 nt, hsa; identical to SEQ ID NO: 41384

SEQ ID NO: 231512 - RNA, 64 nt, hsa; identical to SEQ ID NO: 41385

SEQ ID NO: 231513 - RNA, 64 nt, hsa; identical to SEQ ID NO: 41386

SEQ ID NO: 231514 - RNA, 64 nt, hsa; identical to SEQ ID NO: 41387

SEQ ID NO: 231515 - RNA, 64 nt, hsa; identical to SEQ ID NO: 41388

SEQ ID NO: 231516 - RNA, 64 nt, hsa; identical to SEQ ID NO: 41389

SEQ ID NO: 231517 - RNA, 64 nt, hsa; identical to SEQ ID NO: 41390

SEQ ID NO: 231518 - RNA, 64 nt, hsa; identical to SEQ ID NO: 41391

SEQ ID NO: 231519 - RNA, 64 nt, hsa; identical to SEQ ID NO: 41392

SEQ ID NO: 231520 - RNA, 64 nt, hsa; identical to SEQ ID NO: 41393

SEQ ID NO: 231521 - RNA, 64 nt, hsa; identical to SEQ ID NO: 41394

SEQ ID NO: 231522 - RNA, 64 nt, hsa; identical to SEQ ID NO: 41395

SEQ ID NO: 231523 - RNA, 64 nt, hsa; identical to SEQ ID NO: 41396

SEQ ID NO: 231524 - RNA, 64 nt, hsa; identical to SEQ ID NO: 41397

SEQ ID NO: 231525 - RNA, 64 nt, hsa; identical to SEQ ID NO: 41398

SEQ ID NO: 231526 - RNA, 64 nt, hsa; identical to SEQ ID NO: 41399

SEQ ID NO: 231527 - RNA, 64 nt, hsa; identical to SEQ ID NO: 41400

SEQ ID NO: 231528 - RNA, 64 nt, hsa; identical to SEQ ID NO: 41401

SEQ ID NO: 231529 - RNA, 64 nt, hsa; identical to SEQ ID NO: 41402

SEQ ID NO: 231530 - RNA, 64 nt, hsa; identical to SEQ ID NO: 41403

SEQ ID NO: 231531 - RNA, 64 nt, hsa; identical to SEQ ID NO: 41404

SEQ ID NO: 231532 - RNA, 64 nt, hsa; identical to SEQ ID NO: 41405

SEQ ID NO: 231533 - RNA, 64 nt, hsa; identical to SEQ ID NO: 41406

SEQ ID NO: 231534 - RNA, 64 nt, hsa; identical to SEQ ID NO: 41407

SEQ ID NO: 231535 - RNA, 64 nt, hsa; identical to SEQ ID NO: 41408

SEQ ID NO: 231536 - RNA, 64 nt, hsa; identical to SEQ ID NO: 41409

SEQ ID NO: 231537 - RNA, 64 nt, hsa; identical to SEQ ID NO: 41410

SEQ ID NO: 231538 - RNA, 64 nt, hsa; identical to SEQ ID NO: 41411

SEQ ID NO: 231539 - RNA, 64 nt, hsa; identical to SEQ ID NO: 41412

SEQ ID NO: 231540 - RNA, 64 nt, hsa; identical to SEQ ID NO: 41413

SEQ ID NO: 231541 - RNA, 64 nt, hsa; identical to SEQ ID NO: 41414

SEQ ID NO: 231542 - RNA, 64 nt, hsa; identical to SEQ ID NO: 41415

SEQ ID NO: 231543 - RNA, 64 nt, hsa; identical to SEQ ID NO: 41416

SEQ ID NO: 231544 - RNA, 64 nt, hsa; identical to SEQ ID NO: 41417

SEQ ID NO: 231545 - RNA, 64 nt, hsa; identical to SEQ ID NO: 41418

SEQ ID NO: 231546 - RNA, 64 nt, hsa; identical to SEQ ID NO: 41419

SEQ ID NO: 231547 - RNA, 64 nt, hsa; identical to SEQ ID NO: 41420

SEQ ID NO: 231548 - RNA, 64 nt, hsa; identical to SEQ ID NO: 41421

SEQ ID NO: 231549 - RNA, 64 nt, hsa; identical to SEQ ID NO: 41422

SEQ ID NO: 231550 - RNA, 64 nt, hsa; identical to SEQ ID NO: 41423

SEQ ID NO: 231551 - RNA, 64 nt, hsa; identical to SEQ ID NO: 41424

SEQ ID NO: 231552 - RNA, 64 nt, hsa; identical to SEQ ID NO: 41425

SEQ ID NO: 231553 - RNA, 64 nt, hsa; identical to SEQ ID NO: 41426

SEQ ID NO: 231554 - RNA, 64 nt, hsa; identical to SEQ ID NO: 41427

SEQ ID NO: 231555 - RNA, 64 nt, hsa; identical to SEQ ID NO: 41428

SEQ ID NO: 231556 - RNA, 64 nt, hsa; identical to SEQ ID NO: 41429

SEQ ID NO: 231557 - RNA, 64 nt, hsa; identical to SEQ ID NO: 41430

SEQ ID NO: 231558 - RNA, 64 nt, hsa; identical to SEQ ID NO: 41431

SEQ ID NO: 231559 - RNA, 64 nt, hsa; identical to SEQ ID NO: 41432

SEQ ID NO: 231560 - RNA, 64 nt, hsa; identical to SEQ ID NO: 41433

SEQ ID NO: 231561 - RNA, 64 nt, hsa; identical to SEQ ID NO: 41434

SEQ ID NO: 231562 - RNA, 64 nt, hsa; identical to SEQ ID NO: 41435

SEQ ID NO: 231563 - RNA, 64 nt, hsa; identical to SEQ ID NO: 41436

SEQ ID NO: 231564 - RNA, 64 nt, hsa; identical to SEQ ID NO: 41437

SEQ ID NO: 231565 - RNA, 64 nt, hsa; identical to SEQ ID NO: 41438

SEQ ID NO: 231566 - RNA, 64 nt, hsa; identical to SEQ ID NO: 41439

SEQ ID NO: 231567 - RNA, 64 nt, hsa; identical to SEQ ID NO: 41440

SEQ ID NO: 231568 - RNA, 64 nt, hsa; identical to SEQ ID NO: 41441

SEQ ID NO: 231569 - RNA, 64 nt, hsa; identical to SEQ ID NO: 41442

SEQ ID NO: 231570 - RNA, 64 nt, hsa; identical to SEQ ID NO: 41443

SEQ ID NO: 231571 - RNA, 64 nt, hsa; identical to SEQ ID NO: 41444

SEQ ID NO: 231572 - RNA, 64 nt, hsa; identical to SEQ ID NO: 41445

SEQ ID NO: 231573 - RNA, 64 nt, hsa; identical to SEQ ID NO: 41446

SEQ ID NO: 231574 - RNA, 64 nt, hsa; identical to SEQ ID NO: 41447

SEQ ID NO: 231575 - RNA, 64 nt, hsa; identical to SEQ ID NO: 41448

SEQ ID NO: 231576 - RNA, 64 nt, hsa; identical to SEQ ID NO: 41449

SEQ ID NO: 231577 - RNA, 64 nt, hsa; identical to SEQ ID NO: 41450

SEQ ID NO: 231578 - RNA, 64 nt, hsa; identical to SEQ ID NO: 41451

SEQ ID NO: 231579 - RNA, 64 nt, hsa; identical to SEQ ID NO: 41452

SEQ ID NO: 231580 - RNA, 64 nt, hsa; identical to SEQ ID NO: 41453

SEQ ID NO: 231581 - RNA, 64 nt, hsa; identical to SEQ ID NO: 41454

SEQ ID NO: 231582 - RNA, 64 nt, hsa; identical to SEQ ID NO: 41455

SEQ ID NO: 231583 - RNA, 64 nt, hsa; identical to SEQ ID NO: 41456

SEQ ID NO: 231584 - RNA, 64 nt, hsa; identical to SEQ ID NO: 41457

SEQ ID NO: 231585 - RNA, 64 nt, hsa; identical to SEQ ID NO: 41458

SEQ ID NO: 231586 - RNA, 64 nt, hsa; identical to SEQ ID NO: 41459

SEQ ID NO: 231587 - RNA, 64 nt, hsa; identical to SEQ ID NO: 41460

SEQ ID NO: 231588 - RNA, 64 nt, hsa; identical to SEQ ID NO: 41461

SEQ ID NO: 231589 - RNA, 64 nt, hsa; identical to SEQ ID NO: 41462

SEQ ID NO: 231590 - RNA, 64 nt, hsa; identical to SEQ ID NO: 41463

SEQ ID NO: 231591 - RNA, 64 nt, hsa; identical to SEQ ID NO: 41464

SEQ ID NO: 231592 - RNA, 64 nt, hsa; identical to SEQ ID NO: 41465

SEQ ID NO: 231593 - RNA, 64 nt, hsa; identical to SEQ ID NO: 41466

SEQ ID NO: 231594 - RNA, 64 nt, hsa; identical to SEQ ID NO: 41467

SEQ ID NO: 231595 - RNA, 64 nt, hsa; identical to SEQ ID NO: 41468

SEQ ID NO: 231596 - RNA, 64 nt, hsa; identical to SEQ ID NO: 41469

SEQ ID NO: 231597 - RNA, 64 nt, hsa; identical to SEQ ID NO: 41470

SEQ ID NO: 231598 - RNA, 64 nt, hsa; identical to SEQ ID NO: 41471

SEQ ID NO: 231599 - RNA, 64 nt, hsa; identical to SEQ ID NO: 41472

SEQ ID NO: 231600 - RNA, 64 nt, hsa; identical to SEQ ID NO: 41473

SEQ ID NO: 231601 - RNA, 64 nt, hsa; identical to SEQ ID NO: 41474

SEQ ID NO: 231602 - RNA, 64 nt, hsa; identical to SEQ ID NO: 41475

SEQ ID NO: 231603 - RNA, 64 nt, hsa; identical to SEQ ID NO: 41476

SEQ ID NO: 231604 - RNA, 64 nt, hsa; identical to SEQ ID NO: 41477

SEQ ID NO: 231605 - RNA, 64 nt, hsa; identical to SEQ ID NO: 41478

SEQ ID NO: 231606 - RNA, 64 nt, hsa; identical to SEQ ID NO: 41479

SEQ ID NO: 231607 - RNA, 64 nt, hsa; identical to SEQ ID NO: 41480

SEQ ID NO: 231608 - RNA, 64 nt, hsa; identical to SEQ ID NO: 41481

SEQ ID NO: 231609 - RNA, 64 nt, hsa; identical to SEQ ID NO: 41482

SEQ ID NO: 231610 - RNA, 64 nt, hsa; identical to SEQ ID NO: 41483

SEQ ID NO: 231611 - RNA, 64 nt, hsa; identical to SEQ ID NO: 41484

SEQ ID NO: 231612 - RNA, 64 nt, hsa; identical to SEQ ID NO: 41485

SEQ ID NO: 231613 - RNA, 64 nt, hsa; identical to SEQ ID NO: 41486

SEQ ID NO: 231614 - RNA, 64 nt, hsa; identical to SEQ ID NO: 41487

SEQ ID NO: 231615 - RNA, 64 nt, hsa; identical to SEQ ID NO: 41488

SEQ ID NO: 231616 - RNA, 64 nt, hsa; identical to SEQ ID NO: 41489

SEQ ID NO: 231617 - RNA, 64 nt, hsa; identical to SEQ ID NO: 41490

SEQ ID NO: 231618 - RNA, 64 nt, hsa; identical to SEQ ID NO: 41491

SEQ ID NO: 231619 - RNA, 64 nt, hsa; identical to SEQ ID NO: 41492

SEQ ID NO: 231620 - RNA, 64 nt, hsa; identical to SEQ ID NO: 41493

SEQ ID NO: 231621 - RNA, 64 nt, hsa; identical to SEQ ID NO: 41494

SEQ ID NO: 231622 - RNA, 64 nt, hsa; identical to SEQ ID NO: 41495

SEQ ID NO: 231623 - RNA, 64 nt, hsa; identical to SEQ ID NO: 41496

SEQ ID NO: 231624 - RNA, 64 nt, hsa; identical to SEQ ID NO: 41497

SEQ ID NO: 231625 - RNA, 64 nt, hsa; identical to SEQ ID NO: 41498

SEQ ID NO: 231626 - RNA, 64 nt, hsa; identical to SEQ ID NO: 41499

SEQ ID NO: 231627 - RNA, 64 nt, hsa; identical to SEQ ID NO: 41500

SEQ ID NO: 231628 - RNA, 64 nt, hsa; identical to SEQ ID NO: 41501

SEQ ID NO: 231629 - RNA, 64 nt, hsa; identical to SEQ ID NO: 41502

SEQ ID NO: 231630 - RNA, 64 nt, hsa; identical to SEQ ID NO: 41503

SEQ ID NO: 231631 - RNA, 64 nt, hsa; identical to SEQ ID NO: 41504

SEQ ID NO: 231632 - RNA, 64 nt, hsa; identical to SEQ ID NO: 41505

SEQ ID NO: 231633 - RNA, 64 nt, hsa; identical to SEQ ID NO: 41506

SEQ ID NO: 231634 - RNA, 64 nt, hsa; identical to SEQ ID NO: 41507

SEQ ID NO: 231635 - RNA, 64 nt, hsa; identical to SEQ ID NO: 41508

SEQ ID NO: 231636 - RNA, 64 nt, hsa; identical to SEQ ID NO: 41509

SEQ ID NO: 231637 - RNA, 64 nt, hsa; identical to SEQ ID NO: 41510

SEQ ID NO: 231638 - RNA, 64 nt, hsa; identical to SEQ ID NO: 41511

SEQ ID NO: 231639 - RNA, 64 nt, hsa; identical to SEQ ID NO: 41512

SEQ ID NO: 231640 - RNA, 64 nt, hsa; identical to SEQ ID NO: 41513

SEQ ID NO: 231641 - RNA, 64 nt, hsa; identical to SEQ ID NO: 41514

SEQ ID NO: 231642 - RNA, 64 nt, hsa; identical to SEQ ID NO: 41515

SEQ ID NO: 231643 - RNA, 64 nt, hsa; identical to SEQ ID NO: 41516

SEQ ID NO: 231644 - RNA, 64 nt, hsa; identical to SEQ ID NO: 41517

SEQ ID NO: 231645 - RNA, 64 nt, hsa; identical to SEQ ID NO: 41518

SEQ ID NO: 231646 - RNA, 64 nt, hsa; identical to SEQ ID NO: 41519

SEQ ID NO: 231647 - RNA, 64 nt, hsa; identical to SEQ ID NO: 41520

SEQ ID NO: 231648 - RNA, 64 nt, hsa; identical to SEQ ID NO: 41521

SEQ ID NO: 231649 - RNA, 64 nt, hsa; identical to SEQ ID NO: 41522

SEQ ID NO: 231650 - RNA, 64 nt, hsa; identical to SEQ ID NO: 41523

SEQ ID NO: 231651 - RNA, 64 nt, hsa; identical to SEQ ID NO: 41524

SEQ ID NO: 231652 - RNA, 64 nt, hsa; identical to SEQ ID NO: 41525

SEQ ID NO: 231653 - RNA, 64 nt, hsa; identical to SEQ ID NO: 41526

SEQ ID NO: 231654 - RNA, 64 nt, hsa; identical to SEQ ID NO: 41527

SEQ ID NO: 231655 - RNA, 64 nt, hsa; identical to SEQ ID NO: 41528

SEQ ID NO: 231656 - RNA, 64 nt, hsa; identical to SEQ ID NO: 41529

SEQ ID NO: 231657 - RNA, 64 nt, hsa; identical to SEQ ID NO: 41530

SEQ ID NO: 231658 - RNA, 64 nt, hsa; identical to SEQ ID NO: 41531

SEQ ID NO: 231659 - RNA, 64 nt, hsa; identical to SEQ ID NO: 41532

SEQ ID NO: 231660 - RNA, 64 nt, hsa; identical to SEQ ID NO: 41533

SEQ ID NO: 231661 - RNA, 64 nt, hsa; identical to SEQ ID NO: 41534

SEQ ID NO: 231662 - RNA, 64 nt, hsa; identical to SEQ ID NO: 41535

SEQ ID NO: 231663 - RNA, 64 nt, hsa; identical to SEQ ID NO: 41536

SEQ ID NO: 231664 - RNA, 64 nt, hsa; identical to SEQ ID NO: 41537

SEQ ID NO: 231665 - RNA, 64 nt, hsa; identical to SEQ ID NO: 41538

SEQ ID NO: 231666 - RNA, 64 nt, hsa; identical to SEQ ID NO: 41539

SEQ ID NO: 231667 - RNA, 64 nt, hsa; identical to SEQ ID NO: 41540

SEQ ID NO: 231668 - RNA, 64 nt, hsa; identical to SEQ ID NO: 41541

SEQ ID NO: 231669 - RNA, 64 nt, hsa; identical to SEQ ID NO: 41542

SEQ ID NO: 231670 - RNA, 64 nt, hsa; identical to SEQ ID NO: 41543

SEQ ID NO: 231671 - RNA, 64 nt, hsa; identical to SEQ ID NO: 41544

SEQ ID NO: 231672 - RNA, 64 nt, hsa; identical to SEQ ID NO: 41545

SEQ ID NO: 231673 - RNA, 64 nt, hsa; identical to SEQ ID NO: 41546

SEQ ID NO: 231674 - RNA, 64 nt, hsa; identical to SEQ ID NO: 41547

SEQ ID NO: 231675 - RNA, 64 nt, hsa; identical to SEQ ID NO: 41548

SEQ ID NO: 231676 - RNA, 64 nt, hsa; identical to SEQ ID NO: 41549

SEQ ID NO: 231677 - RNA, 64 nt, hsa; identical to SEQ ID NO: 41550

SEQ ID NO: 231678 - RNA, 64 nt, hsa; identical to SEQ ID NO: 41551

SEQ ID NO: 231679 - RNA, 64 nt, hsa; identical to SEQ ID NO: 41552

SEQ ID NO: 231680 - RNA, 64 nt, hsa; identical to SEQ ID NO: 41553

SEQ ID NO: 231681 - RNA, 64 nt, hsa; identical to SEQ ID NO: 41554

SEQ ID NO: 231682 - RNA, 64 nt, hsa; identical to SEQ ID NO: 41555

SEQ ID NO: 231683 - RNA, 64 nt, hsa; identical to SEQ ID NO: 41556

SEQ ID NO: 231684 - RNA, 64 nt, hsa; identical to SEQ ID NO: 41557

SEQ ID NO: 231685 - RNA, 64 nt, hsa; identical to SEQ ID NO: 41558

SEQ ID NO: 231686 - RNA, 64 nt, hsa; identical to SEQ ID NO: 41559

SEQ ID NO: 231687 - RNA, 64 nt, hsa; identical to SEQ ID NO: 41560

SEQ ID NO: 231688 - RNA, 64 nt, hsa; identical to SEQ ID NO: 41561

SEQ ID NO: 231689 - RNA, 64 nt, hsa; identical to SEQ ID NO: 41562

SEQ ID NO: 231690 - RNA, 64 nt, hsa; identical to SEQ ID NO: 41563

SEQ ID NO: 231691 - RNA, 64 nt, hsa; identical to SEQ ID NO: 41564

SEQ ID NO: 231692 - RNA, 64 nt, hsa; identical to SEQ ID NO: 41565

SEQ ID NO: 231693 - RNA, 64 nt, hsa; identical to SEQ ID NO: 41566

SEQ ID NO: 231694 - RNA, 64 nt, hsa; identical to SEQ ID NO: 41567

SEQ ID NO: 231695 - RNA, 64 nt, hsa; identical to SEQ ID NO: 41568

SEQ ID NO: 231696 - RNA, 64 nt, hsa; identical to SEQ ID NO: 41569

SEQ ID NO: 231697 - RNA, 64 nt, hsa; identical to SEQ ID NO: 41570

SEQ ID NO: 231698 - RNA, 64 nt, hsa; identical to SEQ ID NO: 41571

SEQ ID NO: 231699 - RNA, 64 nt, hsa; identical to SEQ ID NO: 41572

SEQ ID NO: 231700 - RNA, 64 nt, hsa; identical to SEQ ID NO: 41573

SEQ ID NO: 231701 - RNA, 64 nt, hsa; identical to SEQ ID NO: 41574

SEQ ID NO: 231702 - RNA, 64 nt, hsa; identical to SEQ ID NO: 41575

SEQ ID NO: 231703 - RNA, 64 nt, hsa; identical to SEQ ID NO: 41576

SEQ ID NO: 231704 - RNA, 64 nt, hsa; identical to SEQ ID NO: 41577

SEQ ID NO: 231705 - RNA, 64 nt, hsa; identical to SEQ ID NO: 41578

SEQ ID NO: 231706 - RNA, 64 nt, hsa; identical to SEQ ID NO: 41579

SEQ ID NO: 231707 - RNA, 64 nt, hsa; identical to SEQ ID NO: 41580

SEQ ID NO: 231708 - RNA, 64 nt, hsa; identical to SEQ ID NO: 41581

SEQ ID NO: 231709 - RNA, 64 nt, hsa; identical to SEQ ID NO: 41582

SEQ ID NO: 231710 - RNA, 64 nt, hsa; identical to SEQ ID NO: 41583

SEQ ID NO: 231711 - RNA, 64 nt, hsa; identical to SEQ ID NO: 41584

SEQ ID NO: 231712 - RNA, 64 nt, hsa; identical to SEQ ID NO: 41585

SEQ ID NO: 231713 - RNA, 64 nt, hsa; identical to SEQ ID NO: 41586

SEQ ID NO: 231714 - RNA, 64 nt, hsa; identical to SEQ ID NO: 41587

SEQ ID NO: 231715 - RNA, 64 nt, hsa; identical to SEQ ID NO: 41588

SEQ ID NO: 231716 - RNA, 64 nt, hsa; identical to SEQ ID NO: 41589

SEQ ID NO: 231717 - RNA, 64 nt, hsa; identical to SEQ ID NO: 41590

SEQ ID NO: 231718 - RNA, 64 nt, hsa; identical to SEQ ID NO: 41591

SEQ ID NO: 231719 - RNA, 64 nt, hsa; identical to SEQ ID NO: 41592

SEQ ID NO: 231720 - RNA, 64 nt, hsa; identical to SEQ ID NO: 41593

SEQ ID NO: 231721 - RNA, 64 nt, hsa; identical to SEQ ID NO: 41594

SEQ ID NO: 231722 - RNA, 64 nt, hsa; identical to SEQ ID NO: 41595

SEQ ID NO: 231723 - RNA, 64 nt, hsa; identical to SEQ ID NO: 41596

SEQ ID NO: 231724 - RNA, 64 nt, hsa; identical to SEQ ID NO: 41597

SEQ ID NO: 231725 - RNA, 64 nt, hsa; identical to SEQ ID NO: 41598

SEQ ID NO: 231726 - RNA, 64 nt, hsa; identical to SEQ ID NO: 41599

SEQ ID NO: 231727 - RNA, 64 nt, hsa; identical to SEQ ID NO: 41600

SEQ ID NO: 231728 - RNA, 64 nt, hsa; identical to SEQ ID NO: 41601

SEQ ID NO: 231729 - RNA, 64 nt, hsa; identical to SEQ ID NO: 41602

SEQ ID NO: 231730 - RNA, 64 nt, hsa; identical to SEQ ID NO: 41603

SEQ ID NO: 231731 - RNA, 64 nt, hsa; identical to SEQ ID NO: 41604

SEQ ID NO: 231732 - RNA, 64 nt, hsa; identical to SEQ ID NO: 41605

SEQ ID NO: 231733 - RNA, 64 nt, hsa; identical to SEQ ID NO: 41606

SEQ ID NO: 231734 - RNA, 64 nt, hsa; identical to SEQ ID NO: 41607

SEQ ID NO: 231735 - RNA, 64 nt, hsa; identical to SEQ ID NO: 41608

SEQ ID NO: 231736 - RNA, 64 nt, hsa; identical to SEQ ID NO: 41609

SEQ ID NO: 231737 - RNA, 64 nt, hsa; identical to SEQ ID NO: 41610

SEQ ID NO: 231738 - RNA, 64 nt, hsa; identical to SEQ ID NO: 41611

SEQ ID NO: 231739 - RNA, 64 nt, hsa; identical to SEQ ID NO: 41612

SEQ ID NO: 231740 - RNA, 64 nt, hsa; identical to SEQ ID NO: 41613

SEQ ID NO: 231741 - RNA, 64 nt, hsa; identical to SEQ ID NO: 41614

SEQ ID NO: 231742 - RNA, 64 nt, hsa; identical to SEQ ID NO: 41615

SEQ ID NO: 231743 - RNA, 64 nt, hsa; identical to SEQ ID NO: 41616

SEQ ID NO: 231744 - RNA, 64 nt, hsa; identical to SEQ ID NO: 41617

SEQ ID NO: 231745 - RNA, 64 nt, hsa; identical to SEQ ID NO: 41618

SEQ ID NO: 231746 - RNA, 64 nt, hsa; identical to SEQ ID NO: 41619

SEQ ID NO: 231747 - RNA, 64 nt, hsa; identical to SEQ ID NO: 41620

SEQ ID NO: 231748 - RNA, 64 nt, hsa; identical to SEQ ID NO: 41621

SEQ ID NO: 231749 - RNA, 63 nt, hsa; identical to SEQ ID NO: 41622

SEQ ID NO: 231750 - RNA, 64 nt, hsa; identical to SEQ ID NO: 41623

SEQ ID NO: 231751 - RNA, 64 nt, hsa; identical to SEQ ID NO: 41624

SEQ ID NO: 231752 - RNA, 64 nt, hsa; identical to SEQ ID NO: 41625

SEQ ID NO: 231753 - RNA, 64 nt, hsa; identical to SEQ ID NO: 41626

SEQ ID NO: 231754 - RNA, 64 nt, hsa; identical to SEQ ID NO: 41627

SEQ ID NO: 231755 - RNA, 64 nt, hsa; identical to SEQ ID NO: 41628

SEQ ID NO: 231756 - RNA, 64 nt, hsa; identical to SEQ ID NO: 41629

SEQ ID NO: 231757 - RNA, 64 nt, hsa; identical to SEQ ID NO: 41630

SEQ ID NO: 231758 - RNA, 64 nt, hsa; identical to SEQ ID NO: 41631

SEQ ID NO: 231759 - RNA, 64 nt, hsa; identical to SEQ ID NO: 41632

SEQ ID NO: 231760 - RNA, 64 nt, hsa; identical to SEQ ID NO: 41633

SEQ ID NO: 231761 - RNA, 64 nt, hsa; identical to SEQ ID NO: 41634

SEQ ID NO: 231762 - RNA, 64 nt, hsa; identical to SEQ ID NO: 41635

SEQ ID NO: 231763 - RNA, 64 nt, hsa; identical to SEQ ID NO: 41636

SEQ ID NO: 231764 - RNA, 64 nt, hsa; identical to SEQ ID NO: 41637

SEQ ID NO: 231765 - RNA, 64 nt, hsa; identical to SEQ ID NO: 41638

SEQ ID NO: 231766 - RNA, 64 nt, hsa; identical to SEQ ID NO: 41639

SEQ ID NO: 231767 - RNA, 64 nt, hsa; identical to SEQ ID NO: 41640

SEQ ID NO: 231768 - RNA, 64 nt, hsa; identical to SEQ ID NO: 41641

SEQ ID NO: 231769 - RNA, 64 nt, hsa; identical to SEQ ID NO: 41642

SEQ ID NO: 231770 - RNA, 64 nt, hsa; identical to SEQ ID NO: 41643

SEQ ID NO: 231771 - RNA, 64 nt, hsa; identical to SEQ ID NO: 41644

SEQ ID NO: 231772 - RNA, 64 nt, hsa; identical to SEQ ID NO: 41645

SEQ ID NO: 231773 - RNA, 64 nt, hsa; identical to SEQ ID NO: 41646

SEQ ID NO: 231774 - RNA, 64 nt, hsa; identical to SEQ ID NO: 41647

SEQ ID NO: 231775 - RNA, 64 nt, hsa; identical to SEQ ID NO: 41648

SEQ ID NO: 231776 - RNA, 64 nt, hsa; identical to SEQ ID NO: 41649

SEQ ID NO: 231777 - RNA, 64 nt, hsa; identical to SEQ ID NO: 41650

SEQ ID NO: 231778 - RNA, 64 nt, hsa; identical to SEQ ID NO: 41651

SEQ ID NO: 231779 - RNA, 64 nt, hsa; identical to SEQ ID NO: 41652

SEQ ID NO: 231780 - RNA, 64 nt, hsa; identical to SEQ ID NO: 41653

SEQ ID NO: 231781 - RNA, 64 nt, hsa; identical to SEQ ID NO: 41654

SEQ ID NO: 231782 - RNA, 64 nt, hsa; identical to SEQ ID NO: 41655

SEQ ID NO: 231783 - RNA, 64 nt, hsa; identical to SEQ ID NO: 41656

SEQ ID NO: 231784 - RNA, 64 nt, hsa; identical to SEQ ID NO: 41657

SEQ ID NO: 231785 - RNA, 64 nt, hsa; identical to SEQ ID NO: 41658

SEQ ID NO: 231786 - RNA, 64 nt, hsa; identical to SEQ ID NO: 41659

SEQ ID NO: 231787 - RNA, 64 nt, hsa; identical to SEQ ID NO: 41660

SEQ ID NO: 231788 - RNA, 64 nt, hsa; identical to SEQ ID NO: 41661

SEQ ID NO: 231789 - RNA, 64 nt, hsa; identical to SEQ ID NO: 41662

SEQ ID NO: 231790 - RNA, 64 nt, hsa; identical to SEQ ID NO: 41663

SEQ ID NO: 231791 - RNA, 64 nt, hsa; identical to SEQ ID NO: 41664

SEQ ID NO: 231792 - RNA, 64 nt, hsa; identical to SEQ ID NO: 41665

SEQ ID NO: 231793 - RNA, 64 nt, hsa; identical to SEQ ID NO: 41666

SEQ ID NO: 231794 - RNA, 64 nt, hsa; identical to SEQ ID NO: 41667

SEQ ID NO: 231795 - RNA, 64 nt, hsa; identical to SEQ ID NO: 41668

SEQ ID NO: 231796 - RNA, 64 nt, hsa; identical to SEQ ID NO: 41669

SEQ ID NO: 231797 - RNA, 64 nt, hsa; identical to SEQ ID NO: 41670

SEQ ID NO: 231798 - RNA, 64 nt, hsa; identical to SEQ ID NO: 41671

SEQ ID NO: 231799 - RNA, 64 nt, hsa; identical to SEQ ID NO: 41672

SEQ ID NO: 231800 - RNA, 64 nt, hsa; identical to SEQ ID NO: 41673

SEQ ID NO: 231801 - RNA, 64 nt, hsa; identical to SEQ ID NO: 41674

SEQ ID NO: 231802 - RNA, 64 nt, hsa; identical to SEQ ID NO: 41675

SEQ ID NO: 231803 - RNA, 64 nt, hsa; identical to SEQ ID NO: 41676

SEQ ID NO: 231804 - RNA, 64 nt, hsa; identical to SEQ ID NO: 41677

SEQ ID NO: 231805 - RNA, 64 nt, hsa; identical to SEQ ID NO: 41678

SEQ ID NO: 231806 - RNA, 64 nt, hsa; identical to SEQ ID NO: 41679

SEQ ID NO: 231807 - RNA, 64 nt, hsa; identical to SEQ ID NO: 41680

SEQ ID NO: 231808 - RNA, 64 nt, hsa; identical to SEQ ID NO: 41681

SEQ ID NO: 231809 - RNA, 64 nt, hsa; identical to SEQ ID NO: 41682

SEQ ID NO: 231810 - RNA, 64 nt, hsa; identical to SEQ ID NO: 41683

SEQ ID NO: 231811 - RNA, 64 nt, hsa; identical to SEQ ID NO: 41684

SEQ ID NO: 231812 - RNA, 64 nt, hsa; identical to SEQ ID NO: 41685

SEQ ID NO: 231813 - RNA, 64 nt, hsa; identical to SEQ ID NO: 41686

SEQ ID NO: 231814 - RNA, 64 nt, hsa; identical to SEQ ID NO: 41687

SEQ ID NO: 231815 - RNA, 64 nt, hsa; identical to SEQ ID NO: 41688

SEQ ID NO: 231816 - RNA, 64 nt, hsa; identical to SEQ ID NO: 41689

SEQ ID NO: 231817 - RNA, 64 nt, hsa; identical to SEQ ID NO: 41690

SEQ ID NO: 231818 - RNA, 64 nt, hsa; identical to SEQ ID NO: 41691

SEQ ID NO: 231819 - RNA, 64 nt, hsa; identical to SEQ ID NO: 41692

SEQ ID NO: 231820 - RNA, 64 nt, hsa; identical to SEQ ID NO: 41693

SEQ ID NO: 231821 - RNA, 64 nt, hsa; identical to SEQ ID NO: 41694

SEQ ID NO: 231822 - RNA, 64 nt, hsa; identical to SEQ ID NO: 41695

SEQ ID NO: 231823 - RNA, 64 nt, hsa; identical to SEQ ID NO: 41696

SEQ ID NO: 231824 - RNA, 64 nt, hsa; identical to SEQ ID NO: 41697

SEQ ID NO: 231825 - RNA, 64 nt, hsa; identical to SEQ ID NO: 41698

SEQ ID NO: 231826 - RNA, 64 nt, hsa; identical to SEQ ID NO: 41699

SEQ ID NO: 231827 - RNA, 64 nt, hsa; identical to SEQ ID NO: 41700

SEQ ID NO: 231828 - RNA, 64 nt, hsa; identical to SEQ ID NO: 41701

SEQ ID NO: 231829 - RNA, 64 nt, hsa; identical to SEQ ID NO: 41702

SEQ ID NO: 231830 - RNA, 64 nt, hsa; identical to SEQ ID NO: 41703

SEQ ID NO: 231831 - RNA, 64 nt, hsa; identical to SEQ ID NO: 41704

SEQ ID NO: 231832 - RNA, 64 nt, hsa; identical to SEQ ID NO: 41705

SEQ ID NO: 231833 - RNA, 64 nt, hsa; identical to SEQ ID NO: 41706

SEQ ID NO: 231834 - RNA, 64 nt, hsa; identical to SEQ ID NO: 41707

SEQ ID NO: 231835 - RNA, 64 nt, hsa; identical to SEQ ID NO: 41708

SEQ ID NO: 231836 - RNA, 64 nt, hsa; identical to SEQ ID NO: 41709

SEQ ID NO: 231837 - RNA, 64 nt, hsa; identical to SEQ ID NO: 41710

SEQ ID NO: 231838 - RNA, 64 nt, hsa; identical to SEQ ID NO: 41711

SEQ ID NO: 231839 - RNA, 64 nt, hsa; identical to SEQ ID NO: 41712

SEQ ID NO: 231840 - RNA, 64 nt, hsa; identical to SEQ ID NO: 41713

SEQ ID NO: 231841 - RNA, 64 nt, hsa; identical to SEQ ID NO: 41714

SEQ ID NO: 231842 - RNA, 64 nt, hsa; identical to SEQ ID NO: 41715

SEQ ID NO: 231843 - RNA, 64 nt, hsa; identical to SEQ ID NO: 41716

SEQ ID NO: 231844 - RNA, 64 nt, hsa; identical to SEQ ID NO: 41717

SEQ ID NO: 231845 - RNA, 64 nt, hsa; identical to SEQ ID NO: 41718

SEQ ID NO: 231846 - RNA, 64 nt, hsa; identical to SEQ ID NO: 41719

SEQ ID NO: 231847 - RNA, 64 nt, hsa; identical to SEQ ID NO: 41720

SEQ ID NO: 231848 - RNA, 64 nt, hsa; identical to SEQ ID NO: 41721

SEQ ID NO: 231849 - RNA, 64 nt, hsa; identical to SEQ ID NO: 41722

SEQ ID NO: 231850 - RNA, 64 nt, hsa; identical to SEQ ID NO: 41723

SEQ ID NO: 231851 - RNA, 64 nt, hsa; identical to SEQ ID NO: 41724

SEQ ID NO: 231852 - RNA, 64 nt, hsa; identical to SEQ ID NO: 41725

SEQ ID NO: 231853 - RNA, 64 nt, hsa; identical to SEQ ID NO: 41726

SEQ ID NO: 231854 - RNA, 64 nt, hsa; identical to SEQ ID NO: 41727

SEQ ID NO: 231855 - RNA, 64 nt, hsa; identical to SEQ ID NO: 41728

SEQ ID NO: 231856 - RNA, 64 nt, hsa; identical to SEQ ID NO: 41729

SEQ ID NO: 231857 - RNA, 64 nt, hsa; identical to SEQ ID NO: 41730

SEQ ID NO: 231858 - RNA, 64 nt, hsa; identical to SEQ ID NO: 41731

SEQ ID NO: 231859 - RNA, 64 nt, hsa; identical to SEQ ID NO: 41732

SEQ ID NO: 231860 - RNA, 64 nt, hsa; identical to SEQ ID NO: 41733

SEQ ID NO: 231861 - RNA, 64 nt, hsa; identical to SEQ ID NO: 41734

SEQ ID NO: 231862 - RNA, 64 nt, hsa; identical to SEQ ID NO: 41735

SEQ ID NO: 231863 - RNA, 64 nt, hsa; identical to SEQ ID NO: 41736

SEQ ID NO: 231864 - RNA, 64 nt, hsa; identical to SEQ ID NO: 41737

SEQ ID NO: 231865 - RNA, 64 nt, hsa; identical to SEQ ID NO: 41738

SEQ ID NO: 231866 - RNA, 64 nt, hsa; identical to SEQ ID NO: 41739

SEQ ID NO: 231867 - RNA, 64 nt, hsa; identical to SEQ ID NO: 41740

SEQ ID NO: 231868 - RNA, 64 nt, hsa; identical to SEQ ID NO: 41741

SEQ ID NO: 231869 - RNA, 64 nt, hsa; identical to SEQ ID NO: 41742

SEQ ID NO: 231870 - RNA, 64 nt, hsa; identical to SEQ ID NO: 41743

SEQ ID NO: 231871 - RNA, 64 nt, hsa; identical to SEQ ID NO: 41744

SEQ ID NO: 231872 - RNA, 64 nt, hsa; identical to SEQ ID NO: 41745

SEQ ID NO: 231873 - RNA, 64 nt, hsa; identical to SEQ ID NO: 41746

SEQ ID NO: 231874 - RNA, 64 nt, hsa; identical to SEQ ID NO: 41747

SEQ ID NO: 231875 - RNA, 64 nt, hsa; identical to SEQ ID NO: 41748

SEQ ID NO: 231876 - RNA, 64 nt, hsa; identical to SEQ ID NO: 41749

SEQ ID NO: 231877 - RNA, 64 nt, hsa; identical to SEQ ID NO: 41750

SEQ ID NO: 231878 - RNA, 64 nt, hsa; identical to SEQ ID NO: 41751

SEQ ID NO: 231879 - RNA, 64 nt, hsa; identical to SEQ ID NO: 41752

SEQ ID NO: 231880 - RNA, 64 nt, hsa; identical to SEQ ID NO: 41753

SEQ ID NO: 231881 - RNA, 64 nt, hsa; identical to SEQ ID NO: 41754

SEQ ID NO: 231882 - RNA, 64 nt, hsa; identical to SEQ ID NO: 41755

SEQ ID NO: 231883 - RNA, 64 nt, hsa; identical to SEQ ID NO: 41756

SEQ ID NO: 231884 - RNA, 64 nt, hsa; identical to SEQ ID NO: 41757

SEQ ID NO: 231885 - RNA, 64 nt, hsa; identical to SEQ ID NO: 41758

SEQ ID NO: 231886 - RNA, 64 nt, hsa; identical to SEQ ID NO: 41759

SEQ ID NO: 231887 - RNA, 64 nt, hsa; identical to SEQ ID NO: 41760

SEQ ID NO: 231888 - RNA, 64 nt, hsa; identical to SEQ ID NO: 41761

SEQ ID NO: 231889 - RNA, 64 nt, hsa; identical to SEQ ID NO: 41762

SEQ ID NO: 231890 - RNA, 64 nt, hsa; identical to SEQ ID NO: 41763

SEQ ID NO: 231891 - RNA, 64 nt, hsa; identical to SEQ ID NO: 41764

SEQ ID NO: 231892 - RNA, 64 nt, hsa; identical to SEQ ID NO: 41765

SEQ ID NO: 231893 - RNA, 64 nt, hsa; identical to SEQ ID NO: 41766

SEQ ID NO: 231894 - RNA, 64 nt, hsa; identical to SEQ ID NO: 41767

SEQ ID NO: 231895 - RNA, 64 nt, hsa; identical to SEQ ID NO: 41768

SEQ ID NO: 231896 - RNA, 64 nt, hsa; identical to SEQ ID NO: 41769

SEQ ID NO: 231897 - RNA, 64 nt, hsa; identical to SEQ ID NO: 41770

SEQ ID NO: 231898 - RNA, 64 nt, hsa; identical to SEQ ID NO: 41771

SEQ ID NO: 231899 - RNA, 64 nt, hsa; identical to SEQ ID NO: 41772

SEQ ID NO: 231900 - RNA, 64 nt, hsa; identical to SEQ ID NO: 41773

SEQ ID NO: 231901 - RNA, 64 nt, hsa; identical to SEQ ID NO: 41774

SEQ ID NO: 231902 - RNA, 64 nt, hsa; identical to SEQ ID NO: 41775

SEQ ID NO: 231903 - RNA, 64 nt, hsa; identical to SEQ ID NO: 41776

SEQ ID NO: 231904 - RNA, 64 nt, hsa; identical to SEQ ID NO: 41777

SEQ ID NO: 231905 - RNA, 64 nt, hsa; identical to SEQ ID NO: 41778

SEQ ID NO: 231906 - RNA, 64 nt, hsa; identical to SEQ ID NO: 41779

SEQ ID NO: 231907 - RNA, 64 nt, hsa; identical to SEQ ID NO: 41780

SEQ ID NO: 231908 - RNA, 64 nt, hsa; identical to SEQ ID NO: 41781

SEQ ID NO: 231909 - RNA, 64 nt, hsa; identical to SEQ ID NO: 41782

SEQ ID NO: 231910 - RNA, 64 nt, hsa; identical to SEQ ID NO: 41783

SEQ ID NO: 231911 - RNA, 64 nt, hsa; identical to SEQ ID NO: 41784

SEQ ID NO: 231912 - RNA, 64 nt, hsa; identical to SEQ ID NO: 41785

SEQ ID NO: 231913 - RNA, 64 nt, hsa; identical to SEQ ID NO: 41786

SEQ ID NO: 231914 - RNA, 64 nt, hsa; identical to SEQ ID NO: 41787

SEQ ID NO: 231915 - RNA, 64 nt, hsa; identical to SEQ ID NO: 41788

SEQ ID NO: 231916 - RNA, 64 nt, hsa; identical to SEQ ID NO: 41789

SEQ ID NO: 231917 - RNA, 64 nt, hsa; identical to SEQ ID NO: 41790

SEQ ID NO: 231918 - RNA, 64 nt, hsa; identical to SEQ ID NO: 41791

SEQ ID NO: 231919 - RNA, 64 nt, hsa; identical to SEQ ID NO: 41792

SEQ ID NO: 231920 - RNA, 64 nt, hsa; identical to SEQ ID NO: 41793

SEQ ID NO: 231921 - RNA, 64 nt, hsa; identical to SEQ ID NO: 41794

SEQ ID NO: 231922 - RNA, 64 nt, hsa; identical to SEQ ID NO: 41795

SEQ ID NO: 231923 - RNA, 64 nt, hsa; identical to SEQ ID NO: 41796

SEQ ID NO: 231924 - RNA, 64 nt, hsa; identical to SEQ ID NO: 41797

SEQ ID NO: 231925 - RNA, 64 nt, hsa; identical to SEQ ID NO: 41798

SEQ ID NO: 231926 - RNA, 64 nt, hsa; identical to SEQ ID NO: 41799

SEQ ID NO: 231927 - RNA, 64 nt, hsa; identical to SEQ ID NO: 41800

SEQ ID NO: 231928 - RNA, 64 nt, hsa; identical to SEQ ID NO: 41801

SEQ ID NO: 231929 - RNA, 64 nt, hsa; identical to SEQ ID NO: 41802

SEQ ID NO: 231930 - RNA, 64 nt, hsa; identical to SEQ ID NO: 41803

SEQ ID NO: 231931 - RNA, 64 nt, hsa; identical to SEQ ID NO: 41804

SEQ ID NO: 231932 - RNA, 64 nt, hsa; identical to SEQ ID NO: 41805

SEQ ID NO: 231933 - RNA, 64 nt, hsa; identical to SEQ ID NO: 41806

SEQ ID NO: 231934 - RNA, 64 nt, hsa; identical to SEQ ID NO: 41807

SEQ ID NO: 231935 - RNA, 64 nt, hsa; identical to SEQ ID NO: 41808

SEQ ID NO: 231936 - RNA, 64 nt, hsa; identical to SEQ ID NO: 41809

SEQ ID NO: 231937 - RNA, 64 nt, hsa; identical to SEQ ID NO: 41810

SEQ ID NO: 231938 - RNA, 64 nt, hsa; identical to SEQ ID NO: 41811

SEQ ID NO: 231939 - RNA, 64 nt, hsa; identical to SEQ ID NO: 41812

SEQ ID NO: 231940 - RNA, 64 nt, hsa; identical to SEQ ID NO: 41813

SEQ ID NO: 231941 - RNA, 64 nt, hsa; identical to SEQ ID NO: 41814

SEQ ID NO: 231942 - RNA, 64 nt, hsa; identical to SEQ ID NO: 41815

SEQ ID NO: 231943 - RNA, 64 nt, hsa; identical to SEQ ID NO: 41816

SEQ ID NO: 231944 - RNA, 64 nt, hsa; identical to SEQ ID NO: 41817

SEQ ID NO: 231945 - RNA, 64 nt, hsa; identical to SEQ ID NO: 41818

SEQ ID NO: 231946 - RNA, 64 nt, hsa; identical to SEQ ID NO: 41819

SEQ ID NO: 231947 - RNA, 64 nt, hsa; identical to SEQ ID NO: 41820

SEQ ID NO: 231948 - RNA, 64 nt, hsa; identical to SEQ ID NO: 41821

SEQ ID NO: 231949 - RNA, 64 nt, hsa; identical to SEQ ID NO: 41822

SEQ ID NO: 231950 - RNA, 64 nt, hsa; identical to SEQ ID NO: 41823

SEQ ID NO: 231951 - RNA, 64 nt, hsa; identical to SEQ ID NO: 41824

SEQ ID NO: 231952 - RNA, 64 nt, hsa; identical to SEQ ID NO: 41825

SEQ ID NO: 231953 - RNA, 64 nt, hsa; identical to SEQ ID NO: 41826

SEQ ID NO: 231954 - RNA, 64 nt, hsa; identical to SEQ ID NO: 41827

SEQ ID NO: 231955 - RNA, 64 nt, hsa; identical to SEQ ID NO: 41828

SEQ ID NO: 231956 - RNA, 64 nt, hsa; identical to SEQ ID NO: 41829

SEQ ID NO: 231957 - RNA, 64 nt, hsa; identical to SEQ ID NO: 41830

SEQ ID NO: 231958 - RNA, 64 nt, hsa; identical to SEQ ID NO: 41831

SEQ ID NO: 231959 - RNA, 64 nt, hsa; identical to SEQ ID NO: 41832

SEQ ID NO: 231960 - RNA, 64 nt, hsa; identical to SEQ ID NO: 41833

SEQ ID NO: 231961 - RNA, 64 nt, hsa; identical to SEQ ID NO: 41834

SEQ ID NO: 231962 - RNA, 64 nt, hsa; identical to SEQ ID NO: 41835

SEQ ID NO: 231963 - RNA, 64 nt, hsa; identical to SEQ ID NO: 41836

SEQ ID NO: 231964 - RNA, 64 nt, hsa; identical to SEQ ID NO: 41837

SEQ ID NO: 231965 - RNA, 64 nt, hsa; identical to SEQ ID NO: 41838

SEQ ID NO: 231966 - RNA, 64 nt, hsa; identical to SEQ ID NO: 41839

SEQ ID NO: 231967 - RNA, 64 nt, hsa; identical to SEQ ID NO: 41840

SEQ ID NO: 231968 - RNA, 64 nt, hsa; identical to SEQ ID NO: 41841

SEQ ID NO: 231969 - RNA, 64 nt, hsa; identical to SEQ ID NO: 41842

SEQ ID NO: 231970 - RNA, 64 nt, hsa; identical to SEQ ID NO: 41843

SEQ ID NO: 231971 - RNA, 64 nt, hsa; identical to SEQ ID NO: 41844

SEQ ID NO: 231972 - RNA, 64 nt, hsa; identical to SEQ ID NO: 41845

SEQ ID NO: 231973 - RNA, 64 nt, hsa; identical to SEQ ID NO: 41846

SEQ ID NO: 231974 - RNA, 64 nt, hsa; identical to SEQ ID NO: 41847

SEQ ID NO: 231975 - RNA, 64 nt, hsa; identical to SEQ ID NO: 41848

SEQ ID NO: 231976 - RNA, 64 nt, hsa; identical to SEQ ID NO: 41849

SEQ ID NO: 231977 - RNA, 64 nt, hsa; identical to SEQ ID NO: 41850

SEQ ID NO: 231978 - RNA, 64 nt, hsa; identical to SEQ ID NO: 41851

SEQ ID NO: 231979 - RNA, 64 nt, hsa; identical to SEQ ID NO: 41852

SEQ ID NO: 231980 - RNA, 64 nt, hsa; identical to SEQ ID NO: 41853

SEQ ID NO: 231981 - RNA, 64 nt, hsa; identical to SEQ ID NO: 41854

SEQ ID NO: 231982 - RNA, 64 nt, hsa; identical to SEQ ID NO: 41855

SEQ ID NO: 231983 - RNA, 64 nt, hsa; identical to SEQ ID NO: 41856

SEQ ID NO: 231984 - RNA, 64 nt, hsa; identical to SEQ ID NO: 41857

SEQ ID NO: 231985 - RNA, 64 nt, hsa; identical to SEQ ID NO: 41858

SEQ ID NO: 231986 - RNA, 64 nt, hsa; identical to SEQ ID NO: 41859

SEQ ID NO: 231987 - RNA, 64 nt, hsa; identical to SEQ ID NO: 41860

SEQ ID NO: 231988 - RNA, 64 nt, hsa; identical to SEQ ID NO: 41861

SEQ ID NO: 231989 - RNA, 64 nt, hsa; identical to SEQ ID NO: 41862

SEQ ID NO: 231990 - RNA, 64 nt, hsa; identical to SEQ ID NO: 41863

SEQ ID NO: 231991 - RNA, 64 nt, hsa; identical to SEQ ID NO: 41864

SEQ ID NO: 231992 - RNA, 64 nt, hsa; identical to SEQ ID NO: 41865

SEQ ID NO: 231993 - RNA, 64 nt, hsa; identical to SEQ ID NO: 41866

SEQ ID NO: 231994 - RNA, 64 nt, hsa; identical to SEQ ID NO: 41867

SEQ ID NO: 231995 - RNA, 64 nt, hsa; identical to SEQ ID NO: 41868

SEQ ID NO: 231996 - RNA, 64 nt, hsa; identical to SEQ ID NO: 41869

SEQ ID NO: 231997 - RNA, 64 nt, hsa; identical to SEQ ID NO: 41870

SEQ ID NO: 231998 - RNA, 64 nt, hsa; identical to SEQ ID NO: 41871

SEQ ID NO: 231999 - RNA, 64 nt, hsa; identical to SEQ ID NO: 41872

SEQ ID NO: 232000 - RNA, 64 nt, hsa; identical to SEQ ID NO: 41873

SEQ ID NO: 232001 - RNA, 64 nt, hsa; identical to SEQ ID NO: 41874

SEQ ID NO: 232002 - RNA, 64 nt, hsa; identical to SEQ ID NO: 41875

SEQ ID NO: 232003 - RNA, 64 nt, hsa; identical to SEQ ID NO: 41876

SEQ ID NO: 232004 - RNA, 64 nt, hsa; identical to SEQ ID NO: 41877

SEQ ID NO: 232005 - RNA, 64 nt, hsa; identical to SEQ ID NO: 41878

SEQ ID NO: 232006 - RNA, 64 nt, hsa; identical to SEQ ID NO: 41879

SEQ ID NO: 232007 - RNA, 64 nt, hsa; identical to SEQ ID NO: 41880

SEQ ID NO: 232008 - RNA, 64 nt, hsa; identical to SEQ ID NO: 41881

SEQ ID NO: 232009 - RNA, 64 nt, hsa; identical to SEQ ID NO: 41882

SEQ ID NO: 232010 - RNA, 64 nt, hsa; identical to SEQ ID NO: 41883

SEQ ID NO: 232011 - RNA, 64 nt, hsa; identical to SEQ ID NO: 41884

SEQ ID NO: 232012 - RNA, 64 nt, hsa; identical to SEQ ID NO: 41885

SEQ ID NO: 232013 - RNA, 64 nt, hsa; identical to SEQ ID NO: 41886

SEQ ID NO: 232014 - RNA, 64 nt, hsa; identical to SEQ ID NO: 41887

SEQ ID NO: 232015 - RNA, 64 nt, hsa; identical to SEQ ID NO: 41888

SEQ ID NO: 232016 - RNA, 64 nt, hsa; identical to SEQ ID NO: 41889

SEQ ID NO: 232017 - RNA, 64 nt, hsa; identical to SEQ ID NO: 41890

SEQ ID NO: 232018 - RNA, 64 nt, hsa; identical to SEQ ID NO: 41891

SEQ ID NO: 232019 - RNA, 64 nt, hsa; identical to SEQ ID NO: 41892

SEQ ID NO: 232020 - RNA, 64 nt, hsa; identical to SEQ ID NO: 41893

SEQ ID NO: 232021 - RNA, 64 nt, hsa; identical to SEQ ID NO: 41894

SEQ ID NO: 232022 - RNA, 64 nt, hsa; identical to SEQ ID NO: 41895

SEQ ID NO: 232023 - RNA, 64 nt, hsa; identical to SEQ ID NO: 41896

SEQ ID NO: 232024 - RNA, 64 nt, hsa; identical to SEQ ID NO: 41897

SEQ ID NO: 232025 - RNA, 64 nt, hsa; identical to SEQ ID NO: 41898

SEQ ID NO: 232026 - RNA, 64 nt, hsa; identical to SEQ ID NO: 41899

SEQ ID NO: 232027 - RNA, 64 nt, hsa; identical to SEQ ID NO: 41900

SEQ ID NO: 232028 - RNA, 64 nt, hsa; identical to SEQ ID NO: 41901

SEQ ID NO: 232029 - RNA, 64 nt, hsa; identical to SEQ ID NO: 41902

SEQ ID NO: 232030 - RNA, 64 nt, hsa; identical to SEQ ID NO: 41903

SEQ ID NO: 232031 - RNA, 64 nt, hsa; identical to SEQ ID NO: 41904

SEQ ID NO: 232032 - RNA, 64 nt, hsa; identical to SEQ ID NO: 41905

SEQ ID NO: 232033 - RNA, 64 nt, hsa; identical to SEQ ID NO: 41906

SEQ ID NO: 232034 - RNA, 64 nt, hsa; identical to SEQ ID NO: 41907

SEQ ID NO: 232035 - RNA, 64 nt, hsa; identical to SEQ ID NO: 41908

SEQ ID NO: 232036 - RNA, 64 nt, hsa; identical to SEQ ID NO: 41909

SEQ ID NO: 232037 - RNA, 64 nt, hsa; identical to SEQ ID NO: 41910

SEQ ID NO: 232038 - RNA, 64 nt, hsa; identical to SEQ ID NO: 41911

SEQ ID NO: 232039 - RNA, 64 nt, hsa; identical to SEQ ID NO: 41912

SEQ ID NO: 232040 - RNA, 64 nt, hsa; identical to SEQ ID NO: 41913

SEQ ID NO: 232041 - RNA, 64 nt, hsa; identical to SEQ ID NO: 41914

SEQ ID NO: 232042 - RNA, 64 nt, hsa; identical to SEQ ID NO: 41915

SEQ ID NO: 232043 - RNA, 64 nt, hsa; identical to SEQ ID NO: 41916

SEQ ID NO: 232044 - RNA, 64 nt, hsa; identical to SEQ ID NO: 41917

SEQ ID NO: 232045 - RNA, 64 nt, hsa; identical to SEQ ID NO: 41918

SEQ ID NO: 232046 - RNA, 64 nt, hsa; identical to SEQ ID NO: 41919

SEQ ID NO: 232047 - RNA, 64 nt, hsa; identical to SEQ ID NO: 41920

SEQ ID NO: 232048 - RNA, 64 nt, hsa; identical to SEQ ID NO: 41921

SEQ ID NO: 232049 - RNA, 64 nt, hsa; identical to SEQ ID NO: 41922

SEQ ID NO: 232050 - RNA, 64 nt, hsa; identical to SEQ ID NO: 41923

SEQ ID NO: 232051 - RNA, 64 nt, hsa; identical to SEQ ID NO: 41924

SEQ ID NO: 232052 - RNA, 64 nt, hsa; identical to SEQ ID NO: 41925

SEQ ID NO: 232053 - RNA, 64 nt, hsa; identical to SEQ ID NO: 41926

SEQ ID NO: 232054 - RNA, 64 nt, hsa; identical to SEQ ID NO: 41927

SEQ ID NO: 232055 - RNA, 64 nt, hsa; identical to SEQ ID NO: 41928

SEQ ID NO: 232056 - RNA, 64 nt, hsa; identical to SEQ ID NO: 41929

SEQ ID NO: 232057 - RNA, 64 nt, hsa; identical to SEQ ID NO: 41930

SEQ ID NO: 232058 - RNA, 64 nt, hsa; identical to SEQ ID NO: 41931

SEQ ID NO: 232059 - RNA, 64 nt, hsa; identical to SEQ ID NO: 41932

SEQ ID NO: 232060 - RNA, 64 nt, hsa; identical to SEQ ID NO: 41933

SEQ ID NO: 232061 - RNA, 64 nt, hsa; identical to SEQ ID NO: 41934

SEQ ID NO: 232062 - RNA, 64 nt, hsa; identical to SEQ ID NO: 41935

SEQ ID NO: 232063 - RNA, 64 nt, hsa; identical to SEQ ID NO: 41936

SEQ ID NO: 232064 - RNA, 64 nt, hsa; identical to SEQ ID NO: 41937

SEQ ID NO: 232065 - RNA, 64 nt, hsa; identical to SEQ ID NO: 41938

SEQ ID NO: 232066 - RNA, 64 nt, hsa; identical to SEQ ID NO: 41939

SEQ ID NO: 232067 - RNA, 64 nt, hsa; identical to SEQ ID NO: 41940

SEQ ID NO: 232068 - RNA, 64 nt, hsa; identical to SEQ ID NO: 41941

SEQ ID NO: 232069 - RNA, 64 nt, hsa; identical to SEQ ID NO: 41942

SEQ ID NO: 232070 - RNA, 64 nt, hsa; identical to SEQ ID NO: 41943

SEQ ID NO: 232071 - RNA, 64 nt, hsa; identical to SEQ ID NO: 41944

SEQ ID NO: 232072 - RNA, 64 nt, hsa; identical to SEQ ID NO: 41945

SEQ ID NO: 232073 - RNA, 64 nt, hsa; identical to SEQ ID NO: 41946

SEQ ID NO: 232074 - RNA, 64 nt, hsa; identical to SEQ ID NO: 41947

SEQ ID NO: 232075 - RNA, 64 nt, hsa; identical to SEQ ID NO: 41948

SEQ ID NO: 232076 - RNA, 64 nt, hsa; identical to SEQ ID NO: 41949

SEQ ID NO: 232077 - RNA, 64 nt, hsa; identical to SEQ ID NO: 41950

SEQ ID NO: 232078 - RNA, 64 nt, hsa; identical to SEQ ID NO: 41951

SEQ ID NO: 232079 - RNA, 64 nt, hsa; identical to SEQ ID NO: 41952

SEQ ID NO: 232080 - RNA, 64 nt, hsa; identical to SEQ ID NO: 41953

SEQ ID NO: 232081 - RNA, 64 nt, hsa; identical to SEQ ID NO: 41954

SEQ ID NO: 232082 - RNA, 64 nt, hsa; identical to SEQ ID NO: 41955

SEQ ID NO: 232083 - RNA, 64 nt, hsa; identical to SEQ ID NO: 41956

SEQ ID NO: 232084 - RNA, 64 nt, hsa; identical to SEQ ID NO: 41957

SEQ ID NO: 232085 - RNA, 64 nt, hsa; identical to SEQ ID NO: 41958

SEQ ID NO: 232086 - RNA, 64 nt, hsa; identical to SEQ ID NO: 41959

SEQ ID NO: 232087 - RNA, 64 nt, hsa; identical to SEQ ID NO: 41960

SEQ ID NO: 232088 - RNA, 64 nt, hsa; identical to SEQ ID NO: 41961

SEQ ID NO: 232089 - RNA, 64 nt, hsa; identical to SEQ ID NO: 41962

SEQ ID NO: 232090 - RNA, 64 nt, hsa; identical to SEQ ID NO: 41963

SEQ ID NO: 232091 - RNA, 64 nt, hsa; identical to SEQ ID NO: 41964

SEQ ID NO: 232092 - RNA, 64 nt, hsa; identical to SEQ ID NO: 41965

SEQ ID NO: 232093 - RNA, 64 nt, hsa; identical to SEQ ID NO: 41966

SEQ ID NO: 232094 - RNA, 64 nt, hsa; identical to SEQ ID NO: 41967

SEQ ID NO: 232095 - RNA, 64 nt, hsa; identical to SEQ ID NO: 41968

SEQ ID NO: 232096 - RNA, 64 nt, hsa; identical to SEQ ID NO: 41969

SEQ ID NO: 232097 - RNA, 64 nt, hsa; identical to SEQ ID NO: 41970

SEQ ID NO: 232098 - RNA, 64 nt, hsa; identical to SEQ ID NO: 41971

SEQ ID NO: 232099 - RNA, 64 nt, hsa; identical to SEQ ID NO: 41972

SEQ ID NO: 232100 - RNA, 64 nt, hsa; identical to SEQ ID NO: 41973

SEQ ID NO: 232101 - RNA, 64 nt, hsa; identical to SEQ ID NO: 41974

SEQ ID NO: 232102 - RNA, 64 nt, hsa; identical to SEQ ID NO: 41975

SEQ ID NO: 232103 - RNA, 64 nt, hsa; identical to SEQ ID NO: 41976

SEQ ID NO: 232104 - RNA, 64 nt, hsa; identical to SEQ ID NO: 41977

SEQ ID NO: 232105 - RNA, 64 nt, hsa; identical to SEQ ID NO: 41978

SEQ ID NO: 232106 - RNA, 64 nt, hsa; identical to SEQ ID NO: 41979

SEQ ID NO: 232107 - RNA, 64 nt, hsa; identical to SEQ ID NO: 41980

SEQ ID NO: 232108 - RNA, 64 nt, hsa; identical to SEQ ID NO: 41981

SEQ ID NO: 232109 - RNA, 64 nt, hsa; identical to SEQ ID NO: 41982

SEQ ID NO: 232110 - RNA, 64 nt, hsa; identical to SEQ ID NO: 41983

SEQ ID NO: 232111 - RNA, 64 nt, hsa; identical to SEQ ID NO: 41984

SEQ ID NO: 232112 - RNA, 64 nt, hsa; identical to SEQ ID NO: 41985

SEQ ID NO: 232113 - RNA, 64 nt, hsa; identical to SEQ ID NO: 41986

SEQ ID NO: 232114 - RNA, 64 nt, hsa; identical to SEQ ID NO: 41987

SEQ ID NO: 232115 - RNA, 64 nt, hsa; identical to SEQ ID NO: 41988

SEQ ID NO: 232116 - RNA, 64 nt, hsa; identical to SEQ ID NO: 41989

SEQ ID NO: 232117 - RNA, 64 nt, hsa; identical to SEQ ID NO: 41990

SEQ ID NO: 232118 - RNA, 64 nt, hsa; identical to SEQ ID NO: 41991

SEQ ID NO: 232119 - RNA, 64 nt, hsa; identical to SEQ ID NO: 41992

SEQ ID NO: 232120 - RNA, 64 nt, hsa; identical to SEQ ID NO: 41993

SEQ ID NO: 232121 - RNA, 64 nt, hsa; identical to SEQ ID NO: 41994

SEQ ID NO: 232122 - RNA, 64 nt, hsa; identical to SEQ ID NO: 41995

SEQ ID NO: 232123 - RNA, 64 nt, hsa; identical to SEQ ID NO: 41996

SEQ ID NO: 232124 - RNA, 64 nt, hsa; identical to SEQ ID NO: 41997

SEQ ID NO: 232125 - RNA, 64 nt, hsa; identical to SEQ ID NO: 41998

SEQ ID NO: 232126 - RNA, 64 nt, hsa; identical to SEQ ID NO: 41999

SEQ ID NO: 232127 - RNA, 64 nt, hsa; identical to SEQ ID NO: 42000

SEQ ID NO: 232128 - RNA, 64 nt, hsa; identical to SEQ ID NO: 42001

SEQ ID NO: 232129 - RNA, 64 nt, hsa; identical to SEQ ID NO: 42002

SEQ ID NO: 232130 - RNA, 64 nt, hsa; identical to SEQ ID NO: 42003

SEQ ID NO: 232131 - RNA, 64 nt, hsa; identical to SEQ ID NO: 42004

SEQ ID NO: 232132 - RNA, 64 nt, hsa; identical to SEQ ID NO: 42005

SEQ ID NO: 232133 - RNA, 64 nt, hsa; identical to SEQ ID NO: 42006

SEQ ID NO: 232134 - RNA, 64 nt, hsa; identical to SEQ ID NO: 42007

SEQ ID NO: 232135 - RNA, 64 nt, hsa; identical to SEQ ID NO: 42008

SEQ ID NO: 232136 - RNA, 64 nt, hsa; identical to SEQ ID NO: 42009

SEQ ID NO: 232137 - RNA, 64 nt, hsa; identical to SEQ ID NO: 42010

SEQ ID NO: 232138 - RNA, 64 nt, hsa; identical to SEQ ID NO: 42011

SEQ ID NO: 232139 - RNA, 64 nt, hsa; identical to SEQ ID NO: 42012

SEQ ID NO: 232140 - RNA, 64 nt, hsa; identical to SEQ ID NO: 42013

SEQ ID NO: 232141 - RNA, 64 nt, hsa; identical to SEQ ID NO: 42014

SEQ ID NO: 232142 - RNA, 64 nt, hsa; identical to SEQ ID NO: 42015

SEQ ID NO: 232143 - RNA, 64 nt, hsa; identical to SEQ ID NO: 42016

SEQ ID NO: 232144 - RNA, 64 nt, hsa; identical to SEQ ID NO: 42017

SEQ ID NO: 232145 - RNA, 64 nt, hsa; identical to SEQ ID NO: 42018

SEQ ID NO: 232146 - RNA, 64 nt, hsa; identical to SEQ ID NO: 42019

SEQ ID NO: 232147 - RNA, 64 nt, hsa; identical to SEQ ID NO: 42020

SEQ ID NO: 232148 - RNA, 64 nt, hsa; identical to SEQ ID NO: 42021

SEQ ID NO: 232149 - RNA, 64 nt, hsa; identical to SEQ ID NO: 42022

SEQ ID NO: 232150 - RNA, 64 nt, hsa; identical to SEQ ID NO: 42023

SEQ ID NO: 232151 - RNA, 64 nt, hsa; identical to SEQ ID NO: 42024

SEQ ID NO: 232152 - RNA, 64 nt, hsa; identical to SEQ ID NO: 42025

SEQ ID NO: 232153 - RNA, 64 nt, hsa; identical to SEQ ID NO: 42026

SEQ ID NO: 232154 - RNA, 64 nt, hsa; identical to SEQ ID NO: 42027

SEQ ID NO: 232155 - RNA, 64 nt, hsa; identical to SEQ ID NO: 42028

SEQ ID NO: 232156 - RNA, 64 nt, hsa; identical to SEQ ID NO: 42029

SEQ ID NO: 232157 - RNA, 64 nt, hsa; identical to SEQ ID NO: 42030

SEQ ID NO: 232158 - RNA, 64 nt, hsa; identical to SEQ ID NO: 42031

SEQ ID NO: 232159 - RNA, 64 nt, hsa; identical to SEQ ID NO: 42032

SEQ ID NO: 232160 - RNA, 64 nt, hsa; identical to SEQ ID NO: 42033

SEQ ID NO: 232161 - RNA, 64 nt, hsa; identical to SEQ ID NO: 42034

SEQ ID NO: 232162 - RNA, 64 nt, hsa; identical to SEQ ID NO: 42035

SEQ ID NO: 232163 - RNA, 64 nt, hsa; identical to SEQ ID NO: 42036

SEQ ID NO: 232164 - RNA, 64 nt, hsa; identical to SEQ ID NO: 42037

SEQ ID NO: 232165 - RNA, 64 nt, hsa; identical to SEQ ID NO: 42038

SEQ ID NO: 232166 - RNA, 64 nt, hsa; identical to SEQ ID NO: 42039

SEQ ID NO: 232167 - RNA, 64 nt, hsa; identical to SEQ ID NO: 42040

SEQ ID NO: 232168 - RNA, 64 nt, hsa; identical to SEQ ID NO: 42041

SEQ ID NO: 232169 - RNA, 64 nt, hsa; identical to SEQ ID NO: 42042

SEQ ID NO: 232170 - RNA, 64 nt, hsa; identical to SEQ ID NO: 42043

SEQ ID NO: 232171 - RNA, 64 nt, hsa; identical to SEQ ID NO: 42044

SEQ ID NO: 232172 - RNA, 64 nt, hsa; identical to SEQ ID NO: 42045

SEQ ID NO: 232173 - RNA, 64 nt, hsa; identical to SEQ ID NO: 42046

SEQ ID NO: 232174 - RNA, 64 nt, hsa; identical to SEQ ID NO: 42047

SEQ ID NO: 232175 - RNA, 64 nt, hsa; identical to SEQ ID NO: 42048

SEQ ID NO: 232176 - RNA, 64 nt, hsa; identical to SEQ ID NO: 42049

SEQ ID NO: 232177 - RNA, 64 nt, hsa; identical to SEQ ID NO: 42050

SEQ ID NO: 232178 - RNA, 64 nt, hsa; identical to SEQ ID NO: 42051

SEQ ID NO: 232179 - RNA, 64 nt, hsa; identical to SEQ ID NO: 42052

SEQ ID NO: 232180 - RNA, 64 nt, hsa; identical to SEQ ID NO: 42053

SEQ ID NO: 232181 - RNA, 64 nt, hsa; identical to SEQ ID NO: 42054

SEQ ID NO: 232182 - RNA, 64 nt, hsa; identical to SEQ ID NO: 42055

SEQ ID NO: 232183 - RNA, 64 nt, hsa; identical to SEQ ID NO: 42056

SEQ ID NO: 232184 - RNA, 64 nt, hsa; identical to SEQ ID NO: 42057

SEQ ID NO: 232185 - RNA, 64 nt, hsa; identical to SEQ ID NO: 42058

SEQ ID NO: 232186 - RNA, 64 nt, hsa; identical to SEQ ID NO: 42059

SEQ ID NO: 232187 - RNA, 64 nt, hsa; identical to SEQ ID NO: 42060

SEQ ID NO: 232188 - RNA, 64 nt, hsa; identical to SEQ ID NO: 42061

SEQ ID NO: 232189 - RNA, 64 nt, hsa; identical to SEQ ID NO: 42062

SEQ ID NO: 232190 - RNA, 64 nt, hsa; identical to SEQ ID NO: 42063

SEQ ID NO: 232191 - RNA, 64 nt, hsa; identical to SEQ ID NO: 42064

SEQ ID NO: 232192 - RNA, 64 nt, hsa; identical to SEQ ID NO: 42065

SEQ ID NO: 232193 - RNA, 64 nt, hsa; identical to SEQ ID NO: 42066

SEQ ID NO: 232194 - RNA, 64 nt, hsa; identical to SEQ ID NO: 42067

SEQ ID NO: 232195 - RNA, 64 nt, hsa; identical to SEQ ID NO: 42068

SEQ ID NO: 232196 - RNA, 64 nt, hsa; identical to SEQ ID NO: 42069

SEQ ID NO: 232197 - RNA, 64 nt, hsa; identical to SEQ ID NO: 42070

SEQ ID NO: 232198 - RNA, 64 nt, hsa; identical to SEQ ID NO: 42071

SEQ ID NO: 232199 - RNA, 64 nt, hsa; identical to SEQ ID NO: 42072

SEQ ID NO: 232200 - RNA, 64 nt, hsa; identical to SEQ ID NO: 42073

SEQ ID NO: 232201 - RNA, 64 nt, hsa; identical to SEQ ID NO: 42074

SEQ ID NO: 232202 - RNA, 64 nt, hsa; identical to SEQ ID NO: 42075

SEQ ID NO: 232203 - RNA, 64 nt, hsa; identical to SEQ ID NO: 42076

SEQ ID NO: 232204 - RNA, 64 nt, hsa; identical to SEQ ID NO: 42077

SEQ ID NO: 232205 - RNA, 64 nt, hsa; identical to SEQ ID NO: 42078

SEQ ID NO: 232206 - RNA, 64 nt, hsa; identical to SEQ ID NO: 42079

SEQ ID NO: 232207 - RNA, 64 nt, hsa; identical to SEQ ID NO: 42080

SEQ ID NO: 232208 - RNA, 64 nt, hsa; identical to SEQ ID NO: 42081

SEQ ID NO: 232209 - RNA, 64 nt, hsa; identical to SEQ ID NO: 42082

SEQ ID NO: 232210 - RNA, 64 nt, hsa; identical to SEQ ID NO: 42083

SEQ ID NO: 232211 - RNA, 64 nt, hsa; identical to SEQ ID NO: 42084

SEQ ID NO: 232212 - RNA, 64 nt, hsa; identical to SEQ ID NO: 42085

SEQ ID NO: 232213 - RNA, 64 nt, hsa; identical to SEQ ID NO: 42086

SEQ ID NO: 232214 - RNA, 64 nt, hsa; identical to SEQ ID NO: 42087

SEQ ID NO: 232215 - RNA, 64 nt, hsa; identical to SEQ ID NO: 42088

SEQ ID NO: 232216 - RNA, 64 nt, hsa; identical to SEQ ID NO: 42089

SEQ ID NO: 232217 - RNA, 64 nt, hsa; identical to SEQ ID NO: 42090

SEQ ID NO: 232218 - RNA, 64 nt, hsa; identical to SEQ ID NO: 42091

SEQ ID NO: 232219 - RNA, 64 nt, hsa; identical to SEQ ID NO: 42092

SEQ ID NO: 232220 - RNA, 64 nt, hsa; identical to SEQ ID NO: 42093

SEQ ID NO: 232221 - RNA, 64 nt, hsa; identical to SEQ ID NO: 42094

SEQ ID NO: 232222 - RNA, 64 nt, hsa; identical to SEQ ID NO: 42095

SEQ ID NO: 232223 - RNA, 64 nt, hsa; identical to SEQ ID NO: 42096

SEQ ID NO: 232224 - RNA, 64 nt, hsa; identical to SEQ ID NO: 42097

SEQ ID NO: 232225 - RNA, 64 nt, hsa; identical to SEQ ID NO: 42098

SEQ ID NO: 232226 - RNA, 64 nt, hsa; identical to SEQ ID NO: 42099

SEQ ID NO: 232227 - RNA, 64 nt, hsa; identical to SEQ ID NO: 42100

SEQ ID NO: 232228 - RNA, 64 nt, hsa; identical to SEQ ID NO: 42101

SEQ ID NO: 232229 - RNA, 64 nt, hsa; identical to SEQ ID NO: 41907

SEQ ID NO: 232230 - RNA, 64 nt, hsa; identical to SEQ ID NO: 41906

SEQ ID NO: 232231 - RNA, 64 nt, hsa; identical to SEQ ID NO: 41905

SEQ ID NO: 232232 - RNA, 64 nt, hsa; identical to SEQ ID NO: 41904

SEQ ID NO: 232233 - RNA, 64 nt, hsa; identical to SEQ ID NO: 42106

SEQ ID NO: 232234 - RNA, 64 nt, hsa; identical to SEQ ID NO: 42107

SEQ ID NO: 232235 - RNA, 64 nt, hsa; identical to SEQ ID NO: 42108

SEQ ID NO: 232236 - RNA, 64 nt, hsa; identical to SEQ ID NO: 42109

SEQ ID NO: 232237 - RNA, 64 nt, hsa; identical to SEQ ID NO: 42110

SEQ ID NO: 232238 - RNA, 64 nt, hsa; identical to SEQ ID NO: 42111

SEQ ID NO: 232239 - RNA, 64 nt, hsa; identical to SEQ ID NO: 42112

SEQ ID NO: 232240 - RNA, 64 nt, hsa; identical to SEQ ID NO: 42113

SEQ ID NO: 232241 - RNA, 64 nt, hsa; identical to SEQ ID NO: 42114

SEQ ID NO: 232242 - RNA, 64 nt, hsa; identical to SEQ ID NO: 42115

SEQ ID NO: 232243 - RNA, 64 nt, hsa; identical to SEQ ID NO: 42116

SEQ ID NO: 232244 - RNA, 64 nt, hsa; identical to SEQ ID NO: 42117

SEQ ID NO: 232245 - RNA, 64 nt, hsa; identical to SEQ ID NO: 42118

SEQ ID NO: 232246 - RNA, 64 nt, hsa; identical to SEQ ID NO: 42119

SEQ ID NO: 232247 - RNA, 64 nt, hsa; identical to SEQ ID NO: 42120

SEQ ID NO: 232248 - RNA, 64 nt, hsa; identical to SEQ ID NO: 42121

SEQ ID NO: 232249 - RNA, 64 nt, hsa; identical to SEQ ID NO: 42122

SEQ ID NO: 232250 - RNA, 64 nt, hsa; identical to SEQ ID NO: 42123

SEQ ID NO: 232251 - RNA, 64 nt, hsa; identical to SEQ ID NO: 42124

SEQ ID NO: 232252 - RNA, 64 nt, hsa; identical to SEQ ID NO: 42125

SEQ ID NO: 232253 - RNA, 64 nt, hsa; identical to SEQ ID NO: 42126

SEQ ID NO: 232254 - RNA, 64 nt, hsa; identical to SEQ ID NO: 42127

SEQ ID NO: 232255 - RNA, 64 nt, hsa; identical to SEQ ID NO: 42128

SEQ ID NO: 232256 - RNA, 64 nt, hsa; identical to SEQ ID NO: 42129

SEQ ID NO: 232257 - RNA, 64 nt, hsa; identical to SEQ ID NO: 42130

SEQ ID NO: 232258 - RNA, 64 nt, hsa; identical to SEQ ID NO: 42131

SEQ ID NO: 232259 - RNA, 64 nt, hsa; identical to SEQ ID NO: 42132

SEQ ID NO: 232260 - RNA, 64 nt, hsa; identical to SEQ ID NO: 42133

SEQ ID NO: 232261 - RNA, 64 nt, hsa; identical to SEQ ID NO: 42134

SEQ ID NO: 232262 - RNA, 64 nt, hsa; identical to SEQ ID NO: 42135

SEQ ID NO: 232263 - RNA, 64 nt, hsa; identical to SEQ ID NO: 42136

SEQ ID NO: 232264 - RNA, 64 nt, hsa; identical to SEQ ID NO: 42137

SEQ ID NO: 232265 - RNA, 64 nt, hsa; identical to SEQ ID NO: 42138

SEQ ID NO: 232266 - RNA, 64 nt, hsa; identical to SEQ ID NO: 42139

SEQ ID NO: 232267 - RNA, 64 nt, hsa; identical to SEQ ID NO: 42140

SEQ ID NO: 232268 - RNA, 64 nt, hsa; identical to SEQ ID NO: 42141

SEQ ID NO: 232269 - RNA, 64 nt, hsa; identical to SEQ ID NO: 42142

SEQ ID NO: 232270 - RNA, 64 nt, hsa; identical to SEQ ID NO: 42143

SEQ ID NO: 232271 - RNA, 64 nt, hsa; identical to SEQ ID NO: 42144

SEQ ID NO: 232272 - RNA, 64 nt, hsa; identical to SEQ ID NO: 42145

SEQ ID NO: 232273 - RNA, 64 nt, hsa; identical to SEQ ID NO: 42146

SEQ ID NO: 232274 - RNA, 64 nt, hsa; identical to SEQ ID NO: 42147

SEQ ID NO: 232275 - RNA, 64 nt, hsa; identical to SEQ ID NO: 42148

SEQ ID NO: 232276 - RNA, 64 nt, hsa; identical to SEQ ID NO: 42149

SEQ ID NO: 232277 - RNA, 64 nt, hsa; identical to SEQ ID NO: 42150

SEQ ID NO: 232278 - RNA, 64 nt, hsa; identical to SEQ ID NO: 42151

SEQ ID NO: 232279 - RNA, 64 nt, hsa; identical to SEQ ID NO: 42152

SEQ ID NO: 232280 - RNA, 64 nt, hsa; identical to SEQ ID NO: 42153

SEQ ID NO: 232281 - RNA, 64 nt, hsa; identical to SEQ ID NO: 42154

SEQ ID NO: 232282 - RNA, 64 nt, hsa; identical to SEQ ID NO: 42155

SEQ ID NO: 232283 - RNA, 64 nt, hsa; identical to SEQ ID NO: 42156

SEQ ID NO: 232284 - RNA, 64 nt, hsa; identical to SEQ ID NO: 42157

SEQ ID NO: 232285 - RNA, 64 nt, hsa; identical to SEQ ID NO: 42158

SEQ ID NO: 232286 - RNA, 64 nt, hsa; identical to SEQ ID NO: 42159

SEQ ID NO: 232287 - RNA, 64 nt, hsa; identical to SEQ ID NO: 42160

SEQ ID NO: 232288 - RNA, 64 nt, hsa; identical to SEQ ID NO: 42161

SEQ ID NO: 232289 - RNA, 64 nt, hsa; identical to SEQ ID NO: 42162

SEQ ID NO: 232290 - RNA, 64 nt, hsa; identical to SEQ ID NO: 42163

SEQ ID NO: 232291 - RNA, 64 nt, hsa; identical to SEQ ID NO: 42164

SEQ ID NO: 232292 - RNA, 64 nt, hsa; identical to SEQ ID NO: 42165

SEQ ID NO: 232293 - RNA, 64 nt, hsa; identical to SEQ ID NO: 42166

SEQ ID NO: 232294 - RNA, 64 nt, hsa; identical to SEQ ID NO: 42167

SEQ ID NO: 232295 - RNA, 64 nt, hsa; identical to SEQ ID NO: 42168

SEQ ID NO: 232296 - RNA, 64 nt, hsa; identical to SEQ ID NO: 42169

SEQ ID NO: 232297 - RNA, 64 nt, hsa; identical to SEQ ID NO: 42170

SEQ ID NO: 232298 - RNA, 64 nt, hsa; identical to SEQ ID NO: 42171

SEQ ID NO: 232299 - RNA, 64 nt, hsa; identical to SEQ ID NO: 42172

SEQ ID NO: 232300 - RNA, 64 nt, hsa; identical to SEQ ID NO: 42173

SEQ ID NO: 232301 - RNA, 64 nt, hsa; identical to SEQ ID NO: 42174

SEQ ID NO: 232302 - RNA, 64 nt, hsa; identical to SEQ ID NO: 42175

SEQ ID NO: 232303 - RNA, 64 nt, hsa; identical to SEQ ID NO: 42176

SEQ ID NO: 232304 - RNA, 64 nt, hsa; identical to SEQ ID NO: 42177

SEQ ID NO: 232305 - RNA, 64 nt, hsa; identical to SEQ ID NO: 42178

SEQ ID NO: 232306 - RNA, 64 nt, hsa; identical to SEQ ID NO: 42179

SEQ ID NO: 232307 - RNA, 64 nt, hsa; identical to SEQ ID NO: 42180

SEQ ID NO: 232308 - RNA, 64 nt, hsa; identical to SEQ ID NO: 42181

SEQ ID NO: 232309 - RNA, 64 nt, hsa; identical to SEQ ID NO: 42182

SEQ ID NO: 232310 - RNA, 64 nt, hsa; identical to SEQ ID NO: 42183

SEQ ID NO: 232311 - RNA, 64 nt, hsa; identical to SEQ ID NO: 42184

SEQ ID NO: 232312 - RNA, 64 nt, hsa; identical to SEQ ID NO: 42185

SEQ ID NO: 232313 - RNA, 64 nt, hsa; identical to SEQ ID NO: 42186

SEQ ID NO: 232314 - RNA, 64 nt, hsa; identical to SEQ ID NO: 42187

SEQ ID NO: 232315 - RNA, 64 nt, hsa; identical to SEQ ID NO: 42188

SEQ ID NO: 232316 - RNA, 64 nt, hsa; identical to SEQ ID NO: 42189

SEQ ID NO: 232317 - RNA, 64 nt, hsa; identical to SEQ ID NO: 42190

SEQ ID NO: 232318 - RNA, 64 nt, hsa; identical to SEQ ID NO: 42191

SEQ ID NO: 232319 - RNA, 64 nt, hsa; identical to SEQ ID NO: 42192

SEQ ID NO: 232320 - RNA, 64 nt, hsa; identical to SEQ ID NO: 42193

SEQ ID NO: 232321 - RNA, 64 nt, hsa; identical to SEQ ID NO: 42194

SEQ ID NO: 232322 - RNA, 64 nt, hsa; identical to SEQ ID NO: 42195

SEQ ID NO: 232323 - RNA, 64 nt, hsa; identical to SEQ ID NO: 42196

SEQ ID NO: 232324 - RNA, 64 nt, hsa; identical to SEQ ID NO: 42197

SEQ ID NO: 232325 - RNA, 64 nt, hsa; identical to SEQ ID NO: 42198

SEQ ID NO: 232326 - RNA, 64 nt, hsa; identical to SEQ ID NO: 42199

SEQ ID NO: 232327 - RNA, 64 nt, hsa; identical to SEQ ID NO: 42200

SEQ ID NO: 232328 - RNA, 64 nt, hsa; identical to SEQ ID NO: 42201

SEQ ID NO: 232329 - RNA, 64 nt, hsa; identical to SEQ ID NO: 42202

SEQ ID NO: 232330 - RNA, 64 nt, hsa; identical to SEQ ID NO: 42203

SEQ ID NO: 232331 - RNA, 64 nt, hsa; identical to SEQ ID NO: 42204

SEQ ID NO: 232332 - RNA, 64 nt, hsa; identical to SEQ ID NO: 42205

SEQ ID NO: 232333 - RNA, 64 nt, hsa; identical to SEQ ID NO: 42206

SEQ ID NO: 232334 - RNA, 64 nt, hsa; identical to SEQ ID NO: 42207

SEQ ID NO: 232335 - RNA, 64 nt, hsa; identical to SEQ ID NO: 42208

SEQ ID NO: 232336 - RNA, 64 nt, hsa; identical to SEQ ID NO: 42209

SEQ ID NO: 232337 - RNA, 64 nt, hsa; identical to SEQ ID NO: 42210

SEQ ID NO: 232338 - RNA, 64 nt, hsa; identical to SEQ ID NO: 42211

SEQ ID NO: 232339 - RNA, 64 nt, hsa; identical to SEQ ID NO: 42212

SEQ ID NO: 232340 - RNA, 64 nt, hsa; identical to SEQ ID NO: 42213

SEQ ID NO: 232341 - RNA, 64 nt, hsa; identical to SEQ ID NO: 42214

SEQ ID NO: 232342 - RNA, 64 nt, hsa; identical to SEQ ID NO: 42215

SEQ ID NO: 232343 - RNA, 64 nt, hsa; identical to SEQ ID NO: 42216

SEQ ID NO: 232344 - RNA, 64 nt, hsa; identical to SEQ ID NO: 42217

SEQ ID NO: 232345 - RNA, 64 nt, hsa; identical to SEQ ID NO: 42218

SEQ ID NO: 232346 - RNA, 64 nt, hsa; identical to SEQ ID NO: 42219

SEQ ID NO: 232347 - RNA, 64 nt, hsa; identical to SEQ ID NO: 42220

SEQ ID NO: 232348 - RNA, 64 nt, hsa; identical to SEQ ID NO: 42221

SEQ ID NO: 232349 - RNA, 64 nt, hsa; identical to SEQ ID NO: 42222

SEQ ID NO: 232350 - RNA, 64 nt, hsa; identical to SEQ ID NO: 42223

SEQ ID NO: 232351 - RNA, 64 nt, hsa; identical to SEQ ID NO: 42224

SEQ ID NO: 232352 - RNA, 64 nt, hsa; identical to SEQ ID NO: 42225

SEQ ID NO: 232353 - RNA, 64 nt, hsa; identical to SEQ ID NO: 42226

SEQ ID NO: 232354 - RNA, 64 nt, hsa; identical to SEQ ID NO: 42227

SEQ ID NO: 232355 - RNA, 64 nt, hsa; identical to SEQ ID NO: 42228

SEQ ID NO: 232356 - RNA, 64 nt, hsa; identical to SEQ ID NO: 42229

SEQ ID NO: 232357 - RNA, 64 nt, hsa; identical to SEQ ID NO: 42230

SEQ ID NO: 232358 - RNA, 64 nt, hsa; identical to SEQ ID NO: 42231

SEQ ID NO: 232359 - RNA, 64 nt, hsa; identical to SEQ ID NO: 42232

SEQ ID NO: 232360 - RNA, 64 nt, hsa; identical to SEQ ID NO: 42233

SEQ ID NO: 232361 - RNA, 64 nt, hsa; identical to SEQ ID NO: 42234

SEQ ID NO: 232362 - RNA, 64 nt, hsa; identical to SEQ ID NO: 42235

SEQ ID NO: 232363 - RNA, 64 nt, hsa
ucuauuccugccgggaggaaccucaguuggguaagguguacauaccuguacaguuuuggucauc

SEQ ID NO: 232364 - RNA, 64 nt, hsa
agcugauggccaguguauacagagcguggcccgcgguguacaauacccauauaagguacauugu

SEQ ID NO: 232365 - RNA, 64 nt, hsa
gagcaagucaccuacauaacccugccuguacuaagguguacaccugucuauuguaaguuugccu

SEQ ID NO: 232366 - RNA, 64 nt, hsa
uacaccugucuauuguaaguuugccuaggcuguugguguacagagaccagaggagagagacaca

SEQ ID NO: 232367 - RNA, 64 nt, hsa
gggcaauauuguucuuguuuagcuacaucacuguggugaauauagauggaauuaaggaaguaaa

SEQ ID NO: 232368 - RNA, 64 nt, hsa
ugaauuuucucuauuauauauuucccauauuucaggugaauaauuuaauuuaaaugacaaaacc

SEQ ID NO: 232369 - RNA, 64 nt, hsa
auucucacggagagaagccccagcgagauuuuccggugaauacgggauugcacuuacucuuuca

SEQ ID NO: 232370 - RNA, 64 nt, hsa
agaccccccgagagaagccccaacgagauuuuccggugaauacgggacugcacguacucucuca

SEQ ID NO: 232371 - RNA, 64 nt, hsa
cuccgaguggugcauaaucuuauuuuguuugggaguaacaaaucguggaauauuuuuaaggaaa

SEQ ID NO: 232372 - RNA, 64 nt, hsa
acauuguguacuuggugguucugucccucugccuguaacaaaucucauuuuuguuaccaagaac

SEQ ID NO: 232373 - RNA, 64 nt, hsa
agucuguugcaguaacaaacuccagucuguugcaguaacaaacucuagaauauugacauucucu

SEQ ID NO: 232374 - RNA, 64 nt, hsa
ugucguuugcaguaacaaacuccagucuguugcaguaacaaacuccagucuguugcaguaacaa

SEQ ID NO: 232375 - RNA, 64 nt, hsa
caccucgugaagaacucuuucccugucguuugcaguaacaaacuccagucuguugcaguaacaa

SEQ ID NO: 232376 - RNA, 64 nt, hsa
cacucugagcagagauuugguuuuguuuccuuuuguaacaaagugaaaacaggugagacaaugu

SEQ ID NO: 232377 - RNA, 64 nt, hsa
ucaaaaagaggaaaauaaguuaaauuaagcccaaguaacaaaaauacuggaauuauuaaaacgu

SEQ ID NO: 232378 - RNA, 64 nt, hsa
cuugauauaaagauuuuauuugucccuugaaaaaguaacaaaugugcauagaucaauuuguacu

SEQ ID NO: 232379 - RNA, 64 nt, hsa
uacaauacugaaugggaaaaguaucuaauauuuuguaacaaaaagaccuucauauuaucuguuu

SEQ ID NO: 232380 - RNA, 64 nt, hsa
guuuucacgguguauauuuuuuuucaaaaauucuguaacaaauauauuuaauguguugccauaa

SEQ ID NO: 232381 - RNA, 64 nt, hsa
ugaugcacuggacuaacucuuguuuaccauucauguaacaaaacccagcacauuaucugcacua

SEQ ID NO: 232382 - RNA, 64 nt, hsa
ugaaguaaauguguuuuuauccaucaguuucugaguaacaaagagcaccaaguuuuaauuuaaa

SEQ ID NO: 232383 - RNA, 64 nt, hsa
ugcucagagcugagauauuucucugauaaaucagguaacaaaauguauuugauugauggaauuu

SEQ ID NO: 232384 - RNA, 64 nt, hsa
guguaacaaacccccaugacacaccuuuauguauguaacaaaccagcacuuccugcgcauguac

SEQ ID NO: 232385 - RNA, 64 nt, hsa
acuaauggauacuuagggugaugaaauaaucuguguaacaaacccccaugacacaccuuuaugu

SEQ ID NO: 232386 - RNA, 64 nt, hsa
agugaaacuccaucuccaaaaaaaaaaagaaaaaguaacaaaaggaaauuauuuguuuuugaaa

SEQ ID NO: 232387 - RNA, 64 nt, hsa
gggucaaaguaaauguauacaguuuuauuacaauguaacaaaaguugaaaaucaggcagaugug

SEQ ID NO: 232388 - RNA, 64 nt, hsa
aacauguuuuuaucacucaaaguaagcaauggagguaacaaauauugugcauuuuaacaguaau

SEQ ID NO: 232389 - RNA, 64 nt, hsa
accauauggcacuaauuuugauuuuaacauuaguguaacaaauaaggucgggacauauauuuac

SEQ ID NO: 232390 - RNA, 59 nt, hsa; identical to SEQ ID NO: 188365

SEQ ID NO: 232391 - RNA, 64 nt, hsa; identical to SEQ ID NO: 188366

SEQ ID NO: 232392 - RNA, 64 nt, hsa; identical to SEQ ID NO: 188367

SEQ ID NO: 232393 - RNA, 64 nt, hsa; identical to SEQ ID NO: 188368

SEQ ID NO: 232394 - RNA, 64 nt, hsa; identical to SEQ ID NO: 188369

SEQ ID NO: 232395 - RNA, 64 nt, hsa; identical to SEQ ID NO: 188370

SEQ ID NO: 232396 - RNA, 64 nt, hsa; identical to SEQ ID NO: 188371

SEQ ID NO: 232397 - RNA, 64 nt, hsa; identical to SEQ ID NO: 188372

SEQ ID NO: 232398 - RNA, 64 nt, hsa; identical to SEQ ID NO: 188373

SEQ ID NO: 232399 - RNA, 64 nt, hsa; identical to SEQ ID NO: 188374

SEQ ID NO: 232400 - RNA, 64 nt, hsa; identical to SEQ ID NO: 188375

SEQ ID NO: 232401 - RNA, 64 nt, hsa; identical to SEQ ID NO: 188376

SEQ ID NO: 232402 - RNA, 64 nt, hsa; identical to SEQ ID NO: 188377

SEQ ID NO: 232403 - RNA, 64 nt, hsa; identical to SEQ ID NO: 188378

SEQ ID NO: 232404 - RNA, 64 nt, hsa; identical to SEQ ID NO: 188379

SEQ ID NO: 232405 - RNA, 64 nt, hsa; identical to SEQ ID NO: 188380

SEQ ID NO: 232406 - RNA, 64 nt, hsa; identical to SEQ ID NO: 188381

SEQ ID NO: 232407 - RNA, 64 nt, hsa; identical to SEQ ID NO: 188382

SEQ ID NO: 232408 - RNA, 64 nt, hsa; identical to SEQ ID NO: 188383

SEQ ID NO: 232409 - RNA, 64 nt, hsa; identical to SEQ ID NO: 188384

SEQ ID NO: 232410 - RNA, 64 nt, hsa; identical to SEQ ID NO: 188385

SEQ ID NO: 232411 - RNA, 64 nt, hsa; identical to SEQ ID NO: 188386

SEQ ID NO: 232412 - RNA, 64 nt, hsa; identical to SEQ ID NO: 188387

SEQ ID NO: 232413 - RNA, 64 nt, hsa; identical to SEQ ID NO: 188388

SEQ ID NO: 232414 - RNA, 64 nt, hsa; identical to SEQ ID NO: 188389

SEQ ID NO: 232415 - RNA, 64 nt, hsa; identical to SEQ ID NO: 188390

SEQ ID NO: 232416 - RNA, 64 nt, hsa; identical to SEQ ID NO: 188391

SEQ ID NO: 232417 - RNA, 64 nt, hsa; identical to SEQ ID NO: 188392

SEQ ID NO: 232418 - RNA, 64 nt, hsa; identical to SEQ ID NO: 188393

SEQ ID NO: 232419 - RNA, 52 nt, hsa; identical to SEQ ID NO: 188394

SEQ ID NO: 232420 - RNA, 62 nt, hsa; identical to SEQ ID NO: 188395

SEQ ID NO: 232421 - RNA, 55 nt, hsa; identical to SEQ ID NO: 188396

SEQ ID NO: 232422 - RNA, 64 nt, hsa; identical to SEQ ID NO: 188397

SEQ ID NO: 232423 - RNA, 64 nt, hsa; identical to SEQ ID NO: 188398

SEQ ID NO: 232424 - RNA, 64 nt, hsa; identical to SEQ ID NO: 188399

SEQ ID NO: 232425 - RNA, 64 nt, hsa; identical to SEQ ID NO: 188400

SEQ ID NO: 232426 - RNA, 64 nt, hsa; identical to SEQ ID NO: 188401

SEQ ID NO: 232427 - RNA, 64 nt, hsa; identical to SEQ ID NO: 188402

SEQ ID NO: 232428 - RNA, 64 nt, hsa; identical to SEQ ID NO: 188403

SEQ ID NO: 232429 - RNA, 64 nt, hsa; identical to SEQ ID NO: 188404

SEQ ID NO: 232430 - RNA, 64 nt, hsa; identical to SEQ ID NO: 188405

SEQ ID NO: 232431 - RNA, 64 nt, hsa; identical to SEQ ID NO: 188406

SEQ ID NO: 232432 - RNA, 64 nt, hsa; identical to SEQ ID NO: 188407

SEQ ID NO: 232433 - RNA, 64 nt, hsa; identical to SEQ ID NO: 188408

SEQ ID NO: 232434 - RNA, 64 nt, hsa; identical to SEQ ID NO: 188409

SEQ ID NO: 232435 - RNA, 64 nt, hsa; identical to SEQ ID NO: 188410

SEQ ID NO: 232436 - RNA, 64 nt, hsa; identical to SEQ ID NO: 188411

SEQ ID NO: 232437 - RNA, 64 nt, hsa; identical to SEQ ID NO: 188412

SEQ ID NO: 232438 - RNA, 64 nt, hsa; identical to SEQ ID NO: 188413

SEQ ID NO: 232439 - RNA, 64 nt, hsa; identical to SEQ ID NO: 188414

SEQ ID NO: 232440 - RNA, 64 nt, hsa; identical to SEQ ID NO: 188415

SEQ ID NO: 232441 - RNA, 64 nt, hsa; identical to SEQ ID NO: 188416

SEQ ID NO: 232442 - RNA, 64 nt, hsa; identical to SEQ ID NO: 188417

SEQ ID NO: 232443 - RNA, 64 nt, hsa; identical to SEQ ID NO: 188418

SEQ ID NO: 232444 - RNA, 64 nt, hsa; identical to SEQ ID NO: 188419

SEQ ID NO: 232445 - RNA, 64 nt, hsa; identical to SEQ ID NO: 188420

SEQ ID NO: 232446 - RNA, 64 nt, hsa; identical to SEQ ID NO: 188421

SEQ ID NO: 232447 - RNA, 64 nt, hsa; identical to SEQ ID NO: 188422

SEQ ID NO: 232448 - RNA, 64 nt, hsa; identical to SEQ ID NO: 188423

SEQ ID NO: 232449 - RNA, 64 nt, hsa; identical to SEQ ID NO: 188424

SEQ ID NO: 232450 - RNA, 64 nt, hsa; identical to SEQ ID NO: 188425

SEQ ID NO: 232451 - RNA, 64 nt, hsa; identical to SEQ ID NO: 188426

SEQ ID NO: 232452 - RNA, 64 nt, hsa; identical to SEQ ID NO: 188427

SEQ ID NO: 232453 - RNA, 64 nt, hsa; identical to SEQ ID NO: 188428

SEQ ID NO: 232454 - RNA, 64 nt, hsa; identical to SEQ ID NO: 188429

SEQ ID NO: 232455 - RNA, 64 nt, hsa; identical to SEQ ID NO: 188430

SEQ ID NO: 232456 - RNA, 64 nt, hsa; identical to SEQ ID NO: 188431

SEQ ID NO: 232457 - RNA, 64 nt, hsa; identical to SEQ ID NO: 188432

SEQ ID NO: 232458 - RNA, 64 nt, hsa; identical to SEQ ID NO: 188433

SEQ ID NO: 232459 - RNA, 64 nt, hsa; identical to SEQ ID NO: 188434

SEQ ID NO: 232460 - RNA, 64 nt, hsa; identical to SEQ ID NO: 188435

SEQ ID NO: 232461 - RNA, 64 nt, hsa; identical to SEQ ID NO: 188436

SEQ ID NO: 232462 - RNA, 64 nt, hsa; identical to SEQ ID NO: 188437

SEQ ID NO: 232463 - RNA, 64 nt, hsa; identical to SEQ ID NO: 188438

SEQ ID NO: 232464 - RNA, 64 nt, hsa; identical to SEQ ID NO: 188439

SEQ ID NO: 232465 - RNA, 64 nt, hsa; identical to SEQ ID NO: 188440

SEQ ID NO: 232466 - RNA, 64 nt, hsa; identical to SEQ ID NO: 188441

SEQ ID NO: 232467 - RNA, 64 nt, hsa; identical to SEQ ID NO: 188442

SEQ ID NO: 232468 - RNA, 64 nt, hsa; identical to SEQ ID NO: 188443

SEQ ID NO: 232469 - RNA, 64 nt, hsa; identical to SEQ ID NO: 188444

SEQ ID NO: 232470 - RNA, 64 nt, hsa; identical to SEQ ID NO: 188445

SEQ ID NO: 232471 - RNA, 64 nt, hsa; identical to SEQ ID NO: 188446

SEQ ID NO: 232472 - RNA, 64 nt, hsa; identical to SEQ ID NO: 188447

SEQ ID NO: 232473 - RNA, 64 nt, hsa; identical to SEQ ID NO: 188448

SEQ ID NO: 232474 - RNA, 64 nt, hsa; identical to SEQ ID NO: 188449

SEQ ID NO: 232475 - RNA, 64 nt, hsa; identical to SEQ ID NO: 188450

SEQ ID NO: 232476 - RNA, 64 nt, hsa; identical to SEQ ID NO: 188451

SEQ ID NO: 232477 - RNA, 64 nt, hsa; identical to SEQ ID NO: 188452

SEQ ID NO: 232478 - RNA, 64 nt, hsa; identical to SEQ ID NO: 188453

SEQ ID NO: 232479 - RNA, 64 nt, hsa; identical to SEQ ID NO: 188454

SEQ ID NO: 232480 - RNA, 64 nt, hsa; identical to SEQ ID NO: 188455

SEQ ID NO: 232481 - RNA, 64 nt, hsa; identical to SEQ ID NO: 188456

SEQ ID NO: 232482 - RNA, 64 nt, hsa; identical to SEQ ID NO: 188457

SEQ ID NO: 232483 - RNA, 64 nt, hsa; identical to SEQ ID NO: 188458

SEQ ID NO: 232484 - RNA, 64 nt, hsa
cugaggcaucauuccugggccagagucguguccaccaagggacaguagccagagcuccucuucc

SEQ ID NO: 232485 - RNA, 64 nt, hsa
uggaggccccgagaagcgucuucccuugaguuggccaagggaauaagcaagaggagacauuucc

SEQ ID NO: 232486 - RNA, 64 nt, hsa
ccacaccccagcagggugucuucuagccauaaggccaagggaguggcagaacugggccgccucu

SEQ ID NO: 232487 - RNA, 64 nt, hsa
aaagucacgauuccacaauggaggggagaccuggccaagggagccagccagcgugcaacugccc

SEQ ID NO: 232488 - RNA, 64 nt, hsa
gggcugcugagcuagaauucccaccuaugucuuuccaagggacuguucacggcuugggacuugg

SEQ ID NO: 232489 - RNA, 64 nt, hsa
cugcgcaccugcucuguagcagacacggaagaguccaagggagcagccacguuaggaagagaga

SEQ ID NO: 232490 - RNA, 64 nt, hsa
augccucauuuuagaaccaccaacaagcaagcucccaagggauggugcccuguucucuaccaag

SEQ ID NO: 232491 - RNA, 64 nt, hsa
aaaucagggaauuguuuuaagucuuaucaagcagccaagggaugaaagagaagguggguuuuca

SEQ ID NO: 232492 - RNA, 64 nt, hsa
gaucucugaccucugcugagugcugggcacugcuccaagggacaggugggccuggcggccugug

SEQ ID NO: 232493 - RNA, 64 nt, hsa
gccuccuaggggaagggggugcaaagacucugagccaagggagggaagggccacccugcugcac

SEQ ID NO: 232494 - RNA, 64 nt, hsa
uucugggauggcuggccccacaagccacucaguuccaagggaugugaccagcucugagccaucg

SEQ ID NO: 232495 - RNA, 64 nt, hsa
guuaagcagcugacauaagacagcccguaggcuaccaagggacaccugccugcaaaggcuguug

SEQ ID NO: 232496 - RNA, 64 nt, hsa
cuuuaaagugcuuaauagugccugguacaugggcagugcccaauaaacgguagcuauuuccugu

SEQ ID NO: 232497 - RNA, 64 nt, hsa
cucacaagcugugugacuucaaacaaaugaaaucagugcccagaaccucgguuuccucaucugu

SEQ ID NO: 232498 - RNA, 64 nt, hsa
gggcaggaaguaggcuccccugagcacagugcccagugcccaucuucguucgucuccuugccug

SEQ ID NO: 232499 - RNA, 64 nt, hsa
ccccagggggcaggaaguaggcuccccugagcacagugcccagugcccaucuucguucgucucc

SEQ ID NO: 232500 - RNA, 64 nt, hsa
gucagaguuccguacucgggagccccuuucccugagugcccagggugucuccucugcccagagg

SEQ ID NO: 232501 - RNA, 64 nt, hsa
ccagggcagacgggguagggcgggcucaggacccagugcccaugguuccucacuccuaccagca

SEQ ID NO: 232502 - RNA, 64 nt, hsa
ccacccuccccucccuugcugcucugccccugccagugcccagcccagcggcucugggaagggg

SEQ ID NO: 232503 - RNA, 64 nt, hsa
ugccagugcagguggagggcuguaggggagggccagugcccagacagggucauggggcucagac

SEQ ID NO: 232504 - RNA, 64 nt, hsa
agagauagaugguaguuugguacuucugguucccagugcccaggaaugguccacucccaagaaa

SEQ ID NO: 232505 - RNA, 64 nt, hsa
uugaguugucaggggccaggacuggccccacugcagugcccaggccagucuugagcagcaggga

SEQ ID NO: 232506 - RNA, 64 nt, hsa
acucaaggacagcacuucucgcagaaggucuggaagugcccagaaugggaggcacggaagcccc

SEQ ID NO: 232507 - RNA, 64 nt, hsa
ugagacaagugcaauuccuuccaugucgccccagagugcccaggaggcaggcagugcggggugc

SEQ ID NO: 232508 - RNA, 64 nt, hsa
ucuguguccuuuuucaagccuguuuagaugggggagugcccaugcccucugugaagugcccaaa

SEQ ID NO: 232509 - RNA, 64 nt, hsa
uguuuagaugggggagugcccaugcccucugugaagugcccaaaugcgaaagaauaacaccuuu

SEQ ID NO: 232510 - RNA, 64 nt, hsa
ugucuguagagccgcauggcacucuucccaccucagugcccacagccaagguagggucacuaac

SEQ ID NO: 232511 - RNA, 64 nt, hsa
gcacugccucuuccagggccucugggagccugacagugcccagcaugaagguggggccagugcu

SEQ ID NO: 232512 - RNA, 64 nt, hsa
cagugccucuccuggcccuggaaggugccacuccagugcccaucagccuuguccuaauaaaauu

SEQ ID NO: 232513 - RNA, 64 nt, hsa
ggaggaaaauggaugaaugagagagggagggaacagugcccaagcgcuuggccucuccuucucu

SEQ ID NO: 232514 - RNA, 64 nt, hsa
ugccucugccacagucucucuguuguccccacaucuacccaacuuccuguacuguugcccuucu

SEQ ID NO: 232515 - RNA, 64 nt, hsa
gaaguuuuugcggaagugacagaggcaaagggugcuacccaagccccucuuaccucucuggaug

SEQ ID NO: 232516 - RNA, 64 nt, hsa
agaccagcauguucuccccaaagacuggaauauucuacccaaaugucaggaccaggauuuucua

SEQ ID NO: 232517 - RNA, 64 nt, hsa
agaccugcauguucucuccaacgaccagaauauucuacccaaaugucaggaccaagauuuucua

SEQ ID NO: 232518 - RNA, 64 nt, hsa
cccgcccucuggagcgugugcugucuuuagggcccuacccaaagucacuguaacaguuaagugu

SEQ ID NO: 232519 - RNA, 64 nt, hsa
augccuaaugagcuaguguuucuggcagcucucucuacccaacuuugcacuuguaguuuugagu

SEQ ID NO: 232520 - RNA, 64 nt, hsa; identical to SEQ ID NO: 21574

SEQ ID NO: 232521 - RNA, 64 nt, hsa; identical to SEQ ID NO: 21575

SEQ ID NO: 232522 - RNA, 64 nt, hsa; identical to SEQ ID NO: 21576

SEQ ID NO: 232523 - RNA, 64 nt, hsa; identical to SEQ ID NO: 21577

SEQ ID NO: 232524 - RNA, 64 nt, hsa; identical to SEQ ID NO: 21578

SEQ ID NO: 232525 - RNA, 64 nt, hsa; identical to SEQ ID NO: 21579

SEQ ID NO: 232526 - RNA, 64 nt, hsa; identical to SEQ ID NO: 21580

SEQ ID NO: 232527 - RNA, 64 nt, hsa; identical to SEQ ID NO: 21581

SEQ ID NO: 232528 - RNA, 64 nt, hsa; identical to SEQ ID NO: 21582

SEQ ID NO: 232529 - RNA, 64 nt, hsa; identical to SEQ ID NO: 21583

SEQ ID NO: 232530 - RNA, 64 nt, hsa; identical to SEQ ID NO: 21584

SEQ ID NO: 232531 - RNA, 64 nt, hsa; identical to SEQ ID NO: 21585

SEQ ID NO: 232532 - RNA, 64 nt, hsa; identical to SEQ ID NO: 21586

SEQ ID NO: 232533 - RNA, 64 nt, hsa; identical to SEQ ID NO: 21587

SEQ ID NO: 232534 - RNA, 64 nt, hsa; identical to SEQ ID NO: 21588

SEQ ID NO: 232535 - RNA, 64 nt, hsa; identical to SEQ ID NO: 21589

SEQ ID NO: 232536 - RNA, 64 nt, hsa; identical to SEQ ID NO: 21590

SEQ ID NO: 232537 - RNA, 64 nt, hsa; identical to SEQ ID NO: 21591

SEQ ID NO: 232538 - RNA, 64 nt, hsa; identical to SEQ ID NO: 21592

SEQ ID NO: 232539 - RNA, 64 nt, hsa; identical to SEQ ID NO: 21593

SEQ ID NO: 232540 - RNA, 64 nt, hsa; identical to SEQ ID NO: 21594

SEQ ID NO: 232541 - RNA, 64 nt, hsa; identical to SEQ ID NO: 21595

SEQ ID NO: 232542 - RNA, 64 nt, hsa; identical to SEQ ID NO: 21596

SEQ ID NO: 232543 - RNA, 64 nt, hsa; identical to SEQ ID NO: 21597

SEQ ID NO: 232544 - RNA, 64 nt, hsa; identical to SEQ ID NO: 21598

SEQ ID NO: 232545 - RNA, 64 nt, hsa; identical to SEQ ID NO: 21599

SEQ ID NO: 232546 - RNA, 64 nt, hsa; identical to SEQ ID NO: 21600

SEQ ID NO: 232547 - RNA, 64 nt, hsa; identical to SEQ ID NO: 21601

SEQ ID NO: 232548 - RNA, 64 nt, hsa; identical to SEQ ID NO: 21602

SEQ ID NO: 232549 - RNA, 64 nt, hsa; identical to SEQ ID NO: 21603

SEQ ID NO: 232550 - RNA, 64 nt, hsa; identical to SEQ ID NO: 21604

SEQ ID NO: 232551 - RNA, 64 nt, hsa; identical to SEQ ID NO: 21605

SEQ ID NO: 232552 - RNA, 64 nt, hsa; identical to SEQ ID NO: 21606

SEQ ID NO: 232553 - RNA, 64 nt, hsa; identical to SEQ ID NO: 21607

SEQ ID NO: 232554 - RNA, 64 nt, hsa; identical to SEQ ID NO: 21608

SEQ ID NO: 232555 - RNA, 64 nt, hsa; identical to SEQ ID NO: 21609

SEQ ID NO: 232556 - RNA, 64 nt, hsa; identical to SEQ ID NO: 21610

SEQ ID NO: 232557 - RNA, 64 nt, hsa; identical to SEQ ID NO: 21611

SEQ ID NO: 232558 - RNA, 64 nt, hsa; identical to SEQ ID NO: 21612

SEQ ID NO: 232559 - RNA, 64 nt, hsa; identical to SEQ ID NO: 21613

SEQ ID NO: 232560 - RNA, 64 nt, hsa; identical to SEQ ID NO: 21614

SEQ ID NO: 232561 - RNA, 64 nt, hsa; identical to SEQ ID NO: 21615

SEQ ID NO: 232562 - RNA, 64 nt, hsa; identical to SEQ ID NO: 21616

SEQ ID NO: 232563 - RNA, 64 nt, hsa; identical to SEQ ID NO: 21617

SEQ ID NO: 232564 - RNA, 64 nt, hsa; identical to SEQ ID NO: 21618

SEQ ID NO: 232565 - RNA, 64 nt, hsa; identical to SEQ ID NO: 21619

SEQ ID NO: 232566 - RNA, 64 nt, hsa; identical to SEQ ID NO: 21620

SEQ ID NO: 232567 - RNA, 64 nt, hsa; identical to SEQ ID NO: 21621

SEQ ID NO: 232568 - RNA, 64 nt, hsa; identical to SEQ ID NO: 21622

SEQ ID NO: 232569 - RNA, 64 nt, hsa; identical to SEQ ID NO: 21623

SEQ ID NO: 232570 - RNA, 64 nt, hsa; identical to SEQ ID NO: 21624

SEQ ID NO: 232571 - RNA, 64 nt, hsa; identical to SEQ ID NO: 21625

SEQ ID NO: 232572 - RNA, 64 nt, hsa; identical to SEQ ID NO: 21626

SEQ ID NO: 232573 - RNA, 64 nt, hsa; identical to SEQ ID NO: 21627

SEQ ID NO: 232574 - RNA, 64 nt, hsa; identical to SEQ ID NO: 21628

SEQ ID NO: 232575 - RNA, 64 nt, hsa; identical to SEQ ID NO: 21629

SEQ ID NO: 232576 - RNA, 64 nt, hsa; identical to SEQ ID NO: 21630

SEQ ID NO: 232577 - RNA, 57 nt, hsa; identical to SEQ ID NO: 21631

SEQ ID NO: 232578 - RNA, 64 nt, hsa; identical to SEQ ID NO: 21632

SEQ ID NO: 232579 - RNA, 64 nt, hsa; identical to SEQ ID NO: 21633

SEQ ID NO: 232580 - RNA, 64 nt, hsa; identical to SEQ ID NO: 21634

SEQ ID NO: 232581 - RNA, 64 nt, hsa; identical to SEQ ID NO: 21635

SEQ ID NO: 232582 - RNA, 64 nt, hsa; identical to SEQ ID NO: 21636

SEQ ID NO: 232583 - RNA, 64 nt, hsa; identical to SEQ ID NO: 21637

SEQ ID NO: 232584 - RNA, 64 nt, hsa; identical to SEQ ID NO: 21638

SEQ ID NO: 232585 - RNA, 64 nt, hsa; identical to SEQ ID NO: 21639

SEQ ID NO: 232586 - RNA, 64 nt, hsa; identical to SEQ ID NO: 21640

SEQ ID NO: 232587 - RNA, 64 nt, hsa; identical to SEQ ID NO: 21641

SEQ ID NO: 232588 - RNA, 64 nt, hsa; identical to SEQ ID NO: 21642

SEQ ID NO: 232589 - RNA, 64 nt, hsa; identical to SEQ ID NO: 21643

SEQ ID NO: 232590 - RNA, 64 nt, hsa; identical to SEQ ID NO: 21644

SEQ ID NO: 232591 - RNA, 64 nt, hsa; identical to SEQ ID NO: 21645

SEQ ID NO: 232592 - RNA, 64 nt, hsa; identical to SEQ ID NO: 21646

SEQ ID NO: 232593 - RNA, 64 nt, hsa; identical to SEQ ID NO: 21647

SEQ ID NO: 232594 - RNA, 64 nt, hsa; identical to SEQ ID NO: 21648

SEQ ID NO: 232595 - RNA, 64 nt, hsa; identical to SEQ ID NO: 21649

SEQ ID NO: 232596 - RNA, 64 nt, hsa; identical to SEQ ID NO: 21650

SEQ ID NO: 232597 - RNA, 64 nt, hsa; identical to SEQ ID NO: 21651

SEQ ID NO: 232598 - RNA, 64 nt, hsa; identical to SEQ ID NO: 21652

SEQ ID NO: 232599 - RNA, 64 nt, hsa; identical to SEQ ID NO: 21653

SEQ ID NO: 232600 - RNA, 64 nt, hsa; identical to SEQ ID NO: 21654

SEQ ID NO: 232601 - RNA, 64 nt, hsa; identical to SEQ ID NO: 21655

SEQ ID NO: 232602 - RNA, 64 nt, hsa; identical to SEQ ID NO: 21656

SEQ ID NO: 232603 - RNA, 64 nt, hsa; identical to SEQ ID NO: 21657

SEQ ID NO: 232604 - RNA, 64 nt, hsa; identical to SEQ ID NO: 21658

SEQ ID NO: 232605 - RNA, 64 nt, hsa; identical to SEQ ID NO: 21659

SEQ ID NO: 232606 - RNA, 64 nt, hsa; identical to SEQ ID NO: 21660

SEQ ID NO: 232607 - RNA, 64 nt, hsa; identical to SEQ ID NO: 21661

SEQ ID NO: 232608 - RNA, 64 nt, hsa; identical to SEQ ID NO: 21662

SEQ ID NO: 232609 - RNA, 64 nt, hsa; identical to SEQ ID NO: 21663

SEQ ID NO: 232610 - RNA, 64 nt, hsa; identical to SEQ ID NO: 21664

SEQ ID NO: 232611 - RNA, 64 nt, hsa; identical to SEQ ID NO: 21665

SEQ ID NO: 232612 - RNA, 64 nt, hsa; identical to SEQ ID NO: 21666

SEQ ID NO: 232613 - RNA, 64 nt, hsa; identical to SEQ ID NO: 21667

SEQ ID NO: 232614 - RNA, 64 nt, hsa; identical to SEQ ID NO: 21668

SEQ ID NO: 232615 - RNA, 64 nt, hsa; identical to SEQ ID NO: 21669

SEQ ID NO: 232616 - RNA, 64 nt, hsa; identical to SEQ ID NO: 21670

SEQ ID NO: 232617 - RNA, 64 nt, hsa; identical to SEQ ID NO: 21671

SEQ ID NO: 232618 - RNA, 64 nt, hsa; identical to SEQ ID NO: 21672

SEQ ID NO: 232619 - RNA, 64 nt, hsa; identical to SEQ ID NO: 21673

SEQ ID NO: 232620 - RNA, 64 nt, hsa; identical to SEQ ID NO: 21674

SEQ ID NO: 232621 - RNA, 64 nt, hsa; identical to SEQ ID NO: 21675

SEQ ID NO: 232622 - RNA, 64 nt, hsa; identical to SEQ ID NO: 21676

SEQ ID NO: 232623 - RNA, 64 nt, hsa; identical to SEQ ID NO: 21677

SEQ ID NO: 232624 - RNA, 64 nt, hsa; identical to SEQ ID NO: 21678

SEQ ID NO: 232625 - RNA, 64 nt, hsa; identical to SEQ ID NO: 21679

SEQ ID NO: 232626 - RNA, 64 nt, hsa; identical to SEQ ID NO: 21680

SEQ ID NO: 232627 - RNA, 64 nt, hsa; identical to SEQ ID NO: 21681

SEQ ID NO: 232628 - RNA, 64 nt, hsa; identical to SEQ ID NO: 21682

SEQ ID NO: 232629 - RNA, 64 nt, hsa
auucugugucaagcacuguggguuuuaauauuuuuaaaucaaacgcugauuacagauaauagua

SEQ ID NO: 232630 - RNA, 64 nt, hsa
aaaccuuuuuagugugacuguuaaaacuuccuuuuaaaucaaaaugccaaauuuauuaaggugg

SEQ ID NO: 232631 - RNA, 64 nt, hsa
uaacgcaaccaagugugcuaaaaaugagcuugauuaaaucaaccaccuauuuuugacauggaaa

SEQ ID NO: 232632 - RNA, 64 nt, hsa
ugugcugcuucucaauuagcguuuaaggugagcauaaaucaacuguccaucaggugaggugugc

SEQ ID NO: 232633 - RNA, 64 nt, hsa
ucauauuguucccuauuuugccagugggaacuccuaaaucaaguuggcuucuaaucaaagcuuu

SEQ ID NO: 232634 - RNA, 64 nt, hsa
uaaauacuguuuuuaacaacuaugauuuggaaaauaaaucaaugcuauaacuauguugauaaaa

SEQ ID NO: 232635 - RNA, 64 nt, hsa
uuauucagggucugagcagcaguaaaagucacccuaaaucaaggggcuuuucagaaggucauuc

SEQ ID NO: 232636 - RNA, 64 nt, hsa
guuucagaguuuucuaauauagagauauauauauuaaaucaaucacaaguaauuuugagugcuc

SEQ ID NO: 232637 - RNA, 64 nt, hsa
auuaaaaaggaaaaaauauuaaaucaauaaguguuaaaucaaaauggaauaucugauucaaacc

SEQ ID NO: 232638 - RNA, 64 nt, hsa
cuuuuuagaaacaugauuaaaaaggaaaaaauauuaaaucaauaaguguuaaaucaaaauggaa

SEQ ID NO: 232639 - RNA, 64 nt, hsa
uuuaauuuaaaauauacugucauguuguguuuuguaaaucaacugaauugagguacuauuuacu

SEQ ID NO: 232640 - RNA, 64 nt, hsa
uaggaaacugaacucagcacucagaauuuuaaauuaaaucaaugaucuucaaguauuugccacu

SEQ ID NO: 232641 - RNA, 64 nt, hsa
uauagugacucuacuguuugaaauacuauuuuuuuaaaucaaguuuuauaaaaguguagaauuu

SEQ ID NO: 232642 - RNA, 64 nt, hsa
uccauauuacuucuagaauuagaccaacaauuuauaaaucaaacaaacccaagagcauugaaau

SEQ ID NO: 232643 - RNA, 64 nt, hsa
aaaauaaaucuucacugcccuaucaaaauacaaauaaaucaaucuaugcuguucuguccuucuu

SEQ ID NO: 232644 - RNA, 64 nt, hsa
uuuacauaaaaugcuaaaauuuauuauaggaaaauaaaucaaacccaaagaaaguuuauucaau

SEQ ID NO: 232645 - RNA, 64 nt, hsa
aaaucaagauuaugaugaguaaauguguauggguuaaaucaaagauaagguuauaguaacauca

SEQ ID NO: 232646 - RNA, 64 nt, hsa
augucuuuugugcuacaguuucguagcaugaguuuaaaucaagauuaugaugaguaaaugugua

SEQ ID NO: 232647 - RNA, 64 nt, hsa
ugcuauaggccaagggucauuuuauacuuggguauaaaucaaucccaguuugggaaaagauuau

SEQ ID NO: 232648 - RNA, 64 nt, hsa
uccuucugucuuguagagucuuguuauaguuguauaaaucaaaaacacagaauaaggaacauau

SEQ ID NO: 232649 - RNA, 64 nt, hsa
aucuccacuuuaaaucuguccuguaaaaguuuuauaaaucaaaugaaaggugacauugccagaa

SEQ ID NO: 232650 - RNA, 64 nt, hsa
agcuuuucagaagaagcaauuuaccuuggauuuguaaaucaagcugaaacuuuuuugauguuca

SEQ ID NO: 232651 - RNA, 64 nt, hsa
gauuauacauaacuacaucuauugcuuuuggugguaaaucaagauuuaguuguaauuuuccagc

SEQ ID NO: 232652 - RNA, 64 nt, hsa
uuacauaagaaauguauuccugaaaagcugcauuuaaaucaagucccaaauucauugacuuagg

SEQ ID NO: 232653 - RNA, 64 nt, hsa
cuguuugauuacugugacagucuuaaugauaccauaaaucaauauuagaaagcuaguugacuua

SEQ ID NO: 232654 - RNA, 64 nt, hsa
acaucaugcuucucauuuuuuaaacuauguucuuuaaaucaacacuggaaacucuguauuauau

SEQ ID NO: 232655 - RNA, 64 nt, hsa
ugguaauaauguuggcaaguaauaguuaucugaauaaaucaaucauauaagaauguauagacaa

SEQ ID NO: 232656 - RNA, 64 nt, hsa
acagaauguuaaaacacuguuguuuaagcauguuuaaaucaagguauuccaaaucucuucuaac

SEQ ID NO: 232657 - RNA, 64 nt, hsa
cuaagaggucuagaaaugcuuaaacuauugaaaauaaaucaaauuauucaaagacuggauuaaa

SEQ ID NO: 232658 - RNA, 64 nt, hsa
uucuuagguucuaugugaauaagauggcagaaucuaaaucaaguauuuugaaggaagcacccau

SEQ ID NO: 232659 - RNA, 64 nt, hsa
gaugacaauacuuucaguguccccuuuucuggcauaaaucaacuaugaauauguuucaagcauc

SEQ ID NO: 232660 - RNA, 64 nt, hsa
acccuuacaagcaagggugcuaggggcucagcuauacgaccauucucccugacagggaguccaa

SEQ ID NO: 232661 - RNA, 64 nt, hsa
gcucuguuguaggugguuccgaguugagacaaauuacgaccacuggaagccagcacccaaggaa

SEQ ID NO: 232662 - RNA, 64 nt, hsa
uuuuagaaauuuagauuuuaaaaggcgugggacauacgaccaggcccuauagccacauaaauau

SEQ ID NO: 232663 - RNA, 64 nt, hsa
aauuuugguaaauuggauaucuuuuuuuuacaaauacgaccauuaaccucaguuaaauuuuugu

SEQ ID NO: 232664 - RNA, 64 nt, hsa
ugaaaaaggaagcccuacuucugggaccacauuuuacgaccaccuagcugagugauguaagcgu

SEQ ID NO: 232665 - RNA, 64 nt, hsa
uacggauaggcuuauauucaaaacaucuuagucauacgaccauaaauuaaaaguggagucacua

SEQ ID NO: 232666 - RNA, 64 nt, hsa
uauuaaauaggucaaucagacuaugacagcuauguacgaccauuuguauguguaucuaugucag

SEQ ID NO: 232667 - RNA, 64 nt, hsa
uacgagaaagugguauauaagucuuuguauacauuacgaccauugugauuauccauuaaaucca

SEQ ID NO: 232668 - RNA, 64 nt, hsa
cacugaacaaacaaaaaacaaaacgcucaagccuuacgaccagagaaggauuucagcaaaccac

SEQ ID NO: 232669 - RNA, 64 nt, hsa
ccgggugcugcuggacggcaagcccaucagcgccuacgaccacaaguacuugcaccguguggua

SEQ ID NO: 232670 - RNA, 64 nt, hsa
aaauuaaaaacaagucacugauuuguuuugaacuuacgaccauuugguuucagcaugucaggag

SEQ ID NO: 232671 - RNA, 64 nt, hsa
aauagauucauuuaauuuuccugugguugaccuauacgaccaggauguagaaaacuagaaagaa

SEQ ID NO: 232672 - RNA, 64 nt, hsa
accugcaaaaucuuuaaggaaaaaagcugaaggguacgaccaugcacauaugugaccuggaaaa

SEQ ID NO: 232673 - RNA, 64 nt, hsa
ccaggaguggccguugcuacaagucaccuggugcuacgaccagggugagaauaaagacgucucc

SEQ ID NO: 232674 - RNA, 65 nt, hsa
uuaugguugcuuguguaauaaagcauguccuucguaugucacaguuuggggcaacggaagucuuu

SEQ ID NO: 232675 - RNA, 65 nt, hsa
uuccacccgcaacuguggggcuaagaauucuuaagaugucacagaauuauaccauccuaccucau

SEQ ID NO: 232676 - RNA, 65 nt, hsa
uacuccuguuggcuaucaguacggucaaggaucugaugucacauccaaaagcuuuccagguaccc

SEQ ID NO: 232677 - RNA, 65 nt, hsa
cuuuugugaaugugugacauaaacagauguaaugcaugucacagugacggagauaacacugccau

SEQ ID NO: 232678 - RNA, 65 nt, hsa
ucccaucaugacaugguccccaggcuggccugaggaugucacagcuugaggcuguggugugaaag

SEQ ID NO: 232679 - RNA, 65 nt, hsa
uauagaaaugccuuuuguuucuccugcccuucuugaugucacaguuuuuuguacuuccagcuguc

SEQ ID NO: 232680 - RNA, 65 nt, hsa
cccaacaguuuuaccucgggaugguugguuagugcaugucacaugacauccacaugcacauguau

SEQ ID NO: 232681 - RNA, 65 nt, hsa
auacagugcuccccacugaaaauuaaaccuaaaaaaugucacauauugguauguuguuaaccugg

SEQ ID NO: 232682 - RNA, 65 nt, hsa
uccagggaaucgcaauguuguggcgucugacuuguaugucacauuuguguaaaaugguauauucu

SEQ ID NO: 232683 - RNA, 65 nt, hsa
guaaauucagucccugguuuuuaauuuucugucugaugucacagaucauuguugcacacaaacgu

SEQ ID NO: 232684 - RNA, 65 nt, hsa
cagagaagaucuauaguccguccugaggucugucaaugucacaggaaaaggcaaacuugagggga

SEQ ID NO: 232685 - RNA, 65 nt, hsa
uggccccuggacggguacaauaacacacuguacugaugucacaacuuugcaagcucugccuuggg

SEQ ID NO: 232686 - RNA, 65 nt, hsa
ccuguauacgugugacaugcuggccucagagauucaugucacauauugaaauagcaaauagaaau

SEQ ID NO: 232687 - RNA, 65 nt, hsa
guaugguggguugguuuugguguaacaucuucaacaugucacacuggcuaucaaagaauaagaaa

SEQ ID NO: 232688 - RNA, 65 nt, hsa
gccaacccacccacacgcucgucucacucaauucaaugucacacuucugccucuugcaaaauugc

SEQ ID NO: 232689 - RNA, 65 nt, hsa
uuuuaaucuauguuaaaauaucuucaaugaggaaaaugucacagaauaaauuuauauuacacauu

SEQ ID NO: 232690 - RNA, 65 nt, hsa
aagaaauccuaacauuuaaguguaauucauuucaaaugucacaaguaaagcaucauccucaaaua

SEQ ID NO: 232691 - RNA, 65 nt, hsa
uacaugaaaauugcaaucuaaagcuuucauaccaaaugucacaggagcugucucccagcucauuu

SEQ ID NO: 232692 - RNA, 65 nt, hsa
uuucuauagacccaaagcuuaugaaagaagaacaaaugucacaggcccagcucuucaccagaagc

SEQ ID NO: 232693 - RNA, 65 nt, hsa
ucuccccagaaggcacuuccugucugauguccaggaugucacauguucccuuaccccuguaccug

SEQ ID NO: 232694 - RNA, 65 nt, hsa
aaaaguuuuuaaacacucucaauuucuaauucaccaugucacagacuggugaaaaaaaaaaaaag

SEQ ID NO: 232695 - RNA, 65 nt, hsa
guguuuaagccuacaaucauugauuuuuuuuuguuaugucacaaucaguauaucuucuuuggggu

SEQ ID NO: 232696 - RNA, 65 nt, hsa
aaguggaagaauucauuaauaaggaacuuuuaauuaugucacaaaugaauaguugguuuccaaug

SEQ ID NO: 232697 - RNA, 65 nt, hsa
acaagguuagcuuuuuuaauugcagacaguaaugcaugucacacuaauauguaguggccuuuuca

SEQ ID NO: 232698 - RNA, 65 nt, hsa
cagugucaggcuggacgccgugauuucagggaccuaugucacaauguucgcugaggccccaggug

SEQ ID NO: 232699 - RNA, 65 nt, hsa
uguauuuucaagaacucuucuauuuauuaaggaaaaugucacauugugauguauuaagccaguac

SEQ ID NO: 232700 - RNA, 65 nt, hsa
cuguaaaaccauccagccauuugacacccuuuaugaugucacaccuuuaacuuaaggagacgggu

SEQ ID NO: 232701 - RNA, 65 nt, hsa
uccaaccacugucagcagcacucuggaguuuucaaaugucacauuagccucacccugcaugcuag

SEQ ID NO: 232702 - RNA, 65 nt, hsa
uucuuuguuuuuacccccuggcugccaccacugccaugucacagcugcuuucucuggcuggagug

SEQ ID NO: 232703 - RNA, 65 nt, hsa
auauaaaaaugaaaaugaagauacgugaaauucaaaugucacaacuugccuauuauuuauuuuag

SEQ ID NO: 232704 - RNA, 65 nt, hsa
aggauauuaccgucucaggaaaggaucaggacuccaugucacaguccugccaucuuacuuuccuc

SEQ ID NO: 232705 - RNA, 65 nt, hsa
aagagaguagggccagugaaggcugcccagagagaaugucacagaugaggcugccccugcccccc

SEQ ID NO: 232706 - RNA, 65 nt, hsa
cuggagggaaguaacauuuacugagcaccuguuguaugucacaugccuuaugaauagaaucuuaa

SEQ ID NO: 232707 - RNA, 65 nt, hsa
auuuugcuaaauccuguuuaguuuucagccauuaaaugucacaugaagccuugauagaauuuguu

SEQ ID NO: 232708 - RNA, 65 nt, hsa
aauguuaacuuauggaaaugcuaguucaaaugguaaugucacaguguuuuguaugcagagagcaa

SEQ ID NO: 232709 - RNA, 65 nt, hsa
ucuaauaagcuuaaccuaagugucacgaagacgagaugucacagagguccacucagugacaaaca

SEQ ID NO: 232710 - RNA, 65 nt, hsa
uugugacaaguuugcacuuacaaaaucauguaaauaugucacauuuuguuuaacauuauuuuucc

SEQ ID NO: 232711 - RNA, 65 nt, hsa
uucucauaucaaugucagaaguauccuggaaacauaugucacaugcgggaacuguuuaacaaaua

SEQ ID NO: 232712 - RNA, 65 nt, hsa
uuagagaugcagccacggaaaccgugacaacugccaugucacaagaaaauaccugccagucaaca

SEQ ID NO: 232713 - RNA, 65 nt, hsa
uauugaaugauaauucagucuugccuuugaaggguaugucacaaagagcugacagugcuucuaca

SEQ ID NO: 232714 - RNA, 65 nt, hsa
agccauauaauggcgguuugggggagccugcuagaaugucacauggauggcugucauagggguug

SEQ ID NO: 232715 - RNA, 65 nt, hsa
gugggugguaaaaagggaaggaugaggcucccccaaugucacauuaaauucaugguuuucauuca

SEQ ID NO: 232716 - RNA, 65 nt, hsa
ccuccgaaucugguugggcauccagcauacggccaaugucacaacaaucagcccugggcagacac

SEQ ID NO: 232717 - RNA, 65 nt, hsa
uacucaauccauucuucacaagucuugguuaaagaaugucacauauuggugauagaaugaauuca

SEQ ID NO: 232718 - RNA, 65 nt, hsa
aagcaacacuuuaacgucuuacauuuucucugaugaugucacacaaaauuaucaugacaaauauu

SEQ ID NO: 232719 - RNA, 65 nt, hsa
auguuuauaaagguaaaauggcaguuugaagucaaaugucacauaggcaaagcaaucaagcacca

SEQ ID NO: 232720 - RNA, 65 nt, hsa
uggaguccccagcaccuggggcccugguggggcugaugucacagguguuuacugugcugcugcac

SEQ ID NO: 232721 - RNA, 65 nt, hsa
auuuucucuaccuucaagaaccaggcagcccugccaugucacaauaggccaggggaguuuccaaa

SEQ ID NO: 232722 - RNA, 65 nt, hsa
ugguugcauucagggauugcaaggaccauauagacaugucacagguggaaaaagggccacaagcc

SEQ ID NO: 232723 - RNA, 65 nt, hsa
cagaguggcauuauguuuuuacaaaauaaugacauaugucacauguuugcauguuuguuugcuug

SEQ ID NO: 232724 - RNA, 65 nt, hsa
aauucuguauuucuuaagauggagccacugacgagaugucacaguauagagccugcagucucaac

SEQ ID NO: 232725 - RNA, 65 nt, hsa
acauguaccaggaaccauuuaacaaagaauauaaaaugucacaaucuguguacuguuagccuuug

SEQ ID NO: 232726 - RNA, 65 nt, hsa
uuacagggcugcuauuuucauaauguacaugaacaaugucacagaacuuuuuuaauuuuuuugaa

SEQ ID NO: 232727 - RNA, 65 nt, hsa
acucauugauuuuguuuugcuuguuaagcaaaggaaugucacauaccucuguccagcuuuuuagg

SEQ ID NO: 232728 - RNA, 65 nt, hsa
aauuuauagcuccaaaaacaaaaauauacuuguauaugucacagagaaaaaaaaugcaaaauuua

SEQ ID NO: 232729 - RNA, 65 nt, hsa
caugggauuuuggaaaucagcuucuggaggaaugcaugucacaggcgggacuuucuucagagagu

SEQ ID NO: 232730 - RNA, 65 nt, hsa
gagaggugggauucauuacaagacuuugggcucuuaugucacaucacaugauuuggagaaauuag

SEQ ID NO: 232731 - RNA, 65 nt, hsa
ugucaccuagagagcaagaggucuauagaaacaucaugucacaugaaacgauucucugcuuuuug

SEQ ID NO: 232732 - RNA, 65 nt, hsa
auuauuuuauaaauugagaacaaccacaccaccaaaugucacaccuucuuauaaagugugaacaa

SEQ ID NO: 232733 - RNA, 65 nt, hsa
agaaauaguuugguacuaccgacauugucuaauccaugucacauccucauacaauuuaauugcuc

SEQ ID NO: 232734 - RNA, 65 nt, hsa
gcagcuaagucauacauucauuuugacuccuuucaaugucacacacauaguauugaucagaaauc

SEQ ID NO: 232735 - RNA, 65 nt, hsa
aaaaaaccaaggcuuuuuucaguagcguccuauggaugucacauuguacaucaaacaaccuugug

SEQ ID NO: 232736 - RNA, 65 nt, hsa
cgauggaauaaaaguauguuuuaaagguuacuugaaugucacaaaauuaugccuucaucaaaacu

SEQ ID NO: 232737 - RNA, 60 nt, hsa
agaaggcaggacucaaaugaugcccuggagaugucacagauuccuggcagagccaugguc

SEQ ID NO: 232738 - RNA, 65 nt, hsa
uucauuuugcaaauucagaaaguugguccagauauaugucacagaacuuuucacuuguauacuac

SEQ ID NO: 232739 - RNA, 65 nt, hsa
cauuugaguaggugucauuuaaaaauaguuggugaaugucacaaaugccuucuauguuguuugcu

SEQ ID NO: 232740 - RNA, 65 nt, hsa
aaauuagugaaguucuuuuacuguaauuggugacaaugucacauaaugaaugcuauugaaaaggu

SEQ ID NO: 232741 - RNA, 65 nt, hsa
ggggcacaaguuuuuuuguucauacuuuggcugugaugucacaguuuguucagugagguaugaug

SEQ ID NO: 232742 - RNA, 65 nt, hsa
gguuacaugaaaaaaaauuuacuaagcuuaacuacaugucacacauuguacauggaaacaagaac

SEQ ID NO: 232743 - RNA, 65 nt, hsa
agcauaaccuaagacagggaauugggagccaucauaugucacaguguucagaauucaagcauauu

SEQ ID NO: 232744 - RNA, 65 nt, hsa
guuauguuugggcaaagccuuugucuucaagcagaaugucacagaaggcagcuacuuuauaagcc

SEQ ID NO: 232745 - RNA, 65 nt, hsa
uuaggaguacugauagggguucaugcuuaauaaacaugucacaauacaguaaguaaagugguuuu

SEQ ID NO: 232746 - RNA, 65 nt, hsa
guccacuguuuauaauauuuugugccuugaagggaaugucacaggaggaaaaggaagacuaaagc

SEQ ID NO: 232747 - RNA, 65 nt, hsa
agucucagcaugaucaguccugauugaauuucauuaugucacagugaugcaugucuuagcacuga

SEQ ID NO: 232748 - RNA, 65 nt, hsa
cucgugaagagcagcacaacauggaaagagccaaaaugucacaguuccuaucugugagggaaugg

SEQ ID NO: 232749 - RNA, 65 nt, hsa
uacaacugucuuugauggcauuuucagaacaauaaaugucacaaucccuucuauagcccccuaca

SEQ ID NO: 232750 - RNA, 65 nt, hsa
gugaucagggaacuaaaagucugagggggacacaaaugucacaccuaagaggacaaucaaucauu

SEQ ID NO: 232751 - RNA, 65 nt, hsa
ggacccuuauaaaauccugugcaauagacacauacaugucacauuuagcugugcucagaagggcu

SEQ ID NO: 232752 - RNA, 65 nt, hsa
uuucuccccaaaagaaucagcagcacaggggaacuaugucacaguuuaccucuuccugauucaga

SEQ ID NO: 232753 - RNA, 65 nt, hsa
uaaugcccaauuauuaaaugaacacaagagcugagaugucacauucgucagcauuacaggugauc

SEQ ID NO: 232754 - RNA, 65 nt, hsa
ucacaagugcagcauuccuuaauuccuucugcuauaugucacacaguuguuauuuggagaaccaa

SEQ ID NO: 232755 - RNA, 65 nt, hsa
cugccagguaucgaguuggaauauccaguuauuucaugucacacaucggcacguaugaugguggu

SEQ ID NO: 232756 - RNA, 65 nt, hsa
cgucaguuugaggggacgguggggggaugauaugaaugucacaggaggagacaccuucugucuuu

SEQ ID NO: 232757 - RNA, 65 nt, hsa
gaguuaauuaaaaauuguuuuuauuuggggucauuaugucacagucuugaguuaacaagaucuua

SEQ ID NO: 232758 - RNA, 65 nt, hsa
gaaucugggaauaugaagcuauaauuuuuuaauuaaugucacaaagcucuagugcaaucuaguug

SEQ ID NO: 232759 - RNA, 59 nt, hsa
cagaaucagaacagaaguaguaccaaucaaugucacaugaacaaacaagcugcccccag

SEQ ID NO: 232760 - RNA, 65 nt, hsa
aacccagcacauuaucugcacuauaagcucaaagaaugucacauccgcccagacagcucuuugau

SEQ ID NO: 232761 - RNA, 65 nt, hsa
uauggugauuuagcagaacacaagagagcaagaaaaugucacaucuauaccaaauuaaggauguu

SEQ ID NO: 232762 - RNA, 65 nt, hsa
uuuuuuuuuaaguagaaaaauuguuuccaaagugcaugucacaugccacaaccacggucacaccu

SEQ ID NO: 232763 - RNA, 65 nt, hsa
aguccauuucauuaggaacuuuuuuguuugaaugaaugucacauagguauccucaguaacacaga

SEQ ID NO: 232764 - RNA, 65 nt, hsa
acugcugaggaagguuuauggauuugacagggugcaugucacagagagacaguucucagucagca

SEQ ID NO: 232765 - RNA, 65 nt, hsa
uacugucucuugaucugaucucacuaaggaucacaaugucacagaugaaacuuaaaugauaaccc

SEQ ID NO: 232766 - RNA, 65 nt, hsa
auuagauaaugacacaaucaaauauaaauugcaagaugucacaggugugaugaagggagaguagg

SEQ ID NO: 232767 - RNA, 65 nt, hsa
ggacauuccaaaacauuuaccauuagagaggggggaugucacacgcaggauucuguggggacugu

SEQ ID NO: 232768 - RNA, 65 nt, hsa
gaggagaucaugaucuuuauacugugaauagcagaaugucacagaugaagaauauuaaaauuagg

SEQ ID NO: 232769 - RNA, 65 nt, hsa
auuuucuccuucuucuaggaaaucccuucugagugaugucacaucuuggcagggguggaggagag

SEQ ID NO: 232770 - RNA, 65 nt, hsa
aagccaucaggacagaguagcagugucuguuucccaugucacaaguccucuggccucucccugca

SEQ ID NO: 232771 - RNA, 65 nt, hsa
uaacuagaauauauuauuuuagguauaauuuacaaaugucacaccuaauaaucuuuuauaauaua

SEQ ID NO: 232772 - RNA, 65 nt, hsa
auauuuauuugccuguauuucauuucccccaaugaaugucacaaggagaugggcacggagcugcu

SEQ ID NO: 232773 - RNA, 65 nt, hsa
ugagagggaaggggacagauguuucucauugcauaaugucacaguugccucaaaugagcaccauu

SEQ ID NO: 232774 - RNA, 65 nt, hsa
aauaaauuugcacacagauaacaugcaugcuauuuaugucacaucucacauuaaauuauuuuaaa

SEQ ID NO: 232775 - RNA, 65 nt, hsa
uauaacuugauugaaaaugacaacuuuuugcacccaugucacagaauacuuguuacgcauuguuc

SEQ ID NO: 232776 - RNA, 65 nt, hsa
aggccccaaccacggauuuuuuuucucaguggcccaugucacaaacccuaucucaggaauuucuu

SEQ ID NO: 232777 - RNA, 65 nt, hsa
ccauugauauucuuguuuauucuuuuuaaauaaaaaugucacaaguuuaauagaucagccuugua

SEQ ID NO: 232778 - RNA, 65 nt, hsa
acagggacccuuguaaauugucauacgccaauaaaaugucacaaguaauaacugcuguuguuugu

SEQ ID NO: 232779 - RNA, 65 nt, hsa
gauaauuuacucagguagcacuccagucacaaacaaugucacagagaugaaacagauucaaagaa

SEQ ID NO: 232780 - RNA, 65 nt, hsa
uguuuuguuuucuuuuuuacaggauaaguuuauguaugucacagaugacuggauuaauuaagugc

SEQ ID NO: 232781 - RNA, 65 nt, hsa
ugccugggggggcggggacuccgcacaugccugugaugucacaguuacugucaguucacagugaa

SEQ ID NO: 232782 - RNA, 65 nt, hsa
aggaacuguccagagagcaacucugagaucuaaggaugucacagggccaacuugagggcccagag

SEQ ID NO: 232783 - RNA, 65 nt, hsa
agcaucugugauagcuucugucccuucaucgguucaugucacagggauuuucuuucccaggaagc

SEQ ID NO: 232784 - RNA, 65 nt, hsa
auucuaugucuuuaaaaauuugaucuugacauuuaaugucacaaaguuuuguuuuuuuaaaaagu

SEQ ID NO: 232785 - RNA, 65 nt, hsa
auauccaugaccaagauugacauguugcucacaacaugucacaauuuagugaggagcuacaugua

SEQ ID NO: 232786 - RNA, 65 nt, hsa
uuucugggggcgggcaagcuggcgguagauuugugaugucacagugcaaacugcagugacuguaa

SEQ ID NO: 232787 - RNA, 65 nt, hsa
gccacagcgggcucucagcacccuucccacgucccaugucacaggcucuuugagcugcuggcuuu

SEQ ID NO: 232788 - RNA, 65 nt, hsa
gcuaauucagugucacaugaggaaguagcugucagaugucacauaauuacuuucguaauagcuca

SEQ ID NO: 232789 - RNA, 65 nt, hsa
aauggaaaucaaaacugaaauagccucccuuuagaaugucacauuuuucuuagaaaacauuuugg

SEQ ID NO: 232790 - RNA, 65 nt, hsa
gugaacuccaucauucauccaggacugagaugcaaaugucacaguaaugcaagcaaaguaucaaa

SEQ ID NO: 232791 - RNA, 65 nt, hsa
ggaacacgugcagguuuguucuauagaucaauuacaugucacagggguuugguguacauauuauu

SEQ ID NO: 232792 - RNA, 56 nt, hsa
uugagauggaggaguuauaaaaagaaaugucacagaagaaaaccacaaacuuguuu

SEQ ID NO: 232793 - RNA, 65 nt, hsa
uaacaucccugugagauugaauacuugugccacacaugucacaaaagaguauggaaauaaaagaa

SEQ ID NO: 232794 - RNA, 65 nt, hsa
cucagcugagacaugaaacuauuugaaauggcuuuaugucacagaagacuuuaauccgucaaauu

SEQ ID NO: 232795 - RNA, 65 nt, hsa
agucucccaggcccccugcaucuaucgaguuugcaaugucacaaccucucugaucuugugcucag

SEQ ID NO: 232796 - RNA, 65 nt, hsa
ucugacuguggggguggggggugugaaugaaauggaugucacagagugucaugugucugaugcag

SEQ ID NO: 232797 - RNA, 65 nt, hsa
uguuaugaaucugugcuggccauggacgaauaugaaugucacauuugaauucuugaucucuaaug

SEQ ID NO: 232798 - RNA, 65 nt, hsa
agguauuugcuuaagugaucauaauuguaaaguauaugucacauugucacauuaaugucacacug

SEQ ID NO: 232799 - RNA, 65 nt, hsa
uuuauugacuuuccaaaguuucaggaauuacuuuuaugucacauugagugggaggcuucauccaa

SEQ ID NO: 232800 - RNA, 65 nt, hsa
gcauaaaaacuuccaguacuuugguugacccuuguaugucacagcucugcucuauuuauuauuau

SEQ ID NO: 232801 - RNA, 65 nt, hsa
auuuugcuaagaaacaaacuuugaaugucaaacugaugucacaguaguuuuuguuagcuuuaaau

SEQ ID NO: 232802 - RNA, 65 nt, hsa
uucauaaaauccauauuuuaagacaauaguucuucaugucacaaacacaaucuauucuacaugag

SEQ ID NO: 232803 - RNA, 65 nt, hsa
aacaccuccacuaccucacugacuucauaauuggaaugucacaugguuuuuuuaaucaagaugca

SEQ ID NO: 232804 - RNA, 65 nt, hsa
gaagggcucuuucacagcuggcagagcgagagaauaugucacauuucugacaguuacccccaacc

SEQ ID NO: 232805 - RNA, 65 nt, hsa
agcggcauccucagucguuguuacuuacucagcugaugucacagugcagacauccaccguuccac

SEQ ID NO: 232806 - RNA, 65 nt, hsa
cguuagcugcaucugcccuggcuguuugcccguucaugucacaaacugccacuacuauguaccug

SEQ ID NO: 232807 - RNA, 65 nt, hsa
agaugggagccuagcuaauaauccauauccaggugaugucacaaaguuuggccguggggacucug

SEQ ID NO: 232808 - RNA, 65 nt, hsa
cccagcuucugcaguggaaaugccugguucagcagaugucacaggauuaaaugugcaguuugggg

SEQ ID NO: 232809 - RNA, 65 nt, hsa
ccuuuuuauucuuugugauuaaauccuguuuuaaaaugucacaaaacaggaaccagcauucuaau

SEQ ID NO: 232810 - RNA, 65 nt, hsa
uugaaucuuagaacuuuuguacacacuaaauauugaugucacaccauuucuaaucugagcauccu

SEQ ID NO: 232811 - RNA, 65 nt, hsa
guaguuuuguuacuacuguugcuuuuaagaagcaaaugucacaaggcuuucuucaaugggauguu

SEQ ID NO: 232812 - RNA, 65 nt, hsa
cugauuuuaaagaguguuagaaagccuuuagcaagaugucacaccuuguuguacaugagaaacuu

SEQ ID NO: 232813 - RNA, 65 nt, hsa
gcaguggagacugacuucuuccugcugacagcuggaugucacacaugaaggucuggccuagcgag

SEQ ID NO: 232814 - RNA, 65 nt, hsa
guccuccuggcagccccucaaacacacaccaccccaugucacacggguauccagagcaaggcugg

SEQ ID NO: 232815 - RNA, 65 nt, hsa
gcugcgggcccaggacagcugccgugagacucccgaugucacaggcagucugugugguuacagcg

SEQ ID NO: 232816 - RNA, 65 nt, hsa
aagccaccaugcugugcggaacugcgucagggcaaaugucacagcaggauuuccccaacccagcu

SEQ ID NO: 232817 - RNA, 65 nt, hsa
aaaagaggaccacacaucuguuggucacagaguucaugucacaccagugcuagaaguuucaugau

SEQ ID NO: 232818 - RNA, 65 nt, hsa
cagagaugugagaagauaauacagaugaaccaaagaugucacacaguugccauccacugcuuugg

SEQ ID NO: 232819 - RNA, 65 nt, hsa
gguagagacacuuaauaguaucaugucgcaugcagaugucacaucggccucugcaaaaacuguac

SEQ ID NO: 232820 - RNA, 65 nt, hsa
ugcccgucuugucccucugccccucccaccugcacaugucacacugaccacaucuguagacaucu

SEQ ID NO: 232821 - RNA, 65 nt, hsa
ggcuuaauauaggcguuuccccuuucacccaagugaugucacaguucgaugcaaaaucaaugauc

SEQ ID NO: 232822 - RNA, 65 nt, hsa
aauuauuuuaaaacguacacacuuuucuuguaaauaugucacaucugaguucaaaaaaauuacuu

SEQ ID NO: 232823 - RNA, 65 nt, hsa
guaaguaucauugaaaacaaaacaugcccgucaacaugucacagaaaacgaacgaaggacaacaa

SEQ ID NO: 232824 - RNA, 65 nt, hsa
aauuacuuguuacugacaccacagcaguauagcauaugucacagcuccugugauucaauguuaua

SEQ ID NO: 232825 - RNA, 65 nt, hsa
cauucccugaccacagggaagcaccuggcucaaucaugucacacagcaguggaaagaauacggac

SEQ ID NO: 232826 - RNA, 65 nt, hsa
uugcucucagcugcagagacacagagacacugcagaugucacacgcuuucaucuucccuuugagc

SEQ ID NO: 232827 - RNA, 65 nt, hsa
ccuagacuaugaggcaggcauugucucauuuuucaaugucacaaaccacggagcacucaucuaca

SEQ ID NO: 232828 - RNA, 65 nt, hsa
aauaaaggcuguaucuaaaauaucaaagguucuauaugucacacaaucguaauuccaaaagccau

SEQ ID NO: 232829 - RNA, 65 nt, hsa
guuggguuuuuggaccccagggauaagcuuuuccgaugucacaauguggaggaaagcaccugggg

SEQ ID NO: 232830 - RNA, 65 nt, hsa
ugggccaccgggcagccuggggcggugugugugccaugucacagcauggccucucggccuuggga

SEQ ID NO: 232831 - RNA, 65 nt, hsa
aaauuccagagaacaauggaagcauugccuggcagaugucacaacagaauaaccacuuguuugga

SEQ ID NO: 232832 - RNA, 65 nt, hsa
uaacuaaauacucagacuuagaagucagaugcuucaugucacagcauuuaguuuguucaacaguu

SEQ ID NO: 232833 - RNA, 65 nt, hsa
acauuuuuggugagugcugcuuuuauaaauaugugaugucacauauuucagugacagcugauguu

SEQ ID NO: 232834 - RNA, 65 nt, hsa
gcuggcugacaugcccagggcuccacucucaucuaaugucacagcccucagaacuaaagcggacu

SEQ ID NO: 232835 - RNA, 65 nt, hsa
auuacuagagcuuuggucaguauuuccuucccuauaugucacagagggcaccacugagaacugcg

SEQ ID NO: 232836 - RNA, 65 nt, hsa
gggggcagaugucaaaauaccuguacaauuuuaaaaugucacaauuaaacaugagcugguuuccc

SEQ ID NO: 232837 - RNA, 65 nt, hsa
augcaguuguguccaguuggaggccaggguaccacaugucacaggcggccuuacaugugugccgu

SEQ ID NO: 232838 - RNA, 65 nt, hsa
gaguguaagagugcuggacaggaaccuccacccucaugucacauuucuucaaugugacccuucug

SEQ ID NO: 232839 - RNA, 65 nt, hsa
ugcaguaauucaaaagcugguauuuuucuuccuaaaugucacauagcaaaggcugcccaaauccc

SEQ ID NO: 232840 - RNA, 65 nt, hsa
cuccugugagucauuggcuggguucugauugcuagaugucacacccaccagcaucaccaaaguga

SEQ ID NO: 232841 - RNA, 65 nt, hsa
aaaucuguuagcauaauuccaagguggccaagcagaugucacauggaguuagucaaagcacaaag

SEQ ID NO: 232842 - RNA, 65 nt, hsa
agagauccccauggcugaauacuccaaauaauccuaugucacaauauauuccauugcaucugaca

SEQ ID NO: 232843 - RNA, 65 nt, hsa
cguucuaaucaugagaucuuggggacaaauugacuaugucacagguugcucuccuuguaacucau

SEQ ID NO: 232844 - RNA, 65 nt, hsa
uuauugccagggagugagguacaagacgauggcucaugucacaggccuaccugauacggugucag

SEQ ID NO: 232845 - RNA, 65 nt, hsa
aguaguagaaccuguucugaaaccagaaacuguugaugucacauccuuugacccuggucugagcu

SEQ ID NO: 232846 - RNA, 65 nt, hsa
uauucugguccgaggguucaguuccuuuagucaagaugucacaaguuuaaaaacaaaacuugaga

SEQ ID NO: 232847 - RNA, 65 nt, hsa
cuugccuugcuccaggaugggguggcagcagaggaaugucacaggucagcagccuaggccuccag

SEQ ID NO: 232848 - RNA, 65 nt, hsa
uguacgagcucccugaaccauuguucagaggaccaaugucacaucgcuucaugggcauggcccau

SEQ ID NO: 232849 - RNA, 65 nt, hsa
aaguacgauuuacuguagugucuuaucacucuuucaugucacaauagcguggagcauuagagaaa

SEQ ID NO: 232850 - RNA, 65 nt, hsa
auuucucccuauguuuauuuuuguacauuugagccaugucacacaaacugaugaugacaggucag

SEQ ID NO: 232851 - RNA, 65 nt, hsa
gcccagaggaccacgcagaggcaaugguaguacagaugucacagcugaggguacgaugaggccug

SEQ ID NO: 232852 - RNA, 65 nt, hsa
uucguacuuugggacuuugauagcaacuuccaggaaugucacacacgaugaaauaucucugcuga

SEQ ID NO: 232853 - RNA, 65 nt, hsa
aguccguguuaagguaaauaucuguuuucuuccugaugucacagccugagcauacucugugcauu

SEQ ID NO: 232854 - RNA, 65 nt, hsa
ucucagauuuacagcuuuuuuuugucauuggcuugaugucacacauuuccaaucucuugcaagcc

SEQ ID NO: 232855 - RNA, 65 nt, hsa
uuuucuuaacuuuuuauuagcucuuccuaagggaaaugucacauauuauuauuuaauuguacuug

SEQ ID NO: 232856 - RNA, 65 nt, hsa
guuccuguugugugguuuauagauuucgaagcaacaugucacaacaauaaccuccauagcaccuc

SEQ ID NO: 232857 - RNA, 65 nt, hsa
acauuucuguacuguuccucuuucacagcuggaauaugucacaugaugaaguuguauagaaacag

SEQ ID NO: 232858 - RNA, 65 nt, hsa
auccaggagacagagccccugccccauggcccuggaugucacacucccaccagggcugaagacaa

SEQ ID NO: 232859 - RNA, 65 nt, hsa
gcugucucucagagaucuugcauuucugcucucuuaugucacagcuggccugcagcaggucccug

SEQ ID NO: 232860 - RNA, 65 nt, hsa
auuuaguucuuaagaaaccuguucuuaauguuggcaugucacauuuuucuguuacuauaaucaga

SEQ ID NO: 232861 - RNA, 65 nt, hsa
ggcuccucuuggggauggauuauggaauuuaaaccaugucacagcugugaagaucuggcacaaga

SEQ ID NO: 232862 - RNA, 65 nt, hsa
gaaugacucagauuucauagaaaggagcaaccaaaaugucacaacccaaaacuuuacaagcuuug

SEQ ID NO: 232863 - RNA, 65 nt, hsa
guaauugugauuuaccugugccaaaggugcuuuaaaugucacauuuguaaaggggaaggcggaca

SEQ ID NO: 232864 - RNA, 65 nt, hsa
aauagguuuggugcuuaucuucuaauaagauuuaaaugucacaaacuguagcacaaauaauauaa

SEQ ID NO: 232865 - RNA, 65 nt, hsa
gaaaaaaaaaagucaaauucaaauaucaucuggacaugucacaauggaucgcggauccuuaugag

SEQ ID NO: 232866 - RNA, 65 nt, hsa
aggauagggauagguaagguaaacuuguaaaaaggaugucacagaagucacuuuuuaauuaaguc

SEQ ID NO: 232867 - RNA, 65 nt, hsa
uggaagugcagucagcagaugcuguugugaagcuaaugucacaauuaugugcaaaggugugcuuc

SEQ ID NO: 232868 - RNA, 65 nt, hsa
gguugucuccaggccaugauggccuuacacugaaaaugucacauucuauuuuggguauuaauaua

SEQ ID NO: 232869 - RNA, 65 nt, hsa
agauuacuuuuucaacuguaaauaauguacauuuaaugucacaagaaaaaaaugucuucugcaaa

SEQ ID NO: 232870 - RNA, 65 nt, hsa
cguuagaaaagugaccccaucaaacugagccuuugaugucacauucugacacaagaugcaagucu

SEQ ID NO: 232871 - RNA, 65 nt, hsa
uauauaaguaaucagaacacuuagaagacugauagaugucacacagugguauuauagaaggauaa

SEQ ID NO: 232872 - RNA, 65 nt, hsa
gcccaaaccucagcauucugcaauauguaaccaacaugucacaaacaagcagcauguaacagacu

SEQ ID NO: 232873 - RNA, 65 nt, hsa
uucagagugaagaucugucuggcuuuaucaccaggaugucacaugucagagaguaucauuaaaag

SEQ ID NO: 232874 - RNA, 65 nt, hsa
guaugagaagaacauaaugaagccugacucagcuaaugucacaacauggugcuacuucuucuucu

SEQ ID NO: 232875 - RNA, 65 nt, hsa
agcucagaauacccauguagcagcaacuugaacgaaugucacaacuuguacguuuuuuauauacu

SEQ ID NO: 232876 - RNA, 65 nt, hsa
ucacuguugacccuaccucacgugccgagacucucaugucacaggcgugccuugcugccccccug

SEQ ID NO: 232877 - RNA, 65 nt, hsa
ggcugggggaacugugucuggucaaguuauggcagaugucacagcuuuagguagguaaaaagggu

SEQ ID NO: 232878 - RNA, 65 nt, hsa
ggaaccauacacuucuggcauguuuggaaaucaaaaugucacauucucgggggaggaagcccaga

SEQ ID NO: 232879 - RNA, 65 nt, hsa
gacaguguuuuucacucugugguaagcugaggaauaugucacauuuucagucaaagaaccaugau

SEQ ID NO: 232880 - RNA, 65 nt, hsa
guuugcauucugugaaaugccucuccacguugcauaugucacacuuuugucugcacauaacucuu

SEQ ID NO: 232881 - RNA, 65 nt, hsa
accauugaccauuauuauagggacccaugaaguaaaugucacaaucaucuuacuagcucucucuc

SEQ ID NO: 232882 - RNA, 65 nt, hsa
cuuuacauaugucuuaucagguauaacauguugaaaugucacauuaguaguaaagugggguuuau

SEQ ID NO: 232883 - RNA, 65 nt, hsa
guaucagcuuguuugguacuaggugcaaguguagcaugucacaugugaccauguuggaucauuga

SEQ ID NO: 232884 - RNA, 65 nt, hsa
aucucugucccgucggcacuggcugcaugaucgugaugucacacgguacaauguccuacccacaa

SEQ ID NO: 232885 - RNA, 65 nt, hsa
uuuugauuaauguuucuuaaauggaauuauuuugaaugucacaaauugaucaagauauuaaaaug

SEQ ID NO: 232886 - RNA, 65 nt, hsa
ccccagacucuuuuuuugagugacagcuuucugggaugucacaguccaaccagaaacaccccucu

SEQ ID NO: 232887 - RNA, 65 nt, hsa
uuuaaaaaugaaucuugcuucauuugaugaauuucaugucacaaagcuucucucaagagcucucg

SEQ ID NO: 232888 - RNA, 65 nt, hsa
cuccuucagccuccuccucccucaucuguucccugaugucacauucccugugcaaucuucccuug

SEQ ID NO: 232889 - RNA, 65 nt, hsa
ugauuuugcuaaacuccuguucccuacaaugggaaaugucacaagaaugugcaaaaauaaaaauc

SEQ ID NO: 232890 - RNA, 65 nt, hsa
cggucauuccugucaacaaggggucaaugucauaaaugucacaauaaaacaaucucuucuuuuuu

SEQ ID NO: 232891 - RNA, 65 nt, hsa
ggacaccgagguccagaggaaaagacaccugucaaaugucacagaucugggaggggacuuaagac

SEQ ID NO: 232892 - RNA, 65 nt, hsa
acagcacacccuucgcggcugucagcgcucuccugaugucacaguggcugcguguccuuggggug

SEQ ID NO: 232893 - RNA, 65 nt, hsa
aagggagcaagacaagagcaagcaacggcuauuaaaugucacaauccuuuaauuagaaaccauuu

SEQ ID NO: 232894 - RNA, 65 nt, hsa
ugacagugccaauaaaugauaaaaaaaaaauuaacaugucacaauguaacggaugaccauaugca

SEQ ID NO: 232895 - RNA, 65 nt, hsa
gugucuuuuuucacuacauuauaaaugucucuuuaaugucacaggcagguccaggguuugaguuc

SEQ ID NO: 232896 - RNA, 65 nt, hsa
aguacacgucacauuauuuuaccggugagaugagaaugucacaaacauuaaaagccuuaugugcu

SEQ ID NO: 232897 - RNA, 65 nt, hsa
cggccgcucugugacuggaguuaugcucuuuugaaaugucacaaggccgccucccaccucugggg

SEQ ID NO: 232898 - RNA, 65 nt, hsa
gcugaaagcugcggcgccacuggugccagagucagaugucacagauguguuguguaaacaguugg

SEQ ID NO: 232899 - RNA, 65 nt, hsa
aauacccuguuuuugaguuuauuuuguuucugucuaugucacaguguuccucuacgacccgaccu

SEQ ID NO: 232900 - RNA, 65 nt, hsa
uuauuggaaaguauucaaauaaauaugguuugaauaugucacaaggucuuuuuuuuuaaagcacu

SEQ ID NO: 232901 - RNA, 65 nt, hsa
uuuguguccuuaggcaaagcugugggagucuugaaaugucacaguaguaaauaacuuauuacuuu

SEQ ID NO: 232902 - RNA, 65 nt, hsa
acucauucccucaaaauauuuauugagcaccaacaaugucacaagcacugugcuaaacacugugg

SEQ ID NO: 232903 - RNA, 65 nt, hsa
acacuaaaauguuuuaaguuuucuuauugcuaacaaugucacagugaacauuuauauauucauua

SEQ ID NO: 232904 - RNA, 65 nt, hsa
cccgguccugcccuuccugaagaagaucccagaggaugucacaaagaucaugaaaguccagguua

SEQ ID NO: 232905 - RNA, 65 nt, hsa
gauguggccugaaagcacuuagcgggcgcgcugggaugucacagaguuggagucauuguuggggg

SEQ ID NO: 232906 - RNA, 65 nt, hsa
aucuucuagugccauucuccucucuguucagguaaaugucacacugugcccagaauggaugacca

SEQ ID NO: 232907 - RNA, 65 nt, hsa
ccucuguagcauuccagcggcuugaccaaugaccuaugucacaagagguggcguguaaggaaugc

SEQ ID NO: 232908 - RNA, 65 nt, hsa
augucuuauccucacaacaaaaguauugcgcuguaaugucacagagcugguuucagcaugguauu

SEQ ID NO: 232909 - RNA, 65 nt, hsa
agccaugcuaaggugguuuucagauuccacacaaaaugucacacuuguuucuuguucauccaagg

SEQ ID NO: 232910 - RNA, 65 nt, hsa
auuuauauuggcauuuuucaacccagugucacuagaugucacacacauuuguggugcuuugaugu

SEQ ID NO: 232911 - RNA, 65 nt, hsa
cuauuaaacugaguuuaacaauggcaaaauacaguaugucacagucaugcacauucaagagagaa

SEQ ID NO: 232912 - RNA, 65 nt, hsa
uuuauuacauuagcagaagcaugcacaaagagauaaugucacagugcuacaauuaggucuuuguc

SEQ ID NO: 232913 - RNA, 65 nt, hsa
aucccaaauuauaaaugugacaaucucauuggaacaugucacaaaaaguuaaugugauuaagauu

SEQ ID NO: 232914 - RNA, 65 nt, hsa
aaucuguuuaucauacauuuauuauuuaugacuuuaugucacauugaagaauuucuucaugauac

SEQ ID NO: 232915 - RNA, 65 nt, hsa
gacagugacagccuccgucagacucccgcgugaagaugucacaagggauuggcaauuguccccag

SEQ ID NO: 232916 - RNA, 65 nt, hsa
gcacauauuggucaccuacugugugccuggcacucaugucacaaagauaaguuccugauucggua

SEQ ID NO: 232917 - RNA, 65 nt, hsa
uuaaaauaauaauaauaacacaucuuuggucaucuaugucacacaaaaauuuuccuuuguuugcg

SEQ ID NO: 232918 - RNA, 65 nt, hsa
aauuuauacuggacagaaauccuaaagugugaagaaugucacaaagcccuuaauaaguccucaau

SEQ ID NO: 232919 - RNA, 65 nt, hsa
uguuucauacuggagcgaaacuacaauccugaaugaugucacagugcuuuuaacaauaccucaaa

SEQ ID NO: 232920 - RNA, 65 nt, hsa
cuucugaggggcugcccugagagcauucaguucacaugucacaggguauggugugacagggugcc

SEQ ID NO: 232921 - RNA, 65 nt, hsa
uguaugaauaugaccaguuucaagcagagcccaaaaugucacaguugucaagagaacacacaaca

SEQ ID NO: 232922 - RNA, 65 nt, hsa
ugacaagugacaucuugaaaaugccacauucccucaugucacaggaaguucugggaucaccaagg

SEQ ID NO: 232923 - RNA, 65 nt, hsa
aucaaaucugugcucuuucauuugcuaaguguaugaugucacacaagcuccuuaaccuuccaugu

SEQ ID NO: 232924 - RNA, 65 nt, hsa
uaugcaaaacauaggagaauucaugcaggagagaaaugucacaagugugaugaguguugcaaagc

SEQ ID NO: 232925 - RNA, 65 nt, hsa
uuuaguauagauccuccuugacuuaugaugggguuaugucacaauaaacccauugcaaguugaaa

SEQ ID NO: 232926 - RNA, 65 nt, hsa
ggauggggggagagagagaaaauccacaaauuccaaugucacaaaagcaauaaaacaaacuagaa

SEQ ID NO: 232927 - RNA, 65 nt, hsa
caaccuccagcaugggugucauagccaucacgagcaugucacagugccgcagagauuuuguuuau

SEQ ID NO: 232928 - RNA, 65 nt, hsa
cagccuccagcaugggcgucauagccaucacgagcaugucacagugcugcagagauuuuguuuau

SEQ ID NO: 232929 - RNA, 65 nt, hsa
gcacugaugaugcuccggccuucucacgucagugcaugucacaugcauccugcuccaggacuggu

SEQ ID NO: 232930 - RNA, 65 nt, hsa
acagacgcggcgauggcaucacacagacggugaugaugucacacacagacacagugacaacacac

SEQ ID NO: 232931 - RNA, 65 nt, hsa
cgacgucacgggccaugucgacgucacacauauuaaugucacacagacgcggcgauggcaucaca

SEQ ID NO: 232932 - RNA, 65 nt, hsa
uguauauuauuguaaauagaaaugaccacagcagaaugucacacauggcuguucuggagagggcc

SEQ ID NO: 232933 - RNA, 65 nt, hsa
uguauauuauuguaaauagaaaugaccacaucagaaugucacacauggcuguucuggagagggcc

SEQ ID NO: 232934 - RNA, 65 nt, hsa
auuuacacuuaggguuuggagcuauucaagaggaaaugucacagaagcagcuaaaccaaggacug

SEQ ID NO: 232935 - RNA, 65 nt, hsa
ucuugguauaaaggcuucuccggaucaguacaugcaugucacauuaacacacacacacacacaca

SEQ ID NO: 232936 - RNA, 65 nt, hsa
uuuauuuacauguauauuuucacaugaaauaccaaaugucacagcauuauuacugaaugucaguc

SEQ ID NO: 232937 - RNA, 65 nt, hsa
uuuccgguggguauguucauucuucaacuguucuuaugucacagagggcuccuugcuggugggca

SEQ ID NO: 232938 - RNA, 65 nt, hsa
uucguuugugcuauaaccucaaacuuugauuucuaaugucacacuuaaaacuguguggaauaaga

SEQ ID NO: 232939 - RNA, 65 nt, hsa
auccuugcuuuccagcccuaagccaucucagccugaugucacaacccaauaaauggggcacuuuc

SEQ ID NO: 232940 - RNA, 65 nt, hsa
agcucuuuuucugugagcuggguugcacaggaagaaugucacagggaaccaaaaagcacagaaaa

SEQ ID NO: 232941 - RNA, 65 nt, hsa
aaccaaggcuaagagaugagcgaugccucucccagaugucacaauuagaaguggcagagucaggu

SEQ ID NO: 232942 - RNA, 65 nt, hsa
uugcugucacuuuggcgagggaguggauauagggcaugucacaaaagaacaaaauaacccgaccu

SEQ ID NO: 232943 - RNA, 65 nt, hsa
cgaaaggaaaauugacccggaaguuccuguaauaaaugucacaauaaaacgaaugaaugaaaaug

SEQ ID NO: 232944 - RNA, 65 nt, hsa
gcucugcucucucauacgcguguauguuugguuccaugucacagcccccuaggagccagugaugc

SEQ ID NO: 232945 - RNA, 65 nt, hsa
aucaucagguaaaugagucagcauauccuuguaguaugucacaguauacgcccaaauuguuuuca

SEQ ID NO: 232946 - RNA, 65 nt, hsa
ccugugcgggugccccugacuucgaccccuagcuuaugucacagcccgaaccagaucgacugguc

SEQ ID NO: 232947 - RNA, 65 nt, hsa
gaaguuucagucggugagccuugggcaccucacccaugucacauccugucuccugcaauuggaau

SEQ ID NO: 232948 - RNA, 65 nt, hsa
uuuuaaaaauucucauuacauagacgcacaagaauaugucacauaaagaaaauguguuuagaaua

SEQ ID NO: 232949 - RNA, 65 nt, hsa
uuucccaaccaauagaaacuauuuauuguaagcuuaugucacaggccuggacuaaauugauuuua

SEQ ID NO: 232950 - RNA, 65 nt, hsa
acuaacaaguguuguuuuggguccaugccuggaccaugucacaaaaaggaggugccccccugugc

SEQ ID NO: 232951 - RNA, 65 nt, hsa
ugcuguggccugagguagcaggugggaaguuagggaugucacagaaaugucugugucugaaucca

SEQ ID NO: 232952 - RNA, 65 nt, hsa
cugugcuagcagcucagcagggccucuaaccugugaugucacacucaagaggccuuggcagcucc

SEQ ID NO: 232953 - RNA, 65 nt, hsa
gccgaguagccagcugcauugcuuagauuugauucaugucacagcauaaauugucuugauuccaa

SEQ ID NO: 232954 - RNA, 65 nt, hsa
uaagcuaccugguaaaggguuugaacauuuacaaaaugucacacuuuuucuuaaaagaaaaauau

SEQ ID NO: 232955 - RNA, 65 nt, hsa
cuuccaaugaaaccaagaauuucucaaaauauuuaaugucacauauuauaagaaguuaccuaauc

SEQ ID NO: 232956 - RNA, 65 nt, hsa
uccuagaauuggcacuuucugccuccuugcucuaaaugucacaaaaaauuauacuuccuuaaagu

SEQ ID NO: 232957 - RNA, 65 nt, hsa
ugacuuuauuagggacacuaaacuacaucauuaacaugucacagcuugguugacaauaaucacca

SEQ ID NO: 232958 - RNA, 65 nt, hsa
cucuugcucuuuugcaucuaauaauuuuuggcugaaugucacagauguuguauguaggacaguag

SEQ ID NO: 232959 - RNA, 65 nt, hsa
aaaaagaagacaagcugaagcuacacacauggcugaugucacauugaaaaugugacugaaaauuu

SEQ ID NO: 232960 - RNA, 65 nt, hsa
gaagacauucauaggucccaaaucugcccauucagaugucacauaauauggugggauaucaauuu

SEQ ID NO: 232961 - RNA, 65 nt, hsa
caaaucacaaauuguucaguucuuaaaauguaauuaugucacacacacaaaaaauccuuuucaau

SEQ ID NO: 232962 - RNA, 65 nt, hsa
agaacauucucaaaaaucuugugggucuucuacguaugucacauugauucacacauucagaaaag

SEQ ID NO: 232963 - RNA, 65 nt, hsa
aggugcaccucaggcugcacaaauaccccaccagaaugucacaaucauucauugcuccagcuacu

SEQ ID NO: 232964 - RNA, 65 nt, hsa
aaacauaguuauguuuucucuaacuugaugaggucaugucacagaccauuuuaucccuucagugg

SEQ ID NO: 232965 - RNA, 65 nt, hsa
uuuguauuauuuuuuuuauucgugcauauuugcucaugucacaggaauauggaagagauugugua

SEQ ID NO: 232966 - RNA, 65 nt, hsa
ugcuagggcaauucuaccaagacacucaauggaauaugucacacuccuuaauagggaccugugac

SEQ ID NO: 232967 - RNA, 65 nt, hsa
cagcauauguaaaaaaaaaaaaaaagggaauugacaugucacauaucaaaugaauggaaacuuug

SEQ ID NO: 232968 - RNA, 65 nt, hsa
agcucuacaaucaaaaugaauacuugaucaaugaaaugucacauuauucauccugaguccgagac

SEQ ID NO: 232969 - RNA, 65 nt, hsa
ucuauagacugacuuuuuccauuuuuuaaauguucaugucacauccuaauagaaagaaauuacuu

SEQ ID NO: 232970 - RNA, 65 nt, hsa
uggcccccaauggucagaagagccaucccauggccaugucacagggauagauggacauuuguuga

SEQ ID NO: 232971 - RNA, 65 nt, hsa
acuucagggcuggaaaagucacacagacacacaaaaugucacaauccugucccucacucaacaca

SEQ ID NO: 232972 - RNA, 65 nt, hsa
gguauaauucagaucauuuuagcuuguugcugaggaugucacauauaagacaggaucaaaccuga

SEQ ID NO: 232973 - RNA, 65 nt, hsa
caaaucacaaauuguucaguucuuaaaauguaauuaugucacacacacaaaaaaauccuuuucaa

SEQ ID NO: 232974 - RNA, 64 nt, hsa
gucacccccaccccgcggaucacagcucacccacgcggcgcacaccccuccugccguugucauc

SEQ ID NO: 232975 - RNA, 64 nt, hsa
gggccaccgagaggccgaagaaggccaaggaggagcggcgcauggaccagguaggccugcggcu

SEQ ID NO: 232976 - RNA, 64 nt, hsa
acagggaugcucacgggugcaccaggagccaggugcggcgcagccaacccugagccugcaggga

SEQ ID NO: 232977 - RNA, 64 nt, hsa
uaccugggcacgccagucugcaccaugugucccugcggcgcaugagugacuggcguauuuagcc

SEQ ID NO: 232978 - RNA, 64 nt, hsa
acuaaaaaugcaaaaaaaaauuuagcuaggcauggcggcgcaugccugcaaucccagcuacuug

SEQ ID NO: 232979 - RNA, 64 nt, hsa
agggccaaagcacagcugggcaugccaugucugagcggcgcagagcccuccaggccugcagggg

SEQ ID NO: 232980 - RNA, 64 nt, hsa
aucaaguagcugcuggauguugacgaaggaagcggcggcgcagcucagggaucuccgagucagg

SEQ ID NO: 232981 - RNA, 64 nt, hsa
ccuagagugcuguggacuggacccaggagccccggcggcgcagcugcaagguugccaggaccca

SEQ ID NO: 232982 - RNA, 64 nt, hsa
ggccucuccugccccaggaggacaucucacggcugcggcgcaagcuggaaaagcagaggaaggu

SEQ ID NO: 232983 - RNA, 64 nt, hsa
ccaucugcaccgacgccugcccccgucccaccucgcggcgcagccccuggagcuccugcugggg

SEQ ID NO: 232984 - RNA, 64 nt, hsa
ggugugcagccucucaucucacacugugaguccagcggcgcagggugguaccaggaaagaggau

SEQ ID NO: 232985 - RNA, 64 nt, hsa
aggaguuucacuacaaucgcuaccugacgcggcggcggcgcaucgagaucgcgcacgcccugug

SEQ ID NO: 232986 - RNA, 64 nt, hsa
ggggggcgugcucucgggggggccucacgcacccgcggcgcaggagcuucaguggucuggggcc

SEQ ID NO: 232987 - RNA, 64 nt, hsa
cuaagccagcccacccugggcugggcccaggugcgcggcgcagagccuuugggaauaaaaagcc

SEQ ID NO: 232988 - RNA, 64 nt, hsa
uggacagcgagcugggcaccugggagcaccagcugcggcgcauggagauggauaagaccagggg

SEQ ID NO: 232989 - RNA, 64 nt, hsa
cagccauuccugcagccaagggcacugggccagggcggcgcacgcgcaagaggcgcgcuucgag

SEQ ID NO: 232990 - RNA, 64 nt, hsa
uuuuuugaggagagugaaagagaguaccaugcuggcggcgcagagggaaggggccuacacccgu

SEQ ID NO: 232991 - RNA, 64 nt, hsa
aagggguggggccgaggaugcaaguccaggcagagcggcgcaggcagcugugagcuuuucucca

SEQ ID NO: 232992 - RNA, 64 nt, hsa
cgcguggagacuuaugacucgucgugggcgcauggcggcgcaccugcugcaggagcggccacgu

SEQ ID NO: 232993 - RNA, 64 nt, hsa
agacgcaggccucuccauuguccaggggagccuggcggcgcaucccuccucucccaccuccugg

SEQ ID NO: 232994 - RNA, 64 nt, hsa
uagagacaaaacaagcagacaccugaaacaaucaacgcccaauaaaacaaaguaggaugaaaau

SEQ ID NO: 232995 - RNA, 64 nt, hsa
uggcugggguuccugguggauuucuuacuaccuaacgcccaagaaaaccaacuaaggacucuca

SEQ ID NO: 232996 - RNA, 64 nt, hsa
cugggauuacaggcgugagccaccgugccuggccacgcccaacuaauuuuuguauuuuuaguag

SEQ ID NO: 232997 - RNA, 64 nt, hsa
acgugcuacccccaugcuggaggugacaucucuuacgcccaacccuuccccacugcacacaccu

SEQ ID NO: 232998 - RNA, 64 nt, hsa
ggaaagccccgccuccuacaggugccguggagccacgcccaaaagagagcucccuuagggaaaa

SEQ ID NO: 232999 - RNA, 64 nt, hsa
auuuugugaaccgugaaguacgugagacuagaagacgcccaaacaagucagauaauaguaacua

SEQ ID NO: 233000 - RNA, 64 nt, hsa
cauggcagucccuccgcagccccagucccuggccacgcccaagggaagagggaggugaggacuu

SEQ ID NO: 233001 - RNA, 64 nt, hsa
ggcgugagaggagcggcagccacacugcggccccacgcccaaggacugggcugcucucgagggg

SEQ ID NO: 233002 - RNA, 52 nt, hsa
ugaagcgcaaagcugaaugaaaacgcccaaaauaauuaguaggaguucaucu

SEQ ID NO: 233003 - RNA, 64 nt, hsa
ucccaaagugcugggauuacaggcgugagccaccacgcccaacugggaccaggguuuucuguuu

SEQ ID NO: 233004 - RNA, 64 nt, hsa
cuuaaauguagauaugugcugaaagaaaaaaaaaacgcccaacucuugaaguccauugcugaaa

SEQ ID NO: 233005 - RNA, 64 nt, hsa
aauagggggcacucauuuuguuucaacgguccaaacgcccaaccuucagaaagaggaagucaga

SEQ ID NO: 233006 - RNA, 64 nt, hsa
acugggcucuguccugcagacaccucuuucagaaacgcccaagcccagccccuaggagggggug

SEQ ID NO: 233007 - RNA, 64 nt, hsa
ucucacgucauauuauaggaaacucugacacagaacgcccaacguggacacaggugccaguuca

SEQ ID NO: 233008 - RNA, 64 nt, hsa
aaccacauaccccaggcccaagcgccuugcugccacgcccaaccucuuugggagaaguaugaau

SEQ ID NO: 233009 - RNA, 64 nt, hsa
auguauucucuauaaggcauucaauaaaugcacaacgcccaaaggaaauaaaauccuaucuaau

SEQ ID NO: 233010 - RNA, 64 nt, hsa
ggugaggcgggcucugcgugcgcaccgcgccuacacgcccaacgacgagugcuucuucaucuuc

SEQ ID NO: 233011 - RNA, 64 nt, hsa
ccacgggauuuguagccagccagcucccaggccaacgcccaaagcccugaugaccugguucuuc

SEQ ID NO: 233012 - RNA, 64 nt, hsa
agaaacguauugcucacaguccuggggggcugggacgcccaagaucaagaggccagcagauucg

SEQ ID NO: 233013 - RNA, 64 nt, hsa
ucccuaguagcugggauuauaggcgccccccaccacgcccaaguaacuuuuguauuuuuaguag

SEQ ID NO: 233014 - RNA, 64 nt, hsa
aaggaggcaggacagaggcaccgaggccagggagacgcccaacgaggcagcccugggcucuucu

SEQ ID NO: 233015 - RNA, 64 nt, hsa
acacacgugugcauguuccugugcgcugauguuuacgcccaagcauuucugaacaaaugaaacu

SEQ ID NO: 233016 - RNA, 64 nt, hsa
agacagccggcuagccccacugcccguuccuuuuacgcccaaguuuugcuccuugagagcagau

SEQ ID NO: 233017 - RNA, 64 nt, hsa
aagugaaucccgcaggacagcugcacucagggauacgcccaacaccauggccugcaaccccagg

SEQ ID NO: 233018 - RNA, 64 nt, hsa
ucucggugauaaaggcgcccacuggacccucccaacgcccaaugcuuugcuuuucuccuccucc

SEQ ID NO: 233019 - RNA, 64 nt, hsa
ccccuaguagcuggcauuacaggcacaugccaccacgcccaacuaauuuuuauauuuuuaguag

SEQ ID NO: 233020 - RNA, 64 nt, hsa
uucugaguagcugggauuacaggcaugcgccaccacgcccaacuaauuuuguauuuuuaguaga

SEQ ID NO: 233021 - RNA, 64 nt, hsa
gcccauggugccugucagcccgcagagcccaucuacgcccaacacagagcucacacaggucacu

SEQ ID NO: 233022 - RNA, 64 nt, hsa
ucccaaguagcugagauuacaggcgcacaccaccacgcccaacugauuuuuguauuuuuaguag

SEQ ID NO: 233023 - RNA, 64 nt, hsa
ugagucagcauauccuuguaguaugucacaguauacgcccaaauuguuuucaccauauugcaug

SEQ ID NO: 233024 - RNA, 64 nt, hsa
agauccuaauuuaugccuaugcaaaaaauaaaugacgcccaagagcugugggauguggcuuuca

SEQ ID NO: 233025 - RNA, 64 nt, hsa
uuugaauacauuaaaagaaguaaccaacugaacgacaaagcaugguauuugaauuuuaaauuaa

SEQ ID NO: 233026 - RNA, 64 nt, hsa
uugaauuuuaaauuaaagcaaaguaaauaaaaguacaaagcauauuuuaguuaguacuaaauuc

SEQ ID NO: 233027 - RNA, 64 nt, hsa
aagagaaaggccaaagauuuguacuuuuucacuuacaaagcacuccuuuuucccuuaaacuucu

SEQ ID NO: 233028 - RNA, 64 nt, hsa
caguauuaaaaaucucucauguuguuuucuuuauacaaagcaagauaacggcauauaacacugc

SEQ ID NO: 233029 - RNA, 64 nt, hsa
gcuguuuacauuuauuuucuucagccugugcaaaacaaagcaauggaaaaggaaacuaaaaaau

SEQ ID NO: 233030 - RNA, 64 nt, hsa
uuaaaaugucagcaagaaggccugccucaucuuaacaaagcaaaaaaaaaugcuuuaauucaaa

SEQ ID NO: 233031 - RNA, 64 nt, hsa
cucgaagccuucucugggaagaaagggaauucugacaaagcacaauuccauaugguauguaacu

SEQ ID NO: 233032 - RNA, 64 nt, hsa
uaagcuugcacacauuauuaacacauaagauugaacaaagcauuuagauuauuccagguuauau

SEQ ID NO: 233033 - RNA, 64 nt, hsa
cauguagucuuaacagucuuuuguacaaauaucuacaaagcagauaauaucccuauccagugcu

SEQ ID NO: 233034 - RNA, 64 nt, hsa
ccugccaaggccauuacaucccacaaacccaaauacaaagcagcugacuucccuggaucuuccc

SEQ ID NO: 233035 - RNA, 64 nt, hsa
uaacaacaccugggucaacucuuuuaauuuauauacaaagcaaagaacaacauuaauggagaug

SEQ ID NO: 233036 - RNA, 64 nt, hsa
acaagaauuagaaugacuugagaacgggcaaauaacaaagcaaaccaauauaauuauaugguca

SEQ ID NO: 233037 - RNA, 64 nt, hsa
uagcugcugaugcaaguugucccccaaggccaucacaaagcaguggggcaugagcuguguuuca

SEQ ID NO: 233038 - RNA, 64 nt, hsa
uggcuugucccaucagcagaugaauguguuaagcacaaagcaucuuccuuaaagcacaaagaga

SEQ ID NO: 233039 - RNA, 64 nt, hsa
ucaugaagagaaaggacuugcauaaccaaaauaaacaaagcaagacaaauuaaaaauauguggg

SEQ ID NO: 233040 - RNA, 64 nt, hsa
uucgcugaucuaucaacaucaccccauuaagaauacaaagcacuacauucuuuuaucuuuuuug

SEQ ID NO: 233041 - RNA, 64 nt, hsa
uccucucaccuugucccuccacugccaacagaaaacaaagcagcugacugagauggucaaagga

SEQ ID NO: 233042 - RNA, 64 nt, hsa
guucuuccucuuccccgacccacauuucaagcggacaaagcacaaguggcgaaucaucaguccc

SEQ ID NO: 233043 - RNA, 64 nt, hsa
uguuagaaaaauuagaaaauuuaaaauggaaauaacaaagcagaauuucuucacaaaaugaaaa

SEQ ID NO: 233044 - RNA, 64 nt, hsa
uagggugugaauuauuuugauguugaauuagacgacaaagcaucuauauagcuaagcuaaaaga

SEQ ID NO: 233045 - RNA, 64 nt, hsa
aagagguuguuaccucaguaaaaaccuucaggccacaaagcaaaaaguugcauagccacaacga

SEQ ID NO: 233046 - RNA, 64 nt, hsa
uaaagcagggcuuaaaauuuuuuggaaaaguuugacaaagcauaccacaugaauucagauuuac

SEQ ID NO: 233047 - RNA, 64 nt, hsa
cuguccccggguuucagagacaacuucccaaagcacaaagcaguuuuucccccuagggguggga

SEQ ID NO: 233048 - RNA, 64 nt, hsa
cacuggguucggaggagagucaggaagggccacgacaaagcagaaacaucggauuuggggaacg

SEQ ID NO: 233049 - RNA, 64 nt, hsa
ccccggccuucuggggaaggaacaaaguccccaaacaaagcaaccagcacaauucugaaggggc

SEQ ID NO: 233050 - RNA, 64 nt, hsa
ucucuuucucucucuuucuuaauuguaugaaaacacaaagcacaggucaggauccucugagaga

SEQ ID NO: 233051 - RNA, 64 nt, hsa
uacacauuagaaagcaaagauuauuuucauuuauccagaugaccauuuucugccacagguaaca

SEQ ID NO: 233052 - RNA, 64 nt, hsa
uaucccuuugcagucaguucaucccuacccuggcccagaugaucacugaucuugucauuauaga

SEQ ID NO: 233053 - RNA, 64 nt, hsa
accugcguaucugagaguuccagauucccagcuuccagaugauccuugcacagacaaccuaccu

SEQ ID NO: 233054 - RNA, 64 nt, hsa
cucacugacacaggagggcugggcuccacuucauccagaugaaggaaaggaagaccucaagaaa

SEQ ID NO: 233055 - RNA, 64 nt, hsa
cuccagaugagaguacaccccaacagcacccucuccagaugagaguacaccccaacagcacccu

SEQ ID NO: 233056 - RNA, 64 nt, hsa; identical to SEQ ID NO: 233055

SEQ ID NO: 233057 - RNA, 64 nt, hsa
ucuccagaugggagugcccccaacagcacccucuccagaugagaguacaccccaacagcacccu

SEQ ID NO: 233058 - RNA, 64 nt, hsa
uuauuaagccacuuugcuuacaccuuaaguguguacaauucaagugugagaaugcuguguuaac

SEQ ID NO: 233059 - RNA, 64 nt, hsa
ccuccccuccaaacaccuucucacauucuuuuccacaauucacauaacacuacugcuuuugugc

SEQ ID NO: 233060 - RNA, 64 nt, hsa
auucacauaccauauaaucacacauuuaaaauacacaauucagugguuuuaacauauuuaaaua

SEQ ID NO: 233061 - RNA, 64 nt, hsa
caguguuguuuuguuuaaaaagccuucaugagauacaauucacauaccauauaaucacacauuu

SEQ ID NO: 233062 - RNA, 64 nt, hsa
auucagucacuaacuguacaguuuuauguggggaacaauucaugcaggcuacuggaaaauuaaa

SEQ ID NO: 233063 - RNA, 64 nt, hsa
gucucacuaauguaaaauacugggacuuaaguauacaauucagucacuaacuguacaguuuuau

SEQ ID NO: 233064 - RNA, 64 nt, hsa
uuguuuuaauaucuugcucucugacaggaaagaaacaauucacuuaccagccuccucaccccau

SEQ ID NO: 233065 - RNA, 64 nt, hsa
guauuuucaacggaauacacuuugaaagguaaaaacaauucaaaaguaucgauuaucauaaauu

SEQ ID NO: 233066 - RNA, 64 nt, hsa
gcaugacuggacagcgguuguaaauacaauucaaacaauucaaucaaagcuaccuuuuuuuuac

SEQ ID NO: 233067 - RNA, 64 nt, hsa
uaacagacagcaugacuggacagcgguuguaaauacaauucaaacaauucaaucaaagcuaccu

SEQ ID NO: 233068 - RNA, 63 nt, hsa
uuauguuaaaauaauuuuuauuaauuuagagaagacaaucaaugucugugagaaaacggacuu

SEQ ID NO: 233069 - RNA, 63 nt, hsa
uuuguucuaaaacuuagacugacaucuagcuuugacaaucauaguauguuuuauuuuccugag

SEQ ID NO: 233070 - RNA, 63 nt, hsa
ugcccggguuuuuacauuuuaaaaguuauucuagacaaucacuauuggcuuuuuucuuuuauu

SEQ ID NO: 233071 - RNA, 63 nt, hsa
uuucuuuuauuuuuaaaaaacucacauagaggagacaaucagaaauuuaccauagucccaaga

SEQ ID NO: 233072 - RNA, 63 nt, hsa
ucauauuauuuuagaaucauuuauuuuaaaugagacaaucauuuuaaguuuuaagauaacaga

SEQ ID NO: 233073 - RNA, 63 nt, hsa
acauuauuuuagaaucauuuacuauuuaaaugagacaaucauauuauuuuagaaucauuuauu

SEQ ID NO: 233074 - RNA, 63 nt, hsa
cuccuuuugagaucguggacaaucaggccuuuggacaaucaccgcuuccagugcccgcugugc

SEQ ID NO: 233075 - RNA, 63 nt, hsa
cacaaaaauaccagaucuccuuuugagaucguggacaaucaggccuuuggacaaucaccgcuu

SEQ ID NO: 233076 - RNA, 63 nt, hsa
uggagcucagugucaggaaagggggugauaaaugacaaucaaaucgacauggagguugagcac

SEQ ID NO: 233077 - RNA, 63 nt, hsa
aaacacauacauggccaaaugcaauacugaagagacaaucauccuguaucuuuuaugguuuuu

SEQ ID NO: 233078 - RNA, 63 nt, hsa
uugaacuuccauugugauaugaaaacagcuauagacaaucauaaaugaaugaucauggcuaug

SEQ ID NO: 233079 - RNA, 63 nt, hsa
caauucuaccacugugguaugaaaacagcuauagacaaucauaaaugaaugaucauggcuaug

SEQ ID NO: 233080 - RNA, 62 nt, hsa
gcaggcuagaccaucuaaguagccauuuucgaacaauucaccaggcauguaaacucaucugc

SEQ ID NO: 233081 - RNA, 62 nt, hsa
aucugcuucucugccccucaaacuuuuaguucacaauucaucuucuaccuuaacuugggcuu

SEQ ID NO: 233082 - RNA, 62 nt, hsa
gcaaaccaccccuccauauuuccguaccauuuacaauucaguuucugugacaucuuuuuaaa

SEQ ID NO: 233083 - RNA, 62 nt, hsa
guguuacagccccuucagaauauaacuucaggacaauucaaacuaugcuuaauguaugauuu

SEQ ID NO: 233084 - RNA, 62 nt, hsa
gccgucacuuuggguucuggcauaaguucagaacaauucaaguccaugugucccauggcugg

SEQ ID NO: 233085 - RNA, 62 nt, hsa
acaagaaaaggcaacaucucauuuuaaauaguacaauucagaagggauacuaaaucaauaaa

SEQ ID NO: 233086 - RNA, 62 nt, hsa
uaaggguguuuaugaaaugagaaaauuauuggacaauucagacuuuacuaaagcacaguuag

SEQ ID NO: 233087 - RNA, 62 nt, hsa
ggaaucaagauuuaauccuagagauuugguguacaauucaggcuuuggauguuucuuuagca

SEQ ID NO: 233088 - RNA, 62 nt, hsa
aaauacaguagauaagcugucgaaaauggaaaacaauucaauuuuaauuuucugcucugagu

SEQ ID NO: 233089 - RNA, 62 nt, hsa
uuaauaaaguugccaaagaagauguauuaugaacaauucagcaauaagacaauugucaacac

SEQ ID NO: 233090 - RNA, 62 nt, hsa
ugcacuaauucucaacaugcuaaacauuaacuacaauucacuguugugagaauauuccucgu

SEQ ID NO: 233091 - RNA, 62 nt, hsa
gaggaauaguacagacagaaggugcuaagcagacaauucaacugccauguuuugccaccccc

SEQ ID NO: 233092 - RNA, 62 nt, hsa
ugcugcuacuuucuguuuuaaggugugagguaacaauucaaucucuucuucaaaucaaaaug

SEQ ID NO: 233093 - RNA, 62 nt, hsa
ucugaauuuagaucuccagacccugccuggccacaauucaaauuaaggcaacaaacauauac

SEQ ID NO: 233094 - RNA, 62 nt, hsa
acauacgugcacacacacauacauauucauacacaauucauacacaugcaaucauacaugca

SEQ ID NO: 233095 - RNA, 62 nt, hsa
aguucggcugucauuuaagagaacuccaggacacaauucagcccggguuccgcaaacacugc

SEQ ID NO: 233096 - RNA, 62 nt, hsa
ggcccucccucagcucucuguggguagggguuacaauucacauuccuuauucugagaauuug

SEQ ID NO: 233097 - RNA, 62 nt, hsa
aggcauagguccagagcaccaaacucuaguggacaauucagacucuccugguuguguaacug

SEQ ID NO: 233098 - RNA, 62 nt, hsa
auauauuauguuuauacaaaaucaaucugaacacaauucauaaagauuucucuuuuauaccu

SEQ ID NO: 233099 - RNA, 62 nt, hsa
aggcaagaggacaggaucucucaagacacagcacaauucagucucuuaagauuagcuucaca

SEQ ID NO: 233100 - RNA, 62 nt, hsa
auaccacguuuugcucaagaagcugggcuguaacaauucaggguuuucccuuguuuuccucu

SEQ ID NO: 233101 - RNA, 62 nt, hsa
uccugccauagugagagaaaugggauuucaucacaauucauggugcuaaaaugaaaaccucu

SEQ ID NO: 233102 - RNA, 62 nt, hsa
cuuacagaauccaagaggaagcuuucauaaaaacaauucagcaaauauuuccaauauaauuu

SEQ ID NO: 233103 - RNA, 62 nt, hsa
uccucccacaacacgugggaauuauaggagcuacaauucaagaugagauuugagugggaaca

SEQ ID NO: 233104 - RNA, 62 nt, hsa
acauucuccugaccacuaaugggagccaauucacaauucacuaagugacuaaaguaaguuaa

SEQ ID NO: 233105 - RNA, 62 nt, hsa
gugacagaauacgacucaauucaccggcuacaacaauucauagaauuuuucaauguuuucuu

SEQ ID NO: 233106 - RNA, 62 nt, hsa
aaaauauaguuaucuucuuaaaaaccauuauaacaauucagagagaguucuuuacaaagcca

SEQ ID NO: 233107 - RNA, 62 nt, hsa
ugagcaaauggaaaagacuuuucauuuaguagacaauucacuucuuuuucugugcuuccccu

SEQ ID NO: 233108 - RNA, 62 nt, hsa
uaggugggaugaauuuuuuuuuuaauugugaaacaauucauaagcacaauaugauuuacaga

SEQ ID NO: 233109 - RNA, 62 nt, hsa
cuacauuauuuucccucaaacaauuuauuuucacaauucauauuuauuauagauagcagaag

SEQ ID NO: 233110 - RNA, 62 nt, hsa
gauacuucucuuuuuuugcuguuccaccaaauacaauucaaaugcuuuuuguuuuauuuuuu

SEQ ID NO: 233111 - RNA, 62 nt, hsa
uaaguauauuuuggaacagauuuguaauuuguacaauucaaugcuuuaauuauuuuuucuau

SEQ ID NO: 233112 - RNA, 62 nt, hsa
cacuucuuucaggaaauggccagccucaaacgacaauucacggaacuguuaucggauauagg

SEQ ID NO: 233113 - RNA, 62 nt, hsa
cugucccacaacacgugggaauucugggagauacaauucaaguugagauuuguggggggaca

SEQ ID NO: 233114 - RNA, 62 nt, hsa
aaccacaguuuugcugcccucuaggugcacagacaauucagguccauggcccagaugguacu

SEQ ID NO: 233115 - RNA, 62 nt, hsa
uaugcugugcuaucugaaaagaacuuaaggccacaauucacgucucguccugggcauuguga

SEQ ID NO: 233116 - RNA, 62 nt, hsa
gcagccugcucuugggccuggggaugagacacacaauucauuggcuccuggauuuuaaguag

SEQ ID NO: 233117 - RNA, 62 nt, hsa
aaauauucauugucugaaaaugucuuuaagauacaauucagaggucccuauuuccuuuguac

SEQ ID NO: 233118 - RNA, 62 nt, hsa
gaacaaaugcaucuuugcguauccuagacuuaacaauucaucaguuucugagaccacagaau

SEQ ID NO: 233119 - RNA, 62 nt, hsa
guauuuguacgcacaacauuaaaucaagggcuacaauucaagcacuuuuauucguaucauug

SEQ ID NO: 233120 - RNA, 62 nt, hsa
cccacacccacccacccacacacaacacugggacaauucagacacgacagcucaccucacuu

SEQ ID NO: 233121 - RNA, 62 nt, hsa
gaauuuuaaaguaccucgguuuauagggauuuacaauucaguagaaacuuguuauucaugug

SEQ ID NO: 233122 - RNA, 62 nt, hsa
uggguaaggaaaccacuugggguagcaguucaacaauucacuuacgaauguuuauaagcuuu

SEQ ID NO: 233123 - RNA, 62 nt, hsa
ggcaacuuggaaucccuaaauucuguaaaaagacaauucaucucauugugaguggaaguagu

SEQ ID NO: 233124 - RNA, 62 nt, hsa
uuauuucacugauacuauuaaucaugcaguguacaauucaaaaucaugcaauguuucacuuu

SEQ ID NO: 233125 - RNA, 62 nt, hsa
aaauacaguucuguuaauguauuucuucccaaacaauucauuuuucucuucuaaagguaguc

SEQ ID NO: 233126 - RNA, 62 nt, hsa
gaaaccagcagauaguaaaccugguucaaaguacaauucaagaaacugaguauuuaugggca

SEQ ID NO: 233127 - RNA, 62 nt, hsa
acucaugcugcaugacaaaauguuuacuaauaacaauucauuauaaaguuauaucccucuuu

SEQ ID NO: 233128 - RNA, 62 nt, hsa
caaagaaauagaucaguuggagaaaauacaaaacaauucaaagcucuuaagguauuuaaacc

SEQ ID NO: 233129 - RNA, 62 nt, hsa
acggucaauugauuuuugacaagguucccaagacaauucaauagagaaaggagagucuuuuc

SEQ ID NO: 233130 - RNA, 62 nt, hsa
guggaggcuuaaaaaaaaaaaaauccaagaacacaauucauuuucaccaccucugguguuca

SEQ ID NO: 233131 - RNA, 62 nt, hsa
cugguaaacacauuuuuaaaaaguaaaaugaaacaauucauuuuuauaauauacuuuacuua

SEQ ID NO: 233132 - RNA, 62 nt, hsa
uuaggaagaauuuuuauauccacuaaaaucaaacaauucagggagugggcuaagcacgggcc

SEQ ID NO: 233133 - RNA, 62 nt, hsa
aguuacauuuuuuucuuuuuaacacuaaaaauacaauucaaauuuauuagcucuacuacuug

SEQ ID NO: 233134 - RNA, 62 nt, hsa
uccaguugaaagagggugguagaaaucuauucacaauucagcuucuaugaccaaaaugaguu

SEQ ID NO: 233135 - RNA, 62 nt, hsa
ggucuaaagcuguguccugaauauuagggaucacaauucacugaaauacagcagugugugga

SEQ ID NO: 233136 - RNA, 62 nt, hsa
uagaagcacuugaaauaaucucugcauguguuacaauucaguuauuucuguaguuuguaaac

SEQ ID NO: 233137 - RNA, 62 nt, hsa
acucaugacuccuuucucuaaaacugccuuccacaauucacuagaccagaaguggacgcaac

SEQ ID NO: 233138 - RNA, 62 nt, hsa
uauauaauauugucauaugucauaguuuuaauacaauucacaugauuucuauguuucuuaau

SEQ ID NO: 233139 - RNA, 62 nt, hsa
cucauuccugauguuugauacccugguugaaaacaauucaguaaagcauccugccucagaau

SEQ ID NO: 233140 - RNA, 62 nt, hsa
auuaagccacuuugcuuacaccuuaaguguguacaauucaagugugagaaugcuguguuaac

SEQ ID NO: 233141 - RNA, 62 nt, hsa
uccccuccaaacaccuucucacauucuuuuccacaauucacauaacacuacugcuuuugugc

SEQ ID NO: 233142 - RNA, 62 nt, hsa
aaaauuuaugguggaaaaccuuaaaaauugagacaauucaaucuauuuaaucuauuaaauuu

SEQ ID NO: 233143 - RNA, 62 nt, hsa
ugcuggcuggacugaacugaagaucaauccucacaauucagacugaggguugagacaaaacu

SEQ ID NO: 233144 - RNA, 62 nt, hsa
cugugacuauaguacguugcuucuuguucuucacaauucaugacuuaaguaccaaaaugcau

SEQ ID NO: 233145 - RNA, 62 nt, hsa
ccuaugggcuaguguguggugaucaaacuaucacaauucagugugaugagcagcauagcaaa

SEQ ID NO: 233146 - RNA, 62 nt, hsa
aauuuuacuuuaaaugcauuuuacuacaaagcacaauucauuuguaaugcauauccaucuug

SEQ ID NO: 233147 - RNA, 62 nt, hsa
uuuagacuuaaguggugcuuugugguaucugaacaauucauaacauguaaauaaugugggaa

SEQ ID NO: 233148 - RNA, 62 nt, hsa
agcuuuuguucacagcuugaaauagaugccucacaauucagacaguuuaauucaggaacugu

SEQ ID NO: 233149 - RNA, 62 nt, hsa
ugaggacgauguuuggaaauaugguuggaagcacaauucauucgcuacuaguuauucagagc

SEQ ID NO: 233150 - RNA, 62 nt, hsa
cuuaguuaaggauaguuaacuauuauacuccaacaauucaugagcaacaguauauacacuga

SEQ ID NO: 233151 - RNA, 62 nt, hsa
guuagauaugauaguauaaaaaaugguuaaugacaauucagaggcgaggagauucuguaaac

SEQ ID NO: 233152 - RNA, 62 nt, hsa
aaaaacaaaugauuuuuuuaaaagucacaaaaacaauucacuaaaaauaaauaugucauugu

SEQ ID NO: 233153 - RNA, 62 nt, hsa
cuuauagucgugacuuuaaacuuuuguagaccacaauucacuuuuuaguuuucuuuuacuua

SEQ ID NO: 233154 - RNA, 62 nt, hsa
cuuuuuuuguaaagcaaauuacuuaagaaaauacaauucacuugaauuugacaaacugaaac

SEQ ID NO: 233155 - RNA, 62 nt, hsa
uccagacugagacucagugucuaagucuuacaacaauucaucauuuuauaccuucaauggga

SEQ ID NO: 233156 - RNA, 62 nt, hsa
ucacauaccauauaaucacacauuuaaaauacacaauucagugguuuuaacauauuuaaaua

SEQ ID NO: 233157 - RNA, 62 nt, hsa
guguuguuuuguuuaaaaagccuucaugagauacaauucacauaccauauaaucacacauuu

SEQ ID NO: 233158 - RNA, 62 nt, hsa
ucaacuuuugaaauuuaaaaaucuuucagaauacaauucaguuuuaguuucaaaauguuaac

SEQ ID NO: 233159 - RNA, 62 nt, hsa
uggucacaggggugucuugucugagaacaaauacaauucagucuucucuuugggguuuuagu

SEQ ID NO: 233160 - RNA, 62 nt, hsa
acacugcagcucuuuucaguuuuugcuuauacacaauucauucuuugcagcuaauuaagccg

SEQ ID NO: 233161 - RNA, 62 nt, hsa
aacuuucucuugcuaucauugcuccuuuugaaacaauucaauuuucaugucuacagcugacu

SEQ ID NO: 233162 - RNA, 62 nt, hsa
uucuuugucccaccaacuuaaaaaaaaaaaguacaauucauuguuuugcaaaaguguauggu

SEQ ID NO: 233163 - RNA, 62 nt, hsa
cauuuaccuuuauuccugguucuuaaaaggugacaauucauucuuuaacccagauggucuua

SEQ ID NO: 233164 - RNA, 62 nt, hsa
agguucucauuccuuuucccauuauacuucucacaauucaguuucuaugaguuugaucaccu

SEQ ID NO: 233165 - RNA, 62 nt, hsa
uaaggcuauuuaaauuaauucaaauuaaauguacaauucagucacucauucucaucaaccac

SEQ ID NO: 233166 - RNA, 55 nt, hsa
uuccugaaucugagucuugaguaugacaauucacugauauuuauguguacauuua

SEQ ID NO: 233167 - RNA, 62 nt, hsa
cccugugaaacgucccacacuuugaagcaaauacaauucacagcacaguacacacaaaaacc

SEQ ID NO: 233168 - RNA, 62 nt, hsa
uuccauaaguggccuuuaagaaaacauggaagacaauucauguuugacaaaugcugacaggg

SEQ ID NO: 233169 - RNA, 62 nt, hsa
cuugugugugcgugucaguuacuuuuuuaguaacaauucagauccaguguaaacuuccguuc

SEQ ID NO: 233170 - RNA, 62 nt, hsa
cgcaacucaaaucugugcuggacuuuaaaaaaacaauucaggaccaaauuuuuucucagugu

SEQ ID NO: 233171 - RNA, 62 nt, hsa
cccacccacgacacgugggaauugugggagcuacaauucaagaugagauuuggaugggacac

SEQ ID NO: 233172 - RNA, 62 nt, hsa
aauugacauuaagagacacuucauagguucccacaauucaguaugggauaggcuuuuuaaaa

SEQ ID NO: 233173 - RNA, 62 nt, hsa
uuuugaguuguucuugucauagacauaaaaagacaauucauuuucuuguuuuauuaacucug

SEQ ID NO: 233174 - RNA, 62 nt, hsa
gguccaauauccagaaucuacaaggaacuuaaacaauucaacaagcaagaagaaaaaaccca

SEQ ID NO: 233175 - RNA, 62 nt, hsa
aauaaaaagaauuauaaaauacccucaaauuaacaauucaauugcauauaauagccuaacuc

SEQ ID NO: 233176 - RNA, 62 nt, hsa
agguccuucccaccugugaccucaccucaaagacaauucauagccuguggucuccacauaaa

SEQ ID NO: 233177 - RNA, 62 nt, hsa
ucagucacuaacuguacaguuuuauguggggaacaauucaugcaggcuacuggaaaauuaaa

SEQ ID NO: 233178 - RNA, 62 nt, hsa
cucacuaauguaaaauacugggacuuaaguauacaauucagucacuaacuguacaguuuuau

SEQ ID NO: 233179 - RNA, 62 nt, hsa
gaagucuggaaaacuccucugacuacugaugcacaauucagaauggcagaaguaauuuggga

SEQ ID NO: 233180 - RNA, 62 nt, hsa
cuugagaaaugauguugcuagugcaguguuucacaauucauuuucuacuaaauguguaccau

SEQ ID NO: 233181 - RNA, 62 nt, hsa
uuaaaaauauuuauuaaugugaauggaauauaacaauucagcuuaauuccccaaccuuauuc

SEQ ID NO: 233182 - RNA, 62 nt, hsa
uacauaccauaagauucacccuuuuaaauuauacaauucauuuuuguuuuguuuuguuuguu

SEQ ID NO: 233183 - RNA, 62 nt, hsa
auuauuauucagcagcacauucugaggggggaacaauucacaccaccaauaauaaccuggua

SEQ ID NO: 233184 - RNA, 62 nt, hsa
aaagaauauaaaugaggucucguugaugcuggacaauucaagaauucagacuugaaccuuaa

SEQ ID NO: 233185 - RNA, 62 nt, hsa
agcagggaccuaaacuuuggcaaaaagugaacacaauucaaauacgaaugaaggaagagccc

SEQ ID NO: 233186 - RNA, 62 nt, hsa
gaaauagcauaucugagacugaagagaaauugacaauucacuuauuugugguuuuuuucuca

SEQ ID NO: 233187 - RNA, 62 nt, hsa
ugucuuuugucauguggcuaaaugccuaauaaacaauucaagugaaauacuaauugugucag

SEQ ID NO: 233188 - RNA, 62 nt, hsa
ggugguugauugguuuuauuuuauguagcuugacaauucagugacuuaauaucuauuccauu

SEQ ID NO: 233189 - RNA, 62 nt, hsa
ccagcuguuccugcuuccacucuugcuccucuacaauucauucugcacgcagaagucagaau

SEQ ID NO: 233190 - RNA, 62 nt, hsa
uguaaaauuauucuuuucugaauaaacugcauacaauucaaaaugcaacuugcuuuuauacc

SEQ ID NO: 233191 - RNA, 62 nt, hsa
uuacuucuaaaauuacagacaaaauuacuuacacaauucaguuaagaugcuuugacacugaa

SEQ ID NO: 233192 - RNA, 62 nt, hsa
ggggggaggggaagccagaguccacuuuugucacaauucauuuuuauuaauagaaaauaaac

SEQ ID NO: 233193 - RNA, 62 nt, hsa
cgguuggaaccuaaugggaaucauuccacuauacaauucaguacugauuauucuucuuacau

SEQ ID NO: 233194 - RNA, 62 nt, hsa
gauucgccaucacccccuaccccagaaauaggacaauucacuucauugaccaagaugaucac

SEQ ID NO: 233195 - RNA, 62 nt, hsa
agucaauguauuggugacuguugauuuguugaacaauucaggaaucaagggcuguggagaaa

SEQ ID NO: 233196 - RNA, 62 nt, hsa
agaugaaauaguuugaauaaacugguaaaauaacaauucauacuaucucuacauauuuuuag

SEQ ID NO: 233197 - RNA, 62 nt, hsa
cuuguuacuuucuacucugcaaugauguauuaacaauucaugguauuuauuuguuauucuuc

SEQ ID NO: 233198 - RNA, 62 nt, hsa
gguaugaauuaaaagcaaaaacaaaaaacaaaacaauucauuagccucagauucuucaucug

SEQ ID NO: 233199 - RNA, 62 nt, hsa
ggcuagaaucucauguuuuauaugaaagauguacaauucaguguuuaaaaauaaaaauauuu

SEQ ID NO: 233200 - RNA, 62 nt, hsa
cuacguuauuuucccucaaacaauuuauuuucacaauucauauuuauuauagauagcagaag

SEQ ID NO: 233201 - RNA, 62 nt, hsa
guuuuaauaucuugcucucugacaggaaagaaacaauucacuuaccagccuccucaccccau

SEQ ID NO: 233202 - RNA, 62 nt, hsa
auuuucaacggaauacacuuugaaagguaaaaacaauucaaaaguaucgauuaucauaaauu

SEQ ID NO: 233203 - RNA, 62 nt, hsa
uucuuuucucaguuuuauaaacacagaauauaacaauucacuuuaaacuuuuauuaccacag

SEQ ID NO: 233204 - RNA, 62 nt, hsa
uaauuauuuuuaauugagaacaacucaugaucacaauucauaaaauccauauuuuaagacaa

SEQ ID NO: 233205 - RNA, 62 nt, hsa
cugcucugggaaggggcuuuuagauguaaccuacaauucaguuaggcuagagacagaugcug

SEQ ID NO: 233206 - RNA, 62 nt, hsa
caucucuuagccuaauuugaaauagcacaaucacaauucaaaauguuuagucuucucacuaa

SEQ ID NO: 233207 - RNA, 62 nt, hsa
aaaccuacauuauuuucccucaauuuauuuucacaauucauauuuauuauagauagcagaag

SEQ ID NO: 233208 - RNA, 62 nt, hsa
caaggucaaggaagcuagagucugaaaaacgaacaauucacuuccaggucuucaucaggguu

SEQ ID NO: 233209 - RNA, 62 nt, hsa
uguauguuggauuauguaggaaauguuuguguacaauucaaaaaaaaaaaagaugaaaaaag

SEQ ID NO: 233210 - RNA, 62 nt, hsa
aacuggguuugaaaaaauaaucaacaaaagauacaauucaaggguuagguugcagagagcug

SEQ ID NO: 233211 - RNA, 62 nt, hsa
aauaauaagcccucuauacauaaaugcccagcacaauucauuguuaaaaaacaaccaaaccu

SEQ ID NO: 233212 - RNA, 62 nt, hsa
cugagcuuucugugcuucuagguggagcuggaacaauucagauucacccgcccugaugcuaa

SEQ ID NO: 233213 - RNA, 62 nt, hsa
aagauacuuuucauuuuaaaauguauaaaguaacaauucagauucacuugggaauagcagaa

SEQ ID NO: 233214 - RNA, 62 nt, hsa
cagagcuccuggccagagcguuugaccgacagacaauucacauccauaugccagggcccugg

SEQ ID NO: 233215 - RNA, 62 nt, hsa
auagaaauaagugcaauuucuacacccccgaaacaauucaaagggaagcagcauuucuuguu

SEQ ID NO: 233216 - RNA, 62 nt, hsa
ucuuauuaucaagguucuaccuauguuaauuuacaauucauguuucaagacauuugccaaau

SEQ ID NO: 233217 - RNA, 62 nt, hsa
uugccaccccuucacgugcacccucaauuuccacaauucacuugaaugacuuguuuuauuug

SEQ ID NO: 233218 - RNA, 62 nt, hsa
gucgguuagucauugauagaacuacuuugaaaacaauucaguggucuuauuuuugggugauu

SEQ ID NO: 233219 - RNA, 62 nt, hsa
uccacgcccuuuuccucuuugaagagucaaguacaauucagacaaacugcuuucuccugucc

SEQ ID NO: 233220 - RNA, 62 nt, hsa
gaggagcugccccaccagccauccuugaagagacaauucagggcaguugaugaauaucaggg

SEQ ID NO: 233221 - RNA, 62 nt, hsa
acuagaaaacaaagaaaaaugauuaauaaaugacaauucagagccauuuauucucugcaugc

SEQ ID NO: 233222 - RNA, 62 nt, hsa
cccgauaugauuuaggaugcauaucaguucuaacaauucaaucagaagucaagcucauugga

SEQ ID NO: 233223 - RNA, 62 nt, hsa
gccagugggccugccuuaggguaccaugcaggacaauucaaggaccagccuuuuuaccacug

SEQ ID NO: 233224 - RNA, 62 nt, hsa
acuuuuccccacauauggggcacuggcuucaaacaauucaguucaguaucauuacuuuuaau

SEQ ID NO: 233225 - RNA, 62 nt, hsa
cuaagagauuuuuaaauucugaaaaacugcuuacaauucauguuuucuagccacuccacaaa

SEQ ID NO: 233226 - RNA, 62 nt, hsa
gucuuauuaacucuuagcuccucaguuagaaaacaauucaccuggcuuagucuugucuaguu

SEQ ID NO: 233227 - RNA, 62 nt, hsa
uaccauacaguucacucauuuaaaauauacauacaauucagugguuuuuaguauuuuugcag

SEQ ID NO: 233228 - RNA, 62 nt, hsa
uccgaauggagguucauguauaauacucauuuacaauucaauauauaauuacacaaauaauu

SEQ ID NO: 233229 - RNA, 62 nt, hsa
gggccguggccuccuccaccaagucucucuagacaauucagggccugcuuuccccagcucca

SEQ ID NO: 233230 - RNA, 62 nt, hsa
ucagauggguagaguaaaagugucuguacuuuacaauucaacuacauguucuacccagcauu

SEQ ID NO: 233231 - RNA, 62 nt, hsa
guguuuaccaaacauaccaauaauucagcacuacaauucagaccuuugaaaaucuggcuuuc

SEQ ID NO: 233232 - RNA, 62 nt, hsa
agaaagaaagaaggaaagaggguauguuuuucacaauucaugggggccugcauggcaggagu

SEQ ID NO: 233233 - RNA, 62 nt, hsa
acagcggcaguccuguuuguuugagguuuaaaacaauucaauuacaaaagcggcagcagcca

SEQ ID NO: 233234 - RNA, 62 nt, hsa
gaguagguggcagauguagcaaaaacuucacaacaauucagcaaucauuagcucgggucacu

SEQ ID NO: 233235 - RNA, 62 nt, hsa
agcccugaguaguaacugguuagcuucucuggacaauucagcaugguaacgugacugucauc

SEQ ID NO: 233236 - RNA, 62 nt, hsa
uuucaguugguuucugcuuuuaauuuacuuguacaauucauuguuacuguucuguuuuucua

SEQ ID NO: 233237 - RNA, 62 nt, hsa
gaacuuaauuuaaaagucuuaaauauucugauacaauucagcugucuucucuaccuuaccau

SEQ ID NO: 233238 - RNA, 62 nt, hsa
auuauauuacuaauaaaacuuaaccaacacuuacaauucagucaucaaaguaaguaaaaauu

SEQ ID NO: 233239 - RNA, 62 nt, hsa
ucaauuuaaaucauauauccuaaacuaaaagcacaauucauacuucgggaauauuuuauaag

SEQ ID NO: 233240 - RNA, 62 nt, hsa
cgucauugaaggacaauuucuucaaagugguuacaauucauaaugcagcaguuucuccaaaa

SEQ ID NO: 233241 - RNA, 62 nt, hsa
uaacguauuguccuuccguuaacagaaacaucacaauucaaaagugaguuuucuuauuauag

SEQ ID NO: 233242 - RNA, 62 nt, hsa
auguauuuuagugccacccacuggccauagguacaauucaguuguuggcuuguuuugacuua

SEQ ID NO: 233243 - RNA, 62 nt, hsa
cuaccacugcaauucacauuauauuggaaugaacaauucacaugucuaccacaagucuguaa

SEQ ID NO: 233244 - RNA, 62 nt, hsa
uuaguggcuguuuuacuaauuaaaggacauccacaauucaauguauaacagaaaaaguaaug

SEQ ID NO: 233245 - RNA, 62 nt, hsa
acaaagcaaaucacauuuagcuucaaauuguaacaauucaauugaauuuuaaaaugacaccu

SEQ ID NO: 233246 - RNA, 62 nt, hsa
gaaaauccaguuggccucucuccucuauccacacaauucaacuugauaacuggacuuuagga

SEQ ID NO: 233247 - RNA, 62 nt, hsa
augaaugccuuuauagauagucacuuguuucuacaauucaguauuugauguggucguguaaa

SEQ ID NO: 233248 - RNA, 62 nt, hsa
cuaagacacuaauauauguaucuuauaaacaaacaauucaacucagaaguuuaugagaagac

SEQ ID NO: 233249 - RNA, 51 nt, hsa
auuuaguucuuuuggacuaauacaauucaggaaagaaaaaacccaaaaacc

SEQ ID NO: 233250 - RNA, 62 nt, hsa
uccuuucauuuuuccagccaugcauuccuaacacaauucagugguacuuggaauccuguuuu

SEQ ID NO: 233251 - RNA, 62 nt, hsa
uuugggacuucugacaggcaucuggugaagagacaauucaagccuuagugacuauuuagaau

SEQ ID NO: 233252 - RNA, 62 nt, hsa
gcguggcagcaaccaugcagagugacugaaacacaauucauuucugacugacauuccuuucu

SEQ ID NO: 233253 - RNA, 62 nt, hsa
ccugaagucaaaucucuaucuauacaagugauacaauucauagggggcuggcuccucccaga

SEQ ID NO: 233254 - RNA, 62 nt, hsa
aauaccauaaagcucucacccuucuaaaguguacaauucaguggugugaguauauucauaag

SEQ ID NO: 233255 - RNA, 62 nt, hsa
cacggguuuccauagccaggcaguugguauguacaauucaguucagcguaugaacuuguauc

SEQ ID NO: 233256 - RNA, 62 nt, hsa
aaauguugaauauucccuuguauggauauaccacaauucauuuacccauuuacuuguugaug

SEQ ID NO: 233257 - RNA, 62 nt, hsa
acaugacuucugugacuucauugaaaaucugcacaauucaguuucagcucuggauuacuuca

SEQ ID NO: 233258 - RNA, 62 nt, hsa
ggaccccccuugcccaugccuccagcuacaaaacaauucaauugcuuuuuuuuuuuggucca

SEQ ID NO: 233259 - RNA, 62 nt, hsa
uucuaauuagcucauuuguggaguuugaucacacaauucauaauguugcugcuuuccauuaa

SEQ ID NO: 233260 - RNA, 62 nt, hsa
cauacaaggaguuugaaaagcagaagggaaggacaauucaguaucuacaccaguuggcucuu

SEQ ID NO: 233261 - RNA, 62 nt, hsa
cuagcauauaaguuuggaaguuugccaacaucacaauucaucuugaaaagagcuuuuuuccc

SEQ ID NO: 233262 - RNA, 62 nt, hsa
auuaggcuuauugcuagacuguaaguuuaaaaacaauucauguucaaaggagcuuuucaaau

SEQ ID NO: 233263 - RNA, 62 nt, hsa
ucaauuuuauagacuuguucuacauuguaaauacaauucaguuuuuaaaaaauaaagcuuaa

SEQ ID NO: 233264 - RNA, 62 nt, hsa
ucaguaagaagauggaguagauaucagauaaaacaauucacguuuaauauguaaauguacca

SEQ ID NO: 233265 - RNA, 62 nt, hsa
uguuucuugcugccaugauguauauccauauaacaauucaguaacaaagguuuaaaguuuga

SEQ ID NO: 233266 - RNA, 62 nt, hsa
cugguucuuauccauuaucaucuucacuucagacaauucagaagcaucaccaugcauggugg

SEQ ID NO: 233267 - RNA, 62 nt, hsa
aauuuugucaugcuaagcacuuuuguaucugcacaauucaguagguuaagaaucaaucuucu

SEQ ID NO: 233268 - RNA, 62 nt, hsa
auuagagaaaaauccuugucaccagauucauuacaauucaaaucgaagaguugugaacuguu

SEQ ID NO: 233269 - RNA, 62 nt, hsa
agagagacucuuacuaacauguuguaaauauuacaauucaugaaauguuauuguaagucugu

SEQ ID NO: 233270 - RNA, 62 nt, hsa
ccuggucccacccuugacacguggggauugcuacaauucaagguuagauuugggugaggaca

SEQ ID NO: 233271 - RNA, 62 nt, hsa
gcacucugggccuauuuguauugaaccauuagacaauucaaaccacuacuuguaucuuucuu

SEQ ID NO: 233272 - RNA, 62 nt, hsa
cucauggggcaaaaguaaauaaacagcuuauuacaauucaacaauucaaacucaauauuuuu

SEQ ID NO: 233273 - RNA, 62 nt, hsa
ugccucagccuucacuaauuaggaauauugugacaauucauugcuaauaaaacauaacauga

SEQ ID NO: 233274 - RNA, 62 nt, hsa
agucuugucauuuuguuuacacauuggggaaaacaauucaguuuauuaaacguuucauguaa

SEQ ID NO: 233275 - RNA, 62 nt, hsa
aaacauaaacuuuuuuuauaaaaauauuuuguacaauucauuaaaggcuaauuuaugaaauu

SEQ ID NO: 233276 - RNA, 62 nt, hsa
guguuuuuguaaaguguggucccaacaggaggacaauucaugaacuucgcaucaaaagacaa

SEQ ID NO: 233277 - RNA, 62 nt, hsa
auuuaugcaaauuugaacuagcuucuuuguucacaauucaguuccucccaaccaaccagucu

SEQ ID NO: 233278 - RNA, 62 nt, hsa
guugaguagccagaugaaauucaagccuaaagacaauucauucauuugcauccaugggcaca

SEQ ID NO: 233279 - RNA, 62 nt, hsa
aguggcucuacuuuuuacauacagccacucauacaauucagacagcaauguaugauugaucc

SEQ ID NO: 233280 - RNA, 62 nt, hsa
uauuuacaauaaaauguuccuacuuuaaauauacaauucagugaguuuugauaaauugauau

SEQ ID NO: 233281 - RNA, 62 nt, hsa
guugauaucguugaaugaaaagcaaaacaaaaacaauucaggaacaacggcuaauuuuuucu

SEQ ID NO: 233282 - RNA, 62 nt, hsa
accuccuuuuaccuuuagauaggugaauuuuuacaauucaguuuuacauguuuugggcagua

SEQ ID NO: 233283 - RNA, 62 nt, hsa
aaagaaacaaaguuaugggguuaaucuccuacacaauucauuuacuucguuugaauguuaua

SEQ ID NO: 233284 - RNA, 62 nt, hsa
uucuuugggaugguuuuuacuuaaguccauuaacaauucagguuucuaacgagacccauccu

SEQ ID NO: 233285 - RNA, 62 nt, hsa
acuaaaauuguuuuucuaccauaucaaauuaaacaauucaugccuuuauagggucaggccua

SEQ ID NO: 233286 - RNA, 62 nt, hsa
acuuucucuuuugaauguuaagaauaacuaauacaauucauugugaacagaaguccuuaagc

SEQ ID NO: 233287 - RNA, 62 nt, hsa
agcauuugccuucuuuaaugaaugauggucucacaauucaguugacuuugaccuaauauuua

SEQ ID NO: 233288 - RNA, 62 nt, hsa
gucuccaaaaagauauuaccuuauugggcuuaacaauucacaaggcacuuucacacccauua

SEQ ID NO: 233289 - RNA, 62 nt, hsa
uuagcugcaagaaugcacuuuagaacuauuugacaauucagacuuucaaaauaaagauguaa

SEQ ID NO: 233290 - RNA, 62 nt, hsa
aacaacaaaaaguuacgggguucaucuccuacacaauucauuuacuccauuugaaugcuaga

SEQ ID NO: 233291 - RNA, 62 nt, hsa
ccaagucccucuaacuuugccuuugauaccaaacaauucaaaaguuggaucugaguuuggag

SEQ ID NO: 233292 - RNA, 62 nt, hsa
uuggugcacagagauugacuugauucagagagacaauucacuccaucccuauggcagaggaa

SEQ ID NO: 233293 - RNA, 62 nt, hsa
acaucuaaaacauuauucuuuaaugggauaauacaauucauugagcagcuaccacuuaaaaa

SEQ ID NO: 233294 - RNA, 62 nt, hsa
aaagaaacaaaguuaugggguuaaucuccuacacaauucauuuacuucauuugaauguuaua

SEQ ID NO: 233295 - RNA, 62 nt, hsa
aacgaaacaaaguuaugggguuaaucuccuacacaauucauuuacuucauuugaauguuaga

SEQ ID NO: 233296 - RNA, 62 nt, hsa
gucgauuuaugccucagccacuugccugugcuacaauucauuguguuaccuguagauucagg

SEQ ID NO: 233297 - RNA, 62 nt, hsa
ugaaguuauuccauauaaguaucaaguuaaacacaauucauuuugauuauaaacuauuugac

SEQ ID NO: 233298 - RNA, 62 nt, hsa
caugccacuggaaacaacagacucuuaaacuaacaauucaagcaggcgccaagugcuaugac

SEQ ID NO: 233299 - RNA, 62 nt, hsa
auucagccuacccuguauuugccauaaacuccacaauucacaccaaaaugucuguacuuaga

SEQ ID NO: 233300 - RNA, 62 nt, hsa
uuguguauuuucuuuggggguggaaaaggaaaacaauucaagcugagaaaaguauucucaaa

SEQ ID NO: 233301 - RNA, 62 nt, hsa
aaucuucuguaaggauuuuagaugauaaggcuacaauucagaaucuucugaaccaucuaugu

SEQ ID NO: 233302 - RNA, 62 nt, hsa
aguggccuuggauauccuguuuguuaauaaagacaauucaaccagcucccaccaugcaggcc

SEQ ID NO: 233303 - RNA, 62 nt, hsa
ccucuacaacuuguuacagccuucacauuuguacaauucauugauucucuuuuccuuccaca

SEQ ID NO: 233304 - RNA, 62 nt, hsa
agucaggucaagugaugcuuuugagcuuacacacaauucacaggcccaccagugacaauuua

SEQ ID NO: 233305 - RNA, 62 nt, hsa
gggcauuuuccucuccuuaucuugccccagagacaauucaagauuucuauaugggguugugg

SEQ ID NO: 233306 - RNA, 62 nt, hsa
auuaucagcaugaugaaaggugugucuaaaaaacaauucagaauaccagcagcauuguacag

SEQ ID NO: 233307 - RNA, 62 nt, hsa
aaaaaauauaaaugaggucucguugauguuggacaauucaagaauucagacuugaaccuuaa

SEQ ID NO: 233308 - RNA, 62 nt, hsa
cccccuuaaagcgaacacugaaaugcagguagacaauucaaagucuggagaagagggaucau

SEQ ID NO: 233309 - RNA, 62 nt, hsa
aaaagagacuucaauguuguggacaaaaucauacaauucagucaauuuuauuuuuagcauac

SEQ ID NO: 233310 - RNA, 62 nt, hsa
uauaagcaauauggaacucgaauuaaauauccacaauucaaaagcaccuaaaaagaauaggc

SEQ ID NO: 233311 - RNA, 62 nt, hsa
accugccuucuccacuaguagcugggcagcucacaauucacaccuguguaccugccacaucc

SEQ ID NO: 233312 - RNA, 62 nt, hsa
uguuaucucuggugggcuggcagucauaauucacaauucagacagcccaggcuuccuccaca

SEQ ID NO: 233313 - RNA, 62 nt, hsa
caggucccauuucugaucaccccacuggcaggacaauucacaguucuugagcaaacugaguu

SEQ ID NO: 233314 - RNA, 62 nt, hsa
gguuuuaaugagacccaaaugacucucucuuaacaauucaagcaguagacaaaguugcucac

SEQ ID NO: 233315 - RNA, 62 nt, hsa
auuaaauuuggcagaguuuaauugagcaaaggacaauucacaaaucagguagccccugaacc

SEQ ID NO: 233316 - RNA, 62 nt, hsa
caauauaaaccguggucucauguaacacauaaacaauucaugccuuucauaguuuauuauua

SEQ ID NO: 233317 - RNA, 62 nt, hsa
ugcagcauguugacaccaaccucacguuacgaacaauucacagagaauuugccuuuguggca

SEQ ID NO: 233318 - RNA, 62 nt, hsa
gggauaacaauaguagguaacaccgagugcuuacaauucagugggcacggucaaagugcuuu

SEQ ID NO: 233319 - RNA, 62 nt, hsa
uuaggacuucaauauauaaauuuugcgguuacacaauucaauccaugacagaauccaaaggu

SEQ ID NO: 233320 - RNA, 62 nt, hsa
cccagaauccauuccauuugugauuccaugauacaauucaccaguaaccuaucuuacaugag

SEQ ID NO: 233321 - RNA, 62 nt, hsa
gagcauguguguauucagucagauacuggcagacaauucagaacuuucaccacaugagauaa

SEQ ID NO: 233322 - RNA, 62 nt, hsa
aacucuagccugaauucuuuucaauaaaaaauacaauucaaguugcuucucauggauggcac

SEQ ID NO: 233323 - RNA, 62 nt, hsa
gagagugugagcagggcuugcuccugccaaccacaauucaaugaauccccgaccccccuacc

SEQ ID NO: 233324 - RNA, 62 nt, hsa
auaauccucaauuuuuccuuaucuuguuuuccacaauucacaagcaacagcaagcauuuucu

SEQ ID NO: 233325 - RNA, 62 nt, hsa
aaaaucuagaagaacuuggaugguuucguaauacaauucaccuauagccaaucuugcaugag

SEQ ID NO: 233326 - RNA, 62 nt, hsa
uuacuuggcuuucaaacuugaauaaacaucagacaauucacacuggugacaaacccuaugaa

SEQ ID NO: 233327 - RNA, 62 nt, hsa
aaaguguaaugaguguggcaacaccuuccaucacaauucaacccuuguaagucacaaagcca

SEQ ID NO: 233328 - RNA, 62 nt, hsa
auaguguaaugaguguggcaagaccuuccaucacaauucaacccuguaagucauaaggcaau

SEQ ID NO: 233329 - RNA, 62 nt, hsa
ccuuacaaaugaguguggugaggucauuagguacaauucacuccuuucacaucaguuaauuu

SEQ ID NO: 233330 - RNA, 62 nt, hsa
caaguauaauaaauguggcaagguuuucagucacaauucacuccuacacagcaucagagaau

SEQ ID NO: 233331 - RNA, 62 nt, hsa
uucgcaaaugcucacugaagaaaauuccuaagacaauucaggggccucucauacccucuacu

SEQ ID NO: 233332 - RNA, 62 nt, hsa
ugaaaacugaaugucaagaaaaggagucaagaacaauucacaguaugagaagaaaaauggaa

SEQ ID NO: 233333 - RNA, 62 nt, hsa
aauauaaugaaauaaauauuuauuugugcacuacaauucaaagcauuagaaacauugagagu

SEQ ID NO: 233334 - RNA, 62 nt, hsa
guagucaguuguuuacaaacucccucuccugcacaauucauuuagaggcuucaaucauagaa

SEQ ID NO: 233335 - RNA, 62 nt, hsa
aggucugugugucugcagacugcuaaccuaugacaauucagggaccucaccugucggaccua

SEQ ID NO: 233336 - RNA, 62 nt, hsa
ccuccacuccgcugagaauccuggaggaauacacaauucaucguugcacccccaccucagag

SEQ ID NO: 233337 - RNA, 62 nt, hsa
gguucuguagaaagagggaaaagaugauugugacaauucagagcauaacucagauggcgaga

SEQ ID NO: 233338 - RNA, 62 nt, hsa
aggucuguuuuuauguucaguuuguacaauccacaauucauucaccagauauuuuguucuua

SEQ ID NO: 233339 - RNA, 62 nt, hsa
acauguacuucuguauacauuuacauauuuuuacaauucauacuuuaauuucuaggcuauaa

SEQ ID NO: 233340 - RNA, 62 nt, hsa
gaucugaaauuccucuguagaauuuagcuuauacaauucagagaauagcaguuucacugcca

SEQ ID NO: 233341 - RNA, 62 nt, hsa
aggaaagauucaugucacuacuguccguggcuacaauucaaagguauccaaugucgcuguaa

SEQ ID NO: 233342 - RNA, 62 nt, hsa
aaagcuggcuguuaaaauuauuuuuuugucuuacaauucagggaauauauuuauauuuuucu

SEQ ID NO: 233343 - RNA, 62 nt, hsa
augacuggacagcgguuguaaauacaauucaaacaauucaaucaaagcuaccuuuuuuuuac

SEQ ID NO: 233344 - RNA, 62 nt, hsa
acagacagcaugacuggacagcgguuguaaauacaauucaaacaauucaaucaaagcuaccu

SEQ ID NO: 233345 - RNA, 62 nt, hsa
ugcauuuauaauuuuaccagaauauacaacuaacaauucaacagugauguucuuugcauuug

SEQ ID NO: 233346 - RNA, 62 nt, hsa
cguuauacaaagucauaggagaaaaauaugggacaauucaugauuauacuuaaucuaauuug

SEQ ID NO: 233347 - RNA, 62 nt, hsa
gggcucagaaucucgagaaccgccugcuccuaacaauucagcaagucaggggcuuccucucu

SEQ ID NO: 233348 - RNA, 62 nt, hsa
uggugggguuggacucucuucuggagacccagacaauucagucuccagauuucuggcagugg

SEQ ID NO: 233349 - RNA, 62 nt, hsa
acgaggcaggggcuccaggaaaggaaucagagacaauucacagagccucccucccugggcuc

SEQ ID NO: 233350 - RNA, 62 nt, hsa
ccaguuucuggcacaauuccagcacaauuaugacaauucagagaagcaagucaaaggacugg

SEQ ID NO: 233351 - RNA, 62 nt, hsa
ugcccaagcuuccugugcccagggugucagccacaauucagcgggugagggccucgcuuggg

SEQ ID NO: 233352 - RNA, 62 nt, hsa
auuugagaaaggaucugcaaaauaaagauaccacaauucaucuuaaaacugcagagauuuaa

SEQ ID NO: 233353 - RNA, 62 nt, hsa
uuggcuuaauuccaaucauuguuaaaguaaaaacaauucaaagaaucaccuaauuaauuuca

SEQ ID NO: 233354 - RNA, 62 nt, hsa
cacauaacauaaaguuaaccauuuuaaagggaacaauucaguggcauuugguacugaacauc

SEQ ID NO: 233355 - RNA, 62 nt, hsa
aacuccgccccaaaaaggagaguaacaaauacacaauucacacauaacacuaagcguaaauc

SEQ ID NO: 233356 - RNA, 62 nt, hsa
gaugaacaguguaugacucaaacagcugccuuacaauucacucauuccauguggaacaaaca

SEQ ID NO: 233357 - RNA, 62 nt, hsa
ccccuuggcucucaaugcuguuuggguuuccaacaauucagcauuagugggaaaaagugggc

SEQ ID NO: 233358 - RNA, 62 nt, hsa
guaacauuauugagauauaauucacauaccuuacaauucacuuauuuuaaggguacaauuua

SEQ ID NO: 233359 - RNA, 61 nt, hsa
accccagggggauugacucugcaguuugggagccacaaaaagcguagcggugugauuucua

SEQ ID NO: 233360 - RNA, 61 nt, hsa
acagcuucacagccccuugaggagugaccaagccacaaaguaaauccuaaagccacaaccc

SEQ ID NO: 233361 - RNA, 61 nt, hsa
cugcccuccuucccaucccacaugcugagccgccacaaagaccaaagaagugauggcuuuu

SEQ ID NO: 233362 - RNA, 61 nt, hsa
cugcccaaauguggcuuaggaggcugcuucugccacaaaaccgucauacucuugugcgugc

SEQ ID NO: 233363 - RNA, 61 nt, hsa
gggauugagcauuuauggcagcaacagaggagccacaaaauguucuuuguucuuuggcucc

SEQ ID NO: 233364 - RNA, 61 nt, hsa
uuuucaagaaccauacuucgacauuuccucugccacaaaaaaugaacgcauuuuaaguuag

SEQ ID NO: 233365 - RNA, 61 nt, hsa
ucaagccccagaggaggcggcaagaggaacagccacaaacaaguacuuuaccccacagcuu

SEQ ID NO: 233366 - RNA, 61 nt, hsa
gacuuucacaccauuaauggggaaaagcguggccacaaaaacagaugcuaggaagcuuggc

SEQ ID NO: 233367 - RNA, 61 nt, hsa
cugcugauucccugcaccuagcacagugcuugccacaaagugggcucucaauaaauauuau

SEQ ID NO: 233368 - RNA, 61 nt, hsa
gauggaccgggugggccuggccugagcuggggccacaaaucaaagcaagggcuccagcauc

SEQ ID NO: 233369 - RNA, 61 nt, hsa
aaacccaaauucugcaaaaaaauaaaaauaagccacaaaacuaaaaggccuggccccauuc

SEQ ID NO: 233370 - RNA, 61 nt, hsa
uuucauuaugcacuuuuagaaaugcauauuugccacaaaaccuguauuacugaauaauauc

SEQ ID NO: 233371 - RNA, 61 nt, hsa
cuggagacuuugaguucuccuacauucauccgccacaaaucuuaauguguugaaagaauga

SEQ ID NO: 233372 - RNA, 59 nt, hsa
cuuaccugaugcuaaaauaaugugccucggccacaaaaaagcaugcaaagucauuguua

SEQ ID NO: 233373 - RNA, 61 nt, hsa
uugagcaucugucccccuuuagaucucugaagccacaaauaggaugcuugggaagacuccu

SEQ ID NO: 233374 - RNA, 61 nt, hsa
auaaaugaagaaggaauaaaagaaauaggaagccacaaauuuguauggauauuucaugaua

SEQ ID NO: 233375 - RNA, 61 nt, hsa
cuuggccuggugggaccagggcuccacagaggccacaaaauguugcaagucaugauggaug

SEQ ID NO: 233376 - RNA, 61 nt, hsa
acaucuugaugcuaaguaacauuucccaugagccacaaaacugaaugcugaaaagcuacua

SEQ ID NO: 233377 - RNA, 61 nt, hsa
gucuuaaaaucaaaguauccaauauuuuaaagccacaaaguagauuacauaauuagcagag

SEQ ID NO: 233378 - RNA, 61 nt, hsa
uaaauguguguugaaugaaugugccuaugaagccacaaagaugccacauguuaguauauca

SEQ ID NO: 233379 - RNA, 61 nt, hsa
uuaaguucuaccuaggauauuuccaaggacugccacaaaacccauaugugcaguacuuuac

SEQ ID NO: 233380 - RNA, 61 nt, hsa
agcucaaaggagaaccagaauuuuuuugacagccacaaacaagaauacagguaucuuggau

SEQ ID NO: 233381 - RNA, 61 nt, hsa
gagcccaccuuggaauuaagggcgugccucagccacaaaugugacccaggauacagagugu

SEQ ID NO: 233382 - RNA, 61 nt, hsa
uuauuuccuccuccccuaccccuaguuaagugccacaaagacuguguuauguagucaguac

SEQ ID NO: 233383 - RNA, 61 nt, hsa
uggugccaugcaauccccuuuugguagaauugccacaaacaaggcucaaaauucucaucau

SEQ ID NO: 233384 - RNA, 61 nt, hsa
agucuguggaaaccaggaagauaaaacaacagccacaaaagagaaaaucaagaguguugca

SEQ ID NO: 233385 - RNA, 61 nt, hsa
guguuuuguuugaaugugcaauaguuuauaggccacaaauaagcuuucuuguaagcucucu

SEQ ID NO: 233386 - RNA, 61 nt, hsa
uguguuuuaauuugagaaucuugaggguagagccacaaauuucaauucuuacauuuccauu

SEQ ID NO: 233387 - RNA, 61 nt, hsa
caagccaguccuaagagaaaaggugguggcagccacaaauucuagguacacuggcugcugc

SEQ ID NO: 233388 - RNA, 61 nt, hsa
guaacagaguagcagaaauuuaaacucugaagccacaaagacccagagcaaacccacuccc

SEQ ID NO: 233389 - RNA, 61 nt, hsa
agacuggugucuguuuuguuaaugcagcugugccacaaauucuccuuuaucuuuuaaaaau

SEQ ID NO: 233390 - RNA, 61 nt, hsa
aagguagggguucagaaauggugccauugaagccacaaagccgguaaaugccucaauacgu

SEQ ID NO: 233391 - RNA, 61 nt, hsa
gcugcuugucauagcugacacagagccaucugccacaaaccuguggcggcuucagaucucc

SEQ ID NO: 233392 - RNA, 61 nt, hsa
agaacucguagcucgugacugcacgguuuacgccacaaaagugcucuugacauccgugaca

SEQ ID NO: 233393 - RNA, 61 nt, hsa
uuuuguuauuagggugguauuuagucuauuagccacaaaauugggaaaggaguagaaaaag

SEQ ID NO: 233394 - RNA, 61 nt, hsa
ucaugaagagaagacaccaguuuuaaaaugagccacaaacaguaaagcccuaucaguauaa

SEQ ID NO: 233395 - RNA, 61 nt, hsa
acaucuggugcuuuucaugugucauuugugagccacaaaugcaaaguugccauuugaauuc

SEQ ID NO: 233396 - RNA, 61 nt, hsa
agaaucaaguaucugagacuguggaguaauagccacaaaacagagggcccacugcacagca

SEQ ID NO: 233397 - RNA, 61 nt, hsa
auaaugacaguuacaugguagaacugcccaugccacaaauauuuauuuggaaaaguaguca

SEQ ID NO: 233398 - RNA, 61 nt, hsa
ucaguuuggucugcuccgccuggggcagaaagccacaaacuccauccagauccggaacguc

SEQ ID NO: 233399 - RNA, 61 nt, hsa
gaguggccaaguauggggucauggauuccaggccacaaauuccaggccuaguucagucugg

SEQ ID NO: 233400 - RNA, 61 nt, hsa
ggugggagugguuuaggcuauuuguaaaucugccacaaaaacagguauauacuuugaaagg

SEQ ID NO: 233401 - RNA, 61 nt, hsa
agaugugcgaguuauugacuguggaguacuugccacaaaaucaauaaaagaugguaagaac

SEQ ID NO: 233402 - RNA, 61 nt, hsa
ccuguuccaauucggaaaacaauaggggaaagccacaaaagcacaaacaugggucaaagga

SEQ ID NO: 233403 - RNA, 61 nt, hsa
uuccugggaaaguaauugcugagccaguacagccacaaacaguacuauuuugcagaugcuc

SEQ ID NO: 233404 - RNA, 61 nt, hsa
aaaauggacaugguggcuuuguuuagguagagccacaaaagaaaagacuuguaauauuuuu

SEQ ID NO: 233405 - RNA, 61 nt, hsa
ccaaacauaaagagaacucuggggagccugagccacaaaaauguuccuuuauuuuauguaa

SEQ ID NO: 233406 - RNA, 61 nt, hsa
aauguuuugagucagugcauuucaaggaacagccacaaaauacacaccccuaagaaaaggc

SEQ ID NO: 233407 - RNA, 61 nt, hsa
cagccucacgacagauaccaggcaauccagagccacaaaacgugauuccuccaggcucugc

SEQ ID NO: 233408 - RNA, 61 nt, hsa
cuuugaaaccccuuagagagaagcauauauggccacaaagcacagaggcuuagguuugcca

SEQ ID NO: 233409 - RNA, 61 nt, hsa
gggaauucaacccugcagaugucaacugaaggccacaaaaaugaacuccaucuacaaguga

SEQ ID NO: 233410 - RNA, 61 nt, hsa
ugggaggguagaaugccauuccagaggacaagccacaaaaaugccuuaauuugagcucgua

SEQ ID NO: 233411 - RNA, 61 nt, hsa
auuuugacacaauguugcacugaaaacccaggccacaaaugugucccagugaacaguuugg

SEQ ID NO: 233412 - RNA, 61 nt, hsa
aacacaaaacuuaagauggcccaaaacaaaagccacaaacaguucaucauuuggugcuuag

SEQ ID NO: 233413 - RNA, 61 nt, hsa
guuucauguauuuuuuaaaguuuucauuugugccacaaaaaucugucguggaauauauuuu

SEQ ID NO: 233414 - RNA, 61 nt, hsa
cagaguccgagcuuaucuaaauaugaauguggccacaaagcuguggaaggugacaaagcuu

SEQ ID NO: 233415 - RNA, 61 nt, hsa
aacuugauaccacgggaguccaguaauauuggccacaaaagccagagaaaguaccaagccc

SEQ ID NO: 233416 - RNA, 61 nt, hsa
cuaaauauaagagaaaugauauuggugagaagccacaaaaauaugaaaaauguggcaaagc

SEQ ID NO: 233417 - RNA, 61 nt, hsa
ggauggccuggcagcagggauguuuccgugagccacaaauaccagaaacugaggcgaggcu

SEQ ID NO: 233418 - RNA, 61 nt, hsa
aaucucaaagaaugagacuuguaaugagaaugccacaaacuugaauaccuuaugcacaaaa

SEQ ID NO: 233419 - RNA, 61 nt, hsa
aaauacucacacgugaaauuucaaaaaagaagccacaaauauguaguucugaagauguuga

SEQ ID NO: 233420 - RNA, 61 nt, hsa
uguuaucgucauauaauuuucauguacaaaugccacaaauaaauugaauguuuaaagcuau

SEQ ID NO: 233421 - RNA, 60 nt, hsa
uuucccccaugaaguucaauaaaccagcuuagccacaaagaaauuguguuuuauuuucuu

SEQ ID NO: 233422 - RNA, 61 nt, hsa
aaaaaaauaaaaaggaaaggaagcguucaccgccacaaaucauaaaauggacaugacugug

SEQ ID NO: 233423 - RNA, 61 nt, hsa
auuugccaugucaugaguagguagauguuuugccacaaauaugaauguguuuguuguuucc

SEQ ID NO: 233424 - RNA, 61 nt, hsa
uaacaauuuaguguuugacauugcuuccucugccacaaagacaauacucuggugacacaug

SEQ ID NO: 233425 - RNA, 61 nt, hsa
gauaccauuauauuuauaugagcuauguacugccacaaaaaaagaugaaauguaauuucua

SEQ ID NO: 233426 - RNA, 61 nt, hsa
aguuuaguuauuuuguucuguucugucaugugccacaaaauauguacuuuuuucacuuuuu

SEQ ID NO: 233427 - RNA, 61 nt, hsa
uuuaggaagacaaauaaauaacaaacaaacagccacaaauacuuuuuuuucaaaauuuuag

SEQ ID NO: 233428 - RNA, 61 nt, hsa
aauaaaauuagagcuguaaggaaaaugaaaagccacaaaugcaagacuguucuuaaaugga

SEQ ID NO: 233429 - RNA, 61 nt, hsa
uaauacagugcuguccaauagaaacacaacagccacaaaugcaggccacagaugcaaauau

SEQ ID NO: 233430 - RNA, 61 nt, hsa
aagucauuaguaauaaaaccucaucucaauagccacaaaaagacaaauguggucaccacac

SEQ ID NO: 233431 - RNA, 61 nt, hsa
acauugggucuauaaaugugcauuuguaagggccacaaaagugaacgugugguacuguagu

SEQ ID NO: 233432 - RNA, 61 nt, hsa
uuaaaacuaacuccagcacuaaagcugaaaugccacaaacacuaaaaguauaaauaugucu

SEQ ID NO: 233433 - RNA, 61 nt, hsa
acagauauaauauacagugaucauucucuaugccacaaauuagcuaaugcuuucuuguuuu

SEQ ID NO: 233434 - RNA, 61 nt, hsa
agagaaagaucagaauggccuugagaauagagccacaaaaauaacuaugaaaaugccagua

SEQ ID NO: 233435 - RNA, 61 nt, hsa
ccuuccaaacauacaaacauaaugauuugaugccacaaagcucgcuuacucagaccaagga

SEQ ID NO: 233436 - RNA, 61 nt, hsa
aguuuagcauuuccaucugcgaugaauguaggccacaaaccacaguaguauuagcagugcc

SEQ ID NO: 233437 - RNA, 61 nt, hsa
cuugauucuacaauguagaaaaugaggaaaugccacaaauuguauggugauaaaagucacg

SEQ ID NO: 233438 - RNA, 61 nt, hsa
gaaaucacauuuacaaaauuacacaguuaaugccacaaaacugacaguaaaucucacaaau

SEQ ID NO: 233439 - RNA, 61 nt, hsa
aaaacucuuuggugcacaaguaacacauuuggccacaaaacaccaaagaauuguaggcagu

SEQ ID NO: 233440 - RNA, 61 nt, hsa
cccuuagcccugacaucugucaagcuuuggggccacaaaauaauuuaauauaacccuaagc

SEQ ID NO: 233441 - RNA, 61 nt, hsa
ugaaaguuuucuauaccugucuccuuucucagccacaaaauaaauguugggagaaaugaua

SEQ ID NO: 233442 - RNA, 61 nt, hsa
cuuuuuuucuuagaaauuaaagauuaugaaagccacaaacuuuuuaguuuuuaacuucaaa

SEQ ID NO: 233443 - RNA, 61 nt, hsa
aaaaauguauuugucauguuaaaaaguguuagccacaaaaggcuacuuacuuucuuuuccu

SEQ ID NO: 233444 - RNA, 61 nt, hsa
cccacaaucuggcuuagugccacccaccuuugccacaaagcuaggaugguucugugaccca

SEQ ID NO: 233445 - RNA, 61 nt, hsa
gccguguagaauauuugucuuaaaauucaaggccacaaaaacaauguuugggggaaaaaaa

SEQ ID NO: 233446 - RNA, 61 nt, hsa
cuccccaaggagaucggucaccaggagagcagccacaaaggucaagaaagacacacacgga

SEQ ID NO: 233447 - RNA, 61 nt, hsa
aucaaucaaaagacuuucucaaucuauuuuggccacaaacaaacauauucaacugaagcuu

SEQ ID NO: 233448 - RNA, 61 nt, hsa
uuccucauuucaucauuggucuuuauauguagccacaaacacugaccucauguaggcaccu

SEQ ID NO: 233449 - RNA, 61 nt, hsa
auauaaaaauaagcauugguuguucuuaccagccacaaaguaaacuucauuuucaggcagu

SEQ ID NO: 233450 - RNA, 61 nt, hsa
gagguucagugguggcagcaggaaggacacugccacaaauuuugucuauuucauauuuguc

SEQ ID NO: 233451 - RNA, 61 nt, hsa
ggcuaauuaaaaaaauaguuaugaaaucuuagccacaaaaaauaaaucagguaaacauuuu

SEQ ID NO: 233452 - RNA, 61 nt, hsa
cuucagaaguuucacccuuuuuaaucucucagccacaaaccucaguuuccaaauauuuguu

SEQ ID NO: 233453 - RNA, 61 nt, hsa
ggccucccaugcaucuguacucccccugugugccacaaaugcacuacguuauuaaauuuuu

SEQ ID NO: 233454 - RNA, 61 nt, hsa
uuguauagaauggauuuagauugucuauaaagccacaaauacguauuuugccacaguguau

SEQ ID NO: 233455 - RNA, 61 nt, hsa
ggaagccaugcugucagcagguacacaucuugccacaaaaccaguaaccuguggcacugag

SEQ ID NO: 233456 - RNA, 61 nt, hsa
uuuccuuaauucaaagaucauauuuuagcuggccacaaaaccaagaacauaucuagcaaga

SEQ ID NO: 233457 - RNA, 61 nt, hsa
gcagcgggugcagccaggugucugcagagcagccacaaagguggccuaggaugcggguguc

SEQ ID NO: 233458 - RNA, 61 nt, hsa
gccuuugaaauggcuuugcuaaaaugcucccgccacaaaguuguaggaaaugggaagagga

SEQ ID NO: 233459 - RNA, 61 nt, hsa
aagacuugugcauucagugaagcguuauuaugccacaaacuaaccuaccucaccuuacuca

SEQ ID NO: 233460 - RNA, 61 nt, hsa
aauuugaaucaugagaauuauggguuaaaaagccacaaagaagcacauauuggugaccauc

SEQ ID NO: 233461 - RNA, 61 nt, hsa
auuuuuaaugauaugagaaaaauuuuguuaggccacaaaaacacugcacugugaacauuuu

SEQ ID NO: 233462 - RNA, 61 nt, hsa
ccauaugucccugaguuauuuuuaucauaaagccacaaauguauuauaacaaggcaaauug

SEQ ID NO: 233463 - RNA, 61 nt, hsa
ucucauccuuucuccucccucuccuuuuccugccacaaaaggugaaaaaugagauccaauc

SEQ ID NO: 233464 - RNA, 61 nt, hsa
gguuuuuugaacucacuucuggaggugcagagccacaaacgcacuuucggggccuaguuuu

SEQ ID NO: 233465 - RNA, 61 nt, hsa
augaaaaagaauaagucacauugguuccauggccacaaaccauucagaucagccacuugcu

SEQ ID NO: 233466 - RNA, 61 nt, hsa
uauuguugaucuuagauuaaaaaguggaagagccacaaacauuggugcccuuuucagacua

SEQ ID NO: 233467 - RNA, 61 nt, hsa
ugcucuucaucacagcuaucugucuuuuagugccacaaauaaaagaaaaucaaaucuuagc

SEQ ID NO: 233468 - RNA, 61 nt, hsa
auuauuaauccucuugagagaaacgugaaacgccacaaaaauagagaaaauucaggucugu

SEQ ID NO: 233469 - RNA, 61 nt, hsa
aaggaacgaauauaugugauuaucacuguaagccacaaaggcauucgaagagaaugaagug

SEQ ID NO: 233470 - RNA, 61 nt, hsa
ugucgccaaggcccacauuuuccugagagaagccacaaaagaugugcaaaugcccuucagc

SEQ ID NO: 233471 - RNA, 61 nt, hsa
uuugguccauccuuugaugugugguucguuagccacaaagagaaauaucugaaagucaaca

SEQ ID NO: 233472 - RNA, 61 nt, hsa
ggcucuuguucagucaagaccccagacucuggccacaaaaaugccauaaugccuguuggua

SEQ ID NO: 233473 - RNA, 61 nt, hsa
uuuagcuuuucuuuuguuauauaaacugcuagccacaaauuuuaguuauguaaaaggcuac

SEQ ID NO: 233474 - RNA, 61 nt, hsa
augcauuccugucauuacccauuguaacagagccacaaacuaauacuaugcaauguuuuac

SEQ ID NO: 233475 - RNA, 61 nt, hsa
cuuuuuuaaauuaaaggacuuuguuacuuuagccacaaagcuaaaacagcauuaccucagc

SEQ ID NO: 233476 - RNA, 61 nt, hsa
cuuauauaacaagugagcauagcuaucaaaagccacaaaguuuuggucaggacuguaaauc

SEQ ID NO: 233477 - RNA, 61 nt, hsa
cuugcaagcagagucagggucaccagugaaugccacaaaaguucucuuucccacuguuuaa

SEQ ID NO: 233478 - RNA, 61 nt, hsa
auuuuccuuuuaccuuucuccaccauccagagccacaaaagcaaaccuucuaccuccuacc

SEQ ID NO: 233479 - RNA, 61 nt, hsa
acaagacaacauucaauuugauagaaaucuugccacaaaacuucaaaugcuacaaaauaua

SEQ ID NO: 233480 - RNA, 61 nt, hsa
cuacugaauuuagcgaauuuguggaggcauugccacaaaucagccaggugaaguuucacac

SEQ ID NO: 233481 - RNA, 61 nt, hsa
auuugaagagcaaagcauguuuuguguguuugccacaaaacauugcuugaagcacauacuu

SEQ ID NO: 233482 - RNA, 61 nt, hsa
aaauaauccuguuuauauguuauaguuucuugccacaaauuuuguuuuuucaaacuuaccu

SEQ ID NO: 233483 - RNA, 61 nt, hsa
gcugggacagucaccaggguuggggggaagggccacaaaaugaaaccauuaaagacccuua

SEQ ID NO: 233484 - RNA, 61 nt, hsa
ugacagugaaguauguuuuauggacuuaaaugccacaaacaguuaaguccauuggcuugga

SEQ ID NO: 233485 - RNA, 61 nt, hsa
aaauggacauuuucauaugcaauggaaaacagccacaaaaaaaccuaccuuauauggaagu

SEQ ID NO: 233486 - RNA, 61 nt, hsa
uaaagagagcccugguccuagacauaguucagccacaaaguaguugucccuuuguggacaa

SEQ ID NO: 233487 - RNA, 61 nt, hsa
ggaaacagccucucucuuuucuacacacucagccacaaagccccccagcucccacaccgcg

SEQ ID NO: 233488 - RNA, 61 nt, hsa
aaaggaaggccaaaguauccaucauuagucagccacaaaagacaaucaaaguggcagaacu

SEQ ID NO: 233489 - RNA, 61 nt, hsa
caaucauaauguguuaaagcccucuguggcugccacaaaagacuagaaucaugaaaucuuu

SEQ ID NO: 233490 - RNA, 61 nt, hsa
uuagggagaaaaauaaauauaugcuguaguggccacaaauaggccuaugauuuagcuggca

SEQ ID NO: 233491 - RNA, 61 nt, hsa
uaaaggaaggccuuugaggacacaccugucugccacaaaugcuuuaaaguguaucaugagc

SEQ ID NO: 233492 - RNA, 61 nt, hsa
cuaaccaaggaacaagaaucucacuaucagagccacaaaucugggaccugucuuuccaacu

SEQ ID NO: 233493 - RNA, 61 nt, hsa
ccacggagggcuccugccucucuucuucagcgccacaaaauuacauggaggccagcugguu

SEQ ID NO: 233494 - RNA, 61 nt, hsa
cagucagggggcaucuugcaagaccuuuagugccacaaauaagcaucgagcaccuccccau

SEQ ID NO: 233495 - RNA, 61 nt, hsa
ucuccaaacuacacuucccuggagaacaagugccacaaaaaugaaaacaggccacuucuca

SEQ ID NO: 233496 - RNA, 61 nt, hsa
guggccuggcaucgcaucguggugugucaaugccacaaaaucguguguccguggaaccagu

SEQ ID NO: 233497 - RNA, 61 nt, hsa
aggaugucugcagaacuuuguucuguuuucugccacaaaaaugugaauaguucagagugaa

SEQ ID NO: 233498 - RNA, 61 nt, hsa
cucugccuaucgccuggauggcuuuaaauuagccacaaaaaaucacaagccauuuucuuug

SEQ ID NO: 233499 - RNA, 61 nt, hsa
agucauaaugcaguaucuuccccugacuccagccacaaagcucauacccagcccuaccaau

SEQ ID NO: 233500 - RNA, 61 nt, hsa
cucacuagcuugagggggcacaugaagauaagccacaaaugaagagaaaagccaugcccac

SEQ ID NO: 233501 - RNA, 61 nt, hsa
aggccucuccgcguggguacuuggggguggggccacaaaucuggcgaaaaacuucaugcug

SEQ ID NO: 233502 - RNA, 61 nt, hsa
auuucagccuacauugaugccaagcuuuuuugccacaaagaagauucuuaccaagaguggg

SEQ ID NO: 233503 - RNA, 61 nt, hsa
ucuagccuaaguguggagaaggauagccucagccacaaaacucugucaggcauugaaugac

SEQ ID NO: 233504 - RNA, 61 nt, hsa
gagaguuguuuuuguucuauguaacaguauugccacaaaacuauaggcaaaucguguuugc

SEQ ID NO: 233505 - RNA, 61 nt, hsa
gcaacaaccuugaagggacagcaauggcaaagccacaaaggcuucacuguacucaggggag

SEQ ID NO: 233506 - RNA, 61 nt, hsa
gucuuccuuccacccuguggccugcacuugagccacaaagugugugugugugugugcgugu

SEQ ID NO: 233507 - RNA, 54 nt, hsa
aaaaaaaagcgacagccugaagcagccacaaaauccuguguuagaagcagcugu

SEQ ID NO: 233508 - RNA, 61 nt, hsa
cugccacucuccccauuggcaccgcuucucagccacaaacccugccucuuuuccccaugaa

SEQ ID NO: 233509 - RNA, 61 nt, hsa
ccagaugccagggaagggacagaggaaaacagccacaaacaagccaggggggcuccccgga

SEQ ID NO: 233510 - RNA, 61 nt, hsa
cucagccuacagcaguguggucucuuacauggccacaaagggacacacagugacaaaaggc

SEQ ID NO: 233511 - RNA, 61 nt, hsa
uuuuuuuuuuuaaaccaacaaaccaaaaaaggccacaaaauuaauuagaggcuucucaucu

SEQ ID NO: 233512 - RNA, 61 nt, hsa
cccaacucuuaacugaaaauguguuagacaagccacaaaguuaaaauuaaacuggauucau

SEQ ID NO: 233513 - RNA, 61 nt, hsa
uucucugacauaguucuuggcaugggagccagccacaaaugagauucugacguguccaggu

SEQ ID NO: 233514 - RNA, 61 nt, hsa
uucccucuuccccuuuauaaauuaugcuaaagccacaaagcacauuuuuggggaucauaga

SEQ ID NO: 233515 - RNA, 61 nt, hsa
uuucugaaaauaacccuuaacguauccaacagccacaaagcaugaacaaccuaacaauaau

SEQ ID NO: 233516 - RNA, 61 nt, hsa
aaagcaggaguaaugugccgauucugaaguugccacaaaaaauaagacacuggugaaugag

SEQ ID NO: 233517 - RNA, 61 nt, hsa
ucugcccccacccugguacugccuggugccugccacaaaauaagcacuaacaaaaguguau

SEQ ID NO: 233518 - RNA, 61 nt, hsa
aacuguguaucucaaaaaccauauuuccagagccacaaacaugaggaccaaaaaggaugga

SEQ ID NO: 233519 - RNA, 61 nt, hsa
gcagcauccaggcugaccucaaggaagcauagccacaaaacagaauagcaccugucuguac

SEQ ID NO: 233520 - RNA, 61 nt, hsa
cuuuccucaaagaagcaugaggugagagaaagccacaaagucagugccuggagaaggguuc

SEQ ID NO: 233521 - RNA, 61 nt, hsa
gacgaugcacaaaaaaccacccuguacgaaggccacaaagaacagcucagaugcacaaaga

SEQ ID NO: 233522 - RNA, 61 nt, hsa
ccuggcuggagaauguggagaacuaaagguggccacaaauucuuugacacucaaguccccc

SEQ ID NO: 233523 - RNA, 61 nt, hsa
gggagugggccuugauggccgggccucgaaggccacaaacaaggcgucgaggaauuggaaa

SEQ ID NO: 233524 - RNA, 61 nt, hsa
caaaguaagacuaauuauuuaaaauaaaaaugccacaaauuucauuuucuccuucuaagua

SEQ ID NO: 233525 - RNA, 59 nt, hsa
augggggccccagcaguuaacagggcccagccacaaauucagcugaagggaccaaggug

SEQ ID NO: 233526 - RNA, 61 nt, hsa
cuucuagauuauugauucaaaauaaaaagaagccacaaagaguaauugaguuguuacuggu

SEQ ID NO: 233527 - RNA, 61 nt, hsa
auauauauaucuuagucccugccucucaagagccacaaaugcauggguguuguauagaucc

SEQ ID NO: 233528 - RNA, 61 nt, hsa
cuguugaaaucaaguaauuaaacauuuaagagccacaaaauuguaucacuuuuauaauauu

SEQ ID NO: 233529 - RNA, 61 nt, hsa
ccgagggcugagcuccagagccgcaccaucugccacaaacagaauucgagacauacuuaau

SEQ ID NO: 233530 - RNA, 61 nt, hsa
agaugcaggcgaaaagcagccacaccccucugccacaaaugaccaacagcuggucaggacg

SEQ ID NO: 233531 - RNA, 61 nt, hsa
ucugcaucuuuccuacaugagaagcuucucugccacaaaagugacuucaaagacggauggg

SEQ ID NO: 233532 - RNA, 61 nt, hsa
agguagaggcuggcacuuuauuagaaugcaagccacaaaaauaucaauuuuguuuuuuuug

SEQ ID NO: 233533 - RNA, 61 nt, hsa
ucuuuucuuacacucuuggacaauggaccaugccacaaaaacuuaccguuuucuaugagaa

SEQ ID NO: 233534 - RNA, 61 nt, hsa
cauacuauccuguuuccuccucaauagaauugccacaaacugcaugcuaaauaaagaugua

SEQ ID NO: 233535 - RNA, 61 nt, hsa
uacacacaugcacacacauauacacacaugugccacaaacaagugcacacuguccuggugu

SEQ ID NO: 233536 - RNA, 61 nt, hsa
gaguauugugucuacuuuuaucugugcaccagccacaaauacccacauuggaaagacccau

SEQ ID NO: 233537 - RNA, 61 nt, hsa
aguuaucuuucguagcagaaaccauuuugcugccacaaaauuuucaucaucagaacuaaua

SEQ ID NO: 233538 - RNA, 61 nt, hsa
ucugacuucuuauuaccuccgauuggaacgcgccacaaaucauccugcuuucuuuauccuc

SEQ ID NO: 233539 - RNA, 61 nt, hsa
guuguuguaacacaaguguuauuagaccauagccacaaaauauuuaauguguugugccuuc

SEQ ID NO: 233540 - RNA, 61 nt, hsa
uacuuuggggaaauuccacaauguauuagcagccacaaauuuccacugguaaccaaagagu

SEQ ID NO: 233541 - RNA, 61 nt, hsa
ggcacugugaaauuuaaguguaagacauugagccacaaacauggaaucucuucuuuguacu

SEQ ID NO: 233542 - RNA, 61 nt, hsa
cagaguccuggcccuugaugcccagcucagugccacaaagcucaauaggagggauguucca

SEQ ID NO: 233543 - RNA, 61 nt, hsa
aucuggauaaagagauuuugauuuuugaaaugccacaaaaccccuuaaaguggucaaguac

SEQ ID NO: 233544 - RNA, 61 nt, hsa
gucuuuuuuuucugaagugagugaaaaaggugccacaaaggaauuccagguccgagccaac

SEQ ID NO: 233545 - RNA, 61 nt, hsa
ggacccccucaccaggccuggaacaccuccagccacaaagaagccaaaggucagucccucu

SEQ ID NO: 233546 - RNA, 61 nt, hsa
aagagguuguuaccucaguaaaaaccuucaggccacaaagcaaaaaguugcauagccacaa

SEQ ID NO: 233547 - RNA, 61 nt, hsa
auugaugauaauacuguacuucaucuuacuugccacaaaauaacauuuuauaaauccucaa

SEQ ID NO: 233548 - RNA, 61 nt, hsa
cucaccugccucugguggcugggauucagaugccacaaaacugucaguaucuauagaccag

SEQ ID NO: 233549 - RNA, 61 nt, hsa
uaaaaagagagcuuaaugauaauauuguggugccacaaauaaaauggauuuauuagaauuu

SEQ ID NO: 233550 - RNA, 61 nt, hsa
accauacaaucuagugucaaaaacauaaauggccacaaaaaaguaguuugaguguuaugaa

SEQ ID NO: 233551 - RNA, 61 nt, hsa
uguuuaaaguuguucugguugauugcuuguugccacaaagguguguugagcccauucauuu

SEQ ID NO: 233552 - RNA, 61 nt, hsa
ccaguuacuuggagugggggguggggguggggccacaaaaggaaaaccggaggagcaauug

SEQ ID NO: 233553 - RNA, 61 nt, hsa
aauaaagaacuucaggagcuucuuaggucuugccacaaaaaucugcaaauuugauaauucu

SEQ ID NO: 233554 - RNA, 61 nt, hsa
ugccucccagccucggcucagcacaucccuugccacaaaucagugucuggggcuuggccac

SEQ ID NO: 233555 - RNA, 61 nt, hsa
uccuaugaauuuagugguuuuauguggauaugccacaaaacacaagugguaugcuuuagau

SEQ ID NO: 233556 - RNA, 61 nt, hsa
uaugcauggggagccuguuagcacagugccugccacaaaaacaagugcccccgacaagaua

SEQ ID NO: 233557 - RNA, 61 nt, hsa
ggacucugauuucauagcauuuugauaaaaugccacaaaauaagggcuauagagagauuuu

SEQ ID NO: 233558 - RNA, 61 nt, hsa
ccaaaucaagaaugcaauccuauucacaauugccacaaaaagaauaaaauaccuaggaaua

SEQ ID NO: 233559 - RNA, 61 nt, hsa
uucggugugcugccaacuugauguuccaccugccacaaaccaccaggacugaaagaagaaa

SEQ ID NO: 233560 - RNA, 61 nt, hsa
aagacaaaaacaaauuuaaaaaaaaauuuaagccacaaaaaaaggcacauagggaauuaug

SEQ ID NO: 233561 - RNA, 61 nt, hsa
cuguauaaauguuuuacauuaaguguuacgagccacaaauuucauguacauuuauuauaua

SEQ ID NO: 233562 - RNA, 61 nt, hsa
ggcgcugucccgcccaaccccgccuuuaaacgccacaaauaaagagcauuguuaccgccac

SEQ ID NO: 233563 - RNA, 61 nt, hsa
accgcuagcgaggugauaggacaucuggcuugccacaaaggucuguucgaccagacauauc

SEQ ID NO: 233564 - RNA, 61 nt, hsa
gaugauacaguguuuuuuaggaaaagcaucugccacaaaaauguucacuucgaaauucuga

SEQ ID NO: 233565 - RNA, 61 nt, hsa
aacaguucuucuaauugagacugacuccaaggccacaaacuguucaacacacacaaagugg

SEQ ID NO: 233566 - RNA, 61 nt, hsa
gguguacauauacaccauggaauacuauucagccacaaaaaggaacaaaauaauggcauuc

SEQ ID NO: 233567 - RNA, 61 nt, hsa
ucaaauauauuaaguuguauaaacuaucaaggccacaaaauacuaaugucauuuggucaua

SEQ ID NO: 233568 - RNA, 61 nt, hsa
ucuacuagaggacuugaaagagaacugaggggccacaaaauaaacuucaccuuccauuaag

SEQ ID NO: 233569 - RNA, 60 nt, hsa
uacagcauucuuacuccuaaacagcagucagccacaaacugacccagaguuuaauuagca

SEQ ID NO: 233570 - RNA, 61 nt, hsa
cucauuccucuuccucuuuguguagguuucagccacaaaacugucauucacucuaggggac

SEQ ID NO: 233571 - RNA, 61 nt, hsa
uuacuuuaaccccuaaauugauuuuguaaaugccacaaaugcauagaauuguuaccaaccu

SEQ ID NO: 233572 - RNA, 61 nt, hsa
guauugcuuauauguccuuauggggaugggugccacaaauagaaaauaugaccagaucagg

SEQ ID NO: 233573 - RNA, 61 nt, hsa
agcugaucccuuacccccaggcugggaugcggccacaaagcacgucuauuuuuuuaugaaa

SEQ ID NO: 233574 - RNA, 61 nt, hsa
ccuucccagcagcagaaucuguugaguugcugccacaaacaaaaaauacaauaaauauuug

SEQ ID NO: 233575 - RNA, 61 nt, hsa
uggcccacucccccagacaccuggacacguggccacaaaucugggacaaggggcccccgca

SEQ ID NO: 233576 - RNA, 61 nt, hsa
gccuucgcccucugaagcuguuccucuacuggccacaaacucugggccuggugggagaggc

SEQ ID NO: 233577 - RNA, 61 nt, hsa
ccaacauucagauucaggaaauacagagaacgccacaaagauacuccuugagaagagcaac

SEQ ID NO: 233578 - RNA, 61 nt, hsa
cacaaccgcacacccauacacaacuacaagggccacaaagcaacugcuggguuagcuuucc

SEQ ID NO: 233579 - RNA, 61 nt, hsa
uucuuuccugaguucaggugacugaggaagagccacaaaacaaaacacaacaaaaccaaac

SEQ ID NO: 233580 - RNA, 61 nt, hsa
uggccagcacaugagggcucaccaaguguaagccacaaauacacaucagcuauagcacaaa

SEQ ID NO: 233581 - RNA, 61 nt, hsa
ccaaaucaagaauggaaucccauucacaguagccacaaaaaguauaaaauaccuaggaaua

SEQ ID NO: 233582 - RNA, 61 nt, hsa
gaugcuggugauucggauaugccaaagagaagccacaaagugcuuccuuuuaaaugaaaag

SEQ ID NO: 233583 - RNA, 61 nt, hsa
gucuucaucuuagggcaucgcuccuccucacgccacaaaucuggugccucucucuugcuua

SEQ ID NO: 233584 - RNA, 61 nt, hsa
aacuaugaaugugggauagccuucugaaaaagccacaaauuuaugaaacauuagagaauuc

SEQ ID NO: 233585 - RNA, 61 nt, hsa
cgcugccuucccccagagugcgggcuguguugccacaaacacugcagagaccaggugaagg

SEQ ID NO: 233586 - RNA, 61 nt, hsa
ggcggaggagggugaggggugccgcccaugggccacaaaucucuacaagugccugcuaucc

SEQ ID NO: 233587 - RNA, 61 nt, hsa
aaccuuacaaaggagugcggccaguuuuucagccacaaauucuuucacaacaucagagaau

SEQ ID NO: 233588 - RNA, 61 nt, hsa
uguguuuaaccccuaagauguguccauugaggccacaaaucacccuccacuggaaucaccu

SEQ ID NO: 233589 - RNA, 60 nt, hsa
uugaaggaugcccuguguagauuauucagugccacaaauugaaagcuuccauguuuaaug

SEQ ID NO: 233590 - RNA, 61 nt, hsa
aauugcuuaaaaaagaguuuucuuuaguauagccacaaaugccuugaacuguugucuggga

SEQ ID NO: 233591 - RNA, 61 nt, hsa
gucucucagaccccuggauucagaacccaaggccacaaaucauaggcaugaagcacuuucu

SEQ ID NO: 233592 - RNA, 61 nt, hsa
cuuaaggcggccuacagaaaaaggaaaaaaggccacaaaaguucccucucacuuucaguaa

SEQ ID NO: 233593 - RNA, 61 nt, hsa
aagcaaaaauaacuauuugacuauaauauaggccacaaaaaaucuugauauaacuccuagu

SEQ ID NO: 233594 - RNA, 61 nt, hsa
gacucucagauccuccucuccccuccucuuagccacaaaagaggggggagacuggaggcac

SEQ ID NO: 233595 - RNA, 61 nt, hsa
ccgugacagaggcagagggugcagugacacagccacaaaccaaggaaggccgaggauggau

SEQ ID NO: 233596 - RNA, 61 nt, hsa
uuucccaucagcgugcauucaccagcccaucgccacaaacucuaucggagaacaugaauca

SEQ ID NO: 233597 - RNA, 61 nt, hsa
aucugcuuuuuucugaaauacacuaagagcagccacaaaacuguaaccucaaggaaaccau

SEQ ID NO: 233598 - RNA, 61 nt, hsa
ccugguucccuggggcaggugaagacuuggugccacaaagaaugccacaguggauacgcca

SEQ ID NO: 233599 - RNA, 61 nt, hsa
uuagcagacagcuuuccaagugugcuuucuugccacaaaaguguccuggcaagagccccuu

SEQ ID NO: 233600 - RNA, 61 nt, hsa
agaaccggccacaccgcugaaggccaaagaggccacaaagaagaaaaagaaacaguuuggg

SEQ ID NO: 233601 - RNA, 61 nt, hsa
cgcugucauucagacauucagagaaugguuggccacaaacaaugaccaaguauugcuuggc

SEQ ID NO: 233602 - RNA, 61 nt, hsa
ccucagugucgccucugagcccaggccuccugccacaaagacugggccgagagauggggcu

SEQ ID NO: 233603 - RNA, 61 nt, hsa
uucuggcaguggcugucuuuugagggccccagccacaaaggccacaugccucugauaggag

SEQ ID NO: 233604 - RNA, 61 nt, hsa
aaaaccaguuuuauuugccccaccccuuggagccacaaauguuuagaacucuucaacuucg

SEQ ID NO: 233605 - RNA, 61 nt, hsa
uacuccacaguuauucccagggcuggcccuagccacaaaggaacuuuagggcaggguaggg

SEQ ID NO: 233606 - RNA, 61 nt, hsa
uugcugugcuuuggaacaaucacagggaauggccacaaaccugcccgccuaagacccugaa

SEQ ID NO: 233607 - RNA, 61 nt, hsa
aauucuggggcaauagagaagcaacagaacugccacaaaguauaccucaauauaauuccuc

SEQ ID NO: 233608 - RNA, 61 nt, hsa
ugauugaugaagcagaugaguuuguagcagggccacaaaacaaagugaaacguccagggga

SEQ ID NO: 233609 - RNA, 61 nt, hsa
ccugagggagccgccugcaagcggcccugcagccacaaagcaacccgcccucugcaaaaac

SEQ ID NO: 233610 - RNA, 61 nt, hsa
gagugaggccucaucucaaaaaaaaaaaaaggccacaaaacucaacaauaaaaacaaacag

SEQ ID NO: 233611 - RNA, 61 nt, hsa
aauuagagggguaaaaaaagcuauuuucauugccacaaagugcuuugaugauguaauaccu

SEQ ID NO: 233612 - RNA, 61 nt, hsa
uuguuagauguguucuuaagcauaauuuuuagccacaaacccauuguuagauagauaucua

SEQ ID NO: 233613 - RNA, 61 nt, hsa
ggggaugaagugcccuccagccucagagcuagccacaaagcccccagagcugaauucauug

SEQ ID NO: 233614 - RNA, 61 nt, hsa
ucugcucauguguuucaucuguaguaauauagccacaaacuggacaagaagcuggguauuu

SEQ ID NO: 233615 - RNA, 63 nt, hsa
auugugcggauuaaaagaaauaauauauguaaagcacuuuaacacagcaccaggcccacggaa

SEQ ID NO: 233616 - RNA, 63 nt, hsa
aaggggaucuuuggggcuaacuucgggaucccugcacuuuauguaagaauguaaaccuggagu

SEQ ID NO: 233617 - RNA, 63 nt, hsa
guuauagggaguaguuuuuucccuuaggacucugcacuuuauagaauguuguaaaacagacaa

SEQ ID NO: 233618 - RNA, 63 nt, hsa
gcugauaguuuuguuuaagguuuuggauaaggagcacuuuaaaacaaacugguguguuguuuu

SEQ ID NO: 233619 - RNA, 63 nt, hsa
uuauucucuagguucugagagugaaugcauugggcacuuuaaguugauauuuucucuucuccg

SEQ ID NO: 233620 - RNA, 63 nt, hsa
aguguccacaacaguuagggaaaugaugcuagagcacuuuaaaaaucagcaggacaacccuga

SEQ ID NO: 233621 - RNA, 63 nt, hsa
aagugaguacacucuaauuaacuugcuucuguugcacuuuaguuuucuaccugcauauggacu

SEQ ID NO: 233622 - RNA, 63 nt, hsa
guuuuuaaauuuggaaauaugacauuuuauguagcacuuuauaaaaagugaaagcgacaaauu

SEQ ID NO: 233623 - RNA, 63 nt, hsa
augcuagucuuugugaccgauugcuaaucuucugcacuuuaauuuauuuuauauaaacuuuac

SEQ ID NO: 233624 - RNA, 63 nt, hsa
acaaucaagaauguuauuaauguguaauacugagcacuuuacuucuuaauaaaaacuugauau

SEQ ID NO: 233625 - RNA, 63 nt, hsa
guaacaaacuuacaaggacaaagaggcuuguuggcacuuuacauauacaguguauacaugugu

SEQ ID NO: 233626 - RNA, 63 nt, hsa
caaacgaagacauuccaauacugcuuaauuauagcacuuuauuuuuagcugcugaacugccaa

SEQ ID NO: 233627 - RNA, 63 nt, hsa
auuucucuccugauggguacuuuaauuugaaaugcacuuuaugcacaguuaugucuuauaacu

SEQ ID NO: 233628 - RNA, 63 nt, hsa
caacuuugcacuauguaaaguaccuuauguauugcacuuuaaauuucucuccugauggguacu

SEQ ID NO: 233629 - RNA, 63 nt, hsa
auucacguguacuguuuaacugagggucucaaagcacuuuaaacuguuguguucuauuuccac

SEQ ID NO: 233630 - RNA, 63 nt, hsa
cugaaaaauguguagauuaaaugaguuuuuaaagcacuuuagaaaauauaagggagaaaauga

SEQ ID NO: 233631 - RNA, 63 nt, hsa
ggaggcccauucuguauuccuaauccagucucagcacuuuauucauacaaaauaaucaaaaua

SEQ ID NO: 233632 - RNA, 63 nt, hsa
auuugcacuuuucaaaugccuuuggaugacccagcacuuuaaucugaaaccugcaacaagacu

SEQ ID NO: 233633 - RNA, 63 nt, hsa
cucuggagccuauggcuuuaagcaagcacuacugcacuuuacagaauuaccccacuggauccu

SEQ ID NO: 233634 - RNA, 63 nt, hsa
aggaguucuuagcuccucagcgagcaacagagagcacuuuagauggcaccuuucaccacuugg

SEQ ID NO: 233635 - RNA, 63 nt, hsa
uucuauuuauaucuuauuacaauaaaauuaguggcacuuuauucauaaauauucaugagccug

SEQ ID NO: 233636 - RNA, 63 nt, hsa
ugugaagguaguacuuuuuagagugcacugagugcacuuuacaucuuuauuuaaauuuuuuuu

SEQ ID NO: 233637 - RNA, 63 nt, hsa
auuugaaugauugggaugauacaucauugaacugcacuuuauauaaccaaagcuuagcaguuu

SEQ ID NO: 233638 - RNA, 63 nt, hsa
cuucugagucugccuuuuuugcacugaacauaagcacuuuauacuaaugggucacaaaucuug

SEQ ID NO: 233639 - RNA, 63 nt, hsa
ugaacaaaugaaacucuucuccauuuaaaagaggcacuuuacuuuagacuugccacucugaaa

SEQ ID NO: 233640 - RNA, 63 nt, hsa
uauacaugcggcuucauugccaauaaauuucaugcacuuuaaaguccuguggcuugugaccuc

SEQ ID NO: 233641 - RNA, 63 nt, hsa
gugccacccucucuggcauucaugcagagcaaagcacuuuaaccauuucuuuuaaaaggucua

SEQ ID NO: 233642 - RNA, 63 nt, hsa
gguuuuguuucaguuuguaagauuucuuuucuggcacuuuaauggcuugagguaucauuauca

SEQ ID NO: 233643 - RNA, 63 nt, hsa
ggcagggcacgguagcucacaccuguaaucccagcacuuuaggaggucaaggugggcagauca

SEQ ID NO: 233644 - RNA, 63 nt, hsa
aggcuuuuggucuuucaaaauuugugauugaaagcacuuuagugacuuggauuuuguaaaucu

SEQ ID NO: 233645 - RNA, 63 nt, hsa
auuucauucuagaauggaaacgguuccuuaauggcacuuuaaccaguuaacuuggugcaaaac

SEQ ID NO: 233646 - RNA, 63 nt, hsa
gaacuuacgugacaaugauuguauuccucaguagcacuuuaaacgccgaagacagcccugcag

SEQ ID NO: 233647 - RNA, 63 nt, hsa
cagcugaaaaccugcugugagaguuuugacagagcacuuuauuuucgucaaguuucaagucug

SEQ ID NO: 233648 - RNA, 64 nt, hsa
gagcuaaugaacuagggagaaaaacuuuccaugugugcgguaucgucuuucagaaugucuccug

SEQ ID NO: 233649 - RNA, 64 nt, hsa
gagugcuggcuccacgcccuggggagugagcuuggugcgguaggugcuggccucaaacagccac

SEQ ID NO: 233650 - RNA, 64 nt, hsa
aaugcagcacaguacucaggcagugcaauacucagugcgguacucaguaacacagugcaguacu

SEQ ID NO: 233651 - RNA, 64 nt, hsa
cccagucgggaguguggucagucugccugcugcugugcgguagcuccagaaccaccucguuccu

SEQ ID NO: 233652 - RNA, 64 nt, hsa
agaacuuuuagaagaaacagggaaaugaccgguggugcgguaaccugcguggcuccugauagcg

SEQ ID NO: 233653 - RNA, 64 nt, hsa
uuuuucuuuuuuuggcaaaggcuugguacccaaggugcgguagggggucgagggggaggaggcc

SEQ ID NO: 233654 - RNA, 64 nt, hsa
aguggagccaggcuggcccagagcugagaugggagugcgguacaaucuggagcccacagcuguc

SEQ ID NO: 233655 - RNA, 64 nt, hsa
ggauugaaagaaugugugugaagggguagaauuugugcgguaaagacuuaaaaaaaaaaguagg

SEQ ID NO: 233656 - RNA, 64 nt, hsa
ggcucagacauuuaaauaggccaacccagacacagugcgguaccagaauugccuuagaagauac

SEQ ID NO: 233657 - RNA, 64 nt, hsa
ggcaggagcugagaaauccucugaguagcgggaagugcgguacagucugggcauucugauguuu

SEQ ID NO: 233658 - RNA, 64 nt, hsa
aagugguguagugccgaaagugcuaaaauauuuagugcgguauugcucugugaauucaaguuca

SEQ ID NO: 233659 - RNA, 64 nt, hsa
gcacucagcugugggcugcacguggagcugucccgugcgguaguagcugugucuguguccccuc

SEQ ID NO: 233660 - RNA, 64 nt, hsa
uauugaaugauauuucuauaucgaagugagguaggugcgguauuaaagugaaagggaaggugau

SEQ ID NO: 233661 - RNA, 64 nt, hsa
cccgggugugccugcccuggagggaggcucuucagugcgguagcuauuuguuuacaugcagauu

SEQ ID NO: 233662 - RNA, 64 nt, hsa
aagcaguaauccuacuucauuaagccuuccuggggugcgguacacaccguuaauucagcaaccc

SEQ ID NO: 233663 - RNA, 64 nt, hsa
cgccugugcacacgcgugucuucgugcacuccccgugcgguacaggggcacuucguaacccagg

SEQ ID NO: 233664 - RNA, 64 nt, hsa
uguauaucagaaaaaaaucuaucucuaauuuagagugcgguacauaauuauauccgcaaauaaa

SEQ ID NO: 233665 - RNA, 64 nt, hsa
guucagcuggcuaaagguucaccggugaaggcaggugcgguaacugccgcacuggacccuagga

SEQ ID NO: 233666 - RNA, 64 nt, hsa
gagcuguguuauaaauuccuuaugucagaggccagugcgguagccuuugucccuucaugccuuu

SEQ ID NO: 233667 - RNA, 64 nt, hsa
ggucagcuggcaugagaauauuuuuuuuuuuuaagugcgguaguuuuuaaacuguuuguuuuua

SEQ ID NO: 233668 - RNA, 64 nt, hsa
gagacaaaggagaagaaauuacucccugcaacaggaggaauagaaaugaagcagugaguguuca

SEQ ID NO: 233669 - RNA, 64 nt, hsa
cacauccagaaugacuaaaacaucuuaaguaaaugaggaauagccaccgagaugcucagagaua

SEQ ID NO: 233670 - RNA, 64 nt, hsa
uacuuuuggaauuucauuaauaaggcuaaaauuugaggaauauaacuaauuuucagccuuaaga

SEQ ID NO: 233671 - RNA, 64 nt, hsa
gcccaucuccugugucuucaaaggugugagagcugaggaauauguguuccuaugggaacuaugu

SEQ ID NO: 233672 - RNA, 64 nt, hsa
auauauaccacuggugugugugggagggagggaggaggaauacuagcccuuuuuauauauuuac

SEQ ID NO: 233673 - RNA, 64 nt, hsa
cuuuuuuuuccccagaaauauuuggaaauuauuggaggaauaugcaccccagaugaaaauguuc

SEQ ID NO: 233674 - RNA, 64 nt, hsa
uccuaauuccaucucacuggagauguuuaaaguuggccucuauccuaaugacucaaaacuuggu

SEQ ID NO: 233675 - RNA, 64 nt, hsa
uuuguaguugaauugucuucuaaagagauuggauggccucuaaagagguauguguaucuuuauu

SEQ ID NO: 233676 - RNA, 64 nt, hsa
agacaggccucccuccccacaggcccgcugcugcggccucuaugacacuguccauccccaagug

SEQ ID NO: 233677 - RNA, 64 nt, hsa
cuugccccugcucuguagccaccuccuuggcaccggccucuauuugucauaaggcggcgugggc

SEQ ID NO: 233678 - RNA, 64 nt, hsa
uuuucaaagcugcauaucucuuauauuugguauuggccucuaagucuaauauugcaguuggaau

SEQ ID NO: 233679 - RNA, 64 nt, hsa
gaaagaacucuuuccacgagaucugcuaguuccaggccucuaagacaggaacguaugugccaua

SEQ ID NO: 233680 - RNA, 64 nt, hsa
uuauggcucuugcuuccuuucacaaaugagcugaggccucuacuuuuuuuuuuaagcugcauac

SEQ ID NO: 233681 - RNA, 64 nt, hsa
uucgcaauguuggccaggccgaucucgaacuucuggccucuagcgaucugcccgccucggccuc

SEQ ID NO: 233682 - RNA, 64 nt, hsa
ucccacuuugaaaacuuacaccuaaaggccuguaggccucuaacucuuucugcccuuucauuca

SEQ ID NO: 233683 - RNA, 64 nt, hsa
caggucugaguauggcugggagucgggggccacaggccucuagcugugcugcucaagagacugg

SEQ ID NO: 233684 - RNA, 64 nt, hsa
cauuucaccaggaugacuaaggcaagcucccuguggccucuaaaaaccaccugccagauuucag

SEQ ID NO: 233685 - RNA, 64 nt, hsa
ugugugaccuuggacaaggcgcuucaucucucugggccucuauuucuccauuuguaaaacaagu

SEQ ID NO: 233686 - RNA, 64 nt, hsa
guuugagaccagccuggccaacauggugaaaccuggccucuacuaaaaauacaaaaauuagccg

SEQ ID NO: 233687 - RNA, 64 nt, hsa
ucucucugcuaacaccagugucucuuucuaguuaggccucuaaucuucuguuucuguuuaccag

SEQ ID NO: 233688 - RNA, 64 nt, hsa
aaagagcuaaaaucaggcucaguuccccuacucuggccucuacuccccacaccccagugccacu

SEQ ID NO: 233689 - RNA, 64 nt, hsa
auacuugaugcagggaaggaaccagaagcagaggggccucuacgcagguacacacguguaccug

SEQ ID NO: 233690 - RNA, 64 nt, hsa
gaaguguccagaccauugucuuccaaccccagcuggccucuagaacacccacuggccaguccua

SEQ ID NO: 233691 - RNA, 64 nt, hsa
uccacugaccugguuguccaggucuagaaggccaggccucuacuaggucugcuccugaaccagu

SEQ ID NO: 233692 - RNA, 64 nt, hsa
ggcaaacucaggagcuuccuuuuuaucauaacgcggccucuaauuccaccccccaagugaaacg

SEQ ID NO: 233693 - RNA, 64 nt, hsa
ugaaaauugccuuuaugagugauacccauuugagggccucuaaacccuucaauuugguacucac

SEQ ID NO: 233694 - RNA, 64 nt, hsa
agcauccgggcauguacgagggaagagggaggcaggccucuauucaaaggcagaaauuccuuua

SEQ ID NO: 233695 - RNA, 64 nt, hsa
uuuaaaggacacuguacaggcccucccuccccuuggccucuaggaggaaacaguuuuuuagacu

SEQ ID NO: 233696 - RNA, 64 nt, hsa
aacguaggaaacuugauuuuuuuguuuugaucauggccucuacaugcaccuuuccagagugguc

SEQ ID NO: 233697 - RNA, 64 nt, hsa
cugccagccccagcacagacccaaacuggggcugggccucuaucccuccucugccucuguucgc

SEQ ID NO: 233698 - RNA, 64 nt, hsa
uguggggggcaagaucaggagagucaggccccugggccucuaugccagguggggaccagaaguc

SEQ ID NO: 233699 - RNA, 64 nt, hsa
ggguggaggagggagccaggcuucgcuucaaggcggccucuaccuuuucucagaaugguuuccu

SEQ ID NO: 233700 - RNA, 64 nt, hsa
ugcaguggcuuggcugacauugccucuuuguccuggccucuaguuuucuuuugauauuucauag

SEQ ID NO: 233701 - RNA, 64 nt, hsa
ccagagggaucggaggcucaggcccccugagcugggccucuaagaaccacagccacagagucag

SEQ ID NO: 233702 - RNA, 64 nt, hsa
ccugugcuaggacugcagauucuauacuugcguuggccucuaacucuccaauccagagccuccu

SEQ ID NO: 233703 - RNA, 64 nt, hsa
cuacuuuucccugcuggaagccagaagggcuugaggccucuaugggugggggcagaaggcagag

SEQ ID NO: 233704 - RNA, 64 nt, hsa
ccccaagcccugcccuucaccgcccggcugcacuggccucuaggacucacagcagccagcccca

SEQ ID NO: 233705 - RNA, 64 nt, hsa
cgauucccgggugcagaauuguaacucgggguugggccucuauauggagugaccaaaaugccaa

SEQ ID NO: 233706 - RNA, 64 nt, hsa
aaacccaguagccuagaagauacaaaacuccacuggccucuaaaauuauauuagccaagagugg

SEQ ID NO: 233707 - RNA, 64 nt, hsa
augucaagcccauugcucucccacugcagaacauggccucuagauuaaugccaccgauucagga

SEQ ID NO: 233708 - RNA, 64 nt, hsa
uuccucccagcaaccuucccucucugaccaauggggccucuaggcucugcccuucacguugggg

SEQ ID NO: 233709 - RNA, 64 nt, hsa
cagggguuuuacaacaggcuuuccaauccuggcuggccucuaaaucaccuggagagccucgaaa

SEQ ID NO: 233710 - RNA, 64 nt, hsa
uggaggcugcuccagaacucagcaguguuggaggggccucuaagcugcacucucuuucuggccc

SEQ ID NO: 233711 - RNA, 64 nt, hsa
agcugcccagcauggaccuggugacucuccacagggccucuaccauccucucuguggccacuuc

SEQ ID NO: 233712 - RNA, 64 nt, hsa
caaggcuucccugucucccacggggaggggcucgggccucuagucagacauuccugcagagggu

SEQ ID NO: 233713 - RNA, 64 nt, hsa
uguaggggucuccugccuagcugccuagcaagcuggccucuaccacaagggcucucuuaggcau

SEQ ID NO: 233714 - RNA, 64 nt, hsa
guagggggccugcagggagccagaggguggaaauggccucuaagcuagcaccccguaagaagag

SEQ ID NO: 233715 - RNA, 64 nt, hsa
ccaagaaugaugccuuucagguccuagggccucuggccucuagguaaccaguuuaaauugguuc

SEQ ID NO: 233716 - RNA, 64 nt, hsa
uucaagagguccacugguuggaucucuagcuacuggccucuaaauacaacccuucuuuacaaaa

SEQ ID NO: 233717 - RNA, 64 nt, hsa
gugcucccacgguaggauguuuaguagcaccccuggccucuacccacuaggugccaggaaugcg

SEQ ID NO: 233718 - RNA, 64 nt, hsa
gccuucacaaacaggguguggaguggcaggcagaggccucuaaaucucagggcaaacaugguga

SEQ ID NO: 233719 - RNA, 64 nt, hsa
uuuuacacacacaccucucaagacggagaugcauggccucuaagagugcccgugucgguucuuc

SEQ ID NO: 233720 - RNA, 64 nt, hsa
gcccuuuuauagcccaccguaguggugggugacuggccucuaguuuauauaauuauuuaccucu

SEQ ID NO: 233721 - RNA, 64 nt, hsa
ugcucaugauuucacuugacagcguaugcuccuuggccucuaauuguacuuugcuuuuccagag

SEQ ID NO: 233722 - RNA, 64 nt, hsa
gccuauuguaacuacacugggcaucagaauaaaaggccucuagaaauugcugaacaaugguuaa

SEQ ID NO: 233723 - RNA, 64 nt, hsa
uuagcuccaucuuaaaauuucaccuuaaguaaauggccucuaguagaugauaagccuaaaaaaa

SEQ ID NO: 233724 - RNA, 64 nt, hsa
cucaccccgcaacccaucaguauuuuaguuauuuggccucuacuccaguaaaccugauuggguu

SEQ ID NO: 233725 - RNA, 64 nt, hsa
aucacgaggaacagagauggcccagcagacauuuggccucuagauccuuugaauggagcguaag

SEQ ID NO: 233726 - RNA, 64 nt, hsa
gacaagaaaauuaauagagcguuauuccacagaaggccucuagccagagaucuugaguguagug

SEQ ID NO: 233727 - RNA, 52 nt, hsa
cugcuguccugaaaagauaacuggccucuauuucuuaauaaauucuuccaag

SEQ ID NO: 233728 - RNA, 64 nt, hsa
cugaagcaaaagagauuauaguuaccagaaguauggccucuaaugguguugagccuuuucaaga

SEQ ID NO: 233729 - RNA, 64 nt, hsa
acacauuccagcccugcccagcaugcugaccuuuggccucuaacccucagugggcccccagguc

SEQ ID NO: 233730 - RNA, 64 nt, hsa
guguccuuaagcuugucucacaagaaagaugccaggccucuaaauguaauaagauagaggguca

SEQ ID NO: 233731 - RNA, 64 nt, hsa
ccuucuucuacccuaaaucuuaacuuuauggaagggccucuauuuuacaucauauaauuucugc

SEQ ID NO: 233732 - RNA, 64 nt, hsa
cccccuccucccugccgcagugccccccaacccaggccucuauuguuccauguuguaaauaccc

SEQ ID NO: 233733 - RNA, 64 nt, hsa
cuuccuuggaagcccagagggacuaugaucugauggccucuagguguuguuuugugcaauauac

SEQ ID NO: 233734 - RNA, 64 nt, hsa
uuacagaaguaaaucgaccgucaagagaagacuuggccucuaauuuauauugcuuugcacuuug

SEQ ID NO: 233735 - RNA, 64 nt, hsa
ucaaauuccugaccuuaagugauccaccugccuaggccucuaaaaugcugggauuacaggcgug

SEQ ID NO: 233736 - RNA, 64 nt, hsa
acaaguguuggggaagaugggagguugugggugaggccucuaaagguccucucccaaacugacc

SEQ ID NO: 233737 - RNA, 64 nt, hsa
uuaagcaucucagaggaagcagcccucccucgauggccucuagcccagagaagcccgcgcaucu

SEQ ID NO: 233738 - RNA, 64 nt, hsa
uaagguguaauuacagaauuuacgaaauguaaauggccucuacagaguuuuauggaauaccugg

SEQ ID NO: 233739 - RNA, 64 nt, hsa
cucggacgccgaggggcuggcgcucccgcaggacggccucuauuaccucuacugucucgucggc

SEQ ID NO: 233740 - RNA, 64 nt, hsa
ccauccucaguugaaguuugaugaauugaagucgggccucuaugccaacugguuccuuuuguuc

SEQ ID NO: 233741 - RNA, 64 nt, hsa
gcugggggugcuaauuacauggcaggaagaauggggccucuaaggggaguguggggucugucuc

SEQ ID NO: 233742 - RNA, 64 nt, hsa
ggugaagggagaaagccugugcucuggcuggcugggccucuauccugaagagggaaggugcuag

SEQ ID NO: 233743 - RNA, 64 nt, hsa
aggggcccucuggaauggcaucccaugagcuuguggccucuaucugcuaccaucuguguuuuau

SEQ ID NO: 233744 - RNA, 64 nt, hsa
ccagcuuuaucacuuauuuagccaugcuagccuaggccucuauuuccuugucuccaaaaugaga

SEQ ID NO: 233745 - RNA, 64 nt, hsa
guugugagauaauugaguuuaaagggaauuguguggccucuagccuagucauuuaaagaaggau

SEQ ID NO: 233746 - RNA, 64 nt, hsa
gcagcucugccaccauccugcugggaacugggggggccucuauuggguuauaggcaaggccuuu

SEQ ID NO: 233747 - RNA, 64 nt, hsa
auccucauguguugacccugaugucuuuagcagaggccucuagcaucucgguuuuucauccacu

SEQ ID NO: 233748 - RNA, 64 nt, hsa
cugccagcuggcuccgagggcaacacaggggccuggccucuagagggcuggugauugaggggcc

SEQ ID NO: 233749 - RNA, 64 nt, hsa
uuguaaacagaagcaacagaagggacaagaggcuggccucuacaucacucucaccuuccaaauc

SEQ ID NO: 233750 - RNA, 64 nt, hsa
ucuaaccagccccagcacaaauggaacucccgagggccucuaggaccaggguuugccaggcuaa

SEQ ID NO: 233751 - RNA, 64 nt, hsa
agccucuguuccccuaguaagugccuuccaugucggccucuaaccccaggccccgaggacccag

SEQ ID NO: 233752 - RNA, 64 nt, hsa
ccaaacacaugacuucuucccagcagcccuucccggccucuaaaguuuggucccagcagcccuu

SEQ ID NO: 233753 - RNA, 64 nt, hsa
gaguuaagucuacaaaggaauaaacauaauguguggccucuauauacaaacucuauuucuguca

SEQ ID NO: 233754 - RNA, 64 nt, hsa
gguauugggguuauaugauucuuucuuagauaauggccucuacuaaauaacucaagaucuuucu

SEQ ID NO: 233755 - RNA, 64 nt, hsa
caugcgcaagacuaaagcagcggaagaggaggugggccucuaggaucuuugucuucuggcugga

SEQ ID NO: 233756 - RNA, 64 nt, hsa
cccacgcugggaggacacgggcugggcugagcagggccucuaguggaacacaugggggucucau

SEQ ID NO: 233757 - RNA, 64 nt, hsa
cggguccgcggggcacccgccggaugcgcagccuggccucuacuacagcgccaacgagcagugc

SEQ ID NO: 233758 - RNA, 64 nt, hsa
auuucacuuuccucuucuaggggcaaaggcugauggccucuaccuuuguauccaggagaaacug

SEQ ID NO: 233759 - RNA, 64 nt, hsa
cuaggccacgggacagauggccaggaagggcccuggccucuaaacuggcucgagagcaucuugg

SEQ ID NO: 233760 - RNA, 64 nt, hsa
gaaggcaaugggguuucuccaagacagccuguguggccucuacucugaacaaauacacugauga

SEQ ID NO: 233761 - RNA, 64 nt, hsa
cgaaccauguagcuucaccugacucagugcugggggccucuaccaucuacugugcuugugucau

SEQ ID NO: 233762 - RNA, 64 nt, hsa
cacagggcucccaggccaggccucauucuccucuggccucuaauagucaaugauuguguagcca

SEQ ID NO: 233763 - RNA, 64 nt, hsa
auuccacugaaccuaaaaucaucaaagcagcaguggccucuacguuuuacuccuuugcugaaaa

SEQ ID NO: 233764 - RNA, 64 nt, hsa
ggggagggaacugcaagugccugaggaccagaguggccucuagccccgaauugaacacuuuuaa

SEQ ID NO: 233765 - RNA, 64 nt, hsa
ccuccucugcugcagggcucccccacccccacacggccucuaaagauguuuauuuccuuauaga

SEQ ID NO: 233766 - RNA, 64 nt, hsa
ucgcccuuuagcggggaggucauuacagccucauggccucuaccaaggccccagaucacaggau

SEQ ID NO: 233767 - RNA, 64 nt, hsa
ugucagacugaagcuuuguuuuaaggugaccacuggccucuaggaaaccuucuacccccauuau

SEQ ID NO: 233768 - RNA, 64 nt, hsa
uguucccugcaagugccauuuccucuccaggaugggccucuaaagcugaggccuggcucagagc

SEQ ID NO: 233769 - RNA, 64 nt, hsa
aacucagcccccugaccuggaggcagccggccaaggccucuagggaagagccccccacugcaga

SEQ ID NO: 233770 - RNA, 64 nt, hsa
agauuugcccccccaguggcccugggcugggccuggccucuacagagccuuuuagggggagggg

SEQ ID NO: 233771 - RNA, 64 nt, hsa
uccuuugcacuguaggagauuuacuaauaucccuggccucuacccaguaguaccacuagcaccu

SEQ ID NO: 233772 - RNA, 64 nt, hsa
guucccgguggaaaaccgugggagaggaagcuugggccucuacuccaaguaucagagccuguuc

SEQ ID NO: 233773 - RNA, 64 nt, hsa
ccugcuguccugcccaagaacugagggucuccccggccucuacugcccuggcugcagucagugc

SEQ ID NO: 233774 - RNA, 64 nt, hsa
ccucucuggacuuucuccaaaggcacugacccucggccucuacuuuguccccucaccuccaccc

SEQ ID NO: 233775 - RNA, 64 nt, hsa
uuguguucgagcacagaacggauauaaucagucuggccucuacaacaaguuuugcauuguagaa

SEQ ID NO: 233776 - RNA, 64 nt, hsa
uagaggagugacuacagguuuucuuuacaaccauggccucuaguauacuuaaaauaagcgucca

SEQ ID NO: 233777 - RNA, 64 nt, hsa
ucucucucacuugaauucuggcauuauuuuuaguggccucuacugauaauaccuacccuagagu

SEQ ID NO: 233778 - RNA, 64 nt, hsa
ugugagagggccacauuggcuaaaaccuaaagguggccucuaggagaugagaccuaccuuccag

SEQ ID NO: 233779 - RNA, 64 nt, hsa
uuuguuuuuuuaguuuguuauccccuuacugagcggccucuacuagguggcugugauuaaaugu

SEQ ID NO: 233780 - RNA, 61 nt, hsa
cacgggguaccaaggccugagggccgccagcggccucuacggccccgacggacgcuuguga

SEQ ID NO: 233781 - RNA, 64 nt, hsa
uuagaggcugauuaucuaguuuuguaguuccucaggccucuaauuuauuuuuugcuuucugcuu

SEQ ID NO: 233782 - RNA, 64 nt, hsa
ucagaacuggggaaggaguggaacuuaugacuugggccucuaggcugucucuguccccucagcu

SEQ ID NO: 233783 - RNA, 64 nt, hsa
auucugagaaaugucugggcuucccauuguuucuggccucuaauagguugggaaguuuuagcgu

SEQ ID NO: 233784 - RNA, 64 nt, hsa
guuuacaaaggggcaaggaccucucauggacacuggccucuagcccucuguuuuuguuugauga

SEQ ID NO: 233785 - RNA, 64 nt, hsa
cagagccgucuccucagguugccuauccucuccuggccucuagucuucccugcucuccgaggua

SEQ ID NO: 233786 - RNA, 64 nt, hsa
ccagguccuggcugccagcuuuccuccucugcccggccucuagcgcagucgcuaacuacucugc

SEQ ID NO: 233787 - RNA, 64 nt, hsa
aggugcuguagcaggcgcaagaccguagaucucaggccucuaacacuuccaacuccagccacca

SEQ ID NO: 233788 - RNA, 64 nt, hsa
uuuuacuuuuaacaguccaugaacagaaaauuaaggccucuaaaaucagauccccuaguuacuc

SEQ ID NO: 233789 - RNA, 64 nt, hsa
aagaaugaguuuguggaacaauuugauuugcuguggccucuaugccuaaugagcuaguguuucu

SEQ ID NO: 233790 - RNA, 64 nt, hsa
uugacugagacuggggucucuacuucaccaaacuggccucuauccauaccaaggaggccagccu

SEQ ID NO: 233791 - RNA, 64 nt, hsa
gcagggcacccaccagcagcugcuggcccagggcggccucuacgccaagcuggugcagcggcag

SEQ ID NO: 233792 - RNA, 64 nt, hsa
uuauucguuuaacgaccgcacagcuccgagguuuggccucuaucguuaugcugcagaucaguuu

SEQ ID NO: 233793 - RNA, 64 nt, hsa
ugcaguugggaggggcaccguccggaggagaccaggccucuacacaccccccacucuacuuauc

SEQ ID NO: 233794 - RNA, 64 nt, hsa
cuuuuaaaauuugcacacauuaugauuaaaauugggccucuacugugaugauuccuauuuccuc

SEQ ID NO: 233795 - RNA, 64 nt, hsa
gcccccauucagacacgcugacucaggagguccaggccucuaaggcuucucucccuggagugag

SEQ ID NO: 233796 - RNA, 64 nt, hsa
uugcaucauuuaaaaaaaauaauuaaauccucauggccucuaaauuaguauguagaacacugaa

SEQ ID NO: 233797 - RNA, 64 nt, hsa
ccucaucugggguugggucugugcugagcuggagggccucuagggaaccguggggcaggguggc

SEQ ID NO: 233798 - RNA, 64 nt, hsa
cucccugcuccugggaugcuucccaagcagcccaggccucuagccuccauggcugaugaccuca

SEQ ID NO: 233799 - RNA, 64 nt, hsa
uggcccggggcugcagccugaccccucugccaucggccucuaguucuccaaggaccuagaagac

SEQ ID NO: 233800 - RNA, 64 nt, hsa
gacucaguucccuucugaacacucgggggacaugggccucuaacugcccacucugauaugccug

SEQ ID NO: 233801 - RNA, 64 nt, hsa
agacuguaaauacgaacccaaucugcacacuccaggccucuaguuccagaaggauccaagacaa

SEQ ID NO: 233802 - RNA, 64 nt, hsa
acccaaacacgccucuccuggcaggguagacccaggccucuaaccaucugacagagacucggcc

SEQ ID NO: 233803 - RNA, 64 nt, hsa
auguuaccccagggaguucucagaggauuggguuggccucuaacauguuccuuguuaauucuug

SEQ ID NO: 233804 - RNA, 64 nt, hsa
cuggccggaggaaggaccgcaggcagacagccugggccucuaacagcuuuuguccggagcuaga

SEQ ID NO: 233805 - RNA, 64 nt, hsa
ggggccuccugagguacaccuuugccccuguaagggccucuaggcccugggccugccuccccaa

SEQ ID NO: 233806 - RNA, 64 nt, hsa
ugcuccuaaccccugccacuuucuguuucauuaaggccucuacucuggcucaggacccagucca

SEQ ID NO: 233807 - RNA, 64 nt, hsa
uggcuuugaggacacggggaccacagccaugagcggccucuaagagcugagagacagccggcag

SEQ ID NO: 233808 - RNA, 64 nt, hsa
ugggcagcagggcuccauucucuggccuggcccaggccucuacauacuuacuccagccauuugg

SEQ ID NO: 233809 - RNA, 64 nt, hsa
uucugugcauauguacauaugaauacaaaucgaaggccucuaccuccuggaguuauacaacuug

SEQ ID NO: 233810 - RNA, 64 nt, hsa
auccucccacccugacgccaucuuucuggugaccggccucuaaaucgcugucucucugucucuu

SEQ ID NO: 233811 - RNA, 64 nt, hsa
ugaaggauggaggugcugaauaaauuaggccucaggccucuaccaccagagagcuggagaaugg

SEQ ID NO: 233812 - RNA, 64 nt, hsa
gaaaggggcccagucguucuugggcccaggauggggccucuagacuugcaagggagaggaacag

SEQ ID NO: 233813 - RNA, 64 nt, hsa
ccagggaugaggacacugugcucaagcaucuuagggccucuaugaagaaacuaacaagaaagca

SEQ ID NO: 233814 - RNA, 64 nt, hsa
auggccauggcuauugucuccagggcuugaacuuggccucuacccaaacuuaacccuuguagcc

SEQ ID NO: 233815 - RNA, 64 nt, hsa
ucagaaaaaugcuaagucccagcuauggauuucaggccucuacacuucugcuuacugguguggg

SEQ ID NO: 233816 - RNA, 64 nt, hsa
cagggacaggagagccagcaggguggaugcaaggggccucuacccacaccuggaccuccgugcc

SEQ ID NO: 233817 - RNA, 64 nt, hsa
augagacuguaagaaacaguuugcggugcuuagaggccucuauaauuuaaacaugaacauauau

SEQ ID NO: 233818 - RNA, 64 nt, hsa
guuuuuuggaauacugacaauuccucgggaaccuggccucuaauuaguuuuagaugacaagguc

SEQ ID NO: 233819 - RNA, 64 nt, hsa
ugcuguucacacgcucagccugucugggggagcgggccucuagcuucagccagggcggguacac

SEQ ID NO: 233820 - RNA, 64 nt, hsa
gaagguccuugagaugaugcucagcuguggggcgggccucuaagaugccccauacuuugggggu

SEQ ID NO: 233821 - RNA, 64 nt, hsa
uaaagggucgggggaggggggagccuuguagggaggccucuacacagaagaaagcagcccccau

SEQ ID NO: 233822 - RNA, 64 nt, hsa
ugacagcacccugcuggcccuccagggggcccugggccucuaugauggacacaccccgccauau

SEQ ID NO: 233823 - RNA, 64 nt, hsa
gugagaggggacugcuguacaaagaauauaggaaggccucuagacuacauccauuccuuccuca

SEQ ID NO: 233824 - RNA, 64 nt, hsa
uggucucaucucaacguucaaccggggaugggucggccucuaagcucaugugguuguaagccag

SEQ ID NO: 233825 - RNA, 64 nt, hsa
uggaugaaagagaauaagaauucagcugacaggaggccucuauccugucccuccaccccacccu

SEQ ID NO: 233826 - RNA, 64 nt, hsa
agacuccacaugcugguggugccugaggucugauggccucuaauaaacuguguccuauaugccc

SEQ ID NO: 233827 - RNA, 64 nt, hsa
cuggaauugucaccccagaauuccauguugaaauggccucuaauuuggaggcuauuuuugaagg

SEQ ID NO: 233828 - RNA, 64 nt, hsa
ugggugucccagggcaagccaccuugccugucuaggccucuaugucaggacucccuggccuuca

SEQ ID NO: 233829 - RNA, 64 nt, hsa
gggcacccuccccagggauuggaaacggaugacgggccucuaggcggucuucugccacgagcag

SEQ ID NO: 233830 - RNA, 64 nt, hsa
cgugcucuggggccgggccucgcugcuuagcagcggccucuagcuccgucucccggggaccugg

SEQ ID NO: 233831 - RNA, 64 nt, hsa
gcaucuuggaucucagaauggccuggaaacggauggccucuacgcuguuccaucacagucucca

SEQ ID NO: 233832 - RNA, 64 nt, hsa
ccacccuggugugucccuagaauucccacugcugggccucuaucuccaugacaacaaaauaaaa

SEQ ID NO: 233833 - RNA, 64 nt, hsa
aacaagagagcgcuccucucccagauaggaaaagggccucuaacaaggagaaauuagugugcgg

SEQ ID NO: 233834 - RNA, 64 nt, hsa
aagguuucucuuugauuucaagaaugaccaaaauggccucuaaaagauguuaaucaucucaaau

SEQ ID NO: 233835 - RNA, 64 nt, hsa
caucccccacaaaaacaugagugccccucuguguggccucuaacccucugcacagcccuucugg

SEQ ID NO: 233836 - RNA, 64 nt, hsa
uuugauucuuuguggucaucauugaauauacaggggccucuauacacucuggggaguaucuauu

SEQ ID NO: 233837 - RNA, 64 nt, hsa
ccacuccauaauauaacauuucauccaguaaacuggccucuacuaucuuuaacucaugcauggc

SEQ ID NO: 233838 - RNA, 64 nt, hsa
ggggugaagaaucugggccaaccagggguccuugggccucuagaaggccacaguaggccucucu

SEQ ID NO: 233839 - RNA, 64 nt, hsa
auccuuaauaggcaggaagucugggaauucugguggccucuagggcaguguucucacagcaccg

SEQ ID NO: 233840 - RNA, 64 nt, hsa
gcaccagcccuccaguagauccuuucacgaccuuggccucuaaggcuucacccacacuggacuu

SEQ ID NO: 233841 - RNA, 64 nt, hsa
auuucuccacugcacugugcuagcagcucagcagggccucuaaccugugaugucacacucaaga

SEQ ID NO: 233842 - RNA, 64 nt, hsa
ucccugcuuugcugugaagggagaaauuagccugggccucuacccccuauucccugugucugcc

SEQ ID NO: 233843 - RNA, 64 nt, hsa
acuucuuuuggggcaauuuuccuguggccuuccuggccucuacuuccaugugcgcagccccaca

SEQ ID NO: 233844 - RNA, 64 nt, hsa
ggggggaggggacaugaagguagguaaauagguaggccucuaauugaaccaccucucuaaguua

SEQ ID NO: 233845 - RNA, 64 nt, hsa
ggauguguucgccauuucuguguuugaccuacauggccucuaauucuuuggaccauuguaacug

SEQ ID NO: 233846 - RNA, 64 nt, hsa
gagguucagagaagagaacccucaccucugaucuggccucuacgagagguccucaucuccaucu

SEQ ID NO: 233847 - RNA, 64 nt, hsa
ccacaggcccgcuaagccccaaaggcaggaucuagaugaugaugaacaugauuaugaagaaaua

SEQ ID NO: 233848 - RNA, 64 nt, hsa
caggcccgcuaagccccaaaggcaggaucuagaugaugaugaacaugauuaugaagaaauacuu

SEQ ID NO: 233849 - RNA, 64 nt, hsa
auucuuggaaaaguggcaagaccaaaaugacaaugaugaugauaaugaugaugacgacgacaac

SEQ ID NO: 233850 - RNA, 64 nt, hsa
guggcaagaccaaaaugacaaugaugaugauaaugaugaugacgacgacaacgaugaugcuugu

SEQ ID NO: 233851 - RNA, 64 nt, hsa
ccuacuagauggacaggcugagguguuuggcagugaugaugaccacauucaguuugugcaggua

SEQ ID NO: 233852 - RNA, 64 nt, hsa
uucuccuaagaaaaauccgcugugggcagagaacgaugaugauuuaaugguguuuacuccuuua

SEQ ID NO: 233853 - RNA, 64 nt, hsa
agagcuggguuccuugggaggaaguuguaguggugaugaugaugaugauaaugaugaugaugau

SEQ ID NO: 233854 - RNA, 64 nt, hsa
gcuggguuccuugggaggaaguuguaguggugaugaugaugaugauaaugaugaugaugauggu

SEQ ID NO: 233855 - RNA, 64 nt, hsa
ggguuccuugggaggaaguuguaguggugaugaugaugaugauaaugaugaugaugaugguggu

SEQ ID NO: 233856 - RNA, 64 nt, hsa
aggaaguuguaguggugaugaugaugaugauaaugaugaugaugauggugguguugaugguggc

SEQ ID NO: 233857 - RNA, 64 nt, hsa
aaguuguaguggugaugaugaugaugauaaugaugaugaugauggugguguugaugguggcggu

SEQ ID NO: 233858 - RNA, 64 nt, hsa
ucaguaguggggaauucugugacagcugauugaagaugaugaugaagaaccucugcauucuagu

SEQ ID NO: 233859 - RNA, 64 nt, hsa
guaguggggaauucugugacagcugauugaagaugaugaugaagaaccucugcauucuaguuac

SEQ ID NO: 233860 - RNA, 64 nt, hsa
ugcuacuggugcaauuggaucaguguaugauauggaugaugaugaaauggaccccaauuaugcc

SEQ ID NO: 233861 - RNA, 64 nt, hsa
uacuggugcaauuggaucaguguaugauauggaugaugaugaaauggaccccaauuaugccaga

SEQ ID NO: 233862 - RNA, 64 nt, hsa
auccuguggugcccccuucccccugccuugugaugaugaugagugagucuccccuuaauuagac

SEQ ID NO: 233863 - RNA, 64 nt, hsa
gaaauccuguggugcccccuucccccugccuugugaugaugaugagugagucuccccuuaauua

SEQ ID NO: 233864 - RNA, 64 nt, hsa
uagaaguucuaagcgggagaugacucccuacugggaugaugaaggauggcauccuagugaagaa

SEQ ID NO: 233865 - RNA, 64 nt, hsa
uguuuucauuaucucaaaacugcacugucaagaugaugaugaucuuuaaaauacacacucaaau

SEQ ID NO: 233866 - RNA, 64 nt, hsa
uuuuguuuucauuaucucaaaacugcacugucaagaugaugaugaucuuuaaaauacacacuca

SEQ ID NO: 233867 - RNA, 64 nt, hsa
cacaccuccaagaucaagauccuguucugagucagaugaugaugacagcagugaaacuccuccu

SEQ ID NO: 233868 - RNA, 64 nt, hsa
accuccaagaucaagauccuguucugagucagaugaugaugacagcagugaaacuccuccucac

SEQ ID NO: 233869 - RNA, 64 nt, hsa
ggagaguucaagugaugagcagacgccuagucgggaugaugauagccaguccaggaguccaagu

SEQ ID NO: 233870 - RNA, 64 nt, hsa
cuuguuuugugacuggaccacugcccaggugcuugaugaugaccaggagugugcucugggaaug

SEQ ID NO: 233871 - RNA, 64 nt, hsa
uaugagcugacuccaaauggacagcccagaagcugaugaugagaauucuuaucacucaccuuua

SEQ ID NO: 233872 - RNA, 64 nt, hsa
gcuagaagcuaaauuugccgaguuagaagguggagaugaugauauugaagagaugggagaagaa

SEQ ID NO: 233873 - RNA, 64 nt, hsa
auugaagagguuuucacucucugcuaaagugguagaugaugaaauuuacuacuucagguaaagc

SEQ ID NO: 233874 - RNA, 64 nt, hsa
cguggccucuguauuugcaaaugcagauaaaggugaugaugagaagaauacagacaacucagag

SEQ ID NO: 233875 - RNA, 64 nt, hsa
ggcucagaggauagcgguuuccaucauaaaccaagaugaugaguucagccuuuaucccucgugg

SEQ ID NO: 233876 - RNA, 64 nt, hsa
gggucagaggauagcgguuuccaucauaaaccaagaugaugaguucagccuuuaucccucgugg

SEQ ID NO: 233877 - RNA, 64 nt, hsa
gaaguaguugagggagagauugggggaauggggagaugaugaugauggucaaagggugcaaaau

SEQ ID NO: 233878 - RNA, 64 nt, hsa
guaguugagggagagauugggggaauggggagaugaugaugauggucaaagggugcaaaaucuc

SEQ ID NO: 233879 - RNA, 64 nt, hsa
acuccauuuugagcaggcugcuuaaagugguggugaugaugaugaugaugauggcagcuuuaua

SEQ ID NO: 233880 - RNA, 64 nt, hsa
ccauuuugagcaggcugcuuaaagugguggugaugaugaugaugaugauggcagcuuuauaucg

SEQ ID NO: 233881 - RNA, 64 nt, hsa
uuuugagcaggcugcuuaaagugguggugaugaugaugaugaugauggcagcuuuauaucgagu

SEQ ID NO: 233882 - RNA, 64 nt, hsa
ugagcaggcugcuuaaagugguggugaugaugaugaugaugauggcagcuuuauaucgagugcc

SEQ ID NO: 233883 - RNA, 64 nt, hsa
cauuuuugugcccccucugcuuacugugacagucgaugaugaaucuugcguugccauuuucugc

SEQ ID NO: 233884 - RNA, 64 nt, hsa
agugaugugucuguaucuuuaauguaaauagagagaugaugaaaaaagagucuauuuuaguguu

SEQ ID NO: 233885 - RNA, 64 nt, hsa
gggcaauagagcgagacccugucucuuaaaaaacgaugaugaugaacacagaggacggggcacu

SEQ ID NO: 233886 - RNA, 64 nt, hsa
caauagagcgagacccugucucuuaaaaaacgaugaugaugaacacagaggacggggcacugug

SEQ ID NO: 233887 - RNA, 64 nt, hsa
ucaaaggcugcaacccuauggccucuuggagacagaugaugacuggcaaggacuagagagcagg

SEQ ID NO: 233888 - RNA, 64 nt, hsa
aauaacccacuagugccugagcucagugcugcuggaugaugagggagaucaagaaaaagccacg

SEQ ID NO: 233889 - RNA, 64 nt, hsa
ggacuguaaaucucucgcagacccugggagcucagaugaugaugauguuaguaguuuggaagaa

SEQ ID NO: 233890 - RNA, 64 nt, hsa
cuguaaaucucucgcagacccugggagcucagaugaugaugauguuaguaguuuggaagaagaa

SEQ ID NO: 233891 - RNA, 64 nt, hsa
ugauuaauauuauuaauauaauaaugaugaugaugaugaugaaaacuaaggauuuuucaagaga

SEQ ID NO: 233892 - RNA, 64 nt, hsa
auaugauuaauauuauuaauauaauaaugaugaugaugaugaugaaaacuaaggauuuuucaag

SEQ ID NO: 233893 - RNA, 64 nt, hsa
aggauaugauuaauauuauuaauauaauaaugaugaugaugaugaugaaaacuaaggauuuuuc

SEQ ID NO: 233894 - RNA, 64 nt, hsa
uuaaggauaugauuaauauuauuaauauaauaaugaugaugaugaugaugaaaacuaaggauuu

SEQ ID NO: 233895 - RNA, 64 nt, hsa
ccuuggccagggcugacuccuuaaauuucuggaugaugaugauuguuauuuaauagccagaggc

SEQ ID NO: 233896 - RNA, 64 nt, hsa
ccaccuuggccagggcugacuccuuaaauuucuggaugaugaugauuguuauuuaauagccaga

SEQ ID NO: 233897 - RNA, 64 nt, hsa
agguauuccguuuaucacaguccacuuaaaaaaugaugaugaugauaaaaaccacgacccaacc

SEQ ID NO: 233898 - RNA, 64 nt, hsa
uauuccguuuaucacaguccacuuaaaaaaugaugaugaugauaaaaaccacgacccaaccagg

SEQ ID NO: 233899 - RNA, 64 nt, hsa
gggcuguguuuucgaugaugaugaugaucaugaugaugaugauuuuaacaguuuuacuucuggc

SEQ ID NO: 233900 - RNA, 64 nt, hsa
cuggggcuguguuuucgaugaugaugaugaucaugaugaugaugauuuuaacaguuuuacuucu

SEQ ID NO: 233901 - RNA, 64 nt, hsa
cuguaaagcaaacuggggcuguguuuucgaugaugaugaugaucaugaugaugaucaucaugau

SEQ ID NO: 233902 - RNA, 64 nt, hsa
gggcuguaaagcaaacuggggcuguguuuucgaugaugaugaugaucaugaugaugaucaucau

SEQ ID NO: 233903 - RNA, 64 nt, hsa
cuugggcuguaaagcaaacuggggcuguguuuucgaugaugaugaugaucaugaugaugaucau

SEQ ID NO: 233904 - RNA, 64 nt, hsa
ugcauuacaacuuguuuucuuauguaauaauaaugaugaugaugaugauaauaauaaauauuuu

SEQ ID NO: 233905 - RNA, 64 nt, hsa
auuacaacuuguuuucuuauguaauaauaaugaugaugaugaugauaauaauaaauauuuuuga

SEQ ID NO: 233906 - RNA, 64 nt, hsa
acaacuuguuuucuuauguaauaauaaugaugaugaugaugauaauaauaaauauuuuugagug

SEQ ID NO: 233907 - RNA, 64 nt, hsa
ugggcagaaaaaaguaaaacuugcugcugcugcugaugaugaugaugaugaagaugaugaugau

SEQ ID NO: 233908 - RNA, 64 nt, hsa
gcagaaaaaaguaaaacuugcugcugcugcugaugaugaugaugaugaagaugaugaugaugau

SEQ ID NO: 233909 - RNA, 64 nt, hsa
gaaaaaaguaaaacuugcugcugcugcugaugaugaugaugaugaagaugaugaugaugaugau

SEQ ID NO: 233910 - RNA, 64 nt, hsa
aaaaguaaaacuugcugcugcugcugaugaugaugaugaugaagaugaugaugaugaugaugac

SEQ ID NO: 233911 - RNA, 64 nt, hsa
acuugcugcugcugcugaugaugaugaugaugaagaugaugaugaugaugaugacgaggaagcu

SEQ ID NO: 233912 - RNA, 64 nt, hsa
ugcugcugcugcugaugaugaugaugaugaagaugaugaugaugaugaugacgaggaagcugaa

SEQ ID NO: 233913 - RNA, 64 nt, hsa
ugcugcugcugaugaugaugaugaugaagaugaugaugaugaugaugacgaggaagcugaagaa

SEQ ID NO: 233914 - RNA, 64 nt, hsa
ugcugcugaugaugaugaugaugaagaugaugaugaugaugaugacgaggaagcugaagaaaaa

SEQ ID NO: 233915 - RNA, 64 nt, hsa
ugcugaugaugaugaugaugaagaugaugaugaugaugaugacgaggaagcugaagaaaaagcg

SEQ ID NO: 233916 - RNA, 64 nt, hsa
ucuggaugcccgggauggcaaugagguggagccugaugaugaccacuucuccauugugaguggc

SEQ ID NO: 233917 - RNA, 64 nt, hsa
cagccagcccaggauccguccucauuuuauuggugaugaugaaugggaaugaaaucagggggcu

SEQ ID NO: 233918 - RNA, 64 nt, hsa
aaccaguuuaauuuuuuuuuuccucauuguuggggaugaugagaagaaaugauuugggaaaauu

SEQ ID NO: 233919 - RNA, 64 nt, hsa
aauugucacagugucccuucuacuucccucuauugaugaugaugaugaugaugaugaugaugau

SEQ ID NO: 233920 - RNA, 64 nt, hsa
ugucacagugucccuucuacuucccucuauugaugaugaugaugaugaugaugaugaugaugau

SEQ ID NO: 233921 - RNA, 64 nt, hsa
cacagugucccuucuacuucccucuauugaugaugaugaugaugaugaugaugaugaugaugau

SEQ ID NO: 233922 - RNA, 64 nt, hsa
agugucccuucuacuucccucuauugaugaugaugaugaugaugaugaugaugaugaugaugau

SEQ ID NO: 233923 - RNA, 64 nt, hsa
gucccuucuacuucccucuauugaugaugaugaugaugaugaugaugaugaugaugaugaugau

SEQ ID NO: 233924 - RNA, 64 nt, hsa
ccuucuacuucccucuauugaugaugaugaugaugaugaugaugaugaugaugaugaugaugau

SEQ ID NO: 233925 - RNA, 64 nt, hsa
ucuacuucccucuauugaugaugaugaugaugaugaugaugaugaugaugaugaugaugauggu

SEQ ID NO: 233926 - RNA, 64 nt, hsa
acuucccucuauugaugaugaugaugaugaugaugaugaugaugaugaugaugaugaugguuuu

SEQ ID NO: 233927 - RNA, 64 nt, hsa
ucccucuauugaugaugaugaugaugaugaugaugaugaugaugaugaugaugaugguuuuuuc

SEQ ID NO: 233928 - RNA, 64 nt, hsa
cucuauugaugaugaugaugaugaugaugaugaugaugaugaugaugaugaugguuuuuucuaa

SEQ ID NO: 233929 - RNA, 64 nt, hsa
uauugaugaugaugaugaugaugaugaugaugaugaugaugaugaugaugguuuuuucuaauca

SEQ ID NO: 233930 - RNA, 64 nt, hsa
ugaugaugaugaugaugaugaugaugaugaugaugaugaugaugaugguuuuuucuaaucagaa

SEQ ID NO: 233931 - RNA, 64 nt, hsa
ugaugaugaugaugaugaugaugaugaugaugaugaugaugaugguuuuuucuaaucagaagaa

SEQ ID NO: 233932 - RNA, 64 nt, hsa
gauuucagaaucaggagucagcucugacaaugaagaugaugaugaugaagaagaugggaauuac

SEQ ID NO: 233933 - RNA, 64 nt, hsa
uucagaaucaggagucagcucugacaaugaagaugaugaugaugaagaagaugggaauuaccuu

SEQ ID NO: 233934 - RNA, 64 nt, hsa
agaaucaggagucagcucugacaaugaagaugaugaugaugaagaagaugggaauuaccuucau

SEQ ID NO: 233935 - RNA, 64 nt, hsa
ucugcuuccccuggaaaaaaaucguguuaagcuagaugaugacagugaugaugaugaagaaagc

SEQ ID NO: 233936 - RNA, 64 nt, hsa
ggaaaaaaaucguguuaagcuagaugaugacagugaugaugaugaagaaagcaaagaaggccaa

SEQ ID NO: 233937 - RNA, 64 nt, hsa
aaaaaaucguguuaagcuagaugaugacagugaugaugaugaagaaagcaaagaaggccaagaa

SEQ ID NO: 233938 - RNA, 64 nt, hsa
ugcauguccagcuggauucuggccugccaaagaagaugaugauuaaaaacauagauauugcuug

SEQ ID NO: 233939 - RNA, 64 nt, hsa
guauauacauauauauauuuucacuugcuuucaagaugaugaccacacauggauuuugauaugu

SEQ ID NO: 233940 - RNA, 64 nt, hsa
gggucugguagauuauccugaugaugaugaagaugaugaugaggaugaagauaaggaagauacg

SEQ ID NO: 233941 - RNA, 64 nt, hsa
cgugggucugguagauuauccugaugaugaugaagaugaugaugaggaugaagauaaggaagau

SEQ ID NO: 233942 - RNA, 64 nt, hsa
gggaggccucgugggucugguagauuauccugaugaugaugaagaugaugaugaggaugaagau

SEQ ID NO: 233943 - RNA, 64 nt, hsa
acagggaggccucgugggucugguagauuauccugaugaugaugaagaugaugaugaggaugaa

SEQ ID NO: 233944 - RNA, 64 nt, hsa
agcuguagugucuccaucugacaaaacuaaaaaugaugaugauauuauggauccaauaaguaaa

SEQ ID NO: 233945 - RNA, 64 nt, hsa
uuccucaaaguuguaguugucuguugaugauggugaugaugaugaugaugacgauagugaugcc

SEQ ID NO: 233946 - RNA, 64 nt, hsa
cucaaaguuguaguugucuguugaugauggugaugaugaugaugaugacgauagugaugccaca

SEQ ID NO: 233947 - RNA, 64 nt, hsa
aaaguuguaguugucuguugaugauggugaugaugaugaugaugacgauagugaugccacacau

SEQ ID NO: 233948 - RNA, 64 nt, hsa
guuguaguugucuguugaugauggugaugaugaugaugaugacgauagugaugccacacauucu

SEQ ID NO: 233949 - RNA, 64 nt, hsa
ugcagaauaguguaaaaugcgcuucaagaauguugaugaugaugauauagaauuguggcuuuag

SEQ ID NO: 233950 - RNA, 64 nt, hsa
agaauaguguaaaaugcgcuucaagaauguugaugaugaugauauagaauuguggcuuuaguag

SEQ ID NO: 233951 - RNA, 64 nt, hsa
ugccuaaaaaggacaggugguuugacucauggaugaugaugaugucacugugccacuuggacag

SEQ ID NO: 233952 - RNA, 64 nt, hsa
aaaugccuaaaaaggacaggugguuugacucauggaugaugaugaugucacugugccacuugga

SEQ ID NO: 233953 - RNA, 64 nt, hsa
ggacgugaaauacuucgaugaugaugaugaugaugaugaugauaauaauaauaauaauaacaac

SEQ ID NO: 233954 - RNA, 64 nt, hsa
ucuggacgugaaauacuucgaugaugaugaugaugaugaugaugauaauaauaauaauaauaac

SEQ ID NO: 233955 - RNA, 64 nt, hsa
agcucuggacgugaaauacuucgaugaugaugaugaugaugaugaugauaauaauaauaauaau

SEQ ID NO: 233956 - RNA, 64 nt, hsa
cuuagcucuggacgugaaauacuucgaugaugaugaugaugaugaugaugauaauaauaauaau

SEQ ID NO: 233957 - RNA, 64 nt, hsa
ugucuuagcucuggacgugaaauacuucgaugaugaugaugaugaugaugaugauaauaauaau

SEQ ID NO: 233958 - RNA, 64 nt, hsa
ucuugucuuagcucuggacgugaaauacuucgaugaugaugaugaugaugaugaugauaauaau

SEQ ID NO: 233959 - RNA, 64 nt, hsa
uagucuugucuuagcucuggacgugaaauacuucgaugaugaugaugaugaugaugaugauaau

SEQ ID NO: 233960 - RNA, 64 nt, hsa
gagggguugcgggggagcuggaaauaaaccuggagaugaugaugaugaugaugaugaugaugau

SEQ ID NO: 233961 - RNA, 64 nt, hsa
ggguugcgggggagcuggaaauaaaccuggagaugaugaugaugaugaugaugaugaugaugga

SEQ ID NO: 233962 - RNA, 64 nt, hsa
uugcgggggagcuggaaauaaaccuggagaugaugaugaugaugaugaugaugaugauggagcg

SEQ ID NO: 233963 - RNA, 64 nt, hsa
cgggggagcuggaaauaaaccuggagaugaugaugaugaugaugaugaugaugauggagcggau

SEQ ID NO: 233964 - RNA, 64 nt, hsa
gggagcuggaaauaaaccuggagaugaugaugaugaugaugaugaugaugauggagcggaucug

SEQ ID NO: 233965 - RNA, 64 nt, hsa
gggauuguuaggauggagcccaggccacauggaugaugaugauucucccccacagguucgaacc

SEQ ID NO: 233966 - RNA, 64 nt, hsa
auggggauuguuaggauggagcccaggccacauggaugaugaugauucucccccacagguucga

SEQ ID NO: 233967 - RNA, 64 nt, hsa
aaagaaauguaaacagaucgcacagaguaaagaagaugaugauguaauagugaauaaaccucau

SEQ ID NO: 233968 - RNA, 64 nt, hsa
gguuccuguggagaaaaauggugaagaaaacaaagaugaugauaauguuuucagcagcaauuug

SEQ ID NO: 233969 - RNA, 64 nt, hsa
aaaggcacuuuuauugagaaugagaagaacuuuagaugaugauguauuuaugcccuuauauccc

SEQ ID NO: 233970 - RNA, 64 nt, hsa
uaagauggcagaucaccuugaaggccuuuccagugaugaugaagaaacuucuacagauauuacu

SEQ ID NO: 233971 - RNA, 64 nt, hsa
caucugaccaguuuucucuuaaagccauuuccaugaugaugaugaugggacucaauuguauuuu

SEQ ID NO: 233972 - RNA, 64 nt, hsa
cugaccaguuuucucuuaaagccauuuccaugaugaugaugaugggacucaauuguauuuuuua

SEQ ID NO: 233973 - RNA, 64 nt, hsa
aaguugucaaggaaugagggaaaguaaauccucaugaggaaaaguacaaauggaaaucguauua

SEQ ID NO: 233974 - RNA, 64 nt, hsa
cuuuucuuucugcuucaaacacacaguucgucucugaggaaaguaaaauaaauggaauaagagu

SEQ ID NO: 233975 - RNA, 64 nt, hsa
uuuauuuggaaauauucuaugaccacuuuacagaugaggaaacaggccucaagcguggaggggu

SEQ ID NO: 233976 - RNA, 64 nt, hsa
caagucuugcugugcuuuauuugugaaacuuuaaugaggaaaaaacaaauaauaaauguucucg

SEQ ID NO: 233977 - RNA, 64 nt, hsa
ugagaucuucuaccccaacucaucauuuuccuauugaggaaacggguccagggcagucgugugu

SEQ ID NO: 233978 - RNA, 64 nt, hsa
aucuacauguuuguagaauuauuuugaauauguuugaggaaaauguuuaaaaucuaaauauacu

SEQ ID NO: 233979 - RNA, 64 nt, hsa
gaggaaagugcuauucuugucuccauuuuaguguugaggaaaacgaggcaaagagagguuauac

SEQ ID NO: 233980 - RNA, 64 nt, hsa
acuuuagguaucauugaauucucacagcaacuccugaggaaagugcuauucuugucuccauuuu

SEQ ID NO: 233981 - RNA, 64 nt, hsa
guuauuauaauuauaauuauuauuauuauugacaugaggaaaccuagcacuggcagagggcacc

SEQ ID NO: 233982 - RNA, 64 nt, hsa
aaguccuuguuggcagagggauguggggcgggaaugaggaaaggggagggcaugauccuggcaa

SEQ ID NO: 233983 - RNA, 64 nt, hsa
aaaaugauuccucuucccaugaccuaaaacacugugaggaaaaaucauucaaguggcaugccaa

SEQ ID NO: 233984 - RNA, 64 nt, hsa
augagcauuguaauuaauauucccauuuuacagaugaggaaacugaagcuaagagaagcuaagu

SEQ ID NO: 233985 - RNA, 64 nt, hsa
aagguugagaccaaugauuuccuguuaugagucaugaggaaacugaaucaccuagaaguggaau

SEQ ID NO: 233986 - RNA, 64 nt, hsa
cagggucuacaauggggagaacuuguuuuauagaugaggaaaccaaggcucagaggggcaaagu

SEQ ID NO: 233987 - RNA, 64 nt, hsa
aaauacauuauuagaauauaaaaaauguuauuacugaggaaagggaggagaggacaaguguaau

SEQ ID NO: 233988 - RNA, 64 nt, hsa
aggggauggcccauuaagaguuacucagaugaccugaggaaaggagggaaaguuccagcaguuu

SEQ ID NO: 233989 - RNA, 64 nt, hsa
cauguguuuuauaaaaucaaguuuuaagugaaagugaggaaauaaaguuaaguuuguuuuaaau

SEQ ID NO: 233990 - RNA, 58 nt, hsa
aaauuccugucaaugacugaggaugacaugaggaaaauaauguaauuguaauuuugaa

SEQ ID NO: 233991 - RNA, 64 nt, hsa
augccuucaacugaaaaaaacauauccaaaauaaugaggaaauguguuggcucacuacguagag

SEQ ID NO: 233992 - RNA, 64 nt, hsa
uuuauuuacacucuugauucuacaauguagaaaaugaggaaaugccacaaauuguauggugaua

SEQ ID NO: 233993 - RNA, 64 nt, hsa
guacuuugauuucuuauuucuugggcaggcaauuugaggaaagaagaaauggcauggggaauau

SEQ ID NO: 233994 - RNA, 64 nt, hsa
gaugcuuagaaauccuuucugagaugcauaugagugaggaaauaaacuuuaaguaauuauuuuu

SEQ ID NO: 233995 - RNA, 64 nt, hsa
aaaagcucaaggacuuuaugaagaucucauuauaugaggaaaaucauagguuaccauuuuauaa

SEQ ID NO: 233996 - RNA, 64 nt, hsa
cagugaaaauaauuuuauuucagucaaacauuuaugaggaaaugagaucacaucuuugucacug

SEQ ID NO: 233997 - RNA, 64 nt, hsa
uguccuugaagcagcuauuugaagauguguuuucugaggaaaacaggcuacaacuguuuauuaa

SEQ ID NO: 233998 - RNA, 64 nt, hsa
uuauacuguaaauaaacuugaugaauauuauaugugaggaaaacuuucauguauagcacucauu

SEQ ID NO: 233999 - RNA, 64 nt, hsa
uugguuugugauaaaaauauaaagacagaagacaugaggaaaaacaaaagguuugaggaaauca

SEQ ID NO: 234000 - RNA, 64 nt, hsa
uaaagacagaagacaugaggaaaaacaaaagguuugaggaaaucaggcauaugacuuuauacuu

SEQ ID NO: 234001 - RNA, 64 nt, hsa
agacagcuuuuccuacacugauaaagaaaaaaaaugaggaaauuauuucauccccuugugacau

SEQ ID NO: 234002 - RNA, 64 nt, hsa
aagaucccagcugucaguggucucaucucauuagugaggaaagccaagcuguauggaaaagcug

SEQ ID NO: 234003 - RNA, 64 nt, hsa
ggucugaguucugaauggagagcauggauugugaugaggaaacaaggcuggaagagcugccaag

SEQ ID NO: 234004 - RNA, 64 nt, hsa
cucagaaucagaaacgucuccaaagccaggauucugaggaaaguccuguggggagauucugacc

SEQ ID NO: 234005 - RNA, 64 nt, hsa
aauuuucuaaaaacacacacagaaaucgcuugagugaggaaaaguccacauggcagagacaggu

SEQ ID NO: 234006 - RNA, 64 nt, hsa
ucuccaacaguucugaagccaacccacaaaucuuugaggaaaaggggucacuuuguuuacuauu

SEQ ID NO: 234007 - RNA, 64 nt, hsa
ccaauccaugaaccaagaccauugaauucuugguugaggaaacaaacaugacccuaaaucuuga

SEQ ID NO: 234008 - RNA, 64 nt, hsa
guaccuucaaacuagggccaagcccagcacugcuugaggaaaacaagcauucacaacuuguuuu

SEQ ID NO: 234009 - RNA, 64 nt, hsa
ugcagugaccuggucaccuggggugggggugauuugaggaaaugacaugaggaaaagaaaccua

SEQ ID NO: 234010 - RNA, 64 nt, hsa
ucaccuggggugggggugauuugaggaaaugacaugaggaaaagaaaccuauuccugcccuggg

SEQ ID NO: 234011 - RNA, 64 nt, hsa
uggaguuuuagaggaaaagucaacaucuaacuagugaggaaaagugccuaauacaauuagaauc

SEQ ID NO: 234012 - RNA, 64 nt, hsa
uugaaggcaaaggaaacuaaggaaggagguucagugaggaaaauaagguuguccaugagauuug

SEQ ID NO: 234013 - RNA, 64 nt, hsa
caucauucuagucuuuaaguaaaaaugacacuauugaggaaagucagucuacucccuucuuccu

SEQ ID NO: 234014 - RNA, 64 nt, hsa
ucuagggaguuagcauguagaugggauauugggaugaggaaaggaaaaucagguagauggugcu

SEQ ID NO: 234015 - RNA, 64 nt, hsa
cuggugaggcauuuguuaauuugcuacucaacuuugaggaaagacagggccuuggucagagaga

SEQ ID NO: 234016 - RNA, 64 nt, hsa
acucugaacaggcacagcccucccaucuucccaaugaggaaacggauucaggaagagccacuca

SEQ ID NO: 234017 - RNA, 64 nt, hsa
gagggugaguucugcugccuuguccauuuagcgaugaggaaagugaagcucagagcacaaacca

SEQ ID NO: 234018 - RNA, 64 nt, hsa
cauauuuuuuuucugcuuagacuuacuuauucuuugaggaaaaaagguaauguaggagcucauu

SEQ ID NO: 234019 - RNA, 64 nt, hsa
uuuucauuuugcugcaaaucuauaucugaccugcugaggaaaucguuuggugaaaugaauccag

SEQ ID NO: 234020 - RNA, 64 nt, hsa
gauacggcaaccaccacggaccuguggggaccaaugaggaaagagagaggcaggucugggccag

SEQ ID NO: 234021 - RNA, 64 nt, hsa
uaaccuggaauucccuguuuccuuguccagggccugaggaaauggcuccccaggucugucucug

SEQ ID NO: 234022 - RNA, 64 nt, hsa
caucuguugacaaugucuuguggagcauuuuugcugaggaaaaggucacuuguaaacagaggag

SEQ ID NO: 234023 - RNA, 64 nt, hsa
uuuguuucuuuuuaauuaaaauacaagaagcagcugaggaaagggagacaagguauuuuauuuc

SEQ ID NO: 234024 - RNA, 64 nt, hsa
aaguaccucugugucugaaguaugauaguugucuugaggaaaagcacuugugugauugaauugu

SEQ ID NO: 234025 - RNA, 64 nt, hsa
gaaguaaacacuauuauuauccucauuuuuuaguugaggaaacugaggcucauagagguugaaa

SEQ ID NO: 234026 - RNA, 64 nt, hsa
aaauuuggauggauuuacgacuucacaggcauugugaggaaagagcauuuuccaaggcuguuuu

SEQ ID NO: 234027 - RNA, 64 nt, hsa
cauuuacagccagaaucaacauucccugggccccugaggaaauaagcagcuggucuggaggaga

SEQ ID NO: 234028 - RNA, 64 nt, hsa
aaaaaaaaaaaaaaguuuaaucugaaucuaaccaugaggaaauaaucagacaaauccacauuag

SEQ ID NO: 234029 - RNA, 64 nt, hsa
acucuguuggguguacucugcuaaguucuggggaugaggaaauuaauaaagguacagucuugcc

SEQ ID NO: 234030 - RNA, 64 nt, hsa
auugauuuggggauguuugccccgaaugagagguugaggaaaagacuguggguggggaggcccu

SEQ ID NO: 234031 - RNA, 64 nt, hsa
ggaccaauacuaagaauaacaagaagcccaguggugaggaaagugcguucucccagcacugccu

SEQ ID NO: 234032 - RNA, 64 nt, hsa
aacuaagcauuugaggaaaauuuuaaggauaaauugaggaaacugauuaauagagauagcaagg

SEQ ID NO: 234033 - RNA, 64 nt, hsa
uuuuaaaaagcaaauaauaaaauaacuaagcauuugaggaaaauuuuaaggauaaauugaggaa

SEQ ID NO: 234034 - RNA, 64 nt, hsa
aacauuuuacccacacacagauaaaguuuucccuugaggaaacaacagcuuuaaaagaaaaaga

SEQ ID NO: 234035 - RNA, 64 nt, hsa
agaccagagauaguggggagacuucuuggcuuggugaggaaaagcggacaucagcuggucaaac

SEQ ID NO: 234036 - RNA, 64 nt, hsa
uaaaggaggguuugugauugucaccauuuacugaugaggaaacuaaggcuccuaggggagaaau

SEQ ID NO: 234037 - RNA, 64 nt, hsa
cuuguuaucaucuccauuugaucaucuccuccaaugaggaaacccacgcaccuuccuuaguaau

SEQ ID NO: 234038 - RNA, 64 nt, hsa
ucagugaggaaaaaacauucagacaaauguucagugaggaaaaaaaggggaaguuggggauagg

SEQ ID NO: 234039 - RNA, 64 nt, hsa
aaauguucagugugagugaggaaaacauguucagugaggaaaaaacauucagacaaauguucag

SEQ ID NO: 234040 - RNA, 64 nt, hsa
gcagccacaguuucagacaaauguucagugugagugaggaaaacauguucagugaggaaaaaac

SEQ ID NO: 234041 - RNA, 64 nt, hsa
uucaguuuaacaguuccuuuacauguguaguauuugaggaaaaaaaucaauaaacaguugaucu

SEQ ID NO: 234042 - RNA, 64 nt, hsa
ccguguguaggcuuagccucagguggcagauguuugaggaaaggaauuaugccaggaagguggg

SEQ ID NO: 234043 - RNA, 64 nt, hsa
uuaaauuauggcacagauugaugcgcaccagucuugaggaaacgaucucccuauucccuuaccc

SEQ ID NO: 234044 - RNA, 64 nt, hsa
caaggggauuugggauugaagcacagcuuucuguugaggaaaccuaggugucacuuuuuagaac

SEQ ID NO: 234045 - RNA, 64 nt, hsa
gggcacucagugcauuggacuguccacauguucuugaggaaagccgguggaagauucuggaaug

SEQ ID NO: 234046 - RNA, 64 nt, hsa
ugguaaccgggugccugagccccaaucuggguugugaggaaauaggggagagguauccugggcc

SEQ ID NO: 234047 - RNA, 64 nt, hsa
gcacugauggggucuaccugguaagcggagggccugaggaaaccuguagcuucaaucaugucug

SEQ ID NO: 234048 - RNA, 64 nt, hsa
agacaacugcaaacucauuuaagcaagagaaaaacagcucuaauucgagauugugaagcaacac

SEQ ID NO: 234049 - RNA, 64 nt, hsa
aguggucguggggcacagaaaaaauagauaggggcagcucuaaagaccagcuguuaagacagac

SEQ ID NO: 234050 - RNA, 64 nt, hsa
aaacucagcugugacugcuuuccauuaacaguuccagcucuauguguuuccucuaacgcuaaag

SEQ ID NO: 234051 - RNA, 64 nt, hsa
gagaaagcggggagagcaacaccccagcuucuagcagcucuacagcugccuggaccugcaggcc

SEQ ID NO: 234052 - RNA, 64 nt, hsa
guuccccaaaacugucuucaaccacaugacucaacagcucuaugggauaggaacugucaguguu

SEQ ID NO: 234053 - RNA, 64 nt, hsa
agcagagagugggaagacagcucuacuaacccuucagcucuagcaguccaugacuuuuuaagga

SEQ ID NO: 234054 - RNA, 64 nt, hsa
ugcauaaaaaggggagaagcagagagugggaagacagcucuacuaacccuucagcucuagcagu

SEQ ID NO: 234055 - RNA, 64 nt, hsa
uagcuuugcucuuugguagaaaaggcuagguacacagcucuagacacugccacacagggucugc

SEQ ID NO: 234056 - RNA, 64 nt, hsa
acuguuccuugucacugguagaccaaaauaaaaccagcucuacuggucuuguggaauugggagc

SEQ ID NO: 234057 - RNA, 64 nt, hsa
gacucucccugauaguuuaguuuuugauaaagcaugcugguaaaaccacuacccucagagagag

SEQ ID NO: 234058 - RNA, 64 nt, hsa
cuuucuucugagaaaugcugcagucagaagggugugcugguaaaguauuuugguggcagcugcc

SEQ ID NO: 234059 - RNA, 64 nt, hsa
gcccccauguugggagaggggaguggauucuugcugcugguaugagacucccugggaccuagag

SEQ ID NO: 234060 - RNA, 64 nt, hsa
gccuugucuccacccaugacucacuacaaccuugugcugguaagguccuagcaucuuccccuca

SEQ ID NO: 234061 - RNA, 64 nt, hsa
gagccugcuguguccugggugcucucuacgugguggccgguagaauucuccaucuauccaggcu

SEQ ID NO: 234062 - RNA, 50 nt, hsa
agucccaagagccuucgugaggccgguacuuggggccgaaaaacuguggc

SEQ ID NO: 234063 - RNA, 64 nt, hsa
cgagaaggccucaauguggcgaggaagaugcuggggccgguagggcugugagaucuucugggga

SEQ ID NO: 234064 - RNA, 64 nt, hsa
cucugaggggaggggguccgugguagaggccuggggccgguagaggcuccccagggcucccuua

SEQ ID NO: 234065 - RNA, 64 nt, hsa
gaugucggacuaagcgaacagcgcccccacugccggccgguagcagccggaagugccagaccgg

SEQ ID NO: 234066 - RNA, 64 nt, hsa
guguccauggguuagggccaugcuggggaaaacgggccgguauuuacacacgcgcaaaacaccc

SEQ ID NO: 234067 - RNA, 64 nt, hsa
agcuggcggccaccgcaggggcccuccacauucuggccgguaacugggggaaggugauggggcg

SEQ ID NO: 234068 - RNA, 64 nt, hsa
gcagaaugagugagcaagcagauugccccagaggggccgguaauaaucacgugagggauaauca

SEQ ID NO: 234069 - RNA, 64 nt, hsa
cucugagaagcuuggccuggacaccugagccugcggccgguacuccugccuucuccccaucuau

SEQ ID NO: 234070 - RNA, 64 nt, hsa
ccuuugagcuggccugagggcacuuucgcuuccuggccgguacuggaauggcuguguccuaguc

SEQ ID NO: 234071 - RNA, 64 nt, hsa
gggggugauguauguggagaaggguugggggagaggccgguagggcaggggcugcuaguggcug

SEQ ID NO: 234072 - RNA, 64 nt, hsa
gcugucuugugugcagccugagugggguggugcaggccgguagucugcccgucacuuuggauca

SEQ ID NO: 234073 - RNA, 64 nt, hsa
cagguacugccuuacaaagcuguggccaggaaguggccgguauaaaggaugcccaaggucuuug

SEQ ID NO: 234074 - RNA, 64 nt, hsa
agggggccuaguuugggaugagaacagcucugacggccgguaugugaaggagaacugcaaaccu

SEQ ID NO: 234075 - RNA, 64 nt, hsa
ccugaguggagugcugggggaaggaggagguccaggccgguaguggccauucgccgugccucag

SEQ ID NO: 234076 - RNA, 64 nt, hsa
ggggaaccccggggacaugcccccacccgggaggggccgguaaccccugggcuaucuucuagac

SEQ ID NO: 234077 - RNA, 53 nt, hsa
ucugcgaguuccccuucuagcggggccgguaccccgccucccugcccauccca

SEQ ID NO: 234078 - RNA, 64 nt, hsa
cacccuguuggggagagaagaaaggggguucagaggccgguaccuccccuacagcagcccuugg

SEQ ID NO: 234079 - RNA, 64 nt, hsa
gggcucacuacaugggccagcccuugcucuaccuggccgguaggcugcuggcgccuagguugug

SEQ ID NO: 234080 - RNA, 61 nt, hsa
aauguuuaaucauauuugcuaagaaauguuucugcuguaguuggauuugcccauauuuaug

SEQ ID NO: 234081 - RNA, 61 nt, hsa
uuuccucaucuugaaaugaggauaauaauaccugcuguaccuaccucacagggcuguugug

SEQ ID NO: 234082 - RNA, 61 nt, hsa
gcacuccuccgagcccgguggagaaugcaggcugcuguagucucagguaaugaaggcacag

SEQ ID NO: 234083 - RNA, 61 nt, hsa
gucauagcugcugcugcugccaugcgcagagcugcuguaacagcucuuccuguucugcucc

SEQ ID NO: 234084 - RNA, 61 nt, hsa
cuugcuuaaaaaggaugccucuuguuuuuugcugcuguaacuuaccagaaaguguucuaua

SEQ ID NO: 234085 - RNA, 54 nt, hsa
ugagaggaauucaggucugaacagcugcuguagugaugaaacucuugcuuaaaa

SEQ ID NO: 234086 - RNA, 61 nt, hsa
agggggacaugccacauguauuagaaggcaucugcuguaacuuccagugcaagauaauuca

SEQ ID NO: 234087 - RNA, 61 nt, hsa
gcuucuagcccugucucaguccguuaucacucugcuguagaagggggacaugccacaugua

SEQ ID NO: 234088 - RNA, 61 nt, hsa
ucuguaaaugaaaugcugacuucgccucuuccugcuguaugcucaucccugcacugagcac

SEQ ID NO: 234089 - RNA, 61 nt, hsa
gauaacucauaauuauuuuaauggcagagcacugcuguaucuguuuuauggucuacauagu

SEQ ID NO: 234090 - RNA, 61 nt, hsa
aaaggaaauuaaugaaaauguuuuuguuuuucugcuguaauucugcauuaagcucacauga

SEQ ID NO: 234091 - RNA, 61 nt, hsa
ggugauugccaugggacuuuucccaugucuucugcuguaauuauccugugcagaacuagga

SEQ ID NO: 234092 - RNA, 61 nt, hsa
uuuaggcccuguuccagcaauaagaaccaaucugcuguacaaucugaggacuuggcucugu

SEQ ID NO: 234093 - RNA, 61 nt, hsa
cacuugcaguuuugcuuuucucugcauuucucugcuguaagaugacuguugcauuguugaa

SEQ ID NO: 234094 - RNA, 61 nt, hsa
acaauuuugggaucuaguuccccuggaaaagcugcuguauuuuuaauuuuuaauggaaugu

SEQ ID NO: 234095 - RNA, 61 nt, hsa
uaacaucugagagcaguaacacugauuuuaucugcuguaugagacuuugugcauuuuacuu

SEQ ID NO: 234096 - RNA, 61 nt, hsa
auugggaccaaugaaucuggugugaaaaacccugcuguaguagugaaagagcaucaggaga

SEQ ID NO: 234097 - RNA, 61 nt, hsa
gcccccucugccagccuuucugcugcuuuugcugcuguaacagcaauaguggagaaaaaug

SEQ ID NO: 234098 - RNA, 61 nt, hsa
uuccuuggaguggcuuugcauguccaacacucugcuguaucuuuuuuuuuuuuuuuuuuuu

SEQ ID NO: 234099 - RNA, 61 nt, hsa
gagccccaaaucauugcucaggguccauucccugcuguagaacgaugccauaucuggcugc

SEQ ID NO: 234100 - RNA, 61 nt, hsa
uuguuuuuuuuucccccaugcuuuuguuuggcugcuguaauuuuuaaguauuugaguuuga

SEQ ID NO: 234101 - RNA, 61 nt, hsa
agcaguccaacccagaauggcacacacugcucugcuguagcaucaugucagggcuuccugg

SEQ ID NO: 234102 - RNA, 61 nt, hsa
uuccuucauaauggucaugggugaaugcuuucugcuguaagugucuuuuagaguaggaauc

SEQ ID NO: 234103 - RNA, 61 nt, hsa
cuugggaagacuuuggaggugccuauuuuuucugcuguaauuguucuggguagauggagua

SEQ ID NO: 234104 - RNA, 61 nt, hsa
uaauaaacuggaauucuguugaugaauauagcugcuguacuguauauuaauauuuaauaga

SEQ ID NO: 234105 - RNA, 61 nt, hsa
uguagguagugucagugaguggcucuugugccugcuguagacauuaggccugcacuagggc

SEQ ID NO: 234106 - RNA, 61 nt, hsa
aaaagaccaagcaaaugcacucugcuuuuugcugcuguaagaccaccaaaaaugagucaga

SEQ ID NO: 234107 - RNA, 61 nt, hsa
aggccagaacuaguuuaucugaacaccucagcugcuguaagcuucuccucucucaccccgu

SEQ ID NO: 234108 - RNA, 61 nt, hsa
cacaggagugauuggucuauucaccaucccccugcuguaccggcagcaccaggugagugug

SEQ ID NO: 234109 - RNA, 61 nt, hsa
cauuggcccacagaaggcaaaaguggcggaccugcuguacuggaaggacacgaggacguca

SEQ ID NO: 234110 - RNA, 61 nt, hsa
cagucuccuucaacaguucggccaagcagaacugcuguaccucugaccacuuguguuagga

SEQ ID NO: 234111 - RNA, 61 nt, hsa
gcagucugauggacugcggguuuggauaccacugcuguaauguaacccucuuuguuuagau

SEQ ID NO: 234112 - RNA, 61 nt, hsa
ugacucaugccucugagcuucuaaacugaagcugcuguaacuaaaggaaucugaaaagaac

SEQ ID NO: 234113 - RNA, 61 nt, hsa
ucuuuaaaucaguauuccaucaggcagauaacugcuguauucaugaaucuugagaguguuc

SEQ ID NO: 234114 - RNA, 64 nt, hsa
ugacugccccugguggaacauuugaaagcccuugggacuccaggagagagguuuuugcagcaug

SEQ ID NO: 234115 - RNA, 64 nt, hsa
cagaaugcuggaaugaugucuguuggaaaacccaggacuccacacacaaaacuccugggauuuu

SEQ ID NO: 234116 - RNA, 64 nt, hsa
aagcuucagucucggaacaugaccuuuagucuguggacuccauuuaaaaauagguaugaauaag

SEQ ID NO: 234117 - RNA, 64 nt, hsa
accaccaccaccaccaaaaccaguuuaugcaguuggacuccaagcuguaacuuccuagaguugc

SEQ ID NO: 234118 - RNA, 64 nt, hsa
agccuugacccccucccugaccuccccgccagcuggacuccagccauccuccugccucagcuuc

SEQ ID NO: 234119 - RNA, 64 nt, hsa
gucgugcggcaugcccgccgccugcuccccacacggacuccaggcgguccccacccacagaagc

SEQ ID NO: 234120 - RNA, 64 nt, hsa
gacuauggucacagggccguccuguuccuccccgggacuccagaauuucucuccucaaaggaaa

SEQ ID NO: 234121 - RNA, 64 nt, hsa
ccucugcuucccugggggagccccgacggccacaggacuccagcuccaaguggguuuucuuggc

SEQ ID NO: 234122 - RNA, 64 nt, hsa
acuccaggcccccagccccuccuuccuggacccaggacuccaggcccccagccccuccuuccug

SEQ ID NO: 234123 - RNA, 64 nt, hsa
uucccgggccccaguaccuccucccucagacccaggacuccaggcccccagccccuccuuccug

SEQ ID NO: 234124 - RNA, 64 nt, hsa
ccagagagaccugcugccggagagaaggggaggaggacuccagcugggcucggucccccacagu

SEQ ID NO: 234125 - RNA, 64 nt, hsa
gcuccccguguccccaguuccgucucagcuaccuggacuccaggacccuggagaagggagaccu

SEQ ID NO: 234126 - RNA, 64 nt, hsa; identical to SEQ ID NO: 97987

SEQ ID NO: 234127 - RNA, 64 nt, hsa; identical to SEQ ID NO: 97988

SEQ ID NO: 234128 - RNA, 64 nt, hsa; identical to SEQ ID NO: 97989

SEQ ID NO: 234129 - RNA, 64 nt, hsa; identical to SEQ ID NO: 97990

SEQ ID NO: 234130 - RNA, 64 nt, hsa; identical to SEQ ID NO: 97991

SEQ ID NO: 234131 - RNA, 64 nt, hsa; identical to SEQ ID NO: 97992

SEQ ID NO: 234132 - RNA, 64 nt, hsa; identical to SEQ ID NO: 97993

SEQ ID NO: 234133 - RNA, 64 nt, hsa; identical to SEQ ID NO: 97994

SEQ ID NO: 234134 - RNA, 64 nt, hsa; identical to SEQ ID NO: 97995

SEQ ID NO: 234135 - RNA, 64 nt, hsa; identical to SEQ ID NO: 97996

SEQ ID NO: 234136 - RNA, 64 nt, hsa; identical to SEQ ID NO: 97997

SEQ ID NO: 234137 - RNA, 64 nt, hsa; identical to SEQ ID NO: 97998

SEQ ID NO: 234138 - RNA, 64 nt, hsa; identical to SEQ ID NO: 97999

SEQ ID NO: 234139 - RNA, 64 nt, hsa; identical to SEQ ID NO: 98000

SEQ ID NO: 234140 - RNA, 64 nt, hsa; identical to SEQ ID NO: 98001

SEQ ID NO: 234141 - RNA, 64 nt, hsa; identical to SEQ ID NO: 98002

SEQ ID NO: 234142 - RNA, 64 nt, hsa; identical to SEQ ID NO: 98003

SEQ ID NO: 234143 - RNA, 64 nt, hsa; identical to SEQ ID NO: 98004

SEQ ID NO: 234144 - RNA, 64 nt, hsa; identical to SEQ ID NO: 98005

SEQ ID NO: 234145 - RNA, 64 nt, hsa; identical to SEQ ID NO: 98006

SEQ ID NO: 234146 - RNA, 64 nt, hsa; identical to SEQ ID NO: 98007

SEQ ID NO: 234147 - RNA, 64 nt, hsa; identical to SEQ ID NO: 98008

SEQ ID NO: 234148 - RNA, 53 nt, hsa; identical to SEQ ID NO: 98009

SEQ ID NO: 234149 - RNA, 64 nt, hsa; identical to SEQ ID NO: 98010

SEQ ID NO: 234150 - RNA, 64 nt, hsa
ggugcuugaggcgggaccgaggcgcacagagaccgaggcgcauagagaccgaggcacagcccag

SEQ ID NO: 234151 - RNA, 64 nt, hsa
agcggagacgccacccggugcuugaggcgggaccgaggcgcacagagaccgaggcgcauagaga

SEQ ID NO: 234152 - RNA, 63 nt, hsa
accaaaguuuuaagauuugcugugugaugaagugacagggagggccggagucagcaggugcca

SEQ ID NO: 234153 - RNA, 63 nt, hsa
cugccuucuuguagaugacuugcuguucuuuaugacagggaucaguggcauuuguuuccuagc

SEQ ID NO: 234154 - RNA, 63 nt, hsa
cuuucuaagcccuggggcgcccaagucccaugggacagggaaacgugguccucagugaggcug

SEQ ID NO: 234155 - RNA, 63 nt, hsa
cacaucccuauuaacagaggcagcuccacuucagacagggacaaggcuuccugcugugccuuu

SEQ ID NO: 234156 - RNA, 63 nt, hsa
cccaggaggaggagcccuagggaagaagucagggacagggaccaggauaccacucugucacug

SEQ ID NO: 234157 - RNA, 63 nt, hsa
gaccacggccuggaggacuggcccaggcagggggacagggaaaauggagcccaaguagccucu

SEQ ID NO: 234158 - RNA, 63 nt, hsa
accuguuauguugcuuuuggaaggagacucuaagacagggaaagcaaguucaugguacauacg

SEQ ID NO: 234159 - RNA, 63 nt, hsa
gaggccugcccagacuaggaggcagcggggauagacagggaauggggagaagaaagaccccca

SEQ ID NO: 234160 - RNA, 63 nt, hsa
agcuccacaaugggcucccccgccaacggggacgacagggaucuucaggaacuucugaccuca

SEQ ID NO: 234161 - RNA, 63 nt, hsa
ucuaagacaaggaaguccuauagaagccaaagggacagggacggaaaggacaggucccaaggg

SEQ ID NO: 234162 - RNA, 63 nt, hsa
uuauaaaaauccaugcuuuacaccuggacaguagacagggacuucagagauugcacguuugaa

SEQ ID NO: 234163 - RNA, 63 nt, hsa
aguauguuaggaggggccaggcagcggggcagggacagggagccgagugccccucagaguccc

SEQ ID NO: 234164 - RNA, 63 nt, hsa
ggcuggaaagaggagaaggagagggaguacaaagacagggaauagugggaucaaagcuaggaa

SEQ ID NO: 234165 - RNA, 63 nt, hsa
ggagaggaugcacaguuugcuauuugcuuuagagacagggacuguauaaacaagccuaacauu

SEQ ID NO: 234166 - RNA, 63 nt, hsa
cuaccugggugguugaggggacugacauuugaggacagggagauggagcagugucauugucag

SEQ ID NO: 234167 - RNA, 63 nt, hsa
cuuugccagaugaugggaaggcaaggaagaagggacagggaaagauaauuacugauaaaugaa

SEQ ID NO: 234168 - RNA, 63 nt, hsa
ucuccccagcucugcccucuggguccacaugaggacagggaagcucgggaaggggaagggaga

SEQ ID NO: 234169 - RNA, 63 nt, hsa
ccccgcugggcacucucugucccaucccucuaggacagggaagcuggccugguccagggcacu

SEQ ID NO: 234170 - RNA, 63 nt, hsa
auuccaggcccgaagcaugaacagugcaccugggacagggagcagccccaaauugucaccugc

SEQ ID NO: 234171 - RNA, 63 nt, hsa
uccccccaccucccccacucccaaccacguugggacagggaggugugaggcaggagagacagu

SEQ ID NO: 234172 - RNA, 64 nt, hsa; identical to SEQ ID NO: 77430

SEQ ID NO: 234173 - RNA, 64 nt, hsa; identical to SEQ ID NO: 77431

SEQ ID NO: 234174 - RNA, 64 nt, hsa; identical to SEQ ID NO: 77432

SEQ ID NO: 234175 - RNA, 64 nt, hsa; identical to SEQ ID NO: 77433

SEQ ID NO: 234176 - RNA, 64 nt, hsa; identical to SEQ ID NO: 77434

SEQ ID NO: 234177 - RNA, 64 nt, hsa; identical to SEQ ID NO: 77435

SEQ ID NO: 234178 - RNA, 64 nt, hsa; identical to SEQ ID NO: 77436

SEQ ID NO: 234179 - RNA, 64 nt, hsa; identical to SEQ ID NO: 77437

SEQ ID NO: 234180 - RNA, 64 nt, hsa; identical to SEQ ID NO: 77438

SEQ ID NO: 234181 - RNA, 64 nt, hsa; identical to SEQ ID NO: 77439

SEQ ID NO: 234182 - RNA, 64 nt, hsa; identical to SEQ ID NO: 77440

SEQ ID NO: 234183 - RNA, 64 nt, hsa; identical to SEQ ID NO: 77441

SEQ ID NO: 234184 - RNA, 64 nt, hsa; identical to SEQ ID NO: 77442

SEQ ID NO: 234185 - RNA, 64 nt, hsa; identical to SEQ ID NO: 77443

SEQ ID NO: 234186 - RNA, 64 nt, hsa; identical to SEQ ID NO: 77444

SEQ ID NO: 234187 - RNA, 64 nt, hsa; identical to SEQ ID NO: 77445

SEQ ID NO: 234188 - RNA, 64 nt, hsa; identical to SEQ ID NO: 77446

SEQ ID NO: 234189 - RNA, 64 nt, hsa; identical to SEQ ID NO: 77447

SEQ ID NO: 234190 - RNA, 64 nt, hsa; identical to SEQ ID NO: 77448

SEQ ID NO: 234191 - RNA, 64 nt, hsa; identical to SEQ ID NO: 77449

SEQ ID NO: 234192 - RNA, 64 nt, hsa; identical to SEQ ID NO: 77450

SEQ ID NO: 234193 - RNA, 64 nt, hsa; identical to SEQ ID NO: 77451

SEQ ID NO: 234194 - RNA, 64 nt, hsa; identical to SEQ ID NO: 77452

SEQ ID NO: 234195 - RNA, 64 nt, hsa; identical to SEQ ID NO: 77453

SEQ ID NO: 234196 - RNA, 64 nt, hsa; identical to SEQ ID NO: 77454

SEQ ID NO: 234197 - RNA, 64 nt, hsa; identical to SEQ ID NO: 77455

SEQ ID NO: 234198 - RNA, 64 nt, hsa; identical to SEQ ID NO: 77456

SEQ ID NO: 234199 - RNA, 64 nt, hsa; identical to SEQ ID NO: 77457

SEQ ID NO: 234200 - RNA, 64 nt, hsa; identical to SEQ ID NO: 77458

SEQ ID NO: 234201 - RNA, 64 nt, hsa; identical to SEQ ID NO: 77459

SEQ ID NO: 234202 - RNA, 64 nt, hsa; identical to SEQ ID NO: 77460

SEQ ID NO: 234203 - RNA, 64 nt, hsa; identical to SEQ ID NO: 77461

SEQ ID NO: 234204 - RNA, 64 nt, hsa; identical to SEQ ID NO: 77462

SEQ ID NO: 234205 - RNA, 64 nt, hsa; identical to SEQ ID NO: 77463

SEQ ID NO: 234206 - RNA, 64 nt, hsa; identical to SEQ ID NO: 77464

SEQ ID NO: 234207 - RNA, 64 nt, hsa; identical to SEQ ID NO: 77465

SEQ ID NO: 234208 - RNA, 64 nt, hsa; identical to SEQ ID NO: 77466

SEQ ID NO: 234209 - RNA, 64 nt, hsa; identical to SEQ ID NO: 77467

SEQ ID NO: 234210 - RNA, 64 nt, hsa; identical to SEQ ID NO: 77468

SEQ ID NO: 234211 - RNA, 64 nt, hsa; identical to SEQ ID NO: 77469

SEQ ID NO: 234212 - RNA, 64 nt, hsa; identical to SEQ ID NO: 77470

SEQ ID NO: 234213 - RNA, 64 nt, hsa; identical to SEQ ID NO: 77471

SEQ ID NO: 234214 - RNA, 64 nt, hsa; identical to SEQ ID NO: 77472

SEQ ID NO: 234215 - RNA, 64 nt, hsa; identical to SEQ ID NO: 77473

SEQ ID NO: 234216 - RNA, 64 nt, hsa; identical to SEQ ID NO: 77474

SEQ ID NO: 234217 - RNA, 64 nt, hsa; identical to SEQ ID NO: 77475

SEQ ID NO: 234218 - RNA, 64 nt, hsa; identical to SEQ ID NO: 77476

SEQ ID NO: 234219 - RNA, 64 nt, hsa; identical to SEQ ID NO: 77477

SEQ ID NO: 234220 - RNA, 64 nt, hsa; identical to SEQ ID NO: 77478

SEQ ID NO: 234221 - RNA, 64 nt, hsa; identical to SEQ ID NO: 77479

SEQ ID NO: 234222 - RNA, 64 nt, hsa; identical to SEQ ID NO: 77480

SEQ ID NO: 234223 - RNA, 64 nt, hsa; identical to SEQ ID NO: 77481

SEQ ID NO: 234224 - RNA, 64 nt, hsa; identical to SEQ ID NO: 77482

SEQ ID NO: 234225 - RNA, 64 nt, hsa; identical to SEQ ID NO: 77483

SEQ ID NO: 234226 - RNA, 64 nt, hsa; identical to SEQ ID NO: 77484

SEQ ID NO: 234227 - RNA, 64 nt, hsa; identical to SEQ ID NO: 77485

SEQ ID NO: 234228 - RNA, 64 nt, hsa; identical to SEQ ID NO: 77486

SEQ ID NO: 234229 - RNA, 62 nt, hsa
gagcaguggagagggaaagcaacuucuugcuggaagaauaucucugccuucuuaccuuaaau

SEQ ID NO: 234230 - RNA, 62 nt, hsa
ccaaaagauauuuugcucuauuuuaaaguguagaagaauacacugcuaauaaauaauaaaag

SEQ ID NO: 234231 - RNA, 62 nt, hsa
caauggcaauaucaacaaugaggaaaauuacugaagaauaaguuuccauaagucuccuacau

SEQ ID NO: 234232 - RNA, 62 nt, hsa
uucagguuuagaucauaugacacucgagcacagaagaauaauuucaaggaggucaucuugua

SEQ ID NO: 234233 - RNA, 62 nt, hsa
aauuaaaaugggguuugcaggcuuuuuauggugaagaauaauauaucucugucuauagcuuu

SEQ ID NO: 234234 - RNA, 62 nt, hsa
ggccauuucauugagggaaaacauaauaucuugaagaauauuguuaaaaccuuacuuaaagc

SEQ ID NO: 234235 - RNA, 62 nt, hsa
gaaauucacacugugcguuuuagaguaugcaagaagaauauaaauaaauaaaaauauucucc

SEQ ID NO: 234236 - RNA, 62 nt, hsa
uuuccgcaggucugcuccccaccccugccucggaagaauaaagagaauguaguucccuacuc

SEQ ID NO: 234237 - RNA, 62 nt, hsa
agaaaaaaugaauguauuccuguuuuugaagagaagaauaauuuuuuuuuucucuagggaga

SEQ ID NO: 234238 - RNA, 62 nt, hsa
auugcuguauacaccucaugcuuaugcaaugggaagaauaugggggccagggggugugguac

SEQ ID NO: 234239 - RNA, 62 nt, hsa
aaagcaguaucuucacucaaaagucuugcuuggaagaauaagcagaaauaauuuuauauauu

SEQ ID NO: 234240 - RNA, 62 nt, hsa
uugaagguaaugacuaugggucccucucuguggaagaauacugaauagaagagagaaaucac

SEQ ID NO: 234241 - RNA, 62 nt, hsa
gguuucagccgugguccuaguggcuacuuauggaagaauaggaauaguuccacaacauccug

SEQ ID NO: 234242 - RNA, 62 nt, hsa
uuaaggucauuacucucaaccaccuaggcaaugaagaauauaccauuucaaauauuuacagu

SEQ ID NO: 234243 - RNA, 62 nt, hsa
agcccuccaagaaaaaaaauagaaaagcacuugaagaauauucccaauauucccggucagca

SEQ ID NO: 234244 - RNA, 62 nt, hsa
gggacugucauaccagugaagaauaaaagggugaagaauaaaagggauaugaugacaagguu

SEQ ID NO: 234245 - RNA, 62 nt, hsa
ggcuaagaugguauagggacugucauaccagugaagaauaaaagggugaagaauaaaaggga

SEQ ID NO: 234246 - RNA, 62 nt, hsa
gaaaaauuaaggggggauccauugaaagacuugaagaauacauauacuuauauucggggaua

SEQ ID NO: 234247 - RNA, 62 nt, hsa
gauucaaugaaugaucucuagaaagauuuaaagaagaauauucagauaaggauguugaagau

SEQ ID NO: 234248 - RNA, 62 nt, hsa
uacuugguauuuagaacuccuagcaccacggggaagaauagagguaucaucaaacguggcaa

SEQ ID NO: 234249 - RNA, 62 nt, hsa
guauauacauuucccuauuacucucaucagcugaagaauauguacuauuguguuacucaaau

SEQ ID NO: 234250 - RNA, 62 nt, hsa
ugaacacugaucaaguaguuguggagagaugagaagaauauaugcagcaaaggugcugugag

SEQ ID NO: 234251 - RNA, 62 nt, hsa
ugaugcuuuuucuugaugcuaagaucacugcagaagaauaaccugaccuuuucuuugcauuu

SEQ ID NO: 234252 - RNA, 62 nt, hsa
uggugcuucuuacauuuaauauggaaaggugggaagaauauuacugcauuagauguaauucu

SEQ ID NO: 234253 - RNA, 62 nt, hsa
uucgcuuaaaggaaaaaaaaaucuaaaacugcgaagaauacuaaauguaguugagaaauaau

SEQ ID NO: 234254 - RNA, 62 nt, hsa
accaggaagugcuuauucucucaucacagugggaagaauagccuauugucuuucauuuugcc

SEQ ID NO: 234255 - RNA, 62 nt, hsa
uugauuuccucccaaaguaggugagcuauagugaagaauaggugcaaacaaacaagcuuacu

SEQ ID NO: 234256 - RNA, 61 nt, hsa
uaugcugugaaguaggcaauacaguuguuaaagaagaauaauguuggacucugaauguuau

SEQ ID NO: 234257 - RNA, 62 nt, hsa
aguucaaucugucucugggaaagacuagauuggaagaauaaaauucaagaaugugauguuuu

SEQ ID NO: 234258 - RNA, 64 nt, hsa; identical to SEQ ID NO: 53984

SEQ ID NO: 234259 - RNA, 64 nt, hsa; identical to SEQ ID NO: 53985

SEQ ID NO: 234260 - RNA, 64 nt, hsa; identical to SEQ ID NO: 53986

SEQ ID NO: 234261 - RNA, 64 nt, hsa; identical to SEQ ID NO: 54015

SEQ ID NO: 234262 - RNA, 64 nt, hsa; identical to SEQ ID NO: 54016

SEQ ID NO: 234263 - RNA, 64 nt, hsa; identical to SEQ ID NO: 54128

SEQ ID NO: 234264 - RNA, 64 nt, hsa; identical to SEQ ID NO: 54129

SEQ ID NO: 234265 - RNA, 64 nt, hsa; identical to SEQ ID NO: 54130

SEQ ID NO: 234266 - RNA, 64 nt, hsa; identical to SEQ ID NO: 54166

SEQ ID NO: 234267 - RNA, 64 nt, hsa; identical to SEQ ID NO: 54167

SEQ ID NO: 234268 - RNA, 64 nt, hsa; identical to SEQ ID NO: 54231

SEQ ID NO: 234269 - RNA, 64 nt, hsa; identical to SEQ ID NO: 54232

SEQ ID NO: 234270 - RNA, 64 nt, hsa
agggaggaacuuguccauuaguuuggaauuguguucuucguaaagacugaggcaagcaagugcu

SEQ ID NO: 234271 - RNA, 64 nt, hsa
uggugguucugugccuuccccuacucucuucucaucuucguauaugacgaagucagaaaacuca

SEQ ID NO: 234272 - RNA, 64 nt, hsa
cuucccugcuggaaggcauucucagagcuuuaugucuucguaccucucagagauuggacuuuuu

SEQ ID NO: 234273 - RNA, 64 nt, hsa
uuuaauaaauauucauugaauaaugaaugaaccaucuucguacaugaauaauaauacugucuua

SEQ ID NO: 234274 - RNA, 64 nt, hsa
ggucagcaucuccucgacgaucaagaucuaucucucuucguagaucaagaucagcuucacucag

SEQ ID NO: 234275 - RNA, 64 nt, hsa
uaacacuucacuaauuuauaacuaaaauuucucaucuucguacuugaugcucacagaggaagaa

SEQ ID NO: 234276 - RNA, 58 nt, hsa
cuucccguucuucuggaugagcauccuaucuucguaguugguuuggacuucgauaggu

SEQ ID NO: 234277 - RNA, 64 nt, hsa
auuucugauuucugcuucacuuugggcuuccucuucuucguacacauuccaucuaccuaaucaa

SEQ ID NO: 234278 - RNA, 64 nt, hsa
cacauaggaaaugauaaggaagaccaggaggagcucuucguaguccagaaagguagaaguggga

SEQ ID NO: 234279 - RNA, 64 nt, hsa
gucuuugcaggcaccucuucccuucaauaucuguucuucguauuuuuaaaaaaauuuguuuuag

SEQ ID NO: 234280 - RNA, 64 nt, hsa
cccucaugcucgcagccacucugugcccaccucaucuucguagggaccuugauuuuggggacac

SEQ ID NO: 234281 - RNA, 64 nt, hsa
agccaaaugguuccagauacuucagcuuuguguaucuucguaacuucauauuaauauaaguuuc

SEQ ID NO: 234282 - RNA, 64 nt, hsa
cugguuucguuagaggugucuacaguccagauguucuucguaauaaaagcaaaguuuuugaacc

SEQ ID NO: 234283 - RNA, 64 nt, hsa
cugaaauuuauuugauucugaucugaaacuauugucuucguaaaaguuagaucugacuucagac

SEQ ID NO: 234284 - RNA, 64 nt, hsa
cacucuccauuucuaauguucuuguguugccccuucuucguacuguuugugaacuuugguuacc

SEQ ID NO: 234285 - RNA, 64 nt, hsa
ugccagacuuuaagauugcccggaggaagcaaacucuucguauaaaaaaagcaggccaucugcu

SEQ ID NO: 234286 - RNA, 64 nt, hsa
cgucuagcaguaugugccgagaagaggcuuacucucuucguaggugacugugaauuuuguacua

SEQ ID NO: 234287 - RNA, 64 nt, hsa
gaugaauaaaccaguaugacuagucguggagaugucuucguacaguucuucgggaagagaggag

SEQ ID NO: 234288 - RNA, 64 nt, hsa
uugugaccauaggaccauuuuucaaaaugcgcuuucuucguagaagaaauguucaguuuaauua

SEQ ID NO: 234289 - RNA, 64 nt, hsa
uuccauuaagagacucauugcuugggaaaugcuuucuucguacuaaaauuugauuccuuuuuuu

SEQ ID NO: 234290 - RNA, 64 nt, hsa
aaaccaacauguggcugagccuuuuuuuuuuuaaucuucguaacauguuuaaaaaaaaacagug

SEQ ID NO: 234291 - RNA, 64 nt, hsa
acugaagggguucucacagugggagccagggcugucuucguauucccauuagaccaagcuuguc

SEQ ID NO: 234292 - RNA, 64 nt, hsa
gcacuauuauaagugcuucacagguuuuauguguucuucguaacuuuauggaguagguaccauu

SEQ ID NO: 234293 - RNA, 64 nt, hsa
uccaaguccugaaguagaugguugagauaugaguucuucguacuggaaaagcccuuccguaguu

SEQ ID NO: 234294 - RNA, 64 nt, hsa
aaaguucaaccucaaguuaaaugguuugacuuauucuucguaucauuagaagaaccccagagau

SEQ ID NO: 234295 - RNA, 64 nt, hsa
ugguguguucacgugagccuacauccgagggugcucuucguaagggguaguuguuguuuuauag

SEQ ID NO: 234296 - RNA, 64 nt, hsa
gccuguugcuuucuuccugcauagucuguuccuuucuucguacauagucuguuccuuuucucuc

SEQ ID NO: 234297 - RNA, 64 nt, hsa
guaucugggcagaaguaggcacagcucuugcaacucuucguaacggcagacgcuggcccucucc

SEQ ID NO: 234298 - RNA, 64 nt, hsa
gucagaauaggccccuacagguauauuuuaaaacucuucguaauucuaauguguacugcuggua

SEQ ID NO: 234299 - RNA, 64 nt, hsa
uugucuuuaucauccuuuccccuuucccuucaacucuucguacauucaaugcauggaucaauca

SEQ ID NO: 234300 - RNA, 64 nt, hsa
cuuuuccauuucgucaugaccuagaugaccugucucuucguacucgguuauuaaauggccuagc

SEQ ID NO: 234301 - RNA, 64 nt, hsa
ugcaucuuauuaauuuucuaugauauuuuuuccuucuucguagggacuugggacaaucuggcuu

SEQ ID NO: 234302 - RNA, 64 nt, hsa
ggaaugacugaaagaagaacagcuguuccuguguucuucguauauacacacaaaaaggagcggg

SEQ ID NO: 234303 - RNA, 64 nt, hsa
aaaaaaaaaaaaaaaaaaaaagaaugcuagguaaucuucguagaaaacuagaaaguaugauaaa

SEQ ID NO: 234304 - RNA, 64 nt, hsa
ugcaaccuugggcaaguuccucaaccucucugugucuucguacccucaucuguaacaugcgugu

SEQ ID NO: 234305 - RNA, 64 nt, hsa
aguauaauagcacuggaggagacugugguagccaucuucguaaauuuaaacuuugagcacccac

SEQ ID NO: 234306 - RNA, 64 nt, hsa
caucuucaaugacaucugcaaccauugucgagauucuucguaggaagaauuaaaggaaugggga

SEQ ID NO: 234307 - RNA, 64 nt, hsa
gaugcacaugagcuggcgggauugaaggaugcugucuucguacugggaaagggauuuucagccc

SEQ ID NO: 234308 - RNA, 64 nt, hsa
ucuguagauuuccuuaaaacuauuauuuuuuucuucuucguaaaauuuugauaaucuguucucu

SEQ ID NO: 234309 - RNA, 64 nt, hsa
ccugagguagaagagauuuuucaguugcuauuucucuucguaaugaauuuucuuuacauccugu

SEQ ID NO: 234310 - RNA, 64 nt, hsa; identical to SEQ ID NO: 229168

SEQ ID NO: 234311 - RNA, 64 nt, hsa; identical to SEQ ID NO: 229169

SEQ ID NO: 234312 - RNA, 64 nt, hsa; identical to SEQ ID NO: 229170

SEQ ID NO: 234313 - RNA, 64 nt, hsa; identical to SEQ ID NO: 229171

SEQ ID NO: 234314 - RNA, 64 nt, hsa; identical to SEQ ID NO: 229172

SEQ ID NO: 234315 - RNA, 64 nt, hsa; identical to SEQ ID NO: 229173

SEQ ID NO: 234316 - RNA, 64 nt, hsa; identical to SEQ ID NO: 229174

SEQ ID NO: 234317 - RNA, 64 nt, hsa; identical to SEQ ID NO: 229175

SEQ ID NO: 234318 - RNA, 64 nt, hsa; identical to SEQ ID NO: 229176

SEQ ID NO: 234319 - RNA, 64 nt, hsa; identical to SEQ ID NO: 229177

SEQ ID NO: 234320 - RNA, 64 nt, hsa; identical to SEQ ID NO: 229178

SEQ ID NO: 234321 - RNA, 64 nt, hsa; identical to SEQ ID NO: 229179

SEQ ID NO: 234322 - RNA, 64 nt, hsa; identical to SEQ ID NO: 229180

SEQ ID NO: 234323 - RNA, 64 nt, hsa; identical to SEQ ID NO: 229181

SEQ ID NO: 234324 - RNA, 64 nt, hsa; identical to SEQ ID NO: 229182

SEQ ID NO: 234325 - RNA, 64 nt, hsa; identical to SEQ ID NO: 229183

SEQ ID NO: 234326 - RNA, 64 nt, hsa; identical to SEQ ID NO: 229184

SEQ ID NO: 234327 - RNA, 64 nt, hsa; identical to SEQ ID NO: 229185

SEQ ID NO: 234328 - RNA, 54 nt, hsa; identical to SEQ ID NO: 229186

SEQ ID NO: 234329 - RNA, 64 nt, hsa; identical to SEQ ID NO: 229187

SEQ ID NO: 234330 - RNA, 64 nt, hsa; identical to SEQ ID NO: 229188

SEQ ID NO: 234331 - RNA, 64 nt, hsa; identical to SEQ ID NO: 229189

SEQ ID NO: 234332 - RNA, 63 nt, hsa
cauuuguguauucaggcuuuuuaaauaaaauuagagcuguaaggaaaaugaaaagccacaaau

SEQ ID NO: 234333 - RNA, 63 nt, hsa
auguguguauuauaacuuauuaaucuugcuguugagcuguauacaugguuuaaaaaauaguac

SEQ ID NO: 234334 - RNA, 63 nt, hsa
ggguaaauugguugaauuauuguauugaagcuugagcuguagcuaaaaguaauuuagguuucc

SEQ ID NO: 234335 - RNA, 63 nt, hsa
aaguuguauaauaugcuuguaaaggcugagggugagcuguaucuggaugccuuuuuacaauuu

SEQ ID NO: 234336 - RNA, 64 nt, hsa
cuucauuuaccagugcaggaagucucauaaaacucagauguacucccacaaaaauuuuauuggc

SEQ ID NO: 234337 - RNA, 64 nt, hsa
ugcccucuguaaauguguugagugauauagcuaucagauguauugaaggcaaaguucucgcaga

SEQ ID NO: 234338 - RNA, 64 nt, hsa
gaaauuguacuuagauuuaagaaaaagagaaaaucagauguauuuauuugacuucauuccguau

SEQ ID NO: 234339 - RNA, 64 nt, hsa
gaaaugccuaaaagacuuuauuguucuaauuauccagauguaccuuuguaaaauagcucuuuua

SEQ ID NO: 234340 - RNA, 64 nt, hsa
uugauaggauacauacugaaaucagcaaacaaaacagauguauagauuagaguguggagaaaac

SEQ ID NO: 234341 - RNA, 64 nt, hsa
agaguucaaacagauacagcaugguccagagucccagauguacaaaaacagggauucaucacaa

SEQ ID NO: 234342 - RNA, 64 nt, hsa
guguacaccaugcccauguauauacaaguacacacagauguacacacagauguacacaugcucc

SEQ ID NO: 234343 - RNA, 64 nt, hsa
cccauguauauacaaguacacacagauguacacacagauguacacaugcuccagccccagcucu

SEQ ID NO: 234344 - RNA, 64 nt, hsa
uuugaaacagcugcagcaagaguuggcacuuauucagauguaucuucaaccucuguuauucugg

SEQ ID NO: 234345 - RNA, 64 nt, hsa
uuuacaugacaauuuguaaucauaagagaugguucagauguauaacagaaugggaaagccagca

SEQ ID NO: 234346 - RNA, 64 nt, hsa
uuaugccaaauaucaagaugugaaggacuaauucaggaugcaaaaacguuauugggggguugua

SEQ ID NO: 234347 - RNA, 64 nt, hsa
ugggggguuguaaauaucaacuauucaacaguuuaggaugcaauuacgaguguaaacugugugc

SEQ ID NO: 234348 - RNA, 64 nt, hsa
ucuagucagggccuugggcaagacauugggcucuaggaugcaauuggcaaauacguccccguua

SEQ ID NO: 234349 - RNA, 64 nt, hsa
cuguaggaaagcaaauguagguaaggggagagcaaggaugcacagaaaacacacugacuguggg

SEQ ID NO: 234350 - RNA, 64 nt, hsa
ugcacagaaaacacacugacugugggacugugccaggaugcauuuggaaagauagagcauucug

SEQ ID NO: 234351 - RNA, 64 nt, hsa
cccugggggaugacacucaguucugucacugucaaggaugcagagagcuggugguaggugggaa

SEQ ID NO: 234352 - RNA, 64 nt, hsa
accagugggauugaaaaccagcagaagccaagacaggaugcacagcugaauuggaggagaguag

SEQ ID NO: 234353 - RNA, 64 nt, hsa
gccucaaucccauuuugauauucauuuuagugaaaggaugcaucagaccuguuccacaucaugc

SEQ ID NO: 234354 - RNA, 64 nt, hsa
aaugaggaguuguugaacccacugcuaggaagcaaggaugcaacaagaugaugcugagcgugaa

SEQ ID NO: 234355 - RNA, 64 nt, hsa
gauagccaaguaaguuuuaaaaaccaaagcauccaggaugcacaccccugcaccauuugcugug

SEQ ID NO: 234356 - RNA, 64 nt, hsa
ggaugaauguuugacggggaagaggaaggguaggaggaugcauggaugaguggaugaguggauc

SEQ ID NO: 234357 - RNA, 64 nt, hsa
gaagugggaggaucaccugagcccagggaggucaaggaugcagugagccauggucucaccacug

SEQ ID NO: 234358 - RNA, 64 nt, hsa; identical to SEQ ID NO: 234336

SEQ ID NO: 234359 - RNA, 64 nt, hsa; identical to SEQ ID NO: 234337

SEQ ID NO: 234360 - RNA, 64 nt, hsa; identical to SEQ ID NO: 234338

SEQ ID NO: 234361 - RNA, 64 nt, hsa; identical to SEQ ID NO: 234339

SEQ ID NO: 234362 - RNA, 64 nt, hsa; identical to SEQ ID NO: 234340

SEQ ID NO: 234363 - RNA, 64 nt, hsa; identical to SEQ ID NO: 234341

SEQ ID NO: 234364 - RNA, 64 nt, hsa; identical to SEQ ID NO: 234342

SEQ ID NO: 234365 - RNA, 64 nt, hsa; identical to SEQ ID NO: 234343

SEQ ID NO: 234366 - RNA, 64 nt, hsa; identical to SEQ ID NO: 234344

SEQ ID NO: 234367 - RNA, 64 nt, hsa; identical to SEQ ID NO: 234345

SEQ ID NO: 234368 - RNA, 64 nt, hsa; identical to SEQ ID NO: 234346

SEQ ID NO: 234369 - RNA, 64 nt, hsa; identical to SEQ ID NO: 234347

SEQ ID NO: 234370 - RNA, 64 nt, hsa; identical to SEQ ID NO: 234348

SEQ ID NO: 234371 - RNA, 64 nt, hsa; identical to SEQ ID NO: 234349

SEQ ID NO: 234372 - RNA, 64 nt, hsa; identical to SEQ ID NO: 234350

SEQ ID NO: 234373 - RNA, 64 nt, hsa; identical to SEQ ID NO: 234351

SEQ ID NO: 234374 - RNA, 64 nt, hsa; identical to SEQ ID NO: 234352

SEQ ID NO: 234375 - RNA, 64 nt, hsa; identical to SEQ ID NO: 234353

SEQ ID NO: 234376 - RNA, 64 nt, hsa; identical to SEQ ID NO: 234354

SEQ ID NO: 234377 - RNA, 64 nt, hsa; identical to SEQ ID NO: 234355

SEQ ID NO: 234378 - RNA, 64 nt, hsa; identical to SEQ ID NO: 234356

SEQ ID NO: 234379 - RNA, 64 nt, hsa; identical to SEQ ID NO: 234357

SEQ ID NO: 234380 - RNA, 64 nt, hsa
gaaaucuuacagaaaacaggggugggaaucucuuccgauagagucgcuauuucugguuaauaua

SEQ ID NO: 234381 - RNA, 64 nt, hsa
uccccugccugaacgaagacuuccgccgcgaagcccgauagaucgggggaaaauggggccuucg

SEQ ID NO: 234382 - RNA, 64 nt, hsa
accuuuucuuuuuguaaaaguuuaugguauuauaccgauagaccaaaacagcauguguaagagg

SEQ ID NO: 234383 - RNA, 64 nt, hsa
gcauauuagcaaaguauagaggucacuguguaaaccgauagaaaaguaaccaucagcaaauacu

SEQ ID NO: 234384 - RNA, 64 nt, hsa
aaugaguaagcagugccaccaacuaguguuuugcccgauagaagagccagcauguucacguuau

SEQ ID NO: 234385 - RNA, 64 nt, hsa
gugucaggaaaaaaugugggguaugccaaguaugccgauagaauaagugcuaaugaugccauug

SEQ ID NO: 234386 - RNA, 64 nt, hsa
acuucuuugaccaaggaauaccacagacacccuaccgauagaacaguggcucagaucuuacuug

SEQ ID NO: 234387 - RNA, 64 nt, hsa
uuuaacuuauugacaaccgagaagguuuaucccgccgauagagggacggccaagaauguacguc

SEQ ID NO: 234388 - RNA, 64 nt, hsa
ccccuacugcaccccugggagaggaagccaggcaccgauagagcacccagccccaccccuguaa

SEQ ID NO: 234389 - RNA, 64 nt, hsa
uuguuagccugacacucccaaacaguuguagaauccgauagaugacugauggcaaaagauugug

SEQ ID NO: 234390 - RNA, 64 nt, hsa
caccuugagccagagucaagggcugcagcacugcccgauagaacacgcccgcccucacugcugu

SEQ ID NO: 234391 - RNA, 64 nt, hsa
accuugguuugguuuaugugucaguuucacuuuuccgauagaaauuucuuaccucauuuuuuua

SEQ ID NO: 234392 - RNA, 64 nt, hsa
aaggagagaagguuuuuagguuagaaaccuuuaaccgauagaaggauaugguauguuguaaagc

SEQ ID NO: 234393 - RNA, 64 nt, hsa
cugguggggcccaguguacugaaauaaagucguuccgauagacacgucagcugggccucuaucu

SEQ ID NO: 234394 - RNA, 64 nt, hsa
uaguuucucuaaaaagaaaacuuggggaucauagccgauagagagacuugcuaaaauauaaauc

SEQ ID NO: 234395 - RNA, 64 nt, hsa
gcauccugguuauuaugacguucuuugagcugggccgauagauccagcugaagaguucuacaua

SEQ ID NO: 234396 - RNA, 64 nt, hsa
uaaucauuuuauuuugaagucucauacaagcucuccgauagagaacuuucaggcagaucccacc

SEQ ID NO: 234397 - RNA, 64 nt, hsa
cuuucuugaauuauaauacugaauguuuucuguuccgauagagaaaagugaagcaaauauguga

SEQ ID NO: 234398 - RNA, 64 nt, hsa
uggcuccuugcagccuccagggacuggccuguccccgauagaauugaagcaguccacggggagg

SEQ ID NO: 234399 - RNA, 64 nt, hsa; identical to SEQ ID NO: 97553

SEQ ID NO: 234400 - RNA, 64 nt, hsa; identical to SEQ ID NO: 97554

SEQ ID NO: 234401 - RNA, 64 nt, hsa; identical to SEQ ID NO: 97555

SEQ ID NO: 234402 - RNA, 64 nt, hsa; identical to SEQ ID NO: 97556

SEQ ID NO: 234403 - RNA, 64 nt, hsa
ggcacuggcccacuugcggaaccugacucaggcugcuggcaagcguagcuauguguuggcccug

SEQ ID NO: 234404 - RNA, 64 nt, hsa
ccucccucuacagccucauuccuuaguucccggagcuggcaagggcuggagccccgccuggguc

SEQ ID NO: 234405 - RNA, 64 nt, hsa
gggauuacuagaaaaccugacuaauggugucacugcuggcaauggugauaauggauuaauuccu

SEQ ID NO: 234406 - RNA, 64 nt, hsa
cggauucccagaaaaccugacuaauggugccacugcuggcaauggugaugauggauuaauuccu

SEQ ID NO: 234407 - RNA, 64 nt, hsa
cugggcagucuguuuacagcuggcaaacagacuggcuggcaaguuguggggcugggucagaaag

SEQ ID NO: 234408 - RNA, 64 nt, hsa
gucccagagaggcagccugggcagucuguuuacagcuggcaaacagacuggcuggcaaguugug

SEQ ID NO: 234409 - RNA, 64 nt, hsa
guaaucaaauaguuaacaucaggaaguuaauuuggcuggcaaaauucuagggaaacuuggccag

SEQ ID NO: 234410 - RNA, 64 nt, hsa
gaguuuuguggugcuguagguaacguguggcacugcuggcaaaugaaggucaugagaugaguuc

SEQ ID NO: 234411 - RNA, 64 nt, hsa
aguauaucaaucaacucuaacucggagacgucuagcuggcaauguuucuaaaacuuucacugga

SEQ ID NO: 234412 - RNA, 64 nt, hsa
aagcuccuuguucucuacuguucaccgggaccuggcuggcaaaugacuuagcuauuaguauauu

SEQ ID NO: 234413 - RNA, 64 nt, hsa
uuguccaacaacagugcugacuguccggauaagagcuggcaagugcccuuaggaugccgcaugg

SEQ ID NO: 234414 - RNA, 64 nt, hsa
uggauuucugcccaagaccagaggagugugcugugcuggcaaguguaagucccccaguugcucu

SEQ ID NO: 234415 - RNA, 64 nt, hsa
uagggaggugggguagagcacucuccguccugcugcuggcaaggaaugggaacaguggcugucu

SEQ ID NO: 234416 - RNA, 58 nt, hsa
aaaugaguuguucaccuuaacccauuacgcuggcaaacugauacaacucagaaacugc

SEQ ID NO: 234417 - RNA, 64 nt, hsa
aacugaaauuuagccuuacucccaaguuauaaaugcuggcaacaaaucacaguaguaaaagcag

SEQ ID NO: 234418 - RNA, 64 nt, hsa
uccuagcugcucuggaggcuccuuugauucucuagaccuggaaaaggugucccuaggcagagcc

SEQ ID NO: 234419 - RNA, 64 nt, hsa
gcucagagcuggggauuuccugccuggaacaagggaccuggagaauguuuuugcgugggaugau

SEQ ID NO: 234420 - RNA, 64 nt, hsa
ccaguuucaagaugaagaacuacaugauacaguggaccuggagaccauccccuuggaaagacaa

SEQ ID NO: 234421 - RNA, 64 nt, hsa
ggcuuacagaaaugacugccggucauuugaaugagaccuggaacaaaucguuucucagaaguac

SEQ ID NO: 234422 - RNA, 64 nt, hsa
uggcuauuacaaagcaguacugcaguaugucuuggaccuggaaaguuggacauguguguggcuc

SEQ ID NO: 234423 - RNA, 64 nt, hsa
cugggcugaccuacuaaaaccugcuccauguauggaccuggaaggccauugcugccauggcacu

SEQ ID NO: 234424 - RNA, 64 nt, hsa
cugacuucuuagagaauguguggccagacccagggaccuggaguguguuuggacugcaguuugc

SEQ ID NO: 234425 - RNA, 64 nt, hsa
cauguucugaugaaagaaccaagugacccaaagugaccuggacaagauucauagacugaaagcu

SEQ ID NO: 234426 - RNA, 64 nt, hsa
ugucccccuugaggacgaagccuccagugaccuggaccuggagcaacucauggaagauguuggg

SEQ ID NO: 234427 - RNA, 64 nt, hsa
uggaagugucccccuugaggacgaagccuccagugaccuggaccuggagcaacucauggaagau

SEQ ID NO: 234428 - RNA, 64 nt, hsa
aggacagagacuacaccuuguacuuuuugugcaugaccuggaccugcuaaggaaaaaaaaaucu

SEQ ID NO: 234429 - RNA, 64 nt, hsa
gacacccuuggacagaagacuggccuaccuagcagaccuggauuuuucuuccugaucugcugcu

SEQ ID NO: 234430 - RNA, 64 nt, hsa
uuuuggaguuccucucggguuaucucccacgccugaccuggaaccagcaagccccuuuccugcc

SEQ ID NO: 234431 - RNA, 64 nt, hsa
aguuugugaagcaccuggucagcaaccugccccagaccuggagggucuuuguggacugaaggua

SEQ ID NO: 234432 - RNA, 64 nt, hsa
gguggagaaucagauuuagagggagggagagucugaccuggauccugaccuguaaccagcugaa

SEQ ID NO: 234433 - RNA, 64 nt, hsa
cucaagcgggaccuucuuucucugucaggcccuugaccuggaaugggggccuuugucaaacacu

SEQ ID NO: 234434 - RNA, 64 nt, hsa
cagccacaucuucuaugagccagaugcuuaugaugaccuggaccaagaagacccagaugacgac

SEQ ID NO: 234435 - RNA, 64 nt, hsa
uuaugaugaccuggaccaagaagacccagaugacgaccuggauauuugacuggccagauuugau

SEQ ID NO: 234436 - RNA, 64 nt, hsa
gaagcccaccaagaccgaaacuggagaagggcuggaccuggaccuggaccuggaccuacagcgg

SEQ ID NO: 234437 - RNA, 64 nt, hsa
caccaagaccgaaacuggagaagggcuggaccuggaccuggaccuggaccuacagcggggacuu

SEQ ID NO: 234438 - RNA, 64 nt, hsa
gaccgaaacuggagaagggcuggaccuggaccuggaccuggaccuacagcggggacuuaaaugc

SEQ ID NO: 234439 - RNA, 64 nt, hsa
ccagcagacucuggaggccugugccuugcuagcugaccuggagaugcugccugguggggaucag

SEQ ID NO: 234440 - RNA, 64 nt, hsa
cauccugguuuuagacgaggccacagcugccaucgaccuggagacugacaaccucauccaggcu

SEQ ID NO: 234441 - RNA, 64 nt, hsa
aagcaaagagcagacacacauacagccugaaacagaccuggacagacagacacagccugaaaca

SEQ ID NO: 234442 - RNA, 64 nt, hsa
cagacagagagacaggcagacacagccuaaaacagaccuggacagacaggcagacguagucuga

SEQ ID NO: 234443 - RNA, 64 nt, hsa
aagacuggcaguucuagauuccucuauauggggagaccuggauuguugaccagggugagaagcc

SEQ ID NO: 234444 - RNA, 64 nt, hsa
ggacucaggacuucagaagcaacauuucuggccugaccuggaaggugaaggugaaggugagacc

SEQ ID NO: 234445 - RNA, 64 nt, hsa
cuccucccuccccaccccugucgcauccacgugcgaccuggaggacuggucagaaccguuacug

SEQ ID NO: 234446 - RNA, 64 nt, hsa
agccacguccugccucgcgccgccccucgggccugaccuggaagcuccgucagcuccguccuug

SEQ ID NO: 234447 - RNA, 64 nt, hsa
cgggacagaauggauauuuggcugaccuuggugagaccuggagcugccuguuucuucccuaggg

SEQ ID NO: 234448 - RNA, 64 nt, hsa
acaugugccgcuaacugaccgcguugccauuggcgaccuggacucugaacucagguuuauucua

SEQ ID NO: 234449 - RNA, 64 nt, hsa
cgcagguuguccucaaacccucuccucacaggaaaaggcggauugaggcugcugggucagccuu

SEQ ID NO: 234450 - RNA, 64 nt, hsa
gggguugcuccugguccaagaggcuaccugcuccaaggcggagggugggagcaggugugccagg

SEQ ID NO: 234451 - RNA, 64 nt, hsa
ggugggccagaagcccguccuccuaugcugguggaaggcggaggaccggagucccugcagaagg

SEQ ID NO: 234452 - RNA, 64 nt, hsa
gccccacuggagcagucuguccuuaugccgaaucaaggcggaacaugggugaaagacgaguaag

SEQ ID NO: 234453 - RNA, 64 nt, hsa
ccaugaaacagauuucaaaggaaaagcuuaaagcaaggcggaacagaacugcauuugaagaagu

SEQ ID NO: 234454 - RNA, 64 nt, hsa
ucauccuugugugcugcucugcuaagagauguccaaggcggagccggggcaagauccuuccaga

SEQ ID NO: 234455 - RNA, 64 nt, hsa
ugggagauccugcauuucuaacaagcucccagguaaggcggaggcugcuggugugaggaccaug

SEQ ID NO: 234456 - RNA, 64 nt, hsa
ccaccgagaaccaccagccacaccauuauaccagaaggcggaucccccaagaccacagugagag

SEQ ID NO: 234457 - RNA, 64 nt, hsa
cccguuuuguuucucugggcgguuguggcagcugaaggcggacguuguuuccuaaccauaggug

SEQ ID NO: 234458 - RNA, 64 nt, hsa
gggaggcugaggcaggagaaucgcuugaaccuagaaggcggagguugcagugagcggagauugu

SEQ ID NO: 234459 - RNA, 64 nt, hsa
guggugacucaagccuauaaucccagcacuucggaaggcggaggcaggaggaucgcuugaggcc

SEQ ID NO: 234460 - RNA, 64 nt, hsa
gaagccuccugucuccccuuuccccgcguccgagaaggcggaaacccacaguguuaccugacuu

SEQ ID NO: 234461 - RNA, 64 nt, hsa
ccgccgggccgcgccaaggaccugcaagggacugaaggcggagcccauccaacccucgcccgac

SEQ ID NO: 234462 - RNA, 64 nt, hsa
aggggccacauaggaaagccccacggugggucagaaggcggaaggagggaggggaacguguggg

SEQ ID NO: 234463 - RNA, 64 nt, hsa
uguggagagagccgcacaccagcgccacccaggaaaggcggagcgguuaccaguguuuuguguu

SEQ ID NO: 234464 - RNA, 64 nt, hsa
aguccucuucaacuucagcugauuacaauaacaaaaggcggaauugaauugugcgaugccaacg

SEQ ID NO: 234465 - RNA, 54 nt, hsa
ucuucugguugcaggacuagugggaaggcggaggugggcccccacagagcccac

SEQ ID NO: 234466 - RNA, 64 nt, hsa
gauaugacuaacucaccaaacaaugccaaggagaaaggcggacaggucaccaucaccuuucauc

SEQ ID NO: 234467 - RNA, 64 nt, hsa
cugccaacaccggaacaagccgacgcuuccagacaaggcggaaaaggccuuuuguaauggaaau

SEQ ID NO: 234468 - RNA, 64 nt, hsa
ggauccccaaacacuagagaagcucuccuaacccaaggcggagaaugaaggugguggcggcaga

SEQ ID NO: 234469 - RNA, 64 nt, hsa
gggaggcugaggcaggagaauggcaugaaccuggaaggcggagcuugcagugagcugagauugc

SEQ ID NO: 234470 - RNA, 64 nt, hsa
cccaggucaccuccgggcuuccgcagcccccuccaaggcggaguggagccuugggaaccccucg

SEQ ID NO: 234471 - RNA, 64 nt, hsa
aggaggcugaggcaggagaauggcgugaacccggaaggcggagcuugcaguuagccgagaucau

SEQ ID NO: 234472 - RNA, 64 nt, hsa
agauauaggaaggcaggaugguuauauggaauaaaaggcggacugcaucuguauguagugaaau

SEQ ID NO: 234473 - RNA, 64 nt, hsa
caaaggugcuuuaaaugucacauuuguaaaggggaaggcggacaagauuuggaaguuuagucac

SEQ ID NO: 234474 - RNA, 64 nt, hsa
caaaaggcuuuuggauuugugcauagcuggagugaaggcggagggagccugcuacaggccgcag

SEQ ID NO: 234475 - RNA, 64 nt, hsa
ugccauacgugacagccagaggcccagcguuaucaaggcggacaauuagacucuugagaacaca

SEQ ID NO: 234476 - RNA, 64 nt, hsa
agaaaaggaccuugugagacggaggaagcggcagaaggcggacgcgugccggcgggaggagcca

SEQ ID NO: 234477 - RNA, 64 nt, hsa
guucucggaaagaccggagggcuucuccccacagaaggcggagagagcuggggcucagacaugg

SEQ ID NO: 234478 - RNA, 64 nt, hsa
ccuuggaacgcugccuccacugaggcgggcacacaaggcggacccuccugaaacagccuccauu

SEQ ID NO: 234479 - RNA, 64 nt, hsa
ggcagagguuggcccuuucucuaaugccuucuggaaggcggaaaaugugggaacuauaaaucac

SEQ ID NO: 234480 - RNA, 64 nt, hsa
gcucgcgccuguaaucccagcacuuugggaggccaaggcggacggaucacuugagguuaggagu

SEQ ID NO: 234481 - RNA, 64 nt, hsa
gacauuuacaauggauuguauuuguccggcaaaaaaggcggauucauucauagagcagaaagaa

SEQ ID NO: 234482 - RNA, 64 nt, hsa
aggaggcugagaaaagagaauuguuugaaccuggaaggcggagguugcagugagccaagaucac

SEQ ID NO: 234483 - RNA, 64 nt, hsa
augcaacuauccgucucgaauaccagggcagggcaaggcggacugaugccguccaaccaauuau

SEQ ID NO: 234484 - RNA, 64 nt, hsa
uggccccacugcagaauuaaagaaggaagaagggaaggcggaggagucuauaagaaggaaucau

SEQ ID NO: 234485 - RNA, 64 nt, hsa
gccaugaugacaauggcgguuuuguggaauagaaaaggcggaaagguggggaaaagauugagaa

SEQ ID NO: 234486 - RNA, 64 nt, hsa
gggaggcugaggcaggagaauugcuugaacucagaaggcggaggcugcagugagccgagaucgu

SEQ ID NO: 234487 - RNA, 64 nt, hsa
ggcucaugccuguaauccagcacuuugggaggccaaggcggacagaccaccugaggucaggagu

SEQ ID NO: 234488 - RNA, 64 nt, hsa
cuccagccguuggaaucgcugaagauggcaaugaaaggcggagggaugaugggcucucucugug

SEQ ID NO: 234489 - RNA, 64 nt, hsa
uccccccuaucaggugguuuuggagaaaacaaggaaggcggaagaauggagugcaauuguguga

SEQ ID NO: 234490 - RNA, 64 nt, hsa
uaacaguuuaccacuaugcuugauuauaaugugaaaggcggaauucugaguguguuaagauggu

SEQ ID NO: 234491 - RNA, 64 nt, hsa
gcucacgccuguaaucccagcacuuuaagaggccaaggcggauggaucacuugagcccaggagu

SEQ ID NO: 234492 - RNA, 64 nt, hsa
gggaggcugaggcaggagaaucgcuugaacccagaaggcggaaguugcagugagcugagauugc

SEQ ID NO: 234493 - RNA, 64 nt, hsa
auggaguggggucccauggugcaggucucugagcaaggcggagguguggaggagaggccggcuu

SEQ ID NO: 234494 - RNA, 64 nt, hsa
guaaagacuaaaaggcguuugcucugagacugacaaggcggaaacuuccaugugucuccugcca

SEQ ID NO: 234495 - RNA, 64 nt, hsa
agauaguugcccacuugggcaaaaacgcaugcagaaggcggaguuuuuaaauuuaaaacauuuu

SEQ ID NO: 234496 - RNA, 64 nt, hsa
gauuccccauccaucucauugucuaaauauuuagaaggcggagaaguucccagaggcuucugua

SEQ ID NO: 234497 - RNA, 64 nt, hsa
ccaguaggcugcagaccagggacauggguuaguuaaggcggagguacgaggccgacccggggag

SEQ ID NO: 234498 - RNA, 64 nt, hsa
cuuaaagcccaaccuuaggaauauagugccccaaaaggcggaugcuucuuccauuaucuuauuu

SEQ ID NO: 234499 - RNA, 64 nt, hsa
guugacuuguuggcugccaguaggggcgggaggaaaggcggaggcgagcccuggaggagggagg

SEQ ID NO: 234500 - RNA, 64 nt, hsa
cagggagggggcugggaaagaacuuggacuucuaaaggcggagggucucccugggcacccugca

SEQ ID NO: 234501 - RNA, 64 nt, hsa
ugaaagagaagcugcugcgugagcagagaccaagaaggcggagguuaguugagggagagcagug

SEQ ID NO: 234502 - RNA, 64 nt, hsa
caggcauccuucccuuuauagauugauuccagcaaaggcggaauaaaacaaauuuccuaugaag

SEQ ID NO: 234503 - RNA, 64 nt, hsa
caggggaacccaacaguccuaugucaucuaagagaaggcggaaugcuacuaucauucacgaugg

SEQ ID NO: 234504 - RNA, 64 nt, hsa
gucccaggagaugacaggaaggaagcaccagggcaaggcggacgcucacccugugaccacgaug

SEQ ID NO: 234505 - RNA, 64 nt, hsa
aggggaguuuccucugcucacaguucuuaccuucaaggcggaucugggcuuccacccucaugaa

SEQ ID NO: 234506 - RNA, 64 nt, hsa
uuucugcugcucagccugccugcaacucaccucgaaggcggaccagccugccucugugaugacu

SEQ ID NO: 234507 - RNA, 64 nt, hsa
cgcccacccuggggagagacuuuugcggggagggaaggcggagcugaggacagccagcuccgcc

SEQ ID NO: 234508 - RNA, 64 nt, hsa
acgacccagccagacccucgcggagauggugcagaaggcggagcgggugagcggccgugcgucc

SEQ ID NO: 234509 - RNA, 64 nt, hsa; identical to SEQ ID NO: 129516

SEQ ID NO: 234510 - RNA, 64 nt, hsa; identical to SEQ ID NO: 129517

SEQ ID NO: 234511 - RNA, 64 nt, hsa; identical to SEQ ID NO: 129518

SEQ ID NO: 234512 - RNA, 64 nt, hsa; identical to SEQ ID NO: 129519

SEQ ID NO: 234513 - RNA, 64 nt, hsa; identical to SEQ ID NO: 129520

SEQ ID NO: 234514 - RNA, 64 nt, hsa; identical to SEQ ID NO: 129521

SEQ ID NO: 234515 - RNA, 64 nt, hsa; identical to SEQ ID NO: 129522

SEQ ID NO: 234516 - RNA, 64 nt, hsa; identical to SEQ ID NO: 129523

SEQ ID NO: 234517 - RNA, 64 nt, hsa; identical to SEQ ID NO: 129524

SEQ ID NO: 234518 - RNA, 64 nt, hsa; identical to SEQ ID NO: 129525

SEQ ID NO: 234519 - RNA, 59 nt, hsa; identical to SEQ ID NO: 129526

SEQ ID NO: 234520 - RNA, 64 nt, hsa; identical to SEQ ID NO: 129527

SEQ ID NO: 234521 - RNA, 64 nt, hsa; identical to SEQ ID NO: 129528

SEQ ID NO: 234522 - RNA, 64 nt, hsa; identical to SEQ ID NO: 129529

SEQ ID NO: 234523 - RNA, 64 nt, hsa; identical to SEQ ID NO: 129530

SEQ ID NO: 234524 - RNA, 64 nt, hsa; identical to SEQ ID NO: 129531

SEQ ID NO: 234525 - RNA, 64 nt, hsa; identical to SEQ ID NO: 129532

SEQ ID NO: 234526 - RNA, 53 nt, hsa; identical to SEQ ID NO: 129533

SEQ ID NO: 234527 - RNA, 64 nt, hsa; identical to SEQ ID NO: 129534

SEQ ID NO: 234528 - RNA, 64 nt, hsa; identical to SEQ ID NO: 129535

SEQ ID NO: 234529 - RNA, 64 nt, hsa; identical to SEQ ID NO: 129536

SEQ ID NO: 234530 - RNA, 64 nt, hsa; identical to SEQ ID NO: 129537

SEQ ID NO: 234531 - RNA, 64 nt, hsa; identical to SEQ ID NO: 129538

SEQ ID NO: 234532 - RNA, 64 nt, hsa; identical to SEQ ID NO: 129539

SEQ ID NO: 234533 - RNA, 64 nt, hsa; identical to SEQ ID NO: 129540

SEQ ID NO: 234534 - RNA, 64 nt, hsa; identical to SEQ ID NO: 129541

SEQ ID NO: 234535 - RNA, 64 nt, hsa; identical to SEQ ID NO: 129542

SEQ ID NO: 234536 - RNA, 64 nt, hsa; identical to SEQ ID NO: 129543

SEQ ID NO: 234537 - RNA, 64 nt, hsa; identical to SEQ ID NO: 129544

SEQ ID NO: 234538 - RNA, 64 nt, hsa; identical to SEQ ID NO: 129545

SEQ ID NO: 234539 - RNA, 64 nt, hsa; identical to SEQ ID NO: 129546

SEQ ID NO: 234540 - RNA, 64 nt, hsa; identical to SEQ ID NO: 129547

SEQ ID NO: 234541 - RNA, 64 nt, hsa; identical to SEQ ID NO: 129548

SEQ ID NO: 234542 - RNA, 64 nt, hsa; identical to SEQ ID NO: 129549

SEQ ID NO: 234543 - RNA, 64 nt, hsa; identical to SEQ ID NO: 129550

SEQ ID NO: 234544 - RNA, 64 nt, hsa; identical to SEQ ID NO: 129551

SEQ ID NO: 234545 - RNA, 64 nt, hsa; identical to SEQ ID NO: 129552

SEQ ID NO: 234546 - RNA, 64 nt, hsa; identical to SEQ ID NO: 129553

SEQ ID NO: 234547 - RNA, 64 nt, hsa; identical to SEQ ID NO: 129554

SEQ ID NO: 234548 - RNA, 64 nt, hsa; identical to SEQ ID NO: 129555

SEQ ID NO: 234549 - RNA, 64 nt, hsa; identical to SEQ ID NO: 129556

SEQ ID NO: 234550 - RNA, 64 nt, hsa; identical to SEQ ID NO: 129557

SEQ ID NO: 234551 - RNA, 64 nt, hsa
aaguaacugggacuauagcaugccaccacacccagcugauuaucauauuuuuuuuuguagaggu

SEQ ID NO: 234552 - RNA, 64 nt, hsa; identical to SEQ ID NO: 234551

SEQ ID NO: 234553 - RNA, 64 nt, hsa
cuagucucuucucuacauggugaugcauuucagcaauuauaaauuaauauaaaugaccaaaagu

SEQ ID NO: 234554 - RNA, 64 nt, hsa
gauauuugcuauuucauucauugggcacauaucaaauuauaauuuugauuuuaaauggucaccc

SEQ ID NO: 234555 - RNA, 64 nt, hsa
aaaacauuggaaaguuaagagaguucgagggaagaauuauaaagacuaggaguccuagaaagag

SEQ ID NO: 234556 - RNA, 64 nt, hsa
cauaaguaaauuuaaacuguuguuuguauaaaacaauuauaaugaaguguuuauaagaaauugu

SEQ ID NO: 234557 - RNA, 64 nt, hsa
uaaucacaguaggucugauagagaauuggagcuaaauuauaauauuuuuguugguaaaguugag

SEQ ID NO: 234558 - RNA, 64 nt, hsa
uuaaauaauuuaagucuagcauuuacuuuuaaauaauuauaaugaaguuuugaaauacuaaguu

SEQ ID NO: 234559 - RNA, 64 nt, hsa
ugauuuuuauuaaaaaccuggacagaaaauuauaaauuauaaauaugacuuuauccuggcuaua

SEQ ID NO: 234560 - RNA, 64 nt, hsa
acauuacugauuuuuauuaaaaaccuggacagaaaauuauaaauuauaaauaugacuuuauccu

SEQ ID NO: 234561 - RNA, 64 nt, hsa
aaaaaaauucugcuguguaauucuugccaguuaaaauuauaacuugcaaaugagcagaauaaau

SEQ ID NO: 234562 - RNA, 64 nt, hsa
uaaguggggggaaggggguggagggggugguaauaauuauaacugaaagguuuaaauauacuac

SEQ ID NO: 234563 - RNA, 64 nt, hsa
gaaaauacucugggaauagucauacugacaaaccaauuauaagugagaauacuguuuuccuuag

SEQ ID NO: 234564 - RNA, 64 nt, hsa
aaaccucagugauuacaauugaggaaaaagucaaaauuauaaaauaccuuuaaagacaugcacu

SEQ ID NO: 234565 - RNA, 64 nt, hsa
uguugauaauagaucaucuuguauauacuucugcaauuauaagauguuuuuugaugaugaaagc

SEQ ID NO: 234566 - RNA, 64 nt, hsa
ucuuuccugaguuugguucagauggucugucacuaauuauaaggcagauaggaacagacagaaa

SEQ ID NO: 234567 - RNA, 64 nt, hsa
uuuguacagguuauuuaauagcuuuguuaaagauaauuauaauaauuauaacauuaauaaaaau

SEQ ID NO: 234568 - RNA, 64 nt, hsa
guuauuuaauagcuuuguuaaagauaauuauaauaauuauaacauuaauaaaaauguugcuuuu

SEQ ID NO: 234569 - RNA, 64 nt, hsa
cuccaccccacaacccaaaagguuuaagaaauagaauuauaacuguaaagauguuuauuucagg

SEQ ID NO: 234570 - RNA, 64 nt, hsa
uaacacagcauuguauaugugaagcaaacucuaaaauuauaaaugacaaccugaauuaucuauu

SEQ ID NO: 234571 - RNA, 64 nt, hsa
guuguuguuuuugagcuggcuguauauauuuuaaaauuauaaauagauaauauauuauuuuuug

SEQ ID NO: 234572 - RNA, 64 nt, hsa
aauguaguaaacuauucuaaguuuucauucuuugaauuauaaauggccucagcaguuuugcuca

SEQ ID NO: 234573 - RNA, 64 nt, hsa
aaaaugaguaacagaguccacggcgugcaaugguaauuauaaauuggugaugcuuguuugcaaa

SEQ ID NO: 234574 - RNA, 64 nt, hsa
cauuaagauaugauucauguaacaauguuaaauuaauuauaaugggauuggguuuguuaucugu

SEQ ID NO: 234575 - RNA, 64 nt, hsa
agcacuggcuucuauauuuuauuucauauuuaugaauuauaaauaugaauuuaauuacuaaaga

SEQ ID NO: 234576 - RNA, 64 nt, hsa
auguacuguuuagaaauauacauauuuuauacaaaauuauaaagaaagcauagagagguaagca

SEQ ID NO: 234577 - RNA, 64 nt, hsa
aauagaaaugggaggccucugauggaccuucuagaauuauaagucacaaagaguucuggaaaag

SEQ ID NO: 234578 - RNA, 64 nt, hsa
ggugaagagccagaagugaagagugacuaguacaaauuauaaaaagccacuagacucuucacug

SEQ ID NO: 234579 - RNA, 64 nt, hsa
uuauacaaauagauugcuuagaaugguucucaagaauuauaagagaaaugaacucacaguacaa

SEQ ID NO: 234580 - RNA, 64 nt, hsa
auaagaaagacuuuuugcccaagacagugaaaguaauuauaaaaacaagcuuugaccacuuacc

SEQ ID NO: 234581 - RNA, 64 nt, hsa
uauaauguaauuauaacagggauuuauaagagggaauuauaagagggauuaugaaagggaauua

SEQ ID NO: 234582 - RNA, 64 nt, hsa
aauguuuaaccaaagaaaguuguucuuauaauguaauuauaacagggauuuauaagagggaauu

SEQ ID NO: 234583 - RNA, 64 nt, hsa
aacagcaaaacaauaauuuuuucaacaaauuguaaauuauaagaaaaagaguugguuuguguac

SEQ ID NO: 234584 - RNA, 64 nt, hsa
ucucuuuuaaaaaguacauuuauagauugaucagaauuauaaccauggagaauuuuuucuucug

SEQ ID NO: 234585 - RNA, 64 nt, hsa
aaaaaagcucucuugaaucuagguagcaugaacaaauuauaaaauuuguuuaaaaaagcaaacu

SEQ ID NO: 234586 - RNA, 64 nt, hsa
aucgcacaagugguuuauggaguguuuggauuguaauuauaaaugguucuuugauaugcaaauu

SEQ ID NO: 234587 - RNA, 64 nt, hsa
guaauagcuacguuugggaaggaggaaacauuuaaauuauaaaggacugaauaaucuaaaaagc

SEQ ID NO: 234588 - RNA, 64 nt, hsa
uaucuuauuaccuauaacuauuaauuuuucauagaauuauaaaugucauuugacuaugucaauc

SEQ ID NO: 234589 - RNA, 64 nt, hsa
gaaaaucauuccaaauaagaguuuaauuuuuauuaauuauaaaaaacucuguauuaguuuccua

SEQ ID NO: 234590 - RNA, 64 nt, hsa
uuucuuaauucuuacaauggugauaaguuacuucaauuauaaaauugaauuuugcagacuaaau

SEQ ID NO: 234591 - RNA, 64 nt, hsa
ucuguauuuuuuuucccuguuggagaaagugggaaauuauaaugucgaacucugaaacaaaagu

SEQ ID NO: 234592 - RNA, 64 nt, hsa
aggaaacuuuuuuuguuugcucuugcauugcaaaaauuauaaaguaauuuauuauuuauugucg

SEQ ID NO: 234593 - RNA, 64 nt, hsa
uucuauugacauccuuuuguuuucuaauuuuaaaaauuauaaagauguaaauggaauuauaaau

SEQ ID NO: 234594 - RNA, 64 nt, hsa
uuucuaauuuuaaaaauuauaaagauguaaauggaauuauaaauacugugaccuaagaaaagac

SEQ ID NO: 234595 - RNA, 64 nt, hsa
ucuuccagguaccccauguaccuuuauugagcuuaauuauaauacugucaaauugccacgaucu

SEQ ID NO: 234596 - RNA, 64 nt, hsa
ccuguaccuuuccuucccauuaggacauccuuuaaauuauaagcauccuuuuugaaaagagcua

SEQ ID NO: 234597 - RNA, 64 nt, hsa
uguuugagagacauguaaguugaaaguuuugcuaaauuauaaagcuccuuuaauucguugguuu

SEQ ID NO: 234598 - RNA, 64 nt, hsa
cucugacacaucugaaaaaguaaucugaugugcaaauuauaauuuaaauauguuaauuuuuuug

SEQ ID NO: 234599 - RNA, 64 nt, hsa
uuuacaagcaugaaggauauuaggguaaguggcuaauuauaaaucuacucuagagacauauaau

SEQ ID NO: 234600 - RNA, 64 nt, hsa
ggcaagauacaauuauaugcguuccucuuccugaaauuauaacauuucuaaacuuacccacgua

SEQ ID NO: 234601 - RNA, 64 nt, hsa
uuuggccccacaaauacuuuaagcaaaucauuaaaauuauaacaguuaaugguuuggggguguu

SEQ ID NO: 234602 - RNA, 64 nt, hsa
gauuauagcuuuuauaugccuuuuuauauucugaaauuauaacaaaagauacuuucuaacagua

SEQ ID NO: 234603 - RNA, 64 nt, hsa
uacaguuuugcuuuaaccacugaagauugcuguaaauuauaaagggugugauagaauccacaug

SEQ ID NO: 234604 - RNA, 64 nt, hsa
augucuauaguuuuggccuuaacuaugccaaucuaauuauaauucccuguauuuaaaaugguuu

SEQ ID NO: 234605 - RNA, 64 nt, hsa
auauuuuauuuuuuaguuauuugugucaaauuauaauuauaaaagguacagcagaaaauauacc

SEQ ID NO: 234606 - RNA, 64 nt, hsa
uagggaauauuuuauuuuuuaguuauuugugucaaauuauaauuauaaaagguacagcagaaaa

SEQ ID NO: 234607 - RNA, 64 nt, hsa
gaucuuaauuaaaagguaauuguagcacauuaccaauuauaaggugaagaaauguuuuuuuccc

SEQ ID NO: 234608 - RNA, 64 nt, hsa
uuagauauuuauuagauagcccugaauucacucuaauuauaaacagggaguguaaacugccccc

SEQ ID NO: 234609 - RNA, 64 nt, hsa
augacauucguucacaauagcacuauuuuaaauaaauuauaagcuuuaagguacgaaguauuua

SEQ ID NO: 234610 - RNA, 64 nt, hsa
auauguugauucauggcuauaauaaagcaggagcaauuauaaaaucuucaaucaauugaacuuu

SEQ ID NO: 234611 - RNA, 64 nt, hsa
auaaauuccuuugaaacuauaagucuuugaggaaaauuauaagguaaaauuuuccuguuuuucc

SEQ ID NO: 234612 - RNA, 64 nt, hsa
gugaugaaaaacaaaaaauugcaaguaguaugcaaauuauaaauauacagucuucccacuucac

SEQ ID NO: 234613 - RNA, 64 nt, hsa
gcaagaaaugauacauaaucauucucuuuaagacaauuauaaauuggauggagcuauuauucac

SEQ ID NO: 234614 - RNA, 64 nt, hsa
agcuauuauucacuacuucuuuucuuaguuugaaaauuauaaacaaauuuuaagcuuuauucaa

SEQ ID NO: 234615 - RNA, 64 nt, hsa
caaauccaaaauuauuuucaaaucaagauguuuaaauuauaaguuuuuuuguuuuguuuuccag

SEQ ID NO: 234616 - RNA, 64 nt, hsa
aauguauguaacuaaagcuuuguccucugugaagaauuauaaaagggaggggggaaaggauucg

SEQ ID NO: 234617 - RNA, 64 nt, hsa
auauuucaauugugaauucacauagaaaacauuaaauuauaauguuugacuauuauauaugugu

SEQ ID NO: 234618 - RNA, 64 nt, hsa
auuuauggaggauuuuuuugccccuuguguuuggaauuauaaaauauagguaaaaguacguaau

SEQ ID NO: 234619 - RNA, 64 nt, hsa
cuuuugugauuuaauaauacuauuucuguggaauaauuauaaaaguaugaccuuuuuaaaucaa

SEQ ID NO: 234620 - RNA, 64 nt, hsa
uauuauuauuucagaacuagcucagcccaucucuaauuauaaaacaugguuuuguuuuuuuuuu

SEQ ID NO: 234621 - RNA, 64 nt, hsa
aauaaauacagaaaagucauaugguugaauaaauaauuauaaauugagcacugauggaaucccu

SEQ ID NO: 234622 - RNA, 64 nt, hsa
ugaccauuagaauagucauaccuggaaugugucaaauuauaagagacagacacuugguuagugg

SEQ ID NO: 234623 - RNA, 64 nt, hsa
ccauuugcaauauggauuucuuagagauuaaaccaauuauaacuuauuagcagucgcgagcaca

SEQ ID NO: 234624 - RNA, 64 nt, hsa
uacuuaaauuugguuuguuaauucuuauuuuagaaauuauaauuuuaguuuauauuaauuucgg

SEQ ID NO: 234625 - RNA, 64 nt, hsa
cugugauaacuacuuuuuauacuuuaucccauuuaauuauaaaaaccacucuugagaaguaauu

SEQ ID NO: 234626 - RNA, 64 nt, hsa
auaaaaacaguguuuuauagugaaaucuaagguuaauuauaaucuuuccuuauuucaacaagau

SEQ ID NO: 234627 - RNA, 64 nt, hsa
acaacagaaaugcuccuggaacuucaaguugcugaauuauaaguuuauuuuuuaucaauaaaua

SEQ ID NO: 234628 - RNA, 64 nt, hsa
uauauuuuuacauaaaagcuugaacauacagaugaauuauaaccuaugugaagaaaucuuagau

SEQ ID NO: 234629 - RNA, 64 nt, hsa
gcucaaaaagauuuggcuuaguguuuucauugcaaauuauaauugcuguagagccacacacaac

SEQ ID NO: 234630 - RNA, 64 nt, hsa
uugcuguagagccacacacaacuuuugaacuuuuaauuauaaguguuauggcuaaaguuauuua

SEQ ID NO: 234631 - RNA, 64 nt, hsa
uuaaauuuugacuguacuaacuauaaauguaaugaauuauaauaauuauaaaugguauaaaugc

SEQ ID NO: 234632 - RNA, 64 nt, hsa
gacuguacuaacuauaaauguaaugaauuauaauaauuauaaaugguauaaaugcauucuacaa

SEQ ID NO: 234633 - RNA, 64 nt, hsa
cuuuuaauaauuauaaaauuaauaauuucuugauaauuauaaaaaugaagugucaaaaaaucuc

SEQ ID NO: 234634 - RNA, 64 nt, hsa
gaugcaaagccugaagacacugguagcuuuuaauaauuauaaaauuaauaauuucuugauaauu

SEQ ID NO: 234635 - RNA, 64 nt, hsa
augaauuuggaaaaacauuuuuucaaaaacuacaaauuauaaaacaccaaaguguucauacuaa

SEQ ID NO: 234636 - RNA, 64 nt, hsa
guacuucuaugaaauaauaugcagucuauuuuuaaauuauaaauuaugugugaacuuagcuuuu

SEQ ID NO: 234637 - RNA, 64 nt, hsa
ugcgugucucaguaaaaauuauaaaaugggggauaauuauaauaccuaccucauaaugcuuugu

SEQ ID NO: 234638 - RNA, 64 nt, hsa
uuucuguucauauauacaugcgugucucaguaaaaauuauaaaaugggggauaauuauaauacc

SEQ ID NO: 234639 - RNA, 64 nt, hsa
cagagaaacuuuaugcauauuaaaaauguaauguaauuauaagcgauuccccucaacaauccag

SEQ ID NO: 234640 - RNA, 64 nt, hsa
guuuugccuauaccauccugauuuuugaaaagugaauuauaaacacaaaauuguuaguguuuau

SEQ ID NO: 234641 - RNA, 64 nt, hsa
uuuacuuuuuggguccagaaugacuuucuccaagaauuauaagaugaaaauuauauauuuugcc

SEQ ID NO: 234642 - RNA, 64 nt, hsa
uaaucagaauuuuaaauguucauguuacauaccaaauuauaauaucuaauggagcaauuugucu

SEQ ID NO: 234643 - RNA, 64 nt, hsa
ucugauacaaaaugagggccucugcucuugauuuaauuauaaaaugucuacgucuuucuccagu

SEQ ID NO: 234644 - RNA, 64 nt, hsa
uuucuaaucauacuuaauccacacuaaugugcgcaauuauaauaaaugguaagauaucacaugu

SEQ ID NO: 234645 - RNA, 64 nt, hsa
aaagcugugcagucaggcacccuggcugagcuagagaagccaguaccugcaucuugguuuauaa

SEQ ID NO: 234646 - RNA, 64 nt, hsa
ggagagaagauggcuuaguguuuagacuguuaguagaagccaucuggaagcuuuucucuuugcc

SEQ ID NO: 234647 - RNA, 64 nt, hsa
caccagccccucccucugaagaaguauuauguucagaagccaacaaaacaguuuguugccagac

SEQ ID NO: 234648 - RNA, 64 nt, hsa
cuucuaacccaggaccaugaacucaggugccuagagaagccaggcagcuaaaggacaaggaaug

SEQ ID NO: 234649 - RNA, 64 nt, hsa
cccuccuagauggcuacauugacuucagguggagagaagccaaacaaagacuuggagagcugca

SEQ ID NO: 234650 - RNA, 64 nt, hsa
auuuauuguauucugggguauggcguaaguacagagaagccaucaccucagauggcagcuuuua

SEQ ID NO: 234651 - RNA, 64 nt, hsa
cauggagaaagcugacuuggcuggugugguacagagaagccagcuuguuuacaugcuuauucca

SEQ ID NO: 234652 - RNA, 64 nt, hsa
caguggugccaggcagcuugccacuugggagggcagaagccaggaauuccacacccuuguguug

SEQ ID NO: 234653 - RNA, 64 nt, hsa
ugacacagaagauugccuuacgcucgugagcgugagaagccauaagagagagaccgaauucugu

SEQ ID NO: 234654 - RNA, 64 nt, hsa
uccuggugaagagcaaagcagaagaaaugacagcagaagccauggcacagacuuguauagagga

SEQ ID NO: 234655 - RNA, 64 nt, hsa
gaagagaggcucugaaagaaaggaggggagcagcagaagccacggcagggaggaaaggagccgg

SEQ ID NO: 234656 - RNA, 64 nt, hsa
guuggugagagcaggaggagagguggggacagcaagaagccacagauuggcaugaaggauccug

SEQ ID NO: 234657 - RNA, 64 nt, hsa
agacacagcugcuacgugauagauguugagagacagaagccaacgaaggaggucauucaucaac

SEQ ID NO: 234658 - RNA, 64 nt, hsa
aucccugggagccucacguauuuuagaagccaagagaagccacauggagacucaaauucgcauc

SEQ ID NO: 234659 - RNA, 64 nt, hsa
agguucccugaucccugggagccucacguauuuuagaagccaagagaagccacauggagacuca

SEQ ID NO: 234660 - RNA, 64 nt, hsa
aggggccaacuagggccagguggaaggggagcugagaagccaaccccuagcccaggggugcugu

SEQ ID NO: 234661 - RNA, 64 nt, hsa
ugccagggguccugaaaaccaaaggaggagcagcagaagccauaggcuccccagcuuucuccag

SEQ ID NO: 234662 - RNA, 64 nt, hsa
ccgggugguauuuuauugcucugcaaagauguccagaagccauguauauaauguuuuuuaaaca

SEQ ID NO: 234663 - RNA, 64 nt, hsa
cccccaguacugcagaucucacaguuugccuuccagaagccagccuaucucuagcccaugguuu

SEQ ID NO: 234664 - RNA, 64 nt, hsa
ucuuccaagggcagugcuccaaggcagggacuggagaagccaaggggagagucuaaaagggcua

SEQ ID NO: 234665 - RNA, 64 nt, hsa
augcuggcaggaacaacuauuaauacagauacucagaagccaauaacaugacaggagcugggac

SEQ ID NO: 234666 - RNA, 63 nt, hsa
uggugguauguacaagaugagagcgagccuuucagaagccagggucugguccuggcuccucuu

SEQ ID NO: 234667 - RNA, 64 nt, hsa
auggaagugccuuuugaugucuuacaauaagagaagaagccaauggaaaugaaagagauuggca

SEQ ID NO: 234668 - RNA, 64 nt, hsa
auugguccuagaacuuccaaaggcugcuugucauagaagccauugcaucuauaaagcaacggcu

SEQ ID NO: 234669 - RNA, 64 nt, hsa
cccaccccaccucaccccaacaaacuccucuagaagaagccaagaauuucucucuaugucuguu

SEQ ID NO: 234670 - RNA, 64 nt, hsa
ugagacaaauccuaggcuccugggaggcccuggcagaagccagaacacauggcugggccuuucc

SEQ ID NO: 234671 - RNA, 64 nt, hsa
cauauccuucaucagguguuuuaagaugucucugagaagccaucaaggcaaaagagaacuuuaa

SEQ ID NO: 234672 - RNA, 64 nt, hsa
cccugaaacacacacauuucccccuuccuuucccagaagccacuggccccccauagcacccagu

SEQ ID NO: 234673 - RNA, 64 nt, hsa
aggugugagaaacagaguuauuaaguaaguugccagaagccauacaaguacaaagugucaaggg

SEQ ID NO: 234674 - RNA, 64 nt, hsa
agaugucuaauuccacaugucagaagauuauuccagaagccagcaguauuucaguaucacagug

SEQ ID NO: 234675 - RNA, 64 nt, hsa
gaagaagaugagagaccugcaaauccagcgccacagaagccaggugaccagggacccgcgggcu

SEQ ID NO: 234676 - RNA, 64 nt, hsa
aacaugcaggcugguggugauggguucuguguggagaagccaaacaauaaaacaaccuaguggg

SEQ ID NO: 234677 - RNA, 64 nt, hsa
agauagaucuuggaaggagagauccauugaguccagaagccagaucagcaaauggaggaaccuc

SEQ ID NO: 234678 - RNA, 64 nt, hsa
aguacuguggcagagcugcuguuuucugaaggugagaagccauuuuuagcucagagcaacccuu

SEQ ID NO: 234679 - RNA, 64 nt, hsa
ucucugacagccaagacauggagcaucucugcuaagaagccaaaagaaauugguuuucuucuuc

SEQ ID NO: 234680 - RNA, 64 nt, hsa
cacagccagauuucagcuuugaguuauucccugaagaagccacaccaaccuugcuuucaagcaa

SEQ ID NO: 234681 - RNA, 64 nt, hsa
gcauucagaaacugcaggagacaagaugaauuugagaagccaaauggaauuuuuaauggaaacc

SEQ ID NO: 234682 - RNA, 64 nt, hsa
cgacugugcuuguccauuauuuuacacaugcccuagaagccaaaacugaaagccacuggauccu

SEQ ID NO: 234683 - RNA, 64 nt, hsa
uccaucuuuggggguggaaggacuugacaugaaaagaagccagucccaugacuuuggaugacaa

SEQ ID NO: 234684 - RNA, 64 nt, hsa
ugcucccacggcagcaccaucaacucaacaagucagaagccaaguggaucaucuguguccccuu

SEQ ID NO: 234685 - RNA, 64 nt, hsa
agacccucacugaauaagaguauuuucagucaucagaagccagcuguugguaggcauuaaugag

SEQ ID NO: 234686 - RNA, 64 nt, hsa
uaacccugugaacacccaagccaggaguucuaugagaagccaaauggugcucgcaauugugcuu

SEQ ID NO: 234687 - RNA, 64 nt, hsa
uaacuuucacauuccuaagcuggcuucccggcacagaagccauggauuuccccucucucccuuc

SEQ ID NO: 234688 - RNA, 64 nt, hsa
uauuaaucacguaucgcagggcuccagcuguuuuagaagccacaucauguuaaacauuaacugg

SEQ ID NO: 234689 - RNA, 64 nt, hsa
uguugacccaagggccgugguccacgguacuugaagaagccagagcccacauccugugcacugc

SEQ ID NO: 234690 - RNA, 64 nt, hsa
ggaccgucacucagacugagacuugaguuauuacagaagccaggaaaaguguauuagaaacugu

SEQ ID NO: 234691 - RNA, 64 nt, hsa
guaagccuaguugcugaaauuuccugcuguauccagaagccaguuuuaucuaacggcuacugaa

SEQ ID NO: 234692 - RNA, 64 nt, hsa
aucaaucuugaaauacucaaccaaaagacagucgagaagccagggggagaaagaacucagggca

SEQ ID NO: 234693 - RNA, 64 nt, hsa
cuuugccuuuugcacacgcaccuggaaaagacacagaagccaaccugagaaccccuggugcuau

SEQ ID NO: 234694 - RNA, 64 nt, hsa
ugauguuucggacugaccuaaaaacuaauugucgagaagccaagggugaggaggcaggaagcac

SEQ ID NO: 234695 - RNA, 64 nt, hsa
ggacuugaccgaggucccacuucuguuucgaggcagaagccagacuaauuuucaugccuccuga

SEQ ID NO: 234696 - RNA, 64 nt, hsa
ugagaaucugagggugaugucuggccgcuggucaagaagccaacagucauguggcucgcagaug

SEQ ID NO: 234697 - RNA, 63 nt, hsa
cauucagagguguggcuuuuuccacgucuuuuucuccugcaaugaacugcucccacguccugc

SEQ ID NO: 234698 - RNA, 63 nt, hsa
uggguggguggguuugauugagaacacuuugggcuccugcagugauggugggaaagaaaaauu

SEQ ID NO: 234699 - RNA, 63 nt, hsa
cggcugcagaggccagaggcccccagcccagggcuccugcacuuacuugcuuauuugacaacg

SEQ ID NO: 234700 - RNA, 63 nt, hsa
gacuguagggagggcggcaggggccuggagauccuccugcagaccacgcccguccugccugug

SEQ ID NO: 234701 - RNA, 63 nt, hsa
ucacaggaagacuuuguaaggacaguuuaaguucuccugcaagguuuaauuuguuaucaugua

SEQ ID NO: 234702 - RNA, 63 nt, hsa
accaacagucugucaguguacagcagcaguacucuccugcacagucucaagcaaccauauauu

SEQ ID NO: 234703 - RNA, 63 nt, hsa
agggagcuguauuccuuuauacaaaucugauggcuccugcagcacuuuuuccuucugaaaaua

SEQ ID NO: 234704 - RNA, 63 nt, hsa
gaaaaaagcaagauugaaauuugaacuaugagucuccugcauggcaacaaaaugugugucacc

SEQ ID NO: 234705 - RNA, 63 nt, hsa
guccucuguccgucuguccugcgccugcgccuccuccugcaugucggggccccugcguguguu

SEQ ID NO: 234706 - RNA, 63 nt, hsa
gggcggggcgagggcggcggggccugggucccccuccugcacgcggacuccgggguucggauc

SEQ ID NO: 234707 - RNA, 63 nt, hsa
gccaggaccgagcucuuccugcuguuugccggccuccugcagagguaccgccugcugcccccg

SEQ ID NO: 234708 - RNA, 63 nt, hsa
gcgugcgagcccugcaccccccagguccugggacuccugcagaccccacuccauucccgcucc

SEQ ID NO: 234709 - RNA, 63 nt, hsa
aaaauucgcugggaggccaauaggcugaaauggcuccugcacuuuggguuccuaagucagcaa

SEQ ID NO: 234710 - RNA, 63 nt, hsa
aguauaacugauaugauaugaagggggacuuaucuccugcagagauuggagaagguagaggag

SEQ ID NO: 234711 - RNA, 63 nt, hsa
ggaucccagcaucucagaguccagucaaguucccuccugcagccugaccccaggcagcucgag

SEQ ID NO: 234712 - RNA, 63 nt, hsa
acagcuuccugagucaccccucuguccagccagcuccugcacaaauggaacuccccagggccu

SEQ ID NO: 234713 - RNA, 63 nt, hsa
ccucccgucugugagcucccugcccagcaccaccuccugcacugcacuucugccguccacauc

SEQ ID NO: 234714 - RNA, 63 nt, hsa
acagaacuccacauauacaacuuccgucauuaccuccugcagucugacaagcucaucacugaa

SEQ ID NO: 234715 - RNA, 63 nt, hsa
aaucaaacucaaccaggaggcaugauuccuucucuccugcaauugcacaaaaacaaguggugg

SEQ ID NO: 234716 - RNA, 63 nt, hsa
cucacacaugaucuucagagugcuggaaacacacuccugcagaagcuguaggacucuugaauu

SEQ ID NO: 234717 - RNA, 63 nt, hsa
cagccgggcucucuaguggugauccggcucauucuccugcaaguuggaagcacaauuuucccc

SEQ ID NO: 234718 - RNA, 63 nt, hsa
gggcaaggcgguggguggugggcaaggugggaccuccugcagccuggaaagaggagggaggcc

SEQ ID NO: 234719 - RNA, 63 nt, hsa
cauauguacauguacccaccacaaacgugcaagcuccugcacacaugcaugcacacaaacgug

SEQ ID NO: 234720 - RNA, 63 nt, hsa
cacgcacacguacauucacuacaaacgugcagccuccugcacacgugcacauucauguguaca

SEQ ID NO: 234721 - RNA, 63 nt, hsa
ugcacauguacgcaccacaaacacaugcgcaggcuccugcaggcgugaauacacacaugcaca

SEQ ID NO: 234722 - RNA, 63 nt, hsa
ucuccucuccccuccuucccccaccacaggucucuccugcauaggcagccacuguccguucuu

SEQ ID NO: 234723 - RNA, 63 nt, hsa
gccaaccacggagaugugccaagcaucucaucucuccugcacacuuuagucagaaggacuucu

SEQ ID NO: 234724 - RNA, 63 nt, hsa
cugcccacguguggccuccgcuggcucugccugcuccugcaacagugcggucccugcccggag

SEQ ID NO: 234725 - RNA, 63 nt, hsa
acacaugcugucacgcauacacacacgcacauacuccugcacauguucccaugcaugugugug

SEQ ID NO: 234726 - RNA, 63 nt, hsa
uguuccucaauagcugggggcugggacugaggccuccugcagguaccugccccccuucacaca

SEQ ID NO: 234727 - RNA, 63 nt, hsa
caguccccugggugucagaaggugggcuagggccuccugcaggguugugggguggaacagggu

SEQ ID NO: 234728 - RNA, 63 nt, hsa
agcugggaucugccugaggacagagaacauggucuccugcagggcccugccucccaagccccg

SEQ ID NO: 234729 - RNA, 63 nt, hsa
uccguccacacuggccggcacccccugcugggucuccugcauuccacggagccccugcugcca

SEQ ID NO: 234730 - RNA, 63 nt, hsa
uacuccaggcuugcuucggagucauagucaucccuccugcacugcuccuuuccaaacacugua

SEQ ID NO: 234731 - RNA, 63 nt, hsa
aaaccuaccaucuguucaacuuccaccuaccaccuccugcaccccuuugaucggggacuuacu

SEQ ID NO: 234732 - RNA, 63 nt, hsa
cacagggacuaggacaucgaccacccucugccccuccugcagucagaacccgaguagugcaag

SEQ ID NO: 234733 - RNA, 63 nt, hsa
ucuugccuugggacacucuugaggcuggcagcccuccugcaaugaguugcucucaguuccuuc

SEQ ID NO: 234734 - RNA, 63 nt, hsa
acagguaacugacuguucccaccugcuccuuuucuccugcagcauggagcaaucagucaugug

SEQ ID NO: 234735 - RNA, 63 nt, hsa
uucaugucccugcggcuggccucucgccagccacuccugcagugugcguccggccgccugagc

SEQ ID NO: 234736 - RNA, 64 nt, hsa; identical to SEQ ID NO: 234645

SEQ ID NO: 234737 - RNA, 64 nt, hsa; identical to SEQ ID NO: 234646

SEQ ID NO: 234738 - RNA, 64 nt, hsa; identical to SEQ ID NO: 234647

SEQ ID NO: 234739 - RNA, 64 nt, hsa; identical to SEQ ID NO: 234648

SEQ ID NO: 234740 - RNA, 64 nt, hsa; identical to SEQ ID NO: 234649

SEQ ID NO: 234741 - RNA, 64 nt, hsa; identical to SEQ ID NO: 234650

SEQ ID NO: 234742 - RNA, 64 nt, hsa; identical to SEQ ID NO: 234651

SEQ ID NO: 234743 - RNA, 64 nt, hsa; identical to SEQ ID NO: 234652

SEQ ID NO: 234744 - RNA, 64 nt, hsa; identical to SEQ ID NO: 234653

SEQ ID NO: 234745 - RNA, 64 nt, hsa; identical to SEQ ID NO: 234654

SEQ ID NO: 234746 - RNA, 64 nt, hsa; identical to SEQ ID NO: 234655

SEQ ID NO: 234747 - RNA, 64 nt, hsa; identical to SEQ ID NO: 234656

SEQ ID NO: 234748 - RNA, 64 nt, hsa; identical to SEQ ID NO: 234657

SEQ ID NO: 234749 - RNA, 64 nt, hsa; identical to SEQ ID NO: 234658

SEQ ID NO: 234750 - RNA, 64 nt, hsa; identical to SEQ ID NO: 234659

SEQ ID NO: 234751 - RNA, 64 nt, hsa; identical to SEQ ID NO: 234660

SEQ ID NO: 234752 - RNA, 64 nt, hsa; identical to SEQ ID NO: 234661

SEQ ID NO: 234753 - RNA, 64 nt, hsa; identical to SEQ ID NO: 234662

SEQ ID NO: 234754 - RNA, 64 nt, hsa; identical to SEQ ID NO: 234663

SEQ ID NO: 234755 - RNA, 64 nt, hsa; identical to SEQ ID NO: 234664

SEQ ID NO: 234756 - RNA, 64 nt, hsa; identical to SEQ ID NO: 234665

SEQ ID NO: 234757 - RNA, 63 nt, hsa; identical to SEQ ID NO: 234666

SEQ ID NO: 234758 - RNA, 64 nt, hsa; identical to SEQ ID NO: 234667

SEQ ID NO: 234759 - RNA, 64 nt, hsa; identical to SEQ ID NO: 234668

SEQ ID NO: 234760 - RNA, 64 nt, hsa; identical to SEQ ID NO: 234669

SEQ ID NO: 234761 - RNA, 64 nt, hsa; identical to SEQ ID NO: 234670

SEQ ID NO: 234762 - RNA, 64 nt, hsa; identical to SEQ ID NO: 234671

SEQ ID NO: 234763 - RNA, 64 nt, hsa; identical to SEQ ID NO: 234672

SEQ ID NO: 234764 - RNA, 64 nt, hsa; identical to SEQ ID NO: 234673

SEQ ID NO: 234765 - RNA, 64 nt, hsa; identical to SEQ ID NO: 234674

SEQ ID NO: 234766 - RNA, 64 nt, hsa; identical to SEQ ID NO: 234675

SEQ ID NO: 234767 - RNA, 64 nt, hsa; identical to SEQ ID NO: 234676

SEQ ID NO: 234768 - RNA, 64 nt, hsa; identical to SEQ ID NO: 234677

SEQ ID NO: 234769 - RNA, 64 nt, hsa; identical to SEQ ID NO: 234678

SEQ ID NO: 234770 - RNA, 64 nt, hsa; identical to SEQ ID NO: 234679

SEQ ID NO: 234771 - RNA, 64 nt, hsa; identical to SEQ ID NO: 234680

SEQ ID NO: 234772 - RNA, 64 nt, hsa; identical to SEQ ID NO: 234681

SEQ ID NO: 234773 - RNA, 64 nt, hsa; identical to SEQ ID NO: 234682

SEQ ID NO: 234774 - RNA, 64 nt, hsa; identical to SEQ ID NO: 234683

SEQ ID NO: 234775 - RNA, 64 nt, hsa; identical to SEQ ID NO: 234684

SEQ ID NO: 234776 - RNA, 64 nt, hsa; identical to SEQ ID NO: 234685

SEQ ID NO: 234777 - RNA, 64 nt, hsa; identical to SEQ ID NO: 234686

SEQ ID NO: 234778 - RNA, 64 nt, hsa; identical to SEQ ID NO: 234687

SEQ ID NO: 234779 - RNA, 64 nt, hsa; identical to SEQ ID NO: 234688

SEQ ID NO: 234780 - RNA, 64 nt, hsa; identical to SEQ ID NO: 234689

SEQ ID NO: 234781 - RNA, 64 nt, hsa; identical to SEQ ID NO: 234690

SEQ ID NO: 234782 - RNA, 64 nt, hsa; identical to SEQ ID NO: 234691

SEQ ID NO: 234783 - RNA, 64 nt, hsa; identical to SEQ ID NO: 234692

SEQ ID NO: 234784 - RNA, 64 nt, hsa; identical to SEQ ID NO: 234693

SEQ ID NO: 234785 - RNA, 64 nt, hsa; identical to SEQ ID NO: 234694

SEQ ID NO: 234786 - RNA, 64 nt, hsa; identical to SEQ ID NO: 234695

SEQ ID NO: 234787 - RNA, 64 nt, hsa; identical to SEQ ID NO: 234696

SEQ ID NO: 234788 - RNA, 64 nt, hsa; identical to SEQ ID NO: 78063

SEQ ID NO: 234789 - RNA, 64 nt, hsa; identical to SEQ ID NO: 78064

SEQ ID NO: 234790 - RNA, 64 nt, hsa; identical to SEQ ID NO: 78065

SEQ ID NO: 234791 - RNA, 64 nt, hsa; identical to SEQ ID NO: 78066

SEQ ID NO: 234792 - RNA, 64 nt, hsa; identical to SEQ ID NO: 78067

SEQ ID NO: 234793 - RNA, 64 nt, hsa; identical to SEQ ID NO: 78068

SEQ ID NO: 234794 - RNA, 64 nt, hsa; identical to SEQ ID NO: 78069

SEQ ID NO: 234795 - RNA, 64 nt, hsa; identical to SEQ ID NO: 78070

SEQ ID NO: 234796 - RNA, 64 nt, hsa; identical to SEQ ID NO: 78071

SEQ ID NO: 234797 - RNA, 64 nt, hsa; identical to SEQ ID NO: 78072

SEQ ID NO: 234798 - RNA, 64 nt, hsa; identical to SEQ ID NO: 234645

SEQ ID NO: 234799 - RNA, 64 nt, hsa; identical to SEQ ID NO: 234646

SEQ ID NO: 234800 - RNA, 64 nt, hsa; identical to SEQ ID NO: 234647

SEQ ID NO: 234801 - RNA, 64 nt, hsa; identical to SEQ ID NO: 234648

SEQ ID NO: 234802 - RNA, 64 nt, hsa; identical to SEQ ID NO: 234649

SEQ ID NO: 234803 - RNA, 64 nt, hsa; identical to SEQ ID NO: 234650

SEQ ID NO: 234804 - RNA, 64 nt, hsa; identical to SEQ ID NO: 234651

SEQ ID NO: 234805 - RNA, 64 nt, hsa; identical to SEQ ID NO: 234652

SEQ ID NO: 234806 - RNA, 64 nt, hsa; identical to SEQ ID NO: 234653

SEQ ID NO: 234807 - RNA, 64 nt, hsa; identical to SEQ ID NO: 234654

SEQ ID NO: 234808 - RNA, 64 nt, hsa; identical to SEQ ID NO: 234655

SEQ ID NO: 234809 - RNA, 64 nt, hsa; identical to SEQ ID NO: 234656

SEQ ID NO: 234810 - RNA, 64 nt, hsa; identical to SEQ ID NO: 234657

SEQ ID NO: 234811 - RNA, 64 nt, hsa; identical to SEQ ID NO: 234658

SEQ ID NO: 234812 - RNA, 64 nt, hsa; identical to SEQ ID NO: 234659

SEQ ID NO: 234813 - RNA, 64 nt, hsa; identical to SEQ ID NO: 234660

SEQ ID NO: 234814 - RNA, 64 nt, hsa; identical to SEQ ID NO: 234661

SEQ ID NO: 234815 - RNA, 64 nt, hsa; identical to SEQ ID NO: 234662

SEQ ID NO: 234816 - RNA, 64 nt, hsa; identical to SEQ ID NO: 234663

SEQ ID NO: 234817 - RNA, 64 nt, hsa; identical to SEQ ID NO: 234664

SEQ ID NO: 234818 - RNA, 64 nt, hsa; identical to SEQ ID NO: 234665

SEQ ID NO: 234819 - RNA, 63 nt, hsa; identical to SEQ ID NO: 234666

SEQ ID NO: 234820 - RNA, 64 nt, hsa; identical to SEQ ID NO: 234667

SEQ ID NO: 234821 - RNA, 64 nt, hsa; identical to SEQ ID NO: 234668

SEQ ID NO: 234822 - RNA, 64 nt, hsa; identical to SEQ ID NO: 234669

SEQ ID NO: 234823 - RNA, 64 nt, hsa; identical to SEQ ID NO: 234670

SEQ ID NO: 234824 - RNA, 64 nt, hsa; identical to SEQ ID NO: 234671

SEQ ID NO: 234825 - RNA, 64 nt, hsa; identical to SEQ ID NO: 234672

SEQ ID NO: 234826 - RNA, 64 nt, hsa; identical to SEQ ID NO: 234673

SEQ ID NO: 234827 - RNA, 64 nt, hsa; identical to SEQ ID NO: 234674

SEQ ID NO: 234828 - RNA, 64 nt, hsa; identical to SEQ ID NO: 234675

SEQ ID NO: 234829 - RNA, 64 nt, hsa; identical to SEQ ID NO: 234676

SEQ ID NO: 234830 - RNA, 64 nt, hsa; identical to SEQ ID NO: 234677

SEQ ID NO: 234831 - RNA, 64 nt, hsa; identical to SEQ ID NO: 234678

SEQ ID NO: 234832 - RNA, 64 nt, hsa; identical to SEQ ID NO: 234679

SEQ ID NO: 234833 - RNA, 64 nt, hsa; identical to SEQ ID NO: 234680

SEQ ID NO: 234834 - RNA, 64 nt, hsa; identical to SEQ ID NO: 234681

SEQ ID NO: 234835 - RNA, 64 nt, hsa; identical to SEQ ID NO: 234682

SEQ ID NO: 234836 - RNA, 64 nt, hsa; identical to SEQ ID NO: 234683

SEQ ID NO: 234837 - RNA, 64 nt, hsa; identical to SEQ ID NO: 234684

SEQ ID NO: 234838 - RNA, 64 nt, hsa; identical to SEQ ID NO: 234685

SEQ ID NO: 234839 - RNA, 64 nt, hsa; identical to SEQ ID NO: 234686

SEQ ID NO: 234840 - RNA, 64 nt, hsa; identical to SEQ ID NO: 234687

SEQ ID NO: 234841 - RNA, 64 nt, hsa; identical to SEQ ID NO: 234688

SEQ ID NO: 234842 - RNA, 64 nt, hsa; identical to SEQ ID NO: 234689

SEQ ID NO: 234843 - RNA, 64 nt, hsa; identical to SEQ ID NO: 234690

SEQ ID NO: 234844 - RNA, 64 nt, hsa; identical to SEQ ID NO: 234691

SEQ ID NO: 234845 - RNA, 64 nt, hsa; identical to SEQ ID NO: 234692

SEQ ID NO: 234846 - RNA, 64 nt, hsa; identical to SEQ ID NO: 234693

SEQ ID NO: 234847 - RNA, 64 nt, hsa; identical to SEQ ID NO: 234694

SEQ ID NO: 234848 - RNA, 64 nt, hsa; identical to SEQ ID NO: 234695

SEQ ID NO: 234849 - RNA, 64 nt, hsa; identical to SEQ ID NO: 234696

SEQ ID NO: 234850 - RNA, 64 nt, hsa; identical to SEQ ID NO: 78063

SEQ ID NO: 234851 - RNA, 64 nt, hsa; identical to SEQ ID NO: 78064

SEQ ID NO: 234852 - RNA, 64 nt, hsa; identical to SEQ ID NO: 78065

SEQ ID NO: 234853 - RNA, 64 nt, hsa; identical to SEQ ID NO: 78066

SEQ ID NO: 234854 - RNA, 64 nt, hsa; identical to SEQ ID NO: 78067

SEQ ID NO: 234855 - RNA, 64 nt, hsa; identical to SEQ ID NO: 78068

SEQ ID NO: 234856 - RNA, 64 nt, hsa; identical to SEQ ID NO: 78069

SEQ ID NO: 234857 - RNA, 64 nt, hsa; identical to SEQ ID NO: 78070

SEQ ID NO: 234858 - RNA, 64 nt, hsa; identical to SEQ ID NO: 78071

SEQ ID NO: 234859 - RNA, 64 nt, hsa; identical to SEQ ID NO: 78072

SEQ ID NO: 234860 - RNA, 64 nt, hsa
caucuuucucuacuguaaagugauuuuguuugcagguaagaaaauaauagaugacucaccacac

SEQ ID NO: 234861 - RNA, 64 nt, hsa
guaaagcagaucuguggauggggagccuacgggugguaagaagugguguuuuguguuucaucuc

SEQ ID NO: 234862 - RNA, 64 nt, hsa
ggaagagccucccauaaaaucacaccuacucugugguaagaauaaaaucccacccaccugggac

SEQ ID NO: 234863 - RNA, 64 nt, hsa
uuccugugugggagcccauagcuguugucuaacagguaagaaaugaaauugaacuauugacugg

SEQ ID NO: 234864 - RNA, 64 nt, hsa
aucuaagaaggaauuaccuuugacaauauuuuucgguaagaaguaaaaccucuggagaccuauc

SEQ ID NO: 234865 - RNA, 64 nt, hsa
uguuaaaaggguccuuuugaagcaauuaagugcugguaagaauauuucucuguuguugccaggu

SEQ ID NO: 234866 - RNA, 64 nt, hsa
ugaaggucaagcccauagacacacacucucugcugguaagaaaccauagcccagaacugagcca

SEQ ID NO: 234867 - RNA, 64 nt, hsa
agaguuuuauugugucuauggcagguuugggaaagguaagaaauggguccuuuuuccuccuaau

SEQ ID NO: 234868 - RNA, 64 nt, hsa
ucaucuaugauaugagugagauaauuaugggagugguaagaauuaugacuugaauucuucuuug

SEQ ID NO: 234869 - RNA, 64 nt, hsa
uuuuuuuccuuuagucuuuucuuuagugggggaggguaagaaaagcaguuugcacuuaaaaaga

SEQ ID NO: 234870 - RNA, 64 nt, hsa
uuaguccagauuugagaaaguuuggggugaacaagguaagaaagauuuuuuuuuuuuuggcauc

SEQ ID NO: 234871 - RNA, 64 nt, hsa
uggagaaguuugaaucaacauaaacacguuuuuugguaagaaaagagaauuagccagcccugug

SEQ ID NO: 234872 - RNA, 64 nt, hsa
aucugcauuauaauagcucuaaaauuuguugauugguaagaaauugggcauugcuuggcucuuu

SEQ ID NO: 234873 - RNA, 64 nt, hsa
uguuuugauauauaucuguuaauaugcuuauagugguaagaaauggacuugaggucccaggaga

SEQ ID NO: 234874 - RNA, 64 nt, hsa
cuuggcucacguauuuaagagccugaauauuccagguaagaaaauauaaaaugagguuuauuuu

SEQ ID NO: 234875 - RNA, 64 nt, hsa
aagauauugauguaauaacauuacugagucccaugguaagaaagaaucuuugcuaauuuuuuuu

SEQ ID NO: 234876 - RNA, 64 nt, hsa
agaaauuaaggucuauuccauucuccauauccuggguaagaauguaaauaagaggagaaggaag

SEQ ID NO: 234877 - RNA, 64 nt, hsa
ccagagcuaugccauggaaaugauauuggauguugguaagaauaaaacagauuucuacagacug

SEQ ID NO: 234878 - RNA, 64 nt, hsa
cucugcguuaauuauugaggaaaaaaaaagaugggguaagaaaacuacccaugcaugauguaga

SEQ ID NO: 234879 - RNA, 64 nt, hsa
cuucaucuuucccuuucccuucaaaucuuuuaaugguaagaaagcaagugaagcuuggugcaag

SEQ ID NO: 234880 - RNA, 64 nt, hsa
gacgcugcuaccugaggggaaggccugagguccagguaagaagggaaaauagacugggaguggg

SEQ ID NO: 234881 - RNA, 64 nt, hsa
gauaaaauugcuuuuccaggucauuuuuuuuugugguaagaauaacuaauggaaaauaaugaaa

SEQ ID NO: 234882 - RNA, 64 nt, hsa
cauugcguguucuuaaguuuuaccccuauuagaugguaagaacaauuaaugcaguuuugcacaa

SEQ ID NO: 234883 - RNA, 64 nt, hsa
uggggcaugugcaaagcaagcaaggaacauuugggguaagaaaacaaacaugaggcaaaagaaa

SEQ ID NO: 234884 - RNA, 64 nt, hsa
agaauacauuaaaauaaaaaacuugccccuacuagguaagaacuuuauaaugaagacauacauu

SEQ ID NO: 234885 - RNA, 64 nt, hsa
ucaaaagaaaugauugacuugagggucucuguuugguaagaauacaucauuagcuuaaauaagc

SEQ ID NO: 234886 - RNA, 64 nt, hsa
ccuacaacuuuggaaaugcuggggucccuggugugguaagaaacucaacaucagacggguaugc

SEQ ID NO: 234887 - RNA, 64 nt, hsa
uugguugcuguugaguuuuuguuuugucuucugugguaagaacacuuaacucaagaccuacccu

SEQ ID NO: 234888 - RNA, 64 nt, hsa
auucaagaaguuauugucuaagagaugagcaguagguaagaaaaccucagucauugacucuuca

SEQ ID NO: 234889 - RNA, 64 nt, hsa
aaugaacuagaagauauuaaaaacauuugacauugguaagaaauauugauacugauauugauuu

SEQ ID NO: 234890 - RNA, 64 nt, hsa
auacauuuuuuuggacuuuguuauaauucauugugguaagaaugauugaaaugcagauuuaaca

SEQ ID NO: 234891 - RNA, 64 nt, hsa
uuaaaguugugaagaaauuguuaauugccagacagguaagaaaauguuuauaaucuaucucauu

SEQ ID NO: 234892 - RNA, 64 nt, hsa
uuuucaaaacucggugaaaguuacaaguuugcaugguaagaauaaaauaagaauauugaaacug

SEQ ID NO: 234893 - RNA, 64 nt, hsa
gguuuagaugaagcaagguuaucaugcagaauuggguaagaaugcuucuguuccuggaagaccc

SEQ ID NO: 234894 - RNA, 64 nt, hsa
aggcagccaucauaaccauugaauagcaugcaaggguaagaaugaguuuuuaacugcuuuguaa

SEQ ID NO: 234895 - RNA, 64 nt, hsa
augaaggguuugggguguuuuuauuuguagcagagguaagaauauguauucauauaaucugccu

SEQ ID NO: 234896 - RNA, 64 nt, hsa
uccaaauuacaggaaaugaaaccugaaaagguuggguaagaauaguguugaaaauucacaguuu

SEQ ID NO: 234897 - RNA, 64 nt, hsa
ggggagugggaauaugcgugugugggugggaaucgguaagaaaugcaccuagcuuuucauauug

SEQ ID NO: 234898 - RNA, 64 nt, hsa
aacgcauauucuauaggaagccagguuuacaauagguaagaauaaacuguauuaaguagaugua

SEQ ID NO: 234899 - RNA, 64 nt, hsa
aaauaagugaauaaacaaauaaguaguaaaauaagguaagaaguaaauauguaaaagagauaau

SEQ ID NO: 234900 - RNA, 64 nt, hsa
gggagaaaauuaagggccgauuuaauuaaacuuagguaagaagauucauuuaagucaggguuac

SEQ ID NO: 234901 - RNA, 64 nt, hsa
gaaccuaagucauaguuguaaccuacagcugauugguaagaacuaugggccagacauuuaaucu

SEQ ID NO: 234902 - RNA, 64 nt, hsa
guuacaguggaaucuggugcuugucaggguguuugguaagaacuguauauagucagaauuaccu

SEQ ID NO: 234903 - RNA, 61 nt, hsa
gguuugauacugaccuguaaaucauccuuuagguaagaaguuuuaaaaagccaguuugggu

SEQ ID NO: 234904 - RNA, 64 nt, hsa
aaauuaaagacccacauucugcuuucuuacucaugguaagaaaaguggccaugaguagagauug

SEQ ID NO: 234905 - RNA, 64 nt, hsa
ccucggcuuuuaauuuaaaaaaaaaaaagaaguggguaagaaaaugcaaaccuguuauaaguua

SEQ ID NO: 234906 - RNA, 64 nt, hsa
ucugaggcaucggccaguccaggcccucaucugagguaagaauguacaucagcuggcagcccca

SEQ ID NO: 234907 - RNA, 64 nt, hsa
cagccauauuuggggaggauggacaacuacaauagguaagaaaaugcagccggagccucagucc

SEQ ID NO: 234908 - RNA, 64 nt, hsa
ucuuuuuucuggaccucaguuuccucagugagcugguaagaaugcacuaaccuuuugauuugau

SEQ ID NO: 234909 - RNA, 64 nt, hsa
agaagauccuucgugaucaccaugcuguucucaugguaagaacuggaguuauguuuuuaaauuu

SEQ ID NO: 234910 - RNA, 64 nt, hsa
aacuuuaauaaaauaguuagcuaauagaaaaacagguaagaauaaagcaauguugccuuaauuu

SEQ ID NO: 234911 - RNA, 64 nt, hsa
uaguagggacuccauggaauauuugcccaguaaugguaagaaaucuuucggguaagaguaugga

SEQ ID NO: 234912 - RNA, 64 nt, hsa
gagaaaaggauugagaaggauaaacuggaauccugguaagaagccuuuaugccagcccgacacc

SEQ ID NO: 234913 - RNA, 64 nt, hsa
ugagccccucucauuccacuuuagcaaucuuuuugguaagaacucuuaaagccaaaagucugcu

SEQ ID NO: 234914 - RNA, 64 nt, hsa
aacugugaagugacaugucagaacaguccagacugguaagaaaauuaauggcuucacuugaauu

SEQ ID NO: 234915 - RNA, 64 nt, hsa
uacuagggucaaaaaugaauuugagggaacaguggguaagaaacuuuaugccugaauaacauuu

SEQ ID NO: 234916 - RNA, 64 nt, hsa
ggaaacaaguagaaaucagcaguggagugucugugguaagaaaacaugaacuuuaugcuucacu

SEQ ID NO: 234917 - RNA, 64 nt, hsa
uguacauaugugcaaaaaaaaauccacuugcaaugguaagaaauugaaguauccuuaaaggcca

SEQ ID NO: 234918 - RNA, 64 nt, hsa
ugaaaguuuauaguuuuauauuuggaccuugaaagguaagaaaaaaccagguucuccaaaguua

SEQ ID NO: 234919 - RNA, 64 nt, hsa
gagugggcugaauccaguucauuguuuuuuuuuugguaagaagugagacuacaguuccagcuac

SEQ ID NO: 234920 - RNA, 64 nt, hsa
ugguugucagguuagaaggaugggguguaggguugguaagaaaagaauucagggaagagcagcg

SEQ ID NO: 234921 - RNA, 64 nt, hsa
caucaauugagguacggagaaacugaacugagaagguaagaaaagcaauuuaaagucagcgagc

SEQ ID NO: 234922 - RNA, 64 nt, hsa
ccacaaacaaaauuaagauuuaaacugugggauggguaagaaauccccuucuuuggcugggaau

SEQ ID NO: 234923 - RNA, 64 nt, hsa
caagugccaaacagaguauguccgaugguaucuggguaagaagaaagcaaaagcaagggaccuu

SEQ ID NO: 234924 - RNA, 64 nt, hsa
gcaaagaccuugacaggaaagagggaggggccaagguaagaacugagaagggaggcaugaggcg

SEQ ID NO: 234925 - RNA, 64 nt, hsa
uauacuuugugggauaaaacuugggaaugagugugguaagaaauuuauaaaguuuugcuuuuaa

SEQ ID NO: 234926 - RNA, 64 nt, hsa
aauagguggaugguaaguugaaauuauugauguggguaagaagggagguuguggaaaguuaaca

SEQ ID NO: 234927 - RNA, 64 nt, hsa
uggaagcagggacugguugagggaguggggaggugguaagaacaccugacaacuucugaauauu

SEQ ID NO: 234928 - RNA, 64 nt, hsa
auugguuuuggguuuuguuuuuaguuguuuuaaugguaagaauuaagacauuuguagauuuuaa

SEQ ID NO: 234929 - RNA, 64 nt, hsa
acuguaaucugaagcuucaacaaaaggcuuaccugguaagaauauucagcuggucuggguccuc

SEQ ID NO: 234930 - RNA, 64 nt, hsa
agucgucaaaucuaaugucaaguucucuuaagcagguaagaacucagaacauaauaccugagug

SEQ ID NO: 234931 - RNA, 64 nt, hsa
caaagccuuuaaaugguugucacacuugauuguagguaagaauccauacugaagaaaacuccug

SEQ ID NO: 234932 - RNA, 64 nt, hsa
uuuauaugaaggaauagccugaacucaaacagaugguaagaauaguacaaacaccuuagcacau

SEQ ID NO: 234933 - RNA, 64 nt, hsa
aagggguugcuaggggguggggacggcuaaccaggguaagaauguucagggggcugcccaggag

SEQ ID NO: 234934 - RNA, 64 nt, hsa
gacuuccccaagccgcaggugagaccugguccaggguaagaaugggaucgguggagagccuguc

SEQ ID NO: 234935 - RNA, 64 nt, hsa
ucagagcccuugcuggggggugccugggagaugggguaagaagagcuuucauuugucugguaga

SEQ ID NO: 234936 - RNA, 64 nt, hsa
caaagcuacuguuccuaguccagcuuuaaguuucgguaagaaacaugcuguuuuguuucaugau

SEQ ID NO: 234937 - RNA, 64 nt, hsa
augaagcaggaucaaugaugggauaaaaaucaaggguaagaagaggauguaaggcagcuggugu

SEQ ID NO: 234938 - RNA, 64 nt, hsa
cuagcuauuuggaauaaccgauucccacaguuuugguaagaaaccagccccaguaaucaguaag

SEQ ID NO: 234939 - RNA, 64 nt, hsa
uuagaggugcaucacacauccgcuucauauguuggguaagaaacauaacuuagucuuuauuuug

SEQ ID NO: 234940 - RNA, 64 nt, hsa
aaaugguuugauaguugaugauggcagcaggcuggguaagaagcuggguuguguacuuucuggu

SEQ ID NO: 234941 - RNA, 64 nt, hsa
uuuuaaaagauuaucucagaaaguaaaucugagagguaagaaguaauaaugaguaaaugguaag

SEQ ID NO: 234942 - RNA, 64 nt, hsa
guaacuguauuuaccaugauaauauauucugcacgguaagaauuccuuuuacagacauucuuua

SEQ ID NO: 234943 - RNA, 64 nt, hsa
uauuucuauuuuuauaaauugugugauaauuagagguaagaauaacaaguaacuauaaacgggu

SEQ ID NO: 234944 - RNA, 64 nt, hsa
uggcuuauucacaacugggcaagaaaacaucauugguaagaacugcugagugugcccuuagaaa

SEQ ID NO: 234945 - RNA, 64 nt, hsa
uaccuucaaucuucaacuaaagauuucuaaaagggguaagaaaugaggcaguaguuuauuaaau

SEQ ID NO: 234946 - RNA, 64 nt, hsa
gagauuguuuucuuuuucuaccuuaaagggagaugguaagaaacaaugaaugucuuuuuucaaa

SEQ ID NO: 234947 - RNA, 64 nt, hsa
agcugggccuuucccucucuuaucccugaggguggguaagaaggacuguaucuacaccuguucu

SEQ ID NO: 234948 - RNA, 64 nt, hsa
cucuucagaguggaagggcuggcuggaucggguagguaagaauagcuggauuuuuuagaaaaga

SEQ ID NO: 234949 - RNA, 64 nt, hsa
gagaucucaauucucuguguccaacaggauauuagguaagaaaguacaaagauaaaccuggacu

SEQ ID NO: 234950 - RNA, 64 nt, hsa
ucugucaugcuuauuucaaacucccugagugauggguaagaaaucaaacauugccucaguggua

SEQ ID NO: 234951 - RNA, 64 nt, hsa
ucccagccccugcagauucugagcaaaggcccuggguaagaagggugggaguggggccuuugcc

SEQ ID NO: 234952 - RNA, 64 nt, hsa
aggcaguuaaguggagaaccagguuucaaaaucagguaagaaaaccaucaucauuaacugagca

SEQ ID NO: 234953 - RNA, 64 nt, hsa
guuucuggcauuagcagaugauuucuguucaccugguaagaaaagaaugauaggcuugucagag

SEQ ID NO: 234954 - RNA, 64 nt, hsa
uccacuaaugagucacaagaaaaggaguggauuugguaagaauagagauuuguuuuauuuaaac

SEQ ID NO: 234955 - RNA, 64 nt, hsa
uuuucuuaaaguguguaaauaguuuauuuauagggguaagaauguucucacaccauuucacuuc

SEQ ID NO: 234956 - RNA, 64 nt, hsa
uccacaaaugaagggauauaaaaauaaugucauagguaagaaacacagcaacaaugacuuaacc

SEQ ID NO: 234957 - RNA, 64 nt, hsa
uauuagucugguagauaaaaugaaaaaccacucagguaagaacacucacucauggcaguuuuua

SEQ ID NO: 234958 - RNA, 64 nt, hsa
ccccucccccgacacagacucucaaucugccggugguaagaaccgguucugagcuggcgucuga

SEQ ID NO: 234959 - RNA, 64 nt, hsa
cuuuuuuucauuucaaacuugaaacugugaauaagguaagaaaacuauuuugaauaaauaaacu

SEQ ID NO: 234960 - RNA, 64 nt, hsa
acaaucuagaaaaccaaaagaacaagaauuucuugguaagaagccgggaacagacaacagaagu

SEQ ID NO: 234961 - RNA, 64 nt, hsa
aaaauucuaaccagucauauacacuggauaauuugguaagaaaacuguauuuuuuuucccugaa

SEQ ID NO: 234962 - RNA, 64 nt, hsa
auagguucuguuuuuucuugaagccuauguauuugguaagaagaaauacuaccgaaguaaaaua

SEQ ID NO: 234963 - RNA, 64 nt, hsa
cuaguccuaagcuuugguucuuuagggugacugugguaagaaggauauuuaaucaugacaugca

SEQ ID NO: 234964 - RNA, 64 nt, hsa
cauccucucuuggccuuacugaagaugggggaaggguaagaaggaaggguguaggccaaggcuc

SEQ ID NO: 234965 - RNA, 64 nt, hsa
gaaacugaacucaccauuucuauuaauuucuguugguaagaacuuggugagaaugccccgugga

SEQ ID NO: 234966 - RNA, 64 nt, hsa
agaggggcuaaggauagucagcgagcuggacugggguaagaaagaaaaccagauguccuagggc

SEQ ID NO: 234967 - RNA, 64 nt, hsa
auuuacacaucugauaaauauuaaaucauaacuugguaagaaacuccuaauuaaaagguuuuuu

SEQ ID NO: 234968 - RNA, 64 nt, hsa
gaggucuuccuaguguuacuuaaauuaagaucaagguaagaaacauuguaaaaaaaaauuacaa

SEQ ID NO: 234969 - RNA, 64 nt, hsa
uaagaaaccuaauuugugcuuaggaaucuucccagguaagaagaacuaguuccucuaguuguug

SEQ ID NO: 234970 - RNA, 64 nt, hsa
uuggcuccucaggccaccauuuaggccugacugggguaagaaaugucgcuccacuuuacagagg

SEQ ID NO: 234971 - RNA, 64 nt, hsa
cuucagaacagguuuuuaguauuuaauucuucacgguaagaaaaugaaguucuaaugaacuguu

SEQ ID NO: 234972 - RNA, 64 nt, hsa
caaagucauuaaagacaggagacaaaagagcagugguaagaauaguagauguggccuuugaauu

SEQ ID NO: 234973 - RNA, 64 nt, hsa
aaagcuuugccucccauucugugguugugguggugguaagaaggagauauugguaccaagaaaa

SEQ ID NO: 234974 - RNA, 64 nt, hsa
aaaggacuuauagccaauugauuguucuaggccagguaagaauggauauggacaugcauuuauu

SEQ ID NO: 234975 - RNA, 64 nt, hsa
caccaagcaauuaugguggaccuauuacccuauggguaagaaauaaauggaaauaugacaucgg

SEQ ID NO: 234976 - RNA, 64 nt, hsa
aucuguguuuuuuaaauugaucguucuucauggggguaagaaaagcuggucuggaguugcugaa

SEQ ID NO: 234977 - RNA, 64 nt, hsa
guucuuguuagaaucaugggauguguggcccagagguaagaauagaauuucuuucccuaaagaa

SEQ ID NO: 234978 - RNA, 64 nt, hsa
aguaggcuauaagggaagauugucaauauuuugugguaagaaaagcuacagucauuuuuucuuu

SEQ ID NO: 234979 - RNA, 64 nt, hsa
aaauuaacauuuuugaugccaaaauuagggucuugguaagaaauuucuaucaguuauugaaacu

SEQ ID NO: 234980 - RNA, 64 nt, hsa
aaaugaugauaaagauguuucugacaagaauuaggguaagaacaguaauugaagccaauuauuu

SEQ ID NO: 234981 - RNA, 64 nt, hsa
auuucaagauauuuguaaaagaacaguaaacauugguaagaaugagcuuucaacucauaggcuu

SEQ ID NO: 234982 - RNA, 64 nt, hsa
cccauccuagcuucugugagaguuaaaaaucucagguaagaaggcaaggaaggcucuguuaauu

SEQ ID NO: 234983 - RNA, 64 nt, hsa
ggucugcugaccuuuaccuaagcagccccugccugguaagaaggugcccauuguucagaggcaa

SEQ ID NO: 234984 - RNA, 64 nt, hsa
aaaaaagaaauggauaaacuuggccuuucuaagugguaagaaugaccugucacuauaauauacu

SEQ ID NO: 234985 - RNA, 64 nt, hsa
uuaaggaacuuagccuuggauuccugaauagaaagguaagaauucuaucauucuggaguugaug

SEQ ID NO: 234986 - RNA, 64 nt, hsa
uaaaauauuuauuugaaguagaggguaaaucagcgguaagaacagugaacacagugguugggau

SEQ ID NO: 234987 - RNA, 64 nt, hsa
ugcuuugaagggccaaagggggaagaucucuugagguaagaauuugagaccagccugggcaaaa

SEQ ID NO: 234988 - RNA, 64 nt, hsa
uugaaguucaugaaucuugcugucaaggaagaaagguaagaaagcugauagcuccuccauguug

SEQ ID NO: 234989 - RNA, 64 nt, hsa
caccaagcagaugauugauaaaaccugggaguaagguaagaaaaauggaacaaauuuuuaucua

SEQ ID NO: 234990 - RNA, 64 nt, hsa
guguggcugcuucccuuguaaauaguuguucucugguaagaagccaaauauuuaagcucacuuc

SEQ ID NO: 234991 - RNA, 64 nt, hsa
cugagguuaaaaacaaaaaguacgugaccagucugguaagaaguauuaaugaaguagcuaauau

SEQ ID NO: 234992 - RNA, 64 nt, hsa
cuacaauuacuucagguagcuacacaauauaccagguaagaaucaaugcacaguauaaagaacu

SEQ ID NO: 234993 - RNA, 64 nt, hsa
gcagggccuccuaggccccaucuuccauuucuuagguaagaagagcauuuccucagacucccag

SEQ ID NO: 234994 - RNA, 64 nt, hsa
aauuucuccuccuuuaacuccuccuaccccccaagguaagaaacaaaaaacaaacaaacaaaca

SEQ ID NO: 234995 - RNA, 64 nt, hsa
uauuacaaaggguuuccugcucaagugauguuuugguaagaacuucgcugaguuccacugugga

SEQ ID NO: 234996 - RNA, 64 nt, hsa
aacucagcagaauucugaaaaugaggucacgcuggguaagaaugccuuuuuuuuuuuuucauag

SEQ ID NO: 234997 - RNA, 64 nt, hsa
gaaagaauaguugcaguguuuauaggauaguugugguaagaaucuaguuuauuuugcauuuggc

SEQ ID NO: 234998 - RNA, 64 nt, hsa
ggaacuucugagaguauuacagagugguagaaucgguaagaacucugauuuggacuucgcuuug

SEQ ID NO: 234999 - RNA, 64 nt, hsa
guucucugaugcagaaauuauugggcucuuuuaggguaagaaguuugugucuuugucuggccac

SEQ ID NO: 235000 - RNA, 64 nt, hsa
aaccaguaaggcaacacgaauaaacuaagaaaaagguaagaacugucucaaaaacgaaagcaca

SEQ ID NO: 235001 - RNA, 64 nt, hsa
ggccuuccacgguugccccacuuugucuuucuaagguaagaagccuucaccuuccagcuuuugu

SEQ ID NO: 235002 - RNA, 64 nt, hsa
aggugggugaagggucaccacagacacuuagaacgguaagaaaccaugagcacucacaauucug

SEQ ID NO: 235003 - RNA, 64 nt, hsa
uaucccauugcccccuccuccacuggguucagaggguaagaaagcacccuccaauaaacccagg

SEQ ID NO: 235004 - RNA, 64 nt, hsa
cauuaagguauuuuguuaagaacuuuaaguuuaggguaagaagaaugaaaaugauccagaaaaa

SEQ ID NO: 235005 - RNA, 64 nt, hsa
uuaauuugugaggcagcucuuuaagacguucagagguaagaaauacuggauuuauaaagcaaau

SEQ ID NO: 235006 - RNA, 64 nt, hsa
uucuuuuuuuucccccuaaacaaccucuuaaagggguaagaaguuaggggguuguuuauuaaga

SEQ ID NO: 235007 - RNA, 64 nt, hsa
caguguagccaaaagagaaacagauaagugaauugguaagaaauaagauucagagcacuuggga

SEQ ID NO: 235008 - RNA, 64 nt, hsa
ucuggggaagagguuuuauuuacauuuuaggguggguaagaaagccaccuuguuacaaauuuuu

SEQ ID NO: 235009 - RNA, 64 nt, hsa
guuaaaacuacagaaccacaucccaaagguaccugguaagaauguuugaaagaucuuccauuuc

SEQ ID NO: 235010 - RNA, 64 nt, hsa
ugcuucgagcacuuuucuaacuaaugagcucugugguaagaaaaaaugaacucuuucaauugag

SEQ ID NO: 235011 - RNA, 64 nt, hsa
agcucagugaaacacugaagcuaaugggauguuggguaagaagguucugugcugucucauugaa

SEQ ID NO: 235012 - RNA, 64 nt, hsa
uuuaguacguguggcuuggucacuucguggcuaagguaagaacgugcuuguggaagacaagucu

SEQ ID NO: 235013 - RNA, 64 nt, hsa
guccauaccagcugcgauuugugaguggaccugugguaagaagaauagaaaaggcucucagaga

SEQ ID NO: 235014 - RNA, 64 nt, hsa
gguacguucauaugaaacaaucugcagaaagugggguaagaaagggcacauggcacaguuaaag

SEQ ID NO: 235015 - RNA, 64 nt, hsa
ucagggaaaauacuucugugcccccugauuugaggguaagaaguagauaaugaggccacugugg

SEQ ID NO: 235016 - RNA, 64 nt, hsa
gguaggucacugguuguaagaccuacuggggccagguaagaacaguaauuggcccagacaggua

SEQ ID NO: 235017 - RNA, 64 nt, hsa
ugugaacucccaucaccuucaagaaagcuuccgagguaagaauuuuauggucaucugggacaac

SEQ ID NO: 235018 - RNA, 64 nt, hsa
cccagaagggcuucugcaagcugcacagaacugggguaagaagacaaagaguagccaccgggag

SEQ ID NO: 235019 - RNA, 64 nt, hsa
aggaugaaaacuaaaucaauuaauuauucaauuagguaagaagaucugguuuuuuggucaaagg

SEQ ID NO: 235020 - RNA, 64 nt, hsa
uccgguggggccaugaggaagaagaggagcugaagguaagaaacucauaaacaagaugacucuu

SEQ ID NO: 235021 - RNA, 64 nt, hsa
gcuuccuuuaauuacacacagacauggagguugggguaagaagauggugguaaauaugaagaua

SEQ ID NO: 235022 - RNA, 64 nt, hsa
uuuacaucuaacaaaguaaaaaaauuaaaaagaggguaagaaacgauuccggugggaugauuuu

SEQ ID NO: 235023 - RNA, 64 nt, hsa
aaauaagcccucacuccaaaaaaacaaaaaacaggguaagaaaauuacuuggguggguagacuu

SEQ ID NO: 235024 - RNA, 64 nt, hsa
aaucaauacgguauacagaguuaaaguggaaugagguaagaagauacagcuacagaaaauaguu

SEQ ID NO: 235025 - RNA, 64 nt, hsa
ucaagagaauuggaacaaaaccuugugacuuuuagguaagaaauaggcaugaugauaagcuaug

SEQ ID NO: 235026 - RNA, 64 nt, hsa
uuagaguauauuaaugugagcuauauccuuuacugguaagaaguuuuagaaaaguuuguuuugu

SEQ ID NO: 235027 - RNA, 64 nt, hsa
aggaacacaaggaugaaggggaugucauuugccugguaagaacuggguuauuuccacugaaauu

SEQ ID NO: 235028 - RNA, 64 nt, hsa
uccccagcaccaugccaaaaggucuuaucugaaagguaagaaauaaacaaugaaagcgaugagg

SEQ ID NO: 235029 - RNA, 64 nt, hsa
ccuuuaugcaaaauaggauccaaagcuaaggcuggguaagaauaguugugcagggagggagcac

SEQ ID NO: 235030 - RNA, 64 nt, hsa
aggucuugcucuccuagguagcccccucuucccugguaagaaaaagcaaaaggcauuucccacc

SEQ ID NO: 235031 - RNA, 64 nt, hsa
cagauaugccaaugggccauguuuauuguggauugguaagaaucaccaggaaaccauuaagccc

SEQ ID NO: 235032 - RNA, 64 nt, hsa
gaucuggauuugaaaaggauuucuagaaauuggggguaagaaguacuaccaaaauguaacugcu

SEQ ID NO: 235033 - RNA, 64 nt, hsa
cugcugacagcugcacacauuacagcugucuccaaacccacagugaugcuuagggaaagacccu

SEQ ID NO: 235034 - RNA, 64 nt, hsa
uugaaagucagcacuaaaggaugggcagagguucaacccacaccuccacuuugcuucugaaggc

SEQ ID NO: 235035 - RNA, 64 nt, hsa
ccuguagcaagcccagccgguaauccuccuaaugaacccacaaggucaauucacaacugauauc

SEQ ID NO: 235036 - RNA, 64 nt, hsa
uguggugacucucacaugggcaucgaagaaguacaacccacauagcccucuggagaccgccuag

SEQ ID NO: 235037 - RNA, 64 nt, hsa
accuuauguugagggaacucugccaccugcgugcaacccacagcuaaaguaaauucaaugacac

SEQ ID NO: 235038 - RNA, 64 nt, hsa
cucuaccaacccuaaacccugaggacaggggaggaacccacagcuuccuucuccugccagcugc

SEQ ID NO: 235039 - RNA, 64 nt, hsa
uuaauaaaggcugacaguucuguuggcagccaagaacccacaccaugaagacagggagugaggg

SEQ ID NO: 235040 - RNA, 64 nt, hsa
uguuugcagucccacguggcauggccuccagcccaacccacaguggagacuggagacagggcaa

SEQ ID NO: 235041 - RNA, 64 nt, hsa
ggcgaacacaaauggacacacauaccuggccacgaacccacaccuccucagacacucagacacc

SEQ ID NO: 235042 - RNA, 64 nt, hsa
ugguggccuccaaauccuuccugggauucccccaaacccacacugaugcgaagcuguucuugac

SEQ ID NO: 235043 - RNA, 64 nt, hsa
caccugugggaggcugugugcaggcugcaggauaucuggguaugauuucagguccucugcacgu

SEQ ID NO: 235044 - RNA, 64 nt, hsa
acacaugacuaggauaggcaggaguaagggugggucuggguauaugacugugcagcuguuugug

SEQ ID NO: 235045 - RNA, 64 nt, hsa
agcagcuuuuccuggaggcccaggauauuucuuuucuggguaucuuggcugaaaauuuuguuuu

SEQ ID NO: 235046 - RNA, 64 nt, hsa
cucagauuccagauuucacaucccagcagccgguucuggguagcagaucaauuuccaacuggaa

SEQ ID NO: 235047 - RNA, 64 nt, hsa
gggcaccugcuacagaagagaauguuucguucccucuggguaugcacagcuaaggggccucauu

SEQ ID NO: 235048 - RNA, 64 nt, hsa
uuucuucuagcguugcgcaaacacugacccagcuucuggguauggaaauaacccugugaugaug

SEQ ID NO: 235049 - RNA, 64 nt, hsa
gcagccuuucauccggcagagccuuccugcguuugcagcagagaggaggccccacagcuugccc

SEQ ID NO: 235050 - RNA, 64 nt, hsa
ugcagguggcaaaauggcacugaauauccccuuggcagcagagaaaacccacugaaagaucgua

SEQ ID NO: 235051 - RNA, 64 nt, hsa
augcggcuauagcagauggccauggcagucaguggcagcagaaagaggcagcagaaggugaaga

SEQ ID NO: 235052 - RNA, 64 nt, hsa
agauggccauggcagucaguggcagcagaaagaggcagcagaaggugaagagguuauagguggu

SEQ ID NO: 235053 - RNA, 64 nt, hsa
caucucuuugcagguagcagcaacaguuguagcagcagcagacgaagccauugcagaggcagaa

SEQ ID NO: 235054 - RNA, 64 nt, hsa
aacguucccuugcagauggagacugaaucugagggcagcagacuuuuaucagcuugaguuuaug

SEQ ID NO: 235055 - RNA, 64 nt, hsa
cauuuucgugaguagaaggaaagauaagaaugaggcagcagauuuucccuccuggaauuacaca

SEQ ID NO: 235056 - RNA, 64 nt, hsa
agaauuuuauuugucccacuuuuacuaaacaguggcagcagauuuuaaguuaaagaauauggaa

SEQ ID NO: 235057 - RNA, 64 nt, hsa
uugacuccaucaacuucaaggggacagagccuaggcagcagauucuccuaauuuuuaacacuaa

SEQ ID NO: 235058 - RNA, 64 nt, hsa
uuuaccuuuuuaaaaaucuguuagaagaaaaaaagcagcagacgaaagagaaaaacccuccucu

SEQ ID NO: 235059 - RNA, 64 nt, hsa
ccccucuuaggacaggcacugcccagcagcaagggcagcagaguugggugcuaagauccugagg

SEQ ID NO: 235060 - RNA, 64 nt, hsa
agaagggacuugccuaaagccacccagcaacucagcagcagaaccaagaugggccccaggcucc

SEQ ID NO: 235061 - RNA, 64 nt, hsa
ucaucagaaacaugguuaaaguuuaaaacuagaagcagcagaaaacuagcuuguaaaauuuauc

SEQ ID NO: 235062 - RNA, 64 nt, hsa
auguacacuggacaugaaaacaaagacugguuuagcagcagacauugguuuacucugcagccug

SEQ ID NO: 235063 - RNA, 64 nt, hsa
aggccauagcugcuccagccggggcuccggggcggcagcagagcuggcacaccgauucugggaa

SEQ ID NO: 235064 - RNA, 64 nt, hsa
acaaagacaacgcugagggguagugacuccuguagcagcagagacgccuuggaguuuaaccccc

SEQ ID NO: 235065 - RNA, 64 nt, hsa
ugagccgagaucgcaccacugcacuccagccugggcagcagagcaaguaguaauaaccaccgug

SEQ ID NO: 235066 - RNA, 64 nt, hsa
cgcagggcuggugaauccaugacaagguccgggagcagcagaccaaaaccacagcagccuccua

SEQ ID NO: 235067 - RNA, 64 nt, hsa
cagcccagaggggggcuacagagaggagucggcugcagcagagggcaggagccccagcuuagcc

SEQ ID NO: 235068 - RNA, 64 nt, hsa
ccccuccucccaggggagaguagaagucgcacacgcagcagagcagaccugaugucccggugcu

SEQ ID NO: 235069 - RNA, 64 nt, hsa
ugaccgaaagugaccaagaccaaggcccaccaaggcagcagacuguuaaucagacaaacagauc

SEQ ID NO: 235070 - RNA, 64 nt, hsa
cauuuacuucagccuuugauucaguaaauguuaagcagcagaagacuucgaaugguugaaauuc

SEQ ID NO: 235071 - RNA, 64 nt, hsa
ggcccucaauacccagcugcuucuggcuaagagugcagcagagacugaggcauagccagcuuca

SEQ ID NO: 235072 - RNA, 64 nt, hsa
agucaccccagcugcugggcuccucugccucucugcagcagaauguccguccucuguugauuga

SEQ ID NO: 235073 - RNA, 64 nt, hsa
auugaacggccuguccaaagauccucucucuagggcagcagagagcuuuuugcacuuuaaaaaa

SEQ ID NO: 235074 - RNA, 64 nt, hsa
uaaauuggucagcagaaaagggagcccagaaaaggcagcagauggaccaugcccuugcuggguu

SEQ ID NO: 235075 - RNA, 64 nt, hsa
cacauauccaagagcucagggccaguucuggugggcagcagagaccugcucugccaaguugucc

SEQ ID NO: 235076 - RNA, 64 nt, hsa
ugggcagcagagaccugcucugccaaguuguccagcagcagaguggcccuggccugggcaucac

SEQ ID NO: 235077 - RNA, 64 nt, hsa
uggguacuaucauuagucccauguuauagaaacugcagcagaguugaaaauugccuccaaauua

SEQ ID NO: 235078 - RNA, 64 nt, hsa
guagaacccaaggacuucuggguacugagaagcagcagcagaaugaggccaaaugcagagauga

SEQ ID NO: 235079 - RNA, 64 nt, hsa
uggagugcgggcccugccagaagguauuuguggugcagcagauucccaacaguaaccuccuccu

SEQ ID NO: 235080 - RNA, 64 nt, hsa
gugagcaguucagccugcagcagaggagggcacggcagcagagacacgcacaugcacguaagca

SEQ ID NO: 235081 - RNA, 62 nt, hsa
cucagcacaccaaugugugagcaguucagccugcagcagaggagggcacggcagcagagaca

SEQ ID NO: 235082 - RNA, 64 nt, hsa
aguuggaaaggacacgugagagugagcucaaguggcagcagaggcaguuuggaauaagcugcgg

SEQ ID NO: 235083 - RNA, 64 nt, hsa
aucugagaggcaguaaagcagugaugaagacagugcagcagaacauugaaguccugauugcagc

SEQ ID NO: 235084 - RNA, 64 nt, hsa
gguagccuccgcagaggcugggggccuccacccagcagcagaccaaccaggaagcagcuugaac

SEQ ID NO: 235085 - RNA, 64 nt, hsa
ucugcaccccaagcccuugccccagcccaguccagcagcagauguuacaaucugagugaggaca

SEQ ID NO: 235086 - RNA, 64 nt, hsa
ccugagcaggauagauuugaagugcaagccggaggcagcagaucaggaguagggacaggaagga

SEQ ID NO: 235087 - RNA, 64 nt, hsa
uucucuccgggccaccuucuccccaccaggcacugcagcagacggagcuguacugccgggcccg

SEQ ID NO: 235088 - RNA, 64 nt, hsa
ugagccgagauugugccacggcacuccagccugggcagcagagugagacucucucucaaaaaaa

SEQ ID NO: 235089 - RNA, 64 nt, hsa
gucaccaucuuugcaccaaacugucaccaucuuugcagcagaaggucacuacucacauuauagu

SEQ ID NO: 235090 - RNA, 64 nt, hsa; identical to SEQ ID NO: 115592

SEQ ID NO: 235091 - RNA, 64 nt, hsa; identical to SEQ ID NO: 115593

SEQ ID NO: 235092 - RNA, 64 nt, hsa; identical to SEQ ID NO: 115594

SEQ ID NO: 235093 - RNA, 64 nt, hsa; identical to SEQ ID NO: 115595

SEQ ID NO: 235094 - RNA, 64 nt, hsa; identical to SEQ ID NO: 115596

SEQ ID NO: 235095 - RNA, 64 nt, hsa; identical to SEQ ID NO: 115597

SEQ ID NO: 235096 - RNA, 64 nt, hsa; identical to SEQ ID NO: 115598

SEQ ID NO: 235097 - RNA, 64 nt, hsa; identical to SEQ ID NO: 115599

SEQ ID NO: 235098 - RNA, 64 nt, hsa; identical to SEQ ID NO: 115600

SEQ ID NO: 235099 - RNA, 64 nt, hsa; identical to SEQ ID NO: 115601

SEQ ID NO: 235100 - RNA, 64 nt, hsa; identical to SEQ ID NO: 115602

SEQ ID NO: 235101 - RNA, 64 nt, hsa; identical to SEQ ID NO: 115603

SEQ ID NO: 235102 - RNA, 64 nt, hsa; identical to SEQ ID NO: 115604

SEQ ID NO: 235103 - RNA, 64 nt, hsa; identical to SEQ ID NO: 115605

SEQ ID NO: 235104 - RNA, 64 nt, hsa; identical to SEQ ID NO: 115606

SEQ ID NO: 235105 - RNA, 64 nt, hsa; identical to SEQ ID NO: 115607

SEQ ID NO: 235106 - RNA, 64 nt, hsa; identical to SEQ ID NO: 115608

SEQ ID NO: 235107 - RNA, 64 nt, hsa; identical to SEQ ID NO: 115609

SEQ ID NO: 235108 - RNA, 64 nt, hsa; identical to SEQ ID NO: 115610

SEQ ID NO: 235109 - RNA, 64 nt, hsa; identical to SEQ ID NO: 115611

SEQ ID NO: 235110 - RNA, 64 nt, hsa; identical to SEQ ID NO: 115612

SEQ ID NO: 235111 - RNA, 64 nt, hsa; identical to SEQ ID NO: 115613

SEQ ID NO: 235112 - RNA, 64 nt, hsa; identical to SEQ ID NO: 115614

SEQ ID NO: 235113 - RNA, 64 nt, hsa; identical to SEQ ID NO: 115615

SEQ ID NO: 235114 - RNA, 52 nt, hsa; identical to SEQ ID NO: 115616

SEQ ID NO: 235115 - RNA, 64 nt, hsa; identical to SEQ ID NO: 115617

SEQ ID NO: 235116 - RNA, 64 nt, hsa; identical to SEQ ID NO: 115618

SEQ ID NO: 235117 - RNA, 64 nt, hsa; identical to SEQ ID NO: 115619

SEQ ID NO: 235118 - RNA, 64 nt, hsa; identical to SEQ ID NO: 115620

SEQ ID NO: 235119 - RNA, 64 nt, hsa; identical to SEQ ID NO: 115621

SEQ ID NO: 235120 - RNA, 64 nt, hsa; identical to SEQ ID NO: 115622

SEQ ID NO: 235121 - RNA, 64 nt, hsa; identical to SEQ ID NO: 115623

SEQ ID NO: 235122 - RNA, 64 nt, hsa; identical to SEQ ID NO: 115624

SEQ ID NO: 235123 - RNA, 64 nt, hsa; identical to SEQ ID NO: 115625

SEQ ID NO: 235124 - RNA, 64 nt, hsa; identical to SEQ ID NO: 115626

SEQ ID NO: 235125 - RNA, 64 nt, hsa; identical to SEQ ID NO: 115627

SEQ ID NO: 235126 - RNA, 64 nt, hsa; identical to SEQ ID NO: 115628

SEQ ID NO: 235127 - RNA, 64 nt, hsa; identical to SEQ ID NO: 115629

SEQ ID NO: 235128 - RNA, 64 nt, hsa; identical to SEQ ID NO: 115630

SEQ ID NO: 235129 - RNA, 64 nt, hsa; identical to SEQ ID NO: 115631

SEQ ID NO: 235130 - RNA, 64 nt, hsa; identical to SEQ ID NO: 115632

SEQ ID NO: 235131 - RNA, 64 nt, hsa; identical to SEQ ID NO: 115633

SEQ ID NO: 235132 - RNA, 64 nt, hsa; identical to SEQ ID NO: 115634

SEQ ID NO: 235133 - RNA, 64 nt, hsa; identical to SEQ ID NO: 115635

SEQ ID NO: 235134 - RNA, 64 nt, hsa; identical to SEQ ID NO: 115636

SEQ ID NO: 235135 - RNA, 64 nt, hsa; identical to SEQ ID NO: 115637

SEQ ID NO: 235136 - RNA, 64 nt, hsa; identical to SEQ ID NO: 115636

SEQ ID NO: 235137 - RNA, 64 nt, hsa; identical to SEQ ID NO: 115639

SEQ ID NO: 235138 - RNA, 64 nt, hsa; identical to SEQ ID NO: 115640

SEQ ID NO: 235139 - RNA, 64 nt, hsa; identical to SEQ ID NO: 115641

SEQ ID NO: 235140 - RNA, 64 nt, hsa; identical to SEQ ID NO: 115642

SEQ ID NO: 235141 - RNA, 64 nt, hsa; identical to SEQ ID NO: 115643

SEQ ID NO: 235142 - RNA, 64 nt, hsa; identical to SEQ ID NO: 115644

SEQ ID NO: 235143 - RNA, 64 nt, hsa; identical to SEQ ID NO: 115645

SEQ ID NO: 235144 - RNA, 64 nt, hsa; identical to SEQ ID NO: 115646

SEQ ID NO: 235145 - RNA, 64 nt, hsa; identical to SEQ ID NO: 115647

SEQ ID NO: 235146 - RNA, 64 nt, hsa; identical to SEQ ID NO: 115648

SEQ ID NO: 235147 - RNA, 64 nt, hsa; identical to SEQ ID NO: 115649

SEQ ID NO: 235148 - RNA, 64 nt, hsa; identical to SEQ ID NO: 115650

SEQ ID NO: 235149 - RNA, 64 nt, hsa; identical to SEQ ID NO: 115651

SEQ ID NO: 235150 - RNA, 64 nt, hsa; identical to SEQ ID NO: 115652

SEQ ID NO: 235151 - RNA, 64 nt, hsa; identical to SEQ ID NO: 115653

SEQ ID NO: 235152 - RNA, 64 nt, hsa; identical to SEQ ID NO: 115654

SEQ ID NO: 235153 - RNA, 64 nt, hsa; identical to SEQ ID NO: 115655

SEQ ID NO: 235154 - RNA, 64 nt, hsa; identical to SEQ ID NO: 115656

SEQ ID NO: 235155 - RNA, 64 nt, hsa; identical to SEQ ID NO: 115657

SEQ ID NO: 235156 - RNA, 64 nt, hsa; identical to SEQ ID NO: 115658

SEQ ID NO: 235157 - RNA, 64 nt, hsa; identical to SEQ ID NO: 115659

SEQ ID NO: 235158 - RNA, 64 nt, hsa; identical to SEQ ID NO: 77753

SEQ ID NO: 235159 - RNA, 64 nt, hsa; identical to SEQ ID NO: 77754

SEQ ID NO: 235160 - RNA, 64 nt, hsa; identical to SEQ ID NO: 77755

SEQ ID NO: 235161 - RNA, 64 nt, hsa; identical to SEQ ID NO: 77756

SEQ ID NO: 235162 - RNA, 64 nt, hsa; identical to SEQ ID NO: 77757

SEQ ID NO: 235163 - RNA, 64 nt, hsa; identical to SEQ ID NO: 77758

SEQ ID NO: 235164 - RNA, 64 nt, hsa; identical to SEQ ID NO: 77759

SEQ ID NO: 235165 - RNA, 64 nt, hsa; identical to SEQ ID NO: 77760

SEQ ID NO: 235166 - RNA, 64 nt, hsa; identical to SEQ ID NO: 77761

SEQ ID NO: 235167 - RNA, 64 nt, hsa; identical to SEQ ID NO: 77762

SEQ ID NO: 235168 - RNA, 64 nt, hsa; identical to SEQ ID NO: 77763

SEQ ID NO: 235169 - RNA, 64 nt, hsa; identical to SEQ ID NO: 77764

SEQ ID NO: 235170 - RNA, 64 nt, hsa; identical to SEQ ID NO: 77765

SEQ ID NO: 235171 - RNA, 64 nt, hsa; identical to SEQ ID NO: 77766

SEQ ID NO: 235172 - RNA, 64 nt, hsa; identical to SEQ ID NO: 77767

SEQ ID NO: 235173 - RNA, 64 nt, hsa; identical to SEQ ID NO: 77768

SEQ ID NO: 235174 - RNA, 64 nt, hsa; identical to SEQ ID NO: 77769

SEQ ID NO: 235175 - RNA, 64 nt, hsa; identical to SEQ ID NO: 77770

SEQ ID NO: 235176 - RNA, 64 nt, hsa; identical to SEQ ID NO: 77771

SEQ ID NO: 235177 - RNA, 64 nt, hsa; identical to SEQ ID NO: 77772

SEQ ID NO: 235178 - RNA, 64 nt, hsa; identical to SEQ ID NO: 77773

SEQ ID NO: 235179 - RNA, 64 nt, hsa; identical to SEQ ID NO: 77774

SEQ ID NO: 235180 - RNA, 64 nt, hsa; identical to SEQ ID NO: 77775

SEQ ID NO: 235181 - RNA, 64 nt, hsa; identical to SEQ ID NO: 77776

SEQ ID NO: 235182 - RNA, 64 nt, hsa; identical to SEQ ID NO: 77777

SEQ ID NO: 235183 - RNA, 64 nt, hsa; identical to SEQ ID NO: 77778

SEQ ID NO: 235184 - RNA, 64 nt, hsa; identical to SEQ ID NO: 77779

SEQ ID NO: 235185 - RNA, 64 nt, hsa; identical to SEQ ID NO: 77780

SEQ ID NO: 235186 - RNA, 64 nt, hsa; identical to SEQ ID NO: 77781

SEQ ID NO: 235187 - RNA, 64 nt, hsa; identical to SEQ ID NO: 77782

SEQ ID NO: 235188 - RNA, 64 nt, hsa; identical to SEQ ID NO: 77783

SEQ ID NO: 235189 - RNA, 64 nt, hsa; identical to SEQ ID NO: 77784

SEQ ID NO: 235190 - RNA, 64 nt, hsa; identical to SEQ ID NO: 77785

SEQ ID NO: 235191 - RNA, 64 nt, hsa; identical to SEQ ID NO: 171819

SEQ ID NO: 235192 - RNA, 64 nt, hsa; identical to SEQ ID NO: 171820

SEQ ID NO: 235193 - RNA, 64 nt, hsa; identical to SEQ ID NO: 171821

SEQ ID NO: 235194 - RNA, 64 nt, hsa; identical to SEQ ID NO: 171822

SEQ ID NO: 235195 - RNA, 64 nt, hsa; identical to SEQ ID NO: 171823

SEQ ID NO: 235196 - RNA, 64 nt, hsa; identical to SEQ ID NO: 171824

SEQ ID NO: 235197 - RNA, 64 nt, hsa; identical to SEQ ID NO: 171825

SEQ ID NO: 235198 - RNA, 64 nt, hsa; identical to SEQ ID NO: 171826

SEQ ID NO: 235199 - RNA, 64 nt, hsa; identical to SEQ ID NO: 171827

SEQ ID NO: 235200 - RNA, 64 nt, hsa; identical to SEQ ID NO: 171828

SEQ ID NO: 235201 - RNA, 64 nt, hsa; identical to SEQ ID NO: 171829

SEQ ID NO: 235202 - RNA, 64 nt, hsa; identical to SEQ ID NO: 88616

SEQ ID NO: 235203 - RNA, 64 nt, hsa; identical to SEQ ID NO: 88617

SEQ ID NO: 235204 - RNA, 64 nt, hsa; identical to SEQ ID NO: 88618

SEQ ID NO: 235205 - RNA, 64 nt, hsa; identical to SEQ ID NO: 88619

SEQ ID NO: 235206 - RNA, 64 nt, hsa; identical to SEQ ID NO: 88620

SEQ ID NO: 235207 - RNA, 64 nt, hsa; identical to SEQ ID NO: 88621

SEQ ID NO: 235208 - RNA, 64 nt, hsa; identical to SEQ ID NO: 88622

SEQ ID NO: 235209 - RNA, 64 nt, hsa; identical to SEQ ID NO: 88623

SEQ ID NO: 235210 - RNA, 64 nt, hsa; identical to SEQ ID NO: 110959

SEQ ID NO: 235211 - RNA, 64 nt, hsa; identical to SEQ ID NO: 110960

SEQ ID NO: 235212 - RNA, 64 nt, hsa; identical to SEQ ID NO: 110961

SEQ ID NO: 235213 - RNA, 64 nt, hsa; identical to SEQ ID NO: 110962

SEQ ID NO: 235214 - RNA, 64 nt, hsa; identical to SEQ ID NO: 110963

SEQ ID NO: 235215 - RNA, 64 nt, hsa; identical to SEQ ID NO: 110964

SEQ ID NO: 235216 - RNA, 64 nt, hsa; identical to SEQ ID NO: 110965

SEQ ID NO: 235217 - RNA, 64 nt, hsa; identical to SEQ ID NO: 110966

SEQ ID NO: 235218 - RNA, 64 nt, hsa; identical to SEQ ID NO: 110967

SEQ ID NO: 235219 - RNA, 64 nt, hsa; identical to SEQ ID NO: 110968

SEQ ID NO: 235220 - RNA, 64 nt, hsa; identical to SEQ ID NO: 110969

SEQ ID NO: 235221 - RNA, 64 nt, hsa; identical to SEQ ID NO: 110970

SEQ ID NO: 235222 - RNA, 64 nt, hsa; identical to SEQ ID NO: 110971

SEQ ID NO: 235223 - RNA, 64 nt, hsa; identical to SEQ ID NO: 110972

SEQ ID NO: 235224 - RNA, 64 nt, hsa; identical to SEQ ID NO: 110973

SEQ ID NO: 235225 - RNA, 64 nt, hsa; identical to SEQ ID NO: 110974

SEQ ID NO: 235226 - RNA, 64 nt, hsa; identical to SEQ ID NO: 110975

SEQ ID NO: 235227 - RNA, 64 nt, hsa; identical to SEQ ID NO: 110976

SEQ ID NO: 235228 - RNA, 64 nt, hsa; identical to SEQ ID NO: 110977

SEQ ID NO: 235229 - RNA, 64 nt, hsa; identical to SEQ ID NO: 110978

SEQ ID NO: 235230 - RNA, 64 nt, hsa; identical to SEQ ID NO: 110979

SEQ ID NO: 235231 - RNA, 64 nt, hsa; identical to SEQ ID NO: 110980

SEQ ID NO: 235232 - RNA, 64 nt, hsa; identical to SEQ ID NO: 72205

SEQ ID NO: 235233 - RNA, 64 nt, hsa; identical to SEQ ID NO: 72206

SEQ ID NO: 235234 - RNA, 64 nt, hsa; identical to SEQ ID NO: 72207

SEQ ID NO: 235235 - RNA, 64 nt, hsa; identical to SEQ ID NO: 72208

SEQ ID NO: 235236 - RNA, 64 nt, hsa; identical to SEQ ID NO: 72209

SEQ ID NO: 235237 - RNA, 64 nt, hsa; identical to SEQ ID NO: 72210

SEQ ID NO: 235238 - RNA, 64 nt, hsa; identical to SEQ ID NO: 72211

SEQ ID NO: 235239 - RNA, 64 nt, hsa; identical to SEQ ID NO: 72212

SEQ ID NO: 235240 - RNA, 64 nt, hsa; identical to SEQ ID NO: 72213

SEQ ID NO: 235241 - RNA, 64 nt, hsa; identical to SEQ ID NO: 72214

SEQ ID NO: 235242 - RNA, 64 nt, hsa; identical to SEQ ID NO: 72215

SEQ ID NO: 235243 - RNA, 64 nt, hsa; identical to SEQ ID NO: 72216

SEQ ID NO: 235244 - RNA, 64 nt, hsa; identical to SEQ ID NO: 72217

SEQ ID NO: 235245 - RNA, 64 nt, hsa; identical to SEQ ID NO: 72218

SEQ ID NO: 235246 - RNA, 64 nt, hsa; identical to SEQ ID NO: 72219

SEQ ID NO: 235247 - RNA, 64 nt, hsa; identical to SEQ ID NO: 72220

SEQ ID NO: 235248 - RNA, 64 nt, hsa; identical to SEQ ID NO: 72221

SEQ ID NO: 235249 - RNA, 64 nt, hsa; identical to SEQ ID NO: 72222

SEQ ID NO: 235250 - RNA, 64 nt, hsa; identical to SEQ ID NO: 72223

SEQ ID NO: 235251 - RNA, 64 nt, hsa; identical to SEQ ID NO: 72224

SEQ ID NO: 235252 - RNA, 64 nt, hsa; identical to SEQ ID NO: 72225

SEQ ID NO: 235253 - RNA, 64 nt, hsa; identical to SEQ ID NO: 72226

SEQ ID NO: 235254 - RNA, 64 nt, hsa; identical to SEQ ID NO: 72227

SEQ ID NO: 235255 - RNA, 64 nt, hsa; identical to SEQ ID NO: 72228

SEQ ID NO: 235256 - RNA, 64 nt, hsa; identical to SEQ ID NO: 72229

SEQ ID NO: 235257 - RNA, 64 nt, hsa; identical to SEQ ID NO: 72230

SEQ ID NO: 235258 - RNA, 64 nt, hsa; identical to SEQ ID NO: 72231

SEQ ID NO: 235259 - RNA, 64 nt, hsa; identical to SEQ ID NO: 72232

SEQ ID NO: 235260 - RNA, 64 nt, hsa; identical to SEQ ID NO: 72233

SEQ ID NO: 235261 - RNA, 64 nt, hsa; identical to SEQ ID NO: 72234

SEQ ID NO: 235262 - RNA, 64 nt, hsa; identical to SEQ ID NO: 72235

SEQ ID NO: 235263 - RNA, 64 nt, hsa; identical to SEQ ID NO: 72236

SEQ ID NO: 235264 - RNA, 64 nt, hsa; identical to SEQ ID NO: 72237

SEQ ID NO: 235265 - RNA, 64 nt, hsa; identical to SEQ ID NO: 72238

SEQ ID NO: 235266 - RNA, 64 nt, hsa; identical to SEQ ID NO: 72239

SEQ ID NO: 235267 - RNA, 64 nt, hsa; identical to SEQ ID NO: 72240

SEQ ID NO: 235268 - RNA, 64 nt, hsa; identical to SEQ ID NO: 72241

SEQ ID NO: 235269 - RNA, 64 nt, hsa; identical to SEQ ID NO: 72242

SEQ ID NO: 235270 - RNA, 64 nt, hsa; identical to SEQ ID NO: 72243

SEQ ID NO: 235271 - RNA, 64 nt, hsa; identical to SEQ ID NO: 72244

SEQ ID NO: 235272 - RNA, 64 nt, hsa; identical to SEQ ID NO: 72245

SEQ ID NO: 235273 - RNA, 64 nt, hsa; identical to SEQ ID NO: 72246

SEQ ID NO: 235274 - RNA, 64 nt, hsa; identical to SEQ ID NO: 72247

SEQ ID NO: 235275 - RNA, 64 nt, hsa; identical to SEQ ID NO: 72248

SEQ ID NO: 235276 - RNA, 64 nt, hsa; identical to SEQ ID NO: 72249

SEQ ID NO: 235277 - RNA, 64 nt, hsa; identical to SEQ ID NO: 72250

SEQ ID NO: 235278 - RNA, 64 nt, hsa; identical to SEQ ID NO: 72251

SEQ ID NO: 235279 - RNA, 64 nt, hsa; identical to SEQ ID NO: 72252

SEQ ID NO: 235280 - RNA, 64 nt, hsa; identical to SEQ ID NO: 72253

SEQ ID NO: 235281 - RNA, 64 nt, hsa; identical to SEQ ID NO: 72254

SEQ ID NO: 235282 - RNA, 64 nt, hsa; identical to SEQ ID NO: 72255

SEQ ID NO: 235283 - RNA, 64 nt, hsa; identical to SEQ ID NO: 72256

SEQ ID NO: 235284 - RNA, 64 nt, hsa; identical to SEQ ID NO: 72257

SEQ ID NO: 235285 - RNA, 64 nt, hsa; identical to SEQ ID NO: 72258

SEQ ID NO: 235286 - RNA, 64 nt, hsa; identical to SEQ ID NO: 72259

SEQ ID NO: 235287 - RNA, 64 nt, hsa; identical to SEQ ID NO: 72260

SEQ ID NO: 235288 - RNA, 64 nt, hsa; identical to SEQ ID NO: 72261

SEQ ID NO: 235289 - RNA, 64 nt, hsa; identical to SEQ ID NO: 72262

SEQ ID NO: 235290 - RNA, 64 nt, hsa; identical to SEQ ID NO: 72263

SEQ ID NO: 235291 - RNA, 64 nt, hsa; identical to SEQ ID NO: 72264

SEQ ID NO: 235292 - RNA, 64 nt, hsa; identical to SEQ ID NO: 72265

SEQ ID NO: 235293 - RNA, 64 nt, hsa; identical to SEQ ID NO: 72266

SEQ ID NO: 235294 - RNA, 64 nt, hsa; identical to SEQ ID NO: 72267

SEQ ID NO: 235295 - RNA, 64 nt, hsa; identical to SEQ ID NO: 72268

SEQ ID NO: 235296 - RNA, 64 nt, hsa; identical to SEQ ID NO: 72269

SEQ ID NO: 235297 - RNA, 64 nt, hsa; identical to SEQ ID NO: 72270

SEQ ID NO: 235298 - RNA, 64 nt, hsa; identical to SEQ ID NO: 72271

SEQ ID NO: 235299 - RNA, 64 nt, hsa; identical to SEQ ID NO: 72272

SEQ ID NO: 235300 - RNA, 64 nt, hsa; identical to SEQ ID NO: 72273

SEQ ID NO: 235301 - RNA, 64 nt, hsa
agcugagaagaagcugaggauccucacaggagcagacagagaaaugugaagggugggguuuuau

SEQ ID NO: 235302 - RNA, 64 nt, hsa
aaguggagggggugucuggaagcugagcaggcccgacagagagaugaagccaucagaaggacuu

SEQ ID NO: 235303 - RNA, 64 nt, hsa
ggcuuggucaguuucuuaagguaugguucucugagacagagagcaacgaccuuugaguuaagcu

SEQ ID NO: 235304 - RNA, 64 nt, hsa
augcaucucauaaucagacuccaugcuuuuuaaagacagagauaauaucuucucuauucuauuc

SEQ ID NO: 235305 - RNA, 64 nt, hsa
cuugcagacaccauccgugcuccugguaaagggggacagagagccucaccuugccacauauuug

SEQ ID NO: 235306 - RNA, 64 nt, hsa
ccuuuuaccucgggguuuugaggccaacagggacgacagagacaguuucuaguuagagccuugg

SEQ ID NO: 235307 - RNA, 64 nt, hsa
guacguguugucuaccaguacacaggcugcagaagacagagacagaagaaagagaucaagggca

SEQ ID NO: 235308 - RNA, 64 nt, hsa
ccaguuuuucuagcuagacuguaaacuccuuaaggacagagacuacaccuuguacuuuuugugc

SEQ ID NO: 235309 - RNA, 64 nt, hsa
acuugugacugcaucccucuggagucuacccagagacagagaaugugucuuuaugugggagugg

SEQ ID NO: 235310 - RNA, 64 nt, hsa
aaugugucuuuaugugggaguggugacucugaaagacagagagggcuccuguggcugccaggag

SEQ ID NO: 235311 - RNA, 64 nt, hsa
guuccaacaaacaucaugauagucugguagucaagacagagauuaaguaaaacagguuuuacug

SEQ ID NO: 235312 - RNA, 64 nt, hsa
uucuaaagauuuggguuauauuuucaacuugggggacagagagaaauggagagcaggaauuaca

SEQ ID NO: 235313 - RNA, 64 nt, hsa
cuugacauggaaugccuuugaccauuggugcucugacagagaagucauggagucauugccauuu

SEQ ID NO: 235314 - RNA, 64 nt, hsa
auaaaguccuuuucucuuacagguauuaaaugaggacagagaaccucagguguucuuaugcuag

SEQ ID NO: 235315 - RNA, 64 nt, hsa
aguggagaacugugggagcugguggcucugcccugacagagagccauggagcagaggagccucu

SEQ ID NO: 235316 - RNA, 64 nt, hsa
agccgagaucgugucacugcacuccagccugggugacagagacuccauuuaaaaaaaaaaaaaa

SEQ ID NO: 235317 - RNA, 64 nt, hsa
cacaauggagcaggaaggauaaaaaauaaagaaagacagagagaaacaaauuugcugggagagg

SEQ ID NO: 235318 - RNA, 64 nt, hsa
uuuuguaauauugucaaaugucucuauggauucugacagagauuucuuuuuguuuuguuauucu

SEQ ID NO: 235319 - RNA, 64 nt, hsa
uguguguaugagagagagagagagagacaacagagacagagagaggcagagaggcauagagaga

SEQ ID NO: 235320 - RNA, 64 nt, hsa
aacagagacagagagaggcagagaggcauagagagacagagagagagacaagaaacagagauag

SEQ ID NO: 235321 - RNA, 64 nt, hsa
uguuugaaaucuggucuguuugcauuucuguuaugacagagagaugauguuugcauuucuguua

SEQ ID NO: 235322 - RNA, 64 nt, hsa
uaugacagagagaugauguuugcauuucuguuaugacagagagaugaugaaaguaggcagggcu

SEQ ID NO: 235323 - RNA, 64 nt, hsa
gagggcaugggagggagggagagguggggagggagacagagacagaaacagagagagacagaga

SEQ ID NO: 235324 - RNA, 64 nt, hsa
gguggggagggagacagagacagaaacagagagagacagagacagagagagacugagggagaga

SEQ ID NO: 235325 - RNA, 64 nt, hsa
gagggagacagagacagaaacagagagagacagagacagagagagacugagggagagacucuga

SEQ ID NO: 235326 - RNA, 64 nt, hsa
gaacagaaggccgaauccaaguuucaugugguaggacagagaacggcaaucuacaaaacuacac

SEQ ID NO: 235327 - RNA, 64 nt, hsa
uuagugaaggcugaauccaaguuucauguaguaggacagagaacagaaggccgaauccaaguuu

SEQ ID NO: 235328 - RNA, 64 nt, hsa
uacauuccucgccagggucucucagugggucuucgacagagagcuuuugcaguuuaaaauguug

SEQ ID NO: 235329 - RNA, 64 nt, hsa
cagauguggguauggggcccagugugagaaggaagacagagaaguucuugaaagcugggggaug

SEQ ID NO: 235330 - RNA, 64 nt, hsa
cugguagacuuuuguuaaaagagagagagacagagacagagaaauaagcauuagagaccugcaa

SEQ ID NO: 235331 - RNA, 64 nt, hsa
aggccgcugguagacuuuuguuaaaagagagagagacagagacagagaaauaagcauuagagac

SEQ ID NO: 235332 - RNA, 64 nt, hsa
cggagugagaagcuuugcccuccuaagagagagagacagagagacagagagagagaaagagaga

SEQ ID NO: 235333 - RNA, 64 nt, hsa
gaagcuuugcccuccuaagagagagagacagagagacagagagagagaaagagagagugugugg

SEQ ID NO: 235334 - RNA, 64 nt, hsa
uagcugaccuggagaugcugccugguggggaucagacagagauuggagagaagguacagagucc

SEQ ID NO: 235335 - RNA, 64 nt, hsa
ucguggcuguggagagggucaaggaguacuccaagacagagacagagguggguacuggcaugag

SEQ ID NO: 235336 - RNA, 64 nt, hsa
gggagagaggcagagagacagagagggagagagggacagagagagauagagcaggaggucgggg

SEQ ID NO: 235337 - RNA, 64 nt, hsa
gagggagagaggcagagagggagagaggcagagagacagagagggagagagggacagagagaga

SEQ ID NO: 235338 - RNA, 64 nt, hsa
gacagaggaggcagagagggagagaaacagaggagacagagagggagagagagacagagggaga

SEQ ID NO: 235339 - RNA, 64 nt, hsa
acucggaaaguaaaugcuucaaaaggaaggaaaugacagagacacacgcccuugcccaccuucc

SEQ ID NO: 235340 - RNA, 64 nt, hsa
cuagggccuuugcucccacacucucauggaaucagacagagauccuaccgggccggaugaaucu

SEQ ID NO: 235341 - RNA, 64 nt, hsa
guagcuaugcuuugauguccuguugaggccaucggacagagacuggagcccaggugacaggaga

SEQ ID NO: 235342 - RNA, 64 nt, hsa
uccuggcuccagagcccauucuuuuaaucagagagacagagaauaaugcuggacuaccugggua

SEQ ID NO: 235343 - RNA, 64 nt, hsa
aagggcccucccuccagccuaggucagagguggggacagagaacuccccuacagcccagagaug

SEQ ID NO: 235344 - RNA, 64 nt, hsa
ugccucugggcugggugagcuugaaguccucugggacagagaccugucuccacgccuccgggag

SEQ ID NO: 235345 - RNA, 64 nt, hsa
uuccugagaccucgccggccuuguuuuauucaaagacagagaagaccaaagcauugccugccag

SEQ ID NO: 235346 - RNA, 64 nt, hsa
aggccagggaaagcccgugucaaugaaugccggggacagagaggggcagguugaccgggacuuc

SEQ ID NO: 235347 - RNA, 64 nt, hsa
uuaggcucacaguuacaguuuauuacaguaaaaggacagagauuaagaucagcaaagggaggag

SEQ ID NO: 235348 - RNA, 64 nt, hsa
aagagaaaauaagcaggacagaggauuugcucuggacagagauggaagagccgggaacagagaa

SEQ ID NO: 235349 - RNA, 64 nt, hsa
caaacaaacaaaaagagccagugggggagggagggacagagacccagagggcagcgucagacac

SEQ ID NO: 235350 - RNA, 64 nt, hsa
cgcagaagagaggaacagaaauccagaguggggagacagagaccaagagcaggggauagaagcc

SEQ ID NO: 235351 - RNA, 64 nt, hsa
gacccagaaaaaggaagagguggaaacccagagagacagagacccaaagggagagaaacagaga

SEQ ID NO: 235352 - RNA, 64 nt, hsa
ucaugucuacuguuaggugagggagucacagccagacagagaguauugcuggagggugagagaa

SEQ ID NO: 235353 - RNA, 64 nt, hsa
ccacauauccacaagaagugccucuuaggucugugacagagagugugucuccauuccucaguuc

SEQ ID NO: 235354 - RNA, 64 nt, hsa; identical to SEQ ID NO: 56346

SEQ ID NO: 235355 - RNA, 64 nt, hsa; identical to SEQ ID NO: 56347

SEQ ID NO: 235356 - RNA, 64 nt, hsa; identical to SEQ ID NO: 56348

SEQ ID NO: 235357 - RNA, 64 nt, hsa; identical to SEQ ID NO: 56349

SEQ ID NO: 235358 - RNA, 64 nt, hsa; identical to SEQ ID NO: 56350

SEQ ID NO: 235359 - RNA, 64 nt, hsa; identical to SEQ ID NO: 56351

SEQ ID NO: 235360 - RNA, 64 nt, hsa; identical to SEQ ID NO: 56352

SEQ ID NO: 235361 - RNA, 64 nt, hsa; identical to SEQ ID NO: 56353

SEQ ID NO: 235362 - RNA, 64 nt, hsa; identical to SEQ ID NO: 56354

SEQ ID NO: 235363 - RNA, 64 nt, hsa; identical to SEQ ID NO: 56355

SEQ ID NO: 235364 - RNA, 64 nt, hsa; identical to SEQ ID NO: 56356

SEQ ID NO: 235365 - RNA, 64 nt, hsa; identical to SEQ ID NO: 56357

SEQ ID NO: 235366 - RNA, 64 nt, hsa; identical to SEQ ID NO: 56358

SEQ ID NO: 235367 - RNA, 64 nt, hsa; identical to SEQ ID NO: 56359

SEQ ID NO: 235368 - RNA, 64 nt, hsa; identical to SEQ ID NO: 43975

SEQ ID NO: 235369 - RNA, 64 nt, hsa; identical to SEQ ID NO: 43976

SEQ ID NO: 235370 - RNA, 64 nt, hsa; identical to SEQ ID NO: 43977

SEQ ID NO: 235371 - RNA, 64 nt, hsa; identical to SEQ ID NO: 43978

SEQ ID NO: 235372 - RNA, 64 nt, hsa; identical to SEQ ID NO: 43979

SEQ ID NO: 235373 - RNA, 64 nt, hsa; identical to SEQ ID NO: 43980

SEQ ID NO: 235374 - RNA, 64 nt, hsa; identical to SEQ ID NO: 43981

SEQ ID NO: 235375 - RNA, 64 nt, hsa; identical to SEQ ID NO: 43982

SEQ ID NO: 235376 - RNA, 64 nt, hsa; identical to SEQ ID NO: 43983

SEQ ID NO: 235377 - RNA, 64 nt, hsa; identical to SEQ ID NO: 43984

SEQ ID NO: 235378 - RNA, 64 nt, hsa; identical to SEQ ID NO: 43985

SEQ ID NO: 235379 - RNA, 64 nt, hsa; identical to SEQ ID NO: 43986

SEQ ID NO: 235380 - RNA, 64 nt, hsa; identical to SEQ ID NO: 43987

SEQ ID NO: 235381 - RNA, 64 nt, hsa; identical to SEQ ID NO: 43988

SEQ ID NO: 235382 - RNA, 64 nt, hsa; identical to SEQ ID NO: 111411

SEQ ID NO: 235383 - RNA, 64 nt, hsa; identical to SEQ ID NO: 111412

SEQ ID NO: 235384 - RNA, 64 nt, hsa; identical to SEQ ID NO: 111413

SEQ ID NO: 235385 - RNA, 64 nt, hsa; identical to SEQ ID NO: 111414

SEQ ID NO: 235386 - RNA, 64 nt, hsa; identical to SEQ ID NO: 111415

SEQ ID NO: 235387 - RNA, 64 nt, hsa; identical to SEQ ID NO: 111416

SEQ ID NO: 235388 - RNA, 64 nt, hsa; identical to SEQ ID NO: 111417

SEQ ID NO: 235389 - RNA, 64 nt, hsa; identical to SEQ ID NO: 111418

SEQ ID NO: 235390 - RNA, 64 nt, hsa; identical to SEQ ID NO: 111419

SEQ ID NO: 235391 - RNA, 64 nt, hsa; identical to SEQ ID NO: 111420

SEQ ID NO: 235392 - RNA, 64 nt, hsa; identical to SEQ ID NO: 111421

SEQ ID NO: 235393 - RNA, 64 nt, hsa; identical to SEQ ID NO: 111422

SEQ ID NO: 235394 - RNA, 64 nt, hsa; identical to SEQ ID NO: 111423

SEQ ID NO: 235395 - RNA, 64 nt, hsa; identical to SEQ ID NO: 111424

SEQ ID NO: 235396 - RNA, 64 nt, hsa; identical to SEQ ID NO: 111425

SEQ ID NO: 235397 - RNA, 64 nt, hsa; identical to SEQ ID NO: 111426

SEQ ID NO: 235398 - RNA, 64 nt, hsa; identical to SEQ ID NO: 111427

SEQ ID NO: 235399 - RNA, 64 nt, hsa; identical to SEQ ID NO: 111428

SEQ ID NO: 235400 - RNA, 64 nt, hsa; identical to SEQ ID NO: 111429

SEQ ID NO: 235401 - RNA, 64 nt, hsa; identical to SEQ ID NO: 111430

SEQ ID NO: 235402 - RNA, 64 nt, hsa; identical to SEQ ID NO: 111431

SEQ ID NO: 235403 - RNA, 64 nt, hsa; identical to SEQ ID NO: 111432

SEQ ID NO: 235404 - RNA, 64 nt, hsa; identical to SEQ ID NO: 111433

SEQ ID NO: 235405 - RNA, 64 nt, hsa; identical to SEQ ID NO: 111434

SEQ ID NO: 235406 - RNA, 58 nt, hsa; identical to SEQ ID NO: 111435

SEQ ID NO: 235407 - RNA, 64 nt, hsa; identical to SEQ ID NO: 111436

SEQ ID NO: 235408 - RNA, 64 nt, hsa; identical to SEQ ID NO: 111437

SEQ ID NO: 235409 - RNA, 64 nt, hsa; identical to SEQ ID NO: 111438

SEQ ID NO: 235410 - RNA, 64 nt, hsa; identical to SEQ ID NO: 111439

SEQ ID NO: 235411 - RNA, 64 nt, hsa; identical to SEQ ID NO: 111440

SEQ ID NO: 235412 - RNA, 64 nt, hsa; identical to SEQ ID NO: 111441

SEQ ID NO: 235413 - RNA, 64 nt, hsa; identical to SEQ ID NO: 111442

SEQ ID NO: 235414 - RNA, 64 nt, hsa; identical to SEQ ID NO: 111443

SEQ ID NO: 235415 - RNA, 64 nt, hsa; identical to SEQ ID NO: 111444

SEQ ID NO: 235416 - RNA, 64 nt, hsa; identical to SEQ ID NO: 111445

SEQ ID NO: 235417 - RNA, 64 nt, hsa; identical to SEQ ID NO: 111446

SEQ ID NO: 235418 - RNA, 64 nt, hsa; identical to SEQ ID NO: 111447

SEQ ID NO: 235419 - RNA, 64 nt, hsa; identical to SEQ ID NO: 111448

SEQ ID NO: 235420 - RNA, 64 nt, hsa; identical to SEQ ID NO: 111449

SEQ ID NO: 235421 - RNA, 64 nt, hsa; identical to SEQ ID NO: 111450

SEQ ID NO: 235422 - RNA, 64 nt, hsa; identical to SEQ ID NO: 111451

SEQ ID NO: 235423 - RNA, 64 nt, hsa; identical to SEQ ID NO: 111452

SEQ ID NO: 235424 - RNA, 64 nt, hsa; identical to SEQ ID NO: 111453

SEQ ID NO: 235425 - RNA, 64 nt, hsa; identical to SEQ ID NO: 111454

SEQ ID NO: 235426 - RNA, 64 nt, hsa; identical to SEQ ID NO: 111455

SEQ ID NO: 235427 - RNA, 64 nt, hsa; identical to SEQ ID NO: 111456

SEQ ID NO: 235428 - RNA, 64 nt, hsa; identical to SEQ ID NO: 111457

SEQ ID NO: 235429 - RNA, 64 nt, hsa; identical to SEQ ID NO: 111458

SEQ ID NO: 235430 - RNA, 64 nt, hsa; identical to SEQ ID NO: 111459

SEQ ID NO: 235431 - RNA, 52 nt, hsa; identical to SEQ ID NO: 111460

SEQ ID NO: 235432 - RNA, 64 nt, hsa; identical to SEQ ID NO: 111461

SEQ ID NO: 235433 - RNA, 64 nt, hsa; identical to SEQ ID NO: 111462

SEQ ID NO: 235434 - RNA, 64 nt, hsa; identical to SEQ ID NO: 111463

SEQ ID NO: 235435 - RNA, 64 nt, hsa; identical to SEQ ID NO: 111464

SEQ ID NO: 235436 - RNA, 64 nt, hsa; identical to SEQ ID NO: 111465

SEQ ID NO: 235437 - RNA, 64 nt, hsa; identical to SEQ ID NO: 111466

SEQ ID NO: 235438 - RNA, 64 nt, hsa; identical to SEQ ID NO: 111467

SEQ ID NO: 235439 - RNA, 64 nt, hsa
aguuaagaguaguguagaaaugcaugaacuucauccuaauaaggauaaaacuuaaggaaaacca

SEQ ID NO: 235440 - RNA, 64 nt, hsa
caauaauuuaugaauaaguuuccagaacaaauuuccuaauaacacaaucagauugguuuuauuc

SEQ ID NO: 235441 - RNA, 64 nt, hsa
gaaagucagccacugugucuuaugaggaauuggaccuaauaaauuuuagugugccuuccaaacc

SEQ ID NO: 235442 - RNA, 64 nt, hsa
uucccaaguguaauuaucaugcguuuuauaucuuccuaauaagguguggucuguuugucugaac

SEQ ID NO: 235443 - RNA, 64 nt, hsa
aaaacugcuuuucgccuccacucuuacagcugugccuaauaauaauuaauuaauaaacgcacag

SEQ ID NO: 235444 - RNA, 64 nt, hsa
caguguucaaggcaugacuaguauuucuaauuagccuaauaaauucccacacuuucugaaguga

SEQ ID NO: 235445 - RNA, 64 nt, hsa
guuuguuuuagagaaaguuguauuccacacacaaccuaauaauuucuuauaaaaauuuuaaacu

SEQ ID NO: 235446 - RNA, 64 nt, hsa
aauguuucuugauagcacauggcaauaccaucauccuaauaacagaagaucuugcaaagaauca

SEQ ID NO: 235447 - RNA, 64 nt, hsa
uauauuauuuuagguauaauuuacaaaugucacaccuaauaaucuuuuauaauauaccauauuu

SEQ ID NO: 235448 - RNA, 64 nt, hsa
uuacuauuuuguuauauggaaugguuaauuuuuaccuaauaaaaacauagaugaaauacauugu

SEQ ID NO: 235449 - RNA, 64 nt, hsa
guacucgugccuuauauuugugugccaauuaaugccuaauaaauaccaugugcuuaaacaagua

SEQ ID NO: 235450 - RNA, 64 nt, hsa
aaagaauuuuuuuuuuccuuuuuuauaaacagacccuaauaaagagaacaggguaagaugugag

SEQ ID NO: 235451 - RNA, 64 nt, hsa
uucuuuuuccagguuuuauuuucaguuuuaaauuccuaauaaauuauuugaaaacguugcuggg

SEQ ID NO: 235452 - RNA, 64 nt, hsa
uucguguuuuggguuuuuuuuuuuuuuaauguuuccuaauaaaagagaagcugcauuuuauugg

SEQ ID NO: 235453 - RNA, 64 nt, hsa
gacacauuauuuucuucugaacuuggcaauauaaccuaauaaggcagaauaaguuucuguuaaa

SEQ ID NO: 235454 - RNA, 64 nt, hsa
uacuuuuauuacauuucuuaauccauuguuuuuaccuaauaaaauuuccuccucuauauuccaa

SEQ ID NO: 235455 - RNA, 64 nt, hsa
ucauuugaaaucuaggagucaaauggaaagauccccuaauaauacaccuauuucacuaacuugu

SEQ ID NO: 235456 - RNA, 64 nt, hsa
cggcugcagccaucccccucauuuuaaauguugcccuaauaaucaaugcaguuaacaaguauau

SEQ ID NO: 235457 - RNA, 64 nt, hsa
ucgagcugucuugcugagugcccuguguguaaguccuaauaaacuuagcuacucgccaagcugg

SEQ ID NO: 235458 - RNA, 64 nt, hsa
cccuauucauacacucccuccccuuuugaaagucccuaauaaaaacuugcugguuuugcggcuu

SEQ ID NO: 235459 - RNA, 64 nt, hsa
cgcucccaggcuuauuaggaagaggaaauucccgccuaauaaauuuuggucagaccgguugcuc

SEQ ID NO: 235460 - RNA, 64 nt, hsa
caguuuucuugucuucauucagugauauguagggaggaaggagguugauagcauagauggcaac

SEQ ID NO: 235461 - RNA, 64 nt, hsa
cauagauggcaacugauucccaguuuaagauaggaggaaggagagcaauuucuaaguuucaauc

SEQ ID NO: 235462 - RNA, 64 nt, hsa
cagacaggugggagauggagguagggcuggcuggaggaaggaaacaacaaaggaagugagguag

SEQ ID NO: 235463 - RNA, 64 nt, hsa
gacaucugaggaaaauggaagaccuaaggcagacaggaaggaagcacaaaagacaagcauuggg

SEQ ID NO: 235464 - RNA, 64 nt, hsa
ggagcaucugcuguuugaggacgggggguggggaaggaaggaacaugaucccuccagaagucuc

SEQ ID NO: 235465 - RNA, 64 nt, hsa
uggccugcccacaggacaagaaguggguaagggcaggaaggaaaugaacggaguuagcucccag

SEQ ID NO: 235466 - RNA, 64 nt, hsa
cucaagacuacuggucacaaugagucugauuuuuaggaaggaauaggaggagcagggaaaucag

SEQ ID NO: 235467 - RNA, 64 nt, hsa
gcugucauucaaauuggauaggagaaaguuggugaggaaggaauggagagagcaggaucccugg

SEQ ID NO: 235468 - RNA, 64 nt, hsa
auccugggacagucagauucuucuaaaucaggccaggaaggaggggaaaagagugagagaaugg

SEQ ID NO: 235469 - RNA, 64 nt, hsa
gaggugggaggaggggcagaagugaaggaagaauaggaaggauauuaccucuucuguuauuuuu

SEQ ID NO: 235470 - RNA, 64 nt, hsa
guuucaguucugugucaugguuggaagacagaguaggaaggauauggaaaaggucauggggaag

SEQ ID NO: 235471 - RNA, 64 nt, hsa
uuaaaguguuuauuccccauuucuuugagggaucaggaaggaauccuggguaugccauugacuu

SEQ ID NO: 235472 - RNA, 64 nt, hsa
uccucuuggauuuuuugaaauaaucuucagaggaaggaaggaaaauccuauuuugggguaucag

SEQ ID NO: 235473 - RNA, 64 nt, hsa
uuauuccucuuggauuuuuugaaauaaucuucagaggaaggaaggaaaauccuauuuuggggua

SEQ ID NO: 235474 - RNA, 64 nt, hsa
uccacccaccuggagacgaauguagccagagaggaggaaggagggaaacugaagacaccguggc

SEQ ID NO: 235475 - RNA, 64 nt, hsa
gggggaagcagcaggacacauuggcaagucaagcaggaaggagggagauggaaaggggauauca

SEQ ID NO: 235476 - RNA, 64 nt, hsa
uacuggauugcaccaaggaagcuuuuggggaggaaggaaggacauuaaauucuuucccugguaa

SEQ ID NO: 235477 - RNA, 64 nt, hsa
ucuguacuggauugcaccaaggaagcuuuuggggaggaaggaaggacauuaaauucuuucccug

SEQ ID NO: 235478 - RNA, 64 nt, hsa
uuucugcaguagcuagagggacagguuuccuuccaggaaggauucgaguuccugugccuguggg

SEQ ID NO: 235479 - RNA, 64 nt, hsa
auaugccuugagaugccuugaaccaugcuugagaaggaaggacaaacacauuauuaucuuggaa

SEQ ID NO: 235480 - RNA, 64 nt, hsa
aaccauuuuucuaauucuaacaaguuagaaugugaggaaggaaugaacaugaguguuuaggaac

SEQ ID NO: 235481 - RNA, 64 nt, hsa
gacgggccucauggucugcugugcagagagaggcaggaaggaucccugaagagucuuggagaaa

SEQ ID NO: 235482 - RNA, 64 nt, hsa
acaguagcaaauauuuauugacaaauugaaaagcaggaaggaagaggguugugccaagguauug

SEQ ID NO: 235483 - RNA, 64 nt, hsa
gaagcacauacaaaagaagacagggaaugcaaucaggaaggaaagacuuuuuaaaaaauaaaaa

SEQ ID NO: 235484 - RNA, 64 nt, hsa
acacuuagaaagaaaagacagaaaaggaagaggaaggaaggaaauauuuugagaauauauugag

SEQ ID NO: 235485 - RNA, 64 nt, hsa
auacacacuuagaaagaaaagacagaaaaggaagaggaaggaaggaaauauuuugagaauauau

SEQ ID NO: 235486 - RNA, 64 nt, hsa
gcaauaaauuuuuuuuaaaaaacugaaaauacuuaggaaggauccgcauaauuuuuuucugcaa

SEQ ID NO: 235487 - RNA, 64 nt, hsa
auaggcaucacauuuuuguguggauaugaaacuuaggaaggauccucuugacuccuugugaugu

SEQ ID NO: 235488 - RNA, 64 nt, hsa
cccccucagccuggcagccucuggacagagaggaaggaaggauuggaaaaguccccgcagcaca

SEQ ID NO: 235489 - RNA, 64 nt, hsa
guggcccccucagccuggcagccucuggacagagaggaaggaaggauuggaaaaguccccgcag

SEQ ID NO: 235490 - RNA, 64 nt, hsa
agaaggagacagagcugguugggaagacauggggaggaaggacaaggcuagaucaugaagaacc

SEQ ID NO: 235491 - RNA, 64 nt, hsa
ugcagaagguuuacucuguggccaaaggagggucaggaaggaugagcauuuagggcaaggagac

SEQ ID NO: 235492 - RNA, 64 nt, hsa
cacacaccuguaaucccagcuacucgggaggcugaggaaggagaauugcuugaaccugggaggu

SEQ ID NO: 235493 - RNA, 64 nt, hsa
cuuauauacauauuuuuuaaaaguagcuuuacauaggaaggaaguggcauaguuuuaucaauau

SEQ ID NO: 235494 - RNA, 64 nt, hsa
ucaaaaaaaaaccccacaaucuaggaugggaacaaggaaggaaagaugugaauaggcugauggg

SEQ ID NO: 235495 - RNA, 64 nt, hsa
gucaacauagugagacacugucucuaccaaaaaaaggaaggaagggacacauaucaaacugaaa

SEQ ID NO: 235496 - RNA, 64 nt, hsa
auuugucuaaauugccccuuuuucuguuccuaaaaggaaggauaagagagaacauuccagguga

SEQ ID NO: 235497 - RNA, 64 nt, hsa
ugcaaacuggaggugaggcggaggaaaggcagguaggaaggaguaaggauggagaugcucagaa

SEQ ID NO: 235498 - RNA, 64 nt, hsa
cccuggaucccaggagaaaggaguggaccgaggaaggaaggaaggcaaggcugucuguccaucc

SEQ ID NO: 235499 - RNA, 64 nt, hsa
ccaacccuggaucccaggagaaaggaguggaccgaggaaggaaggaaggcaaggcugucugucc

SEQ ID NO: 235500 - RNA, 64 nt, hsa
uucaaugugaagcuguguguggugucaaaguuucaggaaggauuuuacccuuuuguucuucccc

SEQ ID NO: 235501 - RNA, 64 nt, hsa
uuccagaccguuacgugucuccuggccaagccccaggaaggaaaugaugcagcucuggcuccuu

SEQ ID NO: 235502 - RNA, 64 nt, hsa
uucuuuaagcuuuuuuuuuuuaaugucaugaaucaggaaggauacauagugauucguauacaau

SEQ ID NO: 235503 - RNA, 64 nt, hsa
agugagcaccaaaaacuucauuaaucaccuuaucaggaaggaauauccugccauaguaaaauug

SEQ ID NO: 235504 - RNA, 64 nt, hsa
aucccaaguuucccaggcacuuuuggccaaaggaaggaaggaacuaauucuucauuuuaaaaau

SEQ ID NO: 235505 - RNA, 64 nt, hsa
cuucaucccaaguuucccaggcacuuuuggccaaaggaaggaaggaacuaauucuucauuuuaa

SEQ ID NO: 235506 - RNA, 64 nt, hsa
guccaucagguuuucuguugcacaaggacgggucaggaaggaaggagaggcuuuuccagaaaca

SEQ ID NO: 235507 - RNA, 64 nt, hsa
aucagguuuucuguugcacaaggacgggucaggaaggaaggagaggcuuuuccagaaacaaaaa

SEQ ID NO: 235508 - RNA, 64 nt, hsa
gcuagcuaagaagccgagguucagugguggcagcaggaaggacacugccacaaauuuugucuau

SEQ ID NO: 235509 - RNA, 64 nt, hsa
aaccuuucagcacauuccaagguuuuaguuacucaggaaggaguuaauuaaaaugauuuuauuu

SEQ ID NO: 235510 - RNA, 64 nt, hsa
cuucagugaauucuaagaaggaaggaaggaagaaaggaaggaaagaagggagggaaacagggag

SEQ ID NO: 235511 - RNA, 64 nt, hsa
accuaggaaauacuucagugaauucuaagaaggaaggaaggaagaaaggaaggaaagaagggag

SEQ ID NO: 235512 - RNA, 64 nt, hsa
ggcuaccuaggaaauacuucagugaauucuaagaaggaaggaaggaagaaaggaaggaaagaag

SEQ ID NO: 235513 - RNA, 64 nt, hsa
ccugagggccaugaaagccacagaggaugggcugaggaaggaaagaaaugggguuacugcuccc

SEQ ID NO: 235514 - RNA, 64 nt, hsa
cacuaucacugccuucuuuauauaaaggcuaauaaggaaggaguguuauuuauggcuuugccaa

SEQ ID NO: 235515 - RNA, 64 nt, hsa
agaagggcccaggaaggaugcucucauaaggcccaggaaggaugcucucauaagcaccuugguc

SEQ ID NO: 235516 - RNA, 64 nt, hsa
ccauccacggccuuuucuggcaagagaagggcccaggaaggaugcucucauaaggcccaggaag

SEQ ID NO: 235517 - RNA, 64 nt, hsa
cccaggaggccaagccugaaaacagaggggagggaggaaggaaggagucccagcaggagcacag

SEQ ID NO: 235518 - RNA, 64 nt, hsa
ggaggccaagccugaaaacagaggggagggaggaaggaaggagucccagcaggagcacagcccu

SEQ ID NO: 235519 - RNA, 64 nt, hsa
ucuacuuucccuauucuuauggagguaaaaggaaaggaaggaaggaaaaagcagcuuucacuua

SEQ ID NO: 235520 - RNA, 64 nt, hsa
cuuucccuauucuuauggagguaaaaggaaaggaaggaaggaaaaagcagcuuucacuuacaaa

SEQ ID NO: 235521 - RNA, 64 nt, hsa
gaaacagcuuuucuuguguccuuaagacaaaauaaggaaggaaaacguagcugcaguuguccac

SEQ ID NO: 235522 - RNA, 64 nt, hsa
aaucacugccaaagucaagcguaacgugucagagaggaaggaucaccgaccugaaacaccaagc

SEQ ID NO: 235523 - RNA, 64 nt, hsa
aaaacccgcuaugaaauguaugucagcauucucaaggaaggaggcaaagagcuacugaguaacg

SEQ ID NO: 235524 - RNA, 64 nt, hsa
gcccagaggccggggccaggcucugggucaaggcaggaaggagacagacagcuggcaguuccuc

SEQ ID NO: 235525 - RNA, 64 nt, hsa
ggagaaggagcuguggccugucuuucagugaaagaggaaggaaaggaguagggcuagugaaugu

SEQ ID NO: 235526 - RNA, 64 nt, hsa
ggaaggccuaggcuaggacguuggccucagggccaggaaggacagacuggccgggcaggcguga

SEQ ID NO: 235527 - RNA, 64 nt, hsa
ccgggcaggcgugacucagcagccugcgcucggcaggaaggagcggcgcccuggacuugguaca

SEQ ID NO: 235528 - RNA, 64 nt, hsa
ucugagaaaaugaggcagagcauggaaaaggaauaggaaggagaaauuaauugagauuuucagg

SEQ ID NO: 235529 - RNA, 64 nt, hsa
agccccuuccccuucccucucguggcccacaaggaggaaggaagggcaaccuaaaagcccacuu

SEQ ID NO: 235530 - RNA, 64 nt, hsa
auauuuaagagauguacacauguguaauauaggaaggaaggauguaaagugguaugaucugggg

SEQ ID NO: 235531 - RNA, 64 nt, hsa
auaaauauuuaagagauguacacauguguaauauaggaaggaaggauguaaagugguaugaucu

SEQ ID NO: 235532 - RNA, 64 nt, hsa
aaauuauguuuuaauuccaaguguuucuguuucaaggaaggaugaauaaguuuuauugaaaaug

SEQ ID NO: 235533 - RNA, 64 nt, hsa
ggcgaggacgugaagccucccgaacacgcacagaaggaaggagccagcucccagcccacucauc

SEQ ID NO: 235534 - RNA, 64 nt, hsa
gggagacucugucucgaaagaaagaaagaaaaaaaggaaggaaggagaaggaaggaaggagaag

SEQ ID NO: 235535 - RNA, 64 nt, hsa
gacucugucucgaaagaaagaaagaaaaaaaggaaggaaggagaaggaaggaaggagaagaaaa

SEQ ID NO: 235536 - RNA, 64 nt, hsa
cgaaagaaagaaagaaaaaaaggaaggaaggagaaggaaggaaggagaagaaaagguaccuguu

SEQ ID NO: 235537 - RNA, 64 nt, hsa
agaaagaaagaaaaaaaggaaggaaggagaaggaaggaaggagaagaaaagguaccuguucuac

SEQ ID NO: 235538 - RNA, 64 nt, hsa
gauaauuggacaaagagagagaaagaaagaaggaaggaaggaaaaacuuguuacugaaagagac

SEQ ID NO: 235539 - RNA, 64 nt, hsa
uauugauaauuggacaaagagagagaaagaaagaaggaaggaaggaaaaacuuguuacugaaag

SEQ ID NO: 235540 - RNA, 64 nt, hsa
cacggucuuggauauaaguaacucuuggccucagaggaaggaaaagcaacucaacacucauggu

SEQ ID NO: 235541 - RNA, 64 nt, hsa
uguuguuuuaauuaguauuuguguaguucaaaccaggaaggauuugacuaucauuagauuuugc

SEQ ID NO: 235542 - RNA, 64 nt, hsa
gagggagcugcuggcccgcucuaaggggugcaagaggaaggagugugcccagaccagcuggggg

SEQ ID NO: 235543 - RNA, 64 nt, hsa
caaaugauguauggggagaggagaaggaagggcaaggaaggaauugacagauaagaagcaaaug

SEQ ID NO: 235544 - RNA, 64 nt, hsa
cggaaggaggaggaaggaaggacggaagcaaggaaggaaggaagggcugcuggagcccagucac

SEQ ID NO: 235545 - RNA, 64 nt, hsa
cagacggaaggaggaggaaggaaggacggaagcaaggaaggaaggaagggcugcuggagcccag

SEQ ID NO: 235546 - RNA, 64 nt, hsa
augcaggaaggaggugcagacggaaggaggaggaaggaaggacggaagcaaggaaggaaggaag

SEQ ID NO: 235547 - RNA, 64 nt, hsa
ccggaugcaggaaggaggugcagacggaaggaggaggaaggaaggacggaagcaaggaaggaag

SEQ ID NO: 235548 - RNA, 64 nt, hsa
cagcacaagcucaggacauggaggugccggaugcaggaaggaggugcagacggaaggaggagga

SEQ ID NO: 235549 - RNA, 64 nt, hsa
guuuaugcuuuuuaaaaacacacguuaacuucagaggaaggaugggcaaaucuggucuagcugg

SEQ ID NO: 235550 - RNA, 64 nt, hsa
gaagagaggaaugacuugaaggcaaaggaaacuaaggaaggagguucagugaggaaaauaaggu

SEQ ID NO: 235551 - RNA, 64 nt, hsa
cauccaucaagagagacagagcgcacaauggagcaggaaggauaaaaaauaaagaaagacagag

SEQ ID NO: 235552 - RNA, 64 nt, hsa
uuucugccuacaccguucaucagccccauaacccaggaaggaacaggcauuguuagcaucagau

SEQ ID NO: 235553 - RNA, 64 nt, hsa
uugccuuguuuguuaguuugccugggucugucugaggaaggagggggucccgccuuccaccuca

SEQ ID NO: 235554 - RNA, 64 nt, hsa
gggaugggcgcuuuccucucugguugugaacgaaaggaaggaacaucuuucuauggcuaacaaa

SEQ ID NO: 235555 - RNA, 64 nt, hsa
guaugcuuugggcuuucuccuucuguggccccggaggaaggagagacugaggcaaggcaaagug

SEQ ID NO: 235556 - RNA, 64 nt, hsa
uccugcauuguuucaagacugacauuuuuuccuaaggaaggaaauaaucaucuaagaccacgaa

SEQ ID NO: 235557 - RNA, 64 nt, hsa
ccucaaguccaaggcuuuaucuuuggagaaggcaaggaaggaggcggugacagacgggcugaag

SEQ ID NO: 235558 - RNA, 64 nt, hsa
gggggcgacuaccccagugccccccccgcuccagaggaaggaaagcugugggggacggggggca

SEQ ID NO: 235559 - RNA, 64 nt, hsa
cggugagggcuuggaaggagacaggaauggggcgaggaaggagccaggcccggcaugaggaccu

SEQ ID NO: 235560 - RNA, 64 nt, hsa
uaccuucaaugaauuaauucagauguuuuacgcaaggaaggacuuacccaguauuacugcugcu

SEQ ID NO: 235561 - RNA, 64 nt, hsa
gcaggagcagggcggcugccgacucccccaaccaaggaaggagccccugaguccgccugcgccu

SEQ ID NO: 235562 - RNA, 64 nt, hsa
ugaaacccgauaaaaucaggaacaugauauaggaaggaaggauuguaggagauuugugggggaa

SEQ ID NO: 235563 - RNA, 64 nt, hsa
aaaaugaaacccgauaaaaucaggaacaugauauaggaaggaaggauuguaggagauuuguggg

SEQ ID NO: 235564 - RNA, 64 nt, hsa
uauugcccacuguucucauagcuaaaaguuaagaaggaaggaaggaaagcaggagaaaggaagg

SEQ ID NO: 235565 - RNA, 64 nt, hsa
gcccacuguucucauagcuaaaaguuaagaaggaaggaaggaaagcaggagaaaggaaggauua

SEQ ID NO: 235566 - RNA, 64 nt, hsa
aaaaguuaagaaggaaggaaggaaagcaggagaaaggaaggauuaauugccuguaugugaggac

SEQ ID NO: 235567 - RNA, 64 nt, hsa
caaaacccaggagguagcuggcagaguagcugucaggaaggagaaagguucuuucuggcugguu

SEQ ID NO: 235568 - RNA, 64 nt, hsa
cuucacauggggcaccaggaacaccgucuggaacaggaaggacaucgggcaggacugacacugu

SEQ ID NO: 235569 - RNA, 64 nt, hsa
aucugcaccuuacaacucggggacaaauggggacaggaaggaucaaguuguagagagaaaaaga

SEQ ID NO: 235570 - RNA, 64 nt, hsa
acgcuugagguccccggagcucccgggcacauccaggaaggaccuugcuuuggacccuacacac

SEQ ID NO: 235571 - RNA, 64 nt, hsa
augcuguguggcuucagacccaaacaaggcccugaggaaggagacucucauuuccccaagcaua

SEQ ID NO: 235572 - RNA, 64 nt, hsa
uggauucccacuucuuaccucauggagccuguugaggaaggauugagcugaugacuuaagggca

SEQ ID NO: 235573 - RNA, 64 nt, hsa
aagagagguguucuuuuuccuuacuggugcugaaaggaaggauggauaacgaggagaaaauaaa

SEQ ID NO: 235574 - RNA, 64 nt, hsa
ucucaaaggaagccacaaggcgcgggggccacugaggaaggaaauguucauuuucauuugucca

SEQ ID NO: 235575 - RNA, 64 nt, hsa
ccaaguguguaccucauucuucccuuaucacugaaggaaggaagaguccagaagggccacagag

SEQ ID NO: 235576 - RNA, 64 nt, hsa
ccagaggacacacaggggagacgccccagucugcaggaaggaugaguaagucauuaguaauaaa

SEQ ID NO: 235577 - RNA, 64 nt, hsa
gagcggggagcacugaugaggugcuggggaugacaggaaggaaggaacacugggcagaaccaga

SEQ ID NO: 235578 - RNA, 64 nt, hsa
ggggagcacugaugaggugcuggggaugacaggaaggaaggaacacugggcagaaccagagaga

SEQ ID NO: 235579 - RNA, 64 nt, hsa
gagaggaagggaagguggcagaaagucucauuucaggaaggagggauagaaggaaggaaggaag

SEQ ID NO: 235580 - RNA, 64 nt, hsa
ggcagaaagucucauuucaggaaggagggauagaaggaaggaaggaaggaaccccccccccccc

SEQ ID NO: 235581 - RNA, 64 nt, hsa
gaaagucucauuucaggaaggagggauagaaggaaggaaggaaggaacccccccccccccgaaa

SEQ ID NO: 235582 - RNA, 64 nt, hsa
gucucauuucaggaaggagggauagaaggaaggaaggaaggaacccccccccccccgaaaaaaa

SEQ ID NO: 235583 - RNA, 64 nt, hsa
gccaguuugaugcagcacuucagaucaagugcuuaggaaggagaggaaacuugccuuuuuuaug

SEQ ID NO: 235584 - RNA, 64 nt, hsa
auuuucuccuguggagcccuagagcagguuacuaaggaaggacacauuguuuuccagaagccuc

SEQ ID NO: 235585 - RNA, 64 nt, hsa
cugcugaugcgcugggaucugauugaggauaaaaaggaaggagagaugaccccuacccccucau

SEQ ID NO: 235586 - RNA, 64 nt, hsa
gcacugggcgucugacucccuccccacccaagagaggaaggaccccucaccacccccacuggug

SEQ ID NO: 235587 - RNA, 64 nt, hsa
aauacucugugcacggaggaaagacaugcccaagaggaaggaaguacugaccaucggcugccug

SEQ ID NO: 235588 - RNA, 64 nt, hsa
agggacccgacuugcagacgcauugcccgguacuaggaaggagugagguguguucccaccguac

SEQ ID NO: 235589 - RNA, 64 nt, hsa
cccccuccccggccagccugaggcugccugaggaaggaaggacccgcuuccuguugucggugcu

SEQ ID NO: 235590 - RNA, 64 nt, hsa
cccacccccuccccggccagccugaggcugccugaggaaggaaggacccgcuuccuguugucgg

SEQ ID NO: 235591 - RNA, 64 nt, hsa
ggaccccaggucuucccuggaggcagccuccugaaggaaggaagauucagucuccacugagagg

SEQ ID NO: 235592 - RNA, 54 nt, hsa
ggacagccagccagcgcugagugcaggaaggaccccaggucuucccuggaggca

SEQ ID NO: 235593 - RNA, 64 nt, hsa
cucacgccuauacacccagcacuuuggaaggcugaggaaggaggaucgcuugaggccaggaguu

SEQ ID NO: 235594 - RNA, 64 nt, hsa
gagaaagaaagaaagaaagaaagggaaagauggaaggaaggaaggaaaaagaaagagaaagaga

SEQ ID NO: 235595 - RNA, 64 nt, hsa
aagaaagaaagaaagaaagggaaagauggaaggaaggaaggaaaaagaaagagaaagagagaga

SEQ ID NO: 235596 - RNA, 64 nt, hsa
caaauggugcucagugcuccaaggaaaggaaggaaggaaggaaaaggaggggagaggaggggaa

SEQ ID NO: 235597 - RNA, 64 nt, hsa
cuuccaaauggugcucagugcuccaaggaaaggaaggaaggaaggaaaaggaggggagaggagg

SEQ ID NO: 235598 - RNA, 64 nt, hsa
caagcuuccaaauggugcucagugcuccaaggaaaggaaggaaggaaggaaaaggaggggagag

SEQ ID NO: 235599 - RNA, 64 nt, hsa
ggucuggaguucuggcuacuugaggaccaaaggcaggaaggauccugccuugauuuuacuucag

SEQ ID NO: 235600 - RNA, 64 nt, hsa
agaaagaaacaggcuggggccuggauucugaggcaggaaggaauuugggucuggaguucuggcu

SEQ ID NO: 235601 - RNA, 64 nt, hsa
uuuuuuuccuaaaagauaauguuuauuuuuaaaaaggaaggaaggagcaagugaaguuucauuc

SEQ ID NO: 235602 - RNA, 64 nt, hsa
uuuccuaaaagauaauguuuauuuuuaaaaaggaaggaaggagcaagugaaguuucauucugcu

SEQ ID NO: 235603 - RNA, 64 nt, hsa
aauguagcuucucaggggaggcaggaagaaaggaaggaaggaaagaaggaagggaggacccaau

SEQ ID NO: 235604 - RNA, 64 nt, hsa
caaaaauguagcuucucaggggaggcaggaagaaaggaaggaaggaaagaaggaagggaggacc

SEQ ID NO: 235605 - RNA, 64 nt, hsa
gccagagggagagcuuggucucuggaccugccuuaggaaggagagggagggcaggaaggaaaag

SEQ ID NO: 235606 - RNA, 64 nt, hsa
ucucuggaccugccuuaggaaggagagggagggcaggaaggaaaagaaaggacuuggagguggc

SEQ ID NO: 235607 - RNA, 64 nt, hsa
cucccccacuggagugauuucagugaaucagacaaggaaggauguguaggaucacuacugcauu

SEQ ID NO: 235608 - RNA, 64 nt, hsa
cacuuuuuuuaauuuaauuuuauuuuuuauuuaaaggaaggaacaauagcuagguaagauuuuu

SEQ ID NO: 235609 - RNA, 64 nt, hsa
uuuuucucagagccuugcaugucaguaaacaggaaggaaggaggccaucuguucaaaaauugug

SEQ ID NO: 235610 - RNA, 64 nt, hsa
auuauuuuucucagagccuugcaugucaguaaacaggaaggaaggaggccaucuguucaaaaau

SEQ ID NO: 235611 - RNA, 64 nt, hsa
cccggagucccccagcacagucccaggagaugacaggaaggaagcaccagggcaaggcggacgc

SEQ ID NO: 235612 - RNA, 64 nt, hsa
accuuccuggcaagaggcagaccccggggcccucaggaaggagggaguuggcagcgggggcugc

SEQ ID NO: 235613 - RNA, 64 nt, hsa
ggaaggagggaagaaaagaaagcaaaggaacagaaggaaggaaagaaagaugggaggaagugca

SEQ ID NO: 235614 - RNA, 64 nt, hsa
gcggagaggggagaagaaggaagggaagggcagaaggaaggagggaagaaaagaaagcaaagga

SEQ ID NO: 235615 - RNA, 64 nt, hsa
gggacaccuggagcccccaggagcugggagaggcaggaaggauccuccccuagagccuccaggg

SEQ ID NO: 235616 - RNA, 64 nt, hsa
gggaugccuggaguccccaggagcugggagaggcaggaaggacccuccccuagagucucuggag

SEQ ID NO: 235617 - RNA, 65 nt, hsa; identical to SEQ ID NO: 65698

SEQ ID NO: 235618 - RNA, 65 nt, hsa; identical to SEQ ID NO: 65699

SEQ ID NO: 235619 - RNA, 65 nt, hsa; identical to SEQ ID NO: 65706

SEQ ID NO: 235620 - RNA, 65 nt, hsa; identical to SEQ ID NO: 65707

SEQ ID NO: 235621 - RNA, 65 nt, hsa; identical to SEQ ID NO: 65720

SEQ ID NO: 235622 - RNA, 65 nt, hsa; identical to SEQ ID NO: 65721

SEQ ID NO: 235623 - RNA, 65 nt, hsa; identical to SEQ ID NO: 65744

SEQ ID NO: 235624 - RNA, 65 nt, hsa; identical to SEQ ID NO: 65745

SEQ ID NO: 235625 - RNA, 65 nt, hsa; identical to SEQ ID NO: 65788

SEQ ID NO: 235626 - RNA, 65 nt, hsa; identical to SEQ ID NO: 65789

SEQ ID NO: 235627 - RNA, 65 nt, hsa; identical to SEQ ID NO: 65808

SEQ ID NO: 235628 - RNA, 65 nt, hsa; identical to SEQ ID NO: 65809

SEQ ID NO: 235629 - RNA, 65 nt, hsa; identical to SEQ ID NO: 65810

SEQ ID NO: 235630 - RNA, 65 nt, hsa; identical to SEQ ID NO: 65811

SEQ ID NO: 235631 - RNA, 65 nt, hsa; identical to SEQ ID NO: 65827

SEQ ID NO: 235632 - RNA, 65 nt, hsa; identical to SEQ ID NO: 65828

SEQ ID NO: 235633 - RNA, 65 nt, hsa; identical to SEQ ID NO: 65831

SEQ ID NO: 235634 - RNA, 56 nt, hsa; identical to SEQ ID NO: 61369

SEQ ID NO: 235635 - RNA, 65 nt, hsa; identical to SEQ ID NO: 65853

SEQ ID NO: 235636 - RNA, 65 nt, hsa; identical to SEQ ID NO: 65854

SEQ ID NO: 235637 - RNA, 65 nt, hsa; identical to SEQ ID NO: 65891

SEQ ID NO: 235638 - RNA, 65 nt, hsa; identical to SEQ ID NO: 65892

SEQ ID NO: 235639 - RNA, 65 nt, hsa; identical to SEQ ID NO: 65896

SEQ ID NO: 235640 - RNA, 65 nt, hsa; identical to SEQ ID NO: 65897

SEQ ID NO: 235641 - RNA, 64 nt, hsa
auauccugaugcaucuguuucaccauuuugauuuuuaaaguaugcuguagcauuucuuaauaac

SEQ ID NO: 235642 - RNA, 64 nt, hsa
aauaaauuauaggcucauuuuguucucugcuaguuuaaaguaauucguuuaauaauagaugugu

SEQ ID NO: 235643 - RNA, 64 nt, hsa
ucugaccaaucaaguacacuaaauuagaauauuuuuaaaguauguaacauucccaguuucagcc

SEQ ID NO: 235644 - RNA, 64 nt, hsa
aacuguguuuuuuaauuaaucaauaacugcaaaauuaaaguaccuucaauggauaagacaauug

SEQ ID NO: 235645 - RNA, 64 nt, hsa
gauaaaaacaaaauauuuuggaguguuuuccaacuuaaaguaugaagacauacucaguucuugg

SEQ ID NO: 235646 - RNA, 64 nt, hsa
uuuccuaaucuuuccuauuucuuaacaaaagauuuuaaaguacuucucuagucauugaaguuuu

SEQ ID NO: 235647 - RNA, 64 nt, hsa
accaaguauugaauaaagagaguuaauuaucuuuuuaaaguaaauaaaauuaugaaaauauaua

SEQ ID NO: 235648 - RNA, 64 nt, hsa
uaacugguaagcgauuugaaacacuauuuuuauauuaaaguaaauggcauggaguauagugcaa

SEQ ID NO: 235649 - RNA, 64 nt, hsa
uucgugaacauagaguuuggggccgaaaauguuuuuaaaguauguguuugaguuaaauauaaag

SEQ ID NO: 235650 - RNA, 64 nt, hsa
gccuaauaugagucauguuauuucuagauugaauuuaaaguaaguauggauuauggaagucuag

SEQ ID NO: 235651 - RNA, 64 nt, hsa
ugguguacuuugcaagaaauaagcacucuaauuuuuaaaguaaaucucuuauuuuagcaaauau

SEQ ID NO: 235652 - RNA, 64 nt, hsa
ugugagccaccgugccuagccaaggaugagauuuuuaaaguauguuucaguucugugucauggu

SEQ ID NO: 235653 - RNA, 64 nt, hsa
aggucauuuggagaacaagugcuuuaguaguaguuuaaaguaguaacugcuacuguauuuagug

SEQ ID NO: 235654 - RNA, 64 nt, hsa
cuggcuuuaugguauuccauuagguucuuuucauuuaaaguagucuuaaaaucaaaguauccaa

SEQ ID NO: 235655 - RNA, 64 nt, hsa
accaacccaauuacaggggauaaauguaagcuuguuaaaguaagcaccacaccauguuucuguc

SEQ ID NO: 235656 - RNA, 64 nt, hsa
gauccuuagauuugcauuaaaauauagaagucuuuuaaaguaaaugugaaccuugucuaaguac

SEQ ID NO: 235657 - RNA, 64 nt, hsa
uauuuuuauaacuucccugaugaauaaucugauauuaaaguaguauuuggacccagagccagaa

SEQ ID NO: 235658 - RNA, 64 nt, hsa
uuuuucugagaugcucacuuuauuaucccuauuuuuaaaguacacaauuguuuuaccuguucug

SEQ ID NO: 235659 - RNA, 64 nt, hsa
uuauaaggaaauguauuuugacacugguaucuuauuaaaguauucugauccuaccacugcuggu

SEQ ID NO: 235660 - RNA, 64 nt, hsa
caaaccugcacguugugcacauguacccuagaacuuaaaguauauaaaaaaaagaaaccuugca

SEQ ID NO: 235661 - RNA, 64 nt, hsa
gugugccacuacacccggcuaauuuuuguacuuuuuaaaguagagacggggcuuugccauauug

SEQ ID NO: 235662 - RNA, 64 nt, hsa
ugauguauauuuaaguuauuuuuguuuuuauagauuaaaguaagauuaaaauauacuauccagu

SEQ ID NO: 235663 - RNA, 64 nt, hsa
uucuuuggucuuucauaugcauuaguuaaaucccuuaaaguagacauucauaaaaacuuacauu

SEQ ID NO: 235664 - RNA, 64 nt, hsa
agacucauugguacugacuggcaaguauucugcuuuaaaguaucauguauuaaaauguuuagac

SEQ ID NO: 235665 - RNA, 64 nt, hsa
cuugaacugugcuacaaguaggggaaaaccuacuuuaaaguaugguaaauguguguuuuaaacu

SEQ ID NO: 235666 - RNA, 64 nt, hsa
uguauguagcuuucuaggaaaauuuuacagacacuuaaaguauuuaugcuuaagugugcauuuu

SEQ ID NO: 235667 - RNA, 64 nt, hsa
accaaggaauacuauauaaaguaaugagacugguuuaaaguaacaugccagaacuuacgcaucc

SEQ ID NO: 235668 - RNA, 64 nt, hsa
ccucaaguccaguccucuaucacuuuugcaugaauuaaaguauauagcgcaaaagagcaccuaa

SEQ ID NO: 235669 - RNA, 64 nt, hsa
guuucuuucaagaaaauauauuuggauggccuuuuuaaaguaacaggauauuuaauaagagucc

SEQ ID NO: 235670 - RNA, 64 nt, hsa
aaaguaggugauauaagaccauuugcuguuuuuauuaaaguauguguguguaucagugucucaa

SEQ ID NO: 235671 - RNA, 64 nt, hsa
aguucuuucacuuacccuuuuuauuagucagcuuuuaaaguaauuguuuuacugagccuucuga

SEQ ID NO: 235672 - RNA, 64 nt, hsa
uuuaaaaaaucuguuguuccaaauguguauaauuuuaaaguaauuucuaaagcaguuuauuaua

SEQ ID NO: 235673 - RNA, 64 nt, hsa
uuuauuuauaguuaauaaucuaugaugaagguaauuaaaguagauuauggccuuuuuaaguauu

SEQ ID NO: 235674 - RNA, 64 nt, hsa
guaaaaagguuaauaucaaguaacuuauuagcucuuaaaguaaaauugaacuuauuaaaagcua

SEQ ID NO: 235675 - RNA, 64 nt, hsa
aguagauuuuuuaccauguuaaauuauagugagauuaaaguauuacuaaacugugaugcuaugu

SEQ ID NO: 235676 - RNA, 64 nt, hsa
aauuuguuauggauuagucuuuuugaaaguaccauuaaaguaaauuuauuucuuuaaacaugau

SEQ ID NO: 235677 - RNA, 64 nt, hsa
aauguuuacuuuuuaggacagaacaguagcuaaauuaaaguaauauccaguucuuacugauuga

SEQ ID NO: 235678 - RNA, 64 nt, hsa
guuaaaaauacaaauguacuauauuguagucauuuuaaaguacacaaagggcacaaucaaaaug

SEQ ID NO: 235679 - RNA, 64 nt, hsa
guuuccuuuugaauuuuaaguaucauaaauauuuuuaaaguaaauaauacggggugucaguaau

SEQ ID NO: 235680 - RNA, 64 nt, hsa
ucuuuuucugcuuucauuuuaauuuugggaaauuuuaaaguaaaaguuucaaaguugaaagauu

SEQ ID NO: 235681 - RNA, 64 nt, hsa
uggagggaaguagauaagaauguauuaguguauuuuaaaguaauaaugauuaaagaauaacuaa

SEQ ID NO: 235682 - RNA, 64 nt, hsa
cagccaaggaaaaaugauacugcaacuuuaaaauuuaaaguaucuugcacugauaaauauauuu

SEQ ID NO: 235683 - RNA, 64 nt, hsa
ugcauaggcaaagaaggauuaggcuguuuucuuuuuaaaguacuguagccucaguacuggugua

SEQ ID NO: 235684 - RNA, 64 nt, hsa
ugccuaaaauuuuauuuuuaaaaaggaaaauuguuuaaaguauuauauguaaacauauggguau

SEQ ID NO: 235685 - RNA, 64 nt, hsa
caugggaauauuuuuuccuuaaaacagaaaaaaauuaaaguauuauuaauaauauaugucugua

SEQ ID NO: 235686 - RNA, 64 nt, hsa
cuuuaucuaggaguuuguuuuucauuuuguuuuuuuaaaguauuagaaaagguuuuagcugaaa

SEQ ID NO: 235687 - RNA, 64 nt, hsa
gugacccuuuauacauuucauuuuuuauuugauauuaaaguaugagauagaguugagagacaau

SEQ ID NO: 235688 - RNA, 64 nt, hsa
aaaaagaaaaaaaagaaagcauagacauauuuuuuuaaaguauaaaaacaacaauucuauagau

SEQ ID NO: 235689 - RNA, 64 nt, hsa
ggucaaauuucuguucucucuuccccaaauaauauuaaaguauuauuugaacuuuuuaagauga

SEQ ID NO: 235690 - RNA, 64 nt, hsa
uauaagccacuugucuugaaaacugugcaacuuuuuaaaguaaauuauuaagcagacuggaaaa

SEQ ID NO: 235691 - RNA, 64 nt, hsa
cuuuuucaucccagaccaauggcauuauuaggucuuaaaguaguuacucccuucucguguuugc

SEQ ID NO: 235692 - RNA, 64 nt, hsa
ucuacauucuugguuguuaauuuagagcguuugguuaaaguauguccuucagcugacuccagua

SEQ ID NO: 235693 - RNA, 64 nt, hsa
uauuucucuggcaaacuuuucuuucuuuucuuuuuuaaaguaaacuuguguauugagucuuaac

SEQ ID NO: 235694 - RNA, 64 nt, hsa
caaaccugcacauucagcacauguaucccagaacuuaaaguauaauaaaaauaaauaaauaauu

SEQ ID NO: 235695 - RNA, 64 nt, hsa
aaaauauuaaauauuuucuuauuuauuuuuuugauuaaaguauaaauuaagacacccuauugac

SEQ ID NO: 235696 - RNA, 64 nt, hsa
uucuuuccaaagcaaugucuaaaaacucuuuuuuuuaaaguaacaguuugguauguuuauugua

SEQ ID NO: 235697 - RNA, 64 nt, hsa
guuauucguauuuugcuaauaucaacugcauggauuaaaguagucccuccauacauggggaagu

SEQ ID NO: 235698 - RNA, 64 nt, hsa
gcgaauguaggaccucugaguggcuguauaauuguuaauucaaaugaaauucauuuaaacaguu

SEQ ID NO: 235699 - RNA, 64 nt, hsa
ucaauuuaaaaaaucacguuagccuccaaaccauuuaauucaaaugaacccaucaacuggaugc

SEQ ID NO: 235700 - RNA, 64 nt, hsa
uuguauuuuuuaauuuuugaauuugacauugaguuuaauucagcaacaacaaaaaauacauaua

SEQ ID NO: 235701 - RNA, 64 nt, hsa
agaaaauacuuaauacacauuuguugacuuaaauuuaauucaaggauugaaaaauuaacuggau

SEQ ID NO: 235702 - RNA, 64 nt, hsa
gcuuccacuucacccaaaauguuaaaauuuuuacuuaauucauagccuuccuugguuucauauu

SEQ ID NO: 235703 - RNA, 64 nt, hsa
ucauagccuuccuugguuucauauuuguuugcauuuaauucauguuugagucucuuaacugaug

SEQ ID NO: 235704 - RNA, 64 nt, hsa
auuuucuaccugauacuuaagccaguggccuacuuuaauucacaauuccauuuugauuagcagg

SEQ ID NO: 235705 - RNA, 64 nt, hsa
aauagcaacuuuaucaaagugacuguacugcaaauuaauucauaaugccugauaguuuuauaua

SEQ ID NO: 235706 - RNA, 64 nt, hsa
auugauggccaucacaaugcagcuuugguuuaauuuaauucaggccugcugcugaguuaugcac

SEQ ID NO: 235707 - RNA, 64 nt, hsa
auaaauaugucucuuuauuuuuaaaaaugaaaucuuaauucauuuacucuauuugaugauaaac

SEQ ID NO: 235708 - RNA, 64 nt, hsa
uauacagcaauuacuuuucaaaauuaauuuuuuauuaauucaugaugauaaauacauaguauuc

SEQ ID NO: 235709 - RNA, 64 nt, hsa
guucgcaacaucaaguaguaccaguuuuaagguuuuaauucauuugaaucacuuaugaauugau

SEQ ID NO: 235710 - RNA, 64 nt, hsa
agauuuugaguuaugguuauugguuucagauugauuaauucacauaugcuguguuuugaaauga

SEQ ID NO: 235711 - RNA, 64 nt, hsa
ucccuauagacauauuaauauuccaaucauaacuuuaauucaagaaugcaguuuuaccaaaaga

SEQ ID NO: 235712 - RNA, 64 nt, hsa
cagcuugaaauagaugccucacaauucagacaguuuaauucaggaacugugacccugcaguguu

SEQ ID NO: 235713 - RNA, 64 nt, hsa
gucaaguaucaguuuaccacauauuauuuuuauauuaauucaacauuugccuuaaguguguugu

SEQ ID NO: 235714 - RNA, 64 nt, hsa
auuuaauaaaacauauauuauauugaacuauguguuaauucauuuguaucuuuuaaaaaauuau

SEQ ID NO: 235715 - RNA, 64 nt, hsa
ccaagguaauaggaaaaguuugaguuaaguguuuuuaauucagucagugaauucagaauaagua

SEQ ID NO: 235716 - RNA, 64 nt, hsa
caauuguuuuaagaaaacucuauuucuguucauauuaauucacuugccagacuccaauucugaa

SEQ ID NO: 235717 - RNA, 64 nt, hsa
cucaccuuguugacuuccaccagaacaaaaccuguuaauucagcuugacuucucauauguguuc

SEQ ID NO: 235718 - RNA, 64 nt, hsa
gaauguauucacaggaagacggugauucuugcccuuaauucauaauugaaaauaugcaguaaca

SEQ ID NO: 235719 - RNA, 64 nt, hsa
aaagaaacaaguccagaaaucauauuacaagauuuuaauucaaauuuuucuucuuaaaaaucag

SEQ ID NO: 235720 - RNA, 64 nt, hsa
uguucagcaccucagcccccuacugagaaguuaauuaauucaguccaaaaugaaauuauagggc

SEQ ID NO: 235721 - RNA, 64 nt, hsa
auaaaacauuuaacaaaaucuauaacugugaagcuuaauucagaggcauuauagaauaaugugu

SEQ ID NO: 235722 - RNA, 64 nt, hsa
gcuucagcaacugcuuugcaaugacauuuauuuauuaauucaugccuuaaaaaaauaggaaggg

SEQ ID NO: 235723 - RNA, 64 nt, hsa
gaaaaggaagggugauucacuuucugacaaucacuuaauucagaggaaaaugagauuuacuaag

SEQ ID NO: 235724 - RNA, 64 nt, hsa
ugauagcaaaaaacuugaaauauugcagcccaguuuaauucagcacuuucccauuuucauaacu

SEQ ID NO: 235725 - RNA, 64 nt, hsa
guaauaguuaacauuaaacauuugauucauaaaguuaauucacugcuuaagcauguggcucaua

SEQ ID NO: 235726 - RNA, 64 nt, hsa
auuauuuguuugaggaaaaaaagaaaucugcauuuuaauucauguuggucaaagucgaauuacu

SEQ ID NO: 235727 - RNA, 64 nt, hsa
caaacuuguuuucuuuuuucuguuuuuuucuuuguuaauucauuuaaacucauugaaaacauag

SEQ ID NO: 235728 - RNA, 64 nt, hsa
guuuauuuucuugugcuucagcuacuagaaagguuuaauucagggauaagucccaauugaguag

SEQ ID NO: 235729 - RNA, 64 nt, hsa
gucaguguugaggauguaaucuccuuugccaucuuuaauucaccuaacuuacacuagguguucu

SEQ ID NO: 235730 - RNA, 64 nt, hsa
aauguacagaaaucuauuuuauaauaauuuauuuuuaauucauaagcaauuaauucacuaagcu

SEQ ID NO: 235731 - RNA, 64 nt, hsa
auuuuauaauaauuuauuuuuaauucauaagcaauuaauucacuaagcugccuagccacacucu

SEQ ID NO: 235732 - RNA, 64 nt, hsa
gggacuaagauggaaacacuuuuuuuauaaguuuuuaauucauagucacuaaagagauaaaugu

SEQ ID NO: 235733 - RNA, 64 nt, hsa
cucaagauuuucuuaauuuaguucgcuguuuaaauuaauucauguccuguaaaguucugaccuu

SEQ ID NO: 235734 - RNA, 64 nt, hsa
ggacuucuagacucaccuguucucacucccuguuuuaauucaacccagccaugcaaugccaaau

SEQ ID NO: 235735 - RNA, 64 nt, hsa
ggagcuaucacuguacuuguagaguggugcugcuuuaauucauaaaucacaaauaaaagccaau

SEQ ID NO: 235736 - RNA, 64 nt, hsa
gucuuuuagugcuuuuuaaaauuuuacccauucuuuaauucagcaucucccuauguauguguca

SEQ ID NO: 235737 - RNA, 64 nt, hsa
acacacacauacuacuuuaagggggugaggaucauuaauucagauaauuuuuaaguuuccuagu

SEQ ID NO: 235738 - RNA, 64 nt, hsa
uguuguauuacaauguauguagaaauaguaaccugugaacuaugcuuuuccauaacuuuuuaaa

SEQ ID NO: 235739 - RNA, 64 nt, hsa
augcaaugugcauaaauauuuuuuaaacauaacagugaacuauugcaccuuuugcuaaugccuc

SEQ ID NO: 235740 - RNA, 64 nt, hsa; identical to SEQ ID NO: 83364

SEQ ID NO: 235741 - RNA, 64 nt, hsa; identical to SEQ ID NO: 83365

SEQ ID NO: 235742 - RNA, 64 nt, hsa
aaucgccccagacuccuuuccucugaggaagaagggauaauagacacaucaaaugccccgaauu

SEQ ID NO: 235743 - RNA, 64 nt, hsa
ucucuaagccacagcuucuucaucuuuaaaauaaggauaauaaucauucuuuccccucagagcu

SEQ ID NO: 235744 - RNA, 64 nt, hsa
ucuuaacuuuauucaacuggacucagaauuguagggauaauaugaaugcaggaggaaacauucu

SEQ ID NO: 235745 - RNA, 64 nt, hsa
cacaucggcacguaugauggugguuuggucagauggauaauacagcagacacacuuagaacacu

SEQ ID NO: 235746 - RNA, 64 nt, hsa
cuuccuggcagacacaaauaaacccagugucaggucuaggaaauuaauggcuauucuuccccag

SEQ ID NO: 235747 - RNA, 64 nt, hsa
ugugccauaccagcugagguuuuuccucugucucucuaggaauagggucuguuucacaggccau

SEQ ID NO: 235748 - RNA, 64 nt, hsa
gaauauaaccagaggaaaaaaggauggagaaauaucuaggaaagguaauuuugcgaaacacauu

SEQ ID NO: 235749 - RNA, 64 nt, hsa
gaauauaaccagagaaaaaaaggauggagaaauaucuaggaaagguaauuuugcgaaacacauu

SEQ ID NO: 235750 - RNA, 64 nt, hsa
aagugaggagcgucucugcccggccgccaucccaucuaggaagugaggagcgccucuucccacc

SEQ ID NO: 235751 - RNA, 64 nt, hsa
aagugaggagcgccucuucccacccgccaucccaucuaggaagugaggagcuucucugccuggc

SEQ ID NO: 235752 - RNA, 64 nt, hsa
guauugccauuauuuuguauuugguaaagguuaaucuaggaaguuaccaacuguuuaaugcuau

SEQ ID NO: 235753 - RNA, 64 nt, hsa
uauuggagaaguagauaaugaauuaagcaacuggucuaggaaaggaaaauuuguuucaaauaug

SEQ ID NO: 235754 - RNA, 64 nt, hsa
ucucaguuggaccauccuuaacuugauugaacugucuaggaacuuuacagauuguucugcaguu

SEQ ID NO: 235755 - RNA, 64 nt, hsa
uauuugaacauuuuuucaauaauuccuuuuuacuucuaggaagucucaaaagaccaucuuaaau

SEQ ID NO: 235756 - RNA, 64 nt, hsa
auucaguacaacccccaggcucacagcaguggcuucuaggaaacugggaguuuagaucagcuuu

SEQ ID NO: 235757 - RNA, 64 nt, hsa
gcucaaaaacaugcugacagaaaacucccauggcucuaggaagaagugacacuaagccaacacc

SEQ ID NO: 235758 - RNA, 64 nt, hsa
uccuaaagauuugggguuuucuaaaacuaaagaaucuaggaaccuugccugcgaccaaucaugg

SEQ ID NO: 235759 - RNA, 64 nt, hsa
uacaaggaauacuaauggaucgucuuaaaauuggucuaggaaaaaaccuugguguguguuaugg

SEQ ID NO: 235760 - RNA, 64 nt, hsa
aagugaggagcgccucugcccggccgccaucccaucuaggaagugaggagcgccucuucccagc

SEQ ID NO: 235761 - RNA, 64 nt, hsa
aagugaggagcgccucuucccagccgccaucccaucuaggaagugaggagcgucucugcccggc

SEQ ID NO: 235762 - RNA, 64 nt, hsa
uauucauguuuucauuuaaaguuuuauccaauauucuaggaauuuucagcaauacugauauuca

SEQ ID NO: 235763 - RNA, 64 nt, hsa
aguuguucauguuauuuaaaguuuuauccaguauucuaggaauuuucagcaauacuaauauucu

SEQ ID NO: 235764 - RNA, 64 nt, hsa; identical to SEQ ID NO: 193740

SEQ ID NO: 235765 - RNA, 64 nt, hsa; identical to SEQ ID NO: 193741

SEQ ID NO: 235766 - RNA, 64 nt, hsa; identical to SEQ ID NO: 193742

SEQ ID NO: 235767 - RNA, 64 nt, hsa; identical to SEQ ID NO: 193743

SEQ ID NO: 235768 - RNA, 64 nt, hsa; identical to SEQ ID NO: 193744

SEQ ID NO: 235769 - RNA, 64 nt, hsa; identical to SEQ ID NO: 193745

SEQ ID NO: 235770 - RNA, 64 nt, hsa
uaugaacaguuuucuuuuaaaauuuugagauuaagaaugccaggaauauugucauccuuugagc

SEQ ID NO: 235771 - RNA, 64 nt, hsa
uaaguaaaaaaguaugcuuguuaauuuuauucaagaaugccaguagaaaauucauaacguguau

SEQ ID NO: 235772 - RNA, 64 nt, hsa
cuggaguauuuauauggugcuuaaugaaucuccagaaugccagccagaagccugauugguuagu

SEQ ID NO: 235773 - RNA, 64 nt, hsa
gucagccuccaugcuuucuucauuuugaaggggggaaugccagcauuuuggaggaaauucuacu

SEQ ID NO: 235774 - RNA, 64 nt, hsa
ggggaccuacccaaaccaauauucauccccaauggaaugccaaacacuguugugccauguggaa

SEQ ID NO: 235775 - RNA, 64 nt, hsa
cugucaccucaggagaaucgccccagccucuuuggaaugccauugauuguuccaugcacugugc

SEQ ID NO: 235776 - RNA, 62 nt, hsa
auuaccaccaacuuucugacuaagcuaaaaaugaaugaaaaugguggcuaaagaaaauaggg

SEQ ID NO: 235777 - RNA, 62 nt, hsa
ggaagaauguucaaguugaauccuaaugccgugaaugaaacacagucuguguagggaaugag

SEQ ID NO: 235778 - RNA, 62 nt, hsa
aauuuggaagcccaguuccuuaggugggauaggaaugaaagccuaaaccucuuccuuuagcu

SEQ ID NO: 235779 - RNA, 62 nt, hsa
aaaaugauuucuuaguaugauuguacaguaaugaaugaaaguggaacauguuucuuuuugaa

SEQ ID NO: 235780 - RNA, 62 nt, hsa
ugaaaccggcaguuacacuaaguaaguggagggaaugaaaguguuucgaggugaauguggau

SEQ ID NO: 235781 - RNA, 62 nt, hsa
cuuauaguaauucaggcucuaauuagcugagggaaugaaacacacaaaaaucacugaauucc

SEQ ID NO: 235782 - RNA, 62 nt, hsa
aucuuuagagaccauuggcccacugaugaauggaaugaaaaagcgagcagauacuguugguc

SEQ ID NO: 235783 - RNA, 62 nt, hsa
augacucgaaguuugcaguauggagaacaggugaaugaaauccugugccguucuucagucug

SEQ ID NO: 235784 - RNA, 62 nt, hsa
acauuaguauguauaacuggcuuuaccaaauugaaugaaaaggagcuugugcaaaaaaauuu

SEQ ID NO: 235785 - RNA, 62 nt, hsa
uuugggguuuaaagaaauggucugcauaaccugaaugaaagaagcaaaugacuauucucuga

SEQ ID NO: 235786 - RNA, 62 nt, hsa
cuuuuauauuuacccuuuuugucaucacuuuagaaugaaaauucccauuuaaaucugaaagu

SEQ ID NO: 235787 - RNA, 62 nt, hsa
ugagccacugugccugaccugucauuuuuauagaaugaaaugugcuuauuucuaaacauucu

SEQ ID NO: 235788 - RNA, 62 nt, hsa
auugcuucugauuauugaagaggucagauuaugaaugaaaggauaaaauguuuuaauaguag

SEQ ID NO: 235789 - RNA, 62 nt, hsa
guuuuuauaaaaagaaagcccgggucugcagagaaugaaaacugguuggaaacuaaagguuc

SEQ ID NO: 235790 - RNA, 62 nt, hsa
agagcguguugcuguuguaacaucccagagaagaaugaaaaggcacaugcuuuuauccguga

SEQ ID NO: 235791 - RNA, 62 nt, hsa
ucucuagcuuaucccugcacaauuauuagagugaaugaaaaaccacuuuccugcuuuccauu

SEQ ID NO: 235792 - RNA, 62 nt, hsa
ccuccacagcucauuucuuuguaauauaaucagaaugaaaaauaauuuaagaggacagaaga

SEQ ID NO: 235793 - RNA, 60 nt, hsa; identical to SEQ ID NO: 23583

SEQ ID NO: 235794 - RNA, 62 nt, hsa
aaguuuacccagccugcuuugcuuuacugcaugaaugaaacugaugguucaauuucagaagu

SEQ ID NO: 235795 - RNA, 62 nt, hsa
caaaacaaaaaucuguguaacuguaaaacauugaaugaaacuauuuuaccugaacuagauuu

SEQ ID NO: 235796 - RNA, 62 nt, hsa
agaaauuuuauuuccauugugaguucugacaagaaugaaauuccacauacaacauaacugua

SEQ ID NO: 235797 - RNA, 62 nt, hsa
uccauggaucuguguucugacuggcaccuuuggaaugaaagaaaagugugugcuguccaaau

SEQ ID NO: 235798 - RNA, 62 nt, hsa
ccauaaauaaaaguacaguuuucuugguggcagaaugaaaaucagcaacuucuagcauauag

SEQ ID NO: 235799 - RNA, 62 nt, hsa
gacgacaccuagcucuaagagcaauucugggagaaugaaaggaaguauaaaguaacccauaa

SEQ ID NO: 235800 - RNA, 62 nt, hsa
uaagaaaaaauauauauugcucuucaacuagugaaugaaagaaacuucagaaagcuagaauu

SEQ ID NO: 235801 - RNA, 62 nt, hsa
aacuaaacuaucagucauuuacauccucucaugaaugaaaugcaguguagggagaggagaug

SEQ ID NO: 235802 - RNA, 62 nt, hsa
uuacuauaauuaccaaaaacauguauauaaaagaaugaaauugaaaaauaaaauauauaaac

SEQ ID NO: 235803 - RNA, 62 nt, hsa
uacauucaaguuguacuuguuauaucugacaugaaugaaauaaaaucuuaauuacagaugcu

SEQ ID NO: 235804 - RNA, 62 nt, hsa
agauuaaauuggagaaacguguuaauuguguggaaugaaaaaauacauauauuuuuggaaaa

SEQ ID NO: 235805 - RNA, 62 nt, hsa
uguguugugugacauucaaaugucauuuuuuugaaugaaaaauacuuuccccuuuguguuuu

SEQ ID NO: 235806 - RNA, 62 nt, hsa
caaucugguuuucuuuuacccauaaauaacaugaaugaaaaaagauugggacaauagagacu

SEQ ID NO: 235807 - RNA, 62 nt, hsa
aacaugaaaugguuuuagcuagagucagaccagaaugaaaaugccaggagcugguacacuac

SEQ ID NO: 235808 - RNA, 62 nt, hsa
gccuagaauguauuuuaaauacuuacuaagaagaaugaaaauucuuugguuguuuuauauau

SEQ ID NO: 235809 - RNA, 62 nt, hsa
cagacccuugaagaaacgucacuucaaacucagaaugaaauuuucauuaauauuaaaauugu

SEQ ID NO: 235810 - RNA, 62 nt, hsa
gaggcgaauuuguugaaaagucccaagggucugaaugaaagcaucuuuaaucaacacucaac

SEQ ID NO: 235811 - RNA, 62 nt, hsa
uuggaauuuuuguuuuaguggucaguauaggggaaugaaagcgucuguuguuacccacguaa

SEQ ID NO: 235812 - RNA, 62 nt, hsa
auuagacauaaugauaauuuuuuccauacucagaaugaaaaacuggauauuacguuuuuguu

SEQ ID NO: 235813 - RNA, 62 nt, hsa
uuccucuuugcuguuuguaguagagacauuuugaaugaaacuuggcacugcuugauucaaaa

SEQ ID NO: 235814 - RNA, 62 nt, hsa
uauuguguaacauggauaguuaaaacaauguugaaugaaaaaaaucaaaauacaaaugaaac

SEQ ID NO: 235815 - RNA, 62 nt, hsa
gaaacauuguguaauaauauuuauguaaauuggaaugaaaucauuuauaaagaacaacuguu

SEQ ID NO: 235816 - RNA, 62 nt, hsa
auaacucuuccugcuauucagaauaaguaggagaaugaaaacugcagcauaucagacagcaa

SEQ ID NO: 235817 - RNA, 62 nt, hsa
guaauaaacuauucuuugaaacuuguuggguagaaugaaaauuaaagccauaaugguagaag

SEQ ID NO: 235818 - RNA, 62 nt, hsa
uuuuaaaaacuuucucgcuccccacgaccccagaaugaaacagcuuuaaaaauagccuuaag

SEQ ID NO: 235819 - RNA, 62 nt, hsa
uccugagggcuagaggacagagaaagagaauagaaugaaaugacuuugauuccugcgccuuu

SEQ ID NO: 235820 - RNA, 62 nt, hsa
cgguauugacuggauugacagcuaaaguaucagaaugaaagcaagguuuuuuugauguuacc

SEQ ID NO: 235821 - RNA, 62 nt, hsa
acaacucagugaaaagauggucuccaguuucugaaugaaaaagcuacagcugagaaauaaaa

SEQ ID NO: 235822 - RNA, 64 nt, hsa
ugguacccaugugagacaugaacaacaggagggagggaaagagcccaggugggacgugggacag

SEQ ID NO: 235823 - RNA, 64 nt, hsa
gaaagagcccaggugggacgugggacaggcuuaggggaaagagcuuguccuaucucaggaacaa

SEQ ID NO: 235824 - RNA, 64 nt, hsa
cacacacacacacacacacuuuugcaagagugaugggaaagacccuaggugcucauaacuagag

SEQ ID NO: 235825 - RNA, 64 nt, hsa
gggcuauaugccuauauuuauaaaccagcagcaggggaaagauuauauuuuauaagagggaaca

SEQ ID NO: 235826 - RNA, 64 nt, hsa
auuuggcaccaggcaaacgaauaaagauaggauugggaaagaaguugcuaagugugcuuaguuu

SEQ ID NO: 235827 - RNA, 64 nt, hsa
auuugaggagggaaugauugguagcaaaggaugggggaaagaaguagguucuguuuuguuuugu

SEQ ID NO: 235828 - RNA, 64 nt, hsa
ucuccuuuaaaacuaucaugguuauaauucuauugggaaagacuuuuagauaacaaagauuuca

SEQ ID NO: 235829 - RNA, 64 nt, hsa
uuaaaacuuacugauauauuggacuuugagccaagggaaagaaugaguacuaucuuuccagaua

SEQ ID NO: 235830 - RNA, 64 nt, hsa
augacuggauugcucuuuauccagcccacagcaggggaaagaaaggcaacucgcaaagaugaga

SEQ ID NO: 235831 - RNA, 64 nt, hsa
uauauccugccugaauggggaagucuucuaaaaugggaaagaagugguuucaucuccacacagu

SEQ ID NO: 235832 - RNA, 64 nt, hsa
ggucaccacuggacgggaaggagaacagaggagagggaaagagaagcccaaccucugugaucau

SEQ ID NO: 235833 - RNA, 64 nt, hsa
guccaaggaauaagcaugaaugacaagaaaacaagggaaagaguuaaccugucacauagcaggu

SEQ ID NO: 235834 - RNA, 64 nt, hsa
ucaugagacuuauucacugucacgagaauagcacgggaaagacuggcccccaugauucaauuac

SEQ ID NO: 235835 - RNA, 64 nt, hsa
uugugaaacuuauucacuaucacaagaauagcaugggaaagacuggcccccaugauucaauuac

SEQ ID NO: 235836 - RNA, 64 nt, hsa
aaacccuuuagugcuuugugauaguucagucccagggaaagagaaaacucgcccuaggcccuag

SEQ ID NO: 235837 - RNA, 64 nt, hsa
cacagagagggacgacauccugugccccgacugugggaaagacaucugaauucaacacagagaa

SEQ ID NO: 235838 - RNA, 64 nt, hsa
ugucugcucagcagcucagcugauucagaucagagggaaagaaauaccaacccugcaauaagug

SEQ ID NO: 235839 - RNA, 64 nt, hsa
ggaaaaaagcaaaauuggccugaauauucucuuggggaaagagggcaccaaagaaaaggguaag

SEQ ID NO: 235840 - RNA, 64 nt, hsa
uguucuuccugccaucauuccuccuuuucccacagggaaagaaaaguuggaucacuaguggcca

SEQ ID NO: 235841 - RNA, 64 nt, hsa
cuuucuucaccugcucuaggugcaaaggcauguugggaaagagauggauguuggggaggaagag

SEQ ID NO: 235842 - RNA, 64 nt, hsa
gcuguagacuucuuuauguggcucaguggagagagggaaagaauguugcaccugcucuaguacc

SEQ ID NO: 235843 - RNA, 64 nt, hsa
ugagcaggaggcagugaugucccuggucuauucagggaaagauuucagugugaaaugguaaaca

SEQ ID NO: 235844 - RNA, 64 nt, hsa
uuccacccaccccucuuuauucuggagcauaucagggaaagaaaaguugaugauagauugccuu

SEQ ID NO: 235845 - RNA, 64 nt, hsa
cccaggccuggagcugggaugcaauguaggcugagggaaagacgucagguuccuuuaaucacag

SEQ ID NO: 235846 - RNA, 55 nt, hsa
gccaagugauggaacccugacccuggggaaagacgccuucaucugggacaaaacu

SEQ ID NO: 235847 - RNA, 64 nt, hsa
acgccuucaucugggacaaaacuggagaugcaucgggaaagaagaaacuccgaagaaaagaauu

SEQ ID NO: 235848 - RNA, 64 nt, hsa
aguuaccucagcagaagacuagaauuagagaaaagggaaagaccuuuucuucuaguaaguguca

SEQ ID NO: 235849 - RNA, 64 nt, hsa
gccuuggacaaagaaucccucuguucacuguggugggaaagaucacacuacaugccuguugauu

SEQ ID NO: 235850 - RNA, 64 nt, hsa
gacaaggggacggggucugugagagucaauucaggggaaagauacaagauugauuuguaaaacc

SEQ ID NO: 235851 - RNA, 64 nt, hsa
uaaggaaauggcccaaugaacgugguugugggaggggaaagaggaaacagagcuagucagaugu

SEQ ID NO: 235852 - RNA, 64 nt, hsa
uaacauuuguaggauuauuucgagggcagggcaggggaaagaaacgcguuaaagggccaugaca

SEQ ID NO: 235853 - RNA, 64 nt, hsa
aguggagggcaggauucucagguccccauagagagggaaagagaagaccagaugugcauagaag

SEQ ID NO: 235854 - RNA, 64 nt, hsa
augaagaacccuugugaaguaaccaggaggaauggggaaagaagcaaguugggcaggauauggc

SEQ ID NO: 235855 - RNA, 64 nt, hsa
caguccucccaaucccacaccuccuguuugccaggggaaagaaccuaaagacuucgugugauug

SEQ ID NO: 235856 - RNA, 64 nt, hsa
gagaggucccucagaccugggaccucccuuuauagggaaagaccauauuccauagguuuagggc

SEQ ID NO: 235857 - RNA, 64 nt, hsa
gugugacauccuucagcacccagggacaagagaggggaaagaugcuuuauggaauguaagaaga

SEQ ID NO: 235858 - RNA, 64 nt, hsa
acacugcuuuggaaauuauucuaaacacaaaaaagggaaagaaaauguuauuucucccuaaguc

SEQ ID NO: 235859 - RNA, 64 nt, hsa
ugaggaggagggacucuggaguagcagaggggcugggaaagagggggcaggggcugcugggaca

SEQ ID NO: 235860 - RNA, 64 nt, hsa
acaaaugacuauccugaacaggguggaggggugugggaaagaaaccagccauauugguuuuggu

SEQ ID NO: 235861 - RNA, 64 nt, hsa
uuucccuagaaauuggcucaccuugggaaacccagggaaagaaucagcagguucucugcccucc

SEQ ID NO: 235862 - RNA, 64 nt, hsa
uuucaaguugcauauuugguuuccccuuaugauugggaaagaugaauuuucagcagaaaacauu

SEQ ID NO: 235863 - RNA, 64 nt, hsa
ccuuuguuuucaaaagcacaaaggaaaagugaaagggaaagagaaacaagugacugagaagucu

SEQ ID NO: 235864 - RNA, 64 nt, hsa
ucuggauguuccuacagagggaaagaccuacagagggaaagacccucgggccgcuccccugcgc

SEQ ID NO: 235865 - RNA, 64 nt, hsa
cuugcuuccagaaucuucuggauguuccuacagagggaaagaccuacagagggaaagacccucg

SEQ ID NO: 235866 - RNA, 64 nt, hsa
cccagagcagaaaagaagcacauccuaagauucagggaaagacuaacugugaaaaggaaggcug

SEQ ID NO: 235867 - RNA, 64 nt, hsa
gaggugccucugaggauuaggguugagcacucaagggaaagauggaguagagggcaaauagcaa

SEQ ID NO: 235868 - RNA, 64 nt, hsa
gucugcuguaaagaacaacacuuguuugucuguggggaaagaaaagcagaauacuugagaugaa

SEQ ID NO: 235869 - RNA, 64 nt, hsa
aguaguuaugcgaguggauagauugguauguagagggaaagaggucugcuguaaagaacaacac

SEQ ID NO: 235870 - RNA, 64 nt, hsa
ugccagaugaugggaaggcaaggaagaagggacagggaaagauaauuacugauaaaugaagggg

SEQ ID NO: 235871 - RNA, 64 nt, hsa
agccaagucagcucugccaacugcuaggggaguugggaaagaguggguguguguccgcaucccc

SEQ ID NO: 235872 - RNA, 64 nt, hsa
gacaucuuucccguggagcaacuuccugcuccacgggaaagaggucgauggauuuaccccugga

SEQ ID NO: 235873 - RNA, 64 nt, hsa
uggaauuguacauuuauuuuuuaaaacucaaagagggaaagagccuuguaucauaugugaacau

SEQ ID NO: 235874 - RNA, 64 nt, hsa
guccagcacagcggccugcuggacucugagaacugggaaagaucagagcaagccuugccucuua

SEQ ID NO: 235875 - RNA, 64 nt, hsa
ggguggaguugaccagagaaaggggagagaauucgggaaagacccaaaguguuuguaauucuuc

SEQ ID NO: 235876 - RNA, 64 nt, hsa
cagugccugcagguugccuggccagguggagagggggaaagaggaagggcaccguggguguaag

SEQ ID NO: 235877 - RNA, 64 nt, hsa
gggagaagcccagcagaagcugagccaggcagaggggaaagaagcugauaugaggaagggucug

SEQ ID NO: 235878 - RNA, 64 nt, hsa
uucagacccagucuguuggagccaugaaggaagagggaaagagggcugccauuccugacagccu

SEQ ID NO: 235879 - RNA, 64 nt, hsa
ucccaccucauucggcaccaaaaaguucacacuagggaaagaacuuacaaaugcagcaaaugug

SEQ ID NO: 235880 - RNA, 64 nt, hsa
acaccagauaaagaauguauauauaaagcagauggggaaagacuucacacagaaaucuacucug

SEQ ID NO: 235881 - RNA, 64 nt, hsa
aggaagcccuggugguaccagaggccagaauggugggaaagacagauccagauaaugcugggaa

SEQ ID NO: 235882 - RNA, 64 nt, hsa
ugcuucgauggccccaaagcugggccagaguuaagggaaagaggaggaaguccuaagcagagaa

SEQ ID NO: 235883 - RNA, 64 nt, hsa
aguagagccacagaaaaagaagaauuccaggagagggaaagaucguaaggaugagagaggagac

SEQ ID NO: 235884 - RNA, 64 nt, hsa
agaguccucucccaaguggcugaggcaggcuuaggggaaagaaccagaggggcaggggaggacu

SEQ ID NO: 235885 - RNA, 64 nt, hsa
cuuucuucucuagaauaaaucaggagacaaaauggggaaagaugaaaauauccaguguaaaguu

SEQ ID NO: 235886 - RNA, 64 nt, hsa
ugcugacaggaauguaaaaugguacagccacucugggaaagaguuuaugaauuucuuaucaagu

SEQ ID NO: 235887 - RNA, 62 nt, hsa
gugagggccaugcaugcaguaugaggggucuacaccugcaaggacugagaggcuuuucuagc

SEQ ID NO: 235888 - RNA, 62 nt, hsa
ugcaggcauugcacauggugugagaaggucuacaccugcaagggacgaguccccgggccugg

SEQ ID NO: 235889 - RNA, 62 nt, hsa
gcacaggcauugcacacggugugaggaguguacaccugcaagggcugaggcccugggcccag

SEQ ID NO: 235890 - RNA, 62 nt, hsa
uacaggcauugcacacagugugaaugggucuacaccugcaugggcugagucccugggcucag

SEQ ID NO: 235891 - RNA, 62 nt, hsa
gugcaggcauugcacacggugugaagggucuacaccugcacaggcugaguuccugggcucga

SEQ ID NO: 235892 - RNA, 62 nt, hsa
ccccuccugaccccaccuagaauggaagccuccaccugcagccccaggccucccucccccgg

SEQ ID NO: 235893 - RNA, 62 nt, hsa
agcugaggggcagggccguagacucacggcugcaccugcagggagcagcacgccaaccccag

SEQ ID NO: 235894 - RNA, 62 nt, hsa
ccacccuuugcugacucuuuuuggacucagcccaccugcacccaggugauuaaaaagcuuua

SEQ ID NO: 235895 - RNA, 62 nt, hsa
agugcugcaguauggccagacgugguggcucacaccugcaaucccagcaccuuaggaggccg

SEQ ID NO: 235896 - RNA, 62 nt, hsa
ggggacccugccagggaaggccacuggguguucaccugcaaaguuucugguugucacugcac

SEQ ID NO: 235897 - RNA, 62 nt, hsa
accuggcccaacagaaaaacccugccccaaugcaccugcaggcaagguacccgaagaagcag

SEQ ID NO: 235898 - RNA, 62 nt, hsa
ggcacgccuggcuuuccuuggauacccacugucaccugcacuaugaagugcugcuggcuggg

SEQ ID NO: 235899 - RNA, 62 nt, hsa
ccccccuuuggcuuaauuaagugugcugucugcaccugcaagguauggccacccaaucuucu

SEQ ID NO: 235900 - RNA, 62 nt, hsa
ucagugcccccuuuuggagagaugagcuguaucaccugcagaugugggguaaguggggagca

SEQ ID NO: 235901 - RNA, 62 nt, hsa
accugcaaggcugucaacagucuuggagaagccaccugcacagcagagcucauuguggaaac

SEQ ID NO: 235902 - RNA, 62 nt, hsa
agugauguuugcggggaugacgaugccaaguacaccugcaaggcugucaacagucuuggaga

SEQ ID NO: 235903 - RNA, 62 nt, hsa
ugccuugccaucgggcccaguucuccgggccccaccugcaccccuuucuucccccugggaua

SEQ ID NO: 235904 - RNA, 62 nt, hsa
cuuugccccagggugggugcaggugcgagugucaccugcagcugccucagucauucagaguu

SEQ ID NO: 235905 - RNA, 62 nt, hsa
ucuacuaaaaauuagccaagugugguaauguucaccugcagucccagcuacuugggaggcca

SEQ ID NO: 235906 - RNA, 62 nt, hsa
aaaugaugaaguugcaaauggcagugugcugucaccugcaacagaagugcguaccagaagua

SEQ ID NO: 235907 - RNA, 62 nt, hsa
cccgugcacaggcacacgugcuggucugcacacaccugcacacaccugcacacucgcuaugc

SEQ ID NO: 235908 - RNA, 62 nt, hsa
ggcacacgugcuggucugcacacaccugcacacaccugcacacucgcuaugccaggccuccu

SEQ ID NO: 235909 - RNA, 62 nt, hsa
ccgcaaucuggcuccuccuggaaaauuucccccaccugcagcgcugggccccaaggcuugcc

SEQ ID NO: 235910 - RNA, 62 nt, hsa
cccauacucccacuuugugccaaaugacuuugcaccugcaaauggugcuucaaugucguuuu

SEQ ID NO: 235911 - RNA, 62 nt, hsa
aaauacaaaaaucagccagacaugguggcaugcaccugcaaucccagcuacucgggaggcug

SEQ ID NO: 235912 - RNA, 62 nt, hsa
guuaacaugacauuuaccagcaacuugaacuucaccugcaaagcucuguggccacauuuuca

SEQ ID NO: 235913 - RNA, 62 nt, hsa
gacugccccaacuccuggaagcuguguccuugcaccugcauccguaguucccugaaaaccca

SEQ ID NO: 235914 - RNA, 62 nt, hsa
ggagaaaugcauccauuccucagggacagagacaccugcaccuccccccacugcaggccccg

SEQ ID NO: 235915 - RNA, 62 nt, hsa
aaguacaaaaauuagcugggcaugauggcacgcaccugcagucccagcuacuugggaggcug

SEQ ID NO: 235916 - RNA, 62 nt, hsa
acagccauguccuauuccuugaucauccaaagcaccugcagaguccagugaaaugauauauu

SEQ ID NO: 235917 - RNA, 62 nt, hsa
acggugccaucucuuguguaugcagggcuaugcaccugcaggcacguguguaugcacucccc

SEQ ID NO: 235918 - RNA, 62 nt, hsa
agccacauuuccauuugcaucauuacugccuucaccugcauagucacucuuuugaugcuggg

SEQ ID NO: 235919 - RNA, 62 nt, hsa
aaagggucccaggcugucaggggcguuugcgccaccugcaagggcgugggucagagaguuuu

SEQ ID NO: 235920 - RNA, 62 nt, hsa
ugcugucccggcuccaucuugguucuagccgccaccugcaugaacacaguggcccggcuuaa

SEQ ID NO: 235921 - RNA, 62 nt, hsa
uguucuggucaaaacuaaaggaacucccuccccaccugcaggacuccgaagacagugcgacu

SEQ ID NO: 235922 - RNA, 62 nt, hsa
cugagucagacaagugggagcuguaggaacugcaccugcagccucuucuuacuccccauuga

SEQ ID NO: 235923 - RNA, 62 nt, hsa
guuguuggugucagggaggcuuacuggagccacaccugcaggcgcuguguucaggcaccacc

SEQ ID NO: 235924 - RNA, 62 nt, hsa
gugucagcccagaugacuccucacccauccaccaccugcagcuugagauguuaacuauuaga

SEQ ID NO: 235925 - RNA, 62 nt, hsa
agaagacgagagauagugggugugguggcucacaccugcaaucccagcacuuuggaaggccg

SEQ ID NO: 235926 - RNA, 62 nt, hsa
ugacugcuggggacccucgccuucccuccucucaccugcaggcugauccuucuuuucacuuu

SEQ ID NO: 235927 - RNA, 62 nt, hsa
uuacaccccgacccuccuccugucagcccccucaccugcagccuguugcccaauaaauuuaa

SEQ ID NO: 235928 - RNA, 62 nt, hsa
augcugacccuaggauuuuccuucccugcccucaccugcaaaugaguuaaagaagaggcgug

SEQ ID NO: 235929 - RNA, 62 nt, hsa
ugcacgugcacacaccugcacaccccugcacacaccugcacaccgucccucuccccggacaa

SEQ ID NO: 235930 - RNA, 62 nt, hsa
cugcccuagcaguuugccucugcacgugcacacaccugcacaccccugcacacaccugcaca

SEQ ID NO: 235931 - RNA, 62 nt, hsa
gaacgcucaacuugguugcgguaccaucagcccaccugcauuuggcuuucgacuugcuuguu

SEQ ID NO: 235932 - RNA, 62 nt, hsa
guuuagauccaugccauucacugacucacuaacaccugcaaaaucuuuaaggaaaaaagcug

SEQ ID NO: 235933 - RNA, 62 nt, hsa
aacuugcccugagcacuccuggugcaggucuccaccugcacauuggguggggcuccugggag

SEQ ID NO: 235934 - RNA, 62 nt, hsa
ggagagacauggaaagggagacagccagguggcaccugcagcggcugcccucuggggccacu

SEQ ID NO: 235935 - RNA, 64 nt, hsa
aguugagcagacagccacauugggcagcgcccuuccucuccacccucccagaccugccucuucc

SEQ ID NO: 235936 - RNA, 64 nt, hsa
cucuucccccugcuuccaccucaccccacuuaucccucuccauaaccccacccuugcccacccc

SEQ ID NO: 235937 - RNA, 64 nt, hsa
ggguuugggcaggagauggccaaucaugcgcccaccucuccagugcugccugcagucagcucgg

SEQ ID NO: 235938 - RNA, 64 nt, hsa
ccuggggacuaggaaaaggaaccaacuguaggcaccucuccagggccuagggagacaagugucc

SEQ ID NO: 235939 - RNA, 64 nt, hsa
aaugcugguccuucagacccugcccgaacucccaccucuccauggccugccuagccaggcuggc

SEQ ID NO: 235940 - RNA, 64 nt, hsa
uguaugugcgugugaugcuaccucuccucccgucccucuccaggggccccgcauacacacggcc

SEQ ID NO: 235941 - RNA, 64 nt, hsa
caguguuggugcacauuugccucucacaugcugcccucuccacccacccagggacaccccacgg

SEQ ID NO: 235942 - RNA, 64 nt, hsa
uauuuuaaaauauuauuuuaacaaaaguuacauuccucuccacaaugaggcuaaaugucaccca

SEQ ID NO: 235943 - RNA, 64 nt, hsa
agcaucucuaguacuaccugaaggcucuccuaacccucuccacacauuccauuuacagaguaug

SEQ ID NO: 235944 - RNA, 64 nt, hsa
ccuacgucgggcuuccugcuggggcggccagcacccucuccacgugcagaccccaugcgucccg

SEQ ID NO: 235945 - RNA, 64 nt, hsa
ugccccgccagccacaggcugggugcacguccugccucuccagccccacagggcagcagcauga

SEQ ID NO: 235946 - RNA, 64 nt, hsa
ccggcuuuuucuaaucaggcaggcgucugucaacccucuccacuucugggcugaagccucccca

SEQ ID NO: 235947 - RNA, 64 nt, hsa
uacagcugcgccggaucugggcgaccacguuuugccucuccaaaaagagcuuccuuucgugacg

SEQ ID NO: 235948 - RNA, 64 nt, hsa
uauugauuucacagucagcugcucaacggaauggccucuccacaccagggauccuuagcaccca

SEQ ID NO: 235949 - RNA, 64 nt, hsa
aauaguauuagaagaauugauccuauuuugaaccccucuccaguaucuucacacucuugucaac

SEQ ID NO: 235950 - RNA, 64 nt, hsa
cuguucuguuuuucuccuagucccucuccugccaccucuccaagacuuccgugggacacccacu

SEQ ID NO: 235951 - RNA, 64 nt, hsa
ugggcucagcaccugaggcggguuuccuggguccccucuccagcaagccuccaccagcaagcuc

SEQ ID NO: 235952 - RNA, 64 nt, hsa
gaaggagaggaggaauuaguugggaugccaauuuccucuccacugcuggacaugagauggagag

SEQ ID NO: 235953 - RNA, 64 nt, hsa
gguggccauguuaugcuggugguuaaggccagggccucuccaaccacugugccacugacuugcu

SEQ ID NO: 235954 - RNA, 64 nt, hsa
uuggggagugcguggugucagaucccauccugcuccucuccagaguuuccggucaccuccgugu

SEQ ID NO: 235955 - RNA, 64 nt, hsa
ucggggagugcguggugucagaucccauccugcuccucuccagcauuuccucucaccuccgugu

SEQ ID NO: 235956 - RNA, 64 nt, hsa
ucggggagugcguggugucagaucccauccugcuccucuccagaguuuccucucaccuccgugu

SEQ ID NO: 235957 - RNA, 64 nt, hsa
ccggaccccuccccggguuggcucucccuggagaccucuccaucauucccgaaaaguggaugga

SEQ ID NO: 235958 - RNA, 64 nt, hsa
cucccacccagcccuuggugugcccacccagccuccucuccagcaccuugcugugcugcccucu

SEQ ID NO: 235959 - RNA, 64 nt, hsa
gaagccuaugggagucaggacccucuccacucucccucuccacuccccuuccuguucucaccug

SEQ ID NO: 235960 - RNA, 64 nt, hsa
ggccagcccagaugaagccuaugggagucaggacccucuccacucucccucuccacuccccuuc

SEQ ID NO: 235961 - RNA, 64 nt, hsa
uggccaaagauuuccuuucuguggugagggagaaccucuccaaagaggaagcaggcauaugagu

SEQ ID NO: 235962 - RNA, 64 nt, hsa
uccaccccaggaaucucuguuccuucucugucugccucuccacagcccgugauccccugcuucu

SEQ ID NO: 235963 - RNA, 64 nt, hsa
cuccuaccacccagcccuauccauucucuccuucccucuccagccugcuguauaaguaacaugu

SEQ ID NO: 235964 - RNA, 64 nt, hsa
ggaccaugcugagacaucccucaucuagucuugaccucuccagcaucccagccucagaagccuu

SEQ ID NO: 235965 - RNA, 64 nt, hsa
ucaugccccgccauggucacccucaggaacccacccucuccacacccagccugucccacuggcu

SEQ ID NO: 235966 - RNA, 64 nt, hsa
aagguaaagguuuuggcuggucagugugccaagaccucuccagcuucucauucaugaugaccuc

SEQ ID NO: 235967 - RNA, 64 nt, hsa
aacauagauucucugcagcuuucucaaggggaacccucuccagcuucccuggugugacccuucu

SEQ ID NO: 235968 - RNA, 64 nt, hsa
ccugagggccuccuaaaagguuuaaauguccacgccucuccaguugcugaaguagggucugaga

SEQ ID NO: 235969 - RNA, 64 nt, hsa
cagggcggugggcaguccugguguagagcacaagccucuccacccuagagaaaugccucuguac

SEQ ID NO: 235970 - RNA, 64 nt, hsa
ggccaugcuggucaucggcuugcccaggcuccagccucuccagauucugaggggucucagccca

SEQ ID NO: 235971 - RNA, 64 nt, hsa
guaaacguauccucuguauucaguaaacaggcugccucuccagggagggcugccauucauucca

SEQ ID NO: 235972 - RNA, 64 nt, hsa
agccagaaaucagaccaccgaagcucacucccuuccucuccaucucucccucucuccaagacuc

SEQ ID NO: 235973 - RNA, 64 nt, hsa
uuuccaaaagcaaggcagccgugcuguucuaguuccucuccauccgccaccuccccucccgcug

SEQ ID NO: 235974 - RNA, 64 nt, hsa
uacggguaaggccuaaaaggucaccccucggcccccucuccaaaagaagggcaugggcaccccc

SEQ ID NO: 235975 - RNA, 58 nt, hsa
ucccgcacgcacaaucgugaccccgcgaccucuccaucuucagcuucuucaucuucac

SEQ ID NO: 235976 - RNA, 64 nt, hsa
caccuucacccucuuccuuccccagccagggcagccucuccacaucuuucccugacucuuggau

SEQ ID NO: 235977 - RNA, 64 nt, hsa
aaugggcaggacccugaggauggggacuccacagccucuccaaguucagagugagauucugcau

SEQ ID NO: 235978 - RNA, 64 nt, hsa
ggggugggagguaggcuguggggugggcuggaguccucuccagagaggcucaacaaggaaaaau

SEQ ID NO: 235979 - RNA, 64 nt, hsa
acgccaacuucucccaccccuuggccccucacauccucuccaggaagggagugaggggcuguga

SEQ ID NO: 235980 - RNA, 64 nt, hsa
acccucuccagaugagaguacaccccaacagcacccucuccagaugcagccccaucuccucagc

SEQ ID NO: 235981 - RNA, 64 nt, hsa
acccucuccagaugagaguacaccccaacagcacccucuccagaugagaguacaccccaacagc

SEQ ID NO: 235982 - RNA, 64 nt, hsa; identical to SEQ ID NO: 235981

SEQ ID NO: 235983 - RNA, 64 nt, hsa
cacccucuccagaugggagugcccccaacagcacccucuccagaugagaguacaccccaacagc

SEQ ID NO: 235984 - RNA, 64 nt, hsa
ccccugccuucccaggaguacaccccaacagcacccucuccagaugggagugcccccaacagca

SEQ ID NO: 235985 - RNA, 64 nt, hsa
agcugacuuccuuagcugauuguucccacuugcaccucuccaccuuuggcacuagaacuccuga

SEQ ID NO: 235986 - RNA, 64 nt, hsa
uugaccugaaucgggagccacacuuggcccucuuccucuccaaagcgccagaaccuccuucucu

SEQ ID NO: 235987 - RNA, 64 nt, hsa
agccugacuugguucauggaggcuccuacucugcccucuccaagcuccccuggcggcuccccac

SEQ ID NO: 235988 - RNA, 64 nt, hsa
cagcuuugccccuguuugaagaccucccuucuugccucuccagacguguuccccgaggagaucu

SEQ ID NO: 235989 - RNA, 64 nt, hsa
ccgccucuccagguugacagccuucucugaacgaccucuccauuacucucaugcuuugcucaug

SEQ ID NO: 235990 - RNA, 64 nt, hsa
aggcuuguuuuacugccuucugucuuucuucccgccucuccagguugacagccuucucugaacg

SEQ ID NO: 235991 - RNA, 64 nt, hsa
uccagcuccucacucagcuccugccucccucuccccucuccaccaugggcugcaguauagacag

SEQ ID NO: 235992 - RNA, 64 nt, hsa
gccugaguccuucuguccgucagaaucuccgcugccucuccagcccuuuugcagcccuguuuau

SEQ ID NO: 235993 - RNA, 64 nt, hsa
ucuugugcacacagccaagauuucuucaaugggugugagcuaguugaggguuaaccuuguaggu

SEQ ID NO: 235994 - RNA, 64 nt, hsa
ugaaggugguagaaucuuuucagccucuuagccagugagcuaaauauggcuaagcacaggucau

SEQ ID NO: 235995 - RNA, 64 nt, hsa
uuuugcauaaaaugucuagucuuugccacagauagugagcuacccacuaaugagcccaugguuu

SEQ ID NO: 235996 - RNA, 64 nt, hsa
ucacuguucugcaaugcucauggcaaguugaauggugagcuagcuuauaaauuaaagagcucug

SEQ ID NO: 235997 - RNA, 64 nt, hsa
auuuaagccaguagauuccuuaucuagaaagcaggugagcuagcccuuagagaaggcugucccg

SEQ ID NO: 235998 - RNA, 64 nt, hsa
gagaaucacuugaaccugggacacggagguugcagugagcuaagaucaugccaucgcacuccag

SEQ ID NO: 235999 - RNA, 64 nt, hsa; identical to SEQ ID NO: 141321

SEQ ID NO: 236000 - RNA, 64 nt, hsa; identical to SEQ ID NO: 141322

SEQ ID NO: 236001 - RNA, 64 nt, hsa; identical to SEQ ID NO: 141323

SEQ ID NO: 236002 - RNA, 64 nt, hsa; identical to SEQ ID NO: 141324

SEQ ID NO: 236003 - RNA, 64 nt, hsa; identical to SEQ ID NO: 141325

SEQ ID NO: 236004 - RNA, 64 nt, hsa; identical to SEQ ID NO: 141326

SEQ ID NO: 236005 - RNA, 64 nt, hsa; identical to SEQ ID NO: 141327

SEQ ID NO: 236006 - RNA, 64 nt, hsa; identical to SEQ ID NO: 141328

SEQ ID NO: 236007 - RNA, 64 nt, hsa; identical to SEQ ID NO: 141329

SEQ ID NO: 236008 - RNA, 64 nt, hsa; identical to SEQ ID NO: 141330

SEQ ID NO: 236009 - RNA, 64 nt, hsa; identical to SEQ ID NO: 141331

SEQ ID NO: 236010 - RNA, 64 nt, hsa; identical to SEQ ID NO: 141332

SEQ ID NO: 236011 - RNA, 64 nt, hsa; identical to SEQ ID NO: 141333

SEQ ID NO: 236012 - RNA, 64 nt, hsa; identical to SEQ ID NO: 141334

SEQ ID NO: 236013 - RNA, 64 nt, hsa; identical to SEQ ID NO: 141335

SEQ ID NO: 236014 - RNA, 64 nt, hsa; identical to SEQ ID NO: 141336

SEQ ID NO: 236015 - RNA, 64 nt, hsa; identical to SEQ ID NO: 141337

SEQ ID NO: 236016 - RNA, 64 nt, hsa; identical to SEQ ID NO: 141338

SEQ ID NO: 236017 - RNA, 64 nt, hsa; identical to SEQ ID NO: 141339

SEQ ID NO: 236018 - RNA, 64 nt, hsa; identical to SEQ ID NO: 141340

SEQ ID NO: 236019 - RNA, 64 nt, hsa; identical to SEQ ID NO: 141341

SEQ ID NO: 236020 - RNA, 64 nt, hsa; identical to SEQ ID NO: 141342

SEQ ID NO: 236021 - RNA, 64 nt, hsa; identical to SEQ ID NO: 141343

SEQ ID NO: 236022 - RNA, 64 nt, hsa; identical to SEQ ID NO: 141344

SEQ ID NO: 236023 - RNA, 64 nt, hsa; identical to SEQ ID NO: 141345

SEQ ID NO: 236024 - RNA, 64 nt, hsa; identical to SEQ ID NO: 141346

SEQ ID NO: 236025 - RNA, 64 nt, hsa; identical to SEQ ID NO: 141347

SEQ ID NO: 236026 - RNA, 64 nt, hsa; identical to SEQ ID NO: 141348

SEQ ID NO: 236027 - RNA, 64 nt, hsa; identical to SEQ ID NO: 141349

SEQ ID NO: 236028 - RNA, 64 nt, hsa; identical to SEQ ID NO: 141350

SEQ ID NO: 236029 - RNA, 64 nt, hsa; identical to SEQ ID NO: 141351

SEQ ID NO: 236030 - RNA, 64 nt, hsa; identical to SEQ ID NO: 141352

SEQ ID NO: 236031 - RNA, 64 nt, hsa; identical to SEQ ID NO: 141353

SEQ ID NO: 236032 - RNA, 64 nt, hsa; identical to SEQ ID NO: 141354

SEQ ID NO: 236033 - RNA, 64 nt, hsa; identical to SEQ ID NO: 141355

SEQ ID NO: 236034 - RNA, 64 nt, hsa; identical to SEQ ID NO: 141356

SEQ ID NO: 236035 - RNA, 64 nt, hsa; identical to SEQ ID NO: 141357

SEQ ID NO: 236036 - RNA, 64 nt, hsa; identical to SEQ ID NO: 141358

SEQ ID NO: 236037 - RNA, 64 nt, hsa; identical to SEQ ID NO: 141359

SEQ ID NO: 236038 - RNA, 64 nt, hsa; identical to SEQ ID NO: 141360

SEQ ID NO: 236039 - RNA, 64 nt, hsa; identical to SEQ ID NO: 141361

SEQ ID NO: 236040 - RNA, 64 nt, hsa; identical to SEQ ID NO: 141362

SEQ ID NO: 236041 - RNA, 64 nt, hsa; identical to SEQ ID NO: 141363

SEQ ID NO: 236042 - RNA, 64 nt, hsa; identical to SEQ ID NO: 141364

SEQ ID NO: 236043 - RNA, 64 nt, hsa; identical to SEQ ID NO: 141365

SEQ ID NO: 236044 - RNA, 64 nt, hsa; identical to SEQ ID NO: 141366

SEQ ID NO: 236045 - RNA, 64 nt, hsa; identical to SEQ ID NO: 141367

SEQ ID NO: 236046 - RNA, 64 nt, hsa; identical to SEQ ID NO: 141368

SEQ ID NO: 236047 - RNA, 64 nt, hsa; identical to SEQ ID NO: 141369

SEQ ID NO: 236048 - RNA, 64 nt, hsa; identical to SEQ ID NO: 141370

SEQ ID NO: 236049 - RNA, 64 nt, hsa; identical to SEQ ID NO: 141371

SEQ ID NO: 236050 - RNA, 64 nt, hsa; identical to SEQ ID NO: 141372

SEQ ID NO: 236051 - RNA, 64 nt, hsa; identical to SEQ ID NO: 141373

SEQ ID NO: 236052 - RNA, 64 nt, hsa; identical to SEQ ID NO: 141374

SEQ ID NO: 236053 - RNA, 64 nt, hsa; identical to SEQ ID NO: 141375

SEQ ID NO: 236054 - RNA, 64 nt, hsa; identical to SEQ ID NO: 141376

SEQ ID NO: 236055 - RNA, 64 nt, hsa; identical to SEQ ID NO: 141377

SEQ ID NO: 236056 - RNA, 64 nt, hsa; identical to SEQ ID NO: 141378

SEQ ID NO: 236057 - RNA, 64 nt, hsa; identical to SEQ ID NO: 141379

SEQ ID NO: 236058 - RNA, 64 nt, hsa; identical to SEQ ID NO: 141380

SEQ ID NO: 236059 - RNA, 64 nt, hsa; identical to SEQ ID NO: 141381

SEQ ID NO: 236060 - RNA, 64 nt, hsa; identical to SEQ ID NO: 141382

SEQ ID NO: 236061 - RNA, 64 nt, hsa; identical to SEQ ID NO: 215308

SEQ ID NO: 236062 - RNA, 64 nt, hsa; identical to SEQ ID NO: 215309

SEQ ID NO: 236063 - RNA, 64 nt, hsa; identical to SEQ ID NO: 215310

SEQ ID NO: 236064 - RNA, 64 nt, hsa; identical to SEQ ID NO: 215311

SEQ ID NO: 236065 - RNA, 64 nt, hsa; identical to SEQ ID NO: 215312

SEQ ID NO: 236066 - RNA, 64 nt, hsa; identical to SEQ ID NO: 215313

SEQ ID NO: 236067 - RNA, 64 nt, hsa; identical to SEQ ID NO: 215314

SEQ ID NO: 236068 - RNA, 64 nt, hsa; identical to SEQ ID NO: 215315

SEQ ID NO: 236069 - RNA, 64 nt, hsa; identical to SEQ ID NO: 215316

SEQ ID NO: 236070 - RNA, 64 nt, hsa; identical to SEQ ID NO: 215317

SEQ ID NO: 236071 - RNA, 64 nt, hsa; identical to SEQ ID NO: 215318

SEQ ID NO: 236072 - RNA, 64 nt, hsa; identical to SEQ ID NO: 215319

SEQ ID NO: 236073 - RNA, 64 nt, hsa; identical to SEQ ID NO: 215320

SEQ ID NO: 236074 - RNA, 64 nt, hsa; identical to SEQ ID NO: 215321

SEQ ID NO: 236075 - RNA, 64 nt, hsa; identical to SEQ ID NO: 215322

SEQ ID NO: 236076 - RNA, 64 nt, hsa; identical to SEQ ID NO: 215323

SEQ ID NO: 236077 - RNA, 64 nt, hsa; identical to SEQ ID NO: 215324

SEQ ID NO: 236078 - RNA, 58 nt, hsa; identical to SEQ ID NO: 215325

SEQ ID NO: 236079 - RNA, 64 nt, hsa; identical to SEQ ID NO: 215326

SEQ ID NO: 236080 - RNA, 64 nt, hsa; identical to SEQ ID NO: 215327

SEQ ID NO: 236081 - RNA, 64 nt, hsa
uaacaaugugguugacauaccuucaguugcuuuccacaucuaaaagaguuaucuuucauauaug

SEQ ID NO: 236082 - RNA, 64 nt, hsa
guuauauuauggcagaucucuuuacguuuuuucucacaucuaucugcuaguccaggaauuuguu

SEQ ID NO: 236083 - RNA, 64 nt, hsa
ccuuaucuaaagucaacugauuauggacuuuaaucacaucuacaaaacacuuccauggcgacag

SEQ ID NO: 236084 - RNA, 64 nt, hsa
cagaggcacucagugggugguggggugauggauacacaucuaucaggcacagggcggagguggg

SEQ ID NO: 236085 - RNA, 64 nt, hsa
uucuaaaagcuccuaacuuauauccaaagaauugcuuucugauucguguagucucucccacaga

SEQ ID NO: 236086 - RNA, 64 nt, hsa
aauccacugccaauucagcuccucuggaguggagcuuucugauuucuuggagcaggaauuuuag

SEQ ID NO: 236087 - RNA, 64 nt, hsa
acugucaggcuaacaggaauaagugguagccuugcuuucugagcaccaucuaaagaauuuuaaa

SEQ ID NO: 236088 - RNA, 64 nt, hsa
aaaccaguuuuuaauaagaaaguuuaucuuuacucuuucugaaauuaugacuccagaaaaagaa

SEQ ID NO: 236089 - RNA, 64 nt, hsa
acaugcuaucaguaauagucccaguuccauccaacuuucugaaauuucauuuuuuuuuuugaga

SEQ ID NO: 236090 - RNA, 64 nt, hsa
gagauuacaggugugagccaccgcacccggccaacuuucugaaauuucaaaacugaauugaucc

SEQ ID NO: 236091 - RNA, 64 nt, hsa
aucacaacuauuaaacuuagagaauaauaauagucuuucugaugaggcugccauauuuugagca

SEQ ID NO: 236092 - RNA, 64 nt, hsa
ucucugguuucuuaacaaaagagaaagcacagcacuuucugauccaaacugucuuuuuuuugua

SEQ ID NO: 236093 - RNA, 64 nt, hsa
ucauuguaucuuuuuuuuacaaugguggaagcaacuuucugaaaguucagucuuaugcuacauc

SEQ ID NO: 236094 - RNA, 64 nt, hsa
aguuuaguauauauauauuuuuuucuuuuugcuacuuucugaggcauuauguaaagggcucaua

SEQ ID NO: 236095 - RNA, 64 nt, hsa
cuauuauuuauuuuuaaaugaaaguguaagaaugcuuucugauucaacaaauuuguuaucaaac

SEQ ID NO: 236096 - RNA, 64 nt, hsa
guuauugggguuagggagguggggaagagauaaucuuucugauuaccuguuuugucuggauggc

SEQ ID NO: 236097 - RNA, 64 nt, hsa
gcuaguaucuuggauuaacugaugccugcuagugcuuucugauuacucgcauucuguuucuugc

SEQ ID NO: 236098 - RNA, 64 nt, hsa
auaagcaguucaaguuacugaaaaccuuuuaaaccuuucugaaguucguuaguauaaauuacuu

SEQ ID NO: 236099 - RNA, 64 nt, hsa
acaaaaauauggagaagaguaauuugaaagccuacuuucugaagaaaauggugggauuuuuuuu

SEQ ID NO: 236100 - RNA, 64 nt, hsa
aaaacauauauuuacuaaaauguguuuaauuuuccuuucugaaaacucucauuuuaaaaacguu

SEQ ID NO: 236101 - RNA, 64 nt, hsa
ccacaaguggaaaauuccccacccgacaccuuugcuuucugaugguucaguuuaaacagauuuu

SEQ ID NO: 236102 - RNA, 64 nt, hsa
agagugcauauuuaaucucuuuucuauacugcuccuuucugaugcuuauccuuucaucugugug

SEQ ID NO: 236103 - RNA, 64 nt, hsa
gcauguaaguacgguaguaagaaaccuuugagaucuuucugacuuuucaaaauuagagaaagca

SEQ ID NO: 236104 - RNA, 64 nt, hsa
cugugugaacgccaaacuaaaguuuacagucuuucuuucugaauuuugaguaucuucuguugua

SEQ ID NO: 236105 - RNA, 64 nt, hsa
gucaauggucaagcgugcagcuuguucagcgguucuuucugaggagcggacaccggguuacauu

SEQ ID NO: 236106 - RNA, 64 nt, hsa
accagugguuucuucuaauuauaaaauguuuaaacuuucugagaauuuaaaaagccaccacugu

SEQ ID NO: 236107 - RNA, 64 nt, hsa
uccuuaccuuuaccacuaauaccaguaaaauuaucuuucugauagugaaaagguucugucaaga

SEQ ID NO: 236108 - RNA, 64 nt, hsa
gaauguuguaaaacugucaggagauguaaaauuccuuucugaagugucucuucugugaaagggu

SEQ ID NO: 236109 - RNA, 64 nt, hsa
cugugcauccugagaccuugugucccugagucuccuuucugagugcaagcugcacugugagcug

SEQ ID NO: 236110 - RNA, 64 nt, hsa
cagucuccuuaugcguugaauauugccaaaugcucuuucugaaaaugcugaauugccuuuuuug

SEQ ID NO: 236111 - RNA, 64 nt, hsa
uuuacucagcuacccaguagagcuugaagcugaccuuucugagaaguugguaugguguaacacu

SEQ ID NO: 236112 - RNA, 64 nt, hsa
uccaaguugugugaccuuggcuaagucacuuaaccuuucugauugucauuucgcuuuuuaauaa

SEQ ID NO: 236113 - RNA, 64 nt, hsa
gcucaaggaaauuauucacgaaggugaccacugucuuucugaccuggcacagaggaaauguugg

SEQ ID NO: 236114 - RNA, 64 nt, hsa
aaaauaugaauaugauuggauucagaaaaauuaacuuucugaauuugaucugucuucagucuug

SEQ ID NO: 236115 - RNA, 64 nt, hsa
aaacaguucuucucaaacauuuucauucagauagcuuucugaaaguucccuaucccucuuuacc

SEQ ID NO: 236116 - RNA, 64 nt, hsa
ggaccaccuaacagcgcccccuccuucaguugcccuuucugaggcaacuaaacuacagaaucag

SEQ ID NO: 236117 - RNA, 64 nt, hsa
cugaagugccaaaggagcccccccauuccugggccuuucugagggcaggaggggcgaccagaua

SEQ ID NO: 236118 - RNA, 64 nt, hsa
ucggaaguuuacuggcucugcucccgccuguuuucuuucugacucuaucuggcagcccgaugcc

SEQ ID NO: 236119 - RNA, 64 nt, hsa
cugcacaggacaguccuauuuuugauguccuuuccuuucugaaaauaaaguuuugugcuuugga

SEQ ID NO: 236120 - RNA, 64 nt, hsa
uuaaagucagguccaauuuguaaaaacagcauugcuuucugaaauuagggcccaauuaauaauc

SEQ ID NO: 236121 - RNA, 64 nt, hsa
cuauaaagcaacggcuccuguuaaaugguaucuccuuucugaggcuccuacuaaaagucauuug

SEQ ID NO: 236122 - RNA, 64 nt, hsa
caaauaugucaugaccaucacagcagaggagugacuuucugacuaaugcugccacccacacaga

SEQ ID NO: 236123 - RNA, 64 nt, hsa
acagccaaccagaaugagugggucaucuuauaaccuuucugaagcuccaugaggacauguauag

SEQ ID NO: 236124 - RNA, 64 nt, hsa
gagaaggggugacauuuuuuuaauuucagagaugcuuucugauuuuccucucccaggucacugu

SEQ ID NO: 236125 - RNA, 64 nt, hsa
caugcuuaaagaggggaaaaggaagggugauucacuuucugacaaucacuuaauucagaggaaa

SEQ ID NO: 236126 - RNA, 64 nt, hsa
ccgccgccucuccagcucacccucacucagcucacuuucugacgugucccagccugucuguugg

SEQ ID NO: 236127 - RNA, 64 nt, hsa
aaggcuugaugcaccaggccugacuuugucuccucuuucugagcuuagggggcuaggguggcca

SEQ ID NO: 236128 - RNA, 64 nt, hsa
uuggauaugaauucccuguuaguugauuuaaauccuuucugaauaaagaucagauaaacaguaa

SEQ ID NO: 236129 - RNA, 64 nt, hsa
ugaacuaaacucagcaguggucugguaucaagagcuuucugauguuuuacagccugaauuugga

SEQ ID NO: 236130 - RNA, 64 nt, hsa
uggaaaguguucauugcacaauauauuuuuacugcuuucugaauguagacggaacaguguggaa

SEQ ID NO: 236131 - RNA, 64 nt, hsa
uuccuuuuaaguggacucucugacaaaguggguacuuucugaaaauuuauauaacuguuguuga

SEQ ID NO: 236132 - RNA, 64 nt, hsa
uucuagugaugaacaaaaugauacucagaagcaacuuucugaagaacagaacacuggaauauua

SEQ ID NO: 236133 - RNA, 64 nt, hsa
uguuucuagucgucauaauguaauuugccaguuacuuucugacuacaaagaaaaacagauacua

SEQ ID NO: 236134 - RNA, 64 nt, hsa
uaguaauaaaauagagcauaacgaaacugugaaacuuucugaagccuugucagugguuaaaagu

SEQ ID NO: 236135 - RNA, 64 nt, hsa
gagacaauagaaauaaaaagaucuucagccaggccuuucugaaggaguuauucugcuaaaaaug

SEQ ID NO: 236136 - RNA, 64 nt, hsa
uauacuuuaaaccccgcuccucauggccuuggcccuuucugaagcugcuuccucuuauaaaaua

SEQ ID NO: 236137 - RNA, 64 nt, hsa
aguugcccuggcagaaaaauggauucaacuuggccuuucugaaggcaagacugggauuggauca

SEQ ID NO: 236138 - RNA, 64 nt, hsa
uuauuuuaccugcaauaggugugccuacaaaagucuuucugacauacacacugcagguggcagu

SEQ ID NO: 236139 - RNA, 64 nt, hsa
aaaaggaccuaagauucucuggcucagccccagccuuucugaagaagggaaaacuagggaccca

SEQ ID NO: 236140 - RNA, 64 nt, hsa
agcgguuugcagagaauguuagccaugacuugggcuuucugaaaguuggcuauaauuucucuau

SEQ ID NO: 236141 - RNA, 64 nt, hsa
uacucaaagucuaacauauucaaugcaaguaagacuuucugaaaacacuugaugauguggaaau

SEQ ID NO: 236142 - RNA, 64 nt, hsa; identical to SEQ ID NO: 138992

SEQ ID NO: 236143 - RNA, 64 nt, hsa; identical to SEQ ID NO: 138993

SEQ ID NO: 236144 - RNA, 64 nt, hsa; identical to SEQ ID NO: 138994

SEQ ID NO: 236145 - RNA, 64 nt, hsa; identical to SEQ ID NO: 138995

SEQ ID NO: 236146 - RNA, 64 nt, hsa; identical to SEQ ID NO: 138996

SEQ ID NO: 236147 - RNA, 64 nt, hsa; identical to SEQ ID NO: 138997

SEQ ID NO: 236148 - RNA, 64 nt, hsa; identical to SEQ ID NO: 138998

SEQ ID NO: 236149 - RNA, 64 nt, hsa; identical to SEQ ID NO: 138999

SEQ ID NO: 236150 - RNA, 64 nt, hsa; identical to SEQ ID NO: 139000

SEQ ID NO: 236151 - RNA, 64 nt, hsa; identical to SEQ ID NO: 139001

SEQ ID NO: 236152 - RNA, 64 nt, hsa; identical to SEQ ID NO: 139002

SEQ ID NO: 236153 - RNA, 64 nt, hsa; identical to SEQ ID NO: 139003

SEQ ID NO: 236154 - RNA, 64 nt, hsa; identical to SEQ ID NO: 139004

SEQ ID NO: 236155 - RNA, 64 nt, hsa; identical to SEQ ID NO: 139005

SEQ ID NO: 236156 - RNA, 64 nt, hsa; identical to SEQ ID NO: 139006

SEQ ID NO: 236157 - RNA, 64 nt, hsa; identical to SEQ ID NO: 139007

SEQ ID NO: 236158 - RNA, 64 nt, hsa; identical to SEQ ID NO: 139008

SEQ ID NO: 236159 - RNA, 64 nt, hsa; identical to SEQ ID NO: 139009

SEQ ID NO: 236160 - RNA, 64 nt, hsa; identical to SEQ ID NO: 139010

SEQ ID NO: 236161 - RNA, 64 nt, hsa; identical to SEQ ID NO: 139011

SEQ ID NO: 236162 - RNA, 64 nt, hsa; identical to SEQ ID NO: 139012

SEQ ID NO: 236163 - RNA, 64 nt, hsa; identical to SEQ ID NO: 139013

SEQ ID NO: 236164 - RNA, 64 nt, hsa; identical to SEQ ID NO: 139014

SEQ ID NO: 236165 - RNA, 64 nt, hsa; identical to SEQ ID NO: 139015

SEQ ID NO: 236166 - RNA, 64 nt, hsa; identical to SEQ ID NO: 139016

SEQ ID NO: 236167 - RNA, 64 nt, hsa; identical to SEQ ID NO: 139017

SEQ ID NO: 236168 - RNA, 64 nt, hsa; identical to SEQ ID NO: 139018

SEQ ID NO: 236169 - RNA, 64 nt, hsa; identical to SEQ ID NO: 139019

SEQ ID NO: 236170 - RNA, 64 nt, hsa; identical to SEQ ID NO: 139020

SEQ ID NO: 236171 - RNA, 64 nt, hsa; identical to SEQ ID NO: 139021

SEQ ID NO: 236172 - RNA, 64 nt, hsa; identical to SEQ ID NO: 139022

SEQ ID NO: 236173 - RNA, 64 nt, hsa; identical to SEQ ID NO: 139023

SEQ ID NO: 236174 - RNA, 64 nt, hsa; identical to SEQ ID NO: 139024

SEQ ID NO: 236175 - RNA, 64 nt, hsa; identical to SEQ ID NO: 139025

SEQ ID NO: 236176 - RNA, 64 nt, hsa; identical to SEQ ID NO: 139026

SEQ ID NO: 236177 - RNA, 64 nt, hsa; identical to SEQ ID NO: 139027

SEQ ID NO: 236178 - RNA, 64 nt, hsa; identical to SEQ ID NO: 139028

SEQ ID NO: 236179 - RNA, 64 nt, hsa
ccauaccagagauguggugagcucuguucuucuaccaacccagucucaacacacaaagugccac

SEQ ID NO: 236180 - RNA, 64 nt, hsa
ggccugagcuacuugaagggggccaucuagguccccaacccauggacuuugccuccauuuucag

SEQ ID NO: 236181 - RNA, 64 nt, hsa
cagcacggccuagcccaacccagcccaacccggcccaacccagcccagcccagcucagcucagc

SEQ ID NO: 236182 - RNA, 51 nt, hsa; identical to SEQ ID NO: 110042

SEQ ID NO: 236183 - RNA, 64 nt, hsa
cauuaauagugaaccacaccaggagaacaaauacccaacccaguggcaucagcagucacagagc

SEQ ID NO: 236184 - RNA, 64 nt, hsa
ggacuagacaucaaagcagcguuccaaccugaggccaacccaucucaccugacacugaauacug

SEQ ID NO: 236185 - RNA, 64 nt, hsa
cgggccaggcgcagccaucgggaaggucauucagccaacccagaggauguagacccuguccuca

SEQ ID NO: 236186 - RNA, 64 nt, hsa
cuucuccucacagggccuggccauauagccagcuccaacccaaagcccugcacagugccucacc

SEQ ID NO: 236187 - RNA, 64 nt, hsa
uccugcaccuuccucucccaggucgcugcugcagccaacccaguagcccccuuagcgcccccgc

SEQ ID NO: 236188 - RNA, 64 nt, hsa
aaucuuaagccauguccucaucugcccacccuccccaacccacauaccuccauuccacuuguga

SEQ ID NO: 236189 - RNA, 64 nt, hsa
ugcugggucccagccugguuugcaaagaccaccuccaacccaacccaaucccucuccacucuuc

SEQ ID NO: 236190 - RNA, 64 nt, hsa
ggucccagccugguuugcaaagaccaccuccaacccaacccaaucccucuccacucuucucucc

SEQ ID NO: 236191 - RNA, 64 nt, hsa
agggaggcucugcucagaguucggcggacccaccccaacccaacucccagccgccagccaaagc

SEQ ID NO: 236192 - RNA, 64 nt, hsa
uccgaguccugggucccaguccagcugcugccucccaacccaugcccgcuagaaaccugcugcg

SEQ ID NO: 236193 - RNA, 64 nt, hsa
uccaccccacaucccaccacauccaccuccauccccaacccauccucauccccaacuacagccc

SEQ ID NO: 236194 - RNA, 64 nt, hsa
caacucauccucauccccaacugcagccccaaacccaacccagggccauccccaaacccauccc

SEQ ID NO: 236195 - RNA, 64 nt, hsa
gccuugagacagcagccuaucuggggccacacagccaacccagcccuggucccugaggucugcc

SEQ ID NO: 236196 - RNA, 64 nt, hsa
uccuugggccccuuccucugacccucguuggaccccaacccagacccccuuuucuccauguacc

SEQ ID NO: 236197 - RNA, 64 nt, hsa
aaagagaaauccugcacccaucagccaacacuccccaacccaucggccaccccaagcccucugc

SEQ ID NO: 236198 - RNA, 64 nt, hsa
uucuugaugcuuugggggcucaauuauuuuauauccaacccagcaucuuucuagucccuaugcu

SEQ ID NO: 236199 - RNA, 64 nt, hsa; identical to SEQ ID NO: 164794

SEQ ID NO: 236200 - RNA, 64 nt, hsa; identical to SEQ ID NO: 164795

SEQ ID NO: 236201 - RNA, 64 nt, hsa; identical to SEQ ID NO: 164796

SEQ ID NO: 236202 - RNA, 64 nt, hsa; identical to SEQ ID NO: 164797

SEQ ID NO: 236203 - RNA, 64 nt, hsa; identical to SEQ ID NO: 164798

SEQ ID NO: 236204 - RNA, 64 nt, hsa; identical to SEQ ID NO: 164799

SEQ ID NO: 236205 - RNA, 64 nt, hsa; identical to SEQ ID NO: 164800

SEQ ID NO: 236206 - RNA, 64 nt, hsa; identical to SEQ ID NO: 164801

SEQ ID NO: 236207 - RNA, 64 nt, hsa; identical to SEQ ID NO: 164802

SEQ ID NO: 236208 - RNA, 64 nt, hsa; identical to SEQ ID NO: 164803

SEQ ID NO: 236209 - RNA, 64 nt, hsa; identical to SEQ ID NO: 164804

SEQ ID NO: 236210 - RNA, 64 nt, hsa; identical to SEQ ID NO: 164805

SEQ ID NO: 236211 - RNA, 64 nt, hsa; identical to SEQ ID NO: 164806

SEQ ID NO: 236212 - RNA, 64 nt, hsa; identical to SEQ ID NO: 164807

SEQ ID NO: 236213 - RNA, 64 nt, hsa; identical to SEQ ID NO: 164808

SEQ ID NO: 236214 - RNA, 64 nt, hsa; identical to SEQ ID NO: 164809

SEQ ID NO: 236215 - RNA, 64 nt, hsa; identical to SEQ ID NO: 164810

SEQ ID NO: 236216 - RNA, 64 nt, hsa; identical to SEQ ID NO: 164811

SEQ ID NO: 236217 - RNA, 64 nt, hsa; identical to SEQ ID NO: 164812

SEQ ID NO: 236218 - RNA, 64 nt, hsa; identical to SEQ ID NO: 164813

SEQ ID NO: 236219 - RNA, 64 nt, hsa; identical to SEQ ID NO: 164814

SEQ ID NO: 236220 - RNA, 64 nt, hsa; identical to SEQ ID NO: 164815

SEQ ID NO: 236221 - RNA, 64 nt, hsa; identical to SEQ ID NO: 164816

SEQ ID NO: 236222 - RNA, 64 nt, hsa; identical to SEQ ID NO: 164817

SEQ ID NO: 236223 - RNA, 64 nt, hsa; identical to SEQ ID NO: 164818

SEQ ID NO: 236224 - RNA, 64 nt, hsa; identical to SEQ ID NO: 164819

SEQ ID NO: 236225 - RNA, 64 nt, hsa; identical to SEQ ID NO: 164820

SEQ ID NO: 236226 - RNA, 64 nt, hsa; identical to SEQ ID NO: 164821

SEQ ID NO: 236227 - RNA, 64 nt, hsa; identical to SEQ ID NO: 164822

SEQ ID NO: 236228 - RNA, 64 nt, hsa; identical to SEQ ID NO: 164823

SEQ ID NO: 236229 - RNA, 64 nt, hsa; identical to SEQ ID NO: 164824

SEQ ID NO: 236230 - RNA, 64 nt, hsa; identical to SEQ ID NO: 164825

SEQ ID NO: 236231 - RNA, 64 nt, hsa; identical to SEQ ID NO: 164826

SEQ ID NO: 236232 - RNA, 64 nt, hsa; identical to SEQ ID NO: 164827

SEQ ID NO: 236233 - RNA, 64 nt, hsa; identical to SEQ ID NO: 164828

SEQ ID NO: 236234 - RNA, 64 nt, hsa
aaggggagcagaaaggaaacguuguuacugaugaguaccacagacucaucuuaaaaaaaacucu

SEQ ID NO: 236235 - RNA, 64 nt, hsa
uuuaaaugguaaauauugcaaaaguuaaacaaggguaccacaauaucauuuauaauugauguca

SEQ ID NO: 236236 - RNA, 64 nt, hsa
aaguggguucucugggcuguggcuuugucuaguaguaccacaguggcuaaaguagaagaaaacc

SEQ ID NO: 236237 - RNA, 64 nt, hsa
uucguagugccagcacaguccuaaaagggcuggaguaccacaccaacacagguaggggugcagg

SEQ ID NO: 236238 - RNA, 64 nt, hsa
aaguguugucaaguacagugugugucggagagauguaccacagcuuaacuggaagaggaagccc

SEQ ID NO: 236239 - RNA, 64 nt, hsa
agggagaugaacaaaauugucaaacaagacugauguaccacaaguguugucaaguacagugugu

SEQ ID NO: 236240 - RNA, 64 nt, hsa
cagaagaaaacagguuaacaaucaaguagugaaagcacuauauucuagucauuaacucaacgga

SEQ ID NO: 236241 - RNA, 64 nt, hsa
uccaggggcagguaaagcccugcugggcucagaagcacuauagaauuugcuguacacacugaag

SEQ ID NO: 236242 - RNA, 64 nt, hsa
ucauuuucucauuaacgauaaaauaugcuguaaggcacuauaagaauauaaaugauucuauuac

SEQ ID NO: 236243 - RNA, 64 nt, hsa
acuuuguaagguucgguuuaagguuucaggguuagcacuauaguuuugguucauuuucucauua

SEQ ID NO: 236244 - RNA, 64 nt, hsa
auaguuuucacauuuuaauuccuccuccugagaugcacuauacuuaaaaccauucucuccccug

SEQ ID NO: 236245 - RNA, 64 nt, hsa
uugguuggauucuucaacacagccaaugaaaacagcacuauauuucugaucugucacuguuguu

SEQ ID NO: 236246 - RNA, 64 nt, hsa
ucucauuuucaaaagcaauucuucggugcuguguagcuggcagaaaguucuguccaguaaacgc

SEQ ID NO: 236247 - RNA, 64 nt, hsa
cagauggaagaaauagcaggagagaggacccauuagcuggcagacccagggggaagaaaggagg

SEQ ID NO: 236248 - RNA, 64 nt, hsa
caguauaucaaucaacucuaacucggagacgucuagcuggcaauguuucuaaaacuuucacugg

SEQ ID NO: 236249 - RNA, 64 nt, hsa
guuguccaacaacagugcugacuguccggauaagagcuggcaagugcccuuaggaugccgcaug

SEQ ID NO: 236250 - RNA, 64 nt, hsa
uuccgguuggaggcucucaugucucuuuggggagagcuggcagugugcggagcugauaacauuu

SEQ ID NO: 236251 - RNA, 64 nt, hsa
gcuccccagaggucacacagccugugugcaguggagcuggcaccauucagacuuucagccgacu

SEQ ID NO: 236252 - RNA, 64 nt, hsa
uugcuauccagcacguggaccgggcucccagaagagcuggcauugugucugagcagagcugggu

SEQ ID NO: 236253 - RNA, 64 nt, hsa
ccccuuguccugcagaugggaaaacaggauggggagcuggcaagaggagcugcuuguucccacc

SEQ ID NO: 236254 - RNA, 64 nt, hsa
caucuccucccaccaguggcccccacucacagggagcuggcaaugcccuaccugccuguucucc

SEQ ID NO: 236255 - RNA, 64 nt, hsa
cugccgccuccuucuuaacucugcaggaaaucagagcuggcagccuccagugggaggacagagc

SEQ ID NO: 236256 - RNA, 64 nt, hsa
guuuuguggacagccguguugucugacuguauccagcuggcacuugacagggugcagucauugg

SEQ ID NO: 236257 - RNA, 64 nt, hsa
agaugguuuaaggacaccccagaguccccagaugagcuggcauuugagcuggucuggagcagag

SEQ ID NO: 236258 - RNA, 64 nt, hsa
uaauuuaauuuuaaaauaaaugcugcauugguaaagcuggcaguugaaaccaguuggacggccc

SEQ ID NO: 236259 - RNA, 64 nt, hsa
uaauugacccuugcagcuacccaauagcccuuggagcuggcacugaaccaggcugcaagauuug

SEQ ID NO: 236260 - RNA, 64 nt, hsa
cccuccgcaggggacuucagagcagcaaggccccagcuggcaguagccugaccaucuggacaca

SEQ ID NO: 236261 - RNA, 64 nt, hsa
cugugucuccucccuguaccgugucaacuccaagagcuggcaccaggccgggagggcuauuccc

SEQ ID NO: 236262 - RNA, 64 nt, hsa
caguuaagcacucuuugacugcugaaggaaccccauggaugaggugcaggcuacuucacucuuu

SEQ ID NO: 236263 - RNA, 64 nt, hsa
cgaagccaggagagguagagugaaaaucccagccauggaugaauguacuaauuugaaagccaag

SEQ ID NO: 236264 - RNA, 64 nt, hsa
cccuuuuugucccuuuccccaagccaccaauuggauggaugaauguuugacggggaagaggaag

SEQ ID NO: 236265 - RNA, 64 nt, hsa
uguuugacggggaagaggaaggguaggaggaugcauggaugaguggaugaguggaucgauggau

SEQ ID NO: 236266 - RNA, 64 nt, hsa
aggcaguuucccagagaaacaagcauauugccucauggaugaaagacuuguaguucuaguuuca

SEQ ID NO: 236267 - RNA, 64 nt, hsa
cauuggcuaaaaauguguuuuguugaguuuccaaauggaugaauuuucauuuggacauuacauc

SEQ ID NO: 236268 - RNA, 64 nt, hsa
ugaucacgaaacaaucacggugcagaauguccguauggaugaucaugacaaacaaucacugcgc

SEQ ID NO: 236269 - RNA, 64 nt, hsa
cgaucacgaaacaaucacggugcgaaauguccgcauggaugaucacgaaacaaucacggugcag

SEQ ID NO: 236270 - RNA, 64 nt, hsa; identical to SEQ ID NO: 153150

SEQ ID NO: 236271 - RNA, 64 nt, hsa; identical to SEQ ID NO: 153151

SEQ ID NO: 236272 - RNA, 64 nt, hsa; identical to SEQ ID NO: 153152

SEQ ID NO: 236273 - RNA, 64 nt, hsa; identical to SEQ ID NO: 153153

SEQ ID NO: 236274 - RNA, 64 nt, hsa; identical to SEQ ID NO: 153154

SEQ ID NO: 236275 - RNA, 64 nt, hsa; identical to SEQ ID NO: 153155

SEQ ID NO: 236276 - RNA, 64 nt, hsa; identical to SEQ ID NO: 153156

SEQ ID NO: 236277 - RNA, 64 nt, hsa; identical to SEQ ID NO: 153157

SEQ ID NO: 236278 - RNA, 64 nt, hsa; identical to SEQ ID NO: 153158

SEQ ID NO: 236279 - RNA, 64 nt, hsa; identical to SEQ ID NO: 153159

SEQ ID NO: 236280 - RNA, 64 nt, hsa; identical to SEQ ID NO: 153160

SEQ ID NO: 236281 - RNA, 64 nt, hsa; identical to SEQ ID NO: 153161

SEQ ID NO: 236282 - RNA, 52 nt, hsa; identical to SEQ ID NO: 153162

SEQ ID NO: 236283 - RNA, 64 nt, hsa; identical to SEQ ID NO: 153163

SEQ ID NO: 236284 - RNA, 64 nt, hsa
ucucagguagagauuggggcugcuauggggacuggcccuguaggguugagccacagacagcucu

SEQ ID NO: 236285 - RNA, 64 nt, hsa
ccccaaccucucuauggcagagaggcagggaguggcccuguacauagacugcuggggauugggu

SEQ ID NO: 236286 - RNA, 64 nt, hsa
gaaauuaaguuaacauggauucauuacguuccuggcccuguagacacguguaagauuauuuaaa

SEQ ID NO: 236287 - RNA, 64 nt, hsa
uuagugaacagaaaauugcuuuggaagagauucugcccuguagacacuaugugaauaacugaag

SEQ ID NO: 236288 - RNA, 64 nt, hsa
auuuuggaccagaucguucuuuguugugggggcugcccuguacggcaaagaaugccgagcagca

SEQ ID NO: 236289 - RNA, 64 nt, hsa
ccuuaaggaugggggaaucagcaggugucagcgugcccuguaugcucagggcagcuguuuccac

SEQ ID NO: 236290 - RNA, 63 nt, hsa
agcuuucuuucccaggggugaaggauggcgcucgggggugacuccuaagcucagcguggaagc

SEQ ID NO: 236291 - RNA, 63 nt, hsa
uuuuuaacuuguuccucugucuacuguguguuugggggugacaucuaaauuccauuucuucuu

SEQ ID NO: 236292 - RNA, 63 nt, hsa
guuuuuuguuuuuuaacagaauuauauaugucugggggugaaaaaacccuugcauuccaaagg

SEQ ID NO: 236293 - RNA, 63 nt, hsa
ccaucucgcccuugcugggggcacgggaguggggggggugacaugggcccuaggcagacugca

SEQ ID NO: 236294 - RNA, 63 nt, hsa
aacgccagagcccuggcuggugaugugcuggcugggggugaaucccaaugagggucccucuca

SEQ ID NO: 236295 - RNA, 63 nt, hsa
aacgccagagcccuggauggugaugcgcuggcugggggugaaucccaaugagggucccucuca

SEQ ID NO: 236296 - RNA, 63 nt, hsa
aacgccagagcccuggcuggugacaugcuggcugggggugaauccgaaugacagugcagacgu

SEQ ID NO: 236297 - RNA, 63 nt, hsa
gggugacaccaggagagagggacagguucuguugggggugacaccaggacacaggaauagguu

SEQ ID NO: 236298 - RNA, 63 nt, hsa
gggugacaagaggagacagggacagguucugucgggggugacaccaggagagagggacagguu

SEQ ID NO: 236299 - RNA, 63 nt, hsa
gggugacaccaggagagagggacagguucuguugggggugacaagaggagacagggacagguu

SEQ ID NO: 236300 - RNA, 63 nt, hsa
gggugacaccaggacacagggacagguucugucgggggugacaccaggacacagggacagguu

SEQ ID NO: 236301 - RNA, 63 nt, hsa
ucuuuuuuuuuuuuuuuggagucugcuuucugugggggugaggccgggcugucucgugguggc

SEQ ID NO: 236302 - RNA, 63 nt, hsa
gaccaugguguuucucuauguuucucuaaguuggggggugagcgugugugacagucuacugga

SEQ ID NO: 236303 - RNA, 63 nt, hsa
ugacugcauuaacuuaacuuacggggugggggcgggggugaggguaggugcuuuuuucuuaug

SEQ ID NO: 236304 - RNA, 63 nt, hsa
ccggacguccuacucaggcugucggggcuuggugggggugacuuuuggcagcccgagacccag

SEQ ID NO: 236305 - RNA, 63 nt, hsa
cacccucucaugcuaccagcaccauaauccagugggggugacugggugcacaccugcccaggu

SEQ ID NO: 236306 - RNA, 63 nt, hsa
uccaaagagagucagagcuaagcauacaggcuugggggugagcccugcugugagaguucaggc

SEQ ID NO: 236307 - RNA, 63 nt, hsa
uucuuccuccccucaacagugaguuagacucaagggggugacagaaccgagaagggggugaca

SEQ ID NO: 236308 - RNA, 63 nt, hsa
gaguuagacucaagggggugacagaaccgagaagggggugacaguccuccauccacguggccu

SEQ ID NO: 236309 - RNA, 63 nt, hsa
ugcucaugcagacucuggggcugaggugccccggggggugaucucuggugcucacagccgagg

SEQ ID NO: 236310 - RNA, 63 nt, hsa
ugaggagaggacccaggagugugggggcauuuggggggugaaguggcccccgaagaauggaac

SEQ ID NO: 236311 - RNA, 64 nt, hsa
cccucucacuccucuugcccucugcuuuacucucauguggcaaacgugcggcucguggugugag

SEQ ID NO: 236312 - RNA, 64 nt, hsa
guuuggucaccgugugcaucgcaccgugcuguaaauguggcagacgcagccugcggccaggcuu

SEQ ID NO: 236313 - RNA, 64 nt, hsa
ugguggggagaggcagggcugagguggucuacgaauguggcagguagggaaggggagaugucug

SEQ ID NO: 236314 - RNA, 64 nt, hsa
ccaacacuucuggacauugcauccuuauucacacauguggcagcugaacgaggugcuguugugg

SEQ ID NO: 236315 - RNA, 64 nt, hsa
uucauacuugagagaaauccuacaaauguaaagaauguggcaaaccuuuggaugauccacaaac

SEQ ID NO: 236316 - RNA, 64 nt, hsa
auaagaaaaaucaugcuggagggaagcccuacacauguggcagaauguggcaaagcauuuaauu

SEQ ID NO: 236317 - RNA, 64 nt, hsa
ucaugcuggagggaagcccuacacauguggcagaauguggcaaagcauuuaauugguccucaau

SEQ ID NO: 236318 - RNA, 64 nt, hsa
uucaugcuggagcaaaaugcuucacaugcgaagaauguggcacagucuuuaccacauccucaaa

SEQ ID NO: 236319 - RNA, 64 nt, hsa
uuuauaccagagagaaacccuacacauguaaagaauguggcaaagccuucaauagguucucaac

SEQ ID NO: 236320 - RNA, 64 nt, hsa
cucauacuggaggaaagucuuacaaaugugaagaauguggcagucuuuaaaucuuccucagucu

SEQ ID NO: 236321 - RNA, 64 nt, hsa
augauauuggugagaagccacaaaaauaugaaaaauguggcaaagccuucaaaugcuugucaca

SEQ ID NO: 236322 - RNA, 64 nt, hsa
uuccuacugaagaaauccccuggaaaugcaaaaaauguggcaggauuuuuaccaaugcucaucu

SEQ ID NO: 236323 - RNA, 64 nt, hsa
ccgcgggcggccaggcaacgugcgugucucugccauguggcagaagugcucuuuguggcagugg

SEQ ID NO: 236324 - RNA, 64 nt, hsa
uugagacccccaagcuuccaccugucccucuccuauguggcagcuggggagcagcugagaugug

SEQ ID NO: 236325 - RNA, 64 nt, hsa
gcugaaauuuuuauacauucaacucaugauucacauguggcaucagucccaucagccggaacua

SEQ ID NO: 236326 - RNA, 64 nt, hsa
ggaugaggcuucagcccccauugucuuauguagaauguggcaaugccaacuggagaaagggaag

SEQ ID NO: 236327 - RNA, 64 nt, hsa
uuuuauacuggugagaaaccuuacaauguaaagaauguggcacagcuuuuaacuaaucuucaaa

SEQ ID NO: 236328 - RNA, 64 nt, hsa
auucguacuggagagaauccuacaaaugugaaaaauguggcaaauccuuuaacugauccucaac

SEQ ID NO: 236329 - RNA, 64 nt, hsa
uucauacuggagaaaagccauacaaaugagaagaauguggcaaugccuuuaaucaguccucaca

SEQ ID NO: 236330 - RNA, 64 nt, hsa
uuuauacuggagaggaacucuauaguugugaagaauguggcaaagcuuuuaaccaauccucaua

SEQ ID NO: 236331 - RNA, 64 nt, hsa
uucauacuggagagaaagccuacaauugugaagaauguggcaaagcuuuuaaccuuccuuaacc

SEQ ID NO: 236332 - RNA, 64 nt, hsa
uuauacuuugagagaaacccugcaaaugugaauaauguggcaauacuuuaaaccaauccucaaa

SEQ ID NO: 236333 - RNA, 64 nt, hsa
uccauacugaagaaaacuccuggaaguguaaaaaauguggcaacacuuuuaauaaaugcucacc

SEQ ID NO: 236334 - RNA, 64 nt, hsa
uuuacacuagagagaaagccuacaaaugugaagaauguggcaaagccuuuaaccaguuuucaac

SEQ ID NO: 236335 - RNA, 64 nt, hsa
uucauagcggagagaaaccccacaaaugugaagaauguggcagagcuuuuaaccaguccgcaaa

SEQ ID NO: 236336 - RNA, 64 nt, hsa
uucacaguggagaaaaacccuacaaaugugaagaauguggcaaagcuuuuaaccaguccucaca

SEQ ID NO: 236337 - RNA, 64 nt, hsa
uucauacuggagagaaaccuuacaaaugugaggaauguggcaaagguuuuagccaacucucaaa

SEQ ID NO: 236338 - RNA, 64 nt, hsa
uucauacuagagagaaacccuacaaaugugaagaauguggcauaucuuuuaaccaguucucaca

SEQ ID NO: 236339 - RNA, 64 nt, hsa
uucacacuugaaugaaacccuacaaaugugaacgauguggcaguuguuuuaacuaguucucgaa

SEQ ID NO: 236340 - RNA, 64 nt, hsa
uucaaacuggagagaaacucuacaaaugugaagaauguggcaaagcuuuuaaccaagucucaac

SEQ ID NO: 236341 - RNA, 64 nt, hsa
aaauucacaaagagaugcccuguaaguguacuguauguggcagugacuucugccauacuucaua

SEQ ID NO: 236342 - RNA, 64 nt, hsa
ucuauaccagugagaaaucuuacaaauguauugaauguggcaaauuuuucaugcuauuaguauu

SEQ ID NO: 236343 - RNA, 64 nt, hsa
caaaaugcacagccugaauggacguagcacugucauguggcauuuggaaaaucuuuaauuaucc

SEQ ID NO: 236344 - RNA, 64 nt, hsa
uaauuucucgagcuguuuuucucauccaggguauauguggcagccuuugccauaucagcguaug

SEQ ID NO: 236345 - RNA, 64 nt, hsa
uucauacuggagagaaaccuuacaagugugaagaauguggcaaaacuucuaaccauuucucaac

SEQ ID NO: 236346 - RNA, 64 nt, hsa
uucauacugaagagaaacaguacaaaugugaugaauguggcaaagcuucuaccugauccucaaa

SEQ ID NO: 236347 - RNA, 64 nt, hsa
uucauacuggagagaaacccuacaaaugugaagaauguggcaaagcuuuuaaccaaucuucaac

SEQ ID NO: 236348 - RNA, 64 nt, hsa
aaaaggugaaagguuauauuuuuuacagaucagaauguggcaccagaggacugugucucauuaa

SEQ ID NO: 236349 - RNA, 64 nt, hsa
cuucuucauaccauucuccuugucccuugcuccuauguggcaaaaggucagccuugggguuggc

SEQ ID NO: 236350 - RNA, 64 nt, hsa
acacauguguuaucuaccucaagguaacaagaguauguggcaaaacauauaccacccauagugc

SEQ ID NO: 236351 - RNA, 64 nt, hsa
aggcaagcaugaauaaaauuagguuaaacguagcauguggcaucgcagucucuuagaauuuguu

SEQ ID NO: 236352 - RNA, 64 nt, hsa
uuuauaugggagugaaacccuacaaauguuaagaauguggcauaaccuuuaacuauuuucaagc

SEQ ID NO: 236353 - RNA, 64 nt, hsa
auauaaacugaaaaaauccauacaaauauuaaaaauguggcaaauuauuuuaaacugugcucaa

SEQ ID NO: 236354 - RNA, 53 nt, hsa
aagagacuguacaaaagugaagaauguggcaaaggccuuuacugcuccuauuc

SEQ ID NO: 236355 - RNA, 64 nt, hsa
aaggccuuuacugcuccuauucccuuacuaaagaauguggcaaagcuuuucaccaguacuuuac

SEQ ID NO: 236356 - RNA, 64 nt, hsa
uuaaugcuggagagaaacccuacaaaugugaagaauguggcaaagauuucuauugauucucaua

SEQ ID NO: 236357 - RNA, 64 nt, hsa
uucauauuggagagaaauucuacagaugugaagaauguggcaaaggcuuuaauuaguucucauc

SEQ ID NO: 236358 - RNA, 64 nt, hsa
uucauaaaggagauaaauuauacaaaugugaagaauguggcaaagcuuuuaacaaauccucauc

SEQ ID NO: 236359 - RNA, 64 nt, hsa
uucauacuggagagaaaaccuacaaaugugaggaauguggcaaagccuuuagccugucccucca

SEQ ID NO: 236360 - RNA, 64 nt, hsa
uuuauacuggagagaagcccuacaaaugugaaaaauguggcaaaccuuuuaaccaauccucaac

SEQ ID NO: 236361 - RNA, 64 nt, hsa
uucaugcuggagagaaacccuacaaaugugaaaaauguggcaaagcuuuuaaccaauuuucaaa

SEQ ID NO: 236362 - RNA, 64 nt, hsa
cucauacuggagaaaaaucuuacaaaugugaagaauguggcaaagccuuuauccaguccucaac

SEQ ID NO: 236363 - RNA, 64 nt, hsa
uuaaugauggagagaaaccauacaacugugaagaauguggcaaagcuuuuaaccaguccucaaa

SEQ ID NO: 236364 - RNA, 64 nt, hsa
uucauauuggaaaaauuuccuacaaguaagaacaauguggcaaaguuuuuaacuaauacaccuu

SEQ ID NO: 236365 - RNA, 50 nt, hsa
guaccuuacagauggaaugaauguggcaaaaucuuuaguuagaauucaca

SEQ ID NO: 236366 - RNA, 64 nt, hsa
aggacucaggagaaaaaccuuacaaauaucauaaauguggcaaagaauuuaguuugcauugaag

SEQ ID NO: 236367 - RNA, 64 nt, hsa
auucuuacuagaaaaacucuuacaagugugaagaauguggcaaaauuuuuaaugaauacucaca

SEQ ID NO: 236368 - RNA, 64 nt, hsa
uucauacuagagagaaacccuacaaauguaaagaauguggcaaagcauuuaacuggucccuaaa

SEQ ID NO: 236369 - RNA, 64 nt, hsa
uucauacuggagagaaauccuacaaaugugauaaauguggcaaagccuuuaacuggcucuuaau

SEQ ID NO: 236370 - RNA, 64 nt, hsa
gauaauauacuggagaaaacuacuagaauaaacaauguggcacacauuuaaccaauacucaugc

SEQ ID NO: 236371 - RNA, 64 nt, hsa
uucauacuggagggaauuccuauaauuguguggaauguggcaaagccuuuaaccaguccuuaag

SEQ ID NO: 236372 - RNA, 64 nt, hsa
uuuauacaggagggaaacccuacaaaugugaagaauguggcaagccuuuuagcuguuccucaau

SEQ ID NO: 236373 - RNA, 64 nt, hsa
uucauacuggagagaaaaucuacaaaggugaagaauguggcaaagcuuuuaaacaguccucaau

SEQ ID NO: 236374 - RNA, 64 nt, hsa
uucuugcuggugagaaaccuaacaaauguaaugaauguggcaaggucuucuggcacaauucuca

SEQ ID NO: 236375 - RNA, 64 nt, hsa
accauagaggacagaaacuuuacuaauguacugaauguggcaaggucuuaagguaaaaucugag

SEQ ID NO: 236376 - RNA, 64 nt, hsa
uucguauuggagagaaacccuacaaguguaaugaauguggcauaguuuuuaaucaacagucaca

SEQ ID NO: 236377 - RNA, 64 nt, hsa
uucauacuggagagaaacuuuacaaguguaaugaauguggcaagguuuuuaaucaaaaaacaac

SEQ ID NO: 236378 - RNA, 64 nt, hsa
aauccacagugaagagaucuuacaaguguaauaaauguggcaaauuuuucagacaucguucaug

SEQ ID NO: 236379 - RNA, 64 nt, hsa
uucauacuggagagaaaccuuacaagcauaaugaauguggcaagguuuuuaaucaaaaagcaac

SEQ ID NO: 236380 - RNA, 64 nt, hsa
agccagccugagcucuccugcaagacagagccugauguggcacggagugggguugcggggggug

SEQ ID NO: 236381 - RNA, 64 nt, hsa
uuuuaucugaaagguuuuuuucucauuuaaucugauguggcauuuucgucaucugaagcaugag

SEQ ID NO: 236382 - RNA, 64 nt, hsa; identical to SEQ ID NO: 74555

SEQ ID NO: 236383 - RNA, 64 nt, hsa; identical to SEQ ID NO: 74556

SEQ ID NO: 236384 - RNA, 64 nt, hsa; identical to SEQ ID NO: 74557

SEQ ID NO: 236385 - RNA, 64 nt, hsa; identical to SEQ ID NO: 74558

SEQ ID NO: 236386 - RNA, 64 nt, hsa; identical to SEQ ID NO: 74559

SEQ ID NO: 236387 - RNA, 64 nt, hsa; identical to SEQ ID NO: 74560

SEQ ID NO: 236388 - RNA, 64 nt, hsa; identical to SEQ ID NO: 236311

SEQ ID NO: 236389 - RNA, 64 nt, hsa; identical to SEQ ID NO: 236312

SEQ ID NO: 236390 - RNA, 64 nt, hsa; identical to SEQ ID NO: 236313

SEQ ID NO: 236391 - RNA, 64 nt, hsa; identical to SEQ ID NO: 236314

SEQ ID NO: 236392 - RNA, 64 nt, hsa; identical to SEQ ID NO: 236315

SEQ ID NO: 236393 - RNA, 64 nt, hsa; identical to SEQ ID NO: 236316

SEQ ID NO: 236394 - RNA, 64 nt, hsa; identical to SEQ ID NO: 236317

SEQ ID NO: 236395 - RNA, 64 nt, hsa; identical to SEQ ID NO: 236318

SEQ ID NO: 236396 - RNA, 64 nt, hsa; identical to SEQ ID NO: 236319

SEQ ID NO: 236397 - RNA, 64 nt, hsa; identical to SEQ ID NO: 236320

SEQ ID NO: 236398 - RNA, 64 nt, hsa; identical to SEQ ID NO: 236321

SEQ ID NO: 236399 - RNA, 64 nt, hsa; identical to SEQ ID NO: 236322

SEQ ID NO: 236400 - RNA, 64 nt, hsa; identical to SEQ ID NO: 236323

SEQ ID NO: 236401 - RNA, 64 nt, hsa; identical to SEQ ID NO: 236324

SEQ ID NO: 236402 - RNA, 64 nt, hsa; identical to SEQ ID NO: 236325

SEQ ID NO: 236403 - RNA, 64 nt, hsa; identical to SEQ ID NO: 236326

SEQ ID NO: 236404 - RNA, 64 nt, hsa; identical to SEQ ID NO: 236327

SEQ ID NO: 236405 - RNA, 64 nt, hsa; identical to SEQ ID NO: 236328

SEQ ID NO: 236406 - RNA, 64 nt, hsa; identical to SEQ ID NO: 236329

SEQ ID NO: 236407 - RNA, 64 nt, hsa; identical to SEQ ID NO: 236330

SEQ ID NO: 236408 - RNA, 64 nt, hsa; identical to SEQ ID NO: 236331

SEQ ID NO: 236409 - RNA, 64 nt, hsa; identical to SEQ ID NO: 236332

SEQ ID NO: 236410 - RNA, 64 nt, hsa; identical to SEQ ID NO: 236333

SEQ ID NO: 236411 - RNA, 64 nt, hsa; identical to SEQ ID NO: 236334

SEQ ID NO: 236412 - RNA, 64 nt, hsa; identical to SEQ ID NO: 236335

SEQ ID NO: 236413 - RNA, 64 nt, hsa; identical to SEQ ID NO: 236336

SEQ ID NO: 236414 - RNA, 64 nt, hsa; identical to SEQ ID NO: 236337

SEQ ID NO: 236415 - RNA, 64 nt, hsa; identical to SEQ ID NO: 236338

SEQ ID NO: 236416 - RNA, 64 nt, hsa; identical to SEQ ID NO: 236339

SEQ ID NO: 236417 - RNA, 64 nt, hsa; identical to SEQ ID NO: 236340

SEQ ID NO: 236418 - RNA, 64 nt, hsa; identical to SEQ ID NO: 236341

SEQ ID NO: 236419 - RNA, 64 nt, hsa; identical to SEQ ID NO: 236342

SEQ ID NO: 236420 - RNA, 64 nt, hsa; identical to SEQ ID NO: 236343

SEQ ID NO: 236421 - RNA, 64 nt, hsa; identical to SEQ ID NO: 236344

SEQ ID NO: 236422 - RNA, 64 nt, hsa; identical to SEQ ID NO: 236345

SEQ ID NO: 236423 - RNA, 64 nt, hsa; identical to SEQ ID NO: 236346

SEQ ID NO: 236424 - RNA, 64 nt, hsa; identical to SEQ ID NO: 236347

SEQ ID NO: 236425 - RNA, 64 nt, hsa; identical to SEQ ID NO: 236348

SEQ ID NO: 236426 - RNA, 64 nt, hsa; identical to SEQ ID NO: 236349

SEQ ID NO: 236427 - RNA, 64 nt, hsa; identical to SEQ ID NO: 236350

SEQ ID NO: 236428 - RNA, 64 nt, hsa; identical to SEQ ID NO: 236351

SEQ ID NO: 236429 - RNA, 64 nt, hsa; identical to SEQ ID NO: 236352

SEQ ID NO: 236430 - RNA, 64 nt, hsa; identical to SEQ ID NO: 236353

SEQ ID NO: 236431 - RNA, 53 nt, hsa; identical to SEQ ID NO: 236354

SEQ ID NO: 236432 - RNA, 64 nt, hsa; identical to SEQ ID NO: 236355

SEQ ID NO: 236433 - RNA, 64 nt, hsa; identical to SEQ ID NO: 236356

SEQ ID NO: 236434 - RNA, 64 nt, hsa; identical to SEQ ID NO: 236357

SEQ ID NO: 236435 - RNA, 64 nt, hsa; identical to SEQ ID NO: 236358

SEQ ID NO: 236436 - RNA, 64 nt, hsa; identical to SEQ ID NO: 236359

SEQ ID NO: 236437 - RNA, 64 nt, hsa; identical to SEQ ID NO: 236360

SEQ ID NO: 236438 - RNA, 64 nt, hsa; identical to SEQ ID NO: 236361

SEQ ID NO: 236439 - RNA, 64 nt, hsa; identical to SEQ ID NO: 236362

SEQ ID NO: 236440 - RNA, 64 nt, hsa; identical to SEQ ID NO: 236363

SEQ ID NO: 236441 - RNA, 64 nt, hsa; identical to SEQ ID NO: 236364

SEQ ID NO: 236442 - RNA, 50 nt, hsa; identical to SEQ ID NO: 236365

SEQ ID NO: 236443 - RNA, 64 nt, hsa; identical to SEQ ID NO: 236366

SEQ ID NO: 236444 - RNA, 64 nt, hsa; identical to SEQ ID NO: 236367

SEQ ID NO: 236445 - RNA, 64 nt, hsa; identical to SEQ ID NO: 236368

SEQ ID NO: 236446 - RNA, 64 nt, hsa; identical to SEQ ID NO: 236369

SEQ ID NO: 236447 - RNA, 64 nt, hsa; identical to SEQ ID NO: 236370

SEQ ID NO: 236448 - RNA, 64 nt, hsa; identical to SEQ ID NO: 236371

SEQ ID NO: 236449 - RNA, 64 nt, hsa; identical to SEQ ID NO: 236372

SEQ ID NO: 236450 - RNA, 64 nt, hsa; identical to SEQ ID NO: 236373

SEQ ID NO: 236451 - RNA, 64 nt, hsa; identical to SEQ ID NO: 236374

SEQ ID NO: 236452 - RNA, 64 nt, hsa; identical to SEQ ID NO: 236375

SEQ ID NO: 236453 - RNA, 64 nt, hsa; identical to SEQ ID NO: 236376

SEQ ID NO: 236454 - RNA, 64 nt, hsa; identical to SEQ ID NO: 236377

SEQ ID NO: 236455 - RNA, 64 nt, hsa; identical to SEQ ID NO: 236378

SEQ ID NO: 236456 - RNA, 64 nt, hsa; identical to SEQ ID NO: 236379

SEQ ID NO: 236457 - RNA, 64 nt, hsa; identical to SEQ ID NO: 236380

SEQ ID NO: 236458 - RNA, 64 nt, hsa; identical to SEQ ID NO: 236381

SEQ ID NO: 236459 - RNA, 64 nt, hsa; identical to SEQ ID NO: 74555

SEQ ID NO: 236460 - RNA, 64 nt, hsa; identical to SEQ ID NO: 74556

SEQ ID NO: 236461 - RNA, 64 nt, hsa; identical to SEQ ID NO: 74557

SEQ ID NO: 236462 - RNA, 64 nt, hsa; identical to SEQ ID NO: 74558

SEQ ID NO: 236463 - RNA, 64 nt, hsa; identical to SEQ ID NO: 74559

SEQ ID NO: 236464 - RNA, 64 nt, hsa; identical to SEQ ID NO: 74560

SEQ ID NO: 236465 - RNA, 64 nt, hsa; identical to SEQ ID NO: 236311

SEQ ID NO: 236466 - RNA, 64 nt, hsa; identical to SEQ ID NO: 236312

SEQ ID NO: 236467 - RNA, 64 nt, hsa; identical to SEQ ID NO: 236313

SEQ ID NO: 236468 - RNA, 64 nt, hsa; identical to SEQ ID NO: 236314

SEQ ID NO: 236469 - RNA, 64 nt, hsa; identical to SEQ ID NO: 236315

SEQ ID NO: 236470 - RNA, 64 nt, hsa; identical to SEQ ID NO: 236316

SEQ ID NO: 236471 - RNA, 64 nt, hsa; identical to SEQ ID NO: 236317

SEQ ID NO: 236472 - RNA, 64 nt, hsa; identical to SEQ ID NO: 236318

SEQ ID NO: 236473 - RNA, 64 nt, hsa; identical to SEQ ID NO: 236319

SEQ ID NO: 236474 - RNA, 64 nt, hsa; identical to SEQ ID NO: 236320

SEQ ID NO: 236475 - RNA, 64 nt, hsa; identical to SEQ ID NO: 236321

SEQ ID NO: 236476 - RNA, 64 nt, hsa; identical to SEQ ID NO: 236322

SEQ ID NO: 236477 - RNA, 64 nt, hsa; identical to SEQ ID NO: 236323

SEQ ID NO: 236478 - RNA, 64 nt, hsa; identical to SEQ ID NO: 236324

SEQ ID NO: 236479 - RNA, 64 nt, hsa; identical to SEQ ID NO: 236325

SEQ ID NO: 236480 - RNA, 64 nt, hsa; identical to SEQ ID NO: 236326

SEQ ID NO: 236481 - RNA, 64 nt, hsa; identical to SEQ ID NO: 236327

SEQ ID NO: 236482 - RNA, 64 nt, hsa; identical to SEQ ID NO: 236328

SEQ ID NO: 236483 - RNA, 64 nt, hsa; identical to SEQ ID NO: 236329

SEQ ID NO: 236484 - RNA, 64 nt, hsa; identical to SEQ ID NO: 236330

SEQ ID NO: 236485 - RNA, 64 nt, hsa; identical to SEQ ID NO: 236331

SEQ ID NO: 236486 - RNA, 64 nt, hsa; identical to SEQ ID NO: 236332

SEQ ID NO: 236487 - RNA, 64 nt, hsa; identical to SEQ ID NO: 236333

SEQ ID NO: 236488 - RNA, 64 nt, hsa; identical to SEQ ID NO: 236334

SEQ ID NO: 236489 - RNA, 64 nt, hsa; identical to SEQ ID NO: 236335

SEQ ID NO: 236490 - RNA, 64 nt, hsa; identical to SEQ ID NO: 236336

SEQ ID NO: 236491 - RNA, 64 nt, hsa; identical to SEQ ID NO: 236337

SEQ ID NO: 236492 - RNA, 64 nt, hsa; identical to SEQ ID NO: 236338

SEQ ID NO: 236493 - RNA, 64 nt, hsa; identical to SEQ ID NO: 236339

SEQ ID NO: 236494 - RNA, 64 nt, hsa; identical to SEQ ID NO: 236340

SEQ ID NO: 236495 - RNA, 64 nt, hsa; identical to SEQ ID NO: 236341
